United States Patent 11,640,849 (METHODS FOR HISTOLOGICAL DIAGNOSIS AND TREATMENT OF DISEASES) - sequence listing, part 31

SEQ ID NO: 1213219 - protein, 10 aa, Mycobacterium
LNDDTPGKGV

SEQ ID NO: 1213220 - protein, 8 aa, Mycobacterium
LNDEEEYR

SEQ ID NO: 1213221 - protein, 5 aa, Mycobacterium
LNDGA

SEQ ID NO: 1213222 - protein, 9 aa, Mycobacterium
LNDGANATL

SEQ ID NO: 1213223 - protein, 12 aa, Mycobacterium
LNDGSTLDPLSG

SEQ ID NO: 1213224 - protein, 14 aa, Mycobacterium
LNDPAGASGARAGQ

SEQ ID NO: 1213225 - protein, 8 aa, Mycobacterium
LNEEQARE

SEQ ID NO: 1213226 - protein, 5 aa, Mycobacterium
LNEPD

SEQ ID NO: 1213227 - protein, 10 aa, Mycobacterium
LNERTGQSQP

SEQ ID NO: 1213228 - protein, 11 aa, Mycobacterium
LNGDPTQAGAA

SEQ ID NO: 1213229 - protein, 6 aa, Mycobacterium
LNGEGI

SEQ ID NO: 1213230 - protein, 9 aa, Mycobacterium
LNGEPLDDG

SEQ ID NO: 1213231 - protein, 9 aa, Mycobacterium
LNGRQPAAG

SEQ ID NO: 1213232 - protein, 17 aa, Mycobacterium
LNGTAASALVRAGRASW

SEQ ID NO: 1213233 - protein, 11 aa, Mycobacterium
LNGTRTPHTVP

SEQ ID NO: 1213234 - protein, 8 aa, Mycobacterium
LNKNADTR

SEQ ID NO: 1213235 - protein, 15 aa, Mycobacterium
LNNEPSVLDDPRRPD

SEQ ID NO: 1213236 - protein, 6 aa, Mycobacterium
LNNPRR

SEQ ID NO: 1213237 - protein, 24 aa, Mycobacterium
LNPAGKVDKKAIRKPYWQSNSRQI

SEQ ID NO: 1213238 - protein, 4 aa, Mycobacterium
LNPD

SEQ ID NO: 1213239 - protein, 13 aa, Mycobacterium
LNPDASIKVENSG

SEQ ID NO: 1213240 - protein, 5 aa, Mycobacterium
LNPDT

SEQ ID NO: 1213241 - protein, 5 aa, Mycobacterium
LNPDV

SEQ ID NO: 1213242 - protein, 10 aa, Mycobacterium
LNPEKQPNSY

SEQ ID NO: 1213243 - protein, 4 aa, Mycobacterium
LNPG

SEQ ID NO: 1213244 - protein, 8 aa, Mycobacterium
LNPGDEKF

SEQ ID NO: 1213245 - protein, 6 aa, Mycobacterium
LNPGSV

SEQ ID NO: 1213246 - protein, 9 aa, Mycobacterium
LNPKPGDEF

SEQ ID NO: 1213247 - protein, 12 aa, Mycobacterium
LNPPPDSAELSS

SEQ ID NO: 1213248 - protein, 7 aa, Mycobacterium
LNPQPVR

SEQ ID NO: 1213249 - protein, 7 aa, Mycobacterium
LNPRLGR

SEQ ID NO: 1213250 - protein, 22 aa, Mycobacterium
LNPRPNGPSGHARITMAPRVRE

SEQ ID NO: 1213251 - protein, 7 aa, Mycobacterium
LNPSETK

SEQ ID NO: 1213252 - protein, 8 aa, Mycobacterium
LNPSTGAV

SEQ ID NO: 1213253 - protein, 7 aa, Mycobacterium
LNQQKED

SEQ ID NO: 1213254 - protein, 7 aa, Mycobacterium
LNRDQAT

SEQ ID NO: 1213255 - protein, 13 aa, Mycobacterium
LNRNRRGGQHPLG

SEQ ID NO: 1213256 - protein, 4 aa, Mycobacterium
LNRP

SEQ ID NO: 1213257 - protein, 16 aa, Mycobacterium
LNRPNMPDFPGRDTFS

SEQ ID NO: 1213258 - protein, 19 aa, Mycobacterium
LNRQPDPGHGDGADTAGQR

SEQ ID NO: 1213259 - protein, 7 aa, Mycobacterium
LNRRDGR

SEQ ID NO: 1213260 - protein, 13 aa, Mycobacterium
LNRTTASPVDPPS

SEQ ID NO: 1213261 - protein, 4 aa, Mycobacterium
LNSG

SEQ ID NO: 1213262 - protein, 4 aa, Mycobacterium
LNSR

SEQ ID NO: 1213263 - protein, 19 aa, Mycobacterium
LNSRAQNYTPPEQTPGSAR

SEQ ID NO: 1213264 - protein, 8 aa, Mycobacterium
LNSRGAKT

SEQ ID NO: 1213265 - protein, 7 aa, Mycobacterium
LNTQDMS

SEQ ID NO: 1213266 - protein, 18 aa, Mycobacterium
LNTRDTIARGREAIDAGA

SEQ ID NO: 1213267 - protein, 9 aa, Mycobacterium
LNTSPAPMR

SEQ ID NO: 1213268 - protein, 7 aa, Mycobacterium
LPAADEA

SEQ ID NO: 1213269 - protein, 10 aa, Mycobacterium
LPAAERPEPL

SEQ ID NO: 1213270 - protein, 5 aa, Mycobacterium
LPAAP

SEQ ID NO: 1213271 - protein, 6 aa, Mycobacterium
LPAATE

SEQ ID NO: 1213272 - protein, 8 aa, Mycobacterium
LPADELPS

SEQ ID NO: 1213273 - protein, 12 aa, Mycobacterium
LPADGTADGSRL

SEQ ID NO: 1213274 - protein, 7 aa, Mycobacterium
LPADQER

SEQ ID NO: 1213275 - protein, 14 aa, Mycobacterium
LPADTANLREGANL

SEQ ID NO: 1213276 - protein, 8 aa, Mycobacterium
LPADTPGQ

SEQ ID NO: 1213277 - protein, 16 aa, Mycobacterium
LPADTPVTEALGGAPA

SEQ ID NO: 1213278 - protein, 5 aa, Mycobacterium
LPAEA

SEQ ID NO: 1213279 - protein, 6 aa, Mycobacterium
LPAEDT

SEQ ID NO: 1213280 - protein, 5 aa, Mycobacterium
LPAEG

SEQ ID NO: 1213281 - protein, 6 aa, Mycobacterium
LPAEPL

SEQ ID NO: 1213282 - protein, 12 aa, Mycobacterium
LPAERTTTAAWR

SEQ ID NO: 1213283 - protein, 14 aa, Mycobacterium
LPAGAAAGGSLADS

SEQ ID NO: 1213284 - protein, 11 aa, Mycobacterium
LPAGAGSLGRA

SEQ ID NO: 1213285 - protein, 18 aa, Mycobacterium
LPAGGGVESPAAESNTGD

SEQ ID NO: 1213286 - protein, 24 aa, Mycobacterium
LPAGKKNPPPTGYTGHQASHPTRA

SEQ ID NO: 1213287 - protein, 6 aa, Mycobacterium
LPAGQR

SEQ ID NO: 1213288 - protein, 5 aa, Mycobacterium
LPAGS

SEQ ID NO: 1213289 - protein, 10 aa, Mycobacterium
LPAGSDGAVR

SEQ ID NO: 1213290 - protein, 7 aa, Mycobacterium
LPAGSTE

SEQ ID NO: 1213291 - protein, 6 aa, Mycobacterium
LPAGTD

SEQ ID NO: 1213292 - protein, 14 aa, Mycobacterium
LPAGTDAASQAEVD

SEQ ID NO: 1213293 - protein, 16 aa, Mycobacterium
LPAGVGDGSASGFPGD

SEQ ID NO: 1213294 - protein, 6 aa, Mycobacterium
LPAKAR

SEQ ID NO: 1213295 - protein, 7 aa, Mycobacterium
LPALGSR

SEQ ID NO: 1213296 - protein, 5 aa, Mycobacterium
LPAPA

SEQ ID NO: 1213297 - protein, 13 aa, Mycobacterium
LPAPAERVRTPGA

SEQ ID NO: 1213298 - protein, 8 aa, Mycobacterium
LPAPDGSA

SEQ ID NO: 1213299 - protein, 10 aa, Mycobacterium
LPAPDGVATT

SEQ ID NO: 1213300 - protein, 8 aa, Mycobacterium
LPAPGVSP

SEQ ID NO: 1213301 - protein, 6 aa, Mycobacterium
LPAPHG

SEQ ID NO: 1213302 - protein, 9 aa, Mycobacterium
LPAPPPADV

SEQ ID NO: 1213303 - protein, 5 aa, Mycobacterium
LPAPR

SEQ ID NO: 1213304 - protein, 8 aa, Mycobacterium
LPAPRTGD

SEQ ID NO: 1213305 - protein, 13 aa, Mycobacterium
LPAPTAALTDHDA

SEQ ID NO: 1213306 - protein, 22 aa, Mycobacterium
LPAPTTSTSVRTSTATADLDAN

SEQ ID NO: 1213307 - protein, 6 aa, Mycobacterium
LPAPTV

SEQ ID NO: 1213308 - protein, 13 aa, Mycobacterium
LPAPYRPAGDGVE

SEQ ID NO: 1213309 - protein, 24 aa, Mycobacterium
LPAQGATLATPTVPAPPAGPGAPR

SEQ ID NO: 1213310 - protein, 11 aa, Mycobacterium
LPAQTPGGEVR

SEQ ID NO: 1213311 - protein, 14 aa, Mycobacterium
LPARADDSAPLALP

SEQ ID NO: 1213312 - protein, 10 aa, Mycobacterium
LPARSGAASA

SEQ ID NO: 1213313 - protein, 20 aa, Mycobacterium
LPARYSEAVTAESLQPIGQP

SEQ ID NO: 1213314 - protein, 4 aa, Mycobacterium
LPAS

SEQ ID NO: 1213315 - protein, 7 aa, Mycobacterium
LPASGLS

SEQ ID NO: 1213316 - protein, 7 aa, Mycobacterium
LPATGGL

SEQ ID NO: 1213317 - protein, 23 aa, Mycobacterium
LPATGPDALEPTGPPGPAPSVPL

SEQ ID NO: 1213318 - protein, 8 aa, Mycobacterium
LPATGSNK

SEQ ID NO: 1213319 - protein, 6 aa, Mycobacterium
LPATPA

SEQ ID NO: 1213320 - protein, 9 aa, Mycobacterium
LPATTDPAT

SEQ ID NO: 1213321 - protein, 10 aa, Mycobacterium
LPDAAAAVET

SEQ ID NO: 1213322 - protein, 6 aa, Mycobacterium
LPDAGS

SEQ ID NO: 1213323 - protein, 6 aa, Mycobacterium
LPDDEA

SEQ ID NO: 1213324 - protein, 12 aa, Mycobacterium
LPDEDDDSSPRD

SEQ ID NO: 1213325 - protein, 7 aa, Mycobacterium
LPDGDAR

SEQ ID NO: 1213326 - protein, 8 aa, Mycobacterium
LPDGDGPY

SEQ ID NO: 1213327 - protein, 7 aa, Mycobacterium
LPDGDPK

SEQ ID NO: 1213328 - protein, 6 aa, Mycobacterium
LPDGGT

SEQ ID NO: 1213329 - protein, 7 aa, Mycobacterium
LPDGHPD

SEQ ID NO: 1213330 - protein, 6 aa, Mycobacterium
LPDGQV

SEQ ID NO: 1213331 - protein, 11 aa, Mycobacterium
LPDGRDEQPSY

SEQ ID NO: 1213332 - protein, 11 aa, Mycobacterium
LPDGSRGATLA

SEQ ID NO: 1213333 - protein, 9 aa, Mycobacterium
LPDGSSTEV

SEQ ID NO: 1213334 - protein, 15 aa, Mycobacterium
LPDGSTANARTPELA

SEQ ID NO: 1213335 - protein, 14 aa, Mycobacterium
LPDGSTATAPNAVA

SEQ ID NO: 1213336 - protein, 15 aa, Mycobacterium
LPDGSTSIKRSPGGL

SEQ ID NO: 1213337 - protein, 6 aa, Mycobacterium
LPDGTA

SEQ ID NO: 1213338 - protein, 26 aa, Mycobacterium
LPDGTPVSSGEGGGVKIGGGGAYQEQ

SEQ ID NO: 1213339 - protein, 6 aa, Mycobacterium
LPDGVD

SEQ ID NO: 1213340 - protein, 4 aa, Mycobacterium
LPDN

SEQ ID NO: 1213341 - protein, 12 aa, Mycobacterium
LPDPERRTATAQ

SEQ ID NO: 1213342 - protein, 5 aa, Mycobacterium
LPDPI

SEQ ID NO: 1213343 - protein, 7 aa, Mycobacterium
LPDPQRD

SEQ ID NO: 1213344 - protein, 13 aa, Mycobacterium
LPDPRSTAPRDPG

SEQ ID NO: 1213345 - protein, 19 aa, Mycobacterium
LPDPSALRASAHPDPSALR

SEQ ID NO: 1213346 - protein, 12 aa, Mycobacterium
LPDPTGDGANTF

SEQ ID NO: 1213347 - protein, 7 aa, Mycobacterium
LPDQGRG

SEQ ID NO: 1213348 - protein, 10 aa, Mycobacterium
LPDQPGRSTV

SEQ ID NO: 1213349 - protein, 8 aa, Mycobacterium
LPDQPGSL

SEQ ID NO: 1213350 - protein, 18 aa, Mycobacterium
LPDRPATTLTGGRLNGTK

SEQ ID NO: 1213351 - protein, 8 aa, Mycobacterium
LPDRPKVS

SEQ ID NO: 1213352 - protein, 8 aa, Mycobacterium
LPDRTEAT

SEQ ID NO: 1213353 - protein, 31 aa, Mycobacterium
LPDSDAAAGETPATETSPIDHNHPDREADSP

SEQ ID NO: 1213354 - protein, 10 aa, Mycobacterium
LPDSPPSMPG

SEQ ID NO: 1213355 - protein, 5 aa, Mycobacterium
LPDST

SEQ ID NO: 1213356 - protein, 9 aa, Mycobacterium
LPDSWDSPV

SEQ ID NO: 1213357 - protein, 9 aa, Mycobacterium
LPDTAPVNS

SEQ ID NO: 1213358 - protein, 7 aa, Mycobacterium
LPDTTGG

SEQ ID NO: 1213359 - protein, 11 aa, Mycobacterium
LPDYTSADNYL

SEQ ID NO: 1213360 - protein, 8 aa, Mycobacterium
LPEAGAGS

SEQ ID NO: 1213361 - protein, 13 aa, Mycobacterium
LPEAGGTSPQDSV

SEQ ID NO: 1213362 - protein, 11 aa, Mycobacterium
LPEANVRGPVR

SEQ ID NO: 1213363 - protein, 28 aa, Mycobacterium
LPEAPPPEGDGEAPPPEGGAESERTRNQ

SEQ ID NO: 1213364 - protein, 20 aa, Mycobacterium
LPEASSDERDDRAFEDEAQH

SEQ ID NO: 1213365 - protein, 23 aa, Mycobacterium
LPEDDDHPYRTGPWRPQTTEWDD

SEQ ID NO: 1213366 - protein, 8 aa, Mycobacterium
LPEDERSL

SEQ ID NO: 1213367 - protein, 5 aa, Mycobacterium
LPEDH

SEQ ID NO: 1213368 - protein, 14 aa, Mycobacterium
LPEDPDAKPRPLGK

SEQ ID NO: 1213369 - protein, 5 aa, Mycobacterium
LPEDQ

SEQ ID NO: 1213370 - protein, 5 aa, Mycobacterium
LPEDT

SEQ ID NO: 1213371 - protein, 8 aa, Mycobacterium
LPEEAKAM

SEQ ID NO: 1213372 - protein, 26 aa, Mycobacterium
LPEEAQASLGKQVPHPARLGDPDEYG

SEQ ID NO: 1213373 - protein, 12 aa, Mycobacterium
LPEENGGIGGGP

SEQ ID NO: 1213374 - protein, 5 aa, Mycobacterium
LPEGE

SEQ ID NO: 1213375 - protein, 6 aa, Mycobacterium
LPEGGR

SEQ ID NO: 1213376 - protein, 24 aa, Mycobacterium
LPEGSYADEDDLTDDRPRKLRPGD

SEQ ID NO: 1213377 - protein, 6 aa, Mycobacterium
LPEGTE

SEQ ID NO: 1213378 - protein, 9 aa, Mycobacterium
LPEGTPADQ

SEQ ID NO: 1213379 - protein, 5 aa, Mycobacterium
LPEGW

SEQ ID NO: 1213380 - protein, 21 aa, Mycobacterium
LPEHDARARMKAQASDEQRRA

SEQ ID NO: 1213381 - protein, 4 aa, Mycobacterium
LPEK

SEQ ID NO: 1213382 - protein, 8 aa, Mycobacterium
LPEPAAGT

SEQ ID NO: 1213383 - protein, 7 aa, Mycobacterium
LPEPDAG

SEQ ID NO: 1213384 - protein, 7 aa, Mycobacterium
LPEPEPL

SEQ ID NO: 1213385 - protein, 13 aa, Mycobacterium
LPEPGEPAKKAFG

SEQ ID NO: 1213386 - protein, 14 aa, Mycobacterium
LPEPGMRSEYTPDR

SEQ ID NO: 1213387 - protein, 9 aa, Mycobacterium
LPEPGPGET

SEQ ID NO: 1213388 - protein, 7 aa, Mycobacterium
LPEPHRD

SEQ ID NO: 1213389 - protein, 49 aa, Mycobacterium; identical to SEQ ID NO: 1102738

SEQ ID NO: 1213390 - protein, 7 aa, Mycobacterium
LPEPRPA

SEQ ID NO: 1213391 - protein, 11 aa, Mycobacterium
LPEPSSAAQVR

SEQ ID NO: 1213392 - protein, 13 aa, Mycobacterium
LPERAAGLDGDHV

SEQ ID NO: 1213393 - protein, 31 aa, Mycobacterium
LPERSAGDLDGVPTERSTAAAATPAAHANGV

SEQ ID NO: 1213394 - protein, 11 aa, Mycobacterium
LPESSKAGQRL

SEQ ID NO: 1213395 - protein, 8 aa, Mycobacterium
LPESTARK

SEQ ID NO: 1213396 - protein, 9 aa, Mycobacterium
LPETGDDHR

SEQ ID NO: 1213397 - protein, 14 aa, Mycobacterium
LPETPAESEDMPPD

SEQ ID NO: 1213398 - protein, 4 aa, Mycobacterium
LPEV

SEQ ID NO: 1213399 - protein, 11 aa, Mycobacterium
LPEVDAGSKAV

SEQ ID NO: 1213400 - protein, 6 aa, Mycobacterium
LPEYRN

SEQ ID NO: 1213401 - protein, 12 aa, Mycobacterium
LPGAARAAAQAT

SEQ ID NO: 1213402 - protein, 15 aa, Mycobacterium
LPGAEPEKGYRPSAG

SEQ ID NO: 1213403 - protein, 9 aa, Mycobacterium
LPGAGCTED

SEQ ID NO: 1213404 - protein, 9 aa, Mycobacterium
LPGAGCTEE

SEQ ID NO: 1213405 - protein, 9 aa, Mycobacterium
LPGARERLA

SEQ ID NO: 1213406 - protein, 4 aa, Mycobacterium
LPGD

SEQ ID NO: 1213407 - protein, 7 aa, Mycobacterium
LPGDGPL

SEQ ID NO: 1213408 - protein, 12 aa, Mycobacterium
LPGDPGYDSAGG

SEQ ID NO: 1213409 - protein, 14 aa, Mycobacterium
LPGDTKADNARAKR

SEQ ID NO: 1213410 - protein, 5 aa, Mycobacterium
LPGEA

SEQ ID NO: 1213411 - protein, 7 aa, Mycobacterium
LPGETAL

SEQ ID NO: 1213412 - protein, 7 aa, Mycobacterium
LPGGDPT

SEQ ID NO: 1213413 - protein, 6 aa, Mycobacterium
LPGGEF

SEQ ID NO: 1213414 - protein, 6 aa, Mycobacterium
LPGGGD

SEQ ID NO: 1213415 - protein, 7 aa, Mycobacterium
LPGGGFG

SEQ ID NO: 1213416 - protein, 17 aa, Mycobacterium
LPGGVDRVTSAREAATT

SEQ ID NO: 1213417 - protein, 4 aa, Mycobacterium
LPGI

SEQ ID NO: 1213418 - protein, 9 aa, Mycobacterium
LPGKDGKRS

SEQ ID NO: 1213419 - protein, 12 aa, Mycobacterium
LPGKNAKLPATH

SEQ ID NO: 1213420 - protein, 15 aa, Mycobacterium
LPGKNAKLPATYAEA

SEQ ID NO: 1213421 - protein, 9 aa, Mycobacterium
LPGKPAPDA

SEQ ID NO: 1213422 - protein, 4 aa, Mycobacterium
LPGL

SEQ ID NO: 1213423 - protein, 7 aa, Mycobacterium
LPGLSDR

SEQ ID NO: 1213424 - protein, 4 aa, Mycobacterium
LPGM

SEQ ID NO: 1213425 - protein, 8 aa, Mycobacterium
LPGMPPPP

SEQ ID NO: 1213426 - protein, 6 aa, Mycobacterium
LPGNGS

SEQ ID NO: 1213427 - protein, 6 aa, Mycobacterium
LPGNRL

SEQ ID NO: 1213428 - protein, 31 aa, Mycobacterium
LPGPEHGQRDLGGADPESLPRTGPAGPAPSM

SEQ ID NO: 1213429 - protein, 6 aa, Mycobacterium
LPGPFT

SEQ ID NO: 1213430 - protein, 9 aa, Mycobacterium
LPGPHYETP

SEQ ID NO: 1213431 - protein, 5 aa, Mycobacterium
LPGPL

SEQ ID NO: 1213432 - protein, 13 aa, Mycobacterium
LPGPLSKTTSVQK

SEQ ID NO: 1213433 - protein, 11 aa, Mycobacterium
LPGPNGAVKAA

SEQ ID NO: 1213434 - protein, 20 aa, Mycobacterium
LPGPPPVPESPLADPAHPPR

SEQ ID NO: 1213435 - protein, 6 aa, Mycobacterium
LPGPRL

SEQ ID NO: 1213436 - protein, 5 aa, Mycobacterium
LPGQM

SEQ ID NO: 1213437 - protein, 6 aa, Mycobacterium
LPGQNG

SEQ ID NO: 1213438 - protein, 5 aa, Mycobacterium
LPGQR

SEQ ID NO: 1213439 - protein, 5 aa, Mycobacterium
LPGRG

SEQ ID NO: 1213440 - protein, 12 aa, Mycobacterium
LPGRGITAGENR

SEQ ID NO: 1213441 - protein, 8 aa, Mycobacterium
LPGRGPAV

SEQ ID NO: 1213442 - protein, 9 aa, Mycobacterium
LPGRGQTMS

SEQ ID NO: 1213443 - protein, 6 aa, Mycobacterium
LPGRPA

SEQ ID NO: 1213444 - protein, 12 aa, Mycobacterium
LPGRSPERHGAG

SEQ ID NO: 1213445 - protein, 4 aa, Mycobacterium
LPGS

SEQ ID NO: 1213446 - protein, 5 aa, Mycobacterium
LPGSD

SEQ ID NO: 1213447 - protein, 11 aa, Mycobacterium
LPGSESEKMGP

SEQ ID NO: 1213448 - protein, 11 aa, Mycobacterium
LPGSSPRPYGG

SEQ ID NO: 1213449 - protein, 22 aa, Mycobacterium
LPGSSQLERDDYRRDPHPSGAQ

SEQ ID NO: 1213450 - protein, 8 aa, Mycobacterium
LPGSVDGA

SEQ ID NO: 1213451 - protein, 10 aa, Mycobacterium
LPGTAPADTY

SEQ ID NO: 1213452 - protein, 16 aa, Mycobacterium
LPGTARDYDPESNESL

SEQ ID NO: 1213453 - protein, 7 aa, Mycobacterium
LPGTDGL

SEQ ID NO: 1213454 - protein, 6 aa, Mycobacterium
LPGTDR

SEQ ID NO: 1213455 - protein, 5 aa, Mycobacterium
LPGTL

SEQ ID NO: 1213456 - protein, 7 aa, Mycobacterium
LPGTPDG

SEQ ID NO: 1213457 - protein, 9 aa, Mycobacterium
LPGTSAVPT

SEQ ID NO: 1213458 - protein, 4 aa, Mycobacterium
LPGV

SEQ ID NO: 1213459 - protein, 11 aa, Mycobacterium
LPHGPGRGTGE

SEQ ID NO: 1213460 - protein, 7 aa, Mycobacterium
LPHGQPG

SEQ ID NO: 1213461 - protein, 5 aa, Mycobacterium
LPHPA

SEQ ID NO: 1213462 - protein, 7 aa, Mycobacterium
LPHPSRN

SEQ ID NO: 1213463 - protein, 16 aa, Mycobacterium
LPHSSQALARGGQPVS

SEQ ID NO: 1213464 - protein, 23 aa, Mycobacterium
LPHSSQALARGGQPVSTDQMQPG

SEQ ID NO: 1213465 - protein, 7 aa, Mycobacterium
LPHTRSG

SEQ ID NO: 1213466 - protein, 14 aa, Mycobacterium
LPIAPATPRELAVA

SEQ ID NO: 1213467 - protein, 8 aa, Mycobacterium
LPINPSGG

SEQ ID NO: 1213468 - protein, 5 aa, Mycobacterium
LPKGA

SEQ ID NO: 1213469 - protein, 9 aa, Mycobacterium
LPKNATRDD

SEQ ID NO: 1213470 - protein, 6 aa, Mycobacterium
LPKPAD

SEQ ID NO: 1213471 - protein, 5 aa, Mycobacterium
LPKPP

SEQ ID NO: 1213472 - protein, 12 aa, Mycobacterium
LPKPPTSASRRV

SEQ ID NO: 1213473 - protein, 6 aa, Mycobacterium
LPKPTV

SEQ ID NO: 1213474 - protein, 6 aa, Mycobacterium
LPKRRV

SEQ ID NO: 1213475 - protein, 8 aa, Mycobacterium
LPKTRSGK

SEQ ID NO: 1213476 - protein, 13 aa, Mycobacterium
LPLPDGADEDDVN

SEQ ID NO: 1213477 - protein, 6 aa, Mycobacterium
LPLPTG

SEQ ID NO: 1213478 - protein, 4 aa, Mycobacterium
LPLQ

SEQ ID NO: 1213479 - protein, 18 aa, Mycobacterium
LPNAEGAWAQQAEARLGD

SEQ ID NO: 1213480 - protein, 5 aa, Mycobacterium
LPNDP

SEQ ID NO: 1213481 - protein, 10 aa, Mycobacterium
LPNPDDPSHL

SEQ ID NO: 1213482 - protein, 5 aa, Mycobacterium
LPNSG

SEQ ID NO: 1213483 - protein, 7 aa, Mycobacterium
LPPAARE

SEQ ID NO: 1213484 - protein, 16 aa, Mycobacterium
LPPADSDLAQQSTRDP

SEQ ID NO: 1213485 - protein, 7 aa, Mycobacterium
LPPAEDP

SEQ ID NO: 1213486 - protein, 6 aa, Mycobacterium
LPPAGR

SEQ ID NO: 1213487 - protein, 24 aa, Mycobacterium
LPPAPAPAPAPAAVAAPAPDPLAP

SEQ ID NO: 1213488 - protein, 21 aa, Mycobacterium
LPPAPAVPAPAAAPPANDPGV

SEQ ID NO: 1213489 - protein, 25 aa, Mycobacterium
LPPAPEPPSDDDVARRAGEVSGATL

SEQ ID NO: 1213490 - protein, 22 aa, Mycobacterium
LPPAPPPGAPREPGPTPGSEPF

SEQ ID NO: 1213491 - protein, 5 aa, Mycobacterium
LPPAS

SEQ ID NO: 1213492 - protein, 8 aa, Mycobacterium
LPPATTRP

SEQ ID NO: 1213493 - protein, 26 aa, Mycobacterium
LPPDAQRSRAQRELAQARAAARALER

SEQ ID NO: 1213494 - protein, 7 aa, Mycobacterium
LPPDQKA

SEQ ID NO: 1213495 - protein, 8 aa, Mycobacterium
LPPDRERD

SEQ ID NO: 1213496 - protein, 5 aa, Mycobacterium
LPPDS

SEQ ID NO: 1213497 - protein, 6 aa, Mycobacterium
LPPDTQ

SEQ ID NO: 1213498 - protein, 5 aa, Mycobacterium
LPPDV

SEQ ID NO: 1213499 - protein, 7 aa, Mycobacterium
LPPEGAS

SEQ ID NO: 1213500 - protein, 6 aa, Mycobacterium
LPPEGE

SEQ ID NO: 1213501 - protein, 12 aa, Mycobacterium
LPPEGRFGSAEA

SEQ ID NO: 1213502 - protein, 7 aa, Mycobacterium
LPPEHPD

SEQ ID NO: 1213503 - protein, 15 aa, Mycobacterium
LPPEKAWESASDLSR

SEQ ID NO: 1213504 - protein, 7 aa, Mycobacterium
LPPEQAT

SEQ ID NO: 1213505 - protein, 6 aa, Mycobacterium
LPPEQP

SEQ ID NO: 1213506 - protein, 6 aa, Mycobacterium
LPPERS

SEQ ID NO: 1213507 - protein, 5 aa, Mycobacterium
LPPES

SEQ ID NO: 1213508 - protein, 21 aa, Mycobacterium
LPPEVPEDPRRSGATPPALPI

SEQ ID NO: 1213509 - protein, 6 aa, Mycobacterium
LPPGGR

SEQ ID NO: 1213510 - protein, 8 aa, Mycobacterium
LPPGPAFY

SEQ ID NO: 1213511 - protein, 21 aa, Mycobacterium
LPPGPLGPPPSVPAAIPPAAG

SEQ ID NO: 1213512 - protein, 10 aa, Mycobacterium
LPPGPRLPPS

SEQ ID NO: 1213513 - protein, 5 aa, Mycobacterium
LPPGS

SEQ ID NO: 1213514 - protein, 7 aa, Mycobacterium
LPPGSEV

SEQ ID NO: 1213515 - protein, 5 aa, Mycobacterium
LPPHS

SEQ ID NO: 1213516 - protein, 8 aa, Mycobacterium
LPPIEDPD

SEQ ID NO: 1213517 - protein, 12 aa, Mycobacterium
LPPITGEGLYAK

SEQ ID NO: 1213518 - protein, 4 aa, Mycobacterium
LPPK

SEQ ID NO: 1213519 - protein, 7 aa, Mycobacterium
LPPLPDE

SEQ ID NO: 1213520 - protein, 6 aa, Mycobacterium
LPPLPE

SEQ ID NO: 1213521 - protein, 8 aa, Mycobacterium
LPPLPSPP

SEQ ID NO: 1213522 - protein, 6 aa, Mycobacterium
LPPNEQ

SEQ ID NO: 1213523 - protein, 7 aa, Mycobacterium
LPPPDEQ

SEQ ID NO: 1213524 - protein, 5 aa, Mycobacterium
LPPPE

SEQ ID NO: 1213525 - protein, 8 aa, Mycobacterium
LPPPEDRS

SEQ ID NO: 1213526 - protein, 11 aa, Mycobacterium
LPPPGADSTPV

SEQ ID NO: 1213527 - protein, 17 aa, Mycobacterium
LPPPGTPVTAPVDPSRL

SEQ ID NO: 1213528 - protein, 43 aa, Mycobacterium
LPPPPPGAPLPPPPPGAPLPPPPPGAPLPPPPPGAPLPPPPMA

SEQ ID NO: 1213529 - protein, 5 aa, Mycobacterium
LPPPS

SEQ ID NO: 1213530 - protein, 13 aa, Mycobacterium
LPPPTHSKTPTVD

SEQ ID NO: 1213531 - protein, 54 aa, Mycobacterium
LPPPVAPPPAQPLSSTTGASSVPVSAGPAPVSAAGGPAHVASPTPAAGAPAGHM

SEQ ID NO: 1213532 - protein, 17 aa, Mycobacterium
LPPPVPPAPGYGDDLPP

SEQ ID NO: 1213533 - protein, 6 aa, Mycobacterium
LPPQHR

SEQ ID NO: 1213534 - protein, 11 aa, Mycobacterium
LPPQPGAPEED

SEQ ID NO: 1213535 - protein, 5 aa, Mycobacterium
LPPQT

SEQ ID NO: 1213536 - protein, 11 aa, Mycobacterium
LPPRPGQPESW

SEQ ID NO: 1213537 - protein, 5 aa, Mycobacterium
LPPRQ

SEQ ID NO: 1213538 - protein, 7 aa, Mycobacterium
LPPRRAR

SEQ ID NO: 1213539 - protein, 4 aa, Mycobacterium
LPPS

SEQ ID NO: 1213540 - protein, 16 aa, Mycobacterium
LPPSDGPVVGTPPYDI

SEQ ID NO: 1213541 - protein, 5 aa, Mycobacterium
LPPSG

SEQ ID NO: 1213542 - protein, 11 aa, Mycobacterium
LPPSGTFTPAD

SEQ ID NO: 1213543 - protein, 5 aa, Mycobacterium
LPPSI

SEQ ID NO: 1213544 - protein, 6 aa, Mycobacterium
LPPSQA

SEQ ID NO: 1213545 - protein, 13 aa, Mycobacterium
LPPSRSNPRDAGN

SEQ ID NO: 1213546 - protein, 4 aa, Mycobacterium
LPPT

SEQ ID NO: 1213547 - protein, 7 aa, Mycobacterium
LPPTDAR

SEQ ID NO: 1213548 - protein, 7 aa, Mycobacterium
LPPTPRI

SEQ ID NO: 1213549 - protein, 5 aa, Mycobacterium
LPPVD

SEQ ID NO: 1213550 - protein, 13 aa, Mycobacterium
LPPVPRPKVPTTQ

SEQ ID NO: 1213551 - protein, 7 aa, Mycobacterium
LPPVSGE

SEQ ID NO: 1213552 - protein, 18 aa, Mycobacterium
LPPVSGLPEARRTAPGDA

SEQ ID NO: 1213553 - protein, 5 aa, Mycobacterium
LPPYR

SEQ ID NO: 1213554 - protein, 6 aa, Mycobacterium
LPQAIG

SEQ ID NO: 1213555 - protein, 5 aa, Mycobacterium
LPQGL

SEQ ID NO: 1213556 - protein, 5 aa, Mycobacterium
LPQPL

SEQ ID NO: 1213557 - protein, 6 aa, Mycobacterium
LPQRER

SEQ ID NO: 1213558 - protein, 5 aa, Mycobacterium
LPQRQ

SEQ ID NO: 1213559 - protein, 7 aa, Mycobacterium
LPQTPPF

SEQ ID NO: 1213560 - protein, 7 aa, Mycobacterium
LPQTPPL

SEQ ID NO: 1213561 - protein, 4 aa, Mycobacterium
LPQV

SEQ ID NO: 1213562 - protein, 4 aa, Mycobacterium
LPRD

SEQ ID NO: 1213563 - protein, 7 aa, Mycobacterium
LPRDPAE

SEQ ID NO: 1213564 - protein, 4 aa, Mycobacterium
LPRG

SEQ ID NO: 1213565 - protein, 14 aa, Mycobacterium
LPRGAAPKRAGRPT

SEQ ID NO: 1213566 - protein, 5 aa, Mycobacterium
LPRGL

SEQ ID NO: 1213567 - protein, 8 aa, Mycobacterium
LPRGSTGK

SEQ ID NO: 1213568 - protein, 6 aa, Mycobacterium
LPRKSD

SEQ ID NO: 1213569 - protein, 6 aa, Mycobacterium
LPRNPA

SEQ ID NO: 1213570 - protein, 10 aa, Mycobacterium
LPRNPQSPFA

SEQ ID NO: 1213571 - protein, 8 aa, Mycobacterium
LPRPDEVD

SEQ ID NO: 1213572 - protein, 13 aa, Mycobacterium
LPRPDHSPSPDLL

SEQ ID NO: 1213573 - protein, 7 aa, Mycobacterium
LPRPGET

SEQ ID NO: 1213574 - protein, 10 aa, Mycobacterium
LPRPTRNSLH

SEQ ID NO: 1213575 - protein, 6 aa, Mycobacterium
LPRPTT

SEQ ID NO: 1213576 - protein, 5 aa, Mycobacterium
LPRPV

SEQ ID NO: 1213577 - protein, 7 aa, Mycobacterium
LPRQPQH

SEQ ID NO: 1213578 - protein, 11 aa, Mycobacterium
LPRRDLNPNEA

SEQ ID NO: 1213579 - protein, 6 aa, Mycobacterium
LPRRGG

SEQ ID NO: 1213580 - protein, 8 aa, Mycobacterium
LPRRPDAQ

SEQ ID NO: 1213581 - protein, 9 aa, Mycobacterium
LPRSDTGKL

SEQ ID NO: 1213582 - protein, 5 aa, Mycobacterium
LPRSP

SEQ ID NO: 1213583 - protein, 9 aa, Mycobacterium
LPRSSNASI

SEQ ID NO: 1213584 - protein, 4 aa, Mycobacterium
LPRT

SEQ ID NO: 1213585 - protein, 18 aa, Mycobacterium
LPRTDTGKLYKQELVKKH

SEQ ID NO: 1213586 - protein, 6 aa, Mycobacterium
LPRTGT

SEQ ID NO: 1213587 - protein, 8 aa, Mycobacterium
LPRTPTGK

SEQ ID NO: 1213588 - protein, 12 aa, Mycobacterium
LPSAAGGGGGVV

SEQ ID NO: 1213589 - protein, 6 aa, Mycobacterium
LPSADI

SEQ ID NO: 1213590 - protein, 11 aa, Mycobacterium
LPSAGAPGDPV

SEQ ID NO: 1213591 - protein, 9 aa, Mycobacterium
LPSAGGAFT

SEQ ID NO: 1213592 - protein, 11 aa, Mycobacterium
LPSDKGTGLGK

SEQ ID NO: 1213593 - protein, 6 aa, Mycobacterium
LPSDRS

SEQ ID NO: 1213594 - protein, 11 aa, Mycobacterium
LPSGFAPAQRH

SEQ ID NO: 1213595 - protein, 14 aa, Mycobacterium
LPSGFAPSRRTRMD

SEQ ID NO: 1213596 - protein, 9 aa, Mycobacterium
LPSGGSVAG

SEQ ID NO: 1213597 - protein, 7 aa, Mycobacterium
LPSGPTA

SEQ ID NO: 1213598 - protein, 5 aa, Mycobacterium
LPSGR

SEQ ID NO: 1213599 - protein, 4 aa, Mycobacterium
LPSH

SEQ ID NO: 1213600 - protein, 4 aa, Mycobacterium
LPSI

SEQ ID NO: 1213601 - protein, 6 aa, Mycobacterium
LPSNTG

SEQ ID NO: 1213602 - protein, 7 aa, Mycobacterium
LPSPAED

SEQ ID NO: 1213603 - protein, 10 aa, Mycobacterium
LPSPEAATDA

SEQ ID NO: 1213604 - protein, 9 aa, Mycobacterium
LPSPGAYGV

SEQ ID NO: 1213605 - protein, 8 aa, Mycobacterium
LPSPGGRV

SEQ ID NO: 1213606 - protein, 7 aa, Mycobacterium
LPSPLTR

SEQ ID NO: 1213607 - protein, 6 aa, Mycobacterium
LPSPPE

SEQ ID NO: 1213608 - protein, 6 aa, Mycobacterium
LPSPPR

SEQ ID NO: 1213609 - protein, 8 aa, Mycobacterium
LPSPQRDA

SEQ ID NO: 1213610 - protein, 11 aa, Mycobacterium
LPSQQVYPAGT

SEQ ID NO: 1213611 - protein, 13 aa, Mycobacterium
LPSRAAAEYRPGQ

SEQ ID NO: 1213612 - protein, 9 aa, Mycobacterium
LPSRMTTQS

SEQ ID NO: 1213613 - protein, 7 aa, Mycobacterium
LPSRPTV

SEQ ID NO: 1213614 - protein, 8 aa, Mycobacterium
LPSSGDVT

SEQ ID NO: 1213615 - protein, 11 aa, Mycobacterium
LPSSGGAGADV

SEQ ID NO: 1213616 - protein, 11 aa, Mycobacterium
LPSSGSTVTTY

SEQ ID NO: 1213617 - protein, 12 aa, Mycobacterium
LPSSGSTVTTYD

SEQ ID NO: 1213618 - protein, 5 aa, Mycobacterium
LPSSP

SEQ ID NO: 1213619 - protein, 14 aa, Mycobacterium
LPSSPAAHQVRPVR

SEQ ID NO: 1213620 - protein, 5 aa, Mycobacterium
LPSSS

SEQ ID NO: 1213621 - protein, 9 aa, Mycobacterium
LPSSVSEPH

SEQ ID NO: 1213622 - protein, 4 aa, Mycobacterium
LPST

SEQ ID NO: 1213623 - protein, 11 aa, Mycobacterium
LPSTATAQREQ

SEQ ID NO: 1213624 - protein, 8 aa, Mycobacterium
LPSTATNK

SEQ ID NO: 1213625 - protein, 9 aa, Mycobacterium
LPSTSPAHT

SEQ ID NO: 1213626 - protein, 4 aa, Mycobacterium
LPSV

SEQ ID NO: 1213627 - protein, 12 aa, Mycobacterium
LPSVGSAAPGFT

SEQ ID NO: 1213628 - protein, 4 aa, Mycobacterium
LPTA

SEQ ID NO: 1213629 - protein, 10 aa, Mycobacterium
LPTAAGDAYP

SEQ ID NO: 1213630 - protein, 8 aa, Mycobacterium
LPTAERKD

SEQ ID NO: 1213631 - protein, 6 aa, Mycobacterium
LPTAGG

SEQ ID NO: 1213632 - protein, 7 aa, Mycobacterium
LPTAPDQ

SEQ ID NO: 1213633 - protein, 8 aa, Mycobacterium
LPTAPPVD

SEQ ID NO: 1213634 - protein, 7 aa, Mycobacterium
LPTDEEL

SEQ ID NO: 1213635 - protein, 11 aa, Mycobacterium
LPTDTSSLETK

SEQ ID NO: 1213636 - protein, 5 aa, Mycobacterium
LPTEG

SEQ ID NO: 1213637 - protein, 12 aa, Mycobacterium
LPTEVTEDTPFG

SEQ ID NO: 1213638 - protein, 8 aa, Mycobacterium
LPTGGPLG

SEQ ID NO: 1213639 - protein, 11 aa, Mycobacterium
LPTGHSAPVPL

SEQ ID NO: 1213640 - protein, 6 aa, Mycobacterium
LPTGIK

SEQ ID NO: 1213641 - protein, 7 aa, Mycobacterium
LPTGQTY

SEQ ID NO: 1213642 - protein, 5 aa, Mycobacterium
LPTGT

SEQ ID NO: 1213643 - protein, 4 aa, Mycobacterium
LPTN

SEQ ID NO: 1213644 - protein, 7 aa, Mycobacterium
LPTNATG

SEQ ID NO: 1213645 - protein, 13 aa, Mycobacterium
LPTPEDPPIDPAE

SEQ ID NO: 1213646 - protein, 11 aa, Mycobacterium
LPTPEQARAAR

SEQ ID NO: 1213647 - protein, 13 aa, Mycobacterium
LPTPGEQSGAAAT

SEQ ID NO: 1213648 - protein, 9 aa, Mycobacterium
LPTPNAYRS

SEQ ID NO: 1213649 - protein, 19 aa, Mycobacterium
LPTPQVSNSVASEVAEGSR

SEQ ID NO: 1213650 - protein, 7 aa, Mycobacterium
LPTPTAN

SEQ ID NO: 1213651 - protein, 9 aa, Mycobacterium
LPTPTATRT

SEQ ID NO: 1213652 - protein, 4 aa, Mycobacterium
LPTR

SEQ ID NO: 1213653 - protein, 6 aa, Mycobacterium
LPTRHP

SEQ ID NO: 1213654 - protein, 10 aa, Mycobacterium
LPTRQPPASA

SEQ ID NO: 1213655 - protein, 11 aa, Mycobacterium
LPTRTTGAEVP

SEQ ID NO: 1213656 - protein, 8 aa, Mycobacterium
LPTSAEIP

SEQ ID NO: 1213657 - protein, 6 aa, Mycobacterium
LPTSEP

SEQ ID NO: 1213658 - protein, 6 aa, Mycobacterium
LPTTTT

SEQ ID NO: 1213659 - protein, 5 aa, Mycobacterium
LPTTV

SEQ ID NO: 1213660 - protein, 4 aa, Mycobacterium
LPVD

SEQ ID NO: 1213661 - protein, 4 aa, Mycobacterium
LPVR

SEQ ID NO: 1213662 - protein, 16 aa, Mycobacterium
LPYASTERATDPTGHE

SEQ ID NO: 1213663 - protein, 9 aa, Mycobacterium
LPYATTEAT

SEQ ID NO: 1213664 - protein, 4 aa, Mycobacterium
LPYD

SEQ ID NO: 1213665 - protein, 35 aa, Mycobacterium
LPYPPSYPKMPGEPPRVQPSKKVAANWDEDGNRVG

SEQ ID NO: 1213666 - protein, 14 aa, Mycobacterium
LPYQPGDEVDYPGS

SEQ ID NO: 1213667 - protein, 6 aa, Mycobacterium
LPYSGA

SEQ ID NO: 1213668 - protein, 5 aa, Mycobacterium
LPYTT

SEQ ID NO: 1213669 - protein, 10 aa, Mycobacterium
LQAAEDAQVR

SEQ ID NO: 1213670 - protein, 13 aa, Mycobacterium
LQAEDDRIGDVRG

SEQ ID NO: 1213671 - protein, 24 aa, Mycobacterium
LQAGESAPTVLSGPGVGLPGSTTL

SEQ ID NO: 1213672 - protein, 9 aa, Mycobacterium
LQAKTGIDQ

SEQ ID NO: 1213673 - protein, 4 aa, Mycobacterium
LQAQ

SEQ ID NO: 1213674 - protein, 7 aa, Mycobacterium
LQARQEE

SEQ ID NO: 1213675 - protein, 11 aa, Mycobacterium
LQASAGSISGA

SEQ ID NO: 1213676 - protein, 14 aa, Mycobacterium
LQASGGYRPRDRQR

SEQ ID NO: 1213677 - protein, 8 aa, Mycobacterium
LQATTLAT

SEQ ID NO: 1213678 - protein, 4 aa, Mycobacterium
LQDG

SEQ ID NO: 1213679 - protein, 4 aa, Mycobacterium
LQDH

SEQ ID NO: 1213680 - protein, 4 aa, Mycobacterium
LQDP

SEQ ID NO: 1213681 - protein, 5 aa, Mycobacterium
LQDPD

SEQ ID NO: 1213682 - protein, 5 aa, Mycobacterium
LQDPV

SEQ ID NO: 1213683 - protein, 9 aa, Mycobacterium
LQDRTPKQA

SEQ ID NO: 1213684 - protein, 4 aa, Mycobacterium
LQDS

SEQ ID NO: 1213685 - protein, 9 aa, Mycobacterium
LQDTDSGSE

SEQ ID NO: 1213686 - protein, 10 aa, Mycobacterium
LQEGADPAEL

SEQ ID NO: 1213687 - protein, 8 aa, Mycobacterium
LQEGRKQD

SEQ ID NO: 1213688 - protein, 9 aa, Mycobacterium
LQGDGPSHN

SEQ ID NO: 1213689 - protein, 8 aa, Mycobacterium
LQGGGDSA

SEQ ID NO: 1213690 - protein, 6 aa, Mycobacterium
LQGGGV

SEQ ID NO: 1213691 - protein, 19 aa, Mycobacterium
LQGHPGAGTYSAAKAAVRS

SEQ ID NO: 1213692 - protein, 9 aa, Mycobacterium
LQGKAKEMS

SEQ ID NO: 1213693 - protein, 9 aa, Mycobacterium
LQGPETDRK

SEQ ID NO: 1213694 - protein, 4 aa, Mycobacterium
LQGR

SEQ ID NO: 1213695 - protein, 11 aa, Mycobacterium
LQGRPAYRSKV

SEQ ID NO: 1213696 - protein, 6 aa, Mycobacterium
LQGRRE

SEQ ID NO: 1213697 - protein, 8 aa, Mycobacterium
LQGSEAAV

SEQ ID NO: 1213698 - protein, 6 aa, Mycobacterium
LQGTRE

SEQ ID NO: 1213699 - protein, 24 aa, Mycobacterium
LQKHTGGLRTPADRRKTVAQGAAT

SEQ ID NO: 1213700 - protein, 6 aa, Mycobacterium
LQNGFR

SEQ ID NO: 1213701 - protein, 12 aa, Mycobacterium
LQNPPVAGPLRK

SEQ ID NO: 1213702 - protein, 6 aa, Mycobacterium
LQPAEA

SEQ ID NO: 1213703 - protein, 4 aa, Mycobacterium
LQPG

SEQ ID NO: 1213704 - protein, 10 aa, Mycobacterium
LQPGAEDLST

SEQ ID NO: 1213705 - protein, 7 aa, Mycobacterium
LQPGDDE

SEQ ID NO: 1213706 - protein, 7 aa, Mycobacterium
LQPGDQE

SEQ ID NO: 1213707 - protein, 8 aa, Mycobacterium
LQPGQEED

SEQ ID NO: 1213708 - protein, 15 aa, Mycobacterium
LQPGSARVAATARDQ

SEQ ID NO: 1213709 - protein, 14 aa, Mycobacterium
LQPNHPTDDPRGIA

SEQ ID NO: 1213710 - protein, 7 aa, Mycobacterium
LQPPERL

SEQ ID NO: 1213711 - protein, 15 aa, Mycobacterium
LQPPNQPAAQRVPDN

SEQ ID NO: 1213712 - protein, 19 aa, Mycobacterium
LQPPRRQQLPEARRRETLA

SEQ ID NO: 1213713 - protein, 6 aa, Mycobacterium
LQPQQA

SEQ ID NO: 1213714 - protein, 5 aa, Mycobacterium
LQPRD

SEQ ID NO: 1213715 - protein, 35 aa, Mycobacterium
LQPRQVAPAGAGAPPPAPPPAPPASPGQGTALPPG

SEQ ID NO: 1213716 - protein, 5 aa, Mycobacterium
LQPRT

SEQ ID NO: 1213717 - protein, 10 aa, Mycobacterium
LQPSSQDAIA

SEQ ID NO: 1213718 - protein, 5 aa, Mycobacterium
LQPTP

SEQ ID NO: 1213719 - protein, 6 aa, Mycobacterium
LQQEGK

SEQ ID NO: 1213720 - protein, 46 aa, Mycobacterium
LQQHSPSYIPGAPGPEKPTFEEPTAPREPLPPKPDQGGPDLRTATG

SEQ ID NO: 1213721 - protein, 11 aa, Mycobacterium
LQRSSRDMSNV

SEQ ID NO: 1213722 - protein, 4 aa, Mycobacterium
LQRT

SEQ ID NO: 1213723 - protein, 6 aa, Mycobacterium
LQSAQP

SEQ ID NO: 1213724 - protein, 11 aa, Mycobacterium
LQSDDRAEHER

SEQ ID NO: 1213725 - protein, 7 aa, Mycobacterium
LQSDIGA

SEQ ID NO: 1213726 - protein, 20 aa, Mycobacterium
LQSDPEPVLGPGRKMLGFIK

SEQ ID NO: 1213727 - protein, 6 aa, Mycobacterium
LQSEPA

SEQ ID NO: 1213728 - protein, 10 aa, Mycobacterium
LQSGPDITNP

SEQ ID NO: 1213729 - protein, 7 aa, Mycobacterium
LQSGQPV

SEQ ID NO: 1213730 - protein, 7 aa, Mycobacterium
LQSGRSD

SEQ ID NO: 1213731 - protein, 7 aa, Mycobacterium
LQSGSSD

SEQ ID NO: 1213732 - protein, 5 aa, Mycobacterium
LQSPG

SEQ ID NO: 1213733 - protein, 5 aa, Mycobacterium
LQSSM

SEQ ID NO: 1213734 - protein, 14 aa, Mycobacterium
LQSTGELARRTQEV

SEQ ID NO: 1213735 - protein, 9 aa, Mycobacterium
LQSTTNART

SEQ ID NO: 1213736 - protein, 15 aa, Mycobacterium
LQSVTPEQAGKHPTW

SEQ ID NO: 1213737 - protein, 18 aa, Mycobacterium
LQTDANRKAAGSLPDGAE

SEQ ID NO: 1213738 - protein, 7 aa, Mycobacterium
LQTLGGS

SEQ ID NO: 1213739 - protein, 7 aa, Mycobacterium
LQTPAGD

SEQ ID NO: 1213740 - protein, 19 aa, Mycobacterium
LQTPAKARAALAGGSTHPA

SEQ ID NO: 1213741 - protein, 13 aa, Mycobacterium
LRAATKEARRLRP

SEQ ID NO: 1213742 - protein, 11 aa, Mycobacterium
LRADAEKGDAL

SEQ ID NO: 1213743 - protein, 8 aa, Mycobacterium
LRADEPGL

SEQ ID NO: 1213744 - protein, 6 aa, Mycobacterium
LRADPH

SEQ ID NO: 1213745 - protein, 6 aa, Mycobacterium
LRAEDR

SEQ ID NO: 1213746 - protein, 5 aa, Mycobacterium
LRAEG

SEQ ID NO: 1213747 - protein, 7 aa, Mycobacterium
LRAGESL

SEQ ID NO: 1213748 - protein, 13 aa, Mycobacterium
LRAGNGATAPAGW

SEQ ID NO: 1213749 - protein, 10 aa, Mycobacterium
LRANGRPDDE

SEQ ID NO: 1213750 - protein, 8 aa, Mycobacterium
LRAPGGVG

SEQ ID NO: 1213751 - protein, 15 aa, Mycobacterium
LRARGPKARLRTTRY

SEQ ID NO: 1213752 - protein, 23 aa, Mycobacterium
LRASGGDPDDAQVRPEGEVEGYL

SEQ ID NO: 1213753 - protein, 11 aa, Mycobacterium
LRATPTDAGTA

SEQ ID NO: 1213754 - protein, 29 aa, Mycobacterium
LRDAAAEVAGDFGPGSVADLDDQARRTRL

SEQ ID NO: 1213755 - protein, 10 aa, Mycobacterium
LRDDDPATAI

SEQ ID NO: 1213756 - protein, 6 aa, Mycobacterium
LRDEDA

SEQ ID NO: 1213757 - protein, 10 aa, Mycobacterium
LRDGGSRYLG

SEQ ID NO: 1213758 - protein, 7 aa, Mycobacterium
LRDGQTV

SEQ ID NO: 1213759 - protein, 11 aa, Mycobacterium
LRDGTEAIGGE

SEQ ID NO: 1213760 - protein, 11 aa, Mycobacterium
LRDKRDKRMPR

SEQ ID NO: 1213761 - protein, 5 aa, Mycobacterium
LRDPA

SEQ ID NO: 1213762 - protein, 7 aa, Mycobacterium
LRDPDDE

SEQ ID NO: 1213763 - protein, 11 aa, Mycobacterium
LRDPRATESLA

SEQ ID NO: 1213764 - protein, 7 aa, Mycobacterium
LRDPRNR

SEQ ID NO: 1213765 - protein, 6 aa, Mycobacterium
LRDPTE

SEQ ID NO: 1213766 - protein, 16 aa, Mycobacterium
LRDPTGTRGQPPDTGV

SEQ ID NO: 1213767 - protein, 5 aa, Mycobacterium
LRDSD

SEQ ID NO: 1213768 - protein, 5 aa, Mycobacterium
LRDSG

SEQ ID NO: 1213769 - protein, 11 aa, Mycobacterium
LRDSPDKISNF

SEQ ID NO: 1213770 - protein, 9 aa, Mycobacterium
LRDSRIGPT

SEQ ID NO: 1213771 - protein, 6 aa, Mycobacterium
LRDTGA

SEQ ID NO: 1213772 - protein, 6 aa, Mycobacterium
LRDTTS

SEQ ID NO: 1213773 - protein, 9 aa, Mycobacterium
LREAADDPE

SEQ ID NO: 1213774 - protein, 9 aa, Mycobacterium
LREAGSAAV

SEQ ID NO: 1213775 - protein, 13 aa, Mycobacterium
LREAKDKDTSEEL

SEQ ID NO: 1213776 - protein, 8 aa, Mycobacterium
LREDGTLA

SEQ ID NO: 1213777 - protein, 40 aa, Mycobacterium
LREEQTASDERLREEQTASDERLREEQTASDGADATAEQI

SEQ ID NO: 1213778 - protein, 12 aa, Mycobacterium
LREERATDEEAT

SEQ ID NO: 1213779 - protein, 6 aa, Mycobacterium
LREGDT

SEQ ID NO: 1213780 - protein, 6 aa, Mycobacterium
LREGKG

SEQ ID NO: 1213781 - protein, 34 aa, Mycobacterium
LREPPGDGGDSPAWSRKRGAYQAPQLPRSGGAVP

SEQ ID NO: 1213782 - protein, 9 aa, Mycobacterium
LREQAQAAV

SEQ ID NO: 1213783 - protein, 5 aa, Mycobacterium
LREQG

SEQ ID NO: 1213784 - protein, 6 aa, Mycobacterium
LREQTT

SEQ ID NO: 1213785 - protein, 12 aa, Mycobacterium
LRESAERAAETA

SEQ ID NO: 1213786 - protein, 14 aa, Mycobacterium
LRESSSIDQRSGVS

SEQ ID NO: 1213787 - protein, 8 aa, Mycobacterium
LRETTTTA

SEQ ID NO: 1213788 - protein, 7 aa, Mycobacterium
LRGAERE

SEQ ID NO: 1213789 - protein, 5 aa, Mycobacterium
LRGAR

SEQ ID NO: 1213790 - protein, 6 aa, Mycobacterium
LRGDDG

SEQ ID NO: 1213791 - protein, 12 aa, Mycobacterium
LRGEAGDRQVAD

SEQ ID NO: 1213792 - protein, 12 aa, Mycobacterium
LRGEAGERQVDG

SEQ ID NO: 1213793 - protein, 8 aa, Mycobacterium
LRGEGVSG

SEQ ID NO: 1213794 - protein, 5 aa, Mycobacterium
LRGEP

SEQ ID NO: 1213795 - protein, 4 aa, Mycobacterium
LRGF

SEQ ID NO: 1213796 - protein, 14 aa, Mycobacterium
LRGKPGSAEAARAQ

SEQ ID NO: 1213797 - protein, 11 aa, Mycobacterium
LRGPASAAIGD

SEQ ID NO: 1213798 - protein, 5 aa, Mycobacterium
LRGPD

SEQ ID NO: 1213799 - protein, 6 aa, Mycobacterium
LRGPGI

SEQ ID NO: 1213800 - protein, 6 aa, Mycobacterium
LRGPGR

SEQ ID NO: 1213801 - protein, 8 aa, Mycobacterium
LRGPRARA

SEQ ID NO: 1213802 - protein, 11 aa, Mycobacterium
LRGPSQAREES

SEQ ID NO: 1213803 - protein, 7 aa, Mycobacterium
LRGPVGA

SEQ ID NO: 1213804 - protein, 9 aa, Mycobacterium
LRGQSQDVD

SEQ ID NO: 1213805 - protein, 12 aa, Mycobacterium
LRGQSTANVPDA

SEQ ID NO: 1213806 - protein, 5 aa, Mycobacterium
LRGRG

SEQ ID NO: 1213807 - protein, 24 aa, Mycobacterium
LRGSEPPAVDLDGPPDPAPDDEDI

SEQ ID NO: 1213808 - protein, 9 aa, Mycobacterium
LRGSRTPDR

SEQ ID NO: 1213809 - protein, 4 aa, Mycobacterium
LRGT

SEQ ID NO: 1213810 - protein, 7 aa, Mycobacterium
LRGTNSN

SEQ ID NO: 1213811 - protein, 9 aa, Mycobacterium
LRGTSVNQV

SEQ ID NO: 1213812 - protein, 4 aa, Mycobacterium
LRGV

SEQ ID NO: 1213813 - protein, 9 aa, Mycobacterium
LRHPTPPSA

SEQ ID NO: 1213814 - protein, 10 aa, Mycobacterium
LRKDAERNRQ

SEQ ID NO: 1213815 - protein, 10 aa, Mycobacterium
LRNGALNPNA

SEQ ID NO: 1213816 - protein, 5 aa, Mycobacterium
LRNGY

SEQ ID NO: 1213817 - protein, 4 aa, Mycobacterium
LRNH

SEQ ID NO: 1213818 - protein, 11 aa, Mycobacterium
LRNPGGGAEYG

SEQ ID NO: 1213819 - protein, 6 aa, Mycobacterium
LRNTRA

SEQ ID NO: 1213820 - protein, 6 aa, Mycobacterium
LRNYPD

SEQ ID NO: 1213821 - protein, 5 aa, Mycobacterium
LRPAD

SEQ ID NO: 1213822 - protein, 6 aa, Mycobacterium
LRPARR

SEQ ID NO: 1213823 - protein, 10 aa, Mycobacterium
LRPAVDGNVD

SEQ ID NO: 1213824 - protein, 4 aa, Mycobacterium
LRPD

SEQ ID NO: 1213825 - protein, 5 aa, Mycobacterium
LRPDD

SEQ ID NO: 1213826 - protein, 16 aa, Mycobacterium
LRPDPDNPLSRGRACP

SEQ ID NO: 1213827 - protein, 22 aa, Mycobacterium
LRPDRNSGSNSCRATPPDQVMI

SEQ ID NO: 1213828 - protein, 9 aa, Mycobacterium
LRPEGKQGQ

SEQ ID NO: 1213829 - protein, 9 aa, Mycobacterium
LRPEGRSGP

SEQ ID NO: 1213830 - protein, 15 aa, Mycobacterium
LRPGAAVPEGVSEAA

SEQ ID NO: 1213831 - protein, 6 aa, Mycobacterium
LRPGAR

SEQ ID NO: 1213832 - protein, 6 aa, Mycobacterium
LRPGDL

SEQ ID NO: 1213833 - protein, 6 aa, Mycobacterium
LRPGDR

SEQ ID NO: 1213834 - protein, 5 aa, Mycobacterium
LRPGE

SEQ ID NO: 1213835 - protein, 6 aa, Mycobacterium
LRPGGR

SEQ ID NO: 1213836 - protein, 16 aa, Mycobacterium
LRPGHSAGPAENGTNC

SEQ ID NO: 1213837 - protein, 12 aa, Mycobacterium
LRPLPRKRRRRR

SEQ ID NO: 1213838 - protein, 7 aa, Mycobacterium
LRPMTPD

SEQ ID NO: 1213839 - protein, 4 aa, Mycobacterium
LRPP

SEQ ID NO: 1213840 - protein, 6 aa, Mycobacterium
LRPPEP

SEQ ID NO: 1213841 - protein, 8 aa, Mycobacterium
LRPPQGAP

SEQ ID NO: 1213842 - protein, 4 aa, Mycobacterium
LRPR

SEQ ID NO: 1213843 - protein, 6 aa, Mycobacterium
LRPSRG

SEQ ID NO: 1213844 - protein, 9 aa, Mycobacterium
LRPSSRREL

SEQ ID NO: 1213845 - protein, 4 aa, Mycobacterium
LRPT

SEQ ID NO: 1213846 - protein, 6 aa, Mycobacterium
LRPTPL

SEQ ID NO: 1213847 - protein, 4 aa, Mycobacterium
LRPW

SEQ ID NO: 1213848 - protein, 5 aa, Mycobacterium
LRQAT

SEQ ID NO: 1213849 - protein, 5 aa, Mycobacterium
LRQED

SEQ ID NO: 1213850 - protein, 4 aa, Mycobacterium
LRQP

SEQ ID NO: 1213851 - protein, 10 aa, Mycobacterium
LRQPRDKGPV

SEQ ID NO: 1213852 - protein, 11 aa, Mycobacterium
LRRAASDYARE

SEQ ID NO: 1213853 - protein, 4 aa, Mycobacterium
LRRD

SEQ ID NO: 1213854 - protein, 12 aa, Mycobacterium
LRREKEDVTEVR

SEQ ID NO: 1213855 - protein, 12 aa, Mycobacterium
LRRGDAGPDEPR

SEQ ID NO: 1213856 - protein, 9 aa, Mycobacterium
LRRGESDHA

SEQ ID NO: 1213857 - protein, 19 aa, Mycobacterium
LRRGQAALTGPVARGDAAA

SEQ ID NO: 1213858 - protein, 4 aa, Mycobacterium
LRRK

SEQ ID NO: 1213859 - protein, 12 aa, Mycobacterium
LRRKTEARREHD

SEQ ID NO: 1213860 - protein, 6 aa, Mycobacterium
LRRPGT

SEQ ID NO: 1213861 - protein, 7 aa, Mycobacterium
LRRRAGS

SEQ ID NO: 1213862 - protein, 5 aa, Mycobacterium
LRRRG

SEQ ID NO: 1213863 - protein, 11 aa, Mycobacterium
LRRSEAAAEQD

SEQ ID NO: 1213864 - protein, 8 aa, Mycobacterium
LRRSGVPD

SEQ ID NO: 1213865 - protein, 5 aa, Mycobacterium
LRRTA

SEQ ID NO: 1213866 - protein, 9 aa, Mycobacterium
LRSATKAFA

SEQ ID NO: 1213867 - protein, 5 aa, Mycobacterium
LRSDA

SEQ ID NO: 1213868 - protein, 8 aa, Mycobacterium
LRSDPGLD

SEQ ID NO: 1213869 - protein, 8 aa, Mycobacterium
LRSEARKG

SEQ ID NO: 1213870 - protein, 8 aa, Mycobacterium
LRSEPASG

SEQ ID NO: 1213871 - protein, 13 aa, Mycobacterium
LRSERDDAATQAA

SEQ ID NO: 1213872 - protein, 9 aa, Mycobacterium
LRSEREQGI

SEQ ID NO: 1213873 - protein, 6 aa, Mycobacterium
LRSGDA

SEQ ID NO: 1213874 - protein, 9 aa, Mycobacterium
LRSGDRSAL

SEQ ID NO: 1213875 - protein, 8 aa, Mycobacterium
LRSGDSEL

SEQ ID NO: 1213876 - protein, 13 aa, Mycobacterium
LRSGEKPTPSRSG

SEQ ID NO: 1213877 - protein, 5 aa, Mycobacterium
LRSPG

SEQ ID NO: 1213878 - protein, 8 aa, Mycobacterium
LRSQKTPM

SEQ ID NO: 1213879 - protein, 8 aa, Mycobacterium
LRSRREGA

SEQ ID NO: 1213880 - protein, 8 aa, Mycobacterium
LRSTKAPV

SEQ ID NO: 1213881 - protein, 9 aa, Mycobacterium
LRSTRGAPL

SEQ ID NO: 1213882 - protein, 12 aa, Mycobacterium
LRTDKTPDEVVW

SEQ ID NO: 1213883 - protein, 8 aa, Mycobacterium
LRTDSDHN

SEQ ID NO: 1213884 - protein, 13 aa, Mycobacterium
LRTERDAVAALGL

SEQ ID NO: 1213885 - protein, 21 aa, Mycobacterium
LRTGDRARITTAAGSAEAGVE

SEQ ID NO: 1213886 - protein, 18 aa, Mycobacterium
LRTGPQSLARAVENFLRR

SEQ ID NO: 1213887 - protein, 11 aa, Mycobacterium
LRTQKQRYQTE

SEQ ID NO: 1213888 - protein, 11 aa, Mycobacterium
LRTQKRGYETT

SEQ ID NO: 1213889 - protein, 19 aa, Mycobacterium
LRTRPASEAAASAEKSQKF

SEQ ID NO: 1213890 - protein, 10 aa, Mycobacterium
LRTRPSRLSE

SEQ ID NO: 1213891 - protein, 5 aa, Mycobacterium
LRTSA

SEQ ID NO: 1213892 - protein, 8 aa, Mycobacterium
LRTSAEDG

SEQ ID NO: 1213893 - protein, 7 aa, Mycobacterium
LRTSRPG

SEQ ID NO: 1213894 - protein, 11 aa, Mycobacterium
LRTTTDNRQRV

SEQ ID NO: 1213895 - protein, 6 aa, Mycobacterium
LRYGPD

SEQ ID NO: 1213896 - protein, 6 aa, Mycobacterium
LSAAAA

SEQ ID NO: 1213897 - protein, 8 aa, Mycobacterium
LSAADGAK

SEQ ID NO: 1213898 - protein, 6 aa, Mycobacterium
LSAADR

SEQ ID NO: 1213899 - protein, 11 aa, Mycobacterium
LSAAPGAGGRP

SEQ ID NO: 1213900 - protein, 5 aa, Mycobacterium
LSAAT

SEQ ID NO: 1213901 - protein, 4 aa, Mycobacterium
LSAD

SEQ ID NO: 1213902 - protein, 6 aa, Mycobacterium
LSADAV

SEQ ID NO: 1213903 - protein, 6 aa, Mycobacterium
LSADEA

SEQ ID NO: 1213904 - protein, 5 aa, Mycobacterium
LSADG

SEQ ID NO: 1213905 - protein, 12 aa, Mycobacterium
LSADGKTKEDFG

SEQ ID NO: 1213906 - protein, 11 aa, Mycobacterium
LSAEAGTVDNT

SEQ ID NO: 1213907 - protein, 8 aa, Mycobacterium
LSAEAKQD

SEQ ID NO: 1213908 - protein, 17 aa, Mycobacterium
LSAEGTDCPDPVHPIRR

SEQ ID NO: 1213909 - protein, 11 aa, Mycobacterium
LSAESARIGRP

SEQ ID NO: 1213910 - protein, 16 aa, Mycobacterium
LSAEYTGNGRSVALEP

SEQ ID NO: 1213911 - protein, 8 aa, Mycobacterium
LSAGEALP

SEQ ID NO: 1213912 - protein, 11 aa, Mycobacterium
LSAGEPEGTRL

SEQ ID NO: 1213913 - protein, 8 aa, Mycobacterium
LSAGTENL

SEQ ID NO: 1213914 - protein, 10 aa, Mycobacterium
LSAPGSRVAA

SEQ ID NO: 1213915 - protein, 8 aa, Mycobacterium
LSAPGVAY

SEQ ID NO: 1213916 - protein, 9 aa, Mycobacterium
LSAPPDVSA

SEQ ID NO: 1213917 - protein, 26 aa, Mycobacterium
LSAPPSTGESETGGVPSGDAVVGGST

SEQ ID NO: 1213918 - protein, 16 aa, Mycobacterium
LSAPQSTPKATGRRRR

SEQ ID NO: 1213919 - protein, 7 aa, Mycobacterium
LSAPRPM

SEQ ID NO: 1213920 - protein, 4 aa, Mycobacterium
LSAQ

SEQ ID NO: 1213921 - protein, 18 aa, Mycobacterium
LSARGRPCSADPAYRGRD

SEQ ID NO: 1213922 - protein, 6 aa, Mycobacterium
LSASDT

SEQ ID NO: 1213923 - protein, 16 aa, Mycobacterium
LSASGALGDVSKSGYL

SEQ ID NO: 1213924 - protein, 18 aa, Mycobacterium
LSASKGAARRTIAEGGVS

SEQ ID NO: 1213925 - protein, 18 aa, Mycobacterium
LSASKGAARRTVAEGGAY

SEQ ID NO: 1213926 - protein, 9 aa, Mycobacterium
LSDAEAEQS

SEQ ID NO: 1213927 - protein, 6 aa, Mycobacterium
LSDAGA

SEQ ID NO: 1213928 - protein, 6 aa, Mycobacterium
LSDAKE

SEQ ID NO: 1213929 - protein, 9 aa, Mycobacterium
LSDASADAE

SEQ ID NO: 1213930 - protein, 5 aa, Mycobacterium
LSDDD

SEQ ID NO: 1213931 - protein, 8 aa, Mycobacterium
LSDDDRAF

SEQ ID NO: 1213932 - protein, 7 aa, Mycobacterium
LSDDGDR

SEQ ID NO: 1213933 - protein, 9 aa, Mycobacterium
LSDDPAGPR

SEQ ID NO: 1213934 - protein, 5 aa, Mycobacterium
LSDDQ

SEQ ID NO: 1213935 - protein, 8 aa, Mycobacterium
LSDEDPVA

SEQ ID NO: 1213936 - protein, 5 aa, Mycobacterium
LSDEE

SEQ ID NO: 1213937 - protein, 7 aa, Mycobacterium
LSDEEIR

SEQ ID NO: 1213938 - protein, 6 aa, Mycobacterium
LSDEHT

SEQ ID NO: 1213939 - protein, 28 aa, Mycobacterium
LSDEPDDPEAPEDPDDPEESDAPEPPDG

SEQ ID NO: 1213940 - protein, 9 aa, Mycobacterium
LSDEPEPEP

SEQ ID NO: 1213941 - protein, 15 aa, Mycobacterium
LSDGDVGRLSSDESG

SEQ ID NO: 1213942 - protein, 5 aa, Mycobacterium
LSDGE

SEQ ID NO: 1213943 - protein, 7 aa, Mycobacterium
LSDGESL

SEQ ID NO: 1213944 - protein, 9 aa, Mycobacterium
LSDGSEKDV

SEQ ID NO: 1213945 - protein, 10 aa, Mycobacterium
LSDGTPAPTL

SEQ ID NO: 1213946 - protein, 6 aa, Mycobacterium
LSDGVN

SEQ ID NO: 1213947 - protein, 4 aa, Mycobacterium
LSDH

SEQ ID NO: 1213948 - protein, 4 aa, Mycobacterium
LSDI

SEQ ID NO: 1213949 - protein, 7 aa, Mycobacterium
LSDLDPP

SEQ ID NO: 1213950 - protein, 9 aa, Mycobacterium
LSDLGREQA

SEQ ID NO: 1213951 - protein, 11 aa, Mycobacterium
LSDLSDDTARV

SEQ ID NO: 1213952 - protein, 7 aa, Mycobacterium
LSDPGEV

SEQ ID NO: 1213953 - protein, 8 aa, Mycobacterium
LSDPPPDQ

SEQ ID NO: 1213954 - protein, 5 aa, Mycobacterium
LSDPR

SEQ ID NO: 1213955 - protein, 7 aa, Mycobacterium
LSDQAQR

SEQ ID NO: 1213956 - protein, 5 aa, Mycobacterium
LSDQP

SEQ ID NO: 1213957 - protein, 8 aa, Mycobacterium
LSDRARND

SEQ ID NO: 1213958 - protein, 7 aa, Mycobacterium
LSDRERE

SEQ ID NO: 1213959 - protein, 6 aa, Mycobacterium
LSDRGV

SEQ ID NO: 1213960 - protein, 16 aa, Mycobacterium
LSDSARRGADHDPHEP

SEQ ID NO: 1213961 - protein, 14 aa, Mycobacterium
LSDTGRCEVSPTAR

SEQ ID NO: 1213962 - protein, 22 aa, Mycobacterium
LSDTKAMAQAAHGSAPDIAGRN

SEQ ID NO: 1213963 - protein, 4 aa, Mycobacterium
LSEA

SEQ ID NO: 1213964 - protein, 12 aa, Mycobacterium
LSEAAGRDPSDL

SEQ ID NO: 1213965 - protein, 7 aa, Mycobacterium
LSEAGDP

SEQ ID NO: 1213966 - protein, 15 aa, Mycobacterium
LSEAPERIRSDGIRP

SEQ ID NO: 1213967 - protein, 7 aa, Mycobacterium
LSEAQTD

SEQ ID NO: 1213968 - protein, 10 aa, Mycobacterium
LSEDAEGPGA

SEQ ID NO: 1213969 - protein, 31 aa, Mycobacterium
LSEDDEADETGETTTAETELPQVSSTALGAE

SEQ ID NO: 1213970 - protein, 6 aa, Mycobacterium
LSEDDV

SEQ ID NO: 1213971 - protein, 4 aa, Mycobacterium
LSEE

SEQ ID NO: 1213972 - protein, 13 aa, Mycobacterium
LSEEAAGTGAQKA

SEQ ID NO: 1213973 - protein, 11 aa, Mycobacterium
LSEEGADDPVR

SEQ ID NO: 1213974 - protein, 9 aa, Mycobacterium
LSEEPSRSA

SEQ ID NO: 1213975 - protein, 7 aa, Mycobacterium
LSEETTV

SEQ ID NO: 1213976 - protein, 7 aa, Mycobacterium
LSEGSAP

SEQ ID NO: 1213977 - protein, 7 aa, Mycobacterium
LSEGTGK

SEQ ID NO: 1213978 - protein, 4 aa, Mycobacterium
LSEL

SEQ ID NO: 1213979 - protein, 12 aa, Mycobacterium
LSELAPRPDAPP

SEQ ID NO: 1213980 - protein, 8 aa, Mycobacterium
LSENGALE

SEQ ID NO: 1213981 - protein, 8 aa, Mycobacterium
LSEPESAT

SEQ ID NO: 1213982 - protein, 12 aa, Mycobacterium
LSEPQAGSDAAA

SEQ ID NO: 1213983 - protein, 7 aa, Mycobacterium
LSEQRNA

SEQ ID NO: 1213984 - protein, 12 aa, Mycobacterium
LSERAEGTITAE

SEQ ID NO: 1213985 - protein, 7 aa, Mycobacterium
LSERDAE

SEQ ID NO: 1213986 - protein, 6 aa, Mycobacterium
LSERPD

SEQ ID NO: 1213987 - protein, 9 aa, Mycobacterium
LSESLGEAL

SEQ ID NO: 1213988 - protein, 6 aa, Mycobacterium
LSESTL

SEQ ID NO: 1213989 - protein, 9 aa, Mycobacterium
LSFGEGTRT

SEQ ID NO: 1213990 - protein, 18 aa, Mycobacterium
LSGADASGNRKEVESCQQ

SEQ ID NO: 1213991 - protein, 7 aa, Mycobacterium
LSGARVQ

SEQ ID NO: 1213992 - protein, 19 aa, Mycobacterium
LSGASAPAIPDGPAPVEPM

SEQ ID NO: 1213993 - protein, 5 aa, Mycobacterium
LSGAT

SEQ ID NO: 1213994 - protein, 4 aa, Mycobacterium
LSGD

SEQ ID NO: 1213995 - protein, 7 aa, Mycobacterium
LSGDEKA

SEQ ID NO: 1213996 - protein, 8 aa, Mycobacterium
LSGDGPVE

SEQ ID NO: 1213997 - protein, 7 aa, Mycobacterium
LSGEEES

SEQ ID NO: 1213998 - protein, 8 aa, Mycobacterium
LSGGEKRR

SEQ ID NO: 1213999 - protein, 9 aa, Mycobacterium
LSGGEVERA

SEQ ID NO: 1214000 - protein, 8 aa, Mycobacterium
LSGGGAAL

SEQ ID NO: 1214001 - protein, 15 aa, Mycobacterium
LSGGGDRHPAGGWSR

SEQ ID NO: 1214002 - protein, 8 aa, Mycobacterium
LSGGGTQV

SEQ ID NO: 1214003 - protein, 17 aa, Mycobacterium
LSGGQAQPQGQSGGGLG

SEQ ID NO: 1214004 - protein, 7 aa, Mycobacterium
LSGGQRQ

SEQ ID NO: 1214005 - protein, 17 aa, Mycobacterium
LSGHSGETALDEATHAQ

SEQ ID NO: 1214006 - protein, 9 aa, Mycobacterium
LSGKPPSPY

SEQ ID NO: 1214007 - protein, 11 aa, Mycobacterium
LSGKRDQATTV

SEQ ID NO: 1214008 - protein, 15 aa, Mycobacterium
LSGLESKAGQGIPAL

SEQ ID NO: 1214009 - protein, 9 aa, Mycobacterium
LSGLGGRGT

SEQ ID NO: 1214010 - protein, 5 aa, Mycobacterium
LSGMG

SEQ ID NO: 1214011 - protein, 6 aa, Mycobacterium
LSGNST

SEQ ID NO: 1214012 - protein, 16 aa, Mycobacterium
LSGPADDPATVAPLTG

SEQ ID NO: 1214013 - protein, 35 aa, Mycobacterium; identical to SEQ ID NO: 524859

SEQ ID NO: 1214014 - protein, 9 aa, Mycobacterium
LSGPAPDLE

SEQ ID NO: 1214015 - protein, 10 aa, Mycobacterium
LSGPGVTAAQ

SEQ ID NO: 1214016 - protein, 12 aa, Mycobacterium
LSGPPLAEPASA

SEQ ID NO: 1214017 - protein, 7 aa, Mycobacterium
LSGPRNS

SEQ ID NO: 1214018 - protein, 12 aa, Mycobacterium
LSGPTSLPLEFG

SEQ ID NO: 1214019 - protein, 13 aa, Mycobacterium
LSGQEQNPDLTDR

SEQ ID NO: 1214020 - protein, 6 aa, Mycobacterium
LSGQPV

SEQ ID NO: 1214021 - protein, 13 aa, Mycobacterium
LSGQSFAPGSAAN

SEQ ID NO: 1214022 - protein, 53 aa, Mycobacterium
LSGRGGDGGVGGAGGKGGAGAHGSDAVAAEEDGGPGGSGGAGGNAGAGGVGGR

SEQ ID NO: 1214023 - protein, 7 aa, Mycobacterium
LSGRSSA

SEQ ID NO: 1214024 - protein, 7 aa, Mycobacterium
LSGRTDT

SEQ ID NO: 1214025 - protein, 18 aa, Mycobacterium
LSGRTVPYESLSGGAKEQ

SEQ ID NO: 1214026 - protein, 13 aa, Mycobacterium
LSGSEGGKPSLTV

SEQ ID NO: 1214027 - protein, 9 aa, Mycobacterium
LSGSGGAPD

SEQ ID NO: 1214028 - protein, 13 aa, Mycobacterium
LSGSPRVQAGRFK

SEQ ID NO: 1214029 - protein, 7 aa, Mycobacterium
LSGSTTT

SEQ ID NO: 1214030 - protein, 5 aa, Mycobacterium
LSGSV

SEQ ID NO: 1214031 - protein, 5 aa, Mycobacterium
LSGTG

SEQ ID NO: 1214032 - protein, 11 aa, Mycobacterium
LSHYSDGTTDI

SEQ ID NO: 1214033 - protein, 4 aa, Mycobacterium
LSIT

SEQ ID NO: 1214034 - protein, 5 aa, Mycobacterium
LSKGG

SEQ ID NO: 1214035 - protein, 4 aa, Mycobacterium
LSLE

SEQ ID NO: 1214036 - protein, 10 aa, Mycobacterium
LSLPGRDAPG

SEQ ID NO: 1214037 - protein, 10 aa, Mycobacterium
LSLPTSDNPI

SEQ ID NO: 1214038 - protein, 11 aa, Mycobacterium
LSNADDREQIR

SEQ ID NO: 1214039 - protein, 28 aa, Mycobacterium
LSNAPDNDRLNGSDPSPDESWADEDDWR

SEQ ID NO: 1214040 - protein, 6 aa, Mycobacterium
LSNGAT

SEQ ID NO: 1214041 - protein, 6 aa, Mycobacterium
LSNGGI

SEQ ID NO: 1214042 - protein, 15 aa, Mycobacterium
LSNPGDAPDAGRVGA

SEQ ID NO: 1214043 - protein, 15 aa, Mycobacterium
LSNPKPAKPAGGDVD

SEQ ID NO: 1214044 - protein, 6 aa, Mycobacterium
LSNREV

SEQ ID NO: 1214045 - protein, 8 aa, Mycobacterium
LSNSEGVD

SEQ ID NO: 1214046 - protein, 8 aa, Mycobacterium
LSNSGAAR

SEQ ID NO: 1214047 - protein, 4 aa, Mycobacterium
LSPA

SEQ ID NO: 1214048 - protein, 6 aa, Mycobacterium
LSPADG

SEQ ID NO: 1214049 - protein, 9 aa, Mycobacterium
LSPASGRPL

SEQ ID NO: 1214050 - protein, 18 aa, Mycobacterium
LSPDAPRTRHTSGITQPP

SEQ ID NO: 1214051 - protein, 6 aa, Mycobacterium
LSPDGR

SEQ ID NO: 1214052 - protein, 9 aa, Mycobacterium
LSPDGSASY

SEQ ID NO: 1214053 - protein, 6 aa, Mycobacterium
LSPDQP

SEQ ID NO: 1214054 - protein, 5 aa, Mycobacterium
LSPEA

SEQ ID NO: 1214055 - protein, 6 aa, Mycobacterium
LSPERL

SEQ ID NO: 1214056 - protein, 11 aa, Mycobacterium
LSPESASRTRE

SEQ ID NO: 1214057 - protein, 4 aa, Mycobacterium
LSPG

SEQ ID NO: 1214058 - protein, 8 aa, Mycobacterium
LSPGADVQ

SEQ ID NO: 1214059 - protein, 12 aa, Mycobacterium
LSPGDGGEGPAI

SEQ ID NO: 1214060 - protein, 10 aa, Mycobacterium
LSPGDPASWT

SEQ ID NO: 1214061 - protein, 12 aa, Mycobacterium
LSPGELAADADY

SEQ ID NO: 1214062 - protein, 6 aa, Mycobacterium
LSPGNR

SEQ ID NO: 1214063 - protein, 12 aa, Mycobacterium
LSPGRAAATDVQ

SEQ ID NO: 1214064 - protein, 7 aa, Mycobacterium
LSPLGAG

SEQ ID NO: 1214065 - protein, 5 aa, Mycobacterium
LSPPD

SEQ ID NO: 1214066 - protein, 8 aa, Mycobacterium
LSPPGSRH

SEQ ID NO: 1214067 - protein, 6 aa, Mycobacterium
LSPPLA

SEQ ID NO: 1214068 - protein, 5 aa, Mycobacterium
LSPPV

SEQ ID NO: 1214069 - protein, 6 aa, Mycobacterium
LSPPVA

SEQ ID NO: 1214070 - protein, 7 aa, Mycobacterium
LSPQPGR

SEQ ID NO: 1214071 - protein, 9 aa, Mycobacterium
LSPQPTTAR

SEQ ID NO: 1214072 - protein, 5 aa, Mycobacterium
LSPRA

SEQ ID NO: 1214073 - protein, 7 aa, Mycobacterium
LSPRAAK

SEQ ID NO: 1214074 - protein, 6 aa, Mycobacterium
LSPRAL

SEQ ID NO: 1214075 - protein, 8 aa, Mycobacterium
LSPRARAA

SEQ ID NO: 1214076 - protein, 7 aa, Mycobacterium
LSPRATF

SEQ ID NO: 1214077 - protein, 6 aa, Mycobacterium
LSPRER

SEQ ID NO: 1214078 - protein, 15 aa, Mycobacterium
LSPREVGQSLEATRT

SEQ ID NO: 1214079 - protein, 5 aa, Mycobacterium
LSPRH

SEQ ID NO: 1214080 - protein, 8 aa, Mycobacterium
LSPRPTAV

SEQ ID NO: 1214081 - protein, 5 aa, Mycobacterium
LSPRR

SEQ ID NO: 1214082 - protein, 6 aa, Mycobacterium
LSPSSY

SEQ ID NO: 1214083 - protein, 11 aa, Mycobacterium
LSPTATLATTH

SEQ ID NO: 1214084 - protein, 21 aa, Mycobacterium
LSPTAVAAATAASAERGLSER

SEQ ID NO: 1214085 - protein, 12 aa, Mycobacterium
LSPTSKAEFHGN

SEQ ID NO: 1214086 - protein, 12 aa, Mycobacterium
LSPVKSAEAGLT

SEQ ID NO: 1214087 - protein, 13 aa, Mycobacterium
LSPVSRSALPPQL

SEQ ID NO: 1214088 - protein, 7 aa, Mycobacterium
LSQAQAR

SEQ ID NO: 1214089 - protein, 8 aa, Mycobacterium
LSQPARER

SEQ ID NO: 1214090 - protein, 11 aa, Mycobacterium
LSQPRKPDIPG

SEQ ID NO: 1214091 - protein, 9 aa, Mycobacterium
LSQPRREHG

SEQ ID NO: 1214092 - protein, 11 aa, Mycobacterium
LSQRVPDDETV

SEQ ID NO: 1214093 - protein, 10 aa, Mycobacterium
LSQSYSGATM

SEQ ID NO: 1214094 - protein, 6 aa, Mycobacterium
LSRAAE

SEQ ID NO: 1214095 - protein, 10 aa, Mycobacterium
LSRADQDEFA

SEQ ID NO: 1214096 - protein, 9 aa, Mycobacterium
LSRAQQESL

SEQ ID NO: 1214097 - protein, 7 aa, Mycobacterium
LSRARPE

SEQ ID NO: 1214098 - protein, 11 aa, Mycobacterium
LSRASHATEDI

SEQ ID NO: 1214099 - protein, 7 aa, Mycobacterium
LSREDLA

SEQ ID NO: 1214100 - protein, 8 aa, Mycobacterium
LSREGRDF

SEQ ID NO: 1214101 - protein, 7 aa, Mycobacterium
LSRPAAA

SEQ ID NO: 1214102 - protein, 13 aa, Mycobacterium
LSRPDEQCKILVT

SEQ ID NO: 1214103 - protein, 16 aa, Mycobacterium
LSRPGTRSRFAPRPTS

SEQ ID NO: 1214104 - protein, 8 aa, Mycobacterium
LSRPTTRR

SEQ ID NO: 1214105 - protein, 15 aa, Mycobacterium
LSRRSESGATDAAGR

SEQ ID NO: 1214106 - protein, 8 aa, Mycobacterium
LSRSAPAT

SEQ ID NO: 1214107 - protein, 9 aa, Mycobacterium
LSRSPNPHL

SEQ ID NO: 1214108 - protein, 8 aa, Mycobacterium
LSRSQRDE

SEQ ID NO: 1214109 - protein, 4 aa, Mycobacterium
LSRT

SEQ ID NO: 1214110 - protein, 17 aa, Mycobacterium
LSRTAKGSANRAKTRAA

SEQ ID NO: 1214111 - protein, 4 aa, Mycobacterium
LSSA

SEQ ID NO: 1214112 - protein, 8 aa, Mycobacterium
LSSAEAAA

SEQ ID NO: 1214113 - protein, 10 aa, Mycobacterium
LSSAGTPDRL

SEQ ID NO: 1214114 - protein, 11 aa, Mycobacterium
LSSDGGVSEGL

SEQ ID NO: 1214115 - protein, 11 aa, Mycobacterium
LSSDGPASWPP

SEQ ID NO: 1214116 - protein, 7 aa, Mycobacterium
LSSDTDA

SEQ ID NO: 1214117 - protein, 5 aa, Mycobacterium
LSSFA

SEQ ID NO: 1214118 - protein, 7 aa, Mycobacterium
LSSGATV

SEQ ID NO: 1214119 - protein, 10 aa, Mycobacterium
LSSGDTGHFD

SEQ ID NO: 1214120 - protein, 7 aa, Mycobacterium
LSSGGYK

SEQ ID NO: 1214121 - protein, 9 aa, Mycobacterium
LSSGLTSQQ

SEQ ID NO: 1214122 - protein, 8 aa, Mycobacterium
LSSGPDHA

SEQ ID NO: 1214123 - protein, 9 aa, Mycobacterium
LSSGPDRAA

SEQ ID NO: 1214124 - protein, 5 aa, Mycobacterium
LSSGQ

SEQ ID NO: 1214125 - protein, 10 aa, Mycobacterium
LSSGVDEEPD

SEQ ID NO: 1214126 - protein, 5 aa, Mycobacterium
LSSHQ

SEQ ID NO: 1214127 - protein, 8 aa, Mycobacterium
LSSNGYGV

SEQ ID NO: 1214128 - protein, 7 aa, Mycobacterium
LSSPAGL

SEQ ID NO: 1214129 - protein, 5 aa, Mycobacterium
LSSPS

SEQ ID NO: 1214130 - protein, 12 aa, Mycobacterium
LSSPTTDSDPVV

SEQ ID NO: 1214131 - protein, 8 aa, Mycobacterium
LSSQARKY

SEQ ID NO: 1214132 - protein, 9 aa, Mycobacterium
LSSQHGATI

SEQ ID NO: 1214133 - protein, 21 aa, Mycobacterium
LSSQSVSDRGAKRLRELLNRN

SEQ ID NO: 1214134 - protein, 15 aa, Mycobacterium
LSSTADVSRVASDTD

SEQ ID NO: 1214135 - protein, 10 aa, Mycobacterium
LSSTAKSTLN

SEQ ID NO: 1214136 - protein, 22 aa, Mycobacterium
LSSTPGGKGGNQAVAAARAGAQ

SEQ ID NO: 1214137 - protein, 9 aa, Mycobacterium
LSSTTPASG

SEQ ID NO: 1214138 - protein, 8 aa, Mycobacterium
LSSTYSAA

SEQ ID NO: 1214139 - protein, 6 aa, Mycobacterium
LSTAAS

SEQ ID NO: 1214140 - protein, 14 aa, Mycobacterium
LSTAEDMGQEFAPS

SEQ ID NO: 1214141 - protein, 12 aa, Mycobacterium
LSTAEGRRSAAE

SEQ ID NO: 1214142 - protein, 6 aa, Mycobacterium
LSTAMD

SEQ ID NO: 1214143 - protein, 9 aa, Mycobacterium
LSTAQDRAI

SEQ ID NO: 1214144 - protein, 10 aa, Mycobacterium
LSTDEKRDYV

SEQ ID NO: 1214145 - protein, 9 aa, Mycobacterium
LSTDPETRD

SEQ ID NO: 1214146 - protein, 8 aa, Mycobacterium
LSTEEQER

SEQ ID NO: 1214147 - protein, 4 aa, Mycobacterium
LSTG

SEQ ID NO: 1214148 - protein, 11 aa, Mycobacterium
LSTGGPEAAEA

SEQ ID NO: 1214149 - protein, 5 aa, Mycobacterium
LSTGN

SEQ ID NO: 1214150 - protein, 9 aa, Mycobacterium
LSTLDKERL

SEQ ID NO: 1214151 - protein, 5 aa, Mycobacterium
LSTNP

SEQ ID NO: 1214152 - protein, 5 aa, Mycobacterium
LSTRS

SEQ ID NO: 1214153 - protein, 9 aa, Mycobacterium
LSTRSHGEV

SEQ ID NO: 1214154 - protein, 12 aa, Mycobacterium
LSTSAAAAIGTA

SEQ ID NO: 1214155 - protein, 11 aa, Mycobacterium
LSTSDGRAAAA

SEQ ID NO: 1214156 - protein, 18 aa, Mycobacterium
LSTSSLSAHRDSDPTVAG

SEQ ID NO: 1214157 - protein, 7 aa, Mycobacterium
LSTSTEV

SEQ ID NO: 1214158 - protein, 15 aa, Mycobacterium
LSTSVERDDQGQEVT

SEQ ID NO: 1214159 - protein, 9 aa, Mycobacterium
LSTTDPHSR

SEQ ID NO: 1214160 - protein, 5 aa, Mycobacterium
LSTTT

SEQ ID NO: 1214161 - protein, 40 aa, Mycobacterium
LSVGGGQTARGQQGEYLTTAQGARLHDTDHSLKAGERGPT

SEQ ID NO: 1214162 - protein, 6 aa, Mycobacterium
LSVQAS

SEQ ID NO: 1214163 - protein, 12 aa, Mycobacterium
LSVRPDRQRAGI

SEQ ID NO: 1214164 - protein, 8 aa, Mycobacterium
LSYPPGDV

SEQ ID NO: 1214165 - protein, 9 aa, Mycobacterium
LTAAGGPPV

SEQ ID NO: 1214166 - protein, 7 aa, Mycobacterium
LTAAGTA

SEQ ID NO: 1214167 - protein, 8 aa, Mycobacterium
LTAASPSD

SEQ ID NO: 1214168 - protein, 15 aa, Mycobacterium
LTAATAAAGHRGPRP

SEQ ID NO: 1214169 - protein, 4 aa, Mycobacterium
LTAD

SEQ ID NO: 1214170 - protein, 16 aa, Mycobacterium
LTAEPGETEYDAAGGA

SEQ ID NO: 1214171 - protein, 8 aa, Mycobacterium
LTAGANLG

SEQ ID NO: 1214172 - protein, 9 aa, Mycobacterium
LTAGTPGAH

SEQ ID NO: 1214173 - protein, 12 aa, Mycobacterium
LTAKDSETGEAK

SEQ ID NO: 1214174 - protein, 6 aa, Mycobacterium
LTAKQI

SEQ ID NO: 1214175 - protein, 11 aa, Mycobacterium
LTANGASRDRI

SEQ ID NO: 1214176 - protein, 4 aa, Mycobacterium
LTAP

SEQ ID NO: 1214177 - protein, 10 aa, Mycobacterium
LTAPAPHHTR

SEQ ID NO: 1214178 - protein, 10 aa, Mycobacterium
LTAPGRTPHS

SEQ ID NO: 1214179 - protein, 5 aa, Mycobacterium
LTAPL

SEQ ID NO: 1214180 - protein, 11 aa, Mycobacterium
LTAPTDADSID

SEQ ID NO: 1214181 - protein, 8 aa, Mycobacterium
LTAQDAGE

SEQ ID NO: 1214182 - protein, 9 aa, Mycobacterium
LTARKSELA

SEQ ID NO: 1214183 - protein, 11 aa, Mycobacterium
LTARPGPPRID

SEQ ID NO: 1214184 - protein, 11 aa, Mycobacterium
LTARRSEPRIR

SEQ ID NO: 1214185 - protein, 4 aa, Mycobacterium
LTAS

SEQ ID NO: 1214186 - protein, 15 aa, Mycobacterium
LTASEQRAVPGEGSR

SEQ ID NO: 1214187 - protein, 6 aa, Mycobacterium
LTASGH

SEQ ID NO: 1214188 - protein, 31 aa, Mycobacterium
LTASPSTEAPPSPAAVAARKSTGSPCARKDM

SEQ ID NO: 1214189 - protein, 9 aa, Mycobacterium
LTASRSELP

SEQ ID NO: 1214190 - protein, 4 aa, Mycobacterium
LTAT

SEQ ID NO: 1214191 - protein, 5 aa, Mycobacterium
LTATD

SEQ ID NO: 1214192 - protein, 6 aa, Mycobacterium
LTATEQ

SEQ ID NO: 1214193 - protein, 7 aa, Mycobacterium
LTATPEA

SEQ ID NO: 1214194 - protein, 14 aa, Mycobacterium
LTATRDVAGPGPLR

SEQ ID NO: 1214195 - protein, 10 aa, Mycobacterium
LTATTGAVTA

SEQ ID NO: 1214196 - protein, 5 aa, Mycobacterium
LTDAG

SEQ ID NO: 1214197 - protein, 6 aa, Mycobacterium
LTDAGR

SEQ ID NO: 1214198 - protein, 8 aa, Mycobacterium
LTDAQTDE

SEQ ID NO: 1214199 - protein, 15 aa, Mycobacterium
LTDDANDDALPAPVD

SEQ ID NO: 1214200 - protein, 7 aa, Mycobacterium
LTDDDSR

SEQ ID NO: 1214201 - protein, 12 aa, Mycobacterium
LTDDGGSGGLDA

SEQ ID NO: 1214202 - protein, 5 aa, Mycobacterium
LTDDP

SEQ ID NO: 1214203 - protein, 12 aa, Mycobacterium
LTDDQRSQIEEV

SEQ ID NO: 1214204 - protein, 5 aa, Mycobacterium
LTDEQ

SEQ ID NO: 1214205 - protein, 11 aa, Mycobacterium
LTDEQKVPDNL

SEQ ID NO: 1214206 - protein, 6 aa, Mycobacterium
LTDEQR

SEQ ID NO: 1214207 - protein, 15 aa, Mycobacterium
LTDGAKVEVVAAVQG

SEQ ID NO: 1214208 - protein, 6 aa, Mycobacterium
LTDGDG

SEQ ID NO: 1214209 - protein, 6 aa, Mycobacterium
LTDGGA

SEQ ID NO: 1214210 - protein, 8 aa, Mycobacterium
LTDGQGAD

SEQ ID NO: 1214211 - protein, 12 aa, Mycobacterium
LTDGSGGADAYA

SEQ ID NO: 1214212 - protein, 10 aa, Mycobacterium
LTDNGKQFTG

SEQ ID NO: 1214213 - protein, 4 aa, Mycobacterium
LTDP

SEQ ID NO: 1214214 - protein, 9 aa, Mycobacterium
LTDPKAGPL

SEQ ID NO: 1214215 - protein, 6 aa, Mycobacterium
LTDPTG

SEQ ID NO: 1214216 - protein, 6 aa, Mycobacterium
LTDPTH

SEQ ID NO: 1214217 - protein, 8 aa, Mycobacterium
LTDRDTER

SEQ ID NO: 1214218 - protein, 16 aa, Mycobacterium
LTDRGNVARDDDFATS

SEQ ID NO: 1214219 - protein, 10 aa, Mycobacterium
LTDRRDGYAQ

SEQ ID NO: 1214220 - protein, 7 aa, Mycobacterium
LTDRSEM

SEQ ID NO: 1214221 - protein, 4 aa, Mycobacterium
LTDS

SEQ ID NO: 1214222 - protein, 6 aa, Mycobacterium
LTDSPV

SEQ ID NO: 1214223 - protein, 8 aa, Mycobacterium
LTDSSSDL

SEQ ID NO: 1214224 - protein, 5 aa, Mycobacterium
LTDTE

SEQ ID NO: 1214225 - protein, 4 aa, Mycobacterium
LTEA

SEQ ID NO: 1214226 - protein, 6 aa, Mycobacterium
LTEAES

SEQ ID NO: 1214227 - protein, 9 aa, Mycobacterium
LTEAGRDTL

SEQ ID NO: 1214228 - protein, 5 aa, Mycobacterium
LTEDE

SEQ ID NO: 1214229 - protein, 7 aa, Mycobacterium
LTEDEVA

SEQ ID NO: 1214230 - protein, 5 aa, Mycobacterium
LTEDG

SEQ ID NO: 1214231 - protein, 7 aa, Mycobacterium
LTEDPER

SEQ ID NO: 1214232 - protein, 7 aa, Mycobacterium
LTEDQRR

SEQ ID NO: 1214233 - protein, 7 aa, Mycobacterium
LTEEQGM

SEQ ID NO: 1214234 - protein, 15 aa, Mycobacterium
LTEGDHDREHEEQDM

SEQ ID NO: 1214235 - protein, 5 aa, Mycobacterium
LTEGG

SEQ ID NO: 1214236 - protein, 13 aa, Mycobacterium
LTEGGNRPQLETP

SEQ ID NO: 1214237 - protein, 8 aa, Mycobacterium
LTENDPAK

SEQ ID NO: 1214238 - protein, 9 aa, Mycobacterium
LTENDPAKL

SEQ ID NO: 1214239 - protein, 5 aa, Mycobacterium
LTEPA

SEQ ID NO: 1214240 - protein, 6 aa, Mycobacterium
LTERAE

SEQ ID NO: 1214241 - protein, 5 aa, Mycobacterium
LTERG

SEQ ID NO: 1214242 - protein, 11 aa, Mycobacterium
LTERGEFETEN

SEQ ID NO: 1214243 - protein, 21 aa, Mycobacterium
LTESDDSALVTSARSKLPGLP

SEQ ID NO: 1214244 - protein, 20 aa, Mycobacterium
LTESDDSALVTSARTKLTGL

SEQ ID NO: 1214245 - protein, 12 aa, Mycobacterium
LTETPADRQGTI

SEQ ID NO: 1214246 - protein, 5 aa, Mycobacterium
LTETS

SEQ ID NO: 1214247 - protein, 7 aa, Mycobacterium
LTGAGDK

SEQ ID NO: 1214248 - protein, 15 aa, Mycobacterium
LTGAGKSQVGRRLGR

SEQ ID NO: 1214249 - protein, 7 aa, Mycobacterium
LTGAPTL

SEQ ID NO: 1214250 - protein, 27 aa, Mycobacterium
LTGAQRACDDARAELAQAREKSAARRA

SEQ ID NO: 1214251 - protein, 6 aa, Mycobacterium
LTGDPA

SEQ ID NO: 1214252 - protein, 15 aa, Mycobacterium
LTGDPRRWPNDHGTA

SEQ ID NO: 1214253 - protein, 8 aa, Mycobacterium
LTGEPAAD

SEQ ID NO: 1214254 - protein, 9 aa, Mycobacterium
LTGESPAAL

SEQ ID NO: 1214255 - protein, 10 aa, Mycobacterium
LTGESQAQAV

SEQ ID NO: 1214256 - protein, 5 aa, Mycobacterium
LTGEV

SEQ ID NO: 1214257 - protein, 6 aa, Mycobacterium
LTGGAE

SEQ ID NO: 1214258 - protein, 9 aa, Mycobacterium
LTGGASRTT

SEQ ID NO: 1214259 - protein, 10 aa, Mycobacterium
LTGGRGSDSV

SEQ ID NO: 1214260 - protein, 9 aa, Mycobacterium
LTGGTEKVR

SEQ ID NO: 1214261 - protein, 11 aa, Mycobacterium
LTGGTLAAQSL

SEQ ID NO: 1214262 - protein, 12 aa, Mycobacterium
LTGKSGSWTPEG

SEQ ID NO: 1214263 - protein, 11 aa, Mycobacterium
LTGKSKDEVNA

SEQ ID NO: 1214264 - protein, 6 aa, Mycobacterium
LTGLEP

SEQ ID NO: 1214265 - protein, 7 aa, Mycobacterium
LTGNDTS

SEQ ID NO: 1214266 - protein, 6 aa, Mycobacterium
LTGNQY

SEQ ID NO: 1214267 - protein, 7 aa, Mycobacterium
LTGPGGL

SEQ ID NO: 1214268 - protein, 5 aa, Mycobacterium
LTGPV

SEQ ID NO: 1214269 - protein, 6 aa, Mycobacterium
LTGQGG

SEQ ID NO: 1214270 - protein, 15 aa, Mycobacterium
LTGQPSKRAPFEPLP

SEQ ID NO: 1214271 - protein, 17 aa, Mycobacterium
LTGRAGTLTPHREVTAT

SEQ ID NO: 1214272 - protein, 7 aa, Mycobacterium
LTGRDHR

SEQ ID NO: 1214273 - protein, 7 aa, Mycobacterium
LTGRGTD

SEQ ID NO: 1214274 - protein, 11 aa, Mycobacterium
LTGSATGDVDT

SEQ ID NO: 1214275 - protein, 10 aa, Mycobacterium
LTGSVAASQR

SEQ ID NO: 1214276 - protein, 4 aa, Mycobacterium
LTGT

SEQ ID NO: 1214277 - protein, 12 aa, Mycobacterium
LTGTATKAQYEA

SEQ ID NO: 1214278 - protein, 6 aa, Mycobacterium
LTGTEA

SEQ ID NO: 1214279 - protein, 15 aa, Mycobacterium
LTGTETAAELAEAGR

SEQ ID NO: 1214280 - protein, 10 aa, Mycobacterium
LTGTKKGCDH

SEQ ID NO: 1214281 - protein, 6 aa, Mycobacterium
LTGTSD

SEQ ID NO: 1214282 - protein, 10 aa, Mycobacterium
LTGTTAPHNG

SEQ ID NO: 1214283 - protein, 6 aa, Mycobacterium
LTGTTE

SEQ ID NO: 1214284 - protein, 6 aa, Mycobacterium
LTGVDA

SEQ ID NO: 1214285 - protein, 11 aa, Mycobacterium
LTGYSRDEAKE

SEQ ID NO: 1214286 - protein, 4 aa, Mycobacterium
LTIP

SEQ ID NO: 1214287 - protein, 7 aa, Mycobacterium
LTKEQAE

SEQ ID NO: 1214288 - protein, 13 aa, Mycobacterium
LTKPRSPTTTGKI

SEQ ID NO: 1214289 - protein, 8 aa, Mycobacterium
LTKQQQDE

SEQ ID NO: 1214290 - protein, 5 aa, Mycobacterium
LTKRQ

SEQ ID NO: 1214291 - protein, 5 aa, Mycobacterium
LTNAE

SEQ ID NO: 1214292 - protein, 7 aa, Mycobacterium
LTNFGST

SEQ ID NO: 1214293 - protein, 10 aa, Mycobacterium
LTNMRSSTAD

SEQ ID NO: 1214294 - protein, 10 aa, Mycobacterium
LTNPASPRAG

SEQ ID NO: 1214295 - protein, 30 aa, Mycobacterium
LTNRNVNGDVGSDGSTPQQRAEAAGFSGAV

SEQ ID NO: 1214296 - protein, 4 aa, Mycobacterium
LTPA

SEQ ID NO: 1214297 - protein, 7 aa, Mycobacterium
LTPAGTA

SEQ ID NO: 1214298 - protein, 7 aa, Mycobacterium
LTPDDPG

SEQ ID NO: 1214299 - protein, 5 aa, Mycobacterium
LTPDE

SEQ ID NO: 1214300 - protein, 7 aa, Mycobacterium
LTPDEAA

SEQ ID NO: 1214301 - protein, 7 aa, Mycobacterium
LTPDEDQ

SEQ ID NO: 1214302 - protein, 5 aa, Mycobacterium
LTPDQ

SEQ ID NO: 1214303 - protein, 10 aa, Mycobacterium
LTPDSEPVLT

SEQ ID NO: 1214304 - protein, 6 aa, Mycobacterium
LTPDYR

SEQ ID NO: 1214305 - protein, 4 aa, Mycobacterium
LTPE

SEQ ID NO: 1214306 - protein, 6 aa, Mycobacterium
LTPEDV

SEQ ID NO: 1214307 - protein, 9 aa, Mycobacterium
LTPGARTTL

SEQ ID NO: 1214308 - protein, 7 aa, Mycobacterium
LTPGASA

SEQ ID NO: 1214309 - protein, 6 aa, Mycobacterium
LTPGDA

SEQ ID NO: 1214310 - protein, 11 aa, Mycobacterium
LTPGDGDKRTA

SEQ ID NO: 1214311 - protein, 5 aa, Mycobacterium
LTPGG

SEQ ID NO: 1214312 - protein, 9 aa, Mycobacterium
LTPGSHDKR

SEQ ID NO: 1214313 - protein, 13 aa, Mycobacterium
LTPGTVGSPGADA

SEQ ID NO: 1214314 - protein, 36 aa, Mycobacterium
LTPHPSTPQRPPAPAHATQSLDTSLAENENGNTIEV

SEQ ID NO: 1214315 - protein, 12 aa, Mycobacterium
LTPNGKLDRTAL

SEQ ID NO: 1214316 - protein, 12 aa, Mycobacterium
LTPNPKDHEVAA

SEQ ID NO: 1214317 - protein, 5 aa, Mycobacterium
LTPPD

SEQ ID NO: 1214318 - protein, 98 aa, Mycobacterium
LTPPGDPDLPGASAEPADTKNIGDTEPNNRAAGEADETRPAKTAAPVAGETRQAPCAEDATTSPADVNETRPVEPGSPIRSADSAGEPGGPAPPQNRA

SEQ ID NO: 1214319 - protein, 8 aa, Mycobacterium
LTPPQKRQ

SEQ ID NO: 1214320 - protein, 8 aa, Mycobacterium
LTPPSRAK

SEQ ID NO: 1214321 - protein, 4 aa, Mycobacterium
LTPQ

SEQ ID NO: 1214322 - protein, 7 aa, Mycobacterium
LTPQGTL

SEQ ID NO: 1214323 - protein, 5 aa, Mycobacterium
LTPQN

SEQ ID NO: 1214324 - protein, 14 aa, Mycobacterium
LTPRSIRTGGADRL

SEQ ID NO: 1214325 - protein, 10 aa, Mycobacterium
LTPSPQSRDM

SEQ ID NO: 1214326 - protein, 10 aa, Mycobacterium
LTPSSAHGVT

SEQ ID NO: 1214327 - protein, 8 aa, Mycobacterium
LTPTGSHC

SEQ ID NO: 1214328 - protein, 12 aa, Mycobacterium
LTPTSDKKPAPL

SEQ ID NO: 1214329 - protein, 6 aa, Mycobacterium
LTPVQK

SEQ ID NO: 1214330 - protein, 9 aa, Mycobacterium
LTPWSGTEY

SEQ ID NO: 1214331 - protein, 6 aa, Mycobacterium
LTPYAE

SEQ ID NO: 1214332 - protein, 7 aa, Mycobacterium
LTQEETI

SEQ ID NO: 1214333 - protein, 8 aa, Mycobacterium
LTQEPDTN

SEQ ID NO: 1214334 - protein, 5 aa, Mycobacterium
LTQGL

SEQ ID NO: 1214335 - protein, 8 aa, Mycobacterium
LTQGPGFP

SEQ ID NO: 1214336 - protein, 4 aa, Mycobacterium
LTQI

SEQ ID NO: 1214337 - protein, 7 aa, Mycobacterium
LTQPDGN

SEQ ID NO: 1214338 - protein, 6 aa, Mycobacterium
LTQPDR

SEQ ID NO: 1214339 - protein, 9 aa, Mycobacterium
LTQPPPGSI

SEQ ID NO: 1214340 - protein, 11 aa, Mycobacterium
LTQQSSGPLTR

SEQ ID NO: 1214341 - protein, 9 aa, Mycobacterium
LTQTHPDIP

SEQ ID NO: 1214342 - protein, 11 aa, Mycobacterium
LTQTHPDIPEQ

SEQ ID NO: 1214343 - protein, 10 aa, Mycobacterium
LTRASSEPRV

SEQ ID NO: 1214344 - protein, 8 aa, Mycobacterium
LTRDATQQ

SEQ ID NO: 1214345 - protein, 6 aa, Mycobacterium
LTRDGT

SEQ ID NO: 1214346 - protein, 4 aa, Mycobacterium
LTRH

SEQ ID NO: 1214347 - protein, 7 aa, Mycobacterium
LTRNPAT

SEQ ID NO: 1214348 - protein, 6 aa, Mycobacterium
LTRPGT

SEQ ID NO: 1214349 - protein, 9 aa, Mycobacterium
LTRRDQGQA

SEQ ID NO: 1214350 - protein, 8 aa, Mycobacterium
LTRRTGGW

SEQ ID NO: 1214351 - protein, 4 aa, Mycobacterium
LTRS

SEQ ID NO: 1214352 - protein, 10 aa, Mycobacterium
LTRSAELTND

SEQ ID NO: 1214353 - protein, 12 aa, Mycobacterium
LTRSPNTRISGS

SEQ ID NO: 1214354 - protein, 10 aa, Mycobacterium
LTRTPQSRST

SEQ ID NO: 1214355 - protein, 10 aa, Mycobacterium
LTSAASDDSV

SEQ ID NO: 1214356 - protein, 5 aa, Mycobacterium
LTSAR

SEQ ID NO: 1214357 - protein, 9 aa, Mycobacterium
LTSDDGYDL

SEQ ID NO: 1214358 - protein, 10 aa, Mycobacterium
LTSDPALRGA

SEQ ID NO: 1214359 - protein, 15 aa, Mycobacterium
LTSDPDPARAAAATK

SEQ ID NO: 1214360 - protein, 5 aa, Mycobacterium
LTSEP

SEQ ID NO: 1214361 - protein, 12 aa, Mycobacterium
LTSGGGGSAGAI

SEQ ID NO: 1214362 - protein, 7 aa, Mycobacterium
LTSGRAV

SEQ ID NO: 1214363 - protein, 6 aa, Mycobacterium
LTSGSK

SEQ ID NO: 1214364 - protein, 7 aa, Mycobacterium
LTSGYSP

SEQ ID NO: 1214365 - protein, 8 aa, Mycobacterium
LTSPARTA

SEQ ID NO: 1214366 - protein, 10 aa, Mycobacterium
LTSPDAKPGF

SEQ ID NO: 1214367 - protein, 8 aa, Mycobacterium
LTSPDGAY

SEQ ID NO: 1214368 - protein, 9 aa, Mycobacterium
LTSPDKPYF

SEQ ID NO: 1214369 - protein, 14 aa, Mycobacterium
LTSPDQHARPAPEM

SEQ ID NO: 1214370 - protein, 6 aa, Mycobacterium
LTSPGE

SEQ ID NO: 1214371 - protein, 5 aa, Mycobacterium
LTSPP

SEQ ID NO: 1214372 - protein, 13 aa, Mycobacterium
LTSPPSPVEADPH

SEQ ID NO: 1214373 - protein, 9 aa, Mycobacterium
LTSQGPDRV

SEQ ID NO: 1214374 - protein, 11 aa, Mycobacterium
LTSSSEDLKKL

SEQ ID NO: 1214375 - protein, 10 aa, Mycobacterium
LTSTGERTGY

SEQ ID NO: 1214376 - protein, 6 aa, Mycobacterium
LTSTGV

SEQ ID NO: 1214377 - protein, 6 aa, Mycobacterium
LTTAGS

SEQ ID NO: 1214378 - protein, 30 aa, Mycobacterium
LTTANPEHPPLAADPASVGAAGRLTTAGTT

SEQ ID NO: 1214379 - protein, 12 aa, Mycobacterium
LTTAPGNGAPLG

SEQ ID NO: 1214380 - protein, 9 aa, Mycobacterium
LTTDEERAR

SEQ ID NO: 1214381 - protein, 10 aa, Mycobacterium
LTTEDRRRAE

SEQ ID NO: 1214382 - protein, 11 aa, Mycobacterium
LTTEGGAESID

SEQ ID NO: 1214383 - protein, 6 aa, Mycobacterium
LTTGPV

SEQ ID NO: 1214384 - protein, 13 aa, Mycobacterium
LTTHQSDWNPGRF

SEQ ID NO: 1214385 - protein, 8 aa, Mycobacterium
LTTPDPAV

SEQ ID NO: 1214386 - protein, 8 aa, Mycobacterium
LTTPPPVE

SEQ ID NO: 1214387 - protein, 6 aa, Mycobacterium
LTTPTT

SEQ ID NO: 1214388 - protein, 6 aa, Mycobacterium
LTTQDT

SEQ ID NO: 1214389 - protein, 12 aa, Mycobacterium
LTTQLTRDDEEN

SEQ ID NO: 1214390 - protein, 10 aa, Mycobacterium
LTTSEEDLDS

SEQ ID NO: 1214391 - protein, 12 aa, Mycobacterium
LTTSRTINISRL

SEQ ID NO: 1214392 - protein, 10 aa, Mycobacterium
LTTSSRAGRL

SEQ ID NO: 1214393 - protein, 5 aa, Mycobacterium
LTTST

SEQ ID NO: 1214394 - protein, 8 aa, Mycobacterium
LTTTPSDD

SEQ ID NO: 1214395 - protein, 14 aa, Mycobacterium
LTTVPDGAAKDPTA

SEQ ID NO: 1214396 - protein, 14 aa, Mycobacterium
LTTVPDGAAVDPTA

SEQ ID NO: 1214397 - protein, 6 aa, Mycobacterium
LTVDGQ

SEQ ID NO: 1214398 - protein, 9 aa, Mycobacterium
LTVTTASRT

SEQ ID NO: 1214399 - protein, 12 aa, Mycobacterium
LTYENSATVTRP

SEQ ID NO: 1214400 - protein, 9 aa, Mycobacterium
LVEGKGQIE

SEQ ID NO: 1214401 - protein, 12 aa, Mycobacterium
LVETPARNLPPV

SEQ ID NO: 1214402 - protein, 7 aa, Mycobacterium
LVKSGGE

SEQ ID NO: 1214403 - protein, 6 aa, Mycobacterium
LVPEQT

SEQ ID NO: 1214404 - protein, 19 aa, Mycobacterium
LVPSGEDEEIQSSEAKVGP

SEQ ID NO: 1214405 - protein, 18 aa, Mycobacterium
LVPTTDEPQKAKDFTTDQ

SEQ ID NO: 1214406 - protein, 6 aa, Mycobacterium
LVRGSD

SEQ ID NO: 1214407 - protein, 40 aa, Mycobacterium
LVSGEPAGISEASPVGTFTPGSGDVAAGVPGSADAVPGRA

SEQ ID NO: 1214408 - protein, 12 aa, Mycobacterium
LVSGSDAKESRG

SEQ ID NO: 1214409 - protein, 4 aa, Mycobacterium
LVSP

SEQ ID NO: 1214410 - protein, 13 aa, Mycobacterium
LVSQRDDRVREDP

SEQ ID NO: 1214411 - protein, 8 aa, Mycobacterium
LVTEANRS

SEQ ID NO: 1214412 - protein, 8 aa, Mycobacterium
LYAPQAQN

SEQ ID NO: 1214413 - protein, 15 aa, Mycobacterium
LYDAGDDAGAAEAAN

SEQ ID NO: 1214414 - protein, 11 aa, Mycobacterium
LYDSDPRKGNA

SEQ ID NO: 1214415 - protein, 9 aa, Mycobacterium
LYGGTEPAR

SEQ ID NO: 1214416 - protein, 17 aa, Mycobacterium
LYSGPRPTNPKSHSDWT

SEQ ID NO: 1214417 - protein, 5 aa, Mycobacterium
LYSPL

SEQ ID NO: 1214418 - protein, 14 aa, Mycobacterium
LYSSSRKWTAGPRG

SEQ ID NO: 1214419 - protein, 13 aa, Mycobacterium
LYTSTDNGQTWQP

SEQ ID NO: 1214420 - protein, 13 aa, Mycobacterium
MAAAKAAGKVRIE

SEQ ID NO: 1214421 - protein, 12 aa, Mycobacterium
MAARDQAEGAKW

SEQ ID NO: 1214422 - protein, 8 aa, Mycobacterium
MADAGDDL

SEQ ID NO: 1214423 - protein, 9 aa, Mycobacterium
MADDNRSDL

SEQ ID NO: 1214424 - protein, 9 aa, Mycobacterium
MADPTALPT

SEQ ID NO: 1214425 - protein, 4 aa, Mycobacterium
MADR

SEQ ID NO: 1214426 - protein, 4 aa, Mycobacterium
MAED

SEQ ID NO: 1214427 - protein, 4 aa, Mycobacterium
MAER

SEQ ID NO: 1214428 - protein, 19 aa, Mycobacterium
MAERANAQAPTYRAPSTAL

SEQ ID NO: 1214429 - protein, 14 aa, Mycobacterium
MAERANAQAPTYRV

SEQ ID NO: 1214430 - protein, 6 aa, Mycobacterium
MAESGK

SEQ ID NO: 1214431 - protein, 12 aa, Mycobacterium
MAETSAGSNGGV

SEQ ID NO: 1214432 - protein, 7 aa, Mycobacterium
MAGGDEL

SEQ ID NO: 1214433 - protein, 5 aa, Mycobacterium
MAGGN

SEQ ID NO: 1214434 - protein, 10 aa, Mycobacterium
MAGKAGTFNV

SEQ ID NO: 1214435 - protein, 7 aa, Mycobacterium
MAGNGEW

SEQ ID NO: 1214436 - protein, 36 aa, Mycobacterium
MAHGPTQAGAAGAAPPAGGTPTGGGADALGQAAGQL

SEQ ID NO: 1214437 - protein, 29 aa, Mycobacterium
MAKRGRKKRDRKHSKANHGKRPNAGSKSV

SEQ ID NO: 1214438 - protein, 9 aa, Mycobacterium
MAPDPDGSI

SEQ ID NO: 1214439 - protein, 4 aa, Mycobacterium
MAPE

SEQ ID NO: 1214440 - protein, 8 aa, Mycobacterium
MAPNPAAA

SEQ ID NO: 1214441 - protein, 8 aa, Mycobacterium
MAPNPSAQ

SEQ ID NO: 1214442 - protein, 12 aa, Mycobacterium
MAPQTHDGEMKT

SEQ ID NO: 1214443 - protein, 4 aa, Mycobacterium
MAPT

SEQ ID NO: 1214444 - protein, 10 aa, Mycobacterium
MAQERGAEHT

SEQ ID NO: 1214445 - protein, 10 aa, Mycobacterium
MAQGTGKTHP

SEQ ID NO: 1214446 - protein, 9 aa, Mycobacterium
MAQPSPPVR

SEQ ID NO: 1214447 - protein, 8 aa, Mycobacterium
MARAKGGL

SEQ ID NO: 1214448 - protein, 7 aa, Mycobacterium
MATGPNL

SEQ ID NO: 1214449 - protein, 6 aa, Mycobacterium
MATPRH

SEQ ID NO: 1214450 - protein, 4 aa, Mycobacterium
MATS

SEQ ID NO: 1214451 - protein, 10 aa, Mycobacterium
MATSTPDAQQ

SEQ ID NO: 1214452 - protein, 30 aa, Mycobacterium
MCNPDDPEPCTSGTPSQAQIDNDHRSLAQR

SEQ ID NO: 1214453 - protein, 41 aa, Mycobacterium
MDAAGGGSMDAAGGGSMDAAGGGSEVVTNPAGWTGAKGAPT

SEQ ID NO: 1214454 - protein, 5 aa, Mycobacterium
MDAGE

SEQ ID NO: 1214455 - protein, 8 aa, Mycobacterium
MDAGEKAG

SEQ ID NO: 1214456 - protein, 23 aa, Mycobacterium
MDAPPPSEDFGRQPPHDAAAEQA

SEQ ID NO: 1214457 - protein, 8 aa, Mycobacterium
MDARTGTD

SEQ ID NO: 1214458 - protein, 4 aa, Mycobacterium
MDAS

SEQ ID NO: 1214459 - protein, 12 aa, Mycobacterium
MDATPPPTPRRP

SEQ ID NO: 1214460 - protein, 8 aa, Mycobacterium
MDDATKKQ

SEQ ID NO: 1214461 - protein, 4 aa, Mycobacterium
MDDD

SEQ ID NO: 1214462 - protein, 6 aa, Mycobacterium
MDEGTV

SEQ ID NO: 1214463 - protein, 10 aa, Mycobacterium
MDGAADDVAT

SEQ ID NO: 1214464 - protein, 7 aa, Mycobacterium
MDGGAQR

SEQ ID NO: 1214465 - protein, 11 aa, Mycobacterium
MDGGPHQPIAA

SEQ ID NO: 1214466 - protein, 8 aa, Mycobacterium
MDGPDGTV

SEQ ID NO: 1214467 - protein, 4 aa, Mycobacterium
MDGS

SEQ ID NO: 1214468 - protein, 11 aa, Mycobacterium
MDGSTTGGVAR

SEQ ID NO: 1214469 - protein, 5 aa, Mycobacterium
MDKRR

SEQ ID NO: 1214470 - protein, 5 aa, Mycobacterium
MDPAA

SEQ ID NO: 1214471 - protein, 5 aa, Mycobacterium
MDPNG

SEQ ID NO: 1214472 - protein, 5 aa, Mycobacterium
MDPQQ

SEQ ID NO: 1214473 - protein, 7 aa, Mycobacterium
MDPSGAE

SEQ ID NO: 1214474 - protein, 4 aa, Mycobacterium
MDPV

SEQ ID NO: 1214475 - protein, 7 aa, Mycobacterium
MDSAHRD

SEQ ID NO: 1214476 - protein, 6 aa, Mycobacterium
MDSGSP

SEQ ID NO: 1214477 - protein, 15 aa, Mycobacterium
MDSKGAADQLRTSAP

SEQ ID NO: 1214478 - protein, 21 aa, Mycobacterium
MDSSFGKNAANRVEESYGDAK

SEQ ID NO: 1214479 - protein, 9 aa, Mycobacterium
MDSTAPSVR

SEQ ID NO: 1214480 - protein, 8 aa, Mycobacterium
MDTPELRA

SEQ ID NO: 1214481 - protein, 12 aa, Mycobacterium
MEATSARGTRRI

SEQ ID NO: 1214482 - protein, 6 aa, Mycobacterium
MEDSEP

SEQ ID NO: 1214483 - protein, 8 aa, Mycobacterium
MEETQENL

SEQ ID NO: 1214484 - protein, 10 aa, Mycobacterium
MEGNSANGRR

SEQ ID NO: 1214485 - protein, 7 aa, Mycobacterium
MELPDSA

SEQ ID NO: 1214486 - protein, 17 aa, Mycobacterium
MENSADRSHDCEDRPDI

SEQ ID NO: 1214487 - protein, 11 aa, Mycobacterium
MEPNPSGSTGL

SEQ ID NO: 1214488 - protein, 53 aa, Mycobacterium
MEQAGESVDGPPDPDPEPDPPGGGSNPDDVAEGQERQQKSSSPSGQSAPPAHT

SEQ ID NO: 1214489 - protein, 9 aa, Mycobacterium
MERAEDELA

SEQ ID NO: 1214490 - protein, 7 aa, Mycobacterium
MERPNSG

SEQ ID NO: 1214491 - protein, 4 aa, Mycobacterium
MEST

SEQ ID NO: 1214492 - protein, 4 aa, Mycobacterium
METK

SEQ ID NO: 1214493 - protein, 7 aa, Mycobacterium
METNPQL

SEQ ID NO: 1214494 - protein, 5 aa, Mycobacterium
METSD

SEQ ID NO: 1214495 - protein, 10 aa, Mycobacterium
MGAEEAERAG

SEQ ID NO: 1214496 - protein, 8 aa, Mycobacterium
MGAGEGNA

SEQ ID NO: 1214497 - protein, 7 aa, Mycobacterium
MGAGPSV

SEQ ID NO: 1214498 - protein, 6 aa, Mycobacterium
MGAPHA

SEQ ID NO: 1214499 - protein, 7 aa, Mycobacterium
MGATPTG

SEQ ID NO: 1214500 - protein, 4 aa, Mycobacterium
MGDH

SEQ ID NO: 1214501 - protein, 8 aa, Mycobacterium
MGDKTKRA

SEQ ID NO: 1214502 - protein, 22 aa, Mycobacterium
MGEAPGDAQGSEGATGSPIVTV

SEQ ID NO: 1214503 - protein, 10 aa, Mycobacterium
MGEHRTYPEP

SEQ ID NO: 1214504 - protein, 14 aa, Mycobacterium
MGEPAAASVEGSVA

SEQ ID NO: 1214505 - protein, 5 aa, Mycobacterium
MGEPE

SEQ ID NO: 1214506 - protein, 9 aa, Mycobacterium
MGGAAGGRL

SEQ ID NO: 1214507 - protein, 12 aa, Mycobacterium
MGGDASAAELSR

SEQ ID NO: 1214508 - protein, 29 aa, Mycobacterium
MGGDRKYRGAYRRGEPQNTSLPQSVVPNT

SEQ ID NO: 1214509 - protein, 9 aa, Mycobacterium
MGGGRERAE

SEQ ID NO: 1214510 - protein, 6 aa, Mycobacterium
MGGMGG

SEQ ID NO: 1214511 - protein, 8 aa, Mycobacterium
MGGRPSGF

SEQ ID NO: 1214512 - protein, 17 aa, Mycobacterium
MGGRTAAQAIEDGVEPR

SEQ ID NO: 1214513 - protein, 7 aa, Mycobacterium
MGGTAEV

SEQ ID NO: 1214514 - protein, 5 aa, Mycobacterium
MGGTS

SEQ ID NO: 1214515 - protein, 8 aa, Mycobacterium
MGGVTGSA

SEQ ID NO: 1214516 - protein, 4 aa, Mycobacterium
MGPA

SEQ ID NO: 1214517 - protein, 15 aa, Mycobacterium
MGPDSDHDSAPTDLR

SEQ ID NO: 1214518 - protein, 9 aa, Mycobacterium
MGPEDDDVV

SEQ ID NO: 1214519 - protein, 6 aa, Mycobacterium
MGPEYK

SEQ ID NO: 1214520 - protein, 4 aa, Mycobacterium
MGPH

SEQ ID NO: 1214521 - protein, 8 aa, Mycobacterium
MGPPADPE

SEQ ID NO: 1214522 - protein, 8 aa, Mycobacterium
MGPREVSG

SEQ ID NO: 1214523 - protein, 6 aa, Mycobacterium
MGPYPS

SEQ ID NO: 1214524 - protein, 4 aa, Mycobacterium
MGQA

SEQ ID NO: 1214525 - protein, 10 aa, Mycobacterium
MGRPGTVDEI

SEQ ID NO: 1214526 - protein, 5 aa, Mycobacterium
MGRTP

SEQ ID NO: 1214527 - protein, 6 aa, Mycobacterium
MGRTPG

SEQ ID NO: 1214528 - protein, 11 aa, Mycobacterium
MGSAHDTYKSG

SEQ ID NO: 1214529 - protein, 8 aa, Mycobacterium
MGSDGKLG

SEQ ID NO: 1214530 - protein, 4 aa, Mycobacterium
MGST

SEQ ID NO: 1214531 - protein, 13 aa, Mycobacterium
MGTGLSGGATALD

SEQ ID NO: 1214532 - protein, 13 aa, Mycobacterium
MGYAPAENDADDQ

SEQ ID NO: 1214533 - protein, 9 aa, Mycobacterium
MHDEPGKPW

SEQ ID NO: 1214534 - protein, 5 aa, Mycobacterium
MHGPD

SEQ ID NO: 1214535 - protein, 8 aa, Mycobacterium
MHSTESDY

SEQ ID NO: 1214536 - protein, 13 aa, Mycobacterium
MIKTGGENVASRE

SEQ ID NO: 1214537 - protein, 8 aa, Mycobacterium
MKAKQSQA

SEQ ID NO: 1214538 - protein, 7 aa, Mycobacterium
MKETGAD

SEQ ID NO: 1214539 - protein, 9 aa, Mycobacterium
MKNPDRGYA

SEQ ID NO: 1214540 - protein, 10 aa, Mycobacterium
MKPEAEAAKD

SEQ ID NO: 1214541 - protein, 4 aa, Mycobacterium
MKPG

SEQ ID NO: 1214542 - protein, 9 aa, Mycobacterium
MKPQGIRDA

SEQ ID NO: 1214543 - protein, 8 aa, Mycobacterium
MKRGAAEK

SEQ ID NO: 1214544 - protein, 18 aa, Mycobacterium
MKSAGFPGTMPNPYRERS

SEQ ID NO: 1214545 - protein, 8 aa, Mycobacterium
MKTAGGGS

SEQ ID NO: 1214546 - protein, 9 aa, Mycobacterium
MKTGEGKTL

SEQ ID NO: 1214547 - protein, 5 aa, Mycobacterium
MLPPR

SEQ ID NO: 1214548 - protein, 15 aa, Mycobacterium
MNDGTAGGYQNNTAP

SEQ ID NO: 1214549 - protein, 6 aa, Mycobacterium
MNDSPL

SEQ ID NO: 1214550 - protein, 9 aa, Mycobacterium
MNPAPYSVN

SEQ ID NO: 1214551 - protein, 10 aa, Mycobacterium
MNPDGRHPVS

SEQ ID NO: 1214552 - protein, 4 aa, Mycobacterium
MNPE

SEQ ID NO: 1214553 - protein, 8 aa, Mycobacterium
MNPEDLRK

SEQ ID NO: 1214554 - protein, 4 aa, Mycobacterium
MNPG

SEQ ID NO: 1214555 - protein, 16 aa, Mycobacterium
MNPPPERDGSSGDRQY

SEQ ID NO: 1214556 - protein, 10 aa, Mycobacterium
MNPPSRQTTV

SEQ ID NO: 1214557 - protein, 7 aa, Mycobacterium
MNPRDRR

SEQ ID NO: 1214558 - protein, 10 aa, Mycobacterium
MNQDTARQRL

SEQ ID NO: 1214559 - protein, 4 aa, Mycobacterium
MNSY

SEQ ID NO: 1214560 - protein, 8 aa, Mycobacterium
MNTPDSPA

SEQ ID NO: 1214561 - protein, 13 aa, Mycobacterium
MPAEQSKQNPTSG

SEQ ID NO: 1214562 - protein, 5 aa, Mycobacterium
MPAGC

SEQ ID NO: 1214563 - protein, 8 aa, Mycobacterium
MPAGRTSD

SEQ ID NO: 1214564 - protein, 6 aa, Mycobacterium
MPAHSD

SEQ ID NO: 1214565 - protein, 11 aa, Mycobacterium
MPANRPDTDSL

SEQ ID NO: 1214566 - protein, 4 aa, Mycobacterium
MPAP

SEQ ID NO: 1214567 - protein, 7 aa, Mycobacterium
MPAPGRA

SEQ ID NO: 1214568 - protein, 6 aa, Mycobacterium
MPATIT

SEQ ID NO: 1214569 - protein, 10 aa, Mycobacterium
MPDAATERAI

SEQ ID NO: 1214570 - protein, 4 aa, Mycobacterium
MPDD

SEQ ID NO: 1214571 - protein, 6 aa, Mycobacterium
MPDDRT

SEQ ID NO: 1214572 - protein, 8 aa, Mycobacterium
MPDGGASA

SEQ ID NO: 1214573 - protein, 5 aa, Mycobacterium
MPDGQ

SEQ ID NO: 1214574 - protein, 6 aa, Mycobacterium
MPDKER

SEQ ID NO: 1214575 - protein, 6 aa, Mycobacterium
MPDNAT

SEQ ID NO: 1214576 - protein, 8 aa, Mycobacterium
MPDRQRNV

SEQ ID NO: 1214577 - protein, 6 aa, Mycobacterium
MPDSPH

SEQ ID NO: 1214578 - protein, 7 aa, Mycobacterium
MPDSRVA

SEQ ID NO: 1214579 - protein, 8 aa, Mycobacterium
MPDSSGAH

SEQ ID NO: 1214580 - protein, 6 aa, Mycobacterium
MPEEQL

SEQ ID NO: 1214581 - protein, 7 aa, Mycobacterium
MPEPRHD

SEQ ID NO: 1214582 - protein, 16 aa, Mycobacterium
MPETAKGAIEPDDPEI

SEQ ID NO: 1214583 - protein, 4 aa, Mycobacterium
MPGA

SEQ ID NO: 1214584 - protein, 11 aa, Mycobacterium
MPGADVTQQQL

SEQ ID NO: 1214585 - protein, 11 aa, Mycobacterium
MPGANAESVAE

SEQ ID NO: 1214586 - protein, 5 aa, Mycobacterium
MPGAP

SEQ ID NO: 1214587 - protein, 5 aa, Mycobacterium
MPGAR

SEQ ID NO: 1214588 - protein, 4 aa, Mycobacterium
MPGE

SEQ ID NO: 1214589 - protein, 4 aa, Mycobacterium
MPGG

SEQ ID NO: 1214590 - protein, 38 aa, Mycobacterium
MPGGAGQGGGADERNAKPKQVVGKDRPHTESVTGKVTA

SEQ ID NO: 1214591 - protein, 9 aa, Mycobacterium
MPGGESAQQ

SEQ ID NO: 1214592 - protein, 23 aa, Mycobacterium
MPGHGGMPSASAAPSESGAPTQS

SEQ ID NO: 1214593 - protein, 24 aa, Mycobacterium
MPGHSGMPSASAAPSESGTPTQSM

SEQ ID NO: 1214594 - protein, 9 aa, Mycobacterium
MPGNAESLN

SEQ ID NO: 1214595 - protein, 6 aa, Mycobacterium
MPGPGG

SEQ ID NO: 1214596 - protein, 11 aa, Mycobacterium
MPKPGRQRAPI

SEQ ID NO: 1214597 - protein, 22 aa, Mycobacterium
MPKRRRTRAAEEAARIKAEREC

SEQ ID NO: 1214598 - protein, 4 aa, Mycobacterium
MPNP

SEQ ID NO: 1214599 - protein, 13 aa, Mycobacterium
MPNPKTGTVTPDV

SEQ ID NO: 1214600 - protein, 13 aa, Mycobacterium
MPNPKTGTVTPEL

SEQ ID NO: 1214601 - protein, 4 aa, Mycobacterium
MPPA

SEQ ID NO: 1214602 - protein, 8 aa, Mycobacterium
MPPQGSLK

SEQ ID NO: 1214603 - protein, 7 aa, Mycobacterium
MPPRERN

SEQ ID NO: 1214604 - protein, 7 aa, Mycobacterium
MPPRGSK

SEQ ID NO: 1214605 - protein, 9 aa, Mycobacterium
MPPRPGERD

SEQ ID NO: 1214606 - protein, 5 aa, Mycobacterium
MPPSG

SEQ ID NO: 1214607 - protein, 18 aa, Mycobacterium
MPPTDPRYVDGGPGSEVP

SEQ ID NO: 1214608 - protein, 9 aa, Mycobacterium
MPPTTGTGM

SEQ ID NO: 1214609 - protein, 8 aa, Mycobacterium
MPQGSKGV

SEQ ID NO: 1214610 - protein, 5 aa, Mycobacterium
MPQNF

SEQ ID NO: 1214611 - protein, 11 aa, Mycobacterium
MPQTESPRPYY

SEQ ID NO: 1214612 - protein, 11 aa, Mycobacterium
MPQTPAERTWH

SEQ ID NO: 1214613 - protein, 4 aa, Mycobacterium
MPRA

SEQ ID NO: 1214614 - protein, 9 aa, Mycobacterium
MPRGGPDAS

SEQ ID NO: 1214615 - protein, 12 aa, Mycobacterium
MPRNNRGRGSFD

SEQ ID NO: 1214616 - protein, 4 aa, Mycobacterium
MPRP

SEQ ID NO: 1214617 - protein, 17 aa, Mycobacterium
MPRRSGKSNLRAVRDGT

SEQ ID NO: 1214618 - protein, 5 aa, Mycobacterium
MPRSS

SEQ ID NO: 1214619 - protein, 12 aa, Mycobacterium
MPRTASMNRAGR

SEQ ID NO: 1214620 - protein, 12 aa, Mycobacterium
MPSATAQRPGDV

SEQ ID NO: 1214621 - protein, 14 aa, Mycobacterium
MPSPAPRDTDPASP

SEQ ID NO: 1214622 - protein, 5 aa, Mycobacterium
MPSQR

SEQ ID NO: 1214623 - protein, 22 aa, Mycobacterium
MPSSKSELTVTATASAATDTEV

SEQ ID NO: 1214624 - protein, 4 aa, Mycobacterium
MPSV

SEQ ID NO: 1214625 - protein, 12 aa, Mycobacterium
MPTATSNAQSGV

SEQ ID NO: 1214626 - protein, 10 aa, Mycobacterium
MPTDPATGTL

SEQ ID NO: 1214627 - protein, 7 aa, Mycobacterium
MPTPATP

SEQ ID NO: 1214628 - protein, 6 aa, Mycobacterium
MPTPGD

SEQ ID NO: 1214629 - protein, 8 aa, Mycobacterium
MPTSEDLA

SEQ ID NO: 1214630 - protein, 18 aa, Mycobacterium
MPTTQADTINADLLEFIR

SEQ ID NO: 1214631 - protein, 10 aa, Mycobacterium
MPVTEGSSFT

SEQ ID NO: 1214632 - protein, 8 aa, Mycobacterium
MPYTPGAE

SEQ ID NO: 1214633 - protein, 9 aa, Mycobacterium
MQAQAAGGS

SEQ ID NO: 1214634 - protein, 9 aa, Mycobacterium
MQDRGPDTT

SEQ ID NO: 1214635 - protein, 15 aa, Mycobacterium
MQDTSSNGDAQDWRG

SEQ ID NO: 1214636 - protein, 11 aa, Mycobacterium
MQEPTDQPWGA

SEQ ID NO: 1214637 - protein, 19 aa, Mycobacterium
MQGRGAGGNLRGSYSKDRY

SEQ ID NO: 1214638 - protein, 7 aa, Mycobacterium
MQHQSQA

SEQ ID NO: 1214639 - protein, 5 aa, Mycobacterium
MQRPE

SEQ ID NO: 1214640 - protein, 11 aa, Mycobacterium
MQSDDPAYRGN

SEQ ID NO: 1214641 - protein, 6 aa, Mycobacterium
MRDGAG

SEQ ID NO: 1214642 - protein, 15 aa, Mycobacterium
MRDNAEKMQQRIRDR

SEQ ID NO: 1214643 - protein, 7 aa, Mycobacterium
MRDPSRY

SEQ ID NO: 1214644 - protein, 8 aa, Mycobacterium
MRERPKVT

SEQ ID NO: 1214645 - protein, 6 aa, Mycobacterium
MRERRR

SEQ ID NO: 1214646 - protein, 11 aa, Mycobacterium
MRETRGAADHV

SEQ ID NO: 1214647 - protein, 4 aa, Mycobacterium
MRGT

SEQ ID NO: 1214648 - protein, 7 aa, Mycobacterium
MRPASGS

SEQ ID NO: 1214649 - protein, 8 aa, Mycobacterium
MRPDGRHD

SEQ ID NO: 1214650 - protein, 17 aa, Mycobacterium
MRPGSSSGWHTHPGPEH

SEQ ID NO: 1214651 - protein, 4 aa, Mycobacterium
MRPL

SEQ ID NO: 1214652 - protein, 19 aa, Mycobacterium
MRPRPTSRPVTSQRIVEAD

SEQ ID NO: 1214653 - protein, 8 aa, Mycobacterium
MRPSGGRA

SEQ ID NO: 1214654 - protein, 11 aa, Mycobacterium
MRPSLDPSTVK

SEQ ID NO: 1214655 - protein, 10 aa, Mycobacterium
MRQGLKSSKM

SEQ ID NO: 1214656 - protein, 13 aa, Mycobacterium
MRQPQREDPGEHL

SEQ ID NO: 1214657 - protein, 10 aa, Mycobacterium
MRRAPQPGWD

SEQ ID NO: 1214658 - protein, 12 aa, Mycobacterium
MRRKGSDRRQIT

SEQ ID NO: 1214659 - protein, 9 aa, Mycobacterium
MRSAGSADW

SEQ ID NO: 1214660 - protein, 5 aa, Mycobacterium
MRSGG

SEQ ID NO: 1214661 - protein, 15 aa, Mycobacterium
MRSTNRAGGLEGGMT

SEQ ID NO: 1214662 - protein, 8 aa, Mycobacterium
MRTGTEKL

SEQ ID NO: 1214663 - protein, 4 aa, Mycobacterium
MRYG

SEQ ID NO: 1214664 - protein, 9 aa, Mycobacterium
MSAAATALR

SEQ ID NO: 1214665 - protein, 10 aa, Mycobacterium
MSAARERAEE

SEQ ID NO: 1214666 - protein, 11 aa, Mycobacterium
MSAEEREETGN

SEQ ID NO: 1214667 - protein, 17 aa, Mycobacterium
MSAERAAELEAQANAVQ

SEQ ID NO: 1214668 - protein, 20 aa, Mycobacterium
MSAGDPEAAGLRKDAERNRR

SEQ ID NO: 1214669 - protein, 10 aa, Mycobacterium
MSAGEEAAAA

SEQ ID NO: 1214670 - protein, 5 aa, Mycobacterium
MSAKG

SEQ ID NO: 1214671 - protein, 6 aa, Mycobacterium
MSAQGG

SEQ ID NO: 1214672 - protein, 10 aa, Mycobacterium
MSATDGGRAP

SEQ ID NO: 1214673 - protein, 7 aa, Mycobacterium
MSDPEEA

SEQ ID NO: 1214674 - protein, 8 aa, Mycobacterium
MSDPETGH

SEQ ID NO: 1214675 - protein, 15 aa, Mycobacterium
MSDPQSVKDLAEQAG

SEQ ID NO: 1214676 - protein, 7 aa, Mycobacterium
MSDSTSE

SEQ ID NO: 1214677 - protein, 8 aa, Mycobacterium
MSEEDKAA

SEQ ID NO: 1214678 - protein, 13 aa, Mycobacterium
MSEEKDESTMAEE

SEQ ID NO: 1214679 - protein, 15 aa, Mycobacterium
MSEEKDESTMAEEQA

SEQ ID NO: 1214680 - protein, 5 aa, Mycobacterium
MSEEP

SEQ ID NO: 1214681 - protein, 5 aa, Mycobacterium
MSEEQ

SEQ ID NO: 1214682 - protein, 8 aa, Mycobacterium
MSERARSL

SEQ ID NO: 1214683 - protein, 6 aa, Mycobacterium
MSETAG

SEQ ID NO: 1214684 - protein, 15 aa, Mycobacterium
MSGAGASLPARTRAG

SEQ ID NO: 1214685 - protein, 12 aa, Mycobacterium
MSGKPNVPTLPG

SEQ ID NO: 1214686 - protein, 13 aa, Mycobacterium
MSGRMGSDRVTTQ

SEQ ID NO: 1214687 - protein, 14 aa, Mycobacterium
MSGRSESRAQLTDR

SEQ ID NO: 1214688 - protein, 8 aa, Mycobacterium
MSGTPGPA

SEQ ID NO: 1214689 - protein, 7 aa, Mycobacterium
MSHPDHD

SEQ ID NO: 1214690 - protein, 10 aa, Mycobacterium
MSIPGDGKLE

SEQ ID NO: 1214691 - protein, 10 aa, Mycobacterium
MSNTDPAPAE

SEQ ID NO: 1214692 - protein, 14 aa, Mycobacterium
MSPAEAAAGTSRTP

SEQ ID NO: 1214693 - protein, 9 aa, Mycobacterium
MSPDDGEPV

SEQ ID NO: 1214694 - protein, 14 aa, Mycobacterium
MSPPGSGRLRSAVA

SEQ ID NO: 1214695 - protein, 7 aa, Mycobacterium
MSPSYPE

SEQ ID NO: 1214696 - protein, 7 aa, Mycobacterium
MSPTNSF

SEQ ID NO: 1214697 - protein, 7 aa, Mycobacterium
MSQYTRG

SEQ ID NO: 1214698 - protein, 10 aa, Mycobacterium
MSRSTGRGEA

SEQ ID NO: 1214699 - protein, 5 aa, Mycobacterium
MSSAG

SEQ ID NO: 1214700 - protein, 8 aa, Mycobacterium
MSSGPITR

SEQ ID NO: 1214701 - protein, 7 aa, Mycobacterium
MSSGWES

SEQ ID NO: 1214702 - protein, 13 aa, Mycobacterium
MSSPEAGSGTPEQ

SEQ ID NO: 1214703 - protein, 17 aa, Mycobacterium
MSSSGKGQSKIDGPEGV

SEQ ID NO: 1214704 - protein, 4 aa, Mycobacterium
MSTD

SEQ ID NO: 1214705 - protein, 9 aa, Mycobacterium
MSTGRSVGA

SEQ ID NO: 1214706 - protein, 10 aa, Mycobacterium
MSTGSSSVAD

SEQ ID NO: 1214707 - protein, 11 aa, Mycobacterium
MSTNPQRSGPH

SEQ ID NO: 1214708 - protein, 8 aa, Mycobacterium
MSTPDTGA

SEQ ID NO: 1214709 - protein, 5 aa, Mycobacterium
MSTQL

SEQ ID NO: 1214710 - protein, 11 aa, Mycobacterium
MSTQPKSDVMT

SEQ ID NO: 1214711 - protein, 5 aa, Mycobacterium
MSTRD

SEQ ID NO: 1214712 - protein, 11 aa, Mycobacterium
MSTRNRQITGT

SEQ ID NO: 1214713 - protein, 7 aa, Mycobacterium
MSTSQSA

SEQ ID NO: 1214714 - protein, 8 aa, Mycobacterium
MTAEDDEI

SEQ ID NO: 1214715 - protein, 18 aa, Mycobacterium
MTAQQKRDARREVASGEA

SEQ ID NO: 1214716 - protein, 7 aa, Mycobacterium
MTATQRA

SEQ ID NO: 1214717 - protein, 8 aa, Mycobacterium
MTDAGARV

SEQ ID NO: 1214718 - protein, 4 aa, Mycobacterium
MTDG

SEQ ID NO: 1214719 - protein, 9 aa, Mycobacterium
MTDSAGRPL

SEQ ID NO: 1214720 - protein, 6 aa, Mycobacterium
MTEELG

SEQ ID NO: 1214721 - protein, 9 aa, Mycobacterium
MTEGPGESW

SEQ ID NO: 1214722 - protein, 27 aa, Mycobacterium
MTEKQGGSDVRAGTTEATPNGDGTYSL

SEQ ID NO: 1214723 - protein, 8 aa, Mycobacterium
MTENAEQR

SEQ ID NO: 1214724 - protein, 8 aa, Mycobacterium
MTEPGPAG

SEQ ID NO: 1214725 - protein, 10 aa, Mycobacterium
MTEPPRGIPD

SEQ ID NO: 1214726 - protein, 15 aa, Mycobacterium
MTEPTDRDLDTDQHA

SEQ ID NO: 1214727 - protein, 8 aa, Mycobacterium
MTETSAAI

SEQ ID NO: 1214728 - protein, 16 aa, Mycobacterium
MTGATAASTAAARMNG

SEQ ID NO: 1214729 - protein, 24 aa, Mycobacterium
MTGDPQGPPTLPGYSSADNSTGLT

SEQ ID NO: 1214730 - protein, 9 aa, Mycobacterium
MTGETVTAP

SEQ ID NO: 1214731 - protein, 15 aa, Mycobacterium
MTGGQEPNKGVNPDE

SEQ ID NO: 1214732 - protein, 14 aa, Mycobacterium
MTGPGAWPETDESV

SEQ ID NO: 1214733 - protein, 14 aa, Mycobacterium
MTGQAGLIDGGMVY

SEQ ID NO: 1214734 - protein, 6 aa, Mycobacterium
MTGQTS

SEQ ID NO: 1214735 - protein, 6 aa, Mycobacterium
MTGRPL

SEQ ID NO: 1214736 - protein, 12 aa, Mycobacterium
MTGSGTATAAAR

SEQ ID NO: 1214737 - protein, 12 aa, Mycobacterium
MTGTARSEASEF

SEQ ID NO: 1214738 - protein, 13 aa, Mycobacterium
MTGTSPSAFARAT

SEQ ID NO: 1214739 - protein, 6 aa, Mycobacterium
MTLDKD

SEQ ID NO: 1214740 - protein, 7 aa, Mycobacterium
MTNGKTA

SEQ ID NO: 1214741 - protein, 6 aa, Mycobacterium
MTPADA

SEQ ID NO: 1214742 - protein, 7 aa, Mycobacterium
MTPEQRG

SEQ ID NO: 1214743 - protein, 13 aa, Mycobacterium
MTPGGPTGFPGDA

SEQ ID NO: 1214744 - protein, 13 aa, Mycobacterium
MTPPTEVARPDDA

SEQ ID NO: 1214745 - protein, 6 aa, Mycobacterium
MTPSGA

SEQ ID NO: 1214746 - protein, 6 aa, Mycobacterium
MTPTEA

SEQ ID NO: 1214747 - protein, 11 aa, Mycobacterium
MTQMTDKSAPR

SEQ ID NO: 1214748 - protein, 7 aa, Mycobacterium
MTQSGTV

SEQ ID NO: 1214749 - protein, 12 aa, Mycobacterium
MTQTHPGIPEEL

SEQ ID NO: 1214750 - protein, 5 aa, Mycobacterium
MTRGD

SEQ ID NO: 1214751 - protein, 9 aa, Mycobacterium
MTRPDYEEQ

SEQ ID NO: 1214752 - protein, 4 aa, Mycobacterium
MTRT

SEQ ID NO: 1214753 - protein, 8 aa, Mycobacterium
MTSHPNSL

SEQ ID NO: 1214754 - protein, 23 aa, Mycobacterium
MTSPSTKPGCYRPRDKLLAFLEG

SEQ ID NO: 1214755 - protein, 8 aa, Mycobacterium
MTSQRSTI

SEQ ID NO: 1214756 - protein, 6 aa, Mycobacterium
MTSSTR

SEQ ID NO: 1214757 - protein, 7 aa, Mycobacterium
MTTPGER

SEQ ID NO: 1214758 - protein, 11 aa, Mycobacterium
MTTPKGTTADG

SEQ ID NO: 1214759 - protein, 9 aa, Mycobacterium
MTTPSGTDW

SEQ ID NO: 1214760 - protein, 9 aa, Mycobacterium
MTTSRGDQR

SEQ ID NO: 1214761 - protein, 5 aa, Mycobacterium
MVAGP

SEQ ID NO: 1214762 - protein, 7 aa, Mycobacterium
MVGESRG

SEQ ID NO: 1214763 - protein, 13 aa, Mycobacterium
MYETGAGGSAPKH

SEQ ID NO: 1214764 - protein, 21 aa, Mycobacterium
NAAAGRDIRDDPGAGAAGGIG

SEQ ID NO: 1214765 - protein, 9 aa, Mycobacterium
NAAARTSPA

SEQ ID NO: 1214766 - protein, 6 aa, Mycobacterium
NAADTV

SEQ ID NO: 1214767 - protein, 9 aa, Mycobacterium
NAAEPGDQR

SEQ ID NO: 1214768 - protein, 9 aa, Mycobacterium
NAAGDDWPP

SEQ ID NO: 1214769 - protein, 6 aa, Mycobacterium
NAAGEG

SEQ ID NO: 1214770 - protein, 9 aa, Mycobacterium
NAAGETRTA

SEQ ID NO: 1214771 - protein, 8 aa, Mycobacterium
NAAGRPVR

SEQ ID NO: 1214772 - protein, 6 aa, Mycobacterium
NAAPRY

SEQ ID NO: 1214773 - protein, 7 aa, Mycobacterium
NAAQASR

SEQ ID NO: 1214774 - protein, 9 aa, Mycobacterium
NAAQGKPVD

SEQ ID NO: 1214775 - protein, 9 aa, Mycobacterium
NAARTTVAT

SEQ ID NO: 1214776 - protein, 9 aa, Mycobacterium
NAASAGRRY

SEQ ID NO: 1214777 - protein, 5 aa, Mycobacterium
NAASI

SEQ ID NO: 1214778 - protein, 6 aa, Mycobacterium
NAASLG

SEQ ID NO: 1214779 - protein, 16 aa, Mycobacterium
NAASSTRNSDKPATDF

SEQ ID NO: 1214780 - protein, 17 aa, Mycobacterium
NAATAALASDGLTGWPR

SEQ ID NO: 1214781 - protein, 20 aa, Mycobacterium
NAATAERDAEFRANAQAKEA

SEQ ID NO: 1214782 - protein, 5 aa, Mycobacterium
NAATD

SEQ ID NO: 1214783 - protein, 10 aa, Mycobacterium
NAATGPDDAV

SEQ ID NO: 1214784 - protein, 11 aa, Mycobacterium
NAATPAGQPPR

SEQ ID NO: 1214785 - protein, 7 aa, Mycobacterium
NAATTAG

SEQ ID NO: 1214786 - protein, 35 aa, Mycobacterium
NAATTRASSWAARRSAARKRAPTGPSMSAPPPAVV

SEQ ID NO: 1214787 - protein, 6 aa, Mycobacterium
NADAHG

SEQ ID NO: 1214788 - protein, 12 aa, Mycobacterium
NADDAEAEAEVK

SEQ ID NO: 1214789 - protein, 8 aa, Mycobacterium
NADDERLP

SEQ ID NO: 1214790 - protein, 8 aa, Mycobacterium
NADDTSPK

SEQ ID NO: 1214791 - protein, 9 aa, Mycobacterium
NADEDTQRR

SEQ ID NO: 1214792 - protein, 10 aa, Mycobacterium
NADERDASEA

SEQ ID NO: 1214793 - protein, 6 aa, Mycobacterium
NADGGL

SEQ ID NO: 1214794 - protein, 4 aa, Mycobacterium
NADK

SEQ ID NO: 1214795 - protein, 7 aa, Mycobacterium
NADKDIS

SEQ ID NO: 1214796 - protein, 7 aa, Mycobacterium
NADLSAV

SEQ ID NO: 1214797 - protein, 4 aa, Mycobacterium
NADM

SEQ ID NO: 1214798 - protein, 7 aa, Mycobacterium
NADPASV

SEQ ID NO: 1214799 - protein, 6 aa, Mycobacterium
NADPDL

SEQ ID NO: 1214800 - protein, 10 aa, Mycobacterium
NADPGHSPEA

SEQ ID NO: 1214801 - protein, 13 aa, Mycobacterium
NADPNGGDVTVAF

SEQ ID NO: 1214802 - protein, 4 aa, Mycobacterium
NADT

SEQ ID NO: 1214803 - protein, 5 aa, Mycobacterium
NADTA

SEQ ID NO: 1214804 - protein, 6 aa, Mycobacterium
NADTAA

SEQ ID NO: 1214805 - protein, 6 aa, Mycobacterium
NADTSV

SEQ ID NO: 1214806 - protein, 22 aa, Mycobacterium
NAEAGDSTDEVNTDPDATDDEE

SEQ ID NO: 1214807 - protein, 17 aa, Mycobacterium
NAEAPPRYERAPSTTSA

SEQ ID NO: 1214808 - protein, 8 aa, Mycobacterium
NAEEAQQR

SEQ ID NO: 1214809 - protein, 6 aa, Mycobacterium
NAEEGR

SEQ ID NO: 1214810 - protein, 4 aa, Mycobacterium
NAEG

SEQ ID NO: 1214811 - protein, 5 aa, Mycobacterium
NAEGS

SEQ ID NO: 1214812 - protein, 15 aa, Mycobacterium
NAEHGAVDAADDGLQ

SEQ ID NO: 1214813 - protein, 13 aa, Mycobacterium
NAEHSSTGLRSAE

SEQ ID NO: 1214814 - protein, 10 aa, Mycobacterium
NAEKDTSQWV

SEQ ID NO: 1214815 - protein, 10 aa, Mycobacterium
NAEKGNANSF

SEQ ID NO: 1214816 - protein, 7 aa, Mycobacterium
NAELSGD

SEQ ID NO: 1214817 - protein, 5 aa, Mycobacterium
NAEPV

SEQ ID NO: 1214818 - protein, 4 aa, Mycobacterium
NAER

SEQ ID NO: 1214819 - protein, 15 aa, Mycobacterium
NAERQGSKKSGKLKD

SEQ ID NO: 1214820 - protein, 5 aa, Mycobacterium
NAETS

SEQ ID NO: 1214821 - protein, 5 aa, Mycobacterium
NAETT

SEQ ID NO: 1214822 - protein, 11 aa, Mycobacterium
NAEVNGQAGGG

SEQ ID NO: 1214823 - protein, 6 aa, Mycobacterium
NAEVSG

SEQ ID NO: 1214824 - protein, 7 aa, Mycobacterium
NAEVSGS

SEQ ID NO: 1214825 - protein, 9 aa, Mycobacterium
NAFDADAET

SEQ ID NO: 1214826 - protein, 8 aa, Mycobacterium
NAFSTDAR

SEQ ID NO: 1214827 - protein, 8 aa, Mycobacterium
NAFSTGAR

SEQ ID NO: 1214828 - protein, 17 aa, Mycobacterium
NAGATPDSLNNKKRPRT

SEQ ID NO: 1214829 - protein, 5 aa, Mycobacterium
NAGCS

SEQ ID NO: 1214830 - protein, 12 aa, Mycobacterium
NAGDGTHEHPTQ

SEQ ID NO: 1214831 - protein, 11 aa, Mycobacterium
NAGGARGLESV

SEQ ID NO: 1214832 - protein, 7 aa, Mycobacterium
NAGGDRL

SEQ ID NO: 1214833 - protein, 6 aa, Mycobacterium
NAGGGD

SEQ ID NO: 1214834 - protein, 6 aa, Mycobacterium
NAGGLA

SEQ ID NO: 1214835 - protein, 7 aa, Mycobacterium
NAGGRIH

SEQ ID NO: 1214836 - protein, 7 aa, Mycobacterium
NAGGSPY

SEQ ID NO: 1214837 - protein, 10 aa, Mycobacterium
NAGHGGISGR

SEQ ID NO: 1214838 - protein, 10 aa, Mycobacterium
NAGHLGPGRT

SEQ ID NO: 1214839 - protein, 5 aa, Mycobacterium
NAGKD

SEQ ID NO: 1214840 - protein, 7 aa, Mycobacterium
NAGLRED

SEQ ID NO: 1214841 - protein, 5 aa, Mycobacterium
NAGLT

SEQ ID NO: 1214842 - protein, 15 aa, Mycobacterium
NAGMAESVEGKEFPR

SEQ ID NO: 1214843 - protein, 13 aa, Mycobacterium
NAGNAGAEGFGGR

SEQ ID NO: 1214844 - protein, 6 aa, Mycobacterium
NAGQKT

SEQ ID NO: 1214845 - protein, 11 aa, Mycobacterium
NAGSPDVDPNR

SEQ ID NO: 1214846 - protein, 9 aa, Mycobacterium
NAGSPEVDT

SEQ ID NO: 1214847 - protein, 19 aa, Mycobacterium
NAGTASKGQPVGDTPGADF

SEQ ID NO: 1214848 - protein, 18 aa, Mycobacterium
NAGTELRPQNPPPGTESA

SEQ ID NO: 1214849 - protein, 11 aa, Mycobacterium
NAGTGKTAAAE

SEQ ID NO: 1214850 - protein, 9 aa, Mycobacterium
NAGTPLTAG

SEQ ID NO: 1214851 - protein, 10 aa, Mycobacterium
NAGTSPVDPE

SEQ ID NO: 1214852 - protein, 18 aa, Mycobacterium
NAGVAGSEAALAAFRTAF

SEQ ID NO: 1214853 - protein, 8 aa, Mycobacterium
NAHPDAVA

SEQ ID NO: 1214854 - protein, 13 aa, Mycobacterium
NAHTGEPAARRRV

SEQ ID NO: 1214855 - protein, 4 aa, Mycobacterium
NAIA

SEQ ID NO: 1214856 - protein, 7 aa, Mycobacterium
NAKAGDI

SEQ ID NO: 1214857 - protein, 9 aa, Mycobacterium
NAKDRTVAS

SEQ ID NO: 1214858 - protein, 8 aa, Mycobacterium
NAKGVSVT

SEQ ID NO: 1214859 - protein, 5 aa, Mycobacterium
NAKPQ

SEQ ID NO: 1214860 - protein, 14 aa, Mycobacterium
NAKRDGASAWSGVS

SEQ ID NO: 1214861 - protein, 4 aa, Mycobacterium
NAKT

SEQ ID NO: 1214862 - protein, 20 aa, Mycobacterium
NALDPGTASTIASAANSHAG

SEQ ID NO: 1214863 - protein, 10 aa, Mycobacterium
NALESHPAVA

SEQ ID NO: 1214864 - protein, 5 aa, Mycobacterium
NALPN

SEQ ID NO: 1214865 - protein, 6 aa, Mycobacterium
NALPRR

SEQ ID NO: 1214866 - protein, 6 aa, Mycobacterium
NALPTP

SEQ ID NO: 1214867 - protein, 8 aa, Mycobacterium
NALQTGAV

SEQ ID NO: 1214868 - protein, 6 aa, Mycobacterium
NANADA

SEQ ID NO: 1214869 - protein, 10 aa, Mycobacterium
NANATELSNY

SEQ ID NO: 1214870 - protein, 8 aa, Mycobacterium
NANHTEGA

SEQ ID NO: 1214871 - protein, 6 aa, Mycobacterium
NANPAC

SEQ ID NO: 1214872 - protein, 9 aa, Mycobacterium
NANPASDEV

SEQ ID NO: 1214873 - protein, 7 aa, Mycobacterium
NANPECT

SEQ ID NO: 1214874 - protein, 8 aa, Mycobacterium
NANQKLQD

SEQ ID NO: 1214875 - protein, 13 aa, Mycobacterium
NAPARTPAGEQVS

SEQ ID NO: 1214876 - protein, 4 aa, Mycobacterium
NAPE

SEQ ID NO: 1214877 - protein, 6 aa, Mycobacterium
NAPEAT

SEQ ID NO: 1214878 - protein, 12 aa, Mycobacterium
NAPEKTAEAQHP

SEQ ID NO: 1214879 - protein, 8 aa, Mycobacterium
NAPGLSEL

SEQ ID NO: 1214880 - protein, 9 aa, Mycobacterium
NAPGRSTQR

SEQ ID NO: 1214881 - protein, 16 aa, Mycobacterium
NAPGSAQLRGRDGDGE

SEQ ID NO: 1214882 - protein, 7 aa, Mycobacterium
NAPHTTR

SEQ ID NO: 1214883 - protein, 6 aa, Mycobacterium
NAPLAV

SEQ ID NO: 1214884 - protein, 13 aa, Mycobacterium
NAPLSVAAGKATA

SEQ ID NO: 1214885 - protein, 7 aa, Mycobacterium
NAPNKLT

SEQ ID NO: 1214886 - protein, 4 aa, Mycobacterium
NAPP

SEQ ID NO: 1214887 - protein, 6 aa, Mycobacterium
NAPPAD

SEQ ID NO: 1214888 - protein, 14 aa, Mycobacterium
NAPPPSAPAPQDPA

SEQ ID NO: 1214889 - protein, 9 aa, Mycobacterium
NAPQLDAAG

SEQ ID NO: 1214890 - protein, 4 aa, Mycobacterium
NAPR

SEQ ID NO: 1214891 - protein, 8 aa, Mycobacterium
NAPRGDGM

SEQ ID NO: 1214892 - protein, 13 aa, Mycobacterium
NAPSTTLGDGGTH

SEQ ID NO: 1214893 - protein, 4 aa, Mycobacterium
NAPT

SEQ ID NO: 1214894 - protein, 5 aa, Mycobacterium
NAPTL

SEQ ID NO: 1214895 - protein, 6 aa, Mycobacterium
NAPTVA

SEQ ID NO: 1214896 - protein, 7 aa, Mycobacterium
NAPVQQR

SEQ ID NO: 1214897 - protein, 7 aa, Mycobacterium
NAQDLND

SEQ ID NO: 1214898 - protein, 8 aa, Mycobacterium
NAQGAEAS

SEQ ID NO: 1214899 - protein, 14 aa, Mycobacterium
NAQNSVAVSGERSA

SEQ ID NO: 1214900 - protein, 6 aa, Mycobacterium
NAQPTK

SEQ ID NO: 1214901 - protein, 5 aa, Mycobacterium
NAQQE

SEQ ID NO: 1214902 - protein, 7 aa, Mycobacterium
NAQRSIT

SEQ ID NO: 1214903 - protein, 9 aa, Mycobacterium
NAQSQVEQA

SEQ ID NO: 1214904 - protein, 6 aa, Mycobacterium
NAQTVR

SEQ ID NO: 1214905 - protein, 8 aa, Mycobacterium
NARAEAES

SEQ ID NO: 1214906 - protein, 7 aa, Mycobacterium
NARAETL

SEQ ID NO: 1214907 - protein, 12 aa, Mycobacterium
NARATAALSDAG

SEQ ID NO: 1214908 - protein, 7 aa, Mycobacterium
NARDTAE

SEQ ID NO: 1214909 - protein, 8 aa, Mycobacterium
NARFTEES

SEQ ID NO: 1214910 - protein, 7 aa, Mycobacterium
NARGLDP

SEQ ID NO: 1214911 - protein, 20 aa, Mycobacterium
NARHGLDNPNARYRKESSVE

SEQ ID NO: 1214912 - protein, 8 aa, Mycobacterium
NARMQGTV

SEQ ID NO: 1214913 - protein, 8 aa, Mycobacterium
NARNGQSL

SEQ ID NO: 1214914 - protein, 6 aa, Mycobacterium
NARPGV

SEQ ID NO: 1214915 - protein, 12 aa, Mycobacterium
NARRNPRAQTRD

SEQ ID NO: 1214916 - protein, 7 aa, Mycobacterium
NARYSPP

SEQ ID NO: 1214917 - protein, 16 aa, Mycobacterium
NASAGWANKVGARSAQ

SEQ ID NO: 1214918 - protein, 9 aa, Mycobacterium
NASAPRFQA

SEQ ID NO: 1214919 - protein, 10 aa, Mycobacterium
NASATGGKKV

SEQ ID NO: 1214920 - protein, 6 aa, Mycobacterium
NASDAL

SEQ ID NO: 1214921 - protein, 11 aa, Mycobacterium
NASDDLRESPN

SEQ ID NO: 1214922 - protein, 6 aa, Mycobacterium
NASGSA

SEQ ID NO: 1214923 - protein, 5 aa, Mycobacterium
NASLG

SEQ ID NO: 1214924 - protein, 10 aa, Mycobacterium
NASPADGEAA

SEQ ID NO: 1214925 - protein, 6 aa, Mycobacterium
NASPAE

SEQ ID NO: 1214926 - protein, 8 aa, Mycobacterium
NASPAQAT

SEQ ID NO: 1214927 - protein, 17 aa, Mycobacterium
NASPARTARRISPDGAP

SEQ ID NO: 1214928 - protein, 8 aa, Mycobacterium
NASPGGDD

SEQ ID NO: 1214929 - protein, 5 aa, Mycobacterium
NASQA

SEQ ID NO: 1214930 - protein, 20 aa, Mycobacterium
NASQGVDGLEATPDKSTTTV

SEQ ID NO: 1214931 - protein, 17 aa, Mycobacterium
NASQNANRNATEQQQAS

SEQ ID NO: 1214932 - protein, 9 aa, Mycobacterium
NASRDAEQV

SEQ ID NO: 1214933 - protein, 9 aa, Mycobacterium
NASRGPSAG

SEQ ID NO: 1214934 - protein, 10 aa, Mycobacterium
NASRRNSYDA

SEQ ID NO: 1214935 - protein, 10 aa, Mycobacterium
NASSDGTAAV

SEQ ID NO: 1214936 - protein, 5 aa, Mycobacterium
NASSV

SEQ ID NO: 1214937 - protein, 11 aa, Mycobacterium
NASTPGSWAGY

SEQ ID NO: 1214938 - protein, 46 aa, Mycobacterium
NASTTAITVPETTDVDAGKTGDVTPSTDGAAAVDTTVGSGAPTEVE

SEQ ID NO: 1214939 - protein, 6 aa, Mycobacterium
NASVSQ

SEQ ID NO: 1214940 - protein, 5 aa, Mycobacterium
NATDV

SEQ ID NO: 1214941 - protein, 6 aa, Mycobacterium
NATGLT

SEQ ID NO: 1214942 - protein, 14 aa, Mycobacterium
NATGQAPDSINESA

SEQ ID NO: 1214943 - protein, 10 aa, Mycobacterium
NATPAGVPET

SEQ ID NO: 1214944 - protein, 7 aa, Mycobacterium
NATPEEA

SEQ ID NO: 1214945 - protein, 17 aa, Mycobacterium
NATPRKRDDPRQGGEEA

SEQ ID NO: 1214946 - protein, 15 aa, Mycobacterium
NATRGNIDVKLVVTD

SEQ ID NO: 1214947 - protein, 23 aa, Mycobacterium
NATSAAQHAASEKAGNSENADGA

SEQ ID NO: 1214948 - protein, 9 aa, Mycobacterium
NATVEGRPK

SEQ ID NO: 1214949 - protein, 12 aa, Mycobacterium
NATYAVEEPGCG

SEQ ID NO: 1214950 - protein, 10 aa, Mycobacterium
NAVGPGEQSA

SEQ ID NO: 1214951 - protein, 11 aa, Mycobacterium
NAVPADPNGAW

SEQ ID NO: 1214952 - protein, 20 aa, Mycobacterium
NAVPSQTTAVRGWESMPTIV

SEQ ID NO: 1214953 - protein, 13 aa, Mycobacterium
NAYAAASDKGELP

SEQ ID NO: 1214954 - protein, 9 aa, Mycobacterium
NAYAGSNRS

SEQ ID NO: 1214955 - protein, 5 aa, Mycobacterium
NAYSI

SEQ ID NO: 1214956 - protein, 5 aa, Mycobacterium
NCADG

SEQ ID NO: 1214957 - protein, 5 aa, Mycobacterium
NCAPS

SEQ ID NO: 1214958 - protein, 6 aa, Mycobacterium
NCGSTH

SEQ ID NO: 1214959 - protein, 5 aa, Mycobacterium
NCSPA

SEQ ID NO: 1214960 - protein, 6 aa, Mycobacterium
NCTDPR

SEQ ID NO: 1214961 - protein, 4 aa, Mycobacterium
NDAA

SEQ ID NO: 1214962 - protein, 9 aa, Mycobacterium
NDAADAERV

SEQ ID NO: 1214963 - protein, 7 aa, Mycobacterium
NDAATGA

SEQ ID NO: 1214964 - protein, 12 aa, Mycobacterium
NDADKAREIGRG

SEQ ID NO: 1214965 - protein, 12 aa, Mycobacterium
NDAGGSPGAADF

SEQ ID NO: 1214966 - protein, 8 aa, Mycobacterium
NDANAGAV

SEQ ID NO: 1214967 - protein, 7 aa, Mycobacterium
NDAPIRA

SEQ ID NO: 1214968 - protein, 5 aa, Mycobacterium
NDARQ

SEQ ID NO: 1214969 - protein, 43 aa, Mycobacterium
NDASRMPGTNVPGFAPGQRLGPLPGPAPEAPASTAPAPTAPAP

SEQ ID NO: 1214970 - protein, 15 aa, Mycobacterium
NDDAELQRGESMEER

SEQ ID NO: 1214971 - protein, 9 aa, Mycobacterium
NDDEKRAAA

SEQ ID NO: 1214972 - protein, 10 aa, Mycobacterium
NDDGAYEEPW

SEQ ID NO: 1214973 - protein, 7 aa, Mycobacterium
NDDGSIA

SEQ ID NO: 1214974 - protein, 9 aa, Mycobacterium
NDDRDAAEQ

SEQ ID NO: 1214975 - protein, 7 aa, Mycobacterium
NDDTRTA

SEQ ID NO: 1214976 - protein, 10 aa, Mycobacterium
NDEAAEAQRM

SEQ ID NO: 1214977 - protein, 5 aa, Mycobacterium
NDEAL

SEQ ID NO: 1214978 - protein, 7 aa, Mycobacterium
NDEALRQ

SEQ ID NO: 1214979 - protein, 8 aa, Mycobacterium
NDEEARDR

SEQ ID NO: 1214980 - protein, 5 aa, Mycobacterium
NDEGS

SEQ ID NO: 1214981 - protein, 7 aa, Mycobacterium
NDELSDR

SEQ ID NO: 1214982 - protein, 11 aa, Mycobacterium
NDEPPALDEDE

SEQ ID NO: 1214983 - protein, 6 aa, Mycobacterium
NDEQRD

SEQ ID NO: 1214984 - protein, 9 aa, Mycobacterium
NDERTSVEG

SEQ ID NO: 1214985 - protein, 9 aa, Mycobacterium
NDETQAPTI

SEQ ID NO: 1214986 - protein, 7 aa, Mycobacterium
NDEVGGT

SEQ ID NO: 1214987 - protein, 7 aa, Mycobacterium
NDEYDNE

SEQ ID NO: 1214988 - protein, 11 aa, Mycobacterium
NDGAARGEDPL

SEQ ID NO: 1214989 - protein, 6 aa, Mycobacterium
NDGDLR

SEQ ID NO: 1214990 - protein, 5 aa, Mycobacterium
NDGEK

SEQ ID NO: 1214991 - protein, 8 aa, Mycobacterium
NDGGDAAA

SEQ ID NO: 1214992 - protein, 8 aa, Mycobacterium
NDGGTEKL

SEQ ID NO: 1214993 - protein, 9 aa, Mycobacterium
NDGQKMSKS

SEQ ID NO: 1214994 - protein, 17 aa, Mycobacterium
NDGRHLSRPMPSDGPYQ

SEQ ID NO: 1214995 - protein, 8 aa, Mycobacterium
NDGRPSQL

SEQ ID NO: 1214996 - protein, 6 aa, Mycobacterium
NDGTAI

SEQ ID NO: 1214997 - protein, 10 aa, Mycobacterium
NDGVVGGPFE

SEQ ID NO: 1214998 - protein, 5 aa, Mycobacterium
NDGYA

SEQ ID NO: 1214999 - protein, 5 aa, Mycobacterium
NDHEN

SEQ ID NO: 1215000 - protein, 6 aa, Mycobacterium
NDHPGE

SEQ ID NO: 1215001 - protein, 18 aa, Mycobacterium
NDHRDDNELTDITAEVRA

SEQ ID NO: 1215002 - protein, 4 aa, Mycobacterium
NDIP

SEQ ID NO: 1215003 - protein, 15 aa, Mycobacterium
NDKQAAQQAAEARHA

SEQ ID NO: 1215004 - protein, 17 aa, Mycobacterium
NDKTGHGALVSVQNVQP

SEQ ID NO: 1215005 - protein, 4 aa, Mycobacterium
NDLA

SEQ ID NO: 1215006 - protein, 5 aa, Mycobacterium
NDLRD

SEQ ID NO: 1215007 - protein, 8 aa, Mycobacterium
NDLSEGDW

SEQ ID NO: 1215008 - protein, 6 aa, Mycobacterium
NDLTED

SEQ ID NO: 1215009 - protein, 8 aa, Mycobacterium
NDMAPRDR

SEQ ID NO: 1215010 - protein, 7 aa, Mycobacterium
NDMGTTY

SEQ ID NO: 1215011 - protein, 4 aa, Mycobacterium
NDND

SEQ ID NO: 1215012 - protein, 13 aa, Mycobacterium
NDNETEADDKAAH

SEQ ID NO: 1215013 - protein, 9 aa, Mycobacterium
NDNPFSESE

SEQ ID NO: 1215014 - protein, 12 aa, Mycobacterium
NDPATGQPMTTS

SEQ ID NO: 1215015 - protein, 8 aa, Mycobacterium
NDPDRRNA

SEQ ID NO: 1215016 - protein, 7 aa, Mycobacterium
NDPEAEG

SEQ ID NO: 1215017 - protein, 6 aa, Mycobacterium
NDPEKR

SEQ ID NO: 1215018 - protein, 8 aa, Mycobacterium
NDPGMDGT

SEQ ID NO: 1215019 - protein, 12 aa, Mycobacterium
NDPKVSARETPH

SEQ ID NO: 1215020 - protein, 5 aa, Mycobacterium
NDPLG

SEQ ID NO: 1215021 - protein, 16 aa, Mycobacterium
NDPPAGNPRPRRRTGA

SEQ ID NO: 1215022 - protein, 9 aa, Mycobacterium
NDPPGPEQL

SEQ ID NO: 1215023 - protein, 5 aa, Mycobacterium
NDPRN

SEQ ID NO: 1215024 - protein, 14 aa, Mycobacterium
NDPRTLDERRNDAH

SEQ ID NO: 1215025 - protein, 4 aa, Mycobacterium
NDPS

SEQ ID NO: 1215026 - protein, 8 aa, Mycobacterium
NDPSLDAT

SEQ ID NO: 1215027 - protein, 6 aa, Mycobacterium
NDPTGL

SEQ ID NO: 1215028 - protein, 8 aa, Mycobacterium
NDPTSVDL

SEQ ID NO: 1215029 - protein, 7 aa, Mycobacterium
NDPTVAD

SEQ ID NO: 1215030 - protein, 5 aa, Mycobacterium
NDPYK

SEQ ID NO: 1215031 - protein, 8 aa, Mycobacterium
NDPYPSAR

SEQ ID NO: 1215032 - protein, 9 aa, Mycobacterium
NDQGATDER

SEQ ID NO: 1215033 - protein, 9 aa, Mycobacterium
NDQGEPPYR

SEQ ID NO: 1215034 - protein, 5 aa, Mycobacterium
NDRCQ

SEQ ID NO: 1215035 - protein, 5 aa, Mycobacterium
NDRGA

SEQ ID NO: 1215036 - protein, 6 aa, Mycobacterium
NDRGSA

SEQ ID NO: 1215037 - protein, 16 aa, Mycobacterium
NDRPAKPSTTVAPGDQ

SEQ ID NO: 1215038 - protein, 15 aa, Mycobacterium
NDRQRPADVSAARTG

SEQ ID NO: 1215039 - protein, 5 aa, Mycobacterium
NDRRK

SEQ ID NO: 1215040 - protein, 6 aa, Mycobacterium
NDSANN

SEQ ID NO: 1215041 - protein, 7 aa, Mycobacterium
NDSDESW

SEQ ID NO: 1215042 - protein, 19 aa, Mycobacterium
NDSGGALDGEGADTGPAQA

SEQ ID NO: 1215043 - protein, 7 aa, Mycobacterium
NDSPADV

SEQ ID NO: 1215044 - protein, 7 aa, Mycobacterium
NDSPAGE

SEQ ID NO: 1215045 - protein, 10 aa, Mycobacterium
NDSPDTDRSG

SEQ ID NO: 1215046 - protein, 5 aa, Mycobacterium
NDSRY

SEQ ID NO: 1215047 - protein, 7 aa, Mycobacterium
NDTAQRW

SEQ ID NO: 1215048 - protein, 6 aa, Mycobacterium
NDTGGG

SEQ ID NO: 1215049 - protein, 7 aa, Mycobacterium
NDTNYGL

SEQ ID NO: 1215050 - protein, 12 aa, Mycobacterium
NDTRNTLESWLK

SEQ ID NO: 1215051 - protein, 8 aa, Mycobacterium
NDVDRGEV

SEQ ID NO: 1215052 - protein, 13 aa, Mycobacterium
NDVSARDAAVPMS

SEQ ID NO: 1215053 - protein, 12 aa, Mycobacterium
NDYADRKNGRQA

SEQ ID NO: 1215054 - protein, 11 aa, Mycobacterium
NDYSDANGFPE

SEQ ID NO: 1215055 - protein, 5 aa, Mycobacterium
NDYSV

SEQ ID NO: 1215056 - protein, 7 aa, Mycobacterium
NEADEPA

SEQ ID NO: 1215057 - protein, 12 aa, Mycobacterium
NEAGAEQPDAWQ

SEQ ID NO: 1215058 - protein, 11 aa, Mycobacterium
NEAGPGTPGEV

SEQ ID NO: 1215059 - protein, 6 aa, Mycobacterium
NEAGQY

SEQ ID NO: 1215060 - protein, 10 aa, Mycobacterium
NEAGSTASFT

SEQ ID NO: 1215061 - protein, 7 aa, Mycobacterium
NEAQYNS

SEQ ID NO: 1215062 - protein, 16 aa, Mycobacterium
NEARAQPGNFATADSV

SEQ ID NO: 1215063 - protein, 10 aa, Mycobacterium
NEARGLDPAL

SEQ ID NO: 1215064 - protein, 8 aa, Mycobacterium
NEASDRDI

SEQ ID NO: 1215065 - protein, 11 aa, Mycobacterium
NEATDGTGGAV

SEQ ID NO: 1215066 - protein, 5 aa, Mycobacterium
NEATS

SEQ ID NO: 1215067 - protein, 4 aa, Mycobacterium
NECP

SEQ ID NO: 1215068 - protein, 5 aa, Mycobacterium
NEDDV

SEQ ID NO: 1215069 - protein, 5 aa, Mycobacterium
NEDEA

SEQ ID NO: 1215070 - protein, 13 aa, Mycobacterium
NEDLPNTTNPDDW

SEQ ID NO: 1215071 - protein, 9 aa, Mycobacterium
NEDPVEAPT

SEQ ID NO: 1215072 - protein, 5 aa, Mycobacterium
NEDSR

SEQ ID NO: 1215073 - protein, 7 aa, Mycobacterium
NEDTEID

SEQ ID NO: 1215074 - protein, 5 aa, Mycobacterium
NEEPQ

SEQ ID NO: 1215075 - protein, 6 aa, Mycobacterium
NEEQGV

SEQ ID NO: 1215076 - protein, 19 aa, Mycobacterium
NEGDRQAGEIYSSPRPGEQ

SEQ ID NO: 1215077 - protein, 11 aa, Mycobacterium
NEGEDTASGTQ

SEQ ID NO: 1215078 - protein, 4 aa, Mycobacterium
NEGF

SEQ ID NO: 1215079 - protein, 6 aa, Mycobacterium
NEGGLH

SEQ ID NO: 1215080 - protein, 4 aa, Mycobacterium
NEGI

SEQ ID NO: 1215081 - protein, 9 aa, Mycobacterium
NEGKGDASC

SEQ ID NO: 1215082 - protein, 10 aa, Mycobacterium
NEGKTPKTVK

SEQ ID NO: 1215083 - protein, 7 aa, Mycobacterium
NEGLRSR

SEQ ID NO: 1215084 - protein, 21 aa, Mycobacterium
NEGRVKAAQAEKDAKAAKEAA

SEQ ID NO: 1215085 - protein, 9 aa, Mycobacterium
NEGTEGAER

SEQ ID NO: 1215086 - protein, 13 aa, Mycobacterium
NEGTEGAERAVEG

SEQ ID NO: 1215087 - protein, 4 aa, Mycobacterium
NEGY

SEQ ID NO: 1215088 - protein, 13 aa, Mycobacterium
NEHGTDERPSHSK

SEQ ID NO: 1215089 - protein, 8 aa, Mycobacterium
NEHNQPIN

SEQ ID NO: 1215090 - protein, 6 aa, Mycobacterium
NEIGIT

SEQ ID NO: 1215091 - protein, 21 aa, Mycobacterium
NEKHNEANGEDNNDGESHNRS

SEQ ID NO: 1215092 - protein, 9 aa, Mycobacterium
NEKSQLQNK

SEQ ID NO: 1215093 - protein, 8 aa, Mycobacterium
NELAEARR

SEQ ID NO: 1215094 - protein, 10 aa, Mycobacterium
NEPDERPELA

SEQ ID NO: 1215095 - protein, 10 aa, Mycobacterium
NEPEPGAWPN

SEQ ID NO: 1215096 - protein, 18 aa, Mycobacterium
NEPETGPVDAEPEAPSTL

SEQ ID NO: 1215097 - protein, 9 aa, Mycobacterium
NEPGERREL

SEQ ID NO: 1215098 - protein, 9 aa, Mycobacterium
NEPGLSGAE

SEQ ID NO: 1215099 - protein, 4 aa, Mycobacterium
NEPV

SEQ ID NO: 1215100 - protein, 13 aa, Mycobacterium
NEQHEKDADSAIA

SEQ ID NO: 1215101 - protein, 11 aa, Mycobacterium
NEQQKREYTEY

SEQ ID NO: 1215102 - protein, 10 aa, Mycobacterium
NEQSARAEAV

SEQ ID NO: 1215103 - protein, 7 aa, Mycobacterium
NERASTT

SEQ ID NO: 1215104 - protein, 6 aa, Mycobacterium
NERGET

SEQ ID NO: 1215105 - protein, 5 aa, Mycobacterium
NERIS

SEQ ID NO: 1215106 - protein, 12 aa, Mycobacterium
NERQSARARRET

SEQ ID NO: 1215107 - protein, 8 aa, Mycobacterium
NESAASAG

SEQ ID NO: 1215108 - protein, 6 aa, Mycobacterium
NESQED

SEQ ID NO: 1215109 - protein, 6 aa, Mycobacterium
NESYKE

SEQ ID NO: 1215110 - protein, 6 aa, Mycobacterium
NETDPV

SEQ ID NO: 1215111 - protein, 7 aa, Mycobacterium
NETGAPS

SEQ ID NO: 1215112 - protein, 8 aa, Mycobacterium
NETGTRAR

SEQ ID NO: 1215113 - protein, 4 aa, Mycobacterium
NETW

SEQ ID NO: 1215114 - protein, 5 aa, Mycobacterium
NEVAA

SEQ ID NO: 1215115 - protein, 105 aa, Mycobacterium
NEVPDDVEDTVTPQDTQDEVEASEGDGAAPTGTSADHAEVSEATAEDRDVTADDAEAPGDETRSTEDVDREATEPDSESDDTVTQNDAEPRESAADTAAEDSGPS

SEQ ID NO: 1215116 - protein, 5 aa, Mycobacterium
NEVTR

SEQ ID NO: 1215117 - protein, 7 aa, Mycobacterium
NEVTVPK

SEQ ID NO: 1215118 - protein, 6 aa, Mycobacterium
NEYEAT

SEQ ID NO: 1215119 - protein, 15 aa, Mycobacterium
NEYPLATSRDLEEAG

SEQ ID NO: 1215120 - protein, 5 aa, Mycobacterium
NFAPA

SEQ ID NO: 1215121 - protein, 8 aa, Mycobacterium
NFDGPSSL

SEQ ID NO: 1215122 - protein, 7 aa, Mycobacterium
NFDNDEA

SEQ ID NO: 1215123 - protein, 6 aa, Mycobacterium
NFDNGA

SEQ ID NO: 1215124 - protein, 12 aa, Mycobacterium
NFDPKRLDPESR

SEQ ID NO: 1215125 - protein, 5 aa, Mycobacterium
NFEGG

SEQ ID NO: 1215126 - protein, 10 aa, Mycobacterium
NFGEDPSWKD

SEQ ID NO: 1215127 - protein, 7 aa, Mycobacterium
NFGPRGA

SEQ ID NO: 1215128 - protein, 11 aa, Mycobacterium
NFKTKSGLTTN

SEQ ID NO: 1215129 - protein, 10 aa, Mycobacterium
NFPDGTVPEV

SEQ ID NO: 1215130 - protein, 7 aa, Mycobacterium
NFPNPLE

SEQ ID NO: 1215131 - protein, 7 aa, Mycobacterium
NFTSDGK

SEQ ID NO: 1215132 - protein, 10 aa, Mycobacterium
NFTSEPEGFA

SEQ ID NO: 1215133 - protein, 9 aa, Mycobacterium
NFVEPGSGV

SEQ ID NO: 1215134 - protein, 6 aa, Mycobacterium
NGAAGD

SEQ ID NO: 1215135 - protein, 7 aa, Mycobacterium
NGAAHGG

SEQ ID NO: 1215136 - protein, 22 aa, Mycobacterium
NGADGAPGVLPGEAGGKGGNGG

SEQ ID NO: 1215137 - protein, 9 aa, Mycobacterium
NGADGTPFS

SEQ ID NO: 1215138 - protein, 7 aa, Mycobacterium
NGADREV

SEQ ID NO: 1215139 - protein, 9 aa, Mycobacterium
NGAELPAGE

SEQ ID NO: 1215140 - protein, 15 aa, Mycobacterium
NGAEYLEPADLSTFP

SEQ ID NO: 1215141 - protein, 4 aa, Mycobacterium
NGAG

SEQ ID NO: 1215142 - protein, 15 aa, Mycobacterium
NGAGEVGNGSLTPQQ

SEQ ID NO: 1215143 - protein, 7 aa, Mycobacterium
NGAGKST

SEQ ID NO: 1215144 - protein, 12 aa, Mycobacterium
NGAGYTSAKHAQ

SEQ ID NO: 1215145 - protein, 17 aa, Mycobacterium
NGAPADRTFRPSGAFGT

SEQ ID NO: 1215146 - protein, 7 aa, Mycobacterium
NGAPLQQ

SEQ ID NO: 1215147 - protein, 27 aa, Mycobacterium
NGAPPPDQTTLATGDAGARVACGVITG

SEQ ID NO: 1215148 - protein, 7 aa, Mycobacterium
NGARTGA

SEQ ID NO: 1215149 - protein, 14 aa, Mycobacterium
NGASGEGGPNGSVN

SEQ ID NO: 1215150 - protein, 137 aa, Mycobacterium
NGASSAATSDSVQTDTTSDTVDTPEADTEDETEPDPEPEDQAEPDPEPEDQAEPDPEPEPEPQDEPDPDQDQDQDADDSEGADADQEPPKATETNTETSTKPEPEPEPEPEPTEKTTATVTDDGSDDPAVPPQEPKK

SEQ ID NO: 1215151 - protein, 11 aa, Mycobacterium
NGDDPAAVTDG

SEQ ID NO: 1215152 - protein, 10 aa, Mycobacterium
NGDELQDGGV

SEQ ID NO: 1215153 - protein, 8 aa, Mycobacterium
NGDERQNA

SEQ ID NO: 1215154 - protein, 5 aa, Mycobacterium
NGDEV

SEQ ID NO: 1215155 - protein, 15 aa, Mycobacterium
NGDEVGSWPQATGWT

SEQ ID NO: 1215156 - protein, 7 aa, Mycobacterium
NGDGDDL

SEQ ID NO: 1215157 - protein, 16 aa, Mycobacterium
NGDGTQRIEDTGPLTR

SEQ ID NO: 1215158 - protein, 8 aa, Mycobacterium
NGDPALPT

SEQ ID NO: 1215159 - protein, 7 aa, Mycobacterium
NGDQTRT

SEQ ID NO: 1215160 - protein, 4 aa, Mycobacterium
NGDT

SEQ ID NO: 1215161 - protein, 5 aa, Mycobacterium
NGDVD

SEQ ID NO: 1215162 - protein, 14 aa, Mycobacterium
NGDVGAKARDLAEA

SEQ ID NO: 1215163 - protein, 8 aa, Mycobacterium
NGDYPQAA

SEQ ID NO: 1215164 - protein, 10 aa, Mycobacterium
NGEEGEPASV

SEQ ID NO: 1215165 - protein, 5 aa, Mycobacterium
NGEEH

SEQ ID NO: 1215166 - protein, 5 aa, Mycobacterium
NGEGE

SEQ ID NO: 1215167 - protein, 23 aa, Mycobacterium
NGEGGYDDGVETTTRLAQILLAP

SEQ ID NO: 1215168 - protein, 23 aa, Mycobacterium
NGEGGYDDGVETTTRLARILLAP

SEQ ID NO: 1215169 - protein, 5 aa, Mycobacterium
NGEGI

SEQ ID NO: 1215170 - protein, 10 aa, Mycobacterium
NGEQRQHDRT

SEQ ID NO: 1215171 - protein, 5 aa, Mycobacterium
NGETL

SEQ ID NO: 1215172 - protein, 5 aa, Mycobacterium
NGETM

SEQ ID NO: 1215173 - protein, 10 aa, Mycobacterium
NGFAPPGAEL

SEQ ID NO: 1215174 - protein, 6 aa, Mycobacterium
NGFDPR

SEQ ID NO: 1215175 - protein, 13 aa, Mycobacterium
NGFHKPDDARRAF

SEQ ID NO: 1215176 - protein, 13 aa, Mycobacterium
NGFTSSVTQWSTS

SEQ ID NO: 1215177 - protein, 24 aa, Mycobacterium
NGGAGGAGAPGVAGGAGGAGGNGG

SEQ ID NO: 1215178 - protein, 13 aa, Mycobacterium
NGGASRPDGIAKQ

SEQ ID NO: 1215179 - protein, 4 aa, Mycobacterium
NGGD

SEQ ID NO: 1215180 - protein, 13 aa, Mycobacterium
NGGDGANGGVGGA

SEQ ID NO: 1215181 - protein, 5 aa, Mycobacterium
NGGEA

SEQ ID NO: 1215182 - protein, 6 aa, Mycobacterium
NGGFDA

SEQ ID NO: 1215183 - protein, 8 aa, Mycobacterium
NGGGGAKY

SEQ ID NO: 1215184 - protein, 7 aa, Mycobacterium
NGGGHGE

SEQ ID NO: 1215185 - protein, 5 aa, Mycobacterium
NGGGL

SEQ ID NO: 1215186 - protein, 6 aa, Mycobacterium
NGGGSI

SEQ ID NO: 1215187 - protein, 15 aa, Mycobacterium
NGGILSEQTTLILEG

SEQ ID NO: 1215188 - protein, 15 aa, Mycobacterium
NGGILSEQTTLVLEG

SEQ ID NO: 1215189 - protein, 4 aa, Mycobacterium
NGGK

SEQ ID NO: 1215190 - protein, 5 aa, Mycobacterium
NGGKE

SEQ ID NO: 1215191 - protein, 7 aa, Mycobacterium
NGGKSSW

SEQ ID NO: 1215192 - protein, 8 aa, Mycobacterium
NGGNGGIA

SEQ ID NO: 1215193 - protein, 5 aa, Mycobacterium
NGGNH

SEQ ID NO: 1215194 - protein, 8 aa, Mycobacterium
NGGNPIGA

SEQ ID NO: 1215195 - protein, 9 aa, Mycobacterium
NGGPDDFTN

SEQ ID NO: 1215196 - protein, 8 aa, Mycobacterium
NGGPEQLR

SEQ ID NO: 1215197 - protein, 9 aa, Mycobacterium
NGGPRPLDT

SEQ ID NO: 1215198 - protein, 7 aa, Mycobacterium
NGGPTDL

SEQ ID NO: 1215199 - protein, 4 aa, Mycobacterium
NGGR

SEQ ID NO: 1215200 - protein, 13 aa, Mycobacterium
NGGRAFEPRVVLD

SEQ ID NO: 1215201 - protein, 22 aa, Mycobacterium
NGGRGGDAVLPGQKGGDGGNAG

SEQ ID NO: 1215202 - protein, 9 aa, Mycobacterium
NGGRIDGTQ

SEQ ID NO: 1215203 - protein, 22 aa, Mycobacterium
NGGRYNPAAPFGGYKKSGIGRE

SEQ ID NO: 1215204 - protein, 10 aa, Mycobacterium
NGGSAPRVTC

SEQ ID NO: 1215205 - protein, 7 aa, Mycobacterium
NGGSKST

SEQ ID NO: 1215206 - protein, 6 aa, Mycobacterium
NGGSTP

SEQ ID NO: 1215207 - protein, 14 aa, Mycobacterium
NGGTGAAGVAGGTG

SEQ ID NO: 1215208 - protein, 13 aa, Mycobacterium
NGGTLGGVESRHR

SEQ ID NO: 1215209 - protein, 6 aa, Mycobacterium
NGGVPK

SEQ ID NO: 1215210 - protein, 12 aa, Mycobacterium
NGIARQNGGRSW

SEQ ID NO: 1215211 - protein, 17 aa, Mycobacterium
NGIGAPGYSPSTMGPAE

SEQ ID NO: 1215212 - protein, 14 aa, Mycobacterium
NGIRGTANTAHYTA

SEQ ID NO: 1215213 - protein, 7 aa, Mycobacterium
NGKGGQP

SEQ ID NO: 1215214 - protein, 25 aa, Mycobacterium
NGKNQTEWLPPPDLDTGQHRTNDYH

SEQ ID NO: 1215215 - protein, 18 aa, Mycobacterium
NGKPADLGTGEPEGDNVP

SEQ ID NO: 1215216 - protein, 9 aa, Mycobacterium
NGKPDRSRI

SEQ ID NO: 1215217 - protein, 6 aa, Mycobacterium
NGKPMD

SEQ ID NO: 1215218 - protein, 7 aa, Mycobacterium
NGKQFTG

SEQ ID NO: 1215219 - protein, 6 aa, Mycobacterium
NGKRAG

SEQ ID NO: 1215220 - protein, 8 aa, Mycobacterium
NGKSKRQH

SEQ ID NO: 1215221 - protein, 7 aa, Mycobacterium
NGLGPPV

SEQ ID NO: 1215222 - protein, 20 aa, Mycobacterium
NGLGRPGQARLPGRHPFGVA

SEQ ID NO: 1215223 - protein, 5 aa, Mycobacterium
NGLPI

SEQ ID NO: 1215224 - protein, 7 aa, Mycobacterium
NGLQGSM

SEQ ID NO: 1215225 - protein, 7 aa, Mycobacterium
NGLSTHE

SEQ ID NO: 1215226 - protein, 4 aa, Mycobacterium
NGLT

SEQ ID NO: 1215227 - protein, 14 aa, Mycobacterium
NGLTRQGKTAPKFP

SEQ ID NO: 1215228 - protein, 22 aa, Mycobacterium
NGMAAPDPVETEGEGTQPDPEI

SEQ ID NO: 1215229 - protein, 11 aa, Mycobacterium
NGMGSRLDTGS

SEQ ID NO: 1215230 - protein, 6 aa, Mycobacterium
NGNAGD

SEQ ID NO: 1215231 - protein, 19 aa, Mycobacterium
NGNAGSGSGFVPPSGPGRC

SEQ ID NO: 1215232 - protein, 9 aa, Mycobacterium
NGNVKPPYE

SEQ ID NO: 1215233 - protein, 4 aa, Mycobacterium
NGPA

SEQ ID NO: 1215234 - protein, 9 aa, Mycobacterium
NGPAAGAGW

SEQ ID NO: 1215235 - protein, 6 aa, Mycobacterium
NGPAIG

SEQ ID NO: 1215236 - protein, 7 aa, Mycobacterium
NGPAVGA

SEQ ID NO: 1215237 - protein, 6 aa, Mycobacterium
NGPCYR

SEQ ID NO: 1215238 - protein, 6 aa, Mycobacterium
NGPDYD

SEQ ID NO: 1215239 - protein, 9 aa, Mycobacterium
NGPESFTPD

SEQ ID NO: 1215240 - protein, 8 aa, Mycobacterium
NGPESSIV

SEQ ID NO: 1215241 - protein, 5 aa, Mycobacterium
NGPEY

SEQ ID NO: 1215242 - protein, 9 aa, Mycobacterium
NGPGDPATA

SEQ ID NO: 1215243 - protein, 8 aa, Mycobacterium
NGPGDPAV

SEQ ID NO: 1215244 - protein, 6 aa, Mycobacterium
NGPGPT

SEQ ID NO: 1215245 - protein, 12 aa, Mycobacterium
NGPLPGVSGGEN

SEQ ID NO: 1215246 - protein, 10 aa, Mycobacterium
NGPNPRQPTG

SEQ ID NO: 1215247 - protein, 5 aa, Mycobacterium
NGPRA

SEQ ID NO: 1215248 - protein, 5 aa, Mycobacterium
NGPSA

SEQ ID NO: 1215249 - protein, 9 aa, Mycobacterium
NGPSDDPFG

SEQ ID NO: 1215250 - protein, 11 aa, Mycobacterium
NGPSESGHRPA

SEQ ID NO: 1215251 - protein, 5 aa, Mycobacterium
NGPTV

SEQ ID NO: 1215252 - protein, 6 aa, Mycobacterium
NGQADD

SEQ ID NO: 1215253 - protein, 6 aa, Mycobacterium
NGQAKL

SEQ ID NO: 1215254 - protein, 10 aa, Mycobacterium
NGQGHAVDGG

SEQ ID NO: 1215255 - protein, 5 aa, Mycobacterium
NGQTM

SEQ ID NO: 1215256 - protein, 6 aa, Mycobacterium
NGRATW

SEQ ID NO: 1215257 - protein, 11 aa, Mycobacterium
NGRDTDPAIKG

SEQ ID NO: 1215258 - protein, 5 aa, Mycobacterium
NGRGA

SEQ ID NO: 1215259 - protein, 12 aa, Mycobacterium
NGRKNATRQNRV

SEQ ID NO: 1215260 - protein, 12 aa, Mycobacterium
NGRPPADHERGW

SEQ ID NO: 1215261 - protein, 8 aa, Mycobacterium
NGRSGRRF

SEQ ID NO: 1215262 - protein, 6 aa, Mycobacterium
NGRSGY

SEQ ID NO: 1215263 - protein, 4 aa, Mycobacterium
NGRT

SEQ ID NO: 1215264 - protein, 4 aa, Mycobacterium
NGRY

SEQ ID NO: 1215265 - protein, 6 aa, Mycobacterium
NGSAGF

SEQ ID NO: 1215266 - protein, 14 aa, Mycobacterium
NGSAGSEPDDVPQE

SEQ ID NO: 1215267 - protein, 7 aa, Mycobacterium
NGSARSA

SEQ ID NO: 1215268 - protein, 9 aa, Mycobacterium
NGSEPISAA

SEQ ID NO: 1215269 - protein, 7 aa, Mycobacterium
NGSEVKR

SEQ ID NO: 1215270 - protein, 8 aa, Mycobacterium
NGSGDGWA

SEQ ID NO: 1215271 - protein, 7 aa, Mycobacterium
NGSGKST

SEQ ID NO: 1215272 - protein, 8 aa, Mycobacterium
NGSGRSGS

SEQ ID NO: 1215273 - protein, 7 aa, Mycobacterium
NGSGVTV

SEQ ID NO: 1215274 - protein, 4 aa, Mycobacterium
NGSI

SEQ ID NO: 1215275 - protein, 9 aa, Mycobacterium
NGSLPPNAG

SEQ ID NO: 1215276 - protein, 9 aa, Mycobacterium
NGSLSDTAR

SEQ ID NO: 1215277 - protein, 5 aa, Mycobacterium
NGSPE

SEQ ID NO: 1215278 - protein, 6 aa, Mycobacterium
NGSPRA

SEQ ID NO: 1215279 - protein, 18 aa, Mycobacterium
NGSRASALSARGLLIAAG

SEQ ID NO: 1215280 - protein, 5 aa, Mycobacterium
NGSRL

SEQ ID NO: 1215281 - protein, 9 aa, Mycobacterium
NGSRPNGGL

SEQ ID NO: 1215282 - protein, 10 aa, Mycobacterium
NGSSPSVAAA

SEQ ID NO: 1215283 - protein, 13 aa, Mycobacterium
NGSTDGAPEEAVE

SEQ ID NO: 1215284 - protein, 5 aa, Mycobacterium
NGSTS

SEQ ID NO: 1215285 - protein, 8 aa, Mycobacterium
NGTAAGAG

SEQ ID NO: 1215286 - protein, 25 aa, Mycobacterium
NGTAEDLQGAGDVRGKTGEAEFAGG

SEQ ID NO: 1215287 - protein, 11 aa, Mycobacterium
NGTASRETDAL

SEQ ID NO: 1215288 - protein, 8 aa, Mycobacterium
NGTDGAGV

SEQ ID NO: 1215289 - protein, 23 aa, Mycobacterium
NGTDLPDAAGPSVIDGGSGAVNR

SEQ ID NO: 1215290 - protein, 6 aa, Mycobacterium
NGTELG

SEQ ID NO: 1215291 - protein, 10 aa, Mycobacterium
NGTGKTTTVG

SEQ ID NO: 1215292 - protein, 10 aa, Mycobacterium
NGTKASAASA

SEQ ID NO: 1215293 - protein, 9 aa, Mycobacterium
NGTNPGMGH

SEQ ID NO: 1215294 - protein, 8 aa, Mycobacterium
NGTPVTDS

SEQ ID NO: 1215295 - protein, 7 aa, Mycobacterium
NGTPYGL

SEQ ID NO: 1215296 - protein, 14 aa, Mycobacterium
NGTSTPGVRKRAEV

SEQ ID NO: 1215297 - protein, 11 aa, Mycobacterium
NGTVPEADQPA

SEQ ID NO: 1215298 - protein, 10 aa, Mycobacterium
NGTVRESQLD

SEQ ID NO: 1215299 - protein, 15 aa, Mycobacterium
NGTVTIDSDNPVDPA

SEQ ID NO: 1215300 - protein, 10 aa, Mycobacterium
NGVANDSDDD

SEQ ID NO: 1215301 - protein, 15 aa, Mycobacterium
NGVGRDGQRTQGGYS

SEQ ID NO: 1215302 - protein, 5 aa, Mycobacterium
NGVSD

SEQ ID NO: 1215303 - protein, 7 aa, Mycobacterium
NGVSGTS

SEQ ID NO: 1215304 - protein, 6 aa, Mycobacterium
NGVTRD

SEQ ID NO: 1215305 - protein, 4 aa, Mycobacterium
NGVY

SEQ ID NO: 1215306 - protein, 5 aa, Mycobacterium
NGWEI

SEQ ID NO: 1215307 - protein, 5 aa, Mycobacterium
NGWPA

SEQ ID NO: 1215308 - protein, 12 aa, Mycobacterium
NGWTGADEKAQM

SEQ ID NO: 1215309 - protein, 7 aa, Mycobacterium
NGYLPPS

SEQ ID NO: 1215310 - protein, 6 aa, Mycobacterium
NGYTRE

SEQ ID NO: 1215311 - protein, 6 aa, Mycobacterium
NHAGTD

SEQ ID NO: 1215312 - protein, 7 aa, Mycobacterium
NHAPGGH

SEQ ID NO: 1215313 - protein, 6 aa, Mycobacterium
NHARQS

SEQ ID NO: 1215314 - protein, 9 aa, Mycobacterium
NHDGRSNGM

SEQ ID NO: 1215315 - protein, 15 aa, Mycobacterium
NHDHTSIRAASKGRH

SEQ ID NO: 1215316 - protein, 6 aa, Mycobacterium
NHDNAT

SEQ ID NO: 1215317 - protein, 7 aa, Mycobacterium
NHEPRKR

SEQ ID NO: 1215318 - protein, 7 aa, Mycobacterium
NHHPEDI

SEQ ID NO: 1215319 - protein, 8 aa, Mycobacterium
NHHPPPSM

SEQ ID NO: 1215320 - protein, 6 aa, Mycobacterium
NHLGDR

SEQ ID NO: 1215321 - protein, 7 aa, Mycobacterium
NHNPTGM

SEQ ID NO: 1215322 - protein, 38 aa, Mycobacterium
NHPDRNPGNAEAEERYKTASEAKEVLTDPAKRKEYDET

SEQ ID NO: 1215323 - protein, 7 aa, Mycobacterium
NHPGRTK

SEQ ID NO: 1215324 - protein, 13 aa, Mycobacterium
NHPGVTARGRGMA

SEQ ID NO: 1215325 - protein, 5 aa, Mycobacterium
NHPID

SEQ ID NO: 1215326 - protein, 15 aa, Mycobacterium
NHRGGTVLGPDARPL

SEQ ID NO: 1215327 - protein, 7 aa, Mycobacterium
NHRNPGA

SEQ ID NO: 1215328 - protein, 4 aa, Mycobacterium
NHRP

SEQ ID NO: 1215329 - protein, 16 aa, Mycobacterium
NHSGPAAPPAPRRKPI

SEQ ID NO: 1215330 - protein, 6 aa, Mycobacterium
NHSQSQ

SEQ ID NO: 1215331 - protein, 4 aa, Mycobacterium
NHTN

SEQ ID NO: 1215332 - protein, 27 aa, Mycobacterium
NHTPVEAPEPADSPQLADGAQRSRRKR

SEQ ID NO: 1215333 - protein, 6 aa, Mycobacterium
NHTSDQ

SEQ ID NO: 1215334 - protein, 7 aa, Mycobacterium
NHVPAPP

SEQ ID NO: 1215335 - protein, 6 aa, Mycobacterium
NHYPDD

SEQ ID NO: 1215336 - protein, 7 aa, Mycobacterium
NHYPDDI

SEQ ID NO: 1215337 - protein, 7 aa, Mycobacterium
NIAPPEP

SEQ ID NO: 1215338 - protein, 7 aa, Mycobacterium
NIATNAG

SEQ ID NO: 1215339 - protein, 7 aa, Mycobacterium
NIDGESV

SEQ ID NO: 1215340 - protein, 14 aa, Mycobacterium
NIDPTRDKIIPLPA

SEQ ID NO: 1215341 - protein, 6 aa, Mycobacterium
NIDQRR

SEQ ID NO: 1215342 - protein, 15 aa, Mycobacterium
NIDSTQSKAREQTHR

SEQ ID NO: 1215343 - protein, 8 aa, Mycobacterium
NIEDPATR

SEQ ID NO: 1215344 - protein, 7 aa, Mycobacterium
NIEPNSR

SEQ ID NO: 1215345 - protein, 7 aa, Mycobacterium
NIEPRGD

SEQ ID NO: 1215346 - protein, 10 aa, Mycobacterium
NIGDEARSYF

SEQ ID NO: 1215347 - protein, 13 aa, Mycobacterium
NIGNSAVTSSIAE

SEQ ID NO: 1215348 - protein, 12 aa, Mycobacterium
NIGREKSDEDDH

SEQ ID NO: 1215349 - protein, 20 aa, Mycobacterium
NIPEPQTQTITASGTEEKSV

SEQ ID NO: 1215350 - protein, 19 aa, Mycobacterium
NISAPPVSAVTPAANAARA

SEQ ID NO: 1215351 - protein, 6 aa, Mycobacterium
NISNPE

SEQ ID NO: 1215352 - protein, 14 aa, Mycobacterium
NITAGLTSSQTHRG

SEQ ID NO: 1215353 - protein, 47 aa, Mycobacterium
NITDHTDDHNHDINSDPGHGDGRDITNPGPDYDGGGGEGVGRAPLPD

SEQ ID NO: 1215354 - protein, 52 aa, Mycobacterium
NITDHTDDHNHDINSDPGRGDGHDTVDRGYDTDDGGGGGGGGEGVGRAPLPD

SEQ ID NO: 1215355 - protein, 23 aa, Mycobacterium
NITDHTDGHDITDRTDGHDGGVG

SEQ ID NO: 1215356 - protein, 11 aa, Mycobacterium
NITKSDSGACG

SEQ ID NO: 1215357 - protein, 16 aa, Mycobacterium
NITQHEEARLRRSRAV

SEQ ID NO: 1215358 - protein, 4 aa, Mycobacterium
NITT

SEQ ID NO: 1215359 - protein, 4 aa, Mycobacterium
NIYP

SEQ ID NO: 1215360 - protein, 7 aa, Mycobacterium
NIYPTAD

SEQ ID NO: 1215361 - protein, 13 aa, Mycobacterium
NKAAAEAGRPAPR

SEQ ID NO: 1215362 - protein, 17 aa, Mycobacterium
NKADARPATLSGGQQQR

SEQ ID NO: 1215363 - protein, 10 aa, Mycobacterium
NKAEVEIPSP

SEQ ID NO: 1215364 - protein, 11 aa, Mycobacterium
NKAHDAGNPEI

SEQ ID NO: 1215365 - protein, 8 aa, Mycobacterium
NKARGEAV

SEQ ID NO: 1215366 - protein, 6 aa, Mycobacterium
NKATAN

SEQ ID NO: 1215367 - protein, 21 aa, Mycobacterium
NKEAAEDAKGKLEAAGATVTV

SEQ ID NO: 1215368 - protein, 12 aa, Mycobacterium
NKENPVESASAG

SEQ ID NO: 1215369 - protein, 7 aa, Mycobacterium
NKETLPA

SEQ ID NO: 1215370 - protein, 4 aa, Mycobacterium
NKFT

SEQ ID NO: 1215371 - protein, 17 aa, Mycobacterium
NKGAATEKAAASKAKKN

SEQ ID NO: 1215372 - protein, 9 aa, Mycobacterium
NKGDGTRDE

SEQ ID NO: 1215373 - protein, 7 aa, Mycobacterium
NKGGDYD

SEQ ID NO: 1215374 - protein, 7 aa, Mycobacterium
NKHTTAP

SEQ ID NO: 1215375 - protein, 7 aa, Mycobacterium
NKISGED

SEQ ID NO: 1215376 - protein, 4 aa, Mycobacterium
NKKA

SEQ ID NO: 1215377 - protein, 7 aa, Mycobacterium
NKLTPSQ

SEQ ID NO: 1215378 - protein, 4 aa, Mycobacterium
NKNE

SEQ ID NO: 1215379 - protein, 9 aa, Mycobacterium
NKNYAKSAL

SEQ ID NO: 1215380 - protein, 9 aa, Mycobacterium
NKPAKRKGK

SEQ ID NO: 1215381 - protein, 9 aa, Mycobacterium
NKPAPSVSQ

SEQ ID NO: 1215382 - protein, 5 aa, Mycobacterium
NKPFG

SEQ ID NO: 1215383 - protein, 10 aa, Mycobacterium
NKPKTHVSVP

SEQ ID NO: 1215384 - protein, 9 aa, Mycobacterium
NKPSEDQSC

SEQ ID NO: 1215385 - protein, 8 aa, Mycobacterium
NKPTGTTD

SEQ ID NO: 1215386 - protein, 6 aa, Mycobacterium
NKQYEQ

SEQ ID NO: 1215387 - protein, 5 aa, Mycobacterium
NKRAI

SEQ ID NO: 1215388 - protein, 18 aa, Mycobacterium
NKRSLTLDSTTDEGKEIT

SEQ ID NO: 1215389 - protein, 5 aa, Mycobacterium
NKRTG

SEQ ID NO: 1215390 - protein, 7 aa, Mycobacterium
NKSARTL

SEQ ID NO: 1215391 - protein, 10 aa, Mycobacterium
NKTAGDAERL

SEQ ID NO: 1215392 - protein, 20 aa, Mycobacterium
NKTKRQKDRAVTPDAQPADT

SEQ ID NO: 1215393 - protein, 4 aa, Mycobacterium
NKTL

SEQ ID NO: 1215394 - protein, 11 aa, Mycobacterium
NLAEAGSAKEV

SEQ ID NO: 1215395 - protein, 12 aa, Mycobacterium
NLAGEDGHGDID

SEQ ID NO: 1215396 - protein, 5 aa, Mycobacterium
NLAGQ

SEQ ID NO: 1215397 - protein, 23 aa, Mycobacterium
NLAKQKDQVAAAIGGSAQRKDRE

SEQ ID NO: 1215398 - protein, 8 aa, Mycobacterium
NLAQTDAT

SEQ ID NO: 1215399 - protein, 9 aa, Mycobacterium
NLARPSDEL

SEQ ID NO: 1215400 - protein, 12 aa, Mycobacterium
NLDEGEPHGLPG

SEQ ID NO: 1215401 - protein, 4 aa, Mycobacterium
NLDK

SEQ ID NO: 1215402 - protein, 12 aa, Mycobacterium
NLDSAASRLAGG

SEQ ID NO: 1215403 - protein, 17 aa, Mycobacterium
NLDSDQPVGSLAPPSQV

SEQ ID NO: 1215404 - protein, 12 aa, Mycobacterium
NLDTRGGSTIEQ

SEQ ID NO: 1215405 - protein, 4 aa, Mycobacterium
NLEE

SEQ ID NO: 1215406 - protein, 5 aa, Mycobacterium
NLEGT

SEQ ID NO: 1215407 - protein, 9 aa, Mycobacterium
NLGDGRDKL

SEQ ID NO: 1215408 - protein, 10 aa, Mycobacterium
NLGDGSTSDL

SEQ ID NO: 1215409 - protein, 12 aa, Mycobacterium
NLGQGATLQTQA

SEQ ID NO: 1215410 - protein, 6 aa, Mycobacterium
NLGRPG

SEQ ID NO: 1215411 - protein, 7 aa, Mycobacterium
NLGRTPA

SEQ ID NO: 1215412 - protein, 7 aa, Mycobacterium
NLGTQGA

SEQ ID NO: 1215413 - protein, 6 aa, Mycobacterium
NLGYGT

SEQ ID NO: 1215414 - protein, 10 aa, Mycobacterium
NLKDKKDEAI

SEQ ID NO: 1215415 - protein, 8 aa, Mycobacterium
NLKSEEDR

SEQ ID NO: 1215416 - protein, 4 aa, Mycobacterium
NLPA

SEQ ID NO: 1215417 - protein, 7 aa, Mycobacterium
NLPAGHG

SEQ ID NO: 1215418 - protein, 6 aa, Mycobacterium
NLPAKT

SEQ ID NO: 1215419 - protein, 6 aa, Mycobacterium
NLPDTD

SEQ ID NO: 1215420 - protein, 8 aa, Mycobacterium
NLPDTPSV

SEQ ID NO: 1215421 - protein, 10 aa, Mycobacterium
NLPEAATADD

SEQ ID NO: 1215422 - protein, 11 aa, Mycobacterium
NLPEEDSRRLR

SEQ ID NO: 1215423 - protein, 6 aa, Mycobacterium
NLPETG

SEQ ID NO: 1215424 - protein, 10 aa, Mycobacterium
NLPKGADDQR

SEQ ID NO: 1215425 - protein, 8 aa, Mycobacterium
NLPKSETR

SEQ ID NO: 1215426 - protein, 7 aa, Mycobacterium
NLPPDYI

SEQ ID NO: 1215427 - protein, 31 aa, Mycobacterium
NLPPTSLTDEQKTALAEGREVDTIPKETQDY

SEQ ID NO: 1215428 - protein, 6 aa, Mycobacterium
NLPRAT

SEQ ID NO: 1215429 - protein, 6 aa, Mycobacterium
NLPSGD

SEQ ID NO: 1215430 - protein, 5 aa, Mycobacterium
NLPSS

SEQ ID NO: 1215431 - protein, 5 aa, Mycobacterium
NLPSY

SEQ ID NO: 1215432 - protein, 7 aa, Mycobacterium
NLPTTGG

SEQ ID NO: 1215433 - protein, 18 aa, Mycobacterium
NLPTTPWTTDGDGRGPAW

SEQ ID NO: 1215434 - protein, 8 aa, Mycobacterium
NLQRDTEE

SEQ ID NO: 1215435 - protein, 9 aa, Mycobacterium
NLRADSSVE

SEQ ID NO: 1215436 - protein, 7 aa, Mycobacterium
NLRNSST

SEQ ID NO: 1215437 - protein, 8 aa, Mycobacterium
NLSARGAA

SEQ ID NO: 1215438 - protein, 8 aa, Mycobacterium
NLTDEGPF

SEQ ID NO: 1215439 - protein, 8 aa, Mycobacterium
NLTPGPRA

SEQ ID NO: 1215440 - protein, 8 aa, Mycobacterium
NLTPPRTI

SEQ ID NO: 1215441 - protein, 5 aa, Mycobacterium
NLTPY

SEQ ID NO: 1215442 - protein, 6 aa, Mycobacterium
NMGTGY

SEQ ID NO: 1215443 - protein, 13 aa, Mycobacterium
NMNSGLGAGGRRL

SEQ ID NO: 1215444 - protein, 13 aa, Mycobacterium
NMPSATAQRPGDV

SEQ ID NO: 1215445 - protein, 6 aa, Mycobacterium
NMSDED

SEQ ID NO: 1215446 - protein, 5 aa, Mycobacterium
NNAAA

SEQ ID NO: 1215447 - protein, 5 aa, Mycobacterium
NNACP

SEQ ID NO: 1215448 - protein, 8 aa, Mycobacterium
NNAGNGEV

SEQ ID NO: 1215449 - protein, 6 aa, Mycobacterium
NNAKVA

SEQ ID NO: 1215450 - protein, 5 aa, Mycobacterium
NNAPG

SEQ ID NO: 1215451 - protein, 17 aa, Mycobacterium
NNARAKASTTQGTSSSI

SEQ ID NO: 1215452 - protein, 8 aa, Mycobacterium
NNCSTGSS

SEQ ID NO: 1215453 - protein, 15 aa, Mycobacterium
NNDDPAGACRPFDKD

SEQ ID NO: 1215454 - protein, 7 aa, Mycobacterium
NNDGAEL

SEQ ID NO: 1215455 - protein, 14 aa, Mycobacterium
NNEHQYDKSKKNRR

SEQ ID NO: 1215456 - protein, 10 aa, Mycobacterium
NNGDTPAPGL

SEQ ID NO: 1215457 - protein, 13 aa, Mycobacterium
NNGETVAEGRSDA

SEQ ID NO: 1215458 - protein, 16 aa, Mycobacterium
NNHHAGNPPNPHGSPT

SEQ ID NO: 1215459 - protein, 8 aa, Mycobacterium
NNLPSGAF

SEQ ID NO: 1215460 - protein, 13 aa, Mycobacterium
NNLQAAQDAFAPS

SEQ ID NO: 1215461 - protein, 7 aa, Mycobacterium
NNPAAAA

SEQ ID NO: 1215462 - protein, 12 aa, Mycobacterium
NNPADARPLPAA

SEQ ID NO: 1215463 - protein, 10 aa, Mycobacterium
NNPAGATARA

SEQ ID NO: 1215464 - protein, 5 aa, Mycobacterium
NNPAH

SEQ ID NO: 1215465 - protein, 7 aa, Mycobacterium
NNPAINP

SEQ ID NO: 1215466 - protein, 8 aa, Mycobacterium
NNPATATV

SEQ ID NO: 1215467 - protein, 14 aa, Mycobacterium
NNPATSLDTPAGEQ

SEQ ID NO: 1215468 - protein, 12 aa, Mycobacterium
NNPKQRNSYDAS

SEQ ID NO: 1215469 - protein, 5 aa, Mycobacterium
NNPME

SEQ ID NO: 1215470 - protein, 14 aa, Mycobacterium
NNQVVATNRKARHN

SEQ ID NO: 1215471 - protein, 5 aa, Mycobacterium
NNRRQ

SEQ ID NO: 1215472 - protein, 10 aa, Mycobacterium
NNRTGPAAGG

SEQ ID NO: 1215473 - protein, 8 aa, Mycobacterium
NNRTHAGT

SEQ ID NO: 1215474 - protein, 7 aa, Mycobacterium
NNSGVRD

SEQ ID NO: 1215475 - protein, 27 aa, Mycobacterium
NNSKRGAEGEAAADASNPRNDNKSGQI

SEQ ID NO: 1215476 - protein, 8 aa, Mycobacterium
NNSQEAID

SEQ ID NO: 1215477 - protein, 7 aa, Mycobacterium
NNSSRAI

SEQ ID NO: 1215478 - protein, 7 aa, Mycobacterium
NNSSRAL

SEQ ID NO: 1215479 - protein, 10 aa, Mycobacterium
NNSVPGAPNR

SEQ ID NO: 1215480 - protein, 5 aa, Mycobacterium
NNTSP

SEQ ID NO: 1215481 - protein, 8 aa, Mycobacterium
NNTTMGDA

SEQ ID NO: 1215482 - protein, 7 aa, Mycobacterium
NNVEEGR

SEQ ID NO: 1215483 - protein, 20 aa, Mycobacterium
NNVPVASPVQDAGANAQNGA

SEQ ID NO: 1215484 - protein, 16 aa, Mycobacterium
NPAAPLAAGAARADRQ

SEQ ID NO: 1215485 - protein, 7 aa, Mycobacterium
NPAASPV

SEQ ID NO: 1215486 - protein, 22 aa, Mycobacterium
NPADGSVAATVDEASPDDARAA

SEQ ID NO: 1215487 - protein, 22 aa, Mycobacterium
NPADGSVAATVDEATPDDARAA

SEQ ID NO: 1215488 - protein, 23 aa, Mycobacterium
NPADGSVAATVDEATPDDARAAV

SEQ ID NO: 1215489 - protein, 5 aa, Mycobacterium
NPAFS

SEQ ID NO: 1215490 - protein, 4 aa, Mycobacterium
NPAG

SEQ ID NO: 1215491 - protein, 5 aa, Mycobacterium
NPAGA

SEQ ID NO: 1215492 - protein, 10 aa, Mycobacterium
NPAGDPRRAQ

SEQ ID NO: 1215493 - protein, 12 aa, Mycobacterium
NPAGEPADSPTV

SEQ ID NO: 1215494 - protein, 8 aa, Mycobacterium
NPAGERPL

SEQ ID NO: 1215495 - protein, 7 aa, Mycobacterium
NPAGPRI

SEQ ID NO: 1215496 - protein, 9 aa, Mycobacterium
NPAGTPDHK

SEQ ID NO: 1215497 - protein, 10 aa, Mycobacterium
NPAKGLADRM

SEQ ID NO: 1215498 - protein, 4 aa, Mycobacterium
NPAL

SEQ ID NO: 1215499 - protein, 6 aa, Mycobacterium
NPALAT

SEQ ID NO: 1215500 - protein, 7 aa, Mycobacterium
NPALSTL

SEQ ID NO: 1215501 - protein, 7 aa, Mycobacterium
NPANNDA

SEQ ID NO: 1215502 - protein, 7 aa, Mycobacterium
NPANTNA

SEQ ID NO: 1215503 - protein, 4 aa, Mycobacterium
NPAP

SEQ ID NO: 1215504 - protein, 11 aa, Mycobacterium
NPAPAGGVEPS

SEQ ID NO: 1215505 - protein, 8 aa, Mycobacterium
NPAPAQNW

SEQ ID NO: 1215506 - protein, 5 aa, Mycobacterium
NPAPG

SEQ ID NO: 1215507 - protein, 5 aa, Mycobacterium
NPAPH

SEQ ID NO: 1215508 - protein, 6 aa, Mycobacterium
NPARPT

SEQ ID NO: 1215509 - protein, 12 aa, Mycobacterium
NPASHQDDSHSE

SEQ ID NO: 1215510 - protein, 11 aa, Mycobacterium
NPATDSPRATS

SEQ ID NO: 1215511 - protein, 6 aa, Mycobacterium
NPATGE

SEQ ID NO: 1215512 - protein, 11 aa, Mycobacterium
NPATGEAARKL

SEQ ID NO: 1215513 - protein, 5 aa, Mycobacterium
NPATI

SEQ ID NO: 1215514 - protein, 8 aa, Mycobacterium
NPATSGID

SEQ ID NO: 1215515 - protein, 8 aa, Mycobacterium
NPAVSDGS

SEQ ID NO: 1215516 - protein, 16 aa, Mycobacterium
NPAVTVQDGDEVTEGV

SEQ ID NO: 1215517 - protein, 6 aa, Mycobacterium
NPDAES

SEQ ID NO: 1215518 - protein, 6 aa, Mycobacterium
NPDARR

SEQ ID NO: 1215519 - protein, 6 aa, Mycobacterium
NPDASW

SEQ ID NO: 1215520 - protein, 11 aa, Mycobacterium
NPDATASTLTA

SEQ ID NO: 1215521 - protein, 15 aa, Mycobacterium
NPDCHASTNPRPPRD

SEQ ID NO: 1215522 - protein, 6 aa, Mycobacterium
NPDDLE

SEQ ID NO: 1215523 - protein, 5 aa, Mycobacterium
NPDDW

SEQ ID NO: 1215524 - protein, 4 aa, Mycobacterium
NPDE

SEQ ID NO: 1215525 - protein, 5 aa, Mycobacterium
NPDEA

SEQ ID NO: 1215526 - protein, 8 aa, Mycobacterium
NPDGSDTW

SEQ ID NO: 1215527 - protein, 8 aa, Mycobacterium
NPDGSPQV

SEQ ID NO: 1215528 - protein, 6 aa, Mycobacterium
NPDGTG

SEQ ID NO: 1215529 - protein, 7 aa, Mycobacterium
NPDHADD

SEQ ID NO: 1215530 - protein, 7 aa, Mycobacterium
NPDHAGD

SEQ ID NO: 1215531 - protein, 12 aa, Mycobacterium
NPDNPNQPPYSQ

SEQ ID NO: 1215532 - protein, 6 aa, Mycobacterium
NPDPAD

SEQ ID NO: 1215533 - protein, 12 aa, Mycobacterium
NPDPEIHPDAAR

SEQ ID NO: 1215534 - protein, 4 aa, Mycobacterium
NPDQ

SEQ ID NO: 1215535 - protein, 6 aa, Mycobacterium
NPDQKD

SEQ ID NO: 1215536 - protein, 6 aa, Mycobacterium
NPDQLT

SEQ ID NO: 1215537 - protein, 10 aa, Mycobacterium
NPDRRHGAER

SEQ ID NO: 1215538 - protein, 11 aa, Mycobacterium
NPDRRHGTERM

SEQ ID NO: 1215539 - protein, 9 aa, Mycobacterium
NPDSIEDKN

SEQ ID NO: 1215540 - protein, 10 aa, Mycobacterium
NPDTGGPRGS

SEQ ID NO: 1215541 - protein, 9 aa, Mycobacterium
NPDTNDGQT

SEQ ID NO: 1215542 - protein, 8 aa, Mycobacterium
NPEATEAA

SEQ ID NO: 1215543 - protein, 6 aa, Mycobacterium
NPEGTR

SEQ ID NO: 1215544 - protein, 10 aa, Mycobacterium
NPEPTPLTAS

SEQ ID NO: 1215545 - protein, 102 aa, Mycobacterium
NPEPTTDSSASENGQQTRTAAPKAPPEPAPAPAPKSQDSKSQAPKQDSKPQESKPQAKAKPAESKSSTKPADAKSEKSGKSGTNGAAKPAAQPADDSDQNQV

SEQ ID NO: 1215546 - protein, 6 aa, Mycobacterium
NPERIT

SEQ ID NO: 1215547 - protein, 37 aa, Mycobacterium
NPERPENPSNPDGATSGHDNETTVDLGSPAAQAIWVT

SEQ ID NO: 1215548 - protein, 10 aa, Mycobacterium
NPESPDDAGW

SEQ ID NO: 1215549 - protein, 8 aa, Mycobacterium
NPESPEGI

SEQ ID NO: 1215550 - protein, 5 aa, Mycobacterium
NPETA

SEQ ID NO: 1215551 - protein, 6 aa, Mycobacterium
NPETDA

SEQ ID NO: 1215552 - protein, 9 aa, Mycobacterium
NPETGHEQM

SEQ ID NO: 1215553 - protein, 12 aa, Mycobacterium
NPEVKPERRRRR

SEQ ID NO: 1215554 - protein, 15 aa, Mycobacterium
NPGDVLSEEGPGPVR

SEQ ID NO: 1215555 - protein, 5 aa, Mycobacterium
NPGEL

SEQ ID NO: 1215556 - protein, 9 aa, Mycobacterium
NPGGEPGAV

SEQ ID NO: 1215557 - protein, 9 aa, Mycobacterium
NPGGPDERV

SEQ ID NO: 1215558 - protein, 4 aa, Mycobacterium
NPGH

SEQ ID NO: 1215559 - protein, 11 aa, Mycobacterium
NPGKDDDGNIY

SEQ ID NO: 1215560 - protein, 8 aa, Mycobacterium
NPGKGGTI

SEQ ID NO: 1215561 - protein, 5 aa, Mycobacterium
NPGLA

SEQ ID NO: 1215562 - protein, 8 aa, Mycobacterium
NPGNGGSI

SEQ ID NO: 1215563 - protein, 8 aa, Mycobacterium
NPGPAENT

SEQ ID NO: 1215564 - protein, 7 aa, Mycobacterium
NPGPAGY

SEQ ID NO: 1215565 - protein, 11 aa, Mycobacterium
NPGPQYATTRH

SEQ ID NO: 1215566 - protein, 14 aa, Mycobacterium
NPGRASADKALSEI

SEQ ID NO: 1215567 - protein, 11 aa, Mycobacterium
NPGSPTDRRRQ

SEQ ID NO: 1215568 - protein, 6 aa, Mycobacterium
NPGTGY

SEQ ID NO: 1215569 - protein, 6 aa, Mycobacterium
NPGTSE

SEQ ID NO: 1215570 - protein, 5 aa, Mycobacterium
NPGVG

SEQ ID NO: 1215571 - protein, 8 aa, Mycobacterium
NPHAWSSA

SEQ ID NO: 1215572 - protein, 11 aa, Mycobacterium
NPHRSRPANVD

SEQ ID NO: 1215573 - protein, 4 aa, Mycobacterium
NPIE

SEQ ID NO: 1215574 - protein, 5 aa, Mycobacterium
NPKAQ

SEQ ID NO: 1215575 - protein, 8 aa, Mycobacterium
NPKATAEA

SEQ ID NO: 1215576 - protein, 5 aa, Mycobacterium
NPKDG

SEQ ID NO: 1215577 - protein, 6 aa, Mycobacterium
NPLEDP

SEQ ID NO: 1215578 - protein, 6 aa, Mycobacterium
NPMGTE

SEQ ID NO: 1215579 - protein, 8 aa, Mycobacterium
NPNADALH

SEQ ID NO: 1215580 - protein, 7 aa, Mycobacterium
NPNDDGL

SEQ ID NO: 1215581 - protein, 11 aa, Mycobacterium
NPNGGEPQRVA

SEQ ID NO: 1215582 - protein, 5 aa, Mycobacterium
NPNGN

SEQ ID NO: 1215583 - protein, 11 aa, Mycobacterium
NPNHDEAKGAV

SEQ ID NO: 1215584 - protein, 8 aa, Mycobacterium
NPNPDLPV

SEQ ID NO: 1215585 - protein, 8 aa, Mycobacterium
NPNSITGA

SEQ ID NO: 1215586 - protein, 12 aa, Mycobacterium
NPNTGGKTGIAD

SEQ ID NO: 1215587 - protein, 12 aa, Mycobacterium
NPPDRGEGYDTG

SEQ ID NO: 1215588 - protein, 8 aa, Mycobacterium
NPPFGRKS

SEQ ID NO: 1215589 - protein, 5 aa, Mycobacterium
NPPGA

SEQ ID NO: 1215590 - protein, 10 aa, Mycobacterium
NPPGSNATGM

SEQ ID NO: 1215591 - protein, 6 aa, Mycobacterium
NPPGTV

SEQ ID NO: 1215592 - protein, 13 aa, Mycobacterium
NPPPGVPSRKDSL

SEQ ID NO: 1215593 - protein, 6 aa, Mycobacterium
NPPPLN

SEQ ID NO: 1215594 - protein, 22 aa, Mycobacterium
NPPPLPNSASDTVAPTDVTPVG

SEQ ID NO: 1215595 - protein, 9 aa, Mycobacterium
NPPRHQLRN

SEQ ID NO: 1215596 - protein, 5 aa, Mycobacterium
NPQEY

SEQ ID NO: 1215597 - protein, 14 aa, Mycobacterium
NPQHERTKAFLSKV

SEQ ID NO: 1215598 - protein, 7 aa, Mycobacterium
NPQPINK

SEQ ID NO: 1215599 - protein, 4 aa, Mycobacterium
NPQQ

SEQ ID NO: 1215600 - protein, 9 aa, Mycobacterium
NPQQTERTF

SEQ ID NO: 1215601 - protein, 7 aa, Mycobacterium
NPRASRT

SEQ ID NO: 1215602 - protein, 5 aa, Mycobacterium
NPRLD

SEQ ID NO: 1215603 - protein, 11 aa, Mycobacterium
NPRPTNPAGKM

SEQ ID NO: 1215604 - protein, 4 aa, Mycobacterium
NPRQ

SEQ ID NO: 1215605 - protein, 8 aa, Mycobacterium
NPRSDTVR

SEQ ID NO: 1215606 - protein, 9 aa, Mycobacterium
NPRVIDGDG

SEQ ID NO: 1215607 - protein, 19 aa, Mycobacterium
NPSAPVRYPNGRTLTDDVA

SEQ ID NO: 1215608 - protein, 9 aa, Mycobacterium
NPSASQGSM

SEQ ID NO: 1215609 - protein, 9 aa, Mycobacterium
NPSEGTPVG

SEQ ID NO: 1215610 - protein, 4 aa, Mycobacterium
NPSG

SEQ ID NO: 1215611 - protein, 6 aa, Mycobacterium
NPSGTV

SEQ ID NO: 1215612 - protein, 6 aa, Mycobacterium
NPSNET

SEQ ID NO: 1215613 - protein, 8 aa, Mycobacterium
NPSPAAAL

SEQ ID NO: 1215614 - protein, 11 aa, Mycobacterium
NPSPRKKPQAL

SEQ ID NO: 1215615 - protein, 6 aa, Mycobacterium
NPSRDY

SEQ ID NO: 1215616 - protein, 11 aa, Mycobacterium
NPSREGRLTDD

SEQ ID NO: 1215617 - protein, 12 aa, Mycobacterium
NPSVPDDDVTPE

SEQ ID NO: 1215618 - protein, 7 aa, Mycobacterium
NPTAEAL

SEQ ID NO: 1215619 - protein, 14 aa, Mycobacterium
NPTATRSPAGMPRG

SEQ ID NO: 1215620 - protein, 8 aa, Mycobacterium
NPTDGLTV

SEQ ID NO: 1215621 - protein, 12 aa, Mycobacterium
NPTGHRPAESQF

SEQ ID NO: 1215622 - protein, 5 aa, Mycobacterium
NPTGI

SEQ ID NO: 1215623 - protein, 5 aa, Mycobacterium
NPTGV

SEQ ID NO: 1215624 - protein, 7 aa, Mycobacterium
NPTIDGR

SEQ ID NO: 1215625 - protein, 6 aa, Mycobacterium
NPTLQG

SEQ ID NO: 1215626 - protein, 16 aa, Mycobacterium
NPTPGSEWDASPKPVE

SEQ ID NO: 1215627 - protein, 8 aa, Mycobacterium
NPTRGAAD

SEQ ID NO: 1215628 - protein, 14 aa, Mycobacterium
NPTSGHGNAPHAAE

SEQ ID NO: 1215629 - protein, 5 aa, Mycobacterium
NPTSL

SEQ ID NO: 1215630 - protein, 7 aa, Mycobacterium
NPTTGCD

SEQ ID NO: 1215631 - protein, 7 aa, Mycobacterium
NPTYGQG

SEQ ID NO: 1215632 - protein, 8 aa, Mycobacterium
NPVAEKSV

SEQ ID NO: 1215633 - protein, 8 aa, Mycobacterium
NPVAKKSV

SEQ ID NO: 1215634 - protein, 7 aa, Mycobacterium
NPVANDG

SEQ ID NO: 1215635 - protein, 9 aa, Mycobacterium
NPVDEWADD

SEQ ID NO: 1215636 - protein, 28 aa, Mycobacterium
NPVDKPDLRGRIGGDEGTLRAAEATRCN

SEQ ID NO: 1215637 - protein, 10 aa, Mycobacterium
NPVDQEGTYA

SEQ ID NO: 1215638 - protein, 6 aa, Mycobacterium
NPVPKL

SEQ ID NO: 1215639 - protein, 10 aa, Mycobacterium
NPVPNPPPYW

SEQ ID NO: 1215640 - protein, 4 aa, Mycobacterium
NPVR

SEQ ID NO: 1215641 - protein, 27 aa, Mycobacterium
NPVSDAESAAGEEIDGEEGDEVPWSGE

SEQ ID NO: 1215642 - protein, 7 aa, Mycobacterium
NPVSHDA

SEQ ID NO: 1215643 - protein, 6 aa, Mycobacterium
NPVTAH

SEQ ID NO: 1215644 - protein, 9 aa, Mycobacterium
NPVTGDAQR

SEQ ID NO: 1215645 - protein, 5 aa, Mycobacterium
NPWTT

SEQ ID NO: 1215646 - protein, 11 aa, Mycobacterium
NPYGPPDFQPR

SEQ ID NO: 1215647 - protein, 12 aa, Mycobacterium
NPYPETAPAGRP

SEQ ID NO: 1215648 - protein, 12 aa, Mycobacterium
NQAALPPPGPRQ

SEQ ID NO: 1215649 - protein, 16 aa, Mycobacterium
NQAANRKSALAKALQK

SEQ ID NO: 1215650 - protein, 5 aa, Mycobacterium
NQADR

SEQ ID NO: 1215651 - protein, 7 aa, Mycobacterium
NQAGASL

SEQ ID NO: 1215652 - protein, 8 aa, Mycobacterium
NQASPRSK

SEQ ID NO: 1215653 - protein, 10 aa, Mycobacterium
NQDAEAAGDW

SEQ ID NO: 1215654 - protein, 8 aa, Mycobacterium
NQDGHTQA

SEQ ID NO: 1215655 - protein, 18 aa, Mycobacterium
NQDPDGSEALQPRTPSTE

SEQ ID NO: 1215656 - protein, 24 aa, Mycobacterium
NQESSAGTSLANQLDGAGLERNAR

SEQ ID NO: 1215657 - protein, 8 aa, Mycobacterium
NQGAEEDR

SEQ ID NO: 1215658 - protein, 7 aa, Mycobacterium
NQGAEST

SEQ ID NO: 1215659 - protein, 6 aa, Mycobacterium
NQGAPM

SEQ ID NO: 1215660 - protein, 23 aa, Mycobacterium
NQGASSTHQGDGDDGPDEQVPAT

SEQ ID NO: 1215661 - protein, 12 aa, Mycobacterium
NQGAVGARDTTK

SEQ ID NO: 1215662 - protein, 5 aa, Mycobacterium
NQGLS

SEQ ID NO: 1215663 - protein, 4 aa, Mycobacterium
NQGV

SEQ ID NO: 1215664 - protein, 10 aa, Mycobacterium
NQHDENPDVE

SEQ ID NO: 1215665 - protein, 6 aa, Mycobacterium
NQHGPA

SEQ ID NO: 1215666 - protein, 17 aa, Mycobacterium
NQKDVSARFGSREPDKF

SEQ ID NO: 1215667 - protein, 13 aa, Mycobacterium
NQKGGVAKTTTVA

SEQ ID NO: 1215668 - protein, 12 aa, Mycobacterium
NQKGGVGKTTTA

SEQ ID NO: 1215669 - protein, 11 aa, Mycobacterium
NQKGSPDTPLE

SEQ ID NO: 1215670 - protein, 14 aa, Mycobacterium
NQKRGSNPGSGTYR

SEQ ID NO: 1215671 - protein, 46 aa, Mycobacterium
NQKRVPQPHSVPAGGDGGVRNPNLPPPSRPQDNDLDVTPEHRPGIP

SEQ ID NO: 1215672 - protein, 4 aa, Mycobacterium
NQLG

SEQ ID NO: 1215673 - protein, 14 aa, Mycobacterium
NQNANTAMGTAQAG

SEQ ID NO: 1215674 - protein, 6 aa, Mycobacterium
NQNGGL

SEQ ID NO: 1215675 - protein, 10 aa, Mycobacterium
NQPGDAYRSS

SEQ ID NO: 1215676 - protein, 12 aa, Mycobacterium
NQPHGPRPSTVY

SEQ ID NO: 1215677 - protein, 9 aa, Mycobacterium
NQPLPQESV

SEQ ID NO: 1215678 - protein, 12 aa, Mycobacterium
NQPNLGGSGGYS

SEQ ID NO: 1215679 - protein, 4 aa, Mycobacterium
NQPR

SEQ ID NO: 1215680 - protein, 7 aa, Mycobacterium
NQPTTGM

SEQ ID NO: 1215681 - protein, 7 aa, Mycobacterium
NQPVPAE

SEQ ID NO: 1215682 - protein, 6 aa, Mycobacterium
NQPWEA

SEQ ID NO: 1215683 - protein, 6 aa, Mycobacterium
NQQLTS

SEQ ID NO: 1215684 - protein, 6 aa, Mycobacterium
NQQTPL

SEQ ID NO: 1215685 - protein, 10 aa, Mycobacterium
NQQTVTDSAD

SEQ ID NO: 1215686 - protein, 11 aa, Mycobacterium
NQQYGSGDGPL

SEQ ID NO: 1215687 - protein, 5 aa, Mycobacterium
NQRAD

SEQ ID NO: 1215688 - protein, 5 aa, Mycobacterium
NQRET

SEQ ID NO: 1215689 - protein, 4 aa, Mycobacterium
NQRR

SEQ ID NO: 1215690 - protein, 13 aa, Mycobacterium
NQRYTSVEGGLPA

SEQ ID NO: 1215691 - protein, 11 aa, Mycobacterium
NQSGETGRTAY

SEQ ID NO: 1215692 - protein, 10 aa, Mycobacterium
NQSGPAQANG

SEQ ID NO: 1215693 - protein, 5 aa, Mycobacterium
NQSGT

SEQ ID NO: 1215694 - protein, 7 aa, Mycobacterium
NQSGTFG

SEQ ID NO: 1215695 - protein, 4 aa, Mycobacterium
NQSR

SEQ ID NO: 1215696 - protein, 8 aa, Mycobacterium
NQSRPGAA

SEQ ID NO: 1215697 - protein, 5 aa, Mycobacterium
NQSTR

SEQ ID NO: 1215698 - protein, 7 aa, Mycobacterium
NQTDQAA

SEQ ID NO: 1215699 - protein, 7 aa, Mycobacterium
NQTGTTA

SEQ ID NO: 1215700 - protein, 5 aa, Mycobacterium
NQTID

SEQ ID NO: 1215701 - protein, 13 aa, Mycobacterium
NQTIGKQGVPTEI

SEQ ID NO: 1215702 - protein, 14 aa, Mycobacterium
NQTLEAAKRGLPEG

SEQ ID NO: 1215703 - protein, 5 aa, Mycobacterium
NQTPP

SEQ ID NO: 1215704 - protein, 8 aa, Mycobacterium
NQTPSSVR

SEQ ID NO: 1215705 - protein, 9 aa, Mycobacterium
NQTPTSARD

SEQ ID NO: 1215706 - protein, 6 aa, Mycobacterium
NRAADA

SEQ ID NO: 1215707 - protein, 6 aa, Mycobacterium
NRAADE

SEQ ID NO: 1215708 - protein, 7 aa, Mycobacterium
NRAADET

SEQ ID NO: 1215709 - protein, 5 aa, Mycobacterium
NRADV

SEQ ID NO: 1215710 - protein, 12 aa, Mycobacterium
NRAGGSVTNDHG

SEQ ID NO: 1215711 - protein, 9 aa, Mycobacterium
NRANAAATA

SEQ ID NO: 1215712 - protein, 9 aa, Mycobacterium
NRANPIDGK

SEQ ID NO: 1215713 - protein, 12 aa, Mycobacterium
NRAPRQSRAPNS

SEQ ID NO: 1215714 - protein, 9 aa, Mycobacterium
NRAPSGGNV

SEQ ID NO: 1215715 - protein, 6 aa, Mycobacterium
NRARST

SEQ ID NO: 1215716 - protein, 7 aa, Mycobacterium
NRARSTR

SEQ ID NO: 1215717 - protein, 6 aa, Mycobacterium
NRCGPD

SEQ ID NO: 1215718 - protein, 5 aa, Mycobacterium
NRDED

SEQ ID NO: 1215719 - protein, 5 aa, Mycobacterium
NRDEK

SEQ ID NO: 1215720 - protein, 5 aa, Mycobacterium
NRDEL

SEQ ID NO: 1215721 - protein, 11 aa, Mycobacterium
NRDERRYRNPD

SEQ ID NO: 1215722 - protein, 11 aa, Mycobacterium
NRDGADEHSGD

SEQ ID NO: 1215723 - protein, 11 aa, Mycobacterium
NRDGSKGTVPL

SEQ ID NO: 1215724 - protein, 5 aa, Mycobacterium
NRDKR

SEQ ID NO: 1215725 - protein, 4 aa, Mycobacterium
NRDL

SEQ ID NO: 1215726 - protein, 4 aa, Mycobacterium
NRDP

SEQ ID NO: 1215727 - protein, 5 aa, Mycobacterium
NRDPA

SEQ ID NO: 1215728 - protein, 10 aa, Mycobacterium
NRDPARFDAP

SEQ ID NO: 1215729 - protein, 6 aa, Mycobacterium
NRDPAV

SEQ ID NO: 1215730 - protein, 9 aa, Mycobacterium
NRDPELAGS

SEQ ID NO: 1215731 - protein, 11 aa, Mycobacterium
NRDPSHFDDPG

SEQ ID NO: 1215732 - protein, 7 aa, Mycobacterium
NRDPSRF

SEQ ID NO: 1215733 - protein, 21 aa, Mycobacterium
NRDQVEELAETQKGQTAEEIA

SEQ ID NO: 1215734 - protein, 12 aa, Mycobacterium
NRDSQRGKLKQA

SEQ ID NO: 1215735 - protein, 11 aa, Mycobacterium
NRDSVDGRPRG

SEQ ID NO: 1215736 - protein, 10 aa, Mycobacterium
NREAKPDPYG

SEQ ID NO: 1215737 - protein, 4 aa, Mycobacterium
NREE

SEQ ID NO: 1215738 - protein, 9 aa, Mycobacterium
NREPSDTRA

SEQ ID NO: 1215739 - protein, 4 aa, Mycobacterium
NRET

SEQ ID NO: 1215740 - protein, 7 aa, Mycobacterium
NREVDGH

SEQ ID NO: 1215741 - protein, 11 aa, Mycobacterium
NRGDDPEASSP

SEQ ID NO: 1215742 - protein, 7 aa, Mycobacterium
NRGDETN

SEQ ID NO: 1215743 - protein, 9 aa, Mycobacterium
NRGDNSGSA

SEQ ID NO: 1215744 - protein, 6 aa, Mycobacterium
NRGKRS

SEQ ID NO: 1215745 - protein, 7 aa, Mycobacterium
NRGRGAL

SEQ ID NO: 1215746 - protein, 8 aa, Mycobacterium
NRGTATTA

SEQ ID NO: 1215747 - protein, 22 aa, Mycobacterium
NRGTSVSPERADCTATARRDGT

SEQ ID NO: 1215748 - protein, 4 aa, Mycobacterium
NRGV

SEQ ID NO: 1215749 - protein, 10 aa, Mycobacterium
NRGWSASESL

SEQ ID NO: 1215750 - protein, 4 aa, Mycobacterium
NRHT

SEQ ID NO: 1215751 - protein, 21 aa, Mycobacterium
NRIPNSKEASMGKAKAARVAS

SEQ ID NO: 1215752 - protein, 8 aa, Mycobacterium
NRKGDNAP

SEQ ID NO: 1215753 - protein, 10 aa, Mycobacterium
NRKPDSAASR

SEQ ID NO: 1215754 - protein, 12 aa, Mycobacterium
NRLDDHESPGEA

SEQ ID NO: 1215755 - protein, 9 aa, Mycobacterium
NRLPGKTGD

SEQ ID NO: 1215756 - protein, 26 aa, Mycobacterium
NRLSTGAANRTVSGIATPTTSPVPGA

SEQ ID NO: 1215757 - protein, 8 aa, Mycobacterium
NRMGTSGA

SEQ ID NO: 1215758 - protein, 5 aa, Mycobacterium
NRNAA

SEQ ID NO: 1215759 - protein, 5 aa, Mycobacterium
NRNFQ

SEQ ID NO: 1215760 - protein, 8 aa, Mycobacterium
NRNGDTDD

SEQ ID NO: 1215761 - protein, 16 aa, Mycobacterium
NRNGEAPPTAPRRKPI

SEQ ID NO: 1215762 - protein, 11 aa, Mycobacterium
NRNGSRSWSTT

SEQ ID NO: 1215763 - protein, 7 aa, Mycobacterium
NRNPTNY

SEQ ID NO: 1215764 - protein, 13 aa, Mycobacterium
NRPDAANGMNGTM

SEQ ID NO: 1215765 - protein, 9 aa, Mycobacterium
NRPDAARPR

SEQ ID NO: 1215766 - protein, 6 aa, Mycobacterium
NRPDAL

SEQ ID NO: 1215767 - protein, 10 aa, Mycobacterium
NRPDARNAIN

SEQ ID NO: 1215768 - protein, 10 aa, Mycobacterium
NRPDATAEVL

SEQ ID NO: 1215769 - protein, 16 aa, Mycobacterium
NRPDHAMDRLTHYFHL

SEQ ID NO: 1215770 - protein, 6 aa, Mycobacterium
NRPEKL

SEQ ID NO: 1215771 - protein, 7 aa, Mycobacterium
NRPETGN

SEQ ID NO: 1215772 - protein, 10 aa, Mycobacterium
NRPGRAVSTE

SEQ ID NO: 1215773 - protein, 9 aa, Mycobacterium
NRPGSRNAL

SEQ ID NO: 1215774 - protein, 5 aa, Mycobacterium
NRPGV

SEQ ID NO: 1215775 - protein, 5 aa, Mycobacterium
NRPID

SEQ ID NO: 1215776 - protein, 4 aa, Mycobacterium
NRPS

SEQ ID NO: 1215777 - protein, 7 aa, Mycobacterium
NRPSDSW

SEQ ID NO: 1215778 - protein, 4 aa, Mycobacterium
NRPT

SEQ ID NO: 1215779 - protein, 12 aa, Mycobacterium
NRPTVSEEAVEA

SEQ ID NO: 1215780 - protein, 7 aa, Mycobacterium
NRQPTSV

SEQ ID NO: 1215781 - protein, 22 aa, Mycobacterium
NRRAAAGGAPAETIEDAKTRGP

SEQ ID NO: 1215782 - protein, 9 aa, Mycobacterium
NRRGQATRA

SEQ ID NO: 1215783 - protein, 8 aa, Mycobacterium
NRRGRSTR

SEQ ID NO: 1215784 - protein, 7 aa, Mycobacterium
NRRGSSL

SEQ ID NO: 1215785 - protein, 6 aa, Mycobacterium
NRRGTI

SEQ ID NO: 1215786 - protein, 7 aa, Mycobacterium
NRRGVRG

SEQ ID NO: 1215787 - protein, 6 aa, Mycobacterium
NRRRIS

SEQ ID NO: 1215788 - protein, 6 aa, Mycobacterium
NRRRTR

SEQ ID NO: 1215789 - protein, 8 aa, Mycobacterium
NRRTASNY

SEQ ID NO: 1215790 - protein, 17 aa, Mycobacterium
NRRTDAYGGSADNRARL

SEQ ID NO: 1215791 - protein, 8 aa, Mycobacterium
NRSGGANV

SEQ ID NO: 1215792 - protein, 10 aa, Mycobacterium
NRSGPSPAPT

SEQ ID NO: 1215793 - protein, 7 aa, Mycobacterium
NRSGVPD

SEQ ID NO: 1215794 - protein, 7 aa, Mycobacterium
NRSKRSV

SEQ ID NO: 1215795 - protein, 22 aa, Mycobacterium
NRSLQPTKGARAEQAVRRSAKT

SEQ ID NO: 1215796 - protein, 7 aa, Mycobacterium
NRSPHNT

SEQ ID NO: 1215797 - protein, 8 aa, Mycobacterium
NRSPKGLR

SEQ ID NO: 1215798 - protein, 10 aa, Mycobacterium
NRSPRSASAA

SEQ ID NO: 1215799 - protein, 6 aa, Mycobacterium
NRSPRY

SEQ ID NO: 1215800 - protein, 5 aa, Mycobacterium
NRSRA

SEQ ID NO: 1215801 - protein, 8 aa, Mycobacterium
NRSRPSAH

SEQ ID NO: 1215802 - protein, 19 aa, Mycobacterium
NRSRTETFGPDARPTRGDE

SEQ ID NO: 1215803 - protein, 6 aa, Mycobacterium
NRSSAE

SEQ ID NO: 1215804 - protein, 6 aa, Mycobacterium
NRSSLR

SEQ ID NO: 1215805 - protein, 4 aa, Mycobacterium
NRSV

SEQ ID NO: 1215806 - protein, 19 aa, Mycobacterium
NRSYWERGDASVGGGNPPP

SEQ ID NO: 1215807 - protein, 7 aa, Mycobacterium
NRTDPAE

SEQ ID NO: 1215808 - protein, 5 aa, Mycobacterium
NRTLT

SEQ ID NO: 1215809 - protein, 7 aa, Mycobacterium
NRTRGSL

SEQ ID NO: 1215810 - protein, 8 aa, Mycobacterium
NRTRRLNP

SEQ ID NO: 1215811 - protein, 7 aa, Mycobacterium
NRTSEHT

SEQ ID NO: 1215812 - protein, 12 aa, Mycobacterium
NRTTTGNTRPGQ

SEQ ID NO: 1215813 - protein, 4 aa, Mycobacterium
NRTY

SEQ ID NO: 1215814 - protein, 14 aa, Mycobacterium
NRVGVTTSGTFSPT

SEQ ID NO: 1215815 - protein, 12 aa, Mycobacterium
NRVSSTLTELGL

SEQ ID NO: 1215816 - protein, 10 aa, Mycobacterium
NRYAKENDGG

SEQ ID NO: 1215817 - protein, 9 aa, Mycobacterium
NRYKEAENG

SEQ ID NO: 1215818 - protein, 7 aa, Mycobacterium
NRYPDNG

SEQ ID NO: 1215819 - protein, 7 aa, Mycobacterium
NSADALG

SEQ ID NO: 1215820 - protein, 10 aa, Mycobacterium
NSAKPGAGYT

SEQ ID NO: 1215821 - protein, 4 aa, Mycobacterium
NSAM

SEQ ID NO: 1215822 - protein, 26 aa, Mycobacterium
NSAPDFTNIDTQSAQQIQSVAGGLRF

SEQ ID NO: 1215823 - protein, 7 aa, Mycobacterium
NSAPLRP

SEQ ID NO: 1215824 - protein, 8 aa, Mycobacterium
NSAPQAAV

SEQ ID NO: 1215825 - protein, 27 aa, Mycobacterium
NSAQPDAASQDEINAANQQRGKSTAPD

SEQ ID NO: 1215826 - protein, 7 aa, Mycobacterium
NSARSQL

SEQ ID NO: 1215827 - protein, 7 aa, Mycobacterium
NSARTRN

SEQ ID NO: 1215828 - protein, 13 aa, Mycobacterium
NSASSAGAAPPED

SEQ ID NO: 1215829 - protein, 9 aa, Mycobacterium
NSATEESTQ

SEQ ID NO: 1215830 - protein, 14 aa, Mycobacterium
NSATQSSAVSARQT

SEQ ID NO: 1215831 - protein, 8 aa, Mycobacterium
NSDERATL

SEQ ID NO: 1215832 - protein, 13 aa, Mycobacterium
NSDGRPVSSAADA

SEQ ID NO: 1215833 - protein, 16 aa, Mycobacterium
NSDGRSVGLTAPSQEA

SEQ ID NO: 1215834 - protein, 5 aa, Mycobacterium
NSDGV

SEQ ID NO: 1215835 - protein, 5 aa, Mycobacterium
NSDGY

SEQ ID NO: 1215836 - protein, 7 aa, Mycobacterium
NSDHEAE

SEQ ID NO: 1215837 - protein, 7 aa, Mycobacterium
NSDHEPV

SEQ ID NO: 1215838 - protein, 6 aa, Mycobacterium
NSDLRQ

SEQ ID NO: 1215839 - protein, 7 aa, Mycobacterium
NSDPATG

SEQ ID NO: 1215840 - protein, 9 aa, Mycobacterium
NSDPQSIRD

SEQ ID NO: 1215841 - protein, 7 aa, Mycobacterium
NSDPYGE

SEQ ID NO: 1215842 - protein, 6 aa, Mycobacterium
NSEDPI

SEQ ID NO: 1215843 - protein, 6 aa, Mycobacterium
NSEEAA

SEQ ID NO: 1215844 - protein, 10 aa, Mycobacterium
NSEEARETVS

SEQ ID NO: 1215845 - protein, 6 aa, Mycobacterium
NSELPA

SEQ ID NO: 1215846 - protein, 9 aa, Mycobacterium
NSEPAMNST

SEQ ID NO: 1215847 - protein, 8 aa, Mycobacterium
NSEPVPGD

SEQ ID NO: 1215848 - protein, 11 aa, Mycobacterium
NSEQDGGAAQD

SEQ ID NO: 1215849 - protein, 9 aa, Mycobacterium
NSESAEKSA

SEQ ID NO: 1215850 - protein, 4 aa, Mycobacterium
NSGA

SEQ ID NO: 1215851 - protein, 16 aa, Mycobacterium
NSGAKAVIGSSATRKV

SEQ ID NO: 1215852 - protein, 4 aa, Mycobacterium
NSGD

SEQ ID NO: 1215853 - protein, 10 aa, Mycobacterium
NSGERELGTI

SEQ ID NO: 1215854 - protein, 7 aa, Mycobacterium
NSGGGSL

SEQ ID NO: 1215855 - protein, 11 aa, Mycobacterium
NSGGGSPLQSD

SEQ ID NO: 1215856 - protein, 11 aa, Mycobacterium
NSGHPGKGEPL

SEQ ID NO: 1215857 - protein, 8 aa, Mycobacterium
NSGHPIGN

SEQ ID NO: 1215858 - protein, 10 aa, Mycobacterium
NSGIGRENGW

SEQ ID NO: 1215859 - protein, 6 aa, Mycobacterium
NSGMQA

SEQ ID NO: 1215860 - protein, 29 aa, Mycobacterium
NSGNDEAASPAPAPVQTSSAAPAASHNQT

SEQ ID NO: 1215861 - protein, 7 aa, Mycobacterium
NSGPGSF

SEQ ID NO: 1215862 - protein, 6 aa, Mycobacterium
NSGQDC

SEQ ID NO: 1215863 - protein, 9 aa, Mycobacterium
NSGSAGELV

SEQ ID NO: 1215864 - protein, 12 aa, Mycobacterium
NSGSSQGEGDTR

SEQ ID NO: 1215865 - protein, 5 aa, Mycobacterium
NSIPQ

SEQ ID NO: 1215866 - protein, 6 aa, Mycobacterium
NSIRGQ

SEQ ID NO: 1215867 - protein, 9 aa, Mycobacterium
NSISQGQAV

SEQ ID NO: 1215868 - protein, 14 aa, Mycobacterium
NSKGDPHLTGTVRG

SEQ ID NO: 1215869 - protein, 14 aa, Mycobacterium
NSKGEPHLTGTVRG

SEQ ID NO: 1215870 - protein, 8 aa, Mycobacterium
NSKGEPYA

SEQ ID NO: 1215871 - protein, 11 aa, Mycobacterium
NSKGETEDAGV

SEQ ID NO: 1215872 - protein, 6 aa, Mycobacterium
NSMGGG

SEQ ID NO: 1215873 - protein, 8 aa, Mycobacterium
NSMGGGTA

SEQ ID NO: 1215874 - protein, 5 aa, Mycobacterium
NSMGT

SEQ ID NO: 1215875 - protein, 6 aa, Mycobacterium
NSNETI

SEQ ID NO: 1215876 - protein, 9 aa, Mycobacterium
NSPAALTRP

SEQ ID NO: 1215877 - protein, 6 aa, Mycobacterium
NSPATE

SEQ ID NO: 1215878 - protein, 72 aa, Mycobacterium
NSPAVAAADDDTTSSEASSASTADSDTISNTPNNTDSDSDSDSEESGDAGEPDQADEDDPAPDVEDEERRTR

SEQ ID NO: 1215879 - protein, 7 aa, Mycobacterium
NSPAVGS

SEQ ID NO: 1215880 - protein, 12 aa, Mycobacterium
NSPDSVAPHGQA

SEQ ID NO: 1215881 - protein, 9 aa, Mycobacterium
NSPGAAALT

SEQ ID NO: 1215882 - protein, 9 aa, Mycobacterium
NSPGGGYDL

SEQ ID NO: 1215883 - protein, 12 aa, Mycobacterium
NSPGTVDAGYRG

SEQ ID NO: 1215884 - protein, 4 aa, Mycobacterium
NSPN

SEQ ID NO: 1215885 - protein, 7 aa, Mycobacterium
NSPSFDD

SEQ ID NO: 1215886 - protein, 8 aa, Mycobacterium
NSPSFDDD

SEQ ID NO: 1215887 - protein, 6 aa, Mycobacterium
NSPTFD

SEQ ID NO: 1215888 - protein, 9 aa, Mycobacterium
NSQAGNRAL

SEQ ID NO: 1215889 - protein, 14 aa, Mycobacterium
NSRAGVRNDPERSV

SEQ ID NO: 1215890 - protein, 5 aa, Mycobacterium
NSRGT

SEQ ID NO: 1215891 - protein, 6 aa, Mycobacterium
NSRRWA

SEQ ID NO: 1215892 - protein, 8 aa, Mycobacterium
NSRSAPLA

SEQ ID NO: 1215893 - protein, 6 aa, Mycobacterium
NSRSLE

SEQ ID NO: 1215894 - protein, 31 aa, Mycobacterium
NSRTPSSRSGRSRSREKDTLSREERKEATRR

SEQ ID NO: 1215895 - protein, 7 aa, Mycobacterium
NSSGATI

SEQ ID NO: 1215896 - protein, 13 aa, Mycobacterium
NSSGTRNSVGGWG

SEQ ID NO: 1215897 - protein, 24 aa, Mycobacterium
NSSRSARSAASNVTPVSVSTAETV

SEQ ID NO: 1215898 - protein, 16 aa, Mycobacterium
NSSTASDCGDRPSSYA

SEQ ID NO: 1215899 - protein, 9 aa, Mycobacterium
NSTAGGAYI

SEQ ID NO: 1215900 - protein, 7 aa, Mycobacterium
NSTGQFK

SEQ ID NO: 1215901 - protein, 13 aa, Mycobacterium
NSTHRVPDGVSDE

SEQ ID NO: 1215902 - protein, 22 aa, Mycobacterium
NSTQPCISDPDRWAAGGQDPEL

SEQ ID NO: 1215903 - protein, 17 aa, Mycobacterium
NSTSSRFADYEKRPDRA

SEQ ID NO: 1215904 - protein, 16 aa, Mycobacterium
NSVPTRAQSFLRSTSP

SEQ ID NO: 1215905 - protein, 8 aa, Mycobacterium
NSVTGPLD

SEQ ID NO: 1215906 - protein, 10 aa, Mycobacterium
NSVTGPLDDR

SEQ ID NO: 1215907 - protein, 7 aa, Mycobacterium
NSYGGAA

SEQ ID NO: 1215908 - protein, 16 aa, Mycobacterium
NTAAAPPRVQDSSPRL

SEQ ID NO: 1215909 - protein, 7 aa, Mycobacterium
NTAAGSM

SEQ ID NO: 1215910 - protein, 10 aa, Mycobacterium
NTAALNTATD

SEQ ID NO: 1215911 - protein, 14 aa, Mycobacterium
NTAAPVADKDEAIA

SEQ ID NO: 1215912 - protein, 7 aa, Mycobacterium
NTAAQAS

SEQ ID NO: 1215913 - protein, 16 aa, Mycobacterium
NTADLDAARAAGTPEA

SEQ ID NO: 1215914 - protein, 4 aa, Mycobacterium
NTAE

SEQ ID NO: 1215915 - protein, 5 aa, Mycobacterium
NTAER

SEQ ID NO: 1215916 - protein, 7 aa, Mycobacterium
NTAGGDH

SEQ ID NO: 1215917 - protein, 6 aa, Mycobacterium
NTAGMT

SEQ ID NO: 1215918 - protein, 7 aa, Mycobacterium
NTAGRTR

SEQ ID NO: 1215919 - protein, 11 aa, Mycobacterium
NTAKGRRPTWN

SEQ ID NO: 1215920 - protein, 15 aa, Mycobacterium
NTAMPSTVYRLAQCR

SEQ ID NO: 1215921 - protein, 4 aa, Mycobacterium
NTAN

SEQ ID NO: 1215922 - protein, 6 aa, Mycobacterium
NTAPHD

SEQ ID NO: 1215923 - protein, 5 aa, Mycobacterium
NTARQ

SEQ ID NO: 1215924 - protein, 10 aa, Mycobacterium
NTARRPGMTA

SEQ ID NO: 1215925 - protein, 13 aa, Mycobacterium
NTARSGKFSSDRA

SEQ ID NO: 1215926 - protein, 6 aa, Mycobacterium
NTASTN

SEQ ID NO: 1215927 - protein, 11 aa, Mycobacterium
NTATGEESTLP

SEQ ID NO: 1215928 - protein, 4 aa, Mycobacterium
NTAV

SEQ ID NO: 1215929 - protein, 4 aa, Mycobacterium
NTCE

SEQ ID NO: 1215930 - protein, 14 aa, Mycobacterium
NTDAMDNSAGVDCS

SEQ ID NO: 1215931 - protein, 7 aa, Mycobacterium
NTDDMPI

SEQ ID NO: 1215932 - protein, 8 aa, Mycobacterium
NTDGKPYG

SEQ ID NO: 1215933 - protein, 10 aa, Mycobacterium
NTDGRWDPGK

SEQ ID NO: 1215934 - protein, 5 aa, Mycobacterium
NTDGT

SEQ ID NO: 1215935 - protein, 8 aa, Mycobacterium
NTDGTGSW

SEQ ID NO: 1215936 - protein, 4 aa, Mycobacterium
NTDH

SEQ ID NO: 1215937 - protein, 12 aa, Mycobacterium
NTDKPRRGTKRY

SEQ ID NO: 1215938 - protein, 7 aa, Mycobacterium
NTDPASV

SEQ ID NO: 1215939 - protein, 6 aa, Mycobacterium
NTDTVT

SEQ ID NO: 1215940 - protein, 9 aa, Mycobacterium
NTDVPTSPG

SEQ ID NO: 1215941 - protein, 5 aa, Mycobacterium
NTEDG

SEQ ID NO: 1215942 - protein, 19 aa, Mycobacterium
NTEGAQKVADGIKGEGGNA

SEQ ID NO: 1215943 - protein, 8 aa, Mycobacterium
NTEGPGQF

SEQ ID NO: 1215944 - protein, 18 aa, Mycobacterium
NTEKSGGSDVGRSIGAPA

SEQ ID NO: 1215945 - protein, 4 aa, Mycobacterium
NTEP

SEQ ID NO: 1215946 - protein, 7 aa, Mycobacterium
NTEYGAG

SEQ ID NO: 1215947 - protein, 10 aa, Mycobacterium
NTGAVNRDDT

SEQ ID NO: 1215948 - protein, 7 aa, Mycobacterium
NTGGGEL

SEQ ID NO: 1215949 - protein, 5 aa, Mycobacterium
NTGIP

SEQ ID NO: 1215950 - protein, 6 aa, Mycobacterium
NTGMDQ

SEQ ID NO: 1215951 - protein, 7 aa, Mycobacterium
NTGNGYH

SEQ ID NO: 1215952 - protein, 9 aa, Mycobacterium
NTGNGYSGG

SEQ ID NO: 1215953 - protein, 8 aa, Mycobacterium
NTGPDDAA

SEQ ID NO: 1215954 - protein, 8 aa, Mycobacterium
NTGPLPDE

SEQ ID NO: 1215955 - protein, 6 aa, Mycobacterium
NTGRPP

SEQ ID NO: 1215956 - protein, 24 aa, Mycobacterium
NTGRRTSHMPNRPYPDGTGVFPTR

SEQ ID NO: 1215957 - protein, 4 aa, Mycobacterium
NTGS

SEQ ID NO: 1215958 - protein, 8 aa, Mycobacterium
NTGTIGNA

SEQ ID NO: 1215959 - protein, 8 aa, Mycobacterium
NTGTNTRD

SEQ ID NO: 1215960 - protein, 17 aa, Mycobacterium
NTGVNHGGTTAHPARGA

SEQ ID NO: 1215961 - protein, 11 aa, Mycobacterium
NTHEGGTHEEG

SEQ ID NO: 1215962 - protein, 7 aa, Mycobacterium
NTHPSSR

SEQ ID NO: 1215963 - protein, 9 aa, Mycobacterium
NTIEGGTSE

SEQ ID NO: 1215964 - protein, 7 aa, Mycobacterium
NTISEQD

SEQ ID NO: 1215965 - protein, 11 aa, Mycobacterium
NTKANYSPHSR

SEQ ID NO: 1215966 - protein, 7 aa, Mycobacterium
NTKDELA

SEQ ID NO: 1215967 - protein, 8 aa, Mycobacterium
NTKSYGGG

SEQ ID NO: 1215968 - protein, 8 aa, Mycobacterium
NTLGDGPD

SEQ ID NO: 1215969 - protein, 8 aa, Mycobacterium
NTLGSTQD

SEQ ID NO: 1215970 - protein, 9 aa, Mycobacterium
NTLPGELND

SEQ ID NO: 1215971 - protein, 12 aa, Mycobacterium
NTLPSDRPDWPA

SEQ ID NO: 1215972 - protein, 6 aa, Mycobacterium
NTLSSY

SEQ ID NO: 1215973 - protein, 8 aa, Mycobacterium
NTLSTPAR

SEQ ID NO: 1215974 - protein, 20 aa, Mycobacterium
NTMAAPSGTVYPGGGNPIGT

SEQ ID NO: 1215975 - protein, 4 aa, Mycobacterium
NTMT

SEQ ID NO: 1215976 - protein, 6 aa, Mycobacterium
NTNGTV

SEQ ID NO: 1215977 - protein, 8 aa, Mycobacterium
NTNGYRRY

SEQ ID NO: 1215978 - protein, 4 aa, Mycobacterium
NTNV

SEQ ID NO: 1215979 - protein, 7 aa, Mycobacterium
NTNVGSG

SEQ ID NO: 1215980 - protein, 7 aa, Mycobacterium
NTPADGD

SEQ ID NO: 1215981 - protein, 12 aa, Mycobacterium
NTPAGEGPDIPF

SEQ ID NO: 1215982 - protein, 8 aa, Mycobacterium
NTPANGPA

SEQ ID NO: 1215983 - protein, 4 aa, Mycobacterium
NTPD

SEQ ID NO: 1215984 - protein, 9 aa, Mycobacterium
NTPEGESKE

SEQ ID NO: 1215985 - protein, 6 aa, Mycobacterium
NTPEQT

SEQ ID NO: 1215986 - protein, 5 aa, Mycobacterium
NTPET

SEQ ID NO: 1215987 - protein, 9 aa, Mycobacterium
NTPGGDGQV

SEQ ID NO: 1215988 - protein, 5 aa, Mycobacterium
NTPLP

SEQ ID NO: 1215989 - protein, 13 aa, Mycobacterium
NTPLRTEGEARQD

SEQ ID NO: 1215990 - protein, 11 aa, Mycobacterium
NTPPAKVKEGY

SEQ ID NO: 1215991 - protein, 5 aa, Mycobacterium
NTPPS

SEQ ID NO: 1215992 - protein, 7 aa, Mycobacterium
NTPPSHL

SEQ ID NO: 1215993 - protein, 9 aa, Mycobacterium
NTPQGKALG

SEQ ID NO: 1215994 - protein, 19 aa, Mycobacterium
NTPQPPPGGITTQTPGMSD

SEQ ID NO: 1215995 - protein, 27 aa, Mycobacterium
NTQPAAGPNGPSKAKYTLADGTAERVR

SEQ ID NO: 1215996 - protein, 8 aa, Mycobacterium
NTQRGLTE

SEQ ID NO: 1215997 - protein, 8 aa, Mycobacterium
NTRAGRSV

SEQ ID NO: 1215998 - protein, 10 aa, Mycobacterium
NTRAKTTAVA

SEQ ID NO: 1215999 - protein, 9 aa, Mycobacterium
NTRETTVDG

SEQ ID NO: 1216000 - protein, 9 aa, Mycobacterium
NTRKPTRVA

SEQ ID NO: 1216001 - protein, 10 aa, Mycobacterium
NTRNEQRDAH

SEQ ID NO: 1216002 - protein, 7 aa, Mycobacterium
NTRPAPQ

SEQ ID NO: 1216003 - protein, 11 aa, Mycobacterium
NTRPGSPAETA

SEQ ID NO: 1216004 - protein, 7 aa, Mycobacterium
NTRPNIS

SEQ ID NO: 1216005 - protein, 18 aa, Mycobacterium
NTRPPDPSVFDSPPASPG

SEQ ID NO: 1216006 - protein, 8 aa, Mycobacterium
NTRRGDAL

SEQ ID NO: 1216007 - protein, 9 aa, Mycobacterium
NTRTGEREE

SEQ ID NO: 1216008 - protein, 5 aa, Mycobacterium
NTRYS

SEQ ID NO: 1216009 - protein, 8 aa, Mycobacterium
NTSAARAR

SEQ ID NO: 1216010 - protein, 8 aa, Mycobacterium
NTSAQQRA

SEQ ID NO: 1216011 - protein, 8 aa, Mycobacterium
NTSDPSAD

SEQ ID NO: 1216012 - protein, 17 aa, Mycobacterium
NTSGGAYNQNDGAQDWQ

SEQ ID NO: 1216013 - protein, 6 aa, Mycobacterium
NTSGLI

SEQ ID NO: 1216014 - protein, 15 aa, Mycobacterium
NTSGTARDRDPAAPV

SEQ ID NO: 1216015 - protein, 17 aa, Mycobacterium
NTSLNETTKMNRPGMSG

SEQ ID NO: 1216016 - protein, 8 aa, Mycobacterium
NTSRPSTI

SEQ ID NO: 1216017 - protein, 24 aa, Mycobacterium
NTSSGAGLQGSVGQANYSASKAGI

SEQ ID NO: 1216018 - protein, 15 aa, Mycobacterium
NTTASLERPSTGDEL

SEQ ID NO: 1216019 - protein, 6 aa, Mycobacterium
NTTAWT

SEQ ID NO: 1216020 - protein, 7 aa, Mycobacterium
NTTDDLG

SEQ ID NO: 1216021 - protein, 9 aa, Mycobacterium
NTTEGGAQF

SEQ ID NO: 1216022 - protein, 6 aa, Mycobacterium
NTTGKN

SEQ ID NO: 1216023 - protein, 15 aa, Mycobacterium
NTTGLPAGRRPPEST

SEQ ID NO: 1216024 - protein, 6 aa, Mycobacterium
NTTISR

SEQ ID NO: 1216025 - protein, 29 aa, Mycobacterium
NTTISRAGLKTPGVEELGPGGVSGAPVAA

SEQ ID NO: 1216026 - protein, 6 aa, Mycobacterium
NTTNGV

SEQ ID NO: 1216027 - protein, 10 aa, Mycobacterium
NTTPRGGSPY

SEQ ID NO: 1216028 - protein, 7 aa, Mycobacterium
NTTTRTR

SEQ ID NO: 1216029 - protein, 5 aa, Mycobacterium
NTVRS

SEQ ID NO: 1216030 - protein, 12 aa, Mycobacterium
NTVTSGATITAG

SEQ ID NO: 1216031 - protein, 4 aa, Mycobacterium
NTYP

SEQ ID NO: 1216032 - protein, 8 aa, Mycobacterium
NVAPDPAV

SEQ ID NO: 1216033 - protein, 13 aa, Mycobacterium
NVASQTRAVGERA

SEQ ID NO: 1216034 - protein, 5 aa, Mycobacterium
NVATG

SEQ ID NO: 1216035 - protein, 12 aa, Mycobacterium
NVEPQMLRQILA

SEQ ID NO: 1216036 - protein, 13 aa, Mycobacterium
NVERGREQAMEDA

SEQ ID NO: 1216037 - protein, 7 aa, Mycobacterium
NVESGPE

SEQ ID NO: 1216038 - protein, 7 aa, Mycobacterium
NVGKPQV

SEQ ID NO: 1216039 - protein, 14 aa, Mycobacterium
NVGPEPEGAPIEQQ

SEQ ID NO: 1216040 - protein, 8 aa, Mycobacterium
NVGRAGRG

SEQ ID NO: 1216041 - protein, 5 aa, Mycobacterium
NVGRK

SEQ ID NO: 1216042 - protein, 9 aa, Mycobacterium
NVGYSNPDR

SEQ ID NO: 1216043 - protein, 10 aa, Mycobacterium
NVLPTGEAGE

SEQ ID NO: 1216044 - protein, 7 aa, Mycobacterium
NVPDDEI

SEQ ID NO: 1216045 - protein, 13 aa, Mycobacterium
NVPGASRIEEASL

SEQ ID NO: 1216046 - protein, 5 aa, Mycobacterium
NVPGL

SEQ ID NO: 1216047 - protein, 11 aa, Mycobacterium
NVPGPRERARV

SEQ ID NO: 1216048 - protein, 8 aa, Mycobacterium
NVPGPREY

SEQ ID NO: 1216049 - protein, 9 aa, Mycobacterium
NVPGPRGRQ

SEQ ID NO: 1216050 - protein, 16 aa, Mycobacterium
NVPGPRRRGHIGGAPV

SEQ ID NO: 1216051 - protein, 10 aa, Mycobacterium
NVPPSGIETP

SEQ ID NO: 1216052 - protein, 6 aa, Mycobacterium
NVQPEE

SEQ ID NO: 1216053 - protein, 7 aa, Mycobacterium
NVRDDAA

SEQ ID NO: 1216054 - protein, 6 aa, Mycobacterium
NVRRDP

SEQ ID NO: 1216055 - protein, 11 aa, Mycobacterium
NVRRDRETDTS

SEQ ID NO: 1216056 - protein, 7 aa, Mycobacterium
NVSASDA

SEQ ID NO: 1216057 - protein, 6 aa, Mycobacterium
NVSRGA

SEQ ID NO: 1216058 - protein, 11 aa, Mycobacterium
NVSVKGPKGTL

SEQ ID NO: 1216059 - protein, 8 aa, Mycobacterium
NVTDPEQV

SEQ ID NO: 1216060 - protein, 7 aa, Mycobacterium
NVTPERT

SEQ ID NO: 1216061 - protein, 11 aa, Mycobacterium
NVTPGKLGMPA

SEQ ID NO: 1216062 - protein, 20 aa, Mycobacterium
NVTQEHDPDFGRGASAYDGY

SEQ ID NO: 1216063 - protein, 7 aa, Mycobacterium
NVTTDDQ

SEQ ID NO: 1216064 - protein, 5 aa, Mycobacterium
NVTTE

SEQ ID NO: 1216065 - protein, 4 aa, Mycobacterium
NVVT

SEQ ID NO: 1216066 - protein, 5 aa, Mycobacterium
NVYGG

SEQ ID NO: 1216067 - protein, 4 aa, Mycobacterium
NVYP

SEQ ID NO: 1216068 - protein, 6 aa, Mycobacterium
NVYSPE

SEQ ID NO: 1216069 - protein, 9 aa, Mycobacterium
NWERSGWGD

SEQ ID NO: 1216070 - protein, 35 aa, Mycobacterium
NWKGDPNATVTGQSVPQLPPGSPPALQAAPPPPVA

SEQ ID NO: 1216071 - protein, 7 aa, Mycobacterium
NWQPEKR

SEQ ID NO: 1216072 - protein, 5 aa, Mycobacterium
NWRDD

SEQ ID NO: 1216073 - protein, 10 aa, Mycobacterium
NWRGEGRRSL

SEQ ID NO: 1216074 - protein, 14 aa, Mycobacterium
NWSASGTDLKGDAY

SEQ ID NO: 1216075 - protein, 13 aa, Mycobacterium
NWSSENKTTPIHP

SEQ ID NO: 1216076 - protein, 11 aa, Mycobacterium
NWTAPDPRAQD

SEQ ID NO: 1216077 - protein, 7 aa, Mycobacterium
NYAPPAL

SEQ ID NO: 1216078 - protein, 12 aa, Mycobacterium
NYDANANEAIRA

SEQ ID NO: 1216079 - protein, 5 aa, Mycobacterium
NYDED

SEQ ID NO: 1216080 - protein, 9 aa, Mycobacterium
NYEPTAKSF

SEQ ID NO: 1216081 - protein, 10 aa, Mycobacterium
NYGETTEAFG

SEQ ID NO: 1216082 - protein, 4 aa, Mycobacterium
NYGG

SEQ ID NO: 1216083 - protein, 5 aa, Mycobacterium
NYGGD

SEQ ID NO: 1216084 - protein, 7 aa, Mycobacterium
NYGGRRH

SEQ ID NO: 1216085 - protein, 9 aa, Mycobacterium
NYGPGDPNL

SEQ ID NO: 1216086 - protein, 6 aa, Mycobacterium
NYGPTI

SEQ ID NO: 1216087 - protein, 13 aa, Mycobacterium
NYHTPRDDIDNVD

SEQ ID NO: 1216088 - protein, 5 aa, Mycobacterium
NYKDE

SEQ ID NO: 1216089 - protein, 5 aa, Mycobacterium
NYPDE

SEQ ID NO: 1216090 - protein, 8 aa, Mycobacterium
NYPDGYRY

SEQ ID NO: 1216091 - protein, 12 aa, Mycobacterium
NYPDPTDEDWQR

SEQ ID NO: 1216092 - protein, 6 aa, Mycobacterium
NYPPTV

SEQ ID NO: 1216093 - protein, 4 aa, Mycobacterium
NYRK

SEQ ID NO: 1216094 - protein, 27 aa, Mycobacterium
NYRRDDGGVKAARAPAPATRRLSPRRG

SEQ ID NO: 1216095 - protein, 5 aa, Mycobacterium
NYTGD

SEQ ID NO: 1216096 - protein, 21 aa, Mycobacterium
NYTPTTAARHAAATSDPNLAA

SEQ ID NO: 1216097 - protein, 5 aa, Mycobacterium
PAAAA

SEQ ID NO: 1216098 - protein, 10 aa, Mycobacterium
PAAADSTDDA

SEQ ID NO: 1216099 - protein, 8 aa, Mycobacterium
PAAAEPDQ

SEQ ID NO: 1216100 - protein, 12 aa, Mycobacterium
PAAAKPKELAAS

SEQ ID NO: 1216101 - protein, 5 aa, Mycobacterium
PAAAL

SEQ ID NO: 1216102 - protein, 10 aa, Mycobacterium
PAAANGTPRC

SEQ ID NO: 1216103 - protein, 12 aa, Mycobacterium
PAAAPAGPLPPF

SEQ ID NO: 1216104 - protein, 16 aa, Mycobacterium
PAAAPPDDAARRDRLP

SEQ ID NO: 1216105 - protein, 19 aa, Mycobacterium
PAAAQPDAPPAPVPGPPAV

SEQ ID NO: 1216106 - protein, 8 aa, Mycobacterium
PAACPSIT

SEQ ID NO: 1216107 - protein, 13 aa, Mycobacterium
PAADAALRRTESP

SEQ ID NO: 1216108 - protein, 8 aa, Mycobacterium
PAADAAMG

SEQ ID NO: 1216109 - protein, 10 aa, Mycobacterium
PAADDRDGYV

SEQ ID NO: 1216110 - protein, 6 aa, Mycobacterium
PAADGV

SEQ ID NO: 1216111 - protein, 10 aa, Mycobacterium
PAADPDRYAG

SEQ ID NO: 1216112 - protein, 7 aa, Mycobacterium
PAADPGP

SEQ ID NO: 1216113 - protein, 8 aa, Mycobacterium
PAADPLTE

SEQ ID NO: 1216114 - protein, 19 aa, Mycobacterium
PAAEDDGGAGGSGPFPAAQ

SEQ ID NO: 1216115 - protein, 7 aa, Mycobacterium
PAAEDRA

SEQ ID NO: 1216116 - protein, 7 aa, Mycobacterium
PAAEGVN

SEQ ID NO: 1216117 - protein, 8 aa, Mycobacterium
PAAESLEG

SEQ ID NO: 1216118 - protein, 19 aa, Mycobacterium
PAAESVTAQNENADGPSLP

SEQ ID NO: 1216119 - protein, 9 aa, Mycobacterium
PAAETYEPE

SEQ ID NO: 1216120 - protein, 15 aa, Mycobacterium
PAAEYPGGKAAIEKT

SEQ ID NO: 1216121 - protein, 9 aa, Mycobacterium
PAAGAAELS

SEQ ID NO: 1216122 - protein, 5 aa, Mycobacterium
PAAGD

SEQ ID NO: 1216123 - protein, 9 aa, Mycobacterium
PAAGEHGGQ

SEQ ID NO: 1216124 - protein, 5 aa, Mycobacterium
PAAGG

SEQ ID NO: 1216125 - protein, 8 aa, Mycobacterium
PAAGGEES

SEQ ID NO: 1216126 - protein, 9 aa, Mycobacterium
PAAGKNLPG

SEQ ID NO: 1216127 - protein, 8 aa, Mycobacterium
PAAGPQGL

SEQ ID NO: 1216128 - protein, 14 aa, Mycobacterium
PAAGTGTPTADYGI

SEQ ID NO: 1216129 - protein, 8 aa, Mycobacterium
PAAGTVTK

SEQ ID NO: 1216130 - protein, 5 aa, Mycobacterium
PAAGW

SEQ ID NO: 1216131 - protein, 7 aa, Mycobacterium
PAAGYAN

SEQ ID NO: 1216132 - protein, 9 aa, Mycobacterium
PAAHPPTPL

SEQ ID NO: 1216133 - protein, 6 aa, Mycobacterium
PAAKNY

SEQ ID NO: 1216134 - protein, 9 aa, Mycobacterium
PAAKPATAV

SEQ ID NO: 1216135 - protein, 16 aa, Mycobacterium
PAAMSGGPDEPSLSPE

SEQ ID NO: 1216136 - protein, 7 aa, Mycobacterium
PAAMTRP

SEQ ID NO: 1216137 - protein, 7 aa, Mycobacterium
PAANSTV

SEQ ID NO: 1216138 - protein, 4 aa, Mycobacterium
PAAP

SEQ ID NO: 1216139 - protein, 7 aa, Mycobacterium
PAAPAGE

SEQ ID NO: 1216140 - protein, 11 aa, Mycobacterium
PAAPAGIADGP

SEQ ID NO: 1216141 - protein, 29 aa, Mycobacterium
PAAPAVPPVPSYPQYQPSTGVAPAPAPVL

SEQ ID NO: 1216142 - protein, 7 aa, Mycobacterium
PAAPDVE

SEQ ID NO: 1216143 - protein, 7 aa, Mycobacterium
PAAPEWD

SEQ ID NO: 1216144 - protein, 6 aa, Mycobacterium
PAAPKI

SEQ ID NO: 1216145 - protein, 7 aa, Mycobacterium
PAAPMHS

SEQ ID NO: 1216146 - protein, 8 aa, Mycobacterium
PAAPPGFA

SEQ ID NO: 1216147 - protein, 5 aa, Mycobacterium
PAAPV

SEQ ID NO: 1216148 - protein, 10 aa, Mycobacterium
PAAQDRGVRA

SEQ ID NO: 1216149 - protein, 6 aa, Mycobacterium
PAAQGV

SEQ ID NO: 1216150 - protein, 8 aa, Mycobacterium
PAARDGLE

SEQ ID NO: 1216151 - protein, 10 aa, Mycobacterium
PAARMGRPDE

SEQ ID NO: 1216152 - protein, 7 aa, Mycobacterium
PAARNAL

SEQ ID NO: 1216153 - protein, 14 aa, Mycobacterium
PAARTATAENLQDD

SEQ ID NO: 1216154 - protein, 9 aa, Mycobacterium
PAASPADVD

SEQ ID NO: 1216155 - protein, 6 aa, Mycobacterium
PAATAE

SEQ ID NO: 1216156 - protein, 8 aa, Mycobacterium
PAATPDDE

SEQ ID NO: 1216157 - protein, 8 aa, Mycobacterium
PAATPDSA

SEQ ID NO: 1216158 - protein, 7 aa, Mycobacterium
PAATQRQ

SEQ ID NO: 1216159 - protein, 13 aa, Mycobacterium
PAATQSLAGMPRG

SEQ ID NO: 1216160 - protein, 23 aa, Mycobacterium
PAAVLGDPKEERTRQFLQRILNP

SEQ ID NO: 1216161 - protein, 14 aa, Mycobacterium
PAAVPAPALGDDTA

SEQ ID NO: 1216162 - protein, 5 aa, Mycobacterium
PAAVT

SEQ ID NO: 1216163 - protein, 5 aa, Mycobacterium
PACGT

SEQ ID NO: 1216164 - protein, 12 aa, Mycobacterium
PACPGAPSPGVY

SEQ ID NO: 1216165 - protein, 4 aa, Mycobacterium
PADA

SEQ ID NO: 1216166 - protein, 7 aa, Mycobacterium
PADAADL

SEQ ID NO: 1216167 - protein, 11 aa, Mycobacterium
PADAANRVSGP

SEQ ID NO: 1216168 - protein, 10 aa, Mycobacterium
PADADASRGS

SEQ ID NO: 1216169 - protein, 6 aa, Mycobacterium
PADAEA

SEQ ID NO: 1216170 - protein, 8 aa, Mycobacterium
PADAGQTV

SEQ ID NO: 1216171 - protein, 8 aa, Mycobacterium
PADAGRHG

SEQ ID NO: 1216172 - protein, 10 aa, Mycobacterium
PADAMDEPDN

SEQ ID NO: 1216173 - protein, 47 aa, Mycobacterium
PADANDISDAEPADECDETVPAEPDSPTRSADSAGEPGGPAPPEGRA

SEQ ID NO: 1216174 - protein, 10 aa, Mycobacterium
PADAPVPPEK

SEQ ID NO: 1216175 - protein, 10 aa, Mycobacterium
PADARDYGTG

SEQ ID NO: 1216176 - protein, 11 aa, Mycobacterium
PADATAPLDYT

SEQ ID NO: 1216177 - protein, 13 aa, Mycobacterium
PADDDHPYRTGPW

SEQ ID NO: 1216178 - protein, 7 aa, Mycobacterium
PADDNAA

SEQ ID NO: 1216179 - protein, 10 aa, Mycobacterium
PADDPLAPYA

SEQ ID NO: 1216180 - protein, 8 aa, Mycobacterium
PADDTAPR

SEQ ID NO: 1216181 - protein, 9 aa, Mycobacterium
PADEFTPSA

SEQ ID NO: 1216182 - protein, 10 aa, Mycobacterium
PADEHRRSSD

SEQ ID NO: 1216183 - protein, 5 aa, Mycobacterium
PADEQ

SEQ ID NO: 1216184 - protein, 7 aa, Mycobacterium
PADERTL

SEQ ID NO: 1216185 - protein, 7 aa, Mycobacterium
PADESAI

SEQ ID NO: 1216186 - protein, 7 aa, Mycobacterium
PADESPA

SEQ ID NO: 1216187 - protein, 7 aa, Mycobacterium
PADFPTA

SEQ ID NO: 1216188 - protein, 8 aa, Mycobacterium
PADGAGVD

SEQ ID NO: 1216189 - protein, 6 aa, Mycobacterium
PADGEH

SEQ ID NO: 1216190 - protein, 5 aa, Mycobacterium
PADGH

SEQ ID NO: 1216191 - protein, 6 aa, Mycobacterium
PADGSA

SEQ ID NO: 1216192 - protein, 17 aa, Mycobacterium
PADGTYPSGTAAYEKRN

SEQ ID NO: 1216193 - protein, 9 aa, Mycobacterium
PADIARDPD

SEQ ID NO: 1216194 - protein, 6 aa, Mycobacterium
PADISQ

SEQ ID NO: 1216195 - protein, 9 aa, Mycobacterium
PADLESSLP

SEQ ID NO: 1216196 - protein, 9 aa, Mycobacterium
PADPADPDS

SEQ ID NO: 1216197 - protein, 15 aa, Mycobacterium
PADPAFANPTKPIGP

SEQ ID NO: 1216198 - protein, 9 aa, Mycobacterium
PADPAQDSL

SEQ ID NO: 1216199 - protein, 10 aa, Mycobacterium
PADPATPVPT

SEQ ID NO: 1216200 - protein, 15 aa, Mycobacterium
PADPDVDVRPSHGSE

SEQ ID NO: 1216201 - protein, 9 aa, Mycobacterium
PADPEERDA

SEQ ID NO: 1216202 - protein, 11 aa, Mycobacterium
PADPPPPPGEH

SEQ ID NO: 1216203 - protein, 9 aa, Mycobacterium
PADPTPTVG

SEQ ID NO: 1216204 - protein, 10 aa, Mycobacterium
PADQEDAVRE

SEQ ID NO: 1216205 - protein, 4 aa, Mycobacterium
PADR

SEQ ID NO: 1216206 - protein, 7 aa, Mycobacterium
PADRAEI

SEQ ID NO: 1216207 - protein, 9 aa, Mycobacterium
PADRATDGA

SEQ ID NO: 1216208 - protein, 5 aa, Mycobacterium
PADRP

SEQ ID NO: 1216209 - protein, 5 aa, Mycobacterium
PADTF

SEQ ID NO: 1216210 - protein, 49 aa, Mycobacterium
PADTPAYRKGAAAVDDSGDRRSDADIRTATAAPAVGERSDDAGRDGGRT

SEQ ID NO: 1216211 - protein, 6 aa, Mycobacterium
PADTPV

SEQ ID NO: 1216212 - protein, 5 aa, Mycobacterium
PADTQ

SEQ ID NO: 1216213 - protein, 5 aa, Mycobacterium
PADVP

SEQ ID NO: 1216214 - protein, 7 aa, Mycobacterium
PADWNSE

SEQ ID NO: 1216215 - protein, 7 aa, Mycobacterium
PADWRPG

SEQ ID NO: 1216216 - protein, 5 aa, Mycobacterium
PAEAA

SEQ ID NO: 1216217 - protein, 14 aa, Mycobacterium
PAEADESTKRGEQA

SEQ ID NO: 1216218 - protein, 5 aa, Mycobacterium
PAEAF

SEQ ID NO: 1216219 - protein, 90 aa, Mycobacterium
PAEAGGSIGRPKRTADKEPREPRERREKPTSNRSRRRTRGGKSVGGHPEGTTEQAAPEADNAGAEAPEGAASPARRRRRRRPSKAAAAGS

SEQ ID NO: 1216220 - protein, 11 aa, Mycobacterium
PAEAPLDEEER

SEQ ID NO: 1216221 - protein, 9 aa, Mycobacterium
PAEDTPASA

SEQ ID NO: 1216222 - protein, 8 aa, Mycobacterium
PAEEADRA

SEQ ID NO: 1216223 - protein, 11 aa, Mycobacterium
PAEEANPPTDV

SEQ ID NO: 1216224 - protein, 13 aa, Mycobacterium
PAEEELAGDGAHQ

SEQ ID NO: 1216225 - protein, 5 aa, Mycobacterium
PAEEF

SEQ ID NO: 1216226 - protein, 8 aa, Mycobacterium
PAEEGTQR

SEQ ID NO: 1216227 - protein, 12 aa, Mycobacterium
PAEETGDGARGM

SEQ ID NO: 1216228 - protein, 7 aa, Mycobacterium
PAEGDGV

SEQ ID NO: 1216229 - protein, 7 aa, Mycobacterium
PAEGETG

SEQ ID NO: 1216230 - protein, 5 aa, Mycobacterium
PAEGL

SEQ ID NO: 1216231 - protein, 6 aa, Mycobacterium
PAEGRG

SEQ ID NO: 1216232 - protein, 4 aa, Mycobacterium
PAEH

SEQ ID NO: 1216233 - protein, 33 aa, Mycobacterium
PAEHPYGSSSVGSKYQGQRGPTPSRSYQNFVKN

SEQ ID NO: 1216234 - protein, 5 aa, Mycobacterium
PAEID

SEQ ID NO: 1216235 - protein, 10 aa, Mycobacterium
PAEISEKDLT

SEQ ID NO: 1216236 - protein, 4 aa, Mycobacterium
PAEL

SEQ ID NO: 1216237 - protein, 7 aa, Mycobacterium
PAELDPQ

SEQ ID NO: 1216238 - protein, 12 aa, Mycobacterium
PAEMEGGPNEVT

SEQ ID NO: 1216239 - protein, 11 aa, Mycobacterium
PAENTDDGDVT

SEQ ID NO: 1216240 - protein, 5 aa, Mycobacterium
PAEPA

SEQ ID NO: 1216241 - protein, 8 aa, Mycobacterium
PAEPADQQ

SEQ ID NO: 1216242 - protein, 10 aa, Mycobacterium
PAEPEPVKDI

SEQ ID NO: 1216243 - protein, 5 aa, Mycobacterium
PAEPT

SEQ ID NO: 1216244 - protein, 10 aa, Mycobacterium
PAEQRQPALA

SEQ ID NO: 1216245 - protein, 4 aa, Mycobacterium
PAER

SEQ ID NO: 1216246 - protein, 16 aa, Mycobacterium
PAERAKGAQVPEDLDP

SEQ ID NO: 1216247 - protein, 5 aa, Mycobacterium
PAERL

SEQ ID NO: 1216248 - protein, 7 aa, Mycobacterium
PAERQAY

SEQ ID NO: 1216249 - protein, 9 aa, Mycobacterium
PAESRQRRT

SEQ ID NO: 1216250 - protein, 11 aa, Mycobacterium
PAETKPVGGRD

SEQ ID NO: 1216251 - protein, 7 aa, Mycobacterium
PAETVSV

SEQ ID NO: 1216252 - protein, 10 aa, Mycobacterium
PAFESQENIS

SEQ ID NO: 1216253 - protein, 4 aa, Mycobacterium
PAFG

SEQ ID NO: 1216254 - protein, 8 aa, Mycobacterium
PAFGPGDT

SEQ ID NO: 1216255 - protein, 7 aa, Mycobacterium
PAFGTED

SEQ ID NO: 1216256 - protein, 4 aa, Mycobacterium
PAFK

SEQ ID NO: 1216257 - protein, 5 aa, Mycobacterium
PAFSA

SEQ ID NO: 1216258 - protein, 15 aa, Mycobacterium
PAGADEDGIKASYDK

SEQ ID NO: 1216259 - protein, 8 aa, Mycobacterium
PAGADPRD

SEQ ID NO: 1216260 - protein, 11 aa, Mycobacterium
PAGAEGGGGLG

SEQ ID NO: 1216261 - protein, 8 aa, Mycobacterium
PAGAPLPE

SEQ ID NO: 1216262 - protein, 5 aa, Mycobacterium
PAGAS

SEQ ID NO: 1216263 - protein, 11 aa, Mycobacterium
PAGASAPAAGS

SEQ ID NO: 1216264 - protein, 11 aa, Mycobacterium
PAGATDDKAQV

SEQ ID NO: 1216265 - protein, 6 aa, Mycobacterium
PAGDDE

SEQ ID NO: 1216266 - protein, 7 aa, Mycobacterium
PAGDDTA

SEQ ID NO: 1216267 - protein, 20 aa, Mycobacterium
PAGDERSREEQTTADGDDDG

SEQ ID NO: 1216268 - protein, 7 aa, Mycobacterium
PAGDGDV

SEQ ID NO: 1216269 - protein, 17 aa, Mycobacterium
PAGDRIASTGGRASGPV

SEQ ID NO: 1216270 - protein, 7 aa, Mycobacterium
PAGEAGQ

SEQ ID NO: 1216271 - protein, 10 aa, Mycobacterium
PAGESASQEQ

SEQ ID NO: 1216272 - protein, 7 aa, Mycobacterium
PAGETAA

SEQ ID NO: 1216273 - protein, 22 aa, Mycobacterium
PAGETTGPPAASDVPDEPDDAA

SEQ ID NO: 1216274 - protein, 7 aa, Mycobacterium
PAGFSNG

SEQ ID NO: 1216275 - protein, 6 aa, Mycobacterium
PAGGDA

SEQ ID NO: 1216276 - protein, 8 aa, Mycobacterium
PAGGFSEE

SEQ ID NO: 1216277 - protein, 8 aa, Mycobacterium
PAGGGFTS

SEQ ID NO: 1216278 - protein, 8 aa, Mycobacterium
PAGGPALG

SEQ ID NO: 1216279 - protein, 13 aa, Mycobacterium
PAGGRRLDQTADG

SEQ ID NO: 1216280 - protein, 13 aa, Mycobacterium
PAGGTAASEVPRT

SEQ ID NO: 1216281 - protein, 5 aa, Mycobacterium
PAGHH

SEQ ID NO: 1216282 - protein, 6 aa, Mycobacterium
PAGIGK

SEQ ID NO: 1216283 - protein, 9 aa, Mycobacterium
PAGITGPMA

SEQ ID NO: 1216284 - protein, 8 aa, Mycobacterium
PAGLPEDG

SEQ ID NO: 1216285 - protein, 11 aa, Mycobacterium
PAGNDVETVDG

SEQ ID NO: 1216286 - protein, 8 aa, Mycobacterium
PAGNRTTM

SEQ ID NO: 1216287 - protein, 9 aa, Mycobacterium
PAGPEDFDP

SEQ ID NO: 1216288 - protein, 8 aa, Mycobacterium
PAGPGSQM

SEQ ID NO: 1216289 - protein, 7 aa, Mycobacterium
PAGPISE

SEQ ID NO: 1216290 - protein, 10 aa, Mycobacterium
PAGPPTPTPL

SEQ ID NO: 1216291 - protein, 9 aa, Mycobacterium
PAGPSASPV

SEQ ID NO: 1216292 - protein, 8 aa, Mycobacterium
PAGPVETA

SEQ ID NO: 1216293 - protein, 7 aa, Mycobacterium
PAGPVRP

SEQ ID NO: 1216294 - protein, 4 aa, Mycobacterium
PAGR

SEQ ID NO: 1216295 - protein, 5 aa, Mycobacterium
PAGRT

SEQ ID NO: 1216296 - protein, 6 aa, Mycobacterium
PAGSAQ

SEQ ID NO: 1216297 - protein, 8 aa, Mycobacterium
PAGSARRL

SEQ ID NO: 1216298 - protein, 14 aa, Mycobacterium
PAGSCGTAQSRMSG

SEQ ID NO: 1216299 - protein, 12 aa, Mycobacterium
PAGSGGAEGGLG

SEQ ID NO: 1216300 - protein, 17 aa, Mycobacterium
PAGSTDKFGEELSDRTV

SEQ ID NO: 1216301 - protein, 6 aa, Mycobacterium
PAGSTV

SEQ ID NO: 1216302 - protein, 9 aa, Mycobacterium
PAGSTVRDG

SEQ ID NO: 1216303 - protein, 9 aa, Mycobacterium
PAGTAGGAQ

SEQ ID NO: 1216304 - protein, 12 aa, Mycobacterium
PAGTEDPSLPRT

SEQ ID NO: 1216305 - protein, 11 aa, Mycobacterium
PAGTGKSSVAR

SEQ ID NO: 1216306 - protein, 8 aa, Mycobacterium
PAGTGLRS

SEQ ID NO: 1216307 - protein, 7 aa, Mycobacterium
PAGTSRQ

SEQ ID NO: 1216308 - protein, 5 aa, Mycobacterium
PAGVD

SEQ ID NO: 1216309 - protein, 4 aa, Mycobacterium
PAGW

SEQ ID NO: 1216310 - protein, 5 aa, Mycobacterium
PAGYE

SEQ ID NO: 1216311 - protein, 9 aa, Mycobacterium
PAGYGKTTA

SEQ ID NO: 1216312 - protein, 6 aa, Mycobacterium
PAHDAD

SEQ ID NO: 1216313 - protein, 15 aa, Mycobacterium
PAHDGPRGNASDRDV

SEQ ID NO: 1216314 - protein, 7 aa, Mycobacterium
PAHERAR

SEQ ID NO: 1216315 - protein, 5 aa, Mycobacterium
PAHLG

SEQ ID NO: 1216316 - protein, 10 aa, Mycobacterium
PAHPTAGEGP

SEQ ID NO: 1216317 - protein, 8 aa, Mycobacterium
PAHSTRDH

SEQ ID NO: 1216318 - protein, 6 aa, Mycobacterium
PAHTGV

SEQ ID NO: 1216319 - protein, 4 aa, Mycobacterium
PAIA

SEQ ID NO: 1216320 - protein, 10 aa, Mycobacterium
PAIAPPGEAI

SEQ ID NO: 1216321 - protein, 7 aa, Mycobacterium
PAIDPGD

SEQ ID NO: 1216322 - protein, 15 aa, Mycobacterium
PAIYPDEAPLSAFQL

SEQ ID NO: 1216323 - protein, 4 aa, Mycobacterium
PAKA

SEQ ID NO: 1216324 - protein, 10 aa, Mycobacterium
PAKANRSTHG

SEQ ID NO: 1216325 - protein, 19 aa, Mycobacterium
PAKGDDAEGGAEQDRPSQV

SEQ ID NO: 1216326 - protein, 8 aa, Mycobacterium
PAKGGNYS

SEQ ID NO: 1216327 - protein, 25 aa, Mycobacterium
PAKNGPPTAPERPVPPDVPDPAVTP

SEQ ID NO: 1216328 - protein, 7 aa, Mycobacterium
PAKNGSG

SEQ ID NO: 1216329 - protein, 10 aa, Mycobacterium
PAKPAQYPNG

SEQ ID NO: 1216330 - protein, 5 aa, Mycobacterium
PAKQR

SEQ ID NO: 1216331 - protein, 5 aa, Mycobacterium
PALDK

SEQ ID NO: 1216332 - protein, 9 aa, Mycobacterium
PALDTGQAR

SEQ ID NO: 1216333 - protein, 10 aa, Mycobacterium
PALGGGGSAQ

SEQ ID NO: 1216334 - protein, 5 aa, Mycobacterium
PALGT

SEQ ID NO: 1216335 - protein, 6 aa, Mycobacterium
PALGTS

SEQ ID NO: 1216336 - protein, 24 aa, Mycobacterium
PALKDPPFVPATPSAFGERETPKS

SEQ ID NO: 1216337 - protein, 8 aa, Mycobacterium
PALPEGLA

SEQ ID NO: 1216338 - protein, 12 aa, Mycobacterium
PALPKPAQRPHP

SEQ ID NO: 1216339 - protein, 4 aa, Mycobacterium
PALQ

SEQ ID NO: 1216340 - protein, 5 aa, Mycobacterium
PALSE

SEQ ID NO: 1216341 - protein, 17 aa, Mycobacterium
PALTEEAYADDRKAARQ

SEQ ID NO: 1216342 - protein, 8 aa, Mycobacterium
PAMAPPGM

SEQ ID NO: 1216343 - protein, 9 aa, Mycobacterium
PAMGQPGGG

SEQ ID NO: 1216344 - protein, 4 aa, Mycobacterium
PAMT

SEQ ID NO: 1216345 - protein, 8 aa, Mycobacterium
PANDGGPC

SEQ ID NO: 1216346 - protein, 7 aa, Mycobacterium
PANEAAT

SEQ ID NO: 1216347 - protein, 19 aa, Mycobacterium
PANISDSTVVSSANPSYDH

SEQ ID NO: 1216348 - protein, 9 aa, Mycobacterium
PANPPGGQF

SEQ ID NO: 1216349 - protein, 5 aa, Mycobacterium
PANQD

SEQ ID NO: 1216350 - protein, 6 aa, Mycobacterium
PANSEP

SEQ ID NO: 1216351 - protein, 5 aa, Mycobacterium
PANSS

SEQ ID NO: 1216352 - protein, 6 aa, Mycobacterium
PANTYA

SEQ ID NO: 1216353 - protein, 12 aa, Mycobacterium
PAPAARALTEAA

SEQ ID NO: 1216354 - protein, 23 aa, Mycobacterium
PAPAEDAAPIPDLGQRQPAGRRE

SEQ ID NO: 1216355 - protein, 26 aa, Mycobacterium
PAPAENATKITSREPAVAGDRPELTE

SEQ ID NO: 1216356 - protein, 7 aa, Mycobacterium
PAPAGVR

SEQ ID NO: 1216357 - protein, 14 aa, Mycobacterium
PAPAPSRRRRGTRS

SEQ ID NO: 1216358 - protein, 11 aa, Mycobacterium
PAPASGDAALN

SEQ ID NO: 1216359 - protein, 8 aa, Mycobacterium
PAPASRKA

SEQ ID NO: 1216360 - protein, 4 aa, Mycobacterium
PAPD

SEQ ID NO: 1216361 - protein, 11 aa, Mycobacterium
PAPDAATSFEE

SEQ ID NO: 1216362 - protein, 14 aa, Mycobacterium
PAPDADAAAAARAR

SEQ ID NO: 1216363 - protein, 7 aa, Mycobacterium
PAPDAPL

SEQ ID NO: 1216364 - protein, 10 aa, Mycobacterium
PAPDAWTDGA

SEQ ID NO: 1216365 - protein, 11 aa, Mycobacterium
PAPDDNDHPPH

SEQ ID NO: 1216366 - protein, 14 aa, Mycobacterium
PAPDPNPVAPAAVD

SEQ ID NO: 1216367 - protein, 5 aa, Mycobacterium
PAPDT

SEQ ID NO: 1216368 - protein, 7 aa, Mycobacterium
PAPDTPW

SEQ ID NO: 1216369 - protein, 10 aa, Mycobacterium
PAPDTPWSGT

SEQ ID NO: 1216370 - protein, 8 aa, Mycobacterium
PAPEALPQ

SEQ ID NO: 1216371 - protein, 7 aa, Mycobacterium
PAPEDSY

SEQ ID NO: 1216372 - protein, 7 aa, Mycobacterium
PAPEGAP

SEQ ID NO: 1216373 - protein, 7 aa, Mycobacterium
PAPEKVP

SEQ ID NO: 1216374 - protein, 12 aa, Mycobacterium
PAPFNPVGTDPL

SEQ ID NO: 1216375 - protein, 4 aa, Mycobacterium
PAPG

SEQ ID NO: 1216376 - protein, 7 aa, Mycobacterium
PAPGDDA

SEQ ID NO: 1216377 - protein, 10 aa, Mycobacterium
PAPGDGRTVA

SEQ ID NO: 1216378 - protein, 11 aa, Mycobacterium
PAPGDRPGSEG

SEQ ID NO: 1216379 - protein, 13 aa, Mycobacterium
PAPGDRTGASTPV

SEQ ID NO: 1216380 - protein, 5 aa, Mycobacterium
PAPGG

SEQ ID NO: 1216381 - protein, 15 aa, Mycobacterium
PAPGLSDELGSAASE

SEQ ID NO: 1216382 - protein, 7 aa, Mycobacterium
PAPGPVS

SEQ ID NO: 1216383 - protein, 6 aa, Mycobacterium
PAPGRA

SEQ ID NO: 1216384 - protein, 8 aa, Mycobacterium
PAPGRRRE

SEQ ID NO: 1216385 - protein, 7 aa, Mycobacterium
PAPGSDA

SEQ ID NO: 1216386 - protein, 9 aa, Mycobacterium
PAPGSHPHR

SEQ ID NO: 1216387 - protein, 16 aa, Mycobacterium
PAPGTGPSEQTRERGH

SEQ ID NO: 1216388 - protein, 9 aa, Mycobacterium
PAPHSRTPI

SEQ ID NO: 1216389 - protein, 4 aa, Mycobacterium
PAPL

SEQ ID NO: 1216390 - protein, 11 aa, Mycobacterium
PAPLDPPGIEQ

SEQ ID NO: 1216391 - protein, 5 aa, Mycobacterium
PAPLT

SEQ ID NO: 1216392 - protein, 24 aa, Mycobacterium
PAPNKMNTGGVHGSALGADEVAAT

SEQ ID NO: 1216393 - protein, 8 aa, Mycobacterium
PAPNLPDE

SEQ ID NO: 1216394 - protein, 8 aa, Mycobacterium
PAPPGAPV

SEQ ID NO: 1216395 - protein, 5 aa, Mycobacterium
PAPPH

SEQ ID NO: 1216396 - protein, 5 aa, Mycobacterium
PAPPL

SEQ ID NO: 1216397 - protein, 17 aa, Mycobacterium
PAPPLPNATLRPRRHPG

SEQ ID NO: 1216398 - protein, 17 aa, Mycobacterium
PAPPPNPAPEIPALATA

SEQ ID NO: 1216399 - protein, 13 aa, Mycobacterium
PAPPSVSTIRSRR

SEQ ID NO: 1216400 - protein, 5 aa, Mycobacterium
PAPPV

SEQ ID NO: 1216401 - protein, 32 aa, Mycobacterium
PAPPVPPTPPNSAGVNTGTPGSPIPGTPGSTL

SEQ ID NO: 1216402 - protein, 22 aa, Mycobacterium
PAPQPCPTPSSAALHRPSPRAL

SEQ ID NO: 1216403 - protein, 8 aa, Mycobacterium
PAPQPGER

SEQ ID NO: 1216404 - protein, 6 aa, Mycobacterium
PAPQRL

SEQ ID NO: 1216405 - protein, 9 aa, Mycobacterium
PAPQSDDPR

SEQ ID NO: 1216406 - protein, 6 aa, Mycobacterium
PAPRIQ

SEQ ID NO: 1216407 - protein, 10 aa, Mycobacterium
PAPRLGEHNE

SEQ ID NO: 1216408 - protein, 23 aa, Mycobacterium
PAPRPDADPAAPRAAEPVAPPAA

SEQ ID NO: 1216409 - protein, 5 aa, Mycobacterium
PAPRS

SEQ ID NO: 1216410 - protein, 4 aa, Mycobacterium
PAPS

SEQ ID NO: 1216411 - protein, 9 aa, Mycobacterium
PAPTAANGK

SEQ ID NO: 1216412 - protein, 7 aa, Mycobacterium
PAPTERF

SEQ ID NO: 1216413 - protein, 12 aa, Mycobacterium
PAPTGELTDEPR

SEQ ID NO: 1216414 - protein, 8 aa, Mycobacterium
PAPTRSFD

SEQ ID NO: 1216415 - protein, 7 aa, Mycobacterium
PAPTTDQ

SEQ ID NO: 1216416 - protein, 4 aa, Mycobacterium
PAPV

SEQ ID NO: 1216417 - protein, 24 aa, Mycobacterium
PAPVPPPAAPLDAPLPPPPAPVDP

SEQ ID NO: 1216418 - protein, 5 aa, Mycobacterium
PAPVS

SEQ ID NO: 1216419 - protein, 5 aa, Mycobacterium
PAPWN

SEQ ID NO: 1216420 - protein, 5 aa, Mycobacterium
PAPYD

SEQ ID NO: 1216421 - protein, 11 aa, Mycobacterium
PAPYDTDPKAW

SEQ ID NO: 1216422 - protein, 15 aa, Mycobacterium
PAPYQPREDDIDEQV

SEQ ID NO: 1216423 - protein, 7 aa, Mycobacterium
PAQAEEW

SEQ ID NO: 1216424 - protein, 5 aa, Mycobacterium
PAQAK

SEQ ID NO: 1216425 - protein, 8 aa, Mycobacterium
PAQDDAVR

SEQ ID NO: 1216426 - protein, 8 aa, Mycobacterium
PAQEPDDL

SEQ ID NO: 1216427 - protein, 23 aa, Mycobacterium
PAQNTTLATPDVAAPRPLDGPPR

SEQ ID NO: 1216428 - protein, 13 aa, Mycobacterium
PAQPGAAEIDNRD

SEQ ID NO: 1216429 - protein, 8 aa, Mycobacterium
PAQPGAAY

SEQ ID NO: 1216430 - protein, 7 aa, Mycobacterium
PAQPGVA

SEQ ID NO: 1216431 - protein, 17 aa, Mycobacterium
PAQRNRPVRRSEEDDSV

SEQ ID NO: 1216432 - protein, 10 aa, Mycobacterium
PAQSGAAVGR

SEQ ID NO: 1216433 - protein, 18 aa, Mycobacterium
PAQSGRTFTRANPADPAD

SEQ ID NO: 1216434 - protein, 11 aa, Mycobacterium
PAQSRAAETVE

SEQ ID NO: 1216435 - protein, 6 aa, Mycobacterium
PAQTDY

SEQ ID NO: 1216436 - protein, 4 aa, Mycobacterium
PAQV

SEQ ID NO: 1216437 - protein, 5 aa, Mycobacterium
PARAA

SEQ ID NO: 1216438 - protein, 13 aa, Mycobacterium
PARAAPGRPRDGR

SEQ ID NO: 1216439 - protein, 7 aa, Mycobacterium
PARAPFG

SEQ ID NO: 1216440 - protein, 13 aa, Mycobacterium
PARCSQAKVTSAL

SEQ ID NO: 1216441 - protein, 4 aa, Mycobacterium
PARD

SEQ ID NO: 1216442 - protein, 10 aa, Mycobacterium
PARDDEDPRP

SEQ ID NO: 1216443 - protein, 5 aa, Mycobacterium
PARDP

SEQ ID NO: 1216444 - protein, 7 aa, Mycobacterium
PARDYTG

SEQ ID NO: 1216445 - protein, 8 aa, Mycobacterium
PAREGRPH

SEQ ID NO: 1216446 - protein, 4 aa, Mycobacterium
PARF

SEQ ID NO: 1216447 - protein, 9 aa, Mycobacterium
PARHGRTPS

SEQ ID NO: 1216448 - protein, 6 aa, Mycobacterium
PARIPE

SEQ ID NO: 1216449 - protein, 7 aa, Mycobacterium
PARMRGD

SEQ ID NO: 1216450 - protein, 27 aa, Mycobacterium
PARPGGSEEEITPAGRHRGDDPVGEPL

SEQ ID NO: 1216451 - protein, 10 aa, Mycobacterium
PARPGQPESW

SEQ ID NO: 1216452 - protein, 8 aa, Mycobacterium
PARPNSGE

SEQ ID NO: 1216453 - protein, 5 aa, Mycobacterium
PARPR

SEQ ID NO: 1216454 - protein, 12 aa, Mycobacterium
PARPRPLTGNER

SEQ ID NO: 1216455 - protein, 11 aa, Mycobacterium
PARPTAEPSKY

SEQ ID NO: 1216456 - protein, 6 aa, Mycobacterium
PARREV

SEQ ID NO: 1216457 - protein, 36 aa, Mycobacterium
PARRSDRSGNGGGPNTLGSTPVTGRPRTRAAAPTHG

SEQ ID NO: 1216458 - protein, 13 aa, Mycobacterium
PARRTGSRRRFDP

SEQ ID NO: 1216459 - protein, 13 aa, Mycobacterium
PARRTNMEQRTPL

SEQ ID NO: 1216460 - protein, 11 aa, Mycobacterium
PARRTTPGRDG

SEQ ID NO: 1216461 - protein, 8 aa, Mycobacterium
PARRVTGT

SEQ ID NO: 1216462 - protein, 6 aa, Mycobacterium
PARSFA

SEQ ID NO: 1216463 - protein, 15 aa, Mycobacterium
PARSGGSAAPPTAVA

SEQ ID NO: 1216464 - protein, 5 aa, Mycobacterium
PARSW

SEQ ID NO: 1216465 - protein, 6 aa, Mycobacterium
PARSWG

SEQ ID NO: 1216466 - protein, 20 aa, Mycobacterium
PARTADGDAEGSHRPGRKAG

SEQ ID NO: 1216467 - protein, 7 aa, Mycobacterium
PARTAPW

SEQ ID NO: 1216468 - protein, 14 aa, Mycobacterium
PARTPATGQLPAGA

SEQ ID NO: 1216469 - protein, 9 aa, Mycobacterium
PARTSRATA

SEQ ID NO: 1216470 - protein, 4 aa, Mycobacterium
PARV

SEQ ID NO: 1216471 - protein, 9 aa, Mycobacterium
PASADTATI

SEQ ID NO: 1216472 - protein, 8 aa, Mycobacterium
PASAQLPD

SEQ ID NO: 1216473 - protein, 7 aa, Mycobacterium
PASAYHT

SEQ ID NO: 1216474 - protein, 10 aa, Mycobacterium
PASDADDVRN

SEQ ID NO: 1216475 - protein, 11 aa, Mycobacterium
PASESPQESRT

SEQ ID NO: 1216476 - protein, 7 aa, Mycobacterium
PASFTDR

SEQ ID NO: 1216477 - protein, 10 aa, Mycobacterium
PASGDRDPRL

SEQ ID NO: 1216478 - protein, 9 aa, Mycobacterium
PASGEPRPL

SEQ ID NO: 1216479 - protein, 19 aa, Mycobacterium
PASGPAPLSSVTGAQTTSI

SEQ ID NO: 1216480 - protein, 21 aa, Mycobacterium
PASGRLTGADSGAGRLPEAEE

SEQ ID NO: 1216481 - protein, 5 aa, Mycobacterium
PASGS

SEQ ID NO: 1216482 - protein, 10 aa, Mycobacterium
PASGSGTGAR

SEQ ID NO: 1216483 - protein, 8 aa, Mycobacterium
PASGTFDP

SEQ ID NO: 1216484 - protein, 7 aa, Mycobacterium
PASKTRN

SEQ ID NO: 1216485 - protein, 7 aa, Mycobacterium
PASKTRT

SEQ ID NO: 1216486 - protein, 23 aa, Mycobacterium
PASLEPYADTAAKTAGTPAELAA

SEQ ID NO: 1216487 - protein, 24 aa, Mycobacterium
PASLEPYADTPAKTAATPAELGAN

SEQ ID NO: 1216488 - protein, 14 aa, Mycobacterium
PASLGSQGNSNVTN

SEQ ID NO: 1216489 - protein, 6 aa, Mycobacterium
PASLTA

SEQ ID NO: 1216490 - protein, 10 aa, Mycobacterium
PASLTDPSEM

SEQ ID NO: 1216491 - protein, 16 aa, Mycobacterium
PASMGKPRYPTPTGQF

SEQ ID NO: 1216492 - protein, 13 aa, Mycobacterium
PASMSPGRSCPRS

SEQ ID NO: 1216493 - protein, 12 aa, Mycobacterium
PASNPTPVTPEG

SEQ ID NO: 1216494 - protein, 7 aa, Mycobacterium
PASPAVP

SEQ ID NO: 1216495 - protein, 9 aa, Mycobacterium
PASPDWPRA

SEQ ID NO: 1216496 - protein, 13 aa, Mycobacterium
PASPFGVGGPPVY

SEQ ID NO: 1216497 - protein, 8 aa, Mycobacterium
PASPLRTT

SEQ ID NO: 1216498 - protein, 8 aa, Mycobacterium
PASRADYV

SEQ ID NO: 1216499 - protein, 5 aa, Mycobacterium
PASRG

SEQ ID NO: 1216500 - protein, 12 aa, Mycobacterium
PASRPADHDVAG

SEQ ID NO: 1216501 - protein, 6 aa, Mycobacterium
PASSGT

SEQ ID NO: 1216502 - protein, 8 aa, Mycobacterium
PASSPDVQ

SEQ ID NO: 1216503 - protein, 15 aa, Mycobacterium
PASSQIGHKESMKDT

SEQ ID NO: 1216504 - protein, 16 aa, Mycobacterium
PASVTDRASRLPADRQ

SEQ ID NO: 1216505 - protein, 6 aa, Mycobacterium
PATDPA

SEQ ID NO: 1216506 - protein, 10 aa, Mycobacterium
PATDTGDGTS

SEQ ID NO: 1216507 - protein, 5 aa, Mycobacterium
PATEG

SEQ ID NO: 1216508 - protein, 21 aa, Mycobacterium
PATEQALGSVPGGTDADVDAA

SEQ ID NO: 1216509 - protein, 11 aa, Mycobacterium
PATGAVPGAEA

SEQ ID NO: 1216510 - protein, 8 aa, Mycobacterium
PATGDGRA

SEQ ID NO: 1216511 - protein, 11 aa, Mycobacterium
PATGDRRRAVT

SEQ ID NO: 1216512 - protein, 5 aa, Mycobacterium
PATGE

SEQ ID NO: 1216513 - protein, 6 aa, Mycobacterium
PATGEV

SEQ ID NO: 1216514 - protein, 7 aa, Mycobacterium
PATGRKA

SEQ ID NO: 1216515 - protein, 7 aa, Mycobacterium
PATGRVD

SEQ ID NO: 1216516 - protein, 6 aa, Mycobacterium
PATGSV

SEQ ID NO: 1216517 - protein, 11 aa, Mycobacterium
PATGSVNKSGV

SEQ ID NO: 1216518 - protein, 4 aa, Mycobacterium
PATH

SEQ ID NO: 1216519 - protein, 6 aa, Mycobacterium
PATHAA

SEQ ID NO: 1216520 - protein, 4 aa, Mycobacterium
PATI

SEQ ID NO: 1216521 - protein, 13 aa, Mycobacterium
PATKEATAKGEGR

SEQ ID NO: 1216522 - protein, 7 aa, Mycobacterium
PATKGHT

SEQ ID NO: 1216523 - protein, 4 aa, Mycobacterium
PATL

SEQ ID NO: 1216524 - protein, 12 aa, Mycobacterium
PATLPADEVDAS

SEQ ID NO: 1216525 - protein, 7 aa, Mycobacterium
PATPDRR

SEQ ID NO: 1216526 - protein, 6 aa, Mycobacterium
PATPES

SEQ ID NO: 1216527 - protein, 10 aa, Mycobacterium
PATPYPDPRY

SEQ ID NO: 1216528 - protein, 4 aa, Mycobacterium
PATQ

SEQ ID NO: 1216529 - protein, 6 aa, Mycobacterium
PATQEI

SEQ ID NO: 1216530 - protein, 14 aa, Mycobacterium
PATRHGVQPRNDGS

SEQ ID NO: 1216531 - protein, 7 aa, Mycobacterium
PATRPLQ

SEQ ID NO: 1216532 - protein, 5 aa, Mycobacterium
PATSD

SEQ ID NO: 1216533 - protein, 8 aa, Mycobacterium
PATSGPYE

SEQ ID NO: 1216534 - protein, 7 aa, Mycobacterium
PATTAAG

SEQ ID NO: 1216535 - protein, 7 aa, Mycobacterium
PATTDEM

SEQ ID NO: 1216536 - protein, 7 aa, Mycobacterium
PATTPED

SEQ ID NO: 1216537 - protein, 8 aa, Mycobacterium
PATVDNRT

SEQ ID NO: 1216538 - protein, 5 aa, Mycobacterium
PATVG

SEQ ID NO: 1216539 - protein, 20 aa, Mycobacterium
PATYGAGPKLSTHTRADSPL

SEQ ID NO: 1216540 - protein, 6 aa, Mycobacterium
PAVAPA

SEQ ID NO: 1216541 - protein, 24 aa, Mycobacterium
PAVDAQRVAEGGAVTRKGSLTDPK

SEQ ID NO: 1216542 - protein, 6 aa, Mycobacterium
PAVDQG

SEQ ID NO: 1216543 - protein, 13 aa, Mycobacterium
PAVERGGVPGEPL

SEQ ID NO: 1216544 - protein, 6 aa, Mycobacterium
PAVNPA

SEQ ID NO: 1216545 - protein, 4 aa, Mycobacterium
PAVP

SEQ ID NO: 1216546 - protein, 22 aa, Mycobacterium
PAVPASAPAPVPAAAPLPPPVA

SEQ ID NO: 1216547 - protein, 14 aa, Mycobacterium
PAVPAVTEPPPRTG

SEQ ID NO: 1216548 - protein, 6 aa, Mycobacterium
PAVPGD

SEQ ID NO: 1216549 - protein, 19 aa, Mycobacterium
PAVQSAAGDRVATNETRRL

SEQ ID NO: 1216550 - protein, 7 aa, Mycobacterium
PAVQSDP

SEQ ID NO: 1216551 - protein, 10 aa, Mycobacterium
PAVRPSPGGC

SEQ ID NO: 1216552 - protein, 7 aa, Mycobacterium
PAVSADD

SEQ ID NO: 1216553 - protein, 11 aa, Mycobacterium
PAVSDNKKSVK

SEQ ID NO: 1216554 - protein, 5 aa, Mycobacterium
PAVSE

SEQ ID NO: 1216555 - protein, 10 aa, Mycobacterium
PAVSEANRSI

SEQ ID NO: 1216556 - protein, 12 aa, Mycobacterium
PAVSSPAVQHGG

SEQ ID NO: 1216557 - protein, 5 aa, Mycobacterium
PAVTK

SEQ ID NO: 1216558 - protein, 7 aa, Mycobacterium
PAVTPAK

SEQ ID NO: 1216559 - protein, 4 aa, Mycobacterium
PAVV

SEQ ID NO: 1216560 - protein, 5 aa, Mycobacterium
PAWAS

SEQ ID NO: 1216561 - protein, 5 aa, Mycobacterium
PAWGD

SEQ ID NO: 1216562 - protein, 8 aa, Mycobacterium
PAWQGQGI

SEQ ID NO: 1216563 - protein, 16 aa, Mycobacterium
PAWRSTDASLAPYNGM

SEQ ID NO: 1216564 - protein, 6 aa, Mycobacterium
PAYANP

SEQ ID NO: 1216565 - protein, 11 aa, Mycobacterium
PAYAPGKTVPG

SEQ ID NO: 1216566 - protein, 8 aa, Mycobacterium
PAYEGPPG

SEQ ID NO: 1216567 - protein, 6 aa, Mycobacterium
PAYPQD

SEQ ID NO: 1216568 - protein, 8 aa, Mycobacterium
PAYPTDDE

SEQ ID NO: 1216569 - protein, 19 aa, Mycobacterium
PAYRPAPRLDEHADAAAHS

SEQ ID NO: 1216570 - protein, 10 aa, Mycobacterium
PAYSPGDTDI

SEQ ID NO: 1216571 - protein, 4 aa, Mycobacterium
PAYT

SEQ ID NO: 1216572 - protein, 12 aa, Mycobacterium
PAYTGRLSTNPI

SEQ ID NO: 1216573 - protein, 9 aa, Mycobacterium
PCAAGKGTA

SEQ ID NO: 1216574 - protein, 14 aa, Mycobacterium
PCAPADPRNCSCPG

SEQ ID NO: 1216575 - protein, 15 aa, Mycobacterium
PCAPADPRNCSCPGG

SEQ ID NO: 1216576 - protein, 17 aa, Mycobacterium
PCAVPRQEQAKRASASR

SEQ ID NO: 1216577 - protein, 4 aa, Mycobacterium
PCTP

SEQ ID NO: 1216578 - protein, 6 aa, Mycobacterium
PCTRDP

SEQ ID NO: 1216579 - protein, 12 aa, Mycobacterium
PDAAERVGTDAG

SEQ ID NO: 1216580 - protein, 9 aa, Mycobacterium
PDAAPGASP

SEQ ID NO: 1216581 - protein, 41 aa, Mycobacterium
PDAARTADESDRETPPAGRDTVAPPGGAPNGDATPPPMPAA

SEQ ID NO: 1216582 - protein, 8 aa, Mycobacterium
PDAASTPL

SEQ ID NO: 1216583 - protein, 7 aa, Mycobacterium
PDADNQA

SEQ ID NO: 1216584 - protein, 10 aa, Mycobacterium
PDADSSEAAV

SEQ ID NO: 1216585 - protein, 4 aa, Mycobacterium
PDAE

SEQ ID NO: 1216586 - protein, 9 aa, Mycobacterium
PDAEGGKEL

SEQ ID NO: 1216587 - protein, 15 aa, Mycobacterium
PDAEPAEDKLAPSGA

SEQ ID NO: 1216588 - protein, 7 aa, Mycobacterium
PDAESLE

SEQ ID NO: 1216589 - protein, 28 aa, Mycobacterium
PDAESPPAATADPVAAGDDSGGAPEVEG

SEQ ID NO: 1216590 - protein, 7 aa, Mycobacterium
PDAGDRF

SEQ ID NO: 1216591 - protein, 9 aa, Mycobacterium
PDAGGDFDA

SEQ ID NO: 1216592 - protein, 8 aa, Mycobacterium
PDAGGPRD

SEQ ID NO: 1216593 - protein, 8 aa, Mycobacterium
PDAGWSRT

SEQ ID NO: 1216594 - protein, 13 aa, Mycobacterium
PDAIPNDSDNFDE

SEQ ID NO: 1216595 - protein, 5 aa, Mycobacterium
PDAIS

SEQ ID NO: 1216596 - protein, 12 aa, Mycobacterium
PDAISAEPHPAA

SEQ ID NO: 1216597 - protein, 9 aa, Mycobacterium
PDAKGFSAR

SEQ ID NO: 1216598 - protein, 11 aa, Mycobacterium
PDAKPAATGLE

SEQ ID NO: 1216599 - protein, 13 aa, Mycobacterium
PDANPADPHVGVR

SEQ ID NO: 1216600 - protein, 10 aa, Mycobacterium
PDAPAAGSPL

SEQ ID NO: 1216601 - protein, 10 aa, Mycobacterium
PDAPDAEARE

SEQ ID NO: 1216602 - protein, 7 aa, Mycobacterium
PDAPGAR

SEQ ID NO: 1216603 - protein, 7 aa, Mycobacterium
PDAPKHR

SEQ ID NO: 1216604 - protein, 14 aa, Mycobacterium
PDAPREDPSDPSVI

SEQ ID NO: 1216605 - protein, 7 aa, Mycobacterium
PDAPTAS

SEQ ID NO: 1216606 - protein, 5 aa, Mycobacterium
PDAPV

SEQ ID NO: 1216607 - protein, 7 aa, Mycobacterium
PDAPVDE

SEQ ID NO: 1216608 - protein, 5 aa, Mycobacterium
PDAQD

SEQ ID NO: 1216609 - protein, 22 aa, Mycobacterium
PDAQEPAVPYAPDGRPDGRPWT

SEQ ID NO: 1216610 - protein, 9 aa, Mycobacterium
PDAQNAQSR

SEQ ID NO: 1216611 - protein, 7 aa, Mycobacterium
PDAQNHR

SEQ ID NO: 1216612 - protein, 7 aa, Mycobacterium
PDAQRAA

SEQ ID NO: 1216613 - protein, 8 aa, Mycobacterium
PDARERVA

SEQ ID NO: 1216614 - protein, 7 aa, Mycobacterium
PDARHAP

SEQ ID NO: 1216615 - protein, 8 aa, Mycobacterium
PDASDREL

SEQ ID NO: 1216616 - protein, 5 aa, Mycobacterium
PDASG

SEQ ID NO: 1216617 - protein, 9 aa, Mycobacterium
PDASLPDKV

SEQ ID NO: 1216618 - protein, 9 aa, Mycobacterium
PDASPNPAF

SEQ ID NO: 1216619 - protein, 5 aa, Mycobacterium
PDATA

SEQ ID NO: 1216620 - protein, 8 aa, Mycobacterium
PDATEPTH

SEQ ID NO: 1216621 - protein, 12 aa, Mycobacterium
PDATLEEAQENK

SEQ ID NO: 1216622 - protein, 12 aa, Mycobacterium
PDAVADDFTKPG

SEQ ID NO: 1216623 - protein, 5 aa, Mycobacterium
PDAVD

SEQ ID NO: 1216624 - protein, 7 aa, Mycobacterium
PDAVGGD

SEQ ID NO: 1216625 - protein, 15 aa, Mycobacterium
PDAYRSAAEAGSVNQ

SEQ ID NO: 1216626 - protein, 7 aa, Mycobacterium
PDCGPNR

SEQ ID NO: 1216627 - protein, 20 aa, Mycobacterium
PDCGQRVREATDAVAASRGL

SEQ ID NO: 1216628 - protein, 4 aa, Mycobacterium
PDCP

SEQ ID NO: 1216629 - protein, 14 aa, Mycobacterium
PDCPGNRDTQPTKD

SEQ ID NO: 1216630 - protein, 7 aa, Mycobacterium
PDCSSSG

SEQ ID NO: 1216631 - protein, 4 aa, Mycobacterium
PDCT

SEQ ID NO: 1216632 - protein, 4 aa, Mycobacterium
PDDA

SEQ ID NO: 1216633 - protein, 5 aa, Mycobacterium
PDDAA

SEQ ID NO: 1216634 - protein, 7 aa, Mycobacterium
PDDAADG

SEQ ID NO: 1216635 - protein, 14 aa, Mycobacterium
PDDADSEPSPPLAK

SEQ ID NO: 1216636 - protein, 7 aa, Mycobacterium
PDDAQEF

SEQ ID NO: 1216637 - protein, 8 aa, Mycobacterium
PDDASLPE

SEQ ID NO: 1216638 - protein, 5 aa, Mycobacterium
PDDAW

SEQ ID NO: 1216639 - protein, 16 aa, Mycobacterium
PDDCTVPAGAHVMHSG

SEQ ID NO: 1216640 - protein, 13 aa, Mycobacterium
PDDDAVDPASAAL

SEQ ID NO: 1216641 - protein, 7 aa, Mycobacterium
PDDDLGQ

SEQ ID NO: 1216642 - protein, 10 aa, Mycobacterium
PDDDSLSEHL

SEQ ID NO: 1216643 - protein, 8 aa, Mycobacterium
PDDESEHE

SEQ ID NO: 1216644 - protein, 10 aa, Mycobacterium
PDDETLTTGA

SEQ ID NO: 1216645 - protein, 10 aa, Mycobacterium
PDDETLTTGG

SEQ ID NO: 1216646 - protein, 6 aa, Mycobacterium
PDDFST

SEQ ID NO: 1216647 - protein, 7 aa, Mycobacterium
PDDGEKK

SEQ ID NO: 1216648 - protein, 9 aa, Mycobacterium
PDDGEPDWA

SEQ ID NO: 1216649 - protein, 6 aa, Mycobacterium
PDDGSW

SEQ ID NO: 1216650 - protein, 9 aa, Mycobacterium
PDDGTETYA

SEQ ID NO: 1216651 - protein, 12 aa, Mycobacterium
PDDGTTPPPFER

SEQ ID NO: 1216652 - protein, 5 aa, Mycobacterium
PDDHR

SEQ ID NO: 1216653 - protein, 4 aa, Mycobacterium
PDDI

SEQ ID NO: 1216654 - protein, 7 aa, Mycobacterium
PDDIPEG

SEQ ID NO: 1216655 - protein, 4 aa, Mycobacterium
PDDL

SEQ ID NO: 1216656 - protein, 6 aa, Mycobacterium
PDDLNA

SEQ ID NO: 1216657 - protein, 6 aa, Mycobacterium
PDDLPY

SEQ ID NO: 1216658 - protein, 7 aa, Mycobacterium
PDDLSKQ

SEQ ID NO: 1216659 - protein, 6 aa, Mycobacterium
PDDLTA

SEQ ID NO: 1216660 - protein, 16 aa, Mycobacterium
PDDPDVASAVTATPTV

SEQ ID NO: 1216661 - protein, 10 aa, Mycobacterium
PDDPSPQRLK

SEQ ID NO: 1216662 - protein, 8 aa, Mycobacterium
PDDQDAEV

SEQ ID NO: 1216663 - protein, 5 aa, Mycobacterium
PDDRP

SEQ ID NO: 1216664 - protein, 5 aa, Mycobacterium
PDDRT

SEQ ID NO: 1216665 - protein, 10 aa, Mycobacterium
PDDRTPSGLD

SEQ ID NO: 1216666 - protein, 9 aa, Mycobacterium
PDDRTQPIP

SEQ ID NO: 1216667 - protein, 10 aa, Mycobacterium
PDDRWDDPGL

SEQ ID NO: 1216668 - protein, 17 aa, Mycobacterium
PDDSPKAVAQAGAGKVG

SEQ ID NO: 1216669 - protein, 6 aa, Mycobacterium
PDDSTA

SEQ ID NO: 1216670 - protein, 12 aa, Mycobacterium
PDDTDAPGDSEM

SEQ ID NO: 1216671 - protein, 10 aa, Mycobacterium
PDDTPWGGKP

SEQ ID NO: 1216672 - protein, 4 aa, Mycobacterium
PDEA

SEQ ID NO: 1216673 - protein, 15 aa, Mycobacterium
PDEAAAMETDRHNEA

SEQ ID NO: 1216674 - protein, 13 aa, Mycobacterium
PDEASAAASIGEP

SEQ ID NO: 1216675 - protein, 9 aa, Mycobacterium
PDEASLPTV

SEQ ID NO: 1216676 - protein, 11 aa, Mycobacterium
PDEDAADAARQ

SEQ ID NO: 1216677 - protein, 5 aa, Mycobacterium
PDEDR

SEQ ID NO: 1216678 - protein, 10 aa, Mycobacterium
PDEDRGKFDG

SEQ ID NO: 1216679 - protein, 5 aa, Mycobacterium
PDEGA

SEQ ID NO: 1216680 - protein, 7 aa, Mycobacterium
PDEGLDR

SEQ ID NO: 1216681 - protein, 10 aa, Mycobacterium
PDEGRASMGA

SEQ ID NO: 1216682 - protein, 6 aa, Mycobacterium
PDEGTV

SEQ ID NO: 1216683 - protein, 4 aa, Mycobacterium
PDEH

SEQ ID NO: 1216684 - protein, 11 aa, Mycobacterium
PDEITTPGRGQ

SEQ ID NO: 1216685 - protein, 10 aa, Mycobacterium
PDEKPGRKRH

SEQ ID NO: 1216686 - protein, 5 aa, Mycobacterium
PDELA

SEQ ID NO: 1216687 - protein, 18 aa, Mycobacterium
PDELDEAVTSASREAAAA

SEQ ID NO: 1216688 - protein, 8 aa, Mycobacterium
PDEPARDP

SEQ ID NO: 1216689 - protein, 8 aa, Mycobacterium
PDEPGQAV

SEQ ID NO: 1216690 - protein, 18 aa, Mycobacterium
PDEPLKTDGSAQPVPTPR

SEQ ID NO: 1216691 - protein, 16 aa, Mycobacterium
PDEPVTPNAEAPAALP

SEQ ID NO: 1216692 - protein, 6 aa, Mycobacterium
PDEREM

SEQ ID NO: 1216693 - protein, 13 aa, Mycobacterium
PDETAASIRAFAE

SEQ ID NO: 1216694 - protein, 8 aa, Mycobacterium
PDETASNR

SEQ ID NO: 1216695 - protein, 5 aa, Mycobacterium
PDETE

SEQ ID NO: 1216696 - protein, 7 aa, Mycobacterium
PDETVTE

SEQ ID NO: 1216697 - protein, 4 aa, Mycobacterium
PDEV

SEQ ID NO: 1216698 - protein, 7 aa, Mycobacterium
PDEVAEA

SEQ ID NO: 1216699 - protein, 4 aa, Mycobacterium
PDEY

SEQ ID NO: 1216700 - protein, 6 aa, Mycobacterium
PDEYAP

SEQ ID NO: 1216701 - protein, 10 aa, Mycobacterium
PDFGSAAAPL

SEQ ID NO: 1216702 - protein, 10 aa, Mycobacterium
PDFGSNGENR

SEQ ID NO: 1216703 - protein, 23 aa, Mycobacterium
PDFGSNPAGMRTRARRSGAGENA

SEQ ID NO: 1216704 - protein, 19 aa, Mycobacterium
PDFGSNPGGMRTTARRDGS

SEQ ID NO: 1216705 - protein, 6 aa, Mycobacterium
PDFRAG

SEQ ID NO: 1216706 - protein, 5 aa, Mycobacterium
PDFTP

SEQ ID NO: 1216707 - protein, 10 aa, Mycobacterium
PDGAATSSTQ

SEQ ID NO: 1216708 - protein, 12 aa, Mycobacterium
PDGAEPNTGSDG

SEQ ID NO: 1216709 - protein, 12 aa, Mycobacterium
PDGAPTPESRYR

SEQ ID NO: 1216710 - protein, 16 aa, Mycobacterium
PDGAQPCDKERARKRG

SEQ ID NO: 1216711 - protein, 10 aa, Mycobacterium
PDGASASIDD

SEQ ID NO: 1216712 - protein, 12 aa, Mycobacterium
PDGAVAGSVSGG

SEQ ID NO: 1216713 - protein, 8 aa, Mycobacterium
PDGAVYPS

SEQ ID NO: 1216714 - protein, 4 aa, Mycobacterium
PDGD

SEQ ID NO: 1216715 - protein, 15 aa, Mycobacterium
PDGDDGHRSVSATRK

SEQ ID NO: 1216716 - protein, 13 aa, Mycobacterium
PDGDDSPAMPAPQ

SEQ ID NO: 1216717 - protein, 5 aa, Mycobacterium
PDGDE

SEQ ID NO: 1216718 - protein, 5 aa, Mycobacterium
PDGDR

SEQ ID NO: 1216719 - protein, 7 aa, Mycobacterium
PDGDRAG

SEQ ID NO: 1216720 - protein, 4 aa, Mycobacterium
PDGE

SEQ ID NO: 1216721 - protein, 6 aa, Mycobacterium
PDGEIE

SEQ ID NO: 1216722 - protein, 16 aa, Mycobacterium
PDGEKTPGKTVPDPYF

SEQ ID NO: 1216723 - protein, 5 aa, Mycobacterium
PDGEL

SEQ ID NO: 1216724 - protein, 6 aa, Mycobacterium
PDGETH

SEQ ID NO: 1216725 - protein, 6 aa, Mycobacterium
PDGGAP

SEQ ID NO: 1216726 - protein, 7 aa, Mycobacterium
PDGGASA

SEQ ID NO: 1216727 - protein, 6 aa, Mycobacterium
PDGGDL

SEQ ID NO: 1216728 - protein, 7 aa, Mycobacterium
PDGGDRA

SEQ ID NO: 1216729 - protein, 14 aa, Mycobacterium
PDGGMSVAAAPKKR

SEQ ID NO: 1216730 - protein, 9 aa, Mycobacterium
PDGGPHLQN

SEQ ID NO: 1216731 - protein, 10 aa, Mycobacterium
PDGGPREAAL

SEQ ID NO: 1216732 - protein, 9 aa, Mycobacterium
PDGGQAERA

SEQ ID NO: 1216733 - protein, 9 aa, Mycobacterium
PDGHPGRAE

SEQ ID NO: 1216734 - protein, 7 aa, Mycobacterium
PDGHTES

SEQ ID NO: 1216735 - protein, 8 aa, Mycobacterium
PDGLPDAD

SEQ ID NO: 1216736 - protein, 12 aa, Mycobacterium
PDGLRGTLSTRA

SEQ ID NO: 1216737 - protein, 6 aa, Mycobacterium
PDGLSD

SEQ ID NO: 1216738 - protein, 9 aa, Mycobacterium
PDGLSDPAG

SEQ ID NO: 1216739 - protein, 8 aa, Mycobacterium
PDGPFEPD

SEQ ID NO: 1216740 - protein, 9 aa, Mycobacterium
PDGPGQAVT

SEQ ID NO: 1216741 - protein, 5 aa, Mycobacterium
PDGPH

SEQ ID NO: 1216742 - protein, 7 aa, Mycobacterium
PDGPPDS

SEQ ID NO: 1216743 - protein, 5 aa, Mycobacterium
PDGPQ

SEQ ID NO: 1216744 - protein, 6 aa, Mycobacterium
PDGPQR

SEQ ID NO: 1216745 - protein, 6 aa, Mycobacterium
PDGQGG

SEQ ID NO: 1216746 - protein, 10 aa, Mycobacterium
PDGQGGYRLT

SEQ ID NO: 1216747 - protein, 14 aa, Mycobacterium
PDGQKTPGKTVPDP

SEQ ID NO: 1216748 - protein, 10 aa, Mycobacterium
PDGQPYRDSE

SEQ ID NO: 1216749 - protein, 5 aa, Mycobacterium
PDGRD

SEQ ID NO: 1216750 - protein, 9 aa, Mycobacterium
PDGRPYDED

SEQ ID NO: 1216751 - protein, 11 aa, Mycobacterium
PDGRRYGVTAG

SEQ ID NO: 1216752 - protein, 13 aa, Mycobacterium
PDGRSYRARIRGK

SEQ ID NO: 1216753 - protein, 7 aa, Mycobacterium
PDGRTPP

SEQ ID NO: 1216754 - protein, 11 aa, Mycobacterium
PDGSALSDTEA

SEQ ID NO: 1216755 - protein, 5 aa, Mycobacterium
PDGSE

SEQ ID NO: 1216756 - protein, 5 aa, Mycobacterium
PDGSL

SEQ ID NO: 1216757 - protein, 5 aa, Mycobacterium
PDGSR

SEQ ID NO: 1216758 - protein, 8 aa, Mycobacterium
PDGSRRDT

SEQ ID NO: 1216759 - protein, 10 aa, Mycobacterium
PDGSTAEGNA

SEQ ID NO: 1216760 - protein, 5 aa, Mycobacterium
PDGTL

SEQ ID NO: 1216761 - protein, 8 aa, Mycobacterium
PDGTTAEV

SEQ ID NO: 1216762 - protein, 13 aa, Mycobacterium
PDGTVTGSVSGGC

SEQ ID NO: 1216763 - protein, 5 aa, Mycobacterium
PDGVA

SEQ ID NO: 1216764 - protein, 4 aa, Mycobacterium
PDGY

SEQ ID NO: 1216765 - protein, 8 aa, Mycobacterium
PDHADTAR

SEQ ID NO: 1216766 - protein, 7 aa, Mycobacterium
PDHDGDV

SEQ ID NO: 1216767 - protein, 9 aa, Mycobacterium
PDHEGTSGM

SEQ ID NO: 1216768 - protein, 10 aa, Mycobacterium
PDHPRKDAAV

SEQ ID NO: 1216769 - protein, 4 aa, Mycobacterium
PDIA

SEQ ID NO: 1216770 - protein, 16 aa, Mycobacterium
PDIAAPAPAPTAKPKS

SEQ ID NO: 1216771 - protein, 5 aa, Mycobacterium
PDIAD

SEQ ID NO: 1216772 - protein, 5 aa, Mycobacterium
PDIDG

SEQ ID NO: 1216773 - protein, 4 aa, Mycobacterium
PDIS

SEQ ID NO: 1216774 - protein, 4 aa, Mycobacterium
PDKD

SEQ ID NO: 1216775 - protein, 7 aa, Mycobacterium
PDKDSFA

SEQ ID NO: 1216776 - protein, 6 aa, Mycobacterium
PDKLRD

SEQ ID NO: 1216777 - protein, 8 aa, Mycobacterium
PDKSEADV

SEQ ID NO: 1216778 - protein, 9 aa, Mycobacterium
PDKVGRDAG

SEQ ID NO: 1216779 - protein, 11 aa, Mycobacterium
PDKVGRDAGEI

SEQ ID NO: 1216780 - protein, 5 aa, Mycobacterium
PDLDR

SEQ ID NO: 1216781 - protein, 13 aa, Mycobacterium
PDLENPTRADAEP

SEQ ID NO: 1216782 - protein, 4 aa, Mycobacterium
PDLG

SEQ ID NO: 1216783 - protein, 5 aa, Mycobacterium
PDLGE

SEQ ID NO: 1216784 - protein, 10 aa, Mycobacterium
PDLGRAPADL

SEQ ID NO: 1216785 - protein, 18 aa, Mycobacterium
PDLGTGPVSFRDSTSPEF

SEQ ID NO: 1216786 - protein, 14 aa, Mycobacterium
PDLPADTKTGQEVG

SEQ ID NO: 1216787 - protein, 9 aa, Mycobacterium
PDLPAGGQR

SEQ ID NO: 1216788 - protein, 20 aa, Mycobacterium
PDLPDDPEPPAPTAAAHRSK

SEQ ID NO: 1216789 - protein, 5 aa, Mycobacterium
PDLPN

SEQ ID NO: 1216790 - protein, 6 aa, Mycobacterium
PDLPPE

SEQ ID NO: 1216791 - protein, 5 aa, Mycobacterium
PDLQA

SEQ ID NO: 1216792 - protein, 6 aa, Mycobacterium
PDLQQA

SEQ ID NO: 1216793 - protein, 17 aa, Mycobacterium
PDLRADSNEGGQHDRLT

SEQ ID NO: 1216794 - protein, 8 aa, Mycobacterium
PDLTATRG

SEQ ID NO: 1216795 - protein, 15 aa, Mycobacterium
PDLTNAGKEPVTELP

SEQ ID NO: 1216796 - protein, 4 aa, Mycobacterium
PDLV

SEQ ID NO: 1216797 - protein, 5 aa, Mycobacterium
PDNEV

SEQ ID NO: 1216798 - protein, 4 aa, Mycobacterium
PDNF

SEQ ID NO: 1216799 - protein, 11 aa, Mycobacterium
PDNGPYDEPAA

SEQ ID NO: 1216800 - protein, 5 aa, Mycobacterium
PDNGS

SEQ ID NO: 1216801 - protein, 8 aa, Mycobacterium
PDNNGAFE

SEQ ID NO: 1216802 - protein, 6 aa, Mycobacterium
PDNPSM

SEQ ID NO: 1216803 - protein, 7 aa, Mycobacterium
PDNTLAD

SEQ ID NO: 1216804 - protein, 15 aa, Mycobacterium
PDNVAGGMGGMPPDE

SEQ ID NO: 1216805 - protein, 9 aa, Mycobacterium
PDPADGGQA

SEQ ID NO: 1216806 - protein, 8 aa, Mycobacterium
PDPAGQGL

SEQ ID NO: 1216807 - protein, 13 aa, Mycobacterium
PDPAHPDVTKRAR

SEQ ID NO: 1216808 - protein, 19 aa, Mycobacterium
PDPAPPDESSSAAATHEDG

SEQ ID NO: 1216809 - protein, 19 aa, Mycobacterium
PDPAQRSDRLASPAWGANA

SEQ ID NO: 1216810 - protein, 6 aa, Mycobacterium
PDPAVG

SEQ ID NO: 1216811 - protein, 5 aa, Mycobacterium
PDPDA

SEQ ID NO: 1216812 - protein, 4 aa, Mycobacterium
PDPE

SEQ ID NO: 1216813 - protein, 8 aa, Mycobacterium
PDPEMGEQ

SEQ ID NO: 1216814 - protein, 5 aa, Mycobacterium
PDPET

SEQ ID NO: 1216815 - protein, 8 aa, Mycobacterium
PDPEWGET

SEQ ID NO: 1216816 - protein, 7 aa, Mycobacterium
PDPEYGE

SEQ ID NO: 1216817 - protein, 9 aa, Mycobacterium
PDPGGAAFY

SEQ ID NO: 1216818 - protein, 8 aa, Mycobacterium
PDPGGDPV

SEQ ID NO: 1216819 - protein, 8 aa, Mycobacterium
PDPGRGRR

SEQ ID NO: 1216820 - protein, 6 aa, Mycobacterium
PDPGRL

SEQ ID NO: 1216821 - protein, 5 aa, Mycobacterium
PDPHP

SEQ ID NO: 1216822 - protein, 6 aa, Mycobacterium
PDPKWG

SEQ ID NO: 1216823 - protein, 5 aa, Mycobacterium
PDPLA

SEQ ID NO: 1216824 - protein, 10 aa, Mycobacterium
PDPNGERAGY

SEQ ID NO: 1216825 - protein, 10 aa, Mycobacterium
PDPNGKRAGY

SEQ ID NO: 1216826 - protein, 10 aa, Mycobacterium
PDPPATERDA

SEQ ID NO: 1216827 - protein, 19 aa, Mycobacterium
PDPPRDRSERLSAGGYESA

SEQ ID NO: 1216828 - protein, 7 aa, Mycobacterium
PDPRHDT

SEQ ID NO: 1216829 - protein, 7 aa, Mycobacterium
PDPRLTG

SEQ ID NO: 1216830 - protein, 11 aa, Mycobacterium
PDPRPRGSAPA

SEQ ID NO: 1216831 - protein, 7 aa, Mycobacterium
PDPRPVA

SEQ ID NO: 1216832 - protein, 14 aa, Mycobacterium
PDPRRATGEGYTDR

SEQ ID NO: 1216833 - protein, 6 aa, Mycobacterium
PDPRRG

SEQ ID NO: 1216834 - protein, 14 aa, Mycobacterium
PDPSAAESPQQRGR

SEQ ID NO: 1216835 - protein, 4 aa, Mycobacterium
PDPT

SEQ ID NO: 1216836 - protein, 9 aa, Mycobacterium
PDPTAPEVQ

SEQ ID NO: 1216837 - protein, 9 aa, Mycobacterium
PDPTPGKNK

SEQ ID NO: 1216838 - protein, 11 aa, Mycobacterium
PDPTPQGHHDP

SEQ ID NO: 1216839 - protein, 6 aa, Mycobacterium
PDPTPV

SEQ ID NO: 1216840 - protein, 7 aa, Mycobacterium
PDPTRAS

SEQ ID NO: 1216841 - protein, 6 aa, Mycobacterium
PDPTVG

SEQ ID NO: 1216842 - protein, 6 aa, Mycobacterium
PDPTVQ

SEQ ID NO: 1216843 - protein, 6 aa, Mycobacterium
PDPTWD

SEQ ID NO: 1216844 - protein, 6 aa, Mycobacterium
PDPVDP

SEQ ID NO: 1216845 - protein, 7 aa, Mycobacterium
PDPVGDT

SEQ ID NO: 1216846 - protein, 10 aa, Mycobacterium
PDPVSAGPDV

SEQ ID NO: 1216847 - protein, 9 aa, Mycobacterium
PDPVTESRC

SEQ ID NO: 1216848 - protein, 18 aa, Mycobacterium
PDQDTPPEAGSGHPAGGV

SEQ ID NO: 1216849 - protein, 6 aa, Mycobacterium
PDQEGV

SEQ ID NO: 1216850 - protein, 8 aa, Mycobacterium
PDQEKTTA

SEQ ID NO: 1216851 - protein, 13 aa, Mycobacterium
PDQGNRKVRDHPE

SEQ ID NO: 1216852 - protein, 13 aa, Mycobacterium
PDQGRPLEVGEPA

SEQ ID NO: 1216853 - protein, 7 aa, Mycobacterium
PDQLASV

SEQ ID NO: 1216854 - protein, 5 aa, Mycobacterium
PDQPD

SEQ ID NO: 1216855 - protein, 7 aa, Mycobacterium
PDQPGEI

SEQ ID NO: 1216856 - protein, 6 aa, Mycobacterium
PDQPHA

SEQ ID NO: 1216857 - protein, 7 aa, Mycobacterium
PDQPPSL

SEQ ID NO: 1216858 - protein, 6 aa, Mycobacterium
PDQRYG

SEQ ID NO: 1216859 - protein, 5 aa, Mycobacterium
PDQST

SEQ ID NO: 1216860 - protein, 4 aa, Mycobacterium
PDQT

SEQ ID NO: 1216861 - protein, 8 aa, Mycobacterium
PDQTGTVR

SEQ ID NO: 1216862 - protein, 6 aa, Mycobacterium
PDQTRW

SEQ ID NO: 1216863 - protein, 14 aa, Mycobacterium
PDRADELRAAKARP

SEQ ID NO: 1216864 - protein, 7 aa, Mycobacterium
PDRAGET

SEQ ID NO: 1216865 - protein, 11 aa, Mycobacterium
PDRARAQPNHE

SEQ ID NO: 1216866 - protein, 9 aa, Mycobacterium
PDRARSAAR

SEQ ID NO: 1216867 - protein, 5 aa, Mycobacterium
PDRDG

SEQ ID NO: 1216868 - protein, 8 aa, Mycobacterium
PDRDPASC

SEQ ID NO: 1216869 - protein, 4 aa, Mycobacterium
PDRE

SEQ ID NO: 1216870 - protein, 5 aa, Mycobacterium
PDREA

SEQ ID NO: 1216871 - protein, 8 aa, Mycobacterium
PDRGAPGT

SEQ ID NO: 1216872 - protein, 14 aa, Mycobacterium
PDRGPKPHRGRPQS

SEQ ID NO: 1216873 - protein, 7 aa, Mycobacterium
PDRGRYP

SEQ ID NO: 1216874 - protein, 8 aa, Mycobacterium
PDRGSPGT

SEQ ID NO: 1216875 - protein, 9 aa, Mycobacterium
PDRGSPTAR

SEQ ID NO: 1216876 - protein, 10 aa, Mycobacterium
PDRPGESVTG

SEQ ID NO: 1216877 - protein, 9 aa, Mycobacterium
PDRPGPAEH

SEQ ID NO: 1216878 - protein, 5 aa, Mycobacterium
PDRPI

SEQ ID NO: 1216879 - protein, 10 aa, Mycobacterium
PDRPSVPLDG

SEQ ID NO: 1216880 - protein, 8 aa, Mycobacterium
PDRPTTGN

SEQ ID NO: 1216881 - protein, 19 aa, Mycobacterium
PDRRRYKAPTTFRAKADAR

SEQ ID NO: 1216882 - protein, 12 aa, Mycobacterium
PDRSSDAVTPTG

SEQ ID NO: 1216883 - protein, 13 aa, Mycobacterium
PDRTAGVEYPEGA

SEQ ID NO: 1216884 - protein, 8 aa, Mycobacterium
PDRTAIQT

SEQ ID NO: 1216885 - protein, 30 aa, Mycobacterium
PDRTLTEDEASAARDAAVREAARRVHAVQR

SEQ ID NO: 1216886 - protein, 5 aa, Mycobacterium
PDRTR

SEQ ID NO: 1216887 - protein, 15 aa, Mycobacterium
PDRVPGISSPEAIPG

SEQ ID NO: 1216888 - protein, 4 aa, Mycobacterium
PDSA

SEQ ID NO: 1216889 - protein, 10 aa, Mycobacterium
PDSADPDAVR

SEQ ID NO: 1216890 - protein, 9 aa, Mycobacterium
PDSDAVSRK

SEQ ID NO: 1216891 - protein, 10 aa, Mycobacterium
PDSDDRTRDA

SEQ ID NO: 1216892 - protein, 8 aa, Mycobacterium
PDSDPTAA

SEQ ID NO: 1216893 - protein, 19 aa, Mycobacterium
PDSEGSVAITSSDPEAPLD

SEQ ID NO: 1216894 - protein, 7 aa, Mycobacterium
PDSGGRW

SEQ ID NO: 1216895 - protein, 18 aa, Mycobacterium
PDSGNTGPITLPIGFTPA

SEQ ID NO: 1216896 - protein, 7 aa, Mycobacterium
PDSGSVA

SEQ ID NO: 1216897 - protein, 7 aa, Mycobacterium
PDSNRYK

SEQ ID NO: 1216898 - protein, 7 aa, Mycobacterium
PDSPWRA

SEQ ID NO: 1216899 - protein, 5 aa, Mycobacterium
PDSRG

SEQ ID NO: 1216900 - protein, 16 aa, Mycobacterium
PDSTRTAVAALLTAAG

SEQ ID NO: 1216901 - protein, 27 aa, Mycobacterium
PDSTTEETTEADEIPRVSRDRGGEGVD

SEQ ID NO: 1216902 - protein, 5 aa, Mycobacterium
PDSWT

SEQ ID NO: 1216903 - protein, 5 aa, Mycobacterium
PDTAA

SEQ ID NO: 1216904 - protein, 6 aa, Mycobacterium
PDTAAS

SEQ ID NO: 1216905 - protein, 10 aa, Mycobacterium
PDTARRPGAP

SEQ ID NO: 1216906 - protein, 8 aa, Mycobacterium
PDTDRHDA

SEQ ID NO: 1216907 - protein, 8 aa, Mycobacterium
PDTDSDTV

SEQ ID NO: 1216908 - protein, 7 aa, Mycobacterium
PDTDVRR

SEQ ID NO: 1216909 - protein, 14 aa, Mycobacterium
PDTEIDSSSPGQAI

SEQ ID NO: 1216910 - protein, 5 aa, Mycobacterium
PDTER

SEQ ID NO: 1216911 - protein, 6 aa, Mycobacterium
PDTGAA

SEQ ID NO: 1216912 - protein, 10 aa, Mycobacterium
PDTGFRDTAT

SEQ ID NO: 1216913 - protein, 14 aa, Mycobacterium
PDTGRLAEPGDEAA

SEQ ID NO: 1216914 - protein, 9 aa, Mycobacterium
PDTGSLQGD

SEQ ID NO: 1216915 - protein, 6 aa, Mycobacterium
PDTGTV

SEQ ID NO: 1216916 - protein, 15 aa, Mycobacterium
PDTKAATKDAAAHAE

SEQ ID NO: 1216917 - protein, 5 aa, Mycobacterium
PDTPA

SEQ ID NO: 1216918 - protein, 13 aa, Mycobacterium
PDTPRGQPAADKV

SEQ ID NO: 1216919 - protein, 8 aa, Mycobacterium
PDTQHGQR

SEQ ID NO: 1216920 - protein, 5 aa, Mycobacterium
PDTQY

SEQ ID NO: 1216921 - protein, 5 aa, Mycobacterium
PDTTV

SEQ ID NO: 1216922 - protein, 7 aa, Mycobacterium
PDTVDTT

SEQ ID NO: 1216923 - protein, 5 aa, Mycobacterium
PDTVG

SEQ ID NO: 1216924 - protein, 7 aa, Mycobacterium
PDTVTPD

SEQ ID NO: 1216925 - protein, 5 aa, Mycobacterium
PDVEQ

SEQ ID NO: 1216926 - protein, 7 aa, Mycobacterium
PDVESTD

SEQ ID NO: 1216927 - protein, 8 aa, Mycobacterium
PDVGKNEL

SEQ ID NO: 1216928 - protein, 4 aa, Mycobacterium
PDVK

SEQ ID NO: 1216929 - protein, 12 aa, Mycobacterium
PDVNPDEGAQAR

SEQ ID NO: 1216930 - protein, 14 aa, Mycobacterium
PDVPDPQALPSSAP

SEQ ID NO: 1216931 - protein, 9 aa, Mycobacterium
PDVPLPPSE

SEQ ID NO: 1216932 - protein, 4 aa, Mycobacterium
PDVQ

SEQ ID NO: 1216933 - protein, 13 aa, Mycobacterium
PDVRAGEYVSPRQ

SEQ ID NO: 1216934 - protein, 12 aa, Mycobacterium
PDVRPGSKPVGP

SEQ ID NO: 1216935 - protein, 8 aa, Mycobacterium
PDVTPPRG

SEQ ID NO: 1216936 - protein, 13 aa, Mycobacterium
PDWAQPAQEGGSY

SEQ ID NO: 1216937 - protein, 5 aa, Mycobacterium
PDWGE

SEQ ID NO: 1216938 - protein, 5 aa, Mycobacterium
PDWSG

SEQ ID NO: 1216939 - protein, 4 aa, Mycobacterium
PDYD

SEQ ID NO: 1216940 - protein, 13 aa, Mycobacterium
PDYDGPRGRVSDR

SEQ ID NO: 1216941 - protein, 7 aa, Mycobacterium
PDYEGRD

SEQ ID NO: 1216942 - protein, 18 aa, Mycobacterium
PDYKPELPGGKPGGGRSL

SEQ ID NO: 1216943 - protein, 15 aa, Mycobacterium
PDYPATGKRTLQDNG

SEQ ID NO: 1216944 - protein, 7 aa, Mycobacterium
PDYPKPD

SEQ ID NO: 1216945 - protein, 5 aa, Mycobacterium
PEAAR

SEQ ID NO: 1216946 - protein, 7 aa, Mycobacterium
PEADRRL

SEQ ID NO: 1216947 - protein, 11 aa, Mycobacterium
PEAEATSGDLP

SEQ ID NO: 1216948 - protein, 12 aa, Mycobacterium
PEAELEGATADG

SEQ ID NO: 1216949 - protein, 18 aa, Mycobacterium
PEAENPESEARASGRAAR

SEQ ID NO: 1216950 - protein, 13 aa, Mycobacterium
PEAGEQGSTNPFD

SEQ ID NO: 1216951 - protein, 13 aa, Mycobacterium
PEAGGAKVLQGKE

SEQ ID NO: 1216952 - protein, 6 aa, Mycobacterium
PEAGHI

SEQ ID NO: 1216953 - protein, 5 aa, Mycobacterium
PEAGS

SEQ ID NO: 1216954 - protein, 4 aa, Mycobacterium
PEAH

SEQ ID NO: 1216955 - protein, 11 aa, Mycobacterium
PEANAARLRTS

SEQ ID NO: 1216956 - protein, 27 aa, Mycobacterium
PEAPDDADNTLQRGFGTEASPEDQKEF

SEQ ID NO: 1216957 - protein, 8 aa, Mycobacterium
PEAPLASV

SEQ ID NO: 1216958 - protein, 6 aa, Mycobacterium
PEARAR

SEQ ID NO: 1216959 - protein, 6 aa, Mycobacterium
PEAREG

SEQ ID NO: 1216960 - protein, 15 aa, Mycobacterium
PEARESVAGQRRETV

SEQ ID NO: 1216961 - protein, 14 aa, Mycobacterium
PEARKRVAEKRSEV

SEQ ID NO: 1216962 - protein, 8 aa, Mycobacterium
PEARNAVN

SEQ ID NO: 1216963 - protein, 9 aa, Mycobacterium
PEARTQQTA

SEQ ID NO: 1216964 - protein, 7 aa, Mycobacterium
PEASLTE

SEQ ID NO: 1216965 - protein, 13 aa, Mycobacterium
PEASRLSGGPTGR

SEQ ID NO: 1216966 - protein, 8 aa, Mycobacterium
PEATARAL

SEQ ID NO: 1216967 - protein, 12 aa, Mycobacterium
PEATAYAAAKSG

SEQ ID NO: 1216968 - protein, 7 aa, Mycobacterium
PEATEAD

SEQ ID NO: 1216969 - protein, 5 aa, Mycobacterium
PEATR

SEQ ID NO: 1216970 - protein, 13 aa, Mycobacterium
PEATSRIAEATAD

SEQ ID NO: 1216971 - protein, 5 aa, Mycobacterium
PEAVR

SEQ ID NO: 1216972 - protein, 5 aa, Mycobacterium
PEAVT

SEQ ID NO: 1216973 - protein, 8 aa, Mycobacterium
PEDAGWAE

SEQ ID NO: 1216974 - protein, 14 aa, Mycobacterium
PEDAKDEDGDAEYQ

SEQ ID NO: 1216975 - protein, 8 aa, Mycobacterium
PEDDARAR

SEQ ID NO: 1216976 - protein, 10 aa, Mycobacterium
PEDDDGPEAD

SEQ ID NO: 1216977 - protein, 8 aa, Mycobacterium
PEDDPRTT

SEQ ID NO: 1216978 - protein, 6 aa, Mycobacterium
PEDDRA

SEQ ID NO: 1216979 - protein, 4 aa, Mycobacterium
PEDE

SEQ ID NO: 1216980 - protein, 5 aa, Mycobacterium
PEDEL

SEQ ID NO: 1216981 - protein, 8 aa, Mycobacterium
PEDGGETA

SEQ ID NO: 1216982 - protein, 17 aa, Mycobacterium
PEDGPEAALPVDEPESV

SEQ ID NO: 1216983 - protein, 4 aa, Mycobacterium
PEDI

SEQ ID NO: 1216984 - protein, 7 aa, Mycobacterium
PEDIESL

SEQ ID NO: 1216985 - protein, 4 aa, Mycobacterium
PEDK

SEQ ID NO: 1216986 - protein, 5 aa, Mycobacterium
PEDLD

SEQ ID NO: 1216987 - protein, 9 aa, Mycobacterium
PEDNSESFD

SEQ ID NO: 1216988 - protein, 7 aa, Mycobacterium
PEDPREI

SEQ ID NO: 1216989 - protein, 4 aa, Mycobacterium
PEDQ

SEQ ID NO: 1216990 - protein, 8 aa, Mycobacterium
PEDREDEL

SEQ ID NO: 1216991 - protein, 8 aa, Mycobacterium
PEDSTGGA

SEQ ID NO: 1216992 - protein, 5 aa, Mycobacterium
PEDTE

SEQ ID NO: 1216993 - protein, 6 aa, Mycobacterium
PEDTTD

SEQ ID NO: 1216994 - protein, 4 aa, Mycobacterium
PEDW

SEQ ID NO: 1216995 - protein, 6 aa, Mycobacterium
PEDYDE

SEQ ID NO: 1216996 - protein, 15 aa, Mycobacterium
PEEAAALGDELKGVT

SEQ ID NO: 1216997 - protein, 7 aa, Mycobacterium
PEEAEGL

SEQ ID NO: 1216998 - protein, 5 aa, Mycobacterium
PEEDR

SEQ ID NO: 1216999 - protein, 9 aa, Mycobacterium
PEEEAAQTN

SEQ ID NO: 1217000 - protein, 11 aa, Mycobacterium
PEEEPELPGLT

SEQ ID NO: 1217001 - protein, 11 aa, Mycobacterium
PEEFADPSYDK

SEQ ID NO: 1217002 - protein, 6 aa, Mycobacterium
PEEHRP

SEQ ID NO: 1217003 - protein, 6 aa, Mycobacterium
PEELPA

SEQ ID NO: 1217004 - protein, 8 aa, Mycobacterium
PEEPGGRK

SEQ ID NO: 1217005 - protein, 5 aa, Mycobacterium
PEEQA

SEQ ID NO: 1217006 - protein, 5 aa, Mycobacterium
PEERR

SEQ ID NO: 1217007 - protein, 4 aa, Mycobacterium
PEET

SEQ ID NO: 1217008 - protein, 17 aa, Mycobacterium
PEFAESQANMGSNYQGS

SEQ ID NO: 1217009 - protein, 5 aa, Mycobacterium
PEFGT

SEQ ID NO: 1217010 - protein, 18 aa, Mycobacterium
PEFNDGKSSTPTALGGSS

SEQ ID NO: 1217011 - protein, 10 aa, Mycobacterium
PEFPDSEPVR

SEQ ID NO: 1217012 - protein, 5 aa, Mycobacterium
PEFPR

SEQ ID NO: 1217013 - protein, 5 aa, Mycobacterium
PEFPT

SEQ ID NO: 1217014 - protein, 5 aa, Mycobacterium
PEFSG

SEQ ID NO: 1217015 - protein, 7 aa, Mycobacterium
PEFSSRA

SEQ ID NO: 1217016 - protein, 12 aa, Mycobacterium
PEGAARRPSERV

SEQ ID NO: 1217017 - protein, 10 aa, Mycobacterium
PEGAASAGEP

SEQ ID NO: 1217018 - protein, 12 aa, Mycobacterium
PEGAEITRSDES

SEQ ID NO: 1217019 - protein, 9 aa, Mycobacterium
PEGAPPFNA

SEQ ID NO: 1217020 - protein, 8 aa, Mycobacterium
PEGAQSPL

SEQ ID NO: 1217021 - protein, 7 aa, Mycobacterium
PEGDHAE

SEQ ID NO: 1217022 - protein, 12 aa, Mycobacterium
PEGGADSDDDAV

SEQ ID NO: 1217023 - protein, 5 aa, Mycobacterium
PEGGG

SEQ ID NO: 1217024 - protein, 21 aa, Mycobacterium
PEGGGGAGQRLSGGQLPQPGG

SEQ ID NO: 1217025 - protein, 8 aa, Mycobacterium
PEGGVADD

SEQ ID NO: 1217026 - protein, 9 aa, Mycobacterium
PEGKTAKNR

SEQ ID NO: 1217027 - protein, 4 aa, Mycobacterium
PEGL

SEQ ID NO: 1217028 - protein, 13 aa, Mycobacterium
PEGLAAGSPQERE

SEQ ID NO: 1217029 - protein, 11 aa, Mycobacterium
PEGPEGNPDPI

SEQ ID NO: 1217030 - protein, 7 aa, Mycobacterium
PEGPTRG

SEQ ID NO: 1217031 - protein, 7 aa, Mycobacterium
PEGPVRR

SEQ ID NO: 1217032 - protein, 7 aa, Mycobacterium
PEGRGEV

SEQ ID NO: 1217033 - protein, 19 aa, Mycobacterium
PEGSRPQDIDVSEPNESRI

SEQ ID NO: 1217034 - protein, 8 aa, Mycobacterium
PEGSSITN

SEQ ID NO: 1217035 - protein, 9 aa, Mycobacterium
PEGTDGWTE

SEQ ID NO: 1217036 - protein, 11 aa, Mycobacterium
PEGTGVDHGPR

SEQ ID NO: 1217037 - protein, 5 aa, Mycobacterium
PEGVE

SEQ ID NO: 1217038 - protein, 18 aa, Mycobacterium
PEHEPNGAEHALEDAPAR

SEQ ID NO: 1217039 - protein, 5 aa, Mycobacterium
PEHGP

SEQ ID NO: 1217040 - protein, 7 aa, Mycobacterium
PEHGTTL

SEQ ID NO: 1217041 - protein, 12 aa, Mycobacterium
PEHPAPAAVEDS

SEQ ID NO: 1217042 - protein, 6 aa, Mycobacterium
PEHPAT

SEQ ID NO: 1217043 - protein, 8 aa, Mycobacterium
PEHPYPAA

SEQ ID NO: 1217044 - protein, 5 aa, Mycobacterium
PEIAE

SEQ ID NO: 1217045 - protein, 9 aa, Mycobacterium
PEINGEGNR

SEQ ID NO: 1217046 - protein, 5 aa, Mycobacterium
PEINT

SEQ ID NO: 1217047 - protein, 13 aa, Mycobacterium
PEISAADSAEFGE

SEQ ID NO: 1217048 - protein, 6 aa, Mycobacterium
PEITEN

SEQ ID NO: 1217049 - protein, 4 aa, Mycobacterium
PEKA

SEQ ID NO: 1217050 - protein, 16 aa, Mycobacterium
PEKAVAEADSKPDGYL

SEQ ID NO: 1217051 - protein, 6 aa, Mycobacterium
PEKDGL

SEQ ID NO: 1217052 - protein, 8 aa, Mycobacterium
PEKFDPER

SEQ ID NO: 1217053 - protein, 5 aa, Mycobacterium
PEKGQ

SEQ ID NO: 1217054 - protein, 10 aa, Mycobacterium
PEKKAPPAEV

SEQ ID NO: 1217055 - protein, 7 aa, Mycobacterium
PEKPVKT

SEQ ID NO: 1217056 - protein, 4 aa, Mycobacterium
PELA

SEQ ID NO: 1217057 - protein, 12 aa, Mycobacterium
PELAGDTAEGLR

SEQ ID NO: 1217058 - protein, 5 aa, Mycobacterium
PELCD

SEQ ID NO: 1217059 - protein, 6 aa, Mycobacterium
PELEPD

SEQ ID NO: 1217060 - protein, 8 aa, Mycobacterium
PELGTGPI

SEQ ID NO: 1217061 - protein, 8 aa, Mycobacterium
PELGTRGQ

SEQ ID NO: 1217062 - protein, 11 aa, Mycobacterium
PELPDAPTPDL

SEQ ID NO: 1217063 - protein, 6 aa, Mycobacterium
PELPEG

SEQ ID NO: 1217064 - protein, 12 aa, Mycobacterium
PELPGGSALGST

SEQ ID NO: 1217065 - protein, 26 aa, Mycobacterium
PELSSSPSSTPGSSKPPLDDPGVELS

SEQ ID NO: 1217066 - protein, 13 aa, Mycobacterium
PELTARQRSTLST

SEQ ID NO: 1217067 - protein, 5 aa, Mycobacterium
PELTT

SEQ ID NO: 1217068 - protein, 9 aa, Mycobacterium
PEMKSTGEV

SEQ ID NO: 1217069 - protein, 9 aa, Mycobacterium
PEMTSAPEQ

SEQ ID NO: 1217070 - protein, 7 aa, Mycobacterium
PEMVPTD

SEQ ID NO: 1217071 - protein, 11 aa, Mycobacterium
PENGRQGYEPG

SEQ ID NO: 1217072 - protein, 4 aa, Mycobacterium
PENK

SEQ ID NO: 1217073 - protein, 5 aa, Mycobacterium
PENPA

SEQ ID NO: 1217074 - protein, 7 aa, Mycobacterium
PENPKNI

SEQ ID NO: 1217075 - protein, 4 aa, Mycobacterium
PENR

SEQ ID NO: 1217076 - protein, 6 aa, Mycobacterium
PENSSA

SEQ ID NO: 1217077 - protein, 5 aa, Mycobacterium
PENTT

SEQ ID NO: 1217078 - protein, 5 aa, Mycobacterium
PEPAD

SEQ ID NO: 1217079 - protein, 6 aa, Mycobacterium
PEPAPL

SEQ ID NO: 1217080 - protein, 22 aa, Mycobacterium
PEPATDDYQKRIEETRAVPATS

SEQ ID NO: 1217081 - protein, 5 aa, Mycobacterium
PEPDT

SEQ ID NO: 1217082 - protein, 6 aa, Mycobacterium
PEPDTA

SEQ ID NO: 1217083 - protein, 41 aa, Mycobacterium
PEPEPPKGDASKTDASKTDASKTDASKTEAPKTSSSASRRV

SEQ ID NO: 1217084 - protein, 8 aa, Mycobacterium
PEPGADPV

SEQ ID NO: 1217085 - protein, 7 aa, Mycobacterium
PEPGSVA

SEQ ID NO: 1217086 - protein, 24 aa, Mycobacterium
PEPGTPEPLQPNADDEGRHSPTDE

SEQ ID NO: 1217087 - protein, 9 aa, Mycobacterium
PEPGTPNSA

SEQ ID NO: 1217088 - protein, 10 aa, Mycobacterium
PEPLEGQPLD

SEQ ID NO: 1217089 - protein, 6 aa, Mycobacterium
PEPLTS

SEQ ID NO: 1217090 - protein, 28 aa, Mycobacterium
PEPPDEGEAGATAKKGKKPTGPKPRTGS

SEQ ID NO: 1217091 - protein, 10 aa, Mycobacterium
PEPPPAESEV

SEQ ID NO: 1217092 - protein, 14 aa, Mycobacterium
PEPPPGLEPIGPGH

SEQ ID NO: 1217093 - protein, 21 aa, Mycobacterium
PEPPYGQGEIAARGGATAMTD

SEQ ID NO: 1217094 - protein, 8 aa, Mycobacterium
PEPTGLDA

SEQ ID NO: 1217095 - protein, 6 aa, Mycobacterium
PEPVPA

SEQ ID NO: 1217096 - protein, 11 aa, Mycobacterium
PEPVTSRRKRL

SEQ ID NO: 1217097 - protein, 4 aa, Mycobacterium
PEPY

SEQ ID NO: 1217098 - protein, 7 aa, Mycobacterium
PEQATLD

SEQ ID NO: 1217099 - protein, 5 aa, Mycobacterium
PEQES

SEQ ID NO: 1217100 - protein, 5 aa, Mycobacterium
PEQHA

SEQ ID NO: 1217101 - protein, 5 aa, Mycobacterium
PEQIP

SEQ ID NO: 1217102 - protein, 11 aa, Mycobacterium
PEQLTDPTPCT

SEQ ID NO: 1217103 - protein, 11 aa, Mycobacterium
PEQRAAAPEYD

SEQ ID NO: 1217104 - protein, 10 aa, Mycobacterium
PEQRAAVGKA

SEQ ID NO: 1217105 - protein, 5 aa, Mycobacterium
PEQRE

SEQ ID NO: 1217106 - protein, 6 aa, Mycobacterium
PEQRRV

SEQ ID NO: 1217107 - protein, 8 aa, Mycobacterium
PEQTATAI

SEQ ID NO: 1217108 - protein, 5 aa, Mycobacterium
PERAE

SEQ ID NO: 1217109 - protein, 11 aa, Mycobacterium
PERAKASPFGG

SEQ ID NO: 1217110 - protein, 7 aa, Mycobacterium
PERARPG

SEQ ID NO: 1217111 - protein, 5 aa, Mycobacterium
PERDP

SEQ ID NO: 1217112 - protein, 6 aa, Mycobacterium
PEREPI

SEQ ID NO: 1217113 - protein, 5 aa, Mycobacterium
PERER

SEQ ID NO: 1217114 - protein, 12 aa, Mycobacterium
PERFGDTTVTPV

SEQ ID NO: 1217115 - protein, 4 aa, Mycobacterium
PERG

SEQ ID NO: 1217116 - protein, 6 aa, Mycobacterium
PERGGT

SEQ ID NO: 1217117 - protein, 13 aa, Mycobacterium
PERLEDGIERGAA

SEQ ID NO: 1217118 - protein, 4 aa, Mycobacterium
PERM

SEQ ID NO: 1217119 - protein, 11 aa, Mycobacterium
PERPDDADNPL

SEQ ID NO: 1217120 - protein, 16 aa, Mycobacterium
PERQPGPALEGRSADE

SEQ ID NO: 1217121 - protein, 6 aa, Mycobacterium
PERQRQ

SEQ ID NO: 1217122 - protein, 5 aa, Mycobacterium
PERQW

SEQ ID NO: 1217123 - protein, 12 aa, Mycobacterium
PERRPVTAANSA

SEQ ID NO: 1217124 - protein, 10 aa, Mycobacterium
PERSSPPTEL

SEQ ID NO: 1217125 - protein, 6 aa, Mycobacterium
PERTRQ

SEQ ID NO: 1217126 - protein, 9 aa, Mycobacterium
PERTSTGMT

SEQ ID NO: 1217127 - protein, 15 aa, Mycobacterium
PERVRAGQAAATPGV

SEQ ID NO: 1217128 - protein, 6 aa, Mycobacterium
PERVRR

SEQ ID NO: 1217129 - protein, 4 aa, Mycobacterium
PERW

SEQ ID NO: 1217130 - protein, 5 aa, Mycobacterium
PESAH

SEQ ID NO: 1217131 - protein, 7 aa, Mycobacterium
PESARRA

SEQ ID NO: 1217132 - protein, 8 aa, Mycobacterium
PESDDVAP

SEQ ID NO: 1217133 - protein, 8 aa, Mycobacterium
PESDHNDF

SEQ ID NO: 1217134 - protein, 5 aa, Mycobacterium
PESDY

SEQ ID NO: 1217135 - protein, 4 aa, Mycobacterium
PESE

SEQ ID NO: 1217136 - protein, 10 aa, Mycobacterium
PESEGGAPVS

SEQ ID NO: 1217137 - protein, 12 aa, Mycobacterium
PESFDSSPPPAA

SEQ ID NO: 1217138 - protein, 19 aa, Mycobacterium
PESGGLYKSGNVTYRGSEV

SEQ ID NO: 1217139 - protein, 6 aa, Mycobacterium
PESGKL

SEQ ID NO: 1217140 - protein, 18 aa, Mycobacterium
PESGTPAAVGYAQESGIP

SEQ ID NO: 1217141 - protein, 11 aa, Mycobacterium
PESHGGAGGTL

SEQ ID NO: 1217142 - protein, 8 aa, Mycobacterium
PESIGGPS

SEQ ID NO: 1217143 - protein, 4 aa, Mycobacterium
PESP

SEQ ID NO: 1217144 - protein, 12 aa, Mycobacterium
PESREANGIGST

SEQ ID NO: 1217145 - protein, 7 aa, Mycobacterium
PESRGAG

SEQ ID NO: 1217146 - protein, 4 aa, Mycobacterium
PEST

SEQ ID NO: 1217147 - protein, 8 aa, Mycobacterium
PESTLPDA

SEQ ID NO: 1217148 - protein, 5 aa, Mycobacterium
PESTR

SEQ ID NO: 1217149 - protein, 16 aa, Mycobacterium
PETAESLKHDARQRTV

SEQ ID NO: 1217150 - protein, 8 aa, Mycobacterium
PETAPVPT

SEQ ID NO: 1217151 - protein, 7 aa, Mycobacterium
PETARDG

SEQ ID NO: 1217152 - protein, 6 aa, Mycobacterium
PETATA

SEQ ID NO: 1217153 - protein, 7 aa, Mycobacterium
PETEPTA

SEQ ID NO: 1217154 - protein, 6 aa, Mycobacterium
PETGGR

SEQ ID NO: 1217155 - protein, 16 aa, Mycobacterium
PETGLATSVPGPGWTS

SEQ ID NO: 1217156 - protein, 5 aa, Mycobacterium
PETGS

SEQ ID NO: 1217157 - protein, 8 aa, Mycobacterium
PETGTSTT

SEQ ID NO: 1217158 - protein, 5 aa, Mycobacterium
PETGV

SEQ ID NO: 1217159 - protein, 33 aa, Mycobacterium
PETIATRTDKWDPATETSRAQRDAAALAEEQKE

SEQ ID NO: 1217160 - protein, 13 aa, Mycobacterium
PETLGPQRDRAGW

SEQ ID NO: 1217161 - protein, 9 aa, Mycobacterium
PETLTTPTA

SEQ ID NO: 1217162 - protein, 4 aa, Mycobacterium
PETP

SEQ ID NO: 1217163 - protein, 6 aa, Mycobacterium
PETPFD

SEQ ID NO: 1217164 - protein, 5 aa, Mycobacterium
PETPN

SEQ ID NO: 1217165 - protein, 7 aa, Mycobacterium
PETPPRG

SEQ ID NO: 1217166 - protein, 13 aa, Mycobacterium
PETPVDDPPALPA

SEQ ID NO: 1217167 - protein, 7 aa, Mycobacterium
PETRAEV

SEQ ID NO: 1217168 - protein, 5 aa, Mycobacterium
PETRP

SEQ ID NO: 1217169 - protein, 12 aa, Mycobacterium
PETRTENPDGKM

SEQ ID NO: 1217170 - protein, 7 aa, Mycobacterium
PETTEEF

SEQ ID NO: 1217171 - protein, 6 aa, Mycobacterium
PETTGV

SEQ ID NO: 1217172 - protein, 5 aa, Mycobacterium
PETTQ

SEQ ID NO: 1217173 - protein, 11 aa, Mycobacterium
PETVSTDYDTA

SEQ ID NO: 1217174 - protein, 15 aa, Mycobacterium
PETYSSVTGGERAFG

SEQ ID NO: 1217175 - protein, 39 aa, Mycobacterium
PEVATPEPDPEASTPEPAAPELQAPDVDAETVTEDEPES

SEQ ID NO: 1217176 - protein, 4 aa, Mycobacterium
PEVD

SEQ ID NO: 1217177 - protein, 4 aa, Mycobacterium
PEVE

SEQ ID NO: 1217178 - protein, 14 aa, Mycobacterium
PEVEDPRVRGNSHT

SEQ ID NO: 1217179 - protein, 8 aa, Mycobacterium
PEVEPDDI

SEQ ID NO: 1217180 - protein, 4 aa, Mycobacterium
PEVG

SEQ ID NO: 1217181 - protein, 5 aa, Mycobacterium
PEVGP

SEQ ID NO: 1217182 - protein, 4 aa, Mycobacterium
PEVL

SEQ ID NO: 1217183 - protein, 8 aa, Mycobacterium
PEVTEANQ

SEQ ID NO: 1217184 - protein, 7 aa, Mycobacterium
PEVTPPP

SEQ ID NO: 1217185 - protein, 12 aa, Mycobacterium
PEWDGKRKAYRP

SEQ ID NO: 1217186 - protein, 4 aa, Mycobacterium
PEYA

SEQ ID NO: 1217187 - protein, 4 aa, Mycobacterium
PEYG

SEQ ID NO: 1217188 - protein, 4 aa, Mycobacterium
PEYP

SEQ ID NO: 1217189 - protein, 4 aa, Mycobacterium
PEYQ

SEQ ID NO: 1217190 - protein, 14 aa, Mycobacterium
PEYRGGLRKRSAHT

SEQ ID NO: 1217191 - protein, 10 aa, Mycobacterium
PEYVRGATGE

SEQ ID NO: 1217192 - protein, 7 aa, Mycobacterium
PFAESAE

SEQ ID NO: 1217193 - protein, 6 aa, Mycobacterium
PFAPPE

SEQ ID NO: 1217194 - protein, 14 aa, Mycobacterium
PFDGPSDGQPENPY

SEQ ID NO: 1217195 - protein, 10 aa, Mycobacterium
PFDPPTPGGF

SEQ ID NO: 1217196 - protein, 17 aa, Mycobacterium
PFDTSEHGWTKTTYRQG

SEQ ID NO: 1217197 - protein, 28 aa, Mycobacterium
PFEERPGSERFAEPGEKEFSASFQTFCG

SEQ ID NO: 1217198 - protein, 4 aa, Mycobacterium
PFEG

SEQ ID NO: 1217199 - protein, 5 aa, Mycobacterium
PFEGG

SEQ ID NO: 1217200 - protein, 18 aa, Mycobacterium
PFESDSKYPYTADGNREF

SEQ ID NO: 1217201 - protein, 7 aa, Mycobacterium
PFGATSA

SEQ ID NO: 1217202 - protein, 10 aa, Mycobacterium
PFGGPPRKPT

SEQ ID NO: 1217203 - protein, 17 aa, Mycobacterium
PFGGVGDSGIGREGGTF

SEQ ID NO: 1217204 - protein, 13 aa, Mycobacterium
PFGRRRDDQVRDA

SEQ ID NO: 1217205 - protein, 5 aa, Mycobacterium
PFGTG

SEQ ID NO: 1217206 - protein, 4 aa, Mycobacterium
PFIP

SEQ ID NO: 1217207 - protein, 17 aa, Mycobacterium
PFPATSDSRSTSVGSQA

SEQ ID NO: 1217208 - protein, 13 aa, Mycobacterium
PFPDEGQAAEAEI

SEQ ID NO: 1217209 - protein, 4 aa, Mycobacterium
PFPE

SEQ ID NO: 1217210 - protein, 5 aa, Mycobacterium
PFPGA

SEQ ID NO: 1217211 - protein, 6 aa, Mycobacterium
PFPPLS

SEQ ID NO: 1217212 - protein, 20 aa, Mycobacterium
PFPPPEPETYDTDPRIAQTQ

SEQ ID NO: 1217213 - protein, 7 aa, Mycobacterium
PFPSARE

SEQ ID NO: 1217214 - protein, 12 aa, Mycobacterium
PFREQAEAAATS

SEQ ID NO: 1217215 - protein, 14 aa, Mycobacterium
PFRPDRRWGGDNTD

SEQ ID NO: 1217216 - protein, 11 aa, Mycobacterium
PFRPGPDGVEA

SEQ ID NO: 1217217 - protein, 5 aa, Mycobacterium
PFRPR

SEQ ID NO: 1217218 - protein, 5 aa, Mycobacterium
PFRQA

SEQ ID NO: 1217219 - protein, 12 aa, Mycobacterium
PFRSRSDATEAA

SEQ ID NO: 1217220 - protein, 11 aa, Mycobacterium
PFSGATAAAAV

SEQ ID NO: 1217221 - protein, 8 aa, Mycobacterium
PFSGQGET

SEQ ID NO: 1217222 - protein, 18 aa, Mycobacterium
PFSNHPAIGGSGAATGAG

SEQ ID NO: 1217223 - protein, 9 aa, Mycobacterium
PFTESPAVG

SEQ ID NO: 1217224 - protein, 5 aa, Mycobacterium
PFTPG

SEQ ID NO: 1217225 - protein, 6 aa, Mycobacterium
PFTPGQ

SEQ ID NO: 1217226 - protein, 7 aa, Mycobacterium
PFTPSGR

SEQ ID NO: 1217227 - protein, 12 aa, Mycobacterium
PFTSNGEDIDTG

SEQ ID NO: 1217228 - protein, 22 aa, Mycobacterium
PFTTPEQACRSGLAAGNTDTAL

SEQ ID NO: 1217229 - protein, 4 aa, Mycobacterium
PFVP

SEQ ID NO: 1217230 - protein, 14 aa, Mycobacterium
PGAAAASEPEEIDA

SEQ ID NO: 1217231 - protein, 6 aa, Mycobacterium
PGAADA

SEQ ID NO: 1217232 - protein, 7 aa, Mycobacterium
PGAADAD

SEQ ID NO: 1217233 - protein, 7 aa, Mycobacterium
PGAAQLR

SEQ ID NO: 1217234 - protein, 6 aa, Mycobacterium
PGAATA

SEQ ID NO: 1217235 - protein, 7 aa, Mycobacterium
PGADDTD

SEQ ID NO: 1217236 - protein, 10 aa, Mycobacterium
PGADGTLTTT

SEQ ID NO: 1217237 - protein, 6 aa, Mycobacterium
PGADKP

SEQ ID NO: 1217238 - protein, 7 aa, Mycobacterium
PGADPAA

SEQ ID NO: 1217239 - protein, 8 aa, Mycobacterium
PGADQPAV

SEQ ID NO: 1217240 - protein, 9 aa, Mycobacterium
PGADRGTQR

SEQ ID NO: 1217241 - protein, 17 aa, Mycobacterium
PGAEVTTESNPESTSPR

SEQ ID NO: 1217242 - protein, 4 aa, Mycobacterium
PGAG

SEQ ID NO: 1217243 - protein, 8 aa, Mycobacterium
PGAGAAAK

SEQ ID NO: 1217244 - protein, 8 aa, Mycobacterium
PGAGAAAN

SEQ ID NO: 1217245 - protein, 6 aa, Mycobacterium
PGAGAT

SEQ ID NO: 1217246 - protein, 7 aa, Mycobacterium
PGAGGAI

SEQ ID NO: 1217247 - protein, 7 aa, Mycobacterium
PGAGHSE

SEQ ID NO: 1217248 - protein, 30 aa, Mycobacterium
PGAGRGSSYVGTPYGSAGIPRGGAPTEDQV

SEQ ID NO: 1217249 - protein, 10 aa, Mycobacterium
PGAGSTDVDN

SEQ ID NO: 1217250 - protein, 7 aa, Mycobacterium
PGAGTNE

SEQ ID NO: 1217251 - protein, 26 aa, Mycobacterium
PGAHPIDTAGPLADSVAAARQVCLDT

SEQ ID NO: 1217252 - protein, 8 aa, Mycobacterium
PGAIPGRT

SEQ ID NO: 1217253 - protein, 14 aa, Mycobacterium
PGAISSQHGHTGDH

SEQ ID NO: 1217254 - protein, 14 aa, Mycobacterium
PGALDTADEARAKV

SEQ ID NO: 1217255 - protein, 9 aa, Mycobacterium
PGAPADPRA

SEQ ID NO: 1217256 - protein, 6 aa, Mycobacterium
PGAPAT

SEQ ID NO: 1217257 - protein, 317 aa, Mycobacterium
PGAPGAGGVTTPASSTTGTPGAPGPGGVTTPASSTTGTPGAPGPGGVTTPASSTTGTPGAPGPGGVTTPASPTTGTPGAPGPGGVTTPASSTTGTPGAGGPGGATTPAWSTTGTPGAGGPGGATRPAWSPTGAPGAGGAGGATTPAWSPTGAPGAGGPALPAAAATGAPGAPAPPPGPPGAATPEAPSSGAPPTPGGGTAPASPKIGAPGGAGAGGAATPAGIAAGPPGIGGAGGVTTPAGTAAGPPGTGGSGGSAAPPSPMTGTPGTGGDGGATLATGVPAGAPGTGGSGGVPPPIGVPAGTPGTGGAGGVAPAAG

SEQ ID NO: 1217258 - protein, 20 aa, Mycobacterium
PGAPGPGPTGLPTDAVPHGT

SEQ ID NO: 1217259 - protein, 10 aa, Mycobacterium
PGAPPSLAAL

SEQ ID NO: 1217260 - protein, 11 aa, Mycobacterium
PGAPPSVTALP

SEQ ID NO: 1217261 - protein, 9 aa, Mycobacterium
PGAPRRDGD

SEQ ID NO: 1217262 - protein, 6 aa, Mycobacterium
PGAQEF

SEQ ID NO: 1217263 - protein, 7 aa, Mycobacterium
PGAQEFT

SEQ ID NO: 1217264 - protein, 7 aa, Mycobacterium
PGAQGFT

SEQ ID NO: 1217265 - protein, 7 aa, Mycobacterium
PGARRQI

SEQ ID NO: 1217266 - protein, 9 aa, Mycobacterium
PGASQGRGL

SEQ ID NO: 1217267 - protein, 4 aa, Mycobacterium
PGAT

SEQ ID NO: 1217268 - protein, 5 aa, Mycobacterium
PGAVD

SEQ ID NO: 1217269 - protein, 15 aa, Mycobacterium
PGAVDADRQDRGELE

SEQ ID NO: 1217270 - protein, 8 aa, Mycobacterium
PGAVDDVE

SEQ ID NO: 1217271 - protein, 8 aa, Mycobacterium
PGAVPGEG

SEQ ID NO: 1217272 - protein, 5 aa, Mycobacterium
PGCLP

SEQ ID NO: 1217273 - protein, 7 aa, Mycobacterium
PGCPELQ

SEQ ID NO: 1217274 - protein, 14 aa, Mycobacterium
PGDAAPEPHYTPSR

SEQ ID NO: 1217275 - protein, 13 aa, Mycobacterium
PGDADHPVFALVP

SEQ ID NO: 1217276 - protein, 5 aa, Mycobacterium
PGDAE

SEQ ID NO: 1217277 - protein, 9 aa, Mycobacterium
PGDARVSPA

SEQ ID NO: 1217278 - protein, 10 aa, Mycobacterium
PGDDHRKAAG

SEQ ID NO: 1217279 - protein, 6 aa, Mycobacterium
PGDDHY

SEQ ID NO: 1217280 - protein, 8 aa, Mycobacterium
PGDEPHRD

SEQ ID NO: 1217281 - protein, 6 aa, Mycobacterium
PGDEPW

SEQ ID NO: 1217282 - protein, 4 aa, Mycobacterium
PGDF

SEQ ID NO: 1217283 - protein, 10 aa, Mycobacterium
PGDGLPDSGI

SEQ ID NO: 1217284 - protein, 10 aa, Mycobacterium
PGDGVRGRPY

SEQ ID NO: 1217285 - protein, 11 aa, Mycobacterium
PGDIAGKTGFT

SEQ ID NO: 1217286 - protein, 10 aa, Mycobacterium
PGDLGTKGGI

SEQ ID NO: 1217287 - protein, 15 aa, Mycobacterium
PGDPAYLKTDDGDRS

SEQ ID NO: 1217288 - protein, 13 aa, Mycobacterium
PGDPAYLQGEAGE

SEQ ID NO: 1217289 - protein, 14 aa, Mycobacterium
PGDPAYLQGEDGEV

SEQ ID NO: 1217290 - protein, 10 aa, Mycobacterium
PGDPGPIGGE

SEQ ID NO: 1217291 - protein, 5 aa, Mycobacterium
PGDPL

SEQ ID NO: 1217292 - protein, 9 aa, Mycobacterium
PGDPPATHQ

SEQ ID NO: 1217293 - protein, 8 aa, Mycobacterium
PGDPPGAF

SEQ ID NO: 1217294 - protein, 4 aa, Mycobacterium
PGDQ

SEQ ID NO: 1217295 - protein, 6 aa, Mycobacterium
PGDRER

SEQ ID NO: 1217296 - protein, 8 aa, Mycobacterium
PGDTVSRG

SEQ ID NO: 1217297 - protein, 21 aa, Mycobacterium
PGDTVTANAGGFRSASHQVPF

SEQ ID NO: 1217298 - protein, 8 aa, Mycobacterium
PGDTVTRG

SEQ ID NO: 1217299 - protein, 10 aa, Mycobacterium
PGDVDAAQRY

SEQ ID NO: 1217300 - protein, 5 aa, Mycobacterium
PGEAE

SEQ ID NO: 1217301 - protein, 15 aa, Mycobacterium
PGEARTSRGPRQRTT

SEQ ID NO: 1217302 - protein, 4 aa, Mycobacterium
PGED

SEQ ID NO: 1217303 - protein, 4 aa, Mycobacterium
PGEG

SEQ ID NO: 1217304 - protein, 6 aa, Mycobacterium
PGEGER

SEQ ID NO: 1217305 - protein, 7 aa, Mycobacterium
PGEGTQR

SEQ ID NO: 1217306 - protein, 7 aa, Mycobacterium
PGEITGT

SEQ ID NO: 1217307 - protein, 16 aa, Mycobacterium
PGEKVPRAGSGHAADP

SEQ ID NO: 1217308 - protein, 27 aa, Mycobacterium
PGENDENSIDSPQSRWPEGGNGTARPS

SEQ ID NO: 1217309 - protein, 6 aa, Mycobacterium
PGEPFD

SEQ ID NO: 1217310 - protein, 7 aa, Mycobacterium
PGEPGEI

SEQ ID NO: 1217311 - protein, 7 aa, Mycobacterium
PGEPGFS

SEQ ID NO: 1217312 - protein, 6 aa, Mycobacterium
PGEPGY

SEQ ID NO: 1217313 - protein, 6 aa, Mycobacterium
PGEPIG

SEQ ID NO: 1217314 - protein, 5 aa, Mycobacterium
PGEPL

SEQ ID NO: 1217315 - protein, 8 aa, Mycobacterium
PGEPPRDG

SEQ ID NO: 1217316 - protein, 5 aa, Mycobacterium
PGEQC

SEQ ID NO: 1217317 - protein, 7 aa, Mycobacterium
PGEQGTS

SEQ ID NO: 1217318 - protein, 7 aa, Mycobacterium
PGERPMR

SEQ ID NO: 1217319 - protein, 16 aa, Mycobacterium
PGESPLRPSYDRVRDD

SEQ ID NO: 1217320 - protein, 7 aa, Mycobacterium
PGESTAD

SEQ ID NO: 1217321 - protein, 6 aa, Mycobacterium
PGESWP

SEQ ID NO: 1217322 - protein, 15 aa, Mycobacterium
PGETPVGPARRARRV

SEQ ID NO: 1217323 - protein, 12 aa, Mycobacterium
PGETSDVPPPEV

SEQ ID NO: 1217324 - protein, 7 aa, Mycobacterium
PGETYRR

SEQ ID NO: 1217325 - protein, 7 aa, Mycobacterium
PGEVEMG

SEQ ID NO: 1217326 - protein, 8 aa, Mycobacterium
PGFAPPEV

SEQ ID NO: 1217327 - protein, 5 aa, Mycobacterium
PGFER

SEQ ID NO: 1217328 - protein, 6 aa, Mycobacterium
PGFERG

SEQ ID NO: 1217329 - protein, 11 aa, Mycobacterium
PGFPEATTGAA

SEQ ID NO: 1217330 - protein, 8 aa, Mycobacterium
PGFPPTAP

SEQ ID NO: 1217331 - protein, 10 aa, Mycobacterium
PGFTTPDPSY

SEQ ID NO: 1217332 - protein, 13 aa, Mycobacterium
PGGADLDSNIEGP

SEQ ID NO: 1217333 - protein, 19 aa, Mycobacterium
PGGAEAAAADAADDTAIPE

SEQ ID NO: 1217334 - protein, 13 aa, Mycobacterium
PGGAEPDSLRGDV

SEQ ID NO: 1217335 - protein, 11 aa, Mycobacterium
PGGAKQSTKVT

SEQ ID NO: 1217336 - protein, 9 aa, Mycobacterium
PGGAPCTCG

SEQ ID NO: 1217337 - protein, 7 aa, Mycobacterium
PGGARCS

SEQ ID NO: 1217338 - protein, 7 aa, Mycobacterium
PGGARDA

SEQ ID NO: 1217339 - protein, 9 aa, Mycobacterium
PGGASERPR

SEQ ID NO: 1217340 - protein, 5 aa, Mycobacterium
PGGAT

SEQ ID NO: 1217341 - protein, 4 aa, Mycobacterium
PGGD

SEQ ID NO: 1217342 - protein, 15 aa, Mycobacterium
PGGDPGRLDPVRDGS

SEQ ID NO: 1217343 - protein, 7 aa, Mycobacterium
PGGDQRD

SEQ ID NO: 1217344 - protein, 7 aa, Mycobacterium
PGGDRDV

SEQ ID NO: 1217345 - protein, 5 aa, Mycobacterium
PGGDV

SEQ ID NO: 1217346 - protein, 7 aa, Mycobacterium
PGGERRA

SEQ ID NO: 1217347 - protein, 5 aa, Mycobacterium
PGGES

SEQ ID NO: 1217348 - protein, 9 aa, Mycobacterium
PGGESQSQI

SEQ ID NO: 1217349 - protein, 5 aa, Mycobacterium
PGGET

SEQ ID NO: 1217350 - protein, 4 aa, Mycobacterium
PGGF

SEQ ID NO: 1217351 - protein, 4 aa, Mycobacterium
PGGG

SEQ ID NO: 1217352 - protein, 11 aa, Mycobacterium
PGGGEARRTDY

SEQ ID NO: 1217353 - protein, 8 aa, Mycobacterium
PGGGRDAI

SEQ ID NO: 1217354 - protein, 6 aa, Mycobacterium
PGGHEA

SEQ ID NO: 1217355 - protein, 7 aa, Mycobacterium
PGGIGTT

SEQ ID NO: 1217356 - protein, 7 aa, Mycobacterium
PGGLETE

SEQ ID NO: 1217357 - protein, 22 aa, Mycobacterium
PGGLRTSYEPVRPSVRAGQTVR

SEQ ID NO: 1217358 - protein, 6 aa, Mycobacterium
PGGLST

SEQ ID NO: 1217359 - protein, 21 aa, Mycobacterium
PGGNWSSYPAHKHDENTEVET

SEQ ID NO: 1217360 - protein, 10 aa, Mycobacterium
PGGPDRHRGE

SEQ ID NO: 1217361 - protein, 16 aa, Mycobacterium
PGGPETGQALTANPNL

SEQ ID NO: 1217362 - protein, 91 aa, Mycobacterium
PGGPGGVAGPDGAAGAIPGGPSGAAGPEGAAGAIPGGPVGEAGPGGASAAIPGGPVGEAGPGGASGAIPGGPSGSVGPDGVEGCIPAVGCI

SEQ ID NO: 1217363 - protein, 10 aa, Mycobacterium
PGGPLTAQQV

SEQ ID NO: 1217364 - protein, 5 aa, Mycobacterium
PGGPT

SEQ ID NO: 1217365 - protein, 4 aa, Mycobacterium
PGGQ

SEQ ID NO: 1217366 - protein, 6 aa, Mycobacterium
PGGQAQ

SEQ ID NO: 1217367 - protein, 33 aa, Mycobacterium
PGGQGGSGAEGGSGGALGAGTTRNGSDGPDGAD

SEQ ID NO: 1217368 - protein, 9 aa, Mycobacterium
PGGQPASIP

SEQ ID NO: 1217369 - protein, 9 aa, Mycobacterium
PGGQRASAQ

SEQ ID NO: 1217370 - protein, 7 aa, Mycobacterium
PGGQTQF

SEQ ID NO: 1217371 - protein, 13 aa, Mycobacterium
PGGRFPFATAAAG

SEQ ID NO: 1217372 - protein, 5 aa, Mycobacterium
PGGRV

SEQ ID NO: 1217373 - protein, 5 aa, Mycobacterium
PGGSE

SEQ ID NO: 1217374 - protein, 11 aa, Mycobacterium
PGGSGGGSAAA

SEQ ID NO: 1217375 - protein, 6 aa, Mycobacterium
PGGSMR

SEQ ID NO: 1217376 - protein, 8 aa, Mycobacterium
PGGSSTPL

SEQ ID NO: 1217377 - protein, 10 aa, Mycobacterium
PGGSVPSEEN

SEQ ID NO: 1217378 - protein, 9 aa, Mycobacterium
PGGTAPGQA

SEQ ID NO: 1217379 - protein, 9 aa, Mycobacterium
PGGTGGFGD

SEQ ID NO: 1217380 - protein, 7 aa, Mycobacterium
PGGTPAK

SEQ ID NO: 1217381 - protein, 10 aa, Mycobacterium
PGGTPLPEQS

SEQ ID NO: 1217382 - protein, 5 aa, Mycobacterium
PGGTQ

SEQ ID NO: 1217383 - protein, 8 aa, Mycobacterium
PGGVNSPV

SEQ ID NO: 1217384 - protein, 4 aa, Mycobacterium
PGGY

SEQ ID NO: 1217385 - protein, 14 aa, Mycobacterium
PGGYAESVTAPATA

SEQ ID NO: 1217386 - protein, 20 aa, Mycobacterium
PGGYSTDWAGASAKRATALP

SEQ ID NO: 1217387 - protein, 4 aa, Mycobacterium
PGHA

SEQ ID NO: 1217388 - protein, 8 aa, Mycobacterium
PGHAESGE

SEQ ID NO: 1217389 - protein, 17 aa, Mycobacterium
PGHGDRVDEESTLANRR

SEQ ID NO: 1217390 - protein, 7 aa, Mycobacterium
PGHGGGL

SEQ ID NO: 1217391 - protein, 18 aa, Mycobacterium
PGHGRSAWREDGDYGPKL

SEQ ID NO: 1217392 - protein, 9 aa, Mycobacterium
PGHHGSPEA

SEQ ID NO: 1217393 - protein, 7 aa, Mycobacterium
PGHHGTN

SEQ ID NO: 1217394 - protein, 4 aa, Mycobacterium
PGHI

SEQ ID NO: 1217395 - protein, 11 aa, Mycobacterium
PGHNGAPALQG

SEQ ID NO: 1217396 - protein, 5 aa, Mycobacterium
PGHPS

SEQ ID NO: 1217397 - protein, 11 aa, Mycobacterium
PGHTEKPAESE

SEQ ID NO: 1217398 - protein, 4 aa, Mycobacterium
PGIA

SEQ ID NO: 1217399 - protein, 10 aa, Mycobacterium
PGIAGSPGPF

SEQ ID NO: 1217400 - protein, 5 aa, Mycobacterium
PGIEQ

SEQ ID NO: 1217401 - protein, 7 aa, Mycobacterium
PGIESGR

SEQ ID NO: 1217402 - protein, 5 aa, Mycobacterium
PGINP

SEQ ID NO: 1217403 - protein, 5 aa, Mycobacterium
PGISA

SEQ ID NO: 1217404 - protein, 8 aa, Mycobacterium
PGISPEQA

SEQ ID NO: 1217405 - protein, 8 aa, Mycobacterium
PGKAGRDV

SEQ ID NO: 1217406 - protein, 14 aa, Mycobacterium
PGKAKRNLPAPPAA

SEQ ID NO: 1217407 - protein, 11 aa, Mycobacterium
PGKASAFAAGV

SEQ ID NO: 1217408 - protein, 7 aa, Mycobacterium
PGKDSHP

SEQ ID NO: 1217409 - protein, 5 aa, Mycobacterium
PGKGI

SEQ ID NO: 1217410 - protein, 8 aa, Mycobacterium
PGKGNAMG

SEQ ID NO: 1217411 - protein, 4 aa, Mycobacterium
PGKV

SEQ ID NO: 1217412 - protein, 5 aa, Mycobacterium
PGLAG

SEQ ID NO: 1217413 - protein, 25 aa, Mycobacterium
PGLAPGGGGTAPAPAETPPAVSAYT

SEQ ID NO: 1217414 - protein, 4 aa, Mycobacterium
PGLD

SEQ ID NO: 1217415 - protein, 6 aa, Mycobacterium
PGLDAA

SEQ ID NO: 1217416 - protein, 10 aa, Mycobacterium
PGLDGHDRGA

SEQ ID NO: 1217417 - protein, 7 aa, Mycobacterium
PGLGAAA

SEQ ID NO: 1217418 - protein, 6 aa, Mycobacterium
PGLGGP

SEQ ID NO: 1217419 - protein, 8 aa, Mycobacterium
PGLGKSTV

SEQ ID NO: 1217420 - protein, 10 aa, Mycobacterium
PGLGTDETAA

SEQ ID NO: 1217421 - protein, 10 aa, Mycobacterium
PGLGVRPASE

SEQ ID NO: 1217422 - protein, 6 aa, Mycobacterium
PGLKGT

SEQ ID NO: 1217423 - protein, 4 aa, Mycobacterium
PGLN

SEQ ID NO: 1217424 - protein, 7 aa, Mycobacterium
PGLNDED

SEQ ID NO: 1217425 - protein, 4 aa, Mycobacterium
PGLP

SEQ ID NO: 1217426 - protein, 11 aa, Mycobacterium
PGLPADKAAKL

SEQ ID NO: 1217427 - protein, 15 aa, Mycobacterium
PGLPAPAPTGSGSAL

SEQ ID NO: 1217428 - protein, 8 aa, Mycobacterium
PGLPEGPA

SEQ ID NO: 1217429 - protein, 7 aa, Mycobacterium
PGLPEPA

SEQ ID NO: 1217430 - protein, 6 aa, Mycobacterium
PGLPNG

SEQ ID NO: 1217431 - protein, 9 aa, Mycobacterium
PGLPNPVEP

SEQ ID NO: 1217432 - protein, 8 aa, Mycobacterium
PGLPRVSD

SEQ ID NO: 1217433 - protein, 42 aa, Mycobacterium
PGLRARKNRQRHGNEQAPAAHPGPDHPQARRGQQAPRCRPGT

SEQ ID NO: 1217434 - protein, 10 aa, Mycobacterium
PGLSDDEVAR

SEQ ID NO: 1217435 - protein, 6 aa, Mycobacterium
PGLSRR

SEQ ID NO: 1217436 - protein, 6 aa, Mycobacterium
PGLTDP

SEQ ID NO: 1217437 - protein, 4 aa, Mycobacterium
PGMA

SEQ ID NO: 1217438 - protein, 26 aa, Mycobacterium
PGMCNPDDPEPCTSGTPSQAQIDNDY

SEQ ID NO: 1217439 - protein, 32 aa, Mycobacterium
PGMCNPDDPEPCTSGTPTQEQIDNDHRTLAQR

SEQ ID NO: 1217440 - protein, 10 aa, Mycobacterium
PGMDPGALTG

SEQ ID NO: 1217441 - protein, 19 aa, Mycobacterium
PGMEAPPHAMAPDSTDDDY

SEQ ID NO: 1217442 - protein, 15 aa, Mycobacterium
PGMLPGSRSEKTGVL

SEQ ID NO: 1217443 - protein, 4 aa, Mycobacterium
PGMP

SEQ ID NO: 1217444 - protein, 7 aa, Mycobacterium
PGMPDYP

SEQ ID NO: 1217445 - protein, 6 aa, Mycobacterium
PGMPNA

SEQ ID NO: 1217446 - protein, 7 aa, Mycobacterium
PGMPQGA

SEQ ID NO: 1217447 - protein, 10 aa, Mycobacterium
PGMPRDTPYS

SEQ ID NO: 1217448 - protein, 5 aa, Mycobacterium
PGMQG

SEQ ID NO: 1217449 - protein, 7 aa, Mycobacterium
PGMSSQR

SEQ ID NO: 1217450 - protein, 7 aa, Mycobacterium
PGMTPGE

SEQ ID NO: 1217451 - protein, 7 aa, Mycobacterium
PGNDAPL

SEQ ID NO: 1217452 - protein, 5 aa, Mycobacterium
PGNDD

SEQ ID NO: 1217453 - protein, 4 aa, Mycobacterium
PGNG

SEQ ID NO: 1217454 - protein, 6 aa, Mycobacterium
PGNPAY

SEQ ID NO: 1217455 - protein, 5 aa, Mycobacterium
PGNPT

SEQ ID NO: 1217456 - protein, 9 aa, Mycobacterium
PGNRPSTSI

SEQ ID NO: 1217457 - protein, 14 aa, Mycobacterium
PGNSEDTWTPPIGP

SEQ ID NO: 1217458 - protein, 10 aa, Mycobacterium
PGNVRPQISE

SEQ ID NO: 1217459 - protein, 6 aa, Mycobacterium
PGNWAG

SEQ ID NO: 1217460 - protein, 17 aa, Mycobacterium
PGPDDGTQPIPADNGGY

SEQ ID NO: 1217461 - protein, 9 aa, Mycobacterium
PGPDDRDEH

SEQ ID NO: 1217462 - protein, 9 aa, Mycobacterium
PGPDENGYA

SEQ ID NO: 1217463 - protein, 8 aa, Mycobacterium
PGPDGQAA

SEQ ID NO: 1217464 - protein, 12 aa, Mycobacterium
PGPDPEPHYRPS

SEQ ID NO: 1217465 - protein, 19 aa, Mycobacterium
PGPGSEPGESRAYQPGDDV

SEQ ID NO: 1217466 - protein, 19 aa, Mycobacterium
PGPGSEPGESRIYQPGDDV

SEQ ID NO: 1217467 - protein, 6 aa, Mycobacterium
PGPGVG

SEQ ID NO: 1217468 - protein, 22 aa, Mycobacterium
PGPGVGGYKGAGEGGAIGSPPA

SEQ ID NO: 1217469 - protein, 11 aa, Mycobacterium
PGPGVRGRPHP

SEQ ID NO: 1217470 - protein, 15 aa, Mycobacterium
PGPHASQTVDPDRAD

SEQ ID NO: 1217471 - protein, 5 aa, Mycobacterium
PGPHD

SEQ ID NO: 1217472 - protein, 4 aa, Mycobacterium
PGPI

SEQ ID NO: 1217473 - protein, 6 aa, Mycobacterium
PGPIDT

SEQ ID NO: 1217474 - protein, 7 aa, Mycobacterium
PGPNMSP

SEQ ID NO: 1217475 - protein, 7 aa, Mycobacterium
PGPPIRT

SEQ ID NO: 1217476 - protein, 5 aa, Mycobacterium
PGPRD

SEQ ID NO: 1217477 - protein, 5 aa, Mycobacterium
PGPRG

SEQ ID NO: 1217478 - protein, 7 aa, Mycobacterium
PGPSAVT

SEQ ID NO: 1217479 - protein, 4 aa, Mycobacterium
PGPT

SEQ ID NO: 1217480 - protein, 8 aa, Mycobacterium
PGPTATKA

SEQ ID NO: 1217481 - protein, 4 aa, Mycobacterium
PGPV

SEQ ID NO: 1217482 - protein, 5 aa, Mycobacterium
PGPVA

SEQ ID NO: 1217483 - protein, 6 aa, Mycobacterium
PGPVNG

SEQ ID NO: 1217484 - protein, 10 aa, Mycobacterium
PGPVQSTVTA

SEQ ID NO: 1217485 - protein, 15 aa, Mycobacterium
PGPVRTELPDPDEQS

SEQ ID NO: 1217486 - protein, 10 aa, Mycobacterium
PGPVTTESHA

SEQ ID NO: 1217487 - protein, 6 aa, Mycobacterium
PGPYPF

SEQ ID NO: 1217488 - protein, 5 aa, Mycobacterium
PGQES

SEQ ID NO: 1217489 - protein, 9 aa, Mycobacterium
PGQHTLSSR

SEQ ID NO: 1217490 - protein, 8 aa, Mycobacterium
PGQLGPGA

SEQ ID NO: 1217491 - protein, 6 aa, Mycobacterium
PGQLTS

SEQ ID NO: 1217492 - protein, 7 aa, Mycobacterium
PGQQQER

SEQ ID NO: 1217493 - protein, 7 aa, Mycobacterium
PGQQRPG

SEQ ID NO: 1217494 - protein, 7 aa, Mycobacterium
PGQRAAD

SEQ ID NO: 1217495 - protein, 7 aa, Mycobacterium
PGQRDHS

SEQ ID NO: 1217496 - protein, 12 aa, Mycobacterium
PGQRTEAHRHTS

SEQ ID NO: 1217497 - protein, 15 aa, Mycobacterium
PGQSPPEPRYTPSQK

SEQ ID NO: 1217498 - protein, 5 aa, Mycobacterium
PGQSV

SEQ ID NO: 1217499 - protein, 7 aa, Mycobacterium
PGQTEEQ

SEQ ID NO: 1217500 - protein, 10 aa, Mycobacterium
PGQVQQTRHE

SEQ ID NO: 1217501 - protein, 4 aa, Mycobacterium
PGRA

SEQ ID NO: 1217502 - protein, 15 aa, Mycobacterium
PGRASEVRAAAKERG

SEQ ID NO: 1217503 - protein, 11 aa, Mycobacterium
PGRCEPGTGEI

SEQ ID NO: 1217504 - protein, 6 aa, Mycobacterium
PGRCGP

SEQ ID NO: 1217505 - protein, 5 aa, Mycobacterium
PGRDA

SEQ ID NO: 1217506 - protein, 14 aa, Mycobacterium
PGRDYDRDAILFMA

SEQ ID NO: 1217507 - protein, 17 aa, Mycobacterium
PGRESALPDISEVIALL

SEQ ID NO: 1217508 - protein, 6 aa, Mycobacterium
PGRGAY

SEQ ID NO: 1217509 - protein, 6 aa, Mycobacterium
PGRGGG

SEQ ID NO: 1217510 - protein, 10 aa, Mycobacterium
PGRGGKIDTG

SEQ ID NO: 1217511 - protein, 8 aa, Mycobacterium
PGRGGSDH

SEQ ID NO: 1217512 - protein, 13 aa, Mycobacterium
PGRGLTPMGPELG

SEQ ID NO: 1217513 - protein, 6 aa, Mycobacterium
PGRGPR

SEQ ID NO: 1217514 - protein, 10 aa, Mycobacterium
PGRGSTYSAS

SEQ ID NO: 1217515 - protein, 13 aa, Mycobacterium
PGRGSYASEQGRR

SEQ ID NO: 1217516 - protein, 8 aa, Mycobacterium
PGRGTQPT

SEQ ID NO: 1217517 - protein, 9 aa, Mycobacterium
PGRHGMSRA

SEQ ID NO: 1217518 - protein, 7 aa, Mycobacterium
PGRHPTS

SEQ ID NO: 1217519 - protein, 17 aa, Mycobacterium
PGRLGRTGTIRTPHGDI

SEQ ID NO: 1217520 - protein, 5 aa, Mycobacterium
PGRLP

SEQ ID NO: 1217521 - protein, 13 aa, Mycobacterium
PGRPADGSDPDWD

SEQ ID NO: 1217522 - protein, 5 aa, Mycobacterium
PGRPD

SEQ ID NO: 1217523 - protein, 5 aa, Mycobacterium
PGRPE

SEQ ID NO: 1217524 - protein, 10 aa, Mycobacterium
PGRPPRHGEQ

SEQ ID NO: 1217525 - protein, 8 aa, Mycobacterium
PGRPSDLV

SEQ ID NO: 1217526 - protein, 5 aa, Mycobacterium
PGRPV

SEQ ID NO: 1217527 - protein, 9 aa, Mycobacterium
PGRQDRYSE

SEQ ID NO: 1217528 - protein, 7 aa, Mycobacterium
PGRRARV

SEQ ID NO: 1217529 - protein, 11 aa, Mycobacterium
PGRRARVNGAD

SEQ ID NO: 1217530 - protein, 8 aa, Mycobacterium
PGRSAEAI

SEQ ID NO: 1217531 - protein, 8 aa, Mycobacterium
PGRSDTAE

SEQ ID NO: 1217532 - protein, 5 aa, Mycobacterium
PGRTA

SEQ ID NO: 1217533 - protein, 8 aa, Mycobacterium
PGRTEADV

SEQ ID NO: 1217534 - protein, 4 aa, Mycobacterium
PGRV

SEQ ID NO: 1217535 - protein, 15 aa, Mycobacterium
PGRVDLSGDAGQDWA

SEQ ID NO: 1217536 - protein, 14 aa, Mycobacterium
PGRVETSTDAREDL

SEQ ID NO: 1217537 - protein, 12 aa, Mycobacterium
PGRVTKADGTPY

SEQ ID NO: 1217538 - protein, 4 aa, Mycobacterium
PGRW

SEQ ID NO: 1217539 - protein, 12 aa, Mycobacterium
PGRWDEDGEKRI

SEQ ID NO: 1217540 - protein, 7 aa, Mycobacterium
PGSAAEL

SEQ ID NO: 1217541 - protein, 20 aa, Mycobacterium
PGSAAPPATDRRRDGFARKS

SEQ ID NO: 1217542 - protein, 8 aa, Mycobacterium
PGSADGLA

SEQ ID NO: 1217543 - protein, 9 aa, Mycobacterium
PGSADTENV

SEQ ID NO: 1217544 - protein, 14 aa, Mycobacterium
PGSAEESQRSLRAR

SEQ ID NO: 1217545 - protein, 14 aa, Mycobacterium
PGSAGSLSVTRTRR

SEQ ID NO: 1217546 - protein, 13 aa, Mycobacterium
PGSDADAAPAEEA

SEQ ID NO: 1217547 - protein, 6 aa, Mycobacterium
PGSDPP

SEQ ID NO: 1217548 - protein, 7 aa, Mycobacterium
PGSDRRS

SEQ ID NO: 1217549 - protein, 6 aa, Mycobacterium
PGSGRT

SEQ ID NO: 1217550 - protein, 5 aa, Mycobacterium
PGSIA

SEQ ID NO: 1217551 - protein, 27 aa, Mycobacterium
PGSISSGMTDGTGASRQSIGPGLPEDA

SEQ ID NO: 1217552 - protein, 10 aa, Mycobacterium
PGSMGRPLPG

SEQ ID NO: 1217553 - protein, 16 aa, Mycobacterium
PGSMTGRYPVGNTGRV

SEQ ID NO: 1217554 - protein, 11 aa, Mycobacterium
PGSPFGEHRPD

SEQ ID NO: 1217555 - protein, 11 aa, Mycobacterium
PGSRAHGGRYA

SEQ ID NO: 1217556 - protein, 5 aa, Mycobacterium
PGSSL

SEQ ID NO: 1217557 - protein, 17 aa, Mycobacterium
PGSTGPSPDAVGPAGPL

SEQ ID NO: 1217558 - protein, 6 aa, Mycobacterium
PGSVGR

SEQ ID NO: 1217559 - protein, 8 aa, Mycobacterium
PGTAAADV

SEQ ID NO: 1217560 - protein, 11 aa, Mycobacterium
PGTAEPGDEAA

SEQ ID NO: 1217561 - protein, 7 aa, Mycobacterium
PGTAKRT

SEQ ID NO: 1217562 - protein, 6 aa, Mycobacterium
PGTAQG

SEQ ID NO: 1217563 - protein, 6 aa, Mycobacterium
PGTAVG

SEQ ID NO: 1217564 - protein, 5 aa, Mycobacterium
PGTDF

SEQ ID NO: 1217565 - protein, 11 aa, Mycobacterium
PGTDGEPTAQD

SEQ ID NO: 1217566 - protein, 7 aa, Mycobacterium
PGTDGGA

SEQ ID NO: 1217567 - protein, 7 aa, Mycobacterium
PGTDQEY

SEQ ID NO: 1217568 - protein, 5 aa, Mycobacterium
PGTDV

SEQ ID NO: 1217569 - protein, 6 aa, Mycobacterium
PGTGAQ

SEQ ID NO: 1217570 - protein, 8 aa, Mycobacterium
PGTGLSPD

SEQ ID NO: 1217571 - protein, 10 aa, Mycobacterium
PGTGPHRHSG

SEQ ID NO: 1217572 - protein, 8 aa, Mycobacterium
PGTGSDDD

SEQ ID NO: 1217573 - protein, 8 aa, Mycobacterium
PGTGSSVR

SEQ ID NO: 1217574 - protein, 11 aa, Mycobacterium
PGTKEPVSPDD

SEQ ID NO: 1217575 - protein, 11 aa, Mycobacterium
PGTLEPDPELT

SEQ ID NO: 1217576 - protein, 6 aa, Mycobacterium
PGTLEQ

SEQ ID NO: 1217577 - protein, 7 aa, Mycobacterium
PGTLPEP

SEQ ID NO: 1217578 - protein, 12 aa, Mycobacterium
PGTNWDSNPNAM

SEQ ID NO: 1217579 - protein, 11 aa, Mycobacterium
PGTPIELSGTP

SEQ ID NO: 1217580 - protein, 4 aa, Mycobacterium
PGTR

SEQ ID NO: 1217581 - protein, 6 aa, Mycobacterium
PGTRAA

SEQ ID NO: 1217582 - protein, 6 aa, Mycobacterium
PGTREP

SEQ ID NO: 1217583 - protein, 11 aa, Mycobacterium
PGTREPVGPDD

SEQ ID NO: 1217584 - protein, 6 aa, Mycobacterium
PGTRIP

SEQ ID NO: 1217585 - protein, 4 aa, Mycobacterium
PGTS

SEQ ID NO: 1217586 - protein, 8 aa, Mycobacterium
PGTTGVHT

SEQ ID NO: 1217587 - protein, 14 aa, Mycobacterium
PGTTTTPPAQQLPE

SEQ ID NO: 1217588 - protein, 14 aa, Mycobacterium
PGTVDQERGSSIDT

SEQ ID NO: 1217589 - protein, 5 aa, Mycobacterium
PGTVN

SEQ ID NO: 1217590 - protein, 4 aa, Mycobacterium
PGTW

SEQ ID NO: 1217591 - protein, 7 aa, Mycobacterium
PGTWTAE

SEQ ID NO: 1217592 - protein, 5 aa, Mycobacterium
PGVDG

SEQ ID NO: 1217593 - protein, 8 aa, Mycobacterium
PGVDPEED

SEQ ID NO: 1217594 - protein, 9 aa, Mycobacterium
PGVDPEKDV

SEQ ID NO: 1217595 - protein, 13 aa, Mycobacterium
PGVEPDQVAENTS

SEQ ID NO: 1217596 - protein, 7 aa, Mycobacterium
PGVEPQE

SEQ ID NO: 1217597 - protein, 12 aa, Mycobacterium
PGVEPRADGGYG

SEQ ID NO: 1217598 - protein, 6 aa, Mycobacterium
PGVGPG

SEQ ID NO: 1217599 - protein, 4 aa, Mycobacterium
PGVL

SEQ ID NO: 1217600 - protein, 8 aa, Mycobacterium
PGVPDPDP

SEQ ID NO: 1217601 - protein, 12 aa, Mycobacterium
PGVPPDSQAEGD

SEQ ID NO: 1217602 - protein, 5 aa, Mycobacterium
PGVPS

SEQ ID NO: 1217603 - protein, 11 aa, Mycobacterium
PGVQPGDPARV

SEQ ID NO: 1217604 - protein, 7 aa, Mycobacterium
PGVQTPD

SEQ ID NO: 1217605 - protein, 16 aa, Mycobacterium
PGVQVSSDAAAERSAA

SEQ ID NO: 1217606 - protein, 7 aa, Mycobacterium
PGVRNYD

SEQ ID NO: 1217607 - protein, 9 aa, Mycobacterium
PGVSVPGST

SEQ ID NO: 1217608 - protein, 8 aa, Mycobacterium
PGVTEVEA

SEQ ID NO: 1217609 - protein, 4 aa, Mycobacterium
PGWG

SEQ ID NO: 1217610 - protein, 16 aa, Mycobacterium
PGWGQSEAVKPDARDH

SEQ ID NO: 1217611 - protein, 13 aa, Mycobacterium
PGWPTTDPDDHAV

SEQ ID NO: 1217612 - protein, 8 aa, Mycobacterium
PGWQEERK

SEQ ID NO: 1217613 - protein, 11 aa, Mycobacterium
PGWRKRDTDGA

SEQ ID NO: 1217614 - protein, 8 aa, Mycobacterium
PGWSPEAR

SEQ ID NO: 1217615 - protein, 5 aa, Mycobacterium
PGYDD

SEQ ID NO: 1217616 - protein, 10 aa, Mycobacterium
PGYDDAMPGS

SEQ ID NO: 1217617 - protein, 7 aa, Mycobacterium
PGYGRES

SEQ ID NO: 1217618 - protein, 7 aa, Mycobacterium
PGYGRST

SEQ ID NO: 1217619 - protein, 13 aa, Mycobacterium
PGYGWSGPAPHKW

SEQ ID NO: 1217620 - protein, 5 aa, Mycobacterium
PGYKG

SEQ ID NO: 1217621 - protein, 6 aa, Mycobacterium
PGYPRR

SEQ ID NO: 1217622 - protein, 6 aa, Mycobacterium
PGYSDA

SEQ ID NO: 1217623 - protein, 4 aa, Mycobacterium
PGYT

SEQ ID NO: 1217624 - protein, 7 aa, Mycobacterium
PHAAAPP

SEQ ID NO: 1217625 - protein, 4 aa, Mycobacterium
PHAG

SEQ ID NO: 1217626 - protein, 5 aa, Mycobacterium
PHAGK

SEQ ID NO: 1217627 - protein, 8 aa, Mycobacterium
PHAPDTHS

SEQ ID NO: 1217628 - protein, 4 aa, Mycobacterium
PHAT

SEQ ID NO: 1217629 - protein, 4 aa, Mycobacterium
PHDA

SEQ ID NO: 1217630 - protein, 5 aa, Mycobacterium
PHDAL

SEQ ID NO: 1217631 - protein, 11 aa, Mycobacterium
PHDASEAPNGT

SEQ ID NO: 1217632 - protein, 6 aa, Mycobacterium
PHDDGR

SEQ ID NO: 1217633 - protein, 7 aa, Mycobacterium
PHDDKQV

SEQ ID NO: 1217634 - protein, 10 aa, Mycobacterium
PHDPEHHRRP

SEQ ID NO: 1217635 - protein, 7 aa, Mycobacterium
PHDPSEN

SEQ ID NO: 1217636 - protein, 10 aa, Mycobacterium
PHDSSEATVS

SEQ ID NO: 1217637 - protein, 5 aa, Mycobacterium
PHDVG

SEQ ID NO: 1217638 - protein, 11 aa, Mycobacterium
PHDVRGGTGMD

SEQ ID NO: 1217639 - protein, 5 aa, Mycobacterium
PHEPG

SEQ ID NO: 1217640 - protein, 6 aa, Mycobacterium
PHGDHW

SEQ ID NO: 1217641 - protein, 12 aa, Mycobacterium
PHGEGLADPTSF

SEQ ID NO: 1217642 - protein, 11 aa, Mycobacterium
PHGQPAPERAL

SEQ ID NO: 1217643 - protein, 5 aa, Mycobacterium
PHGRE

SEQ ID NO: 1217644 - protein, 11 aa, Mycobacterium
PHGVADSGEYR

SEQ ID NO: 1217645 - protein, 13 aa, Mycobacterium
PHGVEGGTSEADG

SEQ ID NO: 1217646 - protein, 7 aa, Mycobacterium
PHHDPET

SEQ ID NO: 1217647 - protein, 4 aa, Mycobacterium
PHIG

SEQ ID NO: 1217648 - protein, 14 aa, Mycobacterium
PHKPVKRVDSGIRG

SEQ ID NO: 1217649 - protein, 17 aa, Mycobacterium
PHLGGNAYSEAEPQTGI

SEQ ID NO: 1217650 - protein, 10 aa, Mycobacterium
PHMGRDGDTL

SEQ ID NO: 1217651 - protein, 7 aa, Mycobacterium
PHMTASG

SEQ ID NO: 1217652 - protein, 14 aa, Mycobacterium
PHNPTGSVASDDEL

SEQ ID NO: 1217653 - protein, 7 aa, Mycobacterium
PHNQPGR

SEQ ID NO: 1217654 - protein, 6 aa, Mycobacterium
PHPARP

SEQ ID NO: 1217655 - protein, 11 aa, Mycobacterium
PHPEGLETPKG

SEQ ID NO: 1217656 - protein, 5 aa, Mycobacterium
PHPER

SEQ ID NO: 1217657 - protein, 11 aa, Mycobacterium
PHPFTDAGNTA

SEQ ID NO: 1217658 - protein, 9 aa, Mycobacterium
PHPGSGHDR

SEQ ID NO: 1217659 - protein, 10 aa, Mycobacterium
PHPKAADASL

SEQ ID NO: 1217660 - protein, 6 aa, Mycobacterium
PHPLTG

SEQ ID NO: 1217661 - protein, 7 aa, Mycobacterium
PHPMPGT

SEQ ID NO: 1217662 - protein, 12 aa, Mycobacterium
PHPPGGLTGYRE

SEQ ID NO: 1217663 - protein, 18 aa, Mycobacterium
PHPPRDSREFHTTTGKAN

SEQ ID NO: 1217664 - protein, 5 aa, Mycobacterium
PHPRT

SEQ ID NO: 1217665 - protein, 7 aa, Mycobacterium
PHPTPGF

SEQ ID NO: 1217666 - protein, 10 aa, Mycobacterium
PHQRGTGGEV

SEQ ID NO: 1217667 - protein, 5 aa, Mycobacterium
PHQYT

SEQ ID NO: 1217668 - protein, 15 aa, Mycobacterium
PHRGAEALTEFWATL

SEQ ID NO: 1217669 - protein, 10 aa, Mycobacterium
PHRGERTTLT

SEQ ID NO: 1217670 - protein, 21 aa, Mycobacterium
PHRGIPEAPPGPQREATAERF

SEQ ID NO: 1217671 - protein, 9 aa, Mycobacterium
PHRGSGHDR

SEQ ID NO: 1217672 - protein, 10 aa, Mycobacterium
PHRPRPADLD

SEQ ID NO: 1217673 - protein, 7 aa, Mycobacterium
PHRRARE

SEQ ID NO: 1217674 - protein, 10 aa, Mycobacterium
PHRSPDWTGG

SEQ ID NO: 1217675 - protein, 6 aa, Mycobacterium
PHSEGW

SEQ ID NO: 1217676 - protein, 7 aa, Mycobacterium
PHSGEDD

SEQ ID NO: 1217677 - protein, 17 aa, Mycobacterium
PHSGGGRTETGGCPRGC

SEQ ID NO: 1217678 - protein, 5 aa, Mycobacterium
PHSLG

SEQ ID NO: 1217679 - protein, 20 aa, Mycobacterium
PHSNRIPGQEELPEVDPADP

SEQ ID NO: 1217680 - protein, 6 aa, Mycobacterium
PHSRPN

SEQ ID NO: 1217681 - protein, 16 aa, Mycobacterium
PHSSIPDAIDTIAASW

SEQ ID NO: 1217682 - protein, 5 aa, Mycobacterium
PHSTH

SEQ ID NO: 1217683 - protein, 5 aa, Mycobacterium
PHTAQ

SEQ ID NO: 1217684 - protein, 7 aa, Mycobacterium
PHTDPSW

SEQ ID NO: 1217685 - protein, 16 aa, Mycobacterium
PHTGGEKRVSASGDTL

SEQ ID NO: 1217686 - protein, 17 aa, Mycobacterium
PHTTSDDPTRYRSDEEV

SEQ ID NO: 1217687 - protein, 4 aa, Mycobacterium
PHTV

SEQ ID NO: 1217688 - protein, 11 aa, Mycobacterium
PIADSTERQAR

SEQ ID NO: 1217689 - protein, 7 aa, Mycobacterium
PIAEAAQ

SEQ ID NO: 1217690 - protein, 4 aa, Mycobacterium
PIAG

SEQ ID NO: 1217691 - protein, 4 aa, Mycobacterium
PIAP

SEQ ID NO: 1217692 - protein, 6 aa, Mycobacterium
PIAPRR

SEQ ID NO: 1217693 - protein, 4 aa, Mycobacterium
PIDE

SEQ ID NO: 1217694 - protein, 5 aa, Mycobacterium
PIDEA

SEQ ID NO: 1217695 - protein, 7 aa, Mycobacterium
PIDPEIG

SEQ ID NO: 1217696 - protein, 22 aa, Mycobacterium
PIDPEQGRKQGKYSWAKSPRYA

SEQ ID NO: 1217697 - protein, 10 aa, Mycobacterium
PIDTAKPARV

SEQ ID NO: 1217698 - protein, 6 aa, Mycobacterium
PIDTPP

SEQ ID NO: 1217699 - protein, 4 aa, Mycobacterium
PIEA

SEQ ID NO: 1217700 - protein, 5 aa, Mycobacterium
PIEAE

SEQ ID NO: 1217701 - protein, 12 aa, Mycobacterium
PIEGAGARAPEI

SEQ ID NO: 1217702 - protein, 12 aa, Mycobacterium
PIEGTGERAPEI

SEQ ID NO: 1217703 - protein, 7 aa, Mycobacterium
PIEPTLP

SEQ ID NO: 1217704 - protein, 4 aa, Mycobacterium
PIER

SEQ ID NO: 1217705 - protein, 4 aa, Mycobacterium
PIET

SEQ ID NO: 1217706 - protein, 4 aa, Mycobacterium
PIGA

SEQ ID NO: 1217707 - protein, 11 aa, Mycobacterium
PIGDGEPGPVT

SEQ ID NO: 1217708 - protein, 8 aa, Mycobacterium
PIGDPERL

SEQ ID NO: 1217709 - protein, 10 aa, Mycobacterium
PIGDPGEAAA

SEQ ID NO: 1217710 - protein, 4 aa, Mycobacterium
PIGL

SEQ ID NO: 1217711 - protein, 7 aa, Mycobacterium
PIGPGTY

SEQ ID NO: 1217712 - protein, 4 aa, Mycobacterium
PIGS

SEQ ID NO: 1217713 - protein, 10 aa, Mycobacterium
PIGSAGSAVG

SEQ ID NO: 1217714 - protein, 21 aa, Mycobacterium
PIGTATATAVANPGFDPAHPI

SEQ ID NO: 1217715 - protein, 6 aa, Mycobacterium
PIHPTG

SEQ ID NO: 1217716 - protein, 9 aa, Mycobacterium
PINGPVPAM

SEQ ID NO: 1217717 - protein, 8 aa, Mycobacterium
PINPSGGL

SEQ ID NO: 1217718 - protein, 19 aa, Mycobacterium
PINPSGGLKAKGHPPGATG

SEQ ID NO: 1217719 - protein, 10 aa, Mycobacterium
PINTSGGNLA

SEQ ID NO: 1217720 - protein, 12 aa, Mycobacterium
PINTSGGQLSGG

SEQ ID NO: 1217721 - protein, 28 aa, Mycobacterium
PIPAAAAAAAPRKRAAAAGTIAASVRGH

SEQ ID NO: 1217722 - protein, 5 aa, Mycobacterium
PIPAT

SEQ ID NO: 1217723 - protein, 13 aa, Mycobacterium
PIPDARRAGPSTL

SEQ ID NO: 1217724 - protein, 5 aa, Mycobacterium
PIPDD

SEQ ID NO: 1217725 - protein, 12 aa, Mycobacterium
PIPDSRTPTGSR

SEQ ID NO: 1217726 - protein, 7 aa, Mycobacterium
PIPGAAE

SEQ ID NO: 1217727 - protein, 8 aa, Mycobacterium
PIPGGKSA

SEQ ID NO: 1217728 - protein, 15 aa, Mycobacterium
PIPGRPAPLHPNADG

SEQ ID NO: 1217729 - protein, 5 aa, Mycobacterium
PIPLP

SEQ ID NO: 1217730 - protein, 6 aa, Mycobacterium
PIPPGS

SEQ ID NO: 1217731 - protein, 5 aa, Mycobacterium
PIPQP

SEQ ID NO: 1217732 - protein, 5 aa, Mycobacterium
PIPSE

SEQ ID NO: 1217733 - protein, 5 aa, Mycobacterium
PIPSF

SEQ ID NO: 1217734 - protein, 18 aa, Mycobacterium
PIPSHSAVSTPVPNTFNR

SEQ ID NO: 1217735 - protein, 9 aa, Mycobacterium
PIPTAESPR

SEQ ID NO: 1217736 - protein, 6 aa, Mycobacterium
PIPTPY

SEQ ID NO: 1217737 - protein, 13 aa, Mycobacterium
PIPVGDDGSLPAE

SEQ ID NO: 1217738 - protein, 7 aa, Mycobacterium
PIQGPVS

SEQ ID NO: 1217739 - protein, 4 aa, Mycobacterium
PIQP

SEQ ID NO: 1217740 - protein, 13 aa, Mycobacterium
PIQPTKDTTTDRG

SEQ ID NO: 1217741 - protein, 7 aa, Mycobacterium
PIREGLD

SEQ ID NO: 1217742 - protein, 7 aa, Mycobacterium
PIRPQGE

SEQ ID NO: 1217743 - protein, 4 aa, Mycobacterium
PIRT

SEQ ID NO: 1217744 - protein, 12 aa, Mycobacterium
PISGSYDAGSRT

SEQ ID NO: 1217745 - protein, 15 aa, Mycobacterium
PISHPDTAILAMLLA

SEQ ID NO: 1217746 - protein, 23 aa, Mycobacterium
PISNGELAATGKVGAEVSAEDAK

SEQ ID NO: 1217747 - protein, 6 aa, Mycobacterium
PISPVD

SEQ ID NO: 1217748 - protein, 6 aa, Mycobacterium
PISSEQ

SEQ ID NO: 1217749 - protein, 11 aa, Mycobacterium
PISSPRRPSAD

SEQ ID NO: 1217750 - protein, 8 aa, Mycobacterium
PISSQGAS

SEQ ID NO: 1217751 - protein, 11 aa, Mycobacterium
PISSVAGRKGY

SEQ ID NO: 1217752 - protein, 8 aa, Mycobacterium
PITAERAK

SEQ ID NO: 1217753 - protein, 4 aa, Mycobacterium
PITD

SEQ ID NO: 1217754 - protein, 6 aa, Mycobacterium
PITDRE

SEQ ID NO: 1217755 - protein, 15 aa, Mycobacterium
PITPGTGDGTGPQVH

SEQ ID NO: 1217756 - protein, 12 aa, Mycobacterium
PITSPATSDRNF

SEQ ID NO: 1217757 - protein, 8 aa, Mycobacterium
PKAAEPAV

SEQ ID NO: 1217758 - protein, 5 aa, Mycobacterium
PKAAG

SEQ ID NO: 1217759 - protein, 32 aa, Mycobacterium
PKAASGHPGRNLDSPDGGTAHHRGRPPRRGQR

SEQ ID NO: 1217760 - protein, 16 aa, Mycobacterium
PKADDRPAVPEDLDPD

SEQ ID NO: 1217761 - protein, 7 aa, Mycobacterium
PKADGFR

SEQ ID NO: 1217762 - protein, 8 aa, Mycobacterium
PKADGGGA

SEQ ID NO: 1217763 - protein, 9 aa, Mycobacterium
PKAGSRAPW

SEQ ID NO: 1217764 - protein, 12 aa, Mycobacterium
PKAHKRKDGATY

SEQ ID NO: 1217765 - protein, 12 aa, Mycobacterium
PKANKRKDGATY

SEQ ID NO: 1217766 - protein, 5 aa, Mycobacterium
PKAQY

SEQ ID NO: 1217767 - protein, 4 aa, Mycobacterium
PKAT

SEQ ID NO: 1217768 - protein, 6 aa, Mycobacterium
PKATAL

SEQ ID NO: 1217769 - protein, 9 aa, Mycobacterium
PKATPEQTA

SEQ ID NO: 1217770 - protein, 14 aa, Mycobacterium
PKAVRGQTAVAEGY

SEQ ID NO: 1217771 - protein, 5 aa, Mycobacterium
PKDDT

SEQ ID NO: 1217772 - protein, 14 aa, Mycobacterium
PKDPVEAMRDGTAH

SEQ ID NO: 1217773 - protein, 25 aa, Mycobacterium
PKDRLQTKGEEQLKAAEDAGHDTRA

SEQ ID NO: 1217774 - protein, 13 aa, Mycobacterium
PKDSGSYSAASRL

SEQ ID NO: 1217775 - protein, 6 aa, Mycobacterium
PKDSPN

SEQ ID NO: 1217776 - protein, 7 aa, Mycobacterium
PKDVGRF

SEQ ID NO: 1217777 - protein, 8 aa, Mycobacterium
PKEERTRR

SEQ ID NO: 1217778 - protein, 8 aa, Mycobacterium
PKEGRGRK

SEQ ID NO: 1217779 - protein, 4 aa, Mycobacterium
PKEN

SEQ ID NO: 1217780 - protein, 17 aa, Mycobacterium
PKEPEADRDIPFRQARR

SEQ ID NO: 1217781 - protein, 7 aa, Mycobacterium
PKESGLR

SEQ ID NO: 1217782 - protein, 6 aa, Mycobacterium
PKEVPL

SEQ ID NO: 1217783 - protein, 10 aa, Mycobacterium
PKEYGGQDLP

SEQ ID NO: 1217784 - protein, 9 aa, Mycobacterium
PKGATGNTG

SEQ ID NO: 1217785 - protein, 8 aa, Mycobacterium
PKGDPDYR

SEQ ID NO: 1217786 - protein, 12 aa, Mycobacterium
PKGEARQRAEEL

SEQ ID NO: 1217787 - protein, 9 aa, Mycobacterium
PKGEGGGFV

SEQ ID NO: 1217788 - protein, 10 aa, Mycobacterium
PKGEGGPAMA

SEQ ID NO: 1217789 - protein, 16 aa, Mycobacterium
PKGESAASLKLDGTET

SEQ ID NO: 1217790 - protein, 9 aa, Mycobacterium
PKGGEPETE

SEQ ID NO: 1217791 - protein, 13 aa, Mycobacterium
PKGKVDPGETEAV

SEQ ID NO: 1217792 - protein, 4 aa, Mycobacterium
PKGL

SEQ ID NO: 1217793 - protein, 19 aa, Mycobacterium
PKGQVRDPERARTKAEEFG

SEQ ID NO: 1217794 - protein, 6 aa, Mycobacterium
PKGRAL

SEQ ID NO: 1217795 - protein, 19 aa, Mycobacterium
PKGWTGPREVDGKKVEGTW

SEQ ID NO: 1217796 - protein, 13 aa, Mycobacterium
PKHKRDPGLSEGE

SEQ ID NO: 1217797 - protein, 13 aa, Mycobacterium
PKHPRLQDFLAKV

SEQ ID NO: 1217798 - protein, 4 aa, Mycobacterium
PKIG

SEQ ID NO: 1217799 - protein, 5 aa, Mycobacterium
PKIKR

SEQ ID NO: 1217800 - protein, 52 aa, Mycobacterium
PKKAESAAAPAKKAAKKAPAKKASPAAAAKTSAATPAKKAPAKKAAAKKVTQ

SEQ ID NO: 1217801 - protein, 8 aa, Mycobacterium
PKKPDIPG

SEQ ID NO: 1217802 - protein, 5 aa, Mycobacterium
PKLAD

SEQ ID NO: 1217803 - protein, 5 aa, Mycobacterium
PKLAG

SEQ ID NO: 1217804 - protein, 11 aa, Mycobacterium
PKLEGAKCAGR

SEQ ID NO: 1217805 - protein, 14 aa, Mycobacterium
PKLPPVGDVTGPGV

SEQ ID NO: 1217806 - protein, 4 aa, Mycobacterium
PKNA

SEQ ID NO: 1217807 - protein, 8 aa, Mycobacterium
PKNAGRDE

SEQ ID NO: 1217808 - protein, 7 aa, Mycobacterium
PKNPDNW

SEQ ID NO: 1217809 - protein, 8 aa, Mycobacterium
PKNPLERD

SEQ ID NO: 1217810 - protein, 11 aa, Mycobacterium
PKPDYDDVRGE

SEQ ID NO: 1217811 - protein, 14 aa, Mycobacterium
PKPESIGRSGRWQS

SEQ ID NO: 1217812 - protein, 13 aa, Mycobacterium
PKPGDEAAAAGMG

SEQ ID NO: 1217813 - protein, 7 aa, Mycobacterium
PKPGVTS

SEQ ID NO: 1217814 - protein, 5 aa, Mycobacterium
PKPIR

SEQ ID NO: 1217815 - protein, 7 aa, Mycobacterium
PKPLART

SEQ ID NO: 1217816 - protein, 8 aa, Mycobacterium
PKPNEPRG

SEQ ID NO: 1217817 - protein, 6 aa, Mycobacterium
PKPPAL

SEQ ID NO: 1217818 - protein, 4 aa, Mycobacterium
PKPR

SEQ ID NO: 1217819 - protein, 7 aa, Mycobacterium
PKPSGHI

SEQ ID NO: 1217820 - protein, 6 aa, Mycobacterium
PKPSIA

SEQ ID NO: 1217821 - protein, 10 aa, Mycobacterium
PKPSSLPAAA

SEQ ID NO: 1217822 - protein, 9 aa, Mycobacterium
PKPTAPKTY

SEQ ID NO: 1217823 - protein, 5 aa, Mycobacterium
PKPTE

SEQ ID NO: 1217824 - protein, 6 aa, Mycobacterium
PKQMRS

SEQ ID NO: 1217825 - protein, 6 aa, Mycobacterium
PKQVGN

SEQ ID NO: 1217826 - protein, 4 aa, Mycobacterium
PKQY

SEQ ID NO: 1217827 - protein, 7 aa, Mycobacterium
PKRGDYD

SEQ ID NO: 1217828 - protein, 14 aa, Mycobacterium
PKRRRTRAADQAAR

SEQ ID NO: 1217829 - protein, 23 aa, Mycobacterium
PKRRRTRAADQAARIKAEREHNA

SEQ ID NO: 1217830 - protein, 31 aa, Mycobacterium
PKRRRTRAADQAARIKTEREHNATQRALERQ

SEQ ID NO: 1217831 - protein, 56 aa, Mycobacterium
PKRRRTRAADTAARIKTEREHNATQRALESERATAVEHDRQAGRPPPTDYGDEPPP

SEQ ID NO: 1217832 - protein, 22 aa, Mycobacterium
PKRRRTRAAEEAARIKAEREHN

SEQ ID NO: 1217833 - protein, 12 aa, Mycobacterium
PKRRTKAQIARE

SEQ ID NO: 1217834 - protein, 7 aa, Mycobacterium
PKSERSE

SEQ ID NO: 1217835 - protein, 8 aa, Mycobacterium
PKSETRQL

SEQ ID NO: 1217836 - protein, 18 aa, Mycobacterium
PKSGGGVDPLTDAPAPIT

SEQ ID NO: 1217837 - protein, 4 aa, Mycobacterium
PKSI

SEQ ID NO: 1217838 - protein, 5 aa, Mycobacterium
PKSRA

SEQ ID NO: 1217839 - protein, 5 aa, Mycobacterium
PKSRG

SEQ ID NO: 1217840 - protein, 9 aa, Mycobacterium
PKSTTVTEK

SEQ ID NO: 1217841 - protein, 9 aa, Mycobacterium
PKTARPVGP

SEQ ID NO: 1217842 - protein, 8 aa, Mycobacterium
PKTNPTIT

SEQ ID NO: 1217843 - protein, 15 aa, Mycobacterium
PKTPTDTGALDPDAG

SEQ ID NO: 1217844 - protein, 7 aa, Mycobacterium
PKTRADL

SEQ ID NO: 1217845 - protein, 6 aa, Mycobacterium
PKTRFQ

SEQ ID NO: 1217846 - protein, 8 aa, Mycobacterium
PKTSGGRG

SEQ ID NO: 1217847 - protein, 8 aa, Mycobacterium
PKTSGSRG

SEQ ID NO: 1217848 - protein, 12 aa, Mycobacterium
PKTSVGKFSKKT

SEQ ID NO: 1217849 - protein, 6 aa, Mycobacterium
PKTTVT

SEQ ID NO: 1217850 - protein, 5 aa, Mycobacterium
PKTYD

SEQ ID NO: 1217851 - protein, 11 aa, Mycobacterium
PKVDEDSDVDS

SEQ ID NO: 1217852 - protein, 7 aa, Mycobacterium
PKVDPVT

SEQ ID NO: 1217853 - protein, 23 aa, Mycobacterium
PKVERRTQAPGNPLTGAYRTADG

SEQ ID NO: 1217854 - protein, 13 aa, Mycobacterium
PKVPAPTLRDRAE

SEQ ID NO: 1217855 - protein, 18 aa, Mycobacterium
PKVPDTGATSLDCDAEPV

SEQ ID NO: 1217856 - protein, 6 aa, Mycobacterium
PKWPPM

SEQ ID NO: 1217857 - protein, 6 aa, Mycobacterium
PKWPSM

SEQ ID NO: 1217858 - protein, 15 aa, Mycobacterium
PKYAPPQGLRSQSAV

SEQ ID NO: 1217859 - protein, 8 aa, Mycobacterium
PKYDQENT

SEQ ID NO: 1217860 - protein, 5 aa, Mycobacterium
PKYTP

SEQ ID NO: 1217861 - protein, 13 aa, Mycobacterium
PKYTVTSGSITLD

SEQ ID NO: 1217862 - protein, 8 aa, Mycobacterium
PLAAADGP

SEQ ID NO: 1217863 - protein, 10 aa, Mycobacterium
PLAAAEADGA

SEQ ID NO: 1217864 - protein, 11 aa, Mycobacterium
PLAAAGADDSL

SEQ ID NO: 1217865 - protein, 11 aa, Mycobacterium
PLAADGKHRAE

SEQ ID NO: 1217866 - protein, 16 aa, Mycobacterium
PLADDTLSALSLPGVF

SEQ ID NO: 1217867 - protein, 8 aa, Mycobacterium
PLADPPVD

SEQ ID NO: 1217868 - protein, 14 aa, Mycobacterium
PLADSVGKSDREGM

SEQ ID NO: 1217869 - protein, 12 aa, Mycobacterium
PLAETAGTRLAN

SEQ ID NO: 1217870 - protein, 8 aa, Mycobacterium
PLAGDRRL

SEQ ID NO: 1217871 - protein, 13 aa, Mycobacterium
PLAGGMGGLGLPG

SEQ ID NO: 1217872 - protein, 5 aa, Mycobacterium
PLAGN

SEQ ID NO: 1217873 - protein, 16 aa, Mycobacterium
PLAGRESVSPEDFAPG

SEQ ID NO: 1217874 - protein, 5 aa, Mycobacterium
PLAKK

SEQ ID NO: 1217875 - protein, 8 aa, Mycobacterium
PLAPDPEF

SEQ ID NO: 1217876 - protein, 8 aa, Mycobacterium
PLAPGGYA

SEQ ID NO: 1217877 - protein, 7 aa, Mycobacterium
PLAPGQA

SEQ ID NO: 1217878 - protein, 13 aa, Mycobacterium
PLAPRNNASEATY

SEQ ID NO: 1217879 - protein, 13 aa, Mycobacterium
PLAPTGRGTACDG

SEQ ID NO: 1217880 - protein, 14 aa, Mycobacterium
PLAQAADDNEAERI

SEQ ID NO: 1217881 - protein, 5 aa, Mycobacterium
PLAQR

SEQ ID NO: 1217882 - protein, 15 aa, Mycobacterium
PLATDDGDHAVADDH

SEQ ID NO: 1217883 - protein, 10 aa, Mycobacterium
PLATPEDLAA

SEQ ID NO: 1217884 - protein, 11 aa, Mycobacterium
PLAVPTSAEYR

SEQ ID NO: 1217885 - protein, 8 aa, Mycobacterium
PLDDERNA

SEQ ID NO: 1217886 - protein, 15 aa, Mycobacterium
PLDERWESRDETSAA

SEQ ID NO: 1217887 - protein, 18 aa, Mycobacterium
PLDPASASVPARVWSGGP

SEQ ID NO: 1217888 - protein, 5 aa, Mycobacterium
PLDPH

SEQ ID NO: 1217889 - protein, 6 aa, Mycobacterium
PLDPND

SEQ ID NO: 1217890 - protein, 13 aa, Mycobacterium
PLDPTERTLHEHD

SEQ ID NO: 1217891 - protein, 6 aa, Mycobacterium
PLDSDE

SEQ ID NO: 1217892 - protein, 5 aa, Mycobacterium
PLDTQ

SEQ ID NO: 1217893 - protein, 12 aa, Mycobacterium
PLDYPEDKTELS

SEQ ID NO: 1217894 - protein, 5 aa, Mycobacterium
PLEAN

SEQ ID NO: 1217895 - protein, 4 aa, Mycobacterium
PLEG

SEQ ID NO: 1217896 - protein, 13 aa, Mycobacterium
PLEGARVNNGGGL

SEQ ID NO: 1217897 - protein, 6 aa, Mycobacterium
PLEGDN

SEQ ID NO: 1217898 - protein, 9 aa, Mycobacterium
PLEPGERGV

SEQ ID NO: 1217899 - protein, 17 aa, Mycobacterium
PLEPVEPPGIAPAGRRR

SEQ ID NO: 1217900 - protein, 4 aa, Mycobacterium
PLER

SEQ ID NO: 1217901 - protein, 7 aa, Mycobacterium
PLETGGA

SEQ ID NO: 1217902 - protein, 17 aa, Mycobacterium
PLGAPGSEGLPASTPIT

SEQ ID NO: 1217903 - protein, 5 aa, Mycobacterium
PLGAS

SEQ ID NO: 1217904 - protein, 6 aa, Mycobacterium
PLGDQG

SEQ ID NO: 1217905 - protein, 11 aa, Mycobacterium
PLGEQRAAAQG

SEQ ID NO: 1217906 - protein, 9 aa, Mycobacterium
PLGGDEMGG

SEQ ID NO: 1217907 - protein, 6 aa, Mycobacterium
PLGHPG

SEQ ID NO: 1217908 - protein, 4 aa, Mycobacterium
PLGP

SEQ ID NO: 1217909 - protein, 10 aa, Mycobacterium
PLGPASRTLL

SEQ ID NO: 1217910 - protein, 6 aa, Mycobacterium
PLGPDS

SEQ ID NO: 1217911 - protein, 9 aa, Mycobacterium
PLGPGQPPA

SEQ ID NO: 1217912 - protein, 8 aa, Mycobacterium
PLGPLAPG

SEQ ID NO: 1217913 - protein, 10 aa, Mycobacterium
PLGQPSDASA

SEQ ID NO: 1217914 - protein, 5 aa, Mycobacterium
PLGRT

SEQ ID NO: 1217915 - protein, 8 aa, Mycobacterium
PLGSTDMG

SEQ ID NO: 1217916 - protein, 10 aa, Mycobacterium
PLGSTGESAY

SEQ ID NO: 1217917 - protein, 4 aa, Mycobacterium
PLGT

SEQ ID NO: 1217918 - protein, 10 aa, Mycobacterium
PLHPPTTATT

SEQ ID NO: 1217919 - protein, 22 aa, Mycobacterium
PLKEKSRSSAAYSGGGRSLPRG

SEQ ID NO: 1217920 - protein, 11 aa, Mycobacterium
PLKSDREIART

SEQ ID NO: 1217921 - protein, 4 aa, Mycobacterium
PLLN

SEQ ID NO: 1217922 - protein, 6 aa, Mycobacterium
PLNAPS

SEQ ID NO: 1217923 - protein, 7 aa, Mycobacterium
PLNAPSR

SEQ ID NO: 1217924 - protein, 11 aa, Mycobacterium
PLNDATPDIEV

SEQ ID NO: 1217925 - protein, 16 aa, Mycobacterium
PLNPNERSKRDDNPLN

SEQ ID NO: 1217926 - protein, 6 aa, Mycobacterium
PLPAGA

SEQ ID NO: 1217927 - protein, 8 aa, Mycobacterium
PLPATAPS

SEQ ID NO: 1217928 - protein, 10 aa, Mycobacterium
PLPDANNPNV

SEQ ID NO: 1217929 - protein, 6 aa, Mycobacterium
PLPDDP

SEQ ID NO: 1217930 - protein, 5 aa, Mycobacterium
PLPDS

SEQ ID NO: 1217931 - protein, 12 aa, Mycobacterium
PLPEGEVDKPSE

SEQ ID NO: 1217932 - protein, 91 aa, Mycobacterium
PLPEGPSNGDPFSTGDDDRSTDKRSDESPERPPEAAVETGDTQPRLSVPDPSDAESRSGNTAPRVSTGPTPGPSSLSPHPPAQSASPASVA

SEQ ID NO: 1217933 - protein, 10 aa, Mycobacterium
PLPEPEKGSV

SEQ ID NO: 1217934 - protein, 9 aa, Mycobacterium
PLPESPDDD

SEQ ID NO: 1217935 - protein, 5 aa, Mycobacterium
PLPGA

SEQ ID NO: 1217936 - protein, 7 aa, Mycobacterium
PLPGTGR

SEQ ID NO: 1217937 - protein, 6 aa, Mycobacterium
PLPGTR

SEQ ID NO: 1217938 - protein, 11 aa, Mycobacterium
PLPGTVGTGSN

SEQ ID NO: 1217939 - protein, 8 aa, Mycobacterium
PLPGVEPY

SEQ ID NO: 1217940 - protein, 15 aa, Mycobacterium
PLPGVNGPSPAAGGF

SEQ ID NO: 1217941 - protein, 9 aa, Mycobacterium
PLPHPDPVD

SEQ ID NO: 1217942 - protein, 4 aa, Mycobacterium
PLPK

SEQ ID NO: 1217943 - protein, 5 aa, Mycobacterium
PLPKD

SEQ ID NO: 1217944 - protein, 16 aa, Mycobacterium
PLPKDTVQGIPSRPEA

SEQ ID NO: 1217945 - protein, 15 aa, Mycobacterium
PLPKNTDPWASSPER

SEQ ID NO: 1217946 - protein, 4 aa, Mycobacterium
PLPP

SEQ ID NO: 1217947 - protein, 6 aa, Mycobacterium
PLPPDA

SEQ ID NO: 1217948 - protein, 7 aa, Mycobacterium
PLPPDEA

SEQ ID NO: 1217949 - protein, 6 aa, Mycobacterium
PLPPGG

SEQ ID NO: 1217950 - protein, 6 aa, Mycobacterium
PLPPGR

SEQ ID NO: 1217951 - protein, 8 aa, Mycobacterium
PLPPPADA

SEQ ID NO: 1217952 - protein, 9 aa, Mycobacterium
PLPPPADAH

SEQ ID NO: 1217953 - protein, 16 aa, Mycobacterium
PLPPPHTEPGARTPGF

SEQ ID NO: 1217954 - protein, 11 aa, Mycobacterium
PLPPRNTASEA

SEQ ID NO: 1217955 - protein, 5 aa, Mycobacterium
PLPPV

SEQ ID NO: 1217956 - protein, 27 aa, Mycobacterium
PLPPVPAVPASAPAPVPAAAPLPPPVA

SEQ ID NO: 1217957 - protein, 16 aa, Mycobacterium
PLPQAADPVEEPDTRA

SEQ ID NO: 1217958 - protein, 10 aa, Mycobacterium
PLPQGDPLPQ

SEQ ID NO: 1217959 - protein, 8 aa, Mycobacterium
PLPRADKV

SEQ ID NO: 1217960 - protein, 5 aa, Mycobacterium
PLPRD

SEQ ID NO: 1217961 - protein, 8 aa, Mycobacterium
PLPSFTPG

SEQ ID NO: 1217962 - protein, 12 aa, Mycobacterium
PLPSGEPSWTDG

SEQ ID NO: 1217963 - protein, 6 aa, Mycobacterium
PLPSRT

SEQ ID NO: 1217964 - protein, 15 aa, Mycobacterium
PLPSTDDYPPGKPRY

SEQ ID NO: 1217965 - protein, 19 aa, Mycobacterium
PLPTGADNPNGTTVDERTY

SEQ ID NO: 1217966 - protein, 25 aa, Mycobacterium
PLQAPSPSLRSTQDRRLPPDTAAWV

SEQ ID NO: 1217967 - protein, 8 aa, Mycobacterium
PLQDPDRA

SEQ ID NO: 1217968 - protein, 7 aa, Mycobacterium
PLQPHGD

SEQ ID NO: 1217969 - protein, 7 aa, Mycobacterium
PLQPISD

SEQ ID NO: 1217970 - protein, 8 aa, Mycobacterium
PLQPRADR

SEQ ID NO: 1217971 - protein, 7 aa, Mycobacterium
PLQPTTH

SEQ ID NO: 1217972 - protein, 7 aa, Mycobacterium
PLQQPHP

SEQ ID NO: 1217973 - protein, 7 aa, Mycobacterium
PLQSPHP

SEQ ID NO: 1217974 - protein, 10 aa, Mycobacterium
PLQSRSLQRN

SEQ ID NO: 1217975 - protein, 5 aa, Mycobacterium
PLRAP

SEQ ID NO: 1217976 - protein, 19 aa, Mycobacterium
PLRAPSKCQQDDTDKEDAM

SEQ ID NO: 1217977 - protein, 4 aa, Mycobacterium
PLRD

SEQ ID NO: 1217978 - protein, 14 aa, Mycobacterium
PLRDDAGKARRSAV

SEQ ID NO: 1217979 - protein, 8 aa, Mycobacterium
PLRDDDGR

SEQ ID NO: 1217980 - protein, 9 aa, Mycobacterium
PLRDEGRHY

SEQ ID NO: 1217981 - protein, 12 aa, Mycobacterium
PLRDKRDKRMPR

SEQ ID NO: 1217982 - protein, 14 aa, Mycobacterium
PLRPAARVNPGPRY

SEQ ID NO: 1217983 - protein, 10 aa, Mycobacterium
PLRPASTPEA

SEQ ID NO: 1217984 - protein, 6 aa, Mycobacterium
PLRPDA

SEQ ID NO: 1217985 - protein, 7 aa, Mycobacterium
PLRPEAA

SEQ ID NO: 1217986 - protein, 6 aa, Mycobacterium
PLRPTD

SEQ ID NO: 1217987 - protein, 4 aa, Mycobacterium
PLRR

SEQ ID NO: 1217988 - protein, 10 aa, Mycobacterium
PLRTANRSEE

SEQ ID NO: 1217989 - protein, 12 aa, Mycobacterium
PLRTRGPVADGP

SEQ ID NO: 1217990 - protein, 9 aa, Mycobacterium
PLRTRSEAH

SEQ ID NO: 1217991 - protein, 5 aa, Mycobacterium
PLSAT

SEQ ID NO: 1217992 - protein, 15 aa, Mycobacterium
PLSDDGDAAHPTVPE

SEQ ID NO: 1217993 - protein, 12 aa, Mycobacterium
PLSDPASTPPLE

SEQ ID NO: 1217994 - protein, 4 aa, Mycobacterium
PLSE

SEQ ID NO: 1217995 - protein, 10 aa, Mycobacterium
PLSGDALQES

SEQ ID NO: 1217996 - protein, 7 aa, Mycobacterium
PLSGGTG

SEQ ID NO: 1217997 - protein, 14 aa, Mycobacterium
PLSGHGNAPHATER

SEQ ID NO: 1217998 - protein, 8 aa, Mycobacterium
PLSGIGPD

SEQ ID NO: 1217999 - protein, 8 aa, Mycobacterium
PLSGRSGG

SEQ ID NO: 1218000 - protein, 6 aa, Mycobacterium
PLSGYR

SEQ ID NO: 1218001 - protein, 4 aa, Mycobacterium
PLSP

SEQ ID NO: 1218002 - protein, 7 aa, Mycobacterium
PLSPRGV

SEQ ID NO: 1218003 - protein, 5 aa, Mycobacterium
PLSPY

SEQ ID NO: 1218004 - protein, 4 aa, Mycobacterium
PLSR

SEQ ID NO: 1218005 - protein, 6 aa, Mycobacterium
PLSRGA

SEQ ID NO: 1218006 - protein, 10 aa, Mycobacterium
PLSSPLKPNI

SEQ ID NO: 1218007 - protein, 9 aa, Mycobacterium
PLSTPRPLG

SEQ ID NO: 1218008 - protein, 10 aa, Mycobacterium
PLTADEATRR

SEQ ID NO: 1218009 - protein, 7 aa, Mycobacterium
PLTAGSG

SEQ ID NO: 1218010 - protein, 9 aa, Mycobacterium
PLTDGQPGI

SEQ ID NO: 1218011 - protein, 10 aa, Mycobacterium
PLTKGEAAER

SEQ ID NO: 1218012 - protein, 8 aa, Mycobacterium
PLTNASSA

SEQ ID NO: 1218013 - protein, 11 aa, Mycobacterium
PLTPATVETPA

SEQ ID NO: 1218014 - protein, 7 aa, Mycobacterium
PLTPGSD

SEQ ID NO: 1218015 - protein, 6 aa, Mycobacterium
PLTQRD

SEQ ID NO: 1218016 - protein, 5 aa, Mycobacterium
PLTSG

SEQ ID NO: 1218017 - protein, 8 aa, Mycobacterium
PLTSNKDL

SEQ ID NO: 1218018 - protein, 16 aa, Mycobacterium
PLTTPDTPGGPPPNLP

SEQ ID NO: 1218019 - protein, 17 aa, Mycobacterium
PLTTPDTPGGPPPNLPV

SEQ ID NO: 1218020 - protein, 45 aa, Mycobacterium
PLTTPDTPGGTPPIAPGAPGAPVAPLAGPAPAPAPVPAPAPVLPP

SEQ ID NO: 1218021 - protein, 8 aa, Mycobacterium
PLVDGTDM

SEQ ID NO: 1218022 - protein, 9 aa, Mycobacterium
PLVDGTDMG

SEQ ID NO: 1218023 - protein, 6 aa, Mycobacterium
PLVGRD

SEQ ID NO: 1218024 - protein, 11 aa, Mycobacterium
PLVGSAAANKG

SEQ ID NO: 1218025 - protein, 6 aa, Mycobacterium
PMADAG

SEQ ID NO: 1218026 - protein, 7 aa, Mycobacterium
PMANGGM

SEQ ID NO: 1218027 - protein, 12 aa, Mycobacterium
PMARAGRAGELS

SEQ ID NO: 1218028 - protein, 5 aa, Mycobacterium
PMDAT

SEQ ID NO: 1218029 - protein, 4 aa, Mycobacterium
PMDT

SEQ ID NO: 1218030 - protein, 12 aa, Mycobacterium
PMESEMDRRRAR

SEQ ID NO: 1218031 - protein, 19 aa, Mycobacterium
PMGGWKSSGIGARFGGPEG

SEQ ID NO: 1218032 - protein, 5 aa, Mycobacterium
PMGQA

SEQ ID NO: 1218033 - protein, 11 aa, Mycobacterium
PMGRPTKVDGG

SEQ ID NO: 1218034 - protein, 4 aa, Mycobacterium
PMGS

SEQ ID NO: 1218035 - protein, 17 aa, Mycobacterium
PMGSDGGAWAGDPETNY

SEQ ID NO: 1218036 - protein, 19 aa, Mycobacterium
PMGSDGGAWANDPKTNLTT

SEQ ID NO: 1218037 - protein, 6 aa, Mycobacterium
PMGSTD

SEQ ID NO: 1218038 - protein, 11 aa, Mycobacterium
PMLPTTKASID

SEQ ID NO: 1218039 - protein, 10 aa, Mycobacterium
PMPAGPDPGR

SEQ ID NO: 1218040 - protein, 15 aa, Mycobacterium
PMPATLGKSNNYPRS

SEQ ID NO: 1218041 - protein, 4 aa, Mycobacterium
PMPD

SEQ ID NO: 1218042 - protein, 5 aa, Mycobacterium
PMPGG

SEQ ID NO: 1218043 - protein, 12 aa, Mycobacterium
PMSGAAGGNASA

SEQ ID NO: 1218044 - protein, 9 aa, Mycobacterium
PMSPEPARF

SEQ ID NO: 1218045 - protein, 8 aa, Mycobacterium
PMSSGWES

SEQ ID NO: 1218046 - protein, 11 aa, Mycobacterium
PMTEGGALPPT

SEQ ID NO: 1218047 - protein, 4 aa, Mycobacterium
PMTG

SEQ ID NO: 1218048 - protein, 9 aa, Mycobacterium
PMTGANEPF

SEQ ID NO: 1218049 - protein, 10 aa, Mycobacterium
PNADGAKVTT

SEQ ID NO: 1218050 - protein, 7 aa, Mycobacterium
PNADNQV

SEQ ID NO: 1218051 - protein, 4 aa, Mycobacterium
PNAE

SEQ ID NO: 1218052 - protein, 5 aa, Mycobacterium
PNAHT

SEQ ID NO: 1218053 - protein, 15 aa, Mycobacterium
PNALRGRSTSSGNVL

SEQ ID NO: 1218054 - protein, 12 aa, Mycobacterium
PNALSTKGHPEG

SEQ ID NO: 1218055 - protein, 7 aa, Mycobacterium
PNANDYH

SEQ ID NO: 1218056 - protein, 8 aa, Mycobacterium
PNANPINS

SEQ ID NO: 1218057 - protein, 9 aa, Mycobacterium
PNAQKRKEG

SEQ ID NO: 1218058 - protein, 5 aa, Mycobacterium
PNARQ

SEQ ID NO: 1218059 - protein, 8 aa, Mycobacterium
PNARSGEL

SEQ ID NO: 1218060 - protein, 5 aa, Mycobacterium
PNATE

SEQ ID NO: 1218061 - protein, 10 aa, Mycobacterium
PNATKAKALY

SEQ ID NO: 1218062 - protein, 5 aa, Mycobacterium
PNATV

SEQ ID NO: 1218063 - protein, 19 aa, Mycobacterium
PNATVPEQHSHGHGHGHGH

SEQ ID NO: 1218064 - protein, 4 aa, Mycobacterium
PNDA

SEQ ID NO: 1218065 - protein, 9 aa, Mycobacterium
PNDEPEAGK

SEQ ID NO: 1218066 - protein, 4 aa, Mycobacterium
PNDG

SEQ ID NO: 1218067 - protein, 6 aa, Mycobacterium
PNDPGG

SEQ ID NO: 1218068 - protein, 15 aa, Mycobacterium
PNEDAEVSKEIEKQY

SEQ ID NO: 1218069 - protein, 5 aa, Mycobacterium
PNEGA

SEQ ID NO: 1218070 - protein, 10 aa, Mycobacterium
PNEVAPRRKP

SEQ ID NO: 1218071 - protein, 5 aa, Mycobacterium
PNFAA

SEQ ID NO: 1218072 - protein, 10 aa, Mycobacterium
PNGAGKTTTV

SEQ ID NO: 1218073 - protein, 7 aa, Mycobacterium
PNGDELA

SEQ ID NO: 1218074 - protein, 11 aa, Mycobacterium
PNGLGPKGFVG

SEQ ID NO: 1218075 - protein, 7 aa, Mycobacterium
PNGPAGR

SEQ ID NO: 1218076 - protein, 4 aa, Mycobacterium
PNGR

SEQ ID NO: 1218077 - protein, 8 aa, Mycobacterium
PNGRPVGK

SEQ ID NO: 1218078 - protein, 10 aa, Mycobacterium
PNIDYDRSEV

SEQ ID NO: 1218079 - protein, 5 aa, Mycobacterium
PNIEN

SEQ ID NO: 1218080 - protein, 15 aa, Mycobacterium
PNIETKELKKGQTVR

SEQ ID NO: 1218081 - protein, 5 aa, Mycobacterium
PNIGG

SEQ ID NO: 1218082 - protein, 11 aa, Mycobacterium
PNKGALSESAA

SEQ ID NO: 1218083 - protein, 17 aa, Mycobacterium
PNKGEEDLRPAQGEGYR

SEQ ID NO: 1218084 - protein, 4 aa, Mycobacterium
PNLG

SEQ ID NO: 1218085 - protein, 4 aa, Mycobacterium
PNLN

SEQ ID NO: 1218086 - protein, 7 aa, Mycobacterium
PNLPADG

SEQ ID NO: 1218087 - protein, 6 aa, Mycobacterium
PNLRPQ

SEQ ID NO: 1218088 - protein, 8 aa, Mycobacterium
PNNDLSRL

SEQ ID NO: 1218089 - protein, 10 aa, Mycobacterium
PNNITGKGPI

SEQ ID NO: 1218090 - protein, 8 aa, Mycobacterium
PNNPIPEG

SEQ ID NO: 1218091 - protein, 27 aa, Mycobacterium
PNNYAEPPRYPAPHADAPIEESLTDED

SEQ ID NO: 1218092 - protein, 4 aa, Mycobacterium
PNPA

SEQ ID NO: 1218093 - protein, 14 aa, Mycobacterium
PNPAGTDETERTDQ

SEQ ID NO: 1218094 - protein, 11 aa, Mycobacterium
PNPDNEPIPGP

SEQ ID NO: 1218095 - protein, 9 aa, Mycobacterium
PNPEEPGAS

SEQ ID NO: 1218096 - protein, 7 aa, Mycobacterium
PNPNDPN

SEQ ID NO: 1218097 - protein, 5 aa, Mycobacterium
PNPRA

SEQ ID NO: 1218098 - protein, 12 aa, Mycobacterium
PNPRAEADENEL

SEQ ID NO: 1218099 - protein, 15 aa, Mycobacterium
PNPTGEQHVAYLKRP

SEQ ID NO: 1218100 - protein, 14 aa, Mycobacterium
PNPWPTSPQMSTDA

SEQ ID NO: 1218101 - protein, 4 aa, Mycobacterium
PNRL

SEQ ID NO: 1218102 - protein, 9 aa, Mycobacterium
PNRPDERWP

SEQ ID NO: 1218103 - protein, 7 aa, Mycobacterium
PNRPDGG

SEQ ID NO: 1218104 - protein, 5 aa, Mycobacterium
PNSAK

SEQ ID NO: 1218105 - protein, 5 aa, Mycobacterium
PNSDA

SEQ ID NO: 1218106 - protein, 10 aa, Mycobacterium
PNSKALESAL

SEQ ID NO: 1218107 - protein, 5 aa, Mycobacterium
PNTLN

SEQ ID NO: 1218108 - protein, 6 aa, Mycobacterium
PNTPGA

SEQ ID NO: 1218109 - protein, 11 aa, Mycobacterium
PNTPIQLPADA

SEQ ID NO: 1218110 - protein, 7 aa, Mycobacterium
PNTSSNI

SEQ ID NO: 1218111 - protein, 12 aa, Mycobacterium
PNVPALPGRGPQ

SEQ ID NO: 1218112 - protein, 9 aa, Mycobacterium
PNWPQPGST

SEQ ID NO: 1218113 - protein, 10 aa, Mycobacterium
PNYDRRPGSL

SEQ ID NO: 1218114 - protein, 10 aa, Mycobacterium
PNYNKGREAF

SEQ ID NO: 1218115 - protein, 4 aa, Mycobacterium
PNYP

SEQ ID NO: 1218116 - protein, 16 aa, Mycobacterium
PNYSVPAGNRPLSADE

SEQ ID NO: 1218117 - protein, 16 aa, Mycobacterium
PNYSVPAGNRPLTDDD

SEQ ID NO: 1218118 - protein, 12 aa, Mycobacterium
PPAADPDRDNGM

SEQ ID NO: 1218119 - protein, 13 aa, Mycobacterium
PPAADPGVTDEER

SEQ ID NO: 1218120 - protein, 11 aa, Mycobacterium
PPAAKAAETRE

SEQ ID NO: 1218121 - protein, 7 aa, Mycobacterium
PPAAQAA

SEQ ID NO: 1218122 - protein, 10 aa, Mycobacterium
PPAARASAAR

SEQ ID NO: 1218123 - protein, 8 aa, Mycobacterium
PPAATEHE

SEQ ID NO: 1218124 - protein, 5 aa, Mycobacterium
PPADE

SEQ ID NO: 1218125 - protein, 13 aa, Mycobacterium
PPADPADGIAEAS

SEQ ID NO: 1218126 - protein, 6 aa, Mycobacterium
PPAGEA

SEQ ID NO: 1218127 - protein, 7 aa, Mycobacterium
PPAGTLT

SEQ ID NO: 1218128 - protein, 16 aa, Mycobacterium
PPAGVSTQTVNPSRPV

SEQ ID NO: 1218129 - protein, 5 aa, Mycobacterium
PPAHA

SEQ ID NO: 1218130 - protein, 8 aa, Mycobacterium
PPAHGEAA

SEQ ID NO: 1218131 - protein, 10 aa, Mycobacterium
PPALAHSSSR

SEQ ID NO: 1218132 - protein, 19 aa, Mycobacterium
PPALPTDHPRTGRSRRAAG

SEQ ID NO: 1218133 - protein, 7 aa, Mycobacterium
PPANNAN

SEQ ID NO: 1218134 - protein, 5 aa, Mycobacterium
PPAPA

SEQ ID NO: 1218135 - protein, 5 aa, Mycobacterium
PPAPL

SEQ ID NO: 1218136 - protein, 21 aa, Mycobacterium
PPAPLGPDPAACRRNPRRAPH

SEQ ID NO: 1218137 - protein, 8 aa, Mycobacterium
PPAPPPVL

SEQ ID NO: 1218138 - protein, 19 aa, Mycobacterium
PPAPTGDAAADRDATREEG

SEQ ID NO: 1218139 - protein, 13 aa, Mycobacterium
PPAPTGSGTLDAD

SEQ ID NO: 1218140 - protein, 6 aa, Mycobacterium
PPAPVK

SEQ ID NO: 1218141 - protein, 4 aa, Mycobacterium
PPAQ

SEQ ID NO: 1218142 - protein, 4 aa, Mycobacterium
PPAR

SEQ ID NO: 1218143 - protein, 12 aa, Mycobacterium
PPARRDEAAPDA

SEQ ID NO: 1218144 - protein, 23 aa, Mycobacterium
PPARRPETNGRRRGHLRVLPDPT

SEQ ID NO: 1218145 - protein, 17 aa, Mycobacterium
PPASPDSTVNVPPTSPA

SEQ ID NO: 1218146 - protein, 4 aa, Mycobacterium
PPAT

SEQ ID NO: 1218147 - protein, 14 aa, Mycobacterium
PPATADLEPPADDS

SEQ ID NO: 1218148 - protein, 10 aa, Mycobacterium
PPATDSEAAQ

SEQ ID NO: 1218149 - protein, 6 aa, Mycobacterium
PPATTP

SEQ ID NO: 1218150 - protein, 5 aa, Mycobacterium
PPATV

SEQ ID NO: 1218151 - protein, 8 aa, Mycobacterium
PPDAEART

SEQ ID NO: 1218152 - protein, 11 aa, Mycobacterium
PPDAGLRTDEP

SEQ ID NO: 1218153 - protein, 7 aa, Mycobacterium
PPDAHPV

SEQ ID NO: 1218154 - protein, 6 aa, Mycobacterium
PPDAQD

SEQ ID NO: 1218155 - protein, 8 aa, Mycobacterium
PPDARSIR

SEQ ID NO: 1218156 - protein, 17 aa, Mycobacterium
PPDDDVSSAVATAVAMV

SEQ ID NO: 1218157 - protein, 5 aa, Mycobacterium
PPDDL

SEQ ID NO: 1218158 - protein, 7 aa, Mycobacterium
PPDDPRI

SEQ ID NO: 1218159 - protein, 9 aa, Mycobacterium
PPDDTAAAV

SEQ ID NO: 1218160 - protein, 54 aa, Mycobacterium
PPDEPEPQGHNDTEAEIESAGSAQGNPRGDETNGPRPTDDAGKPGGPAPPGDQA

SEQ ID NO: 1218161 - protein, 11 aa, Mycobacterium
PPDGPDGTWGR

SEQ ID NO: 1218162 - protein, 8 aa, Mycobacterium
PPDGSPLR

SEQ ID NO: 1218163 - protein, 5 aa, Mycobacterium
PPDHT

SEQ ID NO: 1218164 - protein, 5 aa, Mycobacterium
PPDID

SEQ ID NO: 1218165 - protein, 6 aa, Mycobacterium
PPDPSS

SEQ ID NO: 1218166 - protein, 10 aa, Mycobacterium
PPDQIKSAGF

SEQ ID NO: 1218167 - protein, 5 aa, Mycobacterium
PPDRA

SEQ ID NO: 1218168 - protein, 5 aa, Mycobacterium
PPDRV

SEQ ID NO: 1218169 - protein, 8 aa, Mycobacterium
PPDRYSAA

SEQ ID NO: 1218170 - protein, 4 aa, Mycobacterium
PPDT

SEQ ID NO: 1218171 - protein, 10 aa, Mycobacterium
PPDTELSPMN

SEQ ID NO: 1218172 - protein, 5 aa, Mycobacterium
PPDTL

SEQ ID NO: 1218173 - protein, 5 aa, Mycobacterium
PPDVG

SEQ ID NO: 1218174 - protein, 16 aa, Mycobacterium
PPDWSGGGALAPEERA

SEQ ID NO: 1218175 - protein, 5 aa, Mycobacterium
PPDYT

SEQ ID NO: 1218176 - protein, 16 aa, Mycobacterium
PPEAAAGSRAQDIASD

SEQ ID NO: 1218177 - protein, 8 aa, Mycobacterium
PPEADHDV

SEQ ID NO: 1218178 - protein, 7 aa, Mycobacterium
PPEAIGP

SEQ ID NO: 1218179 - protein, 4 aa, Mycobacterium
PPEC

SEQ ID NO: 1218180 - protein, 5 aa, Mycobacterium
PPEGP

SEQ ID NO: 1218181 - protein, 13 aa, Mycobacterium
PPEGVTNPPNDTS

SEQ ID NO: 1218182 - protein, 10 aa, Mycobacterium
PPEHPDTSKG

SEQ ID NO: 1218183 - protein, 5 aa, Mycobacterium
PPEHR

SEQ ID NO: 1218184 - protein, 12 aa, Mycobacterium
PPERLNKAGPAP

SEQ ID NO: 1218185 - protein, 13 aa, Mycobacterium
PPERLNKATPAPF

SEQ ID NO: 1218186 - protein, 6 aa, Mycobacterium
PPERSL

SEQ ID NO: 1218187 - protein, 8 aa, Mycobacterium
PPESLEEA

SEQ ID NO: 1218188 - protein, 9 aa, Mycobacterium
PPETELSPV

SEQ ID NO: 1218189 - protein, 7 aa, Mycobacterium
PPETVDD

SEQ ID NO: 1218190 - protein, 4 aa, Mycobacterium
PPEV

SEQ ID NO: 1218191 - protein, 10 aa, Mycobacterium
PPEYPGDEPM

SEQ ID NO: 1218192 - protein, 4 aa, Mycobacterium
PPFA

SEQ ID NO: 1218193 - protein, 14 aa, Mycobacterium
PPFDEAPETGATFE

SEQ ID NO: 1218194 - protein, 16 aa, Mycobacterium
PPFHGPKERSADETAD

SEQ ID NO: 1218195 - protein, 6 aa, Mycobacterium
PPFPPS

SEQ ID NO: 1218196 - protein, 4 aa, Mycobacterium
PPGA

SEQ ID NO: 1218197 - protein, 5 aa, Mycobacterium
PPGAI

SEQ ID NO: 1218198 - protein, 14 aa, Mycobacterium
PPGAYGAAHAETEA

SEQ ID NO: 1218199 - protein, 13 aa, Mycobacterium
PPGCGADADSASE

SEQ ID NO: 1218200 - protein, 7 aa, Mycobacterium
PPGDDEV

SEQ ID NO: 1218201 - protein, 6 aa, Mycobacterium
PPGEIG

SEQ ID NO: 1218202 - protein, 11 aa, Mycobacterium
PPGFGTPLPDG

SEQ ID NO: 1218203 - protein, 4 aa, Mycobacterium
PPGG

SEQ ID NO: 1218204 - protein, 19 aa, Mycobacterium
PPGGAGAIYPTPSHRRSSV

SEQ ID NO: 1218205 - protein, 7 aa, Mycobacterium
PPGGGRF

SEQ ID NO: 1218206 - protein, 5 aa, Mycobacterium
PPGGH

SEQ ID NO: 1218207 - protein, 6 aa, Mycobacterium
PPGHAD

SEQ ID NO: 1218208 - protein, 7 aa, Mycobacterium
PPGHPPA

SEQ ID NO: 1218209 - protein, 9 aa, Mycobacterium
PPGHPSTPS

SEQ ID NO: 1218210 - protein, 8 aa, Mycobacterium
PPGIGATG

SEQ ID NO: 1218211 - protein, 9 aa, Mycobacterium
PPGNADALG

SEQ ID NO: 1218212 - protein, 9 aa, Mycobacterium
PPGNTPPKG

SEQ ID NO: 1218213 - protein, 5 aa, Mycobacterium
PPGPA

SEQ ID NO: 1218214 - protein, 7 aa, Mycobacterium
PPGPQVG

SEQ ID NO: 1218215 - protein, 7 aa, Mycobacterium
PPGPRFG

SEQ ID NO: 1218216 - protein, 6 aa, Mycobacterium
PPGPRI

SEQ ID NO: 1218217 - protein, 5 aa, Mycobacterium
PPGQA

SEQ ID NO: 1218218 - protein, 7 aa, Mycobacterium
PPGQPAL

SEQ ID NO: 1218219 - protein, 6 aa, Mycobacterium
PPGQPM

SEQ ID NO: 1218220 - protein, 17 aa, Mycobacterium
PPGSAGAPPHRHPGGPA

SEQ ID NO: 1218221 - protein, 11 aa, Mycobacterium
PPGSAPAPGRI

SEQ ID NO: 1218222 - protein, 5 aa, Mycobacterium
PPGSL

SEQ ID NO: 1218223 - protein, 9 aa, Mycobacterium
PPGSSDSVD

SEQ ID NO: 1218224 - protein, 6 aa, Mycobacterium
PPGTGD

SEQ ID NO: 1218225 - protein, 9 aa, Mycobacterium
PPGTGKTSF

SEQ ID NO: 1218226 - protein, 5 aa, Mycobacterium
PPGTL

SEQ ID NO: 1218227 - protein, 11 aa, Mycobacterium
PPGTPGLSQGQ

SEQ ID NO: 1218228 - protein, 7 aa, Mycobacterium
PPGTRPD

SEQ ID NO: 1218229 - protein, 11 aa, Mycobacterium
PPGVASNTVQD

SEQ ID NO: 1218230 - protein, 9 aa, Mycobacterium
PPGVEDGQR

SEQ ID NO: 1218231 - protein, 6 aa, Mycobacterium
PPGVGK

SEQ ID NO: 1218232 - protein, 14 aa, Mycobacterium
PPGVGKSDVTYQTA

SEQ ID NO: 1218233 - protein, 5 aa, Mycobacterium
PPHDG

SEQ ID NO: 1218234 - protein, 4 aa, Mycobacterium
PPHS

SEQ ID NO: 1218235 - protein, 14 aa, Mycobacterium
PPIPPPPPTATSQL

SEQ ID NO: 1218236 - protein, 11 aa, Mycobacterium
PPIPRKDSLPL

SEQ ID NO: 1218237 - protein, 6 aa, Mycobacterium
PPKAAK

SEQ ID NO: 1218238 - protein, 49 aa, Mycobacterium
PPKAQQAIKEDLENTGGGSQVQDYPDESTTRHRHHEDDAPTASIPVARE

SEQ ID NO: 1218239 - protein, 26 aa, Mycobacterium
PPKKAVPAAPTRTASGSVAVKGARAK

SEQ ID NO: 1218240 - protein, 5 aa, Mycobacterium
PPKPS

SEQ ID NO: 1218241 - protein, 9 aa, Mycobacterium
PPKQTTSDG

SEQ ID NO: 1218242 - protein, 13 aa, Mycobacterium
PPKVSSAEQSNTS

SEQ ID NO: 1218243 - protein, 4 aa, Mycobacterium
PPLD

SEQ ID NO: 1218244 - protein, 6 aa, Mycobacterium
PPLEEY

SEQ ID NO: 1218245 - protein, 5 aa, Mycobacterium
PPLGD

SEQ ID NO: 1218246 - protein, 10 aa, Mycobacterium
PPLGPEAPPL

SEQ ID NO: 1218247 - protein, 12 aa, Mycobacterium
PPLPADEERSEG

SEQ ID NO: 1218248 - protein, 23 aa, Mycobacterium
PPLPESRLPPPSTLAGSPWNHPA

SEQ ID NO: 1218249 - protein, 5 aa, Mycobacterium
PPLPG

SEQ ID NO: 1218250 - protein, 6 aa, Mycobacterium
PPLPGG

SEQ ID NO: 1218251 - protein, 16 aa, Mycobacterium
PPLPTPTDLPDEYTDE

SEQ ID NO: 1218252 - protein, 14 aa, Mycobacterium
PPLRESETNPLQGG

SEQ ID NO: 1218253 - protein, 13 aa, Mycobacterium
PPLRGPSLTPVSS

SEQ ID NO: 1218254 - protein, 9 aa, Mycobacterium
PPLRTPPDM

SEQ ID NO: 1218255 - protein, 11 aa, Mycobacterium
PPLSGVPEPLA

SEQ ID NO: 1218256 - protein, 4 aa, Mycobacterium
PPLV

SEQ ID NO: 1218257 - protein, 14 aa, Mycobacterium
PPMPAPAQPDEPGL

SEQ ID NO: 1218258 - protein, 5 aa, Mycobacterium
PPNGC

SEQ ID NO: 1218259 - protein, 5 aa, Mycobacterium
PPNGT

SEQ ID NO: 1218260 - protein, 13 aa, Mycobacterium
PPNPTADGPFTQH

SEQ ID NO: 1218261 - protein, 6 aa, Mycobacterium
PPPAEF

SEQ ID NO: 1218262 - protein, 22 aa, Mycobacterium
PPPAGSASLPEPPAGVPPGGGT

SEQ ID NO: 1218263 - protein, 7 aa, Mycobacterium
PPPAPQP

SEQ ID NO: 1218264 - protein, 9 aa, Mycobacterium
PPPATGPLR

SEQ ID NO: 1218265 - protein, 5 aa, Mycobacterium
PPPDF

SEQ ID NO: 1218266 - protein, 5 aa, Mycobacterium
PPPER

SEQ ID NO: 1218267 - protein, 7 aa, Mycobacterium
PPPEVDT

SEQ ID NO: 1218268 - protein, 10 aa, Mycobacterium
PPPEVTSPAA

SEQ ID NO: 1218269 - protein, 12 aa, Mycobacterium
PPPGAPSDRDKG

SEQ ID NO: 1218270 - protein, 7 aa, Mycobacterium
PPPGEYP

SEQ ID NO: 1218271 - protein, 7 aa, Mycobacterium
PPPGMSP

SEQ ID NO: 1218272 - protein, 12 aa, Mycobacterium
PPPHGRAAGPAE

SEQ ID NO: 1218273 - protein, 14 aa, Mycobacterium
PPPHPRPTSDNTMR

SEQ ID NO: 1218274 - protein, 5 aa, Mycobacterium
PPPIQ

SEQ ID NO: 1218275 - protein, 10 aa, Mycobacterium
PPPLDTGQAR

SEQ ID NO: 1218276 - protein, 5 aa, Mycobacterium
PPPLS

SEQ ID NO: 1218277 - protein, 10 aa, Mycobacterium
PPPLTTGGPP

SEQ ID NO: 1218278 - protein, 9 aa, Mycobacterium
PPPNCSSAD

SEQ ID NO: 1218279 - protein, 4 aa, Mycobacterium
PPPP

SEQ ID NO: 1218280 - protein, 17 aa, Mycobacterium
PPPPPPPAPPPPPPPPP

SEQ ID NO: 1218281 - protein, 10 aa, Mycobacterium
PPPPPSRSPH

SEQ ID NO: 1218282 - protein, 9 aa, Mycobacterium
PPPPRDRGV

SEQ ID NO: 1218283 - protein, 18 aa, Mycobacterium
PPPPVDPFAPPPAPAPVD

SEQ ID NO: 1218284 - protein, 8 aa, Mycobacterium
PPPQYPTD

SEQ ID NO: 1218285 - protein, 6 aa, Mycobacterium
PPPSRI

SEQ ID NO: 1218286 - protein, 39 aa, Mycobacterium
PPPVADEKPAPKRRTSRAKAAEVAETAEEPDSPDPQVAA

SEQ ID NO: 1218287 - protein, 5 aa, Mycobacterium
PPPVP

SEQ ID NO: 1218288 - protein, 8 aa, Mycobacterium
PPQALRSS

SEQ ID NO: 1218289 - protein, 8 aa, Mycobacterium
PPQAPPDL

SEQ ID NO: 1218290 - protein, 8 aa, Mycobacterium
PPQARPTW

SEQ ID NO: 1218291 - protein, 4 aa, Mycobacterium
PPQG

SEQ ID NO: 1218292 - protein, 6 aa, Mycobacterium
PPQGPN

SEQ ID NO: 1218293 - protein, 7 aa, Mycobacterium
PPQHTEY

SEQ ID NO: 1218294 - protein, 6 aa, Mycobacterium
PPQHTT

SEQ ID NO: 1218295 - protein, 7 aa, Mycobacterium
PPQIERG

SEQ ID NO: 1218296 - protein, 9 aa, Mycobacterium
PPQLDTGQA

SEQ ID NO: 1218297 - protein, 9 aa, Mycobacterium
PPQNPLATQ

SEQ ID NO: 1218298 - protein, 6 aa, Mycobacterium
PPQRVG

SEQ ID NO: 1218299 - protein, 6 aa, Mycobacterium
PPQSRD

SEQ ID NO: 1218300 - protein, 4 aa, Mycobacterium
PPRA

SEQ ID NO: 1218301 - protein, 7 aa, Mycobacterium
PPRADGE

SEQ ID NO: 1218302 - protein, 8 aa, Mycobacterium
PPRAEPDG

SEQ ID NO: 1218303 - protein, 7 aa, Mycobacterium
PPRAEQD

SEQ ID NO: 1218304 - protein, 7 aa, Mycobacterium
PPRAGGI

SEQ ID NO: 1218305 - protein, 22 aa, Mycobacterium
PPRAGRVEARDGFAPTADRREP

SEQ ID NO: 1218306 - protein, 6 aa, Mycobacterium
PPRDEA

SEQ ID NO: 1218307 - protein, 5 aa, Mycobacterium
PPRDF

SEQ ID NO: 1218308 - protein, 5 aa, Mycobacterium
PPREV

SEQ ID NO: 1218309 - protein, 4 aa, Mycobacterium
PPRG

SEQ ID NO: 1218310 - protein, 5 aa, Mycobacterium
PPRHD

SEQ ID NO: 1218311 - protein, 5 aa, Mycobacterium
PPRHR

SEQ ID NO: 1218312 - protein, 5 aa, Mycobacterium
PPRHT

SEQ ID NO: 1218313 - protein, 5 aa, Mycobacterium
PPRIA

SEQ ID NO: 1218314 - protein, 9 aa, Mycobacterium
PPRLDTGQA

SEQ ID NO: 1218315 - protein, 11 aa, Mycobacterium
PPRPDGQPTFN

SEQ ID NO: 1218316 - protein, 12 aa, Mycobacterium
PPRPRRHLPPAT

SEQ ID NO: 1218317 - protein, 6 aa, Mycobacterium
PPRRGG

SEQ ID NO: 1218318 - protein, 16 aa, Mycobacterium
PPRRQPPKSVPPLRRP

SEQ ID NO: 1218319 - protein, 5 aa, Mycobacterium
PPRSG

SEQ ID NO: 1218320 - protein, 19 aa, Mycobacterium
PPRSGHRKGGVEKSNHTAA

SEQ ID NO: 1218321 - protein, 8 aa, Mycobacterium
PPRSGVEQ

SEQ ID NO: 1218322 - protein, 5 aa, Mycobacterium
PPRSL

SEQ ID NO: 1218323 - protein, 17 aa, Mycobacterium
PPRSVPRAGRFPTGPVS

SEQ ID NO: 1218324 - protein, 8 aa, Mycobacterium
PPRTGKSV

SEQ ID NO: 1218325 - protein, 5 aa, Mycobacterium
PPRTV

SEQ ID NO: 1218326 - protein, 26 aa, Mycobacterium
PPSAPVTSAAASTCPTAAPADGEPEW

SEQ ID NO: 1218327 - protein, 9 aa, Mycobacterium
PPSARPPGN

SEQ ID NO: 1218328 - protein, 10 aa, Mycobacterium
PPSEVQSPPV

SEQ ID NO: 1218329 - protein, 4 aa, Mycobacterium
PPSL

SEQ ID NO: 1218330 - protein, 10 aa, Mycobacterium
PPSLDTGQAR

SEQ ID NO: 1218331 - protein, 11 aa, Mycobacterium
PPSLEGEAAEA

SEQ ID NO: 1218332 - protein, 7 aa, Mycobacterium
PPSPPIE

SEQ ID NO: 1218333 - protein, 6 aa, Mycobacterium
PPSQAS

SEQ ID NO: 1218334 - protein, 11 aa, Mycobacterium
PPSRRAPSDVN

SEQ ID NO: 1218335 - protein, 7 aa, Mycobacterium
PPSSGTV

SEQ ID NO: 1218336 - protein, 124 aa, Mycobacterium
PPSSPQVDATDQTGVDNDEEPGTADDVDDEEVGEDLAPEEADPSASEDTDVDSDEELPGSSGGSGESPGGSDSTPDEQQAADPDVTAPDSEQVDSSPDETVVSTPEDDGAEEGPALDDAHPQGD

SEQ ID NO: 1218337 - protein, 8 aa, Mycobacterium
PPSTDPPV

SEQ ID NO: 1218338 - protein, 13 aa, Mycobacterium
PPSTPDDLAETAR

SEQ ID NO: 1218339 - protein, 8 aa, Mycobacterium
PPSTRTGK

SEQ ID NO: 1218340 - protein, 6 aa, Mycobacterium
PPTAAH

SEQ ID NO: 1218341 - protein, 7 aa, Mycobacterium
PPTAGEI

SEQ ID NO: 1218342 - protein, 5 aa, Mycobacterium
PPTDR

SEQ ID NO: 1218343 - protein, 12 aa, Mycobacterium
PPTDVRPAGKLR

SEQ ID NO: 1218344 - protein, 6 aa, Mycobacterium
PPTGSP

SEQ ID NO: 1218345 - protein, 8 aa, Mycobacterium
PPTHTDEG

SEQ ID NO: 1218346 - protein, 10 aa, Mycobacterium
PPTHTSEGLD

SEQ ID NO: 1218347 - protein, 4 aa, Mycobacterium
PPTI

SEQ ID NO: 1218348 - protein, 5 aa, Mycobacterium
PPTID

SEQ ID NO: 1218349 - protein, 10 aa, Mycobacterium
PPTLTNTEGD

SEQ ID NO: 1218350 - protein, 6 aa, Mycobacterium
PPTNIN

SEQ ID NO: 1218351 - protein, 4 aa, Mycobacterium
PPTP

SEQ ID NO: 1218352 - protein, 6 aa, Mycobacterium
PPTQHR

SEQ ID NO: 1218353 - protein, 15 aa, Mycobacterium
PPTSGAYSAAKAAGW

SEQ ID NO: 1218354 - protein, 9 aa, Mycobacterium
PPTSTPTGR

SEQ ID NO: 1218355 - protein, 5 aa, Mycobacterium
PPTTA

SEQ ID NO: 1218356 - protein, 4 aa, Mycobacterium
PPVA

SEQ ID NO: 1218357 - protein, 11 aa, Mycobacterium
PPVATAGHSQG

SEQ ID NO: 1218358 - protein, 12 aa, Mycobacterium
PPVDDPAALTRR

SEQ ID NO: 1218359 - protein, 5 aa, Mycobacterium
PPVEF

SEQ ID NO: 1218360 - protein, 4 aa, Mycobacterium
PPVG

SEQ ID NO: 1218361 - protein, 32 aa, Mycobacterium
PPVGESPTGRLQPGASVPIDRTSTYPSTEQTL

SEQ ID NO: 1218362 - protein, 15 aa, Mycobacterium
PPVGPGPSSSPEGAA

SEQ ID NO: 1218363 - protein, 4 aa, Mycobacterium
PPVP

SEQ ID NO: 1218364 - protein, 9 aa, Mycobacterium
PPVPADYDP

SEQ ID NO: 1218365 - protein, 5 aa, Mycobacterium
PPVPE

SEQ ID NO: 1218366 - protein, 8 aa, Mycobacterium
PPVPESAP

SEQ ID NO: 1218367 - protein, 5 aa, Mycobacterium
PPVPN

SEQ ID NO: 1218368 - protein, 5 aa, Mycobacterium
PPVSC

SEQ ID NO: 1218369 - protein, 5 aa, Mycobacterium
PPVSG

SEQ ID NO: 1218370 - protein, 5 aa, Mycobacterium
PPVTV

SEQ ID NO: 1218371 - protein, 11 aa, Mycobacterium
PPWENSPIGRN

SEQ ID NO: 1218372 - protein, 12 aa, Mycobacterium
PPWGKRGYNEKA

SEQ ID NO: 1218373 - protein, 7 aa, Mycobacterium
PPWPSAG

SEQ ID NO: 1218374 - protein, 5 aa, Mycobacterium
PPYDH

SEQ ID NO: 1218375 - protein, 6 aa, Mycobacterium
PPYEVD

SEQ ID NO: 1218376 - protein, 19 aa, Mycobacterium
PPYSDRSQRAQFESEQAER

SEQ ID NO: 1218377 - protein, 10 aa, Mycobacterium
PPYSQEADRV

SEQ ID NO: 1218378 - protein, 4 aa, Mycobacterium
PPYT

SEQ ID NO: 1218379 - protein, 7 aa, Mycobacterium
PPYTGGS

SEQ ID NO: 1218380 - protein, 8 aa, Mycobacterium
PQAADAAV

SEQ ID NO: 1218381 - protein, 23 aa, Mycobacterium
PQAAPADSGTAAAVIDDDQRRVT

SEQ ID NO: 1218382 - protein, 7 aa, Mycobacterium
PQACEGA

SEQ ID NO: 1218383 - protein, 12 aa, Mycobacterium
PQADAYDYANGQ

SEQ ID NO: 1218384 - protein, 8 aa, Mycobacterium
PQADGGTI

SEQ ID NO: 1218385 - protein, 16 aa, Mycobacterium
PQAGPDPAVTQTLKGG

SEQ ID NO: 1218386 - protein, 13 aa, Mycobacterium
PQAKELAEAKTEH

SEQ ID NO: 1218387 - protein, 6 aa, Mycobacterium
PQAPFD

SEQ ID NO: 1218388 - protein, 51 aa, Mycobacterium
PQAPPVGARHEQQRSAPPPAPRPAPAPPPSQFYGEPTDQRQPTAPTSAAAM

SEQ ID NO: 1218389 - protein, 12 aa, Mycobacterium
PQARELAEAKTE

SEQ ID NO: 1218390 - protein, 12 aa, Mycobacterium
PQARNAVDGPTA

SEQ ID NO: 1218391 - protein, 10 aa, Mycobacterium
PQATGGNYSQ

SEQ ID NO: 1218392 - protein, 11 aa, Mycobacterium
PQDATRGERTR

SEQ ID NO: 1218393 - protein, 5 aa, Mycobacterium
PQDIT

SEQ ID NO: 1218394 - protein, 9 aa, Mycobacterium
PQDPKEGDL

SEQ ID NO: 1218395 - protein, 9 aa, Mycobacterium
PQDSGPTPI

SEQ ID NO: 1218396 - protein, 5 aa, Mycobacterium
PQDSR

SEQ ID NO: 1218397 - protein, 5 aa, Mycobacterium
PQEER

SEQ ID NO: 1218398 - protein, 11 aa, Mycobacterium
PQFDDGETTYE

SEQ ID NO: 1218399 - protein, 8 aa, Mycobacterium
PQFDEPSV

SEQ ID NO: 1218400 - protein, 14 aa, Mycobacterium
PQFDPPSVNSGGQA

SEQ ID NO: 1218401 - protein, 11 aa, Mycobacterium
PQFPTPSGPPV

SEQ ID NO: 1218402 - protein, 20 aa, Mycobacterium
PQFSSAPADHLPGRLSSSSV

SEQ ID NO: 1218403 - protein, 11 aa, Mycobacterium
PQGAGTKAEGL

SEQ ID NO: 1218404 - protein, 9 aa, Mycobacterium
PQGASAPGQ

SEQ ID NO: 1218405 - protein, 4 aa, Mycobacterium
PQGD

SEQ ID NO: 1218406 - protein, 10 aa, Mycobacterium
PQGDETPGDL

SEQ ID NO: 1218407 - protein, 7 aa, Mycobacterium
PQGDRQA

SEQ ID NO: 1218408 - protein, 9 aa, Mycobacterium
PQGGGSETY

SEQ ID NO: 1218409 - protein, 21 aa, Mycobacterium
PQGGTTAESTVNQGSNGRDVT

SEQ ID NO: 1218410 - protein, 4 aa, Mycobacterium
PQGI

SEQ ID NO: 1218411 - protein, 8 aa, Mycobacterium
PQGNPITA

SEQ ID NO: 1218412 - protein, 17 aa, Mycobacterium
PQGQRADGDNTETDQAG

SEQ ID NO: 1218413 - protein, 4 aa, Mycobacterium
PQGR

SEQ ID NO: 1218414 - protein, 6 aa, Mycobacterium
PQGRRR

SEQ ID NO: 1218415 - protein, 4 aa, Mycobacterium
PQGS

SEQ ID NO: 1218416 - protein, 5 aa, Mycobacterium
PQGSL

SEQ ID NO: 1218417 - protein, 12 aa, Mycobacterium
PQGTAGESPADA

SEQ ID NO: 1218418 - protein, 17 aa, Mycobacterium
PQGTVTDAGCGTDAPVG

SEQ ID NO: 1218419 - protein, 4 aa, Mycobacterium
PQHD

SEQ ID NO: 1218420 - protein, 4 aa, Mycobacterium
PQHR

SEQ ID NO: 1218421 - protein, 7 aa, Mycobacterium
PQHSPRY

SEQ ID NO: 1218422 - protein, 8 aa, Mycobacterium
PQIDPKPT

SEQ ID NO: 1218423 - protein, 4 aa, Mycobacterium
PQIF

SEQ ID NO: 1218424 - protein, 4 aa, Mycobacterium
PQIS

SEQ ID NO: 1218425 - protein, 7 aa, Mycobacterium
PQLDSAA

SEQ ID NO: 1218426 - protein, 27 aa, Mycobacterium
PQLEPTGQLASGARGRPAELFHRREPG

SEQ ID NO: 1218427 - protein, 4 aa, Mycobacterium
PQLG

SEQ ID NO: 1218428 - protein, 13 aa, Mycobacterium
PQLPGGPRYPGDA

SEQ ID NO: 1218429 - protein, 7 aa, Mycobacterium
PQLPTPD

SEQ ID NO: 1218430 - protein, 10 aa, Mycobacterium
PQPAAISTGK

SEQ ID NO: 1218431 - protein, 9 aa, Mycobacterium
PQPAQHGGS

SEQ ID NO: 1218432 - protein, 6 aa, Mycobacterium
PQPEVP

SEQ ID NO: 1218433 - protein, 14 aa, Mycobacterium
PQPGATLEEAQENK

SEQ ID NO: 1218434 - protein, 6 aa, Mycobacterium
PQPHGV

SEQ ID NO: 1218435 - protein, 5 aa, Mycobacterium
PQPIN

SEQ ID NO: 1218436 - protein, 23 aa, Mycobacterium
PQPPPEPDLGSNVAAPASVEGQV

SEQ ID NO: 1218437 - protein, 7 aa, Mycobacterium
PQPPTTW

SEQ ID NO: 1218438 - protein, 7 aa, Mycobacterium
PQPPVAA

SEQ ID NO: 1218439 - protein, 6 aa, Mycobacterium
PQPQTI

SEQ ID NO: 1218440 - protein, 5 aa, Mycobacterium
PQPRA

SEQ ID NO: 1218441 - protein, 29 aa, Mycobacterium
PQPRSGDALSQASRRLGSTASTHVGALHR

SEQ ID NO: 1218442 - protein, 7 aa, Mycobacterium
PQPTSEA

SEQ ID NO: 1218443 - protein, 6 aa, Mycobacterium
PQQEHR

SEQ ID NO: 1218444 - protein, 19 aa, Mycobacterium
PQQGESAADTATSGAVDPA

SEQ ID NO: 1218445 - protein, 19 aa, Mycobacterium
PQQLPQVSQGTHPEPVDGS

SEQ ID NO: 1218446 - protein, 18 aa, Mycobacterium
PQQLPQVSQGTHPEPVDT

SEQ ID NO: 1218447 - protein, 24 aa, Mycobacterium
PQQNAVDEPEPESNENAEDDSDSF

SEQ ID NO: 1218448 - protein, 8 aa, Mycobacterium
PQQSPERF

SEQ ID NO: 1218449 - protein, 14 aa, Mycobacterium
PQRAKTANLRRRPR

SEQ ID NO: 1218450 - protein, 9 aa, Mycobacterium
PQRDLADAR

SEQ ID NO: 1218451 - protein, 5 aa, Mycobacterium
PQRES

SEQ ID NO: 1218452 - protein, 7 aa, Mycobacterium
PQRGERL

SEQ ID NO: 1218453 - protein, 6 aa, Mycobacterium
PQRGRI

SEQ ID NO: 1218454 - protein, 4 aa, Mycobacterium
PQRH

SEQ ID NO: 1218455 - protein, 4 aa, Mycobacterium
PQRL

SEQ ID NO: 1218456 - protein, 9 aa, Mycobacterium
PQRPAGYDG

SEQ ID NO: 1218457 - protein, 14 aa, Mycobacterium
PQRPQDQVPDPRDP

SEQ ID NO: 1218458 - protein, 5 aa, Mycobacterium
PQRQA

SEQ ID NO: 1218459 - protein, 4 aa, Mycobacterium
PQRR

SEQ ID NO: 1218460 - protein, 33 aa, Mycobacterium
PQRRPVKPNPQQGAYGTPAGGSGLKEVLKTALG

SEQ ID NO: 1218461 - protein, 5 aa, Mycobacterium
PQRRR

SEQ ID NO: 1218462 - protein, 7 aa, Mycobacterium
PQRSGRR

SEQ ID NO: 1218463 - protein, 13 aa, Mycobacterium
PQRSWEANEPSEL

SEQ ID NO: 1218464 - protein, 10 aa, Mycobacterium
PQSAGPEALA

SEQ ID NO: 1218465 - protein, 12 aa, Mycobacterium
PQSAIDDGSVPA

SEQ ID NO: 1218466 - protein, 8 aa, Mycobacterium
PQSASEPV

SEQ ID NO: 1218467 - protein, 7 aa, Mycobacterium
PQSDWTD

SEQ ID NO: 1218468 - protein, 4 aa, Mycobacterium
PQSE

SEQ ID NO: 1218469 - protein, 7 aa, Mycobacterium
PQSEGLA

SEQ ID NO: 1218470 - protein, 9 aa, Mycobacterium
PQSSGVGGG

SEQ ID NO: 1218471 - protein, 6 aa, Mycobacterium
PQSVNG

SEQ ID NO: 1218472 - protein, 7 aa, Mycobacterium
PQTAHSD

SEQ ID NO: 1218473 - protein, 7 aa, Mycobacterium
PQTAPAE

SEQ ID NO: 1218474 - protein, 15 aa, Mycobacterium
PQTDRAKDFLGKILH

SEQ ID NO: 1218475 - protein, 10 aa, Mycobacterium
PQTEDARAAD

SEQ ID NO: 1218476 - protein, 10 aa, Mycobacterium
PQTGEPGERN

SEQ ID NO: 1218477 - protein, 12 aa, Mycobacterium
PQTLTPATAETS

SEQ ID NO: 1218478 - protein, 13 aa, Mycobacterium
PQTPNTEPADDNA

SEQ ID NO: 1218479 - protein, 12 aa, Mycobacterium
PQTPPSVSPDGS

SEQ ID NO: 1218480 - protein, 6 aa, Mycobacterium
PQTREK

SEQ ID NO: 1218481 - protein, 8 aa, Mycobacterium
PQTREKAL

SEQ ID NO: 1218482 - protein, 5 aa, Mycobacterium
PQTSE

SEQ ID NO: 1218483 - protein, 13 aa, Mycobacterium
PQVPEGDREPRQD

SEQ ID NO: 1218484 - protein, 7 aa, Mycobacterium
PQVSGRY

SEQ ID NO: 1218485 - protein, 12 aa, Mycobacterium
PQVSPSLTTSNA

SEQ ID NO: 1218486 - protein, 6 aa, Mycobacterium
PQWADP

SEQ ID NO: 1218487 - protein, 6 aa, Mycobacterium
PQWNAP

SEQ ID NO: 1218488 - protein, 4 aa, Mycobacterium
PQWR

SEQ ID NO: 1218489 - protein, 7 aa, Mycobacterium
PQWRPRP

SEQ ID NO: 1218490 - protein, 8 aa, Mycobacterium
PQYTPYPV

SEQ ID NO: 1218491 - protein, 5 aa, Mycobacterium
PRAAA

SEQ ID NO: 1218492 - protein, 10 aa, Mycobacterium
PRAAAPSYGL

SEQ ID NO: 1218493 - protein, 7 aa, Mycobacterium
PRAAEES

SEQ ID NO: 1218494 - protein, 4 aa, Mycobacterium
PRAD

SEQ ID NO: 1218495 - protein, 14 aa, Mycobacterium
PRADTTADPQEAEP

SEQ ID NO: 1218496 - protein, 4 aa, Mycobacterium
PRAE

SEQ ID NO: 1218497 - protein, 11 aa, Mycobacterium
PRAERIDAGPV

SEQ ID NO: 1218498 - protein, 12 aa, Mycobacterium
PRAFDPAAELTD

SEQ ID NO: 1218499 - protein, 4 aa, Mycobacterium
PRAG

SEQ ID NO: 1218500 - protein, 17 aa, Mycobacterium
PRAGAGPSQRQRESDEI

SEQ ID NO: 1218501 - protein, 10 aa, Mycobacterium
PRAGQTAARL

SEQ ID NO: 1218502 - protein, 7 aa, Mycobacterium
PRAGQTV

SEQ ID NO: 1218503 - protein, 8 aa, Mycobacterium
PRAHGATT

SEQ ID NO: 1218504 - protein, 12 aa, Mycobacterium
PRALGSDAAAVA

SEQ ID NO: 1218505 - protein, 9 aa, Mycobacterium
PRANEEARK

SEQ ID NO: 1218506 - protein, 6 aa, Mycobacterium
PRAPEL

SEQ ID NO: 1218507 - protein, 9 aa, Mycobacterium
PRARQCSAE

SEQ ID NO: 1218508 - protein, 16 aa, Mycobacterium
PRATPERESDGGGDVA

SEQ ID NO: 1218509 - protein, 9 aa, Mycobacterium
PRAVSAEGN

SEQ ID NO: 1218510 - protein, 6 aa, Mycobacterium
PRDAAG

SEQ ID NO: 1218511 - protein, 7 aa, Mycobacterium
PRDADAL

SEQ ID NO: 1218512 - protein, 10 aa, Mycobacterium
PRDAPKEAPP

SEQ ID NO: 1218513 - protein, 11 aa, Mycobacterium
PRDEVSDEEYT

SEQ ID NO: 1218514 - protein, 5 aa, Mycobacterium
PRDGE

SEQ ID NO: 1218515 - protein, 5 aa, Mycobacterium
PRDGL

SEQ ID NO: 1218516 - protein, 8 aa, Mycobacterium
PRDGVPDV

SEQ ID NO: 1218517 - protein, 7 aa, Mycobacterium
PRDHDDP

SEQ ID NO: 1218518 - protein, 6 aa, Mycobacterium
PRDLER

SEQ ID NO: 1218519 - protein, 5 aa, Mycobacterium
PRDPD

SEQ ID NO: 1218520 - protein, 10 aa, Mycobacterium
PRDRNGTFDP

SEQ ID NO: 1218521 - protein, 10 aa, Mycobacterium
PRDSDDPQEW

SEQ ID NO: 1218522 - protein, 5 aa, Mycobacterium
PRDSL

SEQ ID NO: 1218523 - protein, 7 aa, Mycobacterium
PRDTATY

SEQ ID NO: 1218524 - protein, 7 aa, Mycobacterium
PRDVAGT

SEQ ID NO: 1218525 - protein, 7 aa, Mycobacterium
PREAGAD

SEQ ID NO: 1218526 - protein, 6 aa, Mycobacterium
PREEYT

SEQ ID NO: 1218527 - protein, 5 aa, Mycobacterium
PREGG

SEQ ID NO: 1218528 - protein, 8 aa, Mycobacterium
PREGGNGD

SEQ ID NO: 1218529 - protein, 6 aa, Mycobacterium
PREHGG

SEQ ID NO: 1218530 - protein, 22 aa, Mycobacterium
PREPEVGGQLAESSADSRAPRN

SEQ ID NO: 1218531 - protein, 6 aa, Mycobacterium
PREPGG

SEQ ID NO: 1218532 - protein, 15 aa, Mycobacterium
PREPGLPRRNPLGVA

SEQ ID NO: 1218533 - protein, 10 aa, Mycobacterium
PRERTSVPAD

SEQ ID NO: 1218534 - protein, 4 aa, Mycobacterium
PRES

SEQ ID NO: 1218535 - protein, 7 aa, Mycobacterium
PRESPGG

SEQ ID NO: 1218536 - protein, 6 aa, Mycobacterium
PRESRG

SEQ ID NO: 1218537 - protein, 7 aa, Mycobacterium
PRETEGQ

SEQ ID NO: 1218538 - protein, 5 aa, Mycobacterium
PRETT

SEQ ID NO: 1218539 - protein, 4 aa, Mycobacterium
PRFA

SEQ ID NO: 1218540 - protein, 5 aa, Mycobacterium
PRFAT

SEQ ID NO: 1218541 - protein, 11 aa, Mycobacterium
PRFDEDADDDL

SEQ ID NO: 1218542 - protein, 7 aa, Mycobacterium
PRFGQDA

SEQ ID NO: 1218543 - protein, 4 aa, Mycobacterium
PRFP

SEQ ID NO: 1218544 - protein, 13 aa, Mycobacterium
PRFPSPASKSAAR

SEQ ID NO: 1218545 - protein, 7 aa, Mycobacterium
PRFTPPA

SEQ ID NO: 1218546 - protein, 9 aa, Mycobacterium
PRGAGGELQ

SEQ ID NO: 1218547 - protein, 8 aa, Mycobacterium
PRGAGKTH

SEQ ID NO: 1218548 - protein, 6 aa, Mycobacterium
PRGART

SEQ ID NO: 1218549 - protein, 10 aa, Mycobacterium
PRGGLDRTVP

SEQ ID NO: 1218550 - protein, 4 aa, Mycobacterium
PRGI

SEQ ID NO: 1218551 - protein, 15 aa, Mycobacterium
PRGLGQGGHLRGAGA

SEQ ID NO: 1218552 - protein, 18 aa, Mycobacterium
PRGNTQWARNARAAGQVE

SEQ ID NO: 1218553 - protein, 10 aa, Mycobacterium
PRGPDSAGVW

SEQ ID NO: 1218554 - protein, 4 aa, Mycobacterium
PRGR

SEQ ID NO: 1218555 - protein, 8 aa, Mycobacterium
PRGRDPLR

SEQ ID NO: 1218556 - protein, 8 aa, Mycobacterium
PRGRQLPK

SEQ ID NO: 1218557 - protein, 11 aa, Mycobacterium
PRGRSGVGQPC

SEQ ID NO: 1218558 - protein, 12 aa, Mycobacterium
PRGSDERRAPVE

SEQ ID NO: 1218559 - protein, 16 aa, Mycobacterium
PRGSRQERIVVIRADA

SEQ ID NO: 1218560 - protein, 9 aa, Mycobacterium
PRGTEDQRA

SEQ ID NO: 1218561 - protein, 5 aa, Mycobacterium
PRGTT

SEQ ID NO: 1218562 - protein, 19 aa, Mycobacterium
PRGVTGKISRKDLQDRLDN

SEQ ID NO: 1218563 - protein, 10 aa, Mycobacterium
PRGYAEDPDE

SEQ ID NO: 1218564 - protein, 14 aa, Mycobacterium
PRHANAEKKIREPL

SEQ ID NO: 1218565 - protein, 14 aa, Mycobacterium
PRHRREEKSAIERS

SEQ ID NO: 1218566 - protein, 13 aa, Mycobacterium
PRHRREERSAIER

SEQ ID NO: 1218567 - protein, 4 aa, Mycobacterium
PRHS

SEQ ID NO: 1218568 - protein, 5 aa, Mycobacterium
PRHTT

SEQ ID NO: 1218569 - protein, 4 aa, Mycobacterium
PRHV

SEQ ID NO: 1218570 - protein, 5 aa, Mycobacterium
PRIAP

SEQ ID NO: 1218571 - protein, 5 aa, Mycobacterium
PRIDP

SEQ ID NO: 1218572 - protein, 12 aa, Mycobacterium
PRIDPATLPHPR

SEQ ID NO: 1218573 - protein, 12 aa, Mycobacterium
PRIGDGGRGYRR

SEQ ID NO: 1218574 - protein, 6 aa, Mycobacterium
PRKAFG

SEQ ID NO: 1218575 - protein, 13 aa, Mycobacterium
PRKDAPRVATGMP

SEQ ID NO: 1218576 - protein, 9 aa, Mycobacterium
PRKNATEKT

SEQ ID NO: 1218577 - protein, 13 aa, Mycobacterium
PRKPSRTERRDKS

SEQ ID NO: 1218578 - protein, 8 aa, Mycobacterium
PRKTETAA

SEQ ID NO: 1218579 - protein, 4 aa, Mycobacterium
PRLG

SEQ ID NO: 1218580 - protein, 5 aa, Mycobacterium
PRLGE

SEQ ID NO: 1218581 - protein, 7 aa, Mycobacterium
PRLNTQQ

SEQ ID NO: 1218582 - protein, 14 aa, Mycobacterium
PRLPQIPATDEQVE

SEQ ID NO: 1218583 - protein, 10 aa, Mycobacterium
PRLPSGKGDA

SEQ ID NO: 1218584 - protein, 5 aa, Mycobacterium
PRLQD

SEQ ID NO: 1218585 - protein, 13 aa, Mycobacterium
PRLTAREDEDVSA

SEQ ID NO: 1218586 - protein, 7 aa, Mycobacterium
PRLTPPL

SEQ ID NO: 1218587 - protein, 10 aa, Mycobacterium
PRLTRATAEV

SEQ ID NO: 1218588 - protein, 10 aa, Mycobacterium
PRMAAPAPSV

SEQ ID NO: 1218589 - protein, 12 aa, Mycobacterium
PRNAGLRSHNGE

SEQ ID NO: 1218590 - protein, 9 aa, Mycobacterium
PRNARPRDA

SEQ ID NO: 1218591 - protein, 7 aa, Mycobacterium
PRNETGK

SEQ ID NO: 1218592 - protein, 6 aa, Mycobacterium
PRNGLS

SEQ ID NO: 1218593 - protein, 7 aa, Mycobacterium
PRNPGGK

SEQ ID NO: 1218594 - protein, 7 aa, Mycobacterium
PRNPSGK

SEQ ID NO: 1218595 - protein, 7 aa, Mycobacterium
PRNRAPI

SEQ ID NO: 1218596 - protein, 20 aa, Mycobacterium
PRNSIPGRDSSSTTAGNVPR

SEQ ID NO: 1218597 - protein, 7 aa, Mycobacterium
PRNTPLP

SEQ ID NO: 1218598 - protein, 10 aa, Mycobacterium
PRPAEHADVN

SEQ ID NO: 1218599 - protein, 10 aa, Mycobacterium
PRPDRAEFAG

SEQ ID NO: 1218600 - protein, 10 aa, Mycobacterium
PRPDYQPRYD

SEQ ID NO: 1218601 - protein, 22 aa, Mycobacterium
PRPEPEPDKDADGEPKPVPVPQ

SEQ ID NO: 1218602 - protein, 7 aa, Mycobacterium
PRPEPRE

SEQ ID NO: 1218603 - protein, 10 aa, Mycobacterium
PRPGATAEDD

SEQ ID NO: 1218604 - protein, 16 aa, Mycobacterium
PRPGETIPSTYDFAEG

SEQ ID NO: 1218605 - protein, 11 aa, Mycobacterium
PRPGGDAEDDG

SEQ ID NO: 1218606 - protein, 8 aa, Mycobacterium
PRPGRPRV

SEQ ID NO: 1218607 - protein, 11 aa, Mycobacterium
PRPGRTDADRN

SEQ ID NO: 1218608 - protein, 8 aa, Mycobacterium
PRPGVGGS

SEQ ID NO: 1218609 - protein, 4 aa, Mycobacterium
PRPL

SEQ ID NO: 1218610 - protein, 7 aa, Mycobacterium
PRPLGDH

SEQ ID NO: 1218611 - protein, 5 aa, Mycobacterium
PRPLQ

SEQ ID NO: 1218612 - protein, 5 aa, Mycobacterium
PRPPR

SEQ ID NO: 1218613 - protein, 6 aa, Mycobacterium
PRPPTG

SEQ ID NO: 1218614 - protein, 19 aa, Mycobacterium
PRPQRAEHSPQSNCTAHEQ

SEQ ID NO: 1218615 - protein, 5 aa, Mycobacterium
PRPQT

SEQ ID NO: 1218616 - protein, 4 aa, Mycobacterium
PRPR

SEQ ID NO: 1218617 - protein, 24 aa, Mycobacterium
PRPRPAHARPKGTADADAETVTLS

SEQ ID NO: 1218618 - protein, 7 aa, Mycobacterium
PRPRTQI

SEQ ID NO: 1218619 - protein, 8 aa, Mycobacterium
PRPSEIKT

SEQ ID NO: 1218620 - protein, 10 aa, Mycobacterium
PRPSTNSYAQ

SEQ ID NO: 1218621 - protein, 5 aa, Mycobacterium
PRPTT

SEQ ID NO: 1218622 - protein, 8 aa, Mycobacterium
PRPVEESI

SEQ ID NO: 1218623 - protein, 7 aa, Mycobacterium
PRPVTYG

SEQ ID NO: 1218624 - protein, 5 aa, Mycobacterium
PRQRP

SEQ ID NO: 1218625 - protein, 23 aa, Mycobacterium
PRQSGVDAFGQGRVDRPGECPQP

SEQ ID NO: 1218626 - protein, 11 aa, Mycobacterium
PRRADGSPLGT

SEQ ID NO: 1218627 - protein, 5 aa, Mycobacterium
PRRAG

SEQ ID NO: 1218628 - protein, 7 aa, Mycobacterium
PRRAGSD

SEQ ID NO: 1218629 - protein, 5 aa, Mycobacterium
PRRAI

SEQ ID NO: 1218630 - protein, 18 aa, Mycobacterium
PRRAPAAPARTASGSVAV

SEQ ID NO: 1218631 - protein, 8 aa, Mycobacterium
PRRDGGAR

SEQ ID NO: 1218632 - protein, 25 aa, Mycobacterium
PRREATEDLEELDDGEVDDTDDPDL

SEQ ID NO: 1218633 - protein, 12 aa, Mycobacterium
PRRERDTELGGR

SEQ ID NO: 1218634 - protein, 4 aa, Mycobacterium
PRRG

SEQ ID NO: 1218635 - protein, 14 aa, Mycobacterium
PRRGSGRKRPGTRL

SEQ ID NO: 1218636 - protein, 7 aa, Mycobacterium
PRRGSRV

SEQ ID NO: 1218637 - protein, 9 aa, Mycobacterium
PRRHPDDPR

SEQ ID NO: 1218638 - protein, 5 aa, Mycobacterium
PRRHR

SEQ ID NO: 1218639 - protein, 7 aa, Mycobacterium
PRRLPGR

SEQ ID NO: 1218640 - protein, 6 aa, Mycobacterium
PRRNAE

SEQ ID NO: 1218641 - protein, 12 aa, Mycobacterium
PRRPEPRTKVPV

SEQ ID NO: 1218642 - protein, 9 aa, Mycobacterium
PRRPSWGEP

SEQ ID NO: 1218643 - protein, 7 aa, Mycobacterium
PRRQAAR

SEQ ID NO: 1218644 - protein, 14 aa, Mycobacterium
PRRRGAAEDTKKGD

SEQ ID NO: 1218645 - protein, 9 aa, Mycobacterium
PRRRTDRRH

SEQ ID NO: 1218646 - protein, 5 aa, Mycobacterium
PRRSN

SEQ ID NO: 1218647 - protein, 10 aa, Mycobacterium
PRRSPQDDEI

SEQ ID NO: 1218648 - protein, 8 aa, Mycobacterium
PRRTETAR

SEQ ID NO: 1218649 - protein, 11 aa, Mycobacterium
PRRTGTAAKAT

SEQ ID NO: 1218650 - protein, 5 aa, Mycobacterium
PRRYE

SEQ ID NO: 1218651 - protein, 5 aa, Mycobacterium
PRSDQ

SEQ ID NO: 1218652 - protein, 9 aa, Mycobacterium
PRSDSSVQL

SEQ ID NO: 1218653 - protein, 7 aa, Mycobacterium
PRSEELT

SEQ ID NO: 1218654 - protein, 10 aa, Mycobacterium
PRSFTTSDGV

SEQ ID NO: 1218655 - protein, 7 aa, Mycobacterium
PRSGEGL

SEQ ID NO: 1218656 - protein, 7 aa, Mycobacterium
PRSGELG

SEQ ID NO: 1218657 - protein, 7 aa, Mycobacterium
PRSGGLR

SEQ ID NO: 1218658 - protein, 13 aa, Mycobacterium
PRSGRWNPDASAR

SEQ ID NO: 1218659 - protein, 6 aa, Mycobacterium
PRSGTT

SEQ ID NO: 1218660 - protein, 5 aa, Mycobacterium
PRSGV

SEQ ID NO: 1218661 - protein, 9 aa, Mycobacterium
PRSKKGDGL

SEQ ID NO: 1218662 - protein, 8 aa, Mycobacterium
PRSLGDPV

SEQ ID NO: 1218663 - protein, 6 aa, Mycobacterium
PRSLPE

SEQ ID NO: 1218664 - protein, 4 aa, Mycobacterium
PRSN

SEQ ID NO: 1218665 - protein, 8 aa, Mycobacterium
PRSNVSYT

SEQ ID NO: 1218666 - protein, 12 aa, Mycobacterium
PRSRGGGDIQPE

SEQ ID NO: 1218667 - protein, 5 aa, Mycobacterium
PRSRR

SEQ ID NO: 1218668 - protein, 7 aa, Mycobacterium
PRSSDID

SEQ ID NO: 1218669 - protein, 4 aa, Mycobacterium
PRST

SEQ ID NO: 1218670 - protein, 21 aa, Mycobacterium
PRSTAAAFPGLARTAALVRLT

SEQ ID NO: 1218671 - protein, 16 aa, Mycobacterium
PRSTSPSDPLPDTAEG

SEQ ID NO: 1218672 - protein, 7 aa, Mycobacterium
PRSVEQA

SEQ ID NO: 1218673 - protein, 4 aa, Mycobacterium
PRSY

SEQ ID NO: 1218674 - protein, 11 aa, Mycobacterium
PRSYPPSREPI

SEQ ID NO: 1218675 - protein, 18 aa, Mycobacterium
PRTAHRTTLAPASARDLQ

SEQ ID NO: 1218676 - protein, 19 aa, Mycobacterium
PRTASGKPDLTAVRSHFAQ

SEQ ID NO: 1218677 - protein, 4 aa, Mycobacterium
PRTE

SEQ ID NO: 1218678 - protein, 12 aa, Mycobacterium
PRTEKPRNRRKT

SEQ ID NO: 1218679 - protein, 5 aa, Mycobacterium
PRTEL

SEQ ID NO: 1218680 - protein, 4 aa, Mycobacterium
PRTG

SEQ ID NO: 1218681 - protein, 9 aa, Mycobacterium
PRTGAPLTA

SEQ ID NO: 1218682 - protein, 7 aa, Mycobacterium
PRTGRTV

SEQ ID NO: 1218683 - protein, 6 aa, Mycobacterium
PRTGST

SEQ ID NO: 1218684 - protein, 5 aa, Mycobacterium
PRTGT

SEQ ID NO: 1218685 - protein, 18 aa, Mycobacterium
PRTGVDPDELRRSPEYGQ

SEQ ID NO: 1218686 - protein, 4 aa, Mycobacterium
PRTL

SEQ ID NO: 1218687 - protein, 13 aa, Mycobacterium
PRTNVGAGGNYYN

SEQ ID NO: 1218688 - protein, 9 aa, Mycobacterium
PRTSTVGRG

SEQ ID NO: 1218689 - protein, 11 aa, Mycobacterium
PRTTRPGEAEF

SEQ ID NO: 1218690 - protein, 4 aa, Mycobacterium
PRTV

SEQ ID NO: 1218691 - protein, 16 aa, Mycobacterium
PRVAEATRKELADQRG

SEQ ID NO: 1218692 - protein, 10 aa, Mycobacterium
PRVGEQRRPE

SEQ ID NO: 1218693 - protein, 8 aa, Mycobacterium
PRVPPTRP

SEQ ID NO: 1218694 - protein, 7 aa, Mycobacterium
PRVQDSV

SEQ ID NO: 1218695 - protein, 10 aa, Mycobacterium
PRWGSKTQAT

SEQ ID NO: 1218696 - protein, 4 aa, Mycobacterium
PRWS

SEQ ID NO: 1218697 - protein, 12 aa, Mycobacterium
PRYATADSVGRD

SEQ ID NO: 1218698 - protein, 4 aa, Mycobacterium
PRYN

SEQ ID NO: 1218699 - protein, 5 aa, Mycobacterium
PRYPG

SEQ ID NO: 1218700 - protein, 8 aa, Mycobacterium
PRYSAARR

SEQ ID NO: 1218701 - protein, 16 aa, Mycobacterium
PRYSRRRSAVSRYSAA

SEQ ID NO: 1218702 - protein, 7 aa, Mycobacterium
PSAAALP

SEQ ID NO: 1218703 - protein, 6 aa, Mycobacterium
PSAAPP

SEQ ID NO: 1218704 - protein, 11 aa, Mycobacterium
PSAAPSDEPVE

SEQ ID NO: 1218705 - protein, 9 aa, Mycobacterium
PSADEMERT

SEQ ID NO: 1218706 - protein, 11 aa, Mycobacterium
PSADPTRNATA

SEQ ID NO: 1218707 - protein, 10 aa, Mycobacterium
PSADRSPRDT

SEQ ID NO: 1218708 - protein, 6 aa, Mycobacterium
PSAGDV

SEQ ID NO: 1218709 - protein, 6 aa, Mycobacterium
PSAGEL

SEQ ID NO: 1218710 - protein, 10 aa, Mycobacterium
PSAGGGGKGM

SEQ ID NO: 1218711 - protein, 9 aa, Mycobacterium
PSAGLSGPR

SEQ ID NO: 1218712 - protein, 16 aa, Mycobacterium
PSAGPPPHFDSADEYD

SEQ ID NO: 1218713 - protein, 7 aa, Mycobacterium
PSAGYGD

SEQ ID NO: 1218714 - protein, 5 aa, Mycobacterium
PSAKY

SEQ ID NO: 1218715 - protein, 5 aa, Mycobacterium
PSALA

SEQ ID NO: 1218716 - protein, 9 aa, Mycobacterium
PSALHPAPR

SEQ ID NO: 1218717 - protein, 8 aa, Mycobacterium
PSALTGHG

SEQ ID NO: 1218718 - protein, 15 aa, Mycobacterium
PSANDPGLAPPGKHA

SEQ ID NO: 1218719 - protein, 7 aa, Mycobacterium
PSAPDLQ

SEQ ID NO: 1218720 - protein, 5 aa, Mycobacterium
PSAPI

SEQ ID NO: 1218721 - protein, 5 aa, Mycobacterium
PSAPV

SEQ ID NO: 1218722 - protein, 33 aa, Mycobacterium
PSAPVNAGPLPPLPAPGTVPSGGSAMPGTGFPQ

SEQ ID NO: 1218723 - protein, 7 aa, Mycobacterium
PSAQPDV

SEQ ID NO: 1218724 - protein, 4 aa, Mycobacterium
PSAR

SEQ ID NO: 1218725 - protein, 8 aa, Mycobacterium
PSASQTDY

SEQ ID NO: 1218726 - protein, 13 aa, Mycobacterium
PSATFNSALEAAG

SEQ ID NO: 1218727 - protein, 11 aa, Mycobacterium
PSATGSPQQCA

SEQ ID NO: 1218728 - protein, 5 aa, Mycobacterium
PSATH

SEQ ID NO: 1218729 - protein, 8 aa, Mycobacterium
PSAYADEA

SEQ ID NO: 1218730 - protein, 7 aa, Mycobacterium
PSAYDAK

SEQ ID NO: 1218731 - protein, 14 aa, Mycobacterium
PSCAGSVSAEAQLT

SEQ ID NO: 1218732 - protein, 9 aa, Mycobacterium
PSDAGMHTT

SEQ ID NO: 1218733 - protein, 7 aa, Mycobacterium
PSDAPGC

SEQ ID NO: 1218734 - protein, 9 aa, Mycobacterium
PSDDDDRVT

SEQ ID NO: 1218735 - protein, 8 aa, Mycobacterium
PSDEQRQS

SEQ ID NO: 1218736 - protein, 4 aa, Mycobacterium
PSDG

SEQ ID NO: 1218737 - protein, 6 aa, Mycobacterium
PSDGSW

SEQ ID NO: 1218738 - protein, 7 aa, Mycobacterium
PSDGYRA

SEQ ID NO: 1218739 - protein, 9 aa, Mycobacterium
PSDKEAQDF

SEQ ID NO: 1218740 - protein, 4 aa, Mycobacterium
PSDL

SEQ ID NO: 1218741 - protein, 5 aa, Mycobacterium
PSDLA

SEQ ID NO: 1218742 - protein, 11 aa, Mycobacterium
PSDLRGARRAG

SEQ ID NO: 1218743 - protein, 9 aa, Mycobacterium
PSDNPITAT

SEQ ID NO: 1218744 - protein, 8 aa, Mycobacterium
PSDPDGSL

SEQ ID NO: 1218745 - protein, 12 aa, Mycobacterium
PSDPEAYDAASE

SEQ ID NO: 1218746 - protein, 21 aa, Mycobacterium
PSDTADAVTDRYPPLAEGEVT

SEQ ID NO: 1218747 - protein, 14 aa, Mycobacterium
PSDTGDAATDRYPP

SEQ ID NO: 1218748 - protein, 14 aa, Mycobacterium
PSDTGPRVGGDDVT

SEQ ID NO: 1218749 - protein, 4 aa, Mycobacterium
PSDV

SEQ ID NO: 1218750 - protein, 126 aa, Mycobacterium
PSEASQTATVDEGDNAATVDEGDQVETGNIAESDAAEAPPAEQQGDVDDGTDEDLDAQEDVEELEGPENEELEGPAAEEPASTDDADADDADADDEGADEPEAGEPAATTAPDSASGADGSTDTSG

SEQ ID NO: 1218751 - protein, 9 aa, Mycobacterium
PSEDGGQKF

SEQ ID NO: 1218752 - protein, 7 aa, Mycobacterium
PSEDRAS

SEQ ID NO: 1218753 - protein, 5 aa, Mycobacterium
PSEGR

SEQ ID NO: 1218754 - protein, 5 aa, Mycobacterium
PSEIT

SEQ ID NO: 1218755 - protein, 6 aa, Mycobacterium
PSELDE

SEQ ID NO: 1218756 - protein, 9 aa, Mycobacterium
PSEPAETAR

SEQ ID NO: 1218757 - protein, 5 aa, Mycobacterium
PSEPH

SEQ ID NO: 1218758 - protein, 8 aa, Mycobacterium
PSEQTGSV

SEQ ID NO: 1218759 - protein, 4 aa, Mycobacterium
PSER

SEQ ID NO: 1218760 - protein, 6 aa, Mycobacterium
PSERGI

SEQ ID NO: 1218761 - protein, 9 aa, Mycobacterium
PSESRHEKR

SEQ ID NO: 1218762 - protein, 15 aa, Mycobacterium
PSETKRDGGDGPPLR

SEQ ID NO: 1218763 - protein, 15 aa, Mycobacterium
PSETTPSLPECAGAA

SEQ ID NO: 1218764 - protein, 4 aa, Mycobacterium
PSEW

SEQ ID NO: 1218765 - protein, 4 aa, Mycobacterium
PSFA

SEQ ID NO: 1218766 - protein, 4 aa, Mycobacterium
PSFC

SEQ ID NO: 1218767 - protein, 20 aa, Mycobacterium
PSFGERSVNEGFSGGEKKRH

SEQ ID NO: 1218768 - protein, 7 aa, Mycobacterium
PSGAPAL

SEQ ID NO: 1218769 - protein, 14 aa, Mycobacterium
PSGAPVEVDLSVGL

SEQ ID NO: 1218770 - protein, 7 aa, Mycobacterium
PSGASAA

SEQ ID NO: 1218771 - protein, 9 aa, Mycobacterium
PSGCGKSTS

SEQ ID NO: 1218772 - protein, 7 aa, Mycobacterium
PSGCGKT

SEQ ID NO: 1218773 - protein, 4 aa, Mycobacterium
PSGD

SEQ ID NO: 1218774 - protein, 14 aa, Mycobacterium
PSGDALDNDPQAKV

SEQ ID NO: 1218775 - protein, 4 aa, Mycobacterium
PSGE

SEQ ID NO: 1218776 - protein, 9 aa, Mycobacterium
PSGEAADLE

SEQ ID NO: 1218777 - protein, 5 aa, Mycobacterium
PSGEI

SEQ ID NO: 1218778 - protein, 8 aa, Mycobacterium
PSGEPLTD

SEQ ID NO: 1218779 - protein, 4 aa, Mycobacterium
PSGF

SEQ ID NO: 1218780 - protein, 7 aa, Mycobacterium
PSGGEVD

SEQ ID NO: 1218781 - protein, 7 aa, Mycobacterium
PSGIPDG

SEQ ID NO: 1218782 - protein, 4 aa, Mycobacterium
PSGK

SEQ ID NO: 1218783 - protein, 19 aa, Mycobacterium
PSGKQGAGSNRDGAAGTDL

SEQ ID NO: 1218784 - protein, 10 aa, Mycobacterium
PSGLSADDNL

SEQ ID NO: 1218785 - protein, 8 aa, Mycobacterium
PSGNPITA

SEQ ID NO: 1218786 - protein, 8 aa, Mycobacterium
PSGNRDDE

SEQ ID NO: 1218787 - protein, 6 aa, Mycobacterium
PSGPQV

SEQ ID NO: 1218788 - protein, 8 aa, Mycobacterium
PSGRRDTW

SEQ ID NO: 1218789 - protein, 5 aa, Mycobacterium
PSGRS

SEQ ID NO: 1218790 - protein, 14 aa, Mycobacterium
PSGSGLSGPTSIAG

SEQ ID NO: 1218791 - protein, 8 aa, Mycobacterium
PSGSSISG

SEQ ID NO: 1218792 - protein, 4 aa, Mycobacterium
PSGT

SEQ ID NO: 1218793 - protein, 8 aa, Mycobacterium
PSGTDEHN

SEQ ID NO: 1218794 - protein, 8 aa, Mycobacterium
PSGTEPKL

SEQ ID NO: 1218795 - protein, 5 aa, Mycobacterium
PSGTG

SEQ ID NO: 1218796 - protein, 10 aa, Mycobacterium
PSGTQPGDAK

SEQ ID NO: 1218797 - protein, 7 aa, Mycobacterium
PSGVEGT

SEQ ID NO: 1218798 - protein, 5 aa, Mycobacterium
PSGYT

SEQ ID NO: 1218799 - protein, 4 aa, Mycobacterium
PSHE

SEQ ID NO: 1218800 - protein, 7 aa, Mycobacterium
PSHPNHD

SEQ ID NO: 1218801 - protein, 8 aa, Mycobacterium
PSHSPGEH

SEQ ID NO: 1218802 - protein, 9 aa, Mycobacterium
PSIASGEAM

SEQ ID NO: 1218803 - protein, 5 aa, Mycobacterium
PSIDE

SEQ ID NO: 1218804 - protein, 12 aa, Mycobacterium
PSIDPDDPPFSV

SEQ ID NO: 1218805 - protein, 4 aa, Mycobacterium
PSIE

SEQ ID NO: 1218806 - protein, 10 aa, Mycobacterium
PSIGSVGDSF

SEQ ID NO: 1218807 - protein, 4 aa, Mycobacterium
PSIP

SEQ ID NO: 1218808 - protein, 10 aa, Mycobacterium
PSIPADRRAE

SEQ ID NO: 1218809 - protein, 6 aa, Mycobacterium
PSIPFT

SEQ ID NO: 1218810 - protein, 6 aa, Mycobacterium
PSIRGR

SEQ ID NO: 1218811 - protein, 10 aa, Mycobacterium
PSKGTWRTDS

SEQ ID NO: 1218812 - protein, 8 aa, Mycobacterium
PSKHEYGN

SEQ ID NO: 1218813 - protein, 6 aa, Mycobacterium
PSKPPL

SEQ ID NO: 1218814 - protein, 10 aa, Mycobacterium
PSKPTPAQAD

SEQ ID NO: 1218815 - protein, 12 aa, Mycobacterium
PSKWPTQVRRRD

SEQ ID NO: 1218816 - protein, 12 aa, Mycobacterium
PSLGGPVEVDPK

SEQ ID NO: 1218817 - protein, 13 aa, Mycobacterium
PSLGRPARAGSWD

SEQ ID NO: 1218818 - protein, 6 aa, Mycobacterium
PSLGST

SEQ ID NO: 1218819 - protein, 9 aa, Mycobacterium
PSLNPATGE

SEQ ID NO: 1218820 - protein, 7 aa, Mycobacterium
PSLPRYT

SEQ ID NO: 1218821 - protein, 10 aa, Mycobacterium
PSLQEAEDAT

SEQ ID NO: 1218822 - protein, 6 aa, Mycobacterium
PSLRPD

SEQ ID NO: 1218823 - protein, 9 aa, Mycobacterium
PSLRPEDSL

SEQ ID NO: 1218824 - protein, 4 aa, Mycobacterium
PSLT

SEQ ID NO: 1218825 - protein, 4 aa, Mycobacterium
PSLY

SEQ ID NO: 1218826 - protein, 8 aa, Mycobacterium
PSMTQPDT

SEQ ID NO: 1218827 - protein, 8 aa, Mycobacterium
PSNAPAIR

SEQ ID NO: 1218828 - protein, 11 aa, Mycobacterium
PSNGSTVTTYD

SEQ ID NO: 1218829 - protein, 10 aa, Mycobacterium
PSNPARSAAA

SEQ ID NO: 1218830 - protein, 8 aa, Mycobacterium
PSNPGTLG

SEQ ID NO: 1218831 - protein, 23 aa, Mycobacterium
PSNPYPLATPEDLAETERSVKEI

SEQ ID NO: 1218832 - protein, 7 aa, Mycobacterium
PSNTASY

SEQ ID NO: 1218833 - protein, 5 aa, Mycobacterium
PSNTQ

SEQ ID NO: 1218834 - protein, 8 aa, Mycobacterium
PSPAAALS

SEQ ID NO: 1218835 - protein, 9 aa, Mycobacterium
PSPAPSSSA

SEQ ID NO: 1218836 - protein, 7 aa, Mycobacterium
PSPDEPV

SEQ ID NO: 1218837 - protein, 4 aa, Mycobacterium
PSPE

SEQ ID NO: 1218838 - protein, 6 aa, Mycobacterium
PSPEGP

SEQ ID NO: 1218839 - protein, 22 aa, Mycobacterium
PSPESVRKRRAESFAARDHLYT

SEQ ID NO: 1218840 - protein, 4 aa, Mycobacterium
PSPH

SEQ ID NO: 1218841 - protein, 5 aa, Mycobacterium
PSPHI

SEQ ID NO: 1218842 - protein, 5 aa, Mycobacterium
PSPIP

SEQ ID NO: 1218843 - protein, 6 aa, Mycobacterium
PSPKPF

SEQ ID NO: 1218844 - protein, 10 aa, Mycobacterium
PSPNAMEVGP

SEQ ID NO: 1218845 - protein, 21 aa, Mycobacterium
PSPPPGLAGPDDTRRTRANAD

SEQ ID NO: 1218846 - protein, 14 aa, Mycobacterium
PSPPRPVTPAHAPE

SEQ ID NO: 1218847 - protein, 7 aa, Mycobacterium
PSPQRQD

SEQ ID NO: 1218848 - protein, 6 aa, Mycobacterium
PSPREA

SEQ ID NO: 1218849 - protein, 6 aa, Mycobacterium
PSPRHH

SEQ ID NO: 1218850 - protein, 5 aa, Mycobacterium
PSPRL

SEQ ID NO: 1218851 - protein, 9 aa, Mycobacterium
PSPRPGEGQ

SEQ ID NO: 1218852 - protein, 5 aa, Mycobacterium
PSPSG

SEQ ID NO: 1218853 - protein, 13 aa, Mycobacterium
PSPSGVTHHLFWR

SEQ ID NO: 1218854 - protein, 6 aa, Mycobacterium
PSPSLG

SEQ ID NO: 1218855 - protein, 5 aa, Mycobacterium
PSPTQ

SEQ ID NO: 1218856 - protein, 7 aa, Mycobacterium
PSPTRRA

SEQ ID NO: 1218857 - protein, 6 aa, Mycobacterium
PSPTSL

SEQ ID NO: 1218858 - protein, 9 aa, Mycobacterium
PSPVEEPEA

SEQ ID NO: 1218859 - protein, 5 aa, Mycobacterium
PSPVK

SEQ ID NO: 1218860 - protein, 9 aa, Mycobacterium
PSPVSREVQ

SEQ ID NO: 1218861 - protein, 16 aa, Mycobacterium
PSPVVPPRSGAPNPAA

SEQ ID NO: 1218862 - protein, 23 aa, Mycobacterium
PSQAEIPDPAPIDDGVGPQVDGE

SEQ ID NO: 1218863 - protein, 7 aa, Mycobacterium
PSQAQRN

SEQ ID NO: 1218864 - protein, 11 aa, Mycobacterium
PSQGDVDSSGP

SEQ ID NO: 1218865 - protein, 13 aa, Mycobacterium
PSQIDPNPRQPRQ

SEQ ID NO: 1218866 - protein, 9 aa, Mycobacterium
PSQQNTFTG

SEQ ID NO: 1218867 - protein, 5 aa, Mycobacterium
PSQSF

SEQ ID NO: 1218868 - protein, 7 aa, Mycobacterium
PSRAADG

SEQ ID NO: 1218869 - protein, 13 aa, Mycobacterium
PSRASEANKTRPA

SEQ ID NO: 1218870 - protein, 11 aa, Mycobacterium
PSRDAEPVATD

SEQ ID NO: 1218871 - protein, 11 aa, Mycobacterium
PSRGDDRTRAD

SEQ ID NO: 1218872 - protein, 12 aa, Mycobacterium
PSRGDDRTRSDV

SEQ ID NO: 1218873 - protein, 9 aa, Mycobacterium
PSRGGSSIG

SEQ ID NO: 1218874 - protein, 5 aa, Mycobacterium
PSRGR

SEQ ID NO: 1218875 - protein, 4 aa, Mycobacterium
PSRL

SEQ ID NO: 1218876 - protein, 7 aa, Mycobacterium
PSRPGRM

SEQ ID NO: 1218877 - protein, 7 aa, Mycobacterium
PSRQPQA

SEQ ID NO: 1218878 - protein, 7 aa, Mycobacterium
PSRRADA

SEQ ID NO: 1218879 - protein, 13 aa, Mycobacterium
PSRSLASPTETLG

SEQ ID NO: 1218880 - protein, 7 aa, Mycobacterium
PSRSPTA

SEQ ID NO: 1218881 - protein, 4 aa, Mycobacterium
PSRT

SEQ ID NO: 1218882 - protein, 5 aa, Mycobacterium
PSRTA

SEQ ID NO: 1218883 - protein, 9 aa, Mycobacterium
PSRTGQVED

SEQ ID NO: 1218884 - protein, 6 aa, Mycobacterium
PSRVNT

SEQ ID NO: 1218885 - protein, 12 aa, Mycobacterium
PSRVPVAPSGPL

SEQ ID NO: 1218886 - protein, 4 aa, Mycobacterium
PSSA

SEQ ID NO: 1218887 - protein, 36 aa, Mycobacterium
PSSDGRDGGRGDRGGRGRRDDRGGRGGRDDREKSQY

SEQ ID NO: 1218888 - protein, 12 aa, Mycobacterium
PSSNTVSNANEL

SEQ ID NO: 1218889 - protein, 8 aa, Mycobacterium
PSSPADAK

SEQ ID NO: 1218890 - protein, 8 aa, Mycobacterium
PSSPAEAG

SEQ ID NO: 1218891 - protein, 7 aa, Mycobacterium
PSSPLTA

SEQ ID NO: 1218892 - protein, 16 aa, Mycobacterium
PSSPPSAEDVLELAIS

SEQ ID NO: 1218893 - protein, 13 aa, Mycobacterium
PSSPRAESTNDSA

SEQ ID NO: 1218894 - protein, 9 aa, Mycobacterium
PSSRHRDKA

SEQ ID NO: 1218895 - protein, 6 aa, Mycobacterium
PSSSAY

SEQ ID NO: 1218896 - protein, 10 aa, Mycobacterium
PSSSCDPNYS

SEQ ID NO: 1218897 - protein, 8 aa, Mycobacterium
PSSTPQRL

SEQ ID NO: 1218898 - protein, 10 aa, Mycobacterium
PSSVPSDRSY

SEQ ID NO: 1218899 - protein, 10 aa, Mycobacterium
PSSWKSAPSR

SEQ ID NO: 1218900 - protein, 16 aa, Mycobacterium
PSTAEAQDSAMSSRGY

SEQ ID NO: 1218901 - protein, 24 aa, Mycobacterium
PSTAPDAAGADEVTPIAADSTSAA

SEQ ID NO: 1218902 - protein, 9 aa, Mycobacterium
PSTASPRTW

SEQ ID NO: 1218903 - protein, 8 aa, Mycobacterium
PSTATTGA

SEQ ID NO: 1218904 - protein, 4 aa, Mycobacterium
PSTC

SEQ ID NO: 1218905 - protein, 6 aa, Mycobacterium
PSTGPS

SEQ ID NO: 1218906 - protein, 30 aa, Mycobacterium
PSTMTDHGAATGTSHHHNEHDHDPVDPGVD

SEQ ID NO: 1218907 - protein, 12 aa, Mycobacterium
PSTPIPDESEGD

SEQ ID NO: 1218908 - protein, 13 aa, Mycobacterium
PSTQGKKFDPSGD

SEQ ID NO: 1218909 - protein, 7 aa, Mycobacterium
PSTSEAV

SEQ ID NO: 1218910 - protein, 11 aa, Mycobacterium
PSVDGHPLDST

SEQ ID NO: 1218911 - protein, 10 aa, Mycobacterium
PSVEKGRRAG

SEQ ID NO: 1218912 - protein, 7 aa, Mycobacterium
PSVGPDD

SEQ ID NO: 1218913 - protein, 6 aa, Mycobacterium
PSVGYQ

SEQ ID NO: 1218914 - protein, 4 aa, Mycobacterium
PSVK

SEQ ID NO: 1218915 - protein, 12 aa, Mycobacterium
PSVKDLTRLLAP

SEQ ID NO: 1218916 - protein, 4 aa, Mycobacterium
PSVP

SEQ ID NO: 1218917 - protein, 4 aa, Mycobacterium
PSVR

SEQ ID NO: 1218918 - protein, 4 aa, Mycobacterium
PSVT

SEQ ID NO: 1218919 - protein, 8 aa, Mycobacterium
PSVTPDAV

SEQ ID NO: 1218920 - protein, 4 aa, Mycobacterium
PSWP

SEQ ID NO: 1218921 - protein, 14 aa, Mycobacterium
PSYDPARPARAYAP

SEQ ID NO: 1218922 - protein, 10 aa, Mycobacterium
PSYDPLDGGH

SEQ ID NO: 1218923 - protein, 5 aa, Mycobacterium
PSYPM

SEQ ID NO: 1218924 - protein, 12 aa, Mycobacterium
PSYQSGDPDVVT

SEQ ID NO: 1218925 - protein, 5 aa, Mycobacterium
PSYRP

SEQ ID NO: 1218926 - protein, 5 aa, Mycobacterium
PSYSG

SEQ ID NO: 1218927 - protein, 4 aa, Mycobacterium
PTAA

SEQ ID NO: 1218928 - protein, 10 aa, Mycobacterium
PTAAAPDSPQ

SEQ ID NO: 1218929 - protein, 35 aa, Mycobacterium
PTAADLESEGGGERAEQAAEAPEAGEAEAASESES

SEQ ID NO: 1218930 - protein, 18 aa, Mycobacterium
PTAAERGPLVGTTTKRAH

SEQ ID NO: 1218931 - protein, 7 aa, Mycobacterium
PTAAHAE

SEQ ID NO: 1218932 - protein, 23 aa, Mycobacterium
PTAATGKGGKAESSQDQQQQQNQ

SEQ ID NO: 1218933 - protein, 10 aa, Mycobacterium
PTADDMYPNG

SEQ ID NO: 1218934 - protein, 7 aa, Mycobacterium
PTADDPD

SEQ ID NO: 1218935 - protein, 5 aa, Mycobacterium
PTADY

SEQ ID NO: 1218936 - protein, 5 aa, Mycobacterium
PTAEA

SEQ ID NO: 1218937 - protein, 7 aa, Mycobacterium
PTAEATH

SEQ ID NO: 1218938 - protein, 6 aa, Mycobacterium
PTAEQQ

SEQ ID NO: 1218939 - protein, 21 aa, Mycobacterium
PTAERQFSADGAEWDPADLSD

SEQ ID NO: 1218940 - protein, 10 aa, Mycobacterium
PTAETDPLAS

SEQ ID NO: 1218941 - protein, 7 aa, Mycobacterium
PTAETTQ

SEQ ID NO: 1218942 - protein, 4 aa, Mycobacterium
PTAH

SEQ ID NO: 1218943 - protein, 7 aa, Mycobacterium
PTAPAAR

SEQ ID NO: 1218944 - protein, 14 aa, Mycobacterium
PTAPFPGKTLTNQN

SEQ ID NO: 1218945 - protein, 8 aa, Mycobacterium
PTAPNPDI

SEQ ID NO: 1218946 - protein, 8 aa, Mycobacterium
PTAPTLGA

SEQ ID NO: 1218947 - protein, 9 aa, Mycobacterium
PTAQLPPKN

SEQ ID NO: 1218948 - protein, 6 aa, Mycobacterium
PTAQPA

SEQ ID NO: 1218949 - protein, 9 aa, Mycobacterium
PTARDAATG

SEQ ID NO: 1218950 - protein, 4 aa, Mycobacterium
PTAS

SEQ ID NO: 1218951 - protein, 10 aa, Mycobacterium
PTASFAEQRA

SEQ ID NO: 1218952 - protein, 9 aa, Mycobacterium
PTASSSGQA

SEQ ID NO: 1218953 - protein, 8 aa, Mycobacterium
PTATGTRL

SEQ ID NO: 1218954 - protein, 8 aa, Mycobacterium
PTATLPGV

SEQ ID NO: 1218955 - protein, 9 aa, Mycobacterium
PTATTTHQA

SEQ ID NO: 1218956 - protein, 7 aa, Mycobacterium
PTAVPAS

SEQ ID NO: 1218957 - protein, 9 aa, Mycobacterium
PTAVPGAEP

SEQ ID NO: 1218958 - protein, 7 aa, Mycobacterium
PTAWPQS

SEQ ID NO: 1218959 - protein, 9 aa, Mycobacterium
PTAYTPDQR

SEQ ID NO: 1218960 - protein, 6 aa, Mycobacterium
PTCTGR

SEQ ID NO: 1218961 - protein, 20 aa, Mycobacterium
PTCTGTVSSVDEVDGERRAT

SEQ ID NO: 1218962 - protein, 10 aa, Mycobacterium
PTDASTLENK

SEQ ID NO: 1218963 - protein, 31 aa, Mycobacterium
PTDDGDVNQAGDDGDVNQAGDDGDVDQAGAD

SEQ ID NO: 1218964 - protein, 8 aa, Mycobacterium
PTDDPPTF

SEQ ID NO: 1218965 - protein, 4 aa, Mycobacterium
PTDE

SEQ ID NO: 1218966 - protein, 8 aa, Mycobacterium
PTDEEFAD

SEQ ID NO: 1218967 - protein, 6 aa, Mycobacterium
PTDEQA

SEQ ID NO: 1218968 - protein, 13 aa, Mycobacterium
PTDGAATIGQPAY

SEQ ID NO: 1218969 - protein, 6 aa, Mycobacterium
PTDGDA

SEQ ID NO: 1218970 - protein, 5 aa, Mycobacterium
PTDGR

SEQ ID NO: 1218971 - protein, 8 aa, Mycobacterium
PTDKGYDQ

SEQ ID NO: 1218972 - protein, 31 aa, Mycobacterium
PTDKRDHQRAVRKQRRKDRRDVANLRRDYDR

SEQ ID NO: 1218973 - protein, 4 aa, Mycobacterium
PTDL

SEQ ID NO: 1218974 - protein, 6 aa, Mycobacterium
PTDNPF

SEQ ID NO: 1218975 - protein, 8 aa, Mycobacterium
PTDNTVGI

SEQ ID NO: 1218976 - protein, 7 aa, Mycobacterium
PTDPADL

SEQ ID NO: 1218977 - protein, 13 aa, Mycobacterium
PTDPAKLSDELAA

SEQ ID NO: 1218978 - protein, 5 aa, Mycobacterium
PTDRD

SEQ ID NO: 1218979 - protein, 6 aa, Mycobacterium
PTDRIG

SEQ ID NO: 1218980 - protein, 8 aa, Mycobacterium
PTDSDGNV

SEQ ID NO: 1218981 - protein, 9 aa, Mycobacterium
PTDSDRPFT

SEQ ID NO: 1218982 - protein, 5 aa, Mycobacterium
PTDSW

SEQ ID NO: 1218983 - protein, 9 aa, Mycobacterium
PTDTDPVPA

SEQ ID NO: 1218984 - protein, 11 aa, Mycobacterium
PTDTRPQQTAI

SEQ ID NO: 1218985 - protein, 5 aa, Mycobacterium
PTDVG

SEQ ID NO: 1218986 - protein, 10 aa, Mycobacterium
PTDVRDAEAV

SEQ ID NO: 1218987 - protein, 9 aa, Mycobacterium
PTEAPAGTR

SEQ ID NO: 1218988 - protein, 7 aa, Mycobacterium
PTEDDSA

SEQ ID NO: 1218989 - protein, 6 aa, Mycobacterium
PTEEKV

SEQ ID NO: 1218990 - protein, 11 aa, Mycobacterium
PTEIDRARSDF

SEQ ID NO: 1218991 - protein, 4 aa, Mycobacterium
PTEL

SEQ ID NO: 1218992 - protein, 6 aa, Mycobacterium
PTELPD

SEQ ID NO: 1218993 - protein, 10 aa, Mycobacterium
PTENTPDGEG

SEQ ID NO: 1218994 - protein, 8 aa, Mycobacterium
PTEPEPPY

SEQ ID NO: 1218995 - protein, 8 aa, Mycobacterium
PTEPTPRK

SEQ ID NO: 1218996 - protein, 15 aa, Mycobacterium
PTERDLAAARDRLRN

SEQ ID NO: 1218997 - protein, 8 aa, Mycobacterium
PTESESLA

SEQ ID NO: 1218998 - protein, 5 aa, Mycobacterium
PTFDP

SEQ ID NO: 1218999 - protein, 5 aa, Mycobacterium
PTFTD

SEQ ID NO: 1219000 - protein, 6 aa, Mycobacterium
PTGDHQ

SEQ ID NO: 1219001 - protein, 12 aa, Mycobacterium
PTGDMGPSSRPI

SEQ ID NO: 1219002 - protein, 6 aa, Mycobacterium
PTGDQS

SEQ ID NO: 1219003 - protein, 12 aa, Mycobacterium
PTGDVGPSSRPI

SEQ ID NO: 1219004 - protein, 12 aa, Mycobacterium
PTGEAETDRQLE

SEQ ID NO: 1219005 - protein, 7 aa, Mycobacterium
PTGEDTV

SEQ ID NO: 1219006 - protein, 15 aa, Mycobacterium
PTGEPDADYDTYKHH

SEQ ID NO: 1219007 - protein, 5 aa, Mycobacterium
PTGGR

SEQ ID NO: 1219008 - protein, 7 aa, Mycobacterium
PTGHTPA

SEQ ID NO: 1219009 - protein, 4 aa, Mycobacterium
PTGL

SEQ ID NO: 1219010 - protein, 20 aa, Mycobacterium
PTGPAEGGEPATLGPKMGAA

SEQ ID NO: 1219011 - protein, 13 aa, Mycobacterium
PTGPRAKRGSRPT

SEQ ID NO: 1219012 - protein, 6 aa, Mycobacterium
PTGPRL

SEQ ID NO: 1219013 - protein, 6 aa, Mycobacterium
PTGRPL

SEQ ID NO: 1219014 - protein, 9 aa, Mycobacterium
PTGRRDPTR

SEQ ID NO: 1219015 - protein, 11 aa, Mycobacterium
PTGRVDNDLTN

SEQ ID NO: 1219016 - protein, 12 aa, Mycobacterium
PTGSTNAAPPTV

SEQ ID NO: 1219017 - protein, 12 aa, Mycobacterium
PTGSTNTAPPTV

SEQ ID NO: 1219018 - protein, 7 aa, Mycobacterium
PTGSTPV

SEQ ID NO: 1219019 - protein, 8 aa, Mycobacterium
PTGTGKSD

SEQ ID NO: 1219020 - protein, 6 aa, Mycobacterium
PTGYRN

SEQ ID NO: 1219021 - protein, 17 aa, Mycobacterium
PTHGADRTAARSPTAMG

SEQ ID NO: 1219022 - protein, 5 aa, Mycobacterium
PTHGS

SEQ ID NO: 1219023 - protein, 23 aa, Mycobacterium
PTHHEADQEELREKMKESSDRWR

SEQ ID NO: 1219024 - protein, 8 aa, Mycobacterium
PTHPDTTR

SEQ ID NO: 1219025 - protein, 14 aa, Mycobacterium
PTHPHPGVESAAAN

SEQ ID NO: 1219026 - protein, 5 aa, Mycobacterium
PTHRR

SEQ ID NO: 1219027 - protein, 5 aa, Mycobacterium
PTIPA

SEQ ID NO: 1219028 - protein, 12 aa, Mycobacterium
PTISGSLGSDQR

SEQ ID NO: 1219029 - protein, 5 aa, Mycobacterium
PTKEF

SEQ ID NO: 1219030 - protein, 9 aa, Mycobacterium
PTKHTGSSH

SEQ ID NO: 1219031 - protein, 10 aa, Mycobacterium
PTKITKDTAG

SEQ ID NO: 1219032 - protein, 39 aa, Mycobacterium
PTKKATPKKTEQKKPDRKPEKPAADSGEQERRRRRDKAK

SEQ ID NO: 1219033 - protein, 7 aa, Mycobacterium
PTKLTGK

SEQ ID NO: 1219034 - protein, 15 aa, Mycobacterium
PTKPPAGANDPSVGV

SEQ ID NO: 1219035 - protein, 6 aa, Mycobacterium
PTLDSA

SEQ ID NO: 1219036 - protein, 4 aa, Mycobacterium
PTLE

SEQ ID NO: 1219037 - protein, 12 aa, Mycobacterium
PTLGDNGADVPD

SEQ ID NO: 1219038 - protein, 10 aa, Mycobacterium
PTLGGPGGAI

SEQ ID NO: 1219039 - protein, 12 aa, Mycobacterium
PTLPQIPTTPRE

SEQ ID NO: 1219040 - protein, 7 aa, Mycobacterium
PTLPRYT

SEQ ID NO: 1219041 - protein, 16 aa, Mycobacterium
PTLPTDPGDRNRTSPF

SEQ ID NO: 1219042 - protein, 8 aa, Mycobacterium
PTLQQRGE

SEQ ID NO: 1219043 - protein, 10 aa, Mycobacterium
PTLTAAEQTE

SEQ ID NO: 1219044 - protein, 12 aa, Mycobacterium
PTLTRSTPEGAR

SEQ ID NO: 1219045 - protein, 11 aa, Mycobacterium
PTNAASEPTAL

SEQ ID NO: 1219046 - protein, 8 aa, Mycobacterium
PTNDADIN

SEQ ID NO: 1219047 - protein, 6 aa, Mycobacterium
PTNDLD

SEQ ID NO: 1219048 - protein, 7 aa, Mycobacterium
PTNDRSR

SEQ ID NO: 1219049 - protein, 8 aa, Mycobacterium
PTNGESAR

SEQ ID NO: 1219050 - protein, 10 aa, Mycobacterium
PTNGKVPGTR

SEQ ID NO: 1219051 - protein, 7 aa, Mycobacterium
PTNHGVE

SEQ ID NO: 1219052 - protein, 8 aa, Mycobacterium
PTNNLDAD

SEQ ID NO: 1219053 - protein, 6 aa, Mycobacterium
PTNNQM

SEQ ID NO: 1219054 - protein, 4 aa, Mycobacterium
PTNV

SEQ ID NO: 1219055 - protein, 20 aa, Mycobacterium
PTPAPCGKTPLTAKGLTKTY

SEQ ID NO: 1219056 - protein, 8 aa, Mycobacterium
PTPAPERG

SEQ ID NO: 1219057 - protein, 6 aa, Mycobacterium
PTPAPG

SEQ ID NO: 1219058 - protein, 17 aa, Mycobacterium
PTPAPVPGPGPAPGPAA

SEQ ID NO: 1219059 - protein, 5 aa, Mycobacterium
PTPAR

SEQ ID NO: 1219060 - protein, 11 aa, Mycobacterium
PTPARGDEPPL

SEQ ID NO: 1219061 - protein, 15 aa, Mycobacterium
PTPARRRARAASSTL

SEQ ID NO: 1219062 - protein, 10 aa, Mycobacterium
PTPATEDADD

SEQ ID NO: 1219063 - protein, 13 aa, Mycobacterium
PTPAVGGSPTDEA

SEQ ID NO: 1219064 - protein, 11 aa, Mycobacterium
PTPDAASSWEE

SEQ ID NO: 1219065 - protein, 17 aa, Mycobacterium
PTPDEARASAAELAARS

SEQ ID NO: 1219066 - protein, 9 aa, Mycobacterium
PTPDTGTLR

SEQ ID NO: 1219067 - protein, 15 aa, Mycobacterium
PTPEGNAAAYYPETN

SEQ ID NO: 1219068 - protein, 16 aa, Mycobacterium
PTPEKAAASEAALIAR

SEQ ID NO: 1219069 - protein, 7 aa, Mycobacterium
PTPGAAP

SEQ ID NO: 1219070 - protein, 11 aa, Mycobacterium
PTPGFTAEPAY

SEQ ID NO: 1219071 - protein, 8 aa, Mycobacterium
PTPGHSPG

SEQ ID NO: 1219072 - protein, 10 aa, Mycobacterium
PTPGHSPGSV

SEQ ID NO: 1219073 - protein, 4 aa, Mycobacterium
PTPH

SEQ ID NO: 1219074 - protein, 13 aa, Mycobacterium
PTPLSGEAAEETV

SEQ ID NO: 1219075 - protein, 7 aa, Mycobacterium
PTPMNRT

SEQ ID NO: 1219076 - protein, 7 aa, Mycobacterium
PTPNSLA

SEQ ID NO: 1219077 - protein, 10 aa, Mycobacterium
PTPPGVDRSP

SEQ ID NO: 1219078 - protein, 11 aa, Mycobacterium
PTPQSVPAVPD

SEQ ID NO: 1219079 - protein, 4 aa, Mycobacterium
PTPR

SEQ ID NO: 1219080 - protein, 7 aa, Mycobacterium
PTPRATR

SEQ ID NO: 1219081 - protein, 6 aa, Mycobacterium
PTPRQR

SEQ ID NO: 1219082 - protein, 9 aa, Mycobacterium
PTPRQYTRK

SEQ ID NO: 1219083 - protein, 13 aa, Mycobacterium
PTPSATAAAGPAD

SEQ ID NO: 1219084 - protein, 7 aa, Mycobacterium
PTPSNEV

SEQ ID NO: 1219085 - protein, 22 aa, Mycobacterium
PTPSVYSTPPRKSAGGDDRGAT

SEQ ID NO: 1219086 - protein, 12 aa, Mycobacterium
PTPTKPGRPAPG

SEQ ID NO: 1219087 - protein, 14 aa, Mycobacterium
PTPTPTPTPTPTRT

SEQ ID NO: 1219088 - protein, 85 aa, Mycobacterium
PTPVEPPQHGPAATPYIGGGSSVPMPAPQSTSRTAHPQGSAPRPWAGTNPTAAPASPTPQPTGAPGTRTGSLPGQGAGNRGAAPL

SEQ ID NO: 1219089 - protein, 15 aa, Mycobacterium
PTPWRADGRPRRAGV

SEQ ID NO: 1219090 - protein, 6 aa, Mycobacterium
PTPWSA

SEQ ID NO: 1219091 - protein, 4 aa, Mycobacterium
PTPY

SEQ ID NO: 1219092 - protein, 4 aa, Mycobacterium
PTQM

SEQ ID NO: 1219093 - protein, 14 aa, Mycobacterium
PTQSGRRVTDDLLE

SEQ ID NO: 1219094 - protein, 11 aa, Mycobacterium
PTRANALTPEA

SEQ ID NO: 1219095 - protein, 10 aa, Mycobacterium
PTRAPHGGES

SEQ ID NO: 1219096 - protein, 8 aa, Mycobacterium
PTRARDGE

SEQ ID NO: 1219097 - protein, 15 aa, Mycobacterium
PTRAYGGTYPALPQT

SEQ ID NO: 1219098 - protein, 9 aa, Mycobacterium
PTRDPEAAA

SEQ ID NO: 1219099 - protein, 17 aa, Mycobacterium
PTRFGADGEVPPAEADA

SEQ ID NO: 1219100 - protein, 13 aa, Mycobacterium
PTRGAGPVGITAT

SEQ ID NO: 1219101 - protein, 7 aa, Mycobacterium
PTRHGPV

SEQ ID NO: 1219102 - protein, 7 aa, Mycobacterium
PTRHRQE

SEQ ID NO: 1219103 - protein, 4 aa, Mycobacterium
PTRI

SEQ ID NO: 1219104 - protein, 14 aa, Mycobacterium
PTRLDQPAEPITRA

SEQ ID NO: 1219105 - protein, 53 aa, Mycobacterium
PTRPLPPQPRRPDGWEQQQPPPGWAPQAPPSAPPYPPRPQADAPWTAPQPTSY

SEQ ID NO: 1219106 - protein, 11 aa, Mycobacterium
PTRPPAEHGDD

SEQ ID NO: 1219107 - protein, 6 aa, Mycobacterium
PTRSIG

SEQ ID NO: 1219108 - protein, 5 aa, Mycobacterium
PTRTA

SEQ ID NO: 1219109 - protein, 12 aa, Mycobacterium
PTRTGRRLSTDT

SEQ ID NO: 1219110 - protein, 25 aa, Mycobacterium
PTRVSPTGASKSTDEQPDPRAQSGR

SEQ ID NO: 1219111 - protein, 4 aa, Mycobacterium
PTRW

SEQ ID NO: 1219112 - protein, 27 aa, Mycobacterium
PTSAGVATSTDEFTGAPGTPGTGGVDT

SEQ ID NO: 1219113 - protein, 6 aa, Mycobacterium
PTSDAR

SEQ ID NO: 1219114 - protein, 14 aa, Mycobacterium
PTSEASPAKPGTRS

SEQ ID NO: 1219115 - protein, 7 aa, Mycobacterium
PTSEGRL

SEQ ID NO: 1219116 - protein, 18 aa, Mycobacterium
PTSENLEDRTATGTSEKG

SEQ ID NO: 1219117 - protein, 7 aa, Mycobacterium
PTSGDEL

SEQ ID NO: 1219118 - protein, 10 aa, Mycobacterium
PTSGLDPVNA

SEQ ID NO: 1219119 - protein, 15 aa, Mycobacterium
PTSGTLTVDGRDVTK

SEQ ID NO: 1219120 - protein, 6 aa, Mycobacterium
PTSHAA

SEQ ID NO: 1219121 - protein, 9 aa, Mycobacterium
PTSNPGAVT

SEQ ID NO: 1219122 - protein, 4 aa, Mycobacterium
PTSP

SEQ ID NO: 1219123 - protein, 14 aa, Mycobacterium
PTSPDDPAAPANRA

SEQ ID NO: 1219124 - protein, 11 aa, Mycobacterium
PTSRSVYPAED

SEQ ID NO: 1219125 - protein, 15 aa, Mycobacterium
PTSSPGTTLTGQHRD

SEQ ID NO: 1219126 - protein, 7 aa, Mycobacterium
PTSTPGF

SEQ ID NO: 1219127 - protein, 5 aa, Mycobacterium
PTTAV

SEQ ID NO: 1219128 - protein, 5 aa, Mycobacterium
PTTDA

SEQ ID NO: 1219129 - protein, 6 aa, Mycobacterium
PTTDRV

SEQ ID NO: 1219130 - protein, 10 aa, Mycobacterium
PTTGLDPRSR

SEQ ID NO: 1219131 - protein, 10 aa, Mycobacterium
PTTGLDPSVQ

SEQ ID NO: 1219132 - protein, 10 aa, Mycobacterium
PTTGLDTDSA

SEQ ID NO: 1219133 - protein, 7 aa, Mycobacterium
PTTIGDQ

SEQ ID NO: 1219134 - protein, 6 aa, Mycobacterium
PTTNPV

SEQ ID NO: 1219135 - protein, 20 aa, Mycobacterium
PTTPPKPGVTRVPDGVEGAA

SEQ ID NO: 1219136 - protein, 13 aa, Mycobacterium
PTTSGTGSEVSPA

SEQ ID NO: 1219137 - protein, 11 aa, Mycobacterium
PTTSGTGSEVT

SEQ ID NO: 1219138 - protein, 6 aa, Mycobacterium
PTTTAG

SEQ ID NO: 1219139 - protein, 4 aa, Mycobacterium
PTTV

SEQ ID NO: 1219140 - protein, 7 aa, Mycobacterium
PTVDSPS

SEQ ID NO: 1219141 - protein, 4 aa, Mycobacterium
PTVR

SEQ ID NO: 1219142 - protein, 10 aa, Mycobacterium
PTVRGGTMNP

SEQ ID NO: 1219143 - protein, 10 aa, Mycobacterium
PTVRSPTAIG

SEQ ID NO: 1219144 - protein, 15 aa, Mycobacterium
PTVSSPPAEAPAAGL

SEQ ID NO: 1219145 - protein, 18 aa, Mycobacterium
PTVTGKPAGGDLSEHKAT

SEQ ID NO: 1219146 - protein, 5 aa, Mycobacterium
PTWST

SEQ ID NO: 1219147 - protein, 6 aa, Mycobacterium
PTYPQD

SEQ ID NO: 1219148 - protein, 5 aa, Mycobacterium
PTYSQ

SEQ ID NO: 1219149 - protein, 7 aa, Mycobacterium
PVADDRT

SEQ ID NO: 1219150 - protein, 7 aa, Mycobacterium
PVADEQT

SEQ ID NO: 1219151 - protein, 8 aa, Mycobacterium
PVAEPTAR

SEQ ID NO: 1219152 - protein, 5 aa, Mycobacterium
PVAGF

SEQ ID NO: 1219153 - protein, 13 aa, Mycobacterium
PVAPGTPRGQRTP

SEQ ID NO: 1219154 - protein, 7 aa, Mycobacterium
PVAPPKP

SEQ ID NO: 1219155 - protein, 10 aa, Mycobacterium
PVAPPSVPPL

SEQ ID NO: 1219156 - protein, 16 aa, Mycobacterium
PVAPTRATNKTPRSAP

SEQ ID NO: 1219157 - protein, 4 aa, Mycobacterium
PVAS

SEQ ID NO: 1219158 - protein, 14 aa, Mycobacterium
PVASPTEEPDEAPH

SEQ ID NO: 1219159 - protein, 5 aa, Mycobacterium
PVATE

SEQ ID NO: 1219160 - protein, 13 aa, Mycobacterium
PVATGDGADLSSA

SEQ ID NO: 1219161 - protein, 5 aa, Mycobacterium
PVATR

SEQ ID NO: 1219162 - protein, 11 aa, Mycobacterium
PVDCGKAKREL

SEQ ID NO: 1219163 - protein, 13 aa, Mycobacterium
PVDDDGNISDPGR

SEQ ID NO: 1219164 - protein, 7 aa, Mycobacterium
PVDDDRG

SEQ ID NO: 1219165 - protein, 5 aa, Mycobacterium
PVDDP

SEQ ID NO: 1219166 - protein, 6 aa, Mycobacterium
PVDEPE

SEQ ID NO: 1219167 - protein, 8 aa, Mycobacterium
PVDESTSD

SEQ ID NO: 1219168 - protein, 6 aa, Mycobacterium
PVDETG

SEQ ID NO: 1219169 - protein, 8 aa, Mycobacterium
PVDPDELA

SEQ ID NO: 1219170 - protein, 12 aa, Mycobacterium
PVDPGRGGDRTG

SEQ ID NO: 1219171 - protein, 11 aa, Mycobacterium
PVDPMPTNEDQ

SEQ ID NO: 1219172 - protein, 8 aa, Mycobacterium
PVDPTNNK

SEQ ID NO: 1219173 - protein, 10 aa, Mycobacterium
PVDQSGYGFD

SEQ ID NO: 1219174 - protein, 9 aa, Mycobacterium
PVDSDGSRD

SEQ ID NO: 1219175 - protein, 20 aa, Mycobacterium
PVDTATAPIPPAYSPTSPVR

SEQ ID NO: 1219176 - protein, 15 aa, Mycobacterium
PVDTGADPTLGAERA

SEQ ID NO: 1219177 - protein, 6 aa, Mycobacterium
PVDTSA

SEQ ID NO: 1219178 - protein, 10 aa, Mycobacterium
PVEAGGYGFD

SEQ ID NO: 1219179 - protein, 5 aa, Mycobacterium
PVEGA

SEQ ID NO: 1219180 - protein, 24 aa, Mycobacterium
PVEKPGEADTGAGPASMAPPDAVR

SEQ ID NO: 1219181 - protein, 5 aa, Mycobacterium
PVELE

SEQ ID NO: 1219182 - protein, 15 aa, Mycobacterium
PVEPPSTGAPGDAVD

SEQ ID NO: 1219183 - protein, 5 aa, Mycobacterium
PVEPV

SEQ ID NO: 1219184 - protein, 11 aa, Mycobacterium
PVERSAAAQSL

SEQ ID NO: 1219185 - protein, 19 aa, Mycobacterium
PVESAPAPVADESASGATE

SEQ ID NO: 1219186 - protein, 7 aa, Mycobacterium
PVETGAA

SEQ ID NO: 1219187 - protein, 28 aa, Mycobacterium
PVETHGEAAPGSGSPAAHPAGTEPPETV

SEQ ID NO: 1219188 - protein, 12 aa, Mycobacterium
PVGAGAAVPGPL

SEQ ID NO: 1219189 - protein, 8 aa, Mycobacterium
PVGAGVDE

SEQ ID NO: 1219190 - protein, 6 aa, Mycobacterium
PVGATA

SEQ ID NO: 1219191 - protein, 7 aa, Mycobacterium
PVGATGG

SEQ ID NO: 1219192 - protein, 6 aa, Mycobacterium
PVGDDR

SEQ ID NO: 1219193 - protein, 5 aa, Mycobacterium
PVGEG

SEQ ID NO: 1219194 - protein, 7 aa, Mycobacterium
PVGGAGS

SEQ ID NO: 1219195 - protein, 14 aa, Mycobacterium
PVGGSRSRRPRRGC

SEQ ID NO: 1219196 - protein, 8 aa, Mycobacterium
PVGNEEGE

SEQ ID NO: 1219197 - protein, 12 aa, Mycobacterium
PVGNTSDERVQN

SEQ ID NO: 1219198 - protein, 11 aa, Mycobacterium
PVGPDNDAHLD

SEQ ID NO: 1219199 - protein, 36 aa, Mycobacterium
PVGPPPGVEPKPLKGMPPFSGPQGPFAGVTSGPDGT

SEQ ID NO: 1219200 - protein, 15 aa, Mycobacterium
PVGPPPGVEPKPLRG

SEQ ID NO: 1219201 - protein, 8 aa, Mycobacterium
PVGPYADA

SEQ ID NO: 1219202 - protein, 13 aa, Mycobacterium
PVGRSTKDGRALS

SEQ ID NO: 1219203 - protein, 5 aa, Mycobacterium
PVGTE

SEQ ID NO: 1219204 - protein, 6 aa, Mycobacterium
PVGTTR

SEQ ID NO: 1219205 - protein, 14 aa, Mycobacterium
PVGTTTRKADLSNL

SEQ ID NO: 1219206 - protein, 9 aa, Mycobacterium
PVHSDGPHY

SEQ ID NO: 1219207 - protein, 15 aa, Mycobacterium
PVKAAASRLLSVPAG

SEQ ID NO: 1219208 - protein, 14 aa, Mycobacterium
PVKGAQEADSDAYR

SEQ ID NO: 1219209 - protein, 10 aa, Mycobacterium
PVKGGEGGSR

SEQ ID NO: 1219210 - protein, 21 aa, Mycobacterium
PVKIEEPDLAQAGAAGGPSAA

SEQ ID NO: 1219211 - protein, 54 aa, Mycobacterium
PVKKTPAKKTPAKKAVEPAKAAAAKKTPAKKTPAKKAPAKKAPAKKAVKRPGNP

SEQ ID NO: 1219212 - protein, 5 aa, Mycobacterium
PVKPK

SEQ ID NO: 1219213 - protein, 11 aa, Mycobacterium
PVLSDEQPDVA

SEQ ID NO: 1219214 - protein, 20 aa, Mycobacterium
PVLTSSQHPASSVQAYRSEL

SEQ ID NO: 1219215 - protein, 4 aa, Mycobacterium
PVMT

SEQ ID NO: 1219216 - protein, 4 aa, Mycobacterium
PVNE

SEQ ID NO: 1219217 - protein, 6 aa, Mycobacterium
PVNPAG

SEQ ID NO: 1219218 - protein, 5 aa, Mycobacterium
PVNPG

SEQ ID NO: 1219219 - protein, 19 aa, Mycobacterium
PVNPSGGLKAKGHPPGATG

SEQ ID NO: 1219220 - protein, 16 aa, Mycobacterium
PVNPSGGVLSSNPIGA

SEQ ID NO: 1219221 - protein, 8 aa, Mycobacterium
PVNSSPSW

SEQ ID NO: 1219222 - protein, 6 aa, Mycobacterium
PVPADN

SEQ ID NO: 1219223 - protein, 24 aa, Mycobacterium
PVPADTEPFTPDAPGNTSHRSRST

SEQ ID NO: 1219224 - protein, 5 aa, Mycobacterium
PVPAR

SEQ ID NO: 1219225 - protein, 5 aa, Mycobacterium
PVPAT

SEQ ID NO: 1219226 - protein, 17 aa, Mycobacterium
PVPDGDTAKVSKAGEAW

SEQ ID NO: 1219227 - protein, 16 aa, Mycobacterium
PVPDTESAGGQPHTGT

SEQ ID NO: 1219228 - protein, 4 aa, Mycobacterium
PVPE

SEQ ID NO: 1219229 - protein, 5 aa, Mycobacterium
PVPET

SEQ ID NO: 1219230 - protein, 4 aa, Mycobacterium
PVPG

SEQ ID NO: 1219231 - protein, 14 aa, Mycobacterium
PVPGAPYGLAGSSG

SEQ ID NO: 1219232 - protein, 19 aa, Mycobacterium
PVPGDQEGSNFNADVDDVS

SEQ ID NO: 1219233 - protein, 6 aa, Mycobacterium
PVPGFR

SEQ ID NO: 1219234 - protein, 6 aa, Mycobacterium
PVPGLA

SEQ ID NO: 1219235 - protein, 14 aa, Mycobacterium
PVPGPTDDKYTQGV

SEQ ID NO: 1219236 - protein, 17 aa, Mycobacterium
PVPGYHAPREQTVGPGT

SEQ ID NO: 1219237 - protein, 18 aa, Mycobacterium
PVPGYRAPAERTTEPGTR

SEQ ID NO: 1219238 - protein, 12 aa, Mycobacterium
PVPPPAGPEEGY

SEQ ID NO: 1219239 - protein, 14 aa, Mycobacterium
PVPPPTPPPPPPAH

SEQ ID NO: 1219240 - protein, 6 aa, Mycobacterium
PVPPQV

SEQ ID NO: 1219241 - protein, 5 aa, Mycobacterium
PVPQE

SEQ ID NO: 1219242 - protein, 18 aa, Mycobacterium
PVPQPAHRGPGVRNRPPA

SEQ ID NO: 1219243 - protein, 9 aa, Mycobacterium
PVPQPGPDE

SEQ ID NO: 1219244 - protein, 10 aa, Mycobacterium
PVPQPPSGYP

SEQ ID NO: 1219245 - protein, 9 aa, Mycobacterium
PVPRDYDPE

SEQ ID NO: 1219246 - protein, 12 aa, Mycobacterium
PVPSELGGSVDP

SEQ ID NO: 1219247 - protein, 8 aa, Mycobacterium
PVPSGPAL

SEQ ID NO: 1219248 - protein, 10 aa, Mycobacterium
PVPSSTESAH

SEQ ID NO: 1219249 - protein, 8 aa, Mycobacterium
PVPSTEPT

SEQ ID NO: 1219250 - protein, 5 aa, Mycobacterium
PVPTE

SEQ ID NO: 1219251 - protein, 13 aa, Mycobacterium
PVPTGLDDGSPVT

SEQ ID NO: 1219252 - protein, 8 aa, Mycobacterium
PVPTSPGL

SEQ ID NO: 1219253 - protein, 20 aa, Mycobacterium
PVPVPESLRSSPPEEQAANT

SEQ ID NO: 1219254 - protein, 7 aa, Mycobacterium
PVPWPDG

SEQ ID NO: 1219255 - protein, 18 aa, Mycobacterium
PVPWSRPADSDLLPPEQN

SEQ ID NO: 1219256 - protein, 10 aa, Mycobacterium
PVQASGTGTL

SEQ ID NO: 1219257 - protein, 7 aa, Mycobacterium
PVQGPRA

SEQ ID NO: 1219258 - protein, 4 aa, Mycobacterium
PVQP

SEQ ID NO: 1219259 - protein, 5 aa, Mycobacterium
PVQPG

SEQ ID NO: 1219260 - protein, 5 aa, Mycobacterium
PVQPL

SEQ ID NO: 1219261 - protein, 4 aa, Mycobacterium
PVQQ

SEQ ID NO: 1219262 - protein, 5 aa, Mycobacterium
PVQRE

SEQ ID NO: 1219263 - protein, 6 aa, Mycobacterium
PVQSTA

SEQ ID NO: 1219264 - protein, 7 aa, Mycobacterium
PVRAGDA

SEQ ID NO: 1219265 - protein, 7 aa, Mycobacterium
PVREDAR

SEQ ID NO: 1219266 - protein, 7 aa, Mycobacterium
PVRGPEP

SEQ ID NO: 1219267 - protein, 9 aa, Mycobacterium
PVRGTGKEV

SEQ ID NO: 1219268 - protein, 7 aa, Mycobacterium
PVRHPDD

SEQ ID NO: 1219269 - protein, 5 aa, Mycobacterium
PVRKR

SEQ ID NO: 1219270 - protein, 14 aa, Mycobacterium
PVRPAAPTTKRTRR

SEQ ID NO: 1219271 - protein, 12 aa, Mycobacterium
PVRPGVGDADEK

SEQ ID NO: 1219272 - protein, 7 aa, Mycobacterium
PVRPTDA

SEQ ID NO: 1219273 - protein, 6 aa, Mycobacterium
PVRSDG

SEQ ID NO: 1219274 - protein, 8 aa, Mycobacterium
PVRTNRTN

SEQ ID NO: 1219275 - protein, 16 aa, Mycobacterium
PVRTSGMTPYVTRLIE

SEQ ID NO: 1219276 - protein, 8 aa, Mycobacterium
PVSAGTDE

SEQ ID NO: 1219277 - protein, 6 aa, Mycobacterium
PVSAPT

SEQ ID NO: 1219278 - protein, 12 aa, Mycobacterium
PVSATESTNPVG

SEQ ID NO: 1219279 - protein, 7 aa, Mycobacterium
PVSDDDV

SEQ ID NO: 1219280 - protein, 27 aa, Mycobacterium
PVSDESDSGSVASPAPVAAADPDDDVV

SEQ ID NO: 1219281 - protein, 12 aa, Mycobacterium
PVSDGAAEEAEI

SEQ ID NO: 1219282 - protein, 8 aa, Mycobacterium
PVSEEANR

SEQ ID NO: 1219283 - protein, 22 aa, Mycobacterium
PVSESSVPAGPRARVSTRSDDG

SEQ ID NO: 1219284 - protein, 13 aa, Mycobacterium
PVSGGAGAADKGE

SEQ ID NO: 1219285 - protein, 11 aa, Mycobacterium
PVSGGGPAVEQ

SEQ ID NO: 1219286 - protein, 9 aa, Mycobacterium
PVSGGPHDI

SEQ ID NO: 1219287 - protein, 8 aa, Mycobacterium
PVSGQSLD

SEQ ID NO: 1219288 - protein, 11 aa, Mycobacterium
PVSGTADDIAA

SEQ ID NO: 1219289 - protein, 7 aa, Mycobacterium
PVSPEAQ

SEQ ID NO: 1219290 - protein, 16 aa, Mycobacterium
PVSPRRSTKAAATGPV

SEQ ID NO: 1219291 - protein, 6 aa, Mycobacterium
PVSPTL

SEQ ID NO: 1219292 - protein, 5 aa, Mycobacterium
PVSRE

SEQ ID NO: 1219293 - protein, 10 aa, Mycobacterium
PVSRGSETPL

SEQ ID NO: 1219294 - protein, 10 aa, Mycobacterium
PVSSGAPLDG

SEQ ID NO: 1219295 - protein, 13 aa, Mycobacterium
PVSTDELTAAIDR

SEQ ID NO: 1219296 - protein, 7 aa, Mycobacterium
PVSVDGR

SEQ ID NO: 1219297 - protein, 11 aa, Mycobacterium
PVTAATRAARR

SEQ ID NO: 1219298 - protein, 14 aa, Mycobacterium
PVTANPAPPEEHPR

SEQ ID NO: 1219299 - protein, 14 aa, Mycobacterium
PVTAPPPPQGDPRE

SEQ ID NO: 1219300 - protein, 5 aa, Mycobacterium
PVTAS

SEQ ID NO: 1219301 - protein, 8 aa, Mycobacterium
PVTDDGDL

SEQ ID NO: 1219302 - protein, 7 aa, Mycobacterium
PVTDSDQ

SEQ ID NO: 1219303 - protein, 7 aa, Mycobacterium
PVTEPAD

SEQ ID NO: 1219304 - protein, 8 aa, Mycobacterium
PVTERRDE

SEQ ID NO: 1219305 - protein, 8 aa, Mycobacterium
PVTGDAQR

SEQ ID NO: 1219306 - protein, 6 aa, Mycobacterium
PVTGRE

SEQ ID NO: 1219307 - protein, 4 aa, Mycobacterium
PVTP

SEQ ID NO: 1219308 - protein, 7 aa, Mycobacterium
PVTPVPD

SEQ ID NO: 1219309 - protein, 8 aa, Mycobacterium
PVTRRNDP

SEQ ID NO: 1219310 - protein, 9 aa, Mycobacterium
PVTSPARTA

SEQ ID NO: 1219311 - protein, 8 aa, Mycobacterium
PVTSRTRT

SEQ ID NO: 1219312 - protein, 9 aa, Mycobacterium
PVTTPTRTA

SEQ ID NO: 1219313 - protein, 12 aa, Mycobacterium
PVVASSANPAEV

SEQ ID NO: 1219314 - protein, 4 aa, Mycobacterium
PVVD

SEQ ID NO: 1219315 - protein, 4 aa, Mycobacterium
PVYA

SEQ ID NO: 1219316 - protein, 19 aa, Mycobacterium
PVYAPNSMGGPHADPRRAS

SEQ ID NO: 1219317 - protein, 13 aa, Mycobacterium
PWAADGKLSPKSV

SEQ ID NO: 1219318 - protein, 7 aa, Mycobacterium
PWEPSTD

SEQ ID NO: 1219319 - protein, 21 aa, Mycobacterium
PWGNYTGPQWASQSRHGPDTD

SEQ ID NO: 1219320 - protein, 21 aa, Mycobacterium
PWGPDKITDDGREQLRALGFT

SEQ ID NO: 1219321 - protein, 7 aa, Mycobacterium
PWGSTPP

SEQ ID NO: 1219322 - protein, 5 aa, Mycobacterium
PWPDP

SEQ ID NO: 1219323 - protein, 5 aa, Mycobacterium
PWPPV

SEQ ID NO: 1219324 - protein, 8 aa, Mycobacterium
PWPRQEGR

SEQ ID NO: 1219325 - protein, 9 aa, Mycobacterium
PWPSGPKTA

SEQ ID NO: 1219326 - protein, 11 aa, Mycobacterium
PWPTADPPPEV

SEQ ID NO: 1219327 - protein, 16 aa, Mycobacterium
PWQETSDTRTPTPDAG

SEQ ID NO: 1219328 - protein, 4 aa, Mycobacterium
PWQG

SEQ ID NO: 1219329 - protein, 10 aa, Mycobacterium
PWQGPNPREF

SEQ ID NO: 1219330 - protein, 4 aa, Mycobacterium
PWRA

SEQ ID NO: 1219331 - protein, 5 aa, Mycobacterium
PWRDN

SEQ ID NO: 1219332 - protein, 8 aa, Mycobacterium
PWSAYGES

SEQ ID NO: 1219333 - protein, 18 aa, Mycobacterium
PWSDGSVGALGSSYSGAA

SEQ ID NO: 1219334 - protein, 11 aa, Mycobacterium
PWSTGSQGYAN

SEQ ID NO: 1219335 - protein, 11 aa, Mycobacterium
PWTRSGRSRVA

SEQ ID NO: 1219336 - protein, 4 aa, Mycobacterium
PYAG

SEQ ID NO: 1219337 - protein, 13 aa, Mycobacterium
PYAPQGVATPVDG

SEQ ID NO: 1219338 - protein, 6 aa, Mycobacterium
PYAPRD

SEQ ID NO: 1219339 - protein, 10 aa, Mycobacterium
PYAQARDDYD

SEQ ID NO: 1219340 - protein, 11 aa, Mycobacterium
PYDGGDDGAVE

SEQ ID NO: 1219341 - protein, 6 aa, Mycobacterium
PYDGPF

SEQ ID NO: 1219342 - protein, 6 aa, Mycobacterium
PYDPAA

SEQ ID NO: 1219343 - protein, 7 aa, Mycobacterium
PYDSDDA

SEQ ID NO: 1219344 - protein, 8 aa, Mycobacterium
PYDTDDDA

SEQ ID NO: 1219345 - protein, 7 aa, Mycobacterium
PYEGPAG

SEQ ID NO: 1219346 - protein, 4 aa, Mycobacterium
PYEH

SEQ ID NO: 1219347 - protein, 15 aa, Mycobacterium
PYEISSADGWRANPE

SEQ ID NO: 1219348 - protein, 16 aa, Mycobacterium
PYEQGKEATVERDPGI

SEQ ID NO: 1219349 - protein, 26 aa, Mycobacterium
PYGAESAPPADAQLPAPPADAQPGGG

SEQ ID NO: 1219350 - protein, 10 aa, Mycobacterium
PYGNSGPRID

SEQ ID NO: 1219351 - protein, 7 aa, Mycobacterium
PYGPHTG

SEQ ID NO: 1219352 - protein, 6 aa, Mycobacterium
PYGQAR

SEQ ID NO: 1219353 - protein, 29 aa, Mycobacterium
PYGRQENWEDSPPGWPQQPPYEWIRLHDA

SEQ ID NO: 1219354 - protein, 5 aa, Mycobacterium
PYHER

SEQ ID NO: 1219355 - protein, 11 aa, Mycobacterium
PYHGRSGNAGH

SEQ ID NO: 1219356 - protein, 14 aa, Mycobacterium
PYLDPGEREGFNEQ

SEQ ID NO: 1219357 - protein, 4 aa, Mycobacterium
PYNG

SEQ ID NO: 1219358 - protein, 6 aa, Mycobacterium
PYPAHD

SEQ ID NO: 1219359 - protein, 10 aa, Mycobacterium
PYPDPSQRAA

SEQ ID NO: 1219360 - protein, 6 aa, Mycobacterium
PYPDTA

SEQ ID NO: 1219361 - protein, 4 aa, Mycobacterium
PYPE

SEQ ID NO: 1219362 - protein, 13 aa, Mycobacterium
PYPEIGTRDDPAD

SEQ ID NO: 1219363 - protein, 19 aa, Mycobacterium
PYPGETSKMSERPSDEMTD

SEQ ID NO: 1219364 - protein, 26 aa, Mycobacterium
PYPGQTADMTPQPRDEMRDYTGTGLL

SEQ ID NO: 1219365 - protein, 21 aa, Mycobacterium
PYPPNYPKMPGEPPRVQPSKK

SEQ ID NO: 1219366 - protein, 4 aa, Mycobacterium
PYPQ

SEQ ID NO: 1219367 - protein, 5 aa, Mycobacterium
PYQNI

SEQ ID NO: 1219368 - protein, 13 aa, Mycobacterium
PYQPPTPPSAAGN

SEQ ID NO: 1219369 - protein, 19 aa, Mycobacterium
PYQSSTGWREPDYGNDPPP

SEQ ID NO: 1219370 - protein, 5 aa, Mycobacterium
PYRGG

SEQ ID NO: 1219371 - protein, 12 aa, Mycobacterium
PYRLPQRLSLRT

SEQ ID NO: 1219372 - protein, 7 aa, Mycobacterium
PYSAPGE

SEQ ID NO: 1219373 - protein, 11 aa, Mycobacterium
PYSENAPGRQE

SEQ ID NO: 1219374 - protein, 17 aa, Mycobacterium
PYTDAPEGCPAPTGNSY

SEQ ID NO: 1219375 - protein, 8 aa, Mycobacterium
PYTGSYTE

SEQ ID NO: 1219376 - protein, 29 aa, Mycobacterium
PYVPVPDADGETIPAAAGPSRAWDAGPDG

SEQ ID NO: 1219377 - protein, 5 aa, Mycobacterium
PYYGT

SEQ ID NO: 1219378 - protein, 13 aa, Mycobacterium
QAAADAGRPPGSV

SEQ ID NO: 1219379 - protein, 7 aa, Mycobacterium
QAAANAG

SEQ ID NO: 1219380 - protein, 16 aa, Mycobacterium
QAAAPRVDSLEPGNSI

SEQ ID NO: 1219381 - protein, 5 aa, Mycobacterium
QAAAR

SEQ ID NO: 1219382 - protein, 9 aa, Mycobacterium
QAAATGDLA

SEQ ID NO: 1219383 - protein, 4 aa, Mycobacterium
QAAD

SEQ ID NO: 1219384 - protein, 7 aa, Mycobacterium
QAADQAG

SEQ ID NO: 1219385 - protein, 16 aa, Mycobacterium
QAADSARARGAPAAAA

SEQ ID NO: 1219386 - protein, 7 aa, Mycobacterium
QAADTGA

SEQ ID NO: 1219387 - protein, 4 aa, Mycobacterium
QAAE

SEQ ID NO: 1219388 - protein, 6 aa, Mycobacterium
QAAEDA

SEQ ID NO: 1219389 - protein, 8 aa, Mycobacterium
QAAESEQI

SEQ ID NO: 1219390 - protein, 7 aa, Mycobacterium
QAAGAAP

SEQ ID NO: 1219391 - protein, 6 aa, Mycobacterium
QAAGAE

SEQ ID NO: 1219392 - protein, 7 aa, Mycobacterium
QAAGGQV

SEQ ID NO: 1219393 - protein, 8 aa, Mycobacterium
QAAGITRE

SEQ ID NO: 1219394 - protein, 9 aa, Mycobacterium
QAAGPASSI

SEQ ID NO: 1219395 - protein, 9 aa, Mycobacterium
QAAGQSNTS

SEQ ID NO: 1219396 - protein, 22 aa, Mycobacterium
QAAGVSEDAVQQAEADEPLSPA

SEQ ID NO: 1219397 - protein, 12 aa, Mycobacterium
QAAHPGKHMIEA

SEQ ID NO: 1219398 - protein, 5 aa, Mycobacterium
QAALP

SEQ ID NO: 1219399 - protein, 19 aa, Mycobacterium
QAANEVAGASLTQAVTLTF

SEQ ID NO: 1219400 - protein, 4 aa, Mycobacterium
QAAP

SEQ ID NO: 1219401 - protein, 7 aa, Mycobacterium
QAAPAQR

SEQ ID NO: 1219402 - protein, 8 aa, Mycobacterium
QAAQDDPE

SEQ ID NO: 1219403 - protein, 5 aa, Mycobacterium
QAAQV

SEQ ID NO: 1219404 - protein, 6 aa, Mycobacterium
QAARSG

SEQ ID NO: 1219405 - protein, 7 aa, Mycobacterium
QAASDAT

SEQ ID NO: 1219406 - protein, 16 aa, Mycobacterium
QAASDRHSQGKTTDSE

SEQ ID NO: 1219407 - protein, 28 aa, Mycobacterium
QAASTSKVDAAASGSAPPRSVGPGVRRP

SEQ ID NO: 1219408 - protein, 4 aa, Mycobacterium
QAAT

SEQ ID NO: 1219409 - protein, 7 aa, Mycobacterium
QAATGVR

SEQ ID NO: 1219410 - protein, 9 aa, Mycobacterium
QAATRTPGV

SEQ ID NO: 1219411 - protein, 8 aa, Mycobacterium
QAATTPDE

SEQ ID NO: 1219412 - protein, 13 aa, Mycobacterium
QAATVDGDTATAR

SEQ ID NO: 1219413 - protein, 9 aa, Mycobacterium
QAAVPGDGA

SEQ ID NO: 1219414 - protein, 8 aa, Mycobacterium
QACPEDER

SEQ ID NO: 1219415 - protein, 7 aa, Mycobacterium
QACTGTS

SEQ ID NO: 1219416 - protein, 8 aa, Mycobacterium
QADAAARY

SEQ ID NO: 1219417 - protein, 6 aa, Mycobacterium
QADAAH

SEQ ID NO: 1219418 - protein, 7 aa, Mycobacterium
QADANAK

SEQ ID NO: 1219419 - protein, 7 aa, Mycobacterium
QADDISE

SEQ ID NO: 1219420 - protein, 6 aa, Mycobacterium
QADERV

SEQ ID NO: 1219421 - protein, 4 aa, Mycobacterium
QADG

SEQ ID NO: 1219422 - protein, 15 aa, Mycobacterium
QADNRSFKQAADQAE

SEQ ID NO: 1219423 - protein, 7 aa, Mycobacterium
QADPALA

SEQ ID NO: 1219424 - protein, 15 aa, Mycobacterium
QADPWTDSGWQGRSV

SEQ ID NO: 1219425 - protein, 6 aa, Mycobacterium
QADRHQ

SEQ ID NO: 1219426 - protein, 7 aa, Mycobacterium
QADRTEL

SEQ ID NO: 1219427 - protein, 8 aa, Mycobacterium
QADSDRTF

SEQ ID NO: 1219428 - protein, 8 aa, Mycobacterium
QAEAAQAN

SEQ ID NO: 1219429 - protein, 9 aa, Mycobacterium
QAEADPTAR

SEQ ID NO: 1219430 - protein, 6 aa, Mycobacterium
QAEAIR

SEQ ID NO: 1219431 - protein, 5 aa, Mycobacterium
QAEEG

SEQ ID NO: 1219432 - protein, 11 aa, Mycobacterium
QAEGTDNPHEA

SEQ ID NO: 1219433 - protein, 16 aa, Mycobacterium
QAELGGAADEATNPVP

SEQ ID NO: 1219434 - protein, 10 aa, Mycobacterium
QAEQGEIDSR

SEQ ID NO: 1219435 - protein, 9 aa, Mycobacterium
QAESGGNWS

SEQ ID NO: 1219436 - protein, 8 aa, Mycobacterium
QAETTIKK

SEQ ID NO: 1219437 - protein, 12 aa, Mycobacterium
QAEWEDDNGDKR

SEQ ID NO: 1219438 - protein, 11 aa, Mycobacterium
QAFDGKGRAAV

SEQ ID NO: 1219439 - protein, 9 aa, Mycobacterium
QAGAAAAQL

SEQ ID NO: 1219440 - protein, 7 aa, Mycobacterium
QAGAAPV

SEQ ID NO: 1219441 - protein, 11 aa, Mycobacterium
QAGAAVSAQLG

SEQ ID NO: 1219442 - protein, 6 aa, Mycobacterium
QAGAGY

SEQ ID NO: 1219443 - protein, 6 aa, Mycobacterium
QAGAPK

SEQ ID NO: 1219444 - protein, 5 aa, Mycobacterium
QAGAT

SEQ ID NO: 1219445 - protein, 5 aa, Mycobacterium
QAGAV

SEQ ID NO: 1219446 - protein, 8 aa, Mycobacterium
QAGDAEAA

SEQ ID NO: 1219447 - protein, 15 aa, Mycobacterium
QAGEKARDSRSEPVE

SEQ ID NO: 1219448 - protein, 16 aa, Mycobacterium
QAGEKKRKDGDDPREG

SEQ ID NO: 1219449 - protein, 9 aa, Mycobacterium
QAGESSKGA

SEQ ID NO: 1219450 - protein, 8 aa, Mycobacterium
QAGGAGMQ

SEQ ID NO: 1219451 - protein, 27 aa, Mycobacterium
QAGGAPFSGDEWTAGAEVNPEPAITGR

SEQ ID NO: 1219452 - protein, 14 aa, Mycobacterium
QAGGASLASGGNIP

SEQ ID NO: 1219453 - protein, 7 aa, Mycobacterium
QAGGEGF

SEQ ID NO: 1219454 - protein, 5 aa, Mycobacterium
QAGGG

SEQ ID NO: 1219455 - protein, 10 aa, Mycobacterium
QAGGPDPAGC

SEQ ID NO: 1219456 - protein, 10 aa, Mycobacterium
QAGGPDPYCS

SEQ ID NO: 1219457 - protein, 13 aa, Mycobacterium
QAGLQPYVARIIE

SEQ ID NO: 1219458 - protein, 8 aa, Mycobacterium
QAGMSRSD

SEQ ID NO: 1219459 - protein, 8 aa, Mycobacterium
QAGNSAHE

SEQ ID NO: 1219460 - protein, 7 aa, Mycobacterium
QAGPRKD

SEQ ID NO: 1219461 - protein, 14 aa, Mycobacterium
QAGQIRPTARPGKL

SEQ ID NO: 1219462 - protein, 8 aa, Mycobacterium
QAGQTYAA

SEQ ID NO: 1219463 - protein, 9 aa, Mycobacterium
QAGQTYAEE

SEQ ID NO: 1219464 - protein, 10 aa, Mycobacterium
QAGRRRGVPA

SEQ ID NO: 1219465 - protein, 6 aa, Mycobacterium
QAGSAE

SEQ ID NO: 1219466 - protein, 6 aa, Mycobacterium
QAGSDA

SEQ ID NO: 1219467 - protein, 11 aa, Mycobacterium
QAGTHPSPAEL

SEQ ID NO: 1219468 - protein, 4 aa, Mycobacterium
QAGV

SEQ ID NO: 1219469 - protein, 7 aa, Mycobacterium
QAGVSRS

SEQ ID NO: 1219470 - protein, 8 aa, Mycobacterium
QAHDKTPA

SEQ ID NO: 1219471 - protein, 24 aa, Mycobacterium
QAHPQGFSTPEARTPTVLSPGETF

SEQ ID NO: 1219472 - protein, 6 aa, Mycobacterium
QAIENS

SEQ ID NO: 1219473 - protein, 6 aa, Mycobacterium
QAIKGE

SEQ ID NO: 1219474 - protein, 6 aa, Mycobacterium
QAINGD

SEQ ID NO: 1219475 - protein, 11 aa, Mycobacterium
QAITSGQSTPA

SEQ ID NO: 1219476 - protein, 11 aa, Mycobacterium
QAKGKGEDAKV

SEQ ID NO: 1219477 - protein, 8 aa, Mycobacterium
QAKNPKYL

SEQ ID NO: 1219478 - protein, 4 aa, Mycobacterium
QAKR

SEQ ID NO: 1219479 - protein, 15 aa, Mycobacterium
QAKTDRAIPLFELTR

SEQ ID NO: 1219480 - protein, 9 aa, Mycobacterium
QAKVPTESG

SEQ ID NO: 1219481 - protein, 6 aa, Mycobacterium
QALGPG

SEQ ID NO: 1219482 - protein, 4 aa, Mycobacterium
QALL

SEQ ID NO: 1219483 - protein, 17 aa, Mycobacterium
QALPGSRTTTGRGTPGL

SEQ ID NO: 1219484 - protein, 6 aa, Mycobacterium
QALPTA

SEQ ID NO: 1219485 - protein, 4 aa, Mycobacterium
QALR

SEQ ID NO: 1219486 - protein, 10 aa, Mycobacterium
QALSEDVGGT

SEQ ID NO: 1219487 - protein, 10 aa, Mycobacterium
QAMQAPPSWQ

SEQ ID NO: 1219488 - protein, 8 aa, Mycobacterium
QANAQTGG

SEQ ID NO: 1219489 - protein, 4 aa, Mycobacterium
QANC

SEQ ID NO: 1219490 - protein, 9 aa, Mycobacterium
QANEDYSEE

SEQ ID NO: 1219491 - protein, 26 aa, Mycobacterium
QANEDYTEEFDPSKYGMADSYDEQGN

SEQ ID NO: 1219492 - protein, 5 aa, Mycobacterium
QANEK

SEQ ID NO: 1219493 - protein, 7 aa, Mycobacterium
QANGDCP

SEQ ID NO: 1219494 - protein, 7 aa, Mycobacterium
QANSGAH

SEQ ID NO: 1219495 - protein, 7 aa, Mycobacterium
QAPAEPL

SEQ ID NO: 1219496 - protein, 11 aa, Mycobacterium
QAPAGAGKTHS

SEQ ID NO: 1219497 - protein, 8 aa, Mycobacterium
QAPDAGAL

SEQ ID NO: 1219498 - protein, 8 aa, Mycobacterium
QAPDRTVA

SEQ ID NO: 1219499 - protein, 9 aa, Mycobacterium
QAPGSLDPQ

SEQ ID NO: 1219500 - protein, 15 aa, Mycobacterium
QAPHSTADDVAKQVR

SEQ ID NO: 1219501 - protein, 4 aa, Mycobacterium
QAPK

SEQ ID NO: 1219502 - protein, 15 aa, Mycobacterium
QAPKSLNNNIPGNAA

SEQ ID NO: 1219503 - protein, 4 aa, Mycobacterium
QAPL

SEQ ID NO: 1219504 - protein, 5 aa, Mycobacterium
QAPMP

SEQ ID NO: 1219505 - protein, 4 aa, Mycobacterium
QAPP

SEQ ID NO: 1219506 - protein, 5 aa, Mycobacterium
QAPPA

SEQ ID NO: 1219507 - protein, 27 aa, Mycobacterium
QAPPATFQTAPQSPRSVVAPAPGKAAL

SEQ ID NO: 1219508 - protein, 6 aa, Mycobacterium
QAPPEL

SEQ ID NO: 1219509 - protein, 6 aa, Mycobacterium
QAPPLE

SEQ ID NO: 1219510 - protein, 9 aa, Mycobacterium
QAPPLTDEQ

SEQ ID NO: 1219511 - protein, 6 aa, Mycobacterium
QAPPNL

SEQ ID NO: 1219512 - protein, 119 aa, Mycobacterium
QAPPPLASSAPATSPAPAPAPSQPAAAPSAAAGAGPSSGGVGGISASAGSAPVGAAPPSGAPPAPPVPLGPPTSPAPPGPVPPTGTPGTAPGGAMGPGVAPMSTTGTAGGAAPAPIPVS

SEQ ID NO: 1219513 - protein, 7 aa, Mycobacterium
QAPQQGM

SEQ ID NO: 1219514 - protein, 6 aa, Mycobacterium
QAPRDD

SEQ ID NO: 1219515 - protein, 10 aa, Mycobacterium
QAPRLTPPAA

SEQ ID NO: 1219516 - protein, 7 aa, Mycobacterium
QAPRTLP

SEQ ID NO: 1219517 - protein, 5 aa, Mycobacterium
QAPRV

SEQ ID NO: 1219518 - protein, 7 aa, Mycobacterium
QAPRVDN

SEQ ID NO: 1219519 - protein, 6 aa, Mycobacterium
QAPSNI

SEQ ID NO: 1219520 - protein, 10 aa, Mycobacterium
QAPTGSNNQG

SEQ ID NO: 1219521 - protein, 6 aa, Mycobacterium
QAPTNH

SEQ ID NO: 1219522 - protein, 4 aa, Mycobacterium
QAPY

SEQ ID NO: 1219523 - protein, 8 aa, Mycobacterium
QAQGRGLG

SEQ ID NO: 1219524 - protein, 5 aa, Mycobacterium
QAQPG

SEQ ID NO: 1219525 - protein, 9 aa, Mycobacterium
QAQRAEADG

SEQ ID NO: 1219526 - protein, 8 aa, Mycobacterium
QAQSEGFA

SEQ ID NO: 1219527 - protein, 10 aa, Mycobacterium
QARADRGAAI

SEQ ID NO: 1219528 - protein, 7 aa, Mycobacterium
QARAEAA

SEQ ID NO: 1219529 - protein, 17 aa, Mycobacterium
QARAQKVTSDLSHAQGE

SEQ ID NO: 1219530 - protein, 11 aa, Mycobacterium
QAREKTGTDPV

SEQ ID NO: 1219531 - protein, 13 aa, Mycobacterium
QARETAFGRDPEV

SEQ ID NO: 1219532 - protein, 7 aa, Mycobacterium
QARGPEL

SEQ ID NO: 1219533 - protein, 5 aa, Mycobacterium
QARPD

SEQ ID NO: 1219534 - protein, 5 aa, Mycobacterium
QARPG

SEQ ID NO: 1219535 - protein, 8 aa, Mycobacterium
QARPIDDD

SEQ ID NO: 1219536 - protein, 8 aa, Mycobacterium
QARPYTGA

SEQ ID NO: 1219537 - protein, 4 aa, Mycobacterium
QARR

SEQ ID NO: 1219538 - protein, 6 aa, Mycobacterium
QARRER

SEQ ID NO: 1219539 - protein, 36 aa, Mycobacterium
QARRRARRQRRRTMQPKTSGRRARSDTTEDPNPGGD

SEQ ID NO: 1219540 - protein, 16 aa, Mycobacterium
QARSSAELTADQESYR

SEQ ID NO: 1219541 - protein, 8 aa, Mycobacterium
QARTATTV

SEQ ID NO: 1219542 - protein, 7 aa, Mycobacterium
QARTDRP

SEQ ID NO: 1219543 - protein, 21 aa, Mycobacterium
QARTEQGAAGATEWHDPREDG

SEQ ID NO: 1219544 - protein, 9 aa, Mycobacterium
QARTPAEEG

SEQ ID NO: 1219545 - protein, 12 aa, Mycobacterium
QARVKGGTTVPH

SEQ ID NO: 1219546 - protein, 11 aa, Mycobacterium
QARVTKQTAGA

SEQ ID NO: 1219547 - protein, 12 aa, Mycobacterium
QASAADADAAVA

SEQ ID NO: 1219548 - protein, 19 aa, Mycobacterium
QASAASAEAARAAAEQAAA

SEQ ID NO: 1219549 - protein, 8 aa, Mycobacterium
QASAEDLS

SEQ ID NO: 1219550 - protein, 9 aa, Mycobacterium
QASENPGGF

SEQ ID NO: 1219551 - protein, 10 aa, Mycobacterium
QASGEGGPGV

SEQ ID NO: 1219552 - protein, 7 aa, Mycobacterium
QASLKGK

SEQ ID NO: 1219553 - protein, 20 aa, Mycobacterium
QASLPALPEAPPNQPTEPLA

SEQ ID NO: 1219554 - protein, 7 aa, Mycobacterium
QASNDQL

SEQ ID NO: 1219555 - protein, 7 aa, Mycobacterium
QASPDEF

SEQ ID NO: 1219556 - protein, 11 aa, Mycobacterium
QASPSRPVGAA

SEQ ID NO: 1219557 - protein, 8 aa, Mycobacterium
QASTDGVE

SEQ ID NO: 1219558 - protein, 9 aa, Mycobacterium
QASTPEAGS

SEQ ID NO: 1219559 - protein, 7 aa, Mycobacterium
QASTTVE

SEQ ID NO: 1219560 - protein, 10 aa, Mycobacterium
QASTVSSGSI

SEQ ID NO: 1219561 - protein, 14 aa, Mycobacterium
QASVPRAALAPILA

SEQ ID NO: 1219562 - protein, 17 aa, Mycobacterium
QATAGAARSTLARRTSA

SEQ ID NO: 1219563 - protein, 12 aa, Mycobacterium
QATPASDDVHIE

SEQ ID NO: 1219564 - protein, 6 aa, Mycobacterium
QATPIP

SEQ ID NO: 1219565 - protein, 9 aa, Mycobacterium
QATSTAQNV

SEQ ID NO: 1219566 - protein, 14 aa, Mycobacterium
QATTERPHERAAQR

SEQ ID NO: 1219567 - protein, 8 aa, Mycobacterium
QATTGDAV

SEQ ID NO: 1219568 - protein, 7 aa, Mycobacterium
QATTTSF

SEQ ID NO: 1219569 - protein, 9 aa, Mycobacterium
QAVDEGVSE

SEQ ID NO: 1219570 - protein, 7 aa, Mycobacterium
QAVESGP

SEQ ID NO: 1219571 - protein, 6 aa, Mycobacterium
QAVGEN

SEQ ID NO: 1219572 - protein, 10 aa, Mycobacterium
QAVPGGPATA

SEQ ID NO: 1219573 - protein, 12 aa, Mycobacterium
QAVTQNSPIAKI

SEQ ID NO: 1219574 - protein, 7 aa, Mycobacterium
QAYPGDE

SEQ ID NO: 1219575 - protein, 8 aa, Mycobacterium
QAYSGGPQ

SEQ ID NO: 1219576 - protein, 5 aa, Mycobacterium
QCCPP

SEQ ID NO: 1219577 - protein, 8 aa, Mycobacterium
QCGSSQQA

SEQ ID NO: 1219578 - protein, 8 aa, Mycobacterium
QCGSSQQT

SEQ ID NO: 1219579 - protein, 15 aa, Mycobacterium
QCGYDSDDAEYGEEV

SEQ ID NO: 1219580 - protein, 5 aa, Mycobacterium
QCPTG

SEQ ID NO: 1219581 - protein, 5 aa, Mycobacterium
QCPTV

SEQ ID NO: 1219582 - protein, 9 aa, Mycobacterium
QCRGQVEGG

SEQ ID NO: 1219583 - protein, 5 aa, Mycobacterium
QCRPE

SEQ ID NO: 1219584 - protein, 6 aa, Mycobacterium
QCTANG

SEQ ID NO: 1219585 - protein, 7 aa, Mycobacterium
QDAAARA

SEQ ID NO: 1219586 - protein, 11 aa, Mycobacterium
QDAADSGNVYG

SEQ ID NO: 1219587 - protein, 11 aa, Mycobacterium
QDAARRAEDRG

SEQ ID NO: 1219588 - protein, 4 aa, Mycobacterium
QDAC

SEQ ID NO: 1219589 - protein, 7 aa, Mycobacterium
QDAEGGI

SEQ ID NO: 1219590 - protein, 5 aa, Mycobacterium
QDAGA

SEQ ID NO: 1219591 - protein, 5 aa, Mycobacterium
QDAPI

SEQ ID NO: 1219592 - protein, 11 aa, Mycobacterium
QDAPSGGDPLQ

SEQ ID NO: 1219593 - protein, 4 aa, Mycobacterium
QDAR

SEQ ID NO: 1219594 - protein, 7 aa, Mycobacterium
QDARDGL

SEQ ID NO: 1219595 - protein, 17 aa, Mycobacterium
QDASGITGTIQRSEALT

SEQ ID NO: 1219596 - protein, 4 aa, Mycobacterium
QDCD

SEQ ID NO: 1219597 - protein, 4 aa, Mycobacterium
QDDA

SEQ ID NO: 1219598 - protein, 4 aa, Mycobacterium
QDDG

SEQ ID NO: 1219599 - protein, 8 aa, Mycobacterium
QDDNQGKF

SEQ ID NO: 1219600 - protein, 7 aa, Mycobacterium
QDDPAVA

SEQ ID NO: 1219601 - protein, 8 aa, Mycobacterium
QDDPAYRT

SEQ ID NO: 1219602 - protein, 6 aa, Mycobacterium
QDDPLA

SEQ ID NO: 1219603 - protein, 8 aa, Mycobacterium
QDDRGWYD

SEQ ID NO: 1219604 - protein, 4 aa, Mycobacterium
QDDT

SEQ ID NO: 1219605 - protein, 13 aa, Mycobacterium
QDDWKGKLTPRNT

SEQ ID NO: 1219606 - protein, 5 aa, Mycobacterium
QDEAR

SEQ ID NO: 1219607 - protein, 7 aa, Mycobacterium
QDEELTR

SEQ ID NO: 1219608 - protein, 9 aa, Mycobacterium
QDEENSVSR

SEQ ID NO: 1219609 - protein, 6 aa, Mycobacterium
QDEGSQ

SEQ ID NO: 1219610 - protein, 17 aa, Mycobacterium
QDELGPEIRAYPGGDFV

SEQ ID NO: 1219611 - protein, 6 aa, Mycobacterium
QDERGH

SEQ ID NO: 1219612 - protein, 7 aa, Mycobacterium
QDESPTM

SEQ ID NO: 1219613 - protein, 11 aa, Mycobacterium
QDFDPEAISPD

SEQ ID NO: 1219614 - protein, 5 aa, Mycobacterium
QDGAA

SEQ ID NO: 1219615 - protein, 16 aa, Mycobacterium
QDGAAARAARQTPAEG

SEQ ID NO: 1219616 - protein, 15 aa, Mycobacterium
QDGAEAGPDLGDAPI

SEQ ID NO: 1219617 - protein, 6 aa, Mycobacterium
QDGHEG

SEQ ID NO: 1219618 - protein, 5 aa, Mycobacterium
QDGHQ

SEQ ID NO: 1219619 - protein, 14 aa, Mycobacterium
QDGKGYASGTQLGE

SEQ ID NO: 1219620 - protein, 5 aa, Mycobacterium
QDGLA

SEQ ID NO: 1219621 - protein, 9 aa, Mycobacterium
QDGPVDPGA

SEQ ID NO: 1219622 - protein, 4 aa, Mycobacterium
QDGT

SEQ ID NO: 1219623 - protein, 10 aa, Mycobacterium
QDGVGKGSAL

SEQ ID NO: 1219624 - protein, 5 aa, Mycobacterium
QDGYE

SEQ ID NO: 1219625 - protein, 9 aa, Mycobacterium
QDGYPQPQG

SEQ ID NO: 1219626 - protein, 4 aa, Mycobacterium
QDHA

SEQ ID NO: 1219627 - protein, 4 aa, Mycobacterium
QDHP

SEQ ID NO: 1219628 - protein, 8 aa, Mycobacterium
QDHSPIRD

SEQ ID NO: 1219629 - protein, 6 aa, Mycobacterium
QDHYDN

SEQ ID NO: 1219630 - protein, 4 aa, Mycobacterium
QDID

SEQ ID NO: 1219631 - protein, 18 aa, Mycobacterium
QDIGTGRHGGYAQTARYP

SEQ ID NO: 1219632 - protein, 8 aa, Mycobacterium
QDKAGPGV

SEQ ID NO: 1219633 - protein, 13 aa, Mycobacterium
QDKDFDSMAPENI

SEQ ID NO: 1219634 - protein, 13 aa, Mycobacterium
QDKERSVHSDPSK

SEQ ID NO: 1219635 - protein, 5 aa, Mycobacterium
QDKQG

SEQ ID NO: 1219636 - protein, 9 aa, Mycobacterium
QDLGRPDGF

SEQ ID NO: 1219637 - protein, 4 aa, Mycobacterium
QDLR

SEQ ID NO: 1219638 - protein, 5 aa, Mycobacterium
QDMAT

SEQ ID NO: 1219639 - protein, 8 aa, Mycobacterium
QDNTSGVS

SEQ ID NO: 1219640 - protein, 4 aa, Mycobacterium
QDNV

SEQ ID NO: 1219641 - protein, 6 aa, Mycobacterium
QDNVER

SEQ ID NO: 1219642 - protein, 8 aa, Mycobacterium
QDPAKDTL

SEQ ID NO: 1219643 - protein, 9 aa, Mycobacterium
QDPAKDTLP

SEQ ID NO: 1219644 - protein, 22 aa, Mycobacterium
QDPAPTGGEVTTPSTSKPQVNI

SEQ ID NO: 1219645 - protein, 10 aa, Mycobacterium
QDPDGPGELR

SEQ ID NO: 1219646 - protein, 16 aa, Mycobacterium
QDPEKAARIREEDDAM

SEQ ID NO: 1219647 - protein, 9 aa, Mycobacterium
QDPHNTDRR

SEQ ID NO: 1219648 - protein, 13 aa, Mycobacterium
QDPKTKAYRAGPG

SEQ ID NO: 1219649 - protein, 6 aa, Mycobacterium
QDPLEP

SEQ ID NO: 1219650 - protein, 8 aa, Mycobacterium
QDPLEQSR

SEQ ID NO: 1219651 - protein, 6 aa, Mycobacterium
QDPPPH

SEQ ID NO: 1219652 - protein, 6 aa, Mycobacterium
QDPRSW

SEQ ID NO: 1219653 - protein, 16 aa, Mycobacterium
QDPTAKMSKSADSDAG

SEQ ID NO: 1219654 - protein, 15 aa, Mycobacterium
QDPTGFGSCGRGRSN

SEQ ID NO: 1219655 - protein, 5 aa, Mycobacterium
QDPTI

SEQ ID NO: 1219656 - protein, 10 aa, Mycobacterium
QDPTPAQQAQ

SEQ ID NO: 1219657 - protein, 6 aa, Mycobacterium
QDPVGE

SEQ ID NO: 1219658 - protein, 21 aa, Mycobacterium
QDQAREAMDAAKSGAQQGDPL

SEQ ID NO: 1219659 - protein, 14 aa, Mycobacterium
QDRDAFTAVLHAAN

SEQ ID NO: 1219660 - protein, 4 aa, Mycobacterium
QDRG

SEQ ID NO: 1219661 - protein, 5 aa, Mycobacterium
QDRGG

SEQ ID NO: 1219662 - protein, 19 aa, Mycobacterium
QDRYAGANGDRTKLENPLG

SEQ ID NO: 1219663 - protein, 11 aa, Mycobacterium
QDSAKMGQHAA

SEQ ID NO: 1219664 - protein, 10 aa, Mycobacterium
QDSALRSGPV

SEQ ID NO: 1219665 - protein, 10 aa, Mycobacterium
QDSAPRDATA

SEQ ID NO: 1219666 - protein, 8 aa, Mycobacterium
QDSDANTK

SEQ ID NO: 1219667 - protein, 12 aa, Mycobacterium
QDSDGGRISVVR

SEQ ID NO: 1219668 - protein, 7 aa, Mycobacterium
QDSNQKH

SEQ ID NO: 1219669 - protein, 10 aa, Mycobacterium
QDSPLSVRGA

SEQ ID NO: 1219670 - protein, 21 aa, Mycobacterium
QDSPQADRDSYATDPAPTRGE

SEQ ID NO: 1219671 - protein, 13 aa, Mycobacterium
QDSRAAAAVIAHL

SEQ ID NO: 1219672 - protein, 9 aa, Mycobacterium
QDSTGNSGV

SEQ ID NO: 1219673 - protein, 4 aa, Mycobacterium
QDTA

SEQ ID NO: 1219674 - protein, 18 aa, Mycobacterium
QDTADRLTSSAKAESEKM

SEQ ID NO: 1219675 - protein, 7 aa, Mycobacterium
QDTEGWG

SEQ ID NO: 1219676 - protein, 8 aa, Mycobacterium
QDTEPLDA

SEQ ID NO: 1219677 - protein, 7 aa, Mycobacterium
QDTGGPG

SEQ ID NO: 1219678 - protein, 8 aa, Mycobacterium
QDTGRQYR

SEQ ID NO: 1219679 - protein, 5 aa, Mycobacterium
QDTRG

SEQ ID NO: 1219680 - protein, 6 aa, Mycobacterium
QDTTTF

SEQ ID NO: 1219681 - protein, 11 aa, Mycobacterium
QDTVDGPAADL

SEQ ID NO: 1219682 - protein, 7 aa, Mycobacterium
QDVAAAR

SEQ ID NO: 1219683 - protein, 8 aa, Mycobacterium
QDVPDEVG

SEQ ID NO: 1219684 - protein, 8 aa, Mycobacterium
QDVPGTGA

SEQ ID NO: 1219685 - protein, 5 aa, Mycobacterium
QDVPR

SEQ ID NO: 1219686 - protein, 15 aa, Mycobacterium
QDVSQHDSGAYTGEI

SEQ ID NO: 1219687 - protein, 8 aa, Mycobacterium
QDVSTGLR

SEQ ID NO: 1219688 - protein, 11 aa, Mycobacterium
QDWDPEQAKLS

SEQ ID NO: 1219689 - protein, 5 aa, Mycobacterium
QDYAE

SEQ ID NO: 1219690 - protein, 9 aa, Mycobacterium
QDYSAKAAL

SEQ ID NO: 1219691 - protein, 6 aa, Mycobacterium
QEAFQN

SEQ ID NO: 1219692 - protein, 5 aa, Mycobacterium
QEAGL

SEQ ID NO: 1219693 - protein, 8 aa, Mycobacterium
QEAGTARR

SEQ ID NO: 1219694 - protein, 11 aa, Mycobacterium
QEAIDETGGAL

SEQ ID NO: 1219695 - protein, 5 aa, Mycobacterium
QEAPD

SEQ ID NO: 1219696 - protein, 7 aa, Mycobacterium
QEARASL

SEQ ID NO: 1219697 - protein, 11 aa, Mycobacterium
QEAREACGGAG

SEQ ID NO: 1219698 - protein, 7 aa, Mycobacterium
QEASTET

SEQ ID NO: 1219699 - protein, 7 aa, Mycobacterium
QEATGGK

SEQ ID NO: 1219700 - protein, 5 aa, Mycobacterium
QEDAG

SEQ ID NO: 1219701 - protein, 6 aa, Mycobacterium
QEDAKS

SEQ ID NO: 1219702 - protein, 11 aa, Mycobacterium
QEDPGAFLGPK

SEQ ID NO: 1219703 - protein, 7 aa, Mycobacterium
QEDRTLD

SEQ ID NO: 1219704 - protein, 6 aa, Mycobacterium
QEEALG

SEQ ID NO: 1219705 - protein, 14 aa, Mycobacterium
QEEPAALDEDEPGV

SEQ ID NO: 1219706 - protein, 6 aa, Mycobacterium
QEEPEA

SEQ ID NO: 1219707 - protein, 6 aa, Mycobacterium
QEESAR

SEQ ID NO: 1219708 - protein, 6 aa, Mycobacterium
QEFPED

SEQ ID NO: 1219709 - protein, 12 aa, Mycobacterium
QEGAKPGDGETR

SEQ ID NO: 1219710 - protein, 7 aa, Mycobacterium
QEGESYD

SEQ ID NO: 1219711 - protein, 13 aa, Mycobacterium
QEGPLRDATAGRS

SEQ ID NO: 1219712 - protein, 6 aa, Mycobacterium
QEGQHS

SEQ ID NO: 1219713 - protein, 7 aa, Mycobacterium
QEGRPVR

SEQ ID NO: 1219714 - protein, 4 aa, Mycobacterium
QEGS

SEQ ID NO: 1219715 - protein, 10 aa, Mycobacterium
QEGSGLSKEE

SEQ ID NO: 1219716 - protein, 4 aa, Mycobacterium
QEGV

SEQ ID NO: 1219717 - protein, 6 aa, Mycobacterium
QEHDRT

SEQ ID NO: 1219718 - protein, 7 aa, Mycobacterium
QEHRTAG

SEQ ID NO: 1219719 - protein, 5 aa, Mycobacterium
QEHVT

SEQ ID NO: 1219720 - protein, 8 aa, Mycobacterium
QEKAEEYR

SEQ ID NO: 1219721 - protein, 4 aa, Mycobacterium
QEKK

SEQ ID NO: 1219722 - protein, 13 aa, Mycobacterium
QEKKAAGDSAESA

SEQ ID NO: 1219723 - protein, 14 aa, Mycobacterium
QEKLGESGEADTLR

SEQ ID NO: 1219724 - protein, 10 aa, Mycobacterium
QEKVGRDAGE

SEQ ID NO: 1219725 - protein, 12 aa, Mycobacterium
QELERRPSDATE

SEQ ID NO: 1219726 - protein, 20 aa, Mycobacterium
QELGAEEARRYEELGPVLIR

SEQ ID NO: 1219727 - protein, 6 aa, Mycobacterium
QELPTR

SEQ ID NO: 1219728 - protein, 4 aa, Mycobacterium
QELS

SEQ ID NO: 1219729 - protein, 12 aa, Mycobacterium
QELTASRGLGAP

SEQ ID NO: 1219730 - protein, 9 aa, Mycobacterium
QEMPAYPDT

SEQ ID NO: 1219731 - protein, 6 aa, Mycobacterium
QENPPQ

SEQ ID NO: 1219732 - protein, 12 aa, Mycobacterium
QEPDHPVPEPAC

SEQ ID NO: 1219733 - protein, 65 aa, Mycobacterium
QEPRPEPEPDRDPGRDCDPEAESGAECGSESESGADCDPESESEAKPRRDPVPRASITKTSDEQY

SEQ ID NO: 1219734 - protein, 4 aa, Mycobacterium
QEPV

SEQ ID NO: 1219735 - protein, 7 aa, Mycobacterium
QEPVPAG

SEQ ID NO: 1219736 - protein, 9 aa, Mycobacterium
QEQGKEGWA

SEQ ID NO: 1219737 - protein, 6 aa, Mycobacterium
QEQRSL

SEQ ID NO: 1219738 - protein, 7 aa, Mycobacterium
QERAEEK

SEQ ID NO: 1219739 - protein, 7 aa, Mycobacterium
QERAGEA

SEQ ID NO: 1219740 - protein, 4 aa, Mycobacterium
QERF

SEQ ID NO: 1219741 - protein, 6 aa, Mycobacterium
QERGRV

SEQ ID NO: 1219742 - protein, 7 aa, Mycobacterium
QERNQRQ

SEQ ID NO: 1219743 - protein, 7 aa, Mycobacterium
QERPDEV

SEQ ID NO: 1219744 - protein, 5 aa, Mycobacterium
QERQD

SEQ ID NO: 1219745 - protein, 11 aa, Mycobacterium
QERTADTGTDW

SEQ ID NO: 1219746 - protein, 10 aa, Mycobacterium
QERTASRHLK

SEQ ID NO: 1219747 - protein, 6 aa, Mycobacterium
QERTGA

SEQ ID NO: 1219748 - protein, 7 aa, Mycobacterium
QESGEEF

SEQ ID NO: 1219749 - protein, 11 aa, Mycobacterium
QESGTTRPIDP

SEQ ID NO: 1219750 - protein, 6 aa, Mycobacterium
QESSYP

SEQ ID NO: 1219751 - protein, 7 aa, Mycobacterium
QETAAKA

SEQ ID NO: 1219752 - protein, 6 aa, Mycobacterium
QETAEA

SEQ ID NO: 1219753 - protein, 23 aa, Mycobacterium
QETDYPSVGPDRPEYEPRGCPRG

SEQ ID NO: 1219754 - protein, 5 aa, Mycobacterium
QETHP

SEQ ID NO: 1219755 - protein, 4 aa, Mycobacterium
QETI

SEQ ID NO: 1219756 - protein, 6 aa, Mycobacterium
QETLAA

SEQ ID NO: 1219757 - protein, 5 aa, Mycobacterium
QETPD

SEQ ID NO: 1219758 - protein, 5 aa, Mycobacterium
QETRG

SEQ ID NO: 1219759 - protein, 4 aa, Mycobacterium
QEYE

SEQ ID NO: 1219760 - protein, 19 aa, Mycobacterium
QFADSRDANAGLVTSPASA

SEQ ID NO: 1219761 - protein, 4 aa, Mycobacterium
QFAE

SEQ ID NO: 1219762 - protein, 4 aa, Mycobacterium
QFAG

SEQ ID NO: 1219763 - protein, 8 aa, Mycobacterium
QFASTTAA

SEQ ID NO: 1219764 - protein, 7 aa, Mycobacterium
QFATAST

SEQ ID NO: 1219765 - protein, 13 aa, Mycobacterium
QFDPADPTSPMAK

SEQ ID NO: 1219766 - protein, 5 aa, Mycobacterium
QFDTA

SEQ ID NO: 1219767 - protein, 9 aa, Mycobacterium
QFENRRRAQ

SEQ ID NO: 1219768 - protein, 27 aa, Mycobacterium
QFERQAEKAAAAGRTKDAEQARASAEQ

SEQ ID NO: 1219769 - protein, 10 aa, Mycobacterium
QFGGPTTGYD

SEQ ID NO: 1219770 - protein, 7 aa, Mycobacterium
QFGGQGY

SEQ ID NO: 1219771 - protein, 9 aa, Mycobacterium
QFGPQGGTR

SEQ ID NO: 1219772 - protein, 9 aa, Mycobacterium
QFGPQGRTR

SEQ ID NO: 1219773 - protein, 5 aa, Mycobacterium
QFGRP

SEQ ID NO: 1219774 - protein, 12 aa, Mycobacterium
QFGSTSSADRLR

SEQ ID NO: 1219775 - protein, 7 aa, Mycobacterium
QFGTRPD

SEQ ID NO: 1219776 - protein, 5 aa, Mycobacterium
QFPAG

SEQ ID NO: 1219777 - protein, 7 aa, Mycobacterium
QFPPPNK

SEQ ID NO: 1219778 - protein, 9 aa, Mycobacterium
QFPTDPEAY

SEQ ID NO: 1219779 - protein, 11 aa, Mycobacterium
QFRKGDTSDKV

SEQ ID NO: 1219780 - protein, 9 aa, Mycobacterium
QFSAPDGGE

SEQ ID NO: 1219781 - protein, 9 aa, Mycobacterium
QFSDPDGGE

SEQ ID NO: 1219782 - protein, 7 aa, Mycobacterium
QGAADTD

SEQ ID NO: 1219783 - protein, 20 aa, Mycobacterium
QGAAEDGFKKEHGGNGDVGA

SEQ ID NO: 1219784 - protein, 10 aa, Mycobacterium
QGAAPGAKWG

SEQ ID NO: 1219785 - protein, 8 aa, Mycobacterium
QGAATGVG

SEQ ID NO: 1219786 - protein, 10 aa, Mycobacterium
QGAEAPLPAA

SEQ ID NO: 1219787 - protein, 7 aa, Mycobacterium
QGAEPGG

SEQ ID NO: 1219788 - protein, 15 aa, Mycobacterium
QGAEQQVAEKKKMEV

SEQ ID NO: 1219789 - protein, 8 aa, Mycobacterium
QGAGATPD

SEQ ID NO: 1219790 - protein, 9 aa, Mycobacterium
QGAGGPVPL

SEQ ID NO: 1219791 - protein, 19 aa, Mycobacterium
QGAIRRGRGARSGAVGRPR

SEQ ID NO: 1219792 - protein, 8 aa, Mycobacterium
QGANAASD

SEQ ID NO: 1219793 - protein, 22 aa, Mycobacterium
QGAPVRNADPDFSSPGAFPAGP

SEQ ID NO: 1219794 - protein, 6 aa, Mycobacterium
QGAPVT

SEQ ID NO: 1219795 - protein, 4 aa, Mycobacterium
QGAR

SEQ ID NO: 1219796 - protein, 5 aa, Mycobacterium
QGARE

SEQ ID NO: 1219797 - protein, 35 aa, Mycobacterium
QGARHAGEADPYRVTGAEDEASGDAEDEGGSNSLD

SEQ ID NO: 1219798 - protein, 13 aa, Mycobacterium
QGARPPKHTVRGL

SEQ ID NO: 1219799 - protein, 15 aa, Mycobacterium
QGARTRRGRCSVSFG

SEQ ID NO: 1219800 - protein, 9 aa, Mycobacterium
QGASAAVQG

SEQ ID NO: 1219801 - protein, 9 aa, Mycobacterium
QGATKAQKL

SEQ ID NO: 1219802 - protein, 8 aa, Mycobacterium
QGATSYDG

SEQ ID NO: 1219803 - protein, 5 aa, Mycobacterium
QGCSG

SEQ ID NO: 1219804 - protein, 4 aa, Mycobacterium
QGDD

SEQ ID NO: 1219805 - protein, 6 aa, Mycobacterium
QGDDMS

SEQ ID NO: 1219806 - protein, 7 aa, Mycobacterium
QGDGDSI

SEQ ID NO: 1219807 - protein, 6 aa, Mycobacterium
QGDGIA

SEQ ID NO: 1219808 - protein, 6 aa, Mycobacterium
QGDITG

SEQ ID NO: 1219809 - protein, 13 aa, Mycobacterium
QGDPEQAERNAHD

SEQ ID NO: 1219810 - protein, 8 aa, Mycobacterium
QGDPGPVV

SEQ ID NO: 1219811 - protein, 7 aa, Mycobacterium
QGDPPFH

SEQ ID NO: 1219812 - protein, 7 aa, Mycobacterium
QGDPQRP

SEQ ID NO: 1219813 - protein, 5 aa, Mycobacterium
QGDPY

SEQ ID NO: 1219814 - protein, 7 aa, Mycobacterium
QGDRSGV

SEQ ID NO: 1219815 - protein, 5 aa, Mycobacterium
QGDTR

SEQ ID NO: 1219816 - protein, 8 aa, Mycobacterium
QGEDRASV

SEQ ID NO: 1219817 - protein, 8 aa, Mycobacterium
QGEEGDRG

SEQ ID NO: 1219818 - protein, 4 aa, Mycobacterium
QGEG

SEQ ID NO: 1219819 - protein, 9 aa, Mycobacterium
QGEGGIRVP

SEQ ID NO: 1219820 - protein, 10 aa, Mycobacterium
QGEGGRTSGI

SEQ ID NO: 1219821 - protein, 9 aa, Mycobacterium
QGEKAKKAI

SEQ ID NO: 1219822 - protein, 12 aa, Mycobacterium
QGELPRAYNSAH

SEQ ID NO: 1219823 - protein, 5 aa, Mycobacterium
QGERG

SEQ ID NO: 1219824 - protein, 6 aa, Mycobacterium
QGERNY

SEQ ID NO: 1219825 - protein, 14 aa, Mycobacterium
QGETLVDPTDSELA

SEQ ID NO: 1219826 - protein, 12 aa, Mycobacterium
QGFPDEDGPPAM

SEQ ID NO: 1219827 - protein, 7 aa, Mycobacterium
QGFSKRP

SEQ ID NO: 1219828 - protein, 13 aa, Mycobacterium
QGGARGREETKSK

SEQ ID NO: 1219829 - protein, 22 aa, Mycobacterium
QGGDMAEQKINEASAAIARLVR

SEQ ID NO: 1219830 - protein, 9 aa, Mycobacterium
QGGDPAKVV

SEQ ID NO: 1219831 - protein, 8 aa, Mycobacterium
QGGDSAKV

SEQ ID NO: 1219832 - protein, 5 aa, Mycobacterium
QGGEI

SEQ ID NO: 1219833 - protein, 9 aa, Mycobacterium
QGGGGASPL

SEQ ID NO: 1219834 - protein, 9 aa, Mycobacterium
QGGIDGQNF

SEQ ID NO: 1219835 - protein, 4 aa, Mycobacterium
QGGL

SEQ ID NO: 1219836 - protein, 14 aa, Mycobacterium
QGGLDAQNIAASGK

SEQ ID NO: 1219837 - protein, 7 aa, Mycobacterium
QGGMGRS

SEQ ID NO: 1219838 - protein, 9 aa, Mycobacterium
QGGRAYDAD

SEQ ID NO: 1219839 - protein, 10 aa, Mycobacterium
QGGSADDIAP

SEQ ID NO: 1219840 - protein, 6 aa, Mycobacterium
QGGTGL

SEQ ID NO: 1219841 - protein, 12 aa, Mycobacterium
QGGTLDLSTSAG

SEQ ID NO: 1219842 - protein, 15 aa, Mycobacterium
QGHQPRPRTFTQSSK

SEQ ID NO: 1219843 - protein, 10 aa, Mycobacterium
QGIDPSESAD

SEQ ID NO: 1219844 - protein, 10 aa, Mycobacterium
QGISAAGGRA

SEQ ID NO: 1219845 - protein, 13 aa, Mycobacterium
QGISDTYTTGRGS

SEQ ID NO: 1219846 - protein, 6 aa, Mycobacterium
QGISKD

SEQ ID NO: 1219847 - protein, 4 aa, Mycobacterium
QGIY

SEQ ID NO: 1219848 - protein, 4 aa, Mycobacterium
QGKA

SEQ ID NO: 1219849 - protein, 5 aa, Mycobacterium
QGKDI

SEQ ID NO: 1219850 - protein, 10 aa, Mycobacterium
QGKDTEPSFA

SEQ ID NO: 1219851 - protein, 5 aa, Mycobacterium
QGKEE

SEQ ID NO: 1219852 - protein, 7 aa, Mycobacterium
QGKEPQW

SEQ ID NO: 1219853 - protein, 11 aa, Mycobacterium
QGKPVAGALNQ

SEQ ID NO: 1219854 - protein, 4 aa, Mycobacterium
QGKQ

SEQ ID NO: 1219855 - protein, 5 aa, Mycobacterium
QGKRD

SEQ ID NO: 1219856 - protein, 10 aa, Mycobacterium
QGKRTPKDIE

SEQ ID NO: 1219857 - protein, 7 aa, Mycobacterium
QGKSVVT

SEQ ID NO: 1219858 - protein, 21 aa, Mycobacterium
QGLATGLGDEGGFAPDLPGTR

SEQ ID NO: 1219859 - protein, 4 aa, Mycobacterium
QGLN

SEQ ID NO: 1219860 - protein, 5 aa, Mycobacterium
QGLPE

SEQ ID NO: 1219861 - protein, 21 aa, Mycobacterium
QGLPGLGGQAYPAQGGEGGVG

SEQ ID NO: 1219862 - protein, 17 aa, Mycobacterium
QGLTDGRATPVPADHPQ

SEQ ID NO: 1219863 - protein, 17 aa, Mycobacterium
QGMPRQPAYAASKAGVT

SEQ ID NO: 1219864 - protein, 51 aa, Mycobacterium
QGMSTGGAIGGGMPAAPPPAPASPSPALSAGGQATPVSATAGGGVPAAAAH

SEQ ID NO: 1219865 - protein, 15 aa, Mycobacterium
QGNFGSPGNDPPAAM

SEQ ID NO: 1219866 - protein, 7 aa, Mycobacterium
QGNRAAT

SEQ ID NO: 1219867 - protein, 18 aa, Mycobacterium
QGNSARVGSVRSSEVEPA

SEQ ID NO: 1219868 - protein, 4 aa, Mycobacterium
QGNT

SEQ ID NO: 1219869 - protein, 14 aa, Mycobacterium
QGPAPAELDAGPAE

SEQ ID NO: 1219870 - protein, 9 aa, Mycobacterium
QGPAPGAAL

SEQ ID NO: 1219871 - protein, 18 aa, Mycobacterium
QGPAPSYGDDPVTAEAAE

SEQ ID NO: 1219872 - protein, 14 aa, Mycobacterium
QGPEPAPAGAADTG

SEQ ID NO: 1219873 - protein, 5 aa, Mycobacterium
QGPGI

SEQ ID NO: 1219874 - protein, 12 aa, Mycobacterium
QGPGSRPTGAGI

SEQ ID NO: 1219875 - protein, 4 aa, Mycobacterium
QGPH

SEQ ID NO: 1219876 - protein, 7 aa, Mycobacterium
QGPNAVP

SEQ ID NO: 1219877 - protein, 26 aa, Mycobacterium
QGPPEAVIGDPKEERTRQFLDRILNP

SEQ ID NO: 1219878 - protein, 11 aa, Mycobacterium
QGPPGTGKTYR

SEQ ID NO: 1219879 - protein, 7 aa, Mycobacterium
QGPRGVL

SEQ ID NO: 1219880 - protein, 23 aa, Mycobacterium
QGPSAGGHRGTFDPTATPSGQPL

SEQ ID NO: 1219881 - protein, 6 aa, Mycobacterium
QGPSSM

SEQ ID NO: 1219882 - protein, 6 aa, Mycobacterium
QGPSSR

SEQ ID NO: 1219883 - protein, 5 aa, Mycobacterium
QGPYR

SEQ ID NO: 1219884 - protein, 10 aa, Mycobacterium
QGQKCSAASR

SEQ ID NO: 1219885 - protein, 5 aa, Mycobacterium
QGQLG

SEQ ID NO: 1219886 - protein, 6 aa, Mycobacterium
QGQTPL

SEQ ID NO: 1219887 - protein, 4 aa, Mycobacterium
QGRA

SEQ ID NO: 1219888 - protein, 8 aa, Mycobacterium
QGRGQEAE

SEQ ID NO: 1219889 - protein, 12 aa, Mycobacterium
QGRGRAEIRSEV

SEQ ID NO: 1219890 - protein, 6 aa, Mycobacterium
QGRGRI

SEQ ID NO: 1219891 - protein, 4 aa, Mycobacterium
QGRK

SEQ ID NO: 1219892 - protein, 5 aa, Mycobacterium
QGRKR

SEQ ID NO: 1219893 - protein, 4 aa, Mycobacterium
QGRL

SEQ ID NO: 1219894 - protein, 8 aa, Mycobacterium
QGRPMSPH

SEQ ID NO: 1219895 - protein, 8 aa, Mycobacterium
QGRPVSPH

SEQ ID NO: 1219896 - protein, 10 aa, Mycobacterium
QGRSATAPGV

SEQ ID NO: 1219897 - protein, 5 aa, Mycobacterium
QGRSQ

SEQ ID NO: 1219898 - protein, 6 aa, Mycobacterium
QGRSRT

SEQ ID NO: 1219899 - protein, 5 aa, Mycobacterium
QGSEP

SEQ ID NO: 1219900 - protein, 7 aa, Mycobacterium
QGSGKSM

SEQ ID NO: 1219901 - protein, 8 aa, Mycobacterium
QGSMSGST

SEQ ID NO: 1219902 - protein, 14 aa, Mycobacterium
QGSPAWGTLAGEDA

SEQ ID NO: 1219903 - protein, 7 aa, Mycobacterium
QGSPGEY

SEQ ID NO: 1219904 - protein, 10 aa, Mycobacterium
QGSQWPGMGG

SEQ ID NO: 1219905 - protein, 6 aa, Mycobacterium
QGSRAA

SEQ ID NO: 1219906 - protein, 5 aa, Mycobacterium
QGSRD

SEQ ID NO: 1219907 - protein, 7 aa, Mycobacterium
QGSREEC

SEQ ID NO: 1219908 - protein, 14 aa, Mycobacterium
QGSRGGIDLPPSDI

SEQ ID NO: 1219909 - protein, 5 aa, Mycobacterium
QGSSG

SEQ ID NO: 1219910 - protein, 11 aa, Mycobacterium
QGSTPTASRRP

SEQ ID NO: 1219911 - protein, 7 aa, Mycobacterium
QGSVGRS

SEQ ID NO: 1219912 - protein, 8 aa, Mycobacterium
QGTAGSGV

SEQ ID NO: 1219913 - protein, 12 aa, Mycobacterium
QGTAGSTGTPRT

SEQ ID NO: 1219914 - protein, 12 aa, Mycobacterium
QGTAPGRADLDA

SEQ ID NO: 1219915 - protein, 4 aa, Mycobacterium
QGTD

SEQ ID NO: 1219916 - protein, 14 aa, Mycobacterium
QGTDSAGPGTFGTP

SEQ ID NO: 1219917 - protein, 11 aa, Mycobacterium
QGTDSSESPEL

SEQ ID NO: 1219918 - protein, 7 aa, Mycobacterium
QGTEPVA

SEQ ID NO: 1219919 - protein, 4 aa, Mycobacterium
QGTG

SEQ ID NO: 1219920 - protein, 12 aa, Mycobacterium
QGTGEGATFPRS

SEQ ID NO: 1219921 - protein, 19 aa, Mycobacterium
QGTKEYSTENASGGSSGPF

SEQ ID NO: 1219922 - protein, 34 aa, Mycobacterium
QGTPEYPNPAVPRGDPCSYTPPADGLPTPGNPLP

SEQ ID NO: 1219923 - protein, 5 aa, Mycobacterium
QGTQV

SEQ ID NO: 1219924 - protein, 4 aa, Mycobacterium
QGTS

SEQ ID NO: 1219925 - protein, 8 aa, Mycobacterium
QGTSGTKA

SEQ ID NO: 1219926 - protein, 7 aa, Mycobacterium
QGTTGGS

SEQ ID NO: 1219927 - protein, 10 aa, Mycobacterium
QGTVGPEGDL

SEQ ID NO: 1219928 - protein, 4 aa, Mycobacterium
QGVD

SEQ ID NO: 1219929 - protein, 6 aa, Mycobacterium
QGVDPE

SEQ ID NO: 1219930 - protein, 7 aa, Mycobacterium
QGVEPSE

SEQ ID NO: 1219931 - protein, 11 aa, Mycobacterium
QGVFGQGSADA

SEQ ID NO: 1219932 - protein, 10 aa, Mycobacterium
QGVGSEDFSE

SEQ ID NO: 1219933 - protein, 27 aa, Mycobacterium
QGVPHPGQRRGRVGGRVGRPAGPDQRL

SEQ ID NO: 1219934 - protein, 10 aa, Mycobacterium
QGVTRRANSA

SEQ ID NO: 1219935 - protein, 13 aa, Mycobacterium
QGVTVGNKTTPGV

SEQ ID NO: 1219936 - protein, 16 aa, Mycobacterium
QGWAAPPEADAKELAD

SEQ ID NO: 1219937 - protein, 9 aa, Mycobacterium
QGWDSSPEM

SEQ ID NO: 1219938 - protein, 5 aa, Mycobacterium
QGWQG

SEQ ID NO: 1219939 - protein, 6 aa, Mycobacterium
QGYADG

SEQ ID NO: 1219940 - protein, 8 aa, Mycobacterium
QGYDATTV

SEQ ID NO: 1219941 - protein, 10 aa, Mycobacterium
QGYQGSDPDF

SEQ ID NO: 1219942 - protein, 19 aa, Mycobacterium
QHAATQSLDPTRPPTAGQH

SEQ ID NO: 1219943 - protein, 7 aa, Mycobacterium
QHAGPTL

SEQ ID NO: 1219944 - protein, 6 aa, Mycobacterium
QHAGTA

SEQ ID NO: 1219945 - protein, 11 aa, Mycobacterium
QHANAARSEAA

SEQ ID NO: 1219946 - protein, 5 aa, Mycobacterium
QHDDV

SEQ ID NO: 1219947 - protein, 11 aa, Mycobacterium
QHDGDTDFSGS

SEQ ID NO: 1219948 - protein, 6 aa, Mycobacterium
QHDTPC

SEQ ID NO: 1219949 - protein, 21 aa, Mycobacterium
QHGKPSQAIGRATPVDGEPGR

SEQ ID NO: 1219950 - protein, 4 aa, Mycobacterium
QHGS

SEQ ID NO: 1219951 - protein, 18 aa, Mycobacterium
QHGSLTDAEQRIPLLLAH

SEQ ID NO: 1219952 - protein, 8 aa, Mycobacterium
QHGTPADL

SEQ ID NO: 1219953 - protein, 9 aa, Mycobacterium
QHGYPGRSR

SEQ ID NO: 1219954 - protein, 17 aa, Mycobacterium
QHHPKQRGIASGGTSVS

SEQ ID NO: 1219955 - protein, 4 aa, Mycobacterium
QHKE

SEQ ID NO: 1219956 - protein, 4 aa, Mycobacterium
QHLT

SEQ ID NO: 1219957 - protein, 14 aa, Mycobacterium
QHNQQRSSQSITND

SEQ ID NO: 1219958 - protein, 14 aa, Mycobacterium
QHNTHARSASRRGD

SEQ ID NO: 1219959 - protein, 5 aa, Mycobacterium
QHPAS

SEQ ID NO: 1219960 - protein, 7 aa, Mycobacterium
QHPKTLP

SEQ ID NO: 1219961 - protein, 12 aa, Mycobacterium
QHPPDPAARDRL

SEQ ID NO: 1219962 - protein, 6 aa, Mycobacterium
QHPRNE

SEQ ID NO: 1219963 - protein, 20 aa, Mycobacterium
QHRGQGAGSGLEGAAPNELA

SEQ ID NO: 1219964 - protein, 6 aa, Mycobacterium
QHVTPE

SEQ ID NO: 1219965 - protein, 18 aa, Mycobacterium
QIAAEDQGALDIEVGARA

SEQ ID NO: 1219966 - protein, 11 aa, Mycobacterium
QIAPAREASTE

SEQ ID NO: 1219967 - protein, 4 aa, Mycobacterium
QIDR

SEQ ID NO: 1219968 - protein, 19 aa, Mycobacterium
QIDRDRTALADHDQSDFQG

SEQ ID NO: 1219969 - protein, 8 aa, Mycobacterium
QIEGRDTA

SEQ ID NO: 1219970 - protein, 8 aa, Mycobacterium
QIEGTGRR

SEQ ID NO: 1219971 - protein, 12 aa, Mycobacterium
QIGDAAAAESAS

SEQ ID NO: 1219972 - protein, 8 aa, Mycobacterium
QIGDGREA

SEQ ID NO: 1219973 - protein, 11 aa, Mycobacterium
QIGDSADDPLT

SEQ ID NO: 1219974 - protein, 6 aa, Mycobacterium
QIGEDM

SEQ ID NO: 1219975 - protein, 8 aa, Mycobacterium
QIGGPSGE

SEQ ID NO: 1219976 - protein, 4 aa, Mycobacterium
QIGP

SEQ ID NO: 1219977 - protein, 8 aa, Mycobacterium
QIGPTPAA

SEQ ID NO: 1219978 - protein, 4 aa, Mycobacterium
QIGR

SEQ ID NO: 1219979 - protein, 9 aa, Mycobacterium
QIGSPTSAH

SEQ ID NO: 1219980 - protein, 11 aa, Mycobacterium
QIGTPDELYRG

SEQ ID NO: 1219981 - protein, 9 aa, Mycobacterium
QIKAKTAEL

SEQ ID NO: 1219982 - protein, 7 aa, Mycobacterium
QIPAAAP

SEQ ID NO: 1219983 - protein, 8 aa, Mycobacterium
QIPAADAT

SEQ ID NO: 1219984 - protein, 4 aa, Mycobacterium
QIPD

SEQ ID NO: 1219985 - protein, 13 aa, Mycobacterium
QIPEGTDFTEDGR

SEQ ID NO: 1219986 - protein, 12 aa, Mycobacterium
QIPGHDPAHEEL

SEQ ID NO: 1219987 - protein, 7 aa, Mycobacterium
QIPPGYI

SEQ ID NO: 1219988 - protein, 8 aa, Mycobacterium
QIPQARRT

SEQ ID NO: 1219989 - protein, 9 aa, Mycobacterium
QIPRKGSYF

SEQ ID NO: 1219990 - protein, 5 aa, Mycobacterium
QIPTE

SEQ ID NO: 1219991 - protein, 11 aa, Mycobacterium
QIQAQAGRLPD

SEQ ID NO: 1219992 - protein, 7 aa, Mycobacterium
QISDGAS

SEQ ID NO: 1219993 - protein, 6 aa, Mycobacterium
QISDTV

SEQ ID NO: 1219994 - protein, 5 aa, Mycobacterium
QISGG

SEQ ID NO: 1219995 - protein, 14 aa, Mycobacterium
QITGTTPDADEHRR

SEQ ID NO: 1219996 - protein, 14 aa, Mycobacterium
QKADAKPGDAPQPP

SEQ ID NO: 1219997 - protein, 7 aa, Mycobacterium
QKADAPL

SEQ ID NO: 1219998 - protein, 7 aa, Mycobacterium
QKAGPDA

SEQ ID NO: 1219999 - protein, 8 aa, Mycobacterium
QKAPELAA

SEQ ID NO: 1220000 - protein, 7 aa, Mycobacterium
QKARPRD

SEQ ID NO: 1220001 - protein, 7 aa, Mycobacterium
QKDGRLQ

SEQ ID NO: 1220002 - protein, 9 aa, Mycobacterium
QKDPETGYA

SEQ ID NO: 1220003 - protein, 7 aa, Mycobacterium
QKDRDSV

SEQ ID NO: 1220004 - protein, 8 aa, Mycobacterium
QKDRLEDA

SEQ ID NO: 1220005 - protein, 13 aa, Mycobacterium
QKEAGRLRNDVPS

SEQ ID NO: 1220006 - protein, 16 aa, Mycobacterium
QKFGQEPGTYSTEGYD

SEQ ID NO: 1220007 - protein, 8 aa, Mycobacterium
QKFTANDG

SEQ ID NO: 1220008 - protein, 12 aa, Mycobacterium
QKGGVGKTTITA

SEQ ID NO: 1220009 - protein, 8 aa, Mycobacterium
QKGTTKDG

SEQ ID NO: 1220010 - protein, 132 aa, Mycobacterium
QKLASEGPAVKRGVAAGPAKRAAKKAPAKKTAAKKTTAAAKKTAPAKKSTAAAKKTAPAKKTAAKKTTAAAKKTAPAKKSTAAAKKTAPAKKAATKAPAKKAAAKAPAKKATAAKKTASKAPARKAPAKKGR

SEQ ID NO: 1220011 - protein, 8 aa, Mycobacterium
QKNGAAKN

SEQ ID NO: 1220012 - protein, 6 aa, Mycobacterium
QKNSPA

SEQ ID NO: 1220013 - protein, 6 aa, Mycobacterium
QKPMDG

SEQ ID NO: 1220014 - protein, 10 aa, Mycobacterium
QKPTPADAAD

SEQ ID NO: 1220015 - protein, 8 aa, Mycobacterium
QKPTPGMR

SEQ ID NO: 1220016 - protein, 11 aa, Mycobacterium
QKPTYQDAQPA

SEQ ID NO: 1220017 - protein, 12 aa, Mycobacterium
QKQDGAVKVILQ

SEQ ID NO: 1220018 - protein, 14 aa, Mycobacterium
QKRAAQASAQATAW

SEQ ID NO: 1220019 - protein, 6 aa, Mycobacterium
QKRLPR

SEQ ID NO: 1220020 - protein, 12 aa, Mycobacterium
QKRSSGRPSPMS

SEQ ID NO: 1220021 - protein, 5 aa, Mycobacterium
QKSGQ

SEQ ID NO: 1220022 - protein, 13 aa, Mycobacterium
QKSKGGLEVRGEP

SEQ ID NO: 1220023 - protein, 14 aa, Mycobacterium
QKSMGRHLSWFALI

SEQ ID NO: 1220024 - protein, 14 aa, Mycobacterium
QKSMGRHLSWVALI

SEQ ID NO: 1220025 - protein, 11 aa, Mycobacterium
QKVGNGHPGTA

SEQ ID NO: 1220026 - protein, 8 aa, Mycobacterium
QKWRPANL

SEQ ID NO: 1220027 - protein, 6 aa, Mycobacterium
QKYGPD

SEQ ID NO: 1220028 - protein, 4 aa, Mycobacterium
QKYN

SEQ ID NO: 1220029 - protein, 5 aa, Mycobacterium
QLAAP

SEQ ID NO: 1220030 - protein, 15 aa, Mycobacterium
QLADDRRDHPGDDLT

SEQ ID NO: 1220031 - protein, 9 aa, Mycobacterium
QLAEESAGV

SEQ ID NO: 1220032 - protein, 4 aa, Mycobacterium
QLAG

SEQ ID NO: 1220033 - protein, 5 aa, Mycobacterium
QLANN

SEQ ID NO: 1220034 - protein, 9 aa, Mycobacterium
QLAPGGPDS

SEQ ID NO: 1220035 - protein, 5 aa, Mycobacterium
QLASE

SEQ ID NO: 1220036 - protein, 5 aa, Mycobacterium
QLASV

SEQ ID NO: 1220037 - protein, 9 aa, Mycobacterium
QLDAETRTL

SEQ ID NO: 1220038 - protein, 4 aa, Mycobacterium
QLDD

SEQ ID NO: 1220039 - protein, 7 aa, Mycobacterium
QLDEASV

SEQ ID NO: 1220040 - protein, 8 aa, Mycobacterium
QLDETTTT

SEQ ID NO: 1220041 - protein, 10 aa, Mycobacterium
QLDGKQPITV

SEQ ID NO: 1220042 - protein, 4 aa, Mycobacterium
QLDQ

SEQ ID NO: 1220043 - protein, 11 aa, Mycobacterium
QLDSDGNHEDE

SEQ ID NO: 1220044 - protein, 6 aa, Mycobacterium
QLEGPV

SEQ ID NO: 1220045 - protein, 23 aa, Mycobacterium
QLEPPAAVTGNAYQGADSPLPRS

SEQ ID NO: 1220046 - protein, 4 aa, Mycobacterium
QLES

SEQ ID NO: 1220047 - protein, 18 aa, Mycobacterium
QLESATPRALRSRSDFED

SEQ ID NO: 1220048 - protein, 16 aa, Mycobacterium
QLGADAADAGPEDAGT

SEQ ID NO: 1220049 - protein, 10 aa, Mycobacterium
QLGDRGGSIG

SEQ ID NO: 1220050 - protein, 81 aa, Mycobacterium
QLGEQARRDEPDPSAESEKDKDDELDEDKDEHDHAPEPVPGETPPSTMPQSGTPPEPVPAGTPGEGAPPAAPGPPPPPPTA

SEQ ID NO: 1220051 - protein, 5 aa, Mycobacterium
QLGET

SEQ ID NO: 1220052 - protein, 5 aa, Mycobacterium
QLGGG

SEQ ID NO: 1220053 - protein, 13 aa, Mycobacterium
QLGNASAERGTAH

SEQ ID NO: 1220054 - protein, 6 aa, Mycobacterium
QLGPDG

SEQ ID NO: 1220055 - protein, 8 aa, Mycobacterium
QLGPEPDA

SEQ ID NO: 1220056 - protein, 5 aa, Mycobacterium
QLGPR

SEQ ID NO: 1220057 - protein, 4 aa, Mycobacterium
QLGS

SEQ ID NO: 1220058 - protein, 12 aa, Mycobacterium
QLGTGPVSYRDS

SEQ ID NO: 1220059 - protein, 4 aa, Mycobacterium
QLHP

SEQ ID NO: 1220060 - protein, 19 aa, Mycobacterium
QLKAQDAGYTLTPAGDKTK

SEQ ID NO: 1220061 - protein, 9 aa, Mycobacterium
QLNGAGKAD

SEQ ID NO: 1220062 - protein, 15 aa, Mycobacterium
QLNTGNRHSQTPPSV

SEQ ID NO: 1220063 - protein, 4 aa, Mycobacterium
QLPA

SEQ ID NO: 1220064 - protein, 10 aa, Mycobacterium
QLPAGPGRQA

SEQ ID NO: 1220065 - protein, 7 aa, Mycobacterium
QLPAQDR

SEQ ID NO: 1220066 - protein, 4 aa, Mycobacterium
QLPD

SEQ ID NO: 1220067 - protein, 5 aa, Mycobacterium
QLPDA

SEQ ID NO: 1220068 - protein, 7 aa, Mycobacterium
QLPDEGR

SEQ ID NO: 1220069 - protein, 6 aa, Mycobacterium
QLPDPR

SEQ ID NO: 1220070 - protein, 4 aa, Mycobacterium
QLPG

SEQ ID NO: 1220071 - protein, 5 aa, Mycobacterium
QLPGG

SEQ ID NO: 1220072 - protein, 6 aa, Mycobacterium
QLPGGS

SEQ ID NO: 1220073 - protein, 7 aa, Mycobacterium
QLPKPGS

SEQ ID NO: 1220074 - protein, 13 aa, Mycobacterium
QLPPDGRPTDLPG

SEQ ID NO: 1220075 - protein, 13 aa, Mycobacterium
QLPPGTDTDTYAR

SEQ ID NO: 1220076 - protein, 14 aa, Mycobacterium
QLPPSLSPDGQPVD

SEQ ID NO: 1220077 - protein, 12 aa, Mycobacterium
QLPPTPSGLTRT

SEQ ID NO: 1220078 - protein, 14 aa, Mycobacterium
QLPSNGETAAIEDS

SEQ ID NO: 1220079 - protein, 18 aa, Mycobacterium
QLPTADEAVPEENGPVAE

SEQ ID NO: 1220080 - protein, 14 aa, Mycobacterium
QLPTYKARNRGKGR

SEQ ID NO: 1220081 - protein, 11 aa, Mycobacterium
QLQSKQSDLAR

SEQ ID NO: 1220082 - protein, 5 aa, Mycobacterium
QLRDT

SEQ ID NO: 1220083 - protein, 15 aa, Mycobacterium
QLRGRSGRQGDPGET

SEQ ID NO: 1220084 - protein, 13 aa, Mycobacterium
QLRGTASDVDKSL

SEQ ID NO: 1220085 - protein, 5 aa, Mycobacterium
QLSDE

SEQ ID NO: 1220086 - protein, 5 aa, Mycobacterium
QLSDG

SEQ ID NO: 1220087 - protein, 10 aa, Mycobacterium
QLSGGQKQRV

SEQ ID NO: 1220088 - protein, 9 aa, Mycobacterium
QLSGGQRKR

SEQ ID NO: 1220089 - protein, 5 aa, Mycobacterium
QLSPS

SEQ ID NO: 1220090 - protein, 7 aa, Mycobacterium
QLSPSDK

SEQ ID NO: 1220091 - protein, 10 aa, Mycobacterium
QLSPYADEHG

SEQ ID NO: 1220092 - protein, 10 aa, Mycobacterium
QLSREPRPYP

SEQ ID NO: 1220093 - protein, 5 aa, Mycobacterium
QLTAD

SEQ ID NO: 1220094 - protein, 8 aa, Mycobacterium
QLTDAGVP

SEQ ID NO: 1220095 - protein, 8 aa, Mycobacterium
QLTGEPDY

SEQ ID NO: 1220096 - protein, 7 aa, Mycobacterium
QLTGNPI

SEQ ID NO: 1220097 - protein, 6 aa, Mycobacterium
QLTGPE

SEQ ID NO: 1220098 - protein, 7 aa, Mycobacterium
QLTPEEN

SEQ ID NO: 1220099 - protein, 11 aa, Mycobacterium
QLTSAGRAKLE

SEQ ID NO: 1220100 - protein, 13 aa, Mycobacterium
QLTTASPAEWPTG

SEQ ID NO: 1220101 - protein, 13 aa, Mycobacterium
QLTTASSAEWPTG

SEQ ID NO: 1220102 - protein, 7 aa, Mycobacterium
QMGGEGA

SEQ ID NO: 1220103 - protein, 10 aa, Mycobacterium
QMGITTPAGL

SEQ ID NO: 1220104 - protein, 18 aa, Mycobacterium
QMGPNRPGPKGYADQPIP

SEQ ID NO: 1220105 - protein, 11 aa, Mycobacterium
QMGRDEGAPDR

SEQ ID NO: 1220106 - protein, 17 aa, Mycobacterium
QMPGGGDMGEMPGMGGG

SEQ ID NO: 1220107 - protein, 5 aa, Mycobacterium
QMPGT

SEQ ID NO: 1220108 - protein, 4 aa, Mycobacterium
QMSG

SEQ ID NO: 1220109 - protein, 10 aa, Mycobacterium
QMTRKRDERA

SEQ ID NO: 1220110 - protein, 11 aa, Mycobacterium
QNAAQNAVDIT

SEQ ID NO: 1220111 - protein, 6 aa, Mycobacterium
QNADRT

SEQ ID NO: 1220112 - protein, 10 aa, Mycobacterium
QNAFGDDDRM

SEQ ID NO: 1220113 - protein, 18 aa, Mycobacterium
QNAKPARKATPAKSTARK

SEQ ID NO: 1220114 - protein, 4 aa, Mycobacterium
QNAP

SEQ ID NO: 1220115 - protein, 9 aa, Mycobacterium
QNAQGADAS

SEQ ID NO: 1220116 - protein, 9 aa, Mycobacterium
QNATGEPAI

SEQ ID NO: 1220117 - protein, 9 aa, Mycobacterium
QNDKDHLAT

SEQ ID NO: 1220118 - protein, 4 aa, Mycobacterium
QNDL

SEQ ID NO: 1220119 - protein, 7 aa, Mycobacterium
QNEASRV

SEQ ID NO: 1220120 - protein, 10 aa, Mycobacterium
QNEKGNPLGE

SEQ ID NO: 1220121 - protein, 15 aa, Mycobacterium
QNERGVGEGVRDAGI

SEQ ID NO: 1220122 - protein, 15 aa, Mycobacterium
QNERGVGQGIRDAGI

SEQ ID NO: 1220123 - protein, 8 aa, Mycobacterium
QNFTSSDG

SEQ ID NO: 1220124 - protein, 7 aa, Mycobacterium
QNGGGTV

SEQ ID NO: 1220125 - protein, 9 aa, Mycobacterium
QNGGPNAPG

SEQ ID NO: 1220126 - protein, 4 aa, Mycobacterium
QNGI

SEQ ID NO: 1220127 - protein, 8 aa, Mycobacterium
QNGLSPND

SEQ ID NO: 1220128 - protein, 8 aa, Mycobacterium
QNGPRDRR

SEQ ID NO: 1220129 - protein, 18 aa, Mycobacterium
QNGQGDLAAARAAARTGV

SEQ ID NO: 1220130 - protein, 13 aa, Mycobacterium
QNGSQPGDPHRGA

SEQ ID NO: 1220131 - protein, 4 aa, Mycobacterium
QNGV

SEQ ID NO: 1220132 - protein, 17 aa, Mycobacterium
QNKKATDYLAGNWASAI

SEQ ID NO: 1220133 - protein, 11 aa, Mycobacterium
QNNANKTTIAP

SEQ ID NO: 1220134 - protein, 21 aa, Mycobacterium
QNNRNRLTSPMRRKPDGSYEE

SEQ ID NO: 1220135 - protein, 7 aa, Mycobacterium
QNPADAT

SEQ ID NO: 1220136 - protein, 12 aa, Mycobacterium
QNPDWADNPKTY

SEQ ID NO: 1220137 - protein, 9 aa, Mycobacterium
QNPLTETEI

SEQ ID NO: 1220138 - protein, 28 aa, Mycobacterium
QNPSINADTGQVRTGTPSIGAVQTSDGG

SEQ ID NO: 1220139 - protein, 9 aa, Mycobacterium
QNPSVDTAG

SEQ ID NO: 1220140 - protein, 4 aa, Mycobacterium
QNPT

SEQ ID NO: 1220141 - protein, 6 aa, Mycobacterium
QNPVGN

SEQ ID NO: 1220142 - protein, 5 aa, Mycobacterium
QNPVY

SEQ ID NO: 1220143 - protein, 7 aa, Mycobacterium
QNPYRTG

SEQ ID NO: 1220144 - protein, 6 aa, Mycobacterium
QNRHDR

SEQ ID NO: 1220145 - protein, 10 aa, Mycobacterium
QNRRGTPAAV

SEQ ID NO: 1220146 - protein, 14 aa, Mycobacterium
QNRRSHPLQGNQTL

SEQ ID NO: 1220147 - protein, 9 aa, Mycobacterium
QNRVPGGAR

SEQ ID NO: 1220148 - protein, 9 aa, Mycobacterium
QNRVQDPAK

SEQ ID NO: 1220149 - protein, 11 aa, Mycobacterium
QNSAADREGPL

SEQ ID NO: 1220150 - protein, 11 aa, Mycobacterium
QNSGSTAEPDR

SEQ ID NO: 1220151 - protein, 5 aa, Mycobacterium
QNSPA

SEQ ID NO: 1220152 - protein, 10 aa, Mycobacterium
QNSSTAAEHD

SEQ ID NO: 1220153 - protein, 6 aa, Mycobacterium
QNTAGL

SEQ ID NO: 1220154 - protein, 13 aa, Mycobacterium
QNTAKPGRAPTGL

SEQ ID NO: 1220155 - protein, 4 aa, Mycobacterium
QNTF

SEQ ID NO: 1220156 - protein, 8 aa, Mycobacterium
QNTKDVHG

SEQ ID NO: 1220157 - protein, 9 aa, Mycobacterium
QNTLPNTGV

SEQ ID NO: 1220158 - protein, 9 aa, Mycobacterium
QNTRRAAGP

SEQ ID NO: 1220159 - protein, 14 aa, Mycobacterium
QNVALGDDDAARSF

SEQ ID NO: 1220160 - protein, 4 aa, Mycobacterium
QNVG

SEQ ID NO: 1220161 - protein, 7 aa, Mycobacterium
QNYAKEG

SEQ ID NO: 1220162 - protein, 5 aa, Mycobacterium
QPAAT

SEQ ID NO: 1220163 - protein, 5 aa, Mycobacterium
QPAAV

SEQ ID NO: 1220164 - protein, 6 aa, Mycobacterium
QPADRR

SEQ ID NO: 1220165 - protein, 24 aa, Mycobacterium
QPADSSSAKPGNATHGGDAHTTAG

SEQ ID NO: 1220166 - protein, 6 aa, Mycobacterium
QPADVD

SEQ ID NO: 1220167 - protein, 11 aa, Mycobacterium
QPAEPTESGVT

SEQ ID NO: 1220168 - protein, 4 aa, Mycobacterium
QPAF

SEQ ID NO: 1220169 - protein, 10 aa, Mycobacterium
QPAGAGSAKL

SEQ ID NO: 1220170 - protein, 9 aa, Mycobacterium
QPAGEAGYN

SEQ ID NO: 1220171 - protein, 17 aa, Mycobacterium
QPAGRLGPAAPEPDGTA

SEQ ID NO: 1220172 - protein, 8 aa, Mycobacterium
QPAGSVAR

SEQ ID NO: 1220173 - protein, 16 aa, Mycobacterium
QPALEEAASRVEEYTD

SEQ ID NO: 1220174 - protein, 15 aa, Mycobacterium
QPANAVGHRERRTPR

SEQ ID NO: 1220175 - protein, 13 aa, Mycobacterium
QPAPTADVTAEEI

SEQ ID NO: 1220176 - protein, 6 aa, Mycobacterium
QPARRA

SEQ ID NO: 1220177 - protein, 9 aa, Mycobacterium
QPASQRVGQ

SEQ ID NO: 1220178 - protein, 6 aa, Mycobacterium
QPASRL

SEQ ID NO: 1220179 - protein, 4 aa, Mycobacterium
QPDA

SEQ ID NO: 1220180 - protein, 11 aa, Mycobacterium
QPDAMRRDGEG

SEQ ID NO: 1220181 - protein, 4 aa, Mycobacterium
QPDE

SEQ ID NO: 1220182 - protein, 4 aa, Mycobacterium
QPDG

SEQ ID NO: 1220183 - protein, 8 aa, Mycobacterium
QPDLSPKA

SEQ ID NO: 1220184 - protein, 7 aa, Mycobacterium
QPDPGQP

SEQ ID NO: 1220185 - protein, 20 aa, Mycobacterium
QPDPHRPPADRPWSAVVRLT

SEQ ID NO: 1220186 - protein, 8 aa, Mycobacterium
QPDPPDVD

SEQ ID NO: 1220187 - protein, 4 aa, Mycobacterium
QPDR

SEQ ID NO: 1220188 - protein, 9 aa, Mycobacterium
QPDRTGDPV

SEQ ID NO: 1220189 - protein, 6 aa, Mycobacterium
QPDRYT

SEQ ID NO: 1220190 - protein, 8 aa, Mycobacterium
QPDSESVA

SEQ ID NO: 1220191 - protein, 5 aa, Mycobacterium
QPDTI

SEQ ID NO: 1220192 - protein, 9 aa, Mycobacterium
QPDVTASDL

SEQ ID NO: 1220193 - protein, 10 aa, Mycobacterium
QPEAATAAVD

SEQ ID NO: 1220194 - protein, 5 aa, Mycobacterium
QPEAD

SEQ ID NO: 1220195 - protein, 5 aa, Mycobacterium
QPEAP

SEQ ID NO: 1220196 - protein, 6 aa, Mycobacterium
QPEEYS

SEQ ID NO: 1220197 - protein, 4 aa, Mycobacterium
QPEG

SEQ ID NO: 1220198 - protein, 8 aa, Mycobacterium
QPEGASDF

SEQ ID NO: 1220199 - protein, 4 aa, Mycobacterium
QPEL

SEQ ID NO: 1220200 - protein, 8 aa, Mycobacterium
QPELATDE

SEQ ID NO: 1220201 - protein, 12 aa, Mycobacterium
QPELRGAAGAAR

SEQ ID NO: 1220202 - protein, 9 aa, Mycobacterium
QPEPVEESI

SEQ ID NO: 1220203 - protein, 5 aa, Mycobacterium
QPEQT

SEQ ID NO: 1220204 - protein, 6 aa, Mycobacterium
QPETAG

SEQ ID NO: 1220205 - protein, 15 aa, Mycobacterium
QPETWNPTAVPSAAQ

SEQ ID NO: 1220206 - protein, 4 aa, Mycobacterium
QPFR

SEQ ID NO: 1220207 - protein, 7 aa, Mycobacterium
QPGAKTD

SEQ ID NO: 1220208 - protein, 17 aa, Mycobacterium
QPGDDGELATVAEVALT

SEQ ID NO: 1220209 - protein, 5 aa, Mycobacterium
QPGER

SEQ ID NO: 1220210 - protein, 6 aa, Mycobacterium
QPGEYT

SEQ ID NO: 1220211 - protein, 9 aa, Mycobacterium
QPGFATEQP

SEQ ID NO: 1220212 - protein, 23 aa, Mycobacterium
QPGFREADNRAAANVASAAKAAG

SEQ ID NO: 1220213 - protein, 10 aa, Mycobacterium
QPGGAPDYRS

SEQ ID NO: 1220214 - protein, 7 aa, Mycobacterium
QPGGPPI

SEQ ID NO: 1220215 - protein, 6 aa, Mycobacterium
QPGHRP

SEQ ID NO: 1220216 - protein, 5 aa, Mycobacterium
QPGQG

SEQ ID NO: 1220217 - protein, 5 aa, Mycobacterium
QPGQI

SEQ ID NO: 1220218 - protein, 16 aa, Mycobacterium
QPGSLGAGAEDRESPL

SEQ ID NO: 1220219 - protein, 16 aa, Mycobacterium
QPGSLGSTYDDRAQPM

SEQ ID NO: 1220220 - protein, 8 aa, Mycobacterium
QPGTASGY

SEQ ID NO: 1220221 - protein, 9 aa, Mycobacterium
QPGTEPDVE

SEQ ID NO: 1220222 - protein, 5 aa, Mycobacterium
QPGVG

SEQ ID NO: 1220223 - protein, 8 aa, Mycobacterium
QPGVGRGG

SEQ ID NO: 1220224 - protein, 19 aa, Mycobacterium
QPGYGHSDKHTEHEQYNRY

SEQ ID NO: 1220225 - protein, 19 aa, Mycobacterium
QPGYGLSDKHTEHEQYNRY

SEQ ID NO: 1220226 - protein, 6 aa, Mycobacterium
QPGYLP

SEQ ID NO: 1220227 - protein, 11 aa, Mycobacterium
QPHPSGRPGWN

SEQ ID NO: 1220228 - protein, 6 aa, Mycobacterium
QPHRPG

SEQ ID NO: 1220229 - protein, 5 aa, Mycobacterium
QPIGD

SEQ ID NO: 1220230 - protein, 11 aa, Mycobacterium
QPIPVGAQGGT

SEQ ID NO: 1220231 - protein, 11 aa, Mycobacterium
QPITSSTLTEE

SEQ ID NO: 1220232 - protein, 6 aa, Mycobacterium
QPKELP

SEQ ID NO: 1220233 - protein, 7 aa, Mycobacterium
QPKLKNP

SEQ ID NO: 1220234 - protein, 9 aa, Mycobacterium
QPLADRRPV

SEQ ID NO: 1220235 - protein, 9 aa, Mycobacterium
QPLGAGRTT

SEQ ID NO: 1220236 - protein, 10 aa, Mycobacterium
QPLGSGLADP

SEQ ID NO: 1220237 - protein, 6 aa, Mycobacterium
QPLNSK

SEQ ID NO: 1220238 - protein, 4 aa, Mycobacterium
QPLP

SEQ ID NO: 1220239 - protein, 6 aa, Mycobacterium
QPLPAD

SEQ ID NO: 1220240 - protein, 10 aa, Mycobacterium
QPLPAGNGDG

SEQ ID NO: 1220241 - protein, 4 aa, Mycobacterium
QPLR

SEQ ID NO: 1220242 - protein, 5 aa, Mycobacterium
QPLRG

SEQ ID NO: 1220243 - protein, 4 aa, Mycobacterium
QPLS

SEQ ID NO: 1220244 - protein, 13 aa, Mycobacterium
QPLTDDAGATKRD

SEQ ID NO: 1220245 - protein, 6 aa, Mycobacterium
QPMGPT

SEQ ID NO: 1220246 - protein, 11 aa, Mycobacterium
QPNEHEAPSTT

SEQ ID NO: 1220247 - protein, 18 aa, Mycobacterium
QPNRGKRSIGLDTSTPEG

SEQ ID NO: 1220248 - protein, 7 aa, Mycobacterium
QPPAATG

SEQ ID NO: 1220249 - protein, 7 aa, Mycobacterium
QPPAATS

SEQ ID NO: 1220250 - protein, 7 aa, Mycobacterium
QPPARYG

SEQ ID NO: 1220251 - protein, 11 aa, Mycobacterium
QPPATLTPGAR

SEQ ID NO: 1220252 - protein, 10 aa, Mycobacterium
QPPESYQNDH

SEQ ID NO: 1220253 - protein, 5 aa, Mycobacterium
QPPEV

SEQ ID NO: 1220254 - protein, 7 aa, Mycobacterium
QPPGAVQ

SEQ ID NO: 1220255 - protein, 4 aa, Mycobacterium
QPPH

SEQ ID NO: 1220256 - protein, 7 aa, Mycobacterium
QPPHAGS

SEQ ID NO: 1220257 - protein, 6 aa, Mycobacterium
QPPLDE

SEQ ID NO: 1220258 - protein, 5 aa, Mycobacterium
QPPLQ

SEQ ID NO: 1220259 - protein, 7 aa, Mycobacterium
QPPPVDD

SEQ ID NO: 1220260 - protein, 11 aa, Mycobacterium
QPPQDAAAEQA

SEQ ID NO: 1220261 - protein, 10 aa, Mycobacterium
QPPRARKPQR

SEQ ID NO: 1220262 - protein, 9 aa, Mycobacterium
QPPRPTFDA

SEQ ID NO: 1220263 - protein, 9 aa, Mycobacterium
QPPSGDAEP

SEQ ID NO: 1220264 - protein, 5 aa, Mycobacterium
QPPVR

SEQ ID NO: 1220265 - protein, 5 aa, Mycobacterium
QPPWS

SEQ ID NO: 1220266 - protein, 13 aa, Mycobacterium
QPQGRGGRRHSGL

SEQ ID NO: 1220267 - protein, 4 aa, Mycobacterium
QPQR

SEQ ID NO: 1220268 - protein, 10 aa, Mycobacterium
QPREGTRPAL

SEQ ID NO: 1220269 - protein, 12 aa, Mycobacterium
QPRHGDGGDELD

SEQ ID NO: 1220270 - protein, 8 aa, Mycobacterium
QPRHRPPS

SEQ ID NO: 1220271 - protein, 8 aa, Mycobacterium
QPRKDEPI

SEQ ID NO: 1220272 - protein, 8 aa, Mycobacterium
QPRKTQSR

SEQ ID NO: 1220273 - protein, 11 aa, Mycobacterium
QPRLQAPGAIQ

SEQ ID NO: 1220274 - protein, 5 aa, Mycobacterium
QPRLS

SEQ ID NO: 1220275 - protein, 10 aa, Mycobacterium
QPRPGAEPGS

SEQ ID NO: 1220276 - protein, 10 aa, Mycobacterium
QPRQQRSTRH

SEQ ID NO: 1220277 - protein, 6 aa, Mycobacterium
QPRRAA

SEQ ID NO: 1220278 - protein, 6 aa, Mycobacterium
QPRRGW

SEQ ID NO: 1220279 - protein, 24 aa, Mycobacterium
QPRRQPPKTVPPLRRPEVRARLQL

SEQ ID NO: 1220280 - protein, 5 aa, Mycobacterium
QPRSY

SEQ ID NO: 1220281 - protein, 8 aa, Mycobacterium
QPRTPRER

SEQ ID NO: 1220282 - protein, 5 aa, Mycobacterium
QPRVT

SEQ ID NO: 1220283 - protein, 4 aa, Mycobacterium
QPSA

SEQ ID NO: 1220284 - protein, 10 aa, Mycobacterium
QPSAGTPAAV

SEQ ID NO: 1220285 - protein, 6 aa, Mycobacterium
QPSASN

SEQ ID NO: 1220286 - protein, 6 aa, Mycobacterium
QPSFRQ

SEQ ID NO: 1220287 - protein, 10 aa, Mycobacterium
QPSGAGSTFT

SEQ ID NO: 1220288 - protein, 9 aa, Mycobacterium
QPSGNPITA

SEQ ID NO: 1220289 - protein, 10 aa, Mycobacterium
QPSGPTNRPQ

SEQ ID NO: 1220290 - protein, 5 aa, Mycobacterium
QPSPP

SEQ ID NO: 1220291 - protein, 7 aa, Mycobacterium
QPSTEPE

SEQ ID NO: 1220292 - protein, 9 aa, Mycobacterium
QPSTHTAET

SEQ ID NO: 1220293 - protein, 7 aa, Mycobacterium
QPSVTPE

SEQ ID NO: 1220294 - protein, 18 aa, Mycobacterium
QPTASAREENRGQAVGPA

SEQ ID NO: 1220295 - protein, 5 aa, Mycobacterium
QPTDG

SEQ ID NO: 1220296 - protein, 5 aa, Mycobacterium
QPTMG

SEQ ID NO: 1220297 - protein, 6 aa, Mycobacterium
QPTPAL

SEQ ID NO: 1220298 - protein, 6 aa, Mycobacterium
QPTPRT

SEQ ID NO: 1220299 - protein, 11 aa, Mycobacterium
QPTQAGAPTWR

SEQ ID NO: 1220300 - protein, 5 aa, Mycobacterium
QPTRP

SEQ ID NO: 1220301 - protein, 7 aa, Mycobacterium
QPTSQQY

SEQ ID NO: 1220302 - protein, 20 aa, Mycobacterium
QPTTVNQAPTTTAMSGMGSG

SEQ ID NO: 1220303 - protein, 5 aa, Mycobacterium
QPVAA

SEQ ID NO: 1220304 - protein, 5 aa, Mycobacterium
QPVGD

SEQ ID NO: 1220305 - protein, 5 aa, Mycobacterium
QPVLT

SEQ ID NO: 1220306 - protein, 5 aa, Mycobacterium
QPVNA

SEQ ID NO: 1220307 - protein, 5 aa, Mycobacterium
QPVPP

SEQ ID NO: 1220308 - protein, 8 aa, Mycobacterium
QPVREQGR

SEQ ID NO: 1220309 - protein, 9 aa, Mycobacterium
QPVSAPAEL

SEQ ID NO: 1220310 - protein, 6 aa, Mycobacterium
QPVTGG

SEQ ID NO: 1220311 - protein, 5 aa, Mycobacterium
QPWGE

SEQ ID NO: 1220312 - protein, 13 aa, Mycobacterium
QPYGGYISPGSTL

SEQ ID NO: 1220313 - protein, 4 aa, Mycobacterium
QPYP

SEQ ID NO: 1220314 - protein, 12 aa, Mycobacterium
QPYREPGQRARD

SEQ ID NO: 1220315 - protein, 7 aa, Mycobacterium
QQAAAAD

SEQ ID NO: 1220316 - protein, 6 aa, Mycobacterium
QQAAAT

SEQ ID NO: 1220317 - protein, 6 aa, Mycobacterium
QQAAPE

SEQ ID NO: 1220318 - protein, 9 aa, Mycobacterium
QQAERGNKI

SEQ ID NO: 1220319 - protein, 10 aa, Mycobacterium
QQAGKRGKTR

SEQ ID NO: 1220320 - protein, 12 aa, Mycobacterium
QQAGNSTSDRKG

SEQ ID NO: 1220321 - protein, 8 aa, Mycobacterium
QQAIDDPS

SEQ ID NO: 1220322 - protein, 7 aa, Mycobacterium
QQAPGGA

SEQ ID NO: 1220323 - protein, 6 aa, Mycobacterium
QQAQAA

SEQ ID NO: 1220324 - protein, 5 aa, Mycobacterium
QQARW

SEQ ID NO: 1220325 - protein, 10 aa, Mycobacterium
QQATAAPVAE

SEQ ID NO: 1220326 - protein, 8 aa, Mycobacterium
QQATDGDY

SEQ ID NO: 1220327 - protein, 8 aa, Mycobacterium
QQATGGAL

SEQ ID NO: 1220328 - protein, 7 aa, Mycobacterium
QQDAEVR

SEQ ID NO: 1220329 - protein, 8 aa, Mycobacterium
QQDGRASY

SEQ ID NO: 1220330 - protein, 4 aa, Mycobacterium
QQDL

SEQ ID NO: 1220331 - protein, 5 aa, Mycobacterium
QQDPD

SEQ ID NO: 1220332 - protein, 11 aa, Mycobacterium
QQDSPTTARRA

SEQ ID NO: 1220333 - protein, 8 aa, Mycobacterium
QQDSTATR

SEQ ID NO: 1220334 - protein, 7 aa, Mycobacterium
QQEAGKV

SEQ ID NO: 1220335 - protein, 5 aa, Mycobacterium
QQEAL

SEQ ID NO: 1220336 - protein, 11 aa, Mycobacterium
QQEDKKELGDF

SEQ ID NO: 1220337 - protein, 25 aa, Mycobacterium
QQELTASEQALTASQTDIDNAQSRF

SEQ ID NO: 1220338 - protein, 14 aa, Mycobacterium
QQEPPRSLQLVAES

SEQ ID NO: 1220339 - protein, 57 aa, Mycobacterium
QQFGGQGGGAQTASSAPAPAAGQPAPAAPAHSAQAPQVREGEPEPTEEQKREDEQRT

SEQ ID NO: 1220340 - protein, 6 aa, Mycobacterium
QQFGQS

SEQ ID NO: 1220341 - protein, 5 aa, Mycobacterium
QQFPD

SEQ ID NO: 1220342 - protein, 7 aa, Mycobacterium
QQGAHGI

SEQ ID NO: 1220343 - protein, 8 aa, Mycobacterium
QQGASYAD

SEQ ID NO: 1220344 - protein, 13 aa, Mycobacterium
QQGEHRSGIPNRS

SEQ ID NO: 1220345 - protein, 7 aa, Mycobacterium
QQGEPVP

SEQ ID NO: 1220346 - protein, 5 aa, Mycobacterium
QQGEY

SEQ ID NO: 1220347 - protein, 7 aa, Mycobacterium
QQGTGAV

SEQ ID NO: 1220348 - protein, 19 aa, Mycobacterium
QQHSTELQASGGLDGQAGV

SEQ ID NO: 1220349 - protein, 4 aa, Mycobacterium
QQLG

SEQ ID NO: 1220350 - protein, 9 aa, Mycobacterium
QQLPGDAGG

SEQ ID NO: 1220351 - protein, 10 aa, Mycobacterium
QQNREQRTAQ

SEQ ID NO: 1220352 - protein, 7 aa, Mycobacterium
QQPDRTQ

SEQ ID NO: 1220353 - protein, 19 aa, Mycobacterium
QQPFGGSRASGTNDKAGSA

SEQ ID NO: 1220354 - protein, 10 aa, Mycobacterium
QQPGSLGNSN

SEQ ID NO: 1220355 - protein, 6 aa, Mycobacterium
QQPHLG

SEQ ID NO: 1220356 - protein, 7 aa, Mycobacterium
QQPPAAV

SEQ ID NO: 1220357 - protein, 6 aa, Mycobacterium
QQPRVS

SEQ ID NO: 1220358 - protein, 9 aa, Mycobacterium
QQPTDMGPV

SEQ ID NO: 1220359 - protein, 12 aa, Mycobacterium
QQPTPDGDAETV

SEQ ID NO: 1220360 - protein, 20 aa, Mycobacterium
QQQAQNPTVTASPSGDGPDL

SEQ ID NO: 1220361 - protein, 9 aa, Mycobacterium
QQQLPAPQE

SEQ ID NO: 1220362 - protein, 8 aa, Mycobacterium
QQQNHKRK

SEQ ID NO: 1220363 - protein, 11 aa, Mycobacterium
QQRAAAAGAPV

SEQ ID NO: 1220364 - protein, 14 aa, Mycobacterium
QQRAKKRLPKSAYS

SEQ ID NO: 1220365 - protein, 11 aa, Mycobacterium
QQRGMDRARSD

SEQ ID NO: 1220366 - protein, 7 aa, Mycobacterium
QQRPEVE

SEQ ID NO: 1220367 - protein, 18 aa, Mycobacterium
QQRRPASEVDYPKRPEGD

SEQ ID NO: 1220368 - protein, 9 aa, Mycobacterium
QQRSTFGKP

SEQ ID NO: 1220369 - protein, 10 aa, Mycobacterium
QQRSTLGTAW

SEQ ID NO: 1220370 - protein, 9 aa, Mycobacterium
QQSGLSEAT

SEQ ID NO: 1220371 - protein, 8 aa, Mycobacterium
QQSKTRRS

SEQ ID NO: 1220372 - protein, 18 aa, Mycobacterium
QQSNARAQAIPAAAGGPA

SEQ ID NO: 1220373 - protein, 11 aa, Mycobacterium
QQSQAAGGPRM

SEQ ID NO: 1220374 - protein, 21 aa, Mycobacterium
QQSVLDPDNEYLTEQSDAEQQ

SEQ ID NO: 1220375 - protein, 5 aa, Mycobacterium
QQTEG

SEQ ID NO: 1220376 - protein, 5 aa, Mycobacterium
QQTES

SEQ ID NO: 1220377 - protein, 4 aa, Mycobacterium
QQTG

SEQ ID NO: 1220378 - protein, 9 aa, Mycobacterium
QQTHTRRKV

SEQ ID NO: 1220379 - protein, 19 aa, Mycobacterium
QQTHTRRKVRNADATEAAE

SEQ ID NO: 1220380 - protein, 5 aa, Mycobacterium
QQTRQ

SEQ ID NO: 1220381 - protein, 11 aa, Mycobacterium
QQTTPGQRAAQ

SEQ ID NO: 1220382 - protein, 9 aa, Mycobacterium
QQVGNTDGI

SEQ ID NO: 1220383 - protein, 4 aa, Mycobacterium
QQVV

SEQ ID NO: 1220384 - protein, 13 aa, Mycobacterium
QQVYDQSGLGPQD

SEQ ID NO: 1220385 - protein, 14 aa, Mycobacterium
QQWEDSRRGVVPAD

SEQ ID NO: 1220386 - protein, 8 aa, Mycobacterium
QQWEGGSG

SEQ ID NO: 1220387 - protein, 4 aa, Mycobacterium
QQWT

SEQ ID NO: 1220388 - protein, 10 aa, Mycobacterium
QRAAEAASAG

SEQ ID NO: 1220389 - protein, 7 aa, Mycobacterium
QRAAGNP

SEQ ID NO: 1220390 - protein, 6 aa, Mycobacterium
QRAATV

SEQ ID NO: 1220391 - protein, 10 aa, Mycobacterium
QRADSRHPPV

SEQ ID NO: 1220392 - protein, 23 aa, Mycobacterium
QRADTETLARDAEARGWTEEAER

SEQ ID NO: 1220393 - protein, 4 aa, Mycobacterium
QRAE

SEQ ID NO: 1220394 - protein, 6 aa, Mycobacterium
QRAEEL

SEQ ID NO: 1220395 - protein, 6 aa, Mycobacterium
QRAEEP

SEQ ID NO: 1220396 - protein, 8 aa, Mycobacterium
QRAEREAR

SEQ ID NO: 1220397 - protein, 8 aa, Mycobacterium
QRAETGVT

SEQ ID NO: 1220398 - protein, 9 aa, Mycobacterium
QRAEWSEER

SEQ ID NO: 1220399 - protein, 4 aa, Mycobacterium
QRAG

SEQ ID NO: 1220400 - protein, 6 aa, Mycobacterium
QRAGAH

SEQ ID NO: 1220401 - protein, 20 aa, Mycobacterium
QRAGEAVGTPGPADTRPDPV

SEQ ID NO: 1220402 - protein, 6 aa, Mycobacterium
QRAGFS

SEQ ID NO: 1220403 - protein, 6 aa, Mycobacterium
QRAGLT

SEQ ID NO: 1220404 - protein, 9 aa, Mycobacterium
QRAGQPAEI

SEQ ID NO: 1220405 - protein, 7 aa, Mycobacterium
QRAGTVR

SEQ ID NO: 1220406 - protein, 16 aa, Mycobacterium
QRAKPGDKLPSEAELS

SEQ ID NO: 1220407 - protein, 6 aa, Mycobacterium
QRANRE

SEQ ID NO: 1220408 - protein, 8 aa, Mycobacterium
QRAPGGLT

SEQ ID NO: 1220409 - protein, 4 aa, Mycobacterium
QRAR

SEQ ID NO: 1220410 - protein, 8 aa, Mycobacterium
QRARGGVG

SEQ ID NO: 1220411 - protein, 13 aa, Mycobacterium
QRARSTREQQPGV

SEQ ID NO: 1220412 - protein, 10 aa, Mycobacterium
QRASRDVTTL

SEQ ID NO: 1220413 - protein, 6 aa, Mycobacterium
QRAYEQ

SEQ ID NO: 1220414 - protein, 6 aa, Mycobacterium
QRDADG

SEQ ID NO: 1220415 - protein, 5 aa, Mycobacterium
QRDAE

SEQ ID NO: 1220416 - protein, 7 aa, Mycobacterium
QRDANDT

SEQ ID NO: 1220417 - protein, 12 aa, Mycobacterium
QRDATSAVPSDT

SEQ ID NO: 1220418 - protein, 9 aa, Mycobacterium
QRDDDGRYR

SEQ ID NO: 1220419 - protein, 4 aa, Mycobacterium
QRDE

SEQ ID NO: 1220420 - protein, 6 aa, Mycobacterium
QRDEDG

SEQ ID NO: 1220421 - protein, 8 aa, Mycobacterium
QRDGEFRP

SEQ ID NO: 1220422 - protein, 6 aa, Mycobacterium
QRDGES

SEQ ID NO: 1220423 - protein, 5 aa, Mycobacterium
QRDGI

SEQ ID NO: 1220424 - protein, 5 aa, Mycobacterium
QRDGT

SEQ ID NO: 1220425 - protein, 19 aa, Mycobacterium
QRDPSIPQTEWTDDQHTQY

SEQ ID NO: 1220426 - protein, 7 aa, Mycobacterium
QRDRGPT

SEQ ID NO: 1220427 - protein, 50 aa, Mycobacterium
QRDSARARLNEARPTTRATAPPSPGRAQPDSAPPPTQWDSATPPSGPDAG

SEQ ID NO: 1220428 - protein, 7 aa, Mycobacterium
QRDTGIA

SEQ ID NO: 1220429 - protein, 10 aa, Mycobacterium
QREAALNTEV

SEQ ID NO: 1220430 - protein, 24 aa, Mycobacterium
QREAQRATAERRGRVADAAEEYHE

SEQ ID NO: 1220431 - protein, 14 aa, Mycobacterium
QREAVAEQTAHDTG

SEQ ID NO: 1220432 - protein, 18 aa, Mycobacterium
QREDDHSYAQAESGLSTA

SEQ ID NO: 1220433 - protein, 8 aa, Mycobacterium
QREEGGNN

SEQ ID NO: 1220434 - protein, 7 aa, Mycobacterium
QREHPVG

SEQ ID NO: 1220435 - protein, 12 aa, Mycobacterium
QREIDQSEEHTR

SEQ ID NO: 1220436 - protein, 16 aa, Mycobacterium
QRENPAMELRELVAAG

SEQ ID NO: 1220437 - protein, 6 aa, Mycobacterium
QREPDV

SEQ ID NO: 1220438 - protein, 4 aa, Mycobacterium
QRES

SEQ ID NO: 1220439 - protein, 5 aa, Mycobacterium
QRESL

SEQ ID NO: 1220440 - protein, 8 aa, Mycobacterium
QRESTGQP

SEQ ID NO: 1220441 - protein, 20 aa, Mycobacterium
QRGASLARQHSSAHGPPASL

SEQ ID NO: 1220442 - protein, 4 aa, Mycobacterium
QRGD

SEQ ID NO: 1220443 - protein, 6 aa, Mycobacterium
QRGDAD

SEQ ID NO: 1220444 - protein, 5 aa, Mycobacterium
QRGDG

SEQ ID NO: 1220445 - protein, 8 aa, Mycobacterium
QRGEDRQK

SEQ ID NO: 1220446 - protein, 6 aa, Mycobacterium
QRGEVR

SEQ ID NO: 1220447 - protein, 8 aa, Mycobacterium
QRGGHTGP

SEQ ID NO: 1220448 - protein, 9 aa, Mycobacterium
QRGGTPTAY

SEQ ID NO: 1220449 - protein, 9 aa, Mycobacterium
QRGGVARTR

SEQ ID NO: 1220450 - protein, 4 aa, Mycobacterium
QRGI

SEQ ID NO: 1220451 - protein, 5 aa, Mycobacterium
QRGIT

SEQ ID NO: 1220452 - protein, 18 aa, Mycobacterium
QRGKSGGNKPGLNAPAPL

SEQ ID NO: 1220453 - protein, 10 aa, Mycobacterium
QRGLTGTNLE

SEQ ID NO: 1220454 - protein, 10 aa, Mycobacterium
QRGNTSESIA

SEQ ID NO: 1220455 - protein, 7 aa, Mycobacterium
QRGPERV

SEQ ID NO: 1220456 - protein, 9 aa, Mycobacterium
QRGPHGGPF

SEQ ID NO: 1220457 - protein, 6 aa, Mycobacterium
QRGPLD

SEQ ID NO: 1220458 - protein, 13 aa, Mycobacterium
QRGQGKWYPGEPL

SEQ ID NO: 1220459 - protein, 17 aa, Mycobacterium
QRGSGRLSEVGRPAPHS

SEQ ID NO: 1220460 - protein, 9 aa, Mycobacterium
QRGSTDPRY

SEQ ID NO: 1220461 - protein, 5 aa, Mycobacterium
QRGTI

SEQ ID NO: 1220462 - protein, 11 aa, Mycobacterium
QRGYGRSSKYR

SEQ ID NO: 1220463 - protein, 6 aa, Mycobacterium
QRHDGT

SEQ ID NO: 1220464 - protein, 16 aa, Mycobacterium
QRHRTGDRARWDDDGR

SEQ ID NO: 1220465 - protein, 4 aa, Mycobacterium
QRIA

SEQ ID NO: 1220466 - protein, 6 aa, Mycobacterium
QRINDE

SEQ ID NO: 1220467 - protein, 14 aa, Mycobacterium
QRITGDETVEPAQT

SEQ ID NO: 1220468 - protein, 6 aa, Mycobacterium
QRKAEH

SEQ ID NO: 1220469 - protein, 45 aa, Mycobacterium
QRKAESMGAKMDDGGSDGAPPPSDSKDKGKGDSKADDKGDDADKD

SEQ ID NO: 1220470 - protein, 7 aa, Mycobacterium
QRKGART

SEQ ID NO: 1220471 - protein, 9 aa, Mycobacterium
QRKGDPIEF

SEQ ID NO: 1220472 - protein, 8 aa, Mycobacterium
QRKGDPVQ

SEQ ID NO: 1220473 - protein, 13 aa, Mycobacterium
QRKKRRAGQLSEE

SEQ ID NO: 1220474 - protein, 10 aa, Mycobacterium
QRKPKDAETK

SEQ ID NO: 1220475 - protein, 5 aa, Mycobacterium
QRLDA

SEQ ID NO: 1220476 - protein, 8 aa, Mycobacterium
QRLSGAPG

SEQ ID NO: 1220477 - protein, 5 aa, Mycobacterium
QRLTG

SEQ ID NO: 1220478 - protein, 24 aa, Mycobacterium
QRLTSERSRASATVGGPGPEGSVG

SEQ ID NO: 1220479 - protein, 23 aa, Mycobacterium
QRLTSERSRASATVGGPGPEQSI

SEQ ID NO: 1220480 - protein, 8 aa, Mycobacterium
QRLTSGPL

SEQ ID NO: 1220481 - protein, 7 aa, Mycobacterium
QRMPNSA

SEQ ID NO: 1220482 - protein, 12 aa, Mycobacterium
QRMSENSDPTAV

SEQ ID NO: 1220483 - protein, 5 aa, Mycobacterium
QRNAE

SEQ ID NO: 1220484 - protein, 8 aa, Mycobacterium
QRNAETVR

SEQ ID NO: 1220485 - protein, 5 aa, Mycobacterium
QRNAI

SEQ ID NO: 1220486 - protein, 7 aa, Mycobacterium
QRNERAQ

SEQ ID NO: 1220487 - protein, 9 aa, Mycobacterium
QRNGEGPWN

SEQ ID NO: 1220488 - protein, 10 aa, Mycobacterium
QRNGSPPPRL

SEQ ID NO: 1220489 - protein, 10 aa, Mycobacterium
QRNGTERPFT

SEQ ID NO: 1220490 - protein, 6 aa, Mycobacterium
QRNPEA

SEQ ID NO: 1220491 - protein, 10 aa, Mycobacterium
QRNPGLDAGR

SEQ ID NO: 1220492 - protein, 6 aa, Mycobacterium
QRNVTG

SEQ ID NO: 1220493 - protein, 4 aa, Mycobacterium
QRPA

SEQ ID NO: 1220494 - protein, 6 aa, Mycobacterium
QRPDAH

SEQ ID NO: 1220495 - protein, 5 aa, Mycobacterium
QRPDL

SEQ ID NO: 1220496 - protein, 15 aa, Mycobacterium
QRPDRDGASATDEVT

SEQ ID NO: 1220497 - protein, 6 aa, Mycobacterium
QRPDTG

SEQ ID NO: 1220498 - protein, 6 aa, Mycobacterium
QRPEDE

SEQ ID NO: 1220499 - protein, 11 aa, Mycobacterium
QRPEGTEGLTA

SEQ ID NO: 1220500 - protein, 9 aa, Mycobacterium
QRPEPDSTE

SEQ ID NO: 1220501 - protein, 7 aa, Mycobacterium
QRPGADL

SEQ ID NO: 1220502 - protein, 5 aa, Mycobacterium
QRPGF

SEQ ID NO: 1220503 - protein, 11 aa, Mycobacterium
QRPHGSPRNTV

SEQ ID NO: 1220504 - protein, 7 aa, Mycobacterium
QRPHPQT

SEQ ID NO: 1220505 - protein, 6 aa, Mycobacterium
QRPIGA

SEQ ID NO: 1220506 - protein, 5 aa, Mycobacterium
QRPLD

SEQ ID NO: 1220507 - protein, 9 aa, Mycobacterium
QRPLPSDRT

SEQ ID NO: 1220508 - protein, 6 aa, Mycobacterium
QRPNAR

SEQ ID NO: 1220509 - protein, 4 aa, Mycobacterium
QRPP

SEQ ID NO: 1220510 - protein, 9 aa, Mycobacterium
QRPPGPDPV

SEQ ID NO: 1220511 - protein, 10 aa, Mycobacterium
QRPPGPTPAF

SEQ ID NO: 1220512 - protein, 5 aa, Mycobacterium
QRPSM

SEQ ID NO: 1220513 - protein, 18 aa, Mycobacterium
QRPSTTSAPGGRSIDGPW

SEQ ID NO: 1220514 - protein, 4 aa, Mycobacterium
QRPY

SEQ ID NO: 1220515 - protein, 18 aa, Mycobacterium
QRQAAADIGRHSADTSRW

SEQ ID NO: 1220516 - protein, 14 aa, Mycobacterium
QRQARSKGKLSAER

SEQ ID NO: 1220517 - protein, 7 aa, Mycobacterium
QRQASAS

SEQ ID NO: 1220518 - protein, 13 aa, Mycobacterium
QRQLDDRDSRQHD

SEQ ID NO: 1220519 - protein, 4 aa, Mycobacterium
QRQM

SEQ ID NO: 1220520 - protein, 18 aa, Mycobacterium
QRQRAKADAAARKQAHAD

SEQ ID NO: 1220521 - protein, 19 aa, Mycobacterium
QRQRAKADAAARKQAHTDL

SEQ ID NO: 1220522 - protein, 8 aa, Mycobacterium
QRQTSEHM

SEQ ID NO: 1220523 - protein, 7 aa, Mycobacterium
QRQVTTA

SEQ ID NO: 1220524 - protein, 7 aa, Mycobacterium
QRRAHGH

SEQ ID NO: 1220525 - protein, 9 aa, Mycobacterium
QRRAHPDSR

SEQ ID NO: 1220526 - protein, 7 aa, Mycobacterium
QRRASGQ

SEQ ID NO: 1220527 - protein, 4 aa, Mycobacterium
QRRD

SEQ ID NO: 1220528 - protein, 6 aa, Mycobacterium
QRRDEY

SEQ ID NO: 1220529 - protein, 7 aa, Mycobacterium
QRRDTQQ

SEQ ID NO: 1220530 - protein, 4 aa, Mycobacterium
QRRE

SEQ ID NO: 1220531 - protein, 12 aa, Mycobacterium
QRREDARARRDW

SEQ ID NO: 1220532 - protein, 7 aa, Mycobacterium
QRRGGPY

SEQ ID NO: 1220533 - protein, 12 aa, Mycobacterium
QRRGPAAAAAEA

SEQ ID NO: 1220534 - protein, 9 aa, Mycobacterium
QRRKTSRNA

SEQ ID NO: 1220535 - protein, 8 aa, Mycobacterium
QRRPRRVS

SEQ ID NO: 1220536 - protein, 8 aa, Mycobacterium
QRRQPARA

SEQ ID NO: 1220537 - protein, 10 aa, Mycobacterium
QRRSPAGAAS

SEQ ID NO: 1220538 - protein, 9 aa, Mycobacterium
QRRSPTPDP

SEQ ID NO: 1220539 - protein, 4 aa, Mycobacterium
QRSA

SEQ ID NO: 1220540 - protein, 10 aa, Mycobacterium
QRSAAGGAPP

SEQ ID NO: 1220541 - protein, 7 aa, Mycobacterium
QRSADDI

SEQ ID NO: 1220542 - protein, 9 aa, Mycobacterium
QRSAGAHPY

SEQ ID NO: 1220543 - protein, 7 aa, Mycobacterium
QRSAGEA

SEQ ID NO: 1220544 - protein, 8 aa, Mycobacterium
QRSAVTSV

SEQ ID NO: 1220545 - protein, 13 aa, Mycobacterium
QRSDDANDANSAM

SEQ ID NO: 1220546 - protein, 6 aa, Mycobacterium
QRSDRR

SEQ ID NO: 1220547 - protein, 5 aa, Mycobacterium
QRSGE

SEQ ID NO: 1220548 - protein, 5 aa, Mycobacterium
QRSGK

SEQ ID NO: 1220549 - protein, 26 aa, Mycobacterium
QRSGPVDGTEAGGGVKVSDPSDRFER

SEQ ID NO: 1220550 - protein, 9 aa, Mycobacterium
QRSGRIPPA

SEQ ID NO: 1220551 - protein, 7 aa, Mycobacterium
QRSGYAP

SEQ ID NO: 1220552 - protein, 5 aa, Mycobacterium
QRSIP

SEQ ID NO: 1220553 - protein, 6 aa, Mycobacterium
QRSPHS

SEQ ID NO: 1220554 - protein, 4 aa, Mycobacterium
QRSQ

SEQ ID NO: 1220555 - protein, 19 aa, Mycobacterium
QRSQTGEMRQNGEAVADRR

SEQ ID NO: 1220556 - protein, 5 aa, Mycobacterium
QRSRL

SEQ ID NO: 1220557 - protein, 5 aa, Mycobacterium
QRSTL

SEQ ID NO: 1220558 - protein, 6 aa, Mycobacterium
QRTEAD

SEQ ID NO: 1220559 - protein, 22 aa, Mycobacterium
QRTGETEVAGDRSTDTNAAEGS

SEQ ID NO: 1220560 - protein, 4 aa, Mycobacterium
QRTQ

SEQ ID NO: 1220561 - protein, 12 aa, Mycobacterium
QRTRQDAVAAGA

SEQ ID NO: 1220562 - protein, 16 aa, Mycobacterium
QRTRQVDRYPSSAADT

SEQ ID NO: 1220563 - protein, 11 aa, Mycobacterium
QRTTRPTLRGN

SEQ ID NO: 1220564 - protein, 25 aa, Mycobacterium
QRTVSQPQLAARSTAPHSVAAPELG

SEQ ID NO: 1220565 - protein, 5 aa, Mycobacterium
QRTWN

SEQ ID NO: 1220566 - protein, 7 aa, Mycobacterium
QRVGGTW

SEQ ID NO: 1220567 - protein, 8 aa, Mycobacterium
QRVPRSDD

SEQ ID NO: 1220568 - protein, 13 aa, Mycobacterium
QRVSPGDGALRDP

SEQ ID NO: 1220569 - protein, 13 aa, Mycobacterium
QRVSVGSAKGRVA

SEQ ID NO: 1220570 - protein, 5 aa, Mycobacterium
QRWTP

SEQ ID NO: 1220571 - protein, 9 aa, Mycobacterium
QRYASESTD

SEQ ID NO: 1220572 - protein, 7 aa, Mycobacterium
QSAAARR

SEQ ID NO: 1220573 - protein, 6 aa, Mycobacterium
QSAASR

SEQ ID NO: 1220574 - protein, 5 aa, Mycobacterium
QSADA

SEQ ID NO: 1220575 - protein, 12 aa, Mycobacterium
QSADDPDSPTRQ

SEQ ID NO: 1220576 - protein, 10 aa, Mycobacterium
QSADGEPPFA

SEQ ID NO: 1220577 - protein, 6 aa, Mycobacterium
QSADSI

SEQ ID NO: 1220578 - protein, 25 aa, Mycobacterium
QSADVANDADGNADPIADAGPEAVT

SEQ ID NO: 1220579 - protein, 9 aa, Mycobacterium
QSAEAAPAR

SEQ ID NO: 1220580 - protein, 7 aa, Mycobacterium
QSAEEMS

SEQ ID NO: 1220581 - protein, 6 aa, Mycobacterium
QSAEPA

SEQ ID NO: 1220582 - protein, 4 aa, Mycobacterium
QSAF

SEQ ID NO: 1220583 - protein, 94 aa, Mycobacterium
QSAGAEDEDADTEEEPAEEPAEEPAEEPADDVEDDSEAEAEADEAEADEASGSGKHHLGEGDEENSVKSIQDKVGADKESDSGSDSGSGGDGAD

SEQ ID NO: 1220584 - protein, 17 aa, Mycobacterium
QSAGGEPAGLGARDTLR

SEQ ID NO: 1220585 - protein, 5 aa, Mycobacterium
QSAGS

SEQ ID NO: 1220586 - protein, 4 aa, Mycobacterium
QSAH

SEQ ID NO: 1220587 - protein, 7 aa, Mycobacterium
QSAPDRF

SEQ ID NO: 1220588 - protein, 9 aa, Mycobacterium
QSAPGLSGA

SEQ ID NO: 1220589 - protein, 11 aa, Mycobacterium
QSAPTSAADLS

SEQ ID NO: 1220590 - protein, 7 aa, Mycobacterium
QSAPVDD

SEQ ID NO: 1220591 - protein, 9 aa, Mycobacterium
QSAPVTSTY

SEQ ID NO: 1220592 - protein, 5 aa, Mycobacterium
QSAQA

SEQ ID NO: 1220593 - protein, 8 aa, Mycobacterium
QSAQDTGL

SEQ ID NO: 1220594 - protein, 8 aa, Mycobacterium
QSARDAGI

SEQ ID NO: 1220595 - protein, 11 aa, Mycobacterium
QSAREEAVAGA

SEQ ID NO: 1220596 - protein, 29 aa, Mycobacterium
QSARPGEDWTGSQRFSGDDPLGMGEGAQA

SEQ ID NO: 1220597 - protein, 5 aa, Mycobacterium
QSARQ

SEQ ID NO: 1220598 - protein, 8 aa, Mycobacterium
QSDEPPCC

SEQ ID NO: 1220599 - protein, 9 aa, Mycobacterium
QSDESLSAW

SEQ ID NO: 1220600 - protein, 11 aa, Mycobacterium
QSDGEENPEAD

SEQ ID NO: 1220601 - protein, 9 aa, Mycobacterium
QSDLGPKQW

SEQ ID NO: 1220602 - protein, 8 aa, Mycobacterium
QSDLTDGL

SEQ ID NO: 1220603 - protein, 4 aa, Mycobacterium
QSDR

SEQ ID NO: 1220604 - protein, 7 aa, Mycobacterium
QSDTGRD

SEQ ID NO: 1220605 - protein, 7 aa, Mycobacterium
QSDVPVS

SEQ ID NO: 1220606 - protein, 4 aa, Mycobacterium
QSEA

SEQ ID NO: 1220607 - protein, 6 aa, Mycobacterium
QSEALS

SEQ ID NO: 1220608 - protein, 20 aa, Mycobacterium
QSEAQQRLSHGGNPFAEQRP

SEQ ID NO: 1220609 - protein, 7 aa, Mycobacterium
QSEARNA

SEQ ID NO: 1220610 - protein, 7 aa, Mycobacterium
QSEHGKK

SEQ ID NO: 1220611 - protein, 4 aa, Mycobacterium
QSEL

SEQ ID NO: 1220612 - protein, 8 aa, Mycobacterium
QSEPQREA

SEQ ID NO: 1220613 - protein, 7 aa, Mycobacterium
QSEQAHA

SEQ ID NO: 1220614 - protein, 8 aa, Mycobacterium
QSEQSIRS

SEQ ID NO: 1220615 - protein, 6 aa, Mycobacterium
QSESAK

SEQ ID NO: 1220616 - protein, 8 aa, Mycobacterium
QSETLPSD

SEQ ID NO: 1220617 - protein, 12 aa, Mycobacterium
QSEVGGEGPEYG

SEQ ID NO: 1220618 - protein, 13 aa, Mycobacterium
QSFEDGQPWGKDQ

SEQ ID NO: 1220619 - protein, 7 aa, Mycobacterium
QSGDTVR

SEQ ID NO: 1220620 - protein, 5 aa, Mycobacterium
QSGGI

SEQ ID NO: 1220621 - protein, 9 aa, Mycobacterium
QSGGPGAPA

SEQ ID NO: 1220622 - protein, 9 aa, Mycobacterium
QSGGSTPKA

SEQ ID NO: 1220623 - protein, 23 aa, Mycobacterium
QSGIGREGGPEGITGFIEYQAII

SEQ ID NO: 1220624 - protein, 9 aa, Mycobacterium
QSGNAYTEG

SEQ ID NO: 1220625 - protein, 7 aa, Mycobacterium
QSGPKDL

SEQ ID NO: 1220626 - protein, 12 aa, Mycobacterium
QSGQHVTDDQLK

SEQ ID NO: 1220627 - protein, 6 aa, Mycobacterium
QSGRFP

SEQ ID NO: 1220628 - protein, 12 aa, Mycobacterium
QSGRRAADAWSD

SEQ ID NO: 1220629 - protein, 5 aa, Mycobacterium
QSGRV

SEQ ID NO: 1220630 - protein, 6 aa, Mycobacterium
QSGSDR

SEQ ID NO: 1220631 - protein, 10 aa, Mycobacterium
QSGSRGDDAW

SEQ ID NO: 1220632 - protein, 6 aa, Mycobacterium
QSGTGE

SEQ ID NO: 1220633 - protein, 5 aa, Mycobacterium
QSGTH

SEQ ID NO: 1220634 - protein, 10 aa, Mycobacterium
QSGTIGRATV

SEQ ID NO: 1220635 - protein, 10 aa, Mycobacterium
QSHGSTAEGE

SEQ ID NO: 1220636 - protein, 9 aa, Mycobacterium
QSHLPGAEA

SEQ ID NO: 1220637 - protein, 5 aa, Mycobacterium
QSHPE

SEQ ID NO: 1220638 - protein, 4 aa, Mycobacterium
QSIG

SEQ ID NO: 1220639 - protein, 9 aa, Mycobacterium
QSKTAYQAE

SEQ ID NO: 1220640 - protein, 5 aa, Mycobacterium
QSKTY

SEQ ID NO: 1220641 - protein, 8 aa, Mycobacterium
QSKWTDEE

SEQ ID NO: 1220642 - protein, 9 aa, Mycobacterium
QSLEETPAH

SEQ ID NO: 1220643 - protein, 11 aa, Mycobacterium
QSLGGNGLTQE

SEQ ID NO: 1220644 - protein, 8 aa, Mycobacterium
QSLPADLR

SEQ ID NO: 1220645 - protein, 6 aa, Mycobacterium
QSLQPH

SEQ ID NO: 1220646 - protein, 4 aa, Mycobacterium
QSMT

SEQ ID NO: 1220647 - protein, 5 aa, Mycobacterium
QSNHE

SEQ ID NO: 1220648 - protein, 8 aa, Mycobacterium
QSNPHKAA

SEQ ID NO: 1220649 - protein, 9 aa, Mycobacterium
QSPAAGALP

SEQ ID NO: 1220650 - protein, 7 aa, Mycobacterium
QSPDERH

SEQ ID NO: 1220651 - protein, 10 aa, Mycobacterium
QSPDSVGDDE

SEQ ID NO: 1220652 - protein, 5 aa, Mycobacterium
QSPEQ

SEQ ID NO: 1220653 - protein, 17 aa, Mycobacterium
QSPIRGSRRSNPATYTG

SEQ ID NO: 1220654 - protein, 9 aa, Mycobacterium
QSPLAGNPE

SEQ ID NO: 1220655 - protein, 5 aa, Mycobacterium
QSPLT

SEQ ID NO: 1220656 - protein, 7 aa, Mycobacterium
QSPNARL

SEQ ID NO: 1220657 - protein, 10 aa, Mycobacterium
QSPPGRTDAV

SEQ ID NO: 1220658 - protein, 9 aa, Mycobacterium
QSPPGVQRG

SEQ ID NO: 1220659 - protein, 12 aa, Mycobacterium
QSPQLEAAAEAV

SEQ ID NO: 1220660 - protein, 6 aa, Mycobacterium
QSPRGA

SEQ ID NO: 1220661 - protein, 8 aa, Mycobacterium
QSPTDNSR

SEQ ID NO: 1220662 - protein, 5 aa, Mycobacterium
QSQMD

SEQ ID NO: 1220663 - protein, 8 aa, Mycobacterium
QSQPRQKQ

SEQ ID NO: 1220664 - protein, 9 aa, Mycobacterium
QSRAAQREN

SEQ ID NO: 1220665 - protein, 9 aa, Mycobacterium
QSRDPEHDK

SEQ ID NO: 1220666 - protein, 7 aa, Mycobacterium
QSREDYD

SEQ ID NO: 1220667 - protein, 9 aa, Mycobacterium
QSRENGATI

SEQ ID NO: 1220668 - protein, 12 aa, Mycobacterium
QSREPGEPPPAF

SEQ ID NO: 1220669 - protein, 4 aa, Mycobacterium
QSRG

SEQ ID NO: 1220670 - protein, 8 aa, Mycobacterium
QSRGVTDE

SEQ ID NO: 1220671 - protein, 8 aa, Mycobacterium
QSRGYERE

SEQ ID NO: 1220672 - protein, 16 aa, Mycobacterium
QSRMNQAKQERSRDDE

SEQ ID NO: 1220673 - protein, 4 aa, Mycobacterium
QSRP

SEQ ID NO: 1220674 - protein, 14 aa, Mycobacterium
QSRQDPSYPVYTTS

SEQ ID NO: 1220675 - protein, 56 aa, Mycobacterium
QSRTPPPVAGTDAVTEPAAPPPADSAPPIEHAPARSATAPTASPTPSTSGGQVDRR

SEQ ID NO: 1220676 - protein, 7 aa, Mycobacterium
QSRYETA

SEQ ID NO: 1220677 - protein, 7 aa, Mycobacterium
QSSEGSF

SEQ ID NO: 1220678 - protein, 11 aa, Mycobacterium
QSSEPTPKAEV

SEQ ID NO: 1220679 - protein, 5 aa, Mycobacterium
QSSGM

SEQ ID NO: 1220680 - protein, 11 aa, Mycobacterium
QSSGRGRHGRQ

SEQ ID NO: 1220681 - protein, 7 aa, Mycobacterium
QSSKDAA

SEQ ID NO: 1220682 - protein, 8 aa, Mycobacterium
QSSKTRAG

SEQ ID NO: 1220683 - protein, 8 aa, Mycobacterium
QSSPNLRD

SEQ ID NO: 1220684 - protein, 15 aa, Mycobacterium
QSSPSACGGRSLTQG

SEQ ID NO: 1220685 - protein, 10 aa, Mycobacterium
QSSPSSADTL

SEQ ID NO: 1220686 - protein, 9 aa, Mycobacterium
QSSYQKCEK

SEQ ID NO: 1220687 - protein, 5 aa, Mycobacterium
QSTAD

SEQ ID NO: 1220688 - protein, 7 aa, Mycobacterium
QSTADQL

SEQ ID NO: 1220689 - protein, 8 aa, Mycobacterium
QSTAGSAL

SEQ ID NO: 1220690 - protein, 7 aa, Mycobacterium
QSTDELV

SEQ ID NO: 1220691 - protein, 7 aa, Mycobacterium
QSTENGR

SEQ ID NO: 1220692 - protein, 8 aa, Mycobacterium
QSTHGTWN

SEQ ID NO: 1220693 - protein, 16 aa, Mycobacterium
QSTKRNRDIASRSNEV

SEQ ID NO: 1220694 - protein, 4 aa, Mycobacterium
QSTL

SEQ ID NO: 1220695 - protein, 5 aa, Mycobacterium
QSTLA

SEQ ID NO: 1220696 - protein, 15 aa, Mycobacterium
QSTPGADGAGSGFTQ

SEQ ID NO: 1220697 - protein, 7 aa, Mycobacterium
QSTRRTY

SEQ ID NO: 1220698 - protein, 10 aa, Mycobacterium
QSTVRTGDPA

SEQ ID NO: 1220699 - protein, 6 aa, Mycobacterium
QSVERR

SEQ ID NO: 1220700 - protein, 4 aa, Mycobacterium
QSVG

SEQ ID NO: 1220701 - protein, 15 aa, Mycobacterium
QSVGGGIDHKATAEQ

SEQ ID NO: 1220702 - protein, 8 aa, Mycobacterium
QSVPDPRD

SEQ ID NO: 1220703 - protein, 6 aa, Mycobacterium
QSVQNT

SEQ ID NO: 1220704 - protein, 8 aa, Mycobacterium
QSVRSQGE

SEQ ID NO: 1220705 - protein, 35 aa, Mycobacterium
QSVSVKAPSIKVTADTTATVSASGPTVIQGAPVKI

SEQ ID NO: 1220706 - protein, 6 aa, Mycobacterium
QSWATN

SEQ ID NO: 1220707 - protein, 12 aa, Mycobacterium
QSWKKPPPREDA

SEQ ID NO: 1220708 - protein, 4 aa, Mycobacterium
QSWQ

SEQ ID NO: 1220709 - protein, 18 aa, Mycobacterium
QSYAARRPHELSGGQQQR

SEQ ID NO: 1220710 - protein, 9 aa, Mycobacterium
QTAAGGPVT

SEQ ID NO: 1220711 - protein, 4 aa, Mycobacterium
QTAD

SEQ ID NO: 1220712 - protein, 22 aa, Mycobacterium
QTADDPDPEEQRELESRAAGLK

SEQ ID NO: 1220713 - protein, 4 aa, Mycobacterium
QTAE

SEQ ID NO: 1220714 - protein, 5 aa, Mycobacterium
QTAEN

SEQ ID NO: 1220715 - protein, 9 aa, Mycobacterium
QTAETRRDP

SEQ ID NO: 1220716 - protein, 4 aa, Mycobacterium
QTAG

SEQ ID NO: 1220717 - protein, 9 aa, Mycobacterium
QTAGERPIP

SEQ ID NO: 1220718 - protein, 19 aa, Mycobacterium
QTAGRGRHGRSWSAPPRSQ

SEQ ID NO: 1220719 - protein, 4 aa, Mycobacterium
QTAK

SEQ ID NO: 1220720 - protein, 5 aa, Mycobacterium
QTAPV

SEQ ID NO: 1220721 - protein, 5 aa, Mycobacterium
QTAQR

SEQ ID NO: 1220722 - protein, 7 aa, Mycobacterium
QTARTAA

SEQ ID NO: 1220723 - protein, 9 aa, Mycobacterium
QTDAKTGKP

SEQ ID NO: 1220724 - protein, 8 aa, Mycobacterium
QTDEGKRA

SEQ ID NO: 1220725 - protein, 14 aa, Mycobacterium
QTDGDVPADTDAKA

SEQ ID NO: 1220726 - protein, 6 aa, Mycobacterium
QTDGPL

SEQ ID NO: 1220727 - protein, 5 aa, Mycobacterium
QTDGR

SEQ ID NO: 1220728 - protein, 4 aa, Mycobacterium
QTDK

SEQ ID NO: 1220729 - protein, 16 aa, Mycobacterium
QTDLQAGAPHAGRNQG

SEQ ID NO: 1220730 - protein, 9 aa, Mycobacterium
QTDPDKGAL

SEQ ID NO: 1220731 - protein, 6 aa, Mycobacterium
QTDSAE

SEQ ID NO: 1220732 - protein, 14 aa, Mycobacterium
QTDSAWSENPLSRT

SEQ ID NO: 1220733 - protein, 4 aa, Mycobacterium
QTDT

SEQ ID NO: 1220734 - protein, 4 aa, Mycobacterium
QTDV

SEQ ID NO: 1220735 - protein, 14 aa, Mycobacterium
QTDWEARGAKGRAK

SEQ ID NO: 1220736 - protein, 12 aa, Mycobacterium
QTDWGAAGSDRP

SEQ ID NO: 1220737 - protein, 6 aa, Mycobacterium
QTEAGV

SEQ ID NO: 1220738 - protein, 7 aa, Mycobacterium
QTEFNAG

SEQ ID NO: 1220739 - protein, 5 aa, Mycobacterium
QTEPF

SEQ ID NO: 1220740 - protein, 5 aa, Mycobacterium
QTERF

SEQ ID NO: 1220741 - protein, 8 aa, Mycobacterium
QTERPEKY

SEQ ID NO: 1220742 - protein, 6 aa, Mycobacterium
QTETTG

SEQ ID NO: 1220743 - protein, 14 aa, Mycobacterium
QTEYNAGSRMQGQL

SEQ ID NO: 1220744 - protein, 5 aa, Mycobacterium
QTFGG

SEQ ID NO: 1220745 - protein, 8 aa, Mycobacterium
QTGEDTKP

SEQ ID NO: 1220746 - protein, 4 aa, Mycobacterium
QTGF

SEQ ID NO: 1220747 - protein, 5 aa, Mycobacterium
QTGGE

SEQ ID NO: 1220748 - protein, 5 aa, Mycobacterium
QTGGK

SEQ ID NO: 1220749 - protein, 4 aa, Mycobacterium
QTGI

SEQ ID NO: 1220750 - protein, 5 aa, Mycobacterium
QTGIA

SEQ ID NO: 1220751 - protein, 6 aa, Mycobacterium
QTGIAR

SEQ ID NO: 1220752 - protein, 6 aa, Mycobacterium
QTGKPL

SEQ ID NO: 1220753 - protein, 9 aa, Mycobacterium
QTGNAEEFA

SEQ ID NO: 1220754 - protein, 7 aa, Mycobacterium
QTGPACH

SEQ ID NO: 1220755 - protein, 14 aa, Mycobacterium
QTGPFRPANTIRGA

SEQ ID NO: 1220756 - protein, 5 aa, Mycobacterium
QTGQL

SEQ ID NO: 1220757 - protein, 11 aa, Mycobacterium
QTGRDVGTERA

SEQ ID NO: 1220758 - protein, 6 aa, Mycobacterium
QTGRSL

SEQ ID NO: 1220759 - protein, 6 aa, Mycobacterium
QTGRTA

SEQ ID NO: 1220760 - protein, 6 aa, Mycobacterium
QTGTFT

SEQ ID NO: 1220761 - protein, 8 aa, Mycobacterium
QTGTGPVV

SEQ ID NO: 1220762 - protein, 4 aa, Mycobacterium
QTIA

SEQ ID NO: 1220763 - protein, 15 aa, Mycobacterium
QTIDSGDQGRAETGK

SEQ ID NO: 1220764 - protein, 4 aa, Mycobacterium
QTIQ

SEQ ID NO: 1220765 - protein, 7 aa, Mycobacterium
QTKHPQI

SEQ ID NO: 1220766 - protein, 9 aa, Mycobacterium
QTKVPDEPG

SEQ ID NO: 1220767 - protein, 6 aa, Mycobacterium
QTLEDN

SEQ ID NO: 1220768 - protein, 8 aa, Mycobacterium
QTLPSGAT

SEQ ID NO: 1220769 - protein, 7 aa, Mycobacterium
QTLRPTG

SEQ ID NO: 1220770 - protein, 8 aa, Mycobacterium
QTLSQQTN

SEQ ID NO: 1220771 - protein, 8 aa, Mycobacterium
QTNEDRRA

SEQ ID NO: 1220772 - protein, 5 aa, Mycobacterium
QTNEF

SEQ ID NO: 1220773 - protein, 7 aa, Mycobacterium
QTNYSAA

SEQ ID NO: 1220774 - protein, 5 aa, Mycobacterium
QTPAA

SEQ ID NO: 1220775 - protein, 5 aa, Mycobacterium
QTPAS

SEQ ID NO: 1220776 - protein, 4 aa, Mycobacterium
QTPD

SEQ ID NO: 1220777 - protein, 6 aa, Mycobacterium
QTPEMG

SEQ ID NO: 1220778 - protein, 9 aa, Mycobacterium
QTPIPQRGD

SEQ ID NO: 1220779 - protein, 8 aa, Mycobacterium
QTPPGDVG

SEQ ID NO: 1220780 - protein, 7 aa, Mycobacterium
QTPPGWH

SEQ ID NO: 1220781 - protein, 9 aa, Mycobacterium
QTPPSEATG

SEQ ID NO: 1220782 - protein, 5 aa, Mycobacterium
QTPPV

SEQ ID NO: 1220783 - protein, 16 aa, Mycobacterium
QTPRINGDDYPTPDGT

SEQ ID NO: 1220784 - protein, 8 aa, Mycobacterium
QTPTGEAQ

SEQ ID NO: 1220785 - protein, 8 aa, Mycobacterium
QTQERGGS

SEQ ID NO: 1220786 - protein, 6 aa, Mycobacterium
QTQPEL

SEQ ID NO: 1220787 - protein, 9 aa, Mycobacterium
QTQPNAGHR

SEQ ID NO: 1220788 - protein, 6 aa, Mycobacterium
QTRAEP

SEQ ID NO: 1220789 - protein, 6 aa, Mycobacterium
QTRDTA

SEQ ID NO: 1220790 - protein, 15 aa, Mycobacterium
QTREHADHRSYAGTV

SEQ ID NO: 1220791 - protein, 9 aa, Mycobacterium
QTRKGKGNA

SEQ ID NO: 1220792 - protein, 9 aa, Mycobacterium
QTRKGPGER

SEQ ID NO: 1220793 - protein, 4 aa, Mycobacterium
QTRR

SEQ ID NO: 1220794 - protein, 7 aa, Mycobacterium
QTRRDGA

SEQ ID NO: 1220795 - protein, 6 aa, Mycobacterium
QTRREL

SEQ ID NO: 1220796 - protein, 9 aa, Mycobacterium
QTSAPATTV

SEQ ID NO: 1220797 - protein, 8 aa, Mycobacterium
QTSDAQAL

SEQ ID NO: 1220798 - protein, 6 aa, Mycobacterium
QTSDTY

SEQ ID NO: 1220799 - protein, 9 aa, Mycobacterium
QTSEEVTVE

SEQ ID NO: 1220800 - protein, 12 aa, Mycobacterium
QTSGGAGPFGDG

SEQ ID NO: 1220801 - protein, 18 aa, Mycobacterium
QTSGRKATAVGKPAPEGF

SEQ ID NO: 1220802 - protein, 6 aa, Mycobacterium
QTSGVN

SEQ ID NO: 1220803 - protein, 4 aa, Mycobacterium
QTSI

SEQ ID NO: 1220804 - protein, 20 aa, Mycobacterium
QTSRATRRVAKTREEGDRGV

SEQ ID NO: 1220805 - protein, 17 aa, Mycobacterium
QTSSQDLVEGRKTGPPV

SEQ ID NO: 1220806 - protein, 9 aa, Mycobacterium
QTSSRYPGG

SEQ ID NO: 1220807 - protein, 6 aa, Mycobacterium
QTSTFS

SEQ ID NO: 1220808 - protein, 8 aa, Mycobacterium
QTSTTPAH

SEQ ID NO: 1220809 - protein, 7 aa, Mycobacterium
QTTEACG

SEQ ID NO: 1220810 - protein, 7 aa, Mycobacterium
QTTHEGV

SEQ ID NO: 1220811 - protein, 5 aa, Mycobacterium
QTTQA

SEQ ID NO: 1220812 - protein, 7 aa, Mycobacterium
QTTSVEA

SEQ ID NO: 1220813 - protein, 7 aa, Mycobacterium
QTTTARD

SEQ ID NO: 1220814 - protein, 7 aa, Mycobacterium
QTTTDDH

SEQ ID NO: 1220815 - protein, 7 aa, Mycobacterium
QTTTTGL

SEQ ID NO: 1220816 - protein, 17 aa, Mycobacterium
QTVDAGKALSRAESRHG

SEQ ID NO: 1220817 - protein, 5 aa, Mycobacterium
QTVDP

SEQ ID NO: 1220818 - protein, 16 aa, Mycobacterium
QTVGPEAAGPLLTDDD

SEQ ID NO: 1220819 - protein, 6 aa, Mycobacterium
QTVPGR

SEQ ID NO: 1220820 - protein, 9 aa, Mycobacterium
QTVPRRDRG

SEQ ID NO: 1220821 - protein, 10 aa, Mycobacterium
QTVRRSPGAY

SEQ ID NO: 1220822 - protein, 5 aa, Mycobacterium
QTVSG

SEQ ID NO: 1220823 - protein, 4 aa, Mycobacterium
QTYR

SEQ ID NO: 1220824 - protein, 5 aa, Mycobacterium
QTYRT

SEQ ID NO: 1220825 - protein, 8 aa, Mycobacterium
QVAANQKQ

SEQ ID NO: 1220826 - protein, 4 aa, Mycobacterium
QVAE

SEQ ID NO: 1220827 - protein, 12 aa, Mycobacterium
QVAESGGETEFA

SEQ ID NO: 1220828 - protein, 15 aa, Mycobacterium
QVAESGGETEFASSY

SEQ ID NO: 1220829 - protein, 7 aa, Mycobacterium
QVAESTD

SEQ ID NO: 1220830 - protein, 28 aa, Mycobacterium
QVAGPDISGARRCERGCGRQGDRPTRCA

SEQ ID NO: 1220831 - protein, 7 aa, Mycobacterium
QVAQAPD

SEQ ID NO: 1220832 - protein, 10 aa, Mycobacterium
QVAQHRSDTV

SEQ ID NO: 1220833 - protein, 8 aa, Mycobacterium
QVASDDAE

SEQ ID NO: 1220834 - protein, 7 aa, Mycobacterium
QVDEADA

SEQ ID NO: 1220835 - protein, 6 aa, Mycobacterium
QVDQSA

SEQ ID NO: 1220836 - protein, 17 aa, Mycobacterium
QVDQTARPPHQRRPRFD

SEQ ID NO: 1220837 - protein, 9 aa, Mycobacterium
QVDTDDRSA

SEQ ID NO: 1220838 - protein, 8 aa, Mycobacterium
QVENLNSK

SEQ ID NO: 1220839 - protein, 5 aa, Mycobacterium
QVEST

SEQ ID NO: 1220840 - protein, 6 aa, Mycobacterium
QVGDDE

SEQ ID NO: 1220841 - protein, 6 aa, Mycobacterium
QVGEPD

SEQ ID NO: 1220842 - protein, 19 aa, Mycobacterium
QVGNRAVGDRPSQNLTTGQ

SEQ ID NO: 1220843 - protein, 8 aa, Mycobacterium
QVGSPGAM

SEQ ID NO: 1220844 - protein, 12 aa, Mycobacterium
QVGTAAAARRAV

SEQ ID NO: 1220845 - protein, 7 aa, Mycobacterium
QVGTRTP

SEQ ID NO: 1220846 - protein, 13 aa, Mycobacterium
QVHEDQRRGAWTT

SEQ ID NO: 1220847 - protein, 10 aa, Mycobacterium
QVKDSESSTV

SEQ ID NO: 1220848 - protein, 5 aa, Mycobacterium
QVKHA

SEQ ID NO: 1220849 - protein, 20 aa, Mycobacterium
QVNGRNSFQRDKAKGPDDWA

SEQ ID NO: 1220850 - protein, 5 aa, Mycobacterium
QVPDA

SEQ ID NO: 1220851 - protein, 7 aa, Mycobacterium
QVPDENV

SEQ ID NO: 1220852 - protein, 10 aa, Mycobacterium
QVPDRAAAER

SEQ ID NO: 1220853 - protein, 5 aa, Mycobacterium
QVPEG

SEQ ID NO: 1220854 - protein, 7 aa, Mycobacterium
QVPGGEN

SEQ ID NO: 1220855 - protein, 12 aa, Mycobacterium
QVPGSPAPQVAN

SEQ ID NO: 1220856 - protein, 6 aa, Mycobacterium
QVPPGG

SEQ ID NO: 1220857 - protein, 16 aa, Mycobacterium
QVPPQLRTQRRFEPDR

SEQ ID NO: 1220858 - protein, 4 aa, Mycobacterium
QVPR

SEQ ID NO: 1220859 - protein, 5 aa, Mycobacterium
QVPTS

SEQ ID NO: 1220860 - protein, 26 aa, Mycobacterium
QVPTSPPPAPGAPESNRGRLTKDGEP

SEQ ID NO: 1220861 - protein, 10 aa, Mycobacterium
QVPYKTPTYA

SEQ ID NO: 1220862 - protein, 7 aa, Mycobacterium
QVQGSGL

SEQ ID NO: 1220863 - protein, 5 aa, Mycobacterium
QVRAR

SEQ ID NO: 1220864 - protein, 14 aa, Mycobacterium
QVRASQSGGSTRMA

SEQ ID NO: 1220865 - protein, 21 aa, Mycobacterium
QVRDGDAPAGRLDTTPAGRLD

SEQ ID NO: 1220866 - protein, 11 aa, Mycobacterium
QVRKGGGDTPY

SEQ ID NO: 1220867 - protein, 6 aa, Mycobacterium
QVRNGN

SEQ ID NO: 1220868 - protein, 42 aa, Mycobacterium
QVRPGDPSEGGPSGARAPGGLSERVGGDYRGVQTVGDERRDA

SEQ ID NO: 1220869 - protein, 8 aa, Mycobacterium
QVRPTGSA

SEQ ID NO: 1220870 - protein, 10 aa, Mycobacterium
QVRSDNTGYD

SEQ ID NO: 1220871 - protein, 20 aa, Mycobacterium
QVRSGKLGKKAARADRPAWG

SEQ ID NO: 1220872 - protein, 21 aa, Mycobacterium
QVRSPSDPGYVPTAPPAMTRE

SEQ ID NO: 1220873 - protein, 5 aa, Mycobacterium
QVRTD

SEQ ID NO: 1220874 - protein, 7 aa, Mycobacterium
QVRTTTT

SEQ ID NO: 1220875 - protein, 9 aa, Mycobacterium
QVSAESGRT

SEQ ID NO: 1220876 - protein, 4 aa, Mycobacterium
QVSG

SEQ ID NO: 1220877 - protein, 8 aa, Mycobacterium
QVSGKYTD

SEQ ID NO: 1220878 - protein, 9 aa, Mycobacterium
QVSPAPPAR

SEQ ID NO: 1220879 - protein, 6 aa, Mycobacterium
QVSPST

SEQ ID NO: 1220880 - protein, 5 aa, Mycobacterium
QVSRS

SEQ ID NO: 1220881 - protein, 4 aa, Mycobacterium
QVTA

SEQ ID NO: 1220882 - protein, 7 aa, Mycobacterium
QVTATGG

SEQ ID NO: 1220883 - protein, 8 aa, Mycobacterium
QVTDGKAV

SEQ ID NO: 1220884 - protein, 8 aa, Mycobacterium
QVTEKAER

SEQ ID NO: 1220885 - protein, 7 aa, Mycobacterium
QVTEPGD

SEQ ID NO: 1220886 - protein, 11 aa, Mycobacterium
QVTGAGSSTLT

SEQ ID NO: 1220887 - protein, 7 aa, Mycobacterium
QVTGGGT

SEQ ID NO: 1220888 - protein, 8 aa, Mycobacterium
QVTGPAGT

SEQ ID NO: 1220889 - protein, 8 aa, Mycobacterium
QVTGPDGV

SEQ ID NO: 1220890 - protein, 6 aa, Mycobacterium
QVTSDD

SEQ ID NO: 1220891 - protein, 9 aa, Mycobacterium
QVTSDPERD

SEQ ID NO: 1220892 - protein, 14 aa, Mycobacterium
QVVGPRDGETPRTR

SEQ ID NO: 1220893 - protein, 15 aa, Mycobacterium
QVVGRPASRGTVEGT

SEQ ID NO: 1220894 - protein, 8 aa, Mycobacterium
QVVPQPGG

SEQ ID NO: 1220895 - protein, 6 aa, Mycobacterium
QVVSPR

SEQ ID NO: 1220896 - protein, 4 aa, Mycobacterium
QVYD

SEQ ID NO: 1220897 - protein, 9 aa, Mycobacterium
QWAGEPLQT

SEQ ID NO: 1220898 - protein, 19 aa, Mycobacterium
QWDPGTRSCERIDSGPVAE

SEQ ID NO: 1220899 - protein, 10 aa, Mycobacterium
QWDPKNQRPE

SEQ ID NO: 1220900 - protein, 11 aa, Mycobacterium
QWDSTSARCPD

SEQ ID NO: 1220901 - protein, 6 aa, Mycobacterium
QWGPPV

SEQ ID NO: 1220902 - protein, 6 aa, Mycobacterium
QWKGRD

SEQ ID NO: 1220903 - protein, 5 aa, Mycobacterium
QWPGG

SEQ ID NO: 1220904 - protein, 9 aa, Mycobacterium
QWPNPDEAA

SEQ ID NO: 1220905 - protein, 12 aa, Mycobacterium
QWQTDPRQLPAS

SEQ ID NO: 1220906 - protein, 7 aa, Mycobacterium
QWRGTEG

SEQ ID NO: 1220907 - protein, 9 aa, Mycobacterium
QYADEVADK

SEQ ID NO: 1220908 - protein, 11 aa, Mycobacterium
QYAESEEEADQ

SEQ ID NO: 1220909 - protein, 11 aa, Mycobacterium
QYAGREKEIGA

SEQ ID NO: 1220910 - protein, 6 aa, Mycobacterium
QYDEAL

SEQ ID NO: 1220911 - protein, 9 aa, Mycobacterium
QYDGASDVP

SEQ ID NO: 1220912 - protein, 9 aa, Mycobacterium
QYDQRRQNA

SEQ ID NO: 1220913 - protein, 14 aa, Mycobacterium
QYEHGRDTAPTVSG

SEQ ID NO: 1220914 - protein, 5 aa, Mycobacterium
QYEKA

SEQ ID NO: 1220915 - protein, 6 aa, Mycobacterium
QYESAG

SEQ ID NO: 1220916 - protein, 9 aa, Mycobacterium
QYGDAANSS

SEQ ID NO: 1220917 - protein, 4 aa, Mycobacterium
QYGF

SEQ ID NO: 1220918 - protein, 12 aa, Mycobacterium
QYGQGPGPGENI

SEQ ID NO: 1220919 - protein, 9 aa, Mycobacterium
QYHKTGEVL

SEQ ID NO: 1220920 - protein, 10 aa, Mycobacterium
QYNNPDNVEA

SEQ ID NO: 1220921 - protein, 12 aa, Mycobacterium
QYPADDAGGPAV

SEQ ID NO: 1220922 - protein, 7 aa, Mycobacterium
QYPDNAS

SEQ ID NO: 1220923 - protein, 12 aa, Mycobacterium
QYRARAGRELTD

SEQ ID NO: 1220924 - protein, 5 aa, Mycobacterium
QYRER

SEQ ID NO: 1220925 - protein, 12 aa, Mycobacterium
QYRGQRPRPYTT

SEQ ID NO: 1220926 - protein, 6 aa, Mycobacterium
QYRQHN

SEQ ID NO: 1220927 - protein, 6 aa, Mycobacterium
QYRSGD

SEQ ID NO: 1220928 - protein, 11 aa, Mycobacterium
QYRSGQGGAQA

SEQ ID NO: 1220929 - protein, 11 aa, Mycobacterium
QYSATDGQARA

SEQ ID NO: 1220930 - protein, 9 aa, Mycobacterium
QYTSQGPSR

SEQ ID NO: 1220931 - protein, 4 aa, Mycobacterium
RAAA

SEQ ID NO: 1220932 - protein, 8 aa, Mycobacterium
RAAAASRD

SEQ ID NO: 1220933 - protein, 7 aa, Mycobacterium
RAAADDD

SEQ ID NO: 1220934 - protein, 7 aa, Mycobacterium
RAAADDL

SEQ ID NO: 1220935 - protein, 6 aa, Mycobacterium
RAAADG

SEQ ID NO: 1220936 - protein, 8 aa, Mycobacterium
RAAADGFR

SEQ ID NO: 1220937 - protein, 17 aa, Mycobacterium
RAAADGKTVAAPEEPKD

SEQ ID NO: 1220938 - protein, 7 aa, Mycobacterium
RAAADGL

SEQ ID NO: 1220939 - protein, 7 aa, Mycobacterium
RAAADPR

SEQ ID NO: 1220940 - protein, 7 aa, Mycobacterium
RAAADRG

SEQ ID NO: 1220941 - protein, 7 aa, Mycobacterium
RAAAGAG

SEQ ID NO: 1220942 - protein, 36 aa, Mycobacterium
RAAAGGPGGRTGERVGGRGGGGGGADLRGGADGAGG

SEQ ID NO: 1220943 - protein, 9 aa, Mycobacterium
RAAAGSREN

SEQ ID NO: 1220944 - protein, 17 aa, Mycobacterium
RAAAKQKRRQKASMQDR

SEQ ID NO: 1220945 - protein, 10 aa, Mycobacterium
RAAAKTAKLK

SEQ ID NO: 1220946 - protein, 12 aa, Mycobacterium
RAAANRNAFEEN

SEQ ID NO: 1220947 - protein, 14 aa, Mycobacterium
RAAARQSVKAATDD

SEQ ID NO: 1220948 - protein, 12 aa, Mycobacterium
RAAASADPDPLI

SEQ ID NO: 1220949 - protein, 13 aa, Mycobacterium
RAAASPARRPVDE

SEQ ID NO: 1220950 - protein, 8 aa, Mycobacterium
RAAATAPY

SEQ ID NO: 1220951 - protein, 10 aa, Mycobacterium
RAAATDPSPM

SEQ ID NO: 1220952 - protein, 8 aa, Mycobacterium
RAADAAGA

SEQ ID NO: 1220953 - protein, 7 aa, Mycobacterium
RAADEEV

SEQ ID NO: 1220954 - protein, 9 aa, Mycobacterium
RAADKPDDL

SEQ ID NO: 1220955 - protein, 10 aa, Mycobacterium
RAADLAGQAG

SEQ ID NO: 1220956 - protein, 9 aa, Mycobacterium
RAADPPANW

SEQ ID NO: 1220957 - protein, 6 aa, Mycobacterium
RAADPR

SEQ ID NO: 1220958 - protein, 10 aa, Mycobacterium
RAADREGPEF

SEQ ID NO: 1220959 - protein, 8 aa, Mycobacterium
RAADRGEY

SEQ ID NO: 1220960 - protein, 7 aa, Mycobacterium
RAADRKY

SEQ ID NO: 1220961 - protein, 9 aa, Mycobacterium
RAADSGDDL

SEQ ID NO: 1220962 - protein, 9 aa, Mycobacterium
RAADTGTEW

SEQ ID NO: 1220963 - protein, 13 aa, Mycobacterium
RAADTSSPEERQE

SEQ ID NO: 1220964 - protein, 7 aa, Mycobacterium
RAAEAER

SEQ ID NO: 1220965 - protein, 7 aa, Mycobacterium
RAAEDNE

SEQ ID NO: 1220966 - protein, 8 aa, Mycobacterium
RAAEGDDN

SEQ ID NO: 1220967 - protein, 10 aa, Mycobacterium
RAAEMGGDTS

SEQ ID NO: 1220968 - protein, 10 aa, Mycobacterium
RAAERGADRH

SEQ ID NO: 1220969 - protein, 6 aa, Mycobacterium
RAAESG

SEQ ID NO: 1220970 - protein, 13 aa, Mycobacterium
RAAESGKGGGRGV

SEQ ID NO: 1220971 - protein, 18 aa, Mycobacterium
RAAESGSKLRAAKGINVP

SEQ ID NO: 1220972 - protein, 8 aa, Mycobacterium
RAAETAGR

SEQ ID NO: 1220973 - protein, 11 aa, Mycobacterium
RAAETERPEPL

SEQ ID NO: 1220974 - protein, 5 aa, Mycobacterium
RAAGA

SEQ ID NO: 1220975 - protein, 9 aa, Mycobacterium
RAAGADAIH

SEQ ID NO: 1220976 - protein, 9 aa, Mycobacterium
RAAGADSDE

SEQ ID NO: 1220977 - protein, 6 aa, Mycobacterium
RAAGAE

SEQ ID NO: 1220978 - protein, 18 aa, Mycobacterium
RAAGAKAGLSVKPGTPLE

SEQ ID NO: 1220979 - protein, 11 aa, Mycobacterium
RAAGALKPGAR

SEQ ID NO: 1220980 - protein, 9 aa, Mycobacterium
RAAGDPQSV

SEQ ID NO: 1220981 - protein, 6 aa, Mycobacterium
RAAGEG

SEQ ID NO: 1220982 - protein, 18 aa, Mycobacterium
RAAGLSKQSINRRVQSGD

SEQ ID NO: 1220983 - protein, 6 aa, Mycobacterium
RAAGPD

SEQ ID NO: 1220984 - protein, 8 aa, Mycobacterium
RAAGPDNF

SEQ ID NO: 1220985 - protein, 9 aa, Mycobacterium
RAAGQAELA

SEQ ID NO: 1220986 - protein, 9 aa, Mycobacterium
RAAGRPEWQ

SEQ ID NO: 1220987 - protein, 30 aa, Mycobacterium
RAAGRRPDWTKQDESVPSAPGGDESVPMAA

SEQ ID NO: 1220988 - protein, 12 aa, Mycobacterium
RAAGRVDGVRPG

SEQ ID NO: 1220989 - protein, 13 aa, Mycobacterium
RAAGSGADRAGSC

SEQ ID NO: 1220990 - protein, 7 aa, Mycobacterium
RAALENK

SEQ ID NO: 1220991 - protein, 5 aa, Mycobacterium
RAALG

SEQ ID NO: 1220992 - protein, 9 aa, Mycobacterium
RAALTAGGA

SEQ ID NO: 1220993 - protein, 4 aa, Mycobacterium
RAAN

SEQ ID NO: 1220994 - protein, 8 aa, Mycobacterium
RAANHPGV

SEQ ID NO: 1220995 - protein, 6 aa, Mycobacterium
RAANRH

SEQ ID NO: 1220996 - protein, 15 aa, Mycobacterium
RAANRRGHARELVGS

SEQ ID NO: 1220997 - protein, 10 aa, Mycobacterium
RAAPESPGGF

SEQ ID NO: 1220998 - protein, 7 aa, Mycobacterium
RAAPGAT

SEQ ID NO: 1220999 - protein, 6 aa, Mycobacterium
RAAPGF

SEQ ID NO: 1221000 - protein, 9 aa, Mycobacterium
RAAPHDPEG

SEQ ID NO: 1221001 - protein, 30 aa, Mycobacterium
RAAPRADRRPSGRAYRDSHTDVSDGTAKTD

SEQ ID NO: 1221002 - protein, 7 aa, Mycobacterium
RAAPSAR

SEQ ID NO: 1221003 - protein, 31 aa, Mycobacterium
RAAPSARITATDPDPRAVTRARRKAAGEGPV

SEQ ID NO: 1221004 - protein, 8 aa, Mycobacterium
RAAPYSMK

SEQ ID NO: 1221005 - protein, 9 aa, Mycobacterium
RAAQPDEIA

SEQ ID NO: 1221006 - protein, 14 aa, Mycobacterium
RAAQPVSAGWSGTE

SEQ ID NO: 1221007 - protein, 8 aa, Mycobacterium
RAAQRDGS

SEQ ID NO: 1221008 - protein, 5 aa, Mycobacterium
RAAQT

SEQ ID NO: 1221009 - protein, 7 aa, Mycobacterium
RAAQVNP

SEQ ID NO: 1221010 - protein, 8 aa, Mycobacterium
RAARDDRV

SEQ ID NO: 1221011 - protein, 10 aa, Mycobacterium
RAARDGDDDY

SEQ ID NO: 1221012 - protein, 6 aa, Mycobacterium
RAAREL

SEQ ID NO: 1221013 - protein, 8 aa, Mycobacterium
RAARGQLR

SEQ ID NO: 1221014 - protein, 5 aa, Mycobacterium
RAARP

SEQ ID NO: 1221015 - protein, 8 aa, Mycobacterium
RAASANRY

SEQ ID NO: 1221016 - protein, 10 aa, Mycobacterium
RAASDATGRA

SEQ ID NO: 1221017 - protein, 8 aa, Mycobacterium
RAASDGAV

SEQ ID NO: 1221018 - protein, 12 aa, Mycobacterium
RAATAADDPAAD

SEQ ID NO: 1221019 - protein, 7 aa, Mycobacterium
RAATDHD

SEQ ID NO: 1221020 - protein, 6 aa, Mycobacterium
RAATQL

SEQ ID NO: 1221021 - protein, 14 aa, Mycobacterium
RAAVPSGASTGEHE

SEQ ID NO: 1221022 - protein, 7 aa, Mycobacterium
RAAYRTG

SEQ ID NO: 1221023 - protein, 4 aa, Mycobacterium
RADA

SEQ ID NO: 1221024 - protein, 11 aa, Mycobacterium
RADAAAAVDDP

SEQ ID NO: 1221025 - protein, 10 aa, Mycobacterium
RADADRQTAL

SEQ ID NO: 1221026 - protein, 8 aa, Mycobacterium
RADAGDRS

SEQ ID NO: 1221027 - protein, 9 aa, Mycobacterium
RADAVGEPF

SEQ ID NO: 1221028 - protein, 4 aa, Mycobacterium
RADD

SEQ ID NO: 1221029 - protein, 6 aa, Mycobacterium
RADDGW

SEQ ID NO: 1221030 - protein, 5 aa, Mycobacterium
RADDL

SEQ ID NO: 1221031 - protein, 8 aa, Mycobacterium
RADDPAAH

SEQ ID NO: 1221032 - protein, 16 aa, Mycobacterium
RADDRARALREDGTTI

SEQ ID NO: 1221033 - protein, 10 aa, Mycobacterium
RADDSAPLTL

SEQ ID NO: 1221034 - protein, 5 aa, Mycobacterium
RADEA

SEQ ID NO: 1221035 - protein, 7 aa, Mycobacterium
RADEANA

SEQ ID NO: 1221036 - protein, 10 aa, Mycobacterium
RADESGDDQN

SEQ ID NO: 1221037 - protein, 6 aa, Mycobacterium
RADGAL

SEQ ID NO: 1221038 - protein, 10 aa, Mycobacterium
RADGAPQTDG

SEQ ID NO: 1221039 - protein, 6 aa, Mycobacterium
RADGAS

SEQ ID NO: 1221040 - protein, 6 aa, Mycobacterium
RADGDD

SEQ ID NO: 1221041 - protein, 10 aa, Mycobacterium
RADGDDVDTE

SEQ ID NO: 1221042 - protein, 7 aa, Mycobacterium
RADGGEA

SEQ ID NO: 1221043 - protein, 10 aa, Mycobacterium
RADGRGANHN

SEQ ID NO: 1221044 - protein, 7 aa, Mycobacterium
RADGRGT

SEQ ID NO: 1221045 - protein, 6 aa, Mycobacterium
RADGSP

SEQ ID NO: 1221046 - protein, 7 aa, Mycobacterium
RADGSTV

SEQ ID NO: 1221047 - protein, 7 aa, Mycobacterium
RADGSWH

SEQ ID NO: 1221048 - protein, 7 aa, Mycobacterium
RADHPDE

SEQ ID NO: 1221049 - protein, 7 aa, Mycobacterium
RADIPVG

SEQ ID NO: 1221050 - protein, 9 aa, Mycobacterium
RADNASGEA

SEQ ID NO: 1221051 - protein, 14 aa, Mycobacterium
RADNPARRAARARS

SEQ ID NO: 1221052 - protein, 9 aa, Mycobacterium
RADNPEQQQ

SEQ ID NO: 1221053 - protein, 12 aa, Mycobacterium
RADNPQPGGRPI

SEQ ID NO: 1221054 - protein, 10 aa, Mycobacterium
RADPAYRQRP

SEQ ID NO: 1221055 - protein, 6 aa, Mycobacterium
RADPDV

SEQ ID NO: 1221056 - protein, 8 aa, Mycobacterium
RADPERRE

SEQ ID NO: 1221057 - protein, 7 aa, Mycobacterium
RADPRAR

SEQ ID NO: 1221058 - protein, 9 aa, Mycobacterium
RADQKPTDG

SEQ ID NO: 1221059 - protein, 4 aa, Mycobacterium
RADR

SEQ ID NO: 1221060 - protein, 13 aa, Mycobacterium
RADRVGGKRKNTV

SEQ ID NO: 1221061 - protein, 10 aa, Mycobacterium
RADSANVTTR

SEQ ID NO: 1221062 - protein, 18 aa, Mycobacterium
RADTHRRTVTRDGRPVSL

SEQ ID NO: 1221063 - protein, 5 aa, Mycobacterium
RADTI

SEQ ID NO: 1221064 - protein, 6 aa, Mycobacterium
RADTRE

SEQ ID NO: 1221065 - protein, 5 aa, Mycobacterium
RADTV

SEQ ID NO: 1221066 - protein, 10 aa, Mycobacterium
RAEADRREGL

SEQ ID NO: 1221067 - protein, 9 aa, Mycobacterium
RAEALDPAV

SEQ ID NO: 1221068 - protein, 8 aa, Mycobacterium
RAEAQRRF

SEQ ID NO: 1221069 - protein, 14 aa, Mycobacterium
RAEDGLPTARRGVR

SEQ ID NO: 1221070 - protein, 8 aa, Mycobacterium
RAEDPAVR

SEQ ID NO: 1221071 - protein, 6 aa, Mycobacterium
RAEDRP

SEQ ID NO: 1221072 - protein, 6 aa, Mycobacterium
RAEELR

SEQ ID NO: 1221073 - protein, 5 aa, Mycobacterium
RAEEQ

SEQ ID NO: 1221074 - protein, 5 aa, Mycobacterium
RAEEY

SEQ ID NO: 1221075 - protein, 4 aa, Mycobacterium
RAEG

SEQ ID NO: 1221076 - protein, 17 aa, Mycobacterium
RAEGATVATGGERPEGT

SEQ ID NO: 1221077 - protein, 7 aa, Mycobacterium
RAEGGDV

SEQ ID NO: 1221078 - protein, 6 aa, Mycobacterium
RAEGIS

SEQ ID NO: 1221079 - protein, 9 aa, Mycobacterium
RAEGKRGGE

SEQ ID NO: 1221080 - protein, 6 aa, Mycobacterium
RAEGRR

SEQ ID NO: 1221081 - protein, 6 aa, Mycobacterium
RAEGRS

SEQ ID NO: 1221082 - protein, 10 aa, Mycobacterium
RAEGSSRSRH

SEQ ID NO: 1221083 - protein, 4 aa, Mycobacterium
RAEK

SEQ ID NO: 1221084 - protein, 9 aa, Mycobacterium
RAEKAHENG

SEQ ID NO: 1221085 - protein, 9 aa, Mycobacterium
RAEKGEGLR

SEQ ID NO: 1221086 - protein, 10 aa, Mycobacterium
RAEKSTADGT

SEQ ID NO: 1221087 - protein, 10 aa, Mycobacterium
RAEKYSPFSG

SEQ ID NO: 1221088 - protein, 13 aa, Mycobacterium
RAELAGPDHPQPW

SEQ ID NO: 1221089 - protein, 17 aa, Mycobacterium
RAELTASAREAGFTGEL

SEQ ID NO: 1221090 - protein, 4 aa, Mycobacterium
RAEN

SEQ ID NO: 1221091 - protein, 5 aa, Mycobacterium
RAENG

SEQ ID NO: 1221092 - protein, 8 aa, Mycobacterium
RAENPDAP

SEQ ID NO: 1221093 - protein, 7 aa, Mycobacterium
RAENQRR

SEQ ID NO: 1221094 - protein, 13 aa, Mycobacterium
RAEPIPGAAESLS

SEQ ID NO: 1221095 - protein, 10 aa, Mycobacterium
RAEPLESAHR

SEQ ID NO: 1221096 - protein, 9 aa, Mycobacterium
RAEQSGDDV

SEQ ID NO: 1221097 - protein, 7 aa, Mycobacterium
RAEREQG

SEQ ID NO: 1221098 - protein, 14 aa, Mycobacterium
RAERGDAIDREATA

SEQ ID NO: 1221099 - protein, 7 aa, Mycobacterium
RAERNGD

SEQ ID NO: 1221100 - protein, 10 aa, Mycobacterium
RAERQGELSG

SEQ ID NO: 1221101 - protein, 18 aa, Mycobacterium
RAERRTPPDGAGRPIADA

SEQ ID NO: 1221102 - protein, 11 aa, Mycobacterium
RAESADGREGV

SEQ ID NO: 1221103 - protein, 19 aa, Mycobacterium
RAESAVPGAIPRVVRQLAT

SEQ ID NO: 1221104 - protein, 7 aa, Mycobacterium
RAESDDL

SEQ ID NO: 1221105 - protein, 8 aa, Mycobacterium
RAESGGVL

SEQ ID NO: 1221106 - protein, 11 aa, Mycobacterium
RAESIPERNRP

SEQ ID NO: 1221107 - protein, 8 aa, Mycobacterium
RAETDDVT

SEQ ID NO: 1221108 - protein, 8 aa, Mycobacterium
RAETGGVP

SEQ ID NO: 1221109 - protein, 8 aa, Mycobacterium
RAETPDDV

SEQ ID NO: 1221110 - protein, 9 aa, Mycobacterium
RAETPRPEY

SEQ ID NO: 1221111 - protein, 7 aa, Mycobacterium
RAEVSKR

SEQ ID NO: 1221112 - protein, 7 aa, Mycobacterium
RAEYQSA

SEQ ID NO: 1221113 - protein, 12 aa, Mycobacterium
RAEYRPITDTEA

SEQ ID NO: 1221114 - protein, 11 aa, Mycobacterium
RAFDDTDWSRD

SEQ ID NO: 1221115 - protein, 8 aa, Mycobacterium
RAFDESDW

SEQ ID NO: 1221116 - protein, 11 aa, Mycobacterium
RAFDPGADLDR

SEQ ID NO: 1221117 - protein, 8 aa, Mycobacterium
RAFSAGGD

SEQ ID NO: 1221118 - protein, 10 aa, Mycobacterium
RAFSAGNDLK

SEQ ID NO: 1221119 - protein, 8 aa, Mycobacterium
RAGAATLG

SEQ ID NO: 1221120 - protein, 5 aa, Mycobacterium
RAGAD

SEQ ID NO: 1221121 - protein, 6 aa, Mycobacterium
RAGADA

SEQ ID NO: 1221122 - protein, 9 aa, Mycobacterium
RAGADDTLD

SEQ ID NO: 1221123 - protein, 7 aa, Mycobacterium
RAGADSL

SEQ ID NO: 1221124 - protein, 18 aa, Mycobacterium
RAGAEARTSARDVADRAE

SEQ ID NO: 1221125 - protein, 11 aa, Mycobacterium
RAGAEATVRDD

SEQ ID NO: 1221126 - protein, 12 aa, Mycobacterium
RAGAIAADGGMG

SEQ ID NO: 1221127 - protein, 10 aa, Mycobacterium
RAGAPERAEN

SEQ ID NO: 1221128 - protein, 10 aa, Mycobacterium
RAGARAENAA

SEQ ID NO: 1221129 - protein, 14 aa, Mycobacterium
RAGASGGEIDDPSS

SEQ ID NO: 1221130 - protein, 14 aa, Mycobacterium
RAGATTAVKRPAEL

SEQ ID NO: 1221131 - protein, 5 aa, Mycobacterium
RAGAY

SEQ ID NO: 1221132 - protein, 8 aa, Mycobacterium
RAGDADTA

SEQ ID NO: 1221133 - protein, 10 aa, Mycobacterium
RAGDDADSAL

SEQ ID NO: 1221134 - protein, 9 aa, Mycobacterium
RAGDFTARS

SEQ ID NO: 1221135 - protein, 10 aa, Mycobacterium
RAGDIPPVSA

SEQ ID NO: 1221136 - protein, 12 aa, Mycobacterium
RAGDPIAQADAA

SEQ ID NO: 1221137 - protein, 7 aa, Mycobacterium
RAGDPQA

SEQ ID NO: 1221138 - protein, 9 aa, Mycobacterium
RAGDPQRAR

SEQ ID NO: 1221139 - protein, 10 aa, Mycobacterium
RAGDQHSPGT

SEQ ID NO: 1221140 - protein, 10 aa, Mycobacterium
RAGDQHTPGT

SEQ ID NO: 1221141 - protein, 10 aa, Mycobacterium
RAGDRGAVEA

SEQ ID NO: 1221142 - protein, 7 aa, Mycobacterium
RAGDRVR

SEQ ID NO: 1221143 - protein, 5 aa, Mycobacterium
RAGDT

SEQ ID NO: 1221144 - protein, 8 aa, Mycobacterium
RAGDTDRI

SEQ ID NO: 1221145 - protein, 8 aa, Mycobacterium
RAGDTERQ

SEQ ID NO: 1221146 - protein, 8 aa, Mycobacterium
RAGDTTST

SEQ ID NO: 1221147 - protein, 41 aa, Mycobacterium
RAGEAAARRAGEAAARRAGEAAARRAGEAAARRAGEAAAER

SEQ ID NO: 1221148 - protein, 11 aa, Mycobacterium
RAGEAGEGDSI

SEQ ID NO: 1221149 - protein, 11 aa, Mycobacterium
RAGEDVTAGTT

SEQ ID NO: 1221150 - protein, 7 aa, Mycobacterium
RAGEEVE

SEQ ID NO: 1221151 - protein, 6 aa, Mycobacterium
RAGEKI

SEQ ID NO: 1221152 - protein, 7 aa, Mycobacterium
RAGELNT

SEQ ID NO: 1221153 - protein, 11 aa, Mycobacterium
RAGEPDAARAA

SEQ ID NO: 1221154 - protein, 8 aa, Mycobacterium
RAGEPEEV

SEQ ID NO: 1221155 - protein, 9 aa, Mycobacterium
RAGFGTPDT

SEQ ID NO: 1221156 - protein, 20 aa, Mycobacterium
RAGGANVNQLTSSEPDDVES

SEQ ID NO: 1221157 - protein, 7 aa, Mycobacterium
RAGGATV

SEQ ID NO: 1221158 - protein, 8 aa, Mycobacterium
RAGGETAA

SEQ ID NO: 1221159 - protein, 7 aa, Mycobacterium
RAGGGPD

SEQ ID NO: 1221160 - protein, 17 aa, Mycobacterium
RAGGMNRPVEGAHTGGF

SEQ ID NO: 1221161 - protein, 5 aa, Mycobacterium
RAGGR

SEQ ID NO: 1221162 - protein, 12 aa, Mycobacterium
RAGGRDNRPTQR

SEQ ID NO: 1221163 - protein, 13 aa, Mycobacterium
RAGGRSSGAVGAS

SEQ ID NO: 1221164 - protein, 13 aa, Mycobacterium
RAGGSEKTRLGSA

SEQ ID NO: 1221165 - protein, 8 aa, Mycobacterium
RAGGSESR

SEQ ID NO: 1221166 - protein, 6 aa, Mycobacterium
RAGGTG

SEQ ID NO: 1221167 - protein, 11 aa, Mycobacterium
RAGGTRDGVTG

SEQ ID NO: 1221168 - protein, 12 aa, Mycobacterium
RAGIDDSPEDAR

SEQ ID NO: 1221169 - protein, 10 aa, Mycobacterium
RAGKLDPNRV

SEQ ID NO: 1221170 - protein, 5 aa, Mycobacterium
RAGLD

SEQ ID NO: 1221171 - protein, 7 aa, Mycobacterium
RAGLDPA

SEQ ID NO: 1221172 - protein, 20 aa, Mycobacterium
RAGLPGSAEDKGAQAAAAAL

SEQ ID NO: 1221173 - protein, 8 aa, Mycobacterium
RAGLPTEI

SEQ ID NO: 1221174 - protein, 9 aa, Mycobacterium
RAGNKPRSF

SEQ ID NO: 1221175 - protein, 13 aa, Mycobacterium
RAGNRGPTAAPQN

SEQ ID NO: 1221176 - protein, 6 aa, Mycobacterium
RAGPAY

SEQ ID NO: 1221177 - protein, 7 aa, Mycobacterium
RAGPDGC

SEQ ID NO: 1221178 - protein, 9 aa, Mycobacterium
RAGPPAVAD

SEQ ID NO: 1221179 - protein, 7 aa, Mycobacterium
RAGPTRT

SEQ ID NO: 1221180 - protein, 6 aa, Mycobacterium
RAGQAE

SEQ ID NO: 1221181 - protein, 9 aa, Mycobacterium
RAGQAESGL

SEQ ID NO: 1221182 - protein, 8 aa, Mycobacterium
RAGQAETS

SEQ ID NO: 1221183 - protein, 9 aa, Mycobacterium
RAGQAETSL

SEQ ID NO: 1221184 - protein, 10 aa, Mycobacterium
RAGQAGPDSL

SEQ ID NO: 1221185 - protein, 9 aa, Mycobacterium
RAGQDGGFT

SEQ ID NO: 1221186 - protein, 9 aa, Mycobacterium
RAGQEPTTR

SEQ ID NO: 1221187 - protein, 5 aa, Mycobacterium
RAGQI

SEQ ID NO: 1221188 - protein, 16 aa, Mycobacterium
RAGQQESISGLRAGAD

SEQ ID NO: 1221189 - protein, 10 aa, Mycobacterium
RAGRAGFDTA

SEQ ID NO: 1221190 - protein, 5 aa, Mycobacterium
RAGRD

SEQ ID NO: 1221191 - protein, 8 aa, Mycobacterium
RAGRDDEA

SEQ ID NO: 1221192 - protein, 21 aa, Mycobacterium
RAGRGAAEHAAAAGPSRAVAP

SEQ ID NO: 1221193 - protein, 11 aa, Mycobacterium
RAGRGEDGGLR

SEQ ID NO: 1221194 - protein, 5 aa, Mycobacterium
RAGRI

SEQ ID NO: 1221195 - protein, 25 aa, Mycobacterium
RAGRPDPAGPTLPNSRCNGGPTPVE

SEQ ID NO: 1221196 - protein, 11 aa, Mycobacterium
RAGRPQKPRRF

SEQ ID NO: 1221197 - protein, 12 aa, Mycobacterium
RAGRPQKPRRFP

SEQ ID NO: 1221198 - protein, 7 aa, Mycobacterium
RAGRSRE

SEQ ID NO: 1221199 - protein, 6 aa, Mycobacterium
RAGRTA

SEQ ID NO: 1221200 - protein, 9 aa, Mycobacterium
RAGSARDID

SEQ ID NO: 1221201 - protein, 6 aa, Mycobacterium
RAGSGD

SEQ ID NO: 1221202 - protein, 8 aa, Mycobacterium
RAGSGRTT

SEQ ID NO: 1221203 - protein, 14 aa, Mycobacterium
RAGSLDSAVQPDSV

SEQ ID NO: 1221204 - protein, 6 aa, Mycobacterium
RAGSTA

SEQ ID NO: 1221205 - protein, 14 aa, Mycobacterium
RAGTLKPGELQGST

SEQ ID NO: 1221206 - protein, 12 aa, Mycobacterium
RAGTPATPTRGA

SEQ ID NO: 1221207 - protein, 6 aa, Mycobacterium
RAGTTQ

SEQ ID NO: 1221208 - protein, 14 aa, Mycobacterium
RAGTVKPSADPRGR

SEQ ID NO: 1221209 - protein, 7 aa, Mycobacterium
RAGVAAA

SEQ ID NO: 1221210 - protein, 6 aa, Mycobacterium
RAGVAK

SEQ ID NO: 1221211 - protein, 7 aa, Mycobacterium
RAGVGER

SEQ ID NO: 1221212 - protein, 9 aa, Mycobacterium
RAGVPDGTT

SEQ ID NO: 1221213 - protein, 15 aa, Mycobacterium
RAGYSAAALRGSRSG

SEQ ID NO: 1221214 - protein, 9 aa, Mycobacterium
RAHADRQLA

SEQ ID NO: 1221215 - protein, 23 aa, Mycobacterium
RAHADRQLARKGAGLGPEELDEA

SEQ ID NO: 1221216 - protein, 24 aa, Mycobacterium
RAHADRQLARKGAGVGPEELDEAA

SEQ ID NO: 1221217 - protein, 9 aa, Mycobacterium
RAHAKNNPY

SEQ ID NO: 1221218 - protein, 12 aa, Mycobacterium
RAHDPEKAGTAG

SEQ ID NO: 1221219 - protein, 12 aa, Mycobacterium
RAHDTAAAASKA

SEQ ID NO: 1221220 - protein, 14 aa, Mycobacterium
RAHEGDKKAASTRV

SEQ ID NO: 1221221 - protein, 7 aa, Mycobacterium
RAHGEGT

SEQ ID NO: 1221222 - protein, 10 aa, Mycobacterium
RAHGRPGGAQ

SEQ ID NO: 1221223 - protein, 5 aa, Mycobacterium
RAHPG

SEQ ID NO: 1221224 - protein, 6 aa, Mycobacterium
RAHPGD

SEQ ID NO: 1221225 - protein, 6 aa, Mycobacterium
RAHPLD

SEQ ID NO: 1221226 - protein, 8 aa, Mycobacterium
RAHQSGRD

SEQ ID NO: 1221227 - protein, 4 aa, Mycobacterium
RAHS

SEQ ID NO: 1221228 - protein, 10 aa, Mycobacterium
RAHTDPRGLA

SEQ ID NO: 1221229 - protein, 5 aa, Mycobacterium
RAIGP

SEQ ID NO: 1221230 - protein, 4 aa, Mycobacterium
RAKA

SEQ ID NO: 1221231 - protein, 9 aa, Mycobacterium
RAKAETASS

SEQ ID NO: 1221232 - protein, 15 aa, Mycobacterium
RAKAGWEPRPLDEQT

SEQ ID NO: 1221233 - protein, 9 aa, Mycobacterium
RAKALGEAA

SEQ ID NO: 1221234 - protein, 7 aa, Mycobacterium
RAKDENH

SEQ ID NO: 1221235 - protein, 7 aa, Mycobacterium
RAKDLRS

SEQ ID NO: 1221236 - protein, 16 aa, Mycobacterium
RAKEGRDVGELTNTAQ

SEQ ID NO: 1221237 - protein, 8 aa, Mycobacterium
RAKEQATI

SEQ ID NO: 1221238 - protein, 33 aa, Mycobacterium
RAKGERPNWTRQDESVPIADGADENVPMAGDAE

SEQ ID NO: 1221239 - protein, 13 aa, Mycobacterium
RAKGSGQREGGDA

SEQ ID NO: 1221240 - protein, 6 aa, Mycobacterium
RAKKNA

SEQ ID NO: 1221241 - protein, 38 aa, Mycobacterium
RAKPAKKSTARKTPAKKAPAKKAAAKAPTKRAGGTKGR

SEQ ID NO: 1221242 - protein, 4 aa, Mycobacterium
RAKQ

SEQ ID NO: 1221243 - protein, 12 aa, Mycobacterium
RAKRDARTDLTG

SEQ ID NO: 1221244 - protein, 7 aa, Mycobacterium
RAKRTVS

SEQ ID NO: 1221245 - protein, 10 aa, Mycobacterium
RAKSDRRGQL

SEQ ID NO: 1221246 - protein, 10 aa, Mycobacterium
RAKSTAKGLD

SEQ ID NO: 1221247 - protein, 24 aa, Mycobacterium
RAKVDELEARGAVGATSPAHVGEK

SEQ ID NO: 1221248 - protein, 14 aa, Mycobacterium
RAKYSGLGRQSLAG

SEQ ID NO: 1221249 - protein, 7 aa, Mycobacterium
RALADAG

SEQ ID NO: 1221250 - protein, 7 aa, Mycobacterium
RALADGA

SEQ ID NO: 1221251 - protein, 9 aa, Mycobacterium
RALDAGVPA

SEQ ID NO: 1221252 - protein, 32 aa, Mycobacterium
RALDQQAAEHNRQAGLPPPAPPPPDYGDDPPP

SEQ ID NO: 1221253 - protein, 9 aa, Mycobacterium
RALEDGADD

SEQ ID NO: 1221254 - protein, 6 aa, Mycobacterium
RALERA

SEQ ID NO: 1221255 - protein, 21 aa, Mycobacterium
RALGADTTMAGVSASDAARAM

SEQ ID NO: 1221256 - protein, 7 aa, Mycobacterium
RALGADV

SEQ ID NO: 1221257 - protein, 13 aa, Mycobacterium
RALPGDPDFGDPL

SEQ ID NO: 1221258 - protein, 4 aa, Mycobacterium
RALQ

SEQ ID NO: 1221259 - protein, 7 aa, Mycobacterium
RALRDDG

SEQ ID NO: 1221260 - protein, 21 aa, Mycobacterium
RALRPAPVGAYPQSASAYGAE

SEQ ID NO: 1221261 - protein, 6 aa, Mycobacterium
RALRTT

SEQ ID NO: 1221262 - protein, 6 aa, Mycobacterium
RALTGK

SEQ ID NO: 1221263 - protein, 17 aa, Mycobacterium
RAMETGTRGPDPEDDPV

SEQ ID NO: 1221264 - protein, 4 aa, Mycobacterium
RAMP

SEQ ID NO: 1221265 - protein, 10 aa, Mycobacterium
RANDAPESTL

SEQ ID NO: 1221266 - protein, 7 aa, Mycobacterium
RANEHTD

SEQ ID NO: 1221267 - protein, 5 aa, Mycobacterium
RANEI

SEQ ID NO: 1221268 - protein, 11 aa, Mycobacterium
RANGGKVGGQF

SEQ ID NO: 1221269 - protein, 6 aa, Mycobacterium
RANGSA

SEQ ID NO: 1221270 - protein, 11 aa, Mycobacterium
RANGSTATGSV

SEQ ID NO: 1221271 - protein, 11 aa, Mycobacterium
RANKDNVDPKR

SEQ ID NO: 1221272 - protein, 9 aa, Mycobacterium
RANKSSREY

SEQ ID NO: 1221273 - protein, 7 aa, Mycobacterium
RANPVPR

SEQ ID NO: 1221274 - protein, 12 aa, Mycobacterium
RANQNPTAQRYG

SEQ ID NO: 1221275 - protein, 12 aa, Mycobacterium
RANTVSPGNTYF

SEQ ID NO: 1221276 - protein, 4 aa, Mycobacterium
RANW

SEQ ID NO: 1221277 - protein, 4 aa, Mycobacterium
RAPA

SEQ ID NO: 1221278 - protein, 24 aa, Mycobacterium
RAPAAQAGRAQGRREARKVAEFLS

SEQ ID NO: 1221279 - protein, 8 aa, Mycobacterium
RAPADAPI

SEQ ID NO: 1221280 - protein, 7 aa, Mycobacterium
RAPAGGV

SEQ ID NO: 1221281 - protein, 8 aa, Mycobacterium
RAPDADTA

SEQ ID NO: 1221282 - protein, 10 aa, Mycobacterium
RAPDAGEDFP

SEQ ID NO: 1221283 - protein, 5 aa, Mycobacterium
RAPDE

SEQ ID NO: 1221284 - protein, 7 aa, Mycobacterium
RAPDRSL

SEQ ID NO: 1221285 - protein, 16 aa, Mycobacterium
RAPDTDVRTAIWQWSR

SEQ ID NO: 1221286 - protein, 12 aa, Mycobacterium
RAPEPDPDHPAH

SEQ ID NO: 1221287 - protein, 9 aa, Mycobacterium
RAPEPHPGL

SEQ ID NO: 1221288 - protein, 7 aa, Mycobacterium
RAPEPTG

SEQ ID NO: 1221289 - protein, 6 aa, Mycobacterium
RAPGAT

SEQ ID NO: 1221290 - protein, 9 aa, Mycobacterium
RAPGEGGRI

SEQ ID NO: 1221291 - protein, 13 aa, Mycobacterium
RAPGFADYESRTD

SEQ ID NO: 1221292 - protein, 7 aa, Mycobacterium
RAPGGDV

SEQ ID NO: 1221293 - protein, 14 aa, Mycobacterium
RAPGPRRGGLGSGV

SEQ ID NO: 1221294 - protein, 7 aa, Mycobacterium
RAPHATL

SEQ ID NO: 1221295 - protein, 8 aa, Mycobacterium
RAPKTQAT

SEQ ID NO: 1221296 - protein, 9 aa, Mycobacterium
RAPQTPYDT

SEQ ID NO: 1221297 - protein, 13 aa, Mycobacterium
RAPRLSQDSPEVV

SEQ ID NO: 1221298 - protein, 10 aa, Mycobacterium
RAPRRDSSIS

SEQ ID NO: 1221299 - protein, 14 aa, Mycobacterium
RAPRRKQSGAEEAV

SEQ ID NO: 1221300 - protein, 11 aa, Mycobacterium
RAPRYTDTTGR

SEQ ID NO: 1221301 - protein, 17 aa, Mycobacterium
RAPSAPTVAAQAAPAGL

SEQ ID NO: 1221302 - protein, 10 aa, Mycobacterium
RAPSTWPGDG

SEQ ID NO: 1221303 - protein, 12 aa, Mycobacterium
RAPTAEPTPVGT

SEQ ID NO: 1221304 - protein, 9 aa, Mycobacterium
RAPTDQAAP

SEQ ID NO: 1221305 - protein, 7 aa, Mycobacterium
RAPTPSE

SEQ ID NO: 1221306 - protein, 14 aa, Mycobacterium
RAPVQAEAAAQTQR

SEQ ID NO: 1221307 - protein, 7 aa, Mycobacterium
RAPYTAD

SEQ ID NO: 1221308 - protein, 12 aa, Mycobacterium
RAQAGGSGPGRC

SEQ ID NO: 1221309 - protein, 7 aa, Mycobacterium
RAQASAA

SEQ ID NO: 1221310 - protein, 13 aa, Mycobacterium
RAQEGALSQIDED

SEQ ID NO: 1221311 - protein, 13 aa, Mycobacterium
RAQEGSLSEIDDD

SEQ ID NO: 1221312 - protein, 9 aa, Mycobacterium
RAQEKSQPW

SEQ ID NO: 1221313 - protein, 5 aa, Mycobacterium
RAQGD

SEQ ID NO: 1221314 - protein, 10 aa, Mycobacterium
RAQGEDEEAH

SEQ ID NO: 1221315 - protein, 6 aa, Mycobacterium
RAQGIP

SEQ ID NO: 1221316 - protein, 6 aa, Mycobacterium
RAQGSG

SEQ ID NO: 1221317 - protein, 12 aa, Mycobacterium
RAQHDEQQRNYA

SEQ ID NO: 1221318 - protein, 8 aa, Mycobacterium
RAQHGTKE

SEQ ID NO: 1221319 - protein, 10 aa, Mycobacterium
RAQKTRTQEI

SEQ ID NO: 1221320 - protein, 7 aa, Mycobacterium
RAQMSPG

SEQ ID NO: 1221321 - protein, 7 aa, Mycobacterium
RAQNPDA

SEQ ID NO: 1221322 - protein, 17 aa, Mycobacterium
RAQPAGRVRPGAGRAEL

SEQ ID NO: 1221323 - protein, 7 aa, Mycobacterium
RAQPDDV

SEQ ID NO: 1221324 - protein, 11 aa, Mycobacterium
RAQPGMGGATG

SEQ ID NO: 1221325 - protein, 8 aa, Mycobacterium
RAQPRPKS

SEQ ID NO: 1221326 - protein, 8 aa, Mycobacterium
RAQQQPDD

SEQ ID NO: 1221327 - protein, 5 aa, Mycobacterium
RAQQW

SEQ ID NO: 1221328 - protein, 8 aa, Mycobacterium
RAQRDGYL

SEQ ID NO: 1221329 - protein, 12 aa, Mycobacterium
RAQRTRHRAAVG

SEQ ID NO: 1221330 - protein, 11 aa, Mycobacterium
RAQRVGDPLPF

SEQ ID NO: 1221331 - protein, 4 aa, Mycobacterium
RAQS

SEQ ID NO: 1221332 - protein, 12 aa, Mycobacterium
RAQYRPITDTEA

SEQ ID NO: 1221333 - protein, 9 aa, Mycobacterium
RARAGRPDF

SEQ ID NO: 1221334 - protein, 5 aa, Mycobacterium
RARAM

SEQ ID NO: 1221335 - protein, 7 aa, Mycobacterium
RARARRA

SEQ ID NO: 1221336 - protein, 5 aa, Mycobacterium
RARDG

SEQ ID NO: 1221337 - protein, 9 aa, Mycobacterium
RARDPGLRS

SEQ ID NO: 1221338 - protein, 7 aa, Mycobacterium
RARDRAR

SEQ ID NO: 1221339 - protein, 7 aa, Mycobacterium
RARDTGL

SEQ ID NO: 1221340 - protein, 11 aa, Mycobacterium
RAREGGATPSR

SEQ ID NO: 1221341 - protein, 8 aa, Mycobacterium
RAREHGGT

SEQ ID NO: 1221342 - protein, 7 aa, Mycobacterium
RARENAR

SEQ ID NO: 1221343 - protein, 9 aa, Mycobacterium
RARESGDHV

SEQ ID NO: 1221344 - protein, 7 aa, Mycobacterium
RARGDAG

SEQ ID NO: 1221345 - protein, 8 aa, Mycobacterium
RARGEGEQ

SEQ ID NO: 1221346 - protein, 8 aa, Mycobacterium
RARGELRP

SEQ ID NO: 1221347 - protein, 9 aa, Mycobacterium
RARGERTLT

SEQ ID NO: 1221348 - protein, 9 aa, Mycobacterium
RARGGRRQS

SEQ ID NO: 1221349 - protein, 5 aa, Mycobacterium
RARGV

SEQ ID NO: 1221350 - protein, 23 aa, Mycobacterium
RARHQGQLARRSGRRFSMRRGVR

SEQ ID NO: 1221351 - protein, 7 aa, Mycobacterium
RARIGDP

SEQ ID NO: 1221352 - protein, 10 aa, Mycobacterium
RARLRPQDFQ

SEQ ID NO: 1221353 - protein, 4 aa, Mycobacterium
RARN

SEQ ID NO: 1221354 - protein, 6 aa, Mycobacterium
RARNGL

SEQ ID NO: 1221355 - protein, 6 aa, Mycobacterium
RARNRA

SEQ ID NO: 1221356 - protein, 8 aa, Mycobacterium
RARPEIGA

SEQ ID NO: 1221357 - protein, 10 aa, Mycobacterium
RARPGRRGDC

SEQ ID NO: 1221358 - protein, 12 aa, Mycobacterium
RARPGTGSGRAG

SEQ ID NO: 1221359 - protein, 5 aa, Mycobacterium
RARPK

SEQ ID NO: 1221360 - protein, 5 aa, Mycobacterium
RARPQ

SEQ ID NO: 1221361 - protein, 9 aa, Mycobacterium
RARPRDGQP

SEQ ID NO: 1221362 - protein, 12 aa, Mycobacterium
RARQAALASSGR

SEQ ID NO: 1221363 - protein, 7 aa, Mycobacterium
RARQESA

SEQ ID NO: 1221364 - protein, 6 aa, Mycobacterium
RARQQG

SEQ ID NO: 1221365 - protein, 7 aa, Mycobacterium
RARQRDS

SEQ ID NO: 1221366 - protein, 14 aa, Mycobacterium
RARRAAERQRTRSQ

SEQ ID NO: 1221367 - protein, 8 aa, Mycobacterium
RARRDGYL

SEQ ID NO: 1221368 - protein, 6 aa, Mycobacterium
RARREA

SEQ ID NO: 1221369 - protein, 8 aa, Mycobacterium
RARREADP

SEQ ID NO: 1221370 - protein, 9 aa, Mycobacterium
RARRHGSDV

SEQ ID NO: 1221371 - protein, 5 aa, Mycobacterium
RARRN

SEQ ID NO: 1221372 - protein, 9 aa, Mycobacterium
RARSEGRYD

SEQ ID NO: 1221373 - protein, 14 aa, Mycobacterium
RARSHGDLESGPFK

SEQ ID NO: 1221374 - protein, 7 aa, Mycobacterium
RARSRAE

SEQ ID NO: 1221375 - protein, 4 aa, Mycobacterium
RART

SEQ ID NO: 1221376 - protein, 5 aa, Mycobacterium
RARTG

SEQ ID NO: 1221377 - protein, 6 aa, Mycobacterium
RARTGR

SEQ ID NO: 1221378 - protein, 19 aa, Mycobacterium
RARTPAYREGTAPVEDGTP

SEQ ID NO: 1221379 - protein, 5 aa, Mycobacterium
RARTV

SEQ ID NO: 1221380 - protein, 7 aa, Mycobacterium
RASAAEH

SEQ ID NO: 1221381 - protein, 13 aa, Mycobacterium
RASAASQGLTPAD

SEQ ID NO: 1221382 - protein, 8 aa, Mycobacterium
RASAEGQV

SEQ ID NO: 1221383 - protein, 7 aa, Mycobacterium
RASANTV

SEQ ID NO: 1221384 - protein, 9 aa, Mycobacterium
RASASAYSR

SEQ ID NO: 1221385 - protein, 11 aa, Mycobacterium
RASDGASEDSV

SEQ ID NO: 1221386 - protein, 11 aa, Mycobacterium
RASEEGRWPAA

SEQ ID NO: 1221387 - protein, 8 aa, Mycobacterium
RASETAGR

SEQ ID NO: 1221388 - protein, 6 aa, Mycobacterium
RASGAA

SEQ ID NO: 1221389 - protein, 16 aa, Mycobacterium
RASGDADDVEKADARL

SEQ ID NO: 1221390 - protein, 10 aa, Mycobacterium
RASGDPATTV

SEQ ID NO: 1221391 - protein, 7 aa, Mycobacterium
RASGGDL

SEQ ID NO: 1221392 - protein, 10 aa, Mycobacterium
RASGHQERSI

SEQ ID NO: 1221393 - protein, 10 aa, Mycobacterium
RASGTSLPFA

SEQ ID NO: 1221394 - protein, 7 aa, Mycobacterium
RASHAER

SEQ ID NO: 1221395 - protein, 6 aa, Mycobacterium
RASIEG

SEQ ID NO: 1221396 - protein, 15 aa, Mycobacterium
RASKRRAQQWLAERG

SEQ ID NO: 1221397 - protein, 9 aa, Mycobacterium
RASPDENPD

SEQ ID NO: 1221398 - protein, 9 aa, Mycobacterium
RASPSRGAL

SEQ ID NO: 1221399 - protein, 7 aa, Mycobacterium
RASPYKA

SEQ ID NO: 1221400 - protein, 6 aa, Mycobacterium
RASQDA

SEQ ID NO: 1221401 - protein, 8 aa, Mycobacterium
RASQQRGT

SEQ ID NO: 1221402 - protein, 9 aa, Mycobacterium
RASQQRGTP

SEQ ID NO: 1221403 - protein, 4 aa, Mycobacterium
RASR

SEQ ID NO: 1221404 - protein, 6 aa, Mycobacterium
RASRAD

SEQ ID NO: 1221405 - protein, 15 aa, Mycobacterium
RASRRSGPPPEHDVD

SEQ ID NO: 1221406 - protein, 8 aa, Mycobacterium
RASRSMQR

SEQ ID NO: 1221407 - protein, 6 aa, Mycobacterium
RASSPI

SEQ ID NO: 1221408 - protein, 8 aa, Mycobacterium
RASSPKRR

SEQ ID NO: 1221409 - protein, 5 aa, Mycobacterium
RASST

SEQ ID NO: 1221410 - protein, 5 aa, Mycobacterium
RASTL

SEQ ID NO: 1221411 - protein, 10 aa, Mycobacterium
RASTPNAQPR

SEQ ID NO: 1221412 - protein, 5 aa, Mycobacterium
RASVR

SEQ ID NO: 1221413 - protein, 8 aa, Mycobacterium
RASVTATA

SEQ ID NO: 1221414 - protein, 5 aa, Mycobacterium
RASYE

SEQ ID NO: 1221415 - protein, 11 aa, Mycobacterium
RATADGSRERL

SEQ ID NO: 1221416 - protein, 10 aa, Mycobacterium
RATADQIGTQ

SEQ ID NO: 1221417 - protein, 6 aa, Mycobacterium
RATAEI

SEQ ID NO: 1221418 - protein, 6 aa, Mycobacterium
RATALR

SEQ ID NO: 1221419 - protein, 7 aa, Mycobacterium
RATAQGR

SEQ ID NO: 1221420 - protein, 8 aa, Mycobacterium
RATDEQKS

SEQ ID NO: 1221421 - protein, 12 aa, Mycobacterium
RATDPDAEPFTA

SEQ ID NO: 1221422 - protein, 8 aa, Mycobacterium
RATDPGAV

SEQ ID NO: 1221423 - protein, 7 aa, Mycobacterium
RATDPTP

SEQ ID NO: 1221424 - protein, 10 aa, Mycobacterium
RATERGRRAG

SEQ ID NO: 1221425 - protein, 5 aa, Mycobacterium
RATET

SEQ ID NO: 1221426 - protein, 5 aa, Mycobacterium
RATEV

SEQ ID NO: 1221427 - protein, 23 aa, Mycobacterium
RATFGAGTPEPGSSYDESATLTG

SEQ ID NO: 1221428 - protein, 4 aa, Mycobacterium
RATG

SEQ ID NO: 1221429 - protein, 8 aa, Mycobacterium
RATGERPT

SEQ ID NO: 1221430 - protein, 11 aa, Mycobacterium
RATGGKAGGIF

SEQ ID NO: 1221431 - protein, 9 aa, Mycobacterium
RATGGMPDL

SEQ ID NO: 1221432 - protein, 10 aa, Mycobacterium
RATGGPAEQT

SEQ ID NO: 1221433 - protein, 12 aa, Mycobacterium
RATGQDGDPRVQ

SEQ ID NO: 1221434 - protein, 7 aa, Mycobacterium
RATGRLS

SEQ ID NO: 1221435 - protein, 4 aa, Mycobacterium
RATI

SEQ ID NO: 1221436 - protein, 11 aa, Mycobacterium
RATKNPDSHPT

SEQ ID NO: 1221437 - protein, 15 aa, Mycobacterium
RATMARAEKDVAAGR

SEQ ID NO: 1221438 - protein, 5 aa, Mycobacterium
RATPA

SEQ ID NO: 1221439 - protein, 7 aa, Mycobacterium
RATPDAT

SEQ ID NO: 1221440 - protein, 6 aa, Mycobacterium
RATPLG

SEQ ID NO: 1221441 - protein, 6 aa, Mycobacterium
RATPRP

SEQ ID NO: 1221442 - protein, 6 aa, Mycobacterium
RATQPE

SEQ ID NO: 1221443 - protein, 6 aa, Mycobacterium
RATREA

SEQ ID NO: 1221444 - protein, 31 aa, Mycobacterium
RATRERAAAAAQASEKSAADARAAAEQAAKV

SEQ ID NO: 1221445 - protein, 5 aa, Mycobacterium
RATRG

SEQ ID NO: 1221446 - protein, 16 aa, Mycobacterium
RATRKDERPTGSEQAQ

SEQ ID NO: 1221447 - protein, 10 aa, Mycobacterium
RATRNAREAG

SEQ ID NO: 1221448 - protein, 8 aa, Mycobacterium
RATRPGGR

SEQ ID NO: 1221449 - protein, 7 aa, Mycobacterium
RATTADK

SEQ ID NO: 1221450 - protein, 7 aa, Mycobacterium
RATTAGA

SEQ ID NO: 1221451 - protein, 19 aa, Mycobacterium
RATTDPDGALNSAAGSDDV

SEQ ID NO: 1221452 - protein, 15 aa, Mycobacterium
RATTDVSNGEPADGS

SEQ ID NO: 1221453 - protein, 10 aa, Mycobacterium
RATTRPEGPA

SEQ ID NO: 1221454 - protein, 8 aa, Mycobacterium
RATTSEQR

SEQ ID NO: 1221455 - protein, 8 aa, Mycobacterium
RATTYGPV

SEQ ID NO: 1221456 - protein, 7 aa, Mycobacterium
RATVPPA

SEQ ID NO: 1221457 - protein, 5 aa, Mycobacterium
RATYQ

SEQ ID NO: 1221458 - protein, 5 aa, Mycobacterium
RAVAD

SEQ ID NO: 1221459 - protein, 9 aa, Mycobacterium
RAVATGRHA

SEQ ID NO: 1221460 - protein, 6 aa, Mycobacterium
RAVDDG

SEQ ID NO: 1221461 - protein, 18 aa, Mycobacterium
RAVEAARDVEQGDPDAWR

SEQ ID NO: 1221462 - protein, 5 aa, Mycobacterium
RAVGG

SEQ ID NO: 1221463 - protein, 24 aa, Mycobacterium
RAVGGGSEFASGTAAENASEMPPD

SEQ ID NO: 1221464 - protein, 9 aa, Mycobacterium
RAVGSPERG

SEQ ID NO: 1221465 - protein, 12 aa, Mycobacterium
RAVGTGADKADT

SEQ ID NO: 1221466 - protein, 12 aa, Mycobacterium
RAVHGDSARAAG

SEQ ID NO: 1221467 - protein, 15 aa, Mycobacterium
RAVPAGGPAAASSPL

SEQ ID NO: 1221468 - protein, 28 aa, Mycobacterium
RAVSRAAREADRARDAYERDDGLQRRTS

SEQ ID NO: 1221469 - protein, 7 aa, Mycobacterium
RAVTAAE

SEQ ID NO: 1221470 - protein, 6 aa, Mycobacterium
RAVTPG

SEQ ID NO: 1221471 - protein, 4 aa, Mycobacterium
RAYG

SEQ ID NO: 1221472 - protein, 5 aa, Mycobacterium
RAYNT

SEQ ID NO: 1221473 - protein, 8 aa, Mycobacterium
RAYPGGLT

SEQ ID NO: 1221474 - protein, 6 aa, Mycobacterium
RAYPTD

SEQ ID NO: 1221475 - protein, 9 aa, Mycobacterium
RAYQPGPSL

SEQ ID NO: 1221476 - protein, 8 aa, Mycobacterium
RAYRPDGQ

SEQ ID NO: 1221477 - protein, 6 aa, Mycobacterium
RCAPRD

SEQ ID NO: 1221478 - protein, 15 aa, Mycobacterium
RCDDSRTIVAAHLLV

SEQ ID NO: 1221479 - protein, 12 aa, Mycobacterium
RCDPPRIDDPDA

SEQ ID NO: 1221480 - protein, 5 aa, Mycobacterium
RCGDP

SEQ ID NO: 1221481 - protein, 12 aa, Mycobacterium
RCGEDGPTVTSS

SEQ ID NO: 1221482 - protein, 9 aa, Mycobacterium
RCGEPRYDT

SEQ ID NO: 1221483 - protein, 7 aa, Mycobacterium
RCGGGTG

SEQ ID NO: 1221484 - protein, 13 aa, Mycobacterium
RCPDPAPDDPRPR

SEQ ID NO: 1221485 - protein, 6 aa, Mycobacterium
RCPDRP

SEQ ID NO: 1221486 - protein, 4 aa, Mycobacterium
RCPG

SEQ ID NO: 1221487 - protein, 14 aa, Mycobacterium
RCPSARARRDAELG

SEQ ID NO: 1221488 - protein, 14 aa, Mycobacterium
RCRGESRKTARATA

SEQ ID NO: 1221489 - protein, 11 aa, Mycobacterium
RCSGDGRVRAR

SEQ ID NO: 1221490 - protein, 9 aa, Mycobacterium
RDAAAGLPR

SEQ ID NO: 1221491 - protein, 12 aa, Mycobacterium
RDAAAPTLDQAR

SEQ ID NO: 1221492 - protein, 5 aa, Mycobacterium
RDAAE

SEQ ID NO: 1221493 - protein, 6 aa, Mycobacterium
RDAAEQ

SEQ ID NO: 1221494 - protein, 5 aa, Mycobacterium
RDAAG

SEQ ID NO: 1221495 - protein, 7 aa, Mycobacterium
RDAAIDR

SEQ ID NO: 1221496 - protein, 95 aa, Mycobacterium
RDADDEAAQEADAAEEVDADTEADTDVDTAADTAAEAEPAAESGSGSGSGSASTVVDETPAQPAAADAEPVRATAPEAANVAPAPVTGVKTGRAK

SEQ ID NO: 1221497 - protein, 5 aa, Mycobacterium
RDADG

SEQ ID NO: 1221498 - protein, 19 aa, Mycobacterium
RDADLGNPAVSPDGQSVAY

SEQ ID NO: 1221499 - protein, 6 aa, Mycobacterium
RDADPE

SEQ ID NO: 1221500 - protein, 6 aa, Mycobacterium
RDAEQM

SEQ ID NO: 1221501 - protein, 9 aa, Mycobacterium
RDAERHGAT

SEQ ID NO: 1221502 - protein, 6 aa, Mycobacterium
RDAGAD

SEQ ID NO: 1221503 - protein, 17 aa, Mycobacterium
RDAGGELAGLGARDTLR

SEQ ID NO: 1221504 - protein, 10 aa, Mycobacterium
RDAGGHASTI

SEQ ID NO: 1221505 - protein, 8 aa, Mycobacterium
RDAGGPVT

SEQ ID NO: 1221506 - protein, 10 aa, Mycobacterium
RDAGNRPKGI

SEQ ID NO: 1221507 - protein, 16 aa, Mycobacterium
RDAGSSREEVEARAER

SEQ ID NO: 1221508 - protein, 6 aa, Mycobacterium
RDAGTV

SEQ ID NO: 1221509 - protein, 9 aa, Mycobacterium
RDAHDEDPA

SEQ ID NO: 1221510 - protein, 13 aa, Mycobacterium
RDAHGYGHTPEDV

SEQ ID NO: 1221511 - protein, 12 aa, Mycobacterium
RDALAGSPATPM

SEQ ID NO: 1221512 - protein, 8 aa, Mycobacterium
RDAPKRPI

SEQ ID NO: 1221513 - protein, 21 aa, Mycobacterium
RDAPLGDPGGAAKVGRVGADT

SEQ ID NO: 1221514 - protein, 7 aa, Mycobacterium
RDAPQAL

SEQ ID NO: 1221515 - protein, 17 aa, Mycobacterium
RDAPTGRLASLIWLEPA

SEQ ID NO: 1221516 - protein, 9 aa, Mycobacterium
RDAPVKGNQ

SEQ ID NO: 1221517 - protein, 4 aa, Mycobacterium
RDAQ

SEQ ID NO: 1221518 - protein, 9 aa, Mycobacterium
RDAQGRSNY

SEQ ID NO: 1221519 - protein, 6 aa, Mycobacterium
RDARAK

SEQ ID NO: 1221520 - protein, 11 aa, Mycobacterium
RDARKAGVGEQ

SEQ ID NO: 1221521 - protein, 5 aa, Mycobacterium
RDASA

SEQ ID NO: 1221522 - protein, 17 aa, Mycobacterium
RDASTGRTADNINPATE

SEQ ID NO: 1221523 - protein, 9 aa, Mycobacterium
RDATAGREA

SEQ ID NO: 1221524 - protein, 15 aa, Mycobacterium
RDATDRADKLENADA

SEQ ID NO: 1221525 - protein, 9 aa, Mycobacterium
RDATESATD

SEQ ID NO: 1221526 - protein, 9 aa, Mycobacterium
RDATGHGQQ

SEQ ID NO: 1221527 - protein, 8 aa, Mycobacterium
RDATGTTI

SEQ ID NO: 1221528 - protein, 13 aa, Mycobacterium
RDATNGRLGGPVE

SEQ ID NO: 1221529 - protein, 6 aa, Mycobacterium
RDDAAA

SEQ ID NO: 1221530 - protein, 5 aa, Mycobacterium
RDDAE

SEQ ID NO: 1221531 - protein, 11 aa, Mycobacterium
RDDARDPDAHE

SEQ ID NO: 1221532 - protein, 9 aa, Mycobacterium
RDDATTDNW

SEQ ID NO: 1221533 - protein, 7 aa, Mycobacterium
RDDAVAS

SEQ ID NO: 1221534 - protein, 9 aa, Mycobacterium
RDDDPEDTL

SEQ ID NO: 1221535 - protein, 9 aa, Mycobacterium
RDDDSGWAG

SEQ ID NO: 1221536 - protein, 6 aa, Mycobacterium
RDDDSH

SEQ ID NO: 1221537 - protein, 8 aa, Mycobacterium
RDDDTRVR

SEQ ID NO: 1221538 - protein, 4 aa, Mycobacterium
RDDG

SEQ ID NO: 1221539 - protein, 7 aa, Mycobacterium
RDDGAEL

SEQ ID NO: 1221540 - protein, 9 aa, Mycobacterium
RDDGGWPGL

SEQ ID NO: 1221541 - protein, 22 aa, Mycobacterium
RDDGQGWTGIPDDGGHEGDTGS

SEQ ID NO: 1221542 - protein, 9 aa, Mycobacterium
RDDGSSARN

SEQ ID NO: 1221543 - protein, 7 aa, Mycobacterium
RDDGTWI

SEQ ID NO: 1221544 - protein, 5 aa, Mycobacterium
RDDIV

SEQ ID NO: 1221545 - protein, 6 aa, Mycobacterium
RDDPAG

SEQ ID NO: 1221546 - protein, 8 aa, Mycobacterium
RDDPGPWK

SEQ ID NO: 1221547 - protein, 9 aa, Mycobacterium
RDDPQKAVE

SEQ ID NO: 1221548 - protein, 9 aa, Mycobacterium
RDDPTRDAP

SEQ ID NO: 1221549 - protein, 9 aa, Mycobacterium
RDDQASLGG

SEQ ID NO: 1221550 - protein, 6 aa, Mycobacterium
RDDQWT

SEQ ID NO: 1221551 - protein, 8 aa, Mycobacterium
RDDRFPNY

SEQ ID NO: 1221552 - protein, 16 aa, Mycobacterium
RDDRPLKREGTAEDVA

SEQ ID NO: 1221553 - protein, 6 aa, Mycobacterium
RDDSGI

SEQ ID NO: 1221554 - protein, 9 aa, Mycobacterium
RDDSPGPHD

SEQ ID NO: 1221555 - protein, 8 aa, Mycobacterium
RDDTARQV

SEQ ID NO: 1221556 - protein, 9 aa, Mycobacterium
RDDTGRVTT

SEQ ID NO: 1221557 - protein, 7 aa, Mycobacterium
RDDTSIP

SEQ ID NO: 1221558 - protein, 10 aa, Mycobacterium
RDEAAPTPAV

SEQ ID NO: 1221559 - protein, 5 aa, Mycobacterium
RDEAD

SEQ ID NO: 1221560 - protein, 6 aa, Mycobacterium
RDEAGP

SEQ ID NO: 1221561 - protein, 10 aa, Mycobacterium
RDEARRARIT

SEQ ID NO: 1221562 - protein, 7 aa, Mycobacterium
RDEARVS

SEQ ID NO: 1221563 - protein, 8 aa, Mycobacterium
RDEDADVR

SEQ ID NO: 1221564 - protein, 17 aa, Mycobacterium
RDEDKDPTGSVGVDPDG

SEQ ID NO: 1221565 - protein, 7 aa, Mycobacterium
RDEETGR

SEQ ID NO: 1221566 - protein, 6 aa, Mycobacterium
RDEHHS

SEQ ID NO: 1221567 - protein, 9 aa, Mycobacterium
RDEKAPRPA

SEQ ID NO: 1221568 - protein, 7 aa, Mycobacterium
RDELPDK

SEQ ID NO: 1221569 - protein, 7 aa, Mycobacterium
RDENPYP

SEQ ID NO: 1221570 - protein, 6 aa, Mycobacterium
RDEPED

SEQ ID NO: 1221571 - protein, 8 aa, Mycobacterium
RDEPLEGG

SEQ ID NO: 1221572 - protein, 8 aa, Mycobacterium
RDEQKCSA

SEQ ID NO: 1221573 - protein, 8 aa, Mycobacterium
RDERGRPL

SEQ ID NO: 1221574 - protein, 25 aa, Mycobacterium
RDERKTGKNRVGSPSDHAPVVVDLC

SEQ ID NO: 1221575 - protein, 10 aa, Mycobacterium
RDERTDNAGF

SEQ ID NO: 1221576 - protein, 8 aa, Mycobacterium
RDESSPAA

SEQ ID NO: 1221577 - protein, 9 aa, Mycobacterium
RDETRRERI

SEQ ID NO: 1221578 - protein, 13 aa, Mycobacterium
RDEVAAGQAAERI

SEQ ID NO: 1221579 - protein, 6 aa, Mycobacterium
RDFADA

SEQ ID NO: 1221580 - protein, 10 aa, Mycobacterium
RDFADGDGGA

SEQ ID NO: 1221581 - protein, 8 aa, Mycobacterium
RDFDDPEE

SEQ ID NO: 1221582 - protein, 6 aa, Mycobacterium
RDFGDR

SEQ ID NO: 1221583 - protein, 5 aa, Mycobacterium
RDFNQ

SEQ ID NO: 1221584 - protein, 4 aa, Mycobacterium
RDFP

SEQ ID NO: 1221585 - protein, 5 aa, Mycobacterium
RDGAA

SEQ ID NO: 1221586 - protein, 16 aa, Mycobacterium
RDGAGDENAAARDQLT

SEQ ID NO: 1221587 - protein, 9 aa, Mycobacterium
RDGAPQLYP

SEQ ID NO: 1221588 - protein, 12 aa, Mycobacterium
RDGARARRRRRA

SEQ ID NO: 1221589 - protein, 5 aa, Mycobacterium
RDGAY

SEQ ID NO: 1221590 - protein, 8 aa, Mycobacterium
RDGDAARD

SEQ ID NO: 1221591 - protein, 6 aa, Mycobacterium
RDGDCD

SEQ ID NO: 1221592 - protein, 10 aa, Mycobacterium
RDGDGAPYRT

SEQ ID NO: 1221593 - protein, 14 aa, Mycobacterium
RDGDGRDTDGEPGL

SEQ ID NO: 1221594 - protein, 7 aa, Mycobacterium
RDGDKIE

SEQ ID NO: 1221595 - protein, 5 aa, Mycobacterium
RDGDV

SEQ ID NO: 1221596 - protein, 12 aa, Mycobacterium
RDGEATVDPSSR

SEQ ID NO: 1221597 - protein, 9 aa, Mycobacterium
RDGEAYREA

SEQ ID NO: 1221598 - protein, 8 aa, Mycobacterium
RDGEEHAP

SEQ ID NO: 1221599 - protein, 5 aa, Mycobacterium
RDGEQ

SEQ ID NO: 1221600 - protein, 8 aa, Mycobacterium
RDGERQRS

SEQ ID NO: 1221601 - protein, 10 aa, Mycobacterium
RDGERSRAQE

SEQ ID NO: 1221602 - protein, 8 aa, Mycobacterium
RDGERTAL

SEQ ID NO: 1221603 - protein, 6 aa, Mycobacterium
RDGETY

SEQ ID NO: 1221604 - protein, 6 aa, Mycobacterium
RDGEVT

SEQ ID NO: 1221605 - protein, 13 aa, Mycobacterium
RDGEVTTATASIT

SEQ ID NO: 1221606 - protein, 4 aa, Mycobacterium
RDGF

SEQ ID NO: 1221607 - protein, 13 aa, Mycobacterium
RDGFTQPAPPYRM

SEQ ID NO: 1221608 - protein, 8 aa, Mycobacterium
RDGGAIKD

SEQ ID NO: 1221609 - protein, 6 aa, Mycobacterium
RDGGAT

SEQ ID NO: 1221610 - protein, 6 aa, Mycobacterium
RDGGDV

SEQ ID NO: 1221611 - protein, 5 aa, Mycobacterium
RDGGH

SEQ ID NO: 1221612 - protein, 6 aa, Mycobacterium
RDGGQT

SEQ ID NO: 1221613 - protein, 12 aa, Mycobacterium
RDGGTYRTVSAQ

SEQ ID NO: 1221614 - protein, 4 aa, Mycobacterium
RDGH

SEQ ID NO: 1221615 - protein, 9 aa, Mycobacterium
RDGHPAYEA

SEQ ID NO: 1221616 - protein, 9 aa, Mycobacterium
RDGHRSPRL

SEQ ID NO: 1221617 - protein, 6 aa, Mycobacterium
RDGIPE

SEQ ID NO: 1221618 - protein, 13 aa, Mycobacterium
RDGIRGLKNCLGM

SEQ ID NO: 1221619 - protein, 4 aa, Mycobacterium
RDGK

SEQ ID NO: 1221620 - protein, 9 aa, Mycobacterium
RDGLSNPEI

SEQ ID NO: 1221621 - protein, 10 aa, Mycobacterium
RDGNARPLRQ

SEQ ID NO: 1221622 - protein, 5 aa, Mycobacterium
RDGNE

SEQ ID NO: 1221623 - protein, 8 aa, Mycobacterium
RDGPDAGL

SEQ ID NO: 1221624 - protein, 7 aa, Mycobacterium
RDGPDSA

SEQ ID NO: 1221625 - protein, 6 aa, Mycobacterium
RDGPEG

SEQ ID NO: 1221626 - protein, 8 aa, Mycobacterium
RDGQPDTD

SEQ ID NO: 1221627 - protein, 18 aa, Mycobacterium
RDGQRRHPSDNTDEPARA

SEQ ID NO: 1221628 - protein, 19 aa, Mycobacterium
RDGRATATVTGSIPGAPVT

SEQ ID NO: 1221629 - protein, 11 aa, Mycobacterium
RDGRGDPRSDT

SEQ ID NO: 1221630 - protein, 5 aa, Mycobacterium
RDGRP

SEQ ID NO: 1221631 - protein, 7 aa, Mycobacterium
RDGRPHG

SEQ ID NO: 1221632 - protein, 6 aa, Mycobacterium
RDGRPI

SEQ ID NO: 1221633 - protein, 11 aa, Mycobacterium
RDGRYRSAAER

SEQ ID NO: 1221634 - protein, 6 aa, Mycobacterium
RDGSER

SEQ ID NO: 1221635 - protein, 16 aa, Mycobacterium
RDGSPTGLVGKQRTGR

SEQ ID NO: 1221636 - protein, 8 aa, Mycobacterium
RDGSTPAE

SEQ ID NO: 1221637 - protein, 5 aa, Mycobacterium
RDGSV

SEQ ID NO: 1221638 - protein, 24 aa, Mycobacterium
RDGTESPGKSAGGGMFGGGGSPGM

SEQ ID NO: 1221639 - protein, 14 aa, Mycobacterium
RDGTGITLNEALHA

SEQ ID NO: 1221640 - protein, 10 aa, Mycobacterium
RDGTPADMGG

SEQ ID NO: 1221641 - protein, 7 aa, Mycobacterium
RDGVDPA

SEQ ID NO: 1221642 - protein, 12 aa, Mycobacterium
RDGVKDTADAAR

SEQ ID NO: 1221643 - protein, 5 aa, Mycobacterium
RDGVR

SEQ ID NO: 1221644 - protein, 6 aa, Mycobacterium
RDGVRS

SEQ ID NO: 1221645 - protein, 4 aa, Mycobacterium
RDGW

SEQ ID NO: 1221646 - protein, 14 aa, Mycobacterium
RDGYAESDKNWTRR

SEQ ID NO: 1221647 - protein, 6 aa, Mycobacterium
RDHEEN

SEQ ID NO: 1221648 - protein, 21 aa, Mycobacterium
RDHGDTDDTDDSSGVGRPPMP

SEQ ID NO: 1221649 - protein, 8 aa, Mycobacterium
RDHGRPGG

SEQ ID NO: 1221650 - protein, 4 aa, Mycobacterium
RDHH

SEQ ID NO: 1221651 - protein, 9 aa, Mycobacterium
RDHHGDDPN

SEQ ID NO: 1221652 - protein, 4 aa, Mycobacterium
RDHP

SEQ ID NO: 1221653 - protein, 6 aa, Mycobacterium
RDHPEK

SEQ ID NO: 1221654 - protein, 10 aa, Mycobacterium
RDIETKSGTI

SEQ ID NO: 1221655 - protein, 23 aa, Mycobacterium
RDIGRAQRRGRRACGQSHQPGEQ

SEQ ID NO: 1221656 - protein, 7 aa, Mycobacterium
RDINPSR

SEQ ID NO: 1221657 - protein, 4 aa, Mycobacterium
RDKD

SEQ ID NO: 1221658 - protein, 8 aa, Mycobacterium
RDKLTPDY

SEQ ID NO: 1221659 - protein, 22 aa, Mycobacterium
RDKPRSSVDHSRSGGRTPKGPI

SEQ ID NO: 1221660 - protein, 9 aa, Mycobacterium
RDKQSPTRA

SEQ ID NO: 1221661 - protein, 19 aa, Mycobacterium
RDKSAEEAAERERREEAAY

SEQ ID NO: 1221662 - protein, 8 aa, Mycobacterium
RDKTASAN

SEQ ID NO: 1221663 - protein, 8 aa, Mycobacterium
RDLAGDDV

SEQ ID NO: 1221664 - protein, 16 aa, Mycobacterium
RDLDDRRRRAREMAQE

SEQ ID NO: 1221665 - protein, 8 aa, Mycobacterium
RDLEAGTV

SEQ ID NO: 1221666 - protein, 6 aa, Mycobacterium
RDLGGQ

SEQ ID NO: 1221667 - protein, 5 aa, Mycobacterium
RDLPD

SEQ ID NO: 1221668 - protein, 5 aa, Mycobacterium
RDLPG

SEQ ID NO: 1221669 - protein, 5 aa, Mycobacterium
RDLPH

SEQ ID NO: 1221670 - protein, 6 aa, Mycobacterium
RDLPPE

SEQ ID NO: 1221671 - protein, 12 aa, Mycobacterium
RDLRDPDGPCGC

SEQ ID NO: 1221672 - protein, 9 aa, Mycobacterium
RDLRPQSSR

SEQ ID NO: 1221673 - protein, 5 aa, Mycobacterium
RDLSG

SEQ ID NO: 1221674 - protein, 8 aa, Mycobacterium
RDLTEEQR

SEQ ID NO: 1221675 - protein, 12 aa, Mycobacterium
RDLTPEQRESEM

SEQ ID NO: 1221676 - protein, 6 aa, Mycobacterium
RDLTRS

SEQ ID NO: 1221677 - protein, 6 aa, Mycobacterium
RDNAGR

SEQ ID NO: 1221678 - protein, 32 aa, Mycobacterium
RDNATGADTPAPADDSRDERPLDEAATATLAP

SEQ ID NO: 1221679 - protein, 5 aa, Mycobacterium
RDNDG

SEQ ID NO: 1221680 - protein, 8 aa, Mycobacterium
RDNGTAVE

SEQ ID NO: 1221681 - protein, 6 aa, Mycobacterium
RDNPPD

SEQ ID NO: 1221682 - protein, 14 aa, Mycobacterium
RDNPRRSVRLSFVS

SEQ ID NO: 1221683 - protein, 4 aa, Mycobacterium
RDPA

SEQ ID NO: 1221684 - protein, 6 aa, Mycobacterium
RDPAEV

SEQ ID NO: 1221685 - protein, 6 aa, Mycobacterium
RDPAGF

SEQ ID NO: 1221686 - protein, 13 aa, Mycobacterium
RDPAGSTVRIQEL

SEQ ID NO: 1221687 - protein, 8 aa, Mycobacterium
RDPAGVPE

SEQ ID NO: 1221688 - protein, 5 aa, Mycobacterium
RDPAK

SEQ ID NO: 1221689 - protein, 5 aa, Mycobacterium
RDPAR

SEQ ID NO: 1221690 - protein, 9 aa, Mycobacterium
RDPASDSDW

SEQ ID NO: 1221691 - protein, 9 aa, Mycobacterium
RDPDADSTV

SEQ ID NO: 1221692 - protein, 9 aa, Mycobacterium
RDPDADTTV

SEQ ID NO: 1221693 - protein, 10 aa, Mycobacterium
RDPDAEAERM

SEQ ID NO: 1221694 - protein, 16 aa, Mycobacterium
RDPDALQAATDAAVTD

SEQ ID NO: 1221695 - protein, 6 aa, Mycobacterium
RDPDDA

SEQ ID NO: 1221696 - protein, 6 aa, Mycobacterium
RDPDGA

SEQ ID NO: 1221697 - protein, 5 aa, Mycobacterium
RDPDL

SEQ ID NO: 1221698 - protein, 7 aa, Mycobacterium
RDPDRRV

SEQ ID NO: 1221699 - protein, 8 aa, Mycobacterium
RDPDSRRN

SEQ ID NO: 1221700 - protein, 7 aa, Mycobacterium
RDPEAVA

SEQ ID NO: 1221701 - protein, 6 aa, Mycobacterium
RDPEGF

SEQ ID NO: 1221702 - protein, 14 aa, Mycobacterium
RDPEHAARISRWRS

SEQ ID NO: 1221703 - protein, 5 aa, Mycobacterium
RDPEL

SEQ ID NO: 1221704 - protein, 5 aa, Mycobacterium
RDPFD

SEQ ID NO: 1221705 - protein, 6 aa, Mycobacterium
RDPGGV

SEQ ID NO: 1221706 - protein, 8 aa, Mycobacterium
RDPGSRST

SEQ ID NO: 1221707 - protein, 9 aa, Mycobacterium
RDPGVPDDR

SEQ ID NO: 1221708 - protein, 4 aa, Mycobacterium
RDPK

SEQ ID NO: 1221709 - protein, 6 aa, Mycobacterium
RDPLRT

SEQ ID NO: 1221710 - protein, 13 aa, Mycobacterium
RDPLTMNETADKV

SEQ ID NO: 1221711 - protein, 14 aa, Mycobacterium
RDPMTGERDIRSED

SEQ ID NO: 1221712 - protein, 21 aa, Mycobacterium
RDPPPQSTPPLPIPSDLSPND

SEQ ID NO: 1221713 - protein, 5 aa, Mycobacterium
RDPPV

SEQ ID NO: 1221714 - protein, 6 aa, Mycobacterium
RDPQAA

SEQ ID NO: 1221715 - protein, 7 aa, Mycobacterium
RDPQGPV

SEQ ID NO: 1221716 - protein, 6 aa, Mycobacterium
RDPQSI

SEQ ID NO: 1221717 - protein, 4 aa, Mycobacterium
RDPR

SEQ ID NO: 1221718 - protein, 5 aa, Mycobacterium
RDPRA

SEQ ID NO: 1221719 - protein, 8 aa, Mycobacterium
RDPREPGG

SEQ ID NO: 1221720 - protein, 5 aa, Mycobacterium
RDPRQ

SEQ ID NO: 1221721 - protein, 9 aa, Mycobacterium
RDPSAATPV

SEQ ID NO: 1221722 - protein, 9 aa, Mycobacterium
RDPSEEQLG

SEQ ID NO: 1221723 - protein, 14 aa, Mycobacterium
RDPSGKLVDPSQLG

SEQ ID NO: 1221724 - protein, 8 aa, Mycobacterium
RDPSGNSV

SEQ ID NO: 1221725 - protein, 7 aa, Mycobacterium
RDPSHPG

SEQ ID NO: 1221726 - protein, 9 aa, Mycobacterium
RDPSPDHYR

SEQ ID NO: 1221727 - protein, 21 aa, Mycobacterium
RDPSPRASNWRATGTLDDELQ

SEQ ID NO: 1221728 - protein, 5 aa, Mycobacterium
RDPSQ

SEQ ID NO: 1221729 - protein, 7 aa, Mycobacterium
RDPSRAR

SEQ ID NO: 1221730 - protein, 5 aa, Mycobacterium
RDPSV

SEQ ID NO: 1221731 - protein, 7 aa, Mycobacterium
RDPTPTN

SEQ ID NO: 1221732 - protein, 7 aa, Mycobacterium
RDPTRGG

SEQ ID NO: 1221733 - protein, 5 aa, Mycobacterium
RDPVV

SEQ ID NO: 1221734 - protein, 4 aa, Mycobacterium
RDQA

SEQ ID NO: 1221735 - protein, 7 aa, Mycobacterium
RDQAAER

SEQ ID NO: 1221736 - protein, 9 aa, Mycobacterium
RDQAPKADD

SEQ ID NO: 1221737 - protein, 5 aa, Mycobacterium
RDQGG

SEQ ID NO: 1221738 - protein, 6 aa, Mycobacterium
RDQHPD

SEQ ID NO: 1221739 - protein, 18 aa, Mycobacterium
RDQMPAHAEEAEDAEREG

SEQ ID NO: 1221740 - protein, 5 aa, Mycobacterium
RDQMS

SEQ ID NO: 1221741 - protein, 8 aa, Mycobacterium
RDQNERGR

SEQ ID NO: 1221742 - protein, 13 aa, Mycobacterium
RDQPRRALPDDVA

SEQ ID NO: 1221743 - protein, 6 aa, Mycobacterium
RDQTEA

SEQ ID NO: 1221744 - protein, 15 aa, Mycobacterium
RDQVSGAAGSRFNRS

SEQ ID NO: 1221745 - protein, 15 aa, Mycobacterium
RDRAAPSLEQARTSG

SEQ ID NO: 1221746 - protein, 5 aa, Mycobacterium
RDRDA

SEQ ID NO: 1221747 - protein, 5 aa, Mycobacterium
RDRDG

SEQ ID NO: 1221748 - protein, 8 aa, Mycobacterium
RDRDPSDL

SEQ ID NO: 1221749 - protein, 11 aa, Mycobacterium
RDRDTQNTPRV

SEQ ID NO: 1221750 - protein, 10 aa, Mycobacterium
RDRDVDPHGR

SEQ ID NO: 1221751 - protein, 4 aa, Mycobacterium
RDRE

SEQ ID NO: 1221752 - protein, 15 aa, Mycobacterium
RDREAEPVIVTAEKA

SEQ ID NO: 1221753 - protein, 10 aa, Mycobacterium
RDRETGDNFD

SEQ ID NO: 1221754 - protein, 53 aa, Mycobacterium
RDRGDGSRRAGRTTGRKRGRGRAGRGDGGADGGSRGRGGGRARRGRAGGRRRR

SEQ ID NO: 1221755 - protein, 19 aa, Mycobacterium
RDRGPVRAGPRAGTDLPST

SEQ ID NO: 1221756 - protein, 8 aa, Mycobacterium
RDRGRDGL

SEQ ID NO: 1221757 - protein, 7 aa, Mycobacterium
RDRHGHP

SEQ ID NO: 1221758 - protein, 4 aa, Mycobacterium
RDRI

SEQ ID NO: 1221759 - protein, 14 aa, Mycobacterium
RDRINKAGEVRSRP

SEQ ID NO: 1221760 - protein, 5 aa, Mycobacterium
RDRIT

SEQ ID NO: 1221761 - protein, 6 aa, Mycobacterium
RDRKAL

SEQ ID NO: 1221762 - protein, 4 aa, Mycobacterium
RDRL

SEQ ID NO: 1221763 - protein, 5 aa, Mycobacterium
RDRLN

SEQ ID NO: 1221764 - protein, 8 aa, Mycobacterium
RDRPDQLA

SEQ ID NO: 1221765 - protein, 6 aa, Mycobacterium
RDRPGQ

SEQ ID NO: 1221766 - protein, 13 aa, Mycobacterium
RDRPHGGSTPVLA

SEQ ID NO: 1221767 - protein, 10 aa, Mycobacterium
RDRRTGDNFD

SEQ ID NO: 1221768 - protein, 9 aa, Mycobacterium
RDRSPGYGD

SEQ ID NO: 1221769 - protein, 7 aa, Mycobacterium
RDRSRRD

SEQ ID NO: 1221770 - protein, 4 aa, Mycobacterium
RDRT

SEQ ID NO: 1221771 - protein, 8 aa, Mycobacterium
RDRTQAQN

SEQ ID NO: 1221772 - protein, 5 aa, Mycobacterium
RDRTR

SEQ ID NO: 1221773 - protein, 11 aa, Mycobacterium
RDSAARAGRQM

SEQ ID NO: 1221774 - protein, 5 aa, Mycobacterium
RDSAD

SEQ ID NO: 1221775 - protein, 9 aa, Mycobacterium
RDSAGARTF

SEQ ID NO: 1221776 - protein, 14 aa, Mycobacterium
RDSAPASPLRLAVG

SEQ ID NO: 1221777 - protein, 5 aa, Mycobacterium
RDSAV

SEQ ID NO: 1221778 - protein, 11 aa, Mycobacterium
RDSDHTKAPVP

SEQ ID NO: 1221779 - protein, 8 aa, Mycobacterium
RDSDTRVG

SEQ ID NO: 1221780 - protein, 6 aa, Mycobacterium
RDSDVT

SEQ ID NO: 1221781 - protein, 10 aa, Mycobacterium
RDSENGEVTE

SEQ ID NO: 1221782 - protein, 9 aa, Mycobacterium
RDSEPDWGP

SEQ ID NO: 1221783 - protein, 8 aa, Mycobacterium
RDSGADVV

SEQ ID NO: 1221784 - protein, 11 aa, Mycobacterium
RDSGARPVSQD

SEQ ID NO: 1221785 - protein, 5 aa, Mycobacterium
RDSGE

SEQ ID NO: 1221786 - protein, 5 aa, Mycobacterium
RDSGI

SEQ ID NO: 1221787 - protein, 11 aa, Mycobacterium
RDSGTAAAGVT

SEQ ID NO: 1221788 - protein, 8 aa, Mycobacterium
RDSLPGDP

SEQ ID NO: 1221789 - protein, 8 aa, Mycobacterium
RDSLSAER

SEQ ID NO: 1221790 - protein, 4 aa, Mycobacterium
RDSR

SEQ ID NO: 1221791 - protein, 11 aa, Mycobacterium
RDSRTWSSQTT

SEQ ID NO: 1221792 - protein, 10 aa, Mycobacterium
RDSSTFNPGT

SEQ ID NO: 1221793 - protein, 11 aa, Mycobacterium
RDSTPTGAAGL

SEQ ID NO: 1221794 - protein, 4 aa, Mycobacterium
RDSV

SEQ ID NO: 1221795 - protein, 10 aa, Mycobacterium
RDTAACQNGR

SEQ ID NO: 1221796 - protein, 12 aa, Mycobacterium
RDTAAVGSPIHS

SEQ ID NO: 1221797 - protein, 21 aa, Mycobacterium
RDTAKTPEPIPGDAPTTGNND

SEQ ID NO: 1221798 - protein, 8 aa, Mycobacterium
RDTANPTM

SEQ ID NO: 1221799 - protein, 11 aa, Mycobacterium
RDTAPAGPGIA

SEQ ID NO: 1221800 - protein, 17 aa, Mycobacterium
RDTAPPGLGLPPSSSPL

SEQ ID NO: 1221801 - protein, 5 aa, Mycobacterium
RDTDD

SEQ ID NO: 1221802 - protein, 13 aa, Mycobacterium
RDTDGRSYQGARN

SEQ ID NO: 1221803 - protein, 72 aa, Mycobacterium
RDTDTGAGQDASDDDAGPLATGSEDADRHDRRTPSSEVDTTDTIHGPSWSDEDATDDTDSGNPQKVGPSSDH

SEQ ID NO: 1221804 - protein, 5 aa, Mycobacterium
RDTDV

SEQ ID NO: 1221805 - protein, 26 aa, Mycobacterium
RDTEPRRTTAAPTATLEEDPATADQI

SEQ ID NO: 1221806 - protein, 5 aa, Mycobacterium
RDTGA

SEQ ID NO: 1221807 - protein, 10 aa, Mycobacterium
RDTGAEALSG

SEQ ID NO: 1221808 - protein, 7 aa, Mycobacterium
RDTGAVS

SEQ ID NO: 1221809 - protein, 6 aa, Mycobacterium
RDTGDL

SEQ ID NO: 1221810 - protein, 11 aa, Mycobacterium
RDTGDPELQPA

SEQ ID NO: 1221811 - protein, 9 aa, Mycobacterium
RDTGFGDNP

SEQ ID NO: 1221812 - protein, 18 aa, Mycobacterium
RDTGRSTHLDSAPADLSA

SEQ ID NO: 1221813 - protein, 5 aa, Mycobacterium
RDTGV

SEQ ID NO: 1221814 - protein, 5 aa, Mycobacterium
RDTKS

SEQ ID NO: 1221815 - protein, 8 aa, Mycobacterium
RDTKTDWT

SEQ ID NO: 1221816 - protein, 6 aa, Mycobacterium
RDTLRG

SEQ ID NO: 1221817 - protein, 13 aa, Mycobacterium
RDTPALADGQARA

SEQ ID NO: 1221818 - protein, 7 aa, Mycobacterium
RDTPPSF

SEQ ID NO: 1221819 - protein, 8 aa, Mycobacterium
RDTQPEGY

SEQ ID NO: 1221820 - protein, 5 aa, Mycobacterium
RDTRS

SEQ ID NO: 1221821 - protein, 14 aa, Mycobacterium
RDTRVTGEQQQISQ

SEQ ID NO: 1221822 - protein, 9 aa, Mycobacterium
RDTYRPPKA

SEQ ID NO: 1221823 - protein, 8 aa, Mycobacterium
RDVDPAVA

SEQ ID NO: 1221824 - protein, 6 aa, Mycobacterium
RDVDPE

SEQ ID NO: 1221825 - protein, 5 aa, Mycobacterium
RDVEA

SEQ ID NO: 1221826 - protein, 6 aa, Mycobacterium
RDVGET

SEQ ID NO: 1221827 - protein, 12 aa, Mycobacterium
RDVPDRAPAERA

SEQ ID NO: 1221828 - protein, 7 aa, Mycobacterium
RDVPSGR

SEQ ID NO: 1221829 - protein, 6 aa, Mycobacterium
RDVQRA

SEQ ID NO: 1221830 - protein, 13 aa, Mycobacterium
RDVTDGLEKAAAR

SEQ ID NO: 1221831 - protein, 5 aa, Mycobacterium
RDYAA

SEQ ID NO: 1221832 - protein, 7 aa, Mycobacterium
REAADGH

SEQ ID NO: 1221833 - protein, 6 aa, Mycobacterium
REAADR

SEQ ID NO: 1221834 - protein, 5 aa, Mycobacterium
REAAG

SEQ ID NO: 1221835 - protein, 6 aa, Mycobacterium
REAAPQ

SEQ ID NO: 1221836 - protein, 5 aa, Mycobacterium
REAAQ

SEQ ID NO: 1221837 - protein, 9 aa, Mycobacterium
REAAQAKAT

SEQ ID NO: 1221838 - protein, 9 aa, Mycobacterium
READGSLTQ

SEQ ID NO: 1221839 - protein, 16 aa, Mycobacterium
READPAADEVGQTYSD

SEQ ID NO: 1221840 - protein, 9 aa, Mycobacterium
READPATGV

SEQ ID NO: 1221841 - protein, 15 aa, Mycobacterium
REAEALAASAAREGT

SEQ ID NO: 1221842 - protein, 7 aa, Mycobacterium
REAEQEL

SEQ ID NO: 1221843 - protein, 5 aa, Mycobacterium
REAER

SEQ ID NO: 1221844 - protein, 7 aa, Mycobacterium
REAGADL

SEQ ID NO: 1221845 - protein, 9 aa, Mycobacterium
REAGDPSTI

SEQ ID NO: 1221846 - protein, 6 aa, Mycobacterium
REAGEQ

SEQ ID NO: 1221847 - protein, 7 aa, Mycobacterium
REAGISP

SEQ ID NO: 1221848 - protein, 9 aa, Mycobacterium
REAGNPAAK

SEQ ID NO: 1221849 - protein, 7 aa, Mycobacterium
REAGQGP

SEQ ID NO: 1221850 - protein, 12 aa, Mycobacterium
REAGREVRKETM

SEQ ID NO: 1221851 - protein, 8 aa, Mycobacterium
REAGRGGG

SEQ ID NO: 1221852 - protein, 10 aa, Mycobacterium
REAISEVPQD

SEQ ID NO: 1221853 - protein, 5 aa, Mycobacterium
REALE

SEQ ID NO: 1221854 - protein, 8 aa, Mycobacterium
REALTGSI

SEQ ID NO: 1221855 - protein, 5 aa, Mycobacterium
REAND

SEQ ID NO: 1221856 - protein, 7 aa, Mycobacterium
REANTDE

SEQ ID NO: 1221857 - protein, 15 aa, Mycobacterium
REAPAVNDSGPGIGD

SEQ ID NO: 1221858 - protein, 9 aa, Mycobacterium
REAPPLPAP

SEQ ID NO: 1221859 - protein, 15 aa, Mycobacterium
REAREGRGELTRDDM

SEQ ID NO: 1221860 - protein, 8 aa, Mycobacterium
REASAPVD

SEQ ID NO: 1221861 - protein, 8 aa, Mycobacterium
REASGGER

SEQ ID NO: 1221862 - protein, 16 aa, Mycobacterium
REATGTAALRNSGYTE

SEQ ID NO: 1221863 - protein, 7 aa, Mycobacterium
REATRDK

SEQ ID NO: 1221864 - protein, 19 aa, Mycobacterium
REDAGRYPAEFSGGQKQRI

SEQ ID NO: 1221865 - protein, 18 aa, Mycobacterium
REDAPSLPVAGPDGAPRV

SEQ ID NO: 1221866 - protein, 18 aa, Mycobacterium
REDARRRLEAKGAALADS

SEQ ID NO: 1221867 - protein, 5 aa, Mycobacterium
REDAT

SEQ ID NO: 1221868 - protein, 8 aa, Mycobacterium
REDDQPKG

SEQ ID NO: 1221869 - protein, 6 aa, Mycobacterium
REDDRA

SEQ ID NO: 1221870 - protein, 7 aa, Mycobacterium
REDDSVK

SEQ ID NO: 1221871 - protein, 11 aa, Mycobacterium
REDGDSAVGTR

SEQ ID NO: 1221872 - protein, 7 aa, Mycobacterium
REDGPDV

SEQ ID NO: 1221873 - protein, 7 aa, Mycobacterium
REDGQTW

SEQ ID NO: 1221874 - protein, 9 aa, Mycobacterium
REDGSAIPG

SEQ ID NO: 1221875 - protein, 5 aa, Mycobacterium
REDPE

SEQ ID NO: 1221876 - protein, 6 aa, Mycobacterium
REDPER

SEQ ID NO: 1221877 - protein, 13 aa, Mycobacterium
REDPNHPASADPF

SEQ ID NO: 1221878 - protein, 7 aa, Mycobacterium
REDPPPI

SEQ ID NO: 1221879 - protein, 15 aa, Mycobacterium
REDPRRPLGSTENAY

SEQ ID NO: 1221880 - protein, 12 aa, Mycobacterium
REDRIEAVLAQA

SEQ ID NO: 1221881 - protein, 9 aa, Mycobacterium
REDSPAGQL

SEQ ID NO: 1221882 - protein, 6 aa, Mycobacterium
REDSSK

SEQ ID NO: 1221883 - protein, 5 aa, Mycobacterium
REDTD

SEQ ID NO: 1221884 - protein, 46 aa, Mycobacterium
REEAAKRGMPDRGRRRGASAAQTPPASPATSAVPPVARPDPADPTL

SEQ ID NO: 1221885 - protein, 13 aa, Mycobacterium
REEAGPKDHTVPP

SEQ ID NO: 1221886 - protein, 11 aa, Mycobacterium
REEAGTADNAD

SEQ ID NO: 1221887 - protein, 12 aa, Mycobacterium
REEAQAGAHKSA

SEQ ID NO: 1221888 - protein, 13 aa, Mycobacterium
REEAQAGARKSAA

SEQ ID NO: 1221889 - protein, 25 aa, Mycobacterium
REEARQHAGPGRRHRPGAADEGIGR

SEQ ID NO: 1221890 - protein, 5 aa, Mycobacterium
REEDL

SEQ ID NO: 1221891 - protein, 6 aa, Mycobacterium
REEDRM

SEQ ID NO: 1221892 - protein, 5 aa, Mycobacterium
REEHT

SEQ ID NO: 1221893 - protein, 25 aa, Mycobacterium
REEIDQDVEARTAQANTIGSGFIGL

SEQ ID NO: 1221894 - protein, 8 aa, Mycobacterium
REELTSAG

SEQ ID NO: 1221895 - protein, 9 aa, Mycobacterium
REEPSPGVR

SEQ ID NO: 1221896 - protein, 6 aa, Mycobacterium
REERAS

SEQ ID NO: 1221897 - protein, 12 aa, Mycobacterium
REESARIGDGPL

SEQ ID NO: 1221898 - protein, 4 aa, Mycobacterium
REEV

SEQ ID NO: 1221899 - protein, 7 aa, Mycobacterium
REEVGGI

SEQ ID NO: 1221900 - protein, 6 aa, Mycobacterium
REEVTE

SEQ ID NO: 1221901 - protein, 8 aa, Mycobacterium
REFNGPGD

SEQ ID NO: 1221902 - protein, 6 aa, Mycobacterium
REGAQQ

SEQ ID NO: 1221903 - protein, 5 aa, Mycobacterium
REGAR

SEQ ID NO: 1221904 - protein, 9 aa, Mycobacterium
REGAREADN

SEQ ID NO: 1221905 - protein, 9 aa, Mycobacterium
REGATPTLS

SEQ ID NO: 1221906 - protein, 6 aa, Mycobacterium
REGDPA

SEQ ID NO: 1221907 - protein, 11 aa, Mycobacterium
REGEGKSTVAA

SEQ ID NO: 1221908 - protein, 7 aa, Mycobacterium
REGEGRS

SEQ ID NO: 1221909 - protein, 6 aa, Mycobacterium
REGEHG

SEQ ID NO: 1221910 - protein, 11 aa, Mycobacterium
REGETEPPVDK

SEQ ID NO: 1221911 - protein, 5 aa, Mycobacterium
REGEV

SEQ ID NO: 1221912 - protein, 15 aa, Mycobacterium
REGGAGSHGEKSDGT

SEQ ID NO: 1221913 - protein, 8 aa, Mycobacterium
REGGDSVD

SEQ ID NO: 1221914 - protein, 6 aa, Mycobacterium
REGGEG

SEQ ID NO: 1221915 - protein, 13 aa, Mycobacterium
REGGEYDSAKDVQ

SEQ ID NO: 1221916 - protein, 7 aa, Mycobacterium
REGGHTR

SEQ ID NO: 1221917 - protein, 24 aa, Mycobacterium
REGGSPSGGRSSGGMFGGDGGSGM

SEQ ID NO: 1221918 - protein, 6 aa, Mycobacterium
REGGVE

SEQ ID NO: 1221919 - protein, 40 aa, Mycobacterium
REGKAQQDKADAQQDAAKKEAEAESARAGAAAAEKRQEAN

SEQ ID NO: 1221920 - protein, 40 aa, Mycobacterium
REGKAQQDKADAQQDAARKEAEAESARGGAKAAEERQKSE

SEQ ID NO: 1221921 - protein, 5 aa, Mycobacterium
REGLE

SEQ ID NO: 1221922 - protein, 9 aa, Mycobacterium
REGNGRATR

SEQ ID NO: 1221923 - protein, 9 aa, Mycobacterium
REGNGRSTR

SEQ ID NO: 1221924 - protein, 4 aa, Mycobacterium
REGP

SEQ ID NO: 1221925 - protein, 18 aa, Mycobacterium
REGPAPVDLTPPAPIDPA

SEQ ID NO: 1221926 - protein, 43 aa, Mycobacterium
REGQAQQDKADAQRDAAKKEAEAEAARGSAKVAEERQKSEQND

SEQ ID NO: 1221927 - protein, 10 aa, Mycobacterium
REGQTSGQVR

SEQ ID NO: 1221928 - protein, 5 aa, Mycobacterium
REGRD

SEQ ID NO: 1221929 - protein, 9 aa, Mycobacterium
REGRVKRGD

SEQ ID NO: 1221930 - protein, 7 aa, Mycobacterium
REGSEEY

SEQ ID NO: 1221931 - protein, 7 aa, Mycobacterium
REGTHSA

SEQ ID NO: 1221932 - protein, 5 aa, Mycobacterium
REGTT

SEQ ID NO: 1221933 - protein, 5 aa, Mycobacterium
REGYE

SEQ ID NO: 1221934 - protein, 12 aa, Mycobacterium
REHKERDDEELE

SEQ ID NO: 1221935 - protein, 4 aa, Mycobacterium
REHN

SEQ ID NO: 1221936 - protein, 26 aa, Mycobacterium
REHNATQRALETERAKTPEQARRAEQ

SEQ ID NO: 1221937 - protein, 20 aa, Mycobacterium
REHPGADPSSGPTVDNGYPR

SEQ ID NO: 1221938 - protein, 5 aa, Mycobacterium
REHPQ

SEQ ID NO: 1221939 - protein, 9 aa, Mycobacterium
REHRQRQGE

SEQ ID NO: 1221940 - protein, 9 aa, Mycobacterium
REHTAEGAL

SEQ ID NO: 1221941 - protein, 7 aa, Mycobacterium
REIPEDG

SEQ ID NO: 1221942 - protein, 7 aa, Mycobacterium
REIRDTA

SEQ ID NO: 1221943 - protein, 4 aa, Mycobacterium
REIS

SEQ ID NO: 1221944 - protein, 7 aa, Mycobacterium
REISPDA

SEQ ID NO: 1221945 - protein, 16 aa, Mycobacterium
REKLGDPDDRDAENKV

SEQ ID NO: 1221946 - protein, 6 aa, Mycobacterium
REKPVD

SEQ ID NO: 1221947 - protein, 10 aa, Mycobacterium
REKQTGVSDE

SEQ ID NO: 1221948 - protein, 4 aa, Mycobacterium
RELD

SEQ ID NO: 1221949 - protein, 6 aa, Mycobacterium
RELGAA

SEQ ID NO: 1221950 - protein, 5 aa, Mycobacterium
RELGD

SEQ ID NO: 1221951 - protein, 11 aa, Mycobacterium
RELGTDGSPGT

SEQ ID NO: 1221952 - protein, 7 aa, Mycobacterium
RELKRGN

SEQ ID NO: 1221953 - protein, 5 aa, Mycobacterium
RELQQ

SEQ ID NO: 1221954 - protein, 7 aa, Mycobacterium
RELSDEE

SEQ ID NO: 1221955 - protein, 7 aa, Mycobacterium
RELSGAR

SEQ ID NO: 1221956 - protein, 9 aa, Mycobacterium
RELSSAEPL

SEQ ID NO: 1221957 - protein, 8 aa, Mycobacterium
RELTPEDV

SEQ ID NO: 1221958 - protein, 9 aa, Mycobacterium
RELTQTRAT

SEQ ID NO: 1221959 - protein, 7 aa, Mycobacterium
RENAGQC

SEQ ID NO: 1221960 - protein, 8 aa, Mycobacterium
RENANTDH

SEQ ID NO: 1221961 - protein, 8 aa, Mycobacterium
RENATPTA

SEQ ID NO: 1221962 - protein, 18 aa, Mycobacterium
RENEQLQSALSTRDRIGQ

SEQ ID NO: 1221963 - protein, 4 aa, Mycobacterium
RENL

SEQ ID NO: 1221964 - protein, 29 aa, Mycobacterium
RENRSDPPRKALAANTATTSRTSRSHDAS

SEQ ID NO: 1221965 - protein, 10 aa, Mycobacterium
RENSDGRDAV

SEQ ID NO: 1221966 - protein, 20 aa, Mycobacterium
REPAENYPGATPPKRRRLSH

SEQ ID NO: 1221967 - protein, 9 aa, Mycobacterium
REPAETKSF

SEQ ID NO: 1221968 - protein, 4 aa, Mycobacterium
REPD

SEQ ID NO: 1221969 - protein, 8 aa, Mycobacterium
REPDAQSA

SEQ ID NO: 1221970 - protein, 10 aa, Mycobacterium
REPDDGPDYD

SEQ ID NO: 1221971 - protein, 11 aa, Mycobacterium
REPDSSPEVNR

SEQ ID NO: 1221972 - protein, 6 aa, Mycobacterium
REPERV

SEQ ID NO: 1221973 - protein, 6 aa, Mycobacterium
REPGAT

SEQ ID NO: 1221974 - protein, 5 aa, Mycobacterium
REPGC

SEQ ID NO: 1221975 - protein, 6 aa, Mycobacterium
REPGLD

SEQ ID NO: 1221976 - protein, 10 aa, Mycobacterium
REPGTDTERE

SEQ ID NO: 1221977 - protein, 11 aa, Mycobacterium
REPPTAEIDPA

SEQ ID NO: 1221978 - protein, 8 aa, Mycobacterium
REPRPSGR

SEQ ID NO: 1221979 - protein, 18 aa, Mycobacterium
REPRVPAGRVPEPAGRGS

SEQ ID NO: 1221980 - protein, 8 aa, Mycobacterium
REPSAEVR

SEQ ID NO: 1221981 - protein, 12 aa, Mycobacterium
REPSRREVRDEA

SEQ ID NO: 1221982 - protein, 11 aa, Mycobacterium
REPTDPPTDAE

SEQ ID NO: 1221983 - protein, 6 aa, Mycobacterium
REPTGE

SEQ ID NO: 1221984 - protein, 5 aa, Mycobacterium
REPVG

SEQ ID NO: 1221985 - protein, 7 aa, Mycobacterium
REQAGAL

SEQ ID NO: 1221986 - protein, 8 aa, Mycobacterium
REQAGDPV

SEQ ID NO: 1221987 - protein, 5 aa, Mycobacterium
REQAI

SEQ ID NO: 1221988 - protein, 5 aa, Mycobacterium
REQFE

SEQ ID NO: 1221989 - protein, 6 aa, Mycobacterium
REQFGR

SEQ ID NO: 1221990 - protein, 7 aa, Mycobacterium
REQFGTP

SEQ ID NO: 1221991 - protein, 6 aa, Mycobacterium
REQGLT

SEQ ID NO: 1221992 - protein, 8 aa, Mycobacterium
REQGVSDG

SEQ ID NO: 1221993 - protein, 5 aa, Mycobacterium
REQMS

SEQ ID NO: 1221994 - protein, 15 aa, Mycobacterium
REQPLAGVSGATVAD

SEQ ID NO: 1221995 - protein, 18 aa, Mycobacterium
REQPSAIASGNVIDAEVI

SEQ ID NO: 1221996 - protein, 7 aa, Mycobacterium
REQQPGV

SEQ ID NO: 1221997 - protein, 7 aa, Mycobacterium
REQRGQR

SEQ ID NO: 1221998 - protein, 8 aa, Mycobacterium
REQRKHRA

SEQ ID NO: 1221999 - protein, 11 aa, Mycobacterium
REQSEGRAAAQ

SEQ ID NO: 1222000 - protein, 8 aa, Mycobacterium
REQSGTAI

SEQ ID NO: 1222001 - protein, 5 aa, Mycobacterium
REQSP

SEQ ID NO: 1222002 - protein, 26 aa, Mycobacterium
REQSRQHADEARRKMSERRSAHDGGI

SEQ ID NO: 1222003 - protein, 4 aa, Mycobacterium
REQT

SEQ ID NO: 1222004 - protein, 5 aa, Mycobacterium
REQTA

SEQ ID NO: 1222005 - protein, 4 aa, Mycobacterium
REQY

SEQ ID NO: 1222006 - protein, 10 aa, Mycobacterium
REQYGSAIGS

SEQ ID NO: 1222007 - protein, 11 aa, Mycobacterium
RERAALTTDEV

SEQ ID NO: 1222008 - protein, 13 aa, Mycobacterium
RERAGARQAKESL

SEQ ID NO: 1222009 - protein, 7 aa, Mycobacterium
RERDAQK

SEQ ID NO: 1222010 - protein, 7 aa, Mycobacterium
RERDGRA

SEQ ID NO: 1222011 - protein, 7 aa, Mycobacterium
RERDHAS

SEQ ID NO: 1222012 - protein, 7 aa, Mycobacterium
RERDPDR

SEQ ID NO: 1222013 - protein, 16 aa, Mycobacterium
RERESAKWTKASREIT

SEQ ID NO: 1222014 - protein, 4 aa, Mycobacterium
RERG

SEQ ID NO: 1222015 - protein, 12 aa, Mycobacterium
RERGEARAAELG

SEQ ID NO: 1222016 - protein, 8 aa, Mycobacterium
RERGETLT

SEQ ID NO: 1222017 - protein, 6 aa, Mycobacterium
RERGGE

SEQ ID NO: 1222018 - protein, 9 aa, Mycobacterium
RERGGHPDL

SEQ ID NO: 1222019 - protein, 21 aa, Mycobacterium
RERGPELAEAARERAEAARER

SEQ ID NO: 1222020 - protein, 7 aa, Mycobacterium
RERGRRG

SEQ ID NO: 1222021 - protein, 5 aa, Mycobacterium
RERKP

SEQ ID NO: 1222022 - protein, 7 aa, Mycobacterium
RERKTTA

SEQ ID NO: 1222023 - protein, 5 aa, Mycobacterium
RERPG

SEQ ID NO: 1222024 - protein, 7 aa, Mycobacterium
RERPGAP

SEQ ID NO: 1222025 - protein, 5 aa, Mycobacterium
RERPS

SEQ ID NO: 1222026 - protein, 9 aa, Mycobacterium
RERQGDEYA

SEQ ID NO: 1222027 - protein, 31 aa, Mycobacterium; identical to SEQ ID NO: 403789

SEQ ID NO: 1222028 - protein, 15 aa, Mycobacterium
RERRGEVEEASDRIA

SEQ ID NO: 1222029 - protein, 11 aa, Mycobacterium
RERSDDPRDTL

SEQ ID NO: 1222030 - protein, 7 aa, Mycobacterium
RERSEGD

SEQ ID NO: 1222031 - protein, 6 aa, Mycobacterium
RERSEN

SEQ ID NO: 1222032 - protein, 7 aa, Mycobacterium
RERSGKQ

SEQ ID NO: 1222033 - protein, 9 aa, Mycobacterium
RERSTLDTA

SEQ ID NO: 1222034 - protein, 7 aa, Mycobacterium
RERTGAG

SEQ ID NO: 1222035 - protein, 8 aa, Mycobacterium
RERTGEPS

SEQ ID NO: 1222036 - protein, 9 aa, Mycobacterium
RERTGEPSV

SEQ ID NO: 1222037 - protein, 14 aa, Mycobacterium
RERTLDAGAREAEP

SEQ ID NO: 1222038 - protein, 10 aa, Mycobacterium
RERVNSSGVA

SEQ ID NO: 1222039 - protein, 6 aa, Mycobacterium
RERVTS

SEQ ID NO: 1222040 - protein, 5 aa, Mycobacterium
RERYA

SEQ ID NO: 1222041 - protein, 13 aa, Mycobacterium
RERYGPPERASRA

SEQ ID NO: 1222042 - protein, 9 aa, Mycobacterium
RESAPGSDH

SEQ ID NO: 1222043 - protein, 4 aa, Mycobacterium
RESG

SEQ ID NO: 1222044 - protein, 9 aa, Mycobacterium
RESGGTIGG

SEQ ID NO: 1222045 - protein, 8 aa, Mycobacterium
RESGGVKI

SEQ ID NO: 1222046 - protein, 10 aa, Mycobacterium
RESGKTPGLV

SEQ ID NO: 1222047 - protein, 8 aa, Mycobacterium
RESGPGAV

SEQ ID NO: 1222048 - protein, 10 aa, Mycobacterium
RESHRDGGSA

SEQ ID NO: 1222049 - protein, 8 aa, Mycobacterium
RESNEQMA

SEQ ID NO: 1222050 - protein, 5 aa, Mycobacterium
RESPE

SEQ ID NO: 1222051 - protein, 8 aa, Mycobacterium
RESPSELP

SEQ ID NO: 1222052 - protein, 7 aa, Mycobacterium
RESPVNQ

SEQ ID NO: 1222053 - protein, 15 aa, Mycobacterium
RESTQYTRTSSRVGR

SEQ ID NO: 1222054 - protein, 5 aa, Mycobacterium
RETAA

SEQ ID NO: 1222055 - protein, 13 aa, Mycobacterium
RETAADDTPRHRY

SEQ ID NO: 1222056 - protein, 6 aa, Mycobacterium
RETDPF

SEQ ID NO: 1222057 - protein, 4 aa, Mycobacterium
RETE

SEQ ID NO: 1222058 - protein, 15 aa, Mycobacterium
RETEAPRKTAGRFWR

SEQ ID NO: 1222059 - protein, 15 aa, Mycobacterium
RETETTKWRDPTGNV

SEQ ID NO: 1222060 - protein, 4 aa, Mycobacterium
RETF

SEQ ID NO: 1222061 - protein, 5 aa, Mycobacterium
RETFG

SEQ ID NO: 1222062 - protein, 6 aa, Mycobacterium
RETGAV

SEQ ID NO: 1222063 - protein, 5 aa, Mycobacterium
RETGD

SEQ ID NO: 1222064 - protein, 6 aa, Mycobacterium
RETGDD

SEQ ID NO: 1222065 - protein, 6 aa, Mycobacterium
RETGES

SEQ ID NO: 1222066 - protein, 20 aa, Mycobacterium
RETGETDPALPERELQMLDP

SEQ ID NO: 1222067 - protein, 9 aa, Mycobacterium
RETGETHTI

SEQ ID NO: 1222068 - protein, 8 aa, Mycobacterium
RETGLGPN

SEQ ID NO: 1222069 - protein, 7 aa, Mycobacterium
RETGPTQ

SEQ ID NO: 1222070 - protein, 5 aa, Mycobacterium
RETGR

SEQ ID NO: 1222071 - protein, 9 aa, Mycobacterium
RETGSIYEK

SEQ ID NO: 1222072 - protein, 7 aa, Mycobacterium
RETGTAV

SEQ ID NO: 1222073 - protein, 12 aa, Mycobacterium
RETLSSFPDDRG

SEQ ID NO: 1222074 - protein, 6 aa, Mycobacterium
RETMGN

SEQ ID NO: 1222075 - protein, 5 aa, Mycobacterium
RETMR

SEQ ID NO: 1222076 - protein, 7 aa, Mycobacterium
RETQGRE

SEQ ID NO: 1222077 - protein, 5 aa, Mycobacterium
RETRA

SEQ ID NO: 1222078 - protein, 8 aa, Mycobacterium
RETREMRD

SEQ ID NO: 1222079 - protein, 17 aa, Mycobacterium
RETREPLAPYGGSSPAM

SEQ ID NO: 1222080 - protein, 7 aa, Mycobacterium
RETRSPE

SEQ ID NO: 1222081 - protein, 5 aa, Mycobacterium
RETRW

SEQ ID NO: 1222082 - protein, 19 aa, Mycobacterium
RETSAPALTKTSSTPQTDK

SEQ ID NO: 1222083 - protein, 19 aa, Mycobacterium
RETSAPALTKTSSTPQTDN

SEQ ID NO: 1222084 - protein, 8 aa, Mycobacterium
RETSASRQ

SEQ ID NO: 1222085 - protein, 7 aa, Mycobacterium
RETSERL

SEQ ID NO: 1222086 - protein, 10 aa, Mycobacterium
RETSGCGQAV

SEQ ID NO: 1222087 - protein, 50 aa, Mycobacterium
RETSRARGTWRATSATAGYSSAARRAGDRAGRRARLGGETELAGARSALE

SEQ ID NO: 1222088 - protein, 5 aa, Mycobacterium
RETST

SEQ ID NO: 1222089 - protein, 9 aa, Mycobacterium
REVDRRPGD

SEQ ID NO: 1222090 - protein, 12 aa, Mycobacterium
REVGGGDTRSDI

SEQ ID NO: 1222091 - protein, 6 aa, Mycobacterium
REVGRP

SEQ ID NO: 1222092 - protein, 9 aa, Mycobacterium
REVSATEVT

SEQ ID NO: 1222093 - protein, 9 aa, Mycobacterium
REVSDSARV

SEQ ID NO: 1222094 - protein, 14 aa, Mycobacterium
REVSPEEMQAAMTQ

SEQ ID NO: 1222095 - protein, 11 aa, Mycobacterium
REVTRGDRPIS

SEQ ID NO: 1222096 - protein, 4 aa, Mycobacterium
REYE

SEQ ID NO: 1222097 - protein, 6 aa, Mycobacterium
REYGEE

SEQ ID NO: 1222098 - protein, 9 aa, Mycobacterium
REYGERGTE

SEQ ID NO: 1222099 - protein, 7 aa, Mycobacterium
REYGPAG

SEQ ID NO: 1222100 - protein, 6 aa, Mycobacterium
REYGRG

SEQ ID NO: 1222101 - protein, 5 aa, Mycobacterium
REYPD

SEQ ID NO: 1222102 - protein, 4 aa, Mycobacterium
REYR

SEQ ID NO: 1222103 - protein, 13 aa, Mycobacterium
REYTRAHGDDIPE

SEQ ID NO: 1222104 - protein, 8 aa, Mycobacterium
REYVDDPR

SEQ ID NO: 1222105 - protein, 5 aa, Mycobacterium
RFAGD

SEQ ID NO: 1222106 - protein, 6 aa, Mycobacterium
RFAPDG

SEQ ID NO: 1222107 - protein, 6 aa, Mycobacterium
RFAPNG

SEQ ID NO: 1222108 - protein, 5 aa, Mycobacterium
RFDAP

SEQ ID NO: 1222109 - protein, 4 aa, Mycobacterium
RFDD

SEQ ID NO: 1222110 - protein, 11 aa, Mycobacterium
RFDDGDPPARL

SEQ ID NO: 1222111 - protein, 4 aa, Mycobacterium
RFDE

SEQ ID NO: 1222112 - protein, 6 aa, Mycobacterium
RFDETV

SEQ ID NO: 1222113 - protein, 14 aa, Mycobacterium
RFEGKNTKTANTDG

SEQ ID NO: 1222114 - protein, 10 aa, Mycobacterium
RFGAKGPARL

SEQ ID NO: 1222115 - protein, 10 aa, Mycobacterium
RFGEAPQRLP

SEQ ID NO: 1222116 - protein, 10 aa, Mycobacterium
RFGPGRPGHD

SEQ ID NO: 1222117 - protein, 10 aa, Mycobacterium
RFGPPSIESH

SEQ ID NO: 1222118 - protein, 13 aa, Mycobacterium
RFGPVDSRRTTQI

SEQ ID NO: 1222119 - protein, 7 aa, Mycobacterium
RFGSPEL

SEQ ID NO: 1222120 - protein, 6 aa, Mycobacterium
RFGTEQ

SEQ ID NO: 1222121 - protein, 4 aa, Mycobacterium
RFPD

SEQ ID NO: 1222122 - protein, 6 aa, Mycobacterium
RFPDKS

SEQ ID NO: 1222123 - protein, 4 aa, Mycobacterium
RFPG

SEQ ID NO: 1222124 - protein, 12 aa, Mycobacterium
RFPGFTSPDPSY

SEQ ID NO: 1222125 - protein, 5 aa, Mycobacterium
RFPGR

SEQ ID NO: 1222126 - protein, 4 aa, Mycobacterium
RFPN

SEQ ID NO: 1222127 - protein, 5 aa, Mycobacterium
RFPSD

SEQ ID NO: 1222128 - protein, 7 aa, Mycobacterium
RFPSSGG

SEQ ID NO: 1222129 - protein, 12 aa, Mycobacterium
RFRDAADSQGFD

SEQ ID NO: 1222130 - protein, 17 aa, Mycobacterium
RFRDRERTAVETNDKTA

SEQ ID NO: 1222131 - protein, 8 aa, Mycobacterium
RFSAPPPV

SEQ ID NO: 1222132 - protein, 15 aa, Mycobacterium
RFSEKEAKPIANQNS

SEQ ID NO: 1222133 - protein, 15 aa, Mycobacterium
RFSEKEATPIANQNT

SEQ ID NO: 1222134 - protein, 17 aa, Mycobacterium
RFSSTTRKSLRRALSRV

SEQ ID NO: 1222135 - protein, 18 aa, Mycobacterium
RFTDPAESRATIEGMKDG

SEQ ID NO: 1222136 - protein, 6 aa, Mycobacterium
RGAADF

SEQ ID NO: 1222137 - protein, 11 aa, Mycobacterium
RGAADREWDPD

SEQ ID NO: 1222138 - protein, 14 aa, Mycobacterium
RGAAGAEPTSGDGA

SEQ ID NO: 1222139 - protein, 6 aa, Mycobacterium
RGAAGV

SEQ ID NO: 1222140 - protein, 15 aa, Mycobacterium
RGAAPESLDGVPQPS

SEQ ID NO: 1222141 - protein, 5 aa, Mycobacterium
RGACS

SEQ ID NO: 1222142 - protein, 9 aa, Mycobacterium
RGADDTAMR

SEQ ID NO: 1222143 - protein, 6 aa, Mycobacterium
RGADDV

SEQ ID NO: 1222144 - protein, 8 aa, Mycobacterium
RGADGEIE

SEQ ID NO: 1222145 - protein, 11 aa, Mycobacterium
RGADGELPPND

SEQ ID NO: 1222146 - protein, 11 aa, Mycobacterium
RGADGELTDSV

SEQ ID NO: 1222147 - protein, 5 aa, Mycobacterium
RGADH

SEQ ID NO: 1222148 - protein, 6 aa, Mycobacterium
RGAERV

SEQ ID NO: 1222149 - protein, 6 aa, Mycobacterium
RGAESD

SEQ ID NO: 1222150 - protein, 11 aa, Mycobacterium
RGAEVAGGARL

SEQ ID NO: 1222151 - protein, 4 aa, Mycobacterium
RGAF

SEQ ID NO: 1222152 - protein, 5 aa, Mycobacterium
RGAGA

SEQ ID NO: 1222153 - protein, 10 aa, Mycobacterium
RGAGAPGPAV

SEQ ID NO: 1222154 - protein, 6 aa, Mycobacterium
RGAGAS

SEQ ID NO: 1222155 - protein, 21 aa, Mycobacterium
RGAGDSYEVTDEALAGDFKKL

SEQ ID NO: 1222156 - protein, 8 aa, Mycobacterium
RGAGGELQ

SEQ ID NO: 1222157 - protein, 6 aa, Mycobacterium
RGAGGT

SEQ ID NO: 1222158 - protein, 15 aa, Mycobacterium
RGAGKSFRRGMPRSS

SEQ ID NO: 1222159 - protein, 10 aa, Mycobacterium
RGAGPAPLDN

SEQ ID NO: 1222160 - protein, 9 aa, Mycobacterium
RGAGRDHPV

SEQ ID NO: 1222161 - protein, 13 aa, Mycobacterium
RGAGTDSPSTLDT

SEQ ID NO: 1222162 - protein, 7 aa, Mycobacterium
RGAGVPA

SEQ ID NO: 1222163 - protein, 18 aa, Mycobacterium
RGAHQSALDKAGQPRPGR

SEQ ID NO: 1222164 - protein, 28 aa, Mycobacterium
RGAKSGQPVTDIGAPGGGGGGGGTGRHS

SEQ ID NO: 1222165 - protein, 34 aa, Mycobacterium
RGAKTRAKAAHDADTPAGQRGDAQAADAPTDTPK

SEQ ID NO: 1222166 - protein, 4 aa, Mycobacterium
RGAP

SEQ ID NO: 1222167 - protein, 8 aa, Mycobacterium
RGAPAPLD

SEQ ID NO: 1222168 - protein, 5 aa, Mycobacterium
RGAPC

SEQ ID NO: 1222169 - protein, 14 aa, Mycobacterium
RGAPGAQDRATAES

SEQ ID NO: 1222170 - protein, 6 aa, Mycobacterium
RGAPNE

SEQ ID NO: 1222171 - protein, 5 aa, Mycobacterium
RGAPR

SEQ ID NO: 1222172 - protein, 6 aa, Mycobacterium
RGAPRE

SEQ ID NO: 1222173 - protein, 15 aa, Mycobacterium
RGAQRQADDIRRAQE

SEQ ID NO: 1222174 - protein, 6 aa, Mycobacterium
RGAQVN

SEQ ID NO: 1222175 - protein, 11 aa, Mycobacterium
RGARDSRQFDN

SEQ ID NO: 1222176 - protein, 5 aa, Mycobacterium
RGARG

SEQ ID NO: 1222177 - protein, 7 aa, Mycobacterium
RGARGVQ

SEQ ID NO: 1222178 - protein, 10 aa, Mycobacterium
RGARPATTAL

SEQ ID NO: 1222179 - protein, 17 aa, Mycobacterium
RGARPRTQPETTGEAGD

SEQ ID NO: 1222180 - protein, 9 aa, Mycobacterium
RGASQSTVE

SEQ ID NO: 1222181 - protein, 5 aa, Mycobacterium
RGASR

SEQ ID NO: 1222182 - protein, 13 aa, Mycobacterium
RGASSAASAANGA

SEQ ID NO: 1222183 - protein, 8 aa, Mycobacterium
RGATEGGV

SEQ ID NO: 1222184 - protein, 9 aa, Mycobacterium
RGATGPADA

SEQ ID NO: 1222185 - protein, 8 aa, Mycobacterium
RGATNRQV

SEQ ID NO: 1222186 - protein, 7 aa, Mycobacterium
RGATSID

SEQ ID NO: 1222187 - protein, 9 aa, Mycobacterium
RGATTKEAA

SEQ ID NO: 1222188 - protein, 5 aa, Mycobacterium
RGATV

SEQ ID NO: 1222189 - protein, 5 aa, Mycobacterium
RGATY

SEQ ID NO: 1222190 - protein, 6 aa, Mycobacterium
RGAVAS

SEQ ID NO: 1222191 - protein, 19 aa, Mycobacterium
RGAVEQRTVEADPSDVPGL

SEQ ID NO: 1222192 - protein, 6 aa, Mycobacterium
RGAVGP

SEQ ID NO: 1222193 - protein, 7 aa, Mycobacterium
RGAVTER

SEQ ID NO: 1222194 - protein, 7 aa, Mycobacterium
RGCGQGP

SEQ ID NO: 1222195 - protein, 14 aa, Mycobacterium
RGCGQSDRPRGPAA

SEQ ID NO: 1222196 - protein, 6 aa, Mycobacterium
RGCPPL

SEQ ID NO: 1222197 - protein, 7 aa, Mycobacterium
RGDAAAY

SEQ ID NO: 1222198 - protein, 14 aa, Mycobacterium
RGDARRRATAEGKV

SEQ ID NO: 1222199 - protein, 7 aa, Mycobacterium
RGDARSV

SEQ ID NO: 1222200 - protein, 6 aa, Mycobacterium
RGDDQA

SEQ ID NO: 1222201 - protein, 14 aa, Mycobacterium
RGDEDQLRGDAGPL

SEQ ID NO: 1222202 - protein, 66 aa, Mycobacterium
RGDGGAGGAGGAAVRTGNGPDGQVYAGRGGDGGDAVVGSGGQGGVGGDATSQGGPATSGGGGHGGS

SEQ ID NO: 1222203 - protein, 9 aa, Mycobacterium
RGDGHDTPL

SEQ ID NO: 1222204 - protein, 9 aa, Mycobacterium
RGDGRVASA

SEQ ID NO: 1222205 - protein, 5 aa, Mycobacterium
RGDGV

SEQ ID NO: 1222206 - protein, 14 aa, Mycobacterium
RGDGVRAGYDPAGA

SEQ ID NO: 1222207 - protein, 6 aa, Mycobacterium
RGDHGD

SEQ ID NO: 1222208 - protein, 6 aa, Mycobacterium
RGDHYP

SEQ ID NO: 1222209 - protein, 15 aa, Mycobacterium
RGDIGGVSTAVGPVD

SEQ ID NO: 1222210 - protein, 5 aa, Mycobacterium
RGDIN

SEQ ID NO: 1222211 - protein, 13 aa, Mycobacterium
RGDKDHPASQGYT

SEQ ID NO: 1222212 - protein, 12 aa, Mycobacterium
RGDKVAATARDL

SEQ ID NO: 1222213 - protein, 17 aa, Mycobacterium
RGDLDASRRVAGNALDA

SEQ ID NO: 1222214 - protein, 8 aa, Mycobacterium
RGDLDTAR

SEQ ID NO: 1222215 - protein, 27 aa, Mycobacterium
RGDLSAASFDPADRDVVDGPQHLSENE

SEQ ID NO: 1222216 - protein, 7 aa, Mycobacterium
RGDNAAA

SEQ ID NO: 1222217 - protein, 7 aa, Mycobacterium
RGDNDDR

SEQ ID NO: 1222218 - protein, 15 aa, Mycobacterium
RGDPDEKLRDDGPTI

SEQ ID NO: 1222219 - protein, 8 aa, Mycobacterium
RGDPDNGV

SEQ ID NO: 1222220 - protein, 9 aa, Mycobacterium
RGDPEPSAR

SEQ ID NO: 1222221 - protein, 14 aa, Mycobacterium
RGDPPRADWAQPPV

SEQ ID NO: 1222222 - protein, 10 aa, Mycobacterium
RGDPQAEQSD

SEQ ID NO: 1222223 - protein, 9 aa, Mycobacterium
RGDPTYPGW

SEQ ID NO: 1222224 - protein, 4 aa, Mycobacterium
RGDQ

SEQ ID NO: 1222225 - protein, 5 aa, Mycobacterium
RGDQL

SEQ ID NO: 1222226 - protein, 9 aa, Mycobacterium
RGDQNNASL

SEQ ID NO: 1222227 - protein, 5 aa, Mycobacterium
RGDQQ

SEQ ID NO: 1222228 - protein, 17 aa, Mycobacterium
RGDRLPDSHPAAAYRGA

SEQ ID NO: 1222229 - protein, 13 aa, Mycobacterium
RGDRLPDTHPAAR

SEQ ID NO: 1222230 - protein, 12 aa, Mycobacterium
RGDRLPEEHRGA

SEQ ID NO: 1222231 - protein, 5 aa, Mycobacterium
RGDRM

SEQ ID NO: 1222232 - protein, 7 aa, Mycobacterium
RGDRRAE

SEQ ID NO: 1222233 - protein, 8 aa, Mycobacterium
RGDSPADH

SEQ ID NO: 1222234 - protein, 9 aa, Mycobacterium
RGDSPRRDV

SEQ ID NO: 1222235 - protein, 14 aa, Mycobacterium
RGDSTVTVAFPGGS

SEQ ID NO: 1222236 - protein, 5 aa, Mycobacterium
RGDTG

SEQ ID NO: 1222237 - protein, 7 aa, Mycobacterium
RGDTQTA

SEQ ID NO: 1222238 - protein, 5 aa, Mycobacterium
RGDTT

SEQ ID NO: 1222239 - protein, 5 aa, Mycobacterium
RGDVD

SEQ ID NO: 1222240 - protein, 8 aa, Mycobacterium
RGDVPDQP

SEQ ID NO: 1222241 - protein, 9 aa, Mycobacterium
RGDVRDRDR

SEQ ID NO: 1222242 - protein, 5 aa, Mycobacterium
RGDVS

SEQ ID NO: 1222243 - protein, 10 aa, Mycobacterium
RGDVSEAAPG

SEQ ID NO: 1222244 - protein, 33 aa, Mycobacterium
RGDWSSTDERSREEYPATDERSREENSATDEPS

SEQ ID NO: 1222245 - protein, 6 aa, Mycobacterium
RGEAGH

SEQ ID NO: 1222246 - protein, 9 aa, Mycobacterium
RGEAHDDPA

SEQ ID NO: 1222247 - protein, 13 aa, Mycobacterium
RGEAPHAQLPPPA

SEQ ID NO: 1222248 - protein, 11 aa, Mycobacterium
RGEARPDVGRN

SEQ ID NO: 1222249 - protein, 15 aa, Mycobacterium
RGEDRRVTPPADDRP

SEQ ID NO: 1222250 - protein, 14 aa, Mycobacterium
RGEEKAKNLSYGDQ

SEQ ID NO: 1222251 - protein, 4 aa, Mycobacterium
RGEF

SEQ ID NO: 1222252 - protein, 12 aa, Mycobacterium
RGEGDFEGEPPW

SEQ ID NO: 1222253 - protein, 8 aa, Mycobacterium
RGEGEREV

SEQ ID NO: 1222254 - protein, 9 aa, Mycobacterium
RGEGGEKLD

SEQ ID NO: 1222255 - protein, 5 aa, Mycobacterium
RGEGP

SEQ ID NO: 1222256 - protein, 7 aa, Mycobacterium
RGEGPAL

SEQ ID NO: 1222257 - protein, 6 aa, Mycobacterium
RGEGPL

SEQ ID NO: 1222258 - protein, 8 aa, Mycobacterium
RGEGYQPG

SEQ ID NO: 1222259 - protein, 14 aa, Mycobacterium
RGEIHPDTNSAEAA

SEQ ID NO: 1222260 - protein, 7 aa, Mycobacterium
RGEIRDP

SEQ ID NO: 1222261 - protein, 4 aa, Mycobacterium
RGEK

SEQ ID NO: 1222262 - protein, 17 aa, Mycobacterium
RGELEATATERARLEGA

SEQ ID NO: 1222263 - protein, 5 aa, Mycobacterium
RGELG

SEQ ID NO: 1222264 - protein, 6 aa, Mycobacterium
RGELRP

SEQ ID NO: 1222265 - protein, 9 aa, Mycobacterium
RGELTVSGR

SEQ ID NO: 1222266 - protein, 8 aa, Mycobacterium
RGEPADAE

SEQ ID NO: 1222267 - protein, 10 aa, Mycobacterium
RGEPLNEGAD

SEQ ID NO: 1222268 - protein, 22 aa, Mycobacterium
RGEPLRAAPPPPESRAPASNDE

SEQ ID NO: 1222269 - protein, 5 aa, Mycobacterium
RGEPV

SEQ ID NO: 1222270 - protein, 4 aa, Mycobacterium
RGER

SEQ ID NO: 1222271 - protein, 9 aa, Mycobacterium
RGERDRPLA

SEQ ID NO: 1222272 - protein, 6 aa, Mycobacterium
RGESIR

SEQ ID NO: 1222273 - protein, 25 aa, Mycobacterium
RGESPGPVTLSAPDPTVTSTTAADV

SEQ ID NO: 1222274 - protein, 4 aa, Mycobacterium
RGET

SEQ ID NO: 1222275 - protein, 9 aa, Mycobacterium
RGETELDER

SEQ ID NO: 1222276 - protein, 5 aa, Mycobacterium
RGETG

SEQ ID NO: 1222277 - protein, 7 aa, Mycobacterium
RGETPPW

SEQ ID NO: 1222278 - protein, 6 aa, Mycobacterium
RGEWHS

SEQ ID NO: 1222279 - protein, 7 aa, Mycobacterium
RGEWHSG

SEQ ID NO: 1222280 - protein, 6 aa, Mycobacterium
RGEYKS

SEQ ID NO: 1222281 - protein, 10 aa, Mycobacterium
RGFASGTADG

SEQ ID NO: 1222282 - protein, 7 aa, Mycobacterium
RGFDPRD

SEQ ID NO: 1222283 - protein, 4 aa, Mycobacterium
RGFE

SEQ ID NO: 1222284 - protein, 37 aa, Mycobacterium
RGFGASRQNGPRADSTGKQQQRSASDRRIPQGADTRS

SEQ ID NO: 1222285 - protein, 7 aa, Mycobacterium
RGFGRSS

SEQ ID NO: 1222286 - protein, 4 aa, Mycobacterium
RGFP

SEQ ID NO: 1222287 - protein, 8 aa, Mycobacterium
RGGAGDLN

SEQ ID NO: 1222288 - protein, 9 aa, Mycobacterium
RGGANGGRI

SEQ ID NO: 1222289 - protein, 14 aa, Mycobacterium
RGGAPAEVTHSGKT

SEQ ID NO: 1222290 - protein, 9 aa, Mycobacterium
RGGASKGRS

SEQ ID NO: 1222291 - protein, 4 aa, Mycobacterium
RGGD

SEQ ID NO: 1222292 - protein, 24 aa, Mycobacterium
RGGDGGDGGSAGTGGAGGFGGTGG

SEQ ID NO: 1222293 - protein, 14 aa, Mycobacterium
RGGDPDRPGKSDPL

SEQ ID NO: 1222294 - protein, 8 aa, Mycobacterium
RGGDPTDN

SEQ ID NO: 1222295 - protein, 12 aa, Mycobacterium
RGGDQDLEEARE

SEQ ID NO: 1222296 - protein, 9 aa, Mycobacterium
RGGEPTPAD

SEQ ID NO: 1222297 - protein, 9 aa, Mycobacterium
RGGEPTPTD

SEQ ID NO: 1222298 - protein, 7 aa, Mycobacterium
RGGERTA

SEQ ID NO: 1222299 - protein, 7 aa, Mycobacterium
RGGETLA

SEQ ID NO: 1222300 - protein, 8 aa, Mycobacterium
RGGFHPDD

SEQ ID NO: 1222301 - protein, 4 aa, Mycobacterium
RGGG

SEQ ID NO: 1222302 - protein, 9 aa, Mycobacterium
RGGGASAPA

SEQ ID NO: 1222303 - protein, 5 aa, Mycobacterium
RGGGE

SEQ ID NO: 1222304 - protein, 7 aa, Mycobacterium
RGGGELG

SEQ ID NO: 1222305 - protein, 34 aa, Mycobacterium
RGGGPRARSRRRAGPGRRRSRLRRGRRRGRGRCR

SEQ ID NO: 1222306 - protein, 5 aa, Mycobacterium
RGGGR

SEQ ID NO: 1222307 - protein, 5 aa, Mycobacterium
RGGHM

SEQ ID NO: 1222308 - protein, 5 aa, Mycobacterium
RGGLR

SEQ ID NO: 1222309 - protein, 5 aa, Mycobacterium
RGGLT

SEQ ID NO: 1222310 - protein, 8 aa, Mycobacterium
RGGPPGSG

SEQ ID NO: 1222311 - protein, 8 aa, Mycobacterium
RGGPQAAR

SEQ ID NO: 1222312 - protein, 7 aa, Mycobacterium
RGGPTGY

SEQ ID NO: 1222313 - protein, 4 aa, Mycobacterium
RGGQ

SEQ ID NO: 1222314 - protein, 7 aa, Mycobacterium
RGGQDPA

SEQ ID NO: 1222315 - protein, 8 aa, Mycobacterium
RGGQRGDR

SEQ ID NO: 1222316 - protein, 5 aa, Mycobacterium
RGGQT

SEQ ID NO: 1222317 - protein, 12 aa, Mycobacterium
RGGRGGNQTKER

SEQ ID NO: 1222318 - protein, 7 aa, Mycobacterium
RGGRGLK

SEQ ID NO: 1222319 - protein, 10 aa, Mycobacterium
RGGRLDPRQA

SEQ ID NO: 1222320 - protein, 6 aa, Mycobacterium
RGGRPT

SEQ ID NO: 1222321 - protein, 15 aa, Mycobacterium
RGGRVASDGKAYRGA

SEQ ID NO: 1222322 - protein, 10 aa, Mycobacterium
RGGRVGPDQL

SEQ ID NO: 1222323 - protein, 14 aa, Mycobacterium
RGGSADGLTPPDAA

SEQ ID NO: 1222324 - protein, 8 aa, Mycobacterium
RGGTGDEV

SEQ ID NO: 1222325 - protein, 6 aa, Mycobacterium
RGGTNE

SEQ ID NO: 1222326 - protein, 9 aa, Mycobacterium
RGGTPKRGQ

SEQ ID NO: 1222327 - protein, 11 aa, Mycobacterium
RGGTRPELQSQ

SEQ ID NO: 1222328 - protein, 6 aa, Mycobacterium
RGGTTE

SEQ ID NO: 1222329 - protein, 6 aa, Mycobacterium
RGGTTG

SEQ ID NO: 1222330 - protein, 13 aa, Mycobacterium
RGGVLGDATGATV

SEQ ID NO: 1222331 - protein, 13 aa, Mycobacterium
RGGVLGEATGATV

SEQ ID NO: 1222332 - protein, 4 aa, Mycobacterium
RGHE

SEQ ID NO: 1222333 - protein, 9 aa, Mycobacterium
RGHERREEP

SEQ ID NO: 1222334 - protein, 5 aa, Mycobacterium
RGHGD

SEQ ID NO: 1222335 - protein, 14 aa, Mycobacterium
RGHGHSTGRSTPAD

SEQ ID NO: 1222336 - protein, 10 aa, Mycobacterium
RGHGRSGGKR

SEQ ID NO: 1222337 - protein, 8 aa, Mycobacterium
RGHGSGDF

SEQ ID NO: 1222338 - protein, 14 aa, Mycobacterium
RGHNPTRGSALGPV

SEQ ID NO: 1222339 - protein, 4 aa, Mycobacterium
RGHP

SEQ ID NO: 1222340 - protein, 8 aa, Mycobacterium
RGHPGASL

SEQ ID NO: 1222341 - protein, 7 aa, Mycobacterium
RGHPGNL

SEQ ID NO: 1222342 - protein, 7 aa, Mycobacterium
RGHPGRE

SEQ ID NO: 1222343 - protein, 12 aa, Mycobacterium
RGHPPNARRQRL

SEQ ID NO: 1222344 - protein, 7 aa, Mycobacterium
RGHQATD

SEQ ID NO: 1222345 - protein, 8 aa, Mycobacterium
RGHRQQAE

SEQ ID NO: 1222346 - protein, 9 aa, Mycobacterium
RGHSPTEQA

SEQ ID NO: 1222347 - protein, 6 aa, Mycobacterium
RGIAND

SEQ ID NO: 1222348 - protein, 10 aa, Mycobacterium
RGIEKSSRSC

SEQ ID NO: 1222349 - protein, 5 aa, Mycobacterium
RGIGR

SEQ ID NO: 1222350 - protein, 4 aa, Mycobacterium
RGIP

SEQ ID NO: 1222351 - protein, 11 aa, Mycobacterium
RGIPQTPYDED

SEQ ID NO: 1222352 - protein, 6 aa, Mycobacterium
RGIPRS

SEQ ID NO: 1222353 - protein, 8 aa, Mycobacterium
RGIRPDDG

SEQ ID NO: 1222354 - protein, 5 aa, Mycobacterium
RGITA

SEQ ID NO: 1222355 - protein, 7 aa, Mycobacterium
RGITGRD

SEQ ID NO: 1222356 - protein, 5 aa, Mycobacterium
RGITR

SEQ ID NO: 1222357 - protein, 4 aa, Mycobacterium
RGKG

SEQ ID NO: 1222358 - protein, 9 aa, Mycobacterium
RGKGSKGRV

SEQ ID NO: 1222359 - protein, 8 aa, Mycobacterium
RGKMTARE

SEQ ID NO: 1222360 - protein, 4 aa, Mycobacterium
RGKP

SEQ ID NO: 1222361 - protein, 10 aa, Mycobacterium
RGKPSPDQLD

SEQ ID NO: 1222362 - protein, 7 aa, Mycobacterium
RGKRYRS

SEQ ID NO: 1222363 - protein, 8 aa, Mycobacterium
RGKSGALP

SEQ ID NO: 1222364 - protein, 13 aa, Mycobacterium
RGKTIRPKTLNQK

SEQ ID NO: 1222365 - protein, 6 aa, Mycobacterium
RGKTKV

SEQ ID NO: 1222366 - protein, 5 aa, Mycobacterium
RGLAA

SEQ ID NO: 1222367 - protein, 7 aa, Mycobacterium
RGLDTDP

SEQ ID NO: 1222368 - protein, 5 aa, Mycobacterium
RGLEH

SEQ ID NO: 1222369 - protein, 17 aa, Mycobacterium
RGLGDREGAVADAATAD

SEQ ID NO: 1222370 - protein, 6 aa, Mycobacterium
RGLGGS

SEQ ID NO: 1222371 - protein, 6 aa, Mycobacterium
RGLGRT

SEQ ID NO: 1222372 - protein, 4 aa, Mycobacterium
RGLH

SEQ ID NO: 1222373 - protein, 12 aa, Mycobacterium
RGLNRRSGPPVH

SEQ ID NO: 1222374 - protein, 10 aa, Mycobacterium
RGLPDEGEDI

SEQ ID NO: 1222375 - protein, 8 aa, Mycobacterium
RGLPPAEP

SEQ ID NO: 1222376 - protein, 10 aa, Mycobacterium
RGLPPGTQFG

SEQ ID NO: 1222377 - protein, 6 aa, Mycobacterium
RGLPRQ

SEQ ID NO: 1222378 - protein, 7 aa, Mycobacterium
RGLPRSA

SEQ ID NO: 1222379 - protein, 9 aa, Mycobacterium
RGLPRSATT

SEQ ID NO: 1222380 - protein, 11 aa, Mycobacterium
RGLQDTADSLP

SEQ ID NO: 1222381 - protein, 4 aa, Mycobacterium
RGLR

SEQ ID NO: 1222382 - protein, 10 aa, Mycobacterium
RGLRDRTDAD

SEQ ID NO: 1222383 - protein, 19 aa, Mycobacterium
RGLSAGTDTAEPAGDTDVL

SEQ ID NO: 1222384 - protein, 9 aa, Mycobacterium
RGLTPATDY

SEQ ID NO: 1222385 - protein, 8 aa, Mycobacterium
RGLTQRES

SEQ ID NO: 1222386 - protein, 7 aa, Mycobacterium
RGLTRPD

SEQ ID NO: 1222387 - protein, 5 aa, Mycobacterium
RGMGR

SEQ ID NO: 1222388 - protein, 9 aa, Mycobacterium
RGNASSPMT

SEQ ID NO: 1222389 - protein, 4 aa, Mycobacterium
RGNE

SEQ ID NO: 1222390 - protein, 7 aa, Mycobacterium
RGNGEPL

SEQ ID NO: 1222391 - protein, 5 aa, Mycobacterium
RGNPL

SEQ ID NO: 1222392 - protein, 4 aa, Mycobacterium
RGNR

SEQ ID NO: 1222393 - protein, 5 aa, Mycobacterium
RGNTL

SEQ ID NO: 1222394 - protein, 8 aa, Mycobacterium
RGPAATTL

SEQ ID NO: 1222395 - protein, 15 aa, Mycobacterium
RGPADAELARDPAGT

SEQ ID NO: 1222396 - protein, 6 aa, Mycobacterium
RGPAGM

SEQ ID NO: 1222397 - protein, 13 aa, Mycobacterium
RGPAQVPETANPV

SEQ ID NO: 1222398 - protein, 9 aa, Mycobacterium
RGPARVPDI

SEQ ID NO: 1222399 - protein, 8 aa, Mycobacterium
RGPASGEA

SEQ ID NO: 1222400 - protein, 4 aa, Mycobacterium
RGPD

SEQ ID NO: 1222401 - protein, 11 aa, Mycobacterium
RGPDEAGARSE

SEQ ID NO: 1222402 - protein, 17 aa, Mycobacterium
RGPDEPGTWADDTDDPG

SEQ ID NO: 1222403 - protein, 5 aa, Mycobacterium
RGPDH

SEQ ID NO: 1222404 - protein, 10 aa, Mycobacterium
RGPDSERFRS

SEQ ID NO: 1222405 - protein, 7 aa, Mycobacterium
RGPESFS

SEQ ID NO: 1222406 - protein, 12 aa, Mycobacterium
RGPGAGDDDGVA

SEQ ID NO: 1222407 - protein, 5 aa, Mycobacterium
RGPGQ

SEQ ID NO: 1222408 - protein, 29 aa, Mycobacterium
RGPHGGAPGAESAVTGPLRRQGTDTVNGP

SEQ ID NO: 1222409 - protein, 13 aa, Mycobacterium
RGPHRPHSAPGTV

SEQ ID NO: 1222410 - protein, 15 aa, Mycobacterium
RGPKNADEAIDEVGE

SEQ ID NO: 1222411 - protein, 5 aa, Mycobacterium
RGPLE

SEQ ID NO: 1222412 - protein, 5 aa, Mycobacterium
RGPLP

SEQ ID NO: 1222413 - protein, 9 aa, Mycobacterium
RGPLPGSRD

SEQ ID NO: 1222414 - protein, 5 aa, Mycobacterium
RGPQV

SEQ ID NO: 1222415 - protein, 5 aa, Mycobacterium
RGPRA

SEQ ID NO: 1222416 - protein, 7 aa, Mycobacterium
RGPRGQL

SEQ ID NO: 1222417 - protein, 6 aa, Mycobacterium
RGPRRK

SEQ ID NO: 1222418 - protein, 15 aa, Mycobacterium
RGPSEVERRNEQQHQ

SEQ ID NO: 1222419 - protein, 5 aa, Mycobacterium
RGPSN

SEQ ID NO: 1222420 - protein, 9 aa, Mycobacterium
RGPSPGGLR

SEQ ID NO: 1222421 - protein, 7 aa, Mycobacterium
RGPTGPV

SEQ ID NO: 1222422 - protein, 5 aa, Mycobacterium
RGPTL

SEQ ID NO: 1222423 - protein, 10 aa, Mycobacterium
RGPVASPDAV

SEQ ID NO: 1222424 - protein, 7 aa, Mycobacterium
RGPVDPL

SEQ ID NO: 1222425 - protein, 5 aa, Mycobacterium
RGPWG

SEQ ID NO: 1222426 - protein, 10 aa, Mycobacterium
RGPWGETVSG

SEQ ID NO: 1222427 - protein, 11 aa, Mycobacterium
RGPWGETVSGT

SEQ ID NO: 1222428 - protein, 4 aa, Mycobacterium
RGPY

SEQ ID NO: 1222429 - protein, 19 aa, Mycobacterium
RGQAEEAEKIGKLTDDTVK

SEQ ID NO: 1222430 - protein, 14 aa, Mycobacterium
RGQAGDRQIPGEPK

SEQ ID NO: 1222431 - protein, 14 aa, Mycobacterium
RGQAGDRQVPGQPR

SEQ ID NO: 1222432 - protein, 9 aa, Mycobacterium
RGQDAQPGD

SEQ ID NO: 1222433 - protein, 20 aa, Mycobacterium
RGQDHARGSSVGRDDTDATV

SEQ ID NO: 1222434 - protein, 13 aa, Mycobacterium
RGQDRDASADEAL

SEQ ID NO: 1222435 - protein, 6 aa, Mycobacterium
RGQGAQ

SEQ ID NO: 1222436 - protein, 13 aa, Mycobacterium
RGQGEDVVSGGYD

SEQ ID NO: 1222437 - protein, 5 aa, Mycobacterium
RGQGR

SEQ ID NO: 1222438 - protein, 7 aa, Mycobacterium
RGQGRSH

SEQ ID NO: 1222439 - protein, 7 aa, Mycobacterium
RGQHPDR

SEQ ID NO: 1222440 - protein, 6 aa, Mycobacterium
RGQNQP

SEQ ID NO: 1222441 - protein, 7 aa, Mycobacterium
RGQPAHH

SEQ ID NO: 1222442 - protein, 7 aa, Mycobacterium
RGQPLAE

SEQ ID NO: 1222443 - protein, 11 aa, Mycobacterium
RGQQDADPGRI

SEQ ID NO: 1222444 - protein, 8 aa, Mycobacterium
RGQQKGLY

SEQ ID NO: 1222445 - protein, 5 aa, Mycobacterium
RGQRV

SEQ ID NO: 1222446 - protein, 15 aa, Mycobacterium
RGQRYVPEDTYPGRI

SEQ ID NO: 1222447 - protein, 9 aa, Mycobacterium
RGRAADRPA

SEQ ID NO: 1222448 - protein, 6 aa, Mycobacterium
RGRAGR

SEQ ID NO: 1222449 - protein, 9 aa, Mycobacterium
RGRANGDDL

SEQ ID NO: 1222450 - protein, 19 aa, Mycobacterium
RGRAPVPPRKGAGRVGGQP

SEQ ID NO: 1222451 - protein, 11 aa, Mycobacterium
RGRCQESPVTA

SEQ ID NO: 1222452 - protein, 16 aa, Mycobacterium
RGRDEPFGDYGRTTSG

SEQ ID NO: 1222453 - protein, 5 aa, Mycobacterium
RGRDG

SEQ ID NO: 1222454 - protein, 6 aa, Mycobacterium
RGRDHH

SEQ ID NO: 1222455 - protein, 16 aa, Mycobacterium
RGRDSGSTSSSRAGDL

SEQ ID NO: 1222456 - protein, 6 aa, Mycobacterium
RGREQD

SEQ ID NO: 1222457 - protein, 4 aa, Mycobacterium
RGRF

SEQ ID NO: 1222458 - protein, 7 aa, Mycobacterium
RGRFPGR

SEQ ID NO: 1222459 - protein, 7 aa, Mycobacterium
RGRGGAS

SEQ ID NO: 1222460 - protein, 7 aa, Mycobacterium
RGRGGGF

SEQ ID NO: 1222461 - protein, 7 aa, Mycobacterium
RGRGGRA

SEQ ID NO: 1222462 - protein, 8 aa, Mycobacterium
RGRGTGEF

SEQ ID NO: 1222463 - protein, 7 aa, Mycobacterium
RGRGVDA

SEQ ID NO: 1222464 - protein, 6 aa, Mycobacterium
RGRHPM

SEQ ID NO: 1222465 - protein, 9 aa, Mycobacterium
RGRKGPAPV

SEQ ID NO: 1222466 - protein, 7 aa, Mycobacterium
RGRKSGK

SEQ ID NO: 1222467 - protein, 14 aa, Mycobacterium
RGRKVGKEFKPGST

SEQ ID NO: 1222468 - protein, 8 aa, Mycobacterium
RGRNQDEL

SEQ ID NO: 1222469 - protein, 8 aa, Mycobacterium
RGRPAPTH

SEQ ID NO: 1222470 - protein, 7 aa, Mycobacterium
RGRPPDP

SEQ ID NO: 1222471 - protein, 7 aa, Mycobacterium
RGRPPHT

SEQ ID NO: 1222472 - protein, 6 aa, Mycobacterium
RGRPQV

SEQ ID NO: 1222473 - protein, 8 aa, Mycobacterium
RGRPRTEA

SEQ ID NO: 1222474 - protein, 6 aa, Mycobacterium
RGRPTS

SEQ ID NO: 1222475 - protein, 14 aa, Mycobacterium
RGRQAGRDLGDDPV

SEQ ID NO: 1222476 - protein, 8 aa, Mycobacterium
RGRQPITT

SEQ ID NO: 1222477 - protein, 9 aa, Mycobacterium
RGRSEHTRR

SEQ ID NO: 1222478 - protein, 13 aa, Mycobacterium
RGRSVGHPARAVG

SEQ ID NO: 1222479 - protein, 4 aa, Mycobacterium
RGRT

SEQ ID NO: 1222480 - protein, 9 aa, Mycobacterium
RGRTDEGAT

SEQ ID NO: 1222481 - protein, 11 aa, Mycobacterium
RGRTGEGQRVD

SEQ ID NO: 1222482 - protein, 6 aa, Mycobacterium
RGRTGF

SEQ ID NO: 1222483 - protein, 17 aa, Mycobacterium
RGRTGRRPPGVGSVGAG

SEQ ID NO: 1222484 - protein, 38 aa, Mycobacterium
RGRTSGPLNTRRAGGSTRRAVAGATRRASPPRSPDGRT

SEQ ID NO: 1222485 - protein, 9 aa, Mycobacterium
RGRTSGTEY

SEQ ID NO: 1222486 - protein, 15 aa, Mycobacterium
RGRTTAGGKNYPVPG

SEQ ID NO: 1222487 - protein, 8 aa, Mycobacterium
RGRTTGRL

SEQ ID NO: 1222488 - protein, 25 aa, Mycobacterium
RGRTTTSSKTPAHANRNQAVPSEPI

SEQ ID NO: 1222489 - protein, 8 aa, Mycobacterium
RGRYGNAA

SEQ ID NO: 1222490 - protein, 7 aa, Mycobacterium
RGSADSV

SEQ ID NO: 1222491 - protein, 5 aa, Mycobacterium
RGSAP

SEQ ID NO: 1222492 - protein, 8 aa, Mycobacterium
RGSAPDYD

SEQ ID NO: 1222493 - protein, 9 aa, Mycobacterium
RGSATSKAV

SEQ ID NO: 1222494 - protein, 12 aa, Mycobacterium
RGSDADDAGIGD

SEQ ID NO: 1222495 - protein, 8 aa, Mycobacterium
RGSDGKVH

SEQ ID NO: 1222496 - protein, 8 aa, Mycobacterium
RGSDGQWR

SEQ ID NO: 1222497 - protein, 8 aa, Mycobacterium
RGSDGSTV

SEQ ID NO: 1222498 - protein, 9 aa, Mycobacterium
RGSEPRSVS

SEQ ID NO: 1222499 - protein, 25 aa, Mycobacterium
RGSETVTLSRPQDGRTATLSRTSRP

SEQ ID NO: 1222500 - protein, 8 aa, Mycobacterium
RGSGARSI

SEQ ID NO: 1222501 - protein, 6 aa, Mycobacterium
RGSGGF

SEQ ID NO: 1222502 - protein, 6 aa, Mycobacterium
RGSGPG

SEQ ID NO: 1222503 - protein, 8 aa, Mycobacterium
RGSGQDGI

SEQ ID NO: 1222504 - protein, 8 aa, Mycobacterium
RGSGTYAD

SEQ ID NO: 1222505 - protein, 11 aa, Mycobacterium
RGSHGSMPQAS

SEQ ID NO: 1222506 - protein, 5 aa, Mycobacterium
RGSHV

SEQ ID NO: 1222507 - protein, 12 aa, Mycobacterium
RGSPVRDRVDPA

SEQ ID NO: 1222508 - protein, 4 aa, Mycobacterium
RGSR

SEQ ID NO: 1222509 - protein, 7 aa, Mycobacterium
RGSRAEM

SEQ ID NO: 1222510 - protein, 6 aa, Mycobacterium
RGSRGV

SEQ ID NO: 1222511 - protein, 15 aa, Mycobacterium
RGSRTGAKVRVPGPE

SEQ ID NO: 1222512 - protein, 9 aa, Mycobacterium
RGSRTGDVA

SEQ ID NO: 1222513 - protein, 10 aa, Mycobacterium
RGSSGDADEA

SEQ ID NO: 1222514 - protein, 10 aa, Mycobacterium
RGSSGLDDFG

SEQ ID NO: 1222515 - protein, 7 aa, Mycobacterium
RGSTYTA

SEQ ID NO: 1222516 - protein, 12 aa, Mycobacterium
RGSVGRANPGAQ

SEQ ID NO: 1222517 - protein, 8 aa, Mycobacterium
RGTADPEL

SEQ ID NO: 1222518 - protein, 15 aa, Mycobacterium
RGTAGDRQVPNDPRV

SEQ ID NO: 1222519 - protein, 27 aa, Mycobacterium
RGTAGGRDEVPTASTPTSNRPRGDDSW

SEQ ID NO: 1222520 - protein, 5 aa, Mycobacterium
RGTAN

SEQ ID NO: 1222521 - protein, 10 aa, Mycobacterium
RGTARERQAR

SEQ ID NO: 1222522 - protein, 6 aa, Mycobacterium
RGTDEN

SEQ ID NO: 1222523 - protein, 5 aa, Mycobacterium
RGTEL

SEQ ID NO: 1222524 - protein, 5 aa, Mycobacterium
RGTER

SEQ ID NO: 1222525 - protein, 22 aa, Mycobacterium
RGTFGDGVPQDGSVYDASPALT

SEQ ID NO: 1222526 - protein, 9 aa, Mycobacterium
RGTGGSGGR

SEQ ID NO: 1222527 - protein, 16 aa, Mycobacterium
RGTGIDDAGWARKTAA

SEQ ID NO: 1222528 - protein, 15 aa, Mycobacterium
RGTGLGDSSEPGCPP

SEQ ID NO: 1222529 - protein, 7 aa, Mycobacterium
RGTGQWA

SEQ ID NO: 1222530 - protein, 7 aa, Mycobacterium
RGTGTDW

SEQ ID NO: 1222531 - protein, 10 aa, Mycobacterium
RGTGVTTRTR

SEQ ID NO: 1222532 - protein, 5 aa, Mycobacterium
RGTHA

SEQ ID NO: 1222533 - protein, 10 aa, Mycobacterium
RGTNRSGRYR

SEQ ID NO: 1222534 - protein, 6 aa, Mycobacterium
RGTPIT

SEQ ID NO: 1222535 - protein, 5 aa, Mycobacterium
RGTQT

SEQ ID NO: 1222536 - protein, 13 aa, Mycobacterium
RGTSRANCGKVLL

SEQ ID NO: 1222537 - protein, 17 aa, Mycobacterium
RGTTKPRTGLDGPDTEL

SEQ ID NO: 1222538 - protein, 8 aa, Mycobacterium
RGTTPDGV

SEQ ID NO: 1222539 - protein, 11 aa, Mycobacterium
RGTTQKANRIR

SEQ ID NO: 1222540 - protein, 7 aa, Mycobacterium
RGTVPCG

SEQ ID NO: 1222541 - protein, 7 aa, Mycobacterium
RGTYESD

SEQ ID NO: 1222542 - protein, 5 aa, Mycobacterium
RGVDP

SEQ ID NO: 1222543 - protein, 9 aa, Mycobacterium
RGVEAPAAR

SEQ ID NO: 1222544 - protein, 18 aa, Mycobacterium
RGVEPGYDGLGSTPPSVA

SEQ ID NO: 1222545 - protein, 6 aa, Mycobacterium
RGVETQ

SEQ ID NO: 1222546 - protein, 25 aa, Mycobacterium
RGVGDTGAVTTVDTSRGASRAARAA

SEQ ID NO: 1222547 - protein, 13 aa, Mycobacterium
RGVGQSDLPQPAK

SEQ ID NO: 1222548 - protein, 5 aa, Mycobacterium
RGVGS

SEQ ID NO: 1222549 - protein, 4 aa, Mycobacterium
RGVI

SEQ ID NO: 1222550 - protein, 10 aa, Mycobacterium
RGVPADGSGI

SEQ ID NO: 1222551 - protein, 11 aa, Mycobacterium
RGVPKRSGGHG

SEQ ID NO: 1222552 - protein, 29 aa, Mycobacterium
RGVPSPRHRPSGRRIETHAADTSTATATG

SEQ ID NO: 1222553 - protein, 7 aa, Mycobacterium
RGVPSSA

SEQ ID NO: 1222554 - protein, 10 aa, Mycobacterium
RGVPSSGSGT

SEQ ID NO: 1222555 - protein, 6 aa, Mycobacterium
RGVRRG

SEQ ID NO: 1222556 - protein, 6 aa, Mycobacterium
RGVRSG

SEQ ID NO: 1222557 - protein, 4 aa, Mycobacterium
RGVT

SEQ ID NO: 1222558 - protein, 10 aa, Mycobacterium
RGVTPQQAKD

SEQ ID NO: 1222559 - protein, 12 aa, Mycobacterium
RGWSGAASSAYS

SEQ ID NO: 1222560 - protein, 12 aa, Mycobacterium
RGWSPTDAKAAL

SEQ ID NO: 1222561 - protein, 5 aa, Mycobacterium
RGYAR

SEQ ID NO: 1222562 - protein, 11 aa, Mycobacterium
RGYDSDHPRVA

SEQ ID NO: 1222563 - protein, 11 aa, Mycobacterium
RGYQERSVQRT

SEQ ID NO: 1222564 - protein, 7 aa, Mycobacterium
RGYRPDE

SEQ ID NO: 1222565 - protein, 6 aa, Mycobacterium
RGYSRN

SEQ ID NO: 1222566 - protein, 10 aa, Mycobacterium
RGYTDEEAEG

SEQ ID NO: 1222567 - protein, 6 aa, Mycobacterium
RGYTPR

SEQ ID NO: 1222568 - protein, 37 aa, Mycobacterium
RHAAGRGAGPGATAGTGTACAGTRPGTARTLRPGRRP

SEQ ID NO: 1222569 - protein, 11 aa, Mycobacterium
RHADGPAGSRT

SEQ ID NO: 1222570 - protein, 5 aa, Mycobacterium
RHADK

SEQ ID NO: 1222571 - protein, 5 aa, Mycobacterium
RHAEA

SEQ ID NO: 1222572 - protein, 5 aa, Mycobacterium
RHAQQ

SEQ ID NO: 1222573 - protein, 19 aa, Mycobacterium
RHDDPDNAGVGGGDGSTHL

SEQ ID NO: 1222574 - protein, 4 aa, Mycobacterium
RHDE

SEQ ID NO: 1222575 - protein, 7 aa, Mycobacterium
RHDGGTP

SEQ ID NO: 1222576 - protein, 5 aa, Mycobacterium
RHDHT

SEQ ID NO: 1222577 - protein, 5 aa, Mycobacterium
RHDLN

SEQ ID NO: 1222578 - protein, 15 aa, Mycobacterium
RHDPDGVRSTKNSQV

SEQ ID NO: 1222579 - protein, 7 aa, Mycobacterium
RHDSPRQ

SEQ ID NO: 1222580 - protein, 10 aa, Mycobacterium
RHDVDPAEQR

SEQ ID NO: 1222581 - protein, 23 aa, Mycobacterium
RHEARGRATTSPIARVADLITGR

SEQ ID NO: 1222582 - protein, 8 aa, Mycobacterium
RHEPADVP

SEQ ID NO: 1222583 - protein, 22 aa, Mycobacterium
RHEPLDPREVRDGRPPEDPDGA

SEQ ID NO: 1222584 - protein, 5 aa, Mycobacterium
RHGAD

SEQ ID NO: 1222585 - protein, 6 aa, Mycobacterium
RHGAPQ

SEQ ID NO: 1222586 - protein, 30 aa, Mycobacterium
RHGDDPGSCPRRHRSRDRPARRGGRRPVES

SEQ ID NO: 1222587 - protein, 8 aa, Mycobacterium
RHGDTGRR

SEQ ID NO: 1222588 - protein, 9 aa, Mycobacterium
RHGEQAPTI

SEQ ID NO: 1222589 - protein, 4 aa, Mycobacterium
RHGG

SEQ ID NO: 1222590 - protein, 8 aa, Mycobacterium
RHGGRSIT

SEQ ID NO: 1222591 - protein, 5 aa, Mycobacterium
RHGGY

SEQ ID NO: 1222592 - protein, 6 aa, Mycobacterium
RHGGYQ

SEQ ID NO: 1222593 - protein, 14 aa, Mycobacterium
RHGPGDDPTRVGAD

SEQ ID NO: 1222594 - protein, 8 aa, Mycobacterium
RHGRPKKV

SEQ ID NO: 1222595 - protein, 8 aa, Mycobacterium
RHGRPLDT

SEQ ID NO: 1222596 - protein, 6 aa, Mycobacterium
RHGRSI

SEQ ID NO: 1222597 - protein, 14 aa, Mycobacterium
RHGSEQPVDLAAGP

SEQ ID NO: 1222598 - protein, 13 aa, Mycobacterium
RHGSVDSTDLDLY

SEQ ID NO: 1222599 - protein, 9 aa, Mycobacterium
RHGVNNTKA

SEQ ID NO: 1222600 - protein, 6 aa, Mycobacterium
RHHTER

SEQ ID NO: 1222601 - protein, 7 aa, Mycobacterium
RHHTSTR

SEQ ID NO: 1222602 - protein, 6 aa, Mycobacterium
RHHTSV

SEQ ID NO: 1222603 - protein, 18 aa, Mycobacterium
RHHTTGNEEVFGGRLRVL

SEQ ID NO: 1222604 - protein, 30 aa, Mycobacterium
RHLEPGSLARPPTQSPPAVAPYQGPPGERA

SEQ ID NO: 1222605 - protein, 30 aa, Mycobacterium
RHLEPGSLARPPTTPPPAVAPYQGPPGERA

SEQ ID NO: 1222606 - protein, 6 aa, Mycobacterium
RHLREG

SEQ ID NO: 1222607 - protein, 4 aa, Mycobacterium
RHPA

SEQ ID NO: 1222608 - protein, 6 aa, Mycobacterium
RHPAWD

SEQ ID NO: 1222609 - protein, 6 aa, Mycobacterium
RHPDEP

SEQ ID NO: 1222610 - protein, 5 aa, Mycobacterium
RHPDG

SEQ ID NO: 1222611 - protein, 9 aa, Mycobacterium
RHPDPDDRR

SEQ ID NO: 1222612 - protein, 6 aa, Mycobacterium
RHPEEP

SEQ ID NO: 1222613 - protein, 5 aa, Mycobacterium
RHPER

SEQ ID NO: 1222614 - protein, 10 aa, Mycobacterium
RHPESPTDWK

SEQ ID NO: 1222615 - protein, 12 aa, Mycobacterium
RHPFGTTLKRLL

SEQ ID NO: 1222616 - protein, 7 aa, Mycobacterium
RHPGGAG

SEQ ID NO: 1222617 - protein, 21 aa, Mycobacterium
RHPGGRDRMAKPDSDDLSQPE

SEQ ID NO: 1222618 - protein, 5 aa, Mycobacterium
RHPGR

SEQ ID NO: 1222619 - protein, 6 aa, Mycobacterium
RHPGTA

SEQ ID NO: 1222620 - protein, 17 aa, Mycobacterium
RHPSGPGSSVDDKPDHP

SEQ ID NO: 1222621 - protein, 9 aa, Mycobacterium
RHPSVGEVR

SEQ ID NO: 1222622 - protein, 6 aa, Mycobacterium
RHPYGD

SEQ ID NO: 1222623 - protein, 13 aa, Mycobacterium
RHQGAHDTSPEDR

SEQ ID NO: 1222624 - protein, 4 aa, Mycobacterium
RHRG

SEQ ID NO: 1222625 - protein, 13 aa, Mycobacterium
RHRGEEQPGPVCP

SEQ ID NO: 1222626 - protein, 6 aa, Mycobacterium
RHRGPK

SEQ ID NO: 1222627 - protein, 4 aa, Mycobacterium
RHRP

SEQ ID NO: 1222628 - protein, 8 aa, Mycobacterium
RHRPDNGL

SEQ ID NO: 1222629 - protein, 11 aa, Mycobacterium
RHRPGRRGRVR

SEQ ID NO: 1222630 - protein, 30 aa, Mycobacterium
RHRPPRRRCAPSRPRPAGTGAAARSPPPVS

SEQ ID NO: 1222631 - protein, 8 aa, Mycobacterium
RHRQPEQA

SEQ ID NO: 1222632 - protein, 13 aa, Mycobacterium
RHRQQRGAQSIAD

SEQ ID NO: 1222633 - protein, 4 aa, Mycobacterium
RHRR

SEQ ID NO: 1222634 - protein, 9 aa, Mycobacterium
RHRSTRPRT

SEQ ID NO: 1222635 - protein, 8 aa, Mycobacterium
RHRTEQVA

SEQ ID NO: 1222636 - protein, 27 aa, Mycobacterium
RHRTRRGSAVDDRTRGAGQGRDARRHA

SEQ ID NO: 1222637 - protein, 6 aa, Mycobacterium
RHSAEQ

SEQ ID NO: 1222638 - protein, 7 aa, Mycobacterium
RHSGATT

SEQ ID NO: 1222639 - protein, 7 aa, Mycobacterium
RHSGGHS

SEQ ID NO: 1222640 - protein, 8 aa, Mycobacterium
RHSGSEPA

SEQ ID NO: 1222641 - protein, 5 aa, Mycobacterium
RHSGT

SEQ ID NO: 1222642 - protein, 5 aa, Mycobacterium
RHSPC

SEQ ID NO: 1222643 - protein, 10 aa, Mycobacterium
RHSQGSPAEV

SEQ ID NO: 1222644 - protein, 13 aa, Mycobacterium
RHSRGDAEREARY

SEQ ID NO: 1222645 - protein, 6 aa, Mycobacterium
RHSRPT

SEQ ID NO: 1222646 - protein, 7 aa, Mycobacterium
RHSRRER

SEQ ID NO: 1222647 - protein, 7 aa, Mycobacterium
RHTEEAP

SEQ ID NO: 1222648 - protein, 18 aa, Mycobacterium
RHTGKDAAQIRKDTDRDK

SEQ ID NO: 1222649 - protein, 14 aa, Mycobacterium
RHTGPDSPAMRGAD

SEQ ID NO: 1222650 - protein, 10 aa, Mycobacterium
RHTGRDRKTI

SEQ ID NO: 1222651 - protein, 17 aa, Mycobacterium
RIAEETARNEGKPEQAL

SEQ ID NO: 1222652 - protein, 11 aa, Mycobacterium
RIAGEERAPVP

SEQ ID NO: 1222653 - protein, 12 aa, Mycobacterium
RIAGGDETLPYT

SEQ ID NO: 1222654 - protein, 16 aa, Mycobacterium
RIAGRPAASIEQHDGR

SEQ ID NO: 1222655 - protein, 11 aa, Mycobacterium
RIAPKDPDSVQ

SEQ ID NO: 1222656 - protein, 26 aa, Mycobacterium
RIAPTDSPTPDPAGTTPHLRVVDGRA

SEQ ID NO: 1222657 - protein, 5 aa, Mycobacterium
RIATD

SEQ ID NO: 1222658 - protein, 10 aa, Mycobacterium
RIDASDLDAA

SEQ ID NO: 1222659 - protein, 9 aa, Mycobacterium
RIDGDEVTG

SEQ ID NO: 1222660 - protein, 8 aa, Mycobacterium
RIDPAEPT

SEQ ID NO: 1222661 - protein, 6 aa, Mycobacterium
RIDPGG

SEQ ID NO: 1222662 - protein, 12 aa, Mycobacterium
RIDPGKDADGLH

SEQ ID NO: 1222663 - protein, 8 aa, Mycobacterium
RIDTDPTR

SEQ ID NO: 1222664 - protein, 9 aa, Mycobacterium
RIDTREKER

SEQ ID NO: 1222665 - protein, 6 aa, Mycobacterium
RIEAEA

SEQ ID NO: 1222666 - protein, 6 aa, Mycobacterium
RIEDAQ

SEQ ID NO: 1222667 - protein, 7 aa, Mycobacterium
RIEDGGD

SEQ ID NO: 1222668 - protein, 7 aa, Mycobacterium
RIEERTD

SEQ ID NO: 1222669 - protein, 8 aa, Mycobacterium
RIEKGTTA

SEQ ID NO: 1222670 - protein, 6 aa, Mycobacterium
RIEPET

SEQ ID NO: 1222671 - protein, 4 aa, Mycobacterium
RIER

SEQ ID NO: 1222672 - protein, 4 aa, Mycobacterium
RIGA

SEQ ID NO: 1222673 - protein, 5 aa, Mycobacterium
RIGAA

SEQ ID NO: 1222674 - protein, 8 aa, Mycobacterium
RIGAEGQG

SEQ ID NO: 1222675 - protein, 4 aa, Mycobacterium
RIGH

SEQ ID NO: 1222676 - protein, 14 aa, Mycobacterium
RIGPTNSQPHQGGN

SEQ ID NO: 1222677 - protein, 8 aa, Mycobacterium
RIGRDDDM

SEQ ID NO: 1222678 - protein, 7 aa, Mycobacterium
RIGSGHA

SEQ ID NO: 1222679 - protein, 16 aa, Mycobacterium
RIGSPYSWGGSGPNAF

SEQ ID NO: 1222680 - protein, 12 aa, Mycobacterium
RIPADGEGRMDP

SEQ ID NO: 1222681 - protein, 4 aa, Mycobacterium
RIPD

SEQ ID NO: 1222682 - protein, 5 aa, Mycobacterium
RIPDD

SEQ ID NO: 1222683 - protein, 8 aa, Mycobacterium
RIPDGTPS

SEQ ID NO: 1222684 - protein, 5 aa, Mycobacterium
RIPDR

SEQ ID NO: 1222685 - protein, 17 aa, Mycobacterium
RIPDTDHSLKAGSRGPT

SEQ ID NO: 1222686 - protein, 15 aa, Mycobacterium
RIPERQPHAKGGGAF

SEQ ID NO: 1222687 - protein, 7 aa, Mycobacterium
RIPGGDV

SEQ ID NO: 1222688 - protein, 4 aa, Mycobacterium
RIPN

SEQ ID NO: 1222689 - protein, 6 aa, Mycobacterium
RIPPDG

SEQ ID NO: 1222690 - protein, 8 aa, Mycobacterium
RIPPKGAT

SEQ ID NO: 1222691 - protein, 12 aa, Mycobacterium
RIPTGFGTEPGE

SEQ ID NO: 1222692 - protein, 12 aa, Mycobacterium
RIPTGLGTERGE

SEQ ID NO: 1222693 - protein, 6 aa, Mycobacterium
RIPTRH

SEQ ID NO: 1222694 - protein, 6 aa, Mycobacterium
RIQPSV

SEQ ID NO: 1222695 - protein, 22 aa, Mycobacterium
RIRPGRGSRPRTKTRPEHADAQ

SEQ ID NO: 1222696 - protein, 5 aa, Mycobacterium
RISGS

SEQ ID NO: 1222697 - protein, 15 aa, Mycobacterium
RISPGTREDTVKQRT

SEQ ID NO: 1222698 - protein, 16 aa, Mycobacterium
RISPGTREDTVKQRTH

SEQ ID NO: 1222699 - protein, 30 aa, Mycobacterium
RISSGTHSTWAPGADLPQWRESDSAAGAIG

SEQ ID NO: 1222700 - protein, 11 aa, Mycobacterium
RISSTPDYQPD

SEQ ID NO: 1222701 - protein, 7 aa, Mycobacterium
RISTDGR

SEQ ID NO: 1222702 - protein, 12 aa, Mycobacterium
RITDGTPRAGAP

SEQ ID NO: 1222703 - protein, 4 aa, Mycobacterium
RITP

SEQ ID NO: 1222704 - protein, 6 aa, Mycobacterium
RITRAD

SEQ ID NO: 1222705 - protein, 20 aa, Mycobacterium
RITRRDADGTRTLANRRRRH

SEQ ID NO: 1222706 - protein, 12 aa, Mycobacterium
RITSTRGKSITS

SEQ ID NO: 1222707 - protein, 5 aa, Mycobacterium
RITTT

SEQ ID NO: 1222708 - protein, 4 aa, Mycobacterium
RKAA

SEQ ID NO: 1222709 - protein, 17 aa, Mycobacterium
RKAAGDRLTDARQLGPR

SEQ ID NO: 1222710 - protein, 17 aa, Mycobacterium
RKAAGEQLTDARQLGPR

SEQ ID NO: 1222711 - protein, 21 aa, Mycobacterium
RKAAKAARAAAADAKTESDEA

SEQ ID NO: 1222712 - protein, 8 aa, Mycobacterium
RKAFGQPI

SEQ ID NO: 1222713 - protein, 7 aa, Mycobacterium
RKAFGTP

SEQ ID NO: 1222714 - protein, 18 aa, Mycobacterium
RKAGEAGGDHFGAPGAND

SEQ ID NO: 1222715 - protein, 60 aa, Mycobacterium
RKAGTKKGPTVGSGGVRRRGLEGKGATPPAHQRPHHPAGKRAAKAARQAQGRHKKTDDTE

SEQ ID NO: 1222716 - protein, 5 aa, Mycobacterium
RKAHE

SEQ ID NO: 1222717 - protein, 8 aa, Mycobacterium
RKAHGPFT

SEQ ID NO: 1222718 - protein, 8 aa, Mycobacterium
RKAKRARE

SEQ ID NO: 1222719 - protein, 8 aa, Mycobacterium
RKALAGDA

SEQ ID NO: 1222720 - protein, 4 aa, Mycobacterium
RKAP

SEQ ID NO: 1222721 - protein, 16 aa, Mycobacterium
RKAPDPDKDQGGGAAG

SEQ ID NO: 1222722 - protein, 8 aa, Mycobacterium
RKARQGRD

SEQ ID NO: 1222723 - protein, 9 aa, Mycobacterium
RKASAKFAD

SEQ ID NO: 1222724 - protein, 16 aa, Mycobacterium
RKATRGIEENSSTDIG

SEQ ID NO: 1222725 - protein, 17 aa, Mycobacterium
RKATTKLAADPSPITVD

SEQ ID NO: 1222726 - protein, 22 aa, Mycobacterium
RKDFGPLTDTPPTMEGGVDDGW

SEQ ID NO: 1222727 - protein, 4 aa, Mycobacterium
RKDG

SEQ ID NO: 1222728 - protein, 12 aa, Mycobacterium
RKDGRPQGGKAH

SEQ ID NO: 1222729 - protein, 6 aa, Mycobacterium
RKDLDG

SEQ ID NO: 1222730 - protein, 8 aa, Mycobacterium
RKDPQHPV

SEQ ID NO: 1222731 - protein, 9 aa, Mycobacterium
RKDPSTPKI

SEQ ID NO: 1222732 - protein, 5 aa, Mycobacterium
RKDPV

SEQ ID NO: 1222733 - protein, 14 aa, Mycobacterium
RKDQTCHQPSQLQN

SEQ ID NO: 1222734 - protein, 11 aa, Mycobacterium
RKEGDTGGTIS

SEQ ID NO: 1222735 - protein, 5 aa, Mycobacterium
RKEGW

SEQ ID NO: 1222736 - protein, 15 aa, Mycobacterium
RKEPDPDKEQGGGAV

SEQ ID NO: 1222737 - protein, 6 aa, Mycobacterium
RKERMS

SEQ ID NO: 1222738 - protein, 10 aa, Mycobacterium
RKESANRAEY

SEQ ID NO: 1222739 - protein, 9 aa, Mycobacterium
RKESETPGA

SEQ ID NO: 1222740 - protein, 15 aa, Mycobacterium
RKESGIDAKPEKLDK

SEQ ID NO: 1222741 - protein, 6 aa, Mycobacterium
RKGATG

SEQ ID NO: 1222742 - protein, 16 aa, Mycobacterium
RKGDADAYSLSTAEVA

SEQ ID NO: 1222743 - protein, 8 aa, Mycobacterium
RKGEAPLR

SEQ ID NO: 1222744 - protein, 16 aa, Mycobacterium
RKGGASAATIKSAAEQ

SEQ ID NO: 1222745 - protein, 9 aa, Mycobacterium
RKGPIEGSL

SEQ ID NO: 1222746 - protein, 8 aa, Mycobacterium
RKGSGQGW

SEQ ID NO: 1222747 - protein, 9 aa, Mycobacterium
RKGSGVRIS

SEQ ID NO: 1222748 - protein, 9 aa, Mycobacterium
RKGSQTERT

SEQ ID NO: 1222749 - protein, 10 aa, Mycobacterium
RKHAATNPKA

SEQ ID NO: 1222750 - protein, 18 aa, Mycobacterium
RKKDGLSGYPSRSESEHD

SEQ ID NO: 1222751 - protein, 17 aa, Mycobacterium
RKKDGLSGYPSSAESEH

SEQ ID NO: 1222752 - protein, 27 aa, Mycobacterium
RKKPKPRKRGGGGATAASGDAVTAPMQ

SEQ ID NO: 1222753 - protein, 9 aa, Mycobacterium
RKKQEERAA

SEQ ID NO: 1222754 - protein, 14 aa, Mycobacterium
RKKQRQPAEYPTEE

SEQ ID NO: 1222755 - protein, 11 aa, Mycobacterium
RKKTRTRETVR

SEQ ID NO: 1222756 - protein, 21 aa, Mycobacterium
RKLAGEPGLDGSPAPAEPMTE

SEQ ID NO: 1222757 - protein, 10 aa, Mycobacterium
RKNHEANAET

SEQ ID NO: 1222758 - protein, 8 aa, Mycobacterium
RKNIDTGM

SEQ ID NO: 1222759 - protein, 9 aa, Mycobacterium
RKNPNHDRP

SEQ ID NO: 1222760 - protein, 39 aa, Mycobacterium
RKNTRKAAKGKNKQAGKKGRKGPTPPKNRNPLGAGMPGM

SEQ ID NO: 1222761 - protein, 13 aa, Mycobacterium
RKPANLSGGQRQR

SEQ ID NO: 1222762 - protein, 9 aa, Mycobacterium
RKPDAYERA

SEQ ID NO: 1222763 - protein, 13 aa, Mycobacterium
RKPDQLSGGQRQR

SEQ ID NO: 1222764 - protein, 7 aa, Mycobacterium
RKPDVAE

SEQ ID NO: 1222765 - protein, 9 aa, Mycobacterium
RKPGESTLI

SEQ ID NO: 1222766 - protein, 12 aa, Mycobacterium
RKPGGRQGRRPS

SEQ ID NO: 1222767 - protein, 17 aa, Mycobacterium
RKPGYDGTWTGDENTDM

SEQ ID NO: 1222768 - protein, 8 aa, Mycobacterium
RKPHPDGD

SEQ ID NO: 1222769 - protein, 12 aa, Mycobacterium
RKPHWEGRDRAN

SEQ ID NO: 1222770 - protein, 13 aa, Mycobacterium
RKPKDLSGGQQQR

SEQ ID NO: 1222771 - protein, 6 aa, Mycobacterium
RKPMDE

SEQ ID NO: 1222772 - protein, 7 aa, Mycobacterium
RKPMTEE

SEQ ID NO: 1222773 - protein, 5 aa, Mycobacterium
RKPNN

SEQ ID NO: 1222774 - protein, 4 aa, Mycobacterium
RKPP

SEQ ID NO: 1222775 - protein, 7 aa, Mycobacterium
RKPPRGT

SEQ ID NO: 1222776 - protein, 6 aa, Mycobacterium
RKPPRT

SEQ ID NO: 1222777 - protein, 8 aa, Mycobacterium
RKPTEDSV

SEQ ID NO: 1222778 - protein, 11 aa, Mycobacterium
RKPTLAAGETY

SEQ ID NO: 1222779 - protein, 9 aa, Mycobacterium
RKPTPAELT

SEQ ID NO: 1222780 - protein, 5 aa, Mycobacterium
RKPTV

SEQ ID NO: 1222781 - protein, 7 aa, Mycobacterium
RKPVAEP

SEQ ID NO: 1222782 - protein, 12 aa, Mycobacterium
RKQAASASKHLT

SEQ ID NO: 1222783 - protein, 7 aa, Mycobacterium
RKQFGKS

SEQ ID NO: 1222784 - protein, 9 aa, Mycobacterium
RKQGYGTAA

SEQ ID NO: 1222785 - protein, 6 aa, Mycobacterium
RKQLRD

SEQ ID NO: 1222786 - protein, 8 aa, Mycobacterium
RKQNPAHG

SEQ ID NO: 1222787 - protein, 10 aa, Mycobacterium
RKQRATKARI

SEQ ID NO: 1222788 - protein, 8 aa, Mycobacterium
RKQRPNQC

SEQ ID NO: 1222789 - protein, 8 aa, Mycobacterium
RKRATAAE

SEQ ID NO: 1222790 - protein, 9 aa, Mycobacterium
RKRDSDGAL

SEQ ID NO: 1222791 - protein, 7 aa, Mycobacterium
RKREDDA

SEQ ID NO: 1222792 - protein, 10 aa, Mycobacterium
RKREKAATRE

SEQ ID NO: 1222793 - protein, 4 aa, Mycobacterium
RKRG

SEQ ID NO: 1222794 - protein, 10 aa, Mycobacterium
RKRGYGTATL

SEQ ID NO: 1222795 - protein, 17 aa, Mycobacterium
RKRPRGRPRKDAKEPVA

SEQ ID NO: 1222796 - protein, 8 aa, Mycobacterium
RKRREMAG

SEQ ID NO: 1222797 - protein, 6 aa, Mycobacterium
RKRSAM

SEQ ID NO: 1222798 - protein, 19 aa, Mycobacterium
RKSEDVRTSYSADVAGKSL

SEQ ID NO: 1222799 - protein, 5 aa, Mycobacterium
RKSEP

SEQ ID NO: 1222800 - protein, 4 aa, Mycobacterium
RKSG

SEQ ID NO: 1222801 - protein, 10 aa, Mycobacterium
RKSGRKWDEE

SEQ ID NO: 1222802 - protein, 9 aa, Mycobacterium
RKSKEGRDD

SEQ ID NO: 1222803 - protein, 7 aa, Mycobacterium
RKSTSGA

SEQ ID NO: 1222804 - protein, 8 aa, Mycobacterium
RKSWQDTQ

SEQ ID NO: 1222805 - protein, 8 aa, Mycobacterium
RKTAADAG

SEQ ID NO: 1222806 - protein, 8 aa, Mycobacterium
RKTAPKGA

SEQ ID NO: 1222807 - protein, 21 aa, Mycobacterium
RKTDSDAKESKIATSRRAAPR

SEQ ID NO: 1222808 - protein, 5 aa, Mycobacterium
RKTGA

SEQ ID NO: 1222809 - protein, 5 aa, Mycobacterium
RKTLE

SEQ ID NO: 1222810 - protein, 16 aa, Mycobacterium
RKTLRTNATQRPLRAP

SEQ ID NO: 1222811 - protein, 24 aa, Mycobacterium
RKTPSARHARSATTSSGGAGGSSQ

SEQ ID NO: 1222812 - protein, 11 aa, Mycobacterium
RKTSKDQAREK

SEQ ID NO: 1222813 - protein, 8 aa, Mycobacterium
RKTTDADL

SEQ ID NO: 1222814 - protein, 21 aa, Mycobacterium
RKVAGAPGLDGLPAPAEPMTE

SEQ ID NO: 1222815 - protein, 10 aa, Mycobacterium
RKVGADPEAT

SEQ ID NO: 1222816 - protein, 12 aa, Mycobacterium
RKVQPGKDPAAM

SEQ ID NO: 1222817 - protein, 8 aa, Mycobacterium
RKVRAPDG

SEQ ID NO: 1222818 - protein, 18 aa, Mycobacterium
RKVSEKQSNQLKGATTDL

SEQ ID NO: 1222819 - protein, 13 aa, Mycobacterium
RKVTPEAQEREAA

SEQ ID NO: 1222820 - protein, 6 aa, Mycobacterium
RKYGVT

SEQ ID NO: 1222821 - protein, 7 aa, Mycobacterium
RKYQGSG

SEQ ID NO: 1222822 - protein, 5 aa, Mycobacterium
RLAAN

SEQ ID NO: 1222823 - protein, 6 aa, Mycobacterium
RLAANG

SEQ ID NO: 1222824 - protein, 5 aa, Mycobacterium
RLADE

SEQ ID NO: 1222825 - protein, 6 aa, Mycobacterium
RLADEG

SEQ ID NO: 1222826 - protein, 10 aa, Mycobacterium
RLADTAPELA

SEQ ID NO: 1222827 - protein, 13 aa, Mycobacterium
RLADTGQRLQDGL

SEQ ID NO: 1222828 - protein, 9 aa, Mycobacterium
RLAEETGGH

SEQ ID NO: 1222829 - protein, 8 aa, Mycobacterium
RLAERTPL

SEQ ID NO: 1222830 - protein, 8 aa, Mycobacterium
RLAGPRDV

SEQ ID NO: 1222831 - protein, 12 aa, Mycobacterium
RLAGQGSRRDTR

SEQ ID NO: 1222832 - protein, 6 aa, Mycobacterium
RLAPGG

SEQ ID NO: 1222833 - protein, 7 aa, Mycobacterium
RLAPPEQ

SEQ ID NO: 1222834 - protein, 8 aa, Mycobacterium
RLAPPQQA

SEQ ID NO: 1222835 - protein, 9 aa, Mycobacterium
RLAPSEANT

SEQ ID NO: 1222836 - protein, 18 aa, Mycobacterium
RLAPTSTVRGWEHLRMLV

SEQ ID NO: 1222837 - protein, 11 aa, Mycobacterium
RLARDGALQAA

SEQ ID NO: 1222838 - protein, 8 aa, Mycobacterium
RLDDEDAA

SEQ ID NO: 1222839 - protein, 5 aa, Mycobacterium
RLDDS

SEQ ID NO: 1222840 - protein, 13 aa, Mycobacterium
RLDGPAVTRGRRV

SEQ ID NO: 1222841 - protein, 18 aa, Mycobacterium
RLDGPAVTRGRRVRGAPC

SEQ ID NO: 1222842 - protein, 15 aa, Mycobacterium
RLDKPGGGLSGGQQQ

SEQ ID NO: 1222843 - protein, 4 aa, Mycobacterium
RLDP

SEQ ID NO: 1222844 - protein, 5 aa, Mycobacterium
RLDPD

SEQ ID NO: 1222845 - protein, 8 aa, Mycobacterium
RLDPDRPA

SEQ ID NO: 1222846 - protein, 9 aa, Mycobacterium
RLDPEDEKA

SEQ ID NO: 1222847 - protein, 8 aa, Mycobacterium
RLDPTREF

SEQ ID NO: 1222848 - protein, 10 aa, Mycobacterium
RLDQPAPDYV

SEQ ID NO: 1222849 - protein, 6 aa, Mycobacterium
RLDTYD

SEQ ID NO: 1222850 - protein, 9 aa, Mycobacterium
RLEDGSDLD

SEQ ID NO: 1222851 - protein, 7 aa, Mycobacterium
RLEDKGV

SEQ ID NO: 1222852 - protein, 7 aa, Mycobacterium
RLEGRGA

SEQ ID NO: 1222853 - protein, 16 aa, Mycobacterium
RLENGEQVSGPAAGRY

SEQ ID NO: 1222854 - protein, 7 aa, Mycobacterium
RLEPENA

SEQ ID NO: 1222855 - protein, 17 aa, Mycobacterium
RLERGATRGDGRTGEDV

SEQ ID NO: 1222856 - protein, 7 aa, Mycobacterium
RLERGDP

SEQ ID NO: 1222857 - protein, 6 aa, Mycobacterium
RLERTT

SEQ ID NO: 1222858 - protein, 27 aa, Mycobacterium
RLESKKVSKTQAVTSNLSGSLAGKIED

SEQ ID NO: 1222859 - protein, 10 aa, Mycobacterium
RLEVPPDEAY

SEQ ID NO: 1222860 - protein, 4 aa, Mycobacterium
RLGD

SEQ ID NO: 1222861 - protein, 7 aa, Mycobacterium
RLGEDGD

SEQ ID NO: 1222862 - protein, 7 aa, Mycobacterium
RLGEYQA

SEQ ID NO: 1222863 - protein, 7 aa, Mycobacterium
RLGGDSP

SEQ ID NO: 1222864 - protein, 6 aa, Mycobacterium
RLGGPT

SEQ ID NO: 1222865 - protein, 13 aa, Mycobacterium
RLGGSDEEDHDRV

SEQ ID NO: 1222866 - protein, 6 aa, Mycobacterium
RLGNGR

SEQ ID NO: 1222867 - protein, 8 aa, Mycobacterium
RLGPSSQH

SEQ ID NO: 1222868 - protein, 7 aa, Mycobacterium
RLGPTDV

SEQ ID NO: 1222869 - protein, 4 aa, Mycobacterium
RLGQ

SEQ ID NO: 1222870 - protein, 19 aa, Mycobacterium
RLGQQTAVTGASGTGNSIP

SEQ ID NO: 1222871 - protein, 5 aa, Mycobacterium
RLGQS

SEQ ID NO: 1222872 - protein, 6 aa, Mycobacterium
RLGSSD

SEQ ID NO: 1222873 - protein, 6 aa, Mycobacterium
RLGTAS

SEQ ID NO: 1222874 - protein, 5 aa, Mycobacterium
RLGTN

SEQ ID NO: 1222875 - protein, 8 aa, Mycobacterium
RLGTTAEA

SEQ ID NO: 1222876 - protein, 8 aa, Mycobacterium
RLKDPRQA

SEQ ID NO: 1222877 - protein, 10 aa, Mycobacterium
RLNPADEDAF

SEQ ID NO: 1222878 - protein, 14 aa, Mycobacterium
RLPDGPDKALAAAQ

SEQ ID NO: 1222879 - protein, 9 aa, Mycobacterium
RLPEPRGPI

SEQ ID NO: 1222880 - protein, 21 aa, Mycobacterium
RLPGAEATREFTGSDAPGSVT

SEQ ID NO: 1222881 - protein, 6 aa, Mycobacterium
RLPGDE

SEQ ID NO: 1222882 - protein, 7 aa, Mycobacterium
RLPKAGS

SEQ ID NO: 1222883 - protein, 6 aa, Mycobacterium
RLPKGE

SEQ ID NO: 1222884 - protein, 8 aa, Mycobacterium
RLPPGSGA

SEQ ID NO: 1222885 - protein, 7 aa, Mycobacterium
RLPPGSR

SEQ ID NO: 1222886 - protein, 7 aa, Mycobacterium
RLPPGYA

SEQ ID NO: 1222887 - protein, 12 aa, Mycobacterium
RLPPSDLTPSQL

SEQ ID NO: 1222888 - protein, 7 aa, Mycobacterium
RLPRDDA

SEQ ID NO: 1222889 - protein, 12 aa, Mycobacterium
RLPRPDPPGTYR

SEQ ID NO: 1222890 - protein, 5 aa, Mycobacterium
RLPRR

SEQ ID NO: 1222891 - protein, 5 aa, Mycobacterium
RLPRS

SEQ ID NO: 1222892 - protein, 10 aa, Mycobacterium
RLPRYGRRPQ

SEQ ID NO: 1222893 - protein, 10 aa, Mycobacterium
RLPSAGSRRN

SEQ ID NO: 1222894 - protein, 5 aa, Mycobacterium
RLPSG

SEQ ID NO: 1222895 - protein, 11 aa, Mycobacterium
RLPSPNTAEAA

SEQ ID NO: 1222896 - protein, 9 aa, Mycobacterium
RLPSSQRKI

SEQ ID NO: 1222897 - protein, 8 aa, Mycobacterium
RLPTTTEW

SEQ ID NO: 1222898 - protein, 10 aa, Mycobacterium
RLPYDKPPLS

SEQ ID NO: 1222899 - protein, 7 aa, Mycobacterium
RLQAGAG

SEQ ID NO: 1222900 - protein, 9 aa, Mycobacterium
RLQARADEL

SEQ ID NO: 1222901 - protein, 17 aa, Mycobacterium
RLQDGEPNLAGTARTPV

SEQ ID NO: 1222902 - protein, 5 aa, Mycobacterium
RLQEG

SEQ ID NO: 1222903 - protein, 8 aa, Mycobacterium
RLQEPDGP

SEQ ID NO: 1222904 - protein, 13 aa, Mycobacterium
RLQGRGRLRSDGT

SEQ ID NO: 1222905 - protein, 13 aa, Mycobacterium
RLQNGEPLRNLVP

SEQ ID NO: 1222906 - protein, 6 aa, Mycobacterium
RLQPDD

SEQ ID NO: 1222907 - protein, 5 aa, Mycobacterium
RLQPE

SEQ ID NO: 1222908 - protein, 5 aa, Mycobacterium
RLQTR

SEQ ID NO: 1222909 - protein, 4 aa, Mycobacterium
RLRD

SEQ ID NO: 1222910 - protein, 6 aa, Mycobacterium
RLRDNG

SEQ ID NO: 1222911 - protein, 9 aa, Mycobacterium
RLREPGDPF

SEQ ID NO: 1222912 - protein, 7 aa, Mycobacterium
RLRGNDS

SEQ ID NO: 1222913 - protein, 9 aa, Mycobacterium
RLRNEGHRY

SEQ ID NO: 1222914 - protein, 10 aa, Mycobacterium
RLRPSDTATY

SEQ ID NO: 1222915 - protein, 10 aa, Mycobacterium
RLRRGEKVSG

SEQ ID NO: 1222916 - protein, 6 aa, Mycobacterium
RLRRNP

SEQ ID NO: 1222917 - protein, 4 aa, Mycobacterium
RLSD

SEQ ID NO: 1222918 - protein, 8 aa, Mycobacterium
RLSDGTTL

SEQ ID NO: 1222919 - protein, 11 aa, Mycobacterium
RLSDKGADEGS

SEQ ID NO: 1222920 - protein, 8 aa, Mycobacterium
RLSETGSS

SEQ ID NO: 1222921 - protein, 7 aa, Mycobacterium
RLSGARP

SEQ ID NO: 1222922 - protein, 9 aa, Mycobacterium
RLSGDEARE

SEQ ID NO: 1222923 - protein, 6 aa, Mycobacterium
RLSGRR

SEQ ID NO: 1222924 - protein, 6 aa, Mycobacterium
RLSGSG

SEQ ID NO: 1222925 - protein, 6 aa, Mycobacterium
RLSPAA

SEQ ID NO: 1222926 - protein, 15 aa, Mycobacterium
RLSPDALQRDDRLTR

SEQ ID NO: 1222927 - protein, 28 aa, Mycobacterium
RLSRSGEPDRRYSRPDPHASATRCAPSH

SEQ ID NO: 1222928 - protein, 6 aa, Mycobacterium
RLSSHS

SEQ ID NO: 1222929 - protein, 4 aa, Mycobacterium
RLTA

SEQ ID NO: 1222930 - protein, 9 aa, Mycobacterium
RLTADQKRH

SEQ ID NO: 1222931 - protein, 7 aa, Mycobacterium
RLTAETA

SEQ ID NO: 1222932 - protein, 8 aa, Mycobacterium
RLTDDVPD

SEQ ID NO: 1222933 - protein, 8 aa, Mycobacterium
RLTDEQKR

SEQ ID NO: 1222934 - protein, 5 aa, Mycobacterium
RLTDS

SEQ ID NO: 1222935 - protein, 5 aa, Mycobacterium
RLTEA

SEQ ID NO: 1222936 - protein, 7 aa, Mycobacterium
RLTETRD

SEQ ID NO: 1222937 - protein, 30 aa, Mycobacterium
RLTGGDKTMATDYDAPRRTETDDVSEDSLE

SEQ ID NO: 1222938 - protein, 17 aa, Mycobacterium
RLTGSRRWSPPGNGAKW

SEQ ID NO: 1222939 - protein, 8 aa, Mycobacterium
RLTGYRNG

SEQ ID NO: 1222940 - protein, 11 aa, Mycobacterium
RLTKDGRGART

SEQ ID NO: 1222941 - protein, 5 aa, Mycobacterium
RLTNR

SEQ ID NO: 1222942 - protein, 4 aa, Mycobacterium
RLTP

SEQ ID NO: 1222943 - protein, 9 aa, Mycobacterium
RLTPAGRER

SEQ ID NO: 1222944 - protein, 11 aa, Mycobacterium
RLTPQGAAKEV

SEQ ID NO: 1222945 - protein, 6 aa, Mycobacterium
RLTPQR

SEQ ID NO: 1222946 - protein, 10 aa, Mycobacterium
RLTPRSDSRQ

SEQ ID NO: 1222947 - protein, 9 aa, Mycobacterium
RLTRSEPVE

SEQ ID NO: 1222948 - protein, 11 aa, Mycobacterium
RLTTNEADAED

SEQ ID NO: 1222949 - protein, 5 aa, Mycobacterium
RLYAT

SEQ ID NO: 1222950 - protein, 5 aa, Mycobacterium
RMAKE

SEQ ID NO: 1222951 - protein, 23 aa, Mycobacterium
RMDSTSGADYTAAEPDPVTPRAA

SEQ ID NO: 1222952 - protein, 4 aa, Mycobacterium
RMES

SEQ ID NO: 1222953 - protein, 6 aa, Mycobacterium
RMGSRS

SEQ ID NO: 1222954 - protein, 8 aa, Mycobacterium
RMPGAEPL

SEQ ID NO: 1222955 - protein, 19 aa, Mycobacterium
RMPPRGLTQAASQYGIGPD

SEQ ID NO: 1222956 - protein, 10 aa, Mycobacterium
RMPPRPPDAH

SEQ ID NO: 1222957 - protein, 6 aa, Mycobacterium
RMPREE

SEQ ID NO: 1222958 - protein, 5 aa, Mycobacterium
RMQAE

SEQ ID NO: 1222959 - protein, 5 aa, Mycobacterium
RMQAT

SEQ ID NO: 1222960 - protein, 4 aa, Mycobacterium
RMRE

SEQ ID NO: 1222961 - protein, 8 aa, Mycobacterium
RMRGGAES

SEQ ID NO: 1222962 - protein, 5 aa, Mycobacterium
RMSAE

SEQ ID NO: 1222963 - protein, 12 aa, Mycobacterium
RNAADAAREATI

SEQ ID NO: 1222964 - protein, 15 aa, Mycobacterium
RNAADVPAKYKSEPW

SEQ ID NO: 1222965 - protein, 6 aa, Mycobacterium
RNAAGK

SEQ ID NO: 1222966 - protein, 6 aa, Mycobacterium
RNAARG

SEQ ID NO: 1222967 - protein, 10 aa, Mycobacterium
RNADATEAAE

SEQ ID NO: 1222968 - protein, 36 aa, Mycobacterium
RNADEQEDASRADGAGSAGGRSDTDAACYPQSPSGL

SEQ ID NO: 1222969 - protein, 5 aa, Mycobacterium
RNADG

SEQ ID NO: 1222970 - protein, 9 aa, Mycobacterium
RNADTGHAS

SEQ ID NO: 1222971 - protein, 6 aa, Mycobacterium
RNAEAC

SEQ ID NO: 1222972 - protein, 6 aa, Mycobacterium
RNAGGE

SEQ ID NO: 1222973 - protein, 10 aa, Mycobacterium
RNAGTRGRQR

SEQ ID NO: 1222974 - protein, 13 aa, Mycobacterium
RNAGWGRSTPTPR

SEQ ID NO: 1222975 - protein, 12 aa, Mycobacterium
RNAKKDTAFRAG

SEQ ID NO: 1222976 - protein, 6 aa, Mycobacterium
RNARDS

SEQ ID NO: 1222977 - protein, 13 aa, Mycobacterium
RNARSAKKTVKSH

SEQ ID NO: 1222978 - protein, 8 aa, Mycobacterium
RNATGITH

SEQ ID NO: 1222979 - protein, 4 aa, Mycobacterium
RNAV

SEQ ID NO: 1222980 - protein, 7 aa, Mycobacterium
RNAVSSN

SEQ ID NO: 1222981 - protein, 8 aa, Mycobacterium
RNDAREQL

SEQ ID NO: 1222982 - protein, 7 aa, Mycobacterium
RNDASSD

SEQ ID NO: 1222983 - protein, 4 aa, Mycobacterium
RNDD

SEQ ID NO: 1222984 - protein, 5 aa, Mycobacterium
RNDDT

SEQ ID NO: 1222985 - protein, 16 aa, Mycobacterium
RNDDTRGVHKAPANEI

SEQ ID NO: 1222986 - protein, 8 aa, Mycobacterium
RNDEATTI

SEQ ID NO: 1222987 - protein, 5 aa, Mycobacterium
RNDES

SEQ ID NO: 1222988 - protein, 7 aa, Mycobacterium
RNDPAFS

SEQ ID NO: 1222989 - protein, 8 aa, Mycobacterium
RNDSDEPA

SEQ ID NO: 1222990 - protein, 9 aa, Mycobacterium
RNEADLDDV

SEQ ID NO: 1222991 - protein, 13 aa, Mycobacterium
RNEALSRGADFSA

SEQ ID NO: 1222992 - protein, 7 aa, Mycobacterium
RNEEEPD

SEQ ID NO: 1222993 - protein, 12 aa, Mycobacterium
RNEGADSTHSPE

SEQ ID NO: 1222994 - protein, 9 aa, Mycobacterium
RNEPDLDDV

SEQ ID NO: 1222995 - protein, 8 aa, Mycobacterium
RNEPTGRA

SEQ ID NO: 1222996 - protein, 6 aa, Mycobacterium
RNERGM

SEQ ID NO: 1222997 - protein, 5 aa, Mycobacterium
RNFTA

SEQ ID NO: 1222998 - protein, 6 aa, Mycobacterium
RNGAAL

SEQ ID NO: 1222999 - protein, 11 aa, Mycobacterium
RNGADAIGAAR

SEQ ID NO: 1223000 - protein, 6 aa, Mycobacterium
RNGDLR

SEQ ID NO: 1223001 - protein, 7 aa, Mycobacterium
RNGESPL

SEQ ID NO: 1223002 - protein, 5 aa, Mycobacterium
RNGFQ

SEQ ID NO: 1223003 - protein, 4 aa, Mycobacterium
RNGG

SEQ ID NO: 1223004 - protein, 12 aa, Mycobacterium
RNGHNVSTRGRI

SEQ ID NO: 1223005 - protein, 8 aa, Mycobacterium
RNGNAGPT

SEQ ID NO: 1223006 - protein, 9 aa, Mycobacterium
RNGNGGPTA

SEQ ID NO: 1223007 - protein, 14 aa, Mycobacterium
RNGPGRWEDHKGRP

SEQ ID NO: 1223008 - protein, 7 aa, Mycobacterium
RNGPGYD

SEQ ID NO: 1223009 - protein, 10 aa, Mycobacterium
RNGPNPVAEV

SEQ ID NO: 1223010 - protein, 14 aa, Mycobacterium
RNGPQARSESGAPP

SEQ ID NO: 1223011 - protein, 9 aa, Mycobacterium
RNGPTSARE

SEQ ID NO: 1223012 - protein, 7 aa, Mycobacterium
RNGQEAV

SEQ ID NO: 1223013 - protein, 4 aa, Mycobacterium
RNGR

SEQ ID NO: 1223014 - protein, 8 aa, Mycobacterium
RNGSSGEL

SEQ ID NO: 1223015 - protein, 11 aa, Mycobacterium
RNGSSLYDSTI

SEQ ID NO: 1223016 - protein, 7 aa, Mycobacterium
RNGTDGG

SEQ ID NO: 1223017 - protein, 5 aa, Mycobacterium
RNGTT

SEQ ID NO: 1223018 - protein, 10 aa, Mycobacterium
RNGVDGDGVD

SEQ ID NO: 1223019 - protein, 12 aa, Mycobacterium
RNHPHPSGKPVT

SEQ ID NO: 1223020 - protein, 18 aa, Mycobacterium
RNIDPARRAYSRRAGSGC

SEQ ID NO: 1223021 - protein, 8 aa, Mycobacterium
RNKDFSQR

SEQ ID NO: 1223022 - protein, 4 aa, Mycobacterium
RNKQ

SEQ ID NO: 1223023 - protein, 6 aa, Mycobacterium
RNLRSA

SEQ ID NO: 1223024 - protein, 12 aa, Mycobacterium
RNMGNQRAASRL

SEQ ID NO: 1223025 - protein, 6 aa, Mycobacterium
RNPDGG

SEQ ID NO: 1223026 - protein, 5 aa, Mycobacterium
RNPDQ

SEQ ID NO: 1223027 - protein, 12 aa, Mycobacterium
RNPDVATAARAA

SEQ ID NO: 1223028 - protein, 8 aa, Mycobacterium
RNPESGHA

SEQ ID NO: 1223029 - protein, 8 aa, Mycobacterium
RNPETAGN

SEQ ID NO: 1223030 - protein, 7 aa, Mycobacterium
RNPGDVP

SEQ ID NO: 1223031 - protein, 6 aa, Mycobacterium
RNPGKI

SEQ ID NO: 1223032 - protein, 6 aa, Mycobacterium
RNPGVT

SEQ ID NO: 1223033 - protein, 8 aa, Mycobacterium
RNPKPAGR

SEQ ID NO: 1223034 - protein, 5 aa, Mycobacterium
RNPLP

SEQ ID NO: 1223035 - protein, 31 aa, Mycobacterium
RNPLPASPLDPPPVPAAPTADEDLSTKPAAQ

SEQ ID NO: 1223036 - protein, 4 aa, Mycobacterium
RNPP

SEQ ID NO: 1223037 - protein, 9 aa, Mycobacterium
RNPSEPGQV

SEQ ID NO: 1223038 - protein, 9 aa, Mycobacterium
RNPTTPGDL

SEQ ID NO: 1223039 - protein, 7 aa, Mycobacterium
RNPTTTK

SEQ ID NO: 1223040 - protein, 9 aa, Mycobacterium
RNQPRADRR

SEQ ID NO: 1223041 - protein, 6 aa, Mycobacterium
RNQQAH

SEQ ID NO: 1223042 - protein, 5 aa, Mycobacterium
RNRAP

SEQ ID NO: 1223043 - protein, 5 aa, Mycobacterium
RNRAV

SEQ ID NO: 1223044 - protein, 7 aa, Mycobacterium
RNRGDGV

SEQ ID NO: 1223045 - protein, 6 aa, Mycobacterium
RNRGRV

SEQ ID NO: 1223046 - protein, 5 aa, Mycobacterium
RNRHS

SEQ ID NO: 1223047 - protein, 4 aa, Mycobacterium
RNRP

SEQ ID NO: 1223048 - protein, 7 aa, Mycobacterium
RNRPGGV

SEQ ID NO: 1223049 - protein, 10 aa, Mycobacterium
RNRPNLAPHG

SEQ ID NO: 1223050 - protein, 13 aa, Mycobacterium
RNRPSGEDPTDDE

SEQ ID NO: 1223051 - protein, 5 aa, Mycobacterium
RNRQQ

SEQ ID NO: 1223052 - protein, 7 aa, Mycobacterium
RNRREAL

SEQ ID NO: 1223053 - protein, 12 aa, Mycobacterium
RNRRPDARTQLG

SEQ ID NO: 1223054 - protein, 9 aa, Mycobacterium
RNRRPYPTL

SEQ ID NO: 1223055 - protein, 7 aa, Mycobacterium
RNRSGKF

SEQ ID NO: 1223056 - protein, 24 aa, Mycobacterium
RNRSRACEELDDQAGPVVDPTGRV

SEQ ID NO: 1223057 - protein, 14 aa, Mycobacterium
RNSGGKLGPHPYPA

SEQ ID NO: 1223058 - protein, 7 aa, Mycobacterium
RNSIDEA

SEQ ID NO: 1223059 - protein, 8 aa, Mycobacterium
RNSPAGAT

SEQ ID NO: 1223060 - protein, 7 aa, Mycobacterium
RNSTTLS

SEQ ID NO: 1223061 - protein, 5 aa, Mycobacterium
RNSYM

SEQ ID NO: 1223062 - protein, 10 aa, Mycobacterium
RNTARLAGTV

SEQ ID NO: 1223063 - protein, 6 aa, Mycobacterium
RNTDAE

SEQ ID NO: 1223064 - protein, 24 aa, Mycobacterium
RNTDSDAIKSNIATKKTGRPARSA

SEQ ID NO: 1223065 - protein, 7 aa, Mycobacterium
RNTELDR

SEQ ID NO: 1223066 - protein, 12 aa, Mycobacterium
RNTETNARLADS

SEQ ID NO: 1223067 - protein, 8 aa, Mycobacterium
RNTGAGAD

SEQ ID NO: 1223068 - protein, 8 aa, Mycobacterium
RNTGGDPL

SEQ ID NO: 1223069 - protein, 14 aa, Mycobacterium
RNTGQIVSNGNNRG

SEQ ID NO: 1223070 - protein, 8 aa, Mycobacterium
RNTGRLSP

SEQ ID NO: 1223071 - protein, 5 aa, Mycobacterium
RNTPR

SEQ ID NO: 1223072 - protein, 14 aa, Mycobacterium
RNTVGSGMTGKSSG

SEQ ID NO: 1223073 - protein, 6 aa, Mycobacterium
RNTVQS

SEQ ID NO: 1223074 - protein, 5 aa, Mycobacterium
RNTVR

SEQ ID NO: 1223075 - protein, 8 aa, Mycobacterium
RNVKGPGV

SEQ ID NO: 1223076 - protein, 6 aa, Mycobacterium
RNYDRE

SEQ ID NO: 1223077 - protein, 5 aa, Mycobacterium
RPAAA

SEQ ID NO: 1223078 - protein, 5 aa, Mycobacterium
RPAAG

SEQ ID NO: 1223079 - protein, 9 aa, Mycobacterium
RPAAPAGVP

SEQ ID NO: 1223080 - protein, 15 aa, Mycobacterium
RPAAPAPLAPTGANL

SEQ ID NO: 1223081 - protein, 15 aa, Mycobacterium
RPAARSADVGGVRPL

SEQ ID NO: 1223082 - protein, 6 aa, Mycobacterium
RPADDS

SEQ ID NO: 1223083 - protein, 18 aa, Mycobacterium
RPADITPPEPAGSTETEV

SEQ ID NO: 1223084 - protein, 19 aa, Mycobacterium
RPADTDPSTHPTTDEVSEG

SEQ ID NO: 1223085 - protein, 5 aa, Mycobacterium
RPAEG

SEQ ID NO: 1223086 - protein, 6 aa, Mycobacterium
RPAETA

SEQ ID NO: 1223087 - protein, 24 aa, Mycobacterium
RPAETIAEQTSATAKRVYGLASCW

SEQ ID NO: 1223088 - protein, 17 aa, Mycobacterium
RPAGDEDTGGGAGPFPA

SEQ ID NO: 1223089 - protein, 8 aa, Mycobacterium
RPAGNTYA

SEQ ID NO: 1223090 - protein, 9 aa, Mycobacterium
RPAGPPVDK

SEQ ID NO: 1223091 - protein, 15 aa, Mycobacterium
RPAGPVSDREPGYAD

SEQ ID NO: 1223092 - protein, 7 aa, Mycobacterium
RPAGRRE

SEQ ID NO: 1223093 - protein, 13 aa, Mycobacterium
RPAGTLSGGEAQR

SEQ ID NO: 1223094 - protein, 4 aa, Mycobacterium
RPAH

SEQ ID NO: 1223095 - protein, 6 aa, Mycobacterium
RPAHPI

SEQ ID NO: 1223096 - protein, 5 aa, Mycobacterium
RPAKY

SEQ ID NO: 1223097 - protein, 15 aa, Mycobacterium
RPALQQPSWDAGQAA

SEQ ID NO: 1223098 - protein, 11 aa, Mycobacterium
RPAPADPTGTP

SEQ ID NO: 1223099 - protein, 8 aa, Mycobacterium
RPAPAPPE

SEQ ID NO: 1223100 - protein, 5 aa, Mycobacterium
RPAPD

SEQ ID NO: 1223101 - protein, 5 aa, Mycobacterium
RPAPE

SEQ ID NO: 1223102 - protein, 8 aa, Mycobacterium
RPAPGKGG

SEQ ID NO: 1223103 - protein, 8 aa, Mycobacterium
RPAPGYPA

SEQ ID NO: 1223104 - protein, 10 aa, Mycobacterium
RPAPLAETPY

SEQ ID NO: 1223105 - protein, 12 aa, Mycobacterium
RPAPSARGQQHN

SEQ ID NO: 1223106 - protein, 8 aa, Mycobacterium
RPAQGPPI

SEQ ID NO: 1223107 - protein, 26 aa, Mycobacterium
RPARKLSPPRRRPATEVTYREKFGTA

SEQ ID NO: 1223108 - protein, 26 aa, Mycobacterium
RPARRPNNNHQPRSTDTGHTAGEGSG

SEQ ID NO: 1223109 - protein, 12 aa, Mycobacterium
RPARTSPTHQPI

SEQ ID NO: 1223110 - protein, 6 aa, Mycobacterium
RPASGL

SEQ ID NO: 1223111 - protein, 9 aa, Mycobacterium
RPASGPGIA

SEQ ID NO: 1223112 - protein, 5 aa, Mycobacterium
RPASK

SEQ ID NO: 1223113 - protein, 12 aa, Mycobacterium
RPASLDSDESDI

SEQ ID NO: 1223114 - protein, 22 aa, Mycobacterium
RPASTNQTNRENDNFPLTDYVF

SEQ ID NO: 1223115 - protein, 8 aa, Mycobacterium
RPATDPQR

SEQ ID NO: 1223116 - protein, 6 aa, Mycobacterium
RPATGD

SEQ ID NO: 1223117 - protein, 8 aa, Mycobacterium
RPAVDGNV

SEQ ID NO: 1223118 - protein, 6 aa, Mycobacterium
RPAYED

SEQ ID NO: 1223119 - protein, 20 aa, Mycobacterium
RPCPPPSTVAGDDPRIPPGV

SEQ ID NO: 1223120 - protein, 8 aa, Mycobacterium
RPDAEGRY

SEQ ID NO: 1223121 - protein, 5 aa, Mycobacterium
RPDAG

SEQ ID NO: 1223122 - protein, 13 aa, Mycobacterium
RPDALDPDTGERY

SEQ ID NO: 1223123 - protein, 10 aa, Mycobacterium
RPDARNSLNK

SEQ ID NO: 1223124 - protein, 5 aa, Mycobacterium
RPDDI

SEQ ID NO: 1223125 - protein, 8 aa, Mycobacterium
RPDDPARL

SEQ ID NO: 1223126 - protein, 5 aa, Mycobacterium
RPDDV

SEQ ID NO: 1223127 - protein, 4 aa, Mycobacterium
RPDE

SEQ ID NO: 1223128 - protein, 8 aa, Mycobacterium
RPDESPRE

SEQ ID NO: 1223129 - protein, 24 aa, Mycobacterium
RPDEVAATLPGDELTEPGGTRTTR

SEQ ID NO: 1223130 - protein, 15 aa, Mycobacterium
RPDGAHPLPQPAPAA

SEQ ID NO: 1223131 - protein, 6 aa, Mycobacterium
RPDGIP

SEQ ID NO: 1223132 - protein, 9 aa, Mycobacterium
RPDGKTQVT

SEQ ID NO: 1223133 - protein, 10 aa, Mycobacterium
RPDGLGSNHN

SEQ ID NO: 1223134 - protein, 12 aa, Mycobacterium
RPDGREAYTRGH

SEQ ID NO: 1223135 - protein, 7 aa, Mycobacterium
RPDGSGD

SEQ ID NO: 1223136 - protein, 9 aa, Mycobacterium
RPDGSSPEL

SEQ ID NO: 1223137 - protein, 7 aa, Mycobacterium
RPDGTPS

SEQ ID NO: 1223138 - protein, 6 aa, Mycobacterium
RPDGVS

SEQ ID NO: 1223139 - protein, 8 aa, Mycobacterium
RPDGWTGE

SEQ ID NO: 1223140 - protein, 8 aa, Mycobacterium
RPDHTVGA

SEQ ID NO: 1223141 - protein, 9 aa, Mycobacterium
RPDKEHPLS

SEQ ID NO: 1223142 - protein, 5 aa, Mycobacterium
RPDKL

SEQ ID NO: 1223143 - protein, 5 aa, Mycobacterium
RPDLA

SEQ ID NO: 1223144 - protein, 13 aa, Mycobacterium
RPDLAPFAGTDRR

SEQ ID NO: 1223145 - protein, 12 aa, Mycobacterium
RPDLDRPPTRAE

SEQ ID NO: 1223146 - protein, 15 aa, Mycobacterium
RPDLPERSVDQPGDP

SEQ ID NO: 1223147 - protein, 4 aa, Mycobacterium
RPDP

SEQ ID NO: 1223148 - protein, 8 aa, Mycobacterium
RPDPATPL

SEQ ID NO: 1223149 - protein, 10 aa, Mycobacterium
RPDPDTGAPH

SEQ ID NO: 1223150 - protein, 9 aa, Mycobacterium
RPDPRWPDG

SEQ ID NO: 1223151 - protein, 9 aa, Mycobacterium
RPDPTGVTP

SEQ ID NO: 1223152 - protein, 7 aa, Mycobacterium
RPDPTSF

SEQ ID NO: 1223153 - protein, 8 aa, Mycobacterium
RPDQKPLD

SEQ ID NO: 1223154 - protein, 6 aa, Mycobacterium
RPDQLS

SEQ ID NO: 1223155 - protein, 5 aa, Mycobacterium
RPDQP

SEQ ID NO: 1223156 - protein, 11 aa, Mycobacterium
RPDRAESVANP

SEQ ID NO: 1223157 - protein, 7 aa, Mycobacterium
RPDRDPL

SEQ ID NO: 1223158 - protein, 10 aa, Mycobacterium
RPDRDPRSCT

SEQ ID NO: 1223159 - protein, 19 aa, Mycobacterium
RPDRGYGRTRPVGSFPPNR

SEQ ID NO: 1223160 - protein, 5 aa, Mycobacterium
RPDRH

SEQ ID NO: 1223161 - protein, 8 aa, Mycobacterium
RPDRPNRG

SEQ ID NO: 1223162 - protein, 8 aa, Mycobacterium
RPDRRGRG

SEQ ID NO: 1223163 - protein, 9 aa, Mycobacterium
RPDRRNAYT

SEQ ID NO: 1223164 - protein, 7 aa, Mycobacterium
RPDSVPE

SEQ ID NO: 1223165 - protein, 10 aa, Mycobacterium
RPDTTKTTVT

SEQ ID NO: 1223166 - protein, 5 aa, Mycobacterium
RPDTY

SEQ ID NO: 1223167 - protein, 4 aa, Mycobacterium
RPDV

SEQ ID NO: 1223168 - protein, 5 aa, Mycobacterium
RPDVP

SEQ ID NO: 1223169 - protein, 5 aa, Mycobacterium
RPDVY

SEQ ID NO: 1223170 - protein, 6 aa, Mycobacterium
RPDYTR

SEQ ID NO: 1223171 - protein, 5 aa, Mycobacterium
RPEAA

SEQ ID NO: 1223172 - protein, 12 aa, Mycobacterium
RPEAANAQNPEL

SEQ ID NO: 1223173 - protein, 14 aa, Mycobacterium
RPEAANAVRPDDRD

SEQ ID NO: 1223174 - protein, 17 aa, Mycobacterium
RPEARNAVNGAVSTAVG

SEQ ID NO: 1223175 - protein, 4 aa, Mycobacterium
RPED

SEQ ID NO: 1223176 - protein, 5 aa, Mycobacterium
RPEDI

SEQ ID NO: 1223177 - protein, 9 aa, Mycobacterium
RPEDTATAL

SEQ ID NO: 1223178 - protein, 5 aa, Mycobacterium
RPEEL

SEQ ID NO: 1223179 - protein, 5 aa, Mycobacterium
RPEEN

SEQ ID NO: 1223180 - protein, 7 aa, Mycobacterium
RPEEVAA

SEQ ID NO: 1223181 - protein, 4 aa, Mycobacterium
RPEG

SEQ ID NO: 1223182 - protein, 10 aa, Mycobacterium
RPEGEVAGDS

SEQ ID NO: 1223183 - protein, 16 aa, Mycobacterium
RPEGGWSPNIYGGREN

SEQ ID NO: 1223184 - protein, 14 aa, Mycobacterium
RPEGNANPEIATGE

SEQ ID NO: 1223185 - protein, 7 aa, Mycobacterium
RPEGSTR

SEQ ID NO: 1223186 - protein, 15 aa, Mycobacterium
RPEHQRRHSARQRAE

SEQ ID NO: 1223187 - protein, 8 aa, Mycobacterium
RPELGGNA

SEQ ID NO: 1223188 - protein, 7 aa, Mycobacterium
RPEPEHH

SEQ ID NO: 1223189 - protein, 7 aa, Mycobacterium
RPEPGQT

SEQ ID NO: 1223190 - protein, 5 aa, Mycobacterium
RPEPP

SEQ ID NO: 1223191 - protein, 4 aa, Mycobacterium
RPEQ

SEQ ID NO: 1223192 - protein, 14 aa, Mycobacterium
RPEQTAETFRPDGL

SEQ ID NO: 1223193 - protein, 13 aa, Mycobacterium
RPERAPEFAKRRP

SEQ ID NO: 1223194 - protein, 5 aa, Mycobacterium
RPERH

SEQ ID NO: 1223195 - protein, 7 aa, Mycobacterium
RPERPSR

SEQ ID NO: 1223196 - protein, 7 aa, Mycobacterium
RPERRGE

SEQ ID NO: 1223197 - protein, 7 aa, Mycobacterium
RPERRNA

SEQ ID NO: 1223198 - protein, 6 aa, Mycobacterium
RPETDA

SEQ ID NO: 1223199 - protein, 8 aa, Mycobacterium
RPETVASQ

SEQ ID NO: 1223200 - protein, 11 aa, Mycobacterium
RPEVANAQNTE

SEQ ID NO: 1223201 - protein, 11 aa, Mycobacterium
RPEVRGDTFGT

SEQ ID NO: 1223202 - protein, 7 aa, Mycobacterium
RPEVVPG

SEQ ID NO: 1223203 - protein, 9 aa, Mycobacterium
RPEYPPAGP

SEQ ID NO: 1223204 - protein, 18 aa, Mycobacterium
RPEYVGTGDAERQTPQRH

SEQ ID NO: 1223205 - protein, 5 aa, Mycobacterium
RPFGK

SEQ ID NO: 1223206 - protein, 8 aa, Mycobacterium
RPFPDGRY

SEQ ID NO: 1223207 - protein, 7 aa, Mycobacterium
RPFTPED

SEQ ID NO: 1223208 - protein, 8 aa, Mycobacterium
RPFTPPPT

SEQ ID NO: 1223209 - protein, 6 aa, Mycobacterium
RPGAAS

SEQ ID NO: 1223210 - protein, 12 aa, Mycobacterium
RPGAGDPLPPVR

SEQ ID NO: 1223211 - protein, 8 aa, Mycobacterium
RPGAHDNP

SEQ ID NO: 1223212 - protein, 6 aa, Mycobacterium
RPGAPV

SEQ ID NO: 1223213 - protein, 9 aa, Mycobacterium
RPGAQTGVD

SEQ ID NO: 1223214 - protein, 6 aa, Mycobacterium
RPGAVK

SEQ ID NO: 1223215 - protein, 5 aa, Mycobacterium
RPGDK

SEQ ID NO: 1223216 - protein, 9 aa, Mycobacterium
RPGDLSPGD

SEQ ID NO: 1223217 - protein, 5 aa, Mycobacterium
RPGDP

SEQ ID NO: 1223218 - protein, 7 aa, Mycobacterium
RPGDPED

SEQ ID NO: 1223219 - protein, 6 aa, Mycobacterium
RPGDPF

SEQ ID NO: 1223220 - protein, 11 aa, Mycobacterium
RPGDRLPTERE

SEQ ID NO: 1223221 - protein, 7 aa, Mycobacterium
RPGEAAR

SEQ ID NO: 1223222 - protein, 12 aa, Mycobacterium
RPGEAPPFQRGG

SEQ ID NO: 1223223 - protein, 11 aa, Mycobacterium
RPGELSPTLPV

SEQ ID NO: 1223224 - protein, 6 aa, Mycobacterium
RPGEPA

SEQ ID NO: 1223225 - protein, 16 aa, Mycobacterium
RPGEPSWPSPFGPGRP

SEQ ID NO: 1223226 - protein, 9 aa, Mycobacterium
RPGEPVAAG

SEQ ID NO: 1223227 - protein, 7 aa, Mycobacterium
RPGERTE

SEQ ID NO: 1223228 - protein, 18 aa, Mycobacterium
RPGESDGSCGGGAPSAGT

SEQ ID NO: 1223229 - protein, 7 aa, Mycobacterium
RPGFHPD

SEQ ID NO: 1223230 - protein, 9 aa, Mycobacterium
RPGGDGPAL

SEQ ID NO: 1223231 - protein, 14 aa, Mycobacterium
RPGGGAKMARSAGA

SEQ ID NO: 1223232 - protein, 10 aa, Mycobacterium
RPGGGRGGGV

SEQ ID NO: 1223233 - protein, 11 aa, Mycobacterium
RPGGPAFRPSE

SEQ ID NO: 1223234 - protein, 16 aa, Mycobacterium
RPGGWQQADQPDAADA

SEQ ID NO: 1223235 - protein, 5 aa, Mycobacterium
RPGHG

SEQ ID NO: 1223236 - protein, 14 aa, Mycobacterium
RPGHRRQRHAGRSV

SEQ ID NO: 1223237 - protein, 12 aa, Mycobacterium
RPGIGSSTPHEY

SEQ ID NO: 1223238 - protein, 8 aa, Mycobacterium
RPGKTPVE

SEQ ID NO: 1223239 - protein, 4 aa, Mycobacterium
RPGL

SEQ ID NO: 1223240 - protein, 8 aa, Mycobacterium
RPGLAPAQ

SEQ ID NO: 1223241 - protein, 22 aa, Mycobacterium
RPGLPGDWPAGYDDPDQPYTPA

SEQ ID NO: 1223242 - protein, 5 aa, Mycobacterium
RPGLS

SEQ ID NO: 1223243 - protein, 5 aa, Mycobacterium
RPGLT

SEQ ID NO: 1223244 - protein, 5 aa, Mycobacterium
RPGLV

SEQ ID NO: 1223245 - protein, 7 aa, Mycobacterium
RPGMGKS

SEQ ID NO: 1223246 - protein, 6 aa, Mycobacterium
RPGPDA

SEQ ID NO: 1223247 - protein, 10 aa, Mycobacterium
RPGPITSAAD

SEQ ID NO: 1223248 - protein, 10 aa, Mycobacterium
RPGPLTAPAG

SEQ ID NO: 1223249 - protein, 7 aa, Mycobacterium
RPGPMAT

SEQ ID NO: 1223250 - protein, 14 aa, Mycobacterium
RPGPPPKCTGADRT

SEQ ID NO: 1223251 - protein, 16 aa, Mycobacterium
RPGQRQRLREDQRKRL

SEQ ID NO: 1223252 - protein, 10 aa, Mycobacterium
RPGQRRVPGR

SEQ ID NO: 1223253 - protein, 6 aa, Mycobacterium
RPGQTP

SEQ ID NO: 1223254 - protein, 7 aa, Mycobacterium
RPGRAPL

SEQ ID NO: 1223255 - protein, 7 aa, Mycobacterium
RPGRKAA

SEQ ID NO: 1223256 - protein, 15 aa, Mycobacterium
RPGRPVGANSDQTRR

SEQ ID NO: 1223257 - protein, 19 aa, Mycobacterium
RPGRQRRRAAARPAGPPSQ

SEQ ID NO: 1223258 - protein, 19 aa, Mycobacterium
RPGSGPMSLTGQPNAMGGR

SEQ ID NO: 1223259 - protein, 7 aa, Mycobacterium
RPGSSPA

SEQ ID NO: 1223260 - protein, 5 aa, Mycobacterium
RPGTD

SEQ ID NO: 1223261 - protein, 13 aa, Mycobacterium
RPGTGLSDPHPYD

SEQ ID NO: 1223262 - protein, 15 aa, Mycobacterium
RPGTPASHRGKGWEP

SEQ ID NO: 1223263 - protein, 10 aa, Mycobacterium
RPGTSGDPRF

SEQ ID NO: 1223264 - protein, 20 aa, Mycobacterium
RPGVGDDTRQWGPPYDSSGV

SEQ ID NO: 1223265 - protein, 8 aa, Mycobacterium
RPGVPDDV

SEQ ID NO: 1223266 - protein, 9 aa, Mycobacterium
RPGVRENTV

SEQ ID NO: 1223267 - protein, 7 aa, Mycobacterium
RPGYGTS

SEQ ID NO: 1223268 - protein, 10 aa, Mycobacterium
RPHAPKGAEW

SEQ ID NO: 1223269 - protein, 9 aa, Mycobacterium
RPHAPTGAD

SEQ ID NO: 1223270 - protein, 6 aa, Mycobacterium
RPHEDT

SEQ ID NO: 1223271 - protein, 4 aa, Mycobacterium
RPHI

SEQ ID NO: 1223272 - protein, 7 aa, Mycobacterium
RPHLRQD

SEQ ID NO: 1223273 - protein, 8 aa, Mycobacterium
RPHQPPFD

SEQ ID NO: 1223274 - protein, 6 aa, Mycobacterium
RPHRRD

SEQ ID NO: 1223275 - protein, 7 aa, Mycobacterium
RPHSDGA

SEQ ID NO: 1223276 - protein, 5 aa, Mycobacterium
RPHSV

SEQ ID NO: 1223277 - protein, 5 aa, Mycobacterium
RPHTE

SEQ ID NO: 1223278 - protein, 4 aa, Mycobacterium
RPIA

SEQ ID NO: 1223279 - protein, 6 aa, Mycobacterium
RPIDAG

SEQ ID NO: 1223280 - protein, 8 aa, Mycobacterium
RPIPDSGD

SEQ ID NO: 1223281 - protein, 13 aa, Mycobacterium
RPIRGHDDTARQA

SEQ ID NO: 1223282 - protein, 8 aa, Mycobacterium
RPKADDRA

SEQ ID NO: 1223283 - protein, 7 aa, Mycobacterium
RPKAGIG

SEQ ID NO: 1223284 - protein, 11 aa, Mycobacterium
RPKDYSEARTI

SEQ ID NO: 1223285 - protein, 10 aa, Mycobacterium
RPKGADKDVK

SEQ ID NO: 1223286 - protein, 12 aa, Mycobacterium
RPKGDEGGGNAV

SEQ ID NO: 1223287 - protein, 9 aa, Mycobacterium
RPKGSDREA

SEQ ID NO: 1223288 - protein, 14 aa, Mycobacterium
RPKIEASTIEPAYD

SEQ ID NO: 1223289 - protein, 8 aa, Mycobacterium
RPKPVSGT

SEQ ID NO: 1223290 - protein, 7 aa, Mycobacterium
RPKQDRR

SEQ ID NO: 1223291 - protein, 10 aa, Mycobacterium
RPKQRNAQNR

SEQ ID NO: 1223292 - protein, 10 aa, Mycobacterium
RPKRGTTPRE

SEQ ID NO: 1223293 - protein, 10 aa, Mycobacterium
RPKRSATQAM

SEQ ID NO: 1223294 - protein, 8 aa, Mycobacterium
RPKSTADQ

SEQ ID NO: 1223295 - protein, 13 aa, Mycobacterium
RPKVTTAGATPAE

SEQ ID NO: 1223296 - protein, 4 aa, Mycobacterium
RPLG

SEQ ID NO: 1223297 - protein, 8 aa, Mycobacterium
RPLGRKRA

SEQ ID NO: 1223298 - protein, 5 aa, Mycobacterium
RPLGT

SEQ ID NO: 1223299 - protein, 13 aa, Mycobacterium
RPLGTGRSTRTIN

SEQ ID NO: 1223300 - protein, 6 aa, Mycobacterium
RPLPGR

SEQ ID NO: 1223301 - protein, 12 aa, Mycobacterium
RPLPHPRTARPT

SEQ ID NO: 1223302 - protein, 13 aa, Mycobacterium
RPLPPEAGDTDPL

SEQ ID NO: 1223303 - protein, 5 aa, Mycobacterium
RPLPR

SEQ ID NO: 1223304 - protein, 16 aa, Mycobacterium
RPLQPLDQTTARGQYA

SEQ ID NO: 1223305 - protein, 24 aa, Mycobacterium
RPLRDDAGKARRSAVRDEVIARRS

SEQ ID NO: 1223306 - protein, 11 aa, Mycobacterium
RPLRGEPGGDR

SEQ ID NO: 1223307 - protein, 11 aa, Mycobacterium
RPLRSSRSRID

SEQ ID NO: 1223308 - protein, 10 aa, Mycobacterium
RPLSTEPGPI

SEQ ID NO: 1223309 - protein, 12 aa, Mycobacterium
RPLTGAADAVDR

SEQ ID NO: 1223310 - protein, 8 aa, Mycobacterium
RPLTGDQS

SEQ ID NO: 1223311 - protein, 17 aa, Mycobacterium
RPLTTPDTPGGPPPNLP

SEQ ID NO: 1223312 - protein, 7 aa, Mycobacterium
RPMPEDL

SEQ ID NO: 1223313 - protein, 6 aa, Mycobacterium
RPNADG

SEQ ID NO: 1223314 - protein, 10 aa, Mycobacterium
RPNDTPAAAH

SEQ ID NO: 1223315 - protein, 5 aa, Mycobacterium
RPNEM

SEQ ID NO: 1223316 - protein, 16 aa, Mycobacterium
RPNEPARMAFCSELHR

SEQ ID NO: 1223317 - protein, 22 aa, Mycobacterium
RPNGDRDRAGADSATTADAVNP

SEQ ID NO: 1223318 - protein, 8 aa, Mycobacterium
RPNHPEDW

SEQ ID NO: 1223319 - protein, 5 aa, Mycobacterium
RPNPE

SEQ ID NO: 1223320 - protein, 14 aa, Mycobacterium
RPNPQFQPTRHANR

SEQ ID NO: 1223321 - protein, 4 aa, Mycobacterium
RPNR

SEQ ID NO: 1223322 - protein, 8 aa, Mycobacterium
RPNRETIE

SEQ ID NO: 1223323 - protein, 7 aa, Mycobacterium
RPNRPGW

SEQ ID NO: 1223324 - protein, 6 aa, Mycobacterium
RPNSLN

SEQ ID NO: 1223325 - protein, 6 aa, Mycobacterium
RPNSRM

SEQ ID NO: 1223326 - protein, 6 aa, Mycobacterium
RPNSST

SEQ ID NO: 1223327 - protein, 5 aa, Mycobacterium
RPNTG

SEQ ID NO: 1223328 - protein, 8 aa, Mycobacterium
RPNTGQHH

SEQ ID NO: 1223329 - protein, 6 aa, Mycobacterium
RPPAEI

SEQ ID NO: 1223330 - protein, 7 aa, Mycobacterium
RPPAEVN

SEQ ID NO: 1223331 - protein, 7 aa, Mycobacterium
RPPATRT

SEQ ID NO: 1223332 - protein, 15 aa, Mycobacterium
RPPAVQAPEGTPGRL

SEQ ID NO: 1223333 - protein, 4 aa, Mycobacterium
RPPD

SEQ ID NO: 1223334 - protein, 56 aa, Mycobacterium
RPPDDPEPPGDNTIAAEAASAGTDQADPRGDAESDAPQPTDDPGEPGGPAPPGDQA

SEQ ID NO: 1223335 - protein, 52 aa, Mycobacterium
RPPDDPESPSQDHNASIEPADDGKVGDAESGPPRSADDTGEPGGPAPPGNRA

SEQ ID NO: 1223336 - protein, 5 aa, Mycobacterium
RPPDL

SEQ ID NO: 1223337 - protein, 9 aa, Mycobacterium
RPPDQPGPG

SEQ ID NO: 1223338 - protein, 53 aa, Mycobacterium
RPPEEPDPHSDNDTAASAKPAEGNEIGDAQPGAPQPADNPSEPGGPAPPDNQA

SEQ ID NO: 1223339 - protein, 53 aa, Mycobacterium
RPPEEPEPHSDNDIAATAKPAEGNEIGDAQPGAPHPADNPGEPGGPAPPDNQA

SEQ ID NO: 1223340 - protein, 9 aa, Mycobacterium
RPPGAAQGE

SEQ ID NO: 1223341 - protein, 6 aa, Mycobacterium
RPPGLP

SEQ ID NO: 1223342 - protein, 7 aa, Mycobacterium
RPPGPLE

SEQ ID NO: 1223343 - protein, 7 aa, Mycobacterium
RPPGSDR

SEQ ID NO: 1223344 - protein, 10 aa, Mycobacterium
RPPGTSDNRD

SEQ ID NO: 1223345 - protein, 10 aa, Mycobacterium
RPPGTSDTRD

SEQ ID NO: 1223346 - protein, 8 aa, Mycobacterium
RPPIEPGG

SEQ ID NO: 1223347 - protein, 7 aa, Mycobacterium
RPPNHEY

SEQ ID NO: 1223348 - protein, 6 aa, Mycobacterium
RPPPGV

SEQ ID NO: 1223349 - protein, 4 aa, Mycobacterium
RPPQ

SEQ ID NO: 1223350 - protein, 5 aa, Mycobacterium
RPPQV

SEQ ID NO: 1223351 - protein, 10 aa, Mycobacterium
RPPRAPADRH

SEQ ID NO: 1223352 - protein, 17 aa, Mycobacterium
RPPRTRSGGPLPRTGDA

SEQ ID NO: 1223353 - protein, 7 aa, Mycobacterium
RPPSAAA

SEQ ID NO: 1223354 - protein, 7 aa, Mycobacterium
RPPSADP

SEQ ID NO: 1223355 - protein, 11 aa, Mycobacterium
RPPSDEAAPPT

SEQ ID NO: 1223356 - protein, 6 aa, Mycobacterium
RPPSHT

SEQ ID NO: 1223357 - protein, 9 aa, Mycobacterium
RPPTDGEPY

SEQ ID NO: 1223358 - protein, 5 aa, Mycobacterium
RPPVA

SEQ ID NO: 1223359 - protein, 10 aa, Mycobacterium
RPPVQAPTEA

SEQ ID NO: 1223360 - protein, 8 aa, Mycobacterium
RPPVRTPE

SEQ ID NO: 1223361 - protein, 5 aa, Mycobacterium
RPPVT

SEQ ID NO: 1223362 - protein, 9 aa, Mycobacterium
RPPVTSRKP

SEQ ID NO: 1223363 - protein, 4 aa, Mycobacterium
RPPY

SEQ ID NO: 1223364 - protein, 4 aa, Mycobacterium
RPQA

SEQ ID NO: 1223365 - protein, 14 aa, Mycobacterium
RPQAELDESSRAAA

SEQ ID NO: 1223366 - protein, 8 aa, Mycobacterium
RPQDAAAS

SEQ ID NO: 1223367 - protein, 6 aa, Mycobacterium
RPQDGA

SEQ ID NO: 1223368 - protein, 8 aa, Mycobacterium
RPQGATHV

SEQ ID NO: 1223369 - protein, 4 aa, Mycobacterium
RPQL

SEQ ID NO: 1223370 - protein, 10 aa, Mycobacterium
RPQLGDPETI

SEQ ID NO: 1223371 - protein, 4 aa, Mycobacterium
RPQP

SEQ ID NO: 1223372 - protein, 10 aa, Mycobacterium
RPQPAGRDWP

SEQ ID NO: 1223373 - protein, 6 aa, Mycobacterium
RPQPGI

SEQ ID NO: 1223374 - protein, 7 aa, Mycobacterium
RPQPGVA

SEQ ID NO: 1223375 - protein, 10 aa, Mycobacterium
RPQPTPGPGQ

SEQ ID NO: 1223376 - protein, 4 aa, Mycobacterium
RPQQ

SEQ ID NO: 1223377 - protein, 5 aa, Mycobacterium
RPQVT

SEQ ID NO: 1223378 - protein, 4 aa, Mycobacterium
RPRA

SEQ ID NO: 1223379 - protein, 11 aa, Mycobacterium
RPRDALRASRA

SEQ ID NO: 1223380 - protein, 9 aa, Mycobacterium
RPRDELARD

SEQ ID NO: 1223381 - protein, 8 aa, Mycobacterium
RPRDETSI

SEQ ID NO: 1223382 - protein, 11 aa, Mycobacterium
RPRNPEHGDYA

SEQ ID NO: 1223383 - protein, 7 aa, Mycobacterium
RPRPTRS

SEQ ID NO: 1223384 - protein, 10 aa, Mycobacterium
RPRPVNPRRE

SEQ ID NO: 1223385 - protein, 5 aa, Mycobacterium
RPRRA

SEQ ID NO: 1223386 - protein, 8 aa, Mycobacterium
RPRREGAP

SEQ ID NO: 1223387 - protein, 8 aa, Mycobacterium
RPRRGAAA

SEQ ID NO: 1223388 - protein, 16 aa, Mycobacterium
RPRRPAGCTAADYGDV

SEQ ID NO: 1223389 - protein, 10 aa, Mycobacterium
RPRRSATSAR

SEQ ID NO: 1223390 - protein, 6 aa, Mycobacterium
RPRRYS

SEQ ID NO: 1223391 - protein, 9 aa, Mycobacterium
RPRSEAARS

SEQ ID NO: 1223392 - protein, 5 aa, Mycobacterium
RPRSV

SEQ ID NO: 1223393 - protein, 4 aa, Mycobacterium
RPRT

SEQ ID NO: 1223394 - protein, 11 aa, Mycobacterium
RPRTAEGLAEP

SEQ ID NO: 1223395 - protein, 20 aa, Mycobacterium
RPRTAPDDPEVIAAIEAVVP

SEQ ID NO: 1223396 - protein, 8 aa, Mycobacterium
RPRTKGME

SEQ ID NO: 1223397 - protein, 8 aa, Mycobacterium
RPRVDGAD

SEQ ID NO: 1223398 - protein, 10 aa, Mycobacterium
RPRVSEREDR

SEQ ID NO: 1223399 - protein, 7 aa, Mycobacterium
RPSAGHI

SEQ ID NO: 1223400 - protein, 7 aa, Mycobacterium
RPSAGTE

SEQ ID NO: 1223401 - protein, 16 aa, Mycobacterium
RPSALRDSLDGSPQIS

SEQ ID NO: 1223402 - protein, 22 aa, Mycobacterium
RPSARSPQSQDSATTHIGFRCA

SEQ ID NO: 1223403 - protein, 13 aa, Mycobacterium
RPSDGAPEGYAAE

SEQ ID NO: 1223404 - protein, 9 aa, Mycobacterium
RPSDLTPEP

SEQ ID NO: 1223405 - protein, 6 aa, Mycobacterium
RPSDRD

SEQ ID NO: 1223406 - protein, 11 aa, Mycobacterium
RPSEQEPTAST

SEQ ID NO: 1223407 - protein, 14 aa, Mycobacterium
RPSGPGAGSPLDQS

SEQ ID NO: 1223408 - protein, 12 aa, Mycobacterium
RPSGPRPTEPVD

SEQ ID NO: 1223409 - protein, 10 aa, Mycobacterium
RPSGTEDLTD

SEQ ID NO: 1223410 - protein, 13 aa, Mycobacterium
RPSGVDQELASAG

SEQ ID NO: 1223411 - protein, 21 aa, Mycobacterium
RPSKAARHAAAATTASDAEKF

SEQ ID NO: 1223412 - protein, 4 aa, Mycobacterium
RPSL

SEQ ID NO: 1223413 - protein, 5 aa, Mycobacterium
RPSLR

SEQ ID NO: 1223414 - protein, 12 aa, Mycobacterium
RPSLRGKKAEIH

SEQ ID NO: 1223415 - protein, 4 aa, Mycobacterium
RPSM

SEQ ID NO: 1223416 - protein, 7 aa, Mycobacterium
RPSNRRE

SEQ ID NO: 1223417 - protein, 7 aa, Mycobacterium
RPSPKAV

SEQ ID NO: 1223418 - protein, 6 aa, Mycobacterium
RPSPRL

SEQ ID NO: 1223419 - protein, 11 aa, Mycobacterium
RPSRPYDGPAE

SEQ ID NO: 1223420 - protein, 8 aa, Mycobacterium
RPSRRAKL

SEQ ID NO: 1223421 - protein, 8 aa, Mycobacterium
RPSRSEPY

SEQ ID NO: 1223422 - protein, 10 aa, Mycobacterium
RPSSAPPGDL

SEQ ID NO: 1223423 - protein, 10 aa, Mycobacterium
RPSSSPEPHG

SEQ ID NO: 1223424 - protein, 19 aa, Mycobacterium
RPSTVPSSAASVASQPTRG

SEQ ID NO: 1223425 - protein, 4 aa, Mycobacterium
RPSV

SEQ ID NO: 1223426 - protein, 5 aa, Mycobacterium
RPSWT

SEQ ID NO: 1223427 - protein, 14 aa, Mycobacterium
RPTAGDPSLAPPGR

SEQ ID NO: 1223428 - protein, 8 aa, Mycobacterium
RPTAQAAA

SEQ ID NO: 1223429 - protein, 18 aa, Mycobacterium
RPTAQALAESTAPDTPDA

SEQ ID NO: 1223430 - protein, 7 aa, Mycobacterium
RPTATAN

SEQ ID NO: 1223431 - protein, 17 aa, Mycobacterium
RPTATDPQTHPTTDEVH

SEQ ID NO: 1223432 - protein, 7 aa, Mycobacterium
RPTDRSQ

SEQ ID NO: 1223433 - protein, 12 aa, Mycobacterium
RPTGDDDEPTRK

SEQ ID NO: 1223434 - protein, 5 aa, Mycobacterium
RPTHE

SEQ ID NO: 1223435 - protein, 7 aa, Mycobacterium
RPTPGRA

SEQ ID NO: 1223436 - protein, 6 aa, Mycobacterium
RPTPLV

SEQ ID NO: 1223437 - protein, 10 aa, Mycobacterium
RPTPNPSSRA

SEQ ID NO: 1223438 - protein, 7 aa, Mycobacterium
RPTPQAN

SEQ ID NO: 1223439 - protein, 4 aa, Mycobacterium
RPTQ

SEQ ID NO: 1223440 - protein, 7 aa, Mycobacterium
RPTRRNS

SEQ ID NO: 1223441 - protein, 9 aa, Mycobacterium
RPTSGTVRV

SEQ ID NO: 1223442 - protein, 5 aa, Mycobacterium
RPTSQ

SEQ ID NO: 1223443 - protein, 5 aa, Mycobacterium
RPTSR

SEQ ID NO: 1223444 - protein, 6 aa, Mycobacterium
RPTSRG

SEQ ID NO: 1223445 - protein, 10 aa, Mycobacterium
RPTSTDPDGP

SEQ ID NO: 1223446 - protein, 4 aa, Mycobacterium
RPTT

SEQ ID NO: 1223447 - protein, 6 aa, Mycobacterium
RPTTAE

SEQ ID NO: 1223448 - protein, 5 aa, Mycobacterium
RPTVD

SEQ ID NO: 1223449 - protein, 7 aa, Mycobacterium
RPTYSNS

SEQ ID NO: 1223450 - protein, 40 aa, Mycobacterium
RPVAATAAAPSAAQPGTVPVSGAPWDRGTTSPGGATKGGL

SEQ ID NO: 1223451 - protein, 6 aa, Mycobacterium
RPVDAE

SEQ ID NO: 1223452 - protein, 8 aa, Mycobacterium
RPVEGSPY

SEQ ID NO: 1223453 - protein, 6 aa, Mycobacterium
RPVEPK

SEQ ID NO: 1223454 - protein, 8 aa, Mycobacterium
RPVGRDSE

SEQ ID NO: 1223455 - protein, 7 aa, Mycobacterium
RPVGTGG

SEQ ID NO: 1223456 - protein, 11 aa, Mycobacterium
RPVHGRGGKAD

SEQ ID NO: 1223457 - protein, 14 aa, Mycobacterium
RPVNPRPRLATTAA

SEQ ID NO: 1223458 - protein, 13 aa, Mycobacterium
RPVPEHRSQRTVE

SEQ ID NO: 1223459 - protein, 12 aa, Mycobacterium
RPVPGRIKIAIV

SEQ ID NO: 1223460 - protein, 8 aa, Mycobacterium
RPVSKADY

SEQ ID NO: 1223461 - protein, 13 aa, Mycobacterium
RPVTGGDRDDLAA

SEQ ID NO: 1223462 - protein, 5 aa, Mycobacterium
RPVTT

SEQ ID NO: 1223463 - protein, 25 aa, Mycobacterium
RPWADAAADELEATGERARRGGTEY

SEQ ID NO: 1223464 - protein, 4 aa, Mycobacterium
RPWK

SEQ ID NO: 1223465 - protein, 11 aa, Mycobacterium
RPYDPETKGVV

SEQ ID NO: 1223466 - protein, 36 aa, Mycobacterium
RPYGDRDADWSRNASGTVAAGVGDAAPDAAADPVDN

SEQ ID NO: 1223467 - protein, 6 aa, Mycobacterium
RPYTDA

SEQ ID NO: 1223468 - protein, 14 aa, Mycobacterium
RQAAADCNGVIVAG

SEQ ID NO: 1223469 - protein, 15 aa, Mycobacterium
RQAAADCNGVIVSGL

SEQ ID NO: 1223470 - protein, 11 aa, Mycobacterium
RQAAAGSVPDP

SEQ ID NO: 1223471 - protein, 6 aa, Mycobacterium
RQAARG

SEQ ID NO: 1223472 - protein, 8 aa, Mycobacterium
RQADPGEF

SEQ ID NO: 1223473 - protein, 6 aa, Mycobacterium
RQAEEV

SEQ ID NO: 1223474 - protein, 5 aa, Mycobacterium
RQAFD

SEQ ID NO: 1223475 - protein, 5 aa, Mycobacterium
RQAGG

SEQ ID NO: 1223476 - protein, 6 aa, Mycobacterium
RQAGGD

SEQ ID NO: 1223477 - protein, 6 aa, Mycobacterium
RQAGPE

SEQ ID NO: 1223478 - protein, 9 aa, Mycobacterium
RQAKPGEFD

SEQ ID NO: 1223479 - protein, 21 aa, Mycobacterium
RQAMTGESLPPALPATATAQA

SEQ ID NO: 1223480 - protein, 10 aa, Mycobacterium
RQAMTGPSLP

SEQ ID NO: 1223481 - protein, 14 aa, Mycobacterium
RQAPDTGAVTGQPE

SEQ ID NO: 1223482 - protein, 10 aa, Mycobacterium
RQAQASRPDL

SEQ ID NO: 1223483 - protein, 10 aa, Mycobacterium
RQARADVSGP

SEQ ID NO: 1223484 - protein, 8 aa, Mycobacterium
RQASAGHA

SEQ ID NO: 1223485 - protein, 13 aa, Mycobacterium
RQASPDGVPGPDV

SEQ ID NO: 1223486 - protein, 10 aa, Mycobacterium
RQASQDPEAR

SEQ ID NO: 1223487 - protein, 14 aa, Mycobacterium
RQATADAAASGADI

SEQ ID NO: 1223488 - protein, 8 aa, Mycobacterium
RQATGESH

SEQ ID NO: 1223489 - protein, 12 aa, Mycobacterium
RQCRSQGDRPVR

SEQ ID NO: 1223490 - protein, 4 aa, Mycobacterium
RQDA

SEQ ID NO: 1223491 - protein, 14 aa, Mycobacterium
RQDAGGGKQTAVTG

SEQ ID NO: 1223492 - protein, 7 aa, Mycobacterium
RQDDDGR

SEQ ID NO: 1223493 - protein, 7 aa, Mycobacterium
RQDGAGV

SEQ ID NO: 1223494 - protein, 4 aa, Mycobacterium
RQDH

SEQ ID NO: 1223495 - protein, 10 aa, Mycobacterium
RQDHPRGVRG

SEQ ID NO: 1223496 - protein, 6 aa, Mycobacterium
RQDPTT

SEQ ID NO: 1223497 - protein, 13 aa, Mycobacterium
RQDRAADPSAGTP

SEQ ID NO: 1223498 - protein, 21 aa, Mycobacterium
RQDRAAQQAYQEAAASYTEQG

SEQ ID NO: 1223499 - protein, 6 aa, Mycobacterium
RQEAGA

SEQ ID NO: 1223500 - protein, 6 aa, Mycobacterium
RQEDGG

SEQ ID NO: 1223501 - protein, 23 aa, Mycobacterium
RQEEQLTKRTESGLAVPKTTHGQ

SEQ ID NO: 1223502 - protein, 12 aa, Mycobacterium
RQEGGGRLEPSG

SEQ ID NO: 1223503 - protein, 4 aa, Mycobacterium
RQEI

SEQ ID NO: 1223504 - protein, 16 aa, Mycobacterium
RQEKWEDSPPGYPQTA

SEQ ID NO: 1223505 - protein, 8 aa, Mycobacterium
RQENPGRV

SEQ ID NO: 1223506 - protein, 7 aa, Mycobacterium
RQEQNRA

SEQ ID NO: 1223507 - protein, 11 aa, Mycobacterium
RQERADPSERE

SEQ ID NO: 1223508 - protein, 6 aa, Mycobacterium
RQESPE

SEQ ID NO: 1223509 - protein, 8 aa, Mycobacterium
RQESTDGV

SEQ ID NO: 1223510 - protein, 12 aa, Mycobacterium
RQGAGKAYEDKS

SEQ ID NO: 1223511 - protein, 8 aa, Mycobacterium
RQGAPDPV

SEQ ID NO: 1223512 - protein, 7 aa, Mycobacterium
RQGAQSV

SEQ ID NO: 1223513 - protein, 6 aa, Mycobacterium
RQGATA

SEQ ID NO: 1223514 - protein, 7 aa, Mycobacterium
RQGDGLD

SEQ ID NO: 1223515 - protein, 8 aa, Mycobacterium
RQGEGEVD

SEQ ID NO: 1223516 - protein, 4 aa, Mycobacterium
RQGF

SEQ ID NO: 1223517 - protein, 9 aa, Mycobacterium
RQGGAAVDP

SEQ ID NO: 1223518 - protein, 8 aa, Mycobacterium
RQGGGVRE

SEQ ID NO: 1223519 - protein, 11 aa, Mycobacterium
RQGHGEPNPSW

SEQ ID NO: 1223520 - protein, 8 aa, Mycobacterium
RQGHPPAG

SEQ ID NO: 1223521 - protein, 9 aa, Mycobacterium
RQGIGDSAN

SEQ ID NO: 1223522 - protein, 6 aa, Mycobacterium
RQGLGA

SEQ ID NO: 1223523 - protein, 10 aa, Mycobacterium
RQGMRATPAG

SEQ ID NO: 1223524 - protein, 13 aa, Mycobacterium
RQGPNGLEVQGPQ

SEQ ID NO: 1223525 - protein, 9 aa, Mycobacterium
RQGRPADEI

SEQ ID NO: 1223526 - protein, 6 aa, Mycobacterium
RQGRTH

SEQ ID NO: 1223527 - protein, 8 aa, Mycobacterium
RQGSGAIV

SEQ ID NO: 1223528 - protein, 7 aa, Mycobacterium
RQHAARN

SEQ ID NO: 1223529 - protein, 7 aa, Mycobacterium
RQHDGEP

SEQ ID NO: 1223530 - protein, 5 aa, Mycobacterium
RQHSE

SEQ ID NO: 1223531 - protein, 6 aa, Mycobacterium
RQIDEN

SEQ ID NO: 1223532 - protein, 9 aa, Mycobacterium
RQIGTTGAR

SEQ ID NO: 1223533 - protein, 8 aa, Mycobacterium
RQIRDSGR

SEQ ID NO: 1223534 - protein, 10 aa, Mycobacterium
RQKNTAATNL

SEQ ID NO: 1223535 - protein, 4 aa, Mycobacterium
RQLD

SEQ ID NO: 1223536 - protein, 6 aa, Mycobacterium
RQLGRS

SEQ ID NO: 1223537 - protein, 4 aa, Mycobacterium
RQLT

SEQ ID NO: 1223538 - protein, 7 aa, Mycobacterium
RQMTGGG

SEQ ID NO: 1223539 - protein, 5 aa, Mycobacterium
RQNAD

SEQ ID NO: 1223540 - protein, 7 aa, Mycobacterium
RQNAEEA

SEQ ID NO: 1223541 - protein, 6 aa, Mycobacterium
RQNATL

SEQ ID NO: 1223542 - protein, 14 aa, Mycobacterium
RQNESGDSLETARP

SEQ ID NO: 1223543 - protein, 5 aa, Mycobacterium
RQNHR

SEQ ID NO: 1223544 - protein, 5 aa, Mycobacterium
RQNLA

SEQ ID NO: 1223545 - protein, 9 aa, Mycobacterium
RQNPTTNQL

SEQ ID NO: 1223546 - protein, 6 aa, Mycobacterium
RQNSDV

SEQ ID NO: 1223547 - protein, 4 aa, Mycobacterium
RQPA

SEQ ID NO: 1223548 - protein, 13 aa, Mycobacterium
RQPAGPPVDADDD

SEQ ID NO: 1223549 - protein, 9 aa, Mycobacterium
RQPAKSTTS

SEQ ID NO: 1223550 - protein, 4 aa, Mycobacterium
RQPD

SEQ ID NO: 1223551 - protein, 5 aa, Mycobacterium
RQPEH

SEQ ID NO: 1223552 - protein, 6 aa, Mycobacterium
RQPEVY

SEQ ID NO: 1223553 - protein, 12 aa, Mycobacterium
RQPKDRQYAQPV

SEQ ID NO: 1223554 - protein, 9 aa, Mycobacterium
RQPKGGDVF

SEQ ID NO: 1223555 - protein, 19 aa, Mycobacterium
RQPPQPARWSPGRALRRLR

SEQ ID NO: 1223556 - protein, 16 aa, Mycobacterium
RQPRGAIGRVTIPEAR

SEQ ID NO: 1223557 - protein, 5 aa, Mycobacterium
RQPSE

SEQ ID NO: 1223558 - protein, 8 aa, Mycobacterium
RQPTTQPP

SEQ ID NO: 1223559 - protein, 9 aa, Mycobacterium
RQQAEAEGV

SEQ ID NO: 1223560 - protein, 7 aa, Mycobacterium
RQQDAER

SEQ ID NO: 1223561 - protein, 10 aa, Mycobacterium
RQQGAARTRN

SEQ ID NO: 1223562 - protein, 7 aa, Mycobacterium
RQQHRPT

SEQ ID NO: 1223563 - protein, 7 aa, Mycobacterium
RQQPGDD

SEQ ID NO: 1223564 - protein, 6 aa, Mycobacterium
RQQQGA

SEQ ID NO: 1223565 - protein, 10 aa, Mycobacterium
RQQRSGRSTL

SEQ ID NO: 1223566 - protein, 11 aa, Mycobacterium
RQQTEKLSTEI

SEQ ID NO: 1223567 - protein, 10 aa, Mycobacterium
RQRAGDVGGT

SEQ ID NO: 1223568 - protein, 16 aa, Mycobacterium
RQRATARGDVNPTGGL

SEQ ID NO: 1223569 - protein, 7 aa, Mycobacterium
RQRDGEA

SEQ ID NO: 1223570 - protein, 6 aa, Mycobacterium
RQRERV

SEQ ID NO: 1223571 - protein, 7 aa, Mycobacterium
RQRGEMA

SEQ ID NO: 1223572 - protein, 6 aa, Mycobacterium
RQRGPI

SEQ ID NO: 1223573 - protein, 9 aa, Mycobacterium
RQRPPVGSA

SEQ ID NO: 1223574 - protein, 7 aa, Mycobacterium
RQRSAFG

SEQ ID NO: 1223575 - protein, 7 aa, Mycobacterium
RQRSEAR

SEQ ID NO: 1223576 - protein, 10 aa, Mycobacterium
RQRSETDERQ

SEQ ID NO: 1223577 - protein, 5 aa, Mycobacterium
RQRSG

SEQ ID NO: 1223578 - protein, 8 aa, Mycobacterium
RQRSGHRF

SEQ ID NO: 1223579 - protein, 5 aa, Mycobacterium
RQRSK

SEQ ID NO: 1223580 - protein, 8 aa, Mycobacterium
RQRTSDDV

SEQ ID NO: 1223581 - protein, 10 aa, Mycobacterium
RQSAAGDDYR

SEQ ID NO: 1223582 - protein, 14 aa, Mycobacterium
RQSAAGSRAGDVQA

SEQ ID NO: 1223583 - protein, 7 aa, Mycobacterium
RQSARST

SEQ ID NO: 1223584 - protein, 13 aa, Mycobacterium
RQSERAALTPEEV

SEQ ID NO: 1223585 - protein, 11 aa, Mycobacterium
RQSMPAPPRGV

SEQ ID NO: 1223586 - protein, 9 aa, Mycobacterium
RQSPAKVNS

SEQ ID NO: 1223587 - protein, 15 aa, Mycobacterium
RQSPHPSPALPTRLL

SEQ ID NO: 1223588 - protein, 5 aa, Mycobacterium
RQSSN

SEQ ID NO: 1223589 - protein, 8 aa, Mycobacterium
RQSSSGIE

SEQ ID NO: 1223590 - protein, 5 aa, Mycobacterium
RQSTA

SEQ ID NO: 1223591 - protein, 6 aa, Mycobacterium
RQSVEE

SEQ ID NO: 1223592 - protein, 6 aa, Mycobacterium
RQTADA

SEQ ID NO: 1223593 - protein, 8 aa, Mycobacterium
RQTDEDGN

SEQ ID NO: 1223594 - protein, 33 aa, Mycobacterium
RQTDQANKLSAATAARARAESAAADAQRRQDDA

SEQ ID NO: 1223595 - protein, 13 aa, Mycobacterium
RQTEPAPRTRGRG

SEQ ID NO: 1223596 - protein, 14 aa, Mycobacterium
RQTGSLGGGSSEMA

SEQ ID NO: 1223597 - protein, 7 aa, Mycobacterium
RQTGTAV

SEQ ID NO: 1223598 - protein, 13 aa, Mycobacterium
RQTNANIGPEPAA

SEQ ID NO: 1223599 - protein, 4 aa, Mycobacterium
RQTP

SEQ ID NO: 1223600 - protein, 7 aa, Mycobacterium
RQTPRPG

SEQ ID NO: 1223601 - protein, 9 aa, Mycobacterium
RQTQSTDIP

SEQ ID NO: 1223602 - protein, 11 aa, Mycobacterium
RQTRSEADRRR

SEQ ID NO: 1223603 - protein, 9 aa, Mycobacterium
RQTSGRGQV

SEQ ID NO: 1223604 - protein, 5 aa, Mycobacterium
RQVGG

SEQ ID NO: 1223605 - protein, 16 aa, Mycobacterium
RQVQGAAEGVPGQAGQ

SEQ ID NO: 1223606 - protein, 18 aa, Mycobacterium
RQVSDTAGDYQVDGAKTF

SEQ ID NO: 1223607 - protein, 15 aa, Mycobacterium
RQVTGRAGDYQVPGA

SEQ ID NO: 1223608 - protein, 8 aa, Mycobacterium
RQVTPGAG

SEQ ID NO: 1223609 - protein, 4 aa, Mycobacterium
RQVV

SEQ ID NO: 1223610 - protein, 5 aa, Mycobacterium
RQWGG

SEQ ID NO: 1223611 - protein, 8 aa, Mycobacterium
RQYAEPEF

SEQ ID NO: 1223612 - protein, 9 aa, Mycobacterium
RQYGRPLRG

SEQ ID NO: 1223613 - protein, 9 aa, Mycobacterium
RRAAATRSG

SEQ ID NO: 1223614 - protein, 9 aa, Mycobacterium
RRAAEAGAA

SEQ ID NO: 1223615 - protein, 6 aa, Mycobacterium
RRAAED

SEQ ID NO: 1223616 - protein, 15 aa, Mycobacterium
RRAAEIGRTATLQQA

SEQ ID NO: 1223617 - protein, 21 aa, Mycobacterium
RRAAEQAGGVPAAKRGKGLAS

SEQ ID NO: 1223618 - protein, 21 aa, Mycobacterium
RRAAEQAGGVPAARRGKGLAS

SEQ ID NO: 1223619 - protein, 21 aa, Mycobacterium
RRAAEQARGVPAAKRGKGLAS

SEQ ID NO: 1223620 - protein, 21 aa, Mycobacterium
RRAAEQARGVPAARRGKGLAS

SEQ ID NO: 1223621 - protein, 12 aa, Mycobacterium
RRAAGAAARSLS

SEQ ID NO: 1223622 - protein, 7 aa, Mycobacterium
RRAAKDR

SEQ ID NO: 1223623 - protein, 9 aa, Mycobacterium
RRAAQTAAE

SEQ ID NO: 1223624 - protein, 6 aa, Mycobacterium
RRAARN

SEQ ID NO: 1223625 - protein, 12 aa, Mycobacterium
RRAATEMREPDT

SEQ ID NO: 1223626 - protein, 7 aa, Mycobacterium
RRAATQD

SEQ ID NO: 1223627 - protein, 53 aa, Mycobacterium
RRADDAPPAAEDDGKTDVNGLRPGDEGYQPFNTRGANAKHATAAKAQEASEKR

SEQ ID NO: 1223628 - protein, 9 aa, Mycobacterium
RRADDYDQR

SEQ ID NO: 1223629 - protein, 8 aa, Mycobacterium
RRADPRDD

SEQ ID NO: 1223630 - protein, 16 aa, Mycobacterium
RRADYDAAAIRVASQL

SEQ ID NO: 1223631 - protein, 20 aa, Mycobacterium
RRAEALDGQGVNLAALERNV

SEQ ID NO: 1223632 - protein, 12 aa, Mycobacterium
RRAEGKIPADAP

SEQ ID NO: 1223633 - protein, 10 aa, Mycobacterium
RRAEGSSDLR

SEQ ID NO: 1223634 - protein, 8 aa, Mycobacterium
RRAEPRDD

SEQ ID NO: 1223635 - protein, 7 aa, Mycobacterium
RRAFDSA

SEQ ID NO: 1223636 - protein, 8 aa, Mycobacterium
RRAGADPD

SEQ ID NO: 1223637 - protein, 6 aa, Mycobacterium
RRAGDD

SEQ ID NO: 1223638 - protein, 11 aa, Mycobacterium
RRAGDGGTREI

SEQ ID NO: 1223639 - protein, 9 aa, Mycobacterium
RRAGDRPAD

SEQ ID NO: 1223640 - protein, 11 aa, Mycobacterium
RRAGGSPGPYL

SEQ ID NO: 1223641 - protein, 8 aa, Mycobacterium
RRAGMGPP

SEQ ID NO: 1223642 - protein, 7 aa, Mycobacterium
RRAGQAH

SEQ ID NO: 1223643 - protein, 9 aa, Mycobacterium
RRAGQGSEL

SEQ ID NO: 1223644 - protein, 6 aa, Mycobacterium
RRAGVP

SEQ ID NO: 1223645 - protein, 6 aa, Mycobacterium
RRAGVT

SEQ ID NO: 1223646 - protein, 11 aa, Mycobacterium
RRAHTDAHSTG

SEQ ID NO: 1223647 - protein, 9 aa, Mycobacterium
RRAKDAGVD

SEQ ID NO: 1223648 - protein, 8 aa, Mycobacterium
RRAKERNS

SEQ ID NO: 1223649 - protein, 17 aa, Mycobacterium
RRANEARAARDKANIKD

SEQ ID NO: 1223650 - protein, 12 aa, Mycobacterium
RRANGSAAGQGE

SEQ ID NO: 1223651 - protein, 7 aa, Mycobacterium
RRANPRD

SEQ ID NO: 1223652 - protein, 4 aa, Mycobacterium
RRAP

SEQ ID NO: 1223653 - protein, 6 aa, Mycobacterium
RRAPES

SEQ ID NO: 1223654 - protein, 12 aa, Mycobacterium
RRAPGDATQQRI

SEQ ID NO: 1223655 - protein, 8 aa, Mycobacterium
RRAPGPAH

SEQ ID NO: 1223656 - protein, 7 aa, Mycobacterium
RRAPGPF

SEQ ID NO: 1223657 - protein, 12 aa, Mycobacterium
RRAPGTVGRPPI

SEQ ID NO: 1223658 - protein, 13 aa, Mycobacterium
RRAPSPVRRLIGW

SEQ ID NO: 1223659 - protein, 5 aa, Mycobacterium
RRAQE

SEQ ID NO: 1223660 - protein, 11 aa, Mycobacterium
RRAQEQGYGRE

SEQ ID NO: 1223661 - protein, 21 aa, Mycobacterium
RRAREGKVPPPPQWMTRQIGG

SEQ ID NO: 1223662 - protein, 10 aa, Mycobacterium
RRARGLPATG

SEQ ID NO: 1223663 - protein, 33 aa, Mycobacterium
RRARGPVKKKAVKKAPAKKTPAKKTAAKKAAKK

SEQ ID NO: 1223664 - protein, 14 aa, Mycobacterium
RRASDAGEAMTTAT

SEQ ID NO: 1223665 - protein, 44 aa, Mycobacterium
RRASPAVEPPPGSPKRRRAGRAAVSPAPAGRQNVKTSEAPPRRP

SEQ ID NO: 1223666 - protein, 8 aa, Mycobacterium
RRASPRDD

SEQ ID NO: 1223667 - protein, 14 aa, Mycobacterium
RRASQASRSNPEAR

SEQ ID NO: 1223668 - protein, 9 aa, Mycobacterium
RRATARKGV

SEQ ID NO: 1223669 - protein, 11 aa, Mycobacterium
RRATRTDGRGT

SEQ ID NO: 1223670 - protein, 5 aa, Mycobacterium
RRATT

SEQ ID NO: 1223671 - protein, 7 aa, Mycobacterium
RRAVAER

SEQ ID NO: 1223672 - protein, 6 aa, Mycobacterium
RRAVRD

SEQ ID NO: 1223673 - protein, 4 aa, Mycobacterium
RRCA

SEQ ID NO: 1223674 - protein, 45 aa, Mycobacterium
RRCGPRRRRHREPTVRRRAPPAPRPGHTVGDRRQRTDVGEDGRRR

SEQ ID NO: 1223675 - protein, 4 aa, Mycobacterium
RRDA

SEQ ID NO: 1223676 - protein, 6 aa, Mycobacterium
RRDAAT

SEQ ID NO: 1223677 - protein, 17 aa, Mycobacterium
RRDARSPKTKLESSGGL

SEQ ID NO: 1223678 - protein, 8 aa, Mycobacterium
RRDEDDGQ

SEQ ID NO: 1223679 - protein, 15 aa, Mycobacterium
RRDEFGGSLENRAKV

SEQ ID NO: 1223680 - protein, 10 aa, Mycobacterium
RRDESASATV

SEQ ID NO: 1223681 - protein, 5 aa, Mycobacterium
RRDET

SEQ ID NO: 1223682 - protein, 13 aa, Mycobacterium
RRDEYGGDIDNRS

SEQ ID NO: 1223683 - protein, 7 aa, Mycobacterium
RRDGADA

SEQ ID NO: 1223684 - protein, 15 aa, Mycobacterium
RRDGAKRPVAETVGR

SEQ ID NO: 1223685 - protein, 7 aa, Mycobacterium
RRDGASV

SEQ ID NO: 1223686 - protein, 8 aa, Mycobacterium
RRDGDARA

SEQ ID NO: 1223687 - protein, 13 aa, Mycobacterium
RRDGDDPGLQTEA

SEQ ID NO: 1223688 - protein, 6 aa, Mycobacterium
RRDGDF

SEQ ID NO: 1223689 - protein, 6 aa, Mycobacterium
RRDGEV

SEQ ID NO: 1223690 - protein, 6 aa, Mycobacterium
RRDGKP

SEQ ID NO: 1223691 - protein, 8 aa, Mycobacterium
RRDGPQRP

SEQ ID NO: 1223692 - protein, 11 aa, Mycobacterium
RRDGQNKTIQQ

SEQ ID NO: 1223693 - protein, 6 aa, Mycobacterium
RRDGSE

SEQ ID NO: 1223694 - protein, 15 aa, Mycobacterium
RRDGSTEGQANARPV

SEQ ID NO: 1223695 - protein, 13 aa, Mycobacterium
RRDKPDPSTYIGS

SEQ ID NO: 1223696 - protein, 13 aa, Mycobacterium
RRDLEPKIDDDAW

SEQ ID NO: 1223697 - protein, 7 aa, Mycobacterium
RRDNASR

SEQ ID NO: 1223698 - protein, 8 aa, Mycobacterium
RRDPETVA

SEQ ID NO: 1223699 - protein, 10 aa, Mycobacterium
RRDPNRPRAV

SEQ ID NO: 1223700 - protein, 5 aa, Mycobacterium
RRDQH

SEQ ID NO: 1223701 - protein, 4 aa, Mycobacterium
RRDR

SEQ ID NO: 1223702 - protein, 23 aa, Mycobacterium
RRDRARHRHDAARGRTRRRRGAP

SEQ ID NO: 1223703 - protein, 20 aa, Mycobacterium
RRDRLRAQADQAHATEGKLA

SEQ ID NO: 1223704 - protein, 7 aa, Mycobacterium
RRDRNPP

SEQ ID NO: 1223705 - protein, 9 aa, Mycobacterium
RRDRPEGKL

SEQ ID NO: 1223706 - protein, 13 aa, Mycobacterium
RRDSYGGSLANRA

SEQ ID NO: 1223707 - protein, 17 aa, Mycobacterium
RRDTGRPVSSPAPTPPP

SEQ ID NO: 1223708 - protein, 14 aa, Mycobacterium
RRDTRREFTGEPVA

SEQ ID NO: 1223709 - protein, 4 aa, Mycobacterium
RRDY

SEQ ID NO: 1223710 - protein, 9 aa, Mycobacterium
RREAADNAR

SEQ ID NO: 1223711 - protein, 5 aa, Mycobacterium
RREAG

SEQ ID NO: 1223712 - protein, 19 aa, Mycobacterium
RREARQNARLAEAGTDSFA

SEQ ID NO: 1223713 - protein, 41 aa, Mycobacterium
RREDARRRLADAEQALTAAEDAYAAGKQTARDAADALKVAK

SEQ ID NO: 1223714 - protein, 8 aa, Mycobacterium
RREDDDAL

SEQ ID NO: 1223715 - protein, 8 aa, Mycobacterium
RREDPQDD

SEQ ID NO: 1223716 - protein, 8 aa, Mycobacterium
RREDTRNT

SEQ ID NO: 1223717 - protein, 13 aa, Mycobacterium
RREEALDSGKEAI

SEQ ID NO: 1223718 - protein, 5 aa, Mycobacterium
RREEC

SEQ ID NO: 1223719 - protein, 24 aa, Mycobacterium
RREEDAHTAGQPIDTEYRYEDLVQ

SEQ ID NO: 1223720 - protein, 8 aa, Mycobacterium
RREEEGYP

SEQ ID NO: 1223721 - protein, 22 aa, Mycobacterium
RREEGSAGRAIPTEYRYEDLVA

SEQ ID NO: 1223722 - protein, 18 aa, Mycobacterium
RREGGDEVSYSTASQQVS

SEQ ID NO: 1223723 - protein, 17 aa, Mycobacterium
RREGHGPGDGSDIPTGR

SEQ ID NO: 1223724 - protein, 6 aa, Mycobacterium
RREGLR

SEQ ID NO: 1223725 - protein, 37 aa, Mycobacterium
RREGNSKEKAARISNAAAARGKSSVGRKGGKSGSYDD

SEQ ID NO: 1223726 - protein, 12 aa, Mycobacterium
RREGRPAGTGSV

SEQ ID NO: 1223727 - protein, 14 aa, Mycobacterium
RREIGRGDALRTPG

SEQ ID NO: 1223728 - protein, 13 aa, Mycobacterium
RRELSESEQDEFR

SEQ ID NO: 1223729 - protein, 8 aa, Mycobacterium
RRELSGGK

SEQ ID NO: 1223730 - protein, 8 aa, Mycobacterium
RRENAELK

SEQ ID NO: 1223731 - protein, 12 aa, Mycobacterium
RRENRDPDADDI

SEQ ID NO: 1223732 - protein, 5 aa, Mycobacterium
RRENT

SEQ ID NO: 1223733 - protein, 5 aa, Mycobacterium
RREPE

SEQ ID NO: 1223734 - protein, 12 aa, Mycobacterium
RREPPSRALPDG

SEQ ID NO: 1223735 - protein, 12 aa, Mycobacterium
RREQLTGDEAHE

SEQ ID NO: 1223736 - protein, 7 aa, Mycobacterium
RREQRRQ

SEQ ID NO: 1223737 - protein, 7 aa, Mycobacterium
RREREPL

SEQ ID NO: 1223738 - protein, 11 aa, Mycobacterium
RRERGSINPDD

SEQ ID NO: 1223739 - protein, 8 aa, Mycobacterium
RRESASLK

SEQ ID NO: 1223740 - protein, 6 aa, Mycobacterium
RRESIR

SEQ ID NO: 1223741 - protein, 12 aa, Mycobacterium
RRFPEHGNTPRT

SEQ ID NO: 1223742 - protein, 11 aa, Mycobacterium
RRFRTPSGEVV

SEQ ID NO: 1223743 - protein, 4 aa, Mycobacterium
RRGA

SEQ ID NO: 1223744 - protein, 6 aa, Mycobacterium
RRGAAE

SEQ ID NO: 1223745 - protein, 7 aa, Mycobacterium
RRGADGG

SEQ ID NO: 1223746 - protein, 6 aa, Mycobacterium
RRGADK

SEQ ID NO: 1223747 - protein, 5 aa, Mycobacterium
RRGAE

SEQ ID NO: 1223748 - protein, 8 aa, Mycobacterium
RRGAPGTV

SEQ ID NO: 1223749 - protein, 15 aa, Mycobacterium
RRGARKGAGKGTAKV

SEQ ID NO: 1223750 - protein, 9 aa, Mycobacterium
RRGARRLPE

SEQ ID NO: 1223751 - protein, 14 aa, Mycobacterium
RRGATAAETDEPVI

SEQ ID NO: 1223752 - protein, 4 aa, Mycobacterium
RRGD

SEQ ID NO: 1223753 - protein, 6 aa, Mycobacterium
RRGDDG

SEQ ID NO: 1223754 - protein, 6 aa, Mycobacterium
RRGDNS

SEQ ID NO: 1223755 - protein, 7 aa, Mycobacterium
RRGDTQI

SEQ ID NO: 1223756 - protein, 7 aa, Mycobacterium
RRGDTSQ

SEQ ID NO: 1223757 - protein, 12 aa, Mycobacterium
RRGEIDERSGRK

SEQ ID NO: 1223758 - protein, 5 aa, Mycobacterium
RRGEP

SEQ ID NO: 1223759 - protein, 22 aa, Mycobacterium
RRGEPTATVPAVPAAADGAEAP

SEQ ID NO: 1223760 - protein, 5 aa, Mycobacterium
RRGEQ

SEQ ID NO: 1223761 - protein, 6 aa, Mycobacterium
RRGEVR

SEQ ID NO: 1223762 - protein, 4 aa, Mycobacterium
RRGG

SEQ ID NO: 1223763 - protein, 9 aa, Mycobacterium
RRGGGTGAA

SEQ ID NO: 1223764 - protein, 18 aa, Mycobacterium
RRGGGVRAGALPADSAVP

SEQ ID NO: 1223765 - protein, 15 aa, Mycobacterium
RRGGHPTPMSATKAS

SEQ ID NO: 1223766 - protein, 6 aa, Mycobacterium
RRGGKY

SEQ ID NO: 1223767 - protein, 8 aa, Mycobacterium
RRGGPHGL

SEQ ID NO: 1223768 - protein, 11 aa, Mycobacterium
RRGGRNFQQTH

SEQ ID NO: 1223769 - protein, 15 aa, Mycobacterium
RRGHGRSTQTPDGHD

SEQ ID NO: 1223770 - protein, 5 aa, Mycobacterium
RRGND

SEQ ID NO: 1223771 - protein, 9 aa, Mycobacterium
RRGPAASSF

SEQ ID NO: 1223772 - protein, 11 aa, Mycobacterium
RRGPESRFPTA

SEQ ID NO: 1223773 - protein, 7 aa, Mycobacterium
RRGPLAG

SEQ ID NO: 1223774 - protein, 10 aa, Mycobacterium
RRGPRDSAFS

SEQ ID NO: 1223775 - protein, 10 aa, Mycobacterium
RRGPTLAADP

SEQ ID NO: 1223776 - protein, 9 aa, Mycobacterium
RRGQDPQAR

SEQ ID NO: 1223777 - protein, 5 aa, Mycobacterium
RRGQW

SEQ ID NO: 1223778 - protein, 4 aa, Mycobacterium
RRGR

SEQ ID NO: 1223779 - protein, 9 aa, Mycobacterium
RRGRGDPCY

SEQ ID NO: 1223780 - protein, 6 aa, Mycobacterium
RRGRVG

SEQ ID NO: 1223781 - protein, 7 aa, Mycobacterium
RRGSRDV

SEQ ID NO: 1223782 - protein, 13 aa, Mycobacterium
RRGSSGHAKSTDA

SEQ ID NO: 1223783 - protein, 6 aa, Mycobacterium
RRGSSI

SEQ ID NO: 1223784 - protein, 11 aa, Mycobacterium
RRGSTATFSSE

SEQ ID NO: 1223785 - protein, 4 aa, Mycobacterium
RRGT

SEQ ID NO: 1223786 - protein, 9 aa, Mycobacterium
RRGTDKTVD

SEQ ID NO: 1223787 - protein, 9 aa, Mycobacterium
RRGTPEEQA

SEQ ID NO: 1223788 - protein, 8 aa, Mycobacterium
RRGVPGDD

SEQ ID NO: 1223789 - protein, 13 aa, Mycobacterium
RRHAAGGRTAREN

SEQ ID NO: 1223790 - protein, 11 aa, Mycobacterium
RRHAANNPKAH

SEQ ID NO: 1223791 - protein, 7 aa, Mycobacterium
RRHGKTS

SEQ ID NO: 1223792 - protein, 9 aa, Mycobacterium
RRHGSQTLP

SEQ ID NO: 1223793 - protein, 4 aa, Mycobacterium
RRHP

SEQ ID NO: 1223794 - protein, 5 aa, Mycobacterium
RRHPD

SEQ ID NO: 1223795 - protein, 11 aa, Mycobacterium
RRHSAADGLSP

SEQ ID NO: 1223796 - protein, 12 aa, Mycobacterium
RRIAGPDGSANV

SEQ ID NO: 1223797 - protein, 43 aa, Mycobacterium
RRIDPDTGQVREDRENSDAGPAPSGPAPDEFAGESVEEAGKAA

SEQ ID NO: 1223798 - protein, 6 aa, Mycobacterium
RRIDPV

SEQ ID NO: 1223799 - protein, 8 aa, Mycobacterium
RRKEPRDD

SEQ ID NO: 1223800 - protein, 8 aa, Mycobacterium
RRKNPRED

SEQ ID NO: 1223801 - protein, 7 aa, Mycobacterium
RRKPEAA

SEQ ID NO: 1223802 - protein, 6 aa, Mycobacterium
RRKRHP

SEQ ID NO: 1223803 - protein, 8 aa, Mycobacterium
RRKRQAAQ

SEQ ID NO: 1223804 - protein, 10 aa, Mycobacterium
RRKRRAGRDE

SEQ ID NO: 1223805 - protein, 8 aa, Mycobacterium
RRKTSGAV

SEQ ID NO: 1223806 - protein, 4 aa, Mycobacterium
RRLD

SEQ ID NO: 1223807 - protein, 7 aa, Mycobacterium
RRLGPQV

SEQ ID NO: 1223808 - protein, 7 aa, Mycobacterium
RRLGRAD

SEQ ID NO: 1223809 - protein, 7 aa, Mycobacterium
RRLKENE

SEQ ID NO: 1223810 - protein, 9 aa, Mycobacterium
RRLKPTPVT

SEQ ID NO: 1223811 - protein, 6 aa, Mycobacterium
RRLKQK

SEQ ID NO: 1223812 - protein, 19 aa, Mycobacterium
RRLPADGALPEIARARDLL

SEQ ID NO: 1223813 - protein, 15 aa, Mycobacterium
RRLPPESHSPHRSHS

SEQ ID NO: 1223814 - protein, 10 aa, Mycobacterium
RRLPTEPTER

SEQ ID NO: 1223815 - protein, 12 aa, Mycobacterium
RRLRNKSVKSSL

SEQ ID NO: 1223816 - protein, 10 aa, Mycobacterium
RRLTASADGL

SEQ ID NO: 1223817 - protein, 7 aa, Mycobacterium
RRMSGPD

SEQ ID NO: 1223818 - protein, 7 aa, Mycobacterium
RRNAARG

SEQ ID NO: 1223819 - protein, 4 aa, Mycobacterium
RRND

SEQ ID NO: 1223820 - protein, 9 aa, Mycobacterium
RRNDPTAYR

SEQ ID NO: 1223821 - protein, 8 aa, Mycobacterium
RRNGGVPT

SEQ ID NO: 1223822 - protein, 6 aa, Mycobacterium
RRNGKD

SEQ ID NO: 1223823 - protein, 4 aa, Mycobacterium
RRNN

SEQ ID NO: 1223824 - protein, 13 aa, Mycobacterium
RRNNTGPVEPTAV

SEQ ID NO: 1223825 - protein, 10 aa, Mycobacterium
RRNPKDEDVP

SEQ ID NO: 1223826 - protein, 21 aa, Mycobacterium
RRNQPLDPREVRDGKPPDDHD

SEQ ID NO: 1223827 - protein, 14 aa, Mycobacterium
RRNQVGGTLSGGEQ

SEQ ID NO: 1223828 - protein, 16 aa, Mycobacterium
RRNSNGARVKGGQREI

SEQ ID NO: 1223829 - protein, 8 aa, Mycobacterium
RRNSRNPS

SEQ ID NO: 1223830 - protein, 8 aa, Mycobacterium
RRNTATHA

SEQ ID NO: 1223831 - protein, 8 aa, Mycobacterium
RRNTRAHN

SEQ ID NO: 1223832 - protein, 8 aa, Mycobacterium
RRPAAGVS

SEQ ID NO: 1223833 - protein, 6 aa, Mycobacterium
RRPADL

SEQ ID NO: 1223834 - protein, 6 aa, Mycobacterium
RRPAEL

SEQ ID NO: 1223835 - protein, 13 aa, Mycobacterium
RRPATATAEESLE

SEQ ID NO: 1223836 - protein, 14 aa, Mycobacterium
RRPDASTPAGTGYG

SEQ ID NO: 1223837 - protein, 9 aa, Mycobacterium
RRPDDRDRR

SEQ ID NO: 1223838 - protein, 10 aa, Mycobacterium
RRPDENDRRR

SEQ ID NO: 1223839 - protein, 10 aa, Mycobacterium
RRPDGTLQHP

SEQ ID NO: 1223840 - protein, 19 aa, Mycobacterium
RRPDPSDPPPALDPDGPEI

SEQ ID NO: 1223841 - protein, 7 aa, Mycobacterium
RRPDSVS

SEQ ID NO: 1223842 - protein, 5 aa, Mycobacterium
RRPER

SEQ ID NO: 1223843 - protein, 6 aa, Mycobacterium
RRPERR

SEQ ID NO: 1223844 - protein, 7 aa, Mycobacterium
RRPEVVD

SEQ ID NO: 1223845 - protein, 14 aa, Mycobacterium
RRPEYAQTERDYTP

SEQ ID NO: 1223846 - protein, 9 aa, Mycobacterium
RRPFEDDGR

SEQ ID NO: 1223847 - protein, 4 aa, Mycobacterium
RRPG

SEQ ID NO: 1223848 - protein, 8 aa, Mycobacterium
RRPGATTT

SEQ ID NO: 1223849 - protein, 7 aa, Mycobacterium
RRPGDDG

SEQ ID NO: 1223850 - protein, 6 aa, Mycobacterium
RRPGET

SEQ ID NO: 1223851 - protein, 8 aa, Mycobacterium
RRPGGPGA

SEQ ID NO: 1223852 - protein, 17 aa, Mycobacterium
RRPGLDPPATPSSARAY

SEQ ID NO: 1223853 - protein, 11 aa, Mycobacterium
RRPGPLTAPAG

SEQ ID NO: 1223854 - protein, 7 aa, Mycobacterium
RRPGTGL

SEQ ID NO: 1223855 - protein, 7 aa, Mycobacterium
RRPHGAH

SEQ ID NO: 1223856 - protein, 17 aa, Mycobacterium
RRPKDRKAQIARASAEA

SEQ ID NO: 1223857 - protein, 5 aa, Mycobacterium
RRPKV

SEQ ID NO: 1223858 - protein, 8 aa, Mycobacterium
RRPLSDPE

SEQ ID NO: 1223859 - protein, 16 aa, Mycobacterium
RRPMTARTTPKTARSA

SEQ ID NO: 1223860 - protein, 6 aa, Mycobacterium
RRPNEA

SEQ ID NO: 1223861 - protein, 8 aa, Mycobacterium
RRPNTDDL

SEQ ID NO: 1223862 - protein, 13 aa, Mycobacterium
RRPPAASLRRLMY

SEQ ID NO: 1223863 - protein, 6 aa, Mycobacterium
RRPPLS

SEQ ID NO: 1223864 - protein, 27 aa, Mycobacterium
RRPPSRPNKTHHPHNTDTGHTVGEGSG

SEQ ID NO: 1223865 - protein, 7 aa, Mycobacterium
RRPPYAV

SEQ ID NO: 1223866 - protein, 5 aa, Mycobacterium
RRPRA

SEQ ID NO: 1223867 - protein, 6 aa, Mycobacterium
RRPRAT

SEQ ID NO: 1223868 - protein, 14 aa, Mycobacterium
RRPRLGVDTDERTI

SEQ ID NO: 1223869 - protein, 8 aa, Mycobacterium
RRPRPQDG

SEQ ID NO: 1223870 - protein, 8 aa, Mycobacterium
RRPRSGPA

SEQ ID NO: 1223871 - protein, 6 aa, Mycobacterium
RRPSEY

SEQ ID NO: 1223872 - protein, 52 aa, Mycobacterium
RRPSRSSNGNRERPRRDQRSAPRSSGPNRARPAQPRTDGDESRPSGPPIPAE

SEQ ID NO: 1223873 - protein, 11 aa, Mycobacterium
RRPTEGGYGTT

SEQ ID NO: 1223874 - protein, 10 aa, Mycobacterium
RRPTKSPSQL

SEQ ID NO: 1223875 - protein, 12 aa, Mycobacterium
RRPTPASETAVA

SEQ ID NO: 1223876 - protein, 5 aa, Mycobacterium
RRPVP

SEQ ID NO: 1223877 - protein, 10 aa, Mycobacterium
RRPYRNTGIQ

SEQ ID NO: 1223878 - protein, 9 aa, Mycobacterium
RRQASLEDS

SEQ ID NO: 1223879 - protein, 15 aa, Mycobacterium
RRQDAAGQRDGVSFG

SEQ ID NO: 1223880 - protein, 5 aa, Mycobacterium
RRQGD

SEQ ID NO: 1223881 - protein, 5 aa, Mycobacterium
RRQGQ

SEQ ID NO: 1223882 - protein, 6 aa, Mycobacterium
RRQGSD

SEQ ID NO: 1223883 - protein, 12 aa, Mycobacterium
RRQGVTGSQAKT

SEQ ID NO: 1223884 - protein, 26 aa, Mycobacterium
RRQHRGDDIGSVEPRHTGQRGAEQQH

SEQ ID NO: 1223885 - protein, 20 aa, Mycobacterium
RRQPAGKSSSRLLTPPAGES

SEQ ID NO: 1223886 - protein, 10 aa, Mycobacterium
RRQPGDVPPL

SEQ ID NO: 1223887 - protein, 6 aa, Mycobacterium
RRQPLR

SEQ ID NO: 1223888 - protein, 5 aa, Mycobacterium
RRQPR

SEQ ID NO: 1223889 - protein, 10 aa, Mycobacterium
RRQRDGANAA

SEQ ID NO: 1223890 - protein, 10 aa, Mycobacterium
RRQRDSALPG

SEQ ID NO: 1223891 - protein, 9 aa, Mycobacterium
RRQRRQPPL

SEQ ID NO: 1223892 - protein, 8 aa, Mycobacterium
RRQSDDER

SEQ ID NO: 1223893 - protein, 8 aa, Mycobacterium
RRQTPRED

SEQ ID NO: 1223894 - protein, 4 aa, Mycobacterium
RRQV

SEQ ID NO: 1223895 - protein, 11 aa, Mycobacterium
RRQVEERREGL

SEQ ID NO: 1223896 - protein, 6 aa, Mycobacterium
RRQYDA

SEQ ID NO: 1223897 - protein, 9 aa, Mycobacterium
RRRAGQGLP

SEQ ID NO: 1223898 - protein, 5 aa, Mycobacterium
RRRAT

SEQ ID NO: 1223899 - protein, 13 aa, Mycobacterium
RRRATRREQLSDE

SEQ ID NO: 1223900 - protein, 10 aa, Mycobacterium
RRRDAGLPYS

SEQ ID NO: 1223901 - protein, 14 aa, Mycobacterium
RRRDAGLPYSRNAS

SEQ ID NO: 1223902 - protein, 17 aa, Mycobacterium
RRRDEAARSGVKPERID

SEQ ID NO: 1223903 - protein, 6 aa, Mycobacterium
RRRDEL

SEQ ID NO: 1223904 - protein, 16 aa, Mycobacterium
RRRDGRRDRRPRRSGA

SEQ ID NO: 1223905 - protein, 11 aa, Mycobacterium
RRRDGTLRDSD

SEQ ID NO: 1223906 - protein, 16 aa, Mycobacterium
RRRDPFDDPGLDPDRL

SEQ ID NO: 1223907 - protein, 8 aa, Mycobacterium
RRRDPGED

SEQ ID NO: 1223908 - protein, 4 aa, Mycobacterium
RRRE

SEQ ID NO: 1223909 - protein, 8 aa, Mycobacterium
RRREPRGD

SEQ ID NO: 1223910 - protein, 7 aa, Mycobacterium
RRRERTG

SEQ ID NO: 1223911 - protein, 10 aa, Mycobacterium
RRRESIDDGI

SEQ ID NO: 1223912 - protein, 12 aa, Mycobacterium
RRRETEKLTRTT

SEQ ID NO: 1223913 - protein, 7 aa, Mycobacterium
RRRGEGI

SEQ ID NO: 1223914 - protein, 17 aa, Mycobacterium
RRRGGDTGARPLDETAS

SEQ ID NO: 1223915 - protein, 8 aa, Mycobacterium
RRRGPQAH

SEQ ID NO: 1223916 - protein, 14 aa, Mycobacterium
RRRGQESERPEYRR

SEQ ID NO: 1223917 - protein, 5 aa, Mycobacterium
RRRHP

SEQ ID NO: 1223918 - protein, 14 aa, Mycobacterium
RRRHTPEEAVDEDV

SEQ ID NO: 1223919 - protein, 5 aa, Mycobacterium
RRRIK

SEQ ID NO: 1223920 - protein, 4 aa, Mycobacterium
RRRL

SEQ ID NO: 1223921 - protein, 8 aa, Mycobacterium
RRRPDGTF

SEQ ID NO: 1223922 - protein, 7 aa, Mycobacterium
RRRPDRP

SEQ ID NO: 1223923 - protein, 20 aa, Mycobacterium
RRRPGEWTPPAERAARRQAE

SEQ ID NO: 1223924 - protein, 15 aa, Mycobacterium
RRRPKGPPSGSATAD

SEQ ID NO: 1223925 - protein, 7 aa, Mycobacterium
RRRPQPG

SEQ ID NO: 1223926 - protein, 7 aa, Mycobacterium
RRRQAGL

SEQ ID NO: 1223927 - protein, 5 aa, Mycobacterium
RRRQD

SEQ ID NO: 1223928 - protein, 4 aa, Mycobacterium
RRRR

SEQ ID NO: 1223929 - protein, 16 aa, Mycobacterium
RRRRAAGDPATGADPY

SEQ ID NO: 1223930 - protein, 9 aa, Mycobacterium
RRRRAGAES

SEQ ID NO: 1223931 - protein, 9 aa, Mycobacterium
RRRRATHPA

SEQ ID NO: 1223932 - protein, 7 aa, Mycobacterium
RRRRATR

SEQ ID NO: 1223933 - protein, 9 aa, Mycobacterium
RRRRATREE

SEQ ID NO: 1223934 - protein, 12 aa, Mycobacterium
RRRRGGRGGRGR

SEQ ID NO: 1223935 - protein, 17 aa, Mycobacterium
RRRRIPGHERTRGASPV

SEQ ID NO: 1223936 - protein, 5 aa, Mycobacterium
RRRRQ

SEQ ID NO: 1223937 - protein, 10 aa, Mycobacterium
RRRRSRAGEI

SEQ ID NO: 1223938 - protein, 5 aa, Mycobacterium
RRRSA

SEQ ID NO: 1223939 - protein, 7 aa, Mycobacterium
RRRSAEV

SEQ ID NO: 1223940 - protein, 173 aa, Mycobacterium
RRRSGPGTRRTGGPVGGRTTGGRAPAPAGARGPGLSPGPGPSGRTASASGRRTRCAATGGSRASGSAGRTGAAAARRSAASAATARGSAAAAATARGSATATRRRSAPAAATRGSRATAARGSRATAARGRDRRARVGAGGAAGRRRRSGERGGLRPHRTAGTFSTRSGRPAL

SEQ ID NO: 1223941 - protein, 7 aa, Mycobacterium
RRRSPLR

SEQ ID NO: 1223942 - protein, 6 aa, Mycobacterium
RRRSTG

SEQ ID NO: 1223943 - protein, 21 aa, Mycobacterium
RRRSVGAQRALGRAGSTMSAA

SEQ ID NO: 1223944 - protein, 5 aa, Mycobacterium
RRRTA

SEQ ID NO: 1223945 - protein, 16 aa, Mycobacterium
RRRTAAAGRVDSGQTM

SEQ ID NO: 1223946 - protein, 9 aa, Mycobacterium
RRRTGEGSM

SEQ ID NO: 1223947 - protein, 5 aa, Mycobacterium
RRRTI

SEQ ID NO: 1223948 - protein, 9 aa, Mycobacterium
RRRTPPAEL

SEQ ID NO: 1223949 - protein, 8 aa, Mycobacterium
RRRWPNGR

SEQ ID NO: 1223950 - protein, 11 aa, Mycobacterium
RRSAAVPAAET

SEQ ID NO: 1223951 - protein, 12 aa, Mycobacterium
RRSAREGSDPRH

SEQ ID NO: 1223952 - protein, 9 aa, Mycobacterium
RRSARGEYE

SEQ ID NO: 1223953 - protein, 10 aa, Mycobacterium
RRSASDTVRQ

SEQ ID NO: 1223954 - protein, 7 aa, Mycobacterium
RRSDDRD

SEQ ID NO: 1223955 - protein, 5 aa, Mycobacterium
RRSDQ

SEQ ID NO: 1223956 - protein, 14 aa, Mycobacterium
RRSEPTEEDRGFES

SEQ ID NO: 1223957 - protein, 14 aa, Mycobacterium
RRSGAGQPVGHSGG

SEQ ID NO: 1223958 - protein, 8 aa, Mycobacterium
RRSGAPAL

SEQ ID NO: 1223959 - protein, 11 aa, Mycobacterium
RRSGGERPALE

SEQ ID NO: 1223960 - protein, 11 aa, Mycobacterium
RRSGGGAGSCE

SEQ ID NO: 1223961 - protein, 8 aa, Mycobacterium
RRSGQEPD

SEQ ID NO: 1223962 - protein, 5 aa, Mycobacterium
RRSGS

SEQ ID NO: 1223963 - protein, 5 aa, Mycobacterium
RRSGV

SEQ ID NO: 1223964 - protein, 6 aa, Mycobacterium
RRSITG

SEQ ID NO: 1223965 - protein, 13 aa, Mycobacterium
RRSKDNSTSTRLT

SEQ ID NO: 1223966 - protein, 6 aa, Mycobacterium
RRSNEP

SEQ ID NO: 1223967 - protein, 12 aa, Mycobacterium
RRSPAAVSAHGG

SEQ ID NO: 1223968 - protein, 8 aa, Mycobacterium
RRSPDGTA

SEQ ID NO: 1223969 - protein, 11 aa, Mycobacterium
RRSPDSGRVTV

SEQ ID NO: 1223970 - protein, 25 aa, Mycobacterium
RRSPLSSDRAPAEPADDVGAYGSEP

SEQ ID NO: 1223971 - protein, 17 aa, Mycobacterium
RRSPRRGGVERGRIGDA

SEQ ID NO: 1223972 - protein, 5 aa, Mycobacterium
RRSPS

SEQ ID NO: 1223973 - protein, 4 aa, Mycobacterium
RRSR

SEQ ID NO: 1223974 - protein, 15 aa, Mycobacterium
RRSRRNPTEGGGAEP

SEQ ID NO: 1223975 - protein, 7 aa, Mycobacterium
RRSRTSL

SEQ ID NO: 1223976 - protein, 11 aa, Mycobacterium
RRSSAAQPHVN

SEQ ID NO: 1223977 - protein, 6 aa, Mycobacterium
RRSTAR

SEQ ID NO: 1223978 - protein, 12 aa, Mycobacterium
RRSTISDAQQAT

SEQ ID NO: 1223979 - protein, 7 aa, Mycobacterium
RRSTREA

SEQ ID NO: 1223980 - protein, 13 aa, Mycobacterium
RRSTYRQTADRTR

SEQ ID NO: 1223981 - protein, 6 aa, Mycobacterium
RRSVDE

SEQ ID NO: 1223982 - protein, 14 aa, Mycobacterium
RRTAARQTRPLPGL

SEQ ID NO: 1223983 - protein, 7 aa, Mycobacterium
RRTAEEL

SEQ ID NO: 1223984 - protein, 5 aa, Mycobacterium
RRTAG

SEQ ID NO: 1223985 - protein, 9 aa, Mycobacterium
RRTATADKA

SEQ ID NO: 1223986 - protein, 6 aa, Mycobacterium
RRTAVP

SEQ ID NO: 1223987 - protein, 9 aa, Mycobacterium
RRTDGTTNG

SEQ ID NO: 1223988 - protein, 6 aa, Mycobacterium
RRTDTD

SEQ ID NO: 1223989 - protein, 6 aa, Mycobacterium
RRTEEV

SEQ ID NO: 1223990 - protein, 9 aa, Mycobacterium
RRTEPEDDT

SEQ ID NO: 1223991 - protein, 5 aa, Mycobacterium
RRTER

SEQ ID NO: 1223992 - protein, 8 aa, Mycobacterium
RRTESNDL

SEQ ID NO: 1223993 - protein, 13 aa, Mycobacterium
RRTFEGAKTPRLG

SEQ ID NO: 1223994 - protein, 5 aa, Mycobacterium
RRTGE

SEQ ID NO: 1223995 - protein, 5 aa, Mycobacterium
RRTGN

SEQ ID NO: 1223996 - protein, 7 aa, Mycobacterium
RRTGPRQ

SEQ ID NO: 1223997 - protein, 8 aa, Mycobacterium
RRTGVNTE

SEQ ID NO: 1223998 - protein, 5 aa, Mycobacterium
RRTHH

SEQ ID NO: 1223999 - protein, 7 aa, Mycobacterium
RRTHPSD

SEQ ID NO: 1224000 - protein, 20 aa, Mycobacterium
RRTISAPIPRDPPVTSARRP

SEQ ID NO: 1224001 - protein, 7 aa, Mycobacterium
RRTNGRP

SEQ ID NO: 1224002 - protein, 10 aa, Mycobacterium
RRTNNPEGRE

SEQ ID NO: 1224003 - protein, 4 aa, Mycobacterium
RRTP

SEQ ID NO: 1224004 - protein, 17 aa, Mycobacterium
RRTPADGWPPVPPPTTI

SEQ ID NO: 1224005 - protein, 21 aa, Mycobacterium
RRTPAPEDGGEESVTVETETL

SEQ ID NO: 1224006 - protein, 9 aa, Mycobacterium
RRTPASRRV

SEQ ID NO: 1224007 - protein, 5 aa, Mycobacterium
RRTPD

SEQ ID NO: 1224008 - protein, 6 aa, Mycobacterium
RRTPDI

SEQ ID NO: 1224009 - protein, 6 aa, Mycobacterium
RRTPGL

SEQ ID NO: 1224010 - protein, 5 aa, Mycobacterium
RRTPM

SEQ ID NO: 1224011 - protein, 17 aa, Mycobacterium
RRTPSGAPLGTTERVDA

SEQ ID NO: 1224012 - protein, 4 aa, Mycobacterium
RRTS

SEQ ID NO: 1224013 - protein, 5 aa, Mycobacterium
RRTSD

SEQ ID NO: 1224014 - protein, 12 aa, Mycobacterium
RRTSEGVLPGLF

SEQ ID NO: 1224015 - protein, 15 aa, Mycobacterium
RRTTPEITGSRAGGL

SEQ ID NO: 1224016 - protein, 9 aa, Mycobacterium
RRTTSPENA

SEQ ID NO: 1224017 - protein, 6 aa, Mycobacterium
RRVDEE

SEQ ID NO: 1224018 - protein, 6 aa, Mycobacterium
RRVEDV

SEQ ID NO: 1224019 - protein, 28 aa, Mycobacterium
RRVGGRRRGRAVGNGRGRAAIDREQSAA

SEQ ID NO: 1224020 - protein, 4 aa, Mycobacterium
RRVP

SEQ ID NO: 1224021 - protein, 5 aa, Mycobacterium
RRVRG

SEQ ID NO: 1224022 - protein, 6 aa, Mycobacterium
RRVRRP

SEQ ID NO: 1224023 - protein, 6 aa, Mycobacterium
RRVRTT

SEQ ID NO: 1224024 - protein, 11 aa, Mycobacterium
RRVTGAARADG

SEQ ID NO: 1224025 - protein, 9 aa, Mycobacterium
RRWGGDNTD

SEQ ID NO: 1224026 - protein, 4 aa, Mycobacterium
RRWT

SEQ ID NO: 1224027 - protein, 12 aa, Mycobacterium
RRYGSRKSGASS

SEQ ID NO: 1224028 - protein, 4 aa, Mycobacterium
RRYP

SEQ ID NO: 1224029 - protein, 6 aa, Mycobacterium
RRYPNK

SEQ ID NO: 1224030 - protein, 11 aa, Mycobacterium
RRYPNSSARLN

SEQ ID NO: 1224031 - protein, 22 aa, Mycobacterium
RRYRAPSTRETCDPHHKTTTMQ

SEQ ID NO: 1224032 - protein, 6 aa, Mycobacterium
RRYSSG

SEQ ID NO: 1224033 - protein, 11 aa, Mycobacterium
RRYTGRSTRGA

SEQ ID NO: 1224034 - protein, 13 aa, Mycobacterium
RSAAAELAQRARN

SEQ ID NO: 1224035 - protein, 6 aa, Mycobacterium
RSAADA

SEQ ID NO: 1224036 - protein, 8 aa, Mycobacterium
RSAADALK

SEQ ID NO: 1224037 - protein, 26 aa, Mycobacterium
RSAADRYDATDETSGRAIDGVGIPGP

SEQ ID NO: 1224038 - protein, 6 aa, Mycobacterium
RSAAED

SEQ ID NO: 1224039 - protein, 11 aa, Mycobacterium
RSAAEEGTLPQ

SEQ ID NO: 1224040 - protein, 7 aa, Mycobacterium
RSAALGY

SEQ ID NO: 1224041 - protein, 7 aa, Mycobacterium
RSAAPDL

SEQ ID NO: 1224042 - protein, 12 aa, Mycobacterium
RSAARQSRRPYI

SEQ ID NO: 1224043 - protein, 9 aa, Mycobacterium
RSADGRVTA

SEQ ID NO: 1224044 - protein, 7 aa, Mycobacterium
RSADPAT

SEQ ID NO: 1224045 - protein, 5 aa, Mycobacterium
RSAEA

SEQ ID NO: 1224046 - protein, 9 aa, Mycobacterium
RSAEDRRTQ

SEQ ID NO: 1224047 - protein, 5 aa, Mycobacterium
RSAEL

SEQ ID NO: 1224048 - protein, 7 aa, Mycobacterium
RSAERGM

SEQ ID NO: 1224049 - protein, 24 aa, Mycobacterium
RSAESAGAARSAEPAADEEPDSDV

SEQ ID NO: 1224050 - protein, 12 aa, Mycobacterium
RSAFGPPPSRWP

SEQ ID NO: 1224051 - protein, 12 aa, Mycobacterium
RSAGEDAEDARA

SEQ ID NO: 1224052 - protein, 5 aa, Mycobacterium
RSAHC

SEQ ID NO: 1224053 - protein, 8 aa, Mycobacterium
RSAKDVGI

SEQ ID NO: 1224054 - protein, 5 aa, Mycobacterium
RSAKG

SEQ ID NO: 1224055 - protein, 9 aa, Mycobacterium
RSAKPGSPV

SEQ ID NO: 1224056 - protein, 6 aa, Mycobacterium
RSALDG

SEQ ID NO: 1224057 - protein, 9 aa, Mycobacterium
RSAPASAQE

SEQ ID NO: 1224058 - protein, 8 aa, Mycobacterium
RSAPDSVR

SEQ ID NO: 1224059 - protein, 7 aa, Mycobacterium
RSAPHDG

SEQ ID NO: 1224060 - protein, 7 aa, Mycobacterium
RSAPLGA

SEQ ID NO: 1224061 - protein, 7 aa, Mycobacterium
RSAPPIT

SEQ ID NO: 1224062 - protein, 5 aa, Mycobacterium
RSAPT

SEQ ID NO: 1224063 - protein, 33 aa, Mycobacterium
RSARSSPQRDTNVPGTDGIARGRHKRPALSGRK

SEQ ID NO: 1224064 - protein, 16 aa, Mycobacterium
RSARYRREAGTPDVET

SEQ ID NO: 1224065 - protein, 18 aa, Mycobacterium
RSASARPGAGGPVGSPGR

SEQ ID NO: 1224066 - protein, 11 aa, Mycobacterium
RSASEERTQNQ

SEQ ID NO: 1224067 - protein, 8 aa, Mycobacterium
RSASLSHH

SEQ ID NO: 1224068 - protein, 8 aa, Mycobacterium
RSASQAAL

SEQ ID NO: 1224069 - protein, 10 aa, Mycobacterium
RSASSAVEAG

SEQ ID NO: 1224070 - protein, 8 aa, Mycobacterium
RSASSDGP

SEQ ID NO: 1224071 - protein, 12 aa, Mycobacterium
RSASSPRTARRA

SEQ ID NO: 1224072 - protein, 12 aa, Mycobacterium
RSASTPQDYRDV

SEQ ID NO: 1224073 - protein, 6 aa, Mycobacterium
RSATED

SEQ ID NO: 1224074 - protein, 9 aa, Mycobacterium
RSATPADVS

SEQ ID NO: 1224075 - protein, 14 aa, Mycobacterium
RSATPGPVSDYTGK

SEQ ID NO: 1224076 - protein, 4 aa, Mycobacterium
RSAV

SEQ ID NO: 1224077 - protein, 16 aa, Mycobacterium
RSAVDPARAGLPADGR

SEQ ID NO: 1224078 - protein, 7 aa, Mycobacterium
RSAYEEF

SEQ ID NO: 1224079 - protein, 4 aa, Mycobacterium
RSCT

SEQ ID NO: 1224080 - protein, 4 aa, Mycobacterium
RSDA

SEQ ID NO: 1224081 - protein, 5 aa, Mycobacterium
RSDAA

SEQ ID NO: 1224082 - protein, 11 aa, Mycobacterium
RSDADDPDVTR

SEQ ID NO: 1224083 - protein, 11 aa, Mycobacterium
RSDADPAGGNR

SEQ ID NO: 1224084 - protein, 7 aa, Mycobacterium
RSDADVP

SEQ ID NO: 1224085 - protein, 7 aa, Mycobacterium
RSDAPYA

SEQ ID NO: 1224086 - protein, 7 aa, Mycobacterium
RSDASFA

SEQ ID NO: 1224087 - protein, 8 aa, Mycobacterium
RSDDVDPQ

SEQ ID NO: 1224088 - protein, 4 aa, Mycobacterium
RSDE

SEQ ID NO: 1224089 - protein, 7 aa, Mycobacterium
RSDEGRR

SEQ ID NO: 1224090 - protein, 7 aa, Mycobacterium
RSDGASA

SEQ ID NO: 1224091 - protein, 18 aa, Mycobacterium
RSDGDGKPPITDGPFAET

SEQ ID NO: 1224092 - protein, 6 aa, Mycobacterium
RSDGEA

SEQ ID NO: 1224093 - protein, 15 aa, Mycobacterium
RSDHGQPLSDGTPSV

SEQ ID NO: 1224094 - protein, 11 aa, Mycobacterium
RSDKPTRREDY

SEQ ID NO: 1224095 - protein, 9 aa, Mycobacterium
RSDLEPKDV

SEQ ID NO: 1224096 - protein, 8 aa, Mycobacterium
RSDLGQHE

SEQ ID NO: 1224097 - protein, 5 aa, Mycobacterium
RSDLR

SEQ ID NO: 1224098 - protein, 9 aa, Mycobacterium
RSDMSTLTR

SEQ ID NO: 1224099 - protein, 6 aa, Mycobacterium
RSDNAQ

SEQ ID NO: 1224100 - protein, 9 aa, Mycobacterium
RSDPADAAM

SEQ ID NO: 1224101 - protein, 5 aa, Mycobacterium
RSDPE

SEQ ID NO: 1224102 - protein, 16 aa, Mycobacterium
RSDPEFAYSDRERDGL

SEQ ID NO: 1224103 - protein, 8 aa, Mycobacterium
RSDPGLSA

SEQ ID NO: 1224104 - protein, 10 aa, Mycobacterium
RSDPPTDDEI

SEQ ID NO: 1224105 - protein, 6 aa, Mycobacterium
RSDPSI

SEQ ID NO: 1224106 - protein, 8 aa, Mycobacterium
RSDPTTRS

SEQ ID NO: 1224107 - protein, 6 aa, Mycobacterium
RSDPVQ

SEQ ID NO: 1224108 - protein, 5 aa, Mycobacterium
RSDQA

SEQ ID NO: 1224109 - protein, 11 aa, Mycobacterium
RSDQSTSDAIA

SEQ ID NO: 1224110 - protein, 12 aa, Mycobacterium
RSDRTERGRDGC

SEQ ID NO: 1224111 - protein, 18 aa, Mycobacterium
RSDSADKVEALDAGADDY

SEQ ID NO: 1224112 - protein, 7 aa, Mycobacterium
RSDSLGR

SEQ ID NO: 1224113 - protein, 8 aa, Mycobacterium
RSDSLRHT

SEQ ID NO: 1224114 - protein, 28 aa, Mycobacterium
RSDTARRRREERVSDEPPPGPTESADDT

SEQ ID NO: 1224115 - protein, 7 aa, Mycobacterium
RSDTDHV

SEQ ID NO: 1224116 - protein, 11 aa, Mycobacterium
RSDTGMSDDPT

SEQ ID NO: 1224117 - protein, 7 aa, Mycobacterium
RSDTGQE

SEQ ID NO: 1224118 - protein, 7 aa, Mycobacterium
RSDTTSY

SEQ ID NO: 1224119 - protein, 7 aa, Mycobacterium
RSEERQA

SEQ ID NO: 1224120 - protein, 4 aa, Mycobacterium
RSEF

SEQ ID NO: 1224121 - protein, 8 aa, Mycobacterium
RSEGAMGP

SEQ ID NO: 1224122 - protein, 14 aa, Mycobacterium
RSEGTADVTPESAV

SEQ ID NO: 1224123 - protein, 5 aa, Mycobacterium
RSEGV

SEQ ID NO: 1224124 - protein, 7 aa, Mycobacterium
RSEHRTL

SEQ ID NO: 1224125 - protein, 12 aa, Mycobacterium
RSEIAGSDQGRS

SEQ ID NO: 1224126 - protein, 7 aa, Mycobacterium
RSEIPDA

SEQ ID NO: 1224127 - protein, 6 aa, Mycobacterium
RSEKSR

SEQ ID NO: 1224128 - protein, 9 aa, Mycobacterium
RSELDYTPS

SEQ ID NO: 1224129 - protein, 8 aa, Mycobacterium
RSELGASQ

SEQ ID NO: 1224130 - protein, 24 aa, Mycobacterium
RSEPGQGSDPSLSAEGLEQAKRLP

SEQ ID NO: 1224131 - protein, 8 aa, Mycobacterium
RSEPPSVA

SEQ ID NO: 1224132 - protein, 11 aa, Mycobacterium
RSEQADPKRAR

SEQ ID NO: 1224133 - protein, 7 aa, Mycobacterium
RSERGPI

SEQ ID NO: 1224134 - protein, 7 aa, Mycobacterium
RSESLTE

SEQ ID NO: 1224135 - protein, 14 aa, Mycobacterium
RSESRLERESMDTA

SEQ ID NO: 1224136 - protein, 6 aa, Mycobacterium
RSEVGG

SEQ ID NO: 1224137 - protein, 8 aa, Mycobacterium
RSEVRDAH

SEQ ID NO: 1224138 - protein, 6 aa, Mycobacterium
RSEWEN

SEQ ID NO: 1224139 - protein, 10 aa, Mycobacterium
RSFDPHRAES

SEQ ID NO: 1224140 - protein, 8 aa, Mycobacterium
RSFGAGKT

SEQ ID NO: 1224141 - protein, 15 aa, Mycobacterium
RSGAEALGSMGTDTP

SEQ ID NO: 1224142 - protein, 8 aa, Mycobacterium
RSGAPRGS

SEQ ID NO: 1224143 - protein, 9 aa, Mycobacterium
RSGATAEEA

SEQ ID NO: 1224144 - protein, 6 aa, Mycobacterium
RSGAYT

SEQ ID NO: 1224145 - protein, 5 aa, Mycobacterium
RSGDE

SEQ ID NO: 1224146 - protein, 9 aa, Mycobacterium
RSGDNDLTA

SEQ ID NO: 1224147 - protein, 7 aa, Mycobacterium
RSGDPEQ

SEQ ID NO: 1224148 - protein, 8 aa, Mycobacterium
RSGDQDEL

SEQ ID NO: 1224149 - protein, 9 aa, Mycobacterium
RSGDRLDRN

SEQ ID NO: 1224150 - protein, 18 aa, Mycobacterium
RSGDRYGTAEPSADRYRS

SEQ ID NO: 1224151 - protein, 11 aa, Mycobacterium
RSGDTTPSKRR

SEQ ID NO: 1224152 - protein, 13 aa, Mycobacterium
RSGDWTGATGERI

SEQ ID NO: 1224153 - protein, 9 aa, Mycobacterium
RSGEAVPDA

SEQ ID NO: 1224154 - protein, 7 aa, Mycobacterium
RSGEFDP

SEQ ID NO: 1224155 - protein, 7 aa, Mycobacterium
RSGEGLR

SEQ ID NO: 1224156 - protein, 9 aa, Mycobacterium
RSGEGYQPG

SEQ ID NO: 1224157 - protein, 9 aa, Mycobacterium
RSGEPVPDA

SEQ ID NO: 1224158 - protein, 9 aa, Mycobacterium
RSGERTETL

SEQ ID NO: 1224159 - protein, 13 aa, Mycobacterium
RSGEWRGATGERI

SEQ ID NO: 1224160 - protein, 13 aa, Mycobacterium
RSGEWTGATGERI

SEQ ID NO: 1224161 - protein, 4 aa, Mycobacterium
RSGF

SEQ ID NO: 1224162 - protein, 6 aa, Mycobacterium
RSGFGG

SEQ ID NO: 1224163 - protein, 6 aa, Mycobacterium
RSGFGR

SEQ ID NO: 1224164 - protein, 9 aa, Mycobacterium
RSGGGSPHI

SEQ ID NO: 1224165 - protein, 17 aa, Mycobacterium
RSGGIENKAFAIVIDPA

SEQ ID NO: 1224166 - protein, 8 aa, Mycobacterium
RSGGPSAV

SEQ ID NO: 1224167 - protein, 9 aa, Mycobacterium
RSGGPVRTV

SEQ ID NO: 1224168 - protein, 5 aa, Mycobacterium
RSGGR

SEQ ID NO: 1224169 - protein, 18 aa, Mycobacterium
RSGGTTGIYTDGPTAWDG

SEQ ID NO: 1224170 - protein, 14 aa, Mycobacterium
RSGGVRGYRGDLPA

SEQ ID NO: 1224171 - protein, 6 aa, Mycobacterium
RSGGYT

SEQ ID NO: 1224172 - protein, 4 aa, Mycobacterium
RSGH

SEQ ID NO: 1224173 - protein, 8 aa, Mycobacterium
RSGHGNRL

SEQ ID NO: 1224174 - protein, 6 aa, Mycobacterium
RSGKDL

SEQ ID NO: 1224175 - protein, 8 aa, Mycobacterium
RSGLPKGT

SEQ ID NO: 1224176 - protein, 10 aa, Mycobacterium
RSGLPKVPTS

SEQ ID NO: 1224177 - protein, 8 aa, Mycobacterium
RSGNDPDL

SEQ ID NO: 1224178 - protein, 11 aa, Mycobacterium
RSGNRTNPSVA

SEQ ID NO: 1224179 - protein, 8 aa, Mycobacterium
RSGNSCGV

SEQ ID NO: 1224180 - protein, 6 aa, Mycobacterium
RSGNTV

SEQ ID NO: 1224181 - protein, 8 aa, Mycobacterium
RSGPDRAI

SEQ ID NO: 1224182 - protein, 7 aa, Mycobacterium
RSGPRLS

SEQ ID NO: 1224183 - protein, 11 aa, Mycobacterium
RSGPVPATDGL

SEQ ID NO: 1224184 - protein, 4 aa, Mycobacterium
RSGQ

SEQ ID NO: 1224185 - protein, 6 aa, Mycobacterium
RSGQGA

SEQ ID NO: 1224186 - protein, 9 aa, Mycobacterium
RSGQPDTIA

SEQ ID NO: 1224187 - protein, 4 aa, Mycobacterium
RSGR

SEQ ID NO: 1224188 - protein, 8 aa, Mycobacterium
RSGRGNVS

SEQ ID NO: 1224189 - protein, 7 aa, Mycobacterium
RSGRIGP

SEQ ID NO: 1224190 - protein, 6 aa, Mycobacterium
RSGRIR

SEQ ID NO: 1224191 - protein, 9 aa, Mycobacterium
RSGRMNDDD

SEQ ID NO: 1224192 - protein, 7 aa, Mycobacterium
RSGRSVR

SEQ ID NO: 1224193 - protein, 13 aa, Mycobacterium
RSGRTARAGSDGD

SEQ ID NO: 1224194 - protein, 10 aa, Mycobacterium
RSGSAGIYGP

SEQ ID NO: 1224195 - protein, 15 aa, Mycobacterium
RSGSAQVGGADPSDA

SEQ ID NO: 1224196 - protein, 22 aa, Mycobacterium
RSGSRSRGSASSREEKKEATRR

SEQ ID NO: 1224197 - protein, 75 aa, Mycobacterium
RSGSSGSRSTSPGESAAVPAPTGAAPPSSGSASAIAPPTPARDMPAATTAADAATRTRDPTWSPPLKPVSPEFSN

SEQ ID NO: 1224198 - protein, 6 aa, Mycobacterium
RSGTAA

SEQ ID NO: 1224199 - protein, 10 aa, Mycobacterium
RSGTPAEAAG

SEQ ID NO: 1224200 - protein, 17 aa, Mycobacterium
RSGVDEDFKRGESAYDR

SEQ ID NO: 1224201 - protein, 5 aa, Mycobacterium
RSGVS

SEQ ID NO: 1224202 - protein, 13 aa, Mycobacterium
RSGVSPPPSWARV

SEQ ID NO: 1224203 - protein, 4 aa, Mycobacterium
RSHA

SEQ ID NO: 1224204 - protein, 8 aa, Mycobacterium
RSHDPAVE

SEQ ID NO: 1224205 - protein, 4 aa, Mycobacterium
RSHP

SEQ ID NO: 1224206 - protein, 4 aa, Mycobacterium
RSHQ

SEQ ID NO: 1224207 - protein, 14 aa, Mycobacterium
RSHQRGEVGGAQRR

SEQ ID NO: 1224208 - protein, 11 aa, Mycobacterium
RSHREGQTPHF

SEQ ID NO: 1224209 - protein, 5 aa, Mycobacterium
RSHSP

SEQ ID NO: 1224210 - protein, 6 aa, Mycobacterium
RSHSPS

SEQ ID NO: 1224211 - protein, 7 aa, Mycobacterium
RSHTPPQ

SEQ ID NO: 1224212 - protein, 11 aa, Mycobacterium
RSIKAGDGVSY

SEQ ID NO: 1224213 - protein, 7 aa, Mycobacterium
RSIPPSI

SEQ ID NO: 1224214 - protein, 5 aa, Mycobacterium
RSIRA

SEQ ID NO: 1224215 - protein, 13 aa, Mycobacterium
RSIRPASPSASNR

SEQ ID NO: 1224216 - protein, 5 aa, Mycobacterium
RSIRR

SEQ ID NO: 1224217 - protein, 7 aa, Mycobacterium
RSKDNLD

SEQ ID NO: 1224218 - protein, 7 aa, Mycobacterium
RSKPNDI

SEQ ID NO: 1224219 - protein, 11 aa, Mycobacterium
RSKRSKRMTAS

SEQ ID NO: 1224220 - protein, 10 aa, Mycobacterium
RSKVTSPAAR

SEQ ID NO: 1224221 - protein, 11 aa, Mycobacterium
RSLAGDRAAYN

SEQ ID NO: 1224222 - protein, 11 aa, Mycobacterium
RSLAGDRSAYN

SEQ ID NO: 1224223 - protein, 4 aa, Mycobacterium
RSLE

SEQ ID NO: 1224224 - protein, 16 aa, Mycobacterium
RSLGDSGNGARQAPTS

SEQ ID NO: 1224225 - protein, 15 aa, Mycobacterium
RSLGRTPVEQPFNNP

SEQ ID NO: 1224226 - protein, 5 aa, Mycobacterium
RSLNA

SEQ ID NO: 1224227 - protein, 8 aa, Mycobacterium
RSLPAGQQ

SEQ ID NO: 1224228 - protein, 13 aa, Mycobacterium
RSLPDDAQTDEYL

SEQ ID NO: 1224229 - protein, 4 aa, Mycobacterium
RSLS

SEQ ID NO: 1224230 - protein, 7 aa, Mycobacterium
RSLSGGE

SEQ ID NO: 1224231 - protein, 12 aa, Mycobacterium
RSMGTRTQRLEE

SEQ ID NO: 1224232 - protein, 7 aa, Mycobacterium
RSNAEQL

SEQ ID NO: 1224233 - protein, 5 aa, Mycobacterium
RSNGA

SEQ ID NO: 1224234 - protein, 8 aa, Mycobacterium
RSNKTLAQ

SEQ ID NO: 1224235 - protein, 6 aa, Mycobacterium
RSNRHT

SEQ ID NO: 1224236 - protein, 9 aa, Mycobacterium
RSNSGLGGA

SEQ ID NO: 1224237 - protein, 4 aa, Mycobacterium
RSPA

SEQ ID NO: 1224238 - protein, 7 aa, Mycobacterium
RSPAAKR

SEQ ID NO: 1224239 - protein, 8 aa, Mycobacterium
RSPADRGT

SEQ ID NO: 1224240 - protein, 6 aa, Mycobacterium
RSPAGF

SEQ ID NO: 1224241 - protein, 19 aa, Mycobacterium
RSPAGKADYRWAREQAISG

SEQ ID NO: 1224242 - protein, 7 aa, Mycobacterium
RSPAPLE

SEQ ID NO: 1224243 - protein, 7 aa, Mycobacterium
RSPATGG

SEQ ID NO: 1224244 - protein, 18 aa, Mycobacterium
RSPCGDATGVAQSPDGVP

SEQ ID NO: 1224245 - protein, 5 aa, Mycobacterium
RSPCT

SEQ ID NO: 1224246 - protein, 8 aa, Mycobacterium
RSPDGSRA

SEQ ID NO: 1224247 - protein, 4 aa, Mycobacterium
RSPE

SEQ ID NO: 1224248 - protein, 15 aa, Mycobacterium
RSPEAAELTGDDADE

SEQ ID NO: 1224249 - protein, 6 aa, Mycobacterium
RSPEEI

SEQ ID NO: 1224250 - protein, 8 aa, Mycobacterium
RSPEGKVL

SEQ ID NO: 1224251 - protein, 5 aa, Mycobacterium
RSPEL

SEQ ID NO: 1224252 - protein, 6 aa, Mycobacterium
RSPELH

SEQ ID NO: 1224253 - protein, 12 aa, Mycobacterium
RSPEQIRDLAAL

SEQ ID NO: 1224254 - protein, 9 aa, Mycobacterium
RSPEWTGAG

SEQ ID NO: 1224255 - protein, 9 aa, Mycobacterium
RSPGAPSAH

SEQ ID NO: 1224256 - protein, 7 aa, Mycobacterium
RSPGTAP

SEQ ID NO: 1224257 - protein, 4 aa, Mycobacterium
RSPL

SEQ ID NO: 1224258 - protein, 5 aa, Mycobacterium
RSPMR

SEQ ID NO: 1224259 - protein, 10 aa, Mycobacterium
RSPNKRVDAE

SEQ ID NO: 1224260 - protein, 9 aa, Mycobacterium
RSPNTAGGL

SEQ ID NO: 1224261 - protein, 10 aa, Mycobacterium
RSPPARSSRD

SEQ ID NO: 1224262 - protein, 19 aa, Mycobacterium
RSPPLARDPGADPARPGIR

SEQ ID NO: 1224263 - protein, 8 aa, Mycobacterium
RSPRERSL

SEQ ID NO: 1224264 - protein, 19 aa, Mycobacterium
RSPSGTETVITSNDGASYI

SEQ ID NO: 1224265 - protein, 5 aa, Mycobacterium
RSPTA

SEQ ID NO: 1224266 - protein, 18 aa, Mycobacterium
RSPTSGRGAAPMSTRSTS

SEQ ID NO: 1224267 - protein, 4 aa, Mycobacterium
RSPV

SEQ ID NO: 1224268 - protein, 6 aa, Mycobacterium
RSPYRP

SEQ ID NO: 1224269 - protein, 6 aa, Mycobacterium
RSQAAG

SEQ ID NO: 1224270 - protein, 14 aa, Mycobacterium
RSQADDRKDTFERR

SEQ ID NO: 1224271 - protein, 4 aa, Mycobacterium
RSQC

SEQ ID NO: 1224272 - protein, 7 aa, Mycobacterium
RSQEERD

SEQ ID NO: 1224273 - protein, 7 aa, Mycobacterium
RSQFGGQ

SEQ ID NO: 1224274 - protein, 12 aa, Mycobacterium
RSQGERADDAVS

SEQ ID NO: 1224275 - protein, 7 aa, Mycobacterium
RSQPAQR

SEQ ID NO: 1224276 - protein, 21 aa, Mycobacterium
RSQPPHGAHEPHADDGHDTEH

SEQ ID NO: 1224277 - protein, 20 aa, Mycobacterium
RSQQGLEQLPAGALSQPELE

SEQ ID NO: 1224278 - protein, 7 aa, Mycobacterium
RSQSGTL

SEQ ID NO: 1224279 - protein, 4 aa, Mycobacterium
RSRA

SEQ ID NO: 1224280 - protein, 9 aa, Mycobacterium
RSRADADEM

SEQ ID NO: 1224281 - protein, 9 aa, Mycobacterium
RSRAGGRTV

SEQ ID NO: 1224282 - protein, 5 aa, Mycobacterium
RSRAT

SEQ ID NO: 1224283 - protein, 10 aa, Mycobacterium
RSRDAVTPRL

SEQ ID NO: 1224284 - protein, 11 aa, Mycobacterium
RSRDDDDSYTI

SEQ ID NO: 1224285 - protein, 7 aa, Mycobacterium
RSRDQID

SEQ ID NO: 1224286 - protein, 10 aa, Mycobacterium
RSREQAAEIA

SEQ ID NO: 1224287 - protein, 4 aa, Mycobacterium
RSRG

SEQ ID NO: 1224288 - protein, 22 aa, Mycobacterium
RSRGDEPGASQISQAAAQLRSA

SEQ ID NO: 1224289 - protein, 6 aa, Mycobacterium
RSRGEQ

SEQ ID NO: 1224290 - protein, 8 aa, Mycobacterium
RSRGGAHS

SEQ ID NO: 1224291 - protein, 9 aa, Mycobacterium
RSRGGSAQI

SEQ ID NO: 1224292 - protein, 12 aa, Mycobacterium
RSRGGSPPPGPL

SEQ ID NO: 1224293 - protein, 6 aa, Mycobacterium
RSRGLA

SEQ ID NO: 1224294 - protein, 15 aa, Mycobacterium
RSRGLHPTRSPEEYD

SEQ ID NO: 1224295 - protein, 10 aa, Mycobacterium
RSRGVDADTQ

SEQ ID NO: 1224296 - protein, 9 aa, Mycobacterium
RSRGVPPAL

SEQ ID NO: 1224297 - protein, 6 aa, Mycobacterium
RSRGYA

SEQ ID NO: 1224298 - protein, 5 aa, Mycobacterium
RSRHA

SEQ ID NO: 1224299 - protein, 6 aa, Mycobacterium
RSRHPR

SEQ ID NO: 1224300 - protein, 8 aa, Mycobacterium
RSRLPADN

SEQ ID NO: 1224301 - protein, 8 aa, Mycobacterium
RSRNKGAF

SEQ ID NO: 1224302 - protein, 7 aa, Mycobacterium
RSRPALR

SEQ ID NO: 1224303 - protein, 10 aa, Mycobacterium
RSRPAQAPGV

SEQ ID NO: 1224304 - protein, 20 aa, Mycobacterium
RSRPGAGTTVTATIPLPANR

SEQ ID NO: 1224305 - protein, 13 aa, Mycobacterium
RSRPGNKNDGCHV

SEQ ID NO: 1224306 - protein, 6 aa, Mycobacterium
RSRPMI

SEQ ID NO: 1224307 - protein, 6 aa, Mycobacterium
RSRPPT

SEQ ID NO: 1224308 - protein, 8 aa, Mycobacterium
RSRPTDTV

SEQ ID NO: 1224309 - protein, 7 aa, Mycobacterium
RSRQSTV

SEQ ID NO: 1224310 - protein, 8 aa, Mycobacterium
RSRRGATA

SEQ ID NO: 1224311 - protein, 4 aa, Mycobacterium
RSRS

SEQ ID NO: 1224312 - protein, 10 aa, Mycobacterium
RSRSNRTTDP

SEQ ID NO: 1224313 - protein, 14 aa, Mycobacterium
RSRSQLEHSLPELA

SEQ ID NO: 1224314 - protein, 5 aa, Mycobacterium
RSRSS

SEQ ID NO: 1224315 - protein, 15 aa, Mycobacterium
RSRSSGSEGAGGELG

SEQ ID NO: 1224316 - protein, 35 aa, Mycobacterium
RSRSSTPTTCGSASPHRRVTPTCSSSSASRRTTPC

SEQ ID NO: 1224317 - protein, 9 aa, Mycobacterium
RSRTEAVER

SEQ ID NO: 1224318 - protein, 12 aa, Mycobacterium
RSRTHRSGTTDS

SEQ ID NO: 1224319 - protein, 10 aa, Mycobacterium
RSRTKAEAGC

SEQ ID NO: 1224320 - protein, 5 aa, Mycobacterium
RSSAD

SEQ ID NO: 1224321 - protein, 6 aa, Mycobacterium
RSSAQI

SEQ ID NO: 1224322 - protein, 6 aa, Mycobacterium
RSSAVS

SEQ ID NO: 1224323 - protein, 4 aa, Mycobacterium
RSSD

SEQ ID NO: 1224324 - protein, 8 aa, Mycobacterium
RSSDGSVR

SEQ ID NO: 1224325 - protein, 10 aa, Mycobacterium
RSSDTAELSY

SEQ ID NO: 1224326 - protein, 18 aa, Mycobacterium
RSSELEGASSTAATRADQ

SEQ ID NO: 1224327 - protein, 7 aa, Mycobacterium
RSSEMAE

SEQ ID NO: 1224328 - protein, 5 aa, Mycobacterium
RSSEV

SEQ ID NO: 1224329 - protein, 8 aa, Mycobacterium
RSSFSGTE

SEQ ID NO: 1224330 - protein, 5 aa, Mycobacterium
RSSFV

SEQ ID NO: 1224331 - protein, 5 aa, Mycobacterium
RSSGG

SEQ ID NO: 1224332 - protein, 6 aa, Mycobacterium
RSSGGV

SEQ ID NO: 1224333 - protein, 8 aa, Mycobacterium
RSSGTHPL

SEQ ID NO: 1224334 - protein, 7 aa, Mycobacterium
RSSHGQS

SEQ ID NO: 1224335 - protein, 4 aa, Mycobacterium
RSSL

SEQ ID NO: 1224336 - protein, 4 aa, Mycobacterium
RSSP

SEQ ID NO: 1224337 - protein, 8 aa, Mycobacterium
RSSPGAEA

SEQ ID NO: 1224338 - protein, 6 aa, Mycobacterium
RSSPPR

SEQ ID NO: 1224339 - protein, 7 aa, Mycobacterium
RSSRGAE

SEQ ID NO: 1224340 - protein, 15 aa, Mycobacterium
RSSRGPDRVHTAPAP

SEQ ID NO: 1224341 - protein, 21 aa, Mycobacterium
RSSRTGPGGSDYDRPETIEET

SEQ ID NO: 1224342 - protein, 13 aa, Mycobacterium
RSSRTNGARTKRH

SEQ ID NO: 1224343 - protein, 4 aa, Mycobacterium
RSSS

SEQ ID NO: 1224344 - protein, 6 aa, Mycobacterium
RSSSCP

SEQ ID NO: 1224345 - protein, 9 aa, Mycobacterium
RSSSPERIK

SEQ ID NO: 1224346 - protein, 7 aa, Mycobacterium
RSSSRAA

SEQ ID NO: 1224347 - protein, 10 aa, Mycobacterium
RSSTAERMNP

SEQ ID NO: 1224348 - protein, 11 aa, Mycobacterium
RSSTGERENPY

SEQ ID NO: 1224349 - protein, 17 aa, Mycobacterium
RSTAARAGIAADTDELL

SEQ ID NO: 1224350 - protein, 21 aa, Mycobacterium
RSTAPSPPGVAPPDAAGESRA

SEQ ID NO: 1224351 - protein, 26 aa, Mycobacterium
RSTAVGDAQAIGDDGKAAITARVTAY

SEQ ID NO: 1224352 - protein, 21 aa, Mycobacterium
RSTDDPDSRLGASSIEQSGSV

SEQ ID NO: 1224353 - protein, 6 aa, Mycobacterium
RSTDGA

SEQ ID NO: 1224354 - protein, 9 aa, Mycobacterium
RSTDPEPLG

SEQ ID NO: 1224355 - protein, 6 aa, Mycobacterium
RSTDVS

SEQ ID NO: 1224356 - protein, 22 aa, Mycobacterium
RSTELEGSRSTNATRADQDAYV

SEQ ID NO: 1224357 - protein, 12 aa, Mycobacterium
RSTELHDHGGSL

SEQ ID NO: 1224358 - protein, 6 aa, Mycobacterium
RSTGAA

SEQ ID NO: 1224359 - protein, 14 aa, Mycobacterium
RSTGASVEFGTDAG

SEQ ID NO: 1224360 - protein, 8 aa, Mycobacterium
RSTGDDRW

SEQ ID NO: 1224361 - protein, 9 aa, Mycobacterium
RSTGDRAIP

SEQ ID NO: 1224362 - protein, 5 aa, Mycobacterium
RSTHD

SEQ ID NO: 1224363 - protein, 10 aa, Mycobacterium
RSTHDSAQVS

SEQ ID NO: 1224364 - protein, 7 aa, Mycobacterium
RSTPRSV

SEQ ID NO: 1224365 - protein, 5 aa, Mycobacterium
RSTRL

SEQ ID NO: 1224366 - protein, 4 aa, Mycobacterium
RSTS

SEQ ID NO: 1224367 - protein, 8 aa, Mycobacterium
RSTSCTRQ

SEQ ID NO: 1224368 - protein, 9 aa, Mycobacterium
RSTSDLPAE

SEQ ID NO: 1224369 - protein, 7 aa, Mycobacterium
RSTSGIP

SEQ ID NO: 1224370 - protein, 17 aa, Mycobacterium
RSTTNAPRTTSVTPTSL

SEQ ID NO: 1224371 - protein, 4 aa, Mycobacterium
RSTV

SEQ ID NO: 1224372 - protein, 6 aa, Mycobacterium
RSVARG

SEQ ID NO: 1224373 - protein, 9 aa, Mycobacterium
RSVDAAPGH

SEQ ID NO: 1224374 - protein, 7 aa, Mycobacterium
RSVDPGY

SEQ ID NO: 1224375 - protein, 7 aa, Mycobacterium
RSVDQRT

SEQ ID NO: 1224376 - protein, 18 aa, Mycobacterium
RSVGAQRALGRRGNAMTA

SEQ ID NO: 1224377 - protein, 5 aa, Mycobacterium
RSVGE

SEQ ID NO: 1224378 - protein, 7 aa, Mycobacterium
RSVGEVR

SEQ ID NO: 1224379 - protein, 19 aa, Mycobacterium
RSVGPGSPTASSNGRGCCG

SEQ ID NO: 1224380 - protein, 19 aa, Mycobacterium
RSVPGTLKQGEKSKDTGTT

SEQ ID NO: 1224381 - protein, 4 aa, Mycobacterium
RSVR

SEQ ID NO: 1224382 - protein, 15 aa, Mycobacterium
RSVREVADPASIQRG

SEQ ID NO: 1224383 - protein, 8 aa, Mycobacterium
RSVSRRDE

SEQ ID NO: 1224384 - protein, 15 aa, Mycobacterium
RSVTGHPSGTSRDVE

SEQ ID NO: 1224385 - protein, 5 aa, Mycobacterium
RSWAA

SEQ ID NO: 1224386 - protein, 14 aa, Mycobacterium
RSWEQVPDPEVQRA

SEQ ID NO: 1224387 - protein, 10 aa, Mycobacterium
RSWPRERTRA

SEQ ID NO: 1224388 - protein, 6 aa, Mycobacterium
RSYQGR

SEQ ID NO: 1224389 - protein, 22 aa, Mycobacterium
RSYQPSVSTRAGKDAELPGTIG

SEQ ID NO: 1224390 - protein, 5 aa, Mycobacterium
RSYRD

SEQ ID NO: 1224391 - protein, 6 aa, Mycobacterium
RSYTRK

SEQ ID NO: 1224392 - protein, 9 aa, Mycobacterium
RTAAAAAMQ

SEQ ID NO: 1224393 - protein, 10 aa, Mycobacterium
RTAADHRQIT

SEQ ID NO: 1224394 - protein, 8 aa, Mycobacterium
RTAAGRPD

SEQ ID NO: 1224395 - protein, 17 aa, Mycobacterium
RTAAGTSGSTSATTSRA

SEQ ID NO: 1224396 - protein, 9 aa, Mycobacterium
RTAANGLDS

SEQ ID NO: 1224397 - protein, 6 aa, Mycobacterium
RTAAQT

SEQ ID NO: 1224398 - protein, 7 aa, Mycobacterium
RTAASVK

SEQ ID NO: 1224399 - protein, 8 aa, Mycobacterium
RTAATDGS

SEQ ID NO: 1224400 - protein, 6 aa, Mycobacterium
RTADAD

SEQ ID NO: 1224401 - protein, 20 aa, Mycobacterium
RTADDLRRSGVADRNTAGTI

SEQ ID NO: 1224402 - protein, 25 aa, Mycobacterium
RTADGWSGSGADSAGAFAAATTAAV

SEQ ID NO: 1224403 - protein, 7 aa, Mycobacterium
RTADLND

SEQ ID NO: 1224404 - protein, 16 aa, Mycobacterium
RTADPVPAAGGAAGDA

SEQ ID NO: 1224405 - protein, 9 aa, Mycobacterium
RTAEEAAEL

SEQ ID NO: 1224406 - protein, 7 aa, Mycobacterium
RTAEGYA

SEQ ID NO: 1224407 - protein, 13 aa, Mycobacterium
RTAEPAAEFADPD

SEQ ID NO: 1224408 - protein, 5 aa, Mycobacterium
RTAER

SEQ ID NO: 1224409 - protein, 8 aa, Mycobacterium
RTAESAGY

SEQ ID NO: 1224410 - protein, 9 aa, Mycobacterium
RTAEVAEPV

SEQ ID NO: 1224411 - protein, 7 aa, Mycobacterium
RTAFDTT

SEQ ID NO: 1224412 - protein, 7 aa, Mycobacterium
RTAGASL

SEQ ID NO: 1224413 - protein, 10 aa, Mycobacterium
RTAGDDRTKV

SEQ ID NO: 1224414 - protein, 10 aa, Mycobacterium
RTAGSADKMR

SEQ ID NO: 1224415 - protein, 8 aa, Mycobacterium
RTAGSPVT

SEQ ID NO: 1224416 - protein, 5 aa, Mycobacterium
RTAGV

SEQ ID NO: 1224417 - protein, 8 aa, Mycobacterium
RTAGYTKG

SEQ ID NO: 1224418 - protein, 7 aa, Mycobacterium
RTAHQRR

SEQ ID NO: 1224419 - protein, 5 aa, Mycobacterium
RTAIS

SEQ ID NO: 1224420 - protein, 9 aa, Mycobacterium
RTALPGHEV

SEQ ID NO: 1224421 - protein, 7 aa, Mycobacterium
RTANGEP

SEQ ID NO: 1224422 - protein, 6 aa, Mycobacterium
RTANRD

SEQ ID NO: 1224423 - protein, 5 aa, Mycobacterium
RTAPS

SEQ ID NO: 1224424 - protein, 13 aa, Mycobacterium
RTAPSASPSITTF

SEQ ID NO: 1224425 - protein, 6 aa, Mycobacterium
RTAPSV

SEQ ID NO: 1224426 - protein, 5 aa, Mycobacterium
RTAPT

SEQ ID NO: 1224427 - protein, 7 aa, Mycobacterium
RTAPTEV

SEQ ID NO: 1224428 - protein, 6 aa, Mycobacterium
RTAPTV

SEQ ID NO: 1224429 - protein, 14 aa, Mycobacterium
RTAPVKDAVQPGRR

SEQ ID NO: 1224430 - protein, 14 aa, Mycobacterium
RTAQRMTSATKNLD

SEQ ID NO: 1224431 - protein, 10 aa, Mycobacterium
RTARSEESTQ

SEQ ID NO: 1224432 - protein, 9 aa, Mycobacterium
RTARVGAGA

SEQ ID NO: 1224433 - protein, 7 aa, Mycobacterium
RTASEEF

SEQ ID NO: 1224434 - protein, 8 aa, Mycobacterium
RTASPGVK

SEQ ID NO: 1224435 - protein, 9 aa, Mycobacterium
RTASPNTVR

SEQ ID NO: 1224436 - protein, 6 aa, Mycobacterium
RTATTS

SEQ ID NO: 1224437 - protein, 5 aa, Mycobacterium
RTAVS

SEQ ID NO: 1224438 - protein, 12 aa, Mycobacterium
RTAVSAPRQYYD

SEQ ID NO: 1224439 - protein, 10 aa, Mycobacterium
RTAWDNRQTV

SEQ ID NO: 1224440 - protein, 6 aa, Mycobacterium
RTAYDA

SEQ ID NO: 1224441 - protein, 6 aa, Mycobacterium
RTCAQE

SEQ ID NO: 1224442 - protein, 8 aa, Mycobacterium
RTDDPEGR

SEQ ID NO: 1224443 - protein, 4 aa, Mycobacterium
RTDE

SEQ ID NO: 1224444 - protein, 15 aa, Mycobacterium
RTDEFGGSLENRAKV

SEQ ID NO: 1224445 - protein, 4 aa, Mycobacterium
RTDG

SEQ ID NO: 1224446 - protein, 5 aa, Mycobacterium
RTDGD

SEQ ID NO: 1224447 - protein, 9 aa, Mycobacterium
RTDGPEVPH

SEQ ID NO: 1224448 - protein, 9 aa, Mycobacterium
RTDGTRNDG

SEQ ID NO: 1224449 - protein, 11 aa, Mycobacterium
RTDLSADTLPA

SEQ ID NO: 1224450 - protein, 10 aa, Mycobacterium
RTDPDAAKHR

SEQ ID NO: 1224451 - protein, 10 aa, Mycobacterium
RTDPGVAESV

SEQ ID NO: 1224452 - protein, 10 aa, Mycobacterium
RTDPQVATDG

SEQ ID NO: 1224453 - protein, 10 aa, Mycobacterium
RTDPSAPKHA

SEQ ID NO: 1224454 - protein, 38 aa, Mycobacterium
RTDPTPSFSAPGRMSSGSSGTGFGAPRPSPMRSGGGKK

SEQ ID NO: 1224455 - protein, 9 aa, Mycobacterium
RTDPTRDAP

SEQ ID NO: 1224456 - protein, 5 aa, Mycobacterium
RTDPV

SEQ ID NO: 1224457 - protein, 9 aa, Mycobacterium
RTDRRAHDE

SEQ ID NO: 1224458 - protein, 7 aa, Mycobacterium
RTDSAAG

SEQ ID NO: 1224459 - protein, 17 aa, Mycobacterium
RTDSESWDELDGRMRPA

SEQ ID NO: 1224460 - protein, 5 aa, Mycobacterium
RTDSI

SEQ ID NO: 1224461 - protein, 9 aa, Mycobacterium
RTDSPSSGV

SEQ ID NO: 1224462 - protein, 13 aa, Mycobacterium
RTDSTGTAPRTLT

SEQ ID NO: 1224463 - protein, 8 aa, Mycobacterium
RTDTGESV

SEQ ID NO: 1224464 - protein, 24 aa, Mycobacterium
RTDTTAQLGDRSTEQNVTEGSQQN

SEQ ID NO: 1224465 - protein, 6 aa, Mycobacterium
RTDTVS

SEQ ID NO: 1224466 - protein, 4 aa, Mycobacterium
RTDW

SEQ ID NO: 1224467 - protein, 5 aa, Mycobacterium
RTDYA

SEQ ID NO: 1224468 - protein, 5 aa, Mycobacterium
RTEAD

SEQ ID NO: 1224469 - protein, 6 aa, Mycobacterium
RTEAGV

SEQ ID NO: 1224470 - protein, 6 aa, Mycobacterium
RTEEQA

SEQ ID NO: 1224471 - protein, 11 aa, Mycobacterium
RTEETLAQSRA

SEQ ID NO: 1224472 - protein, 8 aa, Mycobacterium
RTEGGSSA

SEQ ID NO: 1224473 - protein, 16 aa, Mycobacterium
RTEHGAEFATDGDGEA

SEQ ID NO: 1224474 - protein, 9 aa, Mycobacterium
RTEHPHGLS

SEQ ID NO: 1224475 - protein, 8 aa, Mycobacterium
RTEHPSDD

SEQ ID NO: 1224476 - protein, 10 aa, Mycobacterium
RTEKANPALN

SEQ ID NO: 1224477 - protein, 11 aa, Mycobacterium
RTEKPRGRRKT

SEQ ID NO: 1224478 - protein, 11 aa, Mycobacterium
RTEPAGPEPTV

SEQ ID NO: 1224479 - protein, 10 aa, Mycobacterium
RTEPPHEGAR

SEQ ID NO: 1224480 - protein, 10 aa, Mycobacterium
RTEPTADLAE

SEQ ID NO: 1224481 - protein, 6 aa, Mycobacterium
RTERGD

SEQ ID NO: 1224482 - protein, 6 aa, Mycobacterium
RTERGL

SEQ ID NO: 1224483 - protein, 7 aa, Mycobacterium
RTERTAA

SEQ ID NO: 1224484 - protein, 9 aa, Mycobacterium
RTESAGKAD

SEQ ID NO: 1224485 - protein, 7 aa, Mycobacterium
RTETPEL

SEQ ID NO: 1224486 - protein, 7 aa, Mycobacterium
RTEVSQA

SEQ ID NO: 1224487 - protein, 9 aa, Mycobacterium
RTFETPDGV

SEQ ID NO: 1224488 - protein, 11 aa, Mycobacterium
RTFRDRREAGQ

SEQ ID NO: 1224489 - protein, 23 aa, Mycobacterium
RTFTGAESDTESTLTDSGGSVVG

SEQ ID NO: 1224490 - protein, 8 aa, Mycobacterium
RTFTGASA

SEQ ID NO: 1224491 - protein, 13 aa, Mycobacterium
RTGAAAGPPGRYT

SEQ ID NO: 1224492 - protein, 6 aa, Mycobacterium
RTGAGF

SEQ ID NO: 1224493 - protein, 17 aa, Mycobacterium
RTGAKVSRKHDKATTPF

SEQ ID NO: 1224494 - protein, 6 aa, Mycobacterium
RTGALD

SEQ ID NO: 1224495 - protein, 12 aa, Mycobacterium
RTGANLSLPAVG

SEQ ID NO: 1224496 - protein, 6 aa, Mycobacterium
RTGAPI

SEQ ID NO: 1224497 - protein, 6 aa, Mycobacterium
RTGAPL

SEQ ID NO: 1224498 - protein, 9 aa, Mycobacterium
RTGAQAVHP

SEQ ID NO: 1224499 - protein, 6 aa, Mycobacterium
RTGASR

SEQ ID NO: 1224500 - protein, 4 aa, Mycobacterium
RTGD

SEQ ID NO: 1224501 - protein, 8 aa, Mycobacterium
RTGDDGGV

SEQ ID NO: 1224502 - protein, 7 aa, Mycobacterium
RTGDGMG

SEQ ID NO: 1224503 - protein, 14 aa, Mycobacterium
RTGDGNGPLVNSRT

SEQ ID NO: 1224504 - protein, 7 aa, Mycobacterium
RTGDGTV

SEQ ID NO: 1224505 - protein, 5 aa, Mycobacterium
RTGDQ

SEQ ID NO: 1224506 - protein, 9 aa, Mycobacterium
RTGDRRISE

SEQ ID NO: 1224507 - protein, 5 aa, Mycobacterium
RTGEG

SEQ ID NO: 1224508 - protein, 6 aa, Mycobacterium
RTGEGD

SEQ ID NO: 1224509 - protein, 8 aa, Mycobacterium
RTGEGRDG

SEQ ID NO: 1224510 - protein, 8 aa, Mycobacterium
RTGEGSGG

SEQ ID NO: 1224511 - protein, 9 aa, Mycobacterium
RTGGDDERV

SEQ ID NO: 1224512 - protein, 7 aa, Mycobacterium
RTGGDEG

SEQ ID NO: 1224513 - protein, 8 aa, Mycobacterium
RTGGHSYG

SEQ ID NO: 1224514 - protein, 18 aa, Mycobacterium
RTGIGPATDGLPPGFPDP

SEQ ID NO: 1224515 - protein, 8 aa, Mycobacterium
RTGKTRCQ

SEQ ID NO: 1224516 - protein, 13 aa, Mycobacterium
RTGLAGGFGAPGV

SEQ ID NO: 1224517 - protein, 11 aa, Mycobacterium
RTGLHQQAQSG

SEQ ID NO: 1224518 - protein, 9 aa, Mycobacterium
RTGNEDTAR

SEQ ID NO: 1224519 - protein, 6 aa, Mycobacterium
RTGNPL

SEQ ID NO: 1224520 - protein, 12 aa, Mycobacterium
RTGNSVPPQDDT

SEQ ID NO: 1224521 - protein, 8 aa, Mycobacterium
RTGPDKHR

SEQ ID NO: 1224522 - protein, 16 aa, Mycobacterium
RTGPEGQEPRWRSMPS

SEQ ID NO: 1224523 - protein, 7 aa, Mycobacterium
RTGPGEG

SEQ ID NO: 1224524 - protein, 5 aa, Mycobacterium
RTGPL

SEQ ID NO: 1224525 - protein, 7 aa, Mycobacterium
RTGPNHP

SEQ ID NO: 1224526 - protein, 8 aa, Mycobacterium
RTGPPPLS

SEQ ID NO: 1224527 - protein, 8 aa, Mycobacterium
RTGPSGKR

SEQ ID NO: 1224528 - protein, 7 aa, Mycobacterium
RTGPTVA

SEQ ID NO: 1224529 - protein, 5 aa, Mycobacterium
RTGPV

SEQ ID NO: 1224530 - protein, 6 aa, Mycobacterium
RTGQPL

SEQ ID NO: 1224531 - protein, 7 aa, Mycobacterium
RTGQRYD

SEQ ID NO: 1224532 - protein, 6 aa, Mycobacterium
RTGQTD

SEQ ID NO: 1224533 - protein, 9 aa, Mycobacterium
RTGRAGKTG

SEQ ID NO: 1224534 - protein, 12 aa, Mycobacterium
RTGRGNNTEVEY

SEQ ID NO: 1224535 - protein, 12 aa, Mycobacterium
RTGRLGESGIGH

SEQ ID NO: 1224536 - protein, 5 aa, Mycobacterium
RTGRP

SEQ ID NO: 1224537 - protein, 6 aa, Mycobacterium
RTGRPA

SEQ ID NO: 1224538 - protein, 7 aa, Mycobacterium
RTGRRGA

SEQ ID NO: 1224539 - protein, 8 aa, Mycobacterium
RTGRTISP

SEQ ID NO: 1224540 - protein, 6 aa, Mycobacterium
RTGRTV

SEQ ID NO: 1224541 - protein, 6 aa, Mycobacterium
RTGSLE

SEQ ID NO: 1224542 - protein, 11 aa, Mycobacterium
RTGSRTRSKEM

SEQ ID NO: 1224543 - protein, 11 aa, Mycobacterium
RTGSSQPHSYA

SEQ ID NO: 1224544 - protein, 6 aa, Mycobacterium
RTGSVN

SEQ ID NO: 1224545 - protein, 4 aa, Mycobacterium
RTGT

SEQ ID NO: 1224546 - protein, 7 aa, Mycobacterium
RTGTALG

SEQ ID NO: 1224547 - protein, 5 aa, Mycobacterium
RTGTD

SEQ ID NO: 1224548 - protein, 10 aa, Mycobacterium
RTGTGKSSAL

SEQ ID NO: 1224549 - protein, 11 aa, Mycobacterium
RTGTGKSSALA

SEQ ID NO: 1224550 - protein, 11 aa, Mycobacterium
RTGTPTPTQVR

SEQ ID NO: 1224551 - protein, 16 aa, Mycobacterium
RTGTTARSGRSGGRPA

SEQ ID NO: 1224552 - protein, 9 aa, Mycobacterium
RTGTTGSHF

SEQ ID NO: 1224553 - protein, 6 aa, Mycobacterium
RTGTVY

SEQ ID NO: 1224554 - protein, 18 aa, Mycobacterium
RTGVDEDFGRGDEPYDRA

SEQ ID NO: 1224555 - protein, 9 aa, Mycobacterium
RTGVGGGAG

SEQ ID NO: 1224556 - protein, 5 aa, Mycobacterium
RTGVP

SEQ ID NO: 1224557 - protein, 12 aa, Mycobacterium
RTHAGEAAMSEG

SEQ ID NO: 1224558 - protein, 6 aa, Mycobacterium
RTHAGR

SEQ ID NO: 1224559 - protein, 5 aa, Mycobacterium
RTHDE

SEQ ID NO: 1224560 - protein, 4 aa, Mycobacterium
RTHG

SEQ ID NO: 1224561 - protein, 19 aa, Mycobacterium
RTHGKDGIRANSIAPGAVE

SEQ ID NO: 1224562 - protein, 6 aa, Mycobacterium
RTHGNR

SEQ ID NO: 1224563 - protein, 13 aa, Mycobacterium
RTHPDARSHASAA

SEQ ID NO: 1224564 - protein, 7 aa, Mycobacterium
RTHPGTT

SEQ ID NO: 1224565 - protein, 5 aa, Mycobacterium
RTHRA

SEQ ID NO: 1224566 - protein, 12 aa, Mycobacterium
RTIDGGADLNRR

SEQ ID NO: 1224567 - protein, 8 aa, Mycobacterium
RTIKGEQK

SEQ ID NO: 1224568 - protein, 4 aa, Mycobacterium
RTIT

SEQ ID NO: 1224569 - protein, 10 aa, Mycobacterium
RTKEPGSIGE

SEQ ID NO: 1224570 - protein, 11 aa, Mycobacterium
RTKGEEPSELG

SEQ ID NO: 1224571 - protein, 13 aa, Mycobacterium
RTKGTVPAKLPDG

SEQ ID NO: 1224572 - protein, 9 aa, Mycobacterium
RTKPGVTGA

SEQ ID NO: 1224573 - protein, 11 aa, Mycobacterium
RTKPRSPEGLK

SEQ ID NO: 1224574 - protein, 10 aa, Mycobacterium
RTKRPSVPGL

SEQ ID NO: 1224575 - protein, 9 aa, Mycobacterium
RTLAASDED

SEQ ID NO: 1224576 - protein, 4 aa, Mycobacterium
RTLD

SEQ ID NO: 1224577 - protein, 7 aa, Mycobacterium
RTLETRE

SEQ ID NO: 1224578 - protein, 9 aa, Mycobacterium
RTLSPADAL

SEQ ID NO: 1224579 - protein, 12 aa, Mycobacterium
RTLSTDPEDPEV

SEQ ID NO: 1224580 - protein, 8 aa, Mycobacterium
RTLTDSGL

SEQ ID NO: 1224581 - protein, 9 aa, Mycobacterium
RTLTSYPSL

SEQ ID NO: 1224582 - protein, 5 aa, Mycobacterium
RTLTT

SEQ ID NO: 1224583 - protein, 8 aa, Mycobacterium
RTMKDEKG

SEQ ID NO: 1224584 - protein, 6 aa, Mycobacterium
RTMRSA

SEQ ID NO: 1224585 - protein, 11 aa, Mycobacterium
RTNAGRNPDAI

SEQ ID NO: 1224586 - protein, 6 aa, Mycobacterium
RTNIGE

SEQ ID NO: 1224587 - protein, 20 aa, Mycobacterium
RTNRGYKDDFKRADGGEPAF

SEQ ID NO: 1224588 - protein, 8 aa, Mycobacterium
RTNSESIV

SEQ ID NO: 1224589 - protein, 9 aa, Mycobacterium
RTNTDPKGI

SEQ ID NO: 1224590 - protein, 5 aa, Mycobacterium
RTNTE

SEQ ID NO: 1224591 - protein, 4 aa, Mycobacterium
RTPA

SEQ ID NO: 1224592 - protein, 7 aa, Mycobacterium
RTPAGDR

SEQ ID NO: 1224593 - protein, 7 aa, Mycobacterium
RTPAKLD

SEQ ID NO: 1224594 - protein, 5 aa, Mycobacterium
RTPAM

SEQ ID NO: 1224595 - protein, 23 aa, Mycobacterium
RTPAPPPAPPRARPVTPTSPPPS

SEQ ID NO: 1224596 - protein, 7 aa, Mycobacterium
RTPASPP

SEQ ID NO: 1224597 - protein, 5 aa, Mycobacterium
RTPAY

SEQ ID NO: 1224598 - protein, 10 aa, Mycobacterium
RTPDGASTGP

SEQ ID NO: 1224599 - protein, 7 aa, Mycobacterium
RTPDGGW

SEQ ID NO: 1224600 - protein, 14 aa, Mycobacterium
RTPDPVDLTVPAAD

SEQ ID NO: 1224601 - protein, 9 aa, Mycobacterium
RTPDSLRPE

SEQ ID NO: 1224602 - protein, 14 aa, Mycobacterium
RTPDTPEGSLGPLT

SEQ ID NO: 1224603 - protein, 20 aa, Mycobacterium
RTPEDSLDHPQTAYEGRSVT

SEQ ID NO: 1224604 - protein, 7 aa, Mycobacterium
RTPEGAR

SEQ ID NO: 1224605 - protein, 6 aa, Mycobacterium
RTPEGV

SEQ ID NO: 1224606 - protein, 7 aa, Mycobacterium
RTPERYP

SEQ ID NO: 1224607 - protein, 9 aa, Mycobacterium
RTPGAQAQV

SEQ ID NO: 1224608 - protein, 9 aa, Mycobacterium
RTPGLTETD

SEQ ID NO: 1224609 - protein, 12 aa, Mycobacterium
RTPIGTSRRGTL

SEQ ID NO: 1224610 - protein, 5 aa, Mycobacterium
RTPIR

SEQ ID NO: 1224611 - protein, 20 aa, Mycobacterium
RTPNAGLRASGSSEMRDPTD

SEQ ID NO: 1224612 - protein, 5 aa, Mycobacterium
RTPNI

SEQ ID NO: 1224613 - protein, 4 aa, Mycobacterium
RTPP

SEQ ID NO: 1224614 - protein, 9 aa, Mycobacterium
RTPPAPATA

SEQ ID NO: 1224615 - protein, 10 aa, Mycobacterium
RTPPGRTGGD

SEQ ID NO: 1224616 - protein, 8 aa, Mycobacterium
RTPPPPAA

SEQ ID NO: 1224617 - protein, 10 aa, Mycobacterium
RTPPQPRDDP

SEQ ID NO: 1224618 - protein, 6 aa, Mycobacterium
RTPPTS

SEQ ID NO: 1224619 - protein, 19 aa, Mycobacterium
RTPPVGPLEPDVAPPNDER

SEQ ID NO: 1224620 - protein, 7 aa, Mycobacterium
RTPPWDR

SEQ ID NO: 1224621 - protein, 42 aa, Mycobacterium
RTPQPAPRLGEHTETYRRNSIPGRQAGGLAAGNPVSAQPTGA

SEQ ID NO: 1224622 - protein, 5 aa, Mycobacterium
RTPRQ

SEQ ID NO: 1224623 - protein, 6 aa, Mycobacterium
RTPRTD

SEQ ID NO: 1224624 - protein, 8 aa, Mycobacterium
RTPSDVPS

SEQ ID NO: 1224625 - protein, 6 aa, Mycobacterium
RTPSGK

SEQ ID NO: 1224626 - protein, 5 aa, Mycobacterium
RTPSK

SEQ ID NO: 1224627 - protein, 5 aa, Mycobacterium
RTPTA

SEQ ID NO: 1224628 - protein, 5 aa, Mycobacterium
RTPTI

SEQ ID NO: 1224629 - protein, 9 aa, Mycobacterium
RTQADIDGT

SEQ ID NO: 1224630 - protein, 8 aa, Mycobacterium
RTQAPTSG

SEQ ID NO: 1224631 - protein, 9 aa, Mycobacterium
RTQGPGQLD

SEQ ID NO: 1224632 - protein, 9 aa, Mycobacterium
RTQKPPAFG

SEQ ID NO: 1224633 - protein, 4 aa, Mycobacterium
RTQL

SEQ ID NO: 1224634 - protein, 6 aa, Mycobacterium
RTQLER

SEQ ID NO: 1224635 - protein, 10 aa, Mycobacterium
RTQQRPDGTW

SEQ ID NO: 1224636 - protein, 6 aa, Mycobacterium
RTQRAG

SEQ ID NO: 1224637 - protein, 9 aa, Mycobacterium
RTQREVGTR

SEQ ID NO: 1224638 - protein, 15 aa, Mycobacterium
RTQTDKIVPLRAGGK

SEQ ID NO: 1224639 - protein, 13 aa, Mycobacterium
RTRAADDGRPLHA

SEQ ID NO: 1224640 - protein, 13 aa, Mycobacterium
RTRAAQAEGGHYT

SEQ ID NO: 1224641 - protein, 11 aa, Mycobacterium
RTRAERTADGW

SEQ ID NO: 1224642 - protein, 8 aa, Mycobacterium
RTRAERVD

SEQ ID NO: 1224643 - protein, 18 aa, Mycobacterium
RTRAGDAHAAGQKPRTGV

SEQ ID NO: 1224644 - protein, 7 aa, Mycobacterium
RTRAKAG

SEQ ID NO: 1224645 - protein, 8 aa, Mycobacterium
RTRARDRN

SEQ ID NO: 1224646 - protein, 8 aa, Mycobacterium
RTRARGEQ

SEQ ID NO: 1224647 - protein, 14 aa, Mycobacterium
RTRATRTDGGWSLS

SEQ ID NO: 1224648 - protein, 10 aa, Mycobacterium
RTRDGRSFDT

SEQ ID NO: 1224649 - protein, 10 aa, Mycobacterium
RTREQERRAR

SEQ ID NO: 1224650 - protein, 18 aa, Mycobacterium
RTRGEATPQEETEARRQE

SEQ ID NO: 1224651 - protein, 11 aa, Mycobacterium
RTRGGTSYGQA

SEQ ID NO: 1224652 - protein, 5 aa, Mycobacterium
RTRGI

SEQ ID NO: 1224653 - protein, 10 aa, Mycobacterium
RTRGPFTTAE

SEQ ID NO: 1224654 - protein, 9 aa, Mycobacterium
RTRGRSTRA

SEQ ID NO: 1224655 - protein, 8 aa, Mycobacterium
RTRHGEQA

SEQ ID NO: 1224656 - protein, 11 aa, Mycobacterium
RTRPALEAAGD

SEQ ID NO: 1224657 - protein, 10 aa, Mycobacterium
RTRPDGIADD

SEQ ID NO: 1224658 - protein, 6 aa, Mycobacterium
RTRPEH

SEQ ID NO: 1224659 - protein, 7 aa, Mycobacterium
RTRPERP

SEQ ID NO: 1224660 - protein, 8 aa, Mycobacterium
RTRPGEEL

SEQ ID NO: 1224661 - protein, 7 aa, Mycobacterium
RTRPLAD

SEQ ID NO: 1224662 - protein, 5 aa, Mycobacterium
RTRPM

SEQ ID NO: 1224663 - protein, 9 aa, Mycobacterium
RTRPNDADT

SEQ ID NO: 1224664 - protein, 6 aa, Mycobacterium
RTRPPA

SEQ ID NO: 1224665 - protein, 7 aa, Mycobacterium
RTRPPVG

SEQ ID NO: 1224666 - protein, 13 aa, Mycobacterium
RTRPTDPDSAELS

SEQ ID NO: 1224667 - protein, 6 aa, Mycobacterium
RTRPTV

SEQ ID NO: 1224668 - protein, 4 aa, Mycobacterium
RTRQ

SEQ ID NO: 1224669 - protein, 11 aa, Mycobacterium
RTRRARAARRR

SEQ ID NO: 1224670 - protein, 9 aa, Mycobacterium
RTRRDNTDW

SEQ ID NO: 1224671 - protein, 5 aa, Mycobacterium
RTRRS

SEQ ID NO: 1224672 - protein, 8 aa, Mycobacterium
RTRSGDQI

SEQ ID NO: 1224673 - protein, 5 aa, Mycobacterium
RTRSN

SEQ ID NO: 1224674 - protein, 6 aa, Mycobacterium
RTRTDL

SEQ ID NO: 1224675 - protein, 5 aa, Mycobacterium
RTRTK

SEQ ID NO: 1224676 - protein, 5 aa, Mycobacterium
RTRVG

SEQ ID NO: 1224677 - protein, 6 aa, Mycobacterium
RTRVKD

SEQ ID NO: 1224678 - protein, 21 aa, Mycobacterium
RTRWHTTTDGADRVFTPRTYP

SEQ ID NO: 1224679 - protein, 17 aa, Mycobacterium
RTSAVDDLTDRASVPAD

SEQ ID NO: 1224680 - protein, 8 aa, Mycobacterium
RTSDADME

SEQ ID NO: 1224681 - protein, 12 aa, Mycobacterium
RTSDDGTAASAA

SEQ ID NO: 1224682 - protein, 6 aa, Mycobacterium
RTSDGE

SEQ ID NO: 1224683 - protein, 13 aa, Mycobacterium
RTSDPVRELPDGE

SEQ ID NO: 1224684 - protein, 6 aa, Mycobacterium
RTSDVP

SEQ ID NO: 1224685 - protein, 23 aa, Mycobacterium
RTSEPFSPNDNPTEFITSDTYGE

SEQ ID NO: 1224686 - protein, 11 aa, Mycobacterium
RTSGERADAEG

SEQ ID NO: 1224687 - protein, 6 aa, Mycobacterium
RTSKRT

SEQ ID NO: 1224688 - protein, 16 aa, Mycobacterium
RTSKSQALQSRDPATW

SEQ ID NO: 1224689 - protein, 4 aa, Mycobacterium
RTSL

SEQ ID NO: 1224690 - protein, 5 aa, Mycobacterium
RTSLG

SEQ ID NO: 1224691 - protein, 10 aa, Mycobacterium
RTSNAEPTLS

SEQ ID NO: 1224692 - protein, 11 aa, Mycobacterium
RTSPPDPQRRH

SEQ ID NO: 1224693 - protein, 5 aa, Mycobacterium
RTSQP

SEQ ID NO: 1224694 - protein, 12 aa, Mycobacterium
RTSQPFSATALT

SEQ ID NO: 1224695 - protein, 13 aa, Mycobacterium
RTSRELERHGPGL

SEQ ID NO: 1224696 - protein, 6 aa, Mycobacterium
RTSRYV

SEQ ID NO: 1224697 - protein, 13 aa, Mycobacterium
RTSSGSTPAEQTA

SEQ ID NO: 1224698 - protein, 10 aa, Mycobacterium
RTSSKVPASV

SEQ ID NO: 1224699 - protein, 11 aa, Mycobacterium
RTSSRSGPAYH

SEQ ID NO: 1224700 - protein, 10 aa, Mycobacterium
RTSTADRRRV

SEQ ID NO: 1224701 - protein, 5 aa, Mycobacterium
RTSTW

SEQ ID NO: 1224702 - protein, 4 aa, Mycobacterium
RTSV

SEQ ID NO: 1224703 - protein, 4 aa, Mycobacterium
RTTA

SEQ ID NO: 1224704 - protein, 8 aa, Mycobacterium
RTTATPEF

SEQ ID NO: 1224705 - protein, 13 aa, Mycobacterium
RTTDEDLAGKDLS

SEQ ID NO: 1224706 - protein, 7 aa, Mycobacterium
RTTDENR

SEQ ID NO: 1224707 - protein, 5 aa, Mycobacterium
RTTDG

SEQ ID NO: 1224708 - protein, 9 aa, Mycobacterium
RTTDPEPLG

SEQ ID NO: 1224709 - protein, 6 aa, Mycobacterium
RTTGAR

SEQ ID NO: 1224710 - protein, 6 aa, Mycobacterium
RTTGVG

SEQ ID NO: 1224711 - protein, 4 aa, Mycobacterium
RTTH

SEQ ID NO: 1224712 - protein, 5 aa, Mycobacterium
RTTHP

SEQ ID NO: 1224713 - protein, 16 aa, Mycobacterium
RTTNAGQGFQGFWRPT

SEQ ID NO: 1224714 - protein, 4 aa, Mycobacterium
RTTP

SEQ ID NO: 1224715 - protein, 13 aa, Mycobacterium
RTTPDDGAGESAA

SEQ ID NO: 1224716 - protein, 5 aa, Mycobacterium
RTTPG

SEQ ID NO: 1224717 - protein, 6 aa, Mycobacterium
RTTPPD

SEQ ID NO: 1224718 - protein, 5 aa, Mycobacterium
RTTQA

SEQ ID NO: 1224719 - protein, 7 aa, Mycobacterium
RTTQHRA

SEQ ID NO: 1224720 - protein, 10 aa, Mycobacterium
RTTRDHRSKG

SEQ ID NO: 1224721 - protein, 4 aa, Mycobacterium
RTTS

SEQ ID NO: 1224722 - protein, 8 aa, Mycobacterium
RTTSPGAI

SEQ ID NO: 1224723 - protein, 5 aa, Mycobacterium
RTTSV

SEQ ID NO: 1224724 - protein, 13 aa, Mycobacterium
RTTTAEGQQKLND

SEQ ID NO: 1224725 - protein, 6 aa, Mycobacterium
RTTTKP

SEQ ID NO: 1224726 - protein, 7 aa, Mycobacterium
RTTVTRR

SEQ ID NO: 1224727 - protein, 9 aa, Mycobacterium
RTTYGRTSD

SEQ ID NO: 1224728 - protein, 18 aa, Mycobacterium
RTVASGPARETISTETVS

SEQ ID NO: 1224729 - protein, 8 aa, Mycobacterium
RTVASTTT

SEQ ID NO: 1224730 - protein, 21 aa, Mycobacterium
RTVATPTSAATAADEPPPRAF

SEQ ID NO: 1224731 - protein, 7 aa, Mycobacterium
RTVETDV

SEQ ID NO: 1224732 - protein, 8 aa, Mycobacterium
RTVPATRA

SEQ ID NO: 1224733 - protein, 14 aa, Mycobacterium
RTVPEGSQPTPSGW

SEQ ID NO: 1224734 - protein, 9 aa, Mycobacterium
RTVQNTASS

SEQ ID NO: 1224735 - protein, 6 aa, Mycobacterium
RTVRSG

SEQ ID NO: 1224736 - protein, 5 aa, Mycobacterium
RTVSR

SEQ ID NO: 1224737 - protein, 6 aa, Mycobacterium
RTWDGR

SEQ ID NO: 1224738 - protein, 6 aa, Mycobacterium
RTWPNG

SEQ ID NO: 1224739 - protein, 18 aa, Mycobacterium
RTYRGQNIGSKRWRGSQP

SEQ ID NO: 1224740 - protein, 9 aa, Mycobacterium
RTYSQGAAH

SEQ ID NO: 1224741 - protein, 5 aa, Mycobacterium
RTYTP

SEQ ID NO: 1224742 - protein, 5 aa, Mycobacterium
RVAAA

SEQ ID NO: 1224743 - protein, 10 aa, Mycobacterium
RVAAGDGATM

SEQ ID NO: 1224744 - protein, 17 aa, Mycobacterium
RVAGGRVSAGYGPGREL

SEQ ID NO: 1224745 - protein, 8 aa, Mycobacterium
RVAGGSAG

SEQ ID NO: 1224746 - protein, 8 aa, Mycobacterium
RVANQAPD

SEQ ID NO: 1224747 - protein, 5 aa, Mycobacterium
RVANS

SEQ ID NO: 1224748 - protein, 4 aa, Mycobacterium
RVAP

SEQ ID NO: 1224749 - protein, 14 aa, Mycobacterium
RVAPEGTGSLRDNA

SEQ ID NO: 1224750 - protein, 16 aa, Mycobacterium
RVAPPGTEVPMVEIRV

SEQ ID NO: 1224751 - protein, 6 aa, Mycobacterium
RVAQQI

SEQ ID NO: 1224752 - protein, 8 aa, Mycobacterium
RVARGQNP

SEQ ID NO: 1224753 - protein, 10 aa, Mycobacterium
RVASAADAQE

SEQ ID NO: 1224754 - protein, 6 aa, Mycobacterium
RVATKT

SEQ ID NO: 1224755 - protein, 7 aa, Mycobacterium
RVAYGAD

SEQ ID NO: 1224756 - protein, 10 aa, Mycobacterium
RVDAAAGSRI

SEQ ID NO: 1224757 - protein, 5 aa, Mycobacterium
RVDAG

SEQ ID NO: 1224758 - protein, 13 aa, Mycobacterium
RVDETRTAAMGGS

SEQ ID NO: 1224759 - protein, 5 aa, Mycobacterium
RVDEV

SEQ ID NO: 1224760 - protein, 12 aa, Mycobacterium
RVDGDRGVVTRL

SEQ ID NO: 1224761 - protein, 7 aa, Mycobacterium
RVDGTSG

SEQ ID NO: 1224762 - protein, 5 aa, Mycobacterium
RVDMP

SEQ ID NO: 1224763 - protein, 6 aa, Mycobacterium
RVDPAA

SEQ ID NO: 1224764 - protein, 15 aa, Mycobacterium
RVDPETLDPDDPPAG

SEQ ID NO: 1224765 - protein, 7 aa, Mycobacterium
RVDPKSD

SEQ ID NO: 1224766 - protein, 22 aa, Mycobacterium
RVDPNTPTELAPADKIPNVVVV

SEQ ID NO: 1224767 - protein, 8 aa, Mycobacterium
RVDPTAAD

SEQ ID NO: 1224768 - protein, 4 aa, Mycobacterium
RVDQ

SEQ ID NO: 1224769 - protein, 9 aa, Mycobacterium
RVDSPQDAA

SEQ ID NO: 1224770 - protein, 10 aa, Mycobacterium
RVDTTGGLYP

SEQ ID NO: 1224771 - protein, 13 aa, Mycobacterium
RVEDPVGSAPHRG

SEQ ID NO: 1224772 - protein, 5 aa, Mycobacterium
RVEEA

SEQ ID NO: 1224773 - protein, 7 aa, Mycobacterium
RVEPGSD

SEQ ID NO: 1224774 - protein, 13 aa, Mycobacterium
RVERDATGPDGQQ

SEQ ID NO: 1224775 - protein, 14 aa, Mycobacterium
RVESEGGDARSKVR

SEQ ID NO: 1224776 - protein, 14 aa, Mycobacterium
RVGAKADDQIRRGA

SEQ ID NO: 1224777 - protein, 16 aa, Mycobacterium
RVGAPAGEVTFPDPGG

SEQ ID NO: 1224778 - protein, 7 aa, Mycobacterium
RVGARDG

SEQ ID NO: 1224779 - protein, 12 aa, Mycobacterium
RVGEAVAKGRGR

SEQ ID NO: 1224780 - protein, 5 aa, Mycobacterium
RVGER

SEQ ID NO: 1224781 - protein, 17 aa, Mycobacterium
RVGESGAPAVGDTAPAL

SEQ ID NO: 1224782 - protein, 10 aa, Mycobacterium
RVGETRPPDQ

SEQ ID NO: 1224783 - protein, 7 aa, Mycobacterium
RVGGAAQ

SEQ ID NO: 1224784 - protein, 15 aa, Mycobacterium
RVGGDLSDAGSRSEM

SEQ ID NO: 1224785 - protein, 6 aa, Mycobacterium
RVGGQT

SEQ ID NO: 1224786 - protein, 6 aa, Mycobacterium
RVGPSD

SEQ ID NO: 1224787 - protein, 15 aa, Mycobacterium
RVGSPYSWGATGPNA

SEQ ID NO: 1224788 - protein, 4 aa, Mycobacterium
RVGT

SEQ ID NO: 1224789 - protein, 9 aa, Mycobacterium
RVGTAGDMA

SEQ ID NO: 1224790 - protein, 8 aa, Mycobacterium
RVKAAGGT

SEQ ID NO: 1224791 - protein, 5 aa, Mycobacterium
RVKDE

SEQ ID NO: 1224792 - protein, 11 aa, Mycobacterium
RVKDGDATRHP

SEQ ID NO: 1224793 - protein, 7 aa, Mycobacterium
RVKEPDI

SEQ ID NO: 1224794 - protein, 8 aa, Mycobacterium
RVNEAAKT

SEQ ID NO: 1224795 - protein, 7 aa, Mycobacterium
RVNPDKL

SEQ ID NO: 1224796 - protein, 17 aa, Mycobacterium
RVNQSTTPLDANGMPGV

SEQ ID NO: 1224797 - protein, 4 aa, Mycobacterium
RVNT

SEQ ID NO: 1224798 - protein, 4 aa, Mycobacterium
RVNV

SEQ ID NO: 1224799 - protein, 9 aa, Mycobacterium
RVPAAGTGT

SEQ ID NO: 1224800 - protein, 5 aa, Mycobacterium
RVPAG

SEQ ID NO: 1224801 - protein, 9 aa, Mycobacterium
RVPAPSSRR

SEQ ID NO: 1224802 - protein, 11 aa, Mycobacterium
RVPDELREQAK

SEQ ID NO: 1224803 - protein, 16 aa, Mycobacterium
RVPDGGPSLWPMWRQP

SEQ ID NO: 1224804 - protein, 12 aa, Mycobacterium
RVPDGGSADVDR

SEQ ID NO: 1224805 - protein, 4 aa, Mycobacterium
RVPE

SEQ ID NO: 1224806 - protein, 9 aa, Mycobacterium
RVPGADANP

SEQ ID NO: 1224807 - protein, 6 aa, Mycobacterium
RVPGAQ

SEQ ID NO: 1224808 - protein, 6 aa, Mycobacterium
RVPGGG

SEQ ID NO: 1224809 - protein, 19 aa, Mycobacterium
RVPGGRVRPAYGPGRDLAD

SEQ ID NO: 1224810 - protein, 12 aa, Mycobacterium
RVPLPSAAGWTS

SEQ ID NO: 1224811 - protein, 8 aa, Mycobacterium
RVPPAGPL

SEQ ID NO: 1224812 - protein, 5 aa, Mycobacterium
RVPPD

SEQ ID NO: 1224813 - protein, 10 aa, Mycobacterium
RVPPEAKDNR

SEQ ID NO: 1224814 - protein, 7 aa, Mycobacterium
RVPPPDR

SEQ ID NO: 1224815 - protein, 5 aa, Mycobacterium
RVPRG

SEQ ID NO: 1224816 - protein, 12 aa, Mycobacterium
RVPSEREREQLR

SEQ ID NO: 1224817 - protein, 5 aa, Mycobacterium
RVQDG

SEQ ID NO: 1224818 - protein, 13 aa, Mycobacterium
RVQDGRGGAGKGM

SEQ ID NO: 1224819 - protein, 18 aa, Mycobacterium
RVQGGDDLTGAAHGAGFA

SEQ ID NO: 1224820 - protein, 6 aa, Mycobacterium
RVQGPA

SEQ ID NO: 1224821 - protein, 6 aa, Mycobacterium
RVQPGD

SEQ ID NO: 1224822 - protein, 6 aa, Mycobacterium
RVQPGN

SEQ ID NO: 1224823 - protein, 7 aa, Mycobacterium
RVQPKPE

SEQ ID NO: 1224824 - protein, 12 aa, Mycobacterium
RVQPPSQRYVSY

SEQ ID NO: 1224825 - protein, 13 aa, Mycobacterium
RVQRSERKLSPEL

SEQ ID NO: 1224826 - protein, 8 aa, Mycobacterium
RVQSTESV

SEQ ID NO: 1224827 - protein, 6 aa, Mycobacterium
RVRDAG

SEQ ID NO: 1224828 - protein, 8 aa, Mycobacterium
RVRDSPPV

SEQ ID NO: 1224829 - protein, 9 aa, Mycobacterium
RVRDYPKGV

SEQ ID NO: 1224830 - protein, 12 aa, Mycobacterium
RVREQHDVLLGA

SEQ ID NO: 1224831 - protein, 5 aa, Mycobacterium
RVRPA

SEQ ID NO: 1224832 - protein, 11 aa, Mycobacterium
RVRPEADRARD

SEQ ID NO: 1224833 - protein, 22 aa, Mycobacterium
RVRPGRGSRPRTKTRPEHADAR

SEQ ID NO: 1224834 - protein, 22 aa, Mycobacterium
RVRPGRGSRPRTKTRPEHAEAR

SEQ ID NO: 1224835 - protein, 6 aa, Mycobacterium
RVRRPD

SEQ ID NO: 1224836 - protein, 8 aa, Mycobacterium
RVRSGDRA

SEQ ID NO: 1224837 - protein, 7 aa, Mycobacterium
RVRSNES

SEQ ID NO: 1224838 - protein, 8 aa, Mycobacterium
RVRTPTTT

SEQ ID NO: 1224839 - protein, 20 aa, Mycobacterium
RVRTSPSSRGREGDTGDRGH

SEQ ID NO: 1224840 - protein, 4 aa, Mycobacterium
RVSA

SEQ ID NO: 1224841 - protein, 6 aa, Mycobacterium
RVSAGQ

SEQ ID NO: 1224842 - protein, 4 aa, Mycobacterium
RVSD

SEQ ID NO: 1224843 - protein, 7 aa, Mycobacterium
RVSDAAA

SEQ ID NO: 1224844 - protein, 9 aa, Mycobacterium
RVSDSENAS

SEQ ID NO: 1224845 - protein, 6 aa, Mycobacterium
RVSESP

SEQ ID NO: 1224846 - protein, 18 aa, Mycobacterium
RVSGADRQSLAPEAEPVQ

SEQ ID NO: 1224847 - protein, 9 aa, Mycobacterium
RVSGRPANA

SEQ ID NO: 1224848 - protein, 7 aa, Mycobacterium
RVSGTPV

SEQ ID NO: 1224849 - protein, 8 aa, Mycobacterium
RVSGTPVQ

SEQ ID NO: 1224850 - protein, 9 aa, Mycobacterium
RVSKNDARL

SEQ ID NO: 1224851 - protein, 15 aa, Mycobacterium
RVSPDRPSAPPLGGA

SEQ ID NO: 1224852 - protein, 15 aa, Mycobacterium
RVSRSSALASKATGF

SEQ ID NO: 1224853 - protein, 15 aa, Mycobacterium
RVSSGDASVARQARE

SEQ ID NO: 1224854 - protein, 6 aa, Mycobacterium
RVSSGE

SEQ ID NO: 1224855 - protein, 10 aa, Mycobacterium
RVSSKKRDDL

SEQ ID NO: 1224856 - protein, 6 aa, Mycobacterium
RVSSST

SEQ ID NO: 1224857 - protein, 4 aa, Mycobacterium
RVST

SEQ ID NO: 1224858 - protein, 7 aa, Mycobacterium
RVSTAED

SEQ ID NO: 1224859 - protein, 5 aa, Mycobacterium
RVSTT

SEQ ID NO: 1224860 - protein, 6 aa, Mycobacterium
RVTAEG

SEQ ID NO: 1224861 - protein, 10 aa, Mycobacterium
RVTAERTVPV

SEQ ID NO: 1224862 - protein, 8 aa, Mycobacterium
RVTDPGAV

SEQ ID NO: 1224863 - protein, 8 aa, Mycobacterium
RVTGTPDI

SEQ ID NO: 1224864 - protein, 12 aa, Mycobacterium
RVTGVRTADGSE

SEQ ID NO: 1224865 - protein, 6 aa, Mycobacterium
RVTPAG

SEQ ID NO: 1224866 - protein, 10 aa, Mycobacterium
RVTPRPAEEL

SEQ ID NO: 1224867 - protein, 10 aa, Mycobacterium
RVTPRTGQDL

SEQ ID NO: 1224868 - protein, 21 aa, Mycobacterium
RVTSSGTGGSASEADVRAAMA

SEQ ID NO: 1224869 - protein, 16 aa, Mycobacterium
RVVTSGRAQPESLPSG

SEQ ID NO: 1224870 - protein, 15 aa, Mycobacterium
RWAAPPLKAWSGRDE

SEQ ID NO: 1224871 - protein, 9 aa, Mycobacterium
RWDPNSTRK

SEQ ID NO: 1224872 - protein, 11 aa, Mycobacterium
RWEDERPDHAL

SEQ ID NO: 1224873 - protein, 13 aa, Mycobacterium
RWENGNKGKYQDQ

SEQ ID NO: 1224874 - protein, 9 aa, Mycobacterium
RWGATGARS

SEQ ID NO: 1224875 - protein, 7 aa, Mycobacterium
RWGRPPN

SEQ ID NO: 1224876 - protein, 8 aa, Mycobacterium
RWNQNSEE

SEQ ID NO: 1224877 - protein, 6 aa, Mycobacterium
RWPDGA

SEQ ID NO: 1224878 - protein, 7 aa, Mycobacterium
RWPQPDT

SEQ ID NO: 1224879 - protein, 17 aa, Mycobacterium
RWPQRPDRADSVAPQSL

SEQ ID NO: 1224880 - protein, 6 aa, Mycobacterium
RWPRAG

SEQ ID NO: 1224881 - protein, 17 aa, Mycobacterium
RWRDSGMDGTPARQQQR

SEQ ID NO: 1224882 - protein, 5 aa, Mycobacterium
RWRPP

SEQ ID NO: 1224883 - protein, 4 aa, Mycobacterium
RWSD

SEQ ID NO: 1224884 - protein, 87 aa, Mycobacterium
RWSGAGAGSGGGTGASAGSTGAGAAAGAAAGAAAGAAAGAAAGAGAGAGAGAGAGAGAGAESSGTATGPGAGGWAPGARCGTSPCGS

SEQ ID NO: 1224885 - protein, 16 aa, Mycobacterium
RWSPTWSDDQRAAGYA

SEQ ID NO: 1224886 - protein, 5 aa, Mycobacterium
RWSTT

SEQ ID NO: 1224887 - protein, 16 aa, Mycobacterium
RWTPQWSDGQRAEGYA

SEQ ID NO: 1224888 - protein, 10 aa, Mycobacterium
RWTTGQRGEI

SEQ ID NO: 1224889 - protein, 5 aa, Mycobacterium
RYAEA

SEQ ID NO: 1224890 - protein, 25 aa, Mycobacterium
RYAGPKPIDAGESSTAPTGSAAGPG

SEQ ID NO: 1224891 - protein, 10 aa, Mycobacterium
RYAGQRVPRV

SEQ ID NO: 1224892 - protein, 8 aa, Mycobacterium
RYANPDAT

SEQ ID NO: 1224893 - protein, 7 aa, Mycobacterium
RYAPESF

SEQ ID NO: 1224894 - protein, 11 aa, Mycobacterium
RYAQTPNQGVG

SEQ ID NO: 1224895 - protein, 6 aa, Mycobacterium
RYDEAT

SEQ ID NO: 1224896 - protein, 6 aa, Mycobacterium
RYDEAV

SEQ ID NO: 1224897 - protein, 6 aa, Mycobacterium
RYDEEA

SEQ ID NO: 1224898 - protein, 9 aa, Mycobacterium
RYDENSPRE

SEQ ID NO: 1224899 - protein, 4 aa, Mycobacterium
RYDP

SEQ ID NO: 1224900 - protein, 10 aa, Mycobacterium
RYDPAPDDPF

SEQ ID NO: 1224901 - protein, 10 aa, Mycobacterium
RYDPGSDSGK

SEQ ID NO: 1224902 - protein, 5 aa, Mycobacterium
RYDQQ

SEQ ID NO: 1224903 - protein, 11 aa, Mycobacterium
RYDSGARADME

SEQ ID NO: 1224904 - protein, 10 aa, Mycobacterium
RYDSSVAGTA

SEQ ID NO: 1224905 - protein, 8 aa, Mycobacterium
RYEAGNAD

SEQ ID NO: 1224906 - protein, 8 aa, Mycobacterium
RYEASGEI

SEQ ID NO: 1224907 - protein, 7 aa, Mycobacterium
RYEGPTG

SEQ ID NO: 1224908 - protein, 6 aa, Mycobacterium
RYESAK

SEQ ID NO: 1224909 - protein, 11 aa, Mycobacterium
RYESGDRADME

SEQ ID NO: 1224910 - protein, 12 aa, Mycobacterium
RYETRDAGRDHR

SEQ ID NO: 1224911 - protein, 9 aa, Mycobacterium
RYGAQGGDW

SEQ ID NO: 1224912 - protein, 13 aa, Mycobacterium
RYGDTRLEMAAVD

SEQ ID NO: 1224913 - protein, 4 aa, Mycobacterium
RYGE

SEQ ID NO: 1224914 - protein, 8 aa, Mycobacterium
RYGGGRPM

SEQ ID NO: 1224915 - protein, 10 aa, Mycobacterium
RYGGPAPSLS

SEQ ID NO: 1224916 - protein, 10 aa, Mycobacterium
RYGGQEAPYP

SEQ ID NO: 1224917 - protein, 5 aa, Mycobacterium
RYGGT

SEQ ID NO: 1224918 - protein, 5 aa, Mycobacterium
RYGKT

SEQ ID NO: 1224919 - protein, 7 aa, Mycobacterium
RYGPRPT

SEQ ID NO: 1224920 - protein, 10 aa, Mycobacterium
RYGRSEPLPA

SEQ ID NO: 1224921 - protein, 7 aa, Mycobacterium
RYGRTRS

SEQ ID NO: 1224922 - protein, 6 aa, Mycobacterium
RYGSTE

SEQ ID NO: 1224923 - protein, 10 aa, Mycobacterium
RYKPGEPPLP

SEQ ID NO: 1224924 - protein, 20 aa, Mycobacterium
RYNEARNRRSPQGYADGVPL

SEQ ID NO: 1224925 - protein, 6 aa, Mycobacterium
RYNGRG

SEQ ID NO: 1224926 - protein, 5 aa, Mycobacterium
RYNRE

SEQ ID NO: 1224927 - protein, 5 aa, Mycobacterium
RYNSR

SEQ ID NO: 1224928 - protein, 13 aa, Mycobacterium
RYNSSRGPSYSSY

SEQ ID NO: 1224929 - protein, 4 aa, Mycobacterium
RYPA

SEQ ID NO: 1224930 - protein, 12 aa, Mycobacterium
RYPAGGVSPETV

SEQ ID NO: 1224931 - protein, 4 aa, Mycobacterium
RYPD

SEQ ID NO: 1224932 - protein, 9 aa, Mycobacterium
RYPDGRPHH

SEQ ID NO: 1224933 - protein, 7 aa, Mycobacterium
RYPDRSQ

SEQ ID NO: 1224934 - protein, 4 aa, Mycobacterium
RYPE

SEQ ID NO: 1224935 - protein, 7 aa, Mycobacterium
RYPEPVP

SEQ ID NO: 1224936 - protein, 4 aa, Mycobacterium
RYPG

SEQ ID NO: 1224937 - protein, 7 aa, Mycobacterium
RYPGAAR

SEQ ID NO: 1224938 - protein, 7 aa, Mycobacterium
RYPGTEG

SEQ ID NO: 1224939 - protein, 15 aa, Mycobacterium
RYPQDSSGKSVVSPV

SEQ ID NO: 1224940 - protein, 14 aa, Mycobacterium
RYPQRVRRRDERPA

SEQ ID NO: 1224941 - protein, 14 aa, Mycobacterium
RYPSATPDDLQETV

SEQ ID NO: 1224942 - protein, 9 aa, Mycobacterium
RYPSTRVER

SEQ ID NO: 1224943 - protein, 5 aa, Mycobacterium
RYPTR

SEQ ID NO: 1224944 - protein, 8 aa, Mycobacterium
RYRASSGP

SEQ ID NO: 1224945 - protein, 13 aa, Mycobacterium
RYRSDDGRLDGDK

SEQ ID NO: 1224946 - protein, 4 aa, Mycobacterium
RYRT

SEQ ID NO: 1224947 - protein, 6 aa, Mycobacterium
RYSAPT

SEQ ID NO: 1224948 - protein, 10 aa, Mycobacterium
RYSGRGNPEL

SEQ ID NO: 1224949 - protein, 16 aa, Mycobacterium
RYSRSDTVAETPATEG

SEQ ID NO: 1224950 - protein, 8 aa, Mycobacterium
RYSSLDGY

SEQ ID NO: 1224951 - protein, 10 aa, Mycobacterium
RYSVPPELAS

SEQ ID NO: 1224952 - protein, 9 aa, Mycobacterium
RYTADEPEV

SEQ ID NO: 1224953 - protein, 13 aa, Mycobacterium
RYTGGPDPLAPPV

SEQ ID NO: 1224954 - protein, 10 aa, Mycobacterium
RYTGSVADAE

SEQ ID NO: 1224955 - protein, 10 aa, Mycobacterium
RYTPAPAGTG

SEQ ID NO: 1224956 - protein, 8 aa, Mycobacterium
RYTPLGES

SEQ ID NO: 1224957 - protein, 7 aa, Mycobacterium
RYTREKR

SEQ ID NO: 1224958 - protein, 10 aa, Mycobacterium
SAAAAARDAG

SEQ ID NO: 1224959 - protein, 8 aa, Mycobacterium
SAAAAEGL

SEQ ID NO: 1224960 - protein, 12 aa, Mycobacterium
SAAAAEKAFTGE

SEQ ID NO: 1224961 - protein, 16 aa, Mycobacterium
SAAAALPGTTLPSPAE

SEQ ID NO: 1224962 - protein, 12 aa, Mycobacterium
SAAAASARGDVD

SEQ ID NO: 1224963 - protein, 12 aa, Mycobacterium
SAAAGSSATAPQ

SEQ ID NO: 1224964 - protein, 20 aa, Mycobacterium
SAAAPPDSTPRLGDGGEDRR

SEQ ID NO: 1224965 - protein, 6 aa, Mycobacterium
SAAAPQ

SEQ ID NO: 1224966 - protein, 6 aa, Mycobacterium
SAAAQR

SEQ ID NO: 1224967 - protein, 7 aa, Mycobacterium
SAAARTG

SEQ ID NO: 1224968 - protein, 24 aa, Mycobacterium
SAAARYESVDQAGRDAIEQVALPG

SEQ ID NO: 1224969 - protein, 5 aa, Mycobacterium
SAAAS

SEQ ID NO: 1224970 - protein, 18 aa, Mycobacterium
SAAASALPRASAASRRWS

SEQ ID NO: 1224971 - protein, 9 aa, Mycobacterium
SAAATERCE

SEQ ID NO: 1224972 - protein, 12 aa, Mycobacterium
SAADALRTAATP

SEQ ID NO: 1224973 - protein, 5 aa, Mycobacterium
SAADL

SEQ ID NO: 1224974 - protein, 10 aa, Mycobacterium
SAADPQKWTP

SEQ ID NO: 1224975 - protein, 9 aa, Mycobacterium
SAADTSLDR

SEQ ID NO: 1224976 - protein, 6 aa, Mycobacterium
SAAEAA

SEQ ID NO: 1224977 - protein, 12 aa, Mycobacterium
SAAEAEKAFTGE

SEQ ID NO: 1224978 - protein, 8 aa, Mycobacterium
SAAEDPEL

SEQ ID NO: 1224979 - protein, 8 aa, Mycobacterium
SAAEESGV

SEQ ID NO: 1224980 - protein, 7 aa, Mycobacterium
SAAEKQG

SEQ ID NO: 1224981 - protein, 12 aa, Mycobacterium
SAAEPSGTSAGT

SEQ ID NO: 1224982 - protein, 6 aa, Mycobacterium
SAAEQF

SEQ ID NO: 1224983 - protein, 6 aa, Mycobacterium
SAAERT

SEQ ID NO: 1224984 - protein, 11 aa, Mycobacterium
SAAETGEIDDA

SEQ ID NO: 1224985 - protein, 7 aa, Mycobacterium
SAAGARR

SEQ ID NO: 1224986 - protein, 9 aa, Mycobacterium
SAAGASTRQ

SEQ ID NO: 1224987 - protein, 11 aa, Mycobacterium
SAAGEENSGSL

SEQ ID NO: 1224988 - protein, 10 aa, Mycobacterium
SAAGGPELDA

SEQ ID NO: 1224989 - protein, 8 aa, Mycobacterium
SAAGPLGA

SEQ ID NO: 1224990 - protein, 10 aa, Mycobacterium
SAAGRAAAAA

SEQ ID NO: 1224991 - protein, 6 aa, Mycobacterium
SAAGRQ

SEQ ID NO: 1224992 - protein, 11 aa, Mycobacterium
SAAGVAAGRAG

SEQ ID NO: 1224993 - protein, 18 aa, Mycobacterium
SAAGVKGTPLHTPYTASK

SEQ ID NO: 1224994 - protein, 7 aa, Mycobacterium
SAAGVSP

SEQ ID NO: 1224995 - protein, 7 aa, Mycobacterium
SAAHGDL

SEQ ID NO: 1224996 - protein, 5 aa, Mycobacterium
SAAIA

SEQ ID NO: 1224997 - protein, 9 aa, Mycobacterium
SAAKATVGR

SEQ ID NO: 1224998 - protein, 7 aa, Mycobacterium
SAAKETV

SEQ ID NO: 1224999 - protein, 8 aa, Mycobacterium
SAAKGEVR

SEQ ID NO: 1225000 - protein, 22 aa, Mycobacterium
SAAKRTDGWGARTRMKDASSTD

SEQ ID NO: 1225001 - protein, 16 aa, Mycobacterium
SAAKTGRVIKPVLVTE

SEQ ID NO: 1225002 - protein, 16 aa, Mycobacterium
SAAKTGRVIKPVPVTE

SEQ ID NO: 1225003 - protein, 4 aa, Mycobacterium
SAAL

SEQ ID NO: 1225004 - protein, 17 aa, Mycobacterium
SAALRKGYEKTRVRDII

SEQ ID NO: 1225005 - protein, 8 aa, Mycobacterium
SAANGKRL

SEQ ID NO: 1225006 - protein, 10 aa, Mycobacterium
SAAPAARTTA

SEQ ID NO: 1225007 - protein, 6 aa, Mycobacterium
SAAPAG

SEQ ID NO: 1225008 - protein, 6 aa, Mycobacterium
SAAPAL

SEQ ID NO: 1225009 - protein, 23 aa, Mycobacterium
SAAPAVSVQTGNRNHKAPSSDLN

SEQ ID NO: 1225010 - protein, 5 aa, Mycobacterium
SAAPD

SEQ ID NO: 1225011 - protein, 5 aa, Mycobacterium
SAAPG

SEQ ID NO: 1225012 - protein, 8 aa, Mycobacterium
SAAPGKGF

SEQ ID NO: 1225013 - protein, 7 aa, Mycobacterium
SAAPGRV

SEQ ID NO: 1225014 - protein, 11 aa, Mycobacterium
SAAPSADPAAN

SEQ ID NO: 1225015 - protein, 14 aa, Mycobacterium
SAAPTSGSGMPGMP

SEQ ID NO: 1225016 - protein, 5 aa, Mycobacterium
SAAPY

SEQ ID NO: 1225017 - protein, 9 aa, Mycobacterium
SAAPYDQRD

SEQ ID NO: 1225018 - protein, 18 aa, Mycobacterium
SAAQADGDIPSETDAKSM

SEQ ID NO: 1225019 - protein, 6 aa, Mycobacterium
SAAQDD

SEQ ID NO: 1225020 - protein, 6 aa, Mycobacterium
SAAQKG

SEQ ID NO: 1225021 - protein, 6 aa, Mycobacterium
SAAQRD

SEQ ID NO: 1225022 - protein, 9 aa, Mycobacterium
SAARAESAA

SEQ ID NO: 1225023 - protein, 9 aa, Mycobacterium
SAARGAPMA

SEQ ID NO: 1225024 - protein, 7 aa, Mycobacterium
SAARQAV

SEQ ID NO: 1225025 - protein, 21 aa, Mycobacterium
SAARRGADKPSRHYSSGAHTA

SEQ ID NO: 1225026 - protein, 15 aa, Mycobacterium
SAARRGEGGVQATQT

SEQ ID NO: 1225027 - protein, 12 aa, Mycobacterium
SAARSAPELAGR

SEQ ID NO: 1225028 - protein, 4 aa, Mycobacterium
SAAS

SEQ ID NO: 1225029 - protein, 8 aa, Mycobacterium
SAASAATA

SEQ ID NO: 1225030 - protein, 5 aa, Mycobacterium
SAASP

SEQ ID NO: 1225031 - protein, 15 aa, Mycobacterium
SAASRAFDQASTLDE

SEQ ID NO: 1225032 - protein, 8 aa, Mycobacterium
SAASRDRA

SEQ ID NO: 1225033 - protein, 8 aa, Mycobacterium
SAASSEPL

SEQ ID NO: 1225034 - protein, 14 aa, Mycobacterium
SAASSSATAELQRD

SEQ ID NO: 1225035 - protein, 11 aa, Mycobacterium
SAATARTGDVG

SEQ ID NO: 1225036 - protein, 7 aa, Mycobacterium
SAATDRV

SEQ ID NO: 1225037 - protein, 15 aa, Mycobacterium
SAATEGARRSWSAEQ

SEQ ID NO: 1225038 - protein, 9 aa, Mycobacterium
SAATPASTA

SEQ ID NO: 1225039 - protein, 14 aa, Mycobacterium
SAATPDAVVCEGSA

SEQ ID NO: 1225040 - protein, 8 aa, Mycobacterium
SAATPRAI

SEQ ID NO: 1225041 - protein, 5 aa, Mycobacterium
SAATQ

SEQ ID NO: 1225042 - protein, 7 aa, Mycobacterium
SAATQLE

SEQ ID NO: 1225043 - protein, 5 aa, Mycobacterium
SAATR

SEQ ID NO: 1225044 - protein, 8 aa, Mycobacterium
SAATRSPH

SEQ ID NO: 1225045 - protein, 7 aa, Mycobacterium
SAAVGGV

SEQ ID NO: 1225046 - protein, 6 aa, Mycobacterium
SAAVRD

SEQ ID NO: 1225047 - protein, 19 aa, Mycobacterium
SAAVSAPTRITAPDDQIRS

SEQ ID NO: 1225048 - protein, 13 aa, Mycobacterium
SAAVSPLSRLRAT

SEQ ID NO: 1225049 - protein, 9 aa, Mycobacterium
SAAYTPGEV

SEQ ID NO: 1225050 - protein, 4 aa, Mycobacterium
SACS

SEQ ID NO: 1225051 - protein, 4 aa, Mycobacterium
SADA

SEQ ID NO: 1225052 - protein, 7 aa, Mycobacterium
SADAAAH

SEQ ID NO: 1225053 - protein, 7 aa, Mycobacterium
SADAGDS

SEQ ID NO: 1225054 - protein, 7 aa, Mycobacterium
SADATGA

SEQ ID NO: 1225055 - protein, 9 aa, Mycobacterium
SADDPRGLT

SEQ ID NO: 1225056 - protein, 6 aa, Mycobacterium
SADDSD

SEQ ID NO: 1225057 - protein, 6 aa, Mycobacterium
SADDVA

SEQ ID NO: 1225058 - protein, 6 aa, Mycobacterium
SADEAA

SEQ ID NO: 1225059 - protein, 7 aa, Mycobacterium
SADEATN

SEQ ID NO: 1225060 - protein, 13 aa, Mycobacterium
SADEFTQDPGRFD

SEQ ID NO: 1225061 - protein, 19 aa, Mycobacterium
SADELESAAAQGDPEPVAA

SEQ ID NO: 1225062 - protein, 15 aa, Mycobacterium
SADELRDAARAHDPD

SEQ ID NO: 1225063 - protein, 9 aa, Mycobacterium
SADEQDSDV

SEQ ID NO: 1225064 - protein, 5 aa, Mycobacterium
SADGD

SEQ ID NO: 1225065 - protein, 12 aa, Mycobacterium
SADGDSDADGYS

SEQ ID NO: 1225066 - protein, 19 aa, Mycobacterium
SADGGRRDYPIGAQARPSV

SEQ ID NO: 1225067 - protein, 18 aa, Mycobacterium
SADGLADTAEKAGALGTG

SEQ ID NO: 1225068 - protein, 10 aa, Mycobacterium
SADGRGRERV

SEQ ID NO: 1225069 - protein, 16 aa, Mycobacterium
SADGRHAYTGVTDPAS

SEQ ID NO: 1225070 - protein, 6 aa, Mycobacterium
SADGST

SEQ ID NO: 1225071 - protein, 16 aa, Mycobacterium
SADGYPSGQPGAGILP

SEQ ID NO: 1225072 - protein, 6 aa, Mycobacterium
SADHPD

SEQ ID NO: 1225073 - protein, 8 aa, Mycobacterium
SADKDGMD

SEQ ID NO: 1225074 - protein, 12 aa, Mycobacterium
SADKGAVRDVSA

SEQ ID NO: 1225075 - protein, 9 aa, Mycobacterium
SADKIGRDA

SEQ ID NO: 1225076 - protein, 4 aa, Mycobacterium
SADL

SEQ ID NO: 1225077 - protein, 7 aa, Mycobacterium
SADPADA

SEQ ID NO: 1225078 - protein, 11 aa, Mycobacterium
SADPDGSHAAA

SEQ ID NO: 1225079 - protein, 9 aa, Mycobacterium
SADPERAAG

SEQ ID NO: 1225080 - protein, 8 aa, Mycobacterium
SADPEVEE

SEQ ID NO: 1225081 - protein, 10 aa, Mycobacterium
SADPPRYPPD

SEQ ID NO: 1225082 - protein, 5 aa, Mycobacterium
SADPR

SEQ ID NO: 1225083 - protein, 14 aa, Mycobacterium
SADPSRLVGSADPS

SEQ ID NO: 1225084 - protein, 6 aa, Mycobacterium
SADPVA

SEQ ID NO: 1225085 - protein, 15 aa, Mycobacterium
SADPVDKQAKFADQQ

SEQ ID NO: 1225086 - protein, 7 aa, Mycobacterium
SADQAAR

SEQ ID NO: 1225087 - protein, 10 aa, Mycobacterium
SADQLGGGPY

SEQ ID NO: 1225088 - protein, 8 aa, Mycobacterium
SADQTSQA

SEQ ID NO: 1225089 - protein, 10 aa, Mycobacterium
SADRDPRRYD

SEQ ID NO: 1225090 - protein, 15 aa, Mycobacterium
SADRRTAVAHSGGGI

SEQ ID NO: 1225091 - protein, 13 aa, Mycobacterium
SADSEKPSRVGEL

SEQ ID NO: 1225092 - protein, 9 aa, Mycobacterium
SADTDTNLA

SEQ ID NO: 1225093 - protein, 4 aa, Mycobacterium
SADY

SEQ ID NO: 1225094 - protein, 7 aa, Mycobacterium
SAEAHRA

SEQ ID NO: 1225095 - protein, 6 aa, Mycobacterium
SAEDFE

SEQ ID NO: 1225096 - protein, 9 aa, Mycobacterium
SAEDGERAS

SEQ ID NO: 1225097 - protein, 8 aa, Mycobacterium
SAEDGLTH

SEQ ID NO: 1225098 - protein, 6 aa, Mycobacterium
SAEDRD

SEQ ID NO: 1225099 - protein, 7 aa, Mycobacterium
SAEDVAG

SEQ ID NO: 1225100 - protein, 16 aa, Mycobacterium
SAEERDRRLGEWAAQN

SEQ ID NO: 1225101 - protein, 15 aa, Mycobacterium
SAEGGADARNLDPEE

SEQ ID NO: 1225102 - protein, 15 aa, Mycobacterium
SAEGTDCADPVFEIR

SEQ ID NO: 1225103 - protein, 7 aa, Mycobacterium
SAEGTRD

SEQ ID NO: 1225104 - protein, 8 aa, Mycobacterium
SAELGDDA

SEQ ID NO: 1225105 - protein, 17 aa, Mycobacterium
SAELTDEPAVGVDANAQ

SEQ ID NO: 1225106 - protein, 4 aa, Mycobacterium
SAEN

SEQ ID NO: 1225107 - protein, 9 aa, Mycobacterium
SAEPAGEPV

SEQ ID NO: 1225108 - protein, 7 aa, Mycobacterium
SAEPDDA

SEQ ID NO: 1225109 - protein, 8 aa, Mycobacterium
SAEPGGHD

SEQ ID NO: 1225110 - protein, 7 aa, Mycobacterium
SAEPGTD

SEQ ID NO: 1225111 - protein, 5 aa, Mycobacterium
SAEPR

SEQ ID NO: 1225112 - protein, 9 aa, Mycobacterium
SAEPSGETI

SEQ ID NO: 1225113 - protein, 5 aa, Mycobacterium
SAEQI

SEQ ID NO: 1225114 - protein, 8 aa, Mycobacterium
SAEQIAAD

SEQ ID NO: 1225115 - protein, 13 aa, Mycobacterium
SAEQRGKLAEQFE

SEQ ID NO: 1225116 - protein, 9 aa, Mycobacterium
SAEQRRDGS

SEQ ID NO: 1225117 - protein, 10 aa, Mycobacterium
SAEQSDRNPI

SEQ ID NO: 1225118 - protein, 7 aa, Mycobacterium
SAERAPR

SEQ ID NO: 1225119 - protein, 12 aa, Mycobacterium
SAERDPAGCSDD

SEQ ID NO: 1225120 - protein, 6 aa, Mycobacterium
SAERTA

SEQ ID NO: 1225121 - protein, 12 aa, Mycobacterium
SAERVERGAHPR

SEQ ID NO: 1225122 - protein, 7 aa, Mycobacterium
SAESDSD

SEQ ID NO: 1225123 - protein, 15 aa, Mycobacterium
SAESEQRGTAQHRDR

SEQ ID NO: 1225124 - protein, 8 aa, Mycobacterium
SAESGVPT

SEQ ID NO: 1225125 - protein, 15 aa, Mycobacterium
SAESHQKAARATKDG

SEQ ID NO: 1225126 - protein, 7 aa, Mycobacterium
SAETDSD

SEQ ID NO: 1225127 - protein, 50 aa, Mycobacterium
SAETMRTGLDTTDNTWATKQQAALTESPPVLQQQDTQAAGDYEKSATFPM

SEQ ID NO: 1225128 - protein, 9 aa, Mycobacterium
SAFDGSPEA

SEQ ID NO: 1225129 - protein, 8 aa, Mycobacterium
SAFSQSQR

SEQ ID NO: 1225130 - protein, 6 aa, Mycobacterium
SAGADP

SEQ ID NO: 1225131 - protein, 9 aa, Mycobacterium
SAGAGISAQ

SEQ ID NO: 1225132 - protein, 13 aa, Mycobacterium
SAGAGQAPASVHP

SEQ ID NO: 1225133 - protein, 6 aa, Mycobacterium
SAGAHI

SEQ ID NO: 1225134 - protein, 7 aa, Mycobacterium
SAGAKAA

SEQ ID NO: 1225135 - protein, 6 aa, Mycobacterium
SAGAKV

SEQ ID NO: 1225136 - protein, 15 aa, Mycobacterium
SAGAPAVLPFALAAT

SEQ ID NO: 1225137 - protein, 15 aa, Mycobacterium
SAGAPEVLPFALAAV

SEQ ID NO: 1225138 - protein, 13 aa, Mycobacterium
SAGATGDFRPNPS

SEQ ID NO: 1225139 - protein, 5 aa, Mycobacterium
SAGDE

SEQ ID NO: 1225140 - protein, 8 aa, Mycobacterium
SAGDESTA

SEQ ID NO: 1225141 - protein, 9 aa, Mycobacterium
SAGDGRGPL

SEQ ID NO: 1225142 - protein, 8 aa, Mycobacterium
SAGDLDEP

SEQ ID NO: 1225143 - protein, 7 aa, Mycobacterium
SAGDPVR

SEQ ID NO: 1225144 - protein, 15 aa, Mycobacterium
SAGDRRRTNESGANA

SEQ ID NO: 1225145 - protein, 12 aa, Mycobacterium
SAGDSAFDSRSA

SEQ ID NO: 1225146 - protein, 4 aa, Mycobacterium
SAGE

SEQ ID NO: 1225147 - protein, 6 aa, Mycobacterium
SAGEKK

SEQ ID NO: 1225148 - protein, 5 aa, Mycobacterium
SAGEM

SEQ ID NO: 1225149 - protein, 7 aa, Mycobacterium
SAGEPDA

SEQ ID NO: 1225150 - protein, 14 aa, Mycobacterium
SAGEPMSPLQATRQ

SEQ ID NO: 1225151 - protein, 6 aa, Mycobacterium
SAGETT

SEQ ID NO: 1225152 - protein, 10 aa, Mycobacterium
SAGGAGPADL

SEQ ID NO: 1225153 - protein, 11 aa, Mycobacterium
SAGGDRGEGLA

SEQ ID NO: 1225154 - protein, 13 aa, Mycobacterium
SAGGEVDQATAEH

SEQ ID NO: 1225155 - protein, 10 aa, Mycobacterium
SAGGGRPLSR

SEQ ID NO: 1225156 - protein, 10 aa, Mycobacterium
SAGGNVKEMA

SEQ ID NO: 1225157 - protein, 25 aa, Mycobacterium
SAGGQVLSDDGERVTLTDTPEHRAA

SEQ ID NO: 1225158 - protein, 11 aa, Mycobacterium
SAGGSETIGPI

SEQ ID NO: 1225159 - protein, 9 aa, Mycobacterium
SAGGSGDDV

SEQ ID NO: 1225160 - protein, 20 aa, Mycobacterium
SAGGTLADLPDADAAELPDL

SEQ ID NO: 1225161 - protein, 7 aa, Mycobacterium
SAGGVAA

SEQ ID NO: 1225162 - protein, 15 aa, Mycobacterium
SAGHAERCGTDAGTE

SEQ ID NO: 1225163 - protein, 6 aa, Mycobacterium
SAGITP

SEQ ID NO: 1225164 - protein, 15 aa, Mycobacterium
SAGLKATPGNGHYAA

SEQ ID NO: 1225165 - protein, 5 aa, Mycobacterium
SAGLP

SEQ ID NO: 1225166 - protein, 6 aa, Mycobacterium
SAGNHY

SEQ ID NO: 1225167 - protein, 6 aa, Mycobacterium
SAGPAI

SEQ ID NO: 1225168 - protein, 7 aa, Mycobacterium
SAGPDDR

SEQ ID NO: 1225169 - protein, 7 aa, Mycobacterium
SAGPTDA

SEQ ID NO: 1225170 - protein, 4 aa, Mycobacterium
SAGQ

SEQ ID NO: 1225171 - protein, 15 aa, Mycobacterium
SAGQPSAGAPSAVRD

SEQ ID NO: 1225172 - protein, 17 aa, Mycobacterium
SAGQRPGRVAGDVGPSA

SEQ ID NO: 1225173 - protein, 8 aa, Mycobacterium
SAGQSRAL

SEQ ID NO: 1225174 - protein, 6 aa, Mycobacterium
SAGQVD

SEQ ID NO: 1225175 - protein, 13 aa, Mycobacterium
SAGRADLQPPEGP

SEQ ID NO: 1225176 - protein, 8 aa, Mycobacterium
SAGRAGAR

SEQ ID NO: 1225177 - protein, 9 aa, Mycobacterium
SAGRDRDPA

SEQ ID NO: 1225178 - protein, 5 aa, Mycobacterium
SAGRE

SEQ ID NO: 1225179 - protein, 10 aa, Mycobacterium
SAGRGRHGRQ

SEQ ID NO: 1225180 - protein, 14 aa, Mycobacterium
SAGRPVAHATGSAG

SEQ ID NO: 1225181 - protein, 19 aa, Mycobacterium
SAGRTGGSCSAGHTRCTDG

SEQ ID NO: 1225182 - protein, 8 aa, Mycobacterium
SAGSADRL

SEQ ID NO: 1225183 - protein, 16 aa, Mycobacterium
SAGSEKLRERFTSSPV

SEQ ID NO: 1225184 - protein, 7 aa, Mycobacterium
SAGSETL

SEQ ID NO: 1225185 - protein, 9 aa, Mycobacterium
SAGSGKTNS

SEQ ID NO: 1225186 - protein, 11 aa, Mycobacterium
SAGSRDDAEEI

SEQ ID NO: 1225187 - protein, 9 aa, Mycobacterium
SAGSTRDEL

SEQ ID NO: 1225188 - protein, 10 aa, Mycobacterium
SAGSWPVPGD

SEQ ID NO: 1225189 - protein, 9 aa, Mycobacterium
SAGTAEQLD

SEQ ID NO: 1225190 - protein, 6 aa, Mycobacterium
SAGTGH

SEQ ID NO: 1225191 - protein, 9 aa, Mycobacterium
SAGTGPEVC

SEQ ID NO: 1225192 - protein, 14 aa, Mycobacterium
SAGTNAKGAVNDVS

SEQ ID NO: 1225193 - protein, 5 aa, Mycobacterium
SAGTP

SEQ ID NO: 1225194 - protein, 27 aa, Mycobacterium
SAGTPGKSEVPDAVSASTGIASATAAH

SEQ ID NO: 1225195 - protein, 17 aa, Mycobacterium
SAGWQGYDDHERSAEEA

SEQ ID NO: 1225196 - protein, 11 aa, Mycobacterium
SAHAATPEQQQ

SEQ ID NO: 1225197 - protein, 15 aa, Mycobacterium
SAHDHRKDAPAEGNP

SEQ ID NO: 1225198 - protein, 15 aa, Mycobacterium
SAHDPTLAPPGKHAA

SEQ ID NO: 1225199 - protein, 6 aa, Mycobacterium
SAHGAL

SEQ ID NO: 1225200 - protein, 8 aa, Mycobacterium
SAHGGEAN

SEQ ID NO: 1225201 - protein, 7 aa, Mycobacterium
SAHGSRA

SEQ ID NO: 1225202 - protein, 7 aa, Mycobacterium
SAHPDGL

SEQ ID NO: 1225203 - protein, 7 aa, Mycobacterium
SAHPTDA

SEQ ID NO: 1225204 - protein, 7 aa, Mycobacterium
SAHTADY

SEQ ID NO: 1225205 - protein, 19 aa, Mycobacterium
SAHTSASDAERAATANTVG

SEQ ID NO: 1225206 - protein, 15 aa, Mycobacterium
SAIADAKTALAGTDI

SEQ ID NO: 1225207 - protein, 4 aa, Mycobacterium
SAID

SEQ ID NO: 1225208 - protein, 11 aa, Mycobacterium
SAIEGLGTPRT

SEQ ID NO: 1225209 - protein, 4 aa, Mycobacterium
SAIG

SEQ ID NO: 1225210 - protein, 6 aa, Mycobacterium
SAKAAR

SEQ ID NO: 1225211 - protein, 7 aa, Mycobacterium
SAKEPGF

SEQ ID NO: 1225212 - protein, 7 aa, Mycobacterium
SAKERTD

SEQ ID NO: 1225213 - protein, 10 aa, Mycobacterium
SAKGESPGRW

SEQ ID NO: 1225214 - protein, 13 aa, Mycobacterium
SAKGNPHGISPTA

SEQ ID NO: 1225215 - protein, 8 aa, Mycobacterium
SAKKPSVA

SEQ ID NO: 1225216 - protein, 8 aa, Mycobacterium
SAKKSEPE

SEQ ID NO: 1225217 - protein, 8 aa, Mycobacterium
SAKQDGRN

SEQ ID NO: 1225218 - protein, 7 aa, Mycobacterium
SAKRDVR

SEQ ID NO: 1225219 - protein, 10 aa, Mycobacterium
SAKRGGGSDR

SEQ ID NO: 1225220 - protein, 8 aa, Mycobacterium
SAKTGEGM

SEQ ID NO: 1225221 - protein, 8 aa, Mycobacterium
SAKTGRAV

SEQ ID NO: 1225222 - protein, 7 aa, Mycobacterium
SAKTTRV

SEQ ID NO: 1225223 - protein, 16 aa, Mycobacterium
SALDEAGDYRLSNDQP

SEQ ID NO: 1225224 - protein, 5 aa, Mycobacterium
SALER

SEQ ID NO: 1225225 - protein, 7 aa, Mycobacterium
SALGEAA

SEQ ID NO: 1225226 - protein, 7 aa, Mycobacterium
SALGGND

SEQ ID NO: 1225227 - protein, 16 aa, Mycobacterium
SALGGSGSRRGAGTVS

SEQ ID NO: 1225228 - protein, 4 aa, Mycobacterium
SALP

SEQ ID NO: 1225229 - protein, 12 aa, Mycobacterium
SALPAADDGSTE

SEQ ID NO: 1225230 - protein, 24 aa, Mycobacterium
SALPATGADRDDQAVYRGAERRVP

SEQ ID NO: 1225231 - protein, 5 aa, Mycobacterium
SALPE

SEQ ID NO: 1225232 - protein, 28 aa, Mycobacterium
SALPNGPKVSAGGSLSPRGDWRAPSDMS

SEQ ID NO: 1225233 - protein, 9 aa, Mycobacterium
SALPNSGAD

SEQ ID NO: 1225234 - protein, 5 aa, Mycobacterium
SALQA

SEQ ID NO: 1225235 - protein, 9 aa, Mycobacterium
SALRSAPEQ

SEQ ID NO: 1225236 - protein, 31 aa, Mycobacterium
SALSGGGGGGGGIGAGGSGVVPTSSYTRPVG

SEQ ID NO: 1225237 - protein, 9 aa, Mycobacterium
SALSPADLD

SEQ ID NO: 1225238 - protein, 6 aa, Mycobacterium
SALTAD

SEQ ID NO: 1225239 - protein, 6 aa, Mycobacterium
SALTAE

SEQ ID NO: 1225240 - protein, 11 aa, Mycobacterium
SALTQQSVAPT

SEQ ID NO: 1225241 - protein, 6 aa, Mycobacterium
SALTRR

SEQ ID NO: 1225242 - protein, 7 aa, Mycobacterium
SALYGAT

SEQ ID NO: 1225243 - protein, 9 aa, Mycobacterium
SAMGPDDLS

SEQ ID NO: 1225244 - protein, 13 aa, Mycobacterium
SAMPTITSGNTNA

SEQ ID NO: 1225245 - protein, 7 aa, Mycobacterium
SANATDE

SEQ ID NO: 1225246 - protein, 8 aa, Mycobacterium
SANATTYD

SEQ ID NO: 1225247 - protein, 5 aa, Mycobacterium
SANFP

SEQ ID NO: 1225248 - protein, 4 aa, Mycobacterium
SANG

SEQ ID NO: 1225249 - protein, 5 aa, Mycobacterium
SANPY

SEQ ID NO: 1225250 - protein, 11 aa, Mycobacterium
SANQAVSKAEA

SEQ ID NO: 1225251 - protein, 12 aa, Mycobacterium
SANRDEKHFADP

SEQ ID NO: 1225252 - protein, 11 aa, Mycobacterium
SANRDESRWER

SEQ ID NO: 1225253 - protein, 14 aa, Mycobacterium
SANRDETRFTDPDR

SEQ ID NO: 1225254 - protein, 14 aa, Mycobacterium
SANRDKDVFGPTSE

SEQ ID NO: 1225255 - protein, 10 aa, Mycobacterium
SANRDPDAWT

SEQ ID NO: 1225256 - protein, 11 aa, Mycobacterium
SANRDPEAFTN

SEQ ID NO: 1225257 - protein, 9 aa, Mycobacterium
SANRPTPEL

SEQ ID NO: 1225258 - protein, 8 aa, Mycobacterium
SANSTTHV

SEQ ID NO: 1225259 - protein, 8 aa, Mycobacterium
SANVRPGD

SEQ ID NO: 1225260 - protein, 18 aa, Mycobacterium
SANWSGAIGSTDAPQPFR

SEQ ID NO: 1225261 - protein, 6 aa, Mycobacterium
SAPAAA

SEQ ID NO: 1225262 - protein, 12 aa, Mycobacterium
SAPAADPGDDTV

SEQ ID NO: 1225263 - protein, 7 aa, Mycobacterium
SAPAGAD

SEQ ID NO: 1225264 - protein, 11 aa, Mycobacterium
SAPAGAEGPWT

SEQ ID NO: 1225265 - protein, 13 aa, Mycobacterium
SAPAGAHVQPGDR

SEQ ID NO: 1225266 - protein, 7 aa, Mycobacterium
SAPASLS

SEQ ID NO: 1225267 - protein, 4 aa, Mycobacterium
SAPD

SEQ ID NO: 1225268 - protein, 5 aa, Mycobacterium
SAPDR

SEQ ID NO: 1225269 - protein, 26 aa, Mycobacterium
SAPDSPPISYTAEEGQTYTATNISSY

SEQ ID NO: 1225270 - protein, 8 aa, Mycobacterium
SAPDTGRE

SEQ ID NO: 1225271 - protein, 7 aa, Mycobacterium
SAPDTPL

SEQ ID NO: 1225272 - protein, 7 aa, Mycobacterium
SAPEASQ

SEQ ID NO: 1225273 - protein, 6 aa, Mycobacterium
SAPGEP

SEQ ID NO: 1225274 - protein, 6 aa, Mycobacterium
SAPGFC

SEQ ID NO: 1225275 - protein, 9 aa, Mycobacterium
SAPGGPPTY

SEQ ID NO: 1225276 - protein, 5 aa, Mycobacterium
SAPGM

SEQ ID NO: 1225277 - protein, 20 aa, Mycobacterium
SAPGQTPGEGSVAGAGTAPR

SEQ ID NO: 1225278 - protein, 8 aa, Mycobacterium
SAPGSRLA

SEQ ID NO: 1225279 - protein, 10 aa, Mycobacterium
SAPGSTIATE

SEQ ID NO: 1225280 - protein, 6 aa, Mycobacterium
SAPGVD

SEQ ID NO: 1225281 - protein, 5 aa, Mycobacterium
SAPLA

SEQ ID NO: 1225282 - protein, 5 aa, Mycobacterium
SAPMT

SEQ ID NO: 1225283 - protein, 17 aa, Mycobacterium
SAPNPEETGGGTEFPRS

SEQ ID NO: 1225284 - protein, 4 aa, Mycobacterium
SAPP

SEQ ID NO: 1225285 - protein, 7 aa, Mycobacterium
SAPPDSL

SEQ ID NO: 1225286 - protein, 9 aa, Mycobacterium
SAPPESAGF

SEQ ID NO: 1225287 - protein, 21 aa, Mycobacterium
SAPPPSVRSRRRPLHSASTPV

SEQ ID NO: 1225288 - protein, 21 aa, Mycobacterium
SAPPRTVPTPATATAMAGTDD

SEQ ID NO: 1225289 - protein, 6 aa, Mycobacterium
SAPQAR

SEQ ID NO: 1225290 - protein, 7 aa, Mycobacterium
SAPQRCS

SEQ ID NO: 1225291 - protein, 8 aa, Mycobacterium
SAPRPPGA

SEQ ID NO: 1225292 - protein, 4 aa, Mycobacterium
SAPS

SEQ ID NO: 1225293 - protein, 7 aa, Mycobacterium
SAPSAVA

SEQ ID NO: 1225294 - protein, 5 aa, Mycobacterium
SAPTE

SEQ ID NO: 1225295 - protein, 7 aa, Mycobacterium
SAPTSRF

SEQ ID NO: 1225296 - protein, 6 aa, Mycobacterium
SAPVED

SEQ ID NO: 1225297 - protein, 7 aa, Mycobacterium
SAPVGPR

SEQ ID NO: 1225298 - protein, 9 aa, Mycobacterium
SAPVRDGRG

SEQ ID NO: 1225299 - protein, 7 aa, Mycobacterium
SAPYDRL

SEQ ID NO: 1225300 - protein, 5 aa, Mycobacterium
SAQAI

SEQ ID NO: 1225301 - protein, 5 aa, Mycobacterium
SAQAM

SEQ ID NO: 1225302 - protein, 5 aa, Mycobacterium
SAQEA

SEQ ID NO: 1225303 - protein, 10 aa, Mycobacterium
SAQENQAGAM

SEQ ID NO: 1225304 - protein, 19 aa, Mycobacterium
SAQGRPEPYESGTWGPPSA

SEQ ID NO: 1225305 - protein, 8 aa, Mycobacterium
SAQGTLQT

SEQ ID NO: 1225306 - protein, 15 aa, Mycobacterium
SAQPDVEPKSAEAEA

SEQ ID NO: 1225307 - protein, 22 aa, Mycobacterium
SAQPGQPGTPAGTVAGSVQGLG

SEQ ID NO: 1225308 - protein, 8 aa, Mycobacterium
SAQPSDPV

SEQ ID NO: 1225309 - protein, 13 aa, Mycobacterium
SAQQVSGPADSRT

SEQ ID NO: 1225310 - protein, 6 aa, Mycobacterium
SAQRGT

SEQ ID NO: 1225311 - protein, 9 aa, Mycobacterium
SAQRPGGIR

SEQ ID NO: 1225312 - protein, 8 aa, Mycobacterium
SAQRQSGL

SEQ ID NO: 1225313 - protein, 8 aa, Mycobacterium
SAQSSPAL

SEQ ID NO: 1225314 - protein, 5 aa, Mycobacterium
SAQTA

SEQ ID NO: 1225315 - protein, 78 aa, Mycobacterium
SAQTETADVTETTETPDTAAAPVTPETAAAPVTTETPDAAEAAEALSAPVTAEEVEEVEEAPAGPKHRKPSATSETLK

SEQ ID NO: 1225316 - protein, 8 aa, Mycobacterium
SAQYTTDG

SEQ ID NO: 1225317 - protein, 12 aa, Mycobacterium
SARAAAASDPAV

SEQ ID NO: 1225318 - protein, 15 aa, Mycobacterium
SARAESGGFGGRPSD

SEQ ID NO: 1225319 - protein, 13 aa, Mycobacterium
SARAKNARPTRLD

SEQ ID NO: 1225320 - protein, 6 aa, Mycobacterium
SARDAG

SEQ ID NO: 1225321 - protein, 7 aa, Mycobacterium
SARDEAA

SEQ ID NO: 1225322 - protein, 12 aa, Mycobacterium
SARDSAARANLG

SEQ ID NO: 1225323 - protein, 4 aa, Mycobacterium
SARE

SEQ ID NO: 1225324 - protein, 8 aa, Mycobacterium
SAREAKRK

SEQ ID NO: 1225325 - protein, 17 aa, Mycobacterium
SAREEVAGSSAAQSAAL

SEQ ID NO: 1225326 - protein, 6 aa, Mycobacterium
SAREGN

SEQ ID NO: 1225327 - protein, 5 aa, Mycobacterium
SAREK

SEQ ID NO: 1225328 - protein, 4 aa, Mycobacterium
SARG

SEQ ID NO: 1225329 - protein, 8 aa, Mycobacterium
SARGEPAA

SEQ ID NO: 1225330 - protein, 6 aa, Mycobacterium
SARGIH

SEQ ID NO: 1225331 - protein, 11 aa, Mycobacterium
SARGNTRQHSA

SEQ ID NO: 1225332 - protein, 6 aa, Mycobacterium
SARGPD

SEQ ID NO: 1225333 - protein, 5 aa, Mycobacterium
SARHE

SEQ ID NO: 1225334 - protein, 18 aa, Mycobacterium
SARIPGEPVDRSTLPEDV

SEQ ID NO: 1225335 - protein, 45 aa, Mycobacterium
SARKSGGSGGGPPGADSPTHRTNSANRGAYAVSSTATASGDDVPD

SEQ ID NO: 1225336 - protein, 4 aa, Mycobacterium
SARP

SEQ ID NO: 1225337 - protein, 6 aa, Mycobacterium
SARPAD

SEQ ID NO: 1225338 - protein, 9 aa, Mycobacterium
SARPEAGRM

SEQ ID NO: 1225339 - protein, 11 aa, Mycobacterium
SARPGRQNGAH

SEQ ID NO: 1225340 - protein, 11 aa, Mycobacterium
SARPSALAPGR

SEQ ID NO: 1225341 - protein, 7 aa, Mycobacterium
SARPVEG

SEQ ID NO: 1225342 - protein, 18 aa, Mycobacterium
SARQPAEKAPSQATQTAN

SEQ ID NO: 1225343 - protein, 4 aa, Mycobacterium
SARR

SEQ ID NO: 1225344 - protein, 7 aa, Mycobacterium
SARRADE

SEQ ID NO: 1225345 - protein, 7 aa, Mycobacterium
SARRAED

SEQ ID NO: 1225346 - protein, 7 aa, Mycobacterium
SARRAEE

SEQ ID NO: 1225347 - protein, 17 aa, Mycobacterium
SARRAEGEAIEQRRRDI

SEQ ID NO: 1225348 - protein, 7 aa, Mycobacterium
SARRAFD

SEQ ID NO: 1225349 - protein, 6 aa, Mycobacterium
SARRCG

SEQ ID NO: 1225350 - protein, 5 aa, Mycobacterium
SARRD

SEQ ID NO: 1225351 - protein, 12 aa, Mycobacterium
SARREAASAFGD

SEQ ID NO: 1225352 - protein, 8 aa, Mycobacterium
SARREEQF

SEQ ID NO: 1225353 - protein, 10 aa, Mycobacterium
SARRENRLTD

SEQ ID NO: 1225354 - protein, 11 aa, Mycobacterium
SARRHGSVRPT

SEQ ID NO: 1225355 - protein, 6 aa, Mycobacterium
SARRQA

SEQ ID NO: 1225356 - protein, 12 aa, Mycobacterium
SARRRGGDPVTR

SEQ ID NO: 1225357 - protein, 10 aa, Mycobacterium
SARRVSKDVQ

SEQ ID NO: 1225358 - protein, 6 aa, Mycobacterium
SARSEL

SEQ ID NO: 1225359 - protein, 5 aa, Mycobacterium
SARSV

SEQ ID NO: 1225360 - protein, 6 aa, Mycobacterium
SARTAG

SEQ ID NO: 1225361 - protein, 9 aa, Mycobacterium
SARTGAYRE

SEQ ID NO: 1225362 - protein, 5 aa, Mycobacterium
SARTL

SEQ ID NO: 1225363 - protein, 8 aa, Mycobacterium
SASAIAGR

SEQ ID NO: 1225364 - protein, 12 aa, Mycobacterium
SASAIVEDSPPS

SEQ ID NO: 1225365 - protein, 9 aa, Mycobacterium
SASAPDRAT

SEQ ID NO: 1225366 - protein, 17 aa, Mycobacterium
SASATGAPLQGDAKERV

SEQ ID NO: 1225367 - protein, 9 aa, Mycobacterium
SASATTGPV

SEQ ID NO: 1225368 - protein, 8 aa, Mycobacterium
SASAVNPG

SEQ ID NO: 1225369 - protein, 9 aa, Mycobacterium
SASDDDPRV

SEQ ID NO: 1225370 - protein, 11 aa, Mycobacterium
SASDGDPRVTE

SEQ ID NO: 1225371 - protein, 5 aa, Mycobacterium
SASDL

SEQ ID NO: 1225372 - protein, 7 aa, Mycobacterium
SASDTEA

SEQ ID NO: 1225373 - protein, 10 aa, Mycobacterium
SASEKGVTVT

SEQ ID NO: 1225374 - protein, 7 aa, Mycobacterium
SASEPAL

SEQ ID NO: 1225375 - protein, 7 aa, Mycobacterium
SASESRA

SEQ ID NO: 1225376 - protein, 17 aa, Mycobacterium
SASETLKKQSDAKTGDD

SEQ ID NO: 1225377 - protein, 6 aa, Mycobacterium
SASFTE

SEQ ID NO: 1225378 - protein, 7 aa, Mycobacterium
SASGDDE

SEQ ID NO: 1225379 - protein, 23 aa, Mycobacterium
SASGDDIAASRSSVMDRGRTQVR

SEQ ID NO: 1225380 - protein, 6 aa, Mycobacterium
SASGER

SEQ ID NO: 1225381 - protein, 9 aa, Mycobacterium
SASGTNAEK

SEQ ID NO: 1225382 - protein, 6 aa, Mycobacterium
SASGVP

SEQ ID NO: 1225383 - protein, 12 aa, Mycobacterium
SASGWDTKSVRE

SEQ ID NO: 1225384 - protein, 11 aa, Mycobacterium
SASGWDTTSVR

SEQ ID NO: 1225385 - protein, 5 aa, Mycobacterium
SASGY

SEQ ID NO: 1225386 - protein, 6 aa, Mycobacterium
SASGYK

SEQ ID NO: 1225387 - protein, 7 aa, Mycobacterium
SASISGP

SEQ ID NO: 1225388 - protein, 6 aa, Mycobacterium
SASKAA

SEQ ID NO: 1225389 - protein, 6 aa, Mycobacterium
SASPDL

SEQ ID NO: 1225390 - protein, 9 aa, Mycobacterium
SASPLSKTV

SEQ ID NO: 1225391 - protein, 5 aa, Mycobacterium
SASPV

SEQ ID NO: 1225392 - protein, 8 aa, Mycobacterium
SASRAPEL

SEQ ID NO: 1225393 - protein, 7 aa, Mycobacterium
SASRRAW

SEQ ID NO: 1225394 - protein, 5 aa, Mycobacterium
SASRT

SEQ ID NO: 1225395 - protein, 13 aa, Mycobacterium
SASSPHPDGTEIH

SEQ ID NO: 1225396 - protein, 8 aa, Mycobacterium
SASSTLGT

SEQ ID NO: 1225397 - protein, 9 aa, Mycobacterium
SASTDPLTG

SEQ ID NO: 1225398 - protein, 6 aa, Mycobacterium
SASTPL

SEQ ID NO: 1225399 - protein, 6 aa, Mycobacterium
SASVDG

SEQ ID NO: 1225400 - protein, 7 aa, Mycobacterium
SASVSQL

SEQ ID NO: 1225401 - protein, 12 aa, Mycobacterium
SATADTPATEDR

SEQ ID NO: 1225402 - protein, 20 aa, Mycobacterium
SATAEGGTKPNATDPTLEEE

SEQ ID NO: 1225403 - protein, 7 aa, Mycobacterium
SATAGFN

SEQ ID NO: 1225404 - protein, 10 aa, Mycobacterium
SATAKEPAGN

SEQ ID NO: 1225405 - protein, 5 aa, Mycobacterium
SATAL

SEQ ID NO: 1225406 - protein, 9 aa, Mycobacterium
SATANDVGD

SEQ ID NO: 1225407 - protein, 10 aa, Mycobacterium
SATAQATPTQ

SEQ ID NO: 1225408 - protein, 14 aa, Mycobacterium
SATATAVGGANPIT

SEQ ID NO: 1225409 - protein, 5 aa, Mycobacterium
SATAV

SEQ ID NO: 1225410 - protein, 8 aa, Mycobacterium
SATAVTGK

SEQ ID NO: 1225411 - protein, 4 aa, Mycobacterium
SATD

SEQ ID NO: 1225412 - protein, 11 aa, Mycobacterium
SATDADGVENI

SEQ ID NO: 1225413 - protein, 7 aa, Mycobacterium
SATDDPV

SEQ ID NO: 1225414 - protein, 8 aa, Mycobacterium
SATDEHGV

SEQ ID NO: 1225415 - protein, 14 aa, Mycobacterium
SATDPAGYVSGYVC

SEQ ID NO: 1225416 - protein, 8 aa, Mycobacterium
SATDPGTR

SEQ ID NO: 1225417 - protein, 28 aa, Mycobacterium
SATEARGDNVTDVDEEPTTEQDKSPLEI

SEQ ID NO: 1225418 - protein, 6 aa, Mycobacterium
SATERE

SEQ ID NO: 1225419 - protein, 8 aa, Mycobacterium
SATESEDV

SEQ ID NO: 1225420 - protein, 6 aa, Mycobacterium
SATESI

SEQ ID NO: 1225421 - protein, 6 aa, Mycobacterium
SATESR

SEQ ID NO: 1225422 - protein, 8 aa, Mycobacterium
SATFAYPG

SEQ ID NO: 1225423 - protein, 13 aa, Mycobacterium
SATGAAVQGHPAE

SEQ ID NO: 1225424 - protein, 10 aa, Mycobacterium
SATGADFSGP

SEQ ID NO: 1225425 - protein, 6 aa, Mycobacterium
SATGDH

SEQ ID NO: 1225426 - protein, 9 aa, Mycobacterium
SATGESQAG

SEQ ID NO: 1225427 - protein, 6 aa, Mycobacterium
SATGLS

SEQ ID NO: 1225428 - protein, 11 aa, Mycobacterium
SATGQSQDARA

SEQ ID NO: 1225429 - protein, 7 aa, Mycobacterium
SATGVDQ

SEQ ID NO: 1225430 - protein, 4 aa, Mycobacterium
SATI

SEQ ID NO: 1225431 - protein, 5 aa, Mycobacterium
SATKG

SEQ ID NO: 1225432 - protein, 6 aa, Mycobacterium
SATKVD

SEQ ID NO: 1225433 - protein, 9 aa, Mycobacterium
SATNDDEGR

SEQ ID NO: 1225434 - protein, 16 aa, Mycobacterium
SATNDHRLGANEAPPA

SEQ ID NO: 1225435 - protein, 6 aa, Mycobacterium
SATPAG

SEQ ID NO: 1225436 - protein, 11 aa, Mycobacterium
SATPDTAVTES

SEQ ID NO: 1225437 - protein, 8 aa, Mycobacterium
SATPGEDG

SEQ ID NO: 1225438 - protein, 7 aa, Mycobacterium
SATPLYD

SEQ ID NO: 1225439 - protein, 8 aa, Mycobacterium
SATPNDAV

SEQ ID NO: 1225440 - protein, 9 aa, Mycobacterium
SATPPGGGV

SEQ ID NO: 1225441 - protein, 6 aa, Mycobacterium
SATPSF

SEQ ID NO: 1225442 - protein, 7 aa, Mycobacterium
SATPSFA

SEQ ID NO: 1225443 - protein, 13 aa, Mycobacterium
SATPTDDRATTED

SEQ ID NO: 1225444 - protein, 37 aa, Mycobacterium
SATPTDGTAAAAKHNSAPAPSQATRQPNNIAPQQLTG

SEQ ID NO: 1225445 - protein, 9 aa, Mycobacterium
SATPTGPTM

SEQ ID NO: 1225446 - protein, 12 aa, Mycobacterium
SATPVASVGSSG

SEQ ID NO: 1225447 - protein, 14 aa, Mycobacterium
SATQGDSATTPVNA

SEQ ID NO: 1225448 - protein, 14 aa, Mycobacterium
SATRPDGTRQGPPT

SEQ ID NO: 1225449 - protein, 8 aa, Mycobacterium
SATRRDLD

SEQ ID NO: 1225450 - protein, 42 aa, Mycobacterium
SATRRTASIPSRNAENLTDRRSAPSARSHPLRSGSAASTCSS

SEQ ID NO: 1225451 - protein, 13 aa, Mycobacterium
SATRSAAEQQGTD

SEQ ID NO: 1225452 - protein, 6 aa, Mycobacterium
SATRTV

SEQ ID NO: 1225453 - protein, 15 aa, Mycobacterium
SATSELHDSHRGHGS

SEQ ID NO: 1225454 - protein, 8 aa, Mycobacterium
SATSGGKK

SEQ ID NO: 1225455 - protein, 7 aa, Mycobacterium
SATSGTQ

SEQ ID NO: 1225456 - protein, 6 aa, Mycobacterium
SATSMR

SEQ ID NO: 1225457 - protein, 15 aa, Mycobacterium
SATSQRDEATTRGTA

SEQ ID NO: 1225458 - protein, 4 aa, Mycobacterium
SATT

SEQ ID NO: 1225459 - protein, 20 aa, Mycobacterium
SATTAESRALTRGLKERGRR

SEQ ID NO: 1225460 - protein, 8 aa, Mycobacterium
SATTPAAA

SEQ ID NO: 1225461 - protein, 4 aa, Mycobacterium
SATY

SEQ ID NO: 1225462 - protein, 5 aa, Mycobacterium
SATYE

SEQ ID NO: 1225463 - protein, 13 aa, Mycobacterium
SATYRTADLTERR

SEQ ID NO: 1225464 - protein, 6 aa, Mycobacterium
SAVASR

SEQ ID NO: 1225465 - protein, 6 aa, Mycobacterium
SAVDDP

SEQ ID NO: 1225466 - protein, 4 aa, Mycobacterium
SAVE

SEQ ID NO: 1225467 - protein, 12 aa, Mycobacterium
SAVEATGKPVTV

SEQ ID NO: 1225468 - protein, 5 aa, Mycobacterium
SAVGA

SEQ ID NO: 1225469 - protein, 41 aa, Mycobacterium
SAVGAPAPTPAPAPVPVPPTSPATDPANPAPLASAPVPTPI

SEQ ID NO: 1225470 - protein, 11 aa, Mycobacterium
SAVGDPVPAER

SEQ ID NO: 1225471 - protein, 9 aa, Mycobacterium
SAVKPLKPA

SEQ ID NO: 1225472 - protein, 21 aa, Mycobacterium
SAVNQDGASSGLTVPNGGAQQ

SEQ ID NO: 1225473 - protein, 22 aa, Mycobacterium
SAVNQDGASSGQTVPNGPAQQE

SEQ ID NO: 1225474 - protein, 22 aa, Mycobacterium
SAVNQDGRSNGLTAPNAPSQRD

SEQ ID NO: 1225475 - protein, 5 aa, Mycobacterium
SAVQR

SEQ ID NO: 1225476 - protein, 4 aa, Mycobacterium
SAVR

SEQ ID NO: 1225477 - protein, 6 aa, Mycobacterium
SAVTEP

SEQ ID NO: 1225478 - protein, 8 aa, Mycobacterium
SAWRKDPD

SEQ ID NO: 1225479 - protein, 8 aa, Mycobacterium
SAYGESPY

SEQ ID NO: 1225480 - protein, 9 aa, Mycobacterium
SAYGPDQAH

SEQ ID NO: 1225481 - protein, 8 aa, Mycobacterium
SAYHGSRV

SEQ ID NO: 1225482 - protein, 7 aa, Mycobacterium
SAYTAAG

SEQ ID NO: 1225483 - protein, 4 aa, Mycobacterium
SAYV

SEQ ID NO: 1225484 - protein, 5 aa, Mycobacterium
SCAGH

SEQ ID NO: 1225485 - protein, 7 aa, Mycobacterium
SCATGHD

SEQ ID NO: 1225486 - protein, 15 aa, Mycobacterium
SCDPPPDYVSSTGAS

SEQ ID NO: 1225487 - protein, 4 aa, Mycobacterium
SCGS

SEQ ID NO: 1225488 - protein, 4 aa, Mycobacterium
SCPE

SEQ ID NO: 1225489 - protein, 6 aa, Mycobacterium
SCPGGP

SEQ ID NO: 1225490 - protein, 9 aa, Mycobacterium
SCQGRQVDD

SEQ ID NO: 1225491 - protein, 6 aa, Mycobacterium
SCQHPG

SEQ ID NO: 1225492 - protein, 9 aa, Mycobacterium
SCRSRRPQR

SEQ ID NO: 1225493 - protein, 5 aa, Mycobacterium
SCRTP

SEQ ID NO: 1225494 - protein, 22 aa, Mycobacterium
SCSTAESGAAATSSKPSRSARV

SEQ ID NO: 1225495 - protein, 7 aa, Mycobacterium
SCSTGHQ

SEQ ID NO: 1225496 - protein, 5 aa, Mycobacterium
SCTPE

SEQ ID NO: 1225497 - protein, 11 aa, Mycobacterium
SDAAAALDGAS

SEQ ID NO: 1225498 - protein, 10 aa, Mycobacterium
SDAAGDEGSG

SEQ ID NO: 1225499 - protein, 5 aa, Mycobacterium
SDAAR

SEQ ID NO: 1225500 - protein, 6 aa, Mycobacterium
SDAATA

SEQ ID NO: 1225501 - protein, 4 aa, Mycobacterium
SDAD

SEQ ID NO: 1225502 - protein, 6 aa, Mycobacterium
SDADAD

SEQ ID NO: 1225503 - protein, 9 aa, Mycobacterium
SDADDFSQP

SEQ ID NO: 1225504 - protein, 6 aa, Mycobacterium
SDADLP

SEQ ID NO: 1225505 - protein, 7 aa, Mycobacterium
SDADRRK

SEQ ID NO: 1225506 - protein, 5 aa, Mycobacterium
SDAEA

SEQ ID NO: 1225507 - protein, 6 aa, Mycobacterium
SDAEAH

SEQ ID NO: 1225508 - protein, 15 aa, Mycobacterium
SDAGESPEQAARRGG

SEQ ID NO: 1225509 - protein, 9 aa, Mycobacterium
SDAGGDTYR

SEQ ID NO: 1225510 - protein, 8 aa, Mycobacterium
SDAGGPVL

SEQ ID NO: 1225511 - protein, 6 aa, Mycobacterium
SDAGPA

SEQ ID NO: 1225512 - protein, 8 aa, Mycobacterium
SDAGSQFT

SEQ ID NO: 1225513 - protein, 9 aa, Mycobacterium
SDAGSQGGF

SEQ ID NO: 1225514 - protein, 6 aa, Mycobacterium
SDALTG

SEQ ID NO: 1225515 - protein, 11 aa, Mycobacterium
SDAPADFKADS

SEQ ID NO: 1225516 - protein, 7 aa, Mycobacterium
SDAPAGA

SEQ ID NO: 1225517 - protein, 8 aa, Mycobacterium
SDAPEAFK

SEQ ID NO: 1225518 - protein, 6 aa, Mycobacterium
SDAPLE

SEQ ID NO: 1225519 - protein, 9 aa, Mycobacterium
SDAPTNEQA

SEQ ID NO: 1225520 - protein, 8 aa, Mycobacterium
SDAQEGMQ

SEQ ID NO: 1225521 - protein, 8 aa, Mycobacterium
SDAQPQMK

SEQ ID NO: 1225522 - protein, 8 aa, Mycobacterium
SDAQRDGD

SEQ ID NO: 1225523 - protein, 6 aa, Mycobacterium
SDARDK

SEQ ID NO: 1225524 - protein, 5 aa, Mycobacterium
SDARR

SEQ ID NO: 1225525 - protein, 7 aa, Mycobacterium
SDATDAA

SEQ ID NO: 1225526 - protein, 13 aa, Mycobacterium
SDAVEKGPLASPV

SEQ ID NO: 1225527 - protein, 21 aa, Mycobacterium
SDAVRPDSTPMTALSGGQAAR

SEQ ID NO: 1225528 - protein, 4 aa, Mycobacterium
SDAY

SEQ ID NO: 1225529 - protein, 6 aa, Mycobacterium
SDCGDD

SEQ ID NO: 1225530 - protein, 12 aa, Mycobacterium
SDCQDGEAGTVA

SEQ ID NO: 1225531 - protein, 12 aa, Mycobacterium
SDDAAKEGAVEE

SEQ ID NO: 1225532 - protein, 9 aa, Mycobacterium
SDDAGDVEA

SEQ ID NO: 1225533 - protein, 8 aa, Mycobacterium
SDDAGRSW

SEQ ID NO: 1225534 - protein, 7 aa, Mycobacterium
SDDAQRA

SEQ ID NO: 1225535 - protein, 8 aa, Mycobacterium
SDDASDEA

SEQ ID NO: 1225536 - protein, 7 aa, Mycobacterium
SDDDAWE

SEQ ID NO: 1225537 - protein, 10 aa, Mycobacterium
SDDDDRAQLD

SEQ ID NO: 1225538 - protein, 5 aa, Mycobacterium
SDDDM

SEQ ID NO: 1225539 - protein, 8 aa, Mycobacterium
SDDDRAAF

SEQ ID NO: 1225540 - protein, 32 aa, Mycobacterium
SDDEVGEAITRETAELDRREQAYRGDRGPVSV

SEQ ID NO: 1225541 - protein, 6 aa, Mycobacterium
SDDEWQ

SEQ ID NO: 1225542 - protein, 4 aa, Mycobacterium
SDDG

SEQ ID NO: 1225543 - protein, 9 aa, Mycobacterium
SDDGAGETF

SEQ ID NO: 1225544 - protein, 8 aa, Mycobacterium
SDDGNVEK

SEQ ID NO: 1225545 - protein, 6 aa, Mycobacterium
SDDHGD

SEQ ID NO: 1225546 - protein, 7 aa, Mycobacterium
SDDIAAG

SEQ ID NO: 1225547 - protein, 27 aa, Mycobacterium
SDDKTRSHSESENPAIDSPEPKVHAPL

SEQ ID NO: 1225548 - protein, 21 aa, Mycobacterium
SDDLQTTTLPGSGGTVAGTSV

SEQ ID NO: 1225549 - protein, 13 aa, Mycobacterium
SDDNTTSATVTTA

SEQ ID NO: 1225550 - protein, 23 aa, Mycobacterium
SDDPAGLAEADATANTLPGPLET

SEQ ID NO: 1225551 - protein, 10 aa, Mycobacterium
SDDPEQSRAL

SEQ ID NO: 1225552 - protein, 7 aa, Mycobacterium
SDDQIDT

SEQ ID NO: 1225553 - protein, 12 aa, Mycobacterium
SDDRAQAANTAF

SEQ ID NO: 1225554 - protein, 12 aa, Mycobacterium
SDDRGPSGAQDA

SEQ ID NO: 1225555 - protein, 9 aa, Mycobacterium
SDDRSPAQI

SEQ ID NO: 1225556 - protein, 6 aa, Mycobacterium
SDDSEQ

SEQ ID NO: 1225557 - protein, 7 aa, Mycobacterium
SDDSGRI

SEQ ID NO: 1225558 - protein, 7 aa, Mycobacterium
SDDSRPE

SEQ ID NO: 1225559 - protein, 10 aa, Mycobacterium
SDDTSTRRHP

SEQ ID NO: 1225560 - protein, 10 aa, Mycobacterium
SDDVTRARAV

SEQ ID NO: 1225561 - protein, 7 aa, Mycobacterium
SDDYDAA

SEQ ID NO: 1225562 - protein, 7 aa, Mycobacterium
SDEAGEV

SEQ ID NO: 1225563 - protein, 14 aa, Mycobacterium
SDEATSGLDPATTR

SEQ ID NO: 1225564 - protein, 7 aa, Mycobacterium
SDEAVRA

SEQ ID NO: 1225565 - protein, 16 aa, Mycobacterium
SDEDGAEKGTSYNRVR

SEQ ID NO: 1225566 - protein, 22 aa, Mycobacterium
SDEDLQSTTIDGADEADARQTY

SEQ ID NO: 1225567 - protein, 5 aa, Mycobacterium
SDEFT

SEQ ID NO: 1225568 - protein, 4 aa, Mycobacterium
SDEG

SEQ ID NO: 1225569 - protein, 6 aa, Mycobacterium
SDEGFD

SEQ ID NO: 1225570 - protein, 17 aa, Mycobacterium
SDEGGAEAGSGYNPVRG

SEQ ID NO: 1225571 - protein, 7 aa, Mycobacterium
SDEGRAA

SEQ ID NO: 1225572 - protein, 5 aa, Mycobacterium
SDEKA

SEQ ID NO: 1225573 - protein, 8 aa, Mycobacterium
SDEKLNPD

SEQ ID NO: 1225574 - protein, 5 aa, Mycobacterium
SDELK

SEQ ID NO: 1225575 - protein, 6 aa, Mycobacterium
SDENAR

SEQ ID NO: 1225576 - protein, 5 aa, Mycobacterium
SDENY

SEQ ID NO: 1225577 - protein, 7 aa, Mycobacterium
SDEPAAL

SEQ ID NO: 1225578 - protein, 6 aa, Mycobacterium
SDEPPT

SEQ ID NO: 1225579 - protein, 5 aa, Mycobacterium
SDEQA

SEQ ID NO: 1225580 - protein, 6 aa, Mycobacterium
SDEQKN

SEQ ID NO: 1225581 - protein, 5 aa, Mycobacterium
SDEQR

SEQ ID NO: 1225582 - protein, 8 aa, Mycobacterium
SDERGVNE

SEQ ID NO: 1225583 - protein, 37 aa, Mycobacterium
SDERLREERTGTDERLREERTGTDGRLREERTGAGAT

SEQ ID NO: 1225584 - protein, 17 aa, Mycobacterium
SDERVEGIDAPTLKESG

SEQ ID NO: 1225585 - protein, 10 aa, Mycobacterium
SDESAAQVTP

SEQ ID NO: 1225586 - protein, 15 aa, Mycobacterium
SDESSIPDCAAQSRE

SEQ ID NO: 1225587 - protein, 11 aa, Mycobacterium
SDETLSDSTDV

SEQ ID NO: 1225588 - protein, 5 aa, Mycobacterium
SDETR

SEQ ID NO: 1225589 - protein, 13 aa, Mycobacterium
SDEVPGADGLDGE

SEQ ID NO: 1225590 - protein, 7 aa, Mycobacterium
SDEVTVE

SEQ ID NO: 1225591 - protein, 4 aa, Mycobacterium
SDEY

SEQ ID NO: 1225592 - protein, 15 aa, Mycobacterium
SDEYSAARREFNDED

SEQ ID NO: 1225593 - protein, 6 aa, Mycobacterium
SDFATG

SEQ ID NO: 1225594 - protein, 4 aa, Mycobacterium
SDFP

SEQ ID NO: 1225595 - protein, 13 aa, Mycobacterium
SDFTSASRTAFNN

SEQ ID NO: 1225596 - protein, 7 aa, Mycobacterium
SDGAAAV

SEQ ID NO: 1225597 - protein, 8 aa, Mycobacterium
SDGADGAE

SEQ ID NO: 1225598 - protein, 7 aa, Mycobacterium
SDGAPTT

SEQ ID NO: 1225599 - protein, 8 aa, Mycobacterium
SDGDGRYI

SEQ ID NO: 1225600 - protein, 15 aa, Mycobacterium
SDGDVTTVRRTAEQA

SEQ ID NO: 1225601 - protein, 9 aa, Mycobacterium
SDGEEHDYG

SEQ ID NO: 1225602 - protein, 10 aa, Mycobacterium
SDGEKSTDIT

SEQ ID NO: 1225603 - protein, 20 aa, Mycobacterium
SDGERGLSGARNTGVGAARG

SEQ ID NO: 1225604 - protein, 6 aa, Mycobacterium
SDGETE

SEQ ID NO: 1225605 - protein, 7 aa, Mycobacterium
SDGETLA

SEQ ID NO: 1225606 - protein, 5 aa, Mycobacterium
SDGGA

SEQ ID NO: 1225607 - protein, 6 aa, Mycobacterium
SDGGAA

SEQ ID NO: 1225608 - protein, 8 aa, Mycobacterium
SDGGAATH

SEQ ID NO: 1225609 - protein, 8 aa, Mycobacterium
SDGGALSA

SEQ ID NO: 1225610 - protein, 5 aa, Mycobacterium
SDGGF

SEQ ID NO: 1225611 - protein, 5 aa, Mycobacterium
SDGGR

SEQ ID NO: 1225612 - protein, 13 aa, Mycobacterium
SDGGSGTQCALRA

SEQ ID NO: 1225613 - protein, 7 aa, Mycobacterium
SDGGVRR

SEQ ID NO: 1225614 - protein, 4 aa, Mycobacterium
SDGH

SEQ ID NO: 1225615 - protein, 8 aa, Mycobacterium
SDGIEQNP

SEQ ID NO: 1225616 - protein, 12 aa, Mycobacterium
SDGITKAKETVA

SEQ ID NO: 1225617 - protein, 29 aa, Mycobacterium
SDGKPTRVGYRRDDETGKNVRIAKSNGKD

SEQ ID NO: 1225618 - protein, 5 aa, Mycobacterium
SDGLG

SEQ ID NO: 1225619 - protein, 14 aa, Mycobacterium
SDGLGKADGSSRAE

SEQ ID NO: 1225620 - protein, 9 aa, Mycobacterium
SDGLTQPRF

SEQ ID NO: 1225621 - protein, 8 aa, Mycobacterium
SDGNGGWT

SEQ ID NO: 1225622 - protein, 9 aa, Mycobacterium
SDGNPTGGK

SEQ ID NO: 1225623 - protein, 8 aa, Mycobacterium
SDGPADHP

SEQ ID NO: 1225624 - protein, 8 aa, Mycobacterium
SDGPAPTR

SEQ ID NO: 1225625 - protein, 5 aa, Mycobacterium
SDGQA

SEQ ID NO: 1225626 - protein, 13 aa, Mycobacterium
SDGQGSGEPPLPA

SEQ ID NO: 1225627 - protein, 8 aa, Mycobacterium
SDGQPAYI

SEQ ID NO: 1225628 - protein, 7 aa, Mycobacterium
SDGQTVG

SEQ ID NO: 1225629 - protein, 6 aa, Mycobacterium
SDGRAA

SEQ ID NO: 1225630 - protein, 13 aa, Mycobacterium
SDGRAIGKVVIDL

SEQ ID NO: 1225631 - protein, 6 aa, Mycobacterium
SDGSRI

SEQ ID NO: 1225632 - protein, 9 aa, Mycobacterium
SDGSRRAEM

SEQ ID NO: 1225633 - protein, 18 aa, Mycobacterium
SDGSSESWRPGSGAFDYL

SEQ ID NO: 1225634 - protein, 5 aa, Mycobacterium
SDGST

SEQ ID NO: 1225635 - protein, 7 aa, Mycobacterium
SDGSTIT

SEQ ID NO: 1225636 - protein, 7 aa, Mycobacterium
SDGSTLR

SEQ ID NO: 1225637 - protein, 10 aa, Mycobacterium
SDGTEDNYTY

SEQ ID NO: 1225638 - protein, 6 aa, Mycobacterium
SDGTIG

SEQ ID NO: 1225639 - protein, 7 aa, Mycobacterium
SDGTNID

SEQ ID NO: 1225640 - protein, 5 aa, Mycobacterium
SDGTV

SEQ ID NO: 1225641 - protein, 10 aa, Mycobacterium
SDGTVSANKN

SEQ ID NO: 1225642 - protein, 11 aa, Mycobacterium
SDGTVTVTGTR

SEQ ID NO: 1225643 - protein, 8 aa, Mycobacterium
SDGVRGGI

SEQ ID NO: 1225644 - protein, 5 aa, Mycobacterium
SDHAE

SEQ ID NO: 1225645 - protein, 9 aa, Mycobacterium
SDHDGDRLD

SEQ ID NO: 1225646 - protein, 13 aa, Mycobacterium
SDHDHDHDGHHHH

SEQ ID NO: 1225647 - protein, 8 aa, Mycobacterium
SDHGETQA

SEQ ID NO: 1225648 - protein, 5 aa, Mycobacterium
SDHGL

SEQ ID NO: 1225649 - protein, 6 aa, Mycobacterium
SDHIGA

SEQ ID NO: 1225650 - protein, 4 aa, Mycobacterium
SDHP

SEQ ID NO: 1225651 - protein, 10 aa, Mycobacterium
SDHPDARSAC

SEQ ID NO: 1225652 - protein, 10 aa, Mycobacterium
SDHPEYRNRD

SEQ ID NO: 1225653 - protein, 7 aa, Mycobacterium
SDHRETY

SEQ ID NO: 1225654 - protein, 8 aa, Mycobacterium
SDHTPAST

SEQ ID NO: 1225655 - protein, 6 aa, Mycobacterium
SDIESK

SEQ ID NO: 1225656 - protein, 6 aa, Mycobacterium
SDIGRD

SEQ ID NO: 1225657 - protein, 16 aa, Mycobacterium
SDIGRSKAQSAKDSIA

SEQ ID NO: 1225658 - protein, 24 aa, Mycobacterium
SDIPADEIDGSGKLPSMGSFRGSG

SEQ ID NO: 1225659 - protein, 23 aa, Mycobacterium
SDIPANEIDGSGKLPTAGAFRGT

SEQ ID NO: 1225660 - protein, 8 aa, Mycobacterium
SDISTDEI

SEQ ID NO: 1225661 - protein, 8 aa, Mycobacterium
SDKDTALT

SEQ ID NO: 1225662 - protein, 7 aa, Mycobacterium
SDKGTVT

SEQ ID NO: 1225663 - protein, 8 aa, Mycobacterium
SDKPGSAM

SEQ ID NO: 1225664 - protein, 10 aa, Mycobacterium
SDKPRREPLR

SEQ ID NO: 1225665 - protein, 14 aa, Mycobacterium
SDKRPMEDQAADYG

SEQ ID NO: 1225666 - protein, 11 aa, Mycobacterium
SDKSVRPRHAS

SEQ ID NO: 1225667 - protein, 10 aa, Mycobacterium
SDKTAGERLA

SEQ ID NO: 1225668 - protein, 16 aa, Mycobacterium
SDKVTSSPAFRSSAKA

SEQ ID NO: 1225669 - protein, 9 aa, Mycobacterium
SDKYRGKFD

SEQ ID NO: 1225670 - protein, 21 aa, Mycobacterium
SDLAASKDESTGISGQARAQT

SEQ ID NO: 1225671 - protein, 14 aa, Mycobacterium
SDLAKGGPVHSQAD

SEQ ID NO: 1225672 - protein, 5 aa, Mycobacterium
SDLDR

SEQ ID NO: 1225673 - protein, 7 aa, Mycobacterium
SDLEAKA

SEQ ID NO: 1225674 - protein, 8 aa, Mycobacterium
SDLGGRSK

SEQ ID NO: 1225675 - protein, 7 aa, Mycobacterium
SDLGPKQ

SEQ ID NO: 1225676 - protein, 4 aa, Mycobacterium
SDLN

SEQ ID NO: 1225677 - protein, 6 aa, Mycobacterium
SDLPDL

SEQ ID NO: 1225678 - protein, 9 aa, Mycobacterium
SDLPSDRAH

SEQ ID NO: 1225679 - protein, 10 aa, Mycobacterium
SDLPTTAGFD

SEQ ID NO: 1225680 - protein, 4 aa, Mycobacterium
SDLQ

SEQ ID NO: 1225681 - protein, 11 aa, Mycobacterium
SDLRAAREAGL

SEQ ID NO: 1225682 - protein, 10 aa, Mycobacterium
SDLSGGQRQR

SEQ ID NO: 1225683 - protein, 7 aa, Mycobacterium
SDMEKPV

SEQ ID NO: 1225684 - protein, 5 aa, Mycobacterium
SDMNQ

SEQ ID NO: 1225685 - protein, 68 aa, Mycobacterium
SDMPATARPVEPAKTFTRRSQVADAPAPAPAPAPVEARPEPPAPPVPPPPAPAPPPSPPPVRPPAEPV

SEQ ID NO: 1225686 - protein, 6 aa, Mycobacterium
SDMQSA

SEQ ID NO: 1225687 - protein, 15 aa, Mycobacterium
SDMTSSPNQSSSPDP

SEQ ID NO: 1225688 - protein, 8 aa, Mycobacterium
SDNDGSRY

SEQ ID NO: 1225689 - protein, 5 aa, Mycobacterium
SDNEA

SEQ ID NO: 1225690 - protein, 7 aa, Mycobacterium
SDNPHGI

SEQ ID NO: 1225691 - protein, 7 aa, Mycobacterium
SDNPVPI

SEQ ID NO: 1225692 - protein, 5 aa, Mycobacterium
SDPAA

SEQ ID NO: 1225693 - protein, 7 aa, Mycobacterium
SDPAAWD

SEQ ID NO: 1225694 - protein, 6 aa, Mycobacterium
SDPADV

SEQ ID NO: 1225695 - protein, 14 aa, Mycobacterium
SDPARERLAESGAR

SEQ ID NO: 1225696 - protein, 4 aa, Mycobacterium
SDPD

SEQ ID NO: 1225697 - protein, 5 aa, Mycobacterium
SDPDA

SEQ ID NO: 1225698 - protein, 11 aa, Mycobacterium
SDPDEAGTPHE

SEQ ID NO: 1225699 - protein, 8 aa, Mycobacterium
SDPDEAVA

SEQ ID NO: 1225700 - protein, 8 aa, Mycobacterium
SDPDERGM

SEQ ID NO: 1225701 - protein, 5 aa, Mycobacterium
SDPDI

SEQ ID NO: 1225702 - protein, 6 aa, Mycobacterium
SDPDKL

SEQ ID NO: 1225703 - protein, 8 aa, Mycobacterium
SDPDMRGA

SEQ ID NO: 1225704 - protein, 8 aa, Mycobacterium
SDPEEGSS

SEQ ID NO: 1225705 - protein, 5 aa, Mycobacterium
SDPEL

SEQ ID NO: 1225706 - protein, 8 aa, Mycobacterium
SDPEQPVD

SEQ ID NO: 1225707 - protein, 9 aa, Mycobacterium
SDPEYVPDQ

SEQ ID NO: 1225708 - protein, 13 aa, Mycobacterium
SDPGDRTPPGMHT

SEQ ID NO: 1225709 - protein, 7 aa, Mycobacterium
SDPGHGW

SEQ ID NO: 1225710 - protein, 8 aa, Mycobacterium
SDPGHPSV

SEQ ID NO: 1225711 - protein, 5 aa, Mycobacterium
SDPGL

SEQ ID NO: 1225712 - protein, 11 aa, Mycobacterium
SDPGMDGPTIA

SEQ ID NO: 1225713 - protein, 22 aa, Mycobacterium
SDPHHRKGPFTGSGQHDDDRLP

SEQ ID NO: 1225714 - protein, 4 aa, Mycobacterium
SDPI

SEQ ID NO: 1225715 - protein, 11 aa, Mycobacterium
SDPITRGADAP

SEQ ID NO: 1225716 - protein, 9 aa, Mycobacterium
SDPKGKDLG

SEQ ID NO: 1225717 - protein, 13 aa, Mycobacterium
SDPLDGATPSGAS

SEQ ID NO: 1225718 - protein, 5 aa, Mycobacterium
SDPLG

SEQ ID NO: 1225719 - protein, 8 aa, Mycobacterium
SDPLNPGM

SEQ ID NO: 1225720 - protein, 8 aa, Mycobacterium
SDPNGDPL

SEQ ID NO: 1225721 - protein, 9 aa, Mycobacterium
SDPPETQEL

SEQ ID NO: 1225722 - protein, 8 aa, Mycobacterium
SDPPPYRQ

SEQ ID NO: 1225723 - protein, 7 aa, Mycobacterium
SDPRFTR

SEQ ID NO: 1225724 - protein, 6 aa, Mycobacterium
SDPRLR

SEQ ID NO: 1225725 - protein, 9 aa, Mycobacterium
SDPRSAEIR

SEQ ID NO: 1225726 - protein, 4 aa, Mycobacterium
SDPS

SEQ ID NO: 1225727 - protein, 8 aa, Mycobacterium
SDPSAPGL

SEQ ID NO: 1225728 - protein, 8 aa, Mycobacterium
SDPSGLAA

SEQ ID NO: 1225729 - protein, 7 aa, Mycobacterium
SDPSRLQ

SEQ ID NO: 1225730 - protein, 8 aa, Mycobacterium
SDPTAAPD

SEQ ID NO: 1225731 - protein, 7 aa, Mycobacterium
SDPTGTL

SEQ ID NO: 1225732 - protein, 7 aa, Mycobacterium
SDPTGVL

SEQ ID NO: 1225733 - protein, 6 aa, Mycobacterium
SDPTRA

SEQ ID NO: 1225734 - protein, 5 aa, Mycobacterium
SDPTV

SEQ ID NO: 1225735 - protein, 4 aa, Mycobacterium
SDPV

SEQ ID NO: 1225736 - protein, 7 aa, Mycobacterium
SDPVPDP

SEQ ID NO: 1225737 - protein, 13 aa, Mycobacterium
SDPVTDAHRSGSD

SEQ ID NO: 1225738 - protein, 10 aa, Mycobacterium
SDPYSIGPAD

SEQ ID NO: 1225739 - protein, 9 aa, Mycobacterium
SDQAPQRVG

SEQ ID NO: 1225740 - protein, 5 aa, Mycobacterium
SDQEP

SEQ ID NO: 1225741 - protein, 15 aa, Mycobacterium
SDQGLADRQKVPARL

SEQ ID NO: 1225742 - protein, 12 aa, Mycobacterium
SDQIKASGELRL

SEQ ID NO: 1225743 - protein, 14 aa, Mycobacterium
SDQPAGAAEARATI

SEQ ID NO: 1225744 - protein, 5 aa, Mycobacterium
SDQPW

SEQ ID NO: 1225745 - protein, 5 aa, Mycobacterium
SDQQY

SEQ ID NO: 1225746 - protein, 10 aa, Mycobacterium
SDQTADPGPR

SEQ ID NO: 1225747 - protein, 10 aa, Mycobacterium
SDRAAGRQRQ

SEQ ID NO: 1225748 - protein, 8 aa, Mycobacterium
SDRDIAEA

SEQ ID NO: 1225749 - protein, 7 aa, Mycobacterium
SDRDRTA

SEQ ID NO: 1225750 - protein, 7 aa, Mycobacterium
SDREDQI

SEQ ID NO: 1225751 - protein, 5 aa, Mycobacterium
SDREV

SEQ ID NO: 1225752 - protein, 9 aa, Mycobacterium
SDRGGTTTT

SEQ ID NO: 1225753 - protein, 10 aa, Mycobacterium
SDRGSDSAGV

SEQ ID NO: 1225754 - protein, 7 aa, Mycobacterium
SDRGYTA

SEQ ID NO: 1225755 - protein, 5 aa, Mycobacterium
SDRHP

SEQ ID NO: 1225756 - protein, 6 aa, Mycobacterium
SDRPDA

SEQ ID NO: 1225757 - protein, 5 aa, Mycobacterium
SDRPK

SEQ ID NO: 1225758 - protein, 8 aa, Mycobacterium
SDRPLPVP

SEQ ID NO: 1225759 - protein, 9 aa, Mycobacterium
SDRPPRTPY

SEQ ID NO: 1225760 - protein, 19 aa, Mycobacterium
SDRPVRSRPRGGETAEDTV

SEQ ID NO: 1225761 - protein, 8 aa, Mycobacterium
SDRQSTCA

SEQ ID NO: 1225762 - protein, 6 aa, Mycobacterium
SDRRAL

SEQ ID NO: 1225763 - protein, 9 aa, Mycobacterium
SDRRGEQAP

SEQ ID NO: 1225764 - protein, 8 aa, Mycobacterium
SDRRVGGP

SEQ ID NO: 1225765 - protein, 4 aa, Mycobacterium
SDRS

SEQ ID NO: 1225766 - protein, 10 aa, Mycobacterium
SDRSARDARR

SEQ ID NO: 1225767 - protein, 11 aa, Mycobacterium
SDRSSGRPPMN

SEQ ID NO: 1225768 - protein, 4 aa, Mycobacterium
SDRT

SEQ ID NO: 1225769 - protein, 5 aa, Mycobacterium
SDRTG

SEQ ID NO: 1225770 - protein, 6 aa, Mycobacterium
SDRTKA

SEQ ID NO: 1225771 - protein, 6 aa, Mycobacterium
SDRTNR

SEQ ID NO: 1225772 - protein, 21 aa, Mycobacterium
SDRTYTAANPGPDGATELTLP

SEQ ID NO: 1225773 - protein, 6 aa, Mycobacterium
SDRYQE

SEQ ID NO: 1225774 - protein, 5 aa, Mycobacterium
SDSAM

SEQ ID NO: 1225775 - protein, 10 aa, Mycobacterium
SDSAQQSITA

SEQ ID NO: 1225776 - protein, 5 aa, Mycobacterium
SDSAV

SEQ ID NO: 1225777 - protein, 10 aa, Mycobacterium
SDSDGIDATN

SEQ ID NO: 1225778 - protein, 13 aa, Mycobacterium
SDSDGKSGGQKEK

SEQ ID NO: 1225779 - protein, 6 aa, Mycobacterium
SDSDVA

SEQ ID NO: 1225780 - protein, 6 aa, Mycobacterium
SDSELS

SEQ ID NO: 1225781 - protein, 6 aa, Mycobacterium
SDSFDG

SEQ ID NO: 1225782 - protein, 9 aa, Mycobacterium
SDSGADHAT

SEQ ID NO: 1225783 - protein, 8 aa, Mycobacterium
SDSGDAGA

SEQ ID NO: 1225784 - protein, 13 aa, Mycobacterium
SDSHYPEEAPAHP

SEQ ID NO: 1225785 - protein, 13 aa, Mycobacterium
SDSNWPNSRKRAA

SEQ ID NO: 1225786 - protein, 8 aa, Mycobacterium
SDSQEGAV

SEQ ID NO: 1225787 - protein, 4 aa, Mycobacterium
SDSR

SEQ ID NO: 1225788 - protein, 11 aa, Mycobacterium
SDSRRSSSSSR

SEQ ID NO: 1225789 - protein, 32 aa, Mycobacterium
SDSSFGIPTTTAARIEARSNPWDPGTEPGEAD

SEQ ID NO: 1225790 - protein, 8 aa, Mycobacterium
SDSSGYVH

SEQ ID NO: 1225791 - protein, 6 aa, Mycobacterium
SDSTYD

SEQ ID NO: 1225792 - protein, 5 aa, Mycobacterium
SDTAA

SEQ ID NO: 1225793 - protein, 6 aa, Mycobacterium
SDTAAQ

SEQ ID NO: 1225794 - protein, 11 aa, Mycobacterium
SDTAGAGGKVI

SEQ ID NO: 1225795 - protein, 7 aa, Mycobacterium
SDTAHDE

SEQ ID NO: 1225796 - protein, 18 aa, Mycobacterium
SDTATTGYDTGAFGSAGT

SEQ ID NO: 1225797 - protein, 11 aa, Mycobacterium
SDTDAVDAATA

SEQ ID NO: 1225798 - protein, 14 aa, Mycobacterium
SDTDETPKPPWRER

SEQ ID NO: 1225799 - protein, 9 aa, Mycobacterium
SDTDPAGRR

SEQ ID NO: 1225800 - protein, 4 aa, Mycobacterium
SDTE

SEQ ID NO: 1225801 - protein, 10 aa, Mycobacterium
SDTGSGSDTT

SEQ ID NO: 1225802 - protein, 6 aa, Mycobacterium
SDTHGG

SEQ ID NO: 1225803 - protein, 6 aa, Mycobacterium
SDTPAQ

SEQ ID NO: 1225804 - protein, 9 aa, Mycobacterium
SDTPEGAWS

SEQ ID NO: 1225805 - protein, 5 aa, Mycobacterium
SDTPV

SEQ ID NO: 1225806 - protein, 7 aa, Mycobacterium
SDTPVTD

SEQ ID NO: 1225807 - protein, 7 aa, Mycobacterium
SDTQPAH

SEQ ID NO: 1225808 - protein, 4 aa, Mycobacterium
SDTR

SEQ ID NO: 1225809 - protein, 5 aa, Mycobacterium
SDTRG

SEQ ID NO: 1225810 - protein, 9 aa, Mycobacterium
SDTRPAARR

SEQ ID NO: 1225811 - protein, 6 aa, Mycobacterium
SDTTDE

SEQ ID NO: 1225812 - protein, 6 aa, Mycobacterium
SDTTVG

SEQ ID NO: 1225813 - protein, 6 aa, Mycobacterium
SDVDDL

SEQ ID NO: 1225814 - protein, 5 aa, Mycobacterium
SDVET

SEQ ID NO: 1225815 - protein, 9 aa, Mycobacterium
SDVGDEEQV

SEQ ID NO: 1225816 - protein, 7 aa, Mycobacterium
SDVGEDT

SEQ ID NO: 1225817 - protein, 5 aa, Mycobacterium
SDVNP

SEQ ID NO: 1225818 - protein, 9 aa, Mycobacterium
SDVPKTKPR

SEQ ID NO: 1225819 - protein, 4 aa, Mycobacterium
SDVS

SEQ ID NO: 1225820 - protein, 14 aa, Mycobacterium
SDVSDIQGGTTSEG

SEQ ID NO: 1225821 - protein, 12 aa, Mycobacterium
SDVSDRKGLSDK

SEQ ID NO: 1225822 - protein, 9 aa, Mycobacterium
SDVSTRPGL

SEQ ID NO: 1225823 - protein, 6 aa, Mycobacterium
SDVTTK

SEQ ID NO: 1225824 - protein, 10 aa, Mycobacterium
SDVTVSSPYG

SEQ ID NO: 1225825 - protein, 4 aa, Mycobacterium
SDWA

SEQ ID NO: 1225826 - protein, 6 aa, Mycobacterium
SDWPRY

SEQ ID NO: 1225827 - protein, 13 aa, Mycobacterium
SDWSSKDDGLSPL

SEQ ID NO: 1225828 - protein, 6 aa, Mycobacterium
SDWSSP

SEQ ID NO: 1225829 - protein, 4 aa, Mycobacterium
SDYG

SEQ ID NO: 1225830 - protein, 5 aa, Mycobacterium
SDYGL

SEQ ID NO: 1225831 - protein, 15 aa, Mycobacterium
SDYHPEQPGGSAVGR

SEQ ID NO: 1225832 - protein, 5 aa, Mycobacterium
SDYKG

SEQ ID NO: 1225833 - protein, 4 aa, Mycobacterium
SEAA

SEQ ID NO: 1225834 - protein, 7 aa, Mycobacterium
SEAAGGA

SEQ ID NO: 1225835 - protein, 13 aa, Mycobacterium
SEAAMDNARDATQ

SEQ ID NO: 1225836 - protein, 6 aa, Mycobacterium
SEAAPA

SEQ ID NO: 1225837 - protein, 7 aa, Mycobacterium
SEAATDA

SEQ ID NO: 1225838 - protein, 8 aa, Mycobacterium
SEADDDAS

SEQ ID NO: 1225839 - protein, 10 aa, Mycobacterium
SEADPAGGNR

SEQ ID NO: 1225840 - protein, 11 aa, Mycobacterium
SEADSVDDGDV

SEQ ID NO: 1225841 - protein, 12 aa, Mycobacterium
SEAEVADEDEAV

SEQ ID NO: 1225842 - protein, 10 aa, Mycobacterium
SEAGASVYSA

SEQ ID NO: 1225843 - protein, 7 aa, Mycobacterium
SEAGRKL

SEQ ID NO: 1225844 - protein, 9 aa, Mycobacterium
SEAGSGSAT

SEQ ID NO: 1225845 - protein, 10 aa, Mycobacterium
SEAKSQVSWE

SEQ ID NO: 1225846 - protein, 10 aa, Mycobacterium
SEALQGGVSA

SEQ ID NO: 1225847 - protein, 5 aa, Mycobacterium
SEANL

SEQ ID NO: 1225848 - protein, 4 aa, Mycobacterium
SEAP

SEQ ID NO: 1225849 - protein, 7 aa, Mycobacterium
SEAPRHQ

SEQ ID NO: 1225850 - protein, 4 aa, Mycobacterium
SEAQ

SEQ ID NO: 1225851 - protein, 8 aa, Mycobacterium
SEAQQDRY

SEQ ID NO: 1225852 - protein, 10 aa, Mycobacterium
SEAQRRGQRV

SEQ ID NO: 1225853 - protein, 6 aa, Mycobacterium
SEASYF

SEQ ID NO: 1225854 - protein, 24 aa, Mycobacterium
SEATAAEVGVAGGEPLTVSTDRGA

SEQ ID NO: 1225855 - protein, 31 aa, Mycobacterium
SEAVRSSRERSSPAVRSSRERSSPAVRSSRE

SEQ ID NO: 1225856 - protein, 18 aa, Mycobacterium
SECGRGVGRTKKEAELKA

SEQ ID NO: 1225857 - protein, 8 aa, Mycobacterium
SEDAIDPA

SEQ ID NO: 1225858 - protein, 9 aa, Mycobacterium
SEDAKEGPL

SEQ ID NO: 1225859 - protein, 9 aa, Mycobacterium
SEDARRQGL

SEQ ID NO: 1225860 - protein, 4 aa, Mycobacterium
SEDD

SEQ ID NO: 1225861 - protein, 11 aa, Mycobacterium
SEDDKARARAA

SEQ ID NO: 1225862 - protein, 20 aa, Mycobacterium
SEDERRALKRRNARTKARTG

SEQ ID NO: 1225863 - protein, 5 aa, Mycobacterium
SEDES

SEQ ID NO: 1225864 - protein, 11 aa, Mycobacterium
SEDGETHTTRD

SEQ ID NO: 1225865 - protein, 9 aa, Mycobacterium
SEDGETVTD

SEQ ID NO: 1225866 - protein, 6 aa, Mycobacterium
SEDGPV

SEQ ID NO: 1225867 - protein, 5 aa, Mycobacterium
SEDHQ

SEQ ID NO: 1225868 - protein, 5 aa, Mycobacterium
SEDNP

SEQ ID NO: 1225869 - protein, 5 aa, Mycobacterium
SEDPR

SEQ ID NO: 1225870 - protein, 10 aa, Mycobacterium
SEDPRARNDY

SEQ ID NO: 1225871 - protein, 4 aa, Mycobacterium
SEDR

SEQ ID NO: 1225872 - protein, 8 aa, Mycobacterium
SEDRLTKG

SEQ ID NO: 1225873 - protein, 4 aa, Mycobacterium
SEDV

SEQ ID NO: 1225874 - protein, 7 aa, Mycobacterium
SEDVDRR

SEQ ID NO: 1225875 - protein, 7 aa, Mycobacterium
SEEAPAK

SEQ ID NO: 1225876 - protein, 5 aa, Mycobacterium
SEEEL

SEQ ID NO: 1225877 - protein, 31 aa, Mycobacterium
SEEEPDPAAQLDSSFDDAGRQRSDEAERDAE

SEQ ID NO: 1225878 - protein, 8 aa, Mycobacterium
SEEERRAA

SEQ ID NO: 1225879 - protein, 9 aa, Mycobacterium
SEEGVDDPV

SEQ ID NO: 1225880 - protein, 6 aa, Mycobacterium
SEEHGA

SEQ ID NO: 1225881 - protein, 4 aa, Mycobacterium
SEEK

SEQ ID NO: 1225882 - protein, 9 aa, Mycobacterium
SEEKHGPID

SEQ ID NO: 1225883 - protein, 20 aa, Mycobacterium
SEEPSETPEPGHEHGKPASI

SEQ ID NO: 1225884 - protein, 7 aa, Mycobacterium
SEEQAQQ

SEQ ID NO: 1225885 - protein, 6 aa, Mycobacterium
SEEQRT

SEQ ID NO: 1225886 - protein, 8 aa, Mycobacterium
SEESAPID

SEQ ID NO: 1225887 - protein, 8 aa, Mycobacterium
SEESGGSD

SEQ ID NO: 1225888 - protein, 27 aa, Mycobacterium
SEESRSALTNATAPPSAATAEDNLTAE

SEQ ID NO: 1225889 - protein, 7 aa, Mycobacterium
SEETRSA

SEQ ID NO: 1225890 - protein, 4 aa, Mycobacterium
SEEV

SEQ ID NO: 1225891 - protein, 8 aa, Mycobacterium
SEFSGRDD

SEQ ID NO: 1225892 - protein, 8 aa, Mycobacterium
SEGEAVEK

SEQ ID NO: 1225893 - protein, 6 aa, Mycobacterium
SEGGSF

SEQ ID NO: 1225894 - protein, 6 aa, Mycobacterium
SEGHRM

SEQ ID NO: 1225895 - protein, 14 aa, Mycobacterium
SEGKAPGTIKTYTD

SEQ ID NO: 1225896 - protein, 13 aa, Mycobacterium
SEGLTVTPDPSMG

SEQ ID NO: 1225897 - protein, 5 aa, Mycobacterium
SEGNG

SEQ ID NO: 1225898 - protein, 13 aa, Mycobacterium
SEGNISGAITTAG

SEQ ID NO: 1225899 - protein, 7 aa, Mycobacterium
SEGQNLQ

SEQ ID NO: 1225900 - protein, 8 aa, Mycobacterium
SEGRDDDP

SEQ ID NO: 1225901 - protein, 5 aa, Mycobacterium
SEGSI

SEQ ID NO: 1225902 - protein, 4 aa, Mycobacterium
SEGT

SEQ ID NO: 1225903 - protein, 12 aa, Mycobacterium
SEGTISGPADTR

SEQ ID NO: 1225904 - protein, 6 aa, Mycobacterium
SEGTVK

SEQ ID NO: 1225905 - protein, 5 aa, Mycobacterium
SEGVD

SEQ ID NO: 1225906 - protein, 6 aa, Mycobacterium
SEGVGK

SEQ ID NO: 1225907 - protein, 7 aa, Mycobacterium
SEGWPGE

SEQ ID NO: 1225908 - protein, 7 aa, Mycobacterium
SEGYGDD

SEQ ID NO: 1225909 - protein, 11 aa, Mycobacterium
SEHAQPGDFRR

SEQ ID NO: 1225910 - protein, 11 aa, Mycobacterium
SEHGDQRRATT

SEQ ID NO: 1225911 - protein, 8 aa, Mycobacterium
SEHGVSTA

SEQ ID NO: 1225912 - protein, 8 aa, Mycobacterium
SEHLSGTL

SEQ ID NO: 1225913 - protein, 5 aa, Mycobacterium
SEHLT

SEQ ID NO: 1225914 - protein, 5 aa, Mycobacterium
SEHQR

SEQ ID NO: 1225915 - protein, 6 aa, Mycobacterium
SEHTKA

SEQ ID NO: 1225916 - protein, 6 aa, Mycobacterium
SEIGDS

SEQ ID NO: 1225917 - protein, 6 aa, Mycobacterium
SEIGIT

SEQ ID NO: 1225918 - protein, 17 aa, Mycobacterium
SEIPETMPDPEDDDEGC

SEQ ID NO: 1225919 - protein, 10 aa, Mycobacterium
SEITSSTPRY

SEQ ID NO: 1225920 - protein, 10 aa, Mycobacterium
SEKELGGLPT

SEQ ID NO: 1225921 - protein, 7 aa, Mycobacterium
SEKGSRS

SEQ ID NO: 1225922 - protein, 10 aa, Mycobacterium
SEKLTGENAP

SEQ ID NO: 1225923 - protein, 6 aa, Mycobacterium
SEKPDN

SEQ ID NO: 1225924 - protein, 8 aa, Mycobacterium
SEKRQSRL

SEQ ID NO: 1225925 - protein, 7 aa, Mycobacterium
SEKSRTA

SEQ ID NO: 1225926 - protein, 11 aa, Mycobacterium
SEKTAPKDAGV

SEQ ID NO: 1225927 - protein, 11 aa, Mycobacterium
SELGRGRGGGR

SEQ ID NO: 1225928 - protein, 10 aa, Mycobacterium
SELGTGRGGP

SEQ ID NO: 1225929 - protein, 20 aa, Mycobacterium
SELPAASAGTHPASGVHPGA

SEQ ID NO: 1225930 - protein, 5 aa, Mycobacterium
SELPD

SEQ ID NO: 1225931 - protein, 8 aa, Mycobacterium
SELPDQEA

SEQ ID NO: 1225932 - protein, 13 aa, Mycobacterium
SELPSVEDVNEKR

SEQ ID NO: 1225933 - protein, 8 aa, Mycobacterium
SELRTRGL

SEQ ID NO: 1225934 - protein, 8 aa, Mycobacterium
SELSGDEA

SEQ ID NO: 1225935 - protein, 5 aa, Mycobacterium
SELSR

SEQ ID NO: 1225936 - protein, 5 aa, Mycobacterium
SELTQ

SEQ ID NO: 1225937 - protein, 9 aa, Mycobacterium
SEMADEARR

SEQ ID NO: 1225938 - protein, 8 aa, Mycobacterium
SENAYGEE

SEQ ID NO: 1225939 - protein, 5 aa, Mycobacterium
SENDG

SEQ ID NO: 1225940 - protein, 7 aa, Mycobacterium
SENGAQH

SEQ ID NO: 1225941 - protein, 6 aa, Mycobacterium
SENPTK

SEQ ID NO: 1225942 - protein, 6 aa, Mycobacterium
SENRPE

SEQ ID NO: 1225943 - protein, 7 aa, Mycobacterium
SENTPVQ

SEQ ID NO: 1225944 - protein, 4 aa, Mycobacterium
SEPA

SEQ ID NO: 1225945 - protein, 10 aa, Mycobacterium
SEPAAGSDLA

SEQ ID NO: 1225946 - protein, 7 aa, Mycobacterium
SEPAESI

SEQ ID NO: 1225947 - protein, 8 aa, Mycobacterium
SEPAEVAA

SEQ ID NO: 1225948 - protein, 9 aa, Mycobacterium
SEPDAGSDL

SEQ ID NO: 1225949 - protein, 9 aa, Mycobacterium
SEPDAGTDL

SEQ ID NO: 1225950 - protein, 5 aa, Mycobacterium
SEPDP

SEQ ID NO: 1225951 - protein, 11 aa, Mycobacterium
SEPDSGSDLAS

SEQ ID NO: 1225952 - protein, 12 aa, Mycobacterium
SEPDSGSDLASV

SEQ ID NO: 1225953 - protein, 11 aa, Mycobacterium
SEPEAGSDLAS

SEQ ID NO: 1225954 - protein, 7 aa, Mycobacterium
SEPERYA

SEQ ID NO: 1225955 - protein, 10 aa, Mycobacterium
SEPGAGSDLA

SEQ ID NO: 1225956 - protein, 21 aa, Mycobacterium
SEPGAGSDLASLTTTAVRDGD

SEQ ID NO: 1225957 - protein, 14 aa, Mycobacterium
SEPGAGSDLSSLST

SEQ ID NO: 1225958 - protein, 8 aa, Mycobacterium
SEPGAGTD

SEQ ID NO: 1225959 - protein, 10 aa, Mycobacterium
SEPGGQGLSI

SEQ ID NO: 1225960 - protein, 5 aa, Mycobacterium
SEPGL

SEQ ID NO: 1225961 - protein, 14 aa, Mycobacterium
SEPGPCEDDIGETP

SEQ ID NO: 1225962 - protein, 17 aa, Mycobacterium
SEPGVDGMLPPDTAVWL

SEQ ID NO: 1225963 - protein, 8 aa, Mycobacterium
SEPHPTRE

SEQ ID NO: 1225964 - protein, 4 aa, Mycobacterium
SEPI

SEQ ID NO: 1225965 - protein, 9 aa, Mycobacterium
SEPKAREKA

SEQ ID NO: 1225966 - protein, 6 aa, Mycobacterium
SEPPVS

SEQ ID NO: 1225967 - protein, 10 aa, Mycobacterium
SEPQRGGTEF

SEQ ID NO: 1225968 - protein, 15 aa, Mycobacterium
SEPRDGTLPDLDPAA

SEQ ID NO: 1225969 - protein, 9 aa, Mycobacterium
SEPRPDPAD

SEQ ID NO: 1225970 - protein, 5 aa, Mycobacterium
SEPSM

SEQ ID NO: 1225971 - protein, 16 aa, Mycobacterium
SEPTDDLPTADGTGSM

SEQ ID NO: 1225972 - protein, 5 aa, Mycobacterium
SEPTH

SEQ ID NO: 1225973 - protein, 5 aa, Mycobacterium
SEPVA

SEQ ID NO: 1225974 - protein, 27 aa, Mycobacterium
SEPVKRGSRAIAAAQAKRDAAAPDSAS

SEQ ID NO: 1225975 - protein, 12 aa, Mycobacterium
SEPVRSTSGLTT

SEQ ID NO: 1225976 - protein, 4 aa, Mycobacterium
SEPY

SEQ ID NO: 1225977 - protein, 12 aa, Mycobacterium
SEPYDDDPAWQE

SEQ ID NO: 1225978 - protein, 6 aa, Mycobacterium
SEQDTE

SEQ ID NO: 1225979 - protein, 9 aa, Mycobacterium
SEQEARAQI

SEQ ID NO: 1225980 - protein, 4 aa, Mycobacterium
SEQF

SEQ ID NO: 1225981 - protein, 10 aa, Mycobacterium
SEQGNPDGPT

SEQ ID NO: 1225982 - protein, 7 aa, Mycobacterium
SEQGRRR

SEQ ID NO: 1225983 - protein, 16 aa, Mycobacterium
SEQISTAGKEASGTGN

SEQ ID NO: 1225984 - protein, 8 aa, Mycobacterium
SEQLGTDP

SEQ ID NO: 1225985 - protein, 8 aa, Mycobacterium
SEQLSDTS

SEQ ID NO: 1225986 - protein, 5 aa, Mycobacterium
SEQLT

SEQ ID NO: 1225987 - protein, 6 aa, Mycobacterium
SEQPAW

SEQ ID NO: 1225988 - protein, 12 aa, Mycobacterium
SEQPEAFGDESR

SEQ ID NO: 1225989 - protein, 6 aa, Mycobacterium
SEQQPR

SEQ ID NO: 1225990 - protein, 6 aa, Mycobacterium
SEQQRR

SEQ ID NO: 1225991 - protein, 6 aa, Mycobacterium
SEQRAS

SEQ ID NO: 1225992 - protein, 12 aa, Mycobacterium
SEQRQLGRYERP

SEQ ID NO: 1225993 - protein, 6 aa, Mycobacterium
SEQSEV

SEQ ID NO: 1225994 - protein, 8 aa, Mycobacterium
SEQTDEGT

SEQ ID NO: 1225995 - protein, 8 aa, Mycobacterium
SEQTGVAP

SEQ ID NO: 1225996 - protein, 6 aa, Mycobacterium
SEQTRR

SEQ ID NO: 1225997 - protein, 14 aa, Mycobacterium
SEQVAGRATDGTVE

SEQ ID NO: 1225998 - protein, 15 aa, Mycobacterium
SERAESSRGPTGPLV

SEQ ID NO: 1225999 - protein, 9 aa, Mycobacterium
SERASEPFM

SEQ ID NO: 1226000 - protein, 4 aa, Mycobacterium
SERD

SEQ ID NO: 1226001 - protein, 16 aa, Mycobacterium
SERDAGYAGGRQSQIS

SEQ ID NO: 1226002 - protein, 22 aa, Mycobacterium
SEREAGSDAAAMRTRAKADGDD

SEQ ID NO: 1226003 - protein, 4 aa, Mycobacterium
SERF

SEQ ID NO: 1226004 - protein, 9 aa, Mycobacterium
SERGDPWEG

SEQ ID NO: 1226005 - protein, 6 aa, Mycobacterium
SERGFS

SEQ ID NO: 1226006 - protein, 15 aa, Mycobacterium
SERGGAAGARADRDL

SEQ ID NO: 1226007 - protein, 15 aa, Mycobacterium
SERGGPAGAQADRDL

SEQ ID NO: 1226008 - protein, 10 aa, Mycobacterium
SERGQAQAQA

SEQ ID NO: 1226009 - protein, 6 aa, Mycobacterium
SERGVD

SEQ ID NO: 1226010 - protein, 4 aa, Mycobacterium
SERL

SEQ ID NO: 1226011 - protein, 6 aa, Mycobacterium
SERLDD

SEQ ID NO: 1226012 - protein, 6 aa, Mycobacterium
SERPAR

SEQ ID NO: 1226013 - protein, 16 aa, Mycobacterium
SERPGLSVGIEPLLDL

SEQ ID NO: 1226014 - protein, 10 aa, Mycobacterium
SERPTYENAR

SEQ ID NO: 1226015 - protein, 5 aa, Mycobacterium
SERQN

SEQ ID NO: 1226016 - protein, 7 aa, Mycobacterium
SERRTYH

SEQ ID NO: 1226017 - protein, 10 aa, Mycobacterium
SERRTYHNED

SEQ ID NO: 1226018 - protein, 9 aa, Mycobacterium
SERSGASMR

SEQ ID NO: 1226019 - protein, 14 aa, Mycobacterium
SERTATLSKRAVST

SEQ ID NO: 1226020 - protein, 5 aa, Mycobacterium
SERTP

SEQ ID NO: 1226021 - protein, 9 aa, Mycobacterium
SERTSDGPL

SEQ ID NO: 1226022 - protein, 12 aa, Mycobacterium
SESAASSNIENL

SEQ ID NO: 1226023 - protein, 29 aa, Mycobacterium
SESAGADPHVPFGGAKKSGLGPKEQGGAA

SEQ ID NO: 1226024 - protein, 13 aa, Mycobacterium
SESAGKAQNLTPR

SEQ ID NO: 1226025 - protein, 7 aa, Mycobacterium
SESDAEQ

SEQ ID NO: 1226026 - protein, 7 aa, Mycobacterium
SESDIPA

SEQ ID NO: 1226027 - protein, 10 aa, Mycobacterium
SESDPAVSEA

SEQ ID NO: 1226028 - protein, 13 aa, Mycobacterium
SESEHSRKVGDHT

SEQ ID NO: 1226029 - protein, 23 aa, Mycobacterium
SESESQGLQASATTLRAAQESLG

SEQ ID NO: 1226030 - protein, 5 aa, Mycobacterium
SESGG

SEQ ID NO: 1226031 - protein, 5 aa, Mycobacterium
SESGH

SEQ ID NO: 1226032 - protein, 7 aa, Mycobacterium
SESGPVK

SEQ ID NO: 1226033 - protein, 4 aa, Mycobacterium
SESH

SEQ ID NO: 1226034 - protein, 10 aa, Mycobacterium
SESKAGKDAA

SEQ ID NO: 1226035 - protein, 12 aa, Mycobacterium
SESKHGPAGNRR

SEQ ID NO: 1226036 - protein, 5 aa, Mycobacterium
SESLR

SEQ ID NO: 1226037 - protein, 8 aa, Mycobacterium
SESPASGM

SEQ ID NO: 1226038 - protein, 8 aa, Mycobacterium
SESPGEPL

SEQ ID NO: 1226039 - protein, 15 aa, Mycobacterium
SESPPRKSPPKPTIK

SEQ ID NO: 1226040 - protein, 4 aa, Mycobacterium
SESR

SEQ ID NO: 1226041 - protein, 10 aa, Mycobacterium
SESSPAAHFD

SEQ ID NO: 1226042 - protein, 7 aa, Mycobacterium
SESTGGS

SEQ ID NO: 1226043 - protein, 7 aa, Mycobacterium
SESTGKR

SEQ ID NO: 1226044 - protein, 5 aa, Mycobacterium
SESVN

SEQ ID NO: 1226045 - protein, 16 aa, Mycobacterium
SETAALPDSPAEPMRP

SEQ ID NO: 1226046 - protein, 10 aa, Mycobacterium
SETADGLGDT

SEQ ID NO: 1226047 - protein, 9 aa, Mycobacterium
SETDQDLGD

SEQ ID NO: 1226048 - protein, 5 aa, Mycobacterium
SETEL

SEQ ID NO: 1226049 - protein, 7 aa, Mycobacterium
SETEPGL

SEQ ID NO: 1226050 - protein, 8 aa, Mycobacterium
SETFGTSP

SEQ ID NO: 1226051 - protein, 6 aa, Mycobacterium
SETGHS

SEQ ID NO: 1226052 - protein, 6 aa, Mycobacterium
SETGNA

SEQ ID NO: 1226053 - protein, 5 aa, Mycobacterium
SETIR

SEQ ID NO: 1226054 - protein, 10 aa, Mycobacterium
SETKGSEGVI

SEQ ID NO: 1226055 - protein, 7 aa, Mycobacterium
SETNPSV

SEQ ID NO: 1226056 - protein, 7 aa, Mycobacterium
SETPLSA

SEQ ID NO: 1226057 - protein, 20 aa, Mycobacterium
SETTATGDRDELKPGVADRS

SEQ ID NO: 1226058 - protein, 7 aa, Mycobacterium
SETTGIE

SEQ ID NO: 1226059 - protein, 11 aa, Mycobacterium
SETTVAENPRE

SEQ ID NO: 1226060 - protein, 6 aa, Mycobacterium
SETVDP

SEQ ID NO: 1226061 - protein, 15 aa, Mycobacterium
SETVRAQSAEPGRTS

SEQ ID NO: 1226062 - protein, 13 aa, Mycobacterium
SETVSAPRGGTMG

SEQ ID NO: 1226063 - protein, 6 aa, Mycobacterium
SEVAPA

SEQ ID NO: 1226064 - protein, 8 aa, Mycobacterium
SEVAPASS

SEQ ID NO: 1226065 - protein, 4 aa, Mycobacterium
SEVD

SEQ ID NO: 1226066 - protein, 8 aa, Mycobacterium
SEVDDQSV

SEQ ID NO: 1226067 - protein, 6 aa, Mycobacterium
SEVDPR

SEQ ID NO: 1226068 - protein, 6 aa, Mycobacterium
SEVGSR

SEQ ID NO: 1226069 - protein, 5 aa, Mycobacterium
SEVPE

SEQ ID NO: 1226070 - protein, 9 aa, Mycobacterium
SEVRQGNSH

SEQ ID NO: 1226071 - protein, 8 aa, Mycobacterium
SEVSEPGD

SEQ ID NO: 1226072 - protein, 6 aa, Mycobacterium
SEYATP

SEQ ID NO: 1226073 - protein, 4 aa, Mycobacterium
SEYE

SEQ ID NO: 1226074 - protein, 7 aa, Mycobacterium
SEYETEL

SEQ ID NO: 1226075 - protein, 9 aa, Mycobacterium
SEYKRGEAV

SEQ ID NO: 1226076 - protein, 7 aa, Mycobacterium
SEYSGEV

SEQ ID NO: 1226077 - protein, 5 aa, Mycobacterium
SFAPE

SEQ ID NO: 1226078 - protein, 12 aa, Mycobacterium
SFDESKLAENYG

SEQ ID NO: 1226079 - protein, 7 aa, Mycobacterium
SFDTTRP

SEQ ID NO: 1226080 - protein, 11 aa, Mycobacterium
SFEAKDRGART

SEQ ID NO: 1226081 - protein, 7 aa, Mycobacterium
SFEPLES

SEQ ID NO: 1226082 - protein, 6 aa, Mycobacterium
SFEPPD

SEQ ID NO: 1226083 - protein, 14 aa, Mycobacterium
SFGAGNYGMSGRAY

SEQ ID NO: 1226084 - protein, 12 aa, Mycobacterium
SFGELDNDPDRL

SEQ ID NO: 1226085 - protein, 8 aa, Mycobacterium
SFGGGPVG

SEQ ID NO: 1226086 - protein, 4 aa, Mycobacterium
SFGS

SEQ ID NO: 1226087 - protein, 6 aa, Mycobacterium
SFGSEA

SEQ ID NO: 1226088 - protein, 15 aa, Mycobacterium
SFGTATPAGSDEEAD

SEQ ID NO: 1226089 - protein, 12 aa, Mycobacterium
SFPDSVDAEDEF

SEQ ID NO: 1226090 - protein, 7 aa, Mycobacterium
SFPPRDV

SEQ ID NO: 1226091 - protein, 12 aa, Mycobacterium
SFPTHNAATTRE

SEQ ID NO: 1226092 - protein, 11 aa, Mycobacterium
SFQNKRDRLGS

SEQ ID NO: 1226093 - protein, 7 aa, Mycobacterium
SFQSPRH

SEQ ID NO: 1226094 - protein, 7 aa, Mycobacterium
SFRGPGL

SEQ ID NO: 1226095 - protein, 8 aa, Mycobacterium
SFSGGDSY

SEQ ID NO: 1226096 - protein, 13 aa, Mycobacterium
SFSPTGPRGAGRH

SEQ ID NO: 1226097 - protein, 59 aa, Mycobacterium
SFSTPNAPKLPGGFGGLPEPVATGPSPSGGAGTGGLYGAPASAMGRDGGAATEQRQGRT

SEQ ID NO: 1226098 - protein, 12 aa, Mycobacterium
SFTAAGDQLTGA

SEQ ID NO: 1226099 - protein, 6 aa, Mycobacterium
SFTHPG

SEQ ID NO: 1226100 - protein, 17 aa, Mycobacterium
SFTKAAQRERVAQPAVS

SEQ ID NO: 1226101 - protein, 6 aa, Mycobacterium
SFTPRS

SEQ ID NO: 1226102 - protein, 9 aa, Mycobacterium
SGAAMAPAQ

SEQ ID NO: 1226103 - protein, 8 aa, Mycobacterium
SGAAQSMP

SEQ ID NO: 1226104 - protein, 22 aa, Mycobacterium
SGAASEQYAGANTQNRRATSGV

SEQ ID NO: 1226105 - protein, 7 aa, Mycobacterium
SGAATAA

SEQ ID NO: 1226106 - protein, 9 aa, Mycobacterium
SGACSPDEE

SEQ ID NO: 1226107 - protein, 9 aa, Mycobacterium
SGADAAMAD

SEQ ID NO: 1226108 - protein, 9 aa, Mycobacterium
SGADDAALE

SEQ ID NO: 1226109 - protein, 9 aa, Mycobacterium
SGADGCADG

SEQ ID NO: 1226110 - protein, 6 aa, Mycobacterium
SGADLK

SEQ ID NO: 1226111 - protein, 7 aa, Mycobacterium
SGADPSK

SEQ ID NO: 1226112 - protein, 7 aa, Mycobacterium
SGADTPM

SEQ ID NO: 1226113 - protein, 5 aa, Mycobacterium
SGAEA

SEQ ID NO: 1226114 - protein, 115 aa, Mycobacterium
SGAEEPAEDEPAEEEPVDAEPAEEEPVDEEPAEEEPVDEEPAEEEPVDEEPAGEEPVDAEPPVAEPLEPEEAPAVERPAAQAETDQTETVTRDISDQTAPDQPVADTEAPASPAL

SEQ ID NO: 1226115 - protein, 20 aa, Mycobacterium
SGAEGVSPETGDPDGEDAPP

SEQ ID NO: 1226116 - protein, 7 aa, Mycobacterium
SGAEIES

SEQ ID NO: 1226117 - protein, 7 aa, Mycobacterium
SGAERTV

SEQ ID NO: 1226118 - protein, 5 aa, Mycobacterium
SGAET

SEQ ID NO: 1226119 - protein, 29 aa, Mycobacterium
SGAGAESGPGAGAESGPGAGAESGPGADG

SEQ ID NO: 1226120 - protein, 22 aa, Mycobacterium
SGAGDGSAISDADFKRAGGQLV

SEQ ID NO: 1226121 - protein, 10 aa, Mycobacterium
SGAGQAAQRA

SEQ ID NO: 1226122 - protein, 143 aa, Mycobacterium
SGAHGGDGGDGGGPGGDGGNGGDAGGKDEAYGGWGGDGGPAGVTGDGGKGGNGGNATSASATAYGGRGGNGRDGGLGGDGGAGGDGGTGKSSTGRGDGGNGGNGGNGGLGGRGADGGKGGAGSTNNGKPGGGGNDNGGPPGLA

SEQ ID NO: 1226123 - protein, 5 aa, Mycobacterium
SGAIP

SEQ ID NO: 1226124 - protein, 6 aa, Mycobacterium
SGAITR

SEQ ID NO: 1226125 - protein, 8 aa, Mycobacterium
SGAKAIVG

SEQ ID NO: 1226126 - protein, 9 aa, Mycobacterium
SGAKAQAAG

SEQ ID NO: 1226127 - protein, 8 aa, Mycobacterium
SGALAGDD

SEQ ID NO: 1226128 - protein, 8 aa, Mycobacterium
SGALQGQS

SEQ ID NO: 1226129 - protein, 5 aa, Mycobacterium
SGANG

SEQ ID NO: 1226130 - protein, 9 aa, Mycobacterium
SGANNGDRH

SEQ ID NO: 1226131 - protein, 12 aa, Mycobacterium
SGANSPSPWGTG

SEQ ID NO: 1226132 - protein, 19 aa, Mycobacterium
SGAPAEQQVYGPARDAADA

SEQ ID NO: 1226133 - protein, 7 aa, Mycobacterium
SGAPAMS

SEQ ID NO: 1226134 - protein, 9 aa, Mycobacterium
SGAPDIGPH

SEQ ID NO: 1226135 - protein, 7 aa, Mycobacterium
SGAPFGG

SEQ ID NO: 1226136 - protein, 5 aa, Mycobacterium
SGAPL

SEQ ID NO: 1226137 - protein, 16 aa, Mycobacterium
SGAPLGPGDEGEIQVR

SEQ ID NO: 1226138 - protein, 9 aa, Mycobacterium
SGAQASAEY

SEQ ID NO: 1226139 - protein, 6 aa, Mycobacterium
SGAQAW

SEQ ID NO: 1226140 - protein, 5 aa, Mycobacterium
SGAQS

SEQ ID NO: 1226141 - protein, 4 aa, Mycobacterium
SGAR

SEQ ID NO: 1226142 - protein, 12 aa, Mycobacterium
SGARDPGPSLPD

SEQ ID NO: 1226143 - protein, 11 aa, Mycobacterium
SGARPNSDNEI

SEQ ID NO: 1226144 - protein, 6 aa, Mycobacterium
SGATDV

SEQ ID NO: 1226145 - protein, 6 aa, Mycobacterium
SGATLP

SEQ ID NO: 1226146 - protein, 8 aa, Mycobacterium
SGATNAQL

SEQ ID NO: 1226147 - protein, 9 aa, Mycobacterium
SGATSQKPL

SEQ ID NO: 1226148 - protein, 17 aa, Mycobacterium
SGAVDGAGTLDASGAAT

SEQ ID NO: 1226149 - protein, 10 aa, Mycobacterium
SGAYAPDPAA

SEQ ID NO: 1226150 - protein, 7 aa, Mycobacterium
SGCATGN

SEQ ID NO: 1226151 - protein, 7 aa, Mycobacterium
SGDAHSA

SEQ ID NO: 1226152 - protein, 5 aa, Mycobacterium
SGDAL

SEQ ID NO: 1226153 - protein, 5 aa, Mycobacterium
SGDAP

SEQ ID NO: 1226154 - protein, 8 aa, Mycobacterium
SGDAVGAG

SEQ ID NO: 1226155 - protein, 8 aa, Mycobacterium
SGDDPHDA

SEQ ID NO: 1226156 - protein, 11 aa, Mycobacterium
SGDDPKTTEIE

SEQ ID NO: 1226157 - protein, 6 aa, Mycobacterium
SGDDVV

SEQ ID NO: 1226158 - protein, 7 aa, Mycobacterium
SGDEQLR

SEQ ID NO: 1226159 - protein, 6 aa, Mycobacterium
SGDERS

SEQ ID NO: 1226160 - protein, 8 aa, Mycobacterium
SGDEYQWG

SEQ ID NO: 1226161 - protein, 7 aa, Mycobacterium
SGDGAVV

SEQ ID NO: 1226162 - protein, 7 aa, Mycobacterium
SGDGDRR

SEQ ID NO: 1226163 - protein, 9 aa, Mycobacterium
SGDGFGAGV

SEQ ID NO: 1226164 - protein, 5 aa, Mycobacterium
SGDGT

SEQ ID NO: 1226165 - protein, 6 aa, Mycobacterium
SGDHSR

SEQ ID NO: 1226166 - protein, 5 aa, Mycobacterium
SGDHT

SEQ ID NO: 1226167 - protein, 6 aa, Mycobacterium
SGDKEG

SEQ ID NO: 1226168 - protein, 4 aa, Mycobacterium
SGDL

SEQ ID NO: 1226169 - protein, 6 aa, Mycobacterium
SGDNPH

SEQ ID NO: 1226170 - protein, 6 aa, Mycobacterium
SGDNVP

SEQ ID NO: 1226171 - protein, 4 aa, Mycobacterium
SGDP

SEQ ID NO: 1226172 - protein, 8 aa, Mycobacterium
SGDPGAVT

SEQ ID NO: 1226173 - protein, 19 aa, Mycobacterium
SGDPQLPTPSAPTPPPMPH

SEQ ID NO: 1226174 - protein, 8 aa, Mycobacterium
SGDPQLSD

SEQ ID NO: 1226175 - protein, 8 aa, Mycobacterium
SGDPQTGP

SEQ ID NO: 1226176 - protein, 5 aa, Mycobacterium
SGDPR

SEQ ID NO: 1226177 - protein, 7 aa, Mycobacterium
SGDPVQP

SEQ ID NO: 1226178 - protein, 7 aa, Mycobacterium
SGDQVGR

SEQ ID NO: 1226179 - protein, 19 aa, Mycobacterium
SGDQYNTGRKVPTSQAKRG

SEQ ID NO: 1226180 - protein, 5 aa, Mycobacterium
SGDRE

SEQ ID NO: 1226181 - protein, 5 aa, Mycobacterium
SGDRI

SEQ ID NO: 1226182 - protein, 7 aa, Mycobacterium
SGDRRET

SEQ ID NO: 1226183 - protein, 8 aa, Mycobacterium
SGDRTGAL

SEQ ID NO: 1226184 - protein, 10 aa, Mycobacterium
SGDSAGGGLA

SEQ ID NO: 1226185 - protein, 9 aa, Mycobacterium
SGDSRVPFD

SEQ ID NO: 1226186 - protein, 8 aa, Mycobacterium
SGDTATSR

SEQ ID NO: 1226187 - protein, 11 aa, Mycobacterium
SGDTRDNNHAR

SEQ ID NO: 1226188 - protein, 7 aa, Mycobacterium
SGDTTLA

SEQ ID NO: 1226189 - protein, 13 aa, Mycobacterium
SGDVSGKVLLRVD

SEQ ID NO: 1226190 - protein, 11 aa, Mycobacterium
SGDVTPKPNVA

SEQ ID NO: 1226191 - protein, 6 aa, Mycobacterium
SGDYMS

SEQ ID NO: 1226192 - protein, 8 aa, Mycobacterium
SGEADHEH

SEQ ID NO: 1226193 - protein, 6 aa, Mycobacterium
SGEAPL

SEQ ID NO: 1226194 - protein, 6 aa, Mycobacterium
SGEARS

SEQ ID NO: 1226195 - protein, 7 aa, Mycobacterium
SGEATPT

SEQ ID NO: 1226196 - protein, 8 aa, Mycobacterium
SGEDLARA

SEQ ID NO: 1226197 - protein, 5 aa, Mycobacterium
SGEEA

SEQ ID NO: 1226198 - protein, 5 aa, Mycobacterium
SGEEV

SEQ ID NO: 1226199 - protein, 5 aa, Mycobacterium
SGEGI

SEQ ID NO: 1226200 - protein, 7 aa, Mycobacterium
SGEGRPL

SEQ ID NO: 1226201 - protein, 6 aa, Mycobacterium
SGEGRT

SEQ ID NO: 1226202 - protein, 8 aa, Mycobacterium
SGEHPDWD

SEQ ID NO: 1226203 - protein, 11 aa, Mycobacterium
SGEHPSFSAAQ

SEQ ID NO: 1226204 - protein, 6 aa, Mycobacterium
SGEINR

SEQ ID NO: 1226205 - protein, 4 aa, Mycobacterium
SGEL

SEQ ID NO: 1226206 - protein, 15 aa, Mycobacterium
SGELETVSARGGDII

SEQ ID NO: 1226207 - protein, 9 aa, Mycobacterium
SGELRTPAQ

SEQ ID NO: 1226208 - protein, 6 aa, Mycobacterium
SGELSG

SEQ ID NO: 1226209 - protein, 5 aa, Mycobacterium
SGEME

SEQ ID NO: 1226210 - protein, 11 aa, Mycobacterium
SGENDEPIPGG

SEQ ID NO: 1226211 - protein, 4 aa, Mycobacterium
SGEP

SEQ ID NO: 1226212 - protein, 5 aa, Mycobacterium
SGEPI

SEQ ID NO: 1226213 - protein, 4 aa, Mycobacterium
SGER

SEQ ID NO: 1226214 - protein, 10 aa, Mycobacterium
SGERAPRHPP

SEQ ID NO: 1226215 - protein, 8 aa, Mycobacterium
SGEREFAR

SEQ ID NO: 1226216 - protein, 18 aa, Mycobacterium
SGERQHSGPEERRTAPSR

SEQ ID NO: 1226217 - protein, 7 aa, Mycobacterium
SGERTIG

SEQ ID NO: 1226218 - protein, 10 aa, Mycobacterium
SGESSGGRVT

SEQ ID NO: 1226219 - protein, 4 aa, Mycobacterium
SGET

SEQ ID NO: 1226220 - protein, 7 aa, Mycobacterium
SGETARR

SEQ ID NO: 1226221 - protein, 5 aa, Mycobacterium
SGETI

SEQ ID NO: 1226222 - protein, 5 aa, Mycobacterium
SGETL

SEQ ID NO: 1226223 - protein, 7 aa, Mycobacterium
SGEVGAV

SEQ ID NO: 1226224 - protein, 5 aa, Mycobacterium
SGEVK

SEQ ID NO: 1226225 - protein, 7 aa, Mycobacterium
SGEVPDV

SEQ ID NO: 1226226 - protein, 12 aa, Mycobacterium
SGEWTGATGERI

SEQ ID NO: 1226227 - protein, 8 aa, Mycobacterium
SGEYPKPW

SEQ ID NO: 1226228 - protein, 6 aa, Mycobacterium
SGFANR

SEQ ID NO: 1226229 - protein, 7 aa, Mycobacterium
SGFDTPS

SEQ ID NO: 1226230 - protein, 12 aa, Mycobacterium
SGFGAGQPGGPL

SEQ ID NO: 1226231 - protein, 11 aa, Mycobacterium
SGFHDGGDHDD

SEQ ID NO: 1226232 - protein, 6 aa, Mycobacterium
SGFQRG

SEQ ID NO: 1226233 - protein, 9 aa, Mycobacterium
SGGAGDDAA

SEQ ID NO: 1226234 - protein, 7 aa, Mycobacterium
SGGAGLT

SEQ ID NO: 1226235 - protein, 9 aa, Mycobacterium
SGGAGTGKT

SEQ ID NO: 1226236 - protein, 22 aa, Mycobacterium
SGGANACTGPGGFQDTHATAEA

SEQ ID NO: 1226237 - protein, 18 aa, Mycobacterium
SGGAPVFPAEEDERGLGL

SEQ ID NO: 1226238 - protein, 7 aa, Mycobacterium
SGGDDLG

SEQ ID NO: 1226239 - protein, 5 aa, Mycobacterium
SGGDG

SEQ ID NO: 1226240 - protein, 20 aa, Mycobacterium
SGGDGGAGGAGAAGGTGGNA

SEQ ID NO: 1226241 - protein, 8 aa, Mycobacterium
SGGDHAQQ

SEQ ID NO: 1226242 - protein, 7 aa, Mycobacterium
SGGEAAR

SEQ ID NO: 1226243 - protein, 6 aa, Mycobacterium
SGGEAL

SEQ ID NO: 1226244 - protein, 8 aa, Mycobacterium
SGGEAQRV

SEQ ID NO: 1226245 - protein, 6 aa, Mycobacterium
SGGEHP

SEQ ID NO: 1226246 - protein, 8 aa, Mycobacterium
SGGERPPF

SEQ ID NO: 1226247 - protein, 7 aa, Mycobacterium
SGGGCTT

SEQ ID NO: 1226248 - protein, 6 aa, Mycobacterium
SGGGFD

SEQ ID NO: 1226249 - protein, 23 aa, Mycobacterium
SGGGGTPSAGFGVPTTTQLPAGS

SEQ ID NO: 1226250 - protein, 7 aa, Mycobacterium
SGGGNRI

SEQ ID NO: 1226251 - protein, 5 aa, Mycobacterium
SGGGP

SEQ ID NO: 1226252 - protein, 8 aa, Mycobacterium
SGGGPYTL

SEQ ID NO: 1226253 - protein, 9 aa, Mycobacterium
SGGGVGTAS

SEQ ID NO: 1226254 - protein, 4 aa, Mycobacterium
SGGH

SEQ ID NO: 1226255 - protein, 13 aa, Mycobacterium
SGGHPVTRTDSGR

SEQ ID NO: 1226256 - protein, 6 aa, Mycobacterium
SGGHSW

SEQ ID NO: 1226257 - protein, 7 aa, Mycobacterium
SGGLGDA

SEQ ID NO: 1226258 - protein, 8 aa, Mycobacterium
SGGLPREQ

SEQ ID NO: 1226259 - protein, 15 aa, Mycobacterium
SGGLTPSGALLLRTA

SEQ ID NO: 1226260 - protein, 6 aa, Mycobacterium
SGGMAK

SEQ ID NO: 1226261 - protein, 4 aa, Mycobacterium
SGGN

SEQ ID NO: 1226262 - protein, 7 aa, Mycobacterium
SGGNIRS

SEQ ID NO: 1226263 - protein, 8 aa, Mycobacterium
SGGPAWPR

SEQ ID NO: 1226264 - protein, 5 aa, Mycobacterium
SGGPD

SEQ ID NO: 1226265 - protein, 6 aa, Mycobacterium
SGGPFH

SEQ ID NO: 1226266 - protein, 7 aa, Mycobacterium
SGGPGAV

SEQ ID NO: 1226267 - protein, 10 aa, Mycobacterium
SGGPSSGSAV

SEQ ID NO: 1226268 - protein, 8 aa, Mycobacterium
SGGQAQRV

SEQ ID NO: 1226269 - protein, 5 aa, Mycobacterium
SGGQK

SEQ ID NO: 1226270 - protein, 8 aa, Mycobacterium
SGGQQDTW

SEQ ID NO: 1226271 - protein, 7 aa, Mycobacterium
SGGRAEL

SEQ ID NO: 1226272 - protein, 5 aa, Mycobacterium
SGGRI

SEQ ID NO: 1226273 - protein, 11 aa, Mycobacterium
SGGRLTPDQAA

SEQ ID NO: 1226274 - protein, 8 aa, Mycobacterium
SGGRPLPD

SEQ ID NO: 1226275 - protein, 5 aa, Mycobacterium
SGGRS

SEQ ID NO: 1226276 - protein, 11 aa, Mycobacterium
SGGRVSAGGAS

SEQ ID NO: 1226277 - protein, 12 aa, Mycobacterium
SGGSDRKPSTLE

SEQ ID NO: 1226278 - protein, 7 aa, Mycobacterium
SGGTAPA

SEQ ID NO: 1226279 - protein, 7 aa, Mycobacterium
SGGTETA

SEQ ID NO: 1226280 - protein, 15 aa, Mycobacterium
SGGTGISPTDATPQI

SEQ ID NO: 1226281 - protein, 11 aa, Mycobacterium
SGGTPARSQRG

SEQ ID NO: 1226282 - protein, 9 aa, Mycobacterium
SGGVAAPHS

SEQ ID NO: 1226283 - protein, 13 aa, Mycobacterium
SGGVAPEIGPVDT

SEQ ID NO: 1226284 - protein, 9 aa, Mycobacterium
SGGVEEAVT

SEQ ID NO: 1226285 - protein, 5 aa, Mycobacterium
SGGVG

SEQ ID NO: 1226286 - protein, 5 aa, Mycobacterium
SGGVY

SEQ ID NO: 1226287 - protein, 22 aa, Mycobacterium
SGGYAKRTAIEEYSAQGRGGKG

SEQ ID NO: 1226288 - protein, 7 aa, Mycobacterium
SGGYATT

SEQ ID NO: 1226289 - protein, 10 aa, Mycobacterium
SGGYGGPGFN

SEQ ID NO: 1226290 - protein, 28 aa, Mycobacterium
SGHEPWRSSPRYSPRSRRSSGRGLRSSR

SEQ ID NO: 1226291 - protein, 17 aa, Mycobacterium
SGHPDGRLRSADAEWGA

SEQ ID NO: 1226292 - protein, 14 aa, Mycobacterium
SGHPDPADRSQPPH

SEQ ID NO: 1226293 - protein, 5 aa, Mycobacterium
SGHRA

SEQ ID NO: 1226294 - protein, 11 aa, Mycobacterium
SGHRDESVPDR

SEQ ID NO: 1226295 - protein, 7 aa, Mycobacterium
SGHSDDK

SEQ ID NO: 1226296 - protein, 9 aa, Mycobacterium
SGHSPPEHV

SEQ ID NO: 1226297 - protein, 10 aa, Mycobacterium
SGHSVQSDQP

SEQ ID NO: 1226298 - protein, 6 aa, Mycobacterium
SGHVRG

SEQ ID NO: 1226299 - protein, 7 aa, Mycobacterium
SGIADNE

SEQ ID NO: 1226300 - protein, 6 aa, Mycobacterium
SGIADT

SEQ ID NO: 1226301 - protein, 6 aa, Mycobacterium
SGIDQS

SEQ ID NO: 1226302 - protein, 10 aa, Mycobacterium
SGIDSGVDQV

SEQ ID NO: 1226303 - protein, 5 aa, Mycobacterium
SGIEP

SEQ ID NO: 1226304 - protein, 4 aa, Mycobacterium
SGIG

SEQ ID NO: 1226305 - protein, 9 aa, Mycobacterium
SGIGRENGI

SEQ ID NO: 1226306 - protein, 6 aa, Mycobacterium
SGIHAP

SEQ ID NO: 1226307 - protein, 4 aa, Mycobacterium
SGIR

SEQ ID NO: 1226308 - protein, 6 aa, Mycobacterium
SGIREG

SEQ ID NO: 1226309 - protein, 5 aa, Mycobacterium
SGITD

SEQ ID NO: 1226310 - protein, 9 aa, Mycobacterium
SGITEDDPL

SEQ ID NO: 1226311 - protein, 12 aa, Mycobacterium
SGKAAPAKARAG

SEQ ID NO: 1226312 - protein, 5 aa, Mycobacterium
SGKAL

SEQ ID NO: 1226313 - protein, 12 aa, Mycobacterium
SGKALNAGASPD

SEQ ID NO: 1226314 - protein, 16 aa, Mycobacterium
SGKFDAKARRPRVVTF

SEQ ID NO: 1226315 - protein, 5 aa, Mycobacterium
SGKGF

SEQ ID NO: 1226316 - protein, 11 aa, Mycobacterium
SGKGGVGKSSI

SEQ ID NO: 1226317 - protein, 5 aa, Mycobacterium
SGKHP

SEQ ID NO: 1226318 - protein, 6 aa, Mycobacterium
SGKNFS

SEQ ID NO: 1226319 - protein, 7 aa, Mycobacterium
SGKNTHV

SEQ ID NO: 1226320 - protein, 4 aa, Mycobacterium
SGKR

SEQ ID NO: 1226321 - protein, 7 aa, Mycobacterium
SGKSQTY

SEQ ID NO: 1226322 - protein, 13 aa, Mycobacterium
SGKTGTTESNRSS

SEQ ID NO: 1226323 - protein, 19 aa, Mycobacterium
SGKTSSITAIDSPTGPVGE

SEQ ID NO: 1226324 - protein, 9 aa, Mycobacterium
SGKTTRSQL

SEQ ID NO: 1226325 - protein, 6 aa, Mycobacterium
SGKVPT

SEQ ID NO: 1226326 - protein, 4 aa, Mycobacterium
SGLA

SEQ ID NO: 1226327 - protein, 15 aa, Mycobacterium
SGLADTLRDAEKTVA

SEQ ID NO: 1226328 - protein, 6 aa, Mycobacterium
SGLAGD

SEQ ID NO: 1226329 - protein, 8 aa, Mycobacterium
SGLAKPDG

SEQ ID NO: 1226330 - protein, 9 aa, Mycobacterium
SGLAKPDGI

SEQ ID NO: 1226331 - protein, 10 aa, Mycobacterium
SGLARQKDHS

SEQ ID NO: 1226332 - protein, 5 aa, Mycobacterium
SGLDK

SEQ ID NO: 1226333 - protein, 22 aa, Mycobacterium
SGLDKSEQGRIGPNPDTFDYIP

SEQ ID NO: 1226334 - protein, 9 aa, Mycobacterium
SGLEANRAE

SEQ ID NO: 1226335 - protein, 6 aa, Mycobacterium
SGLEED

SEQ ID NO: 1226336 - protein, 6 aa, Mycobacterium
SGLEGW

SEQ ID NO: 1226337 - protein, 6 aa, Mycobacterium
SGLEPH

SEQ ID NO: 1226338 - protein, 10 aa, Mycobacterium
SGLEPQTADR

SEQ ID NO: 1226339 - protein, 5 aa, Mycobacterium
SGLES

SEQ ID NO: 1226340 - protein, 7 aa, Mycobacterium
SGLGGAA

SEQ ID NO: 1226341 - protein, 8 aa, Mycobacterium
SGLGSSAL

SEQ ID NO: 1226342 - protein, 11 aa, Mycobacterium
SGLIESPRKAR

SEQ ID NO: 1226343 - protein, 5 aa, Mycobacterium
SGLNQ

SEQ ID NO: 1226344 - protein, 5 aa, Mycobacterium
SGLPA

SEQ ID NO: 1226345 - protein, 7 aa, Mycobacterium
SGLPDHA

SEQ ID NO: 1226346 - protein, 7 aa, Mycobacterium
SGLPLPD

SEQ ID NO: 1226347 - protein, 5 aa, Mycobacterium
SGLPP

SEQ ID NO: 1226348 - protein, 11 aa, Mycobacterium
SGLPRGGPPVA

SEQ ID NO: 1226349 - protein, 10 aa, Mycobacterium
SGLPSTAART

SEQ ID NO: 1226350 - protein, 8 aa, Mycobacterium
SGLQGLDP

SEQ ID NO: 1226351 - protein, 7 aa, Mycobacterium
SGLQPTV

SEQ ID NO: 1226352 - protein, 11 aa, Mycobacterium
SGLRGKARGMG

SEQ ID NO: 1226353 - protein, 19 aa, Mycobacterium
SGLRGKGRLTDADIDATAR

SEQ ID NO: 1226354 - protein, 8 aa, Mycobacterium
SGLSNREI

SEQ ID NO: 1226355 - protein, 7 aa, Mycobacterium
SGLSPAP

SEQ ID NO: 1226356 - protein, 8 aa, Mycobacterium
SGLSPEDI

SEQ ID NO: 1226357 - protein, 6 aa, Mycobacterium
SGLSRT

SEQ ID NO: 1226358 - protein, 7 aa, Mycobacterium
SGLSTDA

SEQ ID NO: 1226359 - protein, 5 aa, Mycobacterium
SGLTH

SEQ ID NO: 1226360 - protein, 14 aa, Mycobacterium
SGLTRGTAVGSDYD

SEQ ID NO: 1226361 - protein, 9 aa, Mycobacterium
SGLTVPAGT

SEQ ID NO: 1226362 - protein, 12 aa, Mycobacterium
SGLVRPEPGITS

SEQ ID NO: 1226363 - protein, 12 aa, Mycobacterium
SGMADTPARHQP

SEQ ID NO: 1226364 - protein, 11 aa, Mycobacterium
SGMEGGMTEGY

SEQ ID NO: 1226365 - protein, 4 aa, Mycobacterium
SGMG

SEQ ID NO: 1226366 - protein, 5 aa, Mycobacterium
SGMGK

SEQ ID NO: 1226367 - protein, 4 aa, Mycobacterium
SGMK

SEQ ID NO: 1226368 - protein, 5 aa, Mycobacterium
SGMPA

SEQ ID NO: 1226369 - protein, 8 aa, Mycobacterium
SGMSNKEV

SEQ ID NO: 1226370 - protein, 5 aa, Mycobacterium
SGMTN

SEQ ID NO: 1226371 - protein, 5 aa, Mycobacterium
SGNAL

SEQ ID NO: 1226372 - protein, 12 aa, Mycobacterium
SGNGYRSLEENQ

SEQ ID NO: 1226373 - protein, 9 aa, Mycobacterium
SGNLRSAQR

SEQ ID NO: 1226374 - protein, 29 aa, Mycobacterium
SGNLRSAQRAVERTGAEVEVTADADTALN

SEQ ID NO: 1226375 - protein, 6 aa, Mycobacterium
SGNPVH

SEQ ID NO: 1226376 - protein, 13 aa, Mycobacterium
SGNQPTKERIQSQ

SEQ ID NO: 1226377 - protein, 22 aa, Mycobacterium
SGNQPTRERIQSQTDRARYDDT

SEQ ID NO: 1226378 - protein, 11 aa, Mycobacterium
SGNRAAAQDVY

SEQ ID NO: 1226379 - protein, 15 aa, Mycobacterium
SGNRSGSAAKKLAAA

SEQ ID NO: 1226380 - protein, 10 aa, Mycobacterium
SGNTDDPADI

SEQ ID NO: 1226381 - protein, 4 aa, Mycobacterium
SGNV

SEQ ID NO: 1226382 - protein, 4 aa, Mycobacterium
SGPA

SEQ ID NO: 1226383 - protein, 14 aa, Mycobacterium
SGPAAGQPAITTAE

SEQ ID NO: 1226384 - protein, 6 aa, Mycobacterium
SGPAAI

SEQ ID NO: 1226385 - protein, 29 aa, Mycobacterium
SGPAFGHTRNPWSREHTPGGSSGGSAAAV

SEQ ID NO: 1226386 - protein, 8 aa, Mycobacterium
SGPAGASA

SEQ ID NO: 1226387 - protein, 10 aa, Mycobacterium
SGPAGGGNNG

SEQ ID NO: 1226388 - protein, 13 aa, Mycobacterium
SGPAPGRYTGPAP

SEQ ID NO: 1226389 - protein, 7 aa, Mycobacterium
SGPATDG

SEQ ID NO: 1226390 - protein, 6 aa, Mycobacterium
SGPDSV

SEQ ID NO: 1226391 - protein, 4 aa, Mycobacterium
SGPE

SEQ ID NO: 1226392 - protein, 10 aa, Mycobacterium
SGPESGSPTW

SEQ ID NO: 1226393 - protein, 9 aa, Mycobacterium
SGPGATGWS

SEQ ID NO: 1226394 - protein, 7 aa, Mycobacterium
SGPGDVP

SEQ ID NO: 1226395 - protein, 16 aa, Mycobacterium
SGPGEDADLGAVPAPA

SEQ ID NO: 1226396 - protein, 10 aa, Mycobacterium
SGPGGQKAAI

SEQ ID NO: 1226397 - protein, 8 aa, Mycobacterium
SGPGGRSA

SEQ ID NO: 1226398 - protein, 5 aa, Mycobacterium
SGPGL

SEQ ID NO: 1226399 - protein, 8 aa, Mycobacterium
SGPGRADS

SEQ ID NO: 1226400 - protein, 5 aa, Mycobacterium
SGPGV

SEQ ID NO: 1226401 - protein, 5 aa, Mycobacterium
SGPHG

SEQ ID NO: 1226402 - protein, 7 aa, Mycobacterium
SGPKSAA

SEQ ID NO: 1226403 - protein, 7 aa, Mycobacterium
SGPLAAH

SEQ ID NO: 1226404 - protein, 13 aa, Mycobacterium
SGPLDPETRDEFE

SEQ ID NO: 1226405 - protein, 6 aa, Mycobacterium
SGPLRD

SEQ ID NO: 1226406 - protein, 5 aa, Mycobacterium
SGPMP

SEQ ID NO: 1226407 - protein, 9 aa, Mycobacterium
SGPNGRAES

SEQ ID NO: 1226408 - protein, 8 aa, Mycobacterium
SGPNRIGQ

SEQ ID NO: 1226409 - protein, 6 aa, Mycobacterium
SGPPLK

SEQ ID NO: 1226410 - protein, 7 aa, Mycobacterium
SGPPLTS

SEQ ID NO: 1226411 - protein, 16 aa, Mycobacterium
SGPPRADGKPRAPQDL

SEQ ID NO: 1226412 - protein, 6 aa, Mycobacterium
SGPQHC

SEQ ID NO: 1226413 - protein, 7 aa, Mycobacterium
SGPQHGP

SEQ ID NO: 1226414 - protein, 5 aa, Mycobacterium
SGPRL

SEQ ID NO: 1226415 - protein, 7 aa, Mycobacterium
SGPSGYF

SEQ ID NO: 1226416 - protein, 4 aa, Mycobacterium
SGPT

SEQ ID NO: 1226417 - protein, 14 aa, Mycobacterium
SGPTADTIGAAPGE

SEQ ID NO: 1226418 - protein, 7 aa, Mycobacterium
SGPTGGH

SEQ ID NO: 1226419 - protein, 41 aa, Mycobacterium
SGPTPRCGPPVTEAPGPTEWGEAPGVGPWPGELPDDPRYDP

SEQ ID NO: 1226420 - protein, 5 aa, Mycobacterium
SGPVA

SEQ ID NO: 1226421 - protein, 16 aa, Mycobacterium
SGPVQGARVVPSPSNA

SEQ ID NO: 1226422 - protein, 5 aa, Mycobacterium
SGPVT

SEQ ID NO: 1226423 - protein, 6 aa, Mycobacterium
SGPVYD

SEQ ID NO: 1226424 - protein, 6 aa, Mycobacterium
SGPWGT

SEQ ID NO: 1226425 - protein, 4 aa, Mycobacterium
SGQA

SEQ ID NO: 1226426 - protein, 10 aa, Mycobacterium
SGQAASAALA

SEQ ID NO: 1226427 - protein, 7 aa, Mycobacterium
SGQALSA

SEQ ID NO: 1226428 - protein, 9 aa, Mycobacterium
SGQDAGKQT

SEQ ID NO: 1226429 - protein, 7 aa, Mycobacterium
SGQGTSI

SEQ ID NO: 1226430 - protein, 15 aa, Mycobacterium
SGQHARQREFTQSSK

SEQ ID NO: 1226431 - protein, 7 aa, Mycobacterium
SGQLNPG

SEQ ID NO: 1226432 - protein, 8 aa, Mycobacterium
SGQNPEGL

SEQ ID NO: 1226433 - protein, 7 aa, Mycobacterium
SGQPVPV

SEQ ID NO: 1226434 - protein, 6 aa, Mycobacterium
SGQRRA

SEQ ID NO: 1226435 - protein, 7 aa, Mycobacterium
SGQRRTG

SEQ ID NO: 1226436 - protein, 5 aa, Mycobacterium
SGQTL

SEQ ID NO: 1226437 - protein, 5 aa, Mycobacterium
SGQTV

SEQ ID NO: 1226438 - protein, 8 aa, Mycobacterium
SGQTYGAE

SEQ ID NO: 1226439 - protein, 5 aa, Mycobacterium
SGQWS

SEQ ID NO: 1226440 - protein, 4 aa, Mycobacterium
SGRA

SEQ ID NO: 1226441 - protein, 5 aa, Mycobacterium
SGRAD

SEQ ID NO: 1226442 - protein, 5 aa, Mycobacterium
SGRAE

SEQ ID NO: 1226443 - protein, 4 aa, Mycobacterium
SGRD

SEQ ID NO: 1226444 - protein, 6 aa, Mycobacterium
SGRDFD

SEQ ID NO: 1226445 - protein, 15 aa, Mycobacterium
SGRDPATVRADEVAT

SEQ ID NO: 1226446 - protein, 16 aa, Mycobacterium
SGRDPDAVEQAAQRVS

SEQ ID NO: 1226447 - protein, 5 aa, Mycobacterium
SGRDY

SEQ ID NO: 1226448 - protein, 6 aa, Mycobacterium
SGRELA

SEQ ID NO: 1226449 - protein, 9 aa, Mycobacterium
SGRGAESRI

SEQ ID NO: 1226450 - protein, 7 aa, Mycobacterium
SGRGAKM

SEQ ID NO: 1226451 - protein, 6 aa, Mycobacterium
SGRGDM

SEQ ID NO: 1226452 - protein, 8 aa, Mycobacterium
SGRGGDIS

SEQ ID NO: 1226453 - protein, 9 aa, Mycobacterium
SGRGGEPEF

SEQ ID NO: 1226454 - protein, 8 aa, Mycobacterium
SGRGGQVD

SEQ ID NO: 1226455 - protein, 12 aa, Mycobacterium
SGRGHEEPRTSR

SEQ ID NO: 1226456 - protein, 8 aa, Mycobacterium
SGRGNPDG

SEQ ID NO: 1226457 - protein, 4 aa, Mycobacterium
SGRH

SEQ ID NO: 1226458 - protein, 6 aa, Mycobacterium
SGRHEL

SEQ ID NO: 1226459 - protein, 10 aa, Mycobacterium
SGRKDEAAKV

SEQ ID NO: 1226460 - protein, 4 aa, Mycobacterium
SGRL

SEQ ID NO: 1226461 - protein, 9 aa, Mycobacterium
SGRLDDDSI

SEQ ID NO: 1226462 - protein, 9 aa, Mycobacterium
SGRLGAEEL

SEQ ID NO: 1226463 - protein, 6 aa, Mycobacterium
SGRLPD

SEQ ID NO: 1226464 - protein, 6 aa, Mycobacterium
SGRLPE

SEQ ID NO: 1226465 - protein, 6 aa, Mycobacterium
SGRNMR

SEQ ID NO: 1226466 - protein, 4 aa, Mycobacterium
SGRP

SEQ ID NO: 1226467 - protein, 5 aa, Mycobacterium
SGRPA

SEQ ID NO: 1226468 - protein, 6 aa, Mycobacterium
SGRPGF

SEQ ID NO: 1226469 - protein, 9 aa, Mycobacterium
SGRQPRSKR

SEQ ID NO: 1226470 - protein, 6 aa, Mycobacterium
SGRQVG

SEQ ID NO: 1226471 - protein, 5 aa, Mycobacterium
SGRRD

SEQ ID NO: 1226472 - protein, 8 aa, Mycobacterium
SGRRDGTT

SEQ ID NO: 1226473 - protein, 5 aa, Mycobacterium
SGRRE

SEQ ID NO: 1226474 - protein, 11 aa, Mycobacterium
SGRRPTPGTVA

SEQ ID NO: 1226475 - protein, 6 aa, Mycobacterium
SGRRQA

SEQ ID NO: 1226476 - protein, 9 aa, Mycobacterium
SGRRRTGAQ

SEQ ID NO: 1226477 - protein, 6 aa, Mycobacterium
SGRRTL

SEQ ID NO: 1226478 - protein, 8 aa, Mycobacterium
SGRSPARF

SEQ ID NO: 1226479 - protein, 10 aa, Mycobacterium
SGRSSSEITE

SEQ ID NO: 1226480 - protein, 9 aa, Mycobacterium
SGRSTPVEE

SEQ ID NO: 1226481 - protein, 7 aa, Mycobacterium
SGRTGVD

SEQ ID NO: 1226482 - protein, 6 aa, Mycobacterium
SGRTIT

SEQ ID NO: 1226483 - protein, 8 aa, Mycobacterium
SGRTYRGT

SEQ ID NO: 1226484 - protein, 6 aa, Mycobacterium
SGSADD

SEQ ID NO: 1226485 - protein, 61 aa, Mycobacterium
SGSAGGGNTTGLAGGGAASGSTGGAGAAAGSMGAGGGGGTPGCASADGLPIASAGASPTMT

SEQ ID NO: 1226486 - protein, 15 aa, Mycobacterium
SGSAKAAFSEKTNFN

SEQ ID NO: 1226487 - protein, 9 aa, Mycobacterium
SGSAKDQGL

SEQ ID NO: 1226488 - protein, 5 aa, Mycobacterium
SGSAR

SEQ ID NO: 1226489 - protein, 12 aa, Mycobacterium
SGSATDADGDGL

SEQ ID NO: 1226490 - protein, 7 aa, Mycobacterium
SGSCTTE

SEQ ID NO: 1226491 - protein, 7 aa, Mycobacterium
SGSDLTA

SEQ ID NO: 1226492 - protein, 8 aa, Mycobacterium
SGSEADYQ

SEQ ID NO: 1226493 - protein, 8 aa, Mycobacterium
SGSEAVEN

SEQ ID NO: 1226494 - protein, 22 aa, Mycobacterium
SGSESDVRQAASAAEEALARSV

SEQ ID NO: 1226495 - protein, 4 aa, Mycobacterium
SGSG

SEQ ID NO: 1226496 - protein, 7 aa, Mycobacterium
SGSGKSS

SEQ ID NO: 1226497 - protein, 7 aa, Mycobacterium
SGSGLEA

SEQ ID NO: 1226498 - protein, 5 aa, Mycobacterium
SGSGN

SEQ ID NO: 1226499 - protein, 5 aa, Mycobacterium
SGSGP

SEQ ID NO: 1226500 - protein, 10 aa, Mycobacterium
SGSGPLRPGA

SEQ ID NO: 1226501 - protein, 11 aa, Mycobacterium
SGSGPRRSRPH

SEQ ID NO: 1226502 - protein, 15 aa, Mycobacterium
SGSGRGGSSGLRGVL

SEQ ID NO: 1226503 - protein, 8 aa, Mycobacterium
SGSGRGIG

SEQ ID NO: 1226504 - protein, 4 aa, Mycobacterium
SGSI

SEQ ID NO: 1226505 - protein, 11 aa, Mycobacterium
SGSIEDEHRRA

SEQ ID NO: 1226506 - protein, 8 aa, Mycobacterium
SGSKAQRT

SEQ ID NO: 1226507 - protein, 4 aa, Mycobacterium
SGSL

SEQ ID NO: 1226508 - protein, 5 aa, Mycobacterium
SGSLD

SEQ ID NO: 1226509 - protein, 11 aa, Mycobacterium
SGSLGNTPAVA

SEQ ID NO: 1226510 - protein, 8 aa, Mycobacterium
SGSMQGEP

SEQ ID NO: 1226511 - protein, 10 aa, Mycobacterium
SGSNITPYPR

SEQ ID NO: 1226512 - protein, 14 aa, Mycobacterium
SGSPFDPAVPTRRV

SEQ ID NO: 1226513 - protein, 11 aa, Mycobacterium
SGSPITIGRAD

SEQ ID NO: 1226514 - protein, 10 aa, Mycobacterium
SGSPSDPDVA

SEQ ID NO: 1226515 - protein, 9 aa, Mycobacterium
SGSQIESPI

SEQ ID NO: 1226516 - protein, 6 aa, Mycobacterium
SGSQPT

SEQ ID NO: 1226517 - protein, 16 aa, Mycobacterium
SGSQYNAGRKIPSAQM

SEQ ID NO: 1226518 - protein, 5 aa, Mycobacterium
SGSRD

SEQ ID NO: 1226519 - protein, 6 aa, Mycobacterium
SGSRMR

SEQ ID NO: 1226520 - protein, 23 aa, Mycobacterium
SGSRRGGAVSGIGGHNAAMAVLE

SEQ ID NO: 1226521 - protein, 14 aa, Mycobacterium
SGSSFRGSDPGPWD

SEQ ID NO: 1226522 - protein, 6 aa, Mycobacterium
SGSSGD

SEQ ID NO: 1226523 - protein, 7 aa, Mycobacterium
SGSSLGR

SEQ ID NO: 1226524 - protein, 6 aa, Mycobacterium
SGSSSV

SEQ ID NO: 1226525 - protein, 6 aa, Mycobacterium
SGSSTH

SEQ ID NO: 1226526 - protein, 9 aa, Mycobacterium
SGSTDDTEI

SEQ ID NO: 1226527 - protein, 11 aa, Mycobacterium
SGSTGAPKGAM

SEQ ID NO: 1226528 - protein, 15 aa, Mycobacterium
SGSTGAPKGAMYPES

SEQ ID NO: 1226529 - protein, 9 aa, Mycobacterium
SGSTGDPKG

SEQ ID NO: 1226530 - protein, 10 aa, Mycobacterium
SGSTGEPKGV

SEQ ID NO: 1226531 - protein, 9 aa, Mycobacterium
SGSTGGGVA

SEQ ID NO: 1226532 - protein, 10 aa, Mycobacterium
SGSTGLPKGV

SEQ ID NO: 1226533 - protein, 10 aa, Mycobacterium
SGSTGRPKGV

SEQ ID NO: 1226534 - protein, 5 aa, Mycobacterium
SGSTK

SEQ ID NO: 1226535 - protein, 10 aa, Mycobacterium
SGSYEATQRI

SEQ ID NO: 1226536 - protein, 10 aa, Mycobacterium
SGSYGPHRRG

SEQ ID NO: 1226537 - protein, 11 aa, Mycobacterium
SGSYPSTEETL

SEQ ID NO: 1226538 - protein, 7 aa, Mycobacterium
SGTAMAP

SEQ ID NO: 1226539 - protein, 14 aa, Mycobacterium
SGTAPLSADDADAF

SEQ ID NO: 1226540 - protein, 6 aa, Mycobacterium
SGTARM

SEQ ID NO: 1226541 - protein, 6 aa, Mycobacterium
SGTATQ

SEQ ID NO: 1226542 - protein, 7 aa, Mycobacterium
SGTATSV

SEQ ID NO: 1226543 - protein, 13 aa, Mycobacterium
SGTDRDDLDDDPR

SEQ ID NO: 1226544 - protein, 10 aa, Mycobacterium
SGTDRQDVDD

SEQ ID NO: 1226545 - protein, 8 aa, Mycobacterium
SGTEANEA

SEQ ID NO: 1226546 - protein, 7 aa, Mycobacterium
SGTEASW

SEQ ID NO: 1226547 - protein, 6 aa, Mycobacterium
SGTEEI

SEQ ID NO: 1226548 - protein, 10 aa, Mycobacterium
SGTEMTQEDW

SEQ ID NO: 1226549 - protein, 16 aa, Mycobacterium
SGTENGGYAEGPLPPG

SEQ ID NO: 1226550 - protein, 16 aa, Mycobacterium
SGTESHPKGAQHSSRS

SEQ ID NO: 1226551 - protein, 9 aa, Mycobacterium
SGTESRPKA

SEQ ID NO: 1226552 - protein, 4 aa, Mycobacterium
SGTF

SEQ ID NO: 1226553 - protein, 4 aa, Mycobacterium
SGTG

SEQ ID NO: 1226554 - protein, 16 aa, Mycobacterium
SGTGAQIRDTRKTLPG

SEQ ID NO: 1226555 - protein, 5 aa, Mycobacterium
SGTGM

SEQ ID NO: 1226556 - protein, 8 aa, Mycobacterium
SGTGPNVD

SEQ ID NO: 1226557 - protein, 5 aa, Mycobacterium
SGTGR

SEQ ID NO: 1226558 - protein, 13 aa, Mycobacterium
SGTGTSPAAAAGR

SEQ ID NO: 1226559 - protein, 7 aa, Mycobacterium
SGTHGNR

SEQ ID NO: 1226560 - protein, 4 aa, Mycobacterium
SGTL

SEQ ID NO: 1226561 - protein, 5 aa, Mycobacterium
SGTLS

SEQ ID NO: 1226562 - protein, 12 aa, Mycobacterium
SGTLTDHETGDE

SEQ ID NO: 1226563 - protein, 7 aa, Mycobacterium
SGTPEVA

SEQ ID NO: 1226564 - protein, 18 aa, Mycobacterium
SGTPMRSRGGPNHRGRRA

SEQ ID NO: 1226565 - protein, 8 aa, Mycobacterium
SGTPQDMA

SEQ ID NO: 1226566 - protein, 7 aa, Mycobacterium
SGTPTYH

SEQ ID NO: 1226567 - protein, 11 aa, Mycobacterium
SGTQSSATDQL

SEQ ID NO: 1226568 - protein, 10 aa, Mycobacterium
SGTREMSPAA

SEQ ID NO: 1226569 - protein, 9 aa, Mycobacterium
SGTRLGPGG

SEQ ID NO: 1226570 - protein, 5 aa, Mycobacterium
SGTRP

SEQ ID NO: 1226571 - protein, 8 aa, Mycobacterium
SGTSDEAV

SEQ ID NO: 1226572 - protein, 12 aa, Mycobacterium
SGTSGAGKSAKV

SEQ ID NO: 1226573 - protein, 6 aa, Mycobacterium
SGTSKG

SEQ ID NO: 1226574 - protein, 8 aa, Mycobacterium
SGTSNGRL

SEQ ID NO: 1226575 - protein, 7 aa, Mycobacterium
SGTTAPA

SEQ ID NO: 1226576 - protein, 5 aa, Mycobacterium
SGTTF

SEQ ID NO: 1226577 - protein, 9 aa, Mycobacterium
SGTTGAPKG

SEQ ID NO: 1226578 - protein, 10 aa, Mycobacterium
SGTTGAPKRI

SEQ ID NO: 1226579 - protein, 7 aa, Mycobacterium
SGTTGAS

SEQ ID NO: 1226580 - protein, 10 aa, Mycobacterium
SGTTGFGKST

SEQ ID NO: 1226581 - protein, 9 aa, Mycobacterium
SGTTGFPKG

SEQ ID NO: 1226582 - protein, 9 aa, Mycobacterium
SGTTGNPKG

SEQ ID NO: 1226583 - protein, 10 aa, Mycobacterium
SGTTGPPKRI

SEQ ID NO: 1226584 - protein, 11 aa, Mycobacterium
SGTTGPPKRQS

SEQ ID NO: 1226585 - protein, 8 aa, Mycobacterium
SGTTGRAK

SEQ ID NO: 1226586 - protein, 11 aa, Mycobacterium
SGTTGRPKGCQ

SEQ ID NO: 1226587 - protein, 10 aa, Mycobacterium
SGTTGRPKGV

SEQ ID NO: 1226588 - protein, 11 aa, Mycobacterium
SGTTGRPKGVE

SEQ ID NO: 1226589 - protein, 10 aa, Mycobacterium
SGTTGRSKGV

SEQ ID NO: 1226590 - protein, 20 aa, Mycobacterium
SGTTGSPKGARHSGGGADAL

SEQ ID NO: 1226591 - protein, 10 aa, Mycobacterium
SGTTGTPKGA

SEQ ID NO: 1226592 - protein, 18 aa, Mycobacterium
SGTTGTPKGASHSGGDPS

SEQ ID NO: 1226593 - protein, 20 aa, Mycobacterium
SGTTMRSRGGPNHRSRRASV

SEQ ID NO: 1226594 - protein, 10 aa, Mycobacterium
SGTTSKPKAV

SEQ ID NO: 1226595 - protein, 9 aa, Mycobacterium
SGTTSKPKL

SEQ ID NO: 1226596 - protein, 10 aa, Mycobacterium
SGTTSKPKLV

SEQ ID NO: 1226597 - protein, 16 aa, Mycobacterium
SGTTSSGALKPVEPED

SEQ ID NO: 1226598 - protein, 13 aa, Mycobacterium
SGTVTAASTWGGV

SEQ ID NO: 1226599 - protein, 5 aa, Mycobacterium
SGVAD

SEQ ID NO: 1226600 - protein, 5 aa, Mycobacterium
SGVAG

SEQ ID NO: 1226601 - protein, 9 aa, Mycobacterium
SGVAPGQVG

SEQ ID NO: 1226602 - protein, 15 aa, Mycobacterium
SGVASRATAFICRPS

SEQ ID NO: 1226603 - protein, 7 aa, Mycobacterium
SGVDPAD

SEQ ID NO: 1226604 - protein, 4 aa, Mycobacterium
SGVE

SEQ ID NO: 1226605 - protein, 18 aa, Mycobacterium
SGVEPLGSMGTDTPPAVL

SEQ ID NO: 1226606 - protein, 8 aa, Mycobacterium
SGVETGSV

SEQ ID NO: 1226607 - protein, 14 aa, Mycobacterium
SGVGGPSAAARAAD

SEQ ID NO: 1226608 - protein, 12 aa, Mycobacterium
SGVPAAARTEEL

SEQ ID NO: 1226609 - protein, 6 aa, Mycobacterium
SGVPDY

SEQ ID NO: 1226610 - protein, 5 aa, Mycobacterium
SGVPE

SEQ ID NO: 1226611 - protein, 5 aa, Mycobacterium
SGVPK

SEQ ID NO: 1226612 - protein, 8 aa, Mycobacterium
SGVPTQAD

SEQ ID NO: 1226613 - protein, 7 aa, Mycobacterium
SGVRGLG

SEQ ID NO: 1226614 - protein, 6 aa, Mycobacterium
SGVRGT

SEQ ID NO: 1226615 - protein, 5 aa, Mycobacterium
SGVSG

SEQ ID NO: 1226616 - protein, 13 aa, Mycobacterium
SGVTGQPVAPDKL

SEQ ID NO: 1226617 - protein, 6 aa, Mycobacterium
SGVTGT

SEQ ID NO: 1226618 - protein, 7 aa, Mycobacterium
SGVTNSA

SEQ ID NO: 1226619 - protein, 5 aa, Mycobacterium
SGVTP

SEQ ID NO: 1226620 - protein, 9 aa, Mycobacterium
SGVTSAPAG

SEQ ID NO: 1226621 - protein, 27 aa, Mycobacterium
SGVTTASQARAPRGRRSARPSGDDREQ

SEQ ID NO: 1226622 - protein, 27 aa, Mycobacterium
SGVTTASQARASRGRRSARPSGDDREQ

SEQ ID NO: 1226623 - protein, 7 aa, Mycobacterium
SGVVTTT

SEQ ID NO: 1226624 - protein, 6 aa, Mycobacterium
SGWSEA

SEQ ID NO: 1226625 - protein, 8 aa, Mycobacterium
SGYAEAPT

SEQ ID NO: 1226626 - protein, 6 aa, Mycobacterium
SGYAGL

SEQ ID NO: 1226627 - protein, 11 aa, Mycobacterium
SGYGAVPGGVG

SEQ ID NO: 1226628 - protein, 23 aa, Mycobacterium
SGYGEPVSDSVQPVPPSVRRLIN

SEQ ID NO: 1226629 - protein, 10 aa, Mycobacterium
SGYGGDSSWA

SEQ ID NO: 1226630 - protein, 6 aa, Mycobacterium
SGYGGQ

SEQ ID NO: 1226631 - protein, 5 aa, Mycobacterium
SGYGP

SEQ ID NO: 1226632 - protein, 17 aa, Mycobacterium
SGYGSDSCERADPGRAL

SEQ ID NO: 1226633 - protein, 8 aa, Mycobacterium
SGYGVDGP

SEQ ID NO: 1226634 - protein, 5 aa, Mycobacterium
SGYKY

SEQ ID NO: 1226635 - protein, 5 aa, Mycobacterium
SGYPD

SEQ ID NO: 1226636 - protein, 16 aa, Mycobacterium
SGYPEAPYDGIDNNAY

SEQ ID NO: 1226637 - protein, 7 aa, Mycobacterium
SGYPEET

SEQ ID NO: 1226638 - protein, 8 aa, Mycobacterium
SGYPGGLR

SEQ ID NO: 1226639 - protein, 5 aa, Mycobacterium
SGYQG

SEQ ID NO: 1226640 - protein, 14 aa, Mycobacterium
SGYSKQQSTRPQTL

SEQ ID NO: 1226641 - protein, 12 aa, Mycobacterium
SGYTPGSDDQRV

SEQ ID NO: 1226642 - protein, 9 aa, Mycobacterium
SHAATQSRT

SEQ ID NO: 1226643 - protein, 8 aa, Mycobacterium
SHAERDEY

SEQ ID NO: 1226644 - protein, 6 aa, Mycobacterium
SHAGGE

SEQ ID NO: 1226645 - protein, 8 aa, Mycobacterium
SHAGGRSA

SEQ ID NO: 1226646 - protein, 6 aa, Mycobacterium
SHAGPT

SEQ ID NO: 1226647 - protein, 15 aa, Mycobacterium
SHAPSYDELDRRTAQ

SEQ ID NO: 1226648 - protein, 40 aa, Mycobacterium
SHAPTPAPADGAQVASRSTDGSVRRCEERRTVTTEVTPLP

SEQ ID NO: 1226649 - protein, 8 aa, Mycobacterium
SHASSALS

SEQ ID NO: 1226650 - protein, 14 aa, Mycobacterium
SHDDPDESPHRDLD

SEQ ID NO: 1226651 - protein, 6 aa, Mycobacterium
SHDGGE

SEQ ID NO: 1226652 - protein, 6 aa, Mycobacterium
SHDGSS

SEQ ID NO: 1226653 - protein, 11 aa, Mycobacterium
SHDIGRGRGGV

SEQ ID NO: 1226654 - protein, 7 aa, Mycobacterium
SHDPDGE

SEQ ID NO: 1226655 - protein, 10 aa, Mycobacterium
SHDSDPASRD

SEQ ID NO: 1226656 - protein, 6 aa, Mycobacterium
SHDVEG

SEQ ID NO: 1226657 - protein, 11 aa, Mycobacterium
SHENADKALRA

SEQ ID NO: 1226658 - protein, 11 aa, Mycobacterium
SHGELTERRQR

SEQ ID NO: 1226659 - protein, 4 aa, Mycobacterium
SHGG

SEQ ID NO: 1226660 - protein, 6 aa, Mycobacterium
SHGGDP

SEQ ID NO: 1226661 - protein, 5 aa, Mycobacterium
SHGRP

SEQ ID NO: 1226662 - protein, 4 aa, Mycobacterium
SHGS

SEQ ID NO: 1226663 - protein, 5 aa, Mycobacterium
SHHAA

SEQ ID NO: 1226664 - protein, 14 aa, Mycobacterium
SHKERRSKSSVRSN

SEQ ID NO: 1226665 - protein, 6 aa, Mycobacterium
SHLPGI

SEQ ID NO: 1226666 - protein, 11 aa, Mycobacterium
SHMGTSAPGGW

SEQ ID NO: 1226667 - protein, 5 aa, Mycobacterium
SHNHP

SEQ ID NO: 1226668 - protein, 9 aa, Mycobacterium
SHNPPQDNG

SEQ ID NO: 1226669 - protein, 5 aa, Mycobacterium
SHPAT

SEQ ID NO: 1226670 - protein, 5 aa, Mycobacterium
SHPDR

SEQ ID NO: 1226671 - protein, 4 aa, Mycobacterium
SHPG

SEQ ID NO: 1226672 - protein, 6 aa, Mycobacterium
SHPGAL

SEQ ID NO: 1226673 - protein, 15 aa, Mycobacterium
SHPGGYAEPSGPDHQ

SEQ ID NO: 1226674 - protein, 5 aa, Mycobacterium
SHPPT

SEQ ID NO: 1226675 - protein, 7 aa, Mycobacterium
SHPSAFT

SEQ ID NO: 1226676 - protein, 5 aa, Mycobacterium
SHQGQ

SEQ ID NO: 1226677 - protein, 10 aa, Mycobacterium
SHRGAGNVAG

SEQ ID NO: 1226678 - protein, 28 aa, Mycobacterium
SHRGEGTRTAAVTPGAPLAVPEEDEREL

SEQ ID NO: 1226679 - protein, 13 aa, Mycobacterium
SHRNTGKACEEPV

SEQ ID NO: 1226680 - protein, 12 aa, Mycobacterium
SHRNTGRASGCP

SEQ ID NO: 1226681 - protein, 13 aa, Mycobacterium
SHRRAAAARKNGV

SEQ ID NO: 1226682 - protein, 12 aa, Mycobacterium
SHRRRSRAGDES

SEQ ID NO: 1226683 - protein, 15 aa, Mycobacterium
SHRSPAVRPAGGSRA

SEQ ID NO: 1226684 - protein, 15 aa, Mycobacterium
SHRTPVDSELSPTSV

SEQ ID NO: 1226685 - protein, 5 aa, Mycobacterium
SHSDA

SEQ ID NO: 1226686 - protein, 7 aa, Mycobacterium
SHSDEVP

SEQ ID NO: 1226687 - protein, 8 aa, Mycobacterium
SHSEPVGG

SEQ ID NO: 1226688 - protein, 9 aa, Mycobacterium
SHSKESQAI

SEQ ID NO: 1226689 - protein, 12 aa, Mycobacterium
SHSKSSVALRGP

SEQ ID NO: 1226690 - protein, 6 aa, Mycobacterium
SHSTGE

SEQ ID NO: 1226691 - protein, 5 aa, Mycobacterium
SHSTH

SEQ ID NO: 1226692 - protein, 11 aa, Mycobacterium
SHTARLEDSRY

SEQ ID NO: 1226693 - protein, 14 aa, Mycobacterium
SHTDQRTKAQTPVQ

SEQ ID NO: 1226694 - protein, 16 aa, Mycobacterium
SHTGNQKSIQPTTVEA

SEQ ID NO: 1226695 - protein, 12 aa, Mycobacterium
SHTSPAARKRAP

SEQ ID NO: 1226696 - protein, 6 aa, Mycobacterium
SHTTRA

SEQ ID NO: 1226697 - protein, 15 aa, Mycobacterium
SHTYDDSKSIAAEET

SEQ ID NO: 1226698 - protein, 7 aa, Mycobacterium
SHVDTEE

SEQ ID NO: 1226699 - protein, 4 aa, Mycobacterium
SHVP

SEQ ID NO: 1226700 - protein, 7 aa, Mycobacterium
SHYPKDN

SEQ ID NO: 1226701 - protein, 13 aa, Mycobacterium
SIADADSDSMSKA

SEQ ID NO: 1226702 - protein, 6 aa, Mycobacterium
SIADPR

SEQ ID NO: 1226703 - protein, 10 aa, Mycobacterium
SIAENTADAA

SEQ ID NO: 1226704 - protein, 12 aa, Mycobacterium
SIAGKGDSADGV

SEQ ID NO: 1226705 - protein, 9 aa, Mycobacterium
SIAHSSSEA

SEQ ID NO: 1226706 - protein, 5 aa, Mycobacterium
SIASR

SEQ ID NO: 1226707 - protein, 8 aa, Mycobacterium
SIAYSGSY

SEQ ID NO: 1226708 - protein, 6 aa, Mycobacterium
SIDDSD

SEQ ID NO: 1226709 - protein, 6 aa, Mycobacterium
SIDDVP

SEQ ID NO: 1226710 - protein, 4 aa, Mycobacterium
SIDE

SEQ ID NO: 1226711 - protein, 13 aa, Mycobacterium
SIDGDAGPGWYGG

SEQ ID NO: 1226712 - protein, 13 aa, Mycobacterium
SIDNSGKLTRRGA

SEQ ID NO: 1226713 - protein, 8 aa, Mycobacterium
SIDPGSTR

SEQ ID NO: 1226714 - protein, 9 aa, Mycobacterium
SIEGPAGPV

SEQ ID NO: 1226715 - protein, 12 aa, Mycobacterium
SIESGSKSNVIP

SEQ ID NO: 1226716 - protein, 13 aa, Mycobacterium
SIGATKKDGQRAK

SEQ ID NO: 1226717 - protein, 13 aa, Mycobacterium
SIGEGGPRPPTPF

SEQ ID NO: 1226718 - protein, 15 aa, Mycobacterium
SIGGGSGGPVGTTPD

SEQ ID NO: 1226719 - protein, 11 aa, Mycobacterium
SIGNDLSTPMP

SEQ ID NO: 1226720 - protein, 11 aa, Mycobacterium
SIGNPDRASNT

SEQ ID NO: 1226721 - protein, 5 aa, Mycobacterium
SIGPQ

SEQ ID NO: 1226722 - protein, 6 aa, Mycobacterium
SIGRDT

SEQ ID NO: 1226723 - protein, 14 aa, Mycobacterium
SIGRSGSAKEVTDV

SEQ ID NO: 1226724 - protein, 10 aa, Mycobacterium
SIGSSEPPFL

SEQ ID NO: 1226725 - protein, 28 aa, Mycobacterium
SIGSSETGFGGSSVVTKGQTHTGGPRVT

SEQ ID NO: 1226726 - protein, 12 aa, Mycobacterium
SIGSSETGFGGT

SEQ ID NO: 1226727 - protein, 6 aa, Mycobacterium
SIGTTD

SEQ ID NO: 1226728 - protein, 5 aa, Mycobacterium
SIGYG

SEQ ID NO: 1226729 - protein, 8 aa, Mycobacterium
SILPTDGR

SEQ ID NO: 1226730 - protein, 4 aa, Mycobacterium
SIPA

SEQ ID NO: 1226731 - protein, 9 aa, Mycobacterium
SIPAAHAPD

SEQ ID NO: 1226732 - protein, 7 aa, Mycobacterium
SIPADRP

SEQ ID NO: 1226733 - protein, 5 aa, Mycobacterium
SIPEM

SEQ ID NO: 1226734 - protein, 11 aa, Mycobacterium
SIPGAPANLTG

SEQ ID NO: 1226735 - protein, 7 aa, Mycobacterium
SIPGGID

SEQ ID NO: 1226736 - protein, 9 aa, Mycobacterium
SIPNEAIKD

SEQ ID NO: 1226737 - protein, 9 aa, Mycobacterium
SIPNEKIKD

SEQ ID NO: 1226738 - protein, 7 aa, Mycobacterium
SIPPPTL

SEQ ID NO: 1226739 - protein, 7 aa, Mycobacterium
SIPRRGV

SEQ ID NO: 1226740 - protein, 4 aa, Mycobacterium
SIPS

SEQ ID NO: 1226741 - protein, 8 aa, Mycobacterium
SIPTANGK

SEQ ID NO: 1226742 - protein, 7 aa, Mycobacterium
SIPTNPV

SEQ ID NO: 1226743 - protein, 12 aa, Mycobacterium
SIPTSEDVLESD

SEQ ID NO: 1226744 - protein, 18 aa, Mycobacterium
SIPTTTSGKIRRTASAEL

SEQ ID NO: 1226745 - protein, 11 aa, Mycobacterium
SIQSYDEEEPV

SEQ ID NO: 1226746 - protein, 5 aa, Mycobacterium
SIQTG

SEQ ID NO: 1226747 - protein, 12 aa, Mycobacterium
SIRGDASLSELG

SEQ ID NO: 1226748 - protein, 7 aa, Mycobacterium
SISPGYV

SEQ ID NO: 1226749 - protein, 11 aa, Mycobacterium
SITAATNNYTP

SEQ ID NO: 1226750 - protein, 11 aa, Mycobacterium
SITDGASSRRN

SEQ ID NO: 1226751 - protein, 7 aa, Mycobacterium
SITDPAE

SEQ ID NO: 1226752 - protein, 6 aa, Mycobacterium
SITGKG

SEQ ID NO: 1226753 - protein, 12 aa, Mycobacterium
SITSGSKSNVIP

SEQ ID NO: 1226754 - protein, 6 aa, Mycobacterium
SITSKE

SEQ ID NO: 1226755 - protein, 5 aa, Mycobacterium
SITTA

SEQ ID NO: 1226756 - protein, 18 aa, Mycobacterium
SIYDADGKPTLNTEQAAR

SEQ ID NO: 1226757 - protein, 6 aa, Mycobacterium
SKAALS

SEQ ID NO: 1226758 - protein, 7 aa, Mycobacterium
SKAALSS

SEQ ID NO: 1226759 - protein, 7 aa, Mycobacterium
SKAARPI

SEQ ID NO: 1226760 - protein, 6 aa, Mycobacterium
SKAAVR

SEQ ID NO: 1226761 - protein, 8 aa, Mycobacterium
SKAERHQR

SEQ ID NO: 1226762 - protein, 7 aa, Mycobacterium
SKAGLNA

SEQ ID NO: 1226763 - protein, 7 aa, Mycobacterium
SKAGNPI

SEQ ID NO: 1226764 - protein, 6 aa, Mycobacterium
SKAGSK

SEQ ID NO: 1226765 - protein, 8 aa, Mycobacterium
SKAGTLSL

SEQ ID NO: 1226766 - protein, 14 aa, Mycobacterium
SKAMRAVQGNSDPL

SEQ ID NO: 1226767 - protein, 6 aa, Mycobacterium
SKANVT

SEQ ID NO: 1226768 - protein, 9 aa, Mycobacterium
SKAQAEQVR

SEQ ID NO: 1226769 - protein, 27 aa, Mycobacterium
SKAQAGLPAPVTKRARSREATNHPSRA

SEQ ID NO: 1226770 - protein, 14 aa, Mycobacterium
SKAQSTCIESNADR

SEQ ID NO: 1226771 - protein, 15 aa, Mycobacterium
SKAQWDENDDGLSPL

SEQ ID NO: 1226772 - protein, 4 aa, Mycobacterium
SKAR

SEQ ID NO: 1226773 - protein, 10 aa, Mycobacterium
SKASASTKAL

SEQ ID NO: 1226774 - protein, 8 aa, Mycobacterium
SKATGARI

SEQ ID NO: 1226775 - protein, 6 aa, Mycobacterium
SKAWPD

SEQ ID NO: 1226776 - protein, 19 aa, Mycobacterium
SKDDTGAGTAAGAAGSTGW

SEQ ID NO: 1226777 - protein, 13 aa, Mycobacterium
SKDEAREELANEP

SEQ ID NO: 1226778 - protein, 15 aa, Mycobacterium
SKDGHDESISPVLTL

SEQ ID NO: 1226779 - protein, 11 aa, Mycobacterium
SKDGKTDELKA

SEQ ID NO: 1226780 - protein, 8 aa, Mycobacterium
SKDRADWE

SEQ ID NO: 1226781 - protein, 20 aa, Mycobacterium
SKDRSSKKEVKQVKPTHADV

SEQ ID NO: 1226782 - protein, 4 aa, Mycobacterium
SKEL

SEQ ID NO: 1226783 - protein, 7 aa, Mycobacterium
SKEQVTS

SEQ ID NO: 1226784 - protein, 6 aa, Mycobacterium
SKFEQA

SEQ ID NO: 1226785 - protein, 11 aa, Mycobacterium
SKGASDSEIKR

SEQ ID NO: 1226786 - protein, 16 aa, Mycobacterium
SKGEAGTGDVSNATTH

SEQ ID NO: 1226787 - protein, 11 aa, Mycobacterium
SKGGDPKAPGW

SEQ ID NO: 1226788 - protein, 9 aa, Mycobacterium
SKGGDPRHP

SEQ ID NO: 1226789 - protein, 9 aa, Mycobacterium
SKGKRSTTR

SEQ ID NO: 1226790 - protein, 13 aa, Mycobacterium
SKGYDAAASMSGR

SEQ ID NO: 1226791 - protein, 8 aa, Mycobacterium
SKGYPYEE

SEQ ID NO: 1226792 - protein, 9 aa, Mycobacterium
SKGYRGQRS

SEQ ID NO: 1226793 - protein, 7 aa, Mycobacterium
SKHAPDA

SEQ ID NO: 1226794 - protein, 9 aa, Mycobacterium
SKHNGLSDR

SEQ ID NO: 1226795 - protein, 9 aa, Mycobacterium
SKIGSPGDR

SEQ ID NO: 1226796 - protein, 7 aa, Mycobacterium
SKITERT

SEQ ID NO: 1226797 - protein, 10 aa, Mycobacterium
SKKSGSQTES

SEQ ID NO: 1226798 - protein, 8 aa, Mycobacterium
SKKWGRRA

SEQ ID NO: 1226799 - protein, 10 aa, Mycobacterium
SKLAPPGALS

SEQ ID NO: 1226800 - protein, 11 aa, Mycobacterium
SKLDDTGRAAL

SEQ ID NO: 1226801 - protein, 10 aa, Mycobacterium
SKLGDKAAGE

SEQ ID NO: 1226802 - protein, 7 aa, Mycobacterium
SKLGDQH

SEQ ID NO: 1226803 - protein, 4 aa, Mycobacterium
SKLN

SEQ ID NO: 1226804 - protein, 17 aa, Mycobacterium
SKLQKPAGDRVKTDARD

SEQ ID NO: 1226805 - protein, 9 aa, Mycobacterium
SKNADKVDT

SEQ ID NO: 1226806 - protein, 7 aa, Mycobacterium
SKNDREQ

SEQ ID NO: 1226807 - protein, 8 aa, Mycobacterium
SKPQRLDN

SEQ ID NO: 1226808 - protein, 13 aa, Mycobacterium
SKPRPDFTANPEK

SEQ ID NO: 1226809 - protein, 25 aa, Mycobacterium
SKPTYDDAARQQLATAREAKAHDTA

SEQ ID NO: 1226810 - protein, 7 aa, Mycobacterium
SKQADAY

SEQ ID NO: 1226811 - protein, 6 aa, Mycobacterium
SKQERN

SEQ ID NO: 1226812 - protein, 6 aa, Mycobacterium
SKQGRW

SEQ ID NO: 1226813 - protein, 6 aa, Mycobacterium
SKQRGR

SEQ ID NO: 1226814 - protein, 5 aa, Mycobacterium
SKQRL

SEQ ID NO: 1226815 - protein, 10 aa, Mycobacterium
SKRGNPHGIG

SEQ ID NO: 1226816 - protein, 7 aa, Mycobacterium
SKRLPTA

SEQ ID NO: 1226817 - protein, 5 aa, Mycobacterium
SKRPP

SEQ ID NO: 1226818 - protein, 8 aa, Mycobacterium
SKRSGDRD

SEQ ID NO: 1226819 - protein, 13 aa, Mycobacterium
SKRSPAEVAKHGG

SEQ ID NO: 1226820 - protein, 10 aa, Mycobacterium
SKRTRNKHER

SEQ ID NO: 1226821 - protein, 8 aa, Mycobacterium
SKRTSDDF

SEQ ID NO: 1226822 - protein, 10 aa, Mycobacterium
SKRVSSGRSV

SEQ ID NO: 1226823 - protein, 15 aa, Mycobacterium
SKSRYRYSAASAEHR

SEQ ID NO: 1226824 - protein, 11 aa, Mycobacterium
SKSTSAGAVDA

SEQ ID NO: 1226825 - protein, 11 aa, Mycobacterium
SKTAPDSDPVA

SEQ ID NO: 1226826 - protein, 5 aa, Mycobacterium
SKTAQ

SEQ ID NO: 1226827 - protein, 8 aa, Mycobacterium
SKTDPGDT

SEQ ID NO: 1226828 - protein, 6 aa, Mycobacterium
SKTEGR

SEQ ID NO: 1226829 - protein, 9 aa, Mycobacterium
SKTFGGLPP

SEQ ID NO: 1226830 - protein, 16 aa, Mycobacterium
SKTGTSFDQEVAETQR

SEQ ID NO: 1226831 - protein, 7 aa, Mycobacterium
SKTPVPQ

SEQ ID NO: 1226832 - protein, 15 aa, Mycobacterium
SKTSREQAISRNTKN

SEQ ID NO: 1226833 - protein, 16 aa, Mycobacterium
SKTSREQAISRNTKNL

SEQ ID NO: 1226834 - protein, 5 aa, Mycobacterium
SKVER

SEQ ID NO: 1226835 - protein, 8 aa, Mycobacterium
SKYQRPGD

SEQ ID NO: 1226836 - protein, 11 aa, Mycobacterium
SLAANGTPEQV

SEQ ID NO: 1226837 - protein, 11 aa, Mycobacterium
SLAAPRAYRAA

SEQ ID NO: 1226838 - protein, 9 aa, Mycobacterium
SLAAQKGGN

SEQ ID NO: 1226839 - protein, 10 aa, Mycobacterium
SLADADPAGL

SEQ ID NO: 1226840 - protein, 6 aa, Mycobacterium
SLADEV

SEQ ID NO: 1226841 - protein, 13 aa, Mycobacterium
SLAESSPKTLSPK

SEQ ID NO: 1226842 - protein, 12 aa, Mycobacterium
SLAGKDNEEVRA

SEQ ID NO: 1226843 - protein, 6 aa, Mycobacterium
SLAGRR

SEQ ID NO: 1226844 - protein, 12 aa, Mycobacterium
SLAPGSQESYAP

SEQ ID NO: 1226845 - protein, 11 aa, Mycobacterium
SLAPRQASPLE

SEQ ID NO: 1226846 - protein, 5 aa, Mycobacterium
SLAQP

SEQ ID NO: 1226847 - protein, 10 aa, Mycobacterium
SLARGETAPL

SEQ ID NO: 1226848 - protein, 7 aa, Mycobacterium
SLASEPL

SEQ ID NO: 1226849 - protein, 14 aa, Mycobacterium
SLASGDPGSVSANR

SEQ ID NO: 1226850 - protein, 29 aa, Mycobacterium
SLASRTSKGRPAEAASRRGVAAQPDPGVF

SEQ ID NO: 1226851 - protein, 5 aa, Mycobacterium
SLDAS

SEQ ID NO: 1226852 - protein, 9 aa, Mycobacterium
SLDDPAGVR

SEQ ID NO: 1226853 - protein, 7 aa, Mycobacterium
SLDDRER

SEQ ID NO: 1226854 - protein, 19 aa, Mycobacterium
SLDENGGLVTGSPDAESEL

SEQ ID NO: 1226855 - protein, 7 aa, Mycobacterium
SLDGEQW

SEQ ID NO: 1226856 - protein, 7 aa, Mycobacterium
SLDNDEN

SEQ ID NO: 1226857 - protein, 5 aa, Mycobacterium
SLDPE

SEQ ID NO: 1226858 - protein, 8 aa, Mycobacterium
SLDPETRS

SEQ ID NO: 1226859 - protein, 5 aa, Mycobacterium
SLDPP

SEQ ID NO: 1226860 - protein, 9 aa, Mycobacterium
SLDQQTPLG

SEQ ID NO: 1226861 - protein, 4 aa, Mycobacterium
SLDR

SEQ ID NO: 1226862 - protein, 10 aa, Mycobacterium
SLDRQTRTAK

SEQ ID NO: 1226863 - protein, 10 aa, Mycobacterium
SLDSATDDER

SEQ ID NO: 1226864 - protein, 18 aa, Mycobacterium
SLEDASRLGPDPKTFNFT

SEQ ID NO: 1226865 - protein, 18 aa, Mycobacterium
SLEDGSRLGPDPKTFNFT

SEQ ID NO: 1226866 - protein, 10 aa, Mycobacterium
SLEDLRAGGA

SEQ ID NO: 1226867 - protein, 11 aa, Mycobacterium
SLEGAGPLREG

SEQ ID NO: 1226868 - protein, 7 aa, Mycobacterium
SLEPRQC

SEQ ID NO: 1226869 - protein, 11 aa, Mycobacterium
SLEQRRTDEER

SEQ ID NO: 1226870 - protein, 5 aa, Mycobacterium
SLESG

SEQ ID NO: 1226871 - protein, 8 aa, Mycobacterium
SLETGIGR

SEQ ID NO: 1226872 - protein, 13 aa, Mycobacterium
SLGAADAELTEGQ

SEQ ID NO: 1226873 - protein, 16 aa, Mycobacterium
SLGAAGATVGAGKLPQ

SEQ ID NO: 1226874 - protein, 4 aa, Mycobacterium
SLGD

SEQ ID NO: 1226875 - protein, 5 aa, Mycobacterium
SLGDD

SEQ ID NO: 1226876 - protein, 6 aa, Mycobacterium
SLGDRA

SEQ ID NO: 1226877 - protein, 5 aa, Mycobacterium
SLGEA

SEQ ID NO: 1226878 - protein, 6 aa, Mycobacterium
SLGEAA

SEQ ID NO: 1226879 - protein, 20 aa, Mycobacterium
SLGGAVGASRAAVDSGYYPG

SEQ ID NO: 1226880 - protein, 5 aa, Mycobacterium
SLGGG

SEQ ID NO: 1226881 - protein, 8 aa, Mycobacterium
SLGGGPDP

SEQ ID NO: 1226882 - protein, 10 aa, Mycobacterium
SLGGSAGKAF

SEQ ID NO: 1226883 - protein, 8 aa, Mycobacterium
SLGGSPRW

SEQ ID NO: 1226884 - protein, 8 aa, Mycobacterium
SLGGTANG

SEQ ID NO: 1226885 - protein, 6 aa, Mycobacterium
SLGGVR

SEQ ID NO: 1226886 - protein, 9 aa, Mycobacterium
SLGNSTTYT

SEQ ID NO: 1226887 - protein, 14 aa, Mycobacterium
SLGPDEESAAKVSP

SEQ ID NO: 1226888 - protein, 17 aa, Mycobacterium
SLGPDGSWAPAPDPSVL

SEQ ID NO: 1226889 - protein, 6 aa, Mycobacterium
SLGPDR

SEQ ID NO: 1226890 - protein, 5 aa, Mycobacterium
SLGPG

SEQ ID NO: 1226891 - protein, 7 aa, Mycobacterium
SLGPKAT

SEQ ID NO: 1226892 - protein, 11 aa, Mycobacterium
SLGSAGGEIGT

SEQ ID NO: 1226893 - protein, 12 aa, Mycobacterium
SLGSDVADGSFG

SEQ ID NO: 1226894 - protein, 5 aa, Mycobacterium
SLGTT

SEQ ID NO: 1226895 - protein, 13 aa, Mycobacterium
SLGVDPQGPLRAM

SEQ ID NO: 1226896 - protein, 6 aa, Mycobacterium
SLHGDT

SEQ ID NO: 1226897 - protein, 6 aa, Mycobacterium
SLHNSQ

SEQ ID NO: 1226898 - protein, 10 aa, Mycobacterium
SLHPPGDQVR

SEQ ID NO: 1226899 - protein, 6 aa, Mycobacterium
SLKGRG

SEQ ID NO: 1226900 - protein, 8 aa, Mycobacterium
SLKGTSVE

SEQ ID NO: 1226901 - protein, 7 aa, Mycobacterium
SLKSRRN

SEQ ID NO: 1226902 - protein, 14 aa, Mycobacterium
SLNAAEAKAGTDGA

SEQ ID NO: 1226903 - protein, 14 aa, Mycobacterium
SLNPRARVGDSVSE

SEQ ID NO: 1226904 - protein, 7 aa, Mycobacterium
SLNPRKR

SEQ ID NO: 1226905 - protein, 14 aa, Mycobacterium
SLNQRRAETARSVD

SEQ ID NO: 1226906 - protein, 8 aa, Mycobacterium
SLNRNGKN

SEQ ID NO: 1226907 - protein, 6 aa, Mycobacterium
SLPAGV

SEQ ID NO: 1226908 - protein, 15 aa, Mycobacterium
SLPAHGEDHPSKRNT

SEQ ID NO: 1226909 - protein, 11 aa, Mycobacterium
SLPAPGEGSAS

SEQ ID NO: 1226910 - protein, 8 aa, Mycobacterium
SLPDGEPD

SEQ ID NO: 1226911 - protein, 6 aa, Mycobacterium
SLPDNA

SEQ ID NO: 1226912 - protein, 15 aa, Mycobacterium
SLPDRVRAALASIEV

SEQ ID NO: 1226913 - protein, 8 aa, Mycobacterium
SLPDTPAL

SEQ ID NO: 1226914 - protein, 17 aa, Mycobacterium
SLPEGPPVPMQCRHGSV

SEQ ID NO: 1226915 - protein, 27 aa, Mycobacterium
SLPEGRRPRAARTSRTSPSAAPSPAVA

SEQ ID NO: 1226916 - protein, 10 aa, Mycobacterium
SLPGLSDTDL

SEQ ID NO: 1226917 - protein, 5 aa, Mycobacterium
SLPGS

SEQ ID NO: 1226918 - protein, 13 aa, Mycobacterium
SLPGSSGSSRPER

SEQ ID NO: 1226919 - protein, 12 aa, Mycobacterium
SLPLTTSGKVRR

SEQ ID NO: 1226920 - protein, 4 aa, Mycobacterium
SLPN

SEQ ID NO: 1226921 - protein, 6 aa, Mycobacterium
SLPNGY

SEQ ID NO: 1226922 - protein, 18 aa, Mycobacterium
SLPPGARVAPGTSDGQKS

SEQ ID NO: 1226923 - protein, 5 aa, Mycobacterium
SLPPT

SEQ ID NO: 1226924 - protein, 5 aa, Mycobacterium
SLPRG

SEQ ID NO: 1226925 - protein, 7 aa, Mycobacterium
SLPRQPE

SEQ ID NO: 1226926 - protein, 7 aa, Mycobacterium
SLPSDDA

SEQ ID NO: 1226927 - protein, 4 aa, Mycobacterium
SLPT

SEQ ID NO: 1226928 - protein, 9 aa, Mycobacterium
SLPTPEGNT

SEQ ID NO: 1226929 - protein, 6 aa, Mycobacterium
SLPYGG

SEQ ID NO: 1226930 - protein, 17 aa, Mycobacterium
SLQAENARLREQLERAG

SEQ ID NO: 1226931 - protein, 18 aa, Mycobacterium
SLQDTRAARPTPIPPAGV

SEQ ID NO: 1226932 - protein, 7 aa, Mycobacterium
SLQPETR

SEQ ID NO: 1226933 - protein, 12 aa, Mycobacterium
SLRADEPVNGDT

SEQ ID NO: 1226934 - protein, 16 aa, Mycobacterium
SLRARPDRQTAQQQAE

SEQ ID NO: 1226935 - protein, 7 aa, Mycobacterium
SLRDGLR

SEQ ID NO: 1226936 - protein, 9 aa, Mycobacterium
SLREGQASL

SEQ ID NO: 1226937 - protein, 6 aa, Mycobacterium
SLREPH

SEQ ID NO: 1226938 - protein, 10 aa, Mycobacterium
SLRETAATAL

SEQ ID NO: 1226939 - protein, 8 aa, Mycobacterium
SLRGEVKS

SEQ ID NO: 1226940 - protein, 12 aa, Mycobacterium
SLRKGPDARRQL

SEQ ID NO: 1226941 - protein, 4 aa, Mycobacterium
SLRP

SEQ ID NO: 1226942 - protein, 6 aa, Mycobacterium
SLRTTR

SEQ ID NO: 1226943 - protein, 8 aa, Mycobacterium
SLSDAQTR

SEQ ID NO: 1226944 - protein, 6 aa, Mycobacterium
SLSDGG

SEQ ID NO: 1226945 - protein, 9 aa, Mycobacterium
SLSDPQTRT

SEQ ID NO: 1226946 - protein, 7 aa, Mycobacterium
SLSEEEK

SEQ ID NO: 1226947 - protein, 9 aa, Mycobacterium
SLSEQQRAE

SEQ ID NO: 1226948 - protein, 6 aa, Mycobacterium
SLSETA

SEQ ID NO: 1226949 - protein, 6 aa, Mycobacterium
SLSEYT

SEQ ID NO: 1226950 - protein, 16 aa, Mycobacterium
SLSGAGPVDVDNDSYR

SEQ ID NO: 1226951 - protein, 8 aa, Mycobacterium
SLSGGQKQ

SEQ ID NO: 1226952 - protein, 6 aa, Mycobacterium
SLSPEL

SEQ ID NO: 1226953 - protein, 16 aa, Mycobacterium
SLSPGATFRSTATANA

SEQ ID NO: 1226954 - protein, 13 aa, Mycobacterium
SLSPSPAKAVQEL

SEQ ID NO: 1226955 - protein, 9 aa, Mycobacterium
SLSSATPAF

SEQ ID NO: 1226956 - protein, 8 aa, Mycobacterium
SLSSRSDA

SEQ ID NO: 1226957 - protein, 8 aa, Mycobacterium
SLSSRTGL

SEQ ID NO: 1226958 - protein, 6 aa, Mycobacterium
SLSTAD

SEQ ID NO: 1226959 - protein, 9 aa, Mycobacterium
SLSTETKNR

SEQ ID NO: 1226960 - protein, 8 aa, Mycobacterium
SLSTPLAQ

SEQ ID NO: 1226961 - protein, 11 aa, Mycobacterium
SLSTTRPAYDG

SEQ ID NO: 1226962 - protein, 11 aa, Mycobacterium
SLTDSLSDAQV

SEQ ID NO: 1226963 - protein, 6 aa, Mycobacterium
SLTDTR

SEQ ID NO: 1226964 - protein, 5 aa, Mycobacterium
SLTEA

SEQ ID NO: 1226965 - protein, 17 aa, Mycobacterium
SLTEEEIGEYSGERKEI

SEQ ID NO: 1226966 - protein, 10 aa, Mycobacterium
SLTEPGRSSA

SEQ ID NO: 1226967 - protein, 6 aa, Mycobacterium
SLTETV

SEQ ID NO: 1226968 - protein, 10 aa, Mycobacterium
SLTGADAVHP

SEQ ID NO: 1226969 - protein, 10 aa, Mycobacterium
SLTGHAKGGA

SEQ ID NO: 1226970 - protein, 6 aa, Mycobacterium
SLTKPK

SEQ ID NO: 1226971 - protein, 9 aa, Mycobacterium
SLTKPQGAD

SEQ ID NO: 1226972 - protein, 8 aa, Mycobacterium
SLTPDGDV

SEQ ID NO: 1226973 - protein, 7 aa, Mycobacterium
SLTPSSA

SEQ ID NO: 1226974 - protein, 12 aa, Mycobacterium
SLTQQQHDREAA

SEQ ID NO: 1226975 - protein, 7 aa, Mycobacterium
SLTTTSG

SEQ ID NO: 1226976 - protein, 6 aa, Mycobacterium
SLVPDG

SEQ ID NO: 1226977 - protein, 7 aa, Mycobacterium
SLVTGDG

SEQ ID NO: 1226978 - protein, 8 aa, Mycobacterium
SLVTGGTD

SEQ ID NO: 1226979 - protein, 8 aa, Mycobacterium
SMAGKQGR

SEQ ID NO: 1226980 - protein, 4 aa, Mycobacterium
SMAS

SEQ ID NO: 1226981 - protein, 7 aa, Mycobacterium
SMDAGRA

SEQ ID NO: 1226982 - protein, 6 aa, Mycobacterium
SMGGGV

SEQ ID NO: 1226983 - protein, 6 aa, Mycobacterium
SMGPKV

SEQ ID NO: 1226984 - protein, 32 aa, Mycobacterium
SMGPRYQRNPIAAAPSARRRGTRAEHTAGGSG

SEQ ID NO: 1226985 - protein, 9 aa, Mycobacterium
SMHTSGRVD

SEQ ID NO: 1226986 - protein, 10 aa, Mycobacterium
SMPAPDGPNT

SEQ ID NO: 1226987 - protein, 9 aa, Mycobacterium
SMPRPESRA

SEQ ID NO: 1226988 - protein, 4 aa, Mycobacterium
SMPY

SEQ ID NO: 1226989 - protein, 23 aa, Mycobacterium
SMRDPSRTPEPVPPRPPKAGNND

SEQ ID NO: 1226990 - protein, 5 aa, Mycobacterium
SMRPG

SEQ ID NO: 1226991 - protein, 7 aa, Mycobacterium
SMSDDSA

SEQ ID NO: 1226992 - protein, 7 aa, Mycobacterium
SMSPDAT

SEQ ID NO: 1226993 - protein, 5 aa, Mycobacterium
SMSPE

SEQ ID NO: 1226994 - protein, 6 aa, Mycobacterium
SMSPVT

SEQ ID NO: 1226995 - protein, 8 aa, Mycobacterium
SMTGANPE

SEQ ID NO: 1226996 - protein, 7 aa, Mycobacterium
SMTGGSR

SEQ ID NO: 1226997 - protein, 8 aa, Mycobacterium
SMTGPDNR

SEQ ID NO: 1226998 - protein, 5 aa, Mycobacterium
SMTGR

SEQ ID NO: 1226999 - protein, 12 aa, Mycobacterium
SMTGTESRAEIG

SEQ ID NO: 1227000 - protein, 7 aa, Mycobacterium
SMTNSPV

SEQ ID NO: 1227001 - protein, 5 aa, Mycobacterium
SMTPD

SEQ ID NO: 1227002 - protein, 19 aa, Mycobacterium
SMTPQQKRQVRDEVATGQA

SEQ ID NO: 1227003 - protein, 8 aa, Mycobacterium
SNAAKTEL

SEQ ID NO: 1227004 - protein, 6 aa, Mycobacterium
SNAANG

SEQ ID NO: 1227005 - protein, 6 aa, Mycobacterium
SNAATA

SEQ ID NO: 1227006 - protein, 8 aa, Mycobacterium
SNADPVEA

SEQ ID NO: 1227007 - protein, 15 aa, Mycobacterium
SNAGETGALKVLLTQ

SEQ ID NO: 1227008 - protein, 8 aa, Mycobacterium
SNAGRPAL

SEQ ID NO: 1227009 - protein, 5 aa, Mycobacterium
SNARR

SEQ ID NO: 1227010 - protein, 12 aa, Mycobacterium
SNARSYDEAAQR

SEQ ID NO: 1227011 - protein, 28 aa, Mycobacterium
SNAVYGARNPHRHKAPVTAETPPNPTEL

SEQ ID NO: 1227012 - protein, 19 aa, Mycobacterium
SNAVYGARNPYKSAGPVTA

SEQ ID NO: 1227013 - protein, 9 aa, Mycobacterium
SNDAYQAQG

SEQ ID NO: 1227014 - protein, 5 aa, Mycobacterium
SNDDF

SEQ ID NO: 1227015 - protein, 8 aa, Mycobacterium
SNDDRNDR

SEQ ID NO: 1227016 - protein, 9 aa, Mycobacterium
SNDEPNGGL

SEQ ID NO: 1227017 - protein, 9 aa, Mycobacterium
SNDKKRARI

SEQ ID NO: 1227018 - protein, 14 aa, Mycobacterium
SNDNDIDGTRRGYT

SEQ ID NO: 1227019 - protein, 7 aa, Mycobacterium
SNDPDAV

SEQ ID NO: 1227020 - protein, 24 aa, Mycobacterium
SNDPRSHNNLRADAAGALGRGEST

SEQ ID NO: 1227021 - protein, 5 aa, Mycobacterium
SNDRN

SEQ ID NO: 1227022 - protein, 4 aa, Mycobacterium
SNEA

SEQ ID NO: 1227023 - protein, 7 aa, Mycobacterium
SNENEPW

SEQ ID NO: 1227024 - protein, 5 aa, Mycobacterium
SNERL

SEQ ID NO: 1227025 - protein, 5 aa, Mycobacterium
SNESA

SEQ ID NO: 1227026 - protein, 5 aa, Mycobacterium
SNESL

SEQ ID NO: 1227027 - protein, 13 aa, Mycobacterium
SNFTDNIQANQTQ

SEQ ID NO: 1227028 - protein, 5 aa, Mycobacterium
SNGCR

SEQ ID NO: 1227029 - protein, 6 aa, Mycobacterium
SNGEKK

SEQ ID NO: 1227030 - protein, 6 aa, Mycobacterium
SNGHKM

SEQ ID NO: 1227031 - protein, 7 aa, Mycobacterium
SNGIPPR

SEQ ID NO: 1227032 - protein, 5 aa, Mycobacterium
SNGQI

SEQ ID NO: 1227033 - protein, 5 aa, Mycobacterium
SNGQR

SEQ ID NO: 1227034 - protein, 10 aa, Mycobacterium
SNGSGNTPQM

SEQ ID NO: 1227035 - protein, 10 aa, Mycobacterium
SNGTPLYPAQ

SEQ ID NO: 1227036 - protein, 15 aa, Mycobacterium
SNHGGNNLDGTPAPI

SEQ ID NO: 1227037 - protein, 4 aa, Mycobacterium
SNHP

SEQ ID NO: 1227038 - protein, 17 aa, Mycobacterium
SNHPLAGGSGASSGAGL

SEQ ID NO: 1227039 - protein, 6 aa, Mycobacterium
SNHPYT

SEQ ID NO: 1227040 - protein, 14 aa, Mycobacterium
SNHRDDRYGGSLQN

SEQ ID NO: 1227041 - protein, 8 aa, Mycobacterium
SNIPGEAP

SEQ ID NO: 1227042 - protein, 6 aa, Mycobacterium
SNITRN

SEQ ID NO: 1227043 - protein, 19 aa, Mycobacterium
SNLADGGDLVKSSRSPEIM

SEQ ID NO: 1227044 - protein, 8 aa, Mycobacterium
SNLAPGTR

SEQ ID NO: 1227045 - protein, 8 aa, Mycobacterium
SNLDSTRE

SEQ ID NO: 1227046 - protein, 7 aa, Mycobacterium
SNLNNRS

SEQ ID NO: 1227047 - protein, 16 aa, Mycobacterium
SNLQATPTEEALRPKD

SEQ ID NO: 1227048 - protein, 16 aa, Mycobacterium
SNLQATPTREELRPND

SEQ ID NO: 1227049 - protein, 7 aa, Mycobacterium
SNMSEST

SEQ ID NO: 1227050 - protein, 8 aa, Mycobacterium
SNNDNKYA

SEQ ID NO: 1227051 - protein, 6 aa, Mycobacterium
SNNKIG

SEQ ID NO: 1227052 - protein, 7 aa, Mycobacterium
SNNTRDL

SEQ ID NO: 1227053 - protein, 9 aa, Mycobacterium
SNPAAPEGV

SEQ ID NO: 1227054 - protein, 15 aa, Mycobacterium
SNPADARPLPASAAA

SEQ ID NO: 1227055 - protein, 8 aa, Mycobacterium
SNPANDEV

SEQ ID NO: 1227056 - protein, 14 aa, Mycobacterium
SNPDPTPQYAASKA

SEQ ID NO: 1227057 - protein, 5 aa, Mycobacterium
SNPHG

SEQ ID NO: 1227058 - protein, 7 aa, Mycobacterium
SNPPVPG

SEQ ID NO: 1227059 - protein, 7 aa, Mycobacterium
SNPRRDD

SEQ ID NO: 1227060 - protein, 11 aa, Mycobacterium
SNPRRSGSAPW

SEQ ID NO: 1227061 - protein, 9 aa, Mycobacterium
SNPSRNDGG

SEQ ID NO: 1227062 - protein, 8 aa, Mycobacterium
SNPTGTTY

SEQ ID NO: 1227063 - protein, 5 aa, Mycobacterium
SNPVR

SEQ ID NO: 1227064 - protein, 9 aa, Mycobacterium
SNQFGSPQA

SEQ ID NO: 1227065 - protein, 8 aa, Mycobacterium
SNQRAQAA

SEQ ID NO: 1227066 - protein, 4 aa, Mycobacterium
SNRF

SEQ ID NO: 1227067 - protein, 9 aa, Mycobacterium
SNRFGSPQA

SEQ ID NO: 1227068 - protein, 9 aa, Mycobacterium
SNRKSHDVD

SEQ ID NO: 1227069 - protein, 4 aa, Mycobacterium
SNRP

SEQ ID NO: 1227070 - protein, 6 aa, Mycobacterium
SNRSGG

SEQ ID NO: 1227071 - protein, 7 aa, Mycobacterium
SNRTNPR

SEQ ID NO: 1227072 - protein, 4 aa, Mycobacterium
SNRV

SEQ ID NO: 1227073 - protein, 4 aa, Mycobacterium
SNRY

SEQ ID NO: 1227074 - protein, 15 aa, Mycobacterium
SNSAASARAEPGSVR

SEQ ID NO: 1227075 - protein, 4 aa, Mycobacterium
SNSL

SEQ ID NO: 1227076 - protein, 17 aa, Mycobacterium
SNSRRRTADGTWEPGNS

SEQ ID NO: 1227077 - protein, 12 aa, Mycobacterium
SNSTTTTPAVPA

SEQ ID NO: 1227078 - protein, 5 aa, Mycobacterium
SNSVD

SEQ ID NO: 1227079 - protein, 10 aa, Mycobacterium
SNTPDNFTGA

SEQ ID NO: 1227080 - protein, 5 aa, Mycobacterium
SNTPG

SEQ ID NO: 1227081 - protein, 6 aa, Mycobacterium
SNTREG

SEQ ID NO: 1227082 - protein, 7 aa, Mycobacterium
SNTSTLP

SEQ ID NO: 1227083 - protein, 13 aa, Mycobacterium
SNVGHSQAAAGAL

SEQ ID NO: 1227084 - protein, 11 aa, Mycobacterium
SNVPQAETGVP

SEQ ID NO: 1227085 - protein, 19 aa, Mycobacterium
SNVSNSTEFARDDQTHEAM

SEQ ID NO: 1227086 - protein, 13 aa, Mycobacterium
SNYNKQTAAHPKS

SEQ ID NO: 1227087 - protein, 4 aa, Mycobacterium
SNYT

SEQ ID NO: 1227088 - protein, 9 aa, Mycobacterium
SPAAARGRG

SEQ ID NO: 1227089 - protein, 5 aa, Mycobacterium
SPAAD

SEQ ID NO: 1227090 - protein, 20 aa, Mycobacterium
SPAADPSTSVRGNRVNGPQA

SEQ ID NO: 1227091 - protein, 9 aa, Mycobacterium
SPAANAAIN

SEQ ID NO: 1227092 - protein, 7 aa, Mycobacterium
SPAAREQ

SEQ ID NO: 1227093 - protein, 13 aa, Mycobacterium
SPAARGADADTLK

SEQ ID NO: 1227094 - protein, 26 aa, Mycobacterium
SPAARRARSSGPNASGRSSPSGRGPC

SEQ ID NO: 1227095 - protein, 11 aa, Mycobacterium
SPAAVTTPDDV

SEQ ID NO: 1227096 - protein, 8 aa, Mycobacterium
SPADAATV

SEQ ID NO: 1227097 - protein, 9 aa, Mycobacterium
SPADGRPDG

SEQ ID NO: 1227098 - protein, 11 aa, Mycobacterium
SPADSDPDAGF

SEQ ID NO: 1227099 - protein, 7 aa, Mycobacterium
SPAEAAA

SEQ ID NO: 1227100 - protein, 8 aa, Mycobacterium
SPAEAAAA

SEQ ID NO: 1227101 - protein, 8 aa, Mycobacterium
SPAERGEI

SEQ ID NO: 1227102 - protein, 7 aa, Mycobacterium
SPAEVRR

SEQ ID NO: 1227103 - protein, 4 aa, Mycobacterium
SPAG

SEQ ID NO: 1227104 - protein, 17 aa, Mycobacterium
SPAGANQWRPKDNGWAN

SEQ ID NO: 1227105 - protein, 6 aa, Mycobacterium
SPAGAR

SEQ ID NO: 1227106 - protein, 7 aa, Mycobacterium
SPAGDEE

SEQ ID NO: 1227107 - protein, 13 aa, Mycobacterium
SPAGDNPKASIGN

SEQ ID NO: 1227108 - protein, 14 aa, Mycobacterium
SPAGGYRDDTALAR

SEQ ID NO: 1227109 - protein, 15 aa, Mycobacterium
SPAGHFKGKDPTVPV

SEQ ID NO: 1227110 - protein, 11 aa, Mycobacterium
SPAGIRTSDGV

SEQ ID NO: 1227111 - protein, 24 aa, Mycobacterium
SPAGNGDASIAPSGAGIHEVDVKV

SEQ ID NO: 1227112 - protein, 9 aa, Mycobacterium
SPAGPGNGE

SEQ ID NO: 1227113 - protein, 7 aa, Mycobacterium
SPAGSAI

SEQ ID NO: 1227114 - protein, 8 aa, Mycobacterium
SPAGSYLT

SEQ ID NO: 1227115 - protein, 4 aa, Mycobacterium
SPAH

SEQ ID NO: 1227116 - protein, 11 aa, Mycobacterium
SPAHAEGGHRR

SEQ ID NO: 1227117 - protein, 13 aa, Mycobacterium
SPALDPTRTGPTA

SEQ ID NO: 1227118 - protein, 5 aa, Mycobacterium
SPALG

SEQ ID NO: 1227119 - protein, 8 aa, Mycobacterium
SPALNERL

SEQ ID NO: 1227120 - protein, 9 aa, Mycobacterium
SPALTTRGF

SEQ ID NO: 1227121 - protein, 7 aa, Mycobacterium
SPAMPDA

SEQ ID NO: 1227122 - protein, 4 aa, Mycobacterium
SPAN

SEQ ID NO: 1227123 - protein, 5 aa, Mycobacterium
SPANL

SEQ ID NO: 1227124 - protein, 12 aa, Mycobacterium
SPANPSGTVIPP

SEQ ID NO: 1227125 - protein, 7 aa, Mycobacterium
SPAPAGE

SEQ ID NO: 1227126 - protein, 8 aa, Mycobacterium
SPAPDTRD

SEQ ID NO: 1227127 - protein, 8 aa, Mycobacterium
SPAPGLEH

SEQ ID NO: 1227128 - protein, 14 aa, Mycobacterium
SPAQRNRSTVYTSG

SEQ ID NO: 1227129 - protein, 4 aa, Mycobacterium
SPAR

SEQ ID NO: 1227130 - protein, 14 aa, Mycobacterium
SPASAAADPGITNG

SEQ ID NO: 1227131 - protein, 8 aa, Mycobacterium
SPASEGVN

SEQ ID NO: 1227132 - protein, 11 aa, Mycobacterium
SPASHAKATRE

SEQ ID NO: 1227133 - protein, 10 aa, Mycobacterium
SPASITSGTY

SEQ ID NO: 1227134 - protein, 14 aa, Mycobacterium
SPASMSPGQSGPGS

SEQ ID NO: 1227135 - protein, 8 aa, Mycobacterium
SPASSDAI

SEQ ID NO: 1227136 - protein, 8 aa, Mycobacterium
SPASTQLR

SEQ ID NO: 1227137 - protein, 18 aa, Mycobacterium
SPATAGNQVAEGEATVSD

SEQ ID NO: 1227138 - protein, 7 aa, Mycobacterium
SPATGEL

SEQ ID NO: 1227139 - protein, 6 aa, Mycobacterium
SPATKE

SEQ ID NO: 1227140 - protein, 12 aa, Mycobacterium
SPATPELPPDTR

SEQ ID NO: 1227141 - protein, 8 aa, Mycobacterium
SPATPSTA

SEQ ID NO: 1227142 - protein, 4 aa, Mycobacterium
SPAV

SEQ ID NO: 1227143 - protein, 6 aa, Mycobacterium
SPAVGR

SEQ ID NO: 1227144 - protein, 9 aa, Mycobacterium
SPAVTPSDL

SEQ ID NO: 1227145 - protein, 5 aa, Mycobacterium
SPAVY

SEQ ID NO: 1227146 - protein, 6 aa, Mycobacterium
SPAYED

SEQ ID NO: 1227147 - protein, 4 aa, Mycobacterium
SPDA

SEQ ID NO: 1227148 - protein, 5 aa, Mycobacterium
SPDAQ

SEQ ID NO: 1227149 - protein, 16 aa, Mycobacterium
SPDCTASAAPAPGSSN

SEQ ID NO: 1227150 - protein, 14 aa, Mycobacterium
SPDCTASAPPASSN

SEQ ID NO: 1227151 - protein, 4 aa, Mycobacterium
SPDE

SEQ ID NO: 1227152 - protein, 7 aa, Mycobacterium
SPDFEGR

SEQ ID NO: 1227153 - protein, 17 aa, Mycobacterium
SPDGELRPPAGRETATA

SEQ ID NO: 1227154 - protein, 9 aa, Mycobacterium
SPDGENPLP

SEQ ID NO: 1227155 - protein, 5 aa, Mycobacterium
SPDGR

SEQ ID NO: 1227156 - protein, 7 aa, Mycobacterium
SPDGRAR

SEQ ID NO: 1227157 - protein, 8 aa, Mycobacterium
SPDGRHSR

SEQ ID NO: 1227158 - protein, 5 aa, Mycobacterium
SPDGS

SEQ ID NO: 1227159 - protein, 5 aa, Mycobacterium
SPDHA

SEQ ID NO: 1227160 - protein, 4 aa, Mycobacterium
SPDI

SEQ ID NO: 1227161 - protein, 11 aa, Mycobacterium
SPDKEGGVHGP

SEQ ID NO: 1227162 - protein, 8 aa, Mycobacterium
SPDKPEKL

SEQ ID NO: 1227163 - protein, 6 aa, Mycobacterium
SPDLPG

SEQ ID NO: 1227164 - protein, 5 aa, Mycobacterium
SPDLR

SEQ ID NO: 1227165 - protein, 4 aa, Mycobacterium
SPDN

SEQ ID NO: 1227166 - protein, 5 aa, Mycobacterium
SPDNA

SEQ ID NO: 1227167 - protein, 5 aa, Mycobacterium
SPDPT

SEQ ID NO: 1227168 - protein, 8 aa, Mycobacterium
SPDPTEGV

SEQ ID NO: 1227169 - protein, 6 aa, Mycobacterium
SPDWDE

SEQ ID NO: 1227170 - protein, 8 aa, Mycobacterium
SPDWDGSP

SEQ ID NO: 1227171 - protein, 29 aa, Mycobacterium
SPDYTDRAEARAEKVSGSWGEVDSAELDR

SEQ ID NO: 1227172 - protein, 7 aa, Mycobacterium
SPEAAAG

SEQ ID NO: 1227173 - protein, 15 aa, Mycobacterium
SPEDGQGNPGANSLK

SEQ ID NO: 1227174 - protein, 5 aa, Mycobacterium
SPEDH

SEQ ID NO: 1227175 - protein, 7 aa, Mycobacterium
SPEDLTP

SEQ ID NO: 1227176 - protein, 11 aa, Mycobacterium
SPEDPDGTELT

SEQ ID NO: 1227177 - protein, 5 aa, Mycobacterium
SPEDQ

SEQ ID NO: 1227178 - protein, 6 aa, Mycobacterium
SPEEQA

SEQ ID NO: 1227179 - protein, 9 aa, Mycobacterium
SPEEQQRQW

SEQ ID NO: 1227180 - protein, 16 aa, Mycobacterium
SPEERDAMETDRHNEA

SEQ ID NO: 1227181 - protein, 6 aa, Mycobacterium
SPEESR

SEQ ID NO: 1227182 - protein, 11 aa, Mycobacterium
SPEFREDPHGT

SEQ ID NO: 1227183 - protein, 8 aa, Mycobacterium
SPEGRRSR

SEQ ID NO: 1227184 - protein, 8 aa, Mycobacterium
SPEGRTER

SEQ ID NO: 1227185 - protein, 4 aa, Mycobacterium
SPEH

SEQ ID NO: 1227186 - protein, 8 aa, Mycobacterium
SPELERPD

SEQ ID NO: 1227187 - protein, 6 aa, Mycobacterium
SPELGT

SEQ ID NO: 1227188 - protein, 5 aa, Mycobacterium
SPENA

SEQ ID NO: 1227189 - protein, 4 aa, Mycobacterium
SPEP

SEQ ID NO: 1227190 - protein, 83 aa, Mycobacterium
SPEPTNDAPAGNGKPAAAPTAPPEPASAPAPKPASTNGGAPPAKADTSTTRAPEKKPEEKTSPAPKAKTAAPAGVSDDDETQV

SEQ ID NO: 1227191 - protein, 7 aa, Mycobacterium
SPEQVRA

SEQ ID NO: 1227192 - protein, 11 aa, Mycobacterium
SPESGAEPVTG

SEQ ID NO: 1227193 - protein, 9 aa, Mycobacterium
SPESYTGTE

SEQ ID NO: 1227194 - protein, 13 aa, Mycobacterium
SPETASLAREHNN

SEQ ID NO: 1227195 - protein, 4 aa, Mycobacterium
SPFA

SEQ ID NO: 1227196 - protein, 8 aa, Mycobacterium
SPFARTDN

SEQ ID NO: 1227197 - protein, 32 aa, Mycobacterium
SPFGQQGMGASPFGDPFGQQTGAATPAADPFA

SEQ ID NO: 1227198 - protein, 150 aa, Mycobacterium
SPFGQQGMGASPFGDPFGQQTGAATPAADPFADPFAGSSSGGAPATTASYSAAADPFAAAPSTGTGAVTAASTTTAADPFAASTDTGSGGDGSTDDSGGQDADAAEDNTDGGGEPAAATESSSSGVDTGAFSGADGAAVPADPAASTAGS

SEQ ID NO: 1227199 - protein, 20 aa, Mycobacterium
SPFPPPPGAVPPPPPPPPAG

SEQ ID NO: 1227200 - protein, 5 aa, Mycobacterium
SPFQT

SEQ ID NO: 1227201 - protein, 4 aa, Mycobacterium
SPFS

SEQ ID NO: 1227202 - protein, 9 aa, Mycobacterium
SPFSPQTSW

SEQ ID NO: 1227203 - protein, 7 aa, Mycobacterium
SPFTGDP

SEQ ID NO: 1227204 - protein, 8 aa, Mycobacterium
SPGADAER

SEQ ID NO: 1227205 - protein, 7 aa, Mycobacterium
SPGAEIT

SEQ ID NO: 1227206 - protein, 7 aa, Mycobacterium
SPGDTDK

SEQ ID NO: 1227207 - protein, 4 aa, Mycobacterium
SPGG

SEQ ID NO: 1227208 - protein, 8 aa, Mycobacterium
SPGGAPLP

SEQ ID NO: 1227209 - protein, 23 aa, Mycobacterium
SPGGGGGAGHSPAADQSPEPGGW

SEQ ID NO: 1227210 - protein, 7 aa, Mycobacterium
SPGGTTH

SEQ ID NO: 1227211 - protein, 6 aa, Mycobacterium
SPGIEA

SEQ ID NO: 1227212 - protein, 4 aa, Mycobacterium
SPGL

SEQ ID NO: 1227213 - protein, 5 aa, Mycobacterium
SPGLK

SEQ ID NO: 1227214 - protein, 14 aa, Mycobacterium
SPGLPDATSLTTRP

SEQ ID NO: 1227215 - protein, 5 aa, Mycobacterium
SPGLT

SEQ ID NO: 1227216 - protein, 11 aa, Mycobacterium
SPGMEAGYADA

SEQ ID NO: 1227217 - protein, 7 aa, Mycobacterium
SPGPSEG

SEQ ID NO: 1227218 - protein, 12 aa, Mycobacterium
SPGREADPRDYS

SEQ ID NO: 1227219 - protein, 13 aa, Mycobacterium
SPGRGKSHATKNL

SEQ ID NO: 1227220 - protein, 5 aa, Mycobacterium
SPGSL

SEQ ID NO: 1227221 - protein, 8 aa, Mycobacterium
SPGSVDTE

SEQ ID NO: 1227222 - protein, 4 aa, Mycobacterium
SPGT

SEQ ID NO: 1227223 - protein, 11 aa, Mycobacterium
SPGTAGDGPST

SEQ ID NO: 1227224 - protein, 16 aa, Mycobacterium
SPGTWSGHGGGEYAPA

SEQ ID NO: 1227225 - protein, 13 aa, Mycobacterium
SPGVDRPLTTEKH

SEQ ID NO: 1227226 - protein, 5 aa, Mycobacterium
SPGVG

SEQ ID NO: 1227227 - protein, 4 aa, Mycobacterium
SPGY

SEQ ID NO: 1227228 - protein, 11 aa, Mycobacterium
SPGYPAAEERL

SEQ ID NO: 1227229 - protein, 7 aa, Mycobacterium
SPHAPSL

SEQ ID NO: 1227230 - protein, 10 aa, Mycobacterium
SPHDPAPSLK

SEQ ID NO: 1227231 - protein, 6 aa, Mycobacterium
SPHDVG

SEQ ID NO: 1227232 - protein, 6 aa, Mycobacterium
SPHPAA

SEQ ID NO: 1227233 - protein, 7 aa, Mycobacterium
SPHPEGG

SEQ ID NO: 1227234 - protein, 5 aa, Mycobacterium
SPHSG

SEQ ID NO: 1227235 - protein, 6 aa, Mycobacterium
SPHVNG

SEQ ID NO: 1227236 - protein, 5 aa, Mycobacterium
SPIAK

SEQ ID NO: 1227237 - protein, 5 aa, Mycobacterium
SPIAR

SEQ ID NO: 1227238 - protein, 11 aa, Mycobacterium
SPIGRAGKGSL

SEQ ID NO: 1227239 - protein, 6 aa, Mycobacterium
SPIHDP

SEQ ID NO: 1227240 - protein, 8 aa, Mycobacterium
SPIPPADL

SEQ ID NO: 1227241 - protein, 16 aa, Mycobacterium
SPIPPNKPNIRQDETD

SEQ ID NO: 1227242 - protein, 5 aa, Mycobacterium
SPISD

SEQ ID NO: 1227243 - protein, 4 aa, Mycobacterium
SPIT

SEQ ID NO: 1227244 - protein, 10 aa, Mycobacterium
SPITKNPNVP

SEQ ID NO: 1227245 - protein, 9 aa, Mycobacterium
SPKAGSTFT

SEQ ID NO: 1227246 - protein, 9 aa, Mycobacterium
SPKAQAELD

SEQ ID NO: 1227247 - protein, 14 aa, Mycobacterium
SPKCGNGNDPLDKD

SEQ ID NO: 1227248 - protein, 10 aa, Mycobacterium
SPKGGGPGPH

SEQ ID NO: 1227249 - protein, 8 aa, Mycobacterium
SPKNSATL

SEQ ID NO: 1227250 - protein, 12 aa, Mycobacterium
SPKPAADATRHT

SEQ ID NO: 1227251 - protein, 6 aa, Mycobacterium
SPKPKR

SEQ ID NO: 1227252 - protein, 6 aa, Mycobacterium
SPKPVV

SEQ ID NO: 1227253 - protein, 6 aa, Mycobacterium
SPKQTV

SEQ ID NO: 1227254 - protein, 9 aa, Mycobacterium
SPLAHDDSC

SEQ ID NO: 1227255 - protein, 9 aa, Mycobacterium
SPLAPTARS

SEQ ID NO: 1227256 - protein, 21 aa, Mycobacterium
SPLDLGSRRSGIAKRPSAEPL

SEQ ID NO: 1227257 - protein, 8 aa, Mycobacterium
SPLDSGTV

SEQ ID NO: 1227258 - protein, 6 aa, Mycobacterium
SPLDTQ

SEQ ID NO: 1227259 - protein, 4 aa, Mycobacterium
SPLE

SEQ ID NO: 1227260 - protein, 6 aa, Mycobacterium
SPLGQR

SEQ ID NO: 1227261 - protein, 4 aa, Mycobacterium
SPLI

SEQ ID NO: 1227262 - protein, 6 aa, Mycobacterium
SPLPGS

SEQ ID NO: 1227263 - protein, 13 aa, Mycobacterium
SPLPRAQSLGEVG

SEQ ID NO: 1227264 - protein, 4 aa, Mycobacterium
SPLR

SEQ ID NO: 1227265 - protein, 9 aa, Mycobacterium
SPLSEGDHP

SEQ ID NO: 1227266 - protein, 15 aa, Mycobacterium
SPLSITQQANEKADE

SEQ ID NO: 1227267 - protein, 8 aa, Mycobacterium
SPLTGTPP

SEQ ID NO: 1227268 - protein, 6 aa, Mycobacterium
SPMRTQ

SEQ ID NO: 1227269 - protein, 8 aa, Mycobacterium
SPMTGDDV

SEQ ID NO: 1227270 - protein, 4 aa, Mycobacterium
SPNA

SEQ ID NO: 1227271 - protein, 8 aa, Mycobacterium
SPNGDHNH

SEQ ID NO: 1227272 - protein, 6 aa, Mycobacterium
SPNLHT

SEQ ID NO: 1227273 - protein, 11 aa, Mycobacterium
SPNNPSGQSVS

SEQ ID NO: 1227274 - protein, 12 aa, Mycobacterium
SPNQRAYAAPER

SEQ ID NO: 1227275 - protein, 19 aa, Mycobacterium
SPNSFRGKYRGAEVGRYAT

SEQ ID NO: 1227276 - protein, 14 aa, Mycobacterium
SPNSFRGKYRGSEA

SEQ ID NO: 1227277 - protein, 10 aa, Mycobacterium
SPNTLNDDNA

SEQ ID NO: 1227278 - protein, 9 aa, Mycobacterium
SPPAEPGRA

SEQ ID NO: 1227279 - protein, 5 aa, Mycobacterium
SPPAV

SEQ ID NO: 1227280 - protein, 7 aa, Mycobacterium
SPPELPY

SEQ ID NO: 1227281 - protein, 7 aa, Mycobacterium
SPPEPVA

SEQ ID NO: 1227282 - protein, 6 aa, Mycobacterium
SPPETH

SEQ ID NO: 1227283 - protein, 8 aa, Mycobacterium
SPPGMNAQ

SEQ ID NO: 1227284 - protein, 9 aa, Mycobacterium
SPPGPVQPR

SEQ ID NO: 1227285 - protein, 9 aa, Mycobacterium
SPPGSVQPR

SEQ ID NO: 1227286 - protein, 8 aa, Mycobacterium
SPPHGSPR

SEQ ID NO: 1227287 - protein, 5 aa, Mycobacterium
SPPIE

SEQ ID NO: 1227288 - protein, 7 aa, Mycobacterium
SPPKPGI

SEQ ID NO: 1227289 - protein, 7 aa, Mycobacterium
SPPKQLA

SEQ ID NO: 1227290 - protein, 21 aa, Mycobacterium
SPPPAPQSTDTTEVTPPPPMK

SEQ ID NO: 1227291 - protein, 9 aa, Mycobacterium
SPPPSPRRL

SEQ ID NO: 1227292 - protein, 12 aa, Mycobacterium
SPPQAGNAEPFK

SEQ ID NO: 1227293 - protein, 7 aa, Mycobacterium
SPPQPAC

SEQ ID NO: 1227294 - protein, 12 aa, Mycobacterium
SPPRSGPGGKRY

SEQ ID NO: 1227295 - protein, 8 aa, Mycobacterium
SPPRTARE

SEQ ID NO: 1227296 - protein, 6 aa, Mycobacterium
SPPRTF

SEQ ID NO: 1227297 - protein, 6 aa, Mycobacterium
SPPSLT

SEQ ID NO: 1227298 - protein, 8 aa, Mycobacterium
SPPSPREL

SEQ ID NO: 1227299 - protein, 5 aa, Mycobacterium
SPPVI

SEQ ID NO: 1227300 - protein, 7 aa, Mycobacterium
SPQAATH

SEQ ID NO: 1227301 - protein, 8 aa, Mycobacterium
SPQARAEL

SEQ ID NO: 1227302 - protein, 5 aa, Mycobacterium
SPQDI

SEQ ID NO: 1227303 - protein, 11 aa, Mycobacterium
SPQEYTGERTH

SEQ ID NO: 1227304 - protein, 5 aa, Mycobacterium
SPQGL

SEQ ID NO: 1227305 - protein, 6 aa, Mycobacterium
SPQGRF

SEQ ID NO: 1227306 - protein, 10 aa, Mycobacterium
SPQGRSAPQL

SEQ ID NO: 1227307 - protein, 6 aa, Mycobacterium
SPQHEY

SEQ ID NO: 1227308 - protein, 6 aa, Mycobacterium
SPQPPS

SEQ ID NO: 1227309 - protein, 15 aa, Mycobacterium
SPQRSSGGGRRYSQR

SEQ ID NO: 1227310 - protein, 11 aa, Mycobacterium
SPQRVAADPGR

SEQ ID NO: 1227311 - protein, 11 aa, Mycobacterium
SPQTAREGPSR

SEQ ID NO: 1227312 - protein, 8 aa, Mycobacterium
SPRDHGYD

SEQ ID NO: 1227313 - protein, 5 aa, Mycobacterium
SPRDL

SEQ ID NO: 1227314 - protein, 4 aa, Mycobacterium
SPRE

SEQ ID NO: 1227315 - protein, 6 aa, Mycobacterium
SPRELY

SEQ ID NO: 1227316 - protein, 8 aa, Mycobacterium
SPREVAEQ

SEQ ID NO: 1227317 - protein, 13 aa, Mycobacterium
SPRFGGSTALSGG

SEQ ID NO: 1227318 - protein, 6 aa, Mycobacterium
SPRGEP

SEQ ID NO: 1227319 - protein, 19 aa, Mycobacterium
SPRPFGVGTTREVGTGPTR

SEQ ID NO: 1227320 - protein, 7 aa, Mycobacterium
SPRPHDT

SEQ ID NO: 1227321 - protein, 17 aa, Mycobacterium
SPRPVLTTAEGDAQHEA

SEQ ID NO: 1227322 - protein, 7 aa, Mycobacterium
SPRQQAY

SEQ ID NO: 1227323 - protein, 11 aa, Mycobacterium
SPRQTRLEQAE

SEQ ID NO: 1227324 - protein, 6 aa, Mycobacterium
SPRRDE

SEQ ID NO: 1227325 - protein, 11 aa, Mycobacterium
SPRRGSHGNAV

SEQ ID NO: 1227326 - protein, 15 aa, Mycobacterium
SPRRLRSGPEGETTD

SEQ ID NO: 1227327 - protein, 4 aa, Mycobacterium
SPRT

SEQ ID NO: 1227328 - protein, 8 aa, Mycobacterium
SPRYPLDR

SEQ ID NO: 1227329 - protein, 5 aa, Mycobacterium
SPSAG

SEQ ID NO: 1227330 - protein, 8 aa, Mycobacterium
SPSALAAQ

SEQ ID NO: 1227331 - protein, 9 aa, Mycobacterium
SPSASEIDE

SEQ ID NO: 1227332 - protein, 6 aa, Mycobacterium
SPSAYK

SEQ ID NO: 1227333 - protein, 14 aa, Mycobacterium
SPSCPSAPSSLAEQ

SEQ ID NO: 1227334 - protein, 8 aa, Mycobacterium
SPSDEGPG

SEQ ID NO: 1227335 - protein, 5 aa, Mycobacterium
SPSEH

SEQ ID NO: 1227336 - protein, 7 aa, Mycobacterium
SPSFDGD

SEQ ID NO: 1227337 - protein, 7 aa, Mycobacterium
SPSGETL

SEQ ID NO: 1227338 - protein, 8 aa, Mycobacterium
SPSGPRLA

SEQ ID NO: 1227339 - protein, 18 aa, Mycobacterium
SPSGTETVITSNDGSSYI

SEQ ID NO: 1227340 - protein, 8 aa, Mycobacterium
SPSKDRIT

SEQ ID NO: 1227341 - protein, 13 aa, Mycobacterium
SPSNAPRRRRGER

SEQ ID NO: 1227342 - protein, 5 aa, Mycobacterium
SPSPH

SEQ ID NO: 1227343 - protein, 17 aa, Mycobacterium
SPSPSKRRTATRRATLG

SEQ ID NO: 1227344 - protein, 6 aa, Mycobacterium
SPSQLT

SEQ ID NO: 1227345 - protein, 4 aa, Mycobacterium
SPSS

SEQ ID NO: 1227346 - protein, 19 aa, Mycobacterium
SPSSIPGATISQGQTSTGK

SEQ ID NO: 1227347 - protein, 11 aa, Mycobacterium
SPSSLDPYTYP

SEQ ID NO: 1227348 - protein, 6 aa, Mycobacterium
SPSSQS

SEQ ID NO: 1227349 - protein, 26 aa, Mycobacterium
SPSSWAAAGGTQYAPSAYQASPYQQA

SEQ ID NO: 1227350 - protein, 12 aa, Mycobacterium
SPSTAEGDPTWT

SEQ ID NO: 1227351 - protein, 10 aa, Mycobacterium
SPSTQGTGSD

SEQ ID NO: 1227352 - protein, 5 aa, Mycobacterium
SPTAL

SEQ ID NO: 1227353 - protein, 6 aa, Mycobacterium
SPTDRD

SEQ ID NO: 1227354 - protein, 12 aa, Mycobacterium
SPTGGAVGTTAY

SEQ ID NO: 1227355 - protein, 10 aa, Mycobacterium
SPTGTQGFSG

SEQ ID NO: 1227356 - protein, 8 aa, Mycobacterium
SPTKARKI

SEQ ID NO: 1227357 - protein, 7 aa, Mycobacterium
SPTKGQH

SEQ ID NO: 1227358 - protein, 6 aa, Mycobacterium
SPTNRG

SEQ ID NO: 1227359 - protein, 6 aa, Mycobacterium
SPTPGQ

SEQ ID NO: 1227360 - protein, 7 aa, Mycobacterium
SPTPHQR

SEQ ID NO: 1227361 - protein, 19 aa, Mycobacterium
SPTPTARKDYIGGAAQTAR

SEQ ID NO: 1227362 - protein, 6 aa, Mycobacterium
SPTRRL

SEQ ID NO: 1227363 - protein, 19 aa, Mycobacterium
SPTRTSRKDYIGGAAETAR

SEQ ID NO: 1227364 - protein, 4 aa, Mycobacterium
SPTS

SEQ ID NO: 1227365 - protein, 9 aa, Mycobacterium
SPTSGQVRR

SEQ ID NO: 1227366 - protein, 4 aa, Mycobacterium
SPTT

SEQ ID NO: 1227367 - protein, 11 aa, Mycobacterium
SPTTESTPSTL

SEQ ID NO: 1227368 - protein, 6 aa, Mycobacterium
SPTYGL

SEQ ID NO: 1227369 - protein, 10 aa, Mycobacterium
SPVDAQNGAT

SEQ ID NO: 1227370 - protein, 13 aa, Mycobacterium
SPVDGAPTRPVKS

SEQ ID NO: 1227371 - protein, 10 aa, Mycobacterium
SPVGGGGSVG

SEQ ID NO: 1227372 - protein, 8 aa, Mycobacterium
SPVGPRIE

SEQ ID NO: 1227373 - protein, 4 aa, Mycobacterium
SPVL

SEQ ID NO: 1227374 - protein, 6 aa, Mycobacterium
SPVPEL

SEQ ID NO: 1227375 - protein, 12 aa, Mycobacterium
SPVPTDSADGPV

SEQ ID NO: 1227376 - protein, 25 aa, Mycobacterium
SPVRPGSGWPGDPATRRTAVAATSA

SEQ ID NO: 1227377 - protein, 7 aa, Mycobacterium
SPVRRPR

SEQ ID NO: 1227378 - protein, 6 aa, Mycobacterium
SPVTGA

SEQ ID NO: 1227379 - protein, 5 aa, Mycobacterium
SPWTY

SEQ ID NO: 1227380 - protein, 5 aa, Mycobacterium
SPYAT

SEQ ID NO: 1227381 - protein, 11 aa, Mycobacterium
SPYENVESRNY

SEQ ID NO: 1227382 - protein, 6 aa, Mycobacterium
SPYPRQ

SEQ ID NO: 1227383 - protein, 11 aa, Mycobacterium
SPYQRPRNPDL

SEQ ID NO: 1227384 - protein, 10 aa, Mycobacterium
SPYRRAKERG

SEQ ID NO: 1227385 - protein, 28 aa, Mycobacterium
SQAAAAAAPAASDSAPALPGGDTPADWD

SEQ ID NO: 1227386 - protein, 17 aa, Mycobacterium
SQAADEGSRLTDRELQA

SEQ ID NO: 1227387 - protein, 7 aa, Mycobacterium
SQAAQAA

SEQ ID NO: 1227388 - protein, 5 aa, Mycobacterium
SQADN

SEQ ID NO: 1227389 - protein, 8 aa, Mycobacterium
SQAERFNG

SEQ ID NO: 1227390 - protein, 8 aa, Mycobacterium
SQAGKGSL

SEQ ID NO: 1227391 - protein, 8 aa, Mycobacterium
SQAGPRMP

SEQ ID NO: 1227392 - protein, 4 aa, Mycobacterium
SQAR

SEQ ID NO: 1227393 - protein, 7 aa, Mycobacterium
SQASRTH

SEQ ID NO: 1227394 - protein, 15 aa, Mycobacterium
SQATTAALETREALN

SEQ ID NO: 1227395 - protein, 8 aa, Mycobacterium
SQAYQGEE

SEQ ID NO: 1227396 - protein, 8 aa, Mycobacterium
SQDADGIG

SEQ ID NO: 1227397 - protein, 5 aa, Mycobacterium
SQDER

SEQ ID NO: 1227398 - protein, 8 aa, Mycobacterium
SQDGAADD

SEQ ID NO: 1227399 - protein, 14 aa, Mycobacterium
SQDKAEVARAAGAS

SEQ ID NO: 1227400 - protein, 16 aa, Mycobacterium
SQDPDTPGLAESVRRE

SEQ ID NO: 1227401 - protein, 8 aa, Mycobacterium
SQDPETLR

SEQ ID NO: 1227402 - protein, 6 aa, Mycobacterium
SQDPHP

SEQ ID NO: 1227403 - protein, 61 aa, Mycobacterium
SQDREQQDKLTENTPPGTEPAPESEPAGEAVEPEPQPASEDESPEPTEPEPEAEPEPEPGL

SEQ ID NO: 1227404 - protein, 7 aa, Mycobacterium
SQDSNTK

SEQ ID NO: 1227405 - protein, 5 aa, Mycobacterium
SQEAL

SEQ ID NO: 1227406 - protein, 14 aa, Mycobacterium
SQEERTTARSTPSA

SEQ ID NO: 1227407 - protein, 5 aa, Mycobacterium
SQEGA

SEQ ID NO: 1227408 - protein, 25 aa, Mycobacterium
SQELPGDPGKLCAPGSGASLGIGAD

SEQ ID NO: 1227409 - protein, 5 aa, Mycobacterium
SQERE

SEQ ID NO: 1227410 - protein, 7 aa, Mycobacterium
SQESARH

SEQ ID NO: 1227411 - protein, 4 aa, Mycobacterium
SQET

SEQ ID NO: 1227412 - protein, 5 aa, Mycobacterium
SQETN

SEQ ID NO: 1227413 - protein, 8 aa, Mycobacterium
SQETTRGV

SEQ ID NO: 1227414 - protein, 4 aa, Mycobacterium
SQEV

SEQ ID NO: 1227415 - protein, 14 aa, Mycobacterium
SQFDGYTSGANKNF

SEQ ID NO: 1227416 - protein, 10 aa, Mycobacterium
SQFDPTEGYR

SEQ ID NO: 1227417 - protein, 11 aa, Mycobacterium
SQFGGRDGSNI

SEQ ID NO: 1227418 - protein, 5 aa, Mycobacterium
SQFGP

SEQ ID NO: 1227419 - protein, 4 aa, Mycobacterium
SQGA

SEQ ID NO: 1227420 - protein, 21 aa, Mycobacterium
SQGAGAASAAIPELEGGEFAD

SEQ ID NO: 1227421 - protein, 7 aa, Mycobacterium
SQGAPAD

SEQ ID NO: 1227422 - protein, 8 aa, Mycobacterium
SQGAQSLN

SEQ ID NO: 1227423 - protein, 5 aa, Mycobacterium
SQGEL

SEQ ID NO: 1227424 - protein, 8 aa, Mycobacterium
SQGERGRT

SEQ ID NO: 1227425 - protein, 8 aa, Mycobacterium
SQGGGALP

SEQ ID NO: 1227426 - protein, 8 aa, Mycobacterium
SQGGRASN

SEQ ID NO: 1227427 - protein, 8 aa, Mycobacterium
SQGHEGAQ

SEQ ID NO: 1227428 - protein, 5 aa, Mycobacterium
SQGIS

SEQ ID NO: 1227429 - protein, 11 aa, Mycobacterium
SQGKWYPGEPL

SEQ ID NO: 1227430 - protein, 4 aa, Mycobacterium
SQGP

SEQ ID NO: 1227431 - protein, 6 aa, Mycobacterium
SQGPYP

SEQ ID NO: 1227432 - protein, 4 aa, Mycobacterium
SQGR

SEQ ID NO: 1227433 - protein, 10 aa, Mycobacterium
SQGRGSAANS

SEQ ID NO: 1227434 - protein, 4 aa, Mycobacterium
SQGY

SEQ ID NO: 1227435 - protein, 4 aa, Mycobacterium
SQHA

SEQ ID NO: 1227436 - protein, 6 aa, Mycobacterium
SQHPGW

SEQ ID NO: 1227437 - protein, 9 aa, Mycobacterium
SQISANRAR

SEQ ID NO: 1227438 - protein, 12 aa, Mycobacterium
SQITEPARGLTY

SEQ ID NO: 1227439 - protein, 10 aa, Mycobacterium
SQKSQSLVRT

SEQ ID NO: 1227440 - protein, 7 aa, Mycobacterium
SQLEGAQ

SEQ ID NO: 1227441 - protein, 13 aa, Mycobacterium
SQLGKMGNARKGG

SEQ ID NO: 1227442 - protein, 7 aa, Mycobacterium
SQLRGRP

SEQ ID NO: 1227443 - protein, 5 aa, Mycobacterium
SQLRS

SEQ ID NO: 1227444 - protein, 4 aa, Mycobacterium
SQLS

SEQ ID NO: 1227445 - protein, 9 aa, Mycobacterium
SQLTPSEQR

SEQ ID NO: 1227446 - protein, 6 aa, Mycobacterium
SQMGGR

SEQ ID NO: 1227447 - protein, 9 aa, Mycobacterium
SQNLGGESH

SEQ ID NO: 1227448 - protein, 10 aa, Mycobacterium
SQNVTDPARI

SEQ ID NO: 1227449 - protein, 22 aa, Mycobacterium
SQPAIKGSGEEPTPGSGAALEP

SEQ ID NO: 1227450 - protein, 6 aa, Mycobacterium
SQPAPL

SEQ ID NO: 1227451 - protein, 4 aa, Mycobacterium
SQPD

SEQ ID NO: 1227452 - protein, 6 aa, Mycobacterium
SQPDAA

SEQ ID NO: 1227453 - protein, 5 aa, Mycobacterium
SQPDG

SEQ ID NO: 1227454 - protein, 11 aa, Mycobacterium
SQPGAADPAGY

SEQ ID NO: 1227455 - protein, 8 aa, Mycobacterium
SQPGFDDR

SEQ ID NO: 1227456 - protein, 5 aa, Mycobacterium
SQPGV

SEQ ID NO: 1227457 - protein, 9 aa, Mycobacterium
SQPLTEQDQ

SEQ ID NO: 1227458 - protein, 5 aa, Mycobacterium
SQPLY

SEQ ID NO: 1227459 - protein, 11 aa, Mycobacterium
SQPNCKSDVKY

SEQ ID NO: 1227460 - protein, 8 aa, Mycobacterium
SQPPEENM

SEQ ID NO: 1227461 - protein, 7 aa, Mycobacterium
SQPPSME

SEQ ID NO: 1227462 - protein, 9 aa, Mycobacterium
SQPPSPKAT

SEQ ID NO: 1227463 - protein, 5 aa, Mycobacterium
SQPQE

SEQ ID NO: 1227464 - protein, 10 aa, Mycobacterium
SQPRPQAEAD

SEQ ID NO: 1227465 - protein, 11 aa, Mycobacterium
SQPTRRTGARH

SEQ ID NO: 1227466 - protein, 8 aa, Mycobacterium
SQPVGRSS

SEQ ID NO: 1227467 - protein, 14 aa, Mycobacterium
SQQAEIDTMQGMLD

SEQ ID NO: 1227468 - protein, 5 aa, Mycobacterium
SQQAR

SEQ ID NO: 1227469 - protein, 10 aa, Mycobacterium
SQQGDPGYKA

SEQ ID NO: 1227470 - protein, 25 aa, Mycobacterium
SQQGPTPPTGPVAPRPTAPTQGTPV

SEQ ID NO: 1227471 - protein, 15 aa, Mycobacterium
SQQKEIDTMQQILGS

SEQ ID NO: 1227472 - protein, 6 aa, Mycobacterium
SQQNAR

SEQ ID NO: 1227473 - protein, 6 aa, Mycobacterium
SQQQLQ

SEQ ID NO: 1227474 - protein, 5 aa, Mycobacterium
SQQRD

SEQ ID NO: 1227475 - protein, 18 aa, Mycobacterium
SQQRSTKREHLRPDARRE

SEQ ID NO: 1227476 - protein, 4 aa, Mycobacterium
SQQV

SEQ ID NO: 1227477 - protein, 22 aa, Mycobacterium
SQRERAQSRASRLQRRQATNEA

SEQ ID NO: 1227478 - protein, 11 aa, Mycobacterium
SQRGDPGYKAT

SEQ ID NO: 1227479 - protein, 5 aa, Mycobacterium
SQRGQ

SEQ ID NO: 1227480 - protein, 13 aa, Mycobacterium
SQRGSSATRSTEE

SEQ ID NO: 1227481 - protein, 18 aa, Mycobacterium
SQRHPELADDDHDSLTNS

SEQ ID NO: 1227482 - protein, 7 aa, Mycobacterium
SQRPDGR

SEQ ID NO: 1227483 - protein, 5 aa, Mycobacterium
SQRPG

SEQ ID NO: 1227484 - protein, 7 aa, Mycobacterium
SQRRPGV

SEQ ID NO: 1227485 - protein, 19 aa, Mycobacterium
SQRSRNRHVGEQLGQGKTV

SEQ ID NO: 1227486 - protein, 6 aa, Mycobacterium
SQRTKN

SEQ ID NO: 1227487 - protein, 14 aa, Mycobacterium
SQRVDHGSGDPASR

SEQ ID NO: 1227488 - protein, 9 aa, Mycobacterium
SQSARLARR

SEQ ID NO: 1227489 - protein, 5 aa, Mycobacterium
SQSEN

SEQ ID NO: 1227490 - protein, 8 aa, Mycobacterium
SQSEPGNV

SEQ ID NO: 1227491 - protein, 4 aa, Mycobacterium
SQSG

SEQ ID NO: 1227492 - protein, 11 aa, Mycobacterium
SQSGGEGNGAA

SEQ ID NO: 1227493 - protein, 5 aa, Mycobacterium
SQSHG

SEQ ID NO: 1227494 - protein, 8 aa, Mycobacterium
SQSPSEAA

SEQ ID NO: 1227495 - protein, 10 aa, Mycobacterium
SQSQASTLRP

SEQ ID NO: 1227496 - protein, 5 aa, Mycobacterium
SQSRD

SEQ ID NO: 1227497 - protein, 6 aa, Mycobacterium
SQSRQV

SEQ ID NO: 1227498 - protein, 6 aa, Mycobacterium
SQSRRP

SEQ ID NO: 1227499 - protein, 13 aa, Mycobacterium
SQSTRTHASTAGA

SEQ ID NO: 1227500 - protein, 9 aa, Mycobacterium
SQTAFSEGE

SEQ ID NO: 1227501 - protein, 7 aa, Mycobacterium
SQTATAA

SEQ ID NO: 1227502 - protein, 5 aa, Mycobacterium
SQTDL

SEQ ID NO: 1227503 - protein, 6 aa, Mycobacterium
SQTNLD

SEQ ID NO: 1227504 - protein, 30 aa, Mycobacterium
SQTQPDDESADALRAAAPEARAEILEPVPL

SEQ ID NO: 1227505 - protein, 5 aa, Mycobacterium
SQVEK

SEQ ID NO: 1227506 - protein, 8 aa, Mycobacterium
SQVPEEAA

SEQ ID NO: 1227507 - protein, 10 aa, Mycobacterium
SQVPTRHRNH

SEQ ID NO: 1227508 - protein, 20 aa, Mycobacterium
SQVTAGPRRPRQGRGEVASA

SEQ ID NO: 1227509 - protein, 5 aa, Mycobacterium
SQVYA

SEQ ID NO: 1227510 - protein, 8 aa, Mycobacterium
SRAAAEMG

SEQ ID NO: 1227511 - protein, 8 aa, Mycobacterium
SRAAEAVR

SEQ ID NO: 1227512 - protein, 7 aa, Mycobacterium
SRAAQPI

SEQ ID NO: 1227513 - protein, 12 aa, Mycobacterium
SRAAQRGRFPGH

SEQ ID NO: 1227514 - protein, 6 aa, Mycobacterium
SRAARI

SEQ ID NO: 1227515 - protein, 7 aa, Mycobacterium
SRADGER

SEQ ID NO: 1227516 - protein, 23 aa, Mycobacterium
SRAEAGDGAAVRDADGRTYAGAP

SEQ ID NO: 1227517 - protein, 17 aa, Mycobacterium
SRAEARNRKDWATADQI

SEQ ID NO: 1227518 - protein, 7 aa, Mycobacterium
SRAEDGV

SEQ ID NO: 1227519 - protein, 11 aa, Mycobacterium
SRAEPEHQGTD

SEQ ID NO: 1227520 - protein, 7 aa, Mycobacterium
SRAEPID

SEQ ID NO: 1227521 - protein, 9 aa, Mycobacterium
SRAGAHSPD

SEQ ID NO: 1227522 - protein, 8 aa, Mycobacterium
SRAGETNP

SEQ ID NO: 1227523 - protein, 9 aa, Mycobacterium
SRAGIDPKK

SEQ ID NO: 1227524 - protein, 23 aa, Mycobacterium
SRAGMPTGEPRRPQTYPEPRDGS

SEQ ID NO: 1227525 - protein, 15 aa, Mycobacterium
SRALSGTHSSNDIDA

SEQ ID NO: 1227526 - protein, 12 aa, Mycobacterium
SRALTTEGDAAE

SEQ ID NO: 1227527 - protein, 38 aa, Mycobacterium
SRANGAGKPRSTSRRSSEETSTATGREPFNVGSGRGVG

SEQ ID NO: 1227528 - protein, 7 aa, Mycobacterium
SRAPGPL

SEQ ID NO: 1227529 - protein, 9 aa, Mycobacterium
SRAPGPTII

SEQ ID NO: 1227530 - protein, 8 aa, Mycobacterium
SRAPQADL

SEQ ID NO: 1227531 - protein, 25 aa, Mycobacterium
SRAPQAEVKDGVPGVNRADPDPSTV

SEQ ID NO: 1227532 - protein, 7 aa, Mycobacterium
SRAPRGS

SEQ ID NO: 1227533 - protein, 7 aa, Mycobacterium
SRAQPGL

SEQ ID NO: 1227534 - protein, 4 aa, Mycobacterium
SRAR

SEQ ID NO: 1227535 - protein, 5 aa, Mycobacterium
SRARD

SEQ ID NO: 1227536 - protein, 9 aa, Mycobacterium
SRARVADPP

SEQ ID NO: 1227537 - protein, 4 aa, Mycobacterium
SRAS

SEQ ID NO: 1227538 - protein, 8 aa, Mycobacterium
SRASGADV

SEQ ID NO: 1227539 - protein, 9 aa, Mycobacterium
SRASLTAAP

SEQ ID NO: 1227540 - protein, 8 aa, Mycobacterium
SRATITAA

SEQ ID NO: 1227541 - protein, 11 aa, Mycobacterium
SRATTLNDDEM

SEQ ID NO: 1227542 - protein, 19 aa, Mycobacterium
SRAVNDTPTEQEDTSAALT

SEQ ID NO: 1227543 - protein, 19 aa, Mycobacterium
SRAVNDTSTEQEAVPAALT

SEQ ID NO: 1227544 - protein, 8 aa, Mycobacterium
SRAYPTGA

SEQ ID NO: 1227545 - protein, 12 aa, Mycobacterium
SRCRADGRREAG

SEQ ID NO: 1227546 - protein, 5 aa, Mycobacterium
SRDAS

SEQ ID NO: 1227547 - protein, 27 aa, Mycobacterium
SRDAYRRSMGGDQGTDDDSDASDPLAG

SEQ ID NO: 1227548 - protein, 12 aa, Mycobacterium
SRDDLEDASAHL

SEQ ID NO: 1227549 - protein, 9 aa, Mycobacterium
SRDEGRSVA

SEQ ID NO: 1227550 - protein, 8 aa, Mycobacterium
SRDEPDTM

SEQ ID NO: 1227551 - protein, 5 aa, Mycobacterium
SRDGA

SEQ ID NO: 1227552 - protein, 12 aa, Mycobacterium
SRDGHDGEDAGN

SEQ ID NO: 1227553 - protein, 6 aa, Mycobacterium
SRDGTR

SEQ ID NO: 1227554 - protein, 4 aa, Mycobacterium
SRDM

SEQ ID NO: 1227555 - protein, 10 aa, Mycobacterium
SRDPAAADEH

SEQ ID NO: 1227556 - protein, 10 aa, Mycobacterium
SRDPVPAQRV

SEQ ID NO: 1227557 - protein, 5 aa, Mycobacterium
SRDRS

SEQ ID NO: 1227558 - protein, 9 aa, Mycobacterium
SRDSDGNLT

SEQ ID NO: 1227559 - protein, 7 aa, Mycobacterium
SRDSGTG

SEQ ID NO: 1227560 - protein, 26 aa, Mycobacterium
SRDTATVSESGTVDPSAMTDAQARPA

SEQ ID NO: 1227561 - protein, 5 aa, Mycobacterium
SRDVS

SEQ ID NO: 1227562 - protein, 7 aa, Mycobacterium
SRDYDDA

SEQ ID NO: 1227563 - protein, 10 aa, Mycobacterium
SRDYDTGTDS

SEQ ID NO: 1227564 - protein, 6 aa, Mycobacterium
SRDYED

SEQ ID NO: 1227565 - protein, 13 aa, Mycobacterium
SREAGPVPDDPYG

SEQ ID NO: 1227566 - protein, 7 aa, Mycobacterium
SREAQDE

SEQ ID NO: 1227567 - protein, 16 aa, Mycobacterium
SREATTPLPPVHQDPD

SEQ ID NO: 1227568 - protein, 8 aa, Mycobacterium
SREDTPRT

SEQ ID NO: 1227569 - protein, 11 aa, Mycobacterium
SREEANRRGFP

SEQ ID NO: 1227570 - protein, 5 aa, Mycobacterium
SREEG

SEQ ID NO: 1227571 - protein, 8 aa, Mycobacterium
SREEMQPQ

SEQ ID NO: 1227572 - protein, 7 aa, Mycobacterium
SREFPAK

SEQ ID NO: 1227573 - protein, 15 aa, Mycobacterium
SREGDQIKMSKVEFV

SEQ ID NO: 1227574 - protein, 7 aa, Mycobacterium
SREGDWD

SEQ ID NO: 1227575 - protein, 8 aa, Mycobacterium
SREGVSDS

SEQ ID NO: 1227576 - protein, 10 aa, Mycobacterium
SREHTEAERE

SEQ ID NO: 1227577 - protein, 5 aa, Mycobacterium
SREKR

SEQ ID NO: 1227578 - protein, 5 aa, Mycobacterium
SREKV

SEQ ID NO: 1227579 - protein, 8 aa, Mycobacterium
SRENGEVV

SEQ ID NO: 1227580 - protein, 4 aa, Mycobacterium
SREP

SEQ ID NO: 1227581 - protein, 7 aa, Mycobacterium
SREPESL

SEQ ID NO: 1227582 - protein, 5 aa, Mycobacterium
SREPG

SEQ ID NO: 1227583 - protein, 5 aa, Mycobacterium
SREPI

SEQ ID NO: 1227584 - protein, 5 aa, Mycobacterium
SRERA

SEQ ID NO: 1227585 - protein, 4 aa, Mycobacterium
SRET

SEQ ID NO: 1227586 - protein, 25 aa, Mycobacterium
SRETAASSGGVGVGSCGSGLGRGDI

SEQ ID NO: 1227587 - protein, 11 aa, Mycobacterium
SRETQGSRLSD

SEQ ID NO: 1227588 - protein, 12 aa, Mycobacterium
SRFGATDAGLSD

SEQ ID NO: 1227589 - protein, 7 aa, Mycobacterium
SRFPDST

SEQ ID NO: 1227590 - protein, 5 aa, Mycobacterium
SRGAA

SEQ ID NO: 1227591 - protein, 6 aa, Mycobacterium
SRGAAA

SEQ ID NO: 1227592 - protein, 17 aa, Mycobacterium
SRGAAGGRGVLPSVTGL

SEQ ID NO: 1227593 - protein, 10 aa, Mycobacterium
SRGAGRGGTR

SEQ ID NO: 1227594 - protein, 15 aa, Mycobacterium
SRGAPPRTLERRTPG

SEQ ID NO: 1227595 - protein, 25 aa, Mycobacterium
SRGARVPSPGRRRGYRHGPTPTDQT

SEQ ID NO: 1227596 - protein, 8 aa, Mycobacterium
SRGASADA

SEQ ID NO: 1227597 - protein, 6 aa, Mycobacterium
SRGASS

SEQ ID NO: 1227598 - protein, 18 aa, Mycobacterium
SRGDAAVPTRMVAPRRGR

SEQ ID NO: 1227599 - protein, 19 aa, Mycobacterium
SRGDTPGVPAGSEAPTAKV

SEQ ID NO: 1227600 - protein, 6 aa, Mycobacterium
SRGEHR

SEQ ID NO: 1227601 - protein, 12 aa, Mycobacterium
SRGELARVLNAD

SEQ ID NO: 1227602 - protein, 8 aa, Mycobacterium
SRGESARA

SEQ ID NO: 1227603 - protein, 4 aa, Mycobacterium
SRGG

SEQ ID NO: 1227604 - protein, 8 aa, Mycobacterium
SRGGHDSC

SEQ ID NO: 1227605 - protein, 16 aa, Mycobacterium
SRGGPCPANNGCPANG

SEQ ID NO: 1227606 - protein, 8 aa, Mycobacterium
SRGGRPDL

SEQ ID NO: 1227607 - protein, 8 aa, Mycobacterium
SRGGSDAA

SEQ ID NO: 1227608 - protein, 9 aa, Mycobacterium
SRGGTAVSD

SEQ ID NO: 1227609 - protein, 4 aa, Mycobacterium
SRGH

SEQ ID NO: 1227610 - protein, 15 aa, Mycobacterium
SRGHGDSDRSPDANY

SEQ ID NO: 1227611 - protein, 12 aa, Mycobacterium
SRGKVDGDEDVL

SEQ ID NO: 1227612 - protein, 8 aa, Mycobacterium
SRGNPTVL

SEQ ID NO: 1227613 - protein, 6 aa, Mycobacterium
SRGPIV

SEQ ID NO: 1227614 - protein, 24 aa, Mycobacterium
SRGPRNPVAESDADLGGASSSHAV

SEQ ID NO: 1227615 - protein, 6 aa, Mycobacterium
SRGQGG

SEQ ID NO: 1227616 - protein, 7 aa, Mycobacterium
SRGQSAI

SEQ ID NO: 1227617 - protein, 8 aa, Mycobacterium
SRGQSFDG

SEQ ID NO: 1227618 - protein, 7 aa, Mycobacterium
SRGRGGI

SEQ ID NO: 1227619 - protein, 9 aa, Mycobacterium
SRGRGYGEG

SEQ ID NO: 1227620 - protein, 8 aa, Mycobacterium
SRGRSPAR

SEQ ID NO: 1227621 - protein, 9 aa, Mycobacterium
SRGSADKYA

SEQ ID NO: 1227622 - protein, 6 aa, Mycobacterium
SRGSGE

SEQ ID NO: 1227623 - protein, 5 aa, Mycobacterium
SRGSM

SEQ ID NO: 1227624 - protein, 13 aa, Mycobacterium
SRGVSAEGTGSKF

SEQ ID NO: 1227625 - protein, 7 aa, Mycobacterium
SRGVSDE

SEQ ID NO: 1227626 - protein, 5 aa, Mycobacterium
SRGYR

SEQ ID NO: 1227627 - protein, 7 aa, Mycobacterium
SRHAETR

SEQ ID NO: 1227628 - protein, 14 aa, Mycobacterium
SRHDDSGADLPPEA

SEQ ID NO: 1227629 - protein, 18 aa, Mycobacterium
SRHRGDVTAEPEITEEEA

SEQ ID NO: 1227630 - protein, 13 aa, Mycobacterium
SRHTRHGGESEPV

SEQ ID NO: 1227631 - protein, 5 aa, Mycobacterium
SRIDG

SEQ ID NO: 1227632 - protein, 6 aa, Mycobacterium
SRIDTA

SEQ ID NO: 1227633 - protein, 9 aa, Mycobacterium
SRIGDPEAG

SEQ ID NO: 1227634 - protein, 23 aa, Mycobacterium
SRIPETRPASLSRSAKETPPGHY

SEQ ID NO: 1227635 - protein, 5 aa, Mycobacterium
SRKAA

SEQ ID NO: 1227636 - protein, 6 aa, Mycobacterium
SRKLGP

SEQ ID NO: 1227637 - protein, 11 aa, Mycobacterium
SRKLTAAEGPI

SEQ ID NO: 1227638 - protein, 9 aa, Mycobacterium
SRKRNTGYA

SEQ ID NO: 1227639 - protein, 9 aa, Mycobacterium
SRKTDIEGA

SEQ ID NO: 1227640 - protein, 10 aa, Mycobacterium
SRKYRNLADN

SEQ ID NO: 1227641 - protein, 4 aa, Mycobacterium
SRLD

SEQ ID NO: 1227642 - protein, 7 aa, Mycobacterium
SRLDAAP

SEQ ID NO: 1227643 - protein, 8 aa, Mycobacterium
SRLDGERM

SEQ ID NO: 1227644 - protein, 12 aa, Mycobacterium
SRLEGDTTAVGT

SEQ ID NO: 1227645 - protein, 17 aa, Mycobacterium
SRLGGSASRVTRTGKTL

SEQ ID NO: 1227646 - protein, 6 aa, Mycobacterium
SRLKEN

SEQ ID NO: 1227647 - protein, 9 aa, Mycobacterium
SRLNNEQSA

SEQ ID NO: 1227648 - protein, 9 aa, Mycobacterium
SRLPAGPAK

SEQ ID NO: 1227649 - protein, 8 aa, Mycobacterium
SRLPTGGH

SEQ ID NO: 1227650 - protein, 10 aa, Mycobacterium
SRLRGTDERL

SEQ ID NO: 1227651 - protein, 10 aa, Mycobacterium
SRLSAQARAA

SEQ ID NO: 1227652 - protein, 8 aa, Mycobacterium
SRLTADGQ

SEQ ID NO: 1227653 - protein, 14 aa, Mycobacterium
SRMRGGQQGQERRA

SEQ ID NO: 1227654 - protein, 7 aa, Mycobacterium
SRMSPEE

SEQ ID NO: 1227655 - protein, 7 aa, Mycobacterium
SRMTGNP

SEQ ID NO: 1227656 - protein, 7 aa, Mycobacterium
SRNEELQ

SEQ ID NO: 1227657 - protein, 5 aa, Mycobacterium
SRNGD

SEQ ID NO: 1227658 - protein, 12 aa, Mycobacterium
SRNGRDVTAEYP

SEQ ID NO: 1227659 - protein, 10 aa, Mycobacterium
SRNGVGPVDS

SEQ ID NO: 1227660 - protein, 8 aa, Mycobacterium
SRNPETAA

SEQ ID NO: 1227661 - protein, 9 aa, Mycobacterium
SRNPGSRLD

SEQ ID NO: 1227662 - protein, 4 aa, Mycobacterium
SRNQ

SEQ ID NO: 1227663 - protein, 7 aa, Mycobacterium
SRNSATG

SEQ ID NO: 1227664 - protein, 5 aa, Mycobacterium
SRNTH

SEQ ID NO: 1227665 - protein, 23 aa, Mycobacterium
SRNVTAPGNRVNSAGHQDRSSRQ

SEQ ID NO: 1227666 - protein, 9 aa, Mycobacterium
SRNVTESSL

SEQ ID NO: 1227667 - protein, 7 aa, Mycobacterium
SRPAASA

SEQ ID NO: 1227668 - protein, 10 aa, Mycobacterium
SRPADDKGAG

SEQ ID NO: 1227669 - protein, 11 aa, Mycobacterium
SRPAPLAETPY

SEQ ID NO: 1227670 - protein, 6 aa, Mycobacterium
SRPARG

SEQ ID NO: 1227671 - protein, 9 aa, Mycobacterium
SRPDPAAKR

SEQ ID NO: 1227672 - protein, 7 aa, Mycobacterium
SRPDQLA

SEQ ID NO: 1227673 - protein, 6 aa, Mycobacterium
SRPDRT

SEQ ID NO: 1227674 - protein, 10 aa, Mycobacterium
SRPDSLSDEQ

SEQ ID NO: 1227675 - protein, 8 aa, Mycobacterium
SRPDTSSR

SEQ ID NO: 1227676 - protein, 11 aa, Mycobacterium
SRPEEDGEEAL

SEQ ID NO: 1227677 - protein, 6 aa, Mycobacterium
SRPEGR

SEQ ID NO: 1227678 - protein, 6 aa, Mycobacterium
SRPEPD

SEQ ID NO: 1227679 - protein, 7 aa, Mycobacterium
SRPFHGD

SEQ ID NO: 1227680 - protein, 6 aa, Mycobacterium
SRPGAD

SEQ ID NO: 1227681 - protein, 6 aa, Mycobacterium
SRPGDV

SEQ ID NO: 1227682 - protein, 7 aa, Mycobacterium
SRPGLTD

SEQ ID NO: 1227683 - protein, 23 aa, Mycobacterium
SRPIGHQDEQTSLPGNQNWDAEE

SEQ ID NO: 1227684 - protein, 6 aa, Mycobacterium
SRPKPL

SEQ ID NO: 1227685 - protein, 10 aa, Mycobacterium
SRPPAAVKGV

SEQ ID NO: 1227686 - protein, 10 aa, Mycobacterium
SRPPGSGGGA

SEQ ID NO: 1227687 - protein, 39 aa, Mycobacterium
SRPPKKAGKQGASASAARARRAQASKAATKKATDSKEGS

SEQ ID NO: 1227688 - protein, 26 aa, Mycobacterium
SRPPKVTAPGGSRCTAHGGRRYQRAQ

SEQ ID NO: 1227689 - protein, 7 aa, Mycobacterium
SRPPQAG

SEQ ID NO: 1227690 - protein, 14 aa, Mycobacterium
SRPPRAGGAPRRRR

SEQ ID NO: 1227691 - protein, 6 aa, Mycobacterium
SRPRAR

SEQ ID NO: 1227692 - protein, 57 aa, Mycobacterium
SRPSREGRRGGAGESAGGARARRAQGSKAAAAKKAPASSSTKAATTTEASEEAKGGS

SEQ ID NO: 1227693 - protein, 10 aa, Mycobacterium
SRPSRSALAD

SEQ ID NO: 1227694 - protein, 7 aa, Mycobacterium
SRPTDAD

SEQ ID NO: 1227695 - protein, 9 aa, Mycobacterium
SRPTEPPAF

SEQ ID NO: 1227696 - protein, 8 aa, Mycobacterium
SRPTSPYG

SEQ ID NO: 1227697 - protein, 5 aa, Mycobacterium
SRPVD

SEQ ID NO: 1227698 - protein, 6 aa, Mycobacterium
SRPVDD

SEQ ID NO: 1227699 - protein, 8 aa, Mycobacterium
SRPVPNPE

SEQ ID NO: 1227700 - protein, 5 aa, Mycobacterium
SRPWK

SEQ ID NO: 1227701 - protein, 15 aa, Mycobacterium
SRQAAAQPVTRTVIT

SEQ ID NO: 1227702 - protein, 6 aa, Mycobacterium
SRQAAT

SEQ ID NO: 1227703 - protein, 17 aa, Mycobacterium
SRQLGSGAIDQSGPNAG

SEQ ID NO: 1227704 - protein, 8 aa, Mycobacterium
SRQLRSTS

SEQ ID NO: 1227705 - protein, 6 aa, Mycobacterium
SRQPVA

SEQ ID NO: 1227706 - protein, 6 aa, Mycobacterium
SRQPVE

SEQ ID NO: 1227707 - protein, 6 aa, Mycobacterium
SRQQRG

SEQ ID NO: 1227708 - protein, 6 aa, Mycobacterium
SRQRTL

SEQ ID NO: 1227709 - protein, 5 aa, Mycobacterium
SRQTV

SEQ ID NO: 1227710 - protein, 8 aa, Mycobacterium
SRRADGGM

SEQ ID NO: 1227711 - protein, 5 aa, Mycobacterium
SRRAL

SEQ ID NO: 1227712 - protein, 11 aa, Mycobacterium
SRRAPDADARR

SEQ ID NO: 1227713 - protein, 9 aa, Mycobacterium
SRRCGDSAV

SEQ ID NO: 1227714 - protein, 5 aa, Mycobacterium
SRRDG

SEQ ID NO: 1227715 - protein, 6 aa, Mycobacterium
SRRDGI

SEQ ID NO: 1227716 - protein, 8 aa, Mycobacterium
SRRDRLGS

SEQ ID NO: 1227717 - protein, 14 aa, Mycobacterium
SRREERAGWSEKDW

SEQ ID NO: 1227718 - protein, 5 aa, Mycobacterium
SRRER

SEQ ID NO: 1227719 - protein, 10 aa, Mycobacterium
SRRGGSQLSE

SEQ ID NO: 1227720 - protein, 25 aa, Mycobacterium
SRRGSEQLRAADGRDPGQRQRPQRH

SEQ ID NO: 1227721 - protein, 14 aa, Mycobacterium
SRRHPPGTTERDPL

SEQ ID NO: 1227722 - protein, 13 aa, Mycobacterium
SRRITTRTATKNQ

SEQ ID NO: 1227723 - protein, 10 aa, Mycobacterium
SRRMSTPQEV

SEQ ID NO: 1227724 - protein, 8 aa, Mycobacterium
SRRNHGRS

SEQ ID NO: 1227725 - protein, 9 aa, Mycobacterium
SRRPDRPGV

SEQ ID NO: 1227726 - protein, 15 aa, Mycobacterium
SRRPEEFSSGQGTQI

SEQ ID NO: 1227727 - protein, 5 aa, Mycobacterium
SRRPH

SEQ ID NO: 1227728 - protein, 4 aa, Mycobacterium
SRRQ

SEQ ID NO: 1227729 - protein, 4 aa, Mycobacterium
SRRR

SEQ ID NO: 1227730 - protein, 5 aa, Mycobacterium
SRRRG

SEQ ID NO: 1227731 - protein, 16 aa, Mycobacterium
SRRRGNVTTSLTSETA

SEQ ID NO: 1227732 - protein, 11 aa, Mycobacterium
SRRRRGAESTA

SEQ ID NO: 1227733 - protein, 9 aa, Mycobacterium
SRRRTGGLQ

SEQ ID NO: 1227734 - protein, 11 aa, Mycobacterium
SRRRTSGADGD

SEQ ID NO: 1227735 - protein, 7 aa, Mycobacterium
SRRSFAE

SEQ ID NO: 1227736 - protein, 8 aa, Mycobacterium
SRRSTAAT

SEQ ID NO: 1227737 - protein, 11 aa, Mycobacterium
SRRTQGSRLSD

SEQ ID NO: 1227738 - protein, 8 aa, Mycobacterium
SRRTTEYE

SEQ ID NO: 1227739 - protein, 5 aa, Mycobacterium
SRSAA

SEQ ID NO: 1227740 - protein, 7 aa, Mycobacterium
SRSAAAA

SEQ ID NO: 1227741 - protein, 18 aa, Mycobacterium
SRSADQIRAATGGHEEPI

SEQ ID NO: 1227742 - protein, 12 aa, Mycobacterium
SRSAEHLKVQLI

SEQ ID NO: 1227743 - protein, 14 aa, Mycobacterium
SRSAPNPTTAEDAE

SEQ ID NO: 1227744 - protein, 9 aa, Mycobacterium
SRSATADIE

SEQ ID NO: 1227745 - protein, 9 aa, Mycobacterium
SRSDAGSWT

SEQ ID NO: 1227746 - protein, 7 aa, Mycobacterium
SRSDDGP

SEQ ID NO: 1227747 - protein, 10 aa, Mycobacterium
SRSDRETNTV

SEQ ID NO: 1227748 - protein, 9 aa, Mycobacterium
SRSDSGNCP

SEQ ID NO: 1227749 - protein, 10 aa, Mycobacterium
SRSGAAMNGA

SEQ ID NO: 1227750 - protein, 12 aa, Mycobacterium
SRSGASPASQVR

SEQ ID NO: 1227751 - protein, 8 aa, Mycobacterium
SRSGPPQV

SEQ ID NO: 1227752 - protein, 8 aa, Mycobacterium
SRSGQTKL

SEQ ID NO: 1227753 - protein, 12 aa, Mycobacterium
SRSGRDVTSEYP

SEQ ID NO: 1227754 - protein, 6 aa, Mycobacterium
SRSGSI

SEQ ID NO: 1227755 - protein, 11 aa, Mycobacterium
SRSHRRTAAAL

SEQ ID NO: 1227756 - protein, 10 aa, Mycobacterium
SRSLDGETIR

SEQ ID NO: 1227757 - protein, 6 aa, Mycobacterium
SRSLTT

SEQ ID NO: 1227758 - protein, 9 aa, Mycobacterium
SRSMGGDER

SEQ ID NO: 1227759 - protein, 7 aa, Mycobacterium
SRSPVAA

SEQ ID NO: 1227760 - protein, 5 aa, Mycobacterium
SRSQP

SEQ ID NO: 1227761 - protein, 14 aa, Mycobacterium
SRSSAKWQAGEDFS

SEQ ID NO: 1227762 - protein, 9 aa, Mycobacterium
SRSSELTAR

SEQ ID NO: 1227763 - protein, 10 aa, Mycobacterium
SRSSGPPPVV

SEQ ID NO: 1227764 - protein, 9 aa, Mycobacterium
SRSSPRAGD

SEQ ID NO: 1227765 - protein, 9 aa, Mycobacterium
SRSSQPDLA

SEQ ID NO: 1227766 - protein, 8 aa, Mycobacterium
SRSSRAGG

SEQ ID NO: 1227767 - protein, 6 aa, Mycobacterium
SRSSVE

SEQ ID NO: 1227768 - protein, 4 aa, Mycobacterium
SRST

SEQ ID NO: 1227769 - protein, 5 aa, Mycobacterium
SRTAT

SEQ ID NO: 1227770 - protein, 5 aa, Mycobacterium
SRTAV

SEQ ID NO: 1227771 - protein, 5 aa, Mycobacterium
SRTDE

SEQ ID NO: 1227772 - protein, 6 aa, Mycobacterium
SRTGDH

SEQ ID NO: 1227773 - protein, 6 aa, Mycobacterium
SRTGGS

SEQ ID NO: 1227774 - protein, 7 aa, Mycobacterium
SRTGLDR

SEQ ID NO: 1227775 - protein, 5 aa, Mycobacterium
SRTGR

SEQ ID NO: 1227776 - protein, 18 aa, Mycobacterium
SRTGVPGADWPRYSAEDR

SEQ ID NO: 1227777 - protein, 9 aa, Mycobacterium
SRTPAPGVY

SEQ ID NO: 1227778 - protein, 7 aa, Mycobacterium
SRTPSEH

SEQ ID NO: 1227779 - protein, 13 aa, Mycobacterium
SRTQRGHRGLEVV

SEQ ID NO: 1227780 - protein, 4 aa, Mycobacterium
SRTR

SEQ ID NO: 1227781 - protein, 10 aa, Mycobacterium
SRTRDAQRRP

SEQ ID NO: 1227782 - protein, 7 aa, Mycobacterium
SRTRGRG

SEQ ID NO: 1227783 - protein, 10 aa, Mycobacterium
SRTRQTASEI

SEQ ID NO: 1227784 - protein, 6 aa, Mycobacterium
SRTRSW

SEQ ID NO: 1227785 - protein, 5 aa, Mycobacterium
SRTSY

SEQ ID NO: 1227786 - protein, 6 aa, Mycobacterium
SRTTDF

SEQ ID NO: 1227787 - protein, 8 aa, Mycobacterium
SRTTDGRE

SEQ ID NO: 1227788 - protein, 6 aa, Mycobacterium
SRTTEF

SEQ ID NO: 1227789 - protein, 7 aa, Mycobacterium
SRTTHSR

SEQ ID NO: 1227790 - protein, 21 aa, Mycobacterium
SRTTIAPDADTLSELGEAPSG

SEQ ID NO: 1227791 - protein, 6 aa, Mycobacterium
SRTTWQ

SEQ ID NO: 1227792 - protein, 11 aa, Mycobacterium
SRTVPADRTPH

SEQ ID NO: 1227793 - protein, 4 aa, Mycobacterium
SRTY

SEQ ID NO: 1227794 - protein, 18 aa, Mycobacterium
SRTYGLDRDAGQTVQPQP

SEQ ID NO: 1227795 - protein, 25 aa, Mycobacterium
SRVDAARKALDRAREIASRAGDPNL

SEQ ID NO: 1227796 - protein, 9 aa, Mycobacterium
SRVDPRAQG

SEQ ID NO: 1227797 - protein, 12 aa, Mycobacterium
SRVERAGGVVVR

SEQ ID NO: 1227798 - protein, 5 aa, Mycobacterium
SRVGA

SEQ ID NO: 1227799 - protein, 14 aa, Mycobacterium
SRVGEGATQKKQQG

SEQ ID NO: 1227800 - protein, 7 aa, Mycobacterium
SRVGNNT

SEQ ID NO: 1227801 - protein, 9 aa, Mycobacterium
SRVPGAAPA

SEQ ID NO: 1227802 - protein, 4 aa, Mycobacterium
SRVQ

SEQ ID NO: 1227803 - protein, 8 aa, Mycobacterium
SRVQRGRR

SEQ ID NO: 1227804 - protein, 4 aa, Mycobacterium
SRVR

SEQ ID NO: 1227805 - protein, 5 aa, Mycobacterium
SRVST

SEQ ID NO: 1227806 - protein, 13 aa, Mycobacterium
SRVSTGDADVDEA

SEQ ID NO: 1227807 - protein, 4 aa, Mycobacterium
SRVT

SEQ ID NO: 1227808 - protein, 6 aa, Mycobacterium
SRVTTA

SEQ ID NO: 1227809 - protein, 11 aa, Mycobacterium
SRYGDSPATRR

SEQ ID NO: 1227810 - protein, 21 aa, Mycobacterium
SRYLGGSAATTVGATAVGPSI

SEQ ID NO: 1227811 - protein, 7 aa, Mycobacterium
SRYPDNE

SEQ ID NO: 1227812 - protein, 14 aa, Mycobacterium
SRYPNQLSGGQRQR

SEQ ID NO: 1227813 - protein, 9 aa, Mycobacterium
SRYRAPTRQ

SEQ ID NO: 1227814 - protein, 6 aa, Mycobacterium
SRYTGG

SEQ ID NO: 1227815 - protein, 9 aa, Mycobacterium
SSAAAGPVA

SEQ ID NO: 1227816 - protein, 9 aa, Mycobacterium
SSAAASADY

SEQ ID NO: 1227817 - protein, 11 aa, Mycobacterium
SSAAETDADPY

SEQ ID NO: 1227818 - protein, 11 aa, Mycobacterium
SSAANQLGAGQ

SEQ ID NO: 1227819 - protein, 11 aa, Mycobacterium
SSAANSLGAGE

SEQ ID NO: 1227820 - protein, 9 aa, Mycobacterium
SSAAPGVAK

SEQ ID NO: 1227821 - protein, 8 aa, Mycobacterium
SSAARHRG

SEQ ID NO: 1227822 - protein, 5 aa, Mycobacterium
SSADC

SEQ ID NO: 1227823 - protein, 9 aa, Mycobacterium
SSADGKEIA

SEQ ID NO: 1227824 - protein, 9 aa, Mycobacterium
SSADIERSE

SEQ ID NO: 1227825 - protein, 14 aa, Mycobacterium
SSADYTGAPGPLGK

SEQ ID NO: 1227826 - protein, 5 aa, Mycobacterium
SSAEA

SEQ ID NO: 1227827 - protein, 19 aa, Mycobacterium
SSAEGRDRTRALLRDMRSG

SEQ ID NO: 1227828 - protein, 5 aa, Mycobacterium
SSAES

SEQ ID NO: 1227829 - protein, 9 aa, Mycobacterium
SSAGSADVE

SEQ ID NO: 1227830 - protein, 13 aa, Mycobacterium
SSAGTHAKTAVND

SEQ ID NO: 1227831 - protein, 5 aa, Mycobacterium
SSAGV

SEQ ID NO: 1227832 - protein, 5 aa, Mycobacterium
SSALA

SEQ ID NO: 1227833 - protein, 10 aa, Mycobacterium
SSALADDAEE

SEQ ID NO: 1227834 - protein, 6 aa, Mycobacterium
SSALGR

SEQ ID NO: 1227835 - protein, 6 aa, Mycobacterium
SSAPAI

SEQ ID NO: 1227836 - protein, 10 aa, Mycobacterium
SSAPEVEDTE

SEQ ID NO: 1227837 - protein, 8 aa, Mycobacterium
SSAPPAGH

SEQ ID NO: 1227838 - protein, 8 aa, Mycobacterium
SSAPSASV

SEQ ID NO: 1227839 - protein, 9 aa, Mycobacterium
SSAQADRPL

SEQ ID NO: 1227840 - protein, 10 aa, Mycobacterium
SSAQRGSPGM

SEQ ID NO: 1227841 - protein, 8 aa, Mycobacterium
SSARGRPL

SEQ ID NO: 1227842 - protein, 12 aa, Mycobacterium
SSATAGNLPETQ

SEQ ID NO: 1227843 - protein, 10 aa, Mycobacterium
SSATDEDRER

SEQ ID NO: 1227844 - protein, 16 aa, Mycobacterium
SSAVGEDGEDQSFAGQ

SEQ ID NO: 1227845 - protein, 6 aa, Mycobacterium
SSAWSR

SEQ ID NO: 1227846 - protein, 14 aa, Mycobacterium
SSAYRRPHGVFIAS

SEQ ID NO: 1227847 - protein, 16 aa, Mycobacterium
SSDAGQSWESRSLHGS

SEQ ID NO: 1227848 - protein, 6 aa, Mycobacterium
SSDALG

SEQ ID NO: 1227849 - protein, 8 aa, Mycobacterium
SSDDAGIP

SEQ ID NO: 1227850 - protein, 5 aa, Mycobacterium
SSDDG

SEQ ID NO: 1227851 - protein, 7 aa, Mycobacterium
SSDDGGA

SEQ ID NO: 1227852 - protein, 8 aa, Mycobacterium
SSDDHGEC

SEQ ID NO: 1227853 - protein, 5 aa, Mycobacterium
SSDDW

SEQ ID NO: 1227854 - protein, 7 aa, Mycobacterium
SSDENLR

SEQ ID NO: 1227855 - protein, 10 aa, Mycobacterium
SSDGEECSRD

SEQ ID NO: 1227856 - protein, 9 aa, Mycobacterium
SSDGERRRA

SEQ ID NO: 1227857 - protein, 14 aa, Mycobacterium
SSDGPWESDGIRRA

SEQ ID NO: 1227858 - protein, 6 aa, Mycobacterium
SSDHGV

SEQ ID NO: 1227859 - protein, 6 aa, Mycobacterium
SSDPAA

SEQ ID NO: 1227860 - protein, 13 aa, Mycobacterium
SSDPSRRESPIPR

SEQ ID NO: 1227861 - protein, 7 aa, Mycobacterium
SSDPTAA

SEQ ID NO: 1227862 - protein, 5 aa, Mycobacterium
SSDRQ

SEQ ID NO: 1227863 - protein, 12 aa, Mycobacterium
SSDTDLSDGMTI

SEQ ID NO: 1227864 - protein, 10 aa, Mycobacterium
SSDTPQDLAD

SEQ ID NO: 1227865 - protein, 8 aa, Mycobacterium
SSDTPTPV

SEQ ID NO: 1227866 - protein, 4 aa, Mycobacterium
SSDV

SEQ ID NO: 1227867 - protein, 9 aa, Mycobacterium
SSEAATEAA

SEQ ID NO: 1227868 - protein, 8 aa, Mycobacterium
SSEANDID

SEQ ID NO: 1227869 - protein, 7 aa, Mycobacterium
SSEASQR

SEQ ID NO: 1227870 - protein, 11 aa, Mycobacterium
SSEAVQTREAV

SEQ ID NO: 1227871 - protein, 4 aa, Mycobacterium
SSEE

SEQ ID NO: 1227872 - protein, 12 aa, Mycobacterium
SSEHRHTSPSEQ

SEQ ID NO: 1227873 - protein, 11 aa, Mycobacterium
SSEPNAGSDVG

SEQ ID NO: 1227874 - protein, 7 aa, Mycobacterium
SSERQTA

SEQ ID NO: 1227875 - protein, 7 aa, Mycobacterium
SSESPHF

SEQ ID NO: 1227876 - protein, 6 aa, Mycobacterium
SSETDN

SEQ ID NO: 1227877 - protein, 4 aa, Mycobacterium
SSFM

SEQ ID NO: 1227878 - protein, 7 aa, Mycobacterium
SSFTPEE

SEQ ID NO: 1227879 - protein, 15 aa, Mycobacterium
SSFTTGSIVRADGGI

SEQ ID NO: 1227880 - protein, 8 aa, Mycobacterium
SSGAATAA

SEQ ID NO: 1227881 - protein, 8 aa, Mycobacterium
SSGAESTE

SEQ ID NO: 1227882 - protein, 19 aa, Mycobacterium
SSGAQLVPGSRSAARTATA

SEQ ID NO: 1227883 - protein, 11 aa, Mycobacterium
SSGDAAGPNRE

SEQ ID NO: 1227884 - protein, 5 aa, Mycobacterium
SSGDL

SEQ ID NO: 1227885 - protein, 15 aa, Mycobacterium
SSGDVDENAANPITA

SEQ ID NO: 1227886 - protein, 4 aa, Mycobacterium
SSGE

SEQ ID NO: 1227887 - protein, 8 aa, Mycobacterium
SSGEDITR

SEQ ID NO: 1227888 - protein, 8 aa, Mycobacterium
SSGEERAD

SEQ ID NO: 1227889 - protein, 12 aa, Mycobacterium
SSGESLWVRGDN

SEQ ID NO: 1227890 - protein, 7 aa, Mycobacterium
SSGGASL

SEQ ID NO: 1227891 - protein, 6 aa, Mycobacterium
SSGGNP

SEQ ID NO: 1227892 - protein, 10 aa, Mycobacterium
SSGGSPNRVA

SEQ ID NO: 1227893 - protein, 4 aa, Mycobacterium
SSGH

SEQ ID NO: 1227894 - protein, 5 aa, Mycobacterium
SSGHD

SEQ ID NO: 1227895 - protein, 5 aa, Mycobacterium
SSGIK

SEQ ID NO: 1227896 - protein, 17 aa, Mycobacterium
SSGITGQALDVNCGEFK

SEQ ID NO: 1227897 - protein, 13 aa, Mycobacterium
SSGKPGSHREARR

SEQ ID NO: 1227898 - protein, 14 aa, Mycobacterium
SSGKRDPRELSTQQ

SEQ ID NO: 1227899 - protein, 13 aa, Mycobacterium
SSGKRDPRELSTR

SEQ ID NO: 1227900 - protein, 23 aa, Mycobacterium
SSGLRTDRQAAREGVGGEVLAYV

SEQ ID NO: 1227901 - protein, 5 aa, Mycobacterium
SSGLV

SEQ ID NO: 1227902 - protein, 4 aa, Mycobacterium
SSGM

SEQ ID NO: 1227903 - protein, 17 aa, Mycobacterium
SSGPAEETTAATAEKVD

SEQ ID NO: 1227904 - protein, 6 aa, Mycobacterium
SSGPDR

SEQ ID NO: 1227905 - protein, 11 aa, Mycobacterium
SSGPDSPEQRW

SEQ ID NO: 1227906 - protein, 5 aa, Mycobacterium
SSGPL

SEQ ID NO: 1227907 - protein, 13 aa, Mycobacterium
SSGRDWGSPAIPE

SEQ ID NO: 1227908 - protein, 14 aa, Mycobacterium
SSGRGDATQEQTDV

SEQ ID NO: 1227909 - protein, 19 aa, Mycobacterium
SSGRGKASGVRRIDDDDRV

SEQ ID NO: 1227910 - protein, 6 aa, Mycobacterium
SSGRGQ

SEQ ID NO: 1227911 - protein, 12 aa, Mycobacterium
SSGRITPGDASA

SEQ ID NO: 1227912 - protein, 7 aa, Mycobacterium
SSGRPGP

SEQ ID NO: 1227913 - protein, 10 aa, Mycobacterium
SSGRVKRPQM

SEQ ID NO: 1227914 - protein, 9 aa, Mycobacterium
SSGRVTREP

SEQ ID NO: 1227915 - protein, 8 aa, Mycobacterium
SSGSTRLP

SEQ ID NO: 1227916 - protein, 4 aa, Mycobacterium
SSGT

SEQ ID NO: 1227917 - protein, 9 aa, Mycobacterium
SSGTAQGSV

SEQ ID NO: 1227918 - protein, 13 aa, Mycobacterium
SSGTNKDAARSEH

SEQ ID NO: 1227919 - protein, 5 aa, Mycobacterium
SSGTP

SEQ ID NO: 1227920 - protein, 14 aa, Mycobacterium
SSGTPFSRPVQGTD

SEQ ID NO: 1227921 - protein, 17 aa, Mycobacterium
SSGTSSTRSSRTQLGLP

SEQ ID NO: 1227922 - protein, 12 aa, Mycobacterium
SSGTTGRPKGIR

SEQ ID NO: 1227923 - protein, 7 aa, Mycobacterium
SSGVIGR

SEQ ID NO: 1227924 - protein, 6 aa, Mycobacterium
SSHGTH

SEQ ID NO: 1227925 - protein, 5 aa, Mycobacterium
SSHPD

SEQ ID NO: 1227926 - protein, 7 aa, Mycobacterium
SSHPDPV

SEQ ID NO: 1227927 - protein, 6 aa, Mycobacterium
SSHRPR

SEQ ID NO: 1227928 - protein, 5 aa, Mycobacterium
SSIEA

SEQ ID NO: 1227929 - protein, 9 aa, Mycobacterium
SSIGENLQP

SEQ ID NO: 1227930 - protein, 4 aa, Mycobacterium
SSIH

SEQ ID NO: 1227931 - protein, 18 aa, Mycobacterium
SSINQDGASGGLTVPNGV

SEQ ID NO: 1227932 - protein, 6 aa, Mycobacterium
SSINRS

SEQ ID NO: 1227933 - protein, 7 aa, Mycobacterium
SSIPPKT

SEQ ID NO: 1227934 - protein, 9 aa, Mycobacterium
SSIPRRGVG

SEQ ID NO: 1227935 - protein, 5 aa, Mycobacterium
SSIPT

SEQ ID NO: 1227936 - protein, 4 aa, Mycobacterium
SSIQ

SEQ ID NO: 1227937 - protein, 11 aa, Mycobacterium
SSITAPDGRPV

SEQ ID NO: 1227938 - protein, 12 aa, Mycobacterium
SSITAPDGRPVN

SEQ ID NO: 1227939 - protein, 9 aa, Mycobacterium
SSITNGQDN

SEQ ID NO: 1227940 - protein, 10 aa, Mycobacterium
SSKAAGDRRT

SEQ ID NO: 1227941 - protein, 8 aa, Mycobacterium
SSKGAATM

SEQ ID NO: 1227942 - protein, 12 aa, Mycobacterium
SSKSAGPGTRAN

SEQ ID NO: 1227943 - protein, 5 aa, Mycobacterium
SSKTF

SEQ ID NO: 1227944 - protein, 10 aa, Mycobacterium
SSLADNRSRV

SEQ ID NO: 1227945 - protein, 19 aa, Mycobacterium
SSLEDGSRLGPDPKTFNFT

SEQ ID NO: 1227946 - protein, 6 aa, Mycobacterium
SSLGAA

SEQ ID NO: 1227947 - protein, 8 aa, Mycobacterium
SSLGWTGT

SEQ ID NO: 1227948 - protein, 5 aa, Mycobacterium
SSLLD

SEQ ID NO: 1227949 - protein, 7 aa, Mycobacterium
SSLPTPA

SEQ ID NO: 1227950 - protein, 18 aa, Mycobacterium
SSLPVAGTTGYDALRESG

SEQ ID NO: 1227951 - protein, 6 aa, Mycobacterium
SSLQTH

SEQ ID NO: 1227952 - protein, 17 aa, Mycobacterium
SSLRPKASRLEESESSI

SEQ ID NO: 1227953 - protein, 6 aa, Mycobacterium
SSMPSV

SEQ ID NO: 1227954 - protein, 4 aa, Mycobacterium
SSNA

SEQ ID NO: 1227955 - protein, 13 aa, Mycobacterium
SSNADAHAGHTET

SEQ ID NO: 1227956 - protein, 9 aa, Mycobacterium
SSNGAKRAI

SEQ ID NO: 1227957 - protein, 6 aa, Mycobacterium
SSNLDG

SEQ ID NO: 1227958 - protein, 10 aa, Mycobacterium
SSNPAHSLAD

SEQ ID NO: 1227959 - protein, 19 aa, Mycobacterium
SSNPTAGGASVGSGIGPTR

SEQ ID NO: 1227960 - protein, 12 aa, Mycobacterium
SSNPTPEGAEQL

SEQ ID NO: 1227961 - protein, 7 aa, Mycobacterium
SSNQSYD

SEQ ID NO: 1227962 - protein, 5 aa, Mycobacterium
SSNRE

SEQ ID NO: 1227963 - protein, 9 aa, Mycobacterium
SSNRGGEAL

SEQ ID NO: 1227964 - protein, 13 aa, Mycobacterium
SSNSQGGSGWTEW

SEQ ID NO: 1227965 - protein, 6 aa, Mycobacterium
SSNVEA

SEQ ID NO: 1227966 - protein, 4 aa, Mycobacterium
SSPA

SEQ ID NO: 1227967 - protein, 17 aa, Mycobacterium
SSPAAYPSSGPLRNPFP

SEQ ID NO: 1227968 - protein, 7 aa, Mycobacterium
SSPATSA

SEQ ID NO: 1227969 - protein, 10 aa, Mycobacterium
SSPDAAEDDG

SEQ ID NO: 1227970 - protein, 7 aa, Mycobacterium
SSPDPVP

SEQ ID NO: 1227971 - protein, 8 aa, Mycobacterium
SSPDTDKR

SEQ ID NO: 1227972 - protein, 4 aa, Mycobacterium
SSPE

SEQ ID NO: 1227973 - protein, 9 aa, Mycobacterium
SSPEDLAET

SEQ ID NO: 1227974 - protein, 17 aa, Mycobacterium
SSPERLRAAGADPALYR

SEQ ID NO: 1227975 - protein, 9 aa, Mycobacterium
SSPGAFGEP

SEQ ID NO: 1227976 - protein, 30 aa, Mycobacterium
SSPGPVGNATTATTGGTRPHRTAAVSSDSH

SEQ ID NO: 1227977 - protein, 6 aa, Mycobacterium
SSPGRN

SEQ ID NO: 1227978 - protein, 5 aa, Mycobacterium
SSPGS

SEQ ID NO: 1227979 - protein, 9 aa, Mycobacterium
SSPGSGKTS

SEQ ID NO: 1227980 - protein, 5 aa, Mycobacterium
SSPGV

SEQ ID NO: 1227981 - protein, 22 aa, Mycobacterium
SSPHTDDAPKVTVKRTDGGYGS

SEQ ID NO: 1227982 - protein, 7 aa, Mycobacterium
SSPLRPS

SEQ ID NO: 1227983 - protein, 9 aa, Mycobacterium
SSPPGAVPG

SEQ ID NO: 1227984 - protein, 6 aa, Mycobacterium
SSPPVT

SEQ ID NO: 1227985 - protein, 12 aa, Mycobacterium
SSPQAPRRELGA

SEQ ID NO: 1227986 - protein, 5 aa, Mycobacterium
SSPTG

SEQ ID NO: 1227987 - protein, 7 aa, Mycobacterium
SSPTNRV

SEQ ID NO: 1227988 - protein, 17 aa, Mycobacterium
SSPTPADAHKLTGETRA

SEQ ID NO: 1227989 - protein, 13 aa, Mycobacterium
SSPVGRSADVEPG

SEQ ID NO: 1227990 - protein, 6 aa, Mycobacterium
SSPVPM

SEQ ID NO: 1227991 - protein, 16 aa, Mycobacterium
SSPWHGPPRHADHAEA

SEQ ID NO: 1227992 - protein, 5 aa, Mycobacterium
SSPYQ

SEQ ID NO: 1227993 - protein, 15 aa, Mycobacterium
SSPYWDGEDTGYASN

SEQ ID NO: 1227994 - protein, 9 aa, Mycobacterium
SSQFANPNE

SEQ ID NO: 1227995 - protein, 17 aa, Mycobacterium
SSQGGRTSFPGVSTYSA

SEQ ID NO: 1227996 - protein, 9 aa, Mycobacterium
SSQGVRPDR

SEQ ID NO: 1227997 - protein, 6 aa, Mycobacterium
SSQPGD

SEQ ID NO: 1227998 - protein, 15 aa, Mycobacterium
SSQQAEIDTMQGMLD

SEQ ID NO: 1227999 - protein, 5 aa, Mycobacterium
SSQRL

SEQ ID NO: 1228000 - protein, 15 aa, Mycobacterium
SSRAELGRRMDRAGE

SEQ ID NO: 1228001 - protein, 17 aa, Mycobacterium
SSRDAAAATFEAGPDGL

SEQ ID NO: 1228002 - protein, 4 aa, Mycobacterium
SSRE

SEQ ID NO: 1228003 - protein, 24 aa, Mycobacterium
SSRELTRRAGAGLRARGSAPRLAQ

SEQ ID NO: 1228004 - protein, 8 aa, Mycobacterium
SSRGGQGL

SEQ ID NO: 1228005 - protein, 12 aa, Mycobacterium
SSRIEGIGRPRV

SEQ ID NO: 1228006 - protein, 6 aa, Mycobacterium
SSRKRS

SEQ ID NO: 1228007 - protein, 21 aa, Mycobacterium
SSRPAALERRGLGPADVPARR

SEQ ID NO: 1228008 - protein, 13 aa, Mycobacterium
SSRPAAPEVRTSR

SEQ ID NO: 1228009 - protein, 8 aa, Mycobacterium
SSRPDTDE

SEQ ID NO: 1228010 - protein, 5 aa, Mycobacterium
SSRPE

SEQ ID NO: 1228011 - protein, 7 aa, Mycobacterium
SSRPERI

SEQ ID NO: 1228012 - protein, 7 aa, Mycobacterium
SSRPEVR

SEQ ID NO: 1228013 - protein, 5 aa, Mycobacterium
SSRPL

SEQ ID NO: 1228014 - protein, 6 aa, Mycobacterium
SSRQKL

SEQ ID NO: 1228015 - protein, 6 aa, Mycobacterium
SSRQQI

SEQ ID NO: 1228016 - protein, 4 aa, Mycobacterium
SSRR

SEQ ID NO: 1228017 - protein, 15 aa, Mycobacterium
SSRRTSGNQRRYARD

SEQ ID NO: 1228018 - protein, 4 aa, Mycobacterium
SSRS

SEQ ID NO: 1228019 - protein, 6 aa, Mycobacterium
SSRSNE

SEQ ID NO: 1228020 - protein, 8 aa, Mycobacterium
SSRTDSAV

SEQ ID NO: 1228021 - protein, 12 aa, Mycobacterium
SSRTRRPNSCGT

SEQ ID NO: 1228022 - protein, 8 aa, Mycobacterium
SSRVPSGM

SEQ ID NO: 1228023 - protein, 23 aa, Mycobacterium
SSSAGLKGTGTDRAGGQAYTAAK

SEQ ID NO: 1228024 - protein, 7 aa, Mycobacterium
SSSANTR

SEQ ID NO: 1228025 - protein, 15 aa, Mycobacterium
SSSAPPESKTEGDAY

SEQ ID NO: 1228026 - protein, 6 aa, Mycobacterium
SSSEVQ

SEQ ID NO: 1228027 - protein, 9 aa, Mycobacterium
SSSEYQPCA

SEQ ID NO: 1228028 - protein, 10 aa, Mycobacterium
SSSGATSVRC

SEQ ID NO: 1228029 - protein, 5 aa, Mycobacterium
SSSGH

SEQ ID NO: 1228030 - protein, 8 aa, Mycobacterium
SSSGPELD

SEQ ID NO: 1228031 - protein, 9 aa, Mycobacterium
SSSHPAASL

SEQ ID NO: 1228032 - protein, 12 aa, Mycobacterium
SSSIEYADQTDE

SEQ ID NO: 1228033 - protein, 14 aa, Mycobacterium
SSSKVAKTAAATFE

SEQ ID NO: 1228034 - protein, 30 aa, Mycobacterium
SSSMGGLGGAPGAASAAPLTGTPVATPGLA

SEQ ID NO: 1228035 - protein, 5 aa, Mycobacterium
SSSMP

SEQ ID NO: 1228036 - protein, 12 aa, Mycobacterium
SSSQSTTGTAQI

SEQ ID NO: 1228037 - protein, 4 aa, Mycobacterium
SSSR

SEQ ID NO: 1228038 - protein, 12 aa, Mycobacterium
SSSRVEDNVGAP

SEQ ID NO: 1228039 - protein, 11 aa, Mycobacterium
SSSSTHSGQPY

SEQ ID NO: 1228040 - protein, 4 aa, Mycobacterium
SSST

SEQ ID NO: 1228041 - protein, 6 aa, Mycobacterium
SSSTPM

SEQ ID NO: 1228042 - protein, 16 aa, Mycobacterium
SSSTRRTSSMPKTTTG

SEQ ID NO: 1228043 - protein, 16 aa, Mycobacterium
SSSVDPHDFEPAPKDA

SEQ ID NO: 1228044 - protein, 6 aa, Mycobacterium
SSSVDV

SEQ ID NO: 1228045 - protein, 8 aa, Mycobacterium
SSSVPDGW

SEQ ID NO: 1228046 - protein, 4 aa, Mycobacterium
SSSY

SEQ ID NO: 1228047 - protein, 7 aa, Mycobacterium
SSTEEED

SEQ ID NO: 1228048 - protein, 6 aa, Mycobacterium
SSTFQA

SEQ ID NO: 1228049 - protein, 8 aa, Mycobacterium
SSTGRPGI

SEQ ID NO: 1228050 - protein, 6 aa, Mycobacterium
SSTGVP

SEQ ID NO: 1228051 - protein, 9 aa, Mycobacterium
SSTNPYPAV

SEQ ID NO: 1228052 - protein, 5 aa, Mycobacterium
SSTQV

SEQ ID NO: 1228053 - protein, 13 aa, Mycobacterium
SSTRPGGRGPLGA

SEQ ID NO: 1228054 - protein, 8 aa, Mycobacterium
SSTSAADI

SEQ ID NO: 1228055 - protein, 4 aa, Mycobacterium
SSTV

SEQ ID NO: 1228056 - protein, 6 aa, Mycobacterium
SSTVAR

SEQ ID NO: 1228057 - protein, 6 aa, Mycobacterium
SSTVGT

SEQ ID NO: 1228058 - protein, 8 aa, Mycobacterium
SSTVPGVG

SEQ ID NO: 1228059 - protein, 4 aa, Mycobacterium
SSVA

SEQ ID NO: 1228060 - protein, 10 aa, Mycobacterium
SSVDPDQASR

SEQ ID NO: 1228061 - protein, 12 aa, Mycobacterium
SSVGATATSVAA

SEQ ID NO: 1228062 - protein, 6 aa, Mycobacterium
SSVGGL

SEQ ID NO: 1228063 - protein, 4 aa, Mycobacterium
SSVP

SEQ ID NO: 1228064 - protein, 5 aa, Mycobacterium
SSVSH

SEQ ID NO: 1228065 - protein, 4 aa, Mycobacterium
SSVT

SEQ ID NO: 1228066 - protein, 14 aa, Mycobacterium
SSVYTPPAKELFGI

SEQ ID NO: 1228067 - protein, 6 aa, Mycobacterium
SSWEDY

SEQ ID NO: 1228068 - protein, 7 aa, Mycobacterium
SSWEQTS

SEQ ID NO: 1228069 - protein, 5 aa, Mycobacterium
SSYAE

SEQ ID NO: 1228070 - protein, 21 aa, Mycobacterium
SSYAPQPIALPDGSVKASTKF

SEQ ID NO: 1228071 - protein, 4 aa, Mycobacterium
SSYD

SEQ ID NO: 1228072 - protein, 5 aa, Mycobacterium
SSYDT

SEQ ID NO: 1228073 - protein, 4 aa, Mycobacterium
SSYQ

SEQ ID NO: 1228074 - protein, 8 aa, Mycobacterium
SSYQRGAP

SEQ ID NO: 1228075 - protein, 7 aa, Mycobacterium
STAAADL

SEQ ID NO: 1228076 - protein, 7 aa, Mycobacterium
STAAEVA

SEQ ID NO: 1228077 - protein, 6 aa, Mycobacterium
STAAPV

SEQ ID NO: 1228078 - protein, 12 aa, Mycobacterium
STAAQQAGGGRA

SEQ ID NO: 1228079 - protein, 6 aa, Mycobacterium
STAATV

SEQ ID NO: 1228080 - protein, 8 aa, Mycobacterium
STADANVG

SEQ ID NO: 1228081 - protein, 6 aa, Mycobacterium
STADEF

SEQ ID NO: 1228082 - protein, 8 aa, Mycobacterium
STADGDEL

SEQ ID NO: 1228083 - protein, 7 aa, Mycobacterium
STAEREK

SEQ ID NO: 1228084 - protein, 5 aa, Mycobacterium
STAEV

SEQ ID NO: 1228085 - protein, 9 aa, Mycobacterium
STAGDGATA

SEQ ID NO: 1228086 - protein, 12 aa, Mycobacterium
STAGGAGPQPDV

SEQ ID NO: 1228087 - protein, 5 aa, Mycobacterium
STAGI

SEQ ID NO: 1228088 - protein, 6 aa, Mycobacterium
STAGLR

SEQ ID NO: 1228089 - protein, 9 aa, Mycobacterium
STAGPSAIR

SEQ ID NO: 1228090 - protein, 8 aa, Mycobacterium
STAGQDGD

SEQ ID NO: 1228091 - protein, 7 aa, Mycobacterium
STAGTGY

SEQ ID NO: 1228092 - protein, 16 aa, Mycobacterium
STAGVPDALGRERSGV

SEQ ID NO: 1228093 - protein, 10 aa, Mycobacterium
STAGVTTSDE

SEQ ID NO: 1228094 - protein, 11 aa, Mycobacterium
STAKSAGVLTG

SEQ ID NO: 1228095 - protein, 11 aa, Mycobacterium
STAKSRDGWES

SEQ ID NO: 1228096 - protein, 13 aa, Mycobacterium
STAPCGSPSQSTF

SEQ ID NO: 1228097 - protein, 8 aa, Mycobacterium
STAPEPRW

SEQ ID NO: 1228098 - protein, 7 aa, Mycobacterium
STARLAQ

SEQ ID NO: 1228099 - protein, 13 aa, Mycobacterium
STARLRPAPRRDT

SEQ ID NO: 1228100 - protein, 24 aa, Mycobacterium
STARPATIHSQRGDFGSSGGGGSE

SEQ ID NO: 1228101 - protein, 13 aa, Mycobacterium
STARSDLRKGLRG

SEQ ID NO: 1228102 - protein, 6 aa, Mycobacterium
STASDG

SEQ ID NO: 1228103 - protein, 7 aa, Mycobacterium
STATGYG

SEQ ID NO: 1228104 - protein, 6 aa, Mycobacterium
STAYER

SEQ ID NO: 1228105 - protein, 5 aa, Mycobacterium
STDAA

SEQ ID NO: 1228106 - protein, 4 aa, Mycobacterium
STDD

SEQ ID NO: 1228107 - protein, 14 aa, Mycobacterium
STDDLAERSDNALD

SEQ ID NO: 1228108 - protein, 6 aa, Mycobacterium
STDDVT

SEQ ID NO: 1228109 - protein, 11 aa, Mycobacterium
STDEDPTRVED

SEQ ID NO: 1228110 - protein, 7 aa, Mycobacterium
STDEEAA

SEQ ID NO: 1228111 - protein, 6 aa, Mycobacterium
STDEPL

SEQ ID NO: 1228112 - protein, 6 aa, Mycobacterium
STDEPV

SEQ ID NO: 1228113 - protein, 7 aa, Mycobacterium
STDESPV

SEQ ID NO: 1228114 - protein, 28 aa, Mycobacterium
STDETLRRARDHGAQVQREPYENYGARN

SEQ ID NO: 1228115 - protein, 12 aa, Mycobacterium
STDGTRSNWDPQ

SEQ ID NO: 1228116 - protein, 4 aa, Mycobacterium
STDH

SEQ ID NO: 1228117 - protein, 14 aa, Mycobacterium
STDHTGDRAVAGAP

SEQ ID NO: 1228118 - protein, 6 aa, Mycobacterium
STDLPG

SEQ ID NO: 1228119 - protein, 6 aa, Mycobacterium
STDPDR

SEQ ID NO: 1228120 - protein, 7 aa, Mycobacterium
STDPKQL

SEQ ID NO: 1228121 - protein, 8 aa, Mycobacterium
STDPNAIP

SEQ ID NO: 1228122 - protein, 6 aa, Mycobacterium
STDPRL

SEQ ID NO: 1228123 - protein, 7 aa, Mycobacterium
STDPVGQ

SEQ ID NO: 1228124 - protein, 8 aa, Mycobacterium
STDQVTSG

SEQ ID NO: 1228125 - protein, 9 aa, Mycobacterium
STDSGPATA

SEQ ID NO: 1228126 - protein, 7 aa, Mycobacterium
STDSSGN

SEQ ID NO: 1228127 - protein, 10 aa, Mycobacterium
STDTARAEKV

SEQ ID NO: 1228128 - protein, 7 aa, Mycobacterium
STDTDGA

SEQ ID NO: 1228129 - protein, 8 aa, Mycobacterium
STEAPKEF

SEQ ID NO: 1228130 - protein, 13 aa, Mycobacterium
STEARVSGDPDRM

SEQ ID NO: 1228131 - protein, 7 aa, Mycobacterium
STEDGTG

SEQ ID NO: 1228132 - protein, 5 aa, Mycobacterium
STEEF

SEQ ID NO: 1228133 - protein, 17 aa, Mycobacterium
STENTPEPAARVPNEPV

SEQ ID NO: 1228134 - protein, 24 aa, Mycobacterium
STEPGLQGDRSSAGTKPATLETGA

SEQ ID NO: 1228135 - protein, 7 aa, Mycobacterium
STEPIDD

SEQ ID NO: 1228136 - protein, 7 aa, Mycobacterium
STEPNPA

SEQ ID NO: 1228137 - protein, 4 aa, Mycobacterium
STEQ

SEQ ID NO: 1228138 - protein, 8 aa, Mycobacterium
STEQHGPH

SEQ ID NO: 1228139 - protein, 17 aa, Mycobacterium
STEQSAQLKAALLKGRR

SEQ ID NO: 1228140 - protein, 17 aa, Mycobacterium
STEQSAQLKAALRKGRR

SEQ ID NO: 1228141 - protein, 8 aa, Mycobacterium
STEQTSTF

SEQ ID NO: 1228142 - protein, 13 aa, Mycobacterium
STESDRARPELDG

SEQ ID NO: 1228143 - protein, 5 aa, Mycobacterium
STFGA

SEQ ID NO: 1228144 - protein, 6 aa, Mycobacterium
STFPDK

SEQ ID NO: 1228145 - protein, 11 aa, Mycobacterium
STGAAPTVPGA

SEQ ID NO: 1228146 - protein, 11 aa, Mycobacterium
STGAPPAGVPG

SEQ ID NO: 1228147 - protein, 16 aa, Mycobacterium
STGDGRWGATSAPRSY

SEQ ID NO: 1228148 - protein, 23 aa, Mycobacterium
STGDLASALTASDHAGTGASMSA

SEQ ID NO: 1228149 - protein, 14 aa, Mycobacterium
STGDRLGRIDPDAT

SEQ ID NO: 1228150 - protein, 13 aa, Mycobacterium
STGDVVNVNSGAV

SEQ ID NO: 1228151 - protein, 4 aa, Mycobacterium
STGE

SEQ ID NO: 1228152 - protein, 14 aa, Mycobacterium
STGERRWTSAPMPA

SEQ ID NO: 1228153 - protein, 16 aa, Mycobacterium
STGGAPGSGSTGSSAL

SEQ ID NO: 1228154 - protein, 8 aa, Mycobacterium
STGGGQLN

SEQ ID NO: 1228155 - protein, 6 aa, Mycobacterium
STGGNI

SEQ ID NO: 1228156 - protein, 10 aa, Mycobacterium
STGGPNSERN

SEQ ID NO: 1228157 - protein, 7 aa, Mycobacterium
STGGSTE

SEQ ID NO: 1228158 - protein, 12 aa, Mycobacterium
STGGWDSAGHPV

SEQ ID NO: 1228159 - protein, 10 aa, Mycobacterium
STGHRPRTEQ

SEQ ID NO: 1228160 - protein, 5 aa, Mycobacterium
STGIA

SEQ ID NO: 1228161 - protein, 8 aa, Mycobacterium
STGKADAH

SEQ ID NO: 1228162 - protein, 5 aa, Mycobacterium
STGLG

SEQ ID NO: 1228163 - protein, 5 aa, Mycobacterium
STGNM

SEQ ID NO: 1228164 - protein, 6 aa, Mycobacterium
STGNTM

SEQ ID NO: 1228165 - protein, 7 aa, Mycobacterium
STGPAEI

SEQ ID NO: 1228166 - protein, 9 aa, Mycobacterium
STGPDHDKE

SEQ ID NO: 1228167 - protein, 8 aa, Mycobacterium
STGPTTRE

SEQ ID NO: 1228168 - protein, 13 aa, Mycobacterium
STGQGLKPPTENP

SEQ ID NO: 1228169 - protein, 9 aa, Mycobacterium
STGQKCTAT

SEQ ID NO: 1228170 - protein, 10 aa, Mycobacterium
STGQPPSTAD

SEQ ID NO: 1228171 - protein, 4 aa, Mycobacterium
STGR

SEQ ID NO: 1228172 - protein, 9 aa, Mycobacterium
STGRATGEW

SEQ ID NO: 1228173 - protein, 6 aa, Mycobacterium
STGRLP

SEQ ID NO: 1228174 - protein, 6 aa, Mycobacterium
STGRPF

SEQ ID NO: 1228175 - protein, 9 aa, Mycobacterium
STGRTPVAP

SEQ ID NO: 1228176 - protein, 10 aa, Mycobacterium
STGSEVTGAD

SEQ ID NO: 1228177 - protein, 6 aa, Mycobacterium
STGSID

SEQ ID NO: 1228178 - protein, 5 aa, Mycobacterium
STGSP

SEQ ID NO: 1228179 - protein, 16 aa, Mycobacterium
STGSTAKTIADKGIPV

SEQ ID NO: 1228180 - protein, 12 aa, Mycobacterium
STGSTAKTIAGA

SEQ ID NO: 1228181 - protein, 14 aa, Mycobacterium
STGTMDSDRTKKEQ

SEQ ID NO: 1228182 - protein, 18 aa, Mycobacterium
STGTSGTGADVDKVRKAT

SEQ ID NO: 1228183 - protein, 5 aa, Mycobacterium
STGVD

SEQ ID NO: 1228184 - protein, 10 aa, Mycobacterium
STGVRADGDG

SEQ ID NO: 1228185 - protein, 5 aa, Mycobacterium
STGWF

SEQ ID NO: 1228186 - protein, 4 aa, Mycobacterium
STHG

SEQ ID NO: 1228187 - protein, 4 aa, Mycobacterium
STHP

SEQ ID NO: 1228188 - protein, 6 aa, Mycobacterium
STHRNR

SEQ ID NO: 1228189 - protein, 9 aa, Mycobacterium
STHRTRRRA

SEQ ID NO: 1228190 - protein, 11 aa, Mycobacterium
STHSEDEPTTL

SEQ ID NO: 1228191 - protein, 7 aa, Mycobacterium
STHVQSV

SEQ ID NO: 1228192 - protein, 8 aa, Mycobacterium
STIPPADL

SEQ ID NO: 1228193 - protein, 11 aa, Mycobacterium
STIRKGRRVSA

SEQ ID NO: 1228194 - protein, 14 aa, Mycobacterium
STITVPGASPEHHH

SEQ ID NO: 1228195 - protein, 8 aa, Mycobacterium
STKEEKAA

SEQ ID NO: 1228196 - protein, 6 aa, Mycobacterium
STKEGF

SEQ ID NO: 1228197 - protein, 16 aa, Mycobacterium
STKELGVDPEKVNVNG

SEQ ID NO: 1228198 - protein, 5 aa, Mycobacterium
STKGD

SEQ ID NO: 1228199 - protein, 14 aa, Mycobacterium
STKSMPHPESGPVS

SEQ ID NO: 1228200 - protein, 11 aa, Mycobacterium
STKSRNEARAK

SEQ ID NO: 1228201 - protein, 13 aa, Mycobacterium
STKTKPNPVSGEV

SEQ ID NO: 1228202 - protein, 5 aa, Mycobacterium
STKVR

SEQ ID NO: 1228203 - protein, 16 aa, Mycobacterium
STLASHGVQPTADRRE

SEQ ID NO: 1228204 - protein, 7 aa, Mycobacterium
STLATQR

SEQ ID NO: 1228205 - protein, 10 aa, Mycobacterium
STLDRGTRLR

SEQ ID NO: 1228206 - protein, 16 aa, Mycobacterium
STLDVSDTASDADGVS

SEQ ID NO: 1228207 - protein, 7 aa, Mycobacterium
STLPDAI

SEQ ID NO: 1228208 - protein, 6 aa, Mycobacterium
STLPDE

SEQ ID NO: 1228209 - protein, 8 aa, Mycobacterium
STLPTPAL

SEQ ID NO: 1228210 - protein, 24 aa, Mycobacterium
STLRNDRPGRQGDYENLATGPQRT

SEQ ID NO: 1228211 - protein, 4 aa, Mycobacterium
STLS

SEQ ID NO: 1228212 - protein, 8 aa, Mycobacterium
STMTDAKG

SEQ ID NO: 1228213 - protein, 7 aa, Mycobacterium
STNGAKL

SEQ ID NO: 1228214 - protein, 18 aa, Mycobacterium
STNNNDAAKFDPGTVTPD

SEQ ID NO: 1228215 - protein, 9 aa, Mycobacterium
STNPDAGGA

SEQ ID NO: 1228216 - protein, 19 aa, Mycobacterium
STNPRPADEAQMHALFRAA

SEQ ID NO: 1228217 - protein, 5 aa, Mycobacterium
STNRE

SEQ ID NO: 1228218 - protein, 6 aa, Mycobacterium
STNYTT

SEQ ID NO: 1228219 - protein, 4 aa, Mycobacterium
STPA

SEQ ID NO: 1228220 - protein, 17 aa, Mycobacterium
STPAATAAMAGALRTVM

SEQ ID NO: 1228221 - protein, 18 aa, Mycobacterium
STPAGGGTQAQARNDADV

SEQ ID NO: 1228222 - protein, 6 aa, Mycobacterium
STPAGM

SEQ ID NO: 1228223 - protein, 10 aa, Mycobacterium
STPAPGEPLT

SEQ ID NO: 1228224 - protein, 11 aa, Mycobacterium
STPDGRQQARD

SEQ ID NO: 1228225 - protein, 8 aa, Mycobacterium
STPDTNKD

SEQ ID NO: 1228226 - protein, 13 aa, Mycobacterium
STPEEVARQAADN

SEQ ID NO: 1228227 - protein, 5 aa, Mycobacterium
STPEH

SEQ ID NO: 1228228 - protein, 16 aa, Mycobacterium
STPESLAATKAMGKSF

SEQ ID NO: 1228229 - protein, 6 aa, Mycobacterium
STPGQY

SEQ ID NO: 1228230 - protein, 20 aa, Mycobacterium
STPHGVKPGLNKAAEASSRT

SEQ ID NO: 1228231 - protein, 4 aa, Mycobacterium
STPI

SEQ ID NO: 1228232 - protein, 6 aa, Mycobacterium
STPLDR

SEQ ID NO: 1228233 - protein, 20 aa, Mycobacterium
STPPPVGPVDASKTPRFAGP

SEQ ID NO: 1228234 - protein, 7 aa, Mycobacterium
STPQPAC

SEQ ID NO: 1228235 - protein, 11 aa, Mycobacterium
STPSGDLRGEV

SEQ ID NO: 1228236 - protein, 6 aa, Mycobacterium
STPSGP

SEQ ID NO: 1228237 - protein, 6 aa, Mycobacterium
STPTDN

SEQ ID NO: 1228238 - protein, 5 aa, Mycobacterium
STPTW

SEQ ID NO: 1228239 - protein, 11 aa, Mycobacterium
STPVIDGDPTG

SEQ ID NO: 1228240 - protein, 17 aa, Mycobacterium
STPYGIATSDEPNISST

SEQ ID NO: 1228241 - protein, 5 aa, Mycobacterium
STPYL

SEQ ID NO: 1228242 - protein, 10 aa, Mycobacterium
STPYPTGENF

SEQ ID NO: 1228243 - protein, 8 aa, Mycobacterium
STQDPEEG

SEQ ID NO: 1228244 - protein, 14 aa, Mycobacterium
STQELGVDPERVNV

SEQ ID NO: 1228245 - protein, 7 aa, Mycobacterium
STQNANS

SEQ ID NO: 1228246 - protein, 4 aa, Mycobacterium
STQP

SEQ ID NO: 1228247 - protein, 13 aa, Mycobacterium
STQPGPRPGGKDI

SEQ ID NO: 1228248 - protein, 5 aa, Mycobacterium
STRDH

SEQ ID NO: 1228249 - protein, 6 aa, Mycobacterium
STRESI

SEQ ID NO: 1228250 - protein, 6 aa, Mycobacterium
STRGRP

SEQ ID NO: 1228251 - protein, 16 aa, Mycobacterium
STRKPASSLADSLTPA

SEQ ID NO: 1228252 - protein, 6 aa, Mycobacterium
STRPDA

SEQ ID NO: 1228253 - protein, 10 aa, Mycobacterium
STRPDHRQKA

SEQ ID NO: 1228254 - protein, 15 aa, Mycobacterium
STRPYPGDHPVQGTE

SEQ ID NO: 1228255 - protein, 8 aa, Mycobacterium
STRRQGAC

SEQ ID NO: 1228256 - protein, 6 aa, Mycobacterium
STRSLQ

SEQ ID NO: 1228257 - protein, 5 aa, Mycobacterium
STRSV

SEQ ID NO: 1228258 - protein, 14 aa, Mycobacterium
STSAARAVAKASQR

SEQ ID NO: 1228259 - protein, 5 aa, Mycobacterium
STSAE

SEQ ID NO: 1228260 - protein, 8 aa, Mycobacterium
STSAGAEM

SEQ ID NO: 1228261 - protein, 5 aa, Mycobacterium
STSAQ

SEQ ID NO: 1228262 - protein, 6 aa, Mycobacterium
STSESY

SEQ ID NO: 1228263 - protein, 10 aa, Mycobacterium
STSGLGTGEV

SEQ ID NO: 1228264 - protein, 11 aa, Mycobacterium
STSGPADESSG

SEQ ID NO: 1228265 - protein, 9 aa, Mycobacterium
STSGTGADV

SEQ ID NO: 1228266 - protein, 8 aa, Mycobacterium
STSGVKRD

SEQ ID NO: 1228267 - protein, 9 aa, Mycobacterium
STSGYYAGR

SEQ ID NO: 1228268 - protein, 11 aa, Mycobacterium
STSLSTRVEPE

SEQ ID NO: 1228269 - protein, 16 aa, Mycobacterium
STSNGVSLTGTAGITP

SEQ ID NO: 1228270 - protein, 17 aa, Mycobacterium
STSNGVSLTGTAGLNPS

SEQ ID NO: 1228271 - protein, 9 aa, Mycobacterium
STSPAGRGG

SEQ ID NO: 1228272 - protein, 19 aa, Mycobacterium
STSPEAVNADPRPNTPGRC

SEQ ID NO: 1228273 - protein, 19 aa, Mycobacterium
STSPEAVNAHPRPNTPGRC

SEQ ID NO: 1228274 - protein, 13 aa, Mycobacterium
STSQRLKAGDRAG

SEQ ID NO: 1228275 - protein, 14 aa, Mycobacterium
STSRKLDKAASKGV

SEQ ID NO: 1228276 - protein, 12 aa, Mycobacterium
STSRPGSSFGAK

SEQ ID NO: 1228277 - protein, 10 aa, Mycobacterium
STSRTEAHRA

SEQ ID NO: 1228278 - protein, 9 aa, Mycobacterium
STSSPVPPG

SEQ ID NO: 1228279 - protein, 12 aa, Mycobacterium
STSTDLTGEGRA

SEQ ID NO: 1228280 - protein, 16 aa, Mycobacterium
STSTLNPYTNPDGALA

SEQ ID NO: 1228281 - protein, 5 aa, Mycobacterium
STTAD

SEQ ID NO: 1228282 - protein, 11 aa, Mycobacterium
STTAHRSQASG

SEQ ID NO: 1228283 - protein, 25 aa, Mycobacterium
STTAPDRKDDDPPPNDDAPQRSSAP

SEQ ID NO: 1228284 - protein, 8 aa, Mycobacterium
STTDFTEA

SEQ ID NO: 1228285 - protein, 8 aa, Mycobacterium
STTDGFPS

SEQ ID NO: 1228286 - protein, 6 aa, Mycobacterium
STTDLD

SEQ ID NO: 1228287 - protein, 6 aa, Mycobacterium
STTDLG

SEQ ID NO: 1228288 - protein, 9 aa, Mycobacterium
STTEGGLAR

SEQ ID NO: 1228289 - protein, 10 aa, Mycobacterium
STTELPIESP

SEQ ID NO: 1228290 - protein, 12 aa, Mycobacterium
STTGAPEVGAAH

SEQ ID NO: 1228291 - protein, 5 aa, Mycobacterium
STTGF

SEQ ID NO: 1228292 - protein, 10 aa, Mycobacterium
STTGGQPVGT

SEQ ID NO: 1228293 - protein, 13 aa, Mycobacterium
STTGQSSAVETPT

SEQ ID NO: 1228294 - protein, 5 aa, Mycobacterium
STTGT

SEQ ID NO: 1228295 - protein, 4 aa, Mycobacterium
STTH

SEQ ID NO: 1228296 - protein, 19 aa, Mycobacterium
STTHQQLSAEEQLASGVTP

SEQ ID NO: 1228297 - protein, 6 aa, Mycobacterium
STTIDD

SEQ ID NO: 1228298 - protein, 13 aa, Mycobacterium
STTITTRNAPSVT

SEQ ID NO: 1228299 - protein, 10 aa, Mycobacterium
STTIYGGTSE

SEQ ID NO: 1228300 - protein, 12 aa, Mycobacterium
STTMDPAPPPMD

SEQ ID NO: 1228301 - protein, 5 aa, Mycobacterium
STTNE

SEQ ID NO: 1228302 - protein, 9 aa, Mycobacterium
STTPEAALP

SEQ ID NO: 1228303 - protein, 8 aa, Mycobacterium
STTQGTNA

SEQ ID NO: 1228304 - protein, 12 aa, Mycobacterium
STTRGGQAAPNA

SEQ ID NO: 1228305 - protein, 12 aa, Mycobacterium
STTSGAIRSDQV

SEQ ID NO: 1228306 - protein, 6 aa, Mycobacterium
STTSLS

SEQ ID NO: 1228307 - protein, 12 aa, Mycobacterium
STTSPESLGGGG

SEQ ID NO: 1228308 - protein, 9 aa, Mycobacterium
STTSQATTL

SEQ ID NO: 1228309 - protein, 6 aa, Mycobacterium
STTSVT

SEQ ID NO: 1228310 - protein, 6 aa, Mycobacterium
STTTDE

SEQ ID NO: 1228311 - protein, 20 aa, Mycobacterium
STTTGPGIPVDPSITRNFTE

SEQ ID NO: 1228312 - protein, 6 aa, Mycobacterium
STTTIE

SEQ ID NO: 1228313 - protein, 7 aa, Mycobacterium
STTVDTH

SEQ ID NO: 1228314 - protein, 5 aa, Mycobacterium
STVAE

SEQ ID NO: 1228315 - protein, 7 aa, Mycobacterium
STVDPDR

SEQ ID NO: 1228316 - protein, 14 aa, Mycobacterium
STVEAQDRAGTDVA

SEQ ID NO: 1228317 - protein, 6 aa, Mycobacterium
STVENE

SEQ ID NO: 1228318 - protein, 12 aa, Mycobacterium
STVGAGDSSLAG

SEQ ID NO: 1228319 - protein, 12 aa, Mycobacterium
STVGEAAYAAKN

SEQ ID NO: 1228320 - protein, 5 aa, Mycobacterium
STVGT

SEQ ID NO: 1228321 - protein, 6 aa, Mycobacterium
STVGTA

SEQ ID NO: 1228322 - protein, 6 aa, Mycobacterium
STVNGM

SEQ ID NO: 1228323 - protein, 5 aa, Mycobacterium
STVNS

SEQ ID NO: 1228324 - protein, 11 aa, Mycobacterium
STVQAADRQRI

SEQ ID NO: 1228325 - protein, 10 aa, Mycobacterium
STVSAKAAQQ

SEQ ID NO: 1228326 - protein, 10 aa, Mycobacterium
STVSEAGPAL

SEQ ID NO: 1228327 - protein, 8 aa, Mycobacterium
STVSGADA

SEQ ID NO: 1228328 - protein, 4 aa, Mycobacterium
STWA

SEQ ID NO: 1228329 - protein, 13 aa, Mycobacterium
STYAGHQERDGLN

SEQ ID NO: 1228330 - protein, 11 aa, Mycobacterium
STYEKQNAEEV

SEQ ID NO: 1228331 - protein, 14 aa, Mycobacterium
STYGVPVDSPEGYK

SEQ ID NO: 1228332 - protein, 4 aa, Mycobacterium
STYK

SEQ ID NO: 1228333 - protein, 4 aa, Mycobacterium
STYS

SEQ ID NO: 1228334 - protein, 7 aa, Mycobacterium
SVAAGKA

SEQ ID NO: 1228335 - protein, 9 aa, Mycobacterium
SVADGNETV

SEQ ID NO: 1228336 - protein, 7 aa, Mycobacterium
SVADNGD

SEQ ID NO: 1228337 - protein, 9 aa, Mycobacterium
SVAEPEGAA

SEQ ID NO: 1228338 - protein, 6 aa, Mycobacterium
SVAGED

SEQ ID NO: 1228339 - protein, 7 aa, Mycobacterium
SVAGPRK

SEQ ID NO: 1228340 - protein, 7 aa, Mycobacterium
SVAGRDG

SEQ ID NO: 1228341 - protein, 4 aa, Mycobacterium
SVAN

SEQ ID NO: 1228342 - protein, 11 aa, Mycobacterium
SVANTGQVSSR

SEQ ID NO: 1228343 - protein, 5 aa, Mycobacterium
SVAPG

SEQ ID NO: 1228344 - protein, 12 aa, Mycobacterium
SVARGDRADAGR

SEQ ID NO: 1228345 - protein, 11 aa, Mycobacterium
SVARGGGRASY

SEQ ID NO: 1228346 - protein, 16 aa, Mycobacterium
SVASQRASSYSGHSPA

SEQ ID NO: 1228347 - protein, 8 aa, Mycobacterium
SVATPEQL

SEQ ID NO: 1228348 - protein, 7 aa, Mycobacterium
SVDADER

SEQ ID NO: 1228349 - protein, 15 aa, Mycobacterium
SVDAPGYPVTVRRRP

SEQ ID NO: 1228350 - protein, 9 aa, Mycobacterium
SVDDRREGF

SEQ ID NO: 1228351 - protein, 5 aa, Mycobacterium
SVDEE

SEQ ID NO: 1228352 - protein, 5 aa, Mycobacterium
SVDET

SEQ ID NO: 1228353 - protein, 15 aa, Mycobacterium
SVDGPVPNYPAPDGV

SEQ ID NO: 1228354 - protein, 4 aa, Mycobacterium
SVDP

SEQ ID NO: 1228355 - protein, 9 aa, Mycobacterium
SVDPESKSV

SEQ ID NO: 1228356 - protein, 7 aa, Mycobacterium
SVDPSGK

SEQ ID NO: 1228357 - protein, 6 aa, Mycobacterium
SVDRGQ

SEQ ID NO: 1228358 - protein, 6 aa, Mycobacterium
SVDRPA

SEQ ID NO: 1228359 - protein, 8 aa, Mycobacterium
SVDSGDPV

SEQ ID NO: 1228360 - protein, 14 aa, Mycobacterium
SVDTLTPAPQDGSV

SEQ ID NO: 1228361 - protein, 4 aa, Mycobacterium
SVED

SEQ ID NO: 1228362 - protein, 4 aa, Mycobacterium
SVEE

SEQ ID NO: 1228363 - protein, 10 aa, Mycobacterium
SVEGDRSPRE

SEQ ID NO: 1228364 - protein, 7 aa, Mycobacterium
SVEGGKT

SEQ ID NO: 1228365 - protein, 6 aa, Mycobacterium
SVEGVP

SEQ ID NO: 1228366 - protein, 10 aa, Mycobacterium
SVEKDGSADL

SEQ ID NO: 1228367 - protein, 10 aa, Mycobacterium
SVEKDGSSDL

SEQ ID NO: 1228368 - protein, 5 aa, Mycobacterium
SVEPP

SEQ ID NO: 1228369 - protein, 15 aa, Mycobacterium
SVEPTAGRVKRGKTV

SEQ ID NO: 1228370 - protein, 4 aa, Mycobacterium
SVER

SEQ ID NO: 1228371 - protein, 8 aa, Mycobacterium
SVERGGKI

SEQ ID NO: 1228372 - protein, 5 aa, Mycobacterium
SVERS

SEQ ID NO: 1228373 - protein, 6 aa, Mycobacterium
SVESGL

SEQ ID NO: 1228374 - protein, 21 aa, Mycobacterium
SVETADQPKFAEDPTRDRRKR

SEQ ID NO: 1228375 - protein, 21 aa, Mycobacterium
SVGAEVTGLDPGRLAGDDALG

SEQ ID NO: 1228376 - protein, 5 aa, Mycobacterium
SVGAG

SEQ ID NO: 1228377 - protein, 16 aa, Mycobacterium
SVGAGSTGVDGRVGGR

SEQ ID NO: 1228378 - protein, 8 aa, Mycobacterium
SVGDPNAG

SEQ ID NO: 1228379 - protein, 8 aa, Mycobacterium
SVGEQRTR

SEQ ID NO: 1228380 - protein, 4 aa, Mycobacterium
SVGG

SEQ ID NO: 1228381 - protein, 12 aa, Mycobacterium
SVGGDHNPIHTN

SEQ ID NO: 1228382 - protein, 6 aa, Mycobacterium
SVGGQG

SEQ ID NO: 1228383 - protein, 7 aa, Mycobacterium
SVGGTKN

SEQ ID NO: 1228384 - protein, 8 aa, Mycobacterium
SVGGTPRF

SEQ ID NO: 1228385 - protein, 7 aa, Mycobacterium
SVGNGYP

SEQ ID NO: 1228386 - protein, 6 aa, Mycobacterium
SVGPAT

SEQ ID NO: 1228387 - protein, 10 aa, Mycobacterium
SVGPDALATG

SEQ ID NO: 1228388 - protein, 8 aa, Mycobacterium
SVGPGATN

SEQ ID NO: 1228389 - protein, 5 aa, Mycobacterium
SVGRA

SEQ ID NO: 1228390 - protein, 7 aa, Mycobacterium
SVGRGAR

SEQ ID NO: 1228391 - protein, 14 aa, Mycobacterium
SVGRNSGSPVSQAY

SEQ ID NO: 1228392 - protein, 13 aa, Mycobacterium
SVGRNSGSPVSRA

SEQ ID NO: 1228393 - protein, 11 aa, Mycobacterium
SVGSQGEENVS

SEQ ID NO: 1228394 - protein, 11 aa, Mycobacterium
SVGSQGQSNVS

SEQ ID NO: 1228395 - protein, 10 aa, Mycobacterium
SVGSQGRTNV

SEQ ID NO: 1228396 - protein, 9 aa, Mycobacterium
SVGSQGYAN

SEQ ID NO: 1228397 - protein, 10 aa, Mycobacterium
SVGTDSDLRV

SEQ ID NO: 1228398 - protein, 26 aa, Mycobacterium
SVGTMNSAGVTGSIGTAGSAAVAGSA

SEQ ID NO: 1228399 - protein, 6 aa, Mycobacterium
SVGTSN

SEQ ID NO: 1228400 - protein, 7 aa, Mycobacterium
SVGTVES

SEQ ID NO: 1228401 - protein, 6 aa, Mycobacterium
SVGVGS

SEQ ID NO: 1228402 - protein, 12 aa, Mycobacterium
SVIGTSSPRRAA

SEQ ID NO: 1228403 - protein, 19 aa, Mycobacterium
SVKAKDPATHDEAAAAELG

SEQ ID NO: 1228404 - protein, 13 aa, Mycobacterium
SVKPNTGHLEGGA

SEQ ID NO: 1228405 - protein, 10 aa, Mycobacterium
SVKYPPGDSY

SEQ ID NO: 1228406 - protein, 5 aa, Mycobacterium
SVLDA

SEQ ID NO: 1228407 - protein, 7 aa, Mycobacterium
SVLGPAG

SEQ ID NO: 1228408 - protein, 8 aa, Mycobacterium
SVLTDEAR

SEQ ID NO: 1228409 - protein, 8 aa, Mycobacterium
SVNAASDA

SEQ ID NO: 1228410 - protein, 13 aa, Mycobacterium
SVNDQDKRNVSHG

SEQ ID NO: 1228411 - protein, 11 aa, Mycobacterium
SVNESLDPRDP

SEQ ID NO: 1228412 - protein, 8 aa, Mycobacterium
SVNGHEGA

SEQ ID NO: 1228413 - protein, 11 aa, Mycobacterium
SVNRGAKDLSF

SEQ ID NO: 1228414 - protein, 7 aa, Mycobacterium
SVNRPTP

SEQ ID NO: 1228415 - protein, 4 aa, Mycobacterium
SVNT

SEQ ID NO: 1228416 - protein, 26 aa, Mycobacterium
SVNTANRPGKRKRTRTGFGQRKATKR

SEQ ID NO: 1228417 - protein, 27 aa, Mycobacterium
SVNTANRQGKRKRTRSGFGQRKSTKRA

SEQ ID NO: 1228418 - protein, 6 aa, Mycobacterium
SVPAEG

SEQ ID NO: 1228419 - protein, 10 aa, Mycobacterium
SVPAGDGSVE

SEQ ID NO: 1228420 - protein, 8 aa, Mycobacterium
SVPAGKLG

SEQ ID NO: 1228421 - protein, 7 aa, Mycobacterium
SVPDDEI

SEQ ID NO: 1228422 - protein, 5 aa, Mycobacterium
SVPDE

SEQ ID NO: 1228423 - protein, 11 aa, Mycobacterium
SVPDEEKGEAM

SEQ ID NO: 1228424 - protein, 12 aa, Mycobacterium
SVPDPAAQPSLT

SEQ ID NO: 1228425 - protein, 5 aa, Mycobacterium
SVPDT

SEQ ID NO: 1228426 - protein, 4 aa, Mycobacterium
SVPE

SEQ ID NO: 1228427 - protein, 7 aa, Mycobacterium
SVPGDRA

SEQ ID NO: 1228428 - protein, 13 aa, Mycobacterium
SVPGGVDKNLSRA

SEQ ID NO: 1228429 - protein, 6 aa, Mycobacterium
SVPGHP

SEQ ID NO: 1228430 - protein, 6 aa, Mycobacterium
SVPGNT

SEQ ID NO: 1228431 - protein, 8 aa, Mycobacterium
SVPNTKNL

SEQ ID NO: 1228432 - protein, 10 aa, Mycobacterium
SVPPPGGESF

SEQ ID NO: 1228433 - protein, 5 aa, Mycobacterium
SVPPQ

SEQ ID NO: 1228434 - protein, 15 aa, Mycobacterium
SVPRPREVYAARRRR

SEQ ID NO: 1228435 - protein, 5 aa, Mycobacterium
SVPYG

SEQ ID NO: 1228436 - protein, 5 aa, Mycobacterium
SVQEA

SEQ ID NO: 1228437 - protein, 8 aa, Mycobacterium
SVQPQRRP

SEQ ID NO: 1228438 - protein, 9 aa, Mycobacterium
SVQSGSPCG

SEQ ID NO: 1228439 - protein, 12 aa, Mycobacterium
SVRDEYNDYLDG

SEQ ID NO: 1228440 - protein, 6 aa, Mycobacterium
SVRKTG

SEQ ID NO: 1228441 - protein, 12 aa, Mycobacterium
SVRKTYGNRGPD

SEQ ID NO: 1228442 - protein, 8 aa, Mycobacterium
SVRPGAQQ

SEQ ID NO: 1228443 - protein, 12 aa, Mycobacterium
SVRPGPCATPAD

SEQ ID NO: 1228444 - protein, 10 aa, Mycobacterium
SVRRTTGPAR

SEQ ID NO: 1228445 - protein, 11 aa, Mycobacterium
SVRSATLNGTE

SEQ ID NO: 1228446 - protein, 10 aa, Mycobacterium
SVRTGRPRLD

SEQ ID NO: 1228447 - protein, 12 aa, Mycobacterium
SVRTGSKGRDSA

SEQ ID NO: 1228448 - protein, 10 aa, Mycobacterium
SVSDDEATTA

SEQ ID NO: 1228449 - protein, 9 aa, Mycobacterium
SVSDGAVGV

SEQ ID NO: 1228450 - protein, 9 aa, Mycobacterium
SVSDQPRPG

SEQ ID NO: 1228451 - protein, 9 aa, Mycobacterium
SVSGGNAAS

SEQ ID NO: 1228452 - protein, 7 aa, Mycobacterium
SVSGGSA

SEQ ID NO: 1228453 - protein, 10 aa, Mycobacterium
SVSGPSPEHV

SEQ ID NO: 1228454 - protein, 10 aa, Mycobacterium
SVSPAPGETV

SEQ ID NO: 1228455 - protein, 7 aa, Mycobacterium
SVSPNNP

SEQ ID NO: 1228456 - protein, 6 aa, Mycobacterium
SVSPPA

SEQ ID NO: 1228457 - protein, 5 aa, Mycobacterium
SVSQA

SEQ ID NO: 1228458 - protein, 14 aa, Mycobacterium
SVSRARTGTLDGDL

SEQ ID NO: 1228459 - protein, 7 aa, Mycobacterium
SVSRDAT

SEQ ID NO: 1228460 - protein, 11 aa, Mycobacterium
SVSRDGPSRAY

SEQ ID NO: 1228461 - protein, 10 aa, Mycobacterium
SVSTANPLAT

SEQ ID NO: 1228462 - protein, 17 aa, Mycobacterium
SVTADTARSTSSVKESR

SEQ ID NO: 1228463 - protein, 6 aa, Mycobacterium
SVTDEG

SEQ ID NO: 1228464 - protein, 7 aa, Mycobacterium
SVTEEYR

SEQ ID NO: 1228465 - protein, 8 aa, Mycobacterium
SVTGDGQV

SEQ ID NO: 1228466 - protein, 11 aa, Mycobacterium
SVTGETGSEAS

SEQ ID NO: 1228467 - protein, 19 aa, Mycobacterium
SVTGSERAGAAVAATAGRS

SEQ ID NO: 1228468 - protein, 7 aa, Mycobacterium
SVTGSVP

SEQ ID NO: 1228469 - protein, 19 aa, Mycobacterium
SVTINGRTVSTVSSAGPQW

SEQ ID NO: 1228470 - protein, 13 aa, Mycobacterium
SVTPATGDAEWPW

SEQ ID NO: 1228471 - protein, 8 aa, Mycobacterium
SVTPNPGA

SEQ ID NO: 1228472 - protein, 8 aa, Mycobacterium
SVTTTAST

SEQ ID NO: 1228473 - protein, 14 aa, Mycobacterium
SVTTTDHPDRDDAH

SEQ ID NO: 1228474 - protein, 5 aa, Mycobacterium
SVTVN

SEQ ID NO: 1228475 - protein, 4 aa, Mycobacterium
SVVE

SEQ ID NO: 1228476 - protein, 8 aa, Mycobacterium
SWAGPGTD

SEQ ID NO: 1228477 - protein, 9 aa, Mycobacterium
SWAQDAGGL

SEQ ID NO: 1228478 - protein, 6 aa, Mycobacterium
SWDDEH

SEQ ID NO: 1228479 - protein, 5 aa, Mycobacterium
SWEDY

SEQ ID NO: 1228480 - protein, 4 aa, Mycobacterium
SWGA

SEQ ID NO: 1228481 - protein, 9 aa, Mycobacterium
SWGATGPDA

SEQ ID NO: 1228482 - protein, 11 aa, Mycobacterium
SWGPQSEKKTF

SEQ ID NO: 1228483 - protein, 9 aa, Mycobacterium
SWKDSPPAE

SEQ ID NO: 1228484 - protein, 10 aa, Mycobacterium
SWPGANPRQA

SEQ ID NO: 1228485 - protein, 13 aa, Mycobacterium
SWPSTRTGSTGAL

SEQ ID NO: 1228486 - protein, 25 aa, Mycobacterium
SWPSTSPESWSDTASALSKKSADLS

SEQ ID NO: 1228487 - protein, 8 aa, Mycobacterium
SWSPDGRP

SEQ ID NO: 1228488 - protein, 5 aa, Mycobacterium
SWSPE

SEQ ID NO: 1228489 - protein, 9 aa, Mycobacterium
SWSPSGSNL

SEQ ID NO: 1228490 - protein, 7 aa, Mycobacterium
SYAAPQH

SEQ ID NO: 1228491 - protein, 9 aa, Mycobacterium
SYADGTAAV

SEQ ID NO: 1228492 - protein, 10 aa, Mycobacterium
SYAESDARVD

SEQ ID NO: 1228493 - protein, 8 aa, Mycobacterium
SYAGGGQV

SEQ ID NO: 1228494 - protein, 4 aa, Mycobacterium
SYAP

SEQ ID NO: 1228495 - protein, 13 aa, Mycobacterium
SYAPNLDGRADPG

SEQ ID NO: 1228496 - protein, 8 aa, Mycobacterium
SYASEPDA

SEQ ID NO: 1228497 - protein, 11 aa, Mycobacterium
SYASGVEALSG

SEQ ID NO: 1228498 - protein, 7 aa, Mycobacterium
SYATHNE

SEQ ID NO: 1228499 - protein, 16 aa, Mycobacterium
SYDGQGCSISQAATSV

SEQ ID NO: 1228500 - protein, 5 aa, Mycobacterium
SYDIT

SEQ ID NO: 1228501 - protein, 17 aa, Mycobacterium
SYDRVEPRHPGSSVDER

SEQ ID NO: 1228502 - protein, 14 aa, Mycobacterium
SYDTAESCGGHCAD

SEQ ID NO: 1228503 - protein, 10 aa, Mycobacterium
SYEAGPQQAL

SEQ ID NO: 1228504 - protein, 5 aa, Mycobacterium
SYERF

SEQ ID NO: 1228505 - protein, 10 aa, Mycobacterium
SYETDKADEY

SEQ ID NO: 1228506 - protein, 6 aa, Mycobacterium
SYETPF

SEQ ID NO: 1228507 - protein, 19 aa, Mycobacterium
SYGEPRRAPDCPAEVPTPR

SEQ ID NO: 1228508 - protein, 5 aa, Mycobacterium
SYGGA

SEQ ID NO: 1228509 - protein, 6 aa, Mycobacterium
SYGGGI

SEQ ID NO: 1228510 - protein, 5 aa, Mycobacterium
SYGGY

SEQ ID NO: 1228511 - protein, 9 aa, Mycobacterium
SYGLPDTPL

SEQ ID NO: 1228512 - protein, 18 aa, Mycobacterium
SYGPGRYDRDYENKHQKY

SEQ ID NO: 1228513 - protein, 10 aa, Mycobacterium
SYGPRKAQRQ

SEQ ID NO: 1228514 - protein, 9 aa, Mycobacterium
SYGQCSGGG

SEQ ID NO: 1228515 - protein, 12 aa, Mycobacterium
SYGQNPQDTLQA

SEQ ID NO: 1228516 - protein, 4 aa, Mycobacterium
SYGT

SEQ ID NO: 1228517 - protein, 5 aa, Mycobacterium
SYGWG

SEQ ID NO: 1228518 - protein, 6 aa, Mycobacterium
SYKRPK

SEQ ID NO: 1228519 - protein, 5 aa, Mycobacterium
SYLRG

SEQ ID NO: 1228520 - protein, 12 aa, Mycobacterium
SYNDAHGHTAGD

SEQ ID NO: 1228521 - protein, 14 aa, Mycobacterium
SYPGGADGSSHGRE

SEQ ID NO: 1228522 - protein, 7 aa, Mycobacterium
SYPTFTP

SEQ ID NO: 1228523 - protein, 6 aa, Mycobacterium
SYPTNV

SEQ ID NO: 1228524 - protein, 6 aa, Mycobacterium
SYPTPY

SEQ ID NO: 1228525 - protein, 9 aa, Mycobacterium
SYQDHAGRA

SEQ ID NO: 1228526 - protein, 7 aa, Mycobacterium
SYQRQRR

SEQ ID NO: 1228527 - protein, 4 aa, Mycobacterium
SYRA

SEQ ID NO: 1228528 - protein, 10 aa, Mycobacterium
SYRDGDPAPI

SEQ ID NO: 1228529 - protein, 10 aa, Mycobacterium
SYREANETVN

SEQ ID NO: 1228530 - protein, 10 aa, Mycobacterium
SYRGAHSQHQ

SEQ ID NO: 1228531 - protein, 6 aa, Mycobacterium
SYRKSG

SEQ ID NO: 1228532 - protein, 5 aa, Mycobacterium
SYRNP

SEQ ID NO: 1228533 - protein, 14 aa, Mycobacterium
SYRPDPAEPSQAAA

SEQ ID NO: 1228534 - protein, 6 aa, Mycobacterium
SYRSAG

SEQ ID NO: 1228535 - protein, 9 aa, Mycobacterium
SYRSGDRAT

SEQ ID NO: 1228536 - protein, 12 aa, Mycobacterium
SYSADKTAEAAA

SEQ ID NO: 1228537 - protein, 9 aa, Mycobacterium
SYSAGSGYG

SEQ ID NO: 1228538 - protein, 9 aa, Mycobacterium
SYSDNPGTI

SEQ ID NO: 1228539 - protein, 8 aa, Mycobacterium
SYSEDGRV

SEQ ID NO: 1228540 - protein, 5 aa, Mycobacterium
SYSMG

SEQ ID NO: 1228541 - protein, 5 aa, Mycobacterium
SYSTD

SEQ ID NO: 1228542 - protein, 6 aa, Mycobacterium
SYTADR

SEQ ID NO: 1228543 - protein, 17 aa, Mycobacterium
SYTASDSARAAARNTWY

SEQ ID NO: 1228544 - protein, 4 aa, Mycobacterium
SYTD

SEQ ID NO: 1228545 - protein, 7 aa, Mycobacterium
SYTDRKK

SEQ ID NO: 1228546 - protein, 4 aa, Mycobacterium
SYTE

SEQ ID NO: 1228547 - protein, 6 aa, Mycobacterium
SYTEGA

SEQ ID NO: 1228548 - protein, 13 aa, Mycobacterium
SYTEGAQRMGRTP

SEQ ID NO: 1228549 - protein, 5 aa, Mycobacterium
SYTES

SEQ ID NO: 1228550 - protein, 17 aa, Mycobacterium
SYTRRDDEEQGFKLGAQ

SEQ ID NO: 1228551 - protein, 12 aa, Mycobacterium
SYVGGSTARSGG

SEQ ID NO: 1228552 - protein, 6 aa, Mycobacterium
TAAAAR

SEQ ID NO: 1228553 - protein, 9 aa, Mycobacterium
TAAAEAKTQ

SEQ ID NO: 1228554 - protein, 6 aa, Mycobacterium
TAAAEE

SEQ ID NO: 1228555 - protein, 16 aa, Mycobacterium
TAAAEGPADPDAGSGT

SEQ ID NO: 1228556 - protein, 7 aa, Mycobacterium
TAAAEQT

SEQ ID NO: 1228557 - protein, 8 aa, Mycobacterium
TAAAESIP

SEQ ID NO: 1228558 - protein, 8 aa, Mycobacterium
TAAAGAER

SEQ ID NO: 1228559 - protein, 8 aa, Mycobacterium
TAAAGDEL

SEQ ID NO: 1228560 - protein, 10 aa, Mycobacterium
TAAAGGALSA

SEQ ID NO: 1228561 - protein, 13 aa, Mycobacterium
TAAAGQPGPSGGR

SEQ ID NO: 1228562 - protein, 8 aa, Mycobacterium
TAAAQAQG

SEQ ID NO: 1228563 - protein, 6 aa, Mycobacterium
TAAAQS

SEQ ID NO: 1228564 - protein, 9 aa, Mycobacterium
TAAASDKAA

SEQ ID NO: 1228565 - protein, 10 aa, Mycobacterium
TAADAAAAGF

SEQ ID NO: 1228566 - protein, 9 aa, Mycobacterium
TAADADESV

SEQ ID NO: 1228567 - protein, 9 aa, Mycobacterium
TAADALPTR

SEQ ID NO: 1228568 - protein, 12 aa, Mycobacterium
TAADDADAQDRD

SEQ ID NO: 1228569 - protein, 5 aa, Mycobacterium
TAADG

SEQ ID NO: 1228570 - protein, 15 aa, Mycobacterium
TAADGLGDAVDSTLD

SEQ ID NO: 1228571 - protein, 7 aa, Mycobacterium
TAADGPA

SEQ ID NO: 1228572 - protein, 7 aa, Mycobacterium
TAADGRT

SEQ ID NO: 1228573 - protein, 7 aa, Mycobacterium
TAADSGK

SEQ ID NO: 1228574 - protein, 6 aa, Mycobacterium
TAADTL

SEQ ID NO: 1228575 - protein, 11 aa, Mycobacterium
TAAEATNPSTW

SEQ ID NO: 1228576 - protein, 9 aa, Mycobacterium
TAAEEPVPE

SEQ ID NO: 1228577 - protein, 6 aa, Mycobacterium
TAAEPG

SEQ ID NO: 1228578 - protein, 14 aa, Mycobacterium
TAAEPRETGTAAVS

SEQ ID NO: 1228579 - protein, 8 aa, Mycobacterium
TAAEVEQR

SEQ ID NO: 1228580 - protein, 7 aa, Mycobacterium
TAAFQRQ

SEQ ID NO: 1228581 - protein, 10 aa, Mycobacterium
TAAGARPGGE

SEQ ID NO: 1228582 - protein, 7 aa, Mycobacterium
TAAGASW

SEQ ID NO: 1228583 - protein, 9 aa, Mycobacterium
TAAGDDDDV

SEQ ID NO: 1228584 - protein, 9 aa, Mycobacterium
TAAGEDTAL

SEQ ID NO: 1228585 - protein, 8 aa, Mycobacterium
TAAGGGDT

SEQ ID NO: 1228586 - protein, 17 aa, Mycobacterium
TAAGGGESTPAASEVAD

SEQ ID NO: 1228587 - protein, 11 aa, Mycobacterium
TAAGGRLETGV

SEQ ID NO: 1228588 - protein, 13 aa, Mycobacterium
TAAGGSASAIPAN

SEQ ID NO: 1228589 - protein, 8 aa, Mycobacterium
TAAGGVPR

SEQ ID NO: 1228590 - protein, 8 aa, Mycobacterium
TAAGPGSR

SEQ ID NO: 1228591 - protein, 5 aa, Mycobacterium
TAAGQ

SEQ ID NO: 1228592 - protein, 11 aa, Mycobacterium
TAAGQGTPHPP

SEQ ID NO: 1228593 - protein, 11 aa, Mycobacterium
TAAGQLSARRR

SEQ ID NO: 1228594 - protein, 5 aa, Mycobacterium
TAAGR

SEQ ID NO: 1228595 - protein, 12 aa, Mycobacterium
TAAGRASNTTAG

SEQ ID NO: 1228596 - protein, 8 aa, Mycobacterium
TAAGRDHS

SEQ ID NO: 1228597 - protein, 5 aa, Mycobacterium
TAAGS

SEQ ID NO: 1228598 - protein, 18 aa, Mycobacterium
TAAGSALDGRGDRARQRQ

SEQ ID NO: 1228599 - protein, 10 aa, Mycobacterium
TAAGSGCAAS

SEQ ID NO: 1228600 - protein, 7 aa, Mycobacterium
TAAGTGV

SEQ ID NO: 1228601 - protein, 8 aa, Mycobacterium
TAAGTLTP

SEQ ID NO: 1228602 - protein, 7 aa, Mycobacterium
TAAGVSK

SEQ ID NO: 1228603 - protein, 9 aa, Mycobacterium
TAAGVTERG

SEQ ID NO: 1228604 - protein, 11 aa, Mycobacterium
TAAHTTAAGEL

SEQ ID NO: 1228605 - protein, 6 aa, Mycobacterium
TAAKAG

SEQ ID NO: 1228606 - protein, 19 aa, Mycobacterium
TAAKAVAGATLVEPVTLTL

SEQ ID NO: 1228607 - protein, 5 aa, Mycobacterium
TAALG

SEQ ID NO: 1228608 - protein, 14 aa, Mycobacterium
TAALTTPAATLPSR

SEQ ID NO: 1228609 - protein, 6 aa, Mycobacterium
TAANAE

SEQ ID NO: 1228610 - protein, 13 aa, Mycobacterium
TAANDSLNDHEYR

SEQ ID NO: 1228611 - protein, 11 aa, Mycobacterium
TAANPAAAHGD

SEQ ID NO: 1228612 - protein, 18 aa, Mycobacterium
TAANTFGKTYPGAGATIG

SEQ ID NO: 1228613 - protein, 7 aa, Mycobacterium
TAAPANS

SEQ ID NO: 1228614 - protein, 10 aa, Mycobacterium
TAAPDADQQR

SEQ ID NO: 1228615 - protein, 9 aa, Mycobacterium
TAAPGEKMH

SEQ ID NO: 1228616 - protein, 6 aa, Mycobacterium
TAAPGH

SEQ ID NO: 1228617 - protein, 7 aa, Mycobacterium
TAAPGIT

SEQ ID NO: 1228618 - protein, 5 aa, Mycobacterium
TAAPL

SEQ ID NO: 1228619 - protein, 17 aa, Mycobacterium
TAAPPPVRAHQPPVFAA

SEQ ID NO: 1228620 - protein, 8 aa, Mycobacterium
TAAPRSGD

SEQ ID NO: 1228621 - protein, 9 aa, Mycobacterium
TAAQGRGLG

SEQ ID NO: 1228622 - protein, 6 aa, Mycobacterium
TAAQHG

SEQ ID NO: 1228623 - protein, 38 aa, Mycobacterium
TAAQREADARLAAQTAAEERHRADADALAGANAELAPY

SEQ ID NO: 1228624 - protein, 14 aa, Mycobacterium
TAAQYGANPAQAAG

SEQ ID NO: 1228625 - protein, 5 aa, Mycobacterium
TAARE

SEQ ID NO: 1228626 - protein, 6 aa, Mycobacterium
TAAREN

SEQ ID NO: 1228627 - protein, 6 aa, Mycobacterium
TAARGH

SEQ ID NO: 1228628 - protein, 9 aa, Mycobacterium
TAARNITDA

SEQ ID NO: 1228629 - protein, 10 aa, Mycobacterium
TAARNPAAAR

SEQ ID NO: 1228630 - protein, 8 aa, Mycobacterium
TAARSEEI

SEQ ID NO: 1228631 - protein, 16 aa, Mycobacterium
TAARTAVDGGSAIEAA

SEQ ID NO: 1228632 - protein, 10 aa, Mycobacterium
TAASAPGSSF

SEQ ID NO: 1228633 - protein, 9 aa, Mycobacterium
TAASATKAC

SEQ ID NO: 1228634 - protein, 11 aa, Mycobacterium
TAASDGKISSN

SEQ ID NO: 1228635 - protein, 8 aa, Mycobacterium
TAASGAEA

SEQ ID NO: 1228636 - protein, 9 aa, Mycobacterium
TAASPLAEI

SEQ ID NO: 1228637 - protein, 7 aa, Mycobacterium
TAASPQQ

SEQ ID NO: 1228638 - protein, 9 aa, Mycobacterium
TAASQPALR

SEQ ID NO: 1228639 - protein, 15 aa, Mycobacterium
TAASREMATAASREM

SEQ ID NO: 1228640 - protein, 10 aa, Mycobacterium
TAATGGDLGP

SEQ ID NO: 1228641 - protein, 32 aa, Mycobacterium
TAATGGPSSPPQGTHPTRRSIARSSRSIAHQR

SEQ ID NO: 1228642 - protein, 8 aa, Mycobacterium
TAATGRGG

SEQ ID NO: 1228643 - protein, 8 aa, Mycobacterium
TAAVGGDV

SEQ ID NO: 1228644 - protein, 8 aa, Mycobacterium
TAAYRQGD

SEQ ID NO: 1228645 - protein, 14 aa, Mycobacterium
TADAAAAVAGNTSL

SEQ ID NO: 1228646 - protein, 10 aa, Mycobacterium
TADAAKATGC

SEQ ID NO: 1228647 - protein, 13 aa, Mycobacterium
TADAESAPPRPVR

SEQ ID NO: 1228648 - protein, 15 aa, Mycobacterium
TADAGDEPEEPMPPD

SEQ ID NO: 1228649 - protein, 6 aa, Mycobacterium
TADAGM

SEQ ID NO: 1228650 - protein, 8 aa, Mycobacterium
TADAPNRK

SEQ ID NO: 1228651 - protein, 7 aa, Mycobacterium
TADATLA

SEQ ID NO: 1228652 - protein, 4 aa, Mycobacterium
TADD

SEQ ID NO: 1228653 - protein, 7 aa, Mycobacterium
TADDGAL

SEQ ID NO: 1228654 - protein, 10 aa, Mycobacterium
TADDNTKTLT

SEQ ID NO: 1228655 - protein, 7 aa, Mycobacterium
TADDPEL

SEQ ID NO: 1228656 - protein, 9 aa, Mycobacterium
TADDTDPAE

SEQ ID NO: 1228657 - protein, 7 aa, Mycobacterium
TADDTEA

SEQ ID NO: 1228658 - protein, 5 aa, Mycobacterium
TADEA

SEQ ID NO: 1228659 - protein, 8 aa, Mycobacterium
TADEGANF

SEQ ID NO: 1228660 - protein, 7 aa, Mycobacterium
TADGAAK

SEQ ID NO: 1228661 - protein, 6 aa, Mycobacterium
TADGEA

SEQ ID NO: 1228662 - protein, 5 aa, Mycobacterium
TADGG

SEQ ID NO: 1228663 - protein, 6 aa, Mycobacterium
TADGGW

SEQ ID NO: 1228664 - protein, 5 aa, Mycobacterium
TADGL

SEQ ID NO: 1228665 - protein, 9 aa, Mycobacterium
TADGLDGER

SEQ ID NO: 1228666 - protein, 7 aa, Mycobacterium
TADGPAL

SEQ ID NO: 1228667 - protein, 8 aa, Mycobacterium
TADGPATL

SEQ ID NO: 1228668 - protein, 10 aa, Mycobacterium
TADGQSSARE

SEQ ID NO: 1228669 - protein, 8 aa, Mycobacterium
TADGRESV

SEQ ID NO: 1228670 - protein, 6 aa, Mycobacterium
TADGTM

SEQ ID NO: 1228671 - protein, 6 aa, Mycobacterium
TADGTW

SEQ ID NO: 1228672 - protein, 7 aa, Mycobacterium
TADLPVS

SEQ ID NO: 1228673 - protein, 5 aa, Mycobacterium
TADNP

SEQ ID NO: 1228674 - protein, 5 aa, Mycobacterium
TADPA

SEQ ID NO: 1228675 - protein, 8 aa, Mycobacterium
TADPANRH

SEQ ID NO: 1228676 - protein, 6 aa, Mycobacterium
TADPAS

SEQ ID NO: 1228677 - protein, 11 aa, Mycobacterium
TADPDSDKPAY

SEQ ID NO: 1228678 - protein, 7 aa, Mycobacterium
TADPFGT

SEQ ID NO: 1228679 - protein, 6 aa, Mycobacterium
TADPRK

SEQ ID NO: 1228680 - protein, 9 aa, Mycobacterium
TADPSPAVG

SEQ ID NO: 1228681 - protein, 5 aa, Mycobacterium
TADPT

SEQ ID NO: 1228682 - protein, 10 aa, Mycobacterium
TADPTSAKPA

SEQ ID NO: 1228683 - protein, 18 aa, Mycobacterium
TADRQKTLGTNYRSDGPL

SEQ ID NO: 1228684 - protein, 8 aa, Mycobacterium
TADSAGTR

SEQ ID NO: 1228685 - protein, 8 aa, Mycobacterium
TADSGREE

SEQ ID NO: 1228686 - protein, 6 aa, Mycobacterium
TADSSR

SEQ ID NO: 1228687 - protein, 4 aa, Mycobacterium
TAEA

SEQ ID NO: 1228688 - protein, 20 aa, Mycobacterium
TAEAEAKALTEDRNEVEAEE

SEQ ID NO: 1228689 - protein, 13 aa, Mycobacterium
TAEAEQRRLGRER

SEQ ID NO: 1228690 - protein, 7 aa, Mycobacterium
TAEATDL

SEQ ID NO: 1228691 - protein, 21 aa, Mycobacterium
TAEATNSRTGAPIQASERRGR

SEQ ID NO: 1228692 - protein, 6 aa, Mycobacterium
TAEDRA

SEQ ID NO: 1228693 - protein, 7 aa, Mycobacterium
TAEDRAR

SEQ ID NO: 1228694 - protein, 11 aa, Mycobacterium
TAEDTHGPQGL

SEQ ID NO: 1228695 - protein, 9 aa, Mycobacterium
TAEEGTTAL

SEQ ID NO: 1228696 - protein, 10 aa, Mycobacterium
TAEEISQAQR

SEQ ID NO: 1228697 - protein, 14 aa, Mycobacterium
TAEEITGEGTPPNV

SEQ ID NO: 1228698 - protein, 17 aa, Mycobacterium
TAEERANAVRGRADSLR

SEQ ID NO: 1228699 - protein, 5 aa, Mycobacterium
TAEEV

SEQ ID NO: 1228700 - protein, 6 aa, Mycobacterium
TAEEVT

SEQ ID NO: 1228701 - protein, 5 aa, Mycobacterium
TAEGD

SEQ ID NO: 1228702 - protein, 5 aa, Mycobacterium
TAEGG

SEQ ID NO: 1228703 - protein, 8 aa, Mycobacterium
TAEGGGQV

SEQ ID NO: 1228704 - protein, 6 aa, Mycobacterium
TAEGLG

SEQ ID NO: 1228705 - protein, 16 aa, Mycobacterium
TAEGLTAESARDATDA

SEQ ID NO: 1228706 - protein, 8 aa, Mycobacterium
TAEGNHLG

SEQ ID NO: 1228707 - protein, 10 aa, Mycobacterium
TAEGNPSTVT

SEQ ID NO: 1228708 - protein, 7 aa, Mycobacterium
TAEGQEL

SEQ ID NO: 1228709 - protein, 9 aa, Mycobacterium
TAEGRAAAL

SEQ ID NO: 1228710 - protein, 4 aa, Mycobacterium
TAEI

SEQ ID NO: 1228711 - protein, 5 aa, Mycobacterium
TAEIP

SEQ ID NO: 1228712 - protein, 7 aa, Mycobacterium
TAEKAKR

SEQ ID NO: 1228713 - protein, 12 aa, Mycobacterium
TAEKKVGSLAGR

SEQ ID NO: 1228714 - protein, 6 aa, Mycobacterium
TAELSQ

SEQ ID NO: 1228715 - protein, 6 aa, Mycobacterium
TAEPDD

SEQ ID NO: 1228716 - protein, 8 aa, Mycobacterium
TAEPDTAS

SEQ ID NO: 1228717 - protein, 8 aa, Mycobacterium
TAEPHPKL

SEQ ID NO: 1228718 - protein, 12 aa, Mycobacterium
TAEPHPKLPGTV

SEQ ID NO: 1228719 - protein, 10 aa, Mycobacterium
TAEPLSPAIG

SEQ ID NO: 1228720 - protein, 13 aa, Mycobacterium
TAEPPAGTRARER

SEQ ID NO: 1228721 - protein, 12 aa, Mycobacterium
TAEPPPGAQARD

SEQ ID NO: 1228722 - protein, 4 aa, Mycobacterium
TAEQ

SEQ ID NO: 1228723 - protein, 6 aa, Mycobacterium
TAEQAG

SEQ ID NO: 1228724 - protein, 6 aa, Mycobacterium
TAEQEV

SEQ ID NO: 1228725 - protein, 11 aa, Mycobacterium
TAEQVTDPGEY

SEQ ID NO: 1228726 - protein, 6 aa, Mycobacterium
TAEQYE

SEQ ID NO: 1228727 - protein, 6 aa, Mycobacterium
TAEREK

SEQ ID NO: 1228728 - protein, 6 aa, Mycobacterium
TAERQA

SEQ ID NO: 1228729 - protein, 5 aa, Mycobacterium
TAERR

SEQ ID NO: 1228730 - protein, 7 aa, Mycobacterium
TAESDRI

SEQ ID NO: 1228731 - protein, 17 aa, Mycobacterium
TAESVDAAAATASAAPG

SEQ ID NO: 1228732 - protein, 18 aa, Mycobacterium
TAETETAPLPEDEIAPQD

SEQ ID NO: 1228733 - protein, 11 aa, Mycobacterium
TAFANRTGALT

SEQ ID NO: 1228734 - protein, 6 aa, Mycobacterium
TAFDGS

SEQ ID NO: 1228735 - protein, 6 aa, Mycobacterium
TAFGAN

SEQ ID NO: 1228736 - protein, 8 aa, Mycobacterium
TAGAARAA

SEQ ID NO: 1228737 - protein, 5 aa, Mycobacterium
TAGAD

SEQ ID NO: 1228738 - protein, 10 aa, Mycobacterium
TAGANAPAKA

SEQ ID NO: 1228739 - protein, 5 aa, Mycobacterium
TAGAR

SEQ ID NO: 1228740 - protein, 13 aa, Mycobacterium
TAGAREGLASGAV

SEQ ID NO: 1228741 - protein, 5 aa, Mycobacterium
TAGDD

SEQ ID NO: 1228742 - protein, 18 aa, Mycobacterium
TAGDERLREERSPSASEG

SEQ ID NO: 1228743 - protein, 7 aa, Mycobacterium
TAGDGGA

SEQ ID NO: 1228744 - protein, 11 aa, Mycobacterium
TAGDGSAHRAA

SEQ ID NO: 1228745 - protein, 21 aa, Mycobacterium
TAGDTGDLAVPAASAVTEEDA

SEQ ID NO: 1228746 - protein, 4 aa, Mycobacterium
TAGE

SEQ ID NO: 1228747 - protein, 8 aa, Mycobacterium
TAGEPTTD

SEQ ID NO: 1228748 - protein, 4 aa, Mycobacterium
TAGF

SEQ ID NO: 1228749 - protein, 22 aa, Mycobacterium
TAGGAGNPAVAGESGNPAAART

SEQ ID NO: 1228750 - protein, 23 aa, Mycobacterium
TAGGATAAPEEHIDPDKAHDAAG

SEQ ID NO: 1228751 - protein, 19 aa, Mycobacterium
TAGGGIAERTVKKDGPHSL

SEQ ID NO: 1228752 - protein, 6 aa, Mycobacterium
TAGGHR

SEQ ID NO: 1228753 - protein, 5 aa, Mycobacterium
TAGGL

SEQ ID NO: 1228754 - protein, 6 aa, Mycobacterium
TAGGMR

SEQ ID NO: 1228755 - protein, 9 aa, Mycobacterium
TAGGPLSEI

SEQ ID NO: 1228756 - protein, 10 aa, Mycobacterium
TAGGRGDAEA

SEQ ID NO: 1228757 - protein, 6 aa, Mycobacterium
TAGGRL

SEQ ID NO: 1228758 - protein, 10 aa, Mycobacterium
TAGGSQADPE

SEQ ID NO: 1228759 - protein, 6 aa, Mycobacterium
TAGGTV

SEQ ID NO: 1228760 - protein, 16 aa, Mycobacterium
TAGKSVPLASDGPEAV

SEQ ID NO: 1228761 - protein, 9 aa, Mycobacterium
TAGLSPKDI

SEQ ID NO: 1228762 - protein, 7 aa, Mycobacterium
TAGNPVC

SEQ ID NO: 1228763 - protein, 11 aa, Mycobacterium
TAGNSSGINDA

SEQ ID NO: 1228764 - protein, 6 aa, Mycobacterium
TAGPAA

SEQ ID NO: 1228765 - protein, 5 aa, Mycobacterium
TAGPD

SEQ ID NO: 1228766 - protein, 7 aa, Mycobacterium
TAGPDAT

SEQ ID NO: 1228767 - protein, 9 aa, Mycobacterium
TAGPPPPQI

SEQ ID NO: 1228768 - protein, 6 aa, Mycobacterium
TAGPVD

SEQ ID NO: 1228769 - protein, 13 aa, Mycobacterium
TAGPWESQQTHDS

SEQ ID NO: 1228770 - protein, 5 aa, Mycobacterium
TAGQI

SEQ ID NO: 1228771 - protein, 6 aa, Mycobacterium
TAGRHE

SEQ ID NO: 1228772 - protein, 6 aa, Mycobacterium
TAGRID

SEQ ID NO: 1228773 - protein, 6 aa, Mycobacterium
TAGRQD

SEQ ID NO: 1228774 - protein, 7 aa, Mycobacterium
TAGRRTA

SEQ ID NO: 1228775 - protein, 7 aa, Mycobacterium
TAGSAAV

SEQ ID NO: 1228776 - protein, 6 aa, Mycobacterium
TAGSGA

SEQ ID NO: 1228777 - protein, 14 aa, Mycobacterium
TAGSNEYTPEDSAG

SEQ ID NO: 1228778 - protein, 7 aa, Mycobacterium
TAGSPAP

SEQ ID NO: 1228779 - protein, 6 aa, Mycobacterium
TAGSRL

SEQ ID NO: 1228780 - protein, 18 aa, Mycobacterium
TAGSSTPTGFGSATEPFH

SEQ ID NO: 1228781 - protein, 14 aa, Mycobacterium
TAGTDNDVDGGPSV

SEQ ID NO: 1228782 - protein, 5 aa, Mycobacterium
TAGTG

SEQ ID NO: 1228783 - protein, 9 aa, Mycobacterium
TAGTGPPDI

SEQ ID NO: 1228784 - protein, 8 aa, Mycobacterium
TAGTGRSH

SEQ ID NO: 1228785 - protein, 6 aa, Mycobacterium
TAGTMQ

SEQ ID NO: 1228786 - protein, 5 aa, Mycobacterium
TAGTN

SEQ ID NO: 1228787 - protein, 12 aa, Mycobacterium
TAGTSATEFAGR

SEQ ID NO: 1228788 - protein, 14 aa, Mycobacterium
TAGTVTVGPDEVAA

SEQ ID NO: 1228789 - protein, 8 aa, Mycobacterium
TAGVRPAD

SEQ ID NO: 1228790 - protein, 9 aa, Mycobacterium
TAGVSKPDV

SEQ ID NO: 1228791 - protein, 6 aa, Mycobacterium
TAGVSR

SEQ ID NO: 1228792 - protein, 7 aa, Mycobacterium
TAGVSRA

SEQ ID NO: 1228793 - protein, 8 aa, Mycobacterium
TAHAAGRN

SEQ ID NO: 1228794 - protein, 9 aa, Mycobacterium
TAHAGDRIR

SEQ ID NO: 1228795 - protein, 9 aa, Mycobacterium
TAHDDDSIE

SEQ ID NO: 1228796 - protein, 17 aa, Mycobacterium
TAHDDEGRRDPRTNPDW

SEQ ID NO: 1228797 - protein, 5 aa, Mycobacterium
TAHDH

SEQ ID NO: 1228798 - protein, 11 aa, Mycobacterium
TAHGGPGLPAS

SEQ ID NO: 1228799 - protein, 7 aa, Mycobacterium
TAHGPTR

SEQ ID NO: 1228800 - protein, 9 aa, Mycobacterium
TAHKDRTAT

SEQ ID NO: 1228801 - protein, 6 aa, Mycobacterium
TAHPRD

SEQ ID NO: 1228802 - protein, 7 aa, Mycobacterium
TAHRDTE

SEQ ID NO: 1228803 - protein, 12 aa, Mycobacterium
TAHSRRRSRDGI

SEQ ID NO: 1228804 - protein, 9 aa, Mycobacterium
TAHTAAEGA

SEQ ID NO: 1228805 - protein, 4 aa, Mycobacterium
TAIG

SEQ ID NO: 1228806 - protein, 6 aa, Mycobacterium
TAKAAE

SEQ ID NO: 1228807 - protein, 9 aa, Mycobacterium
TAKANGRTR

SEQ ID NO: 1228808 - protein, 5 aa, Mycobacterium
TAKEQ

SEQ ID NO: 1228809 - protein, 9 aa, Mycobacterium
TAKGSGGNE

SEQ ID NO: 1228810 - protein, 5 aa, Mycobacterium
TAKKS

SEQ ID NO: 1228811 - protein, 6 aa, Mycobacterium
TAKPYF

SEQ ID NO: 1228812 - protein, 5 aa, Mycobacterium
TAKQG

SEQ ID NO: 1228813 - protein, 9 aa, Mycobacterium
TAKQNGKRC

SEQ ID NO: 1228814 - protein, 7 aa, Mycobacterium
TAKSGSV

SEQ ID NO: 1228815 - protein, 7 aa, Mycobacterium
TAKTEGG

SEQ ID NO: 1228816 - protein, 18 aa, Mycobacterium
TAKTEPVTLPDGTTEQQP

SEQ ID NO: 1228817 - protein, 5 aa, Mycobacterium
TAKYG

SEQ ID NO: 1228818 - protein, 9 aa, Mycobacterium
TAKYGGTAT

SEQ ID NO: 1228819 - protein, 8 aa, Mycobacterium
TALAGNAV

SEQ ID NO: 1228820 - protein, 6 aa, Mycobacterium
TALDRS

SEQ ID NO: 1228821 - protein, 4 aa, Mycobacterium
TALG

SEQ ID NO: 1228822 - protein, 8 aa, Mycobacterium
TALGAGYA

SEQ ID NO: 1228823 - protein, 6 aa, Mycobacterium
TALGGG

SEQ ID NO: 1228824 - protein, 19 aa, Mycobacterium
TALGGQPPATRIPNLSGQY

SEQ ID NO: 1228825 - protein, 5 aa, Mycobacterium
TALGR

SEQ ID NO: 1228826 - protein, 17 aa, Mycobacterium
TALHSSKAQPDPLGPDS

SEQ ID NO: 1228827 - protein, 7 aa, Mycobacterium
TALNTAP

SEQ ID NO: 1228828 - protein, 11 aa, Mycobacterium
TALPAPSDKRW

SEQ ID NO: 1228829 - protein, 11 aa, Mycobacterium
TALPAQDATFD

SEQ ID NO: 1228830 - protein, 13 aa, Mycobacterium
TALPDRTPLPRPD

SEQ ID NO: 1228831 - protein, 5 aa, Mycobacterium
TALPF

SEQ ID NO: 1228832 - protein, 8 aa, Mycobacterium
TALPPPEV

SEQ ID NO: 1228833 - protein, 5 aa, Mycobacterium
TALRD

SEQ ID NO: 1228834 - protein, 8 aa, Mycobacterium
TALRDGDS

SEQ ID NO: 1228835 - protein, 9 aa, Mycobacterium
TALTTPTGV

SEQ ID NO: 1228836 - protein, 9 aa, Mycobacterium
TAMDTTAAQ

SEQ ID NO: 1228837 - protein, 8 aa, Mycobacterium
TANASQLQ

SEQ ID NO: 1228838 - protein, 19 aa, Mycobacterium
TANDPEMQDELPEGSDTSV

SEQ ID NO: 1228839 - protein, 10 aa, Mycobacterium
TANEGNGFRT

SEQ ID NO: 1228840 - protein, 8 aa, Mycobacterium
TANGFSEK

SEQ ID NO: 1228841 - protein, 19 aa, Mycobacterium
TANGGRAVANTDSVADWDG

SEQ ID NO: 1228842 - protein, 13 aa, Mycobacterium
TANGKAHGLGDPT

SEQ ID NO: 1228843 - protein, 7 aa, Mycobacterium
TANGQPV

SEQ ID NO: 1228844 - protein, 5 aa, Mycobacterium
TANGY

SEQ ID NO: 1228845 - protein, 6 aa, Mycobacterium
TANPCA

SEQ ID NO: 1228846 - protein, 13 aa, Mycobacterium
TANPRNPRDDVGD

SEQ ID NO: 1228847 - protein, 4 aa, Mycobacterium
TANQ

SEQ ID NO: 1228848 - protein, 6 aa, Mycobacterium
TANRRG

SEQ ID NO: 1228849 - protein, 11 aa, Mycobacterium
TANRYPDGSYR

SEQ ID NO: 1228850 - protein, 26 aa, Mycobacterium
TANVEAAADAALDELGQDAASATPPK

SEQ ID NO: 1228851 - protein, 11 aa, Mycobacterium
TAPAAQQGASF

SEQ ID NO: 1228852 - protein, 7 aa, Mycobacterium
TAPAARG

SEQ ID NO: 1228853 - protein, 11 aa, Mycobacterium
TAPADPAHRHD

SEQ ID NO: 1228854 - protein, 15 aa, Mycobacterium
TAPAFSLPDADGNTV

SEQ ID NO: 1228855 - protein, 6 aa, Mycobacterium
TAPASI

SEQ ID NO: 1228856 - protein, 6 aa, Mycobacterium
TAPAVQ

SEQ ID NO: 1228857 - protein, 4 aa, Mycobacterium
TAPD

SEQ ID NO: 1228858 - protein, 9 aa, Mycobacterium
TAPDPAERA

SEQ ID NO: 1228859 - protein, 11 aa, Mycobacterium
TAPDRDASRNP

SEQ ID NO: 1228860 - protein, 4 aa, Mycobacterium
TAPE

SEQ ID NO: 1228861 - protein, 7 aa, Mycobacterium
TAPEATR

SEQ ID NO: 1228862 - protein, 7 aa, Mycobacterium
TAPEGAN

SEQ ID NO: 1228863 - protein, 5 aa, Mycobacterium
TAPEK

SEQ ID NO: 1228864 - protein, 23 aa, Mycobacterium
TAPEPTSSGESVSPGTHASTGGF

SEQ ID NO: 1228865 - protein, 6 aa, Mycobacterium
TAPGES

SEQ ID NO: 1228866 - protein, 6 aa, Mycobacterium
TAPGGV

SEQ ID NO: 1228867 - protein, 9 aa, Mycobacterium
TAPGPDVDG

SEQ ID NO: 1228868 - protein, 7 aa, Mycobacterium
TAPGTRV

SEQ ID NO: 1228869 - protein, 12 aa, Mycobacterium
TAPIGPSTAERI

SEQ ID NO: 1228870 - protein, 20 aa, Mycobacterium
TAPKPESEATFDTDPGSAMA

SEQ ID NO: 1228871 - protein, 10 aa, Mycobacterium
TAPKSNAVTT

SEQ ID NO: 1228872 - protein, 8 aa, Mycobacterium
TAPNGSEA

SEQ ID NO: 1228873 - protein, 8 aa, Mycobacterium
TAPPGDGQ

SEQ ID NO: 1228874 - protein, 9 aa, Mycobacterium
TAPPPKLER

SEQ ID NO: 1228875 - protein, 9 aa, Mycobacterium
TAPPPVGYD

SEQ ID NO: 1228876 - protein, 13 aa, Mycobacterium
TAPPSAGGPGSGL

SEQ ID NO: 1228877 - protein, 4 aa, Mycobacterium
TAPR

SEQ ID NO: 1228878 - protein, 12 aa, Mycobacterium
TAPRGLAGPLPA

SEQ ID NO: 1228879 - protein, 6 aa, Mycobacterium
TAPRPD

SEQ ID NO: 1228880 - protein, 9 aa, Mycobacterium
TAPRQGGFR

SEQ ID NO: 1228881 - protein, 6 aa, Mycobacterium
TAPRSD

SEQ ID NO: 1228882 - protein, 5 aa, Mycobacterium
TAPSK

SEQ ID NO: 1228883 - protein, 8 aa, Mycobacterium
TAPSQHAA

SEQ ID NO: 1228884 - protein, 5 aa, Mycobacterium
TAPTD

SEQ ID NO: 1228885 - protein, 6 aa, Mycobacterium
TAPTGH

SEQ ID NO: 1228886 - protein, 12 aa, Mycobacterium
TAPTLDSSKCSR

SEQ ID NO: 1228887 - protein, 7 aa, Mycobacterium
TAPTLGA

SEQ ID NO: 1228888 - protein, 6 aa, Mycobacterium
TAPTLT

SEQ ID NO: 1228889 - protein, 20 aa, Mycobacterium
TAPTPPEGAPPVVTADPAPY

SEQ ID NO: 1228890 - protein, 7 aa, Mycobacterium
TAPVDPA

SEQ ID NO: 1228891 - protein, 17 aa, Mycobacterium
TAPVEEKAPAAEAKLPE

SEQ ID NO: 1228892 - protein, 7 aa, Mycobacterium
TAPVLSS

SEQ ID NO: 1228893 - protein, 6 aa, Mycobacterium
TAPYDT

SEQ ID NO: 1228894 - protein, 7 aa, Mycobacterium
TAQAERA

SEQ ID NO: 1228895 - protein, 6 aa, Mycobacterium
TAQAQR

SEQ ID NO: 1228896 - protein, 9 aa, Mycobacterium
TAQDPSGRI

SEQ ID NO: 1228897 - protein, 6 aa, Mycobacterium
TAQHGP

SEQ ID NO: 1228898 - protein, 9 aa, Mycobacterium
TAQKRETAC

SEQ ID NO: 1228899 - protein, 6 aa, Mycobacterium
TAQNPD

SEQ ID NO: 1228900 - protein, 4 aa, Mycobacterium
TAQP

SEQ ID NO: 1228901 - protein, 16 aa, Mycobacterium
TAQREWETRGPKGRAK

SEQ ID NO: 1228902 - protein, 10 aa, Mycobacterium
TAQSEPSQPH

SEQ ID NO: 1228903 - protein, 6 aa, Mycobacterium
TAQSTV

SEQ ID NO: 1228904 - protein, 9 aa, Mycobacterium
TAQTARDFA

SEQ ID NO: 1228905 - protein, 10 aa, Mycobacterium
TAQTEPSQPH

SEQ ID NO: 1228906 - protein, 7 aa, Mycobacterium
TAQTSKP

SEQ ID NO: 1228907 - protein, 7 aa, Mycobacterium
TAQVEGG

SEQ ID NO: 1228908 - protein, 15 aa, Mycobacterium
TARAALSGESDDGFS

SEQ ID NO: 1228909 - protein, 11 aa, Mycobacterium
TARAEAPGTYY

SEQ ID NO: 1228910 - protein, 8 aa, Mycobacterium
TARAERDA

SEQ ID NO: 1228911 - protein, 5 aa, Mycobacterium
TARAR

SEQ ID NO: 1228912 - protein, 16 aa, Mycobacterium
TARARANLEREGTPAA

SEQ ID NO: 1228913 - protein, 6 aa, Mycobacterium
TARDAL

SEQ ID NO: 1228914 - protein, 11 aa, Mycobacterium
TARDELAAQGD

SEQ ID NO: 1228915 - protein, 5 aa, Mycobacterium
TARDT

SEQ ID NO: 1228916 - protein, 12 aa, Mycobacterium
TARDYATADRTE

SEQ ID NO: 1228917 - protein, 14 aa, Mycobacterium
TAREAAGVATVSDG

SEQ ID NO: 1228918 - protein, 9 aa, Mycobacterium
TARETRSGG

SEQ ID NO: 1228919 - protein, 8 aa, Mycobacterium
TARGGRQG

SEQ ID NO: 1228920 - protein, 5 aa, Mycobacterium
TARGL

SEQ ID NO: 1228921 - protein, 12 aa, Mycobacterium
TARLPDGSLADH

SEQ ID NO: 1228922 - protein, 5 aa, Mycobacterium
TARLT

SEQ ID NO: 1228923 - protein, 7 aa, Mycobacterium
TARNGAD

SEQ ID NO: 1228924 - protein, 8 aa, Mycobacterium
TARNGPLE

SEQ ID NO: 1228925 - protein, 10 aa, Mycobacterium
TARPADNGMG

SEQ ID NO: 1228926 - protein, 7 aa, Mycobacterium
TARPFRR

SEQ ID NO: 1228927 - protein, 8 aa, Mycobacterium
TARPGRNL

SEQ ID NO: 1228928 - protein, 7 aa, Mycobacterium
TARPGTQ

SEQ ID NO: 1228929 - protein, 5 aa, Mycobacterium
TARPM

SEQ ID NO: 1228930 - protein, 6 aa, Mycobacterium
TARPRE

SEQ ID NO: 1228931 - protein, 14 aa, Mycobacterium
TARPTSDDKSQEIP

SEQ ID NO: 1228932 - protein, 7 aa, Mycobacterium
TARREGV

SEQ ID NO: 1228933 - protein, 6 aa, Mycobacterium
TARREN

SEQ ID NO: 1228934 - protein, 11 aa, Mycobacterium
TARRGQPPRDD

SEQ ID NO: 1228935 - protein, 11 aa, Mycobacterium
TARRHAPSEPG

SEQ ID NO: 1228936 - protein, 12 aa, Mycobacterium
TARRPHVEFRDR

SEQ ID NO: 1228937 - protein, 9 aa, Mycobacterium
TARRTDADE

SEQ ID NO: 1228938 - protein, 8 aa, Mycobacterium
TARSGIAK

SEQ ID NO: 1228939 - protein, 8 aa, Mycobacterium
TARSSPDA

SEQ ID NO: 1228940 - protein, 6 aa, Mycobacterium
TARTAA

SEQ ID NO: 1228941 - protein, 14 aa, Mycobacterium
TARTGSKLRRRRRT

SEQ ID NO: 1228942 - protein, 6 aa, Mycobacterium
TARTQR

SEQ ID NO: 1228943 - protein, 11 aa, Mycobacterium
TARTRGDGEHL

SEQ ID NO: 1228944 - protein, 6 aa, Mycobacterium
TARVDG

SEQ ID NO: 1228945 - protein, 11 aa, Mycobacterium
TARVPTPADTV

SEQ ID NO: 1228946 - protein, 8 aa, Mycobacterium
TARYGTPF

SEQ ID NO: 1228947 - protein, 4 aa, Mycobacterium
TASA

SEQ ID NO: 1228948 - protein, 10 aa, Mycobacterium
TASAAEDRDG

SEQ ID NO: 1228949 - protein, 16 aa, Mycobacterium
TASAAERLQSARNAAA

SEQ ID NO: 1228950 - protein, 9 aa, Mycobacterium
TASAPGKGA

SEQ ID NO: 1228951 - protein, 16 aa, Mycobacterium
TASATESGQPVSTSSC

SEQ ID NO: 1228952 - protein, 10 aa, Mycobacterium
TASAVGGDEQ

SEQ ID NO: 1228953 - protein, 7 aa, Mycobacterium
TASCTRA

SEQ ID NO: 1228954 - protein, 4 aa, Mycobacterium
TASE

SEQ ID NO: 1228955 - protein, 14 aa, Mycobacterium
TASGARYRGDRGAL

SEQ ID NO: 1228956 - protein, 7 aa, Mycobacterium
TASGDMT

SEQ ID NO: 1228957 - protein, 13 aa, Mycobacterium
TASGGQRVTATAP

SEQ ID NO: 1228958 - protein, 6 aa, Mycobacterium
TASGRT

SEQ ID NO: 1228959 - protein, 23 aa, Mycobacterium
TASGSGVTLPNAGQANYGAAKAG

SEQ ID NO: 1228960 - protein, 8 aa, Mycobacterium
TASKNVDA

SEQ ID NO: 1228961 - protein, 7 aa, Mycobacterium
TASKPAA

SEQ ID NO: 1228962 - protein, 6 aa, Mycobacterium
TASLDV

SEQ ID NO: 1228963 - protein, 10 aa, Mycobacterium
TASNGPAALD

SEQ ID NO: 1228964 - protein, 7 aa, Mycobacterium
TASNKGK

SEQ ID NO: 1228965 - protein, 9 aa, Mycobacterium
TASNPGPVV

SEQ ID NO: 1228966 - protein, 7 aa, Mycobacterium
TASPENL

SEQ ID NO: 1228967 - protein, 12 aa, Mycobacterium
TASPLSIVEAVP

SEQ ID NO: 1228968 - protein, 7 aa, Mycobacterium
TASPRWY

SEQ ID NO: 1228969 - protein, 6 aa, Mycobacterium
TASRKL

SEQ ID NO: 1228970 - protein, 14 aa, Mycobacterium
TASRKTMVRKRPEG

SEQ ID NO: 1228971 - protein, 6 aa, Mycobacterium
TASRPA

SEQ ID NO: 1228972 - protein, 7 aa, Mycobacterium
TASRPES

SEQ ID NO: 1228973 - protein, 9 aa, Mycobacterium
TASSPNGFG

SEQ ID NO: 1228974 - protein, 8 aa, Mycobacterium
TASSTVED

SEQ ID NO: 1228975 - protein, 33 aa, Mycobacterium; identical to SEQ ID NO: 1103529

SEQ ID NO: 1228976 - protein, 16 aa, Mycobacterium
TASTSSSASTSASTSA

SEQ ID NO: 1228977 - protein, 7 aa, Mycobacterium
TASTTAT

SEQ ID NO: 1228978 - protein, 19 aa, Mycobacterium
TASTTSAAPTSTDPDAPPM

SEQ ID NO: 1228979 - protein, 4 aa, Mycobacterium
TASV

SEQ ID NO: 1228980 - protein, 10 aa, Mycobacterium
TATADPDLPP

SEQ ID NO: 1228981 - protein, 8 aa, Mycobacterium
TATAEATR

SEQ ID NO: 1228982 - protein, 7 aa, Mycobacterium
TATAGGA

SEQ ID NO: 1228983 - protein, 6 aa, Mycobacterium
TATAPN

SEQ ID NO: 1228984 - protein, 5 aa, Mycobacterium
TATAR

SEQ ID NO: 1228985 - protein, 17 aa, Mycobacterium
TATDADPQVAGKPAPAL

SEQ ID NO: 1228986 - protein, 18 aa, Mycobacterium
TATDGPAPSNPTIPHPPR

SEQ ID NO: 1228987 - protein, 8 aa, Mycobacterium
TATDLQSV

SEQ ID NO: 1228988 - protein, 6 aa, Mycobacterium
TATDSI

SEQ ID NO: 1228989 - protein, 8 aa, Mycobacterium
TATELGPE

SEQ ID NO: 1228990 - protein, 4 aa, Mycobacterium
TATF

SEQ ID NO: 1228991 - protein, 5 aa, Mycobacterium
TATFA

SEQ ID NO: 1228992 - protein, 4 aa, Mycobacterium
TATG

SEQ ID NO: 1228993 - protein, 8 aa, Mycobacterium
TATGIAGT

SEQ ID NO: 1228994 - protein, 12 aa, Mycobacterium
TATGSDPGDSLA

SEQ ID NO: 1228995 - protein, 5 aa, Mycobacterium
TATGY

SEQ ID NO: 1228996 - protein, 18 aa, Mycobacterium
TATHEESKKGPRAPKHTY

SEQ ID NO: 1228997 - protein, 14 aa, Mycobacterium
TATHETRPSPNTDL

SEQ ID NO: 1228998 - protein, 6 aa, Mycobacterium
TATKAL

SEQ ID NO: 1228999 - protein, 5 aa, Mycobacterium
TATNN

SEQ ID NO: 1229000 - protein, 5 aa, Mycobacterium
TATNT

SEQ ID NO: 1229001 - protein, 4 aa, Mycobacterium
TATP

SEQ ID NO: 1229002 - protein, 7 aa, Mycobacterium
TATPAQL

SEQ ID NO: 1229003 - protein, 7 aa, Mycobacterium
TATPDFS

SEQ ID NO: 1229004 - protein, 22 aa, Mycobacterium
TATPEDLRAAPDTAGKAAEGTD

SEQ ID NO: 1229005 - protein, 7 aa, Mycobacterium
TATPEEI

SEQ ID NO: 1229006 - protein, 10 aa, Mycobacterium
TATPRGPQAA

SEQ ID NO: 1229007 - protein, 9 aa, Mycobacterium
TATPTPEAI

SEQ ID NO: 1229008 - protein, 6 aa, Mycobacterium
TATPWP

SEQ ID NO: 1229009 - protein, 7 aa, Mycobacterium
TATQHSA

SEQ ID NO: 1229010 - protein, 6 aa, Mycobacterium
TATQRA

SEQ ID NO: 1229011 - protein, 8 aa, Mycobacterium
TATQYGRE

SEQ ID NO: 1229012 - protein, 4 aa, Mycobacterium
TATR

SEQ ID NO: 1229013 - protein, 16 aa, Mycobacterium
TATRALPGVGGEDVPA

SEQ ID NO: 1229014 - protein, 10 aa, Mycobacterium
TATRDTEVGG

SEQ ID NO: 1229015 - protein, 6 aa, Mycobacterium
TATREP

SEQ ID NO: 1229016 - protein, 14 aa, Mycobacterium
TATRRDLQDAKTID

SEQ ID NO: 1229017 - protein, 8 aa, Mycobacterium
TATRRPAR

SEQ ID NO: 1229018 - protein, 14 aa, Mycobacterium
TATRTRQTLERTGI

SEQ ID NO: 1229019 - protein, 7 aa, Mycobacterium
TATSPGE

SEQ ID NO: 1229020 - protein, 5 aa, Mycobacterium
TATTA

SEQ ID NO: 1229021 - protein, 10 aa, Mycobacterium
TATTDAPDTV

SEQ ID NO: 1229022 - protein, 8 aa, Mycobacterium
TATTREVN

SEQ ID NO: 1229023 - protein, 6 aa, Mycobacterium
TATVHG

SEQ ID NO: 1229024 - protein, 9 aa, Mycobacterium
TAVASASIG

SEQ ID NO: 1229025 - protein, 5 aa, Mycobacterium
TAVDA

SEQ ID NO: 1229026 - protein, 4 aa, Mycobacterium
TAVG

SEQ ID NO: 1229027 - protein, 9 aa, Mycobacterium
TAVGGTPQQ

SEQ ID NO: 1229028 - protein, 4 aa, Mycobacterium
TAVL

SEQ ID NO: 1229029 - protein, 21 aa, Mycobacterium
TAVNQDGASSGLTVPNGGAQQ

SEQ ID NO: 1229030 - protein, 5 aa, Mycobacterium
TAVPA

SEQ ID NO: 1229031 - protein, 12 aa, Mycobacterium
TAVPADDPVAGT

SEQ ID NO: 1229032 - protein, 7 aa, Mycobacterium
TAVPGLD

SEQ ID NO: 1229033 - protein, 16 aa, Mycobacterium
TAVPPSWRPDIKQPAD

SEQ ID NO: 1229034 - protein, 15 aa, Mycobacterium
TAVQQATGHDDSAEE

SEQ ID NO: 1229035 - protein, 15 aa, Mycobacterium
TAVQQATGHEDTAEE

SEQ ID NO: 1229036 - protein, 10 aa, Mycobacterium
TAVRGAGETF

SEQ ID NO: 1229037 - protein, 9 aa, Mycobacterium
TAVRGEAPK

SEQ ID NO: 1229038 - protein, 18 aa, Mycobacterium
TAVRGTLSSPADLAAEPT

SEQ ID NO: 1229039 - protein, 5 aa, Mycobacterium
TAVRR

SEQ ID NO: 1229040 - protein, 5 aa, Mycobacterium
TAVSE

SEQ ID NO: 1229041 - protein, 6 aa, Mycobacterium
TAVSEP

SEQ ID NO: 1229042 - protein, 5 aa, Mycobacterium
TAVSY

SEQ ID NO: 1229043 - protein, 6 aa, Mycobacterium
TAVTQG

SEQ ID NO: 1229044 - protein, 10 aa, Mycobacterium
TAVTRSGYPA

SEQ ID NO: 1229045 - protein, 7 aa, Mycobacterium
TAYAPSD

SEQ ID NO: 1229046 - protein, 13 aa, Mycobacterium
TAYDSAAAGRTGL

SEQ ID NO: 1229047 - protein, 12 aa, Mycobacterium
TAYGEGGPYSDR

SEQ ID NO: 1229048 - protein, 8 aa, Mycobacterium
TAYGSAGK

SEQ ID NO: 1229049 - protein, 7 aa, Mycobacterium
TAYRPAD

SEQ ID NO: 1229050 - protein, 7 aa, Mycobacterium
TAYTEER

SEQ ID NO: 1229051 - protein, 6 aa, Mycobacterium
TCGPHE

SEQ ID NO: 1229052 - protein, 5 aa, Mycobacterium
TCHDG

SEQ ID NO: 1229053 - protein, 6 aa, Mycobacterium
TCPGGP

SEQ ID NO: 1229054 - protein, 13 aa, Mycobacterium
TCPGRESAEAAPV

SEQ ID NO: 1229055 - protein, 26 aa, Mycobacterium
TCSPNRASSGGVGVGSCGSGLGRGDI

SEQ ID NO: 1229056 - protein, 4 aa, Mycobacterium
TDAA

SEQ ID NO: 1229057 - protein, 8 aa, Mycobacterium
TDAAAEQL

SEQ ID NO: 1229058 - protein, 21 aa, Mycobacterium
TDAADDAAGRRALASARSALQ

SEQ ID NO: 1229059 - protein, 7 aa, Mycobacterium
TDAADGV

SEQ ID NO: 1229060 - protein, 10 aa, Mycobacterium
TDAADREARE

SEQ ID NO: 1229061 - protein, 11 aa, Mycobacterium
TDAADTRVAKY

SEQ ID NO: 1229062 - protein, 7 aa, Mycobacterium
TDAAERQ

SEQ ID NO: 1229063 - protein, 6 aa, Mycobacterium
TDAAGL

SEQ ID NO: 1229064 - protein, 16 aa, Mycobacterium
TDAANADERFRTAAKG

SEQ ID NO: 1229065 - protein, 11 aa, Mycobacterium
TDAATEHPQSL

SEQ ID NO: 1229066 - protein, 8 aa, Mycobacterium
TDAATRGQ

SEQ ID NO: 1229067 - protein, 11 aa, Mycobacterium
TDAATRNGYTV

SEQ ID NO: 1229068 - protein, 9 aa, Mycobacterium
TDADGAVTV

SEQ ID NO: 1229069 - protein, 9 aa, Mycobacterium
TDADGSRFS

SEQ ID NO: 1229070 - protein, 9 aa, Mycobacterium
TDADGVENI

SEQ ID NO: 1229071 - protein, 17 aa, Mycobacterium
TDADGVRRPTRRGADLT

SEQ ID NO: 1229072 - protein, 6 aa, Mycobacterium
TDADPL

SEQ ID NO: 1229073 - protein, 5 aa, Mycobacterium
TDADR

SEQ ID NO: 1229074 - protein, 8 aa, Mycobacterium
TDADRDAA

SEQ ID NO: 1229075 - protein, 8 aa, Mycobacterium
TDADTGLR

SEQ ID NO: 1229076 - protein, 16 aa, Mycobacterium
TDAEKRAAIETTPARK

SEQ ID NO: 1229077 - protein, 7 aa, Mycobacterium
TDAEMAA

SEQ ID NO: 1229078 - protein, 5 aa, Mycobacterium
TDAEP

SEQ ID NO: 1229079 - protein, 8 aa, Mycobacterium
TDAEQTSA

SEQ ID NO: 1229080 - protein, 6 aa, Mycobacterium
TDAEVR

SEQ ID NO: 1229081 - protein, 8 aa, Mycobacterium
TDAGEETL

SEQ ID NO: 1229082 - protein, 6 aa, Mycobacterium
TDAGEG

SEQ ID NO: 1229083 - protein, 7 aa, Mycobacterium
TDAGERS

SEQ ID NO: 1229084 - protein, 9 aa, Mycobacterium
TDAGGRARA

SEQ ID NO: 1229085 - protein, 8 aa, Mycobacterium
TDAGPADT

SEQ ID NO: 1229086 - protein, 7 aa, Mycobacterium
TDAGRRT

SEQ ID NO: 1229087 - protein, 6 aa, Mycobacterium
TDAHAK

SEQ ID NO: 1229088 - protein, 7 aa, Mycobacterium
TDAKGRR

SEQ ID NO: 1229089 - protein, 8 aa, Mycobacterium
TDAKNNEF

SEQ ID NO: 1229090 - protein, 6 aa, Mycobacterium
TDANKR

SEQ ID NO: 1229091 - protein, 14 aa, Mycobacterium
TDAPAIPHGQNAKE

SEQ ID NO: 1229092 - protein, 5 aa, Mycobacterium
TDAPD

SEQ ID NO: 1229093 - protein, 9 aa, Mycobacterium
TDAPDGTRW

SEQ ID NO: 1229094 - protein, 9 aa, Mycobacterium
TDAPEEDTA

SEQ ID NO: 1229095 - protein, 9 aa, Mycobacterium
TDAPFGDAD

SEQ ID NO: 1229096 - protein, 13 aa, Mycobacterium
TDAPGVTVEPQRS

SEQ ID NO: 1229097 - protein, 5 aa, Mycobacterium
TDAPL

SEQ ID NO: 1229098 - protein, 19 aa, Mycobacterium
TDAPLALPGPPPTDTDTAI

SEQ ID NO: 1229099 - protein, 14 aa, Mycobacterium
TDAPPGDPAGSEQW

SEQ ID NO: 1229100 - protein, 8 aa, Mycobacterium
TDAPPMTP

SEQ ID NO: 1229101 - protein, 6 aa, Mycobacterium
TDAPRY

SEQ ID NO: 1229102 - protein, 11 aa, Mycobacterium
TDAPTDSGGQW

SEQ ID NO: 1229103 - protein, 7 aa, Mycobacterium
TDAPVTA

SEQ ID NO: 1229104 - protein, 6 aa, Mycobacterium
TDARAA

SEQ ID NO: 1229105 - protein, 8 aa, Mycobacterium
TDAREHET

SEQ ID NO: 1229106 - protein, 7 aa, Mycobacterium
TDARGQR

SEQ ID NO: 1229107 - protein, 25 aa, Mycobacterium
TDARLGGDTGGAFPSARASSTAVTP

SEQ ID NO: 1229108 - protein, 6 aa, Mycobacterium
TDARPD

SEQ ID NO: 1229109 - protein, 7 aa, Mycobacterium
TDARPDQ

SEQ ID NO: 1229110 - protein, 8 aa, Mycobacterium
TDARPQDD

SEQ ID NO: 1229111 - protein, 12 aa, Mycobacterium
TDASAQGVDPDR

SEQ ID NO: 1229112 - protein, 7 aa, Mycobacterium
TDASDRL

SEQ ID NO: 1229113 - protein, 11 aa, Mycobacterium
TDASQRPSDME

SEQ ID NO: 1229114 - protein, 8 aa, Mycobacterium
TDATGGAH

SEQ ID NO: 1229115 - protein, 14 aa, Mycobacterium
TDATGGATGGDART

SEQ ID NO: 1229116 - protein, 8 aa, Mycobacterium
TDATGSIT

SEQ ID NO: 1229117 - protein, 14 aa, Mycobacterium
TDAVAGAGGDTTDY

SEQ ID NO: 1229118 - protein, 4 aa, Mycobacterium
TDDA

SEQ ID NO: 1229119 - protein, 8 aa, Mycobacterium
TDDATTAA

SEQ ID NO: 1229120 - protein, 9 aa, Mycobacterium
TDDDAPQRI

SEQ ID NO: 1229121 - protein, 6 aa, Mycobacterium
TDDDGR

SEQ ID NO: 1229122 - protein, 6 aa, Mycobacterium
TDDDRN

SEQ ID NO: 1229123 - protein, 4 aa, Mycobacterium
TDDE

SEQ ID NO: 1229124 - protein, 5 aa, Mycobacterium
TDDEL

SEQ ID NO: 1229125 - protein, 9 aa, Mycobacterium
TDDEREAAY

SEQ ID NO: 1229126 - protein, 6 aa, Mycobacterium
TDDEVA

SEQ ID NO: 1229127 - protein, 10 aa, Mycobacterium
TDDGDAVPGP

SEQ ID NO: 1229128 - protein, 6 aa, Mycobacterium
TDDGFR

SEQ ID NO: 1229129 - protein, 10 aa, Mycobacterium
TDDGGYTAAP

SEQ ID NO: 1229130 - protein, 17 aa, Mycobacterium
TDDGSWKTKRINNTPRV

SEQ ID NO: 1229131 - protein, 24 aa, Mycobacterium
TDDGTGPDPVTEIEPSSIGKHTKP

SEQ ID NO: 1229132 - protein, 4 aa, Mycobacterium
TDDH

SEQ ID NO: 1229133 - protein, 5 aa, Mycobacterium
TDDLP

SEQ ID NO: 1229134 - protein, 10 aa, Mycobacterium
TDDNVYQTEK

SEQ ID NO: 1229135 - protein, 13 aa, Mycobacterium
TDDPARNKGVTRA

SEQ ID NO: 1229136 - protein, 13 aa, Mycobacterium
TDDPEFDADPTMA

SEQ ID NO: 1229137 - protein, 7 aa, Mycobacterium
TDDPEVN

SEQ ID NO: 1229138 - protein, 12 aa, Mycobacterium
TDDPKTSETDAR

SEQ ID NO: 1229139 - protein, 8 aa, Mycobacterium
TDDPSDAL

SEQ ID NO: 1229140 - protein, 9 aa, Mycobacterium
TDDPVRAAD

SEQ ID NO: 1229141 - protein, 5 aa, Mycobacterium
TDDQA

SEQ ID NO: 1229142 - protein, 11 aa, Mycobacterium
TDDQRTQIEEV

SEQ ID NO: 1229143 - protein, 8 aa, Mycobacterium
TDDQTEGM

SEQ ID NO: 1229144 - protein, 10 aa, Mycobacterium
TDDQTGDDKT

SEQ ID NO: 1229145 - protein, 4 aa, Mycobacterium
TDDR

SEQ ID NO: 1229146 - protein, 6 aa, Mycobacterium
TDDRFT

SEQ ID NO: 1229147 - protein, 9 aa, Mycobacterium
TDDSTGRRE

SEQ ID NO: 1229148 - protein, 11 aa, Mycobacterium
TDDTAAAATET

SEQ ID NO: 1229149 - protein, 6 aa, Mycobacterium
TDDTET

SEQ ID NO: 1229150 - protein, 6 aa, Mycobacterium
TDDTGT

SEQ ID NO: 1229151 - protein, 17 aa, Mycobacterium
TDDTKLEYNASEPSNDW

SEQ ID NO: 1229152 - protein, 6 aa, Mycobacterium
TDDTNV

SEQ ID NO: 1229153 - protein, 4 aa, Mycobacterium
TDEA

SEQ ID NO: 1229154 - protein, 17 aa, Mycobacterium
TDEDGTEVVTFAFRPVE

SEQ ID NO: 1229155 - protein, 6 aa, Mycobacterium
TDEEAL

SEQ ID NO: 1229156 - protein, 14 aa, Mycobacterium
TDEELTDKLRESKE

SEQ ID NO: 1229157 - protein, 7 aa, Mycobacterium
TDEEPVR

SEQ ID NO: 1229158 - protein, 5 aa, Mycobacterium
TDEGA

SEQ ID NO: 1229159 - protein, 7 aa, Mycobacterium
TDEGAQF

SEQ ID NO: 1229160 - protein, 9 aa, Mycobacterium
TDEGGMDDN

SEQ ID NO: 1229161 - protein, 12 aa, Mycobacterium
TDEHGRETEREA

SEQ ID NO: 1229162 - protein, 12 aa, Mycobacterium
TDEHPRADTSLE

SEQ ID NO: 1229163 - protein, 6 aa, Mycobacterium
TDEKGR

SEQ ID NO: 1229164 - protein, 9 aa, Mycobacterium
TDENEIDAR

SEQ ID NO: 1229165 - protein, 9 aa, Mycobacterium
TDEPDGQRV

SEQ ID NO: 1229166 - protein, 7 aa, Mycobacterium
TDEPSLR

SEQ ID NO: 1229167 - protein, 8 aa, Mycobacterium
TDEQERCG

SEQ ID NO: 1229168 - protein, 7 aa, Mycobacterium
TDEQKKW

SEQ ID NO: 1229169 - protein, 8 aa, Mycobacterium
TDEQKQRY

SEQ ID NO: 1229170 - protein, 6 aa, Mycobacterium
TDEQRQ

SEQ ID NO: 1229171 - protein, 7 aa, Mycobacterium
TDEQRRR

SEQ ID NO: 1229172 - protein, 8 aa, Mycobacterium
TDERFPNY

SEQ ID NO: 1229173 - protein, 17 aa, Mycobacterium
TDESPFATELPKQDAKG

SEQ ID NO: 1229174 - protein, 17 aa, Mycobacterium
TDESPFATRLPTQDATG

SEQ ID NO: 1229175 - protein, 6 aa, Mycobacterium
TDESTL

SEQ ID NO: 1229176 - protein, 9 aa, Mycobacterium
TDESVNQLG

SEQ ID NO: 1229177 - protein, 6 aa, Mycobacterium
TDESVP

SEQ ID NO: 1229178 - protein, 7 aa, Mycobacterium
TDETAAD

SEQ ID NO: 1229179 - protein, 9 aa, Mycobacterium
TDFESGGTV

SEQ ID NO: 1229180 - protein, 5 aa, Mycobacterium
TDFSR

SEQ ID NO: 1229181 - protein, 5 aa, Mycobacterium
TDFTE

SEQ ID NO: 1229182 - protein, 8 aa, Mycobacterium
TDGADPEV

SEQ ID NO: 1229183 - protein, 5 aa, Mycobacterium
TDGDL

SEQ ID NO: 1229184 - protein, 10 aa, Mycobacterium
TDGDNGQTLR

SEQ ID NO: 1229185 - protein, 9 aa, Mycobacterium
TDGDTNPFG

SEQ ID NO: 1229186 - protein, 6 aa, Mycobacterium
TDGEAE

SEQ ID NO: 1229187 - protein, 17 aa, Mycobacterium
TDGEPLSWSTEPGGGMS

SEQ ID NO: 1229188 - protein, 9 aa, Mycobacterium
TDGERETAA

SEQ ID NO: 1229189 - protein, 13 aa, Mycobacterium
TDGETNASLRKGD

SEQ ID NO: 1229190 - protein, 14 aa, Mycobacterium
TDGGAASGNTGPYY

SEQ ID NO: 1229191 - protein, 6 aa, Mycobacterium
TDGGEV

SEQ ID NO: 1229192 - protein, 11 aa, Mycobacterium
TDGGGPGSSQL

SEQ ID NO: 1229193 - protein, 8 aa, Mycobacterium
TDGGPTAG

SEQ ID NO: 1229194 - protein, 11 aa, Mycobacterium
TDGGTPSDWEK

SEQ ID NO: 1229195 - protein, 10 aa, Mycobacterium
TDGGTSQDSV

SEQ ID NO: 1229196 - protein, 6 aa, Mycobacterium
TDGIDG

SEQ ID NO: 1229197 - protein, 6 aa, Mycobacterium
TDGKGW

SEQ ID NO: 1229198 - protein, 8 aa, Mycobacterium
TDGKPMPG

SEQ ID NO: 1229199 - protein, 9 aa, Mycobacterium
TDGNGIRNA

SEQ ID NO: 1229200 - protein, 9 aa, Mycobacterium
TDGNGRTGR

SEQ ID NO: 1229201 - protein, 6 aa, Mycobacterium
TDGPAI

SEQ ID NO: 1229202 - protein, 8 aa, Mycobacterium
TDGPATNG

SEQ ID NO: 1229203 - protein, 9 aa, Mycobacterium
TDGPAVQWS

SEQ ID NO: 1229204 - protein, 11 aa, Mycobacterium
TDGPPPGKKPF

SEQ ID NO: 1229205 - protein, 9 aa, Mycobacterium
TDGQYRRGS

SEQ ID NO: 1229206 - protein, 4 aa, Mycobacterium
TDGR

SEQ ID NO: 1229207 - protein, 11 aa, Mycobacterium
TDGRGGLSARE

SEQ ID NO: 1229208 - protein, 9 aa, Mycobacterium
TDGRQTSRQ

SEQ ID NO: 1229209 - protein, 4 aa, Mycobacterium
TDGS

SEQ ID NO: 1229210 - protein, 8 aa, Mycobacterium
TDGSDAAR

SEQ ID NO: 1229211 - protein, 9 aa, Mycobacterium
TDGSDDAAL

SEQ ID NO: 1229212 - protein, 9 aa, Mycobacterium
TDGSDDPAL

SEQ ID NO: 1229213 - protein, 5 aa, Mycobacterium
TDGSH

SEQ ID NO: 1229214 - protein, 9 aa, Mycobacterium
TDGSLDPDA

SEQ ID NO: 1229215 - protein, 9 aa, Mycobacterium
TDGSPVPVA

SEQ ID NO: 1229216 - protein, 8 aa, Mycobacterium
TDGTAAEA

SEQ ID NO: 1229217 - protein, 8 aa, Mycobacterium
TDGTGAER

SEQ ID NO: 1229218 - protein, 5 aa, Mycobacterium
TDGTL

SEQ ID NO: 1229219 - protein, 12 aa, Mycobacterium
TDGTPVTQAPRS

SEQ ID NO: 1229220 - protein, 6 aa, Mycobacterium
TDGTPY

SEQ ID NO: 1229221 - protein, 8 aa, Mycobacterium
TDGTRNEG

SEQ ID NO: 1229222 - protein, 9 aa, Mycobacterium
TDGTRQRAH

SEQ ID NO: 1229223 - protein, 5 aa, Mycobacterium
TDGTV

SEQ ID NO: 1229224 - protein, 9 aa, Mycobacterium
TDGTVTNGG

SEQ ID NO: 1229225 - protein, 4 aa, Mycobacterium
TDGV

SEQ ID NO: 1229226 - protein, 10 aa, Mycobacterium
TDGVKIGDST

SEQ ID NO: 1229227 - protein, 8 aa, Mycobacterium
TDGVNEAG

SEQ ID NO: 1229228 - protein, 10 aa, Mycobacterium
TDGYGPIDLE

SEQ ID NO: 1229229 - protein, 8 aa, Mycobacterium
TDHGAPHA

SEQ ID NO: 1229230 - protein, 11 aa, Mycobacterium
TDHGDGDQRFE

SEQ ID NO: 1229231 - protein, 13 aa, Mycobacterium
TDHPDATTEQEAS

SEQ ID NO: 1229232 - protein, 9 aa, Mycobacterium
TDHPKRLDR

SEQ ID NO: 1229233 - protein, 11 aa, Mycobacterium
TDIAGANAARL

SEQ ID NO: 1229234 - protein, 7 aa, Mycobacterium
TDIPEEE

SEQ ID NO: 1229235 - protein, 12 aa, Mycobacterium
TDIRPQRAAPGD

SEQ ID NO: 1229236 - protein, 9 aa, Mycobacterium
TDKAGADAA

SEQ ID NO: 1229237 - protein, 6 aa, Mycobacterium
TDKAQL

SEQ ID NO: 1229238 - protein, 6 aa, Mycobacterium
TDKGAA

SEQ ID NO: 1229239 - protein, 16 aa, Mycobacterium
TDKGDNDTRGFSGIED

SEQ ID NO: 1229240 - protein, 14 aa, Mycobacterium
TDKPRMGNRGTSVA

SEQ ID NO: 1229241 - protein, 9 aa, Mycobacterium
TDKRTTEVI

SEQ ID NO: 1229242 - protein, 7 aa, Mycobacterium
TDKSYAA

SEQ ID NO: 1229243 - protein, 13 aa, Mycobacterium
TDKVDTEIPSPVA

SEQ ID NO: 1229244 - protein, 8 aa, Mycobacterium
TDLDDAGG

SEQ ID NO: 1229245 - protein, 18 aa, Mycobacterium
TDLEASKDRDRTLGAGID

SEQ ID NO: 1229246 - protein, 5 aa, Mycobacterium
TDLEP

SEQ ID NO: 1229247 - protein, 5 aa, Mycobacterium
TDLPD

SEQ ID NO: 1229248 - protein, 6 aa, Mycobacterium
TDLPEG

SEQ ID NO: 1229249 - protein, 5 aa, Mycobacterium
TDLPR

SEQ ID NO: 1229250 - protein, 5 aa, Mycobacterium
TDLRG

SEQ ID NO: 1229251 - protein, 8 aa, Mycobacterium
TDLRRRGA

SEQ ID NO: 1229252 - protein, 9 aa, Mycobacterium
TDLSAETLP

SEQ ID NO: 1229253 - protein, 9 aa, Mycobacterium
TDLSAPDGA

SEQ ID NO: 1229254 - protein, 7 aa, Mycobacterium
TDLTDAQ

SEQ ID NO: 1229255 - protein, 6 aa, Mycobacterium
TDLTPP

SEQ ID NO: 1229256 - protein, 11 aa, Mycobacterium
TDLTSAARQRI

SEQ ID NO: 1229257 - protein, 8 aa, Mycobacterium
TDNDGEIN

SEQ ID NO: 1229258 - protein, 6 aa, Mycobacterium
TDNEAV

SEQ ID NO: 1229259 - protein, 8 aa, Mycobacterium
TDNEIRER

SEQ ID NO: 1229260 - protein, 16 aa, Mycobacterium
TDNGGKSASGSMTVSV

SEQ ID NO: 1229261 - protein, 27 aa, Mycobacterium
TDNGPHANSWPDGATTPFRSEKATNWE

SEQ ID NO: 1229262 - protein, 7 aa, Mycobacterium
TDNGPSE

SEQ ID NO: 1229263 - protein, 8 aa, Mycobacterium
TDNPTRRY

SEQ ID NO: 1229264 - protein, 5 aa, Mycobacterium
TDNQG

SEQ ID NO: 1229265 - protein, 9 aa, Mycobacterium
TDNTGSKHT

SEQ ID NO: 1229266 - protein, 6 aa, Mycobacterium
TDPAAK

SEQ ID NO: 1229267 - protein, 6 aa, Mycobacterium
TDPAAN

SEQ ID NO: 1229268 - protein, 9 aa, Mycobacterium
TDPADPRLD

SEQ ID NO: 1229269 - protein, 9 aa, Mycobacterium
TDPAEAVTE

SEQ ID NO: 1229270 - protein, 6 aa, Mycobacterium
TDPAEN

SEQ ID NO: 1229271 - protein, 6 aa, Mycobacterium
TDPAGA

SEQ ID NO: 1229272 - protein, 8 aa, Mycobacterium
TDPAGQGL

SEQ ID NO: 1229273 - protein, 6 aa, Mycobacterium
TDPAGV

SEQ ID NO: 1229274 - protein, 8 aa, Mycobacterium
TDPASNVG

SEQ ID NO: 1229275 - protein, 8 aa, Mycobacterium
TDPATDAV

SEQ ID NO: 1229276 - protein, 7 aa, Mycobacterium
TDPATPH

SEQ ID NO: 1229277 - protein, 4 aa, Mycobacterium
TDPD

SEQ ID NO: 1229278 - protein, 9 aa, Mycobacterium
TDPDAARSR

SEQ ID NO: 1229279 - protein, 8 aa, Mycobacterium
TDPDAGHK

SEQ ID NO: 1229280 - protein, 10 aa, Mycobacterium
TDPDAPKHKG

SEQ ID NO: 1229281 - protein, 16 aa, Mycobacterium
TDPDAPKRPGARKSAG

SEQ ID NO: 1229282 - protein, 10 aa, Mycobacterium
TDPDATTTQK

SEQ ID NO: 1229283 - protein, 20 aa, Mycobacterium
TDPDDWTPPQFDENTEIPGE

SEQ ID NO: 1229284 - protein, 5 aa, Mycobacterium
TDPDE

SEQ ID NO: 1229285 - protein, 7 aa, Mycobacterium
TDPDEVA

SEQ ID NO: 1229286 - protein, 5 aa, Mycobacterium
TDPDG

SEQ ID NO: 1229287 - protein, 9 aa, Mycobacterium
TDPDNPANW

SEQ ID NO: 1229288 - protein, 5 aa, Mycobacterium
TDPDQ

SEQ ID NO: 1229289 - protein, 14 aa, Mycobacterium
TDPDSVKSAVEQTT

SEQ ID NO: 1229290 - protein, 13 aa, Mycobacterium
TDPDTARALTPSH

SEQ ID NO: 1229291 - protein, 8 aa, Mycobacterium
TDPDVPKH

SEQ ID NO: 1229292 - protein, 10 aa, Mycobacterium
TDPEATPRHS

SEQ ID NO: 1229293 - protein, 8 aa, Mycobacterium
TDPEHREA

SEQ ID NO: 1229294 - protein, 9 aa, Mycobacterium
TDPEPPDEL

SEQ ID NO: 1229295 - protein, 6 aa, Mycobacterium
TDPEQR

SEQ ID NO: 1229296 - protein, 6 aa, Mycobacterium
TDPEQV

SEQ ID NO: 1229297 - protein, 15 aa, Mycobacterium
TDPESVRRAAEQATD

SEQ ID NO: 1229298 - protein, 7 aa, Mycobacterium
TDPETLA

SEQ ID NO: 1229299 - protein, 6 aa, Mycobacterium
TDPFGG

SEQ ID NO: 1229300 - protein, 11 aa, Mycobacterium
TDPGSGEPTPE

SEQ ID NO: 1229301 - protein, 17 aa, Mycobacterium
TDPGTAAAILEAVDGRT

SEQ ID NO: 1229302 - protein, 5 aa, Mycobacterium
TDPHG

SEQ ID NO: 1229303 - protein, 6 aa, Mycobacterium
TDPHTG

SEQ ID NO: 1229304 - protein, 9 aa, Mycobacterium
TDPLGTHPG

SEQ ID NO: 1229305 - protein, 5 aa, Mycobacterium
TDPLT

SEQ ID NO: 1229306 - protein, 14 aa, Mycobacterium
TDPNDYTGPATGYA

SEQ ID NO: 1229307 - protein, 13 aa, Mycobacterium
TDPPKLKKQEKHD

SEQ ID NO: 1229308 - protein, 17 aa, Mycobacterium
TDPPRSPPSVTVSDSQR

SEQ ID NO: 1229309 - protein, 6 aa, Mycobacterium
TDPPSV

SEQ ID NO: 1229310 - protein, 6 aa, Mycobacterium
TDPPTV

SEQ ID NO: 1229311 - protein, 14 aa, Mycobacterium
TDPQFAAAAPDDAI

SEQ ID NO: 1229312 - protein, 7 aa, Mycobacterium
TDPQGLA

SEQ ID NO: 1229313 - protein, 17 aa, Mycobacterium
TDPRQAVGQGSPHPTAS

SEQ ID NO: 1229314 - protein, 5 aa, Mycobacterium
TDPSA

SEQ ID NO: 1229315 - protein, 9 aa, Mycobacterium
TDPSAPKHK

SEQ ID NO: 1229316 - protein, 6 aa, Mycobacterium
TDPSGI

SEQ ID NO: 1229317 - protein, 5 aa, Mycobacterium
TDPTA

SEQ ID NO: 1229318 - protein, 6 aa, Mycobacterium
TDPTAV

SEQ ID NO: 1229319 - protein, 9 aa, Mycobacterium
TDPTGTTDA

SEQ ID NO: 1229320 - protein, 14 aa, Mycobacterium
TDPTNPLKNTSTHD

SEQ ID NO: 1229321 - protein, 7 aa, Mycobacterium
TDPVADS

SEQ ID NO: 1229322 - protein, 6 aa, Mycobacterium
TDPVPE

SEQ ID NO: 1229323 - protein, 7 aa, Mycobacterium
TDQAPGF

SEQ ID NO: 1229324 - protein, 8 aa, Mycobacterium
TDQNRVQP

SEQ ID NO: 1229325 - protein, 4 aa, Mycobacterium
TDQP

SEQ ID NO: 1229326 - protein, 12 aa, Mycobacterium
TDQSATTEARPH

SEQ ID NO: 1229327 - protein, 6 aa, Mycobacterium
TDQSRD

SEQ ID NO: 1229328 - protein, 5 aa, Mycobacterium
TDREK

SEQ ID NO: 1229329 - protein, 6 aa, Mycobacterium
TDRERA

SEQ ID NO: 1229330 - protein, 5 aa, Mycobacterium
TDRET

SEQ ID NO: 1229331 - protein, 8 aa, Mycobacterium
TDRGADDV

SEQ ID NO: 1229332 - protein, 9 aa, Mycobacterium
TDRGADDVL

SEQ ID NO: 1229333 - protein, 7 aa, Mycobacterium
TDRGDDI

SEQ ID NO: 1229334 - protein, 5 aa, Mycobacterium
TDRGL

SEQ ID NO: 1229335 - protein, 6 aa, Mycobacterium
TDRGSL

SEQ ID NO: 1229336 - protein, 8 aa, Mycobacterium
TDRGSQYT

SEQ ID NO: 1229337 - protein, 7 aa, Mycobacterium
TDRGVKR

SEQ ID NO: 1229338 - protein, 4 aa, Mycobacterium
TDRL

SEQ ID NO: 1229339 - protein, 11 aa, Mycobacterium
TDRPDGPTDEM

SEQ ID NO: 1229340 - protein, 7 aa, Mycobacterium
TDRPDND

SEQ ID NO: 1229341 - protein, 5 aa, Mycobacterium
TDRPV

SEQ ID NO: 1229342 - protein, 8 aa, Mycobacterium
TDRQRAAA

SEQ ID NO: 1229343 - protein, 8 aa, Mycobacterium
TDRSGAPK

SEQ ID NO: 1229344 - protein, 31 aa, Mycobacterium
TDRTDGRDITNPGRDYDGGGGEGVGRAPLPD

SEQ ID NO: 1229345 - protein, 5 aa, Mycobacterium
TDRTG

SEQ ID NO: 1229346 - protein, 8 aa, Mycobacterium
TDRTGTHH

SEQ ID NO: 1229347 - protein, 6 aa, Mycobacterium
TDRVSQ

SEQ ID NO: 1229348 - protein, 5 aa, Mycobacterium
TDSAE

SEQ ID NO: 1229349 - protein, 5 aa, Mycobacterium
TDSAG

SEQ ID NO: 1229350 - protein, 17 aa, Mycobacterium
TDSANADVGDMARSSYA

SEQ ID NO: 1229351 - protein, 5 aa, Mycobacterium
TDSAP

SEQ ID NO: 1229352 - protein, 6 aa, Mycobacterium
TDSDFG

SEQ ID NO: 1229353 - protein, 6 aa, Mycobacterium
TDSDQV

SEQ ID NO: 1229354 - protein, 13 aa, Mycobacterium
TDSDTYHGTGIGN

SEQ ID NO: 1229355 - protein, 12 aa, Mycobacterium
TDSEKPSRVGEL

SEQ ID NO: 1229356 - protein, 7 aa, Mycobacterium
TDSGADG

SEQ ID NO: 1229357 - protein, 16 aa, Mycobacterium
TDSGLTGAVKTSGSRG

SEQ ID NO: 1229358 - protein, 6 aa, Mycobacterium
TDSGRA

SEQ ID NO: 1229359 - protein, 8 aa, Mycobacterium
TDSHAPGQ

SEQ ID NO: 1229360 - protein, 4 aa, Mycobacterium
TDSL

SEQ ID NO: 1229361 - protein, 8 aa, Mycobacterium
TDSLAPPV

SEQ ID NO: 1229362 - protein, 16 aa, Mycobacterium
TDSSGLSRTTYKDVNP

SEQ ID NO: 1229363 - protein, 16 aa, Mycobacterium
TDSSGLSTTTYKDVNP

SEQ ID NO: 1229364 - protein, 4 aa, Mycobacterium
TDST

SEQ ID NO: 1229365 - protein, 11 aa, Mycobacterium
TDSTAPNPHID

SEQ ID NO: 1229366 - protein, 6 aa, Mycobacterium
TDTAAA

SEQ ID NO: 1229367 - protein, 6 aa, Mycobacterium
TDTAAL

SEQ ID NO: 1229368 - protein, 9 aa, Mycobacterium
TDTAANPAE

SEQ ID NO: 1229369 - protein, 6 aa, Mycobacterium
TDTAPV

SEQ ID NO: 1229370 - protein, 9 aa, Mycobacterium
TDTAQRDRA

SEQ ID NO: 1229371 - protein, 6 aa, Mycobacterium
TDTARQ

SEQ ID NO: 1229372 - protein, 12 aa, Mycobacterium
TDTASVSSEFRE

SEQ ID NO: 1229373 - protein, 6 aa, Mycobacterium
TDTATE

SEQ ID NO: 1229374 - protein, 7 aa, Mycobacterium
TDTATGT

SEQ ID NO: 1229375 - protein, 9 aa, Mycobacterium
TDTDGQLQE

SEQ ID NO: 1229376 - protein, 7 aa, Mycobacterium
TDTDGVT

SEQ ID NO: 1229377 - protein, 10 aa, Mycobacterium
TDTDSKQTDP

SEQ ID NO: 1229378 - protein, 4 aa, Mycobacterium
TDTE

SEQ ID NO: 1229379 - protein, 9 aa, Mycobacterium
TDTEAPKHK

SEQ ID NO: 1229380 - protein, 9 aa, Mycobacterium
TDTEARNAV

SEQ ID NO: 1229381 - protein, 7 aa, Mycobacterium
TDTEDDW

SEQ ID NO: 1229382 - protein, 9 aa, Mycobacterium
TDTERPLTG

SEQ ID NO: 1229383 - protein, 23 aa, Mycobacterium
TDTGHTWGKTEPGWDARKPERPR

SEQ ID NO: 1229384 - protein, 6 aa, Mycobacterium
TDTGPR

SEQ ID NO: 1229385 - protein, 7 aa, Mycobacterium
TDTGQAV

SEQ ID NO: 1229386 - protein, 6 aa, Mycobacterium
TDTGTV

SEQ ID NO: 1229387 - protein, 6 aa, Mycobacterium
TDTHGE

SEQ ID NO: 1229388 - protein, 5 aa, Mycobacterium
TDTLP

SEQ ID NO: 1229389 - protein, 6 aa, Mycobacterium
TDTMEE

SEQ ID NO: 1229390 - protein, 7 aa, Mycobacterium
TDTNPRA

SEQ ID NO: 1229391 - protein, 7 aa, Mycobacterium
TDTPGFT

SEQ ID NO: 1229392 - protein, 8 aa, Mycobacterium
TDTPGQLT

SEQ ID NO: 1229393 - protein, 7 aa, Mycobacterium
TDTPGVK

SEQ ID NO: 1229394 - protein, 10 aa, Mycobacterium
TDTPPAITKP

SEQ ID NO: 1229395 - protein, 7 aa, Mycobacterium
TDTPQQI

SEQ ID NO: 1229396 - protein, 6 aa, Mycobacterium
TDTPVA

SEQ ID NO: 1229397 - protein, 7 aa, Mycobacterium
TDTQRQQ

SEQ ID NO: 1229398 - protein, 12 aa, Mycobacterium
TDTRGSLDPAAQ

SEQ ID NO: 1229399 - protein, 10 aa, Mycobacterium
TDTRSSGNSM

SEQ ID NO: 1229400 - protein, 4 aa, Mycobacterium
TDTT

SEQ ID NO: 1229401 - protein, 6 aa, Mycobacterium
TDTTEY

SEQ ID NO: 1229402 - protein, 10 aa, Mycobacterium
TDTVSTGADA

SEQ ID NO: 1229403 - protein, 9 aa, Mycobacterium
TDVAPPAEG

SEQ ID NO: 1229404 - protein, 9 aa, Mycobacterium
TDVDGDTAT

SEQ ID NO: 1229405 - protein, 9 aa, Mycobacterium
TDVDGGQPF

SEQ ID NO: 1229406 - protein, 8 aa, Mycobacterium
TDVDGRHR

SEQ ID NO: 1229407 - protein, 7 aa, Mycobacterium
TDVEGAD

SEQ ID NO: 1229408 - protein, 5 aa, Mycobacterium
TDVES

SEQ ID NO: 1229409 - protein, 6 aa, Mycobacterium
TDVGRD

SEQ ID NO: 1229410 - protein, 8 aa, Mycobacterium
TDVNPDGY

SEQ ID NO: 1229411 - protein, 4 aa, Mycobacterium
TDVP

SEQ ID NO: 1229412 - protein, 7 aa, Mycobacterium
TDVPAGD

SEQ ID NO: 1229413 - protein, 8 aa, Mycobacterium
TDVPSSAR

SEQ ID NO: 1229414 - protein, 6 aa, Mycobacterium
TDVSAG

SEQ ID NO: 1229415 - protein, 8 aa, Mycobacterium
TDVTAAGD

SEQ ID NO: 1229416 - protein, 9 aa, Mycobacterium
TDVTAAPRR

SEQ ID NO: 1229417 - protein, 16 aa, Mycobacterium
TDWAGPSAKHATPLPD

SEQ ID NO: 1229418 - protein, 4 aa, Mycobacterium
TDYD

SEQ ID NO: 1229419 - protein, 12 aa, Mycobacterium
TDYGGNAAVARD

SEQ ID NO: 1229420 - protein, 15 aa, Mycobacterium
TDYGRAGRPKTRYQW

SEQ ID NO: 1229421 - protein, 5 aa, Mycobacterium
TDYHP

SEQ ID NO: 1229422 - protein, 8 aa, Mycobacterium
TDYPSAAE

SEQ ID NO: 1229423 - protein, 4 aa, Mycobacterium
TEAA

SEQ ID NO: 1229424 - protein, 10 aa, Mycobacterium
TEAAITPNDR

SEQ ID NO: 1229425 - protein, 14 aa, Mycobacterium
TEAARRQLEETDDT

SEQ ID NO: 1229426 - protein, 20 aa, Mycobacterium
TEADIRQAAEAARDALARST

SEQ ID NO: 1229427 - protein, 6 aa, Mycobacterium
TEADYA

SEQ ID NO: 1229428 - protein, 14 aa, Mycobacterium
TEAERDRHGAADSW

SEQ ID NO: 1229429 - protein, 7 aa, Mycobacterium
TEAESLG

SEQ ID NO: 1229430 - protein, 8 aa, Mycobacterium
TEAESREL

SEQ ID NO: 1229431 - protein, 15 aa, Mycobacterium
TEAEWETAARGGLTA

SEQ ID NO: 1229432 - protein, 5 aa, Mycobacterium
TEAGA

SEQ ID NO: 1229433 - protein, 7 aa, Mycobacterium
TEAGERP

SEQ ID NO: 1229434 - protein, 9 aa, Mycobacterium
TEAGISPQD

SEQ ID NO: 1229435 - protein, 8 aa, Mycobacterium
TEAGLTQT

SEQ ID NO: 1229436 - protein, 7 aa, Mycobacterium
TEAGRHS

SEQ ID NO: 1229437 - protein, 8 aa, Mycobacterium
TEAGRHSG

SEQ ID NO: 1229438 - protein, 6 aa, Mycobacterium
TEAGRR

SEQ ID NO: 1229439 - protein, 9 aa, Mycobacterium
TEAGRTASV

SEQ ID NO: 1229440 - protein, 14 aa, Mycobacterium
TEAGSADSLDKGRT

SEQ ID NO: 1229441 - protein, 9 aa, Mycobacterium
TEAGSAPEN

SEQ ID NO: 1229442 - protein, 9 aa, Mycobacterium
TEAGTSASS

SEQ ID NO: 1229443 - protein, 10 aa, Mycobacterium
TEAIGEQTIT

SEQ ID NO: 1229444 - protein, 4 aa, Mycobacterium
TEAK

SEQ ID NO: 1229445 - protein, 11 aa, Mycobacterium
TEAKVRGYQPG

SEQ ID NO: 1229446 - protein, 15 aa, Mycobacterium
TEAPGAYHAKDGTSL

SEQ ID NO: 1229447 - protein, 4 aa, Mycobacterium
TEAQ

SEQ ID NO: 1229448 - protein, 8 aa, Mycobacterium
TEAQATTL

SEQ ID NO: 1229449 - protein, 6 aa, Mycobacterium
TEAQKQ

SEQ ID NO: 1229450 - protein, 9 aa, Mycobacterium
TEARRPDSL

SEQ ID NO: 1229451 - protein, 12 aa, Mycobacterium
TEARSTPAHDAE

SEQ ID NO: 1229452 - protein, 5 aa, Mycobacterium
TEATA

SEQ ID NO: 1229453 - protein, 9 aa, Mycobacterium
TEATATELS

SEQ ID NO: 1229454 - protein, 8 aa, Mycobacterium
TEATGETS

SEQ ID NO: 1229455 - protein, 10 aa, Mycobacterium
TEAVAGAGDT

SEQ ID NO: 1229456 - protein, 5 aa, Mycobacterium
TECTE

SEQ ID NO: 1229457 - protein, 11 aa, Mycobacterium
TEDAARPDAVE

SEQ ID NO: 1229458 - protein, 8 aa, Mycobacterium
TEDAGAGH

SEQ ID NO: 1229459 - protein, 8 aa, Mycobacterium
TEDAQEGP

SEQ ID NO: 1229460 - protein, 9 aa, Mycobacterium
TEDARHPER

SEQ ID NO: 1229461 - protein, 18 aa, Mycobacterium
TEDDGHDGVRIAPYGGPA

SEQ ID NO: 1229462 - protein, 14 aa, Mycobacterium
TEDEAPNAKGGVDK

SEQ ID NO: 1229463 - protein, 5 aa, Mycobacterium
TEDGI

SEQ ID NO: 1229464 - protein, 9 aa, Mycobacterium
TEDGRDRAR

SEQ ID NO: 1229465 - protein, 7 aa, Mycobacterium
TEDGRIA

SEQ ID NO: 1229466 - protein, 7 aa, Mycobacterium
TEDGSAY

SEQ ID NO: 1229467 - protein, 16 aa, Mycobacterium
TEDGTTVERHGTRTSY

SEQ ID NO: 1229468 - protein, 10 aa, Mycobacterium
TEDHKTGSLK

SEQ ID NO: 1229469 - protein, 8 aa, Mycobacterium
TEDLDGFD

SEQ ID NO: 1229470 - protein, 7 aa, Mycobacterium
TEDPTRQ

SEQ ID NO: 1229471 - protein, 64 aa, Mycobacterium
TEDREQQQKHAQNQAKTEPAPEAEAEPTPEPDAEPAGDPVESAPLPVGEDESPEPGPAAGPEVA

SEQ ID NO: 1229472 - protein, 6 aa, Mycobacterium
TEDRSR

SEQ ID NO: 1229473 - protein, 11 aa, Mycobacterium
TEDSEPAPLGA

SEQ ID NO: 1229474 - protein, 6 aa, Mycobacterium
TEDSGR

SEQ ID NO: 1229475 - protein, 29 aa, Mycobacterium
TEEDSGEVDDRYGPAGKQRIEDTGPLTKK

SEQ ID NO: 1229476 - protein, 4 aa, Mycobacterium
TEEE

SEQ ID NO: 1229477 - protein, 5 aa, Mycobacterium
TEEEA

SEQ ID NO: 1229478 - protein, 12 aa, Mycobacterium
TEEEADRALQAG

SEQ ID NO: 1229479 - protein, 6 aa, Mycobacterium
TEEEGG

SEQ ID NO: 1229480 - protein, 7 aa, Mycobacterium
TEEETSA

SEQ ID NO: 1229481 - protein, 8 aa, Mycobacterium
TEEETSRL

SEQ ID NO: 1229482 - protein, 14 aa, Mycobacterium
TEEEVSAAAVMNEK

SEQ ID NO: 1229483 - protein, 4 aa, Mycobacterium
TEEG

SEQ ID NO: 1229484 - protein, 5 aa, Mycobacterium
TEEGE

SEQ ID NO: 1229485 - protein, 14 aa, Mycobacterium
TEEGKTRAEGVGEV

SEQ ID NO: 1229486 - protein, 16 aa, Mycobacterium
TEEMGAPAGLASGPQV

SEQ ID NO: 1229487 - protein, 4 aa, Mycobacterium
TEEP

SEQ ID NO: 1229488 - protein, 11 aa, Mycobacterium
TEEPKWDRTTR

SEQ ID NO: 1229489 - protein, 7 aa, Mycobacterium
TEEPTRQ

SEQ ID NO: 1229490 - protein, 5 aa, Mycobacterium
TEEPV

SEQ ID NO: 1229491 - protein, 15 aa, Mycobacterium
TEEQAASGAGLDAQR

SEQ ID NO: 1229492 - protein, 6 aa, Mycobacterium
TEEQKQ

SEQ ID NO: 1229493 - protein, 7 aa, Mycobacterium
TEEQKRA

SEQ ID NO: 1229494 - protein, 6 aa, Mycobacterium
TEEQRD

SEQ ID NO: 1229495 - protein, 8 aa, Mycobacterium
TEERRDPA

SEQ ID NO: 1229496 - protein, 4 aa, Mycobacterium
TEES

SEQ ID NO: 1229497 - protein, 7 aa, Mycobacterium
TEESGPN

SEQ ID NO: 1229498 - protein, 16 aa, Mycobacterium
TEFGATVSKGTRAAQP

SEQ ID NO: 1229499 - protein, 6 aa, Mycobacterium
TEFGRR

SEQ ID NO: 1229500 - protein, 5 aa, Mycobacterium
TEFHG

SEQ ID NO: 1229501 - protein, 6 aa, Mycobacterium
TEFNAG

SEQ ID NO: 1229502 - protein, 6 aa, Mycobacterium
TEFSPR

SEQ ID NO: 1229503 - protein, 16 aa, Mycobacterium
TEFSTTVSKGVRSAQP

SEQ ID NO: 1229504 - protein, 5 aa, Mycobacterium
TEGAA

SEQ ID NO: 1229505 - protein, 12 aa, Mycobacterium
TEGAGEIQNWHA

SEQ ID NO: 1229506 - protein, 5 aa, Mycobacterium
TEGAV

SEQ ID NO: 1229507 - protein, 16 aa, Mycobacterium
TEGAVSEHGSATLEGG

SEQ ID NO: 1229508 - protein, 27 aa, Mycobacterium
TEGDGGKNAPLRRPTAGGSTVVPMRRP

SEQ ID NO: 1229509 - protein, 11 aa, Mycobacterium
TEGDQRADAPI

SEQ ID NO: 1229510 - protein, 21 aa, Mycobacterium
TEGDWRDSSSGLRYRFYSFVR

SEQ ID NO: 1229511 - protein, 8 aa, Mycobacterium
TEGEDKPL

SEQ ID NO: 1229512 - protein, 6 aa, Mycobacterium
TEGERQ

SEQ ID NO: 1229513 - protein, 10 aa, Mycobacterium
TEGETQEPAM

SEQ ID NO: 1229514 - protein, 6 aa, Mycobacterium
TEGGEL

SEQ ID NO: 1229515 - protein, 6 aa, Mycobacterium
TEGHEA

SEQ ID NO: 1229516 - protein, 7 aa, Mycobacterium
TEGHSFG

SEQ ID NO: 1229517 - protein, 4 aa, Mycobacterium
TEGI

SEQ ID NO: 1229518 - protein, 6 aa, Mycobacterium
TEGIPD

SEQ ID NO: 1229519 - protein, 16 aa, Mycobacterium
TEGIPGSTGNVVNGPG

SEQ ID NO: 1229520 - protein, 14 aa, Mycobacterium
TEGLRARVMAKTHA

SEQ ID NO: 1229521 - protein, 4 aa, Mycobacterium
TEGP

SEQ ID NO: 1229522 - protein, 9 aa, Mycobacterium
TEGRARRAD

SEQ ID NO: 1229523 - protein, 14 aa, Mycobacterium
TEGRSVGEKIASGA

SEQ ID NO: 1229524 - protein, 9 aa, Mycobacterium
TEGSAGTRV

SEQ ID NO: 1229525 - protein, 9 aa, Mycobacterium
TEGSATSIT

SEQ ID NO: 1229526 - protein, 5 aa, Mycobacterium
TEGSV

SEQ ID NO: 1229527 - protein, 20 aa, Mycobacterium
TEGSVNSRDARGGTAPTQVA

SEQ ID NO: 1229528 - protein, 9 aa, Mycobacterium
TEGSVPQQI

SEQ ID NO: 1229529 - protein, 17 aa, Mycobacterium
TEGTAATGLTPTGDTRF

SEQ ID NO: 1229530 - protein, 6 aa, Mycobacterium
TEGTNW

SEQ ID NO: 1229531 - protein, 5 aa, Mycobacterium
TEGYT

SEQ ID NO: 1229532 - protein, 4 aa, Mycobacterium
TEHA

SEQ ID NO: 1229533 - protein, 9 aa, Mycobacterium
TEHDTRNAQ

SEQ ID NO: 1229534 - protein, 4 aa, Mycobacterium
TEHE

SEQ ID NO: 1229535 - protein, 4 aa, Mycobacterium
TEHG

SEQ ID NO: 1229536 - protein, 8 aa, Mycobacterium
TEHGAGDA

SEQ ID NO: 1229537 - protein, 6 aa, Mycobacterium
TEHGDS

SEQ ID NO: 1229538 - protein, 8 aa, Mycobacterium
TEIDDTDR

SEQ ID NO: 1229539 - protein, 4 aa, Mycobacterium
TEIP

SEQ ID NO: 1229540 - protein, 5 aa, Mycobacterium
TEIPQ

SEQ ID NO: 1229541 - protein, 11 aa, Mycobacterium
TEIRDEAEQRQ

SEQ ID NO: 1229542 - protein, 5 aa, Mycobacterium
TEIRE

SEQ ID NO: 1229543 - protein, 15 aa, Mycobacterium
TEKEEAERKNKVRGG

SEQ ID NO: 1229544 - protein, 13 aa, Mycobacterium
TEKGRAEAARAGE

SEQ ID NO: 1229545 - protein, 8 aa, Mycobacterium
TEKTVDPT

SEQ ID NO: 1229546 - protein, 11 aa, Mycobacterium
TELAQDTGPRI

SEQ ID NO: 1229547 - protein, 7 aa, Mycobacterium
TELGGKS

SEQ ID NO: 1229548 - protein, 5 aa, Mycobacterium
TELGV

SEQ ID NO: 1229549 - protein, 12 aa, Mycobacterium
TELHGTELKSGE

SEQ ID NO: 1229550 - protein, 12 aa, Mycobacterium
TELKPPKEGHSH

SEQ ID NO: 1229551 - protein, 15 aa, Mycobacterium
TELPGSAATPGSRPL

SEQ ID NO: 1229552 - protein, 14 aa, Mycobacterium
TELRPTDPPPGSDP

SEQ ID NO: 1229553 - protein, 7 aa, Mycobacterium
TELSPEH

SEQ ID NO: 1229554 - protein, 6 aa, Mycobacterium
TEMERD

SEQ ID NO: 1229555 - protein, 5 aa, Mycobacterium
TEMPE

SEQ ID NO: 1229556 - protein, 5 aa, Mycobacterium
TENDI

SEQ ID NO: 1229557 - protein, 6 aa, Mycobacterium
TENPLH

SEQ ID NO: 1229558 - protein, 15 aa, Mycobacterium
TENREAADRRRRQSV

SEQ ID NO: 1229559 - protein, 11 aa, Mycobacterium
TEPASTAQPAV

SEQ ID NO: 1229560 - protein, 8 aa, Mycobacterium
TEPATEPV

SEQ ID NO: 1229561 - protein, 17 aa, Mycobacterium
TEPAYAARGGVTVSAQR

SEQ ID NO: 1229562 - protein, 4 aa, Mycobacterium
TEPD

SEQ ID NO: 1229563 - protein, 12 aa, Mycobacterium
TEPDAGSDAFGG

SEQ ID NO: 1229564 - protein, 11 aa, Mycobacterium
TEPDGGSDVAT

SEQ ID NO: 1229565 - protein, 8 aa, Mycobacterium
TEPDGTLS

SEQ ID NO: 1229566 - protein, 7 aa, Mycobacterium
TEPDGTP

SEQ ID NO: 1229567 - protein, 5 aa, Mycobacterium
TEPDM

SEQ ID NO: 1229568 - protein, 9 aa, Mycobacterium
TEPDPGLAG

SEQ ID NO: 1229569 - protein, 24 aa, Mycobacterium
TEPGAGSNPSGLRTKAVRDGDGSC

SEQ ID NO: 1229570 - protein, 5 aa, Mycobacterium
TEPGF

SEQ ID NO: 1229571 - protein, 22 aa, Mycobacterium
TEPGGGSDAGATKTTAKSDGST

SEQ ID NO: 1229572 - protein, 9 aa, Mycobacterium
TEPGGGSDL

SEQ ID NO: 1229573 - protein, 10 aa, Mycobacterium
TEPGGGSDLQ

SEQ ID NO: 1229574 - protein, 9 aa, Mycobacterium
TEPGGLRAG

SEQ ID NO: 1229575 - protein, 9 aa, Mycobacterium
TEPGTGSDL

SEQ ID NO: 1229576 - protein, 12 aa, Mycobacterium
TEPGTGSDLQGI

SEQ ID NO: 1229577 - protein, 9 aa, Mycobacterium
TEPLKDERN

SEQ ID NO: 1229578 - protein, 9 aa, Mycobacterium
TEPNPGGGL

SEQ ID NO: 1229579 - protein, 22 aa, Mycobacterium
TEPPERLTPAEEPERLTPTEVP

SEQ ID NO: 1229580 - protein, 16 aa, Mycobacterium
TEPPSRADFDADSSRY

SEQ ID NO: 1229581 - protein, 6 aa, Mycobacterium
TEPQRE

SEQ ID NO: 1229582 - protein, 5 aa, Mycobacterium
TEPQV

SEQ ID NO: 1229583 - protein, 6 aa, Mycobacterium
TEPRMR

SEQ ID NO: 1229584 - protein, 6 aa, Mycobacterium
TEPSAI

SEQ ID NO: 1229585 - protein, 5 aa, Mycobacterium
TEPSR

SEQ ID NO: 1229586 - protein, 9 aa, Mycobacterium
TEPSRARTT

SEQ ID NO: 1229587 - protein, 6 aa, Mycobacterium
TEPTHA

SEQ ID NO: 1229588 - protein, 10 aa, Mycobacterium
TEPTSGTARV

SEQ ID NO: 1229589 - protein, 14 aa, Mycobacterium
TEPVPSSNRISAGA

SEQ ID NO: 1229590 - protein, 15 aa, Mycobacterium
TEPVPVGADGSLPAD

SEQ ID NO: 1229591 - protein, 95 aa, Mycobacterium
TEPVQPTPGMASPAAGAAPLSGGGVPTMGGMGGGGMGSGGAPKMPGALGSGGMPGMGSNPLGSGVGQTPDAGIGLPSASGVPGAGSGAGSPAAAF

SEQ ID NO: 1229592 - protein, 12 aa, Mycobacterium
TEPYSLDNERPA

SEQ ID NO: 1229593 - protein, 14 aa, Mycobacterium
TEQASTGKRPTYAS

SEQ ID NO: 1229594 - protein, 6 aa, Mycobacterium
TEQDDV

SEQ ID NO: 1229595 - protein, 14 aa, Mycobacterium
TEQDEAAAAKKPNL

SEQ ID NO: 1229596 - protein, 5 aa, Mycobacterium
TEQEG

SEQ ID NO: 1229597 - protein, 7 aa, Mycobacterium
TEQHGPH

SEQ ID NO: 1229598 - protein, 32 aa, Mycobacterium
TEQPSSFSAPVGNAGRYGAPRPSPTRPAAGKR

SEQ ID NO: 1229599 - protein, 4 aa, Mycobacterium
TEQQ

SEQ ID NO: 1229600 - protein, 10 aa, Mycobacterium
TEQQAKDEGY

SEQ ID NO: 1229601 - protein, 4 aa, Mycobacterium
TEQR

SEQ ID NO: 1229602 - protein, 7 aa, Mycobacterium
TEQRGRR

SEQ ID NO: 1229603 - protein, 8 aa, Mycobacterium
TEQRNDVD

SEQ ID NO: 1229604 - protein, 7 aa, Mycobacterium
TERAGSL

SEQ ID NO: 1229605 - protein, 5 aa, Mycobacterium
TERAP

SEQ ID NO: 1229606 - protein, 18 aa, Mycobacterium
TERAQPPGARAPSGRAHS

SEQ ID NO: 1229607 - protein, 4 aa, Mycobacterium
TERD

SEQ ID NO: 1229608 - protein, 6 aa, Mycobacterium
TERDGI

SEQ ID NO: 1229609 - protein, 10 aa, Mycobacterium
TEREEGAKTF

SEQ ID NO: 1229610 - protein, 5 aa, Mycobacterium
TERER

SEQ ID NO: 1229611 - protein, 4 aa, Mycobacterium
TERG

SEQ ID NO: 1229612 - protein, 25 aa, Mycobacterium
TERGATRADDRISEAGMEDRKREGY

SEQ ID NO: 1229613 - protein, 5 aa, Mycobacterium
TERGL

SEQ ID NO: 1229614 - protein, 8 aa, Mycobacterium
TERKSSED

SEQ ID NO: 1229615 - protein, 4 aa, Mycobacterium
TERL

SEQ ID NO: 1229616 - protein, 9 aa, Mycobacterium
TERLERKKQ

SEQ ID NO: 1229617 - protein, 5 aa, Mycobacterium
TERPA

SEQ ID NO: 1229618 - protein, 7 aa, Mycobacterium
TERPHGD

SEQ ID NO: 1229619 - protein, 17 aa, Mycobacterium
TERPHQGAVSRGRRNTA

SEQ ID NO: 1229620 - protein, 5 aa, Mycobacterium
TERSA

SEQ ID NO: 1229621 - protein, 5 aa, Mycobacterium
TERSL

SEQ ID NO: 1229622 - protein, 11 aa, Mycobacterium
TERTEDGFGQG

SEQ ID NO: 1229623 - protein, 12 aa, Mycobacterium
TERTGQQSQERA

SEQ ID NO: 1229624 - protein, 8 aa, Mycobacterium
TERTPPPE

SEQ ID NO: 1229625 - protein, 12 aa, Mycobacterium
TERVAAGDPWDE

SEQ ID NO: 1229626 - protein, 12 aa, Mycobacterium
TERVRNEKSLPH

SEQ ID NO: 1229627 - protein, 19 aa, Mycobacterium
TERWPSGIKDGAEFVIPTM

SEQ ID NO: 1229628 - protein, 5 aa, Mycobacterium
TERYN

SEQ ID NO: 1229629 - protein, 16 aa, Mycobacterium
TESADELSDTAARLPA

SEQ ID NO: 1229630 - protein, 5 aa, Mycobacterium
TESAK

SEQ ID NO: 1229631 - protein, 9 aa, Mycobacterium
TESAQRYNT

SEQ ID NO: 1229632 - protein, 9 aa, Mycobacterium
TESAVTPAG

SEQ ID NO: 1229633 - protein, 13 aa, Mycobacterium
TESDAASELRQHV

SEQ ID NO: 1229634 - protein, 12 aa, Mycobacterium
TESDGRTSEGAG

SEQ ID NO: 1229635 - protein, 7 aa, Mycobacterium
TESDPEI

SEQ ID NO: 1229636 - protein, 9 aa, Mycobacterium
TESDSSPRE

SEQ ID NO: 1229637 - protein, 14 aa, Mycobacterium
TESFTATDENDTVE

SEQ ID NO: 1229638 - protein, 6 aa, Mycobacterium
TESGRT

SEQ ID NO: 1229639 - protein, 9 aa, Mycobacterium
TESGTADPL

SEQ ID NO: 1229640 - protein, 7 aa, Mycobacterium
TESIPDA

SEQ ID NO: 1229641 - protein, 9 aa, Mycobacterium
TESNETDQR

SEQ ID NO: 1229642 - protein, 17 aa, Mycobacterium
TESPDDLEKRGAKKTDG

SEQ ID NO: 1229643 - protein, 7 aa, Mycobacterium
TESPQQV

SEQ ID NO: 1229644 - protein, 9 aa, Mycobacterium
TESRPQDSV

SEQ ID NO: 1229645 - protein, 4 aa, Mycobacterium
TESS

SEQ ID NO: 1229646 - protein, 6 aa, Mycobacterium
TESVEA

SEQ ID NO: 1229647 - protein, 4 aa, Mycobacterium
TESY

SEQ ID NO: 1229648 - protein, 13 aa, Mycobacterium
TETADTPRPGEVR

SEQ ID NO: 1229649 - protein, 6 aa, Mycobacterium
TETAGR

SEQ ID NO: 1229650 - protein, 5 aa, Mycobacterium
TETAK

SEQ ID NO: 1229651 - protein, 7 aa, Mycobacterium
TETESMQ

SEQ ID NO: 1229652 - protein, 4 aa, Mycobacterium
TETG

SEQ ID NO: 1229653 - protein, 6 aa, Mycobacterium
TETGEI

SEQ ID NO: 1229654 - protein, 9 aa, Mycobacterium
TETGQSPLA

SEQ ID NO: 1229655 - protein, 7 aa, Mycobacterium
TETGVPE

SEQ ID NO: 1229656 - protein, 5 aa, Mycobacterium
TETHG

SEQ ID NO: 1229657 - protein, 10 aa, Mycobacterium
TETHPTAPSL

SEQ ID NO: 1229658 - protein, 4 aa, Mycobacterium
TETL

SEQ ID NO: 1229659 - protein, 6 aa, Mycobacterium
TETPTL

SEQ ID NO: 1229660 - protein, 6 aa, Mycobacterium
TETQAG

SEQ ID NO: 1229661 - protein, 6 aa, Mycobacterium
TETQPD

SEQ ID NO: 1229662 - protein, 4 aa, Mycobacterium
TETR

SEQ ID NO: 1229663 - protein, 18 aa, Mycobacterium
TETRCTEHRRDNDRYRRQ

SEQ ID NO: 1229664 - protein, 7 aa, Mycobacterium
TETSPVS

SEQ ID NO: 1229665 - protein, 10 aa, Mycobacterium
TETTDTSSKR

SEQ ID NO: 1229666 - protein, 11 aa, Mycobacterium
TETTGKRGGIH

SEQ ID NO: 1229667 - protein, 15 aa, Mycobacterium
TETTGSITQLDGPDH

SEQ ID NO: 1229668 - protein, 7 aa, Mycobacterium
TETTVAN

SEQ ID NO: 1229669 - protein, 15 aa, Mycobacterium
TETWPAKLEELTIGL

SEQ ID NO: 1229670 - protein, 11 aa, Mycobacterium
TETYTSGGASV

SEQ ID NO: 1229671 - protein, 4 aa, Mycobacterium
TEVA

SEQ ID NO: 1229672 - protein, 11 aa, Mycobacterium
TEVDPATPWTA

SEQ ID NO: 1229673 - protein, 8 aa, Mycobacterium
TEVDSGQF

SEQ ID NO: 1229674 - protein, 5 aa, Mycobacterium
TEVEA

SEQ ID NO: 1229675 - protein, 8 aa, Mycobacterium
TEVEDPDG

SEQ ID NO: 1229676 - protein, 6 aa, Mycobacterium
TEVEPE

SEQ ID NO: 1229677 - protein, 20 aa, Mycobacterium
TEVGPAGAKMPVSTGSTEER

SEQ ID NO: 1229678 - protein, 16 aa, Mycobacterium
TEVPSADRTRVEEAAR

SEQ ID NO: 1229679 - protein, 9 aa, Mycobacterium
TEVSAPPVA

SEQ ID NO: 1229680 - protein, 15 aa, Mycobacterium
TEVTPGLESPTIAPL

SEQ ID NO: 1229681 - protein, 9 aa, Mycobacterium
TEWGPTSAT

SEQ ID NO: 1229682 - protein, 5 aa, Mycobacterium
TEWSP

SEQ ID NO: 1229683 - protein, 4 aa, Mycobacterium
TEYD

SEQ ID NO: 1229684 - protein, 7 aa, Mycobacterium
TEYGGKG

SEQ ID NO: 1229685 - protein, 4 aa, Mycobacterium
TEYP

SEQ ID NO: 1229686 - protein, 12 aa, Mycobacterium
TEYRATSDRDTF

SEQ ID NO: 1229687 - protein, 4 aa, Mycobacterium
TFAE

SEQ ID NO: 1229688 - protein, 24 aa, Mycobacterium
TFAGRGAAEFSRRRTAGDAVKADR

SEQ ID NO: 1229689 - protein, 10 aa, Mycobacterium
TFAPETDTDL

SEQ ID NO: 1229690 - protein, 9 aa, Mycobacterium
TFDGQRGAQ

SEQ ID NO: 1229691 - protein, 6 aa, Mycobacterium
TFDGSA

SEQ ID NO: 1229692 - protein, 8 aa, Mycobacterium
TFDSGDPE

SEQ ID NO: 1229693 - protein, 6 aa, Mycobacterium
TFETGR

SEQ ID NO: 1229694 - protein, 6 aa, Mycobacterium
TFETPR

SEQ ID NO: 1229695 - protein, 13 aa, Mycobacterium
TFGAGSGHGPATM

SEQ ID NO: 1229696 - protein, 5 aa, Mycobacterium
TFGSA

SEQ ID NO: 1229697 - protein, 9 aa, Mycobacterium
TFNDSAGDA

SEQ ID NO: 1229698 - protein, 6 aa, Mycobacterium
TFNSTD

SEQ ID NO: 1229699 - protein, 6 aa, Mycobacterium
TFPESA

SEQ ID NO: 1229700 - protein, 4 aa, Mycobacterium
TFPG

SEQ ID NO: 1229701 - protein, 6 aa, Mycobacterium
TFPGGR

SEQ ID NO: 1229702 - protein, 16 aa, Mycobacterium
TFPPASVTGTPKARAR

SEQ ID NO: 1229703 - protein, 16 aa, Mycobacterium
TFPPASVTGTPKGRAR

SEQ ID NO: 1229704 - protein, 5 aa, Mycobacterium
TFRPA

SEQ ID NO: 1229705 - protein, 9 aa, Mycobacterium
TFSDAPDSL

SEQ ID NO: 1229706 - protein, 17 aa, Mycobacterium
TFSPAGSFETDDGENWT

SEQ ID NO: 1229707 - protein, 12 aa, Mycobacterium
TFTGGSPGAFQG

SEQ ID NO: 1229708 - protein, 16 aa, Mycobacterium
TGAAAMSTEIPETVEA

SEQ ID NO: 1229709 - protein, 11 aa, Mycobacterium
TGAADEDDALT

SEQ ID NO: 1229710 - protein, 14 aa, Mycobacterium
TGAADGYARMSGKP

SEQ ID NO: 1229711 - protein, 11 aa, Mycobacterium
TGAAEERLNPL

SEQ ID NO: 1229712 - protein, 8 aa, Mycobacterium
TGAAGDQV

SEQ ID NO: 1229713 - protein, 6 aa, Mycobacterium
TGAAGV

SEQ ID NO: 1229714 - protein, 7 aa, Mycobacterium
TGAAPGL

SEQ ID NO: 1229715 - protein, 7 aa, Mycobacterium
TGAAPVT

SEQ ID NO: 1229716 - protein, 5 aa, Mycobacterium
TGAAQ

SEQ ID NO: 1229717 - protein, 9 aa, Mycobacterium
TGAAQGRVQ

SEQ ID NO: 1229718 - protein, 8 aa, Mycobacterium
TGAARPGS

SEQ ID NO: 1229719 - protein, 9 aa, Mycobacterium
TGAASGIGA

SEQ ID NO: 1229720 - protein, 9 aa, Mycobacterium
TGAATGREA

SEQ ID NO: 1229721 - protein, 11 aa, Mycobacterium
TGADEALTGPE

SEQ ID NO: 1229722 - protein, 14 aa, Mycobacterium
TGADGEDSARGVAG

SEQ ID NO: 1229723 - protein, 15 aa, Mycobacterium
TGADLDAARTAAYST

SEQ ID NO: 1229724 - protein, 10 aa, Mycobacterium
TGADLSPDGE

SEQ ID NO: 1229725 - protein, 10 aa, Mycobacterium
TGADPGQAVE

SEQ ID NO: 1229726 - protein, 8 aa, Mycobacterium
TGADSAPV

SEQ ID NO: 1229727 - protein, 5 aa, Mycobacterium
TGAEA

SEQ ID NO: 1229728 - protein, 8 aa, Mycobacterium
TGAECPPG

SEQ ID NO: 1229729 - protein, 8 aa, Mycobacterium
TGAEERDF

SEQ ID NO: 1229730 - protein, 5 aa, Mycobacterium
TGAEL

SEQ ID NO: 1229731 - protein, 5 aa, Mycobacterium
TGAEP

SEQ ID NO: 1229732 - protein, 10 aa, Mycobacterium
TGAGAGGGIG

SEQ ID NO: 1229733 - protein, 11 aa, Mycobacterium
TGAGERAGYGP

SEQ ID NO: 1229734 - protein, 17 aa, Mycobacterium
TGAGGAALSPAARQTRS

SEQ ID NO: 1229735 - protein, 16 aa, Mycobacterium
TGAGGDGGDGGTGFSQ

SEQ ID NO: 1229736 - protein, 10 aa, Mycobacterium
TGAGKGIGRG

SEQ ID NO: 1229737 - protein, 7 aa, Mycobacterium
TGAGRQL

SEQ ID NO: 1229738 - protein, 9 aa, Mycobacterium
TGAGSDEDF

SEQ ID NO: 1229739 - protein, 9 aa, Mycobacterium
TGAGTAPGL

SEQ ID NO: 1229740 - protein, 6 aa, Mycobacterium
TGAGTV

SEQ ID NO: 1229741 - protein, 5 aa, Mycobacterium
TGAGY

SEQ ID NO: 1229742 - protein, 6 aa, Mycobacterium
TGAHYP

SEQ ID NO: 1229743 - protein, 6 aa, Mycobacterium
TGAIGG

SEQ ID NO: 1229744 - protein, 7 aa, Mycobacterium
TGAKPTA

SEQ ID NO: 1229745 - protein, 8 aa, Mycobacterium
TGAKPTDI

SEQ ID NO: 1229746 - protein, 11 aa, Mycobacterium
TGAKSGQPRVN

SEQ ID NO: 1229747 - protein, 11 aa, Mycobacterium
TGAKSGTSRLS

SEQ ID NO: 1229748 - protein, 9 aa, Mycobacterium
TGALGSEDL

SEQ ID NO: 1229749 - protein, 21 aa, Mycobacterium
TGALGSRSGTLAGTRTAGDTI

SEQ ID NO: 1229750 - protein, 6 aa, Mycobacterium
TGANAQ

SEQ ID NO: 1229751 - protein, 8 aa, Mycobacterium
TGANRPST

SEQ ID NO: 1229752 - protein, 9 aa, Mycobacterium
TGANSSGIV

SEQ ID NO: 1229753 - protein, 11 aa, Mycobacterium
TGANTSRASVG

SEQ ID NO: 1229754 - protein, 9 aa, Mycobacterium
TGAPESRHR

SEQ ID NO: 1229755 - protein, 10 aa, Mycobacterium
TGAPPTDDTF

SEQ ID NO: 1229756 - protein, 11 aa, Mycobacterium
TGAPQPRPAGD

SEQ ID NO: 1229757 - protein, 7 aa, Mycobacterium
TGAPRQK

SEQ ID NO: 1229758 - protein, 8 aa, Mycobacterium
TGAQDVEA

SEQ ID NO: 1229759 - protein, 19 aa, Mycobacterium
TGAQETVAGLEGAAGRGHE

SEQ ID NO: 1229760 - protein, 9 aa, Mycobacterium
TGAQPGTVD

SEQ ID NO: 1229761 - protein, 9 aa, Mycobacterium
TGAQSGKKR

SEQ ID NO: 1229762 - protein, 6 aa, Mycobacterium
TGAQTG

SEQ ID NO: 1229763 - protein, 11 aa, Mycobacterium
TGARSANAGPV

SEQ ID NO: 1229764 - protein, 20 aa, Mycobacterium
TGASAAERAAVESRSLNLGD

SEQ ID NO: 1229765 - protein, 9 aa, Mycobacterium
TGASQNIGE

SEQ ID NO: 1229766 - protein, 8 aa, Mycobacterium
TGASSGIG

SEQ ID NO: 1229767 - protein, 7 aa, Mycobacterium
TGASSGL

SEQ ID NO: 1229768 - protein, 17 aa, Mycobacterium
TGASTTNVQRDRGSRSR

SEQ ID NO: 1229769 - protein, 9 aa, Mycobacterium
TGASVSPPL

SEQ ID NO: 1229770 - protein, 6 aa, Mycobacterium
TGATGE

SEQ ID NO: 1229771 - protein, 4 aa, Mycobacterium
TGAW

SEQ ID NO: 1229772 - protein, 20 aa, Mycobacterium
TGAYTGSLDDAEDALEGQLW

SEQ ID NO: 1229773 - protein, 10 aa, Mycobacterium
TGCAEATRAM

SEQ ID NO: 1229774 - protein, 10 aa, Mycobacterium
TGDADTPNHK

SEQ ID NO: 1229775 - protein, 18 aa, Mycobacterium
TGDAGNPGAAADPASQAG

SEQ ID NO: 1229776 - protein, 9 aa, Mycobacterium
TGDAGYVDD

SEQ ID NO: 1229777 - protein, 9 aa, Mycobacterium
TGDALRDGD

SEQ ID NO: 1229778 - protein, 6 aa, Mycobacterium
TGDARI

SEQ ID NO: 1229779 - protein, 10 aa, Mycobacterium
TGDDGTTGLS

SEQ ID NO: 1229780 - protein, 6 aa, Mycobacterium
TGDDGV

SEQ ID NO: 1229781 - protein, 6 aa, Mycobacterium
TGDDRI

SEQ ID NO: 1229782 - protein, 7 aa, Mycobacterium
TGDEDLG

SEQ ID NO: 1229783 - protein, 8 aa, Mycobacterium
TGDEKAVS

SEQ ID NO: 1229784 - protein, 8 aa, Mycobacterium
TGDEPAPP

SEQ ID NO: 1229785 - protein, 11 aa, Mycobacterium
TGDETTTGPGF

SEQ ID NO: 1229786 - protein, 4 aa, Mycobacterium
TGDG

SEQ ID NO: 1229787 - protein, 14 aa, Mycobacterium
TGDGALDESDPEDI

SEQ ID NO: 1229788 - protein, 10 aa, Mycobacterium
TGDGGEAGSG

SEQ ID NO: 1229789 - protein, 8 aa, Mycobacterium
TGDGPCGE

SEQ ID NO: 1229790 - protein, 7 aa, Mycobacterium
TGDGVPE

SEQ ID NO: 1229791 - protein, 10 aa, Mycobacterium
TGDKGQDAVA

SEQ ID NO: 1229792 - protein, 10 aa, Mycobacterium
TGDLSPGSHP

SEQ ID NO: 1229793 - protein, 6 aa, Mycobacterium
TGDPAI

SEQ ID NO: 1229794 - protein, 12 aa, Mycobacterium
TGDPATTKGEAD

SEQ ID NO: 1229795 - protein, 6 aa, Mycobacterium
TGDPDC

SEQ ID NO: 1229796 - protein, 5 aa, Mycobacterium
TGDPF

SEQ ID NO: 1229797 - protein, 10 aa, Mycobacterium
TGDPGVADRY

SEQ ID NO: 1229798 - protein, 7 aa, Mycobacterium
TGDPLPD

SEQ ID NO: 1229799 - protein, 11 aa, Mycobacterium
TGDPNVPATPI

SEQ ID NO: 1229800 - protein, 12 aa, Mycobacterium
TGDRRPGLRTRE

SEQ ID NO: 1229801 - protein, 4 aa, Mycobacterium
TGDS

SEQ ID NO: 1229802 - protein, 7 aa, Mycobacterium
TGDSGEK

SEQ ID NO: 1229803 - protein, 11 aa, Mycobacterium
TGDSQGNSGGM

SEQ ID NO: 1229804 - protein, 9 aa, Mycobacterium
TGDSSAVMP

SEQ ID NO: 1229805 - protein, 12 aa, Mycobacterium
TGDSTEGVEPMT

SEQ ID NO: 1229806 - protein, 10 aa, Mycobacterium
TGDSTSGQRA

SEQ ID NO: 1229807 - protein, 8 aa, Mycobacterium
TGDTDGFA

SEQ ID NO: 1229808 - protein, 20 aa, Mycobacterium
TGDTGAASQLADDPEEARAA

SEQ ID NO: 1229809 - protein, 8 aa, Mycobacterium
TGDTPVPV

SEQ ID NO: 1229810 - protein, 7 aa, Mycobacterium
TGDTTKI

SEQ ID NO: 1229811 - protein, 26 aa, Mycobacterium
TGDTYYNAPTSGPVQQQNNFGSQTNS

SEQ ID NO: 1229812 - protein, 9 aa, Mycobacterium
TGDVGDATL

SEQ ID NO: 1229813 - protein, 8 aa, Mycobacterium
TGDYTREE

SEQ ID NO: 1229814 - protein, 11 aa, Mycobacterium
TGEAGAQHYSD

SEQ ID NO: 1229815 - protein, 9 aa, Mycobacterium
TGEATGQLA

SEQ ID NO: 1229816 - protein, 5 aa, Mycobacterium
TGEAV

SEQ ID NO: 1229817 - protein, 10 aa, Mycobacterium
TGEGAANQGA

SEQ ID NO: 1229818 - protein, 13 aa, Mycobacterium
TGEGAESLPTDER

SEQ ID NO: 1229819 - protein, 5 aa, Mycobacterium
TGEGK

SEQ ID NO: 1229820 - protein, 5 aa, Mycobacterium
TGEGL

SEQ ID NO: 1229821 - protein, 20 aa, Mycobacterium
TGEGRKDAATARMSGRARDG

SEQ ID NO: 1229822 - protein, 7 aa, Mycobacterium
TGEGSQG

SEQ ID NO: 1229823 - protein, 10 aa, Mycobacterium
TGEGTTGLGK

SEQ ID NO: 1229824 - protein, 14 aa, Mycobacterium
TGEHKPDDWPGPGE

SEQ ID NO: 1229825 - protein, 6 aa, Mycobacterium
TGEIDA

SEQ ID NO: 1229826 - protein, 5 aa, Mycobacterium
TGEIV

SEQ ID NO: 1229827 - protein, 22 aa, Mycobacterium
TGEKARRQPVTSGAQLTAQESQ

SEQ ID NO: 1229828 - protein, 4 aa, Mycobacterium
TGEL

SEQ ID NO: 1229829 - protein, 5 aa, Mycobacterium
TGELT

SEQ ID NO: 1229830 - protein, 6 aa, Mycobacterium
TGEPEP

SEQ ID NO: 1229831 - protein, 20 aa, Mycobacterium
TGEPGPATAGAGAPGSQTLA

SEQ ID NO: 1229832 - protein, 6 aa, Mycobacterium
TGEPLQ

SEQ ID NO: 1229833 - protein, 11 aa, Mycobacterium
TGEPPATEEEL

SEQ ID NO: 1229834 - protein, 6 aa, Mycobacterium
TGEPRI

SEQ ID NO: 1229835 - protein, 8 aa, Mycobacterium
TGEPRSGD

SEQ ID NO: 1229836 - protein, 6 aa, Mycobacterium
TGEPSY

SEQ ID NO: 1229837 - protein, 6 aa, Mycobacterium
TGEPVT

SEQ ID NO: 1229838 - protein, 7 aa, Mycobacterium
TGEPYEP

SEQ ID NO: 1229839 - protein, 7 aa, Mycobacterium
TGEQARA

SEQ ID NO: 1229840 - protein, 5 aa, Mycobacterium
TGEQG

SEQ ID NO: 1229841 - protein, 5 aa, Mycobacterium
TGEQL

SEQ ID NO: 1229842 - protein, 14 aa, Mycobacterium
TGEQLTDTEADGCA

SEQ ID NO: 1229843 - protein, 7 aa, Mycobacterium
TGEREEL

SEQ ID NO: 1229844 - protein, 15 aa, Mycobacterium
TGERPNSQQLATADA

SEQ ID NO: 1229845 - protein, 5 aa, Mycobacterium
TGERS

SEQ ID NO: 1229846 - protein, 10 aa, Mycobacterium
TGESGAVYET

SEQ ID NO: 1229847 - protein, 4 aa, Mycobacterium
TGET

SEQ ID NO: 1229848 - protein, 12 aa, Mycobacterium
TGETAQKRTNSR

SEQ ID NO: 1229849 - protein, 10 aa, Mycobacterium
TGETGTGRTI

SEQ ID NO: 1229850 - protein, 37 aa, Mycobacterium
TGEVRDPSGPAPSGPAPDAAPDSFAGETPEEADKAGE

SEQ ID NO: 1229851 - protein, 12 aa, Mycobacterium
TGEYDDGGPVAG

SEQ ID NO: 1229852 - protein, 5 aa, Mycobacterium
TGEYG

SEQ ID NO: 1229853 - protein, 5 aa, Mycobacterium
TGFGE

SEQ ID NO: 1229854 - protein, 6 aa, Mycobacterium
TGFGSP

SEQ ID NO: 1229855 - protein, 8 aa, Mycobacterium
TGFGTPSD

SEQ ID NO: 1229856 - protein, 11 aa, Mycobacterium
TGFHPSGGASV

SEQ ID NO: 1229857 - protein, 11 aa, Mycobacterium
TGFSEAENISQ

SEQ ID NO: 1229858 - protein, 9 aa, Mycobacterium
TGFSGAERR

SEQ ID NO: 1229859 - protein, 20 aa, Mycobacterium
TGFSRTPGRVRGGAPRLGEH

SEQ ID NO: 1229860 - protein, 8 aa, Mycobacterium
TGFTDEAE

SEQ ID NO: 1229861 - protein, 5 aa, Mycobacterium
TGFTE

SEQ ID NO: 1229862 - protein, 10 aa, Mycobacterium
TGFTEKQLGS

SEQ ID NO: 1229863 - protein, 7 aa, Mycobacterium
TGGAEKI

SEQ ID NO: 1229864 - protein, 9 aa, Mycobacterium
TGGAQVASA

SEQ ID NO: 1229865 - protein, 13 aa, Mycobacterium
TGGASSRIKRFRI

SEQ ID NO: 1229866 - protein, 9 aa, Mycobacterium
TGGATRAPV

SEQ ID NO: 1229867 - protein, 9 aa, Mycobacterium
TGGAVPRTR

SEQ ID NO: 1229868 - protein, 6 aa, Mycobacterium
TGGAWT

SEQ ID NO: 1229869 - protein, 23 aa, Mycobacterium
TGGDDDEMRRYGDGIDKSARYRR

SEQ ID NO: 1229870 - protein, 8 aa, Mycobacterium
TGGDTSAA

SEQ ID NO: 1229871 - protein, 7 aa, Mycobacterium
TGGERGD

SEQ ID NO: 1229872 - protein, 10 aa, Mycobacterium
TGGGAGIGKG

SEQ ID NO: 1229873 - protein, 8 aa, Mycobacterium
TGGGELEG

SEQ ID NO: 1229874 - protein, 15 aa, Mycobacterium
TGGGHADDVKPRAVT

SEQ ID NO: 1229875 - protein, 5 aa, Mycobacterium
TGGGR

SEQ ID NO: 1229876 - protein, 11 aa, Mycobacterium
TGGGRPPGKEF

SEQ ID NO: 1229877 - protein, 9 aa, Mycobacterium
TGGGRPPGL

SEQ ID NO: 1229878 - protein, 8 aa, Mycobacterium
TGGGSGIG

SEQ ID NO: 1229879 - protein, 4 aa, Mycobacterium
TGGH

SEQ ID NO: 1229880 - protein, 9 aa, Mycobacterium
TGGIDSETQ

SEQ ID NO: 1229881 - protein, 7 aa, Mycobacterium
TGGKHRS

SEQ ID NO: 1229882 - protein, 8 aa, Mycobacterium
TGGKQYKV

SEQ ID NO: 1229883 - protein, 9 aa, Mycobacterium
TGGLDGEPV

SEQ ID NO: 1229884 - protein, 5 aa, Mycobacterium
TGGLG

SEQ ID NO: 1229885 - protein, 17 aa, Mycobacterium
TGGPASLPVSGLILGKA

SEQ ID NO: 1229886 - protein, 10 aa, Mycobacterium
TGGPDGTGWP

SEQ ID NO: 1229887 - protein, 6 aa, Mycobacterium
TGGPSY

SEQ ID NO: 1229888 - protein, 5 aa, Mycobacterium
TGGPV

SEQ ID NO: 1229889 - protein, 6 aa, Mycobacterium
TGGQPY

SEQ ID NO: 1229890 - protein, 9 aa, Mycobacterium
TGGRFTGTV

SEQ ID NO: 1229891 - protein, 6 aa, Mycobacterium
TGGRGA

SEQ ID NO: 1229892 - protein, 6 aa, Mycobacterium
TGGRGL

SEQ ID NO: 1229893 - protein, 5 aa, Mycobacterium
TGGRH

SEQ ID NO: 1229894 - protein, 10 aa, Mycobacterium
TGGRPYQDGA

SEQ ID NO: 1229895 - protein, 8 aa, Mycobacterium
TGGRQGQR

SEQ ID NO: 1229896 - protein, 7 aa, Mycobacterium
TGGSAGL

SEQ ID NO: 1229897 - protein, 7 aa, Mycobacterium
TGGSDGI

SEQ ID NO: 1229898 - protein, 6 aa, Mycobacterium
TGGSGH

SEQ ID NO: 1229899 - protein, 20 aa, Mycobacterium
TGGSGRMYKTTSNAHTLTGD

SEQ ID NO: 1229900 - protein, 14 aa, Mycobacterium
TGGSGTSAHVHPDG

SEQ ID NO: 1229901 - protein, 8 aa, Mycobacterium
TGGSPNNM

SEQ ID NO: 1229902 - protein, 8 aa, Mycobacterium
TGGSSPLV

SEQ ID NO: 1229903 - protein, 8 aa, Mycobacterium
TGGTGAER

SEQ ID NO: 1229904 - protein, 8 aa, Mycobacterium
TGGTRVPA

SEQ ID NO: 1229905 - protein, 19 aa, Mycobacterium
TGGTVDPKRFRDSDDPWPG

SEQ ID NO: 1229906 - protein, 4 aa, Mycobacterium
TGGV

SEQ ID NO: 1229907 - protein, 6 aa, Mycobacterium
TGGVPA

SEQ ID NO: 1229908 - protein, 5 aa, Mycobacterium
TGGVT

SEQ ID NO: 1229909 - protein, 19 aa, Mycobacterium
TGHDGGAGTVHANNPAEVP

SEQ ID NO: 1229910 - protein, 20 aa, Mycobacterium
TGHDGGAGTVHANSPAEVPA

SEQ ID NO: 1229911 - protein, 8 aa, Mycobacterium
TGHEGQQA

SEQ ID NO: 1229912 - protein, 6 aa, Mycobacterium
TGHGTA

SEQ ID NO: 1229913 - protein, 8 aa, Mycobacterium
TGHPARAA

SEQ ID NO: 1229914 - protein, 4 aa, Mycobacterium
TGHR

SEQ ID NO: 1229915 - protein, 5 aa, Mycobacterium
TGHRG

SEQ ID NO: 1229916 - protein, 8 aa, Mycobacterium
TGHSDEQL

SEQ ID NO: 1229917 - protein, 8 aa, Mycobacterium
TGHSPSGM

SEQ ID NO: 1229918 - protein, 4 aa, Mycobacterium
TGHT

SEQ ID NO: 1229919 - protein, 19 aa, Mycobacterium
TGHTGNKPVTESLHPASPD

SEQ ID NO: 1229920 - protein, 16 aa, Mycobacterium
TGHVEPRTAARRTLPG

SEQ ID NO: 1229921 - protein, 11 aa, Mycobacterium
TGIDDDDPQAA

SEQ ID NO: 1229922 - protein, 6 aa, Mycobacterium
TGIDPK

SEQ ID NO: 1229923 - protein, 7 aa, Mycobacterium
TGIDSPS

SEQ ID NO: 1229924 - protein, 14 aa, Mycobacterium
TGIEPDKNTPADWR

SEQ ID NO: 1229925 - protein, 21 aa, Mycobacterium
TGIETDTDIASNNDTLAALDA

SEQ ID NO: 1229926 - protein, 7 aa, Mycobacterium
TGIRPPA

SEQ ID NO: 1229927 - protein, 8 aa, Mycobacterium
TGISKSEV

SEQ ID NO: 1229928 - protein, 5 aa, Mycobacterium
TGIST

SEQ ID NO: 1229929 - protein, 10 aa, Mycobacterium
TGKAPPEARA

SEQ ID NO: 1229930 - protein, 19 aa, Mycobacterium
TGKAVDEAMQEEAGDRGLT

SEQ ID NO: 1229931 - protein, 28 aa, Mycobacterium
TGKDPAAYIGDNTRPDAVRTRTLSEETT

SEQ ID NO: 1229932 - protein, 6 aa, Mycobacterium
TGKEST

SEQ ID NO: 1229933 - protein, 14 aa, Mycobacterium
TGKKTTRLRTTPNP

SEQ ID NO: 1229934 - protein, 10 aa, Mycobacterium
TGKPDAIPAV

SEQ ID NO: 1229935 - protein, 8 aa, Mycobacterium
TGKPGKYK

SEQ ID NO: 1229936 - protein, 10 aa, Mycobacterium
TGKPKPAAYA

SEQ ID NO: 1229937 - protein, 11 aa, Mycobacterium
TGKSAADAAQE

SEQ ID NO: 1229938 - protein, 23 aa, Mycobacterium
TGKSGSATLKPRSDINPEGPTTL

SEQ ID NO: 1229939 - protein, 23 aa, Mycobacterium
TGKSGSVTLKPRPDMNPNGPTTL

SEQ ID NO: 1229940 - protein, 15 aa, Mycobacterium
TGKSPVSKDDAQSHA

SEQ ID NO: 1229941 - protein, 20 aa, Mycobacterium
TGKSSSASRAIDTESNLGQY

SEQ ID NO: 1229942 - protein, 12 aa, Mycobacterium
TGKTQKATRSRA

SEQ ID NO: 1229943 - protein, 17 aa, Mycobacterium
TGKTSRITEIEGPSGAV

SEQ ID NO: 1229944 - protein, 5 aa, Mycobacterium
TGKTW

SEQ ID NO: 1229945 - protein, 18 aa, Mycobacterium
TGLDGSEKVDVDGAEHSL

SEQ ID NO: 1229946 - protein, 13 aa, Mycobacterium
TGLDGYDERPDLD

SEQ ID NO: 1229947 - protein, 6 aa, Mycobacterium
TGLDRR

SEQ ID NO: 1229948 - protein, 13 aa, Mycobacterium
TGLEESNAGTAEH

SEQ ID NO: 1229949 - protein, 5 aa, Mycobacterium
TGLGD

SEQ ID NO: 1229950 - protein, 6 aa, Mycobacterium
TGLGGA

SEQ ID NO: 1229951 - protein, 14 aa, Mycobacterium
TGLGLKESKDIVDN

SEQ ID NO: 1229952 - protein, 8 aa, Mycobacterium
TGLGPQKA

SEQ ID NO: 1229953 - protein, 28 aa, Mycobacterium
TGLKPARVTGRAVPSEEKAPYDPARADA

SEQ ID NO: 1229954 - protein, 5 aa, Mycobacterium
TGLSA

SEQ ID NO: 1229955 - protein, 6 aa, Mycobacterium
TGLTED

SEQ ID NO: 1229956 - protein, 5 aa, Mycobacterium
TGLTP

SEQ ID NO: 1229957 - protein, 6 aa, Mycobacterium
TGLTRA

SEQ ID NO: 1229958 - protein, 6 aa, Mycobacterium
TGLVDG

SEQ ID NO: 1229959 - protein, 7 aa, Mycobacterium
TGMSDEE

SEQ ID NO: 1229960 - protein, 8 aa, Mycobacterium
TGNAADKF

SEQ ID NO: 1229961 - protein, 7 aa, Mycobacterium
TGNAEGR

SEQ ID NO: 1229962 - protein, 9 aa, Mycobacterium
TGNDREHSR

SEQ ID NO: 1229963 - protein, 8 aa, Mycobacterium
TGNGGRLD

SEQ ID NO: 1229964 - protein, 13 aa, Mycobacterium
TGNGNNLSGYSNA

SEQ ID NO: 1229965 - protein, 9 aa, Mycobacterium
TGNGPYGPL

SEQ ID NO: 1229966 - protein, 8 aa, Mycobacterium
TGNGTKVL

SEQ ID NO: 1229967 - protein, 5 aa, Mycobacterium
TGNLT

SEQ ID NO: 1229968 - protein, 5 aa, Mycobacterium
TGNRI

SEQ ID NO: 1229969 - protein, 5 aa, Mycobacterium
TGNSA

SEQ ID NO: 1229970 - protein, 4 aa, Mycobacterium
TGNV

SEQ ID NO: 1229971 - protein, 5 aa, Mycobacterium
TGNVG

SEQ ID NO: 1229972 - protein, 8 aa, Mycobacterium
TGNVNGDD

SEQ ID NO: 1229973 - protein, 10 aa, Mycobacterium
TGNYNPKTAR

SEQ ID NO: 1229974 - protein, 10 aa, Mycobacterium
TGPAGRSTDG

SEQ ID NO: 1229975 - protein, 9 aa, Mycobacterium
TGPAPVTNA

SEQ ID NO: 1229976 - protein, 44 aa, Mycobacterium
TGPASKLTVTDATGRRLESGSLARPPNQPPPQVPPYRGPSGERA

SEQ ID NO: 1229977 - protein, 18 aa, Mycobacterium
TGPASKLTVTDATGRRLH

SEQ ID NO: 1229978 - protein, 19 aa, Mycobacterium
TGPAVEAHAGERANPVATG

SEQ ID NO: 1229979 - protein, 6 aa, Mycobacterium
TGPDAF

SEQ ID NO: 1229980 - protein, 5 aa, Mycobacterium
TGPDH

SEQ ID NO: 1229981 - protein, 10 aa, Mycobacterium
TGPDPEGSVD

SEQ ID NO: 1229982 - protein, 6 aa, Mycobacterium
TGPDYR

SEQ ID NO: 1229983 - protein, 8 aa, Mycobacterium
TGPEAEHN

SEQ ID NO: 1229984 - protein, 6 aa, Mycobacterium
TGPEAL

SEQ ID NO: 1229985 - protein, 11 aa, Mycobacterium
TGPENRNELDE

SEQ ID NO: 1229986 - protein, 11 aa, Mycobacterium
TGPEPNPPSEV

SEQ ID NO: 1229987 - protein, 7 aa, Mycobacterium
TGPEREG

SEQ ID NO: 1229988 - protein, 5 aa, Mycobacterium
TGPFP

SEQ ID NO: 1229989 - protein, 9 aa, Mycobacterium
TGPGDDALT

SEQ ID NO: 1229990 - protein, 9 aa, Mycobacterium
TGPGEGATA

SEQ ID NO: 1229991 - protein, 6 aa, Mycobacterium
TGPGIP

SEQ ID NO: 1229992 - protein, 8 aa, Mycobacterium
TGPGPDAV

SEQ ID NO: 1229993 - protein, 9 aa, Mycobacterium
TGPGQAQRS

SEQ ID NO: 1229994 - protein, 8 aa, Mycobacterium
TGPGRPAG

SEQ ID NO: 1229995 - protein, 8 aa, Mycobacterium
TGPGVDAR

SEQ ID NO: 1229996 - protein, 8 aa, Mycobacterium
TGPGVPDV

SEQ ID NO: 1229997 - protein, 19 aa, Mycobacterium
TGPHPYPDSNSEPTPPETA

SEQ ID NO: 1229998 - protein, 4 aa, Mycobacterium
TGPI

SEQ ID NO: 1229999 - protein, 5 aa, Mycobacterium
TGPIT

SEQ ID NO: 1230000 - protein, 10 aa, Mycobacterium
TGPKSVTDDR

SEQ ID NO: 1230001 - protein, 14 aa, Mycobacterium
TGPLSDTGPADRPI

SEQ ID NO: 1230002 - protein, 10 aa, Mycobacterium
TGPNGAGKTT

SEQ ID NO: 1230003 - protein, 8 aa, Mycobacterium
TGPPGADW

SEQ ID NO: 1230004 - protein, 13 aa, Mycobacterium
TGPPGAGKSTTVG

SEQ ID NO: 1230005 - protein, 9 aa, Mycobacterium
TGPPGSGKS

SEQ ID NO: 1230006 - protein, 4 aa, Mycobacterium
TGPQ

SEQ ID NO: 1230007 - protein, 7 aa, Mycobacterium
TGPQGVR

SEQ ID NO: 1230008 - protein, 19 aa, Mycobacterium
TGPQTKRIEKRTVRTAQGA

SEQ ID NO: 1230009 - protein, 10 aa, Mycobacterium
TGPSEDLSRP

SEQ ID NO: 1230010 - protein, 5 aa, Mycobacterium
TGPSR

SEQ ID NO: 1230011 - protein, 10 aa, Mycobacterium
TGPVKRAGGI

SEQ ID NO: 1230012 - protein, 6 aa, Mycobacterium
TGPYTD

SEQ ID NO: 1230013 - protein, 9 aa, Mycobacterium
TGQADQARQ

SEQ ID NO: 1230014 - protein, 5 aa, Mycobacterium
TGQAS

SEQ ID NO: 1230015 - protein, 6 aa, Mycobacterium
TGQATW

SEQ ID NO: 1230016 - protein, 9 aa, Mycobacterium
TGQDCTAAT

SEQ ID NO: 1230017 - protein, 11 aa, Mycobacterium
TGQDTRRGTFT

SEQ ID NO: 1230018 - protein, 103 aa, Mycobacterium
TGQEDEDFEPDTGPSGLRATPPPPPVPDPERRTSFRDPQQSRPGPPPAPPRPQPTNWGQPPGWQPARGPLPPAGAPPQQSRPPESYGPESYGPGGPMAQPGSY

SEQ ID NO: 1230019 - protein, 17 aa, Mycobacterium
TGQGDDLPDGYNRDETV

SEQ ID NO: 1230020 - protein, 14 aa, Mycobacterium
TGQIISNGANKPFP

SEQ ID NO: 1230021 - protein, 4 aa, Mycobacterium
TGQR

SEQ ID NO: 1230022 - protein, 9 aa, Mycobacterium
TGQRCPPGR

SEQ ID NO: 1230023 - protein, 5 aa, Mycobacterium
TGQRG

SEQ ID NO: 1230024 - protein, 8 aa, Mycobacterium
TGQSGAQI

SEQ ID NO: 1230025 - protein, 8 aa, Mycobacterium
TGQSKKVL

SEQ ID NO: 1230026 - protein, 7 aa, Mycobacterium
TGQTKYV

SEQ ID NO: 1230027 - protein, 9 aa, Mycobacterium
TGQTSELKR

SEQ ID NO: 1230028 - protein, 4 aa, Mycobacterium
TGQV

SEQ ID NO: 1230029 - protein, 4 aa, Mycobacterium
TGRA

SEQ ID NO: 1230030 - protein, 9 aa, Mycobacterium
TGRAAEAGA

SEQ ID NO: 1230031 - protein, 7 aa, Mycobacterium
TGRAGDI

SEQ ID NO: 1230032 - protein, 5 aa, Mycobacterium
TGRAL

SEQ ID NO: 1230033 - protein, 18 aa, Mycobacterium
TGRCRPHSATRPPAAAPG

SEQ ID NO: 1230034 - protein, 8 aa, Mycobacterium
TGRDGADL

SEQ ID NO: 1230035 - protein, 9 aa, Mycobacterium
TGRDGLPGT

SEQ ID NO: 1230036 - protein, 8 aa, Mycobacterium
TGRDPGRL

SEQ ID NO: 1230037 - protein, 8 aa, Mycobacterium
TGRDPLQH

SEQ ID NO: 1230038 - protein, 9 aa, Mycobacterium
TGRDPTVPR

SEQ ID NO: 1230039 - protein, 5 aa, Mycobacterium
TGREF

SEQ ID NO: 1230040 - protein, 8 aa, Mycobacterium
TGREGAQE

SEQ ID NO: 1230041 - protein, 8 aa, Mycobacterium
TGRGDTDA

SEQ ID NO: 1230042 - protein, 12 aa, Mycobacterium
TGRGGLPPGFSV

SEQ ID NO: 1230043 - protein, 7 aa, Mycobacterium
TGRGRPV

SEQ ID NO: 1230044 - protein, 10 aa, Mycobacterium
TGRGTAAERL

SEQ ID NO: 1230045 - protein, 10 aa, Mycobacterium
TGRHRVSRPR

SEQ ID NO: 1230046 - protein, 7 aa, Mycobacterium
TGRLATP

SEQ ID NO: 1230047 - protein, 4 aa, Mycobacterium
TGRM

SEQ ID NO: 1230048 - protein, 4 aa, Mycobacterium
TGRN

SEQ ID NO: 1230049 - protein, 7 aa, Mycobacterium
TGRNQHG

SEQ ID NO: 1230050 - protein, 6 aa, Mycobacterium
TGRPAA

SEQ ID NO: 1230051 - protein, 8 aa, Mycobacterium
TGRPASIG

SEQ ID NO: 1230052 - protein, 8 aa, Mycobacterium
TGRPDPAV

SEQ ID NO: 1230053 - protein, 32 aa, Mycobacterium
TGRPLQPGSLARPPTTPPPEVNPYPGTSGERA

SEQ ID NO: 1230054 - protein, 7 aa, Mycobacterium
TGRQERS

SEQ ID NO: 1230055 - protein, 13 aa, Mycobacterium
TGRRAAEAPTGAK

SEQ ID NO: 1230056 - protein, 6 aa, Mycobacterium
TGRRPH

SEQ ID NO: 1230057 - protein, 8 aa, Mycobacterium
TGRRPTPQ

SEQ ID NO: 1230058 - protein, 5 aa, Mycobacterium
TGRRR

SEQ ID NO: 1230059 - protein, 12 aa, Mycobacterium
TGRRSGKTYTTP

SEQ ID NO: 1230060 - protein, 12 aa, Mycobacterium
TGRRSQPSRPSG

SEQ ID NO: 1230061 - protein, 6 aa, Mycobacterium
TGRRTT

SEQ ID NO: 1230062 - protein, 9 aa, Mycobacterium
TGRSAAEPV

SEQ ID NO: 1230063 - protein, 10 aa, Mycobacterium
TGRSTPVEEL

SEQ ID NO: 1230064 - protein, 6 aa, Mycobacterium
TGRTAV

SEQ ID NO: 1230065 - protein, 6 aa, Mycobacterium
TGRTAY

SEQ ID NO: 1230066 - protein, 8 aa, Mycobacterium
TGRTDPAV

SEQ ID NO: 1230067 - protein, 8 aa, Mycobacterium
TGRVEGRS

SEQ ID NO: 1230068 - protein, 19 aa, Mycobacterium
TGRVGAEPLTDSPSEFPRH

SEQ ID NO: 1230069 - protein, 9 aa, Mycobacterium
TGRYTTAAE

SEQ ID NO: 1230070 - protein, 4 aa, Mycobacterium
TGSA

SEQ ID NO: 1230071 - protein, 23 aa, Mycobacterium
TGSAAEATLDGEAPAREETDAEL

SEQ ID NO: 1230072 - protein, 6 aa, Mycobacterium
TGSAAH

SEQ ID NO: 1230073 - protein, 25 aa, Mycobacterium
TGSAAPVGAQPPIVTDDGPAAEDAH

SEQ ID NO: 1230074 - protein, 7 aa, Mycobacterium
TGSADAV

SEQ ID NO: 1230075 - protein, 23 aa, Mycobacterium
TGSARTAAELSPAEKDASSHRGR

SEQ ID NO: 1230076 - protein, 9 aa, Mycobacterium
TGSARTRGQ

SEQ ID NO: 1230077 - protein, 7 aa, Mycobacterium
TGSATDL

SEQ ID NO: 1230078 - protein, 8 aa, Mycobacterium
TGSATDLR

SEQ ID NO: 1230079 - protein, 11 aa, Mycobacterium
TGSDDGTQDKI

SEQ ID NO: 1230080 - protein, 9 aa, Mycobacterium
TGSDGPKGI

SEQ ID NO: 1230081 - protein, 11 aa, Mycobacterium
TGSDPDSGQAI

SEQ ID NO: 1230082 - protein, 8 aa, Mycobacterium
TGSEAVEN

SEQ ID NO: 1230083 - protein, 8 aa, Mycobacterium
TGSEGGRP

SEQ ID NO: 1230084 - protein, 9 aa, Mycobacterium
TGSEGPRGI

SEQ ID NO: 1230085 - protein, 5 aa, Mycobacterium
TGSFG

SEQ ID NO: 1230086 - protein, 14 aa, Mycobacterium
TGSGATSPTTLSPG

SEQ ID NO: 1230087 - protein, 6 aa, Mycobacterium
TGSGDL

SEQ ID NO: 1230088 - protein, 7 aa, Mycobacterium
TGSGSYA

SEQ ID NO: 1230089 - protein, 10 aa, Mycobacterium
TGSGVGQPRG

SEQ ID NO: 1230090 - protein, 7 aa, Mycobacterium
TGSIGTQ

SEQ ID NO: 1230091 - protein, 6 aa, Mycobacterium
TGSLDD

SEQ ID NO: 1230092 - protein, 8 aa, Mycobacterium
TGSPDTTR

SEQ ID NO: 1230093 - protein, 15 aa, Mycobacterium
TGSPPSEPSAQAGQI

SEQ ID NO: 1230094 - protein, 7 aa, Mycobacterium
TGSPRTV

SEQ ID NO: 1230095 - protein, 29 aa, Mycobacterium
TGSPSPTAGPDEQGSGHGSGTQAGGETLT

SEQ ID NO: 1230096 - protein, 10 aa, Mycobacterium
TGSPTKTAAR

SEQ ID NO: 1230097 - protein, 6 aa, Mycobacterium
TGSQAV

SEQ ID NO: 1230098 - protein, 14 aa, Mycobacterium
TGSQVTQPPDARHD

SEQ ID NO: 1230099 - protein, 5 aa, Mycobacterium
TGSRA

SEQ ID NO: 1230100 - protein, 17 aa, Mycobacterium
TGSRHPEQAERQKEGHK

SEQ ID NO: 1230101 - protein, 10 aa, Mycobacterium
TGSRVDPGER

SEQ ID NO: 1230102 - protein, 10 aa, Mycobacterium
TGSSGRRGRV

SEQ ID NO: 1230103 - protein, 11 aa, Mycobacterium
TGSSNLEAERR

SEQ ID NO: 1230104 - protein, 8 aa, Mycobacterium
TGSSRGLG

SEQ ID NO: 1230105 - protein, 5 aa, Mycobacterium
TGSTA

SEQ ID NO: 1230106 - protein, 6 aa, Mycobacterium
TGSTAV

SEQ ID NO: 1230107 - protein, 8 aa, Mycobacterium
TGSTAVGR

SEQ ID NO: 1230108 - protein, 10 aa, Mycobacterium
TGSTGPAKPS

SEQ ID NO: 1230109 - protein, 7 aa, Mycobacterium
TGSTGVG

SEQ ID NO: 1230110 - protein, 8 aa, Mycobacterium
TGSTGVGR

SEQ ID NO: 1230111 - protein, 7 aa, Mycobacterium
TGSTGVQ

SEQ ID NO: 1230112 - protein, 5 aa, Mycobacterium
TGSTL

SEQ ID NO: 1230113 - protein, 9 aa, Mycobacterium
TGSTNTGRA

SEQ ID NO: 1230114 - protein, 18 aa, Mycobacterium
TGSTPSGWYTGRDSPHTR

SEQ ID NO: 1230115 - protein, 10 aa, Mycobacterium
TGSTSGLGAG

SEQ ID NO: 1230116 - protein, 5 aa, Mycobacterium
TGSVA

SEQ ID NO: 1230117 - protein, 7 aa, Mycobacterium
TGSVGAG

SEQ ID NO: 1230118 - protein, 10 aa, Mycobacterium
TGSVQGDPRF

SEQ ID NO: 1230119 - protein, 8 aa, Mycobacterium
TGSWGGAA

SEQ ID NO: 1230120 - protein, 9 aa, Mycobacterium
TGTAANGQR

SEQ ID NO: 1230121 - protein, 8 aa, Mycobacterium
TGTDDFGR

SEQ ID NO: 1230122 - protein, 11 aa, Mycobacterium
TGTDEDDPWSP

SEQ ID NO: 1230123 - protein, 13 aa, Mycobacterium
TGTDRTATLQSPL

SEQ ID NO: 1230124 - protein, 12 aa, Mycobacterium
TGTEPGDPTKAG

SEQ ID NO: 1230125 - protein, 8 aa, Mycobacterium
TGTEQRYG

SEQ ID NO: 1230126 - protein, 4 aa, Mycobacterium
TGTG

SEQ ID NO: 1230127 - protein, 7 aa, Mycobacterium
TGTGETC

SEQ ID NO: 1230128 - protein, 8 aa, Mycobacterium
TGTGRQGD

SEQ ID NO: 1230129 - protein, 21 aa, Mycobacterium
TGTGSRATVNSSDSRATVEGD

SEQ ID NO: 1230130 - protein, 9 aa, Mycobacterium
TGTGVPADE

SEQ ID NO: 1230131 - protein, 11 aa, Mycobacterium
TGTHPRTRTEA

SEQ ID NO: 1230132 - protein, 9 aa, Mycobacterium
TGTIPSKTL

SEQ ID NO: 1230133 - protein, 20 aa, Mycobacterium
TGTKSYRLRTSKTTTRTKRA

SEQ ID NO: 1230134 - protein, 17 aa, Mycobacterium
TGTLRESRVEPLRKHRF

SEQ ID NO: 1230135 - protein, 12 aa, Mycobacterium
TGTLTNHETGEV

SEQ ID NO: 1230136 - protein, 6 aa, Mycobacterium
TGTPAV

SEQ ID NO: 1230137 - protein, 7 aa, Mycobacterium
TGTPGRP

SEQ ID NO: 1230138 - protein, 5 aa, Mycobacterium
TGTPH

SEQ ID NO: 1230139 - protein, 9 aa, Mycobacterium
TGTPPNHHA

SEQ ID NO: 1230140 - protein, 8 aa, Mycobacterium
TGTPVSPG

SEQ ID NO: 1230141 - protein, 4 aa, Mycobacterium
TGTQ

SEQ ID NO: 1230142 - protein, 8 aa, Mycobacterium
TGTQGEPM

SEQ ID NO: 1230143 - protein, 25 aa, Mycobacterium
TGTQLRGSGDGPGIAAQNPSAHPAL

SEQ ID NO: 1230144 - protein, 9 aa, Mycobacterium
TGTRAHSAR

SEQ ID NO: 1230145 - protein, 11 aa, Mycobacterium
TGTRDDGLPDY

SEQ ID NO: 1230146 - protein, 17 aa, Mycobacterium
TGTRHPEQRERQAAGNA

SEQ ID NO: 1230147 - protein, 10 aa, Mycobacterium
TGTSGKTTTT

SEQ ID NO: 1230148 - protein, 11 aa, Mycobacterium
TGTSRAKPSTR

SEQ ID NO: 1230149 - protein, 30 aa, Mycobacterium
TGTSRGSTTRGAPACAAGRGGAGAGTTSGI

SEQ ID NO: 1230150 - protein, 20 aa, Mycobacterium
TGTSSASAPVTNPATGTVTG

SEQ ID NO: 1230151 - protein, 16 aa, Mycobacterium
TGTSTARRWSRHPSCG

SEQ ID NO: 1230152 - protein, 14 aa, Mycobacterium
TGTTKSDRTGTGTR

SEQ ID NO: 1230153 - protein, 7 aa, Mycobacterium
TGTTPAT

SEQ ID NO: 1230154 - protein, 8 aa, Mycobacterium
TGTTRPEN

SEQ ID NO: 1230155 - protein, 5 aa, Mycobacterium
TGTTV

SEQ ID NO: 1230156 - protein, 7 aa, Mycobacterium
TGTTVVG

SEQ ID NO: 1230157 - protein, 8 aa, Mycobacterium
TGTTVVPD

SEQ ID NO: 1230158 - protein, 6 aa, Mycobacterium
TGTVGV

SEQ ID NO: 1230159 - protein, 10 aa, Mycobacterium
TGTVRERQLD

SEQ ID NO: 1230160 - protein, 23 aa, Mycobacterium
TGTWNSDAGYDLEDNQDYAETEQ

SEQ ID NO: 1230161 - protein, 9 aa, Mycobacterium
TGVAGPAAA

SEQ ID NO: 1230162 - protein, 8 aa, Mycobacterium
TGVAPGAV

SEQ ID NO: 1230163 - protein, 6 aa, Mycobacterium
TGVDRR

SEQ ID NO: 1230164 - protein, 5 aa, Mycobacterium
TGVDT

SEQ ID NO: 1230165 - protein, 24 aa, Mycobacterium
TGVETAEPLHTPSVGVRDDGVSKS

SEQ ID NO: 1230166 - protein, 9 aa, Mycobacterium
TGVGGAETL

SEQ ID NO: 1230167 - protein, 18 aa, Mycobacterium
TGVGHGRSCERRHRGPRR

SEQ ID NO: 1230168 - protein, 6 aa, Mycobacterium
TGVGRT

SEQ ID NO: 1230169 - protein, 12 aa, Mycobacterium
TGVLGSPNAGDV

SEQ ID NO: 1230170 - protein, 5 aa, Mycobacterium
TGVPG

SEQ ID NO: 1230171 - protein, 5 aa, Mycobacterium
TGVQR

SEQ ID NO: 1230172 - protein, 8 aa, Mycobacterium
TGVQTGEL

SEQ ID NO: 1230173 - protein, 10 aa, Mycobacterium
TGVRDPDGSV

SEQ ID NO: 1230174 - protein, 25 aa, Mycobacterium
TGVRLEGPKPRWARPDGGEAGLHPS

SEQ ID NO: 1230175 - protein, 7 aa, Mycobacterium
TGVSASQ

SEQ ID NO: 1230176 - protein, 4 aa, Mycobacterium
TGVV

SEQ ID NO: 1230177 - protein, 10 aa, Mycobacterium
TGWDADGGYA

SEQ ID NO: 1230178 - protein, 8 aa, Mycobacterium
TGWGTGND

SEQ ID NO: 1230179 - protein, 20 aa, Mycobacterium
TGWPQPPDGWRRSDGARADD

SEQ ID NO: 1230180 - protein, 7 aa, Mycobacterium
TGWPSGL

SEQ ID NO: 1230181 - protein, 14 aa, Mycobacterium
TGWTENRSLPDRTA

SEQ ID NO: 1230182 - protein, 7 aa, Mycobacterium
TGYADEA

SEQ ID NO: 1230183 - protein, 30 aa, Mycobacterium; identical to SEQ ID NO: 596242

SEQ ID NO: 1230184 - protein, 19 aa, Mycobacterium
TGYPPLADEPPGRVRPTEA

SEQ ID NO: 1230185 - protein, 4 aa, Mycobacterium
TGYR

SEQ ID NO: 1230186 - protein, 6 aa, Mycobacterium
TGYTGE

SEQ ID NO: 1230187 - protein, 5 aa, Mycobacterium
TGYTS

SEQ ID NO: 1230188 - protein, 4 aa, Mycobacterium
TGYV

SEQ ID NO: 1230189 - protein, 12 aa, Mycobacterium
THAARHGGDVPP

SEQ ID NO: 1230190 - protein, 4 aa, Mycobacterium
THAN

SEQ ID NO: 1230191 - protein, 7 aa, Mycobacterium
THARSTA

SEQ ID NO: 1230192 - protein, 9 aa, Mycobacterium
THATEPRMK

SEQ ID NO: 1230193 - protein, 9 aa, Mycobacterium
THDAETSRL

SEQ ID NO: 1230194 - protein, 10 aa, Mycobacterium
THDCEDPNRF

SEQ ID NO: 1230195 - protein, 5 aa, Mycobacterium
THDDG

SEQ ID NO: 1230196 - protein, 6 aa, Mycobacterium
THDEQD

SEQ ID NO: 1230197 - protein, 6 aa, Mycobacterium
THEQSE

SEQ ID NO: 1230198 - protein, 20 aa, Mycobacterium
THERSGRESVKGRVGGRTQE

SEQ ID NO: 1230199 - protein, 5 aa, Mycobacterium
THGAG

SEQ ID NO: 1230200 - protein, 31 aa, Mycobacterium
THGAGRSLQGSQHVTPATRRLAGGSCAHRST

SEQ ID NO: 1230201 - protein, 10 aa, Mycobacterium
THGDSVESAP

SEQ ID NO: 1230202 - protein, 6 aa, Mycobacterium
THGENL

SEQ ID NO: 1230203 - protein, 11 aa, Mycobacterium
THGGPAGGGRL

SEQ ID NO: 1230204 - protein, 7 aa, Mycobacterium
THGGQLG

SEQ ID NO: 1230205 - protein, 12 aa, Mycobacterium
THGGRQANGGLP

SEQ ID NO: 1230206 - protein, 13 aa, Mycobacterium
THGRENGKSRWPN

SEQ ID NO: 1230207 - protein, 19 aa, Mycobacterium
THGRPTDRNAHPHRDASGK

SEQ ID NO: 1230208 - protein, 11 aa, Mycobacterium
THGTGTGLGDP

SEQ ID NO: 1230209 - protein, 5 aa, Mycobacterium
THGTP

SEQ ID NO: 1230210 - protein, 7 aa, Mycobacterium
THGYDTT

SEQ ID NO: 1230211 - protein, 8 aa, Mycobacterium
THGYDTTD

SEQ ID NO: 1230212 - protein, 7 aa, Mycobacterium
THPADSS

SEQ ID NO: 1230213 - protein, 4 aa, Mycobacterium
THPD

SEQ ID NO: 1230214 - protein, 14 aa, Mycobacterium
THPDAEGGKFYGPS

SEQ ID NO: 1230215 - protein, 8 aa, Mycobacterium
THPDAEQL

SEQ ID NO: 1230216 - protein, 6 aa, Mycobacterium
THPDGR

SEQ ID NO: 1230217 - protein, 7 aa, Mycobacterium
THPDGTS

SEQ ID NO: 1230218 - protein, 6 aa, Mycobacterium
THPEPE

SEQ ID NO: 1230219 - protein, 4 aa, Mycobacterium
THPG

SEQ ID NO: 1230220 - protein, 5 aa, Mycobacterium
THPGL

SEQ ID NO: 1230221 - protein, 11 aa, Mycobacterium
THPNYPDRHEP

SEQ ID NO: 1230222 - protein, 4 aa, Mycobacterium
THPQ

SEQ ID NO: 1230223 - protein, 4 aa, Mycobacterium
THPR

SEQ ID NO: 1230224 - protein, 25 aa, Mycobacterium
THPRGDGLRGRPPFPAHAGGSRVDG

SEQ ID NO: 1230225 - protein, 4 aa, Mycobacterium
THPS

SEQ ID NO: 1230226 - protein, 10 aa, Mycobacterium
THRHSDGSPF

SEQ ID NO: 1230227 - protein, 4 aa, Mycobacterium
THRK

SEQ ID NO: 1230228 - protein, 6 aa, Mycobacterium
THRPVG

SEQ ID NO: 1230229 - protein, 6 aa, Mycobacterium
THRRRG

SEQ ID NO: 1230230 - protein, 6 aa, Mycobacterium
THRTSV

SEQ ID NO: 1230231 - protein, 8 aa, Mycobacterium
THSNEHGT

SEQ ID NO: 1230232 - protein, 7 aa, Mycobacterium
THSPAEA

SEQ ID NO: 1230233 - protein, 6 aa, Mycobacterium
THSPEN

SEQ ID NO: 1230234 - protein, 9 aa, Mycobacterium
THSPSRPPR

SEQ ID NO: 1230235 - protein, 8 aa, Mycobacterium
THSQSEWS

SEQ ID NO: 1230236 - protein, 4 aa, Mycobacterium
THSR

SEQ ID NO: 1230237 - protein, 5 aa, Mycobacterium
THSTP

SEQ ID NO: 1230238 - protein, 6 aa, Mycobacterium
THTDHT

SEQ ID NO: 1230239 - protein, 9 aa, Mycobacterium
THVTEPERA

SEQ ID NO: 1230240 - protein, 12 aa, Mycobacterium
TIAASSGATGDE

SEQ ID NO: 1230241 - protein, 6 aa, Mycobacterium
TIADEA

SEQ ID NO: 1230242 - protein, 9 aa, Mycobacterium
TIAGGTSEI

SEQ ID NO: 1230243 - protein, 10 aa, Mycobacterium
TIASGAYQDT

SEQ ID NO: 1230244 - protein, 23 aa, Mycobacterium
TIATSTGTDGVKRPARSGTELTE

SEQ ID NO: 1230245 - protein, 16 aa, Mycobacterium
TIDPDSMPPADGVGAG

SEQ ID NO: 1230246 - protein, 4 aa, Mycobacterium
TIEA

SEQ ID NO: 1230247 - protein, 13 aa, Mycobacterium
TIGAQSEEGGGTT

SEQ ID NO: 1230248 - protein, 21 aa, Mycobacterium
TIGGERSDGGNVAGGVTVPKG

SEQ ID NO: 1230249 - protein, 8 aa, Mycobacterium
TIGPEKAA

SEQ ID NO: 1230250 - protein, 6 aa, Mycobacterium
TIGSDG

SEQ ID NO: 1230251 - protein, 7 aa, Mycobacterium
TIGTRRP

SEQ ID NO: 1230252 - protein, 11 aa, Mycobacterium
TIKGTDPAGRR

SEQ ID NO: 1230253 - protein, 6 aa, Mycobacterium
TINDPG

SEQ ID NO: 1230254 - protein, 7 aa, Mycobacterium
TINSSNV

SEQ ID NO: 1230255 - protein, 5 aa, Mycobacterium
TIPDG

SEQ ID NO: 1230256 - protein, 16 aa, Mycobacterium
TIPGGGPTMWQMWRNP

SEQ ID NO: 1230257 - protein, 16 aa, Mycobacterium
TIPGGGPTMWQMWRRP

SEQ ID NO: 1230258 - protein, 8 aa, Mycobacterium
TIPNRESA

SEQ ID NO: 1230259 - protein, 18 aa, Mycobacterium
TIPPEQAYGPAGGGHRLS

SEQ ID NO: 1230260 - protein, 6 aa, Mycobacterium
TIPQGD

SEQ ID NO: 1230261 - protein, 11 aa, Mycobacterium
TIPRARAPEVR

SEQ ID NO: 1230262 - protein, 6 aa, Mycobacterium
TIPRGG

SEQ ID NO: 1230263 - protein, 5 aa, Mycobacterium
TIPST

SEQ ID NO: 1230264 - protein, 4 aa, Mycobacterium
TIPT

SEQ ID NO: 1230265 - protein, 9 aa, Mycobacterium
TIRGNRDDV

SEQ ID NO: 1230266 - protein, 11 aa, Mycobacterium
TIRNPATGAVA

SEQ ID NO: 1230267 - protein, 7 aa, Mycobacterium
TISPDGK

SEQ ID NO: 1230268 - protein, 8 aa, Mycobacterium
TISPQPAP

SEQ ID NO: 1230269 - protein, 9 aa, Mycobacterium
TISRNGEAI

SEQ ID NO: 1230270 - protein, 4 aa, Mycobacterium
TITD

SEQ ID NO: 1230271 - protein, 9 aa, Mycobacterium
TITDADSDM

SEQ ID NO: 1230272 - protein, 10 aa, Mycobacterium
TITDDATSQI

SEQ ID NO: 1230273 - protein, 9 aa, Mycobacterium
TIYGGSNEI

SEQ ID NO: 1230274 - protein, 6 aa, Mycobacterium
TKAADH

SEQ ID NO: 1230275 - protein, 6 aa, Mycobacterium
TKADLP

SEQ ID NO: 1230276 - protein, 14 aa, Mycobacterium
TKADPEKVNPNGGA

SEQ ID NO: 1230277 - protein, 12 aa, Mycobacterium
TKAEQDAAMGPG

SEQ ID NO: 1230278 - protein, 7 aa, Mycobacterium
TKAKELG

SEQ ID NO: 1230279 - protein, 5 aa, Mycobacterium
TKALA

SEQ ID NO: 1230280 - protein, 6 aa, Mycobacterium
TKALGH

SEQ ID NO: 1230281 - protein, 7 aa, Mycobacterium
TKAQYEE

SEQ ID NO: 1230282 - protein, 7 aa, Mycobacterium
TKARDQL

SEQ ID NO: 1230283 - protein, 8 aa, Mycobacterium
TKAREEVA

SEQ ID NO: 1230284 - protein, 11 aa, Mycobacterium
TKARGSFPSDA

SEQ ID NO: 1230285 - protein, 9 aa, Mycobacterium
TKARTGAEP

SEQ ID NO: 1230286 - protein, 8 aa, Mycobacterium
TKASERAD

SEQ ID NO: 1230287 - protein, 6 aa, Mycobacterium
TKASPW

SEQ ID NO: 1230288 - protein, 12 aa, Mycobacterium
TKATRTDGGYRL

SEQ ID NO: 1230289 - protein, 9 aa, Mycobacterium
TKCSDDQFP

SEQ ID NO: 1230290 - protein, 7 aa, Mycobacterium
TKDAINA

SEQ ID NO: 1230291 - protein, 8 aa, Mycobacterium
TKDEARER

SEQ ID NO: 1230292 - protein, 7 aa, Mycobacterium
TKDESVT

SEQ ID NO: 1230293 - protein, 8 aa, Mycobacterium
TKDGDRCA

SEQ ID NO: 1230294 - protein, 9 aa, Mycobacterium
TKDGTLQGP

SEQ ID NO: 1230295 - protein, 9 aa, Mycobacterium
TKDIESADD

SEQ ID NO: 1230296 - protein, 8 aa, Mycobacterium
TKDPDKFV

SEQ ID NO: 1230297 - protein, 10 aa, Mycobacterium
TKDSETADDI

SEQ ID NO: 1230298 - protein, 6 aa, Mycobacterium
TKEEQI

SEQ ID NO: 1230299 - protein, 6 aa, Mycobacterium
TKETPA

SEQ ID NO: 1230300 - protein, 8 aa, Mycobacterium
TKFPEPDT

SEQ ID NO: 1230301 - protein, 8 aa, Mycobacterium
TKGALTEA

SEQ ID NO: 1230302 - protein, 15 aa, Mycobacterium
TKGAPAERIQHDPLA

SEQ ID NO: 1230303 - protein, 6 aa, Mycobacterium
TKGATH

SEQ ID NO: 1230304 - protein, 11 aa, Mycobacterium
TKGDPDRYRQA

SEQ ID NO: 1230305 - protein, 8 aa, Mycobacterium
TKGETDAE

SEQ ID NO: 1230306 - protein, 13 aa, Mycobacterium
TKGFNTGEPHSPV

SEQ ID NO: 1230307 - protein, 13 aa, Mycobacterium
TKGLTVTPDPSMG

SEQ ID NO: 1230308 - protein, 7 aa, Mycobacterium
TKGPVSL

SEQ ID NO: 1230309 - protein, 4 aa, Mycobacterium
TKGV

SEQ ID NO: 1230310 - protein, 7 aa, Mycobacterium
TKHPDQA

SEQ ID NO: 1230311 - protein, 4 aa, Mycobacterium
TKIA

SEQ ID NO: 1230312 - protein, 5 aa, Mycobacterium
TKKAG

SEQ ID NO: 1230313 - protein, 7 aa, Mycobacterium
TKKETPS

SEQ ID NO: 1230314 - protein, 9 aa, Mycobacterium
TKLRPSARV

SEQ ID NO: 1230315 - protein, 5 aa, Mycobacterium
TKNGW

SEQ ID NO: 1230316 - protein, 6 aa, Mycobacterium
TKNREA

SEQ ID NO: 1230317 - protein, 14 aa, Mycobacterium
TKPDMTPATDADLD

SEQ ID NO: 1230318 - protein, 15 aa, Mycobacterium
TKPESLGQAGRWQSP

SEQ ID NO: 1230319 - protein, 18 aa, Mycobacterium
TKPGALPGATALAQAKAR

SEQ ID NO: 1230320 - protein, 7 aa, Mycobacterium
TKPNEDP

SEQ ID NO: 1230321 - protein, 7 aa, Mycobacterium
TKPPQRI

SEQ ID NO: 1230322 - protein, 8 aa, Mycobacterium
TKPPRALA

SEQ ID NO: 1230323 - protein, 28 aa, Mycobacterium
TKPTDGDRVPTSVSPVANGLPPAPQPDK

SEQ ID NO: 1230324 - protein, 16 aa, Mycobacterium
TKPTDRHAAEYAEDVR

SEQ ID NO: 1230325 - protein, 21 aa, Mycobacterium
TKPTEYAEGKGFGSTEAARGA

SEQ ID NO: 1230326 - protein, 8 aa, Mycobacterium
TKPTRPDL

SEQ ID NO: 1230327 - protein, 7 aa, Mycobacterium
TKPYQRH

SEQ ID NO: 1230328 - protein, 9 aa, Mycobacterium
TKPYTSGGA

SEQ ID NO: 1230329 - protein, 4 aa, Mycobacterium
TKQC

SEQ ID NO: 1230330 - protein, 26 aa, Mycobacterium
TKQMTKSAKGTIDQPGRRVAAKSGLN

SEQ ID NO: 1230331 - protein, 9 aa, Mycobacterium
TKRDGGVLS

SEQ ID NO: 1230332 - protein, 5 aa, Mycobacterium
TKRGD

SEQ ID NO: 1230333 - protein, 11 aa, Mycobacterium
TKRGPQLPREQ

SEQ ID NO: 1230334 - protein, 10 aa, Mycobacterium
TKRPLDAQGV

SEQ ID NO: 1230335 - protein, 12 aa, Mycobacterium
TKRQGYEQRAQS

SEQ ID NO: 1230336 - protein, 16 aa, Mycobacterium
TKRRDAVRRAREVGIL

SEQ ID NO: 1230337 - protein, 17 aa, Mycobacterium
TKRRSGREQLASGDVEA

SEQ ID NO: 1230338 - protein, 10 aa, Mycobacterium
TKSAATPWYE

SEQ ID NO: 1230339 - protein, 12 aa, Mycobacterium
TKSELPQSVPES

SEQ ID NO: 1230340 - protein, 6 aa, Mycobacterium
TKSGET

SEQ ID NO: 1230341 - protein, 17 aa, Mycobacterium
TKSGRFGIPRDSTPTTA

SEQ ID NO: 1230342 - protein, 4 aa, Mycobacterium
TKSL

SEQ ID NO: 1230343 - protein, 10 aa, Mycobacterium
TKSPEGAATI

SEQ ID NO: 1230344 - protein, 8 aa, Mycobacterium
TKSPGGAW

SEQ ID NO: 1230345 - protein, 8 aa, Mycobacterium
TKSREAEA

SEQ ID NO: 1230346 - protein, 5 aa, Mycobacterium
TKSTL

SEQ ID NO: 1230347 - protein, 7 aa, Mycobacterium
TKTDVDA

SEQ ID NO: 1230348 - protein, 8 aa, Mycobacterium
TKTKDEAM

SEQ ID NO: 1230349 - protein, 9 aa, Mycobacterium
TKTPRREAL

SEQ ID NO: 1230350 - protein, 8 aa, Mycobacterium
TKTSGVEE

SEQ ID NO: 1230351 - protein, 4 aa, Mycobacterium
TKVG

SEQ ID NO: 1230352 - protein, 6 aa, Mycobacterium
TKVGEE

SEQ ID NO: 1230353 - protein, 8 aa, Mycobacterium
TKVGEEIA

SEQ ID NO: 1230354 - protein, 6 aa, Mycobacterium
TKVGRR

SEQ ID NO: 1230355 - protein, 6 aa, Mycobacterium
TKVSRA

SEQ ID NO: 1230356 - protein, 16 aa, Mycobacterium
TKVTPPEHAAEDYAES

SEQ ID NO: 1230357 - protein, 11 aa, Mycobacterium
TKYGATPANSV

SEQ ID NO: 1230358 - protein, 4 aa, Mycobacterium
TKYR

SEQ ID NO: 1230359 - protein, 13 aa, Mycobacterium
TLAAAGPPLAEQP

SEQ ID NO: 1230360 - protein, 7 aa, Mycobacterium
TLAAEDR

SEQ ID NO: 1230361 - protein, 19 aa, Mycobacterium
TLAAGSDRTIEAKLIANHD

SEQ ID NO: 1230362 - protein, 6 aa, Mycobacterium
TLADDT

SEQ ID NO: 1230363 - protein, 8 aa, Mycobacterium
TLADGTPV

SEQ ID NO: 1230364 - protein, 7 aa, Mycobacterium
TLADRRG

SEQ ID NO: 1230365 - protein, 4 aa, Mycobacterium
TLAE

SEQ ID NO: 1230366 - protein, 5 aa, Mycobacterium
TLAGR

SEQ ID NO: 1230367 - protein, 18 aa, Mycobacterium
TLAGRSEEDGESGFSDGT

SEQ ID NO: 1230368 - protein, 7 aa, Mycobacterium
TLAPADA

SEQ ID NO: 1230369 - protein, 6 aa, Mycobacterium
TLAPGD

SEQ ID NO: 1230370 - protein, 13 aa, Mycobacterium
TLAPTGALPGGER

SEQ ID NO: 1230371 - protein, 5 aa, Mycobacterium
TLAQK

SEQ ID NO: 1230372 - protein, 5 aa, Mycobacterium
TLAQQ

SEQ ID NO: 1230373 - protein, 7 aa, Mycobacterium
TLASGGD

SEQ ID NO: 1230374 - protein, 13 aa, Mycobacterium
TLASGGTWCPPSP

SEQ ID NO: 1230375 - protein, 7 aa, Mycobacterium
TLASGSK

SEQ ID NO: 1230376 - protein, 12 aa, Mycobacterium
TLASPETLAGTR

SEQ ID NO: 1230377 - protein, 10 aa, Mycobacterium
TLDDDGNVSY

SEQ ID NO: 1230378 - protein, 13 aa, Mycobacterium
TLDDGGTVGLGTP

SEQ ID NO: 1230379 - protein, 9 aa, Mycobacterium
TLDPATQVN

SEQ ID NO: 1230380 - protein, 10 aa, Mycobacterium
TLDPGESTDV

SEQ ID NO: 1230381 - protein, 6 aa, Mycobacterium
TLDPPL

SEQ ID NO: 1230382 - protein, 9 aa, Mycobacterium
TLDPSNRCD

SEQ ID NO: 1230383 - protein, 9 aa, Mycobacterium
TLDPTSADV

SEQ ID NO: 1230384 - protein, 12 aa, Mycobacterium
TLDRSSLGDVGV

SEQ ID NO: 1230385 - protein, 7 aa, Mycobacterium
TLDTSAP

SEQ ID NO: 1230386 - protein, 4 aa, Mycobacterium
TLED

SEQ ID NO: 1230387 - protein, 8 aa, Mycobacterium
TLEDDGSV

SEQ ID NO: 1230388 - protein, 16 aa, Mycobacterium
TLEDGDPDAVLHAEPA

SEQ ID NO: 1230389 - protein, 5 aa, Mycobacterium
TLEEN

SEQ ID NO: 1230390 - protein, 5 aa, Mycobacterium
TLEES

SEQ ID NO: 1230391 - protein, 15 aa, Mycobacterium
TLEGSGRRLGTDTDR

SEQ ID NO: 1230392 - protein, 5 aa, Mycobacterium
TLEPT

SEQ ID NO: 1230393 - protein, 7 aa, Mycobacterium
TLESNSP

SEQ ID NO: 1230394 - protein, 13 aa, Mycobacterium
TLGDDTSTAPPWD

SEQ ID NO: 1230395 - protein, 11 aa, Mycobacterium
TLGDGRTPDVD

SEQ ID NO: 1230396 - protein, 8 aa, Mycobacterium
TLGDRPEY

SEQ ID NO: 1230397 - protein, 16 aa, Mycobacterium
TLGERPSAPPESGRAE

SEQ ID NO: 1230398 - protein, 4 aa, Mycobacterium
TLGG

SEQ ID NO: 1230399 - protein, 10 aa, Mycobacterium
TLGKEGDDSV

SEQ ID NO: 1230400 - protein, 6 aa, Mycobacterium
TLGKPY

SEQ ID NO: 1230401 - protein, 15 aa, Mycobacterium
TLGKSTEAVRQTAHR

SEQ ID NO: 1230402 - protein, 4 aa, Mycobacterium
TLGP

SEQ ID NO: 1230403 - protein, 6 aa, Mycobacterium
TLGPDE

SEQ ID NO: 1230404 - protein, 8 aa, Mycobacterium
TLGPPSGF

SEQ ID NO: 1230405 - protein, 7 aa, Mycobacterium
TLGPVGA

SEQ ID NO: 1230406 - protein, 5 aa, Mycobacterium
TLGQD

SEQ ID NO: 1230407 - protein, 7 aa, Mycobacterium
TLGRPGG

SEQ ID NO: 1230408 - protein, 9 aa, Mycobacterium
TLGRTPVEQ

SEQ ID NO: 1230409 - protein, 9 aa, Mycobacterium
TLGSDVASG

SEQ ID NO: 1230410 - protein, 5 aa, Mycobacterium
TLGSP

SEQ ID NO: 1230411 - protein, 11 aa, Mycobacterium
TLGTDPRADPR

SEQ ID NO: 1230412 - protein, 7 aa, Mycobacterium
TLHEDPV

SEQ ID NO: 1230413 - protein, 5 aa, Mycobacterium
TLHPR

SEQ ID NO: 1230414 - protein, 9 aa, Mycobacterium
TLKERAAAA

SEQ ID NO: 1230415 - protein, 7 aa, Mycobacterium
TLKPEDR

SEQ ID NO: 1230416 - protein, 8 aa, Mycobacterium
TLKSPGAS

SEQ ID NO: 1230417 - protein, 9 aa, Mycobacterium
TLNPDEPVS

SEQ ID NO: 1230418 - protein, 9 aa, Mycobacterium
TLPATAAPR

SEQ ID NO: 1230419 - protein, 9 aa, Mycobacterium
TLPATPAKT

SEQ ID NO: 1230420 - protein, 7 aa, Mycobacterium
TLPATPG

SEQ ID NO: 1230421 - protein, 6 aa, Mycobacterium
TLPDES

SEQ ID NO: 1230422 - protein, 5 aa, Mycobacterium
TLPDG

SEQ ID NO: 1230423 - protein, 11 aa, Mycobacterium
TLPDGAPHTDL

SEQ ID NO: 1230424 - protein, 15 aa, Mycobacterium
TLPERPSTTSLPDAR

SEQ ID NO: 1230425 - protein, 7 aa, Mycobacterium
TLPGAQA

SEQ ID NO: 1230426 - protein, 8 aa, Mycobacterium
TLPGGQPE

SEQ ID NO: 1230427 - protein, 15 aa, Mycobacterium
TLPGSDAVPAPLPGD

SEQ ID NO: 1230428 - protein, 4 aa, Mycobacterium
TLPN

SEQ ID NO: 1230429 - protein, 6 aa, Mycobacterium
TLPNGT

SEQ ID NO: 1230430 - protein, 19 aa, Mycobacterium
TLPNRDGETMVNADGKATL

SEQ ID NO: 1230431 - protein, 4 aa, Mycobacterium
TLPP

SEQ ID NO: 1230432 - protein, 6 aa, Mycobacterium
TLPPER

SEQ ID NO: 1230433 - protein, 19 aa, Mycobacterium
TLPPESEEYRSQAREAAAK

SEQ ID NO: 1230434 - protein, 8 aa, Mycobacterium
TLPPGMDP

SEQ ID NO: 1230435 - protein, 7 aa, Mycobacterium
TLPPPAG

SEQ ID NO: 1230436 - protein, 22 aa, Mycobacterium
TLPPTDPRYVDGAPGSKVPSVA

SEQ ID NO: 1230437 - protein, 18 aa, Mycobacterium
TLPQRGGARKCSARAKGA

SEQ ID NO: 1230438 - protein, 5 aa, Mycobacterium
TLPRE

SEQ ID NO: 1230439 - protein, 12 aa, Mycobacterium
TLPSTYAKPREL

SEQ ID NO: 1230440 - protein, 9 aa, Mycobacterium
TLPTDTPVY

SEQ ID NO: 1230441 - protein, 12 aa, Mycobacterium
TLPTLPDETGVV

SEQ ID NO: 1230442 - protein, 12 aa, Mycobacterium
TLPTPEARRSVS

SEQ ID NO: 1230443 - protein, 9 aa, Mycobacterium
TLPTPNDDR

SEQ ID NO: 1230444 - protein, 4 aa, Mycobacterium
TLPW

SEQ ID NO: 1230445 - protein, 18 aa, Mycobacterium
TLQAPPKIGIPGRDPDWR

SEQ ID NO: 1230446 - protein, 11 aa, Mycobacterium
TLQGGQPGVSA

SEQ ID NO: 1230447 - protein, 18 aa, Mycobacterium
TLQRTGDIRTPDAVRTGD

SEQ ID NO: 1230448 - protein, 7 aa, Mycobacterium
TLQSGSE

SEQ ID NO: 1230449 - protein, 10 aa, Mycobacterium
TLQSTDGIDP

SEQ ID NO: 1230450 - protein, 6 aa, Mycobacterium
TLRARR

SEQ ID NO: 1230451 - protein, 6 aa, Mycobacterium
TLRDDP

SEQ ID NO: 1230452 - protein, 4 aa, Mycobacterium
TLRG

SEQ ID NO: 1230453 - protein, 9 aa, Mycobacterium
TLRGSRTPD

SEQ ID NO: 1230454 - protein, 7 aa, Mycobacterium
TLRPLPD

SEQ ID NO: 1230455 - protein, 9 aa, Mycobacterium
TLRPNSPGA

SEQ ID NO: 1230456 - protein, 14 aa, Mycobacterium
TLRPPTPAPRLGEH

SEQ ID NO: 1230457 - protein, 9 aa, Mycobacterium
TLRPTRRGW

SEQ ID NO: 1230458 - protein, 4 aa, Mycobacterium
TLRQ

SEQ ID NO: 1230459 - protein, 5 aa, Mycobacterium
TLRRP

SEQ ID NO: 1230460 - protein, 20 aa, Mycobacterium
TLRSPTSGRGAAPMSTRSTS

SEQ ID NO: 1230461 - protein, 5 aa, Mycobacterium
TLSAE

SEQ ID NO: 1230462 - protein, 14 aa, Mycobacterium
TLSDGEGSGVAPTD

SEQ ID NO: 1230463 - protein, 9 aa, Mycobacterium
TLSDPRASF

SEQ ID NO: 1230464 - protein, 6 aa, Mycobacterium
TLSDTR

SEQ ID NO: 1230465 - protein, 8 aa, Mycobacterium
TLSEGERK

SEQ ID NO: 1230466 - protein, 5 aa, Mycobacterium
TLSER

SEQ ID NO: 1230467 - protein, 18 aa, Mycobacterium
TLSGDGENGTGKEHSRVP

SEQ ID NO: 1230468 - protein, 9 aa, Mycobacterium
TLSGGQQQR

SEQ ID NO: 1230469 - protein, 10 aa, Mycobacterium
TLSGRKNPVL

SEQ ID NO: 1230470 - protein, 12 aa, Mycobacterium
TLSLPGADNPDL

SEQ ID NO: 1230471 - protein, 10 aa, Mycobacterium
TLSPDDSVSD

SEQ ID NO: 1230472 - protein, 7 aa, Mycobacterium
TLSPPSP

SEQ ID NO: 1230473 - protein, 9 aa, Mycobacterium
TLSRPGDSF

SEQ ID NO: 1230474 - protein, 7 aa, Mycobacterium
TLSSDPA

SEQ ID NO: 1230475 - protein, 5 aa, Mycobacterium
TLSTA

SEQ ID NO: 1230476 - protein, 10 aa, Mycobacterium
TLSTGGDVSG

SEQ ID NO: 1230477 - protein, 9 aa, Mycobacterium
TLSTSQAAL

SEQ ID NO: 1230478 - protein, 12 aa, Mycobacterium
TLTAEPGEDVID

SEQ ID NO: 1230479 - protein, 8 aa, Mycobacterium
TLTGAHDE

SEQ ID NO: 1230480 - protein, 7 aa, Mycobacterium
TLTGESM

SEQ ID NO: 1230481 - protein, 7 aa, Mycobacterium
TLTGGEL

SEQ ID NO: 1230482 - protein, 6 aa, Mycobacterium
TLTGPQ

SEQ ID NO: 1230483 - protein, 6 aa, Mycobacterium
TLTPAD

SEQ ID NO: 1230484 - protein, 6 aa, Mycobacterium
TLTPQN

SEQ ID NO: 1230485 - protein, 9 aa, Mycobacterium
TLTPSPASA

SEQ ID NO: 1230486 - protein, 5 aa, Mycobacterium
TLTQT

SEQ ID NO: 1230487 - protein, 5 aa, Mycobacterium
TLTRE

SEQ ID NO: 1230488 - protein, 11 aa, Mycobacterium
TLTSAAGRGPA

SEQ ID NO: 1230489 - protein, 8 aa, Mycobacterium
TLTSVDDP

SEQ ID NO: 1230490 - protein, 19 aa, Mycobacterium
TMDGDGSPLSSATAALPSA

SEQ ID NO: 1230491 - protein, 14 aa, Mycobacterium
TMDSGADKAAELAN

SEQ ID NO: 1230492 - protein, 6 aa, Mycobacterium
TMDSPV

SEQ ID NO: 1230493 - protein, 12 aa, Mycobacterium
TMGNTGNSTGPH

SEQ ID NO: 1230494 - protein, 15 aa, Mycobacterium
TMNDGEGSGVAPTDA

SEQ ID NO: 1230495 - protein, 4 aa, Mycobacterium
TMPA

SEQ ID NO: 1230496 - protein, 6 aa, Mycobacterium
TMREQR

SEQ ID NO: 1230497 - protein, 5 aa, Mycobacterium
TMRPG

SEQ ID NO: 1230498 - protein, 17 aa, Mycobacterium
TMRTASGASPASEPKAL

SEQ ID NO: 1230499 - protein, 10 aa, Mycobacterium
TMSQDKTAQV

SEQ ID NO: 1230500 - protein, 15 aa, Mycobacterium
TMSTTEADGVTGGVT

SEQ ID NO: 1230501 - protein, 7 aa, Mycobacterium
TMTATDD

SEQ ID NO: 1230502 - protein, 6 aa, Mycobacterium
TMTSTQ

SEQ ID NO: 1230503 - protein, 14 aa, Mycobacterium
TMTTNGESTSRTTT

SEQ ID NO: 1230504 - protein, 4 aa, Mycobacterium
TNAA

SEQ ID NO: 1230505 - protein, 6 aa, Mycobacterium
TNAAAK

SEQ ID NO: 1230506 - protein, 13 aa, Mycobacterium
TNAARADSGVTDD

SEQ ID NO: 1230507 - protein, 8 aa, Mycobacterium
TNAEAAQR

SEQ ID NO: 1230508 - protein, 23 aa, Mycobacterium
TNAGARTERAERTGRPVDRTNLT

SEQ ID NO: 1230509 - protein, 11 aa, Mycobacterium
TNALRKTKGVV

SEQ ID NO: 1230510 - protein, 13 aa, Mycobacterium
TNAPEIDGLPANG

SEQ ID NO: 1230511 - protein, 5 aa, Mycobacterium
TNAPL

SEQ ID NO: 1230512 - protein, 5 aa, Mycobacterium
TNAPN

SEQ ID NO: 1230513 - protein, 7 aa, Mycobacterium
TNAQRTL

SEQ ID NO: 1230514 - protein, 5 aa, Mycobacterium
TNARA

SEQ ID NO: 1230515 - protein, 9 aa, Mycobacterium
TNARTPAEL

SEQ ID NO: 1230516 - protein, 9 aa, Mycobacterium
TNATESLNA

SEQ ID NO: 1230517 - protein, 16 aa, Mycobacterium
TNATETDADGNLPDTF

SEQ ID NO: 1230518 - protein, 9 aa, Mycobacterium
TNATTTETL

SEQ ID NO: 1230519 - protein, 5 aa, Mycobacterium
TNDDP

SEQ ID NO: 1230520 - protein, 7 aa, Mycobacterium
TNDEQKK

SEQ ID NO: 1230521 - protein, 7 aa, Mycobacterium
TNDKGDV

SEQ ID NO: 1230522 - protein, 16 aa, Mycobacterium
TNDNPEIGADDMPALT

SEQ ID NO: 1230523 - protein, 7 aa, Mycobacterium
TNDPDEI

SEQ ID NO: 1230524 - protein, 7 aa, Mycobacterium
TNDPNLA

SEQ ID NO: 1230525 - protein, 9 aa, Mycobacterium
TNDSERSIE

SEQ ID NO: 1230526 - protein, 15 aa, Mycobacterium
TNDTLTADGDQYSEQ

SEQ ID NO: 1230527 - protein, 12 aa, Mycobacterium
TNEFGWSAVAHR

SEQ ID NO: 1230528 - protein, 6 aa, Mycobacterium
TNEGKE

SEQ ID NO: 1230529 - protein, 10 aa, Mycobacterium
TNENPHPPTR

SEQ ID NO: 1230530 - protein, 4 aa, Mycobacterium
TNEY

SEQ ID NO: 1230531 - protein, 18 aa, Mycobacterium
TNGAAAADIDSGSAESVM

SEQ ID NO: 1230532 - protein, 8 aa, Mycobacterium
TNGAGKST

SEQ ID NO: 1230533 - protein, 5 aa, Mycobacterium
TNGAT

SEQ ID NO: 1230534 - protein, 7 aa, Mycobacterium
TNGDADD

SEQ ID NO: 1230535 - protein, 6 aa, Mycobacterium
TNGDEN

SEQ ID NO: 1230536 - protein, 16 aa, Mycobacterium
TNGDGADPLGSGPAAD

SEQ ID NO: 1230537 - protein, 15 aa, Mycobacterium
TNGQQGLSGLNTPDD

SEQ ID NO: 1230538 - protein, 15 aa, Mycobacterium
TNGQQSADDPLGGAG

SEQ ID NO: 1230539 - protein, 9 aa, Mycobacterium
TNGRGTEQL

SEQ ID NO: 1230540 - protein, 19 aa, Mycobacterium
TNGTAGCDGPLPATPAGAN

SEQ ID NO: 1230541 - protein, 9 aa, Mycobacterium
TNGTPDDEA

SEQ ID NO: 1230542 - protein, 9 aa, Mycobacterium
TNGTPEQQA

SEQ ID NO: 1230543 - protein, 6 aa, Mycobacterium
TNGVTP

SEQ ID NO: 1230544 - protein, 4 aa, Mycobacterium
TNHA

SEQ ID NO: 1230545 - protein, 11 aa, Mycobacterium
TNHKGETERLQ

SEQ ID NO: 1230546 - protein, 4 aa, Mycobacterium
TNHP

SEQ ID NO: 1230547 - protein, 8 aa, Mycobacterium
TNITRDTG

SEQ ID NO: 1230548 - protein, 13 aa, Mycobacterium
TNKAEVEIPSPYA

SEQ ID NO: 1230549 - protein, 15 aa, Mycobacterium
TNKPVEGADPRSGRW

SEQ ID NO: 1230550 - protein, 5 aa, Mycobacterium
TNKRG

SEQ ID NO: 1230551 - protein, 6 aa, Mycobacterium
TNLGGI

SEQ ID NO: 1230552 - protein, 5 aa, Mycobacterium
TNLSY

SEQ ID NO: 1230553 - protein, 18 aa, Mycobacterium
TNNDDPAGACRPFDKDRD

SEQ ID NO: 1230554 - protein, 10 aa, Mycobacterium
TNNDDPPGAC

SEQ ID NO: 1230555 - protein, 11 aa, Mycobacterium
TNNDNDLADHP

SEQ ID NO: 1230556 - protein, 9 aa, Mycobacterium
TNNHATEDM

SEQ ID NO: 1230557 - protein, 8 aa, Mycobacterium
TNPAERDR

SEQ ID NO: 1230558 - protein, 6 aa, Mycobacterium
TNPAKA

SEQ ID NO: 1230559 - protein, 7 aa, Mycobacterium
TNPATAL

SEQ ID NO: 1230560 - protein, 10 aa, Mycobacterium
TNPDGPSHRQ

SEQ ID NO: 1230561 - protein, 7 aa, Mycobacterium
TNPDGSL

SEQ ID NO: 1230562 - protein, 8 aa, Mycobacterium
TNPGDRAT

SEQ ID NO: 1230563 - protein, 7 aa, Mycobacterium
TNPGLSI

SEQ ID NO: 1230564 - protein, 5 aa, Mycobacterium
TNPHT

SEQ ID NO: 1230565 - protein, 5 aa, Mycobacterium
TNPIT

SEQ ID NO: 1230566 - protein, 6 aa, Mycobacterium
TNPPFD

SEQ ID NO: 1230567 - protein, 8 aa, Mycobacterium
TNPPGNPV

SEQ ID NO: 1230568 - protein, 8 aa, Mycobacterium
TNPPGTVS

SEQ ID NO: 1230569 - protein, 7 aa, Mycobacterium
TNPPPGV

SEQ ID NO: 1230570 - protein, 5 aa, Mycobacterium
TNPQI

SEQ ID NO: 1230571 - protein, 8 aa, Mycobacterium
TNPYGNGT

SEQ ID NO: 1230572 - protein, 9 aa, Mycobacterium
TNQPPPQQT

SEQ ID NO: 1230573 - protein, 8 aa, Mycobacterium
TNQQLETA

SEQ ID NO: 1230574 - protein, 8 aa, Mycobacterium
TNQRGGEV

SEQ ID NO: 1230575 - protein, 8 aa, Mycobacterium
TNRAEAAS

SEQ ID NO: 1230576 - protein, 4 aa, Mycobacterium
TNRD

SEQ ID NO: 1230577 - protein, 6 aa, Mycobacterium
TNRDTM

SEQ ID NO: 1230578 - protein, 4 aa, Mycobacterium
TNRE

SEQ ID NO: 1230579 - protein, 5 aa, Mycobacterium
TNREV

SEQ ID NO: 1230580 - protein, 12 aa, Mycobacterium
TNRHEGLQIVFF

SEQ ID NO: 1230581 - protein, 16 aa, Mycobacterium
TNRMNRNAIKAAAAQG

SEQ ID NO: 1230582 - protein, 7 aa, Mycobacterium
TNRSKLS

SEQ ID NO: 1230583 - protein, 23 aa, Mycobacterium
TNRTPPGYQATAANESDPSPADL

SEQ ID NO: 1230584 - protein, 17 aa, Mycobacterium
TNSEIPGVGPSESEVGP

SEQ ID NO: 1230585 - protein, 9 aa, Mycobacterium
TNSPGGQKC

SEQ ID NO: 1230586 - protein, 10 aa, Mycobacterium
TNSSTGATYE

SEQ ID NO: 1230587 - protein, 4 aa, Mycobacterium
TNST

SEQ ID NO: 1230588 - protein, 6 aa, Mycobacterium
TNTGQR

SEQ ID NO: 1230589 - protein, 9 aa, Mycobacterium
TNTLDAKGP

SEQ ID NO: 1230590 - protein, 19 aa, Mycobacterium
TNTNPTTTATTNAAIATTE

SEQ ID NO: 1230591 - protein, 8 aa, Mycobacterium
TNTPMTDD

SEQ ID NO: 1230592 - protein, 10 aa, Mycobacterium
TNTPPQPGQT

SEQ ID NO: 1230593 - protein, 12 aa, Mycobacterium
TNTSELQRHQTT

SEQ ID NO: 1230594 - protein, 7 aa, Mycobacterium
TNTVNYS

SEQ ID NO: 1230595 - protein, 5 aa, Mycobacterium
TNVAP

SEQ ID NO: 1230596 - protein, 4 aa, Mycobacterium
TNVD

SEQ ID NO: 1230597 - protein, 8 aa, Mycobacterium
TNVNTGET

SEQ ID NO: 1230598 - protein, 10 aa, Mycobacterium
TNVPPGESQQ

SEQ ID NO: 1230599 - protein, 8 aa, Mycobacterium
TNVQTGQR

SEQ ID NO: 1230600 - protein, 10 aa, Mycobacterium
TNVSTVEPER

SEQ ID NO: 1230601 - protein, 9 aa, Mycobacterium
TNYDPLGGL

SEQ ID NO: 1230602 - protein, 25 aa, Mycobacterium
TPAAATAAATPARAASAQLSERERE

SEQ ID NO: 1230603 - protein, 8 aa, Mycobacterium
TPAAQREF

SEQ ID NO: 1230604 - protein, 8 aa, Mycobacterium
TPAARAAL

SEQ ID NO: 1230605 - protein, 7 aa, Mycobacterium
TPAAVTE

SEQ ID NO: 1230606 - protein, 11 aa, Mycobacterium
TPADAQQAEWR

SEQ ID NO: 1230607 - protein, 10 aa, Mycobacterium
TPADASTLGQ

SEQ ID NO: 1230608 - protein, 5 aa, Mycobacterium
TPAEA

SEQ ID NO: 1230609 - protein, 12 aa, Mycobacterium
TPAEFQESSITR

SEQ ID NO: 1230610 - protein, 11 aa, Mycobacterium
TPAEFQQNPIT

SEQ ID NO: 1230611 - protein, 12 aa, Mycobacterium
TPAELGGANPDG

SEQ ID NO: 1230612 - protein, 12 aa, Mycobacterium
TPAEQRAAMGPG

SEQ ID NO: 1230613 - protein, 4 aa, Mycobacterium
TPAF

SEQ ID NO: 1230614 - protein, 5 aa, Mycobacterium
TPAGA

SEQ ID NO: 1230615 - protein, 14 aa, Mycobacterium
TPAGAKKHASRARA

SEQ ID NO: 1230616 - protein, 11 aa, Mycobacterium
TPAGAPRAELE

SEQ ID NO: 1230617 - protein, 6 aa, Mycobacterium
TPAGDG

SEQ ID NO: 1230618 - protein, 6 aa, Mycobacterium
TPAGHP

SEQ ID NO: 1230619 - protein, 11 aa, Mycobacterium
TPAGKTDGSIE

SEQ ID NO: 1230620 - protein, 7 aa, Mycobacterium
TPAGLTK

SEQ ID NO: 1230621 - protein, 8 aa, Mycobacterium
TPAGQEFG

SEQ ID NO: 1230622 - protein, 9 aa, Mycobacterium
TPAGSALNK

SEQ ID NO: 1230623 - protein, 14 aa, Mycobacterium
TPAHDKGSSHGGSR

SEQ ID NO: 1230624 - protein, 6 aa, Mycobacterium
TPAIGA

SEQ ID NO: 1230625 - protein, 5 aa, Mycobacterium
TPAIR

SEQ ID NO: 1230626 - protein, 9 aa, Mycobacterium
TPANDDAKA

SEQ ID NO: 1230627 - protein, 7 aa, Mycobacterium
TPAPATT

SEQ ID NO: 1230628 - protein, 13 aa, Mycobacterium
TPAPDPNPLAPAT

SEQ ID NO: 1230629 - protein, 87 aa, Mycobacterium
TPAPEDAAGEEAPAGTAAEDEPETPVEDVEESVEDAVEEDADEASGETGAETPAPAEDTGADGPGTDEPASEPASDEKDSVAASASG

SEQ ID NO: 1230630 - protein, 6 aa, Mycobacterium
TPAPEF

SEQ ID NO: 1230631 - protein, 11 aa, Mycobacterium
TPAPSAASEFP

SEQ ID NO: 1230632 - protein, 21 aa, Mycobacterium
TPAPVTQAPPTATVPPTTQPV

SEQ ID NO: 1230633 - protein, 12 aa, Mycobacterium
TPARLREDTGCQ

SEQ ID NO: 1230634 - protein, 6 aa, Mycobacterium
TPARPD

SEQ ID NO: 1230635 - protein, 9 aa, Mycobacterium
TPARPQVQR

SEQ ID NO: 1230636 - protein, 4 aa, Mycobacterium
TPAS

SEQ ID NO: 1230637 - protein, 5 aa, Mycobacterium
TPATA

SEQ ID NO: 1230638 - protein, 7 aa, Mycobacterium
TPATEPN

SEQ ID NO: 1230639 - protein, 4 aa, Mycobacterium
TPAV

SEQ ID NO: 1230640 - protein, 4 aa, Mycobacterium
TPAY

SEQ ID NO: 1230641 - protein, 5 aa, Mycobacterium
TPAYR

SEQ ID NO: 1230642 - protein, 4 aa, Mycobacterium
TPCE

SEQ ID NO: 1230643 - protein, 6 aa, Mycobacterium
TPDAEE

SEQ ID NO: 1230644 - protein, 9 aa, Mycobacterium
TPDASADAE

SEQ ID NO: 1230645 - protein, 6 aa, Mycobacterium
TPDDEL

SEQ ID NO: 1230646 - protein, 11 aa, Mycobacterium
TPDDLSQDIKD

SEQ ID NO: 1230647 - protein, 5 aa, Mycobacterium
TPDEA

SEQ ID NO: 1230648 - protein, 8 aa, Mycobacterium
TPDGGGPW

SEQ ID NO: 1230649 - protein, 9 aa, Mycobacterium
TPDGGRAQL

SEQ ID NO: 1230650 - protein, 22 aa, Mycobacterium
TPDGPTQPSDSAAPASHTDAPG

SEQ ID NO: 1230651 - protein, 5 aa, Mycobacterium
TPDGR

SEQ ID NO: 1230652 - protein, 8 aa, Mycobacterium
TPDGYAQL

SEQ ID NO: 1230653 - protein, 9 aa, Mycobacterium
TPDHDRQRE

SEQ ID NO: 1230654 - protein, 4 aa, Mycobacterium
TPDL

SEQ ID NO: 1230655 - protein, 5 aa, Mycobacterium
TPDPE

SEQ ID NO: 1230656 - protein, 6 aa, Mycobacterium
TPDPYG

SEQ ID NO: 1230657 - protein, 9 aa, Mycobacterium
TPDQRRAAY

SEQ ID NO: 1230658 - protein, 6 aa, Mycobacterium
TPDRAL

SEQ ID NO: 1230659 - protein, 10 aa, Mycobacterium
TPDRTPEEHA

SEQ ID NO: 1230660 - protein, 6 aa, Mycobacterium
TPDRYS

SEQ ID NO: 1230661 - protein, 11 aa, Mycobacterium
TPDSEGGTDAE

SEQ ID NO: 1230662 - protein, 8 aa, Mycobacterium
TPDTAGRT

SEQ ID NO: 1230663 - protein, 8 aa, Mycobacterium
TPDVPRGR

SEQ ID NO: 1230664 - protein, 5 aa, Mycobacterium
TPEAG

SEQ ID NO: 1230665 - protein, 7 aa, Mycobacterium
TPEAIGG

SEQ ID NO: 1230666 - protein, 5 aa, Mycobacterium
TPEDA

SEQ ID NO: 1230667 - protein, 4 aa, Mycobacterium
TPEE

SEQ ID NO: 1230668 - protein, 10 aa, Mycobacterium
TPEEEAAQTN

SEQ ID NO: 1230669 - protein, 6 aa, Mycobacterium
TPEELQ

SEQ ID NO: 1230670 - protein, 9 aa, Mycobacterium
TPEEVAGQL

SEQ ID NO: 1230671 - protein, 5 aa, Mycobacterium
TPEFG

SEQ ID NO: 1230672 - protein, 5 aa, Mycobacterium
TPEGE

SEQ ID NO: 1230673 - protein, 14 aa, Mycobacterium
TPEGEAATDEHVTD

SEQ ID NO: 1230674 - protein, 5 aa, Mycobacterium
TPEGH

SEQ ID NO: 1230675 - protein, 6 aa, Mycobacterium
TPEGRE

SEQ ID NO: 1230676 - protein, 15 aa, Mycobacterium
TPEHAPEREKINEQH

SEQ ID NO: 1230677 - protein, 7 aa, Mycobacterium
TPEHTAR

SEQ ID NO: 1230678 - protein, 9 aa, Mycobacterium
TPEHTEQAR

SEQ ID NO: 1230679 - protein, 8 aa, Mycobacterium
TPEHTRQA

SEQ ID NO: 1230680 - protein, 12 aa, Mycobacterium
TPEKPDDADNPL

SEQ ID NO: 1230681 - protein, 17 aa, Mycobacterium
TPEPGADEHPSPPSSVT

SEQ ID NO: 1230682 - protein, 8 aa, Mycobacterium
TPEPLERT

SEQ ID NO: 1230683 - protein, 9 aa, Mycobacterium
TPEPPKDLP

SEQ ID NO: 1230684 - protein, 5 aa, Mycobacterium
TPEQA

SEQ ID NO: 1230685 - protein, 13 aa, Mycobacterium
TPEQRAAYTAQAQ

SEQ ID NO: 1230686 - protein, 8 aa, Mycobacterium
TPERAKDL

SEQ ID NO: 1230687 - protein, 13 aa, Mycobacterium
TPERAKDLKQRPA

SEQ ID NO: 1230688 - protein, 5 aa, Mycobacterium
TPERL

SEQ ID NO: 1230689 - protein, 5 aa, Mycobacterium
TPERT

SEQ ID NO: 1230690 - protein, 22 aa, Mycobacterium
TPESFTDPNIANTGLARAGGDA

SEQ ID NO: 1230691 - protein, 22 aa, Mycobacterium
TPETAAAKGYRNLTPASPGTAT

SEQ ID NO: 1230692 - protein, 5 aa, Mycobacterium
TPETT

SEQ ID NO: 1230693 - protein, 13 aa, Mycobacterium
TPFGGYKQSGLGR

SEQ ID NO: 1230694 - protein, 11 aa, Mycobacterium
TPFGPAGDAPT

SEQ ID NO: 1230695 - protein, 5 aa, Mycobacterium
TPFGT

SEQ ID NO: 1230696 - protein, 5 aa, Mycobacterium
TPFRD

SEQ ID NO: 1230697 - protein, 13 aa, Mycobacterium
TPFRNEKNSNWEG

SEQ ID NO: 1230698 - protein, 4 aa, Mycobacterium
TPFT

SEQ ID NO: 1230699 - protein, 9 aa, Mycobacterium
TPGAGEESL

SEQ ID NO: 1230700 - protein, 12 aa, Mycobacterium
TPGAGSAAASVD

SEQ ID NO: 1230701 - protein, 16 aa, Mycobacterium
TPGAGVAPKSTALTKV

SEQ ID NO: 1230702 - protein, 11 aa, Mycobacterium
TPGALRPAAGS

SEQ ID NO: 1230703 - protein, 6 aa, Mycobacterium
TPGAQE

SEQ ID NO: 1230704 - protein, 19 aa, Mycobacterium
TPGARSEKADTIAKWITRR

SEQ ID NO: 1230705 - protein, 4 aa, Mycobacterium
TPGD

SEQ ID NO: 1230706 - protein, 6 aa, Mycobacterium
TPGDRS

SEQ ID NO: 1230707 - protein, 17 aa, Mycobacterium
TPGDVAYSDDDGIVIVT

SEQ ID NO: 1230708 - protein, 7 aa, Mycobacterium
TPGEAAA

SEQ ID NO: 1230709 - protein, 6 aa, Mycobacterium
TPGEGQ

SEQ ID NO: 1230710 - protein, 6 aa, Mycobacterium
TPGGDA

SEQ ID NO: 1230711 - protein, 6 aa, Mycobacterium
TPGGLH

SEQ ID NO: 1230712 - protein, 7 aa, Mycobacterium
TPGGPTE

SEQ ID NO: 1230713 - protein, 5 aa, Mycobacterium
TPGGR

SEQ ID NO: 1230714 - protein, 6 aa, Mycobacterium
TPGGRR

SEQ ID NO: 1230715 - protein, 10 aa, Mycobacterium
TPGGSSTPLL

SEQ ID NO: 1230716 - protein, 6 aa, Mycobacterium
TPGHPA

SEQ ID NO: 1230717 - protein, 17 aa, Mycobacterium
TPGHPFSSSRPSMTGGS

SEQ ID NO: 1230718 - protein, 5 aa, Mycobacterium
TPGHT

SEQ ID NO: 1230719 - protein, 7 aa, Mycobacterium
TPGHTGG

SEQ ID NO: 1230720 - protein, 8 aa, Mycobacterium
TPGKPNID

SEQ ID NO: 1230721 - protein, 26 aa, Mycobacterium
TPGKVRGPAPELGADTAAVLDELGLG

SEQ ID NO: 1230722 - protein, 5 aa, Mycobacterium
TPGLA

SEQ ID NO: 1230723 - protein, 12 aa, Mycobacterium
TPGNSSPLSDGS

SEQ ID NO: 1230724 - protein, 9 aa, Mycobacterium
TPGPDPNDQ

SEQ ID NO: 1230725 - protein, 9 aa, Mycobacterium
TPGPPISTA

SEQ ID NO: 1230726 - protein, 10 aa, Mycobacterium
TPGPRLGPGL

SEQ ID NO: 1230727 - protein, 8 aa, Mycobacterium
TPGPTHEK

SEQ ID NO: 1230728 - protein, 20 aa, Mycobacterium
TPGPVPDAEELKQVKGRGLS

SEQ ID NO: 1230729 - protein, 13 aa, Mycobacterium
TPGQESSLNGPVT

SEQ ID NO: 1230730 - protein, 8 aa, Mycobacterium
TPGQPYTT

SEQ ID NO: 1230731 - protein, 6 aa, Mycobacterium
TPGRDL

SEQ ID NO: 1230732 - protein, 7 aa, Mycobacterium
TPGSGTA

SEQ ID NO: 1230733 - protein, 8 aa, Mycobacterium
TPGSTHEK

SEQ ID NO: 1230734 - protein, 13 aa, Mycobacterium
TPGTAEEFSEAEI

SEQ ID NO: 1230735 - protein, 6 aa, Mycobacterium
TPGTDT

SEQ ID NO: 1230736 - protein, 12 aa, Mycobacterium
TPGTGGVRTDQH

SEQ ID NO: 1230737 - protein, 15 aa, Mycobacterium
TPGTPDVTTFVFMLA

SEQ ID NO: 1230738 - protein, 8 aa, Mycobacterium
TPGTRIPY

SEQ ID NO: 1230739 - protein, 6 aa, Mycobacterium
TPGTTA

SEQ ID NO: 1230740 - protein, 6 aa, Mycobacterium
TPGVEG

SEQ ID NO: 1230741 - protein, 15 aa, Mycobacterium
TPHAEKDPDGEYETV

SEQ ID NO: 1230742 - protein, 13 aa, Mycobacterium
TPHDRPTDQPAAY

SEQ ID NO: 1230743 - protein, 4 aa, Mycobacterium
TPHK

SEQ ID NO: 1230744 - protein, 4 aa, Mycobacterium
TPHL

SEQ ID NO: 1230745 - protein, 10 aa, Mycobacterium
TPHNGKDADY

SEQ ID NO: 1230746 - protein, 5 aa, Mycobacterium
TPHRA

SEQ ID NO: 1230747 - protein, 12 aa, Mycobacterium
TPHRRGTAPRMP

SEQ ID NO: 1230748 - protein, 5 aa, Mycobacterium
TPHRT

SEQ ID NO: 1230749 - protein, 9 aa, Mycobacterium
TPHSGKEED

SEQ ID NO: 1230750 - protein, 19 aa, Mycobacterium
TPHSVKPGATKTAEASSRT

SEQ ID NO: 1230751 - protein, 9 aa, Mycobacterium
TPHTITDRT

SEQ ID NO: 1230752 - protein, 7 aa, Mycobacterium
TPIAQAS

SEQ ID NO: 1230753 - protein, 4 aa, Mycobacterium
TPIE

SEQ ID NO: 1230754 - protein, 17 aa, Mycobacterium
TPIESVDPGGINTSDAH

SEQ ID NO: 1230755 - protein, 20 aa, Mycobacterium
TPIETDKGGDRVTYWCPTCQ

SEQ ID NO: 1230756 - protein, 5 aa, Mycobacterium
TPIGE

SEQ ID NO: 1230757 - protein, 6 aa, Mycobacterium
TPIGRG

SEQ ID NO: 1230758 - protein, 12 aa, Mycobacterium
TPIGTMTQSSHG

SEQ ID NO: 1230759 - protein, 11 aa, Mycobacterium
TPIPPETGDVD

SEQ ID NO: 1230760 - protein, 13 aa, Mycobacterium
TPISEADRDTRDV

SEQ ID NO: 1230761 - protein, 17 aa, Mycobacterium
TPITTGAADDGPRERKV

SEQ ID NO: 1230762 - protein, 7 aa, Mycobacterium
TPKEARG

SEQ ID NO: 1230763 - protein, 25 aa, Mycobacterium
TPKEQATAGALRAKATDVDTSIRPR

SEQ ID NO: 1230764 - protein, 18 aa, Mycobacterium
TPKGLTGPDQGLPALTPE

SEQ ID NO: 1230765 - protein, 9 aa, Mycobacterium
TPKGTGARE

SEQ ID NO: 1230766 - protein, 8 aa, Mycobacterium
TPKLADGT

SEQ ID NO: 1230767 - protein, 8 aa, Mycobacterium
TPKPGAAG

SEQ ID NO: 1230768 - protein, 12 aa, Mycobacterium
TPKQRRDPGLSE

SEQ ID NO: 1230769 - protein, 5 aa, Mycobacterium
TPKRI

SEQ ID NO: 1230770 - protein, 43 aa, Mycobacterium
TPKRSGGTTTTQDPSPSTQDPGPTDTEPSGGGTGTESNNETPA

SEQ ID NO: 1230771 - protein, 8 aa, Mycobacterium
TPKRSQAN

SEQ ID NO: 1230772 - protein, 8 aa, Mycobacterium
TPKTPPAT

SEQ ID NO: 1230773 - protein, 4 aa, Mycobacterium
TPKV

SEQ ID NO: 1230774 - protein, 5 aa, Mycobacterium
TPLDG

SEQ ID NO: 1230775 - protein, 5 aa, Mycobacterium
TPLEN

SEQ ID NO: 1230776 - protein, 11 aa, Mycobacterium
TPLGGADGEDI

SEQ ID NO: 1230777 - protein, 12 aa, Mycobacterium
TPLGPATPDPRP

SEQ ID NO: 1230778 - protein, 10 aa, Mycobacterium
TPLGPPSRWP

SEQ ID NO: 1230779 - protein, 5 aa, Mycobacterium
TPLNG

SEQ ID NO: 1230780 - protein, 8 aa, Mycobacterium
TPLPPKGQ

SEQ ID NO: 1230781 - protein, 6 aa, Mycobacterium
TPLPTP

SEQ ID NO: 1230782 - protein, 9 aa, Mycobacterium
TPLPTPTGW

SEQ ID NO: 1230783 - protein, 4 aa, Mycobacterium
TPLQ

SEQ ID NO: 1230784 - protein, 5 aa, Mycobacterium
TPLSA

SEQ ID NO: 1230785 - protein, 6 aa, Mycobacterium
TPLSAP

SEQ ID NO: 1230786 - protein, 12 aa, Mycobacterium
TPLSPDANREID

SEQ ID NO: 1230787 - protein, 7 aa, Mycobacterium
TPLSPGG

SEQ ID NO: 1230788 - protein, 5 aa, Mycobacterium
TPLTE

SEQ ID NO: 1230789 - protein, 9 aa, Mycobacterium
TPLTEDQTK

SEQ ID NO: 1230790 - protein, 14 aa, Mycobacterium
TPLVEGKETRTIDG

SEQ ID NO: 1230791 - protein, 12 aa, Mycobacterium
TPMETTTGKVVD

SEQ ID NO: 1230792 - protein, 15 aa, Mycobacterium
TPNGNHGELRDEGVT

SEQ ID NO: 1230793 - protein, 8 aa, Mycobacterium
TPNGRQGA

SEQ ID NO: 1230794 - protein, 34 aa, Mycobacterium
TPNPGTPSETPERLTPAETPERLTPAEAPERLSP

SEQ ID NO: 1230795 - protein, 11 aa, Mycobacterium
TPNTAQPGTAG

SEQ ID NO: 1230796 - protein, 9 aa, Mycobacterium
TPPADAPRD

SEQ ID NO: 1230797 - protein, 8 aa, Mycobacterium
TPPADGRD

SEQ ID NO: 1230798 - protein, 24 aa, Mycobacterium
TPPAEASLSLDGQSAQPLDEHEPG

SEQ ID NO: 1230799 - protein, 9 aa, Mycobacterium
TPPDTAQAV

SEQ ID NO: 1230800 - protein, 7 aa, Mycobacterium
TPPEATL

SEQ ID NO: 1230801 - protein, 8 aa, Mycobacterium
TPPFGPEA

SEQ ID NO: 1230802 - protein, 6 aa, Mycobacterium
TPPGGL

SEQ ID NO: 1230803 - protein, 8 aa, Mycobacterium
TPPGKSWQ

SEQ ID NO: 1230804 - protein, 10 aa, Mycobacterium
TPPGNPRGIT

SEQ ID NO: 1230805 - protein, 5 aa, Mycobacterium
TPPGR

SEQ ID NO: 1230806 - protein, 6 aa, Mycobacterium
TPPGVA

SEQ ID NO: 1230807 - protein, 6 aa, Mycobacterium
TPPKTI

SEQ ID NO: 1230808 - protein, 6 aa, Mycobacterium
TPPPEP

SEQ ID NO: 1230809 - protein, 7 aa, Mycobacterium
TPPPFAP

SEQ ID NO: 1230810 - protein, 17 aa, Mycobacterium
TPPPGATEIARTPNASQ

SEQ ID NO: 1230811 - protein, 11 aa, Mycobacterium
TPPPPLDTGQA

SEQ ID NO: 1230812 - protein, 7 aa, Mycobacterium
TPPPQPH

SEQ ID NO: 1230813 - protein, 11 aa, Mycobacterium
TPPPQPQQREV

SEQ ID NO: 1230814 - protein, 15 aa, Mycobacterium
TPPPRPSTVQPGVPA

SEQ ID NO: 1230815 - protein, 4 aa, Mycobacterium
TPPQ

SEQ ID NO: 1230816 - protein, 12 aa, Mycobacterium
TPPRARKPQRRV

SEQ ID NO: 1230817 - protein, 11 aa, Mycobacterium
TPPRPDDADNP

SEQ ID NO: 1230818 - protein, 6 aa, Mycobacterium
TPPRQA

SEQ ID NO: 1230819 - protein, 10 aa, Mycobacterium
TPPRRTLDAT

SEQ ID NO: 1230820 - protein, 8 aa, Mycobacterium
TPPSAPRP

SEQ ID NO: 1230821 - protein, 17 aa, Mycobacterium
TPPSGGTRLIWSVPLAR

SEQ ID NO: 1230822 - protein, 7 aa, Mycobacterium
TPPSRNA

SEQ ID NO: 1230823 - protein, 6 aa, Mycobacterium
TPPTRA

SEQ ID NO: 1230824 - protein, 7 aa, Mycobacterium
TPPTSGS

SEQ ID NO: 1230825 - protein, 5 aa, Mycobacterium
TPPVD

SEQ ID NO: 1230826 - protein, 13 aa, Mycobacterium
TPPVERPSAVVCG

SEQ ID NO: 1230827 - protein, 34 aa, Mycobacterium
TPPVPGVPGGAGAVPAGAVTPPTPPVPGSSSGGF

SEQ ID NO: 1230828 - protein, 4 aa, Mycobacterium
TPPY

SEQ ID NO: 1230829 - protein, 7 aa, Mycobacterium
TPQAADQ

SEQ ID NO: 1230830 - protein, 6 aa, Mycobacterium
TPQAGT

SEQ ID NO: 1230831 - protein, 5 aa, Mycobacterium
TPQAK

SEQ ID NO: 1230832 - protein, 20 aa, Mycobacterium
TPQARSGYFSDADDPHANVA

SEQ ID NO: 1230833 - protein, 5 aa, Mycobacterium
TPQDA

SEQ ID NO: 1230834 - protein, 12 aa, Mycobacterium
TPQEGREKTAAY

SEQ ID NO: 1230835 - protein, 10 aa, Mycobacterium
TPQEREDPKI

SEQ ID NO: 1230836 - protein, 23 aa, Mycobacterium
TPQGDTVATVGRGEEVTVTGDPG

SEQ ID NO: 1230837 - protein, 8 aa, Mycobacterium
TPQKAAEL

SEQ ID NO: 1230838 - protein, 9 aa, Mycobacterium
TPQPAMPGQ

SEQ ID NO: 1230839 - protein, 13 aa, Mycobacterium
TPQPATPDAVSKT

SEQ ID NO: 1230840 - protein, 40 aa, Mycobacterium
TPQPPNAASTTWPTASVPTTPAPSTTAASRPTPPYSPASP

SEQ ID NO: 1230841 - protein, 41 aa, Mycobacterium
TPQQPGHTPGQLEAANDAIRTATENDPDSTARNYPAVPGQD

SEQ ID NO: 1230842 - protein, 8 aa, Mycobacterium
TPQRDDRT

SEQ ID NO: 1230843 - protein, 8 aa, Mycobacterium
TPQSDGAA

SEQ ID NO: 1230844 - protein, 14 aa, Mycobacterium
TPQSVSSPASEPAM

SEQ ID NO: 1230845 - protein, 6 aa, Mycobacterium
TPQVSP

SEQ ID NO: 1230846 - protein, 5 aa, Mycobacterium
TPQYR

SEQ ID NO: 1230847 - protein, 7 aa, Mycobacterium
TPRAEDR

SEQ ID NO: 1230848 - protein, 10 aa, Mycobacterium
TPRAIQSQRE

SEQ ID NO: 1230849 - protein, 5 aa, Mycobacterium
TPRAT

SEQ ID NO: 1230850 - protein, 5 aa, Mycobacterium
TPRDA

SEQ ID NO: 1230851 - protein, 13 aa, Mycobacterium
TPRDGNFETYPPE

SEQ ID NO: 1230852 - protein, 9 aa, Mycobacterium
TPRDPLRTR

SEQ ID NO: 1230853 - protein, 11 aa, Mycobacterium
TPRDSRSASDN

SEQ ID NO: 1230854 - protein, 6 aa, Mycobacterium
TPRDWT

SEQ ID NO: 1230855 - protein, 5 aa, Mycobacterium
TPREE

SEQ ID NO: 1230856 - protein, 5 aa, Mycobacterium
TPRGH

SEQ ID NO: 1230857 - protein, 11 aa, Mycobacterium
TPRGKQRNGAL

SEQ ID NO: 1230858 - protein, 11 aa, Mycobacterium
TPRGRNRGGSL

SEQ ID NO: 1230859 - protein, 6 aa, Mycobacterium
TPRGWQ

SEQ ID NO: 1230860 - protein, 4 aa, Mycobacterium
TPRL

SEQ ID NO: 1230861 - protein, 8 aa, Mycobacterium
TPRLGTGS

SEQ ID NO: 1230862 - protein, 6 aa, Mycobacterium
TPRNAP

SEQ ID NO: 1230863 - protein, 9 aa, Mycobacterium
TPRPDGGWA

SEQ ID NO: 1230864 - protein, 13 aa, Mycobacterium
TPRPGVTVAQPDA

SEQ ID NO: 1230865 - protein, 12 aa, Mycobacterium
TPRPNGPEPTAE

SEQ ID NO: 1230866 - protein, 8 aa, Mycobacterium
TPRQRGTA

SEQ ID NO: 1230867 - protein, 9 aa, Mycobacterium
TPRRGTADS

SEQ ID NO: 1230868 - protein, 8 aa, Mycobacterium
TPRSGHAV

SEQ ID NO: 1230869 - protein, 4 aa, Mycobacterium
TPRT

SEQ ID NO: 1230870 - protein, 8 aa, Mycobacterium
TPRTPREV

SEQ ID NO: 1230871 - protein, 17 aa, Mycobacterium
TPRWSSSVSKEWEPLRE

SEQ ID NO: 1230872 - protein, 11 aa, Mycobacterium
TPSAGEEKHRH

SEQ ID NO: 1230873 - protein, 5 aa, Mycobacterium
TPSAH

SEQ ID NO: 1230874 - protein, 18 aa, Mycobacterium
TPSAPERHTEMTDAQKGT

SEQ ID NO: 1230875 - protein, 7 aa, Mycobacterium
TPSAPSG

SEQ ID NO: 1230876 - protein, 7 aa, Mycobacterium
TPSDLDA

SEQ ID NO: 1230877 - protein, 6 aa, Mycobacterium
TPSDYR

SEQ ID NO: 1230878 - protein, 5 aa, Mycobacterium
TPSEA

SEQ ID NO: 1230879 - protein, 8 aa, Mycobacterium
TPSEADAL

SEQ ID NO: 1230880 - protein, 6 aa, Mycobacterium
TPSGPQ

SEQ ID NO: 1230881 - protein, 5 aa, Mycobacterium
TPSGR

SEQ ID NO: 1230882 - protein, 10 aa, Mycobacterium
TPSKTGSPII

SEQ ID NO: 1230883 - protein, 13 aa, Mycobacterium
TPSNSPGAQSPSM

SEQ ID NO: 1230884 - protein, 5 aa, Mycobacterium
TPSQP

SEQ ID NO: 1230885 - protein, 4 aa, Mycobacterium
TPSS

SEQ ID NO: 1230886 - protein, 8 aa, Mycobacterium
TPSSPTDA

SEQ ID NO: 1230887 - protein, 9 aa, Mycobacterium
TPSSRSGGG

SEQ ID NO: 1230888 - protein, 17 aa, Mycobacterium
TPSSVDERVNTPTDPAW

SEQ ID NO: 1230889 - protein, 7 aa, Mycobacterium
TPSTPTD

SEQ ID NO: 1230890 - protein, 6 aa, Mycobacterium
TPSVDS

SEQ ID NO: 1230891 - protein, 4 aa, Mycobacterium
TPTA

SEQ ID NO: 1230892 - protein, 5 aa, Mycobacterium
TPTAA

SEQ ID NO: 1230893 - protein, 9 aa, Mycobacterium
TPTADAADL

SEQ ID NO: 1230894 - protein, 5 aa, Mycobacterium
TPTAL

SEQ ID NO: 1230895 - protein, 8 aa, Mycobacterium
TPTAPLPD

SEQ ID NO: 1230896 - protein, 22 aa, Mycobacterium
TPTDDARLSAGAPGAPVASKED

SEQ ID NO: 1230897 - protein, 8 aa, Mycobacterium
TPTDGAHL

SEQ ID NO: 1230898 - protein, 8 aa, Mycobacterium
TPTDTQAK

SEQ ID NO: 1230899 - protein, 11 aa, Mycobacterium
TPTERKTAKGV

SEQ ID NO: 1230900 - protein, 8 aa, Mycobacterium
TPTEYGGA

SEQ ID NO: 1230901 - protein, 4 aa, Mycobacterium
TPTG

SEQ ID NO: 1230902 - protein, 12 aa, Mycobacterium
TPTGSGKSLVAT

SEQ ID NO: 1230903 - protein, 8 aa, Mycobacterium
TPTLPTAA

SEQ ID NO: 1230904 - protein, 18 aa, Mycobacterium
TPTLQGDSTLGDLAERPR

SEQ ID NO: 1230905 - protein, 4 aa, Mycobacterium
TPTN

SEQ ID NO: 1230906 - protein, 32 aa, Mycobacterium
TPTPDVSDSPPAAADQDPLTADAPAADAPRRV

SEQ ID NO: 1230907 - protein, 8 aa, Mycobacterium
TPTPTDDP

SEQ ID NO: 1230908 - protein, 5 aa, Mycobacterium
TPTPV

SEQ ID NO: 1230909 - protein, 12 aa, Mycobacterium
TPTRDKPSAFGA

SEQ ID NO: 1230910 - protein, 6 aa, Mycobacterium
TPTRTA

SEQ ID NO: 1230911 - protein, 11 aa, Mycobacterium
TPTSPKKPKPL

SEQ ID NO: 1230912 - protein, 9 aa, Mycobacterium
TPTSRGRDA

SEQ ID NO: 1230913 - protein, 6 aa, Mycobacterium
TPTTDE

SEQ ID NO: 1230914 - protein, 8 aa, Mycobacterium
TPTTPEGG

SEQ ID NO: 1230915 - protein, 4 aa, Mycobacterium
TPTY

SEQ ID NO: 1230916 - protein, 4 aa, Mycobacterium
TPVA

SEQ ID NO: 1230917 - protein, 11 aa, Mycobacterium
TPVAGRSEAEL

SEQ ID NO: 1230918 - protein, 11 aa, Mycobacterium
TPVDAKGRFDA

SEQ ID NO: 1230919 - protein, 8 aa, Mycobacterium
TPVEGGRS

SEQ ID NO: 1230920 - protein, 11 aa, Mycobacterium
TPVGKGKANGA

SEQ ID NO: 1230921 - protein, 16 aa, Mycobacterium
TPVGKRNGGLSEQHAA

SEQ ID NO: 1230922 - protein, 6 aa, Mycobacterium
TPVGRS

SEQ ID NO: 1230923 - protein, 4 aa, Mycobacterium
TPVP

SEQ ID NO: 1230924 - protein, 10 aa, Mycobacterium
TPVPGPGDQV

SEQ ID NO: 1230925 - protein, 9 aa, Mycobacterium
TPVPPGRAR

SEQ ID NO: 1230926 - protein, 11 aa, Mycobacterium
TPVQGAASAHG

SEQ ID NO: 1230927 - protein, 16 aa, Mycobacterium
TPVSAGADEDGPRERK

SEQ ID NO: 1230928 - protein, 5 aa, Mycobacterium
TPVSL

SEQ ID NO: 1230929 - protein, 9 aa, Mycobacterium
TPVSSRRSN

SEQ ID NO: 1230930 - protein, 20 aa, Mycobacterium
TPVSYRSGPPALGDSPIAEK

SEQ ID NO: 1230931 - protein, 11 aa, Mycobacterium
TPVTAGDPDYP

SEQ ID NO: 1230932 - protein, 16 aa, Mycobacterium
TPVTTDISKPDPRSTV

SEQ ID NO: 1230933 - protein, 12 aa, Mycobacterium
TPWQRNDRPRIA

SEQ ID NO: 1230934 - protein, 4 aa, Mycobacterium
TPWR

SEQ ID NO: 1230935 - protein, 4 aa, Mycobacterium
TPYD

SEQ ID NO: 1230936 - protein, 13 aa, Mycobacterium
TPYGEEGDEFDPG

SEQ ID NO: 1230937 - protein, 6 aa, Mycobacterium
TPYPAL

SEQ ID NO: 1230938 - protein, 7 aa, Mycobacterium
TPYPELD

SEQ ID NO: 1230939 - protein, 11 aa, Mycobacterium
TPYPIPHDGPV

SEQ ID NO: 1230940 - protein, 9 aa, Mycobacterium
TPYPNFTGR

SEQ ID NO: 1230941 - protein, 6 aa, Mycobacterium
TPYPPG

SEQ ID NO: 1230942 - protein, 5 aa, Mycobacterium
TPYPS

SEQ ID NO: 1230943 - protein, 12 aa, Mycobacterium
TPYPYTKDGQRR

SEQ ID NO: 1230944 - protein, 15 aa, Mycobacterium
TPYYKRGGSLPKSIT

SEQ ID NO: 1230945 - protein, 6 aa, Mycobacterium
TQAAAR

SEQ ID NO: 1230946 - protein, 7 aa, Mycobacterium
TQAAGQL

SEQ ID NO: 1230947 - protein, 12 aa, Mycobacterium
TQADAAQQAGVS

SEQ ID NO: 1230948 - protein, 6 aa, Mycobacterium
TQADEL

SEQ ID NO: 1230949 - protein, 9 aa, Mycobacterium
TQADGSVAA

SEQ ID NO: 1230950 - protein, 9 aa, Mycobacterium
TQADPEGRT

SEQ ID NO: 1230951 - protein, 8 aa, Mycobacterium
TQAENEGH

SEQ ID NO: 1230952 - protein, 11 aa, Mycobacterium
TQAMGAATQGL

SEQ ID NO: 1230953 - protein, 8 aa, Mycobacterium
TQANHGKP

SEQ ID NO: 1230954 - protein, 10 aa, Mycobacterium
TQAPEEGRRR

SEQ ID NO: 1230955 - protein, 5 aa, Mycobacterium
TQAPL

SEQ ID NO: 1230956 - protein, 6 aa, Mycobacterium
TQARGL

SEQ ID NO: 1230957 - protein, 7 aa, Mycobacterium
TQASGGN

SEQ ID NO: 1230958 - protein, 11 aa, Mycobacterium
TQATEGISPDL

SEQ ID NO: 1230959 - protein, 8 aa, Mycobacterium
TQAVTGEE

SEQ ID NO: 1230960 - protein, 5 aa, Mycobacterium
TQAYS

SEQ ID NO: 1230961 - protein, 6 aa, Mycobacterium
TQDADG

SEQ ID NO: 1230962 - protein, 6 aa, Mycobacterium
TQDAEG

SEQ ID NO: 1230963 - protein, 8 aa, Mycobacterium
TQDARSAQ

SEQ ID NO: 1230964 - protein, 11 aa, Mycobacterium
TQDEEGPSSDF

SEQ ID NO: 1230965 - protein, 7 aa, Mycobacterium
TQDGPDR

SEQ ID NO: 1230966 - protein, 9 aa, Mycobacterium
TQDRTIDPE

SEQ ID NO: 1230967 - protein, 17 aa, Mycobacterium
TQDTAENERDQTELGGE

SEQ ID NO: 1230968 - protein, 7 aa, Mycobacterium
TQDTQVG

SEQ ID NO: 1230969 - protein, 7 aa, Mycobacterium
TQEERDD

SEQ ID NO: 1230970 - protein, 11 aa, Mycobacterium
TQEGGTERPFT

SEQ ID NO: 1230971 - protein, 6 aa, Mycobacterium
TQEKIT

SEQ ID NO: 1230972 - protein, 14 aa, Mycobacterium
TQFDGYTTGKTKDF

SEQ ID NO: 1230973 - protein, 4 aa, Mycobacterium
TQGA

SEQ ID NO: 1230974 - protein, 5 aa, Mycobacterium
TQGAE

SEQ ID NO: 1230975 - protein, 17 aa, Mycobacterium
TQGHSDDCQQTDRRASA

SEQ ID NO: 1230976 - protein, 4 aa, Mycobacterium
TQGQ

SEQ ID NO: 1230977 - protein, 5 aa, Mycobacterium
TQGRM

SEQ ID NO: 1230978 - protein, 5 aa, Mycobacterium
TQGRR

SEQ ID NO: 1230979 - protein, 6 aa, Mycobacterium
TQGSSV

SEQ ID NO: 1230980 - protein, 6 aa, Mycobacterium
TQGVHA

SEQ ID NO: 1230981 - protein, 4 aa, Mycobacterium
TQHN

SEQ ID NO: 1230982 - protein, 14 aa, Mycobacterium
TQHSAGFEKGLPNV

SEQ ID NO: 1230983 - protein, 5 aa, Mycobacterium
TQIGD

SEQ ID NO: 1230984 - protein, 13 aa, Mycobacterium
TQITPDARRADLE

SEQ ID NO: 1230985 - protein, 7 aa, Mycobacterium
TQITPGR

SEQ ID NO: 1230986 - protein, 19 aa, Mycobacterium
TQKPADSADAVIDRVGAPV

SEQ ID NO: 1230987 - protein, 19 aa, Mycobacterium
TQKPTDSADAVMDRVSAPV

SEQ ID NO: 1230988 - protein, 14 aa, Mycobacterium
TQKTADAFADEPDA

SEQ ID NO: 1230989 - protein, 6 aa, Mycobacterium
TQLGPS

SEQ ID NO: 1230990 - protein, 5 aa, Mycobacterium
TQLTD

SEQ ID NO: 1230991 - protein, 13 aa, Mycobacterium
TQMASRAATKSTA

SEQ ID NO: 1230992 - protein, 23 aa, Mycobacterium
TQMPPTTQAPTPQGQVPQRPPNG

SEQ ID NO: 1230993 - protein, 11 aa, Mycobacterium
TQNEVSGADAA

SEQ ID NO: 1230994 - protein, 18 aa, Mycobacterium
TQNTLRRNRTELTDKPES

SEQ ID NO: 1230995 - protein, 9 aa, Mycobacterium
TQPAANQLD

SEQ ID NO: 1230996 - protein, 4 aa, Mycobacterium
TQPE

SEQ ID NO: 1230997 - protein, 9 aa, Mycobacterium
TQPEGPSFT

SEQ ID NO: 1230998 - protein, 7 aa, Mycobacterium
TQPEQLA

SEQ ID NO: 1230999 - protein, 6 aa, Mycobacterium
TQPGEG

SEQ ID NO: 1231000 - protein, 8 aa, Mycobacterium
TQPGGRSA

SEQ ID NO: 1231001 - protein, 8 aa, Mycobacterium
TQPKPAAL

SEQ ID NO: 1231002 - protein, 10 aa, Mycobacterium
TQPPEENPQG

SEQ ID NO: 1231003 - protein, 15 aa, Mycobacterium
TQPRDDNSSQNTDTT

SEQ ID NO: 1231004 - protein, 7 aa, Mycobacterium
TQPTARA

SEQ ID NO: 1231005 - protein, 8 aa, Mycobacterium
TQPTGSVE

SEQ ID NO: 1231006 - protein, 9 aa, Mycobacterium
TQPTPADLA

SEQ ID NO: 1231007 - protein, 5 aa, Mycobacterium
TQQAR

SEQ ID NO: 1231008 - protein, 7 aa, Mycobacterium
TQQLGTP

SEQ ID NO: 1231009 - protein, 5 aa, Mycobacterium
TQQPR

SEQ ID NO: 1231010 - protein, 4 aa, Mycobacterium
TQRQ

SEQ ID NO: 1231011 - protein, 11 aa, Mycobacterium
TQRRIGTEGQG

SEQ ID NO: 1231012 - protein, 4 aa, Mycobacterium
TQRT

SEQ ID NO: 1231013 - protein, 7 aa, Mycobacterium
TQSAAIA

SEQ ID NO: 1231014 - protein, 5 aa, Mycobacterium
TQSAH

SEQ ID NO: 1231015 - protein, 10 aa, Mycobacterium
TQSDTGGETA

SEQ ID NO: 1231016 - protein, 57 aa, Mycobacterium
TQSEKVAKARRDEARAYREATAAVEDYDRAGQRAGNSFTSGLRSGEAGAAEAGGGFA

SEQ ID NO: 1231017 - protein, 10 aa, Mycobacterium
TQSQSRQPDL

SEQ ID NO: 1231018 - protein, 16 aa, Mycobacterium
TQSRRRAAATGGESRI

SEQ ID NO: 1231019 - protein, 7 aa, Mycobacterium
TQSSRSI

SEQ ID NO: 1231020 - protein, 5 aa, Mycobacterium
TQSVD

SEQ ID NO: 1231021 - protein, 8 aa, Mycobacterium
TQSVGDET

SEQ ID NO: 1231022 - protein, 12 aa, Mycobacterium
TQSVIGGPPDQV

SEQ ID NO: 1231023 - protein, 12 aa, Mycobacterium
TQTADDAGEAGD

SEQ ID NO: 1231024 - protein, 13 aa, Mycobacterium
TQTDGIGKAHDDS

SEQ ID NO: 1231025 - protein, 14 aa, Mycobacterium
TQTDLSAAQRQADE

SEQ ID NO: 1231026 - protein, 7 aa, Mycobacterium
TQTEPDA

SEQ ID NO: 1231027 - protein, 15 aa, Mycobacterium
TQTLDQQKEALQTAG

SEQ ID NO: 1231028 - protein, 5 aa, Mycobacterium
TQTLR

SEQ ID NO: 1231029 - protein, 16 aa, Mycobacterium
TQTSADWGRRAAQRAE

SEQ ID NO: 1231030 - protein, 9 aa, Mycobacterium
TQTSTTPAH

SEQ ID NO: 1231031 - protein, 4 aa, Mycobacterium
TQTT

SEQ ID NO: 1231032 - protein, 10 aa, Mycobacterium
TQTVAAEHGA

SEQ ID NO: 1231033 - protein, 10 aa, Mycobacterium
TQVDTAGTQI

SEQ ID NO: 1231034 - protein, 5 aa, Mycobacterium
TQVES

SEQ ID NO: 1231035 - protein, 12 aa, Mycobacterium
TQVGRDATEPMR

SEQ ID NO: 1231036 - protein, 10 aa, Mycobacterium
TQVNGVPREQ

SEQ ID NO: 1231037 - protein, 5 aa, Mycobacterium
TQVPP

SEQ ID NO: 1231038 - protein, 17 aa, Mycobacterium
TQVQSKADEIDAGPLNV

SEQ ID NO: 1231039 - protein, 6 aa, Mycobacterium
TRAAAG

SEQ ID NO: 1231040 - protein, 6 aa, Mycobacterium
TRAALD

SEQ ID NO: 1231041 - protein, 9 aa, Mycobacterium
TRADDEQLG

SEQ ID NO: 1231042 - protein, 21 aa, Mycobacterium
TRADLARKEGRNADAAELDQR

SEQ ID NO: 1231043 - protein, 18 aa, Mycobacterium
TRADLARKEGRPSDAAEI

SEQ ID NO: 1231044 - protein, 8 aa, Mycobacterium
TRAEADRQ

SEQ ID NO: 1231045 - protein, 24 aa, Mycobacterium
TRAEADRQLARKGAGLGPEELDEA

SEQ ID NO: 1231046 - protein, 15 aa, Mycobacterium
TRAELEAAGQAHGVP

SEQ ID NO: 1231047 - protein, 9 aa, Mycobacterium
TRAGRPIGR

SEQ ID NO: 1231048 - protein, 16 aa, Mycobacterium
TRAGSDPREHLERIVV

SEQ ID NO: 1231049 - protein, 9 aa, Mycobacterium
TRAHRTGAT

SEQ ID NO: 1231050 - protein, 12 aa, Mycobacterium
TRAKKPPAGTPG

SEQ ID NO: 1231051 - protein, 7 aa, Mycobacterium
TRAPDVA

SEQ ID NO: 1231052 - protein, 8 aa, Mycobacterium
TRAPGLNA

SEQ ID NO: 1231053 - protein, 10 aa, Mycobacterium
TRAPRPGEVD

SEQ ID NO: 1231054 - protein, 7 aa, Mycobacterium
TRAPTAR

SEQ ID NO: 1231055 - protein, 5 aa, Mycobacterium
TRAQE

SEQ ID NO: 1231056 - protein, 20 aa, Mycobacterium
TRAQQDEVAATSHQKAARAW

SEQ ID NO: 1231057 - protein, 14 aa, Mycobacterium
TRARDNGDGTYTID

SEQ ID NO: 1231058 - protein, 13 aa, Mycobacterium
TRAREAADRLSQV

SEQ ID NO: 1231059 - protein, 4 aa, Mycobacterium
TRAS

SEQ ID NO: 1231060 - protein, 13 aa, Mycobacterium
TRASRKSAQAAAV

SEQ ID NO: 1231061 - protein, 8 aa, Mycobacterium
TRATAGAV

SEQ ID NO: 1231062 - protein, 7 aa, Mycobacterium
TRATTGL

SEQ ID NO: 1231063 - protein, 4 aa, Mycobacterium
TRAV

SEQ ID NO: 1231064 - protein, 7 aa, Mycobacterium
TRAVQDG

SEQ ID NO: 1231065 - protein, 7 aa, Mycobacterium
TRCAEPG

SEQ ID NO: 1231066 - protein, 13 aa, Mycobacterium
TRDAEGEANGVDE

SEQ ID NO: 1231067 - protein, 6 aa, Mycobacterium
TRDAGR

SEQ ID NO: 1231068 - protein, 10 aa, Mycobacterium
TRDAHGDPDW

SEQ ID NO: 1231069 - protein, 6 aa, Mycobacterium
TRDAPA

SEQ ID NO: 1231070 - protein, 4 aa, Mycobacterium
TRDD

SEQ ID NO: 1231071 - protein, 6 aa, Mycobacterium
TRDDDG

SEQ ID NO: 1231072 - protein, 5 aa, Mycobacterium
TRDDV

SEQ ID NO: 1231073 - protein, 15 aa, Mycobacterium
TRDFDSRSQREEICH

SEQ ID NO: 1231074 - protein, 8 aa, Mycobacterium
TRDGHSDY

SEQ ID NO: 1231075 - protein, 18 aa, Mycobacterium
TRDHGTDPTGDGDGDRGV

SEQ ID NO: 1231076 - protein, 9 aa, Mycobacterium
TRDKANQGA

SEQ ID NO: 1231077 - protein, 13 aa, Mycobacterium
TRDQGLRDTTAEA

SEQ ID NO: 1231078 - protein, 16 aa, Mycobacterium
TRDTDESKKITASREP

SEQ ID NO: 1231079 - protein, 15 aa, Mycobacterium
TRDTEINGQPVAEGD

SEQ ID NO: 1231080 - protein, 13 aa, Mycobacterium
TRDTTGSDLPPRF

SEQ ID NO: 1231081 - protein, 5 aa, Mycobacterium
TRDVT

SEQ ID NO: 1231082 - protein, 10 aa, Mycobacterium
TREAAERAPS

SEQ ID NO: 1231083 - protein, 9 aa, Mycobacterium
TREAIGEDE

SEQ ID NO: 1231084 - protein, 4 aa, Mycobacterium
TRED

SEQ ID NO: 1231085 - protein, 5 aa, Mycobacterium
TREDL

SEQ ID NO: 1231086 - protein, 5 aa, Mycobacterium
TREDV

SEQ ID NO: 1231087 - protein, 6 aa, Mycobacterium
TREEHS

SEQ ID NO: 1231088 - protein, 5 aa, Mycobacterium
TREGD

SEQ ID NO: 1231089 - protein, 4 aa, Mycobacterium
TREH

SEQ ID NO: 1231090 - protein, 4 aa, Mycobacterium
TREI

SEQ ID NO: 1231091 - protein, 9 aa, Mycobacterium
TREPGNYLP

SEQ ID NO: 1231092 - protein, 8 aa, Mycobacterium
TREPNTQI

SEQ ID NO: 1231093 - protein, 12 aa, Mycobacterium
TREPSTDGARAS

SEQ ID NO: 1231094 - protein, 4 aa, Mycobacterium
TREQ

SEQ ID NO: 1231095 - protein, 5 aa, Mycobacterium
TREQA

SEQ ID NO: 1231096 - protein, 9 aa, Mycobacterium
TREQAERDV

SEQ ID NO: 1231097 - protein, 6 aa, Mycobacterium
TREQHE

SEQ ID NO: 1231098 - protein, 9 aa, Mycobacterium
TREQRLTDA

SEQ ID NO: 1231099 - protein, 8 aa, Mycobacterium
TRERGKPV

SEQ ID NO: 1231100 - protein, 10 aa, Mycobacterium
TRESPGPGVG

SEQ ID NO: 1231101 - protein, 5 aa, Mycobacterium
TREYE

SEQ ID NO: 1231102 - protein, 7 aa, Mycobacterium
TRFGNTA

SEQ ID NO: 1231103 - protein, 7 aa, Mycobacterium
TRFKPGK

SEQ ID NO: 1231104 - protein, 13 aa, Mycobacterium
TRFKPGKAKDTGL

SEQ ID NO: 1231105 - protein, 18 aa, Mycobacterium
TRGAAPESKAGQVHYPGT

SEQ ID NO: 1231106 - protein, 16 aa, Mycobacterium
TRGAGNSGAPKQTSAY

SEQ ID NO: 1231107 - protein, 5 aa, Mycobacterium
TRGAK

SEQ ID NO: 1231108 - protein, 5 aa, Mycobacterium
TRGAP

SEQ ID NO: 1231109 - protein, 13 aa, Mycobacterium
TRGARRRGLWRRR

SEQ ID NO: 1231110 - protein, 6 aa, Mycobacterium
TRGDTH

SEQ ID NO: 1231111 - protein, 4 aa, Mycobacterium
TRGF

SEQ ID NO: 1231112 - protein, 5 aa, Mycobacterium
TRGGD

SEQ ID NO: 1231113 - protein, 17 aa, Mycobacterium
TRGGQQTALPTAVGATT

SEQ ID NO: 1231114 - protein, 6 aa, Mycobacterium
TRGGRS

SEQ ID NO: 1231115 - protein, 14 aa, Mycobacterium
TRGHGASPVPAGPY

SEQ ID NO: 1231116 - protein, 14 aa, Mycobacterium
TRGHGDSDWDPAGR

SEQ ID NO: 1231117 - protein, 5 aa, Mycobacterium
TRGHV

SEQ ID NO: 1231118 - protein, 4 aa, Mycobacterium
TRGL

SEQ ID NO: 1231119 - protein, 8 aa, Mycobacterium
TRGPNSAD

SEQ ID NO: 1231120 - protein, 6 aa, Mycobacterium
TRGPRS

SEQ ID NO: 1231121 - protein, 5 aa, Mycobacterium
TRGRL

SEQ ID NO: 1231122 - protein, 5 aa, Mycobacterium
TRGRP

SEQ ID NO: 1231123 - protein, 10 aa, Mycobacterium
TRGRRAAAKR

SEQ ID NO: 1231124 - protein, 4 aa, Mycobacterium
TRGS

SEQ ID NO: 1231125 - protein, 7 aa, Mycobacterium
TRGSGLD

SEQ ID NO: 1231126 - protein, 12 aa, Mycobacterium
TRGTGPGPARTF

SEQ ID NO: 1231127 - protein, 7 aa, Mycobacterium
TRGTTLP

SEQ ID NO: 1231128 - protein, 40 aa, Mycobacterium
TRGTVTVGPDEVSAREAVAEAKRAAETAAQWSGPGVTADG

SEQ ID NO: 1231129 - protein, 4 aa, Mycobacterium
TRGY

SEQ ID NO: 1231130 - protein, 5 aa, Mycobacterium
TRGYG

SEQ ID NO: 1231131 - protein, 38 aa, Mycobacterium
TRHADADSPGAPRTRYKDRRSPSSANGGSVTTTTQEPV

SEQ ID NO: 1231132 - protein, 5 aa, Mycobacterium
TRHEP

SEQ ID NO: 1231133 - protein, 4 aa, Mycobacterium
TRHG

SEQ ID NO: 1231134 - protein, 6 aa, Mycobacterium
TRHGDD

SEQ ID NO: 1231135 - protein, 6 aa, Mycobacterium
TRHGDG

SEQ ID NO: 1231136 - protein, 7 aa, Mycobacterium
TRHPDGT

SEQ ID NO: 1231137 - protein, 7 aa, Mycobacterium
TRHPPTT

SEQ ID NO: 1231138 - protein, 7 aa, Mycobacterium
TRHQQGN

SEQ ID NO: 1231139 - protein, 7 aa, Mycobacterium
TRHTPAY

SEQ ID NO: 1231140 - protein, 8 aa, Mycobacterium
TRIPPQKR

SEQ ID NO: 1231141 - protein, 13 aa, Mycobacterium
TRISEESESRPKP

SEQ ID NO: 1231142 - protein, 9 aa, Mycobacterium
TRKDAERYA

SEQ ID NO: 1231143 - protein, 9 aa, Mycobacterium
TRKEKGKFA

SEQ ID NO: 1231144 - protein, 9 aa, Mycobacterium
TRKGPLAAP

SEQ ID NO: 1231145 - protein, 5 aa, Mycobacterium
TRKGR

SEQ ID NO: 1231146 - protein, 5 aa, Mycobacterium
TRKPF

SEQ ID NO: 1231147 - protein, 8 aa, Mycobacterium
TRKSSGRA

SEQ ID NO: 1231148 - protein, 6 aa, Mycobacterium
TRLAAE

SEQ ID NO: 1231149 - protein, 5 aa, Mycobacterium
TRLES

SEQ ID NO: 1231150 - protein, 16 aa, Mycobacterium
TRLGLSGTRAVLAGFP

SEQ ID NO: 1231151 - protein, 4 aa, Mycobacterium
TRLP

SEQ ID NO: 1231152 - protein, 8 aa, Mycobacterium
TRLRPTVD

SEQ ID NO: 1231153 - protein, 9 aa, Mycobacterium
TRLSENPRI

SEQ ID NO: 1231154 - protein, 6 aa, Mycobacterium
TRLSGQ

SEQ ID NO: 1231155 - protein, 4 aa, Mycobacterium
TRLT

SEQ ID NO: 1231156 - protein, 6 aa, Mycobacterium
TRMAGD

SEQ ID NO: 1231157 - protein, 6 aa, Mycobacterium
TRMDPQ

SEQ ID NO: 1231158 - protein, 17 aa, Mycobacterium
TRNDDPAGASRPFDKDR

SEQ ID NO: 1231159 - protein, 7 aa, Mycobacterium
TRNDREW

SEQ ID NO: 1231160 - protein, 8 aa, Mycobacterium
TRNEARNL

SEQ ID NO: 1231161 - protein, 13 aa, Mycobacterium
TRNEKDQPRGKGH

SEQ ID NO: 1231162 - protein, 10 aa, Mycobacterium
TRNGIDAQRR

SEQ ID NO: 1231163 - protein, 4 aa, Mycobacterium
TRNI

SEQ ID NO: 1231164 - protein, 7 aa, Mycobacterium
TRNPEQV

SEQ ID NO: 1231165 - protein, 7 aa, Mycobacterium
TRNPNPH

SEQ ID NO: 1231166 - protein, 16 aa, Mycobacterium
TRNRGTQLQRARAGEI

SEQ ID NO: 1231167 - protein, 13 aa, Mycobacterium
TRNYRGAYTLLEF

SEQ ID NO: 1231168 - protein, 4 aa, Mycobacterium
TRPA

SEQ ID NO: 1231169 - protein, 5 aa, Mycobacterium
TRPAD

SEQ ID NO: 1231170 - protein, 9 aa, Mycobacterium
TRPAPETLG

SEQ ID NO: 1231171 - protein, 19 aa, Mycobacterium
TRPDDDDASRAARNNRATY

SEQ ID NO: 1231172 - protein, 18 aa, Mycobacterium
TRPDGSAGSGQGAGSGQG

SEQ ID NO: 1231173 - protein, 10 aa, Mycobacterium
TRPDGTLQHP

SEQ ID NO: 1231174 - protein, 18 aa, Mycobacterium
TRPDPLGLPPSREPNETV

SEQ ID NO: 1231175 - protein, 6 aa, Mycobacterium
TRPDSI

SEQ ID NO: 1231176 - protein, 7 aa, Mycobacterium
TRPEPHA

SEQ ID NO: 1231177 - protein, 4 aa, Mycobacterium
TRPG

SEQ ID NO: 1231178 - protein, 22 aa, Mycobacterium
TRPGADLPDRVTRDAATASDIL

SEQ ID NO: 1231179 - protein, 6 aa, Mycobacterium
TRPGDV

SEQ ID NO: 1231180 - protein, 6 aa, Mycobacterium
TRPGGT

SEQ ID NO: 1231181 - protein, 7 aa, Mycobacterium
TRPGPGF

SEQ ID NO: 1231182 - protein, 8 aa, Mycobacterium
TRPGRGRE

SEQ ID NO: 1231183 - protein, 9 aa, Mycobacterium
TRPHSAEEA

SEQ ID NO: 1231184 - protein, 16 aa, Mycobacterium
TRPIRNREAPVSALPL

SEQ ID NO: 1231185 - protein, 5 aa, Mycobacterium
TRPKE

SEQ ID NO: 1231186 - protein, 14 aa, Mycobacterium
TRPNPDDPTGRSTM

SEQ ID NO: 1231187 - protein, 6 aa, Mycobacterium
TRPNRE

SEQ ID NO: 1231188 - protein, 10 aa, Mycobacterium
TRPPASGPVA

SEQ ID NO: 1231189 - protein, 7 aa, Mycobacterium
TRPPGAV

SEQ ID NO: 1231190 - protein, 13 aa, Mycobacterium
TRPPGVPDDDETV

SEQ ID NO: 1231191 - protein, 10 aa, Mycobacterium
TRPPRQMPGT

SEQ ID NO: 1231192 - protein, 5 aa, Mycobacterium
TRPQA

SEQ ID NO: 1231193 - protein, 10 aa, Mycobacterium
TRPQPTRDDK

SEQ ID NO: 1231194 - protein, 5 aa, Mycobacterium
TRPQR

SEQ ID NO: 1231195 - protein, 23 aa, Mycobacterium
TRPSDAPPIGPAAAAHKPDGPAL

SEQ ID NO: 1231196 - protein, 8 aa, Mycobacterium
TRPSRLSE

SEQ ID NO: 1231197 - protein, 8 aa, Mycobacterium
TRPTSATK

SEQ ID NO: 1231198 - protein, 15 aa, Mycobacterium
TRPVAAPPPRRSGRR

SEQ ID NO: 1231199 - protein, 9 aa, Mycobacterium
TRPYGGVTR

SEQ ID NO: 1231200 - protein, 5 aa, Mycobacterium
TRPYS

SEQ ID NO: 1231201 - protein, 10 aa, Mycobacterium
TRQPDPSDAR

SEQ ID NO: 1231202 - protein, 4 aa, Mycobacterium
TRQQ

SEQ ID NO: 1231203 - protein, 5 aa, Mycobacterium
TRQQT

SEQ ID NO: 1231204 - protein, 5 aa, Mycobacterium
TRQRL

SEQ ID NO: 1231205 - protein, 12 aa, Mycobacterium
TRQRSTVMPDTE

SEQ ID NO: 1231206 - protein, 8 aa, Mycobacterium
TRRAEAQR

SEQ ID NO: 1231207 - protein, 7 aa, Mycobacterium
TRRAERS

SEQ ID NO: 1231208 - protein, 10 aa, Mycobacterium
TRRAKETNDL

SEQ ID NO: 1231209 - protein, 11 aa, Mycobacterium
TRRATQQRSGL

SEQ ID NO: 1231210 - protein, 6 aa, Mycobacterium
TRRDDG

SEQ ID NO: 1231211 - protein, 4 aa, Mycobacterium
TRRE

SEQ ID NO: 1231212 - protein, 5 aa, Mycobacterium
TRRED

SEQ ID NO: 1231213 - protein, 6 aa, Mycobacterium
TRREGR

SEQ ID NO: 1231214 - protein, 12 aa, Mycobacterium
TRRGDEGRITNR

SEQ ID NO: 1231215 - protein, 5 aa, Mycobacterium
TRRGL

SEQ ID NO: 1231216 - protein, 10 aa, Mycobacterium
TRRGRSGGSF

SEQ ID NO: 1231217 - protein, 20 aa, Mycobacterium
TRRHPTSNSLPSGHSASGAA

SEQ ID NO: 1231218 - protein, 17 aa, Mycobacterium
TRRIDDSYANGYGNSKW

SEQ ID NO: 1231219 - protein, 10 aa, Mycobacterium
TRRKPPETGI

SEQ ID NO: 1231220 - protein, 16 aa, Mycobacterium
TRRPKDIRRGAPARVS

SEQ ID NO: 1231221 - protein, 7 aa, Mycobacterium
TRRPTTF

SEQ ID NO: 1231222 - protein, 5 aa, Mycobacterium
TRRPV

SEQ ID NO: 1231223 - protein, 9 aa, Mycobacterium
TRRQSGDAG

SEQ ID NO: 1231224 - protein, 8 aa, Mycobacterium
TRRRDRLD

SEQ ID NO: 1231225 - protein, 23 aa, Mycobacterium
TRRRGGKSSQKATPKSPETPPPT

SEQ ID NO: 1231226 - protein, 10 aa, Mycobacterium
TRRRREPGHD

SEQ ID NO: 1231227 - protein, 5 aa, Mycobacterium
TRRRS

SEQ ID NO: 1231228 - protein, 15 aa, Mycobacterium
TRRTEPVRRPPAERV

SEQ ID NO: 1231229 - protein, 9 aa, Mycobacterium
TRRTGRPTA

SEQ ID NO: 1231230 - protein, 12 aa, Mycobacterium
TRRYGAQGLPDD

SEQ ID NO: 1231231 - protein, 9 aa, Mycobacterium
TRSADPPAM

SEQ ID NO: 1231232 - protein, 9 aa, Mycobacterium
TRSAEAAEQ

SEQ ID NO: 1231233 - protein, 8 aa, Mycobacterium
TRSATEQL

SEQ ID NO: 1231234 - protein, 7 aa, Mycobacterium
TRSEKAI

SEQ ID NO: 1231235 - protein, 7 aa, Mycobacterium
TRSFGTE

SEQ ID NO: 1231236 - protein, 12 aa, Mycobacterium
TRSGAADRRSHT

SEQ ID NO: 1231237 - protein, 7 aa, Mycobacterium
TRSGDRL

SEQ ID NO: 1231238 - protein, 6 aa, Mycobacterium
TRSGPF

SEQ ID NO: 1231239 - protein, 5 aa, Mycobacterium
TRSLG

SEQ ID NO: 1231240 - protein, 10 aa, Mycobacterium
TRSNALNRPK

SEQ ID NO: 1231241 - protein, 5 aa, Mycobacterium
TRSPK

SEQ ID NO: 1231242 - protein, 4 aa, Mycobacterium
TRSQ

SEQ ID NO: 1231243 - protein, 6 aa, Mycobacterium
TRSQLE

SEQ ID NO: 1231244 - protein, 10 aa, Mycobacterium
TRSRTHRRTP

SEQ ID NO: 1231245 - protein, 4 aa, Mycobacterium
TRST

SEQ ID NO: 1231246 - protein, 5 aa, Mycobacterium
TRSTA

SEQ ID NO: 1231247 - protein, 5 aa, Mycobacterium
TRSTI

SEQ ID NO: 1231248 - protein, 19 aa, Mycobacterium
TRSVGQQAATLKGEKRSGL

SEQ ID NO: 1231249 - protein, 5 aa, Mycobacterium
TRSVV

SEQ ID NO: 1231250 - protein, 6 aa, Mycobacterium
TRTASS

SEQ ID NO: 1231251 - protein, 5 aa, Mycobacterium
TRTDI

SEQ ID NO: 1231252 - protein, 10 aa, Mycobacterium
TRTDPNAAAM

SEQ ID NO: 1231253 - protein, 7 aa, Mycobacterium
TRTDTDR

SEQ ID NO: 1231254 - protein, 5 aa, Mycobacterium
TRTGR

SEQ ID NO: 1231255 - protein, 7 aa, Mycobacterium
TRTNTHS

SEQ ID NO: 1231256 - protein, 15 aa, Mycobacterium
TRTPGGSSGGSAAAV

SEQ ID NO: 1231257 - protein, 7 aa, Mycobacterium
TRTPSGD

SEQ ID NO: 1231258 - protein, 5 aa, Mycobacterium
TRTPT

SEQ ID NO: 1231259 - protein, 13 aa, Mycobacterium
TRTRDRRPDLLGD

SEQ ID NO: 1231260 - protein, 8 aa, Mycobacterium
TRTREPRA

SEQ ID NO: 1231261 - protein, 6 aa, Mycobacterium
TRTRPQ

SEQ ID NO: 1231262 - protein, 5 aa, Mycobacterium
TRTRT

SEQ ID NO: 1231263 - protein, 8 aa, Mycobacterium
TRTSSDVP

SEQ ID NO: 1231264 - protein, 11 aa, Mycobacterium
TRTSTDGSGAT

SEQ ID NO: 1231265 - protein, 10 aa, Mycobacterium
TRTTDPKDAR

SEQ ID NO: 1231266 - protein, 7 aa, Mycobacterium
TRTTDRF

SEQ ID NO: 1231267 - protein, 7 aa, Mycobacterium
TRTTDYG

SEQ ID NO: 1231268 - protein, 8 aa, Mycobacterium
TRTTTRKV

SEQ ID NO: 1231269 - protein, 6 aa, Mycobacterium
TRVDPA

SEQ ID NO: 1231270 - protein, 9 aa, Mycobacterium
TRVGGRQPA

SEQ ID NO: 1231271 - protein, 12 aa, Mycobacterium
TRVGQARTDAVR

SEQ ID NO: 1231272 - protein, 17 aa, Mycobacterium
TRVPTDGSLAYRDNGNT

SEQ ID NO: 1231273 - protein, 6 aa, Mycobacterium
TRVQGA

SEQ ID NO: 1231274 - protein, 13 aa, Mycobacterium
TRVSGRTALERAR

SEQ ID NO: 1231275 - protein, 6 aa, Mycobacterium
TRVSTG

SEQ ID NO: 1231276 - protein, 14 aa, Mycobacterium
TRWPERRAPSTAEV

SEQ ID NO: 1231277 - protein, 8 aa, Mycobacterium
TRYAPGGV

SEQ ID NO: 1231278 - protein, 5 aa, Mycobacterium
TRYEQ

SEQ ID NO: 1231279 - protein, 5 aa, Mycobacterium
TRYQA

SEQ ID NO: 1231280 - protein, 4 aa, Mycobacterium
TRYR

SEQ ID NO: 1231281 - protein, 4 aa, Mycobacterium
TRYT

SEQ ID NO: 1231282 - protein, 20 aa, Mycobacterium
TSAAASTCPTAAPADGEPEW

SEQ ID NO: 1231283 - protein, 8 aa, Mycobacterium
TSAADTVE

SEQ ID NO: 1231284 - protein, 9 aa, Mycobacterium
TSAAEKGGY

SEQ ID NO: 1231285 - protein, 6 aa, Mycobacterium
TSAAER

SEQ ID NO: 1231286 - protein, 7 aa, Mycobacterium
TSAAERA

SEQ ID NO: 1231287 - protein, 8 aa, Mycobacterium
TSAAGGLP

SEQ ID NO: 1231288 - protein, 6 aa, Mycobacterium
TSAAQK

SEQ ID NO: 1231289 - protein, 5 aa, Mycobacterium
TSAAS

SEQ ID NO: 1231290 - protein, 9 aa, Mycobacterium
TSADDGQAY

SEQ ID NO: 1231291 - protein, 6 aa, Mycobacterium
TSADEA

SEQ ID NO: 1231292 - protein, 9 aa, Mycobacterium
TSADGSTLA

SEQ ID NO: 1231293 - protein, 8 aa, Mycobacterium
TSADPAAA

SEQ ID NO: 1231294 - protein, 6 aa, Mycobacterium
TSADTV

SEQ ID NO: 1231295 - protein, 7 aa, Mycobacterium
TSAEAAE

SEQ ID NO: 1231296 - protein, 8 aa, Mycobacterium
TSAENAAR

SEQ ID NO: 1231297 - protein, 8 aa, Mycobacterium
TSAERAGL

SEQ ID NO: 1231298 - protein, 11 aa, Mycobacterium
TSAESTTPAVS

SEQ ID NO: 1231299 - protein, 13 aa, Mycobacterium
TSAGAAARTPVAR

SEQ ID NO: 1231300 - protein, 6 aa, Mycobacterium
TSAGEM

SEQ ID NO: 1231301 - protein, 8 aa, Mycobacterium
TSAGERVD

SEQ ID NO: 1231302 - protein, 9 aa, Mycobacterium
TSAGGARDA

SEQ ID NO: 1231303 - protein, 6 aa, Mycobacterium
TSAGGE

SEQ ID NO: 1231304 - protein, 7 aa, Mycobacterium
TSAGPTA

SEQ ID NO: 1231305 - protein, 15 aa, Mycobacterium
TSAGSAVAAQVGSGV

SEQ ID NO: 1231306 - protein, 8 aa, Mycobacterium
TSAHPAFS

SEQ ID NO: 1231307 - protein, 7 aa, Mycobacterium
TSAHPYA

SEQ ID NO: 1231308 - protein, 4 aa, Mycobacterium
TSAI

SEQ ID NO: 1231309 - protein, 8 aa, Mycobacterium
TSALDSRR

SEQ ID NO: 1231310 - protein, 7 aa, Mycobacterium
TSAPEDE

SEQ ID NO: 1231311 - protein, 13 aa, Mycobacterium
TSAPLEEDPSPTV

SEQ ID NO: 1231312 - protein, 13 aa, Mycobacterium
TSAPSPAPNSADD

SEQ ID NO: 1231313 - protein, 10 aa, Mycobacterium
TSAQAGYSAT

SEQ ID NO: 1231314 - protein, 6 aa, Mycobacterium
TSAREV

SEQ ID NO: 1231315 - protein, 20 aa, Mycobacterium
TSATAGARTEVANNSGGRPE

SEQ ID NO: 1231316 - protein, 8 aa, Mycobacterium
TSATRDGD

SEQ ID NO: 1231317 - protein, 7 aa, Mycobacterium
TSAVRDG

SEQ ID NO: 1231318 - protein, 6 aa, Mycobacterium
TSCSSA

SEQ ID NO: 1231319 - protein, 6 aa, Mycobacterium
TSDAFA

SEQ ID NO: 1231320 - protein, 10 aa, Mycobacterium
TSDAGAEDMD

SEQ ID NO: 1231321 - protein, 10 aa, Mycobacterium
TSDAGHGDSI

SEQ ID NO: 1231322 - protein, 7 aa, Mycobacterium
TSDATQR

SEQ ID NO: 1231323 - protein, 8 aa, Mycobacterium
TSDDGTRV

SEQ ID NO: 1231324 - protein, 11 aa, Mycobacterium
TSDDQNPASPA

SEQ ID NO: 1231325 - protein, 6 aa, Mycobacterium
TSDEDT

SEQ ID NO: 1231326 - protein, 11 aa, Mycobacterium
TSDEENLTPQE

SEQ ID NO: 1231327 - protein, 10 aa, Mycobacterium
TSDEGKPQLK

SEQ ID NO: 1231328 - protein, 16 aa, Mycobacterium
TSDEGRKDDIAFLRDN

SEQ ID NO: 1231329 - protein, 12 aa, Mycobacterium
TSDGIDSSTPAG

SEQ ID NO: 1231330 - protein, 33 aa, Mycobacterium
TSDGRGSRGDRDGRGRRDDRGGRGRDGGDKSNY

SEQ ID NO: 1231331 - protein, 8 aa, Mycobacterium
TSDNRSRL

SEQ ID NO: 1231332 - protein, 9 aa, Mycobacterium
TSDPDHYEA

SEQ ID NO: 1231333 - protein, 8 aa, Mycobacterium
TSDPEAAQ

SEQ ID NO: 1231334 - protein, 7 aa, Mycobacterium
TSDPVRR

SEQ ID NO: 1231335 - protein, 17 aa, Mycobacterium
TSDRALSERVRGAGATV

SEQ ID NO: 1231336 - protein, 4 aa, Mycobacterium
TSDS

SEQ ID NO: 1231337 - protein, 5 aa, Mycobacterium
TSDSH

SEQ ID NO: 1231338 - protein, 5 aa, Mycobacterium
TSDTA

SEQ ID NO: 1231339 - protein, 11 aa, Mycobacterium
TSEAADKAQRG

SEQ ID NO: 1231340 - protein, 5 aa, Mycobacterium
TSEDA

SEQ ID NO: 1231341 - protein, 14 aa, Mycobacterium
TSEDRPGDPGYHGQ

SEQ ID NO: 1231342 - protein, 8 aa, Mycobacterium
TSEEPDVG

SEQ ID NO: 1231343 - protein, 5 aa, Mycobacterium
TSEES

SEQ ID NO: 1231344 - protein, 7 aa, Mycobacterium
TSEESVN

SEQ ID NO: 1231345 - protein, 4 aa, Mycobacterium
TSEM

SEQ ID NO: 1231346 - protein, 14 aa, Mycobacterium
TSEQLDDEQALPTA

SEQ ID NO: 1231347 - protein, 7 aa, Mycobacterium
TSESAFS

SEQ ID NO: 1231348 - protein, 5 aa, Mycobacterium
TSESV

SEQ ID NO: 1231349 - protein, 12 aa, Mycobacterium
TSEVYGSSSRDP

SEQ ID NO: 1231350 - protein, 4 aa, Mycobacterium
TSGA

SEQ ID NO: 1231351 - protein, 8 aa, Mycobacterium
TSGAASVT

SEQ ID NO: 1231352 - protein, 16 aa, Mycobacterium
TSGADSLGSNGQLRES

SEQ ID NO: 1231353 - protein, 8 aa, Mycobacterium
TSGAGGLP

SEQ ID NO: 1231354 - protein, 5 aa, Mycobacterium
TSGAH

SEQ ID NO: 1231355 - protein, 7 aa, Mycobacterium
TSGAPAI

SEQ ID NO: 1231356 - protein, 8 aa, Mycobacterium
TSGAQTAD

SEQ ID NO: 1231357 - protein, 10 aa, Mycobacterium
TSGARTAAER

SEQ ID NO: 1231358 - protein, 7 aa, Mycobacterium
TSGAYNS

SEQ ID NO: 1231359 - protein, 5 aa, Mycobacterium
TSGDD

SEQ ID NO: 1231360 - protein, 9 aa, Mycobacterium
TSGDPRSAV

SEQ ID NO: 1231361 - protein, 6 aa, Mycobacterium
TSGDPS

SEQ ID NO: 1231362 - protein, 10 aa, Mycobacterium
TSGEPGQARG

SEQ ID NO: 1231363 - protein, 6 aa, Mycobacterium
TSGESY

SEQ ID NO: 1231364 - protein, 7 aa, Mycobacterium
TSGFDPH

SEQ ID NO: 1231365 - protein, 9 aa, Mycobacterium
TSGGDEFDV

SEQ ID NO: 1231366 - protein, 17 aa, Mycobacterium
TSGGQVARYRPADGETD

SEQ ID NO: 1231367 - protein, 7 aa, Mycobacterium
TSGHTQR

SEQ ID NO: 1231368 - protein, 4 aa, Mycobacterium
TSGI

SEQ ID NO: 1231369 - protein, 12 aa, Mycobacterium
TSGITTDGPAVS

SEQ ID NO: 1231370 - protein, 7 aa, Mycobacterium
TSGPADE

SEQ ID NO: 1231371 - protein, 17 aa, Mycobacterium
TSGPALQQNLVAVLEGQ

SEQ ID NO: 1231372 - protein, 8 aa, Mycobacterium
TSGPYTDA

SEQ ID NO: 1231373 - protein, 18 aa, Mycobacterium
TSGRANKARLNRSPVRSA

SEQ ID NO: 1231374 - protein, 7 aa, Mycobacterium
TSGRQRR

SEQ ID NO: 1231375 - protein, 30 aa, Mycobacterium
TSGSKTVESGKPKATAPMTAATRAAVYQGM

SEQ ID NO: 1231376 - protein, 14 aa, Mycobacterium
TSGSSMVKETTVLP

SEQ ID NO: 1231377 - protein, 9 aa, Mycobacterium
TSGSTRAPA

SEQ ID NO: 1231378 - protein, 10 aa, Mycobacterium
TSGSTRQPAG

SEQ ID NO: 1231379 - protein, 8 aa, Mycobacterium
TSGSTRVP

SEQ ID NO: 1231380 - protein, 5 aa, Mycobacterium
TSGSV

SEQ ID NO: 1231381 - protein, 14 aa, Mycobacterium
TSGTAPLSADDADA

SEQ ID NO: 1231382 - protein, 10 aa, Mycobacterium
TSGTTGNPKG

SEQ ID NO: 1231383 - protein, 13 aa, Mycobacterium
TSGTTGSPKGATL

SEQ ID NO: 1231384 - protein, 11 aa, Mycobacterium
TSGTTGTPKGA

SEQ ID NO: 1231385 - protein, 12 aa, Mycobacterium
TSGVTTDTFKGR

SEQ ID NO: 1231386 - protein, 5 aa, Mycobacterium
TSHLA

SEQ ID NO: 1231387 - protein, 7 aa, Mycobacterium
TSHRETP

SEQ ID NO: 1231388 - protein, 7 aa, Mycobacterium
TSHRQGA

SEQ ID NO: 1231389 - protein, 6 aa, Mycobacterium
TSHRRA

SEQ ID NO: 1231390 - protein, 13 aa, Mycobacterium
TSHTGGAASVAGL

SEQ ID NO: 1231391 - protein, 6 aa, Mycobacterium
TSIADR

SEQ ID NO: 1231392 - protein, 11 aa, Mycobacterium
TSIATSCGQET

SEQ ID NO: 1231393 - protein, 8 aa, Mycobacterium
TSIPEGGI

SEQ ID NO: 1231394 - protein, 12 aa, Mycobacterium
TSKAEGTWTTTG

SEQ ID NO: 1231395 - protein, 6 aa, Mycobacterium
TSKAGD

SEQ ID NO: 1231396 - protein, 8 aa, Mycobacterium
TSKARRTL

SEQ ID NO: 1231397 - protein, 6 aa, Mycobacterium
TSKDRL

SEQ ID NO: 1231398 - protein, 14 aa, Mycobacterium
TSKGSRMRETVPAS

SEQ ID NO: 1231399 - protein, 18 aa, Mycobacterium
TSKIKKSSDPGEDAPTID

SEQ ID NO: 1231400 - protein, 6 aa, Mycobacterium
TSLDGT

SEQ ID NO: 1231401 - protein, 8 aa, Mycobacterium
TSLEDPDS

SEQ ID NO: 1231402 - protein, 6 aa, Mycobacterium
TSLKAG

SEQ ID NO: 1231403 - protein, 15 aa, Mycobacterium
TSLKQATAQKGTRLP

SEQ ID NO: 1231404 - protein, 12 aa, Mycobacterium
TSLNASANTAGY

SEQ ID NO: 1231405 - protein, 14 aa, Mycobacterium
TSLNGTQAQADPDG

SEQ ID NO: 1231406 - protein, 13 aa, Mycobacterium
TSLNGTQAQVDPD

SEQ ID NO: 1231407 - protein, 6 aa, Mycobacterium
TSLPDR

SEQ ID NO: 1231408 - protein, 8 aa, Mycobacterium
TSLRETEA

SEQ ID NO: 1231409 - protein, 12 aa, Mycobacterium
TSLSGEGSGKVA

SEQ ID NO: 1231410 - protein, 20 aa, Mycobacterium
TSLTEDEIGEYSGEKKEIRP

SEQ ID NO: 1231411 - protein, 11 aa, Mycobacterium
TSMAPAAASVA

SEQ ID NO: 1231412 - protein, 6 aa, Mycobacterium
TSMDQG

SEQ ID NO: 1231413 - protein, 4 aa, Mycobacterium
TSMG

SEQ ID NO: 1231414 - protein, 13 aa, Mycobacterium
TSMGKGGTQTIGG

SEQ ID NO: 1231415 - protein, 9 aa, Mycobacterium
TSNGIAPAP

SEQ ID NO: 1231416 - protein, 6 aa, Mycobacterium
TSNGPA

SEQ ID NO: 1231417 - protein, 4 aa, Mycobacterium
TSNK

SEQ ID NO: 1231418 - protein, 8 aa, Mycobacterium
TSNNGDHN

SEQ ID NO: 1231419 - protein, 7 aa, Mycobacterium
TSNNSVR

SEQ ID NO: 1231420 - protein, 5 aa, Mycobacterium
TSNPA

SEQ ID NO: 1231421 - protein, 8 aa, Mycobacterium
TSNPEGAS

SEQ ID NO: 1231422 - protein, 17 aa, Mycobacterium
TSNPSGNDRGGSSSTGV

SEQ ID NO: 1231423 - protein, 26 aa, Mycobacterium
TSNTANTLAGRSEGVDLDDRGREQAS

SEQ ID NO: 1231424 - protein, 8 aa, Mycobacterium
TSPAAAVT

SEQ ID NO: 1231425 - protein, 23 aa, Mycobacterium
TSPAGDKGFPGTSAYGATKAALA

SEQ ID NO: 1231426 - protein, 7 aa, Mycobacterium
TSPDPDG

SEQ ID NO: 1231427 - protein, 10 aa, Mycobacterium
TSPDTGAIAP

SEQ ID NO: 1231428 - protein, 4 aa, Mycobacterium
TSPE

SEQ ID NO: 1231429 - protein, 13 aa, Mycobacterium
TSPEPRGVGTTRT

SEQ ID NO: 1231430 - protein, 7 aa, Mycobacterium
TSPGALD

SEQ ID NO: 1231431 - protein, 9 aa, Mycobacterium
TSPGEGGAR

SEQ ID NO: 1231432 - protein, 15 aa, Mycobacterium
TSPGGAVPRPPDVPE

SEQ ID NO: 1231433 - protein, 15 aa, Mycobacterium
TSPIKADSAPPALDE

SEQ ID NO: 1231434 - protein, 10 aa, Mycobacterium
TSPKAQAELN

SEQ ID NO: 1231435 - protein, 9 aa, Mycobacterium
TSPLGTPGA

SEQ ID NO: 1231436 - protein, 6 aa, Mycobacterium
TSPNPE

SEQ ID NO: 1231437 - protein, 6 aa, Mycobacterium
TSPPRF

SEQ ID NO: 1231438 - protein, 6 aa, Mycobacterium
TSPQAF

SEQ ID NO: 1231439 - protein, 7 aa, Mycobacterium
TSPQGAR

SEQ ID NO: 1231440 - protein, 8 aa, Mycobacterium
TSPQGSVG

SEQ ID NO: 1231441 - protein, 6 aa, Mycobacterium
TSPQLA

SEQ ID NO: 1231442 - protein, 8 aa, Mycobacterium
TSPQQEYT

SEQ ID NO: 1231443 - protein, 7 aa, Mycobacterium
TSPQSLV

SEQ ID NO: 1231444 - protein, 4 aa, Mycobacterium
TSPR

SEQ ID NO: 1231445 - protein, 10 aa, Mycobacterium
TSPRFTDDER

SEQ ID NO: 1231446 - protein, 5 aa, Mycobacterium
TSPRG

SEQ ID NO: 1231447 - protein, 20 aa, Mycobacterium
TSPSPSKRRTATRDNELGGH

SEQ ID NO: 1231448 - protein, 33 aa, Mycobacterium
TSPTAQPAVAPPPPAPAAPLAPGLAPLPQPLGQ

SEQ ID NO: 1231449 - protein, 6 aa, Mycobacterium
TSPTLT

SEQ ID NO: 1231450 - protein, 8 aa, Mycobacterium
TSPTNESK

SEQ ID NO: 1231451 - protein, 7 aa, Mycobacterium
TSPTTAT

SEQ ID NO: 1231452 - protein, 13 aa, Mycobacterium
TSPVAADSRGLGT

SEQ ID NO: 1231453 - protein, 7 aa, Mycobacterium
TSPYDAT

SEQ ID NO: 1231454 - protein, 12 aa, Mycobacterium
TSPYGAAARRAR

SEQ ID NO: 1231455 - protein, 9 aa, Mycobacterium
TSQADVDAG

SEQ ID NO: 1231456 - protein, 9 aa, Mycobacterium
TSQAGGARG

SEQ ID NO: 1231457 - protein, 8 aa, Mycobacterium
TSQEQEAL

SEQ ID NO: 1231458 - protein, 8 aa, Mycobacterium
TSQGPTAT

SEQ ID NO: 1231459 - protein, 8 aa, Mycobacterium
TSQHEAAD

SEQ ID NO: 1231460 - protein, 4 aa, Mycobacterium
TSQS

SEQ ID NO: 1231461 - protein, 18 aa, Mycobacterium
TSRALGPVPREPYETPLG

SEQ ID NO: 1231462 - protein, 4 aa, Mycobacterium
TSRD

SEQ ID NO: 1231463 - protein, 12 aa, Mycobacterium
TSRDPDDAADAL

SEQ ID NO: 1231464 - protein, 5 aa, Mycobacterium
TSREI

SEQ ID NO: 1231465 - protein, 5 aa, Mycobacterium
TSREL

SEQ ID NO: 1231466 - protein, 4 aa, Mycobacterium
TSRG

SEQ ID NO: 1231467 - protein, 5 aa, Mycobacterium
TSRGE

SEQ ID NO: 1231468 - protein, 10 aa, Mycobacterium
TSRGERKQQG

SEQ ID NO: 1231469 - protein, 7 aa, Mycobacterium
TSRIDGS

SEQ ID NO: 1231470 - protein, 8 aa, Mycobacterium
TSRLEPSD

SEQ ID NO: 1231471 - protein, 12 aa, Mycobacterium
TSRRVADRAGLK

SEQ ID NO: 1231472 - protein, 8 aa, Mycobacterium
TSRSAELT

SEQ ID NO: 1231473 - protein, 9 aa, Mycobacterium
TSRSGDQVI

SEQ ID NO: 1231474 - protein, 9 aa, Mycobacterium
TSRSPKDLP

SEQ ID NO: 1231475 - protein, 8 aa, Mycobacterium
TSRSVSND

SEQ ID NO: 1231476 - protein, 4 aa, Mycobacterium
TSRT

SEQ ID NO: 1231477 - protein, 6 aa, Mycobacterium
TSRTGA

SEQ ID NO: 1231478 - protein, 8 aa, Mycobacterium
TSRTPTGD

SEQ ID NO: 1231479 - protein, 16 aa, Mycobacterium
TSRVTNAAGAKQEPRA

SEQ ID NO: 1231480 - protein, 18 aa, Mycobacterium
TSSAEEPADGTGVVSGPP

SEQ ID NO: 1231481 - protein, 11 aa, Mycobacterium
TSSAPTPGRPR

SEQ ID NO: 1231482 - protein, 9 aa, Mycobacterium
TSSAQSRDV

SEQ ID NO: 1231483 - protein, 4 aa, Mycobacterium
TSSD

SEQ ID NO: 1231484 - protein, 7 aa, Mycobacterium
TSSDVEQ

SEQ ID NO: 1231485 - protein, 12 aa, Mycobacterium
TSSEDKAGRDAA

SEQ ID NO: 1231486 - protein, 4 aa, Mycobacterium
TSSG

SEQ ID NO: 1231487 - protein, 5 aa, Mycobacterium
TSSGC

SEQ ID NO: 1231488 - protein, 13 aa, Mycobacterium
TSSGEIPTNWPGP

SEQ ID NO: 1231489 - protein, 12 aa, Mycobacterium
TSSGRMADCSRP

SEQ ID NO: 1231490 - protein, 9 aa, Mycobacterium
TSSIREGSR

SEQ ID NO: 1231491 - protein, 8 aa, Mycobacterium
TSSLTPSR

SEQ ID NO: 1231492 - protein, 9 aa, Mycobacterium
TSSLTPSRI

SEQ ID NO: 1231493 - protein, 11 aa, Mycobacterium
TSSNPVQRTPY

SEQ ID NO: 1231494 - protein, 20 aa, Mycobacterium
TSSPAGEGQEPQLMGPGLER

SEQ ID NO: 1231495 - protein, 7 aa, Mycobacterium
TSSPAVS

SEQ ID NO: 1231496 - protein, 7 aa, Mycobacterium
TSSPDGR

SEQ ID NO: 1231497 - protein, 10 aa, Mycobacterium
TSSPGSGKTT

SEQ ID NO: 1231498 - protein, 13 aa, Mycobacterium
TSSPVTSKGSRTI

SEQ ID NO: 1231499 - protein, 16 aa, Mycobacterium
TSSQPGTPDDFSEQQL

SEQ ID NO: 1231500 - protein, 4 aa, Mycobacterium
TSSR

SEQ ID NO: 1231501 - protein, 5 aa, Mycobacterium
TSSSI

SEQ ID NO: 1231502 - protein, 5 aa, Mycobacterium
TSSST

SEQ ID NO: 1231503 - protein, 8 aa, Mycobacterium
TSSTKAFD

SEQ ID NO: 1231504 - protein, 8 aa, Mycobacterium
TSSTRGID

SEQ ID NO: 1231505 - protein, 5 aa, Mycobacterium
TSSVH

SEQ ID NO: 1231506 - protein, 8 aa, Mycobacterium
TSSVTDGA

SEQ ID NO: 1231507 - protein, 5 aa, Mycobacterium
TSSYG

SEQ ID NO: 1231508 - protein, 5 aa, Mycobacterium
TSTAA

SEQ ID NO: 1231509 - protein, 5 aa, Mycobacterium
TSTAD

SEQ ID NO: 1231510 - protein, 8 aa, Mycobacterium
TSTAGVPT

SEQ ID NO: 1231511 - protein, 15 aa, Mycobacterium
TSTATPAAPPEGTGQ

SEQ ID NO: 1231512 - protein, 5 aa, Mycobacterium
TSTAY

SEQ ID NO: 1231513 - protein, 7 aa, Mycobacterium
TSTDDDG

SEQ ID NO: 1231514 - protein, 8 aa, Mycobacterium
TSTDGGYS

SEQ ID NO: 1231515 - protein, 11 aa, Mycobacterium
TSTDPDNRRKG

SEQ ID NO: 1231516 - protein, 9 aa, Mycobacterium
TSTDPDRDV

SEQ ID NO: 1231517 - protein, 5 aa, Mycobacterium
TSTEA

SEQ ID NO: 1231518 - protein, 6 aa, Mycobacterium
TSTEAV

SEQ ID NO: 1231519 - protein, 7 aa, Mycobacterium
TSTEGEP

SEQ ID NO: 1231520 - protein, 5 aa, Mycobacterium
TSTEL

SEQ ID NO: 1231521 - protein, 7 aa, Mycobacterium
TSTEPGK

SEQ ID NO: 1231522 - protein, 5 aa, Mycobacterium
TSTGF

SEQ ID NO: 1231523 - protein, 13 aa, Mycobacterium
TSTGPDDNDDPAQ

SEQ ID NO: 1231524 - protein, 14 aa, Mycobacterium
TSTGTIGSSGGDAM

SEQ ID NO: 1231525 - protein, 5 aa, Mycobacterium
TSTIN

SEQ ID NO: 1231526 - protein, 6 aa, Mycobacterium
TSTKDM

SEQ ID NO: 1231527 - protein, 4 aa, Mycobacterium
TSTL

SEQ ID NO: 1231528 - protein, 7 aa, Mycobacterium
TSTMPGG

SEQ ID NO: 1231529 - protein, 8 aa, Mycobacterium
TSTNAEPP

SEQ ID NO: 1231530 - protein, 4 aa, Mycobacterium
TSTP

SEQ ID NO: 1231531 - protein, 7 aa, Mycobacterium
TSTPDVA

SEQ ID NO: 1231532 - protein, 12 aa, Mycobacterium
TSTRDDGSAGWR

SEQ ID NO: 1231533 - protein, 6 aa, Mycobacterium
TSTRTR

SEQ ID NO: 1231534 - protein, 8 aa, Mycobacterium
TSTSPDDV

SEQ ID NO: 1231535 - protein, 71 aa, Mycobacterium
TSTSQTSEAAPAKDMPDDSTSEADTADGAEPNGDVEDESVAEADPDSAEPEEDAEDEVVEPEAADESAPVV

SEQ ID NO: 1231536 - protein, 11 aa, Mycobacterium
TSTTLDGGDGD

SEQ ID NO: 1231537 - protein, 8 aa, Mycobacterium
TSTTPAGR

SEQ ID NO: 1231538 - protein, 6 aa, Mycobacterium
TSTTTD

SEQ ID NO: 1231539 - protein, 11 aa, Mycobacterium
TSTTVESDEDR

SEQ ID NO: 1231540 - protein, 8 aa, Mycobacterium
TSTVHHTN

SEQ ID NO: 1231541 - protein, 8 aa, Mycobacterium
TSTVPGGY

SEQ ID NO: 1231542 - protein, 4 aa, Mycobacterium
TSTY

SEQ ID NO: 1231543 - protein, 10 aa, Mycobacterium
TSVADTGGGL

SEQ ID NO: 1231544 - protein, 5 aa, Mycobacterium
TSVAE

SEQ ID NO: 1231545 - protein, 8 aa, Mycobacterium
TSVEKSEY

SEQ ID NO: 1231546 - protein, 6 aa, Mycobacterium
TSVGPD

SEQ ID NO: 1231547 - protein, 17 aa, Mycobacterium
TSVLSPGGRISTPEDDG

SEQ ID NO: 1231548 - protein, 13 aa, Mycobacterium
TSVPDDDTWQTSQ

SEQ ID NO: 1231549 - protein, 24 aa, Mycobacterium
TSVPPATGPLEPAATRTAARRNPY

SEQ ID NO: 1231550 - protein, 10 aa, Mycobacterium
TSWNDPDADF

SEQ ID NO: 1231551 - protein, 4 aa, Mycobacterium
TSWS

SEQ ID NO: 1231552 - protein, 6 aa, Mycobacterium
TSYAQP

SEQ ID NO: 1231553 - protein, 9 aa, Mycobacterium
TSYPGDCTS

SEQ ID NO: 1231554 - protein, 7 aa, Mycobacterium
TSYPPKL

SEQ ID NO: 1231555 - protein, 5 aa, Mycobacterium
TSYQP

SEQ ID NO: 1231556 - protein, 13 aa, Mycobacterium
TSYRVPTDGPSAS

SEQ ID NO: 1231557 - protein, 7 aa, Mycobacterium
TTAAEAA

SEQ ID NO: 1231558 - protein, 13 aa, Mycobacterium
TTAAEIGQRAGYS

SEQ ID NO: 1231559 - protein, 7 aa, Mycobacterium
TTAAGER

SEQ ID NO: 1231560 - protein, 8 aa, Mycobacterium
TTAAGERA

SEQ ID NO: 1231561 - protein, 18 aa, Mycobacterium
TTAALPPMAQPPPDPDRV

SEQ ID NO: 1231562 - protein, 9 aa, Mycobacterium
TTAANAGTE

SEQ ID NO: 1231563 - protein, 12 aa, Mycobacterium
TTAAREDVTSAA

SEQ ID NO: 1231564 - protein, 4 aa, Mycobacterium
TTAD

SEQ ID NO: 1231565 - protein, 10 aa, Mycobacterium
TTADAPAGTR

SEQ ID NO: 1231566 - protein, 28 aa, Mycobacterium
TTADEDDPTAAEATQGTTGQGPDVESEA

SEQ ID NO: 1231567 - protein, 5 aa, Mycobacterium
TTADG

SEQ ID NO: 1231568 - protein, 12 aa, Mycobacterium
TTADHGRRTPPK

SEQ ID NO: 1231569 - protein, 6 aa, Mycobacterium
TTADQM

SEQ ID NO: 1231570 - protein, 5 aa, Mycobacterium
TTADS

SEQ ID NO: 1231571 - protein, 22 aa, Mycobacterium
TTADSAANAPRRDEREPVGGDA

SEQ ID NO: 1231572 - protein, 5 aa, Mycobacterium
TTADV

SEQ ID NO: 1231573 - protein, 11 aa, Mycobacterium
TTAEDAGPAES

SEQ ID NO: 1231574 - protein, 7 aa, Mycobacterium
TTAEDGA

SEQ ID NO: 1231575 - protein, 4 aa, Mycobacterium
TTAG

SEQ ID NO: 1231576 - protein, 12 aa, Mycobacterium
TTAGEGPTHQVA

SEQ ID NO: 1231577 - protein, 5 aa, Mycobacterium
TTAGP

SEQ ID NO: 1231578 - protein, 10 aa, Mycobacterium
TTAGTGSETS

SEQ ID NO: 1231579 - protein, 14 aa, Mycobacterium
TTAGYLRAKTQYRL

SEQ ID NO: 1231580 - protein, 10 aa, Mycobacterium
TTAKTALERG

SEQ ID NO: 1231581 - protein, 6 aa, Mycobacterium
TTAKTG

SEQ ID NO: 1231582 - protein, 7 aa, Mycobacterium
TTAPANA

SEQ ID NO: 1231583 - protein, 10 aa, Mycobacterium
TTAPESAEPQ

SEQ ID NO: 1231584 - protein, 5 aa, Mycobacterium
TTAPR

SEQ ID NO: 1231585 - protein, 10 aa, Mycobacterium
TTAQHSSYSG

SEQ ID NO: 1231586 - protein, 11 aa, Mycobacterium
TTAQPAATASE

SEQ ID NO: 1231587 - protein, 5 aa, Mycobacterium
TTARR

SEQ ID NO: 1231588 - protein, 8 aa, Mycobacterium
TTARRAGD

SEQ ID NO: 1231589 - protein, 15 aa, Mycobacterium
TTASGPGPDVDTVSR

SEQ ID NO: 1231590 - protein, 10 aa, Mycobacterium
TTASKSPKEH

SEQ ID NO: 1231591 - protein, 12 aa, Mycobacterium
TTASPAATGEPS

SEQ ID NO: 1231592 - protein, 16 aa, Mycobacterium
TTASPPPARPDGAAPL

SEQ ID NO: 1231593 - protein, 19 aa, Mycobacterium
TTASTTGGNGGVGVGDANG

SEQ ID NO: 1231594 - protein, 8 aa, Mycobacterium
TTATANDR

SEQ ID NO: 1231595 - protein, 21 aa, Mycobacterium
TTATDRSDRPTDPVVIESITI

SEQ ID NO: 1231596 - protein, 11 aa, Mycobacterium
TTATPFGQQPL

SEQ ID NO: 1231597 - protein, 19 aa, Mycobacterium
TTATPNVGRAETLFGRKPA

SEQ ID NO: 1231598 - protein, 6 aa, Mycobacterium
TTAVRQ

SEQ ID NO: 1231599 - protein, 6 aa, Mycobacterium
TTCDST

SEQ ID NO: 1231600 - protein, 18 aa, Mycobacterium
TTCPEHESAMDQAVKEAL

SEQ ID NO: 1231601 - protein, 5 aa, Mycobacterium
TTDAF

SEQ ID NO: 1231602 - protein, 14 aa, Mycobacterium
TTDAKGDSCPTDAS

SEQ ID NO: 1231603 - protein, 7 aa, Mycobacterium
TTDARLD

SEQ ID NO: 1231604 - protein, 6 aa, Mycobacterium
TTDAVR

SEQ ID NO: 1231605 - protein, 6 aa, Mycobacterium
TTDAYE

SEQ ID NO: 1231606 - protein, 11 aa, Mycobacterium
TTDDPQARKQA

SEQ ID NO: 1231607 - protein, 12 aa, Mycobacterium
TTDEEGKPCSAG

SEQ ID NO: 1231608 - protein, 7 aa, Mycobacterium
TTDEQKA

SEQ ID NO: 1231609 - protein, 14 aa, Mycobacterium
TTDERTGAAKDYDV

SEQ ID NO: 1231610 - protein, 23 aa, Mycobacterium
TTDFNGGGWRDHSRGPRGADTLK

SEQ ID NO: 1231611 - protein, 6 aa, Mycobacterium
TTDGAV

SEQ ID NO: 1231612 - protein, 10 aa, Mycobacterium
TTDKAHASVQ

SEQ ID NO: 1231613 - protein, 8 aa, Mycobacterium
TTDPAGHL

SEQ ID NO: 1231614 - protein, 6 aa, Mycobacterium
TTDPAR

SEQ ID NO: 1231615 - protein, 11 aa, Mycobacterium
TTDPATGDRVA

SEQ ID NO: 1231616 - protein, 10 aa, Mycobacterium
TTDPHTVTDE

SEQ ID NO: 1231617 - protein, 10 aa, Mycobacterium
TTDRDAARAH

SEQ ID NO: 1231618 - protein, 115 aa, Mycobacterium
TTDTDEEDAAAAGEDGSTTVPTEPAPTDETAPADGETEDGETVTEPVDDGTDETTEAGAEEETEGSGDLAEDDTADTDTDNAGDPGAEDTPAGDTSDSGAGDTSDSGSGDTSDSD

SEQ ID NO: 1231619 - protein, 9 aa, Mycobacterium
TTDTDGEHT

SEQ ID NO: 1231620 - protein, 9 aa, Mycobacterium
TTDTGNAKR

SEQ ID NO: 1231621 - protein, 5 aa, Mycobacterium
TTDVE

SEQ ID NO: 1231622 - protein, 9 aa, Mycobacterium
TTDWSTNRE

SEQ ID NO: 1231623 - protein, 9 aa, Mycobacterium
TTEASAAPN

SEQ ID NO: 1231624 - protein, 7 aa, Mycobacterium
TTEDPAL

SEQ ID NO: 1231625 - protein, 16 aa, Mycobacterium
TTEDPANGFRPDTGRI

SEQ ID NO: 1231626 - protein, 10 aa, Mycobacterium
TTEDRRRSER

SEQ ID NO: 1231627 - protein, 11 aa, Mycobacterium
TTEDSTDLKSA

SEQ ID NO: 1231628 - protein, 5 aa, Mycobacterium
TTEEV

SEQ ID NO: 1231629 - protein, 9 aa, Mycobacterium
TTEGAAPKG

SEQ ID NO: 1231630 - protein, 11 aa, Mycobacterium
TTEGGPEPARQ

SEQ ID NO: 1231631 - protein, 7 aa, Mycobacterium
TTEGKRL

SEQ ID NO: 1231632 - protein, 12 aa, Mycobacterium
TTEGLLQTWKQE

SEQ ID NO: 1231633 - protein, 4 aa, Mycobacterium
TTEL

SEQ ID NO: 1231634 - protein, 11 aa, Mycobacterium
TTENGWAAPSS

SEQ ID NO: 1231635 - protein, 21 aa, Mycobacterium
TTEPDAPPPDPVAGPGGGTDL

SEQ ID NO: 1231636 - protein, 7 aa, Mycobacterium
TTEPIST

SEQ ID NO: 1231637 - protein, 7 aa, Mycobacterium
TTEPVES

SEQ ID NO: 1231638 - protein, 4 aa, Mycobacterium
TTEQ

SEQ ID NO: 1231639 - protein, 6 aa, Mycobacterium
TTEQKQ

SEQ ID NO: 1231640 - protein, 9 aa, Mycobacterium
TTEQRQARQ

SEQ ID NO: 1231641 - protein, 6 aa, Mycobacterium
TTERPA

SEQ ID NO: 1231642 - protein, 11 aa, Mycobacterium
TTESIGEQQVT

SEQ ID NO: 1231643 - protein, 17 aa, Mycobacterium
TTETEVDDALAALRSAG

SEQ ID NO: 1231644 - protein, 12 aa, Mycobacterium
TTETSDHPGGYA

SEQ ID NO: 1231645 - protein, 7 aa, Mycobacterium
TTFADSG

SEQ ID NO: 1231646 - protein, 11 aa, Mycobacterium
TTFPATTRAAK

SEQ ID NO: 1231647 - protein, 7 aa, Mycobacterium
TTFPPTV

SEQ ID NO: 1231648 - protein, 6 aa, Mycobacterium
TTFRSS

SEQ ID NO: 1231649 - protein, 7 aa, Mycobacterium
TTFSGQR

SEQ ID NO: 1231650 - protein, 4 aa, Mycobacterium
TTGA

SEQ ID NO: 1231651 - protein, 7 aa, Mycobacterium
TTGAAGP

SEQ ID NO: 1231652 - protein, 9 aa, Mycobacterium
TTGATATES

SEQ ID NO: 1231653 - protein, 9 aa, Mycobacterium
TTGATTSDI

SEQ ID NO: 1231654 - protein, 36 aa, Mycobacterium
TTGDIAGHTGRSGRTCDTRRADRTGCAGDADAAVTT

SEQ ID NO: 1231655 - protein, 9 aa, Mycobacterium
TTGDVDGAH

SEQ ID NO: 1231656 - protein, 6 aa, Mycobacterium
TTGENH

SEQ ID NO: 1231657 - protein, 5 aa, Mycobacterium
TTGEV

SEQ ID NO: 1231658 - protein, 5 aa, Mycobacterium
TTGGR

SEQ ID NO: 1231659 - protein, 7 aa, Mycobacterium
TTGGRPI

SEQ ID NO: 1231660 - protein, 8 aa, Mycobacterium
TTGHNRLR

SEQ ID NO: 1231661 - protein, 6 aa, Mycobacterium
TTGHSY

SEQ ID NO: 1231662 - protein, 7 aa, Mycobacterium
TTGIARS

SEQ ID NO: 1231663 - protein, 11 aa, Mycobacterium
TTGKGKQQVSA

SEQ ID NO: 1231664 - protein, 4 aa, Mycobacterium
TTGL

SEQ ID NO: 1231665 - protein, 5 aa, Mycobacterium
TTGLR

SEQ ID NO: 1231666 - protein, 4 aa, Mycobacterium
TTGN

SEQ ID NO: 1231667 - protein, 5 aa, Mycobacterium
TTGNA

SEQ ID NO: 1231668 - protein, 5 aa, Mycobacterium
TTGNT

SEQ ID NO: 1231669 - protein, 6 aa, Mycobacterium
TTGPGG

SEQ ID NO: 1231670 - protein, 5 aa, Mycobacterium
TTGPL

SEQ ID NO: 1231671 - protein, 9 aa, Mycobacterium
TTGPLGQGL

SEQ ID NO: 1231672 - protein, 132 aa, Mycobacterium
TTGQGVAAAEPASSGGGDTAQSSSSESGDGGSAGDGDQPSRQGGDGADPQESAANGDSGPSSAGDGEEPGDSVVGDATDGSSDDAESRDSDREVDSEDLEAEEVDRSEGDEPSAGDPGTVVDPAEPIAPVEE

SEQ ID NO: 1231673 - protein, 5 aa, Mycobacterium
TTGRE

SEQ ID NO: 1231674 - protein, 18 aa, Mycobacterium
TTGRKSGQPRTTPLGGRR

SEQ ID NO: 1231675 - protein, 10 aa, Mycobacterium
TTGRPDAEVS

SEQ ID NO: 1231676 - protein, 6 aa, Mycobacterium
TTGRTD

SEQ ID NO: 1231677 - protein, 8 aa, Mycobacterium
TTGRTERT

SEQ ID NO: 1231678 - protein, 8 aa, Mycobacterium
TTGSANVT

SEQ ID NO: 1231679 - protein, 14 aa, Mycobacterium
TTGSGDPVDGEEFK

SEQ ID NO: 1231680 - protein, 6 aa, Mycobacterium
TTGSHS

SEQ ID NO: 1231681 - protein, 7 aa, Mycobacterium
TTGSSGG

SEQ ID NO: 1231682 - protein, 7 aa, Mycobacterium
TTGTETW

SEQ ID NO: 1231683 - protein, 9 aa, Mycobacterium
TTGTTKPVE

SEQ ID NO: 1231684 - protein, 9 aa, Mycobacterium
TTHGRIDTA

SEQ ID NO: 1231685 - protein, 12 aa, Mycobacterium
TTHHTPGSAISA

SEQ ID NO: 1231686 - protein, 5 aa, Mycobacterium
TTHIT

SEQ ID NO: 1231687 - protein, 5 aa, Mycobacterium
TTHPA

SEQ ID NO: 1231688 - protein, 8 aa, Mycobacterium
TTHPHPTH

SEQ ID NO: 1231689 - protein, 17 aa, Mycobacterium
TTIADGDSVTILPAVAG

SEQ ID NO: 1231690 - protein, 6 aa, Mycobacterium
TTIATS

SEQ ID NO: 1231691 - protein, 13 aa, Mycobacterium
TTIGAGTAEIQRN

SEQ ID NO: 1231692 - protein, 5 aa, Mycobacterium
TTISK

SEQ ID NO: 1231693 - protein, 8 aa, Mycobacterium
TTISTTSK

SEQ ID NO: 1231694 - protein, 13 aa, Mycobacterium
TTKDESGGTLPGD

SEQ ID NO: 1231695 - protein, 9 aa, Mycobacterium
TTKGGLPRG

SEQ ID NO: 1231696 - protein, 37 aa, Mycobacterium
TTKNYPLSAPNGALSPANPQVSESELQKSADDDLSRD

SEQ ID NO: 1231697 - protein, 17 aa, Mycobacterium
TTKSESASWAAGGGVKL

SEQ ID NO: 1231698 - protein, 20 aa, Mycobacterium
TTKYGGVAAASGLAGSPDLP

SEQ ID NO: 1231699 - protein, 9 aa, Mycobacterium
TTLAPTGYS

SEQ ID NO: 1231700 - protein, 13 aa, Mycobacterium
TTLNTRDTIARGR

SEQ ID NO: 1231701 - protein, 12 aa, Mycobacterium
TTLPTGDQRPGE

SEQ ID NO: 1231702 - protein, 13 aa, Mycobacterium
TTMEGSAANTATA

SEQ ID NO: 1231703 - protein, 35 aa, Mycobacterium
TTMTGADGTAVTAAAGPGQPDRRRRARPSVLSGGY

SEQ ID NO: 1231704 - protein, 12 aa, Mycobacterium
TTMVGERAAGLV

SEQ ID NO: 1231705 - protein, 22 aa, Mycobacterium
TTNAAVSEHDPDSVSAHRHAPA

SEQ ID NO: 1231706 - protein, 6 aa, Mycobacterium
TTNDGV

SEQ ID NO: 1231707 - protein, 14 aa, Mycobacterium
TTNPAPAGHAGTGC

SEQ ID NO: 1231708 - protein, 11 aa, Mycobacterium
TTNPQASTGDG

SEQ ID NO: 1231709 - protein, 9 aa, Mycobacterium
TTNQGGLSR

SEQ ID NO: 1231710 - protein, 13 aa, Mycobacterium
TTNSSDRKPRPGN

SEQ ID NO: 1231711 - protein, 8 aa, Mycobacterium
TTNTEHQA

SEQ ID NO: 1231712 - protein, 5 aa, Mycobacterium
TTPAE

SEQ ID NO: 1231713 - protein, 12 aa, Mycobacterium
TTPAGQHHTTMP

SEQ ID NO: 1231714 - protein, 7 aa, Mycobacterium
TTPARTA

SEQ ID NO: 1231715 - protein, 4 aa, Mycobacterium
TTPD

SEQ ID NO: 1231716 - protein, 17 aa, Mycobacterium
TTPDGDYQTYKANDGAY

SEQ ID NO: 1231717 - protein, 7 aa, Mycobacterium
TTPDPQE

SEQ ID NO: 1231718 - protein, 8 aa, Mycobacterium
TTPDTASE

SEQ ID NO: 1231719 - protein, 61 aa, Mycobacterium
TTPDVDAAASEKAAAELEEPAPEEDEDTEAAATAEETEDAEPTATDSDELESPAASAVLGS

SEQ ID NO: 1231720 - protein, 5 aa, Mycobacterium
TTPDW

SEQ ID NO: 1231721 - protein, 17 aa, Mycobacterium
TTPEETGSVHERTAQRA

SEQ ID NO: 1231722 - protein, 7 aa, Mycobacterium
TTPEGDR

SEQ ID NO: 1231723 - protein, 9 aa, Mycobacterium
TTPELDDSE

SEQ ID NO: 1231724 - protein, 5 aa, Mycobacterium
TTPEQ

SEQ ID NO: 1231725 - protein, 7 aa, Mycobacterium
TTPERVP

SEQ ID NO: 1231726 - protein, 6 aa, Mycobacterium
TTPGPR

SEQ ID NO: 1231727 - protein, 9 aa, Mycobacterium
TTPGPVKGR

SEQ ID NO: 1231728 - protein, 7 aa, Mycobacterium
TTPGQQS

SEQ ID NO: 1231729 - protein, 5 aa, Mycobacterium
TTPHD

SEQ ID NO: 1231730 - protein, 10 aa, Mycobacterium
TTPHPSAPDW

SEQ ID NO: 1231731 - protein, 12 aa, Mycobacterium
TTPKSDAGTRDV

SEQ ID NO: 1231732 - protein, 10 aa, Mycobacterium
TTPLEDGGIK

SEQ ID NO: 1231733 - protein, 9 aa, Mycobacterium
TTPLGDNAP

SEQ ID NO: 1231734 - protein, 15 aa, Mycobacterium
TTPLGRTTDDSGVGA

SEQ ID NO: 1231735 - protein, 5 aa, Mycobacterium
TTPLR

SEQ ID NO: 1231736 - protein, 10 aa, Mycobacterium
TTPLRRDGNA

SEQ ID NO: 1231737 - protein, 10 aa, Mycobacterium
TTPLTDTRSR

SEQ ID NO: 1231738 - protein, 9 aa, Mycobacterium
TTPLTRPHR

SEQ ID NO: 1231739 - protein, 15 aa, Mycobacterium
TTPLTRSHRSVPGVT

SEQ ID NO: 1231740 - protein, 7 aa, Mycobacterium
TTPMRPG

SEQ ID NO: 1231741 - protein, 17 aa, Mycobacterium
TTPNPPQAGGGTEFPRS

SEQ ID NO: 1231742 - protein, 26 aa, Mycobacterium
TTPPHHSDVGASNHQSSSAVRESVVL

SEQ ID NO: 1231743 - protein, 17 aa, Mycobacterium
TTPPPAPAAPGGGRAQA

SEQ ID NO: 1231744 - protein, 8 aa, Mycobacterium
TTPPPDVT

SEQ ID NO: 1231745 - protein, 7 aa, Mycobacterium
TTPPVPE

SEQ ID NO: 1231746 - protein, 8 aa, Mycobacterium
TTPQIASD

SEQ ID NO: 1231747 - protein, 9 aa, Mycobacterium
TTPQPVTYT

SEQ ID NO: 1231748 - protein, 9 aa, Mycobacterium
TTPRAPVGV

SEQ ID NO: 1231749 - protein, 17 aa, Mycobacterium
TTPSDPEARLAAGEQSF

SEQ ID NO: 1231750 - protein, 9 aa, Mycobacterium
TTPSNESPK

SEQ ID NO: 1231751 - protein, 13 aa, Mycobacterium
TTPSPSTSGMSGR

SEQ ID NO: 1231752 - protein, 7 aa, Mycobacterium
TTPSRPA

SEQ ID NO: 1231753 - protein, 12 aa, Mycobacterium
TTPVDRDGAPEK

SEQ ID NO: 1231754 - protein, 7 aa, Mycobacterium
TTQAGTV

SEQ ID NO: 1231755 - protein, 6 aa, Mycobacterium
TTQDDV

SEQ ID NO: 1231756 - protein, 9 aa, Mycobacterium
TTQSDTTRT

SEQ ID NO: 1231757 - protein, 10 aa, Mycobacterium
TTRAEPADAA

SEQ ID NO: 1231758 - protein, 19 aa, Mycobacterium
TTRAGGAEKAITDGLAEIA

SEQ ID NO: 1231759 - protein, 10 aa, Mycobacterium
TTRDLSNEAA

SEQ ID NO: 1231760 - protein, 9 aa, Mycobacterium
TTRDSSLSA

SEQ ID NO: 1231761 - protein, 6 aa, Mycobacterium
TTRDTM

SEQ ID NO: 1231762 - protein, 5 aa, Mycobacterium
TTRGY

SEQ ID NO: 1231763 - protein, 4 aa, Mycobacterium
TTRH

SEQ ID NO: 1231764 - protein, 4 aa, Mycobacterium
TTRI

SEQ ID NO: 1231765 - protein, 13 aa, Mycobacterium
TTRLGDPLDWMRG

SEQ ID NO: 1231766 - protein, 5 aa, Mycobacterium
TTRLT

SEQ ID NO: 1231767 - protein, 5 aa, Mycobacterium
TTRNQ

SEQ ID NO: 1231768 - protein, 6 aa, Mycobacterium
TTRNTK

SEQ ID NO: 1231769 - protein, 14 aa, Mycobacterium
TTRPALAPVGGDRK

SEQ ID NO: 1231770 - protein, 8 aa, Mycobacterium
TTRPPLGP

SEQ ID NO: 1231771 - protein, 6 aa, Mycobacterium
TTRRPR

SEQ ID NO: 1231772 - protein, 10 aa, Mycobacterium
TTRSEKKQRG

SEQ ID NO: 1231773 - protein, 17 aa, Mycobacterium
TTRTGTRSGRPVAKPTP

SEQ ID NO: 1231774 - protein, 5 aa, Mycobacterium
TTRTL

SEQ ID NO: 1231775 - protein, 7 aa, Mycobacterium
TTRTQGR

SEQ ID NO: 1231776 - protein, 6 aa, Mycobacterium
TTRTTR

SEQ ID NO: 1231777 - protein, 7 aa, Mycobacterium
TTSAPVR

SEQ ID NO: 1231778 - protein, 39 aa, Mycobacterium
TTSASTNRNPRRHNPIQPAGSDKNGDAKPTRCGLFSPNR

SEQ ID NO: 1231779 - protein, 11 aa, Mycobacterium
TTSDDGGEHRA

SEQ ID NO: 1231780 - protein, 8 aa, Mycobacterium
TTSEPSDR

SEQ ID NO: 1231781 - protein, 5 aa, Mycobacterium
TTSEV

SEQ ID NO: 1231782 - protein, 6 aa, Mycobacterium
TTSGAG

SEQ ID NO: 1231783 - protein, 8 aa, Mycobacterium
TTSPDYSR

SEQ ID NO: 1231784 - protein, 21 aa, Mycobacterium
TTSPPQGIGDVDTDDHRHGED

SEQ ID NO: 1231785 - protein, 9 aa, Mycobacterium
TTSPQPVRT

SEQ ID NO: 1231786 - protein, 10 aa, Mycobacterium
TTSPQSERAI

SEQ ID NO: 1231787 - protein, 7 aa, Mycobacterium
TTSPSGD

SEQ ID NO: 1231788 - protein, 13 aa, Mycobacterium
TTSPYDSRSSEYC

SEQ ID NO: 1231789 - protein, 15 aa, Mycobacterium
TTSQAPRVDEGRPES

SEQ ID NO: 1231790 - protein, 7 aa, Mycobacterium
TTSTASD

SEQ ID NO: 1231791 - protein, 9 aa, Mycobacterium
TTSTSADGK

SEQ ID NO: 1231792 - protein, 4 aa, Mycobacterium
TTSV

SEQ ID NO: 1231793 - protein, 10 aa, Mycobacterium
TTSVGSRDRS

SEQ ID NO: 1231794 - protein, 14 aa, Mycobacterium
TTSWRTGDRRPLAD

SEQ ID NO: 1231795 - protein, 4 aa, Mycobacterium
TTTA

SEQ ID NO: 1231796 - protein, 12 aa, Mycobacterium
TTTAEGSASADT

SEQ ID NO: 1231797 - protein, 7 aa, Mycobacterium
TTTAEGY

SEQ ID NO: 1231798 - protein, 5 aa, Mycobacterium
TTTAH

SEQ ID NO: 1231799 - protein, 6 aa, Mycobacterium
TTTAKA

SEQ ID NO: 1231800 - protein, 7 aa, Mycobacterium
TTTARDE

SEQ ID NO: 1231801 - protein, 9 aa, Mycobacterium
TTTEPARTN

SEQ ID NO: 1231802 - protein, 18 aa, Mycobacterium
TTTEPVERASATPSESVE

SEQ ID NO: 1231803 - protein, 22 aa, Mycobacterium
TTTGPERVVGSSGAPETQAAET

SEQ ID NO: 1231804 - protein, 6 aa, Mycobacterium
TTTGTV

SEQ ID NO: 1231805 - protein, 5 aa, Mycobacterium
TTTHP

SEQ ID NO: 1231806 - protein, 21 aa, Mycobacterium
TTTNLETEDGRSLATFAFRPE

SEQ ID NO: 1231807 - protein, 11 aa, Mycobacterium
TTTPEGETQAR

SEQ ID NO: 1231808 - protein, 6 aa, Mycobacterium
TTTPLQ

SEQ ID NO: 1231809 - protein, 10 aa, Mycobacterium
TTTPPGSASE

SEQ ID NO: 1231810 - protein, 7 aa, Mycobacterium
TTTPSPF

SEQ ID NO: 1231811 - protein, 10 aa, Mycobacterium
TTTQMQATSP

SEQ ID NO: 1231812 - protein, 5 aa, Mycobacterium
TTTRS

SEQ ID NO: 1231813 - protein, 11 aa, Mycobacterium
TTTSAQPGAYN

SEQ ID NO: 1231814 - protein, 14 aa, Mycobacterium
TTTTTHKSLRGPRG

SEQ ID NO: 1231815 - protein, 22 aa, Mycobacterium
TTTVQSPPDGAGATSVAPGSSP

SEQ ID NO: 1231816 - protein, 12 aa, Mycobacterium
TTTVTRRSSGDY

SEQ ID NO: 1231817 - protein, 5 aa, Mycobacterium
TTVAD

SEQ ID NO: 1231818 - protein, 8 aa, Mycobacterium
TTVAPGDQ

SEQ ID NO: 1231819 - protein, 12 aa, Mycobacterium
TTVGDGPEQEPR

SEQ ID NO: 1231820 - protein, 4 aa, Mycobacterium
TTVN

SEQ ID NO: 1231821 - protein, 6 aa, Mycobacterium
TTVPGT

SEQ ID NO: 1231822 - protein, 15 aa, Mycobacterium
TTVPSSPPVQGAEAE

SEQ ID NO: 1231823 - protein, 5 aa, Mycobacterium
TTVRD

SEQ ID NO: 1231824 - protein, 7 aa, Mycobacterium
TTVREAG

SEQ ID NO: 1231825 - protein, 8 aa, Mycobacterium
TTVRPSYG

SEQ ID NO: 1231826 - protein, 5 aa, Mycobacterium
TTVSA

SEQ ID NO: 1231827 - protein, 10 aa, Mycobacterium
TTVTERDPIA

SEQ ID NO: 1231828 - protein, 9 aa, Mycobacterium
TTVTGTDPV

SEQ ID NO: 1231829 - protein, 4 aa, Mycobacterium
TTWG

SEQ ID NO: 1231830 - protein, 19 aa, Mycobacterium
TTYTTPRDAPYRDTAGATI

SEQ ID NO: 1231831 - protein, 6 aa, Mycobacterium
TVAADG

SEQ ID NO: 1231832 - protein, 18 aa, Mycobacterium
TVAAEGGAGYCTRGNRGS

SEQ ID NO: 1231833 - protein, 8 aa, Mycobacterium
TVAASARH

SEQ ID NO: 1231834 - protein, 8 aa, Mycobacterium
TVADDDEW

SEQ ID NO: 1231835 - protein, 5 aa, Mycobacterium
TVADG

SEQ ID NO: 1231836 - protein, 5 aa, Mycobacterium
TVAEG

SEQ ID NO: 1231837 - protein, 4 aa, Mycobacterium
TVAG

SEQ ID NO: 1231838 - protein, 12 aa, Mycobacterium
TVAGAASGGPQA

SEQ ID NO: 1231839 - protein, 12 aa, Mycobacterium
TVAGSAAVDNAA

SEQ ID NO: 1231840 - protein, 10 aa, Mycobacterium
TVAGTPQGGV

SEQ ID NO: 1231841 - protein, 6 aa, Mycobacterium
TVANSP

SEQ ID NO: 1231842 - protein, 5 aa, Mycobacterium
TVAPI

SEQ ID NO: 1231843 - protein, 10 aa, Mycobacterium
TVAPSNAPSR

SEQ ID NO: 1231844 - protein, 16 aa, Mycobacterium
TVAQTTEPGPPIPDAT

SEQ ID NO: 1231845 - protein, 21 aa, Mycobacterium
TVASRQSDTVASRQSDTALPP

SEQ ID NO: 1231846 - protein, 5 aa, Mycobacterium
TVATA

SEQ ID NO: 1231847 - protein, 14 aa, Mycobacterium
TVATGAEFRGATSE

SEQ ID NO: 1231848 - protein, 20 aa, Mycobacterium
TVATPISAATAADEPPPRAF

SEQ ID NO: 1231849 - protein, 22 aa, Mycobacterium
TVATRAKEAAAGKDVRLGGGAA

SEQ ID NO: 1231850 - protein, 4 aa, Mycobacterium
TVDD

SEQ ID NO: 1231851 - protein, 7 aa, Mycobacterium
TVDDADH

SEQ ID NO: 1231852 - protein, 8 aa, Mycobacterium
TVDDDGDL

SEQ ID NO: 1231853 - protein, 4 aa, Mycobacterium
TVDE

SEQ ID NO: 1231854 - protein, 6 aa, Mycobacterium
TVDEQT

SEQ ID NO: 1231855 - protein, 6 aa, Mycobacterium
TVDGAR

SEQ ID NO: 1231856 - protein, 5 aa, Mycobacterium
TVDGG

SEQ ID NO: 1231857 - protein, 7 aa, Mycobacterium
TVDGGAP

SEQ ID NO: 1231858 - protein, 9 aa, Mycobacterium
TVDGGRESI

SEQ ID NO: 1231859 - protein, 22 aa, Mycobacterium
TVDGKDVPEANTEGLSHEVGSG

SEQ ID NO: 1231860 - protein, 8 aa, Mycobacterium
TVDGNEAV

SEQ ID NO: 1231861 - protein, 17 aa, Mycobacterium
TVDGNTAYAAAKSAQWG

SEQ ID NO: 1231862 - protein, 8 aa, Mycobacterium
TVDGPARD

SEQ ID NO: 1231863 - protein, 8 aa, Mycobacterium
TVDGQERH

SEQ ID NO: 1231864 - protein, 13 aa, Mycobacterium
TVDGRRVATGRDF

SEQ ID NO: 1231865 - protein, 5 aa, Mycobacterium
TVDPG

SEQ ID NO: 1231866 - protein, 16 aa, Mycobacterium
TVDPGGVGGTGGVPTP

SEQ ID NO: 1231867 - protein, 20 aa, Mycobacterium
TVDPTSSTTALAGSTEEGQF

SEQ ID NO: 1231868 - protein, 13 aa, Mycobacterium
TVDRGYSRNDPVR

SEQ ID NO: 1231869 - protein, 5 aa, Mycobacterium
TVDTA

SEQ ID NO: 1231870 - protein, 10 aa, Mycobacterium
TVDTSNRKAS

SEQ ID NO: 1231871 - protein, 11 aa, Mycobacterium
TVDTSTAAGRF

SEQ ID NO: 1231872 - protein, 4 aa, Mycobacterium
TVEE

SEQ ID NO: 1231873 - protein, 12 aa, Mycobacterium
TVEEATADETGA

SEQ ID NO: 1231874 - protein, 4 aa, Mycobacterium
TVEG

SEQ ID NO: 1231875 - protein, 9 aa, Mycobacterium
TVEPDPAGV

SEQ ID NO: 1231876 - protein, 7 aa, Mycobacterium
TVEPGSV

SEQ ID NO: 1231877 - protein, 12 aa, Mycobacterium
TVERGRLTAASS

SEQ ID NO: 1231878 - protein, 10 aa, Mycobacterium
TVERQGLDHP

SEQ ID NO: 1231879 - protein, 9 aa, Mycobacterium
TVESGASVD

SEQ ID NO: 1231880 - protein, 69 aa, Mycobacterium
TVETDRAPLEGTRRRRRPETKPPGGDEPPRGDSGEDDEPDGDGPNEQDPTPPPRPEPEDGPKKPESGDD

SEQ ID NO: 1231881 - protein, 6 aa, Mycobacterium
TVETRD

SEQ ID NO: 1231882 - protein, 4 aa, Mycobacterium
TVGA

SEQ ID NO: 1231883 - protein, 12 aa, Mycobacterium
TVGAKSGKPREV

SEQ ID NO: 1231884 - protein, 21 aa, Mycobacterium
TVGATAVRSQAELGAAGELPP

SEQ ID NO: 1231885 - protein, 4 aa, Mycobacterium
TVGD

SEQ ID NO: 1231886 - protein, 6 aa, Mycobacterium
TVGDER

SEQ ID NO: 1231887 - protein, 7 aa, Mycobacterium
TVGDETF

SEQ ID NO: 1231888 - protein, 20 aa, Mycobacterium
TVGDREPDVPSAAGRGRQDG

SEQ ID NO: 1231889 - protein, 25 aa, Mycobacterium
TVGDSSFGDVNGRRDRSAKPGKPSA

SEQ ID NO: 1231890 - protein, 10 aa, Mycobacterium
TVGEGREVAA

SEQ ID NO: 1231891 - protein, 8 aa, Mycobacterium
TVGGARRA

SEQ ID NO: 1231892 - protein, 14 aa, Mycobacterium
TVGGGERSDVGAGP

SEQ ID NO: 1231893 - protein, 6 aa, Mycobacterium
TVGGRG

SEQ ID NO: 1231894 - protein, 10 aa, Mycobacterium
TVGKDGEADH

SEQ ID NO: 1231895 - protein, 8 aa, Mycobacterium
TVGKSPAQ

SEQ ID NO: 1231896 - protein, 5 aa, Mycobacterium
TVGNA

SEQ ID NO: 1231897 - protein, 5 aa, Mycobacterium
TVGNP

SEQ ID NO: 1231898 - protein, 7 aa, Mycobacterium
TVGPDGP

SEQ ID NO: 1231899 - protein, 13 aa, Mycobacterium
TVGPQSVGAAPGP

SEQ ID NO: 1231900 - protein, 10 aa, Mycobacterium
TVGSPPPPTL

SEQ ID NO: 1231901 - protein, 8 aa, Mycobacterium
TVGTSDEE

SEQ ID NO: 1231902 - protein, 6 aa, Mycobacterium
TVGTSG

SEQ ID NO: 1231903 - protein, 5 aa, Mycobacterium
TVHGE

SEQ ID NO: 1231904 - protein, 6 aa, Mycobacterium
TVHPND

SEQ ID NO: 1231905 - protein, 9 aa, Mycobacterium
TVHSPNDVS

SEQ ID NO: 1231906 - protein, 6 aa, Mycobacterium
TVHTRP

SEQ ID NO: 1231907 - protein, 13 aa, Mycobacterium
TVIPPSGGFDPDA

SEQ ID NO: 1231908 - protein, 8 aa, Mycobacterium
TVKDPDGT

SEQ ID NO: 1231909 - protein, 11 aa, Mycobacterium
TVKPEAQAAKD

SEQ ID NO: 1231910 - protein, 8 aa, Mycobacterium
TVKSQATA

SEQ ID NO: 1231911 - protein, 14 aa, Mycobacterium
TVNGRRPAHYRTSA

SEQ ID NO: 1231912 - protein, 7 aa, Mycobacterium
TVNGTDR

SEQ ID NO: 1231913 - protein, 10 aa, Mycobacterium
TVNPGQPTPA

SEQ ID NO: 1231914 - protein, 8 aa, Mycobacterium
TVNQTKDN

SEQ ID NO: 1231915 - protein, 9 aa, Mycobacterium
TVPAGTTSV

SEQ ID NO: 1231916 - protein, 9 aa, Mycobacterium
TVPDPATIQ

SEQ ID NO: 1231917 - protein, 22 aa, Mycobacterium
TVPDSSTIQSAAAAARGLSDAT

SEQ ID NO: 1231918 - protein, 4 aa, Mycobacterium
TVPE

SEQ ID NO: 1231919 - protein, 4 aa, Mycobacterium
TVPG

SEQ ID NO: 1231920 - protein, 9 aa, Mycobacterium
TVPGKRAPT

SEQ ID NO: 1231921 - protein, 12 aa, Mycobacterium
TVPGPIPASGTG

SEQ ID NO: 1231922 - protein, 11 aa, Mycobacterium
TVPGSKSQTNR

SEQ ID NO: 1231923 - protein, 6 aa, Mycobacterium
TVPPGT

SEQ ID NO: 1231924 - protein, 4 aa, Mycobacterium
TVPR

SEQ ID NO: 1231925 - protein, 11 aa, Mycobacterium
TVPRDGTPTTL

SEQ ID NO: 1231926 - protein, 6 aa, Mycobacterium
TVPRDQ

SEQ ID NO: 1231927 - protein, 6 aa, Mycobacterium
TVPREQ

SEQ ID NO: 1231928 - protein, 18 aa, Mycobacterium
TVPTPAGPAFAGADERRR

SEQ ID NO: 1231929 - protein, 7 aa, Mycobacterium
TVPVGTA

SEQ ID NO: 1231930 - protein, 8 aa, Mycobacterium
TVPVPPDW

SEQ ID NO: 1231931 - protein, 5 aa, Mycobacterium
TVRAL

SEQ ID NO: 1231932 - protein, 10 aa, Mycobacterium
TVRDEAGRLA

SEQ ID NO: 1231933 - protein, 4 aa, Mycobacterium
TVRE

SEQ ID NO: 1231934 - protein, 11 aa, Mycobacterium
TVREGEAGGIT

SEQ ID NO: 1231935 - protein, 8 aa, Mycobacterium
TVRENSAP

SEQ ID NO: 1231936 - protein, 10 aa, Mycobacterium
TVRGEGEDLE

SEQ ID NO: 1231937 - protein, 7 aa, Mycobacterium
TVRPPGR

SEQ ID NO: 1231938 - protein, 13 aa, Mycobacterium
TVRPPRDAVLLQR

SEQ ID NO: 1231939 - protein, 6 aa, Mycobacterium
TVRPRV

SEQ ID NO: 1231940 - protein, 13 aa, Mycobacterium
TVRPRVAAKNPAL

SEQ ID NO: 1231941 - protein, 14 aa, Mycobacterium
TVRPRVAAKNPALN

SEQ ID NO: 1231942 - protein, 11 aa, Mycobacterium
TVRSAPAESGF

SEQ ID NO: 1231943 - protein, 15 aa, Mycobacterium
TVRSAPDSSGFVPGQ

SEQ ID NO: 1231944 - protein, 9 aa, Mycobacterium
TVSDGDGAA

SEQ ID NO: 1231945 - protein, 16 aa, Mycobacterium
TVSESYRTQDGAALNQ

SEQ ID NO: 1231946 - protein, 10 aa, Mycobacterium
TVSPDNTASR

SEQ ID NO: 1231947 - protein, 9 aa, Mycobacterium
TVSPGPVET

SEQ ID NO: 1231948 - protein, 8 aa, Mycobacterium
TVSPSEQA

SEQ ID NO: 1231949 - protein, 7 aa, Mycobacterium
TVSQPRP

SEQ ID NO: 1231950 - protein, 20 aa, Mycobacterium
TVSRPSNGTTYTDPTASGGT

SEQ ID NO: 1231951 - protein, 9 aa, Mycobacterium
TVSSDTPLT

SEQ ID NO: 1231952 - protein, 11 aa, Mycobacterium
TVSSDTPLTTA

SEQ ID NO: 1231953 - protein, 8 aa, Mycobacterium
TVSSPPPA

SEQ ID NO: 1231954 - protein, 8 aa, Mycobacterium
TVSTQPAA

SEQ ID NO: 1231955 - protein, 4 aa, Mycobacterium
TVTA

SEQ ID NO: 1231956 - protein, 13 aa, Mycobacterium
TVTAGNASTMNDG

SEQ ID NO: 1231957 - protein, 12 aa, Mycobacterium
TVTAPQAPRPVL

SEQ ID NO: 1231958 - protein, 9 aa, Mycobacterium
TVTATTGSR

SEQ ID NO: 1231959 - protein, 8 aa, Mycobacterium
TVTDEEMP

SEQ ID NO: 1231960 - protein, 9 aa, Mycobacterium
TVTDEEMPR

SEQ ID NO: 1231961 - protein, 11 aa, Mycobacterium
TVTDTDGAEID

SEQ ID NO: 1231962 - protein, 4 aa, Mycobacterium
TVTE

SEQ ID NO: 1231963 - protein, 7 aa, Mycobacterium
TVTEDEI

SEQ ID NO: 1231964 - protein, 12 aa, Mycobacterium
TVTGADGNERGY

SEQ ID NO: 1231965 - protein, 11 aa, Mycobacterium
TVTGAGNDLKV

SEQ ID NO: 1231966 - protein, 9 aa, Mycobacterium
TVTGGPTAL

SEQ ID NO: 1231967 - protein, 8 aa, Mycobacterium
TVTGPKVR

SEQ ID NO: 1231968 - protein, 6 aa, Mycobacterium
TVTGSR

SEQ ID NO: 1231969 - protein, 7 aa, Mycobacterium
TVTGTSD

SEQ ID NO: 1231970 - protein, 9 aa, Mycobacterium
TVTPAGPAP

SEQ ID NO: 1231971 - protein, 8 aa, Mycobacterium
TVTPARER

SEQ ID NO: 1231972 - protein, 8 aa, Mycobacterium
TVTPGERY

SEQ ID NO: 1231973 - protein, 14 aa, Mycobacterium
TVTPTSGRVKRGKT

SEQ ID NO: 1231974 - protein, 13 aa, Mycobacterium
TVTRGELDATTNR

SEQ ID NO: 1231975 - protein, 20 aa, Mycobacterium
TVTSDSAEMTDHSGDVSDPG

SEQ ID NO: 1231976 - protein, 8 aa, Mycobacterium
TVTSGSIK

SEQ ID NO: 1231977 - protein, 12 aa, Mycobacterium
TVTSPGGTTAAG

SEQ ID NO: 1231978 - protein, 4 aa, Mycobacterium
TVVE

SEQ ID NO: 1231979 - protein, 6 aa, Mycobacterium
TVVPTG

SEQ ID NO: 1231980 - protein, 4 aa, Mycobacterium
TVYG

SEQ ID NO: 1231981 - protein, 5 aa, Mycobacterium
TWAPA

SEQ ID NO: 1231982 - protein, 13 aa, Mycobacterium
TWDGAKDAFDPER

SEQ ID NO: 1231983 - protein, 23 aa, Mycobacterium
TWDPTYKPKDRDDRRPQQDEATK

SEQ ID NO: 1231984 - protein, 9 aa, Mycobacterium
TWDTTTAEQ

SEQ ID NO: 1231985 - protein, 7 aa, Mycobacterium
TWEPTTH

SEQ ID NO: 1231986 - protein, 9 aa, Mycobacterium
TWNADNPVT

SEQ ID NO: 1231987 - protein, 9 aa, Mycobacterium
TWPADDPQL

SEQ ID NO: 1231988 - protein, 17 aa, Mycobacterium
TWPAPPGRRSADGKRPR

SEQ ID NO: 1231989 - protein, 4 aa, Mycobacterium
TWPD

SEQ ID NO: 1231990 - protein, 5 aa, Mycobacterium
TWPKR

SEQ ID NO: 1231991 - protein, 6 aa, Mycobacterium
TWQGTT

SEQ ID NO: 1231992 - protein, 11 aa, Mycobacterium
TWRQKRRGREV

SEQ ID NO: 1231993 - protein, 24 aa, Mycobacterium
TWSDTERLRPSVPEPEDIAPTGLP

SEQ ID NO: 1231994 - protein, 6 aa, Mycobacterium
TWSGPE

SEQ ID NO: 1231995 - protein, 5 aa, Mycobacterium
TWSTS

SEQ ID NO: 1231996 - protein, 8 aa, Mycobacterium
TWTDPTGN

SEQ ID NO: 1231997 - protein, 10 aa, Mycobacterium
TYADKEPTID

SEQ ID NO: 1231998 - protein, 5 aa, Mycobacterium
TYADT

SEQ ID NO: 1231999 - protein, 5 aa, Mycobacterium
TYAGG

SEQ ID NO: 1232000 - protein, 8 aa, Mycobacterium
TYAGSEAT

SEQ ID NO: 1232001 - protein, 8 aa, Mycobacterium
TYDPRGQT

SEQ ID NO: 1232002 - protein, 6 aa, Mycobacterium
TYDPRR

SEQ ID NO: 1232003 - protein, 9 aa, Mycobacterium
TYEAETTAI

SEQ ID NO: 1232004 - protein, 13 aa, Mycobacterium
TYEDGSTMSRQDI

SEQ ID NO: 1232005 - protein, 16 aa, Mycobacterium
TYEPSRQGWEPDPTTF

SEQ ID NO: 1232006 - protein, 8 aa, Mycobacterium
TYESPGDL

SEQ ID NO: 1232007 - protein, 20 aa, Mycobacterium
TYETEKFRDNPPDGPDRGGE

SEQ ID NO: 1232008 - protein, 12 aa, Mycobacterium
TYGAGDWGRTPH

SEQ ID NO: 1232009 - protein, 6 aa, Mycobacterium
TYGGSI

SEQ ID NO: 1232010 - protein, 6 aa, Mycobacterium
TYGPGD

SEQ ID NO: 1232011 - protein, 13 aa, Mycobacterium
TYGPGDWQPTPHG

SEQ ID NO: 1232012 - protein, 5 aa, Mycobacterium
TYGPQ

SEQ ID NO: 1232013 - protein, 7 aa, Mycobacterium
TYGPSTR

SEQ ID NO: 1232014 - protein, 16 aa, Mycobacterium
TYGRAGASTIAAATPT

SEQ ID NO: 1232015 - protein, 4 aa, Mycobacterium
TYGT

SEQ ID NO: 1232016 - protein, 6 aa, Mycobacterium
TYGTNN

SEQ ID NO: 1232017 - protein, 4 aa, Mycobacterium
TYGV

SEQ ID NO: 1232018 - protein, 12 aa, Mycobacterium
TYGVPVNSPEGY

SEQ ID NO: 1232019 - protein, 14 aa, Mycobacterium
TYGVPVNSPNGYRT

SEQ ID NO: 1232020 - protein, 17 aa, Mycobacterium
TYKKEAKARNKEAKAAK

SEQ ID NO: 1232021 - protein, 8 aa, Mycobacterium
TYLKKGDE

SEQ ID NO: 1232022 - protein, 15 aa, Mycobacterium
TYNEPNTNLTGPETA

SEQ ID NO: 1232023 - protein, 5 aa, Mycobacterium
TYPAG

SEQ ID NO: 1232024 - protein, 5 aa, Mycobacterium
TYPDH

SEQ ID NO: 1232025 - protein, 9 aa, Mycobacterium
TYPGGDAAA

SEQ ID NO: 1232026 - protein, 15 aa, Mycobacterium
TYPGPSADSPDPSAV

SEQ ID NO: 1232027 - protein, 9 aa, Mycobacterium
TYPNPTPAF

SEQ ID NO: 1232028 - protein, 4 aa, Mycobacterium
TYQE

SEQ ID NO: 1232029 - protein, 4 aa, Mycobacterium
TYQP

SEQ ID NO: 1232030 - protein, 11 aa, Mycobacterium
TYQPPPETKYD

SEQ ID NO: 1232031 - protein, 5 aa, Mycobacterium
TYRDR

SEQ ID NO: 1232032 - protein, 7 aa, Mycobacterium
TYRGGPA

SEQ ID NO: 1232033 - protein, 8 aa, Mycobacterium
TYRGKAQN

SEQ ID NO: 1232034 - protein, 11 aa, Mycobacterium
TYRGPYTPGSA

SEQ ID NO: 1232035 - protein, 13 aa, Mycobacterium
TYRGRGKTKGLGL

SEQ ID NO: 1232036 - protein, 19 aa, Mycobacterium
TYRPGDDPVRTRTELEDAF

SEQ ID NO: 1232037 - protein, 7 aa, Mycobacterium
TYRPNRM

SEQ ID NO: 1232038 - protein, 6 aa, Mycobacterium
TYRRTR

SEQ ID NO: 1232039 - protein, 9 aa, Mycobacterium
TYSDDEATG

SEQ ID NO: 1232040 - protein, 9 aa, Mycobacterium
TYSGATTAN

SEQ ID NO: 1232041 - protein, 12 aa, Mycobacterium
TYSRKSGRTTRG

SEQ ID NO: 1232042 - protein, 12 aa, Mycobacterium
TYSRTGPGLQAA

SEQ ID NO: 1232043 - protein, 13 aa, Mycobacterium
TYSSGPRGGLEGT

SEQ ID NO: 1232044 - protein, 4 aa, Mycobacterium
TYTD

SEQ ID NO: 1232045 - protein, 15 aa, Mycobacterium
TYTNGSNIKASDATA

SEQ ID NO: 1232046 - protein, 8 aa, Mycobacterium
TYTPTTAA

SEQ ID NO: 1232047 - protein, 9 aa, Mycobacterium
TYTTSDGEI

SEQ ID NO: 1232048 - protein, 5 aa, Mycobacterium
VAAAG

SEQ ID NO: 1232049 - protein, 8 aa, Mycobacterium
VAADCDDD

SEQ ID NO: 1232050 - protein, 7 aa, Mycobacterium
VAADDGA

SEQ ID NO: 1232051 - protein, 29 aa, Mycobacterium
VAADQDRRVARRDGAQDVSAPDPQGRNGF

SEQ ID NO: 1232052 - protein, 8 aa, Mycobacterium
VAADTAKG

SEQ ID NO: 1232053 - protein, 20 aa, Mycobacterium
VAAEKAQAELDEPAPEPDED

SEQ ID NO: 1232054 - protein, 5 aa, Mycobacterium
VAAGA

SEQ ID NO: 1232055 - protein, 16 aa, Mycobacterium
VAAGDAGKATEYNNAA

SEQ ID NO: 1232056 - protein, 27 aa, Mycobacterium
VAAGGATAQGSAAAYDEAHVRAAALLR

SEQ ID NO: 1232057 - protein, 7 aa, Mycobacterium
VAAGGDR

SEQ ID NO: 1232058 - protein, 13 aa, Mycobacterium
VAAGKALSYEGAG

SEQ ID NO: 1232059 - protein, 5 aa, Mycobacterium
VAAGL

SEQ ID NO: 1232060 - protein, 9 aa, Mycobacterium
VAAGPGDSA

SEQ ID NO: 1232061 - protein, 8 aa, Mycobacterium
VAAGRAGG

SEQ ID NO: 1232062 - protein, 8 aa, Mycobacterium
VAAGRTPV

SEQ ID NO: 1232063 - protein, 5 aa, Mycobacterium
VAAGS

SEQ ID NO: 1232064 - protein, 15 aa, Mycobacterium
VAAGYRNPVTPDPFA

SEQ ID NO: 1232065 - protein, 4 aa, Mycobacterium
VAAP

SEQ ID NO: 1232066 - protein, 7 aa, Mycobacterium
VAAPAAC

SEQ ID NO: 1232067 - protein, 12 aa, Mycobacterium
VAAPAPPPQLPP

SEQ ID NO: 1232068 - protein, 8 aa, Mycobacterium
VAAPDDLA

SEQ ID NO: 1232069 - protein, 6 aa, Mycobacterium
VAAPEP

SEQ ID NO: 1232070 - protein, 6 aa, Mycobacterium
VAAPGG

SEQ ID NO: 1232071 - protein, 9 aa, Mycobacterium
VAAPGGNKH

SEQ ID NO: 1232072 - protein, 19 aa, Mycobacterium
VAAPSTPKVPSATPTTAVP

SEQ ID NO: 1232073 - protein, 35 aa, Mycobacterium
VAAPTPVPAPPPAEPLPPAEAPPPAEPVAGAQTPC

SEQ ID NO: 1232074 - protein, 8 aa, Mycobacterium
VAARGGNG

SEQ ID NO: 1232075 - protein, 8 aa, Mycobacterium
VAARSKRL

SEQ ID NO: 1232076 - protein, 10 aa, Mycobacterium
VAARTRATAA

SEQ ID NO: 1232077 - protein, 8 aa, Mycobacterium
VAASPAVT

SEQ ID NO: 1232078 - protein, 9 aa, Mycobacterium
VAASRSGEL

SEQ ID NO: 1232079 - protein, 11 aa, Mycobacterium
VAATAKAAHSV

SEQ ID NO: 1232080 - protein, 8 aa, Mycobacterium
VAATSEEV

SEQ ID NO: 1232081 - protein, 9 aa, Mycobacterium
VADAARSGA

SEQ ID NO: 1232082 - protein, 10 aa, Mycobacterium
VADDLDGDPG

SEQ ID NO: 1232083 - protein, 24 aa, Mycobacterium
VADEAEIQKARNDVAKAGQDANEA

SEQ ID NO: 1232084 - protein, 14 aa, Mycobacterium
VADEARVPVIVARQ

SEQ ID NO: 1232085 - protein, 7 aa, Mycobacterium
VADGERW

SEQ ID NO: 1232086 - protein, 10 aa, Mycobacterium
VADGGALSDG

SEQ ID NO: 1232087 - protein, 5 aa, Mycobacterium
VADGT

SEQ ID NO: 1232088 - protein, 6 aa, Mycobacterium
VADHRG

SEQ ID NO: 1232089 - protein, 7 aa, Mycobacterium
VADHTGV

SEQ ID NO: 1232090 - protein, 7 aa, Mycobacterium
VADNASA

SEQ ID NO: 1232091 - protein, 8 aa, Mycobacterium
VADNASSG

SEQ ID NO: 1232092 - protein, 6 aa, Mycobacterium
VADNGD

SEQ ID NO: 1232093 - protein, 5 aa, Mycobacterium
VADPD

SEQ ID NO: 1232094 - protein, 13 aa, Mycobacterium
VADPMTDEQAEAQ

SEQ ID NO: 1232095 - protein, 7 aa, Mycobacterium
VADPPGI

SEQ ID NO: 1232096 - protein, 8 aa, Mycobacterium
VADPQKVT

SEQ ID NO: 1232097 - protein, 10 aa, Mycobacterium
VADPSETGLP

SEQ ID NO: 1232098 - protein, 10 aa, Mycobacterium
VADPSHGGST

SEQ ID NO: 1232099 - protein, 7 aa, Mycobacterium
VADPSPI

SEQ ID NO: 1232100 - protein, 10 aa, Mycobacterium
VADPTASDEV

SEQ ID NO: 1232101 - protein, 7 aa, Mycobacterium
VADPTAV

SEQ ID NO: 1232102 - protein, 6 aa, Mycobacterium
VADPVK

SEQ ID NO: 1232103 - protein, 5 aa, Mycobacterium
VADSD

SEQ ID NO: 1232104 - protein, 10 aa, Mycobacterium
VADSEASRTI

SEQ ID NO: 1232105 - protein, 11 aa, Mycobacterium
VADSGKTKLDQ

SEQ ID NO: 1232106 - protein, 9 aa, Mycobacterium
VADSIPCGP

SEQ ID NO: 1232107 - protein, 4 aa, Mycobacterium
VADT

SEQ ID NO: 1232108 - protein, 17 aa, Mycobacterium
VADTVRPTIAGAKENPG

SEQ ID NO: 1232109 - protein, 8 aa, Mycobacterium
VADYPTDR

SEQ ID NO: 1232110 - protein, 12 aa, Mycobacterium
VAEAGEEAREAL

SEQ ID NO: 1232111 - protein, 16 aa, Mycobacterium
VAEARNALAEKRTDDI

SEQ ID NO: 1232112 - protein, 11 aa, Mycobacterium
VAEDRTAPTTL

SEQ ID NO: 1232113 - protein, 12 aa, Mycobacterium
VAEDSQARPVRG

SEQ ID NO: 1232114 - protein, 8 aa, Mycobacterium
VAEEHDGD

SEQ ID NO: 1232115 - protein, 11 aa, Mycobacterium
VAEGERLPSPL

SEQ ID NO: 1232116 - protein, 9 aa, Mycobacterium
VAEGGEQAD

SEQ ID NO: 1232117 - protein, 11 aa, Mycobacterium
VAEGKHDPSSV

SEQ ID NO: 1232118 - protein, 5 aa, Mycobacterium
VAEGN

SEQ ID NO: 1232119 - protein, 6 aa, Mycobacterium
VAEGNR

SEQ ID NO: 1232120 - protein, 5 aa, Mycobacterium
VAEGP

SEQ ID NO: 1232121 - protein, 7 aa, Mycobacterium
VAEGRTR

SEQ ID NO: 1232122 - protein, 9 aa, Mycobacterium
VAEGSEPWV

SEQ ID NO: 1232123 - protein, 14 aa, Mycobacterium
VAEGTLSPSALEDQ

SEQ ID NO: 1232124 - protein, 10 aa, Mycobacterium
VAEHTATRTT

SEQ ID NO: 1232125 - protein, 7 aa, Mycobacterium
VAEKDDC

SEQ ID NO: 1232126 - protein, 9 aa, Mycobacterium
VAEPDADGE

SEQ ID NO: 1232127 - protein, 11 aa, Mycobacterium
VAEPEPGPGTV

SEQ ID NO: 1232128 - protein, 5 aa, Mycobacterium
VAEPG

SEQ ID NO: 1232129 - protein, 9 aa, Mycobacterium
VAEPGQTLA

SEQ ID NO: 1232130 - protein, 7 aa, Mycobacterium
VAEPGVA

SEQ ID NO: 1232131 - protein, 13 aa, Mycobacterium
VAEPTAPAAQTPL

SEQ ID NO: 1232132 - protein, 10 aa, Mycobacterium
VAEPTATSAA

SEQ ID NO: 1232133 - protein, 19 aa, Mycobacterium
VAEQRGTIPADYPTAREAA

SEQ ID NO: 1232134 - protein, 4 aa, Mycobacterium
VAER

SEQ ID NO: 1232135 - protein, 16 aa, Mycobacterium
VAERDRDRGRDIDGLE

SEQ ID NO: 1232136 - protein, 20 aa, Mycobacterium
VAERGRQAGRDLGEDPAATV

SEQ ID NO: 1232137 - protein, 6 aa, Mycobacterium
VAERND

SEQ ID NO: 1232138 - protein, 6 aa, Mycobacterium
VAERPR

SEQ ID NO: 1232139 - protein, 5 aa, Mycobacterium
VAERS

SEQ ID NO: 1232140 - protein, 9 aa, Mycobacterium
VAESAGPVS

SEQ ID NO: 1232141 - protein, 16 aa, Mycobacterium
VAESDPDDEVDETTTK

SEQ ID NO: 1232142 - protein, 5 aa, Mycobacterium
VAESG

SEQ ID NO: 1232143 - protein, 7 aa, Mycobacterium
VAESGAT

SEQ ID NO: 1232144 - protein, 12 aa, Mycobacterium
VAESREADLTVD

SEQ ID NO: 1232145 - protein, 5 aa, Mycobacterium
VAESS

SEQ ID NO: 1232146 - protein, 7 aa, Mycobacterium
VAGAADA

SEQ ID NO: 1232147 - protein, 12 aa, Mycobacterium
VAGAAEKLAEQG

SEQ ID NO: 1232148 - protein, 44 aa, Mycobacterium
VAGCRRGGGVGREGRGETDPEGSGEYRDSTDRRARHRDLSSVHR

SEQ ID NO: 1232149 - protein, 10 aa, Mycobacterium
VAGDDDPSVA

SEQ ID NO: 1232150 - protein, 14 aa, Mycobacterium
VAGDGPKGLEPGEI

SEQ ID NO: 1232151 - protein, 9 aa, Mycobacterium
VAGDPEARG

SEQ ID NO: 1232152 - protein, 6 aa, Mycobacterium
VAGDSA

SEQ ID NO: 1232153 - protein, 8 aa, Mycobacterium
VAGEPGAC

SEQ ID NO: 1232154 - protein, 12 aa, Mycobacterium
VAGESEGRIRGY

SEQ ID NO: 1232155 - protein, 4 aa, Mycobacterium
VAGG

SEQ ID NO: 1232156 - protein, 13 aa, Mycobacterium
VAGGGTPRPPVPV

SEQ ID NO: 1232157 - protein, 10 aa, Mycobacterium
VAGGRAAVGQ

SEQ ID NO: 1232158 - protein, 7 aa, Mycobacterium
VAGINDG

SEQ ID NO: 1232159 - protein, 10 aa, Mycobacterium
VAGPDSTLQM

SEQ ID NO: 1232160 - protein, 26 aa, Mycobacterium
VAGPDSTLQSQPANAIKKAAEKEGIS

SEQ ID NO: 1232161 - protein, 10 aa, Mycobacterium
VAGPEPHGGH

SEQ ID NO: 1232162 - protein, 7 aa, Mycobacterium
VAGPGGT

SEQ ID NO: 1232163 - protein, 8 aa, Mycobacterium
VAGPKRRG

SEQ ID NO: 1232164 - protein, 7 aa, Mycobacterium
VAGPRES

SEQ ID NO: 1232165 - protein, 9 aa, Mycobacterium
VAGPTRRGE

SEQ ID NO: 1232166 - protein, 4 aa, Mycobacterium
VAGQ

SEQ ID NO: 1232167 - protein, 13 aa, Mycobacterium
VAGQATSAAWGQT

SEQ ID NO: 1232168 - protein, 9 aa, Mycobacterium
VAGQSAAAL

SEQ ID NO: 1232169 - protein, 12 aa, Mycobacterium
VAGRAGGLAPDH

SEQ ID NO: 1232170 - protein, 8 aa, Mycobacterium
VAGRGEPR

SEQ ID NO: 1232171 - protein, 11 aa, Mycobacterium
VAGRPGDQTGE

SEQ ID NO: 1232172 - protein, 6 aa, Mycobacterium
VAGSAR

SEQ ID NO: 1232173 - protein, 11 aa, Mycobacterium
VAGSDSLPEPT

SEQ ID NO: 1232174 - protein, 9 aa, Mycobacterium
VAGSGEPFR

SEQ ID NO: 1232175 - protein, 124 aa, Mycobacterium
VAGSSPVGPPSSSAGRPQSPVPPSPPSSPLPNVTSTPAQTSSPLSGGSSVGGAPSLGGGSGSGGGGASGVGSSGGSSGGGTSSSPISDGPSSIGDQSSVDPSNGASGPSSGASGQPPIQSPPIA

SEQ ID NO: 1232176 - protein, 10 aa, Mycobacterium
VAGTGTAKLD

SEQ ID NO: 1232177 - protein, 10 aa, Mycobacterium
VAGTPDEVAQ

SEQ ID NO: 1232178 - protein, 17 aa, Mycobacterium
VAGTPLDEVDADRADNA

SEQ ID NO: 1232179 - protein, 7 aa, Mycobacterium
VAGYEGQ

SEQ ID NO: 1232180 - protein, 14 aa, Mycobacterium
VAGYPQGYTDYPTA

SEQ ID NO: 1232181 - protein, 12 aa, Mycobacterium
VAHTGTSEYGRT

SEQ ID NO: 1232182 - protein, 14 aa, Mycobacterium
VAKQALKEKKTIRQ

SEQ ID NO: 1232183 - protein, 13 aa, Mycobacterium
VALPGGDAIGSRP

SEQ ID NO: 1232184 - protein, 8 aa, Mycobacterium
VANDGEPL

SEQ ID NO: 1232185 - protein, 7 aa, Mycobacterium
VANDTQV

SEQ ID NO: 1232186 - protein, 7 aa, Mycobacterium
VANEDNI

SEQ ID NO: 1232187 - protein, 12 aa, Mycobacterium
VANEGIGATPGE

SEQ ID NO: 1232188 - protein, 7 aa, Mycobacterium
VANEIEK

SEQ ID NO: 1232189 - protein, 8 aa, Mycobacterium
VAPAEPVV

SEQ ID NO: 1232190 - protein, 6 aa, Mycobacterium
VAPAGG

SEQ ID NO: 1232191 - protein, 17 aa, Mycobacterium
VAPAPAPAPAPAPVLPP

SEQ ID NO: 1232192 - protein, 6 aa, Mycobacterium
VAPATA

SEQ ID NO: 1232193 - protein, 9 aa, Mycobacterium
VAPATEELA

SEQ ID NO: 1232194 - protein, 9 aa, Mycobacterium
VAPATTADA

SEQ ID NO: 1232195 - protein, 8 aa, Mycobacterium
VAPDAEDT

SEQ ID NO: 1232196 - protein, 8 aa, Mycobacterium
VAPDATGF

SEQ ID NO: 1232197 - protein, 8 aa, Mycobacterium
VAPDPEHA

SEQ ID NO: 1232198 - protein, 6 aa, Mycobacterium
VAPDQI

SEQ ID NO: 1232199 - protein, 14 aa, Mycobacterium
VAPETPGSIHEGGE

SEQ ID NO: 1232200 - protein, 5 aa, Mycobacterium
VAPGA

SEQ ID NO: 1232201 - protein, 13 aa, Mycobacterium
VAPGAKEQARGQV

SEQ ID NO: 1232202 - protein, 19 aa, Mycobacterium
VAPGAQDEERGDTAPGVGR

SEQ ID NO: 1232203 - protein, 10 aa, Mycobacterium
VAPGATLGTD

SEQ ID NO: 1232204 - protein, 8 aa, Mycobacterium
VAPGGDAA

SEQ ID NO: 1232205 - protein, 15 aa, Mycobacterium
VAPGGMPSDLRGPRA

SEQ ID NO: 1232206 - protein, 7 aa, Mycobacterium
VAPGKDQ

SEQ ID NO: 1232207 - protein, 12 aa, Mycobacterium
VAPGNAGTAAVA

SEQ ID NO: 1232208 - protein, 11 aa, Mycobacterium
VAPGPPGGVRD

SEQ ID NO: 1232209 - protein, 10 aa, Mycobacterium
VAPGPTDTEG

SEQ ID NO: 1232210 - protein, 10 aa, Mycobacterium
VAPGPTDTPL

SEQ ID NO: 1232211 - protein, 7 aa, Mycobacterium
VAPGSVH

SEQ ID NO: 1232212 - protein, 8 aa, Mycobacterium
VAPNDSGI

SEQ ID NO: 1232213 - protein, 12 aa, Mycobacterium
VAPNRRPYRTKD

SEQ ID NO: 1232214 - protein, 13 aa, Mycobacterium
VAPNRTGSGPITA

SEQ ID NO: 1232215 - protein, 7 aa, Mycobacterium
VAPNSED

SEQ ID NO: 1232216 - protein, 10 aa, Mycobacterium
VAPPAGAEPD

SEQ ID NO: 1232217 - protein, 7 aa, Mycobacterium
VAPPAVD

SEQ ID NO: 1232218 - protein, 6 aa, Mycobacterium
VAPPEF

SEQ ID NO: 1232219 - protein, 8 aa, Mycobacterium
VAPPESLP

SEQ ID NO: 1232220 - protein, 10 aa, Mycobacterium
VAPPGIEDDP

SEQ ID NO: 1232221 - protein, 6 aa, Mycobacterium
VAPPQN

SEQ ID NO: 1232222 - protein, 7 aa, Mycobacterium
VAPPREV

SEQ ID NO: 1232223 - protein, 4 aa, Mycobacterium
VAPR

SEQ ID NO: 1232224 - protein, 5 aa, Mycobacterium
VAPRP

SEQ ID NO: 1232225 - protein, 11 aa, Mycobacterium
VAPSPKVHDAA

SEQ ID NO: 1232226 - protein, 6 aa, Mycobacterium
VAPTGE

SEQ ID NO: 1232227 - protein, 12 aa, Mycobacterium
VAPTRGSDAIGG

SEQ ID NO: 1232228 - protein, 9 aa, Mycobacterium
VAPTTLGAK

SEQ ID NO: 1232229 - protein, 7 aa, Mycobacterium
VAPTTTI

SEQ ID NO: 1232230 - protein, 4 aa, Mycobacterium
VAPY

SEQ ID NO: 1232231 - protein, 6 aa, Mycobacterium
VAQAPD

SEQ ID NO: 1232232 - protein, 20 aa, Mycobacterium
VAQDSTADAVRALRDAGVAV

SEQ ID NO: 1232233 - protein, 7 aa, Mycobacterium
VAQESDR

SEQ ID NO: 1232234 - protein, 5 aa, Mycobacterium
VAQPA

SEQ ID NO: 1232235 - protein, 14 aa, Mycobacterium
VAQPDTPSTVRTDD

SEQ ID NO: 1232236 - protein, 6 aa, Mycobacterium
VAQRPQ

SEQ ID NO: 1232237 - protein, 9 aa, Mycobacterium
VAQRPTDGT

SEQ ID NO: 1232238 - protein, 6 aa, Mycobacterium
VAQRRP

SEQ ID NO: 1232239 - protein, 10 aa, Mycobacterium
VAQSSDAAGE

SEQ ID NO: 1232240 - protein, 13 aa, Mycobacterium
VARAARRRDPDRV

SEQ ID NO: 1232241 - protein, 6 aa, Mycobacterium
VARADR

SEQ ID NO: 1232242 - protein, 5 aa, Mycobacterium
VARDR

SEQ ID NO: 1232243 - protein, 12 aa, Mycobacterium
VARDRGYPLPEA

SEQ ID NO: 1232244 - protein, 6 aa, Mycobacterium
VARERR

SEQ ID NO: 1232245 - protein, 5 aa, Mycobacterium
VARGS

SEQ ID NO: 1232246 - protein, 12 aa, Mycobacterium
VARHGDPDGPAS

SEQ ID NO: 1232247 - protein, 4 aa, Mycobacterium
VARN

SEQ ID NO: 1232248 - protein, 11 aa, Mycobacterium
VARPGDFSSNL

SEQ ID NO: 1232249 - protein, 8 aa, Mycobacterium
VARPGRGV

SEQ ID NO: 1232250 - protein, 14 aa, Mycobacterium
VARPSGTPLEPEAG

SEQ ID NO: 1232251 - protein, 8 aa, Mycobacterium
VARSDAKA

SEQ ID NO: 1232252 - protein, 7 aa, Mycobacterium
VARSRSD

SEQ ID NO: 1232253 - protein, 8 aa, Mycobacterium
VARTGSVS

SEQ ID NO: 1232254 - protein, 4 aa, Mycobacterium
VASA

SEQ ID NO: 1232255 - protein, 7 aa, Mycobacterium
VASAGRA

SEQ ID NO: 1232256 - protein, 5 aa, Mycobacterium
VASAN

SEQ ID NO: 1232257 - protein, 8 aa, Mycobacterium
VASANQMS

SEQ ID NO: 1232258 - protein, 11 aa, Mycobacterium
VASAQPAAGPW

SEQ ID NO: 1232259 - protein, 18 aa, Mycobacterium
VASDIPAAEKADRTNPDH

SEQ ID NO: 1232260 - protein, 8 aa, Mycobacterium
VASDTAPL

SEQ ID NO: 1232261 - protein, 5 aa, Mycobacterium
VASGA

SEQ ID NO: 1232262 - protein, 8 aa, Mycobacterium
VASGDTVT

SEQ ID NO: 1232263 - protein, 17 aa, Mycobacterium
VASGESVTATLANGGKT

SEQ ID NO: 1232264 - protein, 11 aa, Mycobacterium
VASGKPAPDPY

SEQ ID NO: 1232265 - protein, 10 aa, Mycobacterium
VASLDPASAT

SEQ ID NO: 1232266 - protein, 4 aa, Mycobacterium
VASP

SEQ ID NO: 1232267 - protein, 6 aa, Mycobacterium
VASPDA

SEQ ID NO: 1232268 - protein, 6 aa, Mycobacterium
VASPDG

SEQ ID NO: 1232269 - protein, 5 aa, Mycobacterium
VASPE

SEQ ID NO: 1232270 - protein, 7 aa, Mycobacterium
VASPGDG

SEQ ID NO: 1232271 - protein, 7 aa, Mycobacterium
VASPRRV

SEQ ID NO: 1232272 - protein, 10 aa, Mycobacterium
VASQAGVSRP

SEQ ID NO: 1232273 - protein, 10 aa, Mycobacterium
VASQGSANVS

SEQ ID NO: 1232274 - protein, 7 aa, Mycobacterium
VASRDDV

SEQ ID NO: 1232275 - protein, 8 aa, Mycobacterium
VASRGPEA

SEQ ID NO: 1232276 - protein, 15 aa, Mycobacterium
VASSAEKLAAATQHG

SEQ ID NO: 1232277 - protein, 8 aa, Mycobacterium
VASSNEKL

SEQ ID NO: 1232278 - protein, 21 aa, Mycobacterium
VASSRVDDAPWTPPPRTSPAR

SEQ ID NO: 1232279 - protein, 18 aa, Mycobacterium
VASTDAAPAVTASGKTPL

SEQ ID NO: 1232280 - protein, 9 aa, Mycobacterium
VASTVDDGE

SEQ ID NO: 1232281 - protein, 4 aa, Mycobacterium
VATA

SEQ ID NO: 1232282 - protein, 14 aa, Mycobacterium
VATAARSLLDRLPG

SEQ ID NO: 1232283 - protein, 9 aa, Mycobacterium
VATAETIDP

SEQ ID NO: 1232284 - protein, 6 aa, Mycobacterium
VATDQG

SEQ ID NO: 1232285 - protein, 12 aa, Mycobacterium
VATDSTPTPEPL

SEQ ID NO: 1232286 - protein, 10 aa, Mycobacterium
VATEGGVPEA

SEQ ID NO: 1232287 - protein, 11 aa, Mycobacterium
VATESGEPVDP

SEQ ID NO: 1232288 - protein, 77 aa, Mycobacterium
VATETESDGQESATGTASEIDPESSELSDEDETETADSDPDTSSEGSSADDEGGDTDTETATGDDDSSSSDTGSGAD

SEQ ID NO: 1232289 - protein, 4 aa, Mycobacterium
VATG

SEQ ID NO: 1232290 - protein, 6 aa, Mycobacterium
VATGEA

SEQ ID NO: 1232291 - protein, 7 aa, Mycobacterium
VATGRAS

SEQ ID NO: 1232292 - protein, 8 aa, Mycobacterium
VATGTPAE

SEQ ID NO: 1232293 - protein, 9 aa, Mycobacterium
VATGTQRAP

SEQ ID NO: 1232294 - protein, 11 aa, Mycobacterium
VATIQSKTEPW

SEQ ID NO: 1232295 - protein, 10 aa, Mycobacterium
VATPDRPRTA

SEQ ID NO: 1232296 - protein, 6 aa, Mycobacterium
VATRAA

SEQ ID NO: 1232297 - protein, 10 aa, Mycobacterium
VATRSATKNQ

SEQ ID NO: 1232298 - protein, 8 aa, Mycobacterium
VATTTPQY

SEQ ID NO: 1232299 - protein, 27 aa, Mycobacterium
VATTTTGVVTTPKTGGETARTGPVGGQ

SEQ ID NO: 1232300 - protein, 11 aa, Mycobacterium
VDAADAPSYAA

SEQ ID NO: 1232301 - protein, 9 aa, Mycobacterium
VDAAPEPTL

SEQ ID NO: 1232302 - protein, 6 aa, Mycobacterium
VDAASR

SEQ ID NO: 1232303 - protein, 4 aa, Mycobacterium
VDAD

SEQ ID NO: 1232304 - protein, 6 aa, Mycobacterium
VDADEA

SEQ ID NO: 1232305 - protein, 13 aa, Mycobacterium
VDADEVSSAARGL

SEQ ID NO: 1232306 - protein, 10 aa, Mycobacterium
VDADSKPRTR

SEQ ID NO: 1232307 - protein, 5 aa, Mycobacterium
VDADT

SEQ ID NO: 1232308 - protein, 8 aa, Mycobacterium
VDAEAAKR

SEQ ID NO: 1232309 - protein, 9 aa, Mycobacterium
VDAEDPSTA

SEQ ID NO: 1232310 - protein, 9 aa, Mycobacterium
VDAEQDPSC

SEQ ID NO: 1232311 - protein, 16 aa, Mycobacterium
VDAGARPGTTTEESAE

SEQ ID NO: 1232312 - protein, 7 aa, Mycobacterium
VDAGDSL

SEQ ID NO: 1232313 - protein, 14 aa, Mycobacterium
VDAGNNVRNKETDR

SEQ ID NO: 1232314 - protein, 7 aa, Mycobacterium
VDAGPGG

SEQ ID NO: 1232315 - protein, 7 aa, Mycobacterium
VDAGVRS

SEQ ID NO: 1232316 - protein, 6 aa, Mycobacterium
VDAKPG

SEQ ID NO: 1232317 - protein, 5 aa, Mycobacterium
VDANG

SEQ ID NO: 1232318 - protein, 5 aa, Mycobacterium
VDAPD

SEQ ID NO: 1232319 - protein, 11 aa, Mycobacterium
VDAPGGRRELD

SEQ ID NO: 1232320 - protein, 7 aa, Mycobacterium
VDAPPMS

SEQ ID NO: 1232321 - protein, 9 aa, Mycobacterium
VDAPPSRSS

SEQ ID NO: 1232322 - protein, 6 aa, Mycobacterium
VDAQRK

SEQ ID NO: 1232323 - protein, 18 aa, Mycobacterium
VDAQSQARTALRDSQPIA

SEQ ID NO: 1232324 - protein, 7 aa, Mycobacterium
VDARRRS

SEQ ID NO: 1232325 - protein, 13 aa, Mycobacterium
VDASEVDGGTDTI

SEQ ID NO: 1232326 - protein, 6 aa, Mycobacterium
VDATAD

SEQ ID NO: 1232327 - protein, 6 aa, Mycobacterium
VDATNS

SEQ ID NO: 1232328 - protein, 10 aa, Mycobacterium
VDDAKRAVDA

SEQ ID NO: 1232329 - protein, 15 aa, Mycobacterium
VDDASASGASGPGWK

SEQ ID NO: 1232330 - protein, 4 aa, Mycobacterium
VDDD

SEQ ID NO: 1232331 - protein, 7 aa, Mycobacterium
VDDDEAV

SEQ ID NO: 1232332 - protein, 6 aa, Mycobacterium
VDDDEH

SEQ ID NO: 1232333 - protein, 47 aa, Mycobacterium
VDDDTAVDGDSDDEDADEGAPKAAKPAKDGDDDGVAEPSEKDKASGD

SEQ ID NO: 1232334 - protein, 9 aa, Mycobacterium
VDDDTEELR

SEQ ID NO: 1232335 - protein, 9 aa, Mycobacterium
VDDEGQPDV

SEQ ID NO: 1232336 - protein, 8 aa, Mycobacterium
VDDEGQRC

SEQ ID NO: 1232337 - protein, 4 aa, Mycobacterium
VDDG

SEQ ID NO: 1232338 - protein, 5 aa, Mycobacterium
VDDGR

SEQ ID NO: 1232339 - protein, 8 aa, Mycobacterium
VDDGRART

SEQ ID NO: 1232340 - protein, 6 aa, Mycobacterium
VDDGSL

SEQ ID NO: 1232341 - protein, 5 aa, Mycobacterium
VDDGV

SEQ ID NO: 1232342 - protein, 10 aa, Mycobacterium
VDDHDATYRQ

SEQ ID NO: 1232343 - protein, 6 aa, Mycobacterium
VDDHTS

SEQ ID NO: 1232344 - protein, 14 aa, Mycobacterium
VDDIGKAAKFGGPA

SEQ ID NO: 1232345 - protein, 8 aa, Mycobacterium
VDDPAPEA

SEQ ID NO: 1232346 - protein, 9 aa, Mycobacterium
VDDPAPEAL

SEQ ID NO: 1232347 - protein, 13 aa, Mycobacterium
VDDPATRDKLTPR

SEQ ID NO: 1232348 - protein, 7 aa, Mycobacterium
VDDPDRP

SEQ ID NO: 1232349 - protein, 8 aa, Mycobacterium
VDDPPELV

SEQ ID NO: 1232350 - protein, 7 aa, Mycobacterium
VDDPSGA

SEQ ID NO: 1232351 - protein, 8 aa, Mycobacterium
VDDPSGEA

SEQ ID NO: 1232352 - protein, 6 aa, Mycobacterium
VDDPTE

SEQ ID NO: 1232353 - protein, 5 aa, Mycobacterium
VDDQR

SEQ ID NO: 1232354 - protein, 4 aa, Mycobacterium
VDDR

SEQ ID NO: 1232355 - protein, 21 aa, Mycobacterium
VDDRPVAENAPAKQISAESTF

SEQ ID NO: 1232356 - protein, 13 aa, Mycobacterium
VDDRTERRRARRI

SEQ ID NO: 1232357 - protein, 8 aa, Mycobacterium
VDDSDQAK

SEQ ID NO: 1232358 - protein, 10 aa, Mycobacterium
VDDSGRPDLT

SEQ ID NO: 1232359 - protein, 5 aa, Mycobacterium
VDDSH

SEQ ID NO: 1232360 - protein, 11 aa, Mycobacterium
VDDSPYGGGPG

SEQ ID NO: 1232361 - protein, 18 aa, Mycobacterium
VDDTPDVPEPEDEPESRT

SEQ ID NO: 1232362 - protein, 6 aa, Mycobacterium
VDDVEA

SEQ ID NO: 1232363 - protein, 11 aa, Mycobacterium
VDEAASRAGAP

SEQ ID NO: 1232364 - protein, 6 aa, Mycobacterium
VDEAGG

SEQ ID NO: 1232365 - protein, 21 aa, Mycobacterium
VDEASAEEADEATEVEKADDD

SEQ ID NO: 1232366 - protein, 43 aa, Mycobacterium
VDEASAGNIDSTMPGGTSSPAPAPVPIPPNSVPAPPPPPPMPG

SEQ ID NO: 1232367 - protein, 6 aa, Mycobacterium
VDEDPE

SEQ ID NO: 1232368 - protein, 9 aa, Mycobacterium
VDEEDRTAR

SEQ ID NO: 1232369 - protein, 4 aa, Mycobacterium
VDEL

SEQ ID NO: 1232370 - protein, 9 aa, Mycobacterium
VDENPATAR

SEQ ID NO: 1232371 - protein, 24 aa, Mycobacterium
VDEPVQESAEGTEETAPADPTEAA

SEQ ID NO: 1232372 - protein, 5 aa, Mycobacterium
VDERP

SEQ ID NO: 1232373 - protein, 4 aa, Mycobacterium
VDES

SEQ ID NO: 1232374 - protein, 11 aa, Mycobacterium
VDESESAENFE

SEQ ID NO: 1232375 - protein, 9 aa, Mycobacterium
VDESPTALP

SEQ ID NO: 1232376 - protein, 43 aa, Mycobacterium
VDETNAEVRAGADAEAVGSDEDAAPAEATDAAEGADEEDEDPA

SEQ ID NO: 1232377 - protein, 18 aa, Mycobacterium
VDETTTVEQDTPAVTDDG

SEQ ID NO: 1232378 - protein, 9 aa, Mycobacterium
VDEVDGSKA

SEQ ID NO: 1232379 - protein, 4 aa, Mycobacterium
VDEY

SEQ ID NO: 1232380 - protein, 8 aa, Mycobacterium
VDGADIGK

SEQ ID NO: 1232381 - protein, 18 aa, Mycobacterium
VDGADKPAAVVELISRWV

SEQ ID NO: 1232382 - protein, 10 aa, Mycobacterium
VDGARWDDDG

SEQ ID NO: 1232383 - protein, 6 aa, Mycobacterium
VDGASL

SEQ ID NO: 1232384 - protein, 6 aa, Mycobacterium
VDGCEG

SEQ ID NO: 1232385 - protein, 8 aa, Mycobacterium
VDGDADCQ

SEQ ID NO: 1232386 - protein, 8 aa, Mycobacterium
VDGDDAAR

SEQ ID NO: 1232387 - protein, 6 aa, Mycobacterium
VDGDEA

SEQ ID NO: 1232388 - protein, 7 aa, Mycobacterium
VDGDRTN

SEQ ID NO: 1232389 - protein, 10 aa, Mycobacterium
VDGEGSAGAP

SEQ ID NO: 1232390 - protein, 10 aa, Mycobacterium
VDGETTEADP

SEQ ID NO: 1232391 - protein, 6 aa, Mycobacterium
VDGETV

SEQ ID NO: 1232392 - protein, 8 aa, Mycobacterium
VDGFGGGD

SEQ ID NO: 1232393 - protein, 14 aa, Mycobacterium
VDGGEGVEAAAGQI

SEQ ID NO: 1232394 - protein, 5 aa, Mycobacterium
VDGGP

SEQ ID NO: 1232395 - protein, 5 aa, Mycobacterium
VDGGR

SEQ ID NO: 1232396 - protein, 7 aa, Mycobacterium
VDGGTAG

SEQ ID NO: 1232397 - protein, 5 aa, Mycobacterium
VDGHP

SEQ ID NO: 1232398 - protein, 20 aa, Mycobacterium
VDGHRASALQSAARSSEIDR

SEQ ID NO: 1232399 - protein, 10 aa, Mycobacterium
VDGKINPARI

SEQ ID NO: 1232400 - protein, 6 aa, Mycobacterium
VDGNVT

SEQ ID NO: 1232401 - protein, 7 aa, Mycobacterium
VDGPAAQ

SEQ ID NO: 1232402 - protein, 12 aa, Mycobacterium
VDGPASNDSQDY

SEQ ID NO: 1232403 - protein, 6 aa, Mycobacterium
VDGPAV

SEQ ID NO: 1232404 - protein, 7 aa, Mycobacterium
VDGPEEL

SEQ ID NO: 1232405 - protein, 7 aa, Mycobacterium
VDGPNRR

SEQ ID NO: 1232406 - protein, 10 aa, Mycobacterium
VDGQRLTDEE

SEQ ID NO: 1232407 - protein, 9 aa, Mycobacterium
VDGRGATLQ

SEQ ID NO: 1232408 - protein, 6 aa, Mycobacterium
VDGRQT

SEQ ID NO: 1232409 - protein, 8 aa, Mycobacterium
VDGRTDPL

SEQ ID NO: 1232410 - protein, 6 aa, Mycobacterium
VDGRTR

SEQ ID NO: 1232411 - protein, 7 aa, Mycobacterium
VDGSDNT

SEQ ID NO: 1232412 - protein, 7 aa, Mycobacterium
VDGSGAA

SEQ ID NO: 1232413 - protein, 13 aa, Mycobacterium
VDGSHGGTGGGNH

SEQ ID NO: 1232414 - protein, 11 aa, Mycobacterium
VDGSRSDLDSA

SEQ ID NO: 1232415 - protein, 15 aa, Mycobacterium
VDGSTGEVAVLARSA

SEQ ID NO: 1232416 - protein, 7 aa, Mycobacterium
VDGSTIP

SEQ ID NO: 1232417 - protein, 8 aa, Mycobacterium
VDGTGADR

SEQ ID NO: 1232418 - protein, 16 aa, Mycobacterium
VDGTRIGKKAHTAHTV

SEQ ID NO: 1232419 - protein, 5 aa, Mycobacterium
VDGTT

SEQ ID NO: 1232420 - protein, 6 aa, Mycobacterium
VDGVHG

SEQ ID NO: 1232421 - protein, 7 aa, Mycobacterium
VDGYGEG

SEQ ID NO: 1232422 - protein, 6 aa, Mycobacterium
VDIPGR

SEQ ID NO: 1232423 - protein, 4 aa, Mycobacterium
VDKA

SEQ ID NO: 1232424 - protein, 9 aa, Mycobacterium
VDKGLSKAD

SEQ ID NO: 1232425 - protein, 4 aa, Mycobacterium
VDKP

SEQ ID NO: 1232426 - protein, 9 aa, Mycobacterium
VDKRSEATI

SEQ ID NO: 1232427 - protein, 10 aa, Mycobacterium
VDKSKGRISA

SEQ ID NO: 1232428 - protein, 5 aa, Mycobacterium
VDLGR

SEQ ID NO: 1232429 - protein, 4 aa, Mycobacterium
VDLP

SEQ ID NO: 1232430 - protein, 8 aa, Mycobacterium
VDLSDPAN

SEQ ID NO: 1232431 - protein, 9 aa, Mycobacterium
VDLSTSQGK

SEQ ID NO: 1232432 - protein, 9 aa, Mycobacterium
VDMDDTDET

SEQ ID NO: 1232433 - protein, 7 aa, Mycobacterium
VDMSPNG

SEQ ID NO: 1232434 - protein, 10 aa, Mycobacterium
VDNERGEADA

SEQ ID NO: 1232435 - protein, 8 aa, Mycobacterium
VDNESGDY

SEQ ID NO: 1232436 - protein, 24 aa, Mycobacterium
VDNGGTSGAGAIAQSQVGTSPDSA

SEQ ID NO: 1232437 - protein, 11 aa, Mycobacterium
VDNGPSRNPLQ

SEQ ID NO: 1232438 - protein, 6 aa, Mycobacterium
VDNGQF

SEQ ID NO: 1232439 - protein, 10 aa, Mycobacterium
VDNPTTEEIS

SEQ ID NO: 1232440 - protein, 10 aa, Mycobacterium
VDNYRPSADH

SEQ ID NO: 1232441 - protein, 9 aa, Mycobacterium
VDPAANEDV

SEQ ID NO: 1232442 - protein, 8 aa, Mycobacterium
VDPAAPNG

SEQ ID NO: 1232443 - protein, 7 aa, Mycobacterium
VDPADAA

SEQ ID NO: 1232444 - protein, 10 aa, Mycobacterium
VDPADATDGF

SEQ ID NO: 1232445 - protein, 6 aa, Mycobacterium
VDPADN

SEQ ID NO: 1232446 - protein, 13 aa, Mycobacterium
VDPADPGAQPPPH

SEQ ID NO: 1232447 - protein, 5 aa, Mycobacterium
VDPAE

SEQ ID NO: 1232448 - protein, 6 aa, Mycobacterium
VDPAEV

SEQ ID NO: 1232449 - protein, 12 aa, Mycobacterium
VDPAGPVSVQPN

SEQ ID NO: 1232450 - protein, 6 aa, Mycobacterium
VDPASA

SEQ ID NO: 1232451 - protein, 20 aa, Mycobacterium
VDPATAPAREATLELLAKEI

SEQ ID NO: 1232452 - protein, 8 aa, Mycobacterium
VDPATQTM

SEQ ID NO: 1232453 - protein, 4 aa, Mycobacterium
VDPD

SEQ ID NO: 1232454 - protein, 8 aa, Mycobacterium
VDPDAEQT

SEQ ID NO: 1232455 - protein, 8 aa, Mycobacterium
VDPDASLR

SEQ ID NO: 1232456 - protein, 6 aa, Mycobacterium
VDPDAV

SEQ ID NO: 1232457 - protein, 9 aa, Mycobacterium
VDPDDDWPR

SEQ ID NO: 1232458 - protein, 8 aa, Mycobacterium
VDPDDRDR

SEQ ID NO: 1232459 - protein, 7 aa, Mycobacterium
VDPDESV

SEQ ID NO: 1232460 - protein, 8 aa, Mycobacterium
VDPDGADA

SEQ ID NO: 1232461 - protein, 8 aa, Mycobacterium
VDPDGADG

SEQ ID NO: 1232462 - protein, 10 aa, Mycobacterium
VDPDGADLGA

SEQ ID NO: 1232463 - protein, 6 aa, Mycobacterium
VDPDRV

SEQ ID NO: 1232464 - protein, 10 aa, Mycobacterium
VDPDSGGAAT

SEQ ID NO: 1232465 - protein, 11 aa, Mycobacterium
VDPDSQGPLAG

SEQ ID NO: 1232466 - protein, 18 aa, Mycobacterium
VDPDTVRRYGGGSRWNAG

SEQ ID NO: 1232467 - protein, 7 aa, Mycobacterium
VDPEGGV

SEQ ID NO: 1232468 - protein, 15 aa, Mycobacterium
VDPEGSVYSGGTGRP

SEQ ID NO: 1232469 - protein, 7 aa, Mycobacterium
VDPESAA

SEQ ID NO: 1232470 - protein, 17 aa, Mycobacterium
VDPESAERLWELSEKLL

SEQ ID NO: 1232471 - protein, 21 aa, Mycobacterium
VDPEWTTDADGPHKRERASAL

SEQ ID NO: 1232472 - protein, 9 aa, Mycobacterium
VDPGAKDRK

SEQ ID NO: 1232473 - protein, 9 aa, Mycobacterium
VDPGASGFE

SEQ ID NO: 1232474 - protein, 10 aa, Mycobacterium
VDPGSELGQE

SEQ ID NO: 1232475 - protein, 7 aa, Mycobacterium
VDPGTGV

SEQ ID NO: 1232476 - protein, 9 aa, Mycobacterium
VDPNAKGSY

SEQ ID NO: 1232477 - protein, 10 aa, Mycobacterium
VDPNERTPGT

SEQ ID NO: 1232478 - protein, 9 aa, Mycobacterium
VDPPAQARQ

SEQ ID NO: 1232479 - protein, 5 aa, Mycobacterium
VDPPE

SEQ ID NO: 1232480 - protein, 7 aa, Mycobacterium
VDPPGGL

SEQ ID NO: 1232481 - protein, 8 aa, Mycobacterium
VDPPGPTA

SEQ ID NO: 1232482 - protein, 50 aa, Mycobacterium
VDPPGTVSIQPNSSVTWGDGPAPKAASARPTDGAAVGEATVTTPSVDRPA

SEQ ID NO: 1232483 - protein, 17 aa, Mycobacterium
VDPPPPDLYDGPSARAP

SEQ ID NO: 1232484 - protein, 8 aa, Mycobacterium
VDPPSDHV

SEQ ID NO: 1232485 - protein, 4 aa, Mycobacterium
VDPR

SEQ ID NO: 1232486 - protein, 10 aa, Mycobacterium
VDPRHNSKIE

SEQ ID NO: 1232487 - protein, 10 aa, Mycobacterium
VDPRNSERGL

SEQ ID NO: 1232488 - protein, 7 aa, Mycobacterium
VDPRRAR

SEQ ID NO: 1232489 - protein, 12 aa, Mycobacterium
VDPSAVAKAPAL

SEQ ID NO: 1232490 - protein, 7 aa, Mycobacterium
VDPSEEL

SEQ ID NO: 1232491 - protein, 6 aa, Mycobacterium
VDPSGD

SEQ ID NO: 1232492 - protein, 5 aa, Mycobacterium
VDPSN

SEQ ID NO: 1232493 - protein, 8 aa, Mycobacterium
VDPSPTLR

SEQ ID NO: 1232494 - protein, 8 aa, Mycobacterium
VDPSRGGA

SEQ ID NO: 1232495 - protein, 9 aa, Mycobacterium
VDPTAAPAD

SEQ ID NO: 1232496 - protein, 7 aa, Mycobacterium
VDPTDDP

SEQ ID NO: 1232497 - protein, 7 aa, Mycobacterium
VDPTGPV

SEQ ID NO: 1232498 - protein, 7 aa, Mycobacterium
VDPTQPT

SEQ ID NO: 1232499 - protein, 5 aa, Mycobacterium
VDPTR

SEQ ID NO: 1232500 - protein, 6 aa, Mycobacterium
VDPTTG

SEQ ID NO: 1232501 - protein, 23 aa, Mycobacterium
VDPTTGKHRRGRDCSHASTLSRT

SEQ ID NO: 1232502 - protein, 13 aa, Mycobacterium
VDPVDRDDVGPSF

SEQ ID NO: 1232503 - protein, 10 aa, Mycobacterium
VDPVETSDDD

SEQ ID NO: 1232504 - protein, 14 aa, Mycobacterium
VDPVPRTRSDLDAG

SEQ ID NO: 1232505 - protein, 6 aa, Mycobacterium
VDPVST

SEQ ID NO: 1232506 - protein, 12 aa, Mycobacterium
VDQADTLDPDRT

SEQ ID NO: 1232507 - protein, 9 aa, Mycobacterium
VDQDAVRDS

SEQ ID NO: 1232508 - protein, 9 aa, Mycobacterium
VDQGATQRV

SEQ ID NO: 1232509 - protein, 13 aa, Mycobacterium
VDQPVDSPSCDGL

SEQ ID NO: 1232510 - protein, 10 aa, Mycobacterium
VDQRSAGSFE

SEQ ID NO: 1232511 - protein, 9 aa, Mycobacterium
VDQTAKATG

SEQ ID NO: 1232512 - protein, 10 aa, Mycobacterium
VDRAAQTRDW

SEQ ID NO: 1232513 - protein, 12 aa, Mycobacterium
VDRAESEPERAH

SEQ ID NO: 1232514 - protein, 10 aa, Mycobacterium
VDRAKLESEL

SEQ ID NO: 1232515 - protein, 5 aa, Mycobacterium
VDRAN

SEQ ID NO: 1232516 - protein, 16 aa, Mycobacterium
VDRASRGLGVSKTEVR

SEQ ID NO: 1232517 - protein, 13 aa, Mycobacterium
VDRDETKAFNQPG

SEQ ID NO: 1232518 - protein, 6 aa, Mycobacterium
VDREAE

SEQ ID NO: 1232519 - protein, 10 aa, Mycobacterium
VDREPAGPED

SEQ ID NO: 1232520 - protein, 12 aa, Mycobacterium
VDRESTADTATQ

SEQ ID NO: 1232521 - protein, 5 aa, Mycobacterium
VDRGG

SEQ ID NO: 1232522 - protein, 7 aa, Mycobacterium
VDRGGRT

SEQ ID NO: 1232523 - protein, 9 aa, Mycobacterium
VDRKRTPLE

SEQ ID NO: 1232524 - protein, 6 aa, Mycobacterium
VDRPDM

SEQ ID NO: 1232525 - protein, 6 aa, Mycobacterium
VDRPGA

SEQ ID NO: 1232526 - protein, 7 aa, Mycobacterium
VDRQASM

SEQ ID NO: 1232527 - protein, 11 aa, Mycobacterium
VDRRAGAGAYA

SEQ ID NO: 1232528 - protein, 11 aa, Mycobacterium
VDRRPDLPSGK

SEQ ID NO: 1232529 - protein, 11 aa, Mycobacterium
VDRTRKALADQ

SEQ ID NO: 1232530 - protein, 9 aa, Mycobacterium
VDRVGQKSD

SEQ ID NO: 1232531 - protein, 7 aa, Mycobacterium
VDSARAT

SEQ ID NO: 1232532 - protein, 8 aa, Mycobacterium
VDSASGYK

SEQ ID NO: 1232533 - protein, 6 aa, Mycobacterium
VDSDAR

SEQ ID NO: 1232534 - protein, 9 aa, Mycobacterium
VDSGAAEAK

SEQ ID NO: 1232535 - protein, 6 aa, Mycobacterium
VDSGDW

SEQ ID NO: 1232536 - protein, 10 aa, Mycobacterium
VDSGTGCPPL

SEQ ID NO: 1232537 - protein, 7 aa, Mycobacterium
VDSGVEQ

SEQ ID NO: 1232538 - protein, 9 aa, Mycobacterium
VDSPGINAY

SEQ ID NO: 1232539 - protein, 7 aa, Mycobacterium
VDSPLEE

SEQ ID NO: 1232540 - protein, 6 aa, Mycobacterium
VDSPRP

SEQ ID NO: 1232541 - protein, 20 aa, Mycobacterium
VDSSESSNEAEAGAEKGSGE

SEQ ID NO: 1232542 - protein, 4 aa, Mycobacterium
VDTA

SEQ ID NO: 1232543 - protein, 8 aa, Mycobacterium
VDTANSDV

SEQ ID NO: 1232544 - protein, 19 aa, Mycobacterium
VDTARRNAAEAAGRVTPRA

SEQ ID NO: 1232545 - protein, 10 aa, Mycobacterium
VDTATEDGAD

SEQ ID NO: 1232546 - protein, 7 aa, Mycobacterium
VDTDTRV

SEQ ID NO: 1232547 - protein, 10 aa, Mycobacterium
VDTEEIDKDE

SEQ ID NO: 1232548 - protein, 11 aa, Mycobacterium
VDTEETAAWRD

SEQ ID NO: 1232549 - protein, 6 aa, Mycobacterium
VDTEGL

SEQ ID NO: 1232550 - protein, 10 aa, Mycobacterium
VDTETGEPVD

SEQ ID NO: 1232551 - protein, 9 aa, Mycobacterium
VDTGGGEVT

SEQ ID NO: 1232552 - protein, 10 aa, Mycobacterium
VDTGTAALGQ

SEQ ID NO: 1232553 - protein, 7 aa, Mycobacterium
VDTGVGG

SEQ ID NO: 1232554 - protein, 26 aa, Mycobacterium
VDTPPSSPGTRRRPVSANPLHRKLPR

SEQ ID NO: 1232555 - protein, 5 aa, Mycobacterium
VDTPR

SEQ ID NO: 1232556 - protein, 9 aa, Mycobacterium
VDTRDGEAL

SEQ ID NO: 1232557 - protein, 7 aa, Mycobacterium
VDTRNGS

SEQ ID NO: 1232558 - protein, 7 aa, Mycobacterium
VDTSATY

SEQ ID NO: 1232559 - protein, 7 aa, Mycobacterium
VDTTTTE

SEQ ID NO: 1232560 - protein, 8 aa, Mycobacterium
VDTTVSDR

SEQ ID NO: 1232561 - protein, 6 aa, Mycobacterium
VDTVPT

SEQ ID NO: 1232562 - protein, 11 aa, Mycobacterium
VDVDGPAAELT

SEQ ID NO: 1232563 - protein, 6 aa, Mycobacterium
VDVGDE

SEQ ID NO: 1232564 - protein, 46 aa, Mycobacterium
VDVNDDGHPVTPGDYEHQRDDDASAVPLTPSQPGGLMTPEDAAASV

SEQ ID NO: 1232565 - protein, 4 aa, Mycobacterium
VDVP

SEQ ID NO: 1232566 - protein, 7 aa, Mycobacterium
VDVPART

SEQ ID NO: 1232567 - protein, 6 aa, Mycobacterium
VDVSGT

SEQ ID NO: 1232568 - protein, 17 aa, Mycobacterium
VDVTERDDLPPPPRMPN

SEQ ID NO: 1232569 - protein, 15 aa, Mycobacterium
VEAAKTRSEQLGITP

SEQ ID NO: 1232570 - protein, 15 aa, Mycobacterium
VEAAKTRSEQLGITS

SEQ ID NO: 1232571 - protein, 7 aa, Mycobacterium
VEAARAG

SEQ ID NO: 1232572 - protein, 17 aa, Mycobacterium
VEAATKPSHLDRDEDPV

SEQ ID NO: 1232573 - protein, 11 aa, Mycobacterium
VEADGSPETVA

SEQ ID NO: 1232574 - protein, 10 aa, Mycobacterium
VEADTAQEAI

SEQ ID NO: 1232575 - protein, 10 aa, Mycobacterium
VEAEETPMAD

SEQ ID NO: 1232576 - protein, 12 aa, Mycobacterium
VEAEPGDDLEVE

SEQ ID NO: 1232577 - protein, 10 aa, Mycobacterium
VEAEPGGAHS

SEQ ID NO: 1232578 - protein, 24 aa, Mycobacterium
VEAGDRTLTSTPDVPEANPRRPFA

SEQ ID NO: 1232579 - protein, 7 aa, Mycobacterium
VEAGPAA

SEQ ID NO: 1232580 - protein, 8 aa, Mycobacterium
VEAGPPQQ

SEQ ID NO: 1232581 - protein, 9 aa, Mycobacterium
VEAGQRSAI

SEQ ID NO: 1232582 - protein, 8 aa, Mycobacterium
VEAGRGGY

SEQ ID NO: 1232583 - protein, 6 aa, Mycobacterium
VEAGSS

SEQ ID NO: 1232584 - protein, 4 aa, Mycobacterium
VEAI

SEQ ID NO: 1232585 - protein, 10 aa, Mycobacterium
VEANGKPVKV

SEQ ID NO: 1232586 - protein, 63 aa, Mycobacterium
VEAPASAAAPAPAAASAPAPAPAAAPVPEPPLPATASAPGSTGSGMGMGPGIPDLGGGLSGLG

SEQ ID NO: 1232587 - protein, 14 aa, Mycobacterium
VEAPEGAERAAARE

SEQ ID NO: 1232588 - protein, 10 aa, Mycobacterium
VEAQQQSGGR

SEQ ID NO: 1232589 - protein, 13 aa, Mycobacterium
VEATDEPWHGRPA

SEQ ID NO: 1232590 - protein, 8 aa, Mycobacterium
VEATGNPL

SEQ ID NO: 1232591 - protein, 10 aa, Mycobacterium
VEATGTPGKI

SEQ ID NO: 1232592 - protein, 5 aa, Mycobacterium
VEDAA

SEQ ID NO: 1232593 - protein, 7 aa, Mycobacterium
VEDAEAA

SEQ ID NO: 1232594 - protein, 9 aa, Mycobacterium
VEDAPPAEL

SEQ ID NO: 1232595 - protein, 12 aa, Mycobacterium
VEDASTADPSGL

SEQ ID NO: 1232596 - protein, 6 aa, Mycobacterium
VEDDHR

SEQ ID NO: 1232597 - protein, 5 aa, Mycobacterium
VEDGR

SEQ ID NO: 1232598 - protein, 9 aa, Mycobacterium
VEDGTMPRP

SEQ ID NO: 1232599 - protein, 4 aa, Mycobacterium
VEDH

SEQ ID NO: 1232600 - protein, 4 aa, Mycobacterium
VEDP

SEQ ID NO: 1232601 - protein, 8 aa, Mycobacterium
VEDPADVR

SEQ ID NO: 1232602 - protein, 11 aa, Mycobacterium
VEDPDTQAHSI

SEQ ID NO: 1232603 - protein, 7 aa, Mycobacterium
VEDRDAL

SEQ ID NO: 1232604 - protein, 6 aa, Mycobacterium
VEDRPW

SEQ ID NO: 1232605 - protein, 6 aa, Mycobacterium
VEDSDE

SEQ ID NO: 1232606 - protein, 13 aa, Mycobacterium
VEDTSAEQIAADA

SEQ ID NO: 1232607 - protein, 8 aa, Mycobacterium
VEEARDAG

SEQ ID NO: 1232608 - protein, 40 aa, Mycobacterium
VEEEPALAQEQALTDTELTDDEPSSPAPTDEANDPDSETN

SEQ ID NO: 1232609 - protein, 12 aa, Mycobacterium
VEEPDGTRRQLE

SEQ ID NO: 1232610 - protein, 11 aa, Mycobacterium
VEEPGEPNAET

SEQ ID NO: 1232611 - protein, 12 aa, Mycobacterium
VEEPSGAPEFEA

SEQ ID NO: 1232612 - protein, 4 aa, Mycobacterium
VEER

SEQ ID NO: 1232613 - protein, 8 aa, Mycobacterium
VEERTRAQ

SEQ ID NO: 1232614 - protein, 5 aa, Mycobacterium
VEESE

SEQ ID NO: 1232615 - protein, 10 aa, Mycobacterium
VEESFPASDS

SEQ ID NO: 1232616 - protein, 7 aa, Mycobacterium
VEESRRQ

SEQ ID NO: 1232617 - protein, 21 aa, Mycobacterium
VEETDDAAEVTAPAEESVEVD

SEQ ID NO: 1232618 - protein, 7 aa, Mycobacterium
VEGAGEV

SEQ ID NO: 1232619 - protein, 8 aa, Mycobacterium
VEGEADTD

SEQ ID NO: 1232620 - protein, 7 aa, Mycobacterium
VEGGAPE

SEQ ID NO: 1232621 - protein, 11 aa, Mycobacterium
VEGGDADSWVS

SEQ ID NO: 1232622 - protein, 8 aa, Mycobacterium
VEGGDART

SEQ ID NO: 1232623 - protein, 6 aa, Mycobacterium
VEGGFG

SEQ ID NO: 1232624 - protein, 12 aa, Mycobacterium
VEGGGFKSALGA

SEQ ID NO: 1232625 - protein, 11 aa, Mycobacterium
VEGGNKELEAL

SEQ ID NO: 1232626 - protein, 21 aa, Mycobacterium
VEGGNKELEDLRKKNAEHPIE

SEQ ID NO: 1232627 - protein, 5 aa, Mycobacterium
VEGGS

SEQ ID NO: 1232628 - protein, 11 aa, Mycobacterium
VEGKSQDGKPT

SEQ ID NO: 1232629 - protein, 6 aa, Mycobacterium
VEGPEN

SEQ ID NO: 1232630 - protein, 15 aa, Mycobacterium
VEGPESLPPVQGDTA

SEQ ID NO: 1232631 - protein, 7 aa, Mycobacterium
VEGPGLQ

SEQ ID NO: 1232632 - protein, 11 aa, Mycobacterium
VEGPKAGNPIY

SEQ ID NO: 1232633 - protein, 9 aa, Mycobacterium
VEGPSDDPE

SEQ ID NO: 1232634 - protein, 8 aa, Mycobacterium
VEGPTDDE

SEQ ID NO: 1232635 - protein, 7 aa, Mycobacterium
VEGPTRG

SEQ ID NO: 1232636 - protein, 7 aa, Mycobacterium
VEGQRMS

SEQ ID NO: 1232637 - protein, 6 aa, Mycobacterium
VEGQRT

SEQ ID NO: 1232638 - protein, 6 aa, Mycobacterium
VEGRPG

SEQ ID NO: 1232639 - protein, 5 aa, Mycobacterium
VEGSG

SEQ ID NO: 1232640 - protein, 16 aa, Mycobacterium
VEGTPYKEATATQLAE

SEQ ID NO: 1232641 - protein, 7 aa, Mycobacterium
VEGTSME

SEQ ID NO: 1232642 - protein, 4 aa, Mycobacterium
VEGW

SEQ ID NO: 1232643 - protein, 7 aa, Mycobacterium
VEHDGRR

SEQ ID NO: 1232644 - protein, 10 aa, Mycobacterium
VEHDSSGRVE

SEQ ID NO: 1232645 - protein, 8 aa, Mycobacterium
VEHEPGTR

SEQ ID NO: 1232646 - protein, 13 aa, Mycobacterium
VEHGRSDSGVTEN

SEQ ID NO: 1232647 - protein, 14 aa, Mycobacterium
VEHPPSCSGDTNPL

SEQ ID NO: 1232648 - protein, 8 aa, Mycobacterium
VEKAADDL

SEQ ID NO: 1232649 - protein, 27 aa, Mycobacterium
VEKRSSHKESHGGRKQASRLAKKSGTI

SEQ ID NO: 1232650 - protein, 7 aa, Mycobacterium
VEKSGAV

SEQ ID NO: 1232651 - protein, 8 aa, Mycobacterium
VEKTEYDL

SEQ ID NO: 1232652 - protein, 12 aa, Mycobacterium
VEKTGRKAYTAE

SEQ ID NO: 1232653 - protein, 10 aa, Mycobacterium
VELPADADGE

SEQ ID NO: 1232654 - protein, 9 aa, Mycobacterium
VELTPAGAA

SEQ ID NO: 1232655 - protein, 9 aa, Mycobacterium
VELTSRRGR

SEQ ID NO: 1232656 - protein, 4 aa, Mycobacterium
VENG

SEQ ID NO: 1232657 - protein, 15 aa, Mycobacterium
VENGKVTAERETDDG

SEQ ID NO: 1232658 - protein, 10 aa, Mycobacterium
VENGLAPAEV

SEQ ID NO: 1232659 - protein, 5 aa, Mycobacterium
VENGR

SEQ ID NO: 1232660 - protein, 5 aa, Mycobacterium
VENGS

SEQ ID NO: 1232661 - protein, 8 aa, Mycobacterium
VENPAGKI

SEQ ID NO: 1232662 - protein, 6 aa, Mycobacterium
VENQGR

SEQ ID NO: 1232663 - protein, 8 aa, Mycobacterium
VENRPADE

SEQ ID NO: 1232664 - protein, 10 aa, Mycobacterium
VEPAGPDSVR

SEQ ID NO: 1232665 - protein, 5 aa, Mycobacterium
VEPDD

SEQ ID NO: 1232666 - protein, 8 aa, Mycobacterium
VEPDDAAT

SEQ ID NO: 1232667 - protein, 20 aa, Mycobacterium
VEPDDGLDAQSGVVQATDDP

SEQ ID NO: 1232668 - protein, 8 aa, Mycobacterium
VEPDPVPV

SEQ ID NO: 1232669 - protein, 4 aa, Mycobacterium
VEPE

SEQ ID NO: 1232670 - protein, 5 aa, Mycobacterium
VEPEA

SEQ ID NO: 1232671 - protein, 8 aa, Mycobacterium
VEPEGSQR

SEQ ID NO: 1232672 - protein, 9 aa, Mycobacterium
VEPEGTGTR

SEQ ID NO: 1232673 - protein, 18 aa, Mycobacterium
VEPFTGGDPIDEEDTIPR

SEQ ID NO: 1232674 - protein, 7 aa, Mycobacterium
VEPGGAA

SEQ ID NO: 1232675 - protein, 7 aa, Mycobacterium
VEPGGAV

SEQ ID NO: 1232676 - protein, 6 aa, Mycobacterium
VEPGTD

SEQ ID NO: 1232677 - protein, 6 aa, Mycobacterium
VEPGTP

SEQ ID NO: 1232678 - protein, 7 aa, Mycobacterium
VEPKEGE

SEQ ID NO: 1232679 - protein, 9 aa, Mycobacterium
VEPLTGGSQ

SEQ ID NO: 1232680 - protein, 6 aa, Mycobacterium
VEPNER

SEQ ID NO: 1232681 - protein, 18 aa, Mycobacterium
VEPPGCAPPRVGPGPEHA

SEQ ID NO: 1232682 - protein, 10 aa, Mycobacterium
VEPPQGDNAR

SEQ ID NO: 1232683 - protein, 17 aa, Mycobacterium
VEPQAGAPDTPEDLSGA

SEQ ID NO: 1232684 - protein, 8 aa, Mycobacterium
VEPRSGQE

SEQ ID NO: 1232685 - protein, 6 aa, Mycobacterium
VEPRTA

SEQ ID NO: 1232686 - protein, 13 aa, Mycobacterium
VEPRTAARRTLPG

SEQ ID NO: 1232687 - protein, 5 aa, Mycobacterium
VEPTA

SEQ ID NO: 1232688 - protein, 7 aa, Mycobacterium
VEPTRAE

SEQ ID NO: 1232689 - protein, 6 aa, Mycobacterium
VEPYDT

SEQ ID NO: 1232690 - protein, 12 aa, Mycobacterium
VEQAADTATRAG

SEQ ID NO: 1232691 - protein, 7 aa, Mycobacterium
VEQAQDR

SEQ ID NO: 1232692 - protein, 8 aa, Mycobacterium
VEQEKNGI

SEQ ID NO: 1232693 - protein, 6 aa, Mycobacterium
VEQGNP

SEQ ID NO: 1232694 - protein, 7 aa, Mycobacterium
VEQGRTL

SEQ ID NO: 1232695 - protein, 5 aa, Mycobacterium
VEQGT

SEQ ID NO: 1232696 - protein, 11 aa, Mycobacterium
VEQIGTPTEIY

SEQ ID NO: 1232697 - protein, 10 aa, Mycobacterium
VEQKPYTRRP

SEQ ID NO: 1232698 - protein, 46 aa, Mycobacterium
VEQPRAASDRPRRRSTPQGHGERQGRPQGGGAGTRSRGPRRRPQAA

SEQ ID NO: 1232699 - protein, 27 aa, Mycobacterium
VEQRDGPWGDYSQAPPHRRPDPSHVIE

SEQ ID NO: 1232700 - protein, 10 aa, Mycobacterium
VEQRDPDRVA

SEQ ID NO: 1232701 - protein, 12 aa, Mycobacterium
VEQTSDDAAPVT

SEQ ID NO: 1232702 - protein, 4 aa, Mycobacterium
VEQW

SEQ ID NO: 1232703 - protein, 15 aa, Mycobacterium
VERDAGHRVLVYKPG

SEQ ID NO: 1232704 - protein, 13 aa, Mycobacterium
VERDGADLVVVVP

SEQ ID NO: 1232705 - protein, 12 aa, Mycobacterium
VERDLGDRYEPV

SEQ ID NO: 1232706 - protein, 11 aa, Mycobacterium
VEREDGTVDRL

SEQ ID NO: 1232707 - protein, 5 aa, Mycobacterium
VERGA

SEQ ID NO: 1232708 - protein, 9 aa, Mycobacterium
VERGQSVPS

SEQ ID NO: 1232709 - protein, 8 aa, Mycobacterium
VERGRSGL

SEQ ID NO: 1232710 - protein, 16 aa, Mycobacterium
VERGSQDSDWDPVKEA

SEQ ID NO: 1232711 - protein, 16 aa, Mycobacterium
VERIEPDRRRPGRPPQ

SEQ ID NO: 1232712 - protein, 6 aa, Mycobacterium
VERKEV

SEQ ID NO: 1232713 - protein, 5 aa, Mycobacterium
VERNA

SEQ ID NO: 1232714 - protein, 5 aa, Mycobacterium
VERPP

SEQ ID NO: 1232715 - protein, 12 aa, Mycobacterium
VERPQAHDEEAD

SEQ ID NO: 1232716 - protein, 10 aa, Mycobacterium
VERTATDEAF

SEQ ID NO: 1232717 - protein, 12 aa, Mycobacterium
VERTSKERGHDY

SEQ ID NO: 1232718 - protein, 4 aa, Mycobacterium
VESA

SEQ ID NO: 1232719 - protein, 9 aa, Mycobacterium
VESADDARL

SEQ ID NO: 1232720 - protein, 7 aa, Mycobacterium
VESDPDL

SEQ ID NO: 1232721 - protein, 17 aa, Mycobacterium
VESGDAGGTRLRWCAPL

SEQ ID NO: 1232722 - protein, 12 aa, Mycobacterium
VESGGRATDADI

SEQ ID NO: 1232723 - protein, 8 aa, Mycobacterium
VESGPARD

SEQ ID NO: 1232724 - protein, 7 aa, Mycobacterium
VESGRID

SEQ ID NO: 1232725 - protein, 8 aa, Mycobacterium
VESGSLGQ

SEQ ID NO: 1232726 - protein, 8 aa, Mycobacterium
VESNPKDY

SEQ ID NO: 1232727 - protein, 8 aa, Mycobacterium
VESPPELA

SEQ ID NO: 1232728 - protein, 9 aa, Mycobacterium
VESPPRPVT

SEQ ID NO: 1232729 - protein, 8 aa, Mycobacterium
VESRPRAG

SEQ ID NO: 1232730 - protein, 7 aa, Mycobacterium
VESSDKV

SEQ ID NO: 1232731 - protein, 8 aa, Mycobacterium
VESSGPDA

SEQ ID NO: 1232732 - protein, 4 aa, Mycobacterium
VEST

SEQ ID NO: 1232733 - protein, 19 aa, Mycobacterium
VESTDDERADTPASVPETE

SEQ ID NO: 1232734 - protein, 5 aa, Mycobacterium
VETAP

SEQ ID NO: 1232735 - protein, 10 aa, Mycobacterium
VETARRAQVS

SEQ ID NO: 1232736 - protein, 6 aa, Mycobacterium
VETELG

SEQ ID NO: 1232737 - protein, 5 aa, Mycobacterium
VETEV

SEQ ID NO: 1232738 - protein, 5 aa, Mycobacterium
VETGM

SEQ ID NO: 1232739 - protein, 8 aa, Mycobacterium
VETGPPEQ

SEQ ID NO: 1232740 - protein, 9 aa, Mycobacterium
VETNSEERM

SEQ ID NO: 1232741 - protein, 11 aa, Mycobacterium
VETPDAPTKDM

SEQ ID NO: 1232742 - protein, 6 aa, Mycobacterium
VETPSG

SEQ ID NO: 1232743 - protein, 16 aa, Mycobacterium
VETRSASTVPEGAHSD

SEQ ID NO: 1232744 - protein, 52 aa, Mycobacterium
VETSANTGPGQKPPPGGPPPDEPTPPDPDGPGGPPSPPPSPGRYQHIPVSVE

SEQ ID NO: 1232745 - protein, 8 aa, Mycobacterium
VETSLAPG

SEQ ID NO: 1232746 - protein, 7 aa, Mycobacterium
VETVTGE

SEQ ID NO: 1232747 - protein, 9 aa, Mycobacterium
VEVAPGEEG

SEQ ID NO: 1232748 - protein, 10 aa, Mycobacterium
VEVDDSAADR

SEQ ID NO: 1232749 - protein, 5 aa, Mycobacterium
VEVDG

SEQ ID NO: 1232750 - protein, 8 aa, Mycobacterium
VEVPPPPP

SEQ ID NO: 1232751 - protein, 8 aa, Mycobacterium
VEVPRGDV

SEQ ID NO: 1232752 - protein, 14 aa, Mycobacterium
VEVSDDSPELQQPE

SEQ ID NO: 1232753 - protein, 5 aa, Mycobacterium
VEVTA

SEQ ID NO: 1232754 - protein, 7 aa, Mycobacterium
VEYRDRQ

SEQ ID NO: 1232755 - protein, 5 aa, Mycobacterium
VEYRP

SEQ ID NO: 1232756 - protein, 9 aa, Mycobacterium
VFGRSGDDL

SEQ ID NO: 1232757 - protein, 18 aa, Mycobacterium
VFGTSPDSRLSSEDAAEL

SEQ ID NO: 1232758 - protein, 8 aa, Mycobacterium
VFNSPAGD

SEQ ID NO: 1232759 - protein, 6 aa, Mycobacterium
VFPPEE

SEQ ID NO: 1232760 - protein, 9 aa, Mycobacterium
VFSTGADMN

SEQ ID NO: 1232761 - protein, 7 aa, Mycobacterium
VFTSPAA

SEQ ID NO: 1232762 - protein, 8 aa, Mycobacterium
VGAAEQTR

SEQ ID NO: 1232763 - protein, 13 aa, Mycobacterium
VGAAPGRFRARPG

SEQ ID NO: 1232764 - protein, 10 aa, Mycobacterium
VGAAPLPDGV

SEQ ID NO: 1232765 - protein, 14 aa, Mycobacterium
VGAAPNTAPESVDL

SEQ ID NO: 1232766 - protein, 7 aa, Mycobacterium
VGAAREA

SEQ ID NO: 1232767 - protein, 8 aa, Mycobacterium
VGADGDIS

SEQ ID NO: 1232768 - protein, 12 aa, Mycobacterium
VGADPSLADRQP

SEQ ID NO: 1232769 - protein, 5 aa, Mycobacterium
VGAED

SEQ ID NO: 1232770 - protein, 13 aa, Mycobacterium
VGAEGIDSGPGTG

SEQ ID NO: 1232771 - protein, 11 aa, Mycobacterium
VGAEPRPLPHA

SEQ ID NO: 1232772 - protein, 6 aa, Mycobacterium
VGAGER

SEQ ID NO: 1232773 - protein, 8 aa, Mycobacterium
VGAGPLDT

SEQ ID NO: 1232774 - protein, 9 aa, Mycobacterium
VGAGSGKQV

SEQ ID NO: 1232775 - protein, 9 aa, Mycobacterium
VGAHPRDHR

SEQ ID NO: 1232776 - protein, 7 aa, Mycobacterium
VGANPRE

SEQ ID NO: 1232777 - protein, 6 aa, Mycobacterium
VGAPAA

SEQ ID NO: 1232778 - protein, 7 aa, Mycobacterium
VGAPDNM

SEQ ID NO: 1232779 - protein, 6 aa, Mycobacterium
VGAPEG

SEQ ID NO: 1232780 - protein, 10 aa, Mycobacterium
VGAPGAATAL

SEQ ID NO: 1232781 - protein, 11 aa, Mycobacterium
VGAPPDSKPAV

SEQ ID NO: 1232782 - protein, 10 aa, Mycobacterium
VGARGLGDGY

SEQ ID NO: 1232783 - protein, 16 aa, Mycobacterium
VGARVPKADLDQRDAD

SEQ ID NO: 1232784 - protein, 7 aa, Mycobacterium
VGASDTG

SEQ ID NO: 1232785 - protein, 5 aa, Mycobacterium
VGASE

SEQ ID NO: 1232786 - protein, 6 aa, Mycobacterium
VGASVG

SEQ ID NO: 1232787 - protein, 7 aa, Mycobacterium
VGATAGT

SEQ ID NO: 1232788 - protein, 11 aa, Mycobacterium
VGATDPEGDEL

SEQ ID NO: 1232789 - protein, 6 aa, Mycobacterium
VGATHD

SEQ ID NO: 1232790 - protein, 8 aa, Mycobacterium
VGDADDAL

SEQ ID NO: 1232791 - protein, 7 aa, Mycobacterium
VGDAEPR

SEQ ID NO: 1232792 - protein, 7 aa, Mycobacterium
VGDDEAV

SEQ ID NO: 1232793 - protein, 6 aa, Mycobacterium
VGDDEL

SEQ ID NO: 1232794 - protein, 10 aa, Mycobacterium
VGDDGDSGFR

SEQ ID NO: 1232795 - protein, 12 aa, Mycobacterium
VGDDIDGDADQV

SEQ ID NO: 1232796 - protein, 14 aa, Mycobacterium
VGDDPEAVAANRRR

SEQ ID NO: 1232797 - protein, 7 aa, Mycobacterium
VGDDPFG

SEQ ID NO: 1232798 - protein, 7 aa, Mycobacterium
VGDEGAG

SEQ ID NO: 1232799 - protein, 17 aa, Mycobacterium
VGDEPPARRPLIIDRIT

SEQ ID NO: 1232800 - protein, 7 aa, Mycobacterium
VGDESAV

SEQ ID NO: 1232801 - protein, 4 aa, Mycobacterium
VGDG

SEQ ID NO: 1232802 - protein, 15 aa, Mycobacterium
VGDGDTGPNTGGMGA

SEQ ID NO: 1232803 - protein, 5 aa, Mycobacterium
VGDGP

SEQ ID NO: 1232804 - protein, 8 aa, Mycobacterium
VGDGSGRL

SEQ ID NO: 1232805 - protein, 5 aa, Mycobacterium
VGDHD

SEQ ID NO: 1232806 - protein, 14 aa, Mycobacterium
VGDKTRDATHGQSV

SEQ ID NO: 1232807 - protein, 4 aa, Mycobacterium
VGDP

SEQ ID NO: 1232808 - protein, 12 aa, Mycobacterium
VGDPADRSTDIG

SEQ ID NO: 1232809 - protein, 17 aa, Mycobacterium
VGDPAHAVGAEQSSHAD

SEQ ID NO: 1232810 - protein, 8 aa, Mycobacterium
VGDPALSS

SEQ ID NO: 1232811 - protein, 5 aa, Mycobacterium
VGDPD

SEQ ID NO: 1232812 - protein, 6 aa, Mycobacterium
VGDPDR

SEQ ID NO: 1232813 - protein, 14 aa, Mycobacterium
VGDPFDPATAAAAM

SEQ ID NO: 1232814 - protein, 10 aa, Mycobacterium
VGDPTPGTGV

SEQ ID NO: 1232815 - protein, 11 aa, Mycobacterium
VGDQGGDIART

SEQ ID NO: 1232816 - protein, 6 aa, Mycobacterium
VGDQRQ

SEQ ID NO: 1232817 - protein, 10 aa, Mycobacterium
VGDQSSNIGR

SEQ ID NO: 1232818 - protein, 10 aa, Mycobacterium
VGDRDAADAL

SEQ ID NO: 1232819 - protein, 7 aa, Mycobacterium
VGEAPGA

SEQ ID NO: 1232820 - protein, 11 aa, Mycobacterium
VGEAVGTSTAA

SEQ ID NO: 1232821 - protein, 4 aa, Mycobacterium
VGED

SEQ ID NO: 1232822 - protein, 7 aa, Mycobacterium
VGEEGKG

SEQ ID NO: 1232823 - protein, 51 aa, Mycobacterium
VGEELDDEDFEDAEDAEDSDDSDEDEDEDSDDSDEDEIDLDNDDDEEDDDI

SEQ ID NO: 1232824 - protein, 8 aa, Mycobacterium
VGEENQGW

SEQ ID NO: 1232825 - protein, 9 aa, Mycobacterium
VGEETANRL

SEQ ID NO: 1232826 - protein, 4 aa, Mycobacterium
VGEG

SEQ ID NO: 1232827 - protein, 18 aa, Mycobacterium
VGEGAPGRRSRARNRTGT

SEQ ID NO: 1232828 - protein, 5 aa, Mycobacterium
VGEGD

SEQ ID NO: 1232829 - protein, 12 aa, Mycobacterium
VGEGDEGPQEVR

SEQ ID NO: 1232830 - protein, 5 aa, Mycobacterium
VGEGQ

SEQ ID NO: 1232831 - protein, 6 aa, Mycobacterium
VGEGRD

SEQ ID NO: 1232832 - protein, 13 aa, Mycobacterium
VGEIDPDRTAADE

SEQ ID NO: 1232833 - protein, 12 aa, Mycobacterium
VGEIQESDLPGY

SEQ ID NO: 1232834 - protein, 8 aa, Mycobacterium
VGEKGPTA

SEQ ID NO: 1232835 - protein, 9 aa, Mycobacterium
VGELDDAGN

SEQ ID NO: 1232836 - protein, 10 aa, Mycobacterium
VGELDEGEVG

SEQ ID NO: 1232837 - protein, 8 aa, Mycobacterium
VGENDAAV

SEQ ID NO: 1232838 - protein, 10 aa, Mycobacterium
VGEPDGDAQS

SEQ ID NO: 1232839 - protein, 9 aa, Mycobacterium
VGEPDQVTG

SEQ ID NO: 1232840 - protein, 13 aa, Mycobacterium
VGEPEPAGRPDAA

SEQ ID NO: 1232841 - protein, 6 aa, Mycobacterium
VGEPGA

SEQ ID NO: 1232842 - protein, 16 aa, Mycobacterium
VGEPPDDAAALTQWPQ

SEQ ID NO: 1232843 - protein, 6 aa, Mycobacterium
VGERGS

SEQ ID NO: 1232844 - protein, 23 aa, Mycobacterium
VGESAASYAGGDAMAASSYLIAR

SEQ ID NO: 1232845 - protein, 16 aa, Mycobacterium
VGESAAVGTAEQTPDI

SEQ ID NO: 1232846 - protein, 7 aa, Mycobacterium
VGESEPR

SEQ ID NO: 1232847 - protein, 10 aa, Mycobacterium
VGESGPRVGV

SEQ ID NO: 1232848 - protein, 14 aa, Mycobacterium
VGESRSYTVPSGNT

SEQ ID NO: 1232849 - protein, 4 aa, Mycobacterium
VGET

SEQ ID NO: 1232850 - protein, 5 aa, Mycobacterium
VGGAE

SEQ ID NO: 1232851 - protein, 8 aa, Mycobacterium
VGGAGKTR

SEQ ID NO: 1232852 - protein, 11 aa, Mycobacterium
VGGANTTPRTA

SEQ ID NO: 1232853 - protein, 11 aa, Mycobacterium
VGGAPQTGKST

SEQ ID NO: 1232854 - protein, 6 aa, Mycobacterium
VGGATL

SEQ ID NO: 1232855 - protein, 6 aa, Mycobacterium
VGGDAT

SEQ ID NO: 1232856 - protein, 11 aa, Mycobacterium
VGGDGLYSSNA

SEQ ID NO: 1232857 - protein, 11 aa, Mycobacterium
VGGDHNPIHTN

SEQ ID NO: 1232858 - protein, 6 aa, Mycobacterium
VGGDPA

SEQ ID NO: 1232859 - protein, 7 aa, Mycobacterium
VGGDPTV

SEQ ID NO: 1232860 - protein, 6 aa, Mycobacterium
VGGDPV

SEQ ID NO: 1232861 - protein, 10 aa, Mycobacterium
VGGDVSEPAL

SEQ ID NO: 1232862 - protein, 8 aa, Mycobacterium
VGGESARS

SEQ ID NO: 1232863 - protein, 8 aa, Mycobacterium
VGGEVGRY

SEQ ID NO: 1232864 - protein, 4 aa, Mycobacterium
VGGG

SEQ ID NO: 1232865 - protein, 9 aa, Mycobacterium
VGGGAVGEE

SEQ ID NO: 1232866 - protein, 11 aa, Mycobacterium
VGGGDAAPVRA

SEQ ID NO: 1232867 - protein, 8 aa, Mycobacterium
VGGGDDPV

SEQ ID NO: 1232868 - protein, 10 aa, Mycobacterium
VGGGDGTVAT

SEQ ID NO: 1232869 - protein, 10 aa, Mycobacterium
VGGGGAETGF

SEQ ID NO: 1232870 - protein, 12 aa, Mycobacterium
VGGGGGIGGTTL

SEQ ID NO: 1232871 - protein, 10 aa, Mycobacterium
VGGGIDSKLE

SEQ ID NO: 1232872 - protein, 12 aa, Mycobacterium
VGGGPEAAARAA

SEQ ID NO: 1232873 - protein, 10 aa, Mycobacterium
VGGGSTTGLA

SEQ ID NO: 1232874 - protein, 8 aa, Mycobacterium
VGGGTNHR

SEQ ID NO: 1232875 - protein, 12 aa, Mycobacterium
VGGGYSDGGQHS

SEQ ID NO: 1232876 - protein, 6 aa, Mycobacterium
VGGKPY

SEQ ID NO: 1232877 - protein, 10 aa, Mycobacterium
VGGKRDAQGN

SEQ ID NO: 1232878 - protein, 5 aa, Mycobacterium
VGGLP

SEQ ID NO: 1232879 - protein, 6 aa, Mycobacterium
VGGLQG

SEQ ID NO: 1232880 - protein, 6 aa, Mycobacterium
VGGPDT

SEQ ID NO: 1232881 - protein, 30 aa, Mycobacterium; identical to SEQ ID NO: 607908

SEQ ID NO: 1232882 - protein, 8 aa, Mycobacterium
VGGPSENA

SEQ ID NO: 1232883 - protein, 8 aa, Mycobacterium
VGGQEAGL

SEQ ID NO: 1232884 - protein, 10 aa, Mycobacterium
VGGQGPQKLV

SEQ ID NO: 1232885 - protein, 9 aa, Mycobacterium
VGGQPFTEE

SEQ ID NO: 1232886 - protein, 6 aa, Mycobacterium
VGGQRA

SEQ ID NO: 1232887 - protein, 8 aa, Mycobacterium
VGGQRRPF

SEQ ID NO: 1232888 - protein, 6 aa, Mycobacterium
VGGQST

SEQ ID NO: 1232889 - protein, 12 aa, Mycobacterium
VGGRKIGRNELP

SEQ ID NO: 1232890 - protein, 11 aa, Mycobacterium
VGGRPTAMNSR

SEQ ID NO: 1232891 - protein, 13 aa, Mycobacterium
VGGRVDDPPGSGR

SEQ ID NO: 1232892 - protein, 10 aa, Mycobacterium
VGGSAGAAAR

SEQ ID NO: 1232893 - protein, 18 aa, Mycobacterium
VGGSATRRAVAPASPAVP

SEQ ID NO: 1232894 - protein, 22 aa, Mycobacterium
VGGSEADAKLAEASAAIARLVR

SEQ ID NO: 1232895 - protein, 5 aa, Mycobacterium
VGGSL

SEQ ID NO: 1232896 - protein, 6 aa, Mycobacterium
VGGSRT

SEQ ID NO: 1232897 - protein, 8 aa, Mycobacterium
VGGSSGAL

SEQ ID NO: 1232898 - protein, 9 aa, Mycobacterium
VGGSTPDGR

SEQ ID NO: 1232899 - protein, 8 aa, Mycobacterium
VGGTEIKR

SEQ ID NO: 1232900 - protein, 11 aa, Mycobacterium
VGGTGRPDGLD

SEQ ID NO: 1232901 - protein, 8 aa, Mycobacterium
VGGTGTPI

SEQ ID NO: 1232902 - protein, 8 aa, Mycobacterium
VGGTPQSE

SEQ ID NO: 1232903 - protein, 32 aa, Mycobacterium
VGGTVGDVGDTVGGTVSGTVRGTGKGLRSARR

SEQ ID NO: 1232904 - protein, 5 aa, Mycobacterium
VGGVP

SEQ ID NO: 1232905 - protein, 6 aa, Mycobacterium
VGGVRT

SEQ ID NO: 1232906 - protein, 5 aa, Mycobacterium
VGHAK

SEQ ID NO: 1232907 - protein, 12 aa, Mycobacterium
VGHGGDGPARGR

SEQ ID NO: 1232908 - protein, 8 aa, Mycobacterium
VGHGGRVG

SEQ ID NO: 1232909 - protein, 6 aa, Mycobacterium
VGHPDR

SEQ ID NO: 1232910 - protein, 62 aa, Mycobacterium
VGKATVAEKQRQQAVAKSEDLAKKAAAAEKKLNSARDAGDTKAVASAEKELERVRDQQARTT

SEQ ID NO: 1232911 - protein, 9 aa, Mycobacterium
VGKDGSPLS

SEQ ID NO: 1232912 - protein, 8 aa, Mycobacterium
VGKDGTKR

SEQ ID NO: 1232913 - protein, 6 aa, Mycobacterium
VGKDNP

SEQ ID NO: 1232914 - protein, 4 aa, Mycobacterium
VGKG

SEQ ID NO: 1232915 - protein, 8 aa, Mycobacterium
VGKGDPQV

SEQ ID NO: 1232916 - protein, 10 aa, Mycobacterium
VGKPDRPLTV

SEQ ID NO: 1232917 - protein, 5 aa, Mycobacterium
VGKRG

SEQ ID NO: 1232918 - protein, 4 aa, Mycobacterium
VGKT

SEQ ID NO: 1232919 - protein, 18 aa, Mycobacterium
VGKTPSETAKLAREILAG

SEQ ID NO: 1232920 - protein, 10 aa, Mycobacterium
VGLGGDPRRV

SEQ ID NO: 1232921 - protein, 9 aa, Mycobacterium
VGLPGSVPD

SEQ ID NO: 1232922 - protein, 17 aa, Mycobacterium
VGLPTGRRRRTAGLRRE

SEQ ID NO: 1232923 - protein, 19 aa, Mycobacterium
VGLTEANSAEFDPATPDPV

SEQ ID NO: 1232924 - protein, 7 aa, Mycobacterium
VGMDDPD

SEQ ID NO: 1232925 - protein, 4 aa, Mycobacterium
VGNA

SEQ ID NO: 1232926 - protein, 13 aa, Mycobacterium
VGNDAKVADVEFV

SEQ ID NO: 1232927 - protein, 8 aa, Mycobacterium
VGNSAPAV

SEQ ID NO: 1232928 - protein, 13 aa, Mycobacterium
VGNSTGSSGLDTN

SEQ ID NO: 1232929 - protein, 18 aa, Mycobacterium
VGNTPGQPVKAGSMGRPM

SEQ ID NO: 1232930 - protein, 17 aa, Mycobacterium
VGPAAPPQSTSSEESLN

SEQ ID NO: 1232931 - protein, 7 aa, Mycobacterium
VGPAGDY

SEQ ID NO: 1232932 - protein, 9 aa, Mycobacterium
VGPASSIDK

SEQ ID NO: 1232933 - protein, 15 aa, Mycobacterium
VGPATAAALRLRLVD

SEQ ID NO: 1232934 - protein, 12 aa, Mycobacterium
VGPATARAIARA

SEQ ID NO: 1232935 - protein, 7 aa, Mycobacterium
VGPDDAV

SEQ ID NO: 1232936 - protein, 9 aa, Mycobacterium
VGPDDQVTD

SEQ ID NO: 1232937 - protein, 10 aa, Mycobacterium
VGPDGDVEVS

SEQ ID NO: 1232938 - protein, 6 aa, Mycobacterium
VGPDGG

SEQ ID NO: 1232939 - protein, 6 aa, Mycobacterium
VGPDGT

SEQ ID NO: 1232940 - protein, 6 aa, Mycobacterium
VGPDKV

SEQ ID NO: 1232941 - protein, 10 aa, Mycobacterium
VGPDPDPRTL

SEQ ID NO: 1232942 - protein, 7 aa, Mycobacterium
VGPEEGF

SEQ ID NO: 1232943 - protein, 8 aa, Mycobacterium
VGPEEGYT

SEQ ID NO: 1232944 - protein, 10 aa, Mycobacterium
VGPGAQPGID

SEQ ID NO: 1232945 - protein, 6 aa, Mycobacterium
VGPGEA

SEQ ID NO: 1232946 - protein, 5 aa, Mycobacterium
VGPGL

SEQ ID NO: 1232947 - protein, 5 aa, Mycobacterium
VGPGQ

SEQ ID NO: 1232948 - protein, 5 aa, Mycobacterium
VGPGR

SEQ ID NO: 1232949 - protein, 17 aa, Mycobacterium
VGPGRDQTIVRRDVLAA

SEQ ID NO: 1232950 - protein, 6 aa, Mycobacterium
VGPGSW

SEQ ID NO: 1232951 - protein, 11 aa, Mycobacterium
VGPGTSQPGYY

SEQ ID NO: 1232952 - protein, 11 aa, Mycobacterium
VGPGVEGLEPG

SEQ ID NO: 1232953 - protein, 4 aa, Mycobacterium
VGPP

SEQ ID NO: 1232954 - protein, 12 aa, Mycobacterium
VGPPGNAALRDT

SEQ ID NO: 1232955 - protein, 9 aa, Mycobacterium
VGPPRVKDR

SEQ ID NO: 1232956 - protein, 21 aa, Mycobacterium
VGPQNPQRPPLARSSVTATPT

SEQ ID NO: 1232957 - protein, 12 aa, Mycobacterium
VGPRDTTDPAEW

SEQ ID NO: 1232958 - protein, 12 aa, Mycobacterium
VGPREEAAPYAA

SEQ ID NO: 1232959 - protein, 7 aa, Mycobacterium
VGPSPTH

SEQ ID NO: 1232960 - protein, 21 aa, Mycobacterium
VGPSWRKGPYTVPGRGPRDTY

SEQ ID NO: 1232961 - protein, 5 aa, Mycobacterium
VGPTP

SEQ ID NO: 1232962 - protein, 7 aa, Mycobacterium
VGPTYGT

SEQ ID NO: 1232963 - protein, 16 aa, Mycobacterium
VGQARSALEGTDDAPL

SEQ ID NO: 1232964 - protein, 7 aa, Mycobacterium
VGQDSLD

SEQ ID NO: 1232965 - protein, 8 aa, Mycobacterium
VGQPAREA

SEQ ID NO: 1232966 - protein, 6 aa, Mycobacterium
VGQPVP

SEQ ID NO: 1232967 - protein, 11 aa, Mycobacterium
VGQQAAQRNRE

SEQ ID NO: 1232968 - protein, 6 aa, Mycobacterium
VGQRSA

SEQ ID NO: 1232969 - protein, 10 aa, Mycobacterium
VGQSDAVDEP

SEQ ID NO: 1232970 - protein, 5 aa, Mycobacterium
VGQSE

SEQ ID NO: 1232971 - protein, 5 aa, Mycobacterium
VGQTA

SEQ ID NO: 1232972 - protein, 6 aa, Mycobacterium
VGRAYG

SEQ ID NO: 1232973 - protein, 13 aa, Mycobacterium
VGRDGEKALQQRA

SEQ ID NO: 1232974 - protein, 8 aa, Mycobacterium
VGRDPNKH

SEQ ID NO: 1232975 - protein, 8 aa, Mycobacterium
VGRDPQTI

SEQ ID NO: 1232976 - protein, 6 aa, Mycobacterium
VGRDTS

SEQ ID NO: 1232977 - protein, 4 aa, Mycobacterium
VGRE

SEQ ID NO: 1232978 - protein, 12 aa, Mycobacterium
VGRGAELDDEIA

SEQ ID NO: 1232979 - protein, 22 aa, Mycobacterium
VGRGEGRSGLAYDSAEPHDDVR

SEQ ID NO: 1232980 - protein, 8 aa, Mycobacterium
VGRGPYGA

SEQ ID NO: 1232981 - protein, 4 aa, Mycobacterium
VGRH

SEQ ID NO: 1232982 - protein, 4 aa, Mycobacterium
VGRP

SEQ ID NO: 1232983 - protein, 11 aa, Mycobacterium
VGRPDPRLGET

SEQ ID NO: 1232984 - protein, 6 aa, Mycobacterium
VGRPDT

SEQ ID NO: 1232985 - protein, 7 aa, Mycobacterium
VGRPPDV

SEQ ID NO: 1232986 - protein, 14 aa, Mycobacterium
VGRPTTADAGSGAR

SEQ ID NO: 1232987 - protein, 6 aa, Mycobacterium
VGRPVP

SEQ ID NO: 1232988 - protein, 16 aa, Mycobacterium
VGRPWQEPDEATESLG

SEQ ID NO: 1232989 - protein, 7 aa, Mycobacterium
VGRQDDG

SEQ ID NO: 1232990 - protein, 5 aa, Mycobacterium
VGRRD

SEQ ID NO: 1232991 - protein, 6 aa, Mycobacterium
VGRRSR

SEQ ID NO: 1232992 - protein, 14 aa, Mycobacterium
VGRSNGCSYADSPH

SEQ ID NO: 1232993 - protein, 8 aa, Mycobacterium
VGRSTADV

SEQ ID NO: 1232994 - protein, 17 aa, Mycobacterium
VGRSTGVADAQAVGADG

SEQ ID NO: 1232995 - protein, 13 aa, Mycobacterium
VGRTDLPGGSGRD

SEQ ID NO: 1232996 - protein, 8 aa, Mycobacterium
VGRTGAGE

SEQ ID NO: 1232997 - protein, 6 aa, Mycobacterium
VGRVDD

SEQ ID NO: 1232998 - protein, 6 aa, Mycobacterium
VGSAEE

SEQ ID NO: 1232999 - protein, 11 aa, Mycobacterium
VGSAGDPTARV

SEQ ID NO: 1233000 - protein, 21 aa, Mycobacterium
VGSDETGWTRSPAEHQNTSRK

SEQ ID NO: 1233001 - protein, 9 aa, Mycobacterium
VGSDGKLDS

SEQ ID NO: 1233002 - protein, 21 aa, Mycobacterium
VGSDVTAGESFGEVESTKSVS

SEQ ID NO: 1233003 - protein, 11 aa, Mycobacterium
VGSDYRGDPSA

SEQ ID NO: 1233004 - protein, 4 aa, Mycobacterium
VGSE

SEQ ID NO: 1233005 - protein, 5 aa, Mycobacterium
VGSER

SEQ ID NO: 1233006 - protein, 8 aa, Mycobacterium
VGSEVRPG

SEQ ID NO: 1233007 - protein, 7 aa, Mycobacterium
VGSGEPV

SEQ ID NO: 1233008 - protein, 10 aa, Mycobacterium
VGSGGGSGAI

SEQ ID NO: 1233009 - protein, 7 aa, Mycobacterium
VGSGPAT

SEQ ID NO: 1233010 - protein, 11 aa, Mycobacterium
VGSGSASIRTT

SEQ ID NO: 1233011 - protein, 8 aa, Mycobacterium
VGSGVGSG

SEQ ID NO: 1233012 - protein, 10 aa, Mycobacterium
VGSLAERRAR

SEQ ID NO: 1233013 - protein, 14 aa, Mycobacterium
VGSLAPADGSAVPA

SEQ ID NO: 1233014 - protein, 7 aa, Mycobacterium
VGSPGTV

SEQ ID NO: 1233015 - protein, 10 aa, Mycobacterium
VGSPTEAADQ

SEQ ID NO: 1233016 - protein, 8 aa, Mycobacterium
VGSSEAIS

SEQ ID NO: 1233017 - protein, 11 aa, Mycobacterium
VGSTADPSSFR

SEQ ID NO: 1233018 - protein, 5 aa, Mycobacterium
VGSTV

SEQ ID NO: 1233019 - protein, 14 aa, Mycobacterium
VGSTVTAAESNGKA

SEQ ID NO: 1233020 - protein, 7 aa, Mycobacterium
VGTADEV

SEQ ID NO: 1233021 - protein, 7 aa, Mycobacterium
VGTAERI

SEQ ID NO: 1233022 - protein, 6 aa, Mycobacterium
VGTAPG

SEQ ID NO: 1233023 - protein, 11 aa, Mycobacterium
VGTAPTSDPHR

SEQ ID NO: 1233024 - protein, 7 aa, Mycobacterium
VGTDERR

SEQ ID NO: 1233025 - protein, 6 aa, Mycobacterium
VGTDPR

SEQ ID NO: 1233026 - protein, 5 aa, Mycobacterium
VGTEN

SEQ ID NO: 1233027 - protein, 6 aa, Mycobacterium
VGTESY

SEQ ID NO: 1233028 - protein, 6 aa, Mycobacterium
VGTGAA

SEQ ID NO: 1233029 - protein, 14 aa, Mycobacterium
VGTGPSEQTRERGH

SEQ ID NO: 1233030 - protein, 17 aa, Mycobacterium
VGTGRTGLGPFKDRPAD

SEQ ID NO: 1233031 - protein, 5 aa, Mycobacterium
VGTGS

SEQ ID NO: 1233032 - protein, 12 aa, Mycobacterium
VGTIEPDAGALE

SEQ ID NO: 1233033 - protein, 9 aa, Mycobacterium
VGTIEPNSR

SEQ ID NO: 1233034 - protein, 17 aa, Mycobacterium
VGTLDDPRAKDDPQAAA

SEQ ID NO: 1233035 - protein, 5 aa, Mycobacterium
VGTNP

SEQ ID NO: 1233036 - protein, 12 aa, Mycobacterium
VGTNPTFSGRTR

SEQ ID NO: 1233037 - protein, 4 aa, Mycobacterium
VGTP

SEQ ID NO: 1233038 - protein, 7 aa, Mycobacterium
VGTPAEY

SEQ ID NO: 1233039 - protein, 11 aa, Mycobacterium
VGTPGDDTTSD

SEQ ID NO: 1233040 - protein, 11 aa, Mycobacterium
VGTPSDDATFT

SEQ ID NO: 1233041 - protein, 7 aa, Mycobacterium
VGTRADA

SEQ ID NO: 1233042 - protein, 10 aa, Mycobacterium
VGTRESEQLR

SEQ ID NO: 1233043 - protein, 13 aa, Mycobacterium
VGTRTGRNAAAHP

SEQ ID NO: 1233044 - protein, 5 aa, Mycobacterium
VGTSA

SEQ ID NO: 1233045 - protein, 12 aa, Mycobacterium
VGTSSLNSVRST

SEQ ID NO: 1233046 - protein, 4 aa, Mycobacterium
VGTT

SEQ ID NO: 1233047 - protein, 17 aa, Mycobacterium
VGTTSHTAATELGGSVP

SEQ ID NO: 1233048 - protein, 4 aa, Mycobacterium
VGTV

SEQ ID NO: 1233049 - protein, 14 aa, Mycobacterium
VGTYNQNDGAQDWQ

SEQ ID NO: 1233050 - protein, 4 aa, Mycobacterium
VGVD

SEQ ID NO: 1233051 - protein, 9 aa, Mycobacterium
VGVDGSDPY

SEQ ID NO: 1233052 - protein, 7 aa, Mycobacterium
VGVDPAD

SEQ ID NO: 1233053 - protein, 5 aa, Mycobacterium
VGVET

SEQ ID NO: 1233054 - protein, 5 aa, Mycobacterium
VGVGK

SEQ ID NO: 1233055 - protein, 7 aa, Mycobacterium
VGVGPGS

SEQ ID NO: 1233056 - protein, 4 aa, Mycobacterium
VGYD

SEQ ID NO: 1233057 - protein, 13 aa, Mycobacterium
VGYDGSGADGNGV

SEQ ID NO: 1233058 - protein, 9 aa, Mycobacterium
VGYTPYPES

SEQ ID NO: 1233059 - protein, 4 aa, Mycobacterium
VHAD

SEQ ID NO: 1233060 - protein, 19 aa, Mycobacterium
VHARGSSPSRSSARPRRNA

SEQ ID NO: 1233061 - protein, 5 aa, Mycobacterium
VHDEE

SEQ ID NO: 1233062 - protein, 7 aa, Mycobacterium
VHDPTTG

SEQ ID NO: 1233063 - protein, 5 aa, Mycobacterium
VHGEQ

SEQ ID NO: 1233064 - protein, 10 aa, Mycobacterium
VHGGGEPPHY

SEQ ID NO: 1233065 - protein, 12 aa, Mycobacterium
VHGGQTAIDPSM

SEQ ID NO: 1233066 - protein, 6 aa, Mycobacterium
VHGPAE

SEQ ID NO: 1233067 - protein, 6 aa, Mycobacterium
VHGPAG

SEQ ID NO: 1233068 - protein, 7 aa, Mycobacterium
VHPAPEP

SEQ ID NO: 1233069 - protein, 7 aa, Mycobacterium
VHPDRDE

SEQ ID NO: 1233070 - protein, 5 aa, Mycobacterium
VHPGD

SEQ ID NO: 1233071 - protein, 8 aa, Mycobacterium
VHPGPLGA

SEQ ID NO: 1233072 - protein, 8 aa, Mycobacterium
VHPQPGTA

SEQ ID NO: 1233073 - protein, 7 aa, Mycobacterium
VHPTPRR

SEQ ID NO: 1233074 - protein, 4 aa, Mycobacterium
VHRT

SEQ ID NO: 1233075 - protein, 15 aa, Mycobacterium
VHSEGGRLRSSSEHA

SEQ ID NO: 1233076 - protein, 18 aa, Mycobacterium
VHSESEGVEPSRRVVVLV

SEQ ID NO: 1233077 - protein, 11 aa, Mycobacterium
VHSGSPSAGAA

SEQ ID NO: 1233078 - protein, 11 aa, Mycobacterium
VHSPSSGPGTI

SEQ ID NO: 1233079 - protein, 7 aa, Mycobacterium
VIGRTPA

SEQ ID NO: 1233080 - protein, 7 aa, Mycobacterium
VIKSGGE

SEQ ID NO: 1233081 - protein, 7 aa, Mycobacterium
VKAESVD

SEQ ID NO: 1233082 - protein, 7 aa, Mycobacterium
VKAGERA

SEQ ID NO: 1233083 - protein, 12 aa, Mycobacterium
VKAGKMRVLAEW

SEQ ID NO: 1233084 - protein, 7 aa, Mycobacterium
VKAGPGA

SEQ ID NO: 1233085 - protein, 6 aa, Mycobacterium
VKAGRQ

SEQ ID NO: 1233086 - protein, 13 aa, Mycobacterium
VKAKERAAEQLEA

SEQ ID NO: 1233087 - protein, 8 aa, Mycobacterium
VKASEVSH

SEQ ID NO: 1233088 - protein, 13 aa, Mycobacterium
VKDDFEKDNYNRL

SEQ ID NO: 1233089 - protein, 20 aa, Mycobacterium
VKDERTATGVNALTYCFVKS

SEQ ID NO: 1233090 - protein, 6 aa, Mycobacterium
VKDGYG

SEQ ID NO: 1233091 - protein, 4 aa, Mycobacterium
VKEI

SEQ ID NO: 1233092 - protein, 9 aa, Mycobacterium
VKENAPAFR

SEQ ID NO: 1233093 - protein, 12 aa, Mycobacterium
VKEQAKRAPAPL

SEQ ID NO: 1233094 - protein, 14 aa, Mycobacterium
VKEQEKFPLADYAI

SEQ ID NO: 1233095 - protein, 10 aa, Mycobacterium
VKERAKASGL

SEQ ID NO: 1233096 - protein, 11 aa, Mycobacterium
VKERKGSVHTP

SEQ ID NO: 1233097 - protein, 4 aa, Mycobacterium
VKET

SEQ ID NO: 1233098 - protein, 5 aa, Mycobacterium
VKEVS

SEQ ID NO: 1233099 - protein, 12 aa, Mycobacterium
VKGATKGDYTQY

SEQ ID NO: 1233100 - protein, 6 aa, Mycobacterium
VKGDLG

SEQ ID NO: 1233101 - protein, 5 aa, Mycobacterium
VKGDN

SEQ ID NO: 1233102 - protein, 5 aa, Mycobacterium
VKGEN

SEQ ID NO: 1233103 - protein, 10 aa, Mycobacterium
VKGEPPPPTL

SEQ ID NO: 1233104 - protein, 9 aa, Mycobacterium
VKGGGGGVI

SEQ ID NO: 1233105 - protein, 16 aa, Mycobacterium
VKGGKAGARDRADDLA

SEQ ID NO: 1233106 - protein, 18 aa, Mycobacterium
VKGKAKEGVGTVTGRDDM

SEQ ID NO: 1233107 - protein, 8 aa, Mycobacterium
VKGPGAAE

SEQ ID NO: 1233108 - protein, 10 aa, Mycobacterium
VKGTGVGGRI

SEQ ID NO: 1233109 - protein, 6 aa, Mycobacterium
VKMDPQ

SEQ ID NO: 1233110 - protein, 20 aa, Mycobacterium
VKNGGAAPAPAAPPPPPPVQ

SEQ ID NO: 1233111 - protein, 14 aa, Mycobacterium
VKNGRSEEEGQAEA

SEQ ID NO: 1233112 - protein, 6 aa, Mycobacterium
VKPANS

SEQ ID NO: 1233113 - protein, 13 aa, Mycobacterium
VKPATLSGGQKQR

SEQ ID NO: 1233114 - protein, 6 aa, Mycobacterium
VKPDPA

SEQ ID NO: 1233115 - protein, 7 aa, Mycobacterium
VKPDQPH

SEQ ID NO: 1233116 - protein, 6 aa, Mycobacterium
VKPEQT

SEQ ID NO: 1233117 - protein, 13 aa, Mycobacterium
VKPTSVPAFRPGA

SEQ ID NO: 1233118 - protein, 19 aa, Mycobacterium
VKQDSYSKNRLGQGPTKYY

SEQ ID NO: 1233119 - protein, 12 aa, Mycobacterium
VKQKDKPLAQAR

SEQ ID NO: 1233120 - protein, 8 aa, Mycobacterium
VKQTGKQL

SEQ ID NO: 1233121 - protein, 8 aa, Mycobacterium
VKSDVTAA

SEQ ID NO: 1233122 - protein, 15 aa, Mycobacterium
VKSEPRPDPEPVRDP

SEQ ID NO: 1233123 - protein, 7 aa, Mycobacterium
VKSGETH

SEQ ID NO: 1233124 - protein, 10 aa, Mycobacterium
VKSGPSSPVR

SEQ ID NO: 1233125 - protein, 6 aa, Mycobacterium
VKSGRT

SEQ ID NO: 1233126 - protein, 8 aa, Mycobacterium
VKSGYSVP

SEQ ID NO: 1233127 - protein, 15 aa, Mycobacterium
VKSPADLDGLAASFR

SEQ ID NO: 1233128 - protein, 8 aa, Mycobacterium
VKSSGNQR

SEQ ID NO: 1233129 - protein, 7 aa, Mycobacterium
VKSTNGD

SEQ ID NO: 1233130 - protein, 9 aa, Mycobacterium
VKSTNSEAR

SEQ ID NO: 1233131 - protein, 4 aa, Mycobacterium
VKTA

SEQ ID NO: 1233132 - protein, 10 aa, Mycobacterium
VKTDTGGAPA

SEQ ID NO: 1233133 - protein, 7 aa, Mycobacterium
VKTESPP

SEQ ID NO: 1233134 - protein, 10 aa, Mycobacterium
VKTGATVEPR

SEQ ID NO: 1233135 - protein, 8 aa, Mycobacterium
VKTGKPYD

SEQ ID NO: 1233136 - protein, 4 aa, Mycobacterium
VKTP

SEQ ID NO: 1233137 - protein, 8 aa, Mycobacterium
VKTPTTAP

SEQ ID NO: 1233138 - protein, 9 aa, Mycobacterium
VKTVDGEFR

SEQ ID NO: 1233139 - protein, 7 aa, Mycobacterium
VKVGATD

SEQ ID NO: 1233140 - protein, 5 aa, Mycobacterium
VLAES

SEQ ID NO: 1233141 - protein, 8 aa, Mycobacterium
VLATDPDG

SEQ ID NO: 1233142 - protein, 8 aa, Mycobacterium
VLDTGSGR

SEQ ID NO: 1233143 - protein, 6 aa, Mycobacterium
VLGEGG

SEQ ID NO: 1233144 - protein, 7 aa, Mycobacterium
VLGSPGD

SEQ ID NO: 1233145 - protein, 8 aa, Mycobacterium
VLNPDEAV

SEQ ID NO: 1233146 - protein, 7 aa, Mycobacterium
VLPGGTG

SEQ ID NO: 1233147 - protein, 11 aa, Mycobacterium
VLPGSNPFGTG

SEQ ID NO: 1233148 - protein, 7 aa, Mycobacterium
VLPPGHD

SEQ ID NO: 1233149 - protein, 14 aa, Mycobacterium
VLPSSTNPTRPHTV

SEQ ID NO: 1233150 - protein, 10 aa, Mycobacterium
VLSAPAAGRL

SEQ ID NO: 1233151 - protein, 11 aa, Mycobacterium
VLSAPDGDRLD

SEQ ID NO: 1233152 - protein, 5 aa, Mycobacterium
VMPPR

SEQ ID NO: 1233153 - protein, 8 aa, Mycobacterium
VMPSSATG

SEQ ID NO: 1233154 - protein, 4 aa, Mycobacterium
VMTT

SEQ ID NO: 1233155 - protein, 24 aa, Mycobacterium
VNAATASRFNSDRERRYQGRFAAT

SEQ ID NO: 1233156 - protein, 11 aa, Mycobacterium
VNADASADIDD

SEQ ID NO: 1233157 - protein, 14 aa, Mycobacterium
VNAGPKKSLKTHDN

SEQ ID NO: 1233158 - protein, 7 aa, Mycobacterium
VNAPEYT

SEQ ID NO: 1233159 - protein, 20 aa, Mycobacterium
VNARRGDALTSIGGSPPDLH

SEQ ID NO: 1233160 - protein, 4 aa, Mycobacterium
VNAT

SEQ ID NO: 1233161 - protein, 13 aa, Mycobacterium
VNATERAEGQHLP

SEQ ID NO: 1233162 - protein, 9 aa, Mycobacterium
VNATGSPLM

SEQ ID NO: 1233163 - protein, 9 aa, Mycobacterium
VNDARSEAA

SEQ ID NO: 1233164 - protein, 5 aa, Mycobacterium
VNDKA

SEQ ID NO: 1233165 - protein, 10 aa, Mycobacterium
VNDREDSDAL

SEQ ID NO: 1233166 - protein, 5 aa, Mycobacterium
VNDRP

SEQ ID NO: 1233167 - protein, 10 aa, Mycobacterium
VNDSDGNAVT

SEQ ID NO: 1233168 - protein, 19 aa, Mycobacterium
VNEADDGTLRFRGEYLVSV

SEQ ID NO: 1233169 - protein, 6 aa, Mycobacterium
VNEGTL

SEQ ID NO: 1233170 - protein, 5 aa, Mycobacterium
VNEPQ

SEQ ID NO: 1233171 - protein, 26 aa, Mycobacterium
VNESAEAEAEQERGKRVGWACVSHGF

SEQ ID NO: 1233172 - protein, 10 aa, Mycobacterium
VNFSTDDDAL

SEQ ID NO: 1233173 - protein, 12 aa, Mycobacterium
VNGAPGAGRLPG

SEQ ID NO: 1233174 - protein, 9 aa, Mycobacterium
VNGDGPSYH

SEQ ID NO: 1233175 - protein, 4 aa, Mycobacterium
VNGG

SEQ ID NO: 1233176 - protein, 15 aa, Mycobacterium
VNGGPVEEAKKRPEF

SEQ ID NO: 1233177 - protein, 6 aa, Mycobacterium
VNGNEE

SEQ ID NO: 1233178 - protein, 6 aa, Mycobacterium
VNGNEV

SEQ ID NO: 1233179 - protein, 7 aa, Mycobacterium
VNGNGPR

SEQ ID NO: 1233180 - protein, 5 aa, Mycobacterium
VNGNP

SEQ ID NO: 1233181 - protein, 11 aa, Mycobacterium
VNGPEPEAAPL

SEQ ID NO: 1233182 - protein, 26 aa, Mycobacterium
VNGRQAKPSTMVSPGDEVRARVGETT

SEQ ID NO: 1233183 - protein, 10 aa, Mycobacterium
VNGRSRDRVD

SEQ ID NO: 1233184 - protein, 15 aa, Mycobacterium
VNGSSEIATGTGDFT

SEQ ID NO: 1233185 - protein, 14 aa, Mycobacterium
VNGVPARDERDRSA

SEQ ID NO: 1233186 - protein, 53 aa, Mycobacterium
VNKASRSGGGGGGFGGGGGGGNSRPAANSAPAEDPWGSAPASGSFGGADDEPP

SEQ ID NO: 1233187 - protein, 7 aa, Mycobacterium
VNKNGLP

SEQ ID NO: 1233188 - protein, 8 aa, Mycobacterium
VNNNGFDQ

SEQ ID NO: 1233189 - protein, 13 aa, Mycobacterium
VNNQTGAAQRGQF

SEQ ID NO: 1233190 - protein, 7 aa, Mycobacterium
VNPAPKA

SEQ ID NO: 1233191 - protein, 7 aa, Mycobacterium
VNPGDSV

SEQ ID NO: 1233192 - protein, 11 aa, Mycobacterium
VNPGGKAQVPH

SEQ ID NO: 1233193 - protein, 8 aa, Mycobacterium
VNPPGKGL

SEQ ID NO: 1233194 - protein, 6 aa, Mycobacterium
VNPPLR

SEQ ID NO: 1233195 - protein, 7 aa, Mycobacterium
VNPPRTL

SEQ ID NO: 1233196 - protein, 9 aa, Mycobacterium
VNPPTPHSS

SEQ ID NO: 1233197 - protein, 7 aa, Mycobacterium
VNPPVPP

SEQ ID NO: 1233198 - protein, 5 aa, Mycobacterium
VNPPW

SEQ ID NO: 1233199 - protein, 7 aa, Mycobacterium
VNPQTVG

SEQ ID NO: 1233200 - protein, 23 aa, Mycobacterium
VNPRAAAANPSASAAVARSGHPR

SEQ ID NO: 1233201 - protein, 6 aa, Mycobacterium
VNPSSR

SEQ ID NO: 1233202 - protein, 4 aa, Mycobacterium
VNPT

SEQ ID NO: 1233203 - protein, 6 aa, Mycobacterium
VNPTGA

SEQ ID NO: 1233204 - protein, 26 aa, Mycobacterium
VNPTNGRRTYSPKSAPPDADDTADVS

SEQ ID NO: 1233205 - protein, 7 aa, Mycobacterium
VNPTTRH

SEQ ID NO: 1233206 - protein, 7 aa, Mycobacterium
VNPYASP

SEQ ID NO: 1233207 - protein, 4 aa, Mycobacterium
VNQP

SEQ ID NO: 1233208 - protein, 17 aa, Mycobacterium
VNQPDADAADGEDSDAE

SEQ ID NO: 1233209 - protein, 5 aa, Mycobacterium
VNQSV

SEQ ID NO: 1233210 - protein, 7 aa, Mycobacterium
VNQYPPG

SEQ ID NO: 1233211 - protein, 8 aa, Mycobacterium
VNRDNPEP

SEQ ID NO: 1233212 - protein, 11 aa, Mycobacterium
VNREAGGPGSV

SEQ ID NO: 1233213 - protein, 8 aa, Mycobacterium
VNSDPPPL

SEQ ID NO: 1233214 - protein, 8 aa, Mycobacterium
VNSDSHAE

SEQ ID NO: 1233215 - protein, 10 aa, Mycobacterium
VNSGADEDEC

SEQ ID NO: 1233216 - protein, 6 aa, Mycobacterium
VNSGET

SEQ ID NO: 1233217 - protein, 8 aa, Mycobacterium
VNSGGYTT

SEQ ID NO: 1233218 - protein, 10 aa, Mycobacterium
VNSSEIPERD

SEQ ID NO: 1233219 - protein, 17 aa, Mycobacterium
VNSSPARFDQKKADALN

SEQ ID NO: 1233220 - protein, 10 aa, Mycobacterium
VNSSTRSARD

SEQ ID NO: 1233221 - protein, 4 aa, Mycobacterium
VNST

SEQ ID NO: 1233222 - protein, 7 aa, Mycobacterium
VNSTGRR

SEQ ID NO: 1233223 - protein, 8 aa, Mycobacterium
VNSTYGSS

SEQ ID NO: 1233224 - protein, 31 aa, Mycobacterium
VNSYKRTGAVATSSGASWAPRLPTYGGNDRT

SEQ ID NO: 1233225 - protein, 8 aa, Mycobacterium
VNTDAPDL

SEQ ID NO: 1233226 - protein, 12 aa, Mycobacterium
VNTDDNEGTPEK

SEQ ID NO: 1233227 - protein, 8 aa, Mycobacterium
VNTDPHPL

SEQ ID NO: 1233228 - protein, 5 aa, Mycobacterium
VNTKD

SEQ ID NO: 1233229 - protein, 11 aa, Mycobacterium
VNTPPQTTRAK

SEQ ID NO: 1233230 - protein, 8 aa, Mycobacterium
VNTTGDPM

SEQ ID NO: 1233231 - protein, 4 aa, Mycobacterium
VPAA

SEQ ID NO: 1233232 - protein, 5 aa, Mycobacterium
VPAAA

SEQ ID NO: 1233233 - protein, 12 aa, Mycobacterium
VPAAAGPVQPTL

SEQ ID NO: 1233234 - protein, 11 aa, Mycobacterium
VPAADNLPSRL

SEQ ID NO: 1233235 - protein, 12 aa, Mycobacterium
VPAAGAPEFTET

SEQ ID NO: 1233236 - protein, 12 aa, Mycobacterium
VPAAGPSKNGRR

SEQ ID NO: 1233237 - protein, 19 aa, Mycobacterium
VPAASIEQAGSQAGYPAAP

SEQ ID NO: 1233238 - protein, 8 aa, Mycobacterium
VPAASPRR

SEQ ID NO: 1233239 - protein, 8 aa, Mycobacterium
VPADATPA

SEQ ID NO: 1233240 - protein, 6 aa, Mycobacterium
VPADLP

SEQ ID NO: 1233241 - protein, 14 aa, Mycobacterium
VPADLQGSASYRRR

SEQ ID NO: 1233242 - protein, 12 aa, Mycobacterium
VPADQRANLLRR

SEQ ID NO: 1233243 - protein, 9 aa, Mycobacterium
VPAEPDELA

SEQ ID NO: 1233244 - protein, 8 aa, Mycobacterium
VPAGAHTR

SEQ ID NO: 1233245 - protein, 17 aa, Mycobacterium
VPAGEDEEIQSTQDKIG

SEQ ID NO: 1233246 - protein, 8 aa, Mycobacterium
VPAGGGKF

SEQ ID NO: 1233247 - protein, 10 aa, Mycobacterium
VPAGSESVAR

SEQ ID NO: 1233248 - protein, 5 aa, Mycobacterium
VPAGT

SEQ ID NO: 1233249 - protein, 14 aa, Mycobacterium
VPAKGKRGATADAA

SEQ ID NO: 1233250 - protein, 11 aa, Mycobacterium
VPAKSLDDPNV

SEQ ID NO: 1233251 - protein, 25 aa, Mycobacterium
VPANSNAAAAQDVAAGRADAGVSTA

SEQ ID NO: 1233252 - protein, 4 aa, Mycobacterium
VPAP

SEQ ID NO: 1233253 - protein, 7 aa, Mycobacterium
VPAPERG

SEQ ID NO: 1233254 - protein, 10 aa, Mycobacterium
VPAPGATIAE

SEQ ID NO: 1233255 - protein, 8 aa, Mycobacterium
VPAPGDPW

SEQ ID NO: 1233256 - protein, 5 aa, Mycobacterium
VPAPL

SEQ ID NO: 1233257 - protein, 11 aa, Mycobacterium
VPAPPSPLTPL

SEQ ID NO: 1233258 - protein, 47 aa, Mycobacterium
VPAPPTDPSGPSIPAPPTDPLGPSAPTAERSSAADGSSRERSSAAGL

SEQ ID NO: 1233259 - protein, 12 aa, Mycobacterium
VPAPTPKRRKVS

SEQ ID NO: 1233260 - protein, 15 aa, Mycobacterium
VPAQRARHGGRPHAH

SEQ ID NO: 1233261 - protein, 7 aa, Mycobacterium
VPARGRA

SEQ ID NO: 1233262 - protein, 5 aa, Mycobacterium
VPARP

SEQ ID NO: 1233263 - protein, 15 aa, Mycobacterium
VPASGASFPKAREDR

SEQ ID NO: 1233264 - protein, 9 aa, Mycobacterium
VPASPHTAD

SEQ ID NO: 1233265 - protein, 6 aa, Mycobacterium
VPATEA

SEQ ID NO: 1233266 - protein, 10 aa, Mycobacterium
VPATKGHTKR

SEQ ID NO: 1233267 - protein, 6 aa, Mycobacterium
VPATRS

SEQ ID NO: 1233268 - protein, 11 aa, Mycobacterium
VPATVSGGSAS

SEQ ID NO: 1233269 - protein, 4 aa, Mycobacterium
VPAV

SEQ ID NO: 1233270 - protein, 8 aa, Mycobacterium
VPAVSTAD

SEQ ID NO: 1233271 - protein, 5 aa, Mycobacterium
VPDAG

SEQ ID NO: 1233272 - protein, 7 aa, Mycobacterium
VPDAPGL

SEQ ID NO: 1233273 - protein, 18 aa, Mycobacterium
VPDAPPPEPVEGPGDATR

SEQ ID NO: 1233274 - protein, 4 aa, Mycobacterium
VPDD

SEQ ID NO: 1233275 - protein, 6 aa, Mycobacterium
VPDDDV

SEQ ID NO: 1233276 - protein, 7 aa, Mycobacterium
VPDEASE

SEQ ID NO: 1233277 - protein, 5 aa, Mycobacterium
VPDEQ

SEQ ID NO: 1233278 - protein, 5 aa, Mycobacterium
VPDGA

SEQ ID NO: 1233279 - protein, 10 aa, Mycobacterium
VPDGTAQELD

SEQ ID NO: 1233280 - protein, 6 aa, Mycobacterium
VPDKGL

SEQ ID NO: 1233281 - protein, 17 aa, Mycobacterium
VPDMPEPAESVAPPSCG

SEQ ID NO: 1233282 - protein, 8 aa, Mycobacterium
VPDPDDPG

SEQ ID NO: 1233283 - protein, 6 aa, Mycobacterium
VPDPGL

SEQ ID NO: 1233284 - protein, 9 aa, Mycobacterium
VPDPRSGDQ

SEQ ID NO: 1233285 - protein, 5 aa, Mycobacterium
VPDRA

SEQ ID NO: 1233286 - protein, 8 aa, Mycobacterium
VPDRARRA

SEQ ID NO: 1233287 - protein, 14 aa, Mycobacterium
VPDREGGPTSALNG

SEQ ID NO: 1233288 - protein, 11 aa, Mycobacterium
VPDRGAGRESV

SEQ ID NO: 1233289 - protein, 10 aa, Mycobacterium
VPDRQPAGAN

SEQ ID NO: 1233290 - protein, 4 aa, Mycobacterium
VPDS

SEQ ID NO: 1233291 - protein, 8 aa, Mycobacterium
VPDSGAQG

SEQ ID NO: 1233292 - protein, 8 aa, Mycobacterium
VPDSVERM

SEQ ID NO: 1233293 - protein, 8 aa, Mycobacterium
VPDTAAEQ

SEQ ID NO: 1233294 - protein, 12 aa, Mycobacterium
VPDTPDVTVSYD

SEQ ID NO: 1233295 - protein, 11 aa, Mycobacterium
VPDTPRLREAR

SEQ ID NO: 1233296 - protein, 17 aa, Mycobacterium
VPDVPDASAPAPSGTTR

SEQ ID NO: 1233297 - protein, 4 aa, Mycobacterium
VPDY

SEQ ID NO: 1233298 - protein, 15 aa, Mycobacterium
VPEAQRGNLSTVGDN

SEQ ID NO: 1233299 - protein, 18 aa, Mycobacterium
VPEDADDPNAATEPIEQD

SEQ ID NO: 1233300 - protein, 12 aa, Mycobacterium
VPEDARLPEAQG

SEQ ID NO: 1233301 - protein, 15 aa, Mycobacterium
VPEDGAITLRVTVPP

SEQ ID NO: 1233302 - protein, 12 aa, Mycobacterium
VPEGGYLGQNLL

SEQ ID NO: 1233303 - protein, 13 aa, Mycobacterium
VPEPPRSLEPTRR

SEQ ID NO: 1233304 - protein, 7 aa, Mycobacterium
VPEPPSI

SEQ ID NO: 1233305 - protein, 9 aa, Mycobacterium
VPEPTCAPD

SEQ ID NO: 1233306 - protein, 5 aa, Mycobacterium
VPEQA

SEQ ID NO: 1233307 - protein, 8 aa, Mycobacterium
VPEQPGRQ

SEQ ID NO: 1233308 - protein, 7 aa, Mycobacterium
VPEQPVP

SEQ ID NO: 1233309 - protein, 17 aa, Mycobacterium
VPERADARADPAARDPD

SEQ ID NO: 1233310 - protein, 9 aa, Mycobacterium
VPERSEGDA

SEQ ID NO: 1233311 - protein, 4 aa, Mycobacterium
VPES

SEQ ID NO: 1233312 - protein, 4 aa, Mycobacterium
VPET

SEQ ID NO: 1233313 - protein, 7 aa, Mycobacterium
VPEVEPG

SEQ ID NO: 1233314 - protein, 11 aa, Mycobacterium
VPEYQREDNTI

SEQ ID NO: 1233315 - protein, 12 aa, Mycobacterium
VPFDSENDTEVG

SEQ ID NO: 1233316 - protein, 20 aa, Mycobacterium
VPGADGRHVATTPSKETDHA

SEQ ID NO: 1233317 - protein, 5 aa, Mycobacterium
VPGAE

SEQ ID NO: 1233318 - protein, 11 aa, Mycobacterium
VPGAEALPAAQ

SEQ ID NO: 1233319 - protein, 8 aa, Mycobacterium
VPGAGDTT

SEQ ID NO: 1233320 - protein, 9 aa, Mycobacterium
VPGAGKGVA

SEQ ID NO: 1233321 - protein, 5 aa, Mycobacterium
VPGAP

SEQ ID NO: 1233322 - protein, 14 aa, Mycobacterium
VPGAPDSQAKWRTN

SEQ ID NO: 1233323 - protein, 7 aa, Mycobacterium
VPGAPDY

SEQ ID NO: 1233324 - protein, 5 aa, Mycobacterium
VPGAR

SEQ ID NO: 1233325 - protein, 17 aa, Mycobacterium
VPGASVYSASKAAVESL

SEQ ID NO: 1233326 - protein, 4 aa, Mycobacterium
VPGD

SEQ ID NO: 1233327 - protein, 6 aa, Mycobacterium
VPGDDA

SEQ ID NO: 1233328 - protein, 6 aa, Mycobacterium
VPGDDG

SEQ ID NO: 1233329 - protein, 9 aa, Mycobacterium
VPGEERSGE

SEQ ID NO: 1233330 - protein, 5 aa, Mycobacterium
VPGEF

SEQ ID NO: 1233331 - protein, 6 aa, Mycobacterium
VPGEQR

SEQ ID NO: 1233332 - protein, 6 aa, Mycobacterium
VPGGDH

SEQ ID NO: 1233333 - protein, 8 aa, Mycobacterium
VPGGEPED

SEQ ID NO: 1233334 - protein, 4 aa, Mycobacterium
VPGH

SEQ ID NO: 1233335 - protein, 4 aa, Mycobacterium
VPGI

SEQ ID NO: 1233336 - protein, 5 aa, Mycobacterium
VPGKK

SEQ ID NO: 1233337 - protein, 4 aa, Mycobacterium
VPGM

SEQ ID NO: 1233338 - protein, 11 aa, Mycobacterium
VPGPDEKVRPL

SEQ ID NO: 1233339 - protein, 7 aa, Mycobacterium
VPGPQGP

SEQ ID NO: 1233340 - protein, 5 aa, Mycobacterium
VPGPR

SEQ ID NO: 1233341 - protein, 7 aa, Mycobacterium
VPGPREP

SEQ ID NO: 1233342 - protein, 10 aa, Mycobacterium
VPGPVSDQNL

SEQ ID NO: 1233343 - protein, 15 aa, Mycobacterium
VPGQDGEDPDDPDHE

SEQ ID NO: 1233344 - protein, 10 aa, Mycobacterium
VPGQPAPSVS

SEQ ID NO: 1233345 - protein, 8 aa, Mycobacterium
VPGQRDHS

SEQ ID NO: 1233346 - protein, 29 aa, Mycobacterium
VPGRRRSAATGRWPTCSPSTPASGSASSC

SEQ ID NO: 1233347 - protein, 8 aa, Mycobacterium
VPGSAAEV

SEQ ID NO: 1233348 - protein, 6 aa, Mycobacterium
VPGSAS

SEQ ID NO: 1233349 - protein, 6 aa, Mycobacterium
VPGSEK

SEQ ID NO: 1233350 - protein, 8 aa, Mycobacterium
VPGSGDGY

SEQ ID NO: 1233351 - protein, 11 aa, Mycobacterium
VPGSSDPIDGA

SEQ ID NO: 1233352 - protein, 7 aa, Mycobacterium
VPGSSQD

SEQ ID NO: 1233353 - protein, 14 aa, Mycobacterium
VPGSSRGAARSAGG

SEQ ID NO: 1233354 - protein, 9 aa, Mycobacterium
VPGTAPADD

SEQ ID NO: 1233355 - protein, 7 aa, Mycobacterium
VPGTEKL

SEQ ID NO: 1233356 - protein, 7 aa, Mycobacterium
VPGTPGL

SEQ ID NO: 1233357 - protein, 5 aa, Mycobacterium
VPGTQ

SEQ ID NO: 1233358 - protein, 14 aa, Mycobacterium
VPGTRGRSIAAGEP

SEQ ID NO: 1233359 - protein, 33 aa, Mycobacterium
VPGVGGTGGVAPEDGRTTEPGGVGGTGGVPTDD

SEQ ID NO: 1233360 - protein, 11 aa, Mycobacterium
VPGVGKSTTIE

SEQ ID NO: 1233361 - protein, 7 aa, Mycobacterium
VPGYGSS

SEQ ID NO: 1233362 - protein, 11 aa, Mycobacterium
VPHTRTGKKLE

SEQ ID NO: 1233363 - protein, 4 aa, Mycobacterium
VPID

SEQ ID NO: 1233364 - protein, 6 aa, Mycobacterium
VPIPAD

SEQ ID NO: 1233365 - protein, 6 aa, Mycobacterium
VPITNP

SEQ ID NO: 1233366 - protein, 10 aa, Mycobacterium
VPKDARSEKV

SEQ ID NO: 1233367 - protein, 13 aa, Mycobacterium
VPKDGEQSNQRQK

SEQ ID NO: 1233368 - protein, 6 aa, Mycobacterium
VPKEDL

SEQ ID NO: 1233369 - protein, 6 aa, Mycobacterium
VPKERV

SEQ ID NO: 1233370 - protein, 8 aa, Mycobacterium
VPKGLGRK

SEQ ID NO: 1233371 - protein, 7 aa, Mycobacterium
VPKGPEL

SEQ ID NO: 1233372 - protein, 7 aa, Mycobacterium
VPLETPA

SEQ ID NO: 1233373 - protein, 11 aa, Mycobacterium
VPLPDGSADTV

SEQ ID NO: 1233374 - protein, 9 aa, Mycobacterium
VPLPQPPQP

SEQ ID NO: 1233375 - protein, 19 aa, Mycobacterium
VPNAGGRVVDPETGEPVRG

SEQ ID NO: 1233376 - protein, 8 aa, Mycobacterium
VPNDRGRV

SEQ ID NO: 1233377 - protein, 13 aa, Mycobacterium
VPNQGRRGEAGPT

SEQ ID NO: 1233378 - protein, 7 aa, Mycobacterium
VPNRGRS

SEQ ID NO: 1233379 - protein, 18 aa, Mycobacterium
VPNTGADPSESRTSAENH

SEQ ID NO: 1233380 - protein, 12 aa, Mycobacterium
VPPADTPAVVRV

SEQ ID NO: 1233381 - protein, 7 aa, Mycobacterium
VPPADTT

SEQ ID NO: 1233382 - protein, 6 aa, Mycobacterium
VPPAEL

SEQ ID NO: 1233383 - protein, 6 aa, Mycobacterium
VPPAEY

SEQ ID NO: 1233384 - protein, 11 aa, Mycobacterium
VPPAGPAHRAP

SEQ ID NO: 1233385 - protein, 7 aa, Mycobacterium
VPPAGTL

SEQ ID NO: 1233386 - protein, 7 aa, Mycobacterium
VPPDAPT

SEQ ID NO: 1233387 - protein, 10 aa, Mycobacterium
VPPDDGADRH

SEQ ID NO: 1233388 - protein, 8 aa, Mycobacterium
VPPEPDES

SEQ ID NO: 1233389 - protein, 12 aa, Mycobacterium
VPPGADSQGLGR

SEQ ID NO: 1233390 - protein, 8 aa, Mycobacterium
VPPGAGTV

SEQ ID NO: 1233391 - protein, 6 aa, Mycobacterium
VPPGAY

SEQ ID NO: 1233392 - protein, 11 aa, Mycobacterium
VPPGQSLPDGW

SEQ ID NO: 1233393 - protein, 8 aa, Mycobacterium
VPPGRVTT

SEQ ID NO: 1233394 - protein, 5 aa, Mycobacterium
VPPGS

SEQ ID NO: 1233395 - protein, 6 aa, Mycobacterium
VPPGVG

SEQ ID NO: 1233396 - protein, 5 aa, Mycobacterium
VPPHK

SEQ ID NO: 1233397 - protein, 11 aa, Mycobacterium
VPPLPDPPPKR

SEQ ID NO: 1233398 - protein, 7 aa, Mycobacterium
VPPNDGG

SEQ ID NO: 1233399 - protein, 18 aa, Mycobacterium
VPPNPEYTGIPAGRGHTT

SEQ ID NO: 1233400 - protein, 34 aa, Mycobacterium
VPPPAGRAAGAAPSAASPGPPPGRTRPPGRSPET

SEQ ID NO: 1233401 - protein, 5 aa, Mycobacterium
VPPPD

SEQ ID NO: 1233402 - protein, 14 aa, Mycobacterium
VPPQANPNDPTSRV

SEQ ID NO: 1233403 - protein, 25 aa, Mycobacterium
VPPRGPVPVTAGQEGAAADSPDPVD

SEQ ID NO: 1233404 - protein, 5 aa, Mycobacterium
VPPRV

SEQ ID NO: 1233405 - protein, 6 aa, Mycobacterium
VPPSAR

SEQ ID NO: 1233406 - protein, 9 aa, Mycobacterium
VPPSPRRRH

SEQ ID NO: 1233407 - protein, 5 aa, Mycobacterium
VPPSV

SEQ ID NO: 1233408 - protein, 6 aa, Mycobacterium
VPPSVW

SEQ ID NO: 1233409 - protein, 5 aa, Mycobacterium
VPPTI

SEQ ID NO: 1233410 - protein, 12 aa, Mycobacterium
VPPTSHTYPHME

SEQ ID NO: 1233411 - protein, 9 aa, Mycobacterium
VPPVGDARP

SEQ ID NO: 1233412 - protein, 5 aa, Mycobacterium
VPPVH

SEQ ID NO: 1233413 - protein, 20 aa, Mycobacterium
VPPVTGAAYERGERPVSNGT

SEQ ID NO: 1233414 - protein, 8 aa, Mycobacterium
VPQDPETL

SEQ ID NO: 1233415 - protein, 7 aa, Mycobacterium
VPQGGSG

SEQ ID NO: 1233416 - protein, 17 aa, Mycobacterium
VPQGSSTISGALRSRDT

SEQ ID NO: 1233417 - protein, 6 aa, Mycobacterium
VPQKHP

SEQ ID NO: 1233418 - protein, 9 aa, Mycobacterium
VPQPDDTRL

SEQ ID NO: 1233419 - protein, 6 aa, Mycobacterium
VPQPGT

SEQ ID NO: 1233420 - protein, 10 aa, Mycobacterium
VPQPPSKTLE

SEQ ID NO: 1233421 - protein, 11 aa, Mycobacterium
VPQRCPESLGD

SEQ ID NO: 1233422 - protein, 23 aa, Mycobacterium
VPQRGDKRALAETVKRNAEQALT

SEQ ID NO: 1233423 - protein, 10 aa, Mycobacterium
VPQRRRKTRL

SEQ ID NO: 1233424 - protein, 6 aa, Mycobacterium
VPQRTV

SEQ ID NO: 1233425 - protein, 9 aa, Mycobacterium
VPQSRQTEA

SEQ ID NO: 1233426 - protein, 13 aa, Mycobacterium
VPRAGSGVGSPRI

SEQ ID NO: 1233427 - protein, 7 aa, Mycobacterium
VPRDAAD

SEQ ID NO: 1233428 - protein, 9 aa, Mycobacterium
VPRDGTPTT

SEQ ID NO: 1233429 - protein, 10 aa, Mycobacterium
VPRDKRIERR

SEQ ID NO: 1233430 - protein, 6 aa, Mycobacterium
VPRFAG

SEQ ID NO: 1233431 - protein, 6 aa, Mycobacterium
VPRGTA

SEQ ID NO: 1233432 - protein, 5 aa, Mycobacterium
VPRNA

SEQ ID NO: 1233433 - protein, 16 aa, Mycobacterium
VPRNSNGRVPPGSRVR

SEQ ID NO: 1233434 - protein, 8 aa, Mycobacterium
VPRPRDAD

SEQ ID NO: 1233435 - protein, 6 aa, Mycobacterium
VPRPTM

SEQ ID NO: 1233436 - protein, 8 aa, Mycobacterium
VPRSESPR

SEQ ID NO: 1233437 - protein, 6 aa, Mycobacterium
VPRSGE

SEQ ID NO: 1233438 - protein, 12 aa, Mycobacterium
VPRSSKGSAVAS

SEQ ID NO: 1233439 - protein, 4 aa, Mycobacterium
VPRT

SEQ ID NO: 1233440 - protein, 10 aa, Mycobacterium
VPSAKPGITA

SEQ ID NO: 1233441 - protein, 8 aa, Mycobacterium
VPSAPRAA

SEQ ID NO: 1233442 - protein, 4 aa, Mycobacterium
VPSD

SEQ ID NO: 1233443 - protein, 12 aa, Mycobacterium
VPSDATPAAQAY

SEQ ID NO: 1233444 - protein, 6 aa, Mycobacterium
VPSEET

SEQ ID NO: 1233445 - protein, 6 aa, Mycobacterium
VPSEGR

SEQ ID NO: 1233446 - protein, 7 aa, Mycobacterium
VPSEGRR

SEQ ID NO: 1233447 - protein, 5 aa, Mycobacterium
VPSER

SEQ ID NO: 1233448 - protein, 4 aa, Mycobacterium
VPSG

SEQ ID NO: 1233449 - protein, 10 aa, Mycobacterium
VPSGGSQAIP

SEQ ID NO: 1233450 - protein, 6 aa, Mycobacterium
VPSGPA

SEQ ID NO: 1233451 - protein, 19 aa, Mycobacterium
VPSGPGRQAEFDEHELPWR

SEQ ID NO: 1233452 - protein, 11 aa, Mycobacterium
VPSKPGDDNPL

SEQ ID NO: 1233453 - protein, 12 aa, Mycobacterium
VPSLPDGVPLPV

SEQ ID NO: 1233454 - protein, 4 aa, Mycobacterium
VPSP

SEQ ID NO: 1233455 - protein, 46 aa, Mycobacterium
VPSPESEAEPDSKSESEPETETEPEADAESVDRDDSADDPVSPEPA

SEQ ID NO: 1233456 - protein, 8 aa, Mycobacterium
VPSPGPEE

SEQ ID NO: 1233457 - protein, 11 aa, Mycobacterium
VPSPIDPPSGC

SEQ ID NO: 1233458 - protein, 9 aa, Mycobacterium
VPSPLPDHP

SEQ ID NO: 1233459 - protein, 7 aa, Mycobacterium
VPSPTAA

SEQ ID NO: 1233460 - protein, 7 aa, Mycobacterium
VPSQRTA

SEQ ID NO: 1233461 - protein, 7 aa, Mycobacterium
VPSQTRL

SEQ ID NO: 1233462 - protein, 5 aa, Mycobacterium
VPSTT

SEQ ID NO: 1233463 - protein, 8 aa, Mycobacterium
VPTAANAG

SEQ ID NO: 1233464 - protein, 8 aa, Mycobacterium
VPTAASGL

SEQ ID NO: 1233465 - protein, 4 aa, Mycobacterium
VPTE

SEQ ID NO: 1233466 - protein, 8 aa, Mycobacterium
VPTEGDRR

SEQ ID NO: 1233467 - protein, 10 aa, Mycobacterium
VPTEGDWEQR

SEQ ID NO: 1233468 - protein, 8 aa, Mycobacterium
VPTEGTSV

SEQ ID NO: 1233469 - protein, 6 aa, Mycobacterium
VPTEYA

SEQ ID NO: 1233470 - protein, 16 aa, Mycobacterium
VPTGAPARGDSPDVCR

SEQ ID NO: 1233471 - protein, 6 aa, Mycobacterium
VPTGQK

SEQ ID NO: 1233472 - protein, 7 aa, Mycobacterium
VPTGTLG

SEQ ID NO: 1233473 - protein, 7 aa, Mycobacterium
VPTIETG

SEQ ID NO: 1233474 - protein, 14 aa, Mycobacterium
VPTIPPDASYEPKW

SEQ ID NO: 1233475 - protein, 11 aa, Mycobacterium
VPTNDALDDGS

SEQ ID NO: 1233476 - protein, 5 aa, Mycobacterium
VPTPA

SEQ ID NO: 1233477 - protein, 7 aa, Mycobacterium
VPTPAGE

SEQ ID NO: 1233478 - protein, 6 aa, Mycobacterium
VPTPDN

SEQ ID NO: 1233479 - protein, 11 aa, Mycobacterium
VPTPDVDPTRN

SEQ ID NO: 1233480 - protein, 6 aa, Mycobacterium
VPTPSL

SEQ ID NO: 1233481 - protein, 6 aa, Mycobacterium
VPTPVE

SEQ ID NO: 1233482 - protein, 7 aa, Mycobacterium
VPTQQAT

SEQ ID NO: 1233483 - protein, 9 aa, Mycobacterium
VPTRPALPR

SEQ ID NO: 1233484 - protein, 6 aa, Mycobacterium
VPTSAT

SEQ ID NO: 1233485 - protein, 7 aa, Mycobacterium
VPTSPQQ

SEQ ID NO: 1233486 - protein, 7 aa, Mycobacterium
VPTTATG

SEQ ID NO: 1233487 - protein, 5 aa, Mycobacterium
VPTTE

SEQ ID NO: 1233488 - protein, 21 aa, Mycobacterium
VPTTPGRVTESAEDAKAIAEE

SEQ ID NO: 1233489 - protein, 5 aa, Mycobacterium
VPTTT

SEQ ID NO: 1233490 - protein, 25 aa, Mycobacterium
VPTYSEGEQRDMSRSAAAHNGPIRT

SEQ ID NO: 1233491 - protein, 5 aa, Mycobacterium
VPVGP

SEQ ID NO: 1233492 - protein, 7 aa, Mycobacterium
VPVPGDA

SEQ ID NO: 1233493 - protein, 6 aa, Mycobacterium
VPVPGG

SEQ ID NO: 1233494 - protein, 13 aa, Mycobacterium
VPVSPTLQDPLPE

SEQ ID NO: 1233495 - protein, 8 aa, Mycobacterium
VPVTDGAA

SEQ ID NO: 1233496 - protein, 4 aa, Mycobacterium
VPYA

SEQ ID NO: 1233497 - protein, 6 aa, Mycobacterium
VPYNPG

SEQ ID NO: 1233498 - protein, 4 aa, Mycobacterium
VPYP

SEQ ID NO: 1233499 - protein, 9 aa, Mycobacterium
VQACPEDER

SEQ ID NO: 1233500 - protein, 4 aa, Mycobacterium
VQAE

SEQ ID NO: 1233501 - protein, 8 aa, Mycobacterium
VQAETDPR

SEQ ID NO: 1233502 - protein, 4 aa, Mycobacterium
VQAG

SEQ ID NO: 1233503 - protein, 16 aa, Mycobacterium
VQAGERAAAEVIEALT

SEQ ID NO: 1233504 - protein, 5 aa, Mycobacterium
VQDAP

SEQ ID NO: 1233505 - protein, 16 aa, Mycobacterium
VQDASEEFLRSVAADR

SEQ ID NO: 1233506 - protein, 7 aa, Mycobacterium
VQDQNGP

SEQ ID NO: 1233507 - protein, 12 aa, Mycobacterium
VQEPPRPTSAAP

SEQ ID NO: 1233508 - protein, 7 aa, Mycobacterium
VQGGRTS

SEQ ID NO: 1233509 - protein, 7 aa, Mycobacterium
VQGPNAV

SEQ ID NO: 1233510 - protein, 7 aa, Mycobacterium
VQGRPVR

SEQ ID NO: 1233511 - protein, 6 aa, Mycobacterium
VQKGDR

SEQ ID NO: 1233512 - protein, 9 aa, Mycobacterium
VQNEKNTKQ

SEQ ID NO: 1233513 - protein, 9 aa, Mycobacterium
VQPAEPDGL

SEQ ID NO: 1233514 - protein, 11 aa, Mycobacterium
VQPAGLAPVGD

SEQ ID NO: 1233515 - protein, 10 aa, Mycobacterium
VQPAPLGSSW

SEQ ID NO: 1233516 - protein, 9 aa, Mycobacterium
VQPAPTPDA

SEQ ID NO: 1233517 - protein, 9 aa, Mycobacterium
VQPDPHGGS

SEQ ID NO: 1233518 - protein, 10 aa, Mycobacterium
VQPEGDPGQW

SEQ ID NO: 1233519 - protein, 37 aa, Mycobacterium
VQPEGDPGQWSSPPFEPTERDGRLYGRGTADDKAGIA

SEQ ID NO: 1233520 - protein, 14 aa, Mycobacterium
VQPELRKGRYPDRK

SEQ ID NO: 1233521 - protein, 5 aa, Mycobacterium
VQPEQ

SEQ ID NO: 1233522 - protein, 6 aa, Mycobacterium
VQPGAQ

SEQ ID NO: 1233523 - protein, 14 aa, Mycobacterium
VQPGMGGRQDPRWQ

SEQ ID NO: 1233524 - protein, 18 aa, Mycobacterium
VQPGPIDTDANPDDGAFA

SEQ ID NO: 1233525 - protein, 18 aa, Mycobacterium
VQPGPIDTDANPDNGDFA

SEQ ID NO: 1233526 - protein, 19 aa, Mycobacterium
VQPGPIDTDANPDSGDFAE

SEQ ID NO: 1233527 - protein, 12 aa, Mycobacterium
VQPPGKKPMNAA

SEQ ID NO: 1233528 - protein, 5 aa, Mycobacterium
VQPPR

SEQ ID NO: 1233529 - protein, 30 aa, Mycobacterium
VQPSGNPVTASWDSGSKTLTLSGTATVEQY

SEQ ID NO: 1233530 - protein, 13 aa, Mycobacterium
VQPSPETSAQEVT

SEQ ID NO: 1233531 - protein, 6 aa, Mycobacterium
VQPSPL

SEQ ID NO: 1233532 - protein, 6 aa, Mycobacterium
VQPSSV

SEQ ID NO: 1233533 - protein, 4 aa, Mycobacterium
VQPV

SEQ ID NO: 1233534 - protein, 9 aa, Mycobacterium
VQPVPGAAE

SEQ ID NO: 1233535 - protein, 6 aa, Mycobacterium
VQQDDL

SEQ ID NO: 1233536 - protein, 7 aa, Mycobacterium
VQQDPRL

SEQ ID NO: 1233537 - protein, 6 aa, Mycobacterium
VQQPAS

SEQ ID NO: 1233538 - protein, 6 aa, Mycobacterium
VQQRHN

SEQ ID NO: 1233539 - protein, 8 aa, Mycobacterium
VQQSPNST

SEQ ID NO: 1233540 - protein, 6 aa, Mycobacterium
VQQTAN

SEQ ID NO: 1233541 - protein, 13 aa, Mycobacterium
VQRAGAEGAKTSQ

SEQ ID NO: 1233542 - protein, 45 aa, Mycobacterium
VQRDADPPESPDPPDEPALPQAPLTATPAASPAATGGVPAAGGNI

SEQ ID NO: 1233543 - protein, 6 aa, Mycobacterium
VQRGGG

SEQ ID NO: 1233544 - protein, 9 aa, Mycobacterium
VQRPDSQDA

SEQ ID NO: 1233545 - protein, 9 aa, Mycobacterium
VQRQEADAR

SEQ ID NO: 1233546 - protein, 5 aa, Mycobacterium
VQRRH

SEQ ID NO: 1233547 - protein, 10 aa, Mycobacterium
VQRTPGVDER

SEQ ID NO: 1233548 - protein, 5 aa, Mycobacterium
VQRYP

SEQ ID NO: 1233549 - protein, 12 aa, Mycobacterium
VQSAEPVVVLRA

SEQ ID NO: 1233550 - protein, 12 aa, Mycobacterium
VQSARGPVIVAR

SEQ ID NO: 1233551 - protein, 10 aa, Mycobacterium
VQSEHGSEAF

SEQ ID NO: 1233552 - protein, 5 aa, Mycobacterium
VQSMR

SEQ ID NO: 1233553 - protein, 14 aa, Mycobacterium
VQSPGAARLQDPGY

SEQ ID NO: 1233554 - protein, 11 aa, Mycobacterium
VQSPGAQYLGD

SEQ ID NO: 1233555 - protein, 5 aa, Mycobacterium
VQSRR

SEQ ID NO: 1233556 - protein, 7 aa, Mycobacterium
VQSRRDD

SEQ ID NO: 1233557 - protein, 5 aa, Mycobacterium
VQTAG

SEQ ID NO: 1233558 - protein, 15 aa, Mycobacterium
VQTGTGPAGGTGDDD

SEQ ID NO: 1233559 - protein, 13 aa, Mycobacterium
VQTGTRDGDDDLA

SEQ ID NO: 1233560 - protein, 4 aa, Mycobacterium
VQTP

SEQ ID NO: 1233561 - protein, 7 aa, Mycobacterium
VRAAADR

SEQ ID NO: 1233562 - protein, 7 aa, Mycobacterium
VRAAGDA

SEQ ID NO: 1233563 - protein, 12 aa, Mycobacterium
VRAAGDPGPHRR

SEQ ID NO: 1233564 - protein, 8 aa, Mycobacterium
VRAAGGVP

SEQ ID NO: 1233565 - protein, 4 aa, Mycobacterium
VRAD

SEQ ID NO: 1233566 - protein, 13 aa, Mycobacterium
VRAELSGEGIPHL

SEQ ID NO: 1233567 - protein, 20 aa, Mycobacterium
VRAEPKVKTTIPVDPSGDGG

SEQ ID NO: 1233568 - protein, 11 aa, Mycobacterium
VRAGDGAQLTD

SEQ ID NO: 1233569 - protein, 8 aa, Mycobacterium
VRAGKPLG

SEQ ID NO: 1233570 - protein, 15 aa, Mycobacterium
VRAGTVKPSRNPRAR

SEQ ID NO: 1233571 - protein, 8 aa, Mycobacterium
VRAPRRRR

SEQ ID NO: 1233572 - protein, 10 aa, Mycobacterium
VRAQARSPQI

SEQ ID NO: 1233573 - protein, 17 aa, Mycobacterium
VRARAQDRESSKPGTAL

SEQ ID NO: 1233574 - protein, 8 aa, Mycobacterium
VRARGQRS

SEQ ID NO: 1233575 - protein, 6 aa, Mycobacterium
VRASGL

SEQ ID NO: 1233576 - protein, 16 aa, Mycobacterium
VRASKSEAIQSSDPAT

SEQ ID NO: 1233577 - protein, 8 aa, Mycobacterium
VRATKSNV

SEQ ID NO: 1233578 - protein, 9 aa, Mycobacterium
VRATPDARV

SEQ ID NO: 1233579 - protein, 5 aa, Mycobacterium
VRCSQ

SEQ ID NO: 1233580 - protein, 5 aa, Mycobacterium
VRDAD

SEQ ID NO: 1233581 - protein, 7 aa, Mycobacterium
VRDADAL

SEQ ID NO: 1233582 - protein, 6 aa, Mycobacterium
VRDADG

SEQ ID NO: 1233583 - protein, 11 aa, Mycobacterium
VRDAPGSGGLS

SEQ ID NO: 1233584 - protein, 9 aa, Mycobacterium
VRDATNSED

SEQ ID NO: 1233585 - protein, 7 aa, Mycobacterium
VRDEADA

SEQ ID NO: 1233586 - protein, 4 aa, Mycobacterium
VRDG

SEQ ID NO: 1233587 - protein, 7 aa, Mycobacterium
VRDGAGE

SEQ ID NO: 1233588 - protein, 5 aa, Mycobacterium
VRDGG

SEQ ID NO: 1233589 - protein, 7 aa, Mycobacterium
VRDGNSI

SEQ ID NO: 1233590 - protein, 9 aa, Mycobacterium
VRDGTGAGG

SEQ ID NO: 1233591 - protein, 8 aa, Mycobacterium
VRDPRPER

SEQ ID NO: 1233592 - protein, 15 aa, Mycobacterium
VRDQTGDWNSVGQSR

SEQ ID NO: 1233593 - protein, 4 aa, Mycobacterium
VRDR

SEQ ID NO: 1233594 - protein, 6 aa, Mycobacterium
VRDRDA

SEQ ID NO: 1233595 - protein, 14 aa, Mycobacterium
VRDSADGATADQVA

SEQ ID NO: 1233596 - protein, 10 aa, Mycobacterium
VRDSGTDRKW

SEQ ID NO: 1233597 - protein, 17 aa, Mycobacterium
VRDTEEPSPLPPATETR

SEQ ID NO: 1233598 - protein, 13 aa, Mycobacterium
VRDTSERFRVRLR

SEQ ID NO: 1233599 - protein, 7 aa, Mycobacterium
VREDGAS

SEQ ID NO: 1233600 - protein, 10 aa, Mycobacterium
VREDGSAKLV

SEQ ID NO: 1233601 - protein, 11 aa, Mycobacterium
VREDPDAVAPA

SEQ ID NO: 1233602 - protein, 6 aa, Mycobacterium
VREGAA

SEQ ID NO: 1233603 - protein, 6 aa, Mycobacterium
VREGDW

SEQ ID NO: 1233604 - protein, 9 aa, Mycobacterium
VREGKASQQ

SEQ ID NO: 1233605 - protein, 12 aa, Mycobacterium
VREGKKAAGQAA

SEQ ID NO: 1233606 - protein, 10 aa, Mycobacterium
VREGRDAAPV

SEQ ID NO: 1233607 - protein, 7 aa, Mycobacterium
VREGREG

SEQ ID NO: 1233608 - protein, 7 aa, Mycobacterium
VREHDPS

SEQ ID NO: 1233609 - protein, 7 aa, Mycobacterium
VREQNGD

SEQ ID NO: 1233610 - protein, 8 aa, Mycobacterium
VRERSRTT

SEQ ID NO: 1233611 - protein, 9 aa, Mycobacterium
VRERTGRNR

SEQ ID NO: 1233612 - protein, 5 aa, Mycobacterium
VRESN

SEQ ID NO: 1233613 - protein, 6 aa, Mycobacterium
VRESPA

SEQ ID NO: 1233614 - protein, 5 aa, Mycobacterium
VRETY

SEQ ID NO: 1233615 - protein, 38 aa, Mycobacterium
VRGAGDAETYVPYDPSTGEPHPQYRSSVAESADVLGGA

SEQ ID NO: 1233616 - protein, 5 aa, Mycobacterium
VRGAP

SEQ ID NO: 1233617 - protein, 7 aa, Mycobacterium
VRGDSTR

SEQ ID NO: 1233618 - protein, 8 aa, Mycobacterium
VRGEGGRL

SEQ ID NO: 1233619 - protein, 4 aa, Mycobacterium
VRGG

SEQ ID NO: 1233620 - protein, 18 aa, Mycobacterium
VRGKATTTTIADPGAVRP

SEQ ID NO: 1233621 - protein, 9 aa, Mycobacterium
VRGNADTGR

SEQ ID NO: 1233622 - protein, 12 aa, Mycobacterium
VRGPEGADPASV

SEQ ID NO: 1233623 - protein, 18 aa, Mycobacterium
VRGPLDTERLGTPAPDVL

SEQ ID NO: 1233624 - protein, 9 aa, Mycobacterium
VRGQTRTKS

SEQ ID NO: 1233625 - protein, 4 aa, Mycobacterium
VRGR

SEQ ID NO: 1233626 - protein, 14 aa, Mycobacterium
VRGRGIEEAAPLGV

SEQ ID NO: 1233627 - protein, 8 aa, Mycobacterium
VRGRQTQA

SEQ ID NO: 1233628 - protein, 10 aa, Mycobacterium
VRGSDDHAAP

SEQ ID NO: 1233629 - protein, 13 aa, Mycobacterium
VRGTDQPDGATGL

SEQ ID NO: 1233630 - protein, 8 aa, Mycobacterium
VRGTGTRP

SEQ ID NO: 1233631 - protein, 6 aa, Mycobacterium
VRHSGA

SEQ ID NO: 1233632 - protein, 6 aa, Mycobacterium
VRKPAY

SEQ ID NO: 1233633 - protein, 5 aa, Mycobacterium
VRKPD

SEQ ID NO: 1233634 - protein, 4 aa, Mycobacterium
VRMG

SEQ ID NO: 1233635 - protein, 30 aa, Mycobacterium
VRNAAPSAALRATAKRAINDVRRGVVAVDA

SEQ ID NO: 1233636 - protein, 8 aa, Mycobacterium
VRNDLTPD

SEQ ID NO: 1233637 - protein, 7 aa, Mycobacterium
VRNGTGL

SEQ ID NO: 1233638 - protein, 8 aa, Mycobacterium
VRNNGPEL

SEQ ID NO: 1233639 - protein, 7 aa, Mycobacterium
VRNQPSR

SEQ ID NO: 1233640 - protein, 4 aa, Mycobacterium
VRNT

SEQ ID NO: 1233641 - protein, 7 aa, Mycobacterium
VRPAPGG

SEQ ID NO: 1233642 - protein, 48 aa, Mycobacterium
VRPARGRAPAAGADLPSDDLDGDDPYEDGVGSLDRDGVPEALGDALRS

SEQ ID NO: 1233643 - protein, 12 aa, Mycobacterium
VRPDGDKNRATL

SEQ ID NO: 1233644 - protein, 12 aa, Mycobacterium
VRPDPAAPGTAG

SEQ ID NO: 1233645 - protein, 5 aa, Mycobacterium
VRPDS

SEQ ID NO: 1233646 - protein, 12 aa, Mycobacterium
VRPEAETDAEPV

SEQ ID NO: 1233647 - protein, 10 aa, Mycobacterium
VRPENAPSRR

SEQ ID NO: 1233648 - protein, 10 aa, Mycobacterium
VRPENGPSRA

SEQ ID NO: 1233649 - protein, 8 aa, Mycobacterium
VRPGKERA

SEQ ID NO: 1233650 - protein, 5 aa, Mycobacterium
VRPGR

SEQ ID NO: 1233651 - protein, 9 aa, Mycobacterium
VRPGSADEV

SEQ ID NO: 1233652 - protein, 7 aa, Mycobacterium
VRPKEAL

SEQ ID NO: 1233653 - protein, 6 aa, Mycobacterium
VRPPEE

SEQ ID NO: 1233654 - protein, 5 aa, Mycobacterium
VRPPV

SEQ ID NO: 1233655 - protein, 4 aa, Mycobacterium
VRPR

SEQ ID NO: 1233656 - protein, 14 aa, Mycobacterium
VRPRSYPALAAGPK

SEQ ID NO: 1233657 - protein, 12 aa, Mycobacterium
VRPSNVDANSAE

SEQ ID NO: 1233658 - protein, 17 aa, Mycobacterium
VRPSPPPRRREHSAVAT

SEQ ID NO: 1233659 - protein, 7 aa, Mycobacterium
VRPSTKL

SEQ ID NO: 1233660 - protein, 7 aa, Mycobacterium
VRPTNAR

SEQ ID NO: 1233661 - protein, 16 aa, Mycobacterium
VRPTPEQIAEASALSR

SEQ ID NO: 1233662 - protein, 14 aa, Mycobacterium
VRQDERVPGNRAPL

SEQ ID NO: 1233663 - protein, 14 aa, Mycobacterium
VRQDGQPKDETDWN

SEQ ID NO: 1233664 - protein, 4 aa, Mycobacterium
VRQE

SEQ ID NO: 1233665 - protein, 13 aa, Mycobacterium
VRQPDGALSHPGY

SEQ ID NO: 1233666 - protein, 9 aa, Mycobacterium
VRQPGPAPL

SEQ ID NO: 1233667 - protein, 13 aa, Mycobacterium
VRQPQNPAYTADG

SEQ ID NO: 1233668 - protein, 15 aa, Mycobacterium
VRQPVSSLSGGQRQT

SEQ ID NO: 1233669 - protein, 5 aa, Mycobacterium
VRQRA

SEQ ID NO: 1233670 - protein, 11 aa, Mycobacterium
VRQRNSDTADL

SEQ ID NO: 1233671 - protein, 5 aa, Mycobacterium
VRQRP

SEQ ID NO: 1233672 - protein, 10 aa, Mycobacterium
VRQRSEESYR

SEQ ID NO: 1233673 - protein, 12 aa, Mycobacterium
VRQSSAGSARQT

SEQ ID NO: 1233674 - protein, 4 aa, Mycobacterium
VRRA

SEQ ID NO: 1233675 - protein, 6 aa, Mycobacterium
VRRDDH

SEQ ID NO: 1233676 - protein, 10 aa, Mycobacterium
VRRDGGVTVG

SEQ ID NO: 1233677 - protein, 8 aa, Mycobacterium
VRRDGPMA

SEQ ID NO: 1233678 - protein, 4 aa, Mycobacterium
VRRE

SEQ ID NO: 1233679 - protein, 11 aa, Mycobacterium
VRREKSSDRHV

SEQ ID NO: 1233680 - protein, 7 aa, Mycobacterium
VRRELQD

SEQ ID NO: 1233681 - protein, 5 aa, Mycobacterium
VRRGG

SEQ ID NO: 1233682 - protein, 21 aa, Mycobacterium
VRRGKRVTTTRADPAAPRHPD

SEQ ID NO: 1233683 - protein, 9 aa, Mycobacterium
VRRGPGGEH

SEQ ID NO: 1233684 - protein, 17 aa, Mycobacterium
VRRGRGPKAAGAGRPKL

SEQ ID NO: 1233685 - protein, 23 aa, Mycobacterium
VRRPGTQVGELSRRAADETGLRA

SEQ ID NO: 1233686 - protein, 17 aa, Mycobacterium
VRRPQPRRPIEERPLPD

SEQ ID NO: 1233687 - protein, 9 aa, Mycobacterium
VRRRPGGPL

SEQ ID NO: 1233688 - protein, 6 aa, Mycobacterium
VRRSAA

SEQ ID NO: 1233689 - protein, 9 aa, Mycobacterium
VRRSGRKAL

SEQ ID NO: 1233690 - protein, 6 aa, Mycobacterium
VRRTAG

SEQ ID NO: 1233691 - protein, 13 aa, Mycobacterium
VRRTGDDVQPGDV

SEQ ID NO: 1233692 - protein, 9 aa, Mycobacterium
VRSAGGGAQ

SEQ ID NO: 1233693 - protein, 19 aa, Mycobacterium
VRSAGGTVIEEPSQQSYGK

SEQ ID NO: 1233694 - protein, 7 aa, Mycobacterium
VRSAREG

SEQ ID NO: 1233695 - protein, 12 aa, Mycobacterium
VRSARTRLGDGA

SEQ ID NO: 1233696 - protein, 5 aa, Mycobacterium
VRSDD

SEQ ID NO: 1233697 - protein, 7 aa, Mycobacterium
VRSEATD

SEQ ID NO: 1233698 - protein, 6 aa, Mycobacterium
VRSEGA

SEQ ID NO: 1233699 - protein, 14 aa, Mycobacterium
VRSEQAASTRESRY

SEQ ID NO: 1233700 - protein, 10 aa, Mycobacterium
VRSGASRPRG

SEQ ID NO: 1233701 - protein, 6 aa, Mycobacterium
VRSGDA

SEQ ID NO: 1233702 - protein, 8 aa, Mycobacterium
VRSGERAA

SEQ ID NO: 1233703 - protein, 15 aa, Mycobacterium
VRSGPGINDNGSGVA

SEQ ID NO: 1233704 - protein, 8 aa, Mycobacterium
VRSGRTGA

SEQ ID NO: 1233705 - protein, 17 aa, Mycobacterium
VRSKREASTKPATRRIA

SEQ ID NO: 1233706 - protein, 17 aa, Mycobacterium
VRSNRGVAGIDGTVSTA

SEQ ID NO: 1233707 - protein, 8 aa, Mycobacterium
VRSPATGE

SEQ ID NO: 1233708 - protein, 25 aa, Mycobacterium
VRSPHGTQWEGAAQAAAQARADSDL

SEQ ID NO: 1233709 - protein, 7 aa, Mycobacterium
VRSPSKS

SEQ ID NO: 1233710 - protein, 11 aa, Mycobacterium
VRSPYPTGSGY

SEQ ID NO: 1233711 - protein, 8 aa, Mycobacterium
VRSSPQTG

SEQ ID NO: 1233712 - protein, 15 aa, Mycobacterium
VRSSSTQAPDLGIAV

SEQ ID NO: 1233713 - protein, 5 aa, Mycobacterium
VRSTE

SEQ ID NO: 1233714 - protein, 14 aa, Mycobacterium
VRSVGGKTLKWPAE

SEQ ID NO: 1233715 - protein, 5 aa, Mycobacterium
VRTAD

SEQ ID NO: 1233716 - protein, 5 aa, Mycobacterium
VRTAE

SEQ ID NO: 1233717 - protein, 18 aa, Mycobacterium
VRTATGKGASRRARREGK

SEQ ID NO: 1233718 - protein, 11 aa, Mycobacterium
VRTDAGDRIPT

SEQ ID NO: 1233719 - protein, 11 aa, Mycobacterium
VRTDPNVPKHK

SEQ ID NO: 1233720 - protein, 6 aa, Mycobacterium
VRTENR

SEQ ID NO: 1233721 - protein, 15 aa, Mycobacterium
VRTERRSSGFTRGVG

SEQ ID NO: 1233722 - protein, 8 aa, Mycobacterium
VRTESADH

SEQ ID NO: 1233723 - protein, 11 aa, Mycobacterium
VRTGDRRSGIA

SEQ ID NO: 1233724 - protein, 11 aa, Mycobacterium
VRTGEAADGDT

SEQ ID NO: 1233725 - protein, 7 aa, Mycobacterium
VRTGNAR

SEQ ID NO: 1233726 - protein, 7 aa, Mycobacterium
VRTGTGA

SEQ ID NO: 1233727 - protein, 8 aa, Mycobacterium
VRTGTGET

SEQ ID NO: 1233728 - protein, 11 aa, Mycobacterium
VRTNDAKGIRQ

SEQ ID NO: 1233729 - protein, 5 aa, Mycobacterium
VRTPG

SEQ ID NO: 1233730 - protein, 12 aa, Mycobacterium
VRTPGAERTVTE

SEQ ID NO: 1233731 - protein, 6 aa, Mycobacterium
VRTQYS

SEQ ID NO: 1233732 - protein, 4 aa, Mycobacterium
VRTR

SEQ ID NO: 1233733 - protein, 15 aa, Mycobacterium
VRTRKATGDVHDYGD

SEQ ID NO: 1233734 - protein, 11 aa, Mycobacterium
VRTSSGSARSL

SEQ ID NO: 1233735 - protein, 7 aa, Mycobacterium
VRTTTTG

SEQ ID NO: 1233736 - protein, 6 aa, Mycobacterium
VRTYPK

SEQ ID NO: 1233737 - protein, 4 aa, Mycobacterium
VRVE

SEQ ID NO: 1233738 - protein, 7 aa, Mycobacterium
VRVGSTT

SEQ ID NO: 1233739 - protein, 12 aa, Mycobacterium
VRYDGPAGTYPS

SEQ ID NO: 1233740 - protein, 9 aa, Mycobacterium
VRYPKQPRA

SEQ ID NO: 1233741 - protein, 8 aa, Mycobacterium
VSAAAVDD

SEQ ID NO: 1233742 - protein, 7 aa, Mycobacterium
VSAAPEL

SEQ ID NO: 1233743 - protein, 9 aa, Mycobacterium
VSAAPYGSA

SEQ ID NO: 1233744 - protein, 14 aa, Mycobacterium
VSAAQNISRSRAGY

SEQ ID NO: 1233745 - protein, 12 aa, Mycobacterium
VSAASAAVSTPL

SEQ ID NO: 1233746 - protein, 6 aa, Mycobacterium
VSAATG

SEQ ID NO: 1233747 - protein, 10 aa, Mycobacterium
VSADDTQNPV

SEQ ID NO: 1233748 - protein, 9 aa, Mycobacterium
VSADPDITA

SEQ ID NO: 1233749 - protein, 7 aa, Mycobacterium
VSADRAE

SEQ ID NO: 1233750 - protein, 9 aa, Mycobacterium
VSAEAADVG

SEQ ID NO: 1233751 - protein, 9 aa, Mycobacterium
VSAEAQRRR

SEQ ID NO: 1233752 - protein, 8 aa, Mycobacterium
VSAEETAD

SEQ ID NO: 1233753 - protein, 8 aa, Mycobacterium
VSAEPDLA

SEQ ID NO: 1233754 - protein, 4 aa, Mycobacterium
VSAG

SEQ ID NO: 1233755 - protein, 6 aa, Mycobacterium
VSAGAQ

SEQ ID NO: 1233756 - protein, 7 aa, Mycobacterium
VSAGEWP

SEQ ID NO: 1233757 - protein, 8 aa, Mycobacterium
VSAGGNLK

SEQ ID NO: 1233758 - protein, 6 aa, Mycobacterium
VSAGRS

SEQ ID NO: 1233759 - protein, 4 aa, Mycobacterium
VSAH

SEQ ID NO: 1233760 - protein, 12 aa, Mycobacterium
VSAKEGADIEYS

SEQ ID NO: 1233761 - protein, 7 aa, Mycobacterium
VSAKTGT

SEQ ID NO: 1233762 - protein, 8 aa, Mycobacterium
VSAPADAV

SEQ ID NO: 1233763 - protein, 7 aa, Mycobacterium
VSAPPPV

SEQ ID NO: 1233764 - protein, 8 aa, Mycobacterium
VSAPPYDT

SEQ ID NO: 1233765 - protein, 9 aa, Mycobacterium
VSAPRSRAD

SEQ ID NO: 1233766 - protein, 13 aa, Mycobacterium
VSAPTRNTSGPDW

SEQ ID NO: 1233767 - protein, 12 aa, Mycobacterium
VSARDQQQKDGQ

SEQ ID NO: 1233768 - protein, 11 aa, Mycobacterium
VSARDTAGRTR

SEQ ID NO: 1233769 - protein, 13 aa, Mycobacterium
VSARESHGGEGRI

SEQ ID NO: 1233770 - protein, 8 aa, Mycobacterium
VSARRDAQ

SEQ ID NO: 1233771 - protein, 7 aa, Mycobacterium
VSARTGA

SEQ ID NO: 1233772 - protein, 4 aa, Mycobacterium
VSAS

SEQ ID NO: 1233773 - protein, 8 aa, Mycobacterium
VSASGDRL

SEQ ID NO: 1233774 - protein, 11 aa, Mycobacterium
VSASGPDGVVT

SEQ ID NO: 1233775 - protein, 15 aa, Mycobacterium
VSASPADGHPSRCPG

SEQ ID NO: 1233776 - protein, 11 aa, Mycobacterium
VSASPGDDSTA

SEQ ID NO: 1233777 - protein, 14 aa, Mycobacterium
VSASSSPGRKRFRP

SEQ ID NO: 1233778 - protein, 4 aa, Mycobacterium
VSAY

SEQ ID NO: 1233779 - protein, 20 aa, Mycobacterium
VSCGPSNRSRTSRQTDSEAA

SEQ ID NO: 1233780 - protein, 5 aa, Mycobacterium
VSDAE

SEQ ID NO: 1233781 - protein, 21 aa, Mycobacterium
VSDARSSVNGSTAVPNSDGSV

SEQ ID NO: 1233782 - protein, 9 aa, Mycobacterium
VSDDDPEFA

SEQ ID NO: 1233783 - protein, 9 aa, Mycobacterium
VSDDEATTA

SEQ ID NO: 1233784 - protein, 8 aa, Mycobacterium
VSDDELPS

SEQ ID NO: 1233785 - protein, 11 aa, Mycobacterium
VSDDTGVSSSG

SEQ ID NO: 1233786 - protein, 8 aa, Mycobacterium
VSDDYATR

SEQ ID NO: 1233787 - protein, 18 aa, Mycobacterium
VSDEAACGASSSTCAYAA

SEQ ID NO: 1233788 - protein, 16 aa, Mycobacterium
VSDEDVEDDPTPHGSL

SEQ ID NO: 1233789 - protein, 11 aa, Mycobacterium
VSDEEEREASR

SEQ ID NO: 1233790 - protein, 16 aa, Mycobacterium
VSDEHRDAFAGTEKGK

SEQ ID NO: 1233791 - protein, 17 aa, Mycobacterium
VSDEHRDAFAGTSKGDT

SEQ ID NO: 1233792 - protein, 7 aa, Mycobacterium
VSDESGN

SEQ ID NO: 1233793 - protein, 8 aa, Mycobacterium
VSDGPTAI

SEQ ID NO: 1233794 - protein, 10 aa, Mycobacterium
VSDGTPAQRL

SEQ ID NO: 1233795 - protein, 8 aa, Mycobacterium
VSDIATGA

SEQ ID NO: 1233796 - protein, 8 aa, Mycobacterium
VSDPDTPS

SEQ ID NO: 1233797 - protein, 13 aa, Mycobacterium
VSDPESAKGMAAQ

SEQ ID NO: 1233798 - protein, 7 aa, Mycobacterium
VSDPETI

SEQ ID NO: 1233799 - protein, 7 aa, Mycobacterium
VSDPHTR

SEQ ID NO: 1233800 - protein, 19 aa, Mycobacterium
VSDRDSADAAAAQAAALTG

SEQ ID NO: 1233801 - protein, 8 aa, Mycobacterium
VSDRSGQI

SEQ ID NO: 1233802 - protein, 17 aa, Mycobacterium
VSDRTAAAATALREGIY

SEQ ID NO: 1233803 - protein, 16 aa, Mycobacterium
VSDTPVSNAGNGYPDA

SEQ ID NO: 1233804 - protein, 15 aa, Mycobacterium
VSEAAAGVPPTPEGE

SEQ ID NO: 1233805 - protein, 12 aa, Mycobacterium
VSEARSRDMKKD

SEQ ID NO: 1233806 - protein, 5 aa, Mycobacterium
VSEDE

SEQ ID NO: 1233807 - protein, 7 aa, Mycobacterium
VSEDKQN

SEQ ID NO: 1233808 - protein, 7 aa, Mycobacterium
VSEDKRN

SEQ ID NO: 1233809 - protein, 9 aa, Mycobacterium
VSEEVQGGF

SEQ ID NO: 1233810 - protein, 12 aa, Mycobacterium
VSEGSTLPIPAR

SEQ ID NO: 1233811 - protein, 9 aa, Mycobacterium
VSENPGEGT

SEQ ID NO: 1233812 - protein, 15 aa, Mycobacterium
VSEPGGPVTAGVSTG

SEQ ID NO: 1233813 - protein, 28 aa, Mycobacterium
VSEPHAASVTTNDAAQVTSATEEGRRSE

SEQ ID NO: 1233814 - protein, 4 aa, Mycobacterium
VSER

SEQ ID NO: 1233815 - protein, 7 aa, Mycobacterium
VSESDVA

SEQ ID NO: 1233816 - protein, 7 aa, Mycobacterium
VSESGDL

SEQ ID NO: 1233817 - protein, 5 aa, Mycobacterium
VSESP

SEQ ID NO: 1233818 - protein, 4 aa, Mycobacterium
VSET

SEQ ID NO: 1233819 - protein, 11 aa, Mycobacterium
VSGAATATGAA

SEQ ID NO: 1233820 - protein, 9 aa, Mycobacterium
VSGAEGPVK

SEQ ID NO: 1233821 - protein, 8 aa, Mycobacterium
VSGAERRR

SEQ ID NO: 1233822 - protein, 6 aa, Mycobacterium
VSGAVS

SEQ ID NO: 1233823 - protein, 12 aa, Mycobacterium
VSGDLRSGLLIA

SEQ ID NO: 1233824 - protein, 4 aa, Mycobacterium
VSGE

SEQ ID NO: 1233825 - protein, 6 aa, Mycobacterium
VSGEEL

SEQ ID NO: 1233826 - protein, 9 aa, Mycobacterium
VSGERQGYY

SEQ ID NO: 1233827 - protein, 5 aa, Mycobacterium
VSGGA

SEQ ID NO: 1233828 - protein, 12 aa, Mycobacterium
VSGGAEPPETPE

SEQ ID NO: 1233829 - protein, 11 aa, Mycobacterium
VSGGAGGLGEA

SEQ ID NO: 1233830 - protein, 12 aa, Mycobacterium
VSGGANGNDTDM

SEQ ID NO: 1233831 - protein, 9 aa, Mycobacterium
VSGGEEVSA

SEQ ID NO: 1233832 - protein, 7 aa, Mycobacterium
VSGGEVA

SEQ ID NO: 1233833 - protein, 7 aa, Mycobacterium
VSGGHVG

SEQ ID NO: 1233834 - protein, 25 aa, Mycobacterium
VSGGNGPTGGGRAEVHRRGRARTRA

SEQ ID NO: 1233835 - protein, 9 aa, Mycobacterium
VSGGRYPAK

SEQ ID NO: 1233836 - protein, 8 aa, Mycobacterium
VSGGYTRD

SEQ ID NO: 1233837 - protein, 13 aa, Mycobacterium
VSGKEDANGGGRV

SEQ ID NO: 1233838 - protein, 9 aa, Mycobacterium
VSGLKSYGA

SEQ ID NO: 1233839 - protein, 8 aa, Mycobacterium
VSGNAVRP

SEQ ID NO: 1233840 - protein, 12 aa, Mycobacterium
VSGPADREQERY

SEQ ID NO: 1233841 - protein, 9 aa, Mycobacterium
VSGPHSDAT

SEQ ID NO: 1233842 - protein, 6 aa, Mycobacterium
VSGPNG

SEQ ID NO: 1233843 - protein, 6 aa, Mycobacterium
VSGPSG

SEQ ID NO: 1233844 - protein, 10 aa, Mycobacterium
VSGPTGRSTV

SEQ ID NO: 1233845 - protein, 22 aa, Mycobacterium
VSGRGGRQMSPMGGSSSGADTI

SEQ ID NO: 1233846 - protein, 10 aa, Mycobacterium
VSGRKGEYVR

SEQ ID NO: 1233847 - protein, 9 aa, Mycobacterium
VSGRRPAPC

SEQ ID NO: 1233848 - protein, 9 aa, Mycobacterium
VSGSARTAE

SEQ ID NO: 1233849 - protein, 7 aa, Mycobacterium
VSGSDPT

SEQ ID NO: 1233850 - protein, 7 aa, Mycobacterium
VSGSGPT

SEQ ID NO: 1233851 - protein, 10 aa, Mycobacterium
VSGSLGSDER

SEQ ID NO: 1233852 - protein, 8 aa, Mycobacterium
VSGSPLVT

SEQ ID NO: 1233853 - protein, 9 aa, Mycobacterium
VSGSVPPTV

SEQ ID NO: 1233854 - protein, 10 aa, Mycobacterium
VSGTDGDSRG

SEQ ID NO: 1233855 - protein, 8 aa, Mycobacterium
VSGTEIDN

SEQ ID NO: 1233856 - protein, 7 aa, Mycobacterium
VSGTESD

SEQ ID NO: 1233857 - protein, 14 aa, Mycobacterium
VSGTQLRNAAGSNG

SEQ ID NO: 1233858 - protein, 13 aa, Mycobacterium
VSGTQVDTAYEGT

SEQ ID NO: 1233859 - protein, 11 aa, Mycobacterium
VSHPGGRPTEA

SEQ ID NO: 1233860 - protein, 9 aa, Mycobacterium
VSIGGGSVT

SEQ ID NO: 1233861 - protein, 10 aa, Mycobacterium
VSIGTPPAGL

SEQ ID NO: 1233862 - protein, 14 aa, Mycobacterium
VSINSGGEKIYPEE

SEQ ID NO: 1233863 - protein, 14 aa, Mycobacterium
VSIPGQARNFRPPR

SEQ ID NO: 1233864 - protein, 8 aa, Mycobacterium
VSKPGGQE

SEQ ID NO: 1233865 - protein, 6 aa, Mycobacterium
VSKQCP

SEQ ID NO: 1233866 - protein, 16 aa, Mycobacterium
VSKSQVAQECGASRQS

SEQ ID NO: 1233867 - protein, 4 aa, Mycobacterium
VSKT

SEQ ID NO: 1233868 - protein, 5 aa, Mycobacterium
VSKTN

SEQ ID NO: 1233869 - protein, 4 aa, Mycobacterium
VSLD

SEQ ID NO: 1233870 - protein, 7 aa, Mycobacterium
VSLGDGS

SEQ ID NO: 1233871 - protein, 8 aa, Mycobacterium
VSLPTRED

SEQ ID NO: 1233872 - protein, 8 aa, Mycobacterium
VSMDGSKT

SEQ ID NO: 1233873 - protein, 7 aa, Mycobacterium
VSNDPKE

SEQ ID NO: 1233874 - protein, 12 aa, Mycobacterium
VSNGGELGAESS

SEQ ID NO: 1233875 - protein, 14 aa, Mycobacterium
VSNGSLATAADFPG

SEQ ID NO: 1233876 - protein, 11 aa, Mycobacterium
VSNPDKAGRDV

SEQ ID NO: 1233877 - protein, 8 aa, Mycobacterium
VSNPEAVT

SEQ ID NO: 1233878 - protein, 4 aa, Mycobacterium
VSNR

SEQ ID NO: 1233879 - protein, 10 aa, Mycobacterium
VSNREAATGI

SEQ ID NO: 1233880 - protein, 4 aa, Mycobacterium
VSPA

SEQ ID NO: 1233881 - protein, 7 aa, Mycobacterium
VSPADAD

SEQ ID NO: 1233882 - protein, 18 aa, Mycobacterium
VSPAKLQTGEYRQISGNT

SEQ ID NO: 1233883 - protein, 24 aa, Mycobacterium
VSPASDGGAVSPASDGGAVDPASD

SEQ ID NO: 1233884 - protein, 8 aa, Mycobacterium
VSPASKAV

SEQ ID NO: 1233885 - protein, 21 aa, Mycobacterium
VSPATPAAAAPTGAGIGGGGA

SEQ ID NO: 1233886 - protein, 10 aa, Mycobacterium
VSPDDPSSWT

SEQ ID NO: 1233887 - protein, 17 aa, Mycobacterium
VSPDGKRVYAGRDAQDR

SEQ ID NO: 1233888 - protein, 7 aa, Mycobacterium
VSPDGTR

SEQ ID NO: 1233889 - protein, 7 aa, Mycobacterium
VSPDRYP

SEQ ID NO: 1233890 - protein, 10 aa, Mycobacterium
VSPDYADNTK

SEQ ID NO: 1233891 - protein, 9 aa, Mycobacterium
VSPEAGRRL

SEQ ID NO: 1233892 - protein, 19 aa, Mycobacterium
VSPEQAAPGVRDATVPGRL

SEQ ID NO: 1233893 - protein, 6 aa, Mycobacterium
VSPEQD

SEQ ID NO: 1233894 - protein, 6 aa, Mycobacterium
VSPETW

SEQ ID NO: 1233895 - protein, 6 aa, Mycobacterium
VSPEVA

SEQ ID NO: 1233896 - protein, 10 aa, Mycobacterium
VSPGAIDTPA

SEQ ID NO: 1233897 - protein, 7 aa, Mycobacterium
VSPGAPY

SEQ ID NO: 1233898 - protein, 6 aa, Mycobacterium
VSPGNP

SEQ ID NO: 1233899 - protein, 15 aa, Mycobacterium
VSPGRQAELTAGETR

SEQ ID NO: 1233900 - protein, 9 aa, Mycobacterium
VSPNGDGGA

SEQ ID NO: 1233901 - protein, 9 aa, Mycobacterium
VSPNPHAEP

SEQ ID NO: 1233902 - protein, 9 aa, Mycobacterium
VSPPAEDRG

SEQ ID NO: 1233903 - protein, 9 aa, Mycobacterium
VSPPGSNRE

SEQ ID NO: 1233904 - protein, 9 aa, Mycobacterium
VSPPPPTAP

SEQ ID NO: 1233905 - protein, 14 aa, Mycobacterium
VSPPPSTTSGPDGW

SEQ ID NO: 1233906 - protein, 5 aa, Mycobacterium
VSPQA

SEQ ID NO: 1233907 - protein, 9 aa, Mycobacterium
VSPQNAQAL

SEQ ID NO: 1233908 - protein, 8 aa, Mycobacterium
VSPRGATA

SEQ ID NO: 1233909 - protein, 7 aa, Mycobacterium
VSPRGGV

SEQ ID NO: 1233910 - protein, 9 aa, Mycobacterium
VSPRGKRQF

SEQ ID NO: 1233911 - protein, 4 aa, Mycobacterium
VSPS

SEQ ID NO: 1233912 - protein, 6 aa, Mycobacterium
VSPSFD

SEQ ID NO: 1233913 - protein, 5 aa, Mycobacterium
VSPSN

SEQ ID NO: 1233914 - protein, 9 aa, Mycobacterium
VSPSPVSDT

SEQ ID NO: 1233915 - protein, 5 aa, Mycobacterium
VSPST

SEQ ID NO: 1233916 - protein, 4 aa, Mycobacterium
VSPT

SEQ ID NO: 1233917 - protein, 6 aa, Mycobacterium
VSPTGQ

SEQ ID NO: 1233918 - protein, 6 aa, Mycobacterium
VSPTGR

SEQ ID NO: 1233919 - protein, 17 aa, Mycobacterium
VSPTQKSAGSLRQVTPD

SEQ ID NO: 1233920 - protein, 4 aa, Mycobacterium
VSPV

SEQ ID NO: 1233921 - protein, 14 aa, Mycobacterium
VSPYPHSSPSQCGR

SEQ ID NO: 1233922 - protein, 5 aa, Mycobacterium
VSQDD

SEQ ID NO: 1233923 - protein, 18 aa, Mycobacterium
VSQESAATAEPDAADTAG

SEQ ID NO: 1233924 - protein, 6 aa, Mycobacterium
VSQKAV

SEQ ID NO: 1233925 - protein, 81 aa, Mycobacterium
VSQPSAPLGAPAPAAQPAPPPAPAQPSVPAAASSATAGPGLSGGGFGGAAAGGPPAGSAPTSPPVPLGPPTTPAPPAPPHL

SEQ ID NO: 1233926 - protein, 6 aa, Mycobacterium
VSQPTV

SEQ ID NO: 1233927 - protein, 6 aa, Mycobacterium
VSRAGG

SEQ ID NO: 1233928 - protein, 5 aa, Mycobacterium
VSRAQ

SEQ ID NO: 1233929 - protein, 5 aa, Mycobacterium
VSRAT

SEQ ID NO: 1233930 - protein, 5 aa, Mycobacterium
VSRDA

SEQ ID NO: 1233931 - protein, 6 aa, Mycobacterium
VSRDAE

SEQ ID NO: 1233932 - protein, 8 aa, Mycobacterium
VSRDEAGK

SEQ ID NO: 1233933 - protein, 7 aa, Mycobacterium
VSREAGL

SEQ ID NO: 1233934 - protein, 8 aa, Mycobacterium
VSREASAP

SEQ ID NO: 1233935 - protein, 10 aa, Mycobacterium
VSRELSPSYT

SEQ ID NO: 1233936 - protein, 11 aa, Mycobacterium
VSRGGMEATSA

SEQ ID NO: 1233937 - protein, 6 aa, Mycobacterium
VSRGRL

SEQ ID NO: 1233938 - protein, 8 aa, Mycobacterium
VSRGSSGD

SEQ ID NO: 1233939 - protein, 4 aa, Mycobacterium
VSRP

SEQ ID NO: 1233940 - protein, 5 aa, Mycobacterium
VSRPG

SEQ ID NO: 1233941 - protein, 11 aa, Mycobacterium
VSRPGTPLHDP

SEQ ID NO: 1233942 - protein, 17 aa, Mycobacterium
VSRQTAPVSPAPVTSGA

SEQ ID NO: 1233943 - protein, 8 aa, Mycobacterium
VSRRRGPQ

SEQ ID NO: 1233944 - protein, 11 aa, Mycobacterium
VSRSRTVSAES

SEQ ID NO: 1233945 - protein, 6 aa, Mycobacterium
VSRSSL

SEQ ID NO: 1233946 - protein, 5 aa, Mycobacterium
VSRTQ

SEQ ID NO: 1233947 - protein, 17 aa, Mycobacterium
VSRTSGRVGDEMRRLYG

SEQ ID NO: 1233948 - protein, 7 aa, Mycobacterium
VSSAAEL

SEQ ID NO: 1233949 - protein, 7 aa, Mycobacterium
VSSANGR

SEQ ID NO: 1233950 - protein, 7 aa, Mycobacterium
VSSAPEL

SEQ ID NO: 1233951 - protein, 4 aa, Mycobacterium
VSSF

SEQ ID NO: 1233952 - protein, 18 aa, Mycobacterium
VSSGSAEQMDVTSPTTGK

SEQ ID NO: 1233953 - protein, 4 aa, Mycobacterium
VSSL

SEQ ID NO: 1233954 - protein, 4 aa, Mycobacterium
VSSN

SEQ ID NO: 1233955 - protein, 12 aa, Mycobacterium
VSSNSWEYTGDG

SEQ ID NO: 1233956 - protein, 8 aa, Mycobacterium
VSSPAEEA

SEQ ID NO: 1233957 - protein, 7 aa, Mycobacterium
VSSPAQA

SEQ ID NO: 1233958 - protein, 10 aa, Mycobacterium
VSSPISEPAA

SEQ ID NO: 1233959 - protein, 4 aa, Mycobacterium
VSSR

SEQ ID NO: 1233960 - protein, 9 aa, Mycobacterium
VSSRDEEVG

SEQ ID NO: 1233961 - protein, 9 aa, Mycobacterium
VSSRDEQIG

SEQ ID NO: 1233962 - protein, 18 aa, Mycobacterium
VSSRGEAVAEAKRVGLIA

SEQ ID NO: 1233963 - protein, 10 aa, Mycobacterium
VSSRGRRDIP

SEQ ID NO: 1233964 - protein, 5 aa, Mycobacterium
VSSRR

SEQ ID NO: 1233965 - protein, 7 aa, Mycobacterium
VSSSAAN

SEQ ID NO: 1233966 - protein, 16 aa, Mycobacterium
VSSSGSSVAKGESLRD

SEQ ID NO: 1233967 - protein, 7 aa, Mycobacterium
VSSSKDD

SEQ ID NO: 1233968 - protein, 17 aa, Mycobacterium
VSSSTTAPSTAAMPGHD

SEQ ID NO: 1233969 - protein, 12 aa, Mycobacterium
VSSTAGAGIDPV

SEQ ID NO: 1233970 - protein, 8 aa, Mycobacterium
VSSTSRAA

SEQ ID NO: 1233971 - protein, 4 aa, Mycobacterium
VSTA

SEQ ID NO: 1233972 - protein, 7 aa, Mycobacterium
VSTAEEQ

SEQ ID NO: 1233973 - protein, 14 aa, Mycobacterium
VSTDAKVGRDAGEL

SEQ ID NO: 1233974 - protein, 10 aa, Mycobacterium
VSTDASGRYT

SEQ ID NO: 1233975 - protein, 14 aa, Mycobacterium
VSTDKSTDRITGNE

SEQ ID NO: 1233976 - protein, 9 aa, Mycobacterium
VSTDRTDLE

SEQ ID NO: 1233977 - protein, 7 aa, Mycobacterium
VSTEGNR

SEQ ID NO: 1233978 - protein, 7 aa, Mycobacterium
VSTGATE

SEQ ID NO: 1233979 - protein, 7 aa, Mycobacterium
VSTKSID

SEQ ID NO: 1233980 - protein, 4 aa, Mycobacterium
VSTN

SEQ ID NO: 1233981 - protein, 14 aa, Mycobacterium
VSTPDKAELSRRAG

SEQ ID NO: 1233982 - protein, 6 aa, Mycobacterium
VSTPQQ

SEQ ID NO: 1233983 - protein, 6 aa, Mycobacterium
VSTPSG

SEQ ID NO: 1233984 - protein, 6 aa, Mycobacterium
VSTPTG

SEQ ID NO: 1233985 - protein, 4 aa, Mycobacterium
VSTQ

SEQ ID NO: 1233986 - protein, 6 aa, Mycobacterium
VSTQPA

SEQ ID NO: 1233987 - protein, 7 aa, Mycobacterium
VSTQSAL

SEQ ID NO: 1233988 - protein, 7 aa, Mycobacterium
VSTRTAA

SEQ ID NO: 1233989 - protein, 4 aa, Mycobacterium
VSVD

SEQ ID NO: 1233990 - protein, 11 aa, Mycobacterium
VSVDGQPRPLP

SEQ ID NO: 1233991 - protein, 7 aa, Mycobacterium
VSVPPQA

SEQ ID NO: 1233992 - protein, 9 aa, Mycobacterium
VSVSPDGRS

SEQ ID NO: 1233993 - protein, 4 aa, Mycobacterium
VSYA

SEQ ID NO: 1233994 - protein, 14 aa, Mycobacterium
VSYPDGEGRAVPDR

SEQ ID NO: 1233995 - protein, 9 aa, Mycobacterium
VSYRPGARF

SEQ ID NO: 1233996 - protein, 11 aa, Mycobacterium
VSYRPGARFGP

SEQ ID NO: 1233997 - protein, 14 aa, Mycobacterium
VTAAASARTESRGC

SEQ ID NO: 1233998 - protein, 18 aa, Mycobacterium
VTAAETEAEQVSRRRGAY

SEQ ID NO: 1233999 - protein, 17 aa, Mycobacterium
VTAAGNPTLAAGPAAAH

SEQ ID NO: 1234000 - protein, 5 aa, Mycobacterium
VTAAN

SEQ ID NO: 1234001 - protein, 9 aa, Mycobacterium
VTAATGVNR

SEQ ID NO: 1234002 - protein, 9 aa, Mycobacterium
VTADGRRAE

SEQ ID NO: 1234003 - protein, 7 aa, Mycobacterium
VTADGSL

SEQ ID NO: 1234004 - protein, 18 aa, Mycobacterium
VTADMTGRYEQEVDTTHA

SEQ ID NO: 1234005 - protein, 7 aa, Mycobacterium
VTADPAA

SEQ ID NO: 1234006 - protein, 12 aa, Mycobacterium
VTADPAGASTVS

SEQ ID NO: 1234007 - protein, 7 aa, Mycobacterium
VTADPEL

SEQ ID NO: 1234008 - protein, 12 aa, Mycobacterium
VTADPHQAADGA

SEQ ID NO: 1234009 - protein, 8 aa, Mycobacterium
VTADPSDE

SEQ ID NO: 1234010 - protein, 10 aa, Mycobacterium
VTAEESGKAC

SEQ ID NO: 1234011 - protein, 10 aa, Mycobacterium
VTAEQVDAAA

SEQ ID NO: 1234012 - protein, 5 aa, Mycobacterium
VTAES

SEQ ID NO: 1234013 - protein, 4 aa, Mycobacterium
VTAG

SEQ ID NO: 1234014 - protein, 17 aa, Mycobacterium
VTAGEFPATVDPETASV

SEQ ID NO: 1234015 - protein, 6 aa, Mycobacterium
VTAGGA

SEQ ID NO: 1234016 - protein, 17 aa, Mycobacterium
VTAGKGDPVTVTGRPEE

SEQ ID NO: 1234017 - protein, 6 aa, Mycobacterium
VTAGRY

SEQ ID NO: 1234018 - protein, 6 aa, Mycobacterium
VTAGSG

SEQ ID NO: 1234019 - protein, 9 aa, Mycobacterium
VTAGTDGAP

SEQ ID NO: 1234020 - protein, 10 aa, Mycobacterium
VTAKGENADD

SEQ ID NO: 1234021 - protein, 8 aa, Mycobacterium
VTANRDAQ

SEQ ID NO: 1234022 - protein, 9 aa, Mycobacterium
VTANTRADA

SEQ ID NO: 1234023 - protein, 6 aa, Mycobacterium
VTAPDL

SEQ ID NO: 1234024 - protein, 6 aa, Mycobacterium
VTAPPL

SEQ ID NO: 1234025 - protein, 5 aa, Mycobacterium
VTAPR

SEQ ID NO: 1234026 - protein, 7 aa, Mycobacterium
VTAPRRA

SEQ ID NO: 1234027 - protein, 12 aa, Mycobacterium
VTAQAQPGNPAP

SEQ ID NO: 1234028 - protein, 24 aa, Mycobacterium
VTAQLGGARPTSWPHTVGKGPDRD

SEQ ID NO: 1234029 - protein, 12 aa, Mycobacterium
VTARDKRGRDEL

SEQ ID NO: 1234030 - protein, 18 aa, Mycobacterium
VTARDREVTNRFTKDGQI

SEQ ID NO: 1234031 - protein, 7 aa, Mycobacterium
VTARQGD

SEQ ID NO: 1234032 - protein, 7 aa, Mycobacterium
VTARRGD

SEQ ID NO: 1234033 - protein, 6 aa, Mycobacterium
VTASAI

SEQ ID NO: 1234034 - protein, 15 aa, Mycobacterium
VTASPERRGHLDEDR

SEQ ID NO: 1234035 - protein, 9 aa, Mycobacterium
VTASPPSQR

SEQ ID NO: 1234036 - protein, 10 aa, Mycobacterium
VTASQHRSPD

SEQ ID NO: 1234037 - protein, 10 aa, Mycobacterium
VTASRASRVP

SEQ ID NO: 1234038 - protein, 12 aa, Mycobacterium
VTATDPEGDSLT

SEQ ID NO: 1234039 - protein, 10 aa, Mycobacterium
VTATDSDGDD

SEQ ID NO: 1234040 - protein, 11 aa, Mycobacterium
VTATTADGRTV

SEQ ID NO: 1234041 - protein, 9 aa, Mycobacterium
VTATTDEQG

SEQ ID NO: 1234042 - protein, 7 aa, Mycobacterium
VTDAESA

SEQ ID NO: 1234043 - protein, 8 aa, Mycobacterium
VTDAGATR

SEQ ID NO: 1234044 - protein, 15 aa, Mycobacterium
VTDAQRAAQDAVRSA

SEQ ID NO: 1234045 - protein, 10 aa, Mycobacterium
VTDATPDLAA

SEQ ID NO: 1234046 - protein, 11 aa, Mycobacterium
VTDDEAGAVAD

SEQ ID NO: 1234047 - protein, 13 aa, Mycobacterium
VTDDEGIRRGTTV

SEQ ID NO: 1234048 - protein, 5 aa, Mycobacterium
VTDEA

SEQ ID NO: 1234049 - protein, 7 aa, Mycobacterium
VTDEDSV

SEQ ID NO: 1234050 - protein, 9 aa, Mycobacterium
VTDEDVDAE

SEQ ID NO: 1234051 - protein, 6 aa, Mycobacterium
VTDEKA

SEQ ID NO: 1234052 - protein, 7 aa, Mycobacterium
VTDETGV

SEQ ID NO: 1234053 - protein, 8 aa, Mycobacterium
VTDGPESA

SEQ ID NO: 1234054 - protein, 11 aa, Mycobacterium
VTDGQAETCDR

SEQ ID NO: 1234055 - protein, 6 aa, Mycobacterium
VTDHDS

SEQ ID NO: 1234056 - protein, 8 aa, Mycobacterium
VTDKYGPG

SEQ ID NO: 1234057 - protein, 12 aa, Mycobacterium
VTDPELGPVRQP

SEQ ID NO: 1234058 - protein, 11 aa, Mycobacterium
VTDPGAPAAEA

SEQ ID NO: 1234059 - protein, 8 aa, Mycobacterium
VTDPGSLQ

SEQ ID NO: 1234060 - protein, 5 aa, Mycobacterium
VTDRA

SEQ ID NO: 1234061 - protein, 6 aa, Mycobacterium
VTDRAA

SEQ ID NO: 1234062 - protein, 13 aa, Mycobacterium
VTDSASDAVSTRA

SEQ ID NO: 1234063 - protein, 17 aa, Mycobacterium
VTDSEGKKFGKSTGGGS

SEQ ID NO: 1234064 - protein, 9 aa, Mycobacterium
VTDTGTSIS

SEQ ID NO: 1234065 - protein, 9 aa, Mycobacterium
VTDTKRTYT

SEQ ID NO: 1234066 - protein, 10 aa, Mycobacterium
VTDTSGNPVA

SEQ ID NO: 1234067 - protein, 20 aa, Mycobacterium
VTDTVTNRRESAAKTTAPKL

SEQ ID NO: 1234068 - protein, 12 aa, Mycobacterium
VTEAAAGQPVHT

SEQ ID NO: 1234069 - protein, 14 aa, Mycobacterium
VTEADQPERARAAG

SEQ ID NO: 1234070 - protein, 7 aa, Mycobacterium
VTEAGGT

SEQ ID NO: 1234071 - protein, 10 aa, Mycobacterium
VTEARGGPLG

SEQ ID NO: 1234072 - protein, 17 aa, Mycobacterium
VTEERPADDVHANHVGA

SEQ ID NO: 1234073 - protein, 14 aa, Mycobacterium
VTEEYPEKPGPVAK

SEQ ID NO: 1234074 - protein, 13 aa, Mycobacterium
VTEGGSGDGPDDT

SEQ ID NO: 1234075 - protein, 8 aa, Mycobacterium
VTEPGQAL

SEQ ID NO: 1234076 - protein, 6 aa, Mycobacterium
VTEPLS

SEQ ID NO: 1234077 - protein, 11 aa, Mycobacterium
VTEPNPEQPEL

SEQ ID NO: 1234078 - protein, 8 aa, Mycobacterium
VTERPKST

SEQ ID NO: 1234079 - protein, 7 aa, Mycobacterium
VTERQAK

SEQ ID NO: 1234080 - protein, 7 aa, Mycobacterium
VTERRER

SEQ ID NO: 1234081 - protein, 10 aa, Mycobacterium
VTERTLSNRS

SEQ ID NO: 1234082 - protein, 7 aa, Mycobacterium
VTESGLT

SEQ ID NO: 1234083 - protein, 5 aa, Mycobacterium
VTESH

SEQ ID NO: 1234084 - protein, 65 aa, Mycobacterium
VTETDSATTEVDSATEVPAAEPEETPTAPAEEAPVEEAPAEERADTSAEDGAVQGDAEVTDGEPV

SEQ ID NO: 1234085 - protein, 5 aa, Mycobacterium
VTETE

SEQ ID NO: 1234086 - protein, 7 aa, Mycobacterium
VTETGKQ

SEQ ID NO: 1234087 - protein, 7 aa, Mycobacterium
VTEVGPA

SEQ ID NO: 1234088 - protein, 4 aa, Mycobacterium
VTGA

SEQ ID NO: 1234089 - protein, 10 aa, Mycobacterium
VTGAASDGGF

SEQ ID NO: 1234090 - protein, 7 aa, Mycobacterium
VTGADAA

SEQ ID NO: 1234091 - protein, 12 aa, Mycobacterium
VTGAEGGSRSAM

SEQ ID NO: 1234092 - protein, 7 aa, Mycobacterium
VTGAPGI

SEQ ID NO: 1234093 - protein, 4 aa, Mycobacterium
VTGD

SEQ ID NO: 1234094 - protein, 5 aa, Mycobacterium
VTGDD

SEQ ID NO: 1234095 - protein, 10 aa, Mycobacterium
VTGDEPVGPH

SEQ ID NO: 1234096 - protein, 7 aa, Mycobacterium
VTGDIAP

SEQ ID NO: 1234097 - protein, 10 aa, Mycobacterium
VTGDPQRGLR

SEQ ID NO: 1234098 - protein, 11 aa, Mycobacterium
VTGEAEDTYAE

SEQ ID NO: 1234099 - protein, 6 aa, Mycobacterium
VTGEDV

SEQ ID NO: 1234100 - protein, 9 aa, Mycobacterium
VTGEPVPEG

SEQ ID NO: 1234101 - protein, 11 aa, Mycobacterium
VTGETDGKKEI

SEQ ID NO: 1234102 - protein, 9 aa, Mycobacterium
VTGGDGRIP

SEQ ID NO: 1234103 - protein, 10 aa, Mycobacterium
VTGGEKVDPG

SEQ ID NO: 1234104 - protein, 20 aa, Mycobacterium
VTGGGAPYGLPAGSGSGAQF

SEQ ID NO: 1234105 - protein, 11 aa, Mycobacterium
VTGGGRPEGLD

SEQ ID NO: 1234106 - protein, 6 aa, Mycobacterium
VTGGPL

SEQ ID NO: 1234107 - protein, 9 aa, Mycobacterium
VTGGSRGIG

SEQ ID NO: 1234108 - protein, 20 aa, Mycobacterium
VTGGSTAQTLKTNAFRMLQT

SEQ ID NO: 1234109 - protein, 10 aa, Mycobacterium
VTGKPLPAPI

SEQ ID NO: 1234110 - protein, 5 aa, Mycobacterium
VTGPG

SEQ ID NO: 1234111 - protein, 8 aa, Mycobacterium
VTGPGGRS

SEQ ID NO: 1234112 - protein, 7 aa, Mycobacterium
VTGPGLT

SEQ ID NO: 1234113 - protein, 8 aa, Mycobacterium
VTGPHPDE

SEQ ID NO: 1234114 - protein, 5 aa, Mycobacterium
VTGPL

SEQ ID NO: 1234115 - protein, 8 aa, Mycobacterium
VTGPPAKG

SEQ ID NO: 1234116 - protein, 29 aa, Mycobacterium
VTGQRAERPDDSGADESGGTPAAESDPDA

SEQ ID NO: 1234117 - protein, 10 aa, Mycobacterium
VTGRDGGRDI

SEQ ID NO: 1234118 - protein, 11 aa, Mycobacterium
VTGRDGSGETL

SEQ ID NO: 1234119 - protein, 7 aa, Mycobacterium
VTGRGAG

SEQ ID NO: 1234120 - protein, 8 aa, Mycobacterium
VTGSTQGI

SEQ ID NO: 1234121 - protein, 10 aa, Mycobacterium
VTGTGPQGAV

SEQ ID NO: 1234122 - protein, 11 aa, Mycobacterium
VTGVRTGAGDI

SEQ ID NO: 1234123 - protein, 6 aa, Mycobacterium
VTGVSE

SEQ ID NO: 1234124 - protein, 9 aa, Mycobacterium
VTGYGPPAS

SEQ ID NO: 1234125 - protein, 4 aa, Mycobacterium
VTIN

SEQ ID NO: 1234126 - protein, 30 aa, Mycobacterium
VTISKSAKWERKPVKGAKQAGPPEFSGADP

SEQ ID NO: 1234127 - protein, 8 aa, Mycobacterium
VTITREPG

SEQ ID NO: 1234128 - protein, 7 aa, Mycobacterium
VTKGSGL

SEQ ID NO: 1234129 - protein, 8 aa, Mycobacterium
VTKSLGDN

SEQ ID NO: 1234130 - protein, 4 aa, Mycobacterium
VTLP

SEQ ID NO: 1234131 - protein, 10 aa, Mycobacterium
VTLTDGAGQV

SEQ ID NO: 1234132 - protein, 5 aa, Mycobacterium
VTNDL

SEQ ID NO: 1234133 - protein, 7 aa, Mycobacterium
VTNPAAR

SEQ ID NO: 1234134 - protein, 8 aa, Mycobacterium
VTNPAART

SEQ ID NO: 1234135 - protein, 9 aa, Mycobacterium
VTNPEGKRK

SEQ ID NO: 1234136 - protein, 6 aa, Mycobacterium
VTNPTS

SEQ ID NO: 1234137 - protein, 11 aa, Mycobacterium
VTNQAGGKGVN

SEQ ID NO: 1234138 - protein, 7 aa, Mycobacterium
VTNRPAG

SEQ ID NO: 1234139 - protein, 9 aa, Mycobacterium
VTNSGRSTP

SEQ ID NO: 1234140 - protein, 17 aa, Mycobacterium
VTNSPGAGRFAPSPSAD

SEQ ID NO: 1234141 - protein, 5 aa, Mycobacterium
VTPAA

SEQ ID NO: 1234142 - protein, 9 aa, Mycobacterium
VTPAQRSKR

SEQ ID NO: 1234143 - protein, 9 aa, Mycobacterium
VTPATTDLT

SEQ ID NO: 1234144 - protein, 5 aa, Mycobacterium
VTPAV

SEQ ID NO: 1234145 - protein, 5 aa, Mycobacterium
VTPDD

SEQ ID NO: 1234146 - protein, 6 aa, Mycobacterium
VTPDEI

SEQ ID NO: 1234147 - protein, 8 aa, Mycobacterium
VTPDELPS

SEQ ID NO: 1234148 - protein, 9 aa, Mycobacterium
VTPDPHAGS

SEQ ID NO: 1234149 - protein, 6 aa, Mycobacterium
VTPDQL

SEQ ID NO: 1234150 - protein, 6 aa, Mycobacterium
VTPELE

SEQ ID NO: 1234151 - protein, 6 aa, Mycobacterium
VTPERI

SEQ ID NO: 1234152 - protein, 11 aa, Mycobacterium
VTPESKAMAKE

SEQ ID NO: 1234153 - protein, 8 aa, Mycobacterium
VTPGAGTA

SEQ ID NO: 1234154 - protein, 10 aa, Mycobacterium
VTPGDVGEPY

SEQ ID NO: 1234155 - protein, 7 aa, Mycobacterium
VTPGNPV

SEQ ID NO: 1234156 - protein, 12 aa, Mycobacterium
VTPGSRCDGPVG

SEQ ID NO: 1234157 - protein, 5 aa, Mycobacterium
VTPGV

SEQ ID NO: 1234158 - protein, 16 aa, Mycobacterium
VTPIGDAGSVSRPDGI

SEQ ID NO: 1234159 - protein, 9 aa, Mycobacterium
VTPKGGVAR

SEQ ID NO: 1234160 - protein, 7 aa, Mycobacterium
VTPNDSG

SEQ ID NO: 1234161 - protein, 18 aa, Mycobacterium
VTPPAPPAAAPGAPIDAA

SEQ ID NO: 1234162 - protein, 10 aa, Mycobacterium
VTPPGPSVEA

SEQ ID NO: 1234163 - protein, 8 aa, Mycobacterium
VTPPKPLE

SEQ ID NO: 1234164 - protein, 9 aa, Mycobacterium
VTPPPNGVG

SEQ ID NO: 1234165 - protein, 5 aa, Mycobacterium
VTPRD

SEQ ID NO: 1234166 - protein, 6 aa, Mycobacterium
VTPRTA

SEQ ID NO: 1234167 - protein, 17 aa, Mycobacterium
VTPRTEAPLPPAPDDDY

SEQ ID NO: 1234168 - protein, 6 aa, Mycobacterium
VTPRTG

SEQ ID NO: 1234169 - protein, 7 aa, Mycobacterium
VTPRVDT

SEQ ID NO: 1234170 - protein, 5 aa, Mycobacterium
VTPSA

SEQ ID NO: 1234171 - protein, 11 aa, Mycobacterium
VTPSVGPDAAC

SEQ ID NO: 1234172 - protein, 7 aa, Mycobacterium
VTPTADE

SEQ ID NO: 1234173 - protein, 8 aa, Mycobacterium
VTPTADGS

SEQ ID NO: 1234174 - protein, 12 aa, Mycobacterium
VTPTDNGNRAVL

SEQ ID NO: 1234175 - protein, 19 aa, Mycobacterium
VTPVDSKGRFDASVPDYQG

SEQ ID NO: 1234176 - protein, 19 aa, Mycobacterium
VTQKDVRTAAPRHHPPEQI

SEQ ID NO: 1234177 - protein, 5 aa, Mycobacterium
VTQPT

SEQ ID NO: 1234178 - protein, 4 aa, Mycobacterium
VTRA

SEQ ID NO: 1234179 - protein, 18 aa, Mycobacterium
VTRADGGKTGVGRGYGGA

SEQ ID NO: 1234180 - protein, 6 aa, Mycobacterium
VTRDGD

SEQ ID NO: 1234181 - protein, 7 aa, Mycobacterium
VTRDGRP

SEQ ID NO: 1234182 - protein, 4 aa, Mycobacterium
VTRE

SEQ ID NO: 1234183 - protein, 7 aa, Mycobacterium
VTRETEG

SEQ ID NO: 1234184 - protein, 7 aa, Mycobacterium
VTRGQDT

SEQ ID NO: 1234185 - protein, 6 aa, Mycobacterium
VTRGRP

SEQ ID NO: 1234186 - protein, 11 aa, Mycobacterium
VTRGSEQEARH

SEQ ID NO: 1234187 - protein, 6 aa, Mycobacterium
VTRRGA

SEQ ID NO: 1234188 - protein, 11 aa, Mycobacterium
VTRRGGGAALP

SEQ ID NO: 1234189 - protein, 10 aa, Mycobacterium
VTRRGGRDGD

SEQ ID NO: 1234190 - protein, 6 aa, Mycobacterium
VTRRRA

SEQ ID NO: 1234191 - protein, 8 aa, Mycobacterium
VTRSGTSI

SEQ ID NO: 1234192 - protein, 8 aa, Mycobacterium
VTRSRRGQ

SEQ ID NO: 1234193 - protein, 8 aa, Mycobacterium
VTRTAHDA

SEQ ID NO: 1234194 - protein, 7 aa, Mycobacterium
VTRTGQD

SEQ ID NO: 1234195 - protein, 7 aa, Mycobacterium
VTRTPSN

SEQ ID NO: 1234196 - protein, 4 aa, Mycobacterium
VTSA

SEQ ID NO: 1234197 - protein, 4 aa, Mycobacterium
VTSG

SEQ ID NO: 1234198 - protein, 7 aa, Mycobacterium
VTSGEAV

SEQ ID NO: 1234199 - protein, 10 aa, Mycobacterium
VTSGPALERA

SEQ ID NO: 1234200 - protein, 10 aa, Mycobacterium
VTSGPESVSA

SEQ ID NO: 1234201 - protein, 6 aa, Mycobacterium
VTSGPV

SEQ ID NO: 1234202 - protein, 5 aa, Mycobacterium
VTSGQ

SEQ ID NO: 1234203 - protein, 8 aa, Mycobacterium
VTSGQADA

SEQ ID NO: 1234204 - protein, 14 aa, Mycobacterium
VTSGRSQPDSLPTG

SEQ ID NO: 1234205 - protein, 21 aa, Mycobacterium
VTSGTVEVDGTRVDGASKAQL

SEQ ID NO: 1234206 - protein, 7 aa, Mycobacterium
VTSKDRA

SEQ ID NO: 1234207 - protein, 11 aa, Mycobacterium
VTSPAGTTAAG

SEQ ID NO: 1234208 - protein, 8 aa, Mycobacterium
VTSPARTA

SEQ ID NO: 1234209 - protein, 7 aa, Mycobacterium
VTSPGDT

SEQ ID NO: 1234210 - protein, 7 aa, Mycobacterium
VTSPGRL

SEQ ID NO: 1234211 - protein, 7 aa, Mycobacterium
VTSPPSG

SEQ ID NO: 1234212 - protein, 10 aa, Mycobacterium
VTSPRGVRTV

SEQ ID NO: 1234213 - protein, 4 aa, Mycobacterium
VTSS

SEQ ID NO: 1234214 - protein, 8 aa, Mycobacterium
VTSSEQRA

SEQ ID NO: 1234215 - protein, 10 aa, Mycobacterium
VTSSGVGGSS

SEQ ID NO: 1234216 - protein, 13 aa, Mycobacterium
VTSSKTGNLTTTT

SEQ ID NO: 1234217 - protein, 4 aa, Mycobacterium
VTST

SEQ ID NO: 1234218 - protein, 11 aa, Mycobacterium
VTSTSGPGVSL

SEQ ID NO: 1234219 - protein, 7 aa, Mycobacterium
VTSYADN

SEQ ID NO: 1234220 - protein, 4 aa, Mycobacterium
VTTA

SEQ ID NO: 1234221 - protein, 8 aa, Mycobacterium
VTTADGRG

SEQ ID NO: 1234222 - protein, 19 aa, Mycobacterium
VTTADGRTGVGWIEWNRSQ

SEQ ID NO: 1234223 - protein, 9 aa, Mycobacterium
VTTAERREH

SEQ ID NO: 1234224 - protein, 5 aa, Mycobacterium
VTTAN

SEQ ID NO: 1234225 - protein, 20 aa, Mycobacterium
VTTDHISPAGSIKKGTPAAQ

SEQ ID NO: 1234226 - protein, 9 aa, Mycobacterium
VTTEETAAW

SEQ ID NO: 1234227 - protein, 9 aa, Mycobacterium
VTTGAGLDT

SEQ ID NO: 1234228 - protein, 8 aa, Mycobacterium
VTTGDAEE

SEQ ID NO: 1234229 - protein, 10 aa, Mycobacterium
VTTGSRLARP

SEQ ID NO: 1234230 - protein, 7 aa, Mycobacterium
VTTGTGF

SEQ ID NO: 1234231 - protein, 6 aa, Mycobacterium
VTTKGG

SEQ ID NO: 1234232 - protein, 4 aa, Mycobacterium
VTTN

SEQ ID NO: 1234233 - protein, 8 aa, Mycobacterium
VTTNPHAP

SEQ ID NO: 1234234 - protein, 10 aa, Mycobacterium
VTTNPPTEGS

SEQ ID NO: 1234235 - protein, 8 aa, Mycobacterium
VTTNPPVE

SEQ ID NO: 1234236 - protein, 9 aa, Mycobacterium
VTTPEPGTG

SEQ ID NO: 1234237 - protein, 17 aa, Mycobacterium
VTTPERTAFDLARRGKV

SEQ ID NO: 1234238 - protein, 9 aa, Mycobacterium
VTTPGQYEA

SEQ ID NO: 1234239 - protein, 13 aa, Mycobacterium
VTTPPETNNGWPY

SEQ ID NO: 1234240 - protein, 11 aa, Mycobacterium
VTTRGGSTIEQ

SEQ ID NO: 1234241 - protein, 8 aa, Mycobacterium
VTTSDGKV

SEQ ID NO: 1234242 - protein, 13 aa, Mycobacterium
VTTSQVDDDVRKD

SEQ ID NO: 1234243 - protein, 4 aa, Mycobacterium
VTTV

SEQ ID NO: 1234244 - protein, 9 aa, Mycobacterium
VTVEQAQDS

SEQ ID NO: 1234245 - protein, 6 aa, Mycobacterium
VTVERR

SEQ ID NO: 1234246 - protein, 8 aa, Mycobacterium
VTVHPNDD

SEQ ID NO: 1234247 - protein, 10 aa, Mycobacterium
VTVPQSLSSD

SEQ ID NO: 1234248 - protein, 12 aa, Mycobacterium
VTYGDNGKCARD

SEQ ID NO: 1234249 - protein, 17 aa, Mycobacterium
VTYGELDDRSSRAAQAF

SEQ ID NO: 1234250 - protein, 5 aa, Mycobacterium
VTYRG

SEQ ID NO: 1234251 - protein, 9 aa, Mycobacterium
VTYRPGARF

SEQ ID NO: 1234252 - protein, 10 aa, Mycobacterium
VTYSGPDAAT

SEQ ID NO: 1234253 - protein, 9 aa, Mycobacterium
VVAEGRSDA

SEQ ID NO: 1234254 - protein, 7 aa, Mycobacterium
VVDAPGD

SEQ ID NO: 1234255 - protein, 13 aa, Mycobacterium
VVDEGSDDAPGLT

SEQ ID NO: 1234256 - protein, 9 aa, Mycobacterium
VVDPDGPVR

SEQ ID NO: 1234257 - protein, 7 aa, Mycobacterium
VVDPGGN

SEQ ID NO: 1234258 - protein, 8 aa, Mycobacterium
VVDPSDVE

SEQ ID NO: 1234259 - protein, 62 aa, Mycobacterium
VVEDGEPDPGADEPADSDSDTGPDSDDEAAPPKQRRRATARTRGGDRAASPVRRAAKTRKTR

SEQ ID NO: 1234260 - protein, 61 aa, Mycobacterium
VVEDGEPDPGADEPADSDSDTGPDSDEAAPPKQRRRATARTRGGDRAASPVRRAAKTRKTR

SEQ ID NO: 1234261 - protein, 61 aa, Mycobacterium
VVEDGEPDPGADEPADSDSDTGPDSNEAAPPKQRRRATARTRGGDRAASPVRRAAKTRKTR

SEQ ID NO: 1234262 - protein, 10 aa, Mycobacterium
VVEGSRSGRE

SEQ ID NO: 1234263 - protein, 16 aa, Mycobacterium
VVETDRPEEPKTKATW

SEQ ID NO: 1234264 - protein, 11 aa, Mycobacterium
VVGGQSDESGL

SEQ ID NO: 1234265 - protein, 4 aa, Mycobacterium
VVGP

SEQ ID NO: 1234266 - protein, 7 aa, Mycobacterium
VVGPGGD

SEQ ID NO: 1234267 - protein, 5 aa, Mycobacterium
VVGPS

SEQ ID NO: 1234268 - protein, 9 aa, Mycobacterium
VVGTPKEIA

SEQ ID NO: 1234269 - protein, 5 aa, Mycobacterium
VVPEG

SEQ ID NO: 1234270 - protein, 12 aa, Mycobacterium
VVPPAEDDDPAE

SEQ ID NO: 1234271 - protein, 16 aa, Mycobacterium
VVPPGETLPDRRSRKI

SEQ ID NO: 1234272 - protein, 10 aa, Mycobacterium
VVPPTGRGAC

SEQ ID NO: 1234273 - protein, 13 aa, Mycobacterium
VVPQPGAFTAEDS

SEQ ID NO: 1234274 - protein, 7 aa, Mycobacterium
VVPSESA

SEQ ID NO: 1234275 - protein, 7 aa, Mycobacterium
VVQNGTR

SEQ ID NO: 1234276 - protein, 6 aa, Mycobacterium
VVRPGR

SEQ ID NO: 1234277 - protein, 4 aa, Mycobacterium
VVSE

SEQ ID NO: 1234278 - protein, 11 aa, Mycobacterium
VVSGGGAADDV

SEQ ID NO: 1234279 - protein, 7 aa, Mycobacterium
VVSGSGN

SEQ ID NO: 1234280 - protein, 14 aa, Mycobacterium
VVTGAGDRATASEL

SEQ ID NO: 1234281 - protein, 14 aa, Mycobacterium
VVTSPEAAQSADPM

SEQ ID NO: 1234282 - protein, 10 aa, Mycobacterium
VWTNPDTTFE

SEQ ID NO: 1234283 - protein, 6 aa, Mycobacterium
VYGAED

SEQ ID NO: 1234284 - protein, 9 aa, Mycobacterium
VYGDGRSTV

SEQ ID NO: 1234285 - protein, 5 aa, Mycobacterium
VYGPI

SEQ ID NO: 1234286 - protein, 23 aa, Mycobacterium
VYGSETAMAPRVGSAAADHIGGS

SEQ ID NO: 1234287 - protein, 9 aa, Mycobacterium
VYGSGDLGQ

SEQ ID NO: 1234288 - protein, 6 aa, Mycobacterium
VYPPPS

SEQ ID NO: 1234289 - protein, 11 aa, Mycobacterium
VYPTTSATAGT

SEQ ID NO: 1234290 - protein, 24 aa, Mycobacterium
VYQPPPPGAPPPPPPGAPPPPPPN

SEQ ID NO: 1234291 - protein, 5 aa, Mycobacterium
VYRDQ

SEQ ID NO: 1234292 - protein, 8 aa, Mycobacterium
VYSETAAR

SEQ ID NO: 1234293 - protein, 8 aa, Mycobacterium
VYTDDEHG

SEQ ID NO: 1234294 - protein, 9 aa, Mycobacterium
VYTTDNDRA

SEQ ID NO: 1234295 - protein, 22 aa, Mycobacterium
WAAAPDADAKDLAEAAGRGDPV

SEQ ID NO: 1234296 - protein, 26 aa, Mycobacterium
WAAGRGSAQRLRGGLPPLSVTSDGTV

SEQ ID NO: 1234297 - protein, 9 aa, Mycobacterium
WAASATPGQ

SEQ ID NO: 1234298 - protein, 9 aa, Mycobacterium
WADDRDGSH

SEQ ID NO: 1234299 - protein, 9 aa, Mycobacterium
WADDTDDPG

SEQ ID NO: 1234300 - protein, 8 aa, Mycobacterium
WADGPTAY

SEQ ID NO: 1234301 - protein, 9 aa, Mycobacterium
WADRGQDAE

SEQ ID NO: 1234302 - protein, 15 aa, Mycobacterium
WADTATAAVPVDDAD

SEQ ID NO: 1234303 - protein, 6 aa, Mycobacterium
WAGDAD

SEQ ID NO: 1234304 - protein, 7 aa, Mycobacterium
WAGPGPQ

SEQ ID NO: 1234305 - protein, 8 aa, Mycobacterium
WAGRPSAM

SEQ ID NO: 1234306 - protein, 5 aa, Mycobacterium
WAGST

SEQ ID NO: 1234307 - protein, 14 aa, Mycobacterium
WAPAAAQIGDPTAA

SEQ ID NO: 1234308 - protein, 12 aa, Mycobacterium
WAPHGGESRVDV

SEQ ID NO: 1234309 - protein, 33 aa, Mycobacterium
WAPPPPPPPPAPGDPNVPPPPADPNAPPPRPEV

SEQ ID NO: 1234310 - protein, 6 aa, Mycobacterium
WAPRIP

SEQ ID NO: 1234311 - protein, 8 aa, Mycobacterium
WAPSGSNL

SEQ ID NO: 1234312 - protein, 8 aa, Mycobacterium
WAQDAAPR

SEQ ID NO: 1234313 - protein, 11 aa, Mycobacterium
WARESGHDDVS

SEQ ID NO: 1234314 - protein, 9 aa, Mycobacterium
WATGDPKQQ

SEQ ID NO: 1234315 - protein, 8 aa, Mycobacterium
WATGGQMP

SEQ ID NO: 1234316 - protein, 14 aa, Mycobacterium
WATGTAVGKTAVSS

SEQ ID NO: 1234317 - protein, 35 aa, Mycobacterium
WATKQQAALTESPPVLQQQDTQAAGDYEKSATFPM

SEQ ID NO: 1234318 - protein, 21 aa, Mycobacterium
WCNPPGRALGTPPTTATGHPQ

SEQ ID NO: 1234319 - protein, 4 aa, Mycobacterium
WDAH

SEQ ID NO: 1234320 - protein, 7 aa, Mycobacterium
WDAPEGQ

SEQ ID NO: 1234321 - protein, 5 aa, Mycobacterium
WDAQG

SEQ ID NO: 1234322 - protein, 9 aa, Mycobacterium
WDEGRTRGV

SEQ ID NO: 1234323 - protein, 11 aa, Mycobacterium
WDESGKPVRGE

SEQ ID NO: 1234324 - protein, 10 aa, Mycobacterium
WDGEGAGEDA

SEQ ID NO: 1234325 - protein, 12 aa, Mycobacterium
WDPANQSTHGRA

SEQ ID NO: 1234326 - protein, 8 aa, Mycobacterium
WDPDRADI

SEQ ID NO: 1234327 - protein, 5 aa, Mycobacterium
WDPEP

SEQ ID NO: 1234328 - protein, 12 aa, Mycobacterium
WDPETNSRRRYP

SEQ ID NO: 1234329 - protein, 11 aa, Mycobacterium
WDPGAGHRCDP

SEQ ID NO: 1234330 - protein, 9 aa, Mycobacterium
WDPSDPRRR

SEQ ID NO: 1234331 - protein, 10 aa, Mycobacterium
WDPTSTPVKH

SEQ ID NO: 1234332 - protein, 13 aa, Mycobacterium
WDQRPGVRPPTRR

SEQ ID NO: 1234333 - protein, 11 aa, Mycobacterium
WDSGKKSAAYA

SEQ ID NO: 1234334 - protein, 8 aa, Mycobacterium
WDSPAGEA

SEQ ID NO: 1234335 - protein, 9 aa, Mycobacterium
WDSTRDSKI

SEQ ID NO: 1234336 - protein, 5 aa, Mycobacterium
WDTAR

SEQ ID NO: 1234337 - protein, 6 aa, Mycobacterium
WDTPDA

SEQ ID NO: 1234338 - protein, 8 aa, Mycobacterium
WDYDGRPS

SEQ ID NO: 1234339 - protein, 9 aa, Mycobacterium
WEATSASGY

SEQ ID NO: 1234340 - protein, 8 aa, Mycobacterium
WEDERTDT

SEQ ID NO: 1234341 - protein, 4 aa, Mycobacterium
WEGS

SEQ ID NO: 1234342 - protein, 11 aa, Mycobacterium
WENPENPKPLG

SEQ ID NO: 1234343 - protein, 6 aa, Mycobacterium
WEPPHT

SEQ ID NO: 1234344 - protein, 4 aa, Mycobacterium
WERE

SEQ ID NO: 1234345 - protein, 15 aa, Mycobacterium
WESPDPDAISAAGGP

SEQ ID NO: 1234346 - protein, 12 aa, Mycobacterium
WESPQSPTPHRG

SEQ ID NO: 1234347 - protein, 10 aa, Mycobacterium
WETSAAERAE

SEQ ID NO: 1234348 - protein, 8 aa, Mycobacterium
WETSEGVR

SEQ ID NO: 1234349 - protein, 12 aa, Mycobacterium
WETTGPAIEPVP

SEQ ID NO: 1234350 - protein, 14 aa, Mycobacterium
WETTNSSRVSRARR

SEQ ID NO: 1234351 - protein, 5 aa, Mycobacterium
WGADG

SEQ ID NO: 1234352 - protein, 15 aa, Mycobacterium
WGAPAGPDESLRTEQ

SEQ ID NO: 1234353 - protein, 12 aa, Mycobacterium
WGARTTPGLPPG

SEQ ID NO: 1234354 - protein, 24 aa, Mycobacterium
WGASPETSGPTMADGGEIGQDRTA

SEQ ID NO: 1234355 - protein, 9 aa, Mycobacterium
WGDGQQPDV

SEQ ID NO: 1234356 - protein, 8 aa, Mycobacterium
WGDPARRS

SEQ ID NO: 1234357 - protein, 22 aa, Mycobacterium
WGEDPSAVAVADPDKLTPTTAS

SEQ ID NO: 1234358 - protein, 11 aa, Mycobacterium
WGEGAVGTNAI

SEQ ID NO: 1234359 - protein, 9 aa, Mycobacterium
WGEKQVPAD

SEQ ID NO: 1234360 - protein, 13 aa, Mycobacterium
WGEPADAIAGFTE

SEQ ID NO: 1234361 - protein, 6 aa, Mycobacterium
WGEPGA

SEQ ID NO: 1234362 - protein, 9 aa, Mycobacterium
WGGADPDLA

SEQ ID NO: 1234363 - protein, 13 aa, Mycobacterium
WGGSQVRTEATGY

SEQ ID NO: 1234364 - protein, 10 aa, Mycobacterium
WGGSRTTENV

SEQ ID NO: 1234365 - protein, 5 aa, Mycobacterium
WGGYS

SEQ ID NO: 1234366 - protein, 6 aa, Mycobacterium
WGHEPT

SEQ ID NO: 1234367 - protein, 8 aa, Mycobacterium
WGNGPGKI

SEQ ID NO: 1234368 - protein, 11 aa, Mycobacterium
WGPAGGQHPDV

SEQ ID NO: 1234369 - protein, 8 aa, Mycobacterium
WGPETGAA

SEQ ID NO: 1234370 - protein, 9 aa, Mycobacterium
WGPGAAEFT

SEQ ID NO: 1234371 - protein, 6 aa, Mycobacterium
WGPPDG

SEQ ID NO: 1234372 - protein, 12 aa, Mycobacterium
WGPSSDPAWKRN

SEQ ID NO: 1234373 - protein, 12 aa, Mycobacterium
WGPSSDPAWQRN

SEQ ID NO: 1234374 - protein, 13 aa, Mycobacterium
WGQDGPRAQQAGH

SEQ ID NO: 1234375 - protein, 13 aa, Mycobacterium
WGQTGPRAAQAGH

SEQ ID NO: 1234376 - protein, 12 aa, Mycobacterium
WGRTSPADRGAA

SEQ ID NO: 1234377 - protein, 5 aa, Mycobacterium
WGSGG

SEQ ID NO: 1234378 - protein, 9 aa, Mycobacterium
WGSSGRWTT

SEQ ID NO: 1234379 - protein, 9 aa, Mycobacterium
WGSTVTKTK

SEQ ID NO: 1234380 - protein, 7 aa, Mycobacterium
WGTPATP

SEQ ID NO: 1234381 - protein, 6 aa, Mycobacterium
WGTTLG

SEQ ID NO: 1234382 - protein, 6 aa, Mycobacterium
WGTTNG

SEQ ID NO: 1234383 - protein, 10 aa, Mycobacterium
WHPEDSPLDP

SEQ ID NO: 1234384 - protein, 6 aa, Mycobacterium
WHPPGV

SEQ ID NO: 1234385 - protein, 15 aa, Mycobacterium
WKGAEDYDSVAAATG

SEQ ID NO: 1234386 - protein, 4 aa, Mycobacterium
WKGN

SEQ ID NO: 1234387 - protein, 8 aa, Mycobacterium
WKKPGTGD

SEQ ID NO: 1234388 - protein, 21 aa, Mycobacterium
WKPDQYSNPMGPESHYETTGP

SEQ ID NO: 1234389 - protein, 26 aa, Mycobacterium
WKPSELTENVYDGKDRATGQPKWTAT

SEQ ID NO: 1234390 - protein, 9 aa, Mycobacterium
WKRKDYDEY

SEQ ID NO: 1234391 - protein, 4 aa, Mycobacterium
WKST

SEQ ID NO: 1234392 - protein, 5 aa, Mycobacterium
WLGET

SEQ ID NO: 1234393 - protein, 35 aa, Mycobacterium
WNDGEPTEPLPAGHPAPGIDDDAVREAADALNSGV

SEQ ID NO: 1234394 - protein, 4 aa, Mycobacterium
WNGQ

SEQ ID NO: 1234395 - protein, 7 aa, Mycobacterium
WNGTDER

SEQ ID NO: 1234396 - protein, 19 aa, Mycobacterium
WNNPAEAASSGRDFDASRP

SEQ ID NO: 1234397 - protein, 9 aa, Mycobacterium
WNPDSDRAF

SEQ ID NO: 1234398 - protein, 13 aa, Mycobacterium
WNRTTTGDARPGR

SEQ ID NO: 1234399 - protein, 4 aa, Mycobacterium
WPAA

SEQ ID NO: 1234400 - protein, 5 aa, Mycobacterium
WPAPV

SEQ ID NO: 1234401 - protein, 8 aa, Mycobacterium
WPATAAEA

SEQ ID NO: 1234402 - protein, 6 aa, Mycobacterium
WPATGQ

SEQ ID NO: 1234403 - protein, 8 aa, Mycobacterium
WPDDQTID

SEQ ID NO: 1234404 - protein, 4 aa, Mycobacterium
WPDE

SEQ ID NO: 1234405 - protein, 5 aa, Mycobacterium
WPDGS

SEQ ID NO: 1234406 - protein, 13 aa, Mycobacterium
WPDKPSGSLPGTR

SEQ ID NO: 1234407 - protein, 5 aa, Mycobacterium
WPDPE

SEQ ID NO: 1234408 - protein, 4 aa, Mycobacterium
WPDQ

SEQ ID NO: 1234409 - protein, 5 aa, Mycobacterium
WPDSA

SEQ ID NO: 1234410 - protein, 4 aa, Mycobacterium
WPEG

SEQ ID NO: 1234411 - protein, 6 aa, Mycobacterium
WPEGGV

SEQ ID NO: 1234412 - protein, 4 aa, Mycobacterium
WPEP

SEQ ID NO: 1234413 - protein, 10 aa, Mycobacterium
WPGGGGPLYT

SEQ ID NO: 1234414 - protein, 18 aa, Mycobacterium
WPGPRPQRDRRVDTSDDL

SEQ ID NO: 1234415 - protein, 4 aa, Mycobacterium
WPGT

SEQ ID NO: 1234416 - protein, 12 aa, Mycobacterium
WPLDDPRDAEED

SEQ ID NO: 1234417 - protein, 6 aa, Mycobacterium
WPNGVT

SEQ ID NO: 1234418 - protein, 18 aa, Mycobacterium
WPNKGEDDLRPAQGEPYR

SEQ ID NO: 1234419 - protein, 18 aa, Mycobacterium
WPPKGTDRGKGDAVARST

SEQ ID NO: 1234420 - protein, 7 aa, Mycobacterium
WPPNTEY

SEQ ID NO: 1234421 - protein, 4 aa, Mycobacterium
WPRA

SEQ ID NO: 1234422 - protein, 9 aa, Mycobacterium
WPRDGVPEV

SEQ ID NO: 1234423 - protein, 5 aa, Mycobacterium
WPRGA

SEQ ID NO: 1234424 - protein, 6 aa, Mycobacterium
WPRPVP

SEQ ID NO: 1234425 - protein, 8 aa, Mycobacterium
WPRRQQPA

SEQ ID NO: 1234426 - protein, 12 aa, Mycobacterium
WPSGNRDAHGNP

SEQ ID NO: 1234427 - protein, 17 aa, Mycobacterium
WPSRGGEDSAHRPGRKA

SEQ ID NO: 1234428 - protein, 12 aa, Mycobacterium
WPTPPEDCFGSP

SEQ ID NO: 1234429 - protein, 21 aa, Mycobacterium
WPTPPSTTSTDGSMTASGREP

SEQ ID NO: 1234430 - protein, 8 aa, Mycobacterium
WPTPSGAH

SEQ ID NO: 1234431 - protein, 9 aa, Mycobacterium
WPTPTFPDD

SEQ ID NO: 1234432 - protein, 6 aa, Mycobacterium
WPTTEV

SEQ ID NO: 1234433 - protein, 9 aa, Mycobacterium
WPVPGSRFG

SEQ ID NO: 1234434 - protein, 8 aa, Mycobacterium
WQAGPDTE

SEQ ID NO: 1234435 - protein, 8 aa, Mycobacterium
WQGAGGAA

SEQ ID NO: 1234436 - protein, 5 aa, Mycobacterium
WQPGS

SEQ ID NO: 1234437 - protein, 33 aa, Mycobacterium
WQPPPSPQRIPATLSPPESVSAPSGPEPPKQNV

SEQ ID NO: 1234438 - protein, 22 aa, Mycobacterium
WQPRGRGRSGRPSGLYRTPGRA

SEQ ID NO: 1234439 - protein, 15 aa, Mycobacterium
WQPTSATAQASAARA

SEQ ID NO: 1234440 - protein, 11 aa, Mycobacterium
WQQAGKGKPHL

SEQ ID NO: 1234441 - protein, 4 aa, Mycobacterium
WQQQ

SEQ ID NO: 1234442 - protein, 4 aa, Mycobacterium
WQRG

SEQ ID NO: 1234443 - protein, 6 aa, Mycobacterium
WQRNGG

SEQ ID NO: 1234444 - protein, 17 aa, Mycobacterium
WQSPREGVKVGRDRKST

SEQ ID NO: 1234445 - protein, 18 aa, Mycobacterium
WRADGGPFAPNISPSDPY

SEQ ID NO: 1234446 - protein, 12 aa, Mycobacterium
WRAETDRMTSDD

SEQ ID NO: 1234447 - protein, 7 aa, Mycobacterium
WRDDPRL

SEQ ID NO: 1234448 - protein, 7 aa, Mycobacterium
WRDGPRT

SEQ ID NO: 1234449 - protein, 8 aa, Mycobacterium
WRGTTRSL

SEQ ID NO: 1234450 - protein, 8 aa, Mycobacterium
WRNERPSE

SEQ ID NO: 1234451 - protein, 5 aa, Mycobacterium
WRNPP

SEQ ID NO: 1234452 - protein, 6 aa, Mycobacterium
WRPDGT

SEQ ID NO: 1234453 - protein, 6 aa, Mycobacterium
WRPGES

SEQ ID NO: 1234454 - protein, 13 aa, Mycobacterium
WRPPAGSGPASAR

SEQ ID NO: 1234455 - protein, 7 aa, Mycobacterium
WRPPEPA

SEQ ID NO: 1234456 - protein, 5 aa, Mycobacterium
WRPRK

SEQ ID NO: 1234457 - protein, 9 aa, Mycobacterium
WRRTPPAER

SEQ ID NO: 1234458 - protein, 42 aa, Mycobacterium
WRSPAGPVPAYPRASNDPSAAAAAPAAPVSRPSARRTGEPGI

SEQ ID NO: 1234459 - protein, 11 aa, Mycobacterium
WRSPEAREKYD

SEQ ID NO: 1234460 - protein, 5 aa, Mycobacterium
WRSSH

SEQ ID NO: 1234461 - protein, 4 aa, Mycobacterium
WRST

SEQ ID NO: 1234462 - protein, 12 aa, Mycobacterium
WSADASRPVATG

SEQ ID NO: 1234463 - protein, 6 aa, Mycobacterium
WSADGS

SEQ ID NO: 1234464 - protein, 9 aa, Mycobacterium
WSAGEREPR

SEQ ID NO: 1234465 - protein, 8 aa, Mycobacterium
WSAQPPQC

SEQ ID NO: 1234466 - protein, 15 aa, Mycobacterium
WSAQPPTYQDANPAV

SEQ ID NO: 1234467 - protein, 30 aa, Mycobacterium
WSATDDVNGSDAARIGPAPRTIRNGQRVSS

SEQ ID NO: 1234468 - protein, 13 aa, Mycobacterium
WSDEGGATESGPA

SEQ ID NO: 1234469 - protein, 9 aa, Mycobacterium
WSDGGAATH

SEQ ID NO: 1234470 - protein, 10 aa, Mycobacterium
WSEADSPYQP

SEQ ID NO: 1234471 - protein, 10 aa, Mycobacterium
WSEEPPSRTR

SEQ ID NO: 1234472 - protein, 13 aa, Mycobacterium
WSGARDAPVPPAE

SEQ ID NO: 1234473 - protein, 12 aa, Mycobacterium
WSGDGAAAHRAR

SEQ ID NO: 1234474 - protein, 8 aa, Mycobacterium
WSGGGSLS

SEQ ID NO: 1234475 - protein, 8 aa, Mycobacterium
WSGGKDST

SEQ ID NO: 1234476 - protein, 7 aa, Mycobacterium
WSGGPRT

SEQ ID NO: 1234477 - protein, 15 aa, Mycobacterium
WSGGSEPGDEVNPAA

SEQ ID NO: 1234478 - protein, 12 aa, Mycobacterium
WSGGSEPGHEIN

SEQ ID NO: 1234479 - protein, 13 aa, Mycobacterium
WSGGSEPGNEINP

SEQ ID NO: 1234480 - protein, 4 aa, Mycobacterium
WSGP

SEQ ID NO: 1234481 - protein, 38 aa, Mycobacterium
WSHQGGTWGLPGGARDSHETAEQAAVREAEEEAGLPAD

SEQ ID NO: 1234482 - protein, 7 aa, Mycobacterium
WSPDGSQ

SEQ ID NO: 1234483 - protein, 4 aa, Mycobacterium
WSPE

SEQ ID NO: 1234484 - protein, 7 aa, Mycobacterium
WSPEEQR

SEQ ID NO: 1234485 - protein, 11 aa, Mycobacterium
WSPESGETIGE

SEQ ID NO: 1234486 - protein, 6 aa, Mycobacterium
WSPSAG

SEQ ID NO: 1234487 - protein, 6 aa, Mycobacterium
WSPWGS

SEQ ID NO: 1234488 - protein, 8 aa, Mycobacterium
WSQPPWRP

SEQ ID NO: 1234489 - protein, 7 aa, Mycobacterium
WSQRSTR

SEQ ID NO: 1234490 - protein, 8 aa, Mycobacterium
WSRPGGQC

SEQ ID NO: 1234491 - protein, 9 aa, Mycobacterium
WSSGGEGDV

SEQ ID NO: 1234492 - protein, 11 aa, Mycobacterium
WSSGQTVGGAG

SEQ ID NO: 1234493 - protein, 10 aa, Mycobacterium
WSSKAPTTDL

SEQ ID NO: 1234494 - protein, 20 aa, Mycobacterium
WSTAGIDTSPYSRAKSAAEA

SEQ ID NO: 1234495 - protein, 8 aa, Mycobacterium
WSTDPRSR

SEQ ID NO: 1234496 - protein, 4 aa, Mycobacterium
WSTR

SEQ ID NO: 1234497 - protein, 4 aa, Mycobacterium
WSTT

SEQ ID NO: 1234498 - protein, 19 aa, Mycobacterium
WSYPPSSPAGDSTGRRATP

SEQ ID NO: 1234499 - protein, 4 aa, Mycobacterium
WTAD

SEQ ID NO: 1234500 - protein, 7 aa, Mycobacterium
WTAGQQR

SEQ ID NO: 1234501 - protein, 19 aa, Mycobacterium
WTATADGVRVTTATGTYSA

SEQ ID NO: 1234502 - protein, 11 aa, Mycobacterium
WTDEGGTRPLA

SEQ ID NO: 1234503 - protein, 9 aa, Mycobacterium
WTDENQDIT

SEQ ID NO: 1234504 - protein, 12 aa, Mycobacterium
WTDREIPIVICE

SEQ ID NO: 1234505 - protein, 9 aa, Mycobacterium
WTETGPDGN

SEQ ID NO: 1234506 - protein, 17 aa, Mycobacterium
WTEVDGDEKRWKKLRFR

SEQ ID NO: 1234507 - protein, 4 aa, Mycobacterium
WTGE

SEQ ID NO: 1234508 - protein, 104 aa, Mycobacterium
WTGQEDEDFEPDTGPSGLRATPPPPPVPDPERRTSFRDPQQSRPGPPPAPPRPQPTNWGQPPGWQPARGPLPPAGTPPQQSRPPEGYGPESYGPGGPMAQPGSY

SEQ ID NO: 1234509 - protein, 4 aa, Mycobacterium
WTNP

SEQ ID NO: 1234510 - protein, 12 aa, Mycobacterium
WTPPDRDTHRRG

SEQ ID NO: 1234511 - protein, 12 aa, Mycobacterium
WTPPEAAPKITR

SEQ ID NO: 1234512 - protein, 10 aa, Mycobacterium
WTPPEATRTV

SEQ ID NO: 1234513 - protein, 6 aa, Mycobacterium
WTPPVT

SEQ ID NO: 1234514 - protein, 10 aa, Mycobacterium
WTPSQPGTVE

SEQ ID NO: 1234515 - protein, 10 aa, Mycobacterium
WTRESAEAYR

SEQ ID NO: 1234516 - protein, 7 aa, Mycobacterium
WTRGQAR

SEQ ID NO: 1234517 - protein, 7 aa, Mycobacterium
WTRPPGR

SEQ ID NO: 1234518 - protein, 8 aa, Mycobacterium
WTRTPTAR

SEQ ID NO: 1234519 - protein, 5 aa, Mycobacterium
YAAAN

SEQ ID NO: 1234520 - protein, 12 aa, Mycobacterium
YAAAPGLAPYNA

SEQ ID NO: 1234521 - protein, 8 aa, Mycobacterium
YAADATGL

SEQ ID NO: 1234522 - protein, 26 aa, Mycobacterium
YAAPGASVPHDDAVTGCDDRTTGQRH

SEQ ID NO: 1234523 - protein, 26 aa, Mycobacterium
YAAPGTNRPHDDAHTGRDDRTTGQRH

SEQ ID NO: 1234524 - protein, 12 aa, Mycobacterium
YAARPANPAADD

SEQ ID NO: 1234525 - protein, 11 aa, Mycobacterium
YAARSQERAAA

SEQ ID NO: 1234526 - protein, 11 aa, Mycobacterium
YAATDDSRADS

SEQ ID NO: 1234527 - protein, 4 aa, Mycobacterium
YADA

SEQ ID NO: 1234528 - protein, 9 aa, Mycobacterium
YADRPDPDR

SEQ ID NO: 1234529 - protein, 7 aa, Mycobacterium
YAEAEQD

SEQ ID NO: 1234530 - protein, 10 aa, Mycobacterium
YAEAGRPDKP

SEQ ID NO: 1234531 - protein, 5 aa, Mycobacterium
YAEAK

SEQ ID NO: 1234532 - protein, 9 aa, Mycobacterium
YAEEPVEQY

SEQ ID NO: 1234533 - protein, 11 aa, Mycobacterium
YAEGGLARQTL

SEQ ID NO: 1234534 - protein, 9 aa, Mycobacterium
YAEGQVQNS

SEQ ID NO: 1234535 - protein, 17 aa, Mycobacterium
YAEGSSTAGTDRRGTVL

SEQ ID NO: 1234536 - protein, 6 aa, Mycobacterium
YAEGTV

SEQ ID NO: 1234537 - protein, 15 aa, Mycobacterium
YAEKEAKKGVTVDPD

SEQ ID NO: 1234538 - protein, 6 aa, Mycobacterium
YAEPAS

SEQ ID NO: 1234539 - protein, 18 aa, Mycobacterium
YAEPGTARAYDPETDESI

SEQ ID NO: 1234540 - protein, 5 aa, Mycobacterium
YAEQA

SEQ ID NO: 1234541 - protein, 29 aa, Mycobacterium
YAESGGQIADEGTVTGTGASETAKAAVTD

SEQ ID NO: 1234542 - protein, 13 aa, Mycobacterium
YAETDRNPPSFDP

SEQ ID NO: 1234543 - protein, 6 aa, Mycobacterium
YAGADW

SEQ ID NO: 1234544 - protein, 6 aa, Mycobacterium
YAGAGI

SEQ ID NO: 1234545 - protein, 13 aa, Mycobacterium
YAGAPSRRLPEVT

SEQ ID NO: 1234546 - protein, 5 aa, Mycobacterium
YAGDP

SEQ ID NO: 1234547 - protein, 6 aa, Mycobacterium
YAGELG

SEQ ID NO: 1234548 - protein, 13 aa, Mycobacterium
YAGGVQGKWDPGA

SEQ ID NO: 1234549 - protein, 11 aa, Mycobacterium
YAGLPGDDERY

SEQ ID NO: 1234550 - protein, 5 aa, Mycobacterium
YAGNP

SEQ ID NO: 1234551 - protein, 10 aa, Mycobacterium
YAGPDQRDKL

SEQ ID NO: 1234552 - protein, 8 aa, Mycobacterium
YAGPQDDA

SEQ ID NO: 1234553 - protein, 7 aa, Mycobacterium
YAGRAGD

SEQ ID NO: 1234554 - protein, 15 aa, Mycobacterium
YAGRGYGDLKKETAE

SEQ ID NO: 1234555 - protein, 9 aa, Mycobacterium
YAGRPGATI

SEQ ID NO: 1234556 - protein, 8 aa, Mycobacterium
YAGSSQIQ

SEQ ID NO: 1234557 - protein, 4 aa, Mycobacterium
YAGT

SEQ ID NO: 1234558 - protein, 5 aa, Mycobacterium
YAGTA

SEQ ID NO: 1234559 - protein, 14 aa, Mycobacterium
YAKGGKDKRGGDQL

SEQ ID NO: 1234560 - protein, 7 aa, Mycobacterium
YAKPPLS

SEQ ID NO: 1234561 - protein, 12 aa, Mycobacterium
YAKPRSSDTDAL

SEQ ID NO: 1234562 - protein, 8 aa, Mycobacterium
YAKQDPLS

SEQ ID NO: 1234563 - protein, 8 aa, Mycobacterium
YAKQRSQF

SEQ ID NO: 1234564 - protein, 10 aa, Mycobacterium
YANADPSRTL

SEQ ID NO: 1234565 - protein, 4 aa, Mycobacterium
YANG

SEQ ID NO: 1234566 - protein, 11 aa, Mycobacterium
YAPAPPSPSFY

SEQ ID NO: 1234567 - protein, 11 aa, Mycobacterium
YAPEQLGSTAQ

SEQ ID NO: 1234568 - protein, 9 aa, Mycobacterium
YAPGARERG

SEQ ID NO: 1234569 - protein, 7 aa, Mycobacterium
YAPGDIT

SEQ ID NO: 1234570 - protein, 23 aa, Mycobacterium
YAPGSGPPVTEDWPTTGQTTSVY

SEQ ID NO: 1234571 - protein, 9 aa, Mycobacterium
YAPGSPERH

SEQ ID NO: 1234572 - protein, 4 aa, Mycobacterium
YAPH

SEQ ID NO: 1234573 - protein, 9 aa, Mycobacterium
YAPKSALGH

SEQ ID NO: 1234574 - protein, 15 aa, Mycobacterium
YAPPPPPGANPPPLW

SEQ ID NO: 1234575 - protein, 14 aa, Mycobacterium
YAPPPPPGASPAPL

SEQ ID NO: 1234576 - protein, 9 aa, Mycobacterium
YAPSGPSSA

SEQ ID NO: 1234577 - protein, 11 aa, Mycobacterium
YAPSSRFGTPD

SEQ ID NO: 1234578 - protein, 8 aa, Mycobacterium
YAPSTGPV

SEQ ID NO: 1234579 - protein, 9 aa, Mycobacterium
YAPSVGAAS

SEQ ID NO: 1234580 - protein, 8 aa, Mycobacterium
YAPTAAGS

SEQ ID NO: 1234581 - protein, 4 aa, Mycobacterium
YAQA

SEQ ID NO: 1234582 - protein, 6 aa, Mycobacterium
YARAER

SEQ ID NO: 1234583 - protein, 10 aa, Mycobacterium
YAREREQFDR

SEQ ID NO: 1234584 - protein, 6 aa, Mycobacterium
YARPGE

SEQ ID NO: 1234585 - protein, 9 aa, Mycobacterium
YARSTASMD

SEQ ID NO: 1234586 - protein, 14 aa, Mycobacterium
YARTDWENGGIPQR

SEQ ID NO: 1234587 - protein, 10 aa, Mycobacterium
YASAEANHTV

SEQ ID NO: 1234588 - protein, 13 aa, Mycobacterium
YASDGDGDGRADV

SEQ ID NO: 1234589 - protein, 6 aa, Mycobacterium
YASGRT

SEQ ID NO: 1234590 - protein, 10 aa, Mycobacterium
YASGTSAKEA

SEQ ID NO: 1234591 - protein, 9 aa, Mycobacterium
YASLGESER

SEQ ID NO: 1234592 - protein, 5 aa, Mycobacterium
YASRG

SEQ ID NO: 1234593 - protein, 11 aa, Mycobacterium
YASRQPSPANK

SEQ ID NO: 1234594 - protein, 9 aa, Mycobacterium
YASSDAKFS

SEQ ID NO: 1234595 - protein, 8 aa, Mycobacterium
YATAGEPF

SEQ ID NO: 1234596 - protein, 10 aa, Mycobacterium
YATGSTSSQA

SEQ ID NO: 1234597 - protein, 5 aa, Mycobacterium
YATPT

SEQ ID NO: 1234598 - protein, 5 aa, Mycobacterium
YATQG

SEQ ID NO: 1234599 - protein, 8 aa, Mycobacterium
YATRDQED

SEQ ID NO: 1234600 - protein, 8 aa, Mycobacterium
YATRDSLE

SEQ ID NO: 1234601 - protein, 4 aa, Mycobacterium
YATS

SEQ ID NO: 1234602 - protein, 4 aa, Mycobacterium
YCSP

SEQ ID NO: 1234603 - protein, 5 aa, Mycobacterium
YCTDP

SEQ ID NO: 1234604 - protein, 14 aa, Mycobacterium
YDAARAEDEAPPTA

SEQ ID NO: 1234605 - protein, 7 aa, Mycobacterium
YDADDPD

SEQ ID NO: 1234606 - protein, 8 aa, Mycobacterium
YDAEGADE

SEQ ID NO: 1234607 - protein, 8 aa, Mycobacterium
YDAGDRTP

SEQ ID NO: 1234608 - protein, 13 aa, Mycobacterium
YDAKDPDTTYPPI

SEQ ID NO: 1234609 - protein, 11 aa, Mycobacterium
YDANPLESEEL

SEQ ID NO: 1234610 - protein, 6 aa, Mycobacterium
YDATPA

SEQ ID NO: 1234611 - protein, 10 aa, Mycobacterium
YDDEVEDEQD

SEQ ID NO: 1234612 - protein, 6 aa, Mycobacterium
YDDGDD

SEQ ID NO: 1234613 - protein, 9 aa, Mycobacterium
YDDGSPMPD

SEQ ID NO: 1234614 - protein, 11 aa, Mycobacterium
YDDKPNWRTRK

SEQ ID NO: 1234615 - protein, 11 aa, Mycobacterium
YDDPPTVGTTD

SEQ ID NO: 1234616 - protein, 8 aa, Mycobacterium
YDDQGRPQ

SEQ ID NO: 1234617 - protein, 4 aa, Mycobacterium
YDEA

SEQ ID NO: 1234618 - protein, 8 aa, Mycobacterium
YDEDRERF

SEQ ID NO: 1234619 - protein, 7 aa, Mycobacterium
YDEEEQP

SEQ ID NO: 1234620 - protein, 12 aa, Mycobacterium
YDEGDTFDQSAA

SEQ ID NO: 1234621 - protein, 5 aa, Mycobacterium
YDEGR

SEQ ID NO: 1234622 - protein, 4 aa, Mycobacterium
YDEP

SEQ ID NO: 1234623 - protein, 7 aa, Mycobacterium
YDETSPA

SEQ ID NO: 1234624 - protein, 7 aa, Mycobacterium
YDEVEPG

SEQ ID NO: 1234625 - protein, 4 aa, Mycobacterium
YDGA

SEQ ID NO: 1234626 - protein, 15 aa, Mycobacterium
YDGGSIPVNTHGGQL

SEQ ID NO: 1234627 - protein, 11 aa, Mycobacterium
YDGGTGAAPLT

SEQ ID NO: 1234628 - protein, 12 aa, Mycobacterium
YDGLPGLSAEEA

SEQ ID NO: 1234629 - protein, 18 aa, Mycobacterium
YDGPRPAPSRGPRPKTTV

SEQ ID NO: 1234630 - protein, 15 aa, Mycobacterium
YDGRLQSNEAVTTAR

SEQ ID NO: 1234631 - protein, 7 aa, Mycobacterium
YDGRPGH

SEQ ID NO: 1234632 - protein, 12 aa, Mycobacterium
YDGSSAGPDDAT

SEQ ID NO: 1234633 - protein, 5 aa, Mycobacterium
YDGSW

SEQ ID NO: 1234634 - protein, 9 aa, Mycobacterium
YDGVADAPD

SEQ ID NO: 1234635 - protein, 6 aa, Mycobacterium
YDKAAK

SEQ ID NO: 1234636 - protein, 4 aa, Mycobacterium
YDKP

SEQ ID NO: 1234637 - protein, 4 aa, Mycobacterium
YDLG

SEQ ID NO: 1234638 - protein, 5 aa, Mycobacterium
YDLPA

SEQ ID NO: 1234639 - protein, 7 aa, Mycobacterium
YDLPPSQ

SEQ ID NO: 1234640 - protein, 9 aa, Mycobacterium
YDNAPGQQV

SEQ ID NO: 1234641 - protein, 9 aa, Mycobacterium
YDNGRPKQV

SEQ ID NO: 1234642 - protein, 11 aa, Mycobacterium
YDNKDHEVVGR

SEQ ID NO: 1234643 - protein, 20 aa, Mycobacterium
YDNNLGDNRGFSPTAGPEAS

SEQ ID NO: 1234644 - protein, 14 aa, Mycobacterium
YDNPRAPHTDSDTK

SEQ ID NO: 1234645 - protein, 11 aa, Mycobacterium
YDPDAEDEMNP

SEQ ID NO: 1234646 - protein, 11 aa, Mycobacterium
YDPDATTQGPL

SEQ ID NO: 1234647 - protein, 5 aa, Mycobacterium
YDPDD

SEQ ID NO: 1234648 - protein, 10 aa, Mycobacterium
YDPGSADDGV

SEQ ID NO: 1234649 - protein, 10 aa, Mycobacterium
YDPGSTTDTG

SEQ ID NO: 1234650 - protein, 6 aa, Mycobacterium
YDPHTG

SEQ ID NO: 1234651 - protein, 10 aa, Mycobacterium
YDPNPDVSQR

SEQ ID NO: 1234652 - protein, 6 aa, Mycobacterium
YDPNRD

SEQ ID NO: 1234653 - protein, 8 aa, Mycobacterium
YDPQNEKL

SEQ ID NO: 1234654 - protein, 10 aa, Mycobacterium
YDPRKRLGDD

SEQ ID NO: 1234655 - protein, 12 aa, Mycobacterium
YDPTSAWRTPEV

SEQ ID NO: 1234656 - protein, 13 aa, Mycobacterium
YDPYVGKDIALHN

SEQ ID NO: 1234657 - protein, 4 aa, Mycobacterium
YDQP

SEQ ID NO: 1234658 - protein, 4 aa, Mycobacterium
YDQR

SEQ ID NO: 1234659 - protein, 19 aa, Mycobacterium
YDRPPPSLADYDDLLTGSD

SEQ ID NO: 1234660 - protein, 7 aa, Mycobacterium
YDRRPRP

SEQ ID NO: 1234661 - protein, 8 aa, Mycobacterium
YDRSSTTM

SEQ ID NO: 1234662 - protein, 7 aa, Mycobacterium
YDRTRST

SEQ ID NO: 1234663 - protein, 10 aa, Mycobacterium
YDSEKGRQLA

SEQ ID NO: 1234664 - protein, 9 aa, Mycobacterium
YDSSLAPEG

SEQ ID NO: 1234665 - protein, 5 aa, Mycobacterium
YDTHY

SEQ ID NO: 1234666 - protein, 23 aa, Mycobacterium
YDTPPPPIEAGSEFSQDRDPRYA

SEQ ID NO: 1234667 - protein, 7 aa, Mycobacterium
YDTPVQG

SEQ ID NO: 1234668 - protein, 14 aa, Mycobacterium
YDYTEDPTLNWSSP

SEQ ID NO: 1234669 - protein, 16 aa, Mycobacterium
YEAAKGSVVAVHTRDV

SEQ ID NO: 1234670 - protein, 9 aa, Mycobacterium
YEAGGIAKH

SEQ ID NO: 1234671 - protein, 8 aa, Mycobacterium
YEAGTEPG

SEQ ID NO: 1234672 - protein, 13 aa, Mycobacterium
YEAKSRGRNQLRL

SEQ ID NO: 1234673 - protein, 11 aa, Mycobacterium
YEARPGEADPA

SEQ ID NO: 1234674 - protein, 4 aa, Mycobacterium
YEDA

SEQ ID NO: 1234675 - protein, 5 aa, Mycobacterium
YEDGD

SEQ ID NO: 1234676 - protein, 9 aa, Mycobacterium
YEDPDDDQD

SEQ ID NO: 1234677 - protein, 8 aa, Mycobacterium
YEDPDRAD

SEQ ID NO: 1234678 - protein, 4 aa, Mycobacterium
YEDT

SEQ ID NO: 1234679 - protein, 7 aa, Mycobacterium
YEGDYDR

SEQ ID NO: 1234680 - protein, 12 aa, Mycobacterium
YEGVSARGRGMA

SEQ ID NO: 1234681 - protein, 8 aa, Mycobacterium
YEKDGSAR

SEQ ID NO: 1234682 - protein, 6 aa, Mycobacterium
YELPGT

SEQ ID NO: 1234683 - protein, 4 aa, Mycobacterium
YEMS

SEQ ID NO: 1234684 - protein, 4 aa, Mycobacterium
YENK

SEQ ID NO: 1234685 - protein, 8 aa, Mycobacterium
YENNRSGT

SEQ ID NO: 1234686 - protein, 4 aa, Mycobacterium
YEPA

SEQ ID NO: 1234687 - protein, 10 aa, Mycobacterium
YEPASPDAPD

SEQ ID NO: 1234688 - protein, 6 aa, Mycobacterium
YEPDNT

SEQ ID NO: 1234689 - protein, 5 aa, Mycobacterium
YEPED

SEQ ID NO: 1234690 - protein, 4 aa, Mycobacterium
YEPK

SEQ ID NO: 1234691 - protein, 5 aa, Mycobacterium
YEPLS

SEQ ID NO: 1234692 - protein, 7 aa, Mycobacterium
YEPMQNE

SEQ ID NO: 1234693 - protein, 6 aa, Mycobacterium
YEPTAK

SEQ ID NO: 1234694 - protein, 8 aa, Mycobacterium
YEQERKPH

SEQ ID NO: 1234695 - protein, 7 aa, Mycobacterium
YERERRP

SEQ ID NO: 1234696 - protein, 6 aa, Mycobacterium
YERGAS

SEQ ID NO: 1234697 - protein, 8 aa, Mycobacterium
YESGATIA

SEQ ID NO: 1234698 - protein, 10 aa, Mycobacterium
YESRSAPIEG

SEQ ID NO: 1234699 - protein, 6 aa, Mycobacterium
YETRTR

SEQ ID NO: 1234700 - protein, 16 aa, Mycobacterium
YFGPRPDDERGHDFAL

SEQ ID NO: 1234701 - protein, 4 aa, Mycobacterium
YFGQ

SEQ ID NO: 1234702 - protein, 7 aa, Mycobacterium
YFPGPAR

SEQ ID NO: 1234703 - protein, 6 aa, Mycobacterium
YFTGTG

SEQ ID NO: 1234704 - protein, 6 aa, Mycobacterium
YGADDR

SEQ ID NO: 1234705 - protein, 5 aa, Mycobacterium
YGANG

SEQ ID NO: 1234706 - protein, 13 aa, Mycobacterium
YGAPGTASATILS

SEQ ID NO: 1234707 - protein, 11 aa, Mycobacterium
YGAQGGDWGGA

SEQ ID NO: 1234708 - protein, 5 aa, Mycobacterium
YGASA

SEQ ID NO: 1234709 - protein, 10 aa, Mycobacterium
YGASGEHEGF

SEQ ID NO: 1234710 - protein, 8 aa, Mycobacterium
YGATKAGI

SEQ ID NO: 1234711 - protein, 8 aa, Mycobacterium
YGATTDKA

SEQ ID NO: 1234712 - protein, 13 aa, Mycobacterium
YGDARDAARAGGH

SEQ ID NO: 1234713 - protein, 11 aa, Mycobacterium
YGDEPTPTQEQ

SEQ ID NO: 1234714 - protein, 8 aa, Mycobacterium
YGDGYPAV

SEQ ID NO: 1234715 - protein, 5 aa, Mycobacterium
YGDNP

SEQ ID NO: 1234716 - protein, 9 aa, Mycobacterium
YGDPDNPDD

SEQ ID NO: 1234717 - protein, 6 aa, Mycobacterium
YGDPSS

SEQ ID NO: 1234718 - protein, 19 aa, Mycobacterium
YGDPTHAPNPNLRPVDSGP

SEQ ID NO: 1234719 - protein, 14 aa, Mycobacterium
YGDPTNKPNPNLGE

SEQ ID NO: 1234720 - protein, 4 aa, Mycobacterium
YGDR

SEQ ID NO: 1234721 - protein, 9 aa, Mycobacterium
YGDRKAADV

SEQ ID NO: 1234722 - protein, 10 aa, Mycobacterium
YGDRKDSAPL

SEQ ID NO: 1234723 - protein, 15 aa, Mycobacterium
YGDTRNNFEVSSDNR

SEQ ID NO: 1234724 - protein, 11 aa, Mycobacterium
YGEDEGGEEDL

SEQ ID NO: 1234725 - protein, 9 aa, Mycobacterium
YGEREEVRQ

SEQ ID NO: 1234726 - protein, 16 aa, Mycobacterium
YGESKRNSVGRALPDT

SEQ ID NO: 1234727 - protein, 10 aa, Mycobacterium
YGESLGEDHR

SEQ ID NO: 1234728 - protein, 8 aa, Mycobacterium
YGETTLDT

SEQ ID NO: 1234729 - protein, 9 aa, Mycobacterium
YGFDTEDTH

SEQ ID NO: 1234730 - protein, 12 aa, Mycobacterium
YGFSGKPRSTGW

SEQ ID NO: 1234731 - protein, 4 aa, Mycobacterium
YGGA

SEQ ID NO: 1234732 - protein, 6 aa, Mycobacterium
YGGDAT

SEQ ID NO: 1234733 - protein, 10 aa, Mycobacterium
YGGDPRNPEQ

SEQ ID NO: 1234734 - protein, 6 aa, Mycobacterium
YGGDSM

SEQ ID NO: 1234735 - protein, 7 aa, Mycobacterium
YGGDTPQ

SEQ ID NO: 1234736 - protein, 5 aa, Mycobacterium
YGGEE

SEQ ID NO: 1234737 - protein, 4 aa, Mycobacterium
YGGG

SEQ ID NO: 1234738 - protein, 12 aa, Mycobacterium
YGGHDATAGTTV

SEQ ID NO: 1234739 - protein, 17 aa, Mycobacterium
YGGKTIDDATWTPSRYD

SEQ ID NO: 1234740 - protein, 4 aa, Mycobacterium
YGGL

SEQ ID NO: 1234741 - protein, 12 aa, Mycobacterium
YGGPVDGPWPDA

SEQ ID NO: 1234742 - protein, 26 aa, Mycobacterium
YGGRITSTDSVATTALDTEDLNPQTG

SEQ ID NO: 1234743 - protein, 5 aa, Mycobacterium
YGGRQ

SEQ ID NO: 1234744 - protein, 5 aa, Mycobacterium
YGGRT

SEQ ID NO: 1234745 - protein, 10 aa, Mycobacterium
YGGRTDFAGP

SEQ ID NO: 1234746 - protein, 14 aa, Mycobacterium
YGGTGYAAGKGAVN

SEQ ID NO: 1234747 - protein, 8 aa, Mycobacterium
YGHDDRST

SEQ ID NO: 1234748 - protein, 13 aa, Mycobacterium
YGIKGDQASQGGF

SEQ ID NO: 1234749 - protein, 26 aa, Mycobacterium
YGKPGGTAPSDFTRGYAGGVADARTG

SEQ ID NO: 1234750 - protein, 14 aa, Mycobacterium
YGLKKARKAPQYSK

SEQ ID NO: 1234751 - protein, 4 aa, Mycobacterium
YGLP

SEQ ID NO: 1234752 - protein, 10 aa, Mycobacterium
YGLPTPSEGV

SEQ ID NO: 1234753 - protein, 7 aa, Mycobacterium
YGLTEAG

SEQ ID NO: 1234754 - protein, 31 aa, Mycobacterium
YGMTDTPPEAYERAANTLSEVAGRNNDASAQ

SEQ ID NO: 1234755 - protein, 10 aa, Mycobacterium
YGNPAGYSSS

SEQ ID NO: 1234756 - protein, 5 aa, Mycobacterium
YGNPT

SEQ ID NO: 1234757 - protein, 5 aa, Mycobacterium
YGPDG

SEQ ID NO: 1234758 - protein, 19 aa, Mycobacterium
YGPDKQDKPAKNRPSQRRR

SEQ ID NO: 1234759 - protein, 4 aa, Mycobacterium
YGPG

SEQ ID NO: 1234760 - protein, 20 aa, Mycobacterium
YGPGEDAQKYTAALKAAGHL

SEQ ID NO: 1234761 - protein, 8 aa, Mycobacterium
YGPGHPEL

SEQ ID NO: 1234762 - protein, 6 aa, Mycobacterium
YGPGRP

SEQ ID NO: 1234763 - protein, 16 aa, Mycobacterium
YGPGSVGSALTGDPRV

SEQ ID NO: 1234764 - protein, 7 aa, Mycobacterium
YGPPEPA

SEQ ID NO: 1234765 - protein, 8 aa, Mycobacterium
YGPPNDAR

SEQ ID NO: 1234766 - protein, 14 aa, Mycobacterium
YGPRSKKLGKGEIR

SEQ ID NO: 1234767 - protein, 14 aa, Mycobacterium
YGPSVDAADAEGAA

SEQ ID NO: 1234768 - protein, 4 aa, Mycobacterium
YGPT

SEQ ID NO: 1234769 - protein, 9 aa, Mycobacterium
YGPTPQYPV

SEQ ID NO: 1234770 - protein, 5 aa, Mycobacterium
YGPVS

SEQ ID NO: 1234771 - protein, 9 aa, Mycobacterium
YGQAGEPLP

SEQ ID NO: 1234772 - protein, 18 aa, Mycobacterium
YGQLSPDALSEKFRLAWS

SEQ ID NO: 1234773 - protein, 7 aa, Mycobacterium
YGQRASY

SEQ ID NO: 1234774 - protein, 4 aa, Mycobacterium
YGQS

SEQ ID NO: 1234775 - protein, 11 aa, Mycobacterium
YGQSVDDPEGQ

SEQ ID NO: 1234776 - protein, 6 aa, Mycobacterium
YGRHGT

SEQ ID NO: 1234777 - protein, 11 aa, Mycobacterium
YGRPPADDREL

SEQ ID NO: 1234778 - protein, 5 aa, Mycobacterium
YGRPS

SEQ ID NO: 1234779 - protein, 8 aa, Mycobacterium
YGRRESYA

SEQ ID NO: 1234780 - protein, 9 aa, Mycobacterium
YGRRRRGRR

SEQ ID NO: 1234781 - protein, 10 aa, Mycobacterium
YGRSSNPTWR

SEQ ID NO: 1234782 - protein, 13 aa, Mycobacterium
YGSDGPDADRPAY

SEQ ID NO: 1234783 - protein, 9 aa, Mycobacterium
YGSEEQRKT

SEQ ID NO: 1234784 - protein, 15 aa, Mycobacterium
YGSGSQATVDQGTSI

SEQ ID NO: 1234785 - protein, 5 aa, Mycobacterium
YGSKD

SEQ ID NO: 1234786 - protein, 26 aa, Mycobacterium
YGSSEGGAVATPDPAAPPAALGRPAH

SEQ ID NO: 1234787 - protein, 13 aa, Mycobacterium
YGSSTTTGEGGDE

SEQ ID NO: 1234788 - protein, 8 aa, Mycobacterium
YGSTATAE

SEQ ID NO: 1234789 - protein, 8 aa, Mycobacterium
YGTDLRGP

SEQ ID NO: 1234790 - protein, 8 aa, Mycobacterium
YGTDPATG

SEQ ID NO: 1234791 - protein, 21 aa, Mycobacterium
YGTEGRKGGLDAAETERGRAE

SEQ ID NO: 1234792 - protein, 23 aa, Mycobacterium
YGTGGKGGRGGELVGNGGDGGIA

SEQ ID NO: 1234793 - protein, 6 aa, Mycobacterium
YGTGHT

SEQ ID NO: 1234794 - protein, 43 aa, Mycobacterium
YGTPPNPAAPDRVPGGSSSGSASLVAGGQAELGLGTDTGGSIR

SEQ ID NO: 1234795 - protein, 8 aa, Mycobacterium
YGTPRSST

SEQ ID NO: 1234796 - protein, 5 aa, Mycobacterium
YGTPV

SEQ ID NO: 1234797 - protein, 6 aa, Mycobacterium
YGTQPG

SEQ ID NO: 1234798 - protein, 16 aa, Mycobacterium
YGTRARTGATTDTKES

SEQ ID NO: 1234799 - protein, 17 aa, Mycobacterium
YGTRSGTVATPGTQEAH

SEQ ID NO: 1234800 - protein, 17 aa, Mycobacterium
YGTRSRMGATTVTQETR

SEQ ID NO: 1234801 - protein, 24 aa, Mycobacterium
YGTRTSVHPGPLGDDLEGASRPGH

SEQ ID NO: 1234802 - protein, 6 aa, Mycobacterium
YGTSYG

SEQ ID NO: 1234803 - protein, 4 aa, Mycobacterium
YGTT

SEQ ID NO: 1234804 - protein, 6 aa, Mycobacterium
YGTTAE

SEQ ID NO: 1234805 - protein, 7 aa, Mycobacterium
YGTTGDL

SEQ ID NO: 1234806 - protein, 11 aa, Mycobacterium
YGTTTRAGDER

SEQ ID NO: 1234807 - protein, 6 aa, Mycobacterium
YGTYDD

SEQ ID NO: 1234808 - protein, 5 aa, Mycobacterium
YGVES

SEQ ID NO: 1234809 - protein, 21 aa, Mycobacterium
YGVPGSANDTMGGPGSTGGAH

SEQ ID NO: 1234810 - protein, 8 aa, Mycobacterium
YGVPKAGV

SEQ ID NO: 1234811 - protein, 6 aa, Mycobacterium
YGVPRD

SEQ ID NO: 1234812 - protein, 6 aa, Mycobacterium
YGVPRG

SEQ ID NO: 1234813 - protein, 22 aa, Mycobacterium
YGVTPKGWRAAAGDYGKAGSHM

SEQ ID NO: 1234814 - protein, 5 aa, Mycobacterium
YGWSS

SEQ ID NO: 1234815 - protein, 7 aa, Mycobacterium
YHANEGG

SEQ ID NO: 1234816 - protein, 15 aa, Mycobacterium
YHAPDRTVRISKNNT

SEQ ID NO: 1234817 - protein, 9 aa, Mycobacterium
YHDSDDEHF

SEQ ID NO: 1234818 - protein, 6 aa, Mycobacterium
YHEQEA

SEQ ID NO: 1234819 - protein, 11 aa, Mycobacterium
YHETENGYGRL

SEQ ID NO: 1234820 - protein, 8 aa, Mycobacterium
YHGGTDTA

SEQ ID NO: 1234821 - protein, 9 aa, Mycobacterium
YHRGTPLRE

SEQ ID NO: 1234822 - protein, 6 aa, Mycobacterium
YHRPPL

SEQ ID NO: 1234823 - protein, 8 aa, Mycobacterium
YHRSDRTT

SEQ ID NO: 1234824 - protein, 9 aa, Mycobacterium
YIPDPARRD

SEQ ID NO: 1234825 - protein, 9 aa, Mycobacterium
YKAQNMSNN

SEQ ID NO: 1234826 - protein, 8 aa, Mycobacterium
YKDGGSVT

SEQ ID NO: 1234827 - protein, 6 aa, Mycobacterium
YKDPAM

SEQ ID NO: 1234828 - protein, 6 aa, Mycobacterium
YKDTST

SEQ ID NO: 1234829 - protein, 10 aa, Mycobacterium
YKEEGTTTTP

SEQ ID NO: 1234830 - protein, 13 aa, Mycobacterium
YKMPGGTPSSPGL

SEQ ID NO: 1234831 - protein, 12 aa, Mycobacterium
YKPARREGTREG

SEQ ID NO: 1234832 - protein, 16 aa, Mycobacterium
YKRGATVDRCEGDAKN

SEQ ID NO: 1234833 - protein, 6 aa, Mycobacterium
YKRSED

SEQ ID NO: 1234834 - protein, 16 aa, Mycobacterium
YKSDARPDLGKGEGAQ

SEQ ID NO: 1234835 - protein, 23 aa, Mycobacterium
YKSERNESTGRSRPKGLRENKRT

SEQ ID NO: 1234836 - protein, 9 aa, Mycobacterium
YKSSARPAL

SEQ ID NO: 1234837 - protein, 10 aa, Mycobacterium
YKSSARPALD

SEQ ID NO: 1234838 - protein, 6 aa, Mycobacterium
YKSSEQ

SEQ ID NO: 1234839 - protein, 7 aa, Mycobacterium
YKTKGAS

SEQ ID NO: 1234840 - protein, 10 aa, Mycobacterium
YKVEGKQGTR

SEQ ID NO: 1234841 - protein, 9 aa, Mycobacterium
YLGSEDARY

SEQ ID NO: 1234842 - protein, 6 aa, Mycobacterium
YLSGET

SEQ ID NO: 1234843 - protein, 8 aa, Mycobacterium
YMGGRTDG

SEQ ID NO: 1234844 - protein, 17 aa, Mycobacterium
YMNGPSGALPLAQSPEE

SEQ ID NO: 1234845 - protein, 7 aa, Mycobacterium
YNAPATL

SEQ ID NO: 1234846 - protein, 6 aa, Mycobacterium
YNDADP

SEQ ID NO: 1234847 - protein, 15 aa, Mycobacterium
YNEEAQTFNGTTAMS

SEQ ID NO: 1234848 - protein, 12 aa, Mycobacterium
YNEGAARGEDPL

SEQ ID NO: 1234849 - protein, 10 aa, Mycobacterium
YNEPSPGAWS

SEQ ID NO: 1234850 - protein, 8 aa, Mycobacterium
YNERGGKL

SEQ ID NO: 1234851 - protein, 16 aa, Mycobacterium
YNGDNTVLSGPAGDLE

SEQ ID NO: 1234852 - protein, 7 aa, Mycobacterium
YNGPNTV

SEQ ID NO: 1234853 - protein, 16 aa, Mycobacterium
YNGTNTVLSGPAGDLE

SEQ ID NO: 1234854 - protein, 9 aa, Mycobacterium
YNNNTRYSF

SEQ ID NO: 1234855 - protein, 17 aa, Mycobacterium
YNPEPPELRDESRSPWP

SEQ ID NO: 1234856 - protein, 15 aa, Mycobacterium
YNPETGQYATPDGGV

SEQ ID NO: 1234857 - protein, 15 aa, Mycobacterium
YNPPNGGPADTDATS

SEQ ID NO: 1234858 - protein, 12 aa, Mycobacterium
YNSDDQQSSFTD

SEQ ID NO: 1234859 - protein, 22 aa, Mycobacterium
YNSPDYTDREEARQEKIGGSWG

SEQ ID NO: 1234860 - protein, 11 aa, Mycobacterium
YNSSTNTWSGS

SEQ ID NO: 1234861 - protein, 11 aa, Mycobacterium
YNTAKGGVQAL

SEQ ID NO: 1234862 - protein, 10 aa, Mycobacterium
YPAGPTQASN

SEQ ID NO: 1234863 - protein, 22 aa, Mycobacterium
YPAGTQRDWRETGETPVPGKTI

SEQ ID NO: 1234864 - protein, 7 aa, Mycobacterium
YPAIKGQ

SEQ ID NO: 1234865 - protein, 8 aa, Mycobacterium
YPARIPEA

SEQ ID NO: 1234866 - protein, 12 aa, Mycobacterium
YPARVRDSGFDS

SEQ ID NO: 1234867 - protein, 6 aa, Mycobacterium
YPASGR

SEQ ID NO: 1234868 - protein, 12 aa, Mycobacterium
YPASYHPAKRDH

SEQ ID NO: 1234869 - protein, 11 aa, Mycobacterium
YPATPVPEDGG

SEQ ID NO: 1234870 - protein, 11 aa, Mycobacterium
YPAVSTSEIGK

SEQ ID NO: 1234871 - protein, 9 aa, Mycobacterium
YPDAASESF

SEQ ID NO: 1234872 - protein, 18 aa, Mycobacterium
YPDAEASLAAARATAAEI

SEQ ID NO: 1234873 - protein, 8 aa, Mycobacterium
YPDDADRE

SEQ ID NO: 1234874 - protein, 9 aa, Mycobacterium
YPDDPKAFG

SEQ ID NO: 1234875 - protein, 20 aa, Mycobacterium
YPDGGADGLGPRIPQAAGGW

SEQ ID NO: 1234876 - protein, 17 aa, Mycobacterium
YPDGKGGSAAELAARSA

SEQ ID NO: 1234877 - protein, 7 aa, Mycobacterium
YPDGRPH

SEQ ID NO: 1234878 - protein, 8 aa, Mycobacterium
YPDGSTPE

SEQ ID NO: 1234879 - protein, 4 aa, Mycobacterium
YPDH

SEQ ID NO: 1234880 - protein, 9 aa, Mycobacterium
YPDLNESRA

SEQ ID NO: 1234881 - protein, 9 aa, Mycobacterium
YPDLPEDAN

SEQ ID NO: 1234882 - protein, 21 aa, Mycobacterium
YPDPGADGAGPRIPAAAGGWS

SEQ ID NO: 1234883 - protein, 9 aa, Mycobacterium
YPDPPPESL

SEQ ID NO: 1234884 - protein, 11 aa, Mycobacterium
YPDQPKNYQIS

SEQ ID NO: 1234885 - protein, 8 aa, Mycobacterium
YPEGIPGA

SEQ ID NO: 1234886 - protein, 4 aa, Mycobacterium
YPEI

SEQ ID NO: 1234887 - protein, 7 aa, Mycobacterium
YPEPDSI

SEQ ID NO: 1234888 - protein, 9 aa, Mycobacterium
YPEPGAAGY

SEQ ID NO: 1234889 - protein, 8 aa, Mycobacterium
YPEPSPDA

SEQ ID NO: 1234890 - protein, 34 aa, Mycobacterium
YPETAQPDADIAPARPLRPDSGVAGGQHPAELTT

SEQ ID NO: 1234891 - protein, 4 aa, Mycobacterium
YPEV

SEQ ID NO: 1234892 - protein, 4 aa, Mycobacterium
YPFA

SEQ ID NO: 1234893 - protein, 8 aa, Mycobacterium
YPGADTAA

SEQ ID NO: 1234894 - protein, 7 aa, Mycobacterium
YPGARGM

SEQ ID NO: 1234895 - protein, 9 aa, Mycobacterium
YPGASAAEA

SEQ ID NO: 1234896 - protein, 14 aa, Mycobacterium
YPGFTSTAPPGDGQ

SEQ ID NO: 1234897 - protein, 4 aa, Mycobacterium
YPGG

SEQ ID NO: 1234898 - protein, 8 aa, Mycobacterium
YPGGAGFA

SEQ ID NO: 1234899 - protein, 6 aa, Mycobacterium
YPGGLT

SEQ ID NO: 1234900 - protein, 10 aa, Mycobacterium
YPGGVPGPDR

SEQ ID NO: 1234901 - protein, 24 aa, Mycobacterium
YPGHGDDTTLGTERPHLGEWHERG

SEQ ID NO: 1234902 - protein, 5 aa, Mycobacterium
YPGHR

SEQ ID NO: 1234903 - protein, 7 aa, Mycobacterium
YPGMSGR

SEQ ID NO: 1234904 - protein, 7 aa, Mycobacterium
YPGQDGY

SEQ ID NO: 1234905 - protein, 10 aa, Mycobacterium
YPGQRGKQDF

SEQ ID NO: 1234906 - protein, 5 aa, Mycobacterium
YPHAA

SEQ ID NO: 1234907 - protein, 12 aa, Mycobacterium
YPHNESTFGYSE

SEQ ID NO: 1234908 - protein, 11 aa, Mycobacterium
YPHPEGLAEPK

SEQ ID NO: 1234909 - protein, 11 aa, Mycobacterium
YPHSRPPQAEL

SEQ ID NO: 1234910 - protein, 5 aa, Mycobacterium
YPIPT

SEQ ID NO: 1234911 - protein, 13 aa, Mycobacterium
YPKRDGKLPPTSK

SEQ ID NO: 1234912 - protein, 9 aa, Mycobacterium
YPKTAEPAV

SEQ ID NO: 1234913 - protein, 12 aa, Mycobacterium
YPKTGDAKLDDK

SEQ ID NO: 1234914 - protein, 8 aa, Mycobacterium
YPKYGHPI

SEQ ID NO: 1234915 - protein, 9 aa, Mycobacterium
YPKYGHPVS

SEQ ID NO: 1234916 - protein, 5 aa, Mycobacterium
YPLGA

SEQ ID NO: 1234917 - protein, 13 aa, Mycobacterium
YPLGATYDGSGTN

SEQ ID NO: 1234918 - protein, 16 aa, Mycobacterium
YPLPQGKRLPATDPRH

SEQ ID NO: 1234919 - protein, 8 aa, Mycobacterium
YPNEEVKG

SEQ ID NO: 1234920 - protein, 7 aa, Mycobacterium
YPPDAQL

SEQ ID NO: 1234921 - protein, 9 aa, Mycobacterium
YPPDKQPEA

SEQ ID NO: 1234922 - protein, 5 aa, Mycobacterium
YPPDR

SEQ ID NO: 1234923 - protein, 5 aa, Mycobacterium
YPPEL

SEQ ID NO: 1234924 - protein, 6 aa, Mycobacterium
YPPEVY

SEQ ID NO: 1234925 - protein, 6 aa, Mycobacterium
YPPGLA

SEQ ID NO: 1234926 - protein, 8 aa, Mycobacterium
YPPLGGRP

SEQ ID NO: 1234927 - protein, 17 aa, Mycobacterium
YPPPPEFTESANATAEL

SEQ ID NO: 1234928 - protein, 58 aa, Mycobacterium
YPPPPQGGYPPPPPPGGYPPPPTQGGYPPPPPGGYPPPPPPQGGYPPPPQGNYPPAGF

SEQ ID NO: 1234929 - protein, 7 aa, Mycobacterium
YPPQEDS

SEQ ID NO: 1234930 - protein, 5 aa, Mycobacterium
YPPQR

SEQ ID NO: 1234931 - protein, 5 aa, Mycobacterium
YPPSD

SEQ ID NO: 1234932 - protein, 12 aa, Mycobacterium
YPPTPGQDERLG

SEQ ID NO: 1234933 - protein, 23 aa, Mycobacterium
YPPYAEYQTKTSRQIPVFLVEKA

SEQ ID NO: 1234934 - protein, 6 aa, Mycobacterium
YPQADP

SEQ ID NO: 1234935 - protein, 4 aa, Mycobacterium
YPQF

SEQ ID NO: 1234936 - protein, 8 aa, Mycobacterium
YPQGVPQT

SEQ ID NO: 1234937 - protein, 4 aa, Mycobacterium
YPQP

SEQ ID NO: 1234938 - protein, 6 aa, Mycobacterium
YPQSRS

SEQ ID NO: 1234939 - protein, 7 aa, Mycobacterium
YPRGDLP

SEQ ID NO: 1234940 - protein, 8 aa, Mycobacterium
YPRGDLPP

SEQ ID NO: 1234941 - protein, 9 aa, Mycobacterium
YPSAGLASA

SEQ ID NO: 1234942 - protein, 6 aa, Mycobacterium
YPSGEG

SEQ ID NO: 1234943 - protein, 10 aa, Mycobacterium
YPSGNRDEDV

SEQ ID NO: 1234944 - protein, 7 aa, Mycobacterium
YPSPEQE

SEQ ID NO: 1234945 - protein, 11 aa, Mycobacterium
YPSPGDPRGNC

SEQ ID NO: 1234946 - protein, 16 aa, Mycobacterium
YPSPTSGQRVPLGEAG

SEQ ID NO: 1234947 - protein, 4 aa, Mycobacterium
YPSR

SEQ ID NO: 1234948 - protein, 7 aa, Mycobacterium
YPTATDQ

SEQ ID NO: 1234949 - protein, 5 aa, Mycobacterium
YPTIT

SEQ ID NO: 1234950 - protein, 8 aa, Mycobacterium
YPTKPGSV

SEQ ID NO: 1234951 - protein, 5 aa, Mycobacterium
YPTRP

SEQ ID NO: 1234952 - protein, 5 aa, Mycobacterium
YPTTV

SEQ ID NO: 1234953 - protein, 18 aa, Mycobacterium
YPVGPDAGLGTDPAGDEF

SEQ ID NO: 1234954 - protein, 5 aa, Mycobacterium
YPVQQ

SEQ ID NO: 1234955 - protein, 9 aa, Mycobacterium
YQADPSVGR

SEQ ID NO: 1234956 - protein, 5 aa, Mycobacterium
YQARH

SEQ ID NO: 1234957 - protein, 12 aa, Mycobacterium
YQAVDASNATTL

SEQ ID NO: 1234958 - protein, 13 aa, Mycobacterium
YQDDGNAGQIPEM

SEQ ID NO: 1234959 - protein, 4 aa, Mycobacterium
YQDG

SEQ ID NO: 1234960 - protein, 9 aa, Mycobacterium
YQDSDGNVA

SEQ ID NO: 1234961 - protein, 10 aa, Mycobacterium
YQETLTDPSY

SEQ ID NO: 1234962 - protein, 8 aa, Mycobacterium
YQGFGPGG

SEQ ID NO: 1234963 - protein, 24 aa, Mycobacterium
YQGKETAEAGTGGRGGEAGNPSTS

SEQ ID NO: 1234964 - protein, 14 aa, Mycobacterium
YQGQQYPDRKRPRI

SEQ ID NO: 1234965 - protein, 5 aa, Mycobacterium
YQGRG

SEQ ID NO: 1234966 - protein, 8 aa, Mycobacterium
YQGSPLGG

SEQ ID NO: 1234967 - protein, 13 aa, Mycobacterium
YQNANKRRRKATR

SEQ ID NO: 1234968 - protein, 9 aa, Mycobacterium
YQNRQDPAL

SEQ ID NO: 1234969 - protein, 13 aa, Mycobacterium
YQNSSAGNPDTID

SEQ ID NO: 1234970 - protein, 7 aa, Mycobacterium
YQPAMNN

SEQ ID NO: 1234971 - protein, 10 aa, Mycobacterium
YQPDGGRGAT

SEQ ID NO: 1234972 - protein, 13 aa, Mycobacterium
YQPDGSATPLDRG

SEQ ID NO: 1234973 - protein, 29 aa, Mycobacterium
YQPPAPSAPPAPSSPPPVEAPPPPPPPPN

SEQ ID NO: 1234974 - protein, 5 aa, Mycobacterium
YQPQV

SEQ ID NO: 1234975 - protein, 7 aa, Mycobacterium
YQPRLGD

SEQ ID NO: 1234976 - protein, 8 aa, Mycobacterium
YQPSRENA

SEQ ID NO: 1234977 - protein, 7 aa, Mycobacterium
YQPTSED

SEQ ID NO: 1234978 - protein, 18 aa, Mycobacterium
YQQPGQEPTSVANEISSQ

SEQ ID NO: 1234979 - protein, 11 aa, Mycobacterium
YQSDGGPGVGD

SEQ ID NO: 1234980 - protein, 11 aa, Mycobacterium
YQSNPPRSEYL

SEQ ID NO: 1234981 - protein, 4 aa, Mycobacterium
YQTK

SEQ ID NO: 1234982 - protein, 5 aa, Mycobacterium
YQTRR

SEQ ID NO: 1234983 - protein, 15 aa, Mycobacterium
YQVATGNDADSDRHG

SEQ ID NO: 1234984 - protein, 5 aa, Mycobacterium
YRAGP

SEQ ID NO: 1234985 - protein, 10 aa, Mycobacterium
YRAQQRRAEE

SEQ ID NO: 1234986 - protein, 10 aa, Mycobacterium
YRATETAPGE

SEQ ID NO: 1234987 - protein, 12 aa, Mycobacterium
YRATRDRIQAAT

SEQ ID NO: 1234988 - protein, 4 aa, Mycobacterium
YRDA

SEQ ID NO: 1234989 - protein, 12 aa, Mycobacterium
YRDAVGDGYRTI

SEQ ID NO: 1234990 - protein, 4 aa, Mycobacterium
YRDE

SEQ ID NO: 1234991 - protein, 7 aa, Mycobacterium
YRDESGQ

SEQ ID NO: 1234992 - protein, 17 aa, Mycobacterium
YRDGGEGAEVSWLSRGV

SEQ ID NO: 1234993 - protein, 8 aa, Mycobacterium
YRDKRDDV

SEQ ID NO: 1234994 - protein, 16 aa, Mycobacterium
YRDTVTTASGRLTGSE

SEQ ID NO: 1234995 - protein, 9 aa, Mycobacterium
YREFGDKDG

SEQ ID NO: 1234996 - protein, 8 aa, Mycobacterium
YREKGGKL

SEQ ID NO: 1234997 - protein, 8 aa, Mycobacterium
YRGAGGDG

SEQ ID NO: 1234998 - protein, 23 aa, Mycobacterium
YRGHPDGGTKARASGAEDPTGVS

SEQ ID NO: 1234999 - protein, 8 aa, Mycobacterium
YRGNTTAV

SEQ ID NO: 1235000 - protein, 9 aa, Mycobacterium
YRGNTTPVA

SEQ ID NO: 1235001 - protein, 5 aa, Mycobacterium
YRGQP

SEQ ID NO: 1235002 - protein, 8 aa, Mycobacterium
YRGRADRQ

SEQ ID NO: 1235003 - protein, 4 aa, Mycobacterium
YRGT

SEQ ID NO: 1235004 - protein, 6 aa, Mycobacterium
YRGTAR

SEQ ID NO: 1235005 - protein, 17 aa, Mycobacterium
YRHAAEKPTATILTELA

SEQ ID NO: 1235006 - protein, 8 aa, Mycobacterium
YRNGSGRW

SEQ ID NO: 1235007 - protein, 15 aa, Mycobacterium
YRPAGPDGAYAHPSR

SEQ ID NO: 1235008 - protein, 9 aa, Mycobacterium
YRPAVEADS

SEQ ID NO: 1235009 - protein, 6 aa, Mycobacterium
YRPERG

SEQ ID NO: 1235010 - protein, 5 aa, Mycobacterium
YRPGG

SEQ ID NO: 1235011 - protein, 4 aa, Mycobacterium
YRPN

SEQ ID NO: 1235012 - protein, 11 aa, Mycobacterium
YRPSAESRTAV

SEQ ID NO: 1235013 - protein, 4 aa, Mycobacterium
YRPT

SEQ ID NO: 1235014 - protein, 12 aa, Mycobacterium
YRPTASENTIDF

SEQ ID NO: 1235015 - protein, 8 aa, Mycobacterium
YRQKTPRP

SEQ ID NO: 1235016 - protein, 13 aa, Mycobacterium
YRQRGRHASSSDE

SEQ ID NO: 1235017 - protein, 11 aa, Mycobacterium
YRRADDDTAPI

SEQ ID NO: 1235018 - protein, 5 aa, Mycobacterium
YRRAR

SEQ ID NO: 1235019 - protein, 6 aa, Mycobacterium
YRRGAE

SEQ ID NO: 1235020 - protein, 7 aa, Mycobacterium
YRRNAQR

SEQ ID NO: 1235021 - protein, 7 aa, Mycobacterium
YRRTPDG

SEQ ID NO: 1235022 - protein, 10 aa, Mycobacterium
YRSGEHGDVS

SEQ ID NO: 1235023 - protein, 9 aa, Mycobacterium
YRSPGGAGI

SEQ ID NO: 1235024 - protein, 10 aa, Mycobacterium
YRSTGGKSLD

SEQ ID NO: 1235025 - protein, 6 aa, Mycobacterium
YRSTQT

SEQ ID NO: 1235026 - protein, 6 aa, Mycobacterium
YRSTSV

SEQ ID NO: 1235027 - protein, 5 aa, Mycobacterium
YRTAP

SEQ ID NO: 1235028 - protein, 9 aa, Mycobacterium
YRTDSDIAA

SEQ ID NO: 1235029 - protein, 15 aa, Mycobacterium
YRTESTAAGDSGMPV

SEQ ID NO: 1235030 - protein, 13 aa, Mycobacterium
YRTGGGPAGNVRK

SEQ ID NO: 1235031 - protein, 4 aa, Mycobacterium
YRTK

SEQ ID NO: 1235032 - protein, 25 aa, Mycobacterium
YRTNSLRTAQRAHASEDVFAALAAQ

SEQ ID NO: 1235033 - protein, 16 aa, Mycobacterium
YRTNSWRTAQRAHAPQ

SEQ ID NO: 1235034 - protein, 6 aa, Mycobacterium
YRTPQA

SEQ ID NO: 1235035 - protein, 9 aa, Mycobacterium
YRTPRPNPK

SEQ ID NO: 1235036 - protein, 20 aa, Mycobacterium
YRTQSEADSAAGALAEEIGS

SEQ ID NO: 1235037 - protein, 10 aa, Mycobacterium
YRTRADLPAD

SEQ ID NO: 1235038 - protein, 15 aa, Mycobacterium
YRTRPTTSATTRRTA

SEQ ID NO: 1235039 - protein, 8 aa, Mycobacterium
YRTRTGRR

SEQ ID NO: 1235040 - protein, 4 aa, Mycobacterium
YRVS

SEQ ID NO: 1235041 - protein, 12 aa, Mycobacterium
YRVTGNRGSSAY

SEQ ID NO: 1235042 - protein, 4 aa, Mycobacterium
YRWP

SEQ ID NO: 1235043 - protein, 5 aa, Mycobacterium
YRYDE

SEQ ID NO: 1235044 - protein, 21 aa, Mycobacterium
YRYSTNVEPAGAAVPTPAGRW

SEQ ID NO: 1235045 - protein, 4 aa, Mycobacterium
YSAA

SEQ ID NO: 1235046 - protein, 6 aa, Mycobacterium
YSADGG

SEQ ID NO: 1235047 - protein, 9 aa, Mycobacterium
YSAGKKSPH

SEQ ID NO: 1235048 - protein, 12 aa, Mycobacterium
YSAQEATKALRT

SEQ ID NO: 1235049 - protein, 9 aa, Mycobacterium
YSAQKENYA

SEQ ID NO: 1235050 - protein, 7 aa, Mycobacterium
YSARADA

SEQ ID NO: 1235051 - protein, 16 aa, Mycobacterium
YSDAGTPQLQGQYQDS

SEQ ID NO: 1235052 - protein, 11 aa, Mycobacterium
YSDDKDGTDLG

SEQ ID NO: 1235053 - protein, 10 aa, Mycobacterium
YSDPPALASS

SEQ ID NO: 1235054 - protein, 5 aa, Mycobacterium
YSDPV

SEQ ID NO: 1235055 - protein, 20 aa, Mycobacterium
YSDTAAAAAEPHDPQTSADD

SEQ ID NO: 1235056 - protein, 10 aa, Mycobacterium
YSEGAPAGWE

SEQ ID NO: 1235057 - protein, 8 aa, Mycobacterium
YSEINGPD

SEQ ID NO: 1235058 - protein, 4 aa, Mycobacterium
YSEP

SEQ ID NO: 1235059 - protein, 14 aa, Mycobacterium
YSERTSDNRLRQPS

SEQ ID NO: 1235060 - protein, 6 aa, Mycobacterium
YSGATT

SEQ ID NO: 1235061 - protein, 5 aa, Mycobacterium
YSGDV

SEQ ID NO: 1235062 - protein, 18 aa, Mycobacterium
YSGEGSTDLDVIVEITRL

SEQ ID NO: 1235063 - protein, 4 aa, Mycobacterium
YSGG

SEQ ID NO: 1235064 - protein, 5 aa, Mycobacterium
YSGGM

SEQ ID NO: 1235065 - protein, 7 aa, Mycobacterium
YSGPAAE

SEQ ID NO: 1235066 - protein, 9 aa, Mycobacterium
YSGPAYGEA

SEQ ID NO: 1235067 - protein, 5 aa, Mycobacterium
YSGRS

SEQ ID NO: 1235068 - protein, 10 aa, Mycobacterium
YSGSAPGAAL

SEQ ID NO: 1235069 - protein, 18 aa, Mycobacterium
YSGSQYNAGRKIPSSQMR

SEQ ID NO: 1235070 - protein, 8 aa, Mycobacterium
YSGTGNAK

SEQ ID NO: 1235071 - protein, 8 aa, Mycobacterium
YSGTGTAK

SEQ ID NO: 1235072 - protein, 7 aa, Mycobacterium
YSGTPIN

SEQ ID NO: 1235073 - protein, 12 aa, Mycobacterium
YSISSSPLVSPN

SEQ ID NO: 1235074 - protein, 6 aa, Mycobacterium
YSLRGK

SEQ ID NO: 1235075 - protein, 6 aa, Mycobacterium
YSNQDV

SEQ ID NO: 1235076 - protein, 15 aa, Mycobacterium
YSNTGGQMSKATPLG

SEQ ID NO: 1235077 - protein, 9 aa, Mycobacterium
YSPASGDPM

SEQ ID NO: 1235078 - protein, 5 aa, Mycobacterium
YSPEE

SEQ ID NO: 1235079 - protein, 6 aa, Mycobacterium
YSPEQG

SEQ ID NO: 1235080 - protein, 6 aa, Mycobacterium
YSPGTV

SEQ ID NO: 1235081 - protein, 9 aa, Mycobacterium
YSPNSPLGG

SEQ ID NO: 1235082 - protein, 7 aa, Mycobacterium
YSPRRQK

SEQ ID NO: 1235083 - protein, 5 aa, Mycobacterium
YSPSA

SEQ ID NO: 1235084 - protein, 6 aa, Mycobacterium
YSPSSD

SEQ ID NO: 1235085 - protein, 6 aa, Mycobacterium
YSQASA

SEQ ID NO: 1235086 - protein, 4 aa, Mycobacterium
YSQG

SEQ ID NO: 1235087 - protein, 11 aa, Mycobacterium
YSQTDLATHSR

SEQ ID NO: 1235088 - protein, 8 aa, Mycobacterium
YSRAAEDG

SEQ ID NO: 1235089 - protein, 16 aa, Mycobacterium
YSRPARGAQEVAGSYR

SEQ ID NO: 1235090 - protein, 10 aa, Mycobacterium
YSRSDKKRLQ

SEQ ID NO: 1235091 - protein, 9 aa, Mycobacterium
YSRTAGPKI

SEQ ID NO: 1235092 - protein, 11 aa, Mycobacterium
YSRTGNPTRSV

SEQ ID NO: 1235093 - protein, 4 aa, Mycobacterium
YSSA

SEQ ID NO: 1235094 - protein, 15 aa, Mycobacterium
YSSYTPDPSDGGRSG

SEQ ID NO: 1235095 - protein, 4 aa, Mycobacterium
YSTA

SEQ ID NO: 1235096 - protein, 9 aa, Mycobacterium
YSTDNGENF

SEQ ID NO: 1235097 - protein, 10 aa, Mycobacterium
YSTDNGVPGT

SEQ ID NO: 1235098 - protein, 10 aa, Mycobacterium
YSTGRAATDV

SEQ ID NO: 1235099 - protein, 11 aa, Mycobacterium
YSTGRSASDVA

SEQ ID NO: 1235100 - protein, 4 aa, Mycobacterium
YSTP

SEQ ID NO: 1235101 - protein, 5 aa, Mycobacterium
YSTPF

SEQ ID NO: 1235102 - protein, 10 aa, Mycobacterium
YSTRSGQLAK

SEQ ID NO: 1235103 - protein, 10 aa, Mycobacterium
YSTVTPRDPI

SEQ ID NO: 1235104 - protein, 9 aa, Mycobacterium
YSVPPELAS

SEQ ID NO: 1235105 - protein, 11 aa, Mycobacterium
YSVSTANPLAT

SEQ ID NO: 1235106 - protein, 12 aa, Mycobacterium
YSYENGGVPTNE

SEQ ID NO: 1235107 - protein, 6 aa, Mycobacterium
YSYERR

SEQ ID NO: 1235108 - protein, 5 aa, Mycobacterium
YTADD

SEQ ID NO: 1235109 - protein, 8 aa, Mycobacterium
YTADPDRQ

SEQ ID NO: 1235110 - protein, 6 aa, Mycobacterium
YTAEPL

SEQ ID NO: 1235111 - protein, 8 aa, Mycobacterium
YTAPGGDA

SEQ ID NO: 1235112 - protein, 12 aa, Mycobacterium
YTAREKAKELGA

SEQ ID NO: 1235113 - protein, 7 aa, Mycobacterium
YTARPYR

SEQ ID NO: 1235114 - protein, 7 aa, Mycobacterium
YTASEAE

SEQ ID NO: 1235115 - protein, 11 aa, Mycobacterium
YTASKAAIEGF

SEQ ID NO: 1235116 - protein, 10 aa, Mycobacterium
YTATGDPQID

SEQ ID NO: 1235117 - protein, 10 aa, Mycobacterium
YTDAGPTARR

SEQ ID NO: 1235118 - protein, 7 aa, Mycobacterium
YTDAPRP

SEQ ID NO: 1235119 - protein, 7 aa, Mycobacterium
YTDDQRD

SEQ ID NO: 1235120 - protein, 6 aa, Mycobacterium
YTDGSR

SEQ ID NO: 1235121 - protein, 7 aa, Mycobacterium
YTDGTTK

SEQ ID NO: 1235122 - protein, 9 aa, Mycobacterium
YTDNTSARA

SEQ ID NO: 1235123 - protein, 9 aa, Mycobacterium
YTDPSPTSM

SEQ ID NO: 1235124 - protein, 5 aa, Mycobacterium
YTDRR

SEQ ID NO: 1235125 - protein, 10 aa, Mycobacterium
YTDVAAPSEL

SEQ ID NO: 1235126 - protein, 11 aa, Mycobacterium
YTEDPGNNGSL

SEQ ID NO: 1235127 - protein, 9 aa, Mycobacterium
YTEDSRAEV

SEQ ID NO: 1235128 - protein, 5 aa, Mycobacterium
YTEGR

SEQ ID NO: 1235129 - protein, 6 aa, Mycobacterium
YTEGTG

SEQ ID NO: 1235130 - protein, 9 aa, Mycobacterium
YTGDPDNPL

SEQ ID NO: 1235131 - protein, 14 aa, Mycobacterium
YTGDQVARLRDRQV

SEQ ID NO: 1235132 - protein, 17 aa, Mycobacterium
YTGHVEPRTAARRTLPG

SEQ ID NO: 1235133 - protein, 8 aa, Mycobacterium
YTGQPTEL

SEQ ID NO: 1235134 - protein, 8 aa, Mycobacterium
YTGRPSPV

SEQ ID NO: 1235135 - protein, 7 aa, Mycobacterium
YTGSGDV

SEQ ID NO: 1235136 - protein, 7 aa, Mycobacterium
YTGSTVA

SEQ ID NO: 1235137 - protein, 7 aa, Mycobacterium
YTGSYTE

SEQ ID NO: 1235138 - protein, 21 aa, Mycobacterium
YTGTSTDTLRTEIPERWLAAA

SEQ ID NO: 1235139 - protein, 4 aa, Mycobacterium
YTIG

SEQ ID NO: 1235140 - protein, 10 aa, Mycobacterium
YTIGNQPVKP

SEQ ID NO: 1235141 - protein, 8 aa, Mycobacterium
YTKTAEGW

SEQ ID NO: 1235142 - protein, 4 aa, Mycobacterium
YTLP

SEQ ID NO: 1235143 - protein, 21 aa, Mycobacterium
YTLTPDRAAEPELGAQPDARW

SEQ ID NO: 1235144 - protein, 10 aa, Mycobacterium
YTPADSPDFP

SEQ ID NO: 1235145 - protein, 12 aa, Mycobacterium
YTPAGPQASGYG

SEQ ID NO: 1235146 - protein, 9 aa, Mycobacterium
YTPDSEWRN

SEQ ID NO: 1235147 - protein, 5 aa, Mycobacterium
YTPEN

SEQ ID NO: 1235148 - protein, 16 aa, Mycobacterium
YTPGGEPLDDPDTAQR

SEQ ID NO: 1235149 - protein, 7 aa, Mycobacterium
YTPGPHR

SEQ ID NO: 1235150 - protein, 10 aa, Mycobacterium
YTPRTADPAG

SEQ ID NO: 1235151 - protein, 21 aa, Mycobacterium
YTPRTSSVSLTDRPPMITLRP

SEQ ID NO: 1235152 - protein, 4 aa, Mycobacterium
YTPY

SEQ ID NO: 1235153 - protein, 6 aa, Mycobacterium
YTQPDD

SEQ ID NO: 1235154 - protein, 4 aa, Mycobacterium
YTQS

SEQ ID NO: 1235155 - protein, 12 aa, Mycobacterium
YTRDGAGSRAAE

SEQ ID NO: 1235156 - protein, 4 aa, Mycobacterium
YTRE

SEQ ID NO: 1235157 - protein, 9 aa, Mycobacterium
YTRGPRRWQ

SEQ ID NO: 1235158 - protein, 7 aa, Mycobacterium
YTRTPDE

SEQ ID NO: 1235159 - protein, 9 aa, Mycobacterium
YTSADPVSG

SEQ ID NO: 1235160 - protein, 12 aa, Mycobacterium
YTSEAADKAQQG

SEQ ID NO: 1235161 - protein, 8 aa, Mycobacterium
YTSEPQVA

SEQ ID NO: 1235162 - protein, 16 aa, Mycobacterium
YTSTDNGATVNVPTAV

SEQ ID NO: 1235163 - protein, 5 aa, Mycobacterium
YTTDA

SEQ ID NO: 1235164 - protein, 12 aa, Mycobacterium
YTTDGYGSRVAS

SEQ ID NO: 1235165 - protein, 4 aa, Mycobacterium
YTTG

SEQ ID NO: 1235166 - protein, 7 aa, Mycobacterium
YTTPEDF

SEQ ID NO: 1235167 - protein, 7 aa, Mycobacterium
YTTPGQH

SEQ ID NO: 1235168 - protein, 6 aa, Mycobacterium
YTTRTL

SEQ ID NO: 1235169 - protein, 9 aa, Mycobacterium
YTTSEDFEK

SEQ ID NO: 1235170 - protein, 9 aa, Mycobacterium
YTTTSTGAR

SEQ ID NO: 1235171 - protein, 8 aa, Mycobacterium
YTTTTTGA

SEQ ID NO: 1235172 - protein, 6 aa, Mycobacterium
YTVSGR

SEQ ID NO: 1235173 - protein, 14 aa, Mycobacterium
YVAEDASAASNYTV

SEQ ID NO: 1235174 - protein, 4 aa, Mycobacterium
YVDP

SEQ ID NO: 1235175 - protein, 20 aa, Mycobacterium
YVDQDGSAAASIDSTAVDLG

SEQ ID NO: 1235176 - protein, 5 aa, Mycobacterium
YVEPP

SEQ ID NO: 1235177 - protein, 7 aa, Mycobacterium
YVGENKE

SEQ ID NO: 1235178 - protein, 6 aa, Mycobacterium
YVPDDA

SEQ ID NO: 1235179 - protein, 6 aa, Mycobacterium
YVPQGV

SEQ ID NO: 1235180 - protein, 17 aa, Mycobacterium
YVPTGRSALAETVTFVN

SEQ ID NO: 1235181 - protein, 14 aa, Mycobacterium
YYGPDGIGQQRGNP

SEQ ID NO: 1235182 - protein, 19 aa, Mycobacterium
YYGPGGGEPMGGRGGATAN

SEQ ID NO: 1235183 - protein, 22 aa, Mycobacterium
YYGTPRRAEQAATAGSLGRRRA

SEQ ID NO: 1235184 - protein, 7 aa, Mycobacterium
YYNTDAE

SEQ ID NO: 1235185 - protein, 4 aa, Mycobacterium
YYPA

SEQ ID NO: 1235186 - protein, 23 aa, Mycobacterium
YYPETPGGKATGRSVEPKPFDAK

SEQ ID NO: 1235187 - protein, 8 aa, Mycobacterium
YYPQGAEY

SEQ ID NO: 1235188 - protein, 8 aa, Mycobacterium
YYRSGGGR

SEQ ID NO: 1235189 - protein, 8 aa, Mycobacterium
YYTDSSRT

SEQ ID NO: 1235190 - protein, 22 aa, Mycobacterium
YYTPGQVPGADELKKPKGRGLH

SEQ ID NO: 1235191 - protein, 20 aa, Mycobacterium
DRPRWGWRRAAKMARRAGWK

SEQ ID NO: 1235192 - protein, 22 aa, Mycobacterium
EITESTWHRWIAQYGGMKANEA

SEQ ID NO: 1235193 - protein, 17 aa, Mycobacterium
IDPGSPWQNAWIESFNG

SEQ ID NO: 1235194 - protein, 24 aa, Mycobacterium
MSPIRPNVIWAMDFQFDTTADGRT

SEQ ID NO: 1235195 - protein, 20 aa, Mycobacterium
SGERADWWWYTPFQPPPPTT

SEQ ID NO: 1235196 - protein, 19 aa, Mycobacterium
NPITASWDAATRTLTLSGV

SEQ ID NO: 1235197 - protein, 28 aa, Mycobacterium
ITSMPGIGFRLGAEFLAAVGDPALIGSA

SEQ ID NO: 1235198 - protein, 18 aa, Mycobacterium
AELDRIKAAVWAVPSVEH

SEQ ID NO: 1235199 - protein, 23 aa, Mycobacterium
EMRVLRGETDFSWAESPRSRTRH

SEQ ID NO: 1235200 - protein, 20 aa, Mycobacterium
WLGLLDPDIRYVVPVRTTRE

SEQ ID NO: 1235201 - protein, 17 aa, Mycobacterium
DQLAAWAGLAPVSRDSG

SEQ ID NO: 1235202 - protein, 17 aa, Mycobacterium
DSLRLARREVLLDHSTL

SEQ ID NO: 1235203 - protein, 22 aa, Mycobacterium
HLHAFEVKWLCAVVEVARSSFY

SEQ ID NO: 1235204 - protein, 26 aa, Mycobacterium
HRHRTCAVPGCGATRGLHAHHIQHWE

SEQ ID NO: 1235205 - protein, 19 aa, Mycobacterium
IDCCSRRVAGWAIADHMRT

SEQ ID NO: 1235206 - protein, 18 aa, Mycobacterium
KRPIPATICLARRRTNVL

SEQ ID NO: 1235207 - protein, 19 aa, Mycobacterium
LYLATVIDCCSRRVAGWAI

SEQ ID NO: 1235208 - protein, 17 aa, Mycobacterium
QALRDGRLSLDQVGVIA

SEQ ID NO: 1235209 - protein, 18 aa, Mycobacterium
REVFRWLARYNTTRRHSY

SEQ ID NO: 1235210 - protein, 18 aa, Mycobacterium
RRTNVLYALIRDNRTWQP

SEQ ID NO: 1235211 - protein, 17 aa, Mycobacterium
RVAGWAIADHMRTELVI

SEQ ID NO: 1235212 - protein, 24 aa, Mycobacterium
SQDRGWVILLARYQRPKAIRQSGV

SEQ ID NO: 1235213 - protein, 18 aa, Mycobacterium
VAHLMAWKTGSSSRNGKT

SEQ ID NO: 1235214 - protein, 24 aa, Mycobacterium
VVEVARSSFYAWLAGADGRAARRA

SEQ ID NO: 1235215 - protein, 19 aa, Mycobacterium
DEAAAFGRRDLSGSDYVYL

SEQ ID NO: 1235216 - protein, 22 aa, Mycobacterium
DHLPCRCGSPACAAAAPEKSNV

SEQ ID NO: 1235217 - protein, 23 aa, Mycobacterium
DQEKLCLLVMLGVRADGRKELVA

SEQ ID NO: 1235218 - protein, 25 aa, Mycobacterium
ERKRFSSAILPAWARKSPQMSEVLP

SEQ ID NO: 1235219 - protein, 17 aa, Mycobacterium
GAKSVAHLMAWKTGSSS

SEQ ID NO: 1235220 - protein, 18 aa, Mycobacterium
IALMSGELGQLNGLPVSI

SEQ ID NO: 1235221 - protein, 25 aa, Mycobacterium
PQMSEVLPLLYLHGLSTSDFTPALE

SEQ ID NO: 1235222 - protein, 23 aa, Mycobacterium
VGDGALGFWKAVREVFPATKEQR

SEQ ID NO: 1235223 - protein, 17 aa, Mycobacterium
AGMGRRLLADEPVFAAA

SEQ ID NO: 1235224 - protein, 18 aa, Mycobacterium
DAKEWLAFGPEVLGMEAV

SEQ ID NO: 1235225 - protein, 24 aa, Mycobacterium
ELVACLRTGRALRVPRARTQNKPQ

SEQ ID NO: 1235226 - protein, 19 aa, Mycobacterium
EVLTAAGAVEVKAPRVNDK

SEQ ID NO: 1235227 - protein, 24 aa, Mycobacterium
EWIPPPRLDTGQARLNHYHRPERL

SEQ ID NO: 1235228 - protein, 18 aa, Mycobacterium
GKELAAHAQFTFDTGTKV

SEQ ID NO: 1235229 - protein, 23 aa, Mycobacterium
HLPRLEGWGLAPPVKNGPALSGY

SEQ ID NO: 1235230 - protein, 19 aa, Mycobacterium
HQVREVLTAAGAVEVKAPR

SEQ ID NO: 1235231 - protein, 18 aa, Mycobacterium
HRQDRRWSTAWSPEQIAH

SEQ ID NO: 1235232 - protein, 21 aa, Mycobacterium
IPIRDLIRMAAHSRHYLAVFD

SEQ ID NO: 1235233 - protein, 26 aa, Mycobacterium
LTLNNRPRKVLGWKTPAEVFAQQLHS

SEQ ID NO: 1235234 - protein, 19 aa, Mycobacterium
PVATRWFHHAGGMTPISLD

SEQ ID NO: 1235235 - protein, 25 aa, Mycobacterium
QLPKQLRQTLTWDRGKELAAHAQFT

SEQ ID NO: 1235236 - protein, 24 aa, Mycobacterium
SLFIEGRGALKRELVACLRTGRAL

SEQ ID NO: 1235237 - protein, 25 aa, Mycobacterium
TLSAWCKSAGVPIRHRRGVVVAEPV

SEQ ID NO: 1235238 - protein, 25 aa, Mycobacterium
VGMAYDLCMSRNIPLSMTLGRHVND

SEQ ID NO: 1235239 - protein, 24 aa, Mycobacterium
VVERKSRSVMLVHLPRLEGWGLAP

SEQ ID NO: 1235240 - protein, 19 aa, Mycobacterium
WFHHAGGMTPISLDEPTGR

SEQ ID NO: 1235241 - protein, 25 aa, Mycobacterium
EVGVNVRTARDWRKGIRHTNNTRVH

SEQ ID NO: 1235242 - protein, 25 aa, Mycobacterium
HLTPEAWAVWEVIFAKYAAPGMCNP

SEQ ID NO: 1235243 - protein, 19 aa, Mycobacterium
IDHVVPWPYGPTHASNLNC

SEQ ID NO: 1235244 - protein, 19 aa, Mycobacterium
MGATGICWDNAGSESLWST

SEQ ID NO: 1235245 - protein, 22 aa, Mycobacterium
MSALTAIRCDPDSKAYYQRKRD

SEQ ID NO: 1235246 - protein, 31 aa, Mycobacterium
PPTVTVFGVPIFKLGGAPVKVVSSVTLGDLD

SEQ ID NO: 1235247 - protein, 24 aa, Mycobacterium
QELNGRPRKTLGWDTPAERLRDLL

SEQ ID NO: 1235248 - protein, 24 aa, Mycobacterium
RDEHSRRVLGWSVADHMRTELVEQ

SEQ ID NO: 1235249 - protein, 17 aa, Mycobacterium
RRSCAVGAIVQGHDHLP

SEQ ID NO: 1235250 - protein, 18 aa, Mycobacterium
RSGYYAWEARQRRTEPTA

SEQ ID NO: 1235251 - protein, 24 aa, Mycobacterium
SRRLRRVMYMSALTAIRCDPDSKA

SEQ ID NO: 1235252 - protein, 26 aa, Mycobacterium
TFSATEGGLSRGISFSVTDEAGVQSL

SEQ ID NO: 1235253 - protein, 28 aa, Mycobacterium
TGLPFSRIRILLRLSRGSMTVKEVAHAV

SEQ ID NO: 1235254 - protein, 25 aa, Mycobacterium
TLPAHLRGSLTWDQGCEMAGHKQFT

SEQ ID NO: 1235255 - protein, 18 aa, Mycobacterium
TVRSNLLFFRSRGDSGRW

SEQ ID NO: 1235256 - protein, 23 aa, Mycobacterium
YLTCGEGDAYLCAIRDEHSRRVL

SEQ ID NO: 1235257 - protein, 17 aa, Mycobacterium
YTTRPGSALLFPTLCTP

SEQ ID NO: 1235258 - protein, 27 aa, Mycobacterium
AAITPWNFPVVLAFMKLAPALVAGNTV

SEQ ID NO: 1235259 - protein, 17 aa, Mycobacterium
AALSARIAALLKGICDN

SEQ ID NO: 1235260 - protein, 25 aa, Mycobacterium
ADNDEWLKWLLVRRGSGGEFDLQFS

SEQ ID NO: 1235261 - protein, 21 aa, Mycobacterium
ALAEAALRWGPLSEARLARAL

SEQ ID NO: 1235262 - protein, 19 aa, Mycobacterium
CPYHRWIFNNDGRFAGAPR

SEQ ID NO: 1235263 - protein, 20 aa, Mycobacterium
DDHSRYALASHVALSETAKE

SEQ ID NO: 1235264 - protein, 26 aa, Mycobacterium
DEGHTWKCLADGLGAITHIATPKKGT

SEQ ID NO: 1235265 - protein, 24 aa, Mycobacterium
EMVEGRGPCYLDLRHVPQADLEVL

SEQ ID NO: 1235266 - protein, 24 aa, Mycobacterium
ENFRPGTLERWGLGWEELHAANPR

SEQ ID NO: 1235267 - protein, 19 aa, Mycobacterium
FQMSKPVIPLLRQGGGGSI

SEQ ID NO: 1235268 - protein, 17 aa, Mycobacterium
FVAGVGRPLSESSQNDE

SEQ ID NO: 1235269 - protein, 24 aa, Mycobacterium
FYHYPAEHWIHLRTTNPIESTFAT

SEQ ID NO: 1235270 - protein, 20 aa, Mycobacterium
GDQFMTEFLPGHYDFLQRLF

SEQ ID NO: 1235271 - protein, 24 aa, Mycobacterium
GHPDRPPTHFGFSLGDVTTGIMGA

SEQ ID NO: 1235272 - protein, 19 aa, Mycobacterium
GHVAAWRVGAEFAGMEFGQ

SEQ ID NO: 1235273 - protein, 18 aa, Mycobacterium
GLIFACWDQSAPPLEEYL

SEQ ID NO: 1235274 - protein, 26 aa, Mycobacterium
GLRELHVVEAWGLIFVSMAAQPPPFD

SEQ ID NO: 1235275 - protein, 17 aa, Mycobacterium
GQFREWLGLLDPDIRYV

SEQ ID NO: 1235276 - protein, 38 aa, Mycobacterium; identical to SEQ ID NO: 621829

SEQ ID NO: 1235277 - protein, 26 aa, Mycobacterium
HQEAFPLVITHGWPGSIVEFHNVIEP

SEQ ID NO: 1235278 - protein, 19 aa, Mycobacterium
HRGTLLEQRRCGVAERFEC

SEQ ID NO: 1235279 - protein, 23 aa, Mycobacterium
IPHVDSYAGFIFGSVDPKAPSLT

SEQ ID NO: 1235280 - protein, 22 aa, Mycobacterium
IWTSDEERAFLLGRRFDTGSVF

SEQ ID NO: 1235281 - protein, 20 aa, Mycobacterium
KERMKAAGVRLFERVDVIDL

SEQ ID NO: 1235282 - protein, 24 aa, Mycobacterium
KGAFGTTGQVCFGLKRIYVPTRIH

SEQ ID NO: 1235283 - protein, 17 aa, Mycobacterium
KSPQMSEVLPLLYLHGL

SEQ ID NO: 1235284 - protein, 24 aa, Mycobacterium
LALYESLFRGIDWQVILYDQLNFV

SEQ ID NO: 1235285 - protein, 23 aa, Mycobacterium
LIEHTRPAPGITYVGNGRPRGPH

SEQ ID NO: 1235286 - protein, 27 aa, Mycobacterium
LKKAHEVRAYLTLAIITCEAMKRRTES

SEQ ID NO: 1235287 - protein, 22 aa, Mycobacterium
LLEQRRCGVAERFECPYHRWIF

SEQ ID NO: 1235288 - protein, 23 aa, Mycobacterium
LSNSCRHRGALVCRAEMGNTAHF

SEQ ID NO: 1235289 - protein, 18 aa, Mycobacterium
LVSPRVATYKGLIFACWD

SEQ ID NO: 1235290 - protein, 17 aa, Mycobacterium
MALDFARDNIRVNAIAP

SEQ ID NO: 1235291 - protein, 26 aa, Mycobacterium
MIGMGTAFYGRGFIMWQPRGPRLTEV

SEQ ID NO: 1235292 - protein, 32 aa, Mycobacterium; identical to SEQ ID NO: 703230

SEQ ID NO: 1235293 - protein, 23 aa, Mycobacterium
NIFHCSYHGWSYDTAGRLRSVPL

SEQ ID NO: 1235294 - protein, 25 aa, Mycobacterium
PGLHRYLMPVNWKLLAENFGGDQYH

SEQ ID NO: 1235295 - protein, 18 aa, Mycobacterium
PGPGEALPSGYAEQNQRR

SEQ ID NO: 1235296 - protein, 24 aa, Mycobacterium
PMRRLRQVRPVDVWKAIGEATANP

SEQ ID NO: 1235297 - protein, 19 aa, Mycobacterium
PVFHTARLAPQAADALAAE

SEQ ID NO: 1235298 - protein, 21 aa, Mycobacterium
PWPTSELRSTSGPVLNQGPHQ

SEQ ID NO: 1235299 - protein, 19 aa, Mycobacterium
QSLLELLGGTTLRNDPKYA

SEQ ID NO: 1235300 - protein, 19 aa, Mycobacterium
RAVKERMVFVLSQRQSAAG

SEQ ID NO: 1235301 - protein, 28 aa, Mycobacterium
RELDSIFKRSWLFVGHESMIPKPGDFRT

SEQ ID NO: 1235302 - protein, 18 aa, Mycobacterium
RGGHFAALEQPRLFVDDI

SEQ ID NO: 1235303 - protein, 19 aa, Mycobacterium
RRSGPRKDGVPLWWKSAAR

SEQ ID NO: 1235304 - protein, 20 aa, Mycobacterium
RVATYKGLIFACWDQSAPPL

SEQ ID NO: 1235305 - protein, 26 aa, Mycobacterium
RVGAEFAGMEFGQFAAWSYFNRSFFT

SEQ ID NO: 1235306 - protein, 18 aa, Mycobacterium
SFAEYFAPMRRLRQVRPV

SEQ ID NO: 1235307 - protein, 23 aa, Mycobacterium
TGPWYPKLHYAFADHCSGEGHVA

SEQ ID NO: 1235308 - protein, 21 aa, Mycobacterium
VAERFECPYHRWIFNNDGRFA

SEQ ID NO: 1235309 - protein, 26 aa, Mycobacterium
VDLEFASGICGYTAGISAEILADQQI

SEQ ID NO: 1235310 - protein, 25 aa, Mycobacterium
VQPYSFHVANIFPNFSMIGMGTAFY

SEQ ID NO: 1235311 - protein, 17 aa, Mycobacterium
VVLPAFRLPAAEVRGNG

SEQ ID NO: 1235312 - protein, 21 aa, Mycobacterium
WLADVPLLMVRDGDDRIRVFV

SEQ ID NO: 1235313 - protein, 22 aa, Mycobacterium
AAGQSAEVFGRFEAADPNELWV

SEQ ID NO: 1235314 - protein, 28 aa, Mycobacterium
AATLRLAPTPPWHTTRWQVTRIGDALVS

SEQ ID NO: 1235315 - protein, 26 aa, Mycobacterium
ADLTEAFLWSEFRVVTKTATVSLHSN

SEQ ID NO: 1235316 - protein, 23 aa, Mycobacterium
ADPNELWVGDALHGPRVGDRKTY

SEQ ID NO: 1235317 - protein, 22 aa, Mycobacterium
AFHAVRRAELLLGETVMVLGAG

SEQ ID NO: 1235318 - protein, 20 aa, Mycobacterium
AHQLGYGVESVRSWVRQADI

SEQ ID NO: 1235319 - protein, 17 aa, Mycobacterium
AIVNVIGLPPTVTVFGI

SEQ ID NO: 1235320 - protein, 19 aa, Mycobacterium
ALADRLPHVAALFTAGLIT

SEQ ID NO: 1235321 - protein, 27 aa, Mycobacterium
AMPAECLLDRNALIMGYSGVYSSFLKH

SEQ ID NO: 1235322 - protein, 17 aa, Mycobacterium
APFAASLIGDFGAQVIK

SEQ ID NO: 1235323 - protein, 24 aa, Mycobacterium
ARTQSIDTIADWRAGTLSLSPGGP

SEQ ID NO: 1235324 - protein, 18 aa, Mycobacterium
ATLDRWIRRYRGGGFEAL

SEQ ID NO: 1235325 - protein, 18 aa, Mycobacterium
AVAGRPKEEYGLEPQGLD

SEQ ID NO: 1235326 - protein, 30 aa, Mycobacterium; identical to SEQ ID NO: 620557

SEQ ID NO: 1235327 - protein, 20 aa, Mycobacterium
CTGAAIGTPDGWLARAATVR

SEQ ID NO: 1235328 - protein, 18 aa, Mycobacterium
DAENDRGLQFGFISDAAG

SEQ ID NO: 1235329 - protein, 28 aa, Mycobacterium
DNGSAYRSYAWRDACTQLHITPKRTRPY

SEQ ID NO: 1235330 - protein, 19 aa, Mycobacterium
DRQRLLGALQVAARGIGRL

SEQ ID NO: 1235331 - protein, 20 aa, Mycobacterium
DRYDPIWGDKGGLFTIARAI

SEQ ID NO: 1235332 - protein, 23 aa, Mycobacterium
DTINIRYARPLGVDRTEVRYTFF

SEQ ID NO: 1235333 - protein, 21 aa, Mycobacterium
EGVELWTPCFSERDVHPLEAD

SEQ ID NO: 1235334 - protein, 18 aa, Mycobacterium
ENREMAMELAFLKKAAAY

SEQ ID NO: 1235335 - protein, 19 aa, Mycobacterium
FGAVYGYRRIHAELVRAGE

SEQ ID NO: 1235336 - protein, 18 aa, Mycobacterium
FLLGRRFDTGSVFINSHT

SEQ ID NO: 1235337 - protein, 17 aa, Mycobacterium
FNRRPWPTSELRSTSGP

SEQ ID NO: 1235338 - protein, 19 aa, Mycobacterium
FRPGRAMSGFVTGAQGLGH

SEQ ID NO: 1235339 - protein, 24 aa, Mycobacterium
GAKELSMLIEWRVQDANDQVSQLE

SEQ ID NO: 1235340 - protein, 18 aa, Mycobacterium
GGYQRFVAGVGRPLSESS

SEQ ID NO: 1235341 - protein, 18 aa, Mycobacterium
GQFREWLGLLDPDIRYVV

SEQ ID NO: 1235342 - protein, 18 aa, Mycobacterium
GRRAHPFTIADLAAAVLV

SEQ ID NO: 1235343 - protein, 17 aa, Mycobacterium
GSFRPGRAMSGFVTGAQ

SEQ ID NO: 1235344 - protein, 21 aa, Mycobacterium
HDRMEILSWFLVERDAPEWLR

SEQ ID NO: 1235345 - protein, 19 aa, Mycobacterium
ILLIKRRDNTLWALPGGGH

SEQ ID NO: 1235346 - protein, 22 aa, Mycobacterium
IPAQAIAQVCELTWQLKGQATG

SEQ ID NO: 1235347 - protein, 18 aa, Mycobacterium
IRTWAGWLYLATVIDCFN

SEQ ID NO: 1235348 - protein, 18 aa, Mycobacterium
KERLEVLFEEVAELAGQR

SEQ ID NO: 1235349 - protein, 18 aa, Mycobacterium
KKYGLPFMYWNLMLKGLA

SEQ ID NO: 1235350 - protein, 17 aa, Mycobacterium
KRDRQRLLGALQVAARG

SEQ ID NO: 1235351 - protein, 21 aa, Mycobacterium
KTLNTAGAFVLAGVTYKVDGR

SEQ ID NO: 1235352 - protein, 24 aa, Mycobacterium
LALYRAVTAFGRVAVDELTPVDLS

SEQ ID NO: 1235353 - protein, 19 aa, Mycobacterium
LDALSAVFGDRGDAAPLVL

SEQ ID NO: 1235354 - protein, 28 aa, Mycobacterium
LEPKKKPRSAWRRFVYPAPNACWQLDAT

SEQ ID NO: 1235355 - protein, 20 aa, Mycobacterium
LGACSLAVPVIRQTDDAVVA

SEQ ID NO: 1235356 - protein, 18 aa, Mycobacterium
LGDGLAHRDVRALAFDPH

SEQ ID NO: 1235357 - protein, 17 aa, Mycobacterium
LGWEELHAANPRLIMLR

SEQ ID NO: 1235358 - protein, 25 aa, Mycobacterium
LPGHYDFLQRLFAGINPRHRQQLLA

SEQ ID NO: 1235359 - protein, 27 aa, Mycobacterium
LRKQGRFMEMSSWAGAASLDVNRHLLK

SEQ ID NO: 1235360 - protein, 17 aa, Mycobacterium
LWRSYGVTPDAVIGHSM

SEQ ID NO: 1235361 - protein, 24 aa, Mycobacterium
MAPTIVQMLKWLGVSKSGFYEWWG

SEQ ID NO: 1235362 - protein, 19 aa, Mycobacterium
MERIFGRAWVFLGHESELA

SEQ ID NO: 1235363 - protein, 25 aa, Mycobacterium
MFPNMSFSAGFPRTILVSHPISPTE

SEQ ID NO: 1235364 - protein, 22 aa, Mycobacterium
MPYLKAWFELLGLRAGPVRPPV

SEQ ID NO: 1235365 - protein, 24 aa, Mycobacterium
MRASLGRTGICWDNALAESFFAAL

SEQ ID NO: 1235366 - protein, 20 aa, Mycobacterium
MTELTGRAALPGYTGAADRL

SEQ ID NO: 1235367 - protein, 17 aa, Mycobacterium
NRRRLHSALGYRTPHEV

SEQ ID NO: 1235368 - protein, 19 aa, Mycobacterium
NSAFRIAAEVLPEFDEHPG

SEQ ID NO: 1235369 - protein, 24 aa, Mycobacterium
PALAGRRVELVFSPFDLQAIEVRH

SEQ ID NO: 1235370 - protein, 22 aa, Mycobacterium
PAVTRARRAGVSSFGVSGTNAH

SEQ ID NO: 1235371 - protein, 23 aa, Mycobacterium
PETVVTPGIYVDRVLDLSAIPET

SEQ ID NO: 1235372 - protein, 20 aa, Mycobacterium
PGDPLLCLDPIFQAIPDQKA

SEQ ID NO: 1235373 - protein, 25 aa, Mycobacterium
PTLRHRLRLGVLAALDQRIAVRYTL

SEQ ID NO: 1235374 - protein, 19 aa, Mycobacterium
QGLDCLRKQGRFMEMSSWA

SEQ ID NO: 1235375 - protein, 17 aa, Mycobacterium
QLGILLERARQIAAEDQ

SEQ ID NO: 1235376 - protein, 26 aa, Mycobacterium
QPRGPRLTEVWEWCLVESSAPRAVKE

SEQ ID NO: 1235377 - protein, 19 aa, Mycobacterium
QPRLSYPPYRSSLLRHPTK

SEQ ID NO: 1235378 - protein, 19 aa, Mycobacterium
QSPLARWETGWDRLGALPA

SEQ ID NO: 1235379 - protein, 23 aa, Mycobacterium
RAWPELPGQVMAMAVQDERVAVA

SEQ ID NO: 1235380 - protein, 17 aa, Mycobacterium
RDIKRVTLELGGNDPAI

SEQ ID NO: 1235381 - protein, 25 aa, Mycobacterium
RERSAEPTARWLHRGLTSQDVVDTA

SEQ ID NO: 1235382 - protein, 23 aa, Mycobacterium
RIRVFVNSCAHRGTLLEQRRCGV

SEQ ID NO: 1235383 - protein, 18 aa, Mycobacterium
RRDLSGSDYVYLWVDGIH

SEQ ID NO: 1235384 - protein, 29 aa, Mycobacterium
RREELKLKIAALFTSFGAVYGYRRIHAEL

SEQ ID NO: 1235385 - protein, 19 aa, Mycobacterium
RRIHAELVRAGERVGPELV

SEQ ID NO: 1235386 - protein, 21 aa, Mycobacterium
RRLHSALGYRTPHEVRIEYMN

SEQ ID NO: 1235387 - protein, 24 aa, Mycobacterium
RTKNWRPIIGTAFVHTVIDDHSRM

SEQ ID NO: 1235388 - protein, 25 aa, Mycobacterium
RWETGWDRLGALPALPTAADLTEAF

SEQ ID NO: 1235389 - protein, 17 aa, Mycobacterium
SAAMCRREELKLKIAAL

SEQ ID NO: 1235390 - protein, 24 aa, Mycobacterium
SKSGFYEWWGRPASAAMCRREELK

SEQ ID NO: 1235391 - protein, 18 aa, Mycobacterium
SVLIRRAALTAGPLGSIL

SEQ ID NO: 1235392 - protein, 23 aa, Mycobacterium
TDGEVRQQFSLLFATTVLGGTLA

SEQ ID NO: 1235393 - protein, 21 aa, Mycobacterium
TLPGPHRVASLLKRWNAGTHH

SEQ ID NO: 1235394 - protein, 25 aa, Mycobacterium
TRDVLIRIGDEFAIQVRALTELAET

SEQ ID NO: 1235395 - protein, 17 aa, Mycobacterium
TRIHDRFVEAFSAAVDE

SEQ ID NO: 1235396 - protein, 25 aa, Mycobacterium
VADGLKVGRLPARVVSDPALHTIEM

SEQ ID NO: 1235397 - protein, 19 aa, Mycobacterium
VAIGRIALMSGELGQLNGL

SEQ ID NO: 1235398 - protein, 19 aa, Mycobacterium
VASLLKRWNAGTHHYRVER

SEQ ID NO: 1235399 - protein, 17 aa, Mycobacterium
VGDRKTYLFAFLDDHSR

SEQ ID NO: 1235400 - protein, 20 aa, Mycobacterium
VKQLRPLRSATIAINGTTET

SEQ ID NO: 1235401 - protein, 24 aa, Mycobacterium
VLGTVYDWLGFDVVDDAVFRDLVI

SEQ ID NO: 1235402 - protein, 21 aa, Mycobacterium
VPEAKRWSFPIRPGIAHVRTI

SEQ ID NO: 1235403 - protein, 17 aa, Mycobacterium
VPSRLAVRVPDVVDLEE

SEQ ID NO: 1235404 - protein, 19 aa, Mycobacterium
WRAIWAYSAKRARRDQKTL

SEQ ID NO: 1235405 - protein, 19 aa, Mycobacterium
WSFPIRPGIAHVRTIAVHP

SEQ ID NO: 1235406 - protein, 20 aa, Mycobacterium
AAAFARWTAVAANRVTRQSD

SEQ ID NO: 1235407 - protein, 23 aa, Mycobacterium
AAAGRISYRLGLQGPAVAVDTAC

SEQ ID NO: 1235408 - protein, 25 aa, Mycobacterium
AAGHPFAATGGRIVAQLAKQLAEKK

SEQ ID NO: 1235409 - protein, 24 aa, Mycobacterium
AAGLSSPRIVGWIMRTDSSDLPWH

SEQ ID NO: 1235410 - protein, 27 aa, Mycobacterium
AALGVLRPRGRLMVVAIWEAPAGIDIN

SEQ ID NO: 1235411 - protein, 25 aa, Mycobacterium
ADADFSIASGEFFSMLGPSGCGKTT

SEQ ID NO: 1235412 - protein, 20 aa, Mycobacterium
ADGPVVLFFYPAAMTPGCTK

SEQ ID NO: 1235413 - protein, 22 aa, Mycobacterium
ADLERFSDWILPTEPERYAKRL

SEQ ID NO: 1235414 - protein, 20 aa, Mycobacterium
ADLFLGVPFNIASYALLTHM

SEQ ID NO: 1235415 - protein, 21 aa, Mycobacterium
ADLQSRRRLGLTATLIREDGR

SEQ ID NO: 1235416 - protein, 18 aa, Mycobacterium
ADMAMKVEAARLMVYSAA

SEQ ID NO: 1235417 - protein, 20 aa, Mycobacterium
ADMIRLIIRDEAVHGYYIGY

SEQ ID NO: 1235418 - protein, 24 aa, Mycobacterium
ADPEARYALGSVLNHVVLHQTVIG

SEQ ID NO: 1235419 - protein, 19 aa, Mycobacterium
ADPRLAIVEEEQFGPVVPV

SEQ ID NO: 1235420 - protein, 17 aa, Mycobacterium
AEAVPNMALVVYDNPGA

SEQ ID NO: 1235421 - protein, 20 aa, Mycobacterium
AEIDDAFRWSEENPNLQRKA

SEQ ID NO: 1235422 - protein, 18 aa, Mycobacterium
AELARMLAGLGESDSGRA

SEQ ID NO: 1235423 - protein, 21 aa, Mycobacterium
AEPPGDVLVFLSGEREIRDTA

SEQ ID NO: 1235424 - protein, 27 aa, Mycobacterium
AEQAIRRLVKRGGPITFQAVQREAGVS

SEQ ID NO: 1235425 - protein, 20 aa, Mycobacterium
AESLPMFLSGRLYDDGVIDP

SEQ ID NO: 1235426 - protein, 24 aa, Mycobacterium
AEVLGNWTGIPVFKLTEEETTRLL

SEQ ID NO: 1235427 - protein, 21 aa, Mycobacterium
AFAAGHLQGTLGFELSGSFVS

SEQ ID NO: 1235428 - protein, 18 aa, Mycobacterium
AFARTLRAVVDWRGQVVT

SEQ ID NO: 1235429 - protein, 19 aa, Mycobacterium
AFLGGPVIKDGKPVDFGSF

SEQ ID NO: 1235430 - protein, 27 aa, Mycobacterium
AGAYFPRGIKPVSVWLSHEYVRASPGG

SEQ ID NO: 1235431 - protein, 24 aa, Mycobacterium
AGGVRAGHELKFWTPGGSSTPLLT

SEQ ID NO: 1235432 - protein, 23 aa, Mycobacterium
AGKDLSFVPLRPERVVEVRYDHM

SEQ ID NO: 1235433 - protein, 24 aa, Mycobacterium
AGNYAQRLFPGMRVKYVSTEEFTN

SEQ ID NO: 1235434 - protein, 25 aa, Mycobacterium
AGPRARTAVLTKLYPTRSHTGAAQG

SEQ ID NO: 1235435 - protein, 21 aa, Mycobacterium
AGRDFTVDWVHLKLNDQAQRT

SEQ ID NO: 1235436 - protein, 20 aa, Mycobacterium
AGRLSIPFTTGLLVGIGETL

SEQ ID NO: 1235437 - protein, 19 aa, Mycobacterium
AGSALMIMTLGAGNGAEVT

SEQ ID NO: 1235438 - protein, 20 aa, Mycobacterium
AGSWTENWPELGTAPVDYTD

SEQ ID NO: 1235439 - protein, 25 aa, Mycobacterium
AGVLKGEVKDVLLLDVTPLSLGIET

SEQ ID NO: 1235440 - protein, 20 aa, Mycobacterium
AGVPLKAPVAGIAMGLVSDD

SEQ ID NO: 1235441 - protein, 22 aa, Mycobacterium
AGVVRLRFGLTDGQPRTLDEIG

SEQ ID NO: 1235442 - protein, 19 aa, Mycobacterium
AGYTGLWTAYYLKRADPSL

SEQ ID NO: 1235443 - protein, 18 aa, Mycobacterium
AHALAFAAEGARVVVNDI

SEQ ID NO: 1235444 - protein, 17 aa, Mycobacterium
AHHPRFLGVRRAYESRS

SEQ ID NO: 1235445 - protein, 21 aa, Mycobacterium
AHVDGVPCCTHIGPDGAGHFV

SEQ ID NO: 1235446 - protein, 18 aa, Mycobacterium
AIEAHLDRGRGPVATVLI

SEQ ID NO: 1235447 - protein, 17 aa, Mycobacterium
AIGMFFPGPYRVPKASF

SEQ ID NO: 1235448 - protein, 32 aa, Mycobacterium; identical to SEQ ID NO: 632562

SEQ ID NO: 1235449 - protein, 18 aa, Mycobacterium
AKGGAAVFQMMGLCQVLR

SEQ ID NO: 1235450 - protein, 17 aa, Mycobacterium
AKIAFLMLPGVGTKEDI

SEQ ID NO: 1235451 - protein, 20 aa, Mycobacterium
AKRFARDDYDILLVGHEGHE

SEQ ID NO: 1235452 - protein, 20 aa, Mycobacterium
ALCSPTRQALLTGRNHHSVG

SEQ ID NO: 1235453 - protein, 19 aa, Mycobacterium
ALCYSARPDPSYDPNKCIF

SEQ ID NO: 1235454 - protein, 23 aa, Mycobacterium
ALEALRIPIEYLAGLFTAGDTAV

SEQ ID NO: 1235455 - protein, 26 aa, Mycobacterium
ALELLPTVRGAFCLTFMDENTLYAAR

SEQ ID NO: 1235456 - protein, 24 aa, Mycobacterium
ALENTRFWAPLSLTAEQKHSIDDP

SEQ ID NO: 1235457 - protein, 29 aa, Mycobacterium
ALEVKEGPAALPWGDLGVDVVVESTGIFT

SEQ ID NO: 1235458 - protein, 24 aa, Mycobacterium
ALHSRLDGLIAQWKRDHGDHGDTD

SEQ ID NO: 1235459 - protein, 24 aa, Mycobacterium
ALQFTCPYHGWSYSMDGSLVSTPG

SEQ ID NO: 1235460 - protein, 23 aa, Mycobacterium
ALREVPGIQPGILYVERQFGVLE

SEQ ID NO: 1235461 - protein, 20 aa, Mycobacterium
ALVDDVIWGCVMQAGEQALD

SEQ ID NO: 1235462 - protein, 24 aa, Mycobacterium
AMSGELIEHLFLPAFGPAADAAMG

SEQ ID NO: 1235463 - protein, 19 aa, Mycobacterium
AMYSVMWSEHCSYKSSKVH

SEQ ID NO: 1235464 - protein, 23 aa, Mycobacterium
ANADERFRIAAKGHDVVLRVSVS

SEQ ID NO: 1235465 - protein, 25 aa, Mycobacterium
ANVSDLPRGGLIIANSDEFTKRNLA

SEQ ID NO: 1235466 - protein, 18 aa, Mycobacterium
ANYSMVFDSYAEVPANVS

SEQ ID NO: 1235467 - protein, 25 aa, Mycobacterium
APAGYALGGGDPIVGLQRAVADHHQ

SEQ ID NO: 1235468 - protein, 25 aa, Mycobacterium
APEIYRAPLSYPFRDAEFGKELATD

SEQ ID NO: 1235469 - protein, 18 aa, Mycobacterium
APELYRITYDGSIADEPH

SEQ ID NO: 1235470 - protein, 21 aa, Mycobacterium
APERVAGLIAEIVGVPQPPSK

SEQ ID NO: 1235471 - protein, 18 aa, Mycobacterium
APQISFFFYTHGDFFEEI

SEQ ID NO: 1235472 - protein, 20 aa, Mycobacterium
AQNGRYGPYLKRGTDSRSLA

SEQ ID NO: 1235473 - protein, 17 aa, Mycobacterium
AQNNGGSICRIATHCTE

SEQ ID NO: 1235474 - protein, 19 aa, Mycobacterium
AQVSLAQMEYMLPRLRGWG

SEQ ID NO: 1235475 - protein, 21 aa, Mycobacterium
ARAHGADMLLLIVAALEQPVL

SEQ ID NO: 1235476 - protein, 18 aa, Mycobacterium
ARALRPYAEKLITHAKKG

SEQ ID NO: 1235477 - protein, 17 aa, Mycobacterium
ARAQRAYAELVHETPGF

SEQ ID NO: 1235478 - protein, 18 aa, Mycobacterium
ARASELLADRRARGPVKK

SEQ ID NO: 1235479 - protein, 22 aa, Mycobacterium
ARAWAAENLRGFYMCPVTPLTD

SEQ ID NO: 1235480 - protein, 32 aa, Mycobacterium; identical to SEQ ID NO: 636890

SEQ ID NO: 1235481 - protein, 28 aa, Mycobacterium
ARFTIHAGEAFGLPSIHEAIAFCGADRL

SEQ ID NO: 1235482 - protein, 26 aa, Mycobacterium
ARFVRLCDAFGIPLVVVVDVPGYLPG

SEQ ID NO: 1235483 - protein, 18 aa, Mycobacterium
ARGQYWIHPALPEVVENA

SEQ ID NO: 1235484 - protein, 19 aa, Mycobacterium
ARHSSGLSVQTFLRGIHVV

SEQ ID NO: 1235485 - protein, 20 aa, Mycobacterium
ARKKPPFGIGQIGKSFRNEI

SEQ ID NO: 1235486 - protein, 17 aa, Mycobacterium
ARPSALVFDGATDSVGE

SEQ ID NO: 1235487 - protein, 19 aa, Mycobacterium
ARQQLLALREEVDRLGQPP

SEQ ID NO: 1235488 - protein, 19 aa, Mycobacterium
ARRALDFLRGMRRQDTIAT

SEQ ID NO: 1235489 - protein, 19 aa, Mycobacterium
ARRAMEIGVDKLADAVKVT

SEQ ID NO: 1235490 - protein, 20 aa, Mycobacterium
ARTHAIGQIVPGKVTKLVPF

SEQ ID NO: 1235491 - protein, 30 aa, Mycobacterium
ARVVNPRWITAMRRHGYKGAFEMAATVDYL

SEQ ID NO: 1235492 - protein, 18 aa, Mycobacterium
ARWLLNYRPQPLAVGAEI

SEQ ID NO: 1235493 - protein, 19 aa, Mycobacterium
ASIARKLGALTVGVVTRPF

SEQ ID NO: 1235494 - protein, 24 aa, Mycobacterium
ASMPAMIRLGGKMYGADGRTKDTK

SEQ ID NO: 1235495 - protein, 17 aa, Mycobacterium
ASSGVVAARIFTPAEMF

SEQ ID NO: 1235496 - protein, 30 aa, Mycobacterium
ASSLDQGGPCARTVLDTALLHQVIAGHDPR

SEQ ID NO: 1235497 - protein, 24 aa, Mycobacterium
ASTPLFFAQAIGRFVRSRRPGETA

SEQ ID NO: 1235498 - protein, 27 aa, Mycobacterium
ATGVKRQEDFIGIHFFSPVDKMPLVEI

SEQ ID NO: 1235499 - protein, 17 aa, Mycobacterium
ATLPRSAFEATLDLLSG

SEQ ID NO: 1235500 - protein, 18 aa, Mycobacterium
ATPEALVESALWEASLFE

SEQ ID NO: 1235501 - protein, 23 aa, Mycobacterium
AVASRVGAPLGHDYAVISLSDRL

SEQ ID NO: 1235502 - protein, 18 aa, Mycobacterium
AVDLHRRIAYVPGDVTLW

SEQ ID NO: 1235503 - protein, 27 aa, Mycobacterium
AVIQRELDRYLPFLATTRILIAAVRAG

SEQ ID NO: 1235504 - protein, 23 aa, Mycobacterium
AVRELRPDLVLLDLMLPGMNGID

SEQ ID NO: 1235505 - protein, 29 aa, Mycobacterium
AVTVARVAMKWGFGHLGRFSAEYRRKFGV

SEQ ID NO: 1235506 - protein, 27 aa, Mycobacterium
CAPDHPWAREHPEWFTVLPDGTIAYAE

SEQ ID NO: 1235507 - protein, 20 aa, Mycobacterium
CAQDLLWGPAMRNYPDLKFA

SEQ ID NO: 1235508 - protein, 17 aa, Mycobacterium
CEPVCPVEAIYYEDDVP

SEQ ID NO: 1235509 - protein, 17 aa, Mycobacterium
CGFAGSQRAYEKAYDRL

SEQ ID NO: 1235510 - protein, 33 aa, Mycobacterium; identical to SEQ ID NO: 87245

SEQ ID NO: 1235511 - protein, 20 aa, Mycobacterium
CMDNGMPILVFNLLVDGNIA

SEQ ID NO: 1235512 - protein, 21 aa, Mycobacterium
CQYGAQGIRCNAVAPGVTLTP

SEQ ID NO: 1235513 - protein, 19 aa, Mycobacterium
CRVIRRHGRVMVICSDPRH

SEQ ID NO: 1235514 - protein, 17 aa, Mycobacterium
CRYSTTGSTTWENAQPV

SEQ ID NO: 1235515 - protein, 18 aa, Mycobacterium
CVLGAFQVSERGDLANWH

SEQ ID NO: 1235516 - protein, 23 aa, Mycobacterium
DADKYRRLHVIIGDANLAETSTY

SEQ ID NO: 1235517 - protein, 17 aa, Mycobacterium
DAGCGHAELSLALAADG

SEQ ID NO: 1235518 - protein, 24 aa, Mycobacterium
DATVEVAIRLGVDPRKADQMVRGT

SEQ ID NO: 1235519 - protein, 19 aa, Mycobacterium
DAYVTWDYCRGYADASLNE

SEQ ID NO: 1235520 - protein, 19 aa, Mycobacterium
DCSLQRRFQKLVEEAPAPF

SEQ ID NO: 1235521 - protein, 22 aa, Mycobacterium
DDLRAVAGLLEFVAANPGEARS

SEQ ID NO: 1235522 - protein, 17 aa, Mycobacterium
DDQFPIDVFQTGSGTSS

SEQ ID NO: 1235523 - protein, 20 aa, Mycobacterium
DEFIARYGIDLTVAEEAMAL

SEQ ID NO: 1235524 - protein, 23 aa, Mycobacterium
DEFRLYELIWQRTVASQMADARG

SEQ ID NO: 1235525 - protein, 17 aa, Mycobacterium
DETRRLFAGGGFGRGRF

SEQ ID NO: 1235526 - protein, 19 aa, Mycobacterium
DEVPDVWEGVVSVFRDYGY

SEQ ID NO: 1235527 - protein, 18 aa, Mycobacterium
DFRKVADTLLGFIDQDGT

SEQ ID NO: 1235528 - protein, 21 aa, Mycobacterium
DFTADWYGRVLHFGIREHAMG

SEQ ID NO: 1235529 - protein, 22 aa, Mycobacterium
DFWHPRCDPRIPLTDREPVANY

SEQ ID NO: 1235530 - protein, 24 aa, Mycobacterium
DGDEPIELWAWVGAYDHVVLCQLW

SEQ ID NO: 1235531 - protein, 20 aa, Mycobacterium
DGQFGKWLQGARDWSISRNR

SEQ ID NO: 1235532 - protein, 18 aa, Mycobacterium
DGVLHEFTTVPGVKEDVT

SEQ ID NO: 1235533 - protein, 23 aa, Mycobacterium
DHGKAPVRRACYAADRTGHMILQ

SEQ ID NO: 1235534 - protein, 19 aa, Mycobacterium
DIAEVIGFVASRPSHVDLD

SEQ ID NO: 1235535 - protein, 18 aa, Mycobacterium
DIGEAVGIVAAQSIGEPG

SEQ ID NO: 1235536 - protein, 22 aa, Mycobacterium
DISKLRYHKIVLMADADVDGQH

SEQ ID NO: 1235537 - protein, 26 aa, Mycobacterium
DIVPRYRTMRGYKVERRFGWDTHGLP

SEQ ID NO: 1235538 - protein, 24 aa, Mycobacterium
DKGNACLTCSVFVTDHTHRDVLER

SEQ ID NO: 1235539 - protein, 19 aa, Mycobacterium
DKHKLALEREMLGLYVSGH

SEQ ID NO: 1235540 - protein, 24 aa, Mycobacterium
DKSNWWAAYALWVFTLFGHPDVRL

SEQ ID NO: 1235541 - protein, 22 aa, Mycobacterium
DKTGHPFLQHLLAHRDATRLKV

SEQ ID NO: 1235542 - protein, 21 aa, Mycobacterium
DLDVPVFGICYGFQAMAQALG

SEQ ID NO: 1235543 - protein, 22 aa, Mycobacterium
DLLKCSFCGKSQKQVKKLIAGP

SEQ ID NO: 1235544 - protein, 19 aa, Mycobacterium
DLRARPMFHRTRDAIEAHL

SEQ ID NO: 1235545 - protein, 21 aa, Mycobacterium
DLRGLLGAFMFTGPQLDQPAG

SEQ ID NO: 1235546 - protein, 25 aa, Mycobacterium
DLSISRTTFDWGVPVPDHPDHVMYV

SEQ ID NO: 1235547 - protein, 25 aa, Mycobacterium
DLSKLARPTSTWTYMVHDNPLADDT

SEQ ID NO: 1235548 - protein, 21 aa, Mycobacterium
DLSSLRWALSGAEQVDPLDVE

SEQ ID NO: 1235549 - protein, 25 aa, Mycobacterium
DLVLRRLTEALARDRTRHQVSEVTS

SEQ ID NO: 1235550 - protein, 26 aa, Mycobacterium
DMSRKRNLVDFGFRLPSAVDNRPLTW

SEQ ID NO: 1235551 - protein, 18 aa, Mycobacterium
DMYLFSPYDVERVYGVPF

SEQ ID NO: 1235552 - protein, 17 aa, Mycobacterium
DNDRLSALVAHLVGADA

SEQ ID NO: 1235553 - protein, 21 aa, Mycobacterium
DPIPHGLLFERFLNPERPSAP

SEQ ID NO: 1235554 - protein, 22 aa, Mycobacterium
DPYLRPLYDALHDMMDPELIPK

SEQ ID NO: 1235555 - protein, 17 aa, Mycobacterium
DPYLRRALREVADGLKV

SEQ ID NO: 1235556 - protein, 20 aa, Mycobacterium
DQDFTAWLALFATECAYEVR

SEQ ID NO: 1235557 - protein, 26 aa, Mycobacterium
DQLMRAALPLGLWVPVLPGTRQVTVG

SEQ ID NO: 1235558 - protein, 17 aa, Mycobacterium
DQRDFTLWKGAKPGEPS

SEQ ID NO: 1235559 - protein, 20 aa, Mycobacterium
DRKTYLFAFLDDHSRLVVGH

SEQ ID NO: 1235560 - protein, 19 aa, Mycobacterium
DRLDDLLALAHEVRMAWCG

SEQ ID NO: 1235561 - protein, 19 aa, Mycobacterium
DRLGLLPMYAVNQDKHGTA

SEQ ID NO: 1235562 - protein, 23 aa, Mycobacterium
DRLRRRQMSVGEFIGMVQAGLNH

SEQ ID NO: 1235563 - protein, 30 aa, Mycobacterium; identical to SEQ ID NO: 620787

SEQ ID NO: 1235564 - protein, 25 aa, Mycobacterium
DRTGLWGRLFPEWGAVRDLPPRDVV

SEQ ID NO: 1235565 - protein, 30 aa, Mycobacterium; identical to SEQ ID NO: 87610

SEQ ID NO: 1235566 - protein, 19 aa, Mycobacterium
DTYGFPIELTLEMAAEADL

SEQ ID NO: 1235567 - protein, 19 aa, Mycobacterium
DVEGFPYKEIAEIMDTPIG

SEQ ID NO: 1235568 - protein, 20 aa, Mycobacterium
DWYADLPVASPQVFGDQTDV

SEQ ID NO: 1235569 - protein, 27 aa, Mycobacterium
EAAGDGFARFWLHNGWVTMGGEKMSKS

SEQ ID NO: 1235570 - protein, 20 aa, Mycobacterium
EAAGRLMFYGQGAGGAPTAS

SEQ ID NO: 1235571 - protein, 22 aa, Mycobacterium
EADGRRPRILVAKMGQDGHDRG

SEQ ID NO: 1235572 - protein, 18 aa, Mycobacterium
EAGKPLLIIAEDVEGEAL

SEQ ID NO: 1235573 - protein, 24 aa, Mycobacterium
EANLRLVVSLAKRYTGRGMPLLDL

SEQ ID NO: 1235574 - protein, 25 aa, Mycobacterium
EAPARAYNPLFIWGESGLGKTHLLH

SEQ ID NO: 1235575 - protein, 27 aa, Mycobacterium
EARGVPMTAGCVVPRGDVLELIDDIKD

SEQ ID NO: 1235576 - protein, 18 aa, Mycobacterium
EASAIKWYCSQAATDVAM

SEQ ID NO: 1235577 - protein, 22 aa, Mycobacterium
EAVAAFGRGECFVERYLDKPRH

SEQ ID NO: 1235578 - protein, 24 aa, Mycobacterium
EDAIKELFSMSATRYYQVLNALVD

SEQ ID NO: 1235579 - protein, 17 aa, Mycobacterium
EDIRVAAELALPHRRRR

SEQ ID NO: 1235580 - protein, 26 aa, Mycobacterium
EFVMPTHCPECGTELAPAKEGDADIR

SEQ ID NO: 1235581 - protein, 22 aa, Mycobacterium
EGELRPQLLDRFGLTVDVAASR

SEQ ID NO: 1235582 - protein, 17 aa, Mycobacterium
EGIGCGFTEAVRGVLSH

SEQ ID NO: 1235583 - protein, 19 aa, Mycobacterium
EGLPLAYMMDDCRERLADR

SEQ ID NO: 1235584 - protein, 25 aa, Mycobacterium
EGPLPQTRFVLRKALAAHLPVILVV

SEQ ID NO: 1235585 - protein, 18 aa, Mycobacterium
EGVDVPRLAVGVYATSAS

SEQ ID NO: 1235586 - protein, 21 aa, Mycobacterium
EIAEQLLRVLARRLRRTNNNL

SEQ ID NO: 1235587 - protein, 27 aa, Mycobacterium
EIAIRAFRAAYEMGIATVAVYPYEDRN

SEQ ID NO: 1235588 - protein, 20 aa, Mycobacterium
EIEDSLRYGVVKMNVDTDTQ

SEQ ID NO: 1235589 - protein, 23 aa, Mycobacterium
EKVTLRIAAKYAQYTNFTSEPEG

SEQ ID NO: 1235590 - protein, 19 aa, Mycobacterium
ELAIKTGRPLIGINDGAGA

SEQ ID NO: 1235591 - protein, 19 aa, Mycobacterium
ELDAYVVRRLNLPFRDVDW

SEQ ID NO: 1235592 - protein, 24 aa, Mycobacterium
ELLAHCYRMTGSLHDAEDLVQETY

SEQ ID NO: 1235593 - protein, 30 aa, Mycobacterium; identical to SEQ ID NO: 654210

SEQ ID NO: 1235594 - protein, 25 aa, Mycobacterium
EMAYFEVLHELKLIVDLMYEGGIAR

SEQ ID NO: 1235595 - protein, 26 aa, Mycobacterium
ENLFFKEKRYDLARVGRYKVNKKLGL

SEQ ID NO: 1235596 - protein, 20 aa, Mycobacterium
EPATVAAFCNTVRTPGGGSH

SEQ ID NO: 1235597 - protein, 21 aa, Mycobacterium
EPGIPESFKVLLKELQSLCLN

SEQ ID NO: 1235598 - protein, 19 aa, Mycobacterium
EQANINWGKAGRMRWKGKR

SEQ ID NO: 1235599 - protein, 26 aa, Mycobacterium
EQYTYWRIALPHVEAAVFDAALRSHH

SEQ ID NO: 1235600 - protein, 18 aa, Mycobacterium
ERMVGIDATHAWASVWTP

SEQ ID NO: 1235601 - protein, 30 aa, Mycobacterium; identical to SEQ ID NO: 655602

SEQ ID NO: 1235602 - protein, 17 aa, Mycobacterium
ERSEHRFGQVMTGLTVN

SEQ ID NO: 1235603 - protein, 21 aa, Mycobacterium
ERSSHTWFVLQELLGHKNVKN

SEQ ID NO: 1235604 - protein, 26 aa, Mycobacterium
ESAENGRSWSRWSFIGAGAPSALTVR

SEQ ID NO: 1235605 - protein, 25 aa, Mycobacterium
ETIYHFTRRLLVGIANDIERAAVYF

SEQ ID NO: 1235606 - protein, 17 aa, Mycobacterium
ETRIELFTQATDTRPDE

SEQ ID NO: 1235607 - protein, 23 aa, Mycobacterium
ETSKRYMHHYNFPPYSTGETGRV

SEQ ID NO: 1235608 - protein, 32 aa, Mycobacterium; identical to SEQ ID NO: 621111

SEQ ID NO: 1235609 - protein, 19 aa, Mycobacterium
EVASLLRFAGGLHIVSGRV

SEQ ID NO: 1235610 - protein, 29 aa, Mycobacterium
EVFRGVQKWRIKSNWKFVSENFLGDTYHG

SEQ ID NO: 1235611 - protein, 24 aa, Mycobacterium
EVIEKMRVAGRIAAGALAEAGKAV

SEQ ID NO: 1235612 - protein, 19 aa, Mycobacterium
EVIGPKGKMINSITEETGA

SEQ ID NO: 1235613 - protein, 19 aa, Mycobacterium
EVKANWKLYMDAFQEFYHA

SEQ ID NO: 1235614 - protein, 23 aa, Mycobacterium
EVLRAPRSWCEPIYNITHWTTMP

SEQ ID NO: 1235615 - protein, 25 aa, Mycobacterium
EVSPVLWKKVAPKLSAGRVQSVATR

SEQ ID NO: 1235616 - protein, 25 aa, Mycobacterium
EYQRRLRAANALDFDDLIGETVAVL

SEQ ID NO: 1235617 - protein, 27 aa, Mycobacterium
FADVFGLRAPWNGNWRKAVEGGIQVPV

SEQ ID NO: 1235618 - protein, 21 aa, Mycobacterium
FAPRELVELAVAAEEHGMDSA

SEQ ID NO: 1235619 - protein, 21 aa, Mycobacterium
FARFRRAVTDTGLYKDSDRLA

SEQ ID NO: 1235620 - protein, 19 aa, Mycobacterium
FCDLPGVVQHFSIPASAFD

SEQ ID NO: 1235621 - protein, 17 aa, Mycobacterium
FDAVCFTSSSTVRNLVG

SEQ ID NO: 1235622 - protein, 18 aa, Mycobacterium
FDDAGAIGRRYRRQDEIG

SEQ ID NO: 1235623 - protein, 24 aa, Mycobacterium
FEARFRFVEEMIRLGADARTDGHH

SEQ ID NO: 1235624 - protein, 17 aa, Mycobacterium
FENAIAVVMAFGGSTNA

SEQ ID NO: 1235625 - protein, 19 aa, Mycobacterium
FESHCGWPSFFDPADSDAV

SEQ ID NO: 1235626 - protein, 19 aa, Mycobacterium
FFGDRRKAFLDDLAVVTGG

SEQ ID NO: 1235627 - protein, 23 aa, Mycobacterium
FFNNYRPQFYFRTTDVTGVVTLP

SEQ ID NO: 1235628 - protein, 19 aa, Mycobacterium
FGGVVPEIASRAHLEALGP

SEQ ID NO: 1235629 - protein, 25 aa, Mycobacterium
FGLIPEFIGRLPVVASVTNLDKESL

SEQ ID NO: 1235630 - protein, 25 aa, Mycobacterium
FGQPEIKLGVLPGMGGSQRLTRAIG

SEQ ID NO: 1235631 - protein, 21 aa, Mycobacterium
FHDRFTASRLFGAPPGYVGYE

SEQ ID NO: 1235632 - protein, 23 aa, Mycobacterium
FHRMAVDAFASLAADAIEAAQQT

SEQ ID NO: 1235633 - protein, 17 aa, Mycobacterium
FIGHTFAVHDGRKHVPV

SEQ ID NO: 1235634 - protein, 26 aa, Mycobacterium
FISDAAGFMTVWARMYAPDGAAFEQR

SEQ ID NO: 1235635 - protein, 27 aa, Mycobacterium
FISDAAGFMTVWARMYAPDGAAFEQRV

SEQ ID NO: 1235636 - protein, 19 aa, Mycobacterium
FKKGKLVFNQAGALPPAAL

SEQ ID NO: 1235637 - protein, 24 aa, Mycobacterium
FLESLRYDLAVQEIFVFTPKGDVI

SEQ ID NO: 1235638 - protein, 17 aa, Mycobacterium
FLPGHRQKFGIDVDDIR

SEQ ID NO: 1235639 - protein, 20 aa, Mycobacterium
FLRWGQGAFDDFKVVPPGTG

SEQ ID NO: 1235640 - protein, 43 aa, Mycobacterium; identical to SEQ ID NO: 660404

SEQ ID NO: 1235641 - protein, 19 aa, Mycobacterium
FPGCDAPATRCDIDHTAPW

SEQ ID NO: 1235642 - protein, 25 aa, Mycobacterium
FPLFAFSHCRDVVAAVTNAGGFGVL

SEQ ID NO: 1235643 - protein, 18 aa, Mycobacterium
FPSACGKTNLAMLQPTIP

SEQ ID NO: 1235644 - protein, 24 aa, Mycobacterium
FRDRFPDRFFDVGIAEQHAMTSAA

SEQ ID NO: 1235645 - protein, 19 aa, Mycobacterium
FREGVGFTGVVLTKLDGDA

SEQ ID NO: 1235646 - protein, 18 aa, Mycobacterium
FRLGEKVDDPLAMYLFDL

SEQ ID NO: 1235647 - protein, 25 aa, Mycobacterium
FRPREYWRGPVWPVMTWLFAWCFAR

SEQ ID NO: 1235648 - protein, 18 aa, Mycobacterium
FRRFDNWLTANFDDPTDI

SEQ ID NO: 1235649 - protein, 17 aa, Mycobacterium
FSLCMDNGMPILVFNLL

SEQ ID NO: 1235650 - protein, 24 aa, Mycobacterium
FSLDGLICTLEMYKGKVKVNFAKG

SEQ ID NO: 1235651 - protein, 22 aa, Mycobacterium
FSSADPRRGRVLFTDARANPVL

SEQ ID NO: 1235652 - protein, 18 aa, Mycobacterium
FTFREYVSVYGLTRSEGA

SEQ ID NO: 1235653 - protein, 25 aa, Mycobacterium
FTNICYTGCRFCAFAQRKGDADAYS

SEQ ID NO: 1235654 - protein, 22 aa, Mycobacterium
FTRAQLLQEVWGYDFFGGTRTV

SEQ ID NO: 1235655 - protein, 21 aa, Mycobacterium
FTSLDPRAPFGGAKASGLGRE

SEQ ID NO: 1235656 - protein, 17 aa, Mycobacterium
FVAAFDVDAKKVGFDLS

SEQ ID NO: 1235657 - protein, 23 aa, Mycobacterium
FVDGKGVPCLIAIDQDPKGEGQA

SEQ ID NO: 1235658 - protein, 17 aa, Mycobacterium
FVSENFLGDTYHGATTH

SEQ ID NO: 1235659 - protein, 21 aa, Mycobacterium
FWNREYDILVCTTIVETGLDI

SEQ ID NO: 1235660 - protein, 20 aa, Mycobacterium
FYERREIRDIVAYLRVLDNP

SEQ ID NO: 1235661 - protein, 24 aa, Mycobacterium
FYKYPAEHWIHLRTTNPIESTFAT

SEQ ID NO: 1235662 - protein, 19 aa, Mycobacterium
FYNLCRHRGNKLVWNDYPG

SEQ ID NO: 1235663 - protein, 19 aa, Mycobacterium
GAAGFKLHEDWGTTPAAID

SEQ ID NO: 1235664 - protein, 19 aa, Mycobacterium
GAAGVAMGTRFLLTSDSTV

SEQ ID NO: 1235665 - protein, 17 aa, Mycobacterium
GACIGPMGQRVRNVMSE

SEQ ID NO: 1235666 - protein, 18 aa, Mycobacterium
GAEIGRIPVDSIYSPVLK

SEQ ID NO: 1235667 - protein, 18 aa, Mycobacterium
GANLARREITVAFEELHR

SEQ ID NO: 1235668 - protein, 21 aa, Mycobacterium
GARFEVMPGCGHWPQYEDPKT

SEQ ID NO: 1235669 - protein, 26 aa, Mycobacterium
GARVVKAQVPLSEMFGYVGDLRSKTQ

SEQ ID NO: 1235670 - protein, 20 aa, Mycobacterium
GAVIELVHLATLYHDDVMDE

SEQ ID NO: 1235671 - protein, 27 aa, Mycobacterium
GAVLDRNGLRPGRWWRTIDDRIILASE

SEQ ID NO: 1235672 - protein, 18 aa, Mycobacterium
GDAAVSLMDAFRSADEVL

SEQ ID NO: 1235673 - protein, 21 aa, Mycobacterium
GDDIRARFVVMAQGSYNRPKL

SEQ ID NO: 1235674 - protein, 23 aa, Mycobacterium
GDGWRVAMGTLTFERGVSTLGQQ

SEQ ID NO: 1235675 - protein, 26 aa, Mycobacterium
GDIQLPWVRAAVKWHLGTMLESGALR

SEQ ID NO: 1235676 - protein, 17 aa, Mycobacterium
GDNAAAVAWGMGAHVTV

SEQ ID NO: 1235677 - protein, 23 aa, Mycobacterium
GEARSVLGAEPWQRVNAAHSSSW

SEQ ID NO: 1235678 - protein, 19 aa, Mycobacterium
GEEKFIREARLCRKYGAAV

SEQ ID NO: 1235679 - protein, 21 aa, Mycobacterium
GEIRLVLHGGHIAVNGRRSQE

SEQ ID NO: 1235680 - protein, 17 aa, Mycobacterium
GELHLFTPEVVFLLQHS

SEQ ID NO: 1235681 - protein, 18 aa, Mycobacterium
GERLDAKALVAFTQSGDT

SEQ ID NO: 1235682 - protein, 20 aa, Mycobacterium
GESLLTYALCVEELARGWMS

SEQ ID NO: 1235683 - protein, 23 aa, Mycobacterium
GFDCSGLMLYAFAGVGIKLDHYS

SEQ ID NO: 1235684 - protein, 17 aa, Mycobacterium
GFGRIGRNFFRALDAQK

SEQ ID NO: 1235685 - protein, 20 aa, Mycobacterium
GFIRQILGWREYMWHLYWHF

SEQ ID NO: 1235686 - protein, 23 aa, Mycobacterium
GFRFDLASTLAREFYDVDRLSAF

SEQ ID NO: 1235687 - protein, 17 aa, Mycobacterium
GFSTVWLTEHHFLEEYC

SEQ ID NO: 1235688 - protein, 18 aa, Mycobacterium
GGAEMSRSEFYREGRVPL

SEQ ID NO: 1235689 - protein, 30 aa, Mycobacterium
GGEQEKLMAFCLAGALSFNLASPDSTDNRP

SEQ ID NO: 1235690 - protein, 20 aa, Mycobacterium
GGGAHFCLGANLARREITVA

SEQ ID NO: 1235691 - protein, 20 aa, Mycobacterium
GGHLDVCVLGAFQVSERGDL

SEQ ID NO: 1235692 - protein, 18 aa, Mycobacterium
GGIGWIPFYLDRSDRHYT

SEQ ID NO: 1235693 - protein, 24 aa, Mycobacterium
GGKALKFYASVRMDVRRIETLKDG

SEQ ID NO: 1235694 - protein, 26 aa, Mycobacterium
GGPHFCLGAALARTMLRSLLTEVYTR

SEQ ID NO: 1235695 - protein, 23 aa, Mycobacterium
GGQLRVLHTFGLSIAALEERMRM

SEQ ID NO: 1235696 - protein, 33 aa, Mycobacterium
GGVARTVRASTIWDDVRECVGGYTCHLGFESGA

SEQ ID NO: 1235697 - protein, 19 aa, Mycobacterium
GGVDTMLTGAAERWFAPGF

SEQ ID NO: 1235698 - protein, 19 aa, Mycobacterium
GHSSLTLYIQLYLGGFGLE

SEQ ID NO: 1235699 - protein, 18 aa, Mycobacterium
GHYGMCGRAYDPRFLFAW

SEQ ID NO: 1235700 - protein, 18 aa, Mycobacterium
GIEFCKLSFAETRSRSQV

SEQ ID NO: 1235701 - protein, 24 aa, Mycobacterium
GIETKGGVMTKLIERNTTIPTKRS

SEQ ID NO: 1235702 - protein, 27 aa, Mycobacterium
GIGTIAAAFWPKPVVVRMSDFKTNEYA

SEQ ID NO: 1235703 - protein, 23 aa, Mycobacterium
GIHGQEVLTEWLGMADSEYEALV

SEQ ID NO: 1235704 - protein, 19 aa, Mycobacterium
GIPPKWAAVRRLVMGAING

SEQ ID NO: 1235705 - protein, 25 aa, Mycobacterium
GKAIDAGWIDGPRVIPAGHAITPTG

SEQ ID NO: 1235706 - protein, 21 aa, Mycobacterium
GKAKALRDFAQQAGVPMEQTV

SEQ ID NO: 1235707 - protein, 21 aa, Mycobacterium
GKAQLLALHLGRLKDEGRIRP

SEQ ID NO: 1235708 - protein, 20 aa, Mycobacterium
GKGLSRLVRENCDAVVSIPM

SEQ ID NO: 1235709 - protein, 23 aa, Mycobacterium
GKKIKRLSLLSGGEKSLTAVAML

SEQ ID NO: 1235710 - protein, 18 aa, Mycobacterium
GKNQTEWLPPPDLDTGQH

SEQ ID NO: 1235711 - protein, 26 aa, Mycobacterium
GKTALVAALCRQLRDELSLAVLTNDI

SEQ ID NO: 1235712 - protein, 19 aa, Mycobacterium
GKVAGDWSFGQRVAIDHHQ

SEQ ID NO: 1235713 - protein, 26 aa, Mycobacterium
GKVTKLVPFGAFVRVEEGIEGLVHIS

SEQ ID NO: 1235714 - protein, 20 aa, Mycobacterium
GLDGPWRDNPAFAYVIEAAA

SEQ ID NO: 1235715 - protein, 19 aa, Mycobacterium
GLEAVRKRPGMYIGSTGER

SEQ ID NO: 1235716 - protein, 26 aa, Mycobacterium
GLFDPRLKRPIPFLPGTIGLITGRAS

SEQ ID NO: 1235717 - protein, 26 aa, Mycobacterium
GLKDPKRPSGSFIFAGPSGVGKTELS

SEQ ID NO: 1235718 - protein, 22 aa, Mycobacterium
GLPYYGRWLLAVARVLVEKHHI

SEQ ID NO: 1235719 - protein, 24 aa, Mycobacterium
GMRFDKGYISGYFVTDAERQEAVL

SEQ ID NO: 1235720 - protein, 26 aa, Mycobacterium
GNLDPVVLLAGWPVVERAVRAVVEDG

SEQ ID NO: 1235721 - protein, 17 aa, Mycobacterium
GNVMYATGISWPLADAG

SEQ ID NO: 1235722 - protein, 20 aa, Mycobacterium
GPFDLLLQLIFAHRLDVTEV

SEQ ID NO: 1235723 - protein, 25 aa, Mycobacterium
GPKTAETAAEFGLRVDVQPEVAAVG

SEQ ID NO: 1235724 - protein, 18 aa, Mycobacterium
GPMGLPELTSTKWIVWGD

SEQ ID NO: 1235725 - protein, 18 aa, Mycobacterium
GPNDVYVSMNMVRKNGLR

SEQ ID NO: 1235726 - protein, 23 aa, Mycobacterium
GPPGCGKTLIAKAVANSLAKKMA

SEQ ID NO: 1235727 - protein, 25 aa, Mycobacterium
GQGLMKNAYVGRTFIQPSQTIRQLG

SEQ ID NO: 1235728 - protein, 17 aa, Mycobacterium
GQIAGLNVLRIVNEPTA

SEQ ID NO: 1235729 - protein, 22 aa, Mycobacterium
GQLPGHKVYPWVAEVRHSTPGV

SEQ ID NO: 1235730 - protein, 23 aa, Mycobacterium
GQPRLRPPFPAVAGLYACPTVVN

SEQ ID NO: 1235731 - protein, 18 aa, Mycobacterium
GQSSRIENYLGFPDGLSG

SEQ ID NO: 1235732 - protein, 27 aa, Mycobacterium
GQVLKEIQSRLGFLLDVGLDYLSLSRA

SEQ ID NO: 1235733 - protein, 20 aa, Mycobacterium
GRAEIRAIFRSSKVGNIAGC

SEQ ID NO: 1235734 - protein, 29 aa, Mycobacterium
GRDGGYELARPAADISIADVLRCIDGPLA

SEQ ID NO: 1235735 - protein, 24 aa, Mycobacterium
GRENCFFLHCSLVPYMAPSGELKT

SEQ ID NO: 1235736 - protein, 19 aa, Mycobacterium
GRHAEWPMVLASLPHLADP

SEQ ID NO: 1235737 - protein, 25 aa, Mycobacterium
GRIDRRGRMLWSLPKGHIEMGETAE

SEQ ID NO: 1235738 - protein, 21 aa, Mycobacterium
GRPKGVMWRQSDTYVVSMNGA

SEQ ID NO: 1235739 - protein, 21 aa, Mycobacterium
GRPSIPAEVMASVITLQALHG

SEQ ID NO: 1235740 - protein, 22 aa, Mycobacterium
GRSLPHAVLMMIPEAWERHESM

SEQ ID NO: 1235741 - protein, 20 aa, Mycobacterium
GRVKQMLLKIGWPAEDLAGY

SEQ ID NO: 1235742 - protein, 18 aa, Mycobacterium
GRVRLLPLETDWYYFARL

SEQ ID NO: 1235743 - protein, 20 aa, Mycobacterium
GSGPVGFILTRQGIPVLEGT

SEQ ID NO: 1235744 - protein, 19 aa, Mycobacterium
GSIVLWPQVVKEVAPVPVL

SEQ ID NO: 1235745 - protein, 24 aa, Mycobacterium
GSLHRDGWTFTGWGRATTDEAGRY

SEQ ID NO: 1235746 - protein, 21 aa, Mycobacterium
GTARAGGKFSAHTDAASTGAG

SEQ ID NO: 1235747 - protein, 24 aa, Mycobacterium
GTGKSVFLKSLIGLLRPERGKIIV

SEQ ID NO: 1235748 - protein, 18 aa, Mycobacterium
GTINLCIVSPTGYIRDAF

SEQ ID NO: 1235749 - protein, 25 aa, Mycobacterium
GTKGKRYALPHARILMHQPLGGITG

SEQ ID NO: 1235750 - protein, 18 aa, Mycobacterium
GVDPALVDDVIWGCVMQA

SEQ ID NO: 1235751 - protein, 24 aa, Mycobacterium
GVGGRAAVQIGRRLARLARTHQVI

SEQ ID NO: 1235752 - protein, 19 aa, Mycobacterium
GVHISGGISNVSFSFRGNN

SEQ ID NO: 1235753 - protein, 30 aa, Mycobacterium; identical to SEQ ID NO: 673026

SEQ ID NO: 1235754 - protein, 17 aa, Mycobacterium
GVSRSKQRPDGMVELSG

SEQ ID NO: 1235755 - protein, 20 aa, Mycobacterium
GVVVLPCGAGKTLVGAAAMA

SEQ ID NO: 1235756 - protein, 19 aa, Mycobacterium
GVYRCGFAGSQRAYEKAYD

SEQ ID NO: 1235757 - protein, 19 aa, Mycobacterium
HAGPPWFAVSPLMHAAGMW

SEQ ID NO: 1235758 - protein, 18 aa, Mycobacterium
HALKERYSRITVQDKGKR

SEQ ID NO: 1235759 - protein, 25 aa, Mycobacterium
HEDLKRFFDGFPRNAHPMPVLSSAV

SEQ ID NO: 1235760 - protein, 24 aa, Mycobacterium
HEEFPRIDPAVICLVHDGHDRAVL

SEQ ID NO: 1235761 - protein, 18 aa, Mycobacterium
HEVWKAGEPVSLSPTEFT

SEQ ID NO: 1235762 - protein, 17 aa, Mycobacterium
HGARKGLADTALRTADS

SEQ ID NO: 1235763 - protein, 22 aa, Mycobacterium
HGDRLRCYVVGVTRGAREPLIT

SEQ ID NO: 1235764 - protein, 23 aa, Mycobacterium
HGGLRYLEQLEFGLVREALHERE

SEQ ID NO: 1235765 - protein, 20 aa, Mycobacterium
HGKLTGLITVKDFVKTEQFP

SEQ ID NO: 1235766 - protein, 18 aa, Mycobacterium
HHIQRLMILGSHALQRGY

SEQ ID NO: 1235767 - protein, 22 aa, Mycobacterium
HHQAVMAHADWIIDLGPGAGHD

SEQ ID NO: 1235768 - protein, 19 aa, Mycobacterium
HLAALRAIPNLSVVRPGDP

SEQ ID NO: 1235769 - protein, 18 aa, Mycobacterium
HLNMPIAYPPAGGITDPT

SEQ ID NO: 1235770 - protein, 21 aa, Mycobacterium
HNVAFSKPPIGKRGYNEDEVD

SEQ ID NO: 1235771 - protein, 20 aa, Mycobacterium
HPEMPEWHLHLASIHDPLWQ

SEQ ID NO: 1235772 - protein, 17 aa, Mycobacterium
HPGPRLRDYVLAVKACF

SEQ ID NO: 1235773 - protein, 17 aa, Mycobacterium
HQLGADIIFAFDELTTL

SEQ ID NO: 1235774 - protein, 18 aa, Mycobacterium
HQRVMLVEVMGRHAGWIA

SEQ ID NO: 1235775 - protein, 18 aa, Mycobacterium
HRAEFCIDKLYSPDSARG

SEQ ID NO: 1235776 - protein, 17 aa, Mycobacterium
HRGMAVCRYDEGRALQF

SEQ ID NO: 1235777 - protein, 24 aa, Mycobacterium
HRRLEVGGEYAFRREGELHLFTPE

SEQ ID NO: 1235778 - protein, 32 aa, Mycobacterium; identical to SEQ ID NO: 621862

SEQ ID NO: 1235779 - protein, 32 aa, Mycobacterium; identical to SEQ ID NO: 619380

SEQ ID NO: 1235780 - protein, 17 aa, Mycobacterium
HSSHYGRMCPIETPEGP

SEQ ID NO: 1235781 - protein, 17 aa, Mycobacterium
HTARPGIVIGRRGTEAD

SEQ ID NO: 1235782 - protein, 25 aa, Mycobacterium
HTDELRFLVHWSAEVFSDYDELKKN

SEQ ID NO: 1235783 - protein, 18 aa, Mycobacterium
HVQTTLDLYGWVRDDEAL

SEQ ID NO: 1235784 - protein, 23 aa, Mycobacterium
IADDIRAAIAVRHGVTVRDVLLT

SEQ ID NO: 1235785 - protein, 23 aa, Mycobacterium
IAEEYYISFLLDRANRTYLAMCS

SEQ ID NO: 1235786 - protein, 18 aa, Mycobacterium
IAGITYRQLDYWARTSLV

SEQ ID NO: 1235787 - protein, 18 aa, Mycobacterium
IAQVHGWCVGGASDYALC

SEQ ID NO: 1235788 - protein, 23 aa, Mycobacterium
IATRDRTGLRFDIQLQGTPDKPE

SEQ ID NO: 1235789 - protein, 25 aa, Mycobacterium
ICGPETLRSLYFLGSRVTGGSPHAI

SEQ ID NO: 1235790 - protein, 22 aa, Mycobacterium
IDGSCRRFGAGAGNAPVEALIG

SEQ ID NO: 1235791 - protein, 30 aa, Mycobacterium; identical to SEQ ID NO: 618523

SEQ ID NO: 1235792 - protein, 24 aa, Mycobacterium
IDKVFVVACGTAYHSGLLAKYAIE

SEQ ID NO: 1235793 - protein, 18 aa, Mycobacterium
IDVAYRYFATAKRKFIIA

SEQ ID NO: 1235794 - protein, 26 aa, Mycobacterium
IDVCMGPWPALSLRDACQRGDWTEAA

SEQ ID NO: 1235795 - protein, 26 aa, Mycobacterium
IEDFSGSMSLSFSDPRFDEVKAPVDE

SEQ ID NO: 1235796 - protein, 19 aa, Mycobacterium
IEQGLKGVEFIAINTDAQA

SEQ ID NO: 1235797 - protein, 33 aa, Mycobacterium; identical to SEQ ID NO: 81075

SEQ ID NO: 1235798 - protein, 27 aa, Mycobacterium
IFNRELEYLFPRSWLFVGHASQVSAPG

SEQ ID NO: 1235799 - protein, 22 aa, Mycobacterium
IGAWNFPFALTLGPAVGAIAAG

SEQ ID NO: 1235800 - protein, 21 aa, Mycobacterium
IGILPRHIPLVAQLVDDAMVR

SEQ ID NO: 1235801 - protein, 22 aa, Mycobacterium
IGPTRITTVLGILKAYTTRVGS

SEQ ID NO: 1235802 - protein, 19 aa, Mycobacterium
IGQAFGRDHTTVMYAEKKI

SEQ ID NO: 1235803 - protein, 26 aa, Mycobacterium
IGRGVTVGRPLGLLLTRRSENATVTL

SEQ ID NO: 1235804 - protein, 20 aa, Mycobacterium
IGRPDAWEVQGRGELALAVL

SEQ ID NO: 1235805 - protein, 18 aa, Mycobacterium
IHGGYGYSTEYDVERYFR

SEQ ID NO: 1235806 - protein, 25 aa, Mycobacterium
IIANRVSYFYDFRGPSMAIDTACSS

SEQ ID NO: 1235807 - protein, 26 aa, Mycobacterium
IIQEFVKKLPAWVSWERRDHYERDLV

SEQ ID NO: 1235808 - protein, 18 aa, Mycobacterium
IIVKPGGRCRYTTIQNWS

SEQ ID NO: 1235809 - protein, 25 aa, Mycobacterium
IIYDEVHLLPAPVFRMTADLQSRRR

SEQ ID NO: 1235810 - protein, 24 aa, Mycobacterium
IKAVKEKMSVLVLDQLMYPAMMFG

SEQ ID NO: 1235811 - protein, 21 aa, Mycobacterium
IKKGVLELADIVVVNKADGEH

SEQ ID NO: 1235812 - protein, 19 aa, Mycobacterium
IKSAVAFGALLSKGIGDTI

SEQ ID NO: 1235813 - protein, 22 aa, Mycobacterium
IKTAKLRAAQRVQRFLDAAQAI

SEQ ID NO: 1235814 - protein, 19 aa, Mycobacterium
IKTWSRRSTIIPDFIGHTF

SEQ ID NO: 1235815 - protein, 25 aa, Mycobacterium
IKVVREIVSGLGLKEAKDLVDSAPK

SEQ ID NO: 1235816 - protein, 27 aa, Mycobacterium
ILQRYKDLQDIIAILGIDELAEEDKQL

SEQ ID NO: 1235817 - protein, 19 aa, Mycobacterium
INTMPGFTTISMYPRMWAA

SEQ ID NO: 1235818 - protein, 23 aa, Mycobacterium
IPPELRPMVQLDGGRFATSDLND

SEQ ID NO: 1235819 - protein, 24 aa, Mycobacterium
IREARLCRKYGAAVVVMAFDEQGQ

SEQ ID NO: 1235820 - protein, 17 aa, Mycobacterium
IRLEGKSVLISDSERLA

SEQ ID NO: 1235821 - protein, 17 aa, Mycobacterium
IRPGIAHVRTIAVHPLE

SEQ ID NO: 1235822 - protein, 20 aa, Mycobacterium
IRVAAELALPHRRRRDPFDD

SEQ ID NO: 1235823 - protein, 18 aa, Mycobacterium
ITAKGAWESVKRHFREMG

SEQ ID NO: 1235824 - protein, 24 aa, Mycobacterium
ITFAIRIPLEIDMVVDLRIDKPKF

SEQ ID NO: 1235825 - protein, 26 aa, Mycobacterium
ITQYAWGSIWTRPGLDFRSRSMITLT

SEQ ID NO: 1235826 - protein, 25 aa, Mycobacterium
ITVHYRPRPVVGIIAPWNYPVANAL

SEQ ID NO: 1235827 - protein, 19 aa, Mycobacterium
ITVIHEIAHHFGIDDDRLH

SEQ ID NO: 1235828 - protein, 17 aa, Mycobacterium
IWYPMVYDMPARAKEAF

SEQ ID NO: 1235829 - protein, 26 aa, Mycobacterium
KAAVYLADCRRLGITVLPPDVNESVQ

SEQ ID NO: 1235830 - protein, 20 aa, Mycobacterium
KAKALGLKPRARIVAQANVG

SEQ ID NO: 1235831 - protein, 26 aa, Mycobacterium
KAQPLWRVLVALSIRHVGPTAARALA

SEQ ID NO: 1235832 - protein, 26 aa, Mycobacterium
KATQEDPWRHFARTHAIGQIVPGKVT

SEQ ID NO: 1235833 - protein, 20 aa, Mycobacterium
KDVRRWWRSDSLWQAHDARY

SEQ ID NO: 1235834 - protein, 27 aa, Mycobacterium
KEFELLKYLAQHAGRVFTRAQLLQEVW

SEQ ID NO: 1235835 - protein, 19 aa, Mycobacterium
KEMIRLAVEGCRRNGIHSG

SEQ ID NO: 1235836 - protein, 25 aa, Mycobacterium
KEYASRGTWIWPPEPSLRLIADTIE

SEQ ID NO: 1235837 - protein, 32 aa, Mycobacterium; identical to SEQ ID NO: 618347

SEQ ID NO: 1235838 - protein, 18 aa, Mycobacterium
KGACAQVNKDLGLLAPEK

SEQ ID NO: 1235839 - protein, 21 aa, Mycobacterium
KGGGHKRAYRVIDFRRHDKDG

SEQ ID NO: 1235840 - protein, 25 aa, Mycobacterium
KGLYAKARAGEITHFTGIDSPYQRP

SEQ ID NO: 1235841 - protein, 24 aa, Mycobacterium
KGPVELEWKIPQYGSNTLERNRAR

SEQ ID NO: 1235842 - protein, 22 aa, Mycobacterium
KGSPQRRGVCTRVYTTTPKKPN

SEQ ID NO: 1235843 - protein, 28 aa, Mycobacterium
KHGAKMVTAVACARVPKLTVVIGGSYGA

SEQ ID NO: 1235844 - protein, 22 aa, Mycobacterium
KHRVFHYPGGLVDFVKHINRTK

SEQ ID NO: 1235845 - protein, 40 aa, Mycobacterium; identical to SEQ ID NO: 81452

SEQ ID NO: 1235846 - protein, 20 aa, Mycobacterium
KILDPFGLENMRYKWRKWLY

SEQ ID NO: 1235847 - protein, 18 aa, Mycobacterium
KKFLRYNANKALMNLGYE

SEQ ID NO: 1235848 - protein, 17 aa, Mycobacterium
KLASLPVGMAGRAALGF

SEQ ID NO: 1235849 - protein, 25 aa, Mycobacterium
KLRALKRLKVVAAFQTNRNSPMGMV

SEQ ID NO: 1235850 - protein, 22 aa, Mycobacterium
KPLPLRVPVPGGFTSDDFIIDF

SEQ ID NO: 1235851 - protein, 26 aa, Mycobacterium
KQRGEPVSCFLLRIEDNMESIGRSIN

SEQ ID NO: 1235852 - protein, 18 aa, Mycobacterium
KQVRGCLFGSSNPRLDIP

SEQ ID NO: 1235853 - protein, 26 aa, Mycobacterium
KRLTSCGRPTLFARVALLGEDGQPVP

SEQ ID NO: 1235854 - protein, 21 aa, Mycobacterium
KRNFHNWSPFVGVVFGEPDLV

SEQ ID NO: 1235855 - protein, 20 aa, Mycobacterium
KRPIRRVHKGIPAFTTLRGG

SEQ ID NO: 1235856 - protein, 24 aa, Mycobacterium
KRSTEEVRFLMGFNREVVRRRREN

SEQ ID NO: 1235857 - protein, 29 aa, Mycobacterium
KRTVLRLDPRLAPVKAAVLPLSRHADLSP

SEQ ID NO: 1235858 - protein, 23 aa, Mycobacterium
KRVDNMTMAWGLEGRVPFLDHEL

SEQ ID NO: 1235859 - protein, 17 aa, Mycobacterium
KTFCIPHGGGGPGVGPV

SEQ ID NO: 1235860 - protein, 31 aa, Mycobacterium
KTSGGRGVHVFLRIATDWDFIAVRRAGIALA

SEQ ID NO: 1235861 - protein, 19 aa, Mycobacterium
KVAVASFFAKNFLPLLTST

SEQ ID NO: 1235862 - protein, 24 aa, Mycobacterium
KVGRIARILGPRGLMPNPKTGTVT

SEQ ID NO: 1235863 - protein, 22 aa, Mycobacterium
KVLICGYGDVGKGCAESLAGQG

SEQ ID NO: 1235864 - protein, 20 aa, Mycobacterium
KVRYRGVTKNDHWLHHRVAA

SEQ ID NO: 1235865 - protein, 26 aa, Mycobacterium
KVSARPSDSVAIALRVGVPIYVEEAV

SEQ ID NO: 1235866 - protein, 26 aa, Mycobacterium
KVSHPIVFGHAVKVFYKDAFAKHQKL

SEQ ID NO: 1235867 - protein, 22 aa, Mycobacterium
KVYLDLRVKIAKNWQRDPKQLG

SEQ ID NO: 1235868 - protein, 20 aa, Mycobacterium
KWAADCGQLCVKFSRTDLEY

SEQ ID NO: 1235869 - protein, 19 aa, Mycobacterium
KWQKMWKPVVCAVQGMCTA

SEQ ID NO: 1235870 - protein, 19 aa, Mycobacterium
LAAMMACVMSGQSCILPSR

SEQ ID NO: 1235871 - protein, 18 aa, Mycobacterium
LAASAWTRDVYRAQRASR

SEQ ID NO: 1235872 - protein, 23 aa, Mycobacterium
LADELGRPLSLIAESDMNDPRLI

SEQ ID NO: 1235873 - protein, 18 aa, Mycobacterium
LAEAFVHRTGHGIGLSVH

SEQ ID NO: 1235874 - protein, 17 aa, Mycobacterium
LAFNKWDLVDEDRRYLL

SEQ ID NO: 1235875 - protein, 24 aa, Mycobacterium
LAGDAAHLMPVWQGQGYNSGIRDA

SEQ ID NO: 1235876 - protein, 23 aa, Mycobacterium
LAGLRTVGDVVAYIQKLEEENPE

SEQ ID NO: 1235877 - protein, 28 aa, Mycobacterium
LAKAMDRKVWLPSGGTLVIDRTEAMTVV

SEQ ID NO: 1235878 - protein, 21 aa, Mycobacterium
LAKLPTIAAYAYKKSEGQPFL

SEQ ID NO: 1235879 - protein, 19 aa, Mycobacterium
LANFFRIKPAYFTDDEYYE

SEQ ID NO: 1235880 - protein, 17 aa, Mycobacterium
LARRGRGTPAIFLNARG

SEQ ID NO: 1235881 - protein, 18 aa, Mycobacterium
LCSPTRASLLTGRNATTV

SEQ ID NO: 1235882 - protein, 20 aa, Mycobacterium
LDAPICLTWELTYACNLSCV

SEQ ID NO: 1235883 - protein, 26 aa, Mycobacterium
LDDKGRLTLPAKFRDALAGGLMVTKS

SEQ ID NO: 1235884 - protein, 25 aa, Mycobacterium
LDGDARGGAALSVREVTGVPILFAS

SEQ ID NO: 1235885 - protein, 20 aa, Mycobacterium
LDGRLVRFIAALESPSAVRV

SEQ ID NO: 1235886 - protein, 28 aa, Mycobacterium
LDINVFGRRAGIAAANYALGHDFVDLPE

SEQ ID NO: 1235887 - protein, 19 aa, Mycobacterium
LDLALQCAPDHPWAREHPE

SEQ ID NO: 1235888 - protein, 24 aa, Mycobacterium
LDLGSLVAGSRYRGDFEERLKKVL

SEQ ID NO: 1235889 - protein, 19 aa, Mycobacterium
LDQRIAVRYTLPGMTPADT

SEQ ID NO: 1235890 - protein, 19 aa, Mycobacterium
LDQVRYFFLREVPFGQDGS

SEQ ID NO: 1235891 - protein, 25 aa, Mycobacterium
LDVMMPRLDGLEVCRQLRSTGDDLP

SEQ ID NO: 1235892 - protein, 26 aa, Mycobacterium
LDVTLRGAVSIARRLQDPLAELVKIE

SEQ ID NO: 1235893 - protein, 24 aa, Mycobacterium
LEATKGVAMPLRLTSPAPCTNCHG

SEQ ID NO: 1235894 - protein, 21 aa, Mycobacterium
LEGKSSLGRLGLLTHSTAGFI

SEQ ID NO: 1235895 - protein, 21 aa, Mycobacterium
LEKSDRLGLQIVRTLVSAELD

SEQ ID NO: 1235896 - protein, 21 aa, Mycobacterium
LESRLDNVVYRAGLARTRRMA

SEQ ID NO: 1235897 - protein, 20 aa, Mycobacterium
LESRPEDRRAFIEEAAGVLK

SEQ ID NO: 1235898 - protein, 24 aa, Mycobacterium
LFGAGKMFLPQVVKSARVMKKAVA

SEQ ID NO: 1235899 - protein, 18 aa, Mycobacterium
LFGPWDRPDIKGILPDEL

SEQ ID NO: 1235900 - protein, 19 aa, Mycobacterium
LGAFMNWPGPTFTDSGGFQ

SEQ ID NO: 1235901 - protein, 22 aa, Mycobacterium
LGASLAEYGRRVLLVDLDPQGA

SEQ ID NO: 1235902 - protein, 21 aa, Mycobacterium
LGDLYSERALAAGMTTEKADL

SEQ ID NO: 1235903 - protein, 20 aa, Mycobacterium
LGDVCGKGLEAAVLTGKIRN

SEQ ID NO: 1235904 - protein, 17 aa, Mycobacterium
LGGRAGYYDGIGAARDV

SEQ ID NO: 1235905 - protein, 28 aa, Mycobacterium
LGIEFPIFAFTHCRDVVVAVSKAGGFGV

SEQ ID NO: 1235906 - protein, 19 aa, Mycobacterium
LGIGRPSTYSSIIKTIQDR

SEQ ID NO: 1235907 - protein, 21 aa, Mycobacterium
LGLPVDNWPVLGGMGNASWVQ

SEQ ID NO: 1235908 - protein, 24 aa, Mycobacterium
LGPRAAEAVALLALVAGQDVEPVE

SEQ ID NO: 1235909 - protein, 18 aa, Mycobacterium
LGVVGVITPWNFPMTIAA

SEQ ID NO: 1235910 - protein, 18 aa, Mycobacterium
LHLDILVDRMRREFKVEA

SEQ ID NO: 1235911 - protein, 24 aa, Mycobacterium
LHSAFKLLNWQGGSGNVLVSKPYG

SEQ ID NO: 1235912 - protein, 27 aa, Mycobacterium
LHTHLPWLAHHGRWPVGEEWLYQSWSA

SEQ ID NO: 1235913 - protein, 18 aa, Mycobacterium
LHTLRADIDYGLYEAKTT

SEQ ID NO: 1235914 - protein, 18 aa, Mycobacterium
LITTPGLINVDFADVKGV

SEQ ID NO: 1235915 - protein, 20 aa, Mycobacterium
LKARAVPVNVNFNYTPREVD

SEQ ID NO: 1235916 - protein, 22 aa, Mycobacterium
LKFAFSEGGIGWIPFYLDRSDR

SEQ ID NO: 1235917 - protein, 21 aa, Mycobacterium
LKITHPSAIAWAAQMGTVTLH

SEQ ID NO: 1235918 - protein, 19 aa, Mycobacterium
LKIVARAGVGLDNVDVDAA

SEQ ID NO: 1235919 - protein, 21 aa, Mycobacterium
LKLRGETVAVFVADYRMPQMS

SEQ ID NO: 1235920 - protein, 17 aa, Mycobacterium
LKVIAAVHPGLWQPAVL

SEQ ID NO: 1235921 - protein, 17 aa, Mycobacterium
LLDEAGVTVTRFVRFEV

SEQ ID NO: 1235922 - protein, 24 aa, Mycobacterium
LLDPVGACRQCLVEVEGQRKPMAS

SEQ ID NO: 1235923 - protein, 18 aa, Mycobacterium
LLGAHGGLHQKWFNLYDE

SEQ ID NO: 1235924 - protein, 18 aa, Mycobacterium
LLLTHIPPWTSREDVISE

SEQ ID NO: 1235925 - protein, 29 aa, Mycobacterium
LLRQLRLGEYDVLVGINLLREGLDLPEVS

SEQ ID NO: 1235926 - protein, 19 aa, Mycobacterium
LMDAVPVTLGQEFGGYARQ

SEQ ID NO: 1235927 - protein, 25 aa, Mycobacterium
LNALVGLARPGRFGGDVSHLNLHKT

SEQ ID NO: 1235928 - protein, 25 aa, Mycobacterium
LNFRDVLNVLGLYPGDPGPIGGDFA

SEQ ID NO: 1235929 - protein, 20 aa, Mycobacterium
LNIKGPELLNKFVGETERHI

SEQ ID NO: 1235930 - protein, 24 aa, Mycobacterium
LNQLWMCGLPGYGPGDLIDFEFSG

SEQ ID NO: 1235931 - protein, 25 aa, Mycobacterium
LNRSRLEMVLKVLDVDGAVRRVKGG

SEQ ID NO: 1235932 - protein, 17 aa, Mycobacterium
LPAQWRGPVLGPGIQNW

SEQ ID NO: 1235933 - protein, 19 aa, Mycobacterium
LPFPQNWPVFAPKDKIGDW

SEQ ID NO: 1235934 - protein, 19 aa, Mycobacterium
LPLTRGVGIYAACKRAADT

SEQ ID NO: 1235935 - protein, 24 aa, Mycobacterium
LPMKRTALALNHLVSTRFRSDALQ

SEQ ID NO: 1235936 - protein, 18 aa, Mycobacterium
LPSFPALLKKQLKGAPMP

SEQ ID NO: 1235937 - protein, 24 aa, Mycobacterium
LPSTLGAKFARWLTGVLDAAEPIA

SEQ ID NO: 1235938 - protein, 19 aa, Mycobacterium
LQGTLGFELSGSFVSYFGW

SEQ ID NO: 1235939 - protein, 19 aa, Mycobacterium
LQGWTLDRLPAVDRAILRV

SEQ ID NO: 1235940 - protein, 19 aa, Mycobacterium
LRGLADCVVEVATLDHGLH

SEQ ID NO: 1235941 - protein, 17 aa, Mycobacterium
LRGRPVIVGGGVVLAAS

SEQ ID NO: 1235942 - protein, 19 aa, Mycobacterium
LRNLFKLSSLASFEGQLGK

SEQ ID NO: 1235943 - protein, 18 aa, Mycobacterium
LRNRTAFAAGHLQGTLGF

SEQ ID NO: 1235944 - protein, 21 aa, Mycobacterium
LRRQLKPLGRQAEMARRAQTI

SEQ ID NO: 1235945 - protein, 18 aa, Mycobacterium
LRSTSGPVLNQGPHQVDI

SEQ ID NO: 1235946 - protein, 24 aa, Mycobacterium
LSEALKRRCLFLHIDFPDPDLERR

SEQ ID NO: 1235947 - protein, 24 aa, Mycobacterium
LSELARRAGLPIATTHRLAAELVA

SEQ ID NO: 1235948 - protein, 18 aa, Mycobacterium
LSVYARVNPFGFIETPYR

SEQ ID NO: 1235949 - protein, 17 aa, Mycobacterium
LTAAHWLSEENVPVVGV

SEQ ID NO: 1235950 - protein, 23 aa, Mycobacterium
LTPEAWAVWEAIFAKFAAPGMCN

SEQ ID NO: 1235951 - protein, 28 aa, Mycobacterium
LTPLEFDLLVALARKPRQVFTRDVLLEQ

SEQ ID NO: 1235952 - protein, 18 aa, Mycobacterium
LTSPELATLMAHVKLALK

SEQ ID NO: 1235953 - protein, 18 aa, Mycobacterium
LVASFAIDELLDYRSRRP

SEQ ID NO: 1235954 - protein, 22 aa, Mycobacterium
LVEMRRVRDLQPYIGKEIEAKI

SEQ ID NO: 1235955 - protein, 22 aa, Mycobacterium
LVENFLRMTFGFPAEPYEVDPE

SEQ ID NO: 1235956 - protein, 19 aa, Mycobacterium
LVESSAPRAVKERMVFVLS

SEQ ID NO: 1235957 - protein, 22 aa, Mycobacterium
LVHGLPLYHVHGLVLGLLGSLR

SEQ ID NO: 1235958 - protein, 18 aa, Mycobacterium
LVITPGYDLRYLVGSRAQ

SEQ ID NO: 1235959 - protein, 19 aa, Mycobacterium
LVPEPRRLATRTDTQVLEL

SEQ ID NO: 1235960 - protein, 29 aa, Mycobacterium
LVPSCSYPLTGLRCVNRVYTDYAVFDIDH

SEQ ID NO: 1235961 - protein, 17 aa, Mycobacterium
LVSKGFTPRRIRELEPR

SEQ ID NO: 1235962 - protein, 19 aa, Mycobacterium
LYVSYLRKKIDSGREPMIH

SEQ ID NO: 1235963 - protein, 20 aa, Mycobacterium
MAASMGEFLLAAGTKGKRYA

SEQ ID NO: 1235964 - protein, 21 aa, Mycobacterium
MAVGLAVWRLGAGRSAPGEQV

SEQ ID NO: 1235965 - protein, 18 aa, Mycobacterium
MDAAWALYEAYIKILTGE

SEQ ID NO: 1235966 - protein, 23 aa, Mycobacterium
MDEGLRFAIREGGRTVGAGRVTK

SEQ ID NO: 1235967 - protein, 19 aa, Mycobacterium
MDRVICGDVGYGKTEIAVR

SEQ ID NO: 1235968 - protein, 23 aa, Mycobacterium
MDYDAAAVLQSWFYLSRGKRLPS

SEQ ID NO: 1235969 - protein, 19 aa, Mycobacterium
MEMEKARGISITSTALQFP

SEQ ID NO: 1235970 - protein, 28 aa, Mycobacterium
MGAAEKCSILYLESRCVSLARALGSQGV

SEQ ID NO: 1235971 - protein, 35 aa, Mycobacterium; identical to SEQ ID NO: 82626

SEQ ID NO: 1235972 - protein, 19 aa, Mycobacterium
MGVSGCARECAEARGKDVG

SEQ ID NO: 1235973 - protein, 29 aa, Mycobacterium
MHDWCISRQLWWGHRIPIWHGPNGETVCV

SEQ ID NO: 1235974 - protein, 18 aa, Mycobacterium
MHGSDMVQTGWALARALG

SEQ ID NO: 1235975 - protein, 24 aa, Mycobacterium
MIGKPGAGLCPVRGHSNVQGDRTM

SEQ ID NO: 1235976 - protein, 21 aa, Mycobacterium
MLTGAAERWFAPGFVDREPGT

SEQ ID NO: 1235977 - protein, 18 aa, Mycobacterium
MPDDAKRLMHLMQSVVMV

SEQ ID NO: 1235978 - protein, 17 aa, Mycobacterium
MQTSSANLGDWIASRLV

SEQ ID NO: 1235979 - protein, 21 aa, Mycobacterium
MRRALEYASGLGVLIAQHAEE

SEQ ID NO: 1235980 - protein, 22 aa, Mycobacterium
MRWKGKRPTVRGVVMNPVDHPH

SEQ ID NO: 1235981 - protein, 17 aa, Mycobacterium
MTIGTGFVGRSSIGENL

SEQ ID NO: 1235982 - protein, 18 aa, Mycobacterium
MTIPEEYGGHGLGITEAT

SEQ ID NO: 1235983 - protein, 35 aa, Mycobacterium; identical to SEQ ID NO: 618869

SEQ ID NO: 1235984 - protein, 19 aa, Mycobacterium
MTSFYDWYADLPVASPQVF

SEQ ID NO: 1235985 - protein, 24 aa, Mycobacterium
MVGMKGKAWTGGDFGRVLMQYDDL

SEQ ID NO: 1235986 - protein, 21 aa, Mycobacterium
MVIKDGRFGPYVTDGETNASL

SEQ ID NO: 1235987 - protein, 24 aa, Mycobacterium
MYAAGRIPGSFFRREGRPSTDAIL

SEQ ID NO: 1235988 - protein, 17 aa, Mycobacterium
MYLCRELTDLSLPKIGQ

SEQ ID NO: 1235989 - protein, 26 aa, Mycobacterium
MYPAMMFGAAGAWSIDVCMGPWPALS

SEQ ID NO: 1235990 - protein, 18 aa, Mycobacterium
NAGFGSAGERCMAISACV

SEQ ID NO: 1235991 - protein, 19 aa, Mycobacterium
NAGVHACAVIMSSEPLIDA

SEQ ID NO: 1235992 - protein, 24 aa, Mycobacterium
NAISGRVAFALGLEGPAVAVDTAC

SEQ ID NO: 1235993 - protein, 24 aa, Mycobacterium
NDEIKELLLQTAIYCGVPDANSAF

SEQ ID NO: 1235994 - protein, 17 aa, Mycobacterium
NEAELMAHFGVSRPTLR

SEQ ID NO: 1235995 - protein, 25 aa, Mycobacterium
NEIPSRAYVSAFGFKGPDQQKPAGV

SEQ ID NO: 1235996 - protein, 26 aa, Mycobacterium
NELREMLPHNAVEYFVSYYDYYQPEA

SEQ ID NO: 1235997 - protein, 21 aa, Mycobacterium
NEPERAYLIFGNDAFGLPPQD

SEQ ID NO: 1235998 - protein, 24 aa, Mycobacterium
NGERTGNVCLVTLGLNLFSRGVDP

SEQ ID NO: 1235999 - protein, 25 aa, Mycobacterium
NGILASMCFPTFTGFSARHLNMHRE

SEQ ID NO: 1236000 - protein, 23 aa, Mycobacterium
NGMSWDLRCGSLFEPVAGERFDL

SEQ ID NO: 1236001 - protein, 19 aa, Mycobacterium
NIDSGVYYYGLVQERRRNP

SEQ ID NO: 1236002 - protein, 22 aa, Mycobacterium
NIKASGVIPQISLIMGAAAGGH

SEQ ID NO: 1236003 - protein, 26 aa, Mycobacterium
NKALADFAHRGWIRLEGKSVLISDSE

SEQ ID NO: 1236004 - protein, 18 aa, Mycobacterium
NLMLFSGRAHPELAEQVA

SEQ ID NO: 1236005 - protein, 24 aa, Mycobacterium
NPTVLAAFLHRARLRTIQHPGNAP

SEQ ID NO: 1236006 - protein, 20 aa, Mycobacterium
NRGHCAAIHLNMPIAYPPAG

SEQ ID NO: 1236007 - protein, 19 aa, Mycobacterium
NRLAALIPPPVRKLPILIG

SEQ ID NO: 1236008 - protein, 18 aa, Mycobacterium
NRSACVRIPITGNNPKAK

SEQ ID NO: 1236009 - protein, 20 aa, Mycobacterium
NTTIPTKRSETFTTADDNQP

SEQ ID NO: 1236010 - protein, 23 aa, Mycobacterium
NVQAGLRTDYLFRLANQRGGIVL

SEQ ID NO: 1236011 - protein, 22 aa, Mycobacterium
NVSRPPWLAALRETTVREKVAT

SEQ ID NO: 1236012 - protein, 23 aa, Mycobacterium
NYRAWRHFIAMRASEHADLEIRR

SEQ ID NO: 1236013 - protein, 17 aa, Mycobacterium
PAGIKWAADCGQLCVKF

SEQ ID NO: 1236014 - protein, 26 aa, Mycobacterium
PAVDRAILRVAVWELLHAEDVPEPVA

SEQ ID NO: 1236015 - protein, 18 aa, Mycobacterium
PDLVCDFWTELGRNLTAR

SEQ ID NO: 1236016 - protein, 21 aa, Mycobacterium
PDWTQGIPLGYTRELAAYWAD

SEQ ID NO: 1236017 - protein, 25 aa, Mycobacterium
PEKFGMPDAKAWIAYGASPRASLGI

SEQ ID NO: 1236018 - protein, 25 aa, Mycobacterium
PENPKPLGMPLQYMVSGMAVAATHK

SEQ ID NO: 1236019 - protein, 24 aa, Mycobacterium
PEPHYRPSATLAAFVRARDLFCRF

SEQ ID NO: 1236020 - protein, 19 aa, Mycobacterium
PETAQGIFVNFANVVTTAR

SEQ ID NO: 1236021 - protein, 21 aa, Mycobacterium
PETFPGTVAVIPRFQELIAPY

SEQ ID NO: 1236022 - protein, 18 aa, Mycobacterium
PEVLIPIQCEYYALEGVG

SEQ ID NO: 1236023 - protein, 23 aa, Mycobacterium
PFACKRPIIDQGYYETFNRDNVT

SEQ ID NO: 1236024 - protein, 20 aa, Mycobacterium
PFTPRAKKVLELSLREALQL

SEQ ID NO: 1236025 - protein, 33 aa, Mycobacterium
PGDMATIWRGGCIIRAKFLNRIKDAFDNDPDLP

SEQ ID NO: 1236026 - protein, 20 aa, Mycobacterium
PGERAQWKWYTPFQPPPPTT

SEQ ID NO: 1236027 - protein, 19 aa, Mycobacterium
PGMDGFGLLRRLRADGIDA

SEQ ID NO: 1236028 - protein, 31 aa, Mycobacterium; identical to SEQ ID NO: 708132

SEQ ID NO: 1236029 - protein, 22 aa, Mycobacterium
PHGESGKVIGIRVFSREDDDEL

SEQ ID NO: 1236030 - protein, 28 aa, Mycobacterium
PIEPRLSLQWWVKVESLAKAAGDAVRNG

SEQ ID NO: 1236031 - protein, 18 aa, Mycobacterium
PIHAGGLRYHGMAPALSH

SEQ ID NO: 1236032 - protein, 25 aa, Mycobacterium
PIIEPGCLDLLFRGEIPEGVDPASL

SEQ ID NO: 1236033 - protein, 17 aa, Mycobacterium
PKARALRPYAEKLITHA

SEQ ID NO: 1236034 - protein, 20 aa, Mycobacterium
PKELVARVRARLRRNEDEPA

SEQ ID NO: 1236035 - protein, 19 aa, Mycobacterium
PKLRRAGLDYHDLASVTVH

SEQ ID NO: 1236036 - protein, 18 aa, Mycobacterium
PLLVACDLQRPGAVNQLQ

SEQ ID NO: 1236037 - protein, 19 aa, Mycobacterium
PMKAIPAFFEPEPRIKVMD

SEQ ID NO: 1236038 - protein, 22 aa, Mycobacterium
PMREDIRLLGAILGDTVREQNG

SEQ ID NO: 1236039 - protein, 28 aa, Mycobacterium
PNVGGICIGCTMPGFPDKFMPFMDEPPG

SEQ ID NO: 1236040 - protein, 20 aa, Mycobacterium
PPDDEFWLTLAPTNRLVTAR

SEQ ID NO: 1236041 - protein, 21 aa, Mycobacterium
PPELETRIAILRKKAQMDRLD

SEQ ID NO: 1236042 - protein, 19 aa, Mycobacterium
PPGCGKTFVVRALASSGRL

SEQ ID NO: 1236043 - protein, 23 aa, Mycobacterium
PPKNRNPLGAGMPGMPAGFPDLS

SEQ ID NO: 1236044 - protein, 17 aa, Mycobacterium
PPLLLPEQIQAILDGCA

SEQ ID NO: 1236045 - protein, 19 aa, Mycobacterium
PPSIREIGDAVGLTSTSSV

SEQ ID NO: 1236046 - protein, 25 aa, Mycobacterium
PPVLRRNILENPAWYTAYTPYQPEI

SEQ ID NO: 1236047 - protein, 24 aa, Mycobacterium
PQHTRLRKIISRGFTPRAVGRLED

SEQ ID NO: 1236048 - protein, 23 aa, Mycobacterium
PQLFKQLLMVAGMERYYQIARCY

SEQ ID NO: 1236049 - protein, 23 aa, Mycobacterium
PRADIPRLLSLYREGKLLLDETV

SEQ ID NO: 1236050 - protein, 18 aa, Mycobacterium
PRGAAFSWYTYSPTRVRY

SEQ ID NO: 1236051 - protein, 21 aa, Mycobacterium
PRGVPQIEVTFDIDANGIVHV

SEQ ID NO: 1236052 - protein, 19 aa, Mycobacterium
PRIDVTVRISGFFRDAFPH

SEQ ID NO: 1236053 - protein, 23 aa, Mycobacterium
PRRHPGKRSPLWHQRQRAAQLLD

SEQ ID NO: 1236054 - protein, 20 aa, Mycobacterium
PRTTIGWKGLINDPGMDGTF

SEQ ID NO: 1236055 - protein, 20 aa, Mycobacterium
PSDRTGSVARCYSLCSSPFT

SEQ ID NO: 1236056 - protein, 25 aa, Mycobacterium
PSLPLLERAKFLAIFASNLDEFYMV

SEQ ID NO: 1236057 - protein, 20 aa, Mycobacterium
PTGLAGLGILISEAVRGEGG

SEQ ID NO: 1236058 - protein, 18 aa, Mycobacterium
PTVFQRLAPGIMPLSVAE

SEQ ID NO: 1236059 - protein, 19 aa, Mycobacterium
PVEALIGVFDKIGVKTGID

SEQ ID NO: 1236060 - protein, 18 aa, Mycobacterium
PVHRDWRLNERHYGALQG

SEQ ID NO: 1236061 - protein, 18 aa, Mycobacterium
PVLVDFWATWCGPCKMVA

SEQ ID NO: 1236062 - protein, 18 aa, Mycobacterium
PVMAKARIGHFVEAQILQ

SEQ ID NO: 1236063 - protein, 24 aa, Mycobacterium
PVMVKAQVKVGGRGKAGGVKYAAT

SEQ ID NO: 1236064 - protein, 18 aa, Mycobacterium
PVTNGPVWVLAGFGAQHR

SEQ ID NO: 1236065 - protein, 22 aa, Mycobacterium
PYTEVPESYLAGGREAGKNWAA

SEQ ID NO: 1236066 - protein, 19 aa, Mycobacterium
QAIGVAFGGTVDRAPELLH

SEQ ID NO: 1236067 - protein, 19 aa, Mycobacterium
QALVREGLRNVAAGANPLG

SEQ ID NO: 1236068 - protein, 25 aa, Mycobacterium
QAWTNRPGTEYVWFNNVETRPGQGY

SEQ ID NO: 1236069 - protein, 22 aa, Mycobacterium
QCLGGGGWILGHLIDGTQAEYV

SEQ ID NO: 1236070 - protein, 17 aa, Mycobacterium
QDTRLTWEERRMRREVR

SEQ ID NO: 1236071 - protein, 35 aa, Mycobacterium; identical to SEQ ID NO: 83529

SEQ ID NO: 1236072 - protein, 24 aa, Mycobacterium
QFTMATDMAVYFCDPASPWQRGSN

SEQ ID NO: 1236073 - protein, 17 aa, Mycobacterium
QGIRVNALCPGPVNTPL

SEQ ID NO: 1236074 - protein, 27 aa, Mycobacterium
QHDGRWGRATLEVCFAILQSAYEDREV

SEQ ID NO: 1236075 - protein, 28 aa, Mycobacterium
QHVKPGKGPAFVRTKLKNVVSGKVVDKT

SEQ ID NO: 1236076 - protein, 26 aa, Mycobacterium
QINYLRCIGCGLCIEACPTRALTMTN

SEQ ID NO: 1236077 - protein, 22 aa, Mycobacterium
QLEARIDSLAARNAKLMDTLKE

SEQ ID NO: 1236078 - protein, 23 aa, Mycobacterium
QLIDRIGVDNVMWSSDYPHNEST

SEQ ID NO: 1236079 - protein, 18 aa, Mycobacterium
QLTMRVFTGLTLLDTIQG

SEQ ID NO: 1236080 - protein, 18 aa, Mycobacterium
QNARLAARLTGWRIDIRS

SEQ ID NO: 1236081 - protein, 19 aa, Mycobacterium
QPTEFNDIVAVLALYRPGP

SEQ ID NO: 1236082 - protein, 19 aa, Mycobacterium
QPTIPGWRAETVGDDIAWM

SEQ ID NO: 1236083 - protein, 18 aa, Mycobacterium
QPTLGMMMFTLFQKRLLG

SEQ ID NO: 1236084 - protein, 23 aa, Mycobacterium
QQRVPLGVVGIVYEGRPNVTVDA

SEQ ID NO: 1236085 - protein, 20 aa, Mycobacterium
QRAAELGWASLLVPEELGGG

SEQ ID NO: 1236086 - protein, 21 aa, Mycobacterium
QRDFGTAVVWISHDLGVIGQV

SEQ ID NO: 1236087 - protein, 19 aa, Mycobacterium
QRFLAEQGYGYVIKDADDL

SEQ ID NO: 1236088 - protein, 26 aa, Mycobacterium
QRFLPPTFRGEMIWCQLFSEPGAGSD

SEQ ID NO: 1236089 - protein, 25 aa, Mycobacterium
QRKVVVFRPLYAVGGQDLGYLPGSE

SEQ ID NO: 1236090 - protein, 23 aa, Mycobacterium
QRQLEMRLNRQLADIEKLQVNVR

SEQ ID NO: 1236091 - protein, 20 aa, Mycobacterium
QRVKVIDGQGAFPRIQGDIP

SEQ ID NO: 1236092 - protein, 23 aa, Mycobacterium
QTRRWNPKMKRFIFTDRNGIYII

SEQ ID NO: 1236093 - protein, 30 aa, Mycobacterium
QVAPWNYPMMMAIWKICPAIAAGNTVVIKP

SEQ ID NO: 1236094 - protein, 27 aa, Mycobacterium
QVNRKVLPGYILVRMELNDESWGAVRN

SEQ ID NO: 1236095 - protein, 20 aa, Mycobacterium
QWRGPVLGPGIQNWAAITEN

SEQ ID NO: 1236096 - protein, 23 aa, Mycobacterium
QYLAQLYATIGIRASDAAQQLLG

SEQ ID NO: 1236097 - protein, 25 aa, Mycobacterium
QYVVGRLVWNAGLLAPVEGQLRQVA

SEQ ID NO: 1236098 - protein, 20 aa, Mycobacterium
RAALLEALEVARLDPSVDEV

SEQ ID NO: 1236099 - protein, 21 aa, Mycobacterium
RAAVDSGYYPGQFQVGQTGKT

SEQ ID NO: 1236100 - protein, 19 aa, Mycobacterium
RAFGGTFLQFSDYMRPAVR

SEQ ID NO: 1236101 - protein, 37 aa, Mycobacterium; identical to SEQ ID NO: 717496

SEQ ID NO: 1236102 - protein, 20 aa, Mycobacterium
RAVEKFDYTKGYKFSTYATW

SEQ ID NO: 1236103 - protein, 23 aa, Mycobacterium
RDGEAIGALLTRMGAQDTRLTWE

SEQ ID NO: 1236104 - protein, 25 aa, Mycobacterium
RDGGCTKPCCTVGAYGCQVHHVDAD

SEQ ID NO: 1236105 - protein, 26 aa, Mycobacterium
RDGGCTKPCCTVGAYGCQVHHVDADW

SEQ ID NO: 1236106 - protein, 26 aa, Mycobacterium
RDGRDAGRRRPPILSEAEFLARREAV

SEQ ID NO: 1236107 - protein, 17 aa, Mycobacterium
RDPAPLFRTNVEGTRNV

SEQ ID NO: 1236108 - protein, 24 aa, Mycobacterium
REKASEGTPVIVFFDEMDSIFRTR

SEQ ID NO: 1236109 - protein, 27 aa, Mycobacterium
RELYPECPRVYGVAVMGDLSRRRWWPL

SEQ ID NO: 1236110 - protein, 25 aa, Mycobacterium
RESNGDRYLPIWIGQSEAAAIALEQ

SEQ ID NO: 1236111 - protein, 23 aa, Mycobacterium
REVAAEFERPVLLFSGGKDSIVM

SEQ ID NO: 1236112 - protein, 26 aa, Mycobacterium
REVHHMAALCGFGAAAINPYMAFESI

SEQ ID NO: 1236113 - protein, 18 aa, Mycobacterium
RFSTAFGSTLSRLVRHGI

SEQ ID NO: 1236114 - protein, 26 aa, Mycobacterium
RFTAYDCARLRFILTAQRDQYLPLKV

SEQ ID NO: 1236115 - protein, 19 aa, Mycobacterium
RGFFTSRVIGTFVNEALAM

SEQ ID NO: 1236116 - protein, 25 aa, Mycobacterium
RGFRVEFNSALGPFKGGLRFHPSVY

SEQ ID NO: 1236117 - protein, 22 aa, Mycobacterium
RGGSLKSSWYGDCLPERDFPTL

SEQ ID NO: 1236118 - protein, 22 aa, Mycobacterium
RGIPQLSSAPVWSSDIRAGAGL

SEQ ID NO: 1236119 - protein, 31 aa, Mycobacterium
RGKRLPSARGRGRVHALFGFARHALIAASHD

SEQ ID NO: 1236120 - protein, 25 aa, Mycobacterium
RGSAKRITAILPFYPYARQDKKHRG

SEQ ID NO: 1236121 - protein, 20 aa, Mycobacterium
RGSGAVMVLAGPPGVGKTSL

SEQ ID NO: 1236122 - protein, 19 aa, Mycobacterium
RGVDLILGGFLHFQEEIEY

SEQ ID NO: 1236123 - protein, 20 aa, Mycobacterium
RIGAEVRDGDILVGKVTPKG

SEQ ID NO: 1236124 - protein, 23 aa, Mycobacterium
RIQEGVVSLGLYSRIFHNNIKAS

SEQ ID NO: 1236125 - protein, 21 aa, Mycobacterium
RKDGVPLWWKSAARNKSSVAV

SEQ ID NO: 1236126 - protein, 22 aa, Mycobacterium
RKDGYTSTVFGRRRYLPELDSS

SEQ ID NO: 1236127 - protein, 19 aa, Mycobacterium
RKMAKRGGGAIVNQSSTAA

SEQ ID NO: 1236128 - protein, 22 aa, Mycobacterium
RKNARQHLAFGRGIHSCPGAPL

SEQ ID NO: 1236129 - protein, 18 aa, Mycobacterium
RKRGRAVALVNPRVVSKA

SEQ ID NO: 1236130 - protein, 26 aa, Mycobacterium
RKTLKAVAVKAPFFGDRRKAFLDDLA

SEQ ID NO: 1236131 - protein, 17 aa, Mycobacterium
RKTSRNAFAEWAGSGNE

SEQ ID NO: 1236132 - protein, 19 aa, Mycobacterium
RKVFIPVTHLCRDTCHYCT

SEQ ID NO: 1236133 - protein, 17 aa, Mycobacterium
RLEGRAFGDVPLNLEYK

SEQ ID NO: 1236134 - protein, 26 aa, Mycobacterium
RLEIASPRLGFRIQLDPLELESLSWQ

SEQ ID NO: 1236135 - protein, 19 aa, Mycobacterium
RLERLRSAPTVFIDAAHNP

SEQ ID NO: 1236136 - protein, 25 aa, Mycobacterium
RLFPEEVTACWSGNVACGPAPVTHL

SEQ ID NO: 1236137 - protein, 21 aa, Mycobacterium
RLLDCCQETDGGVAIVVTTPE

SEQ ID NO: 1236138 - protein, 19 aa, Mycobacterium
RLQPGRMFLVDTAQGRIVS

SEQ ID NO: 1236139 - protein, 24 aa, Mycobacterium
RLSARLISEISWRTRLVDDEQVLG

SEQ ID NO: 1236140 - protein, 19 aa, Mycobacterium
RLTCVFVDHGLLRSGERAQ

SEQ ID NO: 1236141 - protein, 20 aa, Mycobacterium
RMLVVPGSMRVRAQAESEGL

SEQ ID NO: 1236142 - protein, 19 aa, Mycobacterium
RMPLHPVAIELLREVGPMA

SEQ ID NO: 1236143 - protein, 24 aa, Mycobacterium
RMTGRNVLHALGFDAFGLPAEQYA

SEQ ID NO: 1236144 - protein, 17 aa, Mycobacterium
RNLGAIVRSVAAFGGHG

SEQ ID NO: 1236145 - protein, 19 aa, Mycobacterium
RNNVVLSRRAWLEQTQSEV

SEQ ID NO: 1236146 - protein, 22 aa, Mycobacterium
RPAEEMLYLAMEDFRVDVVVGK

SEQ ID NO: 1236147 - protein, 19 aa, Mycobacterium
RPDAVVLDVMMPRLDGLEV

SEQ ID NO: 1236148 - protein, 19 aa, Mycobacterium
RPDVLVAMNPAALKANVSD

SEQ ID NO: 1236149 - protein, 20 aa, Mycobacterium
RPEFLNRIDDIIVFHQLTQD

SEQ ID NO: 1236150 - protein, 19 aa, Mycobacterium
RPERDPGLILRVAAASATT

SEQ ID NO: 1236151 - protein, 26 aa, Mycobacterium
RPLSHDTMEVWSWFLVEKDADEEFKQ

SEQ ID NO: 1236152 - protein, 26 aa, Mycobacterium
RPQGVSGLNAVVSWPAEEWGRDPAGF

SEQ ID NO: 1236153 - protein, 20 aa, Mycobacterium
RPQVWDVLEEVIAEHPVLLN

SEQ ID NO: 1236154 - protein, 28 aa, Mycobacterium
RPRGLEIVSCPSCGRAQVDVYTLANEVT

SEQ ID NO: 1236155 - protein, 19 aa, Mycobacterium
RPVFAQLMLDEAFSKSDPQ

SEQ ID NO: 1236156 - protein, 19 aa, Mycobacterium
RPVPFIIGVAGSVAVGKST

SEQ ID NO: 1236157 - protein, 19 aa, Mycobacterium
RQDQLPSTHPVAADIPDLH

SEQ ID NO: 1236158 - protein, 18 aa, Mycobacterium
RQFTCKYHAWRYDLDGNL

SEQ ID NO: 1236159 - protein, 24 aa, Mycobacterium
RQMLRFLSSPLWRAYTSTYVEGYR

SEQ ID NO: 1236160 - protein, 32 aa, Mycobacterium; identical to SEQ ID NO: 91351

SEQ ID NO: 1236161 - protein, 30 aa, Mycobacterium
RRADRFLPNGWCMLPPLQSCDKGNACLTCS

SEQ ID NO: 1236162 - protein, 24 aa, Mycobacterium
RRARKGEFRKLWISRINAAARAND

SEQ ID NO: 1236163 - protein, 19 aa, Mycobacterium
RRDTLIATRDRTGLRFDIQ

SEQ ID NO: 1236164 - protein, 19 aa, Mycobacterium
RREELSFQRCSRCDRWRHV

SEQ ID NO: 1236165 - protein, 21 aa, Mycobacterium
RRKPFSVVLFDEIEKAHQEIY

SEQ ID NO: 1236166 - protein, 18 aa, Mycobacterium
RRSCPECGRRFTTVETAV

SEQ ID NO: 1236167 - protein, 17 aa, Mycobacterium
RRYYMRYSGPGGMTEQD

SEQ ID NO: 1236168 - protein, 21 aa, Mycobacterium
RSDALQIVAFGRYARTVTAAE

SEQ ID NO: 1236169 - protein, 20 aa, Mycobacterium
RSQESLYDFNLATYDEGDTF

SEQ ID NO: 1236170 - protein, 21 aa, Mycobacterium
RSYVLHPYQMVKDLRTEYEVG

SEQ ID NO: 1236171 - protein, 30 aa, Mycobacterium; identical to SEQ ID NO: 727284

SEQ ID NO: 1236172 - protein, 19 aa, Mycobacterium
RTDFPGGNVDDMFRSLQAL

SEQ ID NO: 1236173 - protein, 22 aa, Mycobacterium
RTGDLPAPLPLIGGHEGAGIVR

SEQ ID NO: 1236174 - protein, 21 aa, Mycobacterium
RTGTLTVCTMVPMRSVPHRVV

SEQ ID NO: 1236175 - protein, 17 aa, Mycobacterium
RTKDMIVTGGFNVFPRE

SEQ ID NO: 1236176 - protein, 18 aa, Mycobacterium
RTPSGFDIEYGWDAVTVD

SEQ ID NO: 1236177 - protein, 18 aa, Mycobacterium
RTRLSRTRWPEAECVPDW

SEQ ID NO: 1236178 - protein, 28 aa, Mycobacterium
RTSGEQRLSGFLLWQSAYSEMWFTEAYW

SEQ ID NO: 1236179 - protein, 20 aa, Mycobacterium
RVISDVWLSNLLAWLTRRAS

SEQ ID NO: 1236180 - protein, 17 aa, Mycobacterium
RVQPVIVGLQLALTELW

SEQ ID NO: 1236181 - protein, 18 aa, Mycobacterium
RVTLELGGKSANIVFDDC

SEQ ID NO: 1236182 - protein, 25 aa, Mycobacterium
RVVEIGGPFSLELCGGTHVRSSAQI

SEQ ID NO: 1236183 - protein, 27 aa, Mycobacterium
SAKELYEIRTLFGVMFQDGALFGSMSL

SEQ ID NO: 1236184 - protein, 24 aa, Mycobacterium
SALQNAASIAALFLTTEAVVADKP

SEQ ID NO: 1236185 - protein, 20 aa, Mycobacterium
SAQMAATFARHAPGRILLNV

SEQ ID NO: 1236186 - protein, 19 aa, Mycobacterium
SCVPLLKQLLEAEGVEQSK

SEQ ID NO: 1236187 - protein, 21 aa, Mycobacterium
SDISKAVGLGFTQGGGENNYE

SEQ ID NO: 1236188 - protein, 17 aa, Mycobacterium
SDQAKWITGQIFNVDGG

SEQ ID NO: 1236189 - protein, 19 aa, Mycobacterium
SDTAEFGGYLSGPRVIDAD

SEQ ID NO: 1236190 - protein, 21 aa, Mycobacterium
SEPRTGMSMGEHAAVTAKEMG

SEQ ID NO: 1236191 - protein, 32 aa, Mycobacterium
SFIPACGRCTECARGRSNLCVYGAAIVAGPQL

SEQ ID NO: 1236192 - protein, 25 aa, Mycobacterium
SFLPACGRCRFCSTGHQNLCDLGAM

SEQ ID NO: 1236193 - protein, 19 aa, Mycobacterium
SFTLPRNGIVGVIGPNGVG

SEQ ID NO: 1236194 - protein, 26 aa, Mycobacterium
SGDPYRLAGELGMPPWRVQKAQKQAR

SEQ ID NO: 1236195 - protein, 18 aa, Mycobacterium
SGGIRFADTQGYAYSRRD

SEQ ID NO: 1236196 - protein, 33 aa, Mycobacterium; identical to SEQ ID NO: 731204

SEQ ID NO: 1236197 - protein, 21 aa, Mycobacterium
SGINCDLCVVVARTDPEAGHK

SEQ ID NO: 1236198 - protein, 17 aa, Mycobacterium
SGLRHELFYGQKVVPGS

SEQ ID NO: 1236199 - protein, 20 aa, Mycobacterium
SGSSDYLAGRAFSFISAIDS

SEQ ID NO: 1236200 - protein, 17 aa, Mycobacterium
SHYGRMCPIETPEGPNI

SEQ ID NO: 1236201 - protein, 18 aa, Mycobacterium
SKHWRFTHNFMHHKYTNI

SEQ ID NO: 1236202 - protein, 19 aa, Mycobacterium
SLATDSWLSAASFQETTRV

SEQ ID NO: 1236203 - protein, 21 aa, Mycobacterium
SLDDVVKFLLPPAAAKKPGKA

SEQ ID NO: 1236204 - protein, 17 aa, Mycobacterium
SLIKALEDLGIGRPSTY

SEQ ID NO: 1236205 - protein, 26 aa, Mycobacterium
SLISMFLDFYRPLVEAGMVYVTLPPL

SEQ ID NO: 1236206 - protein, 26 aa, Mycobacterium
SLMRSCTGWPSGTWIDPPRRTAPDGS

SEQ ID NO: 1236207 - protein, 25 aa, Mycobacterium
SLPLGVPRPRMVGVLRGFDPDVVHL

SEQ ID NO: 1236208 - protein, 24 aa, Mycobacterium
SLSRRAKRLIVFDVDSTLIQGEVI

SEQ ID NO: 1236209 - protein, 24 aa, Mycobacterium
SNKDGGYLAANWALYRAELDLVES

SEQ ID NO: 1236210 - protein, 18 aa, Mycobacterium
SNTLWPRTMVATAAVQNL

SEQ ID NO: 1236211 - protein, 21 aa, Mycobacterium
SPFAASLLFGYVGAFMYEGDS

SEQ ID NO: 1236212 - protein, 24 aa, Mycobacterium
SPIGKRNGWLSGLHATELLGAVQK

SEQ ID NO: 1236213 - protein, 19 aa, Mycobacterium
SPITASWDAATRTLTLSGV

SEQ ID NO: 1236214 - protein, 25 aa, Mycobacterium
SPTETEVWRWYLIDKNAPDDVRDWL

SEQ ID NO: 1236215 - protein, 17 aa, Mycobacterium
SPTRVRINVEVPFTELE

SEQ ID NO: 1236216 - protein, 18 aa, Mycobacterium
SRAPRWAVAYKYPPEEAQ

SEQ ID NO: 1236217 - protein, 24 aa, Mycobacterium
SRCTSLAGLVLKRPVLPKDLKTDR

SEQ ID NO: 1236218 - protein, 25 aa, Mycobacterium
SRFRECAARALLLPRRHPGKRSPLW

SEQ ID NO: 1236219 - protein, 25 aa, Mycobacterium
SRLPDLRCLMLTSFTSDEAMLDAIL

SEQ ID NO: 1236220 - protein, 21 aa, Mycobacterium
SRTGKMLPPKLGLLAYVADAY

SEQ ID NO: 1236221 - protein, 21 aa, Mycobacterium
SRTRLIRLFPTVFKGTHVNLD

SEQ ID NO: 1236222 - protein, 18 aa, Mycobacterium
SRTRWPEAECVPDWTQGI

SEQ ID NO: 1236223 - protein, 18 aa, Mycobacterium
SSGIGFGCATTLAEQGMA

SEQ ID NO: 1236224 - protein, 19 aa, Mycobacterium
SSRCLAAYVYAAAGEGEST

SEQ ID NO: 1236225 - protein, 24 aa, Mycobacterium
SSRGKGVLVSPTIYGNVMVGPTSE

SEQ ID NO: 1236226 - protein, 23 aa, Mycobacterium
STALYPPKRFLGAARNIEEGGSL

SEQ ID NO: 1236227 - protein, 25 aa, Mycobacterium
STLQRPSMRGVPFSFVRVDRAGNMS

SEQ ID NO: 1236228 - protein, 22 aa, Mycobacterium
STLRLIPNIVVLPYRNPFVVAK

SEQ ID NO: 1236229 - protein, 24 aa, Mycobacterium
SYIDYAMSVIVGRALPEVRDGLKP

SEQ ID NO: 1236230 - protein, 24 aa, Mycobacterium
TAAEPGALIGFLGPRVYEHLYGEP

SEQ ID NO: 1236231 - protein, 24 aa, Mycobacterium
TAAIAVEFARLYAVELEHYEKLEG

SEQ ID NO: 1236232 - protein, 18 aa, Mycobacterium
TAAKVLEDLGWYVADNLP

SEQ ID NO: 1236233 - protein, 18 aa, Mycobacterium
TAGDRPDVLVAMNPAALK

SEQ ID NO: 1236234 - protein, 25 aa, Mycobacterium
TAKGLEFPVVFVTGWEDGMFPHMRA

SEQ ID NO: 1236235 - protein, 19 aa, Mycobacterium
TALRLPRDASLTVDGQDVV

SEQ ID NO: 1236236 - protein, 18 aa, Mycobacterium
TCAGCGSNSWSWQRSSGR

SEQ ID NO: 1236237 - protein, 23 aa, Mycobacterium
TDDELKAFFTLLAVAANDTTRHA

SEQ ID NO: 1236238 - protein, 24 aa, Mycobacterium
TDDILVELGLDWDRIIELKTAGAV

SEQ ID NO: 1236239 - protein, 26 aa, Mycobacterium
TDGFPNCSGRIPFDTALISEVLAENG

SEQ ID NO: 1236240 - protein, 21 aa, Mycobacterium
TDYRALLEFFFQIHDPTTKNR

SEQ ID NO: 1236241 - protein, 25 aa, Mycobacterium
TEACGDCPRVVLGSPLAGESLDEVI

SEQ ID NO: 1236242 - protein, 22 aa, Mycobacterium
TEDARVGKSLVVQLKYGPSRER

SEQ ID NO: 1236243 - protein, 17 aa, Mycobacterium
TEPKARALRPYAEKLIT

SEQ ID NO: 1236244 - protein, 21 aa, Mycobacterium
TERHIRLIFQRAREKASEGTP

SEQ ID NO: 1236245 - protein, 17 aa, Mycobacterium
TEVKSFVQKICNEQLSH

SEQ ID NO: 1236246 - protein, 21 aa, Mycobacterium
TFMSIFAVMIQNHFFQHVDVG

SEQ ID NO: 1236247 - protein, 26 aa, Mycobacterium
TFSATEGGLSRGISFSVTDDAGVQSL

SEQ ID NO: 1236248 - protein, 23 aa, Mycobacterium
TGAKEILCIRVLGGSSRRYAGIG

SEQ ID NO: 1236249 - protein, 19 aa, Mycobacterium
TGELHAMMLDMRRTFDEMV

SEQ ID NO: 1236250 - protein, 18 aa, Mycobacterium
TGFEDGLFAAWRNDPSFV

SEQ ID NO: 1236251 - protein, 22 aa, Mycobacterium
TGGRIPREYIPSVDAGAQDAMQ

SEQ ID NO: 1236252 - protein, 24 aa, Mycobacterium
TGKAEKCTLCYPRIEVGLPTVCSE

SEQ ID NO: 1236253 - protein, 22 aa, Mycobacterium
TGWDYPSCEAIGLLKMDFLGLR

SEQ ID NO: 1236254 - protein, 27 aa, Mycobacterium
TGWLTPEARAHWDLIAAKYAAPGTNLP

SEQ ID NO: 1236255 - protein, 19 aa, Mycobacterium
THAADRGGLSLLLYDVTTL

SEQ ID NO: 1236256 - protein, 17 aa, Mycobacterium
TIIPDFIGHTFAVHDGR

SEQ ID NO: 1236257 - protein, 25 aa, Mycobacterium
TKRHWPLSRGFERFYGFMGGETDQW

SEQ ID NO: 1236258 - protein, 25 aa, Mycobacterium
TLEDRLRTRFEWGLITDVQPPELET

SEQ ID NO: 1236259 - protein, 23 aa, Mycobacterium
TLEVRLAALISFYRWHQAVSGVV

SEQ ID NO: 1236260 - protein, 26 aa, Mycobacterium
TLGPKGRNVVLEKKWGAPTITNDGVS

SEQ ID NO: 1236261 - protein, 25 aa, Mycobacterium
TLHSVKVIPGRGAWLEFDVDKRDTV

SEQ ID NO: 1236262 - protein, 25 aa, Mycobacterium
TLVRMAQPWSLRYPLVDGQGNFGSP

SEQ ID NO: 1236263 - protein, 20 aa, Mycobacterium
TPSTAFRLGEKVDDPLAMYL

SEQ ID NO: 1236264 - protein, 19 aa, Mycobacterium
TQIKIAIEKIFKVKVDSVN

SEQ ID NO: 1236265 - protein, 21 aa, Mycobacterium
TRETLGFSVLHVVRDNPTSLI

SEQ ID NO: 1236266 - protein, 21 aa, Mycobacterium
TRPGSALLFPTLCTPTADAPI

SEQ ID NO: 1236267 - protein, 21 aa, Mycobacterium
TTAEGFSWTPVHTMSGVDTSA

SEQ ID NO: 1236268 - protein, 25 aa, Mycobacterium
TTGRGPTPFRWSLTAGPAEPATVAA

SEQ ID NO: 1236269 - protein, 30 aa, Mycobacterium; identical to SEQ ID NO: 741306

SEQ ID NO: 1236270 - protein, 25 aa, Mycobacterium
TVEGRPKHYWSIYQKMIVKGRDFDD

SEQ ID NO: 1236271 - protein, 27 aa, Mycobacterium
TVRSYNCLKREGVHTVGELVARTESDL

SEQ ID NO: 1236272 - protein, 24 aa, Mycobacterium
TVSPQLYIALGISGAIQHRAGMQT

SEQ ID NO: 1236273 - protein, 32 aa, Mycobacterium; identical to SEQ ID NO: 85362

SEQ ID NO: 1236274 - protein, 24 aa, Mycobacterium
TVVLPAADVKIFLTASAEERARRR

SEQ ID NO: 1236275 - protein, 18 aa, Mycobacterium
TVVPLLPAQDFKRVGDGD

SEQ ID NO: 1236276 - protein, 19 aa, Mycobacterium
TWDLLRLTRMPTVQVDVGY

SEQ ID NO: 1236277 - protein, 24 aa, Mycobacterium
TYAVPRLLARNGLTLQDFDFYEIH

SEQ ID NO: 1236278 - protein, 22 aa, Mycobacterium
TYLYRDGSDFVFMDSEDYEQHP

SEQ ID NO: 1236279 - protein, 23 aa, Mycobacterium
VAASRFSSAFTFQYSKRPGTPAA

SEQ ID NO: 1236280 - protein, 18 aa, Mycobacterium
VAAVGPLVEALAEHAARL

SEQ ID NO: 1236281 - protein, 27 aa, Mycobacterium
VAIFRARPSPFYVMDEVEAALDDVNLR

SEQ ID NO: 1236282 - protein, 18 aa, Mycobacterium
VALLPKERLEVLFEEVAE

SEQ ID NO: 1236283 - protein, 26 aa, Mycobacterium
VAQMGKDGWLTLSWPKEFGGQARPPM

SEQ ID NO: 1236284 - protein, 17 aa, Mycobacterium
VATFVVFLASDESRYAT

SEQ ID NO: 1236285 - protein, 17 aa, Mycobacterium
VATRAAFGQVLNDVAPK

SEQ ID NO: 1236286 - protein, 18 aa, Mycobacterium
VAVTNCLNFGSPEDPGVM

SEQ ID NO: 1236287 - protein, 17 aa, Mycobacterium
VCELTWQLKGQATGRQV

SEQ ID NO: 1236288 - protein, 19 aa, Mycobacterium
VCEPFLVRAGMIARTPRGR

SEQ ID NO: 1236289 - protein, 25 aa, Mycobacterium
VDAVKLRLGIGYVIQSAGLMPHLRV

SEQ ID NO: 1236290 - protein, 28 aa, Mycobacterium
VDDPLAMYLFDLCTLPLNLAGHCGMSVP

SEQ ID NO: 1236291 - protein, 28 aa, Mycobacterium
VDELLSYLRPRAVVFHRSLGAKFADVLP

SEQ ID NO: 1236292 - protein, 27 aa, Mycobacterium
VDFWATWCGPCKMVAPVLEEIASEKAG

SEQ ID NO: 1236293 - protein, 25 aa, Mycobacterium
VDIGRGRNGVLYAGEVNWEAAGLGG

SEQ ID NO: 1236294 - protein, 25 aa, Mycobacterium
VDLSRLAEDIILWSTTEFGYVTLHD

SEQ ID NO: 1236295 - protein, 17 aa, Mycobacterium
VDPLALTAGDLVVHDQH

SEQ ID NO: 1236296 - protein, 20 aa, Mycobacterium
VDTKAGYAFERIPKAEVEDL

SEQ ID NO: 1236297 - protein, 18 aa, Mycobacterium
VEAIPREHVIAAVDRHKT

SEQ ID NO: 1236298 - protein, 19 aa, Mycobacterium
VEAYVGLDSFRHLAKERAL

SEQ ID NO: 1236299 - protein, 20 aa, Mycobacterium
VEFSTWTPHWFGVVDGPVEA

SEQ ID NO: 1236300 - protein, 21 aa, Mycobacterium
VELHRHGVFWGDCSLANTLFS

SEQ ID NO: 1236301 - protein, 27 aa, Mycobacterium
VEMGLARLWQSWGFEPDVVLGHSVGQY

SEQ ID NO: 1236302 - protein, 25 aa, Mycobacterium
VERRYRAWIRWNAAIMVHRAQRPGV

SEQ ID NO: 1236303 - protein, 21 aa, Mycobacterium
VFHSARWDYDYTGGDADGGLH

SEQ ID NO: 1236304 - protein, 23 aa, Mycobacterium
VFQRPNPFPTMSIRDNVVAGLKL

SEQ ID NO: 1236305 - protein, 20 aa, Mycobacterium
VGFKGSRKSTPFAAQLAAEN

SEQ ID NO: 1236306 - protein, 21 aa, Mycobacterium
VGRRLAEPGPYSMLEVLAPTM

SEQ ID NO: 1236307 - protein, 26 aa, Mycobacterium
VGTRPFGPICEFVRATGEIHLNSTWD

SEQ ID NO: 1236308 - protein, 17 aa, Mycobacterium
VHGTVWAVGERECSIQR

SEQ ID NO: 1236309 - protein, 25 aa, Mycobacterium
VICSFPRQADSYVFDALYRAGKVDL

SEQ ID NO: 1236310 - protein, 23 aa, Mycobacterium
VIDLGDSILLPGLMDMEVNLLMG

SEQ ID NO: 1236311 - protein, 21 aa, Mycobacterium
VIDLLLKRAADLGVQIRYETG

SEQ ID NO: 1236312 - protein, 20 aa, Mycobacterium
VIVRQMLRRVTIIDSGATEF

SEQ ID NO: 1236313 - protein, 17 aa, Mycobacterium
VKDLVIIDGRNHYPQDL

SEQ ID NO: 1236314 - protein, 17 aa, Mycobacterium
VKIAKNWQRDPKQLGRL

SEQ ID NO: 1236315 - protein, 19 aa, Mycobacterium
VKIHGYCVAGGTDIALHAD

SEQ ID NO: 1236316 - protein, 17 aa, Mycobacterium
VKLGCWGPVVKCNVPKR

SEQ ID NO: 1236317 - protein, 25 aa, Mycobacterium
VLHLLYSRFWHKVLYDLGHVSSREP

SEQ ID NO: 1236318 - protein, 24 aa, Mycobacterium
VLPELKGKLDGYALRVPIPTGSCT

SEQ ID NO: 1236319 - protein, 20 aa, Mycobacterium
VLVKASAGGGGRGMRVVRDL

SEQ ID NO: 1236320 - protein, 25 aa, Mycobacterium
VMDNLKFLIDNGIHAVVGTTGFTDE

SEQ ID NO: 1236321 - protein, 23 aa, Mycobacterium
VMYATGISWPLADAGLSHVERPV

SEQ ID NO: 1236322 - protein, 18 aa, Mycobacterium
VMYFKDFNSGAMIQNVVD

SEQ ID NO: 1236323 - protein, 24 aa, Mycobacterium
VNARYRMEQGFTFELNLAGVSDEH

SEQ ID NO: 1236324 - protein, 25 aa, Mycobacterium
VNPTGKFVLGGPMGDAGLTGRKIIV

SEQ ID NO: 1236325 - protein, 17 aa, Mycobacterium
VNSVSMRGVVVIGEGEK

SEQ ID NO: 1236326 - protein, 17 aa, Mycobacterium
VPAAALLADRILEHVDF

SEQ ID NO: 1236327 - protein, 26 aa, Mycobacterium
VPEDLAFAESRIRPSTIAAEDLLHDI

SEQ ID NO: 1236328 - protein, 23 aa, Mycobacterium
VPLPTEKNVYCVIRSPHKYKDSR

SEQ ID NO: 1236329 - protein, 22 aa, Mycobacterium
VPRTKRGVISYAARDIGERLDA

SEQ ID NO: 1236330 - protein, 20 aa, Mycobacterium
VPVSGLLALTARTLRQSEFV

SEQ ID NO: 1236331 - protein, 17 aa, Mycobacterium
VQPEVAAVGPLVEALAE

SEQ ID NO: 1236332 - protein, 18 aa, Mycobacterium
VRDGDILVGKVTPKGETE

SEQ ID NO: 1236333 - protein, 19 aa, Mycobacterium
VRDGLKPVHRRVLYAMFDS

SEQ ID NO: 1236334 - protein, 17 aa, Mycobacterium
VRENCDAVVSIPMAGPT

SEQ ID NO: 1236335 - protein, 17 aa, Mycobacterium
VRFPELKLCMIHGADPW

SEQ ID NO: 1236336 - protein, 17 aa, Mycobacterium
VRLLNMVPYFQANPRIT

SEQ ID NO: 1236337 - protein, 30 aa, Mycobacterium
VRPDRSVTLALRWLVSFSKARREKTMVERL

SEQ ID NO: 1236338 - protein, 18 aa, Mycobacterium
VRVHSLHDPARWKYVHLG

SEQ ID NO: 1236339 - protein, 18 aa, Mycobacterium
VRWIETQDLLFIEEAAGG

SEQ ID NO: 1236340 - protein, 25 aa, Mycobacterium
VRWNCKAGKCGSCSAEINGRPRLLC

SEQ ID NO: 1236341 - protein, 20 aa, Mycobacterium
VSAKGEFLGGAIAPGVQVSS

SEQ ID NO: 1236342 - protein, 19 aa, Mycobacterium
VSIPVLRKDFIVRPYQIHE

SEQ ID NO: 1236343 - protein, 23 aa, Mycobacterium
VSKAGGFGVLGAVGFTPEQLEIE

SEQ ID NO: 1236344 - protein, 19 aa, Mycobacterium
VSLIGAGMRSHPGVTATFC

SEQ ID NO: 1236345 - protein, 23 aa, Mycobacterium
VVLGRLAVEAAKLLRGKHKPTFT

SEQ ID NO: 1236346 - protein, 25 aa, Mycobacterium
VVRAVRRWTQFYAHESCGKCTPCRE

SEQ ID NO: 1236347 - protein, 17 aa, Mycobacterium
VYFPSLSGQTFVYKGML

SEQ ID NO: 1236348 - protein, 19 aa, Mycobacterium
VYRAPTLMAGYWNNPKATA

SEQ ID NO: 1236349 - protein, 17 aa, Mycobacterium
WAGEVLLREAHDLCGLP

SEQ ID NO: 1236350 - protein, 17 aa, Mycobacterium
WATKDVVGAHRFLQRVW

SEQ ID NO: 1236351 - protein, 17 aa, Mycobacterium
WEGVVSVFRDYGYRRLR

SEQ ID NO: 1236352 - protein, 26 aa, Mycobacterium
WEVQGRGELALAVLVEQMRREGFELT

SEQ ID NO: 1236353 - protein, 18 aa, Mycobacterium
WGEAVTAVVVLRPDADSS

SEQ ID NO: 1236354 - protein, 19 aa, Mycobacterium
WKAGEPVSLSPTEFTLLRY

SEQ ID NO: 1236355 - protein, 23 aa, Mycobacterium
WKKGLRHSVYFTHGIRNAVDNGH

SEQ ID NO: 1236356 - protein, 17 aa, Mycobacterium
WNAAIMVHRAQRPGVGV

SEQ ID NO: 1236357 - protein, 21 aa, Mycobacterium
WPKAHIASAMGVSRKCVHTWI

SEQ ID NO: 1236358 - protein, 17 aa, Mycobacterium
WQHGVFIGATLGSEQTA

SEQ ID NO: 1236359 - protein, 19 aa, Mycobacterium
WRAHGRGCAPDRKRLRGNG

SEQ ID NO: 1236360 - protein, 23 aa, Mycobacterium
WRKRYKSLCLHDPVWYDHLPYLP

SEQ ID NO: 1236361 - protein, 25 aa, Mycobacterium
WSSDIRAGAGLVLAGLVADGDTEVH

SEQ ID NO: 1236362 - protein, 23 aa, Mycobacterium
WTSLAHWAQWCFVVARTEKGSKR

SEQ ID NO: 1236363 - protein, 18 aa, Mycobacterium
WTSLIAYADYVWLAVRTN

SEQ ID NO: 1236364 - protein, 19 aa, Mycobacterium
WTTPVKEFMRTATADTEVR

SEQ ID NO: 1236365 - protein, 19 aa, Mycobacterium
WTYSQAKPRDVIWNQNFGH

SEQ ID NO: 1236366 - protein, 24 aa, Mycobacterium
WVAREGRIPLGYFDDAEATRRTFP

SEQ ID NO: 1236367 - protein, 18 aa, Mycobacterium
WVLFPNYFMTVRAGECHV

SEQ ID NO: 1236368 - protein, 21 aa, Mycobacterium
YATSLAQWWSFLEQRGQSDAW

SEQ ID NO: 1236369 - protein, 18 aa, Mycobacterium
YDPLMSPLVWDLAHIGQQ

SEQ ID NO: 1236370 - protein, 17 aa, Mycobacterium
YDRAIGYEAAYAGTSFA

SEQ ID NO: 1236371 - protein, 24 aa, Mycobacterium
YDVKRAETGIIYIDEVDKIARKSE

SEQ ID NO: 1236372 - protein, 17 aa, Mycobacterium
YFATAKRKFIIADTPGH

SEQ ID NO: 1236373 - protein, 32 aa, Mycobacterium
YHMDLGLEIFDWLEVVDFGDAYCPHGQTEVSH

SEQ ID NO: 1236374 - protein, 24 aa, Mycobacterium
YNWIKEFDPRFNIRYRDDKSYPVL

SEQ ID NO: 1236375 - protein, 26 aa, Mycobacterium
YPSGEGLHVGHPLGYIATDVYARYYR

SEQ ID NO: 1236376 - protein, 19 aa, Mycobacterium
YPYYKRLRDEAPLYRNEEL

SEQ ID NO: 1236377 - protein, 26 aa, Mycobacterium
YQDKALEGFTMFALNQGEVCTCPSRS

SEQ ID NO: 1236378 - protein, 17 aa, Mycobacterium
YREGKLLLDETVTHEYK

SEQ ID NO: 1236379 - protein, 17 aa, Mycobacterium
YRRWAEFTDNLSWPQLI

SEQ ID NO: 1236380 - protein, 24 aa, Mycobacterium
YSGPTAALTDVWRALRASMRSVLE

SEQ ID NO: 1236381 - protein, 28 aa, Mycobacterium
YTKGYKFSTYATWWIRQAITRAMADQAR

SEQ ID NO: 1236382 - protein, 22 aa, Mycobacterium
YTLRLPLDVLVVASANPEDYTN

SEQ ID NO: 1236383 - protein, 17 aa, Mycobacterium
YTYCQGVVLGLETELAV

SEQ ID NO: 1236384 - protein, 21 aa, Mycobacterium
YVEGRAAMFAGLADSTLSRDD

SEQ ID NO: 1236385 - protein, 24 aa, Mycobacterium
YVINPRMVRGLDYYTKTTFEFVHD

SEQ ID NO: 1236386 - protein, 19 aa, Mycobacterium
YVNQPWTIRQYAGFSTAAE

SEQ ID NO: 1236387 - protein, 18 aa, Mycobacterium
YVSMNMVRKNGLRRGDAV

SEQ ID NO: 1236388 - protein, 24 aa, Mycobacterium
YYADFEGVMAFLQRRMEQTDSEQM

SEQ ID NO: 1236389 - protein, 19 aa, Mycobacterium
YYMHFSDGSLIVGIGSPPR

SEQ ID NO: 1236390 - protein, 27 aa, Mycobacterium
AAAAAALSCARMGRFLEVDALAERAAA

SEQ ID NO: 1236391 - protein, 24 aa, Mycobacterium
AAAAEAGVDCFVAGSAVYSAQDPA

SEQ ID NO: 1236392 - protein, 24 aa, Mycobacterium
AAAAEAYRGLGRVLREDIAPYARE

SEQ ID NO: 1236393 - protein, 17 aa, Mycobacterium
AAAALALHRMIERNRSG

SEQ ID NO: 1236394 - protein, 26 aa, Mycobacterium
AAAALKARIFDPLGLRNTMLPAAADA

SEQ ID NO: 1236395 - protein, 28 aa, Mycobacterium
AAAAPGLRFVGFLSRPGLISYVAKQSQH

SEQ ID NO: 1236396 - protein, 27 aa, Mycobacterium
AAAAREFKPLILVGGYSAYPRRVNFAK

SEQ ID NO: 1236397 - protein, 24 aa, Mycobacterium
AAAARVALDIATRYALQRKQFSAP

SEQ ID NO: 1236398 - protein, 25 aa, Mycobacterium
AAADLPFRLVESLVNMWSTPPGPQR

SEQ ID NO: 1236399 - protein, 24 aa, Mycobacterium
AAADRFPEFNGFWRDDAFVGADGV

SEQ ID NO: 1236400 - protein, 17 aa, Mycobacterium
AAADRILGRLVKVTPSS

SEQ ID NO: 1236401 - protein, 31 aa, Mycobacterium
AAAEAGCEWAFVCAVDMPYLTMDFVDDLAVP

SEQ ID NO: 1236402 - protein, 36 aa, Mycobacterium
AAAELRSATPLADRGCWLHMLALYRAGRVTDALDVY

SEQ ID NO: 1236403 - protein, 17 aa, Mycobacterium
AAAFYGHVLGWTYDPAT

SEQ ID NO: 1236404 - protein, 17 aa, Mycobacterium
AAAGCGRIVLNGRSAPN

SEQ ID NO: 1236405 - protein, 28 aa, Mycobacterium
AAAGKPRMAAAVVRMKLTMSRWSDERLL

SEQ ID NO: 1236406 - protein, 19 aa, Mycobacterium
AAAGLGCRFATAYRALSAR

SEQ ID NO: 1236407 - protein, 18 aa, Mycobacterium
AAAGTPLLGVCLGHQAIG

SEQ ID NO: 1236408 - protein, 25 aa, Mycobacterium
AAAHLVHPGDLVILIAYGTMEDAEA

SEQ ID NO: 1236409 - protein, 19 aa, Mycobacterium
AAAIKRLQAAEAEVARCAA

SEQ ID NO: 1236410 - protein, 23 aa, Mycobacterium
AAAKAAILASIAFHTRVTADDVY

SEQ ID NO: 1236411 - protein, 17 aa, Mycobacterium
AAAKVFGGNGFGYVNHW

SEQ ID NO: 1236412 - protein, 25 aa, Mycobacterium
AAALALGAAGAWTGSQWLMVEEAEN

SEQ ID NO: 1236413 - protein, 20 aa, Mycobacterium
AAALELLHAAILVHDDVIDA

SEQ ID NO: 1236414 - protein, 18 aa, Mycobacterium
AAALWSLGIGQPHSVSAI

SEQ ID NO: 1236415 - protein, 18 aa, Mycobacterium
AAAMLGIAVDALAPAESA

SEQ ID NO: 1236416 - protein, 27 aa, Mycobacterium
AAANSWLDAFTHWRRAQGLPASAIAWG

SEQ ID NO: 1236417 - protein, 25 aa, Mycobacterium
AAANVLALKAGWNFGETTEAFATTY

SEQ ID NO: 1236418 - protein, 24 aa, Mycobacterium
AAAPVRVGFRLGPPGAGELGVHDG

SEQ ID NO: 1236419 - protein, 23 aa, Mycobacterium
AAAQGKFPLSFSIANVDQNGGVA

SEQ ID NO: 1236420 - protein, 22 aa, Mycobacterium
AAAQRELRWRAVRDDLEEQAAP

SEQ ID NO: 1236421 - protein, 23 aa, Mycobacterium
AAARAAHEAGVWRSMPPQQRADL

SEQ ID NO: 1236422 - protein, 17 aa, Mycobacterium
AAARAAYLAGFAGSSNL

SEQ ID NO: 1236423 - protein, 23 aa, Mycobacterium
AAARAFKAQALAAVNDIEAAFVG

SEQ ID NO: 1236424 - protein, 20 aa, Mycobacterium
AAARCEYALLRSFDARLGWG

SEQ ID NO: 1236425 - protein, 23 aa, Mycobacterium
AAARIGMSLGRPVMGRLFQRFLH

SEQ ID NO: 1236426 - protein, 24 aa, Mycobacterium
AAARKAVELALAWLTRGDLNIAAG

SEQ ID NO: 1236427 - protein, 28 aa, Mycobacterium
AAARLRLSHPLPLRVGDVGLLRDPGQHR

SEQ ID NO: 1236428 - protein, 17 aa, Mycobacterium
AAARPDISYEIVALDTV

SEQ ID NO: 1236429 - protein, 25 aa, Mycobacterium
AAATKPYGFMPFRPGPGVGGHCIPC

SEQ ID NO: 1236430 - protein, 21 aa, Mycobacterium
AAATRGAWRAAGVRDGVTGTL

SEQ ID NO: 1236431 - protein, 17 aa, Mycobacterium
AAAVAMGADGAWTGSVW

SEQ ID NO: 1236432 - protein, 24 aa, Mycobacterium
AAAVICARAGLSVRVIEGQPTPGG

SEQ ID NO: 1236433 - protein, 23 aa, Mycobacterium
AAAYDLKVATIFGGVSQNPQASA

SEQ ID NO: 1236434 - protein, 18 aa, Mycobacterium
AACGWSTDVDRFPDPGER

SEQ ID NO: 1236435 - protein, 24 aa, Mycobacterium
AACTTRLRLGVGVLVSSLHDPLQL

SEQ ID NO: 1236436 - protein, 32 aa, Mycobacterium
AADALALAICHCWRAPMIARMAAAEAMAAEAR

SEQ ID NO: 1236437 - protein, 18 aa, Mycobacterium
AADALRGTVFLVDSADLP

SEQ ID NO: 1236438 - protein, 19 aa, Mycobacterium
AADALRWGLINDVVPDGTV

SEQ ID NO: 1236439 - protein, 29 aa, Mycobacterium
AADGGPLTWPLHISLLLAKEFAMTGTRIP

SEQ ID NO: 1236440 - protein, 18 aa, Mycobacterium
AADGYRFGGKTHDKTADV

SEQ ID NO: 1236441 - protein, 23 aa, Mycobacterium
AADLGEQCAFGLALIAPKLPPFD

SEQ ID NO: 1236442 - protein, 23 aa, Mycobacterium
AADLPEKVREAALREAGKLERAS

SEQ ID NO: 1236443 - protein, 27 aa, Mycobacterium
AADLPRRDVWTWADERAAMPIDPEFGP

SEQ ID NO: 1236444 - protein, 25 aa, Mycobacterium
AADMSLSVSCPRDLVANAPVPLSEG

SEQ ID NO: 1236445 - protein, 30 aa, Mycobacterium
AADMYVSLELARSMTFYAAMSIADGNFDPA

SEQ ID NO: 1236446 - protein, 22 aa, Mycobacterium
AADPRPATLADHDWLINERGVA

SEQ ID NO: 1236447 - protein, 22 aa, Mycobacterium
AADRDWPDWSEWVHTAVQAQRF

SEQ ID NO: 1236448 - protein, 18 aa, Mycobacterium
AADRVLMDAHLIIAGNER

SEQ ID NO: 1236449 - protein, 25 aa, Mycobacterium
AADRWPRAGALGPLIRDPDGSVYPS

SEQ ID NO: 1236450 - protein, 21 aa, Mycobacterium
AADTGCGWIRAAQASRAHHAW

SEQ ID NO: 1236451 - protein, 25 aa, Mycobacterium
AADTIQVLGGIGFTWEHQAHLYFKR

SEQ ID NO: 1236452 - protein, 27 aa, Mycobacterium
AADWAEMLMRMYIRWAEQHDYPVEVFD

SEQ ID NO: 1236453 - protein, 34 aa, Mycobacterium
AADYKKLLLAMLQRREAWQIIDFVNQLTDPSALA

SEQ ID NO: 1236454 - protein, 26 aa, Mycobacterium
AAEAAGVGWACLDMAVEYAKVREQFG

SEQ ID NO: 1236455 - protein, 19 aa, Mycobacterium
AAEALALVLTSHGLQRMTS

SEQ ID NO: 1236456 - protein, 23 aa, Mycobacterium
AAEAQGFASFWFPQVPGYLDAMT

SEQ ID NO: 1236457 - protein, 20 aa, Mycobacterium
AAECVVAYGVNRVTLAEIAR

SEQ ID NO: 1236458 - protein, 18 aa, Mycobacterium
AAEDFGFEAVLTPTGSHC

SEQ ID NO: 1236459 - protein, 18 aa, Mycobacterium
AAEESIVIRDALLARDAG

SEQ ID NO: 1236460 - protein, 21 aa, Mycobacterium
AAEFAHIFSSLGSRVTIVIRG

SEQ ID NO: 1236461 - protein, 17 aa, Mycobacterium
AAEFDRVAELVVDVLNN

SEQ ID NO: 1236462 - protein, 25 aa, Mycobacterium
AAEGLSALNMVSLRKAAAVSGSQLA

SEQ ID NO: 1236463 - protein, 21 aa, Mycobacterium
AAEGRACVLYHRYDGHYGLIT

SEQ ID NO: 1236464 - protein, 20 aa, Mycobacterium
AAEIARMALFLSTPAARHIT

SEQ ID NO: 1236465 - protein, 17 aa, Mycobacterium
AAELGMAAIYCREDVGG

SEQ ID NO: 1236466 - protein, 24 aa, Mycobacterium
AAELPMQMICILLGVPEDDRHWLF

SEQ ID NO: 1236467 - protein, 17 aa, Mycobacterium
AAELQSWGQSWIAACQT

SEQ ID NO: 1236468 - protein, 22 aa, Mycobacterium
AAERALALMIDRVQKRVAFGKP

SEQ ID NO: 1236469 - protein, 18 aa, Mycobacterium
AAESFGFTGALIPTGAWC

SEQ ID NO: 1236470 - protein, 39 aa, Mycobacterium
AAEVAEMWPFADLEPFAAFGWEPRGGYGDAYRTAQAFAA

SEQ ID NO: 1236471 - protein, 22 aa, Mycobacterium
AAEVPGLYCGGGVAGAHAVAVL

SEQ ID NO: 1236472 - protein, 26 aa, Mycobacterium
AAEWTADIRYRWAVCEPTTGELLAEV

SEQ ID NO: 1236473 - protein, 18 aa, Mycobacterium
AAFARHLHRPDIPDVDLF

SEQ ID NO: 1236474 - protein, 17 aa, Mycobacterium
AAFDYCLHGRGGAAPSI

SEQ ID NO: 1236475 - protein, 23 aa, Mycobacterium
AAFGRDIGYRIAHHPDLTAPPPV

SEQ ID NO: 1236476 - protein, 22 aa, Mycobacterium
AAFHPGPVASNFSAEVDNPMFG

SEQ ID NO: 1236477 - protein, 19 aa, Mycobacterium
AAFQRGASMAATFAGDAAI

SEQ ID NO: 1236478 - protein, 23 aa, Mycobacterium
AAFRPNGNLLLALRFPTTAAGEP

SEQ ID NO: 1236479 - protein, 28 aa, Mycobacterium
AAGAHRSAWTLLRRRHGVSPAIEEALET

SEQ ID NO: 1236480 - protein, 18 aa, Mycobacterium
AAGARSWGAMLDTYVPGR

SEQ ID NO: 1236481 - protein, 26 aa, Mycobacterium
AAGAVSFRFGDRTQINGVPRDEAVEA

SEQ ID NO: 1236482 - protein, 17 aa, Mycobacterium
AAGEIRPAWRELAQCVV

SEQ ID NO: 1236483 - protein, 17 aa, Mycobacterium
AAGFGPEVKRRIMIGTY

SEQ ID NO: 1236484 - protein, 23 aa, Mycobacterium
AAGGDARRGFGIDVGGSGVKGGV

SEQ ID NO: 1236485 - protein, 22 aa, Mycobacterium
AAGGGFRPLVAVVLNGPPEGVC

SEQ ID NO: 1236486 - protein, 21 aa, Mycobacterium
AAGIARRTLFRYYSSKSAIPW

SEQ ID NO: 1236487 - protein, 26 aa, Mycobacterium
AAGIGRKTAIAFARKGYTVGAFDIDE

SEQ ID NO: 1236488 - protein, 17 aa, Mycobacterium
AAGISWLTGYPDRNPNE

SEQ ID NO: 1236489 - protein, 20 aa, Mycobacterium
AAGITHILTMPWMFYTGADA

SEQ ID NO: 1236490 - protein, 23 aa, Mycobacterium
AAGLDIRPTIAITKAHVILPEIT

SEQ ID NO: 1236491 - protein, 25 aa, Mycobacterium
AAGLECTASGPALRVSHSTTVCVTG

SEQ ID NO: 1236492 - protein, 23 aa, Mycobacterium
AAGLKMQPFMVHYTASKHAVTGM

SEQ ID NO: 1236493 - protein, 20 aa, Mycobacterium
AAGLPRRTEVALDAGASRRL

SEQ ID NO: 1236494 - protein, 24 aa, Mycobacterium
AAGLSRAHFSRMFTRTFGESPREY

SEQ ID NO: 1236495 - protein, 25 aa, Mycobacterium
AAGMPGRLKAVAALFPTVSRPPAEQ

SEQ ID NO: 1236496 - protein, 18 aa, Mycobacterium
AAGPRLGAVRIDSGDLGV

SEQ ID NO: 1236497 - protein, 18 aa, Mycobacterium
AAGPRVPVTLVHGSGDDV

SEQ ID NO: 1236498 - protein, 17 aa, Mycobacterium
AAGPSGPAFCAGAEVVG

SEQ ID NO: 1236499 - protein, 23 aa, Mycobacterium
AAGRRRALEVFSWESVAAQTVSV

SEQ ID NO: 1236500 - protein, 25 aa, Mycobacterium
AAGRSTAGLAAWGYASGISLGDGSF

SEQ ID NO: 1236501 - protein, 18 aa, Mycobacterium
AAGSRIAFDDVLGMCSGR

SEQ ID NO: 1236502 - protein, 18 aa, Mycobacterium
AAGSVGWDLPMSGKTGTT

SEQ ID NO: 1236503 - protein, 21 aa, Mycobacterium
AAGVGPWFVIRGLRQHGSYRG

SEQ ID NO: 1236504 - protein, 23 aa, Mycobacterium
AAGVKRYVVISSMGANTEAPDDA

SEQ ID NO: 1236505 - protein, 24 aa, Mycobacterium
AAGVPAGVYNLVFGDGPGVGVPLS

SEQ ID NO: 1236506 - protein, 23 aa, Mycobacterium
AAGVPRPSRRNSWYLDPDTNGYK

SEQ ID NO: 1236507 - protein, 17 aa, Mycobacterium
AAHARFIEVSAKINALL

SEQ ID NO: 1236508 - protein, 19 aa, Mycobacterium
AAHARIIARNVDRATVAKI

SEQ ID NO: 1236509 - protein, 23 aa, Mycobacterium
AAHARLRLSYNVDHDKISTIPHG

SEQ ID NO: 1236510 - protein, 17 aa, Mycobacterium
AAHLARRGAEYGVGTGD

SEQ ID NO: 1236511 - protein, 24 aa, Mycobacterium
AAHVRRAGAVIAEAHTLRLLNLRR

SEQ ID NO: 1236512 - protein, 19 aa, Mycobacterium
AAIAARARELGVVGGDIDA

SEQ ID NO: 1236513 - protein, 25 aa, Mycobacterium
AAIARPELLAELARQFGSQCIVLSV

SEQ ID NO: 1236514 - protein, 17 aa, Mycobacterium
AAIEVMARVGLAGLSMR

SEQ ID NO: 1236515 - protein, 17 aa, Mycobacterium
AAIIHYTQGLAYRLAAQ

SEQ ID NO: 1236516 - protein, 20 aa, Mycobacterium
AAIKADPDWCGGDYHDTGRV

SEQ ID NO: 1236517 - protein, 24 aa, Mycobacterium
AAIKSCPPGHVEVIANYTAFLQLN

SEQ ID NO: 1236518 - protein, 23 aa, Mycobacterium
AAILAGDLSLVWADDIVASVDLP

SEQ ID NO: 1236519 - protein, 19 aa, Mycobacterium
AAIMGCAVPTGFGSATNVA

SEQ ID NO: 1236520 - protein, 26 aa, Mycobacterium
AAIMRRLGFGAARTIGHREYAGGVQG

SEQ ID NO: 1236521 - protein, 23 aa, Mycobacterium
AAIPVLAAVPMRGGLPTAVPTDP

SEQ ID NO: 1236522 - protein, 23 aa, Mycobacterium
AAIRRRVIRSWLLAGGARGLTDT

SEQ ID NO: 1236523 - protein, 17 aa, Mycobacterium
AAITYLVERMITSGHLR

SEQ ID NO: 1236524 - protein, 24 aa, Mycobacterium
AAKAFLCTEVARWIDEEGLALDVA

SEQ ID NO: 1236525 - protein, 17 aa, Mycobacterium
AAKGLGVAEYRREMAEL

SEQ ID NO: 1236526 - protein, 28 aa, Mycobacterium
AAKGTFRLAFGIGDFRRDTGFGDNPATL

SEQ ID NO: 1236527 - protein, 20 aa, Mycobacterium
AAKLPFLEVYVSTPVEECEK

SEQ ID NO: 1236528 - protein, 21 aa, Mycobacterium
AAKRLGYPGPDPVARSLRTRR

SEQ ID NO: 1236529 - protein, 23 aa, Mycobacterium
AAKRTFDRLDIDGSCSTNDTVLL

SEQ ID NO: 1236530 - protein, 19 aa, Mycobacterium
AAKVAFRTGPWPNMQARSR

SEQ ID NO: 1236531 - protein, 18 aa, Mycobacterium
AALADARVTIPMAGSAES

SEQ ID NO: 1236532 - protein, 17 aa, Mycobacterium
AALAFGLNVLLNGLAAT

SEQ ID NO: 1236533 - protein, 27 aa, Mycobacterium
AALAMELGCDAVLLASAVTRAADPPAM

SEQ ID NO: 1236534 - protein, 25 aa, Mycobacterium
AALARFSASEAFTAVAAEAVQMHGG

SEQ ID NO: 1236535 - protein, 20 aa, Mycobacterium
AALARFTLQVGRPVGPMLAQ

SEQ ID NO: 1236536 - protein, 19 aa, Mycobacterium
AALARLAAAVAAELVDGGL

SEQ ID NO: 1236537 - protein, 19 aa, Mycobacterium
AALDELWPVLTPQTLLADL

SEQ ID NO: 1236538 - protein, 18 aa, Mycobacterium
AALDHFRTAMAACGWSTD

SEQ ID NO: 1236539 - protein, 21 aa, Mycobacterium
AALDHIMKLAADELGPSWVRV

SEQ ID NO: 1236540 - protein, 26 aa, Mycobacterium
AALDLCPRIRVNAIAPGSILTSALDI

SEQ ID NO: 1236541 - protein, 22 aa, Mycobacterium
AALDRFGPPAGEAAWVVKDDGL

SEQ ID NO: 1236542 - protein, 23 aa, Mycobacterium
AALEGFPSPAEFVAAFEAALEGV

SEQ ID NO: 1236543 - protein, 17 aa, Mycobacterium
AALGGPVPQTPPGTLGD

SEQ ID NO: 1236544 - protein, 26 aa, Mycobacterium
AALHARAALVIMPRFDLTEFLANIAD

SEQ ID NO: 1236545 - protein, 19 aa, Mycobacterium
AALHLHKPVVVHDLPAGGK

SEQ ID NO: 1236546 - protein, 19 aa, Mycobacterium
AALKLARKVTGREAIINFT

SEQ ID NO: 1236547 - protein, 18 aa, Mycobacterium
AALLEMFQYFTALTASRR

SEQ ID NO: 1236548 - protein, 18 aa, Mycobacterium
AALLRRAGINVAPQQVGA

SEQ ID NO: 1236549 - protein, 22 aa, Mycobacterium
AALPEVACTVWSNVVMTAALAA

SEQ ID NO: 1236550 - protein, 22 aa, Mycobacterium
AALQRRLGTTTVYVTHDQVEAM

SEQ ID NO: 1236551 - protein, 28 aa, Mycobacterium
AALRAAASFDLLHVFALLQDDVMDDSPL

SEQ ID NO: 1236552 - protein, 24 aa, Mycobacterium
AALRELSARLGLTARVAHVEGDDL

SEQ ID NO: 1236553 - protein, 34 aa, Mycobacterium
AALRGFQRFPAWMWRNVVVRDFAEWLQAHNRQRR

SEQ ID NO: 1236554 - protein, 17 aa, Mycobacterium
AALRRGVVSEVFATEDA

SEQ ID NO: 1236555 - protein, 17 aa, Mycobacterium
AALRSGLYITAINHHLT

SEQ ID NO: 1236556 - protein, 22 aa, Mycobacterium
AALRYVDALVWTPSAIPVEVAR

SEQ ID NO: 1236557 - protein, 17 aa, Mycobacterium
AALSARITALLKGICDN

SEQ ID NO: 1236558 - protein, 17 aa, Mycobacterium
AALSGALVSPVITAHPT

SEQ ID NO: 1236559 - protein, 20 aa, Mycobacterium
AALTRALARLFRGRGRSYMD

SEQ ID NO: 1236560 - protein, 23 aa, Mycobacterium
AALYRDATAWPGLAQAEQLHGKE

SEQ ID NO: 1236561 - protein, 18 aa, Mycobacterium
AAMCRRRSGLGLVAVHPA

SEQ ID NO: 1236562 - protein, 24 aa, Mycobacterium
AAMHRANEAAARWDAQVTDGKAVK

SEQ ID NO: 1236563 - protein, 23 aa, Mycobacterium
AAMKGAPPMQAWTDGINTNFVGT

SEQ ID NO: 1236564 - protein, 24 aa, Mycobacterium
AAMPSRPVQVIGFTSVPGAGDNLL

SEQ ID NO: 1236565 - protein, 26 aa, Mycobacterium
AAMSTPEMFGRVAIAQTMRDVSPDLM

SEQ ID NO: 1236566 - protein, 18 aa, Mycobacterium
AAMVAFWAKLPIAHLEAG

SEQ ID NO: 1236567 - protein, 24 aa, Mycobacterium
AANCRRSSWDRAVAANLPFNAECL

SEQ ID NO: 1236568 - protein, 26 aa, Mycobacterium
AANHLKAATVRLVLVGGGPGTGKTTL

SEQ ID NO: 1236569 - protein, 20 aa, Mycobacterium
AANLGWKLAAVVDGRAGDAL

SEQ ID NO: 1236570 - protein, 37 aa, Mycobacterium
AAPASDSAGFKWLAPYTGSAIAQHWMYDGKHVLIVFD

SEQ ID NO: 1236571 - protein, 23 aa, Mycobacterium
AAPEGRKLLRLEVRNAQTPIERK

SEQ ID NO: 1236572 - protein, 25 aa, Mycobacterium
AAPERVALAALHWDERFGDRHIALT

SEQ ID NO: 1236573 - protein, 21 aa, Mycobacterium
AAPGLACLPFVTAATSSERVS

SEQ ID NO: 1236574 - protein, 19 aa, Mycobacterium
AAPSGWRNLASGYQTKRYR

SEQ ID NO: 1236575 - protein, 23 aa, Mycobacterium
AAPWELLEGVWARARGRHRKAEI

SEQ ID NO: 1236576 - protein, 18 aa, Mycobacterium
AAQSIGLPVPGVVAHRVG

SEQ ID NO: 1236577 - protein, 25 aa, Mycobacterium
AAQVRRWLAEHLPAAQLVPAHSNAA

SEQ ID NO: 1236578 - protein, 17 aa, Mycobacterium
AARAAEVPIVFFQEVHR

SEQ ID NO: 1236579 - protein, 22 aa, Mycobacterium
AARAGEMLDLVAAYAADPLDPQ

SEQ ID NO: 1236580 - protein, 30 aa, Mycobacterium
AARARAVAFGDGWCPFPAPAVLAQTARTAA

SEQ ID NO: 1236581 - protein, 18 aa, Mycobacterium
AARARGITPAMAFAASYA

SEQ ID NO: 1236582 - protein, 19 aa, Mycobacterium
AARCGTRLPARRLTPQRLR

SEQ ID NO: 1236583 - protein, 23 aa, Mycobacterium
AARFADAVTAIWNGRTEIDRFNE

SEQ ID NO: 1236584 - protein, 23 aa, Mycobacterium
AARGGSIQRGWGLTGFAQDDDGV

SEQ ID NO: 1236585 - protein, 18 aa, Mycobacterium
AARGRGMITASLVRADGV

SEQ ID NO: 1236586 - protein, 24 aa, Mycobacterium
AARHFDHLNIIAGFDELPRKIEVV

SEQ ID NO: 1236587 - protein, 21 aa, Mycobacterium
AARIPEIVSLAVRKATTGAPG

SEQ ID NO: 1236588 - protein, 17 aa, Mycobacterium
AARLTGWRIDIRSDAAP

SEQ ID NO: 1236589 - protein, 20 aa, Mycobacterium
AARMWRLGWQKARDEHRGIP

SEQ ID NO: 1236590 - protein, 18 aa, Mycobacterium
AARRLVHVPMGRFAEPAE

SEQ ID NO: 1236591 - protein, 25 aa, Mycobacterium
AARRQLRYFWPRVVGDTSWQLLDSK

SEQ ID NO: 1236592 - protein, 24 aa, Mycobacterium
AARRRGAVDLERLEHTLTLRRDEE

SEQ ID NO: 1236593 - protein, 25 aa, Mycobacterium
AARTRLLEMRDFYAFLLDEMPAVLD

SEQ ID NO: 1236594 - protein, 22 aa, Mycobacterium
AARVASFGAIPPMRERGLDAVR

SEQ ID NO: 1236595 - protein, 17 aa, Mycobacterium
AARVVWLVANGYATPGQ

SEQ ID NO: 1236596 - protein, 17 aa, Mycobacterium
AARWADVEAGVVRAPAV

SEQ ID NO: 1236597 - protein, 19 aa, Mycobacterium
AASALFYRRGIHATGVDLL

SEQ ID NO: 1236598 - protein, 17 aa, Mycobacterium
AASALRLSDGMWDEAAA

SEQ ID NO: 1236599 - protein, 21 aa, Mycobacterium
AASEAIMRAGGTITHHHAVGA

SEQ ID NO: 1236600 - protein, 27 aa, Mycobacterium
AASGAWCVAADFSVGMLSAGRQRDVPK

SEQ ID NO: 1236601 - protein, 18 aa, Mycobacterium
AASIPFGVNVFAPNPVPI

SEQ ID NO: 1236602 - protein, 25 aa, Mycobacterium
AASRAFIPRSVWQRMGDDFLAATEA

SEQ ID NO: 1236603 - protein, 24 aa, Mycobacterium
AATAFYPRLRELFSQGKSITTFGP

SEQ ID NO: 1236604 - protein, 19 aa, Mycobacterium
AATAMGWMPFYPQFDRSSL

SEQ ID NO: 1236605 - protein, 27 aa, Mycobacterium
AATDGLDFLRLAVLDALLVLHADTTAV

SEQ ID NO: 1236606 - protein, 18 aa, Mycobacterium
AATGFPLVTGPPELATPV

SEQ ID NO: 1236607 - protein, 18 aa, Mycobacterium
AATGVELNEGYGLTEATC

SEQ ID NO: 1236608 - protein, 18 aa, Mycobacterium
AATLEFGDLLADGVVDPV

SEQ ID NO: 1236609 - protein, 25 aa, Mycobacterium
AATPSGRMHPYFAARAVVEACPPGT

SEQ ID NO: 1236610 - protein, 20 aa, Mycobacterium
AATQDPRAWAALPRAGAVVF

SEQ ID NO: 1236611 - protein, 23 aa, Mycobacterium
AATRYPPAGVRSFGPLRPSLGHH

SEQ ID NO: 1236612 - protein, 18 aa, Mycobacterium
AATTEVRASMSIAEVAEL

SEQ ID NO: 1236613 - protein, 26 aa, Mycobacterium
AATVNRFVERFSRFGLNAASVKPSYG

SEQ ID NO: 1236614 - protein, 19 aa, Mycobacterium
AAVAARRGVAVSLPSAGGG

SEQ ID NO: 1236615 - protein, 24 aa, Mycobacterium
AAVAEARALLAIDGVDGVNVSGLA

SEQ ID NO: 1236616 - protein, 21 aa, Mycobacterium
AAVAELHRLWQARRVLAVTFP

SEQ ID NO: 1236617 - protein, 19 aa, Mycobacterium
AAVAPRPAALPYLAVGDAR

SEQ ID NO: 1236618 - protein, 17 aa, Mycobacterium
AAVARAAARLQDIVERF

SEQ ID NO: 1236619 - protein, 19 aa, Mycobacterium
AAVAVLWGDHGTFCAGADL

SEQ ID NO: 1236620 - protein, 20 aa, Mycobacterium
AAVDPHSPWQAQVRQAIEAW

SEQ ID NO: 1236621 - protein, 19 aa, Mycobacterium
AAVEAMWADDVLVWHSGDR

SEQ ID NO: 1236622 - protein, 25 aa, Mycobacterium
AAVEDAWAALTWVAGHGAELSVDTN

SEQ ID NO: 1236623 - protein, 27 aa, Mycobacterium
AAVEILPVPGLPEFRPGDDLAAALAAA

SEQ ID NO: 1236624 - protein, 18 aa, Mycobacterium
AAVFPLLAGVVSPSDYPS

SEQ ID NO: 1236625 - protein, 21 aa, Mycobacterium
AAVGRPDIMVVVGGVIPPGDF

SEQ ID NO: 1236626 - protein, 26 aa, Mycobacterium
AAVIFDLPVGGWACRPTAEFGYAAAA

SEQ ID NO: 1236627 - protein, 24 aa, Mycobacterium
AAVKGTGVGGRIRKQDVLAAAEAD

SEQ ID NO: 1236628 - protein, 19 aa, Mycobacterium
AAVMPPPMNLGVRMVGKRV

SEQ ID NO: 1236629 - protein, 24 aa, Mycobacterium
AAVNGFCVGGGIGLVGNADVIVAS

SEQ ID NO: 1236630 - protein, 22 aa, Mycobacterium
AAVPPRVFAGTAMAQPSGSADD

SEQ ID NO: 1236631 - protein, 18 aa, Mycobacterium
AAVQALRPDAIMLRMPGF

SEQ ID NO: 1236632 - protein, 27 aa, Mycobacterium
AAVQRSVVLSDGWDIMDFVDQLQKLAA

SEQ ID NO: 1236633 - protein, 23 aa, Mycobacterium
AAVRSRWDLPILIGSTTADDGTR

SEQ ID NO: 1236634 - protein, 17 aa, Mycobacterium
AAVSLIVVDEAHCVSAW

SEQ ID NO: 1236635 - protein, 18 aa, Mycobacterium
AAVTEIRAALSALGLLDS

SEQ ID NO: 1236636 - protein, 19 aa, Mycobacterium
AAWAAGYRGLTAATDYNID

SEQ ID NO: 1236637 - protein, 18 aa, Mycobacterium
AAWERGWSPTDLHEVARR

SEQ ID NO: 1236638 - protein, 17 aa, Mycobacterium
AAYADRCDLGKIPCVSY

SEQ ID NO: 1236639 - protein, 17 aa, Mycobacterium
AAYEIAGIGPEDVDIAQ

SEQ ID NO: 1236640 - protein, 18 aa, Mycobacterium
AAYLRWERPPGLATPQCF

SEQ ID NO: 1236641 - protein, 21 aa, Mycobacterium
AAYPPEILLTGVIVNKDGQRF

SEQ ID NO: 1236642 - protein, 19 aa, Mycobacterium
ACADFARWRSRRTAGDAIL

SEQ ID NO: 1236643 - protein, 21 aa, Mycobacterium
ACAGVSRQAFYQHFDDRDDAI

SEQ ID NO: 1236644 - protein, 23 aa, Mycobacterium
ACALLGLDCVIYMGAVDTARQAL

SEQ ID NO: 1236645 - protein, 21 aa, Mycobacterium
ACDFTTASTWEFLPLDDDVFP

SEQ ID NO: 1236646 - protein, 25 aa, Mycobacterium
ACDIPSLLYSYSFEPNPGWTRTYSG

SEQ ID NO: 1236647 - protein, 19 aa, Mycobacterium
ACFATATGMAAVFTSLGAL

SEQ ID NO: 1236648 - protein, 18 aa, Mycobacterium
ACGIDCIEHGFLMDDEAI

SEQ ID NO: 1236649 - protein, 34 aa, Mycobacterium
ACLACVGCFACARCVACLGCARCSNCVGCVGCYN

SEQ ID NO: 1236650 - protein, 18 aa, Mycobacterium
ACLNVCPVYERTGGHAYG

SEQ ID NO: 1236651 - protein, 19 aa, Mycobacterium
ACPECAGLGVRKEVDPELV

SEQ ID NO: 1236652 - protein, 19 aa, Mycobacterium
ACRALRPAPGTVRATIGLQ

SEQ ID NO: 1236653 - protein, 19 aa, Mycobacterium
ACTPEALRAFGVREQGEAE

SEQ ID NO: 1236654 - protein, 21 aa, Mycobacterium
ACVACDVCVKVCPTDVFERGE

SEQ ID NO: 1236655 - protein, 19 aa, Mycobacterium
ACVLYDCVPSKTFIASTGV

SEQ ID NO: 1236656 - protein, 19 aa, Mycobacterium
ACVPEPLTFNSKMIGPVIA

SEQ ID NO: 1236657 - protein, 19 aa, Mycobacterium
ACVSACPVGAIAPEATLTD

SEQ ID NO: 1236658 - protein, 20 aa, Mycobacterium
ADAARRWAVSLDDGGLEFVD

SEQ ID NO: 1236659 - protein, 30 aa, Mycobacterium
ADAASNWYSEFARLAPLMEKDVHYEVDLRK

SEQ ID NO: 1236660 - protein, 33 aa, Mycobacterium
ADAAVPRWGKPEEMAELLAFCAGDRAGYLTGTD

SEQ ID NO: 1236661 - protein, 27 aa, Mycobacterium
ADAAWRAAFDHEEICVAIIKHANPCGI

SEQ ID NO: 1236662 - protein, 29 aa, Mycobacterium
ADADAAFARGVWWPALRATDRAAPQQQAL

SEQ ID NO: 1236663 - protein, 18 aa, Mycobacterium
ADAEFHFAVVRASHNAVL

SEQ ID NO: 1236664 - protein, 27 aa, Mycobacterium
ADAENLWWREVCQISAALMAQLPSGGS

SEQ ID NO: 1236665 - protein, 21 aa, Mycobacterium
ADAGRFLTTIKRRLEEGSFEA

SEQ ID NO: 1236666 - protein, 33 aa, Mycobacterium
ADAGRPAPRIVAGIPVCLCANSEIDAAKERANR

SEQ ID NO: 1236667 - protein, 18 aa, Mycobacterium
ADAIAMGFADHFVPHDQL

SEQ ID NO: 1236668 - protein, 23 aa, Mycobacterium
ADAKALVYAAEFAPQVAAVRDRL

SEQ ID NO: 1236669 - protein, 22 aa, Mycobacterium
ADAKRELVRIGVDRLTGSATGD

SEQ ID NO: 1236670 - protein, 17 aa, Mycobacterium
ADALLVRSATTVDAEVL

SEQ ID NO: 1236671 - protein, 23 aa, Mycobacterium
ADALRSGAVVLVFPGGDYDSYRP

SEQ ID NO: 1236672 - protein, 18 aa, Mycobacterium
ADALSEWIELAAVQAGRR

SEQ ID NO: 1236673 - protein, 19 aa, Mycobacterium
ADALVRTRLHGVRTNRDLL

SEQ ID NO: 1236674 - protein, 21 aa, Mycobacterium
ADAPLGYPAVHHLTSPLRKAA

SEQ ID NO: 1236675 - protein, 21 aa, Mycobacterium
ADAPLIAGVPIAFNTSPDRLS

SEQ ID NO: 1236676 - protein, 17 aa, Mycobacterium
ADARAFLEFAGRHHIEV

SEQ ID NO: 1236677 - protein, 21 aa, Mycobacterium
ADARAGVIGAVHAGRVGARDG

SEQ ID NO: 1236678 - protein, 25 aa, Mycobacterium
ADATRRWELRASQGRPICGVEIRLR

SEQ ID NO: 1236679 - protein, 26 aa, Mycobacterium
ADAVAIPYLIDWEALESAEWELLTSA

SEQ ID NO: 1236680 - protein, 19 aa, Mycobacterium
ADAVFFMFDPLRIKGIRDQ

SEQ ID NO: 1236681 - protein, 20 aa, Mycobacterium
ADAYRFLPTLGEMDLHLFSE

SEQ ID NO: 1236682 - protein, 17 aa, Mycobacterium
ADCALFVIAANEGVDEP

SEQ ID NO: 1236683 - protein, 26 aa, Mycobacterium
ADCQGGIEIVGRFLALLELYRARTVA

SEQ ID NO: 1236684 - protein, 26 aa, Mycobacterium
ADDAYAAFRWASEHAAELGVAADRIA

SEQ ID NO: 1236685 - protein, 24 aa, Mycobacterium
ADDDRVAGLIARVQISAAPAAPVQ

SEQ ID NO: 1236686 - protein, 17 aa, Mycobacterium
ADDGVIWVITPKTGKPG

SEQ ID NO: 1236687 - protein, 22 aa, Mycobacterium
ADDLLHPGLWVQFEGDPAPTDQ

SEQ ID NO: 1236688 - protein, 20 aa, Mycobacterium
ADDRVDWSSEGGATPSGPAD

SEQ ID NO: 1236689 - protein, 22 aa, Mycobacterium
ADDSRRLLLMIGKDMGLDTKKY

SEQ ID NO: 1236690 - protein, 22 aa, Mycobacterium
ADDVRLRRMAVFDVLINNADRK

SEQ ID NO: 1236691 - protein, 24 aa, Mycobacterium
ADEEIARVVPFIEWLRGTFPDVVI

SEQ ID NO: 1236692 - protein, 19 aa, Mycobacterium
ADEGIRCTWLETSHAFHSE

SEQ ID NO: 1236693 - protein, 27 aa, Mycobacterium
ADEKRLRRRISLVFQDPFSSLNSRMRV

SEQ ID NO: 1236694 - protein, 19 aa, Mycobacterium
ADELAALDFFAGCSTENLE

SEQ ID NO: 1236695 - protein, 17 aa, Mycobacterium
ADELRRAAEGYAEAAQS

SEQ ID NO: 1236696 - protein, 28 aa, Mycobacterium
ADELWRIADRLGVEIPRDRGYGHGKLIE

SEQ ID NO: 1236697 - protein, 19 aa, Mycobacterium
ADEPLEFTHRLSATIAAEL

SEQ ID NO: 1236698 - protein, 25 aa, Mycobacterium
ADEPRFMKLGGVPAPTGQPMSYDVD

SEQ ID NO: 1236699 - protein, 18 aa, Mycobacterium
ADERASRRFGAVQSEILH

SEQ ID NO: 1236700 - protein, 27 aa, Mycobacterium
ADESKMPAVFFVNWFRRGDDGRFLWPG

SEQ ID NO: 1236701 - protein, 20 aa, Mycobacterium
ADETYYCFGTAAGPHPFPLM

SEQ ID NO: 1236702 - protein, 26 aa, Mycobacterium
ADEWRLRLDSGDELTSRFLINATGVL

SEQ ID NO: 1236703 - protein, 17 aa, Mycobacterium
ADEYLAAIVELWTSDSP

SEQ ID NO: 1236704 - protein, 17 aa, Mycobacterium
ADFDGRIGTAVEEFVRW

SEQ ID NO: 1236705 - protein, 24 aa, Mycobacterium
ADFKQCPLLYRFRAIDRLPEPQST

SEQ ID NO: 1236706 - protein, 23 aa, Mycobacterium
ADFNSALPLAAMMACVMSGQSCI

SEQ ID NO: 1236707 - protein, 28 aa, Mycobacterium
ADGADCPDWVPGELWVGGRGIARGYRGR

SEQ ID NO: 1236708 - protein, 18 aa, Mycobacterium
ADGAFAAYARARASGVDP

SEQ ID NO: 1236709 - protein, 21 aa, Mycobacterium
ADGAIIRGGFKILPETVRQVL

SEQ ID NO: 1236710 - protein, 31 aa, Mycobacterium
ADGAINDWGVYLPRWETLNAARNWYPKVSQR

SEQ ID NO: 1236711 - protein, 25 aa, Mycobacterium
ADGERRPGWVGLPLAGVETRLVGDD

SEQ ID NO: 1236712 - protein, 19 aa, Mycobacterium
ADGFARQWCTVTGAARADT

SEQ ID NO: 1236713 - protein, 40 aa, Mycobacterium
ADGGFSAVRRRIWELEIGRAHTPWFHWGTTAMVAHTVERF

SEQ ID NO: 1236714 - protein, 20 aa, Mycobacterium
ADGGLVCWATSVLHPRVVRA

SEQ ID NO: 1236715 - protein, 19 aa, Mycobacterium
ADGGWLTHCTALAAPGGEP

SEQ ID NO: 1236716 - protein, 17 aa, Mycobacterium
ADGHFILIGCQRCPVTA

SEQ ID NO: 1236717 - protein, 27 aa, Mycobacterium
ADGHRCVSVRWGLWRSDSGEGIVGAAE

SEQ ID NO: 1236718 - protein, 19 aa, Mycobacterium
ADGLARAQATLGFTAAPPL

SEQ ID NO: 1236719 - protein, 19 aa, Mycobacterium
ADGLLVMPFGTKRFLHEST

SEQ ID NO: 1236720 - protein, 19 aa, Mycobacterium
ADGLPARLAAGVDVADIGC

SEQ ID NO: 1236721 - protein, 22 aa, Mycobacterium
ADGLPHRPGVYLFRGPGDEVLY

SEQ ID NO: 1236722 - protein, 18 aa, Mycobacterium
ADGLPVLFDSGIRSGSDI

SEQ ID NO: 1236723 - protein, 29 aa, Mycobacterium
ADGLSLAHLRRALPEAVFVSARTGQGLDR

SEQ ID NO: 1236724 - protein, 24 aa, Mycobacterium
ADGNLPPWLRLVVVDAANAVFTPR

SEQ ID NO: 1236725 - protein, 23 aa, Mycobacterium
ADGPAAREAYRWMRANQPVFRDR

SEQ ID NO: 1236726 - protein, 18 aa, Mycobacterium
ADGPMTMGALADSISVRQ

SEQ ID NO: 1236727 - protein, 22 aa, Mycobacterium
ADGQLPNMRAIVGFAAETGDAN

SEQ ID NO: 1236728 - protein, 24 aa, Mycobacterium
ADGRAVFTPGLAGLVLGEYRRIAQ

SEQ ID NO: 1236729 - protein, 17 aa, Mycobacterium
ADGRFTLGLGTGENLNE

SEQ ID NO: 1236730 - protein, 20 aa, Mycobacterium
ADGRGPVLLHALEGFSDAGH

SEQ ID NO: 1236731 - protein, 18 aa, Mycobacterium
ADGRIYADYVEWRSKNPS

SEQ ID NO: 1236732 - protein, 27 aa, Mycobacterium
ADGRPGRWRGWDWARGTPAGWHTVDPG

SEQ ID NO: 1236733 - protein, 19 aa, Mycobacterium
ADGSALVFAETLGRRLSKF

SEQ ID NO: 1236734 - protein, 21 aa, Mycobacterium
ADGTLRLYGRDALVVNTGGEK

SEQ ID NO: 1236735 - protein, 26 aa, Mycobacterium
ADGVLRTMPRVCGGRYGLSSKEFTPA

SEQ ID NO: 1236736 - protein, 18 aa, Mycobacterium
ADGVPILAEERVDMRREL

SEQ ID NO: 1236737 - protein, 23 aa, Mycobacterium
ADGVPNFDFKVCGPVAGEPVRTT

SEQ ID NO: 1236738 - protein, 24 aa, Mycobacterium
ADHCGDLILLREGRLLAHSTPEQL

SEQ ID NO: 1236739 - protein, 26 aa, Mycobacterium
ADHGGRGRFVWTPASNRFGWTAYLGH

SEQ ID NO: 1236740 - protein, 24 aa, Mycobacterium
ADHLLCGYAALAAAHRDLIPLLTG

SEQ ID NO: 1236741 - protein, 31 aa, Mycobacterium
ADHVFSRIDIPGWLARTGFQMLDPVKTAQAR

SEQ ID NO: 1236742 - protein, 18 aa, Mycobacterium
ADIAAALAVQSRNGEEFL

SEQ ID NO: 1236743 - protein, 26 aa, Mycobacterium
ADIAERRAEAWFDPAGLFMAFDDASG

SEQ ID NO: 1236744 - protein, 19 aa, Mycobacterium
ADIAMAFHRYRTVTGDDSL

SEQ ID NO: 1236745 - protein, 21 aa, Mycobacterium
ADIGARCELLRGARVWPGVKI

SEQ ID NO: 1236746 - protein, 21 aa, Mycobacterium
ADIGKRWSAMVSEYSAAGRMG

SEQ ID NO: 1236747 - protein, 20 aa, Mycobacterium
ADIPQFLAIAREAAERSTSL

SEQ ID NO: 1236748 - protein, 17 aa, Mycobacterium
ADIRICSSAATFGNAAI

SEQ ID NO: 1236749 - protein, 19 aa, Mycobacterium
ADITTPVWHGAHRVDTGRP

SEQ ID NO: 1236750 - protein, 18 aa, Mycobacterium
ADIVLPATLWAESDQVMV

SEQ ID NO: 1236751 - protein, 25 aa, Mycobacterium
ADKLGIPIVDHWWQTETGWAIAADP

SEQ ID NO: 1236752 - protein, 19 aa, Mycobacterium
ADKLRYDVTSWQRVTLLER

SEQ ID NO: 1236753 - protein, 17 aa, Mycobacterium
ADLAAAFEGVFEGFPTP

SEQ ID NO: 1236754 - protein, 17 aa, Mycobacterium
ADLAAGLAMRDVAVVSG

SEQ ID NO: 1236755 - protein, 24 aa, Mycobacterium
ADLAGACSMAAFTAAMHAGQGCAI

SEQ ID NO: 1236756 - protein, 22 aa, Mycobacterium
ADLAGVCFTAGTGRSHFEHRAA

SEQ ID NO: 1236757 - protein, 20 aa, Mycobacterium
ADLELEWRAAEPIHADCGFM

SEQ ID NO: 1236758 - protein, 22 aa, Mycobacterium
ADLGEGYGVWTLGDDDAMLDIV

SEQ ID NO: 1236759 - protein, 18 aa, Mycobacterium
ADLHMIGKDIIRFHTVYW

SEQ ID NO: 1236760 - protein, 17 aa, Mycobacterium
ADLIVLDYHEWREGLLR

SEQ ID NO: 1236761 - protein, 24 aa, Mycobacterium
ADLKSRLPRYGRRPQDQLIIPGVA

SEQ ID NO: 1236762 - protein, 20 aa, Mycobacterium
ADLKVGMVLEGVVTNVAAFG

SEQ ID NO: 1236763 - protein, 25 aa, Mycobacterium
ADLLAEPILRPGSWIGGDRDGNPNV

SEQ ID NO: 1236764 - protein, 19 aa, Mycobacterium
ADLLARCAQTLLGADAVLG

SEQ ID NO: 1236765 - protein, 22 aa, Mycobacterium
ADLPEITHFVAGLGTTGTLMGT

SEQ ID NO: 1236766 - protein, 17 aa, Mycobacterium
ADLPRSFIRCLQDQSMP

SEQ ID NO: 1236767 - protein, 23 aa, Mycobacterium
ADLRDARLRLAADDLVTRRSEFD

SEQ ID NO: 1236768 - protein, 20 aa, Mycobacterium
ADLVAGFALPIPSLVICELL

SEQ ID NO: 1236769 - protein, 20 aa, Mycobacterium
ADLVHLWAGTGYRHAAEKPT

SEQ ID NO: 1236770 - protein, 22 aa, Mycobacterium
ADMRAYLTGLLRGAGYEVTAVS

SEQ ID NO: 1236771 - protein, 23 aa, Mycobacterium
ADNWLTFGSALGMDALPFDTLRQ

SEQ ID NO: 1236772 - protein, 24 aa, Mycobacterium
ADPADAWIRAGFDVDPDDVCRIGG

SEQ ID NO: 1236773 - protein, 17 aa, Mycobacterium
ADPALSRVVGKHCESGD

SEQ ID NO: 1236774 - protein, 22 aa, Mycobacterium
ADPDILPPALKPFAAVPPLISD

SEQ ID NO: 1236775 - protein, 21 aa, Mycobacterium
ADPEMLRYFDSVGISLDSRLR

SEQ ID NO: 1236776 - protein, 22 aa, Mycobacterium
ADPETNYRIGFVPQGIGADLIA

SEQ ID NO: 1236777 - protein, 23 aa, Mycobacterium
ADPEVAAFVFELFAGTPAAGRGG

SEQ ID NO: 1236778 - protein, 21 aa, Mycobacterium
ADPHFDARSNVLGTINLCEAS

SEQ ID NO: 1236779 - protein, 18 aa, Mycobacterium
ADPLPYLLADARRVRTTA

SEQ ID NO: 1236780 - protein, 20 aa, Mycobacterium
ADPNGAWYTSGIRFGTPALT

SEQ ID NO: 1236781 - protein, 20 aa, Mycobacterium
ADPRYAMRLNRDAQRRLAQL

SEQ ID NO: 1236782 - protein, 20 aa, Mycobacterium
ADPSRGALMIHGHLDVVPAE

SEQ ID NO: 1236783 - protein, 21 aa, Mycobacterium
ADPVPIVSFTFGLPASDVIRA

SEQ ID NO: 1236784 - protein, 23 aa, Mycobacterium
ADPVRLRLFSAIASRAGGEACVC

SEQ ID NO: 1236785 - protein, 28 aa, Mycobacterium
ADQARTIRIPVHMVEVINKLGRIQRELL

SEQ ID NO: 1236786 - protein, 19 aa, Mycobacterium
ADQLAAWAGLAPVSRDSGK

SEQ ID NO: 1236787 - protein, 27 aa, Mycobacterium
ADQLREWKAEYPGAVVVSYVNTTAAVK

SEQ ID NO: 1236788 - protein, 24 aa, Mycobacterium
ADRAEMPPSVVLRDVTKSFSVARR

SEQ ID NO: 1236789 - protein, 24 aa, Mycobacterium
ADRAKAGVMAQLLPILDDLDRARS

SEQ ID NO: 1236790 - protein, 23 aa, Mycobacterium
ADRARRRYACFDHATADDGQAYG

SEQ ID NO: 1236791 - protein, 23 aa, Mycobacterium
ADREGVGIVDDWDGFGQRRTGTG

SEQ ID NO: 1236792 - protein, 22 aa, Mycobacterium
ADREPWAPLLHDIPFRVGKVVE

SEQ ID NO: 1236793 - protein, 17 aa, Mycobacterium
ADRFVSTAVDNYGGLDI

SEQ ID NO: 1236794 - protein, 24 aa, Mycobacterium
ADRPERPRRSAVLTEDLTSPRGKR

SEQ ID NO: 1236795 - protein, 20 aa, Mycobacterium
ADRVACCGWSYGGYLTQAAL

SEQ ID NO: 1236796 - protein, 17 aa, Mycobacterium
ADRVFGYAGDGVNTLLG

SEQ ID NO: 1236797 - protein, 24 aa, Mycobacterium
ADSAACREAFSALELLVVVDVAMT

SEQ ID NO: 1236798 - protein, 23 aa, Mycobacterium
ADSAAQWIGLVSFLMSAGTAARL

SEQ ID NO: 1236799 - protein, 22 aa, Mycobacterium
ADSFLPGALRGFVAANPEVVWH

SEQ ID NO: 1236800 - protein, 22 aa, Mycobacterium
ADSLGAAGLPFSSFSNHPLAGG

SEQ ID NO: 1236801 - protein, 31 aa, Mycobacterium
ADSLVIGGGMCFTFLASQGVSVGKSLVQPEM

SEQ ID NO: 1236802 - protein, 22 aa, Mycobacterium
ADSVATALEWARAARAAVVLVR

SEQ ID NO: 1236803 - protein, 18 aa, Mycobacterium
ADSYCARYRPAARRPQPV

SEQ ID NO: 1236804 - protein, 20 aa, Mycobacterium
ADTARRAVAVATTLAPLNAE

SEQ ID NO: 1236805 - protein, 20 aa, Mycobacterium
ADTELIAWVRAAAPHARRVV

SEQ ID NO: 1236806 - protein, 22 aa, Mycobacterium
ADTGMPVGLTFAGRAYSDTALL

SEQ ID NO: 1236807 - protein, 19 aa, Mycobacterium
ADTIEFCAAEVPRFNAISV

SEQ ID NO: 1236808 - protein, 18 aa, Mycobacterium
ADTMKRTFLELGGKSALI

SEQ ID NO: 1236809 - protein, 20 aa, Mycobacterium
ADTRYPIVHAFCTPLRKLGG

SEQ ID NO: 1236810 - protein, 21 aa, Mycobacterium
ADTTAHHWLVIGSADLAAPLT

SEQ ID NO: 1236811 - protein, 26 aa, Mycobacterium
ADVALKRAARCDGWMHGGGDPEELDG

SEQ ID NO: 1236812 - protein, 25 aa, Mycobacterium
ADVARLEAALARFAAVADAAHAETP

SEQ ID NO: 1236813 - protein, 17 aa, Mycobacterium
ADVDLGDIVSVHGQVIS

SEQ ID NO: 1236814 - protein, 19 aa, Mycobacterium
ADVDMRCLLIVGSSQTQWY

SEQ ID NO: 1236815 - protein, 20 aa, Mycobacterium
ADVFTLRDGKTVRVEVYGDT

SEQ ID NO: 1236816 - protein, 20 aa, Mycobacterium
ADVLVAYGRYPSFEGRLPKL

SEQ ID NO: 1236817 - protein, 17 aa, Mycobacterium
ADVNDSFVLPEDVRLVG

SEQ ID NO: 1236818 - protein, 24 aa, Mycobacterium
ADVPFFVQLCKTLGKPVNFVPVID

SEQ ID NO: 1236819 - protein, 18 aa, Mycobacterium
ADVPITASCACRLDVADD

SEQ ID NO: 1236820 - protein, 17 aa, Mycobacterium
ADVRVVRSLVGTMVTAL

SEQ ID NO: 1236821 - protein, 22 aa, Mycobacterium
ADVSLPVVRAFVARIKERAKGA

SEQ ID NO: 1236822 - protein, 22 aa, Mycobacterium
ADWFRPKAMRDLKVRVDELAKR

SEQ ID NO: 1236823 - protein, 17 aa, Mycobacterium
ADYLQRWRRAAESTLQN

SEQ ID NO: 1236824 - protein, 17 aa, Mycobacterium
ADYYLARGVTWVQDAWV

SEQ ID NO: 1236825 - protein, 19 aa, Mycobacterium
AEAAARGGSTFYGTGMNPG

SEQ ID NO: 1236826 - protein, 23 aa, Mycobacterium
AEADVAVRIGPAAARQSYLDIDA

SEQ ID NO: 1236827 - protein, 17 aa, Mycobacterium
AEAEAGVAHHVALSVVG

SEQ ID NO: 1236828 - protein, 24 aa, Mycobacterium
AEAEDFYLRYNCDTYVMGIAGVDG

SEQ ID NO: 1236829 - protein, 25 aa, Mycobacterium
AEAFAETRYDAVIVDAMFLGILPFL

SEQ ID NO: 1236830 - protein, 23 aa, Mycobacterium
AEAKLGSLAGRTAVVIGAGSMGA

SEQ ID NO: 1236831 - protein, 18 aa, Mycobacterium
AEALAEFEVAFEVGVVSA

SEQ ID NO: 1236832 - protein, 17 aa, Mycobacterium
AEALDWGLVARVVPHDD

SEQ ID NO: 1236833 - protein, 20 aa, Mycobacterium
AEALGAPAVEVYPHAATVAL

SEQ ID NO: 1236834 - protein, 21 aa, Mycobacterium
AEALGEHVFDYFLRNKRAEWE

SEQ ID NO: 1236835 - protein, 19 aa, Mycobacterium
AEAMVPHIAGRAVTRKRWP

SEQ ID NO: 1236836 - protein, 20 aa, Mycobacterium
AEAPARLFYERSLGMLDLAV

SEQ ID NO: 1236837 - protein, 20 aa, Mycobacterium
AEAQGRWGALPPSYRSTSRD

SEQ ID NO: 1236838 - protein, 20 aa, Mycobacterium
AEAQQRWGDTEAWRQSRQRT

SEQ ID NO: 1236839 - protein, 20 aa, Mycobacterium
AEAQRLGLQNAQFVAADVAT

SEQ ID NO: 1236840 - protein, 23 aa, Mycobacterium
AEAQRMGIAWQVCEPDDLMAEAR

SEQ ID NO: 1236841 - protein, 38 aa, Mycobacterium
AEARLAVGWWLVGSARAMLRLACTHARDRVQFGKPIAQ

SEQ ID NO: 1236842 - protein, 24 aa, Mycobacterium
AEASAEALRGGWFHTGDLGRMDAE

SEQ ID NO: 1236843 - protein, 18 aa, Mycobacterium
AEASRVLLRDSILDGMRD

SEQ ID NO: 1236844 - protein, 18 aa, Mycobacterium
AEAVRAGRYAKLYCARAA

SEQ ID NO: 1236845 - protein, 19 aa, Mycobacterium
AEAYRDAYLRQGVKDGEAF

SEQ ID NO: 1236846 - protein, 29 aa, Mycobacterium
AEDGLCALALRFSKDWMSPAERFETLKAR

SEQ ID NO: 1236847 - protein, 21 aa, Mycobacterium
AEEALGLPVLYASGRAGIAST

SEQ ID NO: 1236848 - protein, 34 aa, Mycobacterium; identical to SEQ ID NO: 628752

SEQ ID NO: 1236849 - protein, 18 aa, Mycobacterium
AEEGPPFCDGTVIEHIRA

SEQ ID NO: 1236850 - protein, 25 aa, Mycobacterium
AEELRRTAARLADWVDAQSDGDLRD

SEQ ID NO: 1236851 - protein, 22 aa, Mycobacterium
AEERRRCPADDIVTRLIQADID

SEQ ID NO: 1236852 - protein, 19 aa, Mycobacterium
AEETWPRYFSRPPETPAAE

SEQ ID NO: 1236853 - protein, 17 aa, Mycobacterium
AEFERFLAQQAGEKDKE

SEQ ID NO: 1236854 - protein, 17 aa, Mycobacterium
AEFLAFFVAAIKAAVPG

SEQ ID NO: 1236855 - protein, 17 aa, Mycobacterium
AEFPGLVGEAVRGTFRV

SEQ ID NO: 1236856 - protein, 21 aa, Mycobacterium
AEGARILEIFLDRLVWAASTE

SEQ ID NO: 1236857 - protein, 18 aa, Mycobacterium
AEGCVIAGCALLGGETAE

SEQ ID NO: 1236858 - protein, 19 aa, Mycobacterium
AEGEAFGRAAEPWEVAATI

SEQ ID NO: 1236859 - protein, 17 aa, Mycobacterium
AEGHGGHALIHYDNVRV

SEQ ID NO: 1236860 - protein, 26 aa, Mycobacterium
AEGLLAQQPRRGFVVLPVTGRDIADV

SEQ ID NO: 1236861 - protein, 24 aa, Mycobacterium
AEGRDMWPGILGFEDTVIPQLERA

SEQ ID NO: 1236862 - protein, 17 aa, Mycobacterium
AEGWAPAAEQVAVRGVQ

SEQ ID NO: 1236863 - protein, 40 aa, Mycobacterium
AEGYFRPDIDVDLIYRFIRDTTWVSVRWYQPGGPLTAEEV

SEQ ID NO: 1236864 - protein, 25 aa, Mycobacterium
AEGYWRLQGPNLWPAQPPGFRAAFE

SEQ ID NO: 1236865 - protein, 18 aa, Mycobacterium
AEHGPVVLRVCRAVVGPV

SEQ ID NO: 1236866 - protein, 18 aa, Mycobacterium
AEHILLRTVRCVSGTVEL

SEQ ID NO: 1236867 - protein, 18 aa, Mycobacterium
AEHLHMHVVPRWGGDANF

SEQ ID NO: 1236868 - protein, 31 aa, Mycobacterium
AEHMLRSALIATRLADRLGLTRAQRDCVYYA

SEQ ID NO: 1236869 - protein, 17 aa, Mycobacterium
AEHPDRFARIVVANTGL

SEQ ID NO: 1236870 - protein, 17 aa, Mycobacterium
AEHRAILNAVRRGHGAR

SEQ ID NO: 1236871 - protein, 24 aa, Mycobacterium
AEHVKPRLLGHWGTTPGLNLVYAH

SEQ ID NO: 1236872 - protein, 23 aa, Mycobacterium
AEIAARLSVPLGVARVLVGDLVT

SEQ ID NO: 1236873 - protein, 18 aa, Mycobacterium
AEIGPFFADREGGYTRII

SEQ ID NO: 1236874 - protein, 18 aa, Mycobacterium
AEIREFLENYVIGQDTAK

SEQ ID NO: 1236875 - protein, 17 aa, Mycobacterium
AEIVGAALFLMSNASSF

SEQ ID NO: 1236876 - protein, 24 aa, Mycobacterium
AELAAAGLRRTHFWTDPAGDFGLS

SEQ ID NO: 1236877 - protein, 20 aa, Mycobacterium
AELAAQGWVIIRVSRDILRH

SEQ ID NO: 1236878 - protein, 25 aa, Mycobacterium
AELAARTVIYYVLGFTVDEQSKLQW

SEQ ID NO: 1236879 - protein, 18 aa, Mycobacterium
AELADFIGLEEVKYQVAR

SEQ ID NO: 1236880 - protein, 21 aa, Mycobacterium
AELAEVCPIFADAERMIADPV

SEQ ID NO: 1236881 - protein, 24 aa, Mycobacterium
AELARRIGADLVVIGPEVPLVLGV

SEQ ID NO: 1236882 - protein, 23 aa, Mycobacterium
AELDAYLALPRVAGLAVSPDGSR

SEQ ID NO: 1236883 - protein, 21 aa, Mycobacterium
AELDFAVPTFEQFWRDGSLRL

SEQ ID NO: 1236884 - protein, 20 aa, Mycobacterium
AELEKFQWFVRAHLENAGGD

SEQ ID NO: 1236885 - protein, 19 aa, Mycobacterium
AELERPVLLFSAGKDSIVL

SEQ ID NO: 1236886 - protein, 19 aa, Mycobacterium
AELGDWLVMHEGWRSELPD

SEQ ID NO: 1236887 - protein, 17 aa, Mycobacterium
AELGRLAGRLDDQTADR

SEQ ID NO: 1236888 - protein, 18 aa, Mycobacterium
AELGRRHELLSGLVPQIS

SEQ ID NO: 1236889 - protein, 20 aa, Mycobacterium
AELLLSKGLGVEVGIFHAEA

SEQ ID NO: 1236890 - protein, 24 aa, Mycobacterium
AELLRRLTAPTGRSVHMTPEADHA

SEQ ID NO: 1236891 - protein, 30 aa, Mycobacterium
AELLWEHWERCAFHWFPGNHLLHVSQPDYL

SEQ ID NO: 1236892 - protein, 22 aa, Mycobacterium
AELMAALTMKLEKHWQQRTPAA

SEQ ID NO: 1236893 - protein, 19 aa, Mycobacterium
AELMLRKATWLYDNGKSCG

SEQ ID NO: 1236894 - protein, 20 aa, Mycobacterium
AELPELLTAFPDLADIIGGN

SEQ ID NO: 1236895 - protein, 27 aa, Mycobacterium
AELPGSEHWPAMVFLRSPAPSSNHHDL

SEQ ID NO: 1236896 - protein, 18 aa, Mycobacterium
AELQIVFHTLLRRIPTMR

SEQ ID NO: 1236897 - protein, 19 aa, Mycobacterium
AELQRRFTVSAAETGAQEL

SEQ ID NO: 1236898 - protein, 20 aa, Mycobacterium
AELRARVGLSSSALAQRVPP

SEQ ID NO: 1236899 - protein, 21 aa, Mycobacterium
AELRAWSVLAVYSSVSPARRG

SEQ ID NO: 1236900 - protein, 20 aa, Mycobacterium
AELREKLELAKEPGGEKAAA

SEQ ID NO: 1236901 - protein, 23 aa, Mycobacterium
AELRFPDPLTVGLSVARLGNSSV

SEQ ID NO: 1236902 - protein, 17 aa, Mycobacterium
AELRSALAEAVDAKTLE

SEQ ID NO: 1236903 - protein, 20 aa, Mycobacterium
AELRVIPGIYGHFAGGDANP

SEQ ID NO: 1236904 - protein, 27 aa, Mycobacterium
AELSKLRLLPFRLRFDGGEEVRTDLTL

SEQ ID NO: 1236905 - protein, 21 aa, Mycobacterium
AELSLGVLHQVVRSIAEDDLG

SEQ ID NO: 1236906 - protein, 26 aa, Mycobacterium
AELVARVKALLRRRGSSATFSSETIQ

SEQ ID NO: 1236907 - protein, 18 aa, Mycobacterium
AELVSWSAVLTLREAGCA

SEQ ID NO: 1236908 - protein, 21 aa, Mycobacterium
AEMAERVGISKAMMSKIENAQ

SEQ ID NO: 1236909 - protein, 18 aa, Mycobacterium
AEMPRLFERFHRVETVDA

SEQ ID NO: 1236910 - protein, 23 aa, Mycobacterium
AEMTYLQWLARYVELAIGEGDST

SEQ ID NO: 1236911 - protein, 24 aa, Mycobacterium
AENAFRFALVISHENQHDETMLQA

SEQ ID NO: 1236912 - protein, 22 aa, Mycobacterium
AENIVPYGFDFDRPVSRFEEAL

SEQ ID NO: 1236913 - protein, 20 aa, Mycobacterium
AENMMSGTVWVKGNASQSAG

SEQ ID NO: 1236914 - protein, 24 aa, Mycobacterium
AENWRASFDVDLMGTVGLVDAALP

SEQ ID NO: 1236915 - protein, 22 aa, Mycobacterium
AEPDALVPLYLRRPDATPRAEQ

SEQ ID NO: 1236916 - protein, 25 aa, Mycobacterium
AEPLVVAFCEALRGLGAPVQTGVFG

SEQ ID NO: 1236917 - protein, 24 aa, Mycobacterium
AEPQPTVQFAFLQLFIHAVVAGIL

SEQ ID NO: 1236918 - protein, 26 aa, Mycobacterium
AEPTAQRILAHFGLDGFFEVIAGASP

SEQ ID NO: 1236919 - protein, 21 aa, Mycobacterium
AEPVLKGLVGRIAADEERHEV

SEQ ID NO: 1236920 - protein, 17 aa, Mycobacterium
AEPVYRNLLTLLRDRHG

SEQ ID NO: 1236921 - protein, 20 aa, Mycobacterium
AEQAIAIAFEEASLRGVDLV

SEQ ID NO: 1236922 - protein, 25 aa, Mycobacterium
AERAEVYASLGLRLDYDPHLRRVTA

SEQ ID NO: 1236923 - protein, 25 aa, Mycobacterium
AERAYCVPKAVLLTAACRAAGIPAR

SEQ ID NO: 1236924 - protein, 24 aa, Mycobacterium
AERDRLWELAKNWIPSYADYEKLT

SEQ ID NO: 1236925 - protein, 42 aa, Mycobacterium
AEREARQMRPLYVMPTKGVWTSGFGYRWGVLHGGIDIAGPIG

SEQ ID NO: 1236926 - protein, 26 aa, Mycobacterium
AERGMPLSFQFARFVRFIVTEIFPGG

SEQ ID NO: 1236927 - protein, 17 aa, Mycobacterium
AERIRQCWNDIGHDGGD

SEQ ID NO: 1236928 - protein, 24 aa, Mycobacterium
AERISAAEAYDWGLVTAVHSAEAF

SEQ ID NO: 1236929 - protein, 21 aa, Mycobacterium
AERLYRLAALTAPAGVPGTHR

SEQ ID NO: 1236930 - protein, 23 aa, Mycobacterium
AERMSARRFWVRYAAESTGALTL

SEQ ID NO: 1236931 - protein, 20 aa, Mycobacterium
AERQDLRLLKSRARDPRSRL

SEQ ID NO: 1236932 - protein, 17 aa, Mycobacterium
AERRSRLEGDERGRQLL

SEQ ID NO: 1236933 - protein, 23 aa, Mycobacterium
AERSAAAIAWMLGRTDGRPAEFR

SEQ ID NO: 1236934 - protein, 20 aa, Mycobacterium
AERVELCLIAKDGSEERINL

SEQ ID NO: 1236935 - protein, 21 aa, Mycobacterium
AESADLGWRNGVWVSNGNLVP

SEQ ID NO: 1236936 - protein, 24 aa, Mycobacterium
AESAGLPLFRYLGGPNAHILPVPM

SEQ ID NO: 1236937 - protein, 17 aa, Mycobacterium
AESGLRFSGTSPDGHLV

SEQ ID NO: 1236938 - protein, 19 aa, Mycobacterium
AESMASLARELRYADVSAL

SEQ ID NO: 1236939 - protein, 26 aa, Mycobacterium
AESPKETWLRLLLIRHDFPRPRTQIP

SEQ ID NO: 1236940 - protein, 22 aa, Mycobacterium
AESSCAVTVPILGSGLQVDEVQ

SEQ ID NO: 1236941 - protein, 19 aa, Mycobacterium
AESSVALVVHLGMSGQMLL

SEQ ID NO: 1236942 - protein, 24 aa, Mycobacterium
AESYAELVAEGWLASRQGAGTWVV

SEQ ID NO: 1236943 - protein, 25 aa, Mycobacterium
AETFPEGRFDLVSAQFFHSPLDVDR

SEQ ID NO: 1236944 - protein, 24 aa, Mycobacterium
AETLNLALLRGYRTGGTIHLIVNN

SEQ ID NO: 1236945 - protein, 18 aa, Mycobacterium
AETLRAIRATMVIVTHDL

SEQ ID NO: 1236946 - protein, 33 aa, Mycobacterium; identical to SEQ ID NO: 620143

SEQ ID NO: 1236947 - protein, 21 aa, Mycobacterium
AEVAAGIAFLAAPGASYVTGT

SEQ ID NO: 1236948 - protein, 20 aa, Mycobacterium
AEVADTYFALMDHLNTDSLL

SEQ ID NO: 1236949 - protein, 24 aa, Mycobacterium
AEVAGRIRSAGAIFVGPYAPVSLG

SEQ ID NO: 1236950 - protein, 17 aa, Mycobacterium
AEVASAIVFLASDDASF

SEQ ID NO: 1236951 - protein, 25 aa, Mycobacterium
AEVKKAVAEYGLWYPPDPSSYEICS

SEQ ID NO: 1236952 - protein, 17 aa, Mycobacterium
AEVLDGDGFVRVTAQLK

SEQ ID NO: 1236953 - protein, 19 aa, Mycobacterium
AEVMMSFHRLSDVDIDELA

SEQ ID NO: 1236954 - protein, 23 aa, Mycobacterium
AEVRLRMFLEQYWGGPRTYSDQR

SEQ ID NO: 1236955 - protein, 21 aa, Mycobacterium
AEVTVRIIVSFVLTPSQNVAL

SEQ ID NO: 1236956 - protein, 20 aa, Mycobacterium
AEVVPRLAGTAAEIRQVLRA

SEQ ID NO: 1236957 - protein, 21 aa, Mycobacterium
AEVYTAWGGFAYGRGLDGRPA

SEQ ID NO: 1236958 - protein, 30 aa, Mycobacterium
AEWLRALAELCRRREILLIVDDVQMGCGRT

SEQ ID NO: 1236959 - protein, 28 aa, Mycobacterium
AEWRRGSLPPGRLGWRKAQELRDQAAAL

SEQ ID NO: 1236960 - protein, 26 aa, Mycobacterium
AEYRREMAELFAPFSAVAAKNPYSSS

SEQ ID NO: 1236961 - protein, 24 aa, Mycobacterium
AEYVFRLAGPTGIYGGTLEVFRNM

SEQ ID NO: 1236962 - protein, 35 aa, Mycobacterium
AEYVPKLLEMNGWTEGRSGVPFILAGWSLGGVLAY

SEQ ID NO: 1236963 - protein, 19 aa, Mycobacterium
AFAAQALAVMREWKFTAAD

SEQ ID NO: 1236964 - protein, 19 aa, Mycobacterium
AFADAWKFAEDGVYVSPYF

SEQ ID NO: 1236965 - protein, 24 aa, Mycobacterium
AFADFPAAHWKKIWSTNPLERLNK

SEQ ID NO: 1236966 - protein, 24 aa, Mycobacterium
AFADTGALGQRVFANPAPILEQIL

SEQ ID NO: 1236967 - protein, 20 aa, Mycobacterium
AFAEERWGRLTPGASADLVW

SEQ ID NO: 1236968 - protein, 24 aa, Mycobacterium
AFAEKRLAPYASEWDESHHFPTDV

SEQ ID NO: 1236969 - protein, 18 aa, Mycobacterium
AFAGQLFVHPDYGSVDMS

SEQ ID NO: 1236970 - protein, 19 aa, Mycobacterium
AFAGSGMRADDAVLIGSPG

SEQ ID NO: 1236971 - protein, 25 aa, Mycobacterium
AFASGMAATDCALRAVLRPGDHLVI

SEQ ID NO: 1236972 - protein, 24 aa, Mycobacterium
AFATMACLYPDRIFLGVGTGEALN

SEQ ID NO: 1236973 - protein, 19 aa, Mycobacterium
AFCAACDRTRLTADGQVRN

SEQ ID NO: 1236974 - protein, 24 aa, Mycobacterium
AFDAAIPFGAFRRLIDIPATGKTA

SEQ ID NO: 1236975 - protein, 28 aa, Mycobacterium
AFDFRVMTPTAWWRVPMQTVVGGLPTDP

SEQ ID NO: 1236976 - protein, 26 aa, Mycobacterium
AFDGRKAVVFDDRWASAREDLVKIWL

SEQ ID NO: 1236977 - protein, 18 aa, Mycobacterium
AFDLGRRGNLTAAVQRID

SEQ ID NO: 1236978 - protein, 18 aa, Mycobacterium
AFDTGGWPRTSPAGRIDA

SEQ ID NO: 1236979 - protein, 25 aa, Mycobacterium
AFEAFPKERYKAFFDLCHRIMPADG

SEQ ID NO: 1236980 - protein, 18 aa, Mycobacterium
AFEAMPMSLVRELFETNT

SEQ ID NO: 1236981 - protein, 22 aa, Mycobacterium
AFGELREAVALVAGEEDADTLT

SEQ ID NO: 1236982 - protein, 19 aa, Mycobacterium
AFGLVKINPIAAWSDDDMQ

SEQ ID NO: 1236983 - protein, 25 aa, Mycobacterium
AFGRRFGCTVWDGFGSTETAVIITR

SEQ ID NO: 1236984 - protein, 28 aa, Mycobacterium
AFGSHLIDFTRWLFGSEIVDCGGVTRID

SEQ ID NO: 1236985 - protein, 23 aa, Mycobacterium
AFHLRLEAYAAITTNTVQFGGAL

SEQ ID NO: 1236986 - protein, 19 aa, Mycobacterium
AFLATRLGGQWGGAFGTLP

SEQ ID NO: 1236987 - protein, 21 aa, Mycobacterium
AFLEMNTRLQVEHPVTELITG

SEQ ID NO: 1236988 - protein, 28 aa, Mycobacterium
AFNRELCARFGVSPIEFDGRSDALLHGF

SEQ ID NO: 1236989 - protein, 18 aa, Mycobacterium
AFPPMAVSVSLADDIDIS

SEQ ID NO: 1236990 - protein, 22 aa, Mycobacterium
AFQASPFRWLNWLSDSRATITA

SEQ ID NO: 1236991 - protein, 19 aa, Mycobacterium
AFQRRVWEALLTIPYGETR

SEQ ID NO: 1236992 - protein, 17 aa, Mycobacterium
AFQYRPNPMHVMTVDGG

SEQ ID NO: 1236993 - protein, 19 aa, Mycobacterium
AFRDELRTFYRTEIPAEIR

SEQ ID NO: 1236994 - protein, 19 aa, Mycobacterium
AFRNCVFRRASLWHSTFRN

SEQ ID NO: 1236995 - protein, 18 aa, Mycobacterium
AFRPLGRVPDRWRLAAEL

SEQ ID NO: 1236996 - protein, 22 aa, Mycobacterium
AFRSALRDLTLMLVYEATRDAA

SEQ ID NO: 1236997 - protein, 21 aa, Mycobacterium
AFRTMRVEVLAGQLLELRAQA

SEQ ID NO: 1236998 - protein, 24 aa, Mycobacterium
AFTLPELIGLTAACDVVLDAADHE

SEQ ID NO: 1236999 - protein, 25 aa, Mycobacterium
AFTLSILKFRGHRILNGMLAEDPGF

SEQ ID NO: 1237000 - protein, 17 aa, Mycobacterium
AFTQAWGATPVDMGMGG

SEQ ID NO: 1237001 - protein, 17 aa, Mycobacterium
AFTQRLRDHPSFAARDL

SEQ ID NO: 1237002 - protein, 27 aa, Mycobacterium
AFTTLRGGAYFFLPGLRGLRYLATLGD

SEQ ID NO: 1237003 - protein, 32 aa, Mycobacterium
AFVAARRFAIPAVEAKGALLLEDVGVPVPRLA

SEQ ID NO: 1237004 - protein, 17 aa, Mycobacterium
AFVARARELAERYGDRF

SEQ ID NO: 1237005 - protein, 23 aa, Mycobacterium
AFVPAYRTMDGLKVMDGSAQVEA

SEQ ID NO: 1237006 - protein, 23 aa, Mycobacterium
AFVSWLRLPMALRQSGIVMLPTM

SEQ ID NO: 1237007 - protein, 19 aa, Mycobacterium
AFYGPQFALTFPVLTHYGV

SEQ ID NO: 1237008 - protein, 23 aa, Mycobacterium
AGAAEALRWAMLSGEPQVVLADA

SEQ ID NO: 1237009 - protein, 21 aa, Mycobacterium
AGAAKAREWLSAKRYDAVLIG

SEQ ID NO: 1237010 - protein, 24 aa, Mycobacterium
AGAAWIDPRVRGHVDALADPETGL

SEQ ID NO: 1237011 - protein, 18 aa, Mycobacterium
AGADTVVLLVHGIAASIR

SEQ ID NO: 1237012 - protein, 20 aa, Mycobacterium
AGADVRLWVDRSFSVRGAGT

SEQ ID NO: 1237013 - protein, 26 aa, Mycobacterium
AGAEPGRAHAYLRLGGQEPVVETVSI

SEQ ID NO: 1237014 - protein, 29 aa, Mycobacterium
AGAGRPLLGICGGFQMLCRHIDDAVESRA

SEQ ID NO: 1237015 - protein, 23 aa, Mycobacterium
AGAGVCRDYAHLVIAMLRAVNVP

SEQ ID NO: 1237016 - protein, 22 aa, Mycobacterium
AGAILRRSVERLGITVHMDKRT

SEQ ID NO: 1237017 - protein, 23 aa, Mycobacterium
AGAKGMRNRVTWTIKQVDPPTLL

SEQ ID NO: 1237018 - protein, 20 aa, Mycobacterium
AGALNLFSFRPRVWDSEAET

SEQ ID NO: 1237019 - protein, 18 aa, Mycobacterium
AGALRMPAEIVGTGKHTI

SEQ ID NO: 1237020 - protein, 19 aa, Mycobacterium
AGALWPLAAMAARQGVDVF

SEQ ID NO: 1237021 - protein, 25 aa, Mycobacterium
AGAMARLGHSVAFFIGTAYGSTETA

SEQ ID NO: 1237022 - protein, 17 aa, Mycobacterium
AGAMRRVLREVLTRDGR

SEQ ID NO: 1237023 - protein, 19 aa, Mycobacterium
AGAPAALDWNASREEVNRR

SEQ ID NO: 1237024 - protein, 20 aa, Mycobacterium
AGARFSTKMRMFGVPYRITS

SEQ ID NO: 1237025 - protein, 22 aa, Mycobacterium
AGASLTPWLSVGELIAERLRGT

SEQ ID NO: 1237026 - protein, 17 aa, Mycobacterium
AGASWGNAGWVSPALTI

SEQ ID NO: 1237027 - protein, 26 aa, Mycobacterium
AGATCFLRVNVPGALFSLGDGHYRQG

SEQ ID NO: 1237028 - protein, 25 aa, Mycobacterium
AGATPPRFGIPMALVHAFAAVAGMS

SEQ ID NO: 1237029 - protein, 24 aa, Mycobacterium
AGAVARPFGTPGFLFLDPPDHTRL

SEQ ID NO: 1237030 - protein, 20 aa, Mycobacterium
AGCDLAMMCDIRIASDRASF

SEQ ID NO: 1237031 - protein, 23 aa, Mycobacterium
AGCGQWPGSVVRLDAPVIPHMGW

SEQ ID NO: 1237032 - protein, 30 aa, Mycobacterium
AGCPDPATAAECLRALPADKLRKPVWFVEI

SEQ ID NO: 1237033 - protein, 21 aa, Mycobacterium
AGDKIKMVLLGRRQRIAHGGA

SEQ ID NO: 1237034 - protein, 20 aa, Mycobacterium
AGDMTIAVEPFRKWWQPGPG

SEQ ID NO: 1237035 - protein, 18 aa, Mycobacterium
AGDRLVLISVGGIETADD

SEQ ID NO: 1237036 - protein, 24 aa, Mycobacterium
AGDTPWLVAVRMVSEGVDVPRLAV

SEQ ID NO: 1237037 - protein, 25 aa, Mycobacterium
AGDVFAGVLAVHWRSGHENALRRAC

SEQ ID NO: 1237038 - protein, 20 aa, Mycobacterium
AGDWRARLATVVADNMRLFD

SEQ ID NO: 1237039 - protein, 21 aa, Mycobacterium
AGEAAAMAAFVHARAANASAA

SEQ ID NO: 1237040 - protein, 20 aa, Mycobacterium
AGEAELDLVLAILRARQLFG

SEQ ID NO: 1237041 - protein, 20 aa, Mycobacterium
AGEAIRLARQLARMTDDPEV

SEQ ID NO: 1237042 - protein, 19 aa, Mycobacterium
AGEALDWGLVTDVVPDAEL

SEQ ID NO: 1237043 - protein, 18 aa, Mycobacterium
AGEAPAWAPLPLQYADFG

SEQ ID NO: 1237044 - protein, 18 aa, Mycobacterium
AGECHVHAGINGDELADQ

SEQ ID NO: 1237045 - protein, 26 aa, Mycobacterium
AGEGRRLAPTMAWPVVSASYLRLAQK

SEQ ID NO: 1237046 - protein, 24 aa, Mycobacterium
AGEHGRYLLAATFGNVHGVYKPGN

SEQ ID NO: 1237047 - protein, 25 aa, Mycobacterium
AGELGRSAAGYGLWHNGIEEFEELR

SEQ ID NO: 1237048 - protein, 21 aa, Mycobacterium
AGERGLCAGGDVIALYHSAKA

SEQ ID NO: 1237049 - protein, 32 aa, Mycobacterium
AGERPRTRISWLDSKHSFSFADHYDPANTHHG

SEQ ID NO: 1237050 - protein, 23 aa, Mycobacterium
AGERRFGPLEAREELAALEILAE

SEQ ID NO: 1237051 - protein, 21 aa, Mycobacterium
AGETAPYAWITRLPRGLRKEA

SEQ ID NO: 1237052 - protein, 20 aa, Mycobacterium
AGETERAWFQAHVDQTVDSS

SEQ ID NO: 1237053 - protein, 20 aa, Mycobacterium
AGETGCRVLIPENFENGTGP

SEQ ID NO: 1237054 - protein, 19 aa, Mycobacterium
AGFAVTFGTLFKKPITEEY

SEQ ID NO: 1237055 - protein, 27 aa, Mycobacterium
AGFDPSRPTAWLAEGLLMYLPADAQDR

SEQ ID NO: 1237056 - protein, 17 aa, Mycobacterium
AGGAAVLLRTMPLVVHG

SEQ ID NO: 1237057 - protein, 27 aa, Mycobacterium
AGGAIIRTGLPPFKWWRGLQARKVLDN

SEQ ID NO: 1237058 - protein, 19 aa, Mycobacterium
AGGDFCTGADWVATNTAGQ

SEQ ID NO: 1237059 - protein, 20 aa, Mycobacterium
AGGEILRLLLGHPAYSDGRL

SEQ ID NO: 1237060 - protein, 20 aa, Mycobacterium
AGGGDIRWRHRLVDLQDRTA

SEQ ID NO: 1237061 - protein, 20 aa, Mycobacterium
AGGGGRGMRVVRDLDALAGE

SEQ ID NO: 1237062 - protein, 26 aa, Mycobacterium
AGGGLLRLPRRIPYQKALELALTGES

SEQ ID NO: 1237063 - protein, 17 aa, Mycobacterium
AGGIELRALHTPGHSPG

SEQ ID NO: 1237064 - protein, 24 aa, Mycobacterium
AGGKRFRPLFTVLSARLGPEPDAW

SEQ ID NO: 1237065 - protein, 19 aa, Mycobacterium
AGGPVLWPDLEAILVVPNN

SEQ ID NO: 1237066 - protein, 18 aa, Mycobacterium
AGGTILWMADERAIESHI

SEQ ID NO: 1237067 - protein, 22 aa, Mycobacterium
AGHFPASLLYAAAKLYYTEDAT

SEQ ID NO: 1237068 - protein, 18 aa, Mycobacterium
AGHLSFGQGLHFCLGSAL

SEQ ID NO: 1237069 - protein, 21 aa, Mycobacterium
AGHVRDVLQFYSASPERLSGK

SEQ ID NO: 1237070 - protein, 26 aa, Mycobacterium
AGIADIRRALSMLGRISAEGMRLRGK

SEQ ID NO: 1237071 - protein, 20 aa, Mycobacterium
AGIAHPNMRAQYAVVDPVLT

SEQ ID NO: 1237072 - protein, 17 aa, Mycobacterium
AGIALSILATGLAAAAL

SEQ ID NO: 1237073 - protein, 26 aa, Mycobacterium
AGIEMSGLPSWMWLEVDDVVGDCLTA

SEQ ID NO: 1237074 - protein, 17 aa, Mycobacterium
AGIERILADAGHEVVAG

SEQ ID NO: 1237075 - protein, 25 aa, Mycobacterium
AGILDVLDNYAFVRTSGYLPGPNDV

SEQ ID NO: 1237076 - protein, 19 aa, Mycobacterium
AGILLQLPVELFTEVVDFD

SEQ ID NO: 1237077 - protein, 18 aa, Mycobacterium
AGILPGSLYHHFESKESI

SEQ ID NO: 1237078 - protein, 24 aa, Mycobacterium
AGINVCSSAAWITGGKQSPEDLDR

SEQ ID NO: 1237079 - protein, 21 aa, Mycobacterium
AGIPAASLRRSQTGVFAGACF

SEQ ID NO: 1237080 - protein, 18 aa, Mycobacterium
AGKLPVTLFTAGGIATPA

SEQ ID NO: 1237081 - protein, 25 aa, Mycobacterium
AGKPRPHLATSFWFALGDRDEARAQ

SEQ ID NO: 1237082 - protein, 20 aa, Mycobacterium
AGKSPAVFYRYFDDKEDLLA

SEQ ID NO: 1237083 - protein, 25 aa, Mycobacterium
AGLAEGGTHARIWAHGNLEAARATA

SEQ ID NO: 1237084 - protein, 22 aa, Mycobacterium
AGLAVGVPTRIQITALAATATT

SEQ ID NO: 1237085 - protein, 22 aa, Mycobacterium
AGLDGYSAADCVALLREAAMTA

SEQ ID NO: 1237086 - protein, 17 aa, Mycobacterium
AGLEKRRDAMLSGVHIN

SEQ ID NO: 1237087 - protein, 24 aa, Mycobacterium
AGLHAYRGPWQYETLAREIMFDIA

SEQ ID NO: 1237088 - protein, 24 aa, Mycobacterium
AGLHPAWPLAMSVAHRDEFADALT

SEQ ID NO: 1237089 - protein, 20 aa, Mycobacterium
AGLHSLPWDGLKLSRGEPAI

SEQ ID NO: 1237090 - protein, 17 aa, Mycobacterium
AGLKAIYLSGWQVAGDA

SEQ ID NO: 1237091 - protein, 20 aa, Mycobacterium
AGLLALFLLHHARRPARIRA

SEQ ID NO: 1237092 - protein, 19 aa, Mycobacterium
AGLLRPQAAAKLVGALRSR

SEQ ID NO: 1237093 - protein, 24 aa, Mycobacterium
AGLLSGAVTLVWQAGRVVQVNELG

SEQ ID NO: 1237094 - protein, 24 aa, Mycobacterium
AGLLSLPQPEEWGGGGQPYEVYLQ

SEQ ID NO: 1237095 - protein, 23 aa, Mycobacterium
AGLNPFALLASHGVPLAFGSDSP

SEQ ID NO: 1237096 - protein, 24 aa, Mycobacterium
AGLPGGVPPTGRFGTVEQVARVIG

SEQ ID NO: 1237097 - protein, 26 aa, Mycobacterium
AGLPSSPWYELGQRLAPKGTGAVLAF

SEQ ID NO: 1237098 - protein, 25 aa, Mycobacterium
AGLQARLGLDAGKWTAEQMAQVALD

SEQ ID NO: 1237099 - protein, 19 aa, Mycobacterium
AGLRGVEKGYVLAPQAEDN

SEQ ID NO: 1237100 - protein, 29 aa, Mycobacterium
AGLSHPMGPLRLSDLIGLDTMKLIADAMF

SEQ ID NO: 1237101 - protein, 20 aa, Mycobacterium
AGLTLPWLAGLDRAAVEAHT

SEQ ID NO: 1237102 - protein, 32 aa, Mycobacterium
AGLTRDLAQQWGIRKGIRVNAIAPGFFESEMT

SEQ ID NO: 1237103 - protein, 27 aa, Mycobacterium
AGLVKDIKINWVWNPPWGPDKITEDGR

SEQ ID NO: 1237104 - protein, 18 aa, Mycobacterium
AGMDFVAGVMVFPGGGVD

SEQ ID NO: 1237105 - protein, 25 aa, Mycobacterium
AGMEPDLRWERFITAVRLLAEQLGV

SEQ ID NO: 1237106 - protein, 20 aa, Mycobacterium
AGMRSHPGVTATFCEALAEV

SEQ ID NO: 1237107 - protein, 27 aa, Mycobacterium
AGNDLPLEVGMAFSVEPGIYFPGQWGA

SEQ ID NO: 1237108 - protein, 20 aa, Mycobacterium
AGNPEIDFVVVREGTEGPYT

SEQ ID NO: 1237109 - protein, 20 aa, Mycobacterium
AGNPHVARLLGSFETTLDRE

SEQ ID NO: 1237110 - protein, 19 aa, Mycobacterium
AGNVWEWTTDWYTDTGGSA

SEQ ID NO: 1237111 - protein, 21 aa, Mycobacterium
AGPAAPCWALSLTSGAGRAML

SEQ ID NO: 1237112 - protein, 18 aa, Mycobacterium
AGPAMGFMSGHLCYQIEH

SEQ ID NO: 1237113 - protein, 19 aa, Mycobacterium
AGPEIGVAATKTFLAQIAA

SEQ ID NO: 1237114 - protein, 22 aa, Mycobacterium
AGPLPLQIICDMMGIPEEDHQR

SEQ ID NO: 1237115 - protein, 27 aa, Mycobacterium
AGPNALFDPRFQKLGIHPGGGATWMLQ

SEQ ID NO: 1237116 - protein, 17 aa, Mycobacterium
AGPYARWDDLYRDEHGE

SEQ ID NO: 1237117 - protein, 28 aa, Mycobacterium
AGQAIDLLKGVVVPAITGAIKSAAPPAG

SEQ ID NO: 1237118 - protein, 24 aa, Mycobacterium
AGQCGSCFNGTAAMAAVAVALRDG

SEQ ID NO: 1237119 - protein, 17 aa, Mycobacterium
AGQFLDRLEAGIAARLA

SEQ ID NO: 1237120 - protein, 24 aa, Mycobacterium
AGQGCAITTRLVVPRAKYDDAVEA

SEQ ID NO: 1237121 - protein, 24 aa, Mycobacterium
AGQLADWIRFMLSDAADFLCGSVI

SEQ ID NO: 1237122 - protein, 18 aa, Mycobacterium
AGQPLVWLEAMKMEHILT

SEQ ID NO: 1237123 - protein, 26 aa, Mycobacterium
AGQTLDWLAARGMTGLLQRTVVVLND

SEQ ID NO: 1237124 - protein, 20 aa, Mycobacterium
AGQVPAHLRDGHYSGAAKLG

SEQ ID NO: 1237125 - protein, 19 aa, Mycobacterium
AGRHAALQMVRRHRLMETF

SEQ ID NO: 1237126 - protein, 19 aa, Mycobacterium
AGRLHILEVQRLIRFMPKV

SEQ ID NO: 1237127 - protein, 24 aa, Mycobacterium
AGRMGAPMVRRLVGAGHTVTALGR

SEQ ID NO: 1237128 - protein, 19 aa, Mycobacterium
AGRSAALGFDGKWVLHPDQ

SEQ ID NO: 1237129 - protein, 20 aa, Mycobacterium
AGRSLPEYRALRARNTMMQA

SEQ ID NO: 1237130 - protein, 26 aa, Mycobacterium
AGRTAIRLARGIPVVGNRFGAPPHLD

SEQ ID NO: 1237131 - protein, 24 aa, Mycobacterium
AGRVEGRSGVWLPGDGLRPERKIG

SEQ ID NO: 1237132 - protein, 31 aa, Mycobacterium
AGRVKRPQMGIAAWLIPSIVAFGTDEQKQRF

SEQ ID NO: 1237133 - protein, 23 aa, Mycobacterium
AGRWRVKHPDLIPLYQRARELAE

SEQ ID NO: 1237134 - protein, 20 aa, Mycobacterium
AGSDESWAEFVGTYLSGSED

SEQ ID NO: 1237135 - protein, 17 aa, Mycobacterium
AGSGAKVLLAYADPATQ

SEQ ID NO: 1237136 - protein, 21 aa, Mycobacterium
AGSPMAWLLTLAHRRAVDRVR

SEQ ID NO: 1237137 - protein, 19 aa, Mycobacterium
AGSPSLVPLVAENRMRLNA

SEQ ID NO: 1237138 - protein, 20 aa, Mycobacterium
AGSRATHIVVWATLDKSLGR

SEQ ID NO: 1237139 - protein, 17 aa, Mycobacterium
AGSRFYFLTGRGALLQL

SEQ ID NO: 1237140 - protein, 18 aa, Mycobacterium
AGTALEVFHGAVLDHSPV

SEQ ID NO: 1237141 - protein, 21 aa, Mycobacterium
AGTDAVFWEPFVERGFAPDSG

SEQ ID NO: 1237142 - protein, 19 aa, Mycobacterium
AGTEMAVYLYRLTKDRRKN

SEQ ID NO: 1237143 - protein, 23 aa, Mycobacterium
AGTIADAVALWASRPERHTPVLR

SEQ ID NO: 1237144 - protein, 18 aa, Mycobacterium
AGTLARWSTSRHFLLNLP

SEQ ID NO: 1237145 - protein, 19 aa, Mycobacterium
AGTPIQAFCDLLEVRWLLS

SEQ ID NO: 1237146 - protein, 24 aa, Mycobacterium
AGTPLRLVSLVALDPTFGVLRGDV

SEQ ID NO: 1237147 - protein, 17 aa, Mycobacterium
AGTTAGQRWKWSGRRDG

SEQ ID NO: 1237148 - protein, 24 aa, Mycobacterium
AGTVARAFLRQALGVEVVSHVISI

SEQ ID NO: 1237149 - protein, 22 aa, Mycobacterium
AGVACANILLAAGISDVTVLDS

SEQ ID NO: 1237150 - protein, 17 aa, Mycobacterium
AGVDIVVACPGRLEDLM

SEQ ID NO: 1237151 - protein, 21 aa, Mycobacterium
AGVFHRSFARYEPMPENAAAK

SEQ ID NO: 1237152 - protein, 18 aa, Mycobacterium
AGVQPAVVRMLLDADVSP

SEQ ID NO: 1237153 - protein, 21 aa, Mycobacterium
AGVRPRMCEVAGRVADGLAGH

SEQ ID NO: 1237154 - protein, 17 aa, Mycobacterium
AGVRRPAAGVSRIGPVY

SEQ ID NO: 1237155 - protein, 19 aa, Mycobacterium
AGVSIQLLGKEGSYASLRM

SEQ ID NO: 1237156 - protein, 24 aa, Mycobacterium
AGVSRPTLYRWFASKQELLDAFGR

SEQ ID NO: 1237157 - protein, 29 aa, Mycobacterium
AGWDMWPGPYGQLGGRAYLLASLDESLDR

SEQ ID NO: 1237158 - protein, 26 aa, Mycobacterium
AGWQKLNGPQALSFVRQRHDLPRGDL

SEQ ID NO: 1237159 - protein, 20 aa, Mycobacterium
AGYRPDYRPPPQLPEAATGQ

SEQ ID NO: 1237160 - protein, 17 aa, Mycobacterium
AGYRRFLERRLRETFGF

SEQ ID NO: 1237161 - protein, 24 aa, Mycobacterium
AGYSALRLAPRFVDPSTLNPPGSL

SEQ ID NO: 1237162 - protein, 17 aa, Mycobacterium
AGYVLPCSMRPRSDLVL

SEQ ID NO: 1237163 - protein, 26 aa, Mycobacterium
AHAALWRALCGLDLMERIEIATHPAD

SEQ ID NO: 1237164 - protein, 24 aa, Mycobacterium
AHALHSPFWWLKCAVGTSNNDHPA

SEQ ID NO: 1237165 - protein, 19 aa, Mycobacterium
AHARIVVWEMIDALRRDGV

SEQ ID NO: 1237166 - protein, 20 aa, Mycobacterium
AHARRRGVALAIENASSLYA

SEQ ID NO: 1237167 - protein, 20 aa, Mycobacterium
AHATAWYGLHDLARIGARDK

SEQ ID NO: 1237168 - protein, 25 aa, Mycobacterium
AHAVGDSAIRACIRAGIDCIEHGFL

SEQ ID NO: 1237169 - protein, 24 aa, Mycobacterium
AHDEGWLAEHMLILKLISPENKAY

SEQ ID NO: 1237170 - protein, 27 aa, Mycobacterium
AHDESRKSFGIAGARVIDDLELSVPSA

SEQ ID NO: 1237171 - protein, 17 aa, Mycobacterium
AHDGWGFDEGDKNMVSM

SEQ ID NO: 1237172 - protein, 20 aa, Mycobacterium
AHDIRETFGRMAMNDEETAA

SEQ ID NO: 1237173 - protein, 24 aa, Mycobacterium
AHDLKDWFTFLAGRGPDWTAVQLE

SEQ ID NO: 1237174 - protein, 24 aa, Mycobacterium
AHDLSSLRLLGSVGEPINPEAWRW

SEQ ID NO: 1237175 - protein, 17 aa, Mycobacterium
AHFAYDFAPHGERSIAR

SEQ ID NO: 1237176 - protein, 25 aa, Mycobacterium
AHFHKRGRGHLVLIGSLLGTAAAPY

SEQ ID NO: 1237177 - protein, 17 aa, Mycobacterium
AHGAAVVVFEGRPIGLV

SEQ ID NO: 1237178 - protein, 25 aa, Mycobacterium
AHGIDTVVVGWGYGRADFAEPTSVP

SEQ ID NO: 1237179 - protein, 21 aa, Mycobacterium
AHGNPGILERQLAGIAAAAAR

SEQ ID NO: 1237180 - protein, 17 aa, Mycobacterium
AHGPYAVGITGEDAHLF

SEQ ID NO: 1237181 - protein, 21 aa, Mycobacterium
AHGQILLPGFVDLHTHLREPG

SEQ ID NO: 1237182 - protein, 20 aa, Mycobacterium
AHGTVMLRMPLHPVAIELLR

SEQ ID NO: 1237183 - protein, 19 aa, Mycobacterium
AHHARLGKDSVLGHVNVML

SEQ ID NO: 1237184 - protein, 19 aa, Mycobacterium
AHHNVCMHRGRKLVDTPDG

SEQ ID NO: 1237185 - protein, 26 aa, Mycobacterium
AHHSFHVFVVYPWARFLDRDPTTPIR

SEQ ID NO: 1237186 - protein, 23 aa, Mycobacterium
AHISGESLGGWVAARLAADHGDR

SEQ ID NO: 1237187 - protein, 21 aa, Mycobacterium
AHIVDVPGFRIGRVPVTNGEW

SEQ ID NO: 1237188 - protein, 18 aa, Mycobacterium
AHLGEHFRRAGITAEPAA

SEQ ID NO: 1237189 - protein, 21 aa, Mycobacterium
AHLGPYCWPAAIKMIESGILP

SEQ ID NO: 1237190 - protein, 20 aa, Mycobacterium
AHLHDVKTAIAWARANVDKF

SEQ ID NO: 1237191 - protein, 25 aa, Mycobacterium
AHREHFNLPALRDWLRTQREERSGA

SEQ ID NO: 1237192 - protein, 19 aa, Mycobacterium
AHRLLSMLQYRGFVRQDPA

SEQ ID NO: 1237193 - protein, 23 aa, Mycobacterium
AHRPEPTGARYAAGPIEVNRDGY

SEQ ID NO: 1237194 - protein, 20 aa, Mycobacterium
AHRRGIRVITDLVMNHTSDS

SEQ ID NO: 1237195 - protein, 22 aa, Mycobacterium
AHSELRALAGVGEMFDSLLVYE

SEQ ID NO: 1237196 - protein, 20 aa, Mycobacterium
AHSGWWDHIAPFFTRTHTVV

SEQ ID NO: 1237197 - protein, 22 aa, Mycobacterium
AHSLRELVTRTGVDPAQVDDVI

SEQ ID NO: 1237198 - protein, 17 aa, Mycobacterium
AHSSVAWNSARRDEQFK

SEQ ID NO: 1237199 - protein, 19 aa, Mycobacterium
AHTGTLWRVGFGGFAPGFA

SEQ ID NO: 1237200 - protein, 19 aa, Mycobacterium
AHTLPVLLAGADFIFSGFG

SEQ ID NO: 1237201 - protein, 20 aa, Mycobacterium
AHTNLGLAIDLQGKDGNRQL

SEQ ID NO: 1237202 - protein, 23 aa, Mycobacterium
AHTVRPAFEIIKTLPDVSTVSSI

SEQ ID NO: 1237203 - protein, 22 aa, Mycobacterium
AHVDPSMVLYLFGSKLDLFRES

SEQ ID NO: 1237204 - protein, 23 aa, Mycobacterium
AHVLGESVSAVFPVGGPTGDLVT

SEQ ID NO: 1237205 - protein, 24 aa, Mycobacterium
AHVMRRLWHGELIFNHDGPLGKYP

SEQ ID NO: 1237206 - protein, 19 aa, Mycobacterium
AHVPFPFEGGVRLAGQAQF

SEQ ID NO: 1237207 - protein, 23 aa, Mycobacterium
AHYIMECLQLMASRRATTIEVTQ

SEQ ID NO: 1237208 - protein, 24 aa, Mycobacterium
AHYPGDVFAGFGLGAAVSVLGGRV

SEQ ID NO: 1237209 - protein, 17 aa, Mycobacterium
AHYRPLFPDVPDDLPYV

SEQ ID NO: 1237210 - protein, 25 aa, Mycobacterium
AIARFKRLDGYDVRYLTGTDVHGQK

SEQ ID NO: 1237211 - protein, 25 aa, Mycobacterium
AIAVRYGDCSWTWREHLAEASRQAA

SEQ ID NO: 1237212 - protein, 19 aa, Mycobacterium
AIDAERWLAEIGVAPSDQE

SEQ ID NO: 1237213 - protein, 17 aa, Mycobacterium
AIDFNRPGIPIVASLPS

SEQ ID NO: 1237214 - protein, 25 aa, Mycobacterium
AIDGHVRAGGLGLVGACDIVVAGTG

SEQ ID NO: 1237215 - protein, 17 aa, Mycobacterium
AIDSGFDAVEVHLGHNY

SEQ ID NO: 1237216 - protein, 24 aa, Mycobacterium
AIEAARAAGLPVLRSSAPSSSVDE

SEQ ID NO: 1237217 - protein, 20 aa, Mycobacterium
AIEEMLRWTSPVKNMCRTLT

SEQ ID NO: 1237218 - protein, 25 aa, Mycobacterium
AIEGFPTPADFFAAFNAAIAGLVPG

SEQ ID NO: 1237219 - protein, 27 aa, Mycobacterium
AIEGRFMALCPYAGHMLVFGESRNFCV

SEQ ID NO: 1237220 - protein, 19 aa, Mycobacterium
AIEIGIKHLTVYAFSTENW

SEQ ID NO: 1237221 - protein, 19 aa, Mycobacterium
AIELEWVRSNAWRLDDADY

SEQ ID NO: 1237222 - protein, 20 aa, Mycobacterium
AIELPSWAFGNSGTRFKVFG

SEQ ID NO: 1237223 - protein, 25 aa, Mycobacterium
AIELTRRGVDCFVVDPLPDPPQYAK

SEQ ID NO: 1237224 - protein, 23 aa, Mycobacterium
AIEPLTRRFCVRALDSIADASRF

SEQ ID NO: 1237225 - protein, 19 aa, Mycobacterium
AIGKAAPVGLFVETFGTET

SEQ ID NO: 1237226 - protein, 25 aa, Mycobacterium
AIGLHARPAAIIAEAVVNAGVPVTL

SEQ ID NO: 1237227 - protein, 21 aa, Mycobacterium
AIGMAIRGFVPVPEIQFDGFA

SEQ ID NO: 1237228 - protein, 25 aa, Mycobacterium
AIGVRRRWRAALGYYRATVRNSRPP

SEQ ID NO: 1237229 - protein, 23 aa, Mycobacterium
AILAGEVHFAIGYSEPEAGTDLA

SEQ ID NO: 1237230 - protein, 18 aa, Mycobacterium
AILDVAGWAVPWNTDDVR

SEQ ID NO: 1237231 - protein, 26 aa, Mycobacterium
AILGPARLPGGFAVRYHPATRPLQVG

SEQ ID NO: 1237232 - protein, 20 aa, Mycobacterium
AILLGAVGWPGVPDHVSLWG

SEQ ID NO: 1237233 - protein, 24 aa, Mycobacterium
AILTARHIDCWTLGTVKKGGKDEP

SEQ ID NO: 1237234 - protein, 24 aa, Mycobacterium
AIPNARLVLFDGMGHELPEPLWDD

SEQ ID NO: 1237235 - protein, 19 aa, Mycobacterium
AIPQGWGHRGGGWTLANSV

SEQ ID NO: 1237236 - protein, 20 aa, Mycobacterium
AIQVLGGWDKLIPTLEELAG

SEQ ID NO: 1237237 - protein, 19 aa, Mycobacterium
AIQVPPNGLPVILGPDHPV

SEQ ID NO: 1237238 - protein, 31 aa, Mycobacterium
AIRSKPFDYWRLHLKTMKGQWAPFQSLVDLG

SEQ ID NO: 1237239 - protein, 26 aa, Mycobacterium
AIRTPPLPLLCGGLFAAPTAEVVGDM

SEQ ID NO: 1237240 - protein, 24 aa, Mycobacterium
AISAGLMLIWACDLIVASDDAKFS

SEQ ID NO: 1237241 - protein, 26 aa, Mycobacterium
AISEREVEGLYSIVRRLREQGVAMVY

SEQ ID NO: 1237242 - protein, 23 aa, Mycobacterium
AISLRAAFAAATRGAWRAAGVRD

SEQ ID NO: 1237243 - protein, 25 aa, Mycobacterium
AISSARTAAQFGIEPRVAMLSYSTG

SEQ ID NO: 1237244 - protein, 24 aa, Mycobacterium
AISSVGALSFKIGDLSAPKPAKPA

SEQ ID NO: 1237245 - protein, 25 aa, Mycobacterium
AITDLPEGRWEEFLGEPRIAERVAK

SEQ ID NO: 1237246 - protein, 19 aa, Mycobacterium
AITGARGSGVIGINGAAAH

SEQ ID NO: 1237247 - protein, 20 aa, Mycobacterium
AITGCLIAGVPVVPVPADVG

SEQ ID NO: 1237248 - protein, 26 aa, Mycobacterium
AITQRHLRRLWGLPGTQLGVVAWPAA

SEQ ID NO: 1237249 - protein, 26 aa, Mycobacterium
AITRAPRGEGGFGYDPVFLPEDSDRT

SEQ ID NO: 1237250 - protein, 28 aa, Mycobacterium
AIVEEFRPGPGRRLGVLVDHLVTGSKES

SEQ ID NO: 1237251 - protein, 18 aa, Mycobacterium
AIVEKWRAAGVRMADERD

SEQ ID NO: 1237252 - protein, 18 aa, Mycobacterium
AIVGHDRLLLALLLCAVR

SEQ ID NO: 1237253 - protein, 18 aa, Mycobacterium
AIVHKLRRVLSGLDSHQA

SEQ ID NO: 1237254 - protein, 18 aa, Mycobacterium
AIVLAEFGYGAVPGPFVP

SEQ ID NO: 1237255 - protein, 23 aa, Mycobacterium
AIVPRAHGSALFERGETQILGVT

SEQ ID NO: 1237256 - protein, 20 aa, Mycobacterium
AKAAAAFRHGITPIVCIGEH

SEQ ID NO: 1237257 - protein, 18 aa, Mycobacterium
AKACALEPTGMAAVLGGE

SEQ ID NO: 1237258 - protein, 27 aa, Mycobacterium
AKAEAIVHLGFGFGIVFINPALEAVNW

SEQ ID NO: 1237259 - protein, 25 aa, Mycobacterium
AKAEARTRVALALAESGWGGQLRGV

SEQ ID NO: 1237260 - protein, 21 aa, Mycobacterium
AKALAAFAVAERAKRRLIAEL

SEQ ID NO: 1237261 - protein, 19 aa, Mycobacterium
AKALAARGAHVVLAVRDTE

SEQ ID NO: 1237262 - protein, 21 aa, Mycobacterium
AKARGGITPHLLVMTATPIPR

SEQ ID NO: 1237263 - protein, 24 aa, Mycobacterium
AKARRLHQKAGLRLIVIDYLQLMT

SEQ ID NO: 1237264 - protein, 21 aa, Mycobacterium
AKARRLPVRSVDEVVAEAGLG

SEQ ID NO: 1237265 - protein, 21 aa, Mycobacterium
AKATLAALVARHGVELIAVGN

SEQ ID NO: 1237266 - protein, 19 aa, Mycobacterium
AKATLRRLYRHPASGQLVA

SEQ ID NO: 1237267 - protein, 23 aa, Mycobacterium
AKDLARLCGLNALAAVDALVGID

SEQ ID NO: 1237268 - protein, 19 aa, Mycobacterium
AKEAPGWQVTAAIDETGTH

SEQ ID NO: 1237269 - protein, 19 aa, Mycobacterium
AKEAVRIAERVFAQLARSD

SEQ ID NO: 1237270 - protein, 17 aa, Mycobacterium
AKERGLWNLFLPSESGL

SEQ ID NO: 1237271 - protein, 21 aa, Mycobacterium
AKERLGDPVLAWADIQSDPER

SEQ ID NO: 1237272 - protein, 17 aa, Mycobacterium
AKFLDKRGPGLQQFAYR

SEQ ID NO: 1237273 - protein, 26 aa, Mycobacterium
AKGHDTFCPVGPWIVTDVDPSDLELR

SEQ ID NO: 1237274 - protein, 17 aa, Mycobacterium
AKGRTAAELVDHPRRIR

SEQ ID NO: 1237275 - protein, 19 aa, Mycobacterium
AKIRTRLMPAVSIDHDPDR

SEQ ID NO: 1237276 - protein, 26 aa, Mycobacterium
AKIVAERRLWLAVLRAQIELGMGNTV

SEQ ID NO: 1237277 - protein, 19 aa, Mycobacterium
AKLALELARACTEAGVQIH

SEQ ID NO: 1237278 - protein, 17 aa, Mycobacterium
AKLLERPDVLLLDEPTN

SEQ ID NO: 1237279 - protein, 24 aa, Mycobacterium
AKLNFAVGPFASMIDRARDVIGAA

SEQ ID NO: 1237280 - protein, 20 aa, Mycobacterium
AKNPRLWRRLLQCSSATGAD

SEQ ID NO: 1237281 - protein, 23 aa, Mycobacterium
AKPKRYLAGYAVDVEDESQLPGI

SEQ ID NO: 1237282 - protein, 28 aa, Mycobacterium
AKPRELRRLKALLRRSGRVLQSAPDIAN

SEQ ID NO: 1237283 - protein, 26 aa, Mycobacterium
AKPTVVYCAGGYRSSVAASLLRQNGF

SEQ ID NO: 1237284 - protein, 28 aa, Mycobacterium
AKPVKRPRGEGQWALGYREPLNANEQSK

SEQ ID NO: 1237285 - protein, 29 aa, Mycobacterium
AKQAWAENRFDREISPIVAPVLDENKQPT

SEQ ID NO: 1237286 - protein, 25 aa, Mycobacterium
AKQVRLPGFRPGKAPRKLLEARVGR

SEQ ID NO: 1237287 - protein, 27 aa, Mycobacterium
AKRDAEWMGRVHRFLGLDVGVILSGLT

SEQ ID NO: 1237288 - protein, 22 aa, Mycobacterium
AKRKLFPGLYRLAAAGRLPEEY

SEQ ID NO: 1237289 - protein, 21 aa, Mycobacterium
AKRLPGVPIVALVETARGLER

SEQ ID NO: 1237290 - protein, 25 aa, Mycobacterium
AKRLVDFAAGLAFALRGSFDKVATK

SEQ ID NO: 1237291 - protein, 22 aa, Mycobacterium
AKRTLAVAVYNHYKRIQAGEKS

SEQ ID NO: 1237292 - protein, 19 aa, Mycobacterium
AKSDVRRKVRDGGEREMRQ

SEQ ID NO: 1237293 - protein, 17 aa, Mycobacterium
AKSGLISLVKTLGRELA

SEQ ID NO: 1237294 - protein, 23 aa, Mycobacterium
AKTAEAFRGGWFHSGDLGYYDEH

SEQ ID NO: 1237295 - protein, 19 aa, Mycobacterium
AKTEFFLGLASEIGAAIGI

SEQ ID NO: 1237296 - protein, 33 aa, Mycobacterium
AKTSWDLRNFLWAPQLGCFGIQRIHLLRDVLIL

SEQ ID NO: 1237297 - protein, 19 aa, Mycobacterium
AKTTFFSNISHEFRTPLTL

SEQ ID NO: 1237298 - protein, 18 aa, Mycobacterium
AKTWEFQALMKARPAAGD

SEQ ID NO: 1237299 - protein, 21 aa, Mycobacterium
AKVAPQHLVVVLGHDRERIAP

SEQ ID NO: 1237300 - protein, 18 aa, Mycobacterium
AKVMRIGTMIKQLLEEVR

SEQ ID NO: 1237301 - protein, 27 aa, Mycobacterium
AKVPYYRVLELAPWLNWPQPNFPVSNF

SEQ ID NO: 1237302 - protein, 18 aa, Mycobacterium
AKVRVGVRVRFATRVKDK

SEQ ID NO: 1237303 - protein, 18 aa, Mycobacterium
AKVSLRRGGRTLVGPLTW

SEQ ID NO: 1237304 - protein, 20 aa, Mycobacterium
AKVWRGETALGEKYEVEDIP

SEQ ID NO: 1237305 - protein, 30 aa, Mycobacterium
AKYKSEPWARLGVDVEHDFEPLYIISPDKK

SEQ ID NO: 1237306 - protein, 24 aa, Mycobacterium
AKYLNRLSDLLFILSRAANPDGDV

SEQ ID NO: 1237307 - protein, 20 aa, Mycobacterium
AKYRPGRPNALLGGDFYDFV

SEQ ID NO: 1237308 - protein, 22 aa, Mycobacterium
AKYTGRVGVCMATQGPGAIHLL

SEQ ID NO: 1237309 - protein, 17 aa, Mycobacterium
ALAAFGLTEPGGGSDAG

SEQ ID NO: 1237310 - protein, 17 aa, Mycobacterium
ALAAFGPIFVQLYGQGE

SEQ ID NO: 1237311 - protein, 20 aa, Mycobacterium
ALAAQGWRMLAEALADARPD

SEQ ID NO: 1237312 - protein, 26 aa, Mycobacterium
ALADCARPPAVCAISVAAQCHGLVLL

SEQ ID NO: 1237313 - protein, 22 aa, Mycobacterium
ALADDRPAPGLVRGESHDTPKT

SEQ ID NO: 1237314 - protein, 28 aa, Mycobacterium
ALADGVVRPVIFLAYSGEARWRSSAGEE

SEQ ID NO: 1237315 - protein, 17 aa, Mycobacterium
ALADRAGYVVGSDLDPV

SEQ ID NO: 1237316 - protein, 17 aa, Mycobacterium
ALADRWVRTPVRAGRGY

SEQ ID NO: 1237317 - protein, 25 aa, Mycobacterium
ALADVCAVPGLSGLYVGPADLAISM

SEQ ID NO: 1237318 - protein, 23 aa, Mycobacterium
ALAEAGLDWRQIQLVAGADTIRN

SEQ ID NO: 1237319 - protein, 17 aa, Mycobacterium
ALAEGWAVSVPDHEGPR

SEQ ID NO: 1237320 - protein, 28 aa, Mycobacterium
ALAGEIDRALTFMSACGVDDRNLQTAEI

SEQ ID NO: 1237321 - protein, 22 aa, Mycobacterium
ALAHEVRMAWCGPDVEVEGIIS

SEQ ID NO: 1237322 - protein, 17 aa, Mycobacterium
ALAMAARAHLRRKFLSA

SEQ ID NO: 1237323 - protein, 23 aa, Mycobacterium
ALAPLRLHYLRWQLFDVGSGLHF

SEQ ID NO: 1237324 - protein, 18 aa, Mycobacterium
ALARAGFHTLRLQTYLTA

SEQ ID NO: 1237325 - protein, 23 aa, Mycobacterium
ALARAMMDYLALQRKSEDVRTSY

SEQ ID NO: 1237326 - protein, 29 aa, Mycobacterium
ALARGAVYWDPLATLGFLAACTSRIRLAT

SEQ ID NO: 1237327 - protein, 18 aa, Mycobacterium
ALARKGKRAREIVYGAGL

SEQ ID NO: 1237328 - protein, 17 aa, Mycobacterium
ALARVVAQFGAPAVARC

SEQ ID NO: 1237329 - protein, 24 aa, Mycobacterium
ALASRSRRAPGFALLGEKGQVREL

SEQ ID NO: 1237330 - protein, 22 aa, Mycobacterium
ALDAHAPILLGIDGSPASESAT

SEQ ID NO: 1237331 - protein, 25 aa, Mycobacterium
ALDEARLRGCPVVVVGVRRWESHAP

SEQ ID NO: 1237332 - protein, 17 aa, Mycobacterium
ALDELAYLLGRHPDIGE

SEQ ID NO: 1237333 - protein, 23 aa, Mycobacterium
ALDESPIGLAFRKRTPVRVDRLT

SEQ ID NO: 1237334 - protein, 18 aa, Mycobacterium
ALDICTFHGGPHPAVLGR

SEQ ID NO: 1237335 - protein, 26 aa, Mycobacterium
ALDPDAWRLATLFGLLDAVAAALDGG

SEQ ID NO: 1237336 - protein, 24 aa, Mycobacterium
ALDTGGPVFGGWVVGPTAIGPEAF

SEQ ID NO: 1237337 - protein, 18 aa, Mycobacterium
ALDYARRLVGAGVATELH

SEQ ID NO: 1237338 - protein, 27 aa, Mycobacterium
ALEAAAKWREIFGPQNFFLELMDHGLD

SEQ ID NO: 1237339 - protein, 22 aa, Mycobacterium
ALEARGRGGLFRRDPDGTVTTL

SEQ ID NO: 1237340 - protein, 17 aa, Mycobacterium
ALEAVNWDPPRFTTTAF

SEQ ID NO: 1237341 - protein, 23 aa, Mycobacterium
ALEDGFRVFGELAPHPLLTHAVD

SEQ ID NO: 1237342 - protein, 25 aa, Mycobacterium
ALEEILKRFPEWDVDMANAALSPTS

SEQ ID NO: 1237343 - protein, 19 aa, Mycobacterium
ALEELRKILTDAGVEISYD

SEQ ID NO: 1237344 - protein, 17 aa, Mycobacterium
ALEGMKDGSVDIVIGTH

SEQ ID NO: 1237345 - protein, 27 aa, Mycobacterium
ALELDWYEHLGLCPKGEAEALLRSGAT

SEQ ID NO: 1237346 - protein, 18 aa, Mycobacterium
ALELTWRSLAEVGNLSSA

SEQ ID NO: 1237347 - protein, 18 aa, Mycobacterium
ALEPIGLMRRVGLGDTLR

SEQ ID NO: 1237348 - protein, 18 aa, Mycobacterium
ALEPLEVTSEWVAGETPE

SEQ ID NO: 1237349 - protein, 24 aa, Mycobacterium
ALFQMKFYAVALLRSRGVLPTRLR

SEQ ID NO: 1237350 - protein, 23 aa, Mycobacterium
ALFSPAYYRLVFGLPPLDETALT

SEQ ID NO: 1237351 - protein, 19 aa, Mycobacterium
ALFTGLIAMHGLKESDANG

SEQ ID NO: 1237352 - protein, 26 aa, Mycobacterium
ALGAAGPKRPIVFECVGLPGVIDGII

SEQ ID NO: 1237353 - protein, 18 aa, Mycobacterium
ALGAWGVRWIGELGEADL

SEQ ID NO: 1237354 - protein, 18 aa, Mycobacterium
ALGDKVARRVLETGEREE

SEQ ID NO: 1237355 - protein, 23 aa, Mycobacterium
ALGDLPLIYPFLVNDPGEGTQAK

SEQ ID NO: 1237356 - protein, 23 aa, Mycobacterium
ALGMEPYDRFWVRDEITGEEYQW

SEQ ID NO: 1237357 - protein, 24 aa, Mycobacterium
ALGTYPILGDPLMASVPTAPASTG

SEQ ID NO: 1237358 - protein, 18 aa, Mycobacterium
ALHERWGGELFWHRGSHV

SEQ ID NO: 1237359 - protein, 19 aa, Mycobacterium
ALHGAWGVRVHDVRASVDA

SEQ ID NO: 1237360 - protein, 21 aa, Mycobacterium
ALHHPCCGDLTYGADPTLARR

SEQ ID NO: 1237361 - protein, 21 aa, Mycobacterium
ALHPNRFVLGLGVSHAPLVEH

SEQ ID NO: 1237362 - protein, 21 aa, Mycobacterium
ALHPVLDRYDYVLIDCQPSLG

SEQ ID NO: 1237363 - protein, 24 aa, Mycobacterium
ALHSCAVGLPWKLLLRSRLQAVAV

SEQ ID NO: 1237364 - protein, 19 aa, Mycobacterium
ALIAGARSREEFLFSDELR

SEQ ID NO: 1237365 - protein, 25 aa, Mycobacterium
ALIPRAVDELMRFCPVIFTTIRTAR

SEQ ID NO: 1237366 - protein, 17 aa, Mycobacterium
ALIRMLREAGALEVHVR

SEQ ID NO: 1237367 - protein, 20 aa, Mycobacterium
ALLAAHRLELPWGFAMPRPS

SEQ ID NO: 1237368 - protein, 18 aa, Mycobacterium
ALLAPPVRRPEPTGRRRG

SEQ ID NO: 1237369 - protein, 26 aa, Mycobacterium
ALLARLQPRLAALVAPSFTEPDAVFA

SEQ ID NO: 1237370 - protein, 23 aa, Mycobacterium
ALLDRIAPLGIAYLHVLIDPTHT

SEQ ID NO: 1237371 - protein, 32 aa, Mycobacterium
ALLEVRDLLFARLLQYRAFKHVAVMFAELEAA

SEQ ID NO: 1237372 - protein, 18 aa, Mycobacterium
ALLGEFVPAVARLRALDP

SEQ ID NO: 1237373 - protein, 23 aa, Mycobacterium
ALLMRRLEADDVLGFTWGPEQVA

SEQ ID NO: 1237374 - protein, 21 aa, Mycobacterium
ALLRDCATALLTRHPNLRAGF

SEQ ID NO: 1237375 - protein, 29 aa, Mycobacterium
ALLRICGGADLAAMAGFCAQAAVRRTPLL

SEQ ID NO: 1237376 - protein, 22 aa, Mycobacterium
ALLSCPCGPATGGFADEYNQKF

SEQ ID NO: 1237377 - protein, 25 aa, Mycobacterium
ALLSDTRASPWLTRHPEMPEWHLHL

SEQ ID NO: 1237378 - protein, 24 aa, Mycobacterium
ALLSHLREDFGLSIILITHEMEVV

SEQ ID NO: 1237379 - protein, 24 aa, Mycobacterium
ALLSRMIADLGIEVHLDVSTDAIT

SEQ ID NO: 1237380 - protein, 18 aa, Mycobacterium
ALLVPYLLSAIRMVEAGF

SEQ ID NO: 1237381 - protein, 24 aa, Mycobacterium
ALLYRLCGDRNPLHSDPDFAAAAG

SEQ ID NO: 1237382 - protein, 19 aa, Mycobacterium
ALMLRGWSDDVVLLTDGHP

SEQ ID NO: 1237383 - protein, 17 aa, Mycobacterium
ALMTLEMGKVLAESKGE

SEQ ID NO: 1237384 - protein, 19 aa, Mycobacterium
ALNAQRHFHRYGTTRETLG

SEQ ID NO: 1237385 - protein, 25 aa, Mycobacterium
ALNMMPRWYIGSILRNVDFLCSDVP

SEQ ID NO: 1237386 - protein, 24 aa, Mycobacterium
ALPEDFRMAVYYADVEGFPYKEIA

SEQ ID NO: 1237387 - protein, 18 aa, Mycobacterium
ALPEMRRQIAADLGGRGW

SEQ ID NO: 1237388 - protein, 24 aa, Mycobacterium
ALPGARSYISLVVRMNRDNVRSTA

SEQ ID NO: 1237389 - protein, 27 aa, Mycobacterium
ALPGWYRPNPGLARDLAFIAFSTLGGE

SEQ ID NO: 1237390 - protein, 19 aa, Mycobacterium
ALPPFNQRLVNSMFTLSTL

SEQ ID NO: 1237391 - protein, 25 aa, Mycobacterium
ALPQHCPKVEHWLVIDKDDAQAPFQ

SEQ ID NO: 1237392 - protein, 18 aa, Mycobacterium
ALPRANMAAQIIEVAPGL

SEQ ID NO: 1237393 - protein, 23 aa, Mycobacterium
ALPRSECGGAQLILRTPAGLDGG

SEQ ID NO: 1237394 - protein, 23 aa, Mycobacterium
ALPSVIERKGYILVVSSLAAFAA

SEQ ID NO: 1237395 - protein, 23 aa, Mycobacterium
ALQDMLIRRAFRRAITRPVHYVP

SEQ ID NO: 1237396 - protein, 28 aa, Mycobacterium
ALQEGGRFACGGGRPADRDTGFFIEPTV

SEQ ID NO: 1237397 - protein, 20 aa, Mycobacterium
ALQGALLVRHGHPAVAEAFL

SEQ ID NO: 1237398 - protein, 18 aa, Mycobacterium
ALQLAPGDWVLVTRPDGT

SEQ ID NO: 1237399 - protein, 18 aa, Mycobacterium
ALQLPLWGGVGEEDRLRA

SEQ ID NO: 1237400 - protein, 26 aa, Mycobacterium
ALQTEFDFRFLVGVVSVMGDKDVDGI

SEQ ID NO: 1237401 - protein, 17 aa, Mycobacterium
ALRADIDTLVLVSNCPQ

SEQ ID NO: 1237402 - protein, 25 aa, Mycobacterium
ALRAVLRPGDHLVIPDDAYGGTFRL

SEQ ID NO: 1237403 - protein, 21 aa, Mycobacterium
ALRAWPTPLGVAINSADPIWD

SEQ ID NO: 1237404 - protein, 26 aa, Mycobacterium
ALRRRLEKQTGLSLPPTLLWEYPTAA

SEQ ID NO: 1237405 - protein, 23 aa, Mycobacterium
ALRSELFPLATLVTPNLDEVRLI

SEQ ID NO: 1237406 - protein, 20 aa, Mycobacterium
ALRYLDGRDALFAGRIADRR

SEQ ID NO: 1237407 - protein, 23 aa, Mycobacterium
ALSALRPGDPVLVQRNAHKSVLA

SEQ ID NO: 1237408 - protein, 23 aa, Mycobacterium
ALSDSLLRVGRRVPVTTVVVDTP

SEQ ID NO: 1237409 - protein, 17 aa, Mycobacterium
ALSEGGTGWIPYFLDRV

SEQ ID NO: 1237410 - protein, 26 aa, Mycobacterium
ALSEVGVRLLRHWAVSLGAAEDTFDA

SEQ ID NO: 1237411 - protein, 24 aa, Mycobacterium
ALSGLRPAPDIIAITSERDLEMVR

SEQ ID NO: 1237412 - protein, 26 aa, Mycobacterium
ALSGMEFCTAYALAPEWGTHTKGRML

SEQ ID NO: 1237413 - protein, 17 aa, Mycobacterium
ALSTLVVNAIRKTLKAV

SEQ ID NO: 1237414 - protein, 18 aa, Mycobacterium
ALTAGHRRDAGWGDATDF

SEQ ID NO: 1237415 - protein, 27 aa, Mycobacterium
ALTAGILRYSRDLAFAAASAYADAAEA

SEQ ID NO: 1237416 - protein, 19 aa, Mycobacterium
ALTALGWPPKIRRLPNPDD

SEQ ID NO: 1237417 - protein, 18 aa, Mycobacterium
ALTAPAPHHTRPVRFVWV

SEQ ID NO: 1237418 - protein, 20 aa, Mycobacterium
ALTAVCRRHGIPLLADGAHS

SEQ ID NO: 1237419 - protein, 24 aa, Mycobacterium
ALTGARYVGWQGLLDAQREYLDEF

SEQ ID NO: 1237420 - protein, 20 aa, Mycobacterium
ALTGGMCWEALNNIAAARRP

SEQ ID NO: 1237421 - protein, 17 aa, Mycobacterium
ALTLAREGAAVVVNDLG

SEQ ID NO: 1237422 - protein, 26 aa, Mycobacterium
ALTLIPDHHICVVFTRQIVDTVPQAF

SEQ ID NO: 1237423 - protein, 24 aa, Mycobacterium
ALTRAQSQVVAWWAPSWDEPNGGL

SEQ ID NO: 1237424 - protein, 25 aa, Mycobacterium
ALTRRPALAFGPQWLNRILVATSRK

SEQ ID NO: 1237425 - protein, 17 aa, Mycobacterium
ALTVPGYGWRHHPAAAM

SEQ ID NO: 1237426 - protein, 17 aa, Mycobacterium
ALVALHRQIKFVAVTEV

SEQ ID NO: 1237427 - protein, 25 aa, Mycobacterium
ALVIGCGPIGMAIIAALRLRGVEHV

SEQ ID NO: 1237428 - protein, 18 aa, Mycobacterium
ALVIKGGYMEGRALSIDE

SEQ ID NO: 1237429 - protein, 17 aa, Mycobacterium
ALVLLERFPVPVLAIAE

SEQ ID NO: 1237430 - protein, 28 aa, Mycobacterium
ALVTKAAVEPVWWLPGVAQRFGCSETDL

SEQ ID NO: 1237431 - protein, 17 aa, Mycobacterium
ALVYRAGVHVLFGEFNT

SEQ ID NO: 1237432 - protein, 23 aa, Mycobacterium
ALWACSLAAGAHMRERGSGSIVN

SEQ ID NO: 1237433 - protein, 19 aa, Mycobacterium
ALWTVRRITDGGGSARVQI

SEQ ID NO: 1237434 - protein, 19 aa, Mycobacterium
ALYELGMTGIPVVNVNNNC

SEQ ID NO: 1237435 - protein, 17 aa, Mycobacterium
ALYPDRLTHAGAVEQVR

SEQ ID NO: 1237436 - protein, 19 aa, Mycobacterium
ALYTWARPPGYTGPPPPLS

SEQ ID NO: 1237437 - protein, 29 aa, Mycobacterium
AMAGGRLALGVGPSHHWIVRDMLGLPYEK

SEQ ID NO: 1237438 - protein, 19 aa, Mycobacterium
AMAGLRFAAASADNVREAE

SEQ ID NO: 1237439 - protein, 19 aa, Mycobacterium
AMAGPLMAMMSQMGGMAFG

SEQ ID NO: 1237440 - protein, 23 aa, Mycobacterium
AMALRAAEYGRTVVVLTIDPAKR

SEQ ID NO: 1237441 - protein, 18 aa, Mycobacterium
AMAQCLRGGSADEVATLV

SEQ ID NO: 1237442 - protein, 20 aa, Mycobacterium
AMARRGCVYVSVNYRLGPLG

SEQ ID NO: 1237443 - protein, 20 aa, Mycobacterium
AMDGLSRWYAGELTDPGHEL

SEQ ID NO: 1237444 - protein, 19 aa, Mycobacterium
AMDLCKINQFVAIRDKELR

SEQ ID NO: 1237445 - protein, 25 aa, Mycobacterium
AMDWNLDTGYDWAHRFDDAAREVIL

SEQ ID NO: 1237446 - protein, 21 aa, Mycobacterium
AMENVREGLPLAYMMDDCRER

SEQ ID NO: 1237447 - protein, 17 aa, Mycobacterium
AMEWYYPVLCGALRGAA

SEQ ID NO: 1237448 - protein, 26 aa, Mycobacterium
AMFYPEFSLWCGTTATADWHTRYNAS

SEQ ID NO: 1237449 - protein, 24 aa, Mycobacterium
AMGAVGFISVWGHFAASQLREMLS

SEQ ID NO: 1237450 - protein, 20 aa, Mycobacterium
AMHALGIPTTRSLAVVATGR

SEQ ID NO: 1237451 - protein, 21 aa, Mycobacterium
AMHFVPSLLGLFLSLPGVNQW

SEQ ID NO: 1237452 - protein, 23 aa, Mycobacterium
AMIRAFAPILARNGGGAILNVLS

SEQ ID NO: 1237453 - protein, 29 aa, Mycobacterium
AMKECHGLQCGFCTPGFVTSITALLADNP

SEQ ID NO: 1237454 - protein, 18 aa, Mycobacterium
AMLGKTFSTVRTGVIRDI

SEQ ID NO: 1237455 - protein, 26 aa, Mycobacterium
AMLLRVGDRFGWAGGDLVLIGTVGDD

SEQ ID NO: 1237456 - protein, 23 aa, Mycobacterium
AMPRPRTIHDFYGFPQELFDVQY

SEQ ID NO: 1237457 - protein, 22 aa, Mycobacterium
AMQACLPYYVELYEKMKADGAK

SEQ ID NO: 1237458 - protein, 25 aa, Mycobacterium
AMQKMAFEVAWRILQVTPINATALV

SEQ ID NO: 1237459 - protein, 18 aa, Mycobacterium
AMRAVLRLLEIRRAIRTI

SEQ ID NO: 1237460 - protein, 22 aa, Mycobacterium
AMREGFAFVALGRALLREPDLV

SEQ ID NO: 1237461 - protein, 18 aa, Mycobacterium
AMRKRGVTDFSLAMIDPW

SEQ ID NO: 1237462 - protein, 20 aa, Mycobacterium
AMRPVNRYLLATIHGAGGPF

SEQ ID NO: 1237463 - protein, 24 aa, Mycobacterium
AMSATFRRDGWYPVVGEAIGGLGA

SEQ ID NO: 1237464 - protein, 24 aa, Mycobacterium
AMSVLAVAALRFAHNGDDPAAVTD

SEQ ID NO: 1237465 - protein, 17 aa, Mycobacterium
AMTGITLTLRDFRVGDL

SEQ ID NO: 1237466 - protein, 17 aa, Mycobacterium
AMTHHVFHVAGAHEKKA

SEQ ID NO: 1237467 - protein, 20 aa, Mycobacterium
AMTPWVWPTMHLNPPEWIMP

SEQ ID NO: 1237468 - protein, 27 aa, Mycobacterium
AMVDHCLGVVFYPVIPLGSWVATTEFK

SEQ ID NO: 1237469 - protein, 17 aa, Mycobacterium
AMVGCPIIGINDSGGAR

SEQ ID NO: 1237470 - protein, 24 aa, Mycobacterium
AMVPEDRKLSGVVLSMSVLDNGSL

SEQ ID NO: 1237471 - protein, 18 aa, Mycobacterium
ANAALDFDRTAARGHRLD

SEQ ID NO: 1237472 - protein, 24 aa, Mycobacterium
ANARRAVHYAGRFLSANRAVVLTV

SEQ ID NO: 1237473 - protein, 20 aa, Mycobacterium
ANAYLGAWGIVDCLDAGADV

SEQ ID NO: 1237474 - protein, 19 aa, Mycobacterium
ANDHPFLYPRLVCPVCHDG

SEQ ID NO: 1237475 - protein, 19 aa, Mycobacterium
ANEIARCRDLTDKPFGVNL

SEQ ID NO: 1237476 - protein, 18 aa, Mycobacterium
ANEKITFMTNTAVTEIEG

SEQ ID NO: 1237477 - protein, 26 aa, Mycobacterium
ANFAAGRLSYFLGVRGPAVVVDTACS

SEQ ID NO: 1237478 - protein, 23 aa, Mycobacterium
ANHPPMRTFLGVPVRIRDEVYGN

SEQ ID NO: 1237479 - protein, 30 aa, Mycobacterium
ANIAPWLRAANRYGAKIKWAEVDIETGELP

SEQ ID NO: 1237480 - protein, 24 aa, Mycobacterium
ANIEADPRVCLIVDHYSDDWGQLW

SEQ ID NO: 1237481 - protein, 31 aa, Mycobacterium
ANKGVRFSYRWDFGRNRFIMMDSRNGRILDS

SEQ ID NO: 1237482 - protein, 22 aa, Mycobacterium
ANKRPEVVRVYLPPDANTLLSV

SEQ ID NO: 1237483 - protein, 25 aa, Mycobacterium
ANLKCLCRLHHLLKTFGGWKDQQLP

SEQ ID NO: 1237484 - protein, 18 aa, Mycobacterium
ANLPRLVAHESYPGHHTE

SEQ ID NO: 1237485 - protein, 17 aa, Mycobacterium
ANLSRFLVQQAVGLVAV

SEQ ID NO: 1237486 - protein, 19 aa, Mycobacterium
ANMGEAWWVPIVQIPGDTI

SEQ ID NO: 1237487 - protein, 27 aa, Mycobacterium
ANNEFRPEILLSFGFVPKVESRVGLIN

SEQ ID NO: 1237488 - protein, 21 aa, Mycobacterium
ANNPLRLGGCLNSESAEKAAR

SEQ ID NO: 1237489 - protein, 25 aa, Mycobacterium
ANPTPKSCVFEYVYLARPDSTLAGR

SEQ ID NO: 1237490 - protein, 20 aa, Mycobacterium
ANPTVAAWTRLVGERTAESP

SEQ ID NO: 1237491 - protein, 26 aa, Mycobacterium
ANPYLIPVLRISGIDQLATVEPAQPT

SEQ ID NO: 1237492 - protein, 18 aa, Mycobacterium
ANRPVRRPDLTIATEDHN

SEQ ID NO: 1237493 - protein, 20 aa, Mycobacterium
ANSAEGWDMALTSTRDLFAE

SEQ ID NO: 1237494 - protein, 26 aa, Mycobacterium
ANTAAWAGALGRNVCAVPGPVTSGAS

SEQ ID NO: 1237495 - protein, 24 aa, Mycobacterium
ANTISFAGAEAFRDAEDGPKGNVN

SEQ ID NO: 1237496 - protein, 25 aa, Mycobacterium
ANVARATLYRHFPSANDLLAAAFQS

SEQ ID NO: 1237497 - protein, 18 aa, Mycobacterium
ANVEAWLVTIAHRRALDV

SEQ ID NO: 1237498 - protein, 26 aa, Mycobacterium
ANVLRNLWAYVVIFCGHFPDGADKFD

SEQ ID NO: 1237499 - protein, 17 aa, Mycobacterium
ANVTWEFLSVFGRKAQR

SEQ ID NO: 1237500 - protein, 22 aa, Mycobacterium
ANYRSAPEFMFPTPLDDAFDVY

SEQ ID NO: 1237501 - protein, 21 aa, Mycobacterium
APADRLEMMLAGKPIRLHPDR

SEQ ID NO: 1237502 - protein, 22 aa, Mycobacterium
APAEGWDDFARWLTTESPAPSP

SEQ ID NO: 1237503 - protein, 18 aa, Mycobacterium
APAGYPFQLGNRRHRHSM

SEQ ID NO: 1237504 - protein, 22 aa, Mycobacterium
APAMHTEMWFHPATVDNVATLR

SEQ ID NO: 1237505 - protein, 18 aa, Mycobacterium
APAMTRRMLKAVANPHTD

SEQ ID NO: 1237506 - protein, 23 aa, Mycobacterium
APAPEVVRLLTAVTAGLPFLLRP

SEQ ID NO: 1237507 - protein, 27 aa, Mycobacterium
APAQMAAVWRGKWHGGLEFTAKCCAPI

SEQ ID NO: 1237508 - protein, 20 aa, Mycobacterium
APAQRRGRIGMVLQNPDSQV

SEQ ID NO: 1237509 - protein, 18 aa, Mycobacterium
APARAMIFDSVYDIYRGV

SEQ ID NO: 1237510 - protein, 18 aa, Mycobacterium
APARGWLLGEVHDGIAQM

SEQ ID NO: 1237511 - protein, 19 aa, Mycobacterium
APAVARCGHRLEHLEMVTT

SEQ ID NO: 1237512 - protein, 17 aa, Mycobacterium
APAVRRVILKSTSEVYG

SEQ ID NO: 1237513 - protein, 25 aa, Mycobacterium
APAVVRAWADWCGGLPETVNTSIAL

SEQ ID NO: 1237514 - protein, 19 aa, Mycobacterium
APCRWRSAAPLWGDASFAS

SEQ ID NO: 1237515 - protein, 24 aa, Mycobacterium
APDDRRLQLVAAVWGAIMMAALAD

SEQ ID NO: 1237516 - protein, 27 aa, Mycobacterium
APDGARVPISIVHRAGLQFPAPTLLYG

SEQ ID NO: 1237517 - protein, 25 aa, Mycobacterium
APDIDIRFGIGWGQVTVLDTETGIQ

SEQ ID NO: 1237518 - protein, 24 aa, Mycobacterium
APDMEILGNLGLIIGGGFDTTTAL

SEQ ID NO: 1237519 - protein, 24 aa, Mycobacterium
APDMRDWVACLVRPLTDHLAELGN

SEQ ID NO: 1237520 - protein, 19 aa, Mycobacterium
APDVARSVTIWAANPANGD

SEQ ID NO: 1237521 - protein, 23 aa, Mycobacterium
APDVIRLAPPLVVTEAQIDDFLG

SEQ ID NO: 1237522 - protein, 18 aa, Mycobacterium
APECELVIVVGSKNSSNS

SEQ ID NO: 1237523 - protein, 24 aa, Mycobacterium
APEHRELWRVGSLLKAHVRVAFST

SEQ ID NO: 1237524 - protein, 24 aa, Mycobacterium
APENFRMLMTLMVEAPFLLIRAAL

SEQ ID NO: 1237525 - protein, 21 aa, Mycobacterium
APEPGPAMLGDIVLCPEFAAK

SEQ ID NO: 1237526 - protein, 21 aa, Mycobacterium
APERDVCLIPSSAHGTNAASA

SEQ ID NO: 1237527 - protein, 26 aa, Mycobacterium
APERKDVAALARWLADGHFILIGCQR

SEQ ID NO: 1237528 - protein, 22 aa, Mycobacterium
APESIEGFMAFKERRSPDWVHP

SEQ ID NO: 1237529 - protein, 19 aa, Mycobacterium
APESVFPTIERWPAESVRH

SEQ ID NO: 1237530 - protein, 19 aa, Mycobacterium
APFRAGRSARNYAHLVAER

SEQ ID NO: 1237531 - protein, 19 aa, Mycobacterium
APFTGLKPAGLDVGPVIPL

SEQ ID NO: 1237532 - protein, 17 aa, Mycobacterium
APFVEPIPTLGYHERMP

SEQ ID NO: 1237533 - protein, 18 aa, Mycobacterium
APGACVVVNPCLSGGALE

SEQ ID NO: 1237534 - protein, 25 aa, Mycobacterium
APGARLAWREDARWAPHGGESRVDV

SEQ ID NO: 1237535 - protein, 17 aa, Mycobacterium
APGGIVFALSNPDPEIH

SEQ ID NO: 1237536 - protein, 18 aa, Mycobacterium
APGLGKMKINGVYGSVHL

SEQ ID NO: 1237537 - protein, 24 aa, Mycobacterium
APGLPGPVAPCYHAAYNAETGAFD

SEQ ID NO: 1237538 - protein, 18 aa, Mycobacterium
APGYIWGETLKSYFNHQA

SEQ ID NO: 1237539 - protein, 19 aa, Mycobacterium
APHCLRVMIELQGDGDTDT

SEQ ID NO: 1237540 - protein, 25 aa, Mycobacterium
APHVWAIGDVASWLDTIGNQVRVEH

SEQ ID NO: 1237541 - protein, 24 aa, Mycobacterium
APIASELILPIALAVQNRISVTDL

SEQ ID NO: 1237542 - protein, 18 aa, Mycobacterium
APIEGRLSGVVDIPNACA

SEQ ID NO: 1237543 - protein, 23 aa, Mycobacterium
APIKDPRTGHVIGVVDVSGPAAT

SEQ ID NO: 1237544 - protein, 26 aa, Mycobacterium
APILLYRCGLGFMLGDRFLMLEHVGR

SEQ ID NO: 1237545 - protein, 18 aa, Mycobacterium
APIPLTFADVAVVARRTR

SEQ ID NO: 1237546 - protein, 17 aa, Mycobacterium
APLARAEGRVLLERLLA

SEQ ID NO: 1237547 - protein, 29 aa, Mycobacterium
APLARMEMRIAFPALLRRFPTLTLAEPFE

SEQ ID NO: 1237548 - protein, 17 aa, Mycobacterium
APLDRRLLLAVLADLPA

SEQ ID NO: 1237549 - protein, 19 aa, Mycobacterium
APLFEALRRFVERDQAPFY

SEQ ID NO: 1237550 - protein, 21 aa, Mycobacterium
APLLLPRVVASVFEIDPRCRR

SEQ ID NO: 1237551 - protein, 24 aa, Mycobacterium
APLLYPHMWSWDAAFVAIGLAPLS

SEQ ID NO: 1237552 - protein, 23 aa, Mycobacterium
APLPDTVAAFWALVKAGWDVEVA

SEQ ID NO: 1237553 - protein, 23 aa, Mycobacterium
APLRARVAAIIDVLFDGLSAPDS

SEQ ID NO: 1237554 - protein, 26 aa, Mycobacterium
APLSSSQLRSWFAYRVDGPSVVNNIP

SEQ ID NO: 1237555 - protein, 22 aa, Mycobacterium
APLTKRRAMAFVSIPMAEVKTV

SEQ ID NO: 1237556 - protein, 17 aa, Mycobacterium
APMGVARNGLIAKASAT

SEQ ID NO: 1237557 - protein, 20 aa, Mycobacterium
APNFAYALLAKRLRRQAKPG

SEQ ID NO: 1237558 - protein, 20 aa, Mycobacterium
APNLRGRINMASMAAAEMNH

SEQ ID NO: 1237559 - protein, 20 aa, Mycobacterium
APNSLNWALAEFVLGANPAL

SEQ ID NO: 1237560 - protein, 20 aa, Mycobacterium
APPARELDMLLTAGERISNA

SEQ ID NO: 1237561 - protein, 19 aa, Mycobacterium
APPDWAFGGTASYEADPTP

SEQ ID NO: 1237562 - protein, 23 aa, Mycobacterium
APPEGFQPPVLWGTEEHVRELLG

SEQ ID NO: 1237563 - protein, 32 aa, Mycobacterium
APPHGGIAFGWDRITALLARMDSIREVIAFPK

SEQ ID NO: 1237564 - protein, 19 aa, Mycobacterium
APPISCAWQTSRKAVVVNS

SEQ ID NO: 1237565 - protein, 17 aa, Mycobacterium
APPLQRLLAFTGRRAEV

SEQ ID NO: 1237566 - protein, 20 aa, Mycobacterium
APPLSFSLRGRGRAPKRSDV

SEQ ID NO: 1237567 - protein, 22 aa, Mycobacterium
APPRAVPRARLFPTGPVSADAV

SEQ ID NO: 1237568 - protein, 20 aa, Mycobacterium
APPTVWRMLIQSDLGTKPAG

SEQ ID NO: 1237569 - protein, 18 aa, Mycobacterium
APQRIALSTGSPFPGPAT

SEQ ID NO: 1237570 - protein, 19 aa, Mycobacterium
APQRVAIDRVLSRADDTGP

SEQ ID NO: 1237571 - protein, 18 aa, Mycobacterium
APRGLLYHRYEIGDDGLV

SEQ ID NO: 1237572 - protein, 18 aa, Mycobacterium
APRVCARLGVDMPLACVL

SEQ ID NO: 1237573 - protein, 25 aa, Mycobacterium
APTRANAPLISWDRAFGLVKINPIA

SEQ ID NO: 1237574 - protein, 24 aa, Mycobacterium
APTTLRFEPGITCVVGPNGSGKSN

SEQ ID NO: 1237575 - protein, 25 aa, Mycobacterium
APTYRWPMVPALALLAAMPALGSAE

SEQ ID NO: 1237576 - protein, 18 aa, Mycobacterium
APVAAHWIADRQVAPGLL

SEQ ID NO: 1237577 - protein, 25 aa, Mycobacterium
APVERADYLPLFVAPQPVRFEPADE

SEQ ID NO: 1237578 - protein, 19 aa, Mycobacterium
APVGPVLAESLGLPVSVAS

SEQ ID NO: 1237579 - protein, 25 aa, Mycobacterium
APVPELRSGGLGVRDLKRLVKATGI

SEQ ID NO: 1237580 - protein, 25 aa, Mycobacterium
APVQVDTWGGWLFVNMDPDCEPLMD

SEQ ID NO: 1237581 - protein, 17 aa, Mycobacterium
APVRERLALGFGSSTFR

SEQ ID NO: 1237582 - protein, 24 aa, Mycobacterium
APVRGSAGPLGWFYSANHSPSVVE

SEQ ID NO: 1237583 - protein, 20 aa, Mycobacterium
APWVPRSRSHVVTFPHDLTD

SEQ ID NO: 1237584 - protein, 31 aa, Mycobacterium
AQAAQLLGPRGRRWLNKKLGLDNVFLDFDTA

SEQ ID NO: 1237585 - protein, 22 aa, Mycobacterium
AQAPGGLSCFFLPRILPDGTRN

SEQ ID NO: 1237586 - protein, 17 aa, Mycobacterium
AQAQRIAMGRGWLQLAG

SEQ ID NO: 1237587 - protein, 24 aa, Mycobacterium
AQARDPRPVLGLPPDAVTSPAADL

SEQ ID NO: 1237588 - protein, 18 aa, Mycobacterium
AQATLGFTAAPPLTGIGV

SEQ ID NO: 1237589 - protein, 18 aa, Mycobacterium
AQEPWVLRKSEAVHDQVR

SEQ ID NO: 1237590 - protein, 18 aa, Mycobacterium
AQEQAKCLEELRFEARAA

SEQ ID NO: 1237591 - protein, 19 aa, Mycobacterium
AQFAEGLGFAGVLSGPLVR

SEQ ID NO: 1237592 - protein, 18 aa, Mycobacterium
AQFAEWDVRIVPRDQVQR

SEQ ID NO: 1237593 - protein, 18 aa, Mycobacterium
AQFGHTWDATRLAGQAAL

SEQ ID NO: 1237594 - protein, 23 aa, Mycobacterium
AQFIRAGAIIQLLLGNIGRPGGG

SEQ ID NO: 1237595 - protein, 22 aa, Mycobacterium
AQFRRVLVAPAIRVGAAVLSCD

SEQ ID NO: 1237596 - protein, 18 aa, Mycobacterium
AQHLHSTFAPLFRAGGVG

SEQ ID NO: 1237597 - protein, 20 aa, Mycobacterium
AQHLLDIAVEYAKSRLQFGR

SEQ ID NO: 1237598 - protein, 18 aa, Mycobacterium
AQHRYSFINVRRLVTAGT

SEQ ID NO: 1237599 - protein, 24 aa, Mycobacterium
AQHTRRLKYLVAFRPGVLSPTLAA

SEQ ID NO: 1237600 - protein, 17 aa, Mycobacterium
AQIAAGMDPDLHRRDLA

SEQ ID NO: 1237601 - protein, 27 aa, Mycobacterium
AQIYAWRKGIKTLYYIRLRQMALEGTE

SEQ ID NO: 1237602 - protein, 25 aa, Mycobacterium
AQKLPAWVGGTWRRAAVLRYGENPH

SEQ ID NO: 1237603 - protein, 17 aa, Mycobacterium
AQLAAIVDWEMGTVGDP

SEQ ID NO: 1237604 - protein, 20 aa, Mycobacterium
AQLACGFASAIDGRVDKIVE

SEQ ID NO: 1237605 - protein, 23 aa, Mycobacterium
AQLAEVRKSGFAISRQESEEGVA

SEQ ID NO: 1237606 - protein, 19 aa, Mycobacterium
AQLARASVMALSYVAQSAR

SEQ ID NO: 1237607 - protein, 19 aa, Mycobacterium
AQLDGWQSYPDCVADKPDT

SEQ ID NO: 1237608 - protein, 23 aa, Mycobacterium
AQLLWSFAPARRGRPAGLSEVPA

SEQ ID NO: 1237609 - protein, 19 aa, Mycobacterium
AQLMVGITHVQRGNVDGAR

SEQ ID NO: 1237610 - protein, 19 aa, Mycobacterium
AQLRFLAAEGVDLIVTSGG

SEQ ID NO: 1237611 - protein, 24 aa, Mycobacterium
AQLRGELLRLIGLVETLIRADPSL

SEQ ID NO: 1237612 - protein, 26 aa, Mycobacterium
AQLTRPVRWDLCTATMRQRFENAENA

SEQ ID NO: 1237613 - protein, 17 aa, Mycobacterium
AQLTRYVPALARSGYAG

SEQ ID NO: 1237614 - protein, 26 aa, Mycobacterium
AQMARTCVDAGWLLSLSGTVSFRNAH

SEQ ID NO: 1237615 - protein, 23 aa, Mycobacterium
AQMFPGRFWAALGSGEASNERIT

SEQ ID NO: 1237616 - protein, 33 aa, Mycobacterium
AQMMFDLPPSWFAWWARQGMRTSLRYKVPPMPF

SEQ ID NO: 1237617 - protein, 24 aa, Mycobacterium
AQNGAFNLGFGDITLGDKTTQTAT

SEQ ID NO: 1237618 - protein, 20 aa, Mycobacterium
AQPRDVVPVLALFDHEEVGS

SEQ ID NO: 1237619 - protein, 23 aa, Mycobacterium
AQPRTLHALLMLWTDRLDEAADQ

SEQ ID NO: 1237620 - protein, 23 aa, Mycobacterium
AQRAKEVGLVWRLVEPENLQAEA

SEQ ID NO: 1237621 - protein, 18 aa, Mycobacterium
AQRDWDRIAPILTSRAAF

SEQ ID NO: 1237622 - protein, 19 aa, Mycobacterium
AQRGLQVVGGRGSGAVMVL

SEQ ID NO: 1237623 - protein, 22 aa, Mycobacterium
AQRMADGLVHLHLADGSGASAD

SEQ ID NO: 1237624 - protein, 25 aa, Mycobacterium
AQRMIDYTGLRVCEYLPGRAVVMLM

SEQ ID NO: 1237625 - protein, 27 aa, Mycobacterium
AQRPRSSADLPDWARRWQRLLFDNGWL

SEQ ID NO: 1237626 - protein, 20 aa, Mycobacterium
AQSLHAYFVRGGKYGIDVEL

SEQ ID NO: 1237627 - protein, 17 aa, Mycobacterium
AQSSFEFERPLTGMEIE

SEQ ID NO: 1237628 - protein, 31 aa, Mycobacterium
AQSYPFGRICTPADIAGAVAYLVSADADYVT

SEQ ID NO: 1237629 - protein, 21 aa, Mycobacterium
AQTARMAAVFAQLITHEDGKP

SEQ ID NO: 1237630 - protein, 22 aa, Mycobacterium
AQVCRDQHRIGGYRRCPHGKQL

SEQ ID NO: 1237631 - protein, 25 aa, Mycobacterium
AQVEALRRCVPLVSRIRDYALRDEY

SEQ ID NO: 1237632 - protein, 25 aa, Mycobacterium
AQWIVRVVVSLAYWPDPDPRQEEQL

SEQ ID NO: 1237633 - protein, 20 aa, Mycobacterium
AQWLYLMLMSSPSRNAAGIV

SEQ ID NO: 1237634 - protein, 19 aa, Mycobacterium
AQYERAWGTIEELKEKDEA

SEQ ID NO: 1237635 - protein, 17 aa, Mycobacterium
AQYYRRRFRHILVDEYQ

SEQ ID NO: 1237636 - protein, 19 aa, Mycobacterium
ARAAIPFTPLNYRLSREGL

SEQ ID NO: 1237637 - protein, 18 aa, Mycobacterium
ARAALALLLRLVERSDVA

SEQ ID NO: 1237638 - protein, 21 aa, Mycobacterium
ARAAYEYALDYACQREQFGRK

SEQ ID NO: 1237639 - protein, 27 aa, Mycobacterium
ARACGVGLRAFELAVRYAQQRHTFGKP

SEQ ID NO: 1237640 - protein, 22 aa, Mycobacterium
ARADLKRFVFLSTIGTIAVGAD

SEQ ID NO: 1237641 - protein, 17 aa, Mycobacterium
ARADMPALLRSADVVAC

SEQ ID NO: 1237642 - protein, 17 aa, Mycobacterium
ARAFLEFAGRHHIEVTT

SEQ ID NO: 1237643 - protein, 19 aa, Mycobacterium
ARAFSGVKIACVGQATAER

SEQ ID NO: 1237644 - protein, 17 aa, Mycobacterium
ARAITIAAFANKVTLGF

SEQ ID NO: 1237645 - protein, 19 aa, Mycobacterium
ARAKFKRKGSDLLVVNAVG

SEQ ID NO: 1237646 - protein, 20 aa, Mycobacterium
ARALIAAGWRVYLTGRTVDS

SEQ ID NO: 1237647 - protein, 25 aa, Mycobacterium
ARALIAVRGLHRFATAEGLTDVDVA

SEQ ID NO: 1237648 - protein, 19 aa, Mycobacterium
ARALRFWEVMYPSPPPGLA

SEQ ID NO: 1237649 - protein, 18 aa, Mycobacterium
ARALVRTPAVFLFDEPLS

SEQ ID NO: 1237650 - protein, 23 aa, Mycobacterium
ARANARGLVVVRMGSETKGNEGV

SEQ ID NO: 1237651 - protein, 20 aa, Mycobacterium
ARAPAARTLDGWRRRHPDLE

SEQ ID NO: 1237652 - protein, 17 aa, Mycobacterium
ARAPSVYIVERIRDGGS

SEQ ID NO: 1237653 - protein, 20 aa, Mycobacterium
ARAQALMRLREWDAQPHRAH

SEQ ID NO: 1237654 - protein, 22 aa, Mycobacterium
ARAQLEAGMGLRTLIHMDDPHH

SEQ ID NO: 1237655 - protein, 26 aa, Mycobacterium
ARAQLKPLVFEGSQFGGALMTTTEVE

SEQ ID NO: 1237656 - protein, 17 aa, Mycobacterium
ARARAWLADNMPRIDPD

SEQ ID NO: 1237657 - protein, 25 aa, Mycobacterium
ARASETWRFPPFFHALLDAGVYPPP

SEQ ID NO: 1237658 - protein, 19 aa, Mycobacterium
ARASIPVRLVESAGQLGGL

SEQ ID NO: 1237659 - protein, 24 aa, Mycobacterium
ARAVEVVERLWLYALWGGSDLRHT

SEQ ID NO: 1237660 - protein, 25 aa, Mycobacterium
ARAWTAVIRKLLAQYGEFDRSTAAA

SEQ ID NO: 1237661 - protein, 20 aa, Mycobacterium
ARAYLATGLLALGKTRLSEF

SEQ ID NO: 1237662 - protein, 19 aa, Mycobacterium
ARCATPGPHRAFHVAAGGS

SEQ ID NO: 1237663 - protein, 24 aa, Mycobacterium
ARCERELKAGGVHVVRGPRGHAEL

SEQ ID NO: 1237664 - protein, 24 aa, Mycobacterium
ARDATQIFGGYGFMNEYPVARHYR

SEQ ID NO: 1237665 - protein, 21 aa, Mycobacterium
ARDAVMLGLNGHRWGLGRASR

SEQ ID NO: 1237666 - protein, 24 aa, Mycobacterium
ARDCADRSSAVLVELACDTELSAA

SEQ ID NO: 1237667 - protein, 19 aa, Mycobacterium
ARDEKLLAWIRAAHATTTW

SEQ ID NO: 1237668 - protein, 17 aa, Mycobacterium
ARDEWLAARRDLTDRRR

SEQ ID NO: 1237669 - protein, 18 aa, Mycobacterium
ARDGIDWRDLGAREIQLF

SEQ ID NO: 1237670 - protein, 21 aa, Mycobacterium
ARDLLRNAVLSFLTYIDTNRA

SEQ ID NO: 1237671 - protein, 24 aa, Mycobacterium
ARDLPCHTGVRLLGGSSHALGRVN

SEQ ID NO: 1237672 - protein, 22 aa, Mycobacterium
ARDRARRCLVVVLTDGRATGGP

SEQ ID NO: 1237673 - protein, 18 aa, Mycobacterium
ARDSAPSLVFLDEIDALA

SEQ ID NO: 1237674 - protein, 27 aa, Mycobacterium
ARDWQRLLFDNGWLLPAQPPEFGGRNA

SEQ ID NO: 1237675 - protein, 23 aa, Mycobacterium
ARDYWIPFDRFRALDRVRTEHAT

SEQ ID NO: 1237676 - protein, 23 aa, Mycobacterium
AREAEFWTAPDFSRTCMPQPVPG

SEQ ID NO: 1237677 - protein, 17 aa, Mycobacterium
AREGGLESVLWAGPEQV

SEQ ID NO: 1237678 - protein, 17 aa, Mycobacterium
AREGLADALAEFAAAAG

SEQ ID NO: 1237679 - protein, 24 aa, Mycobacterium
AREGLRPFIFALWDMVRTYREAQP

SEQ ID NO: 1237680 - protein, 25 aa, Mycobacterium
ARERALELLTAVGLPEADRRLDSYP

SEQ ID NO: 1237681 - protein, 19 aa, Mycobacterium
ARERLTFDEAVGLQWGLVS

SEQ ID NO: 1237682 - protein, 19 aa, Mycobacterium
ARESYKPRQAVAMVAAARW

SEQ ID NO: 1237683 - protein, 23 aa, Mycobacterium
ARETGWPAFADRLLDLAHESAPG

SEQ ID NO: 1237684 - protein, 20 aa, Mycobacterium
ARFAGPIVVIELDLKFGGLD

SEQ ID NO: 1237685 - protein, 20 aa, Mycobacterium
ARFEPVMGMEVHVELSTATK

SEQ ID NO: 1237686 - protein, 22 aa, Mycobacterium
ARFGCGFAPSGWDKLTKHLLRK

SEQ ID NO: 1237687 - protein, 25 aa, Mycobacterium
ARFGTSVLCPRPSGDRAYVAHAFPF

SEQ ID NO: 1237688 - protein, 22 aa, Mycobacterium
ARFIEVSAKINALLDIAQVNLG

SEQ ID NO: 1237689 - protein, 18 aa, Mycobacterium
ARFPHARTHLGAPLVDLV

SEQ ID NO: 1237690 - protein, 19 aa, Mycobacterium
ARFPLHGMPDDAKRLMHLM

SEQ ID NO: 1237691 - protein, 23 aa, Mycobacterium
ARFREFYGRVLSWTFEPGRIEDG

SEQ ID NO: 1237692 - protein, 19 aa, Mycobacterium
ARFRVGSIFLAGDAAHVHS

SEQ ID NO: 1237693 - protein, 21 aa, Mycobacterium
ARFTDLFAAVRVRLEDAITRG

SEQ ID NO: 1237694 - protein, 21 aa, Mycobacterium
ARFTPRARAAVVHAQNTAREA

SEQ ID NO: 1237695 - protein, 26 aa, Mycobacterium
ARGADGWRLDAAYAVPDGFWSQVLPR

SEQ ID NO: 1237696 - protein, 17 aa, Mycobacterium
ARGEAFLLQGGDCAETF

SEQ ID NO: 1237697 - protein, 21 aa, Mycobacterium
ARGKLLSILQRNGATRVSVLA

SEQ ID NO: 1237698 - protein, 20 aa, Mycobacterium
ARGLGARWSPLDVTDAAAVQ

SEQ ID NO: 1237699 - protein, 18 aa, Mycobacterium
ARGLRNRFIDRFEADAPL

SEQ ID NO: 1237700 - protein, 24 aa, Mycobacterium
ARGQRLPVAQAIGYMLEILPALGY

SEQ ID NO: 1237701 - protein, 29 aa, Mycobacterium
ARGRKPARVPVWFMRQAGRSLPEYRALRA

SEQ ID NO: 1237702 - protein, 26 aa, Mycobacterium
ARGRVLWRAGSRAVLGSADRLGFIEG

SEQ ID NO: 1237703 - protein, 19 aa, Mycobacterium
ARGVGVIEVRGRPVSRGYT

SEQ ID NO: 1237704 - protein, 21 aa, Mycobacterium
ARGVIWPTIPPDILGQSGTAW

SEQ ID NO: 1237705 - protein, 19 aa, Mycobacterium
ARGYPPYEGEHALIVEVSP

SEQ ID NO: 1237706 - protein, 22 aa, Mycobacterium
ARHVVQRLLAVFGGDDAAEDEL

SEQ ID NO: 1237707 - protein, 21 aa, Mycobacterium
ARHYWGLPFGGWKSSGVGSEE

SEQ ID NO: 1237708 - protein, 25 aa, Mycobacterium
ARIAARVGLRPDVRRVPMFGLGCVA

SEQ ID NO: 1237709 - protein, 19 aa, Mycobacterium
ARIAFAEHVFYRFTDRRIA

SEQ ID NO: 1237710 - protein, 19 aa, Mycobacterium
ARIAVPLTGIITQLVQALR

SEQ ID NO: 1237711 - protein, 25 aa, Mycobacterium
ARIGEIRPDGLIYTIWESPGPIEPD

SEQ ID NO: 1237712 - protein, 36 aa, Mycobacterium
ARIGLERGHDVGCSWLPLYHDMGLSFLLTGALAGVE

SEQ ID NO: 1237713 - protein, 18 aa, Mycobacterium
ARIKWLMADKSKAYDDIV

SEQ ID NO: 1237714 - protein, 19 aa, Mycobacterium
ARITILEVMAEAIDAPDEM

SEQ ID NO: 1237715 - protein, 24 aa, Mycobacterium
ARKAGRRFAQLAPIVATYRKLEAA

SEQ ID NO: 1237716 - protein, 20 aa, Mycobacterium
ARKHELAAIITAEHGKVLSD

SEQ ID NO: 1237717 - protein, 25 aa, Mycobacterium
ARKLREIRAALAMDAALPKAEILAR

SEQ ID NO: 1237718 - protein, 29 aa, Mycobacterium
ARKRGLPVLGLCLGLQCIVIEAARSVGIT

SEQ ID NO: 1237719 - protein, 22 aa, Mycobacterium
ARKRRWEGVVAKKWDSTYQPGR

SEQ ID NO: 1237720 - protein, 22 aa, Mycobacterium
ARLAGEAGLPPGVLNVVTGFGA

SEQ ID NO: 1237721 - protein, 17 aa, Mycobacterium
ARLAHWVHEDAELTFHL

SEQ ID NO: 1237722 - protein, 19 aa, Mycobacterium
ARLDEAAGMFAKREIDGAQ

SEQ ID NO: 1237723 - protein, 20 aa, Mycobacterium
ARLGVDMPLACVLEGGTWAA

SEQ ID NO: 1237724 - protein, 19 aa, Mycobacterium
ARLGVGMGAVALGYTGYLK

SEQ ID NO: 1237725 - protein, 17 aa, Mycobacterium
ARLILRRETVDDLLSLE

SEQ ID NO: 1237726 - protein, 18 aa, Mycobacterium
ARLKGRQVEFFAAALGGP

SEQ ID NO: 1237727 - protein, 21 aa, Mycobacterium
ARLLARDSLVKTALFGSDPNW

SEQ ID NO: 1237728 - protein, 21 aa, Mycobacterium
ARLLHHVAWQPVAWPDADLPA

SEQ ID NO: 1237729 - protein, 19 aa, Mycobacterium
ARLPFPVMHVDTGHNFDEV

SEQ ID NO: 1237730 - protein, 25 aa, Mycobacterium
ARLPGARCTTVWCAVLSPETGELVY

SEQ ID NO: 1237731 - protein, 23 aa, Mycobacterium
ARLPHGWPARLRRVVERHRTAEV

SEQ ID NO: 1237732 - protein, 21 aa, Mycobacterium
ARLPLDPRIGRMILQSDTEGC

SEQ ID NO: 1237733 - protein, 20 aa, Mycobacterium
ARLPSVALRTARAALQAGRP

SEQ ID NO: 1237734 - protein, 20 aa, Mycobacterium
ARLQIIKDYVGWPLISAGAF

SEQ ID NO: 1237735 - protein, 21 aa, Mycobacterium
ARLRCLSQALYVWHRDEPAAI

SEQ ID NO: 1237736 - protein, 19 aa, Mycobacterium
ARLRELAILRVAHLLGSEY

SEQ ID NO: 1237737 - protein, 22 aa, Mycobacterium
ARLRELPQFNSFGVRTFGTDLL

SEQ ID NO: 1237738 - protein, 27 aa, Mycobacterium
ARLRFAGSCKSCPSSAVTLELAVEDAI

SEQ ID NO: 1237739 - protein, 17 aa, Mycobacterium
ARLRRRGTVTVFGIDKF

SEQ ID NO: 1237740 - protein, 23 aa, Mycobacterium
ARLRRRLESALRLPNRTEGVEMS

SEQ ID NO: 1237741 - protein, 26 aa, Mycobacterium
ARLVARAWLDPDFKDLALREPMTASK

SEQ ID NO: 1237742 - protein, 22 aa, Mycobacterium
ARMGMLDAQGFRAARVAIDIGV

SEQ ID NO: 1237743 - protein, 25 aa, Mycobacterium
ARMLEALDTWPLNVVLLGKGNTVSA

SEQ ID NO: 1237744 - protein, 18 aa, Mycobacterium
ARMRSLGEGLTFPAHAPD

SEQ ID NO: 1237745 - protein, 22 aa, Mycobacterium
ARMWRDARIQRIYGGANEVMKD

SEQ ID NO: 1237746 - protein, 17 aa, Mycobacterium
ARNALVLVRGKPTDQLP

SEQ ID NO: 1237747 - protein, 18 aa, Mycobacterium
ARNALYAALDDFAGTLLL

SEQ ID NO: 1237748 - protein, 19 aa, Mycobacterium
ARNAMTPAMYFGIKYAVNH

SEQ ID NO: 1237749 - protein, 21 aa, Mycobacterium
ARNGEGMSRCPLRSTRESSWE

SEQ ID NO: 1237750 - protein, 17 aa, Mycobacterium
ARNPRFGARLAIPKLAE

SEQ ID NO: 1237751 - protein, 21 aa, Mycobacterium
ARNYQATLAFGDRISTATAAA

SEQ ID NO: 1237752 - protein, 22 aa, Mycobacterium
ARPARLNCFGLHEWAMVYRSPD

SEQ ID NO: 1237753 - protein, 27 aa, Mycobacterium
ARPDGPGWWWQTWHLYPGGPRVPGGTA

SEQ ID NO: 1237754 - protein, 19 aa, Mycobacterium
ARPGQPGALALDGAYDSYL

SEQ ID NO: 1237755 - protein, 19 aa, Mycobacterium
ARPGQTVRLHWSRPRKPFA

SEQ ID NO: 1237756 - protein, 21 aa, Mycobacterium
ARPLVHLAARPGVLSAEELAA

SEQ ID NO: 1237757 - protein, 17 aa, Mycobacterium
ARPPVPLDEVESAAEIV

SEQ ID NO: 1237758 - protein, 25 aa, Mycobacterium
ARPRGMAYLVVTGRRGGSAMAAAAV

SEQ ID NO: 1237759 - protein, 25 aa, Mycobacterium
ARPTVLDGQIAWWLVEDAGRELWDT

SEQ ID NO: 1237760 - protein, 47 aa, Mycobacterium
ARPYPIPIICALLGAPARDWARFSAWADDIFKIFNWNVAEDADDIER

SEQ ID NO: 1237761 - protein, 28 aa, Mycobacterium
ARQLKIPSERWIFPYAGTDSHDTYAIGE

SEQ ID NO: 1237762 - protein, 18 aa, Mycobacterium
ARQLPGRLVGVSVDADGS

SEQ ID NO: 1237763 - protein, 18 aa, Mycobacterium
ARQWLAHLYEKWSAELDF

SEQ ID NO: 1237764 - protein, 19 aa, Mycobacterium
ARRAGCTAATQAMEAAAAA

SEQ ID NO: 1237765 - protein, 22 aa, Mycobacterium
ARRHLVAGLMLIHLDIDAAVAV

SEQ ID NO: 1237766 - protein, 21 aa, Mycobacterium
ARRLAGLFASYARQRPGLLVD

SEQ ID NO: 1237767 - protein, 21 aa, Mycobacterium
ARRLGLCGFGALGVDEDRLAR

SEQ ID NO: 1237768 - protein, 24 aa, Mycobacterium
ARRLTEVRKNGVLDYLRPDGKTQV

SEQ ID NO: 1237769 - protein, 17 aa, Mycobacterium
ARRMGISLFATGPLERF

SEQ ID NO: 1237770 - protein, 18 aa, Mycobacterium
ARRRGHRPVRTSVSAATR

SEQ ID NO: 1237771 - protein, 18 aa, Mycobacterium
ARRRGITVLGDRPPMVSV

SEQ ID NO: 1237772 - protein, 17 aa, Mycobacterium
ARRRLIVTTARRLAEAE

SEQ ID NO: 1237773 - protein, 24 aa, Mycobacterium
ARRRRLDALLTRHAIPYATLSGSG

SEQ ID NO: 1237774 - protein, 25 aa, Mycobacterium
ARRRRRGRRGRGRGRGEQSDDNGEP

SEQ ID NO: 1237775 - protein, 26 aa, Mycobacterium
ARRSGDSGAMQMHWYSAMEVLAEYSV

SEQ ID NO: 1237776 - protein, 21 aa, Mycobacterium
ARRTLPGATIVKVSVGPMDNN

SEQ ID NO: 1237777 - protein, 18 aa, Mycobacterium
ARRYPDGLVPQGISAELI

SEQ ID NO: 1237778 - protein, 20 aa, Mycobacterium
ARSAADLADGTWLVIADGRP

SEQ ID NO: 1237779 - protein, 20 aa, Mycobacterium
ARSALELAQRSGRRVGPDQL

SEQ ID NO: 1237780 - protein, 19 aa, Mycobacterium
ARSALHATIDYVKNRKAFG

SEQ ID NO: 1237781 - protein, 17 aa, Mycobacterium
ARSAVVIGAGFIGCEVA

SEQ ID NO: 1237782 - protein, 19 aa, Mycobacterium
ARSLFPHHLDTLVNVPAPQ

SEQ ID NO: 1237783 - protein, 19 aa, Mycobacterium
ARSLFPWITVAKNVELPLM

SEQ ID NO: 1237784 - protein, 27 aa, Mycobacterium
ARSLGCTIKLLAICERLTTDDGQQRVS

SEQ ID NO: 1237785 - protein, 24 aa, Mycobacterium
ARSLTGIAPAGGWHRWSPAKYEIV

SEQ ID NO: 1237786 - protein, 18 aa, Mycobacterium
ARSTHRYDLTYSPGAAGH

SEQ ID NO: 1237787 - protein, 17 aa, Mycobacterium
ARTACLERSDLMATIMV

SEQ ID NO: 1237788 - protein, 19 aa, Mycobacterium
ARTALPSRLIRLPAALVRS

SEQ ID NO: 1237789 - protein, 19 aa, Mycobacterium
ARTAYPLTEVPTVYFGGSS

SEQ ID NO: 1237790 - protein, 26 aa, Mycobacterium
ARTEHLPRIGVPTVFVHGTADPFGSI

SEQ ID NO: 1237791 - protein, 17 aa, Mycobacterium
ARTHLGAPLVDLVDVDG

SEQ ID NO: 1237792 - protein, 27 aa, Mycobacterium
ARTHPDGVLWGHGWDESGWPERTAPTT

SEQ ID NO: 1237793 - protein, 25 aa, Mycobacterium
ARTHTLHDPVRWKLQHIGRYTLSGT

SEQ ID NO: 1237794 - protein, 26 aa, Mycobacterium
ARTKACPRLADSIKHAVAEGCLEESS

SEQ ID NO: 1237795 - protein, 24 aa, Mycobacterium
ARTLKRSLLPPALSPPAGLEACAH

SEQ ID NO: 1237796 - protein, 18 aa, Mycobacterium
ARTLRSQLIGGMTMGLSM

SEQ ID NO: 1237797 - protein, 28 aa, Mycobacterium
ARTPRCGLCPLGTCTWRSLGYPAASAPA

SEQ ID NO: 1237798 - protein, 19 aa, Mycobacterium
ARTRFPAEVVAAVRAAVGP

SEQ ID NO: 1237799 - protein, 26 aa, Mycobacterium
ARTRRISARLAREYDVVLTPTLAESP

SEQ ID NO: 1237800 - protein, 17 aa, Mycobacterium
ARTSFAPAGHLLEGLAV

SEQ ID NO: 1237801 - protein, 18 aa, Mycobacterium
ARTTFTYLAVATRGSDAQ

SEQ ID NO: 1237802 - protein, 20 aa, Mycobacterium
ARTVFKSMLTAVLDRMPDYV

SEQ ID NO: 1237803 - protein, 18 aa, Mycobacterium
ARTWGDRLLGAAASGDLR

SEQ ID NO: 1237804 - protein, 19 aa, Mycobacterium
ARTWLGRPGLVDGAPADLV

SEQ ID NO: 1237805 - protein, 19 aa, Mycobacterium
ARVADWVRVVCRAEQWLDL

SEQ ID NO: 1237806 - protein, 23 aa, Mycobacterium
ARVAELLDLVGLPTDFASRYPHE

SEQ ID NO: 1237807 - protein, 25 aa, Mycobacterium
ARVALEEVLLRWTDWEVDYDNAAMA

SEQ ID NO: 1237808 - protein, 19 aa, Mycobacterium
ARVASRTLATLSTETKNRA

SEQ ID NO: 1237809 - protein, 19 aa, Mycobacterium
ARVATILGRQAPDRLRALF

SEQ ID NO: 1237810 - protein, 31 aa, Mycobacterium
ARVDCGLAGTVLRFLPPVAALSTETVEFDGD

SEQ ID NO: 1237811 - protein, 20 aa, Mycobacterium
ARVDLYFEAAVAGAIPVIRP

SEQ ID NO: 1237812 - protein, 24 aa, Mycobacterium
ARVGDELLERFSIGHAADRVVKSY

SEQ ID NO: 1237813 - protein, 21 aa, Mycobacterium
ARVGFSVAIGEHLAAGVQQVR

SEQ ID NO: 1237814 - protein, 19 aa, Mycobacterium
ARVIESWRAVPGRFPSYLV

SEQ ID NO: 1237815 - protein, 25 aa, Mycobacterium
ARVIWAMQDRVMWENGPALTGYGHY

SEQ ID NO: 1237816 - protein, 19 aa, Mycobacterium
ARVRLRMAQACRRMNDDDT

SEQ ID NO: 1237817 - protein, 20 aa, Mycobacterium
ARVSTPLRWDEVPGCRPEAF

SEQ ID NO: 1237818 - protein, 18 aa, Mycobacterium
ARVTLRGDRMWEFLDRLV

SEQ ID NO: 1237819 - protein, 23 aa, Mycobacterium
ARVVADGGDMVWVSCPDERATPP

SEQ ID NO: 1237820 - protein, 23 aa, Mycobacterium
ARVVAKIYCGLGLLRKETVREVH

SEQ ID NO: 1237821 - protein, 27 aa, Mycobacterium
ARVVLPVYDSWTFRTGRDGDFATLAGR

SEQ ID NO: 1237822 - protein, 21 aa, Mycobacterium
ARWDEARQWLDERGYDSTLDY

SEQ ID NO: 1237823 - protein, 24 aa, Mycobacterium
ARWSTERHLVFACGRYEGIDQRVV

SEQ ID NO: 1237824 - protein, 28 aa, Mycobacterium
ARYLAAESARLAEFLDHVEVAVSLHGYG

SEQ ID NO: 1237825 - protein, 17 aa, Mycobacterium
ARYLPLVVRVDRGAVTM

SEQ ID NO: 1237826 - protein, 19 aa, Mycobacterium
ARYQTKMMWWDRRTYANHA

SEQ ID NO: 1237827 - protein, 18 aa, Mycobacterium
ARYSADPGGPTVVFASAT

SEQ ID NO: 1237828 - protein, 22 aa, Mycobacterium
ASAGHIYAVIGLKDTTTGDTLS

SEQ ID NO: 1237829 - protein, 24 aa, Mycobacterium
ASALAAGLKTVWAPQGLVQRGQGK

SEQ ID NO: 1237830 - protein, 24 aa, Mycobacterium
ASAQRGLSEAVVRDISAKKNEPEW

SEQ ID NO: 1237831 - protein, 18 aa, Mycobacterium
ASARSGSVLIKRFVSEKH

SEQ ID NO: 1237832 - protein, 21 aa, Mycobacterium
ASATGVCAMCYGRSMATGKLV

SEQ ID NO: 1237833 - protein, 23 aa, Mycobacterium
ASDALRPLVGVVRTARIAALTAI

SEQ ID NO: 1237834 - protein, 24 aa, Mycobacterium
ASDVRLRGLIALLRDDPRVQQFAE

SEQ ID NO: 1237835 - protein, 23 aa, Mycobacterium
ASEVKRKGVLIGDTVVIRKAGDV

SEQ ID NO: 1237836 - protein, 18 aa, Mycobacterium
ASEYKVGYVTAKHALEGL

SEQ ID NO: 1237837 - protein, 17 aa, Mycobacterium
ASFMPKPFAEYPGSAMH

SEQ ID NO: 1237838 - protein, 23 aa, Mycobacterium
ASFYASGIFPGFGSDQLALLLAT

SEQ ID NO: 1237839 - protein, 19 aa, Mycobacterium
ASGATWLSLMDHFFQIEPT

SEQ ID NO: 1237840 - protein, 23 aa, Mycobacterium
ASGCGKSTLLRLLAGFEAPTEGT

SEQ ID NO: 1237841 - protein, 24 aa, Mycobacterium
ASGCGKTTLLRLIAGFETPDSGTI

SEQ ID NO: 1237842 - protein, 24 aa, Mycobacterium
ASGEASLRISLRTAAIPHHPGGLQ

SEQ ID NO: 1237843 - protein, 18 aa, Mycobacterium
ASGGRLIGKDGSPLDLDG

SEQ ID NO: 1237844 - protein, 18 aa, Mycobacterium
ASGLGWAGGYVGHGVTAT

SEQ ID NO: 1237845 - protein, 19 aa, Mycobacterium
ASGLLEPAYHHSFLRTVHE

SEQ ID NO: 1237846 - protein, 23 aa, Mycobacterium
ASGMRKSELIAAIRERRGDGGAA

SEQ ID NO: 1237847 - protein, 25 aa, Mycobacterium
ASGVADCVLALGFEQMRPGALAAVW

SEQ ID NO: 1237848 - protein, 25 aa, Mycobacterium
ASHHLRWLASANCLLEIPEDVSELP

SEQ ID NO: 1237849 - protein, 18 aa, Mycobacterium
ASHLPLDLVVIMLGTNDT

SEQ ID NO: 1237850 - protein, 19 aa, Mycobacterium
ASHNGMWDLSVLGIVPGMR

SEQ ID NO: 1237851 - protein, 20 aa, Mycobacterium
ASIDPLRPVAHVRANAVDVA

SEQ ID NO: 1237852 - protein, 29 aa, Mycobacterium
ASKAFKDWKRTTPAQRQKALLDFADEVEK

SEQ ID NO: 1237853 - protein, 24 aa, Mycobacterium
ASLARARMELRLALNGRASAVERG

SEQ ID NO: 1237854 - protein, 19 aa, Mycobacterium
ASLCSLGMNVTVLEATERV

SEQ ID NO: 1237855 - protein, 20 aa, Mycobacterium
ASLLDAYPLVSIEDPLSEDD

SEQ ID NO: 1237856 - protein, 17 aa, Mycobacterium
ASLQSALGWLKYTIDTE

SEQ ID NO: 1237857 - protein, 17 aa, Mycobacterium
ASLRQLGLMRVKDIELR

SEQ ID NO: 1237858 - protein, 24 aa, Mycobacterium
ASLRRYLLEETYELFDAVRSGDAD

SEQ ID NO: 1237859 - protein, 19 aa, Mycobacterium
ASLTKCLATATAVMQLYEQ

SEQ ID NO: 1237860 - protein, 17 aa, Mycobacterium
ASLVCGPLFGTVYLAIP

SEQ ID NO: 1237861 - protein, 21 aa, Mycobacterium
ASMGCALPYGVAAKLDAPQRP

SEQ ID NO: 1237862 - protein, 17 aa, Mycobacterium
ASMIMDYQALRAMGSAA

SEQ ID NO: 1237863 - protein, 19 aa, Mycobacterium
ASMRGEALPSGGATPAASP

SEQ ID NO: 1237864 - protein, 24 aa, Mycobacterium
ASPAAVCPHVEWALSSTLSARANL

SEQ ID NO: 1237865 - protein, 25 aa, Mycobacterium
ASPGYPCYRNILTALGCEVVEIPCG

SEQ ID NO: 1237866 - protein, 23 aa, Mycobacterium
ASPLEARVGHYYQMDDTYLVGRE

SEQ ID NO: 1237867 - protein, 30 aa, Mycobacterium
ASPPDMKLPIALALGWPDRIPGAALACDFT

SEQ ID NO: 1237868 - protein, 19 aa, Mycobacterium
ASPPPLWGREEHVRELFGD

SEQ ID NO: 1237869 - protein, 26 aa, Mycobacterium
ASQVSWTRNMFVPHLWGNLRGVSSGD

SEQ ID NO: 1237870 - protein, 23 aa, Mycobacterium
ASRPSRAGYRIRIILEAGEGEQA

SEQ ID NO: 1237871 - protein, 24 aa, Mycobacterium
ASRRVRARLARRMTAQRSTVNPVL

SEQ ID NO: 1237872 - protein, 18 aa, Mycobacterium
ASVAHGLTLWMCTASAGE

SEQ ID NO: 1237873 - protein, 19 aa, Mycobacterium
ASVARRSAGAIGFLVTVRS

SEQ ID NO: 1237874 - protein, 24 aa, Mycobacterium
ASVDCLRALFPDAIEVTAADAHVL

SEQ ID NO: 1237875 - protein, 24 aa, Mycobacterium
ASVPPDGWSRSGLRSNGSEFTVAS

SEQ ID NO: 1237876 - protein, 27 aa, Mycobacterium
ASWESLPAILFQSGFRQLLSPELRLVQ

SEQ ID NO: 1237877 - protein, 25 aa, Mycobacterium
ASWLPAAGIGYRWEARLGGRRRLTA

SEQ ID NO: 1237878 - protein, 18 aa, Mycobacterium
ATADVLGVDGWYRTGDVA

SEQ ID NO: 1237879 - protein, 20 aa, Mycobacterium
ATAIAALETEVMRPLGDAGP

SEQ ID NO: 1237880 - protein, 19 aa, Mycobacterium
ATALLTRHPNLRAGFFRGD

SEQ ID NO: 1237881 - protein, 19 aa, Mycobacterium
ATAMSRFGFSAGALAPSYG

SEQ ID NO: 1237882 - protein, 20 aa, Mycobacterium
ATAPLPVFLQRSPHFRPPRD

SEQ ID NO: 1237883 - protein, 23 aa, Mycobacterium
ATARLLADLGHRVEPAATAVNAD

SEQ ID NO: 1237884 - protein, 17 aa, Mycobacterium
ATARPPTFVLFTSGFLE

SEQ ID NO: 1237885 - protein, 26 aa, Mycobacterium
ATARWSSDIAAVWWQAALDAYDRLPA

SEQ ID NO: 1237886 - protein, 18 aa, Mycobacterium
ATCPPEYKTAQGGKGVLK

SEQ ID NO: 1237887 - protein, 20 aa, Mycobacterium
ATDAAAFFDFLAGRPEVRGD

SEQ ID NO: 1237888 - protein, 17 aa, Mycobacterium
ATDDIDALLALRPDACC

SEQ ID NO: 1237889 - protein, 21 aa, Mycobacterium
ATDFRLFWDNAYAVHTLTPDF

SEQ ID NO: 1237890 - protein, 23 aa, Mycobacterium
ATDPHARYWGVAIDEHTLVPGDG

SEQ ID NO: 1237891 - protein, 23 aa, Mycobacterium
ATDPRAAAIVDRCESMSPEAMLN

SEQ ID NO: 1237892 - protein, 27 aa, Mycobacterium
ATDVAEWLVRRGVPFRVAHEAAGAAVR

SEQ ID NO: 1237893 - protein, 18 aa, Mycobacterium
ATDVEFDLATGLRARRGR

SEQ ID NO: 1237894 - protein, 20 aa, Mycobacterium
ATEALNLVSYVLGDDRFEGH

SEQ ID NO: 1237895 - protein, 24 aa, Mycobacterium
ATEELRAQWLPKMASGEMIGAIAM

SEQ ID NO: 1237896 - protein, 21 aa, Mycobacterium
ATEEMIRWTTPVKEFMRTATA

SEQ ID NO: 1237897 - protein, 32 aa, Mycobacterium
ATELAVRWSARLRIASFSVRPVAVFSGSIEPS

SEQ ID NO: 1237898 - protein, 26 aa, Mycobacterium
ATELGHTPAQIALAWTLTVAPNVLLI

SEQ ID NO: 1237899 - protein, 23 aa, Mycobacterium
ATEQQWWERSPIFSGLNTNKKGL

SEQ ID NO: 1237900 - protein, 27 aa, Mycobacterium
ATETRIARVFLDYCIDLHLAGQLDVQT

SEQ ID NO: 1237901 - protein, 18 aa, Mycobacterium
ATEVSLNTAFGVRRVVED

SEQ ID NO: 1237902 - protein, 19 aa, Mycobacterium
ATFERRVLGPSGFDTIIEM

SEQ ID NO: 1237903 - protein, 18 aa, Mycobacterium
ATFMPKPFGDRTGSGLHL

SEQ ID NO: 1237904 - protein, 19 aa, Mycobacterium
ATGAQWVREIFTGVYASDF

SEQ ID NO: 1237905 - protein, 18 aa, Mycobacterium
ATGARMLVTLVHELRRRG

SEQ ID NO: 1237906 - protein, 17 aa, Mycobacterium
ATGCARVNIGTAALENP

SEQ ID NO: 1237907 - protein, 24 aa, Mycobacterium
ATGDVEGLLALLAPDAVWITDSGG

SEQ ID NO: 1237908 - protein, 23 aa, Mycobacterium
ATGEHPIDLVLLDLGLPDATGIS

SEQ ID NO: 1237909 - protein, 36 aa, Mycobacterium
ATGFLGRYLALDWLERMALVDGKVICLVRAKDDAAA

SEQ ID NO: 1237910 - protein, 23 aa, Mycobacterium
ATGGRAVLRMTIETFGGRGAHEL

SEQ ID NO: 1237911 - protein, 20 aa, Mycobacterium
ATGKIAFPIARALAPNNEVW

SEQ ID NO: 1237912 - protein, 20 aa, Mycobacterium
ATGLVGWPAFTQRLRDHPSF

SEQ ID NO: 1237913 - protein, 33 aa, Mycobacterium
ATGMVRFIGVDGYRWMIRCVVNGVAESIEALTR

SEQ ID NO: 1237914 - protein, 25 aa, Mycobacterium
ATGQAAVMQCVWVYEHAVDFEGLRR

SEQ ID NO: 1237915 - protein, 25 aa, Mycobacterium
ATGRPPRWVAPVVDGLGLAPMAVCA

SEQ ID NO: 1237916 - protein, 23 aa, Mycobacterium
ATGRPTGEWAAAIKRLQAAEAEV

SEQ ID NO: 1237917 - protein, 17 aa, Mycobacterium
ATGWSRVSVDLIPNLSR

SEQ ID NO: 1237918 - protein, 20 aa, Mycobacterium
ATHLARAGHHVIAGARREDR

SEQ ID NO: 1237919 - protein, 26 aa, Mycobacterium
ATHLSRLVPQHMMRRMFFTAATVSAE

SEQ ID NO: 1237920 - protein, 28 aa, Mycobacterium
ATIGRYIRYRRYATRLCVVDPENSAFFP

SEQ ID NO: 1237921 - protein, 26 aa, Mycobacterium
ATKEVAWRTANMGWIESVRFGETMRK

SEQ ID NO: 1237922 - protein, 17 aa, Mycobacterium
ATKRLRVGVLVTGIHYR

SEQ ID NO: 1237923 - protein, 19 aa, Mycobacterium
ATKYAAWAITEGLRQESDP

SEQ ID NO: 1237924 - protein, 29 aa, Mycobacterium
ATLANLKFAWRSCRAVKSNAIVVVADGAT

SEQ ID NO: 1237925 - protein, 24 aa, Mycobacterium
ATLDRVVPVPAIFGGQRQEVTLYV

SEQ ID NO: 1237926 - protein, 25 aa, Mycobacterium
ATLERFADRFAHFDFHDHMLRPSYG

SEQ ID NO: 1237927 - protein, 23 aa, Mycobacterium
ATLFPGGEGRLLLTDPDDMLTTG

SEQ ID NO: 1237928 - protein, 20 aa, Mycobacterium
ATLPGAAWQRCRTHYTTNLM

SEQ ID NO: 1237929 - protein, 18 aa, Mycobacterium
ATLREAFGHFPTGVIAIA

SEQ ID NO: 1237930 - protein, 26 aa, Mycobacterium
ATLRISSQLLANWLRHGVITEEDVKT

SEQ ID NO: 1237931 - protein, 18 aa, Mycobacterium
ATLSRPGDSFADIATTVG

SEQ ID NO: 1237932 - protein, 20 aa, Mycobacterium
ATMAQWCFLLARTSRGERKQ

SEQ ID NO: 1237933 - protein, 27 aa, Mycobacterium
ATMNTRGRFAMRLARPPERFTDGLVKA

SEQ ID NO: 1237934 - protein, 19 aa, Mycobacterium
ATMPDPIITLARTFMNQPT

SEQ ID NO: 1237935 - protein, 17 aa, Mycobacterium
ATMSGAFPEGFEPSLDL

SEQ ID NO: 1237936 - protein, 23 aa, Mycobacterium
ATPDGRHVWEYSPRGAVDAQALA

SEQ ID NO: 1237937 - protein, 18 aa, Mycobacterium
ATPEPVGTLILTELRTAV

SEQ ID NO: 1237938 - protein, 23 aa, Mycobacterium
ATPIPRTVALTVYGDLETSTLRE

SEQ ID NO: 1237939 - protein, 29 aa, Mycobacterium
ATPVRAILALPVFRDGRSSATLNLYADRP

SEQ ID NO: 1237940 - protein, 19 aa, Mycobacterium
ATQRLGIAHCGPLPPALAA

SEQ ID NO: 1237941 - protein, 24 aa, Mycobacterium
ATRDILDRELLGISEALRASGLSA

SEQ ID NO: 1237942 - protein, 24 aa, Mycobacterium
ATREELRIAIVTWIERTYHRRRRQ

SEQ ID NO: 1237943 - protein, 30 aa, Mycobacterium
ATRMTPRRMMALLLRFGPYGDRFGLRRGGL

SEQ ID NO: 1237944 - protein, 21 aa, Mycobacterium
ATRRRICQRSDAGVPHPPPTQ

SEQ ID NO: 1237945 - protein, 19 aa, Mycobacterium
ATRTDVCFVHVLDDSDRSL

SEQ ID NO: 1237946 - protein, 20 aa, Mycobacterium
ATRVLGTFLRDVIVRNQDRF

SEQ ID NO: 1237947 - protein, 26 aa, Mycobacterium
ATRVTAIGARFTSPVFPGETLTTSVW

SEQ ID NO: 1237948 - protein, 19 aa, Mycobacterium
ATRWLTRLREGLPTPPEGG

SEQ ID NO: 1237949 - protein, 18 aa, Mycobacterium
ATSLAWYAELGRRHELLS

SEQ ID NO: 1237950 - protein, 19 aa, Mycobacterium
ATTGPLFRRVIAAAGTNGE

SEQ ID NO: 1237951 - protein, 28 aa, Mycobacterium
ATTLKPLFLAAAHWKRTGRFPGVDITLV

SEQ ID NO: 1237952 - protein, 28 aa, Mycobacterium
ATTSMNAWANLRLARQMFARVPDPVARH

SEQ ID NO: 1237953 - protein, 17 aa, Mycobacterium
ATVELVELLGPRAIVTV

SEQ ID NO: 1237954 - protein, 17 aa, Mycobacterium
ATWLYDNGKSCGREANT

SEQ ID NO: 1237955 - protein, 19 aa, Mycobacterium
ATYLAFDLVHRLWLDAGHR

SEQ ID NO: 1237956 - protein, 17 aa, Mycobacterium
ATYLDLPLISGRAAQRL

SEQ ID NO: 1237957 - protein, 18 aa, Mycobacterium
AVAAARAALPGWATATPA

SEQ ID NO: 1237958 - protein, 22 aa, Mycobacterium
AVAAGVRVPVRFSHAEHERVWC

SEQ ID NO: 1237959 - protein, 24 aa, Mycobacterium
AVACAAVRIFDPRGWIEQGYAASH

SEQ ID NO: 1237960 - protein, 18 aa, Mycobacterium
AVADGRIVAVGDRSDVET

SEQ ID NO: 1237961 - protein, 18 aa, Mycobacterium
AVADRAPVCVAMTSGTAV

SEQ ID NO: 1237962 - protein, 20 aa, Mycobacterium
AVAERGAEAALEYGEAFDGV

SEQ ID NO: 1237963 - protein, 24 aa, Mycobacterium
AVAERLLARNGWRNTSLAQIAREA

SEQ ID NO: 1237964 - protein, 20 aa, Mycobacterium
AVAEWPTGTQARVWVADGRA

SEQ ID NO: 1237965 - protein, 31 aa, Mycobacterium
AVAFAKQWVTECLRAAYPLGHGHGPVSALFR

SEQ ID NO: 1237966 - protein, 18 aa, Mycobacterium
AVAIERPIFVTGLPRTGT

SEQ ID NO: 1237967 - protein, 28 aa, Mycobacterium
AVAKLGRHRFPLVLSDTVQQFLTAVAEE

SEQ ID NO: 1237968 - protein, 23 aa, Mycobacterium
AVAPGEPGDLCIVEGSPDEVLAE

SEQ ID NO: 1237969 - protein, 26 aa, Mycobacterium
AVAPVLPLRFGAVMTDAESVAEELLR

SEQ ID NO: 1237970 - protein, 20 aa, Mycobacterium
AVAQSWYKLVGDTGEIVSIE

SEQ ID NO: 1237971 - protein, 28 aa, Mycobacterium
AVARAHEQFRWFAGGWAVNADLPTTAGF

SEQ ID NO: 1237972 - protein, 20 aa, Mycobacterium
AVARAIKGRGLGLTVITPSV

SEQ ID NO: 1237973 - protein, 24 aa, Mycobacterium
AVARFPNDPVRVWNGRRNALHWDI

SEQ ID NO: 1237974 - protein, 32 aa, Mycobacterium
AVATGMARHVLCFRTLWEATFGQLLKEGKMAP

SEQ ID NO: 1237975 - protein, 18 aa, Mycobacterium
AVAVRLGPTVLRTSTAAA

SEQ ID NO: 1237976 - protein, 20 aa, Mycobacterium
AVAVYEAWRQHGFAGGDIRP

SEQ ID NO: 1237977 - protein, 23 aa, Mycobacterium
AVDEIRAGVLGLLTRPEQRVVLL

SEQ ID NO: 1237978 - protein, 17 aa, Mycobacterium
AVDHARTAYPLTEVPTV

SEQ ID NO: 1237979 - protein, 18 aa, Mycobacterium
AVDIRYASADAKFSVREV

SEQ ID NO: 1237980 - protein, 18 aa, Mycobacterium
AVDITAICVVVAPEGVAT

SEQ ID NO: 1237981 - protein, 27 aa, Mycobacterium
AVDPPQCPCGGLIRPNVVWFGEALPEA

SEQ ID NO: 1237982 - protein, 19 aa, Mycobacterium
AVDPRRLGLPLAQELSAYL

SEQ ID NO: 1237983 - protein, 22 aa, Mycobacterium
AVDPSVVVLLNLSRDQLDRVGE

SEQ ID NO: 1237984 - protein, 22 aa, Mycobacterium
AVDQEFLRRRLATIEHAAEQFS

SEQ ID NO: 1237985 - protein, 19 aa, Mycobacterium
AVEAGERLGFLPGTLSEKI

SEQ ID NO: 1237986 - protein, 26 aa, Mycobacterium
AVEDVAWEPGDLLLLGSGAAGPAAHV

SEQ ID NO: 1237987 - protein, 24 aa, Mycobacterium
AVEGLLASMAFCIDKISEQGIDVQ

SEQ ID NO: 1237988 - protein, 24 aa, Mycobacterium
AVENALKVAFDWKSRLNESRGLDP

SEQ ID NO: 1237989 - protein, 25 aa, Mycobacterium
AVEPRLVAIAAEWTRGAVKTVPPQW

SEQ ID NO: 1237990 - protein, 23 aa, Mycobacterium
AVESGIKVARKWGTDVKGVPAGL

SEQ ID NO: 1237991 - protein, 18 aa, Mycobacterium
AVFPEIQQIGGMRPDALR

SEQ ID NO: 1237992 - protein, 17 aa, Mycobacterium
AVGACPECHGLGRIHQV

SEQ ID NO: 1237993 - protein, 22 aa, Mycobacterium
AVGDARAAIDWYADAFGATLAG

SEQ ID NO: 1237994 - protein, 18 aa, Mycobacterium
AVGDRPILQIGMDTPQVT

SEQ ID NO: 1237995 - protein, 18 aa, Mycobacterium
AVGGRVDPALLYDVADTE

SEQ ID NO: 1237996 - protein, 24 aa, Mycobacterium
AVGPDLSRCVARVETLRQSGPAGA

SEQ ID NO: 1237997 - protein, 28 aa, Mycobacterium
AVGRARKSFVCGFHGWTYGLDGTCTHIR

SEQ ID NO: 1237998 - protein, 26 aa, Mycobacterium
AVHAWSDPTIYAFPNEEWMTFKPQAD

SEQ ID NO: 1237999 - protein, 24 aa, Mycobacterium
AVHYPWLPVRRLLLDRYPSIERIA

SEQ ID NO: 1238000 - protein, 17 aa, Mycobacterium
AVIPGGVNSPVRAFNAV

SEQ ID NO: 1238001 - protein, 25 aa, Mycobacterium
AVISCGAVLHHLRVALAAAGFAAHV

SEQ ID NO: 1238002 - protein, 19 aa, Mycobacterium
AVIVSEPFVVAIPVLEEKG

SEQ ID NO: 1238003 - protein, 25 aa, Mycobacterium
AVKACGICGSDLHFAAHGDDALAAG

SEQ ID NO: 1238004 - protein, 23 aa, Mycobacterium
AVKEASWLPGQVQVFIHGEAQAV

SEQ ID NO: 1238005 - protein, 26 aa, Mycobacterium
AVKKHARTPFRQEVWDRLAEGIRFVQ

SEQ ID NO: 1238006 - protein, 22 aa, Mycobacterium
AVKRAMVRAAGYVVVAADSSKV

SEQ ID NO: 1238007 - protein, 17 aa, Mycobacterium
AVLAHLGVTAPLYVGSF

SEQ ID NO: 1238008 - protein, 22 aa, Mycobacterium
AVLDRNGLRPSRIWVTEDGLVV

SEQ ID NO: 1238009 - protein, 21 aa, Mycobacterium
AVLLQLRWLALEGRPDRVDDL

SEQ ID NO: 1238010 - protein, 29 aa, Mycobacterium
AVLNRIRDGVKFCEVCGNVSDADRCRICS

SEQ ID NO: 1238011 - protein, 19 aa, Mycobacterium
AVLNVLSVLSWFHPPTSGA

SEQ ID NO: 1238012 - protein, 22 aa, Mycobacterium
AVLRFQYQIARIPLQVIEDRVV

SEQ ID NO: 1238013 - protein, 26 aa, Mycobacterium
AVLSRAQLLELVWGYDFAADTNVVDV

SEQ ID NO: 1238014 - protein, 25 aa, Mycobacterium
AVLTGWRMLLDLGRMQDGEPHLAGT

SEQ ID NO: 1238015 - protein, 24 aa, Mycobacterium
AVLTLHPRFGRWLQLGGHCEPDDP

SEQ ID NO: 1238016 - protein, 22 aa, Mycobacterium
AVMRALTARSWRQGLRQRAEAR

SEQ ID NO: 1238017 - protein, 19 aa, Mycobacterium
AVNDIRNGFKHAAASLTGK

SEQ ID NO: 1238018 - protein, 23 aa, Mycobacterium
AVNGVAFAGGFLLAQQCDLVVAA

SEQ ID NO: 1238019 - protein, 18 aa, Mycobacterium
AVNSRLGTYTNFCNLLDM

SEQ ID NO: 1238020 - protein, 25 aa, Mycobacterium
AVNVRRPLARLGMGLHRRHRQFQGD

SEQ ID NO: 1238021 - protein, 22 aa, Mycobacterium
AVNYPLYVIMSLLGVPEADFPL

SEQ ID NO: 1238022 - protein, 18 aa, Mycobacterium
AVPAELYAQAGSEFRDAI

SEQ ID NO: 1238023 - protein, 25 aa, Mycobacterium
AVPDRPVVLRAWDYHTVWCNSVALQ

SEQ ID NO: 1238024 - protein, 26 aa, Mycobacterium
AVPILRAEMTAALGMSEPGAGSDLAS

SEQ ID NO: 1238025 - protein, 27 aa, Mycobacterium
AVPPARLVGWTARFLGMVLPGDEIDFR

SEQ ID NO: 1238026 - protein, 25 aa, Mycobacterium
AVPPQRRGIGFVFQHYAAFKHLSVR

SEQ ID NO: 1238027 - protein, 22 aa, Mycobacterium
AVPRIRELLALLPGRLRDLENL

SEQ ID NO: 1238028 - protein, 17 aa, Mycobacterium
AVPTGTCVLVLEGDVGI

SEQ ID NO: 1238029 - protein, 19 aa, Mycobacterium
AVQYMYRRHLGVTPLEYLR

SEQ ID NO: 1238030 - protein, 19 aa, Mycobacterium
AVRAVRLFGPVGSALIYAA

SEQ ID NO: 1238031 - protein, 19 aa, Mycobacterium
AVRDARRPGHISGGSSSGS

SEQ ID NO: 1238032 - protein, 24 aa, Mycobacterium
AVRESLRRSLSFNGYSVELAQDGV

SEQ ID NO: 1238033 - protein, 18 aa, Mycobacterium
AVRGTRLAILKGLDLPLH

SEQ ID NO: 1238034 - protein, 23 aa, Mycobacterium
AVRPRPGVWSTLEYGCHVRDVHR

SEQ ID NO: 1238035 - protein, 18 aa, Mycobacterium
AVRPRRWVFTSVGRLGHD

SEQ ID NO: 1238036 - protein, 24 aa, Mycobacterium
AVRRVKGGWLSTGAPWSYDEPRYR

SEQ ID NO: 1238037 - protein, 19 aa, Mycobacterium
AVRWRISTSEAHRRLTEAA

SEQ ID NO: 1238038 - protein, 20 aa, Mycobacterium
AVSAARRAFATWSQTTREER

SEQ ID NO: 1238039 - protein, 19 aa, Mycobacterium
AVSEYWKAGFTDIALVQVG

SEQ ID NO: 1238040 - protein, 19 aa, Mycobacterium
AVSFWRAVQTRVWRGRPDP

SEQ ID NO: 1238041 - protein, 26 aa, Mycobacterium
AVSGGYRLSGSWSFGSGTGHSQYVAA

SEQ ID NO: 1238042 - protein, 22 aa, Mycobacterium
AVSGPLRLYSLLGRNHTALFYA

SEQ ID NO: 1238043 - protein, 22 aa, Mycobacterium
AVSHGALAYLLKPFTFAAFRDR

SEQ ID NO: 1238044 - protein, 19 aa, Mycobacterium
AVSMPRAVAITKLDHARAD

SEQ ID NO: 1238045 - protein, 24 aa, Mycobacterium
AVTDRPSFIAVRTIIGYPAPNKMN

SEQ ID NO: 1238046 - protein, 20 aa, Mycobacterium
AVTFTARIDGAIARLAGLEI

SEQ ID NO: 1238047 - protein, 19 aa, Mycobacterium
AVTLPAYGGTTTWASTEAA

SEQ ID NO: 1238048 - protein, 24 aa, Mycobacterium
AVTRAGGMGVLGCVRFNDSDDLEN

SEQ ID NO: 1238049 - protein, 26 aa, Mycobacterium
AVTRARASGMTAVFWLDTERPHEAEL

SEQ ID NO: 1238050 - protein, 26 aa, Mycobacterium
AVVDAMPGRSMVRVTLHEGRKRIVRR

SEQ ID NO: 1238051 - protein, 17 aa, Mycobacterium
AVVEHWGPPPGELFVDR

SEQ ID NO: 1238052 - protein, 26 aa, Mycobacterium
AVVERVRRAVALGVLLPGDRLPSERA

SEQ ID NO: 1238053 - protein, 25 aa, Mycobacterium
AVVISWGDPILPGAPKFDVARQTGA

SEQ ID NO: 1238054 - protein, 24 aa, Mycobacterium
AVVLGRPGGPAFRPSEVARLGYLA

SEQ ID NO: 1238055 - protein, 19 aa, Mycobacterium
AVVPALRFNPDLAAVYEPL

SEQ ID NO: 1238056 - protein, 19 aa, Mycobacterium
AVVRQRRSLLPAGITGVSG

SEQ ID NO: 1238057 - protein, 20 aa, Mycobacterium
AVWRAVTAVDQIFARSGGNA

SEQ ID NO: 1238058 - protein, 18 aa, Mycobacterium
AVYCCGPPAMIAAVSDAC

SEQ ID NO: 1238059 - protein, 26 aa, Mycobacterium
AVYEDRTGPPIVEWLTGRGVDTPDPV

SEQ ID NO: 1238060 - protein, 17 aa, Mycobacterium
AWARCVQTIGAFDAAAE

SEQ ID NO: 1238061 - protein, 26 aa, Mycobacterium
AWDPITRIVGSLGIYTKVDFENREVV

SEQ ID NO: 1238062 - protein, 23 aa, Mycobacterium
AWDSLWVYDHFHTVPVPTDEATH

SEQ ID NO: 1238063 - protein, 18 aa, Mycobacterium
AWEGLTFGEASQRDPELH

SEQ ID NO: 1238064 - protein, 24 aa, Mycobacterium
AWINALVCGPGMPTIGIVDFDAPL

SEQ ID NO: 1238065 - protein, 25 aa, Mycobacterium
AWQLPSDALPTWVGAPFRGKPPEQP

SEQ ID NO: 1238066 - protein, 18 aa, Mycobacterium
AWRAARLLVLDAFTTAES

SEQ ID NO: 1238067 - protein, 23 aa, Mycobacterium
AWRAKRAALATIYRVERSAGREL

SEQ ID NO: 1238068 - protein, 21 aa, Mycobacterium
AWVDGRPLIVFQASYVTAGPD

SEQ ID NO: 1238069 - protein, 20 aa, Mycobacterium
AYAREFLDGAAPLASGSYAD

SEQ ID NO: 1238070 - protein, 19 aa, Mycobacterium
AYARSRFTIAAKAAHLPSA

SEQ ID NO: 1238071 - protein, 20 aa, Mycobacterium
AYARWAGARLPTEIEWEKAC

SEQ ID NO: 1238072 - protein, 23 aa, Mycobacterium
AYGWSSLRSRPALRDQAAAALTG

SEQ ID NO: 1238073 - protein, 24 aa, Mycobacterium
AYHGYPWLIHRLAYRHANHEQLHV

SEQ ID NO: 1238074 - protein, 21 aa, Mycobacterium
AYISCGTWGLVGVELPAPVVS

SEQ ID NO: 1238075 - protein, 23 aa, Mycobacterium
AYLDCAGDLLIMLSEGTFPNVGD

SEQ ID NO: 1238076 - protein, 19 aa, Mycobacterium
AYMYAMGGGMAHILHNLGT

SEQ ID NO: 1238077 - protein, 22 aa, Mycobacterium
AYPEWDLGVQVMPDNPDQMFEG

SEQ ID NO: 1238078 - protein, 21 aa, Mycobacterium
AYRKLGMSRLRATTCHGSVSF

SEQ ID NO: 1238079 - protein, 19 aa, Mycobacterium
AYRSSPLDDQWELYDLTAD

SEQ ID NO: 1238080 - protein, 24 aa, Mycobacterium
AYRWKERRPAEVLSDEMADFGVHL

SEQ ID NO: 1238081 - protein, 33 aa, Mycobacterium
AYSPRLRPGTPVSFPLDWSELSAVTPGDFTVHT

SEQ ID NO: 1238082 - protein, 18 aa, Mycobacterium
AYTARAVACFAYGQRVPV

SEQ ID NO: 1238083 - protein, 19 aa, Mycobacterium
AYVAHAFPFPNREGEPRAI

SEQ ID NO: 1238084 - protein, 19 aa, Mycobacterium
AYVGHFTWDLKRFAASVAL

SEQ ID NO: 1238085 - protein, 24 aa, Mycobacterium
CAAAIPHLLEHGGSLVNISSAAGV

SEQ ID NO: 1238086 - protein, 17 aa, Mycobacterium
CAACLDPLTGGDRFDFT

SEQ ID NO: 1238087 - protein, 19 aa, Mycobacterium
CAAEVPRFNAISVAGAHFR

SEQ ID NO: 1238088 - protein, 21 aa, Mycobacterium
CAAEYRVHFNSARTGVRLEGP

SEQ ID NO: 1238089 - protein, 21 aa, Mycobacterium
CAAGRPAPRIVAGVPVALCSP

SEQ ID NO: 1238090 - protein, 18 aa, Mycobacterium
CAEGGVLGILCASIASVM

SEQ ID NO: 1238091 - protein, 21 aa, Mycobacterium
CAEHPEALADGGYRLAKEALI

SEQ ID NO: 1238092 - protein, 17 aa, Mycobacterium
CAHGRHDQCCAVRGRGA

SEQ ID NO: 1238093 - protein, 18 aa, Mycobacterium
CAHMSWIDTPLVQDTKAD

SEQ ID NO: 1238094 - protein, 23 aa, Mycobacterium
CAIPHMRTQGAGWIVNIGSVTGM

SEQ ID NO: 1238095 - protein, 25 aa, Mycobacterium
CAIVESLASVSGHVWLTEHGGGTVV

SEQ ID NO: 1238096 - protein, 19 aa, Mycobacterium
CAMACSYCYVPRRKGYANP

SEQ ID NO: 1238097 - protein, 20 aa, Mycobacterium
CAMTTRLIIHESLLEQAVGE

SEQ ID NO: 1238098 - protein, 24 aa, Mycobacterium
CANVPGSGCVAAYGGNNFPDDTPY

SEQ ID NO: 1238099 - protein, 18 aa, Mycobacterium
CAPANRWSVRTVGDLSLL

SEQ ID NO: 1238100 - protein, 28 aa, Mycobacterium
CAQLPPELLDDVHLLRFPPGAHVHVAID

SEQ ID NO: 1238101 - protein, 17 aa, Mycobacterium
CARDRGQAVAGLRALSV

SEQ ID NO: 1238102 - protein, 23 aa, Mycobacterium
CAREVAEVVAPILGWSAEDVSRE

SEQ ID NO: 1238103 - protein, 17 aa, Mycobacterium
CARIQPAHLARGLADAV

SEQ ID NO: 1238104 - protein, 17 aa, Mycobacterium
CAYKGRAAYYSLADGPR

SEQ ID NO: 1238105 - protein, 20 aa, Mycobacterium
CCARSRILVQRNVYDRFMEL

SEQ ID NO: 1238106 - protein, 24 aa, Mycobacterium
CDCGPQLDAAMAMVAREGRGIVLY

SEQ ID NO: 1238107 - protein, 26 aa, Mycobacterium
CDELGRRCAWVLLDAVGPVSFTLACD

SEQ ID NO: 1238108 - protein, 19 aa, Mycobacterium
CDHPDQWGLLAANPALIPR

SEQ ID NO: 1238109 - protein, 24 aa, Mycobacterium
CDKRVIPLLFLQNIAGFMVGRDYE

SEQ ID NO: 1238110 - protein, 19 aa, Mycobacterium
CDLQRPGAVNQLQIVGERA

SEQ ID NO: 1238111 - protein, 19 aa, Mycobacterium
CDNAHPGMKLHVLAPSGTF

SEQ ID NO: 1238112 - protein, 23 aa, Mycobacterium
CDRIAEFPGPVVAALNGHALGGG

SEQ ID NO: 1238113 - protein, 25 aa, Mycobacterium
CDRPIADVCPVEWARMANRSVLQWD

SEQ ID NO: 1238114 - protein, 19 aa, Mycobacterium
CDYAPVVMVNWEFFDNQTP

SEQ ID NO: 1238115 - protein, 28 aa, Mycobacterium
CEDIGVDVAFNWDHFFPLYGDPDGAHYE

SEQ ID NO: 1238116 - protein, 24 aa, Mycobacterium
CEISLTFEASVPMFTIEEGGDCTP

SEQ ID NO: 1238117 - protein, 21 aa, Mycobacterium
CERFAVSRFTIREALRRLRED

SEQ ID NO: 1238118 - protein, 27 aa, Mycobacterium
CESLYHFAWDEFCDWYVELAKVQLGEG

SEQ ID NO: 1238119 - protein, 23 aa, Mycobacterium
CESTLDFANLVTRVHEDPRVTLP

SEQ ID NO: 1238120 - protein, 20 aa, Mycobacterium
CEYDPKPAAAPSWLDGIDRP

SEQ ID NO: 1238121 - protein, 17 aa, Mycobacterium
CEYLPGRAVVMLMLVRY

SEQ ID NO: 1238122 - protein, 23 aa, Mycobacterium
CFTTEADPGLAGRSIHYARGRVI

SEQ ID NO: 1238123 - protein, 28 aa, Mycobacterium
CFVVCSEILPRWGVETVFVDGDDLSQWE

SEQ ID NO: 1238124 - protein, 19 aa, Mycobacterium
CGADTRFQPTAAMLAELDP

SEQ ID NO: 1238125 - protein, 26 aa, Mycobacterium
CGALSEWRATLIVKQSACLSVEHRRH

SEQ ID NO: 1238126 - protein, 26 aa, Mycobacterium
CGALSEWRATLIVRESACLSVEDRRS

SEQ ID NO: 1238127 - protein, 26 aa, Mycobacterium
CGALSEWRATLIVRESACLSVEHRRA

SEQ ID NO: 1238128 - protein, 29 aa, Mycobacterium
CGDDGWWRIEVDAAPDARYGFVLDDDPKV

SEQ ID NO: 1238129 - protein, 20 aa, Mycobacterium
CGDVSRLAGWGNKRVEAEAK

SEQ ID NO: 1238130 - protein, 20 aa, Mycobacterium
CGECGFCKQGAEALCGAVGF

SEQ ID NO: 1238131 - protein, 22 aa, Mycobacterium
CGGSGPKRASAWVTDRALRHLL

SEQ ID NO: 1238132 - protein, 24 aa, Mycobacterium
CGHCTACATGGLTPCEPGTAANSA

SEQ ID NO: 1238133 - protein, 20 aa, Mycobacterium
CGMCGGSGLRPEALKVTFAG

SEQ ID NO: 1238134 - protein, 23 aa, Mycobacterium
CGQGRVSIWLAERGLDVRGLDIS

SEQ ID NO: 1238135 - protein, 19 aa, Mycobacterium
CGQRLAFENSLCLNCGSAL

SEQ ID NO: 1238136 - protein, 20 aa, Mycobacterium
CGRAPSLMPLAARPGQPGAL

SEQ ID NO: 1238137 - protein, 21 aa, Mycobacterium
CGSCKELVGQIVEWAAGGAVT

SEQ ID NO: 1238138 - protein, 17 aa, Mycobacterium
CGYRRFFSITSLAGLRQ

SEQ ID NO: 1238139 - protein, 25 aa, Mycobacterium
CHREQWPVAGPVLGRLGWFVESVVS

SEQ ID NO: 1238140 - protein, 18 aa, Mycobacterium
CHTCVGTLKSGRVRDLRS

SEQ ID NO: 1238141 - protein, 21 aa, Mycobacterium
CHWLLTSRLEFFADRDRYPIG

SEQ ID NO: 1238142 - protein, 24 aa, Mycobacterium
CIGSANRDEMRWARADEFDVFRDR

SEQ ID NO: 1238143 - protein, 30 aa, Mycobacterium
CILPSRILLPRSRYDEGLEILKTMMEGFPV

SEQ ID NO: 1238144 - protein, 20 aa, Mycobacterium
CISACGSCRYCRDGQYGQCL

SEQ ID NO: 1238145 - protein, 20 aa, Mycobacterium
CITVLPLQHPIVLAKALATA

SEQ ID NO: 1238146 - protein, 17 aa, Mycobacterium
CKILVCDADTGEIVRSA

SEQ ID NO: 1238147 - protein, 18 aa, Mycobacterium
CKQRHQFGTPIGSFQVLQ

SEQ ID NO: 1238148 - protein, 17 aa, Mycobacterium
CKVSIPLVGGTLEDLIL

SEQ ID NO: 1238149 - protein, 17 aa, Mycobacterium
CLALADRLGWAVVTRYD

SEQ ID NO: 1238150 - protein, 17 aa, Mycobacterium
CLALIAAGVDDWGGVSP

SEQ ID NO: 1238151 - protein, 17 aa, Mycobacterium
CLREVPMSRDDTGELTR

SEQ ID NO: 1238152 - protein, 24 aa, Mycobacterium
CLRVLRPGGLLLMSTPNRITFSPG

SEQ ID NO: 1238153 - protein, 26 aa, Mycobacterium
CLTMARDLGSLGIRVLAIAPSLFATG

SEQ ID NO: 1238154 - protein, 18 aa, Mycobacterium
CMATLRWMRTNADRLGID

SEQ ID NO: 1238155 - protein, 22 aa, Mycobacterium
CMDARLDVYRVLGLADGEAHVI

SEQ ID NO: 1238156 - protein, 19 aa, Mycobacterium
CMLDADFLEQVGFTVVSPH

SEQ ID NO: 1238157 - protein, 18 aa, Mycobacterium
CNQFRHPALLAKMATTLD

SEQ ID NO: 1238158 - protein, 25 aa, Mycobacterium
CNRAKLSEMPALWGYARDLFQTPGF

SEQ ID NO: 1238159 - protein, 21 aa, Mycobacterium
CNRCPVTTECLSWALESGQDA

SEQ ID NO: 1238160 - protein, 21 aa, Mycobacterium
CPAEVAVPVAVNLVITDEALL

SEQ ID NO: 1238161 - protein, 19 aa, Mycobacterium
CPAPLRDSPNVVMGHGGGG

SEQ ID NO: 1238162 - protein, 18 aa, Mycobacterium
CPECHGLGRIHQVTEQTL

SEQ ID NO: 1238163 - protein, 23 aa, Mycobacterium
CPECRRGEYRRCAVNGIATMFGF

SEQ ID NO: 1238164 - protein, 21 aa, Mycobacterium
CPGAPLARAETRVGLERLLDR

SEQ ID NO: 1238165 - protein, 20 aa, Mycobacterium
CPINNGVLAVTGWEAANTVY

SEQ ID NO: 1238166 - protein, 20 aa, Mycobacterium
CPPDRFPGAITTPVTPPARA

SEQ ID NO: 1238167 - protein, 20 aa, Mycobacterium
CPPLHAGSVGIRGDNAELRL

SEQ ID NO: 1238168 - protein, 17 aa, Mycobacterium
CPVFPGRRYEEWKLDDP

SEQ ID NO: 1238169 - protein, 28 aa, Mycobacterium
CQDFARLAIACLRANGLAASYVSGYLAT

SEQ ID NO: 1238170 - protein, 22 aa, Mycobacterium
CQSPRLRAVLFKAVQGVHPPDL

SEQ ID NO: 1238171 - protein, 24 aa, Mycobacterium
CQTARARAVLAGRGHVLPEDVAAV

SEQ ID NO: 1238172 - protein, 21 aa, Mycobacterium
CRAGERRPWLVWVHGAGQGQP

SEQ ID NO: 1238173 - protein, 17 aa, Mycobacterium
CRAMRRVREEMGLSNVI

SEQ ID NO: 1238174 - protein, 18 aa, Mycobacterium
CRAPSLHNSQPWRWIVGE

SEQ ID NO: 1238175 - protein, 17 aa, Mycobacterium
CRDLGIATVAVYSDADA

SEQ ID NO: 1238176 - protein, 21 aa, Mycobacterium
CREALRLGRVLAALVPDEPEA

SEQ ID NO: 1238177 - protein, 17 aa, Mycobacterium
CREIASCTTPVVSAVGH

SEQ ID NO: 1238178 - protein, 23 aa, Mycobacterium
CRGEVPLGTLIDLLAAFHDVDAE

SEQ ID NO: 1238179 - protein, 18 aa, Mycobacterium
CRLPGGGWVLSRMLGTRF

SEQ ID NO: 1238180 - protein, 26 aa, Mycobacterium
CRQFTCKYHAWRYALNGDLTFIQQED

SEQ ID NO: 1238181 - protein, 26 aa, Mycobacterium
CRQFTCKYHGWRYGLDGALKFVQQPG

SEQ ID NO: 1238182 - protein, 19 aa, Mycobacterium
CRQTHGFALVRAHLEMARR

SEQ ID NO: 1238183 - protein, 20 aa, Mycobacterium
CRRRELAVELLRVAAVVDGN

SEQ ID NO: 1238184 - protein, 22 aa, Mycobacterium
CRTMGIKGRVYIPAKTPKQKRD

SEQ ID NO: 1238185 - protein, 29 aa, Mycobacterium
CRTPTVASVHGWCIGGGVDLISAVDIRYA

SEQ ID NO: 1238186 - protein, 27 aa, Mycobacterium
CRYMKMITPAALLRCLTYGTDEVDVDH

SEQ ID NO: 1238187 - protein, 18 aa, Mycobacterium
CSAIESVGALTAVEERIA

SEQ ID NO: 1238188 - protein, 24 aa, Mycobacterium
CSDMAFDPVFRPMLDGLRDELTIR

SEQ ID NO: 1238189 - protein, 25 aa, Mycobacterium
CSEREWHALPAMIIDCALRADGWDS

SEQ ID NO: 1238190 - protein, 22 aa, Mycobacterium
CSSGSEAIAHGWRQIVMGDADF

SEQ ID NO: 1238191 - protein, 17 aa, Mycobacterium
CSTEFAAAHGIDGAVGI

SEQ ID NO: 1238192 - protein, 24 aa, Mycobacterium
CSYLNKLLWILTGNFAKRGAQHLH

SEQ ID NO: 1238193 - protein, 21 aa, Mycobacterium
CTEPGGLCFCASMGTGPAVGP

SEQ ID NO: 1238194 - protein, 20 aa, Mycobacterium
CTFIRGHARFEDPHTVRVDD

SEQ ID NO: 1238195 - protein, 17 aa, Mycobacterium
CTHIGPDGAGHFVKMVH

SEQ ID NO: 1238196 - protein, 17 aa, Mycobacterium
CTIALGFEKMQPGSLSG

SEQ ID NO: 1238197 - protein, 22 aa, Mycobacterium
CTIAPGLFKTPLLGSLPEEAQK

SEQ ID NO: 1238198 - protein, 28 aa, Mycobacterium
CTMSGLRGGVFSAILPVLAHDIPWNSGV

SEQ ID NO: 1238199 - protein, 21 aa, Mycobacterium
CTQALREGRLSLDQVGAIAER

SEQ ID NO: 1238200 - protein, 17 aa, Mycobacterium
CTVEPGVVTGFLGPNGA

SEQ ID NO: 1238201 - protein, 25 aa, Mycobacterium
CVAQTRILAPRSRYDEVVEKLANFV

SEQ ID NO: 1238202 - protein, 19 aa, Mycobacterium
CVDCGEPAKHWSFSGCESE

SEQ ID NO: 1238203 - protein, 20 aa, Mycobacterium
CVDYARGRFDAAVPEEVQRE

SEQ ID NO: 1238204 - protein, 20 aa, Mycobacterium
CVMVAEGVPCLGPVTHAGCG

SEQ ID NO: 1238205 - protein, 18 aa, Mycobacterium
CVPVLLADARAGVIGAVH

SEQ ID NO: 1238206 - protein, 24 aa, Mycobacterium
CVQAGIPAVTFWAAVPHYVSQPPN

SEQ ID NO: 1238207 - protein, 17 aa, Mycobacterium
CVSGCPYKKMYFNHKTG

SEQ ID NO: 1238208 - protein, 17 aa, Mycobacterium
CVSSLIKVKGFRNTIHW

SEQ ID NO: 1238209 - protein, 17 aa, Mycobacterium
CVTPGYMTMGGFIPAQD

SEQ ID NO: 1238210 - protein, 19 aa, Mycobacterium
CWDPSAPEFDEYVGDFHHW

SEQ ID NO: 1238211 - protein, 26 aa, Mycobacterium
CYDAYLWLRRKGYEPDQIVLAGDSAG

SEQ ID NO: 1238212 - protein, 26 aa, Mycobacterium
CYDIRFPELYVELARRGAQLITVHAS

SEQ ID NO: 1238213 - protein, 17 aa, Mycobacterium
DAAAAGLGCRFATAYRA

SEQ ID NO: 1238214 - protein, 22 aa, Mycobacterium
DAAALVKGGCRIVAEGANMPCT

SEQ ID NO: 1238215 - protein, 18 aa, Mycobacterium
DAAARLFTERGFYDVHID

SEQ ID NO: 1238216 - protein, 25 aa, Mycobacterium
DAAAVQIMTVWVSKGLQYPVVYLPF

SEQ ID NO: 1238217 - protein, 23 aa, Mycobacterium
DAADADGAAALWAEDGSYDVEGW

SEQ ID NO: 1238218 - protein, 21 aa, Mycobacterium
DAADDLAYWRRVMADPPEPLE

SEQ ID NO: 1238219 - protein, 25 aa, Mycobacterium
DAADIHALGGWWAEVLGYAQEVTDD

SEQ ID NO: 1238220 - protein, 18 aa, Mycobacterium
DAAELCGLDEPTGVVATG

SEQ ID NO: 1238221 - protein, 25 aa, Mycobacterium
DAAFEAYEFSRACESLYHFAWDEFC

SEQ ID NO: 1238222 - protein, 29 aa, Mycobacterium
DAALARDFLLTWFVYTAWELDDAKRVSGA

SEQ ID NO: 1238223 - protein, 23 aa, Mycobacterium
DAALEVFVELGLNLDATALGEAL

SEQ ID NO: 1238224 - protein, 25 aa, Mycobacterium
DAANAFKSVGFMLEATGHNYANADA

SEQ ID NO: 1238225 - protein, 20 aa, Mycobacterium
DAAQRWGIAVGDRVVSEQIV

SEQ ID NO: 1238226 - protein, 19 aa, Mycobacterium
DAARRARVASRTLATLSTE

SEQ ID NO: 1238227 - protein, 19 aa, Mycobacterium
DAARSLLESDWRAMDSRAN

SEQ ID NO: 1238228 - protein, 26 aa, Mycobacterium
DAASMLRRLEHVPIATVVRLPTADAA

SEQ ID NO: 1238229 - protein, 26 aa, Mycobacterium
DAATGCARAVVDLHVVDGRLRRASLG

SEQ ID NO: 1238230 - protein, 24 aa, Mycobacterium
DACATAAAVRARWCENLDELDHSA

SEQ ID NO: 1238231 - protein, 24 aa, Mycobacterium
DACRGGCMAAKFFTGLPLDGPDPE

SEQ ID NO: 1238232 - protein, 17 aa, Mycobacterium
DADADAWHVADADEAVH

SEQ ID NO: 1238233 - protein, 20 aa, Mycobacterium
DADCVFYTPVIMDVDTVCRL

SEQ ID NO: 1238234 - protein, 24 aa, Mycobacterium
DADESPATFARRMVGYAAAVFASN

SEQ ID NO: 1238235 - protein, 19 aa, Mycobacterium
DADFLGILDIRPFARGHTL

SEQ ID NO: 1238236 - protein, 23 aa, Mycobacterium
DADLADYVVLDFAAFHWHEESEP

SEQ ID NO: 1238237 - protein, 18 aa, Mycobacterium
DADLRHAVDQEFLRRRLA

SEQ ID NO: 1238238 - protein, 23 aa, Mycobacterium
DADTIGAILARLIHSFVTVPAAA

SEQ ID NO: 1238239 - protein, 17 aa, Mycobacterium
DAEAAWRGAFLAHGSLT

SEQ ID NO: 1238240 - protein, 23 aa, Mycobacterium
DAEDFAALLIYRLGRLPCDRSSI

SEQ ID NO: 1238241 - protein, 23 aa, Mycobacterium
DAEFRVGTMGLGWDSEAQTIVVE

SEQ ID NO: 1238242 - protein, 18 aa, Mycobacterium
DAEGWLRITDRSKEMIKV

SEQ ID NO: 1238243 - protein, 23 aa, Mycobacterium
DAEKYRRLHVIVGDSNMCESTTM

SEQ ID NO: 1238244 - protein, 20 aa, Mycobacterium
DAELGFTVVHCRDIDRIGVD

SEQ ID NO: 1238245 - protein, 28 aa, Mycobacterium
DAELRIAQAQLVGWLEGLFHGIQTALFA

SEQ ID NO: 1238246 - protein, 23 aa, Mycobacterium
DAERIRRVAERIVETKKAGNDVV

SEQ ID NO: 1238247 - protein, 25 aa, Mycobacterium
DAESGYRLFSGIRRLTSVLAAMAAP

SEQ ID NO: 1238248 - protein, 29 aa, Mycobacterium
DAESRRPRCLLAFGQFEFVSRQWFRRGWQ

SEQ ID NO: 1238249 - protein, 22 aa, Mycobacterium
DAFAIERLRAAGAVLIGLTNMP

SEQ ID NO: 1238250 - protein, 26 aa, Mycobacterium
DAFDVYRWVTVNAELVGGDATRVAVA

SEQ ID NO: 1238251 - protein, 17 aa, Mycobacterium
DAFGVTTHGVWAERGGG

SEQ ID NO: 1238252 - protein, 18 aa, Mycobacterium
DAFLDLVLEYGRELRWRT

SEQ ID NO: 1238253 - protein, 18 aa, Mycobacterium
DAFQEYYHVPSLHSQQVP

SEQ ID NO: 1238254 - protein, 25 aa, Mycobacterium
DAGAFWRVAAEYGVKALFTAPTAIR

SEQ ID NO: 1238255 - protein, 17 aa, Mycobacterium
DAGDEWEAFLGKDEDLY

SEQ ID NO: 1238256 - protein, 18 aa, Mycobacterium
DAGFAFTVGDEFQGTHPS

SEQ ID NO: 1238257 - protein, 20 aa, Mycobacterium
DAGFHHVVWAFGDGTLFGIH

SEQ ID NO: 1238258 - protein, 24 aa, Mycobacterium
DAGGGVLLPIHWGTFRLAPHPWAE

SEQ ID NO: 1238259 - protein, 17 aa, Mycobacterium
DAGHLFRPTPNFRRYAV

SEQ ID NO: 1238260 - protein, 19 aa, Mycobacterium
DAGKARKAGRRFAQLAPIV

SEQ ID NO: 1238261 - protein, 17 aa, Mycobacterium
DAGVAFVNALPVFIASD

SEQ ID NO: 1238262 - protein, 18 aa, Mycobacterium
DAGVDLFLCDSTNADRPG

SEQ ID NO: 1238263 - protein, 18 aa, Mycobacterium
DAHFPGDFIVEYIGQTRG

SEQ ID NO: 1238264 - protein, 18 aa, Mycobacterium
DAHRLGGVGDGWRVAMTT

SEQ ID NO: 1238265 - protein, 28 aa, Mycobacterium
DAIGIPDEWFLAGHLVVGWPRGSHGPVR

SEQ ID NO: 1238266 - protein, 30 aa, Mycobacterium
DAIGRLCTRGSAGLVPFSHRLAAEEWRSLR

SEQ ID NO: 1238267 - protein, 24 aa, Mycobacterium
DAIVGLAQRWLRSGGRVAVEHDDT

SEQ ID NO: 1238268 - protein, 20 aa, Mycobacterium
DAKEQLSRLEGMDFGSPEFL

SEQ ID NO: 1238269 - protein, 22 aa, Mycobacterium
DAKIGYPPTRVWGVPAAGMWAH

SEQ ID NO: 1238270 - protein, 21 aa, Mycobacterium
DAKRMFACFDQPDLKATFDVT

SEQ ID NO: 1238271 - protein, 19 aa, Mycobacterium
DALDLLPLPNRLDLLETLG

SEQ ID NO: 1238272 - protein, 17 aa, Mycobacterium
DALDRWLQQSSVETVNI

SEQ ID NO: 1238273 - protein, 20 aa, Mycobacterium
DALDVRWALLVGDRHGGELA

SEQ ID NO: 1238274 - protein, 28 aa, Mycobacterium
DALGSILSWQNWEEMFSIARFVGVSRPG

SEQ ID NO: 1238275 - protein, 22 aa, Mycobacterium
DALHIYRVLFAYLHGHILDELQ

SEQ ID NO: 1238276 - protein, 23 aa, Mycobacterium
DALLDLYEFWLGTKANEIGITAT

SEQ ID NO: 1238277 - protein, 27 aa, Mycobacterium
DALLPWRSVIENVRLPLQIDGGRRGEQ

SEQ ID NO: 1238278 - protein, 22 aa, Mycobacterium
DALRLREILEVGAARTAAGRTL

SEQ ID NO: 1238279 - protein, 21 aa, Mycobacterium
DALRMSRSFVSWAVNDAIERG

SEQ ID NO: 1238280 - protein, 23 aa, Mycobacterium
DALRPQWLFGQSVHEGCDRAGYY

SEQ ID NO: 1238281 - protein, 17 aa, Mycobacterium
DALSIGFCGPTHDERSW

SEQ ID NO: 1238282 - protein, 19 aa, Mycobacterium
DALSRWADRIAGWDAEGRR

SEQ ID NO: 1238283 - protein, 22 aa, Mycobacterium
DALTGLRWVVANAVELQVDPSR

SEQ ID NO: 1238284 - protein, 20 aa, Mycobacterium
DAMARPVIPVFINSVATPLG

SEQ ID NO: 1238285 - protein, 23 aa, Mycobacterium
DANEGLRSRFTRSIDFPSYSPGE

SEQ ID NO: 1238286 - protein, 19 aa, Mycobacterium
DAPDVVRYVMGFGDTPEKA

SEQ ID NO: 1238287 - protein, 20 aa, Mycobacterium
DAPGGIAERVIAPLARASLE

SEQ ID NO: 1238288 - protein, 21 aa, Mycobacterium
DAPLVFDWIDWQGVRRTDQPT

SEQ ID NO: 1238289 - protein, 22 aa, Mycobacterium
DAPQHREFVQAAMVTDLPGELM

SEQ ID NO: 1238290 - protein, 17 aa, Mycobacterium
DAPRYAELIKRTQWWGR

SEQ ID NO: 1238291 - protein, 26 aa, Mycobacterium
DAPVYRLPWQPVFALNFSAVNLGASE

SEQ ID NO: 1238292 - protein, 19 aa, Mycobacterium
DAPWKDIEAQGWIAPAECI

SEQ ID NO: 1238293 - protein, 22 aa, Mycobacterium
DAQRFAQVGAWSGRILLDGQEI

SEQ ID NO: 1238294 - protein, 18 aa, Mycobacterium
DAQRIELRGGDGSANPYL

SEQ ID NO: 1238295 - protein, 20 aa, Mycobacterium
DAQYLALVRCCAAIMRRLGF

SEQ ID NO: 1238296 - protein, 24 aa, Mycobacterium
DARFGWPKRNGFVQPMVDAELHAG

SEQ ID NO: 1238297 - protein, 20 aa, Mycobacterium
DARGSANLPARRGENHVESL

SEQ ID NO: 1238298 - protein, 19 aa, Mycobacterium
DARGWLRDPAPLFRTNVEG

SEQ ID NO: 1238299 - protein, 24 aa, Mycobacterium
DARIPTGRLNTFFKEIVAATPPPV

SEQ ID NO: 1238300 - protein, 22 aa, Mycobacterium
DARSELWFFYHLGRILREKLAG

SEQ ID NO: 1238301 - protein, 29 aa, Mycobacterium
DARSLEVYPGLWAGPSLLRDGAGTAATGS

SEQ ID NO: 1238302 - protein, 21 aa, Mycobacterium
DARTPLPDWWADLDADAVTAE

SEQ ID NO: 1238303 - protein, 24 aa, Mycobacterium
DASGKLLGFHWTKVHGPDLGEVYV

SEQ ID NO: 1238304 - protein, 17 aa, Mycobacterium
DASRFDFITDFGALIPM

SEQ ID NO: 1238305 - protein, 17 aa, Mycobacterium
DASRPFFPFLVDLLDAW

SEQ ID NO: 1238306 - protein, 24 aa, Mycobacterium
DATMKRLLPDFFRAATDHPAGSGT

SEQ ID NO: 1238307 - protein, 18 aa, Mycobacterium
DATWRFMTLDGDGKIRMD

SEQ ID NO: 1238308 - protein, 23 aa, Mycobacterium
DAVARLSAQYGVPVLSVHAPCLL

SEQ ID NO: 1238309 - protein, 29 aa, Mycobacterium
DAVCHACGLEPRLAVPLLAPVLGIEPRAG

SEQ ID NO: 1238310 - protein, 24 aa, Mycobacterium
DAVELHGAHGYLLDEFFWERTNSR

SEQ ID NO: 1238311 - protein, 24 aa, Mycobacterium
DAVFYCVANMPGAVPRTSTFALTN

SEQ ID NO: 1238312 - protein, 17 aa, Mycobacterium
DAVPYLFEREGTNCENL

SEQ ID NO: 1238313 - protein, 17 aa, Mycobacterium
DAVTRLVGLTGITFTNV

SEQ ID NO: 1238314 - protein, 18 aa, Mycobacterium
DAWSETFLSALRAYPDLP

SEQ ID NO: 1238315 - protein, 24 aa, Mycobacterium
DAYVRVSVVGIEILTVDARVVVAS

SEQ ID NO: 1238316 - protein, 25 aa, Mycobacterium
DCAGLCAECGVALATAEPGHHHDTI

SEQ ID NO: 1238317 - protein, 26 aa, Mycobacterium
DCGADFRLTDAAAWERFYGSAHAGSW

SEQ ID NO: 1238318 - protein, 19 aa, Mycobacterium
DCGAGLFQPASRAVLSTVS

SEQ ID NO: 1238319 - protein, 21 aa, Mycobacterium
DCLIGVALPKPGVTTNVIVDT

SEQ ID NO: 1238320 - protein, 21 aa, Mycobacterium
DCLTGRQAAEWGLAVEAPEPE

SEQ ID NO: 1238321 - protein, 25 aa, Mycobacterium
DCMPKSVVINPYFDWGTDRPPNHEY

SEQ ID NO: 1238322 - protein, 20 aa, Mycobacterium
DCPGCAWPEDAGGRKLAEFC

SEQ ID NO: 1238323 - protein, 31 aa, Mycobacterium
DCPGHPRLSLLRLGARLGFTMIALDRPGYGS

SEQ ID NO: 1238324 - protein, 18 aa, Mycobacterium
DCSASLQSALGWLKYTID

SEQ ID NO: 1238325 - protein, 22 aa, Mycobacterium
DCTGLLPLASVAAMQGRIAMYH

SEQ ID NO: 1238326 - protein, 26 aa, Mycobacterium
DDAALRFELCLGVSGVHYPGDAGREL

SEQ ID NO: 1238327 - protein, 18 aa, Mycobacterium
DDAIKLAATRGAEMAKAC

SEQ ID NO: 1238328 - protein, 22 aa, Mycobacterium
DDALMKITHVLRGEDLLPSTPR

SEQ ID NO: 1238329 - protein, 22 aa, Mycobacterium
DDAPILLCVHGISANLTAFTYL

SEQ ID NO: 1238330 - protein, 29 aa, Mycobacterium
DDAVSLLRYCLDHGYQLRIIEQMPLDAEH

SEQ ID NO: 1238331 - protein, 19 aa, Mycobacterium
DDDLFTGFVTWTADILAAR

SEQ ID NO: 1238332 - protein, 25 aa, Mycobacterium
DDEDVWAAKWARAYVEWAAGEKRDY

SEQ ID NO: 1238333 - protein, 24 aa, Mycobacterium
DDEGEKRIPLDVSEGDTVIYSKYG

SEQ ID NO: 1238334 - protein, 18 aa, Mycobacterium
DDENWVWAGADVIDPDHT

SEQ ID NO: 1238335 - protein, 21 aa, Mycobacterium
DDERFSWSYAGARHLKGIRGE

SEQ ID NO: 1238336 - protein, 18 aa, Mycobacterium
DDFAQTWQAVVPEETDEE

SEQ ID NO: 1238337 - protein, 27 aa, Mycobacterium
DDGEGAVRLNHEFHRAINVAADSPKLA

SEQ ID NO: 1238338 - protein, 24 aa, Mycobacterium
DDGIGLDEFVDWLVEAGYRIDRID

SEQ ID NO: 1238339 - protein, 18 aa, Mycobacterium
DDGIPVLLVDEAVAVTDD

SEQ ID NO: 1238340 - protein, 20 aa, Mycobacterium
DDGRPAALIDTAAWFGRTAP

SEQ ID NO: 1238341 - protein, 18 aa, Mycobacterium
DDGWAYAVAEGDAILTPP

SEQ ID NO: 1238342 - protein, 18 aa, Mycobacterium
DDHLLPKVMSFAVEDVFV

SEQ ID NO: 1238343 - protein, 23 aa, Mycobacterium
DDHPGRLDALLDLADRLGPAEKA

SEQ ID NO: 1238344 - protein, 17 aa, Mycobacterium
DDIAALFAQSARTAREV

SEQ ID NO: 1238345 - protein, 21 aa, Mycobacterium
DDIMTGMALATFPDGSTPEVI

SEQ ID NO: 1238346 - protein, 24 aa, Mycobacterium
DDKLPRYIGGVLARLQEVWVGRQI

SEQ ID NO: 1238347 - protein, 23 aa, Mycobacterium
DDKRGRAAANMFWELGADEALII

SEQ ID NO: 1238348 - protein, 23 aa, Mycobacterium
DDLARYPLVYFIDSMLQVDDLDS

SEQ ID NO: 1238349 - protein, 19 aa, Mycobacterium
DDLKVAWRHRSERYTEKLA

SEQ ID NO: 1238350 - protein, 20 aa, Mycobacterium
DDLLRSGVLVDLYPLVRKSF

SEQ ID NO: 1238351 - protein, 23 aa, Mycobacterium
DDLPGFRSGKAFDDAGFAQFAEW

SEQ ID NO: 1238352 - protein, 30 aa, Mycobacterium
DDLPLARACLLGCGVTTGWGSAVNTADVSP

SEQ ID NO: 1238353 - protein, 23 aa, Mycobacterium
DDLRLLPRYVRTIHSWQLSRVED

SEQ ID NO: 1238354 - protein, 25 aa, Mycobacterium
DDLSALDFYRPVPVEDDGEVDGGDL

SEQ ID NO: 1238355 - protein, 31 aa, Mycobacterium
DDLSGSVWRWFRDGDEWKAEKVITVPAEPAD

SEQ ID NO: 1238356 - protein, 33 aa, Mycobacterium
DDLWDEFHRVVNMTSRELLDWLRTRSAGEGSEE

SEQ ID NO: 1238357 - protein, 24 aa, Mycobacterium
DDPAAMTRLPWHVVGDWINGSPRT

SEQ ID NO: 1238358 - protein, 17 aa, Mycobacterium
DDPATWTEPGVRHLAAN

SEQ ID NO: 1238359 - protein, 24 aa, Mycobacterium
DDPDWLRWNYATVVWGIATAHELY

SEQ ID NO: 1238360 - protein, 19 aa, Mycobacterium
DDPGYAWAREYLSVERLRT

SEQ ID NO: 1238361 - protein, 24 aa, Mycobacterium
DDPLRALWEYSWDEATGTLMTEFM

SEQ ID NO: 1238362 - protein, 25 aa, Mycobacterium
DDPLWKAPGAMVFPHDSHASQLLGD

SEQ ID NO: 1238363 - protein, 23 aa, Mycobacterium
DDPRDAAKLAVRMEEDGAAAWRA

SEQ ID NO: 1238364 - protein, 25 aa, Mycobacterium
DDPRLGALLEWRQRLIDSGAVSARS

SEQ ID NO: 1238365 - protein, 24 aa, Mycobacterium
DDPRRRLAASMAKAAAGECQSLVF

SEQ ID NO: 1238366 - protein, 22 aa, Mycobacterium
DDPYPFYAALRDKCPVTREDHY

SEQ ID NO: 1238367 - protein, 24 aa, Mycobacterium
DDRLRRRVRSFGEHLRVTVRAYLL

SEQ ID NO: 1238368 - protein, 27 aa, Mycobacterium
DDSERRIALALARMVPGAREVRIGAPP

SEQ ID NO: 1238369 - protein, 25 aa, Mycobacterium
DDSFPIASVVKLFIADDLLLQESQG

SEQ ID NO: 1238370 - protein, 17 aa, Mycobacterium
DDSRLATYDGRNRVNPP

SEQ ID NO: 1238371 - protein, 18 aa, Mycobacterium
DDSYCAGPRAMPLLVPTT

SEQ ID NO: 1238372 - protein, 22 aa, Mycobacterium
DDTLPMLTGIRVEITGESVVLA

SEQ ID NO: 1238373 - protein, 27 aa, Mycobacterium
DDTRTPWPMWPLVLRTRLSPAHAEGGQ

SEQ ID NO: 1238374 - protein, 18 aa, Mycobacterium
DDTWKGPGRPLSSGYAER

SEQ ID NO: 1238375 - protein, 17 aa, Mycobacterium
DDVFNVDELTAWSSRVR

SEQ ID NO: 1238376 - protein, 18 aa, Mycobacterium
DDVLDGWSRVVRAVHAAG

SEQ ID NO: 1238377 - protein, 23 aa, Mycobacterium
DDVLRLIFIAAHPVLSRENQIAL

SEQ ID NO: 1238378 - protein, 25 aa, Mycobacterium
DDVMYPQILLRVGWAPVNADPLPAT

SEQ ID NO: 1238379 - protein, 21 aa, Mycobacterium
DDVQAAFELACRPTPGRVKIA

SEQ ID NO: 1238380 - protein, 19 aa, Mycobacterium
DDVRARALGATAWAPSAQA

SEQ ID NO: 1238381 - protein, 23 aa, Mycobacterium
DDVRAVGGLYVLGTERHESRRID

SEQ ID NO: 1238382 - protein, 20 aa, Mycobacterium
DDVSGWAVGQPVCALLAGGG

SEQ ID NO: 1238383 - protein, 20 aa, Mycobacterium
DDYHPEWWPGVVAAVEEALP

SEQ ID NO: 1238384 - protein, 17 aa, Mycobacterium
DDYKTLHGMTSRGFPNQ

SEQ ID NO: 1238385 - protein, 27 aa, Mycobacterium
DEAAARLAANLMKWTGISPQHVARTTL

SEQ ID NO: 1238386 - protein, 24 aa, Mycobacterium
DEAAEAVMRWGMLRGAGLRVTPTT

SEQ ID NO: 1238387 - protein, 18 aa, Mycobacterium
DEAIRWYHDHLGMIVLHE

SEQ ID NO: 1238388 - protein, 26 aa, Mycobacterium
DEALAEIKQRWTAIIDEYGSQAIMPH

SEQ ID NO: 1238389 - protein, 23 aa, Mycobacterium
DEALRAGGVVIVFPGGDYDVYRP

SEQ ID NO: 1238390 - protein, 25 aa, Mycobacterium
DEALRRGVPVLGICRGAQILNVALG

SEQ ID NO: 1238391 - protein, 22 aa, Mycobacterium
DEANPALGVRGIRIAHGNPGIL

SEQ ID NO: 1238392 - protein, 21 aa, Mycobacterium
DEARAIALQMERLITDIGQYG

SEQ ID NO: 1238393 - protein, 17 aa, Mycobacterium
DEARAKAFTELRQLLAV

SEQ ID NO: 1238394 - protein, 18 aa, Mycobacterium
DEARPLLRQFPTLVPTGV

SEQ ID NO: 1238395 - protein, 38 aa, Mycobacterium
DEDFWLKVGIDPVRLMTRSGTFYTLRCYLGDDPVFLGR

SEQ ID NO: 1238396 - protein, 17 aa, Mycobacterium
DEDGFYFIVDRTKDMIV

SEQ ID NO: 1238397 - protein, 18 aa, Mycobacterium
DEDLLAWAAADLGTVFGI

SEQ ID NO: 1238398 - protein, 23 aa, Mycobacterium
DEDPIALLVLDAWSEVIPSPSGR

SEQ ID NO: 1238399 - protein, 23 aa, Mycobacterium
DEDRELLESFDLSYGEDAGDEGD

SEQ ID NO: 1238400 - protein, 24 aa, Mycobacterium
DEEALRLLTAVGIPEPARRMRAYP

SEQ ID NO: 1238401 - protein, 28 aa, Mycobacterium
DEEFARAAGMPGVFGMGLLHGGVLAQRL

SEQ ID NO: 1238402 - protein, 25 aa, Mycobacterium
DEELDGPLPRRARTFVLTTEAERPT

SEQ ID NO: 1238403 - protein, 17 aa, Mycobacterium
DEFFALFLDATRTYSCA

SEQ ID NO: 1238404 - protein, 27 aa, Mycobacterium
DEFGIDTANMFGFWDWVGGRYSVDSAI

SEQ ID NO: 1238405 - protein, 22 aa, Mycobacterium
DEFHPELQFDKPYLLAMANAGP

SEQ ID NO: 1238406 - protein, 17 aa, Mycobacterium
DEFIRIGPFKEVMNWDE

SEQ ID NO: 1238407 - protein, 21 aa, Mycobacterium
DEFREALALLAGGRHLFLTGK

SEQ ID NO: 1238408 - protein, 22 aa, Mycobacterium
DEFTYPLKWGWVDVDEVVEVLR

SEQ ID NO: 1238409 - protein, 23 aa, Mycobacterium
DEGDFRWAATLLDHAVFADQNHT

SEQ ID NO: 1238410 - protein, 19 aa, Mycobacterium
DEGMLRCGLQAAAQRLPFL

SEQ ID NO: 1238411 - protein, 19 aa, Mycobacterium
DEGQFEFELDLAIAGLEQL

SEQ ID NO: 1238412 - protein, 17 aa, Mycobacterium
DEHARFGGVVPEIASRA

SEQ ID NO: 1238413 - protein, 18 aa, Mycobacterium
DEHLPDWQPCPGGGGLAL

SEQ ID NO: 1238414 - protein, 17 aa, Mycobacterium
DEICSVGPLAPGCGMNI

SEQ ID NO: 1238415 - protein, 19 aa, Mycobacterium
DEIESAIGLAERDPQVKVI

SEQ ID NO: 1238416 - protein, 23 aa, Mycobacterium
DEIHLPGIFVQRIVALTPIQALR

SEQ ID NO: 1238417 - protein, 23 aa, Mycobacterium
DEIIKMVDLMIGRVGNQLRAKDM

SEQ ID NO: 1238418 - protein, 27 aa, Mycobacterium
DEILSRLSARHDIMWLMTSDLSPLGGP

SEQ ID NO: 1238419 - protein, 21 aa, Mycobacterium
DEIRKAVRYQIKHGAQLIKVC

SEQ ID NO: 1238420 - protein, 20 aa, Mycobacterium
DEIVLLGLRARRPLSDPGTF

SEQ ID NO: 1238421 - protein, 27 aa, Mycobacterium
DEKLVWKAQIFLSHRSWESTITEQVPN

SEQ ID NO: 1238422 - protein, 21 aa, Mycobacterium
DELFALLAYGEVAAFYRLTEE

SEQ ID NO: 1238423 - protein, 19 aa, Mycobacterium
DELITEIAERGGVRRCPSL

SEQ ID NO: 1238424 - protein, 21 aa, Mycobacterium
DELKESLTEQVRRVKRVQQAE

SEQ ID NO: 1238425 - protein, 20 aa, Mycobacterium
DELRAAVSRYWEIDDVRPAF

SEQ ID NO: 1238426 - protein, 20 aa, Mycobacterium
DELRQALSPSRAAAEDVRDI

SEQ ID NO: 1238427 - protein, 27 aa, Mycobacterium
DELRRIIPPWVTLGSRLAVIPSPPTTF

SEQ ID NO: 1238428 - protein, 19 aa, Mycobacterium
DELTSRFLINATGVLTVPN

SEQ ID NO: 1238429 - protein, 23 aa, Mycobacterium
DELYAAGAAAIFPPGTVIADAAT

SEQ ID NO: 1238430 - protein, 24 aa, Mycobacterium
DEPDNRVSLLLPRLPVDKADPLHQ

SEQ ID NO: 1238431 - protein, 23 aa, Mycobacterium
DEPEAHGLVALMELQSSRFAART

SEQ ID NO: 1238432 - protein, 20 aa, Mycobacterium
DEPFWKQTFSEFSTLLKTED

SEQ ID NO: 1238433 - protein, 24 aa, Mycobacterium
DEPIRWAYFPWRRTVVSVLGPRAH

SEQ ID NO: 1238434 - protein, 25 aa, Mycobacterium
DEPVLQWMAAQGLRSYEMTEIVARG

SEQ ID NO: 1238435 - protein, 26 aa, Mycobacterium
DEPWAVPMLVARDGDRLLLHGSTGAG

SEQ ID NO: 1238436 - protein, 17 aa, Mycobacterium
DEQPAVFEYGFAGTCTS

SEQ ID NO: 1238437 - protein, 21 aa, Mycobacterium
DEQRAAALIQHDRNYWQRSLP

SEQ ID NO: 1238438 - protein, 18 aa, Mycobacterium
DERGCGLSDWEVGDFTFD

SEQ ID NO: 1238439 - protein, 20 aa, Mycobacterium
DERLGEVGKAFVVAKPGANL

SEQ ID NO: 1238440 - protein, 23 aa, Mycobacterium
DERLPAVLADLGLDTDAVRPHST

SEQ ID NO: 1238441 - protein, 19 aa, Mycobacterium
DERLRATVMARCIAAAVFG

SEQ ID NO: 1238442 - protein, 23 aa, Mycobacterium
DERWTLLVVRELLLGSTHFNELR

SEQ ID NO: 1238443 - protein, 24 aa, Mycobacterium
DESLDRLGLDYVDIFYSHRIDPTT

SEQ ID NO: 1238444 - protein, 27 aa, Mycobacterium
DESQRPTPPCGLPFVTASAAGIAAGSD

SEQ ID NO: 1238445 - protein, 29 aa, Mycobacterium
DESRLTFLAVRRWYGWSAGRIINIDIGGG

SEQ ID NO: 1238446 - protein, 23 aa, Mycobacterium
DESRYATGAEFVMDGGLVNDVPH

SEQ ID NO: 1238447 - protein, 19 aa, Mycobacterium
DESWECPLHGSRFAPDGTL

SEQ ID NO: 1238448 - protein, 20 aa, Mycobacterium
DETLSRRTARRFSRRRGVRA

SEQ ID NO: 1238449 - protein, 17 aa, Mycobacterium
DETYSFGGLPTGRGGKF

SEQ ID NO: 1238450 - protein, 23 aa, Mycobacterium
DEVACPFHDWRWGGDGKCKLVPY

SEQ ID NO: 1238451 - protein, 20 aa, Mycobacterium
DEVEECWQLLRQSLHSVSYE

SEQ ID NO: 1238452 - protein, 25 aa, Mycobacterium
DEVIFAWRSFEIYPLQVRTAGATPV

SEQ ID NO: 1238453 - protein, 24 aa, Mycobacterium
DEVIQCPFHGWQWNAEGRNVCIPY

SEQ ID NO: 1238454 - protein, 26 aa, Mycobacterium
DEVLAALAPHRARVVGLTGPPGAGKS

SEQ ID NO: 1238455 - protein, 17 aa, Mycobacterium
DEVPRDALLRLLVDVQY

SEQ ID NO: 1238456 - protein, 19 aa, Mycobacterium
DEVRLRLTAASDCTDAALH

SEQ ID NO: 1238457 - protein, 17 aa, Mycobacterium
DEVRRNMGLTGQVATVD

SEQ ID NO: 1238458 - protein, 21 aa, Mycobacterium
DEVVVDWPHRYLAAQVAAGDV

SEQ ID NO: 1238459 - protein, 17 aa, Mycobacterium
DEVWDWTAELAELPSLL

SEQ ID NO: 1238460 - protein, 24 aa, Mycobacterium
DEYARRLAGWTGWADEAQVLNRVR

SEQ ID NO: 1238461 - protein, 21 aa, Mycobacterium
DFAAEAAFVLAMIGVDLSRLA

SEQ ID NO: 1238462 - protein, 19 aa, Mycobacterium
DFATRGWASGEQWREDWPR

SEQ ID NO: 1238463 - protein, 18 aa, Mycobacterium
DFDAHLEHMRHLFDDLDP

SEQ ID NO: 1238464 - protein, 25 aa, Mycobacterium
DFEGLRRFHHNFGYGLAGRRIEPSP

SEQ ID NO: 1238465 - protein, 19 aa, Mycobacterium
DFFDEIFRELGIPYEPVRW

SEQ ID NO: 1238466 - protein, 25 aa, Mycobacterium
DFFEGVMMPELFLADAVGATNKPMI

SEQ ID NO: 1238467 - protein, 17 aa, Mycobacterium
DFFRLFLDPSQMYSCAY

SEQ ID NO: 1238468 - protein, 33 aa, Mycobacterium
DFFTELFGLPAAREFGPFLAVELEHGVSLDYAQ

SEQ ID NO: 1238469 - protein, 24 aa, Mycobacterium
DFHFDVMCPFAYQTSRWIRSVRDQ

SEQ ID NO: 1238470 - protein, 18 aa, Mycobacterium
DFLARLRGPDALDIRRRD

SEQ ID NO: 1238471 - protein, 18 aa, Mycobacterium
DFLREIHTLASIFTTVRI

SEQ ID NO: 1238472 - protein, 30 aa, Mycobacterium
DFLYRRNGYENAPRPDLILLDLNLPKYDGR

SEQ ID NO: 1238473 - protein, 25 aa, Mycobacterium
DFMPVVWAMFEWGRRHIDDSRLRLT

SEQ ID NO: 1238474 - protein, 20 aa, Mycobacterium
DFPSIGALPYLLTLPGHGFY

SEQ ID NO: 1238475 - protein, 19 aa, Mycobacterium
DFRRRGTGAAMARAGLAEG

SEQ ID NO: 1238476 - protein, 27 aa, Mycobacterium
DFRSRCREISAAFGGGEYVRYAAKAFL

SEQ ID NO: 1238477 - protein, 26 aa, Mycobacterium
DFVNARPKPLAAYLFTKTKAIRERVV

SEQ ID NO: 1238478 - protein, 27 aa, Mycobacterium
DFYTWTQWIFLQIYNAWFDRDANRARP

SEQ ID NO: 1238479 - protein, 20 aa, Mycobacterium
DGAEAPAWAEFFATTETVGG

SEQ ID NO: 1238480 - protein, 27 aa, Mycobacterium
DGAEVLRRLKALPGFGEQKAKIFLALL

SEQ ID NO: 1238481 - protein, 21 aa, Mycobacterium
DGAFPRLGVVDGDDALARDPM

SEQ ID NO: 1238482 - protein, 23 aa, Mycobacterium
DGAGRLDQGLAFVSYQRSLEKGF

SEQ ID NO: 1238483 - protein, 20 aa, Mycobacterium
DGAGWLTFWRSLTARGLSGV

SEQ ID NO: 1238484 - protein, 26 aa, Mycobacterium
DGAHYECWTMLAAWAEQTSRIEIGAL

SEQ ID NO: 1238485 - protein, 17 aa, Mycobacterium
DGALRRFGADVAVAITG

SEQ ID NO: 1238486 - protein, 24 aa, Mycobacterium
DGAPGLRLALALPPIEVAVTARLT

SEQ ID NO: 1238487 - protein, 28 aa, Mycobacterium
DGAQDVGGWVRLGLYPNRNAAWINALVC

SEQ ID NO: 1238488 - protein, 26 aa, Mycobacterium
DGARDWDWSTGRYWKIANPSKRNELG

SEQ ID NO: 1238489 - protein, 24 aa, Mycobacterium
DGARLMAERGRLFGSLPAGGRMVA

SEQ ID NO: 1238490 - protein, 24 aa, Mycobacterium
DGASFASAVGRSFYSQILPSNSVT

SEQ ID NO: 1238491 - protein, 19 aa, Mycobacterium
DGAVALMLEHGCTHMAGAT

SEQ ID NO: 1238492 - protein, 19 aa, Mycobacterium
DGDEIYAVIAGSAVNHDGR

SEQ ID NO: 1238493 - protein, 21 aa, Mycobacterium
DGDGALRLHGFEIATVSGRLH

SEQ ID NO: 1238494 - protein, 23 aa, Mycobacterium
DGDGRGGRRGRRFRDRRRRGERG

SEQ ID NO: 1238495 - protein, 24 aa, Mycobacterium
DGDKYPGYWKVIAVDEPRSFSFED

SEQ ID NO: 1238496 - protein, 18 aa, Mycobacterium
DGDLYGLVNVAGGAAPAT

SEQ ID NO: 1238497 - protein, 19 aa, Mycobacterium
DGDPWASFVTYGLLHGAPV

SEQ ID NO: 1238498 - protein, 22 aa, Mycobacterium
DGDRSAVAWPAALRPALTTAGF

SEQ ID NO: 1238499 - protein, 24 aa, Mycobacterium
DGDTLRLGDLVFPIAPGTADGAGP

SEQ ID NO: 1238500 - protein, 34 aa, Mycobacterium
DGEITFCGAIEMGGFIDLRVDVIPGGMETYGVSE

SEQ ID NO: 1238501 - protein, 32 aa, Mycobacterium
DGEPDWVNTIFLSTRFRAWRVGGYNEYLYTFF

SEQ ID NO: 1238502 - protein, 21 aa, Mycobacterium
DGETSAVEWVRYRTVGDLTIT

SEQ ID NO: 1238503 - protein, 19 aa, Mycobacterium
DGFHPLWAHDRPQERKALE

SEQ ID NO: 1238504 - protein, 30 aa, Mycobacterium
DGGAHYGMICDASFPTFMLTHWTRDRATGR

SEQ ID NO: 1238505 - protein, 18 aa, Mycobacterium
DGGHPRETFAVAVESKHF

SEQ ID NO: 1238506 - protein, 17 aa, Mycobacterium
DGGLRIVGITGSSGKTS

SEQ ID NO: 1238507 - protein, 23 aa, Mycobacterium
DGGMARLRLFGRLTDDGLRAVAE

SEQ ID NO: 1238508 - protein, 18 aa, Mycobacterium
DGGQMWLAGAGRTVAVAE

SEQ ID NO: 1238509 - protein, 17 aa, Mycobacterium
DGGRGVARLEYSAHPSA

SEQ ID NO: 1238510 - protein, 27 aa, Mycobacterium
DGGSPIAIAVPAHWGPGTVGALRGALR

SEQ ID NO: 1238511 - protein, 19 aa, Mycobacterium
DGGTLRGLFEFKKGARPPV

SEQ ID NO: 1238512 - protein, 21 aa, Mycobacterium
DGHIETFPAGPLCTEGDPATC

SEQ ID NO: 1238513 - protein, 17 aa, Mycobacterium
DGHLWKLVRSFDDPATW

SEQ ID NO: 1238514 - protein, 20 aa, Mycobacterium
DGHTTYYLDMGWEDLELAVE

SEQ ID NO: 1238515 - protein, 17 aa, Mycobacterium
DGIAFAGVSKYPARVKC

SEQ ID NO: 1238516 - protein, 17 aa, Mycobacterium
DGIKLEVGQRVYGFMQG

SEQ ID NO: 1238517 - protein, 17 aa, Mycobacterium
DGIRFNCVQPGSISSGM

SEQ ID NO: 1238518 - protein, 22 aa, Mycobacterium
DGIRLGDYDIGIAIGLDKHPRG

SEQ ID NO: 1238519 - protein, 22 aa, Mycobacterium
DGKAVADATIDFTGGYATVTVE

SEQ ID NO: 1238520 - protein, 23 aa, Mycobacterium
DGKFWFEGAEVFQEFGKIGKSLK

SEQ ID NO: 1238521 - protein, 29 aa, Mycobacterium
DGKLGVGWPKEFGGLGFGPVEQSIFVNEA

SEQ ID NO: 1238522 - protein, 27 aa, Mycobacterium
DGLAAILPCYWIYARVGEELIGRGSPD

SEQ ID NO: 1238523 - protein, 18 aa, Mycobacterium
DGLGVALRPGHRAVVPDG

SEQ ID NO: 1238524 - protein, 18 aa, Mycobacterium
DGLITGWHSHDVHQIEYA

SEQ ID NO: 1238525 - protein, 26 aa, Mycobacterium
DGLKYPARLIDEFTWETDLGDKVVSV

SEQ ID NO: 1238526 - protein, 19 aa, Mycobacterium
DGLLPPNNWISVFGGPAWT

SEQ ID NO: 1238527 - protein, 20 aa, Mycobacterium
DGLLRAAAMAGAQVRATAAA

SEQ ID NO: 1238528 - protein, 26 aa, Mycobacterium
DGLLRRRAHGYFPVPGLDPHPAVDIR

SEQ ID NO: 1238529 - protein, 20 aa, Mycobacterium
DGLPESHWTGGHLTLGGVKL

SEQ ID NO: 1238530 - protein, 20 aa, Mycobacterium
DGLRRRAFDTSRAALVPLAR

SEQ ID NO: 1238531 - protein, 27 aa, Mycobacterium
DGLRSAALAAWLFGRPAPVDAVTVAPW

SEQ ID NO: 1238532 - protein, 20 aa, Mycobacterium
DGLVIRGEVRAVPAAAQASV

SEQ ID NO: 1238533 - protein, 20 aa, Mycobacterium
DGMLPLPLLEVLFAADRETA

SEQ ID NO: 1238534 - protein, 26 aa, Mycobacterium
DGNALFFGHGLNIHFGLIKPPANVTV

SEQ ID NO: 1238535 - protein, 22 aa, Mycobacterium
DGPATLFCCYAVDDLDAARQSI

SEQ ID NO: 1238536 - protein, 19 aa, Mycobacterium
DGPGESWITPTVDLVKGET

SEQ ID NO: 1238537 - protein, 23 aa, Mycobacterium
DGPLPVMFFIHGGGYAFGSSATP

SEQ ID NO: 1238538 - protein, 18 aa, Mycobacterium
DGPLTLRNRALLELLYST

SEQ ID NO: 1238539 - protein, 24 aa, Mycobacterium
DGQELRRCYSMSSAPVEEELRITV

SEQ ID NO: 1238540 - protein, 19 aa, Mycobacterium
DGQVYTAASAVRWAIDLGL

SEQ ID NO: 1238541 - protein, 25 aa, Mycobacterium
DGRGLHTWPALGFGYAEVGTVTAHP

SEQ ID NO: 1238542 - protein, 22 aa, Mycobacterium
DGRRVRNSECELVQDGVTVARA

SEQ ID NO: 1238543 - protein, 19 aa, Mycobacterium
DGRSFLLPPTWTQLDALAG

SEQ ID NO: 1238544 - protein, 26 aa, Mycobacterium
DGSAHRGELVLAEALDAMARTVDGGS

SEQ ID NO: 1238545 - protein, 20 aa, Mycobacterium
DGSCVFACPVNCIHPTPDEP

SEQ ID NO: 1238546 - protein, 24 aa, Mycobacterium
DGSDAARVVTGWVEQGVTAVCAQS

SEQ ID NO: 1238547 - protein, 23 aa, Mycobacterium
DGSDARPALRFVATHPEPADLCA

SEQ ID NO: 1238548 - protein, 17 aa, Mycobacterium
DGSDWILNGSKMWITNG

SEQ ID NO: 1238549 - protein, 19 aa, Mycobacterium
DGSGEGFVRRLWWRVTVDL

SEQ ID NO: 1238550 - protein, 18 aa, Mycobacterium
DGSIPMVATPADFHGTPC

SEQ ID NO: 1238551 - protein, 17 aa, Mycobacterium
DGSLPPAAGSIIRITHA

SEQ ID NO: 1238552 - protein, 18 aa, Mycobacterium
DGSRGATLAGEFTSTTFP

SEQ ID NO: 1238553 - protein, 19 aa, Mycobacterium
DGSSAYVWHLFDRLDDLRP

SEQ ID NO: 1238554 - protein, 20 aa, Mycobacterium
DGSVDVCLSSNVAEHVPDPW

SEQ ID NO: 1238555 - protein, 17 aa, Mycobacterium
DGTDWYSHVTLIGRVTE

SEQ ID NO: 1238556 - protein, 23 aa, Mycobacterium
DGTEPYAGLDWRCASWLHEREIA

SEQ ID NO: 1238557 - protein, 25 aa, Mycobacterium
DGTHMAGLLFELFARYTEVVTTGSA

SEQ ID NO: 1238558 - protein, 24 aa, Mycobacterium
DGTLRGFVNACRHRGNALCVTETG

SEQ ID NO: 1238559 - protein, 24 aa, Mycobacterium
DGTRRPDGVIDFGDLTDTWAVSEL

SEQ ID NO: 1238560 - protein, 18 aa, Mycobacterium
DGTVLIRRLLREAVVTPV

SEQ ID NO: 1238561 - protein, 20 aa, Mycobacterium
DGTYVRRWVPELKGVADVHK

SEQ ID NO: 1238562 - protein, 21 aa, Mycobacterium
DGVASGWKIAGVLVAQDDAVL

SEQ ID NO: 1238563 - protein, 18 aa, Mycobacterium
DGVAVLLAVELCSLVSKT

SEQ ID NO: 1238564 - protein, 18 aa, Mycobacterium
DGVERVCFLLHLKRDRID

SEQ ID NO: 1238565 - protein, 17 aa, Mycobacterium
DGVGFSFHETTINANSV

SEQ ID NO: 1238566 - protein, 17 aa, Mycobacterium
DGVLGFFLGDKRSLPPD

SEQ ID NO: 1238567 - protein, 24 aa, Mycobacterium
DGVPERLELATAFGADAVVDITEA

SEQ ID NO: 1238568 - protein, 23 aa, Mycobacterium
DGVPRVETHLEWQMTPYTDPSWD

SEQ ID NO: 1238569 - protein, 25 aa, Mycobacterium
DGVVPACRSYDCVTVFARDLDTADA

SEQ ID NO: 1238570 - protein, 28 aa, Mycobacterium
DGVWKIALRRCTIEWMISGDSSILGKGA

SEQ ID NO: 1238571 - protein, 20 aa, Mycobacterium
DGYAAMSFDAVNRVFRDGKV

SEQ ID NO: 1238572 - protein, 25 aa, Mycobacterium
DHINSRPAPLVAYWFGPDDQDFRTF

SEQ ID NO: 1238573 - protein, 20 aa, Mycobacterium
DHLIAGIPPLRRQRLHAKIA

SEQ ID NO: 1238574 - protein, 18 aa, Mycobacterium
DHLMACWTAGETSLRRPL

SEQ ID NO: 1238575 - protein, 21 aa, Mycobacterium
DHLRSGGSIVNVIPENVVIAQ

SEQ ID NO: 1238576 - protein, 18 aa, Mycobacterium
DHLTDWGYAAGWRVVRAV

SEQ ID NO: 1238577 - protein, 25 aa, Mycobacterium
DHPAQRAGLMGAFVIGLATTRYVLA

SEQ ID NO: 1238578 - protein, 24 aa, Mycobacterium
DHPDARPLARIEGWGHRTVGLGLT

SEQ ID NO: 1238579 - protein, 22 aa, Mycobacterium
DHPESLVNWDALAALTGTIVLL

SEQ ID NO: 1238580 - protein, 21 aa, Mycobacterium
DHPGNGIAVVGMYPMGDAARA

SEQ ID NO: 1238581 - protein, 22 aa, Mycobacterium
DHPMTRGGLCVKVKNFHEHHYQ

SEQ ID NO: 1238582 - protein, 18 aa, Mycobacterium
DHPRGRHGGVIHRPADLG

SEQ ID NO: 1238583 - protein, 18 aa, Mycobacterium
DHRGRPFFDLLARVGADA

SEQ ID NO: 1238584 - protein, 18 aa, Mycobacterium
DHRPVPIAPRSVLRRVVE

SEQ ID NO: 1238585 - protein, 22 aa, Mycobacterium
DHSALIKALERLSGADASGNRK

SEQ ID NO: 1238586 - protein, 18 aa, Mycobacterium
DHTSCLAADLIIDATVNN

SEQ ID NO: 1238587 - protein, 19 aa, Mycobacterium
DHVLRLGLHRLPITEFPRL

SEQ ID NO: 1238588 - protein, 21 aa, Mycobacterium
DHVSARIGVLAALSLLLRRER

SEQ ID NO: 1238589 - protein, 28 aa, Mycobacterium
DIAEAICALVSREFRWATGERLEVSGGV

SEQ ID NO: 1238590 - protein, 18 aa, Mycobacterium
DIAIPLGVDREMPPAPAV

SEQ ID NO: 1238591 - protein, 24 aa, Mycobacterium
DIALRRPSLDDVFLALTADSESAA

SEQ ID NO: 1238592 - protein, 18 aa, Mycobacterium
DIARAWQRIRGRVRNWTD

SEQ ID NO: 1238593 - protein, 23 aa, Mycobacterium
DIARTAVLSAGWPETVPGVTVDR

SEQ ID NO: 1238594 - protein, 20 aa, Mycobacterium
DICTCRPYLTHAIEECIRGA

SEQ ID NO: 1238595 - protein, 17 aa, Mycobacterium
DIDLPWERTDKADALKT

SEQ ID NO: 1238596 - protein, 17 aa, Mycobacterium
DIDRIWFAANVWPDEVP

SEQ ID NO: 1238597 - protein, 18 aa, Mycobacterium
DIEAQGWIAPAECIEVRV

SEQ ID NO: 1238598 - protein, 24 aa, Mycobacterium
DIEDLKAPLLAAVGAADLALATVN

SEQ ID NO: 1238599 - protein, 18 aa, Mycobacterium
DIEFGRYLAEAVFEPLGM

SEQ ID NO: 1238600 - protein, 25 aa, Mycobacterium
DIEHWRWMWESNVLGTLLVTRALLP

SEQ ID NO: 1238601 - protein, 24 aa, Mycobacterium
DIEKSFHGVPVLKGITLNLQPGTV

SEQ ID NO: 1238602 - protein, 23 aa, Mycobacterium
DIEPRQVLILVEWESKEAFDSYR

SEQ ID NO: 1238603 - protein, 23 aa, Mycobacterium
DIGKRIERGLGLTGLLRATLVEA

SEQ ID NO: 1238604 - protein, 17 aa, Mycobacterium
DIGQIGYEMAILVERVG

SEQ ID NO: 1238605 - protein, 17 aa, Mycobacterium
DIHAPVFHRDMPSRFAV

SEQ ID NO: 1238606 - protein, 18 aa, Mycobacterium
DIIACTLIELALGPHQPI

SEQ ID NO: 1238607 - protein, 28 aa, Mycobacterium
DIIPNMWVNARYQFLVLYTVGDDALANA

SEQ ID NO: 1238608 - protein, 29 aa, Mycobacterium
DIIVWSGIELLCLPLLALGGTGFLSATAN

SEQ ID NO: 1238609 - protein, 23 aa, Mycobacterium
DILQGQCRFSWPPQIDLPGYKPN

SEQ ID NO: 1238610 - protein, 29 aa, Mycobacterium
DILRRRLPDLKVRVVNVVDIMRLQPESEH

SEQ ID NO: 1238611 - protein, 26 aa, Mycobacterium
DIPLAIDHFRYFAGAIRAQEGALSQI

SEQ ID NO: 1238612 - protein, 17 aa, Mycobacterium
DIQTVCLGQAASAAAVL

SEQ ID NO: 1238613 - protein, 18 aa, Mycobacterium
DISGSGLIESPRKARELW

SEQ ID NO: 1238614 - protein, 30 aa, Mycobacterium; identical to SEQ ID NO: 925846

SEQ ID NO: 1238615 - protein, 27 aa, Mycobacterium
DIVGLPRWLRHFNNRWTLRADGSATAV

SEQ ID NO: 1238616 - protein, 17 aa, Mycobacterium
DIVSGDGAVLGDGNTMN

SEQ ID NO: 1238617 - protein, 22 aa, Mycobacterium
DIWDKGKAAVIWSETTVTDPDG

SEQ ID NO: 1238618 - protein, 24 aa, Mycobacterium
DIWGRRRLAYEIAKHAEGIYAVID

SEQ ID NO: 1238619 - protein, 19 aa, Mycobacterium
DKAKRRWWGRAERLAGGPA

SEQ ID NO: 1238620 - protein, 19 aa, Mycobacterium
DKCIIFWGVATDRDFRGGT

SEQ ID NO: 1238621 - protein, 23 aa, Mycobacterium
DKDDFVAAVFDWVINGIATTTQA

SEQ ID NO: 1238622 - protein, 18 aa, Mycobacterium
DKEIRRLVGKIQDDLDTL

SEQ ID NO: 1238623 - protein, 22 aa, Mycobacterium
DKEVLTAWGAFGEKTMYGKTVQ

SEQ ID NO: 1238624 - protein, 23 aa, Mycobacterium
DKGRILTAMSVFFFDLIDAPNHL

SEQ ID NO: 1238625 - protein, 21 aa, Mycobacterium
DKGVVPFLKIDKGLAEASDDV

SEQ ID NO: 1238626 - protein, 29 aa, Mycobacterium
DKKSMPVPMLTFRLWRPLSHDTMEVWSWF

SEQ ID NO: 1238627 - protein, 17 aa, Mycobacterium
DKLFFDSYLDSVIEAHG

SEQ ID NO: 1238628 - protein, 21 aa, Mycobacterium
DKLTALCRELGVTEFMLLQAA

SEQ ID NO: 1238629 - protein, 17 aa, Mycobacterium
DKMAADMAVDFRGTPVH

SEQ ID NO: 1238630 - protein, 20 aa, Mycobacterium
DKMLAYNLSPSFNWDTTGMT

SEQ ID NO: 1238631 - protein, 25 aa, Mycobacterium
DKPDLRFGLELVECKEFFADTTFRV

SEQ ID NO: 1238632 - protein, 25 aa, Mycobacterium
DKPLKYPHMFAAAGLIIVNKTDLLP

SEQ ID NO: 1238633 - protein, 18 aa, Mycobacterium
DKRQRGFDLCIYMLGADH

SEQ ID NO: 1238634 - protein, 25 aa, Mycobacterium
DKSYEIYRLDAVPGTDKLPYSLKVL

SEQ ID NO: 1238635 - protein, 20 aa, Mycobacterium
DKVAIARDFLLPRQRERAAL

SEQ ID NO: 1238636 - protein, 18 aa, Mycobacterium
DKVVPLYFLADAGVIGLL

SEQ ID NO: 1238637 - protein, 17 aa, Mycobacterium
DKYPEYKAGRSSTPDEF

SEQ ID NO: 1238638 - protein, 24 aa, Mycobacterium
DLADARKAYGISVSDVLLAPTLRE

SEQ ID NO: 1238639 - protein, 24 aa, Mycobacterium
DLAELIVDLEIGRALLRAAEADGA

SEQ ID NO: 1238640 - protein, 18 aa, Mycobacterium
DLAIDWPAPEKVPPLWKT

SEQ ID NO: 1238641 - protein, 27 aa, Mycobacterium
DLAINRRRVASVLQFDPVIVRLLAEHE

SEQ ID NO: 1238642 - protein, 26 aa, Mycobacterium
DLALGLTLPCWTLLGMLDRAIELTTA

SEQ ID NO: 1238643 - protein, 25 aa, Mycobacterium
DLALGRDGLAYVLRSDRRYGGSIDV

SEQ ID NO: 1238644 - protein, 27 aa, Mycobacterium
DLARVKARMGWDIPWFTITDDFDADFG

SEQ ID NO: 1238645 - protein, 19 aa, Mycobacterium
DLAYGYARNQMTAYVELQE

SEQ ID NO: 1238646 - protein, 17 aa, Mycobacterium
DLDDLLLTTYSELRSRS

SEQ ID NO: 1238647 - protein, 29 aa, Mycobacterium
DLDGFKKTIEFYLTAVFNVMRLTAAAIAK

SEQ ID NO: 1238648 - protein, 25 aa, Mycobacterium
DLDGLCERLREQGVRLIYDEPRRGT

SEQ ID NO: 1238649 - protein, 18 aa, Mycobacterium
DLDVEWPAAELIDSTIID

SEQ ID NO: 1238650 - protein, 26 aa, Mycobacterium
DLEKTLRFWLDRGVDGFRIDVAHGMA

SEQ ID NO: 1238651 - protein, 23 aa, Mycobacterium
DLERRRAHTYGMGGPERVAKHHG

SEQ ID NO: 1238652 - protein, 17 aa, Mycobacterium
DLERVWADLPYEAQWHA

SEQ ID NO: 1238653 - protein, 26 aa, Mycobacterium
DLFGHCMGAVVAFEFARVAERNGVTV

SEQ ID NO: 1238654 - protein, 18 aa, Mycobacterium
DLGCGEGADAIWLAGHGW

SEQ ID NO: 1238655 - protein, 26 aa, Mycobacterium
DLGSEMPMRVIGMLVGMPDSLQRSVR

SEQ ID NO: 1238656 - protein, 26 aa, Mycobacterium
DLGSLTLPVLRAWLSAQAAAGTARTT

SEQ ID NO: 1238657 - protein, 25 aa, Mycobacterium
DLHLTLKHVHWNVVGPNFIGVHEMI

SEQ ID NO: 1238658 - protein, 24 aa, Mycobacterium
DLHRAVSTFARMDAVLVTAVNGAA

SEQ ID NO: 1238659 - protein, 17 aa, Mycobacterium
DLIAKLKEAGVVVIPSV

SEQ ID NO: 1238660 - protein, 24 aa, Mycobacterium
DLLARGVIGIGWIPENILRDLGTR

SEQ ID NO: 1238661 - protein, 24 aa, Mycobacterium
DLLARLQRDLGLTYLFIGHDLAVI

SEQ ID NO: 1238662 - protein, 17 aa, Mycobacterium
DLLGREMLDQRFAGMKE

SEQ ID NO: 1238663 - protein, 19 aa, Mycobacterium
DLLITRWVTTFTDQVPLQI

SEQ ID NO: 1238664 - protein, 22 aa, Mycobacterium
DLLRRMGRAEFVRADIRNPFIA

SEQ ID NO: 1238665 - protein, 23 aa, Mycobacterium
DLLTPFMWRMDCFGRPHLEQTPW

SEQ ID NO: 1238666 - protein, 18 aa, Mycobacterium
DLMRFVAEQCRDRSAAKR

SEQ ID NO: 1238667 - protein, 24 aa, Mycobacterium
DLNPVDLLIRYGRIAPTDVADYLE

SEQ ID NO: 1238668 - protein, 24 aa, Mycobacterium
DLNWKARPYSAWLAYGQSKLANLL

SEQ ID NO: 1238669 - protein, 20 aa, Mycobacterium
DLPAEVLNRTLGYPVGPDAG

SEQ ID NO: 1238670 - protein, 21 aa, Mycobacterium
DLPAGRLGGFFGDSGSAAEVF

SEQ ID NO: 1238671 - protein, 24 aa, Mycobacterium
DLPCANGITVHQGRLFIGECREGG

SEQ ID NO: 1238672 - protein, 21 aa, Mycobacterium
DLPELRTVLRIEGSGTGAIDA

SEQ ID NO: 1238673 - protein, 19 aa, Mycobacterium
DLPEPPALPLVPRAEQRDP

SEQ ID NO: 1238674 - protein, 25 aa, Mycobacterium
DLPEPWRWITGGELLMTNGLSFPKS

SEQ ID NO: 1238675 - protein, 24 aa, Mycobacterium
DLPPPRVFGPLSIDVAAREVGLDG

SEQ ID NO: 1238676 - protein, 21 aa, Mycobacterium
DLPRSTAVEVLRILSEADSAV

SEQ ID NO: 1238677 - protein, 25 aa, Mycobacterium
DLPTQLCAFTAGVLRAEATHEPGYY

SEQ ID NO: 1238678 - protein, 19 aa, Mycobacterium
DLPWLRSLTKLPVILKGIC

SEQ ID NO: 1238679 - protein, 18 aa, Mycobacterium
DLQPGSSIMPGKVNPVLP

SEQ ID NO: 1238680 - protein, 22 aa, Mycobacterium
DLRARPGTVGRPYPVVELRIDR

SEQ ID NO: 1238681 - protein, 23 aa, Mycobacterium
DLRDARCTSAIAIVHSRFSTNTF

SEQ ID NO: 1238682 - protein, 23 aa, Mycobacterium
DLREHLMFRAPKFRHHVAEDETA

SEQ ID NO: 1238683 - protein, 24 aa, Mycobacterium
DLRGEVSVPILKLVAAQGEGVPEL

SEQ ID NO: 1238684 - protein, 20 aa, Mycobacterium
DLRGNPTLREVCRRAREMAL

SEQ ID NO: 1238685 - protein, 19 aa, Mycobacterium
DLRLERDGVLVSWAVPKNL

SEQ ID NO: 1238686 - protein, 22 aa, Mycobacterium
DLRRRVKAMSYGLAYGLSAYGL

SEQ ID NO: 1238687 - protein, 22 aa, Mycobacterium
DLRYVPEILLADARIVACRLFF

SEQ ID NO: 1238688 - protein, 31 aa, Mycobacterium
DLSAGPRRYAGWSSCFRREAGSYGKDTRGII

SEQ ID NO: 1238689 - protein, 18 aa, Mycobacterium
DLSGRRGRVLGTEQAGAD

SEQ ID NO: 1238690 - protein, 24 aa, Mycobacterium
DLSTKGWPRYVWIAADLPSTATNK

SEQ ID NO: 1238691 - protein, 24 aa, Mycobacterium
DLSTLRFALSGAEPVEPADVEDLI

SEQ ID NO: 1238692 - protein, 30 aa, Mycobacterium
DLVAELRAGLPRGVAVAGGYLDGIGVPACV

SEQ ID NO: 1238693 - protein, 24 aa, Mycobacterium
DLVARGLIGLGVERGERVGIWAPN

SEQ ID NO: 1238694 - protein, 20 aa, Mycobacterium
DLVAVSIEAAAMARVPLAGT

SEQ ID NO: 1238695 - protein, 25 aa, Mycobacterium
DLVPPQLRRLHGFELAGGYRASEDH

SEQ ID NO: 1238696 - protein, 19 aa, Mycobacterium
DLVPSVSFFQGVRVDADGV

SEQ ID NO: 1238697 - protein, 17 aa, Mycobacterium
DLVSLIYFYEANHDAVV

SEQ ID NO: 1238698 - protein, 20 aa, Mycobacterium
DLWLNESFATFASVLCQAES

SEQ ID NO: 1238699 - protein, 20 aa, Mycobacterium
DLYLPIRPGTDVALLNGLLH

SEQ ID NO: 1238700 - protein, 19 aa, Mycobacterium
DLYVRKFELATGYSELIDP

SEQ ID NO: 1238701 - protein, 18 aa, Mycobacterium
DMAETILLNAKTRRPSVC

SEQ ID NO: 1238702 - protein, 24 aa, Mycobacterium
DMFGEQRLAAALEECAGMPAEAVV

SEQ ID NO: 1238703 - protein, 17 aa, Mycobacterium
DMFLPPDVLDWPLNVVV

SEQ ID NO: 1238704 - protein, 24 aa, Mycobacterium
DMIGRAGALLVDIGIDIVPRGYRI

SEQ ID NO: 1238705 - protein, 24 aa, Mycobacterium
DMVVTHLFQVMAFVVMEPPTALEP

SEQ ID NO: 1238706 - protein, 24 aa, Mycobacterium
DMYRSVLEAIAFGFRHHTDVFTSI

SEQ ID NO: 1238707 - protein, 19 aa, Mycobacterium
DNELLDFTTLARVFGYPST

SEQ ID NO: 1238708 - protein, 18 aa, Mycobacterium
DNELWINAPRPMLVTAAT

SEQ ID NO: 1238709 - protein, 21 aa, Mycobacterium
DNGAWLRRGVADARGTVVALL

SEQ ID NO: 1238710 - protein, 17 aa, Mycobacterium
DNIRVPTLIIRGGENDL

SEQ ID NO: 1238711 - protein, 27 aa, Mycobacterium
DNQPGFLGFQLLRPVKGENRYFVVTQW

SEQ ID NO: 1238712 - protein, 19 aa, Mycobacterium
DNRTGGVTFFGGDQVGFTD

SEQ ID NO: 1238713 - protein, 26 aa, Mycobacterium
DNVEAFLAVCRKWEVLATVIGEVTDG

SEQ ID NO: 1238714 - protein, 24 aa, Mycobacterium
DNVEAYRPLALELQAQLGHIDVLV

SEQ ID NO: 1238715 - protein, 20 aa, Mycobacterium
DNWFWIKVPVGYLYTIANPR

SEQ ID NO: 1238716 - protein, 17 aa, Mycobacterium
DPAELYAAGDYMYQSAD

SEQ ID NO: 1238717 - protein, 17 aa, Mycobacterium
DPAGRGWTKTTYRRGDI

SEQ ID NO: 1238718 - protein, 23 aa, Mycobacterium
DPAIKGMWCVPVFGNPTGVTYSW

SEQ ID NO: 1238719 - protein, 26 aa, Mycobacterium
DPAKLAELQRLWLIEAVKYDVLPIDD

SEQ ID NO: 1238720 - protein, 22 aa, Mycobacterium
DPAKRLAQALGIKDLGNTPQRV

SEQ ID NO: 1238721 - protein, 24 aa, Mycobacterium
DPASARGSLRLSLGHTSTDADVDA

SEQ ID NO: 1238722 - protein, 29 aa, Mycobacterium
DPATWPRWAAGLARGGLRQGPQGWVADSP

SEQ ID NO: 1238723 - protein, 18 aa, Mycobacterium
DPDDVLDLDVEWPAAELI

SEQ ID NO: 1238724 - protein, 25 aa, Mycobacterium
DPDERGMRTVMCILNGQLRPVLVRD

SEQ ID NO: 1238725 - protein, 24 aa, Mycobacterium
DPDGIEVEIIWRAPDDAWSYDDAL

SEQ ID NO: 1238726 - protein, 22 aa, Mycobacterium
DPDLLLRVGISVWERYTGPYSD

SEQ ID NO: 1238727 - protein, 23 aa, Mycobacterium
DPDPRAAHVVETWAEVLDLLERD

SEQ ID NO: 1238728 - protein, 24 aa, Mycobacterium
DPDRDRTAIAMGRRGTPVEQANAI

SEQ ID NO: 1238729 - protein, 23 aa, Mycobacterium
DPDRYAGELAHIIGCEPSDVLRV

SEQ ID NO: 1238730 - protein, 18 aa, Mycobacterium
DPDVLAGRCVDYTGRYRG

SEQ ID NO: 1238731 - protein, 23 aa, Mycobacterium
DPDVRAALQVAIDRARAVHADQR

SEQ ID NO: 1238732 - protein, 26 aa, Mycobacterium
DPELARELFIRHALVEGDWRTKHHFF

SEQ ID NO: 1238733 - protein, 24 aa, Mycobacterium
DPELIPKLMSAGVIEVAPLAYMRG

SEQ ID NO: 1238734 - protein, 19 aa, Mycobacterium
DPELVKGILALMAELAADG

SEQ ID NO: 1238735 - protein, 23 aa, Mycobacterium
DPETIAYGLIPRAHRGIVAVNEL

SEQ ID NO: 1238736 - protein, 20 aa, Mycobacterium
DPFARIGLTVLRGAGLRAGE

SEQ ID NO: 1238737 - protein, 18 aa, Mycobacterium
DPFGAEAAGNVWSSGAAT

SEQ ID NO: 1238738 - protein, 18 aa, Mycobacterium
DPFVAMGYAAARTSTLRL

SEQ ID NO: 1238739 - protein, 25 aa, Mycobacterium
DPHTRELYLDWPRKARAVVGNLRHV

SEQ ID NO: 1238740 - protein, 20 aa, Mycobacterium
DPIGHYEGLLAWLHGLVDSG

SEQ ID NO: 1238741 - protein, 20 aa, Mycobacterium
DPIMPLPGFLSRRAAKGVID

SEQ ID NO: 1238742 - protein, 22 aa, Mycobacterium
DPKTSTEITMRFFAAASTGDLD

SEQ ID NO: 1238743 - protein, 21 aa, Mycobacterium
DPLCYVDPYLPIESFQRRDEA

SEQ ID NO: 1238744 - protein, 17 aa, Mycobacterium
DPLEAFWTQAARLRDLL

SEQ ID NO: 1238745 - protein, 22 aa, Mycobacterium
DPLGGASVDYWGAIAERHDLDL

SEQ ID NO: 1238746 - protein, 21 aa, Mycobacterium
DPLGRLAIRRITDATGTADPL

SEQ ID NO: 1238747 - protein, 24 aa, Mycobacterium
DPLTRLGETLARTLNIAFEREAPV

SEQ ID NO: 1238748 - protein, 32 aa, Mycobacterium
DPMECAEILDWPAKLRLLEGFRHRENLGWSAP

SEQ ID NO: 1238749 - protein, 25 aa, Mycobacterium
DPNASLGTAFHDWVQRYFGAERLFD

SEQ ID NO: 1238750 - protein, 17 aa, Mycobacterium
DPNQKWRPANLGQPLYN

SEQ ID NO: 1238751 - protein, 39 aa, Mycobacterium
DPNSFFFAAPLEWQERLWPTEEFELARSRIPVTLPETDL

SEQ ID NO: 1238752 - protein, 23 aa, Mycobacterium
DPNWAASLQPGWQEERKRNFHNW

SEQ ID NO: 1238753 - protein, 26 aa, Mycobacterium
DPPFEGMWWLYVPMAFDDFAIVLIIQ

SEQ ID NO: 1238754 - protein, 24 aa, Mycobacterium
DPQHRLLLETAWEAVEHAGIDPAA

SEQ ID NO: 1238755 - protein, 25 aa, Mycobacterium
DPQLADLEARFRVVRYDTRGHGASP

SEQ ID NO: 1238756 - protein, 24 aa, Mycobacterium
DPQPGEAMLRCRLGQSQAAWADLR

SEQ ID NO: 1238757 - protein, 32 aa, Mycobacterium
DPQQRMALELTWEALEHARIPASSLRGERVGV

SEQ ID NO: 1238758 - protein, 25 aa, Mycobacterium
DPRARGVVVGLTLRHGRGHLFRAAY

SEQ ID NO: 1238759 - protein, 21 aa, Mycobacterium
DPRDHAELLAAYELDKAVYEV

SEQ ID NO: 1238760 - protein, 20 aa, Mycobacterium
DPRETVVAFVGRIQPLKAPD

SEQ ID NO: 1238761 - protein, 25 aa, Mycobacterium
DPREVCIGLSPALGRSVWLTLCGLT

SEQ ID NO: 1238762 - protein, 19 aa, Mycobacterium
DPRGWSHSAIRAILDNPAY

SEQ ID NO: 1238763 - protein, 18 aa, Mycobacterium
DPRIDWRLADGEAEIAPG

SEQ ID NO: 1238764 - protein, 22 aa, Mycobacterium
DPRPYPELVLAQRDSIFDYTYE

SEQ ID NO: 1238765 - protein, 19 aa, Mycobacterium
DPRVKAVGFTGSRAGGLAL

SEQ ID NO: 1238766 - protein, 24 aa, Mycobacterium
DPSAIRLGLLAGHYREDRFWSDDV

SEQ ID NO: 1238767 - protein, 19 aa, Mycobacterium
DPSIEIQFTPARVIMQDFT

SEQ ID NO: 1238768 - protein, 29 aa, Mycobacterium
DPSKLPGVLADMGAEFIALDKWSGDHPGR

SEQ ID NO: 1238769 - protein, 17 aa, Mycobacterium
DPSVPVRLAELFIEAGL

SEQ ID NO: 1238770 - protein, 22 aa, Mycobacterium
DPSVRFNPVLLKPGSDRTSQLV

SEQ ID NO: 1238771 - protein, 21 aa, Mycobacterium
DPSYHGVVFADLGAPAYALKA

SEQ ID NO: 1238772 - protein, 24 aa, Mycobacterium
DPTEGVKLLGRFAAEPTRENIEKF

SEQ ID NO: 1238773 - protein, 26 aa, Mycobacterium
DPTEIGTRTTVLWVFGGADPSTPTAD

SEQ ID NO: 1238774 - protein, 18 aa, Mycobacterium
DPVLAWLYVVDAWEGGLP

SEQ ID NO: 1238775 - protein, 24 aa, Mycobacterium
DPVLRVLVEAGYDRTINPGVPTPA

SEQ ID NO: 1238776 - protein, 19 aa, Mycobacterium
DPWSGGLDLLLGVETTAGL

SEQ ID NO: 1238777 - protein, 25 aa, Mycobacterium
DPYLYRRFFPTVEYRPVLPGPGEPI

SEQ ID NO: 1238778 - protein, 24 aa, Mycobacterium
DQADRWASLWWLRVSGSERFEEVA

SEQ ID NO: 1238779 - protein, 22 aa, Mycobacterium
DQAERRRLFGMIGSVTPDKMAT

SEQ ID NO: 1238780 - protein, 23 aa, Mycobacterium
DQFPYHSKTGWTYDSGDYETTMR

SEQ ID NO: 1238781 - protein, 17 aa, Mycobacterium
DQLPLALSMRPDLITVC

SEQ ID NO: 1238782 - protein, 22 aa, Mycobacterium
DQLPRGEVGGGESLDEKLAAEV

SEQ ID NO: 1238783 - protein, 18 aa, Mycobacterium
DQPARWLIRESEHAQLVV

SEQ ID NO: 1238784 - protein, 23 aa, Mycobacterium
DQPDGSAELIGWDGTQVAAILTG

SEQ ID NO: 1238785 - protein, 26 aa, Mycobacterium
DQPGYRIATMLTEMAADLAARDSGID

SEQ ID NO: 1238786 - protein, 22 aa, Mycobacterium
DQPLGDCWRHAAVGGEGLTRGW

SEQ ID NO: 1238787 - protein, 26 aa, Mycobacterium
DQPYWGRPAPGWGDTHPRIMVVGLAP

SEQ ID NO: 1238788 - protein, 22 aa, Mycobacterium
DQRRELVDDFSLIPRAIEEVLR

SEQ ID NO: 1238789 - protein, 24 aa, Mycobacterium
DQTGELSVGGWAARVDHIVDVSEE

SEQ ID NO: 1238790 - protein, 17 aa, Mycobacterium
DQVAACESSGNWAINTG

SEQ ID NO: 1238791 - protein, 25 aa, Mycobacterium
DQVRAVCLDGGLLAAMAPGATLVIH

SEQ ID NO: 1238792 - protein, 29 aa, Mycobacterium
DQYEIKGCIAHGGLGWVYLAFDHNVNERP

SEQ ID NO: 1238793 - protein, 17 aa, Mycobacterium
DQYLPKQIARFVSYGAS

SEQ ID NO: 1238794 - protein, 19 aa, Mycobacterium
DQYRFPALATDLTGLPPAI

SEQ ID NO: 1238795 - protein, 24 aa, Mycobacterium
DRAGEPFVGPAGRLLDKALVSAGI

SEQ ID NO: 1238796 - protein, 30 aa, Mycobacterium; identical to SEQ ID NO: 647900

SEQ ID NO: 1238797 - protein, 18 aa, Mycobacterium
DRARAMGINAAYTPEEAA

SEQ ID NO: 1238798 - protein, 19 aa, Mycobacterium
DRAVAYGIGPAVRQLAKGE

SEQ ID NO: 1238799 - protein, 26 aa, Mycobacterium
DRCAVGVPTPDGWRMLSGDETGWLLG

SEQ ID NO: 1238800 - protein, 24 aa, Mycobacterium
DRCNLRCTYCMPAEGLDWLPGEQL

SEQ ID NO: 1238801 - protein, 24 aa, Mycobacterium
DRDAGHIRARMFAPDLGVPEDEAT

SEQ ID NO: 1238802 - protein, 22 aa, Mycobacterium
DRDEFARRLPFMADKRDFREPV

SEQ ID NO: 1238803 - protein, 25 aa, Mycobacterium
DRDGQPRWTPIIAHLSDGQRVVARS

SEQ ID NO: 1238804 - protein, 23 aa, Mycobacterium
DRDGVRTPMQWTPDRNAGFSKAT

SEQ ID NO: 1238805 - protein, 20 aa, Mycobacterium
DRDWAPKVQGAWNLHAATLD

SEQ ID NO: 1238806 - protein, 23 aa, Mycobacterium
DREFKVNGFAGAERKKLRDVLAV

SEQ ID NO: 1238807 - protein, 25 aa, Mycobacterium
DREGLLPAITFVFSRAGCDAAVKQC

SEQ ID NO: 1238808 - protein, 19 aa, Mycobacterium
DREKLFHWTNCIMNTDDPD

SEQ ID NO: 1238809 - protein, 17 aa, Mycobacterium
DRELRRQLETTVHRERV

SEQ ID NO: 1238810 - protein, 19 aa, Mycobacterium
DRESLRPLLAALTERERTV

SEQ ID NO: 1238811 - protein, 25 aa, Mycobacterium
DRFGADLPPLAGIYLAAFGGGPVML

SEQ ID NO: 1238812 - protein, 25 aa, Mycobacterium
DRFGDEFRIQLAWMRQSPPGTPNPG

SEQ ID NO: 1238813 - protein, 26 aa, Mycobacterium
DRFVDRLYGMFAFAIVERDSGRVLLG

SEQ ID NO: 1238814 - protein, 30 aa, Mycobacterium
DRGALPVKLCYAGPFFRYERPQAGRYRQLQ

SEQ ID NO: 1238815 - protein, 23 aa, Mycobacterium
DRGFTGRLERLFVVAVNCTEPGG

SEQ ID NO: 1238816 - protein, 17 aa, Mycobacterium
DRGHRRLAFAYSDVDKL

SEQ ID NO: 1238817 - protein, 23 aa, Mycobacterium
DRGLHVLVFGPLRALRLTTALRR

SEQ ID NO: 1238818 - protein, 21 aa, Mycobacterium
DRGPSQWLLRMLATQTERTEL

SEQ ID NO: 1238819 - protein, 23 aa, Mycobacterium
DRGRALRVIFWFIDHTTQRRYEI

SEQ ID NO: 1238820 - protein, 24 aa, Mycobacterium
DRGRYSIRGVIGPDEFHSGYPDAP

SEQ ID NO: 1238821 - protein, 20 aa, Mycobacterium
DRHRGRKLSLEYVLRKQCRD

SEQ ID NO: 1238822 - protein, 26 aa, Mycobacterium
DRHRRYRTGAGWSRGFGASRQNGPRA

SEQ ID NO: 1238823 - protein, 18 aa, Mycobacterium
DRHWIPVHRDWRLNERHY

SEQ ID NO: 1238824 - protein, 17 aa, Mycobacterium
DRIAYARVVSGTFERGD

SEQ ID NO: 1238825 - protein, 18 aa, Mycobacterium
DRICQTIRAEVSPRHVPD

SEQ ID NO: 1238826 - protein, 19 aa, Mycobacterium
DRIDWSKVHVFFGDERYVP

SEQ ID NO: 1238827 - protein, 22 aa, Mycobacterium
DRIGELPVRAIVRSPLLRCRST

SEQ ID NO: 1238828 - protein, 20 aa, Mycobacterium
DRILEHVDFLSIGTNDLAQY

SEQ ID NO: 1238829 - protein, 26 aa, Mycobacterium
DRINSLVIPPAWKKVWICPYPNGHIQ

SEQ ID NO: 1238830 - protein, 19 aa, Mycobacterium
DRIRDAWEFALLDEALRRG

SEQ ID NO: 1238831 - protein, 24 aa, Mycobacterium
DRIVSIEAFEHFGFERYDDFFKTC

SEQ ID NO: 1238832 - protein, 21 aa, Mycobacterium
DRIVSIGAFEHFGFNKYDDYF

SEQ ID NO: 1238833 - protein, 20 aa, Mycobacterium
DRIVSIGAFEHFGHERYDAF

SEQ ID NO: 1238834 - protein, 20 aa, Mycobacterium
DRIVSIGAFEHFGRDRWDDF

SEQ ID NO: 1238835 - protein, 20 aa, Mycobacterium
DRIVSIGAFEHFGRDRYTDF

SEQ ID NO: 1238836 - protein, 18 aa, Mycobacterium
DRKGVSLDPQRHVNAVWG

SEQ ID NO: 1238837 - protein, 31 aa, Mycobacterium
DRKRPRISALIEVDRVHGWGAQKNNDQPDGR

SEQ ID NO: 1238838 - protein, 17 aa, Mycobacterium
DRLAEYRPGEQILGEEE

SEQ ID NO: 1238839 - protein, 17 aa, Mycobacterium
DRLCDALTAAGLSTTVE

SEQ ID NO: 1238840 - protein, 20 aa, Mycobacterium
DRLESGLVQRSRLLDAVLTD

SEQ ID NO: 1238841 - protein, 25 aa, Mycobacterium
DRLGFPRAVLRERIGVTPACGLATA

SEQ ID NO: 1238842 - protein, 19 aa, Mycobacterium
DRLLVALPDGHRLAASTGV

SEQ ID NO: 1238843 - protein, 23 aa, Mycobacterium
DRLPWLESIGEWLAAHHDGGVMS

SEQ ID NO: 1238844 - protein, 18 aa, Mycobacterium
DRLRARRALVRVQGLLGP

SEQ ID NO: 1238845 - protein, 17 aa, Mycobacterium
DRLRLEAYRRLAAAQDD

SEQ ID NO: 1238846 - protein, 17 aa, Mycobacterium
DRLSALVAHLVGADALV

SEQ ID NO: 1238847 - protein, 23 aa, Mycobacterium
DRLSRPDVHLVLAGGDRLDLPTL

SEQ ID NO: 1238848 - protein, 21 aa, Mycobacterium
DRLTKMGTVFDVIGGDGQVIV

SEQ ID NO: 1238849 - protein, 20 aa, Mycobacterium
DRLYTEFARIGKAVSSPHRL

SEQ ID NO: 1238850 - protein, 24 aa, Mycobacterium
DRMRLLRAAVEIALARGQFEEAEQ

SEQ ID NO: 1238851 - protein, 23 aa, Mycobacterium
DRPAFKTCVSHGIVLGNDGQKMS

SEQ ID NO: 1238852 - protein, 21 aa, Mycobacterium
DRPATEFTLQAWSGGIVGLGR

SEQ ID NO: 1238853 - protein, 18 aa, Mycobacterium
DRPEARWDEARQWLDERG

SEQ ID NO: 1238854 - protein, 20 aa, Mycobacterium
DRPEPPYAQAVEQWEALEAF

SEQ ID NO: 1238855 - protein, 18 aa, Mycobacterium
DRPGKAKALRDFAQQAGV

SEQ ID NO: 1238856 - protein, 29 aa, Mycobacterium
DRPLARFGSWYEFFPRSTGGWDSQGHPVH

SEQ ID NO: 1238857 - protein, 20 aa, Mycobacterium
DRPMEFLGNLVLLIVGGNDT

SEQ ID NO: 1238858 - protein, 22 aa, Mycobacterium
DRPRRLRPGDSLLVDTKAGYAF

SEQ ID NO: 1238859 - protein, 20 aa, Mycobacterium
DRPTGTFTFAELLAHELSVE

SEQ ID NO: 1238860 - protein, 22 aa, Mycobacterium
DRQAKGGIISPVMADASGAAAI

SEQ ID NO: 1238861 - protein, 20 aa, Mycobacterium
DRRDMLAVALSRVTAPEPLA

SEQ ID NO: 1238862 - protein, 19 aa, Mycobacterium
DRRGFAYGTLPGHAETGEE

SEQ ID NO: 1238863 - protein, 22 aa, Mycobacterium
DRRIAPSAAKVFCTEMAGQVAD

SEQ ID NO: 1238864 - protein, 30 aa, Mycobacterium
DRRTAGRLVDAWAGAALVRVGPRGYRDLIM

SEQ ID NO: 1238865 - protein, 20 aa, Mycobacterium
DRRYPLWEFYFADGLADGRW

SEQ ID NO: 1238866 - protein, 20 aa, Mycobacterium
DRVAGISANGAWATFVTCDA

SEQ ID NO: 1238867 - protein, 18 aa, Mycobacterium
DRVAIHWEGEPVGDSRSL

SEQ ID NO: 1238868 - protein, 25 aa, Mycobacterium
DRVGLRETGFWRFVSDPADPSESQA

SEQ ID NO: 1238869 - protein, 24 aa, Mycobacterium
DRVGLRPGPRHAPTVDEVVRAAQQ

SEQ ID NO: 1238870 - protein, 23 aa, Mycobacterium
DRVTRCAIGLLGLGSTPLRGVDG

SEQ ID NO: 1238871 - protein, 20 aa, Mycobacterium
DRWCAVSTNVLGGCRGSTGP

SEQ ID NO: 1238872 - protein, 25 aa, Mycobacterium
DRWHSLARLAIRDDIYGSIRSLCFD

SEQ ID NO: 1238873 - protein, 21 aa, Mycobacterium
DRWNTRFDAAIARGADVTAAD

SEQ ID NO: 1238874 - protein, 17 aa, Mycobacterium
DRYGKFRYSTSLLTDIG

SEQ ID NO: 1238875 - protein, 23 aa, Mycobacterium
DSACSSSLLAVHMACRSLHDGES

SEQ ID NO: 1238876 - protein, 19 aa, Mycobacterium
DSAGLSGLLLIERRTTAAG

SEQ ID NO: 1238877 - protein, 23 aa, Mycobacterium
DSALRAAKVLSLAQETADRLTST

SEQ ID NO: 1238878 - protein, 31 aa, Mycobacterium
DSASLSFSSLSGWAKRGLRDRFIDLTDAVWR

SEQ ID NO: 1238879 - protein, 19 aa, Mycobacterium
DSAVGQLLLAHFVLNAAIG

SEQ ID NO: 1238880 - protein, 18 aa, Mycobacterium
DSAVRRYVTDAGPLLDRL

SEQ ID NO: 1238881 - protein, 18 aa, Mycobacterium
DSCAEMRNGTTYSLLAGF

SEQ ID NO: 1238882 - protein, 19 aa, Mycobacterium
DSCAHCPVRSSCPAQSAGE

SEQ ID NO: 1238883 - protein, 22 aa, Mycobacterium
DSDLGLAIAWNGCIYNYQQLRD

SEQ ID NO: 1238884 - protein, 18 aa, Mycobacterium
DSFLRAAELLGVTPDQAA

SEQ ID NO: 1238885 - protein, 25 aa, Mycobacterium
DSGPECAWLSVFVERVQGAVDELTA

SEQ ID NO: 1238886 - protein, 25 aa, Mycobacterium
DSGVTYRPGARFGPSAIRQASRLLK

SEQ ID NO: 1238887 - protein, 24 aa, Mycobacterium
DSGYASWRRMLWARWPSAGPPPHF

SEQ ID NO: 1238888 - protein, 19 aa, Mycobacterium
DSHRPRIPLGDYRYRELRF

SEQ ID NO: 1238889 - protein, 24 aa, Mycobacterium
DSIGRLAVRLDVSRLVVVGTGRSA

SEQ ID NO: 1238890 - protein, 23 aa, Mycobacterium
DSIQCPYHGWQFDGSTGACSRIP

SEQ ID NO: 1238891 - protein, 24 aa, Mycobacterium
DSITEFRARQSAAFSAERAAWAAA

SEQ ID NO: 1238892 - protein, 25 aa, Mycobacterium
DSLAISINGPRAWDLDVAVDVTFLD

SEQ ID NO: 1238893 - protein, 17 aa, Mycobacterium
DSLDWLISRDIDPDGPF

SEQ ID NO: 1238894 - protein, 19 aa, Mycobacterium
DSLGEFLALGACFEDLGRK

SEQ ID NO: 1238895 - protein, 20 aa, Mycobacterium
DSLMDLGLGDLYSERALAAG

SEQ ID NO: 1238896 - protein, 25 aa, Mycobacterium
DSLPPEFRAAVVLCDIEGLSYEEIG

SEQ ID NO: 1238897 - protein, 19 aa, Mycobacterium
DSLPVRVVDEAVPWQPNGR

SEQ ID NO: 1238898 - protein, 17 aa, Mycobacterium
DSMAVRLLGSVALARAA

SEQ ID NO: 1238899 - protein, 18 aa, Mycobacterium
DSMLVKLTCRGRDFSTAV

SEQ ID NO: 1238900 - protein, 27 aa, Mycobacterium
DSMQAWAEAFAHQRAVIVFDQQGHGRT

SEQ ID NO: 1238901 - protein, 25 aa, Mycobacterium
DSMRAGLKALAWMSRGGAAKRRSWA

SEQ ID NO: 1238902 - protein, 18 aa, Mycobacterium
DSPAFKSAMRSAGTVIGR

SEQ ID NO: 1238903 - protein, 20 aa, Mycobacterium
DSPLGASFHGEFVEFDHAMC

SEQ ID NO: 1238904 - protein, 17 aa, Mycobacterium
DSQALAADGAWVRYDGE

SEQ ID NO: 1238905 - protein, 21 aa, Mycobacterium
DSREACFLALLAEAYAGQVQQ

SEQ ID NO: 1238906 - protein, 24 aa, Mycobacterium
DSRLGVLRLREDVLAPLTREGDLL

SEQ ID NO: 1238907 - protein, 17 aa, Mycobacterium
DSRVFRIDPGPGVEWFD

SEQ ID NO: 1238908 - protein, 21 aa, Mycobacterium
DSSFWIGPRVAITSLALPARS

SEQ ID NO: 1238909 - protein, 24 aa, Mycobacterium
DSSRAWRALLSVLYREVSRPESIV

SEQ ID NO: 1238910 - protein, 25 aa, Mycobacterium
DSVDAVLVAQAWHWFDPERAVKEVS

SEQ ID NO: 1238911 - protein, 25 aa, Mycobacterium
DSVRFRPALTVSRAELDAAVDAVRE

SEQ ID NO: 1238912 - protein, 19 aa, Mycobacterium
DSVSGVLMGGYFTGLLNRD

SEQ ID NO: 1238913 - protein, 18 aa, Mycobacterium
DSWLRRQLTPHFRPGCKR

SEQ ID NO: 1238914 - protein, 20 aa, Mycobacterium
DTAAERFGTIGIGYRPGTTV

SEQ ID NO: 1238915 - protein, 25 aa, Mycobacterium
DTAECLKSYLPRLAVTHGTAMATGP

SEQ ID NO: 1238916 - protein, 23 aa, Mycobacterium
DTALAAYLVRPGQRSFSLDDLSL

SEQ ID NO: 1238917 - protein, 25 aa, Mycobacterium
DTAPTLGAGLDWKSSLQELTAARGL

SEQ ID NO: 1238918 - protein, 24 aa, Mycobacterium
DTARACAEWAHLVAGTDAIREGSR

SEQ ID NO: 1238919 - protein, 17 aa, Mycobacterium
DTARLWMALGHHDRHGV

SEQ ID NO: 1238920 - protein, 18 aa, Mycobacterium
DTATGLPWMAEYRREFGL

SEQ ID NO: 1238921 - protein, 18 aa, Mycobacterium
DTAYAWAYNVEKGQKTRI

SEQ ID NO: 1238922 - protein, 18 aa, Mycobacterium
DTDRALAILTARHIDCWT

SEQ ID NO: 1238923 - protein, 19 aa, Mycobacterium
DTDRLRELLARPVDNDDDL

SEQ ID NO: 1238924 - protein, 27 aa, Mycobacterium
DTDRPFLMPVEDVFTITGRGTVVTGRV

SEQ ID NO: 1238925 - protein, 23 aa, Mycobacterium
DTDTRIATAVAREVAGTLTPSWS

SEQ ID NO: 1238926 - protein, 25 aa, Mycobacterium
DTEFLRLTLRTTLELGVDPASLIHA

SEQ ID NO: 1238927 - protein, 26 aa, Mycobacterium
DTEGCVREVLVLAAALSIPDPRERPA

SEQ ID NO: 1238928 - protein, 23 aa, Mycobacterium
DTEIPSPASGVLQKIVAQEDDTV

SEQ ID NO: 1238929 - protein, 20 aa, Mycobacterium
DTELIFRPLRNTARVASNAV

SEQ ID NO: 1238930 - protein, 23 aa, Mycobacterium
DTEPIAVVGMGCRLPGGVSDPDG

SEQ ID NO: 1238931 - protein, 17 aa, Mycobacterium
DTERAAAFYGHVLGWTY

SEQ ID NO: 1238932 - protein, 20 aa, Mycobacterium
DTFTYGLLYQMEFDAAEQSR

SEQ ID NO: 1238933 - protein, 20 aa, Mycobacterium
DTGARLRARGVFSVPASPSS

SEQ ID NO: 1238934 - protein, 27 aa, Mycobacterium
DTGCSWLPLYHDMGLAFLLTNALGGAE

SEQ ID NO: 1238935 - protein, 17 aa, Mycobacterium
DTGDAWTPTAYPVEFLT

SEQ ID NO: 1238936 - protein, 27 aa, Mycobacterium
DTGEIRVPRMLGVFSIGRAINARTLRS

SEQ ID NO: 1238937 - protein, 24 aa, Mycobacterium
DTGHIPGAVKIDWHVDLNDPNVRD

SEQ ID NO: 1238938 - protein, 19 aa, Mycobacterium
DTHFGRLVRRWRWTAEEDP

SEQ ID NO: 1238939 - protein, 19 aa, Mycobacterium
DTIVLRRARPLQVSVDGRP

SEQ ID NO: 1238940 - protein, 17 aa, Mycobacterium
DTIYIWTHDSIGLGEDG

SEQ ID NO: 1238941 - protein, 18 aa, Mycobacterium
DTLFARYAFPPNELGYCG

SEQ ID NO: 1238942 - protein, 18 aa, Mycobacterium
DTMGRAWRNGQIDAAIGA

SEQ ID NO: 1238943 - protein, 17 aa, Mycobacterium
DTMYCCLPLYHNNALTV

SEQ ID NO: 1238944 - protein, 30 aa, Mycobacterium
DTNVYYRRALVLAAAFGRRADYPQHIVDTA

SEQ ID NO: 1238945 - protein, 18 aa, Mycobacterium
DTPRTGGFDEARADYLAA

SEQ ID NO: 1238946 - protein, 30 aa, Mycobacterium
DTPYPPARLEKLWLPGVDRLLDCVQRTLEM

SEQ ID NO: 1238947 - protein, 19 aa, Mycobacterium
DTRLCISLAGRPSNIGTRF

SEQ ID NO: 1238948 - protein, 25 aa, Mycobacterium
DTRNAFCGPVPYPHVPADWLRMMLA

SEQ ID NO: 1238949 - protein, 22 aa, Mycobacterium
DTRTGDIWLFRGASGPDRAIQA

SEQ ID NO: 1238950 - protein, 25 aa, Mycobacterium
DTSDRWVTLAFTWQGLRALGVPDTS

SEQ ID NO: 1238951 - protein, 20 aa, Mycobacterium
DTSFSMVMENRWLPMKRTAL

SEQ ID NO: 1238952 - protein, 23 aa, Mycobacterium
DTSRLQPLATLQRMFIPPSGFHV

SEQ ID NO: 1238953 - protein, 32 aa, Mycobacterium
DTSWLDPFTEFRFPRIGAAVFDGVEIELRGAI

SEQ ID NO: 1238954 - protein, 26 aa, Mycobacterium
DTTATFEWAFRWLAAHRPPPSPHRLV

SEQ ID NO: 1238955 - protein, 29 aa, Mycobacterium
DTTLMRRIGLRPSLFRELVEPGSVLGPLR

SEQ ID NO: 1238956 - protein, 17 aa, Mycobacterium
DTTRQFDGMFALVQHSL

SEQ ID NO: 1238957 - protein, 17 aa, Mycobacterium
DTVAVWGAGGVGLMAAK

SEQ ID NO: 1238958 - protein, 24 aa, Mycobacterium
DTVGRPRPVRAWQLPSDALPTWVG

SEQ ID NO: 1238959 - protein, 30 aa, Mycobacterium
DTVPVPPDWGGYRITAEVVEFWQGRESRVH

SEQ ID NO: 1238960 - protein, 17 aa, Mycobacterium
DTVRRVAGNAARSLDKV

SEQ ID NO: 1238961 - protein, 18 aa, Mycobacterium
DTWMFGVRICPDLDTCMY

SEQ ID NO: 1238962 - protein, 19 aa, Mycobacterium
DTWSERKLSESDWTLDREA

SEQ ID NO: 1238963 - protein, 29 aa, Mycobacterium
DVAAARWWRKPLVRRWYGFAEMQKQVARQ

SEQ ID NO: 1238964 - protein, 20 aa, Mycobacterium
DVAADVWSVTSWNELNRDGV

SEQ ID NO: 1238965 - protein, 20 aa, Mycobacterium
DVAAFWARAGLAHLLTRPGD

SEQ ID NO: 1238966 - protein, 17 aa, Mycobacterium
DVAAGAVSFRFGDRTQI

SEQ ID NO: 1238967 - protein, 20 aa, Mycobacterium
DVAAHAMGAIGLISLNRLDE

SEQ ID NO: 1238968 - protein, 23 aa, Mycobacterium
DVADDGLCFGRLDADSGERLYIG

SEQ ID NO: 1238969 - protein, 28 aa, Mycobacterium
DVADLGRLCVYLSTRDCYATNAIFHVDG

SEQ ID NO: 1238970 - protein, 19 aa, Mycobacterium
DVAKLTVYLVDWTPEKMPA

SEQ ID NO: 1238971 - protein, 19 aa, Mycobacterium
DVALDMFAARGFDEVSVDD

SEQ ID NO: 1238972 - protein, 23 aa, Mycobacterium
DVAPKLPELWGGSADLAGSNNTT

SEQ ID NO: 1238973 - protein, 26 aa, Mycobacterium
DVAQRFNARFPDTFVIPEPMIPKATA

SEQ ID NO: 1238974 - protein, 25 aa, Mycobacterium
DVARRAAVCSYGYGGTIAHVLLEEA

SEQ ID NO: 1238975 - protein, 25 aa, Mycobacterium
DVAVRRLTHRPVRRVAVATAAEPAA

SEQ ID NO: 1238976 - protein, 17 aa, Mycobacterium
DVCGQYVQTVFAPEQAL

SEQ ID NO: 1238977 - protein, 22 aa, Mycobacterium
DVDAALHYLARMLVAGEDPRFI

SEQ ID NO: 1238978 - protein, 20 aa, Mycobacterium
DVDAYIHAGGQWEWDSAAPA

SEQ ID NO: 1238979 - protein, 18 aa, Mycobacterium
DVDDILWQVPYLPIDPKD

SEQ ID NO: 1238980 - protein, 18 aa, Mycobacterium
DVDGRWGPSGGWQRSVPR

SEQ ID NO: 1238981 - protein, 20 aa, Mycobacterium
DVDGRWTFGATTPREAVAAY

SEQ ID NO: 1238982 - protein, 25 aa, Mycobacterium
DVDGVLIPGGFGIRGIEGKIGAISY

SEQ ID NO: 1238983 - protein, 24 aa, Mycobacterium
DVDPGVLVYLWRTAGMSVDEIETM

SEQ ID NO: 1238984 - protein, 23 aa, Mycobacterium
DVDPLPGGWLVRLAGDREADSGS

SEQ ID NO: 1238985 - protein, 17 aa, Mycobacterium
DVDRFTRVRDVAITDFV

SEQ ID NO: 1238986 - protein, 22 aa, Mycobacterium
DVDYRPGDVLMFGPEPTGLDAE

SEQ ID NO: 1238987 - protein, 26 aa, Mycobacterium
DVEALAVRAEERFGPERVIRAATLPD

SEQ ID NO: 1238988 - protein, 21 aa, Mycobacterium
DVEALVPVFRRFCLDSPRLAQ

SEQ ID NO: 1238989 - protein, 24 aa, Mycobacterium
DVEERLRALIDWTGDHLAEVEVTD

SEQ ID NO: 1238990 - protein, 26 aa, Mycobacterium
DVELLAAVVNRVWFLDAVRGEADVYN

SEQ ID NO: 1238991 - protein, 22 aa, Mycobacterium
DVEPRMLLVHFLRDELRLTGTH

SEQ ID NO: 1238992 - protein, 31 aa, Mycobacterium
DVFAHGMLSMAYLGRLITSWVPQSQLRSLST

SEQ ID NO: 1238993 - protein, 19 aa, Mycobacterium
DVFFARSVVSIGLSSADDA

SEQ ID NO: 1238994 - protein, 34 aa, Mycobacterium
DVFQRTPIWCFPKFDVPLPRALRGAMRLPGGKAV

SEQ ID NO: 1238995 - protein, 25 aa, Mycobacterium
DVFYLHSRLLERCAKLSDELGGGSM

SEQ ID NO: 1238996 - protein, 17 aa, Mycobacterium
DVGELTPAVAALAAVAT

SEQ ID NO: 1238997 - protein, 25 aa, Mycobacterium
DVGGARPVAKWVKIRDLGGFSGDFW

SEQ ID NO: 1238998 - protein, 24 aa, Mycobacterium
DVGLRSSYVAAWYAAPLLLRGPRG

SEQ ID NO: 1238999 - protein, 23 aa, Mycobacterium
DVHLPAGTIVMLCLGAANRDPLK

SEQ ID NO: 1239000 - protein, 31 aa, Mycobacterium
DVHLRGAFHVVRPAFPVMCDAGYGRIVLTSS

SEQ ID NO: 1239001 - protein, 19 aa, Mycobacterium
DVHMLQFSGAIWYPMVYDM

SEQ ID NO: 1239002 - protein, 19 aa, Mycobacterium
DVLGAHLGPYCWPAAIKMI

SEQ ID NO: 1239003 - protein, 19 aa, Mycobacterium
DVLLFKYIIKNTAWQEGKT

SEQ ID NO: 1239004 - protein, 23 aa, Mycobacterium
DVLRRPSFENMPAGIQIDPRDAD

SEQ ID NO: 1239005 - protein, 18 aa, Mycobacterium
DVNVAWPTAQIAVMGASG

SEQ ID NO: 1239006 - protein, 18 aa, Mycobacterium
DVPAEGRPHVVLTGKVVW

SEQ ID NO: 1239007 - protein, 23 aa, Mycobacterium
DVPGNRWRPAFTPADPERFTAML

SEQ ID NO: 1239008 - protein, 22 aa, Mycobacterium
DVPGVPVPVFLGGARVVTQYAF

SEQ ID NO: 1239009 - protein, 18 aa, Mycobacterium
DVPMLRWAGHGVAMGNAH

SEQ ID NO: 1239010 - protein, 18 aa, Mycobacterium
DVPVQYPPIPSFSPEHFA

SEQ ID NO: 1239011 - protein, 20 aa, Mycobacterium
DVRAHFGDKVLRTVIPRSVK

SEQ ID NO: 1239012 - protein, 19 aa, Mycobacterium
DVRARWPRPGPKDDKYTQG

SEQ ID NO: 1239013 - protein, 21 aa, Mycobacterium
DVRQGKRFELEFDGDVTDETV

SEQ ID NO: 1239014 - protein, 18 aa, Mycobacterium
DVRVKWADASTRSVAAEA

SEQ ID NO: 1239015 - protein, 18 aa, Mycobacterium
DVSAELDASVSDPQATPP

SEQ ID NO: 1239016 - protein, 24 aa, Mycobacterium
DVSEFPRSAWLASARRALTNAPSE

SEQ ID NO: 1239017 - protein, 20 aa, Mycobacterium
DVSQLVFLHLRFHGYGDAKG

SEQ ID NO: 1239018 - protein, 23 aa, Mycobacterium
DVSSHTGVAPGVFFRASELSRLD

SEQ ID NO: 1239019 - protein, 23 aa, Mycobacterium
DVTRARFYIFVNQIANYVPFAVS

SEQ ID NO: 1239020 - protein, 24 aa, Mycobacterium
DVTRRPRNILTFSHGAHFCLGAAA

SEQ ID NO: 1239021 - protein, 21 aa, Mycobacterium
DVTVASVYKWLLAPRGTAFLS

SEQ ID NO: 1239022 - protein, 25 aa, Mycobacterium
DVVEINEAFAPVVIAWLKELKADPE

SEQ ID NO: 1239023 - protein, 28 aa, Mycobacterium
DVVFASHHWPTWGRDRITEYLSLQRDMY

SEQ ID NO: 1239024 - protein, 20 aa, Mycobacterium
DVVGVPAFLANQGYVAGTRV

SEQ ID NO: 1239025 - protein, 20 aa, Mycobacterium
DVVLPLRRLSVVTGANGSGK

SEQ ID NO: 1239026 - protein, 18 aa, Mycobacterium
DVVRRVDSLRVFPATHYV

SEQ ID NO: 1239027 - protein, 20 aa, Mycobacterium
DVWRALRASMRSVLEQTSLA

SEQ ID NO: 1239028 - protein, 29 aa, Mycobacterium
DVYNPLRFVKATMKWCRKAAELGTLTDEA

SEQ ID NO: 1239029 - protein, 25 aa, Mycobacterium
DWDRTRGEVRWMTAWDTTAADVDRF

SEQ ID NO: 1239030 - protein, 19 aa, Mycobacterium
DWFRPKAMRALKVRVDELA

SEQ ID NO: 1239031 - protein, 24 aa, Mycobacterium
DWGPDYYQRIGVSFELPNHYQKLT

SEQ ID NO: 1239032 - protein, 19 aa, Mycobacterium
DWHMVNAMYPFGGVKQSGL

SEQ ID NO: 1239033 - protein, 18 aa, Mycobacterium
DWLASGMRYNGTLEHLAS

SEQ ID NO: 1239034 - protein, 22 aa, Mycobacterium
DWLEPFVPWEGMGAAPLSEAQK

SEQ ID NO: 1239035 - protein, 18 aa, Mycobacterium
DWLNFLVGVHKQFDVEIP

SEQ ID NO: 1239036 - protein, 24 aa, Mycobacterium
DWLRGVYGPTVWQRLLRPLFGAKF

SEQ ID NO: 1239037 - protein, 22 aa, Mycobacterium
DWRYKGLPAEWWGATPAQICGD

SEQ ID NO: 1239038 - protein, 22 aa, Mycobacterium
DWTAELAELPSLLAEKVKAPGV

SEQ ID NO: 1239039 - protein, 18 aa, Mycobacterium
DWTLRQLFRHVGRGNRWA

SEQ ID NO: 1239040 - protein, 20 aa, Mycobacterium
DWTRRSLTCGVALQCSPSKE

SEQ ID NO: 1239041 - protein, 25 aa, Mycobacterium
DWVPAHFPKDAWALGRFDGTALYEH

SEQ ID NO: 1239042 - protein, 20 aa, Mycobacterium
DYAPFFTFPENVDWGQVPGD

SEQ ID NO: 1239043 - protein, 21 aa, Mycobacterium
DYDAYFCVVDLHAITVPQDPE

SEQ ID NO: 1239044 - protein, 19 aa, Mycobacterium
DYDYGRPPGGPGRHEDGGY

SEQ ID NO: 1239045 - protein, 19 aa, Mycobacterium
DYFCVGPCWPTPTKPGREA

SEQ ID NO: 1239046 - protein, 25 aa, Mycobacterium
DYFLPRILTGEVFFCQGYSEPEAGS

SEQ ID NO: 1239047 - protein, 22 aa, Mycobacterium
DYGAPIGWRLALADPDAITGIV

SEQ ID NO: 1239048 - protein, 17 aa, Mycobacterium
DYGDVAYGWAMEDTEAF

SEQ ID NO: 1239049 - protein, 20 aa, Mycobacterium
DYGTWPRSVGLSVWGTSAMR

SEQ ID NO: 1239050 - protein, 29 aa, Mycobacterium
DYHALWRWSVEDLAGFWGALWEYFDLGTA

SEQ ID NO: 1239051 - protein, 20 aa, Mycobacterium
DYLIFPALSRSRWRRTLGAN

SEQ ID NO: 1239052 - protein, 19 aa, Mycobacterium
DYPALRLVLDSAPRPDEGQ

SEQ ID NO: 1239053 - protein, 24 aa, Mycobacterium
DYPDLEVCVYAAPTQTVIGGPPEQ

SEQ ID NO: 1239054 - protein, 26 aa, Mycobacterium
DYPRGDLPPHVRYVGAVHPARTQTFT

SEQ ID NO: 1239055 - protein, 17 aa, Mycobacterium
DYPSMLVAECARLNRAG

SEQ ID NO: 1239056 - protein, 23 aa, Mycobacterium
DYRALSGYACGRDVQIRADIHAL

SEQ ID NO: 1239057 - protein, 17 aa, Mycobacterium
DYRYAWVRDSTFALWGL

SEQ ID NO: 1239058 - protein, 33 aa, Mycobacterium
DYSPCLECKLCVAACPVGAIGKNGDFDFVACSV

SEQ ID NO: 1239059 - protein, 17 aa, Mycobacterium
DYSQLVIRRDDLYGNYR

SEQ ID NO: 1239060 - protein, 19 aa, Mycobacterium
DYVKAFWNVVNWEDVQNRF

SEQ ID NO: 1239061 - protein, 20 aa, Mycobacterium
DYVSDGRFRLGIGTSGPQVM

SEQ ID NO: 1239062 - protein, 20 aa, Mycobacterium
EAAAALCRSAGYWALPYPVA

SEQ ID NO: 1239063 - protein, 19 aa, Mycobacterium
EAAAELFAAQGYSATSMGS

SEQ ID NO: 1239064 - protein, 24 aa, Mycobacterium
EAAELHEIYKLGVVPIPTNRDMIR

SEQ ID NO: 1239065 - protein, 23 aa, Mycobacterium
EAAELMINLFWRGLKGTPSDAAG

SEQ ID NO: 1239066 - protein, 22 aa, Mycobacterium
EAAGLARWQLVTATEYAKVREQ

SEQ ID NO: 1239067 - protein, 20 aa, Mycobacterium
EAAGNVWSSGAATAAFDAFA

SEQ ID NO: 1239068 - protein, 26 aa, Mycobacterium
EAAHPGRFLLGIGVGHPEAHQAYRKP

SEQ ID NO: 1239069 - protein, 25 aa, Mycobacterium
EAALARERVGQLLSLVERRMLLPDA

SEQ ID NO: 1239070 - protein, 20 aa, Mycobacterium
EAALDLPLYRGMVTARGDSQ

SEQ ID NO: 1239071 - protein, 25 aa, Mycobacterium
EAALERLRSQPGFTDAANRVETYTD

SEQ ID NO: 1239072 - protein, 31 aa, Mycobacterium
EAALGVALRIGWRALTFAGLRGNERMQQLER

SEQ ID NO: 1239073 - protein, 18 aa, Mycobacterium
EAALTTWIAHRSHRALAP

SEQ ID NO: 1239074 - protein, 20 aa, Mycobacterium
EAAQPLYARYWLHNRGPAPM

SEQ ID NO: 1239075 - protein, 25 aa, Mycobacterium
EAAQRTWFRLSALAERVNATVRIAD

SEQ ID NO: 1239076 - protein, 26 aa, Mycobacterium
EAAQTVARWLVMYLRRPGGQTQFAAP

SEQ ID NO: 1239077 - protein, 25 aa, Mycobacterium
EAARAELPARCVIDGEIVIATADGL

SEQ ID NO: 1239078 - protein, 22 aa, Mycobacterium
EAASGLPWYPGQAVVETAEHGA

SEQ ID NO: 1239079 - protein, 26 aa, Mycobacterium
EAASRMTGKPGLCIGTLGPGVANIAG

SEQ ID NO: 1239080 - protein, 18 aa, Mycobacterium
EAATAWRGRLHGVVHSAG

SEQ ID NO: 1239081 - protein, 18 aa, Mycobacterium
EAAVQMLGVFIGGTETVP

SEQ ID NO: 1239082 - protein, 23 aa, Mycobacterium
EADAPKLPSIRPPGERLVRRVVE

SEQ ID NO: 1239083 - protein, 24 aa, Mycobacterium
EADIRTAFTDGWRVESVETTTYRG

SEQ ID NO: 1239084 - protein, 21 aa, Mycobacterium
EADLFYTDFVERVADGRGLSV

SEQ ID NO: 1239085 - protein, 18 aa, Mycobacterium
EADWRARAATAFPRQIEL

SEQ ID NO: 1239086 - protein, 24 aa, Mycobacterium
EAEARYGRKVAWGVEIGSGADAER

SEQ ID NO: 1239087 - protein, 20 aa, Mycobacterium
EAEGPIKSRLVIAAMAAGAT

SEQ ID NO: 1239088 - protein, 19 aa, Mycobacterium
EAELRKKVKEYLKDHDTEG

SEQ ID NO: 1239089 - protein, 21 aa, Mycobacterium
EAFTRPARLYGLAKLGYTQSY

SEQ ID NO: 1239090 - protein, 23 aa, Mycobacterium
EAFVEIRTAAGLSDELTVVETAM

SEQ ID NO: 1239091 - protein, 22 aa, Mycobacterium
EAGLPLAVFPGGTFNHFAKDIG

SEQ ID NO: 1239092 - protein, 20 aa, Mycobacterium
EAGRISRVIASYVGENKEFG

SEQ ID NO: 1239093 - protein, 18 aa, Mycobacterium
EAGVPVIFHLSDSGYLAI

SEQ ID NO: 1239094 - protein, 21 aa, Mycobacterium
EAHCKHLGAHLGHGGKVVGDC

SEQ ID NO: 1239095 - protein, 17 aa, Mycobacterium
EAHELFVRMGAQAYAER

SEQ ID NO: 1239096 - protein, 18 aa, Mycobacterium
EAHPRPDHRLRLEHVGAI

SEQ ID NO: 1239097 - protein, 19 aa, Mycobacterium
EAIGYTGAGTVEFMADDTG

SEQ ID NO: 1239098 - protein, 18 aa, Mycobacterium
EAIRCFERALELDPDLAV

SEQ ID NO: 1239099 - protein, 23 aa, Mycobacterium
EAKAICRGCPRRWMCARDAVELP

SEQ ID NO: 1239100 - protein, 27 aa, Mycobacterium
EAKASLDALVNRWKAETSWAQRVSLAH

SEQ ID NO: 1239101 - protein, 19 aa, Mycobacterium
EAKHGVDVVRLVAGDPLSV

SEQ ID NO: 1239102 - protein, 23 aa, Mycobacterium
EAKQWPGVEVRVIPAMTAAQAVA

SEQ ID NO: 1239103 - protein, 17 aa, Mycobacterium
EALALVGKRGRVVVTAI

SEQ ID NO: 1239104 - protein, 32 aa, Mycobacterium
EALDRSAFRWWLTVATLRWGVICRFQAERHLS

SEQ ID NO: 1239105 - protein, 24 aa, Mycobacterium
EALKPYYRFMCKRPTSSEHYLASF

SEQ ID NO: 1239106 - protein, 31 aa, Mycobacterium
EALLRRIGLAAAKYWVCKRATPHAAEAMECL

SEQ ID NO: 1239107 - protein, 19 aa, Mycobacterium
EALNAPGIDLFRRLIEDYE

SEQ ID NO: 1239108 - protein, 21 aa, Mycobacterium
EALRLTTDYLKNRKQFGVTLS

SEQ ID NO: 1239109 - protein, 17 aa, Mycobacterium
EALRRLGSGLGCGAVGV

SEQ ID NO: 1239110 - protein, 21 aa, Mycobacterium
EALSARPGVVLSRRQLLDIVR

SEQ ID NO: 1239111 - protein, 19 aa, Mycobacterium
EALVPLVLAGTSHRETPRV

SEQ ID NO: 1239112 - protein, 25 aa, Mycobacterium
EALYSLVAGAGWCIQVGRAAGRDFE

SEQ ID NO: 1239113 - protein, 20 aa, Mycobacterium
EAMARAWGLADTKWHGLDVG

SEQ ID NO: 1239114 - protein, 19 aa, Mycobacterium
EAMRAHPLGAHAAVIGTCV

SEQ ID NO: 1239115 - protein, 27 aa, Mycobacterium
EAMRKRPLPEWSERFATLAGPWAPVQD

SEQ ID NO: 1239116 - protein, 23 aa, Mycobacterium
EANAPALLGLIGLWYSNFFGAQS

SEQ ID NO: 1239117 - protein, 27 aa, Mycobacterium
EANRAWRLYRRLGFSDVIRGYHFAGDP

SEQ ID NO: 1239118 - protein, 19 aa, Mycobacterium
EAPAVFGVVRARKVIAANS

SEQ ID NO: 1239119 - protein, 17 aa, Mycobacterium
EAQAALMRLGRLREQLQ

SEQ ID NO: 1239120 - protein, 27 aa, Mycobacterium
EAQLDRFAIRLELRYLSGPDEVTMLRR

SEQ ID NO: 1239121 - protein, 31 aa, Mycobacterium
EAQVQRPDLVIGWWAAPTILEHGSPEQIEQF

SEQ ID NO: 1239122 - protein, 21 aa, Mycobacterium
EARAAGFGHVNLDLIYGTPGE

SEQ ID NO: 1239123 - protein, 26 aa, Mycobacterium
EARAAGLKAANTWHASRAIQESREAC

SEQ ID NO: 1239124 - protein, 21 aa, Mycobacterium
EARAKDLLDLVGLAEKATAYP

SEQ ID NO: 1239125 - protein, 20 aa, Mycobacterium
EARLTPLAMEMLREIDEETV

SEQ ID NO: 1239126 - protein, 23 aa, Mycobacterium
EARPQTIFLYHNFIRHWRHPLRD

SEQ ID NO: 1239127 - protein, 24 aa, Mycobacterium
EARPRAGILRGREFVMKDSYSFDV

SEQ ID NO: 1239128 - protein, 22 aa, Mycobacterium
EARYRPSWLPIPMKSILRILGV

SEQ ID NO: 1239129 - protein, 25 aa, Mycobacterium
EASFELPADLPLGYHRVHMRTGTVE

SEQ ID NO: 1239130 - protein, 19 aa, Mycobacterium
EASMSFVIPNGLDLDTAAL

SEQ ID NO: 1239131 - protein, 18 aa, Mycobacterium
EASPIRFSLFQPVDDSAR

SEQ ID NO: 1239132 - protein, 24 aa, Mycobacterium
EASRRAGVEKIVYATEGASCSSSP

SEQ ID NO: 1239133 - protein, 25 aa, Mycobacterium
EASSLPGRLALDVLSRLAIATELSA

SEQ ID NO: 1239134 - protein, 21 aa, Mycobacterium
EASSVRRSIMLTGQQVALDDM

SEQ ID NO: 1239135 - protein, 23 aa, Mycobacterium
EASYRSAGHLGFDELISPVETRD

SEQ ID NO: 1239136 - protein, 22 aa, Mycobacterium
EATPGRWALTREGGHSRRRIIH

SEQ ID NO: 1239137 - protein, 29 aa, Mycobacterium
EATYVICEVLAWRGIWLSEERRRIGNVDV

SEQ ID NO: 1239138 - protein, 25 aa, Mycobacterium
EAVGACARGLMSREDVDIIERAICP

SEQ ID NO: 1239139 - protein, 17 aa, Mycobacterium
EAVGELEPMHIWTAESV

SEQ ID NO: 1239140 - protein, 29 aa, Mycobacterium
EAVGIAAYHCGDWAQALAELRAARRMGSK

SEQ ID NO: 1239141 - protein, 18 aa, Mycobacterium
EAVLRLSFDRLTKVSRRR

SEQ ID NO: 1239142 - protein, 26 aa, Mycobacterium
EAYANRFGYNVVRDFTGHGIGTTFHN

SEQ ID NO: 1239143 - protein, 22 aa, Mycobacterium
EAYDLINRRGKPKNIIVGVRPE

SEQ ID NO: 1239144 - protein, 17 aa, Mycobacterium
EAYISPEYARAERDKLW

SEQ ID NO: 1239145 - protein, 20 aa, Mycobacterium
ECARRFPGGQMIFDLPPVLV

SEQ ID NO: 1239146 - protein, 25 aa, Mycobacterium
ECDCYTCAHYTRGYIHHLFKAKEML

SEQ ID NO: 1239147 - protein, 19 aa, Mycobacterium
ECGAALVLPLRAADTVAGV

SEQ ID NO: 1239148 - protein, 22 aa, Mycobacterium
ECMASGCPREPEFEMFGRFPLT

SEQ ID NO: 1239149 - protein, 25 aa, Mycobacterium
EDAAFRYLALDGFESHLHRWRFNLA

SEQ ID NO: 1239150 - protein, 24 aa, Mycobacterium
EDADEVIDVVLLWWRDDDGDLVDA

SEQ ID NO: 1239151 - protein, 24 aa, Mycobacterium
EDADFNTACLIGIGPLMHAGQGCA

SEQ ID NO: 1239152 - protein, 24 aa, Mycobacterium
EDAEGPGATILLRLDRDVPAELRS

SEQ ID NO: 1239153 - protein, 19 aa, Mycobacterium
EDAEMGFKIIRAGDLDVIG

SEQ ID NO: 1239154 - protein, 25 aa, Mycobacterium
EDAFRPGVIDAMFAYQLAELERLAA

SEQ ID NO: 1239155 - protein, 17 aa, Mycobacterium
EDAQRWHALALATTSAD

SEQ ID NO: 1239156 - protein, 17 aa, Mycobacterium
EDARPWGDLSLPALQLL

SEQ ID NO: 1239157 - protein, 18 aa, Mycobacterium
EDASRYPAEFSGGQKQRI

SEQ ID NO: 1239158 - protein, 19 aa, Mycobacterium
EDATPAYLGFNLFSHAIAR

SEQ ID NO: 1239159 - protein, 18 aa, Mycobacterium
EDAYAAWFRLADGATAAQ

SEQ ID NO: 1239160 - protein, 24 aa, Mycobacterium
EDCHFCSQSGLFASPVRSAWLDVP

SEQ ID NO: 1239161 - protein, 20 aa, Mycobacterium
EDFSGLIVSGDEAWNTINSY

SEQ ID NO: 1239162 - protein, 23 aa, Mycobacterium
EDGLPTIFVYDGYPGGAGFAARG

SEQ ID NO: 1239163 - protein, 22 aa, Mycobacterium
EDGPDLVLRWAALLHDIGKPAT

SEQ ID NO: 1239164 - protein, 22 aa, Mycobacterium
EDGSPPYVVRWLDSDHLATVFP

SEQ ID NO: 1239165 - protein, 18 aa, Mycobacterium
EDHLDWHGSMTAYARDKA

SEQ ID NO: 1239166 - protein, 24 aa, Mycobacterium
EDHYGVTMVTGWQEAVDVYNDAET

SEQ ID NO: 1239167 - protein, 17 aa, Mycobacterium
EDILGLFTAALDSLAIP

SEQ ID NO: 1239168 - protein, 21 aa, Mycobacterium
EDISNAVLWLASDESRFVTGM

SEQ ID NO: 1239169 - protein, 18 aa, Mycobacterium
EDKAWYIEHRFLSTERAK

SEQ ID NO: 1239170 - protein, 21 aa, Mycobacterium
EDKLRTVLWGWAGKPIDDETL

SEQ ID NO: 1239171 - protein, 19 aa, Mycobacterium
EDKNIRIAPSFPSEDDLRS

SEQ ID NO: 1239172 - protein, 26 aa, Mycobacterium
EDKRRIHLRIGRRLMRQGDDRLFEAA

SEQ ID NO: 1239173 - protein, 18 aa, Mycobacterium
EDLDRWQTTLGRSLADGN

SEQ ID NO: 1239174 - protein, 17 aa, Mycobacterium
EDLEFAVRLGVDLVALS

SEQ ID NO: 1239175 - protein, 26 aa, Mycobacterium
EDLGITKADIGFWCSGSSDYLAGRAF

SEQ ID NO: 1239176 - protein, 19 aa, Mycobacterium
EDLRVAVGGGFMSVTESGV

SEQ ID NO: 1239177 - protein, 25 aa, Mycobacterium
EDLTDYLLELGIRVRYLHSEVDTLR

SEQ ID NO: 1239178 - protein, 18 aa, Mycobacterium
EDNVGVPMAPYLYTVSTM

SEQ ID NO: 1239179 - protein, 26 aa, Mycobacterium
EDQYLWSVDVARIFAAALRRSPDLHL

SEQ ID NO: 1239180 - protein, 21 aa, Mycobacterium
EDRGRRWPVIISGTITDASGR

SEQ ID NO: 1239181 - protein, 25 aa, Mycobacterium
EDRLEAGLWLRGYLRELIAKRRVEP

SEQ ID NO: 1239182 - protein, 17 aa, Mycobacterium
EDRRGFMDLVLKPLQDK

SEQ ID NO: 1239183 - protein, 17 aa, Mycobacterium
EDRTFPYLFSPAANEAV

SEQ ID NO: 1239184 - protein, 23 aa, Mycobacterium
EDSRGRTGIVITELPYQVNHDNF

SEQ ID NO: 1239185 - protein, 18 aa, Mycobacterium
EDTLRRWMAAAALVRSRA

SEQ ID NO: 1239186 - protein, 17 aa, Mycobacterium
EDVLDVWFDSGSMPYAQ

SEQ ID NO: 1239187 - protein, 21 aa, Mycobacterium
EDVLRRLAAMRSYMRDINLGR

SEQ ID NO: 1239188 - protein, 28 aa, Mycobacterium
EDVMLRVRLRSGLPLDMLTADERSRVGT

SEQ ID NO: 1239189 - protein, 17 aa, Mycobacterium
EDVRYCRDLGVAWVATN

SEQ ID NO: 1239190 - protein, 34 aa, Mycobacterium
EDVTRIVVQLAPWLEPEPVCWAIENIAVHVGPGY

SEQ ID NO: 1239191 - protein, 25 aa, Mycobacterium
EEADKFYAQCCIDAGVAFVNALPVF

SEQ ID NO: 1239192 - protein, 34 aa, Mycobacterium
EEALERSRRALAEFKVEGLATVIPFHRAVVSDPA

SEQ ID NO: 1239193 - protein, 24 aa, Mycobacterium
EEALFARSLFDSVIYVSFQELATR

SEQ ID NO: 1239194 - protein, 30 aa, Mycobacterium; identical to SEQ ID NO: 620909

SEQ ID NO: 1239195 - protein, 22 aa, Mycobacterium
EEAQSGYAYALSKNFVKWYSSA

SEQ ID NO: 1239196 - protein, 26 aa, Mycobacterium
EEARNILGMVCDLYALSVIEEDKAWY

SEQ ID NO: 1239197 - protein, 18 aa, Mycobacterium
EEAVFPLLYLNRSANTDG

SEQ ID NO: 1239198 - protein, 17 aa, Mycobacterium
EEDESWFTGIEVDNREV

SEQ ID NO: 1239199 - protein, 21 aa, Mycobacterium
EEDHVRGAVNIPLHELPQRLD

SEQ ID NO: 1239200 - protein, 26 aa, Mycobacterium
EEDLPMFRRRAVELISYTVNYQRAFD

SEQ ID NO: 1239201 - protein, 19 aa, Mycobacterium
EEDPVGFSFGGWQAPLLDE

SEQ ID NO: 1239202 - protein, 23 aa, Mycobacterium
EEDRIAKQLVRFAGSDHDLGAIL

SEQ ID NO: 1239203 - protein, 27 aa, Mycobacterium
EEELLAAKFMGRWRSGAPLVLAPDQDD

SEQ ID NO: 1239204 - protein, 20 aa, Mycobacterium
EEFLAWEPFRHMAFRFNEAS

SEQ ID NO: 1239205 - protein, 34 aa, Mycobacterium
EEGSGFAIAQARLGPGRIHHCMRALGAAERALAL

SEQ ID NO: 1239206 - protein, 25 aa, Mycobacterium
EEIERRRELSGGKRSFILVPGIDVP

SEQ ID NO: 1239207 - protein, 25 aa, Mycobacterium
EEIPHENLYGFAWNPMTLVGILQNI

SEQ ID NO: 1239208 - protein, 22 aa, Mycobacterium
EEIPQGFSHCLILSEGKVVAAG

SEQ ID NO: 1239209 - protein, 20 aa, Mycobacterium
EEISSAIAYLVSDEAKHVTG

SEQ ID NO: 1239210 - protein, 21 aa, Mycobacterium
EELACPLVPALTEPVLVGMRR

SEQ ID NO: 1239211 - protein, 18 aa, Mycobacterium
EELAEILGHIASLPLDRS

SEQ ID NO: 1239212 - protein, 23 aa, Mycobacterium
EELARELGERAGINELVVSEHDI

SEQ ID NO: 1239213 - protein, 23 aa, Mycobacterium
EELARLYPAMLRRETNRHHGSGT

SEQ ID NO: 1239214 - protein, 17 aa, Mycobacterium
EELATAMAARFLANPAL

SEQ ID NO: 1239215 - protein, 25 aa, Mycobacterium
EELESLFYGYGYRPITVAGDDPDNV

SEQ ID NO: 1239216 - protein, 23 aa, Mycobacterium
EELFGVAEGHFGRIDIVVQSAAI

SEQ ID NO: 1239217 - protein, 22 aa, Mycobacterium
EELGDRVAVYAFRSQGRHAVHL

SEQ ID NO: 1239218 - protein, 19 aa, Mycobacterium
EELNHPLVDHVRGRGLLIG

SEQ ID NO: 1239219 - protein, 23 aa, Mycobacterium
EELRGRWVRMLTHCRRARLMAYR

SEQ ID NO: 1239220 - protein, 27 aa, Mycobacterium
EELRLPVLRAQLRWMEAVLAVWRGDFA

SEQ ID NO: 1239221 - protein, 25 aa, Mycobacterium
EELRRRWGGLLSYRYIGRLYASMDP

SEQ ID NO: 1239222 - protein, 34 aa, Mycobacterium
EELSAESAIALPDKEVVSILDLNADVDVAIDAAS

SEQ ID NO: 1239223 - protein, 19 aa, Mycobacterium
EELWRRLGHDTSLAHGPFP

SEQ ID NO: 1239224 - protein, 26 aa, Mycobacterium
EEMIRYCAPAQWFARTVRRPFTIHGT

SEQ ID NO: 1239225 - protein, 30 aa, Mycobacterium
EEMQTKCPMAWSDTYGGHWVAADSRHVFEL

SEQ ID NO: 1239226 - protein, 18 aa, Mycobacterium
EEPETEWAYTPKDSPNWL

SEQ ID NO: 1239227 - protein, 23 aa, Mycobacterium
EEQGLGWKCPFGTGNANDTVTSG

SEQ ID NO: 1239228 - protein, 24 aa, Mycobacterium
EEQRAEAIFGQRLMYAIPEARGLI

SEQ ID NO: 1239229 - protein, 17 aa, Mycobacterium
EEQRKQWLPAMATGDVI

SEQ ID NO: 1239230 - protein, 27 aa, Mycobacterium
EERAKFGLPEVKRGLIAGAGGVFRIVE

SEQ ID NO: 1239231 - protein, 20 aa, Mycobacterium
EERLDDLRLFAAVVAAANRY

SEQ ID NO: 1239232 - protein, 26 aa, Mycobacterium
EERLVWQCASLLLSYPDHSRFDTAER

SEQ ID NO: 1239233 - protein, 20 aa, Mycobacterium
EERYSFPLFFNVDYHTEVKP

SEQ ID NO: 1239234 - protein, 31 aa, Mycobacterium
EESALFAADLARMYIRYAERHGWSVTILDET

SEQ ID NO: 1239235 - protein, 29 aa, Mycobacterium
EESEALVLRFSIAPRPSMRSRRRRLSTPA

SEQ ID NO: 1239236 - protein, 19 aa, Mycobacterium
EESNPWALHGMAERLLEAA

SEQ ID NO: 1239237 - protein, 20 aa, Mycobacterium
EETYHTFSYSPLRDDGGQVV

SEQ ID NO: 1239238 - protein, 25 aa, Mycobacterium
EEVEVLRLSALRGLFSTVTDQQVTF

SEQ ID NO: 1239239 - protein, 20 aa, Mycobacterium
EEVLACVDAGIPVTVVPGVT

SEQ ID NO: 1239240 - protein, 20 aa, Mycobacterium
EEVLGFMFLMVIAGNETTTK

SEQ ID NO: 1239241 - protein, 17 aa, Mycobacterium
EEVLRTVDLLDVGGVDD

SEQ ID NO: 1239242 - protein, 25 aa, Mycobacterium
EEVPLKRFDLMNGIQVRGTYAVTQA

SEQ ID NO: 1239243 - protein, 23 aa, Mycobacterium
EEVVLRLRALLRRTGVSESGGAK

SEQ ID NO: 1239244 - protein, 22 aa, Mycobacterium
EEVVLRPGLDLRGLVTELRQRA

SEQ ID NO: 1239245 - protein, 23 aa, Mycobacterium
EFAASGARIRLCKGAYDEPASVA

SEQ ID NO: 1239246 - protein, 21 aa, Mycobacterium
EFAAVGFEYGYSVGNPDAMVL

SEQ ID NO: 1239247 - protein, 21 aa, Mycobacterium
EFADRALVMYAGRAVEIASVS

SEQ ID NO: 1239248 - protein, 23 aa, Mycobacterium
EFAERLRPGFPPSEPAAPLTVLQ

SEQ ID NO: 1239249 - protein, 26 aa, Mycobacterium
EFAMPAAEFARAWLPVINTADDDDAR

SEQ ID NO: 1239250 - protein, 19 aa, Mycobacterium
EFAMVPGIGEPGGIRFYAG

SEQ ID NO: 1239251 - protein, 25 aa, Mycobacterium
EFDSRAVTAGGLFLALPGARSDGHD

SEQ ID NO: 1239252 - protein, 22 aa, Mycobacterium
EFGLSRFKVARMLDEALESGMV

SEQ ID NO: 1239253 - protein, 24 aa, Mycobacterium
EFGPEPEDLVLARWHGLGPMGGTD

SEQ ID NO: 1239254 - protein, 17 aa, Mycobacterium
EFGRGLVDVPFLGPALS

SEQ ID NO: 1239255 - protein, 25 aa, Mycobacterium
EFLARLCKTAMWIDHGTVKMTGGIE

SEQ ID NO: 1239256 - protein, 21 aa, Mycobacterium
EFLEVVRRLWAGETVSLDGEH

SEQ ID NO: 1239257 - protein, 17 aa, Mycobacterium
EFLRRWDPMHWPHRPHH

SEQ ID NO: 1239258 - protein, 28 aa, Mycobacterium
EFLRSRRARIAPEMTGLPAYGGRRRVKG

SEQ ID NO: 1239259 - protein, 17 aa, Mycobacterium
EFLSMDIALAVVDGVDA

SEQ ID NO: 1239260 - protein, 19 aa, Mycobacterium
EFPTRVIARLLGLPEEDLP

SEQ ID NO: 1239261 - protein, 25 aa, Mycobacterium
EFRKMCGTANWYGGTIIDDIVPGHT

SEQ ID NO: 1239262 - protein, 18 aa, Mycobacterium
EFRVTRLRDERRFANRRV

SEQ ID NO: 1239263 - protein, 19 aa, Mycobacterium
EFSGDRVLILASLIDSRIG

SEQ ID NO: 1239264 - protein, 22 aa, Mycobacterium
EFTARLKAYFAAHGHDTGLDDA

SEQ ID NO: 1239265 - protein, 18 aa, Mycobacterium
EFTLRSAQRLPWHPGRCA

SEQ ID NO: 1239266 - protein, 19 aa, Mycobacterium
EFTPRVTTILSDLRQLEAV

SEQ ID NO: 1239267 - protein, 23 aa, Mycobacterium
EFVAESISALGAQAVDEAGTGFA

SEQ ID NO: 1239268 - protein, 29 aa, Mycobacterium
EFVEAHSGLRFSVAEGFPDYKPELPGGRP

SEQ ID NO: 1239269 - protein, 32 aa, Mycobacterium
EFVLRGGKRLRPAFAYWGWRAVADRPADSGVL

SEQ ID NO: 1239270 - protein, 18 aa, Mycobacterium
EFVPLLLEQGGFQLSQPT

SEQ ID NO: 1239271 - protein, 17 aa, Mycobacterium
EFVPLPFVHQSSPLYLS

SEQ ID NO: 1239272 - protein, 23 aa, Mycobacterium
EFVQFHPTMLFDGFTNGRRPLIT

SEQ ID NO: 1239273 - protein, 22 aa, Mycobacterium
EGAAAAWALAERGITNVVVVER

SEQ ID NO: 1239274 - protein, 20 aa, Mycobacterium
EGADIIAVDICKQIDSVRIP

SEQ ID NO: 1239275 - protein, 25 aa, Mycobacterium
EGAFRIPELIRWPGKIEPRSVSNEI

SEQ ID NO: 1239276 - protein, 19 aa, Mycobacterium
EGAIAPWSMGQTAEYFTRM

SEQ ID NO: 1239277 - protein, 20 aa, Mycobacterium
EGALALALYCARLVDLGDNQ

SEQ ID NO: 1239278 - protein, 25 aa, Mycobacterium
EGARRPRAVEWGWQLAAALTVATVF

SEQ ID NO: 1239279 - protein, 18 aa, Mycobacterium
EGDAWPSAAGDYFTVRAG

SEQ ID NO: 1239280 - protein, 19 aa, Mycobacterium
EGDGPWPGVVVVHDAIGYG

SEQ ID NO: 1239281 - protein, 18 aa, Mycobacterium
EGDLAKLRASIVNTGALA

SEQ ID NO: 1239282 - protein, 22 aa, Mycobacterium
EGDRGVAVGVYGWVYGIDVENA

SEQ ID NO: 1239283 - protein, 28 aa, Mycobacterium
EGDRGVSWLPFFHDMGLITIMISPMIGH

SEQ ID NO: 1239284 - protein, 20 aa, Mycobacterium
EGDTVVLLESMKMEIPVLAE

SEQ ID NO: 1239285 - protein, 26 aa, Mycobacterium
EGEAMLFGEYIRLMALVEYSADEIKT

SEQ ID NO: 1239286 - protein, 21 aa, Mycobacterium
EGEDFFIRSVRNFQSSIDDPQ

SEQ ID NO: 1239287 - protein, 20 aa, Mycobacterium
EGEIALVIGRRTRRVSPENS

SEQ ID NO: 1239288 - protein, 24 aa, Mycobacterium
EGFDRVTYSWIPRAANARADRLAN

SEQ ID NO: 1239289 - protein, 17 aa, Mycobacterium
EGGHAPFSLAWMTAVGE

SEQ ID NO: 1239290 - protein, 20 aa, Mycobacterium
EGGLFDARWLDAAVPDRPVV

SEQ ID NO: 1239291 - protein, 19 aa, Mycobacterium
EGHTHGFLTSLARPGRTGA

SEQ ID NO: 1239292 - protein, 17 aa, Mycobacterium
EGIAPAYALAAARAAEP

SEQ ID NO: 1239293 - protein, 17 aa, Mycobacterium
EGIDRLGGALLIPPMTL

SEQ ID NO: 1239294 - protein, 23 aa, Mycobacterium
EGIPKLRIEEAAARTQARIDSGA

SEQ ID NO: 1239295 - protein, 20 aa, Mycobacterium
EGIVGRVERLVGMGEAVLGP

SEQ ID NO: 1239296 - protein, 25 aa, Mycobacterium
EGKASLGALAAVWGGSGSEAYQAVQ

SEQ ID NO: 1239297 - protein, 18 aa, Mycobacterium
EGKDLAMLLLRLGRGRLG

SEQ ID NO: 1239298 - protein, 20 aa, Mycobacterium
EGKEPVLYVVGRKALSYYSF

SEQ ID NO: 1239299 - protein, 20 aa, Mycobacterium
EGKSVPPHLALAHTLFDRLV

SEQ ID NO: 1239300 - protein, 20 aa, Mycobacterium
EGLDWLPGEQLLSADELIRL

SEQ ID NO: 1239301 - protein, 18 aa, Mycobacterium
EGLGRAVVDWTFVEPKLL

SEQ ID NO: 1239302 - protein, 21 aa, Mycobacterium
EGLKGLFEFFTPLLRNVTPNA

SEQ ID NO: 1239303 - protein, 21 aa, Mycobacterium
EGLPVGSALLVVKRGPNAGSR

SEQ ID NO: 1239304 - protein, 22 aa, Mycobacterium
EGLSASALRLLAATVLGPTRLA

SEQ ID NO: 1239305 - protein, 17 aa, Mycobacterium
EGMVLAVTAYVWEQGVG

SEQ ID NO: 1239306 - protein, 33 aa, Mycobacterium
EGNPIAWLYEQRRWEVPSNRIANTMKLAIISIE

SEQ ID NO: 1239307 - protein, 26 aa, Mycobacterium
EGPCVDCYRTGLPVSVADLTGAGQRW

SEQ ID NO: 1239308 - protein, 18 aa, Mycobacterium
EGPEELDAALARAREQHP

SEQ ID NO: 1239309 - protein, 18 aa, Mycobacterium
EGPFAKWLEHWNPDRDIF

SEQ ID NO: 1239310 - protein, 27 aa, Mycobacterium
EGPGRRDICIYARESHVLVARSPSELF

SEQ ID NO: 1239311 - protein, 25 aa, Mycobacterium
EGPSYTRPPSWRGLDVPAVLLSGDH

SEQ ID NO: 1239312 - protein, 20 aa, Mycobacterium
EGQLGKWSRMDAEIIAEHAE

SEQ ID NO: 1239313 - protein, 18 aa, Mycobacterium
EGQQRMWFVQAADPSGAL

SEQ ID NO: 1239314 - protein, 25 aa, Mycobacterium
EGQRNRFLLVTNFEYVDPVFMFPGY

SEQ ID NO: 1239315 - protein, 19 aa, Mycobacterium
EGRLPKLGADFAGVVTGVG

SEQ ID NO: 1239316 - protein, 18 aa, Mycobacterium
EGRLRRRLERVARHWEAR

SEQ ID NO: 1239317 - protein, 21 aa, Mycobacterium
EGRRIASMIPGARFEVMPGCG

SEQ ID NO: 1239318 - protein, 29 aa, Mycobacterium
EGSLRDMVLFIGHPIRWADWGNLEHSVRT

SEQ ID NO: 1239319 - protein, 28 aa, Mycobacterium
EGSLWAVLRDRYGMRLARSTAVLESIVL

SEQ ID NO: 1239320 - protein, 20 aa, Mycobacterium
EGTFSLAEHERFLARNADSI

SEQ ID NO: 1239321 - protein, 24 aa, Mycobacterium
EGTNLKAWLYRILTNTYINSYRKK

SEQ ID NO: 1239322 - protein, 24 aa, Mycobacterium
EGTPADKVLQHWLASARRDDEARG

SEQ ID NO: 1239323 - protein, 24 aa, Mycobacterium
EGTPNGCFNEMCTLNGLAGIETED

SEQ ID NO: 1239324 - protein, 45 aa, Mycobacterium
EGTRVVFPYFYSCHRCRNCLLGRRGACLNLKMAMLGRADEPPYFV

SEQ ID NO: 1239325 - protein, 20 aa, Mycobacterium
EGTVTRWLKQEGDTVEQDEP

SEQ ID NO: 1239326 - protein, 19 aa, Mycobacterium
EGTWALAVLERGTGRIVVA

SEQ ID NO: 1239327 - protein, 22 aa, Mycobacterium
EGVAALERLGVTWIQVTVPGDS

SEQ ID NO: 1239328 - protein, 17 aa, Mycobacterium
EGVSALVLRVGADGVAP

SEQ ID NO: 1239329 - protein, 25 aa, Mycobacterium
EGVVWGVDSFDQWGVELGKTQAKAL

SEQ ID NO: 1239330 - protein, 21 aa, Mycobacterium
EGYFINQLITWTVDGGETVAE

SEQ ID NO: 1239331 - protein, 26 aa, Mycobacterium
EGYYQLRGGIPYAIAKQLAAAPFADI

SEQ ID NO: 1239332 - protein, 35 aa, Mycobacterium
EHAAALAWPGLHREWVDGWLLRASDGYTHRGNSAV

SEQ ID NO: 1239333 - protein, 30 aa, Mycobacterium
EHAERWMHWASCFEFDFTFVHEGSTRQTAS

SEQ ID NO: 1239334 - protein, 24 aa, Mycobacterium
EHAHTRLAAKLSYTNIGFALTPTE

SEQ ID NO: 1239335 - protein, 23 aa, Mycobacterium
EHAPHPTQWVRVWFADGDKQHQR

SEQ ID NO: 1239336 - protein, 17 aa, Mycobacterium
EHARDEKLLAWIRAAHA

SEQ ID NO: 1239337 - protein, 21 aa, Mycobacterium
EHEVDCIVFATGFDVAKRGTP

SEQ ID NO: 1239338 - protein, 24 aa, Mycobacterium
EHGEIPLGLFCRKSLAEFMDAERL

SEQ ID NO: 1239339 - protein, 17 aa, Mycobacterium
EHGHVIQVFGLPNMRTV

SEQ ID NO: 1239340 - protein, 24 aa, Mycobacterium
EHHPPMRTFLGVPIRIRDEVFGNL

SEQ ID NO: 1239341 - protein, 23 aa, Mycobacterium
EHKRLECLEVTLSEKSRTYPLFQ

SEQ ID NO: 1239342 - protein, 21 aa, Mycobacterium
EHLDFAKKILKDHGVPTDDSD

SEQ ID NO: 1239343 - protein, 19 aa, Mycobacterium
EHLERMLSLDDVFNVDELT

SEQ ID NO: 1239344 - protein, 21 aa, Mycobacterium
EHLKIQWAQAAARSGIALDPK

SEQ ID NO: 1239345 - protein, 26 aa, Mycobacterium
EHPGRLVPNFLRRAIAYMEDNATADI

SEQ ID NO: 1239346 - protein, 22 aa, Mycobacterium
EHPSSGVAYVLGERLGRTNMAE

SEQ ID NO: 1239347 - protein, 17 aa, Mycobacterium
EHPTVAAPRTWEEIEDP

SEQ ID NO: 1239348 - protein, 18 aa, Mycobacterium
EHRAEFRTPTGATYRSTA

SEQ ID NO: 1239349 - protein, 26 aa, Mycobacterium
EHRRRIGELWAQFSAVAADNPHAWRR

SEQ ID NO: 1239350 - protein, 20 aa, Mycobacterium
EHTEKATLWELMDVQERTGI

SEQ ID NO: 1239351 - protein, 23 aa, Mycobacterium
EHTNRPTTAWLFTGQGSQYPRMA

SEQ ID NO: 1239352 - protein, 25 aa, Mycobacterium
EHTRRVPGYHILKAHMSSSIKRSQP

SEQ ID NO: 1239353 - protein, 30 aa, Mycobacterium
EHVRARLTGFKRPRHVLFVDALPLTTNGKI

SEQ ID NO: 1239354 - protein, 19 aa, Mycobacterium
EIAARRPDLVFVTSPNNPS

SEQ ID NO: 1239355 - protein, 24 aa, Mycobacterium
EIADRAGVSKPVLYQHFSSKLELY

SEQ ID NO: 1239356 - protein, 19 aa, Mycobacterium
EIAEAATLIREAKSPILLV

SEQ ID NO: 1239357 - protein, 19 aa, Mycobacterium
EIAEEVGLTVTDVRYLGSQ

SEQ ID NO: 1239358 - protein, 23 aa, Mycobacterium
EIARLLYRYARAVDSKDWELYRS

SEQ ID NO: 1239359 - protein, 25 aa, Mycobacterium
EIASHNKLLGSFELTGIPPAPRGVP

SEQ ID NO: 1239360 - protein, 22 aa, Mycobacterium
EIDAGAIGEAFLEAGAALEAAF

SEQ ID NO: 1239361 - protein, 30 aa, Mycobacterium
EIDVAEIYVPFSWFEPMWLENLGFAAEGEG

SEQ ID NO: 1239362 - protein, 21 aa, Mycobacterium
EIEPRTGRHLGNFPQAFTHLA

SEQ ID NO: 1239363 - protein, 26 aa, Mycobacterium
EIERKAVFKRAWLNVGRVEQLPRKGS

SEQ ID NO: 1239364 - protein, 18 aa, Mycobacterium
EIEVDTVIAVPCRELLMS

SEQ ID NO: 1239365 - protein, 20 aa, Mycobacterium
EIEWAKASLISPEAYPGAVA

SEQ ID NO: 1239366 - protein, 18 aa, Mycobacterium
EIEYFGARVLPLVREIEA

SEQ ID NO: 1239367 - protein, 23 aa, Mycobacterium
EIFDAAPYGWPVAKGSPLGQSLQ

SEQ ID NO: 1239368 - protein, 27 aa, Mycobacterium
EIFEGLKAYRWADGSVVSFRPESNAAR

SEQ ID NO: 1239369 - protein, 17 aa, Mycobacterium
EIFGPAGALAFADDLPE

SEQ ID NO: 1239370 - protein, 19 aa, Mycobacterium
EIFGPVLVVIPFRDDDEAV

SEQ ID NO: 1239371 - protein, 20 aa, Mycobacterium
EIGAAIGIEGFQHIQEDLAE

SEQ ID NO: 1239372 - protein, 19 aa, Mycobacterium
EIGFFKLLQPQQWGGMQCD

SEQ ID NO: 1239373 - protein, 26 aa, Mycobacterium
EIGRPSRLKGAGFYEYVDGKRTGLWP

SEQ ID NO: 1239374 - protein, 20 aa, Mycobacterium
EIGRSLAPVPWIEHVVAARL

SEQ ID NO: 1239375 - protein, 20 aa, Mycobacterium
EIHLAAGDVVDWSFHGGGGW

SEQ ID NO: 1239376 - protein, 25 aa, Mycobacterium
EIISRVAPVERLRMVNSGTEATMSA

SEQ ID NO: 1239377 - protein, 23 aa, Mycobacterium
EILKALWALIGHDLPTPLPRITY

SEQ ID NO: 1239378 - protein, 23 aa, Mycobacterium
EILPELDASLGLRPQQRTAVDAW

SEQ ID NO: 1239379 - protein, 24 aa, Mycobacterium
EILREFDTLLVMSVEPGFGGQKFI

SEQ ID NO: 1239380 - protein, 20 aa, Mycobacterium
EIPVALGAPYTYWGVGGTDP

SEQ ID NO: 1239381 - protein, 24 aa, Mycobacterium
EIQAARLAKQLTWQQLADAIDRPV

SEQ ID NO: 1239382 - protein, 18 aa, Mycobacterium
EIRKEGKIGRVYYPAPYL

SEQ ID NO: 1239383 - protein, 27 aa, Mycobacterium
EIRRLAIRAFRAIDCQGLARVDFFLTD

SEQ ID NO: 1239384 - protein, 23 aa, Mycobacterium
EIRTFSGLLERFGTGKGCDICKP

SEQ ID NO: 1239385 - protein, 21 aa, Mycobacterium
EISGADALLALTQRPLTTPDT

SEQ ID NO: 1239386 - protein, 25 aa, Mycobacterium
EISTGPYRFVYRKRFHKRAETELTI

SEQ ID NO: 1239387 - protein, 24 aa, Mycobacterium
EISWGDVGLMLSVPRQGLGNAAIS

SEQ ID NO: 1239388 - protein, 19 aa, Mycobacterium
EITGPWPPYSFTGDVVSAD

SEQ ID NO: 1239389 - protein, 18 aa, Mycobacterium
EIVAVRWGGTGRRLTDTD

SEQ ID NO: 1239390 - protein, 23 aa, Mycobacterium
EIVLMELGLDWDRIEALKDSGAI

SEQ ID NO: 1239391 - protein, 19 aa, Mycobacterium
EIYPGGRLPLASMVKEHAV

SEQ ID NO: 1239392 - protein, 17 aa, Mycobacterium
EIYVGGAAGAHIRKGDL

SEQ ID NO: 1239393 - protein, 20 aa, Mycobacterium
EKAFFMLAFTKIGLMPDGGA

SEQ ID NO: 1239394 - protein, 18 aa, Mycobacterium
EKAFRRMRDGDIGVKVGP

SEQ ID NO: 1239395 - protein, 19 aa, Mycobacterium
EKAKSMGAMALFGEAYPDE

SEQ ID NO: 1239396 - protein, 25 aa, Mycobacterium
EKARANRTPIEWDGYTPPVPAQGVG

SEQ ID NO: 1239397 - protein, 26 aa, Mycobacterium
EKATPELVAFMVRYTSGYLCVPLDGA

SEQ ID NO: 1239398 - protein, 30 aa, Mycobacterium
EKDPSASLWLARLWKEAGLPDGVFNVLQGD

SEQ ID NO: 1239399 - protein, 17 aa, Mycobacterium
EKFREWSDCDGHPENVF

SEQ ID NO: 1239400 - protein, 18 aa, Mycobacterium
EKGRRYLVQTSRIAYVEI

SEQ ID NO: 1239401 - protein, 18 aa, Mycobacterium
EKGSTCAGFLERAAHYFR

SEQ ID NO: 1239402 - protein, 24 aa, Mycobacterium
EKGVKSLYLVGSDYVFPQTANRII

SEQ ID NO: 1239403 - protein, 30 aa, Mycobacterium
EKHDLAFGTSRWSSKLVHGGLRYLASGNVG

SEQ ID NO: 1239404 - protein, 21 aa, Mycobacterium
EKIPAHLRVTFAVEKDGAEVA

SEQ ID NO: 1239405 - protein, 22 aa, Mycobacterium
EKKIKEKLNIGAVVTADDVLPA

SEQ ID NO: 1239406 - protein, 23 aa, Mycobacterium
EKLDALLRVLEPYGVRELVQSGV

SEQ ID NO: 1239407 - protein, 21 aa, Mycobacterium
EKLELRRVAYFDGNVETYLHK

SEQ ID NO: 1239408 - protein, 20 aa, Mycobacterium
EKLFNAAFAVGRQVSRLRRE

SEQ ID NO: 1239409 - protein, 18 aa, Mycobacterium
EKLVKRGVPAVVLNAKND

SEQ ID NO: 1239410 - protein, 19 aa, Mycobacterium
EKMEKAVSVARDDLSSIRT

SEQ ID NO: 1239411 - protein, 21 aa, Mycobacterium
EKMLDFMPAYEVDWAGCRRVN

SEQ ID NO: 1239412 - protein, 20 aa, Mycobacterium
EKNPVCCPINNGVLAVTGWE

SEQ ID NO: 1239413 - protein, 19 aa, Mycobacterium
EKPALASWFAPTARPIGGE

SEQ ID NO: 1239414 - protein, 26 aa, Mycobacterium
EKPTRADAELAFGVQQAMPVPFIEPE

SEQ ID NO: 1239415 - protein, 34 aa, Mycobacterium
EKRREMAYEGKVDWAFAELLALGTMISEGKLVRL

SEQ ID NO: 1239416 - protein, 25 aa, Mycobacterium
EKTACLIAASGRFGATFSGADETQI

SEQ ID NO: 1239417 - protein, 27 aa, Mycobacterium
EKTTLKWRFPYGFLDQGQSTPIRMPTP

SEQ ID NO: 1239418 - protein, 23 aa, Mycobacterium
EKVAEAFGGYGERVGEVDEIAAA

SEQ ID NO: 1239419 - protein, 19 aa, Mycobacterium
EKVPPLWKTFEHRRNVHKS

SEQ ID NO: 1239420 - protein, 27 aa, Mycobacterium
ELAATRLDRFIGLVVIDRGHPRVPDPA

SEQ ID NO: 1239421 - protein, 26 aa, Mycobacterium
ELAEGRIRPPVCARASDLRAMGLPQT

SEQ ID NO: 1239422 - protein, 19 aa, Mycobacterium
ELAELLSIEHGKTVPDAKG

SEQ ID NO: 1239423 - protein, 19 aa, Mycobacterium
ELAELRSRITIPIAADESI

SEQ ID NO: 1239424 - protein, 18 aa, Mycobacterium
ELALHFAAHYGWPKAAHL

SEQ ID NO: 1239425 - protein, 26 aa, Mycobacterium
ELALLRLNALLARACGDAASYRRWRD

SEQ ID NO: 1239426 - protein, 21 aa, Mycobacterium
ELAMRGRRPALPTVLGPHDVA

SEQ ID NO: 1239427 - protein, 19 aa, Mycobacterium
ELANSFGVPPSIPTPGVPP

SEQ ID NO: 1239428 - protein, 24 aa, Mycobacterium
ELAPRLRVNAVAPGLVRTPLTSGA

SEQ ID NO: 1239429 - protein, 19 aa, Mycobacterium
ELAQRAAMSPRHFTRVFST

SEQ ID NO: 1239430 - protein, 18 aa, Mycobacterium
ELARLCRTIVAATGQDHD

SEQ ID NO: 1239431 - protein, 17 aa, Mycobacterium
ELARNAADLTVYQRTPI

SEQ ID NO: 1239432 - protein, 19 aa, Mycobacterium
ELASALGLFAPTDEQAAVI

SEQ ID NO: 1239433 - protein, 20 aa, Mycobacterium
ELASGLGLDADWLRSPDGVR

SEQ ID NO: 1239434 - protein, 20 aa, Mycobacterium
ELATLMAHVKLALKADLLDS

SEQ ID NO: 1239435 - protein, 19 aa, Mycobacterium
ELAVKYGIKDEGDRQPPSY

SEQ ID NO: 1239436 - protein, 26 aa, Mycobacterium
ELAVRCLTFPKPVIMAATGPAIAMGS

SEQ ID NO: 1239437 - protein, 25 aa, Mycobacterium
ELAWSDWQGSAAFDRLDDEDVWAAK

SEQ ID NO: 1239438 - protein, 21 aa, Mycobacterium
ELCAMAKRYVTDACYEVADQA

SEQ ID NO: 1239439 - protein, 21 aa, Mycobacterium
ELCATFDGFYTLLVSNRDSFA

SEQ ID NO: 1239440 - protein, 28 aa, Mycobacterium
ELDALRIGRRIVGRLNWRKQGPAPAPVT

SEQ ID NO: 1239441 - protein, 19 aa, Mycobacterium
ELDEAMALVGDDDRYGESQ

SEQ ID NO: 1239442 - protein, 22 aa, Mycobacterium
ELDEARCGPVLGASGDDPASDW

SEQ ID NO: 1239443 - protein, 19 aa, Mycobacterium
ELDLAEGADMVMVKPAMSY

SEQ ID NO: 1239444 - protein, 19 aa, Mycobacterium
ELDVWRYIQLENLELPSIY

SEQ ID NO: 1239445 - protein, 27 aa, Mycobacterium
ELEALRHPKMRVVHAALRARRDRPASF

SEQ ID NO: 1239446 - protein, 18 aa, Mycobacterium
ELEELDWDRYRAHYGNIQ

SEQ ID NO: 1239447 - protein, 19 aa, Mycobacterium
ELEPFVLVVEGSIPNEAIK

SEQ ID NO: 1239448 - protein, 20 aa, Mycobacterium
ELERRTGRHLAHLAEGSEER

SEQ ID NO: 1239449 - protein, 18 aa, Mycobacterium
ELEVLRLLATGATNREIA

SEQ ID NO: 1239450 - protein, 26 aa, Mycobacterium
ELFENGWKPGLAWTAETTLGRVMFNE

SEQ ID NO: 1239451 - protein, 19 aa, Mycobacterium
ELFSVAPLLTAKMYRELGR

SEQ ID NO: 1239452 - protein, 17 aa, Mycobacterium
ELFTGPTAIAFVQGEPV

SEQ ID NO: 1239453 - protein, 21 aa, Mycobacterium
ELGAILRWFVAGTLGVGPVES

SEQ ID NO: 1239454 - protein, 26 aa, Mycobacterium
ELGEFTGVQGFARWAAESSGHSEPTI

SEQ ID NO: 1239455 - protein, 18 aa, Mycobacterium
ELGLRWPAAVAPFDVHVV

SEQ ID NO: 1239456 - protein, 26 aa, Mycobacterium
ELGSGLPVFHPKGGIVRKELEDYSRA

SEQ ID NO: 1239457 - protein, 17 aa, Mycobacterium
ELGVRLRAVGARIQQLT

SEQ ID NO: 1239458 - protein, 24 aa, Mycobacterium
ELHFGRAAERLHIAQPPLSQQIRA

SEQ ID NO: 1239459 - protein, 18 aa, Mycobacterium
ELHGRWLRDTSVDPPGGE

SEQ ID NO: 1239460 - protein, 23 aa, Mycobacterium
ELIDARYGALGVRGHDHELVEFI

SEQ ID NO: 1239461 - protein, 31 aa, Mycobacterium
ELIERRPGWPQARWLRVAIHHRTQRWSDVVR

SEQ ID NO: 1239462 - protein, 19 aa, Mycobacterium
ELIQDAWLSRASRRRAERW

SEQ ID NO: 1239463 - protein, 18 aa, Mycobacterium
ELKLCMIHGADPWWDVAI

SEQ ID NO: 1239464 - protein, 25 aa, Mycobacterium
ELKLDRKIAERRVFPAVDVNPSGTR

SEQ ID NO: 1239465 - protein, 21 aa, Mycobacterium
ELKPVGTVCFCVRRADGRVVT

SEQ ID NO: 1239466 - protein, 19 aa, Mycobacterium
ELKRQSLRVSRLHAKLFYQ

SEQ ID NO: 1239467 - protein, 17 aa, Mycobacterium
ELLAPKFALVGQVLEDR

SEQ ID NO: 1239468 - protein, 18 aa, Mycobacterium
ELLCYPGDLNEVWSNLID

SEQ ID NO: 1239469 - protein, 20 aa, Mycobacterium
ELLDRASSKYALVIYAAKRA

SEQ ID NO: 1239470 - protein, 19 aa, Mycobacterium
ELLERSGLVALRDVIDQQF

SEQ ID NO: 1239471 - protein, 19 aa, Mycobacterium
ELLETVSLEPSFAARRPHQ

SEQ ID NO: 1239472 - protein, 24 aa, Mycobacterium
ELLGLPWVELNPHPLYRPSKGLPP

SEQ ID NO: 1239473 - protein, 23 aa, Mycobacterium
ELLGTRYLPPFPYFTDKPEAQNA

SEQ ID NO: 1239474 - protein, 24 aa, Mycobacterium
ELLKQVWRWDFGDLSTVTVHVKRL

SEQ ID NO: 1239475 - protein, 27 aa, Mycobacterium
ELLPVLVVGAPLRYRHRVYNTAVVIHR

SEQ ID NO: 1239476 - protein, 20 aa, Mycobacterium
ELLRPGGRCVVEFDSETQGV

SEQ ID NO: 1239477 - protein, 19 aa, Mycobacterium
ELLSRLAIPIPTVVTPQMF

SEQ ID NO: 1239478 - protein, 17 aa, Mycobacterium
ELLTAQLYFPGDPHNDD

SEQ ID NO: 1239479 - protein, 23 aa, Mycobacterium
ELLTRRRIFVPILRVTAIEPSAV

SEQ ID NO: 1239480 - protein, 19 aa, Mycobacterium
ELLTRWAGALAAGSWLAMQ

SEQ ID NO: 1239481 - protein, 19 aa, Mycobacterium
ELLTSALAPWTDRYPGVQV

SEQ ID NO: 1239482 - protein, 21 aa, Mycobacterium
ELLTYRRTRRYGRGRTGNGNG

SEQ ID NO: 1239483 - protein, 19 aa, Mycobacterium
ELNEAGVPSAVWVVTPNGR

SEQ ID NO: 1239484 - protein, 23 aa, Mycobacterium
ELPEPYARGALVGIHGSWNRRPP

SEQ ID NO: 1239485 - protein, 32 aa, Mycobacterium
ELPGLAEAIRRAGLPKVPTAVLSRGICGVAGR

SEQ ID NO: 1239486 - protein, 23 aa, Mycobacterium
ELPLPRPKFEIFVYSPRVEGVHL

SEQ ID NO: 1239487 - protein, 25 aa, Mycobacterium
ELPLPYAGNSWVVWDRVGTAPNTTL

SEQ ID NO: 1239488 - protein, 19 aa, Mycobacterium
ELPPRIARKEYGVLGELED

SEQ ID NO: 1239489 - protein, 17 aa, Mycobacterium
ELPRGGTGKVLRNELRA

SEQ ID NO: 1239490 - protein, 25 aa, Mycobacterium
ELPSLGEIWLRYRASVAHGLTLWMC

SEQ ID NO: 1239491 - protein, 29 aa, Mycobacterium
ELQRAGKWPQIWRIAGEYSNFSVFDVESN

SEQ ID NO: 1239492 - protein, 25 aa, Mycobacterium
ELQRAVRRWGITAGTSVVVYDHDVD

SEQ ID NO: 1239493 - protein, 17 aa, Mycobacterium
ELQRHGVVHRESYHEVP

SEQ ID NO: 1239494 - protein, 17 aa, Mycobacterium
ELQRLRLATQLRAGLFG

SEQ ID NO: 1239495 - protein, 28 aa, Mycobacterium
ELRAGRKRTHWIWFIFPQLRGLGRSPTA

SEQ ID NO: 1239496 - protein, 18 aa, Mycobacterium
ELRASWTAITVELGPHVE

SEQ ID NO: 1239497 - protein, 20 aa, Mycobacterium
ELRIGLATADDIRQWSYGEV

SEQ ID NO: 1239498 - protein, 23 aa, Mycobacterium
ELRLRINEFYARETMLLDDGRLD

SEQ ID NO: 1239499 - protein, 18 aa, Mycobacterium
ELRRICGGPPVAAATSDQ

SEQ ID NO: 1239500 - protein, 17 aa, Mycobacterium
ELRRRIEAGEWVVDLRN

SEQ ID NO: 1239501 - protein, 20 aa, Mycobacterium
ELRTLFLFEALSDEQLDMLC

SEQ ID NO: 1239502 - protein, 23 aa, Mycobacterium
ELSAHPQLLFAMGDLLGDTTATL

SEQ ID NO: 1239503 - protein, 18 aa, Mycobacterium
ELSEAVTTLVARYHDDTA

SEQ ID NO: 1239504 - protein, 23 aa, Mycobacterium
ELTEIKRAPSFFDAADLKVDQHF

SEQ ID NO: 1239505 - protein, 25 aa, Mycobacterium
ELTEKGRALAIAVMRKHRLAERLLV

SEQ ID NO: 1239506 - protein, 19 aa, Mycobacterium
ELTIVMAHPAVPWVDAQIS

SEQ ID NO: 1239507 - protein, 20 aa, Mycobacterium
ELTLPGRSLLFVRNVGHLMT

SEQ ID NO: 1239508 - protein, 19 aa, Mycobacterium
ELTPALGIGAFADKTLVHE

SEQ ID NO: 1239509 - protein, 19 aa, Mycobacterium
ELTPRFASSVIEPTPAYDA

SEQ ID NO: 1239510 - protein, 19 aa, Mycobacterium
ELVAEVGCPVMSTRDAQLD

SEQ ID NO: 1239511 - protein, 20 aa, Mycobacterium
ELVDRFHIEPGHHWTAKAPA

SEQ ID NO: 1239512 - protein, 22 aa, Mycobacterium
ELVEAVLDRTGYRAELEASNDP

SEQ ID NO: 1239513 - protein, 21 aa, Mycobacterium
ELVELLGPRYVLIVRAGAHRL

SEQ ID NO: 1239514 - protein, 26 aa, Mycobacterium
ELVGAMHGAWVRFATTGDPGWAPNEL

SEQ ID NO: 1239515 - protein, 17 aa, Mycobacterium
ELVLREARLHLDIPSDV

SEQ ID NO: 1239516 - protein, 18 aa, Mycobacterium
ELVQRGSSFSGLLYAGLA

SEQ ID NO: 1239517 - protein, 17 aa, Mycobacterium
ELVRGGVHDVVLCPGSR

SEQ ID NO: 1239518 - protein, 19 aa, Mycobacterium
ELVRSWASDVVGLFDRDYV

SEQ ID NO: 1239519 - protein, 24 aa, Mycobacterium
ELVRTPAGWRIARRRFTTVRVSPV

SEQ ID NO: 1239520 - protein, 24 aa, Mycobacterium
ELVSMALRYEGWDIATAGDGATAI

SEQ ID NO: 1239521 - protein, 18 aa, Mycobacterium
ELYDPDVLTTRFSVGSFD

SEQ ID NO: 1239522 - protein, 23 aa, Mycobacterium
ELYGKPQFWPLWEAAADAGLPVA

SEQ ID NO: 1239523 - protein, 23 aa, Mycobacterium
ELYKVGLGSVRFLMSVGDLVIGW

SEQ ID NO: 1239524 - protein, 24 aa, Mycobacterium
ELYRRNGIQFLPFNTVYQLAVERA

SEQ ID NO: 1239525 - protein, 19 aa, Mycobacterium
EMAFKVAGSQVLKKAAQAA

SEQ ID NO: 1239526 - protein, 17 aa, Mycobacterium
EMAPGALGFHYDSGLYL

SEQ ID NO: 1239527 - protein, 20 aa, Mycobacterium
EMARRVDVARVYTRHVVERQ

SEQ ID NO: 1239528 - protein, 18 aa, Mycobacterium
EMDRYPGRIWVVAHKPVA

SEQ ID NO: 1239529 - protein, 20 aa, Mycobacterium
EMDVAWMIFAHMVFQELTGL

SEQ ID NO: 1239530 - protein, 20 aa, Mycobacterium
EMFNELWPGFDPNEVPIGSI

SEQ ID NO: 1239531 - protein, 19 aa, Mycobacterium
EMFTMWPTKYTPGLRTQGS

SEQ ID NO: 1239532 - protein, 24 aa, Mycobacterium
EMGLARLWQSWGVTPDVVLGHSVG

SEQ ID NO: 1239533 - protein, 20 aa, Mycobacterium
EMHTRSGLIEEVRASTVDLA

SEQ ID NO: 1239534 - protein, 24 aa, Mycobacterium
EMLNRFPEWDIDYDTAQLAPTSTV

SEQ ID NO: 1239535 - protein, 24 aa, Mycobacterium
EMPGLRAAVLSGRGRPQRWVAGRA

SEQ ID NO: 1239536 - protein, 20 aa, Mycobacterium
EMRESLKIVEQCVDRLKPGP

SEQ ID NO: 1239537 - protein, 27 aa, Mycobacterium
EMRRRADAAGWLRYGLPEQFGGRGGSN

SEQ ID NO: 1239538 - protein, 19 aa, Mycobacterium
EMVRRCRRDPTDAGLVTGL

SEQ ID NO: 1239539 - protein, 23 aa, Mycobacterium
EMVRVLRPGRRMAVMVPTAGQMA

SEQ ID NO: 1239540 - protein, 23 aa, Mycobacterium
ENAIWPDLFIAGGGISRKADKWV

SEQ ID NO: 1239541 - protein, 18 aa, Mycobacterium
ENAMRWYHFEPFKHIPKE

SEQ ID NO: 1239542 - protein, 18 aa, Mycobacterium
ENAQPVFRNTLAGTGVAV

SEQ ID NO: 1239543 - protein, 24 aa, Mycobacterium
ENDARFLFYPAVKELTLDIASVVF

SEQ ID NO: 1239544 - protein, 23 aa, Mycobacterium
ENDPRMARILFVESGAEPLLRQL

SEQ ID NO: 1239545 - protein, 25 aa, Mycobacterium
ENGRAAWYRNRWVRTESFEQHFPVY

SEQ ID NO: 1239546 - protein, 17 aa, Mycobacterium
ENGRTVFRAALDRVTGR

SEQ ID NO: 1239547 - protein, 19 aa, Mycobacterium
ENIADTFVAMGWELAEGPE

SEQ ID NO: 1239548 - protein, 22 aa, Mycobacterium
ENKRFCWNCGRPVGRSTSDGKA

SEQ ID NO: 1239549 - protein, 29 aa, Mycobacterium
ENLDIPGRFAVRVPMQWTSDDNGGFSRAA

SEQ ID NO: 1239550 - protein, 24 aa, Mycobacterium
ENLRLETLAAHWGVPQLKPHDALD

SEQ ID NO: 1239551 - protein, 19 aa, Mycobacterium
ENMFPFRADRFFGAGQTSI

SEQ ID NO: 1239552 - protein, 22 aa, Mycobacterium
ENTRRWRDLRKITIAQVQGNAI

SEQ ID NO: 1239553 - protein, 24 aa, Mycobacterium
ENTVRWSWEPGDLAVWDNRATQHY

SEQ ID NO: 1239554 - protein, 24 aa, Mycobacterium
ENYIWKARTQGIGYLDLAGCMALG

SEQ ID NO: 1239555 - protein, 17 aa, Mycobacterium
ENYRLGTVGQVFDGSEV

SEQ ID NO: 1239556 - protein, 17 aa, Mycobacterium
EPAELPFVLPPGEHLEA

SEQ ID NO: 1239557 - protein, 29 aa, Mycobacterium
EPAFFGVRPHAVIKGGMIAWAAMGDANAS

SEQ ID NO: 1239558 - protein, 21 aa, Mycobacterium
EPALRSLRRGGRFVTVGFASG

SEQ ID NO: 1239559 - protein, 21 aa, Mycobacterium
EPCSALDPISTLAIEDLIDEL

SEQ ID NO: 1239560 - protein, 24 aa, Mycobacterium
EPDEGFVAAIYRWATTGDLTTALA

SEQ ID NO: 1239561 - protein, 22 aa, Mycobacterium
EPEERYKLCSTVHTKIAVVRSI

SEQ ID NO: 1239562 - protein, 19 aa, Mycobacterium
EPEFLPLVRRLGRFLPADV

SEQ ID NO: 1239563 - protein, 20 aa, Mycobacterium
EPERDNWRVLSIMHLADTRE

SEQ ID NO: 1239564 - protein, 19 aa, Mycobacterium
EPEVIAVPVRRPRRRAAAR

SEQ ID NO: 1239565 - protein, 22 aa, Mycobacterium
EPEVQREAFAWHIDLAKCTGKP

SEQ ID NO: 1239566 - protein, 17 aa, Mycobacterium
EPEWFGVSIAEFHQRAT

SEQ ID NO: 1239567 - protein, 19 aa, Mycobacterium
EPFLYAGAVTALIRDYLHR

SEQ ID NO: 1239568 - protein, 30 aa, Mycobacterium
EPFRYPTDFANLFTGGAFGFTNPFADAVEP

SEQ ID NO: 1239569 - protein, 26 aa, Mycobacterium
EPFTPLRAPKLFNLRTDPYERADITS

SEQ ID NO: 1239570 - protein, 26 aa, Mycobacterium
EPGELPREWSAVPFGRPLPNNACRVV

SEQ ID NO: 1239571 - protein, 24 aa, Mycobacterium
EPGGIRFYAGYPLYGPGGHPVGTF

SEQ ID NO: 1239572 - protein, 21 aa, Mycobacterium
EPGLQEKPLSIALREIHEDLL

SEQ ID NO: 1239573 - protein, 19 aa, Mycobacterium
EPGPPFFQAYGEWMGTPPP

SEQ ID NO: 1239574 - protein, 21 aa, Mycobacterium
EPGPPRPGYLERIIDGALHHG

SEQ ID NO: 1239575 - protein, 19 aa, Mycobacterium
EPGVHGWPDHGCVGCSLMA

SEQ ID NO: 1239576 - protein, 28 aa, Mycobacterium
EPHYRPSAKLAAFVRARDLFCRYPGCDV

SEQ ID NO: 1239577 - protein, 23 aa, Mycobacterium
EPIDISNAVLFLASDESRYVTGL

SEQ ID NO: 1239578 - protein, 20 aa, Mycobacterium
EPIHEWLEVRPFMGAPTTVT

SEQ ID NO: 1239579 - protein, 18 aa, Mycobacterium
EPLFNLFQAMPIPYIEPE

SEQ ID NO: 1239580 - protein, 24 aa, Mycobacterium
EPLSGADFPAGWQKLNGPQALSFV

SEQ ID NO: 1239581 - protein, 23 aa, Mycobacterium
EPMIPIYIFYSMFGFQRTGDSFW

SEQ ID NO: 1239582 - protein, 20 aa, Mycobacterium
EPMRPWKAEQLGGGYRVSSW

SEQ ID NO: 1239583 - protein, 22 aa, Mycobacterium
EPPCPELAALVTDVGPVEAAEK

SEQ ID NO: 1239584 - protein, 25 aa, Mycobacterium
EPPGVPWTVVWSFHLMPRGTDRCRL

SEQ ID NO: 1239585 - protein, 18 aa, Mycobacterium
EPPMALCVIVEDGEYHTG

SEQ ID NO: 1239586 - protein, 23 aa, Mycobacterium
EPPRYAFIGVRACDLSAIRVLDG

SEQ ID NO: 1239587 - protein, 23 aa, Mycobacterium
EPQHRSALCHRDAAFALTTIGAL

SEQ ID NO: 1239588 - protein, 22 aa, Mycobacterium
EPQPEWEVAVGRLGHAIIAHPG

SEQ ID NO: 1239589 - protein, 17 aa, Mycobacterium
EPQRVAGDLGVPDAVKF

SEQ ID NO: 1239590 - protein, 23 aa, Mycobacterium
EPQSARFVTPWPRPLDVEAMNDA

SEQ ID NO: 1239591 - protein, 25 aa, Mycobacterium
EPRFDPRLRGPREFERPAPRLGALR

SEQ ID NO: 1239592 - protein, 27 aa, Mycobacterium
EPRLFTCGVDLPLEHPTVFTALVDEAA

SEQ ID NO: 1239593 - protein, 20 aa, Mycobacterium
EPRVSLTVIDGTDWYSHVTL

SEQ ID NO: 1239594 - protein, 23 aa, Mycobacterium
EPSAWIAEGLFGYLPPEAQDRLL

SEQ ID NO: 1239595 - protein, 24 aa, Mycobacterium
EPSPLPFGRHRWVSSLGPPSSLDI

SEQ ID NO: 1239596 - protein, 17 aa, Mycobacterium
EPSRFRTAFNTADVLDF

SEQ ID NO: 1239597 - protein, 17 aa, Mycobacterium
EPSRPYRGVPPSALVSE

SEQ ID NO: 1239598 - protein, 20 aa, Mycobacterium
EPTFRRSVIYIVEHNDGGTL

SEQ ID NO: 1239599 - protein, 25 aa, Mycobacterium
EPTTRGGPDYGRFVEAVRELQDLAR

SEQ ID NO: 1239600 - protein, 18 aa, Mycobacterium
EPVHGVMIVTGYDEALAV

SEQ ID NO: 1239601 - protein, 25 aa, Mycobacterium
EPVLYEWTDRETLLYALGVGAGTAD

SEQ ID NO: 1239602 - protein, 21 aa, Mycobacterium
EPVMRRFLQLDGDFTATTGMF

SEQ ID NO: 1239603 - protein, 24 aa, Mycobacterium
EPVVPRPLIREVTERIDYKGAVIV

SEQ ID NO: 1239604 - protein, 19 aa, Mycobacterium
EPYTGAPMRQVHQGRGITM

SEQ ID NO: 1239605 - protein, 24 aa, Mycobacterium
EQAIRVVTRYDLGLLHPEAVVVLT

SEQ ID NO: 1239606 - protein, 33 aa, Mycobacterium
EQAKRLPDALTRFPIARLVSSPQRRAVQTAQPV

SEQ ID NO: 1239607 - protein, 27 aa, Mycobacterium
EQALRDAWFWAHEVMAVGMVWNTAATS

SEQ ID NO: 1239608 - protein, 24 aa, Mycobacterium
EQCVDRLKPGPVMIADKKLAWPAD

SEQ ID NO: 1239609 - protein, 17 aa, Mycobacterium
EQFGRLDILVANAGVLS

SEQ ID NO: 1239610 - protein, 22 aa, Mycobacterium
EQHPQLRWILVGDDAGPDPELF

SEQ ID NO: 1239611 - protein, 26 aa, Mycobacterium
EQHVDWIADCLLHLRKLGHDRIEATR

SEQ ID NO: 1239612 - protein, 26 aa, Mycobacterium
EQIVPCWECRFCKRGQYHMCQPHDLY

SEQ ID NO: 1239613 - protein, 26 aa, Mycobacterium
EQKIIECFRHGGGLPYSAYPRFHTLM

SEQ ID NO: 1239614 - protein, 31 aa, Mycobacterium
EQLFAVGYAACFHSALRLVARQEKVDVTDST

SEQ ID NO: 1239615 - protein, 27 aa, Mycobacterium
EQLPVYRPPLDMARLFGEPAVGDHRDG

SEQ ID NO: 1239616 - protein, 21 aa, Mycobacterium
EQLRGLAGIAERRGQSLAQLA

SEQ ID NO: 1239617 - protein, 22 aa, Mycobacterium
EQLRMLCVFNPPVTGQEVHDES

SEQ ID NO: 1239618 - protein, 23 aa, Mycobacterium
EQMREYFVHRSLYHLKEGDPHAF

SEQ ID NO: 1239619 - protein, 24 aa, Mycobacterium
EQQKLKVLVSIFGRETPVELTFNQ

SEQ ID NO: 1239620 - protein, 27 aa, Mycobacterium
EQRRGLTIDLGFAWADIGGREMAFVDV

SEQ ID NO: 1239621 - protein, 20 aa, Mycobacterium
EQRVALAYGAVDAMLGEKPR

SEQ ID NO: 1239622 - protein, 20 aa, Mycobacterium
EQRVAQMWARFNGIRRRHRM

SEQ ID NO: 1239623 - protein, 18 aa, Mycobacterium
EQSARLFADACAVIPGGV

SEQ ID NO: 1239624 - protein, 24 aa, Mycobacterium
EQSGFKTAGFAFGREDIWEPEEML

SEQ ID NO: 1239625 - protein, 29 aa, Mycobacterium
EQSGMGVSPSWSVFCVDSGIAFTPDIGVA

SEQ ID NO: 1239626 - protein, 17 aa, Mycobacterium
EQVAFHPGHLVPGIDVT

SEQ ID NO: 1239627 - protein, 29 aa, Mycobacterium
EQVSGRGKYRLGFAIARLARASSGHLDLG

SEQ ID NO: 1239628 - protein, 24 aa, Mycobacterium
EQVVRLWEHWGRPEIVWYRGGHTG

SEQ ID NO: 1239629 - protein, 18 aa, Mycobacterium
EQYRGALEIISRDELLKR

SEQ ID NO: 1239630 - protein, 20 aa, Mycobacterium
EQYTYWRIALPHVEAAVFDA

SEQ ID NO: 1239631 - protein, 18 aa, Mycobacterium
ERAAHYFRAHGITTIEQV

SEQ ID NO: 1239632 - protein, 18 aa, Mycobacterium
ERAAMPIDPEFGPQWHLG

SEQ ID NO: 1239633 - protein, 22 aa, Mycobacterium
ERADIAFTVCDAGWKYLSTGAY

SEQ ID NO: 1239634 - protein, 18 aa, Mycobacterium
ERARRKFDEYQRVDWQVI

SEQ ID NO: 1239635 - protein, 23 aa, Mycobacterium
ERARVLGEAVALLRDMLNPDDLV

SEQ ID NO: 1239636 - protein, 33 aa, Mycobacterium
ERATCAPWLDAEWRLVSGDVRVVIALGGFAWKA

SEQ ID NO: 1239637 - protein, 26 aa, Mycobacterium
ERATPPWWPMRQLVRALGADPDDVLE

SEQ ID NO: 1239638 - protein, 20 aa, Mycobacterium
ERATTGFGWSRPGRSTLSAT

SEQ ID NO: 1239639 - protein, 20 aa, Mycobacterium
ERAVFVLREVFGFDHAEIAE

SEQ ID NO: 1239640 - protein, 20 aa, Mycobacterium
ERAVFVLREVFGFSHDEIAA

SEQ ID NO: 1239641 - protein, 24 aa, Mycobacterium
ERCARVAGIALRHARLRRIPVQDK

SEQ ID NO: 1239642 - protein, 26 aa, Mycobacterium
ERDAFGRDAYRLMSRSFLGTEVDLDE

SEQ ID NO: 1239643 - protein, 21 aa, Mycobacterium
ERDVELLLVIGRLIAGALHQA

SEQ ID NO: 1239644 - protein, 18 aa, Mycobacterium
ERDVPILLSIGYAACHWC

SEQ ID NO: 1239645 - protein, 22 aa, Mycobacterium
ERELPEWLQADVAILGEPSGGF

SEQ ID NO: 1239646 - protein, 23 aa, Mycobacterium
EREPDARIALPTREDQALLYRLS

SEQ ID NO: 1239647 - protein, 19 aa, Mycobacterium
ERFLRAAGVSRWVVDTGFK

SEQ ID NO: 1239648 - protein, 20 aa, Mycobacterium
ERFTLLRPLLFTIAYEILGS

SEQ ID NO: 1239649 - protein, 17 aa, Mycobacterium
ERGEVTIDFVVHGEHGV

SEQ ID NO: 1239650 - protein, 18 aa, Mycobacterium
ERGLLLTTLWYIREVDPT

SEQ ID NO: 1239651 - protein, 20 aa, Mycobacterium
ERGLPIQVHVGFGDRDLDLH

SEQ ID NO: 1239652 - protein, 28 aa, Mycobacterium
ERGLPLTMNKLRFFKFIMDEIFPGGDLP

SEQ ID NO: 1239653 - protein, 25 aa, Mycobacterium
ERGMAFSGVVWRAAAPKPDESSADV

SEQ ID NO: 1239654 - protein, 30 aa, Mycobacterium
ERHVSRGKLLPRDRVDGLLDAGSPFLEIAP

SEQ ID NO: 1239655 - protein, 28 aa, Mycobacterium
ERIIARMLAVMLRRRMAQAGMDTGGVEP

SEQ ID NO: 1239656 - protein, 18 aa, Mycobacterium
ERIPDLPEPPALPLVPRA

SEQ ID NO: 1239657 - protein, 19 aa, Mycobacterium
ERISNALVAMAIESLGAQA

SEQ ID NO: 1239658 - protein, 25 aa, Mycobacterium
ERKNKLRGGAVFAPAFDPVQVEVGF

SEQ ID NO: 1239659 - protein, 17 aa, Mycobacterium
ERLEIEHLEIFDGEDRF

SEQ ID NO: 1239660 - protein, 23 aa, Mycobacterium
ERLGRSFPRPTLIRIAETSGGNP

SEQ ID NO: 1239661 - protein, 19 aa, Mycobacterium
ERLGVTVGIVITDTMGRAW

SEQ ID NO: 1239662 - protein, 18 aa, Mycobacterium
ERLIVAVGAVAAMELALE

SEQ ID NO: 1239663 - protein, 24 aa, Mycobacterium
ERLLRGFLTPALWEAGLYCRADDR

SEQ ID NO: 1239664 - protein, 34 aa, Mycobacterium
ERLRYPIVPCQDGYIRICLLAKRQWHGMFEWMGR

SEQ ID NO: 1239665 - protein, 17 aa, Mycobacterium
ERLSINLRWSWDKPTQD

SEQ ID NO: 1239666 - protein, 19 aa, Mycobacterium
ERLTRSWVGLRTMRSYALA

SEQ ID NO: 1239667 - protein, 23 aa, Mycobacterium
ERMAFRTAGYWDVSAELDASVSD

SEQ ID NO: 1239668 - protein, 24 aa, Mycobacterium
ERMASLRGLLKFKDGVRQPIPIDE

SEQ ID NO: 1239669 - protein, 21 aa, Mycobacterium
ERMLRVHVGGLAHICRAVLPA

SEQ ID NO: 1239670 - protein, 17 aa, Mycobacterium
ERMRLGALARHITDELP

SEQ ID NO: 1239671 - protein, 30 aa, Mycobacterium
ERPATAADEIVRWATPVTSFQRTALCDTEL

SEQ ID NO: 1239672 - protein, 22 aa, Mycobacterium
ERPDGIVVRGARMLATVAPIAD

SEQ ID NO: 1239673 - protein, 24 aa, Mycobacterium
ERPRVRWKILDAWQAAAAQVGIAP

SEQ ID NO: 1239674 - protein, 19 aa, Mycobacterium
ERQRARGGAGAGQLQGRRC

SEQ ID NO: 1239675 - protein, 25 aa, Mycobacterium
ERQRFSSAILPAWARKSPQMTEVLP

SEQ ID NO: 1239676 - protein, 23 aa, Mycobacterium
ERRDAVAGGHRFEFTVAEPGWTM

SEQ ID NO: 1239677 - protein, 25 aa, Mycobacterium
ERREFSITGGMCPRCEGRGSVSDID

SEQ ID NO: 1239678 - protein, 22 aa, Mycobacterium
ERRFDNPWLFDVTRDPNPQIGF

SEQ ID NO: 1239679 - protein, 24 aa, Mycobacterium
ERRGLPLTVFGVALALARNPEAVA

SEQ ID NO: 1239680 - protein, 19 aa, Mycobacterium
ERRKEICGRAYRILTEEVG

SEQ ID NO: 1239681 - protein, 20 aa, Mycobacterium
ERRMPYTVGLLGSVPRLDAR

SEQ ID NO: 1239682 - protein, 25 aa, Mycobacterium
ERRVREGLLEIGQKLGIPPLATNDC

SEQ ID NO: 1239683 - protein, 26 aa, Mycobacterium
ERSAGKLKAAIEGAGGPGGPASGGGG

SEQ ID NO: 1239684 - protein, 20 aa, Mycobacterium
ERTARVALDAVERAIASNPR

SEQ ID NO: 1239685 - protein, 17 aa, Mycobacterium
ERTFFRYFADKREALFG

SEQ ID NO: 1239686 - protein, 18 aa, Mycobacterium
ERTWKVGDELVVEWRALT

SEQ ID NO: 1239687 - protein, 24 aa, Mycobacterium
ERVADAWIKAQAYRLHTFGTVTRV

SEQ ID NO: 1239688 - protein, 24 aa, Mycobacterium
ERVAELLGIVGLRREDASRYPAEF

SEQ ID NO: 1239689 - protein, 17 aa, Mycobacterium
ERVALALLTYVEERTDG

SEQ ID NO: 1239690 - protein, 17 aa, Mycobacterium
ERVERFAHPVLLERSRA

SEQ ID NO: 1239691 - protein, 24 aa, Mycobacterium
ERVLRINLVGTFLVTREAISALRN

SEQ ID NO: 1239692 - protein, 26 aa, Mycobacterium
ERVLVHPRPRLSVMSVGGELVDISRT

SEQ ID NO: 1239693 - protein, 19 aa, Mycobacterium
ERWDGPFMLKGIVRVDDAK

SEQ ID NO: 1239694 - protein, 19 aa, Mycobacterium
ERWFGERGWAAEPTSLADY

SEQ ID NO: 1239695 - protein, 22 aa, Mycobacterium
ERWRVVWERAIAAATDDEERLL

SEQ ID NO: 1239696 - protein, 26 aa, Mycobacterium
ERYEWAYEYLDVVYKLWEGSWDEDAL

SEQ ID NO: 1239697 - protein, 23 aa, Mycobacterium
ERYSVDAVQAFALLRKLSQDSNV

SEQ ID NO: 1239698 - protein, 17 aa, Mycobacterium
ERYWLGVGRTRSDKYLI

SEQ ID NO: 1239699 - protein, 19 aa, Mycobacterium
ESAKYWLAVLTELKNRGVA

SEQ ID NO: 1239700 - protein, 17 aa, Mycobacterium
ESAQWLANERFFGSYRR

SEQ ID NO: 1239701 - protein, 24 aa, Mycobacterium
ESARARDVFAIKLDPGLIDELPLP

SEQ ID NO: 1239702 - protein, 17 aa, Mycobacterium
ESATFWKSGPEVETGEI

SEQ ID NO: 1239703 - protein, 17 aa, Mycobacterium
ESAYDRYYGDPTNKPNP

SEQ ID NO: 1239704 - protein, 18 aa, Mycobacterium
ESDLLVAECLRAGTWEGL

SEQ ID NO: 1239705 - protein, 23 aa, Mycobacterium
ESDPRYMPFQSLRGKDFTSMVSV

SEQ ID NO: 1239706 - protein, 31 aa, Mycobacterium
ESDRLSGPYGRPVVVMAHGFGGTMDSGLEPF

SEQ ID NO: 1239707 - protein, 24 aa, Mycobacterium
ESEWNAKNLFTGWVDVDLTDKGRA

SEQ ID NO: 1239708 - protein, 21 aa, Mycobacterium
ESFGYKYGLPMDADIVMDVRF

SEQ ID NO: 1239709 - protein, 19 aa, Mycobacterium
ESFQTAFAAAPGLLETAFD

SEQ ID NO: 1239710 - protein, 23 aa, Mycobacterium
ESFTEVHPLPGRDLMPVVDGAAP

SEQ ID NO: 1239711 - protein, 18 aa, Mycobacterium
ESGWTFDHFYPIFSDSTG

SEQ ID NO: 1239712 - protein, 20 aa, Mycobacterium
ESHLHRWRFNLATGAATEER

SEQ ID NO: 1239713 - protein, 23 aa, Mycobacterium
ESIRRAAEFAADVNVVINNAGVS

SEQ ID NO: 1239714 - protein, 18 aa, Mycobacterium
ESIYERWQRGDLRVPMPG

SEQ ID NO: 1239715 - protein, 19 aa, Mycobacterium
ESKIASWTDPKGGYFVSLD

SEQ ID NO: 1239716 - protein, 24 aa, Mycobacterium
ESLADRLAEAFAERMHQRVRKEFW

SEQ ID NO: 1239717 - protein, 20 aa, Mycobacterium
ESLDDLRAGGAPMVPLDSAN

SEQ ID NO: 1239718 - protein, 21 aa, Mycobacterium
ESLEFKWVEYLLGSRATTIYG

SEQ ID NO: 1239719 - protein, 19 aa, Mycobacterium
ESLFALSNGHIGLRGNLDE

SEQ ID NO: 1239720 - protein, 17 aa, Mycobacterium
ESLGLRDGQRVSLISEF

SEQ ID NO: 1239721 - protein, 18 aa, Mycobacterium
ESLICTWTTNLALATDAV

SEQ ID NO: 1239722 - protein, 25 aa, Mycobacterium
ESLSEFTSAVAMARCDDKRQTRRIV

SEQ ID NO: 1239723 - protein, 20 aa, Mycobacterium
ESLTLLGAVAAWTERVRLVT

SEQ ID NO: 1239724 - protein, 24 aa, Mycobacterium
ESPGMMAALVSFWMHPDAVYLSPA

SEQ ID NO: 1239725 - protein, 20 aa, Mycobacterium
ESPIVFLRLRKAVRKQGLQV

SEQ ID NO: 1239726 - protein, 20 aa, Mycobacterium
ESQRGNVIPVEITVYEDRSF

SEQ ID NO: 1239727 - protein, 20 aa, Mycobacterium
ESRGGWYVRQLIGAANIEGS

SEQ ID NO: 1239728 - protein, 23 aa, Mycobacterium
ESRPRVVVVGGGFIGAEVAATCR

SEQ ID NO: 1239729 - protein, 20 aa, Mycobacterium
ESRRTAWAFDRYVLPRTYWN

SEQ ID NO: 1239730 - protein, 23 aa, Mycobacterium
ESRTFTGGHEWLAEHGVEVTVLD

SEQ ID NO: 1239731 - protein, 20 aa, Mycobacterium
ESSAAFQAAHARFIEVSAKI

SEQ ID NO: 1239732 - protein, 24 aa, Mycobacterium
ESSDRIGGNWAFGNPNGHSSAYRS

SEQ ID NO: 1239733 - protein, 30 aa, Mycobacterium; identical to SEQ ID NO: 656153

SEQ ID NO: 1239734 - protein, 20 aa, Mycobacterium
ESTWWTWRGRRVHIARAVRP

SEQ ID NO: 1239735 - protein, 21 aa, Mycobacterium
ESVAACAPAGVPVIADGGLQY

SEQ ID NO: 1239736 - protein, 21 aa, Mycobacterium
ESVAPYARRLLLPTGAPKVDD

SEQ ID NO: 1239737 - protein, 25 aa, Mycobacterium
ESVARALGREFVRVALGGVRDEAEI

SEQ ID NO: 1239738 - protein, 17 aa, Mycobacterium
ESVDLIKTGGFRVGAGE

SEQ ID NO: 1239739 - protein, 23 aa, Mycobacterium
ESVEPRIAAATRKELADQRDSLK

SEQ ID NO: 1239740 - protein, 17 aa, Mycobacterium
ESVFRIDHYLGKETVQN

SEQ ID NO: 1239741 - protein, 18 aa, Mycobacterium
ESVNSWAAGEGFYQLGEV

SEQ ID NO: 1239742 - protein, 17 aa, Mycobacterium
ESVRLAFIAALQHLSPR

SEQ ID NO: 1239743 - protein, 19 aa, Mycobacterium
ESVTGRYLFDSAPTATRTP

SEQ ID NO: 1239744 - protein, 18 aa, Mycobacterium
ESVTHSMVLYCTDVDGVV

SEQ ID NO: 1239745 - protein, 17 aa, Mycobacterium
ESWGEPLDRVLNAVALL

SEQ ID NO: 1239746 - protein, 19 aa, Mycobacterium
ESYASRYGGAAVYPTTSAT

SEQ ID NO: 1239747 - protein, 27 aa, Mycobacterium
ESYDLSSLRYIMWCATPVTKSVADDVT

SEQ ID NO: 1239748 - protein, 17 aa, Mycobacterium
ESYLRIDAILDAAHASG

SEQ ID NO: 1239749 - protein, 18 aa, Mycobacterium
ETAFGEIMDLAVGLGGTI

SEQ ID NO: 1239750 - protein, 18 aa, Mycobacterium
ETAGEIFDAAPYGWPVAK

SEQ ID NO: 1239751 - protein, 26 aa, Mycobacterium
ETDRINFRIALWAAHNMGMSDGAGSG

SEQ ID NO: 1239752 - protein, 23 aa, Mycobacterium
ETEVLRHVAKGLTAKQIAARLSL

SEQ ID NO: 1239753 - protein, 20 aa, Mycobacterium
ETFLLGVRGAEYGDLEVYSV

SEQ ID NO: 1239754 - protein, 25 aa, Mycobacterium
ETGLPFSRVRVLRRLGRQPMTVKQV

SEQ ID NO: 1239755 - protein, 18 aa, Mycobacterium
ETGVRLRVLSGVDESRLT

SEQ ID NO: 1239756 - protein, 23 aa, Mycobacterium
ETHEIRWPRNAKLLDVLLDKGLD

SEQ ID NO: 1239757 - protein, 23 aa, Mycobacterium
ETITEARCGIGYLHTGIEKNLEY

SEQ ID NO: 1239758 - protein, 25 aa, Mycobacterium
ETLDALCGVGGWQPRGALGNIPVRF

SEQ ID NO: 1239759 - protein, 28 aa, Mycobacterium
ETLFDALLPRYVSTRIFAAMLEAAASES

SEQ ID NO: 1239760 - protein, 17 aa, Mycobacterium
ETLLPLFDDDIDRAITL

SEQ ID NO: 1239761 - protein, 18 aa, Mycobacterium
ETLMLRLGYQRYGAQGGD

SEQ ID NO: 1239762 - protein, 22 aa, Mycobacterium
ETLPRNEIVAGMAEVVKAGFIA

SEQ ID NO: 1239763 - protein, 25 aa, Mycobacterium
ETMVKAYAGFRSFREGTNLKAWLYR

SEQ ID NO: 1239764 - protein, 19 aa, Mycobacterium
ETPLGRWWRDMKLARVGGG

SEQ ID NO: 1239765 - protein, 17 aa, Mycobacterium
ETSRAPVGVVIGGGLLG

SEQ ID NO: 1239766 - protein, 22 aa, Mycobacterium
ETTAGLLRRMRAIFEQSPIAGR

SEQ ID NO: 1239767 - protein, 24 aa, Mycobacterium
ETTAPFSAFVFKVQAGMDSAHRDR

SEQ ID NO: 1239768 - protein, 21 aa, Mycobacterium
ETTTRLIGWAAKVLAEHPDQR

SEQ ID NO: 1239769 - protein, 24 aa, Mycobacterium
ETTVRLMLIAARFPRPETQIVVRD

SEQ ID NO: 1239770 - protein, 18 aa, Mycobacterium
ETVRRLREKFPTLQDPPS

SEQ ID NO: 1239771 - protein, 23 aa, Mycobacterium
ETYLRAWKSYKGFQGKSSVRTWL

SEQ ID NO: 1239772 - protein, 17 aa, Mycobacterium
EVAAELQTLSARLGGLD

SEQ ID NO: 1239773 - protein, 25 aa, Mycobacterium
EVAEPRKEWTLQFTIGAAPRSSSVV

SEQ ID NO: 1239774 - protein, 19 aa, Mycobacterium
EVAERAGAIALQTRQRIVG

SEQ ID NO: 1239775 - protein, 26 aa, Mycobacterium
EVAPARLTVDLLRPVAMAPVHTRSTV

SEQ ID NO: 1239776 - protein, 19 aa, Mycobacterium
EVARDLVVALARAGVTATC

SEQ ID NO: 1239777 - protein, 27 aa, Mycobacterium
EVARYLFRRVVSWGRSSNVFLRNGARL

SEQ ID NO: 1239778 - protein, 17 aa, Mycobacterium
EVCRLVKQRFVRGDSHF

SEQ ID NO: 1239779 - protein, 18 aa, Mycobacterium
EVCSRSIARYKVPKVFLR

SEQ ID NO: 1239780 - protein, 24 aa, Mycobacterium
EVDGGWRLDGTKVWTSGAHVADQV

SEQ ID NO: 1239781 - protein, 22 aa, Mycobacterium
EVDRRPGDVLAEIQTLVDQGVL

SEQ ID NO: 1239782 - protein, 27 aa, Mycobacterium
EVDRVFAGKVWGAWHLSEAAVDLQLDF

SEQ ID NO: 1239783 - protein, 18 aa, Mycobacterium
EVDYGTWTGRKIGDLVKE

SEQ ID NO: 1239784 - protein, 25 aa, Mycobacterium
EVEGGKIRVAEGWAHGPQVDKGARW

SEQ ID NO: 1239785 - protein, 22 aa, Mycobacterium
EVEMRPRNVVVLGPGSIPKTSS

SEQ ID NO: 1239786 - protein, 18 aa, Mycobacterium
EVESGRILLAGRVEAQTG

SEQ ID NO: 1239787 - protein, 24 aa, Mycobacterium
EVGGDFYDLFALAPGRSAFFLGDS

SEQ ID NO: 1239788 - protein, 24 aa, Mycobacterium
EVGRAVADPANWRRWWPDLRLTVV

SEQ ID NO: 1239789 - protein, 28 aa, Mycobacterium
EVGSRLTTALARHGIVLSLQFETDDDRN

SEQ ID NO: 1239790 - protein, 19 aa, Mycobacterium
EVHIGRHAIAGFYKNTDGV

SEQ ID NO: 1239791 - protein, 18 aa, Mycobacterium
EVHPCAKIAKAADRADFV

SEQ ID NO: 1239792 - protein, 32 aa, Mycobacterium
EVHVRIASPPVRWPCFYGIDFATPAELIANGA

SEQ ID NO: 1239793 - protein, 23 aa, Mycobacterium
EVIPDVLRHRLVLTYDALADEVS

SEQ ID NO: 1239794 - protein, 20 aa, Mycobacterium
EVIRARMAFEADPTGFADRH

SEQ ID NO: 1239795 - protein, 21 aa, Mycobacterium
EVKDECLDYALAHDERFGIWG

SEQ ID NO: 1239796 - protein, 20 aa, Mycobacterium
EVKVGLNGFIIARDTEKEAR

SEQ ID NO: 1239797 - protein, 21 aa, Mycobacterium
EVLARGTAWLDTGTFDSLLDA

SEQ ID NO: 1239798 - protein, 23 aa, Mycobacterium
EVLARNAFDAGAWYSARNGGPEQ

SEQ ID NO: 1239799 - protein, 20 aa, Mycobacterium
EVLASYGLDGEDAFYAALEF

SEQ ID NO: 1239800 - protein, 24 aa, Mycobacterium
EVLENRYGLVPGRADERIEAVNAT

SEQ ID NO: 1239801 - protein, 18 aa, Mycobacterium
EVLFCPDQFLGAHVRRVT

SEQ ID NO: 1239802 - protein, 25 aa, Mycobacterium
EVLKGPPPTWGRPMWEHDLADGLRI

SEQ ID NO: 1239803 - protein, 18 aa, Mycobacterium
EVLLWKRERRELSESEQD

SEQ ID NO: 1239804 - protein, 23 aa, Mycobacterium
EVLPNYSGGLGILAGDHLKSASD

SEQ ID NO: 1239805 - protein, 20 aa, Mycobacterium
EVLREVPVAEFARRCGVSED

SEQ ID NO: 1239806 - protein, 20 aa, Mycobacterium
EVLRRAAAYLSQANLPGKGS

SEQ ID NO: 1239807 - protein, 17 aa, Mycobacterium
EVLRRLYRRAGDRLVLI

SEQ ID NO: 1239808 - protein, 18 aa, Mycobacterium
EVLRYAFDRGITHFDLAN

SEQ ID NO: 1239809 - protein, 22 aa, Mycobacterium
EVLSECMHIFGGSGYLTDETPL

SEQ ID NO: 1239810 - protein, 18 aa, Mycobacterium
EVLSRLGTAGARGAARDA

SEQ ID NO: 1239811 - protein, 28 aa, Mycobacterium
EVLTKPRWLWDFGKTFSPPDLRVPNQAR

SEQ ID NO: 1239812 - protein, 18 aa, Mycobacterium
EVMLAELFGPARALLTRG

SEQ ID NO: 1239813 - protein, 22 aa, Mycobacterium
EVPDPPGPHLLVLARGPEGYRR

SEQ ID NO: 1239814 - protein, 18 aa, Mycobacterium
EVPEILSYLEEWTAPTKV

SEQ ID NO: 1239815 - protein, 26 aa, Mycobacterium
EVPGAMARLGVWSGRGPQLDLHQPTF

SEQ ID NO: 1239816 - protein, 19 aa, Mycobacterium
EVPTAPILDLAGKTAVITG

SEQ ID NO: 1239817 - protein, 18 aa, Mycobacterium
EVPTHWYNLAAELGEPIP

SEQ ID NO: 1239818 - protein, 17 aa, Mycobacterium
EVQGHFTVPLAELRTTS

SEQ ID NO: 1239819 - protein, 34 aa, Mycobacterium
EVQRLIRFMPKVVICLVNGWAAGGGHSLHVTCDL

SEQ ID NO: 1239820 - protein, 18 aa, Mycobacterium
EVQVAYAIGKAAPVGLFV

SEQ ID NO: 1239821 - protein, 28 aa, Mycobacterium
EVQVGYGRLGHWFWGFEQQGVVPDIVSM

SEQ ID NO: 1239822 - protein, 17 aa, Mycobacterium
EVRAVPAAAQASVLVLP

SEQ ID NO: 1239823 - protein, 24 aa, Mycobacterium
EVRETMAQLGFRTVNEMVGQVGVL

SEQ ID NO: 1239824 - protein, 32 aa, Mycobacterium
EVRGDRFGVCGYCMGGRTALIVAGRVPERVAA

SEQ ID NO: 1239825 - protein, 20 aa, Mycobacterium
EVRGPTLFDGYLNRPDATAD

SEQ ID NO: 1239826 - protein, 18 aa, Mycobacterium
EVRHFGFDISEYDVTYAA

SEQ ID NO: 1239827 - protein, 25 aa, Mycobacterium
EVRRYILDCALRWMRDFHADGLRLD

SEQ ID NO: 1239828 - protein, 23 aa, Mycobacterium
EVRVPKDALWRAQTQRAVENFPI

SEQ ID NO: 1239829 - protein, 26 aa, Mycobacterium
EVRYPLCDDRRTLLWLANQRAVEYHP

SEQ ID NO: 1239830 - protein, 19 aa, Mycobacterium
EVSHRGMLVLVHQLADEGR

SEQ ID NO: 1239831 - protein, 17 aa, Mycobacterium
EVSRLVTTVARGDRNRH

SEQ ID NO: 1239832 - protein, 19 aa, Mycobacterium
EVTDIIPFNEFGDLDDIDF

SEQ ID NO: 1239833 - protein, 34 aa, Mycobacterium
EVTDRSWRGIGMIPQSGWRLSPAYRDFDAEYRFA

SEQ ID NO: 1239834 - protein, 28 aa, Mycobacterium
EVTEGVGFDKGFISAYFVTDFDSQEAVL

SEQ ID NO: 1239835 - protein, 20 aa, Mycobacterium
EVTGVPILFASSGEKLEDFD

SEQ ID NO: 1239836 - protein, 17 aa, Mycobacterium
EVTRKLDKMGWRSSDTA

SEQ ID NO: 1239837 - protein, 20 aa, Mycobacterium
EVVAAHLVNLMWNGLTHLEA

SEQ ID NO: 1239838 - protein, 17 aa, Mycobacterium
EVVARPKKIASLTKVSR

SEQ ID NO: 1239839 - protein, 19 aa, Mycobacterium
EVVEAALALPVTDLIADAE

SEQ ID NO: 1239840 - protein, 20 aa, Mycobacterium
EVYDYLRLLYARAGTPHCPV

SEQ ID NO: 1239841 - protein, 35 aa, Mycobacterium; identical to SEQ ID NO: 657146

SEQ ID NO: 1239842 - protein, 18 aa, Mycobacterium
EVYGNLYLTDKVGGQPFT

SEQ ID NO: 1239843 - protein, 18 aa, Mycobacterium
EVYRPRLRGPVPTEDDVV

SEQ ID NO: 1239844 - protein, 24 aa, Mycobacterium
EVYSPASPLGAALIDAKVGETRTY

SEQ ID NO: 1239845 - protein, 24 aa, Mycobacterium
EVYVLRPCIVVGPKAPALAEVMPW

SEQ ID NO: 1239846 - protein, 18 aa, Mycobacterium
EWAAESFGDLEEDVRQSI

SEQ ID NO: 1239847 - protein, 26 aa, Mycobacterium
EWAPNPRLVVGMSLGGLTALRIAATE

SEQ ID NO: 1239848 - protein, 32 aa, Mycobacterium
EWDGKRKAYRPDWCTVREVEARIKASAPQAIE

SEQ ID NO: 1239849 - protein, 18 aa, Mycobacterium
EWEAFLGKDEDLYAFESV

SEQ ID NO: 1239850 - protein, 19 aa, Mycobacterium
EWGGLGLDLTQDVELAMEF

SEQ ID NO: 1239851 - protein, 17 aa, Mycobacterium
EWIELAAVQAGRRGLPI

SEQ ID NO: 1239852 - protein, 24 aa, Mycobacterium
EWKSEADGGFSRVRRRIWELEKRR

SEQ ID NO: 1239853 - protein, 25 aa, Mycobacterium
EWMLDIRLRALRTFDKKPMPNWGSN

SEQ ID NO: 1239854 - protein, 24 aa, Mycobacterium
EWMNRPHLVEAWEYPWPPQRWRRH

SEQ ID NO: 1239855 - protein, 27 aa, Mycobacterium
EWPENPRFLMCTPLSHAGAAFFTPVIV

SEQ ID NO: 1239856 - protein, 25 aa, Mycobacterium
EWTQHWRIATLLGVPEHDLLAVRDW

SEQ ID NO: 1239857 - protein, 29 aa, Mycobacterium
EYAEAGIAFNCLWPETYIATSAVANIGAD

SEQ ID NO: 1239858 - protein, 18 aa, Mycobacterium
EYAKLAVAIVENAMLNGQ

SEQ ID NO: 1239859 - protein, 30 aa, Mycobacterium
EYDIWAYIGAEGITLPGIYYAHTRPVFQRD

SEQ ID NO: 1239860 - protein, 18 aa, Mycobacterium
EYFSQAWAVRKERLQAQG

SEQ ID NO: 1239861 - protein, 20 aa, Mycobacterium
EYGLNMPIAREVDSVINHGS

SEQ ID NO: 1239862 - protein, 21 aa, Mycobacterium
EYHAGAIAHVVRMLRAQEDGW

SEQ ID NO: 1239863 - protein, 23 aa, Mycobacterium
EYKELKSLVKREGLHTVCEEAGC

SEQ ID NO: 1239864 - protein, 19 aa, Mycobacterium
EYLDGFGWTGRRDRDDAEL

SEQ ID NO: 1239865 - protein, 19 aa, Mycobacterium
EYLLLGLRFDRVEDGYVDS

SEQ ID NO: 1239866 - protein, 25 aa, Mycobacterium
EYLPPFAPTAFRWQSEHATHNRIMN

SEQ ID NO: 1239867 - protein, 25 aa, Mycobacterium
EYLQAGSIYPAMENFYLAARAQGLG

SEQ ID NO: 1239868 - protein, 21 aa, Mycobacterium
EYNVAEGWVRVEVPTAKDRHG

SEQ ID NO: 1239869 - protein, 17 aa, Mycobacterium
EYQRIREILGRRPTDAE

SEQ ID NO: 1239870 - protein, 33 aa, Mycobacterium
EYRLIKELWAFGDDRIAVRFAYEFHDDAGRWFR

SEQ ID NO: 1239871 - protein, 30 aa, Mycobacterium
EYVGFDIPNEFVVGYGLDYAERYRDLPYIG

SEQ ID NO: 1239872 - protein, 19 aa, Mycobacterium
EYYHVPSLHSQQVPSAVRQ

SEQ ID NO: 1239873 - protein, 17 aa, Mycobacterium
FAADYGLLLARTDWDVP

SEQ ID NO: 1239874 - protein, 23 aa, Mycobacterium
FAAGEITLALNTLFDLALSPVIG

SEQ ID NO: 1239875 - protein, 17 aa, Mycobacterium
FAAKGARVAVADLNEPG

SEQ ID NO: 1239876 - protein, 22 aa, Mycobacterium
FAALRLTPYRLRVMPGTVMTQG

SEQ ID NO: 1239877 - protein, 18 aa, Mycobacterium
FAAMCVATVKMLDIDPAK

SEQ ID NO: 1239878 - protein, 17 aa, Mycobacterium
FAAMRFVSAEVRLTGLD

SEQ ID NO: 1239879 - protein, 26 aa, Mycobacterium
FAANMMNRIPLKRWAGPEEVAGAFVF

SEQ ID NO: 1239880 - protein, 25 aa, Mycobacterium
FAAPVGDPGWFGPKSAVWHVHSHME

SEQ ID NO: 1239881 - protein, 21 aa, Mycobacterium
FAAQVPACLNLEIDPHTVHPL

SEQ ID NO: 1239882 - protein, 29 aa, Mycobacterium
FAARPALTRPSLGIAEWIVPSLISAAGQE

SEQ ID NO: 1239883 - protein, 25 aa, Mycobacterium
FAAVDKPLRRYRAARDEWLAARRDL

SEQ ID NO: 1239884 - protein, 32 aa, Mycobacterium; identical to SEQ ID NO: 79584

SEQ ID NO: 1239885 - protein, 18 aa, Mycobacterium
FAAWRNDPSFVLNLPPFD

SEQ ID NO: 1239886 - protein, 18 aa, Mycobacterium
FADEDFAKTSWDLRNFLW

SEQ ID NO: 1239887 - protein, 24 aa, Mycobacterium
FADVLPRAGVEVMISIDDGSGSPE

SEQ ID NO: 1239888 - protein, 17 aa, Mycobacterium
FAEKLGHGLHVGAERGR

SEQ ID NO: 1239889 - protein, 24 aa, Mycobacterium
FAEPAELAAAVAFLASDDASFITG

SEQ ID NO: 1239890 - protein, 23 aa, Mycobacterium
FAERGISYGQAFSGLVAAHTRDD

SEQ ID NO: 1239891 - protein, 17 aa, Mycobacterium
FAETGAIKAKAVIIAAG

SEQ ID NO: 1239892 - protein, 27 aa, Mycobacterium
FAEVFTSDFFALWGKFAATRTPTIAAV

SEQ ID NO: 1239893 - protein, 21 aa, Mycobacterium
FAGICFPKEYGGLGLPIAYQR

SEQ ID NO: 1239894 - protein, 26 aa, Mycobacterium
FAGPVLRPAATLVRRGGQYAEASAES

SEQ ID NO: 1239895 - protein, 17 aa, Mycobacterium
FAGRGAAEFSRRRTAGD

SEQ ID NO: 1239896 - protein, 17 aa, Mycobacterium
FAGRLPDGWFAGDPTVV

SEQ ID NO: 1239897 - protein, 17 aa, Mycobacterium
FAGRPAVDPVWIDGEFA

SEQ ID NO: 1239898 - protein, 22 aa, Mycobacterium
FAHGLLRDHLIAGIPPLRRQRL

SEQ ID NO: 1239899 - protein, 17 aa, Mycobacterium
FAHPGYVREQWAELEPL

SEQ ID NO: 1239900 - protein, 22 aa, Mycobacterium
FAIAQTRLGGGRIHHAMRTIGL

SEQ ID NO: 1239901 - protein, 21 aa, Mycobacterium
FAIELGRLGGLGVLNGEGLIG

SEQ ID NO: 1239902 - protein, 22 aa, Mycobacterium
FAIGAARARPAAPVVLITGDGA

SEQ ID NO: 1239903 - protein, 24 aa, Mycobacterium
FAKAWYKLMHRDMGPISRYLGPWV

SEQ ID NO: 1239904 - protein, 27 aa, Mycobacterium
FALADAKLEWKDIQFGFGGSYEVSNPD

SEQ ID NO: 1239905 - protein, 22 aa, Mycobacterium
FALDVMRRYVLSLPDGRVEDVV

SEQ ID NO: 1239906 - protein, 26 aa, Mycobacterium
FALGHLRGAVNIGLAGRYAEFAGSVL

SEQ ID NO: 1239907 - protein, 17 aa, Mycobacterium
FALGYSHPVVIEPPEGI

SEQ ID NO: 1239908 - protein, 17 aa, Mycobacterium
FALLEFLGATSRPGVEV

SEQ ID NO: 1239909 - protein, 17 aa, Mycobacterium
FALNGGEPVDCQGYRRF

SEQ ID NO: 1239910 - protein, 17 aa, Mycobacterium
FAMACRTMGIKGRVYIP

SEQ ID NO: 1239911 - protein, 20 aa, Mycobacterium
FAMLARRRMDLYGATLEDFA

SEQ ID NO: 1239912 - protein, 17 aa, Mycobacterium
FAMRLGGDTDLRRLQAA

SEQ ID NO: 1239913 - protein, 18 aa, Mycobacterium
FAPELHIEGGMGLDAVVD

SEQ ID NO: 1239914 - protein, 26 aa, Mycobacterium
FAPGLPQWNLRGSFTTGPDGAFRIRT

SEQ ID NO: 1239915 - protein, 21 aa, Mycobacterium
FAPVYRPPWDSFPRSEPYVVV

SEQ ID NO: 1239916 - protein, 25 aa, Mycobacterium
FARELAGFPRPILHGLCTYGVAGRA

SEQ ID NO: 1239917 - protein, 19 aa, Mycobacterium
FARGVPIPSAVTARPQVLK

SEQ ID NO: 1239918 - protein, 26 aa, Mycobacterium
FARQALRLFDDLRLEHGRLDQPIPVG

SEQ ID NO: 1239919 - protein, 20 aa, Mycobacterium
FARRGIRSHVLPARATFEQI

SEQ ID NO: 1239920 - protein, 27 aa, Mycobacterium
FARRLQTWLQRRVVIDGEMLARTVSIG

SEQ ID NO: 1239921 - protein, 18 aa, Mycobacterium
FARSCARALAHARREREQ

SEQ ID NO: 1239922 - protein, 18 aa, Mycobacterium
FASAESFAEHTPAAVEIL

SEQ ID NO: 1239923 - protein, 17 aa, Mycobacterium
FASFAAWAEAGGTALYP

SEQ ID NO: 1239924 - protein, 18 aa, Mycobacterium
FASKQELLDAFGRYERAM

SEQ ID NO: 1239925 - protein, 18 aa, Mycobacterium
FASQLGFGVAPRVRTAMT

SEQ ID NO: 1239926 - protein, 25 aa, Mycobacterium
FATARAAVVLVPINFMLTAEEISYL

SEQ ID NO: 1239927 - protein, 17 aa, Mycobacterium
FATFASVLCQAESTEYT

SEQ ID NO: 1239928 - protein, 17 aa, Mycobacterium
FATLVLASVARRDGQVV

SEQ ID NO: 1239929 - protein, 23 aa, Mycobacterium
FATRLAADRVNLILVARRTERLE

SEQ ID NO: 1239930 - protein, 17 aa, Mycobacterium
FAVASGLVHLYAEDRVG

SEQ ID NO: 1239931 - protein, 17 aa, Mycobacterium
FAVCDRLGIKPKELDLF

SEQ ID NO: 1239932 - protein, 29 aa, Mycobacterium
FAVGDRVGVAWLRHTCGRCRFCERGQENL

SEQ ID NO: 1239933 - protein, 19 aa, Mycobacterium
FAVLHGDYRLDNMLFDPDR

SEQ ID NO: 1239934 - protein, 20 aa, Mycobacterium
FAVNPLEWVPVPPGRLVLQT

SEQ ID NO: 1239935 - protein, 19 aa, Mycobacterium
FAVPAAMGAKMGRPDTEVW

SEQ ID NO: 1239936 - protein, 25 aa, Mycobacterium
FAVTLPFTGLIDYRLEVGYDHGGDQ

SEQ ID NO: 1239937 - protein, 17 aa, Mycobacterium
FAYGLLRCGTQEMCDQN

SEQ ID NO: 1239938 - protein, 23 aa, Mycobacterium
FAYQFPQFVDRLILVGAGGVTKD

SEQ ID NO: 1239939 - protein, 17 aa, Mycobacterium
FCAGFDLSAYAEGSSSA

SEQ ID NO: 1239940 - protein, 17 aa, Mycobacterium
FCEVLDVGSAHFVGNSM

SEQ ID NO: 1239941 - protein, 23 aa, Mycobacterium
FCGQRRDGLCNVFVPHATAGVAL

SEQ ID NO: 1239942 - protein, 20 aa, Mycobacterium
FCPDQFLGAHVRRVTGRTNM

SEQ ID NO: 1239943 - protein, 19 aa, Mycobacterium
FCRVTPDLMRFVAEQCRDR

SEQ ID NO: 1239944 - protein, 19 aa, Mycobacterium
FCSGMDLKAFAAGERVDIP

SEQ ID NO: 1239945 - protein, 18 aa, Mycobacterium
FDAAALLRQLNRAQVNTF

SEQ ID NO: 1239946 - protein, 18 aa, Mycobacterium
FDACIDYRSADLAAALKE

SEQ ID NO: 1239947 - protein, 20 aa, Mycobacterium
FDALCAHLATMHPSRYLSLI

SEQ ID NO: 1239948 - protein, 20 aa, Mycobacterium
FDALGRWLLGRTADLSAGRE

SEQ ID NO: 1239949 - protein, 18 aa, Mycobacterium
FDAVELHLGHLYLPSSFL

SEQ ID NO: 1239950 - protein, 20 aa, Mycobacterium
FDAVIAVHLKGHFATMKHAA

SEQ ID NO: 1239951 - protein, 19 aa, Mycobacterium
FDDARPVLERASARETAAR

SEQ ID NO: 1239952 - protein, 24 aa, Mycobacterium
FDDEWPLLNFLKFTGVDTQKRPQG

SEQ ID NO: 1239953 - protein, 20 aa, Mycobacterium
FDEGWLRTGDVGKIDAEGYL

SEQ ID NO: 1239954 - protein, 20 aa, Mycobacterium
FDENYSWVMSPRWFDGNDHL

SEQ ID NO: 1239955 - protein, 25 aa, Mycobacterium
FDFITDFGALIPMRTIGYLLGIPEQ

SEQ ID NO: 1239956 - protein, 19 aa, Mycobacterium
FDFVREIIEQGAIPDDVTI

SEQ ID NO: 1239957 - protein, 19 aa, Mycobacterium
FDGAWPYLRALAAAAGDTD

SEQ ID NO: 1239958 - protein, 24 aa, Mycobacterium
FDGGEEVRTDLTLAAFGNTRSYGG

SEQ ID NO: 1239959 - protein, 27 aa, Mycobacterium
FDGGTSYRPGARFGPMGVRQAARTLRP

SEQ ID NO: 1239960 - protein, 17 aa, Mycobacterium
FDGHLRPGGVISGTREM

SEQ ID NO: 1239961 - protein, 18 aa, Mycobacterium
FDGLSAVARVERLPVQQL

SEQ ID NO: 1239962 - protein, 30 aa, Mycobacterium; identical to SEQ ID NO: 658240

SEQ ID NO: 1239963 - protein, 23 aa, Mycobacterium
FDGTDTVMLVWLGQRRIAGIESG

SEQ ID NO: 1239964 - protein, 24 aa, Mycobacterium
FDGYRFEIAGSLQFPTSATVSREL

SEQ ID NO: 1239965 - protein, 19 aa, Mycobacterium
FDISQTLRSYGWQVPAYTM

SEQ ID NO: 1239966 - protein, 18 aa, Mycobacterium
FDLATGLRARRGRGALAA

SEQ ID NO: 1239967 - protein, 21 aa, Mycobacterium
FDLGELVARLHALLRRAHHSD

SEQ ID NO: 1239968 - protein, 22 aa, Mycobacterium
FDLLMLVAPVLRKLALNDAKAG

SEQ ID NO: 1239969 - protein, 19 aa, Mycobacterium
FDLPAALQRASDVLIKTRT

SEQ ID NO: 1239970 - protein, 23 aa, Mycobacterium
FDLRRRATMYLTYWTAGDTRNRG

SEQ ID NO: 1239971 - protein, 22 aa, Mycobacterium
FDLVHRLWLDAGHRVHYVQNIT

SEQ ID NO: 1239972 - protein, 17 aa, Mycobacterium
FDPEATLALVDEHKATG

SEQ ID NO: 1239973 - protein, 20 aa, Mycobacterium
FDPEVSALSWTVYSAPATPP

SEQ ID NO: 1239974 - protein, 20 aa, Mycobacterium
FDPNNRPAFTAFRDDVKPIE

SEQ ID NO: 1239975 - protein, 23 aa, Mycobacterium
FDPTRAMPAYNWMTVAKSALESV

SEQ ID NO: 1239976 - protein, 23 aa, Mycobacterium
FDQGENFAFLGGRDWDPSQVTLP

SEQ ID NO: 1239977 - protein, 18 aa, Mycobacterium
FDRCQRRAPVQAEAAAQT

SEQ ID NO: 1239978 - protein, 23 aa, Mycobacterium
FDRSAGLQRLRLLETSYGVGVSV

SEQ ID NO: 1239979 - protein, 28 aa, Mycobacterium
FDSAVTYRPGARFGPNAIRQGSRLIRGY

SEQ ID NO: 1239980 - protein, 27 aa, Mycobacterium
FDSGVSYRPGARFGPAHIRASSKLLRT

SEQ ID NO: 1239981 - protein, 24 aa, Mycobacterium
FDSIERILGCGVRDNCDPELCRYD

SEQ ID NO: 1239982 - protein, 27 aa, Mycobacterium
FDTIGRWRPSLSGARDAYVYYPGTADV

SEQ ID NO: 1239983 - protein, 18 aa, Mycobacterium
FDTSILLTRFLEGSWQYR

SEQ ID NO: 1239984 - protein, 19 aa, Mycobacterium
FDVDVAQAYALLVKLAKQQ

SEQ ID NO: 1239985 - protein, 18 aa, Mycobacterium
FDVPAGGVVAVIGSNGAG

SEQ ID NO: 1239986 - protein, 25 aa, Mycobacterium
FDVPIDLRLAEGFRRDVVEQLRTIG

SEQ ID NO: 1239987 - protein, 31 aa, Mycobacterium
FDWNHDWARRICAHLPLPRLVWPSDVVGTVT

SEQ ID NO: 1239988 - protein, 24 aa, Mycobacterium
FDWSCRRFERDGAMMPADGLETLS

SEQ ID NO: 1239989 - protein, 17 aa, Mycobacterium
FDYDLNLTPSFPLLDPT

SEQ ID NO: 1239990 - protein, 20 aa, Mycobacterium
FDYLLMSLRSLPLVMVIGQP

SEQ ID NO: 1239991 - protein, 17 aa, Mycobacterium
FDYRQGDALGFINGRFT

SEQ ID NO: 1239992 - protein, 23 aa, Mycobacterium
FEDAGRCQRGYFVESLGGAQFAV

SEQ ID NO: 1239993 - protein, 22 aa, Mycobacterium
FEDRGFYSWCLHELVEAAAHLG

SEQ ID NO: 1239994 - protein, 27 aa, Mycobacterium
FEEASLRGAPLIAVHAWADHSMSAADL

SEQ ID NO: 1239995 - protein, 17 aa, Mycobacterium
FEERSALVSQARLRSDL

SEQ ID NO: 1239996 - protein, 27 aa, Mycobacterium
FEFGFDPRGGFGFGPGPRGRRGGGRGR

SEQ ID NO: 1239997 - protein, 27 aa, Mycobacterium
FEGELAIVIGRPCKDVPAARAAENILG

SEQ ID NO: 1239998 - protein, 18 aa, Mycobacterium
FEGFPTPAEFVAAIEGAI

SEQ ID NO: 1239999 - protein, 18 aa, Mycobacterium
FEGVEHMPLLDGLGLSLN

SEQ ID NO: 1240000 - protein, 20 aa, Mycobacterium
FEHPYPFARRLSTLDHLTGG

SEQ ID NO: 1240001 - protein, 24 aa, Mycobacterium
FEIKEFKSGAARMAIAAQVPIVPH

SEQ ID NO: 1240002 - protein, 25 aa, Mycobacterium
FEIPVPDVEAAFVLKMLARTVRDSE

SEQ ID NO: 1240003 - protein, 20 aa, Mycobacterium
FEKGRSWPRERTRAKLEEVL

SEQ ID NO: 1240004 - protein, 18 aa, Mycobacterium
FELLRFMMRNSKRVLSKA

SEQ ID NO: 1240005 - protein, 20 aa, Mycobacterium
FEMFGRFPLTDNDPGATARV

SEQ ID NO: 1240006 - protein, 21 aa, Mycobacterium
FEMFPGVWRHGDWITITDHGS

SEQ ID NO: 1240007 - protein, 25 aa, Mycobacterium
FENSLCLNCGSALGFSLDDMALLVI

SEQ ID NO: 1240008 - protein, 18 aa, Mycobacterium
FEPIPPMTPIVIPGVGES

SEQ ID NO: 1240009 - protein, 19 aa, Mycobacterium
FEPNPKWSRLFSTGAEIKQ

SEQ ID NO: 1240010 - protein, 19 aa, Mycobacterium
FEPPAPHVARYVTRDIEIH

SEQ ID NO: 1240011 - protein, 23 aa, Mycobacterium
FEQMRPGALAAVWDDRPSSTGKF

SEQ ID NO: 1240012 - protein, 22 aa, Mycobacterium
FEQPSPQPGVHWSKDVRMDKIA

SEQ ID NO: 1240013 - protein, 26 aa, Mycobacterium
FEQTFMFFLPRICEHCLNPSCMASCP

SEQ ID NO: 1240014 - protein, 17 aa, Mycobacterium
FERAARDGIDWRDLGAR

SEQ ID NO: 1240015 - protein, 23 aa, Mycobacterium
FEREVDALIGPDVVRSWERDLPS

SEQ ID NO: 1240016 - protein, 23 aa, Mycobacterium
FESVAALPGRFEVAVNCAGITAL

SEQ ID NO: 1240017 - protein, 26 aa, Mycobacterium
FEVASGRRWSHVRLSMYPDGGVARLR

SEQ ID NO: 1240018 - protein, 20 aa, Mycobacterium
FEVFCDTPLEDCERRDPKGL

SEQ ID NO: 1240019 - protein, 22 aa, Mycobacterium
FEVNEAFAPVPLAWLADTGAAE

SEQ ID NO: 1240020 - protein, 21 aa, Mycobacterium
FEYVDPVFMFPGYNPDAPTRE

SEQ ID NO: 1240021 - protein, 23 aa, Mycobacterium
FFDAWRRHGWRAPAQSGPDSATW

SEQ ID NO: 1240022 - protein, 25 aa, Mycobacterium
FFGHSMGGLLAFDIARRLERDGDCP

SEQ ID NO: 1240023 - protein, 29 aa, Mycobacterium
FFLHIPFPPVELFMQMPWRTEIIEGLLGA

SEQ ID NO: 1240024 - protein, 21 aa, Mycobacterium
FFPDPWPKARHHKRRLLQPST

SEQ ID NO: 1240025 - protein, 22 aa, Mycobacterium
FFTTDRFDGHLSVLLRGKDIGQ

SEQ ID NO: 1240026 - protein, 19 aa, Mycobacterium
FFVVLPRDHRFAAAVEVPF

SEQ ID NO: 1240027 - protein, 30 aa, Mycobacterium
FGAAEYGLRIARTVCLAGAFMAPDPLSGEP

SEQ ID NO: 1240028 - protein, 22 aa, Mycobacterium
FGACLDRELGRFVDEVRSKIDF

SEQ ID NO: 1240029 - protein, 19 aa, Mycobacterium
FGADALRFTLARGASPGGD

SEQ ID NO: 1240030 - protein, 24 aa, Mycobacterium
FGADHPVPWDWFVADYDRIRDAIA

SEQ ID NO: 1240031 - protein, 17 aa, Mycobacterium
FGAILDRGAGHFRLGPY

SEQ ID NO: 1240032 - protein, 17 aa, Mycobacterium
FGCADRTELEQWVRRLD

SEQ ID NO: 1240033 - protein, 18 aa, Mycobacterium
FGDKGYWLVTKHADVKDV

SEQ ID NO: 1240034 - protein, 17 aa, Mycobacterium
FGDKVLRTVIPRSVKVS

SEQ ID NO: 1240035 - protein, 18 aa, Mycobacterium
FGDPDLRALGQLGRGQAL

SEQ ID NO: 1240036 - protein, 17 aa, Mycobacterium
FGDRTVLDDISLSVGAG

SEQ ID NO: 1240037 - protein, 21 aa, Mycobacterium
FGDRYTAWLPKLKEIVPSLGT

SEQ ID NO: 1240038 - protein, 20 aa, Mycobacterium
FGDTVAIPLMRRAMADPEVT

SEQ ID NO: 1240039 - protein, 18 aa, Mycobacterium
FGEAIPAQAIAQVCELTW

SEQ ID NO: 1240040 - protein, 27 aa, Mycobacterium
FGEAVKLGDRIAVLGPRSKLLQYDTPQ

SEQ ID NO: 1240041 - protein, 18 aa, Mycobacterium
FGEFKGWAKAQGKHSNIG

SEQ ID NO: 1240042 - protein, 23 aa, Mycobacterium
FGEGHLALLRRLMMDDNWYRGEL

SEQ ID NO: 1240043 - protein, 24 aa, Mycobacterium
FGELTQLAGVFGFVESVELLSHYV

SEQ ID NO: 1240044 - protein, 24 aa, Mycobacterium
FGEPAEQALRAWLTSGRPALATAE

SEQ ID NO: 1240045 - protein, 18 aa, Mycobacterium
FGEPRAREFYVDWQDVAE

SEQ ID NO: 1240046 - protein, 23 aa, Mycobacterium
FGEQKAKIFLALLGKQYGVTPQG

SEQ ID NO: 1240047 - protein, 26 aa, Mycobacterium
FGEQVTRPRAILVISAHWYINATAVT

SEQ ID NO: 1240048 - protein, 18 aa, Mycobacterium
FGETLPFLVKVLAADEPL

SEQ ID NO: 1240049 - protein, 17 aa, Mycobacterium
FGFAPAGVHCERADLRS

SEQ ID NO: 1240050 - protein, 31 aa, Mycobacterium; identical to SEQ ID NO: 199120

SEQ ID NO: 1240051 - protein, 31 aa, Mycobacterium; identical to SEQ ID NO: 79705

SEQ ID NO: 1240052 - protein, 17 aa, Mycobacterium
FGFSTAIGIGGDPVIGT

SEQ ID NO: 1240053 - protein, 18 aa, Mycobacterium
FGGEVERGLSMVDGVLLL

SEQ ID NO: 1240054 - protein, 22 aa, Mycobacterium
FGHERYDAFFAMAHRVLPDDGV

SEQ ID NO: 1240055 - protein, 17 aa, Mycobacterium
FGHGLGHGVGLQIHEAP

SEQ ID NO: 1240056 - protein, 26 aa, Mycobacterium
FGIETLPLVTGWSMGAGQTYQWAVSY

SEQ ID NO: 1240057 - protein, 18 aa, Mycobacterium
FGIEYPIFVFTPSEKVAA

SEQ ID NO: 1240058 - protein, 24 aa, Mycobacterium
FGIPEVKRGLVAAGGGLLRLPRRI

SEQ ID NO: 1240059 - protein, 18 aa, Mycobacterium
FGIVKGLMTTVHAYTQDQ

SEQ ID NO: 1240060 - protein, 27 aa, Mycobacterium
FGKNTYHGLSLLRHVEELVKTGWPVLM

SEQ ID NO: 1240061 - protein, 17 aa, Mycobacterium
FGLDGVEHTGGPMVDLD

SEQ ID NO: 1240062 - protein, 25 aa, Mycobacterium
FGLEGAGPMYGHPGNIVGFSGLAAH

SEQ ID NO: 1240063 - protein, 20 aa, Mycobacterium
FGLETMCVGGGQGMAMIIER

SEQ ID NO: 1240064 - protein, 18 aa, Mycobacterium
FGLGCVAGAAGVARLHDH

SEQ ID NO: 1240065 - protein, 23 aa, Mycobacterium
FGMLLRLGADPTFVLSAGGFHPR

SEQ ID NO: 1240066 - protein, 28 aa, Mycobacterium
FGNGLWMSLRVARRLERLHIGARIVDLR

SEQ ID NO: 1240067 - protein, 17 aa, Mycobacterium
FGPAGALAFADDLPEAE

SEQ ID NO: 1240068 - protein, 17 aa, Mycobacterium
FGPAHIRASSKLLRTYH

SEQ ID NO: 1240069 - protein, 18 aa, Mycobacterium
FGPERVIRAATLPDAIET

SEQ ID NO: 1240070 - protein, 19 aa, Mycobacterium
FGPETGKRYLVDFPSPVSY

SEQ ID NO: 1240071 - protein, 19 aa, Mycobacterium
FGPGTRGEHTAQDWAEIIG

SEQ ID NO: 1240072 - protein, 19 aa, Mycobacterium
FGPIGELWYRKSGTYRGKI

SEQ ID NO: 1240073 - protein, 17 aa, Mycobacterium
FGPVLAVEGLDLSVTPG

SEQ ID NO: 1240074 - protein, 18 aa, Mycobacterium
FGPVLAVIPFRDEDDAVR

SEQ ID NO: 1240075 - protein, 17 aa, Mycobacterium
FGPVLVVIPFRDDDDAV

SEQ ID NO: 1240076 - protein, 28 aa, Mycobacterium
FGRAEVRNFLVANALYWLQEFHVDGLRV

SEQ ID NO: 1240077 - protein, 26 aa, Mycobacterium
FGRELFIDKVWDWKRESGGTIGAQMR

SEQ ID NO: 1240078 - protein, 18 aa, Mycobacterium
FGRGRFNGGGGGFGGFGG

SEQ ID NO: 1240079 - protein, 19 aa, Mycobacterium
FGRHVMKHVDEIGGVPVVM

SEQ ID NO: 1240080 - protein, 20 aa, Mycobacterium
FGRIDGRPVGIVANQPTQFA

SEQ ID NO: 1240081 - protein, 20 aa, Mycobacterium
FGRIRLKFGGGVAGHNGLKS

SEQ ID NO: 1240082 - protein, 26 aa, Mycobacterium
FGRKVSRLMEWVAMVGCPIIGINDSG

SEQ ID NO: 1240083 - protein, 25 aa, Mycobacterium
FGRPLPNNACRVVAADGADCPDWVP

SEQ ID NO: 1240084 - protein, 19 aa, Mycobacterium
FGSFLIPRSEYRIDDVWNV

SEQ ID NO: 1240085 - protein, 24 aa, Mycobacterium
FGSKMQRFFVRNALVARLVSEAAF

SEQ ID NO: 1240086 - protein, 17 aa, Mycobacterium
FGSMVMSLLGFDDQVAT

SEQ ID NO: 1240087 - protein, 19 aa, Mycobacterium
FGSPEFLEELAVFRDAVVQ

SEQ ID NO: 1240088 - protein, 26 aa, Mycobacterium
FGSTQRFGVPMGFGGPHAGYLAVHTK

SEQ ID NO: 1240089 - protein, 21 aa, Mycobacterium
FGVAAPRGLLVPVIADAQDMT

SEQ ID NO: 1240090 - protein, 17 aa, Mycobacterium
FGVGHGDAVAFLDKNHP

SEQ ID NO: 1240091 - protein, 23 aa, Mycobacterium
FGVQWQLVRRLVTIVEFSFAARC

SEQ ID NO: 1240092 - protein, 20 aa, Mycobacterium
FGVRISIAVLRAGVKDSVAL

SEQ ID NO: 1240093 - protein, 18 aa, Mycobacterium
FGVVAREVAALGVNIDTI

SEQ ID NO: 1240094 - protein, 20 aa, Mycobacterium
FGYACPLGSHARRLNPRDTA

SEQ ID NO: 1240095 - protein, 25 aa, Mycobacterium
FGYRVSRYELDLEYKVAINRLSGSA

SEQ ID NO: 1240096 - protein, 19 aa, Mycobacterium
FHAMYPRIDEWIAVRRRVD

SEQ ID NO: 1240097 - protein, 27 aa, Mycobacterium
FHAQPVCCPHCGPTLTFRDADGRHTAG

SEQ ID NO: 1240098 - protein, 17 aa, Mycobacterium
FHAWSAPGLTPPIVLGL

SEQ ID NO: 1240099 - protein, 18 aa, Mycobacterium
FHCWAEAELPELLDRALP

SEQ ID NO: 1240100 - protein, 26 aa, Mycobacterium
FHIVKRRYSGFIGTEFDIVLRGLNAS

SEQ ID NO: 1240101 - protein, 34 aa, Mycobacterium
FHLRNRLVVAALHWDGDIGGLVRSHFKATLKHLA

SEQ ID NO: 1240102 - protein, 19 aa, Mycobacterium
FHNARRTSEGLAHQRGANP

SEQ ID NO: 1240103 - protein, 17 aa, Mycobacterium
FHPELFAAGISICGMSD

SEQ ID NO: 1240104 - protein, 17 aa, Mycobacterium
FHPLARELPELVCRLNH

SEQ ID NO: 1240105 - protein, 17 aa, Mycobacterium
FHQPAAVLIDLATLETL

SEQ ID NO: 1240106 - protein, 18 aa, Mycobacterium
FHTAPGVTERGWAPIVRF

SEQ ID NO: 1240107 - protein, 25 aa, Mycobacterium
FHTFGYKAGLIASFIRGATMVPVPV

SEQ ID NO: 1240108 - protein, 18 aa, Mycobacterium
FHVARLALSPLRPEERRT

SEQ ID NO: 1240109 - protein, 17 aa, Mycobacterium
FHVKGDPAASVTIQDIA

SEQ ID NO: 1240110 - protein, 21 aa, Mycobacterium
FIAGIEFARGVPIPSAVTARP

SEQ ID NO: 1240111 - protein, 18 aa, Mycobacterium
FIAKEIFPGGSVPCDEDV

SEQ ID NO: 1240112 - protein, 25 aa, Mycobacterium
FIDEMPRLPTGKLYKRKLRDPYWKE

SEQ ID NO: 1240113 - protein, 18 aa, Mycobacterium
FIDLPYRPGHEAVGVVDA

SEQ ID NO: 1240114 - protein, 18 aa, Mycobacterium
FIDTERWQGVPFYLRTGK

SEQ ID NO: 1240115 - protein, 18 aa, Mycobacterium
FIGINGGPQFPFTEAVSF

SEQ ID NO: 1240116 - protein, 25 aa, Mycobacterium
FILAGPDLRDVSGWMLDRPPHHLET

SEQ ID NO: 1240117 - protein, 17 aa, Mycobacterium
FILALFVDLRGKPCAKL

SEQ ID NO: 1240118 - protein, 20 aa, Mycobacterium
FILIGCQRCPVTATESSVEA

SEQ ID NO: 1240119 - protein, 18 aa, Mycobacterium
FIMDEIFPGGDLPQARAV

SEQ ID NO: 1240120 - protein, 19 aa, Mycobacterium
FIMDEIYPGGRLPLASMVK

SEQ ID NO: 1240121 - protein, 27 aa, Mycobacterium
FIPACGQCQPCLKGYRSLCDRGALLLG

SEQ ID NO: 1240122 - protein, 24 aa, Mycobacterium
FIQREVVARTGLRDCRTHGRTWDL

SEQ ID NO: 1240123 - protein, 25 aa, Mycobacterium
FIRIGPFKEVMNWDEYVEFLTNWAK

SEQ ID NO: 1240124 - protein, 18 aa, Mycobacterium
FIRQFPFNVLLKDLDRRI

SEQ ID NO: 1240125 - protein, 20 aa, Mycobacterium
FIRQVAGKFALLVVADLLGV

SEQ ID NO: 1240126 - protein, 17 aa, Mycobacterium
FKAAQDVFFSARNAATA

SEQ ID NO: 1240127 - protein, 17 aa, Mycobacterium
FKAHVKIGLNNGLTEDE

SEQ ID NO: 1240128 - protein, 27 aa, Mycobacterium
FKALYGSSLVTGWARLHGYPIGILANA

SEQ ID NO: 1240129 - protein, 22 aa, Mycobacterium
FKATLKHLACLEYSTVEIQNKA

SEQ ID NO: 1240130 - protein, 19 aa, Mycobacterium
FKAVRAPGARRDKYSIPAN

SEQ ID NO: 1240131 - protein, 19 aa, Mycobacterium
FKDVNCLAFAPTRDNPFSG

SEQ ID NO: 1240132 - protein, 19 aa, Mycobacterium
FKGDERWRNLPTPSGDTFE

SEQ ID NO: 1240133 - protein, 21 aa, Mycobacterium
FKGGLRFHPSVYLGIIKFLGF

SEQ ID NO: 1240134 - protein, 20 aa, Mycobacterium
FKGIGDTGSDIFLREVQDTW

SEQ ID NO: 1240135 - protein, 23 aa, Mycobacterium
FKHGSEPGALVIGWNSGHAAVTL

SEQ ID NO: 1240136 - protein, 26 aa, Mycobacterium
FKKSDEIYTFMDLWFYHCNPRHHSIA

SEQ ID NO: 1240137 - protein, 25 aa, Mycobacterium
FKKSMRALFDAGWDKAGMPEELGGM

SEQ ID NO: 1240138 - protein, 20 aa, Mycobacterium
FKLGGLKAGTAVSERVRGRW

SEQ ID NO: 1240139 - protein, 28 aa, Mycobacterium
FKLPPGFPEELMASFTRCFDLIFEEAHE

SEQ ID NO: 1240140 - protein, 19 aa, Mycobacterium
FKPGTPVVSFPLVRAAGGI

SEQ ID NO: 1240141 - protein, 18 aa, Mycobacterium
FKPMPRYEQGAVFHPEAP

SEQ ID NO: 1240142 - protein, 21 aa, Mycobacterium
FKPTLVVSVPRVFEKVYNTAE

SEQ ID NO: 1240143 - protein, 20 aa, Mycobacterium
FKRSTDWDVIAARTDLLVCF

SEQ ID NO: 1240144 - protein, 21 aa, Mycobacterium
FKTPQAYLQDVFRIDGVSRVI

SEQ ID NO: 1240145 - protein, 18 aa, Mycobacterium
FKTPRSVEFLDVLPRNPG

SEQ ID NO: 1240146 - protein, 25 aa, Mycobacterium
FLADMPGYRGWQWAVVVAAYPGAEQ

SEQ ID NO: 1240147 - protein, 33 aa, Mycobacterium
FLAESGFMRAIRAELVVPLVVFLASRACESTHR

SEQ ID NO: 1240148 - protein, 20 aa, Mycobacterium
FLDDRLNHWAHTTPDAEAVV

SEQ ID NO: 1240149 - protein, 17 aa, Mycobacterium
FLDDVAGFDAEFFGISE

SEQ ID NO: 1240150 - protein, 17 aa, Mycobacterium
FLDGAAPLASGSYADAT

SEQ ID NO: 1240151 - protein, 19 aa, Mycobacterium
FLDGLAWRLREQGIAATSV

SEQ ID NO: 1240152 - protein, 21 aa, Mycobacterium
FLDKRGPGLQQFAYRVSDLDG

SEQ ID NO: 1240153 - protein, 25 aa, Mycobacterium
FLDVYRVVSNLGVFDFNGPDHQMRA

SEQ ID NO: 1240154 - protein, 19 aa, Mycobacterium
FLEGCGRTDFPGGNVDDMF

SEQ ID NO: 1240155 - protein, 32 aa, Mycobacterium
FLEHPRPGWVGQRLPYQQARVVHRDPDDGRPL

SEQ ID NO: 1240156 - protein, 18 aa, Mycobacterium
FLELAAIRTKAVRQGDPL

SEQ ID NO: 1240157 - protein, 29 aa, Mycobacterium
FLENLSPWFEFVWKPGYADYYPELPGGSE

SEQ ID NO: 1240158 - protein, 20 aa, Mycobacterium
FLERAAHYFRAHGITTIEQV

SEQ ID NO: 1240159 - protein, 17 aa, Mycobacterium
FLGGRDWDPSQVTLPKH

SEQ ID NO: 1240160 - protein, 20 aa, Mycobacterium
FLGILPFLLGEHAARPPVLA

SEQ ID NO: 1240161 - protein, 17 aa, Mycobacterium
FLGNLVLLIVGGNDTTR

SEQ ID NO: 1240162 - protein, 17 aa, Mycobacterium
FLGRNGRISVFGSERAL

SEQ ID NO: 1240163 - protein, 22 aa, Mycobacterium
FLGSISRVYCTLSDGTVLSAQL

SEQ ID NO: 1240164 - protein, 18 aa, Mycobacterium
FLGTEAIDMADAHDKWSG

SEQ ID NO: 1240165 - protein, 20 aa, Mycobacterium
FLGTRHFTESMLPRMRPGSS

SEQ ID NO: 1240166 - protein, 19 aa, Mycobacterium
FLLIAAALAEGWAVSVPDH

SEQ ID NO: 1240167 - protein, 17 aa, Mycobacterium
FLLQGGDCAETFVDNTE

SEQ ID NO: 1240168 - protein, 24 aa, Mycobacterium
FLMSVGDLVIGWLLQQQAAVAIGA

SEQ ID NO: 1240169 - protein, 18 aa, Mycobacterium
FLPKIVEVTELWCQGYSE

SEQ ID NO: 1240170 - protein, 17 aa, Mycobacterium
FLPLRYGQVTVQEKMPR

SEQ ID NO: 1240171 - protein, 26 aa, Mycobacterium
FLPPDVLDWPLNVVVVRSGDRTILVD

SEQ ID NO: 1240172 - protein, 17 aa, Mycobacterium
FLPSSIGRVVMKHAGVD

SEQ ID NO: 1240173 - protein, 18 aa, Mycobacterium
FLPTLGEMDLHLFSEGRH

SEQ ID NO: 1240174 - protein, 22 aa, Mycobacterium
FLPTRLTVDLFKAARGVPTTTK

SEQ ID NO: 1240175 - protein, 18 aa, Mycobacterium
FLQKYGKATPEALVESAL

SEQ ID NO: 1240176 - protein, 21 aa, Mycobacterium
FLQRPARWIQQIAINPGSFTA

SEQ ID NO: 1240177 - protein, 21 aa, Mycobacterium
FLRAADLARAITFVAETPRGG

SEQ ID NO: 1240178 - protein, 19 aa, Mycobacterium
FLRALEEGKLLGARTGKDG

SEQ ID NO: 1240179 - protein, 17 aa, Mycobacterium
FLRGPMRGPVSPPNNTG

SEQ ID NO: 1240180 - protein, 23 aa, Mycobacterium
FLRLEADWEAGYLLTVRSAWQAD

SEQ ID NO: 1240181 - protein, 22 aa, Mycobacterium
FLSDIRRYGATYMNYVGKPLAY

SEQ ID NO: 1240182 - protein, 22 aa, Mycobacterium
FLTERASTCLLYSEPGAGSDLA

SEQ ID NO: 1240183 - protein, 26 aa, Mycobacterium
FLTPDGRPFFCGTYYPKPNFLQLLAA

SEQ ID NO: 1240184 - protein, 24 aa, Mycobacterium
FLYYPSENHWVLAPQHAKLWYQVV

SEQ ID NO: 1240185 - protein, 27 aa, Mycobacterium
FMEVAKLRAGRLLWSELVAEFDPKNEK

SEQ ID NO: 1240186 - protein, 19 aa, Mycobacterium
FMEVFARYSGTLLAADDAP

SEQ ID NO: 1240187 - protein, 18 aa, Mycobacterium
FMHTSICSTVFLRRTALP

SEQ ID NO: 1240188 - protein, 19 aa, Mycobacterium
FMHVLPVGWVEPIDISNAV

SEQ ID NO: 1240189 - protein, 22 aa, Mycobacterium
FMLASFPPLIAMRAQLGDELVR

SEQ ID NO: 1240190 - protein, 18 aa, Mycobacterium
FMMRNSKRVLSKAQILDR

SEQ ID NO: 1240191 - protein, 18 aa, Mycobacterium
FMRPFRADEWLLYDQSSP

SEQ ID NO: 1240192 - protein, 17 aa, Mycobacterium
FMTTGWFTGLVPVTVSV

SEQ ID NO: 1240193 - protein, 18 aa, Mycobacterium
FNAFAEAAAEAFTELSGA

SEQ ID NO: 1240194 - protein, 17 aa, Mycobacterium
FNATRFALMNGAAPAPL

SEQ ID NO: 1240195 - protein, 17 aa, Mycobacterium
FNDSWMSSYGFLRNRLD

SEQ ID NO: 1240196 - protein, 24 aa, Mycobacterium
FNEELIKAGVLLAGEGLTGPEEGF

SEQ ID NO: 1240197 - protein, 21 aa, Mycobacterium
FNEPLPALTSFVLPGGTPLSA

SEQ ID NO: 1240198 - protein, 17 aa, Mycobacterium
FNEVFFTDARVPAENLV

SEQ ID NO: 1240199 - protein, 17 aa, Mycobacterium
FNFRLDMSIDGAGNSVY

SEQ ID NO: 1240200 - protein, 32 aa, Mycobacterium
FNHASGRIKLAWFLLHVARYLPPLLYATDPSW

SEQ ID NO: 1240201 - protein, 30 aa, Mycobacterium
FNIDSRGRFPGRWRMALLENLSRKCNRIRM

SEQ ID NO: 1240202 - protein, 19 aa, Mycobacterium
FNIGRAVAVQLGYDFMPGT

SEQ ID NO: 1240203 - protein, 18 aa, Mycobacterium
FNLSALRFAMGGGSPVPL

SEQ ID NO: 1240204 - protein, 24 aa, Mycobacterium
FNMRERLREGGHEVVGFDPRPEVT

SEQ ID NO: 1240205 - protein, 37 aa, Mycobacterium
FNRIPQPWLREPAKRWIRLRLSRGLGLEAGGGRPVLA

SEQ ID NO: 1240206 - protein, 19 aa, Mycobacterium
FNSEKGFGFIAPDGGSDDV

SEQ ID NO: 1240207 - protein, 17 aa, Mycobacterium
FNSLFLDPYLWKLQLGG

SEQ ID NO: 1240208 - protein, 18 aa, Mycobacterium
FNSLRHWTSLAATVEKAG

SEQ ID NO: 1240209 - protein, 27 aa, Mycobacterium
FNTALWPITWAPLFDRVMAPTVTGSVF

SEQ ID NO: 1240210 - protein, 17 aa, Mycobacterium
FNVPLVFVVDTPGFLPG

SEQ ID NO: 1240211 - protein, 20 aa, Mycobacterium
FNVTGWKIGWACGAADLIAG

SEQ ID NO: 1240212 - protein, 21 aa, Mycobacterium
FPAPNKYVAPIAFNVVPLAGS

SEQ ID NO: 1240213 - protein, 23 aa, Mycobacterium
FPDAYKAIWDFSGQKATSRHIPG

SEQ ID NO: 1240214 - protein, 23 aa, Mycobacterium
FPDHGELSLAGWTKKVTGLPVIA

SEQ ID NO: 1240215 - protein, 23 aa, Mycobacterium
FPEELGKMGFVFNFITYGGHQVD

SEQ ID NO: 1240216 - protein, 23 aa, Mycobacterium
FPEELKGAAPRIWYEDGAYMVGM

SEQ ID NO: 1240217 - protein, 26 aa, Mycobacterium
FPEWNPEIKGCWILARYDDGRPSQLR

SEQ ID NO: 1240218 - protein, 17 aa, Mycobacterium
FPGDFIVEYIGQTRGWF

SEQ ID NO: 1240219 - protein, 25 aa, Mycobacterium
FPGEISGGMRKRAGLARSLVLDPQI

SEQ ID NO: 1240220 - protein, 28 aa, Mycobacterium
FPGGIHAVWFTETWGRYNAALDRNAPHE

SEQ ID NO: 1240221 - protein, 18 aa, Mycobacterium
FPGGVLGVALNLDEHSIG

SEQ ID NO: 1240222 - protein, 18 aa, Mycobacterium
FPGIDIELSKVLHASEAV

SEQ ID NO: 1240223 - protein, 17 aa, Mycobacterium
FPGLSQFRGRWYHTGRW

SEQ ID NO: 1240224 - protein, 20 aa, Mycobacterium
FPGLVGEAVRGTFRVRRRTH

SEQ ID NO: 1240225 - protein, 21 aa, Mycobacterium
FPLKGKPPNVYGFALNKARAK

SEQ ID NO: 1240226 - protein, 17 aa, Mycobacterium
FPLMPRIFMAVRRESRF

SEQ ID NO: 1240227 - protein, 23 aa, Mycobacterium
FPLRRGLVWRRRVSELGEGELLR

SEQ ID NO: 1240228 - protein, 22 aa, Mycobacterium
FPLTAWAVRAMTRLPQRSVVTV

SEQ ID NO: 1240229 - protein, 18 aa, Mycobacterium
FPLTNRWWERPYVAAGIF

SEQ ID NO: 1240230 - protein, 17 aa, Mycobacterium
FPNEEWMTFKPQADEVL

SEQ ID NO: 1240231 - protein, 17 aa, Mycobacterium
FPPNAKARMDELVANLR

SEQ ID NO: 1240232 - protein, 20 aa, Mycobacterium
FPPQLVSAIGRQLRTKVLFG

SEQ ID NO: 1240233 - protein, 25 aa, Mycobacterium
FPQLHDVRFDYRWAGAIDTNTRFCA

SEQ ID NO: 1240234 - protein, 18 aa, Mycobacterium
FPQLRGRCLANYTSDPVF

SEQ ID NO: 1240235 - protein, 20 aa, Mycobacterium
FPQSFCYATIGGFAATRSSG

SEQ ID NO: 1240236 - protein, 19 aa, Mycobacterium
FPREAPRSLAEFLGTVNQL

SEQ ID NO: 1240237 - protein, 26 aa, Mycobacterium
FPRQLIEHLGRTGVFTQKWGDGQQPD

SEQ ID NO: 1240238 - protein, 23 aa, Mycobacterium
FPSAREYSVRYGLSDKRQALLPD

SEQ ID NO: 1240239 - protein, 17 aa, Mycobacterium
FPTDRGWSLRELFTGSR

SEQ ID NO: 1240240 - protein, 17 aa, Mycobacterium
FPTIERWPAESVRHHRQ

SEQ ID NO: 1240241 - protein, 17 aa, Mycobacterium
FPTMPFAALGYDVVHCG

SEQ ID NO: 1240242 - protein, 18 aa, Mycobacterium
FPVNLVVLPAAAAFAAGN

SEQ ID NO: 1240243 - protein, 17 aa, Mycobacterium
FQAAFPLKGKPPNVYGF

SEQ ID NO: 1240244 - protein, 22 aa, Mycobacterium
FQADLMAGVSVRVLDITLLAIT

SEQ ID NO: 1240245 - protein, 17 aa, Mycobacterium
FQDYARSLFPWITVAKN

SEQ ID NO: 1240246 - protein, 26 aa, Mycobacterium
FQELMPDVLHWFGIRKIHRLVSMSNM

SEQ ID NO: 1240247 - protein, 17 aa, Mycobacterium
FQGDLRFLIGPNGAGKT

SEQ ID NO: 1240248 - protein, 17 aa, Mycobacterium
FQGDQLPGYGWVFPMGD

SEQ ID NO: 1240249 - protein, 17 aa, Mycobacterium
FQHPGTEFIYMLEGVMD

SEQ ID NO: 1240250 - protein, 20 aa, Mycobacterium
FQLGSLWYISLDYINHQTSL

SEQ ID NO: 1240251 - protein, 20 aa, Mycobacterium
FQLLVLCMLASKPIDATVAM

SEQ ID NO: 1240252 - protein, 18 aa, Mycobacterium
FQNIRLFGEMTALENVMV

SEQ ID NO: 1240253 - protein, 18 aa, Mycobacterium
FQRYWPADLHMIGKDIIR

SEQ ID NO: 1240254 - protein, 22 aa, Mycobacterium
FQVHSLHGYFLRPGDARAPSVY

SEQ ID NO: 1240255 - protein, 17 aa, Mycobacterium
FQYCPTCQTGGRVLADR

SEQ ID NO: 1240256 - protein, 18 aa, Mycobacterium
FRAILELFLHTDVRPTLE

SEQ ID NO: 1240257 - protein, 19 aa, Mycobacterium
FRAQQRFRDPAADEPQAPP

SEQ ID NO: 1240258 - protein, 21 aa, Mycobacterium
FRDDGHRVVIAGARREDLEIN

SEQ ID NO: 1240259 - protein, 22 aa, Mycobacterium
FRFFAAPGTWTLRALSKVGNGD

SEQ ID NO: 1240260 - protein, 17 aa, Mycobacterium
FRGAEMIAEKWDISREE

SEQ ID NO: 1240261 - protein, 17 aa, Mycobacterium
FRGMVDMAKGLSALWHD

SEQ ID NO: 1240262 - protein, 22 aa, Mycobacterium
FRGRGYATAAARAMIDKAKTAT

SEQ ID NO: 1240263 - protein, 18 aa, Mycobacterium
FRGSLEMHPQYVLENGVD

SEQ ID NO: 1240264 - protein, 17 aa, Mycobacterium
FRGSRKASIDRLSVEDA

SEQ ID NO: 1240265 - protein, 19 aa, Mycobacterium
FRHLIPALADRFHVIAPDH

SEQ ID NO: 1240266 - protein, 17 aa, Mycobacterium
FRLGIGTSGPQVMEGFH

SEQ ID NO: 1240267 - protein, 25 aa, Mycobacterium
FRLGITTDWKSRWYADKQYKDYVKE

SEQ ID NO: 1240268 - protein, 17 aa, Mycobacterium
FRLGLGTQVRTHVVRRY

SEQ ID NO: 1240269 - protein, 19 aa, Mycobacterium
FRLIDKVFSQWGISYTAVA

SEQ ID NO: 1240270 - protein, 23 aa, Mycobacterium
FRLVGSPIRIAGYRPDYRPPPQL

SEQ ID NO: 1240271 - protein, 22 aa, Mycobacterium
FRPAPQEHRARVASAVRALNDP

SEQ ID NO: 1240272 - protein, 25 aa, Mycobacterium
FRPGTLERWDLGYDVLRERNKGIIL

SEQ ID NO: 1240273 - protein, 29 aa, Mycobacterium
FRPKVWPPVRRIDGAYGDRNLMCSCPPVE

SEQ ID NO: 1240274 - protein, 18 aa, Mycobacterium
FRQFSFPGGIPSHVASET

SEQ ID NO: 1240275 - protein, 20 aa, Mycobacterium
FRRAFSWLPAQFASQSNAPV

SEQ ID NO: 1240276 - protein, 17 aa, Mycobacterium
FRRARDSAPSLVFLDEI

SEQ ID NO: 1240277 - protein, 17 aa, Mycobacterium
FRRRAVELARLREKPIA

SEQ ID NO: 1240278 - protein, 17 aa, Mycobacterium
FRRRGVGPDASMLLMFN

SEQ ID NO: 1240279 - protein, 21 aa, Mycobacterium
FRRTEVPPILLTSARTAATAR

SEQ ID NO: 1240280 - protein, 30 aa, Mycobacterium
FRRYVGVPVKWVLCRYRLQQAALEIESTPD

SEQ ID NO: 1240281 - protein, 26 aa, Mycobacterium
FRSDILPISVGFPFGVSAVVPINLPL

SEQ ID NO: 1240282 - protein, 21 aa, Mycobacterium
FRSEKATNWEGAFRIPELIRW

SEQ ID NO: 1240283 - protein, 21 aa, Mycobacterium
FRTWHYWWQAHLLDCLVDAQL

SEQ ID NO: 1240284 - protein, 24 aa, Mycobacterium
FRVDAVPFLFARDGVPGDPGVFDP

SEQ ID NO: 1240285 - protein, 19 aa, Mycobacterium
FSAKFASAVAKNPFVGDPI

SEQ ID NO: 1240286 - protein, 22 aa, Mycobacterium
FSDFQGRLRAPAAMVAEHLRVF

SEQ ID NO: 1240287 - protein, 19 aa, Mycobacterium
FSDGSLIVGIGSPPRTPDV

SEQ ID NO: 1240288 - protein, 18 aa, Mycobacterium
FSDQRYWLARLADSGADH

SEQ ID NO: 1240289 - protein, 17 aa, Mycobacterium
FSDTRPAARRFYNTDAE

SEQ ID NO: 1240290 - protein, 19 aa, Mycobacterium
FSGAIWYPMVYDMPARAKE

SEQ ID NO: 1240291 - protein, 24 aa, Mycobacterium
FSGGYDFGGGFAHWDESMNSDGRW

SEQ ID NO: 1240292 - protein, 24 aa, Mycobacterium
FSGREMKHKLSLRASNTSELHLDD

SEQ ID NO: 1240293 - protein, 19 aa, Mycobacterium
FSHGSLNVIARRAGVAKGS

SEQ ID NO: 1240294 - protein, 20 aa, Mycobacterium
FSHPQSQYFVVGRLAQDQVA

SEQ ID NO: 1240295 - protein, 22 aa, Mycobacterium
FSLEAPEGMRFLSRARAFTDAE

SEQ ID NO: 1240296 - protein, 19 aa, Mycobacterium
FSMVSRFVAEYEMGAEIAV

SEQ ID NO: 1240297 - protein, 19 aa, Mycobacterium
FSPCGAGLVVDEVDADLLA

SEQ ID NO: 1240298 - protein, 21 aa, Mycobacterium
FSPEALRVLVKIQDEVAEQVA

SEQ ID NO: 1240299 - protein, 19 aa, Mycobacterium
FSPQTSFAPTTEFASRNDT

SEQ ID NO: 1240300 - protein, 21 aa, Mycobacterium
FSQIETLVFMAFFERSHAVFT

SEQ ID NO: 1240301 - protein, 17 aa, Mycobacterium
FSRISDVLLPFLVTRQL

SEQ ID NO: 1240302 - protein, 18 aa, Mycobacterium
FSRTRLDEYSARSHELAA

SEQ ID NO: 1240303 - protein, 18 aa, Mycobacterium
FSSCGYLAGFPGQGAYAC

SEQ ID NO: 1240304 - protein, 24 aa, Mycobacterium
FSSKLELYLAVLQRHVDNMVSGVR

SEQ ID NO: 1240305 - protein, 25 aa, Mycobacterium
FSSLNSRMRVGAAIGEPLAVHKLVD

SEQ ID NO: 1240306 - protein, 18 aa, Mycobacterium
FSSMPLRSLVEALEPAPP

SEQ ID NO: 1240307 - protein, 19 aa, Mycobacterium
FSSNVWKVDVAVGERVAAG

SEQ ID NO: 1240308 - protein, 17 aa, Mycobacterium
FSTAIGIGGDPVIGTTH

SEQ ID NO: 1240309 - protein, 20 aa, Mycobacterium
FSVAEGELFSIVGPSGAGKT

SEQ ID NO: 1240310 - protein, 19 aa, Mycobacterium
FSVRLAAAGFLGLTIPTEY

SEQ ID NO: 1240311 - protein, 22 aa, Mycobacterium
FSVVTCRDIGTLGAEGIVDKIR

SEQ ID NO: 1240312 - protein, 23 aa, Mycobacterium
FTAEAVWEMPPFDGWYQGPHDIV

SEQ ID NO: 1240313 - protein, 22 aa, Mycobacterium
FTAEFLGDCITLPCTVTANVAD

SEQ ID NO: 1240314 - protein, 17 aa, Mycobacterium
FTALDWLEDRLAGQRYL

SEQ ID NO: 1240315 - protein, 27 aa, Mycobacterium
FTALPEVRSQLALTWGTETFIVPQIGT

SEQ ID NO: 1240316 - protein, 18 aa, Mycobacterium
FTASLVLVSPEVGLTVVP

SEQ ID NO: 1240317 - protein, 17 aa, Mycobacterium
FTAVVSLDLRRLDRLHW

SEQ ID NO: 1240318 - protein, 17 aa, Mycobacterium
FTDLEVFMQLLPRSSTA

SEQ ID NO: 1240319 - protein, 17 aa, Mycobacterium
FTEAVSFTVACKDQEEV

SEQ ID NO: 1240320 - protein, 21 aa, Mycobacterium
FTESMLPRMRPGSSIVSVSSL

SEQ ID NO: 1240321 - protein, 17 aa, Mycobacterium
FTFPVVHRDGHRLWVNA

SEQ ID NO: 1240322 - protein, 18 aa, Mycobacterium
FTGASAWGKHLFHHYRGG

SEQ ID NO: 1240323 - protein, 17 aa, Mycobacterium
FTGFVTWTADILAARGV

SEQ ID NO: 1240324 - protein, 25 aa, Mycobacterium
FTGQVWPGDLLSFGGRVTGVREAGG

SEQ ID NO: 1240325 - protein, 19 aa, Mycobacterium
FTGTRSVLLTTMLGEQVTD

SEQ ID NO: 1240326 - protein, 22 aa, Mycobacterium
FTGVPCIVDLATMREAVGDLGG

SEQ ID NO: 1240327 - protein, 17 aa, Mycobacterium
FTHIAVPVMTRLRQPER

SEQ ID NO: 1240328 - protein, 25 aa, Mycobacterium
FTHWPDPWVLVGALAQVTSRLKFVT

SEQ ID NO: 1240329 - protein, 22 aa, Mycobacterium
FTLEWPRGSGTLREFPEIDRVA

SEQ ID NO: 1240330 - protein, 19 aa, Mycobacterium
FTLQVGRPVGPMLAQTATG

SEQ ID NO: 1240331 - protein, 17 aa, Mycobacterium
FTLRTMLSFFVAPNPPS

SEQ ID NO: 1240332 - protein, 28 aa, Mycobacterium
FTNLLSNARTVFWNGPMGVFEFPAFAAG

SEQ ID NO: 1240333 - protein, 18 aa, Mycobacterium
FTPAMVVGVFDELARQRP

SEQ ID NO: 1240334 - protein, 19 aa, Mycobacterium
FTPKIGYPVRWKDYSQLVI

SEQ ID NO: 1240335 - protein, 30 aa, Mycobacterium; identical to SEQ ID NO: 199394

SEQ ID NO: 1240336 - protein, 18 aa, Mycobacterium
FTSLMAIYDTMQYVRADI

SEQ ID NO: 1240337 - protein, 18 aa, Mycobacterium
FTSLRPLLFTIAYEILGS

SEQ ID NO: 1240338 - protein, 20 aa, Mycobacterium
FTSSKVMCWVALDRGAKLAE

SEQ ID NO: 1240339 - protein, 23 aa, Mycobacterium
FTTAPAAFVHRLPGGYTDAELAP

SEQ ID NO: 1240340 - protein, 24 aa, Mycobacterium
FTVAEPGWTMFMISHFHYDPVWWN

SEQ ID NO: 1240341 - protein, 19 aa, Mycobacterium
FTVIGRRGSSAGLVRATIG

SEQ ID NO: 1240342 - protein, 17 aa, Mycobacterium
FTVLRPGQPAVTISTPG

SEQ ID NO: 1240343 - protein, 17 aa, Mycobacterium
FTVVHCRDIDRIGVDGV

SEQ ID NO: 1240344 - protein, 30 aa, Mycobacterium
FTWDLKRFAASVALMCWQKALSDGEITNLI

SEQ ID NO: 1240345 - protein, 17 aa, Mycobacterium
FVALPLLAGFDLDDPDP

SEQ ID NO: 1240346 - protein, 19 aa, Mycobacterium
FVDFHLGQVNVWRADLAAA

SEQ ID NO: 1240347 - protein, 24 aa, Mycobacterium
FVECQSRLLAAYAVGRYALPGRAE

SEQ ID NO: 1240348 - protein, 18 aa, Mycobacterium
FVEETGTTPMQWVTDQRV

SEQ ID NO: 1240349 - protein, 17 aa, Mycobacterium
FVERLVDCLAYEMKMDP

SEQ ID NO: 1240350 - protein, 24 aa, Mycobacterium
FVGELRAGLRAADCALFVIAANEG

SEQ ID NO: 1240351 - protein, 25 aa, Mycobacterium
FVIEPLEPGFGYTLGNSLRRTLLSS

SEQ ID NO: 1240352 - protein, 21 aa, Mycobacterium
FVIGASNRFAHAATLAIAEAP

SEQ ID NO: 1240353 - protein, 31 aa, Mycobacterium; identical to SEQ ID NO: 661799

SEQ ID NO: 1240354 - protein, 19 aa, Mycobacterium
FVKIFCRPATGVVIGGVVV

SEQ ID NO: 1240355 - protein, 23 aa, Mycobacterium
FVLTLRLLTLALRHQPALNATWI

SEQ ID NO: 1240356 - protein, 30 aa, Mycobacterium
FVPAERTFPLFARRPLRGDSPAARMGLMPV

SEQ ID NO: 1240357 - protein, 24 aa, Mycobacterium
FVPAFSGLFAPYWRSDARGAIVGL

SEQ ID NO: 1240358 - protein, 25 aa, Mycobacterium
FVPAIPDRVDVVWLDHEGGGAGSVS

SEQ ID NO: 1240359 - protein, 25 aa, Mycobacterium
FVPEYRLETLISLNIGTATGFGTHD

SEQ ID NO: 1240360 - protein, 21 aa, Mycobacterium
FVRFCDSFNVPLVFVVDTPGF

SEQ ID NO: 1240361 - protein, 25 aa, Mycobacterium
FVRRLWWRVTVDLPDDALLHTLIAV

SEQ ID NO: 1240362 - protein, 20 aa, Mycobacterium
FVRSPFARAKVNGIDASAAL

SEQ ID NO: 1240363 - protein, 18 aa, Mycobacterium
FVSVSCWGKLVTGVGASL

SEQ ID NO: 1240364 - protein, 18 aa, Mycobacterium
FVTAEVALILSLPDPKIL

SEQ ID NO: 1240365 - protein, 23 aa, Mycobacterium
FVTGEPRSGTTLMHALMSVDPDA

SEQ ID NO: 1240366 - protein, 25 aa, Mycobacterium
FVTYRHRLLLGWTHMQDGQLQAAAT

SEQ ID NO: 1240367 - protein, 17 aa, Mycobacterium
FVVKPMVFPGGTIGELA

SEQ ID NO: 1240368 - protein, 18 aa, Mycobacterium
FVVPVWRSMYEAMQPGGY

SEQ ID NO: 1240369 - protein, 18 aa, Mycobacterium
FVVSGRWPDSTKEWAQLL

SEQ ID NO: 1240370 - protein, 20 aa, Mycobacterium
FVVSSAHWRADDDMFGALGL

SEQ ID NO: 1240371 - protein, 25 aa, Mycobacterium
FVVVSELCRVCMGVVTGMGVSLGLT

SEQ ID NO: 1240372 - protein, 22 aa, Mycobacterium
FVWDAWTVGVQWWRRFGQERPL

SEQ ID NO: 1240373 - protein, 19 aa, Mycobacterium
FWADPDIFETTSYDFETIA

SEQ ID NO: 1240374 - protein, 23 aa, Mycobacterium
FWDACVKAGIPVSMHASDSGYAQ

SEQ ID NO: 1240375 - protein, 33 aa, Mycobacterium
FWDELRANEALDRVDIPILLFGGWQDLFLEQTL

SEQ ID NO: 1240376 - protein, 29 aa, Mycobacterium
FWFDPLCPWCWITSRWILEVEKVRDIDVN

SEQ ID NO: 1240377 - protein, 19 aa, Mycobacterium
FWGALWEYFDLGTAPAEVL

SEQ ID NO: 1240378 - protein, 17 aa, Mycobacterium
FYADLIFDRDIKVSARP

SEQ ID NO: 1240379 - protein, 23 aa, Mycobacterium
FYATPPIDGAFCRYVVIDDDFAH

SEQ ID NO: 1240380 - protein, 18 aa, Mycobacterium
FYAVSGWDAVTEAIARCD

SEQ ID NO: 1240381 - protein, 28 aa, Mycobacterium
FYFVGQRWEWSDEVARMHGYEPGAVTPT

SEQ ID NO: 1240382 - protein, 18 aa, Mycobacterium
FYLTGSINVPGVEDAFRL

SEQ ID NO: 1240383 - protein, 19 aa, Mycobacterium
FYNICRHRGNKLVWNDFPG

SEQ ID NO: 1240384 - protein, 20 aa, Mycobacterium
FYPKADLTLLQRAYEVAEER

SEQ ID NO: 1240385 - protein, 20 aa, Mycobacterium
FYRGVGLTIYEGYGLTETSA

SEQ ID NO: 1240386 - protein, 23 aa, Mycobacterium
GAAAADCLARAVMVGVLAAEGAA

SEQ ID NO: 1240387 - protein, 24 aa, Mycobacterium
GAAACGQGAALLSEMTTRDKLAQL

SEQ ID NO: 1240388 - protein, 20 aa, Mycobacterium
GAAAEAHWRKHLDTARALLL

SEQ ID NO: 1240389 - protein, 19 aa, Mycobacterium
GAAAPEHWLGGLAGDDLHA

SEQ ID NO: 1240390 - protein, 17 aa, Mycobacterium
GAAAVLISPAWKHAEVA

SEQ ID NO: 1240391 - protein, 20 aa, Mycobacterium
GAAAWRAVVEQATGTEDRTF

SEQ ID NO: 1240392 - protein, 21 aa, Mycobacterium
GAACWDARTWLGRPGLVDGAP

SEQ ID NO: 1240393 - protein, 22 aa, Mycobacterium
GAAEALALVAAVCPVAILSGRD

SEQ ID NO: 1240394 - protein, 27 aa, Mycobacterium
GAAEALRLVHRLVLPVGEMARQMFAGD

SEQ ID NO: 1240395 - protein, 17 aa, Mycobacterium
GAAFWPMLTPIMRSREY

SEQ ID NO: 1240396 - protein, 19 aa, Mycobacterium
GAAGFEAAVLVGGSADDAG

SEQ ID NO: 1240397 - protein, 33 aa, Mycobacterium
GAAGVCFPDLLLLRGEYQLKLEPPFIPGMEVAG

SEQ ID NO: 1240398 - protein, 25 aa, Mycobacterium
GAAHATELPYVWGNLVAGPRDPTFK

SEQ ID NO: 1240399 - protein, 18 aa, Mycobacterium
GAAHGGAVALLFDSVLGY

SEQ ID NO: 1240400 - protein, 24 aa, Mycobacterium
GAAKLGNAVGYVYAHDHPDGVVPQ

SEQ ID NO: 1240401 - protein, 19 aa, Mycobacterium
GAALARLEARIVIRQLLER

SEQ ID NO: 1240402 - protein, 23 aa, Mycobacterium
GAALGNGIGRYALDKAADYARNR

SEQ ID NO: 1240403 - protein, 20 aa, Mycobacterium
GAALRWSLVGAKSRVAVACG

SEQ ID NO: 1240404 - protein, 18 aa, Mycobacterium
GAAMVIDLLLKRAADLGV

SEQ ID NO: 1240405 - protein, 24 aa, Mycobacterium
GAAQFGTAGFRAWAAHARGAVHVQ

SEQ ID NO: 1240406 - protein, 24 aa, Mycobacterium
GAAQPKLAVIVSKFDALRVLRDVE

SEQ ID NO: 1240407 - protein, 27 aa, Mycobacterium
GAAQRAGLELLSFGGRFVEIGKRDIYG

SEQ ID NO: 1240408 - protein, 24 aa, Mycobacterium
GAARDAQFLLGMVVSTGVGGGLVL

SEQ ID NO: 1240409 - protein, 19 aa, Mycobacterium
GAARQAAWVLSGRDAPPDW

SEQ ID NO: 1240410 - protein, 24 aa, Mycobacterium
GAATMKRLFLELGGKSATIVLEDA

SEQ ID NO: 1240411 - protein, 21 aa, Mycobacterium
GAAVALRLGTGVLAVRKGGKL

SEQ ID NO: 1240412 - protein, 18 aa, Mycobacterium
GAAVRAGLGWGMYPEQLA

SEQ ID NO: 1240413 - protein, 20 aa, Mycobacterium
GACDSTLLIAERVQSYADVW

SEQ ID NO: 1240414 - protein, 21 aa, Mycobacterium
GACNPPLAHRAIGVDRQIGLL

SEQ ID NO: 1240415 - protein, 21 aa, Mycobacterium
GACPHDCPDTCAMLYHVEDGK

SEQ ID NO: 1240416 - protein, 20 aa, Mycobacterium
GACRAARTLFGFPVVQAVGS

SEQ ID NO: 1240417 - protein, 20 aa, Mycobacterium
GADAAYVCRGRVCDLPVTTQ

SEQ ID NO: 1240418 - protein, 18 aa, Mycobacterium
GADAVALDLARRVTSGSS

SEQ ID NO: 1240419 - protein, 20 aa, Mycobacterium
GADAWALQEVLALGVTAGAP

SEQ ID NO: 1240420 - protein, 18 aa, Mycobacterium
GADGALWFTEMGSGGIGR

SEQ ID NO: 1240421 - protein, 17 aa, Mycobacterium
GADGWELVAVLPGPTGE

SEQ ID NO: 1240422 - protein, 18 aa, Mycobacterium
GADIIAVDICRDIPSNPY

SEQ ID NO: 1240423 - protein, 22 aa, Mycobacterium
GADSLKGLCPFHDEKSPSFHVR

SEQ ID NO: 1240424 - protein, 24 aa, Mycobacterium
GADTRSQIMLGHWAPLSSAGLAVL

SEQ ID NO: 1240425 - protein, 27 aa, Mycobacterium
GADVLPWWPVRGVYLLLERGASTSTDL

SEQ ID NO: 1240426 - protein, 17 aa, Mycobacterium
GAEIHKRITSAIGPGAD

SEQ ID NO: 1240427 - protein, 25 aa, Mycobacterium
GAEMGRAALDLTLFRTRWLHHDLGL

SEQ ID NO: 1240428 - protein, 18 aa, Mycobacterium
GAEMLAEVARFWVSLASY

SEQ ID NO: 1240429 - protein, 20 aa, Mycobacterium
GAENQLRFSAPPRLDLSLLM

SEQ ID NO: 1240430 - protein, 26 aa, Mycobacterium
GAEPPRRLRMAVAYGSAAAALPGSAL

SEQ ID NO: 1240431 - protein, 18 aa, Mycobacterium
GAERKKLRDVLAVLRDAY

SEQ ID NO: 1240432 - protein, 25 aa, Mycobacterium
GAEYVYRFAPLVGIYGGTLEVFRNM

SEQ ID NO: 1240433 - protein, 27 aa, Mycobacterium
GAFEVNEAFAPVPMAWLKDIGADESKL

SEQ ID NO: 1240434 - protein, 32 aa, Mycobacterium
GAFLIGYAIANLRYFASLARSYAFQTSGPLIE

SEQ ID NO: 1240435 - protein, 17 aa, Mycobacterium
GAFQGSFSYLLQDEDGQ

SEQ ID NO: 1240436 - protein, 18 aa, Mycobacterium
GAFRRTLRLSRGHGIVGL

SEQ ID NO: 1240437 - protein, 19 aa, Mycobacterium
GAGGAGMRAAVEAGPRART

SEQ ID NO: 1240438 - protein, 25 aa, Mycobacterium
GAGISRPTFYFYFGSKEAVLLTLWE

SEQ ID NO: 1240439 - protein, 25 aa, Mycobacterium
GAGLARHAARLGMTVVLADVDGDAI

SEQ ID NO: 1240440 - protein, 18 aa, Mycobacterium
GAGPDGWGGPGFFGPLQK

SEQ ID NO: 1240441 - protein, 26 aa, Mycobacterium
GAGVILSMICDLRVVAPEAYFQFPVA

SEQ ID NO: 1240442 - protein, 17 aa, Mycobacterium
GAHLGPMGLEGAVRLGL

SEQ ID NO: 1240443 - protein, 17 aa, Mycobacterium
GAHLPAVAPHVFDEADP

SEQ ID NO: 1240444 - protein, 25 aa, Mycobacterium
GAHYCLGNALARIEGRIALEEILIR

SEQ ID NO: 1240445 - protein, 19 aa, Mycobacterium
GAILADWGADVIKVEHPVR

SEQ ID NO: 1240446 - protein, 25 aa, Mycobacterium
GAIRLPERVRWADAMELLLTGKPMT

SEQ ID NO: 1240447 - protein, 23 aa, Mycobacterium
GAIRSARVPAVFVDSSQPERLAH

SEQ ID NO: 1240448 - protein, 23 aa, Mycobacterium
GAITFAQGLSFVIGDTHREAVRR

SEQ ID NO: 1240449 - protein, 24 aa, Mycobacterium
GAKAPRLADTAMFARHSAEIVEVE

SEQ ID NO: 1240450 - protein, 26 aa, Mycobacterium
GAKIVCVRPAPVPGLVKPRSLGDPVH

SEQ ID NO: 1240451 - protein, 25 aa, Mycobacterium
GAKVICRRSRLMARIAGSGAMASVE

SEQ ID NO: 1240452 - protein, 23 aa, Mycobacterium
GALALLGANPFWVPAYPPLIANE

SEQ ID NO: 1240453 - protein, 21 aa, Mycobacterium
GALIRRHMLDYGLPVEACNPE

SEQ ID NO: 1240454 - protein, 21 aa, Mycobacterium
GALKLKELTYRWAEHYPAGEL

SEQ ID NO: 1240455 - protein, 20 aa, Mycobacterium
GALPKAEFLAFFVAAIKAAV

SEQ ID NO: 1240456 - protein, 19 aa, Mycobacterium
GALPLLAPMSEVAGRLSAQ

SEQ ID NO: 1240457 - protein, 22 aa, Mycobacterium
GALPRDFADLLSPGMVDELIAE

SEQ ID NO: 1240458 - protein, 22 aa, Mycobacterium
GALRWRPPEPAPAWDGERQATR

SEQ ID NO: 1240459 - protein, 19 aa, Mycobacterium
GAMLYPQIAARPFGMLLGF

SEQ ID NO: 1240460 - protein, 18 aa, Mycobacterium
GANLARLEGRVALDEMLN

SEQ ID NO: 1240461 - protein, 18 aa, Mycobacterium
GANMQRQAVPLVRSEAPL

SEQ ID NO: 1240462 - protein, 17 aa, Mycobacterium
GANPRQAAEIVVGELHT

SEQ ID NO: 1240463 - protein, 17 aa, Mycobacterium
GAPARVFFCNSGTEANE

SEQ ID NO: 1240464 - protein, 20 aa, Mycobacterium
GAPDYRTWRDAVLAADDLGV

SEQ ID NO: 1240465 - protein, 19 aa, Mycobacterium
GAPGLRAASLTAIASANYV

SEQ ID NO: 1240466 - protein, 19 aa, Mycobacterium
GAPLARAEARISMNRLLDR

SEQ ID NO: 1240467 - protein, 19 aa, Mycobacterium
GAPPLMRSDIPQFVPTRSN

SEQ ID NO: 1240468 - protein, 25 aa, Mycobacterium
GAPRIGCTLPEVFDHARPGEKIRFD

SEQ ID NO: 1240469 - protein, 28 aa, Mycobacterium
GAQFTHAVALAHVWRSYGVLPDITVGHS

SEQ ID NO: 1240470 - protein, 24 aa, Mycobacterium
GAQLIKVCVSGGVMSLTGEAGAQH

SEQ ID NO: 1240471 - protein, 24 aa, Mycobacterium
GAQYSQWGALLARTDPNAPKHNGI

SEQ ID NO: 1240472 - protein, 21 aa, Mycobacterium
GARAGGHPWWTLSQLSDEKAI

SEQ ID NO: 1240473 - protein, 18 aa, Mycobacterium
GARALLRRAVGRLTTAPA

SEQ ID NO: 1240474 - protein, 21 aa, Mycobacterium
GARAVGCQFVLVDPLPTTERP

SEQ ID NO: 1240475 - protein, 19 aa, Mycobacterium
GARAVMIGRAYLWGLAANG

SEQ ID NO: 1240476 - protein, 21 aa, Mycobacterium
GARDWPSMLPTVLAPCEPAGA

SEQ ID NO: 1240477 - protein, 22 aa, Mycobacterium
GAREHALLLALRRDPEVEALAV

SEQ ID NO: 1240478 - protein, 18 aa, Mycobacterium
GARGRRLDPRQARTVVHE

SEQ ID NO: 1240479 - protein, 23 aa, Mycobacterium
GARIVDLRWLAPLPVEDMLREAQ

SEQ ID NO: 1240480 - protein, 26 aa, Mycobacterium
GARLLRPRPVRYLVRHIVPRIDPPLL

SEQ ID NO: 1240481 - protein, 20 aa, Mycobacterium
GARVWPGVKIPDGGIRYSTD

SEQ ID NO: 1240482 - protein, 18 aa, Mycobacterium
GARWFPGTQLNYADQVVR

SEQ ID NO: 1240483 - protein, 22 aa, Mycobacterium
GASGALVDWAPLVADAHDRGAL

SEQ ID NO: 1240484 - protein, 18 aa, Mycobacterium
GASKLGFGTYGFGLEGAG

SEQ ID NO: 1240485 - protein, 18 aa, Mycobacterium
GASLGVPAITAHRALTVA

SEQ ID NO: 1240486 - protein, 25 aa, Mycobacterium
GASPMPLPLLRQALKAWPDTDFIQV

SEQ ID NO: 1240487 - protein, 19 aa, Mycobacterium
GASRLGRRLMVPPLSLTIE

SEQ ID NO: 1240488 - protein, 24 aa, Mycobacterium
GASSATFRALAWSQDDEPAGEPVP

SEQ ID NO: 1240489 - protein, 20 aa, Mycobacterium
GASVLKQLVAYVGLESFLAG

SEQ ID NO: 1240490 - protein, 19 aa, Mycobacterium
GASVPPSLIRRAAAYFERA

SEQ ID NO: 1240491 - protein, 33 aa, Mycobacterium
GATACLRKTDWLFPQYREIGAFLLRGIAPAQMA

SEQ ID NO: 1240492 - protein, 30 aa, Mycobacterium; identical to SEQ ID NO: 97058

SEQ ID NO: 1240493 - protein, 21 aa, Mycobacterium
GATFYPVDVMDFAGTEQVLAQ

SEQ ID NO: 1240494 - protein, 25 aa, Mycobacterium
GATMLRLLLLPGSDLDEAWVDQTAA

SEQ ID NO: 1240495 - protein, 19 aa, Mycobacterium
GATPMVLSTAFILEEGTSL

SEQ ID NO: 1240496 - protein, 18 aa, Mycobacterium
GATRSRAPFQTLLANRIT

SEQ ID NO: 1240497 - protein, 19 aa, Mycobacterium
GATVLKTLRNYGAITSYSC

SEQ ID NO: 1240498 - protein, 18 aa, Mycobacterium
GAVAEWLHRCATVRPDLS

SEQ ID NO: 1240499 - protein, 17 aa, Mycobacterium
GAVALVAGWAARTLPDS

SEQ ID NO: 1240500 - protein, 24 aa, Mycobacterium
GAVELRGTMPTPRCSVPTLEHGAL

SEQ ID NO: 1240501 - protein, 24 aa, Mycobacterium
GAVILDHWGIIKADIGIRDGRIVA

SEQ ID NO: 1240502 - protein, 20 aa, Mycobacterium
GAVLDHLRVAMAAGGWIAHI

SEQ ID NO: 1240503 - protein, 17 aa, Mycobacterium
GAVRPSALTIWTGGFGV

SEQ ID NO: 1240504 - protein, 27 aa, Mycobacterium
GAVRRLAQRLALAAGRRLDEAQPWVDG

SEQ ID NO: 1240505 - protein, 18 aa, Mycobacterium
GAVSAVAVGRAFLANPDL

SEQ ID NO: 1240506 - protein, 36 aa, Mycobacterium; identical to SEQ ID NO: 663428

SEQ ID NO: 1240507 - protein, 19 aa, Mycobacterium
GAYHPAWPDIHMNPEEAVR

SEQ ID NO: 1240508 - protein, 18 aa, Mycobacterium
GCACKIPPGELEEVVRGL

SEQ ID NO: 1240509 - protein, 18 aa, Mycobacterium
GCADPLYRRAVRVSMGHA

SEQ ID NO: 1240510 - protein, 21 aa, Mycobacterium
GCAPPRVGPGPEHAVAAQGVD

SEQ ID NO: 1240511 - protein, 20 aa, Mycobacterium
GCDAYGRYLIRVKEMRESLK

SEQ ID NO: 1240512 - protein, 33 aa, Mycobacterium
GCDGVVIGRGCLGRPWLFAELSAKFTGRPLPVP

SEQ ID NO: 1240513 - protein, 19 aa, Mycobacterium
GCDIRPSLTTMAPRSDGGA

SEQ ID NO: 1240514 - protein, 17 aa, Mycobacterium
GCEHLLLGILRGGDEVA

SEQ ID NO: 1240515 - protein, 21 aa, Mycobacterium
GCGPVGLAVICHLKALGVRTI

SEQ ID NO: 1240516 - protein, 21 aa, Mycobacterium
GCIGCGCLSLKTCALANPGDV

SEQ ID NO: 1240517 - protein, 24 aa, Mycobacterium
GCIVDARPVAMFQMTDEAGGDDKV

SEQ ID NO: 1240518 - protein, 17 aa, Mycobacterium
GCLHAAMDLYKWSYKLS

SEQ ID NO: 1240519 - protein, 22 aa, Mycobacterium
GCLHAATSASSWTVRNVTARPE

SEQ ID NO: 1240520 - protein, 21 aa, Mycobacterium
GCPRAQGFMLSRPVDAAAMEA

SEQ ID NO: 1240521 - protein, 22 aa, Mycobacterium
GCRGMGAWDRLTLGSVSSGLVR

SEQ ID NO: 1240522 - protein, 17 aa, Mycobacterium
GCSLVALSDIVYMAPTA

SEQ ID NO: 1240523 - protein, 17 aa, Mycobacterium
GCTLPGADHPLFTVPEG

SEQ ID NO: 1240524 - protein, 19 aa, Mycobacterium
GCVDPGALFDLLEDPPAGV

SEQ ID NO: 1240525 - protein, 21 aa, Mycobacterium
GCVGCTTRGDLLVLLRNLHRR

SEQ ID NO: 1240526 - protein, 29 aa, Mycobacterium
GDAELREGQRLWLSWAMANRDPAVFTEPD

SEQ ID NO: 1240527 - protein, 23 aa, Mycobacterium
GDAGPRYQLVMGERRWRAAQEAG

SEQ ID NO: 1240528 - protein, 21 aa, Mycobacterium
GDALEGLGLVGVRTKTMGTVQ

SEQ ID NO: 1240529 - protein, 18 aa, Mycobacterium
GDALRDVKSGWKVAETFP

SEQ ID NO: 1240530 - protein, 24 aa, Mycobacterium
GDAVAGGVLREWLHKQRTGKPHVT

SEQ ID NO: 1240531 - protein, 21 aa, Mycobacterium
GDAVARLGSPVTLIGHSMGGL

SEQ ID NO: 1240532 - protein, 17 aa, Mycobacterium
GDAVWDIEACRRAGLTS

SEQ ID NO: 1240533 - protein, 27 aa, Mycobacterium
GDCLPERDFPTLISLYLQGRLPLDKFV

SEQ ID NO: 1240534 - protein, 25 aa, Mycobacterium
GDDIAEVLALLGVRPVWDDASRRVV

SEQ ID NO: 1240535 - protein, 18 aa, Mycobacterium
GDDLRLVVIDGKVVAGAL

SEQ ID NO: 1240536 - protein, 26 aa, Mycobacterium
GDDPASDWARYALRAPVMLVHNPEPV

SEQ ID NO: 1240537 - protein, 24 aa, Mycobacterium
GDDTIRLGQFLKLASLIDSGADAK

SEQ ID NO: 1240538 - protein, 19 aa, Mycobacterium
GDEAILFGPGTRGEHTAQD

SEQ ID NO: 1240539 - protein, 23 aa, Mycobacterium
GDERRMRMVYSLAFSLPGTPVLY

SEQ ID NO: 1240540 - protein, 18 aa, Mycobacterium
GDFARAYLATGLLALGKT

SEQ ID NO: 1240541 - protein, 20 aa, Mycobacterium
GDFHTLVGIAAREHPDLPRI

SEQ ID NO: 1240542 - protein, 17 aa, Mycobacterium
GDFLRTVHQLLLSDDFF

SEQ ID NO: 1240543 - protein, 17 aa, Mycobacterium
GDFTAVVSLDLRRLDRL

SEQ ID NO: 1240544 - protein, 23 aa, Mycobacterium
GDFVKIDFGALVSGYHSDMTRTF

SEQ ID NO: 1240545 - protein, 21 aa, Mycobacterium
GDGALGFWRAVREVFPATREQ

SEQ ID NO: 1240546 - protein, 22 aa, Mycobacterium
GDGEAFDFLPQVAAELPMQMIC

SEQ ID NO: 1240547 - protein, 19 aa, Mycobacterium
GDGEEWLRAELDRERAHVF

SEQ ID NO: 1240548 - protein, 24 aa, Mycobacterium
GDGIRIDLPVALMERAATTGWAAA

SEQ ID NO: 1240549 - protein, 27 aa, Mycobacterium
GDGKATCPPLSIAMAGALNGPDAALGI

SEQ ID NO: 1240550 - protein, 20 aa, Mycobacterium
GDGLGIVFRKGLPLEDMEFH

SEQ ID NO: 1240551 - protein, 18 aa, Mycobacterium
GDGLRVVANVAVGYDNID

SEQ ID NO: 1240552 - protein, 24 aa, Mycobacterium
GDGTYSLTGHKWFTSAPMCDIFLV

SEQ ID NO: 1240553 - protein, 19 aa, Mycobacterium
GDGVARYFAGLKRHEFFDY

SEQ ID NO: 1240554 - protein, 17 aa, Mycobacterium
GDGVPAYNLAVVVDDAA

SEQ ID NO: 1240555 - protein, 18 aa, Mycobacterium
GDGVPRVDAVVFLLRTLN

SEQ ID NO: 1240556 - protein, 39 aa, Mycobacterium
GDGVRWALRHLPFYGRWYRFLLFWPGCDKGLAAARVDPD

SEQ ID NO: 1240557 - protein, 20 aa, Mycobacterium
GDHGTFCAGADLKAFGTPDA

SEQ ID NO: 1240558 - protein, 19 aa, Mycobacterium
GDIAALVSRIATDHPLGTP

SEQ ID NO: 1240559 - protein, 23 aa, Mycobacterium
GDIEPGHGLKLGYFAQEHDTIDG

SEQ ID NO: 1240560 - protein, 24 aa, Mycobacterium
GDIHVFHAKAIVFATGGSGRMYKT

SEQ ID NO: 1240561 - protein, 17 aa, Mycobacterium
GDILDREAVDALVADAD

SEQ ID NO: 1240562 - protein, 24 aa, Mycobacterium
GDILTRLTAPVIRGLGVGIVPAAT

SEQ ID NO: 1240563 - protein, 24 aa, Mycobacterium
GDIVRIRVSPTWLRIDAPFGSVLR

SEQ ID NO: 1240564 - protein, 26 aa, Mycobacterium
GDKGGNANLGLWARDDPGYAWAREYL

SEQ ID NO: 1240565 - protein, 19 aa, Mycobacterium
GDLAVRWNCKAGKCGSCSA

SEQ ID NO: 1240566 - protein, 32 aa, Mycobacterium
GDLAYRDAEGWIYLAGRTGDWMRVDGENLTAA

SEQ ID NO: 1240567 - protein, 20 aa, Mycobacterium
GDLCLVWAGQMMRESGLGDR

SEQ ID NO: 1240568 - protein, 24 aa, Mycobacterium
GDLEIRPPVVTVMGHVDHGKTRLL

SEQ ID NO: 1240569 - protein, 18 aa, Mycobacterium
GDLHVLKDINLRVERGQV

SEQ ID NO: 1240570 - protein, 27 aa, Mycobacterium
GDLLEYWSGRRWPSGRHRVLPPQPDAP

SEQ ID NO: 1240571 - protein, 17 aa, Mycobacterium
GDLLIAVCDNAHEELPP

SEQ ID NO: 1240572 - protein, 23 aa, Mycobacterium
GDLPVHRPHVMPGHEVVGEVVGI

SEQ ID NO: 1240573 - protein, 24 aa, Mycobacterium
GDLRGRFRWWGLYTQRKPGFDGTW

SEQ ID NO: 1240574 - protein, 23 aa, Mycobacterium
GDLRRSLDMSVVFVTHDLSVARV

SEQ ID NO: 1240575 - protein, 20 aa, Mycobacterium
GDLSVLDVFGMLRAGGSLVV

SEQ ID NO: 1240576 - protein, 18 aa, Mycobacterium
GDLVVGWASGFDGLMEFV

SEQ ID NO: 1240577 - protein, 21 aa, Mycobacterium
GDMFAWAGATASWPNRTDPGG

SEQ ID NO: 1240578 - protein, 18 aa, Mycobacterium
GDMLELWTNGAFVATSHR

SEQ ID NO: 1240579 - protein, 17 aa, Mycobacterium
GDMPYRWDDDYGARLGV

SEQ ID NO: 1240580 - protein, 22 aa, Mycobacterium
GDNEVLKGVSFRVPAGSVTTII

SEQ ID NO: 1240581 - protein, 20 aa, Mycobacterium
GDPDEYGALAVHIVENPMLN

SEQ ID NO: 1240582 - protein, 22 aa, Mycobacterium
GDPDRGWAWQVPLLELPHAQFL

SEQ ID NO: 1240583 - protein, 23 aa, Mycobacterium
GDPEAFATLATRFLGPSLNGVRP

SEQ ID NO: 1240584 - protein, 26 aa, Mycobacterium
GDPGESRFYLSLGDELMRRFNGATLE

SEQ ID NO: 1240585 - protein, 21 aa, Mycobacterium
GDPNRCIWHVASYMYVPQEFR

SEQ ID NO: 1240586 - protein, 23 aa, Mycobacterium
GDPPRYLAIAALVRDRIATEQLG

SEQ ID NO: 1240587 - protein, 24 aa, Mycobacterium
GDPQALRPFLLVASFVNPHDIVLF

SEQ ID NO: 1240588 - protein, 17 aa, Mycobacterium
GDPRAVLNNVLHAVGAA

SEQ ID NO: 1240589 - protein, 19 aa, Mycobacterium
GDPRPAVAHPDRLRTPHFH

SEQ ID NO: 1240590 - protein, 22 aa, Mycobacterium
GDPRVAAALRKPLEAVHHEKTD

SEQ ID NO: 1240591 - protein, 25 aa, Mycobacterium
GDPRVTGNPGAFAQMLGINDAVERA

SEQ ID NO: 1240592 - protein, 18 aa, Mycobacterium
GDPVPLVASDGSAHRGEL

SEQ ID NO: 1240593 - protein, 21 aa, Mycobacterium
GDQLPGYGWVFPMGDGIFNIG

SEQ ID NO: 1240594 - protein, 22 aa, Mycobacterium
GDQMPWGNPVVGIRNPVAPPLV

SEQ ID NO: 1240595 - protein, 20 aa, Mycobacterium
GDQVEIRWVDGPDREKLLAA

SEQ ID NO: 1240596 - protein, 24 aa, Mycobacterium
GDRELAELSPAFAGELGELQRRFR

SEQ ID NO: 1240597 - protein, 29 aa, Mycobacterium
GDRFLRSRRPWIWGPRMLTGLDVSAGATL

SEQ ID NO: 1240598 - protein, 17 aa, Mycobacterium
GDRLRNDEIVIAVLHSA

SEQ ID NO: 1240599 - protein, 23 aa, Mycobacterium
GDRNVVSVGFNWIMGDHVTPPKP

SEQ ID NO: 1240600 - protein, 20 aa, Mycobacterium
GDRPIPSWLQVVGERQRILV

SEQ ID NO: 1240601 - protein, 22 aa, Mycobacterium
GDRRRLRLGAPQGIVALPSEAA

SEQ ID NO: 1240602 - protein, 22 aa, Mycobacterium
GDRTTSVAWTAWRGMGMGSASG

SEQ ID NO: 1240603 - protein, 19 aa, Mycobacterium
GDSGFYAVSGWDAVTEAIA

SEQ ID NO: 1240604 - protein, 18 aa, Mycobacterium
GDSMLLLLAAAHRDPDAF

SEQ ID NO: 1240605 - protein, 18 aa, Mycobacterium
GDSVTITGFGVFEQRRRA

SEQ ID NO: 1240606 - protein, 25 aa, Mycobacterium
GDTDLAWSRITYWRALLTSAVDQPP

SEQ ID NO: 1240607 - protein, 24 aa, Mycobacterium
GDTEFFIRKAIGWALRQYARTDPT

SEQ ID NO: 1240608 - protein, 20 aa, Mycobacterium
GDTELAPGLVAPVPRGVVEI

SEQ ID NO: 1240609 - protein, 17 aa, Mycobacterium
GDTGAAAPEHWLGGLAG

SEQ ID NO: 1240610 - protein, 19 aa, Mycobacterium
GDTPLPVRTPLAVQLPEPM

SEQ ID NO: 1240611 - protein, 19 aa, Mycobacterium
GDTTRSWYVIDATDVVLGR

SEQ ID NO: 1240612 - protein, 21 aa, Mycobacterium
GDVAYGWAMEDTEAFAKLIVD

SEQ ID NO: 1240613 - protein, 19 aa, Mycobacterium
GDVIPEVLGPVVDLRDGTE

SEQ ID NO: 1240614 - protein, 19 aa, Mycobacterium
GDVLFHARAKFKRKGSDLL

SEQ ID NO: 1240615 - protein, 24 aa, Mycobacterium
GDVLKILRRRSLAALRAQVEPVST

SEQ ID NO: 1240616 - protein, 18 aa, Mycobacterium
GDVPVFVNTGVRAHNAAE

SEQ ID NO: 1240617 - protein, 18 aa, Mycobacterium
GDVTDQFGTPVWHISQGP

SEQ ID NO: 1240618 - protein, 22 aa, Mycobacterium
GDWRTKHHFFRDNARLREELEE

SEQ ID NO: 1240619 - protein, 23 aa, Mycobacterium
GDYLRAGAIAKFAPVMGEVVRAA

SEQ ID NO: 1240620 - protein, 17 aa, Mycobacterium
GEAFPPMAVSVSLADDI

SEQ ID NO: 1240621 - protein, 22 aa, Mycobacterium
GEAGYERCTPWNVAADVRPAAV

SEQ ID NO: 1240622 - protein, 27 aa, Mycobacterium
GEAIKDAKNRLGYEKVVLAGWSGGGSL

SEQ ID NO: 1240623 - protein, 25 aa, Mycobacterium
GEAKDFIAGGAIEIGGKLPINTHGG

SEQ ID NO: 1240624 - protein, 18 aa, Mycobacterium
GEALRGFLRRWVGAAVRR

SEQ ID NO: 1240625 - protein, 17 aa, Mycobacterium
GEARAVTTGGLMVFHIA

SEQ ID NO: 1240626 - protein, 27 aa, Mycobacterium
GEARTAFQHCRRLLPGDPIAPLHLAHC

SEQ ID NO: 1240627 - protein, 27 aa, Mycobacterium
GEASDIAEAIAFLASDRAAWITASDLL

SEQ ID NO: 1240628 - protein, 21 aa, Mycobacterium
GEASVVLMFKRLADAQRDGDR

SEQ ID NO: 1240629 - protein, 24 aa, Mycobacterium
GEDDIPGLVLIPAAASKIDIPMIA

SEQ ID NO: 1240630 - protein, 25 aa, Mycobacterium
GEDGRYRPAAGLALLGSSFDNNVRA

SEQ ID NO: 1240631 - protein, 24 aa, Mycobacterium
GEDLSWLWDVRFEHFEQVQVVAAG

SEQ ID NO: 1240632 - protein, 22 aa, Mycobacterium
GEDLWAPTFVRDFPVETTPLTR

SEQ ID NO: 1240633 - protein, 22 aa, Mycobacterium
GEDPDELFASFAAWAEAGGTAL

SEQ ID NO: 1240634 - protein, 21 aa, Mycobacterium
GEDPRWGKMVAPGIYGPNHQH

SEQ ID NO: 1240635 - protein, 21 aa, Mycobacterium
GEDVRARIGVLSQVPSLWAQY

SEQ ID NO: 1240636 - protein, 24 aa, Mycobacterium
GEDYSVKDLRTWHGTVLAAVAFVD

SEQ ID NO: 1240637 - protein, 18 aa, Mycobacterium
GEEAVKELGDRAKFVQAN

SEQ ID NO: 1240638 - protein, 23 aa, Mycobacterium
GEEICAWIRMRPGRPPLTAEAVR

SEQ ID NO: 1240639 - protein, 17 aa, Mycobacterium
GEELTRSWVAQWPALPE

SEQ ID NO: 1240640 - protein, 28 aa, Mycobacterium
GEESMCGWLKDRFGVSWQIVPDRLTELL

SEQ ID NO: 1240641 - protein, 28 aa, Mycobacterium
GEEVAPWLDLVRKLGLLAGTLATEPTTT

SEQ ID NO: 1240642 - protein, 22 aa, Mycobacterium
GEFKKGPFRIAMSARIPIVPIV

SEQ ID NO: 1240643 - protein, 21 aa, Mycobacterium
GEGADAIWLAGHGWQVVGVDV

SEQ ID NO: 1240644 - protein, 26 aa, Mycobacterium
GEGKLYLCAIKDAFSNRIVGYSIDSR

SEQ ID NO: 1240645 - protein, 24 aa, Mycobacterium
GEGKRLYPLTADRAKPAVPFGGAY

SEQ ID NO: 1240646 - protein, 31 aa, Mycobacterium
GEGPAKAWEHGRFGAPYLRDSLLSAGALCET

SEQ ID NO: 1240647 - protein, 22 aa, Mycobacterium
GEGSIRPGLVIAAEFRGRDEAG

SEQ ID NO: 1240648 - protein, 24 aa, Mycobacterium
GEGTLRGRVLLAERLGRNIELTVD

SEQ ID NO: 1240649 - protein, 26 aa, Mycobacterium
GEHCPMCAAAHAWVGLGRIVYATSSA

SEQ ID NO: 1240650 - protein, 18 aa, Mycobacterium
GEHIRVFPLSNWTEYDIW

SEQ ID NO: 1240651 - protein, 22 aa, Mycobacterium
GEIARCLADLVTLDTPTVSVLL

SEQ ID NO: 1240652 - protein, 18 aa, Mycobacterium
GEIARRVFSTCRRLGIGT

SEQ ID NO: 1240653 - protein, 17 aa, Mycobacterium
GEIDVLVCTTVIEVGVD

SEQ ID NO: 1240654 - protein, 26 aa, Mycobacterium
GEILERSLVHLGLKHYFLVDFPQEPG

SEQ ID NO: 1240655 - protein, 21 aa, Mycobacterium
GEIPGAPVIGELVPRGEHTLV

SEQ ID NO: 1240656 - protein, 22 aa, Mycobacterium
GEIRRLSLLFADLVDSTVLSTR

SEQ ID NO: 1240657 - protein, 17 aa, Mycobacterium
GEIRTPAFIAVGTQATV

SEQ ID NO: 1240658 - protein, 29 aa, Mycobacterium
GEIYEDLAWFCIRAWRFGASERLGAGGLG

SEQ ID NO: 1240659 - protein, 30 aa, Mycobacterium
GEKRTLRITARWAQHWNYVGGPPEEFARKR

SEQ ID NO: 1240660 - protein, 25 aa, Mycobacterium
GELAVALHAGFPAERIALHGNNKSP

SEQ ID NO: 1240661 - protein, 21 aa, Mycobacterium
GELGFPLSIHLEATYGVSTPA

SEQ ID NO: 1240662 - protein, 19 aa, Mycobacterium
GELIIAIAMTEPGAGSDLA

SEQ ID NO: 1240663 - protein, 21 aa, Mycobacterium
GELQRRFRALTGIGAEESEAL

SEQ ID NO: 1240664 - protein, 25 aa, Mycobacterium
GELRARALQLLGLVRLYANSSSEAV

SEQ ID NO: 1240665 - protein, 20 aa, Mycobacterium
GELVCTVGLSLQTPQDCRTF

SEQ ID NO: 1240666 - protein, 17 aa, Mycobacterium
GELWYRKSGTYRGKIQN

SEQ ID NO: 1240667 - protein, 21 aa, Mycobacterium
GENAWAMPLPEELKDDLKSTV

SEQ ID NO: 1240668 - protein, 21 aa, Mycobacterium
GENGVSIDFAKPVSKDELRRY

SEQ ID NO: 1240669 - protein, 21 aa, Mycobacterium
GENLMLLAFGEPRAREFYVDW

SEQ ID NO: 1240670 - protein, 18 aa, Mycobacterium
GENVFFCATGVTDGDLLQ

SEQ ID NO: 1240671 - protein, 28 aa, Mycobacterium
GEPLEEYILPVGGGFFFMLPGVTGEDRF

SEQ ID NO: 1240672 - protein, 22 aa, Mycobacterium
GEPRQLAAMCLLITQSTIQSAQ

SEQ ID NO: 1240673 - protein, 19 aa, Mycobacterium
GEPVAAVAADEGWSSPEVF

SEQ ID NO: 1240674 - protein, 17 aa, Mycobacterium
GEPVPYAGADYDPSATG

SEQ ID NO: 1240675 - protein, 21 aa, Mycobacterium
GEQFMQWFLKEQVEEVAQMTT

SEQ ID NO: 1240676 - protein, 18 aa, Mycobacterium
GEQLPVMPPWHVQENKWR

SEQ ID NO: 1240677 - protein, 22 aa, Mycobacterium
GERILTWRQLYDLTELPEHLVI

SEQ ID NO: 1240678 - protein, 24 aa, Mycobacterium
GERRFARHYVHAGMIGWDGHKMSK

SEQ ID NO: 1240679 - protein, 20 aa, Mycobacterium
GERRRVAGLRREELAQLAGV

SEQ ID NO: 1240680 - protein, 24 aa, Mycobacterium
GERRRVALCKLLLSKPDLLLLDEP

SEQ ID NO: 1240681 - protein, 17 aa, Mycobacterium
GERRVVLGPVTIAQQLA

SEQ ID NO: 1240682 - protein, 28 aa, Mycobacterium
GERRYDYIPTYILRGLTELHLEFDTTGV

SEQ ID NO: 1240683 - protein, 24 aa, Mycobacterium
GERSRLMLDIARWRRRRRDELAAL

SEQ ID NO: 1240684 - protein, 23 aa, Mycobacterium
GERSSHTWFVLTHLLGLPGVRNY

SEQ ID NO: 1240685 - protein, 21 aa, Mycobacterium
GERYLTGPLARYSLSSAALSP

SEQ ID NO: 1240686 - protein, 18 aa, Mycobacterium
GERYQFLRWGQGAFDDFK

SEQ ID NO: 1240687 - protein, 24 aa, Mycobacterium
GERYTLRIDDRFRAAARGDRAAFN

SEQ ID NO: 1240688 - protein, 25 aa, Mycobacterium
GESAYPQLLFRVGWAPVNADPLPPT

SEQ ID NO: 1240689 - protein, 19 aa, Mycobacterium
GESLLRPDVIEGIVSFLEK

SEQ ID NO: 1240690 - protein, 20 aa, Mycobacterium
GESNVRWLQEHGVTIWDEWA

SEQ ID NO: 1240691 - protein, 26 aa, Mycobacterium
GETEAGKSWLALQCAAVELRADNAVV

SEQ ID NO: 1240692 - protein, 24 aa, Mycobacterium
GETEQRLALVAAWEEAGDLFTERE

SEQ ID NO: 1240693 - protein, 25 aa, Mycobacterium
GETRTTLAGGLNWPLDLAVGDDGRL

SEQ ID NO: 1240694 - protein, 22 aa, Mycobacterium
GEVFSMRGGHGLEVSDGPAREP

SEQ ID NO: 1240695 - protein, 26 aa, Mycobacterium
GEVGSRIDPVLARSWLLVNGAHGDRF

SEQ ID NO: 1240696 - protein, 23 aa, Mycobacterium
GEVKLPGGLWIVTERAVACESGE

SEQ ID NO: 1240697 - protein, 23 aa, Mycobacterium
GEVRGAEVVDLLAALNTGHDGGA

SEQ ID NO: 1240698 - protein, 19 aa, Mycobacterium
GEVTASMVYDGAPVHDHFK

SEQ ID NO: 1240699 - protein, 19 aa, Mycobacterium
GEVTIDFVVHGEHGVAGPW

SEQ ID NO: 1240700 - protein, 20 aa, Mycobacterium
GEWLEAGLFQLEELPPGDYV

SEQ ID NO: 1240701 - protein, 17 aa, Mycobacterium
GEWTFAFPQGSMTDEPI

SEQ ID NO: 1240702 - protein, 25 aa, Mycobacterium
GEYLPRLRPGVMEVKIPMPTTGADY

SEQ ID NO: 1240703 - protein, 19 aa, Mycobacterium
GEYVAYCRGPYCVYADDAV

SEQ ID NO: 1240704 - protein, 25 aa, Mycobacterium
GFACMVELLLKLRHCNPRIAEVPLV

SEQ ID NO: 1240705 - protein, 32 aa, Mycobacterium
GFAPPTLHAMGIRVATTFPARQFNLLITNVPG

SEQ ID NO: 1240706 - protein, 18 aa, Mycobacterium
GFARQAMIGIRCTGDTTK

SEQ ID NO: 1240707 - protein, 21 aa, Mycobacterium
GFARRASDRVVFMSDGAIVED

SEQ ID NO: 1240708 - protein, 24 aa, Mycobacterium
GFDEVARLGAQVTIFRLGTDPGLA

SEQ ID NO: 1240709 - protein, 18 aa, Mycobacterium
GFDKSLWERLCAMGATTM

SEQ ID NO: 1240710 - protein, 26 aa, Mycobacterium
GFDPARPSAWLAEGLLMYLPATAQEA

SEQ ID NO: 1240711 - protein, 20 aa, Mycobacterium
GFDPEKLWATVYLDDDEAIQ

SEQ ID NO: 1240712 - protein, 22 aa, Mycobacterium
GFELLSRAKIRTEIKDPELRRK

SEQ ID NO: 1240713 - protein, 35 aa, Mycobacterium
GFELSGSFVSYFGWLYEWGAPVTLIGESQDQIADA

SEQ ID NO: 1240714 - protein, 21 aa, Mycobacterium
GFERSKYASGEFFDKYTEQPW

SEQ ID NO: 1240715 - protein, 19 aa, Mycobacterium
GFGDRVLILMLNRTEFIES

SEQ ID NO: 1240716 - protein, 20 aa, Mycobacterium
GFGPEVKRRIMIGTYALSAG

SEQ ID NO: 1240717 - protein, 25 aa, Mycobacterium
GFIDAGVSGGVWGLAEGYGLMVGGD

SEQ ID NO: 1240718 - protein, 20 aa, Mycobacterium
GFIEIAWRAPIHLMAAGLGV

SEQ ID NO: 1240719 - protein, 21 aa, Mycobacterium
GFPLIPGHDPHVWPELTQHFH

SEQ ID NO: 1240720 - protein, 21 aa, Mycobacterium
GFPNAPMRATPLWAQPEPLSE

SEQ ID NO: 1240721 - protein, 24 aa, Mycobacterium
GFPVLQIRYPLPFVAISRAVAEAT

SEQ ID NO: 1240722 - protein, 24 aa, Mycobacterium
GFQGEFSDGRWLTDRHIARIEACS

SEQ ID NO: 1240723 - protein, 23 aa, Mycobacterium
GFRFDLASTLAREFYDVDRLATF

SEQ ID NO: 1240724 - protein, 24 aa, Mycobacterium
GFRLNTCGYWSHLPGQPIPRRYGR

SEQ ID NO: 1240725 - protein, 24 aa, Mycobacterium
GFSGRAQIGKGMWAMTDLMADMVE

SEQ ID NO: 1240726 - protein, 18 aa, Mycobacterium
GGAAAAYRALAKSLSGNG

SEQ ID NO: 1240727 - protein, 23 aa, Mycobacterium
GGAAFLLCRRASRLSSHAAQWAL

SEQ ID NO: 1240728 - protein, 23 aa, Mycobacterium
GGAELGCVAAIKTLEITTRPEVR

SEQ ID NO: 1240729 - protein, 24 aa, Mycobacterium
GGAESGLRAAMRILDNIDDIHFAE

SEQ ID NO: 1240730 - protein, 24 aa, Mycobacterium
GGAGRIGLHYARHLAERGARRIVL

SEQ ID NO: 1240731 - protein, 18 aa, Mycobacterium
GGAGVVVAEDVHWFDPST

SEQ ID NO: 1240732 - protein, 19 aa, Mycobacterium
GGAHFCLGANLARREIRVL

SEQ ID NO: 1240733 - protein, 19 aa, Mycobacterium
GGAHKCIGMQFGTLEVKAI

SEQ ID NO: 1240734 - protein, 17 aa, Mycobacterium
GGAHKCIGMVFGQLEIK

SEQ ID NO: 1240735 - protein, 22 aa, Mycobacterium
GGAIALGHPFGMTGARITATLL

SEQ ID NO: 1240736 - protein, 17 aa, Mycobacterium
GGAIVVHRAALGGRAGD

SEQ ID NO: 1240737 - protein, 18 aa, Mycobacterium
GGALGLARARAMALVMLA

SEQ ID NO: 1240738 - protein, 20 aa, Mycobacterium
GGALPLFGAFWERTAELPTA

SEQ ID NO: 1240739 - protein, 20 aa, Mycobacterium
GGAVALLFDSVLGYTTYKLT

SEQ ID NO: 1240740 - protein, 24 aa, Mycobacterium
GGAVEWHKMGSGWSWSRKPGSDDD

SEQ ID NO: 1240741 - protein, 24 aa, Mycobacterium
GGCCDVPGLKACTKAGTSCGSCVP

SEQ ID NO: 1240742 - protein, 24 aa, Mycobacterium
GGDATRLLYTLGWHEVPLPAVDPA

SEQ ID NO: 1240743 - protein, 18 aa, Mycobacterium
GGDLEFADELTLGRALAG

SEQ ID NO: 1240744 - protein, 18 aa, Mycobacterium
GGDVQAWLDGSVMAQDTA

SEQ ID NO: 1240745 - protein, 24 aa, Mycobacterium
GGDYRLGVRMNHSIDIAAGAEHFG

SEQ ID NO: 1240746 - protein, 21 aa, Mycobacterium
GGDYRTGLRFYRAAPELIAGF

SEQ ID NO: 1240747 - protein, 18 aa, Mycobacterium
GGEFHTGHKANGFMERLN

SEQ ID NO: 1240748 - protein, 24 aa, Mycobacterium
GGEIVRYAPAAAHTVLRLEPPGCA

SEQ ID NO: 1240749 - protein, 24 aa, Mycobacterium
GGERNRLNLALTLKEGGNLILLDE

SEQ ID NO: 1240750 - protein, 20 aa, Mycobacterium
GGEVRRLLRICDPQGELPLA

SEQ ID NO: 1240751 - protein, 20 aa, Mycobacterium
GGFELDVRYAPTRLRELSKM

SEQ ID NO: 1240752 - protein, 18 aa, Mycobacterium
GGFIPAQDDHGWYDTGDL

SEQ ID NO: 1240753 - protein, 24 aa, Mycobacterium
GGFLLAFLACFDVGDRVAIASPGY

SEQ ID NO: 1240754 - protein, 25 aa, Mycobacterium
GGFPRAVQRFLLGWRASSSRDVELP

SEQ ID NO: 1240755 - protein, 19 aa, Mycobacterium
GGFYLSQPAFKVMAKQKSG

SEQ ID NO: 1240756 - protein, 30 aa, Mycobacterium
GGGMTARLPQVVGAAMARRLSMTGEVVDAE

SEQ ID NO: 1240757 - protein, 18 aa, Mycobacterium
GGGPVVVVGHSFGGAVAL

SEQ ID NO: 1240758 - protein, 19 aa, Mycobacterium
GGGTMRWITVGPPNQPGTS

SEQ ID NO: 1240759 - protein, 17 aa, Mycobacterium
GGGVSQPQAAPVYEPEP

SEQ ID NO: 1240760 - protein, 24 aa, Mycobacterium
GGGVSVPLGFLISWLRFVHTRPER

SEQ ID NO: 1240761 - protein, 22 aa, Mycobacterium
GGHAVALLWSMRNIYDTQPGDV

SEQ ID NO: 1240762 - protein, 17 aa, Mycobacterium
GGHFAAFEQPELFADDV

SEQ ID NO: 1240763 - protein, 20 aa, Mycobacterium
GGHHSWEDLDDLLLTTYSEL

SEQ ID NO: 1240764 - protein, 17 aa, Mycobacterium
GGHPAKRTFQALRIAVN

SEQ ID NO: 1240765 - protein, 24 aa, Mycobacterium
GGHSLLPMMKLRIANPEYLVDIND

SEQ ID NO: 1240766 - protein, 18 aa, Mycobacterium
GGIAYVLGLNPARVNTAM

SEQ ID NO: 1240767 - protein, 23 aa, Mycobacterium
GGIEPWGITNFQIFPNLEILIYH

SEQ ID NO: 1240768 - protein, 23 aa, Mycobacterium
GGIQAGGGVPVYRASKAAILHFT

SEQ ID NO: 1240769 - protein, 27 aa, Mycobacterium
GGISRKADKWVPLLKNRTPVVAAALQN

SEQ ID NO: 1240770 - protein, 27 aa, Mycobacterium
GGITHLVPRDSIGWVEAEGDYARLHSA

SEQ ID NO: 1240771 - protein, 19 aa, Mycobacterium
GGKLAITVPRWLPERICWL

SEQ ID NO: 1240772 - protein, 21 aa, Mycobacterium
GGKPVIIPAITAFIDAKHWDS

SEQ ID NO: 1240773 - protein, 17 aa, Mycobacterium
GGLDLLLGVETTAGLRW

SEQ ID NO: 1240774 - protein, 22 aa, Mycobacterium
GGLDTSVAISWIGKETGREVVA

SEQ ID NO: 1240775 - protein, 20 aa, Mycobacterium
GGLFNGILARYLALVATTLP

SEQ ID NO: 1240776 - protein, 17 aa, Mycobacterium
GGLGIAVTKSWGMVDNR

SEQ ID NO: 1240777 - protein, 19 aa, Mycobacterium
GGLHWDRILFCAKEATYKA

SEQ ID NO: 1240778 - protein, 18 aa, Mycobacterium
GGLPRPEVQFEIVDRCGQ

SEQ ID NO: 1240779 - protein, 19 aa, Mycobacterium
GGLYRWEARFLRGDDQATL

SEQ ID NO: 1240780 - protein, 19 aa, Mycobacterium
GGMGGMPMGGHGAGRGQGG

SEQ ID NO: 1240781 - protein, 25 aa, Mycobacterium
GGMRRRLDLAVSLLAAPPVLFLDEP

SEQ ID NO: 1240782 - protein, 28 aa, Mycobacterium
GGMRRRVRLASVLRRCIVTDAALRGSEL

SEQ ID NO: 1240783 - protein, 20 aa, Mycobacterium
GGPGLLLRAKHAVFDRLVYG

SEQ ID NO: 1240784 - protein, 33 aa, Mycobacterium
GGPLASWNAWHWRWNPWLMVAQGYAVLLPDPAL

SEQ ID NO: 1240785 - protein, 21 aa, Mycobacterium
GGPLTECLADVVARFVPYFEQ

SEQ ID NO: 1240786 - protein, 18 aa, Mycobacterium
GGPMARRIVEGGYELTLW

SEQ ID NO: 1240787 - protein, 25 aa, Mycobacterium
GGPPPRLALSLGDSLAGMFAAQGAL

SEQ ID NO: 1240788 - protein, 23 aa, Mycobacterium
GGPRKVSPLAVQMIMPNGAAAVA

SEQ ID NO: 1240789 - protein, 25 aa, Mycobacterium
GGPVKRDAALCLATLRAGVEAAGVP

SEQ ID NO: 1240790 - protein, 17 aa, Mycobacterium
GGPVPDKITLEFIIAHE

SEQ ID NO: 1240791 - protein, 22 aa, Mycobacterium
GGQGGGMFGSLMQQAMQAAQQF

SEQ ID NO: 1240792 - protein, 21 aa, Mycobacterium
GGRFTLGIGPSHDWIISGQLG

SEQ ID NO: 1240793 - protein, 26 aa, Mycobacterium
GGRGPARLQIHLSWAASDDEAMAIAH

SEQ ID NO: 1240794 - protein, 21 aa, Mycobacterium
GGRIFMQLWHVGRMGHPDISG

SEQ ID NO: 1240795 - protein, 25 aa, Mycobacterium
GGRLDLRAAAAIKVTAARLGEEVLS

SEQ ID NO: 1240796 - protein, 20 aa, Mycobacterium
GGRLILGLGAGWYEKDYTTY

SEQ ID NO: 1240797 - protein, 20 aa, Mycobacterium
GGRPCWDLRVLSSIEVTATT

SEQ ID NO: 1240798 - protein, 23 aa, Mycobacterium
GGRRRGACMAVLDVSHPDIYDFI

SEQ ID NO: 1240799 - protein, 21 aa, Mycobacterium
GGRSWPMYVPLVVPDARTAES

SEQ ID NO: 1240800 - protein, 17 aa, Mycobacterium
GGRVMFEGEDITRLRPS

SEQ ID NO: 1240801 - protein, 24 aa, Mycobacterium
GGRVWRVPVTAFWQAHRDAARRYS

SEQ ID NO: 1240802 - protein, 17 aa, Mycobacterium
GGSAAGYKPFARAFTMD

SEQ ID NO: 1240803 - protein, 25 aa, Mycobacterium
GGSARAPWEIARPVGADGALATEFT

SEQ ID NO: 1240804 - protein, 20 aa, Mycobacterium
GGSIFAYWVANPSAYGVVEF

SEQ ID NO: 1240805 - protein, 19 aa, Mycobacterium
GGSKDTWVLASRASAADRE

SEQ ID NO: 1240806 - protein, 26 aa, Mycobacterium
GGSRGGWKPFLHHVSNRMPRSRRMVT

SEQ ID NO: 1240807 - protein, 17 aa, Mycobacterium
GGSRRIVAIGGDHTIAL

SEQ ID NO: 1240808 - protein, 21 aa, Mycobacterium
GGTCPLWNVYETFANPGKILV

SEQ ID NO: 1240809 - protein, 18 aa, Mycobacterium
GGTGGFGDKGYWLVTKHA

SEQ ID NO: 1240810 - protein, 18 aa, Mycobacterium
GGTGWIPYFLDRVDRTYE

SEQ ID NO: 1240811 - protein, 21 aa, Mycobacterium
GGTHAAGGWYRHPRTGAATLG

SEQ ID NO: 1240812 - protein, 25 aa, Mycobacterium
GGTIAHGLLTLSLLPHFSHQLYTVG

SEQ ID NO: 1240813 - protein, 25 aa, Mycobacterium
GGTLYGIPMPPGLISHAPQGVHHGA

SEQ ID NO: 1240814 - protein, 27 aa, Mycobacterium
GGTPFPEPVLMWWNFVGRSHEEIAAFR

SEQ ID NO: 1240815 - protein, 17 aa, Mycobacterium
GGTRIALSRGLRPDRFV

SEQ ID NO: 1240816 - protein, 18 aa, Mycobacterium
GGTTGRPKGVMWRQSDTY

SEQ ID NO: 1240817 - protein, 20 aa, Mycobacterium
GGTWLRTGDLGFIHEGELFI

SEQ ID NO: 1240818 - protein, 17 aa, Mycobacterium
GGVDVCLKEPVYEPLSG

SEQ ID NO: 1240819 - protein, 24 aa, Mycobacterium
GGVHSAGGFPLEFGTISVSDGISM

SEQ ID NO: 1240820 - protein, 20 aa, Mycobacterium
GGVINALLHRVLRTERLLSF

SEQ ID NO: 1240821 - protein, 18 aa, Mycobacterium
GGVPVAWEVAAALGAPLD

SEQ ID NO: 1240822 - protein, 19 aa, Mycobacterium
GGVPVGWEVAHGLGAPLDV

SEQ ID NO: 1240823 - protein, 18 aa, Mycobacterium
GGVQGKWDPGAIDLDTLR

SEQ ID NO: 1240824 - protein, 24 aa, Mycobacterium
GGVSIGAAVAVEWALANPGSAVAV

SEQ ID NO: 1240825 - protein, 18 aa, Mycobacterium
GGYEQRGPGGYGPPGGGY

SEQ ID NO: 1240826 - protein, 19 aa, Mycobacterium
GGYSYGGRIAALADAAREG

SEQ ID NO: 1240827 - protein, 21 aa, Mycobacterium
GHAAWALGVAKSMLDDVSDLA

SEQ ID NO: 1240828 - protein, 18 aa, Mycobacterium
GHADGVPDDGRWLRTGDL

SEQ ID NO: 1240829 - protein, 18 aa, Mycobacterium
GHAGFLGVERIRELIDAG

SEQ ID NO: 1240830 - protein, 20 aa, Mycobacterium
GHANHYLAVFDRATGSALDL

SEQ ID NO: 1240831 - protein, 20 aa, Mycobacterium
GHAPFSLAWMTAVGERTKRL

SEQ ID NO: 1240832 - protein, 23 aa, Mycobacterium
GHCIPCDPHYLLWQLKATRLPSP

SEQ ID NO: 1240833 - protein, 26 aa, Mycobacterium
GHERTMMWLGFADRIDNVIADFRPTT

SEQ ID NO: 1240834 - protein, 18 aa, Mycobacterium
GHEYCVLTDHSPRLTIAN

SEQ ID NO: 1240835 - protein, 23 aa, Mycobacterium
GHGDAVGVLAGFPVEIAPTAQGL

SEQ ID NO: 1240836 - protein, 25 aa, Mycobacterium
GHGEGWALYAERLMAELGWLDDDGA

SEQ ID NO: 1240837 - protein, 17 aa, Mycobacterium
GHGGHALIHYDNVRVPA

SEQ ID NO: 1240838 - protein, 21 aa, Mycobacterium
GHGPHRYFIVVHAVDVEKLDI

SEQ ID NO: 1240839 - protein, 26 aa, Mycobacterium
GHHCAWPLHRRFGITATARASFAVYN

SEQ ID NO: 1240840 - protein, 17 aa, Mycobacterium
GHIPGAVRLDWKTELQD

SEQ ID NO: 1240841 - protein, 24 aa, Mycobacterium
GHKSPEMTARYAATLAATAEAEFL

SEQ ID NO: 1240842 - protein, 24 aa, Mycobacterium
GHKWFGTVMAAGFDSLVSDRTNRM

SEQ ID NO: 1240843 - protein, 23 aa, Mycobacterium
GHLIEVNAGPVLKVQPNLRYATD

SEQ ID NO: 1240844 - protein, 25 aa, Mycobacterium
GHLLEIRGTCVLVDGVVKSLSPAGM

SEQ ID NO: 1240845 - protein, 17 aa, Mycobacterium
GHLRPGGVISGTREMSP

SEQ ID NO: 1240846 - protein, 24 aa, Mycobacterium
GHLTELFEAAGLRNVDEASIAAEV

SEQ ID NO: 1240847 - protein, 24 aa, Mycobacterium
GHLYLPSSFLSPLMNRRKDEYGGS

SEQ ID NO: 1240848 - protein, 18 aa, Mycobacterium
GHNLRRGPDMSGMLEPLF

SEQ ID NO: 1240849 - protein, 21 aa, Mycobacterium
GHNPIGIIVPCHRVIGANGSL

SEQ ID NO: 1240850 - protein, 21 aa, Mycobacterium
GHNRWHPDIPAAVTVKKGDSF

SEQ ID NO: 1240851 - protein, 29 aa, Mycobacterium
GHPDWTRYSGALALRIGPVAVTGFAVLTD

SEQ ID NO: 1240852 - protein, 20 aa, Mycobacterium
GHPLGASGVRIMTTLVNALE

SEQ ID NO: 1240853 - protein, 25 aa, Mycobacterium
GHQMRYDLAAGFPLITTKKVHLKSV

SEQ ID NO: 1240854 - protein, 25 aa, Mycobacterium
GHRHLFRLAGLAPRLDVAKTPDRVD

SEQ ID NO: 1240855 - protein, 23 aa, Mycobacterium
GHSEAIARISWCVDQCAIGVITG

SEQ ID NO: 1240856 - protein, 18 aa, Mycobacterium
GHSLRFIATPHVPHNWEA

SEQ ID NO: 1240857 - protein, 27 aa, Mycobacterium
GHTDLKFRLVREDFADAVAWVARNLPT

SEQ ID NO: 1240858 - protein, 21 aa, Mycobacterium
GHTRFPGVHIFEQSRNEDMLA

SEQ ID NO: 1240859 - protein, 18 aa, Mycobacterium
GHVHGGVCSLILDHLLGA

SEQ ID NO: 1240860 - protein, 18 aa, Mycobacterium
GIAAHEVNGVYALGGGAS

SEQ ID NO: 1240861 - protein, 18 aa, Mycobacterium
GIAAYRRYAALIQPEADR

SEQ ID NO: 1240862 - protein, 25 aa, Mycobacterium
GIAGFCMGGQFALLLGPGNFGASAP

SEQ ID NO: 1240863 - protein, 22 aa, Mycobacterium
GIAGGWDYAPTFVEAGLDIDWL

SEQ ID NO: 1240864 - protein, 23 aa, Mycobacterium
GIAHCGPLPPALAALVDIPVDRE

SEQ ID NO: 1240865 - protein, 19 aa, Mycobacterium
GIAPFDLVVVNLYPFSETV

SEQ ID NO: 1240866 - protein, 24 aa, Mycobacterium
GIARRLESGTVWVNDWHMVNAMYP

SEQ ID NO: 1240867 - protein, 23 aa, Mycobacterium
GIARRVLGGAIAFGGKSTEPSFA

SEQ ID NO: 1240868 - protein, 22 aa, Mycobacterium
GIASRLKQVAIRVGNDPARIRK

SEQ ID NO: 1240869 - protein, 18 aa, Mycobacterium
GIATEAWSPLGQGSLLAH

SEQ ID NO: 1240870 - protein, 20 aa, Mycobacterium
GIDATHAWASVWTPQDQWLG

SEQ ID NO: 1240871 - protein, 24 aa, Mycobacterium
GIDHVKVRSVLTCASATGVCAMCY

SEQ ID NO: 1240872 - protein, 25 aa, Mycobacterium
GIDRFPVEMIKRYFGGSHLLPGVPL

SEQ ID NO: 1240873 - protein, 17 aa, Mycobacterium
GIDSALMGLGRASIHDL

SEQ ID NO: 1240874 - protein, 24 aa, Mycobacterium
GIFTNARFASARVHLGAGDTLVLY

SEQ ID NO: 1240875 - protein, 19 aa, Mycobacterium
GIGAALCRALVAAGAEVLC

SEQ ID NO: 1240876 - protein, 22 aa, Mycobacterium
GIGEACARELAARGATVTVADR

SEQ ID NO: 1240877 - protein, 24 aa, Mycobacterium
GIGEKRFRVDADRFVLFPTVAHSH

SEQ ID NO: 1240878 - protein, 26 aa, Mycobacterium
GIGISTRTPRGWVARTYSQREGLQYF

SEQ ID NO: 1240879 - protein, 17 aa, Mycobacterium
GIGSLLLGLYTDEGDLQ

SEQ ID NO: 1240880 - protein, 19 aa, Mycobacterium
GIHSCPGAPLARAETRVGL

SEQ ID NO: 1240881 - protein, 21 aa, Mycobacterium
GILARAIVRLAMSYVSMPPEA

SEQ ID NO: 1240882 - protein, 23 aa, Mycobacterium
GINDEYPFLLGHEAAGTVESVGE

SEQ ID NO: 1240883 - protein, 26 aa, Mycobacterium
GINLPGVAFGHDWLASGMRYNGTLEH

SEQ ID NO: 1240884 - protein, 18 aa, Mycobacterium
GIPFDRYSQAGLFPIAYT

SEQ ID NO: 1240885 - protein, 18 aa, Mycobacterium
GIPIPGFSSALSYYDGLR

SEQ ID NO: 1240886 - protein, 21 aa, Mycobacterium
GIPLLRLAAQTALLEAEALGE

SEQ ID NO: 1240887 - protein, 18 aa, Mycobacterium
GIRLKLNPLKEVIRGKRL

SEQ ID NO: 1240888 - protein, 25 aa, Mycobacterium
GITRARVHLTLSWALARAPGGRQGR

SEQ ID NO: 1240889 - protein, 18 aa, Mycobacterium
GIVPPRDLVFAFVSDEEH

SEQ ID NO: 1240890 - protein, 20 aa, Mycobacterium
GIVSGGFRQVIEPLAHELMM

SEQ ID NO: 1240891 - protein, 19 aa, Mycobacterium
GKAKEVVGAVTGNDSLTAE

SEQ ID NO: 1240892 - protein, 19 aa, Mycobacterium
GKDISCNLGSLNIAKAMDS

SEQ ID NO: 1240893 - protein, 23 aa, Mycobacterium
GKDPRDAHFITSRICGICGDNHA

SEQ ID NO: 1240894 - protein, 17 aa, Mycobacterium
GKDWTPVQHQIWLDEMQ

SEQ ID NO: 1240895 - protein, 20 aa, Mycobacterium
GKGFAGTMKRHGFKGQGAAH

SEQ ID NO: 1240896 - protein, 19 aa, Mycobacterium
GKGGVLEFGTTVLAAKDGS

SEQ ID NO: 1240897 - protein, 19 aa, Mycobacterium
GKGKPGGGLHEVLPADLLA

SEQ ID NO: 1240898 - protein, 19 aa, Mycobacterium
GKGRRTVVITGTNGKSTTT

SEQ ID NO: 1240899 - protein, 17 aa, Mycobacterium
GKHLGVGVTSIYWYFRK

SEQ ID NO: 1240900 - protein, 26 aa, Mycobacterium
GKHLSFSGGRHFCLGAALARAEGEVG

SEQ ID NO: 1240901 - protein, 25 aa, Mycobacterium
GKHSAIAALPWFWSDQYDLKLQIAG

SEQ ID NO: 1240902 - protein, 25 aa, Mycobacterium
GKIELLRLAMDWAVAGDDADVPVSD

SEQ ID NO: 1240903 - protein, 23 aa, Mycobacterium
GKIPAGGGWRMLGRTIGNRNSKA

SEQ ID NO: 1240904 - protein, 21 aa, Mycobacterium
GKKLRAGVELDDGPARVDDFA

SEQ ID NO: 1240905 - protein, 24 aa, Mycobacterium
GKLDHLVDLGVDFVELMPVNAFGG

SEQ ID NO: 1240906 - protein, 36 aa, Mycobacterium
GKLGLKPGMTLLDIGCGWGATIMRAVEKYDVNVIGL

SEQ ID NO: 1240907 - protein, 26 aa, Mycobacterium
GKLLAFRDRMGWDLPWVSSGASTFNE

SEQ ID NO: 1240908 - protein, 20 aa, Mycobacterium
GKLPPGPAFYPDGELTDEPE

SEQ ID NO: 1240909 - protein, 25 aa, Mycobacterium
GKLPRLASAALAFSVVPGSLGGHMF

SEQ ID NO: 1240910 - protein, 18 aa, Mycobacterium
GKLTPLYPNQRLRLETSP

SEQ ID NO: 1240911 - protein, 27 aa, Mycobacterium
GKPERLRSGWLNGIKHWQVDYTGSAAK

SEQ ID NO: 1240912 - protein, 20 aa, Mycobacterium
GKPHVTWKFATSVDGRSAAA

SEQ ID NO: 1240913 - protein, 20 aa, Mycobacterium
GKPPRMLVRLHLDGTTDRPS

SEQ ID NO: 1240914 - protein, 18 aa, Mycobacterium
GKPSLVFPREAPRSLAEF

SEQ ID NO: 1240915 - protein, 25 aa, Mycobacterium
GKPVQRVCAVDGGIRIATALTATLA

SEQ ID NO: 1240916 - protein, 18 aa, Mycobacterium
GKQRVEVIQVLRALTVPG

SEQ ID NO: 1240917 - protein, 27 aa, Mycobacterium
GKQTIYRWWPSRPALVADVLLEDAHEI

SEQ ID NO: 1240918 - protein, 25 aa, Mycobacterium
GKRFSRVRILTALMLGRLERSPLYH

SEQ ID NO: 1240919 - protein, 18 aa, Mycobacterium
GKRGIVLNLRTEEGKAAL

SEQ ID NO: 1240920 - protein, 27 aa, Mycobacterium
GKRQAARFFYRYELPKVGPQLDLLDSL

SEQ ID NO: 1240921 - protein, 27 aa, Mycobacterium
GKRVDEMIEILKLVLAGGMVEFHGEFF

SEQ ID NO: 1240922 - protein, 19 aa, Mycobacterium
GKRYLVDFPSPVSYDKCII

SEQ ID NO: 1240923 - protein, 21 aa, Mycobacterium
GKSATTAWLIERLQRPTLLMA

SEQ ID NO: 1240924 - protein, 18 aa, Mycobacterium
GKSRWPNEIELLERLGMD

SEQ ID NO: 1240925 - protein, 23 aa, Mycobacterium
GKSTTIRMLLGFLRPSEGSAHVF

SEQ ID NO: 1240926 - protein, 31 aa, Mycobacterium
GKSVFQCPFCHGWEMRDKRIASLAAGEEAVH

SEQ ID NO: 1240927 - protein, 20 aa, Mycobacterium
GKTFPLPQPFLVMATQNPIE

SEQ ID NO: 1240928 - protein, 20 aa, Mycobacterium
GKTLAAFLWAIDRLASSEPR

SEQ ID NO: 1240929 - protein, 17 aa, Mycobacterium
GKTTCFNAITGVYRPSS

SEQ ID NO: 1240930 - protein, 24 aa, Mycobacterium
GKVLSRYVDAIVWRTFAQERLTSM

SEQ ID NO: 1240931 - protein, 24 aa, Mycobacterium
GKVRTFPLGPGFLLDGRPVILTAP

SEQ ID NO: 1240932 - protein, 19 aa, Mycobacterium
GLADCTIALGFEKMQPGSL

SEQ ID NO: 1240933 - protein, 18 aa, Mycobacterium
GLADIEWTVQLMQLRFAH

SEQ ID NO: 1240934 - protein, 18 aa, Mycobacterium
GLADLFGPRERWGTTQHT

SEQ ID NO: 1240935 - protein, 21 aa, Mycobacterium
GLADMVRVAGWLRDSDIEVDD

SEQ ID NO: 1240936 - protein, 20 aa, Mycobacterium
GLADRGRIAVGYKADLNVID

SEQ ID NO: 1240937 - protein, 18 aa, Mycobacterium
GLADRVEVQVAYAIGKAA

SEQ ID NO: 1240938 - protein, 19 aa, Mycobacterium
GLAGIPWFLIEALLDQGAD

SEQ ID NO: 1240939 - protein, 23 aa, Mycobacterium
GLAKRLEEVWVPSGSDLGPEPII

SEQ ID NO: 1240940 - protein, 25 aa, Mycobacterium
GLAKTRLAVTVGFEMAAVIASAALL

SEQ ID NO: 1240941 - protein, 20 aa, Mycobacterium
GLALALVYRDGRLERAATRG

SEQ ID NO: 1240942 - protein, 17 aa, Mycobacterium
GLAQRMSAGRGILHSEK

SEQ ID NO: 1240943 - protein, 20 aa, Mycobacterium
GLAQVQARAVAAVREHDRRL

SEQ ID NO: 1240944 - protein, 17 aa, Mycobacterium
GLARAYVSGDLELTGVH

SEQ ID NO: 1240945 - protein, 19 aa, Mycobacterium
GLCERHRHLFQAMLEVRGS

SEQ ID NO: 1240946 - protein, 18 aa, Mycobacterium
GLDAGLSIDKFAPRLSFF

SEQ ID NO: 1240947 - protein, 23 aa, Mycobacterium
GLDERYVREWLGGTVAARVVDYD

SEQ ID NO: 1240948 - protein, 18 aa, Mycobacterium
GLDLVRAQLLVAMGRPLP

SEQ ID NO: 1240949 - protein, 20 aa, Mycobacterium
GLDPARVSLSRNLEADEADL

SEQ ID NO: 1240950 - protein, 25 aa, Mycobacterium
GLDSRAYRLDWPSGTTVYEIDQPKV

SEQ ID NO: 1240951 - protein, 29 aa, Mycobacterium
GLDSRAYRLPWPAGTVVFEIDQPGVITFK

SEQ ID NO: 1240952 - protein, 26 aa, Mycobacterium
GLDSRAYRLPWPDGTVVYELDQPRVL

SEQ ID NO: 1240953 - protein, 19 aa, Mycobacterium
GLDYEIWDDGWTVATKDRK

SEQ ID NO: 1240954 - protein, 21 aa, Mycobacterium
GLEAAKPFIKVLCEAQQELAG

SEQ ID NO: 1240955 - protein, 17 aa, Mycobacterium
GLEHGVEVAGYWGEAVT

SEQ ID NO: 1240956 - protein, 20 aa, Mycobacterium
GLEIALACHHRIAADVKGSV

SEQ ID NO: 1240957 - protein, 27 aa, Mycobacterium
GLEKCIGCELCAWACPADAIYVEGDDN

SEQ ID NO: 1240958 - protein, 18 aa, Mycobacterium
GLELRNPLLAAASPLSRT

SEQ ID NO: 1240959 - protein, 22 aa, Mycobacterium
GLELSTGVAVAFPRSPFVTAAT

SEQ ID NO: 1240960 - protein, 23 aa, Mycobacterium
GLEMAAFCGWVVSSPDAVFGLPE

SEQ ID NO: 1240961 - protein, 18 aa, Mycobacterium
GLENFWKEQTCHPPSQLQ

SEQ ID NO: 1240962 - protein, 30 aa, Mycobacterium
GLENMRYKWRKWLYFDCNWKVAMEAFNETY

SEQ ID NO: 1240963 - protein, 24 aa, Mycobacterium
GLERRYLLVPGLRSSRVHVFDTRP

SEQ ID NO: 1240964 - protein, 18 aa, Mycobacterium
GLESVLWAGPEQVAGARR

SEQ ID NO: 1240965 - protein, 20 aa, Mycobacterium
GLETLSLRVERHVANAQKVA

SEQ ID NO: 1240966 - protein, 26 aa, Mycobacterium
GLFDGIGVRAAIPVIRAFTHFALLAN

SEQ ID NO: 1240967 - protein, 25 aa, Mycobacterium
GLGCELRHAHRLVYSEGLDLSGENA

SEQ ID NO: 1240968 - protein, 20 aa, Mycobacterium
GLGLEFLRHIERCAVLVHVV

SEQ ID NO: 1240969 - protein, 17 aa, Mycobacterium
GLGRALGTEDVFRPYGV

SEQ ID NO: 1240970 - protein, 18 aa, Mycobacterium
GLGREIAFGAARCGADVV

SEQ ID NO: 1240971 - protein, 19 aa, Mycobacterium
GLGREYALTLAREGAAVVV

SEQ ID NO: 1240972 - protein, 17 aa, Mycobacterium
GLHCSRIDGSPLIYNRE

SEQ ID NO: 1240973 - protein, 23 aa, Mycobacterium
GLHFCLGSSLARMQARVALEEVL

SEQ ID NO: 1240974 - protein, 38 aa, Mycobacterium
GLHGEAYRGHIFWDELFIFPVLNLRLPMITRSLLAYRY

SEQ ID NO: 1240975 - protein, 19 aa, Mycobacterium
GLHYCLGANLARLEGRVAL

SEQ ID NO: 1240976 - protein, 25 aa, Mycobacterium
GLIDERGMLTFAELDDASDALAVAL

SEQ ID NO: 1240977 - protein, 19 aa, Mycobacterium
GLINAHGPYAVGITGEDAH

SEQ ID NO: 1240978 - protein, 21 aa, Mycobacterium
GLKPRRARTSFAPAGHLLEGL

SEQ ID NO: 1240979 - protein, 21 aa, Mycobacterium
GLKSYRGDMINGFAPDAAARQ

SEQ ID NO: 1240980 - protein, 19 aa, Mycobacterium
GLKYPEWDGKRKAYRPDWC

SEQ ID NO: 1240981 - protein, 21 aa, Mycobacterium
GLLADCGRGEVIGSLAREGGL

SEQ ID NO: 1240982 - protein, 26 aa, Mycobacterium
GLLDRLTSIPLWAAIEAFCADKTRNE

SEQ ID NO: 1240983 - protein, 26 aa, Mycobacterium
GLLGDPDFLLTIGLLPLQTAYALNTA

SEQ ID NO: 1240984 - protein, 25 aa, Mycobacterium
GLLGSLRIGNRFVHTGRPTPEAYAQ

SEQ ID NO: 1240985 - protein, 18 aa, Mycobacterium
GLLRSRLTLDTARDRPLA

SEQ ID NO: 1240986 - protein, 26 aa, Mycobacterium
GLMGLAAEEMIRWVTPVKAFMRTAAQ

SEQ ID NO: 1240987 - protein, 21 aa, Mycobacterium
GLMLGEYWDLGALAADCAADG

SEQ ID NO: 1240988 - protein, 17 aa, Mycobacterium
GLMLIHLDIDAAVAVIR

SEQ ID NO: 1240989 - protein, 17 aa, Mycobacterium
GLNAGRAMAQGNMAAQR

SEQ ID NO: 1240990 - protein, 27 aa, Mycobacterium
GLNAVIRAVVRTCDVRYGSSVVGFQDG

SEQ ID NO: 1240991 - protein, 23 aa, Mycobacterium
GLNIPTGIPLRYDLDSDLKPTVA

SEQ ID NO: 1240992 - protein, 21 aa, Mycobacterium
GLNWYRAMPFMDPRATGGKIT

SEQ ID NO: 1240993 - protein, 25 aa, Mycobacterium
GLPADLKFKLVEPLRLLFKDEVRAV

SEQ ID NO: 1240994 - protein, 21 aa, Mycobacterium
GLPDVPGYAAKVFRAVADADV

SEQ ID NO: 1240995 - protein, 20 aa, Mycobacterium
GLPEELADLSVFRVALHQPR

SEQ ID NO: 1240996 - protein, 17 aa, Mycobacterium
GLPELRAIFGELLGIPV

SEQ ID NO: 1240997 - protein, 20 aa, Mycobacterium
GLPLTMSRVRFIKFIMDEIY

SEQ ID NO: 1240998 - protein, 21 aa, Mycobacterium
GLPPALVLTGGFDPLRDEGNR

SEQ ID NO: 1240999 - protein, 18 aa, Mycobacterium
GLQGSGWAVLGYDTLGQR

SEQ ID NO: 1241000 - protein, 25 aa, Mycobacterium
GLQPLRPPVSFGFASAPAAPQLVAV

SEQ ID NO: 1241001 - protein, 26 aa, Mycobacterium
GLRAAARVYAGWGFSQAFYWQQEYKK

SEQ ID NO: 1241002 - protein, 17 aa, Mycobacterium
GLRAVRILARHDASIAQ

SEQ ID NO: 1241003 - protein, 18 aa, Mycobacterium
GLRELLLRYDGRADRPLL

SEQ ID NO: 1241004 - protein, 29 aa, Mycobacterium
GLRKLLPQEWVRFGWYFLVSRRDPAGLRE

SEQ ID NO: 1241005 - protein, 22 aa, Mycobacterium
GLRLAGRKVVIVGGGTVAQRRL

SEQ ID NO: 1241006 - protein, 21 aa, Mycobacterium
GLRLIVIDYLQLMTSGKKVES

SEQ ID NO: 1241007 - protein, 19 aa, Mycobacterium
GLRPPPPVCYPLAEGPAAL

SEQ ID NO: 1241008 - protein, 23 aa, Mycobacterium
GLRQFEICTPFADPPLGASDNYL

SEQ ID NO: 1241009 - protein, 19 aa, Mycobacterium
GLRRCVTALASQYGDSPAM

SEQ ID NO: 1241010 - protein, 18 aa, Mycobacterium
GLRRGALVAVEVVAEGRA

SEQ ID NO: 1241011 - protein, 17 aa, Mycobacterium
GLRRTTVRFADEGAVRR

SEQ ID NO: 1241012 - protein, 23 aa, Mycobacterium
GLRTRLFAAPGWTVSQGTVMALP

SEQ ID NO: 1241013 - protein, 23 aa, Mycobacterium
GLSAEAPVGLWGYSGGGLASAWA

SEQ ID NO: 1241014 - protein, 24 aa, Mycobacterium
GLSDGRFAVYVKFHHALIDGVSAL

SEQ ID NO: 1241015 - protein, 18 aa, Mycobacterium
GLSEALADRASRMRDLGL

SEQ ID NO: 1241016 - protein, 28 aa, Mycobacterium
GLSEALRGFPPVPSRWLDPAALPEWLVP

SEQ ID NO: 1241017 - protein, 18 aa, Mycobacterium
GLSIRETILFPIVRRHGG

SEQ ID NO: 1241018 - protein, 18 aa, Mycobacterium
GLSKEFRSLLDRVPPANP

SEQ ID NO: 1241019 - protein, 20 aa, Mycobacterium
GLSSQRFATAVGVDIKSVRR

SEQ ID NO: 1241020 - protein, 18 aa, Mycobacterium
GLSTRFDDVTARNRAQIA

SEQ ID NO: 1241021 - protein, 19 aa, Mycobacterium
GLSWGFDRIFAATMNHSVW

SEQ ID NO: 1241022 - protein, 23 aa, Mycobacterium
GLSWRTYLLHARMLRAMALLAAP

SEQ ID NO: 1241023 - protein, 18 aa, Mycobacterium
GLTAQFGGMIGFVDGTIH

SEQ ID NO: 1241024 - protein, 18 aa, Mycobacterium
GLTDVCVHYTFADAHQRD

SEQ ID NO: 1241025 - protein, 25 aa, Mycobacterium
GLTEADVCYLAMPLFHSNAVYAGWS

SEQ ID NO: 1241026 - protein, 23 aa, Mycobacterium
GLTEVCGVISHLMPEAHRDAEHP

SEQ ID NO: 1241027 - protein, 21 aa, Mycobacterium
GLTHGPVEWFSTYRVHHRVSA

SEQ ID NO: 1241028 - protein, 23 aa, Mycobacterium
GLTIARMRPGFIVQRSAAGGLRR

SEQ ID NO: 1241029 - protein, 23 aa, Mycobacterium
GLTKHLAVEWADRGIRVNAVAPG

SEQ ID NO: 1241030 - protein, 21 aa, Mycobacterium
GLTMAHLRGTLDAFARAQFGP

SEQ ID NO: 1241031 - protein, 18 aa, Mycobacterium
GLTSALCYSARPDPSYDP

SEQ ID NO: 1241032 - protein, 19 aa, Mycobacterium
GLTSKPWVKTTMAPGSQVV

SEQ ID NO: 1241033 - protein, 26 aa, Mycobacterium
GLTVESWRVHRCIGMDGSTLLDNLVP

SEQ ID NO: 1241034 - protein, 19 aa, Mycobacterium
GLTYPGIGFVVWRNAEQLP

SEQ ID NO: 1241035 - protein, 23 aa, Mycobacterium
GLVAGALRLTADYVANRHQFGRP

SEQ ID NO: 1241036 - protein, 25 aa, Mycobacterium
GLVAVDCRFCHVSVKVKKLGRGHTS

SEQ ID NO: 1241037 - protein, 19 aa, Mycobacterium
GLVDEYRIVLAPVAVGGGT

SEQ ID NO: 1241038 - protein, 18 aa, Mycobacterium
GLVKRSRDPSDLRAVLVE

SEQ ID NO: 1241039 - protein, 19 aa, Mycobacterium
GLVPPWAVVGLGRQDELLS

SEQ ID NO: 1241040 - protein, 20 aa, Mycobacterium
GLVRAIFFEGFRRLGRDLAS

SEQ ID NO: 1241041 - protein, 17 aa, Mycobacterium
GLVTEVVPHAELLPTAR

SEQ ID NO: 1241042 - protein, 19 aa, Mycobacterium
GLWFEEFETGVVYQHRPGR

SEQ ID NO: 1241043 - protein, 17 aa, Mycobacterium
GLYAVVVDREMSALLDG

SEQ ID NO: 1241044 - protein, 18 aa, Mycobacterium
GMAARTRFFDDFFSDAAD

SEQ ID NO: 1241045 - protein, 23 aa, Mycobacterium
GMELFCAGTHPFANWSTQQLTDA

SEQ ID NO: 1241046 - protein, 19 aa, Mycobacterium
GMGELHLDILVDRMRREFK

SEQ ID NO: 1241047 - protein, 24 aa, Mycobacterium
GMGGSIPFIAEFAAAFPQATILVT

SEQ ID NO: 1241048 - protein, 25 aa, Mycobacterium
GMGIDKPNVRFVVHASVPDSLDSYY

SEQ ID NO: 1241049 - protein, 18 aa, Mycobacterium
GMLKYGFDDARPVLERAS

SEQ ID NO: 1241050 - protein, 18 aa, Mycobacterium
GMLTGVTVLNNWIRQGVV

SEQ ID NO: 1241051 - protein, 22 aa, Mycobacterium
GMPKGVLWRQHDIFLSSMGGRP

SEQ ID NO: 1241052 - protein, 22 aa, Mycobacterium
GMPKGVLWRQHDIFMTAFGGRS

SEQ ID NO: 1241053 - protein, 25 aa, Mycobacterium
GMRLVGMPLDYRWPDRQLPSEGATR

SEQ ID NO: 1241054 - protein, 31 aa, Mycobacterium; identical to SEQ ID NO: 668957

SEQ ID NO: 1241055 - protein, 29 aa, Mycobacterium
GMTKTLYKMPWSTMFPLGISSATIGICEG

SEQ ID NO: 1241056 - protein, 29 aa, Mycobacterium
GMTLLDVGCGWGYTMMRAVEKYDVNVIGL

SEQ ID NO: 1241057 - protein, 18 aa, Mycobacterium
GMVARRSGGILISGSAAG

SEQ ID NO: 1241058 - protein, 29 aa, Mycobacterium
GMVSPTVFWPIPRVYSGLVRIDRYETSPW

SEQ ID NO: 1241059 - protein, 23 aa, Mycobacterium
GMVWKYPDTFVVGREQIRQYAKS

SEQ ID NO: 1241060 - protein, 17 aa, Mycobacterium
GNAALFFATEEAGYITG

SEQ ID NO: 1241061 - protein, 20 aa, Mycobacterium
GNAESVLRMARDCHDDNAAL

SEQ ID NO: 1241062 - protein, 21 aa, Mycobacterium
GNALDGARFVLENVTPFGRGM

SEQ ID NO: 1241063 - protein, 18 aa, Mycobacterium
GNALGAVTHWTALQDDYD

SEQ ID NO: 1241064 - protein, 24 aa, Mycobacterium
GNCGVGFAPVRPGSEEWLIKLMEG

SEQ ID NO: 1241065 - protein, 25 aa, Mycobacterium
GNGPSGELLLVWPNVIAVERQLRVS

SEQ ID NO: 1241066 - protein, 27 aa, Mycobacterium
GNHFYCYSFEPSDRWTHFFAEQPELQA

SEQ ID NO: 1241067 - protein, 21 aa, Mycobacterium
GNHHLAFGFGPHGCIGQQLAR

SEQ ID NO: 1241068 - protein, 22 aa, Mycobacterium
GNHRAIDALSHVGVKSAVKMPS

SEQ ID NO: 1241069 - protein, 18 aa, Mycobacterium
GNLSRYWRDARTHTLHDP

SEQ ID NO: 1241070 - protein, 17 aa, Mycobacterium
GNPRFAPSQDVPRFPYA

SEQ ID NO: 1241071 - protein, 18 aa, Mycobacterium
GNPVFLKDIWPSQQDIND

SEQ ID NO: 1241072 - protein, 22 aa, Mycobacterium
GNPVVLPTVWDAWSANLAVGAG

SEQ ID NO: 1241073 - protein, 21 aa, Mycobacterium
GNQAVDCLLYSAADTAIRYSA

SEQ ID NO: 1241074 - protein, 21 aa, Mycobacterium
GNQEPMYWRGARLDGNYPFSI

SEQ ID NO: 1241075 - protein, 26 aa, Mycobacterium
GNQLARLELRLMLTKVLDRLPDLRLA

SEQ ID NO: 1241076 - protein, 40 aa, Mycobacterium
GNRDAPLLVRFCDEWAGRGWLAVRYNLPYRRRRPKGPPSG

SEQ ID NO: 1241077 - protein, 19 aa, Mycobacterium
GNRGFFVMERLEGVVPMPH

SEQ ID NO: 1241078 - protein, 23 aa, Mycobacterium
GNTDPQYSEWLAFSGTSVTLDGE

SEQ ID NO: 1241079 - protein, 20 aa, Mycobacterium
GNTIAMRVCIVIIVRADGLI

SEQ ID NO: 1241080 - protein, 28 aa, Mycobacterium
GNVMPPRGVGVIELRGECVTPGYMTMGG

SEQ ID NO: 1241081 - protein, 24 aa, Mycobacterium
GPAALREARRGMALAAGLHLPLVL

SEQ ID NO: 1241082 - protein, 26 aa, Mycobacterium
GPAGRLPVTYSRKVFIPVTHLCRDTC

SEQ ID NO: 1241083 - protein, 23 aa, Mycobacterium
GPALMVSDLFDFSVYVDARLEDI

SEQ ID NO: 1241084 - protein, 19 aa, Mycobacterium
GPAWPRLETDTHLACIGSG

SEQ ID NO: 1241085 - protein, 30 aa, Mycobacterium
GPDASMLLMFNRILPAAGMHHMSRLVMGIP

SEQ ID NO: 1241086 - protein, 23 aa, Mycobacterium
GPDELRRLALLKIVHGLGLPLGT

SEQ ID NO: 1241087 - protein, 17 aa, Mycobacterium
GPDGASHNGMWDLSVLG

SEQ ID NO: 1241088 - protein, 35 aa, Mycobacterium
GPDGSTSLVKFHWKPRLGVHSLVWEEAQIAAGMDP

SEQ ID NO: 1241089 - protein, 27 aa, Mycobacterium
GPDGTLLRVRARWCIGADGAASAVRRA

SEQ ID NO: 1241090 - protein, 18 aa, Mycobacterium
GPDGVFLTCLGGREGDDD

SEQ ID NO: 1241091 - protein, 26 aa, Mycobacterium
GPDLRRLRTEVVARLWAARPTGVLER

SEQ ID NO: 1241092 - protein, 22 aa, Mycobacterium
GPDPYCSRGALRRVEDRLAAAG

SEQ ID NO: 1241093 - protein, 23 aa, Mycobacterium
GPEAPRFSVAVMELGATVCTART

SEQ ID NO: 1241094 - protein, 18 aa, Mycobacterium
GPELRALAQAILNRVDPA

SEQ ID NO: 1241095 - protein, 18 aa, Mycobacterium
GPEPHRDALFAAIKKERE

SEQ ID NO: 1241096 - protein, 19 aa, Mycobacterium
GPFLTDVSKAWDFSGTENP

SEQ ID NO: 1241097 - protein, 18 aa, Mycobacterium
GPFWARRDEGAWSIPKGE

SEQ ID NO: 1241098 - protein, 28 aa, Mycobacterium
GPFYDGAVFHRVIDGFMIQGGDPTGTGR

SEQ ID NO: 1241099 - protein, 28 aa, Mycobacterium
GPGDRWIHEQIRAVAPRTTLVVIVTKID

SEQ ID NO: 1241100 - protein, 23 aa, Mycobacterium
GPGENIPAWLIFDQQYRDRYIFA

SEQ ID NO: 1241101 - protein, 18 aa, Mycobacterium
GPGFAIGAARARPAAPVV

SEQ ID NO: 1241102 - protein, 24 aa, Mycobacterium
GPGIFATVMSLAFSPRDRSFTAVR

SEQ ID NO: 1241103 - protein, 21 aa, Mycobacterium
GPGKAHAVQAFAARNGVDLSK

SEQ ID NO: 1241104 - protein, 24 aa, Mycobacterium
GPGVTGWRNFRGVLPAFSAHFRCL

SEQ ID NO: 1241105 - protein, 23 aa, Mycobacterium
GPHAAPDFFTRADIETLCAAEYR

SEQ ID NO: 1241106 - protein, 19 aa, Mycobacterium
GPHLDRFLATLAHATDRPV

SEQ ID NO: 1241107 - protein, 24 aa, Mycobacterium
GPIEAITLLPLFFELDGTFPNHEA

SEQ ID NO: 1241108 - protein, 17 aa, Mycobacterium
GPISRYLGPWVAEPEIW

SEQ ID NO: 1241109 - protein, 17 aa, Mycobacterium
GPKPRWARPDGGEAGLH

SEQ ID NO: 1241110 - protein, 17 aa, Mycobacterium
GPKTVRSAAAWADGMAG

SEQ ID NO: 1241111 - protein, 25 aa, Mycobacterium
GPLIEALGLTVGWITAESTAEERRR

SEQ ID NO: 1241112 - protein, 19 aa, Mycobacterium
GPLRNSRTGSVYIVKPKMH

SEQ ID NO: 1241113 - protein, 19 aa, Mycobacterium
GPLTRAVREGAIFYLDEVV

SEQ ID NO: 1241114 - protein, 18 aa, Mycobacterium
GPLTRLTVYVRRGQRISG

SEQ ID NO: 1241115 - protein, 18 aa, Mycobacterium
GPLVLRAAAPGQIVPVDS

SEQ ID NO: 1241116 - protein, 17 aa, Mycobacterium
GPMAFERSGRAPADVDI

SEQ ID NO: 1241117 - protein, 25 aa, Mycobacterium
GPMDRFHRRLLWPIRAAGGEVIGFG

SEQ ID NO: 1241118 - protein, 18 aa, Mycobacterium
GPPVDVVVCHLFRDERLD

SEQ ID NO: 1241119 - protein, 20 aa, Mycobacterium
GPPYRLNPPVLRTPQPAPRL

SEQ ID NO: 1241120 - protein, 18 aa, Mycobacterium
GPQFPFTEAVSFTVACKD

SEQ ID NO: 1241121 - protein, 25 aa, Mycobacterium
GPQSSVSIGLRLGATHIVMERFDAE

SEQ ID NO: 1241122 - protein, 18 aa, Mycobacterium
GPRHPQWYYNLKAHPECE

SEQ ID NO: 1241123 - protein, 25 aa, Mycobacterium
GPRLRECTRLVLAIEGRSIGEAFGS

SEQ ID NO: 1241124 - protein, 27 aa, Mycobacterium
GPRLSKFEVLTAMAFAAFADAPVDVAV

SEQ ID NO: 1241125 - protein, 18 aa, Mycobacterium
GPRRAAWAAALYLPKNYG

SEQ ID NO: 1241126 - protein, 18 aa, Mycobacterium
GPSELLDDMIEHWEDNGD

SEQ ID NO: 1241127 - protein, 17 aa, Mycobacterium
GPSSTTTFVSWLPFYHD

SEQ ID NO: 1241128 - protein, 25 aa, Mycobacterium
GPSTGTNLWGAFGLLAEMKAQGRSG

SEQ ID NO: 1241129 - protein, 19 aa, Mycobacterium
GPTAEFFTKTGFIRANHEN

SEQ ID NO: 1241130 - protein, 17 aa, Mycobacterium
GPTAIAFVQGEPVDAAK

SEQ ID NO: 1241131 - protein, 20 aa, Mycobacterium
GPTALLAPKWVPWQDRVRPG

SEQ ID NO: 1241132 - protein, 19 aa, Mycobacterium
GPTAMALCEFSHRDVVIGT

SEQ ID NO: 1241133 - protein, 22 aa, Mycobacterium
GPTGCGKTYLAQTLAKMLNVPF

SEQ ID NO: 1241134 - protein, 21 aa, Mycobacterium
GPTIRELFCRAAERGVVVKGL

SEQ ID NO: 1241135 - protein, 18 aa, Mycobacterium
GPVKRAGGISGWQTTPSV

SEQ ID NO: 1241136 - protein, 25 aa, Mycobacterium
GPVRILCAMPFFWIGGLLAATGALH

SEQ ID NO: 1241137 - protein, 18 aa, Mycobacterium
GPVTDSRVAAFVERARAG

SEQ ID NO: 1241138 - protein, 22 aa, Mycobacterium
GPWIADRLLELGVELAHITICG

SEQ ID NO: 1241139 - protein, 18 aa, Mycobacterium
GPWREKLAAATMLGQSKS

SEQ ID NO: 1241140 - protein, 17 aa, Mycobacterium
GPYALACAARMPERVVG

SEQ ID NO: 1241141 - protein, 26 aa, Mycobacterium
GPYENEWGWTWPMNRRVLYNRASADP

SEQ ID NO: 1241142 - protein, 20 aa, Mycobacterium
GPYLDRVGLRDGQQRHPSDN

SEQ ID NO: 1241143 - protein, 22 aa, Mycobacterium
GQAKASFVAVEFDEFGGGRGPQ

SEQ ID NO: 1241144 - protein, 24 aa, Mycobacterium
GQDKLRLLLEFADDLPALPSELEE

SEQ ID NO: 1241145 - protein, 23 aa, Mycobacterium
GQDPRLAPAPVLERQADQRSDEW

SEQ ID NO: 1241146 - protein, 17 aa, Mycobacterium
GQFCLANTIAVAPAAAN

SEQ ID NO: 1241147 - protein, 25 aa, Mycobacterium
GQFVPVMFTRMLKLPEDVRKSYDVS

SEQ ID NO: 1241148 - protein, 17 aa, Mycobacterium
GQGGYRLTGEKYYSTGT

SEQ ID NO: 1241149 - protein, 23 aa, Mycobacterium
GQHVFPIPAGIIGTHSGPFLASA

SEQ ID NO: 1241150 - protein, 21 aa, Mycobacterium
GQKDYNAWIAKIACERIDRGV

SEQ ID NO: 1241151 - protein, 19 aa, Mycobacterium
GQKGFRIGRVCTRRDARGH

SEQ ID NO: 1241152 - protein, 24 aa, Mycobacterium
GQLGRDRVPVFLLPANPVSALVVF

SEQ ID NO: 1241153 - protein, 17 aa, Mycobacterium
GQLPEPSPAVLLDDPVE

SEQ ID NO: 1241154 - protein, 17 aa, Mycobacterium
GQLQGRRCGACRLEIDR

SEQ ID NO: 1241155 - protein, 23 aa, Mycobacterium
GQLRVGMAASFVRCEDPALLAQA

SEQ ID NO: 1241156 - protein, 21 aa, Mycobacterium
GQLTCSAWPAGAGALLSIAFP

SEQ ID NO: 1241157 - protein, 25 aa, Mycobacterium
GQMSECYRVSLTYADAATAGPESVV

SEQ ID NO: 1241158 - protein, 21 aa, Mycobacterium
GQNRFSWKNTGQILADAGLHV

SEQ ID NO: 1241159 - protein, 19 aa, Mycobacterium
GQNRLPCVYLVDSGGAFLP

SEQ ID NO: 1241160 - protein, 23 aa, Mycobacterium
GQPARLPFWRGDGVGRPAELGAA

SEQ ID NO: 1241161 - protein, 20 aa, Mycobacterium
GQPVCALLAGGGYAENVTVP

SEQ ID NO: 1241162 - protein, 24 aa, Mycobacterium
GQQGELWFRTPQLMKGYHNKPEAT

SEQ ID NO: 1241163 - protein, 23 aa, Mycobacterium
GQRRFWFMWDDLIRGAIGAIILV

SEQ ID NO: 1241164 - protein, 24 aa, Mycobacterium
GQSAHLWTRTSLRPSDVDVAELYD

SEQ ID NO: 1241165 - protein, 24 aa, Mycobacterium
GQSGRWVPDFLSLPIAVENSLKNQ

SEQ ID NO: 1241166 - protein, 22 aa, Mycobacterium
GQSLAQLALAWVLRDPTVASTL

SEQ ID NO: 1241167 - protein, 17 aa, Mycobacterium
GQSRLDLAAANVAMAQT

SEQ ID NO: 1241168 - protein, 19 aa, Mycobacterium
GQVGEIWVHGANVARGYWQ

SEQ ID NO: 1241169 - protein, 18 aa, Mycobacterium
GQVLLRFLSAGICGSDLP

SEQ ID NO: 1241170 - protein, 21 aa, Mycobacterium
GQWGSALSFAGAQFGLEVEVW

SEQ ID NO: 1241171 - protein, 24 aa, Mycobacterium
GRAAARHGMKISFSPVPFADAAGN

SEQ ID NO: 1241172 - protein, 23 aa, Mycobacterium
GRAASLELPHLWGGLADLPTGPG

SEQ ID NO: 1241173 - protein, 19 aa, Mycobacterium
GRAATMLHFSHAVTDGVGG

SEQ ID NO: 1241174 - protein, 17 aa, Mycobacterium
GRADWARVTGLDADGSP

SEQ ID NO: 1241175 - protein, 18 aa, Mycobacterium
GRAERLAGGPAHFRAILE

SEQ ID NO: 1241176 - protein, 22 aa, Mycobacterium
GRAGKPCRRCGTPIRRDGNGDR

SEQ ID NO: 1241177 - protein, 23 aa, Mycobacterium
GRAGVELHFERFAAPPVVDGAPF

SEQ ID NO: 1241178 - protein, 17 aa, Mycobacterium
GRAIGVIYLPATERQSH

SEQ ID NO: 1241179 - protein, 20 aa, Mycobacterium
GRAKTGRNGAAWQVTTVRAL

SEQ ID NO: 1241180 - protein, 18 aa, Mycobacterium
GRAMKVLAAMAVQALDFA

SEQ ID NO: 1241181 - protein, 19 aa, Mycobacterium
GRAPAGFICESVYGNAGGM

SEQ ID NO: 1241182 - protein, 26 aa, Mycobacterium
GRARVAKVLPGHVEIVRELLFDSLSD

SEQ ID NO: 1241183 - protein, 18 aa, Mycobacterium
GRAVVVFQPHLYSRTETF

SEQ ID NO: 1241184 - protein, 25 aa, Mycobacterium
GRAYDPRFLFAWPSAKAAVMGGTQL

SEQ ID NO: 1241185 - protein, 30 aa, Mycobacterium
GRAYSDTALLRWACAFEATGARRTPPPRTP

SEQ ID NO: 1241186 - protein, 25 aa, Mycobacterium
GRDAGRAVYVYGIVPADVAVEEDAV

SEQ ID NO: 1241187 - protein, 20 aa, Mycobacterium
GRDDLALRIAVQPGGCAGLR

SEQ ID NO: 1241188 - protein, 22 aa, Mycobacterium
GRDFRINILAAYDAADELRAAH

SEQ ID NO: 1241189 - protein, 25 aa, Mycobacterium
GRDPDSVRVWSCFATVGDHLPEELR

SEQ ID NO: 1241190 - protein, 24 aa, Mycobacterium
GREPRGVLEIAYRCPNGEPGVVKT

SEQ ID NO: 1241191 - protein, 19 aa, Mycobacterium
GREVCIFSQDATVFGGSLG

SEQ ID NO: 1241192 - protein, 17 aa, Mycobacterium
GRFEFRHGPIFTNLLLA

SEQ ID NO: 1241193 - protein, 21 aa, Mycobacterium
GRFLREKVPGVQIVAAEPRYG

SEQ ID NO: 1241194 - protein, 22 aa, Mycobacterium
GRFPCDLYDLMTLWQIASTNPW

SEQ ID NO: 1241195 - protein, 19 aa, Mycobacterium
GRFPSYLVEHMTGVEEVVR

SEQ ID NO: 1241196 - protein, 25 aa, Mycobacterium
GRFSGWQSSRQWVWGELDEARCGPV

SEQ ID NO: 1241197 - protein, 17 aa, Mycobacterium
GRGADVWDDLHPTAEQQ

SEQ ID NO: 1241198 - protein, 20 aa, Mycobacterium
GRGEGFCAGFDLSAYAEGSS

SEQ ID NO: 1241199 - protein, 19 aa, Mycobacterium
GRGGFAGMLLGSVSSAVAQ

SEQ ID NO: 1241200 - protein, 19 aa, Mycobacterium
GRGGFAGMLLGSVSSTVVH

SEQ ID NO: 1241201 - protein, 20 aa, Mycobacterium
GRGLVDVPFLGPALSDDLGR

SEQ ID NO: 1241202 - protein, 26 aa, Mycobacterium
GRGLVLRPGLTLALEPWFARGTDRIV

SEQ ID NO: 1241203 - protein, 19 aa, Mycobacterium
GRGPRIEHTGGIAVRRTGS

SEQ ID NO: 1241204 - protein, 25 aa, Mycobacterium
GRGTYKMVFGHRGINVPVMDHATGR

SEQ ID NO: 1241205 - protein, 19 aa, Mycobacterium
GRGVANPIGAVWSAALMLE

SEQ ID NO: 1241206 - protein, 29 aa, Mycobacterium
GRGVGHLRLRGDECWTLLTTMQEIKGHEE

SEQ ID NO: 1241207 - protein, 21 aa, Mycobacterium
GRHADGWWPAGAWTPQHYADM

SEQ ID NO: 1241208 - protein, 18 aa, Mycobacterium
GRHVLDILGKRRGDLTAD

SEQ ID NO: 1241209 - protein, 27 aa, Mycobacterium
GRIEDGWAVNECRPMTGIGGGSDRSVT

SEQ ID NO: 1241210 - protein, 19 aa, Mycobacterium
GRIHRCAADQLPASSTVTS

SEQ ID NO: 1241211 - protein, 17 aa, Mycobacterium
GRINAMRFLLSKFDYDD

SEQ ID NO: 1241212 - protein, 24 aa, Mycobacterium
GRIRPSMLEFMDAVAINAVEDKLR

SEQ ID NO: 1241213 - protein, 19 aa, Mycobacterium
GRISHFYAMRNPDKLVGVD

SEQ ID NO: 1241214 - protein, 20 aa, Mycobacterium
GRISYAMGLHGPAYTVDSAC

SEQ ID NO: 1241215 - protein, 30 aa, Mycobacterium
GRITVEYEFTRPGADITLFRRTMTIEAPKD

SEQ ID NO: 1241216 - protein, 17 aa, Mycobacterium
GRIVRAIAEAGSMNPVV

SEQ ID NO: 1241217 - protein, 31 aa, Mycobacterium
GRKEIRLAEHEMPGLMALRREYAEVAPLKGA

SEQ ID NO: 1241218 - protein, 19 aa, Mycobacterium
GRLAGRGFAAYGTAKAALA

SEQ ID NO: 1241219 - protein, 34 aa, Mycobacterium
GRLASALLRASGGWPWLAPGHDPGGVLALLEGAA

SEQ ID NO: 1241220 - protein, 19 aa, Mycobacterium
GRLFSRFLPLLPMSEPMIE

SEQ ID NO: 1241221 - protein, 25 aa, Mycobacterium
GRLGTGRQWLSWIGLDDLLDVYYHA

SEQ ID NO: 1241222 - protein, 21 aa, Mycobacterium
GRLILADAIVRACEDNPDYLI

SEQ ID NO: 1241223 - protein, 19 aa, Mycobacterium
GRLKLDRYLYTSMAYPTDY

SEQ ID NO: 1241224 - protein, 25 aa, Mycobacterium
GRLLPRHTGPIFPLIEDLFGVSVVE

SEQ ID NO: 1241225 - protein, 19 aa, Mycobacterium
GRLQPGKMLLIDTAAGRIV

SEQ ID NO: 1241226 - protein, 17 aa, Mycobacterium
GRLRTALAELKQYDFDY

SEQ ID NO: 1241227 - protein, 17 aa, Mycobacterium
GRLSMPFELARTQLVVG

SEQ ID NO: 1241228 - protein, 24 aa, Mycobacterium
GRLTPGASADLVWLSADPRSTPAL

SEQ ID NO: 1241229 - protein, 24 aa, Mycobacterium
GRLTRLWAAPVYRMVYDPDGRSYR

SEQ ID NO: 1241230 - protein, 20 aa, Mycobacterium
GRLTSALLRPTRHEEPVPAP

SEQ ID NO: 1241231 - protein, 19 aa, Mycobacterium
GRLYRRGPATITDLIAGTR

SEQ ID NO: 1241232 - protein, 18 aa, Mycobacterium
GRNGAAWQVTTVRALQEQ

SEQ ID NO: 1241233 - protein, 21 aa, Mycobacterium
GRNLFAGHGLRIARGGRELFA

SEQ ID NO: 1241234 - protein, 19 aa, Mycobacterium
GRNLGKWWRETRFQAYQGV

SEQ ID NO: 1241235 - protein, 23 aa, Mycobacterium
GRNQLRVAMFAAVDPEDVSALTR

SEQ ID NO: 1241236 - protein, 25 aa, Mycobacterium
GRPAPLCPRSLLARVEQRAAERGLE

SEQ ID NO: 1241237 - protein, 20 aa, Mycobacterium
GRPARISREQIVAAARRAPG

SEQ ID NO: 1241238 - protein, 21 aa, Mycobacterium
GRPDPSIGEWWTGIDELVTER

SEQ ID NO: 1241239 - protein, 18 aa, Mycobacterium
GRPHVVLTGKVVWGSVDI

SEQ ID NO: 1241240 - protein, 22 aa, Mycobacterium
GRPISRTAFLHVDYRRVTPIDS

SEQ ID NO: 1241241 - protein, 21 aa, Mycobacterium
GRPITAEAFGVVAREVAALGV

SEQ ID NO: 1241242 - protein, 24 aa, Mycobacterium
GRPKIVKFSGCYHGHSDALLADAG

SEQ ID NO: 1241243 - protein, 22 aa, Mycobacterium
GRPKPTPVWGVPDGDKLLIITD

SEQ ID NO: 1241244 - protein, 24 aa, Mycobacterium
GRPLTRLRVDGGLTRSTVLMQAQA

SEQ ID NO: 1241245 - protein, 18 aa, Mycobacterium
GRPPCPLCDEPLDPEGHI

SEQ ID NO: 1241246 - protein, 20 aa, Mycobacterium
GRPSMLRWRDRPDVITRRNF

SEQ ID NO: 1241247 - protein, 24 aa, Mycobacterium
GRPVEAADAFEMVRIVGRAAEVEF

SEQ ID NO: 1241248 - protein, 18 aa, Mycobacterium
GRPWRDARKLTVPGIARA

SEQ ID NO: 1241249 - protein, 25 aa, Mycobacterium
GRPWSERKKLVWWDTEKQEWTGYDV

SEQ ID NO: 1241250 - protein, 20 aa, Mycobacterium
GRPYYNAIVWQDTRTDRIAT

SEQ ID NO: 1241251 - protein, 18 aa, Mycobacterium
GRQLKLQLEELVGDNDTA

SEQ ID NO: 1241252 - protein, 19 aa, Mycobacterium
GRRAHVVVADLAHPESTAG

SEQ ID NO: 1241253 - protein, 21 aa, Mycobacterium
GRRAWAEPLVRQLVGEGQVET

SEQ ID NO: 1241254 - protein, 17 aa, Mycobacterium
GRRLFDVARRIAVAMAR

SEQ ID NO: 1241255 - protein, 22 aa, Mycobacterium
GRRLGELGADGLFVGRPMWLPL

SEQ ID NO: 1241256 - protein, 17 aa, Mycobacterium
GRRLLDFSCQLVNTNIG

SEQ ID NO: 1241257 - protein, 21 aa, Mycobacterium
GRRLPTEAQWEYAAHAGAATT

SEQ ID NO: 1241258 - protein, 26 aa, Mycobacterium
GRRRPDIGVTILRLANMIGPAMDTAL

SEQ ID NO: 1241259 - protein, 18 aa, Mycobacterium
GRRRVFRPAPTPTGQTLG

SEQ ID NO: 1241260 - protein, 20 aa, Mycobacterium
GRRTFGASFDRTRLDNLTLG

SEQ ID NO: 1241261 - protein, 24 aa, Mycobacterium
GRRYESSIAPGAWESLAAARFRRP

SEQ ID NO: 1241262 - protein, 17 aa, Mycobacterium
GRSAVLVTHDLVDVATL

SEQ ID NO: 1241263 - protein, 22 aa, Mycobacterium
GRSLPHAVLMMIPEAWENNTSM

SEQ ID NO: 1241264 - protein, 19 aa, Mycobacterium
GRSLRACIDLNALGENTIA

SEQ ID NO: 1241265 - protein, 19 aa, Mycobacterium
GRSRASLPFLDEVAAYGER

SEQ ID NO: 1241266 - protein, 19 aa, Mycobacterium
GRSWSERLAELGIELPEVV

SEQ ID NO: 1241267 - protein, 21 aa, Mycobacterium
GRTELLEAVFGARHSTAGEIL

SEQ ID NO: 1241268 - protein, 17 aa, Mycobacterium
GRTFFPFRRVFVVARTG

SEQ ID NO: 1241269 - protein, 25 aa, Mycobacterium
GRTLALEHPEIWDAVIDLDELVPDR

SEQ ID NO: 1241270 - protein, 25 aa, Mycobacterium
GRTLALEHPELWGKVVDVDELVPAE

SEQ ID NO: 1241271 - protein, 29 aa, Mycobacterium
GRTLREVPVGFKWFVDGLIGGTIGFGGEE

SEQ ID NO: 1241272 - protein, 20 aa, Mycobacterium
GRVAFLIRFGSGVLPDAKTV

SEQ ID NO: 1241273 - protein, 18 aa, Mycobacterium
GRVAYGHLQIRVEELAKA

SEQ ID NO: 1241274 - protein, 27 aa, Mycobacterium
GRVERMHRSCLILTFGGGTNEIQRDII

SEQ ID NO: 1241275 - protein, 19 aa, Mycobacterium
GRVIVACFASNVDRVQQII

SEQ ID NO: 1241276 - protein, 18 aa, Mycobacterium
GRVKTSFRMGHGASDNLA

SEQ ID NO: 1241277 - protein, 23 aa, Mycobacterium
GRVRLGDGTSHWEGSAGDLIVIP

SEQ ID NO: 1241278 - protein, 19 aa, Mycobacterium
GRVVGRYTVPPGISAVYVY

SEQ ID NO: 1241279 - protein, 24 aa, Mycobacterium
GRYDHLLPRGGVPTDDRWYTRLHG

SEQ ID NO: 1241280 - protein, 19 aa, Mycobacterium
GRYFHKLAGIPAVANTGIK

SEQ ID NO: 1241281 - protein, 23 aa, Mycobacterium
GRYWNIDPGDTFLVPSPIAHIGG

SEQ ID NO: 1241282 - protein, 17 aa, Mycobacterium
GSAALARAARGEMDTAS

SEQ ID NO: 1241283 - protein, 22 aa, Mycobacterium
GSACGPVPFVGLFDAAAQVVSL

SEQ ID NO: 1241284 - protein, 21 aa, Mycobacterium
GSACVPVLLTAIGKLTGTDTG

SEQ ID NO: 1241285 - protein, 19 aa, Mycobacterium
GSAEYDWGITPGDMATIWR

SEQ ID NO: 1241286 - protein, 30 aa, Mycobacterium; identical to SEQ ID NO: 671412

SEQ ID NO: 1241287 - protein, 40 aa, Mycobacterium
GSAMARSTKRVCRDCGFYLPLSGSLGVMFGVCANEMSADG

SEQ ID NO: 1241288 - protein, 26 aa, Mycobacterium
GSANFTGGWLLRFMSGNLCHQIEHHL

SEQ ID NO: 1241289 - protein, 25 aa, Mycobacterium
GSAPLPVPVFDRLAASTGHEVVERY

SEQ ID NO: 1241290 - protein, 18 aa, Mycobacterium
GSAVRLVRQIPYTIACDL

SEQ ID NO: 1241291 - protein, 34 aa, Mycobacterium; identical to SEQ ID NO: 671458

SEQ ID NO: 1241292 - protein, 23 aa, Mycobacterium
GSCSPPPYLPPVFTGLARAWTAV

SEQ ID NO: 1241293 - protein, 21 aa, Mycobacterium
GSCSWKIYVKDGIITWETQQT

SEQ ID NO: 1241294 - protein, 26 aa, Mycobacterium
GSDATFPGAMAIQFHFVDYVVHGWDV

SEQ ID NO: 1241295 - protein, 24 aa, Mycobacterium
GSDAWKAYMRRATNTVNYSAELPL

SEQ ID NO: 1241296 - protein, 30 aa, Mycobacterium
GSDEQKHRWAVPVLRGELTASLGMSEPSAG

SEQ ID NO: 1241297 - protein, 25 aa, Mycobacterium
GSDGKWRLSPKAMRQLGQAALRDVA

SEQ ID NO: 1241298 - protein, 17 aa, Mycobacterium
GSDLGGIAIKAALEKAG

SEQ ID NO: 1241299 - protein, 25 aa, Mycobacterium
GSDLHAACGRHPFIDLPYRPGHEAV

SEQ ID NO: 1241300 - protein, 24 aa, Mycobacterium
GSEELKQQWLPGIASGETIMAFAI

SEQ ID NO: 1241301 - protein, 17 aa, Mycobacterium
GSEEPWLGLSNVGDAQA

SEQ ID NO: 1241302 - protein, 24 aa, Mycobacterium
GSEEWLIKLMEGVEDIPGSALTEG

SEQ ID NO: 1241303 - protein, 21 aa, Mycobacterium
GSEIPVAVKSVLDRRLAGLDP

SEQ ID NO: 1241304 - protein, 22 aa, Mycobacterium
GSEPWRIPDITGYERIDHTFAQ

SEQ ID NO: 1241305 - protein, 22 aa, Mycobacterium
GSFRGKAPFIQGGIGRFEAITA

SEQ ID NO: 1241306 - protein, 21 aa, Mycobacterium
GSGALRPAAAEVFAAVDDAGI

SEQ ID NO: 1241307 - protein, 22 aa, Mycobacterium
GSGFNRPAAVIVETVQGEGGLN

SEQ ID NO: 1241308 - protein, 18 aa, Mycobacterium
GSGLTLALAADWRISGDN

SEQ ID NO: 1241309 - protein, 25 aa, Mycobacterium
GSGLTRAVLRGGRFIGVHGLGDLAA

SEQ ID NO: 1241310 - protein, 18 aa, Mycobacterium
GSGPVFLQYPWQVLPEEL

SEQ ID NO: 1241311 - protein, 22 aa, Mycobacterium
GSGPYVTPLVRKLAAEHDVDLA

SEQ ID NO: 1241312 - protein, 18 aa, Mycobacterium
GSGSEYEALVGYSRAVRI

SEQ ID NO: 1241313 - protein, 29 aa, Mycobacterium
GSGTRLRPGNRPVNGLLRGERVVADARGA

SEQ ID NO: 1241314 - protein, 18 aa, Mycobacterium
GSIPRYDNAFALSNFNAD

SEQ ID NO: 1241315 - protein, 19 aa, Mycobacterium
GSITMAFAITEPDAGSNSH

SEQ ID NO: 1241316 - protein, 17 aa, Mycobacterium
GSLFEFQCDACGSRFEG

SEQ ID NO: 1241317 - protein, 27 aa, Mycobacterium
GSLGHERTMLWLSYADRLQDLIDDFPA

SEQ ID NO: 1241318 - protein, 21 aa, Mycobacterium
GSLKPRAVVVDGEVVARPTMT

SEQ ID NO: 1241319 - protein, 22 aa, Mycobacterium
GSLLPAAWSFMLALRSRGLGSA

SEQ ID NO: 1241320 - protein, 22 aa, Mycobacterium
GSLPEGGRMVAIFADAKQVEQI

SEQ ID NO: 1241321 - protein, 25 aa, Mycobacterium
GSLPRLSAFSVAGWLRAKARTTAVS

SEQ ID NO: 1241322 - protein, 17 aa, Mycobacterium
GSLPWVLAVTPPYSQEA

SEQ ID NO: 1241323 - protein, 17 aa, Mycobacterium
GSMDFDFENDCLGTDED

SEQ ID NO: 1241324 - protein, 23 aa, Mycobacterium
GSMGGARALEWIVGHPATVRSAL

SEQ ID NO: 1241325 - protein, 19 aa, Mycobacterium
GSNHVLPTAGCARHSSGLS

SEQ ID NO: 1241326 - protein, 19 aa, Mycobacterium
GSNVARTVFKSMVTAVLDR

SEQ ID NO: 1241327 - protein, 19 aa, Mycobacterium
GSPACVAVREDGRRIYVAD

SEQ ID NO: 1241328 - protein, 18 aa, Mycobacterium
GSPEFAVLLAQIAAGARD

SEQ ID NO: 1241329 - protein, 27 aa, Mycobacterium
GSPHYAYKLEWLAALRKTAHGWLTENP

SEQ ID NO: 1241330 - protein, 17 aa, Mycobacterium
GSPKMAHYAASKGALIS

SEQ ID NO: 1241331 - protein, 18 aa, Mycobacterium
GSPSRLLLPGSISIAREI

SEQ ID NO: 1241332 - protein, 27 aa, Mycobacterium
GSQAARPVLFSTFLMWVLADLFTTLPE

SEQ ID NO: 1241333 - protein, 23 aa, Mycobacterium
GSRKLFIRQGFDRWDDRPAELRI

SEQ ID NO: 1241334 - protein, 17 aa, Mycobacterium
GSRPAAIRYRTSIDAED

SEQ ID NO: 1241335 - protein, 18 aa, Mycobacterium
GSSFSGLLYAGLAITSRG

SEQ ID NO: 1241336 - protein, 19 aa, Mycobacterium
GSSIMPGKVNPVLPEAVTQ

SEQ ID NO: 1241337 - protein, 27 aa, Mycobacterium
GSSTFRYAAPAGRDWAPEDLAGRRIAT

SEQ ID NO: 1241338 - protein, 18 aa, Mycobacterium
GSSTYTYDGNWKVQAENG

SEQ ID NO: 1241339 - protein, 19 aa, Mycobacterium
GSSVFKPMYLFRGDTPVDE

SEQ ID NO: 1241340 - protein, 17 aa, Mycobacterium
GSTAFWDAAAFGLIDKR

SEQ ID NO: 1241341 - protein, 23 aa, Mycobacterium
GSTEILAGLAPRPDATARLTQAI

SEQ ID NO: 1241342 - protein, 24 aa, Mycobacterium
GSTGERGLHHLVWEVVDNAVDEAM

SEQ ID NO: 1241343 - protein, 17 aa, Mycobacterium
GSTPWLITGHAAARELF

SEQ ID NO: 1241344 - protein, 18 aa, Mycobacterium
GSTVVYEPLMKRLPPDTP

SEQ ID NO: 1241345 - protein, 25 aa, Mycobacterium
GSVARLRFGPATHRLVKKWLAQGEF

SEQ ID NO: 1241346 - protein, 37 aa, Mycobacterium
GSVIGRAVPRGGVYLLPFPMCHIAGYNMLVQHAVAAT

SEQ ID NO: 1241347 - protein, 26 aa, Mycobacterium
GSVIHTVWSPDGWVSIAGRVVADAGR

SEQ ID NO: 1241348 - protein, 19 aa, Mycobacterium
GSVPHLQRLLGHLEDSLKE

SEQ ID NO: 1241349 - protein, 26 aa, Mycobacterium
GSVREACLWSAGLTPAGVTRRASVLD

SEQ ID NO: 1241350 - protein, 17 aa, Mycobacterium
GSVTRLFDVPGLAEHAR

SEQ ID NO: 1241351 - protein, 25 aa, Mycobacterium
GSYGRRLRAAVIGFGATARGAVTAL

SEQ ID NO: 1241352 - protein, 18 aa, Mycobacterium
GTAARTPLMANLVGDKMA

SEQ ID NO: 1241353 - protein, 26 aa, Mycobacterium
GTAGIGLACAHLLAGAGAEVIVTGRD

SEQ ID NO: 1241354 - protein, 18 aa, Mycobacterium
GTAGLPLHDLRHVRESEI

SEQ ID NO: 1241355 - protein, 35 aa, Mycobacterium
GTALLCPFDPLIFFRPRVERLFGFHYRIEIYVPQH

SEQ ID NO: 1241356 - protein, 17 aa, Mycobacterium
GTARLAMAGTRLSTHVL

SEQ ID NO: 1241357 - protein, 21 aa, Mycobacterium
GTASGPWLRTGDLGVISDGEL

SEQ ID NO: 1241358 - protein, 21 aa, Mycobacterium
GTAWQIFPNFQIGQGLTSALC

SEQ ID NO: 1241359 - protein, 17 aa, Mycobacterium
GTCKALCESGTYDGGTY

SEQ ID NO: 1241360 - protein, 18 aa, Mycobacterium
GTDAAPFFRVFNPSTQGA

SEQ ID NO: 1241361 - protein, 17 aa, Mycobacterium
GTDLLSDVRLDYKPVVQ

SEQ ID NO: 1241362 - protein, 19 aa, Mycobacterium
GTDPRGRHIWIRDRTSYRV

SEQ ID NO: 1241363 - protein, 20 aa, Mycobacterium
GTDVPRWKQLFHNAKADPRG

SEQ ID NO: 1241364 - protein, 26 aa, Mycobacterium
GTELPPGVPGTIWFRGGNSSFEYLND

SEQ ID NO: 1241365 - protein, 27 aa, Mycobacterium
GTEPVSILPAVRAFHGIRPLTVEEIDA

SEQ ID NO: 1241366 - protein, 32 aa, Mycobacterium
GTERMTRVSFGFRGPDRFGFAPAGVHCERADL

SEQ ID NO: 1241367 - protein, 18 aa, Mycobacterium
GTESAWAYTHLPRDVTDD

SEQ ID NO: 1241368 - protein, 23 aa, Mycobacterium
GTEVVGFGCALDAWQSGEDISSY

SEQ ID NO: 1241369 - protein, 26 aa, Mycobacterium
GTFTQLPFKLAWAITIHKSQGQTLER

SEQ ID NO: 1241370 - protein, 23 aa, Mycobacterium
GTGDWDVPVGGMGAVSGALAAAA

SEQ ID NO: 1241371 - protein, 20 aa, Mycobacterium
GTGMELRAAIDAGDVVVSEK

SEQ ID NO: 1241372 - protein, 24 aa, Mycobacterium
GTGVLRFGLRPVTGIDPAAVSPWW

SEQ ID NO: 1241373 - protein, 17 aa, Mycobacterium
GTHRLVRISPFDNQSRR

SEQ ID NO: 1241374 - protein, 18 aa, Mycobacterium
GTHYCLGSALARLEGRIA

SEQ ID NO: 1241375 - protein, 22 aa, Mycobacterium
GTICTREGGFLTSWQPDEFDAE

SEQ ID NO: 1241376 - protein, 25 aa, Mycobacterium
GTIRPDMTVHVSGHFSSFFGAAADS

SEQ ID NO: 1241377 - protein, 17 aa, Mycobacterium
GTLLRRDLPLIAEAARR

SEQ ID NO: 1241378 - protein, 18 aa, Mycobacterium
GTLPTLWGDDDRYIASYL

SEQ ID NO: 1241379 - protein, 23 aa, Mycobacterium
GTLQLRYVRPTPLGPLRAEAWVE

SEQ ID NO: 1241380 - protein, 22 aa, Mycobacterium
GTLRRFVPFDVDASVLQNAGAA

SEQ ID NO: 1241381 - protein, 21 aa, Mycobacterium
GTLTPSWSLAPAVGYGASGEH

SEQ ID NO: 1241382 - protein, 18 aa, Mycobacterium
GTLYAGAALSILPGPVRG

SEQ ID NO: 1241383 - protein, 25 aa, Mycobacterium
GTNALRIGRLCDRLHVTKGSFYWHF

SEQ ID NO: 1241384 - protein, 18 aa, Mycobacterium
GTNMLFTMRSAWSRAQDC

SEQ ID NO: 1241385 - protein, 26 aa, Mycobacterium
GTPDPAWLRRCKEVNDHAVAAVREQL

SEQ ID NO: 1241386 - protein, 17 aa, Mycobacterium
GTPEPPGSSILNVSSAQ

SEQ ID NO: 1241387 - protein, 25 aa, Mycobacterium
GTPGKRLALPNARILIHQPALSGVI

SEQ ID NO: 1241388 - protein, 22 aa, Mycobacterium
GTPYQRLNFMVGKLNRAMQRNP

SEQ ID NO: 1241389 - protein, 19 aa, Mycobacterium
GTQVLRLTIPETYRDDPAL

SEQ ID NO: 1241390 - protein, 22 aa, Mycobacterium
GTRLDRPWMLALGARCRALLLA

SEQ ID NO: 1241391 - protein, 23 aa, Mycobacterium
GTRMPALMSELLWSRIGAQTDAV

SEQ ID NO: 1241392 - protein, 23 aa, Mycobacterium
GTRRCIGAVFANVEMDIVLRTVL

SEQ ID NO: 1241393 - protein, 20 aa, Mycobacterium
GTRRNLEWVAPHADLSAVGA

SEQ ID NO: 1241394 - protein, 21 aa, Mycobacterium
GTSRLRLTARASLTDDDLDTA

SEQ ID NO: 1241395 - protein, 17 aa, Mycobacterium
GTSSWTLIELIRHPEVY

SEQ ID NO: 1241396 - protein, 24 aa, Mycobacterium
GTSTLRLAPAFGAGRTIAVVSTEE

SEQ ID NO: 1241397 - protein, 24 aa, Mycobacterium
GTTNRPGARFGPRAIRATAYEPGT

SEQ ID NO: 1241398 - protein, 17 aa, Mycobacterium
GTTRWGSFLDDIAGFDA

SEQ ID NO: 1241399 - protein, 20 aa, Mycobacterium
GTTVSCPVYAYAAADDAAVT

SEQ ID NO: 1241400 - protein, 23 aa, Mycobacterium
GTTVYACGPAPMLTAVRSALAGR

SEQ ID NO: 1241401 - protein, 18 aa, Mycobacterium
GTVAEGWEERLFELFWPV

SEQ ID NO: 1241402 - protein, 24 aa, Mycobacterium
GTVAQRRLPLLIANGADVHVIARA

SEQ ID NO: 1241403 - protein, 23 aa, Mycobacterium
GTVDMCRAFLPVLLARPEANLTN

SEQ ID NO: 1241404 - protein, 18 aa, Mycobacterium
GTVGELLVRGIGVMAGYN

SEQ ID NO: 1241405 - protein, 26 aa, Mycobacterium
GTVLNRFLLQAAIGYPLTVHGTGGQT

SEQ ID NO: 1241406 - protein, 19 aa, Mycobacterium
GTVMPIAEVIRMAGHANHY

SEQ ID NO: 1241407 - protein, 26 aa, Mycobacterium
GTYYPKPNFLQLLAAVAETWRERRGE

SEQ ID NO: 1241408 - protein, 27 aa, Mycobacterium
GVAGAFTLDGLGGWFLDGVDGDPSNVI

SEQ ID NO: 1241409 - protein, 25 aa, Mycobacterium
GVAMPSFAGIDPWRSPAGPVPEYPR

SEQ ID NO: 1241410 - protein, 23 aa, Mycobacterium
GVAPRLRGGMQMIDVRDVAAVHA

SEQ ID NO: 1241411 - protein, 23 aa, Mycobacterium
GVARPRALGTLCEQFLNAWVPED

SEQ ID NO: 1241412 - protein, 25 aa, Mycobacterium
GVAVMSCREGLEFATSIASDTAPLH

SEQ ID NO: 1241413 - protein, 17 aa, Mycobacterium
GVCLGHQAIGVAFGGTV

SEQ ID NO: 1241414 - protein, 26 aa, Mycobacterium
GVDAKWASSISGYWRRGRTEETFRQW

SEQ ID NO: 1241415 - protein, 22 aa, Mycobacterium
GVDARLSRYSYLVSLLPRRIVD

SEQ ID NO: 1241416 - protein, 18 aa, Mycobacterium
GVDCGRTLTHIAAHLTSL

SEQ ID NO: 1241417 - protein, 23 aa, Mycobacterium
GVDEARALYEWNHAKQILRIQAG

SEQ ID NO: 1241418 - protein, 24 aa, Mycobacterium
GVDEVWAVGGAQAVALLAYGGTDI

SEQ ID NO: 1241419 - protein, 24 aa, Mycobacterium
GVDGFPNLFIVSGPGAPAVLANMV

SEQ ID NO: 1241420 - protein, 24 aa, Mycobacterium
GVDIQRSLPVFGWQDQHGHCEIVF

SEQ ID NO: 1241421 - protein, 24 aa, Mycobacterium
GVDKMAADMAHDFRDVDIAAVSIW

SEQ ID NO: 1241422 - protein, 19 aa, Mycobacterium
GVDLARFGLDEPVGNVDSN

SEQ ID NO: 1241423 - protein, 18 aa, Mycobacterium
GVDLISAVDIRYASADAK

SEQ ID NO: 1241424 - protein, 22 aa, Mycobacterium
GVDVRCGVGVAEVKGQDVDGQE

SEQ ID NO: 1241425 - protein, 32 aa, Mycobacterium
GVEAFKGRSGRKRWAEIEAVIARSWDGVLDAI

SEQ ID NO: 1241426 - protein, 19 aa, Mycobacterium
GVEAPERLAQRRQRFLEAG

SEQ ID NO: 1241427 - protein, 22 aa, Mycobacterium
GVEEARKGFFRVPLIGGTIVHP

SEQ ID NO: 1241428 - protein, 18 aa, Mycobacterium
GVEEARSLFPHHLDTLVN

SEQ ID NO: 1241429 - protein, 22 aa, Mycobacterium
GVEGPHCIDGRAGTDLEPSLRP

SEQ ID NO: 1241430 - protein, 25 aa, Mycobacterium
GVETIPVLLARFGDTVAIPLMRRAM

SEQ ID NO: 1241431 - protein, 19 aa, Mycobacterium
GVEVAGYWGEAVTDADHAR

SEQ ID NO: 1241432 - protein, 24 aa, Mycobacterium
GVEVARSSFYAWLAGAEGRAARKA

SEQ ID NO: 1241433 - protein, 23 aa, Mycobacterium
GVFAGACFSEYGYLASTDLPRVD

SEQ ID NO: 1241434 - protein, 28 aa, Mycobacterium
GVFALSGWDLCGMLTLPAGQVGELLRGG

SEQ ID NO: 1241435 - protein, 27 aa, Mycobacterium
GVFERMPALKFVWADGAADLLTPFMWR

SEQ ID NO: 1241436 - protein, 28 aa, Mycobacterium
GVFGPRIRWRAMLDLLAAEGFPVEPPRR

SEQ ID NO: 1241437 - protein, 25 aa, Mycobacterium
GVFGSLKRHGEWIVPTRLALHRRMG

SEQ ID NO: 1241438 - protein, 17 aa, Mycobacterium
GVFLLKASVRELRERVG

SEQ ID NO: 1241439 - protein, 19 aa, Mycobacterium
GVGAIAFSPVVPIPDVEVP

SEQ ID NO: 1241440 - protein, 18 aa, Mycobacterium
GVGDGWRVAMTTLMNERS

SEQ ID NO: 1241441 - protein, 19 aa, Mycobacterium
GVGGACVLYDCVPSKTFIA

SEQ ID NO: 1241442 - protein, 25 aa, Mycobacterium
GVGPPPERFLVGLAVLSLVAAAVHE

SEQ ID NO: 1241443 - protein, 24 aa, Mycobacterium
GVGRFRLRCLMGERIRVRQWLDDA

SEQ ID NO: 1241444 - protein, 18 aa, Mycobacterium
GVGRGDVVAIMLRNSPEP

SEQ ID NO: 1241445 - protein, 20 aa, Mycobacterium
GVGVFGCGECGFCKQGAEAL

SEQ ID NO: 1241446 - protein, 18 aa, Mycobacterium
GVGVRRVAGDRGVPVDML

SEQ ID NO: 1241447 - protein, 19 aa, Mycobacterium
GVHALCPGFIHTEFHQRAG

SEQ ID NO: 1241448 - protein, 27 aa, Mycobacterium
GVIARIDWARFLPLYQQAGRRAFLTEL

SEQ ID NO: 1241449 - protein, 40 aa, Mycobacterium
GVKFKDAELLGVPWIVVVGRGWGDGVVELRDRFSGEKREI

SEQ ID NO: 1241450 - protein, 19 aa, Mycobacterium
GVLGFKKSDEIYTFMDLWF

SEQ ID NO: 1241451 - protein, 25 aa, Mycobacterium
GVLHPRADILALRRPGRIVVVDEAF

SEQ ID NO: 1241452 - protein, 21 aa, Mycobacterium
GVLPAEWNCELTWPSRPVAGG

SEQ ID NO: 1241453 - protein, 28 aa, Mycobacterium
GVLQLRMYRPFPVEALAAALPETVRTVG

SEQ ID NO: 1241454 - protein, 27 aa, Mycobacterium
GVLRRHFSDALPVRVCALRTDPWNLGT

SEQ ID NO: 1241455 - protein, 21 aa, Mycobacterium
GVLSGAARFTERLTLGYRQAI

SEQ ID NO: 1241456 - protein, 17 aa, Mycobacterium
GVLSIAWGTAIRQLAAG

SEQ ID NO: 1241457 - protein, 27 aa, Mycobacterium
GVMRMTWWPLGVLVFLEVSLGNYSQAL

SEQ ID NO: 1241458 - protein, 18 aa, Mycobacterium
GVMTWLEEQGRGVALDGG

SEQ ID NO: 1241459 - protein, 26 aa, Mycobacterium
GVNPIDWKIVAGFMREQIPLQLPAGT

SEQ ID NO: 1241460 - protein, 24 aa, Mycobacterium
GVNVWDWAAGALVAAEAGAVVSLP

SEQ ID NO: 1241461 - protein, 17 aa, Mycobacterium
GVPGLRHVQGRMVMVDL

SEQ ID NO: 1241462 - protein, 25 aa, Mycobacterium
GVPPKDYFPLLALLKRSLTEEEVVR

SEQ ID NO: 1241463 - protein, 17 aa, Mycobacterium
GVPQRIQHFIGGKLVDS

SEQ ID NO: 1241464 - protein, 26 aa, Mycobacterium
GVPRTLRLDQMIRYYVEHQLDVIVRR

SEQ ID NO: 1241465 - protein, 25 aa, Mycobacterium
GVPVPRLADLCAGIEKIAADRDVMI

SEQ ID NO: 1241466 - protein, 23 aa, Mycobacterium
GVRDELKLSLAAVTVLRERYLLR

SEQ ID NO: 1241467 - protein, 23 aa, Mycobacterium
GVRDICDRYGIVMIADEVMAGFG

SEQ ID NO: 1241468 - protein, 23 aa, Mycobacterium
GVRRIILLTLGWEELPKSVSVHG

SEQ ID NO: 1241469 - protein, 26 aa, Mycobacterium
GVRSICYLPLTYDHRLIDGADAGRFL

SEQ ID NO: 1241470 - protein, 25 aa, Mycobacterium
GVRVDGNDVLACFAVMSEAAARARA

SEQ ID NO: 1241471 - protein, 26 aa, Mycobacterium
GVSAEAALGLLRRHKIEKLPIVDGHG

SEQ ID NO: 1241472 - protein, 19 aa, Mycobacterium
GVSARFAIAAAETVAAAAR

SEQ ID NO: 1241473 - protein, 20 aa, Mycobacterium
GVSLPESFAAALRAGTPPVV

SEQ ID NO: 1241474 - protein, 24 aa, Mycobacterium
GVSTPRSKLLAEIERLQPVRSADA

SEQ ID NO: 1241475 - protein, 21 aa, Mycobacterium
GVSYRRGDVFMSNFPGAHYRC

SEQ ID NO: 1241476 - protein, 24 aa, Mycobacterium
GVTEKRMFGGLAFLLDGNMAVAAS

SEQ ID NO: 1241477 - protein, 27 aa, Mycobacterium
GVTLSAWCKAAGVAIRHRNPSATTAPA

SEQ ID NO: 1241478 - protein, 22 aa, Mycobacterium
GVTRSAFYFYFENKAAAVAALT

SEQ ID NO: 1241479 - protein, 18 aa, Mycobacterium
GVTVGCAHMSWIDTPLVQ

SEQ ID NO: 1241480 - protein, 18 aa, Mycobacterium
GVVADLRPDIVLCDVRMQ

SEQ ID NO: 1241481 - protein, 26 aa, Mycobacterium
GVVALLRIRADWGAVVERQMAVFAAV

SEQ ID NO: 1241482 - protein, 19 aa, Mycobacterium
GVVDADWLRGLCLDSGADD

SEQ ID NO: 1241483 - protein, 24 aa, Mycobacterium
GVVEGVKLVNGRAFSVQYHPEAAA

SEQ ID NO: 1241484 - protein, 18 aa, Mycobacterium
GVVLKIETRRAFEHLPQL

SEQ ID NO: 1241485 - protein, 18 aa, Mycobacterium
GVVPILRERGLFKGQATS

SEQ ID NO: 1241486 - protein, 19 aa, Mycobacterium
GVVPLFWEHGHDDPRAIVG

SEQ ID NO: 1241487 - protein, 18 aa, Mycobacterium
GVWGDWKASLIGDLVRRC

SEQ ID NO: 1241488 - protein, 19 aa, Mycobacterium
GVWRRIGLMDCGERWAVFT

SEQ ID NO: 1241489 - protein, 26 aa, Mycobacterium
GVWSATPPPAGWRLLDTAVEQAQIDS

SEQ ID NO: 1241490 - protein, 23 aa, Mycobacterium
GVYPRESPGGWQLIGHTDAVLWD

SEQ ID NO: 1241491 - protein, 22 aa, Mycobacterium
GVYRFLLKRNRRLYGVAYTLDN

SEQ ID NO: 1241492 - protein, 18 aa, Mycobacterium
GWGGPGFFGPLQKPLPMS

SEQ ID NO: 1241493 - protein, 19 aa, Mycobacterium
GWQLRDYQEMAADSFWSGG

SEQ ID NO: 1241494 - protein, 18 aa, Mycobacterium
GWQVLRFTWLDLTEYPDR

SEQ ID NO: 1241495 - protein, 19 aa, Mycobacterium
GWRNLASGYQTKRYRDAAG

SEQ ID NO: 1241496 - protein, 19 aa, Mycobacterium
GWRSRSLREENVWFTNAPA

SEQ ID NO: 1241497 - protein, 25 aa, Mycobacterium
GWSEALAGEVARFGIGVMLVEPSRF

SEQ ID NO: 1241498 - protein, 17 aa, Mycobacterium
GWVKDLGNIIGHENDPF

SEQ ID NO: 1241499 - protein, 26 aa, Mycobacterium
GWVVRKRPGSAAARAAERASGEAAEQ

SEQ ID NO: 1241500 - protein, 23 aa, Mycobacterium
GWYGQRFPKPLARTREYVNILRQ

SEQ ID NO: 1241501 - protein, 17 aa, Mycobacterium
GYAEDWDLEQLWTALKQ

SEQ ID NO: 1241502 - protein, 18 aa, Mycobacterium
GYALPFDRCNELVPPGSP

SEQ ID NO: 1241503 - protein, 18 aa, Mycobacterium
GYAPDPRTGAVNTPIYAS

SEQ ID NO: 1241504 - protein, 21 aa, Mycobacterium
GYARVDGRPVGVIANQPMHMS

SEQ ID NO: 1241505 - protein, 26 aa, Mycobacterium
GYDIKKWTEWSLRFFYGSPAYSQIYT

SEQ ID NO: 1241506 - protein, 18 aa, Mycobacterium
GYDRPVYTLAHYGVFVPP

SEQ ID NO: 1241507 - protein, 25 aa, Mycobacterium
GYEGEGFPVVRAFAGVSAADLDPFI

SEQ ID NO: 1241508 - protein, 17 aa, Mycobacterium
GYGDAYRTAQAFAAAAR

SEQ ID NO: 1241509 - protein, 25 aa, Mycobacterium
GYGVHFCLGAALARMEVNSFFAELL

SEQ ID NO: 1241510 - protein, 26 aa, Mycobacterium
GYGWSKRIVMEYVDEMCLHLAPRMIR

SEQ ID NO: 1241511 - protein, 19 aa, Mycobacterium
GYHSIPFSAGGALIAGASG

SEQ ID NO: 1241512 - protein, 18 aa, Mycobacterium
GYIGTALRLLERKIAQTP

SEQ ID NO: 1241513 - protein, 19 aa, Mycobacterium
GYLAGFPGQGAYACGNAYL

SEQ ID NO: 1241514 - protein, 24 aa, Mycobacterium
GYLARADMMFALSVPLPGHHIINA

SEQ ID NO: 1241515 - protein, 18 aa, Mycobacterium
GYLEREWKSEADGGFSRV

SEQ ID NO: 1241516 - protein, 19 aa, Mycobacterium
GYLMDFKLPPGFPEELMAS

SEQ ID NO: 1241517 - protein, 31 aa, Mycobacterium
GYLNRPRWPDIPGRDTFAGISVHSAQWDPSL

SEQ ID NO: 1241518 - protein, 18 aa, Mycobacterium
GYNEYYPALLAAGITVFT

SEQ ID NO: 1241519 - protein, 22 aa, Mycobacterium
GYPRLVKRWRRGTPLTEAETVY

SEQ ID NO: 1241520 - protein, 22 aa, Mycobacterium
GYQVLKPAVKVTAIGAGGGSIA

SEQ ID NO: 1241521 - protein, 17 aa, Mycobacterium
GYRAALITLARGRVHIA

SEQ ID NO: 1241522 - protein, 28 aa, Mycobacterium
GYRAPMWEMNWHTPKLLAEYGFTYDSTL

SEQ ID NO: 1241523 - protein, 18 aa, Mycobacterium
GYRLERWLHEDRRPLDRF

SEQ ID NO: 1241524 - protein, 29 aa, Mycobacterium
GYSMEGWYGRIFRGCGYFDPDKPIRKYTK

SEQ ID NO: 1241525 - protein, 18 aa, Mycobacterium
GYTSDLYSAFYPLSVASP

SEQ ID NO: 1241526 - protein, 17 aa, Mycobacterium
GYVDGAITFHELAPNLT

SEQ ID NO: 1241527 - protein, 18 aa, Mycobacterium
GYVLRRLLRRVIRSAKLL

SEQ ID NO: 1241528 - protein, 18 aa, Mycobacterium
GYYPGQFQVGQTGKTVSP

SEQ ID NO: 1241529 - protein, 17 aa, Mycobacterium
HAADDWSECLAAVTALT

SEQ ID NO: 1241530 - protein, 26 aa, Mycobacterium
HAAEGFPSLSSIILNGGLELHPSIAK

SEQ ID NO: 1241531 - protein, 24 aa, Mycobacterium
HAAGRLGEKIGHLDTLMARQRQAL

SEQ ID NO: 1241532 - protein, 26 aa, Mycobacterium
HAAPLRWCSMVHALGGTVVLAKRFDA

SEQ ID NO: 1241533 - protein, 18 aa, Mycobacterium
HAAREAGYAGAMFPWQSG

SEQ ID NO: 1241534 - protein, 17 aa, Mycobacterium
HAASLIDTRTMSVRATV

SEQ ID NO: 1241535 - protein, 20 aa, Mycobacterium
HACADMLVQIEVSRQLVEAA

SEQ ID NO: 1241536 - protein, 28 aa, Mycobacterium
HADHCLDLPGLFVWRRYHPSPAPDRGVL

SEQ ID NO: 1241537 - protein, 19 aa, Mycobacterium
HADLSLNFFASERGVDGGF

SEQ ID NO: 1241538 - protein, 18 aa, Mycobacterium
HAEACRWEHVMSEDVERR

SEQ ID NO: 1241539 - protein, 19 aa, Mycobacterium
HAEWLAEYVEQGWDELYLH

SEQ ID NO: 1241540 - protein, 17 aa, Mycobacterium
HAGDLAGDFVIEHPDGA

SEQ ID NO: 1241541 - protein, 19 aa, Mycobacterium
HAGQACAMTTRLIIHESLL

SEQ ID NO: 1241542 - protein, 27 aa, Mycobacterium
HAGQGCALTSRLLVPARHKDEIVEKIK

SEQ ID NO: 1241543 - protein, 17 aa, Mycobacterium
HAHLRHLNPFPANLGDV

SEQ ID NO: 1241544 - protein, 18 aa, Mycobacterium
HAHPRVADTAARQLRKLN

SEQ ID NO: 1241545 - protein, 18 aa, Mycobacterium
HAIPELYEQLGPRPASPW

SEQ ID NO: 1241546 - protein, 23 aa, Mycobacterium
HAKAEVLKLINWELASTEAAPSP

SEQ ID NO: 1241547 - protein, 23 aa, Mycobacterium
HAKARGANILARIMGASVTSDGY

SEQ ID NO: 1241548 - protein, 22 aa, Mycobacterium
HAKGKLTARERILALLDEDSFV

SEQ ID NO: 1241549 - protein, 22 aa, Mycobacterium
HALAEGADWVWLADDDGRPLDP

SEQ ID NO: 1241550 - protein, 17 aa, Mycobacterium
HALALLLSAARQIPAAD

SEQ ID NO: 1241551 - protein, 17 aa, Mycobacterium
HALHVGSALLAVEQVGA

SEQ ID NO: 1241552 - protein, 18 aa, Mycobacterium
HALLRGVPMTSIMAEMFG

SEQ ID NO: 1241553 - protein, 18 aa, Mycobacterium
HALNEWLHEVWGFNYQNR

SEQ ID NO: 1241554 - protein, 31 aa, Mycobacterium
HALPARLLAEVLRLRGWQVDFLGAQVPTPHL

SEQ ID NO: 1241555 - protein, 24 aa, Mycobacterium
HANACLTCPMFLTTPEFLPHHRAQ

SEQ ID NO: 1241556 - protein, 23 aa, Mycobacterium
HAPPEKLLRCIEAVLECREALAV

SEQ ID NO: 1241557 - protein, 17 aa, Mycobacterium
HAQRVGAWVTVDAEDHT

SEQ ID NO: 1241558 - protein, 23 aa, Mycobacterium
HAQVSWWRGEVPVDRSAPPRPVH

SEQ ID NO: 1241559 - protein, 24 aa, Mycobacterium
HARALCAALLQWGARGGATHAYVQ

SEQ ID NO: 1241560 - protein, 19 aa, Mycobacterium
HARDADCVAIGYRIHKSGE

SEQ ID NO: 1241561 - protein, 22 aa, Mycobacterium
HARGAAAHGVFRGNGAAEKICK

SEQ ID NO: 1241562 - protein, 20 aa, Mycobacterium
HARHLPRRFDHAVPAAVRID

SEQ ID NO: 1241563 - protein, 22 aa, Mycobacterium
HASALRPEDFRKVADTLLGFID

SEQ ID NO: 1241564 - protein, 23 aa, Mycobacterium
HAVAERLGCAVVQGYGMSELSPV

SEQ ID NO: 1241565 - protein, 17 aa, Mycobacterium
HAVELRPGGGAKLARSA

SEQ ID NO: 1241566 - protein, 19 aa, Mycobacterium
HAVHLPERVGGQGGDLVDT

SEQ ID NO: 1241567 - protein, 23 aa, Mycobacterium
HAVKSRYSVPVGGHGWIGPGAEA

SEQ ID NO: 1241568 - protein, 21 aa, Mycobacterium
HAVPMVATFDGEWTEPTVLPA

SEQ ID NO: 1241569 - protein, 25 aa, Mycobacterium
HCASGYRSSIAASYLDRAGHDVVLI

SEQ ID NO: 1241570 - protein, 23 aa, Mycobacterium
HCFAGKDRTGFTVAVVLEAAGVD

SEQ ID NO: 1241571 - protein, 20 aa, Mycobacterium
HCFGCGEGGDVYAFVQKIEH

SEQ ID NO: 1241572 - protein, 24 aa, Mycobacterium
HCNPRIAEVPLVLQYDRKHGASKL

SEQ ID NO: 1241573 - protein, 17 aa, Mycobacterium
HCTQCRAGRYNICRELL

SEQ ID NO: 1241574 - protein, 27 aa, Mycobacterium
HCVIALSALGWRSVVHRFPNPAEPLHL

SEQ ID NO: 1241575 - protein, 21 aa, Mycobacterium
HCVRALLADGHRVRLLVGPDA

SEQ ID NO: 1241576 - protein, 32 aa, Mycobacterium
HDAEHSFPYEVVRGMADMGLFGLPFPEEYGGM

SEQ ID NO: 1241577 - protein, 19 aa, Mycobacterium
HDAELMGSVYFEDGVDEHG

SEQ ID NO: 1241578 - protein, 19 aa, Mycobacterium
HDAGARWILDLGPGDILTR

SEQ ID NO: 1241579 - protein, 19 aa, Mycobacterium
HDAHLYLRRAYGISQALGG

SEQ ID NO: 1241580 - protein, 23 aa, Mycobacterium
HDAYICGPGPFMAAAEEALTSAG

SEQ ID NO: 1241581 - protein, 18 aa, Mycobacterium
HDEFRAFMERLLDRLTAG

SEQ ID NO: 1241582 - protein, 22 aa, Mycobacterium
HDGSLWGRRRVLLLNSTYEPLT

SEQ ID NO: 1241583 - protein, 22 aa, Mycobacterium
HDHHSRRGLLLLVGRRRRLLKY

SEQ ID NO: 1241584 - protein, 21 aa, Mycobacterium
HDIRGALGRPGARDSAAVGYV

SEQ ID NO: 1241585 - protein, 24 aa, Mycobacterium
HDPRGRARFLAMASGGGFLLYLQM

SEQ ID NO: 1241586 - protein, 27 aa, Mycobacterium
HDPRRFAVDLLERFRDLIVLQAVPDAA

SEQ ID NO: 1241587 - protein, 25 aa, Mycobacterium
HDRARPPARHRWLTIPAYRIVLDPD

SEQ ID NO: 1241588 - protein, 22 aa, Mycobacterium
HDRLLLALLLCAVRPEIGGVLI

SEQ ID NO: 1241589 - protein, 25 aa, Mycobacterium
HDTLLWAKLIHKYRGTMTAAPNFAY

SEQ ID NO: 1241590 - protein, 25 aa, Mycobacterium
HDVFHIDRGYPLFVENLKSLGAEIE

SEQ ID NO: 1241591 - protein, 20 aa, Mycobacterium
HDVRLPARLQFDVEDYGGVV

SEQ ID NO: 1241592 - protein, 18 aa, Mycobacterium
HDVSGGSIFAYWVANPSA

SEQ ID NO: 1241593 - protein, 18 aa, Mycobacterium
HDYLTYWLTGRPVTDRSE

SEQ ID NO: 1241594 - protein, 20 aa, Mycobacterium
HEANGTFVFVEQWADADALK

SEQ ID NO: 1241595 - protein, 18 aa, Mycobacterium
HEAVIALGVVIRGQTPHF

SEQ ID NO: 1241596 - protein, 25 aa, Mycobacterium
HEFHRTAVTFSHRYEAAWHFGGGST

SEQ ID NO: 1241597 - protein, 19 aa, Mycobacterium
HEGKPFFGSLLEFITSGPV

SEQ ID NO: 1241598 - protein, 22 aa, Mycobacterium
HEGSLRIGDKVVLGRDNVINTY

SEQ ID NO: 1241599 - protein, 20 aa, Mycobacterium
HELEAMPKLVAQVLKQLNPI

SEQ ID NO: 1241600 - protein, 17 aa, Mycobacterium
HELRVIEKLSFPGYFLV

SEQ ID NO: 1241601 - protein, 21 aa, Mycobacterium
HELTGALTYYGLTPRDSRNAT

SEQ ID NO: 1241602 - protein, 23 aa, Mycobacterium
HEPEVLDRASTILLPHDYLTYWL

SEQ ID NO: 1241603 - protein, 28 aa, Mycobacterium
HEPFEALTIDCPEEFVGAITQLMAARKG

SEQ ID NO: 1241604 - protein, 22 aa, Mycobacterium
HERWRGSICLAIEEPEASVAEI

SEQ ID NO: 1241605 - protein, 30 aa, Mycobacterium
HERWVRGADGWKLAALRLTRLIMEFENADH

SEQ ID NO: 1241606 - protein, 26 aa, Mycobacterium
HESADILKRWKRGVMSTVGDVTAKNV

SEQ ID NO: 1241607 - protein, 24 aa, Mycobacterium
HESKRYLEYTLRWRNTPKPSIAAV

SEQ ID NO: 1241608 - protein, 22 aa, Mycobacterium
HEVADLYFFGTVVRLHRAGEGA

SEQ ID NO: 1241609 - protein, 19 aa, Mycobacterium
HEVLAEFPLGARRAERVAR

SEQ ID NO: 1241610 - protein, 19 aa, Mycobacterium
HEVTVMAAILPQGDAPVLA

SEQ ID NO: 1241611 - protein, 18 aa, Mycobacterium
HFDDDRWELFHIEADRAQ

SEQ ID NO: 1241612 - protein, 17 aa, Mycobacterium
HFEDIRKLLKVINGLVD

SEQ ID NO: 1241613 - protein, 24 aa, Mycobacterium
HFFVCSTHDWILFFTTQGRVYRAK

SEQ ID NO: 1241614 - protein, 22 aa, Mycobacterium
HFKCPRDVHFVAELPRNATGKL

SEQ ID NO: 1241615 - protein, 18 aa, Mycobacterium
HFSAWPVAIGDVALMGAR

SEQ ID NO: 1241616 - protein, 22 aa, Mycobacterium
HFSDPVADLAWFFQRTSRGRSP

SEQ ID NO: 1241617 - protein, 19 aa, Mycobacterium
HFSDWPVSMGDIALMGSRA

SEQ ID NO: 1241618 - protein, 20 aa, Mycobacterium
HGAAQGHAALRDWARALDVN

SEQ ID NO: 1241619 - protein, 22 aa, Mycobacterium
HGADRPAALRALDRALAQTAVL

SEQ ID NO: 1241620 - protein, 22 aa, Mycobacterium
HGAEGLTSIARRVHGHARAVAT

SEQ ID NO: 1241621 - protein, 17 aa, Mycobacterium
HGAIALYESMGFTAQHR

SEQ ID NO: 1241622 - protein, 25 aa, Mycobacterium
HGANLHGRYLLPHFLIHDIADVAAD

SEQ ID NO: 1241623 - protein, 20 aa, Mycobacterium
HGDSEIPLWSTLSIGGVGAD

SEQ ID NO: 1241624 - protein, 23 aa, Mycobacterium
HGEFPWRPDRGYGRTAPVGSYPP

SEQ ID NO: 1241625 - protein, 28 aa, Mycobacterium
HGFRFFPAYYLHIWDLFQRIPVYERIEL

SEQ ID NO: 1241626 - protein, 21 aa, Mycobacterium
HGGVCSLILDHLLGATAHRPD

SEQ ID NO: 1241627 - protein, 22 aa, Mycobacterium
HGGVLPLMFDSMFGMVIHATGR

SEQ ID NO: 1241628 - protein, 27 aa, Mycobacterium
HGHPLPWQDLRAAFTERGWLDMTHTRR

SEQ ID NO: 1241629 - protein, 17 aa, Mycobacterium
HGIPIRWVEMVRHTLRV

SEQ ID NO: 1241630 - protein, 20 aa, Mycobacterium
HGITPIVCIGEHLKVREAGN

SEQ ID NO: 1241631 - protein, 17 aa, Mycobacterium
HGLAQGYALRLADRLVD

SEQ ID NO: 1241632 - protein, 24 aa, Mycobacterium
HGLGGLECLSGIPGSAGATPVQNV

SEQ ID NO: 1241633 - protein, 17 aa, Mycobacterium
HGMVCLDSAGAVVRNAL

SEQ ID NO: 1241634 - protein, 19 aa, Mycobacterium
HGNRIPVLEVLHARLKELH

SEQ ID NO: 1241635 - protein, 23 aa, Mycobacterium
HGSEELRVGIGINTGTVGVGLVG

SEQ ID NO: 1241636 - protein, 19 aa, Mycobacterium
HGSPFRRAYEEGLLLDRNM

SEQ ID NO: 1241637 - protein, 17 aa, Mycobacterium
HGTEGVHFFTRGKAITQ

SEQ ID NO: 1241638 - protein, 18 aa, Mycobacterium
HGTIVRKDFRAIARAVRE

SEQ ID NO: 1241639 - protein, 20 aa, Mycobacterium
HGTLLDRHRPLWEAHLVEGL

SEQ ID NO: 1241640 - protein, 26 aa, Mycobacterium
HGVGRLKRPWLAGQIGPEAMELNRRI

SEQ ID NO: 1241641 - protein, 20 aa, Mycobacterium
HGVPAKGWLVGEVHNGIAQM

SEQ ID NO: 1241642 - protein, 19 aa, Mycobacterium
HGVTAGIAYLGFIDTDLTS

SEQ ID NO: 1241643 - protein, 18 aa, Mycobacterium
HGVTLGGPIAIQIGNTEW

SEQ ID NO: 1241644 - protein, 20 aa, Mycobacterium
HGVVAVRGKGLWAGVDVDPA

SEQ ID NO: 1241645 - protein, 18 aa, Mycobacterium
HHEPRGAQYMGVNWVGPI

SEQ ID NO: 1241646 - protein, 19 aa, Mycobacterium
HHFRSKYALASALVDQWLE

SEQ ID NO: 1241647 - protein, 17 aa, Mycobacterium
HHGCAYQWVHHSAIGRA

SEQ ID NO: 1241648 - protein, 27 aa, Mycobacterium
HHIDKWKFTVPFVCGATNLGEALRRIT

SEQ ID NO: 1241649 - protein, 23 aa, Mycobacterium
HHLVCRACGAAVEIQGGQVETWA

SEQ ID NO: 1241650 - protein, 25 aa, Mycobacterium
HHVFKEWADRYAGRFDMGYEAYREI

SEQ ID NO: 1241651 - protein, 21 aa, Mycobacterium
HHYAWTKDRLVVVTLADVASR

SEQ ID NO: 1241652 - protein, 23 aa, Mycobacterium
HIEPGETIALIALASGLEIGVVL

SEQ ID NO: 1241653 - protein, 33 aa, Mycobacterium
HIGHVRSGVAFDVLRRWLTAKGLDVAFIRNVTD

SEQ ID NO: 1241654 - protein, 24 aa, Mycobacterium
HIGMARPSGMLRLVHMLESAWNIT

SEQ ID NO: 1241655 - protein, 26 aa, Mycobacterium
HIGNLRTAVLAWLFARSTGRRFLMRV

SEQ ID NO: 1241656 - protein, 21 aa, Mycobacterium
HIIRMARDVAPHWLASEFDAT

SEQ ID NO: 1241657 - protein, 20 aa, Mycobacterium
HILSENGWHTALFGMQHETS

SEQ ID NO: 1241658 - protein, 18 aa, Mycobacterium
HIQIMPQVWAMRYTLERV

SEQ ID NO: 1241659 - protein, 27 aa, Mycobacterium
HISTLLLTLLFRFMKPLIENGHVFLAQ

SEQ ID NO: 1241660 - protein, 27 aa, Mycobacterium
HITCRYKCGDACWKPVPNTSDNEYFGD

SEQ ID NO: 1241661 - protein, 24 aa, Mycobacterium
HIYFLGSSEGLVFDVANDNFDVAL

SEQ ID NO: 1241662 - protein, 22 aa, Mycobacterium
HKDLRRARAAALNIVPTSTGAA

SEQ ID NO: 1241663 - protein, 18 aa, Mycobacterium
HKESLAADVIVIADSDNW

SEQ ID NO: 1241664 - protein, 23 aa, Mycobacterium
HKGARLTTQVSLAGRYLVYVPGA

SEQ ID NO: 1241665 - protein, 25 aa, Mycobacterium
HKLIDCAKAYCTVGEMVSALKAVWG

SEQ ID NO: 1241666 - protein, 22 aa, Mycobacterium
HKLSDDEFGFFVILLAVAGNET

SEQ ID NO: 1241667 - protein, 28 aa, Mycobacterium
HKYLIGLRRRHPWLHWATTSAVQLTNRQ

SEQ ID NO: 1241668 - protein, 20 aa, Mycobacterium
HLAEALVCAAARETFEECGV

SEQ ID NO: 1241669 - protein, 18 aa, Mycobacterium
HLAERGARRIVLLSRRAV

SEQ ID NO: 1241670 - protein, 17 aa, Mycobacterium
HLAHGCDIRPSLTTMAP

SEQ ID NO: 1241671 - protein, 20 aa, Mycobacterium
HLASELVRIIGVLRGMQLKK

SEQ ID NO: 1241672 - protein, 20 aa, Mycobacterium
HLAVLKRHHVVSAQRSGNAV

SEQ ID NO: 1241673 - protein, 17 aa, Mycobacterium
HLAVSLVIAHQGGAMLT

SEQ ID NO: 1241674 - protein, 21 aa, Mycobacterium
HLCYGDSKFGASPFMGDPPDE

SEQ ID NO: 1241675 - protein, 27 aa, Mycobacterium
HLDRLDLKPGMTLLEVGCGWGMTMKRA

SEQ ID NO: 1241676 - protein, 22 aa, Mycobacterium
HLEAGKVDGFVRVLRAPQEGSD

SEQ ID NO: 1241677 - protein, 24 aa, Mycobacterium
HLEPLGALAAMGVWGYRQMPELLS

SEQ ID NO: 1241678 - protein, 18 aa, Mycobacterium
HLEQFPALASTFPDATFV

SEQ ID NO: 1241679 - protein, 17 aa, Mycobacterium
HLEVLKVDGGITVNDLC

SEQ ID NO: 1241680 - protein, 18 aa, Mycobacterium
HLFRAAYEGISFGIRQIL

SEQ ID NO: 1241681 - protein, 27 aa, Mycobacterium
HLFTGDCLFPGGVGKTWQEGDFEKLLT

SEQ ID NO: 1241682 - protein, 21 aa, Mycobacterium
HLHAFEVKWLCAGVEVARSSF

SEQ ID NO: 1241683 - protein, 18 aa, Mycobacterium
HLHWAFQHLAEFLPTARI

SEQ ID NO: 1241684 - protein, 33 aa, Mycobacterium
HLLDPLRYRLIDIPFRFHHPMWLENCDVDLDYH

SEQ ID NO: 1241685 - protein, 23 aa, Mycobacterium
HLLEEYRDALGLPADELPSLGEI

SEQ ID NO: 1241686 - protein, 19 aa, Mycobacterium
HLLPRFIRQFPFNVLLKDL

SEQ ID NO: 1241687 - protein, 22 aa, Mycobacterium
HLLRRKLVNSGFTRKRVMDKVP

SEQ ID NO: 1241688 - protein, 27 aa, Mycobacterium
HLNPFPANLGDVLARYPKLVAPEMNMG

SEQ ID NO: 1241689 - protein, 18 aa, Mycobacterium
HLNQNVLISSEWGSPSMI

SEQ ID NO: 1241690 - protein, 18 aa, Mycobacterium
HLPAEVLDAAAVTIAKLW

SEQ ID NO: 1241691 - protein, 28 aa, Mycobacterium
HLPDGLSCLRFRLRWRDFRLTVHARHDE

SEQ ID NO: 1241692 - protein, 23 aa, Mycobacterium
HLQAARPGEDWSGSSEFSGDNPL

SEQ ID NO: 1241693 - protein, 24 aa, Mycobacterium
HLRKWGISDARIVELDWNESHRIG

SEQ ID NO: 1241694 - protein, 19 aa, Mycobacterium
HLRRLSVVIPAALRCVPAG

SEQ ID NO: 1241695 - protein, 23 aa, Mycobacterium
HLRTRGAMKAGIFSGDESAAPMS

SEQ ID NO: 1241696 - protein, 21 aa, Mycobacterium
HLTAPFRILRAAQPVISGLAK

SEQ ID NO: 1241697 - protein, 25 aa, Mycobacterium
HLTDWTHLWERLSIEFDDFTDEVRI

SEQ ID NO: 1241698 - protein, 19 aa, Mycobacterium
HLTFGKGLHYCLGANLARL

SEQ ID NO: 1241699 - protein, 20 aa, Mycobacterium
HLTLVPALRDALAAVGRPDI

SEQ ID NO: 1241700 - protein, 17 aa, Mycobacterium
HLTREWGEDEVRHGHRL

SEQ ID NO: 1241701 - protein, 31 aa, Mycobacterium
HLVDSFPITAAEAVMMGRWRRLGLLRRPTRA

SEQ ID NO: 1241702 - protein, 18 aa, Mycobacterium
HLVIVGGSYIALEFAQMY

SEQ ID NO: 1241703 - protein, 23 aa, Mycobacterium
HLVRRSVWIVGGDGWAYDIGAGG

SEQ ID NO: 1241704 - protein, 23 aa, Mycobacterium
HMADLGFLPGVTRILAATPAGGQ

SEQ ID NO: 1241705 - protein, 31 aa, Mycobacterium
HMARLGVDCEFGRIALLHARAFTAADPVGLD

SEQ ID NO: 1241706 - protein, 18 aa, Mycobacterium
HMCAEMLLRAEQVSVASA

SEQ ID NO: 1241707 - protein, 25 aa, Mycobacterium
HMFFHRLGPVLARRLLLTGDIVDAG

SEQ ID NO: 1241708 - protein, 24 aa, Mycobacterium
HMLGPRGGAFVVAQTRLGGGRIHH

SEQ ID NO: 1241709 - protein, 24 aa, Mycobacterium
HMQPGELVALLGPSGCGKTTALRI

SEQ ID NO: 1241710 - protein, 24 aa, Mycobacterium
HNAGRSQMALGFFTHLAGDAAVAW

SEQ ID NO: 1241711 - protein, 17 aa, Mycobacterium
HNAHIRYSFAMAAQKAG

SEQ ID NO: 1241712 - protein, 24 aa, Mycobacterium
HNGTIYRWNRPVYDVVNGKPHLRV

SEQ ID NO: 1241713 - protein, 18 aa, Mycobacterium
HNLIHGFILAAEHLVPGG

SEQ ID NO: 1241714 - protein, 30 aa, Mycobacterium
HNRGYCGYAPVAGAPWLTAFAQTSKFAEAF

SEQ ID NO: 1241715 - protein, 17 aa, Mycobacterium
HNRILALGYRIAPRPVL

SEQ ID NO: 1241716 - protein, 19 aa, Mycobacterium
HNRVRMIVASFLVKDLHLP

SEQ ID NO: 1241717 - protein, 18 aa, Mycobacterium
HNTRGAGLASAYAAVQAG

SEQ ID NO: 1241718 - protein, 18 aa, Mycobacterium
HNVGFVVADLLAGRIGSG

SEQ ID NO: 1241719 - protein, 17 aa, Mycobacterium
HPACVELTFAAASLGAA

SEQ ID NO: 1241720 - protein, 27 aa, Mycobacterium
HPADLWRAAADLGWHGLAVAEQFGGAG

SEQ ID NO: 1241721 - protein, 19 aa, Mycobacterium
HPAHRRGDLVVGWASGFDG

SEQ ID NO: 1241722 - protein, 19 aa, Mycobacterium
HPAVEDCAVFGEPHPTDGE

SEQ ID NO: 1241723 - protein, 24 aa, Mycobacterium
HPDDARLGPPLRVVVTTARSLVQP

SEQ ID NO: 1241724 - protein, 18 aa, Mycobacterium
HPDEACGVIAGPEGSDRP

SEQ ID NO: 1241725 - protein, 21 aa, Mycobacterium
HPDLLPAYVTHTFDVDDVQAA

SEQ ID NO: 1241726 - protein, 18 aa, Mycobacterium
HPEIEGFSITAGNACGAN

SEQ ID NO: 1241727 - protein, 20 aa, Mycobacterium
HPELTASWLEPCRTDAGVRA

SEQ ID NO: 1241728 - protein, 23 aa, Mycobacterium
HPEQAWFPRARSATELSEVTAEN

SEQ ID NO: 1241729 - protein, 20 aa, Mycobacterium
HPFDLLARTRFRVTVNTDNR

SEQ ID NO: 1241730 - protein, 20 aa, Mycobacterium
HPFGGSWGYQVTSYYAPTSR

SEQ ID NO: 1241731 - protein, 22 aa, Mycobacterium
HPGPRWLVGDLAELDLPARGVA

SEQ ID NO: 1241732 - protein, 33 aa, Mycobacterium
HPGYLRAARGIEIPGRRQLFLHGCDVSRTADGS

SEQ ID NO: 1241733 - protein, 20 aa, Mycobacterium
HPHHRGLREPFGAEVKHVNP

SEQ ID NO: 1241734 - protein, 20 aa, Mycobacterium
HPIDEVFAWHTRPGAMPRLV

SEQ ID NO: 1241735 - protein, 24 aa, Mycobacterium
HPIIADATRTEWLQALRADDFGLD

SEQ ID NO: 1241736 - protein, 22 aa, Mycobacterium
HPKVRGRGVGHLIVERLLDVAR

SEQ ID NO: 1241737 - protein, 24 aa, Mycobacterium
HPLDVWSLTDIVAFNRDSADGTSI

SEQ ID NO: 1241738 - protein, 24 aa, Mycobacterium
HPLGATGLAQCAELTWQLRGTADA

SEQ ID NO: 1241739 - protein, 19 aa, Mycobacterium
HPLLASVPVSFDFNPDRIS

SEQ ID NO: 1241740 - protein, 23 aa, Mycobacterium
HPLPELLLATAFAHYLYDRLAVG

SEQ ID NO: 1241741 - protein, 18 aa, Mycobacterium
HPMHVGGLQLFEPPDGIS

SEQ ID NO: 1241742 - protein, 21 aa, Mycobacterium
HPNCKSDVLYKGALQGDPNSD

SEQ ID NO: 1241743 - protein, 19 aa, Mycobacterium
HPNLRAGFFRGDLPRPVQV

SEQ ID NO: 1241744 - protein, 17 aa, Mycobacterium
HPNLVRKLFSLEVPEIN

SEQ ID NO: 1241745 - protein, 24 aa, Mycobacterium
HPPTRPEVLFVWQVAVTSAARGTG

SEQ ID NO: 1241746 - protein, 18 aa, Mycobacterium
HPQYCRRLILISSGGLGP

SEQ ID NO: 1241747 - protein, 17 aa, Mycobacterium
HPQYDLAKRQMRGGGTV

SEQ ID NO: 1241748 - protein, 21 aa, Mycobacterium
HPQYLVMLVLWDHRKSADSPL

SEQ ID NO: 1241749 - protein, 17 aa, Mycobacterium
HPRRIRAPMRRVGDRYV

SEQ ID NO: 1241750 - protein, 18 aa, Mycobacterium
HPTPGWWDGVAGPGAPID

SEQ ID NO: 1241751 - protein, 24 aa, Mycobacterium
HPTYEERFPQIGWEITAGNSSPLS

SEQ ID NO: 1241752 - protein, 22 aa, Mycobacterium
HPVEVWGWDEAYLGADVEDPFA

SEQ ID NO: 1241753 - protein, 22 aa, Mycobacterium
HPVLEWITGTALRPVRSRLTDE

SEQ ID NO: 1241754 - protein, 17 aa, Mycobacterium
HQACQALQLGECDLALA

SEQ ID NO: 1241755 - protein, 32 aa, Mycobacterium
HQERRYQRFAAFWRSRPVNWVWDRLPMSVRYN

SEQ ID NO: 1241756 - protein, 19 aa, Mycobacterium
HQFGRAIGSYQAIKHKLAD

SEQ ID NO: 1241757 - protein, 20 aa, Mycobacterium
HQLWAETRIELFTQATDTRP

SEQ ID NO: 1241758 - protein, 22 aa, Mycobacterium
HQREPLIYGIGVWHGVRRYLVL

SEQ ID NO: 1241759 - protein, 18 aa, Mycobacterium
HQRTADCVVAGYRLHKSG

SEQ ID NO: 1241760 - protein, 18 aa, Mycobacterium
HRAAALAPWLKHYNTQRR

SEQ ID NO: 1241761 - protein, 30 aa, Mycobacterium
HRAAAMIAEAGDWVTCWAVGMNQSTHGTAN

SEQ ID NO: 1241762 - protein, 19 aa, Mycobacterium
HRAASSVKERKDWSYERWT

SEQ ID NO: 1241763 - protein, 17 aa, Mycobacterium
HRAFLRMINDPDQRAEF

SEQ ID NO: 1241764 - protein, 24 aa, Mycobacterium
HRAGLQFPAPTLLYGYGAYESCED

SEQ ID NO: 1241765 - protein, 22 aa, Mycobacterium
HRARTHLGYGEWLRRMNRRGDA

SEQ ID NO: 1241766 - protein, 26 aa, Mycobacterium
HRARTRGGPPIAFQLLWYPVTMWDMS

SEQ ID NO: 1241767 - protein, 18 aa, Mycobacterium
HRDGVGLTVRYLTPHSKW

SEQ ID NO: 1241768 - protein, 26 aa, Mycobacterium
HRDVSCAIISVGAWSPGASQVYQSLT

SEQ ID NO: 1241769 - protein, 29 aa, Mycobacterium
HREAYQRIFARLGVHYVIVSAVSGAMGGS

SEQ ID NO: 1241770 - protein, 18 aa, Mycobacterium
HRELPLRADYVGKNVPTS

SEQ ID NO: 1241771 - protein, 19 aa, Mycobacterium
HREPLDIAMGMGILVTQVL

SEQ ID NO: 1241772 - protein, 19 aa, Mycobacterium
HREQLDWVFETFPRLAERR

SEQ ID NO: 1241773 - protein, 21 aa, Mycobacterium
HREVFDVLATTTWLGDDPGRA

SEQ ID NO: 1241774 - protein, 18 aa, Mycobacterium
HRGAALIERSEALRRAAQ

SEQ ID NO: 1241775 - protein, 23 aa, Mycobacterium
HRHAHWLLPAAHWLERDDLLAFT

SEQ ID NO: 1241776 - protein, 19 aa, Mycobacterium
HRKTVLKLLARRPEAPTAP

SEQ ID NO: 1241777 - protein, 20 aa, Mycobacterium
HRLWQARRVLAVTFPGADGD

SEQ ID NO: 1241778 - protein, 21 aa, Mycobacterium
HRMLANWLGYCGSAPDEALVR

SEQ ID NO: 1241779 - protein, 21 aa, Mycobacterium
HRPALEVLILGGRPIREPVFH

SEQ ID NO: 1241780 - protein, 18 aa, Mycobacterium
HRPGRRFVSELAVGRAAD

SEQ ID NO: 1241781 - protein, 24 aa, Mycobacterium
HRRCEDVRYLGSWPTGTAAGAPPP

SEQ ID NO: 1241782 - protein, 24 aa, Mycobacterium
HRREVFARDGILLAVSQYAQPRDG

SEQ ID NO: 1241783 - protein, 25 aa, Mycobacterium
HRSCYRADALRDRFVVLPAGFDAVL

SEQ ID NO: 1241784 - protein, 18 aa, Mycobacterium
HRSVLEALGLPVSYDPDA

SEQ ID NO: 1241785 - protein, 19 aa, Mycobacterium
HRTAVWLPVVDRVVVLGTR

SEQ ID NO: 1241786 - protein, 18 aa, Mycobacterium
HRTKAVVIGGGLLGLEAA

SEQ ID NO: 1241787 - protein, 18 aa, Mycobacterium
HRVGEPGNRGFFVMERLE

SEQ ID NO: 1241788 - protein, 18 aa, Mycobacterium
HRVKISGYRIELGEVEAA

SEQ ID NO: 1241789 - protein, 25 aa, Mycobacterium
HRVQRGGNMLSVFFTAEPVGDFATA

SEQ ID NO: 1241790 - protein, 17 aa, Mycobacterium
HRVRRARNRIIADHGAS

SEQ ID NO: 1241791 - protein, 20 aa, Mycobacterium
HRVRTRVGTVVPGDWTPKFA

SEQ ID NO: 1241792 - protein, 20 aa, Mycobacterium
HRVSAEWEYSGPAYGEAIAR

SEQ ID NO: 1241793 - protein, 17 aa, Mycobacterium
HSADAIARHRWFDTHSW

SEQ ID NO: 1241794 - protein, 18 aa, Mycobacterium
HSAFGPFWSVTRHADIIA

SEQ ID NO: 1241795 - protein, 17 aa, Mycobacterium
HSARMFCDITMPDGSPS

SEQ ID NO: 1241796 - protein, 18 aa, Mycobacterium
HSATVDWLTTVLAEDALG

SEQ ID NO: 1241797 - protein, 25 aa, Mycobacterium
HSDPDFAAAAGFPRPILHGLCTYGI

SEQ ID NO: 1241798 - protein, 19 aa, Mycobacterium
HSEEVPLRLPLGAEAVERL

SEQ ID NO: 1241799 - protein, 19 aa, Mycobacterium
HSIGAVILGDFEKIEEGQQ

SEQ ID NO: 1241800 - protein, 24 aa, Mycobacterium
HSLECWYAHIPGIKVVAPATVEDA

SEQ ID NO: 1241801 - protein, 21 aa, Mycobacterium
HSLRDALTVSYDFCRVTPDLM

SEQ ID NO: 1241802 - protein, 23 aa, Mycobacterium
HSMGGLHAWCLAATRPDLVNAVV

SEQ ID NO: 1241803 - protein, 17 aa, Mycobacterium
HSMHVYLLRAGDARRPV

SEQ ID NO: 1241804 - protein, 20 aa, Mycobacterium
HSPARWAWDKAMRREEASSL

SEQ ID NO: 1241805 - protein, 19 aa, Mycobacterium
HSPDAVVIFVTNPVDVVTY

SEQ ID NO: 1241806 - protein, 24 aa, Mycobacterium
HSPLKLCWVPGYSDYYPETPGGKP

SEQ ID NO: 1241807 - protein, 25 aa, Mycobacterium
HSQGAQVADDWLRRYGPTSDIDPAT

SEQ ID NO: 1241808 - protein, 20 aa, Mycobacterium
HSRGLGVLIDAVFNHLGPSG

SEQ ID NO: 1241809 - protein, 18 aa, Mycobacterium
HSTFAPLFRAGGVGRTPV

SEQ ID NO: 1241810 - protein, 24 aa, Mycobacterium
HSVLRSRFGFLAIHGGGLEQMTDV

SEQ ID NO: 1241811 - protein, 18 aa, Mycobacterium
HSVVRKSLGLTFDGAAFE

SEQ ID NO: 1241812 - protein, 18 aa, Mycobacterium
HTANRPFGYTMSGEALEP

SEQ ID NO: 1241813 - protein, 27 aa, Mycobacterium
HTEDSWLRHLVMLGARNRYGPPERAPQ

SEQ ID NO: 1241814 - protein, 22 aa, Mycobacterium
HTEHCRKEFGLVDGKGQAEQTI

SEQ ID NO: 1241815 - protein, 25 aa, Mycobacterium
HTGPAISAFNAWTLLKGLETLAVRV

SEQ ID NO: 1241816 - protein, 23 aa, Mycobacterium
HTGRGRPAKRYRLTAAGRAKLGH

SEQ ID NO: 1241817 - protein, 17 aa, Mycobacterium
HTIRLMAGHELVTEGFA

SEQ ID NO: 1241818 - protein, 18 aa, Mycobacterium
HTKGRMLQWASFYDEHGR

SEQ ID NO: 1241819 - protein, 24 aa, Mycobacterium
HTMREFTALMAPTPNSYRRFVPYS

SEQ ID NO: 1241820 - protein, 25 aa, Mycobacterium
HTNRGDIKIALFGNHAPKTVSNFVG

SEQ ID NO: 1241821 - protein, 24 aa, Mycobacterium
HTPFRGVGAVEVLALAERVLAALL

SEQ ID NO: 1241822 - protein, 22 aa, Mycobacterium
HTTRLGRRFQRCSGGRGETRWR

SEQ ID NO: 1241823 - protein, 27 aa, Mycobacterium
HVADARRKGWSWQAIADALGVSRQAVH

SEQ ID NO: 1241824 - protein, 17 aa, Mycobacterium
HVAEADVAVRIGPAAAR

SEQ ID NO: 1241825 - protein, 21 aa, Mycobacterium
HVAEAMGVVAAETIAGAETLP

SEQ ID NO: 1241826 - protein, 23 aa, Mycobacterium
HVAPGRVIVLPWDKHIAAGTEIQ

SEQ ID NO: 1241827 - protein, 18 aa, Mycobacterium
HVDRYAEAYSLWRTLGGV

SEQ ID NO: 1241828 - protein, 21 aa, Mycobacterium
HVDVPELLRVLDFTPTPDLVL

SEQ ID NO: 1241829 - protein, 17 aa, Mycobacterium
HVELPWDAMLLPIAEDM

SEQ ID NO: 1241830 - protein, 17 aa, Mycobacterium
HVESLLHRWYQHSLADP

SEQ ID NO: 1241831 - protein, 17 aa, Mycobacterium
HVFNALGACLDDPGYGK

SEQ ID NO: 1241832 - protein, 22 aa, Mycobacterium
HVFPNCGHWAMIEAKAAFEAAV

SEQ ID NO: 1241833 - protein, 17 aa, Mycobacterium
HVGEIYEDLAWFCIRAW

SEQ ID NO: 1241834 - protein, 20 aa, Mycobacterium
HVGPGQAVLTGWRMLLDLGR

SEQ ID NO: 1241835 - protein, 23 aa, Mycobacterium
HVHVKRALVLDGLLGSARELTRK

SEQ ID NO: 1241836 - protein, 20 aa, Mycobacterium
HVNVMLGGDVVRTSATVRFT

SEQ ID NO: 1241837 - protein, 29 aa, Mycobacterium
HVPAHTELAWVLGCFTGFGQASRMTQFKD

SEQ ID NO: 1241838 - protein, 17 aa, Mycobacterium
HVREMTADAPVMLDHLS

SEQ ID NO: 1241839 - protein, 26 aa, Mycobacterium
HVSGHAYAGELLFLYNGVKPRNVMPV

SEQ ID NO: 1241840 - protein, 24 aa, Mycobacterium
HVSNEFDATVCWMADASALEPGRE

SEQ ID NO: 1241841 - protein, 23 aa, Mycobacterium
HVSQPACRFVFNREAKATPDDIR

SEQ ID NO: 1241842 - protein, 23 aa, Mycobacterium
HVTKRFADYVAVADADFSIASGE

SEQ ID NO: 1241843 - protein, 17 aa, Mycobacterium
HVTRPGQYEAPLGITLR

SEQ ID NO: 1241844 - protein, 25 aa, Mycobacterium
HVVHQIWMPYHWGNAGLIDGDVVND

SEQ ID NO: 1241845 - protein, 25 aa, Mycobacterium
HVVRRFGELTARLYALEALLAAGTA

SEQ ID NO: 1241846 - protein, 18 aa, Mycobacterium
HVVYAPAVPAVFDAAQGR

SEQ ID NO: 1241847 - protein, 25 aa, Mycobacterium
HWDPRWPEFPGDFAGESIHSHHYVD

SEQ ID NO: 1241848 - protein, 26 aa, Mycobacterium
HWEALQIPVGLAFFFRNSALGRVVAF

SEQ ID NO: 1241849 - protein, 19 aa, Mycobacterium
HWGPPPGELFVDRSRNPDG

SEQ ID NO: 1241850 - protein, 25 aa, Mycobacterium
HWIHPGLPVSFGYDVTDGSGGRVAP

SEQ ID NO: 1241851 - protein, 18 aa, Mycobacterium
HWKAHKLDLSPVLHEPES

SEQ ID NO: 1241852 - protein, 27 aa, Mycobacterium
HWLGRDRFVLSCGHSSLTLYIQLYLGG

SEQ ID NO: 1241853 - protein, 21 aa, Mycobacterium
HWPQGRLSKAYAAYDTPFWRD

SEQ ID NO: 1241854 - protein, 17 aa, Mycobacterium
HWTSLAATVEKAGYDLL

SEQ ID NO: 1241855 - protein, 23 aa, Mycobacterium
HWYNLAAELGEPIPPHLHPGTKE

SEQ ID NO: 1241856 - protein, 24 aa, Mycobacterium
HYLESWLLPSLNLRASVFHFNPGF

SEQ ID NO: 1241857 - protein, 17 aa, Mycobacterium
HYLGCVHLQRLLREPPA

SEQ ID NO: 1241858 - protein, 25 aa, Mycobacterium
HYQKLTGLENLRFFASLYDGPTLDP

SEQ ID NO: 1241859 - protein, 20 aa, Mycobacterium
IAAAAAERFHRALLAGATDG

SEQ ID NO: 1241860 - protein, 17 aa, Mycobacterium
IAAALALQGLKVLVIDL

SEQ ID NO: 1241861 - protein, 23 aa, Mycobacterium
IAAALPHFHRLGGGHFVTVASIG

SEQ ID NO: 1241862 - protein, 25 aa, Mycobacterium
IAAARHRPVRIAPRMAVTARAVDSL

SEQ ID NO: 1241863 - protein, 20 aa, Mycobacterium
IAAFIICADLVRQFEFAQNV

SEQ ID NO: 1241864 - protein, 26 aa, Mycobacterium
IAAFPRYHPRWAWWTNAVPGLREFVV

SEQ ID NO: 1241865 - protein, 17 aa, Mycobacterium
IAAGGFFDGRGLAAALS

SEQ ID NO: 1241866 - protein, 24 aa, Mycobacterium
IAAGLAAFGARVAIWERDADRCAV

SEQ ID NO: 1241867 - protein, 17 aa, Mycobacterium
IAAGVSQLVGGAPTVAG

SEQ ID NO: 1241868 - protein, 19 aa, Mycobacterium
IAAHWRYKESKGRNGSPAG

SEQ ID NO: 1241869 - protein, 22 aa, Mycobacterium
IAAIVEELFPLAAVSDLHAFFG

SEQ ID NO: 1241870 - protein, 25 aa, Mycobacterium
IAALGRDNGWSGLIINGAVRDASTL

SEQ ID NO: 1241871 - protein, 20 aa, Mycobacterium
IAALKAKYLTREDVPEDVVA

SEQ ID NO: 1241872 - protein, 19 aa, Mycobacterium
IAAPFTSDERGFWAKLEGF

SEQ ID NO: 1241873 - protein, 20 aa, Mycobacterium
IAAPLTRVFSALVDPDALLE

SEQ ID NO: 1241874 - protein, 17 aa, Mycobacterium
IAATAKVAAKVDKAVID

SEQ ID NO: 1241875 - protein, 18 aa, Mycobacterium
IAAYRVGFDVDWSRPSEA

SEQ ID NO: 1241876 - protein, 21 aa, Mycobacterium
IACGIEAMSRVGLGANAGPDR

SEQ ID NO: 1241877 - protein, 20 aa, Mycobacterium
IADAVAWGAIGARTTESQVH

SEQ ID NO: 1241878 - protein, 17 aa, Mycobacterium
IADGIATMHMLAGLSDS

SEQ ID NO: 1241879 - protein, 17 aa, Mycobacterium
IADIGVGVFTAALREAI

SEQ ID NO: 1241880 - protein, 20 aa, Mycobacterium
IADLRAWLTTVVSRIGLDRL

SEQ ID NO: 1241881 - protein, 21 aa, Mycobacterium
IADPARYGLSRADATRFHNAR

SEQ ID NO: 1241882 - protein, 20 aa, Mycobacterium
IADTCYFGAEAEFYIFDSVT

SEQ ID NO: 1241883 - protein, 19 aa, Mycobacterium
IADVLRCIDGPLASVRDIG

SEQ ID NO: 1241884 - protein, 23 aa, Mycobacterium
IAEAEGLTVLGWRDVPTDDSSLG

SEQ ID NO: 1241885 - protein, 17 aa, Mycobacterium
IAEAGWFTRAEVRAALA

SEQ ID NO: 1241886 - protein, 26 aa, Mycobacterium
IAEDIRRYLAEMGFRSVDEAVGHAEI

SEQ ID NO: 1241887 - protein, 27 aa, Mycobacterium
IAEPLPRTLAWSAAWEMTREAELRARD

SEQ ID NO: 1241888 - protein, 18 aa, Mycobacterium
IAEQAPLAPWVQRELAPG

SEQ ID NO: 1241889 - protein, 25 aa, Mycobacterium
IAEVSARAGVEVLVFETTDALVTAG

SEQ ID NO: 1241890 - protein, 18 aa, Mycobacterium
IAFWPPAEALDEWVTMGA

SEQ ID NO: 1241891 - protein, 22 aa, Mycobacterium
IAGEGPAILLIHGIGDNSTTWN

SEQ ID NO: 1241892 - protein, 37 aa, Mycobacterium
IAGNGLRPAIWDEFTNRFGIDRVCEFYAASEGNTAFV

SEQ ID NO: 1241893 - protein, 18 aa, Mycobacterium
IAGPFHFYHCSIPCEGGG

SEQ ID NO: 1241894 - protein, 22 aa, Mycobacterium
IAGREFGSRLILGTGGAANLAV

SEQ ID NO: 1241895 - protein, 21 aa, Mycobacterium
IAGVFGESFQTAFAAAPGLLE

SEQ ID NO: 1241896 - protein, 17 aa, Mycobacterium
IAHAMSLPRPGWAEADA

SEQ ID NO: 1241897 - protein, 17 aa, Mycobacterium
IAIALACDPELLIADEP

SEQ ID NO: 1241898 - protein, 19 aa, Mycobacterium
IAIEPRLRCDAARDQALTQ

SEQ ID NO: 1241899 - protein, 17 aa, Mycobacterium
IAIERGTHFKGFERSKY

SEQ ID NO: 1241900 - protein, 24 aa, Mycobacterium
IAKGSLRGGLVLGLEDSGSRMHRI

SEQ ID NO: 1241901 - protein, 23 aa, Mycobacterium
IAKTGRPGAVLVDIPKDILQGQC

SEQ ID NO: 1241902 - protein, 18 aa, Mycobacterium
IALEEILIRFPDWEVDID

SEQ ID NO: 1241903 - protein, 19 aa, Mycobacterium
IALEGKGDMPYRWDDDYGA

SEQ ID NO: 1241904 - protein, 23 aa, Mycobacterium
IALPNLRALHAVHGPVALVHFDA

SEQ ID NO: 1241905 - protein, 17 aa, Mycobacterium
IALRGLTAGPCRTRDLP

SEQ ID NO: 1241906 - protein, 27 aa, Mycobacterium
IAMLRAVNVPARLVSVYAPGCSPMDFH

SEQ ID NO: 1241907 - protein, 21 aa, Mycobacterium
IAMNMSMDGAWGQWVNRWTAE

SEQ ID NO: 1241908 - protein, 23 aa, Mycobacterium
IANEVAKSYGFWMGDAFASGGSV

SEQ ID NO: 1241909 - protein, 20 aa, Mycobacterium
IANGEFFVILGPSGAGKTTT

SEQ ID NO: 1241910 - protein, 18 aa, Mycobacterium
IANLPRERLSIAVAAVAS

SEQ ID NO: 1241911 - protein, 20 aa, Mycobacterium
IANRLCAQILLLSAEDPTKD

SEQ ID NO: 1241912 - protein, 18 aa, Mycobacterium
IAPDRPAVIVAETGEQVS

SEQ ID NO: 1241913 - protein, 17 aa, Mycobacterium
IAPRLDDRYPTYGVLAT

SEQ ID NO: 1241914 - protein, 17 aa, Mycobacterium
IAPRTFHAWAVRAPSKR

SEQ ID NO: 1241915 - protein, 20 aa, Mycobacterium
IAPSARRRDLLNAVRGAHPY

SEQ ID NO: 1241916 - protein, 19 aa, Mycobacterium
IAPWNYPLLQMSWKVAPAL

SEQ ID NO: 1241917 - protein, 18 aa, Mycobacterium
IARARRLGLCGFGALGVD

SEQ ID NO: 1241918 - protein, 19 aa, Mycobacterium
IARMEARAHTARAAYYDAA

SEQ ID NO: 1241919 - protein, 24 aa, Mycobacterium
IARSFAAALGLQFTRVQFTPDLLP

SEQ ID NO: 1241920 - protein, 23 aa, Mycobacterium
IASGETIMAFAITEPDAGSNSHN

SEQ ID NO: 1241921 - protein, 24 aa, Mycobacterium
IASGNLRKVIRLMKYLRDHKNSFT

SEQ ID NO: 1241922 - protein, 25 aa, Mycobacterium
IASHLPRAVGVAFSTARAGKLGVPC

SEQ ID NO: 1241923 - protein, 23 aa, Mycobacterium
IASKRIAPIVILTAFSQRDLVER

SEQ ID NO: 1241924 - protein, 19 aa, Mycobacterium
IASLGRYGYGWADSDVAGA

SEQ ID NO: 1241925 - protein, 20 aa, Mycobacterium
IASLNYLLTSHVWRQDHNGA

SEQ ID NO: 1241926 - protein, 18 aa, Mycobacterium
IASLTFLAVAGRKVQAEI

SEQ ID NO: 1241927 - protein, 25 aa, Mycobacterium
IASRVDELLDLVGLDPGQYADRYPR

SEQ ID NO: 1241928 - protein, 20 aa, Mycobacterium
IASSNVHRWFGAYGPSKAAL

SEQ ID NO: 1241929 - protein, 18 aa, Mycobacterium
IASYLRAFPGYYLTGDGG

SEQ ID NO: 1241930 - protein, 21 aa, Mycobacterium
IATLIPDEWLAPAATGSARQC

SEQ ID NO: 1241931 - protein, 24 aa, Mycobacterium
IAVADRLGLRFTLRDVADALEVPV

SEQ ID NO: 1241932 - protein, 18 aa, Mycobacterium
IAVDLCDQIASVPYPLAT

SEQ ID NO: 1241933 - protein, 20 aa, Mycobacterium
IAVELARQGADIALVDVSEA

SEQ ID NO: 1241934 - protein, 20 aa, Mycobacterium
IAVEPFRKWWQPGPGEGCIG

SEQ ID NO: 1241935 - protein, 17 aa, Mycobacterium
IAVLPGTQVLRLTIPET

SEQ ID NO: 1241936 - protein, 17 aa, Mycobacterium
IAVLTWINVWQLQPNAQ

SEQ ID NO: 1241937 - protein, 21 aa, Mycobacterium
IAVNFPLYVILSLLGLPEEDF

SEQ ID NO: 1241938 - protein, 22 aa, Mycobacterium
IAVPVRRPRRRAAARPAGPPSS

SEQ ID NO: 1241939 - protein, 17 aa, Mycobacterium
IAVRYTLPGMTPADTAD

SEQ ID NO: 1241940 - protein, 20 aa, Mycobacterium
IAVSANFLWAPDPGPMDVVT

SEQ ID NO: 1241941 - protein, 18 aa, Mycobacterium
IAVSRWVRRHAIRPEWAG

SEQ ID NO: 1241942 - protein, 24 aa, Mycobacterium
IAVTRLGITNVRFTGGEPLVVRHL

SEQ ID NO: 1241943 - protein, 17 aa, Mycobacterium
IAYRLLGTLTQFRYVAK

SEQ ID NO: 1241944 - protein, 25 aa, Mycobacterium
IAYSHCIAHGFDLRHGLDQQYRAVN

SEQ ID NO: 1241945 - protein, 18 aa, Mycobacterium
ICDGGFELDVRYAPTRLR

SEQ ID NO: 1241946 - protein, 22 aa, Mycobacterium
ICGSDLPGFRGAKGRLPSDTGV

SEQ ID NO: 1241947 - protein, 17 aa, Mycobacterium
ICMNAASTWDWFPGHHD

SEQ ID NO: 1241948 - protein, 21 aa, Mycobacterium
ICVSDLAAALGRSENAVSQAL

SEQ ID NO: 1241949 - protein, 17 aa, Mycobacterium
IDAASPIDLAAAANLNV

SEQ ID NO: 1241950 - protein, 23 aa, Mycobacterium
IDAAVALGRRVSFVGRSMVRNMG

SEQ ID NO: 1241951 - protein, 19 aa, Mycobacterium
IDAFVEFYHAPILHMKQAT

SEQ ID NO: 1241952 - protein, 18 aa, Mycobacterium
IDAKLGHPTRDPHGDPIP

SEQ ID NO: 1241953 - protein, 18 aa, Mycobacterium
IDALLALRPDACCYNPLW

SEQ ID NO: 1241954 - protein, 18 aa, Mycobacterium
IDALRGADAVVFAAGAGP

SEQ ID NO: 1241955 - protein, 18 aa, Mycobacterium
IDALVKWVGTEQVESLGP

SEQ ID NO: 1241956 - protein, 23 aa, Mycobacterium
IDALWPMVVLRTAVLIVSGAQQA

SEQ ID NO: 1241957 - protein, 24 aa, Mycobacterium
IDANLVAFWAILATRVEAPGLAEL

SEQ ID NO: 1241958 - protein, 17 aa, Mycobacterium
IDATGLLVTPGFVDLHT

SEQ ID NO: 1241959 - protein, 19 aa, Mycobacterium
IDAVRRLAANYERRRSEMA

SEQ ID NO: 1241960 - protein, 18 aa, Mycobacterium
IDDYTAWRLLEGLDDIGL

SEQ ID NO: 1241961 - protein, 25 aa, Mycobacterium
IDEAIKLGDKVAVFGRGGVLLQYDA

SEQ ID NO: 1241962 - protein, 27 aa, Mycobacterium
IDEFGRPDIWVAIAVATDAQWDALCAA

SEQ ID NO: 1241963 - protein, 25 aa, Mycobacterium
IDEGLKLLGQFGRYVEIGNINIGKT

SEQ ID NO: 1241964 - protein, 18 aa, Mycobacterium
IDELKQDYTIVIVTHNMQ

SEQ ID NO: 1241965 - protein, 18 aa, Mycobacterium
IDEPRPISSMPGVVQHTR

SEQ ID NO: 1241966 - protein, 17 aa, Mycobacterium
IDGDGCFQMTNQELATC

SEQ ID NO: 1241967 - protein, 21 aa, Mycobacterium
IDGGIPLDRAALIGCGVTTGY

SEQ ID NO: 1241968 - protein, 19 aa, Mycobacterium
IDGGRWEIYVGGAAGAHIR

SEQ ID NO: 1241969 - protein, 20 aa, Mycobacterium
IDGPMSIEVIHRLAATTEVR

SEQ ID NO: 1241970 - protein, 24 aa, Mycobacterium
IDGVRWSDIVSRVFGRIDPLATGG

SEQ ID NO: 1241971 - protein, 17 aa, Mycobacterium
IDICAPVHDTITYPAAT

SEQ ID NO: 1241972 - protein, 28 aa, Mycobacterium
IDIDGCVYREGLSAVRIDGGIAGNVIPD

SEQ ID NO: 1241973 - protein, 17 aa, Mycobacterium
IDIGEVLLRAHAAARMS

SEQ ID NO: 1241974 - protein, 22 aa, Mycobacterium
IDKFPRMVDYVTPTGVRIADAD

SEQ ID NO: 1241975 - protein, 18 aa, Mycobacterium
IDLEGGQVGDLFAFAAAD

SEQ ID NO: 1241976 - protein, 21 aa, Mycobacterium
IDLERRRISLSLKQANEDYTE

SEQ ID NO: 1241977 - protein, 22 aa, Mycobacterium
IDLGVHAFRGIFDRVDVDPGAV

SEQ ID NO: 1241978 - protein, 20 aa, Mycobacterium
IDLIMPIGKGQRALIVSPPK

SEQ ID NO: 1241979 - protein, 17 aa, Mycobacterium
IDLLQDGWQLRDYQEMA

SEQ ID NO: 1241980 - protein, 24 aa, Mycobacterium
IDLPGHGRSAWREDGDYGPKLNAE

SEQ ID NO: 1241981 - protein, 18 aa, Mycobacterium
IDLRDDWPRALRDRGFDP

SEQ ID NO: 1241982 - protein, 32 aa, Mycobacterium
IDLRMIPAPLRWSSRHLLQFLTVGFLAPIFRE

SEQ ID NO: 1241983 - protein, 20 aa, Mycobacterium
IDLRVLRPLDTATFVESVRR

SEQ ID NO: 1241984 - protein, 27 aa, Mycobacterium
IDLVIKEALRLLAPVPLVMRKTVRDVA

SEQ ID NO: 1241985 - protein, 25 aa, Mycobacterium
IDMARLLCHKAAWTIDQEGNKAAHV

SEQ ID NO: 1241986 - protein, 20 aa, Mycobacterium
IDNRGKISLVLVAEEEAAEA

SEQ ID NO: 1241987 - protein, 24 aa, Mycobacterium
IDPDARPALVSQWELAVTEGPHAA

SEQ ID NO: 1241988 - protein, 26 aa, Mycobacterium
IDPDAWAFTWVVDWPLFEMAEDATAA

SEQ ID NO: 1241989 - protein, 17 aa, Mycobacterium
IDPEFGPQWHLGVQPLI

SEQ ID NO: 1241990 - protein, 24 aa, Mycobacterium
IDPELRRPITELGMVKNVTVDPGD

SEQ ID NO: 1241991 - protein, 18 aa, Mycobacterium
IDPFRHAKTLNMNFFVHD

SEQ ID NO: 1241992 - protein, 17 aa, Mycobacterium
IDPRFTRTSALADRYVS

SEQ ID NO: 1241993 - protein, 19 aa, Mycobacterium
IDPRSAFYSEEVLRRDVGI

SEQ ID NO: 1241994 - protein, 17 aa, Mycobacterium
IDPVRFIGNRSSGKQGY

SEQ ID NO: 1241995 - protein, 24 aa, Mycobacterium
IDQRSACRHPDWTGPDDLTIKINE

SEQ ID NO: 1241996 - protein, 21 aa, Mycobacterium
IDRFARLGVIANMQPLWAQLD

SEQ ID NO: 1241997 - protein, 22 aa, Mycobacterium
IDRIPERLSLAGEFGLETIDYG

SEQ ID NO: 1241998 - protein, 25 aa, Mycobacterium
IDRPLRPTFVSGLRNEIQVVVTVMS

SEQ ID NO: 1241999 - protein, 26 aa, Mycobacterium
IDRRARWGDPVPDGFVRLSMGIEDTD

SEQ ID NO: 1242000 - protein, 17 aa, Mycobacterium
IDRVLALADERQARITH

SEQ ID NO: 1242001 - protein, 19 aa, Mycobacterium
IDRVPLWVEETLRYDTSSQ

SEQ ID NO: 1242002 - protein, 19 aa, Mycobacterium
IDRYRLDAERSYRRLDAVL

SEQ ID NO: 1242003 - protein, 23 aa, Mycobacterium
IDSPERLWEALLRGDDFVTEVPL

SEQ ID NO: 1242004 - protein, 18 aa, Mycobacterium
IDSSDEWVVLDAGQLEIE

SEQ ID NO: 1242005 - protein, 26 aa, Mycobacterium
IDVELPKRRLTVFTGVSGSGKSSLVF

SEQ ID NO: 1242006 - protein, 26 aa, Mycobacterium
IDVPHLDAALDWAKRNPAAAFGAVEV

SEQ ID NO: 1242007 - protein, 17 aa, Mycobacterium
IDVSCDVGMGFSWSRPT

SEQ ID NO: 1242008 - protein, 29 aa, Mycobacterium
IDVSSIKELCRRWYPRIYFGQPEKGLAHR

SEQ ID NO: 1242009 - protein, 21 aa, Mycobacterium
IDWPAPEKVPPLWKTFEHRRN

SEQ ID NO: 1242010 - protein, 17 aa, Mycobacterium
IDYDRIEVVVHPQSIVH

SEQ ID NO: 1242011 - protein, 23 aa, Mycobacterium
IEAAGFKLGTDVTLALDVAATEF

SEQ ID NO: 1242012 - protein, 20 aa, Mycobacterium
IEAAPWQWVGRELPQFSSAP

SEQ ID NO: 1242013 - protein, 17 aa, Mycobacterium
IEACLRAVTEGVPSAHV

SEQ ID NO: 1242014 - protein, 17 aa, Mycobacterium
IEADKGISVDVVVDTIK

SEQ ID NO: 1242015 - protein, 26 aa, Mycobacterium
IEAIDAEIPLLVVITEGIPVQDTAYA

SEQ ID NO: 1242016 - protein, 20 aa, Mycobacterium
IEARALGSVMGRGRPATSPL

SEQ ID NO: 1242017 - protein, 21 aa, Mycobacterium
IEARTPAWVWNLSSIGGVAVV

SEQ ID NO: 1242018 - protein, 20 aa, Mycobacterium
IEAVAFGGTVFYFGVADDDA

SEQ ID NO: 1242019 - protein, 23 aa, Mycobacterium
IEAVARPEVWIFLRPFADALTDA

SEQ ID NO: 1242020 - protein, 18 aa, Mycobacterium
IEAVEYGVRINAVSPSIA

SEQ ID NO: 1242021 - protein, 26 aa, Mycobacterium
IEAVLECREALAVNVKPKFAVDAMVA

SEQ ID NO: 1242022 - protein, 27 aa, Mycobacterium
IEDKFPSRFLLGIGIGHPEATQEYRKP

SEQ ID NO: 1242023 - protein, 25 aa, Mycobacterium
IEDVELIDVYSCFPSAVQVAATELG

SEQ ID NO: 1242024 - protein, 23 aa, Mycobacterium
IEELLRGADMVFVTAGEGGGTGT

SEQ ID NO: 1242025 - protein, 25 aa, Mycobacterium
IEFPARIGVWWASETWSITDAQDVA

SEQ ID NO: 1242026 - protein, 24 aa, Mycobacterium
IEGGEGRPAIVIEHITRLRDDLRP

SEQ ID NO: 1242027 - protein, 25 aa, Mycobacterium
IEGIGRPRVEPSFLPEVVDRMVAVL

SEQ ID NO: 1242028 - protein, 26 aa, Mycobacterium
IEGLSRHRWAVLMKVHHCLADGIAAT

SEQ ID NO: 1242029 - protein, 28 aa, Mycobacterium
IEGNAAARCGISMKGIDIVVGGDIGHMS

SEQ ID NO: 1242030 - protein, 20 aa, Mycobacterium
IEGPAGWGEFGPFLEYAPPE

SEQ ID NO: 1242031 - protein, 21 aa, Mycobacterium
IEGYLKWNRTRGWRGQRAAAG

SEQ ID NO: 1242032 - protein, 21 aa, Mycobacterium
IEHCAGFLGILGLYTLGQAPD

SEQ ID NO: 1242033 - protein, 23 aa, Mycobacterium
IEHHAVLDAVQWLVEHEGAEVTW

SEQ ID NO: 1242034 - protein, 22 aa, Mycobacterium
IEIDAGAIADAFIEAGADLAAA

SEQ ID NO: 1242035 - protein, 21 aa, Mycobacterium
IEIMGKEILPEFIERDEKAVK

SEQ ID NO: 1242036 - protein, 19 aa, Mycobacterium
IEKEFKAVRAPGARRDKYS

SEQ ID NO: 1242037 - protein, 20 aa, Mycobacterium
IEKLGAAPVRIVAVSMGSFI

SEQ ID NO: 1242038 - protein, 25 aa, Mycobacterium
IELDGLRLITWRGASRAEQGLPYAR

SEQ ID NO: 1242039 - protein, 22 aa, Mycobacterium
IELEPVKPFVALRHLRFHSLTE

SEQ ID NO: 1242040 - protein, 18 aa, Mycobacterium
IELPEVVAPLAAYVPAVR

SEQ ID NO: 1242041 - protein, 18 aa, Mycobacterium
IELRRLLYCGEWIHSHAL

SEQ ID NO: 1242042 - protein, 20 aa, Mycobacterium
IELTARMLATLLDFPYEQRH

SEQ ID NO: 1242043 - protein, 18 aa, Mycobacterium
IELTLEMAAEADLAVDEE

SEQ ID NO: 1242044 - protein, 19 aa, Mycobacterium
IENGASWVPYLFYQFKDVY

SEQ ID NO: 1242045 - protein, 25 aa, Mycobacterium
IENPERWAPPYAEAGAHNVTFHAEA

SEQ ID NO: 1242046 - protein, 17 aa, Mycobacterium
IENRLAALIPPPVRKLP

SEQ ID NO: 1242047 - protein, 17 aa, Mycobacterium
IENYLGFPDGLSGSQLA

SEQ ID NO: 1242048 - protein, 26 aa, Mycobacterium
IEPVEWKRDAALKFGGTHAYPDLESA

SEQ ID NO: 1242049 - protein, 22 aa, Mycobacterium
IERGEGVVYWQVPKSATLDTTI

SEQ ID NO: 1242050 - protein, 27 aa, Mycobacterium
IERKLVGGTCVNYGCIPTKTLVASAHA

SEQ ID NO: 1242051 - protein, 18 aa, Mycobacterium
IERLKVAVQLLFETSRPD

SEQ ID NO: 1242052 - protein, 24 aa, Mycobacterium
IERLRRHPAARALRVDKLTLAALE

SEQ ID NO: 1242053 - protein, 24 aa, Mycobacterium
IERRGALPGLRMAYFGDGANNMAH

SEQ ID NO: 1242054 - protein, 17 aa, Mycobacterium
IESRGGFVAAHDHIAEQ

SEQ ID NO: 1242055 - protein, 20 aa, Mycobacterium
IESRYFVSLVTGQVAKNMIQ

SEQ ID NO: 1242056 - protein, 18 aa, Mycobacterium
IETFRCGMMARPSVAADL

SEQ ID NO: 1242057 - protein, 25 aa, Mycobacterium
IETNVEFWAAVILDFAQVPASMMPA

SEQ ID NO: 1242058 - protein, 19 aa, Mycobacterium
IETRTGYEIAVVTGAASSV

SEQ ID NO: 1242059 - protein, 26 aa, Mycobacterium
IEVAVCSTGLIGDRLPMDKVLAGVTE

SEQ ID NO: 1242060 - protein, 18 aa, Mycobacterium
IEVIHRLAATTEVRASMS

SEQ ID NO: 1242061 - protein, 20 aa, Mycobacterium
IEVMARVGLAGLSMRVVAAQ

SEQ ID NO: 1242062 - protein, 25 aa, Mycobacterium
IEYEIKDPRLAGVTITDSKVTNDLH

SEQ ID NO: 1242063 - protein, 21 aa, Mycobacterium
IFARRLPDGRRYGVVAGTARL

SEQ ID NO: 1242064 - protein, 28 aa, Mycobacterium
IFGGMKLDFLITVDWDYYKKFMSVNLDG

SEQ ID NO: 1242065 - protein, 24 aa, Mycobacterium
IFGRSRYDYLVTMCDEMGIVTPEH

SEQ ID NO: 1242066 - protein, 23 aa, Mycobacterium
IFHPVGTCAMGAFDTRGLPRSAT

SEQ ID NO: 1242067 - protein, 18 aa, Mycobacterium
IFNQFDVPINMERVLHRD

SEQ ID NO: 1242068 - protein, 24 aa, Mycobacterium
IFQAREALELGALELTIGRLSPSQ

SEQ ID NO: 1242069 - protein, 19 aa, Mycobacterium
IFSSLGSRVTIVIRGTAML

SEQ ID NO: 1242070 - protein, 17 aa, Mycobacterium
IFTGVDLAIDKGSRVVV

SEQ ID NO: 1242071 - protein, 21 aa, Mycobacterium
IGAAGRLYIGGSVADVTTARD

SEQ ID NO: 1242072 - protein, 24 aa, Mycobacterium
IGAALRIGDRFDLARMLSDAARTI

SEQ ID NO: 1242073 - protein, 21 aa, Mycobacterium
IGAAVDRFGRLDVLVANAGII

SEQ ID NO: 1242074 - protein, 18 aa, Mycobacterium
IGAAVGMPVVSLRLVDPR

SEQ ID NO: 1242075 - protein, 25 aa, Mycobacterium
IGAEPRTDWLDGIVVRDDHGFILAG

SEQ ID NO: 1242076 - protein, 17 aa, Mycobacterium
IGAGHAFDLILTARQVD

SEQ ID NO: 1242077 - protein, 18 aa, Mycobacterium
IGAPASWASAVEAQQQSD

SEQ ID NO: 1242078 - protein, 18 aa, Mycobacterium
IGASGLRQVHELVRQLRG

SEQ ID NO: 1242079 - protein, 26 aa, Mycobacterium
IGCDRCWYCEHDLYSCCDTTNPNAEL

SEQ ID NO: 1242080 - protein, 24 aa, Mycobacterium
IGDAFRAGFLTGRSAGLSLERAAQ

SEQ ID NO: 1242081 - protein, 20 aa, Mycobacterium
IGDLFGGLFGRGASPRPSRP

SEQ ID NO: 1242082 - protein, 25 aa, Mycobacterium
IGDLPILFQPGVLSIAWGTAIRQLA

SEQ ID NO: 1242083 - protein, 17 aa, Mycobacterium
IGDRLVLTHDGVSAVYA

SEQ ID NO: 1242084 - protein, 17 aa, Mycobacterium
IGDRTGALKGWFDAHAE

SEQ ID NO: 1242085 - protein, 23 aa, Mycobacterium
IGDSAALFPSWETLPHERLSPGV

SEQ ID NO: 1242086 - protein, 26 aa, Mycobacterium
IGDVGRPDLLASIGFTREELAEKLYD

SEQ ID NO: 1242087 - protein, 19 aa, Mycobacterium
IGDWIEMFTMWPTKYTPGL

SEQ ID NO: 1242088 - protein, 29 aa, Mycobacterium
IGEACRRARRKGVKVAHAHLRHLNPFPAN

SEQ ID NO: 1242089 - protein, 17 aa, Mycobacterium
IGEEFATRLAADRVNLI

SEQ ID NO: 1242090 - protein, 18 aa, Mycobacterium
IGEICAALDKLAADGGVD

SEQ ID NO: 1242091 - protein, 17 aa, Mycobacterium
IGEVLLRAHAAARMSPG

SEQ ID NO: 1242092 - protein, 23 aa, Mycobacterium
IGEVVRSRCDAFAVGDVVTTLTG

SEQ ID NO: 1242093 - protein, 20 aa, Mycobacterium
IGGAGVKLLFNIVPESAVYL

SEQ ID NO: 1242094 - protein, 20 aa, Mycobacterium
IGGGFGNKVPIYPGYVCAIV

SEQ ID NO: 1242095 - protein, 20 aa, Mycobacterium
IGGGGRYDGLMRRLGGQDVS

SEQ ID NO: 1242096 - protein, 20 aa, Mycobacterium
IGGLPRGRVIEIYGPESSGK

SEQ ID NO: 1242097 - protein, 19 aa, Mycobacterium
IGHACGHNIIAASAVGTAL

SEQ ID NO: 1242098 - protein, 17 aa, Mycobacterium
IGIAPSTCHGRVRRLQE

SEQ ID NO: 1242099 - protein, 17 aa, Mycobacterium
IGIAVAYSAWKFYQATG

SEQ ID NO: 1242100 - protein, 25 aa, Mycobacterium
IGIGLLIDGRWRWRSYSLTSSPRSG

SEQ ID NO: 1242101 - protein, 21 aa, Mycobacterium
IGITLARMMKRRQFGHTLYEH

SEQ ID NO: 1242102 - protein, 28 aa, Mycobacterium
IGIYPDGRFSYQLTIYIFRYGEGTVMAI

SEQ ID NO: 1242103 - protein, 26 aa, Mycobacterium
IGKIRLPLGQGISGWVASHREPVVIG

SEQ ID NO: 1242104 - protein, 24 aa, Mycobacterium
IGLRNCPFLDLADTRRDVVCPVHL

SEQ ID NO: 1242105 - protein, 18 aa, Mycobacterium
IGLSRPSLDDVFLSLTGH

SEQ ID NO: 1242106 - protein, 33 aa, Mycobacterium
IGMTNLVAARVGRPPVIRRAILTLFADRAPEVG

SEQ ID NO: 1242107 - protein, 17 aa, Mycobacterium
IGMVLPISAIELMRMRL

SEQ ID NO: 1242108 - protein, 23 aa, Mycobacterium
IGNTEWPKWETVMAADPVDPAEL

SEQ ID NO: 1242109 - protein, 25 aa, Mycobacterium
IGNTWECLAHVYLRRVLTSTELWPV

SEQ ID NO: 1242110 - protein, 17 aa, Mycobacterium
IGPAAARQSYLDIDAVV

SEQ ID NO: 1242111 - protein, 17 aa, Mycobacterium
IGPVLELTHGFMAEKTI

SEQ ID NO: 1242112 - protein, 26 aa, Mycobacterium
IGQALAVRVFTRFVFGFGLDDRDMQR

SEQ ID NO: 1242113 - protein, 22 aa, Mycobacterium
IGQCFTGGFALAAAVDDSVLAP

SEQ ID NO: 1242114 - protein, 24 aa, Mycobacterium
IGQTEVRPILLWHAFEESEHKAVA

SEQ ID NO: 1242115 - protein, 17 aa, Mycobacterium
IGRLGRVADRPVLAARV

SEQ ID NO: 1242116 - protein, 18 aa, Mycobacterium
IGTMIKQLLEEVRAAPLD

SEQ ID NO: 1242117 - protein, 18 aa, Mycobacterium
IGTTCCFATQDKVWVTGP

SEQ ID NO: 1242118 - protein, 17 aa, Mycobacterium
IGVDGVIERVLDRVGDH

SEQ ID NO: 1242119 - protein, 25 aa, Mycobacterium
IGVPFRCVPIAEPVRTNLAITESDG

SEQ ID NO: 1242120 - protein, 19 aa, Mycobacterium
IGVSRCPYGTDCFAEKARE

SEQ ID NO: 1242121 - protein, 17 aa, Mycobacterium
IGVSRLVAVIAEQQHDE

SEQ ID NO: 1242122 - protein, 21 aa, Mycobacterium
IGWVGTCAHVLDIGGMTPSSW

SEQ ID NO: 1242123 - protein, 31 aa, Mycobacterium
IGYHFAAGIVRHAAAICAVIAPTVNSYKRLV

SEQ ID NO: 1242124 - protein, 25 aa, Mycobacterium
IGYMLEILPALGYLHSLGLTYNDLK

SEQ ID NO: 1242125 - protein, 19 aa, Mycobacterium
IGYRGRPVAGLPFDEADGV

SEQ ID NO: 1242126 - protein, 19 aa, Mycobacterium
IHAATRFRLDAVNAALVER

SEQ ID NO: 1242127 - protein, 18 aa, Mycobacterium
IHAECAGLTYLVDDLDGR

SEQ ID NO: 1242128 - protein, 17 aa, Mycobacterium
IHAGDWVEPGLLDALEE

SEQ ID NO: 1242129 - protein, 24 aa, Mycobacterium
IHAPEPKFQVANFINGINSLPATW

SEQ ID NO: 1242130 - protein, 30 aa, Mycobacterium
IHDYLWRWDTDWFWCSRAFGAQNPKIRRFW

SEQ ID NO: 1242131 - protein, 21 aa, Mycobacterium
IHEALRAAGFDDLTLAQSRFG

SEQ ID NO: 1242132 - protein, 26 aa, Mycobacterium
IHESAKRICKEAGYYGAGTVEYLVGQ

SEQ ID NO: 1242133 - protein, 30 aa, Mycobacterium
IHGADPWWDVAIRLMIKYRNLRLMTSAWSP

SEQ ID NO: 1242134 - protein, 23 aa, Mycobacterium
IHGPRAEVVVALRGPTPTGLARS

SEQ ID NO: 1242135 - protein, 17 aa, Mycobacterium
IHGVKRFITAGEHDLAD

SEQ ID NO: 1242136 - protein, 19 aa, Mycobacterium
IHKRAHGAAVVVFEGRPIG

SEQ ID NO: 1242137 - protein, 25 aa, Mycobacterium
IHNSQPWRWRVGEDSVHLYADTPPH

SEQ ID NO: 1242138 - protein, 20 aa, Mycobacterium
IHPPSLEPRWFAWVDNMHDW

SEQ ID NO: 1242139 - protein, 19 aa, Mycobacterium
IHREPRQHLAFSVGTHYCL

SEQ ID NO: 1242140 - protein, 17 aa, Mycobacterium
IHRPRYDDWSLPKGKVD

SEQ ID NO: 1242141 - protein, 23 aa, Mycobacterium
IHSCPGAPLARVEGRVSIERILD

SEQ ID NO: 1242142 - protein, 19 aa, Mycobacterium
IHSHLKMEGSWKVVPASRP

SEQ ID NO: 1242143 - protein, 24 aa, Mycobacterium
IIADHSRTAAILIGDGVSPGNDGR

SEQ ID NO: 1242144 - protein, 23 aa, Mycobacterium
IIDIGLPVGCEFLEPTSPQYIAD

SEQ ID NO: 1242145 - protein, 19 aa, Mycobacterium
IIDSNWKLGADNFVGDAYH

SEQ ID NO: 1242146 - protein, 26 aa, Mycobacterium
IIFDPNCFALATGIEEHATYGIDFIE

SEQ ID NO: 1242147 - protein, 18 aa, Mycobacterium
IIGERAFDGAPGLRLALA

SEQ ID NO: 1242148 - protein, 18 aa, Mycobacterium
IISCGAALDHFRTAMAAC

SEQ ID NO: 1242149 - protein, 29 aa, Mycobacterium
IIVGDAAGVGVIWLADWADDMVNVSAHHA

SEQ ID NO: 1242150 - protein, 19 aa, Mycobacterium
IIYRMGVKPPEPKQILATG

SEQ ID NO: 1242151 - protein, 18 aa, Mycobacterium
IKALGVRETLRLLDGQHA

SEQ ID NO: 1242152 - protein, 21 aa, Mycobacterium
IKANLFKALAHPARIRILEVL

SEQ ID NO: 1242153 - protein, 17 aa, Mycobacterium
IKAVWRAVTAVDQIFAR

SEQ ID NO: 1242154 - protein, 22 aa, Mycobacterium
IKDKLWNTQEVVIGGWREGNGG

SEQ ID NO: 1242155 - protein, 17 aa, Mycobacterium
IKDRPALRMIEQAERDG

SEQ ID NO: 1242156 - protein, 21 aa, Mycobacterium
IKEHAVAVALAMREKGQEPDL

SEQ ID NO: 1242157 - protein, 19 aa, Mycobacterium
IKKALRLKAAFSDMLDQMQ

SEQ ID NO: 1242158 - protein, 19 aa, Mycobacterium
IKLAATRGAEMAKACALEP

SEQ ID NO: 1242159 - protein, 19 aa, Mycobacterium
IKLDAHIRLANPRTAETEQ

SEQ ID NO: 1242160 - protein, 18 aa, Mycobacterium
IKLHQLGLSLKDSPATFD

SEQ ID NO: 1242161 - protein, 18 aa, Mycobacterium
IKPELPGVRGLCTQVTAF

SEQ ID NO: 1242162 - protein, 26 aa, Mycobacterium
IKPTELRRKIGYSIQQAGLFPHMTIR

SEQ ID NO: 1242163 - protein, 32 aa, Mycobacterium
IKQEILAGIGGVRAIRAFTEVEGLPSPEVFHM

SEQ ID NO: 1242164 - protein, 17 aa, Mycobacterium
IKRAMGLGRQYVAQDRV

SEQ ID NO: 1242165 - protein, 19 aa, Mycobacterium
IKSAAPPAGAPLPPPPPAA

SEQ ID NO: 1242166 - protein, 22 aa, Mycobacterium
IKSREIYEAPGAMVLITAHTEL

SEQ ID NO: 1242167 - protein, 19 aa, Mycobacterium
IKSVRRWLADSDYRIREHN

SEQ ID NO: 1242168 - protein, 22 aa, Mycobacterium
IKTLSKNGAFPLDEFNKVIQVN

SEQ ID NO: 1242169 - protein, 26 aa, Mycobacterium
IKTMLRLALNAGEGILYRLHLDLASL

SEQ ID NO: 1242170 - protein, 17 aa, Mycobacterium
IKTRARMGPEYKELKSL

SEQ ID NO: 1242171 - protein, 21 aa, Mycobacterium
IKVEPRKGDNAPMAVIELVRE

SEQ ID NO: 1242172 - protein, 25 aa, Mycobacterium
ILAEEILEPLGFRWTNFGVAESDVP

SEQ ID NO: 1242173 - protein, 17 aa, Mycobacterium
ILAGAGFRVVCPDLVGF

SEQ ID NO: 1242174 - protein, 23 aa, Mycobacterium
ILAMCAGALRFYLTEQNALPDAP

SEQ ID NO: 1242175 - protein, 23 aa, Mycobacterium
ILARTGSTSSFWVHVTHGDPVEV

SEQ ID NO: 1242176 - protein, 23 aa, Mycobacterium
ILCDPWVNPAYFASWVPFPDNTG

SEQ ID NO: 1242177 - protein, 18 aa, Mycobacterium
ILDEGRIAIAALSVGAAQ

SEQ ID NO: 1242178 - protein, 18 aa, Mycobacterium
ILDEGWLSDLDGWSNAFI

SEQ ID NO: 1242179 - protein, 24 aa, Mycobacterium
ILDGARRCFARYGYDKATVRRLED

SEQ ID NO: 1242180 - protein, 23 aa, Mycobacterium
ILDNPAYRGIRVWGKQEKYEVLL

SEQ ID NO: 1242181 - protein, 19 aa, Mycobacterium
ILDQLRTAYGPAFLDDIPK

SEQ ID NO: 1242182 - protein, 30 aa, Mycobacterium
ILDRHPSLKIGWFEGGIAWVPTALQDAEHM

SEQ ID NO: 1242183 - protein, 24 aa, Mycobacterium
ILDRKDKLMGFGHRVYRAEDPRAR

SEQ ID NO: 1242184 - protein, 17 aa, Mycobacterium
ILEPFPVPQNAYGWSAA

SEQ ID NO: 1242185 - protein, 24 aa, Mycobacterium
ILERAPRSGGHWLAVAEAAVRGPI

SEQ ID NO: 1242186 - protein, 18 aa, Mycobacterium
ILGCDAAVLAARIAELLK

SEQ ID NO: 1242187 - protein, 25 aa, Mycobacterium
ILGGRPIREPVFHYGPFVMNSKSEL

SEQ ID NO: 1242188 - protein, 17 aa, Mycobacterium
ILGQGVAYQARFDPQAK

SEQ ID NO: 1242189 - protein, 25 aa, Mycobacterium
ILLADARIVACRLFFECTPQQEFLG

SEQ ID NO: 1242190 - protein, 17 aa, Mycobacterium
ILLSIGYAACHWCHVMA

SEQ ID NO: 1242191 - protein, 27 aa, Mycobacterium
ILNFVFGEVWLRPGLGMRERRLITVTC

SEQ ID NO: 1242192 - protein, 19 aa, Mycobacterium
ILNGAKAWITNGGKSSWYT

SEQ ID NO: 1242193 - protein, 17 aa, Mycobacterium
ILRDCLRAGDADLPRRF

SEQ ID NO: 1242194 - protein, 19 aa, Mycobacterium
ILREVVPADAGVIIRTASE

SEQ ID NO: 1242195 - protein, 21 aa, Mycobacterium
ILRKVLDAVPFQFSVDEGAEV

SEQ ID NO: 1242196 - protein, 19 aa, Mycobacterium
ILRTNLAAVILQMAALGLG

SEQ ID NO: 1242197 - protein, 20 aa, Mycobacterium
ILRTRRALMLSLLDEHLPDW

SEQ ID NO: 1242198 - protein, 20 aa, Mycobacterium
ILRVRGRGVPKRGGGHGDLL

SEQ ID NO: 1242199 - protein, 19 aa, Mycobacterium
ILSAATVFVCPSVYEPLGI

SEQ ID NO: 1242200 - protein, 18 aa, Mycobacterium
ILSYIGHVADRFDLRDDI

SEQ ID NO: 1242201 - protein, 18 aa, Mycobacterium
IMADFTVRETPRFDFEVS

SEQ ID NO: 1242202 - protein, 18 aa, Mycobacterium
IMAVAAAVLAEFAPDVTP

SEQ ID NO: 1242203 - protein, 17 aa, Mycobacterium
IMGLQLALTELWRSYGV

SEQ ID NO: 1242204 - protein, 27 aa, Mycobacterium
IMGRIDPRTRWLLRELVYALLVKKDHA

SEQ ID NO: 1242205 - protein, 20 aa, Mycobacterium
IMKLHHCIADGIATMHMLAG

SEQ ID NO: 1242206 - protein, 20 aa, Mycobacterium
IMLAARKVPGALKWIEDRRE

SEQ ID NO: 1242207 - protein, 24 aa, Mycobacterium
IMNRGGGIVGMDFDPTRAMPAYNW

SEQ ID NO: 1242208 - protein, 20 aa, Mycobacterium
IMRRLLRDVAEGRELGDTST

SEQ ID NO: 1242209 - protein, 25 aa, Mycobacterium
IMRSFGEKVAMGWTEVLSADATTIE

SEQ ID NO: 1242210 - protein, 18 aa, Mycobacterium
INALPLFFQKSVLWIAAL

SEQ ID NO: 1242211 - protein, 24 aa, Mycobacterium
INDCAVTACSLAPTMLHALLDHLR

SEQ ID NO: 1242212 - protein, 18 aa, Mycobacterium
INEAASLVQDAAHPEANI

SEQ ID NO: 1242213 - protein, 25 aa, Mycobacterium
INESLRLVTPLPFNVRQTVRDTELL

SEQ ID NO: 1242214 - protein, 18 aa, Mycobacterium
INGGNYFSPDSPFGGYKQ

SEQ ID NO: 1242215 - protein, 23 aa, Mycobacterium
INGICCGAGLDWVTTGDIVIASE

SEQ ID NO: 1242216 - protein, 25 aa, Mycobacterium
INGKSWLLFGPFAGWSPKFLKQGKV

SEQ ID NO: 1242217 - protein, 24 aa, Mycobacterium
INGRPRLLCMTRMSTFGESETVTV

SEQ ID NO: 1242218 - protein, 25 aa, Mycobacterium
INIPLDCRDGACGTCKALCESGTYD

SEQ ID NO: 1242219 - protein, 17 aa, Mycobacterium
INLDPEPRWSLREFLGP

SEQ ID NO: 1242220 - protein, 19 aa, Mycobacterium
INLSFGFMGPLLRRSGVIF

SEQ ID NO: 1242221 - protein, 19 aa, Mycobacterium
INNAFRVPSMKPFANTTFE

SEQ ID NO: 1242222 - protein, 17 aa, Mycobacterium
INQFVAIRDKELRRKLT

SEQ ID NO: 1242223 - protein, 21 aa, Mycobacterium
INRHIKRGGKVWINIFPDRPL

SEQ ID NO: 1242224 - protein, 20 aa, Mycobacterium
INTEIPIEWCRMSDERPEVT

SEQ ID NO: 1242225 - protein, 18 aa, Mycobacterium
INVLDGYCRHMGGDLSQG

SEQ ID NO: 1242226 - protein, 23 aa, Mycobacterium
IPAERLRYSPGQFLTLRVPSDRT

SEQ ID NO: 1242227 - protein, 17 aa, Mycobacterium
IPAGRGLAFRARRGDRF

SEQ ID NO: 1242228 - protein, 27 aa, Mycobacterium
IPAREPSDRALLLGAVGEWVTRPAEQV

SEQ ID NO: 1242229 - protein, 29 aa, Mycobacterium
IPASCWRPELPEDWPGVLCRRCQDRMREG

SEQ ID NO: 1242230 - protein, 19 aa, Mycobacterium
IPDMAQWGIFLRNHDELTL

SEQ ID NO: 1242231 - protein, 33 aa, Mycobacterium
IPEIPEFASDEWTDWRWNSILIEGANCREIIDN

SEQ ID NO: 1242232 - protein, 18 aa, Mycobacterium
IPETDFRLSRFAEGDLLR

SEQ ID NO: 1242233 - protein, 17 aa, Mycobacterium
IPGAVRLDWKTELQDQV

SEQ ID NO: 1242234 - protein, 18 aa, Mycobacterium
IPGGQPGLSFGKPEEKMG

SEQ ID NO: 1242235 - protein, 20 aa, Mycobacterium
IPGPDGLQFVGRVGTGFTEK

SEQ ID NO: 1242236 - protein, 25 aa, Mycobacterium
IPGWNVCVDFPIKPGLGEFVSGLDH

SEQ ID NO: 1242237 - protein, 17 aa, Mycobacterium
IPIASAMVVGKEFGFTS

SEQ ID NO: 1242238 - protein, 33 aa, Mycobacterium
IPIDERAKWATFPMLALHGWAQHHDVPLRAVVA

SEQ ID NO: 1242239 - protein, 20 aa, Mycobacterium
IPIPGALNRFVFAMPEQLGR

SEQ ID NO: 1242240 - protein, 21 aa, Mycobacterium
IPLEAQAAALAARRRGAVDLE

SEQ ID NO: 1242241 - protein, 20 aa, Mycobacterium
IPLGDYRYRELRFQSLANAD

SEQ ID NO: 1242242 - protein, 30 aa, Mycobacterium
IPLQGNDIGEAFVARTPRLVEVIAAQTGLL

SEQ ID NO: 1242243 - protein, 17 aa, Mycobacterium
IPMGPARWLTVVSPENP

SEQ ID NO: 1242244 - protein, 18 aa, Mycobacterium
IPMMARNLLESFKLLTNV

SEQ ID NO: 1242245 - protein, 23 aa, Mycobacterium
IPNIFVPGGPPLSIPLGNVRLPI

SEQ ID NO: 1242246 - protein, 21 aa, Mycobacterium
IPQMIERGIPLTFSVARFIKF

SEQ ID NO: 1242247 - protein, 19 aa, Mycobacterium
IPQPIAWPGSSDRNFYDRS

SEQ ID NO: 1242248 - protein, 26 aa, Mycobacterium
IPRPETEALFEWVVRQALPDEPLIVD

SEQ ID NO: 1242249 - protein, 19 aa, Mycobacterium
IPRSEYRIDDVWNVVGLKG

SEQ ID NO: 1242250 - protein, 21 aa, Mycobacterium
IPRTEALSVPSRHLGLVTAVE

SEQ ID NO: 1242251 - protein, 20 aa, Mycobacterium
IPSLFSVYPTTDWHERETYD

SEQ ID NO: 1242252 - protein, 18 aa, Mycobacterium
IPSPYAGRVVERGGDEGQ

SEQ ID NO: 1242253 - protein, 20 aa, Mycobacterium
IPVAHWRYEISPTASGCRVT

SEQ ID NO: 1242254 - protein, 19 aa, Mycobacterium
IPVATRLSGLEPLNITDDS

SEQ ID NO: 1242255 - protein, 25 aa, Mycobacterium
IPVHSIRLAGLVAHQEVLFGTQGET

SEQ ID NO: 1242256 - protein, 25 aa, Mycobacterium
IPVNPSGGLACFGEAIPAQAIAQVC

SEQ ID NO: 1242257 - protein, 19 aa, Mycobacterium
IPVRLAYGATEFAGSVCAW

SEQ ID NO: 1242258 - protein, 19 aa, Mycobacterium
IPWSKAARDNGQFRTRAEL

SEQ ID NO: 1242259 - protein, 24 aa, Mycobacterium
IQAIKGVEIGDGFETARRRGSVAH

SEQ ID NO: 1242260 - protein, 18 aa, Mycobacterium
IQAPTLLLHRRGDRHVRG

SEQ ID NO: 1242261 - protein, 20 aa, Mycobacterium
IQAQDFFFRKIVRDKGQALA

SEQ ID NO: 1242262 - protein, 24 aa, Mycobacterium
IQGARIAGALAIVAVDPVKFKREQ

SEQ ID NO: 1242263 - protein, 20 aa, Mycobacterium
IQQAGLFPHMTIRQNVGLVP

SEQ ID NO: 1242264 - protein, 18 aa, Mycobacterium
IQQIGGMRPDALRWHPNG

SEQ ID NO: 1242265 - protein, 24 aa, Mycobacterium
IQRALRPGGVFLMVDIKASSRLED

SEQ ID NO: 1242266 - protein, 21 aa, Mycobacterium
IQRPEEVAARRGLPLEDVAPA

SEQ ID NO: 1242267 - protein, 24 aa, Mycobacterium
IQRPGMLHACFVRSPFARAKVNGI

SEQ ID NO: 1242268 - protein, 25 aa, Mycobacterium
IQVLPDRTRLLLLLAAAEPVGDSSL

SEQ ID NO: 1242269 - protein, 19 aa, Mycobacterium
IQVLTQCRPELITRTFEAC

SEQ ID NO: 1242270 - protein, 18 aa, Mycobacterium
IRAAQNFDRLGLSAEAPV

SEQ ID NO: 1242271 - protein, 21 aa, Mycobacterium
IRAFWPGALSLVVRQAPSLPW

SEQ ID NO: 1242272 - protein, 20 aa, Mycobacterium
IRAGIDCIEHGFLATDETIQ

SEQ ID NO: 1242273 - protein, 18 aa, Mycobacterium
IRALDSWFVDELDSPVRI

SEQ ID NO: 1242274 - protein, 31 aa, Mycobacterium
IRAPYLVTRAGFIGCHHWRFLETADVLGRAA

SEQ ID NO: 1242275 - protein, 17 aa, Mycobacterium
IRATMALTEPGGGSDLQ

SEQ ID NO: 1242276 - protein, 18 aa, Mycobacterium
IRCSACLNVCPVYERTGG

SEQ ID NO: 1242277 - protein, 17 aa, Mycobacterium
IRDEFHAFAARLDIHDV

SEQ ID NO: 1242278 - protein, 18 aa, Mycobacterium
IRDIGYYVAPTVFADVDP

SEQ ID NO: 1242279 - protein, 21 aa, Mycobacterium
IRDWYARRGLTPWLAVPDRLV

SEQ ID NO: 1242280 - protein, 22 aa, Mycobacterium
IREGGPRLGFQKVPDVTPGKNR

SEQ ID NO: 1242281 - protein, 17 aa, Mycobacterium
IREILGRRPTDAELAMY

SEQ ID NO: 1242282 - protein, 24 aa, Mycobacterium
IRENPRPGLVNALVQLRIDGEPAP

SEQ ID NO: 1242283 - protein, 21 aa, Mycobacterium
IRESGELTSAVGLTNTHSVGV

SEQ ID NO: 1242284 - protein, 17 aa, Mycobacterium
IRFAEAAIQVMGKAGEH

SEQ ID NO: 1242285 - protein, 19 aa, Mycobacterium
IRFDDGRIGGEIVAVERDA

SEQ ID NO: 1242286 - protein, 20 aa, Mycobacterium
IRFPTPAVCGRTPLVGKGLT

SEQ ID NO: 1242287 - protein, 18 aa, Mycobacterium
IRFSEMKSPGEARDQAVW

SEQ ID NO: 1242288 - protein, 25 aa, Mycobacterium
IRFSERTKRLFARVPLLQRTVRLIT

SEQ ID NO: 1242289 - protein, 21 aa, Mycobacterium
IRGTDAVVCGDWNIAHTENDI

SEQ ID NO: 1242290 - protein, 22 aa, Mycobacterium
IRHLTDRLPIMTAPKWVHNKIQ

SEQ ID NO: 1242291 - protein, 18 aa, Mycobacterium
IRIAPSFPSEDDLRSAID

SEQ ID NO: 1242292 - protein, 17 aa, Mycobacterium
IRIENRLAALIPPPVRK

SEQ ID NO: 1242293 - protein, 19 aa, Mycobacterium
IRIRDEVFGNLYLSEKTSG

SEQ ID NO: 1242294 - protein, 17 aa, Mycobacterium
IRISVLVKDTELDKAVA

SEQ ID NO: 1242295 - protein, 20 aa, Mycobacterium
IRLGKYDIGIAIGLDKHPRG

SEQ ID NO: 1242296 - protein, 17 aa, Mycobacterium
IRLRFGLDDGQPRTLDQ

SEQ ID NO: 1242297 - protein, 22 aa, Mycobacterium
IRLRLFHGRGGTVGRGGGPSYD

SEQ ID NO: 1242298 - protein, 22 aa, Mycobacterium
IRLRNCPFHPLARELPELVCRL

SEQ ID NO: 1242299 - protein, 27 aa, Mycobacterium
IRMEILPVSFGFPFGLSAIFPPNLPLP

SEQ ID NO: 1242300 - protein, 24 aa, Mycobacterium
IRMSQRLGIPLARIRAALATLPTD

SEQ ID NO: 1242301 - protein, 19 aa, Mycobacterium
IRNGFKHAAASLTGKASKP

SEQ ID NO: 1242302 - protein, 19 aa, Mycobacterium
IRPEAQWTDNAPIGADDYW

SEQ ID NO: 1242303 - protein, 23 aa, Mycobacterium
IRQNGVVIGLEFDHPEGAKFVMR

SEQ ID NO: 1242304 - protein, 21 aa, Mycobacterium
IRRARELKTVKGLEHANEIKT

SEQ ID NO: 1242305 - protein, 20 aa, Mycobacterium
IRREALRLIKERGYQNTTVE

SEQ ID NO: 1242306 - protein, 21 aa, Mycobacterium
IRRKAMEELARIKKDGEAGED

SEQ ID NO: 1242307 - protein, 20 aa, Mycobacterium
IRRMKPLGFTLEEMRDLLTA

SEQ ID NO: 1242308 - protein, 17 aa, Mycobacterium
IRRSTCVERYGRGEFER

SEQ ID NO: 1242309 - protein, 21 aa, Mycobacterium
IRRYLSYFPSSAWSYPPTRLA

SEQ ID NO: 1242310 - protein, 17 aa, Mycobacterium
IRSAKLLGIDDAVVGDL

SEQ ID NO: 1242311 - protein, 17 aa, Mycobacterium
IRSEWELVESAVNREFV

SEQ ID NO: 1242312 - protein, 22 aa, Mycobacterium
IRSKGVGVFFCTQLPTDVPNGV

SEQ ID NO: 1242313 - protein, 19 aa, Mycobacterium
IRSPALAEWGIPTAQALLE

SEQ ID NO: 1242314 - protein, 19 aa, Mycobacterium
IRTAAHFDRRPEVVLEALN

SEQ ID NO: 1242315 - protein, 18 aa, Mycobacterium
IRVLKPGGRFVFAGEPTT

SEQ ID NO: 1242316 - protein, 22 aa, Mycobacterium
IRWMGSGPLTGLAEIQLPDLQP

SEQ ID NO: 1242317 - protein, 26 aa, Mycobacterium
IRYHGREFIELIAVGTTYDLAAAAAI

SEQ ID NO: 1242318 - protein, 17 aa, Mycobacterium
IRYTTLRPFVVHINHTG

SEQ ID NO: 1242319 - protein, 21 aa, Mycobacterium
ISAAILLAEWQVRRTPHIPIP

SEQ ID NO: 1242320 - protein, 17 aa, Mycobacterium
ISACVAVGPIADDLVAK

SEQ ID NO: 1242321 - protein, 28 aa, Mycobacterium
ISAIIRRLRRPDPYKGKGVRYEGEQIRR

SEQ ID NO: 1242322 - protein, 18 aa, Mycobacterium
ISALMAYEVLRDIPTQDF

SEQ ID NO: 1242323 - protein, 22 aa, Mycobacterium
ISEADILWDLASRLEGRMTAIG

SEQ ID NO: 1242324 - protein, 23 aa, Mycobacterium
ISEVTVRDAIKLAVDEINGAGGV

SEQ ID NO: 1242325 - protein, 26 aa, Mycobacterium
ISGAFLAKLGCSFAVVGHSERRTYHH

SEQ ID NO: 1242326 - protein, 17 aa, Mycobacterium
ISGDNVKVGSTEILAGL

SEQ ID NO: 1242327 - protein, 24 aa, Mycobacterium
ISGEATFDYGAAFDRSRKVAEGRV

SEQ ID NO: 1242328 - protein, 19 aa, Mycobacterium
ISGFSSRQALYEYFFFGDP

SEQ ID NO: 1242329 - protein, 18 aa, Mycobacterium
ISHDRWFLDRTCTHILAW

SEQ ID NO: 1242330 - protein, 24 aa, Mycobacterium
ISHGRPCFFVSKMFAMYGGSTKET

SEQ ID NO: 1242331 - protein, 19 aa, Mycobacterium
ISKLLWANWHRELGEIAMD

SEQ ID NO: 1242332 - protein, 18 aa, Mycobacterium
ISMRLMLRNNLTLKSGVT

SEQ ID NO: 1242333 - protein, 19 aa, Mycobacterium
ISMYPRMWAASGVDYPTLL

SEQ ID NO: 1242334 - protein, 18 aa, Mycobacterium
ISNEFFGLWQDPTRTYSS

SEQ ID NO: 1242335 - protein, 21 aa, Mycobacterium
ISPDAAVAIGARLAEKDIAFV

SEQ ID NO: 1242336 - protein, 18 aa, Mycobacterium
ISQLLSPQFRGYSRLGGE

SEQ ID NO: 1242337 - protein, 25 aa, Mycobacterium
ISSAEARSALMLSATRDLPALGAAA

SEQ ID NO: 1242338 - protein, 36 aa, Mycobacterium
ISSPGWAKHAWSCFFAPWIAEATIFVYNYRRFDAAA

SEQ ID NO: 1242339 - protein, 21 aa, Mycobacterium
ISSRPANPVAEWTAHGRVHNI

SEQ ID NO: 1242340 - protein, 18 aa, Mycobacterium
ISTLRDIYGAALGYQVDA

SEQ ID NO: 1242341 - protein, 19 aa, Mycobacterium
ISVAAQCHGLVLLDDHGNP

SEQ ID NO: 1242342 - protein, 24 aa, Mycobacterium
ISVRGNWPLVPTMDVVVPHTRTMA

SEQ ID NO: 1242343 - protein, 18 aa, Mycobacterium
ITATMLVPSMIYALMDHP

SEQ ID NO: 1242344 - protein, 18 aa, Mycobacterium
ITAYLKPVHDVGGEPDAP

SEQ ID NO: 1242345 - protein, 21 aa, Mycobacterium
ITCAIRVWAYQIADLARDHRV

SEQ ID NO: 1242346 - protein, 22 aa, Mycobacterium
ITDALKRAGVRAGDVGYLEAHG

SEQ ID NO: 1242347 - protein, 34 aa, Mycobacterium
ITEALDLEWNRYGIRVIAMWPLYVQTAMTDNIKT

SEQ ID NO: 1242348 - protein, 17 aa, Mycobacterium
ITEYARYCELRAEGRDD

SEQ ID NO: 1242349 - protein, 23 aa, Mycobacterium
ITFTGPHGSFFLRETERPVLLLA

SEQ ID NO: 1242350 - protein, 22 aa, Mycobacterium
ITGLRMNHAYIRPGGLAADLPD

SEQ ID NO: 1242351 - protein, 18 aa, Mycobacterium
ITGQAWPRKEVRDARLVE

SEQ ID NO: 1242352 - protein, 26 aa, Mycobacterium
ITGRIKELFKTSGGKYVAPPAIEGRF

SEQ ID NO: 1242353 - protein, 20 aa, Mycobacterium
ITHRTVYRYSDVVTSSYGRG

SEQ ID NO: 1242354 - protein, 20 aa, Mycobacterium
ITIAAFANKVTLGFTSDIKN

SEQ ID NO: 1242355 - protein, 18 aa, Mycobacterium
ITINAVLPGNIITEGLVD

SEQ ID NO: 1242356 - protein, 17 aa, Mycobacterium
ITLDFSTEWTAHHRDGA

SEQ ID NO: 1242357 - protein, 23 aa, Mycobacterium
ITLEAGVSLGAMPVYRFGNEDQK

SEQ ID NO: 1242358 - protein, 25 aa, Mycobacterium
ITLGHPVVMGRLTWESLPPKVRPLP

SEQ ID NO: 1242359 - protein, 20 aa, Mycobacterium
ITPFNFPAMIPLWKAGPALA

SEQ ID NO: 1242360 - protein, 24 aa, Mycobacterium
ITPFPRSNIFLVFNSVENRLSEPF

SEQ ID NO: 1242361 - protein, 17 aa, Mycobacterium
ITPILSMIESLRGRTDP

SEQ ID NO: 1242362 - protein, 25 aa, Mycobacterium
ITSNTYWDWVIDRIYLVLYGSAIAT

SEQ ID NO: 1242363 - protein, 18 aa, Mycobacterium
ITTRHGALLIVDEVQTGV

SEQ ID NO: 1242364 - protein, 23 aa, Mycobacterium
ITVLRLRPVEVISAEALQLPLWG

SEQ ID NO: 1242365 - protein, 26 aa, Mycobacterium
ITVPRWLPERICWLLSDEYHANEGGH

SEQ ID NO: 1242366 - protein, 19 aa, Mycobacterium
ITVVNKWDRPGRHALELMD

SEQ ID NO: 1242367 - protein, 29 aa, Mycobacterium
ITYPRLKKTLLQGTRWGDENAKLIPAPGD

SEQ ID NO: 1242368 - protein, 18 aa, Mycobacterium
IVAADGFTALSIDRIAHT

SEQ ID NO: 1242369 - protein, 18 aa, Mycobacterium
IVAAQGAFHGRTMGSLAL

SEQ ID NO: 1242370 - protein, 17 aa, Mycobacterium
IVAEVSIAQTAQDINDA

SEQ ID NO: 1242371 - protein, 23 aa, Mycobacterium
IVAPNLFPLIVRRQLELTLAHGH

SEQ ID NO: 1242372 - protein, 26 aa, Mycobacterium
IVCALCSCYPRPILGNSPEWYRTPNY

SEQ ID NO: 1242373 - protein, 18 aa, Mycobacterium
IVCRGDVVMSGYWNNPAA

SEQ ID NO: 1242374 - protein, 24 aa, Mycobacterium
IVDEFTGRVLLGRRYNEGMHQAIE

SEQ ID NO: 1242375 - protein, 19 aa, Mycobacterium
IVDLCTGSGALALAIATAL

SEQ ID NO: 1242376 - protein, 20 aa, Mycobacterium
IVDNCVQLHGGYGYMLEYRV

SEQ ID NO: 1242377 - protein, 24 aa, Mycobacterium
IVDPRVTAAFSARVRTGPLSSAYR

SEQ ID NO: 1242378 - protein, 29 aa, Mycobacterium
IVEPKYWGGVCLNVGCIPSKALLRNAELA

SEQ ID NO: 1242379 - protein, 20 aa, Mycobacterium
IVEQLPRKVALELIYTGEPI

SEQ ID NO: 1242380 - protein, 18 aa, Mycobacterium
IVGAALFLMSNASSFTTG

SEQ ID NO: 1242381 - protein, 25 aa, Mycobacterium
IVGLQLALTELWRSYGVTPDAVIGH

SEQ ID NO: 1242382 - protein, 18 aa, Mycobacterium
IVGTLGRPQPPPWDVAPA

SEQ ID NO: 1242383 - protein, 19 aa, Mycobacterium
IVGVAGRVVFARNSGKLCF

SEQ ID NO: 1242384 - protein, 18 aa, Mycobacterium
IVHAFCTPLRKLGGDSAD

SEQ ID NO: 1242385 - protein, 34 aa, Mycobacterium; identical to SEQ ID NO: 81328

SEQ ID NO: 1242386 - protein, 25 aa, Mycobacterium
IVIAGAGAIGMEFGYVMKNYGVDVT

SEQ ID NO: 1242387 - protein, 17 aa, Mycobacterium
IVIPWVFDGLSFDAPLE

SEQ ID NO: 1242388 - protein, 18 aa, Mycobacterium
IVLADDGVGFSFHETTIN

SEQ ID NO: 1242389 - protein, 24 aa, Mycobacterium
IVLFPQWVRRSPVKPSPLDPPHVP

SEQ ID NO: 1242390 - protein, 19 aa, Mycobacterium
IVLIPYFVHRELGVRVRGL

SEQ ID NO: 1242391 - protein, 18 aa, Mycobacterium
IVLIRTGWWDRFLEAGDG

SEQ ID NO: 1242392 - protein, 17 aa, Mycobacterium
IVLPRFDTVDGHGATLQ

SEQ ID NO: 1242393 - protein, 18 aa, Mycobacterium
IVNLARWGGLTAGLTTAT

SEQ ID NO: 1242394 - protein, 33 aa, Mycobacterium
IVPAEGFLPTLLDWCRRNDVVFIADEVQTGFAR

SEQ ID NO: 1242395 - protein, 19 aa, Mycobacterium
IVRKDFRAIARAVREVAAF

SEQ ID NO: 1242396 - protein, 21 aa, Mycobacterium
IVRRNKFHLHRLINDALDASH

SEQ ID NO: 1242397 - protein, 17 aa, Mycobacterium
IVRWLFTPDESLVISRD

SEQ ID NO: 1242398 - protein, 17 aa, Mycobacterium
IVSEAGITVPKGRLATF

SEQ ID NO: 1242399 - protein, 24 aa, Mycobacterium
IVSGFPAANWDSGAFAEPERLDVT

SEQ ID NO: 1242400 - protein, 17 aa, Mycobacterium
IVSRIELAYAQFLDVTA

SEQ ID NO: 1242401 - protein, 23 aa, Mycobacterium
IVSVGRLLPRKGFDVVVRALTAI

SEQ ID NO: 1242402 - protein, 28 aa, Mycobacterium
IVTRYPQARSALLPLLHLVQAEDGCLTS

SEQ ID NO: 1242403 - protein, 18 aa, Mycobacterium
IVVELKRDAVAKVVLNNL

SEQ ID NO: 1242404 - protein, 17 aa, Mycobacterium
IVVSSALDSAVGISHGL

SEQ ID NO: 1242405 - protein, 20 aa, Mycobacterium
IWDGEGRRLLDFSCQLVNTN

SEQ ID NO: 1242406 - protein, 22 aa, Mycobacterium
IWGETLKSYFNHQAGKYGTTVE

SEQ ID NO: 1242407 - protein, 23 aa, Mycobacterium
IWRSLLPAEEWVAVARRSAMLVQ

SEQ ID NO: 1242408 - protein, 18 aa, Mycobacterium
IWTAQEWSHEKVSTKLLA

SEQ ID NO: 1242409 - protein, 26 aa, Mycobacterium
IWTSYSDIADWCLVLARTDKEVPRHK

SEQ ID NO: 1242410 - protein, 25 aa, Mycobacterium
IYCRPSCPVRPPFARNVRFYPTAAA

SEQ ID NO: 1242411 - protein, 17 aa, Mycobacterium
IYDEFLELAAIRTKAVR

SEQ ID NO: 1242412 - protein, 18 aa, Mycobacterium
IYDLYGYNAVVHMLSASG

SEQ ID NO: 1242413 - protein, 24 aa, Mycobacterium
IYDVCACLRMLAGHRPSRLHHVAR

SEQ ID NO: 1242414 - protein, 19 aa, Mycobacterium
IYGLPLRLASDARRFDVSP

SEQ ID NO: 1242415 - protein, 24 aa, Mycobacterium
IYPLLRPKITGSRVAFFGHSMGGL

SEQ ID NO: 1242416 - protein, 19 aa, Mycobacterium
IYSFLRLLLPAGLETTYRS

SEQ ID NO: 1242417 - protein, 19 aa, Mycobacterium
IYSVGPLVVGSGMNITVWS

SEQ ID NO: 1242418 - protein, 18 aa, Mycobacterium
IYVATGFDKWGMTNGAAA

SEQ ID NO: 1242419 - protein, 30 aa, Mycobacterium
KAADAGRPWWEWAATYERAFSAAYDALGVL

SEQ ID NO: 1242420 - protein, 18 aa, Mycobacterium
KAADRTGASIALIADPGV

SEQ ID NO: 1242421 - protein, 21 aa, Mycobacterium
KAADVLLRYNFPAAGLTDDAL

SEQ ID NO: 1242422 - protein, 21 aa, Mycobacterium
KAAIAGMCLTMARDLGSLGIR

SEQ ID NO: 1242423 - protein, 18 aa, Mycobacterium
KAARFVRFCDSFNVPLVF

SEQ ID NO: 1242424 - protein, 18 aa, Mycobacterium
KAARFVRTCDCFNIPIVM

SEQ ID NO: 1242425 - protein, 17 aa, Mycobacterium
KAARVGSDITLKVVEMA

SEQ ID NO: 1242426 - protein, 22 aa, Mycobacterium
KAAVICRHCPVILECGADALDN

SEQ ID NO: 1242427 - protein, 23 aa, Mycobacterium
KACAEAGADVVLAARRVEKLEGT

SEQ ID NO: 1242428 - protein, 20 aa, Mycobacterium
KADTMRFGQFIAAYEDIVRR

SEQ ID NO: 1242429 - protein, 32 aa, Mycobacterium
KAEGHKWAMLTAYDFSTARAFDDAGIPVLLVG

SEQ ID NO: 1242430 - protein, 22 aa, Mycobacterium
KAESLRPALFVVPTDTPGLTWT

SEQ ID NO: 1242431 - protein, 23 aa, Mycobacterium
KAGDGVSYGHTWIAQRDTTVALL

SEQ ID NO: 1242432 - protein, 17 aa, Mycobacterium
KAGDWKPLADFYTDDAT

SEQ ID NO: 1242433 - protein, 19 aa, Mycobacterium
KAGEYGFPGLMEALLDLRK

SEQ ID NO: 1242434 - protein, 19 aa, Mycobacterium
KAIIDARRGKNFAKLIKNI

SEQ ID NO: 1242435 - protein, 22 aa, Mycobacterium
KAILHRMLRSFTWKVPENYHVR

SEQ ID NO: 1242436 - protein, 30 aa, Mycobacterium
KAKALAPVRFFNPLSMRFAKKATREDIAEV

SEQ ID NO: 1242437 - protein, 19 aa, Mycobacterium
KALALGARAVMIGRAYLWG

SEQ ID NO: 1242438 - protein, 18 aa, Mycobacterium
KALDVYLNLANYLNNWKR

SEQ ID NO: 1242439 - protein, 34 aa, Mycobacterium
KALQSFEWPRLEGAFNWATDWFDVIARDPITADR

SEQ ID NO: 1242440 - protein, 17 aa, Mycobacterium
KALVRLYLALVALLRGD

SEQ ID NO: 1242441 - protein, 18 aa, Mycobacterium
KAMLQDMAILTGGQVISE

SEQ ID NO: 1242442 - protein, 18 aa, Mycobacterium
KAPITVEALIPFAEPDLC

SEQ ID NO: 1242443 - protein, 20 aa, Mycobacterium
KARYDRLKLNTGRRTSHMPN

SEQ ID NO: 1242444 - protein, 28 aa, Mycobacterium
KASLIGDLVRRCRLVMAGEPLPHPDPID

SEQ ID NO: 1242445 - protein, 24 aa, Mycobacterium
KATAEAFEGGWFHSGDLVRQDEEG

SEQ ID NO: 1242446 - protein, 19 aa, Mycobacterium
KATCYPMLVALTDAGWLVR

SEQ ID NO: 1242447 - protein, 19 aa, Mycobacterium
KATGLIVVPVMFDRIMDLP

SEQ ID NO: 1242448 - protein, 17 aa, Mycobacterium
KATRDEIFVDLKERVAA

SEQ ID NO: 1242449 - protein, 27 aa, Mycobacterium
KATRLSEGYPEWWLSGRPVQTGVSTDH

SEQ ID NO: 1242450 - protein, 25 aa, Mycobacterium
KATRPEVRGGLGGFAGLFALRGGYR

SEQ ID NO: 1242451 - protein, 18 aa, Mycobacterium
KATVEVRVPLVGGKIENF

SEQ ID NO: 1242452 - protein, 31 aa, Mycobacterium
KAVARGSFFPVIPVCSSSGVGTMELLEVATR

SEQ ID NO: 1242453 - protein, 24 aa, Mycobacterium
KAVQRSAGAIAIGPVLQGLNKPVN

SEQ ID NO: 1242454 - protein, 18 aa, Mycobacterium
KAVSPLAVQMYMPNAAAA

SEQ ID NO: 1242455 - protein, 17 aa, Mycobacterium
KAVSVARDDLSSIRTGR

SEQ ID NO: 1242456 - protein, 20 aa, Mycobacterium
KAWDELMVRLGYDRYGAQGG

SEQ ID NO: 1242457 - protein, 24 aa, Mycobacterium
KAYRVAGYRSGWLVITGPKEHASS

SEQ ID NO: 1242458 - protein, 32 aa, Mycobacterium
KCDPWGLDSFQLFPNFVVLFWGQGWYLTYHYW

SEQ ID NO: 1242459 - protein, 26 aa, Mycobacterium
KCILCAACTTSCPIYWTEGSYVGPAA

SEQ ID NO: 1242460 - protein, 31 aa, Mycobacterium
KDAIGREVRRGGLPLQRLMNAESMASLAREL

SEQ ID NO: 1242461 - protein, 21 aa, Mycobacterium
KDAPIRDWVKLAVTRARASGM

SEQ ID NO: 1242462 - protein, 24 aa, Mycobacterium
KDDLLVASLHRWLSACETDARAPL

SEQ ID NO: 1242463 - protein, 24 aa, Mycobacterium
KDEPALDVLAGWLASRVDGEVRRE

SEQ ID NO: 1242464 - protein, 26 aa, Mycobacterium
KDESVEYVDIRFCDLPGVVQHFSIPA

SEQ ID NO: 1242465 - protein, 17 aa, Mycobacterium
KDGHSRYYLDDRGLLRL

SEQ ID NO: 1242466 - protein, 19 aa, Mycobacterium
KDHFDFFPLTIDVEERMYA

SEQ ID NO: 1242467 - protein, 24 aa, Mycobacterium
KDHLELGEALGLIDMERGAKVAGS

SEQ ID NO: 1242468 - protein, 18 aa, Mycobacterium
KDHREFLERGLALKKAGN

SEQ ID NO: 1242469 - protein, 17 aa, Mycobacterium
KDIKGMELAKAIREIGA

SEQ ID NO: 1242470 - protein, 25 aa, Mycobacterium
KDIPLRVKAGAVGLTADEYHAQDVV

SEQ ID NO: 1242471 - protein, 20 aa, Mycobacterium
KDIRLGFGVMHLPPPINHPA

SEQ ID NO: 1242472 - protein, 20 aa, Mycobacterium
KDLGLVLSYLTGRKLTLDEV

SEQ ID NO: 1242473 - protein, 25 aa, Mycobacterium
KDLHLPWQWGARWFLEQLVDGDMAN

SEQ ID NO: 1242474 - protein, 21 aa, Mycobacterium
KDLQLWVAACLYKGAVDVYRL

SEQ ID NO: 1242475 - protein, 20 aa, Mycobacterium
KDPRLTTQLNDVFESAMDPA

SEQ ID NO: 1242476 - protein, 22 aa, Mycobacterium
KDPSGGYARTFLTQMEQVLGTC

SEQ ID NO: 1242477 - protein, 19 aa, Mycobacterium
KDQRIEAVEVVVHKPEAPI

SEQ ID NO: 1242478 - protein, 19 aa, Mycobacterium
KDRDIAMVFQSYALYPHMS

SEQ ID NO: 1242479 - protein, 25 aa, Mycobacterium
KDRFGAEIRTHYPLQLDAEVGVITQ

SEQ ID NO: 1242480 - protein, 20 aa, Mycobacterium
KDRGRAGSQVVVGRDARHRS

SEQ ID NO: 1242481 - protein, 28 aa, Mycobacterium
KDRLFDLIERMRLPTVFFAEGGGGRPGD

SEQ ID NO: 1242482 - protein, 29 aa, Mycobacterium
KDTPELMPLPIALAHRLARRLTEVRKNGV

SEQ ID NO: 1242483 - protein, 18 aa, Mycobacterium
KDTRGIIRVHQFDKVEGF

SEQ ID NO: 1242484 - protein, 24 aa, Mycobacterium
KDVAEAAGCSRATLYRHFDSRDTL

SEQ ID NO: 1242485 - protein, 21 aa, Mycobacterium
KDVDVAFPLGVLTSVTGVSGS

SEQ ID NO: 1242486 - protein, 23 aa, Mycobacterium
KDVLPELIRRAVAVKAEVVAADE

SEQ ID NO: 1242487 - protein, 20 aa, Mycobacterium
KDVSTAWQLDAYRFEIPVVS

SEQ ID NO: 1242488 - protein, 19 aa, Mycobacterium
KDVVIDLLCYRRRGHNEGD

SEQ ID NO: 1242489 - protein, 19 aa, Mycobacterium
KDYVGWGLNHLVFHAPGHD

SEQ ID NO: 1242490 - protein, 27 aa, Mycobacterium
KDYVGWPLISAGAFALAQLALRGRIDQ

SEQ ID NO: 1242491 - protein, 18 aa, Mycobacterium
KEAELKAAAAAWTALSAT

SEQ ID NO: 1242492 - protein, 30 aa, Mycobacterium
KEAMAEPRFRDHIPLMIGGSGEKKTIPLAA

SEQ ID NO: 1242493 - protein, 20 aa, Mycobacterium
KEASVSAFILVRVSPEAVDP

SEQ ID NO: 1242494 - protein, 27 aa, Mycobacterium
KEFAGAFKPPLSWGIRMTGKKFFREYP

SEQ ID NO: 1242495 - protein, 20 aa, Mycobacterium
KEIDGHGLLAGKVVLVTAAA

SEQ ID NO: 1242496 - protein, 19 aa, Mycobacterium
KEIGRRVVARIADVRERHE

SEQ ID NO: 1242497 - protein, 17 aa, Mycobacterium
KELDRMRLANARAAAVN

SEQ ID NO: 1242498 - protein, 17 aa, Mycobacterium
KELITVAGRNIFPAEVE

SEQ ID NO: 1242499 - protein, 21 aa, Mycobacterium
KELRRGATASLVYLSPEAKTA

SEQ ID NO: 1242500 - protein, 17 aa, Mycobacterium
KENLPGVHISGGISNVS

SEQ ID NO: 1242501 - protein, 26 aa, Mycobacterium
KENRLPAYRSIRIPTLVIGFADDVLL

SEQ ID NO: 1242502 - protein, 21 aa, Mycobacterium
KERAFEVLDKLQIIDISNNLG

SEQ ID NO: 1242503 - protein, 25 aa, Mycobacterium
KERYLRPLLDGELFSCYSMTEPHAG

SEQ ID NO: 1242504 - protein, 17 aa, Mycobacterium
KETIAYCRIGERSSHTW

SEQ ID NO: 1242505 - protein, 22 aa, Mycobacterium
KETSAGFWLRANAWFAECGITV

SEQ ID NO: 1242506 - protein, 21 aa, Mycobacterium
KETYWSRFAEQGWYFAGDGAR

SEQ ID NO: 1242507 - protein, 20 aa, Mycobacterium
KEVLGFDPDKTFEVRDEVIE

SEQ ID NO: 1242508 - protein, 17 aa, Mycobacterium
KEVRSFAGRDMVLEEAI

SEQ ID NO: 1242509 - protein, 19 aa, Mycobacterium
KEYGGLGLPIAYQRAFDQE

SEQ ID NO: 1242510 - protein, 20 aa, Mycobacterium
KFASCDGCQLTLLDCEDELL

SEQ ID NO: 1242511 - protein, 33 aa, Mycobacterium
KFERKYQGAGVYRCGKCGGPMRTGKPKGGRRTY

SEQ ID NO: 1242512 - protein, 26 aa, Mycobacterium
KFFREYPYREAFLLDKARKFRAELTM

SEQ ID NO: 1242513 - protein, 18 aa, Mycobacterium
KFGKSTGGGNLWLDPEMT

SEQ ID NO: 1242514 - protein, 19 aa, Mycobacterium
KFGMTLCALGIAEEMREAG

SEQ ID NO: 1242515 - protein, 24 aa, Mycobacterium
KFILTEIFPGGYLPTIDLVGEHAG

SEQ ID NO: 1242516 - protein, 21 aa, Mycobacterium
KFSDMDIEAVRRWDDYTRAKE

SEQ ID NO: 1242517 - protein, 25 aa, Mycobacterium
KFYSTGALFADWLVVRASLDDGSVP

SEQ ID NO: 1242518 - protein, 17 aa, Mycobacterium
KGALDFSSGAGRHLYFY

SEQ ID NO: 1242519 - protein, 17 aa, Mycobacterium
KGARPPVPLDEVESAAE

SEQ ID NO: 1242520 - protein, 28 aa, Mycobacterium
KGASRRARREGKVPAVLYGHGTDPQHLE

SEQ ID NO: 1242521 - protein, 24 aa, Mycobacterium
KGCAESLAGQGARVQVTEIDPINA

SEQ ID NO: 1242522 - protein, 22 aa, Mycobacterium
KGCDICKPTVASILASTSSEHI

SEQ ID NO: 1242523 - protein, 31 aa, Mycobacterium
KGDESLLDTCRRCFASLFTDRAIHYRIDQGF

SEQ ID NO: 1242524 - protein, 24 aa, Mycobacterium
KGDSFRVHCREWFDGAIHNDDSAD

SEQ ID NO: 1242525 - protein, 24 aa, Mycobacterium
KGEELLWRPDLQQLKRSQSGQWNV

SEQ ID NO: 1242526 - protein, 18 aa, Mycobacterium
KGERARIQMRVRTAMSAL

SEQ ID NO: 1242527 - protein, 36 aa, Mycobacterium
KGEVTYGAEFFRWFAEEAVRIGGRYTPSPAGTGRII

SEQ ID NO: 1242528 - protein, 20 aa, Mycobacterium
KGFGGFPVGGQWLRTGNPEL

SEQ ID NO: 1242529 - protein, 18 aa, Mycobacterium
KGFKSFAAPTTLRFEPGI

SEQ ID NO: 1242530 - protein, 18 aa, Mycobacterium
KGGIVAHGCTGKGNDQVR

SEQ ID NO: 1242531 - protein, 23 aa, Mycobacterium
KGGPGMREMLAITGAIKGAGLGK

SEQ ID NO: 1242532 - protein, 17 aa, Mycobacterium
KGGVKVKLIGKVKPSGD

SEQ ID NO: 1242533 - protein, 27 aa, Mycobacterium
KGGYDMTAFWCRAGTAATITPPGIEGM

SEQ ID NO: 1242534 - protein, 23 aa, Mycobacterium
KGHPRLSDGAALRLEDLASEGWI

SEQ ID NO: 1242535 - protein, 25 aa, Mycobacterium
KGKAKEVAGAVLGRDDLYREGQAQQ

SEQ ID NO: 1242536 - protein, 23 aa, Mycobacterium
KGKRALAAELRRKGVDDEVISSS

SEQ ID NO: 1242537 - protein, 20 aa, Mycobacterium
KGLAVLRLDRMRALVDVYPG

SEQ ID NO: 1242538 - protein, 28 aa, Mycobacterium
KGLELIETHLLFGIDYDRIEVVVHPQSI

SEQ ID NO: 1242539 - protein, 24 aa, Mycobacterium
KGLQYPVVYLPFAFNRNIQTRDCV

SEQ ID NO: 1242540 - protein, 22 aa, Mycobacterium
KGLTEALSVEWQRHGVRVADVL

SEQ ID NO: 1242541 - protein, 21 aa, Mycobacterium
KGLVFACWDPSAPEFDEYVGD

SEQ ID NO: 1242542 - protein, 24 aa, Mycobacterium
KGNEIACPFHDWRWGGDGRCKQVP

SEQ ID NO: 1242543 - protein, 20 aa, Mycobacterium
KGNEYFLRHLLGTASNLQAT

SEQ ID NO: 1242544 - protein, 27 aa, Mycobacterium
KGNRHFSFGIGVHRCVGSNVARTVFKS

SEQ ID NO: 1242545 - protein, 21 aa, Mycobacterium
KGREHVESIVLGRNELVDDNG

SEQ ID NO: 1242546 - protein, 24 aa, Mycobacterium
KGRIRKGQQVAWMREVDGHPVVTN

SEQ ID NO: 1242547 - protein, 22 aa, Mycobacterium
KGTGLCGVLARMNRSPHNTIAI

SEQ ID NO: 1242548 - protein, 25 aa, Mycobacterium
KGTLFRRFGSRAGLMVVLLDEDEKA

SEQ ID NO: 1242549 - protein, 26 aa, Mycobacterium
KGVNVARALTLARLDAVALLPAADGD

SEQ ID NO: 1242550 - protein, 22 aa, Mycobacterium
KGWTLPEAERWLAPNLGYNPED

SEQ ID NO: 1242551 - protein, 19 aa, Mycobacterium
KHAAAYWRAQSKAGKTVDA

SEQ ID NO: 1242552 - protein, 38 aa, Mycobacterium
KHAEAYRAISLLLRRPPGREAFPGDVFYLHSRLLERCA

SEQ ID NO: 1242553 - protein, 24 aa, Mycobacterium
KHAEVKAGILVVERQFGYLEFHGE

SEQ ID NO: 1242554 - protein, 20 aa, Mycobacterium
KHESLRGFVFDVATGRLTEV

SEQ ID NO: 1242555 - protein, 19 aa, Mycobacterium
KHGGAHGGHVMYVQDGRLH

SEQ ID NO: 1242556 - protein, 17 aa, Mycobacterium
KHLSVRENVAFGLKIRK

SEQ ID NO: 1242557 - protein, 17 aa, Mycobacterium
KHPEYADSAIIRRLCEP

SEQ ID NO: 1242558 - protein, 17 aa, Mycobacterium
KHPHSMGEWSMASRTHV

SEQ ID NO: 1242559 - protein, 19 aa, Mycobacterium
KHRGPIERLREKMVADLGP

SEQ ID NO: 1242560 - protein, 18 aa, Mycobacterium
KHRMADLYVKVQSAKAVV

SEQ ID NO: 1242561 - protein, 19 aa, Mycobacterium
KHTDFRTGEVEVRRSRRLV

SEQ ID NO: 1242562 - protein, 25 aa, Mycobacterium
KHTQVFRMWLDAVGMTDDLQCYLDD

SEQ ID NO: 1242563 - protein, 20 aa, Mycobacterium
KIAAEAVCTWVSERYRIPLT

SEQ ID NO: 1242564 - protein, 18 aa, Mycobacterium
KIAEGFGCHGEFVEKDDE

SEQ ID NO: 1242565 - protein, 18 aa, Mycobacterium
KIGGEIRRLTSLSEDELY

SEQ ID NO: 1242566 - protein, 22 aa, Mycobacterium
KILDGYCRHMGGDLSQGTIKGD

SEQ ID NO: 1242567 - protein, 25 aa, Mycobacterium
KINEPRFPSFKGIMAAKKKEVTTLT

SEQ ID NO: 1242568 - protein, 18 aa, Mycobacterium
KIRGRRIGTVFQDPMSAL

SEQ ID NO: 1242569 - protein, 23 aa, Mycobacterium
KIRNDPRGWIAQPVMQLSTVPTQ

SEQ ID NO: 1242570 - protein, 25 aa, Mycobacterium
KITLDEWNRYLAVNLTGTFLSIRSA

SEQ ID NO: 1242571 - protein, 20 aa, Mycobacterium
KITLWKDYWDMSGLTATAPP

SEQ ID NO: 1242572 - protein, 24 aa, Mycobacterium
KITWENSCRFFGWDPFALTPKDQA

SEQ ID NO: 1242573 - protein, 28 aa, Mycobacterium
KIVKTIDQIACIRRACQITEQAVAEIQK

SEQ ID NO: 1242574 - protein, 27 aa, Mycobacterium
KKAAEARADELLTAFDLQHAANRRLST

SEQ ID NO: 1242575 - protein, 22 aa, Mycobacterium
KKCGHLGGKVLIPTQQHIRTLT

SEQ ID NO: 1242576 - protein, 20 aa, Mycobacterium
KKDMFIVGGFNAYPAEIEGF

SEQ ID NO: 1242577 - protein, 17 aa, Mycobacterium
KKHFRPEFLNRIDDIIV

SEQ ID NO: 1242578 - protein, 22 aa, Mycobacterium
KKLERTRIQGVLINLEPDRGPK

SEQ ID NO: 1242579 - protein, 17 aa, Mycobacterium
KKLHAVIEKAHQGAAEM

SEQ ID NO: 1242580 - protein, 19 aa, Mycobacterium
KKLLDRLLAQELPDGWDAD

SEQ ID NO: 1242581 - protein, 23 aa, Mycobacterium
KKLPAKVRRAILEGCDEQVHVKY

SEQ ID NO: 1242582 - protein, 27 aa, Mycobacterium
KKLPSVAETIDWGRTVLALGMDTIDDA

SEQ ID NO: 1242583 - protein, 17 aa, Mycobacterium
KKLQWAREFGATDTINA

SEQ ID NO: 1242584 - protein, 22 aa, Mycobacterium
KKTMLEKVRRAPALIKVESVVQ

SEQ ID NO: 1242585 - protein, 24 aa, Mycobacterium
KKTNGRIGHHFPGAPPSLLLHTVG

SEQ ID NO: 1242586 - protein, 18 aa, Mycobacterium
KLAANRPGTFLLESAENG

SEQ ID NO: 1242587 - protein, 30 aa, Mycobacterium
KLAAVAAKRGWPVLRFSSRSGSSPLSQLRT

SEQ ID NO: 1242588 - protein, 20 aa, Mycobacterium
KLAAVVDGRAGDALLDTYDV

SEQ ID NO: 1242589 - protein, 22 aa, Mycobacterium
KLADLVLWEPAFFGVRPHAVIK

SEQ ID NO: 1242590 - protein, 23 aa, Mycobacterium
KLAEKPLTVKLHRLIGEGDTVVA

SEQ ID NO: 1242591 - protein, 17 aa, Mycobacterium
KLAQMMSLITRYAPESV

SEQ ID NO: 1242592 - protein, 18 aa, Mycobacterium
KLARSAGVSIQLLGKEGS

SEQ ID NO: 1242593 - protein, 19 aa, Mycobacterium
KLDAVAVLHRLSLTTDVQQ

SEQ ID NO: 1242594 - protein, 33 aa, Mycobacterium
KLDDLATRVGWRWRLVWFRAVAELLSADYESAT

SEQ ID NO: 1242595 - protein, 18 aa, Mycobacterium
KLDLLMSIDFRMTSTTLL

SEQ ID NO: 1242596 - protein, 23 aa, Mycobacterium
KLDLLNQRVEAIYKALKADVEIG

SEQ ID NO: 1242597 - protein, 17 aa, Mycobacterium
KLDVFSEEFLLSRPLLT

SEQ ID NO: 1242598 - protein, 17 aa, Mycobacterium
KLFLSDRPDEFIQVPFG

SEQ ID NO: 1242599 - protein, 25 aa, Mycobacterium
KLGAVIGGAVLKHSRDFNLMRECVL

SEQ ID NO: 1242600 - protein, 20 aa, Mycobacterium
KLGAVPQPLSARLPDAELSA

SEQ ID NO: 1242601 - protein, 18 aa, Mycobacterium
KLGGEMFGGGAVGLDPDV

SEQ ID NO: 1242602 - protein, 18 aa, Mycobacterium
KLGRLVMRSACADFARWR

SEQ ID NO: 1242603 - protein, 19 aa, Mycobacterium
KLGVRGRVALARRLEELSG

SEQ ID NO: 1242604 - protein, 17 aa, Mycobacterium
KLHEPFEALTIDCPEEF

SEQ ID NO: 1242605 - protein, 20 aa, Mycobacterium
KLHRDELLMFMNVVAVAGAE

SEQ ID NO: 1242606 - protein, 21 aa, Mycobacterium
KLKRLPADQARELGLAQLDRV

SEQ ID NO: 1242607 - protein, 23 aa, Mycobacterium
KLKWQRSTPEFAYSDRERDGLLE

SEQ ID NO: 1242608 - protein, 19 aa, Mycobacterium
KLLGAAMRVLADRPDIQQQ

SEQ ID NO: 1242609 - protein, 27 aa, Mycobacterium
KLLQPWGIVHGGVYCAIVESLASVSGH

SEQ ID NO: 1242610 - protein, 27 aa, Mycobacterium
KLPHFNLSIGVGDAFMRAVESGGMHRL

SEQ ID NO: 1242611 - protein, 19 aa, Mycobacterium
KLPHTILMYPMTVASQVAS

SEQ ID NO: 1242612 - protein, 24 aa, Mycobacterium
KLPSEVFRDHFLTCFISDPVGVKN

SEQ ID NO: 1242613 - protein, 18 aa, Mycobacterium
KLRIARLATGLAPGETPR

SEQ ID NO: 1242614 - protein, 20 aa, Mycobacterium
KLRSSMTLFARCADDNADFL

SEQ ID NO: 1242615 - protein, 21 aa, Mycobacterium
KLSRGEPAIPTRMMAPVRGAG

SEQ ID NO: 1242616 - protein, 26 aa, Mycobacterium
KLTEEAFRLTFDVHVMGTFHCTQAAL

SEQ ID NO: 1242617 - protein, 21 aa, Mycobacterium
KLTPEEFEEFLAAQRDLSTKG

SEQ ID NO: 1242618 - protein, 23 aa, Mycobacterium
KLTRMRDLGCEYAILYFPEAAYD

SEQ ID NO: 1242619 - protein, 23 aa, Mycobacterium
KLTRREVLHYTQVVAGAGNETTG

SEQ ID NO: 1242620 - protein, 30 aa, Mycobacterium
KLVMRRRLEAMGAPIPRYTAVDTVDDVVAF

SEQ ID NO: 1242621 - protein, 23 aa, Mycobacterium
KLVRLARQRLAAFVAPIPLTVRD

SEQ ID NO: 1242622 - protein, 24 aa, Mycobacterium
KMALASLLEMMWADEFVDERDARF

SEQ ID NO: 1242623 - protein, 25 aa, Mycobacterium
KMHKYGVGNGHLWRRHRLAPHRLAY

SEQ ID NO: 1242624 - protein, 23 aa, Mycobacterium
KMPDDQFLVYGFAGLPGDLPGTI

SEQ ID NO: 1242625 - protein, 25 aa, Mycobacterium
KMSKSRGNLVLVSRLRAEGVDPSAI

SEQ ID NO: 1242626 - protein, 21 aa, Mycobacterium
KMVGQAGGWRRDLSLRHAEIL

SEQ ID NO: 1242627 - protein, 25 aa, Mycobacterium
KMYCPRLTQRFTRCSDRLGFPVLQI

SEQ ID NO: 1242628 - protein, 19 aa, Mycobacterium
KNGFILDGYPRSVEQAEAL

SEQ ID NO: 1242629 - protein, 21 aa, Mycobacterium
KNGIEPCIARAKAYAPYSDLI

SEQ ID NO: 1242630 - protein, 37 aa, Mycobacterium; identical to SEQ ID NO: 622176

SEQ ID NO: 1242631 - protein, 24 aa, Mycobacterium
KNRLARIGFDRVIGYVDRPFEVMF

SEQ ID NO: 1242632 - protein, 23 aa, Mycobacterium
KNSTRYLLHFSQSGIGLPDESYF

SEQ ID NO: 1242633 - protein, 18 aa, Mycobacterium
KNVRKWTRRRYRMLELSQ

SEQ ID NO: 1242634 - protein, 25 aa, Mycobacterium
KNWKGNVKKSGFLPSERQWLTDLLG

SEQ ID NO: 1242635 - protein, 19 aa, Mycobacterium
KNYADVFKGDERWRNLPTP

SEQ ID NO: 1242636 - protein, 24 aa, Mycobacterium
KNYVSRLLAKLGMERRTQAAVFVS

SEQ ID NO: 1242637 - protein, 20 aa, Mycobacterium
KPAELEWTLARTDHVDADTE

SEQ ID NO: 1242638 - protein, 19 aa, Mycobacterium
KPDDIGWATAFLASDAASY

SEQ ID NO: 1242639 - protein, 28 aa, Mycobacterium
KPDLAPATIWRDYIRTVGRTPNGVWGGK

SEQ ID NO: 1242640 - protein, 25 aa, Mycobacterium
KPDPHTPWNATRLGRLIAERTDIPP

SEQ ID NO: 1242641 - protein, 25 aa, Mycobacterium
KPGEPPLPGALLIAGEGRVVEPLRT

SEQ ID NO: 1242642 - protein, 19 aa, Mycobacterium
KPGFSRPASQWLSAAQGWL

SEQ ID NO: 1242643 - protein, 26 aa, Mycobacterium
KPGRDPRPAFSTATFAAGVEKVADLK

SEQ ID NO: 1242644 - protein, 19 aa, Mycobacterium
KPGSAFWLKGGPRPRVAEL

SEQ ID NO: 1242645 - protein, 19 aa, Mycobacterium
KPGSVVLWTNCHHPFYDNN

SEQ ID NO: 1242646 - protein, 27 aa, Mycobacterium
KPLAMPRLDMVTGLYFLTTMIEGDKGE

SEQ ID NO: 1242647 - protein, 17 aa, Mycobacterium
KPMAWWFTLSEHVGEPR

SEQ ID NO: 1242648 - protein, 19 aa, Mycobacterium
KPMNCPMHHLIYRSRGRSY

SEQ ID NO: 1242649 - protein, 33 aa, Mycobacterium
KPMSSGWESGSWVLDFIGSWEWTIPGGSSEIQR

SEQ ID NO: 1242650 - protein, 19 aa, Mycobacterium
KPMVKKAIGETLDYLADNL

SEQ ID NO: 1242651 - protein, 18 aa, Mycobacterium
KPRARIHHISARGADPVF

SEQ ID NO: 1242652 - protein, 24 aa, Mycobacterium
KPRQAHAAWVFARLAPGLMQRMAA

SEQ ID NO: 1242653 - protein, 20 aa, Mycobacterium
KPRQAVAMVAAARWITAASL

SEQ ID NO: 1242654 - protein, 19 aa, Mycobacterium
KPSAGLGVGEVGYLITGVK

SEQ ID NO: 1242655 - protein, 20 aa, Mycobacterium
KPSRGRLPLDRDMRQMPLRI

SEQ ID NO: 1242656 - protein, 19 aa, Mycobacterium
KPSSCPDCHGVTREDGPLG

SEQ ID NO: 1242657 - protein, 21 aa, Mycobacterium
KPTGWFCVAWSDEVGVGDVRA

SEQ ID NO: 1242658 - protein, 17 aa, Mycobacterium
KPTPRLMAYLFEVDYAD

SEQ ID NO: 1242659 - protein, 25 aa, Mycobacterium
KPVAAICHGPWTLVEADVVRDRTLT

SEQ ID NO: 1242660 - protein, 28 aa, Mycobacterium
KPVPNKNIRLVIEWLDRYAEALPLTVIG

SEQ ID NO: 1242661 - protein, 24 aa, Mycobacterium
KPWLPHFYLGHGIGTSAAEMPMIG

SEQ ID NO: 1242662 - protein, 29 aa, Mycobacterium
KQADEFTCSSCFLVHHRSRLASEKNGVMI

SEQ ID NO: 1242663 - protein, 19 aa, Mycobacterium
KQFKKLGVKIMTGTKVESI

SEQ ID NO: 1242664 - protein, 25 aa, Mycobacterium
KQFKSYRGMGSLGAMQGRGATGNLR

SEQ ID NO: 1242665 - protein, 23 aa, Mycobacterium
KQGEASAGYMLMKPLVETATAAG

SEQ ID NO: 1242666 - protein, 19 aa, Mycobacterium
KQGRVPFLTDYVASKFAVL

SEQ ID NO: 1242667 - protein, 17 aa, Mycobacterium
KQIARFVSYGASPRATI

SEQ ID NO: 1242668 - protein, 17 aa, Mycobacterium
KQIAVDGARMCVEEAAK

SEQ ID NO: 1242669 - protein, 18 aa, Mycobacterium
KQLRARSSVPVIMVTARD

SEQ ID NO: 1242670 - protein, 17 aa, Mycobacterium
KQPDVFSDFQGDYEELA

SEQ ID NO: 1242671 - protein, 19 aa, Mycobacterium
KQRPDGMVDLSGHLTPEAW

SEQ ID NO: 1242672 - protein, 26 aa, Mycobacterium
KQTRLEEFLMMPAFVRAFGKRVAIGQ

SEQ ID NO: 1242673 - protein, 24 aa, Mycobacterium
KQWLQREGTCLLLAPHHDVGFTDD

SEQ ID NO: 1242674 - protein, 26 aa, Mycobacterium
KRAADLPPAVGVLVEYTGDGENGTEA

SEQ ID NO: 1242675 - protein, 18 aa, Mycobacterium
KRAAWGGSGSRAVLYDLE

SEQ ID NO: 1242676 - protein, 22 aa, Mycobacterium
KRAESGALFAMLSGRHASAALR

SEQ ID NO: 1242677 - protein, 21 aa, Mycobacterium
KRAETELTILAPHREQLTGDE

SEQ ID NO: 1242678 - protein, 21 aa, Mycobacterium
KRAGAGIPLVHTTPMPYDNYF

SEQ ID NO: 1242679 - protein, 21 aa, Mycobacterium
KRAGIEGIYLGGWATSAKGST

SEQ ID NO: 1242680 - protein, 23 aa, Mycobacterium
KRALPHFDDLLFLGASMSRYPLE

SEQ ID NO: 1242681 - protein, 25 aa, Mycobacterium
KRASQEWLQRRLASLEPEQRKTLLM

SEQ ID NO: 1242682 - protein, 21 aa, Mycobacterium
KRDFREPVALNWSQDGTDIDF

SEQ ID NO: 1242683 - protein, 20 aa, Mycobacterium
KRDGDDWVINGTKYYISGVD

SEQ ID NO: 1242684 - protein, 26 aa, Mycobacterium
KRDLAGILDGHWVRFVIHPETVRRYA

SEQ ID NO: 1242685 - protein, 23 aa, Mycobacterium
KREKFTRLRTMLAVHETAEEMMV

SEQ ID NO: 1242686 - protein, 18 aa, Mycobacterium
KRELRGVPTHPVKSPADL

SEQ ID NO: 1242687 - protein, 19 aa, Mycobacterium
KRFARLGVTVLDGPDAVVA

SEQ ID NO: 1242688 - protein, 19 aa, Mycobacterium
KRFMFDYIPDVFKGQYAES

SEQ ID NO: 1242689 - protein, 19 aa, Mycobacterium
KRGDLVVIVAGAPPGTVGS

SEQ ID NO: 1242690 - protein, 20 aa, Mycobacterium
KRGPNAGSRFLLDQPTTSAG

SEQ ID NO: 1242691 - protein, 27 aa, Mycobacterium
KRGVTDFSLAMIDPWPAGYYGRQDHYD

SEQ ID NO: 1242692 - protein, 19 aa, Mycobacterium
KRHKDRPVLFLGDTTMTGG

SEQ ID NO: 1242693 - protein, 21 aa, Mycobacterium
KRIRVPVLVQIADFDRFVPAE

SEQ ID NO: 1242694 - protein, 19 aa, Mycobacterium
KRLFDLFDYRAHSPARSGR

SEQ ID NO: 1242695 - protein, 21 aa, Mycobacterium
KRLGGPDVATAVRCDVTRADE

SEQ ID NO: 1242696 - protein, 18 aa, Mycobacterium
KRLGRYVVGIGVAGASSR

SEQ ID NO: 1242697 - protein, 19 aa, Mycobacterium
KRLHCSRATIYRYAGGKAQ

SEQ ID NO: 1242698 - protein, 21 aa, Mycobacterium
KRLQHRPDLELVGLHCYTPDK

SEQ ID NO: 1242699 - protein, 21 aa, Mycobacterium
KRLVKATGIDERRLGLILEVA

SEQ ID NO: 1242700 - protein, 19 aa, Mycobacterium
KRMDECIEIIRGLTTGEYF

SEQ ID NO: 1242701 - protein, 22 aa, Mycobacterium
KRMRAEGATIVIGDIDPATGKT

SEQ ID NO: 1242702 - protein, 20 aa, Mycobacterium
KRPAYIAERVGKAWELGAGW

SEQ ID NO: 1242703 - protein, 18 aa, Mycobacterium
KRRGEGIGLTTVYRTLQS

SEQ ID NO: 1242704 - protein, 18 aa, Mycobacterium
KRRLPSMYHQFMELAEVD

SEQ ID NO: 1242705 - protein, 26 aa, Mycobacterium
KRRYQSGWKRSLIAMRSQRYFRLLDA

SEQ ID NO: 1242706 - protein, 23 aa, Mycobacterium
KRTADGYASNWLCDNAHPGMKLH

SEQ ID NO: 1242707 - protein, 27 aa, Mycobacterium
KRTQWWGRQMLIWGVHVHVGISSAHKV

SEQ ID NO: 1242708 - protein, 30 aa, Mycobacterium
KRTRGGKISFTHLIGYAIVAAVKKFPNMNR

SEQ ID NO: 1242709 - protein, 19 aa, Mycobacterium
KRVEECLRSLGYAETAGGS

SEQ ID NO: 1242710 - protein, 17 aa, Mycobacterium
KRVPSMHVHAFSPMEIA

SEQ ID NO: 1242711 - protein, 19 aa, Mycobacterium
KRVQGAVVVVSIFVNPLQF

SEQ ID NO: 1242712 - protein, 27 aa, Mycobacterium
KRWAGPEEVAGAFVFMASDAASYITGQ

SEQ ID NO: 1242713 - protein, 17 aa, Mycobacterium
KRWGATMVLTEPDAGSD

SEQ ID NO: 1242714 - protein, 21 aa, Mycobacterium
KSAAEMRALWDSQVPGACDST

SEQ ID NO: 1242715 - protein, 21 aa, Mycobacterium
KSADDAFLFKSAVKEVAAQND

SEQ ID NO: 1242716 - protein, 18 aa, Mycobacterium
KSAKWKVGEESVFRELGR

SEQ ID NO: 1242717 - protein, 35 aa, Mycobacterium
KSAVKMPSQRGWRHVLYLLTRINLGLSPDEMYEMD

SEQ ID NO: 1242718 - protein, 27 aa, Mycobacterium
KSFAGPDFELGMMWREVYKLRQRVLLI

SEQ ID NO: 1242719 - protein, 37 aa, Mycobacterium
KSFQRLGIRCFGFIPLRLPPELDFAALFHGIDERVPV

SEQ ID NO: 1242720 - protein, 21 aa, Mycobacterium
KSFSVARRWFDRSADGDGKLH

SEQ ID NO: 1242721 - protein, 31 aa, Mycobacterium
KSGALRLAPGLKRSSLIGGIRYFDTVVDDAR

SEQ ID NO: 1242722 - protein, 17 aa, Mycobacterium
KSGRKALVGKRPMTRVG

SEQ ID NO: 1242723 - protein, 26 aa, Mycobacterium
KSGVTLERRRMLAAADEFARAHPDLL

SEQ ID NO: 1242724 - protein, 19 aa, Mycobacterium
KSHGINIWLVDADHVSVSC

SEQ ID NO: 1242725 - protein, 25 aa, Mycobacterium
KSIRRVAMEWNEAGLRSTLAGRERK

SEQ ID NO: 1242726 - protein, 24 aa, Mycobacterium
KSLRGPRGGLVLAQPEYSDAVDKG

SEQ ID NO: 1242727 - protein, 20 aa, Mycobacterium
KSLYLRNEVFADWINKVDSH

SEQ ID NO: 1242728 - protein, 27 aa, Mycobacterium
KSMGLFGYAIPQEWGGLGLDLTQDVEL

SEQ ID NO: 1242729 - protein, 22 aa, Mycobacterium
KSRPGEGIVTFSHVGRNQHGDV

SEQ ID NO: 1242730 - protein, 21 aa, Mycobacterium
KSTGGGNLWLDPEMTTPYAWY

SEQ ID NO: 1242731 - protein, 19 aa, Mycobacterium
KSTHFDWVLAPYDIAASKA

SEQ ID NO: 1242732 - protein, 25 aa, Mycobacterium
KSVEEALDILRWAPQQASEPVAKVI

SEQ ID NO: 1242733 - protein, 18 aa, Mycobacterium
KSVLAGLVQSGARPIWLT

SEQ ID NO: 1242734 - protein, 18 aa, Mycobacterium
KTAAFAIPILSKIDPNSR

SEQ ID NO: 1242735 - protein, 23 aa, Mycobacterium
KTALLRLAGRYGVGEDAVDDLLR

SEQ ID NO: 1242736 - protein, 24 aa, Mycobacterium
KTASSRHPLGWKTVGDIGYLDEEG

SEQ ID NO: 1242737 - protein, 21 aa, Mycobacterium
KTEGRLLCGGGRPAHLPQGNF

SEQ ID NO: 1242738 - protein, 24 aa, Mycobacterium
KTGEPRVSPLIFLRDGERVILVAS

SEQ ID NO: 1242739 - protein, 18 aa, Mycobacterium
KTGEWYLHHFYKHQPDLN

SEQ ID NO: 1242740 - protein, 18 aa, Mycobacterium
KTGIRLRLFHGRGGTVGR

SEQ ID NO: 1242741 - protein, 25 aa, Mycobacterium
KTGKARLSPLAYLTVDGRMLIVGSY

SEQ ID NO: 1242742 - protein, 18 aa, Mycobacterium
KTGKEFTPLQLLATDSDG

SEQ ID NO: 1242743 - protein, 24 aa, Mycobacterium
KTHVSVPPALRFTAQAAQLLGPRG

SEQ ID NO: 1242744 - protein, 20 aa, Mycobacterium
KTLTCVLPAYLNALSGKGVH

SEQ ID NO: 1242745 - protein, 23 aa, Mycobacterium
KTMGIPLLYPWANRLSSSKYAID

SEQ ID NO: 1242746 - protein, 18 aa, Mycobacterium
KTPLVERLSGAPVQQRKK

SEQ ID NO: 1242747 - protein, 19 aa, Mycobacterium
KTRVAHGYCARHESAGACP

SEQ ID NO: 1242748 - protein, 26 aa, Mycobacterium
KTSGDPRFRFFGNIAVGEHVHPEELA

SEQ ID NO: 1242749 - protein, 24 aa, Mycobacterium
KTTLLRCVAGLDQPTSGSVTFNGQ

SEQ ID NO: 1242750 - protein, 27 aa, Mycobacterium
KTWMDAEWWRLRVLPELGGTDAPNSLN

SEQ ID NO: 1242751 - protein, 23 aa, Mycobacterium
KVAEGRVAGVHFLMKKNKITEVH

SEQ ID NO: 1242752 - protein, 19 aa, Mycobacterium
KVAPRRSGPVVWVKDASRS

SEQ ID NO: 1242753 - protein, 26 aa, Mycobacterium
KVAQWSGYRFDDFRVPELVSDQTRML

SEQ ID NO: 1242754 - protein, 25 aa, Mycobacterium
KVDGGIRLTGDFSWSSGSEHAHWII

SEQ ID NO: 1242755 - protein, 24 aa, Mycobacterium
KVDRSAAYAMRWVAKNVVAAGLAD

SEQ ID NO: 1242756 - protein, 17 aa, Mycobacterium
KVELCAMAKRYVTDACY

SEQ ID NO: 1242757 - protein, 18 aa, Mycobacterium
KVFAWPDAEVAVMGAKAA

SEQ ID NO: 1242758 - protein, 24 aa, Mycobacterium
KVGKPVAGLYAMFHTLRRAEPVRI

SEQ ID NO: 1242759 - protein, 27 aa, Mycobacterium
KVGLYCRNRIEIVIGMVGIVKAGAIAV

SEQ ID NO: 1242760 - protein, 35 aa, Mycobacterium
KVGRGSPWAAPLSWLVPPRVAMQILLTGDPITAER

SEQ ID NO: 1242761 - protein, 17 aa, Mycobacterium
KVICLVRAKDDAAARKR

SEQ ID NO: 1242762 - protein, 18 aa, Mycobacterium
KVKAVSFVGSTPIAQYVY

SEQ ID NO: 1242763 - protein, 17 aa, Mycobacterium
KVLEDLGWYVADNLPPE

SEQ ID NO: 1242764 - protein, 23 aa, Mycobacterium
KVLGYRNWLGLNRGDLSEEVSKG

SEQ ID NO: 1242765 - protein, 24 aa, Mycobacterium
KVPELVCVLCPWKPSRVADDGKSV

SEQ ID NO: 1242766 - protein, 24 aa, Mycobacterium
KVRAKRGGSVLCAIEVPPEKISAY

SEQ ID NO: 1242767 - protein, 22 aa, Mycobacterium
KVREVTMGLARPVWVDDRDFDI

SEQ ID NO: 1242768 - protein, 18 aa, Mycobacterium
KVRFYGNVRRYGMVSPTV

SEQ ID NO: 1242769 - protein, 32 aa, Mycobacterium
KVSELRAAHPVFRRRRFFSGRPVRQRGAPGLP

SEQ ID NO: 1242770 - protein, 17 aa, Mycobacterium
KVSSLPDLLPLLEKVAE

SEQ ID NO: 1242771 - protein, 17 aa, Mycobacterium
KVVEMAGTVGYSEESLL

SEQ ID NO: 1242772 - protein, 17 aa, Mycobacterium
KVVTCASYRAREFGVHA

SEQ ID NO: 1242773 - protein, 19 aa, Mycobacterium
KWGGLKERLLVATASSYVV

SEQ ID NO: 1242774 - protein, 23 aa, Mycobacterium
KYAADIDGVLAWARESRERLDQL

SEQ ID NO: 1242775 - protein, 19 aa, Mycobacterium
KYAGEFNVPFVPLDTLSTQ

SEQ ID NO: 1242776 - protein, 18 aa, Mycobacterium
KYAVLAVIVADAMAELDK

SEQ ID NO: 1242777 - protein, 18 aa, Mycobacterium
KYDVPIVQAWGMTETSPL

SEQ ID NO: 1242778 - protein, 20 aa, Mycobacterium
KYEIVFKFVAGLPVYLVAKL

SEQ ID NO: 1242779 - protein, 19 aa, Mycobacterium
KYLDGCADLFREGYTDVAQ

SEQ ID NO: 1242780 - protein, 18 aa, Mycobacterium
KYPLHLDIPVTIAGMSFG

SEQ ID NO: 1242781 - protein, 18 aa, Mycobacterium
KYSIPANTVLKFGSDTLK

SEQ ID NO: 1242782 - protein, 25 aa, Mycobacterium
KYVASRGRPDLSWDGTTQLGPDLVG

SEQ ID NO: 1242783 - protein, 18 aa, Mycobacterium
LAAAARRGALVRGLMWRA

SEQ ID NO: 1242784 - protein, 19 aa, Mycobacterium
LAAADPGAGILIDPWSQLS

SEQ ID NO: 1242785 - protein, 18 aa, Mycobacterium
LAAAFAAAIEAFPTPEAF

SEQ ID NO: 1242786 - protein, 32 aa, Mycobacterium
LAAAFEGVFEGFPTPAEFFAAFNAAIAGVLPG

SEQ ID NO: 1242787 - protein, 18 aa, Mycobacterium
LAAAFNAAFEGFPTPAEF

SEQ ID NO: 1242788 - protein, 17 aa, Mycobacterium
LAAAGRDAAEFTVVPEV

SEQ ID NO: 1242789 - protein, 21 aa, Mycobacterium
LAAELMVPFYAVRYEGVVSSF

SEQ ID NO: 1242790 - protein, 18 aa, Mycobacterium
LAAELPRQMLRSWYIFYF

SEQ ID NO: 1242791 - protein, 22 aa, Mycobacterium
LAAFGKMPCYIRGVGAEVVDID

SEQ ID NO: 1242792 - protein, 19 aa, Mycobacterium
LAAGALPLAAIGQLRRFAP

SEQ ID NO: 1242793 - protein, 17 aa, Mycobacterium
LAAGEGRGRIYIVEPEG

SEQ ID NO: 1242794 - protein, 18 aa, Mycobacterium
LAAHAAVWGAMFNAGQTC

SEQ ID NO: 1242795 - protein, 20 aa, Mycobacterium
LAAHGALLMAARADLVHHLA

SEQ ID NO: 1242796 - protein, 20 aa, Mycobacterium
LAAHGARWRPWRAYATQHLW

SEQ ID NO: 1242797 - protein, 20 aa, Mycobacterium
LAAHRRGRRVIVLSKAPEQA

SEQ ID NO: 1242798 - protein, 24 aa, Mycobacterium
LAAIKRPGSFLARQVPQFLRLLES

SEQ ID NO: 1242799 - protein, 17 aa, Mycobacterium
LAAIRFAVEGVRDGVPV

SEQ ID NO: 1242800 - protein, 37 aa, Mycobacterium
LAAISVAMLPGWARKPLRLPYFPPLEATAVRVSGRVL

SEQ ID NO: 1242801 - protein, 18 aa, Mycobacterium
LAAIVELWTSDSPSFHGK

SEQ ID NO: 1242802 - protein, 19 aa, Mycobacterium
LAAKHLPPGVLNVVTGDRV

SEQ ID NO: 1242803 - protein, 20 aa, Mycobacterium
LAAKPAWEATPFDERAAVFL

SEQ ID NO: 1242804 - protein, 17 aa, Mycobacterium
LAALADMAALLFDDRIP

SEQ ID NO: 1242805 - protein, 18 aa, Mycobacterium
LAALGTSCPDHFLRTKVK

SEQ ID NO: 1242806 - protein, 33 aa, Mycobacterium
LAALKEWRLRTSKELGVPAFVVFTDNTLIAIAE

SEQ ID NO: 1242807 - protein, 17 aa, Mycobacterium
LAANYERRRSEMAELIT

SEQ ID NO: 1242808 - protein, 17 aa, Mycobacterium
LAAPISGAVAANANVAA

SEQ ID NO: 1242809 - protein, 24 aa, Mycobacterium
LAAQGFEVLLLLAAVPTPVVAFTV

SEQ ID NO: 1242810 - protein, 25 aa, Mycobacterium
LAAQLKKARGEAVAAMKAEGIEYDE

SEQ ID NO: 1242811 - protein, 17 aa, Mycobacterium
LAARAQGLGACFTSWAS

SEQ ID NO: 1242812 - protein, 18 aa, Mycobacterium
LAARGVLSFAELDTSYFI

SEQ ID NO: 1242813 - protein, 18 aa, Mycobacterium
LAARRGRPEGLRWLDSCQ

SEQ ID NO: 1242814 - protein, 17 aa, Mycobacterium
LAARRPAGDIGQGASPS

SEQ ID NO: 1242815 - protein, 20 aa, Mycobacterium
LAARSDYPLHLGVTEAGPAF

SEQ ID NO: 1242816 - protein, 20 aa, Mycobacterium
LAARYTWANRLVAVVSDGSA

SEQ ID NO: 1242817 - protein, 17 aa, Mycobacterium
LAAVTLEHIECNAACDY

SEQ ID NO: 1242818 - protein, 17 aa, Mycobacterium
LAAWFGPDRLDQWYRTG

SEQ ID NO: 1242819 - protein, 17 aa, Mycobacterium
LAAYPGHIAAMFALVYG

SEQ ID NO: 1242820 - protein, 26 aa, Mycobacterium
LACARLGAVHSVVFGGFAAHELAARI

SEQ ID NO: 1242821 - protein, 27 aa, Mycobacterium
LACLSEARFGIVFGSVGAARDCLETTL

SEQ ID NO: 1242822 - protein, 17 aa, Mycobacterium
LADAFGRAAKSVVRAFD

SEQ ID NO: 1242823 - protein, 20 aa, Mycobacterium
LADAVYWCLENFEADEETTL

SEQ ID NO: 1242824 - protein, 18 aa, Mycobacterium
LADDILDEFLAPGQGEFI

SEQ ID NO: 1242825 - protein, 18 aa, Mycobacterium
LADGAVLVVNVASKCGLT

SEQ ID NO: 1242826 - protein, 19 aa, Mycobacterium
LADGCAALGIPVTGGNVSF

SEQ ID NO: 1242827 - protein, 25 aa, Mycobacterium
LADGGYRLAKEALILYTMRSAGPLG

SEQ ID NO: 1242828 - protein, 17 aa, Mycobacterium
LADGRWALIGKVHHALA

SEQ ID NO: 1242829 - protein, 22 aa, Mycobacterium
LADIGFRQVVLFTHDRASDRTL

SEQ ID NO: 1242830 - protein, 25 aa, Mycobacterium
LADLERRVAEFLGFRDVFTSVGQVY

SEQ ID NO: 1242831 - protein, 18 aa, Mycobacterium
LADPRLAGIHFTGSTATF

SEQ ID NO: 1242832 - protein, 17 aa, Mycobacterium
LADRGQFDIRRMERVMV

SEQ ID NO: 1242833 - protein, 19 aa, Mycobacterium
LADSRLPIGGHVHSGGVEE

SEQ ID NO: 1242834 - protein, 25 aa, Mycobacterium
LAEAGLLAPHWPKPFGRAASAAEQL

SEQ ID NO: 1242835 - protein, 25 aa, Mycobacterium
LAEFDRAGADIVLLDLMLPGMSGTD

SEQ ID NO: 1242836 - protein, 17 aa, Mycobacterium
LAEGAIAPWSMGQTAEY

SEQ ID NO: 1242837 - protein, 23 aa, Mycobacterium
LAELDRLDAWLLGPHDNAGYPAP

SEQ ID NO: 1242838 - protein, 25 aa, Mycobacterium
LAELRKSEPVHWVDVPGGTGGFGDK

SEQ ID NO: 1242839 - protein, 22 aa, Mycobacterium
LAELRPTTLAIMHGSSFTGDGE

SEQ ID NO: 1242840 - protein, 17 aa, Mycobacterium
LAELRRVLDTAGVSGLT

SEQ ID NO: 1242841 - protein, 19 aa, Mycobacterium
LAEMGWVCLSIDYRVAPHN

SEQ ID NO: 1242842 - protein, 19 aa, Mycobacterium
LAERLGVGDRVVFQGAVAR

SEQ ID NO: 1242843 - protein, 19 aa, Mycobacterium
LAERVKRTPALRVEGPHVA

SEQ ID NO: 1242844 - protein, 20 aa, Mycobacterium
LAEVARFWVSLASYDEDRGR

SEQ ID NO: 1242845 - protein, 24 aa, Mycobacterium
LAEYLLRIIQSFVVDPGRPPRTGE

SEQ ID NO: 1242846 - protein, 34 aa, Mycobacterium
LAEYSVDLFALLPLGELWVAAARLRQVERLQHTL

SEQ ID NO: 1242847 - protein, 21 aa, Mycobacterium
LAFDASISGFSSRQALYEYFF

SEQ ID NO: 1242848 - protein, 26 aa, Mycobacterium
LAFLHPLPVRRLWGVGEKTAAKLRAH

SEQ ID NO: 1242849 - protein, 25 aa, Mycobacterium
LAGAFLRAGAIDRIVAYVAPILLGG

SEQ ID NO: 1242850 - protein, 17 aa, Mycobacterium
LAGAFLVIQHAGRHLAD

SEQ ID NO: 1242851 - protein, 20 aa, Mycobacterium
LAGCMALGITGPVLRSTGLP

SEQ ID NO: 1242852 - protein, 18 aa, Mycobacterium
LAGERAGGTILWMADERA

SEQ ID NO: 1242853 - protein, 25 aa, Mycobacterium
LAGFAARLGLLLGRTDDAGLVTLSY

SEQ ID NO: 1242854 - protein, 17 aa, Mycobacterium
LAGGCFWGMQDLIRKQP

SEQ ID NO: 1242855 - protein, 19 aa, Mycobacterium
LAGGVLRPAPSSVLNGPVG

SEQ ID NO: 1242856 - protein, 20 aa, Mycobacterium
LAGLDYRWAAVTLDGARHRV

SEQ ID NO: 1242857 - protein, 18 aa, Mycobacterium
LAGLFGLCERHRHLFQAM

SEQ ID NO: 1242858 - protein, 17 aa, Mycobacterium
LAGLKPAFRDDGVIHAG

SEQ ID NO: 1242859 - protein, 17 aa, Mycobacterium
LAGLKPAFRKDGTITAG

SEQ ID NO: 1242860 - protein, 18 aa, Mycobacterium
LAGLPVTRCVASEAGMDL

SEQ ID NO: 1242861 - protein, 17 aa, Mycobacterium
LAGLRGWLSAPVIVLSA

SEQ ID NO: 1242862 - protein, 19 aa, Mycobacterium
LAGMPSVNLQLLGGRVRGL

SEQ ID NO: 1242863 - protein, 21 aa, Mycobacterium
LAGNLGRPGLAIVESDEDVLL

SEQ ID NO: 1242864 - protein, 25 aa, Mycobacterium
LAGPKLRTGPIRPGPRVIKLRPTRD

SEQ ID NO: 1242865 - protein, 19 aa, Mycobacterium
LAGPLGLVAGDVVTFGDMP

SEQ ID NO: 1242866 - protein, 18 aa, Mycobacterium
LAGPRGVGVLAVRPEFAE

SEQ ID NO: 1242867 - protein, 17 aa, Mycobacterium
LAGRLTGVTAFTPVHPV

SEQ ID NO: 1242868 - protein, 19 aa, Mycobacterium
LAGTCQRIEQIRCMEIIDY

SEQ ID NO: 1242869 - protein, 18 aa, Mycobacterium
LAGVPLLDDWPVVATTLC

SEQ ID NO: 1242870 - protein, 18 aa, Mycobacterium
LAGWSLGGVLAYACAIGL

SEQ ID NO: 1242871 - protein, 19 aa, Mycobacterium
LAHAKIQVELARLMTQRAA

SEQ ID NO: 1242872 - protein, 20 aa, Mycobacterium
LAHAKSYWNAEYAKPEMMLF

SEQ ID NO: 1242873 - protein, 17 aa, Mycobacterium
LAHGAPVAAHWIADRQV

SEQ ID NO: 1242874 - protein, 17 aa, Mycobacterium
LAHICRAVLPAMRRRGS

SEQ ID NO: 1242875 - protein, 27 aa, Mycobacterium
LAHLLKFDSILGRLPYEVSLEGDDTIV

SEQ ID NO: 1242876 - protein, 22 aa, Mycobacterium
LAHPARIRILEVLSAGEQPTPV

SEQ ID NO: 1242877 - protein, 25 aa, Mycobacterium
LAHPLPVAVICRLLGVPLEDEPQFS

SEQ ID NO: 1242878 - protein, 24 aa, Mycobacterium
LAHRISLRPEMWVRRVQGADVVEE

SEQ ID NO: 1242879 - protein, 25 aa, Mycobacterium
LAHRNGLRLAKLVNTLLDFSRIQAG

SEQ ID NO: 1242880 - protein, 18 aa, Mycobacterium
LAIGFEWGVGLQHVELGK

SEQ ID NO: 1242881 - protein, 19 aa, Mycobacterium
LAIGSALFGLLRADDPVPA

SEQ ID NO: 1242882 - protein, 19 aa, Mycobacterium
LAISMGYDPTSAWRTPEVR

SEQ ID NO: 1242883 - protein, 18 aa, Mycobacterium
LAIVGASPLPPAVRESFR

SEQ ID NO: 1242884 - protein, 17 aa, Mycobacterium
LAKAMLSVDRFVREDSP

SEQ ID NO: 1242885 - protein, 24 aa, Mycobacterium
LAKAQGIPAQFLVDILSDLRTDRL

SEQ ID NO: 1242886 - protein, 24 aa, Mycobacterium
LAKGEHRQRLDLGAQHQMVLEVRP

SEQ ID NO: 1242887 - protein, 19 aa, Mycobacterium
LAKHLDEKVARIHVEALGG

SEQ ID NO: 1242888 - protein, 17 aa, Mycobacterium
LAKLGIAPFDLVVVNLY

SEQ ID NO: 1242889 - protein, 20 aa, Mycobacterium
LAKLGLRDRLALTRYAIRAG

SEQ ID NO: 1242890 - protein, 27 aa, Mycobacterium
LAKRQWHGMFEWMGRPEEFADPKFEGL

SEQ ID NO: 1242891 - protein, 23 aa, Mycobacterium
LALAADWRISGDNVKVGSTEILA

SEQ ID NO: 1242892 - protein, 17 aa, Mycobacterium
LALAESWDNGKPIRETL

SEQ ID NO: 1242893 - protein, 29 aa, Mycobacterium
LALAMGLPLFGVRGMNGFVRATRRAAALT

SEQ ID NO: 1242894 - protein, 25 aa, Mycobacterium
LALAQRFEVPWTMSYAGRSRASLPF

SEQ ID NO: 1242895 - protein, 24 aa, Mycobacterium
LALGRWPFDRITRESTGFAGLAQL

SEQ ID NO: 1242896 - protein, 24 aa, Mycobacterium
LALIKSWASQGWLHRIVDERSDQN

SEQ ID NO: 1242897 - protein, 17 aa, Mycobacterium
LALLEADVSLPVVRAFV

SEQ ID NO: 1242898 - protein, 24 aa, Mycobacterium
LALTEWRLLTAAALVGLVEETMTI

SEQ ID NO: 1242899 - protein, 26 aa, Mycobacterium
LALTWPGTRVELCFPGDRPLPQHHTR

SEQ ID NO: 1242900 - protein, 23 aa, Mycobacterium
LANALRSWSVLRFEVTEDPSPGV

SEQ ID NO: 1242901 - protein, 17 aa, Mycobacterium
LANDRLDPKLSHGDVSI

SEQ ID NO: 1242902 - protein, 17 aa, Mycobacterium
LANLRRRAEEVGGALTI

SEQ ID NO: 1242903 - protein, 17 aa, Mycobacterium
LAPDCVVYAASGPQRDA

SEQ ID NO: 1242904 - protein, 17 aa, Mycobacterium
LAPFVFTSALGLGDLFA

SEQ ID NO: 1242905 - protein, 19 aa, Mycobacterium
LAPKGIWFAPKDLRLFYQV

SEQ ID NO: 1242906 - protein, 18 aa, Mycobacterium
LAPKTMRTLLERICADEG

SEQ ID NO: 1242907 - protein, 19 aa, Mycobacterium
LAPLPKRRLAETLDKYPNV

SEQ ID NO: 1242908 - protein, 18 aa, Mycobacterium
LAPNGMRASRRYRVPPMP

SEQ ID NO: 1242909 - protein, 24 aa, Mycobacterium
LAPTAVEEIVRWASPVSYMRRTLT

SEQ ID NO: 1242910 - protein, 18 aa, Mycobacterium
LAQIPGLRVLSDHDLTGP

SEQ ID NO: 1242911 - protein, 25 aa, Mycobacterium
LAQIPHPWFDLIFAGGHEKTAALSS

SEQ ID NO: 1242912 - protein, 20 aa, Mycobacterium
LAQLRSDVGMVFQSFNLFAH

SEQ ID NO: 1242913 - protein, 20 aa, Mycobacterium
LAQRCKRLGRYVVGIGVAGA

SEQ ID NO: 1242914 - protein, 19 aa, Mycobacterium
LAQRFPLSIISPKPHAFLN

SEQ ID NO: 1242915 - protein, 17 aa, Mycobacterium
LAQVCAVLGYEVTRSAG

SEQ ID NO: 1242916 - protein, 17 aa, Mycobacterium
LAQVIAMTVTINAWNRI

SEQ ID NO: 1242917 - protein, 19 aa, Mycobacterium
LARARAMALVMLALPGVVF

SEQ ID NO: 1242918 - protein, 24 aa, Mycobacterium
LARELAVAPVRFVKTIGDAVMLVS

SEQ ID NO: 1242919 - protein, 25 aa, Mycobacterium
LARFKCPKSFDFIDEMPRLPTGKLY

SEQ ID NO: 1242920 - protein, 32 aa, Mycobacterium
LARHPRLTRAFLRFNVHLLFRSTLPARLRELA

SEQ ID NO: 1242921 - protein, 21 aa, Mycobacterium
LARIARAYLDFARENNAVYDA

SEQ ID NO: 1242922 - protein, 21 aa, Mycobacterium
LARLAPVRAALPAGVGSVSPV

SEQ ID NO: 1242923 - protein, 22 aa, Mycobacterium
LARLKSVPILLAPPWGLVVSDL

SEQ ID NO: 1242924 - protein, 20 aa, Mycobacterium
LARLNARAAAPLATVSVPDI

SEQ ID NO: 1242925 - protein, 17 aa, Mycobacterium
LARLWSTALANLVDIGY

SEQ ID NO: 1242926 - protein, 17 aa, Mycobacterium
LARMGGRLVTAFDDEWP

SEQ ID NO: 1242927 - protein, 22 aa, Mycobacterium
LARRLAELGRLIDLGTLQYRPG

SEQ ID NO: 1242928 - protein, 23 aa, Mycobacterium
LARRLHAKGAKLVLTDLDDGPLS

SEQ ID NO: 1242929 - protein, 17 aa, Mycobacterium
LARTRRRSVTVAHKANV

SEQ ID NO: 1242930 - protein, 19 aa, Mycobacterium
LARVLPRSVALRMAIVGKH

SEQ ID NO: 1242931 - protein, 26 aa, Mycobacterium
LASDARRFDVSPAWFSALGAGLTLPW

SEQ ID NO: 1242932 - protein, 20 aa, Mycobacterium
LASEFGKLGLLGMHLEGYGC

SEQ ID NO: 1242933 - protein, 25 aa, Mycobacterium
LASHGVPRVHRWARGVDITGFAPSA

SEQ ID NO: 1242934 - protein, 25 aa, Mycobacterium
LASMMPMRVIGMLLGIPESEQVSVR

SEQ ID NO: 1242935 - protein, 22 aa, Mycobacterium
LASPILCDLVLIRGALSTKALR

SEQ ID NO: 1242936 - protein, 28 aa, Mycobacterium
LASQGKGAWPSCGGPLSGATPRNVVDQP

SEQ ID NO: 1242937 - protein, 17 aa, Mycobacterium
LASRPTFQKGLAHHTAA

SEQ ID NO: 1242938 - protein, 17 aa, Mycobacterium
LASVTKPLAARAAQIAV

SEQ ID NO: 1242939 - protein, 25 aa, Mycobacterium
LATALPFGAASTFALLLALLDDPYL

SEQ ID NO: 1242940 - protein, 22 aa, Mycobacterium
LATAMAARFLANPALLAVSNGL

SEQ ID NO: 1242941 - protein, 23 aa, Mycobacterium
LATCAIEGIPIKVAVINNGNLGM

SEQ ID NO: 1242942 - protein, 18 aa, Mycobacterium
LATDLGRPIDVAIQDQQL

SEQ ID NO: 1242943 - protein, 20 aa, Mycobacterium
LATMHPSRYLSLIEGVTQVF

SEQ ID NO: 1242944 - protein, 18 aa, Mycobacterium
LATQGAAVVREYYFNDHG

SEQ ID NO: 1242945 - protein, 18 aa, Mycobacterium
LATTRWLVAILENHQQPD

SEQ ID NO: 1242946 - protein, 25 aa, Mycobacterium
LATVLARSTFHWVLAFAYKGLSTPK

SEQ ID NO: 1242947 - protein, 23 aa, Mycobacterium
LAVAEQFGGAGFGLSELAVVLEM

SEQ ID NO: 1242948 - protein, 18 aa, Mycobacterium
LAVAIAMASARKERAMPA

SEQ ID NO: 1242949 - protein, 19 aa, Mycobacterium
LAVAPGRVSACIRPQGEVA

SEQ ID NO: 1242950 - protein, 20 aa, Mycobacterium
LAVDLMIPMIGLLKRKAERR

SEQ ID NO: 1242951 - protein, 21 aa, Mycobacterium
LAVGRRLRERYGIDEKPTASD

SEQ ID NO: 1242952 - protein, 25 aa, Mycobacterium
LAVLRDAYCRHIGVEYTHILEPEQQ

SEQ ID NO: 1242953 - protein, 25 aa, Mycobacterium
LAVMREWKFTAADMERTNVHGSGIS

SEQ ID NO: 1242954 - protein, 17 aa, Mycobacterium
LAVPNWPVEWGGKDWTP

SEQ ID NO: 1242955 - protein, 33 aa, Mycobacterium; identical to SEQ ID NO: 89399

SEQ ID NO: 1242956 - protein, 19 aa, Mycobacterium
LAVPRFRQVLRTHPLDLEA

SEQ ID NO: 1242957 - protein, 22 aa, Mycobacterium
LAVQALRSGDCDLALTGGVCVM

SEQ ID NO: 1242958 - protein, 17 aa, Mycobacterium
LAVRYLGAEAGNTFTDQ

SEQ ID NO: 1242959 - protein, 18 aa, Mycobacterium
LAVSRIGALAVPLSTMYT

SEQ ID NO: 1242960 - protein, 20 aa, Mycobacterium
LAVYPRAEFEKLARRASQAS

SEQ ID NO: 1242961 - protein, 23 aa, Mycobacterium
LAYGDMGLALPILAPGGVAAALT

SEQ ID NO: 1242962 - protein, 18 aa, Mycobacterium
LAYQGVRVLPYCWNDETP

SEQ ID NO: 1242963 - protein, 20 aa, Mycobacterium
LCAVRPEIGGVLIRGEKGTA

SEQ ID NO: 1242964 - protein, 21 aa, Mycobacterium
LCAYRQPQLLLNYLGRADVGG

SEQ ID NO: 1242965 - protein, 25 aa, Mycobacterium
LCDPPESFQLYGIVAHVLTFSAHRR

SEQ ID NO: 1242966 - protein, 18 aa, Mycobacterium
LCDRGALLLGGKAIADGT

SEQ ID NO: 1242967 - protein, 17 aa, Mycobacterium
LCDRVAFVVEGRIVALD

SEQ ID NO: 1242968 - protein, 24 aa, Mycobacterium
LCEIKDVQIRDGLHILGAPPAGEA

SEQ ID NO: 1242969 - protein, 17 aa, Mycobacterium
LCFCASMGTGPAVGPGY

SEQ ID NO: 1242970 - protein, 25 aa, Mycobacterium
LCFLCAHPSLTPASAVALTLRAVGG

SEQ ID NO: 1242971 - protein, 18 aa, Mycobacterium
LCINPFFHNFGYKAGILT

SEQ ID NO: 1242972 - protein, 25 aa, Mycobacterium
LCRDTCHYCTFVTVPGRLRAQGAGM

SEQ ID NO: 1242973 - protein, 23 aa, Mycobacterium
LCRPGEMPVVVEIPGPPVGKGLG

SEQ ID NO: 1242974 - protein, 18 aa, Mycobacterium
LCTYGIACKAIVDEFLDG

SEQ ID NO: 1242975 - protein, 18 aa, Mycobacterium
LDAAALERLTGWIDRYRL

SEQ ID NO: 1242976 - protein, 17 aa, Mycobacterium
LDAAAVTIAKLWEVFVG

SEQ ID NO: 1242977 - protein, 23 aa, Mycobacterium
LDAACAVQAEWAATPARKRGEIL

SEQ ID NO: 1242978 - protein, 18 aa, Mycobacterium
LDAAGLPEELSPFDQILH

SEQ ID NO: 1242979 - protein, 26 aa, Mycobacterium
LDAAWAAFCDRLKAAGAQAFKDHNAT

SEQ ID NO: 1242980 - protein, 26 aa, Mycobacterium
LDADLAEWRKIIDLNMSRMLELTQHF

SEQ ID NO: 1242981 - protein, 19 aa, Mycobacterium
LDAEFPKFRQLLPSEHTAV

SEQ ID NO: 1242982 - protein, 22 aa, Mycobacterium
LDAEGARKVMKLVDALEDSDDV

SEQ ID NO: 1242983 - protein, 23 aa, Mycobacterium
LDAGARSRADFHKTLQKMQGAIS

SEQ ID NO: 1242984 - protein, 34 aa, Mycobacterium
LDAHRRVQRVWADIRTEVLGGQFLDIAAEASGAQ

SEQ ID NO: 1242985 - protein, 25 aa, Mycobacterium
LDAKLRAAMRAELKQLGAMSNTTTL

SEQ ID NO: 1242986 - protein, 17 aa, Mycobacterium
LDALAAVYGARRADGEP

SEQ ID NO: 1242987 - protein, 20 aa, Mycobacterium
LDALLFRGSLDARLRELVIM

SEQ ID NO: 1242988 - protein, 18 aa, Mycobacterium
LDALNWLGLDYDEGPEIG

SEQ ID NO: 1242989 - protein, 28 aa, Mycobacterium
LDAPVARVCGAEVPVPYAKHLEQAALPQ

SEQ ID NO: 1242990 - protein, 17 aa, Mycobacterium
LDARIAARVGLRPDVRR

SEQ ID NO: 1242991 - protein, 19 aa, Mycobacterium
LDASADWVPQLWRDMDTTL

SEQ ID NO: 1242992 - protein, 27 aa, Mycobacterium
LDASARQRVRRELKVLQREFGYTTIVV

SEQ ID NO: 1242993 - protein, 20 aa, Mycobacterium
LDASCPVVASFGRRDPLGKD

SEQ ID NO: 1242994 - protein, 31 aa, Mycobacterium
LDATVCWFADAPLRAGDRLALKQGTRTVRAT

SEQ ID NO: 1242995 - protein, 18 aa, Mycobacterium
LDAYGREGEPCRRCGAIM

SEQ ID NO: 1242996 - protein, 26 aa, Mycobacterium
LDAYSCGWFERYTRTFAGTIAGGTSE

SEQ ID NO: 1242997 - protein, 19 aa, Mycobacterium
LDCHGWLRRGQQLEQEADR

SEQ ID NO: 1242998 - protein, 28 aa, Mycobacterium
LDDAAAFLGDLERAWALVLPGLAATERL

SEQ ID NO: 1242999 - protein, 19 aa, Mycobacterium
LDDEVRWVLTKGKLPTSMW

SEQ ID NO: 1243000 - protein, 25 aa, Mycobacterium
LDDGSTWRVEIERAHMEEDTGKLTH

SEQ ID NO: 1243001 - protein, 23 aa, Mycobacterium
LDDIDFRDSTAFDRDSQIIRAPE

SEQ ID NO: 1243002 - protein, 24 aa, Mycobacterium
LDDKRTAFVTAIWELDPAGRRPAR

SEQ ID NO: 1243003 - protein, 18 aa, Mycobacterium
LDDPAGMGVDAVRPIRDD

SEQ ID NO: 1243004 - protein, 27 aa, Mycobacterium
LDEAGPMLGEIAQRFGSRLHAHAAEAP

SEQ ID NO: 1243005 - protein, 17 aa, Mycobacterium
LDEAIAHLAGAELRTTV

SEQ ID NO: 1243006 - protein, 21 aa, Mycobacterium
LDEAPGWRCVHVAGVESDMEL

SEQ ID NO: 1243007 - protein, 19 aa, Mycobacterium
LDEIHLRAIADLNYDNARR

SEQ ID NO: 1243008 - protein, 18 aa, Mycobacterium
LDELLTRIHILRQRPEWR

SEQ ID NO: 1243009 - protein, 20 aa, Mycobacterium
LDERCRRWPQAAAVCDDVLR

SEQ ID NO: 1243010 - protein, 24 aa, Mycobacterium
LDERGRHVFIEMNPRIQVEHTVTE

SEQ ID NO: 1243011 - protein, 18 aa, Mycobacterium
LDERRAAVLASIEEQGKL

SEQ ID NO: 1243012 - protein, 21 aa, Mycobacterium
LDESAVAFVRDFVRSGKPVAA

SEQ ID NO: 1243013 - protein, 21 aa, Mycobacterium
LDFAGNADFAIAIRTALMRDG

SEQ ID NO: 1243014 - protein, 19 aa, Mycobacterium
LDFMPRYEVLWDECRRVAM

SEQ ID NO: 1243015 - protein, 23 aa, Mycobacterium
LDFRPKHRLTVLVVQVSPLAEPV

SEQ ID NO: 1243016 - protein, 17 aa, Mycobacterium
LDFSTEWTAHHRDGAPD

SEQ ID NO: 1243017 - protein, 21 aa, Mycobacterium
LDGADMFLGLSAGVVAEELIA

SEQ ID NO: 1243018 - protein, 19 aa, Mycobacterium
LDGALVCTRAVYRKMAKRG

SEQ ID NO: 1243019 - protein, 18 aa, Mycobacterium
LDGEFARAGYEIENVVID

SEQ ID NO: 1243020 - protein, 17 aa, Mycobacterium
LDGERCWIRSGDGEVKT

SEQ ID NO: 1243021 - protein, 19 aa, Mycobacterium
LDGLVDFLPSKTWFDHSDA

SEQ ID NO: 1243022 - protein, 26 aa, Mycobacterium
LDGMKRGEFDAVICWHTDRLYRSLKD

SEQ ID NO: 1243023 - protein, 19 aa, Mycobacterium
LDGNYPFSIALDGQALNIT

SEQ ID NO: 1243024 - protein, 17 aa, Mycobacterium
LDGPPRIVVSRTRPPAI

SEQ ID NO: 1243025 - protein, 27 aa, Mycobacterium
LDGRADPGEIVWTWVVYEDDPTRGKDR

SEQ ID NO: 1243026 - protein, 17 aa, Mycobacterium
LDGRARRPLPTGLGAPS

SEQ ID NO: 1243027 - protein, 17 aa, Mycobacterium
LDGRLVWMHQVHSDRVV

SEQ ID NO: 1243028 - protein, 17 aa, Mycobacterium
LDGSLGMHDVPSGGTDV

SEQ ID NO: 1243029 - protein, 17 aa, Mycobacterium
LDGTVLLAGCDKSIPGM

SEQ ID NO: 1243030 - protein, 23 aa, Mycobacterium
LDGWGNRRIEAEAKKITTRLDAA

SEQ ID NO: 1243031 - protein, 18 aa, Mycobacterium
LDHAMWFMRPFRADEWLL

SEQ ID NO: 1243032 - protein, 18 aa, Mycobacterium
LDHGACRDTNVPTFKERR

SEQ ID NO: 1243033 - protein, 23 aa, Mycobacterium
LDHGGWRRHPWAEVHQRAENIAA

SEQ ID NO: 1243034 - protein, 19 aa, Mycobacterium
LDHLRRIRLDHAHRDLLDH

SEQ ID NO: 1243035 - protein, 18 aa, Mycobacterium
LDKMGWRSSDTAELSYTD

SEQ ID NO: 1243036 - protein, 25 aa, Mycobacterium
LDKPKLVFFFDEAHLLFADASKAFL

SEQ ID NO: 1243037 - protein, 25 aa, Mycobacterium
LDKPPGIAETIDWVAALVTLGVAEL

SEQ ID NO: 1243038 - protein, 31 aa, Mycobacterium
LDKSRYGLVGVHCDVWEGFIFVNFAEQPEQT

SEQ ID NO: 1243039 - protein, 18 aa, Mycobacterium
LDLADTVAYKGMMLSGIP

SEQ ID NO: 1243040 - protein, 18 aa, Mycobacterium
LDLGNLDISDLVDGVLDT

SEQ ID NO: 1243041 - protein, 33 aa, Mycobacterium; identical to SEQ ID NO: 688441

SEQ ID NO: 1243042 - protein, 17 aa, Mycobacterium
LDLLETLGLTSGELAHW

SEQ ID NO: 1243043 - protein, 19 aa, Mycobacterium
LDLLRLGTYQLLRTRVEPH

SEQ ID NO: 1243044 - protein, 24 aa, Mycobacterium
LDLLTGWRDAWDIGTTVRDNALRL

SEQ ID NO: 1243045 - protein, 17 aa, Mycobacterium
LDLPDFRDYAVPVEEPG

SEQ ID NO: 1243046 - protein, 26 aa, Mycobacterium
LDLQLALYVCYELHYRGFAGVDPHWE

SEQ ID NO: 1243047 - protein, 17 aa, Mycobacterium
LDLRRLIDRAARWLLNY

SEQ ID NO: 1243048 - protein, 18 aa, Mycobacterium
LDLVLAILRARQLFGGEQ

SEQ ID NO: 1243049 - protein, 17 aa, Mycobacterium
LDLVLDGLVARLASGDD

SEQ ID NO: 1243050 - protein, 20 aa, Mycobacterium
LDLVPRVISAAEWTRLERGI

SEQ ID NO: 1243051 - protein, 19 aa, Mycobacterium
LDMAMAVIDLGSRRRTLLF

SEQ ID NO: 1243052 - protein, 23 aa, Mycobacterium
LDMHPSMRLRVEHYLQRRDSPYL

SEQ ID NO: 1243053 - protein, 17 aa, Mycobacterium
LDNFGWLQELVDYMNEL

SEQ ID NO: 1243054 - protein, 18 aa, Mycobacterium
LDNLTFVVNCNLQRLDGP

SEQ ID NO: 1243055 - protein, 26 aa, Mycobacterium
LDNQIWQCPVVLLADVRSVGVQGDGR

SEQ ID NO: 1243056 - protein, 23 aa, Mycobacterium
LDPAELLSAVGLGEHAGTRVAKY

SEQ ID NO: 1243057 - protein, 18 aa, Mycobacterium
LDPAVAADTARRAVAVAT

SEQ ID NO: 1243058 - protein, 27 aa, Mycobacterium
LDPDLAVARWGIAYSVGPNYNKPWEAF

SEQ ID NO: 1243059 - protein, 24 aa, Mycobacterium
LDPDLRTGWSVTIVGTAHPISDVD

SEQ ID NO: 1243060 - protein, 18 aa, Mycobacterium
LDPEFMYPVERITRSGLV

SEQ ID NO: 1243061 - protein, 18 aa, Mycobacterium
LDPEIAYLSGDRLPDGVR

SEQ ID NO: 1243062 - protein, 29 aa, Mycobacterium
LDPELRRRICADAVAFAREIGYSYAGTVE

SEQ ID NO: 1243063 - protein, 17 aa, Mycobacterium
LDPEMTTPYAWYQYFIN

SEQ ID NO: 1243064 - protein, 26 aa, Mycobacterium
LDPEPRWSLREFLGPMITALDDYPFE

SEQ ID NO: 1243065 - protein, 17 aa, Mycobacterium
LDPGHAVAHGMALAAEG

SEQ ID NO: 1243066 - protein, 17 aa, Mycobacterium
LDPHRPGFVIVPGAAGP

SEQ ID NO: 1243067 - protein, 20 aa, Mycobacterium
LDPKDLYDVVAINAASASTQ

SEQ ID NO: 1243068 - protein, 19 aa, Mycobacterium
LDPRLAGVHIQLACDVTAP

SEQ ID NO: 1243069 - protein, 19 aa, Mycobacterium
LDPRLPVFEVLAEPLQANN

SEQ ID NO: 1243070 - protein, 19 aa, Mycobacterium
LDPSREWQPTLGVAGLLTR

SEQ ID NO: 1243071 - protein, 17 aa, Mycobacterium
LDPSRRGPTAARLFYVY

SEQ ID NO: 1243072 - protein, 19 aa, Mycobacterium
LDPTLPIVVLTGNVDDHYG

SEQ ID NO: 1243073 - protein, 17 aa, Mycobacterium
LDQEGRDDLALRIAVQP

SEQ ID NO: 1243074 - protein, 27 aa, Mycobacterium
LDQPLDWFCSFSSAAAMVGSPGQGAYA

SEQ ID NO: 1243075 - protein, 27 aa, Mycobacterium
LDRGFVLPWRKDIALFLSDLYVGGEPF

SEQ ID NO: 1243076 - protein, 32 aa, Mycobacterium
LDRILPDRPAFFFAIDGHSLWANSTALEMAGV

SEQ ID NO: 1243077 - protein, 28 aa, Mycobacterium
LDRLLDWMLVCTLREWFDRPNGEPPPWW

SEQ ID NO: 1243078 - protein, 19 aa, Mycobacterium
LDRRLLLAVLADLPAGSGV

SEQ ID NO: 1243079 - protein, 19 aa, Mycobacterium
LDRTAMDGLSRWYAGELTD

SEQ ID NO: 1243080 - protein, 18 aa, Mycobacterium
LDRTHRWTSTGQRGATIW

SEQ ID NO: 1243081 - protein, 18 aa, Mycobacterium
LDRTPWRAEETTVIVAPM

SEQ ID NO: 1243082 - protein, 23 aa, Mycobacterium
LDRTWPAICDELIGHYEAVAGLR

SEQ ID NO: 1243083 - protein, 17 aa, Mycobacterium
LDRYFSISIVDCSSTMD

SEQ ID NO: 1243084 - protein, 26 aa, Mycobacterium
LDSIRMMSLSGRWRKQGIDVRFAAMA

SEQ ID NO: 1243085 - protein, 17 aa, Mycobacterium
LDSMDWLNFLVGVHKQF

SEQ ID NO: 1243086 - protein, 18 aa, Mycobacterium
LDSPGVMVTDIFAARRVG

SEQ ID NO: 1243087 - protein, 21 aa, Mycobacterium
LDSRQRWTLSTAMISVLGSIV

SEQ ID NO: 1243088 - protein, 19 aa, Mycobacterium
LDSSRFRYLVAQRAAIAVG

SEQ ID NO: 1243089 - protein, 23 aa, Mycobacterium
LDTECRVYRVAGLRVVDASAMPT

SEQ ID NO: 1243090 - protein, 27 aa, Mycobacterium
LDTEPWRGEPLLNYLRRMVFWADVTIE

SEQ ID NO: 1243091 - protein, 27 aa, Mycobacterium
LDTLIKEKWLTANGVIGFFPANAVGDD

SEQ ID NO: 1243092 - protein, 17 aa, Mycobacterium
LDTVLGLTVGADDYVTK

SEQ ID NO: 1243093 - protein, 22 aa, Mycobacterium
LDTYVPGRWVYRPLSVNYRTPA

SEQ ID NO: 1243094 - protein, 18 aa, Mycobacterium
LDVARMVLFGQVGRELVG

SEQ ID NO: 1243095 - protein, 19 aa, Mycobacterium
LDVEGWRGDNFAFTFNIED

SEQ ID NO: 1243096 - protein, 26 aa, Mycobacterium
LDWDDELLSFFGIPRQMMPEIKPSSC

SEQ ID NO: 1243097 - protein, 22 aa, Mycobacterium
LDWKMRHSLEDMVASAWAARQA

SEQ ID NO: 1243098 - protein, 17 aa, Mycobacterium
LDYALAHDERFGIWGGL

SEQ ID NO: 1243099 - protein, 24 aa, Mycobacterium
LDYDCPRHVLDRATEVTPGLESPT

SEQ ID NO: 1243100 - protein, 30 aa, Mycobacterium
LDYLQWLGVDCLWLPPFYDSPLRDGGYDIR

SEQ ID NO: 1243101 - protein, 19 aa, Mycobacterium
LEAAAGIAGVIKVILSLEH

SEQ ID NO: 1243102 - protein, 23 aa, Mycobacterium
LEAARLLYDGGLVAERHEAVGDF

SEQ ID NO: 1243103 - protein, 23 aa, Mycobacterium
LEAARRLGVRPQRAVLIEDSAAG

SEQ ID NO: 1243104 - protein, 25 aa, Mycobacterium
LEADPYRRLAFTFPAAVPSTVDVDA

SEQ ID NO: 1243105 - protein, 22 aa, Mycobacterium
LEAFQSGLSWLIILRKRENFRR

SEQ ID NO: 1243106 - protein, 19 aa, Mycobacterium
LEAGRRIWGFPKIMADFTV

SEQ ID NO: 1243107 - protein, 18 aa, Mycobacterium
LEAIFRSHIHAFNATKRA

SEQ ID NO: 1243108 - protein, 36 aa, Mycobacterium; identical to SEQ ID NO: 81820

SEQ ID NO: 1243109 - protein, 17 aa, Mycobacterium
LEAPSYRAAARSAAATA

SEQ ID NO: 1243110 - protein, 19 aa, Mycobacterium
LEARVAFEEVLARWTDWDV

SEQ ID NO: 1243111 - protein, 21 aa, Mycobacterium
LEAYPAYYAHMGVINREGPAP

SEQ ID NO: 1243112 - protein, 17 aa, Mycobacterium
LEAYPTVEYRVGTVVHG

SEQ ID NO: 1243113 - protein, 24 aa, Mycobacterium
LEDETRGAWYLRQMLGSANFHAGP

SEQ ID NO: 1243114 - protein, 18 aa, Mycobacterium
LEDFDVFHPDRMASRILG

SEQ ID NO: 1243115 - protein, 19 aa, Mycobacterium
LEDGLTCAVLGVPVADLVE

SEQ ID NO: 1243116 - protein, 19 aa, Mycobacterium
LEDLEVLDWPDKVKTMQRN

SEQ ID NO: 1243117 - protein, 17 aa, Mycobacterium
LEDLGWYVADNLPPELI

SEQ ID NO: 1243118 - protein, 18 aa, Mycobacterium
LEDYRRILSAGVNMVGSG

SEQ ID NO: 1243119 - protein, 25 aa, Mycobacterium
LEEAWRAGQVEMITWLGELHGLDRI

SEQ ID NO: 1243120 - protein, 17 aa, Mycobacterium
LEEELIEMVALITPKAK

SEQ ID NO: 1243121 - protein, 17 aa, Mycobacterium
LEEGKLLGARTGKDGKL

SEQ ID NO: 1243122 - protein, 21 aa, Mycobacterium
LEEILRRWPDWTIDEDNAVRA

SEQ ID NO: 1243123 - protein, 19 aa, Mycobacterium
LEELEWCLERGAKTVLVRP

SEQ ID NO: 1243124 - protein, 22 aa, Mycobacterium
LEELRSGVVPSVQRVDGITRTL

SEQ ID NO: 1243125 - protein, 18 aa, Mycobacterium
LEELSVWVSACQGVCPPR

SEQ ID NO: 1243126 - protein, 24 aa, Mycobacterium
LEERATRLVACWGNNDGDELRRRL

SEQ ID NO: 1243127 - protein, 23 aa, Mycobacterium
LEERDFPATSVRFFASARSQGRK

SEQ ID NO: 1243128 - protein, 18 aa, Mycobacterium
LEETLRICAQMWDPDNNG

SEQ ID NO: 1243129 - protein, 22 aa, Mycobacterium
LEFAQMYRRFGARVTVLEHGPR

SEQ ID NO: 1243130 - protein, 21 aa, Mycobacterium
LEFAVRLGVDLVALSFVRSPA

SEQ ID NO: 1243131 - protein, 26 aa, Mycobacterium
LEFDGLRRAGGCWVLTNHPFLTGRTS

SEQ ID NO: 1243132 - protein, 18 aa, Mycobacterium
LEGAGRFAAGAGRHGAKA

SEQ ID NO: 1243133 - protein, 18 aa, Mycobacterium
LEGALGRESEGQLELLAS

SEQ ID NO: 1243134 - protein, 20 aa, Mycobacterium
LEGDEKWVKSVEELMDAVDE

SEQ ID NO: 1243135 - protein, 17 aa, Mycobacterium
LEGLRVLDLGVIVVGAD

SEQ ID NO: 1243136 - protein, 19 aa, Mycobacterium
LEGVLATGAERARDVTAKT

SEQ ID NO: 1243137 - protein, 18 aa, Mycobacterium
LEHAVEMFRLRGGGDEQA

SEQ ID NO: 1243138 - protein, 19 aa, Mycobacterium
LEHHVWRRVRELPRVDILD

SEQ ID NO: 1243139 - protein, 24 aa, Mycobacterium
LEHRIREHMVWWPVDVEAEALADA

SEQ ID NO: 1243140 - protein, 28 aa, Mycobacterium
LEHYEKLEGVALTFAGKVNRLATMVRGN

SEQ ID NO: 1243141 - protein, 18 aa, Mycobacterium
LEIGIMVTEWLRRVPEFT

SEQ ID NO: 1243142 - protein, 18 aa, Mycobacterium
LEIHSASLSDVRRAGEAI

SEQ ID NO: 1243143 - protein, 28 aa, Mycobacterium
LEIRRLAIACLRELVAVAPAVFADFEIY

SEQ ID NO: 1243144 - protein, 23 aa, Mycobacterium
LEITTCLRRGELEIVTRYEPDAE

SEQ ID NO: 1243145 - protein, 19 aa, Mycobacterium
LEKGPRLGVLGVVVEIDGR

SEQ ID NO: 1243146 - protein, 25 aa, Mycobacterium
LEKPCYAVPMLLDNFGWLQELVDYM

SEQ ID NO: 1243147 - protein, 19 aa, Mycobacterium
LEKVTARRHLVAGLMLIHL

SEQ ID NO: 1243148 - protein, 18 aa, Mycobacterium
LELAWTTGMIKWEDDPKP

SEQ ID NO: 1243149 - protein, 18 aa, Mycobacterium
LELGCPRAQGFMLSRPVD

SEQ ID NO: 1243150 - protein, 22 aa, Mycobacterium
LELGESLGIPRTQLAEVLNGGS

SEQ ID NO: 1243151 - protein, 20 aa, Mycobacterium
LELLAYAAACTTRLRLGVGV

SEQ ID NO: 1243152 - protein, 20 aa, Mycobacterium
LELLKGCVGCTTRGDLLVLL

SEQ ID NO: 1243153 - protein, 27 aa, Mycobacterium
LELRIPKLRSGSFFPALLERRRRVDQC

SEQ ID NO: 1243154 - protein, 18 aa, Mycobacterium
LELVSLTQILAWDLPLDA

SEQ ID NO: 1243155 - protein, 20 aa, Mycobacterium
LELYAERGFDGTTVADIADR

SEQ ID NO: 1243156 - protein, 19 aa, Mycobacterium
LEMETHYFGTLQVLRAFAP

SEQ ID NO: 1243157 - protein, 17 aa, Mycobacterium
LEMFQYFTALTASRREH

SEQ ID NO: 1243158 - protein, 17 aa, Mycobacterium
LEMLPVECVARGYLTGS

SEQ ID NO: 1243159 - protein, 17 aa, Mycobacterium
LEMNTRLQVEHPVTEAT

SEQ ID NO: 1243160 - protein, 17 aa, Mycobacterium
LEMQYVLQFRHDERRGK

SEQ ID NO: 1243161 - protein, 23 aa, Mycobacterium
LENLPLQVGDTWEEGGPDSDRIF

SEQ ID NO: 1243162 - protein, 23 aa, Mycobacterium
LEPPRFCAECGRRMVVQVRPDGW

SEQ ID NO: 1243163 - protein, 19 aa, Mycobacterium
LEPRIVAIVDEHLDAMQQS

SEQ ID NO: 1243164 - protein, 17 aa, Mycobacterium
LEPRWFAWVDNMHDWCI

SEQ ID NO: 1243165 - protein, 17 aa, Mycobacterium
LEQELRGLRSLGVGTVL

SEQ ID NO: 1243166 - protein, 22 aa, Mycobacterium
LEQFPGCAVVISHDRWFLDRTC

SEQ ID NO: 1243167 - protein, 18 aa, Mycobacterium
LEQGRYGPVYPRTPACYG

SEQ ID NO: 1243168 - protein, 19 aa, Mycobacterium
LEQHFGRLVDYGFTAAMED

SEQ ID NO: 1243169 - protein, 18 aa, Mycobacterium
LEQHVDWIADCLQYLRSR

SEQ ID NO: 1243170 - protein, 19 aa, Mycobacterium
LEQPCRTVPELAELRSRIT

SEQ ID NO: 1243171 - protein, 24 aa, Mycobacterium
LEQPRSEVLTFLAAREAAHHRLFS

SEQ ID NO: 1243172 - protein, 29 aa, Mycobacterium
LEQRFGPRLFKELLALHFSPTRPTRDEWT

SEQ ID NO: 1243173 - protein, 18 aa, Mycobacterium
LEQRGVGQWATFTDLVAD

SEQ ID NO: 1243174 - protein, 17 aa, Mycobacterium
LEQYWGPQVPFPKRMGR

SEQ ID NO: 1243175 - protein, 17 aa, Mycobacterium
LERAAGWAHTGGGNKIP

SEQ ID NO: 1243176 - protein, 17 aa, Mycobacterium
LERAAGWAHTGGGNRLP

SEQ ID NO: 1243177 - protein, 24 aa, Mycobacterium
LERDGDCPAALFVSASPAPGHGGY

SEQ ID NO: 1243178 - protein, 25 aa, Mycobacterium
LEREAVFKRAWLNVGRVEELPRVGS

SEQ ID NO: 1243179 - protein, 26 aa, Mycobacterium
LERGGAAMCRWCGREELGLRCGRCGS

SEQ ID NO: 1243180 - protein, 19 aa, Mycobacterium
LERKARAGVITPVSACASG

SEQ ID NO: 1243181 - protein, 17 aa, Mycobacterium
LERLEVPLIAAVNGAAV

SEQ ID NO: 1243182 - protein, 21 aa, Mycobacterium
LERLVELVLDWHRPVKLFIET

SEQ ID NO: 1243183 - protein, 19 aa, Mycobacterium
LERRGFLELETPMLQTLAG

SEQ ID NO: 1243184 - protein, 24 aa, Mycobacterium
LERYERQAADWARRTNGSVVELHS

SEQ ID NO: 1243185 - protein, 21 aa, Mycobacterium
LESMKMEIPVLAEVAGTVTKV

SEQ ID NO: 1243186 - protein, 24 aa, Mycobacterium
LETHLGWVAKAGWNINVAGADGVP

SEQ ID NO: 1243187 - protein, 21 aa, Mycobacterium
LETLHAYLVRRVRTQGLVAAS

SEQ ID NO: 1243188 - protein, 23 aa, Mycobacterium
LEVAPNLWAGVGLVRGGAGTALV

SEQ ID NO: 1243189 - protein, 23 aa, Mycobacterium
LEVGQRVVMTFLPRCGHCTACAT

SEQ ID NO: 1243190 - protein, 17 aa, Mycobacterium
LEVPGLILADPGDPMSL

SEQ ID NO: 1243191 - protein, 25 aa, Mycobacterium
LEVRRCGICGSDLHAKDHADELTEV

SEQ ID NO: 1243192 - protein, 20 aa, Mycobacterium
LEVVDLRSLNPLDFDTVAAS

SEQ ID NO: 1243193 - protein, 21 aa, Mycobacterium
LEWREISGLGTLYSYTVARRP

SEQ ID NO: 1243194 - protein, 25 aa, Mycobacterium
LEYELEGLLGRPAVRPLNIAHSMDL

SEQ ID NO: 1243195 - protein, 19 aa, Mycobacterium
LEYHPKWTTAEAFDDYVRG

SEQ ID NO: 1243196 - protein, 24 aa, Mycobacterium
LEYIYCPWHQWGFELATGTTAVKP

SEQ ID NO: 1243197 - protein, 24 aa, Mycobacterium
LEYRVARAYVDGRIQTIFGGTTEI

SEQ ID NO: 1243198 - protein, 17 aa, Mycobacterium
LFADNGIDLSLRGPERA

SEQ ID NO: 1243199 - protein, 19 aa, Mycobacterium
LFAGIPYAAPPVGALRWRP

SEQ ID NO: 1243200 - protein, 17 aa, Mycobacterium
LFALRGGYREPVLASST

SEQ ID NO: 1243201 - protein, 18 aa, Mycobacterium
LFASARAAIPFTPLNYRL

SEQ ID NO: 1243202 - protein, 26 aa, Mycobacterium
LFDVARRIAVAMARMTDPGRLILLTR

SEQ ID NO: 1243203 - protein, 20 aa, Mycobacterium
LFEFKKGARPPVPLDEVESA

SEQ ID NO: 1243204 - protein, 17 aa, Mycobacterium
LFFELDGTFPNHEANPL

SEQ ID NO: 1243205 - protein, 38 aa, Mycobacterium
LFGHPSFRYYGWGPRMWTWIQMMGLRAFQEMVFTGRPF

SEQ ID NO: 1243206 - protein, 30 aa, Mycobacterium
LFGPGGLGTFSWPGAYGTWWQADPTNDLIL

SEQ ID NO: 1243207 - protein, 18 aa, Mycobacterium
LFHLARQSGTPTGRRHPK

SEQ ID NO: 1243208 - protein, 18 aa, Mycobacterium
LFIDGRWATPDGGDAIEV

SEQ ID NO: 1243209 - protein, 19 aa, Mycobacterium
LFIIGRIKDLLIVDGSNHY

SEQ ID NO: 1243210 - protein, 25 aa, Mycobacterium
LFIVGRIKDLLIIRGRNHHPEDIEA

SEQ ID NO: 1243211 - protein, 19 aa, Mycobacterium
LFMKYLRRGSGYYIDVGAC

SEQ ID NO: 1243212 - protein, 23 aa, Mycobacterium
LFPEAKLGIGPPITDGFYYDFDV

SEQ ID NO: 1243213 - protein, 25 aa, Mycobacterium
LFRLHLDPDILLLGFSLPGAPPKPA

SEQ ID NO: 1243214 - protein, 18 aa, Mycobacterium
LFSAGVLGPVCVLRASAL

SEQ ID NO: 1243215 - protein, 17 aa, Mycobacterium
LFTAGLVKAVFATETLA

SEQ ID NO: 1243216 - protein, 22 aa, Mycobacterium
LFTDFAPRLLVSHPAEVKVAHA

SEQ ID NO: 1243217 - protein, 22 aa, Mycobacterium
LFTHRPDWPSATAVGKTAVSSS

SEQ ID NO: 1243218 - protein, 18 aa, Mycobacterium
LFTLRSVAEFDFPDVEFD

SEQ ID NO: 1243219 - protein, 21 aa, Mycobacterium
LFWHRGSHVGHIFSRGVQEVS

SEQ ID NO: 1243220 - protein, 26 aa, Mycobacterium
LGAAACARLALEPSLTPAEAVGTWTP

SEQ ID NO: 1243221 - protein, 18 aa, Mycobacterium
LGAAKLVPLVIAAHGGTL

SEQ ID NO: 1243222 - protein, 18 aa, Mycobacterium
LGAEAARPHRVTHRRLTR

SEQ ID NO: 1243223 - protein, 18 aa, Mycobacterium
LGAETVVLDFPKRVVREP

SEQ ID NO: 1243224 - protein, 26 aa, Mycobacterium
LGAGMHPWGKWGRDFTEYGVVAARAA

SEQ ID NO: 1243225 - protein, 20 aa, Mycobacterium
LGAHLRQARGDRKLVEVAEA

SEQ ID NO: 1243226 - protein, 19 aa, Mycobacterium
LGAIGQRILGSVSRGLVHH

SEQ ID NO: 1243227 - protein, 22 aa, Mycobacterium
LGAKLAPLRERGVLILASGNVV

SEQ ID NO: 1243228 - protein, 17 aa, Mycobacterium
LGALRFALNGGEPVDCQ

SEQ ID NO: 1243229 - protein, 20 aa, Mycobacterium
LGALRMLAGDVVEMATGEGK

SEQ ID NO: 1243230 - protein, 19 aa, Mycobacterium
LGANLARREIRVLYSELRR

SEQ ID NO: 1243231 - protein, 18 aa, Mycobacterium
LGAPRIAERFADLTREVP

SEQ ID NO: 1243232 - protein, 26 aa, Mycobacterium
LGATCAGVRVWSLYVPNGRFVGSPHY

SEQ ID NO: 1243233 - protein, 18 aa, Mycobacterium
LGATVLPLQPVLEAWTDR

SEQ ID NO: 1243234 - protein, 25 aa, Mycobacterium
LGAVLDRLAAYQARSIDIDGCVYRE

SEQ ID NO: 1243235 - protein, 18 aa, Mycobacterium
LGAVLGICSGSERVHAAT

SEQ ID NO: 1243236 - protein, 17 aa, Mycobacterium
LGCWGPVVKCNVPKRGW

SEQ ID NO: 1243237 - protein, 18 aa, Mycobacterium
LGDGRALLLGELVDGDGR

SEQ ID NO: 1243238 - protein, 19 aa, Mycobacterium
LGDLNIFDTIGRWRPSLSG

SEQ ID NO: 1243239 - protein, 17 aa, Mycobacterium
LGDPETIAYGLIPRAHR

SEQ ID NO: 1243240 - protein, 17 aa, Mycobacterium
LGDTFRWKGENVATTEV

SEQ ID NO: 1243241 - protein, 18 aa, Mycobacterium
LGDYRMMPRATFCQPQVA

SEQ ID NO: 1243242 - protein, 18 aa, Mycobacterium
LGEALGIYVDAMRYPRGT

SEQ ID NO: 1243243 - protein, 22 aa, Mycobacterium
LGEERHAALLLAFERATTGFGW

SEQ ID NO: 1243244 - protein, 24 aa, Mycobacterium
LGEGLTRRLLCDRGEKHVLLSTPE

SEQ ID NO: 1243245 - protein, 20 aa, Mycobacterium
LGEQLWKLAAEGIAARVRSG

SEQ ID NO: 1243246 - protein, 19 aa, Mycobacterium
LGFASSRFALHKTSSGSPI

SEQ ID NO: 1243247 - protein, 19 aa, Mycobacterium
LGFDGKWVLHPDQITAGNE

SEQ ID NO: 1243248 - protein, 19 aa, Mycobacterium
LGFEGRYTLQFNRIPQPWL

SEQ ID NO: 1243249 - protein, 27 aa, Mycobacterium
LGFKSSIQREWEWRVSRGESLKNLRAF

SEQ ID NO: 1243250 - protein, 17 aa, Mycobacterium
LGFQLGSLWYISLDYIN

SEQ ID NO: 1243251 - protein, 18 aa, Mycobacterium
LGFVEAQGGGTILLARGD

SEQ ID NO: 1243252 - protein, 18 aa, Mycobacterium
LGFYTGLVDGHFGLQTHH

SEQ ID NO: 1243253 - protein, 19 aa, Mycobacterium
LGGAELWQAPTTAFSASPF

SEQ ID NO: 1243254 - protein, 22 aa, Mycobacterium
LGGDALRPAPVGAYPAGASAYG

SEQ ID NO: 1243255 - protein, 19 aa, Mycobacterium
LGGDLLAVVARLNRLATQR

SEQ ID NO: 1243256 - protein, 17 aa, Mycobacterium
LGGELTNGTVDWREQID

SEQ ID NO: 1243257 - protein, 19 aa, Mycobacterium
LGGGFLDCHVHEPLPDDSP

SEQ ID NO: 1243258 - protein, 18 aa, Mycobacterium
LGGGWIGAFGSHLIDFTR

SEQ ID NO: 1243259 - protein, 17 aa, Mycobacterium
LGGMDYLSPERVELRYT

SEQ ID NO: 1243260 - protein, 26 aa, Mycobacterium
LGGMPMPRALQWALIEHVLGANPAAY

SEQ ID NO: 1243261 - protein, 18 aa, Mycobacterium
LGGQWGGAFGTLPVGLDL

SEQ ID NO: 1243262 - protein, 26 aa, Mycobacterium
LGGRMDWADAFASWSPHELSGIPKAV

SEQ ID NO: 1243263 - protein, 26 aa, Mycobacterium
LGGYPDVIGPFLGRAAAAVKALTEQA

SEQ ID NO: 1243264 - protein, 20 aa, Mycobacterium
LGHFIKQFVGLGVAESTALL

SEQ ID NO: 1243265 - protein, 26 aa, Mycobacterium
LGHRKGFLQFRWQRVSRELTPADGPS

SEQ ID NO: 1243266 - protein, 32 aa, Mycobacterium
LGHRPSTAFTEAWVLAGAAFRLLGTSRAATPD

SEQ ID NO: 1243267 - protein, 17 aa, Mycobacterium
LGITGPVLRSTGLPHDL

SEQ ID NO: 1243268 - protein, 25 aa, Mycobacterium
LGKLDLHPGMTLLDVGCGWGAMMKR

SEQ ID NO: 1243269 - protein, 18 aa, Mycobacterium
LGKNLLVAIMPWEGHNYE

SEQ ID NO: 1243270 - protein, 28 aa, Mycobacterium
LGLERRLGAVLFKDFLALHFSQTRPPVE

SEQ ID NO: 1243271 - protein, 26 aa, Mycobacterium
LGLERVGIELARGGYIPVDRVSRTPA

SEQ ID NO: 1243272 - protein, 18 aa, Mycobacterium
LGLFEINEAASLVQDAAH

SEQ ID NO: 1243273 - protein, 25 aa, Mycobacterium
LGLFLSLPGVNQWRTLQRVPIGGEP

SEQ ID NO: 1243274 - protein, 19 aa, Mycobacterium
LGLGHLMTAIDVLKNYEFE

SEQ ID NO: 1243275 - protein, 17 aa, Mycobacterium
LGLIFHWADQKGLPLLD

SEQ ID NO: 1243276 - protein, 20 aa, Mycobacterium
LGLNGHRWGLGRASREDRER

SEQ ID NO: 1243277 - protein, 25 aa, Mycobacterium
LGLPPPAALLGDWFGSTAVIAPSVT

SEQ ID NO: 1243278 - protein, 17 aa, Mycobacterium
LGLQVVRELLQMRRPLT

SEQ ID NO: 1243279 - protein, 20 aa, Mycobacterium
LGMHLEVPSLVIWGDRDPII

SEQ ID NO: 1243280 - protein, 21 aa, Mycobacterium
LGNWFRAAGYDTHYDGKWHIS

SEQ ID NO: 1243281 - protein, 22 aa, Mycobacterium
LGPFAEVCRDLGLPLVVDAAQA

SEQ ID NO: 1243282 - protein, 18 aa, Mycobacterium
LGPFEAWLVLRSLGSAGL

SEQ ID NO: 1243283 - protein, 18 aa, Mycobacterium
LGPGQLWEAAAAVLADSG

SEQ ID NO: 1243284 - protein, 17 aa, Mycobacterium
LGPQTGGAVTWRDLTAL

SEQ ID NO: 1243285 - protein, 17 aa, Mycobacterium
LGPSGWLGLDFDRADVD

SEQ ID NO: 1243286 - protein, 20 aa, Mycobacterium
LGPVADPACNISVKKGDKDF

SEQ ID NO: 1243287 - protein, 25 aa, Mycobacterium
LGQHGVNIMEFCKAYNAATESQRGN

SEQ ID NO: 1243288 - protein, 21 aa, Mycobacterium
LGQVNVWRADLAAAERVAEDS

SEQ ID NO: 1243289 - protein, 18 aa, Mycobacterium
LGRALPLGRVAEPEEIAQ

SEQ ID NO: 1243290 - protein, 25 aa, Mycobacterium
LGRKYPWALGRPASEVWAEIWPDIG

SEQ ID NO: 1243291 - protein, 18 aa, Mycobacterium
LGRLEELSVWVSACQGVC

SEQ ID NO: 1243292 - protein, 18 aa, Mycobacterium
LGRLNGYLLPLLGTDGRG

SEQ ID NO: 1243293 - protein, 18 aa, Mycobacterium
LGRLSRRPEWAAAGRFAQ

SEQ ID NO: 1243294 - protein, 29 aa, Mycobacterium
LGRPKEAPSHGWRKWLYLATFKLVNIGES

SEQ ID NO: 1243295 - protein, 18 aa, Mycobacterium
LGRRAAIVQFGRRDDTPV

SEQ ID NO: 1243296 - protein, 29 aa, Mycobacterium
LGRSLTRPRMDWVYEVSAGNPLYALELAR

SEQ ID NO: 1243297 - protein, 24 aa, Mycobacterium
LGRVVRRIDMGWPDAMVGIEYDGE

SEQ ID NO: 1243298 - protein, 20 aa, Mycobacterium
LGSALARLEARVAFEEVLAR

SEQ ID NO: 1243299 - protein, 20 aa, Mycobacterium
LGSALARLEGRIALEEILKR

SEQ ID NO: 1243300 - protein, 25 aa, Mycobacterium
LGSDWPRLVAPAFDGRKAVVFDDRW

SEQ ID NO: 1243301 - protein, 19 aa, Mycobacterium
LGSRNPLLLARQVGSVANL

SEQ ID NO: 1243302 - protein, 34 aa, Mycobacterium
LGSTGVWELFWPDFPVDGLYKFRIHGADGVVSER

SEQ ID NO: 1243303 - protein, 24 aa, Mycobacterium
LGSVMPMRVVGMLFGIPEDYQKLV

SEQ ID NO: 1243304 - protein, 25 aa, Mycobacterium
LGTAPPFLVHRIWLDRPVAPDRPAF

SEQ ID NO: 1243305 - protein, 17 aa, Mycobacterium
LGTEADWDRILDVNLRA

SEQ ID NO: 1243306 - protein, 18 aa, Mycobacterium
LGTEIGFDAASLVALSTP

SEQ ID NO: 1243307 - protein, 18 aa, Mycobacterium
LGTLKRVDVVLRRVDADY

SEQ ID NO: 1243308 - protein, 25 aa, Mycobacterium
LGTSCPDHFLRTKVKPLVLDLPADT

SEQ ID NO: 1243309 - protein, 17 aa, Mycobacterium
LGVAESTALLALLQNRV

SEQ ID NO: 1243310 - protein, 20 aa, Mycobacterium
LGVAHCLYAGLTTDTGSFRW

SEQ ID NO: 1243311 - protein, 18 aa, Mycobacterium
LGVARAAYEYALDYACQR

SEQ ID NO: 1243312 - protein, 24 aa, Mycobacterium
LGVAYRAIMNPVLRVRRGPAGELL

SEQ ID NO: 1243313 - protein, 18 aa, Mycobacterium
LGVDGWYRTGDVAVVDGV

SEQ ID NO: 1243314 - protein, 19 aa, Mycobacterium
LGVGDRAGAVATALREGIY

SEQ ID NO: 1243315 - protein, 19 aa, Mycobacterium
LGVHRCIGSNVARTVFKSM

SEQ ID NO: 1243316 - protein, 27 aa, Mycobacterium
LGVLQDLYRRWPFFRTVLSNMAQVLAK

SEQ ID NO: 1243317 - protein, 24 aa, Mycobacterium
LGVSDRGLPIGMMFASTVGREARL

SEQ ID NO: 1243318 - protein, 18 aa, Mycobacterium
LGVSHLYLSPILTAVEGS

SEQ ID NO: 1243319 - protein, 24 aa, Mycobacterium
LGVSRPAIREALKRLAGAGLIEVR

SEQ ID NO: 1243320 - protein, 25 aa, Mycobacterium
LGWLAQRGYVPLGYKGDAAKTARTF

SEQ ID NO: 1243321 - protein, 19 aa, Mycobacterium
LGWLKYTIDTELRMSEIAE

SEQ ID NO: 1243322 - protein, 26 aa, Mycobacterium
LGWVEYEPFGTVLIIGAWNFPFALTL

SEQ ID NO: 1243323 - protein, 18 aa, Mycobacterium
LGYPHVLAGQRLCIYLDP

SEQ ID NO: 1243324 - protein, 17 aa, Mycobacterium
LGYSGLVAPLTFTSAPG

SEQ ID NO: 1243325 - protein, 24 aa, Mycobacterium
LGYTRYWIAEHHNMPAVAATSPPV

SEQ ID NO: 1243326 - protein, 23 aa, Mycobacterium
LHAAKGLEWDAVYLVGLADGTLP

SEQ ID NO: 1243327 - protein, 19 aa, Mycobacterium
LHAGLARFPHVEVRWGHRM

SEQ ID NO: 1243328 - protein, 20 aa, Mycobacterium
LHAHVLLQRDVHYIVRDDAV

SEQ ID NO: 1243329 - protein, 25 aa, Mycobacterium
LHALVEIRSAAGLPAELRRVDTAMA

SEQ ID NO: 1243330 - protein, 25 aa, Mycobacterium
LHAPSIRKDAVFRNSFGASVIGWIS

SEQ ID NO: 1243331 - protein, 20 aa, Mycobacterium
LHAWMTLPAAERIAEIRDTG

SEQ ID NO: 1243332 - protein, 18 aa, Mycobacterium
LHDLRHVRESEIDALQLA

SEQ ID NO: 1243333 - protein, 19 aa, Mycobacterium
LHDPARWKYVHLGNHTLRG

SEQ ID NO: 1243334 - protein, 24 aa, Mycobacterium
LHELFPPGELDWMVLFSSCGYLAG

SEQ ID NO: 1243335 - protein, 30 aa, Mycobacterium
LHGEPSWSFLYRKMIPILAGAGFRVVCPDL

SEQ ID NO: 1243336 - protein, 17 aa, Mycobacterium
LHGGYGYMLEYRVARAY

SEQ ID NO: 1243337 - protein, 17 aa, Mycobacterium
LHHLASFSRLILTDLLG

SEQ ID NO: 1243338 - protein, 17 aa, Mycobacterium
LHIPRTTWYDDVRFEEV

SEQ ID NO: 1243339 - protein, 19 aa, Mycobacterium
LHLTMPISLREEGDELGGN

SEQ ID NO: 1243340 - protein, 18 aa, Mycobacterium
LHLYWRRATALAASLGPA

SEQ ID NO: 1243341 - protein, 23 aa, Mycobacterium
LHMHVVPRWGGDANFITIIGGSK

SEQ ID NO: 1243342 - protein, 25 aa, Mycobacterium
LHMRPSQRRKQAWLRDLARLEPDLV

SEQ ID NO: 1243343 - protein, 24 aa, Mycobacterium
LHMSRPALYKRLAAIGRTLGVDLD

SEQ ID NO: 1243344 - protein, 20 aa, Mycobacterium
LHNSQPWRWIVGETVVDLFA

SEQ ID NO: 1243345 - protein, 22 aa, Mycobacterium
LHPATEEFLRFFTPAPGDGRTF

SEQ ID NO: 1243346 - protein, 30 aa, Mycobacterium
LHPDVAGPYSWWSWRGRAFDNDAGWRIDYQ

SEQ ID NO: 1243347 - protein, 21 aa, Mycobacterium
LHPEYRTMPMVWYIPPLSPIV

SEQ ID NO: 1243348 - protein, 21 aa, Mycobacterium
LHPPARHRITALCGFSDLDAL

SEQ ID NO: 1243349 - protein, 21 aa, Mycobacterium
LHPRALAAYRRAEGKLPSDAP

SEQ ID NO: 1243350 - protein, 29 aa, Mycobacterium
LHPSIAKLVAGLGLRLPIVATGYGTFETA

SEQ ID NO: 1243351 - protein, 17 aa, Mycobacterium
LHPVSTVLAGLVDAEEP

SEQ ID NO: 1243352 - protein, 33 aa, Mycobacterium; identical to SEQ ID NO: 81998

SEQ ID NO: 1243353 - protein, 18 aa, Mycobacterium
LHRGRKQLRELLADVARD

SEQ ID NO: 1243354 - protein, 21 aa, Mycobacterium
LHRHVSVLIAAVMGLPSPESL

SEQ ID NO: 1243355 - protein, 18 aa, Mycobacterium
LHRLFGRVVNLTFKMLPE

SEQ ID NO: 1243356 - protein, 20 aa, Mycobacterium
LHRQIKFVAVTEVVHRRIVA

SEQ ID NO: 1243357 - protein, 19 aa, Mycobacterium
LHTPLPVLAFTALPEVRSQ

SEQ ID NO: 1243358 - protein, 17 aa, Mycobacterium
LHTRLRGLIGHGVVAVR

SEQ ID NO: 1243359 - protein, 18 aa, Mycobacterium
LHTVHRLLVARAFTPRKM

SEQ ID NO: 1243360 - protein, 24 aa, Mycobacterium
LHTVWPGEAYPLGATYDGAGTNFS

SEQ ID NO: 1243361 - protein, 18 aa, Mycobacterium
LHVTLRKAFGFGSMVMSL

SEQ ID NO: 1243362 - protein, 19 aa, Mycobacterium
LIADAGLRIEKWRSTADLP

SEQ ID NO: 1243363 - protein, 27 aa, Mycobacterium
LIAEHSVTVLHWMPGWLEMLLEVGGAL

SEQ ID NO: 1243364 - protein, 19 aa, Mycobacterium
LIAGPGVYICDECIDLCNE

SEQ ID NO: 1243365 - protein, 23 aa, Mycobacterium
LIAGQRGGSIVFTSSTAGLRGFG

SEQ ID NO: 1243366 - protein, 18 aa, Mycobacterium
LIAGVPVVPVPADVGVAE

SEQ ID NO: 1243367 - protein, 18 aa, Mycobacterium
LIAMPALNLDVALVHLNV

SEQ ID NO: 1243368 - protein, 18 aa, Mycobacterium
LIAPLRIALREAGVPVLL

SEQ ID NO: 1243369 - protein, 21 aa, Mycobacterium
LIARRVREARVFSEVVPHTAT

SEQ ID NO: 1243370 - protein, 18 aa, Mycobacterium
LIATMAPGGIVFALSNPD

SEQ ID NO: 1243371 - protein, 19 aa, Mycobacterium
LIDAARPFIFDTGLAPAAV

SEQ ID NO: 1243372 - protein, 17 aa, Mycobacterium
LIDEARTPLIISGPADA

SEQ ID NO: 1243373 - protein, 24 aa, Mycobacterium
LIDNRTGAALGWSAKLDGTYWRRH

SEQ ID NO: 1243374 - protein, 20 aa, Mycobacterium
LIEPYCSGLHNHSRGQERSD

SEQ ID NO: 1243375 - protein, 20 aa, Mycobacterium
LIERLQRPTLLMAPNKTLAA

SEQ ID NO: 1243376 - protein, 18 aa, Mycobacterium
LIESLNVFQGKRVSPGDG

SEQ ID NO: 1243377 - protein, 18 aa, Mycobacterium
LIGMLNLLIGGGFDTTTA

SEQ ID NO: 1243378 - protein, 18 aa, Mycobacterium
LIGSLAITEPGGGSDVGH

SEQ ID NO: 1243379 - protein, 19 aa, Mycobacterium
LIHRSRGKVGWVLGTVALA

SEQ ID NO: 1243380 - protein, 23 aa, Mycobacterium
LIKDGDRIAGAFGYWRESGSFIL

SEQ ID NO: 1243381 - protein, 18 aa, Mycobacterium
LIKGVCAPLVSGRSAVLM

SEQ ID NO: 1243382 - protein, 18 aa, Mycobacterium
LIKNIEVAARTGGGDPGG

SEQ ID NO: 1243383 - protein, 26 aa, Mycobacterium
LILAASRLPANLGLDLKAMIAANNHA

SEQ ID NO: 1243384 - protein, 23 aa, Mycobacterium
LIMDSLRYWVLEMHVDGFRFDLA

SEQ ID NO: 1243385 - protein, 24 aa, Mycobacterium
LINRYPTVCGMTGTALAAGEQLRQ

SEQ ID NO: 1243386 - protein, 22 aa, Mycobacterium
LIPDARAGCSLADSITADQLRE

SEQ ID NO: 1243387 - protein, 30 aa, Mycobacterium
LIPGDGGTWFLPRAVGYARAAEMTLTGDRI

SEQ ID NO: 1243388 - protein, 23 aa, Mycobacterium
LIPRAHRGIVAVNELPDLAERIQ

SEQ ID NO: 1243389 - protein, 23 aa, Mycobacterium
LIPRARAKISMRVAPGGDAKAHL

SEQ ID NO: 1243390 - protein, 18 aa, Mycobacterium
LIPREFGGHGGHWSTGLR

SEQ ID NO: 1243391 - protein, 19 aa, Mycobacterium
LIPRLPLPTKIVIEVQEPI

SEQ ID NO: 1243392 - protein, 27 aa, Mycobacterium
LIQARGLVDVVIPRGGAGLIDAVVRDA

SEQ ID NO: 1243393 - protein, 19 aa, Mycobacterium
LIQRCENHGISVQREDAFT

SEQ ID NO: 1243394 - protein, 19 aa, Mycobacterium
LIQRGTLRVGDSIVAGDAY

SEQ ID NO: 1243395 - protein, 19 aa, Mycobacterium
LIRDPHVETSAFARTLATD

SEQ ID NO: 1243396 - protein, 22 aa, Mycobacterium
LIREAKSPILLVGHGVHTSRTQ

SEQ ID NO: 1243397 - protein, 19 aa, Mycobacterium
LIRGALRPAGLFLNEVQGY

SEQ ID NO: 1243398 - protein, 20 aa, Mycobacterium
LIRHGETEWSRSGRHTSRTD

SEQ ID NO: 1243399 - protein, 20 aa, Mycobacterium
LIRIEGRPVGVLANDTRFMA

SEQ ID NO: 1243400 - protein, 19 aa, Mycobacterium
LISSAFTPRNVRRIEQQIH

SEQ ID NO: 1243401 - protein, 17 aa, Mycobacterium
LITAHSATVDWLTTVLA

SEQ ID NO: 1243402 - protein, 19 aa, Mycobacterium
LITVLGCAFATSTERGDEM

SEQ ID NO: 1243403 - protein, 18 aa, Mycobacterium
LIVDPYFRDAIENAIDSW

SEQ ID NO: 1243404 - protein, 18 aa, Mycobacterium
LIVNRPQMQPAYNASKAA

SEQ ID NO: 1243405 - protein, 19 aa, Mycobacterium
LIVRRQLELTLAHGHTSSS

SEQ ID NO: 1243406 - protein, 26 aa, Mycobacterium
LIYPRETLWRPPVLTMSALHGDGLRE

SEQ ID NO: 1243407 - protein, 26 aa, Mycobacterium
LIYYHFRSKFDIFLAVYQDGMRRVRE

SEQ ID NO: 1243408 - protein, 19 aa, Mycobacterium
LKAGPAVALRKTKQAINAA

SEQ ID NO: 1243409 - protein, 17 aa, Mycobacterium
LKALGVRTIVASDFSAT

SEQ ID NO: 1243410 - protein, 19 aa, Mycobacterium
LKAYHHWGDRFVDRLYGMF

SEQ ID NO: 1243411 - protein, 25 aa, Mycobacterium
LKEAIRRFGPIFAQYYGQSEAPMVI

SEQ ID NO: 1243412 - protein, 19 aa, Mycobacterium
LKEEVFGPVAPITGFDSEE

SEQ ID NO: 1243413 - protein, 19 aa, Mycobacterium
LKEFMVRNTYIYPPKASMR

SEQ ID NO: 1243414 - protein, 25 aa, Mycobacterium
LKEGDNVFVALSWSKHPAPQNYEEA

SEQ ID NO: 1243415 - protein, 17 aa, Mycobacterium
LKEILREVVPADAGVII

SEQ ID NO: 1243416 - protein, 18 aa, Mycobacterium
LKELIPRQQFEVPVQAAV

SEQ ID NO: 1243417 - protein, 23 aa, Mycobacterium
LKELNVMGAIQLFAACQKAPAVR

SEQ ID NO: 1243418 - protein, 21 aa, Mycobacterium
LKENIKRQWWRSVVTGRDDVV

SEQ ID NO: 1243419 - protein, 19 aa, Mycobacterium
LKEWMCPHPTRVVDVQLDA

SEQ ID NO: 1243420 - protein, 18 aa, Mycobacterium
LKFVTTVYVPAMRDPYSA

SEQ ID NO: 1243421 - protein, 21 aa, Mycobacterium
LKGLAELLERVSVPVHVNSHE

SEQ ID NO: 1243422 - protein, 20 aa, Mycobacterium
LKGTFLMCQAVGRRMLADGG

SEQ ID NO: 1243423 - protein, 26 aa, Mycobacterium
LKHPWKRARTTFSYLAVALFGNDADR

SEQ ID NO: 1243424 - protein, 29 aa, Mycobacterium
LKHRLARSLFLYGLCNGWICEGTTVIEAS

SEQ ID NO: 1243425 - protein, 21 aa, Mycobacterium
LKIETRRAFEHLPQLLLTAMR

SEQ ID NO: 1243426 - protein, 19 aa, Mycobacterium
LKITGDWQKFKGLPGAEGT

SEQ ID NO: 1243427 - protein, 21 aa, Mycobacterium
LKKVDAVIVPGGFSYGDYLRA

SEQ ID NO: 1243428 - protein, 21 aa, Mycobacterium
LKLAAELGVVGVLAVELFETV

SEQ ID NO: 1243429 - protein, 22 aa, Mycobacterium
LKLAEVCHRLGVTTGSFYHYFA

SEQ ID NO: 1243430 - protein, 17 aa, Mycobacterium
LKLKELAYMHAEGFAAG

SEQ ID NO: 1243431 - protein, 19 aa, Mycobacterium
LKLLQSMSAGAEHLVNIMP

SEQ ID NO: 1243432 - protein, 20 aa, Mycobacterium
LKLRPDIPVVGSRFTLALVR

SEQ ID NO: 1243433 - protein, 30 aa, Mycobacterium
LKLVEQFRYPLGLRRWEFPQGTAPGRADME

SEQ ID NO: 1243434 - protein, 24 aa, Mycobacterium
LKLVGKLPAAVGIQIPVNSEPRTG

SEQ ID NO: 1243435 - protein, 19 aa, Mycobacterium
LKNKIALMCDVDIDGVIST

SEQ ID NO: 1243436 - protein, 17 aa, Mycobacterium
LKPAEFYQENDITVLLG

SEQ ID NO: 1243437 - protein, 19 aa, Mycobacterium
LKPARSYCMAYKVPGTITR

SEQ ID NO: 1243438 - protein, 17 aa, Mycobacterium
LKPASVALHVRNASTDD

SEQ ID NO: 1243439 - protein, 19 aa, Mycobacterium
LKPRKAFGPIRVAATGASV

SEQ ID NO: 1243440 - protein, 25 aa, Mycobacterium
LKPVRCEVWEGFIFVNFDDDAEPLE

SEQ ID NO: 1243441 - protein, 18 aa, Mycobacterium
LKQDYTIVIVTHNMQQAA

SEQ ID NO: 1243442 - protein, 29 aa, Mycobacterium
LKRADPSLRIAILEARFAGFGASGRNGGW

SEQ ID NO: 1243443 - protein, 20 aa, Mycobacterium
LKSGEKIMLMFESANFDESV

SEQ ID NO: 1243444 - protein, 17 aa, Mycobacterium
LKSLGLKTFLLPLNPGK

SEQ ID NO: 1243445 - protein, 18 aa, Mycobacterium
LKSRGLAGVQLVISDAHA

SEQ ID NO: 1243446 - protein, 17 aa, Mycobacterium
LKTALMDGVERLGGRLD

SEQ ID NO: 1243447 - protein, 18 aa, Mycobacterium
LKTHCKTALVVRREGSMI

SEQ ID NO: 1243448 - protein, 19 aa, Mycobacterium
LKTPDGFGIALDAGPVRGG

SEQ ID NO: 1243449 - protein, 19 aa, Mycobacterium
LKVAVQLLFETSRPDPAAQ

SEQ ID NO: 1243450 - protein, 19 aa, Mycobacterium
LKVGIALALVDTAHDIADG

SEQ ID NO: 1243451 - protein, 18 aa, Mycobacterium
LLAALIFDRGMDRLGDTV

SEQ ID NO: 1243452 - protein, 26 aa, Mycobacterium
LLAALPERERMVLLLRFFENLTQTQI

SEQ ID NO: 1243453 - protein, 29 aa, Mycobacterium
LLAARPDPFCAMESCWLQHMESAHRDVVD

SEQ ID NO: 1243454 - protein, 17 aa, Mycobacterium
LLAATVLGPTRLAALAE

SEQ ID NO: 1243455 - protein, 25 aa, Mycobacterium
LLADRGRQALKNSPSLECEISLTFE

SEQ ID NO: 1243456 - protein, 17 aa, Mycobacterium
LLADWRTTRGLLHDALL

SEQ ID NO: 1243457 - protein, 17 aa, Mycobacterium
LLAGLGFAPEARPTAGG

SEQ ID NO: 1243458 - protein, 31 aa, Mycobacterium
LLAKYAIEHWTRLPVEIELASEFRYRDPVLD

SEQ ID NO: 1243459 - protein, 20 aa, Mycobacterium
LLALLPLVGVWRGEGEGRGP

SEQ ID NO: 1243460 - protein, 26 aa, Mycobacterium
LLALPWDRPLAEWAVPDVPLRDIAVG

SEQ ID NO: 1243461 - protein, 24 aa, Mycobacterium
LLARFASVRLVEPVEWARSNRHTG

SEQ ID NO: 1243462 - protein, 25 aa, Mycobacterium
LLASLRPELTCLLQPLGGEYAGTRE

SEQ ID NO: 1243463 - protein, 18 aa, Mycobacterium
LLCYRRRGHNEGDDPSMT

SEQ ID NO: 1243464 - protein, 17 aa, Mycobacterium
LLDAEGLFDPRLKRPIP

SEQ ID NO: 1243465 - protein, 18 aa, Mycobacterium
LLDAFGRYERAMFDRGIS

SEQ ID NO: 1243466 - protein, 25 aa, Mycobacterium
LLDGYRLTFSLLRVAVDAYVWGDKD

SEQ ID NO: 1243467 - protein, 25 aa, Mycobacterium
LLDIKRIYHEPGIERFPRARAVLER

SEQ ID NO: 1243468 - protein, 18 aa, Mycobacterium
LLDLRADLAAGRGTVEIT

SEQ ID NO: 1243469 - protein, 18 aa, Mycobacterium
LLDLYKRVIDGVGELGFP

SEQ ID NO: 1243470 - protein, 17 aa, Mycobacterium
LLDNGIDPLRFPGSLHA

SEQ ID NO: 1243471 - protein, 24 aa, Mycobacterium
LLDNRIISCFSMTEPHGGADPKVF

SEQ ID NO: 1243472 - protein, 20 aa, Mycobacterium
LLDRCVELLTPALTRRNPDG

SEQ ID NO: 1243473 - protein, 18 aa, Mycobacterium
LLDRVRALTNAWHADGVR

SEQ ID NO: 1243474 - protein, 25 aa, Mycobacterium
LLDVGCGWGAMMKRAVEKYDVNVIG

SEQ ID NO: 1243475 - protein, 22 aa, Mycobacterium
LLDVGCGWGATINRALEKYDVN

SEQ ID NO: 1243476 - protein, 24 aa, Mycobacterium
LLDVGCGWGSTMMRAIERHDVDVI

SEQ ID NO: 1243477 - protein, 22 aa, Mycobacterium
LLEAGADFAALFNGVLEGFPTP

SEQ ID NO: 1243478 - protein, 20 aa, Mycobacterium
LLEAHGWDLGFWTVLDEGPV

SEQ ID NO: 1243479 - protein, 17 aa, Mycobacterium
LLEFPGGVLGVALNLDE

SEQ ID NO: 1243480 - protein, 21 aa, Mycobacterium
LLELLPQITLINGYGSSETGN

SEQ ID NO: 1243481 - protein, 23 aa, Mycobacterium
LLEPARAAYEWCRITQRPDGSWP

SEQ ID NO: 1243482 - protein, 19 aa, Mycobacterium
LLERFPVPVLAIAEDGAIL

SEQ ID NO: 1243483 - protein, 20 aa, Mycobacterium
LLERIKELGLQVVLATSAPE

SEQ ID NO: 1243484 - protein, 19 aa, Mycobacterium
LLERTLRTGQPHRVRLESA

SEQ ID NO: 1243485 - protein, 17 aa, Mycobacterium
LLERTVEGFWNREYDIL

SEQ ID NO: 1243486 - protein, 17 aa, Mycobacterium
LLESDWRAMDSRANSTD

SEQ ID NO: 1243487 - protein, 19 aa, Mycobacterium
LLETLGLTSGELAHWDDVS

SEQ ID NO: 1243488 - protein, 24 aa, Mycobacterium
LLEVEEVYLPLARLIHLQVAARQR

SEQ ID NO: 1243489 - protein, 21 aa, Mycobacterium
LLEVGCGWGMTMKRAMERYDV

SEQ ID NO: 1243490 - protein, 18 aa, Mycobacterium
LLFETGFHLDRIVPTVTH

SEQ ID NO: 1243491 - protein, 17 aa, Mycobacterium
LLGAAGFDDVSIVAEGG

SEQ ID NO: 1243492 - protein, 25 aa, Mycobacterium
LLGARRWVRMPGVHFGPDSCRFRGR

SEQ ID NO: 1243493 - protein, 17 aa, Mycobacterium
LLGGSSHALGRVNAAKR

SEQ ID NO: 1243494 - protein, 18 aa, Mycobacterium
LLGIPAQKVRVIMRDTGG

SEQ ID NO: 1243495 - protein, 18 aa, Mycobacterium
LLGIPVPNLIAGNNASLE

SEQ ID NO: 1243496 - protein, 28 aa, Mycobacterium
LLGKKCYSLRIASAMAHDEGWLAEHMLI

SEQ ID NO: 1243497 - protein, 17 aa, Mycobacterium
LLGLLPVAELPGSEHWP

SEQ ID NO: 1243498 - protein, 24 aa, Mycobacterium
LLGQLWAGFADRYGDAIAPEHRAV

SEQ ID NO: 1243499 - protein, 17 aa, Mycobacterium
LLGRGRTSGAWISEGAA

SEQ ID NO: 1243500 - protein, 18 aa, Mycobacterium
LLGSGLWAMGHTVALTSH

SEQ ID NO: 1243501 - protein, 23 aa, Mycobacterium
LLGVKPKSALLLITRVTYDSDGT

SEQ ID NO: 1243502 - protein, 19 aa, Mycobacterium
LLHDIPFRVGKVVETPADY

SEQ ID NO: 1243503 - protein, 24 aa, Mycobacterium
LLHDLWARRHMAVLHVTHDVDEAI

SEQ ID NO: 1243504 - protein, 22 aa, Mycobacterium
LLHEMMQWLVCEEVPAEYVPML

SEQ ID NO: 1243505 - protein, 26 aa, Mycobacterium
LLHPMSAPMTLRWLRDRFAGRPLSEH

SEQ ID NO: 1243506 - protein, 26 aa, Mycobacterium
LLHRVLRTERLLSFNVDYASVTRLLW

SEQ ID NO: 1243507 - protein, 21 aa, Mycobacterium
LLHYRSGGFFLARAQQVDGGL

SEQ ID NO: 1243508 - protein, 20 aa, Mycobacterium
LLIEWQRDFFDFGHVAKGYA

SEQ ID NO: 1243509 - protein, 20 aa, Mycobacterium
LLIRKSGASSAEMAAELAKH

SEQ ID NO: 1243510 - protein, 23 aa, Mycobacterium
LLKDRVADVPAFLDAVEVVGHGG

SEQ ID NO: 1243511 - protein, 18 aa, Mycobacterium
LLKPLGYATGQFGKNHLG

SEQ ID NO: 1243512 - protein, 18 aa, Mycobacterium
LLLDGARSKLTRAALETL

SEQ ID NO: 1243513 - protein, 22 aa, Mycobacterium
LLLDLQERFGLSYLFVSHDLSV

SEQ ID NO: 1243514 - protein, 19 aa, Mycobacterium
LLLGRGAKGFTVADVAARA

SEQ ID NO: 1243515 - protein, 17 aa, Mycobacterium
LLLKGPNIFAGYVTGRD

SEQ ID NO: 1243516 - protein, 17 aa, Mycobacterium
LLLMIPNMYKIAGELTS

SEQ ID NO: 1243517 - protein, 17 aa, Mycobacterium
LLLPAGVETTYRSLGSL

SEQ ID NO: 1243518 - protein, 17 aa, Mycobacterium
LLMLSGIGPTAHLREMG

SEQ ID NO: 1243519 - protein, 24 aa, Mycobacterium
LLNDPCWKQLLSLVPPMTCDPAFT

SEQ ID NO: 1243520 - protein, 18 aa, Mycobacterium
LLNERLLTIDWRTQDRPE

SEQ ID NO: 1243521 - protein, 24 aa, Mycobacterium
LLNGQKIWSSRAVFGDRAFGLFRS

SEQ ID NO: 1243522 - protein, 18 aa, Mycobacterium
LLNRSGLGAPEFASRIGV

SEQ ID NO: 1243523 - protein, 19 aa, Mycobacterium
LLPKLAAALSEPVAAEAVL

SEQ ID NO: 1243524 - protein, 20 aa, Mycobacterium
LLPLETDWYYFARLFPEEVT

SEQ ID NO: 1243525 - protein, 28 aa, Mycobacterium
LLPSGRPHLVAMWYAVLDGEIWFETKAK

SEQ ID NO: 1243526 - protein, 17 aa, Mycobacterium
LLPVGIFDSGVGGLTVA

SEQ ID NO: 1243527 - protein, 21 aa, Mycobacterium
LLQPLALAPKGIWFAPKDLRL

SEQ ID NO: 1243528 - protein, 30 aa, Mycobacterium; identical to SEQ ID NO: 693047

SEQ ID NO: 1243529 - protein, 22 aa, Mycobacterium
LLREGVTVIGGRGELVDDVPGL

SEQ ID NO: 1243530 - protein, 26 aa, Mycobacterium
LLREKRPLMAGAMLRPFFEAYEILAS

SEQ ID NO: 1243531 - protein, 21 aa, Mycobacterium
LLRETRELLATEWAKQGERSD

SEQ ID NO: 1243532 - protein, 17 aa, Mycobacterium
LLRKAGERFGFAVDSLS

SEQ ID NO: 1243533 - protein, 40 aa, Mycobacterium
LLRNHARWAVFLRHLKFIVVDECHYYRGIFGSNVALVLRR

SEQ ID NO: 1243534 - protein, 17 aa, Mycobacterium
LLRRAGVIEASRENAAD

SEQ ID NO: 1243535 - protein, 17 aa, Mycobacterium
LLSCGAVLDHLRVAMAA

SEQ ID NO: 1243536 - protein, 18 aa, Mycobacterium
LLSCRALHEGAREALQIA

SEQ ID NO: 1243537 - protein, 18 aa, Mycobacterium
LLSLSMSVPGGFAALEST

SEQ ID NO: 1243538 - protein, 20 aa, Mycobacterium
LLSPQGGYRADRRLAERDDV

SEQ ID NO: 1243539 - protein, 18 aa, Mycobacterium
LLSTAMRVMGERPDIQQV

SEQ ID NO: 1243540 - protein, 18 aa, Mycobacterium
LLTAIRLAGHFDVVGVSA

SEQ ID NO: 1243541 - protein, 18 aa, Mycobacterium
LLTDGAMERLRRLDRPLR

SEQ ID NO: 1243542 - protein, 17 aa, Mycobacterium
LLTDPWQPAVLALVAMT

SEQ ID NO: 1243543 - protein, 17 aa, Mycobacterium
LLTFQLFDQQANVPLGI

SEQ ID NO: 1243544 - protein, 23 aa, Mycobacterium
LLTIKLRLVIASLDTAREVGIDW

SEQ ID NO: 1243545 - protein, 21 aa, Mycobacterium
LLTLAAARTVTAWRRRRGQPT

SEQ ID NO: 1243546 - protein, 30 aa, Mycobacterium
LLTPGVHLVKGFYRRPLKVSGREDANGGGR

SEQ ID NO: 1243547 - protein, 23 aa, Mycobacterium
LLTRPEQRVVLLGGDHTIALPAL

SEQ ID NO: 1243548 - protein, 17 aa, Mycobacterium
LLTRSRLPAADDGTGPH

SEQ ID NO: 1243549 - protein, 17 aa, Mycobacterium
LLTSGKIYYELVARKNK

SEQ ID NO: 1243550 - protein, 19 aa, Mycobacterium
LLTSVPFAPGYGVEIGLVV

SEQ ID NO: 1243551 - protein, 17 aa, Mycobacterium
LLTTVCYQFGDAKPVYA

SEQ ID NO: 1243552 - protein, 18 aa, Mycobacterium
LLVCFGGLAMKNTGTNHG

SEQ ID NO: 1243553 - protein, 17 aa, Mycobacterium
LLVDARAGVLRQTNRHA

SEQ ID NO: 1243554 - protein, 18 aa, Mycobacterium
LLVRGIGVMAGYNKRERA

SEQ ID NO: 1243555 - protein, 20 aa, Mycobacterium
LLWEPADLYPPAVLTGITNS

SEQ ID NO: 1243556 - protein, 18 aa, Mycobacterium
LLYCGEWIHSHALHIYLL

SEQ ID NO: 1243557 - protein, 17 aa, Mycobacterium
LLYEALGLCGEGEAPKL

SEQ ID NO: 1243558 - protein, 24 aa, Mycobacterium
LMAAGLPRVVRWLPPVSTLFDPTA

SEQ ID NO: 1243559 - protein, 17 aa, Mycobacterium
LMDAFRSADEVLLNGVQ

SEQ ID NO: 1243560 - protein, 24 aa, Mycobacterium
LMDCGERWAVFTAGMGVDGDVVAA

SEQ ID NO: 1243561 - protein, 18 aa, Mycobacterium
LMETRPSALVAIAALSRL

SEQ ID NO: 1243562 - protein, 26 aa, Mycobacterium
LMFADLPPDFGIRFADLVSARAKRIP

SEQ ID NO: 1243563 - protein, 20 aa, Mycobacterium
LMHAAGMWTAFAALLNGQTV

SEQ ID NO: 1243564 - protein, 18 aa, Mycobacterium
LMHRLGRIPPAEAEARYY

SEQ ID NO: 1243565 - protein, 35 aa, Mycobacterium
LMLVYRVDAVAAFELLKWRAAEAGVKLRTFAERLL

SEQ ID NO: 1243566 - protein, 21 aa, Mycobacterium
LMPCFAELYEDLGITKADIGF

SEQ ID NO: 1243567 - protein, 19 aa, Mycobacterium
LMPVNAFGGTHGWGYDGVL

SEQ ID NO: 1243568 - protein, 24 aa, Mycobacterium
LMRGEVMVDVTFSWFDTGNLERER

SEQ ID NO: 1243569 - protein, 17 aa, Mycobacterium
LMRKNGWQGVRRQKRVR

SEQ ID NO: 1243570 - protein, 17 aa, Mycobacterium
LMSLPSRVTRQIRRLEM

SEQ ID NO: 1243571 - protein, 18 aa, Mycobacterium
LMTDEIFGPILPIVTVQS

SEQ ID NO: 1243572 - protein, 18 aa, Mycobacterium
LMVVPGPHDDWFVDPEFL

SEQ ID NO: 1243573 - protein, 20 aa, Mycobacterium
LMWLDEKFASYVIDRRREPR

SEQ ID NO: 1243574 - protein, 21 aa, Mycobacterium
LMWRAHLGTFGYHLEQNRAFA

SEQ ID NO: 1243575 - protein, 24 aa, Mycobacterium
LNAGRRVALLVGRGAAGAADEIAR

SEQ ID NO: 1243576 - protein, 22 aa, Mycobacterium
LNALLWTVQRIPVFDAVRPVWT

SEQ ID NO: 1243577 - protein, 24 aa, Mycobacterium
LNARADECWSQIQVLMTRRGAIQT

SEQ ID NO: 1243578 - protein, 23 aa, Mycobacterium
LNCKVLLEIGPRPVLTAAALSAW

SEQ ID NO: 1243579 - protein, 20 aa, Mycobacterium
LNDFPLFWEPSLLKQDIHAP

SEQ ID NO: 1243580 - protein, 17 aa, Mycobacterium
LNDLPAIVDALGSLIPE

SEQ ID NO: 1243581 - protein, 23 aa, Mycobacterium
LNEAFASVVLKFQKDLNIPDEKL

SEQ ID NO: 1243582 - protein, 22 aa, Mycobacterium
LNFEFRCRESWAKVKELADSGA

SEQ ID NO: 1243583 - protein, 17 aa, Mycobacterium
LNFSPVIVHENWIADWA

SEQ ID NO: 1243584 - protein, 17 aa, Mycobacterium
LNFTRLTPHAGPCASQF

SEQ ID NO: 1243585 - protein, 39 aa, Mycobacterium
LNGGEPVDCQGYRRFATEMARFGLDPSALVPAYGLAESS

SEQ ID NO: 1243586 - protein, 25 aa, Mycobacterium
LNGMPGVLSARWAGTHGQDAANSAL

SEQ ID NO: 1243587 - protein, 20 aa, Mycobacterium
LNGYLLPLLGTDGRGGLTAR

SEQ ID NO: 1243588 - protein, 19 aa, Mycobacterium
LNKPHGWIHNELRRICGGP

SEQ ID NO: 1243589 - protein, 27 aa, Mycobacterium
LNLALLWASAFPYGPTFADRITRGDYI

SEQ ID NO: 1243590 - protein, 17 aa, Mycobacterium
LNLFLFTMLQKTLKGNI

SEQ ID NO: 1243591 - protein, 20 aa, Mycobacterium
LNLMTTKPFLYVFNADESVL

SEQ ID NO: 1243592 - protein, 23 aa, Mycobacterium
LNLSIRDGWWDEWFDGENGWEIP

SEQ ID NO: 1243593 - protein, 20 aa, Mycobacterium
LNLTYPQYLVLLVLWEEGPV

SEQ ID NO: 1243594 - protein, 18 aa, Mycobacterium
LNLYPYNPGHLMVVPYRR

SEQ ID NO: 1243595 - protein, 33 aa, Mycobacterium
LNPLDWYTGNGIDLRAGVRVVRIDRYARLVHAD

SEQ ID NO: 1243596 - protein, 18 aa, Mycobacterium
LNPLLPILTGAIYLLDGH

SEQ ID NO: 1243597 - protein, 24 aa, Mycobacterium
LNQGEVCTCPSRSLVQADIYDEFL

SEQ ID NO: 1243598 - protein, 17 aa, Mycobacterium
LNQYPHLLALSASSPYW

SEQ ID NO: 1243599 - protein, 22 aa, Mycobacterium
LNRNKRSVCLDLQSADGQRRLG

SEQ ID NO: 1243600 - protein, 20 aa, Mycobacterium
LNRPEVLMIIGAGQTQGYRR

SEQ ID NO: 1243601 - protein, 25 aa, Mycobacterium
LNRRQCLDLLEGVRVGRLVFTEDGL

SEQ ID NO: 1243602 - protein, 27 aa, Mycobacterium
LNSELNRWETIKKWAILDHDLSIENNE

SEQ ID NO: 1243603 - protein, 24 aa, Mycobacterium
LNSPAADFFIKWMSRGNTLVYKLS

SEQ ID NO: 1243604 - protein, 25 aa, Mycobacterium
LNSVGGFRNAMTFVLTGLDIEAKAD

SEQ ID NO: 1243605 - protein, 23 aa, Mycobacterium
LNTAVWSGGSFIYVPPGVHVDIP

SEQ ID NO: 1243606 - protein, 19 aa, Mycobacterium
LNVGCIPTKMFVYSAGIAQ

SEQ ID NO: 1243607 - protein, 17 aa, Mycobacterium
LNVLANIVGKPYSQIFS

SEQ ID NO: 1243608 - protein, 26 aa, Mycobacterium
LNVLQRPRVGTVFVIPGRGDTLRING

SEQ ID NO: 1243609 - protein, 23 aa, Mycobacterium
LNVRSTVHLARLVLGDMVDRGSG

SEQ ID NO: 1243610 - protein, 28 aa, Mycobacterium
LPAELIGPALEDWAKWGQARHDYFLRAA

SEQ ID NO: 1243611 - protein, 40 aa, Mycobacterium
LPALDVNGVFEFYTGVLGFRSRGAFRVPVPPEFGPVRVRF

SEQ ID NO: 1243612 - protein, 25 aa, Mycobacterium
LPAPPMPTVRLKPRLSPPAGGDPSA

SEQ ID NO: 1243613 - protein, 17 aa, Mycobacterium
LPAPVFMAPIGVIGICA

SEQ ID NO: 1243614 - protein, 17 aa, Mycobacterium
LPAVRRAGLVHQPDFDT

SEQ ID NO: 1243615 - protein, 25 aa, Mycobacterium
LPCSMRPRSDLVLQIASSSKVAKTA

SEQ ID NO: 1243616 - protein, 18 aa, Mycobacterium
LPDAVMRAAVDAARHLAR

SEQ ID NO: 1243617 - protein, 17 aa, Mycobacterium
LPDDRLDDLLALAHEVR

SEQ ID NO: 1243618 - protein, 21 aa, Mycobacterium
LPDGALMRRAALGLATAIARE

SEQ ID NO: 1243619 - protein, 18 aa, Mycobacterium
LPDGGAWLYAETVREIKR

SEQ ID NO: 1243620 - protein, 18 aa, Mycobacterium
LPDGTPFPTLYYLTHPVL

SEQ ID NO: 1243621 - protein, 25 aa, Mycobacterium
LPDLDARLALTPAVVSALCDRRRGL

SEQ ID NO: 1243622 - protein, 23 aa, Mycobacterium
LPDNELRRIAALCAAFDVDGMRA

SEQ ID NO: 1243623 - protein, 21 aa, Mycobacterium
LPDRYARGWHCLGPVNDYLDG

SEQ ID NO: 1243624 - protein, 20 aa, Mycobacterium
LPEADRVADRYAYRRADILD

SEQ ID NO: 1243625 - protein, 17 aa, Mycobacterium
LPEAQLDRFAIRLELRY

SEQ ID NO: 1243626 - protein, 24 aa, Mycobacterium
LPEFHELLCAAAADGHAAQDSATE

SEQ ID NO: 1243627 - protein, 18 aa, Mycobacterium
LPEGFTMSVKAHRGLTHF

SEQ ID NO: 1243628 - protein, 25 aa, Mycobacterium
LPEKPAYTAVRWKAILQAMSQYQMA

SEQ ID NO: 1243629 - protein, 18 aa, Mycobacterium
LPELVCRLNHAFLAGALD

SEQ ID NO: 1243630 - protein, 22 aa, Mycobacterium
LPEPLPAKMLFISAGSGITPII

SEQ ID NO: 1243631 - protein, 22 aa, Mycobacterium
LPEPRYPTGYLNEFGGHFQITQ

SEQ ID NO: 1243632 - protein, 28 aa, Mycobacterium
LPESECWRLLDSVALGRLVTCAGGQPEI

SEQ ID NO: 1243633 - protein, 24 aa, Mycobacterium
LPFPPEPLASIGINATRWSLDRAD

SEQ ID NO: 1243634 - protein, 20 aa, Mycobacterium
LPFVELNAAFYPPRPPDEKV

SEQ ID NO: 1243635 - protein, 25 aa, Mycobacterium
LPFYHDMGLVLGICVPILSGHPAAL

SEQ ID NO: 1243636 - protein, 18 aa, Mycobacterium
LPGEVADKFHATFDALLH

SEQ ID NO: 1243637 - protein, 20 aa, Mycobacterium
LPGFTWDHCVADPASTAANK

SEQ ID NO: 1243638 - protein, 24 aa, Mycobacterium
LPGGFPATFIAYRDWLVAELQSIG

SEQ ID NO: 1243639 - protein, 20 aa, Mycobacterium
LPGHGRGRRAHPFTIADLAA

SEQ ID NO: 1243640 - protein, 23 aa, Mycobacterium
LPGIEAWTGIGTSLCGIANRVSH

SEQ ID NO: 1243641 - protein, 19 aa, Mycobacterium
LPGLPKIAVHWPLIDFECG

SEQ ID NO: 1243642 - protein, 18 aa, Mycobacterium
LPGLRALQKYAVRVGGGV

SEQ ID NO: 1243643 - protein, 28 aa, Mycobacterium
LPGLSPAWRQAFGEARSRLEGQGAAVRE

SEQ ID NO: 1243644 - protein, 21 aa, Mycobacterium
LPGNAHFTFRGCEGDSLLMLL

SEQ ID NO: 1243645 - protein, 19 aa, Mycobacterium
LPGPDGWQVVGAAVRRPGG

SEQ ID NO: 1243646 - protein, 17 aa, Mycobacterium
LPGPELYPSLLNDPSIQ

SEQ ID NO: 1243647 - protein, 23 aa, Mycobacterium
LPGPSLTVLPLILLRNPGRADGG

SEQ ID NO: 1243648 - protein, 20 aa, Mycobacterium
LPGPTGSAVPTGWRSARTGV

SEQ ID NO: 1243649 - protein, 19 aa, Mycobacterium
LPGRFVYEDDEIVAFLTIA

SEQ ID NO: 1243650 - protein, 19 aa, Mycobacterium
LPGSIVIAGAGAIGMEFGY

SEQ ID NO: 1243651 - protein, 18 aa, Mycobacterium
LPGTQWVHRRHWRTPAAP

SEQ ID NO: 1243652 - protein, 26 aa, Mycobacterium
LPGVLSGRLRLCLGYTEPEGGSDVAT

SEQ ID NO: 1243653 - protein, 26 aa, Mycobacterium
LPHDRIPVLYCKTGVRSAEALAAVKK

SEQ ID NO: 1243654 - protein, 21 aa, Mycobacterium
LPHIPVRLHARSWHRYAEPHP

SEQ ID NO: 1243655 - protein, 19 aa, Mycobacterium
LPIVKGYGSERSWVVLGTE

SEQ ID NO: 1243656 - protein, 21 aa, Mycobacterium
LPKPGDWKKYQILDQSFIIVR

SEQ ID NO: 1243657 - protein, 18 aa, Mycobacterium
LPKREMLTALTGVVRSQI

SEQ ID NO: 1243658 - protein, 19 aa, Mycobacterium
LPKVMSFAVEDVFVSAIFS

SEQ ID NO: 1243659 - protein, 22 aa, Mycobacterium
LPLHPGFAASWDRLRTVTAAFP

SEQ ID NO: 1243660 - protein, 29 aa, Mycobacterium
LPLLIQRAAVPFRRIVDWAESRRAAEREA

SEQ ID NO: 1243661 - protein, 24 aa, Mycobacterium
LPLMADDVPIDWAGDIYCIVLHIC

SEQ ID NO: 1243662 - protein, 18 aa, Mycobacterium
LPLMFEPYDRKALRTRAI

SEQ ID NO: 1243663 - protein, 20 aa, Mycobacterium
LPLPEERVSLMFDIGTPDVE

SEQ ID NO: 1243664 - protein, 18 aa, Mycobacterium
LPLVCTLNGAPVLAATAG

SEQ ID NO: 1243665 - protein, 21 aa, Mycobacterium
LPMAAAPAWESFEQWMRTRLE

SEQ ID NO: 1243666 - protein, 24 aa, Mycobacterium
LPMADEGLRRWGVAAEVRDRYLGV

SEQ ID NO: 1243667 - protein, 19 aa, Mycobacterium
LPMALTLFRRDLDVWAPGE

SEQ ID NO: 1243668 - protein, 18 aa, Mycobacterium
LPNLRALNVVVHGLLGDG

SEQ ID NO: 1243669 - protein, 20 aa, Mycobacterium
LPNMRTVLHCLPPRDWTEPG

SEQ ID NO: 1243670 - protein, 22 aa, Mycobacterium
LPNYRNSWLRQGFDESDLVRGG

SEQ ID NO: 1243671 - protein, 23 aa, Mycobacterium
LPPELRLAQPVTEERDEDGRVRT

SEQ ID NO: 1243672 - protein, 22 aa, Mycobacterium
LPPGHDGLGWLAQRGYVPLGYK

SEQ ID NO: 1243673 - protein, 18 aa, Mycobacterium
LPPGPPVDVVVCHLFRDE

SEQ ID NO: 1243674 - protein, 18 aa, Mycobacterium
LPPHRRARVQITLADGTR

SEQ ID NO: 1243675 - protein, 18 aa, Mycobacterium
LPPRDVVHIWTVDRHSVE

SEQ ID NO: 1243676 - protein, 22 aa, Mycobacterium
LPQAHAWVAQLWTPPFASEPLR

SEQ ID NO: 1243677 - protein, 21 aa, Mycobacterium
LPQAPYLHLFVPRGEVTLEGA

SEQ ID NO: 1243678 - protein, 22 aa, Mycobacterium
LPQKVGVGMARRMSLTGDYLSA

SEQ ID NO: 1243679 - protein, 18 aa, Mycobacterium
LPQLDLFVSLDLYVNETN

SEQ ID NO: 1243680 - protein, 25 aa, Mycobacterium
LPQRARSLIGAWCFVDHYGPDDVGH

SEQ ID NO: 1243681 - protein, 20 aa, Mycobacterium
LPQVLIRVGAAPAYDPVPPP

SEQ ID NO: 1243682 - protein, 17 aa, Mycobacterium
LPRELVGEGSLFLLKVV

SEQ ID NO: 1243683 - protein, 17 aa, Mycobacterium
LPRIIGAGHAFDLILTA

SEQ ID NO: 1243684 - protein, 25 aa, Mycobacterium
LPRLKPRVFYDLVVEVALIRPGPIQ

SEQ ID NO: 1243685 - protein, 24 aa, Mycobacterium
LPRMPHGPLRAMASMQLAGIVMDR

SEQ ID NO: 1243686 - protein, 18 aa, Mycobacterium
LPRNGFRVLAGLGGVTDL

SEQ ID NO: 1243687 - protein, 25 aa, Mycobacterium
LPRVARMGFDVVYLPPIHPIGKVHR

SEQ ID NO: 1243688 - protein, 25 aa, Mycobacterium
LPRVFSGHVRLCLGYTEPEGGSDIA

SEQ ID NO: 1243689 - protein, 17 aa, Mycobacterium
LPRWSMIDKALGLNTPD

SEQ ID NO: 1243690 - protein, 20 aa, Mycobacterium
LPSDDPRIWPNLVAGQLGWD

SEQ ID NO: 1243691 - protein, 20 aa, Mycobacterium
LPSFAGRSVIVTGANSGLGL

SEQ ID NO: 1243692 - protein, 19 aa, Mycobacterium
LPSGAWFPDLHLTRDFDTR

SEQ ID NO: 1243693 - protein, 17 aa, Mycobacterium
LPSLLAEKVKAPGVTAG

SEQ ID NO: 1243694 - protein, 18 aa, Mycobacterium
LPSTAVGLVPDFEFDDDS

SEQ ID NO: 1243695 - protein, 17 aa, Mycobacterium
LPSTGRLGLVEKQAPAH

SEQ ID NO: 1243696 - protein, 19 aa, Mycobacterium
LPSVAASVVLDRCAGDDVR

SEQ ID NO: 1243697 - protein, 23 aa, Mycobacterium
LPTDRPVLVLAEGVSMYLLEQDG

SEQ ID NO: 1243698 - protein, 19 aa, Mycobacterium
LPTGAKFGSLVHAVLEHAD

SEQ ID NO: 1243699 - protein, 27 aa, Mycobacterium
LPTLLRRLVIMGGAFDYRGNTTAVAEW

SEQ ID NO: 1243700 - protein, 19 aa, Mycobacterium
LPTPAEFVGSFAEAGAQFG

SEQ ID NO: 1243701 - protein, 18 aa, Mycobacterium
LPTPAEMVAAIDWAGDFV

SEQ ID NO: 1243702 - protein, 23 aa, Mycobacterium
LPTPRPAKGQLLLEVRRCGICGS

SEQ ID NO: 1243703 - protein, 24 aa, Mycobacterium
LPTRPRATLVLRKDADHAINRLRL

SEQ ID NO: 1243704 - protein, 17 aa, Mycobacterium
LPTSLGVALGEMENSEL

SEQ ID NO: 1243705 - protein, 26 aa, Mycobacterium
LPTYPFQRRRFWPKTSSITVDGPATS

SEQ ID NO: 1243706 - protein, 23 aa, Mycobacterium
LPVAYAVVGPSFWGDGMYPPSDA

SEQ ID NO: 1243707 - protein, 17 aa, Mycobacterium
LPVIDAIATRLGAQTDG

SEQ ID NO: 1243708 - protein, 21 aa, Mycobacterium
LPVIEIADVWKLHKLGDEVVR

SEQ ID NO: 1243709 - protein, 25 aa, Mycobacterium
LPVIGSKELIAWLPTLLGAGSDDLV

SEQ ID NO: 1243710 - protein, 23 aa, Mycobacterium
LPVPGEVPISAPLATDPALGTYP

SEQ ID NO: 1243711 - protein, 23 aa, Mycobacterium
LPVPPRLGARRSWGLATQLYSVR

SEQ ID NO: 1243712 - protein, 20 aa, Mycobacterium
LPVPRSALSLVDSLRRATRY

SEQ ID NO: 1243713 - protein, 21 aa, Mycobacterium
LPVSDLLGGFTDRMRVSHMLG

SEQ ID NO: 1243714 - protein, 24 aa, Mycobacterium
LPVSVDTFAGFLFLNPDPDAEPLR

SEQ ID NO: 1243715 - protein, 17 aa, Mycobacterium
LPVTGYADLVRAVKKRV

SEQ ID NO: 1243716 - protein, 18 aa, Mycobacterium
LPVVDRVVVLGTRGEVVA

SEQ ID NO: 1243717 - protein, 18 aa, Mycobacterium
LPWDGLKLSRGEPAIPTR

SEQ ID NO: 1243718 - protein, 23 aa, Mycobacterium
LPWMAEYRREFGLVDPPADQIAA

SEQ ID NO: 1243719 - protein, 24 aa, Mycobacterium
LPYDMLHLVPPFRGVRWLEGSGLT

SEQ ID NO: 1243720 - protein, 29 aa, Mycobacterium
LPYDRALELGCGTGFFLLNLIQAGVARRG

SEQ ID NO: 1243721 - protein, 33 aa, Mycobacterium
LPYERSTCFWQRIAYLYSRFDALVEEVKRVGQA

SEQ ID NO: 1243722 - protein, 30 aa, Mycobacterium
LPYNSGRFGKQWFSVHRTIFRLAFPGGKPR

SEQ ID NO: 1243723 - protein, 24 aa, Mycobacterium
LQADNCKLISWPIATLSPNGVRTA

SEQ ID NO: 1243724 - protein, 24 aa, Mycobacterium
LQAEGRGATMIFTRTKRTAQKVAD

SEQ ID NO: 1243725 - protein, 25 aa, Mycobacterium
LQAPRITLCCLHFGGEVRELTAHWD

SEQ ID NO: 1243726 - protein, 19 aa, Mycobacterium
LQAPYDLVAEVARAGKLPV

SEQ ID NO: 1243727 - protein, 25 aa, Mycobacterium
LQARLRPDLRVHLAAREAEFWTAPD

SEQ ID NO: 1243728 - protein, 18 aa, Mycobacterium
LQAYSMTMYAGWRAVIAQ

SEQ ID NO: 1243729 - protein, 19 aa, Mycobacterium
LQCAEVVGVLGAVVDMTVQ

SEQ ID NO: 1243730 - protein, 18 aa, Mycobacterium
LQEEAGLSAAQWRVLVDL

SEQ ID NO: 1243731 - protein, 20 aa, Mycobacterium
LQELEKGAGVAVTGGGSLLP

SEQ ID NO: 1243732 - protein, 22 aa, Mycobacterium
LQEMYARHGFVRAGDEFVEDGI

SEQ ID NO: 1243733 - protein, 20 aa, Mycobacterium
LQFALKRAKAGELLLGGAAE

SEQ ID NO: 1243734 - protein, 26 aa, Mycobacterium
LQGLGGVYPEIFLPLHGEHQAHNAIL

SEQ ID NO: 1243735 - protein, 23 aa, Mycobacterium
LQGRRCGACRLEIDRGEMARISA

SEQ ID NO: 1243736 - protein, 17 aa, Mycobacterium
LQGSASYRRRVGAAMVS

SEQ ID NO: 1243737 - protein, 20 aa, Mycobacterium
LQGVAFSQGYLDAGGVRTRY

SEQ ID NO: 1243738 - protein, 22 aa, Mycobacterium
LQHPRGVLVLWIELLEQRPFTP

SEQ ID NO: 1243739 - protein, 22 aa, Mycobacterium
LQIDKGEFVFLIGPSGSGKSTF

SEQ ID NO: 1243740 - protein, 24 aa, Mycobacterium
LQKTLKGNIFGGGSSHVETPRLVG

SEQ ID NO: 1243741 - protein, 22 aa, Mycobacterium
LQLALTELWRSYGVTPDAVIGH

SEQ ID NO: 1243742 - protein, 24 aa, Mycobacterium
LQLLWLPLAHAFGKVLISAQLACG

SEQ ID NO: 1243743 - protein, 17 aa, Mycobacterium
LQLRILWEELLPRFENI

SEQ ID NO: 1243744 - protein, 20 aa, Mycobacterium
LQLRPSSYSLPAIDVDHTRF

SEQ ID NO: 1243745 - protein, 25 aa, Mycobacterium
LQLSKRGGGVALLLSNIREHGAPIK

SEQ ID NO: 1243746 - protein, 18 aa, Mycobacterium
LQLVKSPVHGLVLVSLDR

SEQ ID NO: 1243747 - protein, 17 aa, Mycobacterium
LQNLSAYDFFVGRDSAT

SEQ ID NO: 1243748 - protein, 18 aa, Mycobacterium
LQNMPSHRVLAVMRGEKE

SEQ ID NO: 1243749 - protein, 18 aa, Mycobacterium
LQPGHRLVIRALPGAASA

SEQ ID NO: 1243750 - protein, 17 aa, Mycobacterium
LQPQARYILPSFIEHSS

SEQ ID NO: 1243751 - protein, 17 aa, Mycobacterium
LQRDVHYIVRDDAVHLI

SEQ ID NO: 1243752 - protein, 19 aa, Mycobacterium
LQRIFVLTFEVEFFARHGF

SEQ ID NO: 1243753 - protein, 17 aa, Mycobacterium
LQSALGWLKYTIDTELR

SEQ ID NO: 1243754 - protein, 24 aa, Mycobacterium
LQSARAQILAGFCDVALVIGADTT

SEQ ID NO: 1243755 - protein, 25 aa, Mycobacterium
LQSLRARFGTLTGVDRPAKDGDFVS

SEQ ID NO: 1243756 - protein, 18 aa, Mycobacterium
LQSYELPRDFLVETQPFT

SEQ ID NO: 1243757 - protein, 17 aa, Mycobacterium
LQTCFFAISGVLPRDQA

SEQ ID NO: 1243758 - protein, 17 aa, Mycobacterium
LQTRIGLEDTLRLPDGS

SEQ ID NO: 1243759 - protein, 23 aa, Mycobacterium
LQTVAALLRLQARRTNNAEGREA

SEQ ID NO: 1243760 - protein, 17 aa, Mycobacterium
LQVLIDLGLGYLTLNRR

SEQ ID NO: 1243761 - protein, 21 aa, Mycobacterium
LQVNVRQALTLADQAVANGDA

SEQ ID NO: 1243762 - protein, 20 aa, Mycobacterium
LQYCKDRKAFGQPIGSFQHN

SEQ ID NO: 1243763 - protein, 27 aa, Mycobacterium
LRADCLDARITALLGLGRVPQALAAAA

SEQ ID NO: 1243764 - protein, 19 aa, Mycobacterium
LRADVLEFMDTVRGVERAV

SEQ ID NO: 1243765 - protein, 19 aa, Mycobacterium
LRAELDRERAHVFDLEQDR

SEQ ID NO: 1243766 - protein, 18 aa, Mycobacterium
LRAFLSRFLLPAILAGDH

SEQ ID NO: 1243767 - protein, 19 aa, Mycobacterium
LRAFSFPFDQVRVLIVGQD

SEQ ID NO: 1243768 - protein, 22 aa, Mycobacterium
LRAGLARHPKAVVVANCDDVLM

SEQ ID NO: 1243769 - protein, 18 aa, Mycobacterium
LRAGTLSRRAHWRSPAGK

SEQ ID NO: 1243770 - protein, 19 aa, Mycobacterium
LRAIPGLQMLTVEAVNTCV

SEQ ID NO: 1243771 - protein, 17 aa, Mycobacterium
LRAKKIARTEALRRADG

SEQ ID NO: 1243772 - protein, 23 aa, Mycobacterium
LRALALNRFAKSPMLVGGQMLNL

SEQ ID NO: 1243773 - protein, 19 aa, Mycobacterium
LRALARVAPTQAHRYALID

SEQ ID NO: 1243774 - protein, 22 aa, Mycobacterium
LRALDYLRGRLNRVVLEIMQSA

SEQ ID NO: 1243775 - protein, 17 aa, Mycobacterium
LRALFVVAGNPVLSVPN

SEQ ID NO: 1243776 - protein, 17 aa, Mycobacterium
LRALHAVAIVNENDTVA

SEQ ID NO: 1243777 - protein, 20 aa, Mycobacterium
LRALHYPKIVLGLSGGLDST

SEQ ID NO: 1243778 - protein, 20 aa, Mycobacterium
LRALRLTTALRRAAGTTERT

SEQ ID NO: 1243779 - protein, 22 aa, Mycobacterium
LRANPDLHLVAVVPRHPDVDGR

SEQ ID NO: 1243780 - protein, 19 aa, Mycobacterium
LRAQIAPLQQVWTRHAAEA

SEQ ID NO: 1243781 - protein, 22 aa, Mycobacterium
LRARAAPLLARHGLAGGPRRTE

SEQ ID NO: 1243782 - protein, 17 aa, Mycobacterium
LRARELQKKLYAGGFAG

SEQ ID NO: 1243783 - protein, 18 aa, Mycobacterium
LRARVWVAQVGRIPLLLL

SEQ ID NO: 1243784 - protein, 18 aa, Mycobacterium
LRASVFHFNPGFEREQDF

SEQ ID NO: 1243785 - protein, 26 aa, Mycobacterium
LRAVEVQLDQCWDLLRQRRALRDSGR

SEQ ID NO: 1243786 - protein, 19 aa, Mycobacterium
LRAVSPLAVQMYMPNAPAA

SEQ ID NO: 1243787 - protein, 17 aa, Mycobacterium
LRAVTNWVGPVGTGAQL

SEQ ID NO: 1243788 - protein, 17 aa, Mycobacterium
LRCASCRRAVESTDVDG

SEQ ID NO: 1243789 - protein, 24 aa, Mycobacterium
LRCNAPERLAMALLGTGFAYAPER

SEQ ID NO: 1243790 - protein, 19 aa, Mycobacterium
LRCVPRTTSDLVYLRMHGP

SEQ ID NO: 1243791 - protein, 22 aa, Mycobacterium
LRDDLRPDWARPAQPGGSYRVE

SEQ ID NO: 1243792 - protein, 21 aa, Mycobacterium
LRDELRLTGTHWGCDTSNCGT

SEQ ID NO: 1243793 - protein, 20 aa, Mycobacterium
LRDEVRGVGPLLATGRGLRA

SEQ ID NO: 1243794 - protein, 21 aa, Mycobacterium
LRDFRVGDLDGAWYVIAATDD

SEQ ID NO: 1243795 - protein, 17 aa, Mycobacterium
LRDGEPVAGLTWLPFMS

SEQ ID NO: 1243796 - protein, 20 aa, Mycobacterium
LRDGRIEWMGAVANRLPMMI

SEQ ID NO: 1243797 - protein, 25 aa, Mycobacterium
LRDGRRVTTCLTFAVAADGAHITTA

SEQ ID NO: 1243798 - protein, 27 aa, Mycobacterium
LRDIQFLPVPHRLSATRVRAAGTVIKT

SEQ ID NO: 1243799 - protein, 24 aa, Mycobacterium
LRDLVRVGSLFLNEGVSLTGHQVV

SEQ ID NO: 1243800 - protein, 19 aa, Mycobacterium
LRDRIRFGTEVLGATFDEG

SEQ ID NO: 1243801 - protein, 17 aa, Mycobacterium
LRDRLFETLAAVEPEVE

SEQ ID NO: 1243802 - protein, 23 aa, Mycobacterium
LRDRLSELWLRAEAQRLTSERSR

SEQ ID NO: 1243803 - protein, 18 aa, Mycobacterium
LRDVLAVLRDAYCRHIGV

SEQ ID NO: 1243804 - protein, 23 aa, Mycobacterium
LRDYAGAVGQAFQLRDDLADLFG

SEQ ID NO: 1243805 - protein, 18 aa, Mycobacterium
LREAIMAVARQMRRHRPD

SEQ ID NO: 1243806 - protein, 23 aa, Mycobacterium
LREAVLVEGWRLHPGSDPVAAQV

SEQ ID NO: 1243807 - protein, 26 aa, Mycobacterium
LREIVGAYFPLGWQMACHVHGDAGVD

SEQ ID NO: 1243808 - protein, 18 aa, Mycobacterium
LREKLGHDPQHGEFIRTI

SEQ ID NO: 1243809 - protein, 20 aa, Mycobacterium
LRERALRLAGSFTGFGPGAR

SEQ ID NO: 1243810 - protein, 30 aa, Mycobacterium
LRERLPDLRLWNFYGQTEMAPLASALGPDE

SEQ ID NO: 1243811 - protein, 17 aa, Mycobacterium
LRERREGDVLGMHQSGR

SEQ ID NO: 1243812 - protein, 21 aa, Mycobacterium
LRERVTRLFGLVLPAIVTDES

SEQ ID NO: 1243813 - protein, 18 aa, Mycobacterium
LRESLLIGLLTGGHVLIE

SEQ ID NO: 1243814 - protein, 20 aa, Mycobacterium
LRESVAPLRILTGIEVDILE

SEQ ID NO: 1243815 - protein, 21 aa, Mycobacterium
LRETERPVLLLAGGTGLAPVL

SEQ ID NO: 1243816 - protein, 24 aa, Mycobacterium
LREVCRRAREMALEAYAHQDLPFD

SEQ ID NO: 1243817 - protein, 24 aa, Mycobacterium
LREYGVHVLVIRPGQVRTRMSAHV

SEQ ID NO: 1243818 - protein, 30 aa, Mycobacterium
LREYIDWQPFFNAWEMKGRFPDILNNPVSG

SEQ ID NO: 1243819 - protein, 18 aa, Mycobacterium
LRFDPPVQLVGRIAAEEM

SEQ ID NO: 1243820 - protein, 17 aa, Mycobacterium
LRFGSKVPGSAMEVRDV

SEQ ID NO: 1243821 - protein, 20 aa, Mycobacterium
LRFLKEDPWERLAALREAVP

SEQ ID NO: 1243822 - protein, 27 aa, Mycobacterium
LRFRPRVKSPFTRRSVAQDGPARADNP

SEQ ID NO: 1243823 - protein, 22 aa, Mycobacterium
LRFYRDGLGLAIAREYGGGTVF

SEQ ID NO: 1243824 - protein, 21 aa, Mycobacterium
LRGAAFPWRTIRGEECSAYWP

SEQ ID NO: 1243825 - protein, 18 aa, Mycobacterium
LRGAFNLISQLTEEEIAA

SEQ ID NO: 1243826 - protein, 24 aa, Mycobacterium
LRGAMKGALAVRAGLVVRKARRSQ

SEQ ID NO: 1243827 - protein, 17 aa, Mycobacterium
LRGASLADFGDDHSDRL

SEQ ID NO: 1243828 - protein, 27 aa, Mycobacterium
LRGAVAHNCRLCKSLREGHALDAGGSE

SEQ ID NO: 1243829 - protein, 20 aa, Mycobacterium
LRGDCDAAYHHLHGAGDELA

SEQ ID NO: 1243830 - protein, 18 aa, Mycobacterium
LRGDLGFAGLPGVVYTPE

SEQ ID NO: 1243831 - protein, 20 aa, Mycobacterium
LRGFVAANPEVVWHRDPGFL

SEQ ID NO: 1243832 - protein, 18 aa, Mycobacterium
LRGFYMCPVTPLTDEFEL

SEQ ID NO: 1243833 - protein, 23 aa, Mycobacterium
LRGGAATEAVWIAAEQHGVATHP

SEQ ID NO: 1243834 - protein, 18 aa, Mycobacterium
LRGHLGIALPDLVTEVRR

SEQ ID NO: 1243835 - protein, 28 aa, Mycobacterium
LRGMTGPEIARWTAAMVASGQRFDFTDL

SEQ ID NO: 1243836 - protein, 18 aa, Mycobacterium
LRGPVFLVQHALPHLKAS

SEQ ID NO: 1243837 - protein, 22 aa, Mycobacterium
LRGSRTPDRVVFRAELPTNATG

SEQ ID NO: 1243838 - protein, 18 aa, Mycobacterium
LRGSRVALRVPQRGDKKA

SEQ ID NO: 1243839 - protein, 18 aa, Mycobacterium
LRGVDLVAVHAWNDVDYE

SEQ ID NO: 1243840 - protein, 21 aa, Mycobacterium
LRGVLDIAARADLKRFVFLST

SEQ ID NO: 1243841 - protein, 20 aa, Mycobacterium
LRHEIGIDIIAWECDYPHSD

SEQ ID NO: 1243842 - protein, 24 aa, Mycobacterium
LRHMLSTRLPRYLVPHHIAVLDEL

SEQ ID NO: 1243843 - protein, 20 aa, Mycobacterium
LRHVAHIGVGARAFSYLANG

SEQ ID NO: 1243844 - protein, 24 aa, Mycobacterium
LRIFEPRYVALVQDCLAMTDPAFG

SEQ ID NO: 1243845 - protein, 20 aa, Mycobacterium
LRIGLEACRATTRAAVVSVA

SEQ ID NO: 1243846 - protein, 23 aa, Mycobacterium
LRINVNCAGIGNAIKTLSKNGAF

SEQ ID NO: 1243847 - protein, 19 aa, Mycobacterium
LRIPEIGPMSIGYVQPPDA

SEQ ID NO: 1243848 - protein, 18 aa, Mycobacterium
LRIREWQDLTGQLRSIAR

SEQ ID NO: 1243849 - protein, 20 aa, Mycobacterium
LRIRFNLALYADPRHFDAQL

SEQ ID NO: 1243850 - protein, 20 aa, Mycobacterium
LRITTTAAIQVWTIDLPHVG

SEQ ID NO: 1243851 - protein, 24 aa, Mycobacterium
LRITVKRDPGGLVSNWLNDTVSEG

SEQ ID NO: 1243852 - protein, 17 aa, Mycobacterium
LRKGYYGASAMPREILA

SEQ ID NO: 1243853 - protein, 19 aa, Mycobacterium
LRKPLVCAVNGLAVGIGTT

SEQ ID NO: 1243854 - protein, 17 aa, Mycobacterium
LRKYCRVETVVAPRTNV

SEQ ID NO: 1243855 - protein, 19 aa, Mycobacterium
LRKYIGAYLALLGSTDVIV

SEQ ID NO: 1243856 - protein, 20 aa, Mycobacterium
LRLAEELLVDYGFEPYRARA

SEQ ID NO: 1243857 - protein, 17 aa, Mycobacterium
LRLARREVLLDHSTLPI

SEQ ID NO: 1243858 - protein, 19 aa, Mycobacterium
LRLDSPVQMSARVAKKDVE

SEQ ID NO: 1243859 - protein, 19 aa, Mycobacterium
LRLEAYRRLAAAQDDAGVD

SEQ ID NO: 1243860 - protein, 25 aa, Mycobacterium
LRLGDLRLSERLARAALQDSGELRA

SEQ ID NO: 1243861 - protein, 20 aa, Mycobacterium
LRLHPAASRVRMLAEKTPAS

SEQ ID NO: 1243862 - protein, 21 aa, Mycobacterium
LRLHPPLIILMRVAQGEFEVA

SEQ ID NO: 1243863 - protein, 20 aa, Mycobacterium
LRLHYAKTLDIWAAALESRK

SEQ ID NO: 1243864 - protein, 17 aa, Mycobacterium
LRLKRMYPGATYRATTG

SEQ ID NO: 1243865 - protein, 20 aa, Mycobacterium
LRLLLPAGLETTYRSSGNLL

SEQ ID NO: 1243866 - protein, 19 aa, Mycobacterium
LRLPMITRSLLAYRYRRLP

SEQ ID NO: 1243867 - protein, 29 aa, Mycobacterium
LRLQQELAELLPGCTGLDVVDSVYGHDGF

SEQ ID NO: 1243868 - protein, 17 aa, Mycobacterium
LRLRGVEHVVAADFSQT

SEQ ID NO: 1243869 - protein, 18 aa, Mycobacterium
LRLRNLLKPDQFPYHSKT

SEQ ID NO: 1243870 - protein, 20 aa, Mycobacterium
LRLRPSRGTHLVFDAAAFGH

SEQ ID NO: 1243871 - protein, 19 aa, Mycobacterium
LRMLFSRAGTYPRGATERL

SEQ ID NO: 1243872 - protein, 30 aa, Mycobacterium
LRMLTLPGTLALYLERAWPRHRRLSRSADD

SEQ ID NO: 1243873 - protein, 20 aa, Mycobacterium
LRMPGFGLDGPWRDNPAFAY

SEQ ID NO: 1243874 - protein, 27 aa, Mycobacterium
LRMQPGHWSGAYICWGTENREAAVRFL

SEQ ID NO: 1243875 - protein, 19 aa, Mycobacterium
LRMRIDIGRTVCATLRSET

SEQ ID NO: 1243876 - protein, 24 aa, Mycobacterium
LRNIALAIGFEWGIALHDIHAAKE

SEQ ID NO: 1243877 - protein, 17 aa, Mycobacterium
LRNRFIDRFEADAPLGY

SEQ ID NO: 1243878 - protein, 23 aa, Mycobacterium
LRNSPEPVLLMLAAVKCGAISGM

SEQ ID NO: 1243879 - protein, 20 aa, Mycobacterium
LRNTEVLPLYARLPTAEQQK

SEQ ID NO: 1243880 - protein, 20 aa, Mycobacterium
LRNVEGLSVESGQTFYVTDE

SEQ ID NO: 1243881 - protein, 22 aa, Mycobacterium
LRNWRDALELPKERHRDTFDEC

SEQ ID NO: 1243882 - protein, 18 aa, Mycobacterium
LRPADLVAAQGVWLISSI

SEQ ID NO: 1243883 - protein, 18 aa, Mycobacterium
LRPDIVLCDVRMQGASGL

SEQ ID NO: 1243884 - protein, 25 aa, Mycobacterium
LRPIEWRYTNDPAWVMRDKGQRLDH

SEQ ID NO: 1243885 - protein, 26 aa, Mycobacterium
LRPLFGAKFGDAFGEVPARYLYQRLG

SEQ ID NO: 1243886 - protein, 19 aa, Mycobacterium
LRPSARVARGLAYVPQGQQ

SEQ ID NO: 1243887 - protein, 20 aa, Mycobacterium
LRPSYGLAEATVFVASGTWS

SEQ ID NO: 1243888 - protein, 21 aa, Mycobacterium
LRPVLVRAFNVLRQYPVDAVA

SEQ ID NO: 1243889 - protein, 17 aa, Mycobacterium
LRPVPGIDLPDYKRTLI

SEQ ID NO: 1243890 - protein, 19 aa, Mycobacterium
LRPVPVGVVGDVYTAGGPL

SEQ ID NO: 1243891 - protein, 25 aa, Mycobacterium
LRPVTDGRWSCVQWGSRTPPFYPEP

SEQ ID NO: 1243892 - protein, 26 aa, Mycobacterium
LRPYPRAVPSPGWSLRIDPVGWMSSA

SEQ ID NO: 1243893 - protein, 30 aa, Mycobacterium
LRQAAGPVIRLKLGPKWMIPEIVVVTSPAG

SEQ ID NO: 1243894 - protein, 22 aa, Mycobacterium
LRQDGMLALARLQRKMRLVESP

SEQ ID NO: 1243895 - protein, 19 aa, Mycobacterium
LRQGYRIDDGIPVLLVDEA

SEQ ID NO: 1243896 - protein, 18 aa, Mycobacterium
LRQLAAVLGVARDAEVLA

SEQ ID NO: 1243897 - protein, 24 aa, Mycobacterium
LRQLEAVAARAARIGKVTPALIKA

SEQ ID NO: 1243898 - protein, 24 aa, Mycobacterium
LRQVMGCVFQDFRLLQQKTVFENV

SEQ ID NO: 1243899 - protein, 21 aa, Mycobacterium
LRRAVRLLAQLTRQVAIVQYP

SEQ ID NO: 1243900 - protein, 17 aa, Mycobacterium
LRRAWGIVNADRDPEAA

SEQ ID NO: 1243901 - protein, 17 aa, Mycobacterium
LRRDRCGVDGATLTQLS

SEQ ID NO: 1243902 - protein, 20 aa, Mycobacterium
LRRFLRSVVEFWREPVVYAA

SEQ ID NO: 1243903 - protein, 20 aa, Mycobacterium
LRRGPDMSGMLEPLFGADGL

SEQ ID NO: 1243904 - protein, 22 aa, Mycobacterium
LRRICAGGHRVIVYSYLVTDEV

SEQ ID NO: 1243905 - protein, 25 aa, Mycobacterium
LRRIPDLRLATSLDEIEFKNNTRAY

SEQ ID NO: 1243906 - protein, 23 aa, Mycobacterium
LRRLIDRAARWLLNYRPQPLAVG

SEQ ID NO: 1243907 - protein, 26 aa, Mycobacterium
LRRLRDEIGCSIVLITHDLGVAAQIS

SEQ ID NO: 1243908 - protein, 17 aa, Mycobacterium
LRRLRRTVVEVGYRDAA

SEQ ID NO: 1243909 - protein, 19 aa, Mycobacterium
LRRPVRRPLDEGVVEYAGE

SEQ ID NO: 1243910 - protein, 18 aa, Mycobacterium
LRRRCLYHWIDYPQPERA

SEQ ID NO: 1243911 - protein, 17 aa, Mycobacterium
LRRRIMLERAAWRLRRG

SEQ ID NO: 1243912 - protein, 24 aa, Mycobacterium
LRRRPYDLSSLFAIGTGGAATNQR

SEQ ID NO: 1243913 - protein, 22 aa, Mycobacterium
LRRRRDLSVLLLLDVSGSTAEP

SEQ ID NO: 1243914 - protein, 23 aa, Mycobacterium
LRRRSARALRQWVHREQHHLDQL

SEQ ID NO: 1243915 - protein, 25 aa, Mycobacterium
LRRRTGIDFDPHWLRHTAATRMLRD

SEQ ID NO: 1243916 - protein, 21 aa, Mycobacterium
LRRRYYRVSGADAYTMRRDPP

SEQ ID NO: 1243917 - protein, 18 aa, Mycobacterium
LRRTGLRLLTMLRPELAD

SEQ ID NO: 1243918 - protein, 19 aa, Mycobacterium
LRRVIRSAKLLGIDDAVVG

SEQ ID NO: 1243919 - protein, 17 aa, Mycobacterium
LRRVPLRVLTPGSESAR

SEQ ID NO: 1243920 - protein, 18 aa, Mycobacterium
LRRVRLTALATKRAKEVH

SEQ ID NO: 1243921 - protein, 18 aa, Mycobacterium
LRRVSLELGGKSAAIVLD

SEQ ID NO: 1243922 - protein, 19 aa, Mycobacterium
LRRWRAVVRSAARQSRRAH

SEQ ID NO: 1243923 - protein, 19 aa, Mycobacterium
LRRYMNWIPGEYVDAMAPA

SEQ ID NO: 1243924 - protein, 21 aa, Mycobacterium
LRSAGAAGWPVVWSGGEEGGV

SEQ ID NO: 1243925 - protein, 18 aa, Mycobacterium
LRSANAFLDAAHPLPRDV

SEQ ID NO: 1243926 - protein, 30 aa, Mycobacterium
LRSAQRLPWHPGRCAEVLIGDTVVGHAGQL

SEQ ID NO: 1243927 - protein, 19 aa, Mycobacterium
LRSDIPIMLGAEGPKNVAL

SEQ ID NO: 1243928 - protein, 18 aa, Mycobacterium
LRSDRRYGGSIDVIDLGA

SEQ ID NO: 1243929 - protein, 20 aa, Mycobacterium
LRSEFDWLGTVLQAYLRRTQ

SEQ ID NO: 1243930 - protein, 22 aa, Mycobacterium
LRSFDARLGWGPSVATEDELLA

SEQ ID NO: 1243931 - protein, 34 aa, Mycobacterium; identical to SEQ ID NO: 622604

SEQ ID NO: 1243932 - protein, 18 aa, Mycobacterium
LRSGGAKLVTLGGDHTIA

SEQ ID NO: 1243933 - protein, 18 aa, Mycobacterium
LRSMEILDDVILGLRKMH

SEQ ID NO: 1243934 - protein, 18 aa, Mycobacterium
LRSPVWAQAISDITGRPQ

SEQ ID NO: 1243935 - protein, 23 aa, Mycobacterium
LRSRGVLPTRLRLLYLADSQVLD

SEQ ID NO: 1243936 - protein, 19 aa, Mycobacterium
LRSRITIPIAADESIRKAD

SEQ ID NO: 1243937 - protein, 19 aa, Mycobacterium
LRSRSWWSGPDVVLLVDDW

SEQ ID NO: 1243938 - protein, 25 aa, Mycobacterium
LRSSGRPDDEFAFVVHGTMADPRWL

SEQ ID NO: 1243939 - protein, 23 aa, Mycobacterium
LRSWFGFGVAGNFAGHLEQAGEA

SEQ ID NO: 1243940 - protein, 20 aa, Mycobacterium
LRSWYIFYFQLPWLPDRSAS

SEQ ID NO: 1243941 - protein, 25 aa, Mycobacterium
LRTEAAFEYAARLGYDGVELMVWAE

SEQ ID NO: 1243942 - protein, 25 aa, Mycobacterium
LRTERVVFDGCDFSGVDMSESEHVG

SEQ ID NO: 1243943 - protein, 19 aa, Mycobacterium
LRTHLTPLDAVLCSTATRT

SEQ ID NO: 1243944 - protein, 17 aa, Mycobacterium
LRTKPGAPMKVADPDRI

SEQ ID NO: 1243945 - protein, 18 aa, Mycobacterium
LRTLKRRITAAVSTTHRV

SEQ ID NO: 1243946 - protein, 19 aa, Mycobacterium
LRTLRRLGFHCGIVSGGFR

SEQ ID NO: 1243947 - protein, 25 aa, Mycobacterium
LRTTEGWLLIDFEGEPGQPLDERRR

SEQ ID NO: 1243948 - protein, 18 aa, Mycobacterium
LRTTVQYVGPLSVVGAEL

SEQ ID NO: 1243949 - protein, 17 aa, Mycobacterium
LRTVRCVSGTVELVMNC

SEQ ID NO: 1243950 - protein, 20 aa, Mycobacterium
LRTYRGVLDAGRVVEFMMLD

SEQ ID NO: 1243951 - protein, 19 aa, Mycobacterium
LRVALQAGLPASRVAAQCR

SEQ ID NO: 1243952 - protein, 25 aa, Mycobacterium
LRVATKLFAARGYHGTRMDDVADAV

SEQ ID NO: 1243953 - protein, 21 aa, Mycobacterium
LRVEKCSAVSLPISDHRALVV

SEQ ID NO: 1243954 - protein, 26 aa, Mycobacterium
LRVHARTGLPCPVCGDTVREVSFADK

SEQ ID NO: 1243955 - protein, 22 aa, Mycobacterium
LRVIEKLSFPGYFLVVHDITRF

SEQ ID NO: 1243956 - protein, 17 aa, Mycobacterium
LRVLNFLADEMGVDLGL

SEQ ID NO: 1243957 - protein, 19 aa, Mycobacterium
LRVPDGVVLSVVMHHIAGD

SEQ ID NO: 1243958 - protein, 20 aa, Mycobacterium
LRVRCLRQLKDALREHVEEM

SEQ ID NO: 1243959 - protein, 26 aa, Mycobacterium
LRVVAPEAYFQFPVAKYGIALDNWSI

SEQ ID NO: 1243960 - protein, 18 aa, Mycobacterium
LRVVDCSVMPTIVAGNLN

SEQ ID NO: 1243961 - protein, 20 aa, Mycobacterium
LRWWPLDALPPDTDFGLAQL

SEQ ID NO: 1243962 - protein, 21 aa, Mycobacterium
LRYLDGCSVPECAELIGRTVH

SEQ ID NO: 1243963 - protein, 28 aa, Mycobacterium
LSAAPFDLARLGPWRDRITSFPADFSNV

SEQ ID NO: 1243964 - protein, 17 aa, Mycobacterium
LSAFFSAAMHAESEDRS

SEQ ID NO: 1243965 - protein, 21 aa, Mycobacterium
LSAFRKFGFQLVIVATVQNAT

SEQ ID NO: 1243966 - protein, 23 aa, Mycobacterium
LSAGHARALLALEGGPERQEELA

SEQ ID NO: 1243967 - protein, 18 aa, Mycobacterium
LSALVAHLVGADALVLLS

SEQ ID NO: 1243968 - protein, 26 aa, Mycobacterium
LSAPDGVSVSWIYRGGRADLVPEEAA

SEQ ID NO: 1243969 - protein, 18 aa, Mycobacterium
LSAQVGAYHLMRTQGGRG

SEQ ID NO: 1243970 - protein, 23 aa, Mycobacterium
LSDAELYLFFYLLFSAGAETTRN

SEQ ID NO: 1243971 - protein, 18 aa, Mycobacterium
LSDASSWITGQIINVDGG

SEQ ID NO: 1243972 - protein, 21 aa, Mycobacterium
LSDDEFGFFVVMLAVAGNETT

SEQ ID NO: 1243973 - protein, 36 aa, Mycobacterium
LSDDVPEYRRYLGRHLPYYANWHRLKSYWATADNNY

SEQ ID NO: 1243974 - protein, 21 aa, Mycobacterium
LSDGLRVCGYVDATYWRDMGT

SEQ ID NO: 1243975 - protein, 22 aa, Mycobacterium
LSDMFYSIWWPKVDGETSDVPP

SEQ ID NO: 1243976 - protein, 22 aa, Mycobacterium
LSDQMIDYWAAFVASGAPSASD

SEQ ID NO: 1243977 - protein, 23 aa, Mycobacterium
LSDWTAGQATHFGTRGITVNAVA

SEQ ID NO: 1243978 - protein, 21 aa, Mycobacterium
LSEDDWDGWVSLTTQIGDRVQ

SEQ ID NO: 1243979 - protein, 28 aa, Mycobacterium
LSEERLERICRLIMLYHLDRGWCEHLAY

SEQ ID NO: 1243980 - protein, 17 aa, Mycobacterium
LSEFTGCTVHLKVEGLN

SEQ ID NO: 1243981 - protein, 20 aa, Mycobacterium
LSEPDRFAVLHGDYRLDNML

SEQ ID NO: 1243982 - protein, 18 aa, Mycobacterium
LSEREIFTTLVMTTALGV

SEQ ID NO: 1243983 - protein, 17 aa, Mycobacterium
LSFAWPDGTTVFSELTA

SEQ ID NO: 1243984 - protein, 17 aa, Mycobacterium
LSFGQGLHFCLGSALAR

SEQ ID NO: 1243985 - protein, 17 aa, Mycobacterium
LSFGQGLHFCLGSSLAR

SEQ ID NO: 1243986 - protein, 28 aa, Mycobacterium
LSFSRFELLRLLAFSRSGALPITKASDR

SEQ ID NO: 1243987 - protein, 20 aa, Mycobacterium
LSGALFRDGLTIVHTGESVP

SEQ ID NO: 1243988 - protein, 18 aa, Mycobacterium
LSGGALEIFLVPQVPAPL

SEQ ID NO: 1243989 - protein, 20 aa, Mycobacterium
LSGLLGRGGAAFPMAVKLRS

SEQ ID NO: 1243990 - protein, 18 aa, Mycobacterium
LSGLTGRPARTVAGEPAA

SEQ ID NO: 1243991 - protein, 19 aa, Mycobacterium
LSGNFCRCTGYQGIVNAVR

SEQ ID NO: 1243992 - protein, 17 aa, Mycobacterium
LSGPLVRSSYRAGRLYA

SEQ ID NO: 1243993 - protein, 18 aa, Mycobacterium
LSGPVPLAGALIQHGDVG

SEQ ID NO: 1243994 - protein, 28 aa, Mycobacterium
LSGSLPRRPQFALLKGRGNYLCLNKIHN

SEQ ID NO: 1243995 - protein, 18 aa, Mycobacterium
LSHNCWQYAVLAFATARA

SEQ ID NO: 1243996 - protein, 20 aa, Mycobacterium
LSINAEFAQPLSVDRAKELL

SEQ ID NO: 1243997 - protein, 20 aa, Mycobacterium
LSINLRWSWDKPTQDLFADI

SEQ ID NO: 1243998 - protein, 27 aa, Mycobacterium
LSLAGLARAIADIAARARSGDLKPDEL

SEQ ID NO: 1243999 - protein, 24 aa, Mycobacterium
LSLGAGFRKVLAMDANRVQADDVI

SEQ ID NO: 1244000 - protein, 21 aa, Mycobacterium
LSLLLRRERTGLGGSASIAQS

SEQ ID NO: 1244001 - protein, 27 aa, Mycobacterium
LSLMVKAGVQWGLFGGAVENLGTERHH

SEQ ID NO: 1244002 - protein, 24 aa, Mycobacterium
LSMKTGQGYAEFAVSSFGTDGVLA

SEQ ID NO: 1244003 - protein, 17 aa, Mycobacterium
LSNAVPFLSAGVVSGGA

SEQ ID NO: 1244004 - protein, 24 aa, Mycobacterium
LSNPFLYRQGRWKSYFERVRNEAP

SEQ ID NO: 1244005 - protein, 20 aa, Mycobacterium
LSPAGCRRVAVAAHDGLART

SEQ ID NO: 1244006 - protein, 22 aa, Mycobacterium
LSPEIMGLGPIEAVKKALGNAG

SEQ ID NO: 1244007 - protein, 17 aa, Mycobacterium
LSPELTRPFTPPPSFMN

SEQ ID NO: 1244008 - protein, 27 aa, Mycobacterium
LSPENTIACSRWGMLAPDGQCKTFDAG

SEQ ID NO: 1244009 - protein, 32 aa, Mycobacterium; identical to SEQ ID NO: 82438

SEQ ID NO: 1244010 - protein, 30 aa, Mycobacterium
LSPRQRAVLVLREVLQWKAAEVADALGTST

SEQ ID NO: 1244011 - protein, 17 aa, Mycobacterium
LSPSFNWDTTGMTDDEM

SEQ ID NO: 1244012 - protein, 17 aa, Mycobacterium
LSQLRLRELLTEVQDRV

SEQ ID NO: 1244013 - protein, 27 aa, Mycobacterium
LSRKFDQWPAIRPYMLVVHDAEFSEPE

SEQ ID NO: 1244014 - protein, 19 aa, Mycobacterium
LSRLEGMDFGSPEFLEELA

SEQ ID NO: 1244015 - protein, 19 aa, Mycobacterium
LSRLPPRRQPPKSVPPLRR

SEQ ID NO: 1244016 - protein, 18 aa, Mycobacterium
LSRPEERERLFAEATKEL

SEQ ID NO: 1244017 - protein, 17 aa, Mycobacterium
LSRRPEWAAAGRFAQAY

SEQ ID NO: 1244018 - protein, 19 aa, Mycobacterium
LSRVRIWDGSTPWLITGHA

SEQ ID NO: 1244019 - protein, 17 aa, Mycobacterium
LSSAIGMSEHGAGSDLA

SEQ ID NO: 1244020 - protein, 22 aa, Mycobacterium
LSSALPAGAALVVEVRYGGTPE

SEQ ID NO: 1244021 - protein, 17 aa, Mycobacterium
LSTAQLRSALPRGGVDV

SEQ ID NO: 1244022 - protein, 18 aa, Mycobacterium
LSTCSELFRQQWASQDVR

SEQ ID NO: 1244023 - protein, 20 aa, Mycobacterium
LSTLTWRIATNVTKLPMLSD

SEQ ID NO: 1244024 - protein, 20 aa, Mycobacterium
LSTVRLGRAIGVIYLPATER

SEQ ID NO: 1244025 - protein, 20 aa, Mycobacterium
LSVADALRYAVSLGGDTDTA

SEQ ID NO: 1244026 - protein, 18 aa, Mycobacterium
LSVASPFFAEFDLAARGV

SEQ ID NO: 1244027 - protein, 20 aa, Mycobacterium
LSVGLSWPHEVYPIFESAIA

SEQ ID NO: 1244028 - protein, 19 aa, Mycobacterium
LSVQLSGWMLMEAAHAVSD

SEQ ID NO: 1244029 - protein, 20 aa, Mycobacterium
LSVRENVAFGLKIRKRPKAE

SEQ ID NO: 1244030 - protein, 19 aa, Mycobacterium
LSVSLKFQGFEVHTASDGA

SEQ ID NO: 1244031 - protein, 23 aa, Mycobacterium
LSYPDLQIRFGLMSRQEVWHYVE

SEQ ID NO: 1244032 - protein, 27 aa, Mycobacterium
LTAACRAAGIPARLGFADVRNHLQTKA

SEQ ID NO: 1244033 - protein, 20 aa, Mycobacterium
LTAGPCRTRDLPLVGAVGRV

SEQ ID NO: 1244034 - protein, 25 aa, Mycobacterium
LTAIWRGDISWQRALLDGGVSVSGP

SEQ ID NO: 1244035 - protein, 22 aa, Mycobacterium
LTAKGFAGTVFLTTDDCQRSYE

SEQ ID NO: 1244036 - protein, 28 aa, Mycobacterium
LTAKVMPYKHGFGPFAPEIYRAPLSYPF

SEQ ID NO: 1244037 - protein, 19 aa, Mycobacterium
LTALGGREVVQPLSVSSLY

SEQ ID NO: 1244038 - protein, 23 aa, Mycobacterium
LTAPEMTALLGGLRVLNVNHGGS

SEQ ID NO: 1244039 - protein, 23 aa, Mycobacterium
LTARELSLRIGITERSVQAILAD

SEQ ID NO: 1244040 - protein, 19 aa, Mycobacterium
LTARTGGVAGRTVCAVVGS

SEQ ID NO: 1244041 - protein, 20 aa, Mycobacterium
LTASFGDGRTGLVAPNGAGK

SEQ ID NO: 1244042 - protein, 17 aa, Mycobacterium
LTASLGMSEPSAGSDLA

SEQ ID NO: 1244043 - protein, 28 aa, Mycobacterium
LTATLLTARCPVLFAPAMHTEMWFHPAT

SEQ ID NO: 1244044 - protein, 28 aa, Mycobacterium
LTAVRFPVWSGRCGFAVEEFARRHGDFA

SEQ ID NO: 1244045 - protein, 17 aa, Mycobacterium
LTAWPKTSGSRGFHIYA

SEQ ID NO: 1244046 - protein, 20 aa, Mycobacterium
LTAWVHGRVQGVGFRWWTRS

SEQ ID NO: 1244047 - protein, 17 aa, Mycobacterium
LTCRGRDFSTAVSRARR

SEQ ID NO: 1244048 - protein, 19 aa, Mycobacterium
LTDAIALLIEEGHPVHVVV

SEQ ID NO: 1244049 - protein, 24 aa, Mycobacterium
LTDERVAYADGWFAEAHDDSASIT

SEQ ID NO: 1244050 - protein, 18 aa, Mycobacterium
LTDGTVLWMADEKAIGDH

SEQ ID NO: 1244051 - protein, 21 aa, Mycobacterium
LTDHSPRLTIANGLSPDRLRK

SEQ ID NO: 1244052 - protein, 23 aa, Mycobacterium
LTDVRFPVQYVIRPQTRDHADHR

SEQ ID NO: 1244053 - protein, 19 aa, Mycobacterium
LTEEARMAPNLRGRINMAS

SEQ ID NO: 1244054 - protein, 25 aa, Mycobacterium
LTELRSQVPSVRHVIAAGSPELTAE

SEQ ID NO: 1244055 - protein, 21 aa, Mycobacterium
LTERKQVLVVIGRADETSERS

SEQ ID NO: 1244056 - protein, 22 aa, Mycobacterium
LTFEIPRAAISVVTGPNGVGKT

SEQ ID NO: 1244057 - protein, 19 aa, Mycobacterium
LTFGTNHLGHFALTGLLLE

SEQ ID NO: 1244058 - protein, 25 aa, Mycobacterium
LTFLDREGWDALTINALATQLGTKG

SEQ ID NO: 1244059 - protein, 25 aa, Mycobacterium
LTGCASIHHSIRCALALADYIGEPQ

SEQ ID NO: 1244060 - protein, 18 aa, Mycobacterium
LTGERRAGVTATDVVLTV

SEQ ID NO: 1244061 - protein, 27 aa, Mycobacterium
LTGHGISFLPTVGWAERGDLTATGHGN

SEQ ID NO: 1244062 - protein, 18 aa, Mycobacterium
LTGKVVWGSVDIRGPQTG

SEQ ID NO: 1244063 - protein, 17 aa, Mycobacterium
LTGMWPDRLAEEQRRGL

SEQ ID NO: 1244064 - protein, 20 aa, Mycobacterium
LTGQGGWPMTCFLTPDGRPF

SEQ ID NO: 1244065 - protein, 24 aa, Mycobacterium
LTGRPAISLPLHWTADGLPLGVQF

SEQ ID NO: 1244066 - protein, 20 aa, Mycobacterium
LTGSAPLGWYTGRDSPQTRR

SEQ ID NO: 1244067 - protein, 24 aa, Mycobacterium
LTGTTAPYNAHWDVTQSTAGDLVR

SEQ ID NO: 1244068 - protein, 24 aa, Mycobacterium
LTHLRAHAPVSWVDVDGYRPFWAV

SEQ ID NO: 1244069 - protein, 38 aa, Mycobacterium
LTHNRFGFGVGIGWAPEEFEWCGVPFARRGKRVDEMIE

SEQ ID NO: 1244070 - protein, 18 aa, Mycobacterium
LTIANGLSPDRLRKQLDV

SEQ ID NO: 1244071 - protein, 23 aa, Mycobacterium
LTKALSGYSAWVTGIRRVEAPTR

SEQ ID NO: 1244072 - protein, 20 aa, Mycobacterium
LTKARLKAAKGLAKAVTAEL

SEQ ID NO: 1244073 - protein, 17 aa, Mycobacterium
LTLAEGAIAPWSMGQTA

SEQ ID NO: 1244074 - protein, 21 aa, Mycobacterium
LTLAQLRARLPSLSVDDLEAL

SEQ ID NO: 1244075 - protein, 18 aa, Mycobacterium
LTLARLAGEAGLPPGVLN

SEQ ID NO: 1244076 - protein, 22 aa, Mycobacterium
LTLLDCGPIRMTELAAHERVRT

SEQ ID NO: 1244077 - protein, 26 aa, Mycobacterium
LTLRQRLGGIEGRRVVIVGDVLHSRV

SEQ ID NO: 1244078 - protein, 23 aa, Mycobacterium
LTLSERRIGVVGANGSGKSTLAR

SEQ ID NO: 1244079 - protein, 17 aa, Mycobacterium
LTLWQTALIRLSRLKIQ

SEQ ID NO: 1244080 - protein, 18 aa, Mycobacterium
LTNPQGFTDWMKKQDSIA

SEQ ID NO: 1244081 - protein, 17 aa, Mycobacterium
LTPAIVWQDRRAESVCA

SEQ ID NO: 1244082 - protein, 17 aa, Mycobacterium
LTPARTWGASTLIPFFG

SEQ ID NO: 1244083 - protein, 17 aa, Mycobacterium
LTPEQKDRITAVADDVW

SEQ ID NO: 1244084 - protein, 28 aa, Mycobacterium
LTPESGCRMGICHSCTRRKTSGVVKNLI

SEQ ID NO: 1244085 - protein, 17 aa, Mycobacterium
LTPLLADAEGLMAVTDA

SEQ ID NO: 1244086 - protein, 27 aa, Mycobacterium
LTPRLLVRRLESMIVERGAPIGCSNLG

SEQ ID NO: 1244087 - protein, 26 aa, Mycobacterium
LTPVAKSWPSQWCLEANSLAIQVHGG

SEQ ID NO: 1244088 - protein, 17 aa, Mycobacterium
LTQLPLGVMVEFDAEPS

SEQ ID NO: 1244089 - protein, 23 aa, Mycobacterium
LTQYPELFGALVCSVPLLDMRRF

SEQ ID NO: 1244090 - protein, 24 aa, Mycobacterium
LTRAADHSKLWFAIAAGLMASGGP

SEQ ID NO: 1244091 - protein, 24 aa, Mycobacterium
LTRLNQRHGFDCPGCAWPEDAGGR

SEQ ID NO: 1244092 - protein, 18 aa, Mycobacterium
LTRQVYRELASAADELTG

SEQ ID NO: 1244093 - protein, 20 aa, Mycobacterium
LTRTDYRAGCPVVAVAVEAG

SEQ ID NO: 1244094 - protein, 17 aa, Mycobacterium
LTSAVGLTNTHSVGVVR

SEQ ID NO: 1244095 - protein, 21 aa, Mycobacterium
LTSELPNWLAANRDVKPTGSA

SEQ ID NO: 1244096 - protein, 19 aa, Mycobacterium
LTTRGFGAAEFDRVAELVV

SEQ ID NO: 1244097 - protein, 18 aa, Mycobacterium
LTVPMYFGAELVKVTPMD

SEQ ID NO: 1244098 - protein, 17 aa, Mycobacterium
LTVPRLGPERADRQYRM

SEQ ID NO: 1244099 - protein, 20 aa, Mycobacterium
LTVPVLRLSPHVDVTADELG

SEQ ID NO: 1244100 - protein, 19 aa, Mycobacterium
LTVRSNLLFFRSRGDSGRW

SEQ ID NO: 1244101 - protein, 30 aa, Mycobacterium
LTVYVRRGQRISGVLAYVAVCDVLRRHGFH

SEQ ID NO: 1244102 - protein, 22 aa, Mycobacterium
LTWIKPREAWLMDRATVQPGAQ

SEQ ID NO: 1244103 - protein, 18 aa, Mycobacterium
LVAARLLARDSLVKTALF

SEQ ID NO: 1244104 - protein, 20 aa, Mycobacterium
LVAEVARGMVARGRGAIVNI

SEQ ID NO: 1244105 - protein, 25 aa, Mycobacterium
LVAGPILLAGYGFRTDARAHREIGA

SEQ ID NO: 1244106 - protein, 18 aa, Mycobacterium
LVAGVPGKVRRELSEAEV

SEQ ID NO: 1244107 - protein, 18 aa, Mycobacterium
LVALGMRAIVGGYAGRVR

SEQ ID NO: 1244108 - protein, 24 aa, Mycobacterium
LVALRRLICERFITEPGYRFVEMP

SEQ ID NO: 1244109 - protein, 24 aa, Mycobacterium
LVARAVDLVQLFPAAAYGKNGADI

SEQ ID NO: 1244110 - protein, 17 aa, Mycobacterium
LVARRGEVVTCQPFAGS

SEQ ID NO: 1244111 - protein, 25 aa, Mycobacterium
LVCGGRLGPSLSDPGRRSVAKTLAK

SEQ ID NO: 1244112 - protein, 17 aa, Mycobacterium
LVCGPLFGTVYLAIPAL

SEQ ID NO: 1244113 - protein, 18 aa, Mycobacterium
LVDACRLSRARVVVTPHR

SEQ ID NO: 1244114 - protein, 23 aa, Mycobacterium
LVDARTIVTLSGFAPPTLHAMGI

SEQ ID NO: 1244115 - protein, 22 aa, Mycobacterium
LVDEAFRHFKALGVLPQGTDLL

SEQ ID NO: 1244116 - protein, 19 aa, Mycobacterium
LVDKFKASSGIDLTKDKMA

SEQ ID NO: 1244117 - protein, 23 aa, Mycobacterium
LVDPRILTGALLYIPLLTRMLMN

SEQ ID NO: 1244118 - protein, 20 aa, Mycobacterium
LVDPRVVDGTAWITGADAPN

SEQ ID NO: 1244119 - protein, 18 aa, Mycobacterium
LVDSGYLVPHWPKPWGRA

SEQ ID NO: 1244120 - protein, 17 aa, Mycobacterium
LVDTLVCQFGRSHQGFI

SEQ ID NO: 1244121 - protein, 28 aa, Mycobacterium
LVEHFILEEKWGRWIGRWTAEEHLHAVA

SEQ ID NO: 1244122 - protein, 18 aa, Mycobacterium
LVEIGRLAGVDALHPGWR

SEQ ID NO: 1244123 - protein, 24 aa, Mycobacterium
LVEIPGRRPLRVAVDAGNGMAGHT

SEQ ID NO: 1244124 - protein, 19 aa, Mycobacterium
LVELLGPRAIVTVRAGDER

SEQ ID NO: 1244125 - protein, 22 aa, Mycobacterium
LVERLIPDFLWISTEYTAKLSL

SEQ ID NO: 1244126 - protein, 23 aa, Mycobacterium
LVESRLDCHLVHLGTMGVYGYET

SEQ ID NO: 1244127 - protein, 17 aa, Mycobacterium
LVETGMAPFFPLVVVVW

SEQ ID NO: 1244128 - protein, 19 aa, Mycobacterium
LVGAGRFDFITDFGAQMPM

SEQ ID NO: 1244129 - protein, 24 aa, Mycobacterium
LVGAIANWRLFSILLRSLNIPLES

SEQ ID NO: 1244130 - protein, 17 aa, Mycobacterium
LVGAPWFALSERNSPGS

SEQ ID NO: 1244131 - protein, 18 aa, Mycobacterium
LVGCPHLSPRWDDDENGP

SEQ ID NO: 1244132 - protein, 24 aa, Mycobacterium
LVGDRWTLLIVRELLDRPRRYGDL

SEQ ID NO: 1244133 - protein, 18 aa, Mycobacterium
LVGHDWGAAVAWGVAAEM

SEQ ID NO: 1244134 - protein, 19 aa, Mycobacterium
LVGLTGITFTNVFNACATA

SEQ ID NO: 1244135 - protein, 17 aa, Mycobacterium
LVGRNVLYGRWTFQIVE

SEQ ID NO: 1244136 - protein, 17 aa, Mycobacterium
LVGTFTVLLAENIAPDA

SEQ ID NO: 1244137 - protein, 25 aa, Mycobacterium
LVGWSYGALIAVQWAARHPSRVAGV

SEQ ID NO: 1244138 - protein, 19 aa, Mycobacterium
LVHAWDYATAIGHTVPAPD

SEQ ID NO: 1244139 - protein, 17 aa, Mycobacterium
LVHCGRLSVEKHAHRSI

SEQ ID NO: 1244140 - protein, 19 aa, Mycobacterium
LVHHCHREQWPVAGPVLGR

SEQ ID NO: 1244141 - protein, 25 aa, Mycobacterium
LVHQRRLLPLIARSYALQFAQNELV

SEQ ID NO: 1244142 - protein, 17 aa, Mycobacterium
LVHRAHCPVAVIHDEAP

SEQ ID NO: 1244143 - protein, 31 aa, Mycobacterium
LVHYTRTPDEFSWRAGEVLDAIAKGAITVTV

SEQ ID NO: 1244144 - protein, 20 aa, Mycobacterium
LVIAPDCEDLVEFSIDAAVS

SEQ ID NO: 1244145 - protein, 23 aa, Mycobacterium
LVIDGWPAFVAEFPDLEPVVQDL

SEQ ID NO: 1244146 - protein, 18 aa, Mycobacterium
LVKALLFSLFEGGLRHGL

SEQ ID NO: 1244147 - protein, 21 aa, Mycobacterium
LVKELGGLSVILGAATGAERA

SEQ ID NO: 1244148 - protein, 17 aa, Mycobacterium
LVKGMRVAVAAEVTRTY

SEQ ID NO: 1244149 - protein, 24 aa, Mycobacterium
LVLDGLRLAARVVEAERAIVYVSD

SEQ ID NO: 1244150 - protein, 27 aa, Mycobacterium
LVLDTDLRWRIVTALAASGDIDADGPE

SEQ ID NO: 1244151 - protein, 25 aa, Mycobacterium
LVLLRSMGIPARYVSGYLHPRKDAA

SEQ ID NO: 1244152 - protein, 18 aa, Mycobacterium
LVLPRLDAQTALDLIERE

SEQ ID NO: 1244153 - protein, 19 aa, Mycobacterium
LVLREVGLDVLGTARRVVV

SEQ ID NO: 1244154 - protein, 32 aa, Mycobacterium
LVLVPAKGVERWLSQRLSHVLGRGSGDDGVCA

SEQ ID NO: 1244155 - protein, 19 aa, Mycobacterium
LVLYGSAIATQFLETFKEF

SEQ ID NO: 1244156 - protein, 34 aa, Mycobacterium
LVNAPAVLGWERWREIGAHYGLGVIEAMLAQAIA

SEQ ID NO: 1244157 - protein, 19 aa, Mycobacterium
LVPGVVWVQPHYVTSFPHH

SEQ ID NO: 1244158 - protein, 18 aa, Mycobacterium
LVPRCERQQKYLSVRAGN

SEQ ID NO: 1244159 - protein, 27 aa, Mycobacterium
LVQLTRKRLGTGLIEAFSTPCPHCAGR

SEQ ID NO: 1244160 - protein, 23 aa, Mycobacterium
LVQNICFLYHLLGGGTGDWDVPV

SEQ ID NO: 1244161 - protein, 22 aa, Mycobacterium
LVQRARRIERFLSQNMMAAEQF

SEQ ID NO: 1244162 - protein, 23 aa, Mycobacterium
LVRLGEIEGVFTLPEPLPAKMLF

SEQ ID NO: 1244163 - protein, 18 aa, Mycobacterium
LVRPDQFVAASIPLRDNV

SEQ ID NO: 1244164 - protein, 24 aa, Mycobacterium
LVRPEVMAGTGFLGAHADEVYRLE

SEQ ID NO: 1244165 - protein, 24 aa, Mycobacterium
LVRQALRMRPDRIVVGEVRGAEVV

SEQ ID NO: 1244166 - protein, 22 aa, Mycobacterium
LVRQLSELGARVVGLDMRRPAA

SEQ ID NO: 1244167 - protein, 18 aa, Mycobacterium
LVRRMHHGGDFVIDPLPN

SEQ ID NO: 1244168 - protein, 26 aa, Mycobacterium
LVRSGLPFGTCLRATYLHPCGTDEFK

SEQ ID NO: 1244169 - protein, 19 aa, Mycobacterium
LVRVLTSLLLFPGGDEGEE

SEQ ID NO: 1244170 - protein, 20 aa, Mycobacterium
LVRWRHPTRGLLLPESFIGV

SEQ ID NO: 1244171 - protein, 26 aa, Mycobacterium
LVSARGIEIGHIFQLGRKYTEAFSAD

SEQ ID NO: 1244172 - protein, 17 aa, Mycobacterium
LVSDIGERVYLREESTG

SEQ ID NO: 1244173 - protein, 26 aa, Mycobacterium
LVSDWTQAWAPRGDRRPLPLPLQNML

SEQ ID NO: 1244174 - protein, 17 aa, Mycobacterium
LVSEAMHALGIPTTRSL

SEQ ID NO: 1244175 - protein, 22 aa, Mycobacterium
LVSGRASFELTQKAVMAGIPVL

SEQ ID NO: 1244176 - protein, 19 aa, Mycobacterium
LVSKKHWQSVASYVSDDAP

SEQ ID NO: 1244177 - protein, 17 aa, Mycobacterium
LVSLLLMILPHLALAPY

SEQ ID NO: 1244178 - protein, 23 aa, Mycobacterium
LVSPRLDPGVPVFSLGRYAGPRR

SEQ ID NO: 1244179 - protein, 17 aa, Mycobacterium
LVSRWSSYFPPAPAEAL

SEQ ID NO: 1244180 - protein, 17 aa, Mycobacterium
LVSVYAPGCSPMDFHAV

SEQ ID NO: 1244181 - protein, 18 aa, Mycobacterium
LVTGVFVYVAFVIDAYAG

SEQ ID NO: 1244182 - protein, 27 aa, Mycobacterium
LVTPEVVRRLCWDWQPVTDIAAAVEEF

SEQ ID NO: 1244183 - protein, 26 aa, Mycobacterium
LVVGPAAWWHAWARADWDRLAGAVVA

SEQ ID NO: 1244184 - protein, 19 aa, Mycobacterium
LVVIDGKVVAGALRMPAEI

SEQ ID NO: 1244185 - protein, 23 aa, Mycobacterium
LVVKCAPGVDFGALRRLGFTGEI

SEQ ID NO: 1244186 - protein, 24 aa, Mycobacterium
LVVKRELPKPGSGNVYDLTDDGRA

SEQ ID NO: 1244187 - protein, 23 aa, Mycobacterium
LWAATLLRRRGASATAVLLNPDR

SEQ ID NO: 1244188 - protein, 18 aa, Mycobacterium
LWDGRASIDLAVATGAQW

SEQ ID NO: 1244189 - protein, 18 aa, Mycobacterium
LWGLLIPIRRAFRQYVNL

SEQ ID NO: 1244190 - protein, 19 aa, Mycobacterium
LWINAPRPMLVTAATDDLS

SEQ ID NO: 1244191 - protein, 27 aa, Mycobacterium
LWKAGPALACGNAFILKPSERDPSVPV

SEQ ID NO: 1244192 - protein, 25 aa, Mycobacterium
LWLCEAAHLPVIWATQVLESLAKSG

SEQ ID NO: 1244193 - protein, 20 aa, Mycobacterium
LWLVHRFKADAVYYVTPTDD

SEQ ID NO: 1244194 - protein, 21 aa, Mycobacterium
LWQLKATRLPSPVTEAAMASI

SEQ ID NO: 1244195 - protein, 19 aa, Mycobacterium
LWQQLARRISGLGHRPSTA

SEQ ID NO: 1244196 - protein, 18 aa, Mycobacterium
LWSAPIKEFPTLKIALSE

SEQ ID NO: 1244197 - protein, 21 aa, Mycobacterium
LWWKNAVFYCADIETFYDWNG

SEQ ID NO: 1244198 - protein, 24 aa, Mycobacterium
LWYEIGRLPLRWEDDTAADITADY

SEQ ID NO: 1244199 - protein, 19 aa, Mycobacterium
LYAGGFAGICFPKEYGGLG

SEQ ID NO: 1244200 - protein, 27 aa, Mycobacterium
LYAHEGRLKYCYNFLGIEYYYVTAEAP

SEQ ID NO: 1244201 - protein, 32 aa, Mycobacterium
LYEAKTTFGRIGVKVWIYKGDIVGGKRELTAA

SEQ ID NO: 1244202 - protein, 24 aa, Mycobacterium
LYELLKLRVEVFVVEQACPYPELD

SEQ ID NO: 1244203 - protein, 21 aa, Mycobacterium
LYELPHGVALADVLTWHGISP

SEQ ID NO: 1244204 - protein, 24 aa, Mycobacterium
LYEQARARQAWIAATRDIATEMLS

SEQ ID NO: 1244205 - protein, 27 aa, Mycobacterium
LYEQLGPRPASPWAQALRLALIDAAPE

SEQ ID NO: 1244206 - protein, 23 aa, Mycobacterium
LYGPGSTAWRLQLRQVDRLVESV

SEQ ID NO: 1244207 - protein, 25 aa, Mycobacterium
LYIQLYLGGFGLELEDIQALRTFKS

SEQ ID NO: 1244208 - protein, 20 aa, Mycobacterium
LYKWSYKLSPLVASDLVMDC

SEQ ID NO: 1244209 - protein, 20 aa, Mycobacterium
LYLADRKSFMIISGGVNIYP

SEQ ID NO: 1244210 - protein, 26 aa, Mycobacterium
LYLRMDEFPARLVIVPGERDRLLQSG

SEQ ID NO: 1244211 - protein, 21 aa, Mycobacterium
LYMAGSRLGFETNIVQLHQVL

SEQ ID NO: 1244212 - protein, 18 aa, Mycobacterium
LYMATVIDCFSGRVAGWA

SEQ ID NO: 1244213 - protein, 28 aa, Mycobacterium
LYMDRYPLVSALSRPLIVKHLVDAAREH

SEQ ID NO: 1244214 - protein, 29 aa, Mycobacterium
LYMEVLRVVRFWISHGVKVFRVDNPHTKP

SEQ ID NO: 1244215 - protein, 21 aa, Mycobacterium
LYPLVRKSFRIGTENYSLKSL

SEQ ID NO: 1244216 - protein, 17 aa, Mycobacterium
LYPSLLNDPSIQRVLHL

SEQ ID NO: 1244217 - protein, 24 aa, Mycobacterium
LYRDFRPVAVLDWEMATLGPREMD

SEQ ID NO: 1244218 - protein, 18 aa, Mycobacterium
LYRHFRKKHDILAQAISE

SEQ ID NO: 1244219 - protein, 18 aa, Mycobacterium
LYRRAGDRLVLISVGGIE

SEQ ID NO: 1244220 - protein, 23 aa, Mycobacterium
LYRRPANTFVAGFIGSPSMNLVP

SEQ ID NO: 1244221 - protein, 29 aa, Mycobacterium
LYSCGAEVKALYPLGPIFHGSGLNITVMS

SEQ ID NO: 1244222 - protein, 26 aa, Mycobacterium
LYTKCAELGLPLCINTGLPGPPIPGE

SEQ ID NO: 1244223 - protein, 18 aa, Mycobacterium
LYVTGRLADLIVIDGRGH

SEQ ID NO: 1244224 - protein, 28 aa, Mycobacterium
LYVVGRKALSYYSFRNWDVTESWSGFSE

SEQ ID NO: 1244225 - protein, 17 aa, Mycobacterium
LYWCHDARGVLCHVIAE

SEQ ID NO: 1244226 - protein, 19 aa, Mycobacterium
MAAAEAMAAEARRKYQAKL

SEQ ID NO: 1244227 - protein, 22 aa, Mycobacterium
MAAALDECFDQIAAIQRAARLD

SEQ ID NO: 1244228 - protein, 18 aa, Mycobacterium
MAADAGLTSSSWARGPHH

SEQ ID NO: 1244229 - protein, 17 aa, Mycobacterium
MAADMAVDFRGTPVHTV

SEQ ID NO: 1244230 - protein, 17 aa, Mycobacterium
MAAELGSDVPFALHGGT

SEQ ID NO: 1244231 - protein, 19 aa, Mycobacterium
MAAGGRAVFELAPQGAAGE

SEQ ID NO: 1244232 - protein, 18 aa, Mycobacterium
MAARLAGGAPVYAYEFND

SEQ ID NO: 1244233 - protein, 19 aa, Mycobacterium
MADAAEALAEFEVAFEVGV

SEQ ID NO: 1244234 - protein, 20 aa, Mycobacterium
MADVPGWRVVEPVDEPTAIT

SEQ ID NO: 1244235 - protein, 25 aa, Mycobacterium
MADWLEAFVPLRVHVLVRFGRWDDL

SEQ ID NO: 1244236 - protein, 18 aa, Mycobacterium
MAEAGLPKGVLSVLPTSS

SEQ ID NO: 1244237 - protein, 26 aa, Mycobacterium
MAEALRVIFPAGFAERIGPRAVNELA

SEQ ID NO: 1244238 - protein, 17 aa, Mycobacterium
MAECGFCADGDQEKLLA

SEQ ID NO: 1244239 - protein, 18 aa, Mycobacterium
MAEIRAIADRVVVLRDGG

SEQ ID NO: 1244240 - protein, 19 aa, Mycobacterium
MAERKRWGTGYFQQQATRP

SEQ ID NO: 1244241 - protein, 17 aa, Mycobacterium
MAERLWENSLELLGERA

SEQ ID NO: 1244242 - protein, 20 aa, Mycobacterium
MAETVARRGGLVVLPQDLPI

SEQ ID NO: 1244243 - protein, 22 aa, Mycobacterium
MAFYNMGLRLLRHVYDAQQAGR

SEQ ID NO: 1244244 - protein, 24 aa, Mycobacterium
MAGFPVTVKGLSRFTDPAESRAAL

SEQ ID NO: 1244245 - protein, 25 aa, Mycobacterium
MAGGPAMPPPPMPLGPPPTPSPAAP

SEQ ID NO: 1244246 - protein, 19 aa, Mycobacterium
MAIPEEYGGAGIDDYRYNV

SEQ ID NO: 1244247 - protein, 17 aa, Mycobacterium
MALLAIGFEGVEHMPLL

SEQ ID NO: 1244248 - protein, 27 aa, Mycobacterium
MALRLLRPKQVIMLGRPTLHRPVSALL

SEQ ID NO: 1244249 - protein, 17 aa, Mycobacterium
MAMGNPDPMGFVDASDV

SEQ ID NO: 1244250 - protein, 23 aa, Mycobacterium
MAQAFPASRFTGIDFSDEGLGVG

SEQ ID NO: 1244251 - protein, 25 aa, Mycobacterium
MARVFPNLFATHRVRAVDDYASHLL

SEQ ID NO: 1244252 - protein, 21 aa, Mycobacterium
MASAVGAAFRDRGFATGTVVA

SEQ ID NO: 1244253 - protein, 17 aa, Mycobacterium
MASEYRALSGLPGVENA

SEQ ID NO: 1244254 - protein, 23 aa, Mycobacterium
MASGEMIGAIAMTEPGTGSDLQS

SEQ ID NO: 1244255 - protein, 18 aa, Mycobacterium
MASMQLAGIVMDRNDFQR

SEQ ID NO: 1244256 - protein, 20 aa, Mycobacterium
MATGDVIGCFGLTEPDFGSN

SEQ ID NO: 1244257 - protein, 20 aa, Mycobacterium
MATGEIRATMALTEPGGGSD

SEQ ID NO: 1244258 - protein, 23 aa, Mycobacterium
MATGETRGAFSMSEPELGSDVAA

SEQ ID NO: 1244259 - protein, 21 aa, Mycobacterium
MAVIDLGSRRRTLLFLRADSL

SEQ ID NO: 1244260 - protein, 18 aa, Mycobacterium
MCAEIRRVAAKGCRAVTM

SEQ ID NO: 1244261 - protein, 23 aa, Mycobacterium
MCDRLTYMRLMLPALAQKVDATV

SEQ ID NO: 1244262 - protein, 19 aa, Mycobacterium
MCEFAAARPGMLGLQTALS

SEQ ID NO: 1244263 - protein, 19 aa, Mycobacterium
MCEQGYWWGLVTYDIAYGA

SEQ ID NO: 1244264 - protein, 19 aa, Mycobacterium
MCGNGVRVFAHYLRAADLE

SEQ ID NO: 1244265 - protein, 25 aa, Mycobacterium
MCSESVWWRCHRRLVADVAVLRFSA

SEQ ID NO: 1244266 - protein, 30 aa, Mycobacterium
MCTVGDPLLDLGWMLICWPHDPNPIDAGSE

SEQ ID NO: 1244267 - protein, 19 aa, Mycobacterium
MDAFQEFYHAPVLHANQSP

SEQ ID NO: 1244268 - protein, 17 aa, Mycobacterium
MDDLSFRLGNRALGNPD

SEQ ID NO: 1244269 - protein, 32 aa, Mycobacterium
MDEERRTTLNLKACIKAAADRVVFINTGFLDR

SEQ ID NO: 1244270 - protein, 18 aa, Mycobacterium
MDERVHHLFARMPDAKVH

SEQ ID NO: 1244271 - protein, 17 aa, Mycobacterium
MDGARLWNAAAALGVPF

SEQ ID NO: 1244272 - protein, 17 aa, Mycobacterium
MDGCTFIRGHARFEDPH

SEQ ID NO: 1244273 - protein, 21 aa, Mycobacterium
MDGNGRWATQRGLGRTEGHKM

SEQ ID NO: 1244274 - protein, 20 aa, Mycobacterium
MDHGELRSDLDIDVVLDTLY

SEQ ID NO: 1244275 - protein, 22 aa, Mycobacterium
MDLPEPRTLCLAISQSGETADV

SEQ ID NO: 1244276 - protein, 21 aa, Mycobacterium
MDLYPMARRVLLTAYADTHAA

SEQ ID NO: 1244277 - protein, 19 aa, Mycobacterium
MDMRWKFQSERLGEHASLG

SEQ ID NO: 1244278 - protein, 26 aa, Mycobacterium
MDPQHRLLLETAWRAVEHSGTAPTDL

SEQ ID NO: 1244279 - protein, 26 aa, Mycobacterium
MDPQQRLLLEVAWEALEHAGIPAASL

SEQ ID NO: 1244280 - protein, 26 aa, Mycobacterium
MDPQQRLLLEVAWEALEHAGITPDRI

SEQ ID NO: 1244281 - protein, 27 aa, Mycobacterium
MDPQQRLLMEVSWEALEHAGIPAQNLR

SEQ ID NO: 1244282 - protein, 27 aa, Mycobacterium
MDPQQRVALRLAWRALENSGINPDDLA

SEQ ID NO: 1244283 - protein, 21 aa, Mycobacterium
MDQYFARFGGIRDYLRDVVDQ

SEQ ID NO: 1244284 - protein, 20 aa, Mycobacterium
MDRWTPAEIEAHLKYMEDFA

SEQ ID NO: 1244285 - protein, 25 aa, Mycobacterium
MDSRLWRMLLAPGRGIGKLVTGAVG

SEQ ID NO: 1244286 - protein, 22 aa, Mycobacterium
MDVPLRVAVMGCVVNGPGEARE

SEQ ID NO: 1244287 - protein, 17 aa, Mycobacterium
MEARVALTELVKRIRGY

SEQ ID NO: 1244288 - protein, 18 aa, Mycobacterium
MEDTEAFAKLIVDDDTGL

SEQ ID NO: 1244289 - protein, 17 aa, Mycobacterium
MEEVLLPVMYDIPSRDD

SEQ ID NO: 1244290 - protein, 21 aa, Mycobacterium
MEKLRRVPGWIHLYRAAEALG

SEQ ID NO: 1244291 - protein, 17 aa, Mycobacterium
MEMLDAFGIPHAGAPGY

SEQ ID NO: 1244292 - protein, 17 aa, Mycobacterium
MENRWLPMKRTALALNH

SEQ ID NO: 1244293 - protein, 18 aa, Mycobacterium
MEPWDGPAAVCFTDGTVI

SEQ ID NO: 1244294 - protein, 26 aa, Mycobacterium
MERAAACPFAPPPRMLEMGAVRPLSR

SEQ ID NO: 1244295 - protein, 17 aa, Mycobacterium
MERLAPLGPVYQAGTLS

SEQ ID NO: 1244296 - protein, 17 aa, Mycobacterium
MERRLGEALGIYVDAMR

SEQ ID NO: 1244297 - protein, 17 aa, Mycobacterium
MESFPRSGGVLTVSNHS

SEQ ID NO: 1244298 - protein, 20 aa, Mycobacterium
MESSLAFYTGVLGMDIVFDV

SEQ ID NO: 1244299 - protein, 19 aa, Mycobacterium
MEVDAGGAAVLLRTMPLVV

SEQ ID NO: 1244300 - protein, 22 aa, Mycobacterium
MEVWLEPSLDGVILHYFLHAEP

SEQ ID NO: 1244301 - protein, 18 aa, Mycobacterium
MFDEARMFLVSAATAMAK

SEQ ID NO: 1244302 - protein, 19 aa, Mycobacterium
MFDSLLVYENFPPGGLVGG

SEQ ID NO: 1244303 - protein, 17 aa, Mycobacterium
MFEFAIRSLIPAGDVLD

SEQ ID NO: 1244304 - protein, 20 aa, Mycobacterium
MFEPGRPRGFVMFRCERDVW

SEQ ID NO: 1244305 - protein, 18 aa, Mycobacterium
MFGNRGIYHDGWTAVTKH

SEQ ID NO: 1244306 - protein, 19 aa, Mycobacterium
MFIFIGAEPRTDWLDGIVV

SEQ ID NO: 1244307 - protein, 17 aa, Mycobacterium
MFQYFTALTASRREHPT

SEQ ID NO: 1244308 - protein, 18 aa, Mycobacterium
MFSELRWPGDPAPDSGID

SEQ ID NO: 1244309 - protein, 20 aa, Mycobacterium
MGAAHARRLAAAGATVALND

SEQ ID NO: 1244310 - protein, 22 aa, Mycobacterium
MGADGAWTGSVWLTTEEAETAP

SEQ ID NO: 1244311 - protein, 27 aa, Mycobacterium
MGAGLPGGHGIKLRYSDPMLLDDVAAD

SEQ ID NO: 1244312 - protein, 23 aa, Mycobacterium
MGDLSRRRWWPLTEALTGERLQA

SEQ ID NO: 1244313 - protein, 17 aa, Mycobacterium
MGEKFPLKAGLVTSLGF

SEQ ID NO: 1244314 - protein, 19 aa, Mycobacterium
MGENCRRVSAAMRAGSAPA

SEQ ID NO: 1244315 - protein, 26 aa, Mycobacterium
MGFERVTLYGLPLVARRRVNYSQIDP

SEQ ID NO: 1244316 - protein, 22 aa, Mycobacterium
MGGAKAHYDGIVAFSQTDFTED

SEQ ID NO: 1244317 - protein, 19 aa, Mycobacterium
MGGDAPVAPLNVVAMANSL

SEQ ID NO: 1244318 - protein, 26 aa, Mycobacterium
MGGPARALVRAGFLAGDGLRRLAGTP

SEQ ID NO: 1244319 - protein, 31 aa, Mycobacterium
MGGWKTSGIGARFGGPEGLRKYCRVETVVAP

SEQ ID NO: 1244320 - protein, 17 aa, Mycobacterium
MGLARRAHLPVIVVGDI

SEQ ID NO: 1244321 - protein, 25 aa, Mycobacterium
MGLEGAVRLGLRKELEAIADDAERE

SEQ ID NO: 1244322 - protein, 21 aa, Mycobacterium
MGLQYLLLRSGPMTMPPSTLG

SEQ ID NO: 1244323 - protein, 24 aa, Mycobacterium
MGPEGRAAIGLGDGVVRVSVGLED

SEQ ID NO: 1244324 - protein, 25 aa, Mycobacterium
MGPLLRRSGVIFIRRNVAGDPLYKY

SEQ ID NO: 1244325 - protein, 25 aa, Mycobacterium
MGPTARAAEAIDVLRAIPGLQMLTV

SEQ ID NO: 1244326 - protein, 19 aa, Mycobacterium
MGPTLSFRGIDNAAYYRLV

SEQ ID NO: 1244327 - protein, 25 aa, Mycobacterium
MGRVPWDRFQTLGGIQYFFDTEFQL

SEQ ID NO: 1244328 - protein, 17 aa, Mycobacterium
MGTATEEMIRWTTPVKE

SEQ ID NO: 1244329 - protein, 26 aa, Mycobacterium
MGVSTCATCDGFFFRDQDIAVIGGGD

SEQ ID NO: 1244330 - protein, 18 aa, Mycobacterium
MGWPEYLVGVDFEGAQHW

SEQ ID NO: 1244331 - protein, 22 aa, Mycobacterium
MHDLAGRGWKLAGVTSDTALAA

SEQ ID NO: 1244332 - protein, 23 aa, Mycobacterium
MHISPARRISCPVGGNTPQYLVE

SEQ ID NO: 1244333 - protein, 18 aa, Mycobacterium
MHQMICAAVGTTRPCLVV

SEQ ID NO: 1244334 - protein, 19 aa, Mycobacterium
MHRWAIDRLTDMLIGLTGS

SEQ ID NO: 1244335 - protein, 18 aa, Mycobacterium
MIFDSVYDIYRGVVTYVR

SEQ ID NO: 1244336 - protein, 24 aa, Mycobacterium
MIHPVGACATAAVSVEEGVDKIRL

SEQ ID NO: 1244337 - protein, 17 aa, Mycobacterium
MIIDCALRADGWDSTLL

SEQ ID NO: 1244338 - protein, 17 aa, Mycobacterium
MIMEMLDAFGIPHAGAP

SEQ ID NO: 1244339 - protein, 23 aa, Mycobacterium
MIPPFMHGAAQWAAYNAVTMGGR

SEQ ID NO: 1244340 - protein, 20 aa, Mycobacterium
MIQDCVQLHGGIGVTWEHDL

SEQ ID NO: 1244341 - protein, 25 aa, Mycobacterium
MIQVSFPVECWKQPKVPDSGATTLD

SEQ ID NO: 1244342 - protein, 23 aa, Mycobacterium
MIRLLRLPIAVQRRVAAGVLSAG

SEQ ID NO: 1244343 - protein, 20 aa, Mycobacterium
MISAPWLTRRGEKLLDPLIG

SEQ ID NO: 1244344 - protein, 24 aa, Mycobacterium
MISTHLCQVLGFVAMEPPVHLDPV

SEQ ID NO: 1244345 - protein, 23 aa, Mycobacterium
MIYREVEGLPKGSVKAVIDAYGE

SEQ ID NO: 1244346 - protein, 23 aa, Mycobacterium
MKILGPEFLNRFPGRVVNTHPAL

SEQ ID NO: 1244347 - protein, 17 aa, Mycobacterium
MKPIPGKRPRKYLRVTL

SEQ ID NO: 1244348 - protein, 23 aa, Mycobacterium
MKPKMDVLDFWQIIKPELPGVRG

SEQ ID NO: 1244349 - protein, 17 aa, Mycobacterium
MKPQPWHPLPDGDVRPF

SEQ ID NO: 1244350 - protein, 18 aa, Mycobacterium
MKSGAVLVDIAIDQGGCF

SEQ ID NO: 1244351 - protein, 17 aa, Mycobacterium
MKSGDAVFLHLAATVAD

SEQ ID NO: 1244352 - protein, 20 aa, Mycobacterium
MKVLAAMAVQALDFARLSAD

SEQ ID NO: 1244353 - protein, 18 aa, Mycobacterium
MKWNMGWMNDTLAFISRD

SEQ ID NO: 1244354 - protein, 20 aa, Mycobacterium
MLALGARCRALLLAARGDLT

SEQ ID NO: 1244355 - protein, 22 aa, Mycobacterium
MLANSAFYYGVLRTMSEEDRPL

SEQ ID NO: 1244356 - protein, 19 aa, Mycobacterium
MLDAFGIPHAGAPGYEADD

SEQ ID NO: 1244357 - protein, 24 aa, Mycobacterium
MLDLFRALWQPGWTEFDGEFYPTP

SEQ ID NO: 1244358 - protein, 21 aa, Mycobacterium
MLDLGFLPDIERILRQTPDTR

SEQ ID NO: 1244359 - protein, 27 aa, Mycobacterium
MLDVLRFWLDLGIDGFRLDAVPYLFER

SEQ ID NO: 1244360 - protein, 18 aa, Mycobacterium
MLEAAVIAGLTSEGVDAL

SEQ ID NO: 1244361 - protein, 33 aa, Mycobacterium
MLEHGAEVWRWLERGAHLYVCGDAARMAKDVDA

SEQ ID NO: 1244362 - protein, 17 aa, Mycobacterium
MLELLLRELDVDPGDVV

SEQ ID NO: 1244363 - protein, 19 aa, Mycobacterium
MLETVWEGIERAGLSPADL

SEQ ID NO: 1244364 - protein, 29 aa, Mycobacterium
MLGDLRPLYRPGLVHIYHALTWGPLVREI

SEQ ID NO: 1244365 - protein, 19 aa, Mycobacterium
MLGPNGIGVLYGRRELLAE

SEQ ID NO: 1244366 - protein, 20 aa, Mycobacterium
MLGVALSAYEQWLADEAVSL

SEQ ID NO: 1244367 - protein, 19 aa, Mycobacterium
MLHQLRRAAPEIDFQAVND

SEQ ID NO: 1244368 - protein, 26 aa, Mycobacterium
MLIGRERPSRLVVCRDDDWRPQWRVD

SEQ ID NO: 1244369 - protein, 20 aa, Mycobacterium
MLLAEFDYDLNLTPSFPLLD

SEQ ID NO: 1244370 - protein, 30 aa, Mycobacterium
MLLDDGRLDEWLGLLAPDVRYTMPFPESST

SEQ ID NO: 1244371 - protein, 23 aa, Mycobacterium
MLLEVGGALPSVRVVPTGGDWVR

SEQ ID NO: 1244372 - protein, 18 aa, Mycobacterium
MLLGFPGHHAFTHRPTYR

SEQ ID NO: 1244373 - protein, 21 aa, Mycobacterium
MLLKIGWPAEDLAGYVDGERH

SEQ ID NO: 1244374 - protein, 25 aa, Mycobacterium
MLLQPGVLSLAWGSVVRQLAAGLGI

SEQ ID NO: 1244375 - protein, 25 aa, Mycobacterium
MLNELERTGGRYGLQTMCEGGGTAN

SEQ ID NO: 1244376 - protein, 31 aa, Mycobacterium
MLNQHAKWLSSSAHLSWRRPIASLNYLLTSH

SEQ ID NO: 1244377 - protein, 22 aa, Mycobacterium
MLQMGFAEDVERILSDTPEYKQ

SEQ ID NO: 1244378 - protein, 23 aa, Mycobacterium
MLRRQAPHLLPFRGDASLTPTDA

SEQ ID NO: 1244379 - protein, 23 aa, Mycobacterium
MLSQLNYRAAAYLNDGVAPRRHP

SEQ ID NO: 1244380 - protein, 26 aa, Mycobacterium
MLTCSIRPSGIWGRGDQTMFRKVFES

SEQ ID NO: 1244381 - protein, 23 aa, Mycobacterium
MLTMGLGGGYITSWVGDPAAVKE

SEQ ID NO: 1244382 - protein, 26 aa, Mycobacterium
MLVELRPDIDWDKGTTLRWIRDRIDA

SEQ ID NO: 1244383 - protein, 24 aa, Mycobacterium
MLYPEIVTKLVVWNIVGGVYGSFV

SEQ ID NO: 1244384 - protein, 17 aa, Mycobacterium
MMCDIRIASDRASFAES

SEQ ID NO: 1244385 - protein, 17 aa, Mycobacterium
MMRITLNVILRAVFGAD

SEQ ID NO: 1244386 - protein, 18 aa, Mycobacterium
MMRPPTWVCETVAELEAE

SEQ ID NO: 1244387 - protein, 25 aa, Mycobacterium
MMSQMAGQMGMPFGRGKNTRKNAKG

SEQ ID NO: 1244388 - protein, 18 aa, Mycobacterium
MMVGCKAIATLSSGYLNA

SEQ ID NO: 1244389 - protein, 18 aa, Mycobacterium
MNAGGVLATMNFPSFPGF

SEQ ID NO: 1244390 - protein, 17 aa, Mycobacterium
MNDPDIHSSVWDWDTAS

SEQ ID NO: 1244391 - protein, 25 aa, Mycobacterium
MNFPSFPGFAARLFATEDPDFSLAL

SEQ ID NO: 1244392 - protein, 17 aa, Mycobacterium
MNLGVRMVGKRVLGTFP

SEQ ID NO: 1244393 - protein, 28 aa, Mycobacterium
MNPNHYLAVAIDYLFTHRPDWPSATAVG

SEQ ID NO: 1244394 - protein, 19 aa, Mycobacterium
MPALHLLPLAGVLGEVPVL

SEQ ID NO: 1244395 - protein, 22 aa, Mycobacterium
MPDFHFERWDSFRAQAPRGIVY

SEQ ID NO: 1244396 - protein, 18 aa, Mycobacterium
MPEPMLARYIDAAEHAVG

SEQ ID NO: 1244397 - protein, 25 aa, Mycobacterium
MPFILRGAALLGIDSVLLPIGPRRE

SEQ ID NO: 1244398 - protein, 20 aa, Mycobacterium
MPGDYFALTADHLFGTIWSR

SEQ ID NO: 1244399 - protein, 22 aa, Mycobacterium
MPGETPSGIVHLMIEVENSDDV

SEQ ID NO: 1244400 - protein, 17 aa, Mycobacterium
MPHLRSGVRGDLHAHID

SEQ ID NO: 1244401 - protein, 17 aa, Mycobacterium
MPIAREVDSVINHGSTV

SEQ ID NO: 1244402 - protein, 18 aa, Mycobacterium
MPLAAAYTASKMAVEGFT

SEQ ID NO: 1244403 - protein, 20 aa, Mycobacterium
MPLKLFAGGNAKFWDPADID

SEQ ID NO: 1244404 - protein, 20 aa, Mycobacterium
MPLQAATQWDALSHVYYDDK

SEQ ID NO: 1244405 - protein, 22 aa, Mycobacterium
MPLSRLDALLVDQWDAMIDVNV

SEQ ID NO: 1244406 - protein, 20 aa, Mycobacterium
MPMVLWLRTTSAQAMKRALQ

SEQ ID NO: 1244407 - protein, 18 aa, Mycobacterium
MPPAPAVVAARRLWAMGF

SEQ ID NO: 1244408 - protein, 26 aa, Mycobacterium
MPPGDMPARIGSWYRERGLPAPDGPA

SEQ ID NO: 1244409 - protein, 20 aa, Mycobacterium
MPQVWAMRYTLERVTRGQDT

SEQ ID NO: 1244410 - protein, 20 aa, Mycobacterium
MPRHWCEDSYHLTHWTDMPR

SEQ ID NO: 1244411 - protein, 18 aa, Mycobacterium
MPSSDVDSALSWRDESSC

SEQ ID NO: 1244412 - protein, 19 aa, Mycobacterium
MPVTIRIPSFGGIGAVEHH

SEQ ID NO: 1244413 - protein, 17 aa, Mycobacterium
MPYVEACHHMYGGEYGQ

SEQ ID NO: 1244414 - protein, 18 aa, Mycobacterium
MQAIADAMGLYFELIAQR

SEQ ID NO: 1244415 - protein, 17 aa, Mycobacterium
MQDAIWRGVYYTPNGPR

SEQ ID NO: 1244416 - protein, 17 aa, Mycobacterium
MQFSSEFEWVAPSGRGL

SEQ ID NO: 1244417 - protein, 30 aa, Mycobacterium
MQKNAPKYTPEWVKTVAIWAESSHREVRYP

SEQ ID NO: 1244418 - protein, 23 aa, Mycobacterium
MQLARPGVGYGVLESRVESGRVD

SEQ ID NO: 1244419 - protein, 18 aa, Mycobacterium
MQMTPHLLIFGAPKSGKT

SEQ ID NO: 1244420 - protein, 24 aa, Mycobacterium
MRAAAWAMASPRRFALAEKALAAG

SEQ ID NO: 1244421 - protein, 23 aa, Mycobacterium
MRADSARFAWLLFRHPERAAFAA

SEQ ID NO: 1244422 - protein, 21 aa, Mycobacterium
MRAGARLFLERCASPDIHRIA

SEQ ID NO: 1244423 - protein, 17 aa, Mycobacterium
MRAGGTITHHHAVGADH

SEQ ID NO: 1244424 - protein, 17 aa, Mycobacterium
MRAIEPGGLVDQLLDED

SEQ ID NO: 1244425 - protein, 17 aa, Mycobacterium
MRAIVGFAAETGDANGD

SEQ ID NO: 1244426 - protein, 18 aa, Mycobacterium
MRALDALDLLPLPNRLDL

SEQ ID NO: 1244427 - protein, 22 aa, Mycobacterium
MRCGRARFVHGNVWDVECDIAV

SEQ ID NO: 1244428 - protein, 17 aa, Mycobacterium
MRDWPDYPFTYGGVDAA

SEQ ID NO: 1244429 - protein, 20 aa, Mycobacterium
MREDMVIMLAARKVPGALKW

SEQ ID NO: 1244430 - protein, 22 aa, Mycobacterium
MRELPTRGAGPVGITATHDDAI

SEQ ID NO: 1244431 - protein, 22 aa, Mycobacterium
MRELTEYVLGLGHRDIGLLTMR

SEQ ID NO: 1244432 - protein, 24 aa, Mycobacterium
MRERGVPFTEGFGMTETAPLVTVL

SEQ ID NO: 1244433 - protein, 25 aa, Mycobacterium
MRETFRAIGVDLMFDHIKISLHDFG

SEQ ID NO: 1244434 - protein, 19 aa, Mycobacterium
MRFHHPLMRAAAYRAADLA

SEQ ID NO: 1244435 - protein, 21 aa, Mycobacterium
MRFQEAMAALPQALRALPQPV

SEQ ID NO: 1244436 - protein, 25 aa, Mycobacterium
MRGPSSIWYRIRINLRHVPEEQRPP

SEQ ID NO: 1244437 - protein, 29 aa, Mycobacterium
MRGPTGPVWRTPLARDMKTAAALWELSEQ

SEQ ID NO: 1244438 - protein, 19 aa, Mycobacterium
MRHLRVDAWGLPTGATEEW

SEQ ID NO: 1244439 - protein, 17 aa, Mycobacterium
MRIGTMIKQLLEEVRAA

SEQ ID NO: 1244440 - protein, 24 aa, Mycobacterium
MRINGVNRLACKVLMRDMLPKNPK

SEQ ID NO: 1244441 - protein, 24 aa, Mycobacterium
MRKLDPRGVIVVMEAEHLCMAMRG

SEQ ID NO: 1244442 - protein, 18 aa, Mycobacterium
MRMADLQARVDMLRYALA

SEQ ID NO: 1244443 - protein, 21 aa, Mycobacterium
MRPGTIAIPQGWGHRGGGWTL

SEQ ID NO: 1244444 - protein, 20 aa, Mycobacterium
MRRAALGLATAIARELTART

SEQ ID NO: 1244445 - protein, 18 aa, Mycobacterium
MRRIVEARALSPITSVAG

SEQ ID NO: 1244446 - protein, 19 aa, Mycobacterium
MRRQIAADLGGRGWQRNRV

SEQ ID NO: 1244447 - protein, 25 aa, Mycobacterium
MRRRIDIACGLVVRPEVVFLDEPTT

SEQ ID NO: 1244448 - protein, 22 aa, Mycobacterium
MRRTRSHLVLRWMVDGYARGIG

SEQ ID NO: 1244449 - protein, 17 aa, Mycobacterium
MRRVLREVLTRDGRSAV

SEQ ID NO: 1244450 - protein, 21 aa, Mycobacterium
MRRYPDRYRLRSMVIRGESTE

SEQ ID NO: 1244451 - protein, 17 aa, Mycobacterium
MRSGAENQLRFSAPPRL

SEQ ID NO: 1244452 - protein, 18 aa, Mycobacterium
MRSGLYSYADDPGFAATL

SEQ ID NO: 1244453 - protein, 17 aa, Mycobacterium
MRTICDRIAEFPGPVVA

SEQ ID NO: 1244454 - protein, 18 aa, Mycobacterium
MRVARILAGRRGDFDVVH

SEQ ID NO: 1244455 - protein, 22 aa, Mycobacterium
MRVPLEGGGRLVVELTPDEAAA

SEQ ID NO: 1244456 - protein, 17 aa, Mycobacterium
MRVVRDLDALAGEVQAA

SEQ ID NO: 1244457 - protein, 19 aa, Mycobacterium
MRWGGARGGIAVHDALSRG

SEQ ID NO: 1244458 - protein, 26 aa, Mycobacterium
MRWTPGDEVLLRLFGKFVELAFVAVP

SEQ ID NO: 1244459 - protein, 17 aa, Mycobacterium
MSADLALLTDPWQPAVL

SEQ ID NO: 1244460 - protein, 17 aa, Mycobacterium
MSALSRMSRGEHRSITL

SEQ ID NO: 1244461 - protein, 33 aa, Mycobacterium
MSDEEWDAVIAVHLRGHFLLTRNAATYWRAKAK

SEQ ID NO: 1244462 - protein, 18 aa, Mycobacterium
MSFLERRPAVFPPLDDHP

SEQ ID NO: 1244463 - protein, 17 aa, Mycobacterium
MSFSVAEGELFSIVGPS

SEQ ID NO: 1244464 - protein, 17 aa, Mycobacterium
MSGSTWAPIFASCGNNN

SEQ ID NO: 1244465 - protein, 32 aa, Mycobacterium
MSIESLYEYGSRAGLWRVLRVFERRGLPLTVF

SEQ ID NO: 1244466 - protein, 25 aa, Mycobacterium
MSKAFAFAGGRLGYLVAAPAVIEAM

SEQ ID NO: 1244467 - protein, 23 aa, Mycobacterium
MSKAGLGLLGFDVGLPRLPQIPP

SEQ ID NO: 1244468 - protein, 18 aa, Mycobacterium
MSKMWPRKLADLKSGLEH

SEQ ID NO: 1244469 - protein, 21 aa, Mycobacterium
MSLRSLPLVMVIGQPEVRIPT

SEQ ID NO: 1244470 - protein, 19 aa, Mycobacterium
MSLVRELFETNTFGVMAMT

SEQ ID NO: 1244471 - protein, 19 aa, Mycobacterium
MSPEVPLMTAIGAAAADCL

SEQ ID NO: 1244472 - protein, 20 aa, Mycobacterium
MSQNVWKKVAPAIADTGRYE

SEQ ID NO: 1244473 - protein, 24 aa, Mycobacterium
MSRELGIQYARQGIRVNALCPGPV

SEQ ID NO: 1244474 - protein, 25 aa, Mycobacterium
MSRSSPRVGDGFIRLDGAGNVVFAS

SEQ ID NO: 1244475 - protein, 19 aa, Mycobacterium
MSSQRGWVFLATDLTEGDH

SEQ ID NO: 1244476 - protein, 27 aa, Mycobacterium
MSSRGYRAMAGIPRLQFAHVDLLVRSF

SEQ ID NO: 1244477 - protein, 20 aa, Mycobacterium
MSSYGFLRNRLDGSIEQPTV

SEQ ID NO: 1244478 - protein, 22 aa, Mycobacterium
MSTVLGRRLWEAAGTPDIDPRR

SEQ ID NO: 1244479 - protein, 19 aa, Mycobacterium
MSVADALGFFADGEAATPA

SEQ ID NO: 1244480 - protein, 20 aa, Mycobacterium
MSVASGYAPRAIVTPIVGAV

SEQ ID NO: 1244481 - protein, 19 aa, Mycobacterium
MSVIRPGKDAHRIVAMADS

SEQ ID NO: 1244482 - protein, 17 aa, Mycobacterium
MSVPGGFAALESTWQIV

SEQ ID NO: 1244483 - protein, 25 aa, Mycobacterium
MSVSCTRIDVDWVIVPGGEVRRLLR

SEQ ID NO: 1244484 - protein, 19 aa, Mycobacterium
MSYAGRSRASLPFLDEVAA

SEQ ID NO: 1244485 - protein, 25 aa, Mycobacterium
MTADDRILAVLPFFHIYGMTVLLNA

SEQ ID NO: 1244486 - protein, 17 aa, Mycobacterium
MTAIGAAAADCLARAVM

SEQ ID NO: 1244487 - protein, 17 aa, Mycobacterium
MTCFLTPDGRPFFCGTY

SEQ ID NO: 1244488 - protein, 18 aa, Mycobacterium
MTEPHGGADPKVFTTTAV

SEQ ID NO: 1244489 - protein, 17 aa, Mycobacterium
MTFGQAVLDRERAGDPV

SEQ ID NO: 1244490 - protein, 26 aa, Mycobacterium
MTKVARFDSYRGFLFGSLNPDVVPLL

SEQ ID NO: 1244491 - protein, 17 aa, Mycobacterium
MTLTGRFLQYYRENANW

SEQ ID NO: 1244492 - protein, 18 aa, Mycobacterium
MTMLRRHCEHVLDTDALA

SEQ ID NO: 1244493 - protein, 20 aa, Mycobacterium
MTMYAGWRAVIAQFVADRIG

SEQ ID NO: 1244494 - protein, 22 aa, Mycobacterium
MTPGCTKEACHFRDLAAEFAAL

SEQ ID NO: 1244495 - protein, 17 aa, Mycobacterium
MTPVAYRRLQDELTELR

SEQ ID NO: 1244496 - protein, 22 aa, Mycobacterium
MTTAHAVLRWIGMDMGKLVDRP

SEQ ID NO: 1244497 - protein, 23 aa, Mycobacterium
MTTRPCPVCGGVGEVIPDPCHRC

SEQ ID NO: 1244498 - protein, 25 aa, Mycobacterium
MVAAIAVGLTRGWSPTKSVQFGVAT

SEQ ID NO: 1244499 - protein, 28 aa, Mycobacterium
MVAGPLLDDATRQWRLVNMKPTDLSDPG

SEQ ID NO: 1244500 - protein, 23 aa, Mycobacterium
MVAGTGCELHLVRPLGFDLSEPK

SEQ ID NO: 1244501 - protein, 18 aa, Mycobacterium
MVAREGRLRTALAELKQY

SEQ ID NO: 1244502 - protein, 23 aa, Mycobacterium
MVARLRPGGLLAVAALSEVGAAP

SEQ ID NO: 1244503 - protein, 21 aa, Mycobacterium
MVFPHLYGPLPAEAVRDVTPY

SEQ ID NO: 1244504 - protein, 30 aa, Mycobacterium
MVGKRVLGTFPYRDLYMLDAARQFVPVAAH

SEQ ID NO: 1244505 - protein, 22 aa, Mycobacterium
MVGRARTLRFVPLREDLFKARG

SEQ ID NO: 1244506 - protein, 18 aa, Mycobacterium
MVIYRISADQAFRVLQWR

SEQ ID NO: 1244507 - protein, 33 aa, Mycobacterium
MVPEAIVAMLACARLGVLHSVVFAGFSASALKA

SEQ ID NO: 1244508 - protein, 17 aa, Mycobacterium
MVPEALIAMLACARLGA

SEQ ID NO: 1244509 - protein, 18 aa, Mycobacterium
MVPFTIDDYTAWRLLEGL

SEQ ID NO: 1244510 - protein, 25 aa, Mycobacterium
MVQDFSALFPIEIISRMIGVPAEDR

SEQ ID NO: 1244511 - protein, 21 aa, Mycobacterium
MVVNRLPGLVVVDDADHPIAV

SEQ ID NO: 1244512 - protein, 27 aa, Mycobacterium
MVVVGSRGLGAWGRRLLGSVSTAVVHH

SEQ ID NO: 1244513 - protein, 20 aa, Mycobacterium
MVYECYCSRKDIAQAPRAPH

SEQ ID NO: 1244514 - protein, 20 aa, Mycobacterium
MWFTEAYWPAFRRVDFLRAL

SEQ ID NO: 1244515 - protein, 17 aa, Mycobacterium
MYCCLPLYHNNALTVAL

SEQ ID NO: 1244516 - protein, 22 aa, Mycobacterium
MYELGETLAWEQSRLSHQLRRM

SEQ ID NO: 1244517 - protein, 17 aa, Mycobacterium
MYFGAELVKVTPMDFLR

SEQ ID NO: 1244518 - protein, 31 aa, Mycobacterium
MYRRHLGVTPLEYLRRVRLDLAHRDLQAADP

SEQ ID NO: 1244519 - protein, 33 aa, Mycobacterium
NAAAFAFPTYILRGADLAGFLPQLTEPVLGTAE

SEQ ID NO: 1244520 - protein, 17 aa, Mycobacterium
NAAAVAVYEAWRQHGFA

SEQ ID NO: 1244521 - protein, 20 aa, Mycobacterium
NAAAVAWGMGAHVTVFDVNI

SEQ ID NO: 1244522 - protein, 19 aa, Mycobacterium
NAAGLGVDAVIFGAGCADP

SEQ ID NO: 1244523 - protein, 17 aa, Mycobacterium
NAARLAIDSGFDAVEVH

SEQ ID NO: 1244524 - protein, 23 aa, Mycobacterium
NAARLGLAGWPRAAEESIVIRDA

SEQ ID NO: 1244525 - protein, 24 aa, Mycobacterium
NAASLPSLMVLSGVSTADEVLRAV

SEQ ID NO: 1244526 - protein, 17 aa, Mycobacterium
NAEEAVWLVATVGADKI

SEQ ID NO: 1244527 - protein, 31 aa, Mycobacterium
NAFRRKEISVDEIMASPVLNYPLRQYMFCAP

SEQ ID NO: 1244528 - protein, 19 aa, Mycobacterium
NAGCVWINDHIPIISEMPH

SEQ ID NO: 1244529 - protein, 18 aa, Mycobacterium
NAGVYAFDITALRSALRR

SEQ ID NO: 1244530 - protein, 17 aa, Mycobacterium
NAGYTWDSVIQKMTDQQ

SEQ ID NO: 1244531 - protein, 18 aa, Mycobacterium
NAIALLIGSQVGVPGAMA

SEQ ID NO: 1244532 - protein, 24 aa, Mycobacterium
NAIIARVVARYGLTGTTAPYNAHW

SEQ ID NO: 1244533 - protein, 24 aa, Mycobacterium
NAILALAAVEAFFGAGAERQLDID

SEQ ID NO: 1244534 - protein, 23 aa, Mycobacterium
NAKARGATILGRIMGAAMTSDGY

SEQ ID NO: 1244535 - protein, 24 aa, Mycobacterium
NAKDCIQVLGGIGITWEHDAHLYL

SEQ ID NO: 1244536 - protein, 23 aa, Mycobacterium
NAKEIDLRFVFAYTPLEFRDTLY

SEQ ID NO: 1244537 - protein, 28 aa, Mycobacterium
NAKRYRLAELALRNKIPLVMLLEGAGFR

SEQ ID NO: 1244538 - protein, 19 aa, Mycobacterium
NALAPRLIAVVDQMEGIVG

SEQ ID NO: 1244539 - protein, 17 aa, Mycobacterium
NALERRGFLELETPMLQ

SEQ ID NO: 1244540 - protein, 17 aa, Mycobacterium
NALGTSTADAWKAVQDT

SEQ ID NO: 1244541 - protein, 21 aa, Mycobacterium
NAMADRALRQIAFEAPYVDAA

SEQ ID NO: 1244542 - protein, 19 aa, Mycobacterium
NANVAAPINAGVAANIGSV

SEQ ID NO: 1244543 - protein, 25 aa, Mycobacterium
NAPALKLFLGDSFEGIVTVEIVDGR

SEQ ID NO: 1244544 - protein, 22 aa, Mycobacterium
NAPEIVELMFGIWAAEAVIVPV

SEQ ID NO: 1244545 - protein, 21 aa, Mycobacterium
NAPHEVAGWWVRMLVTGVQPV

SEQ ID NO: 1244546 - protein, 19 aa, Mycobacterium
NAQLWRFVVLDAPDQRAAV

SEQ ID NO: 1244547 - protein, 20 aa, Mycobacterium
NAVEELMRYLSIIQNGQRRV

SEQ ID NO: 1244548 - protein, 18 aa, Mycobacterium
NAVLPRLAENYRVIAPDL

SEQ ID NO: 1244549 - protein, 19 aa, Mycobacterium
NCEIVPWCRFARKNYFYPD

SEQ ID NO: 1244550 - protein, 19 aa, Mycobacterium
NCELTWPSRPVAGGERVAG

SEQ ID NO: 1244551 - protein, 23 aa, Mycobacterium
NCQSILGYVVRWIDAGVGCSKVP

SEQ ID NO: 1244552 - protein, 17 aa, Mycobacterium
NCSPASLAVIKAQTYGD

SEQ ID NO: 1244553 - protein, 21 aa, Mycobacterium
NCVCPGFVATPMQSRELEWEA

SEQ ID NO: 1244554 - protein, 18 aa, Mycobacterium
NDAAVAWGGAAGAFELNV

SEQ ID NO: 1244555 - protein, 17 aa, Mycobacterium
NDALLFDGLPWVSRAQD

SEQ ID NO: 1244556 - protein, 25 aa, Mycobacterium
NDEQRKRWFPGLADGTLLTAIAMTE

SEQ ID NO: 1244557 - protein, 23 aa, Mycobacterium
NDGTLWCEKPMYIQLDFIVRRLA

SEQ ID NO: 1244558 - protein, 23 aa, Mycobacterium
NDIVAVLALYRPGPMGMNAHNDY

SEQ ID NO: 1244559 - protein, 24 aa, Mycobacterium
NDMSRWPELRAVLTKAFAEHDRDH

SEQ ID NO: 1244560 - protein, 24 aa, Mycobacterium
NDPDWQRFHLIGATNTVYFAMLAR

SEQ ID NO: 1244561 - protein, 35 aa, Mycobacterium
NDPEIRSCILTGAGGYFCAGMDLKAATAKPPGDSF

SEQ ID NO: 1244562 - protein, 25 aa, Mycobacterium
NDRDRLVVIIAGYRKDLDMFLDANE

SEQ ID NO: 1244563 - protein, 20 aa, Mycobacterium
NDRGACLAGAVIDDRLRRSV

SEQ ID NO: 1244564 - protein, 25 aa, Mycobacterium
NDSVSCPRSGEVIVRDGADWYSTGI

SEQ ID NO: 1244565 - protein, 17 aa, Mycobacterium
NDVGHALVAGHIDREAV

SEQ ID NO: 1244566 - protein, 23 aa, Mycobacterium
NDVIRAQLLSSFHDQRRLDAVER

SEQ ID NO: 1244567 - protein, 22 aa, Mycobacterium
NDYYDDMAWLALALERAGRLAG

SEQ ID NO: 1244568 - protein, 18 aa, Mycobacterium
NEAAFLYQLLVRSFGTNN

SEQ ID NO: 1244569 - protein, 22 aa, Mycobacterium
NEDEVDAFLDLVENELTRLIEE

SEQ ID NO: 1244570 - protein, 18 aa, Mycobacterium
NEECLRFESPIKGDFRLA

SEQ ID NO: 1244571 - protein, 27 aa, Mycobacterium
NEEGAICVKLPLPPGTLPTLWGDDDRY

SEQ ID NO: 1244572 - protein, 29 aa, Mycobacterium
NEGDVFCSVVRRVALPDAFFAIDGQTETF

SEQ ID NO: 1244573 - protein, 22 aa, Mycobacterium
NEGMALHGLDIFAADGAAQFRR

SEQ ID NO: 1244574 - protein, 26 aa, Mycobacterium
NEKRLFCRMAEVFAGFLSYTDAQIGR

SEQ ID NO: 1244575 - protein, 22 aa, Mycobacterium
NEKRPVMVWIHGGAFVNGSGGI

SEQ ID NO: 1244576 - protein, 17 aa, Mycobacterium
NELCDRVAFVVEGRIVA

SEQ ID NO: 1244577 - protein, 17 aa, Mycobacterium
NELREITDWEKPIYVKV

SEQ ID NO: 1244578 - protein, 22 aa, Mycobacterium
NEMLHAYPGPKIVAGHSQGAQV

SEQ ID NO: 1244579 - protein, 19 aa, Mycobacterium
NERGCVAIHTNMPIGRPPK

SEQ ID NO: 1244580 - protein, 36 aa, Mycobacterium
NEVPAEALAAVNLMSMFGLHRALRGAAVGHFASTEI

SEQ ID NO: 1244581 - protein, 19 aa, Mycobacterium
NFAQRPAIVFVTAHDDKAV

SEQ ID NO: 1244582 - protein, 23 aa, Mycobacterium
NFLNPRPGTPFGDLEVLPAAEAL

SEQ ID NO: 1244583 - protein, 24 aa, Mycobacterium
NFSYGTGVAELFPTVIAQAREAEE

SEQ ID NO: 1244584 - protein, 30 aa, Mycobacterium
NGAAMRALPIGWAVADDGLRRTVTTGLSRT

SEQ ID NO: 1244585 - protein, 22 aa, Mycobacterium
NGAMRQRAAWRRRGEIADVIDA

SEQ ID NO: 1244586 - protein, 23 aa, Mycobacterium
NGDLSPWAQRGVLLLNRVLTVRP

SEQ ID NO: 1244587 - protein, 25 aa, Mycobacterium
NGFIYFAGRLGDWMRVDGENLGTAP

SEQ ID NO: 1244588 - protein, 22 aa, Mycobacterium
NGFWRRPGYRSSDEVAAQLRAD

SEQ ID NO: 1244589 - protein, 23 aa, Mycobacterium
NGGGFPEFPLPLGNPQEATRSSM

SEQ ID NO: 1244590 - protein, 18 aa, Mycobacterium
NGGLLLRDLDLPDFRDYA

SEQ ID NO: 1244591 - protein, 27 aa, Mycobacterium
NGGLNCLVNACAHRGAMVCRRKTDNRM

SEQ ID NO: 1244592 - protein, 30 aa, Mycobacterium
NGGQTCMAWTRMLVPESRYGEALELVEAAA

SEQ ID NO: 1244593 - protein, 25 aa, Mycobacterium
NGHFYGVGLINWWDPKGTRSTLEEL

SEQ ID NO: 1244594 - protein, 17 aa, Mycobacterium
NGLAASYVSGYLATDPP

SEQ ID NO: 1244595 - protein, 18 aa, Mycobacterium
NGLANKWTFGPIGELWYR

SEQ ID NO: 1244596 - protein, 19 aa, Mycobacterium
NGLEVLRYGGLETGAVPSP

SEQ ID NO: 1244597 - protein, 18 aa, Mycobacterium
NGLGRALYSPVLADPRRP

SEQ ID NO: 1244598 - protein, 22 aa, Mycobacterium
NGMDARLYWPGLGEVTPDELVL

SEQ ID NO: 1244599 - protein, 20 aa, Mycobacterium
NGPGPWSGVVMYPDAGGVRP

SEQ ID NO: 1244600 - protein, 22 aa, Mycobacterium
NGPPPPSRWARRKPEAAARLEA

SEQ ID NO: 1244601 - protein, 24 aa, Mycobacterium
NGPVRFPGVPTWFSRTPGHVRGPA

SEQ ID NO: 1244602 - protein, 23 aa, Mycobacterium
NGQKLWASGGMHADWCLLLARTD

SEQ ID NO: 1244603 - protein, 22 aa, Mycobacterium
NGRGRITLYHGWESGMDNSPRW

SEQ ID NO: 1244604 - protein, 17 aa, Mycobacterium
NGRWGRPPNALVGIGVD

SEQ ID NO: 1244605 - protein, 23 aa, Mycobacterium
NGSARAWLFTVARNLVIDERRSA

SEQ ID NO: 1244606 - protein, 21 aa, Mycobacterium
NGVDGYFPGPARWATSALAAD

SEQ ID NO: 1244607 - protein, 25 aa, Mycobacterium
NGVTANVVVPGWIATAAQLPSEVVA

SEQ ID NO: 1244608 - protein, 17 aa, Mycobacterium
NGVYALGGGASRAVGAL

SEQ ID NO: 1244609 - protein, 17 aa, Mycobacterium
NGYKVYFEEGLQIIGPT

SEQ ID NO: 1244610 - protein, 20 aa, Mycobacterium
NHGRSRAVVMARDHDEAIKG

SEQ ID NO: 1244611 - protein, 24 aa, Mycobacterium
NHHSRWRTALIDSLQEAFFVCDED

SEQ ID NO: 1244612 - protein, 21 aa, Mycobacterium
NHLTMLASMLARFHATADRRA

SEQ ID NO: 1244613 - protein, 21 aa, Mycobacterium
NHTHVLLCLAQSGSLTARELS

SEQ ID NO: 1244614 - protein, 21 aa, Mycobacterium
NHYRPLVDHDKVLRVVALSGG

SEQ ID NO: 1244615 - protein, 24 aa, Mycobacterium
NIADHKCTYAFIAPPVAVALAKHP

SEQ ID NO: 1244616 - protein, 20 aa, Mycobacterium
NIDAELCATVAAGLGLEPPA

SEQ ID NO: 1244617 - protein, 17 aa, Mycobacterium
NIDRYHAAVARELDALR

SEQ ID NO: 1244618 - protein, 20 aa, Mycobacterium
NIPLTAHFLGGAAIGDSAEH

SEQ ID NO: 1244619 - protein, 18 aa, Mycobacterium
NIRPARRLSGAIPAVCPT

SEQ ID NO: 1244620 - protein, 18 aa, Mycobacterium
NITGSARFRNLIKAEDYD

SEQ ID NO: 1244621 - protein, 24 aa, Mycobacterium
NIYEPPRFFEAFLRGRAYTEPPDI

SEQ ID NO: 1244622 - protein, 18 aa, Mycobacterium
NKAYFIAAAFPSACGKTN

SEQ ID NO: 1244623 - protein, 23 aa, Mycobacterium
NKIPLVMLLEGAGFRPSGEHYGR

SEQ ID NO: 1244624 - protein, 21 aa, Mycobacterium
NKLDLCRELGAEVAINYRDED

SEQ ID NO: 1244625 - protein, 19 aa, Mycobacterium
NKNGLPWASAQLEDLTGGI

SEQ ID NO: 1244626 - protein, 25 aa, Mycobacterium
NKQRWGYKFRFGVFRIDDHDFETIR

SEQ ID NO: 1244627 - protein, 32 aa, Mycobacterium
NKVARFPKFDWPRIDAPFIRPGADMAALEAES

SEQ ID NO: 1244628 - protein, 25 aa, Mycobacterium
NKVPGARCALAWSVETAKLAREHNN

SEQ ID NO: 1244629 - protein, 24 aa, Mycobacterium
NKVSELPAGQGFNAATLEFGDLLA

SEQ ID NO: 1244630 - protein, 21 aa, Mycobacterium
NLELPSIYFAHRREVFARDGI

SEQ ID NO: 1244631 - protein, 21 aa, Mycobacterium
NLGAGLGKWSPDSGETIHDRL

SEQ ID NO: 1244632 - protein, 20 aa, Mycobacterium
NLHEGPVRHEGRFYRMNLVP

SEQ ID NO: 1244633 - protein, 21 aa, Mycobacterium
NLHRLPVAIARLARTRRISAR

SEQ ID NO: 1244634 - protein, 23 aa, Mycobacterium
NLIKDMFEEVFAASSDEARAKAF

SEQ ID NO: 1244635 - protein, 24 aa, Mycobacterium
NLKSPFWLVQALLPALRSAGTADD

SEQ ID NO: 1244636 - protein, 23 aa, Mycobacterium
NLLDDITAWGWAQAPPRRLVFAA

SEQ ID NO: 1244637 - protein, 19 aa, Mycobacterium
NLLGWPRDVLPFELAAETL

SEQ ID NO: 1244638 - protein, 22 aa, Mycobacterium
NLLQRTRCVYFQDVTTPCNKRS

SEQ ID NO: 1244639 - protein, 27 aa, Mycobacterium
NLNVAAPIDAAAGANVLSYGSGAQAVV

SEQ ID NO: 1244640 - protein, 28 aa, Mycobacterium
NLPARPVPRVSIFLSIFDAHVQRIPISG

SEQ ID NO: 1244641 - protein, 23 aa, Mycobacterium
NLRAHVRAATLLVPQWQARGRGH

SEQ ID NO: 1244642 - protein, 22 aa, Mycobacterium
NLRAIPRARIEVGTEAYDIDAR

SEQ ID NO: 1244643 - protein, 19 aa, Mycobacterium
NLRCPTCFTESSPDLRNVV

SEQ ID NO: 1244644 - protein, 21 aa, Mycobacterium
NLRIVFVEHAFSWILPLMWRM

SEQ ID NO: 1244645 - protein, 23 aa, Mycobacterium
NLRRFDEWLTIFGGWRSEVPAEI

SEQ ID NO: 1244646 - protein, 18 aa, Mycobacterium
NLRRLISLFEQLRERSQL

SEQ ID NO: 1244647 - protein, 27 aa, Mycobacterium
NLRSACSRRGLRIVAEVSIAQTAQDIN

SEQ ID NO: 1244648 - protein, 30 aa, Mycobacterium
NLVMGSNVQVVWEKFCRYFDVEPRYLPMED

SEQ ID NO: 1244649 - protein, 30 aa, Mycobacterium
NMADPGSVSYLFSRKGVITLEKNGLSEDDV

SEQ ID NO: 1244650 - protein, 23 aa, Mycobacterium
NMAHSVYYSLGWLNQMLRDGEWG

SEQ ID NO: 1244651 - protein, 20 aa, Mycobacterium
NMDALKRFHANLDHSLIGRR

SEQ ID NO: 1244652 - protein, 24 aa, Mycobacterium
NMDEGRWDSVIAVNLLAPLRLTEG

SEQ ID NO: 1244653 - protein, 21 aa, Mycobacterium
NMKPSVIRRLGLTYEALRKHN

SEQ ID NO: 1244654 - protein, 18 aa, Mycobacterium
NMSPEFGSTAAIFPIDDV

SEQ ID NO: 1244655 - protein, 29 aa, Mycobacterium
NMVTKRYWWHAWWWVPHAIIRGGVDKLHS

SEQ ID NO: 1244656 - protein, 19 aa, Mycobacterium
NNDFNYKKMDPFGYACPLG

SEQ ID NO: 1244657 - protein, 26 aa, Mycobacterium
NNIGGRWADKFGGLVYDATGITEPEG

SEQ ID NO: 1244658 - protein, 32 aa, Mycobacterium
NNNWFAAYAYWYFKLYGHENVKLLDGGRKKWE

SEQ ID NO: 1244659 - protein, 24 aa, Mycobacterium
NNTTLWPDFTFRFRNQTRRFDLDA

SEQ ID NO: 1244660 - protein, 29 aa, Mycobacterium
NNVLTFAGALWWRTVQEVGAEYPDVEIAY

SEQ ID NO: 1244661 - protein, 25 aa, Mycobacterium
NNVREALAIARQCRTLLGANGITLE

SEQ ID NO: 1244662 - protein, 17 aa, Mycobacterium
NNWDPAVLQSFREDEVV

SEQ ID NO: 1244663 - protein, 24 aa, Mycobacterium
NPAYVSWLLSQSMLADANEISQQF

SEQ ID NO: 1244664 - protein, 24 aa, Mycobacterium
NPDDLRKADAIEVVLGQGAKPGGG

SEQ ID NO: 1244665 - protein, 18 aa, Mycobacterium
NPDLKLLQSMSAGAEHLV

SEQ ID NO: 1244666 - protein, 21 aa, Mycobacterium
NPDRQVVFFGIGFETTAPANA

SEQ ID NO: 1244667 - protein, 28 aa, Mycobacterium
NPDTAFSCAAGFCGTCETKVLAGEVDHR

SEQ ID NO: 1244668 - protein, 22 aa, Mycobacterium
NPDTRLRMTIALRQHDGRWYVT

SEQ ID NO: 1244669 - protein, 18 aa, Mycobacterium
NPECHLMVVLVDERPEEV

SEQ ID NO: 1244670 - protein, 17 aa, Mycobacterium
NPEVVWHRDPGFLARRT

SEQ ID NO: 1244671 - protein, 17 aa, Mycobacterium
NPFEVASGRRWSHVRLS

SEQ ID NO: 1244672 - protein, 17 aa, Mycobacterium
NPFPPIADYGFLSDCEN

SEQ ID NO: 1244673 - protein, 23 aa, Mycobacterium
NPGRADGGIAARFAPVLDPILGL

SEQ ID NO: 1244674 - protein, 21 aa, Mycobacterium
NPHFDIPQLLSMYKAGKLNLD

SEQ ID NO: 1244675 - protein, 20 aa, Mycobacterium
NPIELFVPIFEKAFADTGAL

SEQ ID NO: 1244676 - protein, 17 aa, Mycobacterium
NPIEQWRAAKAAASEAI

SEQ ID NO: 1244677 - protein, 18 aa, Mycobacterium
NPIGAVWSAALMLEHLGH

SEQ ID NO: 1244678 - protein, 18 aa, Mycobacterium
NPITATWDAGARTLTLSG

SEQ ID NO: 1244679 - protein, 27 aa, Mycobacterium
NPKLFFQIYWLGGREAILERAQRAKEA

SEQ ID NO: 1244680 - protein, 17 aa, Mycobacterium
NPLKEVIRGKRLIVVDD

SEQ ID NO: 1244681 - protein, 17 aa, Mycobacterium
NPLKTSLLSAADVKSNP

SEQ ID NO: 1244682 - protein, 20 aa, Mycobacterium
NPPFYRWFPDGELNTCANAL

SEQ ID NO: 1244683 - protein, 20 aa, Mycobacterium
NPPPFWRAAAEQGLQGVHLP

SEQ ID NO: 1244684 - protein, 18 aa, Mycobacterium
NPRDIKFVPTQHGEMTAD

SEQ ID NO: 1244685 - protein, 23 aa, Mycobacterium
NPRLREFALREGLADAGQRFAHT

SEQ ID NO: 1244686 - protein, 24 aa, Mycobacterium
NPTYRLITIILMRCGLRITDALRL

SEQ ID NO: 1244687 - protein, 30 aa, Mycobacterium
NPVSALVSFEVFLRAPLRAAMGADRPERPR

SEQ ID NO: 1244688 - protein, 20 aa, Mycobacterium
NPYLTFAVLLAAGLRGVEKG

SEQ ID NO: 1244689 - protein, 25 aa, Mycobacterium
NQAKTLLMRDFDVDVAQAYALLVKL

SEQ ID NO: 1244690 - protein, 19 aa, Mycobacterium
NQINNVLAFPGVFRGALDA

SEQ ID NO: 1244691 - protein, 17 aa, Mycobacterium
NQLPLVGALAHEEAATH

SEQ ID NO: 1244692 - protein, 20 aa, Mycobacterium
NQPRPVRRRYLSLMFDALNP

SEQ ID NO: 1244693 - protein, 27 aa, Mycobacterium
NQRIRPIRWRKVDAFAARDVFRYPRLG

SEQ ID NO: 1244694 - protein, 19 aa, Mycobacterium
NQRPRVIAVDAVPNEVGQT

SEQ ID NO: 1244695 - protein, 26 aa, Mycobacterium
NQRRGRRWSMADAFLHPVSHRPNLTV

SEQ ID NO: 1244696 - protein, 25 aa, Mycobacterium
NQVELATAEWVVWFNTERPHEYLDD

SEQ ID NO: 1244697 - protein, 18 aa, Mycobacterium
NREAERLAAVLSEAADVY

SEQ ID NO: 1244698 - protein, 22 aa, Mycobacterium
NREEGVVFNAEISAAIEERLAG

SEQ ID NO: 1244699 - protein, 26 aa, Mycobacterium
NRGEIARRVFRTCRDLGIATVAVYSD

SEQ ID NO: 1244700 - protein, 20 aa, Mycobacterium
NRGKRSVGIDVSTPDGQEVL

SEQ ID NO: 1244701 - protein, 26 aa, Mycobacterium
NRGLLPASFSLVGFARRDWADEDFGQ

SEQ ID NO: 1244702 - protein, 24 aa, Mycobacterium
NRHARIAKLLGIKHFVAAVNKIDL

SEQ ID NO: 1244703 - protein, 24 aa, Mycobacterium
NRHDLPFTLTYLFGDDGDAVLAAS

SEQ ID NO: 1244704 - protein, 20 aa, Mycobacterium
NRHVSFGYGVHFCLGAALAR

SEQ ID NO: 1244705 - protein, 19 aa, Mycobacterium
NRIPEDFPDPDAFKPDRYD

SEQ ID NO: 1244706 - protein, 18 aa, Mycobacterium
NRLHAQKALLVWLLERSG

SEQ ID NO: 1244707 - protein, 27 aa, Mycobacterium
NRLPDKRVDEVLGMVGLADVAGKPAGA

SEQ ID NO: 1244708 - protein, 22 aa, Mycobacterium
NRLPIRDLIRMAAHSRHYLAVF

SEQ ID NO: 1244709 - protein, 24 aa, Mycobacterium
NRLPPVHMFAGINLSFGFMGPLLR

SEQ ID NO: 1244710 - protein, 20 aa, Mycobacterium
NRLQERWTQIEAKAAEITAK

SEQ ID NO: 1244711 - protein, 18 aa, Mycobacterium
NRLRRAAERQDLRLLKSR

SEQ ID NO: 1244712 - protein, 27 aa, Mycobacterium
NRMTLTCPFHGWTFRNDGTLLKVKDPE

SEQ ID NO: 1244713 - protein, 22 aa, Mycobacterium
NRMVCLPYPKLLNSIMSVDMAA

SEQ ID NO: 1244714 - protein, 21 aa, Mycobacterium
NRNQGAFGFSEPCTECKGSGS

SEQ ID NO: 1244715 - protein, 45 aa, Mycobacterium
NRPDFPPTLMGRLLLEAGVTPWITLSCRDRNRIVLEQELRGLRSL

SEQ ID NO: 1244716 - protein, 23 aa, Mycobacterium
NRPEARNAVNFAVSQGLADAVDE

SEQ ID NO: 1244717 - protein, 19 aa, Mycobacterium
NRQGHKGFYIEPTVVGGLR

SEQ ID NO: 1244718 - protein, 18 aa, Mycobacterium
NRSEFYRALPSGPFYGFN

SEQ ID NO: 1244719 - protein, 26 aa, Mycobacterium
NRSVLEMVHRIKTVLGDRVEVVGGNV

SEQ ID NO: 1244720 - protein, 25 aa, Mycobacterium
NRVPRWWSVRELIAAFLSLRDKVVL

SEQ ID NO: 1244721 - protein, 21 aa, Mycobacterium
NRWMPCGSAVATGMRISLHND

SEQ ID NO: 1244722 - protein, 23 aa, Mycobacterium
NSARSQMAAAIWNGRSRIPAASA

SEQ ID NO: 1244723 - protein, 26 aa, Mycobacterium
NSDGRWDPGKDFAFVTGRATSPTGKF

SEQ ID NO: 1244724 - protein, 26 aa, Mycobacterium
NSEGACPACKGAGVIYTELGVMATVE

SEQ ID NO: 1244725 - protein, 17 aa, Mycobacterium
NSEGLYLLQRVRDEAHR

SEQ ID NO: 1244726 - protein, 25 aa, Mycobacterium
NSELYPVLCGSAFKNKGVQPMLDAV

SEQ ID NO: 1244727 - protein, 22 aa, Mycobacterium
NSFMRHARARVLGGCSSHNSCI

SEQ ID NO: 1244728 - protein, 24 aa, Mycobacterium
NSGRVLGLHFFNPVPVLPLVELVS

SEQ ID NO: 1244729 - protein, 18 aa, Mycobacterium
NSKKAADVLLRYNFPAAG

SEQ ID NO: 1244730 - protein, 19 aa, Mycobacterium
NSLGGWVAFELERRGRARS

SEQ ID NO: 1244731 - protein, 17 aa, Mycobacterium
NSLLAGFAARLGLLLGR

SEQ ID NO: 1244732 - protein, 23 aa, Mycobacterium
NSLLPICAAIAVLRTRTTREHSV

SEQ ID NO: 1244733 - protein, 29 aa, Mycobacterium
NSLSDLLVFGRRAGLGASDYVRALGNRPT

SEQ ID NO: 1244734 - protein, 23 aa, Mycobacterium
NSTARGAFNLGYAPTVVASATAT

SEQ ID NO: 1244735 - protein, 24 aa, Mycobacterium
NSTRTRFSFEVGIAQLGGHAVVVD

SEQ ID NO: 1244736 - protein, 31 aa, Mycobacterium
NSWSVKVPRRLKELHLRLGSATAELSQRLGR

SEQ ID NO: 1244737 - protein, 17 aa, Mycobacterium
NSYKRLVRQGSMSGSTW

SEQ ID NO: 1244738 - protein, 24 aa, Mycobacterium
NTCLISSAGSVEWLCVPRPDSPSV

SEQ ID NO: 1244739 - protein, 25 aa, Mycobacterium
NTKSFRFSFLVAYAGRIGERLTATN

SEQ ID NO: 1244740 - protein, 24 aa, Mycobacterium
NTLSEPIPLPGLVATELTISAGGS

SEQ ID NO: 1244741 - protein, 24 aa, Mycobacterium
NTNARAKMSLLRHGFVKIFCRPAT

SEQ ID NO: 1244742 - protein, 20 aa, Mycobacterium
NTPRNFARRGIRSHVLPARA

SEQ ID NO: 1244743 - protein, 17 aa, Mycobacterium
NTPVPACPAWTVRDVVA

SEQ ID NO: 1244744 - protein, 26 aa, Mycobacterium
NTPVVWRGPMLHRALQQFLADVFWGD

SEQ ID NO: 1244745 - protein, 25 aa, Mycobacterium
NTQVCPVCLGLPGSLPVLNQQAVES

SEQ ID NO: 1244746 - protein, 27 aa, Mycobacterium
NVALVLRRLLRLCARYSADPGGPTVVF

SEQ ID NO: 1244747 - protein, 25 aa, Mycobacterium
NVEPEMLRRSLLYAIERKRSELTAV

SEQ ID NO: 1244748 - protein, 27 aa, Mycobacterium
NVEPIDVPYPVLWRNLTQVVADVLDRL

SEQ ID NO: 1244749 - protein, 28 aa, Mycobacterium
NVGLVPGLLRWDRKRIASRVDELLDLVG

SEQ ID NO: 1244750 - protein, 24 aa, Mycobacterium
NVIHPRFGNFILLATVLVDAEISE

SEQ ID NO: 1244751 - protein, 26 aa, Mycobacterium
NVKGPFRLAALIGERMVADGGGTIVN

SEQ ID NO: 1244752 - protein, 19 aa, Mycobacterium
NVKPGRVLFELSYPDEKTA

SEQ ID NO: 1244753 - protein, 22 aa, Mycobacterium
NVMMHRPELVRSWASDVVGLFD

SEQ ID NO: 1244754 - protein, 19 aa, Mycobacterium
NVNRGKRGIVLNLRTEEGK

SEQ ID NO: 1244755 - protein, 28 aa, Mycobacterium
NVPIPVPMAYYSFGGWKNSLFGDSHAHG

SEQ ID NO: 1244756 - protein, 23 aa, Mycobacterium
NVRRWSERTLIALVMQNLDNSIT

SEQ ID NO: 1244757 - protein, 18 aa, Mycobacterium
NVRYFPSLLPEVSDEDPV

SEQ ID NO: 1244758 - protein, 27 aa, Mycobacterium
NVSRLFAERCIDGLVANEEHMREQAES

SEQ ID NO: 1244759 - protein, 25 aa, Mycobacterium
NVTDMAHFFYIHFGLPTYFKNVFEG

SEQ ID NO: 1244760 - protein, 24 aa, Mycobacterium
NVTYRLGVFGGLDLSALGDGFDDN

SEQ ID NO: 1244761 - protein, 18 aa, Mycobacterium
NVVAMANSLAAYYYLHGS

SEQ ID NO: 1244762 - protein, 22 aa, Mycobacterium
NVWAHAIIFCGHFPDQTYTFSE

SEQ ID NO: 1244763 - protein, 21 aa, Mycobacterium
NVWSLHGYHECLQRLGRTAEA

SEQ ID NO: 1244764 - protein, 27 aa, Mycobacterium
NWGRFRWGGDFGWTWGTLLPRDPDDPW

SEQ ID NO: 1244765 - protein, 19 aa, Mycobacterium
NWITRAGMGLQYLLLRSGP

SEQ ID NO: 1244766 - protein, 18 aa, Mycobacterium
NWLLRRPTVASVIIGARN

SEQ ID NO: 1244767 - protein, 23 aa, Mycobacterium
NYAEAFAQLDLEAFKRDVIEVIQ

SEQ ID NO: 1244768 - protein, 20 aa, Mycobacterium
NYALDAPIPWRSKNLNEVGT

SEQ ID NO: 1244769 - protein, 23 aa, Mycobacterium
NYAQRMEAAWGREYKRGRYFHKL

SEQ ID NO: 1244770 - protein, 22 aa, Mycobacterium
NYLNNWKRLGFGDEDVAKPGSD

SEQ ID NO: 1244771 - protein, 22 aa, Mycobacterium
NYRLEMKSGPTLTAAEAGSGRG

SEQ ID NO: 1244772 - protein, 18 aa, Mycobacterium
NYSVEMLCADTCEVLDQI

SEQ ID NO: 1244773 - protein, 18 aa, Mycobacterium
NYVMLEFGHPMHAHDRSL

SEQ ID NO: 1244774 - protein, 19 aa, Mycobacterium
PAAAAHPSLPRGALLQVAL

SEQ ID NO: 1244775 - protein, 27 aa, Mycobacterium
PAAALTARLAFDWAQLEPGDRVLIHAA

SEQ ID NO: 1244776 - protein, 25 aa, Mycobacterium
PAADGLRAGHAMKRAMETAGIDPKD

SEQ ID NO: 1244777 - protein, 30 aa, Mycobacterium
PAADRTGLVAFSLHYPWSQGLPVHTLDGSA

SEQ ID NO: 1244778 - protein, 24 aa, Mycobacterium
PAAEALKAVAAFRLALPRTMLRFA

SEQ ID NO: 1244779 - protein, 19 aa, Mycobacterium
PAAGAPRWTAPAAGSARPA

SEQ ID NO: 1244780 - protein, 18 aa, Mycobacterium
PAAGAVGREATVWFLDEG

SEQ ID NO: 1244781 - protein, 24 aa, Mycobacterium
PAAGGMPIPLGRKGEASDIAEAIA

SEQ ID NO: 1244782 - protein, 20 aa, Mycobacterium
PAALAADWLVSAWDQCAAFH

SEQ ID NO: 1244783 - protein, 17 aa, Mycobacterium
PAALRRTPLQAAAGVAV

SEQ ID NO: 1244784 - protein, 26 aa, Mycobacterium
PAAMTRPDLAFDMVRPGIAVYGQTPI

SEQ ID NO: 1244785 - protein, 21 aa, Mycobacterium
PAARVRRAAMLAGDLPAVAAA

SEQ ID NO: 1244786 - protein, 19 aa, Mycobacterium
PAATGWEPVDLGPWLRGEI

SEQ ID NO: 1244787 - protein, 18 aa, Mycobacterium
PAAVEAFGKLDIVVNNVG

SEQ ID NO: 1244788 - protein, 27 aa, Mycobacterium
PAAVSPWWMQRRLLLSGIRAISPAVDV

SEQ ID NO: 1244789 - protein, 21 aa, Mycobacterium
PACGKAGCQTYKWETFLTSEL

SEQ ID NO: 1244790 - protein, 22 aa, Mycobacterium
PADDRGAGIAVFLVPADADGVE

SEQ ID NO: 1244791 - protein, 18 aa, Mycobacterium
PADEAIGPGDRWIHEQIR

SEQ ID NO: 1244792 - protein, 19 aa, Mycobacterium
PADLCARARALVAEKSPLD

SEQ ID NO: 1244793 - protein, 24 aa, Mycobacterium
PADLESRVSVFAMIETAQGVSALA

SEQ ID NO: 1244794 - protein, 23 aa, Mycobacterium
PADLRIPFDPRDVVARIVDGSEF

SEQ ID NO: 1244795 - protein, 28 aa, Mycobacterium
PADPTVWTTAAWWRRVRDTQRSDIITVD

SEQ ID NO: 1244796 - protein, 22 aa, Mycobacterium
PAEATWPWLVQMGQDRGGLYSY

SEQ ID NO: 1244797 - protein, 25 aa, Mycobacterium
PAEGVGLFRTELCFLNRDTEPTVDE

SEQ ID NO: 1244798 - protein, 20 aa, Mycobacterium
PAEHVVPFSPIFAEPTTYGA

SEQ ID NO: 1244799 - protein, 25 aa, Mycobacterium
PAEIDARLRLLVGRRGGVANQENAG

SEQ ID NO: 1244800 - protein, 28 aa, Mycobacterium
PAELERVLARSAGILGIHLGTEAGAEIA

SEQ ID NO: 1244801 - protein, 20 aa, Mycobacterium
PAEVLAELEVRPMTDVADIV

SEQ ID NO: 1244802 - protein, 29 aa, Mycobacterium
PAFIEPRWLRFLPVLPLDRGLVVPIIHAD

SEQ ID NO: 1244803 - protein, 18 aa, Mycobacterium
PAFTGTLQLRYVRPTPLG

SEQ ID NO: 1244804 - protein, 17 aa, Mycobacterium
PAGASLAVGGFGLAGIP

SEQ ID NO: 1244805 - protein, 32 aa, Mycobacterium
PAGDVTIPFLIDWEALEAAEWAALTELVDGWR

SEQ ID NO: 1244806 - protein, 23 aa, Mycobacterium
PAGELRWRAPQPPQPWRDVADAR

SEQ ID NO: 1244807 - protein, 17 aa, Mycobacterium
PAGIAQRTSRAFRTMRV

SEQ ID NO: 1244808 - protein, 17 aa, Mycobacterium
PAGIFLARYDNRLRRAQ

SEQ ID NO: 1244809 - protein, 17 aa, Mycobacterium
PAGKADYRWAKAVATES

SEQ ID NO: 1244810 - protein, 23 aa, Mycobacterium
PAGSDLRRALALVKTRAELSELL

SEQ ID NO: 1244811 - protein, 18 aa, Mycobacterium
PAGTLAGLDYRWAAVTLD

SEQ ID NO: 1244812 - protein, 28 aa, Mycobacterium
PAHDPALWARLGSELGVLGLSVSEADGG

SEQ ID NO: 1244813 - protein, 22 aa, Mycobacterium
PAHTGVSGLEWVVDPLDGTTNY

SEQ ID NO: 1244814 - protein, 24 aa, Mycobacterium
PAIATRPHRRWVSPAARRVAATLD

SEQ ID NO: 1244815 - protein, 17 aa, Mycobacterium
PAINVGVSVSRVGGAAQ

SEQ ID NO: 1244816 - protein, 19 aa, Mycobacterium
PAISEWSWDSGYRADGTQS

SEQ ID NO: 1244817 - protein, 19 aa, Mycobacterium
PAKMKLAVTGCPRNCAESL

SEQ ID NO: 1244818 - protein, 20 aa, Mycobacterium
PALAGVRVDSGFRAGSVISH

SEQ ID NO: 1244819 - protein, 30 aa, Mycobacterium
PALEHLLDIRIAFSAVEIFQTPVGTRLTYV

SEQ ID NO: 1244820 - protein, 25 aa, Mycobacterium
PALKELLTRRAGLLSGGQRQQLAIA

SEQ ID NO: 1244821 - protein, 20 aa, Mycobacterium
PALLARSAREFGDQAYVISP

SEQ ID NO: 1244822 - protein, 18 aa, Mycobacterium
PALLEATAKDYASLRERH

SEQ ID NO: 1244823 - protein, 19 aa, Mycobacterium
PALRSACVVGAVRSASIGM

SEQ ID NO: 1244824 - protein, 19 aa, Mycobacterium
PALTVSLRGLADCVVEVAT

SEQ ID NO: 1244825 - protein, 20 aa, Mycobacterium
PALYSPVGFGHRNSVKPEIL

SEQ ID NO: 1244826 - protein, 25 aa, Mycobacterium
PAMFADVRRGLTIAAVVHGATVKDT

SEQ ID NO: 1244827 - protein, 19 aa, Mycobacterium
PANACGKRVAVQSTTIEET

SEQ ID NO: 1244828 - protein, 17 aa, Mycobacterium
PANDVLLQMCLEYIDRM

SEQ ID NO: 1244829 - protein, 20 aa, Mycobacterium
PAPCEASCVLGINQDAVTIK

SEQ ID NO: 1244830 - protein, 25 aa, Mycobacterium
PAPDGVKLAAGWLVEHAGFGKGYPG

SEQ ID NO: 1244831 - protein, 23 aa, Mycobacterium
PAPEGFLAAAGRLGVDPEEMYIV

SEQ ID NO: 1244832 - protein, 24 aa, Mycobacterium
PAPEIFTAALTRLGVDAADAVMVG

SEQ ID NO: 1244833 - protein, 24 aa, Mycobacterium
PAPEPLRTLPFPVGASHSLELRYL

SEQ ID NO: 1244834 - protein, 20 aa, Mycobacterium
PAPGKWLLKDLGLIASDHVR

SEQ ID NO: 1244835 - protein, 25 aa, Mycobacterium
PAPRPGDPVAAHWDWVCDALTEDDV

SEQ ID NO: 1244836 - protein, 18 aa, Mycobacterium
PAPTKAALVARAIQDGIL

SEQ ID NO: 1244837 - protein, 19 aa, Mycobacterium
PAQPLMRIAQFGYHADATD

SEQ ID NO: 1244838 - protein, 23 aa, Mycobacterium
PARAAYLAGDWGAVASLSPELFL

SEQ ID NO: 1244839 - protein, 22 aa, Mycobacterium
PARECPTMIGALDRLVDGMSVE

SEQ ID NO: 1244840 - protein, 17 aa, Mycobacterium
PARHFSGRLFSRNTTLW

SEQ ID NO: 1244841 - protein, 17 aa, Mycobacterium
PARIEWADAEWLARGER

SEQ ID NO: 1244842 - protein, 25 aa, Mycobacterium
PARKRRMFDLLVRMGYKEIEVGFPS

SEQ ID NO: 1244843 - protein, 22 aa, Mycobacterium
PARLATAPWWLRAVDPVASRLV

SEQ ID NO: 1244844 - protein, 22 aa, Mycobacterium
PARSFDGAHIFVRYQSDRQLYA

SEQ ID NO: 1244845 - protein, 26 aa, Mycobacterium
PARTRMHRRWSIVMVDEFQDTDPVQW

SEQ ID NO: 1244846 - protein, 19 aa, Mycobacterium
PARVYRLVAEESLKLTHAD

SEQ ID NO: 1244847 - protein, 23 aa, Mycobacterium
PASAEPWSPYGIRTSLDRSAFLV

SEQ ID NO: 1244848 - protein, 18 aa, Mycobacterium
PASCAPAVLALQRGLAAD

SEQ ID NO: 1244849 - protein, 24 aa, Mycobacterium
PASGDLPPLLVRSDGAGKLVVTTD

SEQ ID NO: 1244850 - protein, 30 aa, Mycobacterium
PASIKDRWLLRHRPHLVLDGLRLAARVVEA

SEQ ID NO: 1244851 - protein, 19 aa, Mycobacterium
PASTREMIKTGGFDAVCFT

SEQ ID NO: 1244852 - protein, 26 aa, Mycobacterium
PATGDELRATLLAMIGSPHLCSRGYI

SEQ ID NO: 1244853 - protein, 20 aa, Mycobacterium
PATRCWELGPDGHWSASPRE

SEQ ID NO: 1244854 - protein, 20 aa, Mycobacterium
PATVCGRPPGGLTKREIDIL

SEQ ID NO: 1244855 - protein, 19 aa, Mycobacterium
PAVADVRESPALHILEELH

SEQ ID NO: 1244856 - protein, 28 aa, Mycobacterium
PAVDRHGRLRIAAAVGINGDVGAKARAL

SEQ ID NO: 1244857 - protein, 21 aa, Mycobacterium
PAVEELLRWLSIVHSGIPRIT

SEQ ID NO: 1244858 - protein, 24 aa, Mycobacterium
PAVHRFPGSMAKRIQALAQLIVDR

SEQ ID NO: 1244859 - protein, 28 aa, Mycobacterium
PAVIAARGHIAFVGSIYAFFNGVLAAPY

SEQ ID NO: 1244860 - protein, 18 aa, Mycobacterium
PAVIARVGGDEFVVVPDE

SEQ ID NO: 1244861 - protein, 26 aa, Mycobacterium
PAVLGIRGARKAFPDLPHVAVFDTAY

SEQ ID NO: 1244862 - protein, 17 aa, Mycobacterium
PAVPLKAPVPLAPGAAA

SEQ ID NO: 1244863 - protein, 31 aa, Mycobacterium
PAVRLAREAGRRGGSLTAVYNAANEEAAAAF

SEQ ID NO: 1244864 - protein, 19 aa, Mycobacterium
PAVVARLGGDLAELEELHR

SEQ ID NO: 1244865 - protein, 23 aa, Mycobacterium
PAWANLRPVLGGHPIKVEEDIKD

SEQ ID NO: 1244866 - protein, 24 aa, Mycobacterium
PAWDLARPAGFWAAGHVPDGDWAA

SEQ ID NO: 1244867 - protein, 22 aa, Mycobacterium
PAWDVSCGLYAALAVTTALRHR

SEQ ID NO: 1244868 - protein, 17 aa, Mycobacterium
PAYEVLDDLAARAQRAY

SEQ ID NO: 1244869 - protein, 23 aa, Mycobacterium
PAYVPRSALTHVLVDADGNRHVI

SEQ ID NO: 1244870 - protein, 22 aa, Mycobacterium
PCAAQPRVPIWVGGRTRRSLRR

SEQ ID NO: 1244871 - protein, 18 aa, Mycobacterium
PCDHRMLDNTGWRTRKNG

SEQ ID NO: 1244872 - protein, 19 aa, Mycobacterium
PCDTPLLPPDSWERAEGFT

SEQ ID NO: 1244873 - protein, 22 aa, Mycobacterium
PCEFSRDLFRGDRIYLAVTAQG

SEQ ID NO: 1244874 - protein, 18 aa, Mycobacterium
PCFIQVCLIAKDDAALAE

SEQ ID NO: 1244875 - protein, 22 aa, Mycobacterium
PCRTFAAHLGVRGWIKTFTEAA

SEQ ID NO: 1244876 - protein, 23 aa, Mycobacterium
PCSHPHCCSVGYLIRDDNDQWRS

SEQ ID NO: 1244877 - protein, 21 aa, Mycobacterium
PCTMCAGALVLARVARVVFGA

SEQ ID NO: 1244878 - protein, 21 aa, Mycobacterium
PCTTHWMYADLLARMYPTARV

SEQ ID NO: 1244879 - protein, 21 aa, Mycobacterium
PDAARTLIEYGLAETTPAVVT

SEQ ID NO: 1244880 - protein, 17 aa, Mycobacterium
PDAASFTPIPFVKDGLA

SEQ ID NO: 1244881 - protein, 21 aa, Mycobacterium
PDADAPVLLGIDGSPASEAAT

SEQ ID NO: 1244882 - protein, 17 aa, Mycobacterium
PDADTGTNMLFTMRSAW

SEQ ID NO: 1244883 - protein, 27 aa, Mycobacterium
PDADYRTRWRIPLGVRESDLSVAYNEM

SEQ ID NO: 1244884 - protein, 22 aa, Mycobacterium
PDAEVPLPFRARAIAGLIDSWT

SEQ ID NO: 1244885 - protein, 20 aa, Mycobacterium
PDAISGWAAEHGMGDKSYPD

SEQ ID NO: 1244886 - protein, 23 aa, Mycobacterium
PDALIRRRRISMIRSIYPGQTAT

SEQ ID NO: 1244887 - protein, 21 aa, Mycobacterium
PDALLTRGLYQYKPDLPFTPG

SEQ ID NO: 1244888 - protein, 23 aa, Mycobacterium
PDALPKLLEYMAGDKKTRSGVLR

SEQ ID NO: 1244889 - protein, 27 aa, Mycobacterium
PDALVGRCWPAVFAAIGSAATDSGFPV

SEQ ID NO: 1244890 - protein, 23 aa, Mycobacterium
PDAPFPLAPIQHALWVGRNELTE

SEQ ID NO: 1244891 - protein, 25 aa, Mycobacterium
PDAPKRKGISYFLLDMTTPGVDVRP

SEQ ID NO: 1244892 - protein, 28 aa, Mycobacterium
PDAPTGSGFWHWAVFNLPATVTELPAGV

SEQ ID NO: 1244893 - protein, 18 aa, Mycobacterium
PDAPTIATLVDWANGADL

SEQ ID NO: 1244894 - protein, 25 aa, Mycobacterium
PDAQCLHAAIRRRAFVRALRITGSP

SEQ ID NO: 1244895 - protein, 17 aa, Mycobacterium
PDARVAADLLGRGLTRD

SEQ ID NO: 1244896 - protein, 19 aa, Mycobacterium
PDDAAAMMHACVAAAKTAG

SEQ ID NO: 1244897 - protein, 28 aa, Mycobacterium
PDDARARLEVHLGWEPGTIAAVRAGSPA

SEQ ID NO: 1244898 - protein, 17 aa, Mycobacterium
PDDAWAWAHAQVIGSDV

SEQ ID NO: 1244899 - protein, 18 aa, Mycobacterium
PDDGCCSHGAFLSDDDDR

SEQ ID NO: 1244900 - protein, 22 aa, Mycobacterium
PDDHADLFWGLRGGKATLGIVT

SEQ ID NO: 1244901 - protein, 21 aa, Mycobacterium
PDDKPRHLLGISEPDDLFAAV

SEQ ID NO: 1244902 - protein, 24 aa, Mycobacterium
PDDLSPFAIPPFWIRSRDVIEDDP

SEQ ID NO: 1244903 - protein, 25 aa, Mycobacterium
PDEEWGEIVVAFIVGRVSPTDLDAH

SEQ ID NO: 1244904 - protein, 23 aa, Mycobacterium
PDEFRAVVDVNLNGAYWAAQACG

SEQ ID NO: 1244905 - protein, 23 aa, Mycobacterium
PDEGAAAVIMCRGDIAHRYTDKP

SEQ ID NO: 1244906 - protein, 23 aa, Mycobacterium
PDEGAAAVVMCRADLAHRYTSKP

SEQ ID NO: 1244907 - protein, 18 aa, Mycobacterium
PDEGRKLAQLRSDVGMVF

SEQ ID NO: 1244908 - protein, 27 aa, Mycobacterium
PDEKFRYGFEIAPELVRTVLRDGEPDW

SEQ ID NO: 1244909 - protein, 24 aa, Mycobacterium
PDELRQRIGMVFQQFNLFPHRSVL

SEQ ID NO: 1244910 - protein, 25 aa, Mycobacterium
PDEPKGWLITTAWRRFLDLSRSDTA

SEQ ID NO: 1244911 - protein, 17 aa, Mycobacterium
PDFDTSILLTRFLEGSW

SEQ ID NO: 1244912 - protein, 18 aa, Mycobacterium
PDGAGAWSQGRVALGHRR

SEQ ID NO: 1244913 - protein, 17 aa, Mycobacterium
PDGALRDAGLPNVTAAQ

SEQ ID NO: 1244914 - protein, 17 aa, Mycobacterium
PDGALVWTRDPEGLYWL

SEQ ID NO: 1244915 - protein, 22 aa, Mycobacterium
PDGDAWLLLSMLQVIFAEGLED

SEQ ID NO: 1244916 - protein, 30 aa, Mycobacterium
PDGDGVRLSGRWSWATGVMHGNWIMVGALC

SEQ ID NO: 1244917 - protein, 23 aa, Mycobacterium
PDGDRTKVRFELTVDPTVPLPGF

SEQ ID NO: 1244918 - protein, 18 aa, Mycobacterium
PDGFSFAVSISVQISPPV

SEQ ID NO: 1244919 - protein, 17 aa, Mycobacterium
PDGGMSIDESFFPHGEE

SEQ ID NO: 1244920 - protein, 18 aa, Mycobacterium
PDGGRGYLSKIFNDSWMS

SEQ ID NO: 1244921 - protein, 24 aa, Mycobacterium
PDGLSLPMTLALPGAVNRGNAAQA

SEQ ID NO: 1244922 - protein, 21 aa, Mycobacterium
PDGPSLGGFVCPVTVVTADRW

SEQ ID NO: 1244923 - protein, 34 aa, Mycobacterium
PDGREWAVRDIAEWGKIGGMGPRIVGSGVSVADT

SEQ ID NO: 1244924 - protein, 19 aa, Mycobacterium
PDGRHARRLGADAWGPDAR

SEQ ID NO: 1244925 - protein, 21 aa, Mycobacterium
PDGRHEFRWWDGQRWTDQVSS

SEQ ID NO: 1244926 - protein, 27 aa, Mycobacterium
PDGRRYRLTVDLPRDFALNQPLSTFAL

SEQ ID NO: 1244927 - protein, 21 aa, Mycobacterium
PDGTLRLALDAALSSPSGLGV

SEQ ID NO: 1244928 - protein, 17 aa, Mycobacterium
PDGTVAISAERDGHTVT

SEQ ID NO: 1244929 - protein, 30 aa, Mycobacterium
PDGVYDAAVAWARRFTDYPPQVLAAAKAAF

SEQ ID NO: 1244930 - protein, 17 aa, Mycobacterium
PDGWWRDRRGAMTGLVL

SEQ ID NO: 1244931 - protein, 27 aa, Mycobacterium
PDHRPGIPYPEWNAWTKSFMPDHVAVV

SEQ ID NO: 1244932 - protein, 25 aa, Mycobacterium
PDIPVKGRGGAGVGFHPFVGGEDAL

SEQ ID NO: 1244933 - protein, 20 aa, Mycobacterium
PDIWWQFRNAIQTVDDLDVG

SEQ ID NO: 1244934 - protein, 18 aa, Mycobacterium
PDKPWFSYVCPGAGHAPH

SEQ ID NO: 1244935 - protein, 19 aa, Mycobacterium
PDLAFKQLIMEAGADIAIL

SEQ ID NO: 1244936 - protein, 25 aa, Mycobacterium
PDLDVLTHGLTLWDLDREFKVNGFA

SEQ ID NO: 1244937 - protein, 20 aa, Mycobacterium
PDLFAECLLAGFDEVLAIGG

SEQ ID NO: 1244938 - protein, 17 aa, Mycobacterium
PDLFKQYFGTVIPAGDN

SEQ ID NO: 1244939 - protein, 26 aa, Mycobacterium
PDLIPNMVSEIIRWQTPLAYMRRVAK

SEQ ID NO: 1244940 - protein, 21 aa, Mycobacterium
PDLMPGLVMANVGHWQSGGSG

SEQ ID NO: 1244941 - protein, 17 aa, Mycobacterium
PDLMPRLTKYEPAGNPN

SEQ ID NO: 1244942 - protein, 21 aa, Mycobacterium
PDLNLALAFATAFPYGPYYGD

SEQ ID NO: 1244943 - protein, 19 aa, Mycobacterium
PDLPPLRDAVVVAAFEGWN

SEQ ID NO: 1244944 - protein, 17 aa, Mycobacterium
PDLPPSHHYLAAYRWID

SEQ ID NO: 1244945 - protein, 21 aa, Mycobacterium
PDLRGAFVGLDLAHTRADMYR

SEQ ID NO: 1244946 - protein, 18 aa, Mycobacterium
PDLRKIVWDQVARDLTEQ

SEQ ID NO: 1244947 - protein, 21 aa, Mycobacterium
PDLVVSAGFMKILGPEFLNRF

SEQ ID NO: 1244948 - protein, 22 aa, Mycobacterium
PDMAEFLVRVGIDSMSLNPDTV

SEQ ID NO: 1244949 - protein, 19 aa, Mycobacterium
PDNTFLVWRDRRLSYAESD

SEQ ID NO: 1244950 - protein, 17 aa, Mycobacterium
PDPAAQRPLFTDFAPRL

SEQ ID NO: 1244951 - protein, 19 aa, Mycobacterium
PDPCHRCGGDGRVRARREI

SEQ ID NO: 1244952 - protein, 29 aa, Mycobacterium
PDPDTMRILSWDPRIALFHADLVLGDAGE

SEQ ID NO: 1244953 - protein, 19 aa, Mycobacterium
PDPGDGTSTFWAPTVAADR

SEQ ID NO: 1244954 - protein, 26 aa, Mycobacterium
PDPGHAFPAIALCQKFAAAGDEPTLL

SEQ ID NO: 1244955 - protein, 18 aa, Mycobacterium
PDPIPGRSAPALRVGPAA

SEQ ID NO: 1244956 - protein, 22 aa, Mycobacterium
PDPLDLLTFLAAHTERLGLATG

SEQ ID NO: 1244957 - protein, 25 aa, Mycobacterium
PDPLVPRPAATVMLIRSARGVPETN

SEQ ID NO: 1244958 - protein, 18 aa, Mycobacterium
PDPQHARILQAYLTAEGR

SEQ ID NO: 1244959 - protein, 20 aa, Mycobacterium
PDPQPGAWLKLDDDAVIALT

SEQ ID NO: 1244960 - protein, 17 aa, Mycobacterium
PDPRLLVLNDELASGLG

SEQ ID NO: 1244961 - protein, 26 aa, Mycobacterium
PDQEAFAARLPRYFPSTLRDQFAADT

SEQ ID NO: 1244962 - protein, 18 aa, Mycobacterium
PDQFDWLATRLEIARKLR

SEQ ID NO: 1244963 - protein, 24 aa, Mycobacterium
PDQLAGVVGPLFRSALRSAEVRRR

SEQ ID NO: 1244964 - protein, 17 aa, Mycobacterium
PDQRLLVNFSLTDETRS

SEQ ID NO: 1244965 - protein, 20 aa, Mycobacterium
PDRACWALQNLLTRRYISAE

SEQ ID NO: 1244966 - protein, 33 aa, Mycobacterium
PDRGYCLSVRGMAREIACAYDLDYVDPAFDPER

SEQ ID NO: 1244967 - protein, 24 aa, Mycobacterium
PDRRMLVRPEFRAMFLDDLLNGSR

SEQ ID NO: 1244968 - protein, 25 aa, Mycobacterium
PDSGASWLLPRLVGLARTKRMLLLG

SEQ ID NO: 1244969 - protein, 20 aa, Mycobacterium
PDSLLGRIAGQWTYLPMNGA

SEQ ID NO: 1244970 - protein, 24 aa, Mycobacterium
PDSSGNPYLAFAAMLMAGIDGIKR

SEQ ID NO: 1244971 - protein, 19 aa, Mycobacterium
PDSSRYWYADAYREGQVQP

SEQ ID NO: 1244972 - protein, 27 aa, Mycobacterium
PDSYRLLLDRLGPLVVELDVDGEVFSM

SEQ ID NO: 1244973 - protein, 21 aa, Mycobacterium
PDTAELLRWLDSQTKRNLVIT

SEQ ID NO: 1244974 - protein, 18 aa, Mycobacterium
PDTEIKAALQALPEDFRM

SEQ ID NO: 1244975 - protein, 18 aa, Mycobacterium
PDTFPRDYVEKLREENKR

SEQ ID NO: 1244976 - protein, 22 aa, Mycobacterium
PDVDGRLALPPNQVGRWQAIAT

SEQ ID NO: 1244977 - protein, 17 aa, Mycobacterium
PDVFAVHRIDEQLAKAM

SEQ ID NO: 1244978 - protein, 19 aa, Mycobacterium
PDVGLVLREVGLDVLGTAR

SEQ ID NO: 1244979 - protein, 26 aa, Mycobacterium
PDVIAHGMLTMGLGAGFASAWTGDPG

SEQ ID NO: 1244980 - protein, 22 aa, Mycobacterium
PDVLCAGEREPSLARTTTSDQQ

SEQ ID NO: 1244981 - protein, 17 aa, Mycobacterium
PDVRRVCDEFGVTLNDV

SEQ ID NO: 1244982 - protein, 25 aa, Mycobacterium
PDVSWSELAALVFGLVLEGRETESG

SEQ ID NO: 1244983 - protein, 17 aa, Mycobacterium
PDVTVGRNQGWAKETVD

SEQ ID NO: 1244984 - protein, 22 aa, Mycobacterium
PDWPAEAVVVGPLHFEPTAQVL

SEQ ID NO: 1244985 - protein, 27 aa, Mycobacterium
PDWQPCPGGGGLALWVRLPTPMSSALS

SEQ ID NO: 1244986 - protein, 17 aa, Mycobacterium
PDYLAAPVRNVLLALIF

SEQ ID NO: 1244987 - protein, 27 aa, Mycobacterium
PDYPIIFRFSQWKGLDYTASIADDPTQ

SEQ ID NO: 1244988 - protein, 21 aa, Mycobacterium
PDYRPFWAVTKHADIMAIERD

SEQ ID NO: 1244989 - protein, 17 aa, Mycobacterium
PEADALLVRSATTVDAE

SEQ ID NO: 1244990 - protein, 21 aa, Mycobacterium
PEAFATAGYDYVGIDCQHGYL

SEQ ID NO: 1244991 - protein, 23 aa, Mycobacterium
PEAGHKGFTLFVVERGMEGFTRG

SEQ ID NO: 1244992 - protein, 17 aa, Mycobacterium
PEAIPEYAELRHRGRLR

SEQ ID NO: 1244993 - protein, 21 aa, Mycobacterium
PEALSVFLAPPSWEVLERRLV

SEQ ID NO: 1244994 - protein, 24 aa, Mycobacterium
PEAMADCRRILEAGINVVGSAPGV

SEQ ID NO: 1244995 - protein, 29 aa, Mycobacterium
PEAQGVLCGSLLSGLRMQPGHWSGAYICW

SEQ ID NO: 1244996 - protein, 20 aa, Mycobacterium
PEAQNAWQVLRGDFVTTEDG

SEQ ID NO: 1244997 - protein, 25 aa, Mycobacterium
PEARLEVLDGLGLDYSIMFPTLASL

SEQ ID NO: 1244998 - protein, 19 aa, Mycobacterium
PEARVGFVGVARNEETHEP

SEQ ID NO: 1244999 - protein, 37 aa, Mycobacterium; identical to SEQ ID NO: 706656

SEQ ID NO: 1245000 - protein, 24 aa, Mycobacterium
PEDDRPEFLAALGAETRQGTRVGA

SEQ ID NO: 1245001 - protein, 21 aa, Mycobacterium
PEDEVCVRLGIPTTTAARTAF

SEQ ID NO: 1245002 - protein, 23 aa, Mycobacterium
PEDIAAACAFLISEEAGYITGQI

SEQ ID NO: 1245003 - protein, 23 aa, Mycobacterium
PEDIADAVAWLASDESRFVTAAA

SEQ ID NO: 1245004 - protein, 22 aa, Mycobacterium
PEDIANAVLFLASDEARYITGV

SEQ ID NO: 1245005 - protein, 24 aa, Mycobacterium
PEDLVGMCLFLLSDQAKWITGQIF

SEQ ID NO: 1245006 - protein, 22 aa, Mycobacterium
PEDVARLLVFLYLGVRQASDLD

SEQ ID NO: 1245007 - protein, 19 aa, Mycobacterium
PEEELALVGMGRRDVSFDQ

SEQ ID NO: 1245008 - protein, 20 aa, Mycobacterium
PEEFLRLDAAFHVAMSELAG

SEQ ID NO: 1245009 - protein, 20 aa, Mycobacterium
PEELVFRVNYLGGDMPTFTL

SEQ ID NO: 1245010 - protein, 43 aa, Mycobacterium; identical to SEQ ID NO: 706713

SEQ ID NO: 1245011 - protein, 20 aa, Mycobacterium
PEERERLFAEATKELGAPDI

SEQ ID NO: 1245012 - protein, 24 aa, Mycobacterium
PEESLAFYRDVLGFEVRLDVGGGT

SEQ ID NO: 1245013 - protein, 22 aa, Mycobacterium
PEFAEATAPLGNRLSIHDQPNL

SEQ ID NO: 1245014 - protein, 27 aa, Mycobacterium
PEFEKEAWLSMVMLEWGSCGQVAVRCP

SEQ ID NO: 1245015 - protein, 20 aa, Mycobacterium
PEFRGVYTVPVYDDEFFVVL

SEQ ID NO: 1245016 - protein, 20 aa, Mycobacterium
PEFVISALIDRAAEEPLSTV

SEQ ID NO: 1245017 - protein, 22 aa, Mycobacterium
PEFVRNGYRAITFDNRGVGATE

SEQ ID NO: 1245018 - protein, 23 aa, Mycobacterium
PEGELFFPGSPVLSVHGTFAECV

SEQ ID NO: 1245019 - protein, 24 aa, Mycobacterium
PEGESIAAAAARYMTEEYARIASA

SEQ ID NO: 1245020 - protein, 19 aa, Mycobacterium
PEGIRWIRTLMRDLAGEGR

SEQ ID NO: 1245021 - protein, 21 aa, Mycobacterium
PEGPLKAPQRLLPPVYNRGVV

SEQ ID NO: 1245022 - protein, 21 aa, Mycobacterium
PEGVTARLLLQQATREVLTGM

SEQ ID NO: 1245023 - protein, 20 aa, Mycobacterium
PEHRKRGYGTATLRASRSEM

SEQ ID NO: 1245024 - protein, 33 aa, Mycobacterium
PEIRRARKSIAQFKLREGMPIGARVTLRGDRMW

SEQ ID NO: 1245025 - protein, 35 aa, Mycobacterium
PEISPLQARCGWAVGWRKDAFWGRDALLAEKEAGP

SEQ ID NO: 1245026 - protein, 22 aa, Mycobacterium
PEIVARPAGLLLELSGATIADV

SEQ ID NO: 1245027 - protein, 22 aa, Mycobacterium
PEIVRALDMLLILHADHEQNCS

SEQ ID NO: 1245028 - protein, 21 aa, Mycobacterium
PEIWARLTRALGVVDDAELAP

SEQ ID NO: 1245029 - protein, 19 aa, Mycobacterium
PEKMPAFADGLARAQATLG

SEQ ID NO: 1245030 - protein, 27 aa, Mycobacterium
PELAAACAEAGITFIGPRAELLELTGN

SEQ ID NO: 1245031 - protein, 17 aa, Mycobacterium
PELAFGEYRSCAKTQAL

SEQ ID NO: 1245032 - protein, 20 aa, Mycobacterium
PELFAGFLAQVPFVDPLTTI

SEQ ID NO: 1245033 - protein, 18 aa, Mycobacterium
PELFLRRRGTAVTSSPIK

SEQ ID NO: 1245034 - protein, 17 aa, Mycobacterium
PELGFRLLQRLGADVAE

SEQ ID NO: 1245035 - protein, 19 aa, Mycobacterium
PELGLRRENIAFISGIGCS

SEQ ID NO: 1245036 - protein, 18 aa, Mycobacterium
PELHDCFYNEQFLAHAKS

SEQ ID NO: 1245037 - protein, 17 aa, Mycobacterium
PELKWLTDYAVAEAAGM

SEQ ID NO: 1245038 - protein, 23 aa, Mycobacterium
PELNGLFHLALRGAARNAVIEST

SEQ ID NO: 1245039 - protein, 24 aa, Mycobacterium
PELRDARLEPFWSDRERLRLHYLA

SEQ ID NO: 1245040 - protein, 19 aa, Mycobacterium
PELREALADYLARVRGVRT

SEQ ID NO: 1245041 - protein, 17 aa, Mycobacterium
PELTFFCNAAYRRDTLG

SEQ ID NO: 1245042 - protein, 19 aa, Mycobacterium
PEMLPDHFTGIKRISRRAM

SEQ ID NO: 1245043 - protein, 24 aa, Mycobacterium
PEPDTPLSPGWRTEYPRFLAELAE

SEQ ID NO: 1245044 - protein, 21 aa, Mycobacterium
PEPHPVLPATPWQHNRYWMDL

SEQ ID NO: 1245045 - protein, 20 aa, Mycobacterium
PEPKYGLAVTGIADPNRLLR

SEQ ID NO: 1245046 - protein, 25 aa, Mycobacterium
PEPNKLRLPVQWVSRPTAEQRRRYT

SEQ ID NO: 1245047 - protein, 20 aa, Mycobacterium
PEPPPRRRRAARQPAAAKTA

SEQ ID NO: 1245048 - protein, 20 aa, Mycobacterium
PEPTALLWETFDPRFDLTKT

SEQ ID NO: 1245049 - protein, 31 aa, Mycobacterium
PEQMQAFLRPWADALWDTGIEFGTVGVGKAG

SEQ ID NO: 1245050 - protein, 19 aa, Mycobacterium
PERANAFIGLLLDLEMLVA

SEQ ID NO: 1245051 - protein, 18 aa, Mycobacterium
PERELAARLGVSRDTVRE

SEQ ID NO: 1245052 - protein, 20 aa, Mycobacterium
PERKIGAIGIRVSRGTTLHG

SEQ ID NO: 1245053 - protein, 22 aa, Mycobacterium
PERPEQDWAAAFNTALWPITWA

SEQ ID NO: 1245054 - protein, 20 aa, Mycobacterium
PERRRGMAVVISDFLGPIDW

SEQ ID NO: 1245055 - protein, 20 aa, Mycobacterium
PESAGGLGGPAILRAIVGEE

SEQ ID NO: 1245056 - protein, 18 aa, Mycobacterium
PESDRIDLLVSELATRRP

SEQ ID NO: 1245057 - protein, 20 aa, Mycobacterium
PESLGVLAVPIHYRGLHLHL

SEQ ID NO: 1245058 - protein, 23 aa, Mycobacterium
PESPRPVVQIPLGNDLIHAPTGA

SEQ ID NO: 1245059 - protein, 21 aa, Mycobacterium
PETREIWSYGSGYGGNALLGK

SEQ ID NO: 1245060 - protein, 17 aa, Mycobacterium
PEVKVNPVLPAPPAPVA

SEQ ID NO: 1245061 - protein, 18 aa, Mycobacterium
PEVLSGRGCRASLRPVRV

SEQ ID NO: 1245062 - protein, 21 aa, Mycobacterium
PEVQGRPSLSMRLTNAYTDRV

SEQ ID NO: 1245063 - protein, 19 aa, Mycobacterium
PEVQRLALDRLLIRGDADG

SEQ ID NO: 1245064 - protein, 20 aa, Mycobacterium
PEVRDILGITWTDRDQRKLE

SEQ ID NO: 1245065 - protein, 18 aa, Mycobacterium
PEVSFYPWRDGGLGDQQT

SEQ ID NO: 1245066 - protein, 21 aa, Mycobacterium
PEVTPPPWLSGYRETAKYDAR

SEQ ID NO: 1245067 - protein, 21 aa, Mycobacterium
PEWPQMLLRALMFRLAVHALH

SEQ ID NO: 1245068 - protein, 18 aa, Mycobacterium
PEYAGFAGGRGHWALTRY

SEQ ID NO: 1245069 - protein, 27 aa, Mycobacterium
PEYDHLTLSWVYDWMARGVPVVAMHRS

SEQ ID NO: 1245070 - protein, 19 aa, Mycobacterium
PFAASDVSLVRRMHHGGDF

SEQ ID NO: 1245071 - protein, 25 aa, Mycobacterium
PFAGHPTVGAAWWLRENGLPVHTLQ

SEQ ID NO: 1245072 - protein, 18 aa, Mycobacterium
PFAGWSPKFLKQGKVTDL

SEQ ID NO: 1245073 - protein, 17 aa, Mycobacterium
PFASMALTVAERLRKQG

SEQ ID NO: 1245074 - protein, 23 aa, Mycobacterium
PFCQALAGLCGKDMVLPMNSGAE

SEQ ID NO: 1245075 - protein, 30 aa, Mycobacterium
PFDKNRDGFVFGEAGAMMIIETEEHALARG

SEQ ID NO: 1245076 - protein, 24 aa, Mycobacterium
PFDQWPTGSGFEHFYGFVGGEANQ

SEQ ID NO: 1245077 - protein, 19 aa, Mycobacterium
PFEDGGWIWFDITTDSAVT

SEQ ID NO: 1245078 - protein, 24 aa, Mycobacterium
PFENCPRSALKGVIAKARDMGFAM

SEQ ID NO: 1245079 - protein, 20 aa, Mycobacterium
PFFGSLLEFITSGPVVAAIV

SEQ ID NO: 1245080 - protein, 35 aa, Mycobacterium
PFGTPTFTGRSWPLADVRLLAPILASKVVCIGKNY

SEQ ID NO: 1245081 - protein, 26 aa, Mycobacterium
PFIIIGRPPRFMDIAMFIAMDPPQHD

SEQ ID NO: 1245082 - protein, 18 aa, Mycobacterium
PFIKVLCEAQQELAGRAA

SEQ ID NO: 1245083 - protein, 19 aa, Mycobacterium
PFITFRVWHPLSHDRMEIL

SEQ ID NO: 1245084 - protein, 31 aa, Mycobacterium
PFLHKDLYREYSLRPPKGVLLYGPPGCGKTL

SEQ ID NO: 1245085 - protein, 31 aa, Mycobacterium
PFLHPDLVWDFRLPRVVSINVSGHKYGLTYP

SEQ ID NO: 1245086 - protein, 17 aa, Mycobacterium
PFMSQRYTAVVGKPLYV

SEQ ID NO: 1245087 - protein, 23 aa, Mycobacterium
PFNAECLEAFDVLTGNGVDVPTT

SEQ ID NO: 1245088 - protein, 32 aa, Mycobacterium
PFPSTARLTGRWLRGRLPVVSDFTRGIPYVHR

SEQ ID NO: 1245089 - protein, 18 aa, Mycobacterium
PFPTERGLGGRKDAQWAL

SEQ ID NO: 1245090 - protein, 17 aa, Mycobacterium
PFRPRSVSRLADRIREL

SEQ ID NO: 1245091 - protein, 22 aa, Mycobacterium
PFSALCWGERIAFDNPESLTLL

SEQ ID NO: 1245092 - protein, 25 aa, Mycobacterium
PFTVTRADGLAVWIYQFKIRPHHTM

SEQ ID NO: 1245093 - protein, 26 aa, Mycobacterium
PFVCGCGRCQWCLEGQAQVCPDQTQP

SEQ ID NO: 1245094 - protein, 21 aa, Mycobacterium
PFVLNTGRLPHQWHTMTKTGR

SEQ ID NO: 1245095 - protein, 26 aa, Mycobacterium
PFVNCTDCGPRFTIIASLPYDRAATS

SEQ ID NO: 1245096 - protein, 18 aa, Mycobacterium
PFYVMDVWLAAAERQRTH

SEQ ID NO: 1245097 - protein, 17 aa, Mycobacterium
PGAERWQTYTANRRCYG

SEQ ID NO: 1245098 - protein, 17 aa, Mycobacterium
PGAMPRLVPPWQPMTVV

SEQ ID NO: 1245099 - protein, 28 aa, Mycobacterium
PGAPCVRIGGFALWGSVAVKRKKRKQAA

SEQ ID NO: 1245100 - protein, 17 aa, Mycobacterium
PGAPIPVVAPAPVTAEA

SEQ ID NO: 1245101 - protein, 26 aa, Mycobacterium
PGAPPDGWRTIGRVLAGPADVLVDGD

SEQ ID NO: 1245102 - protein, 23 aa, Mycobacterium
PGAQTRNDIRWHPSSLDRTHRWT

SEQ ID NO: 1245103 - protein, 23 aa, Mycobacterium
PGARDSAAVGYVFDQLVDMLEPP

SEQ ID NO: 1245104 - protein, 20 aa, Mycobacterium
PGCAVEVRLSALPAAENGIA

SEQ ID NO: 1245105 - protein, 20 aa, Mycobacterium
PGCGMNITVWSYVDQLNISV

SEQ ID NO: 1245106 - protein, 23 aa, Mycobacterium
PGDALYLPRGWVHSAHALDTTSI

SEQ ID NO: 1245107 - protein, 22 aa, Mycobacterium
PGDDPWPARAFLAELSAPHNHY

SEQ ID NO: 1245108 - protein, 26 aa, Mycobacterium
PGDDRVASLFLWHFVEEVEHRSSALT

SEQ ID NO: 1245109 - protein, 18 aa, Mycobacterium
PGDGALRNPANWRHLRNP

SEQ ID NO: 1245110 - protein, 18 aa, Mycobacterium
PGDGARLVTTLTRHPGGA

SEQ ID NO: 1245111 - protein, 18 aa, Mycobacterium
PGDRRVYSNYGFGVLAAT

SEQ ID NO: 1245112 - protein, 18 aa, Mycobacterium
PGDTLAIHLVDLTPARTW

SEQ ID NO: 1245113 - protein, 20 aa, Mycobacterium
PGEAFTAVARYAAGFEALRD

SEQ ID NO: 1245114 - protein, 23 aa, Mycobacterium
PGEFPDAGLMRWDGDTLVEEGVY

SEQ ID NO: 1245115 - protein, 21 aa, Mycobacterium
PGEGIDFGLLRYLRADTAERL

SEQ ID NO: 1245116 - protein, 22 aa, Mycobacterium
PGERTRAGLALLQARGTNVLVL

SEQ ID NO: 1245117 - protein, 18 aa, Mycobacterium
PGGAFVYGAGQLQLYNGS

SEQ ID NO: 1245118 - protein, 25 aa, Mycobacterium
PGGCAGLRYNLFFDDRALDGDLTAE

SEQ ID NO: 1245119 - protein, 17 aa, Mycobacterium
PGGCHLTWVMAMKPNGA

SEQ ID NO: 1245120 - protein, 18 aa, Mycobacterium
PGGPRVGVFFDLDGTLVD

SEQ ID NO: 1245121 - protein, 22 aa, Mycobacterium
PGGQTQFAAPVWMPRAKRAPIR

SEQ ID NO: 1245122 - protein, 18 aa, Mycobacterium
PGGRLVVCEFSTPTNRAF

SEQ ID NO: 1245123 - protein, 19 aa, Mycobacterium
PGGSEAWLRNDPMVQIDKL

SEQ ID NO: 1245124 - protein, 23 aa, Mycobacterium
PGGYLKAAVDFALERDDYGPELR

SEQ ID NO: 1245125 - protein, 19 aa, Mycobacterium
PGHAVAHGMALAAEGAAII

SEQ ID NO: 1245126 - protein, 17 aa, Mycobacterium
PGHYEVMFDKSLIDETN

SEQ ID NO: 1245127 - protein, 17 aa, Mycobacterium
PGIEVRPLVQITGESHF

SEQ ID NO: 1245128 - protein, 21 aa, Mycobacterium
PGIQFKDLTPLLADAEGLMAV

SEQ ID NO: 1245129 - protein, 25 aa, Mycobacterium
PGIRRRVAADLQILKRGARLVEFAK

SEQ ID NO: 1245130 - protein, 23 aa, Mycobacterium
PGKGNAMGPAFWAELPDVFTSLD

SEQ ID NO: 1245131 - protein, 17 aa, Mycobacterium
PGLDGLELVAALRAESR

SEQ ID NO: 1245132 - protein, 17 aa, Mycobacterium
PGLEPPPPPSATRPYER

SEQ ID NO: 1245133 - protein, 20 aa, Mycobacterium
PGLGASPVWHAFTIDQAGIV

SEQ ID NO: 1245134 - protein, 19 aa, Mycobacterium
PGLGFAKTGQHNWALLHAL

SEQ ID NO: 1245135 - protein, 22 aa, Mycobacterium
PGLGRYGVWTGGAPKPEQAAQI

SEQ ID NO: 1245136 - protein, 24 aa, Mycobacterium
PGLMTLDGTNTWVLRAPGSDELVI

SEQ ID NO: 1245137 - protein, 17 aa, Mycobacterium
PGLPIGRAAVRREGTDV

SEQ ID NO: 1245138 - protein, 21 aa, Mycobacterium
PGLRATVLKALYDVERGGEGL

SEQ ID NO: 1245139 - protein, 24 aa, Mycobacterium
PGLRDVLAALRWVQNNIAAFGGDP

SEQ ID NO: 1245140 - protein, 18 aa, Mycobacterium
PGMARELFDTEPVFAETM

SEQ ID NO: 1245141 - protein, 19 aa, Mycobacterium
PGMNGIDVCRVLRADSGVP

SEQ ID NO: 1245142 - protein, 24 aa, Mycobacterium
PGMVMKAPVWGAALDDVCTDDTLL

SEQ ID NO: 1245143 - protein, 21 aa, Mycobacterium
PGNEIFGSFFVPDAVEALVAV

SEQ ID NO: 1245144 - protein, 18 aa, Mycobacterium
PGNIVGFSGLAAHDPKVG

SEQ ID NO: 1245145 - protein, 18 aa, Mycobacterium
PGNLTVVLRHRWPEAVVE

SEQ ID NO: 1245146 - protein, 19 aa, Mycobacterium
PGNSLFVSVSCWGKLVTGV

SEQ ID NO: 1245147 - protein, 24 aa, Mycobacterium
PGPAWRLVIVAHHIVIDGWSLPLF

SEQ ID NO: 1245148 - protein, 26 aa, Mycobacterium
PGPQEWRWDKDAGITRLADAYGEDAA

SEQ ID NO: 1245149 - protein, 18 aa, Mycobacterium
PGQFRIGPHTDFGTVTIL

SEQ ID NO: 1245150 - protein, 23 aa, Mycobacterium
PGQGEFIKGFAAPFTLRVIADLL

SEQ ID NO: 1245151 - protein, 20 aa, Mycobacterium
PGQLLRWLVPAFPILQEAAA

SEQ ID NO: 1245152 - protein, 17 aa, Mycobacterium
PGQVRTRMSAHVKEAPL

SEQ ID NO: 1245153 - protein, 17 aa, Mycobacterium
PGRARSGGRLVRQPQRL

SEQ ID NO: 1245154 - protein, 17 aa, Mycobacterium
PGRAVAGEHGFRFFPAY

SEQ ID NO: 1245155 - protein, 24 aa, Mycobacterium
PGRDLPACHVYRTFDDLDAIRADA

SEQ ID NO: 1245156 - protein, 23 aa, Mycobacterium
PGRDSLRTLVPVSVRPADAMDEP

SEQ ID NO: 1245157 - protein, 25 aa, Mycobacterium
PGRHWDHRWALAVLNTALGGGLSSR

SEQ ID NO: 1245158 - protein, 19 aa, Mycobacterium
PGRLRKLVADQIGLILRRS

SEQ ID NO: 1245159 - protein, 23 aa, Mycobacterium
PGRLSGKFWKLLGAATEKNQGRS

SEQ ID NO: 1245160 - protein, 22 aa, Mycobacterium
PGRPRPGVQDVRRSVREGQEGN

SEQ ID NO: 1245161 - protein, 22 aa, Mycobacterium
PGRQRLRIAVCTHSIAREAGRE

SEQ ID NO: 1245162 - protein, 24 aa, Mycobacterium
PGRREVRTSLVPDVFGGNMDTPEM

SEQ ID NO: 1245163 - protein, 17 aa, Mycobacterium
PGRRVRPTIGLTVHQRL

SEQ ID NO: 1245164 - protein, 18 aa, Mycobacterium
PGSREGWDYPQMAKESGT

SEQ ID NO: 1245165 - protein, 18 aa, Mycobacterium
PGTCKDIPLLLTTPHFLV

SEQ ID NO: 1245166 - protein, 17 aa, Mycobacterium
PGTGFAEARSVAVDVLK

SEQ ID NO: 1245167 - protein, 19 aa, Mycobacterium
PGTGLAAISWGLAHERLSI

SEQ ID NO: 1245168 - protein, 24 aa, Mycobacterium
PGTKATVADLQWLRTAGLAEPIAA

SEQ ID NO: 1245169 - protein, 28 aa, Mycobacterium
PGTPNPGWLFSKRVRQMRSLLAEGIRSG

SEQ ID NO: 1245170 - protein, 23 aa, Mycobacterium
PGTTSANVARMFFDRVEKSAQSE

SEQ ID NO: 1245171 - protein, 20 aa, Mycobacterium
PGVEVRPIIQLTGDSEFNEV

SEQ ID NO: 1245172 - protein, 18 aa, Mycobacterium
PGVFGFPHGCRHGPGRRA

SEQ ID NO: 1245173 - protein, 18 aa, Mycobacterium
PGVFRGALDAGARRITER

SEQ ID NO: 1245174 - protein, 17 aa, Mycobacterium
PGVGLRFEFDNRDGDRI

SEQ ID NO: 1245175 - protein, 25 aa, Mycobacterium
PGVPGRSVSKWGAFLDDVAGFDAEF

SEQ ID NO: 1245176 - protein, 27 aa, Mycobacterium
PGVSCVKPAGALYAFPRLDPEVYEIHD

SEQ ID NO: 1245177 - protein, 19 aa, Mycobacterium
PGVTGALLGARTMSHLDDL

SEQ ID NO: 1245178 - protein, 18 aa, Mycobacterium
PGVVLSRRQLLDIVREGP

SEQ ID NO: 1245179 - protein, 24 aa, Mycobacterium
PGWLARRDLVPLGYLGDAAKTAKT

SEQ ID NO: 1245180 - protein, 27 aa, Mycobacterium
PGYTVPDFRRKAVVIAVGGVYDPRIHL

SEQ ID NO: 1245181 - protein, 26 aa, Mycobacterium
PGYTVPEFRRKAVIIAVGGVYDPRIH

SEQ ID NO: 1245182 - protein, 25 aa, Mycobacterium
PHALQLIMDSLRYWVTEMHVDGFRF

SEQ ID NO: 1245183 - protein, 19 aa, Mycobacterium
PHDLWPKQYPAATPRAVTT

SEQ ID NO: 1245184 - protein, 17 aa, Mycobacterium
PHFCLGAPLARLEAAVA

SEQ ID NO: 1245185 - protein, 24 aa, Mycobacterium
PHFTEKRNACGVFHGSVIDYSKTP

SEQ ID NO: 1245186 - protein, 17 aa, Mycobacterium
PHGAALSNSGFRRDPLI

SEQ ID NO: 1245187 - protein, 19 aa, Mycobacterium
PHGDYRFGQQIVVSHDGGD

SEQ ID NO: 1245188 - protein, 17 aa, Mycobacterium
PHGEIRTPAFIAVGTQA

SEQ ID NO: 1245189 - protein, 24 aa, Mycobacterium
PHGGHPVGTVFLGLAGPVDTKVVE

SEQ ID NO: 1245190 - protein, 17 aa, Mycobacterium
PHHRVVLRQQAFGYTYE

SEQ ID NO: 1245191 - protein, 23 aa, Mycobacterium
PHHTRPVRFVWVGDHATRIRLLD

SEQ ID NO: 1245192 - protein, 25 aa, Mycobacterium
PHIEKRFSMPWSHPVGRMREFVAAL

SEQ ID NO: 1245193 - protein, 18 aa, Mycobacterium
PHLCSRGYITEQYDRYVR

SEQ ID NO: 1245194 - protein, 17 aa, Mycobacterium
PHLSVRENIAFPLRAKK

SEQ ID NO: 1245195 - protein, 22 aa, Mycobacterium
PHNLFPLVFDMLYRGDTPRING

SEQ ID NO: 1245196 - protein, 20 aa, Mycobacterium
PHPFLDRRIVIVADTHVDPE

SEQ ID NO: 1245197 - protein, 20 aa, Mycobacterium
PHPKLPGTIYTAAEEIEAAG

SEQ ID NO: 1245198 - protein, 27 aa, Mycobacterium
PHQCTRLAQRSALAVSRIGGSGEQYSG

SEQ ID NO: 1245199 - protein, 19 aa, Mycobacterium
PHRFQVTASRFGRAAARAT

SEQ ID NO: 1245200 - protein, 26 aa, Mycobacterium
PHRYFPRLRLELEQGLGWKADVEAAL

SEQ ID NO: 1245201 - protein, 26 aa, Mycobacterium
PHSERLYCVPATIDLAGAEIELVSMV

SEQ ID NO: 1245202 - protein, 19 aa, Mycobacterium
PHSHFVFLEALRLQGTADQ

SEQ ID NO: 1245203 - protein, 23 aa, Mycobacterium
PHSRKCRCARLVYANSMHVDIVP

SEQ ID NO: 1245204 - protein, 24 aa, Mycobacterium
PHTKPPNFWAWLIGEIKNEDPDVL

SEQ ID NO: 1245205 - protein, 19 aa, Mycobacterium
PHTLHCGPDGVFLTCLGGR

SEQ ID NO: 1245206 - protein, 17 aa, Mycobacterium
PHVSLAIGGVAVLDGPM

SEQ ID NO: 1245207 - protein, 21 aa, Mycobacterium
PHYPYPLARFLPGNRRTALYV

SEQ ID NO: 1245208 - protein, 19 aa, Mycobacterium
PIAGFAQMRIVLSTTNDDP

SEQ ID NO: 1245209 - protein, 28 aa, Mycobacterium
PIARDLSREFIRVCTIAPGLFKTPLLGS

SEQ ID NO: 1245210 - protein, 23 aa, Mycobacterium
PIARPREIHVVPELPKTRSGKIM

SEQ ID NO: 1245211 - protein, 24 aa, Mycobacterium
PIDPWGGSYYVEWLTHQLATAARM

SEQ ID NO: 1245212 - protein, 21 aa, Mycobacterium
PIFAATARLAHWVHEDAELTF

SEQ ID NO: 1245213 - protein, 22 aa, Mycobacterium
PIGRRVLRQSGLMARGITLRPR

SEQ ID NO: 1245214 - protein, 19 aa, Mycobacterium
PIGSMACRIAAHRNNCRVI

SEQ ID NO: 1245215 - protein, 18 aa, Mycobacterium
PIHRGRRQQLWMITITDE

SEQ ID NO: 1245216 - protein, 22 aa, Mycobacterium
PIIDTREGLAWIAQQAALEVHV

SEQ ID NO: 1245217 - protein, 18 aa, Mycobacterium
PIILGGDHTIAWPDHTGV

SEQ ID NO: 1245218 - protein, 18 aa, Mycobacterium
PIKQKYGNKISWADLIAY

SEQ ID NO: 1245219 - protein, 24 aa, Mycobacterium
PILKGDKGEPCWPDGVVGSLTHCE

SEQ ID NO: 1245220 - protein, 20 aa, Mycobacterium
PILQRVMRGGNQLAYLDSGA

SEQ ID NO: 1245221 - protein, 17 aa, Mycobacterium
PILRNAELSKLICVDPD

SEQ ID NO: 1245222 - protein, 20 aa, Mycobacterium
PIMFAACSPTLFVQSTEAVL

SEQ ID NO: 1245223 - protein, 24 aa, Mycobacterium
PIPDERWAAIGWDGCETVGDTAHG

SEQ ID NO: 1245224 - protein, 24 aa, Mycobacterium
PIPLPPKTSYAWAEARHSRGDAER

SEQ ID NO: 1245225 - protein, 17 aa, Mycobacterium
PISGGLLLQQRDALDAD

SEQ ID NO: 1245226 - protein, 29 aa, Mycobacterium
PIVAHIFRAHFWFVEERLRTADDPASRRW

SEQ ID NO: 1245227 - protein, 20 aa, Mycobacterium
PIVQGGMQWVGRAELVAAVA

SEQ ID NO: 1245228 - protein, 28 aa, Mycobacterium
PIWEFPTRFDKICMPEWIPEGTRVVNEL

SEQ ID NO: 1245229 - protein, 26 aa, Mycobacterium
PKAAREFCARTGIFILAESLGGVESL

SEQ ID NO: 1245230 - protein, 26 aa, Mycobacterium
PKALRKVRRLDLGAVFQDPMTSLNPT

SEQ ID NO: 1245231 - protein, 18 aa, Mycobacterium
PKASMRIISDIFGYTSTK

SEQ ID NO: 1245232 - protein, 33 aa, Mycobacterium
PKASVMTHYRWLRALAGFGGLGVRLSSKDTMYC

SEQ ID NO: 1245233 - protein, 32 aa, Mycobacterium
PKELCRKIVIELLAWQFASPVRWIETQDLLFI

SEQ ID NO: 1245234 - protein, 20 aa, Mycobacterium
PKERAGAAYAELALMRGDPS

SEQ ID NO: 1245235 - protein, 19 aa, Mycobacterium
PKGAILTHDNLLWNAINVL

SEQ ID NO: 1245236 - protein, 21 aa, Mycobacterium
PKGEYGGGDMIVWDTGTYETE

SEQ ID NO: 1245237 - protein, 19 aa, Mycobacterium
PKGLAAFRGVGGRVVEKVP

SEQ ID NO: 1245238 - protein, 19 aa, Mycobacterium
PKGQHWRLLSTVKELDPAW

SEQ ID NO: 1245239 - protein, 20 aa, Mycobacterium
PKGTLSLAVAEPIVVARDDE

SEQ ID NO: 1245240 - protein, 22 aa, Mycobacterium
PKIASGDLHFSIGYSEPGAGTD

SEQ ID NO: 1245241 - protein, 17 aa, Mycobacterium
PKILVLGRLRIAIPADF

SEQ ID NO: 1245242 - protein, 21 aa, Mycobacterium
PKIRLGRFADGPTVWAEGETV

SEQ ID NO: 1245243 - protein, 25 aa, Mycobacterium
PKKLARPKVPISIAVGEPIEPTLPA

SEQ ID NO: 1245244 - protein, 20 aa, Mycobacterium
PKLLAEYGFTYDSTLMDSDH

SEQ ID NO: 1245245 - protein, 22 aa, Mycobacterium
PKPGEFLMLYAFGVGEIAISVS

SEQ ID NO: 1245246 - protein, 19 aa, Mycobacterium
PKPLATRIALVTGAASGIG

SEQ ID NO: 1245247 - protein, 19 aa, Mycobacterium
PKPPPQRITLTLPAVQRSR

SEQ ID NO: 1245248 - protein, 29 aa, Mycobacterium
PKRELEWMRRLGAEIERPLSFALIQVDAD

SEQ ID NO: 1245249 - protein, 24 aa, Mycobacterium
PKRIPSFPDLTGIHVLRNFDESLK

SEQ ID NO: 1245250 - protein, 24 aa, Mycobacterium
PKSAEVLGGLGLPTDMDYMGYVDA

SEQ ID NO: 1245251 - protein, 18 aa, Mycobacterium
PKSVPPLRRPEVRARLNP

SEQ ID NO: 1245252 - protein, 17 aa, Mycobacterium
PKSWDPGAVEADIYQGW

SEQ ID NO: 1245253 - protein, 39 aa, Mycobacterium
PKTSGSRGFHIYARIEPRWPFKFVRLAAQTIAREVERRA

SEQ ID NO: 1245254 - protein, 19 aa, Mycobacterium
PKVQGAWNLHAATLDQPLD

SEQ ID NO: 1245255 - protein, 20 aa, Mycobacterium
PKVRLVPFVHRLLVPLVDHD

SEQ ID NO: 1245256 - protein, 26 aa, Mycobacterium
PLAAFCDALGAIGFDISVLDYSEHAL

SEQ ID NO: 1245257 - protein, 18 aa, Mycobacterium
PLANIAIVVQGGRNLVRR

SEQ ID NO: 1245258 - protein, 17 aa, Mycobacterium
PLCPECYDYAGHVLFAW

SEQ ID NO: 1245259 - protein, 25 aa, Mycobacterium
PLDKSRPLWEMYLVEGLAKNRVAIY

SEQ ID NO: 1245260 - protein, 20 aa, Mycobacterium
PLDLRYVDPPARLALDRPDP

SEQ ID NO: 1245261 - protein, 25 aa, Mycobacterium
PLDQFDRLVAVNVRGVFVAIQCAVP

SEQ ID NO: 1245262 - protein, 21 aa, Mycobacterium
PLDRPFAWALIKLDGADTPML

SEQ ID NO: 1245263 - protein, 24 aa, Mycobacterium
PLDRSRPLWEKWIIEGIDGTDARD

SEQ ID NO: 1245264 - protein, 30 aa, Mycobacterium
PLEDWKHWVRWRLIHARAFLLTDELVAEDF

SEQ ID NO: 1245265 - protein, 18 aa, Mycobacterium
PLEPDIPGIDSFTGTSLF

SEQ ID NO: 1245266 - protein, 18 aa, Mycobacterium
PLEQGVRAYDMFKNKQDN

SEQ ID NO: 1245267 - protein, 18 aa, Mycobacterium
PLFHVISGNLGYQVEHHL

SEQ ID NO: 1245268 - protein, 20 aa, Mycobacterium
PLFQSHMWDGSAVPIDENLT

SEQ ID NO: 1245269 - protein, 24 aa, Mycobacterium
PLFSRTSAGLAFTPGGLRLASRAI

SEQ ID NO: 1245270 - protein, 21 aa, Mycobacterium
PLGALLGYRLERWLHEDRRPL

SEQ ID NO: 1245271 - protein, 23 aa, Mycobacterium
PLGATGLAQCAELVWQLRGEAGD

SEQ ID NO: 1245272 - protein, 24 aa, Mycobacterium
PLGEFSRALARRGVTGITDATPDL

SEQ ID NO: 1245273 - protein, 24 aa, Mycobacterium
PLGEQRFPYVFLDATYCKARVNHR

SEQ ID NO: 1245274 - protein, 18 aa, Mycobacterium
PLGLAVARDGRLLICDSP

SEQ ID NO: 1245275 - protein, 25 aa, Mycobacterium
PLGNVRLPIVIAFGLGSLATGMAYP

SEQ ID NO: 1245276 - protein, 23 aa, Mycobacterium
PLHEPRLWPEYHENYYGAFVRDP

SEQ ID NO: 1245277 - protein, 25 aa, Mycobacterium
PLHHFPTRRLCNLASVTSFYFHGDE

SEQ ID NO: 1245278 - protein, 27 aa, Mycobacterium
PLIEVIGGLGIRLSNYLPTRTFELAVH

SEQ ID NO: 1245279 - protein, 18 aa, Mycobacterium
PLIQFTWIYDRAVDIDGL

SEQ ID NO: 1245280 - protein, 23 aa, Mycobacterium
PLIRGRVGLITFDHAVAHELLRS

SEQ ID NO: 1245281 - protein, 18 aa, Mycobacterium
PLLANVDTYRCWLDEERE

SEQ ID NO: 1245282 - protein, 18 aa, Mycobacterium
PLLDELVDLLGRDMAADI

SEQ ID NO: 1245283 - protein, 19 aa, Mycobacterium
PLLDLPWDIAESAPGRIVG

SEQ ID NO: 1245284 - protein, 24 aa, Mycobacterium
PLLDMRRFHLLLAGASWVAEYGNP

SEQ ID NO: 1245285 - protein, 24 aa, Mycobacterium
PLLLDWRAPLSRAFYVATAAHPEG

SEQ ID NO: 1245286 - protein, 17 aa, Mycobacterium
PLNRSLLNEGLREIAAV

SEQ ID NO: 1245287 - protein, 24 aa, Mycobacterium
PLNYRLSREGLHELIARLPDALVI

SEQ ID NO: 1245288 - protein, 26 aa, Mycobacterium
PLPCTPRGIVHLLRRYEVEIAGAHVV

SEQ ID NO: 1245289 - protein, 22 aa, Mycobacterium
PLPMVPSVLCAEDLAPADTAGL

SEQ ID NO: 1245290 - protein, 24 aa, Mycobacterium
PLPRKNIDTGMGIERVACLLQGVD

SEQ ID NO: 1245291 - protein, 26 aa, Mycobacterium
PLQIFAELTLAVSFSIVVRPDHDGDV

SEQ ID NO: 1245292 - protein, 26 aa, Mycobacterium
PLQWNCFGFGIIQRADHFTFYISVDH

SEQ ID NO: 1245293 - protein, 18 aa, Mycobacterium
PLRGRLFAVLGSSLALGD

SEQ ID NO: 1245294 - protein, 18 aa, Mycobacterium
PLRLGRAGTDAVVESMSL

SEQ ID NO: 1245295 - protein, 24 aa, Mycobacterium
PLRLLFKDEVRAVGRELGLPEDIV

SEQ ID NO: 1245296 - protein, 18 aa, Mycobacterium
PLRMCCASASQLGPQAAN

SEQ ID NO: 1245297 - protein, 24 aa, Mycobacterium
PLRNLYRDRLLVLAALDVAPTVEN

SEQ ID NO: 1245298 - protein, 21 aa, Mycobacterium
PLRPRFQGLLPAQTRRRKAAD

SEQ ID NO: 1245299 - protein, 24 aa, Mycobacterium
PLRRGRPAAHVRFAQWHRDNGLNG

SEQ ID NO: 1245300 - protein, 32 aa, Mycobacterium
PLRYRAGDWVYIPKACTFRQIPDTESTLLMIQ

SEQ ID NO: 1245301 - protein, 22 aa, Mycobacterium
PLSCAIGLTVLDVLRAEDLQGN

SEQ ID NO: 1245302 - protein, 20 aa, Mycobacterium
PLSTILTLCRPGEMPVVVEI

SEQ ID NO: 1245303 - protein, 17 aa, Mycobacterium
PLSVFAMAQMFAEAGLP

SEQ ID NO: 1245304 - protein, 21 aa, Mycobacterium
PLTEARAAFRRMQQARHIGKI

SEQ ID NO: 1245305 - protein, 26 aa, Mycobacterium
PLTMKPDVCWQLPIRRTQDWVTRPDG

SEQ ID NO: 1245306 - protein, 18 aa, Mycobacterium
PLVAQVCVIGTPDEKWGE

SEQ ID NO: 1245307 - protein, 17 aa, Mycobacterium
PLVEAGMVYVTLPPLFV

SEQ ID NO: 1245308 - protein, 19 aa, Mycobacterium
PLVHACAAAGTPLLGVCLG

SEQ ID NO: 1245309 - protein, 23 aa, Mycobacterium
PLVKRTWGGEGLVLAQLAEQVSA

SEQ ID NO: 1245310 - protein, 24 aa, Mycobacterium
PLVRPEVATGWLAQARDPRPVLGL

SEQ ID NO: 1245311 - protein, 17 aa, Mycobacterium
PLWEATLVDGLDDGGAA

SEQ ID NO: 1245312 - protein, 21 aa, Mycobacterium
PLYRRLIIAGDWWDTVDEIAG

SEQ ID NO: 1245313 - protein, 23 aa, Mycobacterium
PLYYNERYDFWALSRHADVEKAL

SEQ ID NO: 1245314 - protein, 24 aa, Mycobacterium
PMAGTGWLHGWRLTFGGEDIGWEG

SEQ ID NO: 1245315 - protein, 18 aa, Mycobacterium
PMAVCANGAVIYDPAADR

SEQ ID NO: 1245316 - protein, 23 aa, Mycobacterium
PMFVPKLLGPLLLTPGVHLVKGF

SEQ ID NO: 1245317 - protein, 17 aa, Mycobacterium
PMGDGIFNIGLGYVNSY

SEQ ID NO: 1245318 - protein, 18 aa, Mycobacterium
PMGSRGAGEIGIVGSAAA

SEQ ID NO: 1245319 - protein, 27 aa, Mycobacterium
PMILKRFVKGITEEAVFQKRAPAKRPD

SEQ ID NO: 1245320 - protein, 25 aa, Mycobacterium
PMIRKGAMKSQPWIKAYEDQNVDVG

SEQ ID NO: 1245321 - protein, 21 aa, Mycobacterium
PMLDAALEMAEHKPVGCVILQ

SEQ ID NO: 1245322 - protein, 21 aa, Mycobacterium
PMLGQRVGAWVPLDEVPDVWE

SEQ ID NO: 1245323 - protein, 20 aa, Mycobacterium
PMLRAAAERGYLGDIDATIA

SEQ ID NO: 1245324 - protein, 20 aa, Mycobacterium
PMLRRSALDLIITYRINLPV

SEQ ID NO: 1245325 - protein, 18 aa, Mycobacterium
PMNLLRWTSARSIKENFV

SEQ ID NO: 1245326 - protein, 25 aa, Mycobacterium
PMPAEVQRFASFFLTMDPPEHTVYR

SEQ ID NO: 1245327 - protein, 18 aa, Mycobacterium
PMPLTVAVPTDFAEVLSR

SEQ ID NO: 1245328 - protein, 20 aa, Mycobacterium
PMSVPAGALIGGRRSISGSL

SEQ ID NO: 1245329 - protein, 20 aa, Mycobacterium
PMVADGRVRPIIGAEFPVQE

SEQ ID NO: 1245330 - protein, 20 aa, Mycobacterium
PMVDQIRFFAGAARVLEGKS

SEQ ID NO: 1245331 - protein, 19 aa, Mycobacterium
PMYLFRGDTPVDEFAAVMP

SEQ ID NO: 1245332 - protein, 23 aa, Mycobacterium
PNARTRFVLVGRPAPPPARTGAD

SEQ ID NO: 1245333 - protein, 24 aa, Mycobacterium
PNGDPHVGHAYEYIATDAIARFKR

SEQ ID NO: 1245334 - protein, 18 aa, Mycobacterium
PNGEISWAQSEDGPIPEA

SEQ ID NO: 1245335 - protein, 23 aa, Mycobacterium
PNGEPPPWWAAQRDPVVGDALRL

SEQ ID NO: 1245336 - protein, 21 aa, Mycobacterium
PNKHLAFGYGVHFCLGAALAR

SEQ ID NO: 1245337 - protein, 21 aa, Mycobacterium
PNKHLSFGYGVHFCLGAALAR

SEQ ID NO: 1245338 - protein, 24 aa, Mycobacterium
PNLEILIYHGWYLLYRYWPTSHNT

SEQ ID NO: 1245339 - protein, 19 aa, Mycobacterium
PNLRAVNFVVDGILGQGVA

SEQ ID NO: 1245340 - protein, 17 aa, Mycobacterium
PNLSRLIVKRGFDTNID

SEQ ID NO: 1245341 - protein, 25 aa, Mycobacterium
PNMAFGMIGKYARRVTDVDLSNVRF

SEQ ID NO: 1245342 - protein, 26 aa, Mycobacterium
PNNWISVFGGPAWTRIVEPDGQPGQW

SEQ ID NO: 1245343 - protein, 23 aa, Mycobacterium
PNPKATVALLRRVEDVLDIEVPL

SEQ ID NO: 1245344 - protein, 21 aa, Mycobacterium
PNQQVRCVYVAIGQKGTTIAS

SEQ ID NO: 1245345 - protein, 22 aa, Mycobacterium
PNQRMVLEYKFFEPAMYMTDVP

SEQ ID NO: 1245346 - protein, 18 aa, Mycobacterium
PNRLDLLETLGLTSGELA

SEQ ID NO: 1245347 - protein, 25 aa, Mycobacterium
PNRTARSHLRWIAASNRLPDKRVDE

SEQ ID NO: 1245348 - protein, 21 aa, Mycobacterium
PNSHLAFGFGTHFCLGNQLAR

SEQ ID NO: 1245349 - protein, 25 aa, Mycobacterium
PNSPREVIIENSIKVSKIIGSPAYP

SEQ ID NO: 1245350 - protein, 24 aa, Mycobacterium
PNTVRYRLKRIADFTGRDPTLPRD

SEQ ID NO: 1245351 - protein, 19 aa, Mycobacterium
PNVFTGYWMKAEASAEALR

SEQ ID NO: 1245352 - protein, 25 aa, Mycobacterium
PNWLPCPNGTFAPGHQKFILEGVNP

SEQ ID NO: 1245353 - protein, 25 aa, Mycobacterium
PNYLSLASPYAFLGLNFFNTMEYQM

SEQ ID NO: 1245354 - protein, 18 aa, Mycobacterium
PPAAYRASLPPAATYARV

SEQ ID NO: 1245355 - protein, 24 aa, Mycobacterium
PPAGLRVIALRARLGEERHAALLL

SEQ ID NO: 1245356 - protein, 21 aa, Mycobacterium
PPALERAWHTHGYYGSVSHNV

SEQ ID NO: 1245357 - protein, 29 aa, Mycobacterium
PPALIKAILKAPVDLLWNGGIGTYVKAEA

SEQ ID NO: 1245358 - protein, 17 aa, Mycobacterium
PPASALWLRDNVGVQVA

SEQ ID NO: 1245359 - protein, 17 aa, Mycobacterium
PPDRARATMVLERAAAA

SEQ ID NO: 1245360 - protein, 19 aa, Mycobacterium
PPEDLVWAAVEAEMLRLHV

SEQ ID NO: 1245361 - protein, 21 aa, Mycobacterium
PPELAGLWELPGGKVARGESD

SEQ ID NO: 1245362 - protein, 35 aa, Mycobacterium
PPELHLLGSILWRRAMGLVLGDWVRTGDCTEADAI

SEQ ID NO: 1245363 - protein, 26 aa, Mycobacterium
PPEPHYRPSAALQDFVRCRDLTCRFP

SEQ ID NO: 1245364 - protein, 23 aa, Mycobacterium
PPESLLPTPAWYALDRGLIMADG

SEQ ID NO: 1245365 - protein, 19 aa, Mycobacterium
PPEVYGGAGVHVTELVAQL

SEQ ID NO: 1245366 - protein, 25 aa, Mycobacterium
PPGAEVSDMFTGHAFATVDDLHSFT

SEQ ID NO: 1245367 - protein, 19 aa, Mycobacterium
PPGAWLAYGQWLRTPVHGI

SEQ ID NO: 1245368 - protein, 26 aa, Mycobacterium
PPGCPFAPRCPLAIDECRAAEPELIE

SEQ ID NO: 1245369 - protein, 27 aa, Mycobacterium
PPGPPFSEFDRTAGFGVYGTAKAALNR

SEQ ID NO: 1245370 - protein, 17 aa, Mycobacterium
PPGTMLVVVHSGGGRAK

SEQ ID NO: 1245371 - protein, 22 aa, Mycobacterium
PPIARGEVIWCQGFSEPEAGSD

SEQ ID NO: 1245372 - protein, 17 aa, Mycobacterium
PPKDFAPQFGRNIDVAK

SEQ ID NO: 1245373 - protein, 19 aa, Mycobacterium
PPKQRRRATARTRGGDRAA

SEQ ID NO: 1245374 - protein, 19 aa, Mycobacterium
PPLAPPRRPPGRRERILST

SEQ ID NO: 1245375 - protein, 18 aa, Mycobacterium
PPLDAGIAPGVYDDLFSG

SEQ ID NO: 1245376 - protein, 19 aa, Mycobacterium
PPLLLRMVEAGQLGKKSGQ

SEQ ID NO: 1245377 - protein, 23 aa, Mycobacterium
PPLRRPEVRARLNPGLDRSSRAQ

SEQ ID NO: 1245378 - protein, 17 aa, Mycobacterium
PPLTAREAIDLAREQIT

SEQ ID NO: 1245379 - protein, 25 aa, Mycobacterium
PPLTYLTRWRMTVAADLLVDESATI

SEQ ID NO: 1245380 - protein, 23 aa, Mycobacterium
PPLVVRINFLGTRHFTESMLPRM

SEQ ID NO: 1245381 - protein, 18 aa, Mycobacterium
PPMAELVVHPDFRRRGTG

SEQ ID NO: 1245382 - protein, 20 aa, Mycobacterium
PPNALPWLRGVYDRYVIVGA

SEQ ID NO: 1245383 - protein, 23 aa, Mycobacterium
PPPELRAAVIAVGPHDFRASSWG

SEQ ID NO: 1245384 - protein, 20 aa, Mycobacterium
PPPRELRESLGPALAAAQAG

SEQ ID NO: 1245385 - protein, 27 aa, Mycobacterium
PPPRRSGRRAIPVLAGALVAAAGVGAA

SEQ ID NO: 1245386 - protein, 18 aa, Mycobacterium
PPQAGLLAHFTAVADATD

SEQ ID NO: 1245387 - protein, 25 aa, Mycobacterium
PPQPEPFTTIAWRMAHVIVGVFAMR

SEQ ID NO: 1245388 - protein, 26 aa, Mycobacterium
PPQWLPGPRELRAWTLASGTREPNGY

SEQ ID NO: 1245389 - protein, 22 aa, Mycobacterium
PPREVPEIPVATRLSGLEPLNI

SEQ ID NO: 1245390 - protein, 21 aa, Mycobacterium
PPRIGEFDLPAALQRASDVLI

SEQ ID NO: 1245391 - protein, 20 aa, Mycobacterium
PPRQRMRVMMEALVNPSHWA

SEQ ID NO: 1245392 - protein, 20 aa, Mycobacterium
PPRRPPGRRERILSTATRLF

SEQ ID NO: 1245393 - protein, 18 aa, Mycobacterium
PPSALVLAGGGALDDELL

SEQ ID NO: 1245394 - protein, 19 aa, Mycobacterium
PPSSFQWGWNSVPVEVQVE

SEQ ID NO: 1245395 - protein, 17 aa, Mycobacterium
PPSVRRGLHGKVADVLV

SEQ ID NO: 1245396 - protein, 18 aa, Mycobacterium
PPTARGWEVVAGDEVWDW

SEQ ID NO: 1245397 - protein, 18 aa, Mycobacterium
PPTFVVSSAHWRADDDMF

SEQ ID NO: 1245398 - protein, 24 aa, Mycobacterium
PPTGCAFHPRCPLAIDACDDTGLD

SEQ ID NO: 1245399 - protein, 18 aa, Mycobacterium
PPTLLPVGVRQWPVTVSH

SEQ ID NO: 1245400 - protein, 26 aa, Mycobacterium
PPTQIWRKTFGDHFFYILYFQEPGVA

SEQ ID NO: 1245401 - protein, 31 aa, Mycobacterium
PPTVTVFGIPIFKLGGAPVKVVSSVTLGDLD

SEQ ID NO: 1245402 - protein, 19 aa, Mycobacterium
PPVLCTVKLARRVLTRDEA

SEQ ID NO: 1245403 - protein, 23 aa, Mycobacterium
PPVRGCGSVDEIVEAVRGYAERH

SEQ ID NO: 1245404 - protein, 18 aa, Mycobacterium
PPVVALAAKGVWITIDHP

SEQ ID NO: 1245405 - protein, 20 aa, Mycobacterium
PPWLRRWVRDGYGWIQPRLS

SEQ ID NO: 1245406 - protein, 20 aa, Mycobacterium
PPYEWWCWHDEYGQSEERGC

SEQ ID NO: 1245407 - protein, 17 aa, Mycobacterium
PQAAPVYEPEPEPTPPP

SEQ ID NO: 1245408 - protein, 18 aa, Mycobacterium
PQAPRPVLPEAPPAQPTA

SEQ ID NO: 1245409 - protein, 22 aa, Mycobacterium
PQDHLWYYKSLLEVYRGRSSSW

SEQ ID NO: 1245410 - protein, 22 aa, Mycobacterium
PQDPGTICGPVISGRQQARILG

SEQ ID NO: 1245411 - protein, 18 aa, Mycobacterium
PQEAAYISCGTWGLVGVE

SEQ ID NO: 1245412 - protein, 23 aa, Mycobacterium
PQEFGGGGASVWEQTVVREEMWA

SEQ ID NO: 1245413 - protein, 17 aa, Mycobacterium
PQFSSVVECAAAAKDLG

SEQ ID NO: 1245414 - protein, 19 aa, Mycobacterium
PQFTKPVRLVWGMRDRCFT

SEQ ID NO: 1245415 - protein, 26 aa, Mycobacterium
PQHAKLWYQVVFAFLARHVLGRDVEL

SEQ ID NO: 1245416 - protein, 18 aa, Mycobacterium
PQKASAIAPQIVDDQYTI

SEQ ID NO: 1245417 - protein, 22 aa, Mycobacterium
PQLPKIGERFLGTVVKTTDFGA

SEQ ID NO: 1245418 - protein, 18 aa, Mycobacterium
PQLRVKGVSRLRVVDASA

SEQ ID NO: 1245419 - protein, 18 aa, Mycobacterium
PQLVVPVLNARFALNAAN

SEQ ID NO: 1245420 - protein, 18 aa, Mycobacterium
PQMQIAVGGCLAQKDRDA

SEQ ID NO: 1245421 - protein, 22 aa, Mycobacterium
PQMRERRSGVVVNVTSSVTLTA

SEQ ID NO: 1245422 - protein, 25 aa, Mycobacterium
PQMTEVLPLLYLHGLSTSDFGPALE

SEQ ID NO: 1245423 - protein, 23 aa, Mycobacterium
PQPDLPTSFAIKLPSQDDAVRDR

SEQ ID NO: 1245424 - protein, 22 aa, Mycobacterium
PQPICRYCRSQKLGVRTVSGRG

SEQ ID NO: 1245425 - protein, 25 aa, Mycobacterium
PQPIKDRGSLIVGVNVPYAPNEFKD

SEQ ID NO: 1245426 - protein, 20 aa, Mycobacterium
PQQRLFRGSLEMHPQYVLEN

SEQ ID NO: 1245427 - protein, 20 aa, Mycobacterium
PQRELRELHAQLGIATEAWS

SEQ ID NO: 1245428 - protein, 23 aa, Mycobacterium
PQRLPIDRLLGLLTEIEDDLPAT

SEQ ID NO: 1245429 - protein, 20 aa, Mycobacterium
PQRLRSGWINGVKELPVSYR

SEQ ID NO: 1245430 - protein, 19 aa, Mycobacterium
PQRQIGVGWAALRSLPAPA

SEQ ID NO: 1245431 - protein, 22 aa, Mycobacterium
PQRRSASVTAVAWRTSAGAAAR

SEQ ID NO: 1245432 - protein, 30 aa, Mycobacterium
PQVLATVTAWCARLDVLATDMRVEQRSLED

SEQ ID NO: 1245433 - protein, 20 aa, Mycobacterium
PQVSVPLAYAATVTDGEFAC

SEQ ID NO: 1245434 - protein, 19 aa, Mycobacterium
PQVVKEVAPVPVLAAGGIG

SEQ ID NO: 1245435 - protein, 19 aa, Mycobacterium
PQWFRLRSLTVRGVASAAG

SEQ ID NO: 1245436 - protein, 18 aa, Mycobacterium
PRAAFAAAQRWRRRAEHP

SEQ ID NO: 1245437 - protein, 24 aa, Mycobacterium
PRAMCAAEISELVKELGGLSVILG

SEQ ID NO: 1245438 - protein, 25 aa, Mycobacterium
PRAYRGGTVPGFPNLFITSAPNYSP

SEQ ID NO: 1245439 - protein, 20 aa, Mycobacterium
PRDALLRLLVDVQYARNDMA

SEQ ID NO: 1245440 - protein, 27 aa, Mycobacterium
PRDDPFAFSFSGLKTAVARYVESHPEA

SEQ ID NO: 1245441 - protein, 23 aa, Mycobacterium
PRDDRPRPALRAGEHLFAQTAQS

SEQ ID NO: 1245442 - protein, 24 aa, Mycobacterium
PRDEAVEAIVGWIVERRNTAPTAD

SEQ ID NO: 1245443 - protein, 19 aa, Mycobacterium
PRDGRFGSGPSKVRPEQLQ

SEQ ID NO: 1245444 - protein, 18 aa, Mycobacterium
PRDGRFLLVGNHTISGSA

SEQ ID NO: 1245445 - protein, 22 aa, Mycobacterium
PRDLAARLARSGLIVPEEAIWT

SEQ ID NO: 1245446 - protein, 20 aa, Mycobacterium
PRDRMPIFPVPEGHDQASWL

SEQ ID NO: 1245447 - protein, 18 aa, Mycobacterium
PREAAGVVVECRGRVVQL

SEQ ID NO: 1245448 - protein, 19 aa, Mycobacterium
PRELETMPFLANDRLDPKL

SEQ ID NO: 1245449 - protein, 25 aa, Mycobacterium
PRENDIWLLGAIGPRMVYSTNLDAA

SEQ ID NO: 1245450 - protein, 26 aa, Mycobacterium
PRERKVNASWRLDDRGVFSDSHGDLL

SEQ ID NO: 1245451 - protein, 20 aa, Mycobacterium
PRERSLHAAASFEVETDARV

SEQ ID NO: 1245452 - protein, 21 aa, Mycobacterium
PRERVAEFDRRLRAVEKKVRD

SEQ ID NO: 1245453 - protein, 17 aa, Mycobacterium
PRERVVSSWTRCTDVVD

SEQ ID NO: 1245454 - protein, 20 aa, Mycobacterium
PREVLGVLRAVLFAPEDLAL

SEQ ID NO: 1245455 - protein, 20 aa, Mycobacterium
PREWGDWATRAAMPTLRIPD

SEQ ID NO: 1245456 - protein, 17 aa, Mycobacterium
PRFASAESFAEHTPAAV

SEQ ID NO: 1245457 - protein, 19 aa, Mycobacterium
PRFPLLAIGIREMRSQNSW

SEQ ID NO: 1245458 - protein, 20 aa, Mycobacterium
PRGAAAVSVVVTRLGSGTAS

SEQ ID NO: 1245459 - protein, 17 aa, Mycobacterium
PRGEEWGRLIVPAAPPD

SEQ ID NO: 1245460 - protein, 20 aa, Mycobacterium
PRGGPRASCLDRLLETNRSE

SEQ ID NO: 1245461 - protein, 20 aa, Mycobacterium
PRGPALLEYIAMYRDRARIT

SEQ ID NO: 1245462 - protein, 19 aa, Mycobacterium
PRGPGPLRDTLSGLRLREL

SEQ ID NO: 1245463 - protein, 18 aa, Mycobacterium
PRGRPELREALADYLARV

SEQ ID NO: 1245464 - protein, 18 aa, Mycobacterium
PRGTDWHPHRGFETVTYM

SEQ ID NO: 1245465 - protein, 18 aa, Mycobacterium
PRGTEWIAPGDFEVPPAV

SEQ ID NO: 1245466 - protein, 17 aa, Mycobacterium
PRIAAPDLARAGGDLLA

SEQ ID NO: 1245467 - protein, 26 aa, Mycobacterium
PRIFKRIRPAFRYERSLAVLTAARDD

SEQ ID NO: 1245468 - protein, 20 aa, Mycobacterium
PRIPEWPGMRSYPGEVSHSA

SEQ ID NO: 1245469 - protein, 32 aa, Mycobacterium
PRIREVALMRAVLWRRCDYLWDHHVVLAQRAG

SEQ ID NO: 1245470 - protein, 24 aa, Mycobacterium
PRIRGHAVEARLCAEDPADDYRPC

SEQ ID NO: 1245471 - protein, 18 aa, Mycobacterium
PRKVFDLLEHAPVDVAVL

SEQ ID NO: 1245472 - protein, 20 aa, Mycobacterium
PRKVSALEMTFFGALVNAGS

SEQ ID NO: 1245473 - protein, 17 aa, Mycobacterium
PRKVVTCASYRAREFGV

SEQ ID NO: 1245474 - protein, 24 aa, Mycobacterium
PRLADGIDIVGRWAEAVGLDVALA

SEQ ID NO: 1245475 - protein, 21 aa, Mycobacterium
PRLIRARRGVILGSGGFEHNE

SEQ ID NO: 1245476 - protein, 18 aa, Mycobacterium
PRLMAYLFEVDYADHFVW

SEQ ID NO: 1245477 - protein, 20 aa, Mycobacterium
PRLRGWGESMSRQAGGRAGG

SEQ ID NO: 1245478 - protein, 22 aa, Mycobacterium
PRLRMRHAPFRIGYIERDAWLR

SEQ ID NO: 1245479 - protein, 23 aa, Mycobacterium
PRLTALMCTADVLALSAMDHLRS

SEQ ID NO: 1245480 - protein, 19 aa, Mycobacterium
PRLVCHPTESYGMRLTDPS

SEQ ID NO: 1245481 - protein, 24 aa, Mycobacterium
PRLVELYSAGLLKLDELVTREYSL

SEQ ID NO: 1245482 - protein, 22 aa, Mycobacterium
PRMKANVGIRRRLAPLLENDRN

SEQ ID NO: 1245483 - protein, 17 aa, Mycobacterium
PRMSTYLVALIAGPYAR

SEQ ID NO: 1245484 - protein, 18 aa, Mycobacterium
PRNAFWRIAGALYGFDAD

SEQ ID NO: 1245485 - protein, 20 aa, Mycobacterium
PRNNETLRRLAFLAERRDDR

SEQ ID NO: 1245486 - protein, 17 aa, Mycobacterium
PRNVMPVHGTWRHLRAN

SEQ ID NO: 1245487 - protein, 25 aa, Mycobacterium
PRPDARISVSPLGFVAEGRSLIGSY

SEQ ID NO: 1245488 - protein, 21 aa, Mycobacterium
PRPDHRLRLEHVGAITDEQLE

SEQ ID NO: 1245489 - protein, 25 aa, Mycobacterium
PRPLSCAIAAVSVGVVDGRVRVDLP

SEQ ID NO: 1245490 - protein, 24 aa, Mycobacterium
PRPQFTCSTLHLHAWPAATELDLL

SEQ ID NO: 1245491 - protein, 21 aa, Mycobacterium
PRPVDLMTALALPVPTIAICA

SEQ ID NO: 1245492 - protein, 19 aa, Mycobacterium
PRQHLAFSVGTHYCLGSAL

SEQ ID NO: 1245493 - protein, 17 aa, Mycobacterium
PRRAEPRTKVPAGSVGL

SEQ ID NO: 1245494 - protein, 19 aa, Mycobacterium
PRRDRRHAIAHLVFVEDSD

SEQ ID NO: 1245495 - protein, 18 aa, Mycobacterium
PRRIPTFIEEALRMHAPT

SEQ ID NO: 1245496 - protein, 20 aa, Mycobacterium
PRRSARRFPDKTAIVDGDVV

SEQ ID NO: 1245497 - protein, 19 aa, Mycobacterium
PRSLPELSRLCRTALESLE

SEQ ID NO: 1245498 - protein, 22 aa, Mycobacterium
PRSLVDFYIAYRAVVRAKVDCI

SEQ ID NO: 1245499 - protein, 19 aa, Mycobacterium
PRSRLLYRAFPYNEAALLL

SEQ ID NO: 1245500 - protein, 21 aa, Mycobacterium
PRSSWEDYDRSLISEGGGVYS

SEQ ID NO: 1245501 - protein, 17 aa, Mycobacterium
PRSTPALEIPAIEVRGT

SEQ ID NO: 1245502 - protein, 22 aa, Mycobacterium
PRSVALRMAIVGKHERMSAQRA

SEQ ID NO: 1245503 - protein, 17 aa, Mycobacterium
PRTDWCFTTEADPGLAG

SEQ ID NO: 1245504 - protein, 18 aa, Mycobacterium
PRTFHAWAVRAPSKRALW

SEQ ID NO: 1245505 - protein, 18 aa, Mycobacterium
PRTNPDWDQLLRGAVHDT

SEQ ID NO: 1245506 - protein, 23 aa, Mycobacterium
PRTTDPASLAWLFYTSGTTGRSK

SEQ ID NO: 1245507 - protein, 20 aa, Mycobacterium
PRVAELLARAIGDCYGGSRF

SEQ ID NO: 1245508 - protein, 19 aa, Mycobacterium
PRVAEVLPDLPRLRTLIQV

SEQ ID NO: 1245509 - protein, 17 aa, Mycobacterium
PRVLDHLGLDFAAVQAL

SEQ ID NO: 1245510 - protein, 19 aa, Mycobacterium
PRVLEFLSCGEHPRLAALG

SEQ ID NO: 1245511 - protein, 25 aa, Mycobacterium
PRVLQFKPGLLLGRDLCEDVLDRLE

SEQ ID NO: 1245512 - protein, 19 aa, Mycobacterium
PRVPMQGRFIYAGLADQLV

SEQ ID NO: 1245513 - protein, 17 aa, Mycobacterium
PRVPVTLVHGSGDDVVP

SEQ ID NO: 1245514 - protein, 25 aa, Mycobacterium
PRVRRICTDRGVLLIADEIQSGLAR

SEQ ID NO: 1245515 - protein, 18 aa, Mycobacterium
PRVTLPYTETAWDAVCAL

SEQ ID NO: 1245516 - protein, 20 aa, Mycobacterium
PRWEEIPDRHLVRTDGSSVQ

SEQ ID NO: 1245517 - protein, 21 aa, Mycobacterium
PRYAELIKRTQWWGRQMLIWG

SEQ ID NO: 1245518 - protein, 20 aa, Mycobacterium
PRYAGWTTFARLPRLEDVSH

SEQ ID NO: 1245519 - protein, 17 aa, Mycobacterium
PRYGEGVYALRNIDEGF

SEQ ID NO: 1245520 - protein, 32 aa, Mycobacterium
PRYSGHAIAGVSGFGFGGANAHMVLREVLPSD

SEQ ID NO: 1245521 - protein, 17 aa, Mycobacterium
PRYVEFLDELPLNATGK

SEQ ID NO: 1245522 - protein, 18 aa, Mycobacterium
PSAAMAEMVRVLRPGRRM

SEQ ID NO: 1245523 - protein, 20 aa, Mycobacterium
PSALKAAEMLAEEWDVAADV

SEQ ID NO: 1245524 - protein, 18 aa, Mycobacterium
PSALVAIAALSRLGAVAV

SEQ ID NO: 1245525 - protein, 24 aa, Mycobacterium
PSANARWGNNIAILAGDYLFATAS

SEQ ID NO: 1245526 - protein, 20 aa, Mycobacterium
PSAPAFVLLHGFPTSSHMFR

SEQ ID NO: 1245527 - protein, 24 aa, Mycobacterium
PSAPIPQFLVKRAKKIVLHSATEG

SEQ ID NO: 1245528 - protein, 25 aa, Mycobacterium
PSAPRAAQLEACFEELAELTGQRNA

SEQ ID NO: 1245529 - protein, 26 aa, Mycobacterium
PSAPRAARLEACFEELAELTGQRNAI

SEQ ID NO: 1245530 - protein, 23 aa, Mycobacterium
PSAQNAQPWSWRVTPGGVDLFAD

SEQ ID NO: 1245531 - protein, 19 aa, Mycobacterium
PSASINFVTCHDGFTMHDL

SEQ ID NO: 1245532 - protein, 19 aa, Mycobacterium
PSASKGRYLKKIVVSTTTG

SEQ ID NO: 1245533 - protein, 24 aa, Mycobacterium
PSCGRCPSCQAGLRNLCDLGAGLL

SEQ ID NO: 1245534 - protein, 18 aa, Mycobacterium
PSDEAFSRMFERDKNELR

SEQ ID NO: 1245535 - protein, 25 aa, Mycobacterium
PSDEFPHPAVLEVRGEVFFRVADFE

SEQ ID NO: 1245536 - protein, 18 aa, Mycobacterium
PSDVISLGATSWRITEIT

SEQ ID NO: 1245537 - protein, 29 aa, Mycobacterium
PSGALLNVCVSYRIRGAVDLAALRGALDA

SEQ ID NO: 1245538 - protein, 19 aa, Mycobacterium
PSGEPLRMCCASASQLGPQ

SEQ ID NO: 1245539 - protein, 18 aa, Mycobacterium
PSGLRHELFYGQKVVPGS

SEQ ID NO: 1245540 - protein, 18 aa, Mycobacterium
PSHATVAVGGNRQGHKGF

SEQ ID NO: 1245541 - protein, 18 aa, Mycobacterium
PSHGFRGVLEKLAAELRP

SEQ ID NO: 1245542 - protein, 19 aa, Mycobacterium
PSHILGLLNIVMALETGTW

SEQ ID NO: 1245543 - protein, 19 aa, Mycobacterium
PSHLAGGYAQNAFAFNYLG

SEQ ID NO: 1245544 - protein, 21 aa, Mycobacterium
PSKLCDWCSHRALCPEFGGTP

SEQ ID NO: 1245545 - protein, 18 aa, Mycobacterium
PSLDDVFLSLTGHRTEDE

SEQ ID NO: 1245546 - protein, 20 aa, Mycobacterium
PSLDIGLSWQQYLRVHSGIV

SEQ ID NO: 1245547 - protein, 23 aa, Mycobacterium
PSLDLFLTPTFRGYLANYGTVLY

SEQ ID NO: 1245548 - protein, 23 aa, Mycobacterium
PSLHAGHLVPLLTLRRFQQAGHR

SEQ ID NO: 1245549 - protein, 19 aa, Mycobacterium
PSLIRRAAAYFERALVTRV

SEQ ID NO: 1245550 - protein, 25 aa, Mycobacterium
PSLPGIPGIESFTAAGGEMFHSARW

SEQ ID NO: 1245551 - protein, 24 aa, Mycobacterium
PSMEAEWRRTLLVCRAQGDDVVVP

SEQ ID NO: 1245552 - protein, 20 aa, Mycobacterium
PSNTVSYCAYKGRAAYYSLA

SEQ ID NO: 1245553 - protein, 23 aa, Mycobacterium
PSPQARLALIAAIREAGLDCHVM

SEQ ID NO: 1245554 - protein, 22 aa, Mycobacterium
PSQSNFVWLPLAERTLDFVRRA

SEQ ID NO: 1245555 - protein, 19 aa, Mycobacterium
PSSLALPLALYRAVTAFGR

SEQ ID NO: 1245556 - protein, 25 aa, Mycobacterium
PSSLLRPAVALSWRARLQPMDEGWL

SEQ ID NO: 1245557 - protein, 17 aa, Mycobacterium
PSSQWRYSHNYLHHVFT

SEQ ID NO: 1245558 - protein, 21 aa, Mycobacterium
PSTDAILTCRLIDRPLRPTFV

SEQ ID NO: 1245559 - protein, 21 aa, Mycobacterium
PSTLGYKGFPKSCCTSLNEVI

SEQ ID NO: 1245560 - protein, 25 aa, Mycobacterium
PSTVADMMIYLTWTMDGRGAQEGRT

SEQ ID NO: 1245561 - protein, 25 aa, Mycobacterium
PSVDEPFSALAFKIAVHPFFGKLTY

SEQ ID NO: 1245562 - protein, 18 aa, Mycobacterium
PSVGAVLGALVWTKEVWL

SEQ ID NO: 1245563 - protein, 20 aa, Mycobacterium
PSVRVVPTGGDWVRTEMVRE

SEQ ID NO: 1245564 - protein, 24 aa, Mycobacterium
PSWMKRLDFGAAEAVLISHHAFAA

SEQ ID NO: 1245565 - protein, 17 aa, Mycobacterium
PSYGIAEATLFVATIAP

SEQ ID NO: 1245566 - protein, 17 aa, Mycobacterium
PSYGLAEATLFVSTTPV

SEQ ID NO: 1245567 - protein, 23 aa, Mycobacterium
PSYKSCFLAMMRSFHDAGVTALN

SEQ ID NO: 1245568 - protein, 25 aa, Mycobacterium
PSYLHSFAPMPLHRVDSGGKKGLQE

SEQ ID NO: 1245569 - protein, 26 aa, Mycobacterium
PSYPPEAIDWLLPRGAHTVLDLGAGT

SEQ ID NO: 1245570 - protein, 24 aa, Mycobacterium
PTAALDIWWCQGFSEPEAGSDLAS

SEQ ID NO: 1245571 - protein, 18 aa, Mycobacterium
PTAALGVTGVRYRPLAGD

SEQ ID NO: 1245572 - protein, 26 aa, Mycobacterium
PTAAPRWVVDPDFNLDFHVRRVRIPE

SEQ ID NO: 1245573 - protein, 24 aa, Mycobacterium
PTAKSAVDMAIWDALGRTLGLPVS

SEQ ID NO: 1245574 - protein, 23 aa, Mycobacterium
PTAVLSRGICGVAGRTLVVNLPG

SEQ ID NO: 1245575 - protein, 18 aa, Mycobacterium
PTDAYWLLRHAIAARDPV

SEQ ID NO: 1245576 - protein, 33 aa, Mycobacterium
PTDRLLNLLHYVKWYLDGTLTFRRSCAHGVCGS

SEQ ID NO: 1245577 - protein, 23 aa, Mycobacterium
PTDVRAAAAYARMFEANSEQDGG

SEQ ID NO: 1245578 - protein, 21 aa, Mycobacterium
PTDWGRCVVTIGVFDGVHRGH

SEQ ID NO: 1245579 - protein, 25 aa, Mycobacterium
PTGDAELLLIGWGSSYGPIGEACRR

SEQ ID NO: 1245580 - protein, 26 aa, Mycobacterium
PTGFGEVMPGLTIPGKLDKLGYKGID

SEQ ID NO: 1245581 - protein, 18 aa, Mycobacterium
PTGLPSQEQVKELLDGEF

SEQ ID NO: 1245582 - protein, 19 aa, Mycobacterium
PTGRVRRPGATRCRPGGVR

SEQ ID NO: 1245583 - protein, 20 aa, Mycobacterium
PTGVTYSWEVVRRLVQMRTA

SEQ ID NO: 1245584 - protein, 17 aa, Mycobacterium
PTHSFAFVGADKATTAP

SEQ ID NO: 1245585 - protein, 20 aa, Mycobacterium
PTKFWADVCKHMDLDEYADD

SEQ ID NO: 1245586 - protein, 24 aa, Mycobacterium
PTKLLWQECDAVSMPRAVAITKLD

SEQ ID NO: 1245587 - protein, 18 aa, Mycobacterium
PTLACVLAGLGVTSLSAA

SEQ ID NO: 1245588 - protein, 20 aa, Mycobacterium
PTLHGELIGSLAITEPGGGS

SEQ ID NO: 1245589 - protein, 20 aa, Mycobacterium
PTLPPSVPPIEFPATVPAVP

SEQ ID NO: 1245590 - protein, 24 aa, Mycobacterium
PTPDMRLEMPLVDFFSRGGSLKSS

SEQ ID NO: 1245591 - protein, 17 aa, Mycobacterium
PTPGHAVGLSFSVDPEV

SEQ ID NO: 1245592 - protein, 17 aa, Mycobacterium
PTPLGPLRAEAWVEHED

SEQ ID NO: 1245593 - protein, 26 aa, Mycobacterium
PTPLLWQRYLAIIFDGLRPEGAHPLP

SEQ ID NO: 1245594 - protein, 26 aa, Mycobacterium
PTPPRWEYVADFDLDFHMRRVTAPAP

SEQ ID NO: 1245595 - protein, 18 aa, Mycobacterium
PTPRPALNGTGPRELSYI

SEQ ID NO: 1245596 - protein, 21 aa, Mycobacterium
PTPSRRAVFYARPHVDAAELP

SEQ ID NO: 1245597 - protein, 26 aa, Mycobacterium
PTRLHWYVPNSIRWLDRLKAVSPELV

SEQ ID NO: 1245598 - protein, 24 aa, Mycobacterium
PTRVWGVPAAGMWAHRLGDQRAKR

SEQ ID NO: 1245599 - protein, 23 aa, Mycobacterium
PTSAPRPAGMFHVALEVGTLDEL

SEQ ID NO: 1245600 - protein, 31 aa, Mycobacterium
PTSHLFRPGHRIRLALAGADASHFAVLPGTP

SEQ ID NO: 1245601 - protein, 22 aa, Mycobacterium
PTSRDFPVHWPVSTRWTDNDMF

SEQ ID NO: 1245602 - protein, 20 aa, Mycobacterium
PTSSMGRLFDCVAALAGVRQ

SEQ ID NO: 1245603 - protein, 18 aa, Mycobacterium
PTSVRPGQQLTIVNRDDP

SEQ ID NO: 1245604 - protein, 24 aa, Mycobacterium
PTTALPLFAGWRAMPLAADAPARA

SEQ ID NO: 1245605 - protein, 23 aa, Mycobacterium
PTTDGAYWWAREMTPEMAERNSP

SEQ ID NO: 1245606 - protein, 19 aa, Mycobacterium
PTTRPRRILFVAGGSGITP

SEQ ID NO: 1245607 - protein, 17 aa, Mycobacterium
PTTVLRMHQMICAAVGT

SEQ ID NO: 1245608 - protein, 18 aa, Mycobacterium
PTVPLPGFVVKKGAKGLM

SEQ ID NO: 1245609 - protein, 25 aa, Mycobacterium
PTVTDGWRLERLTAPSRLFGANGLR

SEQ ID NO: 1245610 - protein, 25 aa, Mycobacterium
PTVTGSVFPEWARKDLKDHAIGHVR

SEQ ID NO: 1245611 - protein, 21 aa, Mycobacterium
PTVYRRWPSKAHVVFDAAFQV

SEQ ID NO: 1245612 - protein, 24 aa, Mycobacterium
PTWDDELLDLFGLAGESLPAIVDS

SEQ ID NO: 1245613 - protein, 23 aa, Mycobacterium
PTYPEDRLAFILGDCDAKLVLRE

SEQ ID NO: 1245614 - protein, 21 aa, Mycobacterium
PVACRACGAKVLARKSSWQQT

SEQ ID NO: 1245615 - protein, 17 aa, Mycobacterium
PVAGLPFDEADGVVPNE

SEQ ID NO: 1245616 - protein, 21 aa, Mycobacterium
PVATLPMAVPVSLRSDADPAG

SEQ ID NO: 1245617 - protein, 18 aa, Mycobacterium
PVAVLAPRSPSDCFDIAV

SEQ ID NO: 1245618 - protein, 20 aa, Mycobacterium
PVCPHLGGIVNWNDSDESWE

SEQ ID NO: 1245619 - protein, 19 aa, Mycobacterium
PVDFTGRFHRLRGARLDTE

SEQ ID NO: 1245620 - protein, 23 aa, Mycobacterium
PVDGGYLFNGRWQFSSGTDACDW

SEQ ID NO: 1245621 - protein, 24 aa, Mycobacterium
PVDIAVSMPPCLEIVGEVDDAKVR

SEQ ID NO: 1245622 - protein, 19 aa, Mycobacterium
PVDLGPWLRGEIELPTPSL

SEQ ID NO: 1245623 - protein, 22 aa, Mycobacterium
PVDRLLKPGGVVDRLTAPGGVL

SEQ ID NO: 1245624 - protein, 18 aa, Mycobacterium
PVEGRDGYLSSVHRAAAP

SEQ ID NO: 1245625 - protein, 24 aa, Mycobacterium
PVEIKKQMIDWWGPIVDEYYASSE

SEQ ID NO: 1245626 - protein, 24 aa, Mycobacterium
PVEQANAILFLLSDMSSYITGQTL

SEQ ID NO: 1245627 - protein, 19 aa, Mycobacterium
PVERVRAAFHYVRPNQTLR

SEQ ID NO: 1245628 - protein, 20 aa, Mycobacterium
PVEVLARLGGDEFAWHVPAL

SEQ ID NO: 1245629 - protein, 18 aa, Mycobacterium
PVFAAGFYEEFGYDRPVF

SEQ ID NO: 1245630 - protein, 25 aa, Mycobacterium
PVFHRDMPSRFAVLPRRGDQSQVRW

SEQ ID NO: 1245631 - protein, 19 aa, Mycobacterium
PVFTRHDFSAPVSYVDFTI

SEQ ID NO: 1245632 - protein, 17 aa, Mycobacterium
PVGEAFPPMAVSVSLAD

SEQ ID NO: 1245633 - protein, 26 aa, Mycobacterium
PVGKHWFRWEVRGMESFPRSGGVLTV

SEQ ID NO: 1245634 - protein, 26 aa, Mycobacterium
PVGLARFCTLRSWLSQWSYDDANGDA

SEQ ID NO: 1245635 - protein, 24 aa, Mycobacterium
PVGNAGNITAYWKGYSEYHRDGLS

SEQ ID NO: 1245636 - protein, 28 aa, Mycobacterium
PVGPGLYTWLPLGLRVFRKIEQIVRDEM

SEQ ID NO: 1245637 - protein, 34 aa, Mycobacterium
PVGVCAGIIPWNFPLLLAVWKLGPALAAGNTVVL

SEQ ID NO: 1245638 - protein, 26 aa, Mycobacterium
PVGVVGAIVPWNFPFEVTVNKLGPAL

SEQ ID NO: 1245639 - protein, 19 aa, Mycobacterium
PVHQIPQPIAWPGSSDRNF

SEQ ID NO: 1245640 - protein, 18 aa, Mycobacterium
PVHWRQWTPAALAEAAER

SEQ ID NO: 1245641 - protein, 27 aa, Mycobacterium
PVIARAATAFTRWTALIADRMTADGID

SEQ ID NO: 1245642 - protein, 23 aa, Mycobacterium
PVIGEFCYQCMHSVKAGIKDALS

SEQ ID NO: 1245643 - protein, 17 aa, Mycobacterium
PVIPVFINSVATPLGPL

SEQ ID NO: 1245644 - protein, 17 aa, Mycobacterium
PVKRARTTFTYLAVATR

SEQ ID NO: 1245645 - protein, 23 aa, Mycobacterium
PVKTRKCVFCSKKGQDIDYKDTA

SEQ ID NO: 1245646 - protein, 27 aa, Mycobacterium
PVLGVCVGMQILFARGVEFGVETAGCG

SEQ ID NO: 1245647 - protein, 17 aa, Mycobacterium
PVLKMVGQAGGWRRDLS

SEQ ID NO: 1245648 - protein, 26 aa, Mycobacterium
PVLNARFALNAANARWGSLYDALYGT

SEQ ID NO: 1245649 - protein, 19 aa, Mycobacterium
PVLQLLKITGDWQKFKGLP

SEQ ID NO: 1245650 - protein, 22 aa, Mycobacterium
PVLRRDGMSGGDVDRVFSTFNV

SEQ ID NO: 1245651 - protein, 21 aa, Mycobacterium
PVLTHYGVGLWVPEVGGAVDP

SEQ ID NO: 1245652 - protein, 25 aa, Mycobacterium
PVLVGASRKRFLGALLADAYGAVRP

SEQ ID NO: 1245653 - protein, 17 aa, Mycobacterium
PVLWSRQVLTTGRLRAV

SEQ ID NO: 1245654 - protein, 22 aa, Mycobacterium
PVNMFEFSRPVVEACGERYPRL

SEQ ID NO: 1245655 - protein, 17 aa, Mycobacterium
PVPGPIYLPEVRVACTP

SEQ ID NO: 1245656 - protein, 25 aa, Mycobacterium
PVPVSYHTFGGWKRSGFGDLNQHGP

SEQ ID NO: 1245657 - protein, 19 aa, Mycobacterium
PVQDKRIAVVFSAYPTKHA

SEQ ID NO: 1245658 - protein, 19 aa, Mycobacterium
PVQGARTWVGVAGTMTTLA

SEQ ID NO: 1245659 - protein, 17 aa, Mycobacterium
PVQPGLALLRLAQGRVD

SEQ ID NO: 1245660 - protein, 26 aa, Mycobacterium
PVQVLGFREHASWALASDTLEFVDLE

SEQ ID NO: 1245661 - protein, 21 aa, Mycobacterium
PVRAAFRAAEWALSLNTSCYG

SEQ ID NO: 1245662 - protein, 23 aa, Mycobacterium
PVRNVLLALIFEWGIALHGLHSS

SEQ ID NO: 1245663 - protein, 33 aa, Mycobacterium
PVSALVVFEVMVRPLIRLSLGKRAPMRRIVEAR

SEQ ID NO: 1245664 - protein, 21 aa, Mycobacterium
PVSANAYLGAWGITEALHSGA

SEQ ID NO: 1245665 - protein, 22 aa, Mycobacterium
PVSARELLPERALLGDATAIAA

SEQ ID NO: 1245666 - protein, 24 aa, Mycobacterium
PVSMLIPRVVGFKLTGERRAGVTA

SEQ ID NO: 1245667 - protein, 19 aa, Mycobacterium
PVSPVDFWQHPTINSLIEF

SEQ ID NO: 1245668 - protein, 24 aa, Mycobacterium
PVSRAYRPPFEFTGGTIAQVSFDV

SEQ ID NO: 1245669 - protein, 24 aa, Mycobacterium
PVSRPRVVMLLGGLRELTAITVED

SEQ ID NO: 1245670 - protein, 19 aa, Mycobacterium
PVTEADWPLMVRLDATNFG

SEQ ID NO: 1245671 - protein, 23 aa, Mycobacterium
PVTEFAPVPGMGWMFVADPDGNW

SEQ ID NO: 1245672 - protein, 25 aa, Mycobacterium
PVTNCARTAFDLGRRLPRDDAVARL

SEQ ID NO: 1245673 - protein, 24 aa, Mycobacterium
PVTYRPVPFDDFRAQGFPSAVEMG

SEQ ID NO: 1245674 - protein, 26 aa, Mycobacterium
PVVARGWRTPLRLLFIDGGHTEEAAQ

SEQ ID NO: 1245675 - protein, 20 aa, Mycobacterium
PVVECLRAEVPATALYVAMG

SEQ ID NO: 1245676 - protein, 24 aa, Mycobacterium
PVVGTVMRRGYKVGDQVVRHALVG

SEQ ID NO: 1245677 - protein, 18 aa, Mycobacterium
PVVLAKLMAGHTTLMVTG

SEQ ID NO: 1245678 - protein, 18 aa, Mycobacterium
PVVLIAADGYRFGGKTHD

SEQ ID NO: 1245679 - protein, 17 aa, Mycobacterium
PVWISGPQFDTWKHTQL

SEQ ID NO: 1245680 - protein, 19 aa, Mycobacterium
PVWRHWVRDLSRGHTLIRY

SEQ ID NO: 1245681 - protein, 19 aa, Mycobacterium
PVWVGDFWDMFGAGHLLEL

SEQ ID NO: 1245682 - protein, 21 aa, Mycobacterium
PVYGVCSLDAIGVATSGEALV

SEQ ID NO: 1245683 - protein, 21 aa, Mycobacterium
PWDLGDAHGTVMLRMPLHPVA

SEQ ID NO: 1245684 - protein, 21 aa, Mycobacterium
PWEPKTERVRQLFADAGIRIP

SEQ ID NO: 1245685 - protein, 20 aa, Mycobacterium
PWFSYVCPGAGHAPHHVFKE

SEQ ID NO: 1245686 - protein, 25 aa, Mycobacterium
PWGCGRCKRCQVGMENYCERAADQP

SEQ ID NO: 1245687 - protein, 21 aa, Mycobacterium
PWGERYCQFEDPNGIIVQFVQ

SEQ ID NO: 1245688 - protein, 19 aa, Mycobacterium
PWHPLPDGDVRPFVPRNQR

SEQ ID NO: 1245689 - protein, 23 aa, Mycobacterium
PWKLLLRSRLQAVAVDAVTLTAE

SEQ ID NO: 1245690 - protein, 20 aa, Mycobacterium
PWLVCIHGAEMGRAALDLTL

SEQ ID NO: 1245691 - protein, 25 aa, Mycobacterium
PWNTPFMLESWKLAPALASGCTVVL

SEQ ID NO: 1245692 - protein, 18 aa, Mycobacterium
PWRRPGVTPWQILVSEFM

SEQ ID NO: 1245693 - protein, 17 aa, Mycobacterium
PWSGFNYYLGNYRSTVA

SEQ ID NO: 1245694 - protein, 24 aa, Mycobacterium
PWTMPEPLLPIAVQPRAKTDEDKL

SEQ ID NO: 1245695 - protein, 17 aa, Mycobacterium
PWWLKPLNKVVIASTKL

SEQ ID NO: 1245696 - protein, 22 aa, Mycobacterium
PYAAAGRYVLDRAIFDALRRVK

SEQ ID NO: 1245697 - protein, 30 aa, Mycobacterium
PYAKAIDGTFDWGQPLFSYNFGDPDSRNDD

SEQ ID NO: 1245698 - protein, 19 aa, Mycobacterium
PYASISIAHGIRRFEFMIH

SEQ ID NO: 1245699 - protein, 24 aa, Mycobacterium
PYAVRRPPTGGARVGLVRRALGRL

SEQ ID NO: 1245700 - protein, 17 aa, Mycobacterium
PYCLTGMHSWLANWQLR

SEQ ID NO: 1245701 - protein, 20 aa, Mycobacterium
PYDEPWGWMQPTRHAYGALL

SEQ ID NO: 1245702 - protein, 21 aa, Mycobacterium
PYDGVVLRYANPVTGGSTMPT

SEQ ID NO: 1245703 - protein, 23 aa, Mycobacterium
PYDRGVLDGAAWSHSTRAPRLLV

SEQ ID NO: 1245704 - protein, 18 aa, Mycobacterium
PYDRKALRTRAIELLELV

SEQ ID NO: 1245705 - protein, 19 aa, Mycobacterium
PYEAVIAAANWVHTELDYV

SEQ ID NO: 1245706 - protein, 18 aa, Mycobacterium
PYESCNLGSVNLTRMLTG

SEQ ID NO: 1245707 - protein, 20 aa, Mycobacterium
PYEVELCVAEVAHFGESKAP

SEQ ID NO: 1245708 - protein, 18 aa, Mycobacterium
PYGSRFPAVTIRDQVTAD

SEQ ID NO: 1245709 - protein, 19 aa, Mycobacterium
PYGTMKAAIIHYTQGLAYR

SEQ ID NO: 1245710 - protein, 19 aa, Mycobacterium
PYIPLRAVRHLEKGRVVIF

SEQ ID NO: 1245711 - protein, 18 aa, Mycobacterium
PYLKRAPDSLMFSTSSSS

SEQ ID NO: 1245712 - protein, 20 aa, Mycobacterium
PYNPGHLMVVPYRRVSELED

SEQ ID NO: 1245713 - protein, 20 aa, Mycobacterium
PYPIWKRMRDEAPLYHNDKY

SEQ ID NO: 1245714 - protein, 21 aa, Mycobacterium
PYPMFKRLREEAPLYYNTQYD

SEQ ID NO: 1245715 - protein, 24 aa, Mycobacterium
PYPVIRKLFSTFGIDAMAKESLEK

SEQ ID NO: 1245716 - protein, 20 aa, Mycobacterium
PYPVWKRMRAEAPLYRNSRY

SEQ ID NO: 1245717 - protein, 20 aa, Mycobacterium
PYPVYRRLRDEAPLYYNEKL

SEQ ID NO: 1245718 - protein, 19 aa, Mycobacterium
PYRLRVMPGTVMTQGAGEV

SEQ ID NO: 1245719 - protein, 24 aa, Mycobacterium
PYRREVERLGRLVFGDSFEVEVDS

SEQ ID NO: 1245720 - protein, 20 aa, Mycobacterium
QAAFPLGWVHDVVWAPDTTT

SEQ ID NO: 1245721 - protein, 17 aa, Mycobacterium
QAAGLRPAIALFEQAAR

SEQ ID NO: 1245722 - protein, 23 aa, Mycobacterium
QAAMFDGRFAGFADFLILEGDRY

SEQ ID NO: 1245723 - protein, 22 aa, Mycobacterium
QAAPVSWRIFLRPPDGAPPQVR

SEQ ID NO: 1245724 - protein, 23 aa, Mycobacterium
QAARKLFAERGFHGTTLADITSA

SEQ ID NO: 1245725 - protein, 18 aa, Mycobacterium
QACVLRILDEGGHVVAAD

SEQ ID NO: 1245726 - protein, 29 aa, Mycobacterium
QADEFTCSSCFLVFHRSRLARDSNGTMIC

SEQ ID NO: 1245727 - protein, 27 aa, Mycobacterium
QAEAGEWHWPVPHLVITRGARGASYLG

SEQ ID NO: 1245728 - protein, 23 aa, Mycobacterium
QAEFERLTSLGVRFTQEPVDMGP

SEQ ID NO: 1245729 - protein, 34 aa, Mycobacterium
QAEIDAACELIDFWRFNVAFARGILTQQPVSARG

SEQ ID NO: 1245730 - protein, 24 aa, Mycobacterium
QAEVDRLLALGARRVDIGQGEQSW

SEQ ID NO: 1245731 - protein, 20 aa, Mycobacterium
QAEYLKTPLIVRPEPDNDDY

SEQ ID NO: 1245732 - protein, 24 aa, Mycobacterium
QAGLAMLAPIWGYKPILDIDDDTA

SEQ ID NO: 1245733 - protein, 24 aa, Mycobacterium
QAGLKLAYGCRIGICHTCVGTLKS

SEQ ID NO: 1245734 - protein, 22 aa, Mycobacterium
QAGTVHRFHVPPTVRVDSGVED

SEQ ID NO: 1245735 - protein, 17 aa, Mycobacterium
QAGVGIRTLIHLDDPEH

SEQ ID NO: 1245736 - protein, 18 aa, Mycobacterium
QAGVRRVVYLSGLHPEGV

SEQ ID NO: 1245737 - protein, 18 aa, Mycobacterium
QAHLLDCLVDAQLREPDP

SEQ ID NO: 1245738 - protein, 19 aa, Mycobacterium
QAIAFKIARMEARAHTARA

SEQ ID NO: 1245739 - protein, 18 aa, Mycobacterium
QAKEGMFSGKLVSAQSAY

SEQ ID NO: 1245740 - protein, 29 aa, Mycobacterium
QAKPIRALLRFLLGEGFDEAELDGVFDFD

SEQ ID NO: 1245741 - protein, 26 aa, Mycobacterium
QALLYCVVLHRFLRWRQPGYDPAKHL

SEQ ID NO: 1245742 - protein, 19 aa, Mycobacterium
QALPGERWATRLAEAAALT

SEQ ID NO: 1245743 - protein, 26 aa, Mycobacterium
QALRRMARGDWIIFYSPRVTYPDGAQ

SEQ ID NO: 1245744 - protein, 25 aa, Mycobacterium
QAMQSAWWKIAIDTAGYGRAGAARP

SEQ ID NO: 1245745 - protein, 25 aa, Mycobacterium
QANCSVSRAGVLRGLHFAAVPPGQA

SEQ ID NO: 1245746 - protein, 24 aa, Mycobacterium
QANVKRWVPDILPLLTADDPLGVE

SEQ ID NO: 1245747 - protein, 23 aa, Mycobacterium
QAPDRLRALFTERGVARHLANSD

SEQ ID NO: 1245748 - protein, 18 aa, Mycobacterium
QAPSLPWDLGDAHGTVML

SEQ ID NO: 1245749 - protein, 20 aa, Mycobacterium
QARAKYGWTDVARFAALGIP

SEQ ID NO: 1245750 - protein, 22 aa, Mycobacterium
QARKGLIDSVKGKAKEVVGAVT

SEQ ID NO: 1245751 - protein, 25 aa, Mycobacterium
QARRCMDCGIPFCHSGSAGCPLGNL

SEQ ID NO: 1245752 - protein, 17 aa, Mycobacterium
QATDEFRVPPAGPLGRH

SEQ ID NO: 1245753 - protein, 25 aa, Mycobacterium
QATFRKLQVANRVELARYAIEHGLD

SEQ ID NO: 1245754 - protein, 24 aa, Mycobacterium
QATIRLANKVRLLAYAAGDTTSPG

SEQ ID NO: 1245755 - protein, 21 aa, Mycobacterium
QATVIKANWQRAAKVLGASRP

SEQ ID NO: 1245756 - protein, 29 aa, Mycobacterium
QAVARHREGSCDRCAVDLYDVRRPYEVEA

SEQ ID NO: 1245757 - protein, 17 aa, Mycobacterium
QAVPMISMQEVNKHFGD

SEQ ID NO: 1245758 - protein, 18 aa, Mycobacterium
QAVREMLEMMGSHPRLST

SEQ ID NO: 1245759 - protein, 21 aa, Mycobacterium
QCARAAGAARIFVTEPSGVRA

SEQ ID NO: 1245760 - protein, 19 aa, Mycobacterium
QCGMVPAPTDVIWENHNQV

SEQ ID NO: 1245761 - protein, 26 aa, Mycobacterium
QCHGLQCGFCTPGMMITARALLDRNP

SEQ ID NO: 1245762 - protein, 24 aa, Mycobacterium
QCIPEELFRATGLSVDDAEQLRDA

SEQ ID NO: 1245763 - protein, 23 aa, Mycobacterium
QCLELLIDGGHRWLQPREQCAQD

SEQ ID NO: 1245764 - protein, 21 aa, Mycobacterium
QDAFGNFLARVVFPTRTRQLT

SEQ ID NO: 1245765 - protein, 20 aa, Mycobacterium
QDALSLALHLRGFNEDEKRS

SEQ ID NO: 1245766 - protein, 20 aa, Mycobacterium
QDELTELRTLIANEAPDDGQ

SEQ ID NO: 1245767 - protein, 18 aa, Mycobacterium
QDFAHLSLVLLRSMGIPA

SEQ ID NO: 1245768 - protein, 18 aa, Mycobacterium
QDGWLRTGDMGSFDADGY

SEQ ID NO: 1245769 - protein, 20 aa, Mycobacterium
QDLFFRKIVRNRSVALTHLL

SEQ ID NO: 1245770 - protein, 17 aa, Mycobacterium
QDLPCLAELGMRPPKLY

SEQ ID NO: 1245771 - protein, 24 aa, Mycobacterium
QDLPGDTFVGPKFAMRGPTGPVWR

SEQ ID NO: 1245772 - protein, 21 aa, Mycobacterium
QDLPGRIGLWHIGVPPSGPMD

SEQ ID NO: 1245773 - protein, 20 aa, Mycobacterium
QDMIDRMLFAEAIETQKCLD

SEQ ID NO: 1245774 - protein, 24 aa, Mycobacterium
QDPRCVYQILKRHYARYTPEMVER

SEQ ID NO: 1245775 - protein, 27 aa, Mycobacterium
QDQCAPFCAVQAWPALARQRLSATAGA

SEQ ID NO: 1245776 - protein, 23 aa, Mycobacterium
QDRGWVILLARYQRPKAIRQSGV

SEQ ID NO: 1245777 - protein, 29 aa, Mycobacterium
QDSGELRARLALGYALGWQGRGREADEVL

SEQ ID NO: 1245778 - protein, 26 aa, Mycobacterium
QDTFEWMLEQGMTWHTMQEIWERGFQ

SEQ ID NO: 1245779 - protein, 22 aa, Mycobacterium
QDWGGLIGLRLAAEHPDRFARI

SEQ ID NO: 1245780 - protein, 17 aa, Mycobacterium
QDWWPADYGNYAGLFIR

SEQ ID NO: 1245781 - protein, 19 aa, Mycobacterium
QEAIFGRRKVSGAPIGMTD

SEQ ID NO: 1245782 - protein, 17 aa, Mycobacterium
QEALALPGAAGWRLPDA

SEQ ID NO: 1245783 - protein, 25 aa, Mycobacterium
QEALPRWRRIAEGLRHSKARDAEVI

SEQ ID NO: 1245784 - protein, 18 aa, Mycobacterium
QECIQVHGGIGFTWEHDT

SEQ ID NO: 1245785 - protein, 26 aa, Mycobacterium
QEELSRAGAAFTEISGIYAAVDAANA

SEQ ID NO: 1245786 - protein, 20 aa, Mycobacterium
QEFINLLSAGVWFENILNQA

SEQ ID NO: 1245787 - protein, 25 aa, Mycobacterium
QEGSDRIPVFVFHPAGGSTVVYEPL

SEQ ID NO: 1245788 - protein, 23 aa, Mycobacterium
QEGYASNIIVGFGRIDGRPVGIV

SEQ ID NO: 1245789 - protein, 24 aa, Mycobacterium
QEIDLRYADALSMADNVMTFRYVV

SEQ ID NO: 1245790 - protein, 19 aa, Mycobacterium
QEILFPALLPRAPYETTNR

SEQ ID NO: 1245791 - protein, 21 aa, Mycobacterium
QEIMTELEIAPTRRLRGLGDR

SEQ ID NO: 1245792 - protein, 25 aa, Mycobacterium
QEISARTLMKLKRDAESYLGEDITD

SEQ ID NO: 1245793 - protein, 25 aa, Mycobacterium
QEKMPRRFYCRAKWHHSELDSETQV

SEQ ID NO: 1245794 - protein, 25 aa, Mycobacterium
QELARRTGATLKWYSVTDDGRIDLD

SEQ ID NO: 1245795 - protein, 19 aa, Mycobacterium
QELHRRAGIGLAVVAADRA

SEQ ID NO: 1245796 - protein, 20 aa, Mycobacterium
QELVDICAHIAAVPLDRSKP

SEQ ID NO: 1245797 - protein, 20 aa, Mycobacterium
QEMVLHFAVYAGWPKASRFN

SEQ ID NO: 1245798 - protein, 25 aa, Mycobacterium
QEPTVLPSRFPNLLANGSGGIAVGM

SEQ ID NO: 1245799 - protein, 19 aa, Mycobacterium
QESYLRWAEVDLDTVHDTK

SEQ ID NO: 1245800 - protein, 23 aa, Mycobacterium
QETRLRLLIIRSGLPRPVTQIPV

SEQ ID NO: 1245801 - protein, 21 aa, Mycobacterium
QETRLRLTLIDGGLPRPRTQI

SEQ ID NO: 1245802 - protein, 21 aa, Mycobacterium
QFDKPYLLAMANAGPGTNGSQ

SEQ ID NO: 1245803 - protein, 18 aa, Mycobacterium
QFGYLEFHGETGAVKAAA

SEQ ID NO: 1245804 - protein, 25 aa, Mycobacterium
QFKKYERLWLSWAMANRDPSVFTAP

SEQ ID NO: 1245805 - protein, 18 aa, Mycobacterium
QFRGEVTASMVYDGAPVH

SEQ ID NO: 1245806 - protein, 24 aa, Mycobacterium
QFTGHLPAGFSFVPGHEIVGIVEH

SEQ ID NO: 1245807 - protein, 23 aa, Mycobacterium
QFVSSPGYEHAWLNPDNTEVSLD

SEQ ID NO: 1245808 - protein, 23 aa, Mycobacterium
QFYCVDLGGGGLMYLEDLPHVGG

SEQ ID NO: 1245809 - protein, 25 aa, Mycobacterium
QGADEVFAGYHWYPPMAEPGAASVE

SEQ ID NO: 1245810 - protein, 25 aa, Mycobacterium
QGAEALCGAVGFIGFAVNGALARYA

SEQ ID NO: 1245811 - protein, 19 aa, Mycobacterium
QGALSRWKAPITVEALIPF

SEQ ID NO: 1245812 - protein, 30 aa, Mycobacterium
QGARLSVVVEDLWRAEALAEMITDAGLGAE

SEQ ID NO: 1245813 - protein, 19 aa, Mycobacterium
QGAVARADMPALLRSADVV

SEQ ID NO: 1245814 - protein, 21 aa, Mycobacterium
QGAWPTFGLTLPEMLPDHFTG

SEQ ID NO: 1245815 - protein, 31 aa, Mycobacterium
QGCIAARDRAFFCAYAMEYLARAGLSKEDVA

SEQ ID NO: 1245816 - protein, 25 aa, Mycobacterium
QGFRAARVAIDIGVHCELTAPDGGT

SEQ ID NO: 1245817 - protein, 20 aa, Mycobacterium
QGGGVALQLAVRHGTLVNKL

SEQ ID NO: 1245818 - protein, 25 aa, Mycobacterium
QGGPDLRTATGLSVGGGQTARGQQG

SEQ ID NO: 1245819 - protein, 25 aa, Mycobacterium
QGGREVRVGYTLGSTGTCLQVDDEP

SEQ ID NO: 1245820 - protein, 22 aa, Mycobacterium
QGGVVLGPLAVRDHLIDAARPF

SEQ ID NO: 1245821 - protein, 22 aa, Mycobacterium
QGHASPGIYARAYLEGRLTADQ

SEQ ID NO: 1245822 - protein, 25 aa, Mycobacterium
QGHRIRAAIHFDDLQWERSYSRVGA

SEQ ID NO: 1245823 - protein, 20 aa, Mycobacterium
QGKHLWMIYLMRVVDARVVL

SEQ ID NO: 1245824 - protein, 21 aa, Mycobacterium
QGKWAPSMVVGLGRLAGRTVG

SEQ ID NO: 1245825 - protein, 24 aa, Mycobacterium
QGLAYRLAAQGIRANTVSPGNTYF

SEQ ID NO: 1245826 - protein, 18 aa, Mycobacterium
QGMPMPLLFVCEDNGIGI

SEQ ID NO: 1245827 - protein, 33 aa, Mycobacterium
QGQDLRSLGRIEVGGMPHGLRAAPDGSVIVVAN

SEQ ID NO: 1245828 - protein, 19 aa, Mycobacterium
QGQLLAVRRDGKFVVPQMF

SEQ ID NO: 1245829 - protein, 26 aa, Mycobacterium
QGRFPYRNDGALGWVGTSPVGTFPAN

SEQ ID NO: 1245830 - protein, 31 aa, Mycobacterium
QGRGLARLARRVWPGHDWTALGRAPHLPVAS

SEQ ID NO: 1245831 - protein, 24 aa, Mycobacterium
QGRLTHPVVLRPGATHYEPIAWDD

SEQ ID NO: 1245832 - protein, 19 aa, Mycobacterium
QGSAASVSLPEGWLTDPDD

SEQ ID NO: 1245833 - protein, 18 aa, Mycobacterium
QGSPSGLHAFKLRVSARR

SEQ ID NO: 1245834 - protein, 22 aa, Mycobacterium
QGSQRFAPLNSWPDNANLDKAR

SEQ ID NO: 1245835 - protein, 28 aa, Mycobacterium
QGSTRYPGGMALRFARVLRYRDDKSPAE

SEQ ID NO: 1245836 - protein, 22 aa, Mycobacterium
QGTLYFGVPTVWSRIAADDDAA

SEQ ID NO: 1245837 - protein, 22 aa, Mycobacterium
QGVPISAILFGGRRKTTVPLIT

SEQ ID NO: 1245838 - protein, 17 aa, Mycobacterium
QGVSIPAERPAEVTDII

SEQ ID NO: 1245839 - protein, 20 aa, Mycobacterium
QGVVRRGLVVSGEYISQLGH

SEQ ID NO: 1245840 - protein, 17 aa, Mycobacterium
QHCGFDPSFAVGGDLGE

SEQ ID NO: 1245841 - protein, 18 aa, Mycobacterium
QHFFNFRLDMSIDGAGNS

SEQ ID NO: 1245842 - protein, 20 aa, Mycobacterium
QHPEVVSWAEFFSAQRKHRS

SEQ ID NO: 1245843 - protein, 24 aa, Mycobacterium
QHPKWLDRAWARIVEEVRDGRQAY

SEQ ID NO: 1245844 - protein, 24 aa, Mycobacterium
QHRQIVLDFCDFLAGKTDRLVRDL

SEQ ID NO: 1245845 - protein, 17 aa, Mycobacterium
QHYGERRRVAGLRREEL

SEQ ID NO: 1245846 - protein, 20 aa, Mycobacterium
QIAGLPFSGPVGGVRVALID

SEQ ID NO: 1245847 - protein, 23 aa, Mycobacterium
QIDKFLERGSCEFMTDFAKPLSM

SEQ ID NO: 1245848 - protein, 27 aa, Mycobacterium
QIEPEVGLACRVVWYGDTVVRLDPFAL

SEQ ID NO: 1245849 - protein, 20 aa, Mycobacterium
QIFGDRVVWVPWRRPGFQLG

SEQ ID NO: 1245850 - protein, 26 aa, Mycobacterium
QIGEGRKSLALALRFRAADRTLTEDE

SEQ ID NO: 1245851 - protein, 19 aa, Mycobacterium
QIGRLPALVRDTAAGVSQV

SEQ ID NO: 1245852 - protein, 25 aa, Mycobacterium
QIIEEMLRFPLPVIAAVNGPAVGLG

SEQ ID NO: 1245853 - protein, 24 aa, Mycobacterium
QILPSNSVTLGWSSYAIQWLSRVP

SEQ ID NO: 1245854 - protein, 25 aa, Mycobacterium
QIPTPPRLGNVVVEVEHLDKGFEGR

SEQ ID NO: 1245855 - protein, 19 aa, Mycobacterium
QIRASIVAGNFDELREHVL

SEQ ID NO: 1245856 - protein, 24 aa, Mycobacterium
QIRDVPIAHGWCGVLAVPRDWEST

SEQ ID NO: 1245857 - protein, 19 aa, Mycobacterium
QIRLYKRMFLPGVDDVVFI

SEQ ID NO: 1245858 - protein, 26 aa, Mycobacterium
QIVAYVIKNAERFGMQDAIWRGVYYT

SEQ ID NO: 1245859 - protein, 19 aa, Mycobacterium
QKANRIRQLTAKKTRESLQ

SEQ ID NO: 1245860 - protein, 19 aa, Mycobacterium
QKDRITAVADDVWLEHIPV

SEQ ID NO: 1245861 - protein, 24 aa, Mycobacterium
QKFIPEVLPKVGIVRRLVDSGELT

SEQ ID NO: 1245862 - protein, 33 aa, Mycobacterium
QKFKKMSGMTWRSMVKDGLAMRHGKELTWAQVV

SEQ ID NO: 1245863 - protein, 23 aa, Mycobacterium
QKIERRYANAMGEAELAQNSVQG

SEQ ID NO: 1245864 - protein, 17 aa, Mycobacterium
QKITATMLVPSMIYALM

SEQ ID NO: 1245865 - protein, 25 aa, Mycobacterium
QKLQKRLKEELAWVRSGAKARQAKN

SEQ ID NO: 1245866 - protein, 24 aa, Mycobacterium
QKPPDFGEDIWIPAREPSDRALLL

SEQ ID NO: 1245867 - protein, 20 aa, Mycobacterium
QKQRWLPGMLSGSQIGAYSL

SEQ ID NO: 1245868 - protein, 22 aa, Mycobacterium
QKRRGMRIDFILGSPAFADRVT

SEQ ID NO: 1245869 - protein, 19 aa, Mycobacterium
QKRRWLPGIADGSITMAFA

SEQ ID NO: 1245870 - protein, 22 aa, Mycobacterium
QKSDLLIALGTRFDDRVTGQLD

SEQ ID NO: 1245871 - protein, 19 aa, Mycobacterium
QKSGRFVFISSSAGNFGQP

SEQ ID NO: 1245872 - protein, 24 aa, Mycobacterium
QKVSELYDRVGFAAVGRFNEFNNL

SEQ ID NO: 1245873 - protein, 27 aa, Mycobacterium
QKVWTSLAHLCQWGLATVRTDPDAPKH

SEQ ID NO: 1245874 - protein, 19 aa, Mycobacterium
QLAAWDIALLGAHVVDRVA

SEQ ID NO: 1245875 - protein, 17 aa, Mycobacterium
QLAFARRLGTPTTAHPT

SEQ ID NO: 1245876 - protein, 27 aa, Mycobacterium
QLAGGFARYSVDAEWVVPHFEKMLYDN

SEQ ID NO: 1245877 - protein, 21 aa, Mycobacterium
QLARRARDVLGDIDIIVNNAG

SEQ ID NO: 1245878 - protein, 22 aa, Mycobacterium
QLDARVGGIVRFDVDHVGEQVL

SEQ ID NO: 1245879 - protein, 18 aa, Mycobacterium
QLEKIWGPPDYPATVVDH

SEQ ID NO: 1245880 - protein, 18 aa, Mycobacterium
QLEYFCAVAEHGSFSAAG

SEQ ID NO: 1245881 - protein, 26 aa, Mycobacterium
QLFARPEVRAAVPGLLLAMAENEAMR

SEQ ID NO: 1245882 - protein, 24 aa, Mycobacterium
QLGARCNIEHGCVVAEADELHGAE

SEQ ID NO: 1245883 - protein, 18 aa, Mycobacterium
QLHGGYGYLREYGIEKIV

SEQ ID NO: 1245884 - protein, 19 aa, Mycobacterium
QLIEFCLLAAHYDGLAATI

SEQ ID NO: 1245885 - protein, 18 aa, Mycobacterium
QLIMEAGADIAILEPAAY

SEQ ID NO: 1245886 - protein, 23 aa, Mycobacterium
QLLDRSRYLKALAVATKEQDVQA

SEQ ID NO: 1245887 - protein, 17 aa, Mycobacterium
QLLEQWTALLSGAGTPF

SEQ ID NO: 1245888 - protein, 23 aa, Mycobacterium
QLLQFRLMVLYTAWEIDKYNDYK

SEQ ID NO: 1245889 - protein, 25 aa, Mycobacterium
QLLRGRHVVWAGPLGYRDPELLAGF

SEQ ID NO: 1245890 - protein, 22 aa, Mycobacterium
QLMKGHGAADWSKRPLPDDWLN

SEQ ID NO: 1245891 - protein, 18 aa, Mycobacterium
QLMQLRFAHKVPALHCTS

SEQ ID NO: 1245892 - protein, 24 aa, Mycobacterium
QLPGTWLLASLYFRADVRGLDRIP

SEQ ID NO: 1245893 - protein, 22 aa, Mycobacterium
QLQRRLDRIGALSAGVTTPERR

SEQ ID NO: 1245894 - protein, 24 aa, Mycobacterium
QLRENLGAVGWRLDDEQIARLDAV

SEQ ID NO: 1245895 - protein, 19 aa, Mycobacterium
QLRLERVVLVGVWTDGSAA

SEQ ID NO: 1245896 - protein, 17 aa, Mycobacterium
QLRPRVLYHDIITDITD

SEQ ID NO: 1245897 - protein, 23 aa, Mycobacterium
QLRTRVAALLADLPEPDHAGDLA

SEQ ID NO: 1245898 - protein, 26 aa, Mycobacterium
QLSGPLPVHGCSLHLAPIAFTGGRRV

SEQ ID NO: 1245899 - protein, 23 aa, Mycobacterium
QLSRARALLAGRDFVIPEDVKSL

SEQ ID NO: 1245900 - protein, 23 aa, Mycobacterium
QLTKRIRLRVPLVSSAMDTVTES

SEQ ID NO: 1245901 - protein, 29 aa, Mycobacterium
QLTSDFNFLWPTARIAVIGAEGAAQLIVK

SEQ ID NO: 1245902 - protein, 24 aa, Mycobacterium
QLVAARLAAFGTHVVAYDPYVSHA

SEQ ID NO: 1245903 - protein, 23 aa, Mycobacterium
QLVDARYGALGVRGHGHDLVQFI

SEQ ID NO: 1245904 - protein, 25 aa, Mycobacterium
QLVQARVKMGLSQNIAQVTASSTEL

SEQ ID NO: 1245905 - protein, 18 aa, Mycobacterium
QLWDKGLAYQGVRVLPYC

SEQ ID NO: 1245906 - protein, 25 aa, Mycobacterium
QLWTALKQLYPVGIDYHDLVDSDAV

SEQ ID NO: 1245907 - protein, 23 aa, Mycobacterium
QMAEPKWVLAMGVCASSGGMFNN

SEQ ID NO: 1245908 - protein, 23 aa, Mycobacterium
QMALPPCHAFFQFYVADGRLSCQ

SEQ ID NO: 1245909 - protein, 26 aa, Mycobacterium
QMARIFPTMFRKALRKMAERRLPEGY

SEQ ID NO: 1245910 - protein, 26 aa, Mycobacterium
QMGIGGGWYEHEWRAYGYGFPSAGAR

SEQ ID NO: 1245911 - protein, 20 aa, Mycobacterium
QMMYELRDFGFSTAIGIGGD

SEQ ID NO: 1245912 - protein, 26 aa, Mycobacterium
QMPIHMRLPKLKGFRNRFRTEYAVIN

SEQ ID NO: 1245913 - protein, 17 aa, Mycobacterium
QMRLVANPYLIPVLRIS

SEQ ID NO: 1245914 - protein, 18 aa, Mycobacterium
QMSALLMAIFLRGMTGPE

SEQ ID NO: 1245915 - protein, 23 aa, Mycobacterium
QNIPRLRRALARVDTVVVHDPYW

SEQ ID NO: 1245916 - protein, 17 aa, Mycobacterium
QNLATIVGWVTSELPDD

SEQ ID NO: 1245917 - protein, 23 aa, Mycobacterium
QNLILRRGFSYSRGFDGAGRLDQ

SEQ ID NO: 1245918 - protein, 24 aa, Mycobacterium
QNRWEFAPPAARSGKRVLVVGAGP

SEQ ID NO: 1245919 - protein, 25 aa, Mycobacterium
QNTDILAPGSFSWHVLSSLTDEVRT

SEQ ID NO: 1245920 - protein, 24 aa, Mycobacterium
QPDAGLDDIRWRLDVWNASAQVGH

SEQ ID NO: 1245921 - protein, 23 aa, Mycobacterium
QPDEAMSLIRACAQRFPGAQMMF

SEQ ID NO: 1245922 - protein, 17 aa, Mycobacterium
QPDGSLIRDPHVETSAF

SEQ ID NO: 1245923 - protein, 25 aa, Mycobacterium
QPDLPAHSTVAMIVGMVALRSTFFG

SEQ ID NO: 1245924 - protein, 26 aa, Mycobacterium
QPERLKSGWLNGIKHWQVDYTGAGGP

SEQ ID NO: 1245925 - protein, 24 aa, Mycobacterium
QPGNEFKVALARRTLIAELRALTG

SEQ ID NO: 1245926 - protein, 23 aa, Mycobacterium
QPGVITSMFGGLVRSLAGHLAVE

SEQ ID NO: 1245927 - protein, 24 aa, Mycobacterium
QPLAWQLEERGARWLGPAVTAPLY

SEQ ID NO: 1245928 - protein, 26 aa, Mycobacterium
QPLYNFLLTVLFEWGVALHDTDVEAL

SEQ ID NO: 1245929 - protein, 30 aa, Mycobacterium
QPRGANLDGVFGVLANVVWTNFGPCAVEGF

SEQ ID NO: 1245930 - protein, 18 aa, Mycobacterium
QPRRGLVVLDHGWGSRVF

SEQ ID NO: 1245931 - protein, 20 aa, Mycobacterium
QPSHVAAAFDVSRQTFRVDK

SEQ ID NO: 1245932 - protein, 27 aa, Mycobacterium
QPTLGVAGLLTRLWDWLVDAAAGNFDA

SEQ ID NO: 1245933 - protein, 21 aa, Mycobacterium
QPTMVRCIWRSGDADLNGYAD

SEQ ID NO: 1245934 - protein, 17 aa, Mycobacterium
QPVFPMTLLGTFSPYMV

SEQ ID NO: 1245935 - protein, 29 aa, Mycobacterium
QQDSIRYDVMMQLCRPLTVFEIDALIVHR

SEQ ID NO: 1245936 - protein, 24 aa, Mycobacterium
QQGQLMKLSDAWEGGGAVAAAGEA

SEQ ID NO: 1245937 - protein, 19 aa, Mycobacterium
QQIGCDPVALLGGVKPGRL

SEQ ID NO: 1245938 - protein, 17 aa, Mycobacterium
QQIRLFAPLKPAGRLSV

SEQ ID NO: 1245939 - protein, 22 aa, Mycobacterium
QQKEFLLRQQLAAIRKELGELG

SEQ ID NO: 1245940 - protein, 27 aa, Mycobacterium
QQLARARTGVFWVREMLPIGKIREILS

SEQ ID NO: 1245941 - protein, 18 aa, Mycobacterium
QQLDHWARVGRAVSSHHT

SEQ ID NO: 1245942 - protein, 24 aa, Mycobacterium
QQLIFRPTPGFGRAETPIEGLFLG

SEQ ID NO: 1245943 - protein, 18 aa, Mycobacterium
QQLLDHFVVLLGSALDRP

SEQ ID NO: 1245944 - protein, 24 aa, Mycobacterium
QQLQLPFGAPKTMFNVPIGGARRV

SEQ ID NO: 1245945 - protein, 17 aa, Mycobacterium
QQMAAALDECFDQIAAI

SEQ ID NO: 1245946 - protein, 19 aa, Mycobacterium
QQQKWAVPILRAEMTAALG

SEQ ID NO: 1245947 - protein, 22 aa, Mycobacterium
QQQRLCIARAIAVQPDVLLMDE

SEQ ID NO: 1245948 - protein, 31 aa, Mycobacterium
QQRAWLKLVKPLVITEGFALLSVPTPFVQNE

SEQ ID NO: 1245949 - protein, 17 aa, Mycobacterium
QQRVDAWLADFEAALAV

SEQ ID NO: 1245950 - protein, 23 aa, Mycobacterium
QQSFRIHGGYGYSKEYEIERLMR

SEQ ID NO: 1245951 - protein, 19 aa, Mycobacterium
QQVLLECPKPVLAVKPDEG

SEQ ID NO: 1245952 - protein, 18 aa, Mycobacterium
QRAALVVDSRESAVELLG

SEQ ID NO: 1245953 - protein, 18 aa, Mycobacterium
QRAAWIAAHLGDLPGSGI

SEQ ID NO: 1245954 - protein, 24 aa, Mycobacterium
QRAEGRYALMPGIIAALRDSGTPF

SEQ ID NO: 1245955 - protein, 28 aa, Mycobacterium
QRAKNMFALGLLSWMYGRELHQSEAFIQ

SEQ ID NO: 1245956 - protein, 20 aa, Mycobacterium
QRAPIGWNMKDPTPVAKTVC

SEQ ID NO: 1245957 - protein, 21 aa, Mycobacterium
QRARLWPALVELYADFDTYQS

SEQ ID NO: 1245958 - protein, 28 aa, Mycobacterium
QRCLDLTVQWCRDRETFGRPLISRQSVQ

SEQ ID NO: 1245959 - protein, 17 aa, Mycobacterium
QRCSGGRGETRWRERSH

SEQ ID NO: 1245960 - protein, 19 aa, Mycobacterium
QRDGTCWLGGTTWQGAHVL

SEQ ID NO: 1245961 - protein, 21 aa, Mycobacterium
QRDRFLFKLNIDYPTPEEERE

SEQ ID NO: 1245962 - protein, 30 aa, Mycobacterium
QRDWEFAHEFGLPVVEVISGGDISEAAYAG

SEQ ID NO: 1245963 - protein, 20 aa, Mycobacterium
QRESLDWLVSRFAREVSGVS

SEQ ID NO: 1245964 - protein, 20 aa, Mycobacterium
QRFLDGFAEVMMSFHRLSDV

SEQ ID NO: 1245965 - protein, 21 aa, Mycobacterium
QRGAPGLPDIAWFAPDGSEMT

SEQ ID NO: 1245966 - protein, 18 aa, Mycobacterium
QRGICVVGQGLFDPFDTH

SEQ ID NO: 1245967 - protein, 25 aa, Mycobacterium
QRGIEVIEFAIGIPHLIKGEYTEGA

SEQ ID NO: 1245968 - protein, 21 aa, Mycobacterium
QRGRKGPWWDRSDTKWVTEAL

SEQ ID NO: 1245969 - protein, 19 aa, Mycobacterium
QRGYKCIFVCPDKVSEDKR

SEQ ID NO: 1245970 - protein, 19 aa, Mycobacterium
QRIPSKWLESGVIVKADTL

SEQ ID NO: 1245971 - protein, 19 aa, Mycobacterium
QRKSVLVGYGADEAMDTSR

SEQ ID NO: 1245972 - protein, 31 aa, Mycobacterium
QRKTVHIWGCGGLGSWIAEFIARAGASEITV

SEQ ID NO: 1245973 - protein, 19 aa, Mycobacterium
QRLAEKLVFQEAPKVIRQL

SEQ ID NO: 1245974 - protein, 33 aa, Mycobacterium
QRLDPERGRLWSALWLRPAHGPGVLVVTAHVLA

SEQ ID NO: 1245975 - protein, 17 aa, Mycobacterium
QRLKEILREVVPADAGV

SEQ ID NO: 1245976 - protein, 17 aa, Mycobacterium
QRLKLATRLGDTGADKK

SEQ ID NO: 1245977 - protein, 18 aa, Mycobacterium
QRLLAAGLLRQVDDDTVI

SEQ ID NO: 1245978 - protein, 17 aa, Mycobacterium
QRLLVNFSLTDETRSTG

SEQ ID NO: 1245979 - protein, 24 aa, Mycobacterium
QRLQAACARHRVEWFWVKGHSGVA

SEQ ID NO: 1245980 - protein, 29 aa, Mycobacterium
QRLRLATQLRAGLFGVLYVLDEPSAGLHP

SEQ ID NO: 1245981 - protein, 19 aa, Mycobacterium
QRLSEHLRAPVVTTPESQL

SEQ ID NO: 1245982 - protein, 23 aa, Mycobacterium
QRMTSRVLAALLFTEQPTLTAGE

SEQ ID NO: 1245983 - protein, 21 aa, Mycobacterium
QRPAVHALYGFARRADDILDD

SEQ ID NO: 1245984 - protein, 20 aa, Mycobacterium
QRQAVEFDYPAKSGVQRSLV

SEQ ID NO: 1245985 - protein, 26 aa, Mycobacterium
QRQKYLWNFLVDHWFRMEFDGWENLP

SEQ ID NO: 1245986 - protein, 23 aa, Mycobacterium
QRRDPDSWARLIAEHSVTVLHWM

SEQ ID NO: 1245987 - protein, 17 aa, Mycobacterium
QRRIWFSAYDELAPTAV

SEQ ID NO: 1245988 - protein, 25 aa, Mycobacterium
QRSGRARGASFALPAEADEYRAAAR

SEQ ID NO: 1245989 - protein, 20 aa, Mycobacterium
QRSTENLGLLAWLKETSADV

SEQ ID NO: 1245990 - protein, 24 aa, Mycobacterium
QRSTRARLGYARGRILGAAGDINA

SEQ ID NO: 1245991 - protein, 19 aa, Mycobacterium
QRTSRAFRTMRVEVLAGQL

SEQ ID NO: 1245992 - protein, 18 aa, Mycobacterium
QRTWLDFATRGWASGEQW

SEQ ID NO: 1245993 - protein, 23 aa, Mycobacterium
QRVEELIARYPLRGIKGPMGTAQ

SEQ ID NO: 1245994 - protein, 23 aa, Mycobacterium
QRVIPLEKLRWISFGHLEADECG

SEQ ID NO: 1245995 - protein, 26 aa, Mycobacterium
QRVNGELEFGGWTWRYDLVSLGPART

SEQ ID NO: 1245996 - protein, 30 aa, Mycobacterium
QRWFERLFLFVAFVNRFLPPFVRQGGSHLL

SEQ ID NO: 1245997 - protein, 20 aa, Mycobacterium
QRWIAAGLFDPAVRERAGMR

SEQ ID NO: 1245998 - protein, 18 aa, Mycobacterium
QRYEPMFAAADLGADTMP

SEQ ID NO: 1245999 - protein, 17 aa, Mycobacterium
QRYGFRVHGPWDPSAGH

SEQ ID NO: 1246000 - protein, 21 aa, Mycobacterium
QSAYSEMWFTEAYWPAFRRVD

SEQ ID NO: 1246001 - protein, 18 aa, Mycobacterium
QSEGQGFIQLMTQLPQER

SEQ ID NO: 1246002 - protein, 28 aa, Mycobacterium
QSGGKRLRPRFAYWAWRVGAPADAAPQP

SEQ ID NO: 1246003 - protein, 25 aa, Mycobacterium
QSGKYRRVLAMAWEKQSESNAMWAL

SEQ ID NO: 1246004 - protein, 33 aa, Mycobacterium
QSGLARTGRTFACDHWDVVPDLYLLGKALGGGV

SEQ ID NO: 1246005 - protein, 25 aa, Mycobacterium
QSHAWVQAWTGGWWHYDPTNDSDIN

SEQ ID NO: 1246006 - protein, 21 aa, Mycobacterium
QSLDAPAAWAECGQLTSSDRY

SEQ ID NO: 1246007 - protein, 22 aa, Mycobacterium
QSLGGGVAMQFMYQHPQYCRRL

SEQ ID NO: 1246008 - protein, 25 aa, Mycobacterium
QSLLVRALVAWFWDEPLRAPLIRHG

SEQ ID NO: 1246009 - protein, 27 aa, Mycobacterium
QSLPELPWLRRNRIQQEWGISDEVMRD

SEQ ID NO: 1246010 - protein, 30 aa, Mycobacterium
QSLVFRHGLQLFGAMGFTWENDLQFALKRA

SEQ ID NO: 1246011 - protein, 22 aa, Mycobacterium
QSLVPMLAMRLTHFEHLIDISR

SEQ ID NO: 1246012 - protein, 24 aa, Mycobacterium
QSRTIRLPVHLVEQVNKLARIKRE

SEQ ID NO: 1246013 - protein, 20 aa, Mycobacterium
QSVAPTAMWLRENDPDTWHR

SEQ ID NO: 1246014 - protein, 19 aa, Mycobacterium
QSVPTLFPFVECQSRLLAA

SEQ ID NO: 1246015 - protein, 24 aa, Mycobacterium
QTAELLARFTGVRTCTARLARAAR

SEQ ID NO: 1246016 - protein, 24 aa, Mycobacterium
QTARRISAEGGRLVLADRSELVKE

SEQ ID NO: 1246017 - protein, 20 aa, Mycobacterium
QTCRTEVFLFPAASHVEKAG

SEQ ID NO: 1246018 - protein, 19 aa, Mycobacterium
QTGVVWKDLGLIIVDEEQR

SEQ ID NO: 1246019 - protein, 19 aa, Mycobacterium
QTIARACGKAHVCHLEPED

SEQ ID NO: 1246020 - protein, 23 aa, Mycobacterium
QTIPRPELFALQADELLDMAMAV

SEQ ID NO: 1246021 - protein, 22 aa, Mycobacterium
QTKLCLLVMIGVRADGRKELVA

SEQ ID NO: 1246022 - protein, 24 aa, Mycobacterium
QTLATRYLPEFSVAAPDLIGHGRS

SEQ ID NO: 1246023 - protein, 23 aa, Mycobacterium
QTLPGLRQALGLAEDGHDERTSV

SEQ ID NO: 1246024 - protein, 22 aa, Mycobacterium
QTLWRSRLIAPMRPDRYLKMGA

SEQ ID NO: 1246025 - protein, 17 aa, Mycobacterium
QTPMWPERALTRHDGAA

SEQ ID NO: 1246026 - protein, 26 aa, Mycobacterium
QTPTLLFPFAAPRVAGDMSEVGSRSE

SEQ ID NO: 1246027 - protein, 25 aa, Mycobacterium
QTRARAGDLVAVLGIGGLGHLGVQF

SEQ ID NO: 1246028 - protein, 21 aa, Mycobacterium
QTRARVGVNLLDLEQRARQLI

SEQ ID NO: 1246029 - protein, 24 aa, Mycobacterium
QTSGWSLTAQDVFNNVARTCIEAM

SEQ ID NO: 1246030 - protein, 24 aa, Mycobacterium
QTTARSGDKIAELLQKAAAAYDKG

SEQ ID NO: 1246031 - protein, 19 aa, Mycobacterium
QTVAMAKWWTTERAMKVLD

SEQ ID NO: 1246032 - protein, 26 aa, Mycobacterium
QTVFGGSVGEMFGRKVSRLMEWVAMV

SEQ ID NO: 1246033 - protein, 17 aa, Mycobacterium
QTVIRRVSAAWQLPLEW

SEQ ID NO: 1246034 - protein, 28 aa, Mycobacterium
QTVLTDSGWPCRRHLDGSVVSVEVDLQQ

SEQ ID NO: 1246035 - protein, 26 aa, Mycobacterium
QTVRRFGEQRLRPHVGEWFEAGEVPV

SEQ ID NO: 1246036 - protein, 21 aa, Mycobacterium
QVAAILRFAAAEVVPRLAGTA

SEQ ID NO: 1246037 - protein, 23 aa, Mycobacterium
QVARLKSSVAMSIRRQERGLAVA

SEQ ID NO: 1246038 - protein, 23 aa, Mycobacterium
QVARVGLVNAVIRFDVDAGSDFV

SEQ ID NO: 1246039 - protein, 26 aa, Mycobacterium
QVDAVEVGRWLPSLLVRRLERLELAV

SEQ ID NO: 1246040 - protein, 17 aa, Mycobacterium
QVFPVLTPLAVDPAHPF

SEQ ID NO: 1246041 - protein, 23 aa, Mycobacterium
QVGAELRARYRVVLLDEYQDTGH

SEQ ID NO: 1246042 - protein, 19 aa, Mycobacterium
QVGDIRFAKEPEVTLPLQA

SEQ ID NO: 1246043 - protein, 22 aa, Mycobacterium
QVGDLFAFAAADPVEYLSASHT

SEQ ID NO: 1246044 - protein, 17 aa, Mycobacterium
QVGHRWQSRWPRVETVA

SEQ ID NO: 1246045 - protein, 19 aa, Mycobacterium
QVGNFPGLWTEWNGQYRDT

SEQ ID NO: 1246046 - protein, 19 aa, Mycobacterium
QVHTLLDFHFHPHVVAPSG

SEQ ID NO: 1246047 - protein, 22 aa, Mycobacterium
QVIEAVNLFRAKVVDVSTESLT

SEQ ID NO: 1246048 - protein, 17 aa, Mycobacterium
QVLEEIAARWAAVAVAV

SEQ ID NO: 1246049 - protein, 19 aa, Mycobacterium
QVLETEYLKRPLIDGPAPD

SEQ ID NO: 1246050 - protein, 24 aa, Mycobacterium
QVLRRLRAHLAPAGRAVIGFGAGR

SEQ ID NO: 1246051 - protein, 18 aa, Mycobacterium
QVPASVSSLLEFRMAQHG

SEQ ID NO: 1246052 - protein, 18 aa, Mycobacterium
QVPFPKRMGRSTEYAQLA

SEQ ID NO: 1246053 - protein, 24 aa, Mycobacterium
QVPGEPKVGLAQVYGAPGTASATI

SEQ ID NO: 1246054 - protein, 21 aa, Mycobacterium
QVPSLWAQYVEAWAERTPPPD

SEQ ID NO: 1246055 - protein, 18 aa, Mycobacterium
QVQPRYAGWTTFARLPRL

SEQ ID NO: 1246056 - protein, 18 aa, Mycobacterium
QVRMEFADDVLRLSAGAD

SEQ ID NO: 1246057 - protein, 34 aa, Mycobacterium
QVRMGMRVEAVWKPREEWGLGIDNISHFRPTGEP

SEQ ID NO: 1246058 - protein, 17 aa, Mycobacterium
QVRQNWRGKAVLVKLIW

SEQ ID NO: 1246059 - protein, 26 aa, Mycobacterium
QVSFLPELLRWVPFTKGDYWVLKIDD

SEQ ID NO: 1246060 - protein, 19 aa, Mycobacterium
QVTEAFWNAIRHAKPIAVG

SEQ ID NO: 1246061 - protein, 17 aa, Mycobacterium
QVTMWSKRVRAVDFTIG

SEQ ID NO: 1246062 - protein, 17 aa, Mycobacterium
QVVEGWYGQRFPKPLAR

SEQ ID NO: 1246063 - protein, 22 aa, Mycobacterium
QVVSIPTMILFKDGEPVKRIVG

SEQ ID NO: 1246064 - protein, 30 aa, Mycobacterium
QVYGIALERGRAMRGLGVTIDFAPVVDVTG

SEQ ID NO: 1246065 - protein, 21 aa, Mycobacterium
QVYPLPEPFLVVATQNPVDQE

SEQ ID NO: 1246066 - protein, 18 aa, Mycobacterium
QWAESAGMDTAWMPQVPN

SEQ ID NO: 1246067 - protein, 23 aa, Mycobacterium
QWAKKVPLGPGVKLEVRRVSETE

SEQ ID NO: 1246068 - protein, 24 aa, Mycobacterium
QWAPDGTMSFPFAPPGWPELAGRD

SEQ ID NO: 1246069 - protein, 24 aa, Mycobacterium
QWEKSRLSHHLSRMEARGLIRREP

SEQ ID NO: 1246070 - protein, 24 aa, Mycobacterium
QWEVLDRVLQLFGGYGYMEEYPIA

SEQ ID NO: 1246071 - protein, 17 aa, Mycobacterium
QWFDDCVEFCEKYDQNC

SEQ ID NO: 1246072 - protein, 18 aa, Mycobacterium
QWGEPATIVSMDPWGASV

SEQ ID NO: 1246073 - protein, 18 aa, Mycobacterium
QWKRELVARTSLTEDEIG

SEQ ID NO: 1246074 - protein, 23 aa, Mycobacterium
QWLLPRRSAVTAVLLDGIATGEL

SEQ ID NO: 1246075 - protein, 18 aa, Mycobacterium
QWRALRMSTPLKLTEDEL

SEQ ID NO: 1246076 - protein, 25 aa, Mycobacterium
QWREDWPRYDAVRRRTRVIRSMRDD

SEQ ID NO: 1246077 - protein, 18 aa, Mycobacterium
QYGKTWRTIAKLSLPDKY

SEQ ID NO: 1246078 - protein, 17 aa, Mycobacterium
QYGRPAPLCPRSLLARV

SEQ ID NO: 1246079 - protein, 17 aa, Mycobacterium
QYISVGVGRDYADVSPL

SEQ ID NO: 1246080 - protein, 20 aa, Mycobacterium
QYKVAVGDVVKVEKLDSEPG

SEQ ID NO: 1246081 - protein, 25 aa, Mycobacterium
QYLWSKRVAALFARALRANPDLHLV

SEQ ID NO: 1246082 - protein, 18 aa, Mycobacterium
QYPEHAAVAIERPIFVTG

SEQ ID NO: 1246083 - protein, 22 aa, Mycobacterium
QYPQRLSAVLSVIYLIYNEGYS

SEQ ID NO: 1246084 - protein, 18 aa, Mycobacterium
QYVNLRPIRVFDGVASPL

SEQ ID NO: 1246085 - protein, 25 aa, Mycobacterium
RAAAAEFGEPVAVPAENLLMTGGTA

SEQ ID NO: 1246086 - protein, 19 aa, Mycobacterium
RAAAEFVRTHRRPAFLHLS

SEQ ID NO: 1246087 - protein, 19 aa, Mycobacterium
RAAAFSRLDRQDFAVIYES

SEQ ID NO: 1246088 - protein, 18 aa, Mycobacterium
RAAAHLFQDYGYQNVSID

SEQ ID NO: 1246089 - protein, 24 aa, Mycobacterium
RAAARATQPLSVFMFDLLHVDGAD

SEQ ID NO: 1246090 - protein, 19 aa, Mycobacterium
RAAARLQDIVERFETRAAA

SEQ ID NO: 1246091 - protein, 17 aa, Mycobacterium
RAAAVNPRINAIVRDVP

SEQ ID NO: 1246092 - protein, 18 aa, Mycobacterium
RAAELIGIQIPRFCDHPL

SEQ ID NO: 1246093 - protein, 24 aa, Mycobacterium
RAAENFRFFADLVVAQADDAYKVP

SEQ ID NO: 1246094 - protein, 26 aa, Mycobacterium
RAAEPWEVAATIAFLASDYSSYLTGE

SEQ ID NO: 1246095 - protein, 21 aa, Mycobacterium
RAAEVPIVFFQEVHRPSGVDF

SEQ ID NO: 1246096 - protein, 21 aa, Mycobacterium
RAAGEMRARLRALDQEAGGVG

SEQ ID NO: 1246097 - protein, 25 aa, Mycobacterium
RAAGHPDLLAPPTFVFGLDLEHSDT

SEQ ID NO: 1246098 - protein, 19 aa, Mycobacterium
RAAGIAAGYATEGQALELG

SEQ ID NO: 1246099 - protein, 19 aa, Mycobacterium
RAAGLPATAVNWGLWKSLA

SEQ ID NO: 1246100 - protein, 17 aa, Mycobacterium
RAAGYGMPGVRVDGNDV

SEQ ID NO: 1246101 - protein, 26 aa, Mycobacterium
RAAHGWQPAVDCWLAAWDPEFSVRLA

SEQ ID NO: 1246102 - protein, 26 aa, Mycobacterium
RAAIDAVLIGSAWQRCRVHFLRNVLA

SEQ ID NO: 1246103 - protein, 19 aa, Mycobacterium
RAAIEKVLRRMPAPAREGL

SEQ ID NO: 1246104 - protein, 18 aa, Mycobacterium
RAALIGCGVTTGYGSAVR

SEQ ID NO: 1246105 - protein, 17 aa, Mycobacterium
RAALPGLIADVADDADL

SEQ ID NO: 1246106 - protein, 23 aa, Mycobacterium
RAALRSAGRPVLSRPRRPDDPAE

SEQ ID NO: 1246107 - protein, 18 aa, Mycobacterium
RAAPDGSVIVVANHMTGA

SEQ ID NO: 1246108 - protein, 17 aa, Mycobacterium
RAARAVVRIGGAGHSAA

SEQ ID NO: 1246109 - protein, 17 aa, Mycobacterium
RAARDGIDWRDLGAREI

SEQ ID NO: 1246110 - protein, 25 aa, Mycobacterium
RAARTRRVLDRFGLAGHADHPAHLL

SEQ ID NO: 1246111 - protein, 18 aa, Mycobacterium
RAASFNLDGINWDGTAAE

SEQ ID NO: 1246112 - protein, 25 aa, Mycobacterium
RAASRLSAVVVRWNLRRGRYERHGI

SEQ ID NO: 1246113 - protein, 26 aa, Mycobacterium
RACFRCPECSIEVRAQDDLLLVAGMR

SEQ ID NO: 1246114 - protein, 21 aa, Mycobacterium
RACGALRPGATIVESTSGTLG

SEQ ID NO: 1246115 - protein, 22 aa, Mycobacterium
RACVSAGLVRRIEPAGSSARYE

SEQ ID NO: 1246116 - protein, 26 aa, Mycobacterium
RADEALPLAAVRTGAALVRTDERIDP

SEQ ID NO: 1246117 - protein, 18 aa, Mycobacterium
RADFAWPAAKVVAEYESM

SEQ ID NO: 1246118 - protein, 20 aa, Mycobacterium
RADFVRREFRSHKVKVTDDT

SEQ ID NO: 1246119 - protein, 17 aa, Mycobacterium
RADGTFEAVSWDEALDD

SEQ ID NO: 1246120 - protein, 23 aa, Mycobacterium
RADGTTMSGCWIYSGVYADEVNQ

SEQ ID NO: 1246121 - protein, 23 aa, Mycobacterium
RADPGRFAKLVLLTPSPCYVDDG

SEQ ID NO: 1246122 - protein, 18 aa, Mycobacterium
RADRVGSEIPVAVKSVLD

SEQ ID NO: 1246123 - protein, 22 aa, Mycobacterium
RAEAPLYRNSRYGFYALSRYDD

SEQ ID NO: 1246124 - protein, 27 aa, Mycobacterium
RAELAYREASGWGHPVQPGLALLRLAQ

SEQ ID NO: 1246125 - protein, 23 aa, Mycobacterium
RAELRRIASMTGLPVTFGGEVFD

SEQ ID NO: 1246126 - protein, 22 aa, Mycobacterium
RAELVMPMWQRLERTWGPARDV

SEQ ID NO: 1246127 - protein, 20 aa, Mycobacterium
RAERVWYAACLVLATTRADV

SEQ ID NO: 1246128 - protein, 21 aa, Mycobacterium
RAEVKAALTREYAKFEVLLGG

SEQ ID NO: 1246129 - protein, 18 aa, Mycobacterium
RAFTARLLGIPAQKVRVI

SEQ ID NO: 1246130 - protein, 24 aa, Mycobacterium
RAFVEQRWGLPPGTIRTDAGPGAV

SEQ ID NO: 1246131 - protein, 19 aa, Mycobacterium
RAFVNRPLVLLADEPTGNL

SEQ ID NO: 1246132 - protein, 20 aa, Mycobacterium
RAGADLAPRMDLEARVLRGA

SEQ ID NO: 1246133 - protein, 17 aa, Mycobacterium
RAGAIALQTRQRIVGVV

SEQ ID NO: 1246134 - protein, 26 aa, Mycobacterium
RAGAQLFHDRGWRVAAVDRNEAGLAE

SEQ ID NO: 1246135 - protein, 19 aa, Mycobacterium
RAGASIPLVHACAAAGTPL

SEQ ID NO: 1246136 - protein, 20 aa, Mycobacterium
RAGASRLVLVTAHRRESWGE

SEQ ID NO: 1246137 - protein, 23 aa, Mycobacterium
RAGDPVEAMWIVFDQQYRNSYVF

SEQ ID NO: 1246138 - protein, 17 aa, Mycobacterium
RAGELGFGTPLAANAYL

SEQ ID NO: 1246139 - protein, 22 aa, Mycobacterium
RAGESLRNWGRWGDADELGTLN

SEQ ID NO: 1246140 - protein, 19 aa, Mycobacterium
RAGFGALRLPESLGGAGLT

SEQ ID NO: 1246141 - protein, 19 aa, Mycobacterium
RAGGISGWQTTPSVDGHFD

SEQ ID NO: 1246142 - protein, 21 aa, Mycobacterium
RAGGRPPALYRFTESRYRVTD

SEQ ID NO: 1246143 - protein, 18 aa, Mycobacterium
RAGLGWGMYPEQLAVPEL

SEQ ID NO: 1246144 - protein, 25 aa, Mycobacterium
RAGLPTVRAAVLVPRIGVGAPDADW

SEQ ID NO: 1246145 - protein, 21 aa, Mycobacterium
RAGNEVIRWLAEAGISIAGSH

SEQ ID NO: 1246146 - protein, 19 aa, Mycobacterium
RAGRDVMVLEAFRAGAGAT

SEQ ID NO: 1246147 - protein, 17 aa, Mycobacterium
RAGRLLAPDQGFGEDTE

SEQ ID NO: 1246148 - protein, 25 aa, Mycobacterium
RAGRRRGVVINPVLETSDIPETMPD

SEQ ID NO: 1246149 - protein, 17 aa, Mycobacterium
RAGRRVQMLERLDHVGG

SEQ ID NO: 1246150 - protein, 21 aa, Mycobacterium
RAGTVSGLYVCEMVTARALVE

SEQ ID NO: 1246151 - protein, 24 aa, Mycobacterium
RAGVARSGFYFYFDSKYAVLAVIV

SEQ ID NO: 1246152 - protein, 18 aa, Mycobacterium
RAGVPLIEIVTRPIEGAG

SEQ ID NO: 1246153 - protein, 23 aa, Mycobacterium
RAGVPTLVLWVGAEQPIWGSRVK

SEQ ID NO: 1246154 - protein, 24 aa, Mycobacterium
RAGWFGPPRRWLVVTGTNGKTTTT

SEQ ID NO: 1246155 - protein, 19 aa, Mycobacterium
RAGYPLSQVTEALCDRWNP

SEQ ID NO: 1246156 - protein, 18 aa, Mycobacterium
RAHFPTISLTTVFRQLGD

SEQ ID NO: 1246157 - protein, 18 aa, Mycobacterium
RAHHAFIYVRGEVVPVLR

SEQ ID NO: 1246158 - protein, 24 aa, Mycobacterium
RAIHPINVRLGGFYSVPRRDELGP

SEQ ID NO: 1246159 - protein, 33 aa, Mycobacterium
RAIHYRIDQGFDHFKVSLSIGVMKMVRSDIASS

SEQ ID NO: 1246160 - protein, 19 aa, Mycobacterium
RAIRENRFDAAFGGARRDE

SEQ ID NO: 1246161 - protein, 21 aa, Mycobacterium
RAKAFTELRQLLAVHETAEEM

SEQ ID NO: 1246162 - protein, 20 aa, Mycobacterium
RAKCPVQRATPYGVMAVTGH

SEQ ID NO: 1246163 - protein, 19 aa, Mycobacterium
RAKEVHDLMGPRLQGKMME

SEQ ID NO: 1246164 - protein, 19 aa, Mycobacterium
RAKGLKAVSPLAVQMYMPN

SEQ ID NO: 1246165 - protein, 23 aa, Mycobacterium
RAKILPISFGFPFGLSAVLPVNL

SEQ ID NO: 1246166 - protein, 18 aa, Mycobacterium
RAKLADAVAEHMSPPMPL

SEQ ID NO: 1246167 - protein, 23 aa, Mycobacterium
RAKPGRPPLMFRAVAGMDPAGPR

SEQ ID NO: 1246168 - protein, 21 aa, Mycobacterium
RAKVATGFGKPAGVFMLTDAN

SEQ ID NO: 1246169 - protein, 31 aa, Mycobacterium
RALAAVSVPVDWRRLRMGAEAITAEGTPLPE

SEQ ID NO: 1246170 - protein, 18 aa, Mycobacterium
RALADGVIDCVATDHAPH

SEQ ID NO: 1246171 - protein, 25 aa, Mycobacterium
RALAESFAAAGARLVLGDVDDAGLA

SEQ ID NO: 1246172 - protein, 18 aa, Mycobacterium
RALAEVGVDLLVIDTAHG

SEQ ID NO: 1246173 - protein, 19 aa, Mycobacterium
RALAGWRVNAWLLDADDLR

SEQ ID NO: 1246174 - protein, 22 aa, Mycobacterium
RALARAWPRYDAMRTELAVGQF

SEQ ID NO: 1246175 - protein, 22 aa, Mycobacterium
RALDAAHVWHPYSTIGAGALPP

SEQ ID NO: 1246176 - protein, 23 aa, Mycobacterium
RALEKHGAPVYVRHEIVHNRYVV

SEQ ID NO: 1246177 - protein, 20 aa, Mycobacterium
RALFGAFARRHRVPIAEQPH

SEQ ID NO: 1246178 - protein, 30 aa, Mycobacterium
RALGEIRAVWRINELLNWQVAAAGETIAVA

SEQ ID NO: 1246179 - protein, 19 aa, Mycobacterium
RALGVRRIFGPCAVGSLTP

SEQ ID NO: 1246180 - protein, 25 aa, Mycobacterium
RALIGRFLAALARFPHARTHLGAPL

SEQ ID NO: 1246181 - protein, 19 aa, Mycobacterium
RALLLQSLHPLAMAGVAGH

SEQ ID NO: 1246182 - protein, 20 aa, Mycobacterium
RALRHYRYGPGVCKVDFVLS

SEQ ID NO: 1246183 - protein, 34 aa, Mycobacterium
RALRLDKMLRLKVFPLAVSLPWGIAPAALPQLPL

SEQ ID NO: 1246184 - protein, 19 aa, Mycobacterium
RALSCLLSGTAVRGGRPGV

SEQ ID NO: 1246185 - protein, 27 aa, Mycobacterium
RALYDAGWMRYGWPESAGGLGGPAILR

SEQ ID NO: 1246186 - protein, 24 aa, Mycobacterium
RAMADARAARRPRFVTPGRFAGKV

SEQ ID NO: 1246187 - protein, 36 aa, Mycobacterium
RAMGFPTRMFTVLFALGRLPGWIAHWREMHSEPGKI

SEQ ID NO: 1246188 - protein, 19 aa, Mycobacterium
RAMIDLSTMVGRVISPTNR

SEQ ID NO: 1246189 - protein, 23 aa, Mycobacterium
RAMLRRPRMRPVAGADTEDLPPP

SEQ ID NO: 1246190 - protein, 18 aa, Mycobacterium
RAPFIRLAKEGDVLAKDC

SEQ ID NO: 1246191 - protein, 20 aa, Mycobacterium
RAPGPLRKGLGSGLTGDVIG

SEQ ID NO: 1246192 - protein, 18 aa, Mycobacterium
RAPGRLEGRYELSDTPAG

SEQ ID NO: 1246193 - protein, 18 aa, Mycobacterium
RAPMPALHRLTVGALRAV

SEQ ID NO: 1246194 - protein, 30 aa, Mycobacterium; identical to SEQ ID NO: 717798

SEQ ID NO: 1246195 - protein, 23 aa, Mycobacterium
RAPRARVLFVDYLTLLPPPGEPV

SEQ ID NO: 1246196 - protein, 17 aa, Mycobacterium
RAPRGNVLIGERNAIAP

SEQ ID NO: 1246197 - protein, 18 aa, Mycobacterium
RAPVGRDALILAGGSNVV

SEQ ID NO: 1246198 - protein, 23 aa, Mycobacterium
RAQAEAVAAWLAHRDVVYVVASP

SEQ ID NO: 1246199 - protein, 20 aa, Mycobacterium
RAQGLGACFTSWASYAGEQV

SEQ ID NO: 1246200 - protein, 26 aa, Mycobacterium
RAQRDCVYYATLIMWIGCHADSHEYA

SEQ ID NO: 1246201 - protein, 18 aa, Mycobacterium
RAQVADWRDRLTAAGVRP

SEQ ID NO: 1246202 - protein, 22 aa, Mycobacterium
RARDAGAMAYLVKPFNVNDLIP

SEQ ID NO: 1246203 - protein, 27 aa, Mycobacterium
RAREGRALDDFAVWCALAEKYGNDWHG

SEQ ID NO: 1246204 - protein, 25 aa, Mycobacterium
RARELRENPAWITGFEHRIETPILG

SEQ ID NO: 1246205 - protein, 17 aa, Mycobacterium
RARERWEALSALAELVD

SEQ ID NO: 1246206 - protein, 17 aa, Mycobacterium
RARFRRYRDAGVTDLAA

SEQ ID NO: 1246207 - protein, 20 aa, Mycobacterium
RARFVDFLERVVVRRKISRH

SEQ ID NO: 1246208 - protein, 20 aa, Mycobacterium
RARHPRTRILALSGTGDMQL

SEQ ID NO: 1246209 - protein, 18 aa, Mycobacterium
RARLACTLAEQGRAVAVV

SEQ ID NO: 1246210 - protein, 26 aa, Mycobacterium
RARLAEGMPAYGSCAGMILLATEILD

SEQ ID NO: 1246211 - protein, 17 aa, Mycobacterium
RARMVRFQAGLEQMVLE

SEQ ID NO: 1246212 - protein, 19 aa, Mycobacterium
RARNGRIHAVTELVEGQTP

SEQ ID NO: 1246213 - protein, 17 aa, Mycobacterium
RARSKAARKVWDSADKF

SEQ ID NO: 1246214 - protein, 21 aa, Mycobacterium
RARTRTGASIVAIVRDEEVLA

SEQ ID NO: 1246215 - protein, 24 aa, Mycobacterium
RARVLHCAALRRLADKTQVVGPRE

SEQ ID NO: 1246216 - protein, 24 aa, Mycobacterium
RASAEAFSSLGYHGVSMDAIASRV

SEQ ID NO: 1246217 - protein, 25 aa, Mycobacterium
RASEAPGNPSGICGYRRFFSITSLA

SEQ ID NO: 1246218 - protein, 24 aa, Mycobacterium
RASFAESFVQVGLIPGDGGTWFLP

SEQ ID NO: 1246219 - protein, 17 aa, Mycobacterium
RASGSVSGYTGALVLTR

SEQ ID NO: 1246220 - protein, 27 aa, Mycobacterium
RASIAAYPRVVWIAGGLLKGVSVDALV

SEQ ID NO: 1246221 - protein, 20 aa, Mycobacterium
RASIDLAVATGAQWVREIFT

SEQ ID NO: 1246222 - protein, 21 aa, Mycobacterium
RASVMALSYVAQSARGIHRPA

SEQ ID NO: 1246223 - protein, 21 aa, Mycobacterium
RATAPASTWRDRYEGFRLNTC

SEQ ID NO: 1246224 - protein, 18 aa, Mycobacterium
RATASGIPLLRLAAQTAL

SEQ ID NO: 1246225 - protein, 19 aa, Mycobacterium
RATFCQPQVASFGLTEEQA

SEQ ID NO: 1246226 - protein, 22 aa, Mycobacterium
RATGEIKWTATANDLVFGSNSV

SEQ ID NO: 1246227 - protein, 18 aa, Mycobacterium
RATLELMTAPEQPGSSPR

SEQ ID NO: 1246228 - protein, 21 aa, Mycobacterium
RAVAATMPMVLWLRTTSAQAM

SEQ ID NO: 1246229 - protein, 20 aa, Mycobacterium
RAVADLLGAAGFDDVSIVAE

SEQ ID NO: 1246230 - protein, 18 aa, Mycobacterium
RAVDAGAAGHVFNLGHGV

SEQ ID NO: 1246231 - protein, 25 aa, Mycobacterium
RAVDLVHVRPCRWSPAPFLEPQVPS

SEQ ID NO: 1246232 - protein, 22 aa, Mycobacterium
RAVEARPIWYLVPDGVVQYVTK

SEQ ID NO: 1246233 - protein, 17 aa, Mycobacterium
RAVFDRFGADLPPLAGI

SEQ ID NO: 1246234 - protein, 29 aa, Mycobacterium
RAVGPEVARAALLFGMRFDAEAAVRHGLA

SEQ ID NO: 1246235 - protein, 18 aa, Mycobacterium
RAVGRKALDVYLNLANYL

SEQ ID NO: 1246236 - protein, 20 aa, Mycobacterium
RAVLECAGVHDILAKSLGSD

SEQ ID NO: 1246237 - protein, 17 aa, Mycobacterium
RAVLPAMRRRGSGRIVG

SEQ ID NO: 1246238 - protein, 19 aa, Mycobacterium
RAVNAIDWVCRAPSGLLAI

SEQ ID NO: 1246239 - protein, 25 aa, Mycobacterium
RAVSEVRALVRWLLPQSTTVVVSGV

SEQ ID NO: 1246240 - protein, 17 aa, Mycobacterium
RAVVLADRLNRWRRLGC

SEQ ID NO: 1246241 - protein, 18 aa, Mycobacterium
RAYAELVHETPGFVDYFK

SEQ ID NO: 1246242 - protein, 31 aa, Mycobacterium; identical to SEQ ID NO: 619728

SEQ ID NO: 1246243 - protein, 23 aa, Mycobacterium
RAYARYPNWAPMDMSSFTQDKTP

SEQ ID NO: 1246244 - protein, 22 aa, Mycobacterium
RAYKPLNWMSPPCRLSEESGDP

SEQ ID NO: 1246245 - protein, 24 aa, Mycobacterium
RAYRREVLEKIDLAAVDSKGYCFQ

SEQ ID NO: 1246246 - protein, 21 aa, Mycobacterium
RCATLRYGLNEDLGYNRYLAT

SEQ ID NO: 1246247 - protein, 18 aa, Mycobacterium
RCGHRLEHLEMVTTAEAE

SEQ ID NO: 1246248 - protein, 20 aa, Mycobacterium
RCGIREFVDDGAIDPDHASP

SEQ ID NO: 1246249 - protein, 19 aa, Mycobacterium
RCGLYYTPVNSFLSVDEAA

SEQ ID NO: 1246250 - protein, 23 aa, Mycobacterium
RCLGSYCWVDSGGVVGVGDEVAL

SEQ ID NO: 1246251 - protein, 25 aa, Mycobacterium
RCLTCGNCTMVCPTCFCTSVEDVTD

SEQ ID NO: 1246252 - protein, 19 aa, Mycobacterium
RCPDRPGLIDERGMLTFAE

SEQ ID NO: 1246253 - protein, 17 aa, Mycobacterium
RCRIHTFAADVGDESQV

SEQ ID NO: 1246254 - protein, 22 aa, Mycobacterium
RCRRRFLANGYAWVDVDVRGSG

SEQ ID NO: 1246255 - protein, 19 aa, Mycobacterium
RCTRLREVVYLGTDDWAAL

SEQ ID NO: 1246256 - protein, 18 aa, Mycobacterium
RCVHELVDALGVPQPLVS

SEQ ID NO: 1246257 - protein, 17 aa, Mycobacterium
RCWALWPVLVSIWHWER

SEQ ID NO: 1246258 - protein, 26 aa, Mycobacterium
RDADGRWRLGPALTELAGQVNDPLLT

SEQ ID NO: 1246259 - protein, 17 aa, Mycobacterium
RDALPRAEVVELDEGDD

SEQ ID NO: 1246260 - protein, 18 aa, Mycobacterium
RDALRIRFNLALYADPRH

SEQ ID NO: 1246261 - protein, 20 aa, Mycobacterium
RDAMKAGAILVDGRGPEEFA

SEQ ID NO: 1246262 - protein, 18 aa, Mycobacterium
RDAPRTATVIALDQVTGW

SEQ ID NO: 1246263 - protein, 23 aa, Mycobacterium
RDATRFRIGKRVYLMVDDDATRA

SEQ ID NO: 1246264 - protein, 17 aa, Mycobacterium
RDAYFEMFPGVWRHGDW

SEQ ID NO: 1246265 - protein, 22 aa, Mycobacterium
RDDAGITYAAWFRRKDTVHDTA

SEQ ID NO: 1246266 - protein, 29 aa, Mycobacterium
RDDDWRPQWRVDLVPSYKAHRVAEPQAAG

SEQ ID NO: 1246267 - protein, 18 aa, Mycobacterium
RDDHGFILAGPDLRDVSG

SEQ ID NO: 1246268 - protein, 22 aa, Mycobacterium
RDDPRAAWFLGEVEDHWRYSQA

SEQ ID NO: 1246269 - protein, 18 aa, Mycobacterium
RDDRGWVLSVAHVQVVRV

SEQ ID NO: 1246270 - protein, 23 aa, Mycobacterium
RDDWRALFTANLETAFFMSQAVA

SEQ ID NO: 1246271 - protein, 19 aa, Mycobacterium
RDEARLEALAGALRAETGA

SEQ ID NO: 1246272 - protein, 18 aa, Mycobacterium
RDEFWPGARQGLTQRESE

SEQ ID NO: 1246273 - protein, 21 aa, Mycobacterium
RDELLDNVTLYWVTASAASSA

SEQ ID NO: 1246274 - protein, 22 aa, Mycobacterium
RDELRPGVPERSWRQVSVSARE

SEQ ID NO: 1246275 - protein, 24 aa, Mycobacterium
RDEVAKAQAALRIEQLEATVLEQF

SEQ ID NO: 1246276 - protein, 19 aa, Mycobacterium
RDEVRRAAAAMIDLGIAAG

SEQ ID NO: 1246277 - protein, 23 aa, Mycobacterium
RDEYRVSCASLRSHDFVEGIRAQ

SEQ ID NO: 1246278 - protein, 37 aa, Mycobacterium
RDFAPGFRIDLHYKDLKIALAAAEQARIAVPLTGIIT

SEQ ID NO: 1246279 - protein, 19 aa, Mycobacterium
RDFLLPRQRERAALTTDEV

SEQ ID NO: 1246280 - protein, 21 aa, Mycobacterium
RDFLRVVGMVAPPAQLVHPAT

SEQ ID NO: 1246281 - protein, 24 aa, Mycobacterium
RDFSAELSGAGWRVQYVELAADHA

SEQ ID NO: 1246282 - protein, 32 aa, Mycobacterium
RDFYAAVLHEWPRSVWWNWNTGFDGIRVDEGA

SEQ ID NO: 1246283 - protein, 26 aa, Mycobacterium
RDGAELERLYPRTAAELQSWGQSWIA

SEQ ID NO: 1246284 - protein, 17 aa, Mycobacterium
RDGCGAPVVLAATHERT

SEQ ID NO: 1246285 - protein, 21 aa, Mycobacterium
RDGCRVPMPWSGDAPPFGFST

SEQ ID NO: 1246286 - protein, 17 aa, Mycobacterium
RDGERRWQPFTHWPDPW

SEQ ID NO: 1246287 - protein, 21 aa, Mycobacterium
RDGGIPWHLPEDLARFKEITL

SEQ ID NO: 1246288 - protein, 25 aa, Mycobacterium
RDGGRPCLDYLGAVSDDGWLDTGDL

SEQ ID NO: 1246289 - protein, 18 aa, Mycobacterium
RDGLIGLELAGTGLRYQD

SEQ ID NO: 1246290 - protein, 22 aa, Mycobacterium
RDGRAKVFIGMGGNFSSATPDT

SEQ ID NO: 1246291 - protein, 24 aa, Mycobacterium
RDGREVWASYFYRQVPGSEFSDVG

SEQ ID NO: 1246292 - protein, 24 aa, Mycobacterium
RDGRPCLLEAHLGRLTHSARLMEL

SEQ ID NO: 1246293 - protein, 18 aa, Mycobacterium
RDGTRWVGLSAVRVAEDR

SEQ ID NO: 1246294 - protein, 25 aa, Mycobacterium
RDGVIPLQFLFSGTLFTRGERGFAV

SEQ ID NO: 1246295 - protein, 21 aa, Mycobacterium
RDGVIPRRLVTSCEHFHREAV

SEQ ID NO: 1246296 - protein, 23 aa, Mycobacterium
RDHAATGIDVLWRGQRLRALADQ

SEQ ID NO: 1246297 - protein, 20 aa, Mycobacterium
RDHLAPYLKVRRVEFYELPK

SEQ ID NO: 1246298 - protein, 18 aa, Mycobacterium
RDHRCVDCGEPAKHWSFS

SEQ ID NO: 1246299 - protein, 18 aa, Mycobacterium
RDHRFAAAVEVPFEALAA

SEQ ID NO: 1246300 - protein, 17 aa, Mycobacterium
RDIAPGRILPDAAIINA

SEQ ID NO: 1246301 - protein, 23 aa, Mycobacterium
RDIEALGYGAVWVGGSPPAELDW

SEQ ID NO: 1246302 - protein, 19 aa, Mycobacterium
RDIGGAWILTNHPFLSGRP

SEQ ID NO: 1246303 - protein, 27 aa, Mycobacterium
RDIPRFVELWRSGRLPVETLVSSTISL

SEQ ID NO: 1246304 - protein, 22 aa, Mycobacterium
RDIRFVRLWFTDVLGYLKSVAI

SEQ ID NO: 1246305 - protein, 25 aa, Mycobacterium
RDISAKKNEPEWMLDIRLRALRTFD

SEQ ID NO: 1246306 - protein, 23 aa, Mycobacterium
RDIVARIDYDWSRTGIKPQNAPS

SEQ ID NO: 1246307 - protein, 19 aa, Mycobacterium
RDKLCWRNAAQLYGIELPA

SEQ ID NO: 1246308 - protein, 23 aa, Mycobacterium
RDKRIPLELCPSSNVQTGAVASI

SEQ ID NO: 1246309 - protein, 25 aa, Mycobacterium
RDLAAELRKNWNVEFDDAGAIGRRY

SEQ ID NO: 1246310 - protein, 22 aa, Mycobacterium
RDLDFLLFEWLRVDELTQRPRF

SEQ ID NO: 1246311 - protein, 23 aa, Mycobacterium
RDLFRRNGIENVWIFRALDDPHE

SEQ ID NO: 1246312 - protein, 24 aa, Mycobacterium
RDLIPGVLAALVHRGADFATAEDA

SEQ ID NO: 1246313 - protein, 21 aa, Mycobacterium
RDLKLRVLSWGAAPASDTLLR

SEQ ID NO: 1246314 - protein, 18 aa, Mycobacterium
RDLLAAPDQFDWLATRLE

SEQ ID NO: 1246315 - protein, 18 aa, Mycobacterium
RDLLAEWKAAGRAAKDVD

SEQ ID NO: 1246316 - protein, 17 aa, Mycobacterium
RDLRLHDLPALVDAAQG

SEQ ID NO: 1246317 - protein, 19 aa, Mycobacterium
RDLSGANNLLFRRNSVSGA

SEQ ID NO: 1246318 - protein, 17 aa, Mycobacterium
RDLSGSDYVYLWVDGIH

SEQ ID NO: 1246319 - protein, 17 aa, Mycobacterium
RDLSGTDYVYLWVDGIH

SEQ ID NO: 1246320 - protein, 25 aa, Mycobacterium
RDLSSAIARCRRLLDLDADPEAVVD

SEQ ID NO: 1246321 - protein, 24 aa, Mycobacterium
RDLTSRIYRDFTYRSGSTTVSTKV

SEQ ID NO: 1246322 - protein, 25 aa, Mycobacterium
RDMAETFPGAQILAAFGQTEMSPVT

SEQ ID NO: 1246323 - protein, 19 aa, Mycobacterium
RDMGMVFQAYSLFPHLTVL

SEQ ID NO: 1246324 - protein, 19 aa, Mycobacterium
RDMIDVNLSGVWKTVKAAV

SEQ ID NO: 1246325 - protein, 26 aa, Mycobacterium
RDNRAVHALARIMLHGRISHIQTSWV

SEQ ID NO: 1246326 - protein, 20 aa, Mycobacterium
RDNTGVIVLLTFGTGIGSAV

SEQ ID NO: 1246327 - protein, 18 aa, Mycobacterium
RDNVVRWLGAGNSDWVRI

SEQ ID NO: 1246328 - protein, 21 aa, Mycobacterium
RDPMAMLPFLGYNVGDYFQHW

SEQ ID NO: 1246329 - protein, 17 aa, Mycobacterium
RDPRTNPDWDQLLRGAV

SEQ ID NO: 1246330 - protein, 17 aa, Mycobacterium
RDPSLRATVAMADGREL

SEQ ID NO: 1246331 - protein, 17 aa, Mycobacterium
RDRARRLVAEMVAANPD

SEQ ID NO: 1246332 - protein, 17 aa, Mycobacterium
RDRCGRCDASMAGARLT

SEQ ID NO: 1246333 - protein, 29 aa, Mycobacterium
RDRDFSCFYFRDRELIAADCVNRPRDFMF

SEQ ID NO: 1246334 - protein, 20 aa, Mycobacterium
RDRFLLAVLYDTGMRVGEAL

SEQ ID NO: 1246335 - protein, 28 aa, Mycobacterium
RDRGCTHPGCTVPFYWAEAHHTDDYSRG

SEQ ID NO: 1246336 - protein, 27 aa, Mycobacterium
RDRGCTHPGCTVPFYWTEAHHTHDYSR

SEQ ID NO: 1246337 - protein, 20 aa, Mycobacterium
RDRKVLTFVLDRGMEGFVQS

SEQ ID NO: 1246338 - protein, 23 aa, Mycobacterium
RDRPELWPTAVEEILRLDSPVQM

SEQ ID NO: 1246339 - protein, 22 aa, Mycobacterium
RDRPLWEFYFAEGMADNRFALI

SEQ ID NO: 1246340 - protein, 33 aa, Mycobacterium
RDRTLPCRKWFDDHGVSFGRHYTGSLACVPSRP

SEQ ID NO: 1246341 - protein, 19 aa, Mycobacterium
RDRVGGVADRICLYQPQPI

SEQ ID NO: 1246342 - protein, 25 aa, Mycobacterium
RDRWRAELLSGMSALSGVLGDLVPD

SEQ ID NO: 1246343 - protein, 19 aa, Mycobacterium
RDSYQIGVLGLKGGVGKTA

SEQ ID NO: 1246344 - protein, 25 aa, Mycobacterium
RDTGAWPLICHTIGTGRLRLDVELA

SEQ ID NO: 1246345 - protein, 18 aa, Mycobacterium
RDTGGGFGQKVVPMREDM

SEQ ID NO: 1246346 - protein, 25 aa, Mycobacterium
RDTISVGAKTLWLQQGLWDEQIARD

SEQ ID NO: 1246347 - protein, 21 aa, Mycobacterium
RDTLLWAKLIDKYKGTMTAAP

SEQ ID NO: 1246348 - protein, 26 aa, Mycobacterium
RDVEFPRRDEVGGRRAGRLLAPDQGF

SEQ ID NO: 1246349 - protein, 18 aa, Mycobacterium
RDVIEVIQTSQDWWPADY

SEQ ID NO: 1246350 - protein, 19 aa, Mycobacterium
RDVIPHMQPGSAIINVTST

SEQ ID NO: 1246351 - protein, 23 aa, Mycobacterium
RDVKRVPLARALQTAQRHDYLDA

SEQ ID NO: 1246352 - protein, 17 aa, Mycobacterium
RDVPIGAVVFGPDGTEL

SEQ ID NO: 1246353 - protein, 24 aa, Mycobacterium
RDWLLIELRSDWDGYRAGSLLAAK

SEQ ID NO: 1246354 - protein, 25 aa, Mycobacterium
REAARCRKLAEGGDVTFVGRVSDEE

SEQ ID NO: 1246355 - protein, 19 aa, Mycobacterium
REACGGAGYLAENRLIGLR

SEQ ID NO: 1246356 - protein, 17 aa, Mycobacterium
REAFRLPTMDHRKLGEE

SEQ ID NO: 1246357 - protein, 21 aa, Mycobacterium
REALCPFPTDRGWSLRELFTG

SEQ ID NO: 1246358 - protein, 21 aa, Mycobacterium
REALEGVGRFFTTSGERAGWG

SEQ ID NO: 1246359 - protein, 25 aa, Mycobacterium
REANIRWGFDREHRHPYGVDFVQNT

SEQ ID NO: 1246360 - protein, 21 aa, Mycobacterium
REAPVRHFSEFVADGMEAGRG

SEQ ID NO: 1246361 - protein, 22 aa, Mycobacterium
REARKPGSYFWLKGGKRRQRLA

SEQ ID NO: 1246362 - protein, 17 aa, Mycobacterium
REASLKTPDGFGIALDA

SEQ ID NO: 1246363 - protein, 19 aa, Mycobacterium
REASVDFVTYFSAGIQWAQ

SEQ ID NO: 1246364 - protein, 25 aa, Mycobacterium
REATSAAFADGWYRTGDVGRLDAEG

SEQ ID NO: 1246365 - protein, 19 aa, Mycobacterium
REAVFAGPVLRPAATLVRR

SEQ ID NO: 1246366 - protein, 18 aa, Mycobacterium
REAVRLGGALGVAEPDLL

SEQ ID NO: 1246367 - protein, 23 aa, Mycobacterium
RECDAICQVVRVFADDDVVHVDG

SEQ ID NO: 1246368 - protein, 18 aa, Mycobacterium
RECIGVSRCPYGTDCFAE

SEQ ID NO: 1246369 - protein, 22 aa, Mycobacterium
REDKPFWWSHFDRLNNPVDEWA

SEQ ID NO: 1246370 - protein, 26 aa, Mycobacterium
REDQEVWRYFASVAFPSEAMVRNVID

SEQ ID NO: 1246371 - protein, 27 aa, Mycobacterium
REDTYRLPVTVWRDLIALHYPNTGWLR

SEQ ID NO: 1246372 - protein, 17 aa, Mycobacterium
REEGYAAATSRRVAAEA

SEQ ID NO: 1246373 - protein, 27 aa, Mycobacterium
REELADLLWRMGIRTIGQFSALSRTDV

SEQ ID NO: 1246374 - protein, 22 aa, Mycobacterium
REELPAQLVVRAVGYRGVPTPG

SEQ ID NO: 1246375 - protein, 23 aa, Mycobacterium
REGGRLALMLRLHHAVVDGVSAA

SEQ ID NO: 1246376 - protein, 23 aa, Mycobacterium
REGLPLVCVVGVDHQWGLEVGVY

SEQ ID NO: 1246377 - protein, 17 aa, Mycobacterium
REGRLRTALAELKQYDF

SEQ ID NO: 1246378 - protein, 22 aa, Mycobacterium
REGVNLTYLPFIARAVIDALKQ

SEQ ID NO: 1246379 - protein, 19 aa, Mycobacterium
REHLPVLEKDWSFGNPANL

SEQ ID NO: 1246380 - protein, 22 aa, Mycobacterium
REIAEKGHLPAEVLDAAAVTIA

SEQ ID NO: 1246381 - protein, 25 aa, Mycobacterium
REIAFGAARCGADVVIASRSLETCE

SEQ ID NO: 1246382 - protein, 21 aa, Mycobacterium
REIASELVALYAKRQAAPGHA

SEQ ID NO: 1246383 - protein, 22 aa, Mycobacterium
REIEFPDRGVVVISGANEIGKS

SEQ ID NO: 1246384 - protein, 24 aa, Mycobacterium
REIEGKPSAAFLWEDKGVVPFLKI

SEQ ID NO: 1246385 - protein, 20 aa, Mycobacterium
REIHTLASIFTTVRIEGPDY

SEQ ID NO: 1246386 - protein, 25 aa, Mycobacterium
REILDEWRTITGLDRKTDDALWKRY

SEQ ID NO: 1246387 - protein, 21 aa, Mycobacterium
REILRRAELCTTTAPGERRRV

SEQ ID NO: 1246388 - protein, 22 aa, Mycobacterium
REIPANRPGRAISMEKHHLMMG

SEQ ID NO: 1246389 - protein, 19 aa, Mycobacterium
REIPILIGGQGERKTLRLV

SEQ ID NO: 1246390 - protein, 28 aa, Mycobacterium
RELAALVARSPFGQGAAWPVVETVQRDG

SEQ ID NO: 1246391 - protein, 17 aa, Mycobacterium
RELAERYGDRFTPPDSL

SEQ ID NO: 1246392 - protein, 24 aa, Mycobacterium
RELAPDCCAVVAYGALLSERLLAV

SEQ ID NO: 1246393 - protein, 23 aa, Mycobacterium
RELCLRAAGALGVATEADIRDYF

SEQ ID NO: 1246394 - protein, 22 aa, Mycobacterium
RELDADFDIGAFAHVARWNAGE

SEQ ID NO: 1246395 - protein, 18 aa, Mycobacterium
RELDELIGRIASTPLDRS

SEQ ID NO: 1246396 - protein, 19 aa, Mycobacterium
RELDEVIGRIASTPLDRDR

SEQ ID NO: 1246397 - protein, 23 aa, Mycobacterium
RELERHGPGRVPAGVDIHHLPFI

SEQ ID NO: 1246398 - protein, 22 aa, Mycobacterium
RELKLGTGGLRDVEFAVQLLQL

SEQ ID NO: 1246399 - protein, 22 aa, Mycobacterium
RELLDALAPLGDWATRHIDLIC

SEQ ID NO: 1246400 - protein, 19 aa, Mycobacterium
RELPVLFYTRTPEYTRGAT

SEQ ID NO: 1246401 - protein, 25 aa, Mycobacterium
RELQELRKSSGLDVSDRISVVMSVP

SEQ ID NO: 1246402 - protein, 18 aa, Mycobacterium
RELREFLSTVVTDEVLAR

SEQ ID NO: 1246403 - protein, 18 aa, Mycobacterium
RELRWRTTISNHRPDVLK

SEQ ID NO: 1246404 - protein, 19 aa, Mycobacterium
RELTALALQRIYLDRVAKL

SEQ ID NO: 1246405 - protein, 21 aa, Mycobacterium
RELTVGPFLNRRAMIAEAGDA

SEQ ID NO: 1246406 - protein, 18 aa, Mycobacterium
RELVARIRAMLRRPRMRP

SEQ ID NO: 1246407 - protein, 20 aa, Mycobacterium
RELVGEGSLFLLKVVGDSMV

SEQ ID NO: 1246408 - protein, 26 aa, Mycobacterium
RELVWPSMRISHCRPPGADRDIVLMH

SEQ ID NO: 1246409 - protein, 17 aa, Mycobacterium
REMALKFGATEVLDPAA

SEQ ID NO: 1246410 - protein, 21 aa, Mycobacterium
REMGVAGFEEYTEIKLIATAA

SEQ ID NO: 1246411 - protein, 24 aa, Mycobacterium
REMIADRELETWLVVDMSASLDFG

SEQ ID NO: 1246412 - protein, 21 aa, Mycobacterium
REMIKTGGFDAVCFTSSSTVR

SEQ ID NO: 1246413 - protein, 18 aa, Mycobacterium
RENIAFPLRAKKIARTEA

SEQ ID NO: 1246414 - protein, 18 aa, Mycobacterium
RENIRMIGGLYGIRRREL

SEQ ID NO: 1246415 - protein, 20 aa, Mycobacterium
RENLPLIVKRVHDACPQVHI

SEQ ID NO: 1246416 - protein, 20 aa, Mycobacterium
RENPVAWSRPADSDLLPPEQ

SEQ ID NO: 1246417 - protein, 19 aa, Mycobacterium
REPEFEMFGRFPLTDNDPG

SEQ ID NO: 1246418 - protein, 28 aa, Mycobacterium
REPIRWRSRELLTRIGSVFQNPEHQFLT

SEQ ID NO: 1246419 - protein, 21 aa, Mycobacterium
REQALRFGADLRMEDVDEVSL

SEQ ID NO: 1246420 - protein, 18 aa, Mycobacterium
REQGCPFAPPEQIRTLAA

SEQ ID NO: 1246421 - protein, 25 aa, Mycobacterium
REQGITIDVAYRFFSTANRSYILAD

SEQ ID NO: 1246422 - protein, 22 aa, Mycobacterium
REQIPGLPLLLLTAKDSVEDRI

SEQ ID NO: 1246423 - protein, 18 aa, Mycobacterium
RERCATDVVLGGRHAKYP

SEQ ID NO: 1246424 - protein, 25 aa, Mycobacterium
RERDAIWMRVWQIAGRVEDLPKPGD

SEQ ID NO: 1246425 - protein, 19 aa, Mycobacterium
RERFGYDAWVLAYDAATVA

SEQ ID NO: 1246426 - protein, 19 aa, Mycobacterium
RERGELMGIGMAFFTEAVG

SEQ ID NO: 1246427 - protein, 20 aa, Mycobacterium
RERSSALAFDLRTTPLRDVN

SEQ ID NO: 1246428 - protein, 27 aa, Mycobacterium
RESGAWRRHPWSEVLARSMNVAERIGD

SEQ ID NO: 1246429 - protein, 19 aa, Mycobacterium
RESRFPISEILAQTPEIPD

SEQ ID NO: 1246430 - protein, 17 aa, Mycobacterium
RETCGLTGTHLGCEHGA

SEQ ID NO: 1246431 - protein, 24 aa, Mycobacterium
RETLRLLVDLARAAGLEKRRDAML

SEQ ID NO: 1246432 - protein, 22 aa, Mycobacterium
RETPELAAFIDWEMCTVGDPLL

SEQ ID NO: 1246433 - protein, 25 aa, Mycobacterium
RETVTRIAAQWGFAHTGRFAVMYRE

SEQ ID NO: 1246434 - protein, 19 aa, Mycobacterium
REVDWPVLVDAGWVGLEVP

SEQ ID NO: 1246435 - protein, 17 aa, Mycobacterium
REVFGRDGVNATLSQVA

SEQ ID NO: 1246436 - protein, 17 aa, Mycobacterium
REVHGPAELQAIIEQTH

SEQ ID NO: 1246437 - protein, 28 aa, Mycobacterium
REVLGAGIPLFGICFGNQILGRALGRGT

SEQ ID NO: 1246438 - protein, 31 aa, Mycobacterium
REVLLELARRADVFLTSFLPGHRQKFGIDVD

SEQ ID NO: 1246439 - protein, 20 aa, Mycobacterium
REVLTGMGLDVSALTDDQMV

SEQ ID NO: 1246440 - protein, 20 aa, Mycobacterium
REVSLRDGLQIEQPIPLSAK

SEQ ID NO: 1246441 - protein, 26 aa, Mycobacterium
REYAEVAPLKGARISGSLHMTVQTAV

SEQ ID NO: 1246442 - protein, 24 aa, Mycobacterium
REYRRKVQLCLDVFETMLAQSSFE

SEQ ID NO: 1246443 - protein, 27 aa, Mycobacterium
RFADTHARVGLLPTWGLSVRLPQKVGV

SEQ ID NO: 1246444 - protein, 18 aa, Mycobacterium
RFAHKVPALHCTSTLEAL

SEQ ID NO: 1246445 - protein, 19 aa, Mycobacterium
RFAKEPEVTLPLQAAPRVS

SEQ ID NO: 1246446 - protein, 23 aa, Mycobacterium
RFARELPEMAVRWKAEEAPDPRL

SEQ ID NO: 1246447 - protein, 17 aa, Mycobacterium
RFDHMRRVYREALPVLA

SEQ ID NO: 1246448 - protein, 20 aa, Mycobacterium
RFDYMYKFVSSKKMQPGAGA

SEQ ID NO: 1246449 - protein, 19 aa, Mycobacterium
RFETLKARLGDAFEVIEID

SEQ ID NO: 1246450 - protein, 22 aa, Mycobacterium
RFFCAGGDLKAFATAPSRGRFI

SEQ ID NO: 1246451 - protein, 25 aa, Mycobacterium
RFFTRSEAVLGIWRSLLPAEEWVAV

SEQ ID NO: 1246452 - protein, 20 aa, Mycobacterium
RFGPHPIRAPYLVTRAGFIG

SEQ ID NO: 1246453 - protein, 20 aa, Mycobacterium
RFGTIGIGYRPGTTVDAVRV

SEQ ID NO: 1246454 - protein, 26 aa, Mycobacterium
RFGYVARGGLRWSDRREDFRTEVLGL

SEQ ID NO: 1246455 - protein, 26 aa, Mycobacterium
RFHNHLYEVLGLDFLYKAFTTTDIGA

SEQ ID NO: 1246456 - protein, 40 aa, Mycobacterium
RFHTVYWPAFLMSAGLELPRKVFAHGWLLNRGEKMSKSIG

SEQ ID NO: 1246457 - protein, 17 aa, Mycobacterium
RFIPMAIPAIWDPELCA

SEQ ID NO: 1246458 - protein, 20 aa, Mycobacterium
RFLQLCDAFDIPVLSLVDCP

SEQ ID NO: 1246459 - protein, 18 aa, Mycobacterium
RFLRGVLGFKKSDEIYTF

SEQ ID NO: 1246460 - protein, 18 aa, Mycobacterium
RFRDEMRLPWDADRQRRF

SEQ ID NO: 1246461 - protein, 26 aa, Mycobacterium
RFRIVDCPACGGMLKPDIVYFGESVP

SEQ ID NO: 1246462 - protein, 25 aa, Mycobacterium
RFRRKPHWLDVRFSGDNAGVMPGSH

SEQ ID NO: 1246463 - protein, 19 aa, Mycobacterium
RFSPFDAYTDIAFPGGIHA

SEQ ID NO: 1246464 - protein, 23 aa, Mycobacterium
RFVEAVPPHILVVIDEAYVEYIR

SEQ ID NO: 1246465 - protein, 17 aa, Mycobacterium
RFVPYSWAGTTATWGVD

SEQ ID NO: 1246466 - protein, 23 aa, Mycobacterium
RFVVLPAGFDAVLGIYVAHMGPI

SEQ ID NO: 1246467 - protein, 20 aa, Mycobacterium
RGAAGIALLASMPPRPGERE

SEQ ID NO: 1246468 - protein, 17 aa, Mycobacterium
RGAAGIDHPTIREAGHF

SEQ ID NO: 1246469 - protein, 18 aa, Mycobacterium
RGADAVVFAAGAGPGSGA

SEQ ID NO: 1246470 - protein, 19 aa, Mycobacterium
RGADGRVIVACFASNVDRV

SEQ ID NO: 1246471 - protein, 18 aa, Mycobacterium
RGADPVFMLTGPIPATRY

SEQ ID NO: 1246472 - protein, 17 aa, Mycobacterium
RGADRLAAEANRRRREL

SEQ ID NO: 1246473 - protein, 30 aa, Mycobacterium
RGADVVFQCRGRGSALALALRLLRPQGTVI

SEQ ID NO: 1246474 - protein, 25 aa, Mycobacterium
RGAEYSVDFVPKVRVEVIVDDSAVD

SEQ ID NO: 1246475 - protein, 18 aa, Mycobacterium
RGAGHFRLGPYGVTVPAA

SEQ ID NO: 1246476 - protein, 17 aa, Mycobacterium
RGAPVVVLAHGFPELAY

SEQ ID NO: 1246477 - protein, 22 aa, Mycobacterium
RGAQYMGVNWVGPIIMRHGTEE

SEQ ID NO: 1246478 - protein, 19 aa, Mycobacterium
RGDEMPYFNPNGMPYDHVA

SEQ ID NO: 1246479 - protein, 17 aa, Mycobacterium
RGDRIHLPVSVLSGGER

SEQ ID NO: 1246480 - protein, 36 aa, Mycobacterium
RGDRMWEFLDRLVAIALPRIRDFRGLNPKQFDGTGN

SEQ ID NO: 1246481 - protein, 23 aa, Mycobacterium
RGDRVRVGLRPSDIHVTDGEGTL

SEQ ID NO: 1246482 - protein, 17 aa, Mycobacterium
RGDSAAVEAMWADDVLV

SEQ ID NO: 1246483 - protein, 17 aa, Mycobacterium
RGDVVAIMLRNSPEPVL

SEQ ID NO: 1246484 - protein, 19 aa, Mycobacterium
RGEALARDIARVDCQILLV

SEQ ID NO: 1246485 - protein, 20 aa, Mycobacterium
RGEFDAGWDVLREQIFARQK

SEQ ID NO: 1246486 - protein, 20 aa, Mycobacterium
RGEHRCVLRMPPPGAPPDRD

SEQ ID NO: 1246487 - protein, 20 aa, Mycobacterium
RGEILRSVFETLTDRADDIA

SEQ ID NO: 1246488 - protein, 21 aa, Mycobacterium
RGELVRSAFRDHLRQIGKLPA

SEQ ID NO: 1246489 - protein, 25 aa, Mycobacterium
RGENGLKIYAMCEIPNNVILIDEFA

SEQ ID NO: 1246490 - protein, 20 aa, Mycobacterium
RGEQPRRAAVSSYGLSGTNV

SEQ ID NO: 1246491 - protein, 17 aa, Mycobacterium
RGEVIGSLAREGGLESV

SEQ ID NO: 1246492 - protein, 19 aa, Mycobacterium
RGFLLGAAVALRLGTGVLA

SEQ ID NO: 1246493 - protein, 19 aa, Mycobacterium
RGFVPVPEIQFDGFAAPAF

SEQ ID NO: 1246494 - protein, 20 aa, Mycobacterium
RGGAAFPMAVKLRSVRDHGR

SEQ ID NO: 1246495 - protein, 19 aa, Mycobacterium
RGGAAPSIDTAMHGLVDAA

SEQ ID NO: 1246496 - protein, 26 aa, Mycobacterium
RGGKALRPALSIAVCLGLGGQLDAIL

SEQ ID NO: 1246497 - protein, 25 aa, Mycobacterium
RGGLPRPARQRVFTIANQKGGVGKT

SEQ ID NO: 1246498 - protein, 18 aa, Mycobacterium
RGGLTAREREVIATVVSG

SEQ ID NO: 1246499 - protein, 23 aa, Mycobacterium
RGGMLRPAWEQVKAANFPYRYPW

SEQ ID NO: 1246500 - protein, 24 aa, Mycobacterium
RGGPSILCQVLLYPGLDRDMTCES

SEQ ID NO: 1246501 - protein, 24 aa, Mycobacterium
RGGRRSNVPIARRSSGPADERGLT

SEQ ID NO: 1246502 - protein, 20 aa, Mycobacterium
RGGRVRGQRGWIVEKSGEPG

SEQ ID NO: 1246503 - protein, 20 aa, Mycobacterium
RGGSSIGVSRVSDWAELPAA

SEQ ID NO: 1246504 - protein, 24 aa, Mycobacterium
RGGTSRRLLVVISDGLAYDHGYER

SEQ ID NO: 1246505 - protein, 21 aa, Mycobacterium
RGGVLAHLFGTVAVLHPDDQA

SEQ ID NO: 1246506 - protein, 21 aa, Mycobacterium
RGGWDRALTALGERVHAEVRR

SEQ ID NO: 1246507 - protein, 19 aa, Mycobacterium
RGHDWKFAVTEGGRHSVTH

SEQ ID NO: 1246508 - protein, 17 aa, Mycobacterium
RGHFGPYGGRLVPEALM

SEQ ID NO: 1246509 - protein, 19 aa, Mycobacterium
RGHSVPVPGELGGAAMVID

SEQ ID NO: 1246510 - protein, 20 aa, Mycobacterium
RGHVPRLPAPPMPTVRLKPR

SEQ ID NO: 1246511 - protein, 23 aa, Mycobacterium
RGIGATIAEVFARDGAAVVAVDM

SEQ ID NO: 1246512 - protein, 27 aa, Mycobacterium
RGIGGCLYALLAKCWPEDVSEPAQLAE

SEQ ID NO: 1246513 - protein, 26 aa, Mycobacterium
RGIGKGDRVILMLGNQVELWEAMLAV

SEQ ID NO: 1246514 - protein, 20 aa, Mycobacterium
RGIMPDRHLGTAIAAAHNEM

SEQ ID NO: 1246515 - protein, 17 aa, Mycobacterium
RGIPIITVVNKWDRPGR

SEQ ID NO: 1246516 - protein, 17 aa, Mycobacterium
RGIYRYRAAAEKKSNTA

SEQ ID NO: 1246517 - protein, 19 aa, Mycobacterium
RGKPCAKLVPVEAVEQLAT

SEQ ID NO: 1246518 - protein, 21 aa, Mycobacterium
RGKQMRNMLATLMCSQGTPMI

SEQ ID NO: 1246519 - protein, 17 aa, Mycobacterium
RGLDVVVPAGLELLADV

SEQ ID NO: 1246520 - protein, 19 aa, Mycobacterium
RGLESFPSAGGALVVSNHS

SEQ ID NO: 1246521 - protein, 19 aa, Mycobacterium
RGLFTALAAQGWRMLAEAL

SEQ ID NO: 1246522 - protein, 18 aa, Mycobacterium
RGLGEAMVGINVEDIAQP

SEQ ID NO: 1246523 - protein, 25 aa, Mycobacterium
RGLGGRKDAQWALAHGQRVFARLDR

SEQ ID NO: 1246524 - protein, 21 aa, Mycobacterium
RGLGRLYALELARRGAAVVVN

SEQ ID NO: 1246525 - protein, 30 aa, Mycobacterium
RGLIAEYGISWILPRLVGFGAAMDLLLSGR

SEQ ID NO: 1246526 - protein, 25 aa, Mycobacterium
RGLLDVLTALAWVRDNIAAFGGDPD

SEQ ID NO: 1246527 - protein, 17 aa, Mycobacterium
RGLPSRVLLAGHIDTVP

SEQ ID NO: 1246528 - protein, 19 aa, Mycobacterium
RGLRSSIAAVRGRRREKRA

SEQ ID NO: 1246529 - protein, 27 aa, Mycobacterium
RGLTGRPEHRRLVICDLGMPRDVEPAI

SEQ ID NO: 1246530 - protein, 17 aa, Mycobacterium
RGLVACIDITPADTGCS

SEQ ID NO: 1246531 - protein, 22 aa, Mycobacterium
RGLVRPPGLLAHSLARRAAQTA

SEQ ID NO: 1246532 - protein, 19 aa, Mycobacterium
RGMFLCCKFAIEAMLPTGG

SEQ ID NO: 1246533 - protein, 19 aa, Mycobacterium
RGMTLPFWMVYDDREGEVP

SEQ ID NO: 1246534 - protein, 20 aa, Mycobacterium
RGNELWQMALLELWLQRHGI

SEQ ID NO: 1246535 - protein, 21 aa, Mycobacterium
RGNFASGYRGKLWTFRQYSGF

SEQ ID NO: 1246536 - protein, 20 aa, Mycobacterium
RGPATITDLIAGTRCWTDRE

SEQ ID NO: 1246537 - protein, 17 aa, Mycobacterium
RGPRPPGRLRPHVLDHD

SEQ ID NO: 1246538 - protein, 17 aa, Mycobacterium
RGPTAARLFYVYADTLL

SEQ ID NO: 1246539 - protein, 21 aa, Mycobacterium
RGPYPTMYVNQPWTIRQYAGF

SEQ ID NO: 1246540 - protein, 20 aa, Mycobacterium
RGQCQCGFFGKRRLLRSSAV

SEQ ID NO: 1246541 - protein, 18 aa, Mycobacterium
RGQGRCHAVALAAEGADI

SEQ ID NO: 1246542 - protein, 27 aa, Mycobacterium
RGQRLLGRCPVCLYAGSIMPEDLLALC

SEQ ID NO: 1246543 - protein, 25 aa, Mycobacterium
RGQVWPRMAAKYGVENPVPPWKTSL

SEQ ID NO: 1246544 - protein, 21 aa, Mycobacterium
RGRDMPVPVLVGSWHTIEGLV

SEQ ID NO: 1246545 - protein, 19 aa, Mycobacterium
RGREFVMKDSYSFDVDDDG

SEQ ID NO: 1246546 - protein, 20 aa, Mycobacterium
RGRELCPGGRLVVMTMGIGE

SEQ ID NO: 1246547 - protein, 18 aa, Mycobacterium
RGRFRVRASKGVHIVVPR

SEQ ID NO: 1246548 - protein, 21 aa, Mycobacterium
RGRGAMIAVELVKPGTTEPDA

SEQ ID NO: 1246549 - protein, 19 aa, Mycobacterium
RGRHIWIRDRTSYRVLSGT

SEQ ID NO: 1246550 - protein, 19 aa, Mycobacterium
RGRPGWHTECVAMCEAYLG

SEQ ID NO: 1246551 - protein, 19 aa, Mycobacterium
RGSGYAVAALCGAGGQGDA

SEQ ID NO: 1246552 - protein, 17 aa, Mycobacterium
RGSHFAELDRGRAGARQ

SEQ ID NO: 1246553 - protein, 23 aa, Mycobacterium
RGSTRGALAMDPRRMAMLFEEGS

SEQ ID NO: 1246554 - protein, 23 aa, Mycobacterium
RGTAPEGRGYWFAPTVLTPQRTD

SEQ ID NO: 1246555 - protein, 20 aa, Mycobacterium
RGTDRCRLLIRSRLGLRHPG

SEQ ID NO: 1246556 - protein, 28 aa, Mycobacterium
RGTDWKHGVCAALGWPHDTQADIARAWQ

SEQ ID NO: 1246557 - protein, 23 aa, Mycobacterium
RGTGARGLRAIMEEVLLPVMYDI

SEQ ID NO: 1246558 - protein, 18 aa, Mycobacterium
RGTHLVFDAAAFGHPTAA

SEQ ID NO: 1246559 - protein, 18 aa, Mycobacterium
RGVAKFKVPEQVVLVEAL

SEQ ID NO: 1246560 - protein, 18 aa, Mycobacterium
RGVARLEYSAHPSAAQVL

SEQ ID NO: 1246561 - protein, 18 aa, Mycobacterium
RGVAVLSQVDGARWLSLE

SEQ ID NO: 1246562 - protein, 19 aa, Mycobacterium
RGVGQWATFTDLVADCQGG

SEQ ID NO: 1246563 - protein, 21 aa, Mycobacterium
RGVLSFAELDTSYFIGNAPGS

SEQ ID NO: 1246564 - protein, 18 aa, Mycobacterium
RGVTCVMVAEGVPCLGPV

SEQ ID NO: 1246565 - protein, 25 aa, Mycobacterium
RGWDAPTPAVGWAIRDQISHLAFFD

SEQ ID NO: 1246566 - protein, 29 aa, Mycobacterium
RGWEPEPLRWLGVRGLYLAYRLADRHEAR

SEQ ID NO: 1246567 - protein, 17 aa, Mycobacterium
RGWLDARPAGVGLTERF

SEQ ID NO: 1246568 - protein, 19 aa, Mycobacterium
RGWLSAPVIVLSARTDSSD

SEQ ID NO: 1246569 - protein, 19 aa, Mycobacterium
RGYKGISIPTMIEAENFRG

SEQ ID NO: 1246570 - protein, 17 aa, Mycobacterium
RGYRRIYLTTGDRQPEA

SEQ ID NO: 1246571 - protein, 18 aa, Mycobacterium
RGYWPPQDTFEWMLEQGM

SEQ ID NO: 1246572 - protein, 22 aa, Mycobacterium
RHADLDAALARRVAEARALVPS

SEQ ID NO: 1246573 - protein, 26 aa, Mycobacterium
RHEDGPRPTLCVIHGFMGSAYLFNGQ

SEQ ID NO: 1246574 - protein, 19 aa, Mycobacterium
RHFDAWWRKQRHRTPDLLT

SEQ ID NO: 1246575 - protein, 20 aa, Mycobacterium
RHFSFGLGVHRCIGSNVART

SEQ ID NO: 1246576 - protein, 25 aa, Mycobacterium
RHGEFRAVGYTSIYDDVEHVALVRG

SEQ ID NO: 1246577 - protein, 19 aa, Mycobacterium
RHGKELTWAQVVMAANTPM

SEQ ID NO: 1246578 - protein, 25 aa, Mycobacterium
RHGLKSMLFAPELGLGRAWTMSARR

SEQ ID NO: 1246579 - protein, 23 aa, Mycobacterium
RHILTDSGAQAWLGDKPEDTELP

SEQ ID NO: 1246580 - protein, 22 aa, Mycobacterium
RHLDLPAVQTFHALGVVERRHQ

SEQ ID NO: 1246581 - protein, 23 aa, Mycobacterium
RHLEAHVPWGARLTVTPGDTGQP

SEQ ID NO: 1246582 - protein, 21 aa, Mycobacterium
RHLEIRWDGQVALLSDLNSTN

SEQ ID NO: 1246583 - protein, 17 aa, Mycobacterium
RHLGGALAREPQHRSAL

SEQ ID NO: 1246584 - protein, 23 aa, Mycobacterium
RHLLDMRSGIAFSEEYLDPLAEV

SEQ ID NO: 1246585 - protein, 18 aa, Mycobacterium
RHLVPAPPYGQGRVAADA

SEQ ID NO: 1246586 - protein, 25 aa, Mycobacterium
RHPDRPDRLLACRNGDGWAEIRSDD

SEQ ID NO: 1246587 - protein, 21 aa, Mycobacterium
RHPEFAIARWAAEHLDPSERA

SEQ ID NO: 1246588 - protein, 26 aa, Mycobacterium
RHPFLGMPFWLGRGFGLNLSVVTDPA

SEQ ID NO: 1246589 - protein, 19 aa, Mycobacterium
RHQAMLSAFEQWRAQTRRE

SEQ ID NO: 1246590 - protein, 19 aa, Mycobacterium
RHQEKWARIASAVHAEGGR

SEQ ID NO: 1246591 - protein, 24 aa, Mycobacterium
RHRAEVVAVSGGVTWVDDSKATNP

SEQ ID NO: 1246592 - protein, 26 aa, Mycobacterium
RHRENLGWSAPRLHLVDLQYSDVRLD

SEQ ID NO: 1246593 - protein, 21 aa, Mycobacterium
RHRLALWSRRLLGEAITQAQY

SEQ ID NO: 1246594 - protein, 22 aa, Mycobacterium
RHSLAAVIGRPDLKLVGVHASG

SEQ ID NO: 1246595 - protein, 33 aa, Mycobacterium
RHTAPFEAGSPWLLRFFDRISWYPVSAEELLDL

SEQ ID NO: 1246596 - protein, 17 aa, Mycobacterium
RHTSLRYFNVVGSGSTA

SEQ ID NO: 1246597 - protein, 19 aa, Mycobacterium
RHVHPSTLYPGGIGTTATV

SEQ ID NO: 1246598 - protein, 18 aa, Mycobacterium
RHVLSGADDQAWRAVTET

SEQ ID NO: 1246599 - protein, 24 aa, Mycobacterium
RHWEARRGGLPTGEPNEWRHQSEP

SEQ ID NO: 1246600 - protein, 20 aa, Mycobacterium
RHYRDCRILGIGGGTNEIMN

SEQ ID NO: 1246601 - protein, 21 aa, Mycobacterium
RIADARLLLNQALERDEIVLL

SEQ ID NO: 1246602 - protein, 19 aa, Mycobacterium
RIAELDPHLPVQVLTDGVT

SEQ ID NO: 1246603 - protein, 19 aa, Mycobacterium
RIAGHGFAVVAPDWNSHAD

SEQ ID NO: 1246604 - protein, 17 aa, Mycobacterium
RIALHVRTIYGRDPHHI

SEQ ID NO: 1246605 - protein, 18 aa, Mycobacterium
RIALTYRTPVIILSDGAI

SEQ ID NO: 1246606 - protein, 20 aa, Mycobacterium
RIAMGRGWLQLAGDDLDGAR

SEQ ID NO: 1246607 - protein, 21 aa, Mycobacterium
RIANAISRDARYRFSHDRVAE

SEQ ID NO: 1246608 - protein, 39 aa, Mycobacterium
RIAPELRRKAEEVFPRAQAMLPKAIAAGVRIACGTDAPA

SEQ ID NO: 1246609 - protein, 17 aa, Mycobacterium
RIARIWLNRPHTQNAQS

SEQ ID NO: 1246610 - protein, 17 aa, Mycobacterium
RIAVGYKADLNVIDHAA

SEQ ID NO: 1246611 - protein, 19 aa, Mycobacterium
RIAVPGCYPTAALLALLPA

SEQ ID NO: 1246612 - protein, 20 aa, Mycobacterium
RICSQQQLWSVFGKKRGKNG

SEQ ID NO: 1246613 - protein, 28 aa, Mycobacterium
RIDATRMLVWRAGWMHRNNKAFTSAEGS

SEQ ID NO: 1246614 - protein, 26 aa, Mycobacterium
RIDHIIGLFRLWWIPRGAAPTEGTYV

SEQ ID NO: 1246615 - protein, 17 aa, Mycobacterium
RIDVRRSLIAVADCRHV

SEQ ID NO: 1246616 - protein, 25 aa, Mycobacterium
RIEAAGWSQVRWRNLTGGIVALHAA

SEQ ID NO: 1246617 - protein, 25 aa, Mycobacterium
RIEQLARWGYPFPVGDDGRQLRSSL

SEQ ID NO: 1246618 - protein, 29 aa, Mycobacterium
RIERTPEDWLFKACVGDDFVIDVLHALNG

SEQ ID NO: 1246619 - protein, 19 aa, Mycobacterium
RIETEIANLLSAVHAVQRG

SEQ ID NO: 1246620 - protein, 19 aa, Mycobacterium
RIGFFTVAGQFGMLLRLGA

SEQ ID NO: 1246621 - protein, 23 aa, Mycobacterium
RIGKDKPVGLVWEKDTSLPELLC

SEQ ID NO: 1246622 - protein, 18 aa, Mycobacterium
RIGLALNCEIVPWCRFAR

SEQ ID NO: 1246623 - protein, 17 aa, Mycobacterium
RIGTRASLLATTQAGTI

SEQ ID NO: 1246624 - protein, 17 aa, Mycobacterium
RIGVPSWIRRTGSAPTA

SEQ ID NO: 1246625 - protein, 18 aa, Mycobacterium
RIHLLRDVLILAGAGVGG

SEQ ID NO: 1246626 - protein, 25 aa, Mycobacterium
RIHPETGRRVLLLGHFIKQFVGLGV

SEQ ID NO: 1246627 - protein, 17 aa, Mycobacterium
RIIAAPLTRVFSALVDP

SEQ ID NO: 1246628 - protein, 19 aa, Mycobacterium
RIITSPVFTGDRVLGAILF

SEQ ID NO: 1246629 - protein, 17 aa, Mycobacterium
RIKDICERYELPYNSGR

SEQ ID NO: 1246630 - protein, 19 aa, Mycobacterium
RILAALPHVIVMDAVGSSE

SEQ ID NO: 1246631 - protein, 24 aa, Mycobacterium
RILDRLYGYEVSPVLWKKVAPKLS

SEQ ID NO: 1246632 - protein, 26 aa, Mycobacterium
RILGVKGRVLPMCPIALQIEADVAGL

SEQ ID NO: 1246633 - protein, 22 aa, Mycobacterium
RILRGRTGALIVLGYDDSVETI

SEQ ID NO: 1246634 - protein, 22 aa, Mycobacterium
RILYRCEFGKSRSVPVDLSDHP

SEQ ID NO: 1246635 - protein, 20 aa, Mycobacterium
RINHAYLFSGPRGCGKTSSA

SEQ ID NO: 1246636 - protein, 28 aa, Mycobacterium
RIPDFVKLAEALGCVGLRCEREEDVVEV

SEQ ID NO: 1246637 - protein, 22 aa, Mycobacterium
RIPRGCLDLLVIEEAGQFCLAN

SEQ ID NO: 1246638 - protein, 26 aa, Mycobacterium
RIPYVRRRGEYLYNFWRDAANPRGLW

SEQ ID NO: 1246639 - protein, 19 aa, Mycobacterium
RIQQEWGISDEVMRDLVNN

SEQ ID NO: 1246640 - protein, 19 aa, Mycobacterium
RIRAGSVAINHGFDMNAPF

SEQ ID NO: 1246641 - protein, 29 aa, Mycobacterium
RIRARVAAALPEYMVPAAYVVLDEVPITT

SEQ ID NO: 1246642 - protein, 18 aa, Mycobacterium
RIRDEVYGNLYLTDKVGG

SEQ ID NO: 1246643 - protein, 21 aa, Mycobacterium
RIRRHARLRKKVSGTAQRPRL

SEQ ID NO: 1246644 - protein, 20 aa, Mycobacterium
RIRRNARDSYQIGVLGLKGG

SEQ ID NO: 1246645 - protein, 20 aa, Mycobacterium
RIRVPLRLVVNMAAMSGDRG

SEQ ID NO: 1246646 - protein, 21 aa, Mycobacterium
RISDVLLPFLVTRQLICGAGK

SEQ ID NO: 1246647 - protein, 26 aa, Mycobacterium
RITDRLKDMYICGGFNVYPAEIEQVL

SEQ ID NO: 1246648 - protein, 25 aa, Mycobacterium
RITDWKIKLCDTIADNASSAGWVLG

SEQ ID NO: 1246649 - protein, 17 aa, Mycobacterium
RIVRRIVGTLGRPQPPP

SEQ ID NO: 1246650 - protein, 19 aa, Mycobacterium
RIVSIEAFEAFPKERYKAF

SEQ ID NO: 1246651 - protein, 19 aa, Mycobacterium
RIWELEKRRHHVPWVTWGT

SEQ ID NO: 1246652 - protein, 22 aa, Mycobacterium
RIWNRIGRRPVLSAGNSNGDDE

SEQ ID NO: 1246653 - protein, 18 aa, Mycobacterium
RIWRRARPSYLPVPLARR

SEQ ID NO: 1246654 - protein, 17 aa, Mycobacterium
RIYRDVRLLRLYEGTSE

SEQ ID NO: 1246655 - protein, 19 aa, Mycobacterium
RKAGERFGFAVDSLSLVAE

SEQ ID NO: 1246656 - protein, 21 aa, Mycobacterium
RKAGPDNPARFIAEVNGADDL

SEQ ID NO: 1246657 - protein, 19 aa, Mycobacterium
RKALGHAYGGGSQYYSMWV

SEQ ID NO: 1246658 - protein, 19 aa, Mycobacterium
RKALVGKRPMTRVGRAVEK

SEQ ID NO: 1246659 - protein, 17 aa, Mycobacterium
RKARAVVGNLRHVAGRH

SEQ ID NO: 1246660 - protein, 19 aa, Mycobacterium
RKDLLDVIADVDDRILQVF

SEQ ID NO: 1246661 - protein, 20 aa, Mycobacterium
RKDLLYRPQAVLRSGGRISL

SEQ ID NO: 1246662 - protein, 18 aa, Mycobacterium
RKEDVLFEVGVMSTRSAR

SEQ ID NO: 1246663 - protein, 24 aa, Mycobacterium
RKFAEGVQAEFPDQMLAYNCSPSF

SEQ ID NO: 1246664 - protein, 17 aa, Mycobacterium
RKFLAYYERDGVVAGVV

SEQ ID NO: 1246665 - protein, 25 aa, Mycobacterium
RKFRAELTMPLILLGGITNRETMDL

SEQ ID NO: 1246666 - protein, 19 aa, Mycobacterium
RKGGHILAGADGRVYGVDH

SEQ ID NO: 1246667 - protein, 18 aa, Mycobacterium
RKGIARGRSVVALAYADG

SEQ ID NO: 1246668 - protein, 24 aa, Mycobacterium
RKGKARPTVPGWEDVLLGVRSSGG

SEQ ID NO: 1246669 - protein, 17 aa, Mycobacterium
RKGKIVVEFGSVDDLQR

SEQ ID NO: 1246670 - protein, 25 aa, Mycobacterium
RKGSELRRFLARWLGPAILYPRLSS

SEQ ID NO: 1246671 - protein, 17 aa, Mycobacterium
RKHRGIGYFVVDMSSEG

SEQ ID NO: 1246672 - protein, 39 aa, Mycobacterium
RKKLPSVQVGDPFMEKVLIECCLELYAADLVVGIQDLGG

SEQ ID NO: 1246673 - protein, 24 aa, Mycobacterium
RKLAEKLWQLRILDGERSAADETA

SEQ ID NO: 1246674 - protein, 20 aa, Mycobacterium
RKLATAGAFHTRYMASALDG

SEQ ID NO: 1246675 - protein, 19 aa, Mycobacterium
RKLGAPGHEEFAMGALATG

SEQ ID NO: 1246676 - protein, 25 aa, Mycobacterium
RKLLEARVGREAMLDQVVGEAVPGR

SEQ ID NO: 1246677 - protein, 21 aa, Mycobacterium
RKLRDLPRREVHPEVEAQDRT

SEQ ID NO: 1246678 - protein, 19 aa, Mycobacterium
RKLSESDWTLDREAADAVL

SEQ ID NO: 1246679 - protein, 17 aa, Mycobacterium
RKLSLEYVLRKQCRDTA

SEQ ID NO: 1246680 - protein, 18 aa, Mycobacterium
RKNILRGDEMPYFNPNGM

SEQ ID NO: 1246681 - protein, 19 aa, Mycobacterium
RKPFEAWLADIASVAGEAK

SEQ ID NO: 1246682 - protein, 22 aa, Mycobacterium
RKPPAVPLVELLDALDVTTEAP

SEQ ID NO: 1246683 - protein, 19 aa, Mycobacterium
RKQLRELLADVARDRGFLR

SEQ ID NO: 1246684 - protein, 17 aa, Mycobacterium
RKRGEILRSVFETLTDR

SEQ ID NO: 1246685 - protein, 25 aa, Mycobacterium
RKRIVRRLLAAVGFPVQELVRTDIG

SEQ ID NO: 1246686 - protein, 21 aa, Mycobacterium
RKRPEFGKLTPLYPNQRLRLE

SEQ ID NO: 1246687 - protein, 22 aa, Mycobacterium
RKRWPNGVGELEFFEKQLASSA

SEQ ID NO: 1246688 - protein, 18 aa, Mycobacterium
RKSFMIISGGVNIYPQET

SEQ ID NO: 1246689 - protein, 29 aa, Mycobacterium
RKSPQISEVLPLLYLHGLSSGDFGPALEQ

SEQ ID NO: 1246690 - protein, 18 aa, Mycobacterium
RKTLRLVAEYADIWHGFT

SEQ ID NO: 1246691 - protein, 18 aa, Mycobacterium
RKTVRAFADREVLPHVDE

SEQ ID NO: 1246692 - protein, 17 aa, Mycobacterium
RKVALELIYTGEPISAA

SEQ ID NO: 1246693 - protein, 37 aa, Mycobacterium; identical to SEQ ID NO: 367637

SEQ ID NO: 1246694 - protein, 20 aa, Mycobacterium
RKVMPHFKGQLTAPRASHDW

SEQ ID NO: 1246695 - protein, 17 aa, Mycobacterium
RKVRDRASFAFALVSVA

SEQ ID NO: 1246696 - protein, 22 aa, Mycobacterium
RKVRFLPYGIAVSVLDANTPGD

SEQ ID NO: 1246697 - protein, 23 aa, Mycobacterium
RKVRRRVGFVFTDPDRQILMPTV

SEQ ID NO: 1246698 - protein, 25 aa, Mycobacterium
RKWGRRGNVELLRLSYGRFGDDLAR

SEQ ID NO: 1246699 - protein, 22 aa, Mycobacterium
RLAAAGCARRGVPPMPVVDALT

SEQ ID NO: 1246700 - protein, 28 aa, Mycobacterium
RLAAPLKELICRGTVWSLRREARKPGSA

SEQ ID NO: 1246701 - protein, 18 aa, Mycobacterium
RLAARAAVALDSARLYEE

SEQ ID NO: 1246702 - protein, 17 aa, Mycobacterium
RLAARKARELVRRKSAT

SEQ ID NO: 1246703 - protein, 21 aa, Mycobacterium
RLAELDRRIAQQVDQSAQVVA

SEQ ID NO: 1246704 - protein, 17 aa, Mycobacterium
RLAELGIELPEVVAPLA

SEQ ID NO: 1246705 - protein, 25 aa, Mycobacterium
RLAESMPREYAMVLTPLHTLIADII

SEQ ID NO: 1246706 - protein, 17 aa, Mycobacterium
RLAGAGLIEVRQGDATT

SEQ ID NO: 1246707 - protein, 22 aa, Mycobacterium
RLAGGPAHFRAILELFLHTDVR

SEQ ID NO: 1246708 - protein, 19 aa, Mycobacterium
RLAGVDALHPGWRYPDPLA

SEQ ID NO: 1246709 - protein, 21 aa, Mycobacterium
RLAKRISTIVASAIEYEIKDP

SEQ ID NO: 1246710 - protein, 17 aa, Mycobacterium
RLALANRSLSFADFLRT

SEQ ID NO: 1246711 - protein, 18 aa, Mycobacterium
RLAPEPVLSAALGPGALI

SEQ ID NO: 1246712 - protein, 22 aa, Mycobacterium
RLAPKGTGAVLAFELAGGVDAG

SEQ ID NO: 1246713 - protein, 20 aa, Mycobacterium
RLASEMPVEADLVIGVPESG

SEQ ID NO: 1246714 - protein, 20 aa, Mycobacterium
RLASMESIASYCLTEPGAGS

SEQ ID NO: 1246715 - protein, 19 aa, Mycobacterium
RLCDPVAEQISTVWASALP

SEQ ID NO: 1246716 - protein, 20 aa, Mycobacterium
RLDAGLVLSSIGYRGRPVAG

SEQ ID NO: 1246717 - protein, 20 aa, Mycobacterium
RLDDELATYLTALRDAADRA

SEQ ID NO: 1246718 - protein, 17 aa, Mycobacterium
RLDEILSRLSARHDIMW

SEQ ID NO: 1246719 - protein, 23 aa, Mycobacterium
RLDERARMDLIFTAGGYGVMATA

SEQ ID NO: 1246720 - protein, 17 aa, Mycobacterium
RLDEVPAGTIWVHCASG

SEQ ID NO: 1246721 - protein, 25 aa, Mycobacterium
RLDGGGYRGDLAWWAGPWPVDERWW

SEQ ID NO: 1246722 - protein, 27 aa, Mycobacterium
RLDGYPRPGRTVLFLGRYDEPRKGMNV

SEQ ID NO: 1246723 - protein, 25 aa, Mycobacterium
RLDIAADGSFEWRFTPEVPSQLVIR

SEQ ID NO: 1246724 - protein, 21 aa, Mycobacterium
RLDLFAVPRLHLRHIDPDGRD

SEQ ID NO: 1246725 - protein, 27 aa, Mycobacterium
RLDLSLPANVPFRFLCIPQYETERILR

SEQ ID NO: 1246726 - protein, 26 aa, Mycobacterium
RLDRARPLWECWVIEGLSRHRWAVLM

SEQ ID NO: 1246727 - protein, 19 aa, Mycobacterium
RLDWSTPHDVGRKAIAQNA

SEQ ID NO: 1246728 - protein, 20 aa, Mycobacterium
RLDYDPHLRRVTATADLSRV

SEQ ID NO: 1246729 - protein, 27 aa, Mycobacterium
RLEDLASEGWIRFRRASLLDDYLARTL

SEQ ID NO: 1246730 - protein, 20 aa, Mycobacterium
RLEGRIALEEILKRFPEWDV

SEQ ID NO: 1246731 - protein, 23 aa, Mycobacterium
RLEHACGLGTGGLFVEDVTEPLV

SEQ ID NO: 1246732 - protein, 24 aa, Mycobacterium
RLEKAEDAWSDWLTAVSPEHRASA

SEQ ID NO: 1246733 - protein, 19 aa, Mycobacterium
RLFADACAVIPGGVNSPVR

SEQ ID NO: 1246734 - protein, 19 aa, Mycobacterium
RLFAPLKPAGRLSVVSEVA

SEQ ID NO: 1246735 - protein, 25 aa, Mycobacterium
RLFIGECREGGRLLELDRNGGIVRT

SEQ ID NO: 1246736 - protein, 21 aa, Mycobacterium
RLGAELTVPILAGGEVAADVL

SEQ ID NO: 1246737 - protein, 19 aa, Mycobacterium
RLGGIFVIDVPHLDAALDW

SEQ ID NO: 1246738 - protein, 26 aa, Mycobacterium
RLGLPALGAVKAWASVGVDPAFTGLA

SEQ ID NO: 1246739 - protein, 25 aa, Mycobacterium
RLGPKAFEQCAGFLRITGGDDPLDA

SEQ ID NO: 1246740 - protein, 20 aa, Mycobacterium
RLGPLDLFGHCMGAVVAFEF

SEQ ID NO: 1246741 - protein, 18 aa, Mycobacterium
RLGRLRVGVIGLSVGHAV

SEQ ID NO: 1246742 - protein, 19 aa, Mycobacterium
RLGTYTNFCNLLDMCAVAV

SEQ ID NO: 1246743 - protein, 27 aa, Mycobacterium
RLGVEEELLRLGARPGCAVTIGDMTFD

SEQ ID NO: 1246744 - protein, 18 aa, Mycobacterium
RLGVWLTTSLGFLELSLG

SEQ ID NO: 1246745 - protein, 20 aa, Mycobacterium
RLHAKLFYQPLLESVGQPAL

SEQ ID NO: 1246746 - protein, 19 aa, Mycobacterium
RLHGALGPLVHVNVIPLNP

SEQ ID NO: 1246747 - protein, 20 aa, Mycobacterium
RLHLLSHRLIQPRGANLDGV

SEQ ID NO: 1246748 - protein, 17 aa, Mycobacterium
RLIDEVLDRTGRLDILV

SEQ ID NO: 1246749 - protein, 18 aa, Mycobacterium
RLIEACRPGMTTSGLLAA

SEQ ID NO: 1246750 - protein, 19 aa, Mycobacterium
RLKDVAGLSLTKLFVGSEG

SEQ ID NO: 1246751 - protein, 23 aa, Mycobacterium
RLKLEAMVARTATWVAATCTDEV

SEQ ID NO: 1246752 - protein, 21 aa, Mycobacterium
RLKLRSAMRLLRDKQIQRVQR

SEQ ID NO: 1246753 - protein, 18 aa, Mycobacterium
RLLAADLVFDLPMVGQAA

SEQ ID NO: 1246754 - protein, 20 aa, Mycobacterium
RLLAERIIFLGSQVDDDIAN

SEQ ID NO: 1246755 - protein, 25 aa, Mycobacterium
RLLIDGRLVDTGRVFPSLNPATGQV

SEQ ID NO: 1246756 - protein, 25 aa, Mycobacterium
RLLIDSERTVLCWAMGLTQHRHAVA

SEQ ID NO: 1246757 - protein, 18 aa, Mycobacterium
RLLIKPSHLAGGYAQNAF

SEQ ID NO: 1246758 - protein, 27 aa, Mycobacterium
RLLLRGDCPRFAPGDFAVRPTVGTPVD

SEQ ID NO: 1246759 - protein, 25 aa, Mycobacterium
RLLTGELRQGALIGVMADAVAKAAD

SEQ ID NO: 1246760 - protein, 25 aa, Mycobacterium
RLLTMLRPELADWTALVLPDNRTGG

SEQ ID NO: 1246761 - protein, 18 aa, Mycobacterium
RLLWSSRANQLAVASVNG

SEQ ID NO: 1246762 - protein, 17 aa, Mycobacterium
RLMLECGSIRELATAVD

SEQ ID NO: 1246763 - protein, 28 aa, Mycobacterium
RLMVAECALIFGCDWLNIPIDAPGSSLV

SEQ ID NO: 1246764 - protein, 19 aa, Mycobacterium
RLNAAEAFETFLQTKYVGQ

SEQ ID NO: 1246765 - protein, 24 aa, Mycobacterium
RLNKEIKRRTDVVGVFPNPAALLR

SEQ ID NO: 1246766 - protein, 18 aa, Mycobacterium
RLNTARFQLDIMGVPGII

SEQ ID NO: 1246767 - protein, 19 aa, Mycobacterium
RLPAMPVAHGLGLGFDPPV

SEQ ID NO: 1246768 - protein, 17 aa, Mycobacterium
RLPDGWFAGDPTVVVDR

SEQ ID NO: 1246769 - protein, 23 aa, Mycobacterium
RLPELPEHIIIAGGGYVAAEFAH

SEQ ID NO: 1246770 - protein, 23 aa, Mycobacterium
RLPESLGGAGLTVPQLFSTIIDV

SEQ ID NO: 1246771 - protein, 22 aa, Mycobacterium
RLPSTLWAQYGLAGVLEYEGFV

SEQ ID NO: 1246772 - protein, 18 aa, Mycobacterium
RLPTEIEWEKACAWDPAA

SEQ ID NO: 1246773 - protein, 26 aa, Mycobacterium
RLPVSEWPDLLILLGDQVYADELTPE

SEQ ID NO: 1246774 - protein, 19 aa, Mycobacterium
RLQALRPLRQQLVEIPGRL

SEQ ID NO: 1246775 - protein, 19 aa, Mycobacterium
RLQECGWTVIPIVVDDVRH

SEQ ID NO: 1246776 - protein, 18 aa, Mycobacterium
RLQNELRKTIVFVTHDID

SEQ ID NO: 1246777 - protein, 23 aa, Mycobacterium
RLQTELRKTIVFVTHDFGEAVKL

SEQ ID NO: 1246778 - protein, 19 aa, Mycobacterium
RLQVINWGVFDGYHSIPFS

SEQ ID NO: 1246779 - protein, 20 aa, Mycobacterium
RLRAKLGPEYESLIGTVRNV

SEQ ID NO: 1246780 - protein, 26 aa, Mycobacterium
RLRDYVLAVKACFAAFRTGTLDHHGE

SEQ ID NO: 1246781 - protein, 21 aa, Mycobacterium
RLREAVRVFGFHLSGLDMRQN

SEQ ID NO: 1246782 - protein, 24 aa, Mycobacterium
RLRELSKMDGAVVLSSDGTRILRA

SEQ ID NO: 1246783 - protein, 19 aa, Mycobacterium
RLRGVAHLRGHETDRLAAL

SEQ ID NO: 1246784 - protein, 20 aa, Mycobacterium
RLRKDIYDLYGYNAVVHMLS

SEQ ID NO: 1246785 - protein, 22 aa, Mycobacterium
RLRPESLFNRFVAYRESLGFEV

SEQ ID NO: 1246786 - protein, 19 aa, Mycobacterium
RLRPSGRGADVWDDLHPTA

SEQ ID NO: 1246787 - protein, 18 aa, Mycobacterium
RLRQPSWRGLRPDKTPDD

SEQ ID NO: 1246788 - protein, 20 aa, Mycobacterium
RLRQRLDEAIAHLAGAELRT

SEQ ID NO: 1246789 - protein, 23 aa, Mycobacterium
RLRRLVCKAFTPKASSRLRDTCV

SEQ ID NO: 1246790 - protein, 24 aa, Mycobacterium
RLRSMRWGLIPPWVKSTDDGAPDN

SEQ ID NO: 1246791 - protein, 20 aa, Mycobacterium
RLRVGVIGLSVGHAVAHTLA

SEQ ID NO: 1246792 - protein, 24 aa, Mycobacterium
RLSARLISEISWRTRLVDDEQVLA

SEQ ID NO: 1246793 - protein, 19 aa, Mycobacterium
RLSELRLHNGTIYRWNRPV

SEQ ID NO: 1246794 - protein, 19 aa, Mycobacterium
RLSGARPVLNLVVSNVPGP

SEQ ID NO: 1246795 - protein, 26 aa, Mycobacterium
RLSGGHPVRLFIGSGMPTGLWERVID

SEQ ID NO: 1246796 - protein, 27 aa, Mycobacterium
RLSHSLDEACLLSFPRRDLTPAEAEST

SEQ ID NO: 1246797 - protein, 23 aa, Mycobacterium
RLSRGRTVWFTGLSGSGKSSVAV

SEQ ID NO: 1246798 - protein, 19 aa, Mycobacterium
RLTCWGMCEQGYWWGLVTY

SEQ ID NO: 1246799 - protein, 25 aa, Mycobacterium
RLTGNDHPACFIVANPRRDESFVTT

SEQ ID NO: 1246800 - protein, 19 aa, Mycobacterium
RLTGRIRRGRPLPERSRLH

SEQ ID NO: 1246801 - protein, 18 aa, Mycobacterium
RLTHAGAVEQVRVFKAPF

SEQ ID NO: 1246802 - protein, 26 aa, Mycobacterium
RLTYPDIRCVYWAGGNPFHHHQNIPR

SEQ ID NO: 1246803 - protein, 17 aa, Mycobacterium
RLVLTPGSVTRLFDVPG

SEQ ID NO: 1246804 - protein, 33 aa, Mycobacterium
RLVNETRPDLAILDVRMPPTFTDEGIRAAALLR

SEQ ID NO: 1246805 - protein, 20 aa, Mycobacterium
RLVRVCRAAAARGVRIGAQV

SEQ ID NO: 1246806 - protein, 22 aa, Mycobacterium
RLVSSAFVPRVVKALEPEIVSL

SEQ ID NO: 1246807 - protein, 17 aa, Mycobacterium
RLVTSCEHFHREAVGIS

SEQ ID NO: 1246808 - protein, 18 aa, Mycobacterium
RLWERRVIMLASGVDSVR

SEQ ID NO: 1246809 - protein, 25 aa, Mycobacterium
RLYEERGRIAAALQRGLRPPVLPEV

SEQ ID NO: 1246810 - protein, 21 aa, Mycobacterium
RLYMGAPVWAGAYLPVLAVAL

SEQ ID NO: 1246811 - protein, 21 aa, Mycobacterium
RLYREGWRVVAAMRTPGECAA

SEQ ID NO: 1246812 - protein, 19 aa, Mycobacterium
RMAKLYPDTDVLVFGHSHI

SEQ ID NO: 1246813 - protein, 20 aa, Mycobacterium
RMAQEFARNKIRSIVEDAQT

SEQ ID NO: 1246814 - protein, 24 aa, Mycobacterium
RMDIPRTAAPILRQLVDTLQETVH

SEQ ID NO: 1246815 - protein, 18 aa, Mycobacterium
RMDSIREVIAFPKSGGGA

SEQ ID NO: 1246816 - protein, 21 aa, Mycobacterium
RMGRRPGARWAADLLAAADAL

SEQ ID NO: 1246817 - protein, 18 aa, Mycobacterium
RMGYANFVILDREDDLGG

SEQ ID NO: 1246818 - protein, 19 aa, Mycobacterium
RMHIGEVVAHGGMAQAISE

SEQ ID NO: 1246819 - protein, 21 aa, Mycobacterium
RMICDPYPRLLVARDTVNQGA

SEQ ID NO: 1246820 - protein, 22 aa, Mycobacterium
RMKSRLATAALRNAVGRRGVVA

SEQ ID NO: 1246821 - protein, 17 aa, Mycobacterium
RMLAEALADARPDFLNA

SEQ ID NO: 1246822 - protein, 19 aa, Mycobacterium
RMLALEGFSAPAPDLADNP

SEQ ID NO: 1246823 - protein, 19 aa, Mycobacterium
RMLNAVAVAAGWDNDDGGE

SEQ ID NO: 1246824 - protein, 19 aa, Mycobacterium
RMLSVHLDGGFYLSQPAFK

SEQ ID NO: 1246825 - protein, 18 aa, Mycobacterium
RMMNEARLGVGMGAVALG

SEQ ID NO: 1246826 - protein, 19 aa, Mycobacterium
RMNGGFFPSAREYSVRYGL

SEQ ID NO: 1246827 - protein, 18 aa, Mycobacterium
RMNSMAFDVMVPLRDVLN

SEQ ID NO: 1246828 - protein, 20 aa, Mycobacterium
RMPGPDGKLMHGAVQINGSL

SEQ ID NO: 1246829 - protein, 26 aa, Mycobacterium
RMPQWSPQCRVMKPLGPVRPGTKTIN

SEQ ID NO: 1246830 - protein, 18 aa, Mycobacterium
RMQARRGPGRVCSRESTV

SEQ ID NO: 1246831 - protein, 21 aa, Mycobacterium
RMQGFEVLWLPGMDHAGIATQ

SEQ ID NO: 1246832 - protein, 23 aa, Mycobacterium
RMRAWVHSMERWCAAAGSDTYGG

SEQ ID NO: 1246833 - protein, 21 aa, Mycobacterium
RMRHGMYWSGDLAYRDAEGWI

SEQ ID NO: 1246834 - protein, 20 aa, Mycobacterium
RMRWPHGRMRYNVAMVAELS

SEQ ID NO: 1246835 - protein, 26 aa, Mycobacterium
RMSASDFPPSLGIRLNIPQPDLRKIV

SEQ ID NO: 1246836 - protein, 18 aa, Mycobacterium
RMSKRAGTVITLDDLVEA

SEQ ID NO: 1246837 - protein, 28 aa, Mycobacterium
RMTYGEMLARIDAFAGALADRGIGVGDV

SEQ ID NO: 1246838 - protein, 22 aa, Mycobacterium
RMVREAGMEVCCGGILGMGETL

SEQ ID NO: 1246839 - protein, 20 aa, Mycobacterium
RMVRRLCYEHDVAGVDVVEV

SEQ ID NO: 1246840 - protein, 20 aa, Mycobacterium
RNAKARLLRDNVVVAENLTV

SEQ ID NO: 1246841 - protein, 26 aa, Mycobacterium
RNALHWDITGLYGRVCQGLSAAARAA

SEQ ID NO: 1246842 - protein, 20 aa, Mycobacterium
RNCQQVLGGIGFTEEHELHV

SEQ ID NO: 1246843 - protein, 24 aa, Mycobacterium
RNEDGRWTVQVAWKAGRSDNVAHF

SEQ ID NO: 1246844 - protein, 21 aa, Mycobacterium
RNEGFRRLARYIFGGNHGGTE

SEQ ID NO: 1246845 - protein, 19 aa, Mycobacterium
RNKGIILVRVSGYGQTGPD

SEQ ID NO: 1246846 - protein, 25 aa, Mycobacterium
RNLLESFKLLTNVSRLFAERCIDGL

SEQ ID NO: 1246847 - protein, 19 aa, Mycobacterium
RNLPTPSGDTFEWADDSTY

SEQ ID NO: 1246848 - protein, 21 aa, Mycobacterium
RNLWAYVVIFCGHFPDGAEKF

SEQ ID NO: 1246849 - protein, 17 aa, Mycobacterium
RNNVLKLAQGEFVTISK

SEQ ID NO: 1246850 - protein, 22 aa, Mycobacterium
RNPPELVVAAILEGYRHEHRIL

SEQ ID NO: 1246851 - protein, 19 aa, Mycobacterium
RNPYALAEMGRVPWDRFQT

SEQ ID NO: 1246852 - protein, 23 aa, Mycobacterium
RNQIELFTALLLSLPGSPVLYYG

SEQ ID NO: 1246853 - protein, 27 aa, Mycobacterium
RNQLQWFADPDMMAWVDGARLNILHHI

SEQ ID NO: 1246854 - protein, 24 aa, Mycobacterium
RNRRKPLDPARRVAFDVLRAVSER

SEQ ID NO: 1246855 - protein, 18 aa, Mycobacterium
RNSPQQVRFMLADYRSAL

SEQ ID NO: 1246856 - protein, 17 aa, Mycobacterium
RNTELDTVLGLTVGADD

SEQ ID NO: 1246857 - protein, 18 aa, Mycobacterium
RNTEPWIAAAAYPKYGHP

SEQ ID NO: 1246858 - protein, 28 aa, Mycobacterium
RNTHGVSWLPLFHDMGLSMIGFPAVYGG

SEQ ID NO: 1246859 - protein, 17 aa, Mycobacterium
RNVGPLAKFYSVAPADV

SEQ ID NO: 1246860 - protein, 25 aa, Mycobacterium
RNVWSNAVIFCGHFPDGAEKFTKTD

SEQ ID NO: 1246861 - protein, 23 aa, Mycobacterium
RNYLLPRGLAIVASRGAQRQADD

SEQ ID NO: 1246862 - protein, 20 aa, Mycobacterium
RPADFSDWVLSDAVAPSGVH

SEQ ID NO: 1246863 - protein, 26 aa, Mycobacterium
RPADGAPAWLRFFGVNPRHHSLAFMP

SEQ ID NO: 1246864 - protein, 28 aa, Mycobacterium
RPANLFVAGFIGSPAMNFFPASLTDVGV

SEQ ID NO: 1246865 - protein, 18 aa, Mycobacterium
RPAPPPARTGADRTSVAL

SEQ ID NO: 1246866 - protein, 25 aa, Mycobacterium
RPATFEMMKPFLALYMGGMGAEDTN

SEQ ID NO: 1246867 - protein, 20 aa, Mycobacterium
RPAWDLDRWVRDFFGPAAAN

SEQ ID NO: 1246868 - protein, 26 aa, Mycobacterium
RPDAFPLIITHGWPGSVVEFDKVIEP

SEQ ID NO: 1246869 - protein, 25 aa, Mycobacterium
RPDDCPQGSIGKGFPGVAIYDPDTV

SEQ ID NO: 1246870 - protein, 19 aa, Mycobacterium
RPDGHWALPELSAEVASPD

SEQ ID NO: 1246871 - protein, 17 aa, Mycobacterium
RPDLKLVGVHASGPDKI

SEQ ID NO: 1246872 - protein, 22 aa, Mycobacterium
RPDLLVLGALCHDIGKGRGGDH

SEQ ID NO: 1246873 - protein, 17 aa, Mycobacterium
RPDRAIETNVEFWAAVI

SEQ ID NO: 1246874 - protein, 25 aa, Mycobacterium
RPDRAPLAVPIWYGYQPGGEVLLWT

SEQ ID NO: 1246875 - protein, 25 aa, Mycobacterium
RPDYLRLADAFAQFGNGAPVVALTA

SEQ ID NO: 1246876 - protein, 19 aa, Mycobacterium
RPELLGGRAEPVRYRLSAA

SEQ ID NO: 1246877 - protein, 20 aa, Mycobacterium
RPEPGQTFCSTWDVTDHQGA

SEQ ID NO: 1246878 - protein, 19 aa, Mycobacterium
RPERHVAMLNAERSPTFYR

SEQ ID NO: 1246879 - protein, 19 aa, Mycobacterium
RPETWTAYEDPFGDWHEDP

SEQ ID NO: 1246880 - protein, 20 aa, Mycobacterium
RPEVAALFGGERGEDARRTL

SEQ ID NO: 1246881 - protein, 23 aa, Mycobacterium
RPEVIFCSFGDMLRVPGSESDLF

SEQ ID NO: 1246882 - protein, 26 aa, Mycobacterium
RPFDKDRNGFVFGEGGALLVIETEEH

SEQ ID NO: 1246883 - protein, 26 aa, Mycobacterium
RPFFPFLVDLLDAWVAYFAEHPRERS

SEQ ID NO: 1246884 - protein, 20 aa, Mycobacterium
RPGEKIRFDDGRIGGEIVAV

SEQ ID NO: 1246885 - protein, 28 aa, Mycobacterium
RPGFHPDDWDSAAVLEHWSKELFDQDGS

SEQ ID NO: 1246886 - protein, 19 aa, Mycobacterium
RPGGGWVLDGTKYYATGTL

SEQ ID NO: 1246887 - protein, 26 aa, Mycobacterium
RPGKRTFAAVFPLGPGGHVRLLGLAA

SEQ ID NO: 1246888 - protein, 27 aa, Mycobacterium
RPGLHRLMHRLAPRHPAELASVQDFED

SEQ ID NO: 1246889 - protein, 21 aa, Mycobacterium
RPGYLRFDFNWQGALTDDQRT

SEQ ID NO: 1246890 - protein, 23 aa, Mycobacterium
RPHGGRLLLRLDGVADRTAADAL

SEQ ID NO: 1246891 - protein, 19 aa, Mycobacterium
RPHGHPWTYAAVYDLVRRL

SEQ ID NO: 1246892 - protein, 20 aa, Mycobacterium
RPIDHRALRWVAVHELDDLP

SEQ ID NO: 1246893 - protein, 17 aa, Mycobacterium
RPIRVFDGVASPLRDAT

SEQ ID NO: 1246894 - protein, 18 aa, Mycobacterium
RPIVESAYNRPMGAPPAP

SEQ ID NO: 1246895 - protein, 19 aa, Mycobacterium
RPKDLCAGADALVAGLAGI

SEQ ID NO: 1246896 - protein, 23 aa, Mycobacterium
RPKISRLQAFWELPGMVGQFLRS

SEQ ID NO: 1246897 - protein, 19 aa, Mycobacterium
RPKRYEFIDELPKNSYGKV

SEQ ID NO: 1246898 - protein, 31 aa, Mycobacterium
RPLDGFPDKRVRLMLEMHLLAPLHLSQLAIP

SEQ ID NO: 1246899 - protein, 19 aa, Mycobacterium
RPLEILGATVLPLQPVLEA

SEQ ID NO: 1246900 - protein, 21 aa, Mycobacterium
RPLFLKLLLMLVLERGDGDPG

SEQ ID NO: 1246901 - protein, 24 aa, Mycobacterium
RPLGPNVCAFIGHSDMRTAVMGLD

SEQ ID NO: 1246902 - protein, 24 aa, Mycobacterium
RPLPHPRTGVLTDFLFTRHGRRLG

SEQ ID NO: 1246903 - protein, 23 aa, Mycobacterium
RPLSLGRLDRGWVVASETAALDI

SEQ ID NO: 1246904 - protein, 21 aa, Mycobacterium
RPMWEHDLADGLRIVRLGLET

SEQ ID NO: 1246905 - protein, 21 aa, Mycobacterium
RPNLPPGFDFTDPDIYAERLP

SEQ ID NO: 1246906 - protein, 34 aa, Mycobacterium
RPPAPLHVVRLLAMLPLAPLVPFAHDGVISSLRC

SEQ ID NO: 1246907 - protein, 24 aa, Mycobacterium
RPPRQMPGTSYWYVHADQWRYDGY

SEQ ID NO: 1246908 - protein, 20 aa, Mycobacterium
RPPVAAVRHFQVWANLGATR

SEQ ID NO: 1246909 - protein, 24 aa, Mycobacterium
RPQARNALSKALREAFFTALRNAE

SEQ ID NO: 1246910 - protein, 19 aa, Mycobacterium
RPQAVLRSGGRISLGTDWP

SEQ ID NO: 1246911 - protein, 24 aa, Mycobacterium
RPQGHPPLVLWAVGPVGMDEVAER

SEQ ID NO: 1246912 - protein, 18 aa, Mycobacterium
RPQGLVVADGVLYIVDAG

SEQ ID NO: 1246913 - protein, 20 aa, Mycobacterium
RPQVLIRIGLAPAIEQVPPP

SEQ ID NO: 1246914 - protein, 28 aa, Mycobacterium
RPRGFVMFRCERDVWLVAAGTLGPIRPP

SEQ ID NO: 1246915 - protein, 26 aa, Mycobacterium
RPRHLRCWHPGFGMVLSGDAARPYLA

SEQ ID NO: 1246916 - protein, 18 aa, Mycobacterium
RPRPARLIPGDRPDGVYT

SEQ ID NO: 1246917 - protein, 19 aa, Mycobacterium
RPSERWGSEVVAVVQLAEG

SEQ ID NO: 1246918 - protein, 19 aa, Mycobacterium
RPSGDRAYVAHAFPFPNRE

SEQ ID NO: 1246919 - protein, 35 aa, Mycobacterium
RPSWMPVGPGTYGRFLAIRVFDFWVHERDITTPLG

SEQ ID NO: 1246920 - protein, 25 aa, Mycobacterium
RPSYLPVPLARRGRRFPTSNSLPSG

SEQ ID NO: 1246921 - protein, 31 aa, Mycobacterium
RPSYTLDEIRHWLQVFAQRFYSFSQFKRSAL

SEQ ID NO: 1246922 - protein, 21 aa, Mycobacterium
RPTHEHPLVWTHRSGRKSLVL

SEQ ID NO: 1246923 - protein, 18 aa, Mycobacterium
RPTIERAVRHAGGGTPVD

SEQ ID NO: 1246924 - protein, 19 aa, Mycobacterium
RPTIVMPGTGGTVAGTAVN

SEQ ID NO: 1246925 - protein, 17 aa, Mycobacterium
RPTIYRPPARPDVIAAL

SEQ ID NO: 1246926 - protein, 20 aa, Mycobacterium
RPTLAGAVPTIWNDVDRYLD

SEQ ID NO: 1246927 - protein, 17 aa, Mycobacterium
RPTPELLDIVSRDNRHI

SEQ ID NO: 1246928 - protein, 20 aa, Mycobacterium
RPTRTELGTYVFFLDCVGHL

SEQ ID NO: 1246929 - protein, 20 aa, Mycobacterium
RPTVHADLRPAWAEHDLTGL

SEQ ID NO: 1246930 - protein, 20 aa, Mycobacterium
RPVIDAVAARAPRGYGRGSH

SEQ ID NO: 1246931 - protein, 26 aa, Mycobacterium
RPVMPPQILHMILPRSDYEIVDDSWD

SEQ ID NO: 1246932 - protein, 25 aa, Mycobacterium
RPVRVEIAFMFAHPLGGLIEASEEM

SEQ ID NO: 1246933 - protein, 31 aa, Mycobacterium
RPVSESAWWIADLMRTRGIDVATVYELGDVL

SEQ ID NO: 1246934 - protein, 17 aa, Mycobacterium
RPVVFLCRSGNRSIGAA

SEQ ID NO: 1246935 - protein, 17 aa, Mycobacterium
RPVYLPVAEDIPAGRTD

SEQ ID NO: 1246936 - protein, 23 aa, Mycobacterium
RPWREVFDGADGVRVKHCADGGV

SEQ ID NO: 1246937 - protein, 18 aa, Mycobacterium
RPYLVEGVGEDFWPSAYD

SEQ ID NO: 1246938 - protein, 23 aa, Mycobacterium
RPYSGAVCQYVLMRGEVMVDVTF

SEQ ID NO: 1246939 - protein, 25 aa, Mycobacterium
RQGALPPGIAVQGQRGGPAHPGTGQ

SEQ ID NO: 1246940 - protein, 26 aa, Mycobacterium
RQGKLLASRLLHWARSGHLTVPRSTD

SEQ ID NO: 1246941 - protein, 17 aa, Mycobacterium
RQGMDLFETPPVATAGH

SEQ ID NO: 1246942 - protein, 18 aa, Mycobacterium
RQHDIFLSSMGGRPFGSD

SEQ ID NO: 1246943 - protein, 26 aa, Mycobacterium
RQHIAFCRAADGVRLAYAVSGEGPPL

SEQ ID NO: 1246944 - protein, 30 aa, Mycobacterium
RQHKEWLEKLAESYEFLGTEAIDMADAHDK

SEQ ID NO: 1246945 - protein, 23 aa, Mycobacterium
RQIIDRLVDWVAFTPLQNATGDP

SEQ ID NO: 1246946 - protein, 19 aa, Mycobacterium
RQKGLRAVSPLAVQMYMPN

SEQ ID NO: 1246947 - protein, 17 aa, Mycobacterium
RQKLSPEEFAVLRRAGT

SEQ ID NO: 1246948 - protein, 18 aa, Mycobacterium
RQLASGLSMPVGFKNGTD

SEQ ID NO: 1246949 - protein, 27 aa, Mycobacterium
RQLLLRPRYAGLRVYRGKVVGKGDWEP

SEQ ID NO: 1246950 - protein, 25 aa, Mycobacterium
RQMDIPPKLAIPMRVIASVVAISCQ

SEQ ID NO: 1246951 - protein, 20 aa, Mycobacterium
RQPPDISHLEAIFRSHIHAF

SEQ ID NO: 1246952 - protein, 17 aa, Mycobacterium
RQPPSYRELFGVQPNQQ

SEQ ID NO: 1246953 - protein, 21 aa, Mycobacterium
RQPRSLRVCTLLRKPDAVRAD

SEQ ID NO: 1246954 - protein, 25 aa, Mycobacterium
RQPVTRARVSAVRGVNVDAVMRTLL

SEQ ID NO: 1246955 - protein, 18 aa, Mycobacterium
RQPVTVLLKALGWTNEQI

SEQ ID NO: 1246956 - protein, 24 aa, Mycobacterium
RQQPGDGFVPFIIPINDRTLEDTR

SEQ ID NO: 1246957 - protein, 23 aa, Mycobacterium
RQRAEARAGIGLPAEDPGPLRRL

SEQ ID NO: 1246958 - protein, 25 aa, Mycobacterium
RQRFSSAILPAWARKSPQISEVLPL

SEQ ID NO: 1246959 - protein, 19 aa, Mycobacterium
RQRGLRVAVLAVDPSSPYS

SEQ ID NO: 1246960 - protein, 25 aa, Mycobacterium
RQRGMLRPLRCAELSDGTLRFLLWT

SEQ ID NO: 1246961 - protein, 20 aa, Mycobacterium
RQRIEDIVSIALQEDVAVVG

SEQ ID NO: 1246962 - protein, 22 aa, Mycobacterium
RQRLRAAVQAFFDFIEHDSQGY

SEQ ID NO: 1246963 - protein, 18 aa, Mycobacterium
RQRPRTHFTVGIDDDVSH

SEQ ID NO: 1246964 - protein, 19 aa, Mycobacterium
RQRVAVVRALRNALERRGF

SEQ ID NO: 1246965 - protein, 23 aa, Mycobacterium
RQSRDLASIIAFGAPVDTLAALP

SEQ ID NO: 1246966 - protein, 19 aa, Mycobacterium
RQTLRTAELVDWWSDPGGV

SEQ ID NO: 1246967 - protein, 24 aa, Mycobacterium
RQTLWPERLFSILAGFVEAGESFE

SEQ ID NO: 1246968 - protein, 18 aa, Mycobacterium
RQVRARRALARATADLPL

SEQ ID NO: 1246969 - protein, 25 aa, Mycobacterium
RRAAGLPATAINWGFWKSLADNESD

SEQ ID NO: 1246970 - protein, 23 aa, Mycobacterium
RRADPELRWRTDVLAMLVRSAGE

SEQ ID NO: 1246971 - protein, 17 aa, Mycobacterium
RRAERREQLLARVGLEG

SEQ ID NO: 1246972 - protein, 18 aa, Mycobacterium
RRAGIGLAVVAADRAHVV

SEQ ID NO: 1246973 - protein, 19 aa, Mycobacterium
RRAGVTVRYFYECFTDKDD

SEQ ID NO: 1246974 - protein, 23 aa, Mycobacterium
RRAIHFQEWWVRYRAKVPTHSFA

SEQ ID NO: 1246975 - protein, 18 aa, Mycobacterium
RRALARATADLPLGAAGR

SEQ ID NO: 1246976 - protein, 21 aa, Mycobacterium
RRALTDGGFCYGYHGDLDLLG

SEQ ID NO: 1246977 - protein, 25 aa, Mycobacterium
RRARGATPRCRVCNQVLTTPAAIML

SEQ ID NO: 1246978 - protein, 17 aa, Mycobacterium
RRARNRIIADHGASTVL

SEQ ID NO: 1246979 - protein, 20 aa, Mycobacterium
RRARSVPVYAAIRSLGRTGV

SEQ ID NO: 1246980 - protein, 18 aa, Mycobacterium
RRARVMMRFIELVNQHMD

SEQ ID NO: 1246981 - protein, 18 aa, Mycobacterium
RRARWLVRVLTSLLLFPG

SEQ ID NO: 1246982 - protein, 33 aa, Mycobacterium
RRAVFTRYELVDGFPRFDVDDVFLGNGASELIQ

SEQ ID NO: 1246983 - protein, 26 aa, Mycobacterium
RRAVILGTGGFEWDRALVEAFLRGPM

SEQ ID NO: 1246984 - protein, 38 aa, Mycobacterium
RRAVPGLRWPWHARLGTAAVCWRLRRRHGLPVHDIAPM

SEQ ID NO: 1246985 - protein, 17 aa, Mycobacterium
RRAVREIASELVALYAK

SEQ ID NO: 1246986 - protein, 18 aa, Mycobacterium
RRAYSGLAELGIFGVAIP

SEQ ID NO: 1246987 - protein, 24 aa, Mycobacterium
RRCPHGKQLWCSMSHDHGDERVGQ

SEQ ID NO: 1246988 - protein, 26 aa, Mycobacterium
RRDAPALDFFPGMAVPAREKYAFMQW

SEQ ID NO: 1246989 - protein, 19 aa, Mycobacterium
RRDDGVLVCVAQVRPNTAA

SEQ ID NO: 1246990 - protein, 19 aa, Mycobacterium
RRDEGAWSIPKGEYAPDED

SEQ ID NO: 1246991 - protein, 30 aa, Mycobacterium
RRDKLGGTWDLFKYPGIRSDSDMYTLGFHF

SEQ ID NO: 1246992 - protein, 18 aa, Mycobacterium
RRDLPLIAEAARRVPVSV

SEQ ID NO: 1246993 - protein, 19 aa, Mycobacterium
RRDLRRYSEHLTGRGVEDL

SEQ ID NO: 1246994 - protein, 23 aa, Mycobacterium
RRDPNNLLAMLWTWQNGNVGATP

SEQ ID NO: 1246995 - protein, 19 aa, Mycobacterium
RRDRITAAYPGYPSSSACM

SEQ ID NO: 1246996 - protein, 25 aa, Mycobacterium
RREEARMAADFTRFLGGAHDLATAL

SEQ ID NO: 1246997 - protein, 26 aa, Mycobacterium
RREELGFTRRRLSAEGVIDPQTLADF

SEQ ID NO: 1246998 - protein, 17 aa, Mycobacterium
RREELLVYLNVVAGAGN

SEQ ID NO: 1246999 - protein, 27 aa, Mycobacterium
RREFDILAFERQWWKYAGSKEDAIKEL

SEQ ID NO: 1247000 - protein, 28 aa, Mycobacterium
RREISADFLQLWERLRTTVIFVTHDVDE

SEQ ID NO: 1247001 - protein, 22 aa, Mycobacterium
RRELPDSPYLAAARGRKPARVP

SEQ ID NO: 1247002 - protein, 19 aa, Mycobacterium
RREMVCLSRGDSDMWDDEA

SEQ ID NO: 1247003 - protein, 27 aa, Mycobacterium
RREPEWCAGLLSATRRSSEFAAAPPQG

SEQ ID NO: 1247004 - protein, 27 aa, Mycobacterium
RRERCAAGLDLVHTVMPEFRRMHDMTV

SEQ ID NO: 1247005 - protein, 24 aa, Mycobacterium
RRERIYCPGWVGLIRWAKPILTTR

SEQ ID NO: 1247006 - protein, 17 aa, Mycobacterium
RRFDPEATLALVDEHKA

SEQ ID NO: 1247007 - protein, 20 aa, Mycobacterium
RRFFEGKPIRSADQVRDIAW

SEQ ID NO: 1247008 - protein, 21 aa, Mycobacterium
RRFPDAAVIRLERDYRSTPQV

SEQ ID NO: 1247009 - protein, 22 aa, Mycobacterium
RRFRHAVKFRRWRPDRDPASCT

SEQ ID NO: 1247010 - protein, 19 aa, Mycobacterium
RRFSPEMRLSMTSALEHYT

SEQ ID NO: 1247011 - protein, 17 aa, Mycobacterium
RRGARRALITLCVGGGM

SEQ ID NO: 1247012 - protein, 23 aa, Mycobacterium
RRGDGWVKLVGDWIDRSIGDLAP

SEQ ID NO: 1247013 - protein, 17 aa, Mycobacterium
RRGDLVVGWASGFDGLM

SEQ ID NO: 1247014 - protein, 21 aa, Mycobacterium
RRGELPWTRLDDLHRMTLVDL

SEQ ID NO: 1247015 - protein, 19 aa, Mycobacterium
RRGFAALRRPVRRPLDEGV

SEQ ID NO: 1247016 - protein, 18 aa, Mycobacterium
RRGHPLSYAFRPEAVGGL

SEQ ID NO: 1247017 - protein, 22 aa, Mycobacterium
RRGNWSLDLGYFLQGALTIEDR

SEQ ID NO: 1247018 - protein, 17 aa, Mycobacterium
RRGRATGPTRGRGAIDR

SEQ ID NO: 1247019 - protein, 19 aa, Mycobacterium
RRGREMRGPLLPPTVPGWR

SEQ ID NO: 1247020 - protein, 22 aa, Mycobacterium
RRGRQGAYLNGWDPLLQDGLPD

SEQ ID NO: 1247021 - protein, 18 aa, Mycobacterium
RRGTGCVCLTIGASTDVA

SEQ ID NO: 1247022 - protein, 26 aa, Mycobacterium
RRGTLGLRLGDRIQITPPLGSALAAW

SEQ ID NO: 1247023 - protein, 20 aa, Mycobacterium
RRGVRVYPRTGAPLTADAAV

SEQ ID NO: 1247024 - protein, 20 aa, Mycobacterium
RRGWADRVRLAHALGPTMIA

SEQ ID NO: 1247025 - protein, 37 aa, Mycobacterium
RRGYLPALACARCRAIARCRHCTGPLSLLERGGAAMC

SEQ ID NO: 1247026 - protein, 24 aa, Mycobacterium
RRHELLSGLVPQISIILGKCAGGA

SEQ ID NO: 1247027 - protein, 21 aa, Mycobacterium
RRHEPEVFDRATGWYGSNSYI

SEQ ID NO: 1247028 - protein, 20 aa, Mycobacterium
RRIATAFPNLVRKDLAGRGI

SEQ ID NO: 1247029 - protein, 19 aa, Mycobacterium
RRIEEEVIRSALQTHDGVL

SEQ ID NO: 1247030 - protein, 17 aa, Mycobacterium
RRIMIGTYALSAGYYDA

SEQ ID NO: 1247031 - protein, 22 aa, Mycobacterium
RRIPTMRLGIPFDEVPFKHDRL

SEQ ID NO: 1247032 - protein, 19 aa, Mycobacterium
RRITEGAAMIRSKGEAGTG

SEQ ID NO: 1247033 - protein, 20 aa, Mycobacterium
RRKPEAAARLEAARAGLSAL

SEQ ID NO: 1247034 - protein, 24 aa, Mycobacterium
RRKVRRLLGERVVRITVKPFMDMS

SEQ ID NO: 1247035 - protein, 20 aa, Mycobacterium
RRLAALGWIVVRVIAEDDEA

SEQ ID NO: 1247036 - protein, 17 aa, Mycobacterium
RRLAARGDMVVVTVNYR

SEQ ID NO: 1247037 - protein, 20 aa, Mycobacterium
RRLAERPANMAFFLRALAGR

SEQ ID NO: 1247038 - protein, 34 aa, Mycobacterium
RRLAIPELPEELFLESLRQLIAIDEQWVPPAGGE

SEQ ID NO: 1247039 - protein, 18 aa, Mycobacterium
RRLANFLLANGIGAHQER

SEQ ID NO: 1247040 - protein, 20 aa, Mycobacterium
RRLAREEGLLVGGSCGMAVV

SEQ ID NO: 1247041 - protein, 18 aa, Mycobacterium
RRLARLHTPLPVLAFTAL

SEQ ID NO: 1247042 - protein, 19 aa, Mycobacterium
RRLDAVAINAGIGRAGRFV

SEQ ID NO: 1247043 - protein, 20 aa, Mycobacterium
RRLEEHVGLFRDYLRANSKD

SEQ ID NO: 1247044 - protein, 23 aa, Mycobacterium
RRLFAGGGFGRGRFNGGGGGFGG

SEQ ID NO: 1247045 - protein, 17 aa, Mycobacterium
RRLGFDVSSVDAAYAAV

SEQ ID NO: 1247046 - protein, 22 aa, Mycobacterium
RRLGFHCGIVSGGFRQVIEPLA

SEQ ID NO: 1247047 - protein, 19 aa, Mycobacterium
RRLGLPLAQELSAYLRTLA

SEQ ID NO: 1247048 - protein, 19 aa, Mycobacterium
RRLKGAVVANQLARLGGFQ

SEQ ID NO: 1247049 - protein, 22 aa, Mycobacterium
RRLMAEPVALVFAARNEGADAL

SEQ ID NO: 1247050 - protein, 19 aa, Mycobacterium
RRLPDHIELALYRIAQECL

SEQ ID NO: 1247051 - protein, 19 aa, Mycobacterium
RRLPDSAVMPIHDVADRAE

SEQ ID NO: 1247052 - protein, 23 aa, Mycobacterium
RRLPRPRALATLDAAVHSTWCDT

SEQ ID NO: 1247053 - protein, 18 aa, Mycobacterium
RRLREFAEFADFSDDDLR

SEQ ID NO: 1247054 - protein, 20 aa, Mycobacterium
RRLRSGPMGESFTLYHPAKD

SEQ ID NO: 1247055 - protein, 26 aa, Mycobacterium
RRLRSKARLKFLIKDWGVEKFRQVLE

SEQ ID NO: 1247056 - protein, 17 aa, Mycobacterium
RRLSKFWLTGPQAGTIT

SEQ ID NO: 1247057 - protein, 19 aa, Mycobacterium
RRLSPLLRGLSDREEADAP

SEQ ID NO: 1247058 - protein, 34 aa, Mycobacterium
RRLTLIAFEAMNHWKSDGGFGLHVFHKNNELAGY

SEQ ID NO: 1247059 - protein, 23 aa, Mycobacterium
RRLTSELPLPVNAIGIPDQDDPA

SEQ ID NO: 1247060 - protein, 25 aa, Mycobacterium
RRLVRWPRQVLAEFGLYLPDDVEVR

SEQ ID NO: 1247061 - protein, 24 aa, Mycobacterium
RRLWAMGFPFHARRRFTGVQLEAT

SEQ ID NO: 1247062 - protein, 18 aa, Mycobacterium
RRMLFLVSATDAYPERLI

SEQ ID NO: 1247063 - protein, 29 aa, Mycobacterium
RRMRAARTWIREQCSFLPTRIDPPNEILE

SEQ ID NO: 1247064 - protein, 19 aa, Mycobacterium
RRMRIKDSFELAWSDWQGS

SEQ ID NO: 1247065 - protein, 22 aa, Mycobacterium
RRNGNAQTRGWAVPHLATDGAD

SEQ ID NO: 1247066 - protein, 21 aa, Mycobacterium
RRNGWKGFGPVPYRHEPNRGF

SEQ ID NO: 1247067 - protein, 25 aa, Mycobacterium
RRNLAWKAAELMAEHVGRSPDVAIS

SEQ ID NO: 1247068 - protein, 27 aa, Mycobacterium
RRNLENLDWLGVKARAHDAVVSTLARS

SEQ ID NO: 1247069 - protein, 20 aa, Mycobacterium
RRPAAGVSRIGPVYTAPEVR

SEQ ID NO: 1247070 - protein, 18 aa, Mycobacterium
RRPADTFVARALGQPEIN

SEQ ID NO: 1247071 - protein, 19 aa, Mycobacterium
RRPAHPFAPLGERSVARGY

SEQ ID NO: 1247072 - protein, 17 aa, Mycobacterium
RRPALPTVLGPHDVAGR

SEQ ID NO: 1247073 - protein, 21 aa, Mycobacterium
RRPAVPPVWGTLMLVDPDADI

SEQ ID NO: 1247074 - protein, 22 aa, Mycobacterium
RRPDGARWCAFLGTAAEYADPP

SEQ ID NO: 1247075 - protein, 22 aa, Mycobacterium
RRPSLVPVEAIGLLAGDLQYTE

SEQ ID NO: 1247076 - protein, 31 aa, Mycobacterium
RRQGLKISVPEEVAWRVGFIDDEQLAARGHS

SEQ ID NO: 1247077 - protein, 27 aa, Mycobacterium
RRQRSWFRRDHRVCWLDGGSPDNVDRT

SEQ ID NO: 1247078 - protein, 24 aa, Mycobacterium
RRRAIPIVLRPVVLAKLMAGHTTL

SEQ ID NO: 1247079 - protein, 25 aa, Mycobacterium
RRRAQQVEWTWSMVRDAVLDRVLNN

SEQ ID NO: 1247080 - protein, 18 aa, Mycobacterium
RRRAQRRLPDSAVMPIHD

SEQ ID NO: 1247081 - protein, 17 aa, Mycobacterium
RRRFRHILVDEYQDTNH

SEQ ID NO: 1247082 - protein, 17 aa, Mycobacterium
RRRLATIEHAAEQFSQA

SEQ ID NO: 1247083 - protein, 19 aa, Mycobacterium
RRRLLELSGKLGTFDRPVL

SEQ ID NO: 1247084 - protein, 19 aa, Mycobacterium
RRRLLKYVAQVDVERYRSL

SEQ ID NO: 1247085 - protein, 19 aa, Mycobacterium
RRRNYVYEPTFLLRGLTSL

SEQ ID NO: 1247086 - protein, 21 aa, Mycobacterium
RRRRELLKRNNLDGTLQEIKK

SEQ ID NO: 1247087 - protein, 18 aa, Mycobacterium
RRRRPPWRRDAAKDQQES

SEQ ID NO: 1247088 - protein, 19 aa, Mycobacterium
RRRTRCYSPASAEGAALIE

SEQ ID NO: 1247089 - protein, 26 aa, Mycobacterium
RRSAEVARWLLGRGVGKGVRVGLFFP

SEQ ID NO: 1247090 - protein, 21 aa, Mycobacterium
RRSAGAIGFLVTVRSGAGDHT

SEQ ID NO: 1247091 - protein, 19 aa, Mycobacterium
RRSALPNITRLLPVARAAG

SEQ ID NO: 1247092 - protein, 17 aa, Mycobacterium
RRSGRIGATSSWLGTAL

SEQ ID NO: 1247093 - protein, 17 aa, Mycobacterium
RRSIPLTEWPDGRTTLA

SEQ ID NO: 1247094 - protein, 25 aa, Mycobacterium
RRSKFPQRWWWVVLTDEPFPRFSVV

SEQ ID NO: 1247095 - protein, 18 aa, Mycobacterium
RRSRASAADGDWAVTSVG

SEQ ID NO: 1247096 - protein, 23 aa, Mycobacterium
RRSTEFRLRMARRRNHRRLRRSH

SEQ ID NO: 1247097 - protein, 21 aa, Mycobacterium
RRTAPERWKPLTGISGPATLP

SEQ ID NO: 1247098 - protein, 18 aa, Mycobacterium
RRTAQLADRYPDVRTKVV

SEQ ID NO: 1247099 - protein, 17 aa, Mycobacterium
RRTEVALDAGASRRLTE

SEQ ID NO: 1247100 - protein, 21 aa, Mycobacterium
RRTLDGWQEWAKQRGAKGLAY

SEQ ID NO: 1247101 - protein, 18 aa, Mycobacterium
RRTLRAGFTTVRNLGLFV

SEQ ID NO: 1247102 - protein, 25 aa, Mycobacterium
RRTPRLTGTITMRYLRTTRLGRLHA

SEQ ID NO: 1247103 - protein, 25 aa, Mycobacterium
RRTSAVKTFTAWAVRRGLMASDPAT

SEQ ID NO: 1247104 - protein, 17 aa, Mycobacterium
RRTTVRFADEGAVRRLA

SEQ ID NO: 1247105 - protein, 19 aa, Mycobacterium
RRTTWNSGCSSWYLTEDGY

SEQ ID NO: 1247106 - protein, 17 aa, Mycobacterium
RRTVLKASKGYRGQRSR

SEQ ID NO: 1247107 - protein, 19 aa, Mycobacterium
RRTVRMRVVGDIIGMLTTV

SEQ ID NO: 1247108 - protein, 20 aa, Mycobacterium
RRVAEKMILDGRVEVDGHIV

SEQ ID NO: 1247109 - protein, 17 aa, Mycobacterium
RRVAFDVLRAVSERDAY

SEQ ID NO: 1247110 - protein, 20 aa, Mycobacterium
RRVDELLEVVRLTDFAKRKP

SEQ ID NO: 1247111 - protein, 22 aa, Mycobacterium
RRVDPEYDRHGGFPVFEAAEPG

SEQ ID NO: 1247112 - protein, 19 aa, Mycobacterium
RRVEELPRVLAHVHRELVS

SEQ ID NO: 1247113 - protein, 21 aa, Mycobacterium
RRVGEHLVCTVFDLMLAQYGV

SEQ ID NO: 1247114 - protein, 21 aa, Mycobacterium
RRVSGELYGSFLPGTQENLQR

SEQ ID NO: 1247115 - protein, 21 aa, Mycobacterium
RRVTFGDVWALLVDGRFGDGL

SEQ ID NO: 1247116 - protein, 22 aa, Mycobacterium
RRVVDVCLAGAFLVIQHAGRHL

SEQ ID NO: 1247117 - protein, 30 aa, Mycobacterium
RRWCSGTSNRWCEMRVRIDGRKGGLMESEA

SEQ ID NO: 1247118 - protein, 20 aa, Mycobacterium
RRWMAAAALVRSRADGGVVT

SEQ ID NO: 1247119 - protein, 30 aa, Mycobacterium
RRWRDIWLHEGFACYAEWLWSENSGGRSAD

SEQ ID NO: 1247120 - protein, 25 aa, Mycobacterium
RRYGIPWELFDDFLASMRMDLTVTD

SEQ ID NO: 1247121 - protein, 17 aa, Mycobacterium
RRYGVVAGTARLVEALR

SEQ ID NO: 1247122 - protein, 20 aa, Mycobacterium
RRYLVQTSRIAYVEIGAADV

SEQ ID NO: 1247123 - protein, 19 aa, Mycobacterium
RRYPFGAPLAGYGALPEGQ

SEQ ID NO: 1247124 - protein, 38 aa, Mycobacterium
RRYPFNSAVDLLRFTPLRFTQRIRFGAVSLLLRRLGRG

SEQ ID NO: 1247125 - protein, 17 aa, Mycobacterium
RRYPPVLITTSTRDDRV

SEQ ID NO: 1247126 - protein, 19 aa, Mycobacterium
RRYTLGGGVLKLVTYSPPP

SEQ ID NO: 1247127 - protein, 25 aa, Mycobacterium
RRYVAKYTICPAVAHGLDGEIGSVE

SEQ ID NO: 1247128 - protein, 22 aa, Mycobacterium
RRYVLAEARLAAYAREIGEEPE

SEQ ID NO: 1247129 - protein, 22 aa, Mycobacterium
RRYVYEPTFILRGLTEINIEFK

SEQ ID NO: 1247130 - protein, 24 aa, Mycobacterium
RSAVPRGSAFIVVHRLDNLRRSGR

SEQ ID NO: 1247131 - protein, 25 aa, Mycobacterium
RSDEIKRYLDLEGVALHALGDAGVD

SEQ ID NO: 1247132 - protein, 25 aa, Mycobacterium
RSDGLWKPSPGSVYPTLQLLVDEGL

SEQ ID NO: 1247133 - protein, 25 aa, Mycobacterium
RSDGWLCPYGPLAVGAAALPGTPPA

SEQ ID NO: 1247134 - protein, 20 aa, Mycobacterium
RSDLLRSARFAADQTGAADG

SEQ ID NO: 1247135 - protein, 39 aa, Mycobacterium
RSDRVLEGRWWRRDLGGKMVRFVVCRKGDRHVVAARDDE

SEQ ID NO: 1247136 - protein, 21 aa, Mycobacterium
RSEGDAFGRLILLHDPEGAEA

SEQ ID NO: 1247137 - protein, 18 aa, Mycobacterium
RSEIYRIITEFAGQGMAV

SEQ ID NO: 1247138 - protein, 25 aa, Mycobacterium
RSEPELDQLVGFFINILVLRNDLRG

SEQ ID NO: 1247139 - protein, 27 aa, Mycobacterium
RSEVLRPGTRISLMAAEMLASRPDGSH

SEQ ID NO: 1247140 - protein, 24 aa, Mycobacterium
RSEYDLPGSPAFVLVNNPTRIPLS

SEQ ID NO: 1247141 - protein, 17 aa, Mycobacterium
RSEYRLEKVTARRHLVA

SEQ ID NO: 1247142 - protein, 23 aa, Mycobacterium
RSFAEIRTAAGITAPLTDVPAAL

SEQ ID NO: 1247143 - protein, 25 aa, Mycobacterium
RSFDPCLPCGVHMYLGGGKSLELLH

SEQ ID NO: 1247144 - protein, 27 aa, Mycobacterium
RSFRRYRWVLPMARLIGNAARMSADQH

SEQ ID NO: 1247145 - protein, 19 aa, Mycobacterium
RSGASWTDIGKCMGVTKQA

SEQ ID NO: 1247146 - protein, 22 aa, Mycobacterium
RSGDIFLITGIGYYPNLGVKDA

SEQ ID NO: 1247147 - protein, 20 aa, Mycobacterium
RSGEAMSAVLLEATMAGLAT

SEQ ID NO: 1247148 - protein, 24 aa, Mycobacterium
RSGEFRPDLTAAWLTEALYSLVAG

SEQ ID NO: 1247149 - protein, 18 aa, Mycobacterium
RSGGLLFLGSSRLGGLVT

SEQ ID NO: 1247150 - protein, 19 aa, Mycobacterium
RSGLRTVCLEAKRYAGGMA

SEQ ID NO: 1247151 - protein, 23 aa, Mycobacterium
RSGQLPRTVIWVAGRGTAETAGA

SEQ ID NO: 1247152 - protein, 20 aa, Mycobacterium
RSGREVLYRLVDAHLVHIVT

SEQ ID NO: 1247153 - protein, 18 aa, Mycobacterium
RSGYRVERTMTVLISDIR

SEQ ID NO: 1247154 - protein, 35 aa, Mycobacterium
RSKGDSADGVWSRLKFEGGVHRVQRVPVTESQGRV

SEQ ID NO: 1247155 - protein, 21 aa, Mycobacterium
RSKGIRVIVDFVMNHTSDAHP

SEQ ID NO: 1247156 - protein, 24 aa, Mycobacterium
RSKPRCKRCPLVVHKVLKAEHMGI

SEQ ID NO: 1247157 - protein, 17 aa, Mycobacterium
RSLCDRGALLLGGKAIA

SEQ ID NO: 1247158 - protein, 17 aa, Mycobacterium
RSLDCADELAGVAEIYR

SEQ ID NO: 1247159 - protein, 22 aa, Mycobacterium
RSLDEMYACAATPFERAAITDM

SEQ ID NO: 1247160 - protein, 25 aa, Mycobacterium
RSLDEPHLRLLFDHETEHGNRIPVL

SEQ ID NO: 1247161 - protein, 21 aa, Mycobacterium
RSLEAAGILAALRAHFTLVPD

SEQ ID NO: 1247162 - protein, 19 aa, Mycobacterium
RSLHEPEILAVKRDAAQRL

SEQ ID NO: 1247163 - protein, 19 aa, Mycobacterium
RSLIPVFIEECLRMDSPVK

SEQ ID NO: 1247164 - protein, 17 aa, Mycobacterium
RSLITGGFRVRFAEPGE

SEQ ID NO: 1247165 - protein, 18 aa, Mycobacterium
RSLLAAKAYGRMALDSVY

SEQ ID NO: 1247166 - protein, 19 aa, Mycobacterium
RSLLPAGITGVSGRFYGGD

SEQ ID NO: 1247167 - protein, 18 aa, Mycobacterium
RSLPELEYPLATAEELDE

SEQ ID NO: 1247168 - protein, 23 aa, Mycobacterium
RSLPRAGAPLARALTAAGVPVDL

SEQ ID NO: 1247169 - protein, 17 aa, Mycobacterium
RSLPSYRSVLAEYTGAV

SEQ ID NO: 1247170 - protein, 21 aa, Mycobacterium
RSLTFYRDLLGLLPVAELPGS

SEQ ID NO: 1247171 - protein, 18 aa, Mycobacterium
RSLYRFSRTPMFTADALR

SEQ ID NO: 1247172 - protein, 24 aa, Mycobacterium
RSPDEFSGKILAPAHLPQEQSQRA

SEQ ID NO: 1247173 - protein, 17 aa, Mycobacterium
RSPFVTAATAWELQEAT

SEQ ID NO: 1247174 - protein, 17 aa, Mycobacterium
RSPGGAGIRLDGGTVLG

SEQ ID NO: 1247175 - protein, 18 aa, Mycobacterium
RSPLRAVVRLGRAEDEEL

SEQ ID NO: 1247176 - protein, 19 aa, Mycobacterium
RSRANAVASARHWLDEVGA

SEQ ID NO: 1247177 - protein, 22 aa, Mycobacterium
RSRGRGIPLMRALSDRVDIDKT

SEQ ID NO: 1247178 - protein, 23 aa, Mycobacterium
RSRPLYDYFVELFAQVTNPPLDA

SEQ ID NO: 1247179 - protein, 21 aa, Mycobacterium
RSRSDALAWSVRLVGQHADEW

SEQ ID NO: 1247180 - protein, 18 aa, Mycobacterium
RSRSHVVTFPHDLTDRAE

SEQ ID NO: 1247181 - protein, 18 aa, Mycobacterium
RSTTRLLDAEFPKFRQLL

SEQ ID NO: 1247182 - protein, 21 aa, Mycobacterium
RSVAALVAWKTGVSPANAKTI

SEQ ID NO: 1247183 - protein, 23 aa, Mycobacterium
RSVELRVAATLENLAVLRTLVAA

SEQ ID NO: 1247184 - protein, 19 aa, Mycobacterium
RSVGLSVWGTSAMRTSGDD

SEQ ID NO: 1247185 - protein, 22 aa, Mycobacterium
RSVHGGRIGFVFQDPGTSLNPL

SEQ ID NO: 1247186 - protein, 24 aa, Mycobacterium
RSVKGEVIASTFDRPPSDHTTVAE

SEQ ID NO: 1247187 - protein, 20 aa, Mycobacterium
RSVKVEALLQLAAYAEALTA

SEQ ID NO: 1247188 - protein, 17 aa, Mycobacterium
RSVPLRLVHATGVTPRV

SEQ ID NO: 1247189 - protein, 18 aa, Mycobacterium
RSVPPERIAELDVLATYL

SEQ ID NO: 1247190 - protein, 21 aa, Mycobacterium
RSVRLPLSWDDPATREAIARY

SEQ ID NO: 1247191 - protein, 18 aa, Mycobacterium
RSVYRLHPGDSLQIDGEG

SEQ ID NO: 1247192 - protein, 17 aa, Mycobacterium
RSWNCGVEGPTDDPDVI

SEQ ID NO: 1247193 - protein, 19 aa, Mycobacterium
RSWQKRRAIDLISPHGGVL

SEQ ID NO: 1247194 - protein, 25 aa, Mycobacterium
RSWVGLRTMRSYALATMDVEQPGQD

SEQ ID NO: 1247195 - protein, 19 aa, Mycobacterium
RSYDELARILNTFDTAFPD

SEQ ID NO: 1247196 - protein, 19 aa, Mycobacterium
RSYSDFCGHARSLDGRLAS

SEQ ID NO: 1247197 - protein, 18 aa, Mycobacterium
RSYVTRQARWVDFDNDYK

SEQ ID NO: 1247198 - protein, 17 aa, Mycobacterium
RTAAELQSWGQSWIAAC

SEQ ID NO: 1247199 - protein, 17 aa, Mycobacterium
RTAEHMRHIPATAAPAP

SEQ ID NO: 1247200 - protein, 21 aa, Mycobacterium
RTAFDNWGLVPRMFRATRERD

SEQ ID NO: 1247201 - protein, 20 aa, Mycobacterium
RTAHQRWLRQGMTMRATKLA

SEQ ID NO: 1247202 - protein, 24 aa, Mycobacterium
RTAIDRAKVLAGLEPDTDVRIVGY

SEQ ID NO: 1247203 - protein, 26 aa, Mycobacterium
RTAMMIRPQWRFRRGRAAAGGPGGRT

SEQ ID NO: 1247204 - protein, 33 aa, Mycobacterium
RTAMPGVAWPDQWSRAYFTPVTLIGGRAMLGKT

SEQ ID NO: 1247205 - protein, 19 aa, Mycobacterium
RTAQHWRVTDWSLSADTAR

SEQ ID NO: 1247206 - protein, 17 aa, Mycobacterium
RTARLLRHTNIVDDMVD

SEQ ID NO: 1247207 - protein, 22 aa, Mycobacterium
RTAVAHAAWRGELTVGEEDIRV

SEQ ID NO: 1247208 - protein, 18 aa, Mycobacterium
RTAYARQAAHDWHEFIAF

SEQ ID NO: 1247209 - protein, 23 aa, Mycobacterium
RTDPPPWRLVYGGRDRAAMAFLD

SEQ ID NO: 1247210 - protein, 20 aa, Mycobacterium
RTDQGLPLEGLRVLDLGVIV

SEQ ID NO: 1247211 - protein, 19 aa, Mycobacterium
RTDRLPMAAAPAWESFEQW

SEQ ID NO: 1247212 - protein, 26 aa, Mycobacterium
RTDTPRWRWFIARAVVGGEALYAGEV

SEQ ID NO: 1247213 - protein, 23 aa, Mycobacterium
RTEKSVLFVIPWGTHWIIGTTDT

SEQ ID NO: 1247214 - protein, 26 aa, Mycobacterium
RTELLRLQRRLGITSLYVTHDQEEAM

SEQ ID NO: 1247215 - protein, 27 aa, Mycobacterium
RTEYPRFLAELAESWRDPAAWTGMTRA

SEQ ID NO: 1247216 - protein, 21 aa, Mycobacterium
RTFATGRTRDIEWRKRQLRAL

SEQ ID NO: 1247217 - protein, 30 aa, Mycobacterium
RTFEAAVPPGRLGWNWAKFAFGSWTTLSWV

SEQ ID NO: 1247218 - protein, 18 aa, Mycobacterium
RTFLELGGKSALIVLDDA

SEQ ID NO: 1247219 - protein, 18 aa, Mycobacterium
RTFLQNHSGGLVVISHDV

SEQ ID NO: 1247220 - protein, 28 aa, Mycobacterium
RTGEGSRGISCFLIPGGQPGLSFGKPEE

SEQ ID NO: 1247221 - protein, 27 aa, Mycobacterium
RTGEVLSVPVGDGYLGRVVNPLGQPID

SEQ ID NO: 1247222 - protein, 17 aa, Mycobacterium
RTGPWPNMQARSRSRVL

SEQ ID NO: 1247223 - protein, 17 aa, Mycobacterium
RTGQGLDRLSARMSELV

SEQ ID NO: 1247224 - protein, 21 aa, Mycobacterium
RTGQVRWFGLDGVEHTGGPMV

SEQ ID NO: 1247225 - protein, 21 aa, Mycobacterium
RTGTFSINGGNYFSPDSPFGG

SEQ ID NO: 1247226 - protein, 20 aa, Mycobacterium
RTGTGRTRRHVVGRHTGTRR

SEQ ID NO: 1247227 - protein, 19 aa, Mycobacterium
RTHAARLVTHYGRPISDPH

SEQ ID NO: 1247228 - protein, 28 aa, Mycobacterium
RTHRAVVVDEAWKTGSLAAEISAQIVEN

SEQ ID NO: 1247229 - protein, 26 aa, Mycobacterium
RTHVVRRYGVEFAHPGPRLRDYVLAV

SEQ ID NO: 1247230 - protein, 17 aa, Mycobacterium
RTISGVYRDEAGKATNI

SEQ ID NO: 1247231 - protein, 17 aa, Mycobacterium
RTKDIRLGFGVMHLPPP

SEQ ID NO: 1247232 - protein, 28 aa, Mycobacterium
RTKFRKMAAEPFAFYRGSACLFYADVAA

SEQ ID NO: 1247233 - protein, 19 aa, Mycobacterium
RTKRCRIGSSILYGVGRSP

SEQ ID NO: 1247234 - protein, 20 aa, Mycobacterium
RTKYRSAEAIRRLATDPHSP

SEQ ID NO: 1247235 - protein, 17 aa, Mycobacterium
RTLAEIARHLGVAKATC

SEQ ID NO: 1247236 - protein, 22 aa, Mycobacterium
RTLEVLERFYSLVLTDCGTGLM

SEQ ID NO: 1247237 - protein, 29 aa, Mycobacterium
RTLLDTHPFAWLPMLSRVLASARLLPDAV

SEQ ID NO: 1247238 - protein, 19 aa, Mycobacterium
RTLLKVIVESAALLELGGR

SEQ ID NO: 1247239 - protein, 18 aa, Mycobacterium
RTLRLLVPGDGVPRVDAV

SEQ ID NO: 1247240 - protein, 22 aa, Mycobacterium
RTLRPGYHVELGVAPLERVQVV

SEQ ID NO: 1247241 - protein, 32 aa, Mycobacterium
RTLRRCGAPLLSLRTDRDWIADVVRFVASRRR

SEQ ID NO: 1247242 - protein, 17 aa, Mycobacterium
RTLSAGEALDWGLVTDV

SEQ ID NO: 1247243 - protein, 17 aa, Mycobacterium
RTPDRFVAGTVGQPGNR

SEQ ID NO: 1247244 - protein, 21 aa, Mycobacterium
RTPHIPIPYVYNVNLRALVEP

SEQ ID NO: 1247245 - protein, 24 aa, Mycobacterium
RTPIDVEVPFDMVIGETMVRGRID

SEQ ID NO: 1247246 - protein, 27 aa, Mycobacterium
RTPLLLLPIRIETRLTPGRTQLKVRIY

SEQ ID NO: 1247247 - protein, 18 aa, Mycobacterium
RTPPCVDALLAAEVSAVV

SEQ ID NO: 1247248 - protein, 26 aa, Mycobacterium
RTPRFMPMDLCKIDDHYVLTADLPGV

SEQ ID NO: 1247249 - protein, 17 aa, Mycobacterium
RTPRLARTRAWTTDVRS

SEQ ID NO: 1247250 - protein, 20 aa, Mycobacterium
RTQGPWKLIIAQHFASAEEL

SEQ ID NO: 1247251 - protein, 23 aa, Mycobacterium
RTQLEVILPYFLHYANDEQRKRW

SEQ ID NO: 1247252 - protein, 19 aa, Mycobacterium
RTQLPITTWQQHFADATTG

SEQ ID NO: 1247253 - protein, 30 aa, Mycobacterium
RTQRRLGRRSNIHVVEWAHVQGLTPSGLAM

SEQ ID NO: 1247254 - protein, 23 aa, Mycobacterium
RTRAVELLELVGIAQPERRARAF

SEQ ID NO: 1247255 - protein, 17 aa, Mycobacterium
RTRIPVVAAVNGPAVGL

SEQ ID NO: 1247256 - protein, 25 aa, Mycobacterium
RTRKYKGACIFLNRPGFAGGIGCAL

SEQ ID NO: 1247257 - protein, 17 aa, Mycobacterium
RTRPFRVNYGITERGVV

SEQ ID NO: 1247258 - protein, 18 aa, Mycobacterium
RTRPVAVRPLATLDAAAH

SEQ ID NO: 1247259 - protein, 18 aa, Mycobacterium
RTRQAWIEATRDIATELL

SEQ ID NO: 1247260 - protein, 19 aa, Mycobacterium
RTRRAVQGLNRLGDLEDVL

SEQ ID NO: 1247261 - protein, 23 aa, Mycobacterium
RTRRIASPAQRIMLIARDGGCTK

SEQ ID NO: 1247262 - protein, 26 aa, Mycobacterium
RTRRVSPENSWDCVQFVCAANDLGVY

SEQ ID NO: 1247263 - protein, 19 aa, Mycobacterium
RTRSGILTIEILDTTPDWD

SEQ ID NO: 1247264 - protein, 26 aa, Mycobacterium
RTSCLSCADLHRSDRDAAWPTLAAQL

SEQ ID NO: 1247265 - protein, 23 aa, Mycobacterium
RTSDLIPLCHQLALTGVDVDFEI

SEQ ID NO: 1247266 - protein, 24 aa, Mycobacterium
RTTAGDVRGRWIVNAAGLGADALD

SEQ ID NO: 1247267 - protein, 19 aa, Mycobacterium
RTTDEWLALFRELEIPAAP

SEQ ID NO: 1247268 - protein, 17 aa, Mycobacterium
RTVAIDLRDDWPRALRD

SEQ ID NO: 1247269 - protein, 18 aa, Mycobacterium
RTVLRSGCYLTHDDGLYA

SEQ ID NO: 1247270 - protein, 24 aa, Mycobacterium
RTVPEHPFMLFGQMTTADPTRSPE

SEQ ID NO: 1247271 - protein, 20 aa, Mycobacterium
RTVVPVRVFWVPAGLPTRSK

SEQ ID NO: 1247272 - protein, 23 aa, Mycobacterium
RTWFKRAVFYEVLVRAFHDSDAD

SEQ ID NO: 1247273 - protein, 19 aa, Mycobacterium
RTWLLIATGLLSFDEAAAS

SEQ ID NO: 1247274 - protein, 24 aa, Mycobacterium
RVAAAEHPHLWGGVLDITGDRLPV

SEQ ID NO: 1247275 - protein, 18 aa, Mycobacterium
RVAADLLGRGLTRDHHTS

SEQ ID NO: 1247276 - protein, 18 aa, Mycobacterium
RVAADVAGVVPRAHAALT

SEQ ID NO: 1247277 - protein, 19 aa, Mycobacterium
RVAAFAEQSMDMFWDHVDA

SEQ ID NO: 1247278 - protein, 19 aa, Mycobacterium
RVAAVASRGIVPVVLGGDH

SEQ ID NO: 1247279 - protein, 23 aa, Mycobacterium
RVADDLLALFAHALRLSHNPFER

SEQ ID NO: 1247280 - protein, 19 aa, Mycobacterium
RVAEVLERVGLPAEVAKSR

SEQ ID NO: 1247281 - protein, 24 aa, Mycobacterium
RVAILAPQGLDWVTGFFAAIKAGT

SEQ ID NO: 1247282 - protein, 23 aa, Mycobacterium
RVAIWSPNTWHWVVAALATTYAG

SEQ ID NO: 1247283 - protein, 20 aa, Mycobacterium
RVALGRVLVRPADIYLLDEP

SEQ ID NO: 1247284 - protein, 20 aa, Mycobacterium
RVAMLREWLANELSDASTEL

SEQ ID NO: 1247285 - protein, 19 aa, Mycobacterium
RVARFEKRYGKRGANKAAN

SEQ ID NO: 1247286 - protein, 19 aa, Mycobacterium
RVASHMRTSMVLDALEMAR

SEQ ID NO: 1247287 - protein, 19 aa, Mycobacterium
RVASLDYRLDVNTLHRDKS

SEQ ID NO: 1247288 - protein, 18 aa, Mycobacterium
RVAVACGRAPSLMPLAAR

SEQ ID NO: 1247289 - protein, 21 aa, Mycobacterium
RVAVLRFGKLQQFASPNELYD

SEQ ID NO: 1247290 - protein, 21 aa, Mycobacterium
RVCRPEGRIAVACWTPQGAIG

SEQ ID NO: 1247291 - protein, 21 aa, Mycobacterium
RVDAWLADFEAALAVRDIERV

SEQ ID NO: 1247292 - protein, 23 aa, Mycobacterium
RVDGPPANFAVVFQDYARSLFPW

SEQ ID NO: 1247293 - protein, 25 aa, Mycobacterium
RVDMLEMLPTPWGLVRSGVAPDHPK

SEQ ID NO: 1247294 - protein, 21 aa, Mycobacterium
RVDMMVRLLLSRVGDSGSSPA

SEQ ID NO: 1247295 - protein, 25 aa, Mycobacterium
RVDNIGKLPMAWVDPAAADTRTVLA

SEQ ID NO: 1247296 - protein, 18 aa, Mycobacterium
RVEACGLCGTDHEQFTGH

SEQ ID NO: 1247297 - protein, 23 aa, Mycobacterium
RVEPIWLSWIERWPTPSATAAAG

SEQ ID NO: 1247298 - protein, 21 aa, Mycobacterium
RVEQLPEIWRRLVEGGMESGH

SEQ ID NO: 1247299 - protein, 17 aa, Mycobacterium
RVEYRLLGPEYKSPRLV

SEQ ID NO: 1247300 - protein, 18 aa, Mycobacterium
RVFFCNSGTEANEVAFKI

SEQ ID NO: 1247301 - protein, 20 aa, Mycobacterium
RVFSTCRRLGIGTVAVYTEP

SEQ ID NO: 1247302 - protein, 19 aa, Mycobacterium
RVGAFGFLDLSAFTTSRTR

SEQ ID NO: 1247303 - protein, 26 aa, Mycobacterium
RVGAPGLWYAGSHGFELTGPDGTYHQ

SEQ ID NO: 1247304 - protein, 19 aa, Mycobacterium
RVGDHPVYVSIDIDVLDPA

SEQ ID NO: 1247305 - protein, 17 aa, Mycobacterium
RVGFNPREGIVLHEITY

SEQ ID NO: 1247306 - protein, 33 aa, Mycobacterium
RVGGNEAAFLFAITVGGAMRIEPIEIMTFNHDG

SEQ ID NO: 1247307 - protein, 19 aa, Mycobacterium
RVGHMVLCNQFRHPALLAK

SEQ ID NO: 1247308 - protein, 19 aa, Mycobacterium
RVGHSLDPKADYGPLVTEA

SEQ ID NO: 1247309 - protein, 25 aa, Mycobacterium
RVGKAWELGAGWAKHVTVEVALGTR

SEQ ID NO: 1247310 - protein, 23 aa, Mycobacterium
RVGRFGLDEAYPLDALADEPRLS

SEQ ID NO: 1247311 - protein, 21 aa, Mycobacterium
RVHGPLALAVGRRLRERYGID

SEQ ID NO: 1247312 - protein, 18 aa, Mycobacterium
RVHGPWDPSAGHRCDPSK

SEQ ID NO: 1247313 - protein, 20 aa, Mycobacterium
RVHHLFARMPDAKVHLYGKG

SEQ ID NO: 1247314 - protein, 17 aa, Mycobacterium
RVHKGIPAFTTLRGGAY

SEQ ID NO: 1247315 - protein, 20 aa, Mycobacterium
RVHMLVMLAFIEFNAGRADR

SEQ ID NO: 1247316 - protein, 17 aa, Mycobacterium
RVHPAPMETCGAVADLD

SEQ ID NO: 1247317 - protein, 30 aa, Mycobacterium
RVHPVPEVTRYEAWSFPDFATGATALRAVT

SEQ ID NO: 1247318 - protein, 23 aa, Mycobacterium
RVHRVPSRMFPKVTSLPLGVPRP

SEQ ID NO: 1247319 - protein, 19 aa, Mycobacterium
RVIAEGIADGSLRKVDEAL

SEQ ID NO: 1247320 - protein, 20 aa, Mycobacterium
RVIGGHMVRLLRHVYNVSGI

SEQ ID NO: 1247321 - protein, 18 aa, Mycobacterium
RVIKAVSRPHGFNVGLNL

SEQ ID NO: 1247322 - protein, 22 aa, Mycobacterium
RVITLRYLLSMIAAERGMVATF

SEQ ID NO: 1247323 - protein, 23 aa, Mycobacterium
RVKLSAKASVWYGATLRAEAEPI

SEQ ID NO: 1247324 - protein, 18 aa, Mycobacterium
RVLAGGVVISGDITLSIA

SEQ ID NO: 1247325 - protein, 17 aa, Mycobacterium
RVLDRVGDHPVYVSIDI

SEQ ID NO: 1247326 - protein, 20 aa, Mycobacterium
RVLEDFEHFTWDTPVLKVNY

SEQ ID NO: 1247327 - protein, 26 aa, Mycobacterium
RVLFLISPERIHTWVFALLRAVTTPD

SEQ ID NO: 1247328 - protein, 24 aa, Mycobacterium
RVLGDPALPHLFFVDGGALAVENA

SEQ ID NO: 1247329 - protein, 18 aa, Mycobacterium
RVLGRRVGPSTGTNLWGA

SEQ ID NO: 1247330 - protein, 20 aa, Mycobacterium
RVLMDAHLIIAGNERDLEKA

SEQ ID NO: 1247331 - protein, 17 aa, Mycobacterium
RVLREVLTRDGRSAVLV

SEQ ID NO: 1247332 - protein, 17 aa, Mycobacterium
RVLRGWSTLPITLGTAR

SEQ ID NO: 1247333 - protein, 17 aa, Mycobacterium
RVLRVGWCTVVQDDGSG

SEQ ID NO: 1247334 - protein, 18 aa, Mycobacterium
RVLTALAVGHCYHPDAAV

SEQ ID NO: 1247335 - protein, 20 aa, Mycobacterium
RVLTAVDCAVMLIDAAKGLE

SEQ ID NO: 1247336 - protein, 20 aa, Mycobacterium
RVLTELDLLRPHPADPGATP

SEQ ID NO: 1247337 - protein, 26 aa, Mycobacterium
RVLYLGRGMSKATLFGPAEVADQYAV

SEQ ID NO: 1247338 - protein, 22 aa, Mycobacterium
RVMSRIDTIRVHEVVDVVNDAP

SEQ ID NO: 1247339 - protein, 17 aa, Mycobacterium
RVNSVAPGYIWGETLKS

SEQ ID NO: 1247340 - protein, 27 aa, Mycobacterium
RVPALPRLEPGVALPCCRQTVHRGVVI

SEQ ID NO: 1247341 - protein, 19 aa, Mycobacterium
RVPCLPTDRLLNLLHYVKW

SEQ ID NO: 1247342 - protein, 26 aa, Mycobacterium
RVPGETVAAYIARRAGCTAATQAMEA

SEQ ID NO: 1247343 - protein, 22 aa, Mycobacterium
RVPGIGKRGAERMVLELRDKIG

SEQ ID NO: 1247344 - protein, 19 aa, Mycobacterium
RVPPAGPLGRHFPFDPSQA

SEQ ID NO: 1247345 - protein, 20 aa, Mycobacterium
RVPRVNLLNRYGDVAEDGTY

SEQ ID NO: 1247346 - protein, 20 aa, Mycobacterium
RVPTEKGYREFVDRLDDVKP

SEQ ID NO: 1247347 - protein, 19 aa, Mycobacterium
RVQELFEARVPRNKAPIAD

SEQ ID NO: 1247348 - protein, 20 aa, Mycobacterium
RVQGLILRARRVPVTPRAVV

SEQ ID NO: 1247349 - protein, 25 aa, Mycobacterium
RVQKAQKQARRWSRASVAEAMRLVA

SEQ ID NO: 1247350 - protein, 17 aa, Mycobacterium
RVQPVIMGLQLALTELW

SEQ ID NO: 1247351 - protein, 18 aa, Mycobacterium
RVRCGWLDGSRLAAADFE

SEQ ID NO: 1247352 - protein, 17 aa, Mycobacterium
RVRELPRVDILDGHHVD

SEQ ID NO: 1247353 - protein, 21 aa, Mycobacterium
RVREVASFIPGAMRGLVSERQ

SEQ ID NO: 1247354 - protein, 24 aa, Mycobacterium
RVRFLRNVMGTWLLSETVRQYERD

SEQ ID NO: 1247355 - protein, 18 aa, Mycobacterium
RVRFTSPHPAEFTDDVIE

SEQ ID NO: 1247356 - protein, 17 aa, Mycobacterium
RVRGAAVLEGLHLTAAE

SEQ ID NO: 1247357 - protein, 24 aa, Mycobacterium
RVRGFGDFFSYCLLAEGAVDIAAE

SEQ ID NO: 1247358 - protein, 17 aa, Mycobacterium
RVRGMCDKAVNRVDTVV

SEQ ID NO: 1247359 - protein, 18 aa, Mycobacterium
RVRGMRIASVILFGELIL

SEQ ID NO: 1247360 - protein, 25 aa, Mycobacterium
RVRIDRFEVLAIRRVDGFVDVDVAV

SEQ ID NO: 1247361 - protein, 18 aa, Mycobacterium
RVRLAMGVVTSIDPEILL

SEQ ID NO: 1247362 - protein, 18 aa, Mycobacterium
RVRMPVHLDDPVQVLTDL

SEQ ID NO: 1247363 - protein, 17 aa, Mycobacterium
RVRWDLPAHVVDRRIRA

SEQ ID NO: 1247364 - protein, 20 aa, Mycobacterium
RVSAATAFLKPAMRRPNLTV

SEQ ID NO: 1247365 - protein, 21 aa, Mycobacterium
RVSFVGRSMVRNMGIARELGY

SEQ ID NO: 1247366 - protein, 21 aa, Mycobacterium
RVSHFPRAWAAVTTGDGRTGI

SEQ ID NO: 1247367 - protein, 18 aa, Mycobacterium
RVSKKGVHSLTFTENPST

SEQ ID NO: 1247368 - protein, 18 aa, Mycobacterium
RVSLAHALIGWTKGTGLM

SEQ ID NO: 1247369 - protein, 39 aa, Mycobacterium
RVSLERNMQCGIAWCGHCQLGPLLLCRDGPVVGYDVAEP

SEQ ID NO: 1247370 - protein, 26 aa, Mycobacterium
RVSLLRRATGHWGERLVVEQGFACMV

SEQ ID NO: 1247371 - protein, 23 aa, Mycobacterium
RVSQSRPGAYFQLDELSKAIIEK

SEQ ID NO: 1247372 - protein, 23 aa, Mycobacterium
RVSRLVLCGAYAKGRAVRAANEE

SEQ ID NO: 1247373 - protein, 19 aa, Mycobacterium
RVSRSGWYGLDPVDGDLFT

SEQ ID NO: 1247374 - protein, 18 aa, Mycobacterium
RVTRARVASLDYRLDVNT

SEQ ID NO: 1247375 - protein, 26 aa, Mycobacterium
RVVADARVPWILMHWRSVAAERPHQV

SEQ ID NO: 1247376 - protein, 19 aa, Mycobacterium
RVVAEHSRRFILHRVREAF

SEQ ID NO: 1247377 - protein, 20 aa, Mycobacterium
RVVAGLAGIAVRTGDRRVSE

SEQ ID NO: 1247378 - protein, 32 aa, Mycobacterium
RVVEMAGDFGGVWYWNRFPGIQCDNDAYCYIP

SEQ ID NO: 1247379 - protein, 26 aa, Mycobacterium
RVVERFGDLVFDTVITRTVRFPETSV

SEQ ID NO: 1247380 - protein, 30 aa, Mycobacterium
RVVIALGGFAWKAALHMLRRGGASVPVPAP

SEQ ID NO: 1247381 - protein, 20 aa, Mycobacterium
RVVNELDLGMALTGELELDP

SEQ ID NO: 1247382 - protein, 23 aa, Mycobacterium
RVVPEVLEMVGLSGKANRLPAEL

SEQ ID NO: 1247383 - protein, 24 aa, Mycobacterium
RVVVPDFQLSLAIGKEGQNARLAA

SEQ ID NO: 1247384 - protein, 26 aa, Mycobacterium
RWDEVPGCRPEAFTVATVPARYAEIG

SEQ ID NO: 1247385 - protein, 18 aa, Mycobacterium
RWDHGYDLGGKRVAVIGT

SEQ ID NO: 1247386 - protein, 17 aa, Mycobacterium
RWDSFRAQAPRGIVYDM

SEQ ID NO: 1247387 - protein, 21 aa, Mycobacterium
RWFLDRTCTHILAWEGDDDNE

SEQ ID NO: 1247388 - protein, 20 aa, Mycobacterium
RWFLMASPILRGGNLIVTEQ

SEQ ID NO: 1247389 - protein, 19 aa, Mycobacterium
RWLDLCAGPGGKTAMLAAL

SEQ ID NO: 1247390 - protein, 27 aa, Mycobacterium
RWLDPAALPEWLVPSTFDGPVGSVLIT

SEQ ID NO: 1247391 - protein, 22 aa, Mycobacterium
RWLSVLRGGARFVIGTRSAVFA

SEQ ID NO: 1247392 - protein, 18 aa, Mycobacterium
RWMQTYGQRCWLRQLTPD

SEQ ID NO: 1247393 - protein, 19 aa, Mycobacterium
RWPNEIELLERLGMDNLDG

SEQ ID NO: 1247394 - protein, 18 aa, Mycobacterium
RWPQAAAVCDDVLRSFDP

SEQ ID NO: 1247395 - protein, 18 aa, Mycobacterium
RWQRGDLRVPMPGGETGD

SEQ ID NO: 1247396 - protein, 18 aa, Mycobacterium
RWREYCLSAVTTHDLPPT

SEQ ID NO: 1247397 - protein, 20 aa, Mycobacterium
RWRGGWVRDRRGRLRLRDGG

SEQ ID NO: 1247398 - protein, 19 aa, Mycobacterium
RWRRTSGIHKVRNPRALAA

SEQ ID NO: 1247399 - protein, 19 aa, Mycobacterium
RWRTGYLVLSGRTIDPSTA

SEQ ID NO: 1247400 - protein, 19 aa, Mycobacterium
RWTLHAGPVETTWESRIHS

SEQ ID NO: 1247401 - protein, 22 aa, Mycobacterium
RWTVACRYDYLIPCRGVGVLLP

SEQ ID NO: 1247402 - protein, 19 aa, Mycobacterium
RYAEALPLTVIGAAIPALE

SEQ ID NO: 1247403 - protein, 19 aa, Mycobacterium
RYAEPHPDSAALIVYTSGT

SEQ ID NO: 1247404 - protein, 20 aa, Mycobacterium
RYASLPTKALFRIPDEISLA

SEQ ID NO: 1247405 - protein, 19 aa, Mycobacterium
RYASLSKECVVIGSVDYLE

SEQ ID NO: 1247406 - protein, 17 aa, Mycobacterium
RYDVTSWQRVTLLERTH

SEQ ID NO: 1247407 - protein, 23 aa, Mycobacterium
RYERWKEAAFQYAWVLATADPET

SEQ ID NO: 1247408 - protein, 21 aa, Mycobacterium
RYETAEVYEWMALAHRALGDH

SEQ ID NO: 1247409 - protein, 29 aa, Mycobacterium
RYFGGSHLLPGVPLDRIVAFGAEDDPSKF

SEQ ID NO: 1247410 - protein, 17 aa, Mycobacterium
RYGEIRSPALAEWGIPT

SEQ ID NO: 1247411 - protein, 20 aa, Mycobacterium
RYGEMKTEMGRRVIEKITRI

SEQ ID NO: 1247412 - protein, 19 aa, Mycobacterium
RYGLAPICLAMAGVYGPRQ

SEQ ID NO: 1247413 - protein, 19 aa, Mycobacterium
RYGRVVGWTEVPGLGDELH

SEQ ID NO: 1247414 - protein, 22 aa, Mycobacterium
RYGSFRRSFRLPQHVTGDAISA

SEQ ID NO: 1247415 - protein, 19 aa, Mycobacterium
RYHARAVALVALERQACEP

SEQ ID NO: 1247416 - protein, 22 aa, Mycobacterium
RYHGYPRLVGETGGKDFVVAHT

SEQ ID NO: 1247417 - protein, 27 aa, Mycobacterium
RYHSIWLPDHMVSFWPDSIWTPEFTDL

SEQ ID NO: 1247418 - protein, 20 aa, Mycobacterium
RYILPSFIEHSSFGVKESNP

SEQ ID NO: 1247419 - protein, 17 aa, Mycobacterium
RYLKMGAAVRRVGMTAT

SEQ ID NO: 1247420 - protein, 23 aa, Mycobacterium
RYMKYLLGCADFFNRNVSYVEQF

SEQ ID NO: 1247421 - protein, 24 aa, Mycobacterium
RYMLDRRRALGGFVPERRTKSKAL

SEQ ID NO: 1247422 - protein, 20 aa, Mycobacterium
RYNICRELLVFGCQTAGALA

SEQ ID NO: 1247423 - protein, 26 aa, Mycobacterium
RYPDLAIPFHSRWRHFEAGNVNRAAG

SEQ ID NO: 1247424 - protein, 24 aa, Mycobacterium
RYPECAATVFALCSAARCSPVNQV

SEQ ID NO: 1247425 - protein, 23 aa, Mycobacterium
RYRFTRAGVQFGDHDDVRLMSAT

SEQ ID NO: 1247426 - protein, 20 aa, Mycobacterium
RYRGTGSLLVRPGSTDEVAA

SEQ ID NO: 1247427 - protein, 27 aa, Mycobacterium
RYRMLELSQLPGLGWVEYEPFGTVLII

SEQ ID NO: 1247428 - protein, 20 aa, Mycobacterium
RYRRMLTRSFSVKRANALRP

SEQ ID NO: 1247429 - protein, 20 aa, Mycobacterium
RYRTETEMMRYLRSLADKDI

SEQ ID NO: 1247430 - protein, 18 aa, Mycobacterium
RYTLPAFIEPRWLRFLPV

SEQ ID NO: 1247431 - protein, 17 aa, Mycobacterium
RYVAAWNSAFLPSKDLG

SEQ ID NO: 1247432 - protein, 25 aa, Mycobacterium
RYVYAATGKPGWFLFDGLVKHDLRD

SEQ ID NO: 1247433 - protein, 26 aa, Mycobacterium
SAAAPVPLCYGYHPYLQIPDVARAQW

SEQ ID NO: 1247434 - protein, 24 aa, Mycobacterium
SAAEALGGGWFWPAAAAHPSLPRG

SEQ ID NO: 1247435 - protein, 19 aa, Mycobacterium
SAALAMPGVYAVFTAEDLN

SEQ ID NO: 1247436 - protein, 19 aa, Mycobacterium
SAALERLAQTVLRANNDDV

SEQ ID NO: 1247437 - protein, 19 aa, Mycobacterium
SAALGWDIVPDTVIRDGPA

SEQ ID NO: 1247438 - protein, 18 aa, Mycobacterium
SAALRRVELTRPRSVIGK

SEQ ID NO: 1247439 - protein, 25 aa, Mycobacterium
SAAYLRATFDWHIDGCTPTGDEYPQ

SEQ ID NO: 1247440 - protein, 19 aa, Mycobacterium
SADAVVWSRGSALAEHPDV

SEQ ID NO: 1247441 - protein, 26 aa, Mycobacterium
SADYRACTPLPRFGEVTDIANLSVFL

SEQ ID NO: 1247442 - protein, 23 aa, Mycobacterium
SAEAPGFDWAGWVTALGTTPESV

SEQ ID NO: 1247443 - protein, 25 aa, Mycobacterium
SAEFRFPVVVEDAAAQWLSEGEEIP

SEQ ID NO: 1247444 - protein, 21 aa, Mycobacterium
SAEGTWDLVLARLLATADQAG

SEQ ID NO: 1247445 - protein, 25 aa, Mycobacterium
SAEKLAKLKPVFGVRHGDATMTAGN

SEQ ID NO: 1247446 - protein, 17 aa, Mycobacterium
SAELRWVAEEDVDSLPL

SEQ ID NO: 1247447 - protein, 18 aa, Mycobacterium
SAFAIAFHGILRAGATAT

SEQ ID NO: 1247448 - protein, 24 aa, Mycobacterium
SAFDRVLELSVAIAQCAVTHRAAL

SEQ ID NO: 1247449 - protein, 18 aa, Mycobacterium
SAFLDEARELGLQTVTEA

SEQ ID NO: 1247450 - protein, 20 aa, Mycobacterium
SAGATVFRGVWGFQAGEAAL

SEQ ID NO: 1247451 - protein, 24 aa, Mycobacterium
SAGCPLGNLIPEWNDLVRRGRWDA

SEQ ID NO: 1247452 - protein, 18 aa, Mycobacterium
SAGELIGPLGPEHRQAIA

SEQ ID NO: 1247453 - protein, 18 aa, Mycobacterium
SAGFPGTMPNPYRERSTV

SEQ ID NO: 1247454 - protein, 25 aa, Mycobacterium
SAGFTPTELMRWVHPSLVASTQGTG

SEQ ID NO: 1247455 - protein, 23 aa, Mycobacterium
SAGHLFPMLALLGELAGRGHRVH

SEQ ID NO: 1247456 - protein, 18 aa, Mycobacterium
SAGICGSDLPGFRGAKGR

SEQ ID NO: 1247457 - protein, 19 aa, Mycobacterium
SAHAGSWPYGLPELPGARE

SEQ ID NO: 1247458 - protein, 23 aa, Mycobacterium
SAIARRIAPMVVEYSEEDTNEPH

SEQ ID NO: 1247459 - protein, 18 aa, Mycobacterium
SAIPTVQALIRWDPVGHA

SEQ ID NO: 1247460 - protein, 18 aa, Mycobacterium
SAIRDMARALGFSQGQQD

SEQ ID NO: 1247461 - protein, 26 aa, Mycobacterium
SAIVKGLRSSTDFEYELQMAQMNKHV

SEQ ID NO: 1247462 - protein, 23 aa, Mycobacterium
SAKDLKDAFTFNVATAHALTTAA

SEQ ID NO: 1247463 - protein, 23 aa, Mycobacterium
SALDRPDTTLARLALMSAADAAW

SEQ ID NO: 1247464 - protein, 21 aa, Mycobacterium
SALFAAAVGRIRAMRMALLAE

SEQ ID NO: 1247465 - protein, 19 aa, Mycobacterium
SALKRKYRDQLRRHCADVE

SEQ ID NO: 1247466 - protein, 17 aa, Mycobacterium
SALLPFASQTLYSASKG

SEQ ID NO: 1247467 - protein, 20 aa, Mycobacterium
SALMRIGNRPTLGYSEATVQ

SEQ ID NO: 1247468 - protein, 30 aa, Mycobacterium
SALSALRLKPGNWAGASACWGLENREAAVR

SEQ ID NO: 1247469 - protein, 21 aa, Mycobacterium
SALTEGISWGWESYPEYLDVI

SEQ ID NO: 1247470 - protein, 17 aa, Mycobacterium
SALTIWTGGFGVPGLAA

SEQ ID NO: 1247471 - protein, 29 aa, Mycobacterium
SAMLKRLGIPGDFRGGFRVTTPEVLDVAR

SEQ ID NO: 1247472 - protein, 18 aa, Mycobacterium
SAMPRAARALKVKAVTTT

SEQ ID NO: 1247473 - protein, 17 aa, Mycobacterium
SAMRSAGTVIGREITRS

SEQ ID NO: 1247474 - protein, 19 aa, Mycobacterium
SAPAVKLLIRKSGASSAEM

SEQ ID NO: 1247475 - protein, 18 aa, Mycobacterium
SAPDWIKSSPLSTGDAAG

SEQ ID NO: 1247476 - protein, 18 aa, Mycobacterium
SAPFADVVVFARDWGFRL

SEQ ID NO: 1247477 - protein, 26 aa, Mycobacterium
SAPGHPLMFMVQAWNWIFPLGENPDY

SEQ ID NO: 1247478 - protein, 22 aa, Mycobacterium
SAPLKLSFDYTRSVGPLLGQFF

SEQ ID NO: 1247479 - protein, 18 aa, Mycobacterium
SAPPPVVAVVGRPNVGKS

SEQ ID NO: 1247480 - protein, 24 aa, Mycobacterium
SAPPRLDLSLLMTALPESYKATET

SEQ ID NO: 1247481 - protein, 18 aa, Mycobacterium
SAPYLGAAVEAWDESGQP

SEQ ID NO: 1247482 - protein, 23 aa, Mycobacterium
SAQLSRWLAEWGAPAPPVATLPV

SEQ ID NO: 1247483 - protein, 24 aa, Mycobacterium
SAQVWRHVPSWEFHRANVDPRRAR

SEQ ID NO: 1247484 - protein, 21 aa, Mycobacterium
SARANLKWTPQPAMPGQLRAV

SEQ ID NO: 1247485 - protein, 31 aa, Mycobacterium; identical to SEQ ID NO: 729637

SEQ ID NO: 1247486 - protein, 28 aa, Mycobacterium
SARIALWALGWLARVQFLTGDWDQALST

SEQ ID NO: 1247487 - protein, 24 aa, Mycobacterium
SARKYLSRWHRRRALWVGVAAGGV

SEQ ID NO: 1247488 - protein, 27 aa, Mycobacterium
SARSFKEAHLRLVLRSGRTDVEQIRAM

SEQ ID NO: 1247489 - protein, 25 aa, Mycobacterium
SARSPEALVALARRYDSWLGAHPDA

SEQ ID NO: 1247490 - protein, 22 aa, Mycobacterium
SARTYPAPAVPLIAVPTTAGTG

SEQ ID NO: 1247491 - protein, 21 aa, Mycobacterium
SASAGTIRWCVDAVTEHLRTR

SEQ ID NO: 1247492 - protein, 26 aa, Mycobacterium
SASRAMIWRRPRWAVRLQPEPVGGLL

SEQ ID NO: 1247493 - protein, 22 aa, Mycobacterium
SASYHLPRLIGMRRAQELMLTN

SEQ ID NO: 1247494 - protein, 25 aa, Mycobacterium
SATALLMRALRIGLEKDDADWLHNS

SEQ ID NO: 1247495 - protein, 18 aa, Mycobacterium
SATFLRERFAREMVTALI

SEQ ID NO: 1247496 - protein, 24 aa, Mycobacterium
SATGELWFRGPNVMAGYLNNDEAT

SEQ ID NO: 1247497 - protein, 17 aa, Mycobacterium
SATLDWLDAHGHQAMVA

SEQ ID NO: 1247498 - protein, 17 aa, Mycobacterium
SATNMVHYWSLRQSDLR

SEQ ID NO: 1247499 - protein, 24 aa, Mycobacterium
SATRPPAVLWWIRDHLDIEMVRIG

SEQ ID NO: 1247500 - protein, 17 aa, Mycobacterium
SAVHKMTLAYIASVTPE

SEQ ID NO: 1247501 - protein, 19 aa, Mycobacterium
SAVPTGWRSARTGVALDAD

SEQ ID NO: 1247502 - protein, 19 aa, Mycobacterium
SAVRPGLVIAAEFRGTDEP

SEQ ID NO: 1247503 - protein, 17 aa, Mycobacterium
SAVSLPISDHRALVVDI

SEQ ID NO: 1247504 - protein, 21 aa, Mycobacterium
SAVYACDCGNVIAPADENWKD

SEQ ID NO: 1247505 - protein, 23 aa, Mycobacterium
SAWAAETCGGYAPELNIVGAVLG

SEQ ID NO: 1247506 - protein, 18 aa, Mycobacterium
SAWFTRDEFERMVADGEI

SEQ ID NO: 1247507 - protein, 17 aa, Mycobacterium
SAWGSPTWHRTRVLEAF

SEQ ID NO: 1247508 - protein, 21 aa, Mycobacterium
SCAHLPNLRVESGQGLVVDFV

SEQ ID NO: 1247509 - protein, 27 aa, Mycobacterium
SCEDPRFSIARLSLLDRGMVFAVAHVR

SEQ ID NO: 1247510 - protein, 19 aa, Mycobacterium
SCFFLPRILPDGTRNRMLL

SEQ ID NO: 1247511 - protein, 24 aa, Mycobacterium
SCGKCTPCREGTYWLAQIYARLES

SEQ ID NO: 1247512 - protein, 23 aa, Mycobacterium
SCHRACPHRCALADCLQDRSVQS

SEQ ID NO: 1247513 - protein, 17 aa, Mycobacterium
SCLIKGSTVIDPPWPED

SEQ ID NO: 1247514 - protein, 18 aa, Mycobacterium
SCRDCPECRRGEYRRCAV

SEQ ID NO: 1247515 - protein, 21 aa, Mycobacterium
SCRQGFCGTCRTRVLAGTVDH

SEQ ID NO: 1247516 - protein, 19 aa, Mycobacterium
SCVVREIAEEVGLTVTDVR

SEQ ID NO: 1247517 - protein, 19 aa, Mycobacterium
SDADFKAAGAQLIAGADEV

SEQ ID NO: 1247518 - protein, 25 aa, Mycobacterium
SDAKESRAVVALRARGAAIRIGHDA

SEQ ID NO: 1247519 - protein, 22 aa, Mycobacterium
SDARSRFLVTMFCVPGQEMLVL

SEQ ID NO: 1247520 - protein, 20 aa, Mycobacterium
SDCRLREAGLVGADLREAVL

SEQ ID NO: 1247521 - protein, 28 aa, Mycobacterium
SDDFPLARLYAWHRAMRLFDGPDEVHMR

SEQ ID NO: 1247522 - protein, 21 aa, Mycobacterium
SDDGTGTWMLSVDRTGQVRWF

SEQ ID NO: 1247523 - protein, 26 aa, Mycobacterium
SDDPRFAGTMTMTWSVTAVDAGTRVD

SEQ ID NO: 1247524 - protein, 19 aa, Mycobacterium
SDDVRYRIIADHSRTAAIL

SEQ ID NO: 1247525 - protein, 24 aa, Mycobacterium
SDDWMARFVLGFGSAVRVLEPQEL

SEQ ID NO: 1247526 - protein, 20 aa, Mycobacterium
SDEARELIALTRDIADKVLD

SEQ ID NO: 1247527 - protein, 24 aa, Mycobacterium
SDEEWRLALRRNVDSAFFVTRAAL

SEQ ID NO: 1247528 - protein, 18 aa, Mycobacterium
SDERGFWAKLEGFNPGGM

SEQ ID NO: 1247529 - protein, 25 aa, Mycobacterium
SDFEIKDTWFAMGLKGTGSQDISIK

SEQ ID NO: 1247530 - protein, 23 aa, Mycobacterium
SDGNPTRIGYRVDEETGKKVRVS

SEQ ID NO: 1247531 - protein, 26 aa, Mycobacterium
SDGQLSRWTSFEAHPLDAMDLTRRLA

SEQ ID NO: 1247532 - protein, 22 aa, Mycobacterium
SDGRATSFRSFWTAADELTQPV

SEQ ID NO: 1247533 - protein, 23 aa, Mycobacterium
SDGRLDFDLAIPKEMGGSGDGTN

SEQ ID NO: 1247534 - protein, 21 aa, Mycobacterium
SDGTHTEWAMGFSQDATQSAL

SEQ ID NO: 1247535 - protein, 23 aa, Mycobacterium
SDGTLRFLLWTAALLSPEPPSLM

SEQ ID NO: 1247536 - protein, 19 aa, Mycobacterium
SDGVIIPTECEYFSLRGLA

SEQ ID NO: 1247537 - protein, 24 aa, Mycobacterium
SDHTGRAVGILADLQGPKIRLGRF

SEQ ID NO: 1247538 - protein, 27 aa, Mycobacterium
SDIFLREVQDTWTWLRPYFDERATATA

SEQ ID NO: 1247539 - protein, 19 aa, Mycobacterium
SDILAGAFRRSADRWSAEM

SEQ ID NO: 1247540 - protein, 19 aa, Mycobacterium
SDIQAYRAALVEAWGDVRD

SEQ ID NO: 1247541 - protein, 25 aa, Mycobacterium
SDLEYHLTTLFPPVRPRRWLEIRYL

SEQ ID NO: 1247542 - protein, 19 aa, Mycobacterium
SDLHAWHGTFATRGLGGQL

SEQ ID NO: 1247543 - protein, 24 aa, Mycobacterium
SDLLRAGDVLVVIGTHEGLAGVEV

SEQ ID NO: 1247544 - protein, 17 aa, Mycobacterium
SDLPLRMSCQAAIPLGA

SEQ ID NO: 1247545 - protein, 21 aa, Mycobacterium
SDMALAGGVSIMLEPRKMSSG

SEQ ID NO: 1247546 - protein, 17 aa, Mycobacterium
SDMKSGDAVFLHLAATV

SEQ ID NO: 1247547 - protein, 27 aa, Mycobacterium
SDPIPVLPNVHWLYEYGHPRRLAQTEA

SEQ ID NO: 1247548 - protein, 26 aa, Mycobacterium
SDRIFTWQLAMAVRPRRWVFTSVGRL

SEQ ID NO: 1247549 - protein, 17 aa, Mycobacterium
SDRLGFPVLQIRYPLPF

SEQ ID NO: 1247550 - protein, 45 aa, Mycobacterium
SDRPTPNPIARFFKFLSDLFWRVVHFFEDLVSRFVDVLFGGGPVG

SEQ ID NO: 1247551 - protein, 24 aa, Mycobacterium
SDRYWRRYFENFAEVMSSSEQVGS

SEQ ID NO: 1247552 - protein, 19 aa, Mycobacterium
SDVDSALSWRDESSCDAEK

SEQ ID NO: 1247553 - protein, 22 aa, Mycobacterium
SDVELAQGFLLTEGIIGHRDDV

SEQ ID NO: 1247554 - protein, 18 aa, Mycobacterium
SDVLIEPRVDLWARVLRR

SEQ ID NO: 1247555 - protein, 24 aa, Mycobacterium
SDVVKRLYGLAARVPMGQADKYAV

SEQ ID NO: 1247556 - protein, 22 aa, Mycobacterium
SDWAELPAAIEAARRHDPKVIV

SEQ ID NO: 1247557 - protein, 22 aa, Mycobacterium
SDYKGRKVIVYFYPAASTPGCT

SEQ ID NO: 1247558 - protein, 21 aa, Mycobacterium
SDYRLKTEPIGRHIPVFRLKP

SEQ ID NO: 1247559 - protein, 21 aa, Mycobacterium
SEAEGILHLSEFVPVTRRFTG

SEQ ID NO: 1247560 - protein, 27 aa, Mycobacterium
SEAGRICASLGLAERVLTQPLRTLSGG

SEQ ID NO: 1247561 - protein, 23 aa, Mycobacterium
SEALAEQRWYLGTLRDEGAVAKR

SEQ ID NO: 1247562 - protein, 22 aa, Mycobacterium
SEALRASGLSAGIVDAGVSRGL

SEQ ID NO: 1247563 - protein, 18 aa, Mycobacterium
SEASQRCAYFSEVREAGG

SEQ ID NO: 1247564 - protein, 22 aa, Mycobacterium
SEASYFGPSFMINWLHNNYGGY

SEQ ID NO: 1247565 - protein, 40 aa, Mycobacterium
SEAVMLAGLAMKWRWRQRLGGDAWKGRTPNLVMGSNVQVV

SEQ ID NO: 1247566 - protein, 19 aa, Mycobacterium
SEELREWVRAALPVHHVPV

SEQ ID NO: 1247567 - protein, 24 aa, Mycobacterium
SEEVPARVAGLVERLKAAEKELDR

SEQ ID NO: 1247568 - protein, 18 aa, Mycobacterium
SEGRGLGLEFLRHIERCA

SEQ ID NO: 1247569 - protein, 20 aa, Mycobacterium
SEGRSVCAVGDPAAEIVEAI

SEQ ID NO: 1247570 - protein, 24 aa, Mycobacterium
SEGSAPFGICAGADGALWFTEMGS

SEQ ID NO: 1247571 - protein, 19 aa, Mycobacterium
SEHCSYKSSKVHLRYFGET

SEQ ID NO: 1247572 - protein, 18 aa, Mycobacterium
SEHLCQGWLEGYLLTGRH

SEQ ID NO: 1247573 - protein, 29 aa, Mycobacterium
SEHWEVVRIALPTALARYVVEKGSITVDG

SEQ ID NO: 1247574 - protein, 19 aa, Mycobacterium
SEIGAAIFAAGELAPADRK

SEQ ID NO: 1247575 - protein, 19 aa, Mycobacterium
SEITPDHLLLGLLVDTESL

SEQ ID NO: 1247576 - protein, 18 aa, Mycobacterium
SELALGWSTYGVGDQMSH

SEQ ID NO: 1247577 - protein, 21 aa, Mycobacterium
SELDIPVVAGGVLDHRTALHL

SEQ ID NO: 1247578 - protein, 20 aa, Mycobacterium
SELGLSYLLPRAIGSSRAFE

SEQ ID NO: 1247579 - protein, 20 aa, Mycobacterium
SELLPELTLAQKWDLTANEL

SEQ ID NO: 1247580 - protein, 22 aa, Mycobacterium
SEMEMKVLLWAVQRLIGGLSSI

SEQ ID NO: 1247581 - protein, 32 aa, Mycobacterium
SEPIHPVLMDLCTGVAFPAFPALLAAEQGVSD

SEQ ID NO: 1247582 - protein, 20 aa, Mycobacterium
SEPMWGPGGSEAWLRNDPMV

SEQ ID NO: 1247583 - protein, 25 aa, Mycobacterium
SEPRHAWFPIDRSMVLYYCSLVEDA

SEQ ID NO: 1247584 - protein, 24 aa, Mycobacterium
SEPWTTGPGLPWPGRPAPLHPNAA

SEQ ID NO: 1247585 - protein, 24 aa, Mycobacterium
SEQGVPTPVAWTRMRAPRSLMDTI

SEQ ID NO: 1247586 - protein, 24 aa, Mycobacterium
SERAELIEWLLGRGFTMAEVHEAI

SEQ ID NO: 1247587 - protein, 26 aa, Mycobacterium
SEREREVAELLLLGMPYRDIGAQLFI

SEQ ID NO: 1247588 - protein, 25 aa, Mycobacterium
SERQGESGFAWAFLGAALATTDLPF

SEQ ID NO: 1247589 - protein, 20 aa, Mycobacterium
SESNAMWALSIPVPFTKPVG

SEQ ID NO: 1247590 - protein, 19 aa, Mycobacterium
SETFLPAFSAVYHPMMADL

SEQ ID NO: 1247591 - protein, 21 aa, Mycobacterium
SETLKKVFLELGGKSAAIVLD

SEQ ID NO: 1247592 - protein, 20 aa, Mycobacterium
SETRRVWNMVTKRYWWHAWW

SEQ ID NO: 1247593 - protein, 19 aa, Mycobacterium
SEVAIVCQLARTLFGADHP

SEQ ID NO: 1247594 - protein, 27 aa, Mycobacterium
SEVVARLPFVPSLLEWLHAGRTSVVMD

SEQ ID NO: 1247595 - protein, 18 aa, Mycobacterium
SEWGFAGYVRHFIDKPTI

SEQ ID NO: 1247596 - protein, 17 aa, Mycobacterium
SFALVYDAIVTRGGQAV

SEQ ID NO: 1247597 - protein, 19 aa, Mycobacterium
SFDYHRVSAEWEYSGPAYG

SEQ ID NO: 1247598 - protein, 19 aa, Mycobacterium
SFGAFVPQGITLRVYGDAN

SEQ ID NO: 1247599 - protein, 24 aa, Mycobacterium
SFGGLRYAPRADLATREEQIAIAE

SEQ ID NO: 1247600 - protein, 26 aa, Mycobacterium
SFGKWTRRAWMGAGYLVARTLDPDGT

SEQ ID NO: 1247601 - protein, 19 aa, Mycobacterium
SFGTAGVFVERFVDTARHV

SEQ ID NO: 1247602 - protein, 23 aa, Mycobacterium
SFHDLEHWRPLWEALVETETIMN

SEQ ID NO: 1247603 - protein, 26 aa, Mycobacterium
SFKVLLKELQSLCLNVEVLSSDGAAI

SEQ ID NO: 1247604 - protein, 29 aa, Mycobacterium
SFNNELGHPWTVLRADRSTDFLVLEMSAR

SEQ ID NO: 1247605 - protein, 22 aa, Mycobacterium
SFPDWKPASFDYWPAENGVVMK

SEQ ID NO: 1247606 - protein, 23 aa, Mycobacterium
SFPRSEPYVVVLVRLDEGPQLLA

SEQ ID NO: 1247607 - protein, 19 aa, Mycobacterium
SFSHGRDWGSPKIPEQMNL

SEQ ID NO: 1247608 - protein, 23 aa, Mycobacterium
SFSQFKRSALPNGPKVSAGGSLS

SEQ ID NO: 1247609 - protein, 23 aa, Mycobacterium
SFTAEQGAAWGFVNKVTEPGQAL

SEQ ID NO: 1247610 - protein, 19 aa, Mycobacterium
SFTFGLPASDVIRALQKAG

SEQ ID NO: 1247611 - protein, 18 aa, Mycobacterium
SFVMSNSFSNQVIAQIEL

SEQ ID NO: 1247612 - protein, 24 aa, Mycobacterium
SFYGDFRFGQALYSYDLDAEDLAS

SEQ ID NO: 1247613 - protein, 19 aa, Mycobacterium
SFYMCGDLYQVDPYTADTL

SEQ ID NO: 1247614 - protein, 18 aa, Mycobacterium
SFYWHFSDIQAYRAALVE

SEQ ID NO: 1247615 - protein, 17 aa, Mycobacterium
SGAAAVVRGTRRAHIGA

SEQ ID NO: 1247616 - protein, 31 aa, Mycobacterium; identical to SEQ ID NO: 730994

SEQ ID NO: 1247617 - protein, 18 aa, Mycobacterium
SGAFLKALGSYYRSNALA

SEQ ID NO: 1247618 - protein, 19 aa, Mycobacterium
SGALFGFAGLVDGLVNRIR

SEQ ID NO: 1247619 - protein, 27 aa, Mycobacterium
SGAPVLPARSLVALCGGGTIQRNEHAN

SEQ ID NO: 1247620 - protein, 17 aa, Mycobacterium
SGARRVVVASYLLADGL

SEQ ID NO: 1247621 - protein, 19 aa, Mycobacterium
SGDKLSFAKNMVLRRDPDR

SEQ ID NO: 1247622 - protein, 18 aa, Mycobacterium
SGDTFEWADDSTYVRKPP

SEQ ID NO: 1247623 - protein, 19 aa, Mycobacterium
SGDVPPALRRLVLEGRAGV

SEQ ID NO: 1247624 - protein, 25 aa, Mycobacterium
SGEPAVAIFRPAAVAVYRQRPHGSP

SEQ ID NO: 1247625 - protein, 19 aa, Mycobacterium
SGEREGFWSGALHADVDGA

SEQ ID NO: 1247626 - protein, 17 aa, Mycobacterium
SGFEAVLSRALGPSARI

SEQ ID NO: 1247627 - protein, 22 aa, Mycobacterium
SGFRRDPLIAARVVAWLEDRYA

SEQ ID NO: 1247628 - protein, 26 aa, Mycobacterium
SGGDVDRAFAIACRMRTGNVTINGKS

SEQ ID NO: 1247629 - protein, 19 aa, Mycobacterium
SGGLPAAAFGGRAEVMERL

SEQ ID NO: 1247630 - protein, 23 aa, Mycobacterium
SGGRGVGSAENFGIVEELADALG

SEQ ID NO: 1247631 - protein, 17 aa, Mycobacterium
SGGRHILGLGVSGPQVV

SEQ ID NO: 1247632 - protein, 17 aa, Mycobacterium
SGGRISLGTDWPAAGYF

SEQ ID NO: 1247633 - protein, 22 aa, Mycobacterium
SGGRMMVTFGVGWLEKEFELLG

SEQ ID NO: 1247634 - protein, 26 aa, Mycobacterium
SGGVEFPFDVARHGDAVFVDSPLGAV

SEQ ID NO: 1247635 - protein, 20 aa, Mycobacterium
SGHTEVVLWGGRRPELLGGR

SEQ ID NO: 1247636 - protein, 21 aa, Mycobacterium
SGHYSFLNVFKLFGPGNKAPL

SEQ ID NO: 1247637 - protein, 19 aa, Mycobacterium
SGIGRAVAVAFAKEGADVS

SEQ ID NO: 1247638 - protein, 20 aa, Mycobacterium
SGINSWGRAIVTAARQFRRD

SEQ ID NO: 1247639 - protein, 18 aa, Mycobacterium
SGIRELAGPLGLVAGDVV

SEQ ID NO: 1247640 - protein, 17 aa, Mycobacterium
SGKNVVTPVGWFYPGEK

SEQ ID NO: 1247641 - protein, 30 aa, Mycobacterium
SGKRRLALDHLPRLAAALAVTTDELLRSPE

SEQ ID NO: 1247642 - protein, 17 aa, Mycobacterium
SGLIPGLLGDLPITGAG

SEQ ID NO: 1247643 - protein, 17 aa, Mycobacterium
SGLPDAVRIIAWTDEPG

SEQ ID NO: 1247644 - protein, 25 aa, Mycobacterium
SGLPRARLTGELGRTAGQLRLFAAV

SEQ ID NO: 1247645 - protein, 21 aa, Mycobacterium
SGLPVLLLAASHPHRVRSLVL

SEQ ID NO: 1247646 - protein, 18 aa, Mycobacterium
SGLRVGRLALDILGAIPV

SEQ ID NO: 1247647 - protein, 18 aa, Mycobacterium
SGMPEHRDDTAITIRNRY

SEQ ID NO: 1247648 - protein, 17 aa, Mycobacterium
SGNWAINTGNGYHGGLQ

SEQ ID NO: 1247649 - protein, 24 aa, Mycobacterium
SGPARARYLLLRLLERSGEQRVAI

SEQ ID NO: 1247650 - protein, 19 aa, Mycobacterium
SGPVIPVRMTTVYLTDERV

SEQ ID NO: 1247651 - protein, 24 aa, Mycobacterium
SGQGVRVPHGFAITAAAYRHMLDE

SEQ ID NO: 1247652 - protein, 27 aa, Mycobacterium
SGRDLSGWGRQWLKTTGLNTLRADFDV

SEQ ID NO: 1247653 - protein, 18 aa, Mycobacterium
SGRGEWWSFDAVPGSPAA

SEQ ID NO: 1247654 - protein, 19 aa, Mycobacterium
SGRLKAVVATSSLELGIDM

SEQ ID NO: 1247655 - protein, 19 aa, Mycobacterium
SGRPDCVLLDLNLPDANGT

SEQ ID NO: 1247656 - protein, 24 aa, Mycobacterium
SGRSELRLAAEAVLDALDDAGLAP

SEQ ID NO: 1247657 - protein, 26 aa, Mycobacterium
SGRYMGHAMVSTWQRGAPYTWVDGDL

SEQ ID NO: 1247658 - protein, 20 aa, Mycobacterium
SGSLPPGLPDDWYAEVVARL

SEQ ID NO: 1247659 - protein, 28 aa, Mycobacterium
SGSSFRRMCREEFLHYLRIREWQDLTGQ

SEQ ID NO: 1247660 - protein, 17 aa, Mycobacterium
SGSSRDWAAKGTSLLGV

SEQ ID NO: 1247661 - protein, 17 aa, Mycobacterium
SGSVSGYTGALVLTRER

SEQ ID NO: 1247662 - protein, 24 aa, Mycobacterium
SGSVVQRLWAKPAITVIGIDTTPI

SEQ ID NO: 1247663 - protein, 26 aa, Mycobacterium
SGTERRTNWLKNFYFGGEHGVGDSIA

SEQ ID NO: 1247664 - protein, 17 aa, Mycobacterium
SGTVSFRNAHALREAAQ

SEQ ID NO: 1247665 - protein, 20 aa, Mycobacterium
SGVDSGARLVTGGGIPENLP

SEQ ID NO: 1247666 - protein, 25 aa, Mycobacterium
SGVIPRIPLNLVLIKGVTVQGFQFG

SEQ ID NO: 1247667 - protein, 17 aa, Mycobacterium
SGWRIVALQPYGGAWLN

SEQ ID NO: 1247668 - protein, 17 aa, Mycobacterium
SGYGLPMALTLFRRDLD

SEQ ID NO: 1247669 - protein, 27 aa, Mycobacterium
SGYLVPHWPKPWGRAAGTLEQLVIEEE

SEQ ID NO: 1247670 - protein, 25 aa, Mycobacterium
SHAPMPARDLLGVLVDRITPALRAV

SEQ ID NO: 1247671 - protein, 25 aa, Mycobacterium
SHAQAGRLTEWLKLSLDEPSLLETL

SEQ ID NO: 1247672 - protein, 21 aa, Mycobacterium
SHCSWSAPGTGQFLPHEGASP

SEQ ID NO: 1247673 - protein, 24 aa, Mycobacterium
SHGDLPLFVALIVRVMVSAHFGRE

SEQ ID NO: 1247674 - protein, 19 aa, Mycobacterium
SHGQIAFAVQNALTGLLGA

SEQ ID NO: 1247675 - protein, 23 aa, Mycobacterium
SHGRGGFPGMLLGSVSSEVVQSA

SEQ ID NO: 1247676 - protein, 30 aa, Mycobacterium
SHLAKARGNAVCHPSRLVVIDLSEVTYFGS

SEQ ID NO: 1247677 - protein, 17 aa, Mycobacterium
SHLRLTARLNTAALDSR

SEQ ID NO: 1247678 - protein, 17 aa, Mycobacterium
SHMKVDFFDAGSVISTD

SEQ ID NO: 1247679 - protein, 23 aa, Mycobacterium
SHPARERLAECGAREVIVTNTLP

SEQ ID NO: 1247680 - protein, 25 aa, Mycobacterium
SHQALCYFGYLAGYRLVHDAAADPL

SEQ ID NO: 1247681 - protein, 24 aa, Mycobacterium
SHRAVARVTAWLLAPSDTADAVTD

SEQ ID NO: 1247682 - protein, 17 aa, Mycobacterium
SHSGGPSDIHWIVAATN

SEQ ID NO: 1247683 - protein, 23 aa, Mycobacterium
SHSLELRYLFDVGGAPPLSPAQQ

SEQ ID NO: 1247684 - protein, 19 aa, Mycobacterium
SHVAKWMRRTTLLRPARLA

SEQ ID NO: 1247685 - protein, 22 aa, Mycobacterium
SHWPEVVAAPSAAAAGRVQSWV

SEQ ID NO: 1247686 - protein, 23 aa, Mycobacterium
SIAEIFGMLACGARIVIHRPGGL

SEQ ID NO: 1247687 - protein, 24 aa, Mycobacterium
SIAGRWGFSHAGRFSVAYRRMYGT

SEQ ID NO: 1247688 - protein, 18 aa, Mycobacterium
SIAHGIRRFEFMIHADET

SEQ ID NO: 1247689 - protein, 23 aa, Mycobacterium
SIARPEYAWRPTVAEGSEPWVQT

SEQ ID NO: 1247690 - protein, 18 aa, Mycobacterium
SICGSQIRSVWVTPGAGR

SEQ ID NO: 1247691 - protein, 21 aa, Mycobacterium
SIDNRARFARQIAQRVREVVG

SEQ ID NO: 1247692 - protein, 26 aa, Mycobacterium
SIDRRPDLPSGKGLVIAEGVLVVQRM

SEQ ID NO: 1247693 - protein, 18 aa, Mycobacterium
SIGSILAIPGIRGALRST

SEQ ID NO: 1247694 - protein, 25 aa, Mycobacterium
SIGYAACHWCHVMAHESFEDDEVAA

SEQ ID NO: 1247695 - protein, 24 aa, Mycobacterium
SIILPRPEPELVLRTIERYGVTNY

SEQ ID NO: 1247696 - protein, 24 aa, Mycobacterium
SIISKGRGGSMILTSSMQGLVGRG

SEQ ID NO: 1247697 - protein, 21 aa, Mycobacterium
SILQRRVVFRADREAVKQIAV

SEQ ID NO: 1247698 - protein, 23 aa, Mycobacterium
SILRKPRSGLSYETLLHTVEQRL

SEQ ID NO: 1247699 - protein, 17 aa, Mycobacterium
SILTVLALRDGVIPPTL

SEQ ID NO: 1247700 - protein, 24 aa, Mycobacterium
SIPAVLKNAIDWLSRPWGDGALKD

SEQ ID NO: 1247701 - protein, 17 aa, Mycobacterium
SIPDPQTTFGFLATGPG

SEQ ID NO: 1247702 - protein, 23 aa, Mycobacterium
SIQRTAFDLGRFLPRGEAVAHLD

SEQ ID NO: 1247703 - protein, 19 aa, Mycobacterium
SITDARASELLADRRARGP

SEQ ID NO: 1247704 - protein, 26 aa, Mycobacterium
SITPQLRGRLVLAWRASGPVSPAARV

SEQ ID NO: 1247705 - protein, 24 aa, Mycobacterium
SIVEAKGYCYGWHFYQCADADLVI

SEQ ID NO: 1247706 - protein, 18 aa, Mycobacterium
SIVLLRLAEKAFRPSPLP

SEQ ID NO: 1247707 - protein, 18 aa, Mycobacterium
SIYSALAEQCRRLDALGV

SEQ ID NO: 1247708 - protein, 19 aa, Mycobacterium
SKAARKVWDSADKFTRETL

SEQ ID NO: 1247709 - protein, 20 aa, Mycobacterium
SKADIAHLVSDYGLESLSSG

SEQ ID NO: 1247710 - protein, 22 aa, Mycobacterium
SKAEAIRKFRILPVDFTEDTGE

SEQ ID NO: 1247711 - protein, 20 aa, Mycobacterium
SKAHARVLFSAGLLTEDQRD

SEQ ID NO: 1247712 - protein, 17 aa, Mycobacterium
SKAHVVFDAAFQVNGSS

SEQ ID NO: 1247713 - protein, 24 aa, Mycobacterium
SKAQGAGPSRDWQSFVVSPRAKAK

SEQ ID NO: 1247714 - protein, 17 aa, Mycobacterium
SKDTMYCCLPLYHNNAL

SEQ ID NO: 1247715 - protein, 18 aa, Mycobacterium
SKIRAREFAAKAGAQIAK

SEQ ID NO: 1247716 - protein, 17 aa, Mycobacterium
SKLVFIAGQVARDATGA

SEQ ID NO: 1247717 - protein, 19 aa, Mycobacterium
SKPLWEMYVVEGLVGDRVA

SEQ ID NO: 1247718 - protein, 18 aa, Mycobacterium
SKQGRWQEMATLIPDDML

SEQ ID NO: 1247719 - protein, 22 aa, Mycobacterium
SKRELAFRFGATHFVTTMEEAN

SEQ ID NO: 1247720 - protein, 21 aa, Mycobacterium
SKRVRAVDFTIGYEVRSVGAP

SEQ ID NO: 1247721 - protein, 22 aa, Mycobacterium
SKSAIPWGDFDAHLEHMRHLFD

SEQ ID NO: 1247722 - protein, 18 aa, Mycobacterium
SKSILLQGWEQFDQPVDR

SEQ ID NO: 1247723 - protein, 33 aa, Mycobacterium
SKSQLPRHIAVLCDGNRRWARDAGHDDVSYGYR

SEQ ID NO: 1247724 - protein, 19 aa, Mycobacterium
SKSVLWKQILADVLDTPLF

SEQ ID NO: 1247725 - protein, 18 aa, Mycobacterium
SKTAMSFAAGVLRHAPAL

SEQ ID NO: 1247726 - protein, 17 aa, Mycobacterium
SKVGREEFVSFAPISSV

SEQ ID NO: 1247727 - protein, 19 aa, Mycobacterium
SKVIMEFADEYGLNMPIAR

SEQ ID NO: 1247728 - protein, 20 aa, Mycobacterium
SKYALASALVDQWLESTLRT

SEQ ID NO: 1247729 - protein, 19 aa, Mycobacterium
SLADLIVLAGSAAVEKAAK

SEQ ID NO: 1247730 - protein, 26 aa, Mycobacterium
SLAEAGYLVSRRGRYGGTFLAEELPR

SEQ ID NO: 1247731 - protein, 20 aa, Mycobacterium
SLAEGFLKRGARLVTGGTDN

SEQ ID NO: 1247732 - protein, 18 aa, Mycobacterium
SLAGGGVVPLFWEHGHDD

SEQ ID NO: 1247733 - protein, 25 aa, Mycobacterium
SLAGPRPVVLHGFDLAHRSRAEVTV

SEQ ID NO: 1247734 - protein, 19 aa, Mycobacterium
SLAGPTLSELGAWELDVRA

SEQ ID NO: 1247735 - protein, 18 aa, Mycobacterium
SLAHFIAALVYLPRDRYT

SEQ ID NO: 1247736 - protein, 18 aa, Mycobacterium
SLAHPVRQFVLFTSISGL

SEQ ID NO: 1247737 - protein, 23 aa, Mycobacterium
SLAPALRLGWMALPDALVEPVLA

SEQ ID NO: 1247738 - protein, 19 aa, Mycobacterium
SLARRAAQTAAEIAAAATL

SEQ ID NO: 1247739 - protein, 22 aa, Mycobacterium
SLARRLGLKKIRMEILPVSFGF

SEQ ID NO: 1247740 - protein, 19 aa, Mycobacterium
SLCDIESKVAAAREPIKAD

SEQ ID NO: 1247741 - protein, 27 aa, Mycobacterium
SLDADEFLKLMLRWLNAFVPKPGQTIP

SEQ ID NO: 1247742 - protein, 18 aa, Mycobacterium
SLDLRWWPLDALPPDTDF

SEQ ID NO: 1247743 - protein, 25 aa, Mycobacterium
SLDMAGCSLTVMWLDDELERYWRAP

SEQ ID NO: 1247744 - protein, 18 aa, Mycobacterium
SLDRGMGIAHRVRTGSIG

SEQ ID NO: 1247745 - protein, 29 aa, Mycobacterium
SLDSRLRVLARRDFAGLITVAVDSPESAD

SEQ ID NO: 1247746 - protein, 25 aa, Mycobacterium
SLEYDRLGLPAADWQILLDVPTALA

SEQ ID NO: 1247747 - protein, 17 aa, Mycobacterium
SLFDSVIYVTFQELATR

SEQ ID NO: 1247748 - protein, 35 aa, Mycobacterium
SLFQVLRYGFRPSKVAFLAWHAWRDADSGNWPTGF

SEQ ID NO: 1247749 - protein, 22 aa, Mycobacterium
SLGGAPRSPGWYHNLKANPDVE

SEQ ID NO: 1247750 - protein, 23 aa, Mycobacterium
SLGHPRKGLFLIHTDAVDSVLGT

SEQ ID NO: 1247751 - protein, 24 aa, Mycobacterium
SLGTDWPAAGYFSTYKPLDSIQVG

SEQ ID NO: 1247752 - protein, 24 aa, Mycobacterium
SLGTRLGGYIGQYRIRYRYTANQT

SEQ ID NO: 1247753 - protein, 22 aa, Mycobacterium
SLHALLAQLGRYWNIDPGDTFL

SEQ ID NO: 1247754 - protein, 21 aa, Mycobacterium
SLHQARLALCQATRQVIANGL

SEQ ID NO: 1247755 - protein, 27 aa, Mycobacterium
SLIKVKGFRNTIHWRVTRYDEPKEIEL

SEQ ID NO: 1247756 - protein, 25 aa, Mycobacterium
SLIRGEWRPLYLFADRPQPLIDLEV

SEQ ID NO: 1247757 - protein, 18 aa, Mycobacterium
SLIRRLGVTEVPFRELRD

SEQ ID NO: 1247758 - protein, 23 aa, Mycobacterium
SLKHRLIRDAGRFAITVQDENPP

SEQ ID NO: 1247759 - protein, 29 aa, Mycobacterium
SLLDRGMVFAVAHVRGGGELGRPWYEQGK

SEQ ID NO: 1247760 - protein, 25 aa, Mycobacterium
SLLERARSAGIPVIHIQHSDGPDSL

SEQ ID NO: 1247761 - protein, 18 aa, Mycobacterium
SLLNEGLREIAAVQRRVR

SEQ ID NO: 1247762 - protein, 17 aa, Mycobacterium
SLLNWTKTMLGVRRRHD

SEQ ID NO: 1247763 - protein, 21 aa, Mycobacterium
SLLPGRDGLVHISKLGRGKRI

SEQ ID NO: 1247764 - protein, 26 aa, Mycobacterium
SLNAQWRSATCRVVVAATGSRSANAG

SEQ ID NO: 1247765 - protein, 24 aa, Mycobacterium
SLNLVGGLRRSMAKAGYCDPKEFQ

SEQ ID NO: 1247766 - protein, 22 aa, Mycobacterium
SLPDALGVLVGRSVVSLIDQAE

SEQ ID NO: 1247767 - protein, 19 aa, Mycobacterium
SLPDLLPLLEKVAEAGKPL

SEQ ID NO: 1247768 - protein, 23 aa, Mycobacterium
SLPGAIEEMVRWTSPSPSKRRTA

SEQ ID NO: 1247769 - protein, 18 aa, Mycobacterium
SLPLTVTEWDEWGNPLEH

SEQ ID NO: 1247770 - protein, 24 aa, Mycobacterium
SLPYASSLCGACFDACPVRIDIPS

SEQ ID NO: 1247771 - protein, 25 aa, Mycobacterium
SLRHAEILLALAVQRQGRSAPELAA

SEQ ID NO: 1247772 - protein, 24 aa, Mycobacterium
SLRPYAELLVDGFGIPEQLRYAAM

SEQ ID NO: 1247773 - protein, 25 aa, Mycobacterium
SLRTRRAGAVGLMITEPLNYSFSDP

SEQ ID NO: 1247774 - protein, 18 aa, Mycobacterium
SLSHPYLDTVLFILGVTR

SEQ ID NO: 1247775 - protein, 18 aa, Mycobacterium
SLSTLALLAKGFDVPVTT

SEQ ID NO: 1247776 - protein, 24 aa, Mycobacterium
SLTIKAMIEKVVDRMYAEIDDNRF

SEQ ID NO: 1247777 - protein, 22 aa, Mycobacterium
SLTRYTLRAAAVFDDDPVAVLH

SEQ ID NO: 1247778 - protein, 18 aa, Mycobacterium
SMAAAYAPYGIRVNALAP

SEQ ID NO: 1247779 - protein, 17 aa, Mycobacterium
SMAGARLTGEVLRCPRC

SEQ ID NO: 1247780 - protein, 23 aa, Mycobacterium
SMAHSKYIIVWGMNMTSTNLHGW

SEQ ID NO: 1247781 - protein, 26 aa, Mycobacterium
SMAWQKILHERGWAAPAWPVEYGGCD

SEQ ID NO: 1247782 - protein, 24 aa, Mycobacterium
SMDPWGASVADVFTAELAAGLDIR

SEQ ID NO: 1247783 - protein, 17 aa, Mycobacterium
SMFDLAYGYARNQMTAY

SEQ ID NO: 1247784 - protein, 17 aa, Mycobacterium
SMFQAILPLRGKIINVE

SEQ ID NO: 1247785 - protein, 22 aa, Mycobacterium
SMFRFGCVSGGASLYAPQAQNN

SEQ ID NO: 1247786 - protein, 18 aa, Mycobacterium
SMGAMALFGEAYPDEVRV

SEQ ID NO: 1247787 - protein, 19 aa, Mycobacterium
SMGLAPMVISQIFKIIADI

SEQ ID NO: 1247788 - protein, 17 aa, Mycobacterium
SMKRAGAGIPLVHTTPM

SEQ ID NO: 1247789 - protein, 26 aa, Mycobacterium
SMNARIAANLGAPVVLAVKARGRTPD

SEQ ID NO: 1247790 - protein, 21 aa, Mycobacterium
SMPHLAMAFTIAHPGVTGALL

SEQ ID NO: 1247791 - protein, 20 aa, Mycobacterium
SMPPRPGERELVPRAREQGW

SEQ ID NO: 1247792 - protein, 18 aa, Mycobacterium
SMPWDRLVLTPGSVTRLF

SEQ ID NO: 1247793 - protein, 21 aa, Mycobacterium
SMSGRLVARYLAKYVTKSLVD

SEQ ID NO: 1247794 - protein, 25 aa, Mycobacterium
SMSKSFWGGLRIGWIRADPSTLASI

SEQ ID NO: 1247795 - protein, 19 aa, Mycobacterium
SMSVIRYTTLRPFVVHINH

SEQ ID NO: 1247796 - protein, 25 aa, Mycobacterium
SMVVAGLCRLLARKGVRVAPFKAQN

SEQ ID NO: 1247797 - protein, 23 aa, Mycobacterium
SNAELRPFPGRRGAPRKPGRAVA

SEQ ID NO: 1247798 - protein, 18 aa, Mycobacterium
SNALPRRGFAALRRPVRR

SEQ ID NO: 1247799 - protein, 25 aa, Mycobacterium
SNARNHISFGFGVHRCMGNRLAELQ

SEQ ID NO: 1247800 - protein, 19 aa, Mycobacterium
SNFPLKRATLELMTAPEQP

SEQ ID NO: 1247801 - protein, 23 aa, Mycobacterium
SNICTAQVLLAVIAAMYASYHGA

SEQ ID NO: 1247802 - protein, 25 aa, Mycobacterium
SNISHEFRTPLTLILGPLAEMLRTS

SEQ ID NO: 1247803 - protein, 18 aa, Mycobacterium
SNLAMGFMRAVEVPIISC

SEQ ID NO: 1247804 - protein, 28 aa, Mycobacterium
SNLFLRDLVMALRWVRDNIAVFGGDPDN

SEQ ID NO: 1247805 - protein, 19 aa, Mycobacterium
SNPMLGFRGASRYAHPAYA

SEQ ID NO: 1247806 - protein, 18 aa, Mycobacterium
SNVARTVFKSMLTAVLDR

SEQ ID NO: 1247807 - protein, 25 aa, Mycobacterium
SNVILMLPFVRRVAEADLVLQTMAD

SEQ ID NO: 1247808 - protein, 17 aa, Mycobacterium
SNVVDALTWVMGEHSAK

SEQ ID NO: 1247809 - protein, 17 aa, Mycobacterium
SNWRATGTLDEELVRQG

SEQ ID NO: 1247810 - protein, 24 aa, Mycobacterium
SPAEYPALLQRLAKAQAEDAVRVR

SEQ ID NO: 1247811 - protein, 20 aa, Mycobacterium
SPAGWSHFDDDRWELFHIEA

SEQ ID NO: 1247812 - protein, 25 aa, Mycobacterium
SPDERRSRALAGFAALFGDAASSPI

SEQ ID NO: 1247813 - protein, 23 aa, Mycobacterium
SPDLRGAYAHALKSVAVGPDGAV

SEQ ID NO: 1247814 - protein, 26 aa, Mycobacterium
SPDWDELRARFDLVSRKVPMLRQRVV

SEQ ID NO: 1247815 - protein, 26 aa, Mycobacterium
SPEFVGERVLGMGFDRDVLLRAGIEE

SEQ ID NO: 1247816 - protein, 27 aa, Mycobacterium
SPEGGWIRTWLDTVLDLPWNVRTEDST

SEQ ID NO: 1247817 - protein, 24 aa, Mycobacterium
SPELVGREAVMEWLSEHRKQSPYP

SEQ ID NO: 1247818 - protein, 24 aa, Mycobacterium
SPERIPSLCPIAGVDGAGCCDLAF

SEQ ID NO: 1247819 - protein, 26 aa, Mycobacterium
SPESLYRYASVHWARHSATFDAFGVT

SEQ ID NO: 1247820 - protein, 19 aa, Mycobacterium
SPEVFISALIEASASLGPV

SEQ ID NO: 1247821 - protein, 17 aa, Mycobacterium
SPFGARFAGVNLVTGIA

SEQ ID NO: 1247822 - protein, 26 aa, Mycobacterium
SPFNFPAMVPMWFFPVAIATGNTVVL

SEQ ID NO: 1247823 - protein, 25 aa, Mycobacterium
SPGEPFVLHPGEFVLGSTLETCTLP

SEQ ID NO: 1247824 - protein, 18 aa, Mycobacterium
SPGFTLYSLSGHVTRPGQ

SEQ ID NO: 1247825 - protein, 29 aa, Mycobacterium
SPGHKGGRTLDPWFREHIAAVDLNNLADL

SEQ ID NO: 1247826 - protein, 19 aa, Mycobacterium
SPGIRLEHPSVYDLNDGYL

SEQ ID NO: 1247827 - protein, 19 aa, Mycobacterium
SPGSVCYLVRGAAGATYLF

SEQ ID NO: 1247828 - protein, 17 aa, Mycobacterium
SPHEVLAEFPLGARRAE

SEQ ID NO: 1247829 - protein, 23 aa, Mycobacterium
SPHIPWDRLAVKVVTESTPWERN

SEQ ID NO: 1247830 - protein, 17 aa, Mycobacterium
SPHVVAVGFTFDPKTHI

SEQ ID NO: 1247831 - protein, 20 aa, Mycobacterium
SPKDLPAFCQAITDQFANTP

SEQ ID NO: 1247832 - protein, 19 aa, Mycobacterium
SPKEMWDVFAEEYLSPVRP

SEQ ID NO: 1247833 - protein, 29 aa, Mycobacterium
SPLLRRPDLLVSMLTYWQRHPALSYLFAG

SEQ ID NO: 1247834 - protein, 23 aa, Mycobacterium
SPLSAGDFVRWCRQVLDLLDQVR

SEQ ID NO: 1247835 - protein, 21 aa, Mycobacterium
SPLTREWFAGTFVEPTPAQAQ

SEQ ID NO: 1247836 - protein, 19 aa, Mycobacterium
SPPQARRLIVGAWHDRMAM

SEQ ID NO: 1247837 - protein, 20 aa, Mycobacterium
SPPTPARWARMRSLGEGLTF

SEQ ID NO: 1247838 - protein, 22 aa, Mycobacterium
SPPVELGLLFTLNGVGGIVGAN

SEQ ID NO: 1247839 - protein, 17 aa, Mycobacterium
SPQLWSRQRRLAQTAPA

SEQ ID NO: 1247840 - protein, 18 aa, Mycobacterium
SPRLRALDTAKLAGLAVD

SEQ ID NO: 1247841 - protein, 23 aa, Mycobacterium
SPTGKFMSIWRASKPVIAQVHGW

SEQ ID NO: 1247842 - protein, 18 aa, Mycobacterium
SPVALAVTLESVRRAGRL

SEQ ID NO: 1247843 - protein, 17 aa, Mycobacterium
SPWIGNVDLTFPYLDTA

SEQ ID NO: 1247844 - protein, 19 aa, Mycobacterium
SPYWPESLGVLAVPIHYRG

SEQ ID NO: 1247845 - protein, 27 aa, Mycobacterium
SQAGCGMACPFCATGQGGLQRNLSTAE

SEQ ID NO: 1247846 - protein, 18 aa, Mycobacterium
SQELWGYSAPGEIIHHPY

SEQ ID NO: 1247847 - protein, 17 aa, Mycobacterium
SQERMCAVVTPDNVEAF

SEQ ID NO: 1247848 - protein, 23 aa, Mycobacterium
SQGYSRVRVDGVVYPLTEPPKLK

SEQ ID NO: 1247849 - protein, 25 aa, Mycobacterium
SQHLAKLRMARLVRTRREGTTIYYS

SEQ ID NO: 1247850 - protein, 18 aa, Mycobacterium
SQHPRLRQRPGIADELAA

SEQ ID NO: 1247851 - protein, 17 aa, Mycobacterium
SQLIGGMTMGLSMALHE

SEQ ID NO: 1247852 - protein, 17 aa, Mycobacterium
SQLKPVFRPNGTITAGN

SEQ ID NO: 1247853 - protein, 20 aa, Mycobacterium
SQLLYWTQVLMIARGLSPDD

SEQ ID NO: 1247854 - protein, 18 aa, Mycobacterium
SQLTGRIGALTADGESVS

SEQ ID NO: 1247855 - protein, 24 aa, Mycobacterium
SQPRGRVFPIGSFGHTGFTGTSMW

SEQ ID NO: 1247856 - protein, 18 aa, Mycobacterium
SQPVLYKHFTGMDAIADA

SEQ ID NO: 1247857 - protein, 22 aa, Mycobacterium
SQQPRFAPALQIVSTALSSSRE

SEQ ID NO: 1247858 - protein, 21 aa, Mycobacterium
SQRGVYCGAWSAYVPGEEHVY

SEQ ID NO: 1247859 - protein, 19 aa, Mycobacterium
SQRLYSWAEASSYATPFVT

SEQ ID NO: 1247860 - protein, 25 aa, Mycobacterium
SQRMAEEWRRHGLDLDMADLFYDGE

SEQ ID NO: 1247861 - protein, 20 aa, Mycobacterium
SQTAGALWLEADAARRWMAS

SEQ ID NO: 1247862 - protein, 24 aa, Mycobacterium
SRAAKARFAVYIGDLGADTAATAR

SEQ ID NO: 1247863 - protein, 19 aa, Mycobacterium
SRAGWLRWSDKLAAAPLKP

SEQ ID NO: 1247864 - protein, 33 aa, Mycobacterium; identical to SEQ ID NO: 733553

SEQ ID NO: 1247865 - protein, 26 aa, Mycobacterium
SRALRTRIAPQNAWIVDRYLANDLVV

SEQ ID NO: 1247866 - protein, 32 aa, Mycobacterium
SRALRVSAALDFGCVWINTHIPLVAEMPHGGF

SEQ ID NO: 1247867 - protein, 27 aa, Mycobacterium
SRCRPWRYGFGEARRGDPVAIVLNTEP

SEQ ID NO: 1247868 - protein, 22 aa, Mycobacterium
SRDEAKEAIIARGGKAAGSVSK

SEQ ID NO: 1247869 - protein, 17 aa, Mycobacterium
SRDLDFRYHCLTQLHEA

SEQ ID NO: 1247870 - protein, 22 aa, Mycobacterium
SRDSRMALGELIANTIEAKRQA

SEQ ID NO: 1247871 - protein, 18 aa, Mycobacterium
SRESPQWEEVAGRCLTCG

SEQ ID NO: 1247872 - protein, 25 aa, Mycobacterium
SRETAQRFVGWLGRVVTAFADQPDL

SEQ ID NO: 1247873 - protein, 23 aa, Mycobacterium
SRFNVPAQLLAPIPDGVGAVEAA

SEQ ID NO: 1247874 - protein, 26 aa, Mycobacterium
SRFRAMCEARGLPITRIGVVDPGSDA

SEQ ID NO: 1247875 - protein, 20 aa, Mycobacterium
SRFTLALVREKCREHRIKPK

SEQ ID NO: 1247876 - protein, 20 aa, Mycobacterium
SRFYFLTGRGALLQLGLMQL

SEQ ID NO: 1247877 - protein, 26 aa, Mycobacterium
SRGGAAKRRSWAVLGEMAELGDDSIS

SEQ ID NO: 1247878 - protein, 19 aa, Mycobacterium
SRGKVGWVLGTVALATAKS

SEQ ID NO: 1247879 - protein, 21 aa, Mycobacterium
SRGLRTARQLLLDIIDIGLPV

SEQ ID NO: 1247880 - protein, 17 aa, Mycobacterium
SRGNGIDPLDWVETFGA

SEQ ID NO: 1247881 - protein, 17 aa, Mycobacterium
SRGRAGRRRGVVINPVL

SEQ ID NO: 1247882 - protein, 22 aa, Mycobacterium
SRGRLAMAMGAIRARHSIDEAA

SEQ ID NO: 1247883 - protein, 20 aa, Mycobacterium
SRGRLCPKGSASKQLVTGPQ

SEQ ID NO: 1247884 - protein, 23 aa, Mycobacterium
SRGRSEFTYGSFARSVTLPAAAD

SEQ ID NO: 1247885 - protein, 17 aa, Mycobacterium
SRHGLAQGYALRLADRL

SEQ ID NO: 1247886 - protein, 18 aa, Mycobacterium
SRHVRRTPVTRGRILVAC

SEQ ID NO: 1247887 - protein, 17 aa, Mycobacterium
SRIIARENIRAIRKDVL

SEQ ID NO: 1247888 - protein, 22 aa, Mycobacterium
SRIKLGQMCTAMSYRNPAYLAK

SEQ ID NO: 1247889 - protein, 19 aa, Mycobacterium
SRIQAGRMRAQFEPVDLAA

SEQ ID NO: 1247890 - protein, 19 aa, Mycobacterium
SRISVVPCGVDLDLFTPDG

SEQ ID NO: 1247891 - protein, 22 aa, Mycobacterium
SRKAGFEPLPPVYTTGVLAKYT

SEQ ID NO: 1247892 - protein, 22 aa, Mycobacterium
SRLCSACFDGNYPIELPGESAL

SEQ ID NO: 1247893 - protein, 19 aa, Mycobacterium
SRLCVCPIDPTARGRSVCT

SEQ ID NO: 1247894 - protein, 27 aa, Mycobacterium
SRLDDARLAFYKTLYRDNARYDAKLWV

SEQ ID NO: 1247895 - protein, 17 aa, Mycobacterium
SRLGSLLYDNSQTVIRR

SEQ ID NO: 1247896 - protein, 17 aa, Mycobacterium
SRLIGRSLRACIDLNAL

SEQ ID NO: 1247897 - protein, 25 aa, Mycobacterium
SRLPDLRCLMLTSFTSDEAMIDAIL

SEQ ID NO: 1247898 - protein, 20 aa, Mycobacterium
SRLQSAFIHGIKRLPVTWTP

SEQ ID NO: 1247899 - protein, 22 aa, Mycobacterium
SRLVPRHLVRAMTRTVGRGRGR

SEQ ID NO: 1247900 - protein, 18 aa, Mycobacterium
SRLWVDQRVQKIYAGTNE

SEQ ID NO: 1247901 - protein, 17 aa, Mycobacterium
SRMRPDVVTAFMDQFGD

SEQ ID NO: 1247902 - protein, 19 aa, Mycobacterium
SRMRWLRPGEVPTLGNWFR

SEQ ID NO: 1247903 - protein, 25 aa, Mycobacterium
SRNRKGSTWVLSLAGGRLVAADHIG

SEQ ID NO: 1247904 - protein, 22 aa, Mycobacterium
SRNRRFSVAGHRLEDYRTVRAR

SEQ ID NO: 1247905 - protein, 20 aa, Mycobacterium
SRPASQWLSAAQGWLDDPLR

SEQ ID NO: 1247906 - protein, 20 aa, Mycobacterium
SRPHGFNVGLNLGQSAGGSL

SEQ ID NO: 1247907 - protein, 18 aa, Mycobacterium
SRPLRPVAPLAQLDFDAP

SEQ ID NO: 1247908 - protein, 17 aa, Mycobacterium
SRPPSSFQWGWNSVPVE

SEQ ID NO: 1247909 - protein, 19 aa, Mycobacterium
SRPSTDWLEDSGITLDNGV

SEQ ID NO: 1247910 - protein, 22 aa, Mycobacterium
SRPTIYRRWRDTDAVLAALLTA

SEQ ID NO: 1247911 - protein, 20 aa, Mycobacterium
SRQITGWVAALGATPADADE

SEQ ID NO: 1247912 - protein, 23 aa, Mycobacterium
SRQRVYRQPGFVTAMRDIMALQD

SEQ ID NO: 1247913 - protein, 24 aa, Mycobacterium
SRRIVGWRAARSMTTDLVLDAIEH

SEQ ID NO: 1247914 - protein, 31 aa, Mycobacterium
SRRLRRVMYMSALTAIRCDPDSKAYYQRKRD

SEQ ID NO: 1247915 - protein, 20 aa, Mycobacterium
SRRVIDIAIGILVGLRGCTE

SEQ ID NO: 1247916 - protein, 25 aa, Mycobacterium
SRRVTELLDRVGLRDRSGYHPAQLS

SEQ ID NO: 1247917 - protein, 22 aa, Mycobacterium
SRSEGLAVASWHAFADGLFSSD

SEQ ID NO: 1247918 - protein, 22 aa, Mycobacterium
SRSGFCTVTARYDRASITDPDL

SEQ ID NO: 1247919 - protein, 34 aa, Mycobacterium
SRSKREIPHYYLADEVLMDPALAWLAERNAARSI

SEQ ID NO: 1247920 - protein, 26 aa, Mycobacterium
SRSNITICVGGGIGTPERAAEYLSGR

SEQ ID NO: 1247921 - protein, 25 aa, Mycobacterium
SRSWKAIEASGRFCVNVLHEKQKDV

SEQ ID NO: 1247922 - protein, 20 aa, Mycobacterium
SRTAALPVLLLSARAGQESS

SEQ ID NO: 1247923 - protein, 23 aa, Mycobacterium
SRTALRRWLTKAGVGPDQAMNVL

SEQ ID NO: 1247924 - protein, 26 aa, Mycobacterium
SRTGRPDALLPLARREARDCLAEDLR

SEQ ID NO: 1247925 - protein, 19 aa, Mycobacterium
SRTLARLGLANYFAAATVL

SEQ ID NO: 1247926 - protein, 21 aa, Mycobacterium
SRTLGSLSLMGVRVAELIVNQ

SEQ ID NO: 1247927 - protein, 17 aa, Mycobacterium
SRVAAFVERARAGASRL

SEQ ID NO: 1247928 - protein, 19 aa, Mycobacterium
SRVAEGHPVAWIHATALRT

SEQ ID NO: 1247929 - protein, 19 aa, Mycobacterium
SRVGLGYEVVVTRLDDEAN

SEQ ID NO: 1247930 - protein, 20 aa, Mycobacterium
SRVGRIAWSLFRHPVKSREF

SEQ ID NO: 1247931 - protein, 28 aa, Mycobacterium
SRVLRPGGRLGLVWNTRDERLGWVKDLG

SEQ ID NO: 1247932 - protein, 26 aa, Mycobacterium
SRYAEADKFFGFAATEFGDFTDSEAL

SEQ ID NO: 1247933 - protein, 25 aa, Mycobacterium
SRYKEWLSIHRVWRSKLPETLDKGA

SEQ ID NO: 1247934 - protein, 19 aa, Mycobacterium
SRYLGPWVAEPEIWQDPVP

SEQ ID NO: 1247935 - protein, 19 aa, Mycobacterium
SRYRHWLTHKLGSWHDQFG

SEQ ID NO: 1247936 - protein, 20 aa, Mycobacterium
SSAEQVRWVLSDSGAVLAIV

SEQ ID NO: 1247937 - protein, 20 aa, Mycobacterium
SSANLGDWIASRLVQPKSKA

SEQ ID NO: 1247938 - protein, 19 aa, Mycobacterium
SSAPDWLARGTIVHKSGTT

SEQ ID NO: 1247939 - protein, 25 aa, Mycobacterium
SSARSEVGLDLFWRNIRTHSLHDPV

SEQ ID NO: 1247940 - protein, 17 aa, Mycobacterium
SSATLNLYADRPRGLDA

SEQ ID NO: 1247941 - protein, 26 aa, Mycobacterium
SSAWTIGFYILHNWMLALFGEQAQAE

SEQ ID NO: 1247942 - protein, 24 aa, Mycobacterium
SSDCVAAVFGGWTSSSRKAMLPVF

SEQ ID NO: 1247943 - protein, 21 aa, Mycobacterium
SSDRIPKWLLPVVRENLRTGA

SEQ ID NO: 1247944 - protein, 21 aa, Mycobacterium
SSDWRDAYAGTPWHKHVPARI

SEQ ID NO: 1247945 - protein, 29 aa, Mycobacterium
SSFAVPTRWLIRTEPLPTLAGEKIDKKTL

SEQ ID NO: 1247946 - protein, 17 aa, Mycobacterium
SSGDIETVMSLFDDDVE

SEQ ID NO: 1247947 - protein, 22 aa, Mycobacterium
SSGTDACDWIILGAMVGDADGR

SEQ ID NO: 1247948 - protein, 19 aa, Mycobacterium
SSHAAQWALPGGRLDPGET

SEQ ID NO: 1247949 - protein, 17 aa, Mycobacterium
SSIASSNVHRWFGAYGP

SEQ ID NO: 1247950 - protein, 26 aa, Mycobacterium
SSIRTGRANPGMFSRINVDYYGATTP

SEQ ID NO: 1247951 - protein, 18 aa, Mycobacterium
SSLASFEGQLGKWSRMDA

SEQ ID NO: 1247952 - protein, 19 aa, Mycobacterium
SSLFLRAAAMLGIAVDALA

SEQ ID NO: 1247953 - protein, 24 aa, Mycobacterium
SSLFPMEEDGFWALTRRADIAFVS

SEQ ID NO: 1247954 - protein, 18 aa, Mycobacterium
SSLLSRRDVVVVASVSCI

SEQ ID NO: 1247955 - protein, 19 aa, Mycobacterium
SSLPFRLSAGPQRFHRHPA

SEQ ID NO: 1247956 - protein, 27 aa, Mycobacterium
SSLRLVACGGSAVPLSLMRAFEEKYDV

SEQ ID NO: 1247957 - protein, 25 aa, Mycobacterium
SSLTVFSGYRFVRHAAAHGMPVAII

SEQ ID NO: 1247958 - protein, 25 aa, Mycobacterium
SSLVELPVSWALDDWQQYCFVPDFS

SEQ ID NO: 1247959 - protein, 19 aa, Mycobacterium
SSLVKYGRVNRLFVNNLIS

SEQ ID NO: 1247960 - protein, 20 aa, Mycobacterium
SSLYRALGLLADCGRGEVIG

SEQ ID NO: 1247961 - protein, 19 aa, Mycobacterium
SSPRGVRFAAENAEAIFTA

SEQ ID NO: 1247962 - protein, 21 aa, Mycobacterium
SSPRRALSELLRRGTKNMRGA

SEQ ID NO: 1247963 - protein, 18 aa, Mycobacterium
SSSGWKRVEECLRSLGYA

SEQ ID NO: 1247964 - protein, 18 aa, Mycobacterium
SSSLVAVHLACQSLRSGD

SEQ ID NO: 1247965 - protein, 22 aa, Mycobacterium
SSTIERLRLLGVDIETMTRRLR

SEQ ID NO: 1247966 - protein, 22 aa, Mycobacterium
SSTRRALLMLVQSLRATGWQVA

SEQ ID NO: 1247967 - protein, 18 aa, Mycobacterium
SSVGITWTSELLTVTSVD

SEQ ID NO: 1247968 - protein, 17 aa, Mycobacterium
SSVRYNTPFGGFKQSGL

SEQ ID NO: 1247969 - protein, 24 aa, Mycobacterium
SSWLYRIVVNACLDRLRTNRTHAT

SEQ ID NO: 1247970 - protein, 27 aa, Mycobacterium
SSYFPPAPAEALFRWLANKDGQNKVLN

SEQ ID NO: 1247971 - protein, 19 aa, Mycobacterium
STADALRMLTLPGTLALYL

SEQ ID NO: 1247972 - protein, 18 aa, Mycobacterium
STADAWKAVQDTVDGPAA

SEQ ID NO: 1247973 - protein, 19 aa, Mycobacterium
STAGLAPAAVEAFGKLDIV

SEQ ID NO: 1247974 - protein, 27 aa, Mycobacterium
STAVSRARRALAEFRVRGVSTNIPFLQ

SEQ ID NO: 1247975 - protein, 27 aa, Mycobacterium
STEPGCPPKTWCVRNVSGFAGQLNVTD

SEQ ID NO: 1247976 - protein, 18 aa, Mycobacterium
STGNRGIPPYSWDEDTAT

SEQ ID NO: 1247977 - protein, 21 aa, Mycobacterium
STGPCLEGWITLTALAQATKR

SEQ ID NO: 1247978 - protein, 19 aa, Mycobacterium
STGSSALWLARQAVASGVA

SEQ ID NO: 1247979 - protein, 25 aa, Mycobacterium
STHPLELNLVFGHVLEQLRAADVRV

SEQ ID NO: 1247980 - protein, 20 aa, Mycobacterium
STIGRRLAKALGLTLLDTDA

SEQ ID NO: 1247981 - protein, 18 aa, Mycobacterium
STLAKRFNDLLGEPPLTY

SEQ ID NO: 1247982 - protein, 17 aa, Mycobacterium
STLIRRFMAETDRSVVV

SEQ ID NO: 1247983 - protein, 32 aa, Mycobacterium
STLKSLKVLIRFTNELLRQSVIGLDATLRQRL

SEQ ID NO: 1247984 - protein, 19 aa, Mycobacterium
STLLRLLLGHRTPDEGRAS

SEQ ID NO: 1247985 - protein, 22 aa, Mycobacterium
STLRERTWKRSSFNGTEIYGKT

SEQ ID NO: 1247986 - protein, 21 aa, Mycobacterium
STMHCMSVSLGLDGAGLGTCW

SEQ ID NO: 1247987 - protein, 21 aa, Mycobacterium
STNLHGWPFLLEARKNNGAKI

SEQ ID NO: 1247988 - protein, 24 aa, Mycobacterium
STNLPRVLGGLGVAIISTSSGLLT

SEQ ID NO: 1247989 - protein, 34 aa, Mycobacterium
STPDEFRGQIDIAKEVLVALGIAVLAEPGFEADD

SEQ ID NO: 1247990 - protein, 24 aa, Mycobacterium
STPGCTKQACDFRDNLAELNDAGV

SEQ ID NO: 1247991 - protein, 23 aa, Mycobacterium
STPWPTYPLMFRVSSAHEEGGER

SEQ ID NO: 1247992 - protein, 22 aa, Mycobacterium
STQLFPGYYKRPDVTAEVFDDD

SEQ ID NO: 1247993 - protein, 34 aa, Mycobacterium
STRVEFWAFDILRLDGRWLLKAKYRDRRKLLETL

SEQ ID NO: 1247994 - protein, 18 aa, Mycobacterium
STSAFTYAYFKGAALEAR

SEQ ID NO: 1247995 - protein, 19 aa, Mycobacterium
STTAKRDGDDWVINGTKYY

SEQ ID NO: 1247996 - protein, 18 aa, Mycobacterium
STTARRALLEGADVVISD

SEQ ID NO: 1247997 - protein, 25 aa, Mycobacterium
STVYRHWKNKGALIVDALRTLNTQP

SEQ ID NO: 1247998 - protein, 18 aa, Mycobacterium
STWSRLLLTTAGINLNVL

SEQ ID NO: 1247999 - protein, 23 aa, Mycobacterium
SVDGRTVEGWGLFEHGALGRHDP

SEQ ID NO: 1248000 - protein, 25 aa, Mycobacterium
SVDLDLPRDALIVFTGLSGSGKSSL

SEQ ID NO: 1248001 - protein, 20 aa, Mycobacterium
SVDYAGAGTVEFIVSADRPD

SEQ ID NO: 1248002 - protein, 24 aa, Mycobacterium
SVDYLEIWDAAAWQEYQQAHEENF

SEQ ID NO: 1248003 - protein, 18 aa, Mycobacterium
SVEGLVRAVTDWAAEPDA

SEQ ID NO: 1248004 - protein, 17 aa, Mycobacterium
SVFDHLLLTVHHRVRAA

SEQ ID NO: 1248005 - protein, 26 aa, Mycobacterium
SVFFCCKAALRHMVPAQKGSIINTAS

SEQ ID NO: 1248006 - protein, 17 aa, Mycobacterium
SVFRMARKTTTLGDAAV

SEQ ID NO: 1248007 - protein, 17 aa, Mycobacterium
SVGEPVAVYGPWGCGRC

SEQ ID NO: 1248008 - protein, 19 aa, Mycobacterium
SVGKRCLLGANAGLGISLG

SEQ ID NO: 1248009 - protein, 20 aa, Mycobacterium
SVGPLAPGCGMNITVWSYVD

SEQ ID NO: 1248010 - protein, 24 aa, Mycobacterium
SVGVPMRCVFALTAMGFLPQSSAA

SEQ ID NO: 1248011 - protein, 20 aa, Mycobacterium
SVLGWRAQHSQSHYAAAKAG

SEQ ID NO: 1248012 - protein, 23 aa, Mycobacterium
SVLTKRPPRWIVVADLVETSRLF

SEQ ID NO: 1248013 - protein, 17 aa, Mycobacterium
SVNRLGALGDLAVPGRR

SEQ ID NO: 1248014 - protein, 28 aa, Mycobacterium
SVPEARVPGRLFAGPALDQPAEADPADD

SEQ ID NO: 1248015 - protein, 22 aa, Mycobacterium
SVPEVLVRGVLDRLAEYGYGTV

SEQ ID NO: 1248016 - protein, 22 aa, Mycobacterium
SVPGPVCYRRGGTEPTVTDADV

SEQ ID NO: 1248017 - protein, 22 aa, Mycobacterium
SVPIAARLAGMPSVNLQLLGGR

SEQ ID NO: 1248018 - protein, 27 aa, Mycobacterium
SVPLSGTWIDIRFTLTDVIRTGGAPLV

SEQ ID NO: 1248019 - protein, 18 aa, Mycobacterium
SVPNFLPLLAERFAHQQL

SEQ ID NO: 1248020 - protein, 21 aa, Mycobacterium
SVPPIEFPATVPAVPGGQTDA

SEQ ID NO: 1248021 - protein, 23 aa, Mycobacterium
SVPPILLGGIDWFRSMGSEKSPG

SEQ ID NO: 1248022 - protein, 20 aa, Mycobacterium
SVPTGLWIGGEEREAKSTFN

SEQ ID NO: 1248023 - protein, 17 aa, Mycobacterium
SVRSASVGVWVNVGSRD

SEQ ID NO: 1248024 - protein, 31 aa, Mycobacterium
SVSEAAAVPPAWRVGDDVAHPELGHGWIQGA

SEQ ID NO: 1248025 - protein, 28 aa, Mycobacterium
SVSLGLDGAGLGTCWGRQLATSMLADAG

SEQ ID NO: 1248026 - protein, 19 aa, Mycobacterium
SVSLPEGWLTDPDDCTVPA

SEQ ID NO: 1248027 - protein, 27 aa, Mycobacterium
SVSRARRAGVSSFGFGGTNAHVILEQA

SEQ ID NO: 1248028 - protein, 27 aa, Mycobacterium
SVTEALRAGGFFHHAKVEMRWVASDDC

SEQ ID NO: 1248029 - protein, 24 aa, Mycobacterium
SVTGEMFIALAGRVATAVLVETPG

SEQ ID NO: 1248030 - protein, 17 aa, Mycobacterium
SVVALAYADGVLFVAEN

SEQ ID NO: 1248031 - protein, 24 aa, Mycobacterium
SVVEDIYRTFGIEFTDGAREAMAR

SEQ ID NO: 1248032 - protein, 21 aa, Mycobacterium
SVVFAGTWAKTFTRMTSMEAA

SEQ ID NO: 1248033 - protein, 19 aa, Mycobacterium
SVYAMAVLFALDRADARDE

SEQ ID NO: 1248034 - protein, 22 aa, Mycobacterium
SWDEMLTRAAGFARTLRSLGVG

SEQ ID NO: 1248035 - protein, 31 aa, Mycobacterium
SWDLCVGHAGRITAPRGWELVRHAGPLPSHT

SEQ ID NO: 1248036 - protein, 20 aa, Mycobacterium
SWGPREWASYNGEWLAAWLA

SEQ ID NO: 1248037 - protein, 21 aa, Mycobacterium
SWHDFCAKGRTAAELVDHPRR

SEQ ID NO: 1248038 - protein, 22 aa, Mycobacterium
SWIRREPVGVIGQVAPWNYPMM

SEQ ID NO: 1248039 - protein, 26 aa, Mycobacterium
SWLDRVPPVAWWCRRDLSGGQIVEQA

SEQ ID NO: 1248040 - protein, 21 aa, Mycobacterium
SWLPCFHDMGMVGFLTIPMYF

SEQ ID NO: 1248041 - protein, 25 aa, Mycobacterium
SWMEIEAFRLLTLQTAWKIDQYNDY

SEQ ID NO: 1248042 - protein, 19 aa, Mycobacterium
SWNRPTWTIAELEAAKAGR

SEQ ID NO: 1248043 - protein, 21 aa, Mycobacterium
SWPNRTDPGGSRGLDDYFTRD

SEQ ID NO: 1248044 - protein, 17 aa, Mycobacterium
SWPVYRQLTGDDALGRG

SEQ ID NO: 1248045 - protein, 23 aa, Mycobacterium
SWTDPKGGYFVSLDVWPGTARRT

SEQ ID NO: 1248046 - protein, 24 aa, Mycobacterium
SWVLLELPGGWGPSAFLQSPAVID

SEQ ID NO: 1248047 - protein, 20 aa, Mycobacterium
SYAFRPEAVGGLPYTPAPEA

SEQ ID NO: 1248048 - protein, 18 aa, Mycobacterium
SYEVPKTYVATVLGTVPR

SEQ ID NO: 1248049 - protein, 29 aa, Mycobacterium
SYGDAEGALTFMSGWMGVDLARFGLDEPV

SEQ ID NO: 1248050 - protein, 28 aa, Mycobacterium
SYHREIAMNFSLDGAWGQWVNRWTAEEN

SEQ ID NO: 1248051 - protein, 19 aa, Mycobacterium
SYLDRAGHDVVLIDDDFGN

SEQ ID NO: 1248052 - protein, 17 aa, Mycobacterium
SYLLPSVRGELLARLGR

SEQ ID NO: 1248053 - protein, 20 aa, Mycobacterium
SYMAYRRLEEHVGLFRDYLR

SEQ ID NO: 1248054 - protein, 25 aa, Mycobacterium
SYNRPKLPGIPGIKDFTGHVFHSAR

SEQ ID NO: 1248055 - protein, 20 aa, Mycobacterium
SYPDMVQRALPFCGSSKTSE

SEQ ID NO: 1248056 - protein, 41 aa, Mycobacterium
SYPVLAVTLNEEFPRLKVYRGPRKKGVRYFGPYSHAWAIRE

SEQ ID NO: 1248057 - protein, 27 aa, Mycobacterium
SYQAVRIIRMFVEFWDRTRLAEQEAIF

SEQ ID NO: 1248058 - protein, 33 aa, Mycobacterium
SYQCAIDAIAGRCFPSYALRRGAKALGALAQFE

SEQ ID NO: 1248059 - protein, 19 aa, Mycobacterium
SYQRACLHAIDYLTKFGYS

SEQ ID NO: 1248060 - protein, 22 aa, Mycobacterium
SYRARVAPFNVNYRYVDEELTY

SEQ ID NO: 1248061 - protein, 25 aa, Mycobacterium
SYRELPLRLFEFGSVYRYEKSGVVH

SEQ ID NO: 1248062 - protein, 26 aa, Mycobacterium
SYRSEIKANWKLFIDAFVEFYHAPIL

SEQ ID NO: 1248063 - protein, 21 aa, Mycobacterium
SYSESFGLVAVEAQACGTPVV

SEQ ID NO: 1248064 - protein, 23 aa, Mycobacterium
SYSSAELAGGFWTVGAMTSRTRI

SEQ ID NO: 1248065 - protein, 17 aa, Mycobacterium
SYVAGWIKRGPTGFIGT

SEQ ID NO: 1248066 - protein, 30 aa, Mycobacterium
SYVFAAELFPRMAVPKAWYDAGIAHRSESL

SEQ ID NO: 1248067 - protein, 17 aa, Mycobacterium
TAAAIALLFENFTVVMV

SEQ ID NO: 1248068 - protein, 20 aa, Mycobacterium
TAAALRFEVRGIRDGKVAVV

SEQ ID NO: 1248069 - protein, 18 aa, Mycobacterium
TAAALRGARTVQRGAVDQ

SEQ ID NO: 1248070 - protein, 18 aa, Mycobacterium
TAAELVAAVADFLDNEVR

SEQ ID NO: 1248071 - protein, 17 aa, Mycobacterium
TAAEVAAGIAFLAAPGA

SEQ ID NO: 1248072 - protein, 24 aa, Mycobacterium
TAAFADQMALAWQLASSQRRMQEL

SEQ ID NO: 1248073 - protein, 17 aa, Mycobacterium
TAAGLGTCALTHVTELP

SEQ ID NO: 1248074 - protein, 19 aa, Mycobacterium
TAAHMGFRMITLASESQAL

SEQ ID NO: 1248075 - protein, 20 aa, Mycobacterium
TAALGGLVDRYHLQGEKLGA

SEQ ID NO: 1248076 - protein, 23 aa, Mycobacterium
TAAPRASFLAALADTMAPGDALL

SEQ ID NO: 1248077 - protein, 21 aa, Mycobacterium
TAAQGSYIWDGEGRRLLDFSC

SEQ ID NO: 1248078 - protein, 19 aa, Mycobacterium
TAAQRYGFRLVDLYHAESM

SEQ ID NO: 1248079 - protein, 26 aa, Mycobacterium
TAAVCLPHDWLTWRLSGSDDIGDLHT

SEQ ID NO: 1248080 - protein, 20 aa, Mycobacterium
TAAVPARLFAGTTLEQPAGA

SEQ ID NO: 1248081 - protein, 18 aa, Mycobacterium
TACLFDLDGVLTDTASVH

SEQ ID NO: 1248082 - protein, 17 aa, Mycobacterium
TADDWRRMLSVHLDGGF

SEQ ID NO: 1248083 - protein, 24 aa, Mycobacterium
TADGCNTFAAGICFLPQDPVARAE

SEQ ID NO: 1248084 - protein, 17 aa, Mycobacterium
TADGDLVGAGWISGGSD

SEQ ID NO: 1248085 - protein, 18 aa, Mycobacterium
TADGLRIDTGMYLIGMEE

SEQ ID NO: 1248086 - protein, 26 aa, Mycobacterium
TADLKARFAADVWPLVDVLLRGARRL

SEQ ID NO: 1248087 - protein, 19 aa, Mycobacterium
TADSLSFVLDDAVLTADTV

SEQ ID NO: 1248088 - protein, 17 aa, Mycobacterium
TADSSQRLYSWAEASSY

SEQ ID NO: 1248089 - protein, 21 aa, Mycobacterium
TAEAAGLAAYWHGHSTTVVEV

SEQ ID NO: 1248090 - protein, 25 aa, Mycobacterium
TAEEISYLLGHSGVRGFLVEADLTA

SEQ ID NO: 1248091 - protein, 20 aa, Mycobacterium
TAELKRIWTDSAHRRRGFGR

SEQ ID NO: 1248092 - protein, 19 aa, Mycobacterium
TAELPPGVCGQWRQYADHD

SEQ ID NO: 1248093 - protein, 26 aa, Mycobacterium
TAEPFDAVVCSLVLCSVDDPDGVLRE

SEQ ID NO: 1248094 - protein, 26 aa, Mycobacterium
TAEQMKMFLTRLGFNSKIVVTGDITQ

SEQ ID NO: 1248095 - protein, 20 aa, Mycobacterium
TAERGVFDFFFIGDRLVGLP

SEQ ID NO: 1248096 - protein, 21 aa, Mycobacterium
TAEYPPLCEKYGIPIVVTGFE

SEQ ID NO: 1248097 - protein, 24 aa, Mycobacterium
TAFDLGRRGPLTAAVARLDALIRA

SEQ ID NO: 1248098 - protein, 21 aa, Mycobacterium
TAGALAEWMTGAGAGVALAEV

SEQ ID NO: 1248099 - protein, 19 aa, Mycobacterium
TAGEWDWTPAVTLAEGVAR

SEQ ID NO: 1248100 - protein, 18 aa, Mycobacterium
TAGFPNLFMVTGPGSPSV

SEQ ID NO: 1248101 - protein, 17 aa, Mycobacterium
TAGGFAFTEMAIVDDEG

SEQ ID NO: 1248102 - protein, 18 aa, Mycobacterium
TAGLDLRAGIARQLTDLG

SEQ ID NO: 1248103 - protein, 20 aa, Mycobacterium
TAGQRWKWSGRRDGETLVEI

SEQ ID NO: 1248104 - protein, 19 aa, Mycobacterium
TAIAHGMLTMGLGGGYITS

SEQ ID NO: 1248105 - protein, 18 aa, Mycobacterium
TAIGRLLADLGAHVTAVG

SEQ ID NO: 1248106 - protein, 18 aa, Mycobacterium
TAILPVGRLIAGRVRRVN

SEQ ID NO: 1248107 - protein, 18 aa, Mycobacterium
TAKAALSAGVFERLPEGV

SEQ ID NO: 1248108 - protein, 31 aa, Mycobacterium
TAKFVKRFGDVGAELRRAASQYADEVAAGVF

SEQ ID NO: 1248109 - protein, 23 aa, Mycobacterium
TAKREVRLLSRFTGANPHVAIVG

SEQ ID NO: 1248110 - protein, 17 aa, Mycobacterium
TALARRVRRGEVTAPDD

SEQ ID NO: 1248111 - protein, 17 aa, Mycobacterium
TALASSVGITWTSELLT

SEQ ID NO: 1248112 - protein, 19 aa, Mycobacterium
TALDAGVEHFGRLDIVCAN

SEQ ID NO: 1248113 - protein, 19 aa, Mycobacterium
TALELFAGAVMDLHETVTT

SEQ ID NO: 1248114 - protein, 24 aa, Mycobacterium
TALGPEMGRAILALYRSARQPALA

SEQ ID NO: 1248115 - protein, 18 aa, Mycobacterium
TALGRAAEDFGFEAVLTP

SEQ ID NO: 1248116 - protein, 18 aa, Mycobacterium
TALPSAAPFDEWIGTGSP

SEQ ID NO: 1248117 - protein, 24 aa, Mycobacterium
TALRRIADSLGFAGADVDAMLAEF

SEQ ID NO: 1248118 - protein, 22 aa, Mycobacterium
TAMDACVFLLRHGVDAQRLTWI

SEQ ID NO: 1248119 - protein, 18 aa, Mycobacterium
TAMPYEVHVGRWDQLDGL

SEQ ID NO: 1248120 - protein, 17 aa, Mycobacterium
TAMTRRRDLLLTIGSMS

SEQ ID NO: 1248121 - protein, 23 aa, Mycobacterium
TAPARIPDGLSFVEAAPMGCAGV

SEQ ID NO: 1248122 - protein, 35 aa, Mycobacterium
TAPATPWLATTVRLAWRVKLMVSAAVAARVRLRQR

SEQ ID NO: 1248123 - protein, 33 aa, Mycobacterium
TAPELRTPWPREALKDLLVMLGAGPAVVSTIEA

SEQ ID NO: 1248124 - protein, 24 aa, Mycobacterium
TAPSRLFGANGLRTGPDGRVYVAQ

SEQ ID NO: 1248125 - protein, 17 aa, Mycobacterium
TAQATVIKANWQRAAKV

SEQ ID NO: 1248126 - protein, 17 aa, Mycobacterium
TAQRPGDVLTQYGGTTV

SEQ ID NO: 1248127 - protein, 23 aa, Mycobacterium
TAREAGNAYLLWTAGGAPVSMAG

SEQ ID NO: 1248128 - protein, 20 aa, Mycobacterium
TARFTSMAMIHWANATHACT

SEQ ID NO: 1248129 - protein, 18 aa, Mycobacterium
TARGEYKSAANLFTQDSY

SEQ ID NO: 1248130 - protein, 25 aa, Mycobacterium
TARNLRWSSVFRISHRIVDSYGSGR

SEQ ID NO: 1248131 - protein, 20 aa, Mycobacterium
TARRPLRMVCHGIGYTEGFS

SEQ ID NO: 1248132 - protein, 23 aa, Mycobacterium
TARSIEFDGLVLAGSPATVQAKI

SEQ ID NO: 1248133 - protein, 18 aa, Mycobacterium
TARSIPWSKAARDNGQFR

SEQ ID NO: 1248134 - protein, 29 aa, Mycobacterium
TARVKRGMAEMLKGGVIMDVVTPEQARIA

SEQ ID NO: 1248135 - protein, 23 aa, Mycobacterium
TARVLQALLARWGNHARVDLVTT

SEQ ID NO: 1248136 - protein, 24 aa, Mycobacterium
TARVVRRLRLPSPIRDLALGRDGL

SEQ ID NO: 1248137 - protein, 20 aa, Mycobacterium
TASAELYRKDGFARLDGGKG

SEQ ID NO: 1248138 - protein, 19 aa, Mycobacterium
TASALLRCVVRDPDPAAVG

SEQ ID NO: 1248139 - protein, 21 aa, Mycobacterium
TASELHSFFGRHSKTPVPQGL

SEQ ID NO: 1248140 - protein, 24 aa, Mycobacterium
TASTYKRATLRKMGVEYVYDSRST

SEQ ID NO: 1248141 - protein, 21 aa, Mycobacterium
TATANSIAWLLWHSARVQDAQ

SEQ ID NO: 1248142 - protein, 25 aa, Mycobacterium
TATAPRVGVFRPITRSGPARDYILE

SEQ ID NO: 1248143 - protein, 20 aa, Mycobacterium
TATEAMDFWSFAAGAANVIM

SEQ ID NO: 1248144 - protein, 27 aa, Mycobacterium
TATELLDAALIRLSAARGLNAVVHELF

SEQ ID NO: 1248145 - protein, 24 aa, Mycobacterium
TATTRPQGSWSRERAVLAVVDGPG

SEQ ID NO: 1248146 - protein, 25 aa, Mycobacterium
TAVEEIVRWASPIIFMRRNLTEDIE

SEQ ID NO: 1248147 - protein, 31 aa, Mycobacterium
TAVNILLSSRFPMWMAWGPELTFFCNAAYRR

SEQ ID NO: 1248148 - protein, 17 aa, Mycobacterium
TAVPLVFRLLGETGSHA

SEQ ID NO: 1248149 - protein, 17 aa, Mycobacterium
TAYGPAFLDDIPKPLGR

SEQ ID NO: 1248150 - protein, 25 aa, Mycobacterium
TAYLRARPADGWLRVICTTTQIGQE

SEQ ID NO: 1248151 - protein, 23 aa, Mycobacterium
TAYVVSMPCVEWFESQPKEYRDS

SEQ ID NO: 1248152 - protein, 18 aa, Mycobacterium
TCHYVMGGIEVDPDTGAA

SEQ ID NO: 1248153 - protein, 22 aa, Mycobacterium
TCIQCGNCAFVCPHSVIRTKLY

SEQ ID NO: 1248154 - protein, 19 aa, Mycobacterium
TCLDEGALTFVAKSESGNH

SEQ ID NO: 1248155 - protein, 22 aa, Mycobacterium
TCPPGVVGEIYMRRSPGAAPTY

SEQ ID NO: 1248156 - protein, 21 aa, Mycobacterium
TDAGKFARRVNMEVASHTALM

SEQ ID NO: 1248157 - protein, 23 aa, Mycobacterium
TDAGKPAIEIVKFDEQDAVANAV

SEQ ID NO: 1248158 - protein, 17 aa, Mycobacterium
TDAHRWGKYLGLQAGDL

SEQ ID NO: 1248159 - protein, 18 aa, Mycobacterium
TDALLLGRRTYDIFAAYW

SEQ ID NO: 1248160 - protein, 18 aa, Mycobacterium
TDAMLDWQTARFLELADP

SEQ ID NO: 1248161 - protein, 23 aa, Mycobacterium
TDDDRYRWLTALHTVAINEVSLR

SEQ ID NO: 1248162 - protein, 19 aa, Mycobacterium
TDDGHEWGLEYLFGVLDTA

SEQ ID NO: 1248163 - protein, 23 aa, Mycobacterium
TDDLLVCIPLPGRNRYRMSMLVP

SEQ ID NO: 1248164 - protein, 22 aa, Mycobacterium
TDDRMSAHLGIQVKHREPGHAV

SEQ ID NO: 1248165 - protein, 26 aa, Mycobacterium
TDEDFRHTFDWCVTSAFIMSQLTARH

SEQ ID NO: 1248166 - protein, 22 aa, Mycobacterium
TDEIPHKLVIAGGGATLRTMDD

SEQ ID NO: 1248167 - protein, 22 aa, Mycobacterium
TDESRWPAFTAKSVDATPVRAI

SEQ ID NO: 1248168 - protein, 23 aa, Mycobacterium
TDFELTDLILLCPCGSADVEVRA

SEQ ID NO: 1248169 - protein, 24 aa, Mycobacterium
TDGFLRLDLAFSRDQPKPVYVQHR

SEQ ID NO: 1248170 - protein, 20 aa, Mycobacterium
TDGFRILIRDSPAAITSGTY

SEQ ID NO: 1248171 - protein, 21 aa, Mycobacterium
TDGPVAFAPPYLIAGQALAVD

SEQ ID NO: 1248172 - protein, 20 aa, Mycobacterium
TDGRLGWNIVTSFNQNMFRS

SEQ ID NO: 1248173 - protein, 20 aa, Mycobacterium
TDHPDRFRAMVVESSNPAHS

SEQ ID NO: 1248174 - protein, 23 aa, Mycobacterium
TDIAAQFGTPVFIIDEADFRSRC

SEQ ID NO: 1248175 - protein, 22 aa, Mycobacterium
TDIKPAILALGRDAPRAAFIDA

SEQ ID NO: 1248176 - protein, 23 aa, Mycobacterium
TDIPVTVKFRIGIDDAHHTHLDA

SEQ ID NO: 1248177 - protein, 23 aa, Mycobacterium
TDKAKSLLAKRGFDPVLGARPLR

SEQ ID NO: 1248178 - protein, 22 aa, Mycobacterium
TDLGRRAVSVGTDITDEAQVAN

SEQ ID NO: 1248179 - protein, 17 aa, Mycobacterium
TDMPRGGHFAAFEQPEL

SEQ ID NO: 1248180 - protein, 21 aa, Mycobacterium
TDMVLRLAGQLAEHLVDTDEL

SEQ ID NO: 1248181 - protein, 17 aa, Mycobacterium
TDMVLRLASGMERRSGG

SEQ ID NO: 1248182 - protein, 21 aa, Mycobacterium
TDNGWVWKFDPEIFGGDLLEQ

SEQ ID NO: 1248183 - protein, 18 aa, Mycobacterium
TDNLRLVGLHSHIGSQIF

SEQ ID NO: 1248184 - protein, 17 aa, Mycobacterium
TDPDALAQWWAEAVGGE

SEQ ID NO: 1248185 - protein, 20 aa, Mycobacterium
TDPLLLLPLLRAMTPVPVLL

SEQ ID NO: 1248186 - protein, 23 aa, Mycobacterium
TDPSDIRTIIAWEEAHKNRSRVV

SEQ ID NO: 1248187 - protein, 19 aa, Mycobacterium
TDPTWVLRFVAAREDRLSG

SEQ ID NO: 1248188 - protein, 20 aa, Mycobacterium
TDRHVELLWSLSRAPDADSA

SEQ ID NO: 1248189 - protein, 27 aa, Mycobacterium
TDRLCIPVPFYHCFGMVMGNLGCTTHG

SEQ ID NO: 1248190 - protein, 24 aa, Mycobacterium
TDRLPLRAPERWQEFEPTLRRSIE

SEQ ID NO: 1248191 - protein, 24 aa, Mycobacterium
TDRMRPLRIDDHVVHQIWMPYHWG

SEQ ID NO: 1248192 - protein, 24 aa, Mycobacterium
TDRPHPRGELLVRSTQLFPGYYKR

SEQ ID NO: 1248193 - protein, 17 aa, Mycobacterium
TDRRGWIDWVVRGSRQL

SEQ ID NO: 1248194 - protein, 25 aa, Mycobacterium
TDSFWRDLVAFTWNIKTLEGRDGIA

SEQ ID NO: 1248195 - protein, 23 aa, Mycobacterium
TDSPFPGLTTHAYLWTGGPTGNV

SEQ ID NO: 1248196 - protein, 17 aa, Mycobacterium
TDSRLGIDVPLARHAIS

SEQ ID NO: 1248197 - protein, 27 aa, Mycobacterium
TDTGSFRWASARAHRLAARLVEIGVDN

SEQ ID NO: 1248198 - protein, 20 aa, Mycobacterium
TDVFLLMCAPIHVVENLAAP

SEQ ID NO: 1248199 - protein, 17 aa, Mycobacterium
TDVVIDFTHPSVVMDNL

SEQ ID NO: 1248200 - protein, 26 aa, Mycobacterium
TEAAHGRRLLRIAASTMFAEHAAPGL

SEQ ID NO: 1248201 - protein, 21 aa, Mycobacterium
TEAIAGMNAVAGWSGAPRPVS

SEQ ID NO: 1248202 - protein, 20 aa, Mycobacterium
TEAIKRVALVADRGAQVRME

SEQ ID NO: 1248203 - protein, 24 aa, Mycobacterium
TEAKELFNGFWILDVSSKEEAKQW

SEQ ID NO: 1248204 - protein, 22 aa, Mycobacterium
TEALTNWYVRRSRSRFWDEDPD

SEQ ID NO: 1248205 - protein, 30 aa, Mycobacterium
TEAPAEMHFYFPRYRALCMAENATHNLHNL

SEQ ID NO: 1248206 - protein, 34 aa, Mycobacterium
TEARWAEAEPAWAYGRVALQWAERYYAAERELAQ

SEQ ID NO: 1248207 - protein, 23 aa, Mycobacterium
TEAVAAFARLWVADEHWAAADRV

SEQ ID NO: 1248208 - protein, 24 aa, Mycobacterium
TEDEVWRRNVDFLDCAETPIRPLI

SEQ ID NO: 1248209 - protein, 19 aa, Mycobacterium
TEDLIETWISYKRENEIMP

SEQ ID NO: 1248210 - protein, 23 aa, Mycobacterium
TEDPALVGMPSWYAENGQYLTTQ

SEQ ID NO: 1248211 - protein, 19 aa, Mycobacterium
TEEELRILITPMAASGAEP

SEQ ID NO: 1248212 - protein, 18 aa, Mycobacterium
TEEITDWQLAANAEHSST

SEQ ID NO: 1248213 - protein, 28 aa, Mycobacterium
TEEQKKWAVLAAERGWGATMVLTEPDAG

SEQ ID NO: 1248214 - protein, 22 aa, Mycobacterium
TEEQLARIGWRNRQGVGDSANQ

SEQ ID NO: 1248215 - protein, 25 aa, Mycobacterium
TEFAELRPRLVYDRDAGTLTARPGA

SEQ ID NO: 1248216 - protein, 20 aa, Mycobacterium
TEFEAAIGRNVRQLRQQHGL

SEQ ID NO: 1248217 - protein, 27 aa, Mycobacterium
TEGVDTRIACGVISPASAETSVSTSTS

SEQ ID NO: 1248218 - protein, 17 aa, Mycobacterium
TEGVHFFTRGKAITQRW

SEQ ID NO: 1248219 - protein, 27 aa, Mycobacterium
TEGVPRWRKGTGQGWLTAEYAMLPAAT

SEQ ID NO: 1248220 - protein, 17 aa, Mycobacterium
TEHWDRALLALAGNDYA

SEQ ID NO: 1248221 - protein, 21 aa, Mycobacterium
TEIAERGGVRRCPSLPAEVRS

SEQ ID NO: 1248222 - protein, 19 aa, Mycobacterium
TEIEGAWKPDQYSNPMGPE

SEQ ID NO: 1248223 - protein, 18 aa, Mycobacterium
TEIGRRLAPEPVLSAALG

SEQ ID NO: 1248224 - protein, 18 aa, Mycobacterium
TEIRRLAKDIDFRPRKSF

SEQ ID NO: 1248225 - protein, 21 aa, Mycobacterium
TEISPDWHLRMQAVVQRHVDA

SEQ ID NO: 1248226 - protein, 17 aa, Mycobacterium
TEIWECLNTTYNALAER

SEQ ID NO: 1248227 - protein, 23 aa, Mycobacterium
TEKHYRRARGRKVELTLSDGSQL

SEQ ID NO: 1248228 - protein, 17 aa, Mycobacterium
TELDTVLGLTVGADDYV

SEQ ID NO: 1248229 - protein, 17 aa, Mycobacterium
TELEPDFDRAFKELAKQ

SEQ ID NO: 1248230 - protein, 17 aa, Mycobacterium
TELLAVFDTYRTRFGAL

SEQ ID NO: 1248231 - protein, 36 aa, Mycobacterium
TELLDEAWWFPAMCWPDGRLQFMLNERMMPAQFVVN

SEQ ID NO: 1248232 - protein, 17 aa, Mycobacterium
TELPPPDDAWAWAHAQV

SEQ ID NO: 1248233 - protein, 23 aa, Mycobacterium
TELQRRYGLEHAYAVACDTSTAA

SEQ ID NO: 1248234 - protein, 21 aa, Mycobacterium
TELRATMKREFAALREKPNEL

SEQ ID NO: 1248235 - protein, 18 aa, Mycobacterium
TEMGRRVIEKITRIAPDF

SEQ ID NO: 1248236 - protein, 22 aa, Mycobacterium
TENYRTLVIFDEIHHGGDAKTW

SEQ ID NO: 1248237 - protein, 21 aa, Mycobacterium
TEPALWPWADVLANAMVLDGQ

SEQ ID NO: 1248238 - protein, 25 aa, Mycobacterium
TEPEAFKWIQRAAMDRRTTMKRVAE

SEQ ID NO: 1248239 - protein, 24 aa, Mycobacterium
TEPLRRLPVRPGRTTAFLCGPEPM

SEQ ID NO: 1248240 - protein, 17 aa, Mycobacterium
TEPWGERYCQFEDPNGI

SEQ ID NO: 1248241 - protein, 24 aa, Mycobacterium
TEQDARLVAVTVAWLSGELPQRQI

SEQ ID NO: 1248242 - protein, 19 aa, Mycobacterium
TERAVARFQRRGVDVTAIV

SEQ ID NO: 1248243 - protein, 19 aa, Mycobacterium
TERILYYTGVNYKIGETHD

SEQ ID NO: 1248244 - protein, 26 aa, Mycobacterium
TERLPAPRVSPFPAVFQDVSLIVDDD

SEQ ID NO: 1248245 - protein, 25 aa, Mycobacterium
TERLRAVFGSCRYPKTGVEEIDEKL

SEQ ID NO: 1248246 - protein, 18 aa, Mycobacterium
TERMKVAAAEAIFSVVGD

SEQ ID NO: 1248247 - protein, 23 aa, Mycobacterium
TERWREIAGPVTARFPDSDLGDV

SEQ ID NO: 1248248 - protein, 24 aa, Mycobacterium
TESALRFVGAATFEALSGHPVHTG

SEQ ID NO: 1248249 - protein, 20 aa, Mycobacterium
TESLPLIASSVMSKKIAEGA

SEQ ID NO: 1248250 - protein, 26 aa, Mycobacterium
TEVFDLRPGAIVRDLDLLRPIYAPTA

SEQ ID NO: 1248251 - protein, 20 aa, Mycobacterium
TEVIVAPAYEPGAVEILSRK

SEQ ID NO: 1248252 - protein, 19 aa, Mycobacterium
TEVKRRDRALLSKDATIRE

SEQ ID NO: 1248253 - protein, 18 aa, Mycobacterium
TEVSCKFAPDDVAAELAA

SEQ ID NO: 1248254 - protein, 23 aa, Mycobacterium
TEVVACRPWLLAELDAVRPEVVV

SEQ ID NO: 1248255 - protein, 18 aa, Mycobacterium
TEVWAIDGDGCFQMTNQE

SEQ ID NO: 1248256 - protein, 18 aa, Mycobacterium
TEWPDGRTTLAFRLDGVE

SEQ ID NO: 1248257 - protein, 21 aa, Mycobacterium
TEWYATAYVDGFRWVMPTNVV

SEQ ID NO: 1248258 - protein, 18 aa, Mycobacterium
TFADLQIHPEVLRAVTDV

SEQ ID NO: 1248259 - protein, 22 aa, Mycobacterium
TFAELKGTFDLILNTVSANIDL

SEQ ID NO: 1248260 - protein, 18 aa, Mycobacterium
TFAGDAVFAPGFDNPQWH

SEQ ID NO: 1248261 - protein, 25 aa, Mycobacterium
TFALPRKDFEQWAGNRTRFRMEDFY

SEQ ID NO: 1248262 - protein, 20 aa, Mycobacterium
TFAPMGPWITTRDEVVDPNA

SEQ ID NO: 1248263 - protein, 24 aa, Mycobacterium
TFASLPYRIMHEFQTPIYDAIRER

SEQ ID NO: 1248264 - protein, 18 aa, Mycobacterium
TFDFAMARLQTVSVAAGA

SEQ ID NO: 1248265 - protein, 17 aa, Mycobacterium
TFDKWPMIPVLDDGNRV

SEQ ID NO: 1248266 - protein, 19 aa, Mycobacterium
TFEMGDPKHLGYLLRVVRN

SEQ ID NO: 1248267 - protein, 26 aa, Mycobacterium
TFFWFTSPSWMMWNFQVAGLLVGATI

SEQ ID NO: 1248268 - protein, 22 aa, Mycobacterium
TFGGLKPVHALGECGRVELVDI

SEQ ID NO: 1248269 - protein, 25 aa, Mycobacterium
TFGRKIIDHQGLGFLLADMAAAVVS

SEQ ID NO: 1248270 - protein, 20 aa, Mycobacterium
TFKEFPPRQEPASFTIDHAV

SEQ ID NO: 1248271 - protein, 23 aa, Mycobacterium
TFKELRVGSIAGYRQMREDPNNP

SEQ ID NO: 1248272 - protein, 30 aa, Mycobacterium; identical to SEQ ID NO: 737388

SEQ ID NO: 1248273 - protein, 18 aa, Mycobacterium
TFLRGREEIVEFLTDKWA

SEQ ID NO: 1248274 - protein, 19 aa, Mycobacterium
TFPENVDWGQVPGDLATAF

SEQ ID NO: 1248275 - protein, 17 aa, Mycobacterium
TFQHLWREVGANIERYH

SEQ ID NO: 1248276 - protein, 17 aa, Mycobacterium
TFQKGLAHHTAAWRAAR

SEQ ID NO: 1248277 - protein, 20 aa, Mycobacterium
TFREALRLGHNYIGTEHLLL

SEQ ID NO: 1248278 - protein, 21 aa, Mycobacterium
TFRFNEVIHYWALDGEWDCFA

SEQ ID NO: 1248279 - protein, 18 aa, Mycobacterium
TFSRMYQEMINWCKTNGQ

SEQ ID NO: 1248280 - protein, 18 aa, Mycobacterium
TFTRLPCRVGYLRCENGI

SEQ ID NO: 1248281 - protein, 20 aa, Mycobacterium
TFTSAPGMSCNRRMFEQIVV

SEQ ID NO: 1248282 - protein, 19 aa, Mycobacterium
TFVAEPRVRFHIGSFSEEV

SEQ ID NO: 1248283 - protein, 19 aa, Mycobacterium
TFVRCLQSGYAANVEAVLT

SEQ ID NO: 1248284 - protein, 26 aa, Mycobacterium
TGAALLPVHCWFDGDGWGMRVFAPLD

SEQ ID NO: 1248285 - protein, 24 aa, Mycobacterium
TGACSRIPSLPANGRIPPKAAIKA

SEQ ID NO: 1248286 - protein, 24 aa, Mycobacterium
TGADARGPALLIFDREPGVWRVRQ

SEQ ID NO: 1248287 - protein, 24 aa, Mycobacterium
TGAEVFAGVAGSLARGFRGEDALY

SEQ ID NO: 1248288 - protein, 18 aa, Mycobacterium
TGAEVFVDRGARRLTAAA

SEQ ID NO: 1248289 - protein, 19 aa, Mycobacterium
TGAHLSFGQGLHFCLGSSL

SEQ ID NO: 1248290 - protein, 32 aa, Mycobacterium
TGAIEGWMPFGRVFETLTWGRRHVVMGANQID

SEQ ID NO: 1248291 - protein, 25 aa, Mycobacterium
TGAIVKRPRVIVDEFGNESIGVRSI

SEQ ID NO: 1248292 - protein, 18 aa, Mycobacterium
TGAIVPIVAPREGEPVVV

SEQ ID NO: 1248293 - protein, 18 aa, Mycobacterium
TGALKGWFDAHAESVLFL

SEQ ID NO: 1248294 - protein, 25 aa, Mycobacterium
TGALRAAGLPEEWSPDSESSREVLR

SEQ ID NO: 1248295 - protein, 28 aa, Mycobacterium
TGAMGVPDYLGWDWKSKAGIPIVCVPGC

SEQ ID NO: 1248296 - protein, 26 aa, Mycobacterium
TGATPRYLLDFSRRFPDAAVIRLERD

SEQ ID NO: 1248297 - protein, 22 aa, Mycobacterium
TGAVELRLLAPTVAVSQAPIAD

SEQ ID NO: 1248298 - protein, 19 aa, Mycobacterium
TGDEPFLFHCGQRQLFPLV

SEQ ID NO: 1248299 - protein, 18 aa, Mycobacterium
TGELADWYRLDAGHLRVG

SEQ ID NO: 1248300 - protein, 24 aa, Mycobacterium
TGELPAWQWEGLITGPTRLVAITS

SEQ ID NO: 1248301 - protein, 18 aa, Mycobacterium
TGEVVRPILWGPGKAHAV

SEQ ID NO: 1248302 - protein, 20 aa, Mycobacterium
TGGFTEFVPLPFVHQSSPLY

SEQ ID NO: 1248303 - protein, 24 aa, Mycobacterium
TGGQRIDLFGARVEQLPEIWRRLV

SEQ ID NO: 1248304 - protein, 26 aa, Mycobacterium
TGGRIGWNVVTGYLPAAARNMGQTDQ

SEQ ID NO: 1248305 - protein, 18 aa, Mycobacterium
TGGRIVLAQGRFDPGQVM

SEQ ID NO: 1248306 - protein, 18 aa, Mycobacterium
TGGRIVLTTSRWHVGGPE

SEQ ID NO: 1248307 - protein, 18 aa, Mycobacterium
TGICQGELDEIRDNLPTY

SEQ ID NO: 1248308 - protein, 25 aa, Mycobacterium
TGIDLPAWMFRLARGESDVLAPHLA

SEQ ID NO: 1248309 - protein, 19 aa, Mycobacterium
TGIDPAAVSPWWMQRRLLL

SEQ ID NO: 1248310 - protein, 17 aa, Mycobacterium
TGIPVLFIAGRGGAGRT

SEQ ID NO: 1248311 - protein, 17 aa, Mycobacterium
TGIRRAGADIVLTYWAA

SEQ ID NO: 1248312 - protein, 24 aa, Mycobacterium
TGIVDIRTGVPFFDHMLTSLGSHA

SEQ ID NO: 1248313 - protein, 18 aa, Mycobacterium
TGKDGKLYFPPREADPAT

SEQ ID NO: 1248314 - protein, 22 aa, Mycobacterium
TGKPVRLAREFDVPGSVDNIDF

SEQ ID NO: 1248315 - protein, 18 aa, Mycobacterium
TGLDDVWGAALDDVQPAD

SEQ ID NO: 1248316 - protein, 17 aa, Mycobacterium
TGLDGRLVWMHQVHSDR

SEQ ID NO: 1248317 - protein, 25 aa, Mycobacterium
TGLDLRSDLLIEIAVLVTDADLNIL

SEQ ID NO: 1248318 - protein, 21 aa, Mycobacterium
TGLMAALALHRRGVPAVLVDR

SEQ ID NO: 1248319 - protein, 24 aa, Mycobacterium
TGLPEYRNGGLLLDAGVLALRTPE

SEQ ID NO: 1248320 - protein, 18 aa, Mycobacterium
TGLPVDFTGYIGCRDTVA

SEQ ID NO: 1248321 - protein, 19 aa, Mycobacterium
TGLSARIGLERGHDVGCSW

SEQ ID NO: 1248322 - protein, 19 aa, Mycobacterium
TGLSRPTLHYYFATREEVY

SEQ ID NO: 1248323 - protein, 17 aa, Mycobacterium
TGLVLDTDLRWRIVTAL

SEQ ID NO: 1248324 - protein, 21 aa, Mycobacterium
TGMRLPHRYFAVSALGAPPSG

SEQ ID NO: 1248325 - protein, 30 aa, Mycobacterium
TGMYELEFPAPQLSAADGRGPVLLHALEGF

SEQ ID NO: 1248326 - protein, 23 aa, Mycobacterium
TGNKADAQWRWLAHTLTVDLLRE

SEQ ID NO: 1248327 - protein, 21 aa, Mycobacterium
TGNTGDPVWPQAMNLVEKFNA

SEQ ID NO: 1248328 - protein, 25 aa, Mycobacterium
TGPFRLHHAHIRMLLQSAGTTGDLD

SEQ ID NO: 1248329 - protein, 29 aa, Mycobacterium
TGPIGDWVSRIGLIPAHRAVATQALQSGA

SEQ ID NO: 1248330 - protein, 24 aa, Mycobacterium
TGPLPLPPSKHVAVVACMDARLDV

SEQ ID NO: 1248331 - protein, 20 aa, Mycobacterium
TGQRGATIWFTGLPASGKST

SEQ ID NO: 1248332 - protein, 17 aa, Mycobacterium
TGRENLVLFGRLQGLAK

SEQ ID NO: 1248333 - protein, 26 aa, Mycobacterium
TGRLAEFPELQWRDGAAVTVVVAAEN

SEQ ID NO: 1248334 - protein, 18 aa, Mycobacterium
TGRMFACEHEGIEPDLIV

SEQ ID NO: 1248335 - protein, 20 aa, Mycobacterium
TGRPEWEGVSGADMLRHVRG

SEQ ID NO: 1248336 - protein, 23 aa, Mycobacterium
TGRRFEALSALSAGVKEVRAVIE

SEQ ID NO: 1248337 - protein, 22 aa, Mycobacterium
TGRRIGAWVVDETWWAQRREQA

SEQ ID NO: 1248338 - protein, 23 aa, Mycobacterium
TGRTVVLRLRFDDFSRVTRSHTM

SEQ ID NO: 1248339 - protein, 21 aa, Mycobacterium
TGSAEHFCFLVTQRRPRTELD

SEQ ID NO: 1248340 - protein, 17 aa, Mycobacterium
TGSCGTCMAQVVSGSAR

SEQ ID NO: 1248341 - protein, 20 aa, Mycobacterium
TGSIDRLRTLAATLRQPVML

SEQ ID NO: 1248342 - protein, 23 aa, Mycobacterium
TGSRDLKVWLADGTNYPGQGDIR

SEQ ID NO: 1248343 - protein, 27 aa, Mycobacterium
TGSRLARPPLLVPVLRAGLGMVDQAHA

SEQ ID NO: 1248344 - protein, 18 aa, Mycobacterium
TGSTRAGIEVARNAAPTV

SEQ ID NO: 1248345 - protein, 18 aa, Mycobacterium
TGTDDWLGEWTFAFPQGS

SEQ ID NO: 1248346 - protein, 30 aa, Mycobacterium
TGTDFTWELLLVCGDPAAADTYFAGFDKTK

SEQ ID NO: 1248347 - protein, 23 aa, Mycobacterium
TGTRAHSARSWLGDNAIHKLGAV

SEQ ID NO: 1248348 - protein, 21 aa, Mycobacterium
TGTRPWVMAPMIATAGEAKDF

SEQ ID NO: 1248349 - protein, 19 aa, Mycobacterium
TGTTIRFWADPDIFETTSY

SEQ ID NO: 1248350 - protein, 20 aa, Mycobacterium
TGTVYLRYGVADGIPATGDM

SEQ ID NO: 1248351 - protein, 20 aa, Mycobacterium
TGVLELLNRLGISPLPNTAG

SEQ ID NO: 1248352 - protein, 20 aa, Mycobacterium
TGVPRSGLSTVFSPTRSTFG

SEQ ID NO: 1248353 - protein, 17 aa, Mycobacterium
TGVPSLRRAVAERYCER

SEQ ID NO: 1248354 - protein, 23 aa, Mycobacterium
TGVQRVFFGWAQVWRTKYRSAEA

SEQ ID NO: 1248355 - protein, 19 aa, Mycobacterium
TGVRLEGPKPRWARPDGGE

SEQ ID NO: 1248356 - protein, 17 aa, Mycobacterium
TGVRVFFPDPWPKARHH

SEQ ID NO: 1248357 - protein, 20 aa, Mycobacterium
TGYGSMNGWAADLIGQDVAD

SEQ ID NO: 1248358 - protein, 18 aa, Mycobacterium
THAALRYRAVPDRYLVFE

SEQ ID NO: 1248359 - protein, 19 aa, Mycobacterium
THAEIAAGVSQLVGGAPTV

SEQ ID NO: 1248360 - protein, 17 aa, Mycobacterium
THFKNIFEGHVATQYMN

SEQ ID NO: 1248361 - protein, 25 aa, Mycobacterium
THGSTLRFAPPLVITADEIDWAVDR

SEQ ID NO: 1248362 - protein, 24 aa, Mycobacterium
THLRDLIRAGRWDDCQALTDELEG

SEQ ID NO: 1248363 - protein, 22 aa, Mycobacterium
THLRRAVWWRGYSRGPVSPLHR

SEQ ID NO: 1248364 - protein, 23 aa, Mycobacterium
THPDGRSAFALWFTGGIFVDQRG

SEQ ID NO: 1248365 - protein, 18 aa, Mycobacterium
THPLWIVRRTMIDLIRPI

SEQ ID NO: 1248366 - protein, 18 aa, Mycobacterium
THPVSPVFLYAHGDRELA

SEQ ID NO: 1248367 - protein, 28 aa, Mycobacterium
THQIVLWCMGEAHAAVVLDALSRRYGVT

SEQ ID NO: 1248368 - protein, 18 aa, Mycobacterium
THREVIDRGLAVADATAF

SEQ ID NO: 1248369 - protein, 25 aa, Mycobacterium
THRMAGEFNAPIALEPLPYTVARVA

SEQ ID NO: 1248370 - protein, 24 aa, Mycobacterium
THRVLRHRLILGFEAANADVTADR

SEQ ID NO: 1248371 - protein, 18 aa, Mycobacterium
THTEFRKLVSRGFTPRQV

SEQ ID NO: 1248372 - protein, 17 aa, Mycobacterium
TIAELLKPLGYATGQFG

SEQ ID NO: 1248373 - protein, 19 aa, Mycobacterium
TIALPLLRSLHREHGPIAV

SEQ ID NO: 1248374 - protein, 30 aa, Mycobacterium
TIDATICSRLGFRPDVKRIPLFGLGCVAGA

SEQ ID NO: 1248375 - protein, 18 aa, Mycobacterium
TIEDDCLIGMGAVVLNGA

SEQ ID NO: 1248376 - protein, 25 aa, Mycobacterium
TIEFEPRLPAGYADLAAHWPQGRLS

SEQ ID NO: 1248377 - protein, 19 aa, Mycobacterium
TIGALAFGVFPLVTRTSLG

SEQ ID NO: 1248378 - protein, 17 aa, Mycobacterium
TIGELLIKHPTRVVENA

SEQ ID NO: 1248379 - protein, 22 aa, Mycobacterium
TIGRAAAFAGVTIKTVRHYHRI

SEQ ID NO: 1248380 - protein, 31 aa, Mycobacterium
TIGSLAPKMPWPWGAVDFACRALRPAPGTVR

SEQ ID NO: 1248381 - protein, 23 aa, Mycobacterium
TIIEMWLPLSWALNMVNRSMGKD

SEQ ID NO: 1248382 - protein, 26 aa, Mycobacterium
TILLNAKTRRPSVCNAAESVLIDAAI

SEQ ID NO: 1248383 - protein, 17 aa, Mycobacterium
TIPAGKPVFLLGGSANR

SEQ ID NO: 1248384 - protein, 23 aa, Mycobacterium
TIPRIDALLPLPGSRNQLTDGVG

SEQ ID NO: 1248385 - protein, 18 aa, Mycobacterium
TIRRELRAAGVQFDSEND

SEQ ID NO: 1248386 - protein, 33 aa, Mycobacterium
TISGLAGALARDHARSWGGLVVVESAGAAAADT

SEQ ID NO: 1248387 - protein, 26 aa, Mycobacterium
TITAEFAAPVERVWQIYADPRQLEKI

SEQ ID NO: 1248388 - protein, 18 aa, Mycobacterium
TITFAGFLKAYVESIDEL

SEQ ID NO: 1248389 - protein, 17 aa, Mycobacterium
TIVTVSWSLQRVRHGEQ

SEQ ID NO: 1248390 - protein, 19 aa, Mycobacterium
TIYLSTLFFHGFIDRGLNE

SEQ ID NO: 1248391 - protein, 18 aa, Mycobacterium
TKALFRIPDEISLAEAAV

SEQ ID NO: 1248392 - protein, 23 aa, Mycobacterium
TKALRTGFVAAFSVPANQLPDEV

SEQ ID NO: 1248393 - protein, 25 aa, Mycobacterium
TKDELLLALIERIMAESARHWRADT

SEQ ID NO: 1248394 - protein, 24 aa, Mycobacterium
TKDVHIGPSDHVGWLDDRKWAYVR

SEQ ID NO: 1248395 - protein, 18 aa, Mycobacterium
TKEDLLIGLIGRGFLHVL

SEQ ID NO: 1248396 - protein, 24 aa, Mycobacterium
TKGDLYTLWAPRWRDAGDEWEAFL

SEQ ID NO: 1248397 - protein, 20 aa, Mycobacterium
TKGFPCPKGVHPTVWRVLSI

SEQ ID NO: 1248398 - protein, 23 aa, Mycobacterium
TKHFPDNMLTIPLGRPGQSDEVA

SEQ ID NO: 1248399 - protein, 19 aa, Mycobacterium
TKIAAVVGFPSGKHLPAVK

SEQ ID NO: 1248400 - protein, 25 aa, Mycobacterium
TKIDKRLLPTVAVYDGIHAELRSAA

SEQ ID NO: 1248401 - protein, 26 aa, Mycobacterium
TKLAGALSRRGVGFGDRVLILMLNRT

SEQ ID NO: 1248402 - protein, 21 aa, Mycobacterium
TKLPIPKPMVKKAIGETLDYL

SEQ ID NO: 1248403 - protein, 23 aa, Mycobacterium
TKMLRVRLGEPFMARQGAMVAYQ

SEQ ID NO: 1248404 - protein, 22 aa, Mycobacterium
TKPETFGRISVKARQHAARNPF

SEQ ID NO: 1248405 - protein, 24 aa, Mycobacterium
TKQPVGPCYAITPWNFPLAMGTRK

SEQ ID NO: 1248406 - protein, 18 aa, Mycobacterium
TKSAKAFLSTLTERKQVL

SEQ ID NO: 1248407 - protein, 20 aa, Mycobacterium
TKTLAKEWGRYNVTVNAIAY

SEQ ID NO: 1248408 - protein, 19 aa, Mycobacterium
TKWDLPVRIGGHLVDNVDD

SEQ ID NO: 1248409 - protein, 18 aa, Mycobacterium
TLADGIVVLEFVDREDDH

SEQ ID NO: 1248410 - protein, 24 aa, Mycobacterium
TLADIRRRVGLVFQDPDDQLFMPT

SEQ ID NO: 1248411 - protein, 23 aa, Mycobacterium
TLAEGVARTVEWLRATLDSDCDR

SEQ ID NO: 1248412 - protein, 25 aa, Mycobacterium
TLAERKILASLAFRHTAEYDVAVAS

SEQ ID NO: 1248413 - protein, 24 aa, Mycobacterium
TLAGLKPAFYHPTYEERFPQIGWE

SEQ ID NO: 1248414 - protein, 28 aa, Mycobacterium
TLAPHLVKPLPFLFPLTNRWWERPYVAA

SEQ ID NO: 1248415 - protein, 24 aa, Mycobacterium
TLARSVRLLSEFRFEQSDPARFYG

SEQ ID NO: 1248416 - protein, 17 aa, Mycobacterium
TLAYAWRAGDARVVLPV

SEQ ID NO: 1248417 - protein, 29 aa, Mycobacterium
TLCVFDVKPRLWGTGHVRILSDLAQLAAE

SEQ ID NO: 1248418 - protein, 24 aa, Mycobacterium
TLDAFKPRNMRRLQGWVQEHARDL

SEQ ID NO: 1248419 - protein, 20 aa, Mycobacterium
TLDAIRWQYVHGVADESLVD

SEQ ID NO: 1248420 - protein, 18 aa, Mycobacterium
TLDDGRIARIWLNRPHTQ

SEQ ID NO: 1248421 - protein, 28 aa, Mycobacterium
TLDISIPGVLRWRVDITATPTTRALTAV

SEQ ID NO: 1248422 - protein, 22 aa, Mycobacterium
TLDKLEAIPGFTAELTKSQIRQ

SEQ ID NO: 1248423 - protein, 23 aa, Mycobacterium
TLDLSFMESVIWAFKQLWDKGLA

SEQ ID NO: 1248424 - protein, 19 aa, Mycobacterium
TLDRLRALHAVAIVNENDT

SEQ ID NO: 1248425 - protein, 19 aa, Mycobacterium
TLDTWKRLCDPVAEQISTV

SEQ ID NO: 1248426 - protein, 18 aa, Mycobacterium
TLEGLSIVVTGSLAGFSR

SEQ ID NO: 1248427 - protein, 23 aa, Mycobacterium
TLERAAPHMRLFTATIDECLDEA

SEQ ID NO: 1248428 - protein, 27 aa, Mycobacterium
TLGAYRWLRPQGRRTAQEIAEEFSTAL

SEQ ID NO: 1248429 - protein, 22 aa, Mycobacterium
TLGEARARVVAVRRQTARSVTL

SEQ ID NO: 1248430 - protein, 26 aa, Mycobacterium
TLGPRGRNVVLAKSWGGPTVTNDGVT

SEQ ID NO: 1248431 - protein, 20 aa, Mycobacterium
TLGQRLLTFQLFDQQANVPL

SEQ ID NO: 1248432 - protein, 18 aa, Mycobacterium
TLHPRLAELLTELVDRPI

SEQ ID NO: 1248433 - protein, 18 aa, Mycobacterium
TLKSWADGGLQVVGLDAD

SEQ ID NO: 1248434 - protein, 18 aa, Mycobacterium
TLLDRAYAKKFRFPTFLG

SEQ ID NO: 1248435 - protein, 17 aa, Mycobacterium
TLLQDWTTFAAPAVFGM

SEQ ID NO: 1248436 - protein, 21 aa, Mycobacterium
TLLRHHFRRIIGVTPTDYRRR

SEQ ID NO: 1248437 - protein, 18 aa, Mycobacterium
TLPASNLVQAQWIAERHG

SEQ ID NO: 1248438 - protein, 19 aa, Mycobacterium
TLPEHLVIVGGSYIALEFA

SEQ ID NO: 1248439 - protein, 19 aa, Mycobacterium
TLPHFPLPLGDPAEPCSGE

SEQ ID NO: 1248440 - protein, 25 aa, Mycobacterium
TLPRIASGDLHVCFGVTEPGAGLDT

SEQ ID NO: 1248441 - protein, 18 aa, Mycobacterium
TLQALQWQGGGTRWVLKS

SEQ ID NO: 1248442 - protein, 30 aa, Mycobacterium
TLQALTDCPLRWLLERHGGRDGRDVRSAVG

SEQ ID NO: 1248443 - protein, 19 aa, Mycobacterium
TLQQCRDAAEAVLATATAA

SEQ ID NO: 1248444 - protein, 24 aa, Mycobacterium
TLQVLRAFAPIIERNGGGAVLNVL

SEQ ID NO: 1248445 - protein, 19 aa, Mycobacterium
TLRDLLARVVVKGTGHTLA

SEQ ID NO: 1248446 - protein, 27 aa, Mycobacterium
TLRGALVRDPHAWSGYLTEAIDTFADK

SEQ ID NO: 1248447 - protein, 18 aa, Mycobacterium
TLRLFRPLFGAGLGGRLG

SEQ ID NO: 1248448 - protein, 27 aa, Mycobacterium
TLRNAGIRLGWRSSWVETVLGECLAVV

SEQ ID NO: 1248449 - protein, 18 aa, Mycobacterium
TLRRLHNAVALGLIDIEE

SEQ ID NO: 1248450 - protein, 19 aa, Mycobacterium
TLRRTYKELGHTVELVEPV

SEQ ID NO: 1248451 - protein, 26 aa, Mycobacterium
TLRTRVPVLHFFDGFRTSHELNTVEL

SEQ ID NO: 1248452 - protein, 18 aa, Mycobacterium
TLRWIRDRIDAAGSLMPI

SEQ ID NO: 1248453 - protein, 24 aa, Mycobacterium
TLSAARALDRFGVRANAIAPRART

SEQ ID NO: 1248454 - protein, 21 aa, Mycobacterium
TLSADGMSVWPVRQPAEGETV

SEQ ID NO: 1248455 - protein, 26 aa, Mycobacterium
TLTEAWGLSTAQGWQGVGHTRMATES

SEQ ID NO: 1248456 - protein, 19 aa, Mycobacterium
TLTLWAGLIGAISLEVFGQ

SEQ ID NO: 1248457 - protein, 18 aa, Mycobacterium
TLVQRLTGMWPDRLAEEQ

SEQ ID NO: 1248458 - protein, 20 aa, Mycobacterium
TLVRTVCAQRRLVELDGPEV

SEQ ID NO: 1248459 - protein, 17 aa, Mycobacterium
TLVSLGAEVRWASCNIF

SEQ ID NO: 1248460 - protein, 22 aa, Mycobacterium
TLWEIAARVGATVLGTSPGYVL

SEQ ID NO: 1248461 - protein, 23 aa, Mycobacterium
TLWGPARLMRTAPISREMILNFV

SEQ ID NO: 1248462 - protein, 19 aa, Mycobacterium
TLYFGTRVQPGYDYVVTGR

SEQ ID NO: 1248463 - protein, 19 aa, Mycobacterium
TLYRDNARYDAKLWVVPAN

SEQ ID NO: 1248464 - protein, 23 aa, Mycobacterium
TLYVRPAAWGVWAFYEMSDEERR

SEQ ID NO: 1248465 - protein, 19 aa, Mycobacterium
TMAIFGNRWASAIIGAAFL

SEQ ID NO: 1248466 - protein, 22 aa, Mycobacterium
TMNSDLRLTGLNTEFMALANHR

SEQ ID NO: 1248467 - protein, 20 aa, Mycobacterium
TMRAIKSALDPAGYLNPAVL

SEQ ID NO: 1248468 - protein, 23 aa, Mycobacterium
TMRARVVGVGAGFLTEPWWCRTV

SEQ ID NO: 1248469 - protein, 19 aa, Mycobacterium
TMSAIRLARGFTGRPKIVK

SEQ ID NO: 1248470 - protein, 17 aa, Mycobacterium
TMVHPGYTWTAMGAVNA

SEQ ID NO: 1248471 - protein, 20 aa, Mycobacterium
TMVVTGLHLLGGARADPNRV

SEQ ID NO: 1248472 - protein, 20 aa, Mycobacterium
TNAEAAQRLSLRPETVKSYL

SEQ ID NO: 1248473 - protein, 17 aa, Mycobacterium
TNHLGHFALTGLLLENV

SEQ ID NO: 1248474 - protein, 31 aa, Mycobacterium
TNIEFIVAQLLRLGRLGSFDFNSRFYADDDL

SEQ ID NO: 1248475 - protein, 20 aa, Mycobacterium
TNIEFLRFLLTDPDVAAGRL

SEQ ID NO: 1248476 - protein, 29 aa, Mycobacterium
TNLDASAFLGRLALIRIYKGRIRKGQQVA

SEQ ID NO: 1248477 - protein, 17 aa, Mycobacterium
TNPRWKGITRDYSPADV

SEQ ID NO: 1248478 - protein, 18 aa, Mycobacterium
TNRRARLRLTYSAGSGPE

SEQ ID NO: 1248479 - protein, 24 aa, Mycobacterium
TPAEAKRALTRFIEHRLPTFGDYE

SEQ ID NO: 1248480 - protein, 25 aa, Mycobacterium
TPAEQRAAMGPGIRRLLRLSAPSPV

SEQ ID NO: 1248481 - protein, 38 aa, Mycobacterium
TPARSTVVAADWPRLAAAYRTRAALRIVDELLPVESTD

SEQ ID NO: 1248482 - protein, 24 aa, Mycobacterium
TPCGTCDSCVALAPNGPGNMDVTE

SEQ ID NO: 1248483 - protein, 26 aa, Mycobacterium
TPDFDTLRLLPWLPGTALVMADLSWT

SEQ ID NO: 1248484 - protein, 25 aa, Mycobacterium
TPDHFIPWLYLAGLASTAADSVDIL

SEQ ID NO: 1248485 - protein, 26 aa, Mycobacterium
TPDYRVSWPRHCVVGTDGAEFHPDLD

SEQ ID NO: 1248486 - protein, 24 aa, Mycobacterium
TPEEWYAPSLCAGWTVKDVVAHVI

SEQ ID NO: 1248487 - protein, 25 aa, Mycobacterium
TPEGAEILVPFVTAIVPRVSLADGL

SEQ ID NO: 1248488 - protein, 26 aa, Mycobacterium
TPEPGHICPISMTYAVVPALRFNPDL

SEQ ID NO: 1248489 - protein, 21 aa, Mycobacterium
TPEQWATPSLCPDWSVRDVAV

SEQ ID NO: 1248490 - protein, 19 aa, Mycobacterium
TPEQYPGLLADTFGPDAGQ

SEQ ID NO: 1248491 - protein, 23 aa, Mycobacterium
TPGFEVPYYWWTFNMPTDHGEVV

SEQ ID NO: 1248492 - protein, 20 aa, Mycobacterium
TPGHPEFRHTKGVEITTGPL

SEQ ID NO: 1248493 - protein, 18 aa, Mycobacterium
TPGSIALALHGPAAGDAV

SEQ ID NO: 1248494 - protein, 20 aa, Mycobacterium
TPHAGEFARLAGSPPGDDRV

SEQ ID NO: 1248495 - protein, 23 aa, Mycobacterium
TPIDSVLTARGWLREAEGRKAFV

SEQ ID NO: 1248496 - protein, 28 aa, Mycobacterium
TPIPALGDMGLRPAMTLRCPVAQTRSIK

SEQ ID NO: 1248497 - protein, 19 aa, Mycobacterium
TPKALIALDAWCTEALDGG

SEQ ID NO: 1248498 - protein, 20 aa, Mycobacterium
TPLAEVLDFLGIPPSARPVV

SEQ ID NO: 1248499 - protein, 20 aa, Mycobacterium
TPLDLQRAYVLGGPRLIEYL

SEQ ID NO: 1248500 - protein, 18 aa, Mycobacterium
TPLGDWLRERGVDEVDVV

SEQ ID NO: 1248501 - protein, 17 aa, Mycobacterium
TPLMANLVGDKMAAAPV

SEQ ID NO: 1248502 - protein, 17 aa, Mycobacterium
TPLRDAALAYLAIVRGR

SEQ ID NO: 1248503 - protein, 17 aa, Mycobacterium
TPLRKLGGDSADFTYHQ

SEQ ID NO: 1248504 - protein, 25 aa, Mycobacterium
TPLTWPVGIAGDFKGVLDRRSGTFI

SEQ ID NO: 1248505 - protein, 21 aa, Mycobacterium
TPNVCPALHMPLQSGSDRILR

SEQ ID NO: 1248506 - protein, 22 aa, Mycobacterium
TPPDLKESFSLGADTPTGDPDI

SEQ ID NO: 1248507 - protein, 18 aa, Mycobacterium
TPPGPAREGERVAAGHTP

SEQ ID NO: 1248508 - protein, 25 aa, Mycobacterium
TPQASDFLHGRWLVLRRGKRNIAGV

SEQ ID NO: 1248509 - protein, 21 aa, Mycobacterium
TPRRGDWRLDPGGHRFFTRSE

SEQ ID NO: 1248510 - protein, 17 aa, Mycobacterium
TPSGFDIEYGWDAVTVD

SEQ ID NO: 1248511 - protein, 17 aa, Mycobacterium
TPSRPTPRPALNGTGPR

SEQ ID NO: 1248512 - protein, 17 aa, Mycobacterium
TPTACAMAALTLDHLSG

SEQ ID NO: 1248513 - protein, 17 aa, Mycobacterium
TPTIHWGAPTAAERGPV

SEQ ID NO: 1248514 - protein, 18 aa, Mycobacterium
TPTIQRIRLGANQDGTLT

SEQ ID NO: 1248515 - protein, 19 aa, Mycobacterium
TPTRARGYPPYEGEHALIV

SEQ ID NO: 1248516 - protein, 24 aa, Mycobacterium
TPVAKRLGLYVAEFDTVELNASFY

SEQ ID NO: 1248517 - protein, 17 aa, Mycobacterium
TPVTRGRILVACSEREW

SEQ ID NO: 1248518 - protein, 23 aa, Mycobacterium
TPWGCISCAYGWQAAVNTLGQLR

SEQ ID NO: 1248519 - protein, 26 aa, Mycobacterium
TPWNFPMTIAAWGFAPALAAGNAVVL

SEQ ID NO: 1248520 - protein, 19 aa, Mycobacterium
TPYARMWGAYLTGMWLYRL

SEQ ID NO: 1248521 - protein, 21 aa, Mycobacterium
TPYELMKLRLLNASHQALCYF

SEQ ID NO: 1248522 - protein, 20 aa, Mycobacterium
TPYGFRLRPVADIVAALERA

SEQ ID NO: 1248523 - protein, 17 aa, Mycobacterium
TPYLVPIIGDWPNRPGG

SEQ ID NO: 1248524 - protein, 19 aa, Mycobacterium
TPYPYTRDGERRWQPFTHW

SEQ ID NO: 1248525 - protein, 26 aa, Mycobacterium
TPYRYRITTRYEIACTVSGTVTADGR

SEQ ID NO: 1248526 - protein, 30 aa, Mycobacterium
TQAARLRDLLKFDFYFADSAAFREHVVEEM

SEQ ID NO: 1248527 - protein, 24 aa, Mycobacterium
TQANWWQGRALAAGRNVHASLFGR

SEQ ID NO: 1248528 - protein, 24 aa, Mycobacterium
TQAPSAEEIVAWCRERLAHFKCPR

SEQ ID NO: 1248529 - protein, 27 aa, Mycobacterium
TQEAVMRRAPLTLAHVVAAVATSSPIG

SEQ ID NO: 1248530 - protein, 23 aa, Mycobacterium
TQEKSWKVKRIRNTGRVTIAKCD

SEQ ID NO: 1248531 - protein, 19 aa, Mycobacterium
TQFAGCLDINASEKAARFV

SEQ ID NO: 1248532 - protein, 24 aa, Mycobacterium
TQGYEMMHLATFLARAQVAEAEAD

SEQ ID NO: 1248533 - protein, 23 aa, Mycobacterium
TQHECEAIQALPFSNTQQLVQAR

SEQ ID NO: 1248534 - protein, 18 aa, Mycobacterium
TQHLKELQRHGVVHRESY

SEQ ID NO: 1248535 - protein, 25 aa, Mycobacterium
TQIERLARLGGIVGTAFQISDDIID

SEQ ID NO: 1248536 - protein, 25 aa, Mycobacterium
TQLKASFKAGALIGRGSGEALQVAF

SEQ ID NO: 1248537 - protein, 21 aa, Mycobacterium
TQLLRPGRRYTTFVRIAPTST

SEQ ID NO: 1248538 - protein, 26 aa, Mycobacterium
TQLSAYKVPTRWAVVGADQLPVLASG

SEQ ID NO: 1248539 - protein, 20 aa, Mycobacterium
TQNSRWFLLSKYDGVTVTTA

SEQ ID NO: 1248540 - protein, 26 aa, Mycobacterium
TQSGFTFPVLSDFWPHGAVAQAYGVF

SEQ ID NO: 1248541 - protein, 23 aa, Mycobacterium
TQTLPLRPFRTMAVNVDGELPPG

SEQ ID NO: 1248542 - protein, 28 aa, Mycobacterium
TQVKGASPQSVFFSGYYAEAAPFVQQLK

SEQ ID NO: 1248543 - protein, 20 aa, Mycobacterium
TQWWEIGLFTTLDEGVTQPD

SEQ ID NO: 1248544 - protein, 18 aa, Mycobacterium
TRAAMPTLRIPDFHMSSV

SEQ ID NO: 1248545 - protein, 22 aa, Mycobacterium
TRAAVSAVVDWLRDDTAAPPGR

SEQ ID NO: 1248546 - protein, 26 aa, Mycobacterium
TRAESKWFASQGFSLVNMTGYPEAVL

SEQ ID NO: 1248547 - protein, 20 aa, Mycobacterium
TRAEVRAALAEGDWNAAAGG

SEQ ID NO: 1248548 - protein, 17 aa, Mycobacterium
TRAFEWMECEKILLFSS

SEQ ID NO: 1248549 - protein, 21 aa, Mycobacterium
TRAGGRLCVLVTRDGERQVFV

SEQ ID NO: 1248550 - protein, 20 aa, Mycobacterium
TRAICSRSHLMGEGEAMLFG

SEQ ID NO: 1248551 - protein, 20 aa, Mycobacterium
TRARILLRLSRASGYPSDLA

SEQ ID NO: 1248552 - protein, 18 aa, Mycobacterium
TRATDWVLSGRVFDAAEA

SEQ ID NO: 1248553 - protein, 18 aa, Mycobacterium
TRAVYRKMAKRGGGAIVN

SEQ ID NO: 1248554 - protein, 25 aa, Mycobacterium
TRCDIDHTVPWPAGPTCAANLKCLC

SEQ ID NO: 1248555 - protein, 24 aa, Mycobacterium
TRCEALGIGSLWLYDHLYGPGAPD

SEQ ID NO: 1248556 - protein, 22 aa, Mycobacterium
TRCGTPLKWVRLDSAPFTDRLV

SEQ ID NO: 1248557 - protein, 22 aa, Mycobacterium
TRDLMAIMSRVTWGCEPDAVSL

SEQ ID NO: 1248558 - protein, 18 aa, Mycobacterium
TRDPEGLYWLGRIDGPYR

SEQ ID NO: 1248559 - protein, 17 aa, Mycobacterium
TRDSSFWIGPRVAITSL

SEQ ID NO: 1248560 - protein, 22 aa, Mycobacterium
TREAREALRDTVVRRGDTPLPV

SEQ ID NO: 1248561 - protein, 27 aa, Mycobacterium
TRELALQVAEAFGRYGAHLPVNVLPVY

SEQ ID NO: 1248562 - protein, 28 aa, Mycobacterium
TRFDFRGTDTTIAWKGEEAIEIVSSTEE

SEQ ID NO: 1248563 - protein, 32 aa, Mycobacterium
TRFRRMLSKPFTFKRVEGLRPVIQQVTDECID

SEQ ID NO: 1248564 - protein, 17 aa, Mycobacterium
TRFVEAMAHDLGRELIT

SEQ ID NO: 1248565 - protein, 21 aa, Mycobacterium
TRGDIEDIFWLQATIAEKLAE

SEQ ID NO: 1248566 - protein, 23 aa, Mycobacterium
TRGNVLTLLRFGKQGDTGVRPAL

SEQ ID NO: 1248567 - protein, 17 aa, Mycobacterium
TRGWFMAWLARAHPELV

SEQ ID NO: 1248568 - protein, 17 aa, Mycobacterium
TRHLDAFEYMRGNNARF

SEQ ID NO: 1248569 - protein, 17 aa, Mycobacterium
TRHLGYAPARSRSTLTA

SEQ ID NO: 1248570 - protein, 22 aa, Mycobacterium
TRIALSRGLRPDRFVQEIRQYG

SEQ ID NO: 1248571 - protein, 20 aa, Mycobacterium
TRKLRDWLVCRAIDCEVPPR

SEQ ID NO: 1248572 - protein, 19 aa, Mycobacterium
TRLAPLGSVLGARSGDKGG

SEQ ID NO: 1248573 - protein, 21 aa, Mycobacterium
TRLGLWPSDIDLLSKMVRYHL

SEQ ID NO: 1248574 - protein, 33 aa, Mycobacterium
TRLGRPLRIAHAWSFTFDAAWQPLVALFEGHSV

SEQ ID NO: 1248575 - protein, 19 aa, Mycobacterium
TRLKPEILAVTLAAGDHGA

SEQ ID NO: 1248576 - protein, 24 aa, Mycobacterium
TRLKVVDSELGWSREVWNQLAEIG

SEQ ID NO: 1248577 - protein, 25 aa, Mycobacterium
TRLLKLALDIGCVFSIDTDSHAPGQ

SEQ ID NO: 1248578 - protein, 21 aa, Mycobacterium
TRLRGLIGHGVVAVRGKGLWA

SEQ ID NO: 1248579 - protein, 17 aa, Mycobacterium
TRMAEAMLHSDYPLQAL

SEQ ID NO: 1248580 - protein, 20 aa, Mycobacterium
TRNATYWSRSRGEHWVKGET

SEQ ID NO: 1248581 - protein, 22 aa, Mycobacterium
TRPDGICVSGLTAGASTDSQAL

SEQ ID NO: 1248582 - protein, 25 aa, Mycobacterium
TRPEAIKLAPLVPALRAQGMTPVFV

SEQ ID NO: 1248583 - protein, 21 aa, Mycobacterium
TRPGQYEAPLGITLRELLEYA

SEQ ID NO: 1248584 - protein, 22 aa, Mycobacterium
TRPHPLFAAFIGAALDYKAAER

SEQ ID NO: 1248585 - protein, 19 aa, Mycobacterium
TRPSVLALFDGARRDLEAA

SEQ ID NO: 1248586 - protein, 34 aa, Mycobacterium
TRPTLRGRPVLVGGLGGRGVVAGASYEARVHGAR

SEQ ID NO: 1248587 - protein, 18 aa, Mycobacterium
TRQAMLFSATMPDPIITL

SEQ ID NO: 1248588 - protein, 17 aa, Mycobacterium
TRQAPIYVVHFTQASAL

SEQ ID NO: 1248589 - protein, 19 aa, Mycobacterium
TRQSIRTAAHFDRRPEVVL

SEQ ID NO: 1248590 - protein, 19 aa, Mycobacterium
TRRDPRLINRFDYDGDFGT

SEQ ID NO: 1248591 - protein, 21 aa, Mycobacterium
TRRDVVCPVHLGLMQGALSRW

SEQ ID NO: 1248592 - protein, 26 aa, Mycobacterium
TRRFELDRYLGWPGQAPSYAVGQRIW

SEQ ID NO: 1248593 - protein, 20 aa, Mycobacterium
TRRGLPTVHRLFADRHADRG

SEQ ID NO: 1248594 - protein, 19 aa, Mycobacterium
TRRIEGIPAGAFLEVEVDG

SEQ ID NO: 1248595 - protein, 18 aa, Mycobacterium
TRRRPKLSELAPRPDAPP

SEQ ID NO: 1248596 - protein, 17 aa, Mycobacterium
TRRWLLDPEFMYPVERI

SEQ ID NO: 1248597 - protein, 18 aa, Mycobacterium
TRSGAPLPTGPDVSAAIT

SEQ ID NO: 1248598 - protein, 19 aa, Mycobacterium
TRSGKILRKTMRGLAEGRD

SEQ ID NO: 1248599 - protein, 26 aa, Mycobacterium
TRSGVLRFVVLDGLAKPGRLEGPDPS

SEQ ID NO: 1248600 - protein, 18 aa, Mycobacterium
TRSLLAYRYRRLPEARHA

SEQ ID NO: 1248601 - protein, 23 aa, Mycobacterium
TRSQEILEATGIDRDLRTKDLTD

SEQ ID NO: 1248602 - protein, 20 aa, Mycobacterium
TRSRGLLIYAYRTVVDLAEA

SEQ ID NO: 1248603 - protein, 23 aa, Mycobacterium
TRSRLSLACEVFDGEAYPQVLIR

SEQ ID NO: 1248604 - protein, 19 aa, Mycobacterium
TRSTLPPTLLHAVEELEAD

SEQ ID NO: 1248605 - protein, 23 aa, Mycobacterium
TRSYGGGMLICPDADHTDGLLDV

SEQ ID NO: 1248606 - protein, 17 aa, Mycobacterium
TRTCPRCHNTTQWTQMR

SEQ ID NO: 1248607 - protein, 21 aa, Mycobacterium
TRTLAAVLHRPAVLPVPSAGP

SEQ ID NO: 1248608 - protein, 20 aa, Mycobacterium
TRTPFPPSIVYVGKTDYLMT

SEQ ID NO: 1248609 - protein, 25 aa, Mycobacterium
TRTRVSFEVAGKWMSADVINVSASG

SEQ ID NO: 1248610 - protein, 17 aa, Mycobacterium
TRVGLPVIAAGGLATPA

SEQ ID NO: 1248611 - protein, 19 aa, Mycobacterium
TRVLADVVAHLGVDFSFLR

SEQ ID NO: 1248612 - protein, 20 aa, Mycobacterium
TRVLLQWTGVAARPAPSHDL

SEQ ID NO: 1248613 - protein, 25 aa, Mycobacterium
TRVRTRLIELFELFDPADPEVIAGR

SEQ ID NO: 1248614 - protein, 18 aa, Mycobacterium
TRVSLRYRLPAGSVPPLN

SEQ ID NO: 1248615 - protein, 20 aa, Mycobacterium
TRYAVRLSAPAIVPAKEGAD

SEQ ID NO: 1248616 - protein, 23 aa, Mycobacterium
TRYLQVMMSWYLRVADGGAAGPL

SEQ ID NO: 1248617 - protein, 21 aa, Mycobacterium
TSAAVTCFWNDNQINIIDTPG

SEQ ID NO: 1248618 - protein, 22 aa, Mycobacterium
TSADDLPRGWGVDVAPGSYRLR

SEQ ID NO: 1248619 - protein, 21 aa, Mycobacterium
TSAFRAVLAKAVWDHASDPDY

SEQ ID NO: 1248620 - protein, 21 aa, Mycobacterium
TSAPISVPWLIGVARHKLADH

SEQ ID NO: 1248621 - protein, 33 aa, Mycobacterium
TSDGKALSEGWCPHCGSQYSFLPQLNPGDMVAD

SEQ ID NO: 1248622 - protein, 17 aa, Mycobacterium
TSDPAFRQRYWARNHVG

SEQ ID NO: 1248623 - protein, 29 aa, Mycobacterium
TSDSLAVRCTMRIDFAFPHPQSVVRVGPD

SEQ ID NO: 1248624 - protein, 25 aa, Mycobacterium
TSEDVWRPGIKVFFDTFGAHRGVTV

SEQ ID NO: 1248625 - protein, 18 aa, Mycobacterium
TSEIRISVLVKDTELDKA

SEQ ID NO: 1248626 - protein, 24 aa, Mycobacterium
TSEQWRAVVDVNLIGTWNTCAAAI

SEQ ID NO: 1248627 - protein, 18 aa, Mycobacterium
TSERREMVCLSRGDSDMW

SEQ ID NO: 1248628 - protein, 25 aa, Mycobacterium
TSFSLALLLATERLKVIAAVHPGLW

SEQ ID NO: 1248629 - protein, 17 aa, Mycobacterium
TSGELIIAIAMTEPGAG

SEQ ID NO: 1248630 - protein, 25 aa, Mycobacterium
TSGEQRASNFLLWQSAYAEYVFQDK

SEQ ID NO: 1248631 - protein, 20 aa, Mycobacterium
TSGHFVWPRETLRMGEKFPL

SEQ ID NO: 1248632 - protein, 32 aa, Mycobacterium
TSGLRLANKLTPWPARNGERVGAVSAFGMSGT

SEQ ID NO: 1248633 - protein, 29 aa, Mycobacterium
TSGRIERFLQLWAEGSMTIALPSTPANYF

SEQ ID NO: 1248634 - protein, 18 aa, Mycobacterium
TSGVLWGALLSALGTRLG

SEQ ID NO: 1248635 - protein, 29 aa, Mycobacterium
TSGYLCVPLDGAICDRLGLLPMYAVNQDK

SEQ ID NO: 1248636 - protein, 26 aa, Mycobacterium
TSLAHRARWGLLLARTNPDVPKHKGL

SEQ ID NO: 1248637 - protein, 25 aa, Mycobacterium
TSLAKRTSVLFNFRELLNARKHELA

SEQ ID NO: 1248638 - protein, 19 aa, Mycobacterium
TSLNEVICHGIPDSTVIED

SEQ ID NO: 1248639 - protein, 18 aa, Mycobacterium
TSLPHAVQAAQYFAREKY

SEQ ID NO: 1248640 - protein, 19 aa, Mycobacterium
TSNCGTCVVSLDGEPVKSC

SEQ ID NO: 1248641 - protein, 28 aa, Mycobacterium
TSPECAFWNLCLWNPFLHTYDYTYERVT

SEQ ID NO: 1248642 - protein, 28 aa, Mycobacterium
TSQAPPVMQTCHHLHGGMGMDITYPMDR

SEQ ID NO: 1248643 - protein, 30 aa, Mycobacterium
TSRAGSPWLDITWRDRFAQMLQRAEARLHP

SEQ ID NO: 1248644 - protein, 24 aa, Mycobacterium
TSRGPAVVEFNCRFGDPETQSVLA

SEQ ID NO: 1248645 - protein, 20 aa, Mycobacterium
TSRGRSPLACKLLGVEDFLD

SEQ ID NO: 1248646 - protein, 21 aa, Mycobacterium
TSRKNQARWQFGVLGPPGAAA

SEQ ID NO: 1248647 - protein, 23 aa, Mycobacterium
TSRWWKEEREGVFVDFNQNAFDR

SEQ ID NO: 1248648 - protein, 18 aa, Mycobacterium
TSSDRYLCINPFFHNFGY

SEQ ID NO: 1248649 - protein, 19 aa, Mycobacterium
TSTDYAPWHVVPCDRKWYS

SEQ ID NO: 1248650 - protein, 17 aa, Mycobacterium
TSTELWPVRLEDIDLGF

SEQ ID NO: 1248651 - protein, 23 aa, Mycobacterium
TSTTETFAAITLDIDTRRWAGVP

SEQ ID NO: 1248652 - protein, 26 aa, Mycobacterium
TSVAYRLGRGIARMEAAMSTPEMFGR

SEQ ID NO: 1248653 - protein, 23 aa, Mycobacterium
TSVFRADFLNELDAPPAAGSDSA

SEQ ID NO: 1248654 - protein, 17 aa, Mycobacterium
TSVPGVFVAGDMGRGQS

SEQ ID NO: 1248655 - protein, 17 aa, Mycobacterium
TSVRCARAAGVAVVSAP

SEQ ID NO: 1248656 - protein, 18 aa, Mycobacterium
TSVTWSRDGAKLIVTADD

SEQ ID NO: 1248657 - protein, 19 aa, Mycobacterium
TSYNDFEIVAANLLDDDPR

SEQ ID NO: 1248658 - protein, 23 aa, Mycobacterium
TTAALPVMVWIPGGAFVYGAGQL

SEQ ID NO: 1248659 - protein, 32 aa, Mycobacterium
TTARLAAETGVAVFRIAFERWVAGGDQRDLAQ

SEQ ID NO: 1248660 - protein, 24 aa, Mycobacterium
TTARLKCPFTSLGVAPEAASSYLL

SEQ ID NO: 1248661 - protein, 26 aa, Mycobacterium
TTDDIRWFDLYSCFPSAIEMAAEALD

SEQ ID NO: 1248662 - protein, 18 aa, Mycobacterium
TTDSSVWFHQPVRADEWN

SEQ ID NO: 1248663 - protein, 24 aa, Mycobacterium
TTEAAKRLGLRPLARIHTAVAVGS

SEQ ID NO: 1248664 - protein, 18 aa, Mycobacterium
TTEQAWKFIGLAYPTYCP

SEQ ID NO: 1248665 - protein, 17 aa, Mycobacterium
TTFLDDFAQTWQAVVPE

SEQ ID NO: 1248666 - protein, 29 aa, Mycobacterium
TTGGTGHRGVWRFGEFVLDTARYELRCGH

SEQ ID NO: 1248667 - protein, 26 aa, Mycobacterium
TTGRARRCGWFDAVIARYATRVNGIT

SEQ ID NO: 1248668 - protein, 25 aa, Mycobacterium
TTGWTSLANVTGWAAISLPLGTTST

SEQ ID NO: 1248669 - protein, 25 aa, Mycobacterium
TTHAAEANWMFALVRTTRAPKKQQG

SEQ ID NO: 1248670 - protein, 24 aa, Mycobacterium
TTIVALKFPGGVVMAGDRRATQGN

SEQ ID NO: 1248671 - protein, 23 aa, Mycobacterium
TTKATKVDGGWRVTGQKIWTTGA

SEQ ID NO: 1248672 - protein, 24 aa, Mycobacterium
TTKGEGDCARWVAAQLEEVGYECE

SEQ ID NO: 1248673 - protein, 18 aa, Mycobacterium
TTLARALARDGRRVAEHT

SEQ ID NO: 1248674 - protein, 19 aa, Mycobacterium
TTLEPDWQLDGDGWKITID

SEQ ID NO: 1248675 - protein, 17 aa, Mycobacterium
TTLPGGLRVVTERIPSV

SEQ ID NO: 1248676 - protein, 18 aa, Mycobacterium
TTLPLDLTGLAALDSGRY

SEQ ID NO: 1248677 - protein, 22 aa, Mycobacterium
TTLRPGSLVIDCSTISPDAAVA

SEQ ID NO: 1248678 - protein, 17 aa, Mycobacterium
TTLRVGPVARRLITATS

SEQ ID NO: 1248679 - protein, 25 aa, Mycobacterium
TTLSPCWYCSGLVRQFNIGAVIVGE

SEQ ID NO: 1248680 - protein, 21 aa, Mycobacterium
TTPEPLLSGFLPLQSQYAQLM

SEQ ID NO: 1248681 - protein, 26 aa, Mycobacterium
TTPHLPLSWQRKAIQLVAPMLGTDPT

SEQ ID NO: 1248682 - protein, 22 aa, Mycobacterium
TTRRPSIAGVRADYDRVIRQRT

SEQ ID NO: 1248683 - protein, 30 aa, Mycobacterium
TTRTVEPWGVVTHRGRWYLVGHDRDRDAPR

SEQ ID NO: 1248684 - protein, 38 aa, Mycobacterium
TTSISDLRAIPWVLSWSQSRVMLPGWYGTGSAFEQYIA

SEQ ID NO: 1248685 - protein, 20 aa, Mycobacterium
TTTFVSWLPFYHDMGLVLGI

SEQ ID NO: 1248686 - protein, 18 aa, Mycobacterium
TTTLRFNFFVLKLPIRPP

SEQ ID NO: 1248687 - protein, 20 aa, Mycobacterium
TTTLSVRVCGELAAEEVEVL

SEQ ID NO: 1248688 - protein, 25 aa, Mycobacterium
TTVPGSWLFFPGWDTTTAELPPMAQ

SEQ ID NO: 1248689 - protein, 26 aa, Mycobacterium
TTVYRRWPNVWALVVDAFLEDVSAVA

SEQ ID NO: 1248690 - protein, 17 aa, Mycobacterium
TVAAFRRTGAVFEDAAL

SEQ ID NO: 1248691 - protein, 23 aa, Mycobacterium
TVAEHFPRLDIAVEVVDEPAHEA

SEQ ID NO: 1248692 - protein, 18 aa, Mycobacterium
TVAHGGSIMFVGTKKQAQ

SEQ ID NO: 1248693 - protein, 20 aa, Mycobacterium
TVALARLPVGEWIGVQADSH

SEQ ID NO: 1248694 - protein, 18 aa, Mycobacterium
TVAQIALNWLLRRPTVAS

SEQ ID NO: 1248695 - protein, 24 aa, Mycobacterium
TVAVLLRITEVFGVDATFFASQDD

SEQ ID NO: 1248696 - protein, 25 aa, Mycobacterium
TVAVSFSECGRGMVVDEVDADLLSV

SEQ ID NO: 1248697 - protein, 26 aa, Mycobacterium
TVDDAWRPDTVWRHRLGAGLPAERVY

SEQ ID NO: 1248698 - protein, 26 aa, Mycobacterium
TVDERARAGLFLAMQYPVEVPGVSMS

SEQ ID NO: 1248699 - protein, 22 aa, Mycobacterium
TVDEVRRLALRYLDGRDALFAG

SEQ ID NO: 1248700 - protein, 26 aa, Mycobacterium
TVDGWRVQWQKWSMRVGFNPREGIVL

SEQ ID NO: 1248701 - protein, 25 aa, Mycobacterium
TVELLRWAKEQGIAITAEVTPHHLL

SEQ ID NO: 1248702 - protein, 20 aa, Mycobacterium
TVEPGERVLLLGASGSGKST

SEQ ID NO: 1248703 - protein, 25 aa, Mycobacterium
TVERTAWEMPFRSGAHMCTMVTSSN

SEQ ID NO: 1248704 - protein, 30 aa, Mycobacterium
TVFEHLGRLLIIDCGVLFPGHDEPGVDLIL

SEQ ID NO: 1248705 - protein, 17 aa, Mycobacterium
TVFKSMVTAVLDRMPDY

SEQ ID NO: 1248706 - protein, 20 aa, Mycobacterium
TVFVCPSVYEPLGIVNLEAM

SEQ ID NO: 1248707 - protein, 18 aa, Mycobacterium
TVGDCLPSPVAKPATVAP

SEQ ID NO: 1248708 - protein, 27 aa, Mycobacterium
TVGDGTLSPGFHGLHIHEFGRCEPNSP

SEQ ID NO: 1248709 - protein, 23 aa, Mycobacterium
TVGESLRPARVVVGRADIDGVHG

SEQ ID NO: 1248710 - protein, 24 aa, Mycobacterium
TVGFGWDPRRAWRLEGDDAVRMEL

SEQ ID NO: 1248711 - protein, 21 aa, Mycobacterium
TVGKVRRVRLLPGDPPATRQA

SEQ ID NO: 1248712 - protein, 18 aa, Mycobacterium
TVGPFFGYALPFDRCNEL

SEQ ID NO: 1248713 - protein, 18 aa, Mycobacterium
TVGRRCSQVFVIAAPGQP

SEQ ID NO: 1248714 - protein, 25 aa, Mycobacterium
TVIDCFSGRVAGWAIAEHMRTELVE

SEQ ID NO: 1248715 - protein, 23 aa, Mycobacterium
TVILPRLVGQVLRGEAPGPTELN

SEQ ID NO: 1248716 - protein, 25 aa, Mycobacterium
TVINRHVFESLAFNARIALHVRTIY

SEQ ID NO: 1248717 - protein, 24 aa, Mycobacterium
TVITRKAYGGAYCVMGSKDMGCDV

SEQ ID NO: 1248718 - protein, 25 aa, Mycobacterium
TVIVAPMFHAWGFSQLLFAGLLACT

SEQ ID NO: 1248719 - protein, 18 aa, Mycobacterium
TVKTGPEYGDWANEAHTA

SEQ ID NO: 1248720 - protein, 18 aa, Mycobacterium
TVLDLAWTTPPGGRVVVY

SEQ ID NO: 1248721 - protein, 24 aa, Mycobacterium
TVLYKKSAVLFGLDLAKRDIAKSH

SEQ ID NO: 1248722 - protein, 17 aa, Mycobacterium
TVLYPLGAFDPGALLDV

SEQ ID NO: 1248723 - protein, 18 aa, Mycobacterium
TVLYTTLETVRIAALLSQ

SEQ ID NO: 1248724 - protein, 25 aa, Mycobacterium
TVPDNMGMLFRKHLVMFGPREVLLT

SEQ ID NO: 1248725 - protein, 20 aa, Mycobacterium
TVSAWLWTRREGVVAGLPAA

SEQ ID NO: 1248726 - protein, 25 aa, Mycobacterium
TVSMQAQCCVAVLRRGARPAPNGSV

SEQ ID NO: 1248727 - protein, 27 aa, Mycobacterium
TVSRRAADFMAPFAPSGRFERLEIEHL

SEQ ID NO: 1248728 - protein, 26 aa, Mycobacterium
TVTDVKWWFGHTLTWARRTLQALGAV

SEQ ID NO: 1248729 - protein, 24 aa, Mycobacterium
TVTGRRGGECVVRMVHSLFTDADD

SEQ ID NO: 1248730 - protein, 19 aa, Mycobacterium
TVVDAARPGQTIVLTSTTY

SEQ ID NO: 1248731 - protein, 18 aa, Mycobacterium
TVVDVLRGKLEFESGEEG

SEQ ID NO: 1248732 - protein, 25 aa, Mycobacterium
TVVLKPAQLTPWSGSEYGRIVAEET

SEQ ID NO: 1248733 - protein, 25 aa, Mycobacterium
TVVRARSDWAPEFAIHDLSSTEVLA

SEQ ID NO: 1248734 - protein, 19 aa, Mycobacterium
TVVRRGRRLWLADAELVQA

SEQ ID NO: 1248735 - protein, 17 aa, Mycobacterium
TVYLYWPTKEDLLIGLI

SEQ ID NO: 1248736 - protein, 17 aa, Mycobacterium
TVYRRWSTVPVLVADVL

SEQ ID NO: 1248737 - protein, 22 aa, Mycobacterium
TWDRRPGWFRKPAGWATGVSDR

SEQ ID NO: 1248738 - protein, 18 aa, Mycobacterium
TWERFEVPDEGIGCGFTE

SEQ ID NO: 1248739 - protein, 19 aa, Mycobacterium
TWGASTLIPFFGGLTSVPV

SEQ ID NO: 1248740 - protein, 21 aa, Mycobacterium
TWHRTARLVGSYDWVLMALGA

SEQ ID NO: 1248741 - protein, 20 aa, Mycobacterium
TWLPMPAEWSSLTVERQLAE

SEQ ID NO: 1248742 - protein, 18 aa, Mycobacterium
TWLYRIATNTSLTALDGR

SEQ ID NO: 1248743 - protein, 24 aa, Mycobacterium
TWRNEVDAAIGMELVKVRTAKEAK

SEQ ID NO: 1248744 - protein, 28 aa, Mycobacterium
TWRYDSFRKGDGFEGLWDDVPAITMPTT

SEQ ID NO: 1248745 - protein, 22 aa, Mycobacterium
TWTDSKVSWTLVSAGQLKAQDA

SEQ ID NO: 1248746 - protein, 17 aa, Mycobacterium
TWVPRLASMESIASYCL

SEQ ID NO: 1248747 - protein, 17 aa, Mycobacterium
TYCKARVNHRVVSQAVV

SEQ ID NO: 1248748 - protein, 20 aa, Mycobacterium
TYDLLKRRGTQFVVVSAAEP

SEQ ID NO: 1248749 - protein, 20 aa, Mycobacterium
TYGFLPIIRTFAGAAGINVE

SEQ ID NO: 1248750 - protein, 18 aa, Mycobacterium
TYGHFGQSGTFLWVDPDA

SEQ ID NO: 1248751 - protein, 26 aa, Mycobacterium
TYGIDFIEACAWIKENLPGVHISGGI

SEQ ID NO: 1248752 - protein, 24 aa, Mycobacterium
TYGLPPDFLMRALHDCLAAWQAGT

SEQ ID NO: 1248753 - protein, 25 aa, Mycobacterium
TYGNVLRFLPPLAISDELLDEGLDV

SEQ ID NO: 1248754 - protein, 19 aa, Mycobacterium
TYGQRCWLRQLTPDVTRAQ

SEQ ID NO: 1248755 - protein, 21 aa, Mycobacterium
TYGSLEIFTGVDLAIDKGSRV

SEQ ID NO: 1248756 - protein, 17 aa, Mycobacterium
TYHREVHAGDSLTLQAE

SEQ ID NO: 1248757 - protein, 18 aa, Mycobacterium
TYKELGHTVELVEPVAGL

SEQ ID NO: 1248758 - protein, 25 aa, Mycobacterium
TYLLSRAPGLLGLHAALTGAPFSGA

SEQ ID NO: 1248759 - protein, 17 aa, Mycobacterium
TYLRTTLFFENFANAFP

SEQ ID NO: 1248760 - protein, 22 aa, Mycobacterium
TYPSSVVGPAFHTAPGVTERGW

SEQ ID NO: 1248761 - protein, 17 aa, Mycobacterium
TYPTEWFGREYPNHLAS

SEQ ID NO: 1248762 - protein, 25 aa, Mycobacterium
TYRGMLRLAVISAKVIAGQRVERRP

SEQ ID NO: 1248763 - protein, 21 aa, Mycobacterium
TYRITPLALWNARAAGHDAEQ

SEQ ID NO: 1248764 - protein, 25 aa, Mycobacterium
TYRRLAAHFFLTFPQLHDVRFDYRW

SEQ ID NO: 1248765 - protein, 18 aa, Mycobacterium
TYSLLEPFTRAGVPVEGV

SEQ ID NO: 1248766 - protein, 20 aa, Mycobacterium
TYVGALPGRIVRAIAEAGSM

SEQ ID NO: 1248767 - protein, 22 aa, Mycobacterium
VAAALERWGRIDFLVNNAGVGS

SEQ ID NO: 1248768 - protein, 18 aa, Mycobacterium
VAAARAGSLGLLAAGYKT

SEQ ID NO: 1248769 - protein, 17 aa, Mycobacterium
VAAAVGEGSMAVMLVHR

SEQ ID NO: 1248770 - protein, 25 aa, Mycobacterium
VAACKANGLLPFANFNRIHAVPPCT

SEQ ID NO: 1248771 - protein, 20 aa, Mycobacterium
VAACRPVSPYLALLYSQSQD

SEQ ID NO: 1248772 - protein, 25 aa, Mycobacterium
VAACSARLPMLTIMEMLGVPAADQP

SEQ ID NO: 1248773 - protein, 20 aa, Mycobacterium
VAADVGLPVTFSLLTGNTGD

SEQ ID NO: 1248774 - protein, 31 aa, Mycobacterium
VAAECACDVSDLWIVGAPAAVAALVGNATFT

SEQ ID NO: 1248775 - protein, 18 aa, Mycobacterium
VAAEIAVGAVDREVRGVW

SEQ ID NO: 1248776 - protein, 23 aa, Mycobacterium
VAAGSWRLHRRARQRGEQPDFAQ

SEQ ID NO: 1248777 - protein, 19 aa, Mycobacterium
VAAKDIWIRTPARVTAERT

SEQ ID NO: 1248778 - protein, 22 aa, Mycobacterium
VAAKDWRSKRIVLADDGVGFSF

SEQ ID NO: 1248779 - protein, 17 aa, Mycobacterium
VAALAGIGQEWNASTID

SEQ ID NO: 1248780 - protein, 18 aa, Mycobacterium
VAALCGSPSQARKHADAG

SEQ ID NO: 1248781 - protein, 20 aa, Mycobacterium
VAALGLPPGRRGERRDPEAV

SEQ ID NO: 1248782 - protein, 19 aa, Mycobacterium
VAAQGRLDLGSVLVPMPAA

SEQ ID NO: 1248783 - protein, 26 aa, Mycobacterium
VAAQSWPLERIRSVKRATGATVNDVI

SEQ ID NO: 1248784 - protein, 19 aa, Mycobacterium
VAARAPWSAVVAAGDVLTI

SEQ ID NO: 1248785 - protein, 25 aa, Mycobacterium
VAARDLSPLGIRVCTIAPGTINTPA

SEQ ID NO: 1248786 - protein, 17 aa, Mycobacterium
VAARILGEFNDRLPEDQ

SEQ ID NO: 1248787 - protein, 24 aa, Mycobacterium
VAARRCPDATFLPSDTAAYDEASE

SEQ ID NO: 1248788 - protein, 25 aa, Mycobacterium
VAARRELRLYLNVEVGTHLTHEDLL

SEQ ID NO: 1248789 - protein, 19 aa, Mycobacterium
VAATKTFVCQIIAGVAVTI

SEQ ID NO: 1248790 - protein, 20 aa, Mycobacterium
VAATLGSPVGVAFVDVLGPT

SEQ ID NO: 1248791 - protein, 17 aa, Mycobacterium
VAAVRRWSADHDVAAGM

SEQ ID NO: 1248792 - protein, 17 aa, Mycobacterium
VAAWRPGGENTKDALRD

SEQ ID NO: 1248793 - protein, 20 aa, Mycobacterium
VAAWTRRAHWQPLADLALEP

SEQ ID NO: 1248794 - protein, 18 aa, Mycobacterium
VACQVLAEIGEDYKRPNA

SEQ ID NO: 1248795 - protein, 23 aa, Mycobacterium
VADAVLYEGYLLYPYRATSRKNQ

SEQ ID NO: 1248796 - protein, 19 aa, Mycobacterium
VADCVRYLIEHEAVPADRV

SEQ ID NO: 1248797 - protein, 24 aa, Mycobacterium
VADDPCAILDAWAGARLAVVIDAA

SEQ ID NO: 1248798 - protein, 25 aa, Mycobacterium
VADEYDRRYGLDEIHLRAIADLNYD

SEQ ID NO: 1248799 - protein, 17 aa, Mycobacterium
VADGRYAWLSQHIGDMD

SEQ ID NO: 1248800 - protein, 18 aa, Mycobacterium
VADGWVLTCQSLPTSRSV

SEQ ID NO: 1248801 - protein, 17 aa, Mycobacterium
VADHDRWIAGMRRYQRS

SEQ ID NO: 1248802 - protein, 18 aa, Mycobacterium
VADIFFLVCDGLKGLPQS

SEQ ID NO: 1248803 - protein, 22 aa, Mycobacterium
VADPAARVRIPLATVNRHGLVA

SEQ ID NO: 1248804 - protein, 21 aa, Mycobacterium
VADSFHLPIVFLADNPGMLPG

SEQ ID NO: 1248805 - protein, 21 aa, Mycobacterium
VAEAFRSQGYFFSSTGGSPLS

SEQ ID NO: 1248806 - protein, 17 aa, Mycobacterium
VAEASGLDLVPDPGGAA

SEQ ID NO: 1248807 - protein, 17 aa, Mycobacterium
VAEESLKLTHADVAFVA

SEQ ID NO: 1248808 - protein, 18 aa, Mycobacterium
VAEGCSILAVTNSSHSTL

SEQ ID NO: 1248809 - protein, 27 aa, Mycobacterium
VAELGGRPEYWLSQQGRLTHPVVLRPG

SEQ ID NO: 1248810 - protein, 22 aa, Mycobacterium
VAELVPRAKPGTVIAIHSTISP

SEQ ID NO: 1248811 - protein, 33 aa, Mycobacterium
VAELYDGFTFNCLSWIEALGFCGIGEAKDFLDG

SEQ ID NO: 1248812 - protein, 23 aa, Mycobacterium
VAEPGMVLTVRFDQTGDEETFLL

SEQ ID NO: 1248813 - protein, 24 aa, Mycobacterium
VAEQSLKGANLWKEVKDRLDQPGG

SEQ ID NO: 1248814 - protein, 19 aa, Mycobacterium
VAESLGMHGVISAGVRNED

SEQ ID NO: 1248815 - protein, 23 aa, Mycobacterium
VAEVSGFLFDLGVSSMQLDRTER

SEQ ID NO: 1248816 - protein, 17 aa, Mycobacterium
VAEYEMGAEIAVARATY

SEQ ID NO: 1248817 - protein, 17 aa, Mycobacterium
VAFDVYRLVGATERTRV

SEQ ID NO: 1248818 - protein, 20 aa, Mycobacterium
VAFHPGHLVPGIDVTDDPLL

SEQ ID NO: 1248819 - protein, 21 aa, Mycobacterium
VAFKITRLTGRTKIVAAQGAF

SEQ ID NO: 1248820 - protein, 24 aa, Mycobacterium
VAFKLADMKARIDATRMLVWRAGW

SEQ ID NO: 1248821 - protein, 27 aa, Mycobacterium
VAFRKNHPVFRRRRFFEGKPIRSADQV

SEQ ID NO: 1248822 - protein, 19 aa, Mycobacterium
VAGAAHFLEHLLFKSTPTR

SEQ ID NO: 1248823 - protein, 17 aa, Mycobacterium
VAGDLGVPDAVKFDADG

SEQ ID NO: 1248824 - protein, 19 aa, Mycobacterium
VAGGFAHRTLFEGLDLTVA

SEQ ID NO: 1248825 - protein, 18 aa, Mycobacterium
VAGLTWLPFMSQRYTAVV

SEQ ID NO: 1248826 - protein, 24 aa, Mycobacterium
VAGPFPLQIICDMMGIPEEDEEKV

SEQ ID NO: 1248827 - protein, 20 aa, Mycobacterium
VAGRRMAETVARRGGLVVLP

SEQ ID NO: 1248828 - protein, 17 aa, Mycobacterium
VAGVPVALCSPGEVDDA

SEQ ID NO: 1248829 - protein, 23 aa, Mycobacterium
VAHCSHWRFTLTADEPADGAVRA

SEQ ID NO: 1248830 - protein, 36 aa, Mycobacterium
VAHFDWLVECGVPFKAEFFGEPGWEPMGDQGLMYSG

SEQ ID NO: 1248831 - protein, 25 aa, Mycobacterium
VAHSVCPFCAVGCAQKVYVKDEKVV

SEQ ID NO: 1248832 - protein, 17 aa, Mycobacterium
VAIDLRDDWPRALRDRG

SEQ ID NO: 1248833 - protein, 24 aa, Mycobacterium
VAKLIALALELGRLGSAGIGVGVS

SEQ ID NO: 1248834 - protein, 19 aa, Mycobacterium
VAKNFGVDVMEVISAAATK

SEQ ID NO: 1248835 - protein, 20 aa, Mycobacterium
VALARRLLGRSWGHPTPRSA

SEQ ID NO: 1248836 - protein, 19 aa, Mycobacterium
VALGNRLRPVLGALGLGSP

SEQ ID NO: 1248837 - protein, 20 aa, Mycobacterium
VALHKLPVTLVLDRSGVTGP

SEQ ID NO: 1248838 - protein, 18 aa, Mycobacterium
VALIDGTWVAFPTVEQLE

SEQ ID NO: 1248839 - protein, 24 aa, Mycobacterium
VALKGSNLEFALGYSHPVVIEPPE

SEQ ID NO: 1248840 - protein, 26 aa, Mycobacterium
VALLDQCRRHGLPVLIASPSVPFSMV

SEQ ID NO: 1248841 - protein, 18 aa, Mycobacterium
VALMGIGGVEYHGHTWEL

SEQ ID NO: 1248842 - protein, 25 aa, Mycobacterium
VALPDPRLEALAKIFHSEKIVPAPV

SEQ ID NO: 1248843 - protein, 24 aa, Mycobacterium
VALPSLRAAHSVHGPMALVHFDAH

SEQ ID NO: 1248844 - protein, 19 aa, Mycobacterium
VALRPGHRAVVPDGFACDR

SEQ ID NO: 1248845 - protein, 17 aa, Mycobacterium
VALSGGYSRDDANKKLA

SEQ ID NO: 1248846 - protein, 18 aa, Mycobacterium
VALTPARLLLVVITDTGR

SEQ ID NO: 1248847 - protein, 17 aa, Mycobacterium
VALVALERQACEPGQAP

SEQ ID NO: 1248848 - protein, 19 aa, Mycobacterium
VAMIARRYMHEFGATSADF

SEQ ID NO: 1248849 - protein, 24 aa, Mycobacterium
VAMRLRPTTSMSFRDMLIQTRDTA

SEQ ID NO: 1248850 - protein, 18 aa, Mycobacterium
VANALGCRVAVTAGSANK

SEQ ID NO: 1248851 - protein, 20 aa, Mycobacterium
VANARAGVVVGGRATVEDAY

SEQ ID NO: 1248852 - protein, 23 aa, Mycobacterium
VANERRIAEETARNEGKPEQALP

SEQ ID NO: 1248853 - protein, 34 aa, Mycobacterium
VANLPITLWPGMKIGQLCLLRLTSPAEHPYGSAK

SEQ ID NO: 1248854 - protein, 23 aa, Mycobacterium
VAPAKLLSLGHRFRQPHLADALA

SEQ ID NO: 1248855 - protein, 19 aa, Mycobacterium
VAPDGSDRFQIWVVTTDPD

SEQ ID NO: 1248856 - protein, 22 aa, Mycobacterium
VAPDQSALWGFGRAASLELPHL

SEQ ID NO: 1248857 - protein, 22 aa, Mycobacterium
VAPEALRSLAMLFAIDTLDATA

SEQ ID NO: 1248858 - protein, 20 aa, Mycobacterium
VAPEILRPSFRNWDHPIRRQ

SEQ ID NO: 1248859 - protein, 37 aa, Mycobacterium
VAPIGAPSFKEALRWGAEVYHSLKSVLKKQGLSTGLG

SEQ ID NO: 1248860 - protein, 18 aa, Mycobacterium
VAQARSALHATIDYVKNR

SEQ ID NO: 1248861 - protein, 21 aa, Mycobacterium
VAQLRSEFDAVVLAGGATAWR

SEQ ID NO: 1248862 - protein, 19 aa, Mycobacterium
VARCAAAVGEVDEAVRRHA

SEQ ID NO: 1248863 - protein, 24 aa, Mycobacterium
VARDGMELTGWLYRPPAPVEPVGA

SEQ ID NO: 1248864 - protein, 27 aa, Mycobacterium
VARDIGFRMPSVWFAEGHNAVAPVYLY

SEQ ID NO: 1248865 - protein, 17 aa, Mycobacterium
VARELKDRLGVGSDSVR

SEQ ID NO: 1248866 - protein, 18 aa, Mycobacterium
VARFQRRGVDVTAIVGTD

SEQ ID NO: 1248867 - protein, 19 aa, Mycobacterium
VARIREWLDSPGVMVTDIF

SEQ ID NO: 1248868 - protein, 23 aa, Mycobacterium
VARLADLLLRSGIDDDRVSAALR

SEQ ID NO: 1248869 - protein, 22 aa, Mycobacterium
VARLLRDRGYEIVEPEVGELVT

SEQ ID NO: 1248870 - protein, 23 aa, Mycobacterium
VARLREEFTRWLAEEFELDDVRS

SEQ ID NO: 1248871 - protein, 20 aa, Mycobacterium
VARPWSSYTPTAVRLPDGSV

SEQ ID NO: 1248872 - protein, 19 aa, Mycobacterium
VARRARVSLSTIYKRYATR

SEQ ID NO: 1248873 - protein, 18 aa, Mycobacterium
VASAIVFLASDDASFITG

SEQ ID NO: 1248874 - protein, 17 aa, Mycobacterium
VASATFTRPEIAAVGIP

SEQ ID NO: 1248875 - protein, 24 aa, Mycobacterium
VASDGRPLVAPVWFIVEGNQLVFN

SEQ ID NO: 1248876 - protein, 17 aa, Mycobacterium
VASSLDVRAFKLWAGLS

SEQ ID NO: 1248877 - protein, 18 aa, Mycobacterium
VASTPPIVVNWAGSETVS

SEQ ID NO: 1248878 - protein, 27 aa, Mycobacterium
VATDAQWDALCAAIGAADWASDPALAT

SEQ ID NO: 1248879 - protein, 26 aa, Mycobacterium
VATFDLYSCFPFPVFAVCDEFGLDAD

SEQ ID NO: 1248880 - protein, 21 aa, Mycobacterium
VATLFRAWLRDAIRRVADGVL

SEQ ID NO: 1248881 - protein, 19 aa, Mycobacterium
VATLLAEPDYNDWVSDLAP

SEQ ID NO: 1248882 - protein, 17 aa, Mycobacterium
VATPLGLTDAVQVVAVG

SEQ ID NO: 1248883 - protein, 18 aa, Mycobacterium
VATRGYPLGTYRSIVDRL

SEQ ID NO: 1248884 - protein, 24 aa, Mycobacterium
VATRHPRILLCGSGSRRGGGVSGI

SEQ ID NO: 1248885 - protein, 25 aa, Mycobacterium
VATTCGRPIAGFELRIGDSGEVLLR

SEQ ID NO: 1248886 - protein, 18 aa, Mycobacterium
VATVKMLDIDPAKVNVSG

SEQ ID NO: 1248887 - protein, 17 aa, Mycobacterium
VAVAFPRSPFVTAATAW

SEQ ID NO: 1248888 - protein, 19 aa, Mycobacterium
VAVAKRFPDKSVRSAYAVF

SEQ ID NO: 1248889 - protein, 18 aa, Mycobacterium
VAVATTLAPLNAERIELA

SEQ ID NO: 1248890 - protein, 18 aa, Mycobacterium
VAVDAWLAATGLDGSEKV

SEQ ID NO: 1248891 - protein, 20 aa, Mycobacterium
VAVEAAVAQSWYKLVGDTGE

SEQ ID NO: 1248892 - protein, 20 aa, Mycobacterium
VAVGGVRIGPNVTIRQAGGG

SEQ ID NO: 1248893 - protein, 19 aa, Mycobacterium
VAVGPRIGDDIALSATTVL

SEQ ID NO: 1248894 - protein, 32 aa, Mycobacterium
VAVGWFGGNCNKCIPCRRGLFMQCVNMQVPSW

SEQ ID NO: 1248895 - protein, 18 aa, Mycobacterium
VAVLKMLALQFIMSDHGH

SEQ ID NO: 1248896 - protein, 23 aa, Mycobacterium
VAVLRAMRGCNIVAADIVEVAPA

SEQ ID NO: 1248897 - protein, 22 aa, Mycobacterium
VAVNFPLYVILSLLGLPESDFG

SEQ ID NO: 1248898 - protein, 19 aa, Mycobacterium
VAVPTDFAEVLSRLGTAGA

SEQ ID NO: 1248899 - protein, 18 aa, Mycobacterium
VAVRWAVREAVMRQEELT

SEQ ID NO: 1248900 - protein, 18 aa, Mycobacterium
VAVSAAPVQVYLSPDDAM

SEQ ID NO: 1248901 - protein, 18 aa, Mycobacterium
VAVSCRFPGAPDPEAFWD

SEQ ID NO: 1248902 - protein, 17 aa, Mycobacterium
VAVVACMDARLDVYRVL

SEQ ID NO: 1248903 - protein, 24 aa, Mycobacterium
VAVYLCGPPPMVESVRKHVAAEGI

SEQ ID NO: 1248904 - protein, 18 aa, Mycobacterium
VAVYLDFDNIVISRYDQV

SEQ ID NO: 1248905 - protein, 25 aa, Mycobacterium
VAWGGPPIGALVFRDPSTIEQFGSV

SEQ ID NO: 1248906 - protein, 21 aa, Mycobacterium
VCAALRAGAVETLIIGDIGDA

SEQ ID NO: 1248907 - protein, 21 aa, Mycobacterium
VCAAVCPSVFVITDGGYAEAT

SEQ ID NO: 1248908 - protein, 21 aa, Mycobacterium
VCANAGIATMAFRELTIEEDL

SEQ ID NO: 1248909 - protein, 18 aa, Mycobacterium
VCAQRRLVELDGPEVGAL

SEQ ID NO: 1248910 - protein, 17 aa, Mycobacterium
VCARLGVDMPLACVLEG

SEQ ID NO: 1248911 - protein, 21 aa, Mycobacterium
VCGALRLYHDAFGLPVATLPM

SEQ ID NO: 1248912 - protein, 21 aa, Mycobacterium
VCGELRLADFDGLEVSNLNRV

SEQ ID NO: 1248913 - protein, 17 aa, Mycobacterium
VCNCNGVSKGTLVGCVR

SEQ ID NO: 1248914 - protein, 19 aa, Mycobacterium
VCPDCGTKGQWTEPRDFNM

SEQ ID NO: 1248915 - protein, 18 aa, Mycobacterium
VCPNCNGAGVVNRNQGAF

SEQ ID NO: 1248916 - protein, 28 aa, Mycobacterium
VCPPRQFSRPRVVVFAGDHGVAGAGVSA

SEQ ID NO: 1248917 - protein, 19 aa, Mycobacterium
VCRACPRLVEWREEAATVK

SEQ ID NO: 1248918 - protein, 20 aa, Mycobacterium
VCSEVKRVRAAELLDYTNYT

SEQ ID NO: 1248919 - protein, 19 aa, Mycobacterium
VDAAAPGARLAWREDARWA

SEQ ID NO: 1248920 - protein, 25 aa, Mycobacterium
VDAFSAAFSRLPVPVIDHAAALASR

SEQ ID NO: 1248921 - protein, 18 aa, Mycobacterium
VDAGIPVTVVPGVTSAIG

SEQ ID NO: 1248922 - protein, 17 aa, Mycobacterium
VDALGAWGVRWIGELGE

SEQ ID NO: 1248923 - protein, 24 aa, Mycobacterium
VDALREIGFFRAFVPAKYDGLSVL

SEQ ID NO: 1248924 - protein, 29 aa, Mycobacterium
VDAMCARFRISGLPVVDERGSLVGIITNR

SEQ ID NO: 1248925 - protein, 23 aa, Mycobacterium
VDAPRLRVLGGHTLGLEEGFDAG

SEQ ID NO: 1248926 - protein, 19 aa, Mycobacterium
VDAQNLWMSAKMPDDQFLV

SEQ ID NO: 1248927 - protein, 19 aa, Mycobacterium
VDAVRVVNLLSWRYRDPGL

SEQ ID NO: 1248928 - protein, 21 aa, Mycobacterium
VDAVVCAYVALFATRRPADVT

SEQ ID NO: 1248929 - protein, 23 aa, Mycobacterium
VDAVVGIYGRYDWEDRSTAERAR

SEQ ID NO: 1248930 - protein, 24 aa, Mycobacterium
VDAYPDLIGRLVLTNCDAFDKFPP

SEQ ID NO: 1248931 - protein, 17 aa, Mycobacterium
VDCRIGGEIVRYAPAAA

SEQ ID NO: 1248932 - protein, 17 aa, Mycobacterium
VDDALWGVPASRHEAAC

SEQ ID NO: 1248933 - protein, 21 aa, Mycobacterium
VDEAMAGFATKVEVRILENGG

SEQ ID NO: 1248934 - protein, 23 aa, Mycobacterium
VDEFSATVLATWRRMFPSITGSE

SEQ ID NO: 1248935 - protein, 19 aa, Mycobacterium
VDELIWLPVREAMARLGYP

SEQ ID NO: 1248936 - protein, 22 aa, Mycobacterium
VDELPRTPSLKVRLPDVAALYD

SEQ ID NO: 1248937 - protein, 24 aa, Mycobacterium
VDELRRLPDQLARAGTVAKSVVPP

SEQ ID NO: 1248938 - protein, 18 aa, Mycobacterium
VDELTAWSSRVRAEVGDD

SEQ ID NO: 1248939 - protein, 17 aa, Mycobacterium
VDETLRLRPSRGTHLVF

SEQ ID NO: 1248940 - protein, 26 aa, Mycobacterium
VDFAAARGWWVLRWAGLDDVRILDGG

SEQ ID NO: 1248941 - protein, 17 aa, Mycobacterium
VDFVRARGYSAIVKGLR

SEQ ID NO: 1248942 - protein, 18 aa, Mycobacterium
VDGALYLRMDEFPARLVI

SEQ ID NO: 1248943 - protein, 18 aa, Mycobacterium
VDGAPLLRHRVELGTGSV

SEQ ID NO: 1248944 - protein, 18 aa, Mycobacterium
VDGARWLSLEGKSTVNSD

SEQ ID NO: 1248945 - protein, 21 aa, Mycobacterium
VDGGWKINGHKIWTSSAQHAH

SEQ ID NO: 1248946 - protein, 34 aa, Mycobacterium
VDGGYRVSGAWQWSSGCDHATWAFLGGPVIKDGK

SEQ ID NO: 1248947 - protein, 18 aa, Mycobacterium
VDGPAPWAQALAVRGDTI

SEQ ID NO: 1248948 - protein, 18 aa, Mycobacterium
VDGPLRFELVDTAGGVSR

SEQ ID NO: 1248949 - protein, 17 aa, Mycobacterium
VDGRISHFYAMRNPDKL

SEQ ID NO: 1248950 - protein, 24 aa, Mycobacterium
VDHYAEIGLLGFALITDALGGVDV

SEQ ID NO: 1248951 - protein, 27 aa, Mycobacterium
VDIDGLRRFHCNLGHGLLGRLVERSPL

SEQ ID NO: 1248952 - protein, 24 aa, Mycobacterium
VDIPPRLRGAVTAMLSDVAIVGDL

SEQ ID NO: 1248953 - protein, 25 aa, Mycobacterium
VDIVPHLNLADGREVIVNRDDNEWE

SEQ ID NO: 1248954 - protein, 19 aa, Mycobacterium
VDKGARWDPAELGPVVADL

SEQ ID NO: 1248955 - protein, 26 aa, Mycobacterium
VDKLKDAGFHWATRSGVTVSMADVLV

SEQ ID NO: 1248956 - protein, 24 aa, Mycobacterium
VDLAYTRCDMVAKRGEFAVRGGIL

SEQ ID NO: 1248957 - protein, 19 aa, Mycobacterium
VDLDGGFVAPAFVDSHVHV

SEQ ID NO: 1248958 - protein, 17 aa, Mycobacterium
VDLGARVIESWRAVPGR

SEQ ID NO: 1248959 - protein, 18 aa, Mycobacterium
VDLGGRLLMPGFVEGHTH

SEQ ID NO: 1248960 - protein, 19 aa, Mycobacterium
VDLLHPRSRACVGAAAVLY

SEQ ID NO: 1248961 - protein, 24 aa, Mycobacterium
VDLPERPAEMVVNWVGDILSEHGN

SEQ ID NO: 1248962 - protein, 18 aa, Mycobacterium
VDLPFPRSRGDEGFDDLR

SEQ ID NO: 1248963 - protein, 24 aa, Mycobacterium
VDLRDDWCAALTAAGFDPARPSAW

SEQ ID NO: 1248964 - protein, 17 aa, Mycobacterium
VDLRDDWIGALEAAGFD

SEQ ID NO: 1248965 - protein, 28 aa, Mycobacterium
VDLYLRIAPELFLKRALVGGFEKVFELN

SEQ ID NO: 1248966 - protein, 24 aa, Mycobacterium
VDMKDMCGMMIAVARHFKREGIVP

SEQ ID NO: 1248967 - protein, 24 aa, Mycobacterium
VDNALRLLLLLGERSEIRLTDASE

SEQ ID NO: 1248968 - protein, 25 aa, Mycobacterium
VDNHRIGGIMIGSWTDLSMMGAPLA

SEQ ID NO: 1248969 - protein, 29 aa, Mycobacterium
VDPKAVPSRLAWETGVAMADSLLDRYRDD

SEQ ID NO: 1248970 - protein, 27 aa, Mycobacterium
VDPLLPEVAWSWLVEALDSKSDQVTAL

SEQ ID NO: 1248971 - protein, 23 aa, Mycobacterium
VDPMDRLRLLAATTDQAEALELF

SEQ ID NO: 1248972 - protein, 26 aa, Mycobacterium
VDPVLKIPRLQDAYFKRFTDYPKGIT

SEQ ID NO: 1248973 - protein, 20 aa, Mycobacterium
VDPVLTWSMPPVMTANTGID

SEQ ID NO: 1248974 - protein, 20 aa, Mycobacterium
VDPVVLAAMIVIRLQTIVSR

SEQ ID NO: 1248975 - protein, 25 aa, Mycobacterium
VDQDRCRGWRMCVSGCPYKKMYFNH

SEQ ID NO: 1248976 - protein, 22 aa, Mycobacterium
VDQGYDFFEVFCDTPLEDCERR

SEQ ID NO: 1248977 - protein, 18 aa, Mycobacterium
VDQPFNWVHHVSIELTAR

SEQ ID NO: 1248978 - protein, 23 aa, Mycobacterium
VDRDEVLLDIGYKTEGVIPSREL

SEQ ID NO: 1248979 - protein, 25 aa, Mycobacterium
VDSGFRAGSVISHYYDSLLAKVIAW

SEQ ID NO: 1248980 - protein, 21 aa, Mycobacterium
VDSLRVFPATHYVAGPERMAQ

SEQ ID NO: 1248981 - protein, 23 aa, Mycobacterium
VDSPPYRPFWAITKHADIMAIER

SEQ ID NO: 1248982 - protein, 18 aa, Mycobacterium
VDSYRLVYRADSMVNWCP

SEQ ID NO: 1248983 - protein, 20 aa, Mycobacterium
VDTAVLCDLCHGKGTHGTST

SEQ ID NO: 1248984 - protein, 24 aa, Mycobacterium
VDTEGKPSLGWRSRRAAHKVTAAL

SEQ ID NO: 1248985 - protein, 24 aa, Mycobacterium
VDTEIPSPVAGTLLEIIAEEDDTV

SEQ ID NO: 1248986 - protein, 20 aa, Mycobacterium
VDTLAALPMNLPAGVAVGAA

SEQ ID NO: 1248987 - protein, 20 aa, Mycobacterium
VDTTARLMFERGIENTTMED

SEQ ID NO: 1248988 - protein, 20 aa, Mycobacterium
VDTVECGMCGGSGLRPEALK

SEQ ID NO: 1248989 - protein, 25 aa, Mycobacterium
VDTYLRYADAVNRLDIVNEDPKSDL

SEQ ID NO: 1248990 - protein, 18 aa, Mycobacterium
VDVGNHFYCYSFEPSDRW

SEQ ID NO: 1248991 - protein, 17 aa, Mycobacterium
VDWTRLTAVTEMAVRFF

SEQ ID NO: 1248992 - protein, 17 aa, Mycobacterium
VDYDRVAVFDAMTSEVV

SEQ ID NO: 1248993 - protein, 17 aa, Mycobacterium
VEACPAVAPGIPLTKAI

SEQ ID NO: 1248994 - protein, 22 aa, Mycobacterium
VEAFKRNGVDFVVADDLEELVR

SEQ ID NO: 1248995 - protein, 20 aa, Mycobacterium
VEAGLKWPNDVLVGEGKLAG

SEQ ID NO: 1248996 - protein, 20 aa, Mycobacterium
VEALVGLGFAAKQAEEACDK

SEQ ID NO: 1248997 - protein, 30 aa, Mycobacterium
VEAPFLLIRAALPYMYAQKFGRVINISSVH

SEQ ID NO: 1248998 - protein, 23 aa, Mycobacterium
VEARAAMPVPAGWSGTEHLDAFV

SEQ ID NO: 1248999 - protein, 25 aa, Mycobacterium
VEARSRPDMFAHYGRPFPTGEAVEA

SEQ ID NO: 1249000 - protein, 25 aa, Mycobacterium
VEATRAAAGLGLLPCFMADRHDDLV

SEQ ID NO: 1249001 - protein, 24 aa, Mycobacterium
VECKEFFADTTFRVFQAPYVGAVV

SEQ ID NO: 1249002 - protein, 19 aa, Mycobacterium
VEDCTGCGLCVEACPAVAP

SEQ ID NO: 1249003 - protein, 19 aa, Mycobacterium
VEDLRRWNIRQVPLHVLVD

SEQ ID NO: 1249004 - protein, 21 aa, Mycobacterium
VEDRLKDMIISGGENVYSIEV

SEQ ID NO: 1249005 - protein, 17 aa, Mycobacterium
VEDVFPLPRELVGEGSL

SEQ ID NO: 1249006 - protein, 17 aa, Mycobacterium
VEEAIRLRVPVPSIAAS

SEQ ID NO: 1249007 - protein, 24 aa, Mycobacterium
VEEALRWASPLIHMRRTATQDVTV

SEQ ID NO: 1249008 - protein, 17 aa, Mycobacterium
VEEELRITVKRDPGGLV

SEQ ID NO: 1249009 - protein, 19 aa, Mycobacterium
VEELWRDAHRMSIVLGELG

SEQ ID NO: 1249010 - protein, 23 aa, Mycobacterium
VEEPPEHLIFVFATTEPEKVLPT

SEQ ID NO: 1249011 - protein, 19 aa, Mycobacterium
VEFLDELPLNATGKVMKDQ

SEQ ID NO: 1249012 - protein, 22 aa, Mycobacterium
VEFPPAGTLVGIAKRELRGVPT

SEQ ID NO: 1249013 - protein, 18 aa, Mycobacterium
VEGARKALGHAYGGGSQY

SEQ ID NO: 1249014 - protein, 24 aa, Mycobacterium
VEGRLRRYDCSQLTDGGAGIVLVT

SEQ ID NO: 1249015 - protein, 17 aa, Mycobacterium
VEGWTLVVVTHEIQFAR

SEQ ID NO: 1249016 - protein, 28 aa, Mycobacterium
VEHAFSWILPLMWRMDALYEARKSWLDI

SEQ ID NO: 1249017 - protein, 17 aa, Mycobacterium
VEHKAYLHRSGRTARAG

SEQ ID NO: 1249018 - protein, 17 aa, Mycobacterium
VEHVDGVLGFFLGDKRS

SEQ ID NO: 1249019 - protein, 17 aa, Mycobacterium
VEHVGSALPEFALLMRD

SEQ ID NO: 1249020 - protein, 21 aa, Mycobacterium
VEHYLRTPFVLSQCAIPHMRT

SEQ ID NO: 1249021 - protein, 24 aa, Mycobacterium
VEIAKSLFAQRGYEGTSIEEIAQR

SEQ ID NO: 1249022 - protein, 19 aa, Mycobacterium
VEIRGLVKTFGRTRALDGL

SEQ ID NO: 1249023 - protein, 19 aa, Mycobacterium
VEKVADLKVGMVLEGVVTN

SEQ ID NO: 1249024 - protein, 23 aa, Mycobacterium
VELADGWMPFGLSADRLSELLST

SEQ ID NO: 1249025 - protein, 25 aa, Mycobacterium
VELDGRPAADFDVIDEFIARYGIDL

SEQ ID NO: 1249026 - protein, 22 aa, Mycobacterium
VELEVLRHVPVTIAVAVGSDKV

SEQ ID NO: 1249027 - protein, 21 aa, Mycobacterium
VELLSHYVVVCIDEFELDDPG

SEQ ID NO: 1249028 - protein, 17 aa, Mycobacterium
VELNWAIESGLGTLDGQ

SEQ ID NO: 1249029 - protein, 18 aa, Mycobacterium
VELPIRFLSVIAFPDSAV

SEQ ID NO: 1249030 - protein, 22 aa, Mycobacterium
VELRLRCLDQLHTALVEHRDEL

SEQ ID NO: 1249031 - protein, 17 aa, Mycobacterium
VELRRQPPDISHLEAIF

SEQ ID NO: 1249032 - protein, 19 aa, Mycobacterium
VELRRRLEQGVGKEIPVTL

SEQ ID NO: 1249033 - protein, 22 aa, Mycobacterium
VELTGSWPGLRYDIDTPDDLLA

SEQ ID NO: 1249034 - protein, 19 aa, Mycobacterium
VELVRRVLEELPFQTLATG

SEQ ID NO: 1249035 - protein, 17 aa, Mycobacterium
VEMAWDPITRIVGSLGI

SEQ ID NO: 1249036 - protein, 20 aa, Mycobacterium
VEMENGYLLLMRVGDGSNLA

SEQ ID NO: 1249037 - protein, 17 aa, Mycobacterium
VEMLMPCFAELYEDLGI

SEQ ID NO: 1249038 - protein, 21 aa, Mycobacterium
VEMPAHHGMSLLVEVTADDSE

SEQ ID NO: 1249039 - protein, 20 aa, Mycobacterium
VENFFRFIAEDIRRYLAEMG

SEQ ID NO: 1249040 - protein, 30 aa, Mycobacterium
VEPADRARLAYLRLKGCVAQNHLQEALETG

SEQ ID NO: 1249041 - protein, 18 aa, Mycobacterium
VEPAKWIAALRHTKTDGN

SEQ ID NO: 1249042 - protein, 20 aa, Mycobacterium
VEPALKILVNLGYTNVTQDM

SEQ ID NO: 1249043 - protein, 28 aa, Mycobacterium
VEPGRYRLIVARACPWANRTIIVRRLLG

SEQ ID NO: 1249044 - protein, 18 aa, Mycobacterium
VEPLARRGLVAGRDVFVA

SEQ ID NO: 1249045 - protein, 25 aa, Mycobacterium
VEPLPEGAGFEFVDKVVGGAVPRQF

SEQ ID NO: 1249046 - protein, 23 aa, Mycobacterium
VEPVLRGEVMWCQLFSEPGAGSD

SEQ ID NO: 1249047 - protein, 18 aa, Mycobacterium
VERCLPLADHIARRFDGR

SEQ ID NO: 1249048 - protein, 25 aa, Mycobacterium
VEREIWSGKATFVFTRTTSGEIGIL

SEQ ID NO: 1249049 - protein, 22 aa, Mycobacterium
VEREWRAHLGAETFDRLRDAMV

SEQ ID NO: 1249050 - protein, 19 aa, Mycobacterium
VERFTRFGIARTNADDIAK

SEQ ID NO: 1249051 - protein, 19 aa, Mycobacterium
VERMLVGLLAKGHVLLEGV

SEQ ID NO: 1249052 - protein, 21 aa, Mycobacterium
VESMAARLAARRGRPEGLRWL

SEQ ID NO: 1249053 - protein, 18 aa, Mycobacterium
VETAKLFKGPEFDRRTVL

SEQ ID NO: 1249054 - protein, 19 aa, Mycobacterium
VETERRFYLANSVEMVPRN

SEQ ID NO: 1249055 - protein, 27 aa, Mycobacterium
VETSVLPFGRHRWVSAEGAPIAVSAPR

SEQ ID NO: 1249056 - protein, 28 aa, Mycobacterium
VETWADLVVTLRPEWTAGQARFAVYAAL

SEQ ID NO: 1249057 - protein, 25 aa, Mycobacterium
VEVHSLPLYHCAQLDNFLATDVYLG

SEQ ID NO: 1249058 - protein, 17 aa, Mycobacterium
VEVLRDIALLVADEPEF

SEQ ID NO: 1249059 - protein, 19 aa, Mycobacterium
VEVMSRVPLGSARATGMPY

SEQ ID NO: 1249060 - protein, 23 aa, Mycobacterium
VEVPADGVAAVMGHNGAGKTTLL

SEQ ID NO: 1249061 - protein, 25 aa, Mycobacterium
VEVPGLLDLSALWQIYAVDRPALKD

SEQ ID NO: 1249062 - protein, 20 aa, Mycobacterium
VEVRRSRRLVISMICTVGNY

SEQ ID NO: 1249063 - protein, 24 aa, Mycobacterium
VEYEVDCVIFASGFEISTEIHRRY

SEQ ID NO: 1249064 - protein, 17 aa, Mycobacterium
VFAAAGWDVERDGLIGA

SEQ ID NO: 1249065 - protein, 24 aa, Mycobacterium
VFAQLRAADGLTWHHPLSSLFPME

SEQ ID NO: 1249066 - protein, 18 aa, Mycobacterium
VFDSFPLTHHVECVAVLT

SEQ ID NO: 1249067 - protein, 19 aa, Mycobacterium
VFETMLAQSSFEFERPLTG

SEQ ID NO: 1249068 - protein, 17 aa, Mycobacterium
VFGEPDLVCDFWTELGR

SEQ ID NO: 1249069 - protein, 21 aa, Mycobacterium
VFGGNGFGYVNHWYADRSAVL

SEQ ID NO: 1249070 - protein, 19 aa, Mycobacterium
VFGMLRAGGSLVVVDEAQR

SEQ ID NO: 1249071 - protein, 26 aa, Mycobacterium
VFGRRVAVVACEFDFLAGSIGVAAAE

SEQ ID NO: 1249072 - protein, 17 aa, Mycobacterium
VFGRVYAGWAYCERFFA

SEQ ID NO: 1249073 - protein, 20 aa, Mycobacterium
VFIEECLRMDSPVKSVFRMA

SEQ ID NO: 1249074 - protein, 22 aa, Mycobacterium
VFKMAAELAYLEFGDLIDKMVD

SEQ ID NO: 1249075 - protein, 22 aa, Mycobacterium
VFLTRMRLSGMAIRDLQHYIAL

SEQ ID NO: 1249076 - protein, 19 aa, Mycobacterium
VFMDLPIVFDMGIALEGKG

SEQ ID NO: 1249077 - protein, 23 aa, Mycobacterium
VFNDPLVECLNCHKRHRQDHLQE

SEQ ID NO: 1249078 - protein, 17 aa, Mycobacterium
VFPELPPNTNGRFARPP

SEQ ID NO: 1249079 - protein, 23 aa, Mycobacterium
VFQQPRLFPWRTVGGNVDLALKY

SEQ ID NO: 1249080 - protein, 26 aa, Mycobacterium
VFREPLPRIGLDSLPEQGAWLQPFRP

SEQ ID NO: 1249081 - protein, 19 aa, Mycobacterium
VFRIHIPMFGRTVMVADPQ

SEQ ID NO: 1249082 - protein, 21 aa, Mycobacterium
VFRRASLWHSTFRNCSMLGSV

SEQ ID NO: 1249083 - protein, 21 aa, Mycobacterium
VFRYPRLGPGQLWEAAAAVLA

SEQ ID NO: 1249084 - protein, 20 aa, Mycobacterium
VFRYYARLIAVQSDRVVDVG

SEQ ID NO: 1249085 - protein, 22 aa, Mycobacterium
VFSEASPLFGVYVASKAALSAV

SEQ ID NO: 1249086 - protein, 24 aa, Mycobacterium
VFTGDRVLGAILFEQTMDREIEGK

SEQ ID NO: 1249087 - protein, 18 aa, Mycobacterium
VFTGFRAGQHINLSVEID

SEQ ID NO: 1249088 - protein, 17 aa, Mycobacterium
VFTLRDGKTVRVEVHGD

SEQ ID NO: 1249089 - protein, 24 aa, Mycobacterium
VFTRTGFTGGLNWYRNFDRNWELT

SEQ ID NO: 1249090 - protein, 22 aa, Mycobacterium
VFVAGPSPSGWQVSKGSALNLL

SEQ ID NO: 1249091 - protein, 17 aa, Mycobacterium
VFVDHGLLRSGERAQVQ

SEQ ID NO: 1249092 - protein, 25 aa, Mycobacterium
VFVIRPDGYLGFAAHRLDTEVFEGF

SEQ ID NO: 1249093 - protein, 21 aa, Mycobacterium
VFVMDHFYQLPGLGTPDAPML

SEQ ID NO: 1249094 - protein, 20 aa, Mycobacterium
VFVPPKFAKDAIIEAIDAEI

SEQ ID NO: 1249095 - protein, 24 aa, Mycobacterium
VGAALGRYGGKWAHDESRKSFGIA

SEQ ID NO: 1249096 - protein, 24 aa, Mycobacterium
VGADAYRVDGRLVFDEPTRTAVAT

SEQ ID NO: 1249097 - protein, 25 aa, Mycobacterium
VGADLPLRLSFGGEIDGFGSFEAAL

SEQ ID NO: 1249098 - protein, 20 aa, Mycobacterium
VGADRGYRGLQFYPATGTAG

SEQ ID NO: 1249099 - protein, 18 aa, Mycobacterium
VGAFNFAPNVSMYAAGKA

SEQ ID NO: 1249100 - protein, 24 aa, Mycobacterium
VGAGARLDGAVIFDGVRVGAGAVI

SEQ ID NO: 1249101 - protein, 25 aa, Mycobacterium
VGAHRFLQRVWRLVVDEQSGAVRVA

SEQ ID NO: 1249102 - protein, 17 aa, Mycobacterium
VGAKMARKRMRALKYSK

SEQ ID NO: 1249103 - protein, 27 aa, Mycobacterium
VGALCAVVPDAMRFCFELATEGTAADG

SEQ ID NO: 1249104 - protein, 18 aa, Mycobacterium
VGALGPRLTRATAEHADG

SEQ ID NO: 1249105 - protein, 17 aa, Mycobacterium
VGALGRLGVTGVSDVRQ

SEQ ID NO: 1249106 - protein, 19 aa, Mycobacterium
VGALVWSPLGWGRLTGRIR

SEQ ID NO: 1249107 - protein, 24 aa, Mycobacterium
VGARRTAEELGRAFAGTPVVTSSG

SEQ ID NO: 1249108 - protein, 26 aa, Mycobacterium
VGAVVPWNMPQFLIVTKLIPALLAGC

SEQ ID NO: 1249109 - protein, 19 aa, Mycobacterium
VGCNTEFASELVWRGYPSD

SEQ ID NO: 1249110 - protein, 23 aa, Mycobacterium
VGCYLGASALEYGPELSEFSHHS

SEQ ID NO: 1249111 - protein, 24 aa, Mycobacterium
VGDDIRFGLGAVRNVGANVVASLV

SEQ ID NO: 1249112 - protein, 31 aa, Mycobacterium
VGDFYAYPDALRRCWVRGNMIASVDGGATVA

SEQ ID NO: 1249113 - protein, 25 aa, Mycobacterium
VGDIARPRTEIMINLGNPELAFKTS

SEQ ID NO: 1249114 - protein, 23 aa, Mycobacterium
VGDPIQSIYGWRGASATNLPRFA

SEQ ID NO: 1249115 - protein, 23 aa, Mycobacterium
VGDPKLDLGWMVQSWPDDTDAPG

SEQ ID NO: 1249116 - protein, 19 aa, Mycobacterium
VGEEGRGFFYILDGLNPER

SEQ ID NO: 1249117 - protein, 17 aa, Mycobacterium
VGEIAAYAIAGVISADD

SEQ ID NO: 1249118 - protein, 25 aa, Mycobacterium
VGEPRFGLLEGDGRPSTAPALDRDG

SEQ ID NO: 1249119 - protein, 27 aa, Mycobacterium
VGETRPLYSRVLLKLGGEMFGGGAVGL

SEQ ID NO: 1249120 - protein, 19 aa, Mycobacterium
VGEWIGVQADSHWVADGIS

SEQ ID NO: 1249121 - protein, 21 aa, Mycobacterium
VGFACQSFAALSLEPPLVLFC

SEQ ID NO: 1249122 - protein, 17 aa, Mycobacterium
VGFGAAMDLLLSGRTFY

SEQ ID NO: 1249123 - protein, 20 aa, Mycobacterium
VGFQDGWRGLLENRRIQLRN

SEQ ID NO: 1249124 - protein, 22 aa, Mycobacterium
VGGALYPEWDVFNDRYKPDWCR

SEQ ID NO: 1249125 - protein, 25 aa, Mycobacterium
VGGGTGMICHGFKGGIGTSSRVADT

SEQ ID NO: 1249126 - protein, 24 aa, Mycobacterium
VGGHLKARLEALADRHPIIGTVHG

SEQ ID NO: 1249127 - protein, 23 aa, Mycobacterium
VGGHLTLLRRTRVGRFGLDEAYP

SEQ ID NO: 1249128 - protein, 21 aa, Mycobacterium
VGGKTVWGVGIATSITTASLR

SEQ ID NO: 1249129 - protein, 18 aa, Mycobacterium
VGGLRALLLQSLHPLAMA

SEQ ID NO: 1249130 - protein, 23 aa, Mycobacterium
VGGLRGGFEYARTGNPTRQSLES

SEQ ID NO: 1249131 - protein, 19 aa, Mycobacterium
VGGLRPDFAALQGQPHHRL

SEQ ID NO: 1249132 - protein, 18 aa, Mycobacterium
VGGLRVTALGGISEIGRN

SEQ ID NO: 1249133 - protein, 24 aa, Mycobacterium
VGGPHRFRLPDLIRTALTARGDGR

SEQ ID NO: 1249134 - protein, 24 aa, Mycobacterium
VGGVLRLGYLGTLGVGPGFAIGAA

SEQ ID NO: 1249135 - protein, 19 aa, Mycobacterium
VGHAGEWLAAMSPNQRAYA

SEQ ID NO: 1249136 - protein, 17 aa, Mycobacterium
VGHPLLATLGRDLRELQ

SEQ ID NO: 1249137 - protein, 27 aa, Mycobacterium
VGHSLGGGVAMQFAYQFPQFVDRLILV

SEQ ID NO: 1249138 - protein, 23 aa, Mycobacterium
VGIARSLLQAGIIERVDTPDGRR

SEQ ID NO: 1249139 - protein, 27 aa, Mycobacterium
VGIDLRHDWPAALRGAGFDPSRPTAWL

SEQ ID NO: 1249140 - protein, 26 aa, Mycobacterium
VGIDNWRWAGVPIYLRTGKKMAEGQR

SEQ ID NO: 1249141 - protein, 17 aa, Mycobacterium
VGIDWWTHDPWLTGNKS

SEQ ID NO: 1249142 - protein, 27 aa, Mycobacterium
VGIGSCRDSAWLLVSILRQLGLAARFV

SEQ ID NO: 1249143 - protein, 19 aa, Mycobacterium
VGIGSRPSTDWLEDSGITL

SEQ ID NO: 1249144 - protein, 18 aa, Mycobacterium
VGIVSARDLLGVYAADAD

SEQ ID NO: 1249145 - protein, 34 aa, Mycobacterium
VGKGVRVGLFFPNGVDWIVWWLAVSRIGALAVPL

SEQ ID NO: 1249146 - protein, 18 aa, Mycobacterium
VGKLTWYLGGRSASLSQL

SEQ ID NO: 1249147 - protein, 19 aa, Mycobacterium
VGKYFSVNVMLDRDTVRRR

SEQ ID NO: 1249148 - protein, 25 aa, Mycobacterium
VGLDCSGLTQWAYREAGLDLPRLAQ

SEQ ID NO: 1249149 - protein, 23 aa, Mycobacterium
VGLIRTALFNWAYARHTGGTFVF

SEQ ID NO: 1249150 - protein, 24 aa, Mycobacterium
VGLQRAVADHHQLASNFASPFSPQ

SEQ ID NO: 1249151 - protein, 22 aa, Mycobacterium
VGLRSSYVATVYAAPLMVPHRS

SEQ ID NO: 1249152 - protein, 24 aa, Mycobacterium
VGMAGRAALGFGKRLTGKSRDEVN

SEQ ID NO: 1249153 - protein, 27 aa, Mycobacterium
VGNNIPVFFIQDGIKFPDVVHAAKPHP

SEQ ID NO: 1249154 - protein, 19 aa, Mycobacterium
VGNSCRRDDGVGPAVASAV

SEQ ID NO: 1249155 - protein, 18 aa, Mycobacterium
VGPARAWDAGYDGRMILD

SEQ ID NO: 1249156 - protein, 24 aa, Mycobacterium
VGPFWKSNPWTAAYRQDRAKPSER

SEQ ID NO: 1249157 - protein, 19 aa, Mycobacterium
VGPKIEWVRRHEPEVFDRA

SEQ ID NO: 1249158 - protein, 26 aa, Mycobacterium
VGPLTWAVELDERWVVIGPNGAGKTS

SEQ ID NO: 1249159 - protein, 22 aa, Mycobacterium
VGPPELYAWLHYDPIPQRDDLA

SEQ ID NO: 1249160 - protein, 18 aa, Mycobacterium
VGPTIAAAVKEWFTVDWH

SEQ ID NO: 1249161 - protein, 17 aa, Mycobacterium
VGQAEFADVLVLTEPER

SEQ ID NO: 1249162 - protein, 23 aa, Mycobacterium
VGRCKRARVALPGGDAIGSRPLD

SEQ ID NO: 1249163 - protein, 19 aa, Mycobacterium
VGRCRRIFGTRKVGHAGTL

SEQ ID NO: 1249164 - protein, 29 aa, Mycobacterium
VGRDELLEFVRPRHKMVLITHRADGSLQS

SEQ ID NO: 1249165 - protein, 22 aa, Mycobacterium
VGREEFVSFAPISSVDTLITDG

SEQ ID NO: 1249166 - protein, 24 aa, Mycobacterium
VGRGRGGVRAALQGCRVPTIVGGV

SEQ ID NO: 1249167 - protein, 18 aa, Mycobacterium
VGRLFGWLGKVLADHPDQ

SEQ ID NO: 1249168 - protein, 24 aa, Mycobacterium
VGRRRWNRRGAMVTDRYQRLRHHD

SEQ ID NO: 1249169 - protein, 19 aa, Mycobacterium
VGSDITLKVVEMAGTVGYS

SEQ ID NO: 1249170 - protein, 17 aa, Mycobacterium
VGSEGKGLSRLVRENCD

SEQ ID NO: 1249171 - protein, 18 aa, Mycobacterium
VGSEVIVGLGPVKVPCRV

SEQ ID NO: 1249172 - protein, 17 aa, Mycobacterium
VGSHGRGGFPGMLLGSV

SEQ ID NO: 1249173 - protein, 25 aa, Mycobacterium
VGSLARLPLILTDGHLRELALTGKD

SEQ ID NO: 1249174 - protein, 18 aa, Mycobacterium
VGSSWKARYDRLKLNTGR

SEQ ID NO: 1249175 - protein, 25 aa, Mycobacterium
VGTAIAYACLIRGSAGTLALYDTNS

SEQ ID NO: 1249176 - protein, 19 aa, Mycobacterium
VGTALGVALERAGHVVVAC

SEQ ID NO: 1249177 - protein, 17 aa, Mycobacterium
VGTDMWVEIDKRFAELT

SEQ ID NO: 1249178 - protein, 27 aa, Mycobacterium
VGTGAGVSGLWLLSGMREDGVLTTIDV

SEQ ID NO: 1249179 - protein, 26 aa, Mycobacterium
VGTRQRCGATWGVGLTGVAGPEPHGG

SEQ ID NO: 1249180 - protein, 24 aa, Mycobacterium
VGTTRPCLVVSMDEWKAAAAGATS

SEQ ID NO: 1249181 - protein, 24 aa, Mycobacterium
VGVAISLRGGGLVAPAIHDVPDRS

SEQ ID NO: 1249182 - protein, 26 aa, Mycobacterium
VGVESDMPWPRRLWESGFNHNEPTIW

SEQ ID NO: 1249183 - protein, 19 aa, Mycobacterium
VGVLPTPAVAYLTSAYDAD

SEQ ID NO: 1249184 - protein, 24 aa, Mycobacterium
VGVPRLLNILDEFSVPATFFVPGY

SEQ ID NO: 1249185 - protein, 24 aa, Mycobacterium
VGVREFLDYDLAELREYIDWQPFF

SEQ ID NO: 1249186 - protein, 17 aa, Mycobacterium
VGVTSIYWYFRKKDDLL

SEQ ID NO: 1249187 - protein, 17 aa, Mycobacterium
VGVYGWVYGIDVENAPS

SEQ ID NO: 1249188 - protein, 17 aa, Mycobacterium
VGYPASSLLDLLRPKQS

SEQ ID NO: 1249189 - protein, 17 aa, Mycobacterium
VGYVTKGFPCPKGVHPT

SEQ ID NO: 1249190 - protein, 19 aa, Mycobacterium
VHACGERTARVALDAVERA

SEQ ID NO: 1249191 - protein, 18 aa, Mycobacterium
VHAGCTPVAAGTYHVGSG

SEQ ID NO: 1249192 - protein, 23 aa, Mycobacterium
VHAKVCIVDDVWAVVGSNNLNNR

SEQ ID NO: 1249193 - protein, 24 aa, Mycobacterium
VHAVKGAELMDKWVGASEKAVREL

SEQ ID NO: 1249194 - protein, 23 aa, Mycobacterium
VHDGGDHLVVFGAVHSLSEVPKK

SEQ ID NO: 1249195 - protein, 19 aa, Mycobacterium
VHDLMGPRLQGKMMEYLPP

SEQ ID NO: 1249196 - protein, 17 aa, Mycobacterium
VHGPARRRNYVYEPTFL

SEQ ID NO: 1249197 - protein, 18 aa, Mycobacterium
VHGPVALVHFDAHLDTWD

SEQ ID NO: 1249198 - protein, 18 aa, Mycobacterium
VHGSASWLPVPGLAEILP

SEQ ID NO: 1249199 - protein, 21 aa, Mycobacterium
VHGVGLYLGVEMVRDRQTLEP

SEQ ID NO: 1249200 - protein, 26 aa, Mycobacterium
VHHYPCDHFDVWPGHDWHDRAATDQA

SEQ ID NO: 1249201 - protein, 24 aa, Mycobacterium
VHIPERPNPLMVMSDEEWRLALRR

SEQ ID NO: 1249202 - protein, 18 aa, Mycobacterium
VHLAKSCAAEGAHGLLVV

SEQ ID NO: 1249203 - protein, 26 aa, Mycobacterium
VHLDVPLYWQCWKLDSPLVARLTGAV

SEQ ID NO: 1249204 - protein, 17 aa, Mycobacterium
VHLKGHFATMKHAAAYW

SEQ ID NO: 1249205 - protein, 24 aa, Mycobacterium
VHLKSVVYELLWFLRGESNVRWLQ

SEQ ID NO: 1249206 - protein, 18 aa, Mycobacterium
VHNTWGLRPAVVERTREI

SEQ ID NO: 1249207 - protein, 23 aa, Mycobacterium
VHPARFVVEATKAFNEYAEDGIM

SEQ ID NO: 1249208 - protein, 24 aa, Mycobacterium
VHPECGCATSALYLAGEGAFPADR

SEQ ID NO: 1249209 - protein, 17 aa, Mycobacterium
VHPGCPHGFDAFGFDIS

SEQ ID NO: 1249210 - protein, 18 aa, Mycobacterium
VHPGYTWTAMGAVNAIPD

SEQ ID NO: 1249211 - protein, 23 aa, Mycobacterium
VHPPFRWQRRYAEGFSEQVAELE

SEQ ID NO: 1249212 - protein, 18 aa, Mycobacterium
VHQALELHRKWAADAPEN

SEQ ID NO: 1249213 - protein, 17 aa, Mycobacterium
VHQCMLDADFLEQVGFT

SEQ ID NO: 1249214 - protein, 18 aa, Mycobacterium
VHREHVFEGIGSCVDALN

SEQ ID NO: 1249215 - protein, 17 aa, Mycobacterium
VHRHLRRYMNWIPGEYV

SEQ ID NO: 1249216 - protein, 23 aa, Mycobacterium
VHRVIGRAGGIFISHGQVERNLA

SEQ ID NO: 1249217 - protein, 17 aa, Mycobacterium
VHSCIGAPLARAEGRVL

SEQ ID NO: 1249218 - protein, 19 aa, Mycobacterium
VHTVSIWMGILLTEKLRGA

SEQ ID NO: 1249219 - protein, 18 aa, Mycobacterium
VHVPRLVRRTGQPSGAPL

SEQ ID NO: 1249220 - protein, 18 aa, Mycobacterium
VHVRRLRAKLGPEYESLI

SEQ ID NO: 1249221 - protein, 20 aa, Mycobacterium
VHVRRLREKLGHDPQHGEFI

SEQ ID NO: 1249222 - protein, 19 aa, Mycobacterium
VHYYRHGRIGDFVVEEPMI

SEQ ID NO: 1249223 - protein, 17 aa, Mycobacterium
VIARCRTSVELLAPHAC

SEQ ID NO: 1249224 - protein, 18 aa, Mycobacterium
VIASPAWGAVGEVGSFNF

SEQ ID NO: 1249225 - protein, 20 aa, Mycobacterium
VIAYALAGSMDFDFENDCLG

SEQ ID NO: 1249226 - protein, 27 aa, Mycobacterium
VICDKGFPSYFLIVADLINYAKSVDIR

SEQ ID NO: 1249227 - protein, 31 aa, Mycobacterium
VICGLRPGQRLRIVKYLAYGWSSLRSRPALR

SEQ ID NO: 1249228 - protein, 20 aa, Mycobacterium
VIDGGARPPRITVVVDGDRP

SEQ ID NO: 1249229 - protein, 23 aa, Mycobacterium
VIEAALPGLHDWVDEQLTIRGIA

SEQ ID NO: 1249230 - protein, 25 aa, Mycobacterium
VIEALELLYVGALVWAGMGYSSYDD

SEQ ID NO: 1249231 - protein, 18 aa, Mycobacterium
VIEGLKAMLATYADRVAV

SEQ ID NO: 1249232 - protein, 17 aa, Mycobacterium
VIEHLWDQPQFVGECLR

SEQ ID NO: 1249233 - protein, 20 aa, Mycobacterium
VIELDLKFGGLDLRLPDGAS

SEQ ID NO: 1249234 - protein, 24 aa, Mycobacterium
VIELRIPLRETFGGSAKGHGRHVK

SEQ ID NO: 1249235 - protein, 23 aa, Mycobacterium
VIGCGESGLLAGIRLKEAGIPFT

SEQ ID NO: 1249236 - protein, 25 aa, Mycobacterium
VIGETMVRGRIDAVFADDDGGATIV

SEQ ID NO: 1249237 - protein, 19 aa, Mycobacterium
VIGGLQMLLHQAFAQVEQF

SEQ ID NO: 1249238 - protein, 28 aa, Mycobacterium
VIGLELARRLAREWLNYEFDPASKSADK

SEQ ID NO: 1249239 - protein, 30 aa, Mycobacterium
VIGLPPTVTVFGIPIFKLGGAPVNVVSSVT

SEQ ID NO: 1249240 - protein, 20 aa, Mycobacterium
VIGPDGYRVVDRVEDGTRLE

SEQ ID NO: 1249241 - protein, 22 aa, Mycobacterium
VIGVACPRFVDFVERGVTSGRQ

SEQ ID NO: 1249242 - protein, 17 aa, Mycobacterium
VIHYWALDGEWDCFAEH

SEQ ID NO: 1249243 - protein, 21 aa, Mycobacterium
VILEAKWKYNFRGGAPAEVTH

SEQ ID NO: 1249244 - protein, 17 aa, Mycobacterium
VILTCLDEGALTFVAKS

SEQ ID NO: 1249245 - protein, 22 aa, Mycobacterium
VINAFVRWGRHLLFTRTPTDLV

SEQ ID NO: 1249246 - protein, 17 aa, Mycobacterium
VINTRLTTITTEAKTID

SEQ ID NO: 1249247 - protein, 28 aa, Mycobacterium
VIRRVSAAWQLPLEWLNVPVGGVALDVG

SEQ ID NO: 1249248 - protein, 18 aa, Mycobacterium
VISAAEWTRLERGITQRV

SEQ ID NO: 1249249 - protein, 26 aa, Mycobacterium
VITAFNFPVAVWSWNTAVALVCGDTV

SEQ ID NO: 1249250 - protein, 20 aa, Mycobacterium
VITPSVLVAVELADEPDTTI

SEQ ID NO: 1249251 - protein, 19 aa, Mycobacterium
VIYRRRMLGTVRVAAVADL

SEQ ID NO: 1249252 - protein, 17 aa, Mycobacterium
VKAAGGIGCMLDVEGGA

SEQ ID NO: 1249253 - protein, 20 aa, Mycobacterium
VKAGAIAVNVNFRYVEGELR

SEQ ID NO: 1249254 - protein, 18 aa, Mycobacterium
VKAGARITQAPALGPKPG

SEQ ID NO: 1249255 - protein, 19 aa, Mycobacterium
VKATLPRLGELAIGGTAVG

SEQ ID NO: 1249256 - protein, 19 aa, Mycobacterium
VKDGEAFADAWKFAEDGVY

SEQ ID NO: 1249257 - protein, 20 aa, Mycobacterium
VKDLIIRGGHNIDPAQIEDA

SEQ ID NO: 1249258 - protein, 29 aa, Mycobacterium
VKEPVGVCGLITPWNWPINQIACKVFPAL

SEQ ID NO: 1249259 - protein, 25 aa, Mycobacterium
VKEVSDIPVGVGLGVRSREQAAEIG

SEQ ID NO: 1249260 - protein, 18 aa, Mycobacterium
VKGENRYFVVTQWETEEA

SEQ ID NO: 1249261 - protein, 24 aa, Mycobacterium
VKGGRRFSFTALVIVGDGNGMVGV

SEQ ID NO: 1249262 - protein, 21 aa, Mycobacterium
VKGLVWRSHLDKLAYSEEENR

SEQ ID NO: 1249263 - protein, 21 aa, Mycobacterium
VKGMSPVEWVRFAANTVGTRV

SEQ ID NO: 1249264 - protein, 24 aa, Mycobacterium
VKGRNVEIPDHFRTYVAEKLTRLE

SEQ ID NO: 1249265 - protein, 25 aa, Mycobacterium
VKHAMIDWLGPIVYEYYSSTEAHGM

SEQ ID NO: 1249266 - protein, 17 aa, Mycobacterium
VKHSAMGRLKHEGANIY

SEQ ID NO: 1249267 - protein, 19 aa, Mycobacterium
VKLIQPVAMDEGLRFAIRE

SEQ ID NO: 1249268 - protein, 19 aa, Mycobacterium
VKMGFYSYSFIKTDDDGQI

SEQ ID NO: 1249269 - protein, 18 aa, Mycobacterium
VKPARGGSSIGVSRVSDW

SEQ ID NO: 1249270 - protein, 32 aa, Mycobacterium
VKPEEWRQELPLIEEWFEFVGEKLPTGIRDEF

SEQ ID NO: 1249271 - protein, 31 aa, Mycobacterium
VKPTSVPAFRPGAQFKAIVSGAQKLASEGPA

SEQ ID NO: 1249272 - protein, 18 aa, Mycobacterium
VKQHPDRFVSGWRIVALQ

SEQ ID NO: 1249273 - protein, 29 aa, Mycobacterium
VKQPLGGCYRIAVLSLKGGVGKTTITATL

SEQ ID NO: 1249274 - protein, 25 aa, Mycobacterium
VKQQMLDWWGPVIYEYYGGTEANGT

SEQ ID NO: 1249275 - protein, 20 aa, Mycobacterium
VKREPGQLVEMAWDPITRIV

SEQ ID NO: 1249276 - protein, 21 aa, Mycobacterium
VKSRLHYAVRALRLNLQEMGV

SEQ ID NO: 1249277 - protein, 19 aa, Mycobacterium
VKTAIAWARANVDKFGGDR

SEQ ID NO: 1249278 - protein, 19 aa, Mycobacterium
VKVGARLRARGEISKVDRL

SEQ ID NO: 1249279 - protein, 19 aa, Mycobacterium
VKVHPEFQQYYYAPHMGGV

SEQ ID NO: 1249280 - protein, 17 aa, Mycobacterium
VKVNRLLLNNVDVVGVG

SEQ ID NO: 1249281 - protein, 21 aa, Mycobacterium
VKVVRLGGAGRGFSSGAGISE

SEQ ID NO: 1249282 - protein, 23 aa, Mycobacterium
VKVWKGVRYAAAPAGELRWRAPQ

SEQ ID NO: 1249283 - protein, 19 aa, Mycobacterium
VLAALKAGPAVALRKTKQA

SEQ ID NO: 1249284 - protein, 17 aa, Mycobacterium
VLAAVGMSRSTYYDRQG

SEQ ID NO: 1249285 - protein, 28 aa, Mycobacterium
VLADRLNRWRRLGCWVSGHGEGWALYAE

SEQ ID NO: 1249286 - protein, 18 aa, Mycobacterium
VLAELPARPGGSEEEITP

SEQ ID NO: 1249287 - protein, 21 aa, Mycobacterium
VLAERLAGWADRYPDVPVQRV

SEQ ID NO: 1249288 - protein, 24 aa, Mycobacterium
VLAGFPGTVTSFWQQAGRSGRRGQ

SEQ ID NO: 1249289 - protein, 18 aa, Mycobacterium
VLAGLDWFPPSRHREALT

SEQ ID NO: 1249290 - protein, 23 aa, Mycobacterium
VLAGQRLCIYLDPSREWQPTLGV

SEQ ID NO: 1249291 - protein, 17 aa, Mycobacterium
VLAKAVWDHASDPDYRD

SEQ ID NO: 1249292 - protein, 20 aa, Mycobacterium
VLATDVLRRLRMRKDAAEID

SEQ ID NO: 1249293 - protein, 19 aa, Mycobacterium
VLAVTGWEAANTVYKDSEN

SEQ ID NO: 1249294 - protein, 17 aa, Mycobacterium
VLAVWRGDFAEAERHHR

SEQ ID NO: 1249295 - protein, 25 aa, Mycobacterium
VLCHISHVYPTGASLYFTVVAAQRG

SEQ ID NO: 1249296 - protein, 25 aa, Mycobacterium
VLDEVTARLGRRCRAQVHGQVLGSG

SEQ ID NO: 1249297 - protein, 19 aa, Mycobacterium
VLDGIRAAQNFDRLGLSAE

SEQ ID NO: 1249298 - protein, 30 aa, Mycobacterium
VLDGRRATSHWMAVPLLKPFGVTPVGDERV

SEQ ID NO: 1249299 - protein, 19 aa, Mycobacterium
VLDNGRLAGIVSIGDVVKN

SEQ ID NO: 1249300 - protein, 17 aa, Mycobacterium
VLDNVAFGLKMRGKAKA

SEQ ID NO: 1249301 - protein, 17 aa, Mycobacterium
VLDRGPDAIALLTTDTI

SEQ ID NO: 1249302 - protein, 18 aa, Mycobacterium
VLDRLADVGLGYLSLGQP

SEQ ID NO: 1249303 - protein, 26 aa, Mycobacterium
VLDRRFARADARLRRRPATPAAVPAA

SEQ ID NO: 1249304 - protein, 21 aa, Mycobacterium
VLDRYVPVLTQLRMRYLDVDT

SEQ ID NO: 1249305 - protein, 30 aa, Mycobacterium
VLDWSDAPFAKWFVGGKINVAYNCVDRHVE

SEQ ID NO: 1249306 - protein, 21 aa, Mycobacterium
VLDYHEWREGLLRGLAAHHAG

SEQ ID NO: 1249307 - protein, 26 aa, Mycobacterium
VLEDALRFYFEFHFDQGEGYLAHLHD

SEQ ID NO: 1249308 - protein, 18 aa, Mycobacterium
VLEELPFQTLATGYGLTE

SEQ ID NO: 1249309 - protein, 23 aa, Mycobacterium
VLEGFPTPEEFIAAFNAALEGVV

SEQ ID NO: 1249310 - protein, 18 aa, Mycobacterium
VLEGPALTESLRHGVTTV

SEQ ID NO: 1249311 - protein, 19 aa, Mycobacterium
VLELHGWGDLHTELHRLSR

SEQ ID NO: 1249312 - protein, 19 aa, Mycobacterium
VLENVTPFGRGMRGASNVY

SEQ ID NO: 1249313 - protein, 34 aa, Mycobacterium
VLERGLLLRIRFALDHHINLRPAKLYSGVTGPLA

SEQ ID NO: 1249314 - protein, 26 aa, Mycobacterium
VLERLRPGDFYRPAHQNVYDAVLDLY

SEQ ID NO: 1249315 - protein, 25 aa, Mycobacterium
VLETRGRFGTFVSRVDPADTAMATA

SEQ ID NO: 1249316 - protein, 25 aa, Mycobacterium
VLEVGQRLLWAFAIALGEDPDVFTR

SEQ ID NO: 1249317 - protein, 22 aa, Mycobacterium
VLEVTGRLAAPLLPLVTEVIWR

SEQ ID NO: 1249318 - protein, 18 aa, Mycobacterium
VLGDSLFTRTEVVGLKQN

SEQ ID NO: 1249319 - protein, 25 aa, Mycobacterium
VLGRLRIAIPADFAPIIDLKAEIYG

SEQ ID NO: 1249320 - protein, 23 aa, Mycobacterium
VLGTGFAVLCWNNNPRALLGADL

SEQ ID NO: 1249321 - protein, 18 aa, Mycobacterium
VLGWERNGWLTAAKQPVK

SEQ ID NO: 1249322 - protein, 25 aa, Mycobacterium
VLHAKGRPFGGARIILELSDIPDGC

SEQ ID NO: 1249323 - protein, 18 aa, Mycobacterium
VLHEVRLMLEQYWPSVPH

SEQ ID NO: 1249324 - protein, 26 aa, Mycobacterium
VLHGECGWEYFAPVFVGDELTETRRV

SEQ ID NO: 1249325 - protein, 26 aa, Mycobacterium
VLHLWPHARCALMGVGAPPLMRSDIP

SEQ ID NO: 1249326 - protein, 26 aa, Mycobacterium
VLINGRLRPGVGRICMDQFVVDLGPG

SEQ ID NO: 1249327 - protein, 18 aa, Mycobacterium
VLISSEWGSPSMIENGIV

SEQ ID NO: 1249328 - protein, 18 aa, Mycobacterium
VLIVHWHDLGRYLGAYGH

SEQ ID NO: 1249329 - protein, 29 aa, Mycobacterium
VLLDRERCVLCARCTRFSQQIAGDPFIEL

SEQ ID NO: 1249330 - protein, 18 aa, Mycobacterium
VLLGRRQRIAHGGAVDAS

SEQ ID NO: 1249331 - protein, 24 aa, Mycobacterium
VLLMAVERIELFTKVLIEGGRPAE

SEQ ID NO: 1249332 - protein, 19 aa, Mycobacterium
VLMSPDLKRTVAALAAVGL

SEQ ID NO: 1249333 - protein, 19 aa, Mycobacterium
VLPALAAGCTVVIKPCELT

SEQ ID NO: 1249334 - protein, 19 aa, Mycobacterium
VLPKGLGIETGRLVLDAVQ

SEQ ID NO: 1249335 - protein, 24 aa, Mycobacterium
VLPRRGDQSQVRWFETDPTYALHF

SEQ ID NO: 1249336 - protein, 17 aa, Mycobacterium
VLPSRKEGWGLAVTEAG

SEQ ID NO: 1249337 - protein, 22 aa, Mycobacterium
VLPTAGCARHSSGLSVQTFLRG

SEQ ID NO: 1249338 - protein, 19 aa, Mycobacterium
VLQYPWGVIPDKYIDRVQD

SEQ ID NO: 1249339 - protein, 17 aa, Mycobacterium
VLRAKLAGFTVVDQHGD

SEQ ID NO: 1249340 - protein, 18 aa, Mycobacterium
VLRDCAPSVILTTSSVAG

SEQ ID NO: 1249341 - protein, 24 aa, Mycobacterium
VLRIAADVRLKGRALIRDLLSRQV

SEQ ID NO: 1249342 - protein, 18 aa, Mycobacterium
VLRKDFIVRPYQIHEARA

SEQ ID NO: 1249343 - protein, 23 aa, Mycobacterium
VLRPEALTLASFIAASTTRIGLI

SEQ ID NO: 1249344 - protein, 18 aa, Mycobacterium
VLRQQGWVSSTRVGRAVS

SEQ ID NO: 1249345 - protein, 23 aa, Mycobacterium
VLRRARDGVALNVDEAAIAMTAR

SEQ ID NO: 1249346 - protein, 19 aa, Mycobacterium
VLRRLTAQRAHWALGTLQL

SEQ ID NO: 1249347 - protein, 33 aa, Mycobacterium
VLRTFSKAYGLAGLRIGYAVADADIVTALGKVY

SEQ ID NO: 1249348 - protein, 18 aa, Mycobacterium
VLRVFERRGLPLTVFGVA

SEQ ID NO: 1249349 - protein, 21 aa, Mycobacterium
VLSGRLRLILGDRDFIVEPGE

SEQ ID NO: 1249350 - protein, 23 aa, Mycobacterium
VLSKAQILDRVWSYDFGGRSNIV

SEQ ID NO: 1249351 - protein, 24 aa, Mycobacterium
VLSQRPRMLFDYFQQLFAQVTNPP

SEQ ID NO: 1249352 - protein, 22 aa, Mycobacterium
VLTHLLGLPGVRNYDGSWTEWG

SEQ ID NO: 1249353 - protein, 34 aa, Mycobacterium
VLTPLAVDPAHPFPFVSGLSLNLAITVRHPDDGG

SEQ ID NO: 1249354 - protein, 20 aa, Mycobacterium
VLTRDGRSAVLVTHDLVDVA

SEQ ID NO: 1249355 - protein, 24 aa, Mycobacterium
VLTRPDAAAGRRGRPTPSPVARLA

SEQ ID NO: 1249356 - protein, 29 aa, Mycobacterium
VLVDFWASWCGPCRAFAPTFAASSEKHPD

SEQ ID NO: 1249357 - protein, 17 aa, Mycobacterium
VLVHRIPAGCTFDTHRL

SEQ ID NO: 1249358 - protein, 21 aa, Mycobacterium
VLVKASAGGGGRGMRIVASPD

SEQ ID NO: 1249359 - protein, 18 aa, Mycobacterium
VLVYAHGGGFVFCDLDSH

SEQ ID NO: 1249360 - protein, 20 aa, Mycobacterium
VLWGGRRPELLGGRAEPVRY

SEQ ID NO: 1249361 - protein, 24 aa, Mycobacterium
VLYGRWTFQIVEDFDDNYWSVFRD

SEQ ID NO: 1249362 - protein, 25 aa, Mycobacterium
VLYPRKGVSDLTRFTPDAVQEKYGL

SEQ ID NO: 1249363 - protein, 17 aa, Mycobacterium
VLYTRAGPEIGVAATKT

SEQ ID NO: 1249364 - protein, 30 aa, Mycobacterium
VMAAIGRERFAEFLAGFHLVDEHFRTAPLE

SEQ ID NO: 1249365 - protein, 20 aa, Mycobacterium
VMADLARWEAGSALGEDTYD

SEQ ID NO: 1249366 - protein, 18 aa, Mycobacterium
VMASPEFAADMTGFDVDE

SEQ ID NO: 1249367 - protein, 18 aa, Mycobacterium
VMATKRSPLIAIVDGAGR

SEQ ID NO: 1249368 - protein, 23 aa, Mycobacterium
VMDVRFLPNPHWVDALRPHTGQH

SEQ ID NO: 1249369 - protein, 25 aa, Mycobacterium
VMGLAEMLARLGIPYDSEEALRLTD

SEQ ID NO: 1249370 - protein, 23 aa, Mycobacterium
VMGMPNRVNWTIVHYKPPQAMTL

SEQ ID NO: 1249371 - protein, 19 aa, Mycobacterium
VMIEPGVRTGIPLLVDNPK

SEQ ID NO: 1249372 - protein, 24 aa, Mycobacterium
VMPTVLHDIAWRAMQVHGALGVTN

SEQ ID NO: 1249373 - protein, 19 aa, Mycobacterium
VMRSACADFARWRSRRTAG

SEQ ID NO: 1249374 - protein, 17 aa, Mycobacterium
VMSCSALKRKYRDQLRR

SEQ ID NO: 1249375 - protein, 19 aa, Mycobacterium
VMTGFRVSRSGWYGLDPVD

SEQ ID NO: 1249376 - protein, 26 aa, Mycobacterium
VMTWLFAWCFARRGWAERARVLRHEG

SEQ ID NO: 1249377 - protein, 19 aa, Mycobacterium
VMVTLKIARFNPEAPDDAG

SEQ ID NO: 1249378 - protein, 20 aa, Mycobacterium
VNALAPGYCKTEMAPVDKPE

SEQ ID NO: 1249379 - protein, 22 aa, Mycobacterium
VNARYLRICVLTQYKSHSLDRH

SEQ ID NO: 1249380 - protein, 20 aa, Mycobacterium
VNAYCPGVVGTDMWVEIDKR

SEQ ID NO: 1249381 - protein, 26 aa, Mycobacterium
VNAYRGCSHACRYCFARPTHEYLDFD

SEQ ID NO: 1249382 - protein, 18 aa, Mycobacterium
VNDLLLPIVKGYGSERSW

SEQ ID NO: 1249383 - protein, 18 aa, Mycobacterium
VNEFDYFVRMWNQAAGAM

SEQ ID NO: 1249384 - protein, 18 aa, Mycobacterium
VNESCDYMTFGQAVLDRE

SEQ ID NO: 1249385 - protein, 18 aa, Mycobacterium
VNGRKVWISKALESEKIL

SEQ ID NO: 1249386 - protein, 21 aa, Mycobacterium
VNLLLSPAVFHGFDQAGALSP

SEQ ID NO: 1249387 - protein, 17 aa, Mycobacterium
VNLLSWRYRDPGLLLAQ

SEQ ID NO: 1249388 - protein, 18 aa, Mycobacterium
VNLPDWLSLTFRIDGGDW

SEQ ID NO: 1249389 - protein, 19 aa, Mycobacterium
VNLPEGYLTISYPDRHGAV

SEQ ID NO: 1249390 - protein, 17 aa, Mycobacterium
VNMRGRHLTVHRAEGSE

SEQ ID NO: 1249391 - protein, 18 aa, Mycobacterium
VNPGYVRTPLVTKQIADQ

SEQ ID NO: 1249392 - protein, 18 aa, Mycobacterium
VNPQSFDYCRPISRDEIL

SEQ ID NO: 1249393 - protein, 24 aa, Mycobacterium
VNPRPRFVERIRLHQLVAGTGEAT

SEQ ID NO: 1249394 - protein, 20 aa, Mycobacterium
VNPRVHLFFGGRFPCDLYDL

SEQ ID NO: 1249395 - protein, 22 aa, Mycobacterium
VNRLRWKAYLSAGSRDDAEEIR

SEQ ID NO: 1249396 - protein, 23 aa, Mycobacterium
VNSRSAAMGVGFVATAAARCAAA

SEQ ID NO: 1249397 - protein, 18 aa, Mycobacterium
VNTDVAFHSPAMDGLTAE

SEQ ID NO: 1249398 - protein, 24 aa, Mycobacterium
VNVDGELPPGVSAKDIILAVIAKI

SEQ ID NO: 1249399 - protein, 17 aa, Mycobacterium
VPAAGAILADWGADVIK

SEQ ID NO: 1249400 - protein, 25 aa, Mycobacterium
VPAAIRLLAALAFDLIILETVGVGQ

SEQ ID NO: 1249401 - protein, 25 aa, Mycobacterium
VPAAMLRSTFVYRHRQLADDLASHR

SEQ ID NO: 1249402 - protein, 26 aa, Mycobacterium
VPAARAAENILGYTIANDVSARDQQQ

SEQ ID NO: 1249403 - protein, 25 aa, Mycobacterium
VPAARLGVDVVLPWDGRDHYLAGVY

SEQ ID NO: 1249404 - protein, 23 aa, Mycobacterium
VPAARLMVLPAMSHIGIAAAYDV

SEQ ID NO: 1249405 - protein, 26 aa, Mycobacterium
VPAFALGDYEWILAFEAPELHRIVDL

SEQ ID NO: 1249406 - protein, 21 aa, Mycobacterium
VPAGARVDAYRAADLLAAAAT

SEQ ID NO: 1249407 - protein, 21 aa, Mycobacterium
VPAGLPAEMPHLASPQNLPPG

SEQ ID NO: 1249408 - protein, 19 aa, Mycobacterium
VPAGTIWVHCASGYRSSIA

SEQ ID NO: 1249409 - protein, 22 aa, Mycobacterium
VPASCCGLVGLKPRRARTSFAP

SEQ ID NO: 1249410 - protein, 22 aa, Mycobacterium
VPASGAFEPAEFLDLCEHHPGC

SEQ ID NO: 1249411 - protein, 20 aa, Mycobacterium
VPAVRARLVDLQRRLADGSG

SEQ ID NO: 1249412 - protein, 24 aa, Mycobacterium
VPDDGRWLRTGDLGTYLDGELYVT

SEQ ID NO: 1249413 - protein, 26 aa, Mycobacterium
VPDEFFRAVVDFDLPEPGSYATGIAF

SEQ ID NO: 1249414 - protein, 22 aa, Mycobacterium
VPDHLLQILARFARNLRESSSV

SEQ ID NO: 1249415 - protein, 19 aa, Mycobacterium
VPDHPDHVMYVWVDALTNY

SEQ ID NO: 1249416 - protein, 21 aa, Mycobacterium
VPDRWRLAAELPRQMLRSWYI

SEQ ID NO: 1249417 - protein, 17 aa, Mycobacterium
VPEAMAADVEAALPGSR

SEQ ID NO: 1249418 - protein, 18 aa, Mycobacterium
VPECKLVASYIDKHDEYA

SEQ ID NO: 1249419 - protein, 21 aa, Mycobacterium
VPECQSPLFLHVDAGDRDRVR

SEQ ID NO: 1249420 - protein, 21 aa, Mycobacterium
VPEFPNFFCMYGPGTNLAHGG

SEQ ID NO: 1249421 - protein, 22 aa, Mycobacterium
VPELPVGVRLIFQAAEELMPGG

SEQ ID NO: 1249422 - protein, 18 aa, Mycobacterium
VPEPEPGPGEVVIRVAGA

SEQ ID NO: 1249423 - protein, 22 aa, Mycobacterium
VPEQAKRLLALLEQRGVGQWAT

SEQ ID NO: 1249424 - protein, 17 aa, Mycobacterium
VPEVSFAVCDRLGIKPK

SEQ ID NO: 1249425 - protein, 21 aa, Mycobacterium
VPFGTQWYGYFVRRLAERPAN

SEQ ID NO: 1249426 - protein, 19 aa, Mycobacterium
VPGAAEFAHPISEYEHGEP

SEQ ID NO: 1249427 - protein, 24 aa, Mycobacterium
VPGEPRVGFGQLYGAPGTAAAMIV

SEQ ID NO: 1249428 - protein, 25 aa, Mycobacterium
VPGFPNLFSVSGPYGYVGSSYFALI

SEQ ID NO: 1249429 - protein, 19 aa, Mycobacterium
VPGHELVGVVAEVGAGVEK

SEQ ID NO: 1249430 - protein, 17 aa, Mycobacterium
VPGLSAGQVSVRAGSPF

SEQ ID NO: 1249431 - protein, 24 aa, Mycobacterium
VPGPDRVPLLALLRRRLTDEEVTA

SEQ ID NO: 1249432 - protein, 20 aa, Mycobacterium
VPGPWRLDGLPLVISADDWD

SEQ ID NO: 1249433 - protein, 22 aa, Mycobacterium
VPGSFRPGRAISGFVTGAQGLG

SEQ ID NO: 1249434 - protein, 22 aa, Mycobacterium
VPGTRLVTAISLFDAETAQRLP

SEQ ID NO: 1249435 - protein, 20 aa, Mycobacterium
VPGVVSVPYFWSDQYDVKIQ

SEQ ID NO: 1249436 - protein, 20 aa, Mycobacterium
VPIVQAWGMTETSPLATVAR

SEQ ID NO: 1249437 - protein, 33 aa, Mycobacterium; identical to SEQ ID NO: 748069

SEQ ID NO: 1249438 - protein, 25 aa, Mycobacterium
VPKTLIQHLIRWVILSKQFDDTVNE

SEQ ID NO: 1249439 - protein, 19 aa, Mycobacterium
VPLDPRFGPDSAERHRRSG

SEQ ID NO: 1249440 - protein, 19 aa, Mycobacterium
VPLGARWPVYDDALRRTWV

SEQ ID NO: 1249441 - protein, 17 aa, Mycobacterium
VPLKAPVPLAPGAAACG

SEQ ID NO: 1249442 - protein, 18 aa, Mycobacterium
VPLLDDWPVVATTLCAEH

SEQ ID NO: 1249443 - protein, 23 aa, Mycobacterium
VPLLELPHAQFLLMSATLGDVTF

SEQ ID NO: 1249444 - protein, 17 aa, Mycobacterium
VPLMPAGARIVFVTSHQ

SEQ ID NO: 1249445 - protein, 17 aa, Mycobacterium
VPLPGVLVAPTVGGNDQ

SEQ ID NO: 1249446 - protein, 17 aa, Mycobacterium
VPLRLPLGAEAVERLTA

SEQ ID NO: 1249447 - protein, 17 aa, Mycobacterium
VPLVLGVADAVRAAGVA

SEQ ID NO: 1249448 - protein, 25 aa, Mycobacterium
VPNDMNFEYGLNCILDHAARLIEQQ

SEQ ID NO: 1249449 - protein, 23 aa, Mycobacterium
VPPEAMGAVAVAFRANAQLNSNA

SEQ ID NO: 1249450 - protein, 25 aa, Mycobacterium
VPPEVRDACGLLGLDPMYVANEGKL

SEQ ID NO: 1249451 - protein, 17 aa, Mycobacterium
VPPPGQTRPDWQLICRI

SEQ ID NO: 1249452 - protein, 33 aa, Mycobacterium
VPPRRTPPAHGWRRWVYRLSFGRINPGQSPEEL

SEQ ID NO: 1249453 - protein, 20 aa, Mycobacterium
VPPSRAADVGFRVPAPNGLH

SEQ ID NO: 1249454 - protein, 30 aa, Mycobacterium
VPPTLPAPARWALRKALRPVFAATYLTTVG

SEQ ID NO: 1249455 - protein, 25 aa, Mycobacterium
VPQDLTRRIALRQTVEMVRTTMEFF

SEQ ID NO: 1249456 - protein, 17 aa, Mycobacterium
VPQQGCRVMTKVRHSAF

SEQ ID NO: 1249457 - protein, 19 aa, Mycobacterium
VPQWPRRWRYFSPAIPADP

SEQ ID NO: 1249458 - protein, 26 aa, Mycobacterium
VPRAEVLRPGLLVMAVRGAARYFGSE

SEQ ID NO: 1249459 - protein, 25 aa, Mycobacterium
VPREIGGRTRLDWESLSQRIHPAES

SEQ ID NO: 1249460 - protein, 18 aa, Mycobacterium
VPRHKGISAFIVDMHQPG

SEQ ID NO: 1249461 - protein, 19 aa, Mycobacterium
VPSLPRPGQTVLASSMTTS

SEQ ID NO: 1249462 - protein, 23 aa, Mycobacterium
VPTPRLFGIPAIADNLDVIAADY

SEQ ID NO: 1249463 - protein, 23 aa, Mycobacterium
VPTWAGVAYVCFIVDAHSRMIVG

SEQ ID NO: 1249464 - protein, 17 aa, Mycobacterium
VPTWWDDLVSAGFHAVH

SEQ ID NO: 1249465 - protein, 19 aa, Mycobacterium
VPVAEFARRCGVSEDLLRA

SEQ ID NO: 1249466 - protein, 28 aa, Mycobacterium
VPVIKVPPHPAGEHPMFKAMAAANGRDD

SEQ ID NO: 1249467 - protein, 26 aa, Mycobacterium
VPVRLAELFIEAGLPAGVFQVVHGDK

SEQ ID NO: 1249468 - protein, 19 aa, Mycobacterium
VPVYPTCHYVMGGIPTTVH

SEQ ID NO: 1249469 - protein, 24 aa, Mycobacterium
VPYRANMWALRALGVRRIFGPCAV

SEQ ID NO: 1249470 - protein, 18 aa, Mycobacterium
VQACRGCELYRDATQGVF

SEQ ID NO: 1249471 - protein, 23 aa, Mycobacterium
VQAELPPLAGIVHAAGEIGTTAL

SEQ ID NO: 1249472 - protein, 18 aa, Mycobacterium
VQALIRWDPVGHAESELD

SEQ ID NO: 1249473 - protein, 23 aa, Mycobacterium
VQALRAGELVGVYPEATISRSFE

SEQ ID NO: 1249474 - protein, 20 aa, Mycobacterium
VQCDVWNGFIFINLDPEPRW

SEQ ID NO: 1249475 - protein, 23 aa, Mycobacterium
VQDGQPLLGTWQSVVLVDLNRDN

SEQ ID NO: 1249476 - protein, 30 aa, Mycobacterium
VQEEISRTLGFWLQLGVSGFRVDAVPFLFA

SEQ ID NO: 1249477 - protein, 20 aa, Mycobacterium
VQEFLRKVPGAEFVELSDAG

SEQ ID NO: 1249478 - protein, 24 aa, Mycobacterium
VQFHYDISNEFFKLWQDPNQVYSC

SEQ ID NO: 1249479 - protein, 19 aa, Mycobacterium
VQGEAAAGVVMLRPASPGT

SEQ ID NO: 1249480 - protein, 32 aa, Mycobacterium
VQGRCISGGLMLCWPCDLILAADDALFSDPVA

SEQ ID NO: 1249481 - protein, 25 aa, Mycobacterium
VQHTRLRPAVNLGLDVLNTALRELI

SEQ ID NO: 1249482 - protein, 22 aa, Mycobacterium
VQIGKFRLVFLTGPSTENGPSS

SEQ ID NO: 1249483 - protein, 21 aa, Mycobacterium
VQIKGPCVMDGYHNLPDKTAE

SEQ ID NO: 1249484 - protein, 22 aa, Mycobacterium
VQKEIRWKAELAEKLAAQARAD

SEQ ID NO: 1249485 - protein, 18 aa, Mycobacterium
VQKLGGPVDRDEWFMTPQ

SEQ ID NO: 1249486 - protein, 23 aa, Mycobacterium
VQLARPTLRETLGRLAPGTPLRD

SEQ ID NO: 1249487 - protein, 36 aa, Mycobacterium
VQLGDLHWFYVYSAVIWACVFMRTSARRVHFGEIEP

SEQ ID NO: 1249488 - protein, 17 aa, Mycobacterium
VQLHGGYGYMLEYRVAR

SEQ ID NO: 1249489 - protein, 25 aa, Mycobacterium
VQMGCGRTGAFFSFEEAGIVPDIVT

SEQ ID NO: 1249490 - protein, 25 aa, Mycobacterium
VQNTWRFGLDRVLAGVAMSDDSHAW

SEQ ID NO: 1249491 - protein, 18 aa, Mycobacterium
VQPRRGRRGTLGLRLGDR

SEQ ID NO: 1249492 - protein, 23 aa, Mycobacterium
VQRHALFGCFDRETAVQIRRGAR

SEQ ID NO: 1249493 - protein, 24 aa, Mycobacterium
VQRVKTWLQFPQWFYNDSPPNTMV

SEQ ID NO: 1249494 - protein, 22 aa, Mycobacterium
VQRVLLPTLLDWLSDTPDPDAG

SEQ ID NO: 1249495 - protein, 34 aa, Mycobacterium; identical to SEQ ID NO: 748656

SEQ ID NO: 1249496 - protein, 25 aa, Mycobacterium
VQSPRLDRFAAESILFTRAHATAPL

SEQ ID NO: 1249497 - protein, 25 aa, Mycobacterium
VQSQNRFARRVNMEVASHTALMDPI

SEQ ID NO: 1249498 - protein, 19 aa, Mycobacterium
VQTGFARTGRMFACEHEGI

SEQ ID NO: 1249499 - protein, 24 aa, Mycobacterium
VQTGVGRTGVFYAHQHDGITPDVV

SEQ ID NO: 1249500 - protein, 19 aa, Mycobacterium
VQTVLRWASAHKVAVVPRG

SEQ ID NO: 1249501 - protein, 22 aa, Mycobacterium
VQVMGGAALHFGNVAEMKTGEG

SEQ ID NO: 1249502 - protein, 17 aa, Mycobacterium
VRAAESFGFTGALIPTG

SEQ ID NO: 1249503 - protein, 26 aa, Mycobacterium
VRAALMPERFWVLVHQFEWKVKAGAR

SEQ ID NO: 1249504 - protein, 22 aa, Mycobacterium
VRAELLPGLSSGATVAALGLTG

SEQ ID NO: 1249505 - protein, 17 aa, Mycobacterium
VRAGSPFVDRPLGDTRA

SEQ ID NO: 1249506 - protein, 17 aa, Mycobacterium
VRALEAFGRTEAAAELI

SEQ ID NO: 1249507 - protein, 20 aa, Mycobacterium
VRAMTRLPQRSVVTVATNVP

SEQ ID NO: 1249508 - protein, 18 aa, Mycobacterium
VRAQLLVAMGRPLPEEMH

SEQ ID NO: 1249509 - protein, 22 aa, Mycobacterium
VRAQSWDLVRDGIFVGYQLDRV

SEQ ID NO: 1249510 - protein, 20 aa, Mycobacterium
VRARLRRSWLERGAAEAELG

SEQ ID NO: 1249511 - protein, 25 aa, Mycobacterium
VRAVFGGRIRFMISGSAPLNRDIAE

SEQ ID NO: 1249512 - protein, 20 aa, Mycobacterium
VRDARLVECVDVIRRLLRGE

SEQ ID NO: 1249513 - protein, 22 aa, Mycobacterium
VRDDAPWCPSNIEFIRRVNGLG

SEQ ID NO: 1249514 - protein, 27 aa, Mycobacterium
VRDGLRVIGIRSRLMSRLAGQGAVALV

SEQ ID NO: 1249515 - protein, 23 aa, Mycobacterium
VRDGTELFIRPVLPGDNERTING

SEQ ID NO: 1249516 - protein, 23 aa, Mycobacterium
VRDPRFGHVVTQDFATYHISAHA

SEQ ID NO: 1249517 - protein, 17 aa, Mycobacterium
VRDRILAALPHVIVMDA

SEQ ID NO: 1249518 - protein, 19 aa, Mycobacterium
VRDRIRIARDFTARHRDLH

SEQ ID NO: 1249519 - protein, 27 aa, Mycobacterium
VRDVRRIGSCALDLCMVAAGQLDAYYE

SEQ ID NO: 1249520 - protein, 23 aa, Mycobacterium
VREAIHSVFLFHAIKAGLDMGIV

SEQ ID NO: 1249521 - protein, 18 aa, Mycobacterium
VREALKRDGAPQVYVLPE

SEQ ID NO: 1249522 - protein, 17 aa, Mycobacterium
VREDGRRIYVADHAGAM

SEQ ID NO: 1249523 - protein, 24 aa, Mycobacterium
VREFLQRGSQWLAYKHQVASEAWD

SEQ ID NO: 1249524 - protein, 17 aa, Mycobacterium
VREGFSADLARALRDDM

SEQ ID NO: 1249525 - protein, 24 aa, Mycobacterium
VRELAVFWTARTVGCSWCVDFGAM

SEQ ID NO: 1249526 - protein, 23 aa, Mycobacterium
VRELFKPLPSMVVAHYLGVPEAD

SEQ ID NO: 1249527 - protein, 19 aa, Mycobacterium
VRELLELTSRLHGTLLDRH

SEQ ID NO: 1249528 - protein, 19 aa, Mycobacterium
VREMAGRALVRRKVQEQLI

SEQ ID NO: 1249529 - protein, 31 aa, Mycobacterium
VRERGAVVGARFRPGGFAARFDRDASALTGR

SEQ ID NO: 1249530 - protein, 17 aa, Mycobacterium
VRERLALGFGSSTFRYA

SEQ ID NO: 1249531 - protein, 17 aa, Mycobacterium
VRESFRAATGVELNEGY

SEQ ID NO: 1249532 - protein, 19 aa, Mycobacterium
VRFDDCYRSQTALTAIARS

SEQ ID NO: 1249533 - protein, 26 aa, Mycobacterium
VRFLPMEELIAAFLPVLFPGLEIVEH

SEQ ID NO: 1249534 - protein, 18 aa, Mycobacterium
VRGGEGFFSRQEIRQALV

SEQ ID NO: 1249535 - protein, 28 aa, Mycobacterium
VRGGVHDVVLCPGSRNAPLAFALADADR

SEQ ID NO: 1249536 - protein, 19 aa, Mycobacterium
VRGKGLWAGVDVDPALGTG

SEQ ID NO: 1249537 - protein, 18 aa, Mycobacterium
VRGSGGFGRAFMHADDKE

SEQ ID NO: 1249538 - protein, 18 aa, Mycobacterium
VRGSSPAVRSIWDDARES

SEQ ID NO: 1249539 - protein, 19 aa, Mycobacterium
VRGTGVFWAIELVANPQTR

SEQ ID NO: 1249540 - protein, 19 aa, Mycobacterium
VRHFQVWANLGATRAEALA

SEQ ID NO: 1249541 - protein, 17 aa, Mycobacterium
VRHGKVFPLGVDFGSSG

SEQ ID NO: 1249542 - protein, 27 aa, Mycobacterium
VRHRSRIAGPAIRRGWLDDGPGPSRRR

SEQ ID NO: 1249543 - protein, 19 aa, Mycobacterium
VRIAEFRPAPQEHRARVAS

SEQ ID NO: 1249544 - protein, 25 aa, Mycobacterium
VRIRGRAWLASRPDAVVWIESAGGG

SEQ ID NO: 1249545 - protein, 21 aa, Mycobacterium
VRLDPGCDWNEARAQLTVLPG

SEQ ID NO: 1249546 - protein, 24 aa, Mycobacterium
VRLDRLGFDEAWFGEHHSGGYELI

SEQ ID NO: 1249547 - protein, 20 aa, Mycobacterium
VRLGGPRLKDVAGLSLTKLF

SEQ ID NO: 1249548 - protein, 18 aa, Mycobacterium
VRLGLGAVRHIGDDLAER

SEQ ID NO: 1249549 - protein, 27 aa, Mycobacterium
VRLHPEVIAALGIREWDAVSLTGARTT

SEQ ID NO: 1249550 - protein, 21 aa, Mycobacterium
VRLKGGDPFVFARGYEEVLAC

SEQ ID NO: 1249551 - protein, 34 aa, Mycobacterium
VRLLAKRPGPDLGLMPLDLSLGVADEDSDDTPLE

SEQ ID NO: 1249552 - protein, 18 aa, Mycobacterium
VRLLRHVYNVSGIPRLTS

SEQ ID NO: 1249553 - protein, 17 aa, Mycobacterium
VRLPWEVNGEKFVLHLI

SEQ ID NO: 1249554 - protein, 21 aa, Mycobacterium
VRLRGRWHTGVAHLVPEDDPH

SEQ ID NO: 1249555 - protein, 24 aa, Mycobacterium
VRLTELPAGMPVAVVVRQLTEHVQ

SEQ ID NO: 1249556 - protein, 21 aa, Mycobacterium
VRNALFRRVELFARRRWAELG

SEQ ID NO: 1249557 - protein, 24 aa, Mycobacterium
VRNFNEAFGPFGFKPQAIKPSYGL

SEQ ID NO: 1249558 - protein, 22 aa, Mycobacterium
VRNPRALAAVRELWTTRDHIAR

SEQ ID NO: 1249559 - protein, 18 aa, Mycobacterium
VRNRFTFDCAEWDVATEE

SEQ ID NO: 1249560 - protein, 20 aa, Mycobacterium
VRPANEYRYLVIGSPAGAYF

SEQ ID NO: 1249561 - protein, 18 aa, Mycobacterium
VRPGCAVAVRLDAGHSRE

SEQ ID NO: 1249562 - protein, 17 aa, Mycobacterium
VRPGDRVAILGFTGIDY

SEQ ID NO: 1249563 - protein, 20 aa, Mycobacterium
VRPGVDVLFLDTGYHFAETI

SEQ ID NO: 1249564 - protein, 17 aa, Mycobacterium
VRPRRWLEIRYLDAVSD

SEQ ID NO: 1249565 - protein, 25 aa, Mycobacterium
VRQAERARPHFEANVATAVDDPTLI

SEQ ID NO: 1249566 - protein, 23 aa, Mycobacterium
VRQIPYTIACDLLLTGRHITAAE

SEQ ID NO: 1249567 - protein, 28 aa, Mycobacterium
VRQLRLRDIGGIIVIDFIDMVLESNRDL

SEQ ID NO: 1249568 - protein, 23 aa, Mycobacterium
VRQNAITLLGWQVLRFTWLDLTE

SEQ ID NO: 1249569 - protein, 21 aa, Mycobacterium
VRRAAEWTATMSRWCAEQQGL

SEQ ID NO: 1249570 - protein, 19 aa, Mycobacterium
VRRDHVLGIGGASVSLARA

SEQ ID NO: 1249571 - protein, 23 aa, Mycobacterium
VRRFARERSRWIFSNPDMIHLSL

SEQ ID NO: 1249572 - protein, 17 aa, Mycobacterium
VRRLGGGLVEIPRVPAK

SEQ ID NO: 1249573 - protein, 19 aa, Mycobacterium
VRRQFYWHRFFSHQPDLNY

SEQ ID NO: 1249574 - protein, 20 aa, Mycobacterium
VRRQLGRVSALFNRSPRDRR

SEQ ID NO: 1249575 - protein, 24 aa, Mycobacterium
VRRSGPRLSGKRVIIDPGRGGSDH

SEQ ID NO: 1249576 - protein, 17 aa, Mycobacterium
VRRYGMVSPTVFWPIPR

SEQ ID NO: 1249577 - protein, 22 aa, Mycobacterium
VRRYLERDGLEVAIARDGTEAL

SEQ ID NO: 1249578 - protein, 17 aa, Mycobacterium
VRSAAAWADGMAGTILD

SEQ ID NO: 1249579 - protein, 21 aa, Mycobacterium
VRSGFRFNTMVSRVAREDPRG

SEQ ID NO: 1249580 - protein, 24 aa, Mycobacterium
VRSREPVKHVLVWVSTLGSTDGRN

SEQ ID NO: 1249581 - protein, 19 aa, Mycobacterium
VRSRRPGETASIFVPSVPT

SEQ ID NO: 1249582 - protein, 19 aa, Mycobacterium
VRSYKLRGAFNLISQLTEE

SEQ ID NO: 1249583 - protein, 19 aa, Mycobacterium
VRTADGWRSRSLREENVWF

SEQ ID NO: 1249584 - protein, 29 aa, Mycobacterium
VRTCDCFNIPIVMLVDVPGFLPGTEQEYN

SEQ ID NO: 1249585 - protein, 17 aa, Mycobacterium
VRTELLASVDAAVAAGV

SEQ ID NO: 1249586 - protein, 23 aa, Mycobacterium
VRTVNLPLTWTTRGVDRTVEALR

SEQ ID NO: 1249587 - protein, 20 aa, Mycobacterium
VRVIPCLDVDAGRVVKGVNF

SEQ ID NO: 1249588 - protein, 20 aa, Mycobacterium
VRVLPYCWNDETPLSSHELR

SEQ ID NO: 1249589 - protein, 18 aa, Mycobacterium
VRVLRYGSAGGRDLAGAL

SEQ ID NO: 1249590 - protein, 18 aa, Mycobacterium
VRVRARRGVLLAAGGFEQ

SEQ ID NO: 1249591 - protein, 24 aa, Mycobacterium
VRVTKRGGTVLVIAFGALPKAEFL

SEQ ID NO: 1249592 - protein, 20 aa, Mycobacterium
VRVTVIAAGFDSAGPSRNPV

SEQ ID NO: 1249593 - protein, 24 aa, Mycobacterium
VRWFDIDPCYVFHVANAYEDGNTL

SEQ ID NO: 1249594 - protein, 17 aa, Mycobacterium
VRWKDYSQLVIRRDDLY

SEQ ID NO: 1249595 - protein, 19 aa, Mycobacterium
VRYPELWRGTGGFEAEGVL

SEQ ID NO: 1249596 - protein, 18 aa, Mycobacterium
VSAALPYYASNKISGEDW

SEQ ID NO: 1249597 - protein, 25 aa, Mycobacterium
VSAFRAELLPACADIAEEAAPALGP

SEQ ID NO: 1249598 - protein, 18 aa, Mycobacterium
VSAGSILRNLDPERFDVV

SEQ ID NO: 1249599 - protein, 24 aa, Mycobacterium
VSAIFRVGDVWRQIRAANLPVAVS

SEQ ID NO: 1249600 - protein, 19 aa, Mycobacterium
VSALKALEGDEKWVKSVEE

SEQ ID NO: 1249601 - protein, 19 aa, Mycobacterium
VSALSRLGMHLEVPSLVIW

SEQ ID NO: 1249602 - protein, 18 aa, Mycobacterium
VSALVLRVGADGVAPSDL

SEQ ID NO: 1249603 - protein, 20 aa, Mycobacterium
VSAVEFRGRANIVLTGGGTG

SEQ ID NO: 1249604 - protein, 24 aa, Mycobacterium
VSCDVGMGFSWSRPTTFREPAVTM

SEQ ID NO: 1249605 - protein, 27 aa, Mycobacterium
VSDRLTLRSLGGWGRRHGVATVMISHE

SEQ ID NO: 1249606 - protein, 17 aa, Mycobacterium
VSDWPRYSGHAIAGVSG

SEQ ID NO: 1249607 - protein, 19 aa, Mycobacterium
VSEAAFKQYPEHAAVAIER

SEQ ID NO: 1249608 - protein, 24 aa, Mycobacterium
VSEADRVLAIVPMFHANAWGLIYA

SEQ ID NO: 1249609 - protein, 18 aa, Mycobacterium
VSEDEFDAIYGRIQQRNL

SEQ ID NO: 1249610 - protein, 17 aa, Mycobacterium
VSEDLLRAAVRRIAAAE

SEQ ID NO: 1249611 - protein, 17 aa, Mycobacterium
VSEKFFALCGVFGAENV

SEQ ID NO: 1249612 - protein, 18 aa, Mycobacterium
VSERTLRLLVPGDGVPRV

SEQ ID NO: 1249613 - protein, 17 aa, Mycobacterium
VSESLRYVAAWNSAFLP

SEQ ID NO: 1249614 - protein, 21 aa, Mycobacterium
VSESPWAVVHFTVRLPDGSRP

SEQ ID NO: 1249615 - protein, 36 aa, Mycobacterium
VSFEEMLEMAACGAKVLMLRCVEYARRYDLPIHVRS

SEQ ID NO: 1249616 - protein, 17 aa, Mycobacterium
VSGFRVDAVPFLFARDG

SEQ ID NO: 1249617 - protein, 18 aa, Mycobacterium
VSGGIVWIPSHDRAADEL

SEQ ID NO: 1249618 - protein, 17 aa, Mycobacterium
VSGRGGPGLSPLGNSSA

SEQ ID NO: 1249619 - protein, 27 aa, Mycobacterium
VSGVDFGYPAADVFQGLNLSITRGALT

SEQ ID NO: 1249620 - protein, 18 aa, Mycobacterium
VSHLAKYRMRTRGDVDMP

SEQ ID NO: 1249621 - protein, 18 aa, Mycobacterium
VSHMLGFDSPAAMVAEAE

SEQ ID NO: 1249622 - protein, 22 aa, Mycobacterium
VSHREWGDGVVIGGDTDRVTVL

SEQ ID NO: 1249623 - protein, 25 aa, Mycobacterium
VSHRPVAEYFVWFKADYQVDAKDRL

SEQ ID NO: 1249624 - protein, 17 aa, Mycobacterium
VSIPAERPAEVTDIIPF

SEQ ID NO: 1249625 - protein, 19 aa, Mycobacterium
VSITRRMFRDGGSEYEING

SEQ ID NO: 1249626 - protein, 24 aa, Mycobacterium
VSKHAAVGFAEWLAVTYGDDGIGV

SEQ ID NO: 1249627 - protein, 22 aa, Mycobacterium
VSLAPADAFVGWLPQEHERVPG

SEQ ID NO: 1249628 - protein, 24 aa, Mycobacterium
VSLEPRYSELLPEVMLGVDADRFA

SEQ ID NO: 1249629 - protein, 17 aa, Mycobacterium
VSLGALQLWQAVTERVS

SEQ ID NO: 1249630 - protein, 20 aa, Mycobacterium
VSLGKRKGKIVVEFGSVDDL

SEQ ID NO: 1249631 - protein, 26 aa, Mycobacterium
VSLTSVLPRWGAVIAASTAHIHTDEA

SEQ ID NO: 1249632 - protein, 19 aa, Mycobacterium
VSLVPSLAAWAARGDVAVR

SEQ ID NO: 1249633 - protein, 19 aa, Mycobacterium
VSMTAQWWLDTREPKKEVV

SEQ ID NO: 1249634 - protein, 25 aa, Mycobacterium
VSNALCAAAVALECGATLDQVAAAL

SEQ ID NO: 1249635 - protein, 22 aa, Mycobacterium
VSNTFYEWVLGPSMTYTCACYP

SEQ ID NO: 1249636 - protein, 18 aa, Mycobacterium
VSPALAIERVIDLALREV

SEQ ID NO: 1249637 - protein, 29 aa, Mycobacterium
VSPNVRDAVRFAGGWLYDRSMAGWDVTVL

SEQ ID NO: 1249638 - protein, 31 aa, Mycobacterium
VSRALTGFEHAGLDRVLQWDLRYGADVVAAL

SEQ ID NO: 1249639 - protein, 29 aa, Mycobacterium
VSRGQEVVEFACGIPHLLKGGFTENASTN

SEQ ID NO: 1249640 - protein, 18 aa, Mycobacterium
VSRKCVHTWISRFEADGE

SEQ ID NO: 1249641 - protein, 17 aa, Mycobacterium
VSRTMSKAFAFAGGRLG

SEQ ID NO: 1249642 - protein, 25 aa, Mycobacterium
VSRYTRGRFASAFGPHAALEHLPPG

SEQ ID NO: 1249643 - protein, 19 aa, Mycobacterium
VSSNLARFDAMRFGMRVGD

SEQ ID NO: 1249644 - protein, 25 aa, Mycobacterium
VSSPRVLSDLFWLGRYAERAEYTAR

SEQ ID NO: 1249645 - protein, 18 aa, Mycobacterium
VSSWVGARLDYVPGSSDP

SEQ ID NO: 1249646 - protein, 23 aa, Mycobacterium
VSSYGARFAGVVFPGETLRANVW

SEQ ID NO: 1249647 - protein, 34 aa, Mycobacterium
VSTAGRRTGLIWLRWFLPEATPARPQCRVVDLAE

SEQ ID NO: 1249648 - protein, 25 aa, Mycobacterium
VSTGPWFQWHFDRWTVPPGAVEIAR

SEQ ID NO: 1249649 - protein, 25 aa, Mycobacterium
VSTVSSIFLMCLADRVLAYGDCAIV

SEQ ID NO: 1249650 - protein, 25 aa, Mycobacterium
VSVHVRGSVVLARLYEKTRSLESSE

SEQ ID NO: 1249651 - protein, 24 aa, Mycobacterium
VSVKLPGRIFGSFFGLPPGEIHEK

SEQ ID NO: 1249652 - protein, 20 aa, Mycobacterium
VSVPTFWAADLPRSFIRCLQ

SEQ ID NO: 1249653 - protein, 23 aa, Mycobacterium
VSVRDWVHEFARDVVRPAAAEWD

SEQ ID NO: 1249654 - protein, 25 aa, Mycobacterium
VSVTMPGKFAALRFADERTERAELV

SEQ ID NO: 1249655 - protein, 18 aa, Mycobacterium
VSYDATWSGRRFVVQDTG

SEQ ID NO: 1249656 - protein, 26 aa, Mycobacterium
VSYGASPRATIALCQTARARAVLAGR

SEQ ID NO: 1249657 - protein, 24 aa, Mycobacterium
VSYPVGHLSTMGWIGVRPGDVHLA

SEQ ID NO: 1249658 - protein, 20 aa, Mycobacterium
VTAAACRWALAAGAEQVVLF

SEQ ID NO: 1249659 - protein, 18 aa, Mycobacterium
VTAALKVYGTEGRQGQLD

SEQ ID NO: 1249660 - protein, 20 aa, Mycobacterium
VTADPAWMAAFARHLEACGF

SEQ ID NO: 1249661 - protein, 30 aa, Mycobacterium
VTADRWKLGQLRPGDTVRFVPIRVADAPAR

SEQ ID NO: 1249662 - protein, 20 aa, Mycobacterium
VTAIVPRVSLADGLVEIDPP

SEQ ID NO: 1249663 - protein, 28 aa, Mycobacterium
VTAPAGFRAAGIAAGIKASGALDLALVL

SEQ ID NO: 1249664 - protein, 21 aa, Mycobacterium
VTARGGVVHWARDADEANRIV

SEQ ID NO: 1249665 - protein, 21 aa, Mycobacterium
VTCLWLMPFYPTARKDDGYDI

SEQ ID NO: 1249666 - protein, 18 aa, Mycobacterium
VTCSIFVDQIHYWGDVIV

SEQ ID NO: 1249667 - protein, 24 aa, Mycobacterium
VTDARRREVYWARYRDGVRVDGPA

SEQ ID NO: 1249668 - protein, 18 aa, Mycobacterium
VTDIARWRDVGAVHAEVF

SEQ ID NO: 1249669 - protein, 23 aa, Mycobacterium
VTDIPMDCHLMIENPERWAPPYA

SEQ ID NO: 1249670 - protein, 32 aa, Mycobacterium
VTDLPGELMSALSQGLSSFGINLPPMPTGMLN

SEQ ID NO: 1249671 - protein, 24 aa, Mycobacterium
VTEARIIDRPGWIQAAAQSMRTMT

SEQ ID NO: 1249672 - protein, 24 aa, Mycobacterium
VTEGTVTRWLKKVGDSVEVDEPLL

SEQ ID NO: 1249673 - protein, 19 aa, Mycobacterium
VTELITGLDLVRAQLLVAM

SEQ ID NO: 1249674 - protein, 18 aa, Mycobacterium
VTETFDFRDTGVLKDRIG

SEQ ID NO: 1249675 - protein, 26 aa, Mycobacterium
VTETGNAKRGFLCQYHLWSYDLEGRL

SEQ ID NO: 1249676 - protein, 18 aa, Mycobacterium
VTEWLRRVPEFTVDAERA

SEQ ID NO: 1249677 - protein, 25 aa, Mycobacterium
VTFRLRAAGLPILGKTNMDEFAMGS

SEQ ID NO: 1249678 - protein, 18 aa, Mycobacterium
VTGCPAEVAVPVAVNLVI

SEQ ID NO: 1249679 - protein, 23 aa, Mycobacterium
VTGESRPRVGNSLYGTYGQNFVS

SEQ ID NO: 1249680 - protein, 18 aa, Mycobacterium
VTGGLTFAGGPWNNYVSH

SEQ ID NO: 1249681 - protein, 19 aa, Mycobacterium
VTGHPVVTLFLSVTGDDAT

SEQ ID NO: 1249682 - protein, 24 aa, Mycobacterium
VTGPRWRLGGRDIAALWRRAVELD

SEQ ID NO: 1249683 - protein, 20 aa, Mycobacterium
VTGWFMVGWSAEFVSGETRA

SEQ ID NO: 1249684 - protein, 28 aa, Mycobacterium
VTGYDILFFWVARMMMFGTFVADDPALT

SEQ ID NO: 1249685 - protein, 18 aa, Mycobacterium
VTIAKLWEVFVGEDATLV

SEQ ID NO: 1249686 - protein, 24 aa, Mycobacterium
VTIFRLGTDPGLARFIDQVARRVG

SEQ ID NO: 1249687 - protein, 25 aa, Mycobacterium
VTILEEARIPFLREPFEARITDIGL

SEQ ID NO: 1249688 - protein, 17 aa, Mycobacterium
VTKSGLSVREWLTALRE

SEQ ID NO: 1249689 - protein, 17 aa, Mycobacterium
VTKVFWSDLDVALHQTA

SEQ ID NO: 1249690 - protein, 22 aa, Mycobacterium
VTLDLLRRGALVAAADVDEVGL

SEQ ID NO: 1249691 - protein, 24 aa, Mycobacterium
VTLSEKGWRTFFRGLANDGVQGPS

SEQ ID NO: 1249692 - protein, 22 aa, Mycobacterium
VTMARWCRRRGVELAPHAKTHL

SEQ ID NO: 1249693 - protein, 19 aa, Mycobacterium
VTMTLPFTVASGRDVEPVD

SEQ ID NO: 1249694 - protein, 18 aa, Mycobacterium
VTPFRLRLTASEEPTGSS

SEQ ID NO: 1249695 - protein, 17 aa, Mycobacterium
VTPGGLVRPRALWDDLL

SEQ ID NO: 1249696 - protein, 17 aa, Mycobacterium
VTPLLEWTATQIHALRG

SEQ ID NO: 1249697 - protein, 21 aa, Mycobacterium
VTPRRTVAWDYGALRDDPDAQ

SEQ ID NO: 1249698 - protein, 19 aa, Mycobacterium
VTQYELWKAVWSSLNDGNF

SEQ ID NO: 1249699 - protein, 22 aa, Mycobacterium
VTRAALPGMVERGYGRIVNVAS

SEQ ID NO: 1249700 - protein, 25 aa, Mycobacterium
VTRSRHLLAQFLFRGDRIHLPVSVL

SEQ ID NO: 1249701 - protein, 20 aa, Mycobacterium
VTSRGRIEFDLAGGRINTDA

SEQ ID NO: 1249702 - protein, 24 aa, Mycobacterium
VTTADMTVHFLAPVVVGPARAEAT

SEQ ID NO: 1249703 - protein, 18 aa, Mycobacterium
VTVSSFMHVLGRINLDDL

SEQ ID NO: 1249704 - protein, 18 aa, Mycobacterium
VTVTRLPATPATIVELLE

SEQ ID NO: 1249705 - protein, 26 aa, Mycobacterium
VTVVDPRWVLPVPEVLTEFAAAHKLV

SEQ ID NO: 1249706 - protein, 27 aa, Mycobacterium
VTVVDTRVGTVIARYPLAFTATAMTIS

SEQ ID NO: 1249707 - protein, 19 aa, Mycobacterium
VTYLKEIWHAIQTQEISGA

SEQ ID NO: 1249708 - protein, 24 aa, Mycobacterium
VVAAADGRVVWDNDVYAFLDGEAP

SEQ ID NO: 1249709 - protein, 25 aa, Mycobacterium
VVAAERLGRWCVPGPVVESVAVAPV

SEQ ID NO: 1249710 - protein, 20 aa, Mycobacterium
VVAFLKRWLLVDDDRARQML

SEQ ID NO: 1249711 - protein, 24 aa, Mycobacterium
VVAGHSMGGIAISSWAERFPERVA

SEQ ID NO: 1249712 - protein, 17 aa, Mycobacterium
VVAHLGVDFSFLRHNDH

SEQ ID NO: 1249713 - protein, 24 aa, Mycobacterium
VVAKDYPPILAMTSLNDTRVYYVE

SEQ ID NO: 1249714 - protein, 19 aa, Mycobacterium
VVALCGEVFPVTKSAKPGS

SEQ ID NO: 1249715 - protein, 18 aa, Mycobacterium
VVALPWHAAYSASKYGLR

SEQ ID NO: 1249716 - protein, 23 aa, Mycobacterium
VVAMARKYFGPRLIRGQSAVPPR

SEQ ID NO: 1249717 - protein, 25 aa, Mycobacterium
VVARAGRLDLMFNNAGISWGGDTEL

SEQ ID NO: 1249718 - protein, 24 aa, Mycobacterium
VVARASALLLRRGPEPPDDAWTSP

SEQ ID NO: 1249719 - protein, 18 aa, Mycobacterium
VVATCYLLGVSTRRMDKL

SEQ ID NO: 1249720 - protein, 25 aa, Mycobacterium
VVATGAWTRPFLAQHGIDVPIRVVR

SEQ ID NO: 1249721 - protein, 24 aa, Mycobacterium
VVAVARPLLAPAIESADAVVEWLR

SEQ ID NO: 1249722 - protein, 25 aa, Mycobacterium
VVCRAEQWLDLRFVSGRGALLRGVV

SEQ ID NO: 1249723 - protein, 25 aa, Mycobacterium
VVDAALKLAERITCNAPLAVQASKR

SEQ ID NO: 1249724 - protein, 18 aa, Mycobacterium
VVDALTWVMGEHSAKTLR

SEQ ID NO: 1249725 - protein, 23 aa, Mycobacterium
VVDEAHCVSAWGHDFRPDYLRLA

SEQ ID NO: 1249726 - protein, 23 aa, Mycobacterium
VVDGKWKPLILWELQDGPKRFNA

SEQ ID NO: 1249727 - protein, 22 aa, Mycobacterium
VVDGRIANFYAMANPDKLTGIG

SEQ ID NO: 1249728 - protein, 18 aa, Mycobacterium
VVDGTAWITGADAPNKHV

SEQ ID NO: 1249729 - protein, 20 aa, Mycobacterium
VVDRAGLVWLAREMAADPEF

SEQ ID NO: 1249730 - protein, 17 aa, Mycobacterium
VVDRFGETLPFLVKVLA

SEQ ID NO: 1249731 - protein, 17 aa, Mycobacterium
VVDRRSSEDFAVLESLL

SEQ ID NO: 1249732 - protein, 26 aa, Mycobacterium
VVDSPDLPPLWQVFGAHRRPDGHWAL

SEQ ID NO: 1249733 - protein, 18 aa, Mycobacterium
VVDSVAWLTINRPEARNA

SEQ ID NO: 1249734 - protein, 18 aa, Mycobacterium
VVDYELPGLAEAIRRAGL

SEQ ID NO: 1249735 - protein, 23 aa, Mycobacterium
VVEGAVRAVREWGAGSTGSRLVT

SEQ ID NO: 1249736 - protein, 23 aa, Mycobacterium
VVERIMMLTTQWVRRREHDDIAV

SEQ ID NO: 1249737 - protein, 21 aa, Mycobacterium
VVERNDAIWIWHDVDGREPFF

SEQ ID NO: 1249738 - protein, 19 aa, Mycobacterium
VVFAALPLFHVNALIVTIL

SEQ ID NO: 1249739 - protein, 18 aa, Mycobacterium
VVFEALAGMAARRRDAAG

SEQ ID NO: 1249740 - protein, 21 aa, Mycobacterium
VVGCGPGPFTGLRVGMATAAA

SEQ ID NO: 1249741 - protein, 26 aa, Mycobacterium
VVGDCVECPFHGWRWGPQGDNTYIPY

SEQ ID NO: 1249742 - protein, 25 aa, Mycobacterium
VVGEEWRFLTGWPDPRSDDPDKMAL

SEQ ID NO: 1249743 - protein, 34 aa, Mycobacterium
VVGEWQLLADLSFADYLMWVRRDDGVLVCVAQVR

SEQ ID NO: 1249744 - protein, 23 aa, Mycobacterium
VVGFIWEVLGRIGVGRKDAIVSL

SEQ ID NO: 1249745 - protein, 19 aa, Mycobacterium
VVGGRGSGAVMVLAGPPGV

SEQ ID NO: 1249746 - protein, 28 aa, Mycobacterium
VVGIPSPLEWACFTFGIIQNDGHFTFFA

SEQ ID NO: 1249747 - protein, 23 aa, Mycobacterium
VVGKVNDGWRLARTTLANERIAM

SEQ ID NO: 1249748 - protein, 21 aa, Mycobacterium
VVGLGRYIPRIARIAAATDLN

SEQ ID NO: 1249749 - protein, 30 aa, Mycobacterium
VVGQIIPWNFPILMATWKLAPALAAGNAVV

SEQ ID NO: 1249750 - protein, 18 aa, Mycobacterium
VVGSRFTLALVREKCREH

SEQ ID NO: 1249751 - protein, 19 aa, Mycobacterium
VVGVAYKPAVADVRESPAL

SEQ ID NO: 1249752 - protein, 20 aa, Mycobacterium
VVGVKWKHFAETGAIKAKAV

SEQ ID NO: 1249753 - protein, 18 aa, Mycobacterium
VVIAEWISGIPMSVIIRE

SEQ ID NO: 1249754 - protein, 29 aa, Mycobacterium
VVIPFNISCGTCWMCDHGLQSQCETTQNR

SEQ ID NO: 1249755 - protein, 24 aa, Mycobacterium
VVISDFLGPIDWMRPLRAIAGRHE

SEQ ID NO: 1249756 - protein, 24 aa, Mycobacterium
VVISSEWGLTGWPDATAYCAAKSG

SEQ ID NO: 1249757 - protein, 22 aa, Mycobacterium
VVKVARIAGQYAKPRSSDIDAL

SEQ ID NO: 1249758 - protein, 19 aa, Mycobacterium
VVLDGTWRDPGHRRAARDC

SEQ ID NO: 1249759 - protein, 25 aa, Mycobacterium
VVLELGWGRLIFGQTFADPEKLAKV

SEQ ID NO: 1249760 - protein, 19 aa, Mycobacterium
VVLELTALGGREVVQPLSV

SEQ ID NO: 1249761 - protein, 26 aa, Mycobacterium
VVLFPFAAGVATWWRTVGPKVAGLPN

SEQ ID NO: 1249762 - protein, 18 aa, Mycobacterium
VVLGADRALLLASLADAA

SEQ ID NO: 1249763 - protein, 25 aa, Mycobacterium
VVLKPAEWTPLTSIRLGELAVEAGL

SEQ ID NO: 1249764 - protein, 22 aa, Mycobacterium
VVLPAELAHRLGVEPGSAALQM

SEQ ID NO: 1249765 - protein, 26 aa, Mycobacterium
VVLQCGAADRVGRRIADLVATARRAI

SEQ ID NO: 1249766 - protein, 20 aa, Mycobacterium
VVLRTWQTAHVMKRRRGALE

SEQ ID NO: 1249767 - protein, 26 aa, Mycobacterium
VVLTDEPFPRFSVVRAPRHGSAVGPF

SEQ ID NO: 1249768 - protein, 18 aa, Mycobacterium
VVLVGPPVEFEIDVVSEG

SEQ ID NO: 1249769 - protein, 26 aa, Mycobacterium
VVMSFSAAAVWRIRRAAPMLPTVLLG

SEQ ID NO: 1249770 - protein, 19 aa, Mycobacterium
VVNPCLSGGALEIFLVPQV

SEQ ID NO: 1249771 - protein, 20 aa, Mycobacterium
VVPGARVGHIGLYRDPKTLV

SEQ ID NO: 1249772 - protein, 18 aa, Mycobacterium
VVPGSLGGHMFWNETDPE

SEQ ID NO: 1249773 - protein, 22 aa, Mycobacterium
VVPLRARIAERLDQSGPTVSQT

SEQ ID NO: 1249774 - protein, 23 aa, Mycobacterium
VVPLRASGIALDIVPDVGPVIDH

SEQ ID NO: 1249775 - protein, 25 aa, Mycobacterium
VVQRLEMVRRISLEIDADVVELGTD

SEQ ID NO: 1249776 - protein, 20 aa, Mycobacterium
VVRHLAHRVAVMHKGAIVEQ

SEQ ID NO: 1249777 - protein, 18 aa, Mycobacterium
VVRPILWGPGKAHAVQAF

SEQ ID NO: 1249778 - protein, 17 aa, Mycobacterium
VVRVRLVPGTGKFNLDG

SEQ ID NO: 1249779 - protein, 19 aa, Mycobacterium
VVSALCDRRRGLGADGVLR

SEQ ID NO: 1249780 - protein, 17 aa, Mycobacterium
VVSASYLRLAQKMLTGR

SEQ ID NO: 1249781 - protein, 18 aa, Mycobacterium
VVSLRLVDPRFYHLDTAL

SEQ ID NO: 1249782 - protein, 25 aa, Mycobacterium
VVSRKCGVPYLYRFELMGTTDDVLA

SEQ ID NO: 1249783 - protein, 17 aa, Mycobacterium
VVSTLLLQIDRLPSHVV

SEQ ID NO: 1249784 - protein, 18 aa, Mycobacterium
VVTATFFNADWMIDKLPV

SEQ ID NO: 1249785 - protein, 23 aa, Mycobacterium
VVTKPLPSMPVKFWNDPDGSRYR

SEQ ID NO: 1249786 - protein, 24 aa, Mycobacterium
VVTVPQWRVLVLIYTRGPMNLASV

SEQ ID NO: 1249787 - protein, 20 aa, Mycobacterium
VVVCLSRLVPRKGQDMLIRA

SEQ ID NO: 1249788 - protein, 19 aa, Mycobacterium
VVVEIPGPPVGKGLGADGT

SEQ ID NO: 1249789 - protein, 20 aa, Mycobacterium
VVVIGRRGPLQATFTTLELR

SEQ ID NO: 1249790 - protein, 20 aa, Mycobacterium
VVVRAWWSPGAFELPGANAD

SEQ ID NO: 1249791 - protein, 25 aa, Mycobacterium
VVVRPIGFEPLRWVRALAAEEPVPT

SEQ ID NO: 1249792 - protein, 29 aa, Mycobacterium
VVVRREIVERLGLRDPLMVVGNFDRPNLT

SEQ ID NO: 1249793 - protein, 20 aa, Mycobacterium
VVVVGHSFGGAVALALAAAR

SEQ ID NO: 1249794 - protein, 18 aa, Mycobacterium
VVWPRRDGVEYSVEHAVV

SEQ ID NO: 1249795 - protein, 27 aa, Mycobacterium
VVWVPWRRPGFQLGLDIAEIKRANPQA

SEQ ID NO: 1249796 - protein, 29 aa, Mycobacterium
VVYLEAFGHVVIAWMWLEQFLAAEGRTGD

SEQ ID NO: 1249797 - protein, 18 aa, Mycobacterium
VWAALKIACAGFNVHVPL

SEQ ID NO: 1249798 - protein, 21 aa, Mycobacterium
VWAEGAGLFVLQRKSGAVRDG

SEQ ID NO: 1249799 - protein, 27 aa, Mycobacterium
VWAGDLDHAIAFARRVQTGQLDLNGGA

SEQ ID NO: 1249800 - protein, 24 aa, Mycobacterium
VWDVHASFLPAIYFQGVNLAGGVA

SEQ ID NO: 1249801 - protein, 18 aa, Mycobacterium
VWGPAYAKETHYLRVYLA

SEQ ID NO: 1249802 - protein, 18 aa, Mycobacterium
VWITRRVDIARHWAEHFP

SEQ ID NO: 1249803 - protein, 20 aa, Mycobacterium
VWLSNLLAWLTRRASATDVS

SEQ ID NO: 1249804 - protein, 17 aa, Mycobacterium
VWRHGDWITITDHGSVI

SEQ ID NO: 1249805 - protein, 28 aa, Mycobacterium
VWTSAAHKAHWGVCLARTDPDAPKHKGI

SEQ ID NO: 1249806 - protein, 25 aa, Mycobacterium
VWVSRLAVDFRQKFKKDVVIDLLCY

SEQ ID NO: 1249807 - protein, 18 aa, Mycobacterium
VYAGWAYCERFFAEEVYR

SEQ ID NO: 1249808 - protein, 18 aa, Mycobacterium
VYATGYGSMNGWAADLIG

SEQ ID NO: 1249809 - protein, 23 aa, Mycobacterium
VYEIGDLDAGIWSVGTSMGLIND

SEQ ID NO: 1249810 - protein, 21 aa, Mycobacterium
VYGEYRLVDLLGRRNAADSTA

SEQ ID NO: 1249811 - protein, 22 aa, Mycobacterium
VYLGIIKFLGFEQIFKNSLTGM

SEQ ID NO: 1249812 - protein, 21 aa, Mycobacterium
VYLLCAPESSYITAQTLVCSG

SEQ ID NO: 1249813 - protein, 18 aa, Mycobacterium
VYQPGTWGPNAIHQLIAP

SEQ ID NO: 1249814 - protein, 23 aa, Mycobacterium
VYQRGGCVYGSLAGELIEGDEPV

SEQ ID NO: 1249815 - protein, 24 aa, Mycobacterium
VYRADSMVNWCPGLGTVLANEEVT

SEQ ID NO: 1249816 - protein, 17 aa, Mycobacterium
VYRAGLARTRRMARQLV

SEQ ID NO: 1249817 - protein, 18 aa, Mycobacterium
VYRHFKGKHDILVHALMT

SEQ ID NO: 1249818 - protein, 26 aa, Mycobacterium
VYSDARAAFQVGMWVNRTERETTVTV

SEQ ID NO: 1249819 - protein, 19 aa, Mycobacterium
VYVPCEVCHGARYNRETLE

SEQ ID NO: 1249820 - protein, 18 aa, Mycobacterium
WAAADLGTVFGIDTEPVD

SEQ ID NO: 1249821 - protein, 23 aa, Mycobacterium
WAAANRLLAHFGVAGHAVTTVPT

SEQ ID NO: 1249822 - protein, 17 aa, Mycobacterium
WAAIEAFCADKTRNELE

SEQ ID NO: 1249823 - protein, 17 aa, Mycobacterium
WAAKGTSLLGVRAVITE

SEQ ID NO: 1249824 - protein, 17 aa, Mycobacterium
WAALLPGLDVTTMGWFD

SEQ ID NO: 1249825 - protein, 18 aa, Mycobacterium
WAAPAWPVEYGGCDWSLT

SEQ ID NO: 1249826 - protein, 20 aa, Mycobacterium
WAEAPFPVLQQVIVNQLGYF

SEQ ID NO: 1249827 - protein, 19 aa, Mycobacterium
WAEQLAWVEDFVRAECEPI

SEQ ID NO: 1249828 - protein, 19 aa, Mycobacterium
WAGCRRVNMQNVAGWQNVP

SEQ ID NO: 1249829 - protein, 24 aa, Mycobacterium
WAGSYPGRFIPIAIMPTWNPEAMC

SEQ ID NO: 1249830 - protein, 19 aa, Mycobacterium
WAHMPEFLADYAPARVAAI

SEQ ID NO: 1249831 - protein, 17 aa, Mycobacterium
WAIDLGLVPAADHLDTV

SEQ ID NO: 1249832 - protein, 20 aa, Mycobacterium
WALAGLRVGYALGAPDVLRR

SEQ ID NO: 1249833 - protein, 20 aa, Mycobacterium
WALPCAANRFWMLSEPERAT

SEQ ID NO: 1249834 - protein, 17 aa, Mycobacterium
WALPGGRLDPGETPVEA

SEQ ID NO: 1249835 - protein, 21 aa, Mycobacterium
WAMHVPRRLKDLHVQITRATP

SEQ ID NO: 1249836 - protein, 27 aa, Mycobacterium
WANRGRIAGRCAGIGGLARAGEVALMA

SEQ ID NO: 1249837 - protein, 20 aa, Mycobacterium
WAQAPPRRLVFAADVPKLDQ

SEQ ID NO: 1249838 - protein, 19 aa, Mycobacterium
WARADWDRLAGAVVAGHVI

SEQ ID NO: 1249839 - protein, 31 aa, Mycobacterium
WARRWQRLLFDNGWLLPGHPPEFGGRNATIL

SEQ ID NO: 1249840 - protein, 24 aa, Mycobacterium
WARWVEPGGALIIHDVFPNPDEGG

SEQ ID NO: 1249841 - protein, 18 aa, Mycobacterium
WASAHKVAVVPRGMGTGL

SEQ ID NO: 1249842 - protein, 20 aa, Mycobacterium
WAVDAHKWLNVPYDCAAAIV

SEQ ID NO: 1249843 - protein, 18 aa, Mycobacterium
WAVKELPPRIARKEYGVL

SEQ ID NO: 1249844 - protein, 26 aa, Mycobacterium
WAVSQPARWALLYGSPVPGYRAPAER

SEQ ID NO: 1249845 - protein, 17 aa, Mycobacterium
WCALAEKYGNDWHGWPA

SEQ ID NO: 1249846 - protein, 17 aa, Mycobacterium
WCRQVLDLLDQVRNAAP

SEQ ID NO: 1249847 - protein, 26 aa, Mycobacterium
WDALYKANLRHVLLCTQRVAQQMVAA

SEQ ID NO: 1249848 - protein, 17 aa, Mycobacterium
WDATRLAGQAALQTPDG

SEQ ID NO: 1249849 - protein, 25 aa, Mycobacterium
WDDFFRPLHRPLRALPYVADDLDAT

SEQ ID NO: 1249850 - protein, 23 aa, Mycobacterium
WDDLRSEAVIDRFDEVLTASHYT

SEQ ID NO: 1249851 - protein, 27 aa, Mycobacterium
WDDMPDRLKPVLARQMEIYAGFMEQTD

SEQ ID NO: 1249852 - protein, 27 aa, Mycobacterium
WDDRVRRLAGALSRFGVGHGDAVAFLD

SEQ ID NO: 1249853 - protein, 26 aa, Mycobacterium
WDDTPEGFGRIAATTARQVILQRLRD

SEQ ID NO: 1249854 - protein, 19 aa, Mycobacterium
WDGFRSIVFRDGDEVELGS

SEQ ID NO: 1249855 - protein, 17 aa, Mycobacterium
WDGLAWAVDHLRESLLE

SEQ ID NO: 1249856 - protein, 20 aa, Mycobacterium
WDGPAAVCFTDGTVIGAVLD

SEQ ID NO: 1249857 - protein, 18 aa, Mycobacterium
WDIAESAPGRIVGPRART

SEQ ID NO: 1249858 - protein, 18 aa, Mycobacterium
WDIYACVRQVLDVLDPVP

SEQ ID NO: 1249859 - protein, 18 aa, Mycobacterium
WDPAELGPVVADLLAKAR

SEQ ID NO: 1249860 - protein, 20 aa, Mycobacterium
WDPPEEKLYPVIDALIEAWR

SEQ ID NO: 1249861 - protein, 17 aa, Mycobacterium
WDQPQFVGECLRVLRPG

SEQ ID NO: 1249862 - protein, 17 aa, Mycobacterium
WDQRAPIGWNMKDPTPV

SEQ ID NO: 1249863 - protein, 19 aa, Mycobacterium
WDRPGRHALELMDEIHDRI

SEQ ID NO: 1249864 - protein, 25 aa, Mycobacterium
WDTQMLFFVGHGYRVIAHDRRGHGR

SEQ ID NO: 1249865 - protein, 23 aa, Mycobacterium
WDVPKHKGLSFFILPMKQPGIEV

SEQ ID NO: 1249866 - protein, 24 aa, Mycobacterium
WDVTESWSGFSERPEYEHAQEIGE

SEQ ID NO: 1249867 - protein, 17 aa, Mycobacterium
WDWTPAVTLAEGVARTV

SEQ ID NO: 1249868 - protein, 20 aa, Mycobacterium
WDYATAIGHTVPAPDSLSDY

SEQ ID NO: 1249869 - protein, 18 aa, Mycobacterium
WDYLRSASHYELYLVNPT

SEQ ID NO: 1249870 - protein, 19 aa, Mycobacterium
WEALEHAGIPAASLRRSQT

SEQ ID NO: 1249871 - protein, 18 aa, Mycobacterium
WEALEHAGIPAQNLRGTQ

SEQ ID NO: 1249872 - protein, 18 aa, Mycobacterium
WEELLPRFENIEVVGEPE

SEQ ID NO: 1249873 - protein, 17 aa, Mycobacterium
WEELVRLLAEIADDGTA

SEQ ID NO: 1249874 - protein, 19 aa, Mycobacterium
WEFNQPWSIEEIEIGDPVK

SEQ ID NO: 1249875 - protein, 17 aa, Mycobacterium
WEFPQGTAPGRADMEPL

SEQ ID NO: 1249876 - protein, 18 aa, Mycobacterium
WEHQAHLYFKRATTDATL

SEQ ID NO: 1249877 - protein, 20 aa, Mycobacterium
WEINEAFASVPIAACREYGL

SEQ ID NO: 1249878 - protein, 17 aa, Mycobacterium
WEIYRRMREEAPVYYNE

SEQ ID NO: 1249879 - protein, 19 aa, Mycobacterium
WEKACAWDPAAGQRRRYPW

SEQ ID NO: 1249880 - protein, 17 aa, Mycobacterium
WEPFRHMAFRFNEASTG

SEQ ID NO: 1249881 - protein, 22 aa, Mycobacterium
WEPKTGAVGSLWDVVRDRRLNH

SEQ ID NO: 1249882 - protein, 23 aa, Mycobacterium
WEQHPGMLTAYYRARSSPSGQTL

SEQ ID NO: 1249883 - protein, 19 aa, Mycobacterium
WERFYGSAHAGSWPYGLPE

SEQ ID NO: 1249884 - protein, 19 aa, Mycobacterium
WERLCAMGATTMALPESAG

SEQ ID NO: 1249885 - protein, 17 aa, Mycobacterium
WERPPGLATPQCFVVLR

SEQ ID NO: 1249886 - protein, 19 aa, Mycobacterium
WEVAHGLGAPLDVFLVRKL

SEQ ID NO: 1249887 - protein, 27 aa, Mycobacterium
WEWTTSTLRPWPGFTPMIYDRYSQPFF

SEQ ID NO: 1249888 - protein, 27 aa, Mycobacterium
WFDHWYRHLTALGVRFVRAVANRIDAL

SEQ ID NO: 1249889 - protein, 17 aa, Mycobacterium
WFDRGLIWAYAFNHEEA

SEQ ID NO: 1249890 - protein, 23 aa, Mycobacterium
WFDVDFPDVIALRERFYPTRDHY

SEQ ID NO: 1249891 - protein, 17 aa, Mycobacterium
WFGEGVVPILRERGLFK

SEQ ID NO: 1249892 - protein, 19 aa, Mycobacterium
WFGVIKPSRLMAAPAGPGG

SEQ ID NO: 1249893 - protein, 18 aa, Mycobacterium
WFLIEALLDQGADDLTIV

SEQ ID NO: 1249894 - protein, 17 aa, Mycobacterium
WFLLSKYDGVTVTTADG

SEQ ID NO: 1249895 - protein, 17 aa, Mycobacterium
WFRRGWQVEREVLLETL

SEQ ID NO: 1249896 - protein, 22 aa, Mycobacterium
WFSSALWPFSTMGWPDRTPELA

SEQ ID NO: 1249897 - protein, 17 aa, Mycobacterium
WGADMALHVSAGIGTSP

SEQ ID NO: 1249898 - protein, 19 aa, Mycobacterium
WGADVIKVEHPVRGDTQRG

SEQ ID NO: 1249899 - protein, 33 aa, Mycobacterium; identical to SEQ ID NO: 938026

SEQ ID NO: 1249900 - protein, 30 aa, Mycobacterium
WGAYLTGMWLYRLSLAKVKWHSLTGEPLTG

SEQ ID NO: 1249901 - protein, 17 aa, Mycobacterium
WGEPLDRVLNAVALLLE

SEQ ID NO: 1249902 - protein, 24 aa, Mycobacterium
WGGATYDVALRFLKEDPWERLAAL

SEQ ID NO: 1249903 - protein, 23 aa, Mycobacterium
WGGDGKCKLVPYAKRTPRLARTR

SEQ ID NO: 1249904 - protein, 19 aa, Mycobacterium
WGGGRLDLRPAPDEVVAAY

SEQ ID NO: 1249905 - protein, 17 aa, Mycobacterium
WGLAEGYGLMVGGDDAD

SEQ ID NO: 1249906 - protein, 19 aa, Mycobacterium
WGPSGGWQRSVPRGATRRR

SEQ ID NO: 1249907 - protein, 30 aa, Mycobacterium
WGPTWSGSLKSLWLGDGEAIGDVLVGAELA

SEQ ID NO: 1249908 - protein, 28 aa, Mycobacterium
WGQDSFEFFPNFTLLLWVPGWYLTYNYW

SEQ ID NO: 1249909 - protein, 22 aa, Mycobacterium
WGSRPELMEVLELARHGRIKTE

SEQ ID NO: 1249910 - protein, 19 aa, Mycobacterium
WGSSYGPIGEACRRARRKG

SEQ ID NO: 1249911 - protein, 20 aa, Mycobacterium
WGTGLGKCVAVFLNGEAIPA

SEQ ID NO: 1249912 - protein, 18 aa, Mycobacterium
WGVFDGYHSIPFSAGGAL

SEQ ID NO: 1249913 - protein, 18 aa, Mycobacterium
WGVLHGGIDIAGPIGTPI

SEQ ID NO: 1249914 - protein, 21 aa, Mycobacterium
WGYAAGWRVVRAVPEVLARNA

SEQ ID NO: 1249915 - protein, 24 aa, Mycobacterium
WHERETYDFFGIIFDGHPSLTRIE

SEQ ID NO: 1249916 - protein, 18 aa, Mycobacterium
WHKLPKRQRNWILFTDEQ

SEQ ID NO: 1249917 - protein, 28 aa, Mycobacterium
WHLLASTWLDLPARPGLTGSRGPDGKPY

SEQ ID NO: 1249918 - protein, 17 aa, Mycobacterium
WHRVIGASGRPAPHLAT

SEQ ID NO: 1249919 - protein, 22 aa, Mycobacterium
WIAFEEEYFRAGAPGRASANGT

SEQ ID NO: 1249920 - protein, 22 aa, Mycobacterium
WIDVPPLPGAFIVNIGELLEVA

SEQ ID NO: 1249921 - protein, 19 aa, Mycobacterium
WIEQMKRIGIYGLAIPESY

SEQ ID NO: 1249922 - protein, 21 aa, Mycobacterium
WIGNVDLTFPYLDTAATRTIG

SEQ ID NO: 1249923 - protein, 17 aa, Mycobacterium
WIHNELRRICGGPPVAA

SEQ ID NO: 1249924 - protein, 17 aa, Mycobacterium
WIRDHLDIEMVRIGSAG

SEQ ID NO: 1249925 - protein, 17 aa, Mycobacterium
WIRDRIDAAGSLMPIYI

SEQ ID NO: 1249926 - protein, 24 aa, Mycobacterium
WITGAADPRCKLLIVMGRTNPDAA

SEQ ID NO: 1249927 - protein, 18 aa, Mycobacterium
WIVAGPDVDAAALADGLT

SEQ ID NO: 1249928 - protein, 17 aa, Mycobacterium
WIVGETVVDLFADHRRV

SEQ ID NO: 1249929 - protein, 17 aa, Mycobacterium
WIVPSLISAAGQEVRDR

SEQ ID NO: 1249930 - protein, 17 aa, Mycobacterium
WKAEKVITVPAEPADPD

SEQ ID NO: 1249931 - protein, 21 aa, Mycobacterium
WKAFADIGIEAIHTGPVKRAG

SEQ ID NO: 1249932 - protein, 18 aa, Mycobacterium
WKDGHPHDLPSLQDALAS

SEQ ID NO: 1249933 - protein, 21 aa, Mycobacterium
WKFDPEIFGGDLLEQTAAEHE

SEQ ID NO: 1249934 - protein, 22 aa, Mycobacterium
WKIGWACGAADLIAGVRAAKQY

SEQ ID NO: 1249935 - protein, 18 aa, Mycobacterium
WKLALAVSGNAAPTLLDT

SEQ ID NO: 1249936 - protein, 19 aa, Mycobacterium
WKLVRSFDDPATWTEPGVR

SEQ ID NO: 1249937 - protein, 22 aa, Mycobacterium
WKSKGLDLTPIFTVPTDAHSGR

SEQ ID NO: 1249938 - protein, 19 aa, Mycobacterium
WKYLMALFSSKVDEYADPK

SEQ ID NO: 1249939 - protein, 23 aa, Mycobacterium
WLADGWVALLRRWLADAEAAGIA

SEQ ID NO: 1249940 - protein, 17 aa, Mycobacterium
WLAGAGRTVAVAEVREA

SEQ ID NO: 1249941 - protein, 27 aa, Mycobacterium
WLCVPRPDSPSVFGAILDRGAGHFRLG

SEQ ID NO: 1249942 - protein, 24 aa, Mycobacterium
WLDDRKWAYVRLEGRAFGDVPLNL

SEQ ID NO: 1249943 - protein, 17 aa, Mycobacterium
WLDIKRKPSEYVKDHIK

SEQ ID NO: 1249944 - protein, 19 aa, Mycobacterium
WLDKAGYIIGRLQRVIFYA

SEQ ID NO: 1249945 - protein, 20 aa, Mycobacterium
WLDRLKAVSPELVRGQIRKA

SEQ ID NO: 1249946 - protein, 20 aa, Mycobacterium
WLEGLFHGIQTALFAQQMAA

SEQ ID NO: 1249947 - protein, 18 aa, Mycobacterium
WLEGYLLTGRHGLFNCYE

SEQ ID NO: 1249948 - protein, 17 aa, Mycobacterium
WLERPETAEKWLAEAGV

SEQ ID NO: 1249949 - protein, 25 aa, Mycobacterium
WLEVQPRFGRAVICALAHLGGFPVA

SEQ ID NO: 1249950 - protein, 29 aa, Mycobacterium
WLIEQKGFCAVAAEADWPDAYRVNRYVRG

SEQ ID NO: 1249951 - protein, 27 aa, Mycobacterium
WLLDPSIPLAEVFKDYADMLARDFSPV

SEQ ID NO: 1249952 - protein, 21 aa, Mycobacterium
WLLKQAFYFSLTTVNEAVSEH

SEQ ID NO: 1249953 - protein, 24 aa, Mycobacterium
WLNGNGGLDWAVKRTADSSQRLYS

SEQ ID NO: 1249954 - protein, 18 aa, Mycobacterium
WLNRILVATSRKVNGRKL

SEQ ID NO: 1249955 - protein, 19 aa, Mycobacterium
WLQEHGVTIWDEWASETGE

SEQ ID NO: 1249956 - protein, 23 aa, Mycobacterium
WLRPGEVPTLGNWFRAAGYDTHY

SEQ ID NO: 1249957 - protein, 21 aa, Mycobacterium
WLRTPVHGIHWAGTETADEWT

SEQ ID NO: 1249958 - protein, 17 aa, Mycobacterium
WLSRPGRIPARERDSER

SEQ ID NO: 1249959 - protein, 18 aa, Mycobacterium
WLSRPWGDGALKDKPLAV

SEQ ID NO: 1249960 - protein, 21 aa, Mycobacterium
WLTATRARNALVLVRGKPTDQ

SEQ ID NO: 1249961 - protein, 17 aa, Mycobacterium
WLTSRGWWTDVVEARHL

SEQ ID NO: 1249962 - protein, 23 aa, Mycobacterium
WMGSLLTDRVRGIIASNQEKFGH

SEQ ID NO: 1249963 - protein, 17 aa, Mycobacterium
WMPSTRVTRDDWRALFT

SEQ ID NO: 1249964 - protein, 17 aa, Mycobacterium
WMYDGKHVLIVFDDLTK

SEQ ID NO: 1249965 - protein, 23 aa, Mycobacterium
WNAFVEAVKPVWDNHLYGTLERR

SEQ ID NO: 1249966 - protein, 18 aa, Mycobacterium
WNAPRVRQLLLRPRYAGL

SEQ ID NO: 1249967 - protein, 18 aa, Mycobacterium
WNFEKFLLAPGGEVVNRF

SEQ ID NO: 1249968 - protein, 17 aa, Mycobacterium
WNGRRNALHWDITGLYG

SEQ ID NO: 1249969 - protein, 18 aa, Mycobacterium
WNPEAMCAEIRRVAAKGC

SEQ ID NO: 1249970 - protein, 19 aa, Mycobacterium
WNPVISRTELDGLVVAAGF

SEQ ID NO: 1249971 - protein, 18 aa, Mycobacterium
WNRTRGWRGQRAAAGAGR

SEQ ID NO: 1249972 - protein, 20 aa, Mycobacterium
WNVSKLYYIHGFLRDRMQTL

SEQ ID NO: 1249973 - protein, 17 aa, Mycobacterium
WNWAAHADPDVVRRYGG

SEQ ID NO: 1249974 - protein, 24 aa, Mycobacterium
WPAENGVVMKTRWEGHTTDGVKMG

SEQ ID NO: 1249975 - protein, 24 aa, Mycobacterium
WPDGKRCAVAFTFDVDAESPLLTT

SEQ ID NO: 1249976 - protein, 17 aa, Mycobacterium
WPDRIPGAALACDFTTA

SEQ ID NO: 1249977 - protein, 18 aa, Mycobacterium
WPDTDFIQVYGLTEVCGV

SEQ ID NO: 1249978 - protein, 18 aa, Mycobacterium
WPEHIPGTTVNRACGSSQ

SEQ ID NO: 1249979 - protein, 19 aa, Mycobacterium
WPEPLRSKALAGRAPAKPV

SEQ ID NO: 1249980 - protein, 19 aa, Mycobacterium
WPFDGELVLSDRDAAAPTL

SEQ ID NO: 1249981 - protein, 23 aa, Mycobacterium
WPGDARIAVQFVLNYEEGAENSV

SEQ ID NO: 1249982 - protein, 19 aa, Mycobacterium
WPGVPDHVSLWGLLIPIRR

SEQ ID NO: 1249983 - protein, 23 aa, Mycobacterium
WPHRYRRSSFYWKLIGYDQRFDI

SEQ ID NO: 1249984 - protein, 26 aa, Mycobacterium
WPINQIACKVFPALATGCTMVLKPSE

SEQ ID NO: 1249985 - protein, 35 aa, Mycobacterium
WPLHPDARIVLCSSVSGLWGGHGHAVYSAANRMLD

SEQ ID NO: 1249986 - protein, 17 aa, Mycobacterium
WPLMRYDPLLRAAGRAP

SEQ ID NO: 1249987 - protein, 25 aa, Mycobacterium
WPLTELELPAGHGLLLLTDGLFEGH

SEQ ID NO: 1249988 - protein, 17 aa, Mycobacterium
WPLYPIRPGHTYVNVGF

SEQ ID NO: 1249989 - protein, 22 aa, Mycobacterium
WPNLTGLQAIDFLARLRGPDAL

SEQ ID NO: 1249990 - protein, 21 aa, Mycobacterium
WPNTIPRGGVLGTQRLVDVLD

SEQ ID NO: 1249991 - protein, 24 aa, Mycobacterium
WPNYSPACVERGVLSGLSFKLYTA

SEQ ID NO: 1249992 - protein, 19 aa, Mycobacterium
WPPPMPEYVLFLRTTGQLS

SEQ ID NO: 1249993 - protein, 18 aa, Mycobacterium
WPPSVKGILVTEGVRGDG

SEQ ID NO: 1249994 - protein, 19 aa, Mycobacterium
WPQPNFPVSNFFHAGAAPL

SEQ ID NO: 1249995 - protein, 19 aa, Mycobacterium
WPQSLRTAVNILLSSRFPM

SEQ ID NO: 1249996 - protein, 20 aa, Mycobacterium
WPRETLRMGEKFPLKAGLVT

SEQ ID NO: 1249997 - protein, 20 aa, Mycobacterium
WPRMSPDERAAVLGAAVKLM

SEQ ID NO: 1249998 - protein, 17 aa, Mycobacterium
WPRRSAQFTKIMPSDYQ

SEQ ID NO: 1249999 - protein, 17 aa, Mycobacterium
WPSGIKDGAEFVIPTMK

SEQ ID NO: 1250000 - protein, 28 aa, Mycobacterium
WPSPFGPGRPGWHVECAAIALSRIGTGL

SEQ ID NO: 1250001 - protein, 19 aa, Mycobacterium
WPSVPHVMIEPGVRTGIPL

SEQ ID NO: 1250002 - protein, 24 aa, Mycobacterium
WPVMPCAYTGFHLKPVGFFDGNPA

SEQ ID NO: 1250003 - protein, 25 aa, Mycobacterium
WPVVAEPFTSWVLEDTFTDGRPPFE

SEQ ID NO: 1250004 - protein, 17 aa, Mycobacterium
WPYGGWGYGGLIIGFGI

SEQ ID NO: 1250005 - protein, 24 aa, Mycobacterium
WQAGEPEAAYAHFGRRFDDLQTEV

SEQ ID NO: 1250006 - protein, 21 aa, Mycobacterium
WQAWHRSGLQRRWLAASERGG

SEQ ID NO: 1250007 - protein, 17 aa, Mycobacterium
WQFIPFAGGPRACIGQH

SEQ ID NO: 1250008 - protein, 18 aa, Mycobacterium
WQFSSGTDACDWIILGAM

SEQ ID NO: 1250009 - protein, 17 aa, Mycobacterium
WQLADDILDEFLAPGQG

SEQ ID NO: 1250010 - protein, 21 aa, Mycobacterium
WQNEMEDAFGFTETVDQLTAI

SEQ ID NO: 1250011 - protein, 29 aa, Mycobacterium
WQPNGRPRRAGVSSFGFTGTNAHVLVEEA

SEQ ID NO: 1250012 - protein, 17 aa, Mycobacterium
WQRLVAVTTAMFGSGDI

SEQ ID NO: 1250013 - protein, 21 aa, Mycobacterium
WQRPDIAIALAQRYSAAYADL

SEQ ID NO: 1250014 - protein, 23 aa, Mycobacterium
WQTAHVMKRRRGALEGDGRADNN

SEQ ID NO: 1250015 - protein, 18 aa, Mycobacterium
WQTPLAYMRRVAKKDIML

SEQ ID NO: 1250016 - protein, 17 aa, Mycobacterium
WQYVHGVADESLVDPTA

SEQ ID NO: 1250017 - protein, 26 aa, Mycobacterium
WRAGDLTLPLSYRFEPGAADDGITVH

SEQ ID NO: 1250018 - protein, 21 aa, Mycobacterium
WRARAATAFPRQIELGDDLHR

SEQ ID NO: 1250019 - protein, 17 aa, Mycobacterium
WRASAKAAWNNDQTAIP

SEQ ID NO: 1250020 - protein, 18 aa, Mycobacterium
WRAVHAGDAFTVGHLTVR

SEQ ID NO: 1250021 - protein, 20 aa, Mycobacterium
WRAVPGRFPSYLVEHMTGVE

SEQ ID NO: 1250022 - protein, 17 aa, Mycobacterium
WRDARKLTVPGIARAKD

SEQ ID NO: 1250023 - protein, 25 aa, Mycobacterium
WRDGPRTYLGLGVDGFPNLFIVSGP

SEQ ID NO: 1250024 - protein, 23 aa, Mycobacterium
WRDIADGLAPVPARESYKPRQAV

SEQ ID NO: 1250025 - protein, 21 aa, Mycobacterium
WRDVPEVFGPWQTIWTWHRRM

SEQ ID NO: 1250026 - protein, 26 aa, Mycobacterium
WREVYKLRQRVLLIWGREDRVNPLDG

SEQ ID NO: 1250027 - protein, 20 aa, Mycobacterium
WRFMTLDGDGKIRMDCSSPN

SEQ ID NO: 1250028 - protein, 26 aa, Mycobacterium
WRFTPEVPSQLVIREVYNDWSAQRGT

SEQ ID NO: 1250029 - protein, 17 aa, Mycobacterium
WRGAAPVQAAIAAGDAV

SEQ ID NO: 1250030 - protein, 23 aa, Mycobacterium
WRHLRANAALAERTGVPPESIVL

SEQ ID NO: 1250031 - protein, 21 aa, Mycobacterium
WRIALPHVEAAVFDAALRSHH

SEQ ID NO: 1250032 - protein, 18 aa, Mycobacterium
WRIDAVDLIQRFPNVLVL

SEQ ID NO: 1250033 - protein, 30 aa, Mycobacterium
WRIVALQPYGGAWLNSWLDRDLGISGRLSI

SEQ ID NO: 1250034 - protein, 19 aa, Mycobacterium
WRLDPGGHRFFTRSEAVLG

SEQ ID NO: 1250035 - protein, 20 aa, Mycobacterium
WRLRGQTSYCADGQVYTAAS

SEQ ID NO: 1250036 - protein, 23 aa, Mycobacterium
WRNGHAVCIAMAGARATGKSLYI

SEQ ID NO: 1250037 - protein, 26 aa, Mycobacterium
WRQADKYDVPRICFVNKMDKLGADFY

SEQ ID NO: 1250038 - protein, 17 aa, Mycobacterium
WRQFGFDLDFSELVYTG

SEQ ID NO: 1250039 - protein, 17 aa, Mycobacterium
WRRALERQKRGATLVVV

SEQ ID NO: 1250040 - protein, 17 aa, Mycobacterium
WRRLLQCSSATGADGVV

SEQ ID NO: 1250041 - protein, 20 aa, Mycobacterium
WRRRHRCGPEEIGAKLGVSA

SEQ ID NO: 1250042 - protein, 19 aa, Mycobacterium
WRRRKPYRWLRQILPEPRY

SEQ ID NO: 1250043 - protein, 19 aa, Mycobacterium
WRRTVVSVLGPRAHSRLRL

SEQ ID NO: 1250044 - protein, 17 aa, Mycobacterium
WRRVMADPPEPLELPGP

SEQ ID NO: 1250045 - protein, 24 aa, Mycobacterium
WRRWWPDLRLTVVEDRGPVGHRWT

SEQ ID NO: 1250046 - protein, 32 aa, Mycobacterium
WRSGHENALRRACVAGALATLVPGAGDCAPTA

SEQ ID NO: 1250047 - protein, 26 aa, Mycobacterium
WRSWQDPRFVVLVLHNADLTEVSWEQ

SEQ ID NO: 1250048 - protein, 18 aa, Mycobacterium
WRTFAQERLTSMAAGATV

SEQ ID NO: 1250049 - protein, 20 aa, Mycobacterium
WRTGIAPRFGELVEHTQARW

SEQ ID NO: 1250050 - protein, 17 aa, Mycobacterium
WRTTRGLLHDALLTVAD

SEQ ID NO: 1250051 - protein, 21 aa, Mycobacterium
WRVGFGGFAPGFAYLVGGDER

SEQ ID NO: 1250052 - protein, 19 aa, Mycobacterium
WRVVEFDVTYGPRTGGRSK

SEQ ID NO: 1250053 - protein, 17 aa, Mycobacterium
WRVVRAVPEVLARNAFD

SEQ ID NO: 1250054 - protein, 17 aa, Mycobacterium
WRWIVGETVVDLFADHR

SEQ ID NO: 1250055 - protein, 18 aa, Mycobacterium
WSALCGIVEVGGSLEKFR

SEQ ID NO: 1250056 - protein, 19 aa, Mycobacterium
WSDVQFATGGSWTVANPDA

SEQ ID NO: 1250057 - protein, 20 aa, Mycobacterium
WSEISGLDLARLGTTADADE

SEQ ID NO: 1250058 - protein, 22 aa, Mycobacterium
WSERTGKRWLGSFITTFRFNEV

SEQ ID NO: 1250059 - protein, 19 aa, Mycobacterium
WSGLPYQRFLLANIAHGEP

SEQ ID NO: 1250060 - protein, 18 aa, Mycobacterium
WSGRITIRSTLDGNVTNS

SEQ ID NO: 1250061 - protein, 18 aa, Mycobacterium
WSGSRFAKRPALPEGIHR

SEQ ID NO: 1250062 - protein, 31 aa, Mycobacterium; identical to SEQ ID NO: 923171

SEQ ID NO: 1250063 - protein, 23 aa, Mycobacterium
WSKRTGARHVILFEGRDAAGKGG

SEQ ID NO: 1250064 - protein, 23 aa, Mycobacterium
WSLGGVLAYACAIGLKQAGADVR

SEQ ID NO: 1250065 - protein, 20 aa, Mycobacterium
WSLVGAKSRVAVACGRAPSL

SEQ ID NO: 1250066 - protein, 25 aa, Mycobacterium
WSMALSLRLAAYELLRTDGSDPVLL

SEQ ID NO: 1250067 - protein, 19 aa, Mycobacterium
WSQGIPLAYTRELADYWAN

SEQ ID NO: 1250068 - protein, 17 aa, Mycobacterium
WSQIPIFDPNWRTNMFD

SEQ ID NO: 1250069 - protein, 23 aa, Mycobacterium
WSSGSEHAHWIIVGMMMPGSSEA

SEQ ID NO: 1250070 - protein, 18 aa, Mycobacterium
WSTVPVLVADVLHEMAEQ

SEQ ID NO: 1250071 - protein, 23 aa, Mycobacterium
WSVLPRTEWETPLRDGARVEVVT

SEQ ID NO: 1250072 - protein, 17 aa, Mycobacterium
WSYAKFLLGNERTGITQ

SEQ ID NO: 1250073 - protein, 22 aa, Mycobacterium
WTARAELATAIFEYIEAFYNPV

SEQ ID NO: 1250074 - protein, 17 aa, Mycobacterium
WTDRPATEFTLQAWSGG

SEQ ID NO: 1250075 - protein, 19 aa, Mycobacterium
WTIEPDLSNAVPFLSAGVV

SEQ ID NO: 1250076 - protein, 18 aa, Mycobacterium
WTKVLKFVNETNMRGRLA

SEQ ID NO: 1250077 - protein, 17 aa, Mycobacterium
WTPAVTLAEGVARTVEW

SEQ ID NO: 1250078 - protein, 24 aa, Mycobacterium
WTRVPYEVLERISTRITNEVPEVN

SEQ ID NO: 1250079 - protein, 24 aa, Mycobacterium
WTSSSRKAMLPVFESANSLLYYPV

SEQ ID NO: 1250080 - protein, 23 aa, Mycobacterium
WTTDVRSGLLFVWHDHEGNPPPP

SEQ ID NO: 1250081 - protein, 19 aa, Mycobacterium
WTTLSWVDANVWRRIVPKG

SEQ ID NO: 1250082 - protein, 20 aa, Mycobacterium
WTVKSALDLGVPVTGIAEAV

SEQ ID NO: 1250083 - protein, 17 aa, Mycobacterium
WTYAELNDEIDLVARGL

SEQ ID NO: 1250084 - protein, 17 aa, Mycobacterium
WVACSHGDVIKAVLADA

SEQ ID NO: 1250085 - protein, 26 aa, Mycobacterium
WVDANVWRRIVPKGWFYNVMVTGVKP

SEQ ID NO: 1250086 - protein, 17 aa, Mycobacterium
WVDLPVHPAWEPPVHDD

SEQ ID NO: 1250087 - protein, 17 aa, Mycobacterium
WVEETLRYDTSSQILAR

SEQ ID NO: 1250088 - protein, 24 aa, Mycobacterium
WVGLIRWAKPILTTRIGQASVLKT

SEQ ID NO: 1250089 - protein, 20 aa, Mycobacterium
WVGSRPRMWRSVSKEFDIAE

SEQ ID NO: 1250090 - protein, 21 aa, Mycobacterium
WVHFPEGLGGLGVSRGLQAVA

SEQ ID NO: 1250091 - protein, 19 aa, Mycobacterium
WVHGANVARGYWQRPKETE

SEQ ID NO: 1250092 - protein, 19 aa, Mycobacterium
WVHRRHWRTPAAPPGGRGV

SEQ ID NO: 1250093 - protein, 20 aa, Mycobacterium
WVLDELRQLAAVLGVARDAE

SEQ ID NO: 1250094 - protein, 20 aa, Mycobacterium
WVLTKGKLPTSMWIDVVTTA

SEQ ID NO: 1250095 - protein, 17 aa, Mycobacterium
WVMSPRWFDGNDHLALD

SEQ ID NO: 1250096 - protein, 17 aa, Mycobacterium
WVNDWHMVNAMYPFGGV

SEQ ID NO: 1250097 - protein, 21 aa, Mycobacterium
WVNEILSLTVRLRGVDAPGIA

SEQ ID NO: 1250098 - protein, 24 aa, Mycobacterium
WVRENRLRHAASLSEAAEDLDVVS

SEQ ID NO: 1250099 - protein, 18 aa, Mycobacterium
WVSAAPCAALRTVTLDEM

SEQ ID NO: 1250100 - protein, 26 aa, Mycobacterium
WVSERYRIPLTIIRICSTYGPEGGAP

SEQ ID NO: 1250101 - protein, 18 aa, Mycobacterium
WVTPVKAFMRTAAQDTEV

SEQ ID NO: 1250102 - protein, 17 aa, Mycobacterium
WWDDLWLNESFATFASV

SEQ ID NO: 1250103 - protein, 17 aa, Mycobacterium
WWERPYVAAGIFLYDQL

SEQ ID NO: 1250104 - protein, 31 aa, Mycobacterium
WWPADYGNYAGLFIRMSWHAAGTYRIFDGRG

SEQ ID NO: 1250105 - protein, 17 aa, Mycobacterium
WWQAGHRSPEPGHTLAL

SEQ ID NO: 1250106 - protein, 23 aa, Mycobacterium
WWQTELDGVLYLDTEPWRGEPLL

SEQ ID NO: 1250107 - protein, 20 aa, Mycobacterium
WWYYGRSFEGKQYGVHCRCP

SEQ ID NO: 1250108 - protein, 17 aa, Mycobacterium
WYAAPLLLRGPRGLIAF

SEQ ID NO: 1250109 - protein, 19 aa, Mycobacterium
WYEGPEWLARVLRALPEAG

SEQ ID NO: 1250110 - protein, 17 aa, Mycobacterium
WYFSHPQSQYFVVGRLA

SEQ ID NO: 1250111 - protein, 18 aa, Mycobacterium
WYGLHDLARIGARDKVLI

SEQ ID NO: 1250112 - protein, 22 aa, Mycobacterium
WYIREVDPTVLLLTGLTRDGVY

SEQ ID NO: 1250113 - protein, 17 aa, Mycobacterium
WYSHVTLIGRVTEMYDD

SEQ ID NO: 1250114 - protein, 26 aa, Mycobacterium
WYYPVLCGALRGAAAHDRIHERWDDF

SEQ ID NO: 1250115 - protein, 25 aa, Mycobacterium
YAALEFWSAMHGFVLLEMTGVMNGI

SEQ ID NO: 1250116 - protein, 17 aa, Mycobacterium
YACAIGLKQAGADVRFV

SEQ ID NO: 1250117 - protein, 18 aa, Mycobacterium
YACSFRITEAVYFVERLV

SEQ ID NO: 1250118 - protein, 28 aa, Mycobacterium
YADSAIIRRLCEPERQILFRVPWVDDSG

SEQ ID NO: 1250119 - protein, 29 aa, Mycobacterium
YADVEQRGALPFRVVASYSVRSAPVDGAV

SEQ ID NO: 1250120 - protein, 17 aa, Mycobacterium
YADVSALYTAVGEGHIS

SEQ ID NO: 1250121 - protein, 19 aa, Mycobacterium
YAERHGWSVTILDETTSDL

SEQ ID NO: 1250122 - protein, 18 aa, Mycobacterium
YAEVRFAPELHIEGGMGL

SEQ ID NO: 1250123 - protein, 24 aa, Mycobacterium
YAEVVARLVPLRCRVAVDTSERPL

SEQ ID NO: 1250124 - protein, 17 aa, Mycobacterium
YAFEAPLLLGSRAVLME

SEQ ID NO: 1250125 - protein, 22 aa, Mycobacterium
YAGAFPAWLAPVQVVGIPVADA

SEQ ID NO: 1250126 - protein, 18 aa, Mycobacterium
YAGLTTDTGSFRWASARA

SEQ ID NO: 1250127 - protein, 23 aa, Mycobacterium
YAIPEARGLIYTEYVRLIELITE

SEQ ID NO: 1250128 - protein, 19 aa, Mycobacterium
YALELARRGAAVVVNDLGG

SEQ ID NO: 1250129 - protein, 25 aa, Mycobacterium
YALHCDPRLAVGRVAVRPGPITSAA

SEQ ID NO: 1250130 - protein, 21 aa, Mycobacterium
YANLLSRTGFRLTHVTGTVTP

SEQ ID NO: 1250131 - protein, 19 aa, Mycobacterium
YAPTHGRDELVAGLMVDAL

SEQ ID NO: 1250132 - protein, 26 aa, Mycobacterium
YAPWHVVPCDRKWYSRLAITELLIEA

SEQ ID NO: 1250133 - protein, 19 aa, Mycobacterium
YARHTGGTFVFRIEDTDSA

SEQ ID NO: 1250134 - protein, 29 aa, Mycobacterium
YARQAAHDWHEFIAFRGRELCPGGRLVVM

SEQ ID NO: 1250135 - protein, 23 aa, Mycobacterium
YARSEGAGMLVLKRLSDARRDGD

SEQ ID NO: 1250136 - protein, 23 aa, Mycobacterium
YASATFPWFALGRQVHVRGPVTK

SEQ ID NO: 1250137 - protein, 24 aa, Mycobacterium
YASSLWAGVFMARIGARHLYSAGS

SEQ ID NO: 1250138 - protein, 18 aa, Mycobacterium
YATGIDRRDWPLFRTVFT

SEQ ID NO: 1250139 - protein, 20 aa, Mycobacterium
YAVLDGEIWFETKAKSQKAV

SEQ ID NO: 1250140 - protein, 18 aa, Mycobacterium
YAVPRAGRVLTLVNQRLR

SEQ ID NO: 1250141 - protein, 21 aa, Mycobacterium
YCPHEGGPLCLGRARGRTVVD

SEQ ID NO: 1250142 - protein, 18 aa, Mycobacterium
YCRIGERSSHTWFVLQEL

SEQ ID NO: 1250143 - protein, 18 aa, Mycobacterium
YCRIGERSSHTWFVLTHL

SEQ ID NO: 1250144 - protein, 29 aa, Mycobacterium
YDAGFVESFWKPVWDFHARQVPETEAAMR

SEQ ID NO: 1250145 - protein, 19 aa, Mycobacterium
YDAGLQWFRAALAGRSPDE

SEQ ID NO: 1250146 - protein, 23 aa, Mycobacterium
YDAIPAPARRTGGHPAKRTFQAL

SEQ ID NO: 1250147 - protein, 25 aa, Mycobacterium
YDESLWTLLCEQVGAAALVVPEELG

SEQ ID NO: 1250148 - protein, 25 aa, Mycobacterium
YDFINRPAYQHALATADTEFLRLTL

SEQ ID NO: 1250149 - protein, 20 aa, Mycobacterium
YDFSGFKLVVDVGGGHGSVL

SEQ ID NO: 1250150 - protein, 19 aa, Mycobacterium
YDGRVSWVRLDRVLDVPEE

SEQ ID NO: 1250151 - protein, 27 aa, Mycobacterium
YDGVLGRLWLSRGGTYVLANIRGGGEY

SEQ ID NO: 1250152 - protein, 19 aa, Mycobacterium
YDHPSVVWVAAGGSWANDS

SEQ ID NO: 1250153 - protein, 26 aa, Mycobacterium
YDIGCKRPTFSNSYFRTFTKPHVHLQ

SEQ ID NO: 1250154 - protein, 25 aa, Mycobacterium
YDIPPRSVVPIAWDTIRTLAEHPNI

SEQ ID NO: 1250155 - protein, 21 aa, Mycobacterium
YDIYRGVVTYVRVVDGKITPR

SEQ ID NO: 1250156 - protein, 24 aa, Mycobacterium
YDKLEAFANFGFPESHSLSFASLV

SEQ ID NO: 1250157 - protein, 19 aa, Mycobacterium
YDLFARKVMPHFKGQLTAP

SEQ ID NO: 1250158 - protein, 17 aa, Mycobacterium
YDLLFFADVFGLRAPWN

SEQ ID NO: 1250159 - protein, 17 aa, Mycobacterium
YDLLGLTAPASVRGVPQ

SEQ ID NO: 1250160 - protein, 17 aa, Mycobacterium
YDLTELPEHLVIVGSGV

SEQ ID NO: 1250161 - protein, 20 aa, Mycobacterium
YDMYRLLALAKYDERYVIPT

SEQ ID NO: 1250162 - protein, 18 aa, Mycobacterium
YDNAFALSNFNADDMDDF

SEQ ID NO: 1250163 - protein, 18 aa, Mycobacterium
YDQSKVFVVLRRDVDLAV

SEQ ID NO: 1250164 - protein, 17 aa, Mycobacterium
YDRIEVVVHPQSIVHSM

SEQ ID NO: 1250165 - protein, 20 aa, Mycobacterium
YDRIPYLVAYQNTSGVRDVY

SEQ ID NO: 1250166 - protein, 23 aa, Mycobacterium
YDRPANAFVAGFIGSPAMNLVTL

SEQ ID NO: 1250167 - protein, 17 aa, Mycobacterium
YDRRALMRFVTAVKSGA

SEQ ID NO: 1250168 - protein, 28 aa, Mycobacterium
YDSDYHAELAWWTGWLAVSDGIPHGSLV

SEQ ID NO: 1250169 - protein, 25 aa, Mycobacterium
YDSETCWRDYRLGMLQAPLITVLGC

SEQ ID NO: 1250170 - protein, 19 aa, Mycobacterium
YDTGVSLEAVCELEPYWEA

SEQ ID NO: 1250171 - protein, 21 aa, Mycobacterium
YDWGITPGDMATIWRGGCIIR

SEQ ID NO: 1250172 - protein, 21 aa, Mycobacterium
YECDLHALLPGGHRLAEESAI

SEQ ID NO: 1250173 - protein, 17 aa, Mycobacterium
YEEAGIRAIDLTPAAVG

SEQ ID NO: 1250174 - protein, 17 aa, Mycobacterium
YEEWKLDDPAGMGVDAV

SEQ ID NO: 1250175 - protein, 17 aa, Mycobacterium
YEGRYAWADAAHAVEEA

SEQ ID NO: 1250176 - protein, 31 aa, Mycobacterium
YEHSYPHCWRCRNPLIYRAVSSWFIKVTEFR

SEQ ID NO: 1250177 - protein, 19 aa, Mycobacterium
YEIAEPAYLGPDVVAHFDT

SEQ ID NO: 1250178 - protein, 17 aa, Mycobacterium
YELARTVLRDDRFATPR

SEQ ID NO: 1250179 - protein, 19 aa, Mycobacterium
YELLPAWDDAPAVFDALVS

SEQ ID NO: 1250180 - protein, 17 aa, Mycobacterium
YELPRDFLVETQPFTLE

SEQ ID NO: 1250181 - protein, 21 aa, Mycobacterium
YEMLQRADSVGVFQVESRAQM

SEQ ID NO: 1250182 - protein, 33 aa, Mycobacterium; identical to SEQ ID NO: 92789

SEQ ID NO: 1250183 - protein, 28 aa, Mycobacterium
YEPIAWDDAYRLIADELRALADPDEAVF

SEQ ID NO: 1250184 - protein, 20 aa, Mycobacterium
YEPLMKRLPPDTPIYGIERV

SEQ ID NO: 1250185 - protein, 21 aa, Mycobacterium
YEPLTALPLRRAVVMLICGKA

SEQ ID NO: 1250186 - protein, 17 aa, Mycobacterium
YEPPALQAARYVTRDVD

SEQ ID NO: 1250187 - protein, 18 aa, Mycobacterium
YEREVRFYTDIAPGLPGP

SEQ ID NO: 1250188 - protein, 23 aa, Mycobacterium
YERGRRLVGLFSQQGHFDRTKAE

SEQ ID NO: 1250189 - protein, 19 aa, Mycobacterium
YERLTAAGFELDWGDDGSG

SEQ ID NO: 1250190 - protein, 19 aa, Mycobacterium
YEVDWAGCRRVNMQNVAGW

SEQ ID NO: 1250191 - protein, 21 aa, Mycobacterium
YEVEIAGAHVVVIGRGVTVGR

SEQ ID NO: 1250192 - protein, 22 aa, Mycobacterium
YEVLQSLGPVVAKHPEYADSAI

SEQ ID NO: 1250193 - protein, 17 aa, Mycobacterium
YEVPEAMAADVEAALPG

SEQ ID NO: 1250194 - protein, 21 aa, Mycobacterium
YEVPVLLAALGPVMLRLAGER

SEQ ID NO: 1250195 - protein, 23 aa, Mycobacterium
YFASWFERYARSFSGTIAGGTSE

SEQ ID NO: 1250196 - protein, 20 aa, Mycobacterium
YFATKEELFLAASDRYWRRY

SEQ ID NO: 1250197 - protein, 24 aa, Mycobacterium
YFDFTFAGLPAYRQGLGRKVRFMA

SEQ ID NO: 1250198 - protein, 19 aa, Mycobacterium
YFEKPRTTIGWKGLINDPG

SEQ ID NO: 1250199 - protein, 29 aa, Mycobacterium
YFLNLMLRAPFRLSRDVIPHMQPGSAIIN

SEQ ID NO: 1250200 - protein, 19 aa, Mycobacterium
YFPSSAWSYPPTRLADDTA

SEQ ID NO: 1250201 - protein, 25 aa, Mycobacterium
YFQAYAAACALHFAEKALTEIRAGR

SEQ ID NO: 1250202 - protein, 19 aa, Mycobacterium
YFSLAMIPGGGRRRAVTGS

SEQ ID NO: 1250203 - protein, 23 aa, Mycobacterium
YFTVRAGSLVAWRAGENPHAPFR

SEQ ID NO: 1250204 - protein, 20 aa, Mycobacterium
YFVYRLIKRLKKSANAAPYH

SEQ ID NO: 1250205 - protein, 18 aa, Mycobacterium
YGAALPWPARTADGDAEG

SEQ ID NO: 1250206 - protein, 19 aa, Mycobacterium
YGAIPREDVAAVLLAVLDT

SEQ ID NO: 1250207 - protein, 21 aa, Mycobacterium
YGASPRASLGIIAASRALALV

SEQ ID NO: 1250208 - protein, 24 aa, Mycobacterium
YGDLFPHAVRWQGVIYLEDGLHRA

SEQ ID NO: 1250209 - protein, 24 aa, Mycobacterium
YGDPTLPARFGIAVDHLNGQGMDA

SEQ ID NO: 1250210 - protein, 18 aa, Mycobacterium
YGGGSQYYSMWVVSSDKR

SEQ ID NO: 1250211 - protein, 36 aa, Mycobacterium
YGGSKVALPLVRRALELLPGVGFVNAYGLTETSSTI

SEQ ID NO: 1250212 - protein, 21 aa, Mycobacterium
YGIGGSWFRLAAVGEDESLLI

SEQ ID NO: 1250213 - protein, 18 aa, Mycobacterium
YGLAAADGVMTWLEEQGR

SEQ ID NO: 1250214 - protein, 19 aa, Mycobacterium
YGLIGFNMPEEFGGGGSDD

SEQ ID NO: 1250215 - protein, 18 aa, Mycobacterium
YGLYANIRPARRLSGAIP

SEQ ID NO: 1250216 - protein, 24 aa, Mycobacterium
YGNKISWADLIAYAGNAALEQSGF

SEQ ID NO: 1250217 - protein, 19 aa, Mycobacterium
YGPAGTWLKVPLGKLATER

SEQ ID NO: 1250218 - protein, 17 aa, Mycobacterium
YGPEKIGLLTGDQSING

SEQ ID NO: 1250219 - protein, 19 aa, Mycobacterium
YGPGWGHRGNKHYRKQGFG

SEQ ID NO: 1250220 - protein, 27 aa, Mycobacterium
YGPVYPRTPACYGFSIIAKVKEGREEA

SEQ ID NO: 1250221 - protein, 17 aa, Mycobacterium
YGRCRDGQPAPYAALSD

SEQ ID NO: 1250222 - protein, 25 aa, Mycobacterium
YGRGWPFSLLFAVVYATRGYHVVVQ

SEQ ID NO: 1250223 - protein, 18 aa, Mycobacterium
YGRIVCFCERVTAGEIRD

SEQ ID NO: 1250224 - protein, 28 aa, Mycobacterium
YGSASILPITWMYIRMMGAPGLRAASLT

SEQ ID NO: 1250225 - protein, 24 aa, Mycobacterium
YGSSGKVYGGMGVVGPTRMDYPGT

SEQ ID NO: 1250226 - protein, 19 aa, Mycobacterium
YGSSVVGFQDGWRGLLENR

SEQ ID NO: 1250227 - protein, 22 aa, Mycobacterium
YGTTRETLGWIALNQRANAALN

SEQ ID NO: 1250228 - protein, 24 aa, Mycobacterium
YGVHFCLGAALARMEINSFFSELV

SEQ ID NO: 1250229 - protein, 25 aa, Mycobacterium
YGVHFCLGAALARMEMNSLFTELLP

SEQ ID NO: 1250230 - protein, 18 aa, Mycobacterium
YGVPVAIKAAFGGGGRGM

SEQ ID NO: 1250231 - protein, 20 aa, Mycobacterium
YHAELSWWTAPFEISAGIPQ

SEQ ID NO: 1250232 - protein, 19 aa, Mycobacterium
YHDELRWWTEPSRPYRGVP

SEQ ID NO: 1250233 - protein, 25 aa, Mycobacterium
YHERRAVGGGSEFASGIGPEGVSDQ

SEQ ID NO: 1250234 - protein, 20 aa, Mycobacterium
YHGGLQFSPSTWAGHGGGEF

SEQ ID NO: 1250235 - protein, 17 aa, Mycobacterium
YHHSFLRTVHEGIAQLV

SEQ ID NO: 1250236 - protein, 26 aa, Mycobacterium
YHLDRGWCEHLAYLADIRESIHLRAL

SEQ ID NO: 1250237 - protein, 17 aa, Mycobacterium
YHLELGAKLAPLRERGV

SEQ ID NO: 1250238 - protein, 17 aa, Mycobacterium
YHPTLGLAENIYRPTHL

SEQ ID NO: 1250239 - protein, 18 aa, Mycobacterium
YHRAEMRGLESFPSAGGA

SEQ ID NO: 1250240 - protein, 19 aa, Mycobacterium
YHTPHCARIQPAHLARGLA

SEQ ID NO: 1250241 - protein, 23 aa, Mycobacterium
YHYPAEHWIHLRTTNPIESTFAT

SEQ ID NO: 1250242 - protein, 19 aa, Mycobacterium
YIDIWEAVKPARLDIPAWP

SEQ ID NO: 1250243 - protein, 24 aa, Mycobacterium
YIGLSRCHRGYVPVGEEGVEQDTP

SEQ ID NO: 1250244 - protein, 18 aa, Mycobacterium
YIHRLRKYIGAYLALLGS

SEQ ID NO: 1250245 - protein, 32 aa, Mycobacterium
YIMKADHGLVLPRRLQIEFSQAIQKITDGEGG

SEQ ID NO: 1250246 - protein, 18 aa, Mycobacterium
YIRPEPDGTVLFGNSDLA

SEQ ID NO: 1250247 - protein, 17 aa, Mycobacterium
YIRSCVDAGDVVAAAEA

SEQ ID NO: 1250248 - protein, 24 aa, Mycobacterium
YIVDRLKELIKYKGYQVPPAELEA

SEQ ID NO: 1250249 - protein, 25 aa, Mycobacterium
YKALMDARVPLYRRVATMRVNTNRR

SEQ ID NO: 1250250 - protein, 21 aa, Mycobacterium
YKAWFPLTHRWLGFEDAHITF

SEQ ID NO: 1250251 - protein, 19 aa, Mycobacterium
YKDAIAAAALEYLPGSGAS

SEQ ID NO: 1250252 - protein, 20 aa, Mycobacterium
YKELHVVGALGVEYPAHRAA

SEQ ID NO: 1250253 - protein, 24 aa, Mycobacterium
YKNECVRADSPFRRGPLNTVGDVE

SEQ ID NO: 1250254 - protein, 22 aa, Mycobacterium
YKPELPGGRPGGGRSLSAAPFD

SEQ ID NO: 1250255 - protein, 17 aa, Mycobacterium
YKQVALFSATMPPGIKK

SEQ ID NO: 1250256 - protein, 20 aa, Mycobacterium
YKRMFLPGVDDVVFIGFAQS

SEQ ID NO: 1250257 - protein, 21 aa, Mycobacterium
YKSPWKGKWVQQLTDLVADRL

SEQ ID NO: 1250258 - protein, 19 aa, Mycobacterium
YKVFLNLLRERFETDKTKW

SEQ ID NO: 1250259 - protein, 23 aa, Mycobacterium
YKWWPSAAAIVLEGLLASMQGSI

SEQ ID NO: 1250260 - protein, 19 aa, Mycobacterium
YKYVLKEYVGYVVQKRFNL

SEQ ID NO: 1250261 - protein, 17 aa, Mycobacterium
YLADRFGFQVIGAIVPS

SEQ ID NO: 1250262 - protein, 24 aa, Mycobacterium
YLALQLKARFEGIPTPVYGLQEVH

SEQ ID NO: 1250263 - protein, 20 aa, Mycobacterium
YLCADAGFTAADRALQTHGG

SEQ ID NO: 1250264 - protein, 19 aa, Mycobacterium
YLDICAEVADAGYKGFELL

SEQ ID NO: 1250265 - protein, 20 aa, Mycobacterium
YLDSHLSYQRACLHAIDYLT

SEQ ID NO: 1250266 - protein, 27 aa, Mycobacterium
YLEAWCRSAEGVRLFRFDRIVDARVLN

SEQ ID NO: 1250267 - protein, 19 aa, Mycobacterium
YLEELGFRATEDIRDDAGI

SEQ ID NO: 1250268 - protein, 24 aa, Mycobacterium
YLGKGHPLLSGFGRVLATVVADTS

SEQ ID NO: 1250269 - protein, 25 aa, Mycobacterium
YLIPAERLPLLMPFEQAGVPAPILA

SEQ ID NO: 1250270 - protein, 36 aa, Mycobacterium
YLIPTYPLPLLMPLTWIPVIGPIAVDMLDPVLRVLV

SEQ ID NO: 1250271 - protein, 17 aa, Mycobacterium
YLKRAALNRSLFGSPAA

SEQ ID NO: 1250272 - protein, 17 aa, Mycobacterium
YLKTIWTAQEWSHEKVS

SEQ ID NO: 1250273 - protein, 18 aa, Mycobacterium
YLMFSVFSVRPGELGYDE

SEQ ID NO: 1250274 - protein, 17 aa, Mycobacterium
YLQDVFRIDGVSRVIEQ

SEQ ID NO: 1250275 - protein, 18 aa, Mycobacterium
YLQEALRWLPASDPESDS

SEQ ID NO: 1250276 - protein, 25 aa, Mycobacterium
YLQKMSTVLGRRVWANAGSPEVDPR

SEQ ID NO: 1250277 - protein, 25 aa, Mycobacterium
YLRADELHLGFNFRLVRADFDADEI

SEQ ID NO: 1250278 - protein, 17 aa, Mycobacterium
YLRGRTSLPHAVQAAQY

SEQ ID NO: 1250279 - protein, 22 aa, Mycobacterium
YLRTFVRRRSALAIKKARPLST

SEQ ID NO: 1250280 - protein, 18 aa, Mycobacterium
YLTGCADLFREGYTDVAQ

SEQ ID NO: 1250281 - protein, 20 aa, Mycobacterium
YLTVDGRMLIVGSYAGAPKD

SEQ ID NO: 1250282 - protein, 18 aa, Mycobacterium
YLVALIAGPYARWDDLYR

SEQ ID NO: 1250283 - protein, 17 aa, Mycobacterium
YLVSAALGWDIVPDTVI

SEQ ID NO: 1250284 - protein, 25 aa, Mycobacterium
YLVSLLPRRIVDDLGARIRLVKRRY

SEQ ID NO: 1250285 - protein, 20 aa, Mycobacterium
YLVTCSRTGETLLIDAANDA

SEQ ID NO: 1250286 - protein, 20 aa, Mycobacterium
YLYQGDGLITGWHSHDVHQI

SEQ ID NO: 1250287 - protein, 26 aa, Mycobacterium
YLYRFDFATPMLRLLRLGAAHATELP

SEQ ID NO: 1250288 - protein, 17 aa, Mycobacterium
YNAILAIGFEWGVGLQH

SEQ ID NO: 1250289 - protein, 21 aa, Mycobacterium
YNASCSVYGHLHIPRTTWYDD

SEQ ID NO: 1250290 - protein, 23 aa, Mycobacterium
YNGTLEHLASWGIVAAAPDTETG

SEQ ID NO: 1250291 - protein, 22 aa, Mycobacterium
YNKLFEERIIFLGVQVDDASAN

SEQ ID NO: 1250292 - protein, 18 aa, Mycobacterium
YNQQRLMHRLGRIPPAEA

SEQ ID NO: 1250293 - protein, 26 aa, Mycobacterium
YPARVKCALLGWMAFKDAVAQASHDS

SEQ ID NO: 1250294 - protein, 24 aa, Mycobacterium
YPDKALRERVFRIYNEHIADLQER

SEQ ID NO: 1250295 - protein, 18 aa, Mycobacterium
YPGARCFLVNSGRIGEDM

SEQ ID NO: 1250296 - protein, 21 aa, Mycobacterium
YPGFTALDFIGPYEVLRSLPD

SEQ ID NO: 1250297 - protein, 19 aa, Mycobacterium
YPHIAVAAARMVADGKADR

SEQ ID NO: 1250298 - protein, 24 aa, Mycobacterium
YPHLSVAGNIAFPLRNNGVARDEV

SEQ ID NO: 1250299 - protein, 18 aa, Mycobacterium
YPHPGWGAAVQMIGPCEY

SEQ ID NO: 1250300 - protein, 25 aa, Mycobacterium
YPLYADFRAAGPLALPEANLVVFSA

SEQ ID NO: 1250301 - protein, 17 aa, Mycobacterium
YPMVYDMPARAKEAFGT

SEQ ID NO: 1250302 - protein, 19 aa, Mycobacterium
YPNQRLRLETSPDKLTTRV

SEQ ID NO: 1250303 - protein, 19 aa, Mycobacterium
YPPIPSFSPEHFAVARGTD

SEQ ID NO: 1250304 - protein, 21 aa, Mycobacterium
YPQFQRWSISLLSWIMNPERG

SEQ ID NO: 1250305 - protein, 18 aa, Mycobacterium
YPTGWAMAFNTPYKLFKR

SEQ ID NO: 1250306 - protein, 27 aa, Mycobacterium
YPVIERFGHVWTCLGDPVFDLPDPPEI

SEQ ID NO: 1250307 - protein, 26 aa, Mycobacterium
YPVVGEAIGGLGADMFAGTAVEKMFL

SEQ ID NO: 1250308 - protein, 24 aa, Mycobacterium
YPVVRRILDRSGVTLTEIIGNERQ

SEQ ID NO: 1250309 - protein, 19 aa, Mycobacterium
YQAAFMEVFARYSGTLLAA

SEQ ID NO: 1250310 - protein, 18 aa, Mycobacterium
YQFGDAKPVYALEGSIAV

SEQ ID NO: 1250311 - protein, 18 aa, Mycobacterium
YQFKIRPHHTMPESVGDG

SEQ ID NO: 1250312 - protein, 26 aa, Mycobacterium
YQLLRSGGYGGPGFNGPVFTDDISSM

SEQ ID NO: 1250313 - protein, 21 aa, Mycobacterium
YQRARGMGGLVRVSWAEATEM

SEQ ID NO: 1250314 - protein, 19 aa, Mycobacterium
YRAAPELIAGFAIRTAVLA

SEQ ID NO: 1250315 - protein, 23 aa, Mycobacterium
YRADEWTSPSGRRMDLPNRGNIL

SEQ ID NO: 1250316 - protein, 35 aa, Mycobacterium
YRAGRDIKAGRVWTNCYHMYPAHAAFGGYKQSGIG

SEQ ID NO: 1250317 - protein, 24 aa, Mycobacterium
YRALKEASYRLGARTLMHQFGAPM

SEQ ID NO: 1250318 - protein, 23 aa, Mycobacterium
YRAREFGVHAGMPLRVAARRCPD

SEQ ID NO: 1250319 - protein, 17 aa, Mycobacterium
YRAVSSWFIKVTEFRDR

SEQ ID NO: 1250320 - protein, 20 aa, Mycobacterium
YRCGIAWRDVPEVFGPWQTI

SEQ ID NO: 1250321 - protein, 33 aa, Mycobacterium
YREDWPQADALRFAVNRLRMFAADPAERTPRPA

SEQ ID NO: 1250322 - protein, 20 aa, Mycobacterium
YRELESFAAFASDLDATSKA

SEQ ID NO: 1250323 - protein, 25 aa, Mycobacterium
YREPRPMVYSGLYPVDGSDYPVLRE

SEQ ID NO: 1250324 - protein, 24 aa, Mycobacterium
YRERRARHQTDWVVLVDDTLRIGI

SEQ ID NO: 1250325 - protein, 18 aa, Mycobacterium
YRESLGFEVIPLSGGERP

SEQ ID NO: 1250326 - protein, 19 aa, Mycobacterium
YRFTEFRSAKTAPKDGGLR

SEQ ID NO: 1250327 - protein, 19 aa, Mycobacterium
YRGHQWFDDCVEFCEKYDQ

SEQ ID NO: 1250328 - protein, 19 aa, Mycobacterium
YRGKLWTFRQYSGFGTAEE

SEQ ID NO: 1250329 - protein, 24 aa, Mycobacterium
YRHFPNRRALAAAVYEDIVVTDIK

SEQ ID NO: 1250330 - protein, 20 aa, Mycobacterium
YRIDDEHLLFVATDRISAYD

SEQ ID NO: 1250331 - protein, 22 aa, Mycobacterium
YRISADQAFRVLQWRSQETNTK

SEQ ID NO: 1250332 - protein, 17 aa, Mycobacterium
YRIVVADARTRRDGRSI

SEQ ID NO: 1250333 - protein, 23 aa, Mycobacterium
YRKTGTLCGLTLPPGLTEASKFA

SEQ ID NO: 1250334 - protein, 18 aa, Mycobacterium
YRLAWAQLSGCPVERVRA

SEQ ID NO: 1250335 - protein, 39 aa, Mycobacterium
YRLLGPEYKSPRLVKPEILASTKFRAGLEKIPGATVDEA

SEQ ID NO: 1250336 - protein, 21 aa, Mycobacterium
YRLTLRNGVLVHRKVSADESS

SEQ ID NO: 1250337 - protein, 21 aa, Mycobacterium
YRMPQMSGIEFLEEAMDLYPM

SEQ ID NO: 1250338 - protein, 18 aa, Mycobacterium
YRPGRFAKTLASLQTLII

SEQ ID NO: 1250339 - protein, 20 aa, Mycobacterium
YRPPEILQRRILKRDRTRAR

SEQ ID NO: 1250340 - protein, 24 aa, Mycobacterium
YRPWAGEIRARHTGSLVSDRSGSV

SEQ ID NO: 1250341 - protein, 20 aa, Mycobacterium
YRQDMVRMFGLPESGLAETL

SEQ ID NO: 1250342 - protein, 20 aa, Mycobacterium
YRQGDALGFINGRFTTIPES

SEQ ID NO: 1250343 - protein, 21 aa, Mycobacterium
YRQLDYWARTSLVVPSIRGAA

SEQ ID NO: 1250344 - protein, 19 aa, Mycobacterium
YRQLLPLVRHFHTGQEVLR

SEQ ID NO: 1250345 - protein, 23 aa, Mycobacterium
YRQMPAADLLAWFDTSRAALVAA

SEQ ID NO: 1250346 - protein, 17 aa, Mycobacterium
YRRAFRIAGEGPAILLI

SEQ ID NO: 1250347 - protein, 21 aa, Mycobacterium
YRRFFSITSLAGLRQEDPAVF

SEQ ID NO: 1250348 - protein, 27 aa, Mycobacterium
YRRFLERRLRETFGFEGSPIRINVRVR

SEQ ID NO: 1250349 - protein, 27 aa, Mycobacterium
YRRLREYPEALRLQLLDAVSGRVRTRS

SEQ ID NO: 1250350 - protein, 18 aa, Mycobacterium
YRRPRSGALVAMESRARC

SEQ ID NO: 1250351 - protein, 21 aa, Mycobacterium
YRRQVMVVSMHIGKPLTDNEI

SEQ ID NO: 1250352 - protein, 22 aa, Mycobacterium
YRRSLEEVSQWAELARSADFAD

SEQ ID NO: 1250353 - protein, 27 aa, Mycobacterium
YRSGARFGPSALRQACYLPQDGSRPSL

SEQ ID NO: 1250354 - protein, 26 aa, Mycobacterium
YRSLLRADLPPGGRLGIYGFGGSAHI

SEQ ID NO: 1250355 - protein, 20 aa, Mycobacterium
YRVGFDVDWSRPSEATAVDS

SEQ ID NO: 1250356 - protein, 18 aa, Mycobacterium
YRVPIGEALRLWYELLTR

SEQ ID NO: 1250357 - protein, 21 aa, Mycobacterium
YRVRCAAPVGGVLRLSEAAES

SEQ ID NO: 1250358 - protein, 25 aa, Mycobacterium
YRWFPSKQDLLSAFVVWERSLYERA

SEQ ID NO: 1250359 - protein, 22 aa, Mycobacterium
YRYFPEPDLEPVAPDAEFVEHL

SEQ ID NO: 1250360 - protein, 20 aa, Mycobacterium
YRYGPGVCKVDFVLSGEIPW

SEQ ID NO: 1250361 - protein, 21 aa, Mycobacterium
YSAAKAAAWALTDAVRTELAP

SEQ ID NO: 1250362 - protein, 24 aa, Mycobacterium
YSACAGRYARVFVGLSEGWLADAE

SEQ ID NO: 1250363 - protein, 19 aa, Mycobacterium
YSASSGQRWIRDELCREAL

SEQ ID NO: 1250364 - protein, 17 aa, Mycobacterium
YSAWKFYQATGDLAYLI

SEQ ID NO: 1250365 - protein, 19 aa, Mycobacterium
YSAYPRFHTLMAEESGEVF

SEQ ID NO: 1250366 - protein, 23 aa, Mycobacterium
YSDFRRATALGRASSPVWSNVAL

SEQ ID NO: 1250367 - protein, 18 aa, Mycobacterium
YSDRLTVVHWLESVQGLP

SEQ ID NO: 1250368 - protein, 21 aa, Mycobacterium
YSGDLMLAFSTGNRGIPPYSW

SEQ ID NO: 1250369 - protein, 24 aa, Mycobacterium
YSHTWSVGDTVIWDNRGVLHRAAP

SEQ ID NO: 1250370 - protein, 25 aa, Mycobacterium
YSLFSRLQPMLAIDGGAMFADPSAV

SEQ ID NO: 1250371 - protein, 23 aa, Mycobacterium
YSLPPRSDWAVHIALWQRTGGPG

SEQ ID NO: 1250372 - protein, 23 aa, Mycobacterium
YSPPERPYAPGAFGPGETLDQKL

SEQ ID NO: 1250373 - protein, 24 aa, Mycobacterium
YSPRVEGVHLRFGYVARGGLRWSD

SEQ ID NO: 1250374 - protein, 19 aa, Mycobacterium
YSQAGLFPIAYTKGTDFKK

SEQ ID NO: 1250375 - protein, 25 aa, Mycobacterium
YSQRQWWSAAGWAHRQEAGLTAPQF

SEQ ID NO: 1250376 - protein, 23 aa, Mycobacterium
YSRMREGQTLFTYLHLAASQPCT

SEQ ID NO: 1250377 - protein, 26 aa, Mycobacterium
YSVCAMCLPAYAVGGDFYDHYRVEGG

SEQ ID NO: 1250378 - protein, 19 aa, Mycobacterium
YSVPMARFVDTFARVLGDP

SEQ ID NO: 1250379 - protein, 23 aa, Mycobacterium
YTAASAVRWAIDLGLVPAADHLD

SEQ ID NO: 1250380 - protein, 17 aa, Mycobacterium
YTDEHEWVLRTGDDTLR

SEQ ID NO: 1250381 - protein, 22 aa, Mycobacterium
YTDMRRFGAAAVDLCLVAQGSL

SEQ ID NO: 1250382 - protein, 26 aa, Mycobacterium
YTDRLPFGPPPDWDSLELLLRDAVDE

SEQ ID NO: 1250383 - protein, 30 aa, Mycobacterium
YTEEMPIKVPWSLPAARPCFAGDPEDNRAP

SEQ ID NO: 1250384 - protein, 18 aa, Mycobacterium
YTFGGNWFYDAPVERQRE

SEQ ID NO: 1250385 - protein, 25 aa, Mycobacterium
YTFLSDRYPRRWQAPLRGAMKGALA

SEQ ID NO: 1250386 - protein, 20 aa, Mycobacterium
YTIANPRTDWCFTTEADPGL

SEQ ID NO: 1250387 - protein, 21 aa, Mycobacterium
YTLRFKDLRTGEQYDDTIVGI

SEQ ID NO: 1250388 - protein, 25 aa, Mycobacterium
YTLSPWRLVDYWTWTRRPEPRDFEF

SEQ ID NO: 1250389 - protein, 24 aa, Mycobacterium
YTMAKAAMEMCIRTLAQEERVHGI

SEQ ID NO: 1250390 - protein, 30 aa, Mycobacterium
YTSPDIRALYLFKRTMWWPYSVAMRQVNVL

SEQ ID NO: 1250391 - protein, 25 aa, Mycobacterium
YTVEVMSHWLARGADGWRLDAAYAV

SEQ ID NO: 1250392 - protein, 19 aa, Mycobacterium
YTVPPGISAVYVYRMPAGE

SEQ ID NO: 1250393 - protein, 18 aa, Mycobacterium
YVALTRATQRLGIAHCGP

SEQ ID NO: 1250394 - protein, 27 aa, Mycobacterium
YVAVCDVLRRHGFHSATAYLGVDGTAD

SEQ ID NO: 1250395 - protein, 26 aa, Mycobacterium
YVDARLEDIEGWYISRFLTMRSTAFA

SEQ ID NO: 1250396 - protein, 29 aa, Mycobacterium
YVDGKRTGLWPGLRETFGVGSADIPLQDM

SEQ ID NO: 1250397 - protein, 25 aa, Mycobacterium
YVDLVCSWGPMILGHAHPAVVEAVQ

SEQ ID NO: 1250398 - protein, 18 aa, Mycobacterium
YVDPPARLALDRPDPSPR

SEQ ID NO: 1250399 - protein, 26 aa, Mycobacterium
YVEILPTPFLPAGVFDVWGLADDDPR

SEQ ID NO: 1250400 - protein, 18 aa, Mycobacterium
YVEQGWDELYLHFVGQQQ

SEQ ID NO: 1250401 - protein, 21 aa, Mycobacterium
YVERYMKLLAPKWQMMSDPQL

SEQ ID NO: 1250402 - protein, 23 aa, Mycobacterium
YVEWAIKLGRPGTVIVVDNVTRM

SEQ ID NO: 1250403 - protein, 19 aa, Mycobacterium
YVGAHCVRALLADGHRVRL

SEQ ID NO: 1250404 - protein, 24 aa, Mycobacterium
YVGQKRFSLEGAETVIPAMDAVID

SEQ ID NO: 1250405 - protein, 29 aa, Mycobacterium
YVHKKGSALVPSWVAFAVIGLLEQHFGRL

SEQ ID NO: 1250406 - protein, 20 aa, Mycobacterium
YVNNWKRLGFTDEDVAKPGS

SEQ ID NO: 1250407 - protein, 18 aa, Mycobacterium
YVPWSERTGKRWLGSFIT

SEQ ID NO: 1250408 - protein, 19 aa, Mycobacterium
YVRDELRYLLDDSGATALL

SEQ ID NO: 1250409 - protein, 30 aa, Mycobacterium
YVRDGRPLPLLPLCGGVPTDVAWPYLERAA

SEQ ID NO: 1250410 - protein, 21 aa, Mycobacterium
YVRHFPVVVPRDGVAHIDAEL

SEQ ID NO: 1250411 - protein, 25 aa, Mycobacterium
YVRRQRIPLSLGVTVTRIDRDGDRW

SEQ ID NO: 1250412 - protein, 17 aa, Mycobacterium
YVSRLLAKLGVERRTQA

SEQ ID NO: 1250413 - protein, 24 aa, Mycobacterium
YVTRARSGFDLIKRLRAAGLGAVA

SEQ ID NO: 1250414 - protein, 17 aa, Mycobacterium
YVVKGRYDQQTFLRDLL

SEQ ID NO: 1250415 - protein, 25 aa, Mycobacterium
YVVQKRFNLSWSIEGTRSRTGKMLP

SEQ ID NO: 1250416 - protein, 18 aa, Mycobacterium
YWDLGALAADCAADGVYE

SEQ ID NO: 1250417 - protein, 24 aa, Mycobacterium
YWNIFKQNIGIMIAVAQLAAAQQR

SEQ ID NO: 1250418 - protein, 19 aa, Mycobacterium
YWRGARLDGNYPFSIALDG

SEQ ID NO: 1250419 - protein, 25 aa, Mycobacterium
YWRGRSAVDGEGWLATGDIGRIDAD

SEQ ID NO: 1250420 - protein, 18 aa, Mycobacterium
YWRRHARQPVEFAKSVRT

SEQ ID NO: 1250421 - protein, 26 aa, Mycobacterium
YWSYPNGHLCLWTWAANPEDRPLWDR

SEQ ID NO: 1250422 - protein, 24 aa, Mycobacterium
YWVDNLRHAVRFSAAVQAALEDGF

SEQ ID NO: 1250423 - protein, 22 aa, Mycobacterium
YYAKRGGALEFLVRRSQLTSAG

SEQ ID NO: 1250424 - protein, 26 aa, Mycobacterium
YYARPTQEALYRWYKTVAEEYPDLPI

SEQ ID NO: 1250425 - protein, 19 aa, Mycobacterium
YYASKSLILYDIYKGAADF

SEQ ID NO: 1250426 - protein, 19 aa, Mycobacterium
YYERCRRRSASVEHPRGLH

SEQ ID NO: 1250427 - protein, 20 aa, Mycobacterium
YYIGYKFQKGLALQDPATQA

SEQ ID NO: 1250428 - protein, 19 aa, Mycobacterium
YYLARGVTWVQDAWVEPGD

SEQ ID NO: 1250429 - protein, 17 aa, Mycobacterium
YYLPTIFDRCDRSMRIV

SEQ ID NO: 1250430 - protein, 26 aa, Mycobacterium
YYRLAHPKIRELLVIARTFLADTLDA

SEQ ID NO: 1250431 - protein, 24 aa, Mycobacterium
YYRLSADNRIVWGGYDAVYHFGRK

SEQ ID NO: 1250432 - protein, 19 aa, Mycobacterium
YYRRRAAGGVGLIITEGVR

SEQ ID NO: 1250433 - protein, 24 aa, Mycobacterium
AAADGYRTSLRLVHSTVTTGHLFA

SEQ ID NO: 1250434 - protein, 17 aa, Mycobacterium
AAAEAAYANLLKENTAL

SEQ ID NO: 1250435 - protein, 18 aa, Mycobacterium
AAAERWRPYGIRTNAEVS

SEQ ID NO: 1250436 - protein, 18 aa, Mycobacterium
AAAFDAADHFGWVACDNR

SEQ ID NO: 1250437 - protein, 20 aa, Mycobacterium
AAAFDMALLDLFWTSVSGVL

SEQ ID NO: 1250438 - protein, 20 aa, Mycobacterium
AAAIARRLGTPLVIHQPSYS

SEQ ID NO: 1250439 - protein, 20 aa, Mycobacterium
AAAIDELRVIAGLPPAGEDL

SEQ ID NO: 1250440 - protein, 17 aa, Mycobacterium
AAAKRWRTLTNRHGRDR

SEQ ID NO: 1250441 - protein, 23 aa, Mycobacterium
AAAKSAVVGMNFTTTAGQSCGST

SEQ ID NO: 1250442 - protein, 27 aa, Mycobacterium
AAALLPILELKAGRILFNGWPTGVEVT

SEQ ID NO: 1250443 - protein, 24 aa, Mycobacterium
AAALPISGLTAWQALFDHAHLTAG

SEQ ID NO: 1250444 - protein, 34 aa, Mycobacterium
AAAPEGRARFAAPEPHPPWPGIRDATMPGPTAPQ

SEQ ID NO: 1250445 - protein, 18 aa, Mycobacterium
AAAPPVAVPPLPPVPAVP

SEQ ID NO: 1250446 - protein, 18 aa, Mycobacterium
AAAPRYEEAGIRAIDLTP

SEQ ID NO: 1250447 - protein, 24 aa, Mycobacterium
AAARRARAKVVAISREDQLAPVDE

SEQ ID NO: 1250448 - protein, 23 aa, Mycobacterium
AAARTARYGALRAAHGGAPVLLG

SEQ ID NO: 1250449 - protein, 21 aa, Mycobacterium
AAARTSKPVLYRRWPDRASLL

SEQ ID NO: 1250450 - protein, 18 aa, Mycobacterium
AAASFVVDPDGALRDAGL

SEQ ID NO: 1250451 - protein, 19 aa, Mycobacterium
AAATSRRVAAEAGVKQALV

SEQ ID NO: 1250452 - protein, 24 aa, Mycobacterium
AAAVNFPDVLLIAGRYQVSVPTPF

SEQ ID NO: 1250453 - protein, 24 aa, Mycobacterium
AAAVNSRLGGHIVQGHVDGTGHVI

SEQ ID NO: 1250454 - protein, 22 aa, Mycobacterium
AACGAPLHILHGMPSLGRNLTE

SEQ ID NO: 1250455 - protein, 18 aa, Mycobacterium
AACLADAICDPGPAEKYS

SEQ ID NO: 1250456 - protein, 26 aa, Mycobacterium
AACRRRYGPVFTLRISSIGTMVYLAD

SEQ ID NO: 1250457 - protein, 21 aa, Mycobacterium
AADAALAVWLEMWNTDSEIAR

SEQ ID NO: 1250458 - protein, 21 aa, Mycobacterium
AADEALAWWRGPLLADLSDES

SEQ ID NO: 1250459 - protein, 18 aa, Mycobacterium
AADGRWAVARLRRDREFT

SEQ ID NO: 1250460 - protein, 19 aa, Mycobacterium
AADHFGWVACDNRTTRAVS

SEQ ID NO: 1250461 - protein, 26 aa, Mycobacterium
AADIRSIPTLMAFKKGKLVFNQAGAL

SEQ ID NO: 1250462 - protein, 18 aa, Mycobacterium
AADPAYGRIVCFCERVTA

SEQ ID NO: 1250463 - protein, 23 aa, Mycobacterium
AADQPRGAVLVIHENKGLNDYIR

SEQ ID NO: 1250464 - protein, 23 aa, Mycobacterium
AAEAARAALWRQIGLSPDDPASW

SEQ ID NO: 1250465 - protein, 24 aa, Mycobacterium
AAEALKADFPRIDLLINNAGVMYP

SEQ ID NO: 1250466 - protein, 32 aa, Mycobacterium
AAEAMVQRNCVAPMRLCHHFAPAMAARGRGGL

SEQ ID NO: 1250467 - protein, 27 aa, Mycobacterium
AAEEVKYPVEWAVGIFRSPSGTETVIT

SEQ ID NO: 1250468 - protein, 20 aa, Mycobacterium
AAEKICKAGFLKSGAETDVF

SEQ ID NO: 1250469 - protein, 25 aa, Mycobacterium
AAELADRFATIAARVLGPGDEMIKT

SEQ ID NO: 1250470 - protein, 17 aa, Mycobacterium
AAELDRRGLLRRIGGAP

SEQ ID NO: 1250471 - protein, 18 aa, Mycobacterium
AAELLEFAMRLGGDTDLR

SEQ ID NO: 1250472 - protein, 29 aa, Mycobacterium
AAEPEFSDPRIVRVWWRLTPREQEILRVK

SEQ ID NO: 1250473 - protein, 18 aa, Mycobacterium
AAERLRLKLIQRQDRWHD

SEQ ID NO: 1250474 - protein, 17 aa, Mycobacterium
AAFDGALDVDVVLSPFF

SEQ ID NO: 1250475 - protein, 44 aa, Mycobacterium
AAFGAKKPSVAWAETYPGTLSYYLASAFREVWMQPSGTVGLVGF

SEQ ID NO: 1250476 - protein, 19 aa, Mycobacterium
AAFGMRPEGAMIYLADHLD

SEQ ID NO: 1250477 - protein, 26 aa, Mycobacterium
AAFHPDRFRYAGSMSGFMTPSATTLN

SEQ ID NO: 1250478 - protein, 25 aa, Mycobacterium
AAFLRDVLAEFAVRGHLGGRIAAGH

SEQ ID NO: 1250479 - protein, 20 aa, Mycobacterium
AAGAARWLVLSGPAGIGKTR

SEQ ID NO: 1250480 - protein, 17 aa, Mycobacterium
AAGANWKLFYGGRSTES

SEQ ID NO: 1250481 - protein, 25 aa, Mycobacterium
AAGEAAFNIGSLFVPGGALSKTGTL

SEQ ID NO: 1250482 - protein, 18 aa, Mycobacterium
AAGENGFLGFEFGSEYGG

SEQ ID NO: 1250483 - protein, 23 aa, Mycobacterium
AAGETKPHWCVADNYRSRLIAPG

SEQ ID NO: 1250484 - protein, 18 aa, Mycobacterium
AAGGKCFYTTPIKALSNQ

SEQ ID NO: 1250485 - protein, 19 aa, Mycobacterium
AAGIVDPWTPFWDEHHAYE

SEQ ID NO: 1250486 - protein, 26 aa, Mycobacterium
AAGLRPRTGVGLGIPGVGAPAPAPVT

SEQ ID NO: 1250487 - protein, 17 aa, Mycobacterium
AAGQLRAHLRANGVGLD

SEQ ID NO: 1250488 - protein, 25 aa, Mycobacterium
AAGRAWPSRRSWEAMARVLAHLRRD

SEQ ID NO: 1250489 - protein, 28 aa, Mycobacterium
AAGRERCIAEFSWAHIAEQTMEIYRKVS

SEQ ID NO: 1250490 - protein, 23 aa, Mycobacterium
AAGSPRKAHLVYGVSSDADLVEL

SEQ ID NO: 1250491 - protein, 35 aa, Mycobacterium
AAGTELRYLLATSVPAWWAPYVPRLMRTPQLDGTP

SEQ ID NO: 1250492 - protein, 22 aa, Mycobacterium
AAGVGRPTFYVFTSVLVAVKDM

SEQ ID NO: 1250493 - protein, 27 aa, Mycobacterium
AAGVKRQEDFIGIHFFSPVDKMPLVEI

SEQ ID NO: 1250494 - protein, 20 aa, Mycobacterium
AAHELDRVHVVAYFDNSNGV

SEQ ID NO: 1250495 - protein, 18 aa, Mycobacterium
AAIAAHIRFRGRRAAMRL

SEQ ID NO: 1250496 - protein, 20 aa, Mycobacterium
AAIADWVYWQHVSVMSNDAI

SEQ ID NO: 1250497 - protein, 21 aa, Mycobacterium
AAIDVLVRWALDSRADARNRK

SEQ ID NO: 1250498 - protein, 17 aa, Mycobacterium
AAIGVGALDDWDGAARF

SEQ ID NO: 1250499 - protein, 26 aa, Mycobacterium
AAILRRFDIIVLPLVNPDGRWVSVTA

SEQ ID NO: 1250500 - protein, 19 aa, Mycobacterium
AAIPAGRLGSVADIGNAAL

SEQ ID NO: 1250501 - protein, 20 aa, Mycobacterium
AAIQLAVYRLAWAQLSGCPV

SEQ ID NO: 1250502 - protein, 23 aa, Mycobacterium
AAKARAWLGREACEPIRYLTYDL

SEQ ID NO: 1250503 - protein, 19 aa, Mycobacterium
AAKSAEWGLTNGVRIELAG

SEQ ID NO: 1250504 - protein, 25 aa, Mycobacterium
AAKVLPQPVLMRLVSLATRLTPTKE

SEQ ID NO: 1250505 - protein, 17 aa, Mycobacterium
AALAERTVLVGYEAVVA

SEQ ID NO: 1250506 - protein, 17 aa, Mycobacterium
AALEALDNLTFVVNCNL

SEQ ID NO: 1250507 - protein, 20 aa, Mycobacterium
AALEKAKGVLRTKVGAGTGV

SEQ ID NO: 1250508 - protein, 28 aa, Mycobacterium
AALERGGLRIARRAPLAAAARRVLDVLQ

SEQ ID NO: 1250509 - protein, 24 aa, Mycobacterium
AALHSRFDGLIAQWKRDHGDHGDT

SEQ ID NO: 1250510 - protein, 25 aa, Mycobacterium
AALHSRLDGLIAQWKRDHGDHGDTD

SEQ ID NO: 1250511 - protein, 17 aa, Mycobacterium
AALLCRDHLLGSLDDRS

SEQ ID NO: 1250512 - protein, 17 aa, Mycobacterium
AALLNRYDVAFIQYQYG

SEQ ID NO: 1250513 - protein, 17 aa, Mycobacterium
AALPPDRRRDFLVDSGY

SEQ ID NO: 1250514 - protein, 22 aa, Mycobacterium
AALRAGGVQTRLFPGSWSQWCA

SEQ ID NO: 1250515 - protein, 25 aa, Mycobacterium
AALRRAAKFASGWWSFLTPPEKIAE

SEQ ID NO: 1250516 - protein, 26 aa, Mycobacterium
AALSRLRGMFAFALWDTVTGELFCAR

SEQ ID NO: 1250517 - protein, 19 aa, Mycobacterium
AALSVCGPMGRMVFDQRLA

SEQ ID NO: 1250518 - protein, 17 aa, Mycobacterium
AALTLLWNTLAWGSGDK

SEQ ID NO: 1250519 - protein, 24 aa, Mycobacterium
AAMKPGRGPRRYVCGGELITFDGM

SEQ ID NO: 1250520 - protein, 26 aa, Mycobacterium
AANLLRLKAFFGRQWQQMPAAQFMAV

SEQ ID NO: 1250521 - protein, 27 aa, Mycobacterium
AAPEPHYRPSAALQDFVRCRDLTCRFP

SEQ ID NO: 1250522 - protein, 17 aa, Mycobacterium
AAPGFGLVVSYNPGYQS

SEQ ID NO: 1250523 - protein, 17 aa, Mycobacterium
AAPSVGLMQPWRFIRIT

SEQ ID NO: 1250524 - protein, 25 aa, Mycobacterium
AARFEFPRLRFVASVGEPLNAEAVW

SEQ ID NO: 1250525 - protein, 23 aa, Mycobacterium
AARGPHVMLGYWNRPEETAQALR

SEQ ID NO: 1250526 - protein, 19 aa, Mycobacterium
AARPDPRISDAVDRDDTRL

SEQ ID NO: 1250527 - protein, 22 aa, Mycobacterium
AARSAEFSRPLLAVAGGSHEGG

SEQ ID NO: 1250528 - protein, 25 aa, Mycobacterium
AASAIFRPAFVNGCIADPGDTLQER

SEQ ID NO: 1250529 - protein, 33 aa, Mycobacterium
AASMGYQSWWRRAESVGFCAHPIQLIGTDEYGR

SEQ ID NO: 1250530 - protein, 25 aa, Mycobacterium
AASPKETWLRLLLIDNGYDSLTTQI

SEQ ID NO: 1250531 - protein, 18 aa, Mycobacterium
AASTCPTAAPADGEPEWT

SEQ ID NO: 1250532 - protein, 24 aa, Mycobacterium
AASVLIRPGYEWPGHKPGQYVRLG

SEQ ID NO: 1250533 - protein, 22 aa, Mycobacterium
AATHKWPIVLDEIQERYREGPC

SEQ ID NO: 1250534 - protein, 19 aa, Mycobacterium
AATPGRRVVIVGGGYIGLE

SEQ ID NO: 1250535 - protein, 17 aa, Mycobacterium
AAVAAAFAAVVPLLVPY

SEQ ID NO: 1250536 - protein, 18 aa, Mycobacterium
AAVAEFTASLVLVSPEVG

SEQ ID NO: 1250537 - protein, 19 aa, Mycobacterium
AAVAQCFDTATTAVRSEGP

SEQ ID NO: 1250538 - protein, 23 aa, Mycobacterium
AAVDARWTITCGPDRLGQISSER

SEQ ID NO: 1250539 - protein, 17 aa, Mycobacterium
AAVEGHRALFANRDLLP

SEQ ID NO: 1250540 - protein, 19 aa, Mycobacterium
AAVIDPRLAQLSPEDRQTL

SEQ ID NO: 1250541 - protein, 19 aa, Mycobacterium
AAVRAEFGPVGILVTSAAI

SEQ ID NO: 1250542 - protein, 20 aa, Mycobacterium
AAWAGTLWLKPENLQAIGAF

SEQ ID NO: 1250543 - protein, 28 aa, Mycobacterium
AAYAPRPRMLVFGAIDFAAAVAQQGSFL

SEQ ID NO: 1250544 - protein, 19 aa, Mycobacterium
AAYGWSDIRLDHGFHTYRQ

SEQ ID NO: 1250545 - protein, 19 aa, Mycobacterium
ACAAGLPVIVDGGVTEDVA

SEQ ID NO: 1250546 - protein, 19 aa, Mycobacterium
ACATVYIPTAIFDFPVTPS

SEQ ID NO: 1250547 - protein, 21 aa, Mycobacterium
ACGSMMAGLAMNISDCAAEHS

SEQ ID NO: 1250548 - protein, 19 aa, Mycobacterium
ACLEQGLRVGCFRPPTVPA

SEQ ID NO: 1250549 - protein, 22 aa, Mycobacterium
ACLPIGEGWPNWREAGRRTLET

SEQ ID NO: 1250550 - protein, 34 aa, Mycobacterium
ADAAWLPSKWRRLTEDCLAKHSILPGNGEQAVVF

SEQ ID NO: 1250551 - protein, 17 aa, Mycobacterium
ADAEFARLFPGVVATPL

SEQ ID NO: 1250552 - protein, 19 aa, Mycobacterium
ADAEGLLDVAYRTVDTPVG

SEQ ID NO: 1250553 - protein, 17 aa, Mycobacterium
ADAELGEPVALRRSDGS

SEQ ID NO: 1250554 - protein, 21 aa, Mycobacterium
ADAETALAMARRSGVMRMTWW

SEQ ID NO: 1250555 - protein, 19 aa, Mycobacterium
ADAHGRLLLIDNGEPGPGR

SEQ ID NO: 1250556 - protein, 19 aa, Mycobacterium
ADAHILKNSYEWANDVKNG

SEQ ID NO: 1250557 - protein, 20 aa, Mycobacterium
ADAIRIVDMIGVHNAERVYG

SEQ ID NO: 1250558 - protein, 20 aa, Mycobacterium
ADALAPPRVVWVMVPSGPVT

SEQ ID NO: 1250559 - protein, 17 aa, Mycobacterium
ADANHEWPWSARFNPGG

SEQ ID NO: 1250560 - protein, 20 aa, Mycobacterium
ADAPVAPAWSLGSGILDEVV

SEQ ID NO: 1250561 - protein, 23 aa, Mycobacterium
ADARELSGFIARATRARTTAVAG

SEQ ID NO: 1250562 - protein, 23 aa, Mycobacterium
ADATRVQILWALVSHEKSVNDLA

SEQ ID NO: 1250563 - protein, 20 aa, Mycobacterium
ADAWRAGYVPSMDRVRRGEL

SEQ ID NO: 1250564 - protein, 25 aa, Mycobacterium
ADAYACAGCGTLLAVEIRAHEDEPL

SEQ ID NO: 1250565 - protein, 17 aa, Mycobacterium
ADDAGWDVVHVTLRKAD

SEQ ID NO: 1250566 - protein, 24 aa, Mycobacterium
ADDARLPVRLQWVSAELAMVQGDG

SEQ ID NO: 1250567 - protein, 26 aa, Mycobacterium
ADDLRVGPHPGWRIEVDGADVTVHAD

SEQ ID NO: 1250568 - protein, 20 aa, Mycobacterium
ADDRDVFSLDEMVAAFDVVD

SEQ ID NO: 1250569 - protein, 33 aa, Mycobacterium
ADELAVVHPSWWSRRRVQAVLDAAGDICGAAVA

SEQ ID NO: 1250570 - protein, 19 aa, Mycobacterium
ADELLVFPSTVLRGTPEDA

SEQ ID NO: 1250571 - protein, 25 aa, Mycobacterium
ADELQRRLHLPSRIDAIRHALKAQI

SEQ ID NO: 1250572 - protein, 28 aa, Mycobacterium
ADEVMAGFGRSGKWFSIDHFDVTPDLLT

SEQ ID NO: 1250573 - protein, 24 aa, Mycobacterium
ADFDGWRVPGWTWRDVLPHFRAIE

SEQ ID NO: 1250574 - protein, 20 aa, Mycobacterium
ADFDSLIPYDARFFELLNTV

SEQ ID NO: 1250575 - protein, 17 aa, Mycobacterium
ADFYICGPGPFMDTVEG

SEQ ID NO: 1250576 - protein, 19 aa, Mycobacterium
ADFYTRWFAADLSVRDLFP

SEQ ID NO: 1250577 - protein, 18 aa, Mycobacterium
ADGADVVQFFLGDPQSWK

SEQ ID NO: 1250578 - protein, 25 aa, Mycobacterium
ADGAKFATSFARRGLIAEYGISWIL

SEQ ID NO: 1250579 - protein, 17 aa, Mycobacterium
ADGAPLWTDASLLADPW

SEQ ID NO: 1250580 - protein, 27 aa, Mycobacterium
ADGEPLFMAGLWTTWRPKDAPKEAPPL

SEQ ID NO: 1250581 - protein, 20 aa, Mycobacterium
ADGFSSLWYASAVGGDPLVA

SEQ ID NO: 1250582 - protein, 26 aa, Mycobacterium
ADGKEIAGRLAARIGSGVLTDVIAVA

SEQ ID NO: 1250583 - protein, 21 aa, Mycobacterium
ADGLTVRSGRLCAFRSDVDCA

SEQ ID NO: 1250584 - protein, 19 aa, Mycobacterium
ADGPITMGALADSISVRQA

SEQ ID NO: 1250585 - protein, 25 aa, Mycobacterium
ADGSVSWAPVWARYGTNNRSCMLRL

SEQ ID NO: 1250586 - protein, 24 aa, Mycobacterium
ADGVAVPVNTRWSVHEIAFSLEDA

SEQ ID NO: 1250587 - protein, 19 aa, Mycobacterium
ADGYIDIKGLRLTLTQAAW

SEQ ID NO: 1250588 - protein, 24 aa, Mycobacterium
ADHCARTGFSVIIVGAGFSGLAAA

SEQ ID NO: 1250589 - protein, 18 aa, Mycobacterium
ADHRPAWTSTLVAESVGK

SEQ ID NO: 1250590 - protein, 25 aa, Mycobacterium
ADIAWAGPGPQWWAERLGVDEHLAE

SEQ ID NO: 1250591 - protein, 22 aa, Mycobacterium
ADKDDLDWLSDWGHSYEARPDS

SEQ ID NO: 1250592 - protein, 21 aa, Mycobacterium
ADKEGWLALMADDVVIEDPIG

SEQ ID NO: 1250593 - protein, 17 aa, Mycobacterium
ADKGWRAACQADPALAK

SEQ ID NO: 1250594 - protein, 24 aa, Mycobacterium
ADKLDLRSGITFNTKVTSAVLDED

SEQ ID NO: 1250595 - protein, 17 aa, Mycobacterium
ADLDAARTLARRQGACL

SEQ ID NO: 1250596 - protein, 22 aa, Mycobacterium
ADLEALAGMSVLNGVPVRIEAV

SEQ ID NO: 1250597 - protein, 21 aa, Mycobacterium
ADLHYRFTLDGSRISRLAIEP

SEQ ID NO: 1250598 - protein, 20 aa, Mycobacterium
ADLIAFCAGVGVDLIAVRNA

SEQ ID NO: 1250599 - protein, 17 aa, Mycobacterium
ADLIWSPMLRRFPDLKF

SEQ ID NO: 1250600 - protein, 17 aa, Mycobacterium
ADLLLEHAVRFSSAAGT

SEQ ID NO: 1250601 - protein, 25 aa, Mycobacterium
ADLLRSHVFFDWFDAVGVADLPAVF

SEQ ID NO: 1250602 - protein, 24 aa, Mycobacterium
ADLPACGSVALSFDVRPPRWLPPG

SEQ ID NO: 1250603 - protein, 17 aa, Mycobacterium
ADLWIFLTTAARYADAV

SEQ ID NO: 1250604 - protein, 19 aa, Mycobacterium
ADPAARTALCDELATREIS

SEQ ID NO: 1250605 - protein, 22 aa, Mycobacterium
ADPADCRRVVDTAVERHGGLDI

SEQ ID NO: 1250606 - protein, 18 aa, Mycobacterium
ADPDDWPAAGAVGREATV

SEQ ID NO: 1250607 - protein, 25 aa, Mycobacterium
ADPDLWWPDKRPYAPGSVLPASAQS

SEQ ID NO: 1250608 - protein, 20 aa, Mycobacterium
ADPEGVWGLGVLRAADRAEV

SEQ ID NO: 1250609 - protein, 22 aa, Mycobacterium
ADPHAAALFLPAGRAPRVGDVF

SEQ ID NO: 1250610 - protein, 20 aa, Mycobacterium
ADPRASLAIVAPASESDPLA

SEQ ID NO: 1250611 - protein, 18 aa, Mycobacterium
ADPRLAIVEEEQFGPVVP

SEQ ID NO: 1250612 - protein, 17 aa, Mycobacterium
ADPSGLFRDQRDTPVAG

SEQ ID NO: 1250613 - protein, 22 aa, Mycobacterium
ADQAIPYAWLPGRARTFYGTDF

SEQ ID NO: 1250614 - protein, 19 aa, Mycobacterium
ADRAWDLLAAHCAQSEKTR

SEQ ID NO: 1250615 - protein, 23 aa, Mycobacterium
ADRHPHCRWTVIIDESYPEVDFI

SEQ ID NO: 1250616 - protein, 22 aa, Mycobacterium
ADRIVLCAGAIATAQLLMISGV

SEQ ID NO: 1250617 - protein, 18 aa, Mycobacterium
ADRLFGWNRSGPRPQDHP

SEQ ID NO: 1250618 - protein, 23 aa, Mycobacterium
ADRTHPGLSEWIGSNARFPNSMV

SEQ ID NO: 1250619 - protein, 18 aa, Mycobacterium
ADTKFEFGVDPSGELVLA

SEQ ID NO: 1250620 - protein, 28 aa, Mycobacterium
ADVCPSCGEPFRSIGTMVIPEFGFIAAS

SEQ ID NO: 1250621 - protein, 19 aa, Mycobacterium
ADVLAWLTARHALARAAFQ

SEQ ID NO: 1250622 - protein, 18 aa, Mycobacterium
ADVSRAFFRSQCDTLRQA

SEQ ID NO: 1250623 - protein, 25 aa, Mycobacterium
ADWTEEVFKAFNFQTELTFDESEIM

SEQ ID NO: 1250624 - protein, 19 aa, Mycobacterium
ADYGLLLARTDWDVPKHEG

SEQ ID NO: 1250625 - protein, 20 aa, Mycobacterium
ADYRRHSLTLGREVTATLPG

SEQ ID NO: 1250626 - protein, 19 aa, Mycobacterium
AEAAAIFEHMISYQAVRTH

SEQ ID NO: 1250627 - protein, 19 aa, Mycobacterium
AEAEPRPVVVLSRDVAIPR

SEQ ID NO: 1250628 - protein, 21 aa, Mycobacterium
AEAKGAVRQIVFLQRATTQRP

SEQ ID NO: 1250629 - protein, 25 aa, Mycobacterium
AEAKIKLADMRSGRMSDDDWTRLAR

SEQ ID NO: 1250630 - protein, 21 aa, Mycobacterium
AEALGGGTLRTAVTDSMPALH

SEQ ID NO: 1250631 - protein, 22 aa, Mycobacterium
AEALLTAGLCARALGRADHATA

SEQ ID NO: 1250632 - protein, 19 aa, Mycobacterium
AEAQLLRRSIRRFSADPVA

SEQ ID NO: 1250633 - protein, 22 aa, Mycobacterium
AEASHRAGMHLSIDHPARVRIS

SEQ ID NO: 1250634 - protein, 24 aa, Mycobacterium
AEAVQQQWFSIGMVQPGWDDEPTG

SEQ ID NO: 1250635 - protein, 20 aa, Mycobacterium
AEAYDGPSIVIAYSHCIAHG

SEQ ID NO: 1250636 - protein, 22 aa, Mycobacterium
AEDRFLVAVTFRIGRLGVPVVA

SEQ ID NO: 1250637 - protein, 22 aa, Mycobacterium
AEDVHLWAAIQFLADRLPDNDP

SEQ ID NO: 1250638 - protein, 19 aa, Mycobacterium
AEDYCLPAIQSNALYMDRY

SEQ ID NO: 1250639 - protein, 22 aa, Mycobacterium
AEEVRRVAKKGCHAVSFSENPT

SEQ ID NO: 1250640 - protein, 18 aa, Mycobacterium
AEGEVTGLAHAWEGAPGY

SEQ ID NO: 1250641 - protein, 21 aa, Mycobacterium
AEGIEPCVITHRVSVDADDSD

SEQ ID NO: 1250642 - protein, 21 aa, Mycobacterium
AEGLADLALYAAMGDRASEAT

SEQ ID NO: 1250643 - protein, 19 aa, Mycobacterium
AEGLGQLYVRLLTANFEEA

SEQ ID NO: 1250644 - protein, 27 aa, Mycobacterium
AEIAEGWQPVFFYPEKADAVWGDALRA

SEQ ID NO: 1250645 - protein, 24 aa, Mycobacterium
AEIDEFAMPVAPWMFGAAGREHMR

SEQ ID NO: 1250646 - protein, 24 aa, Mycobacterium
AEIDRPGIDELPRRGDWPPGATSD

SEQ ID NO: 1250647 - protein, 21 aa, Mycobacterium
AEIFENSWICAVRAADLAQPG

SEQ ID NO: 1250648 - protein, 17 aa, Mycobacterium
AEIGGEISAAIGASLEG

SEQ ID NO: 1250649 - protein, 17 aa, Mycobacterium
AEKDLGLALTLGEELDV

SEQ ID NO: 1250650 - protein, 32 aa, Mycobacterium
AELDDFDLELALCQLVGPLAFARMTGIRTVTH

SEQ ID NO: 1250651 - protein, 19 aa, Mycobacterium
AELDRTVVVSGLTEPTDFK

SEQ ID NO: 1250652 - protein, 19 aa, Mycobacterium
AELERRKRRLGILHYDDLL

SEQ ID NO: 1250653 - protein, 17 aa, Mycobacterium
AELFARQIGFGGAKQVK

SEQ ID NO: 1250654 - protein, 24 aa, Mycobacterium
AELIAAKWGLSRTALDEFSAGSHE

SEQ ID NO: 1250655 - protein, 22 aa, Mycobacterium
AELKLAAIQQRFSLWVWENADR

SEQ ID NO: 1250656 - protein, 17 aa, Mycobacterium
AELPPLAGVAHLAGVLD

SEQ ID NO: 1250657 - protein, 18 aa, Mycobacterium
AELRAAVERCERLKSQAA

SEQ ID NO: 1250658 - protein, 18 aa, Mycobacterium
AELSRRIAAVSDRSSLIV

SEQ ID NO: 1250659 - protein, 22 aa, Mycobacterium
AELTPDHWLAAVVRDEMERVGR

SEQ ID NO: 1250660 - protein, 17 aa, Mycobacterium
AEMDFDGVIKRLVDLAY

SEQ ID NO: 1250661 - protein, 23 aa, Mycobacterium
AEMDRCDAWHGGSVAAGADALVA

SEQ ID NO: 1250662 - protein, 25 aa, Mycobacterium
AEMEREGLEIPLLIGGATTSRAHTA

SEQ ID NO: 1250663 - protein, 17 aa, Mycobacterium
AEMGRVAVELGNAAQEV

SEQ ID NO: 1250664 - protein, 20 aa, Mycobacterium
AEPDLGAAFNTLINIPAGMA

SEQ ID NO: 1250665 - protein, 21 aa, Mycobacterium
AEPLLGAAIDRVYLVGDQMRA

SEQ ID NO: 1250666 - protein, 18 aa, Mycobacterium
AEPRFRPVPPPTPPPPPP

SEQ ID NO: 1250667 - protein, 18 aa, Mycobacterium
AEQALRERFGYDAWVLAY

SEQ ID NO: 1250668 - protein, 22 aa, Mycobacterium
AEQRLGDHKDIIGDSWQLMSND

SEQ ID NO: 1250669 - protein, 20 aa, Mycobacterium
AERIRKALNLSKDVKGALRV

SEQ ID NO: 1250670 - protein, 19 aa, Mycobacterium
AERLAALVLGDGIADPDAA

SEQ ID NO: 1250671 - protein, 20 aa, Mycobacterium
AERLPKVLIHHNVPGQPIHR

SEQ ID NO: 1250672 - protein, 17 aa, Mycobacterium
AERLVCRAMNWRAEREG

SEQ ID NO: 1250673 - protein, 17 aa, Mycobacterium
AERRDRITAAYPGYPSS

SEQ ID NO: 1250674 - protein, 18 aa, Mycobacterium
AESWDIDMPNQFEAAERI

SEQ ID NO: 1250675 - protein, 22 aa, Mycobacterium
AETAAALWILHPTYFGTTADIA

SEQ ID NO: 1250676 - protein, 19 aa, Mycobacterium
AETPRGGFIANMELQPEAP

SEQ ID NO: 1250677 - protein, 20 aa, Mycobacterium
AEVKAEFVVVAGDVFEHNQL

SEQ ID NO: 1250678 - protein, 23 aa, Mycobacterium
AEVMPEDLIKFGLIPEFIGRLPV

SEQ ID NO: 1250679 - protein, 18 aa, Mycobacterium
AEVRAWLEHNWKGLPKST

SEQ ID NO: 1250680 - protein, 18 aa, Mycobacterium
AEVYNRFSTMTEVRNALW

SEQ ID NO: 1250681 - protein, 17 aa, Mycobacterium
AEYRFAVTGIHTDESTL

SEQ ID NO: 1250682 - protein, 31 aa, Mycobacterium
AFASGPYFKVMLVNLAPYWILQPYVDAAFKK

SEQ ID NO: 1250683 - protein, 20 aa, Mycobacterium
AFDGLRLANRPVRRPDLTIA

SEQ ID NO: 1250684 - protein, 35 aa, Mycobacterium
AFDKTLSELGFDYVDLFLIHWPLPTLYDGDFVSTW

SEQ ID NO: 1250685 - protein, 27 aa, Mycobacterium
AFGFLRREFDALWSAIRFDEPARPAAA

SEQ ID NO: 1250686 - protein, 23 aa, Mycobacterium
AFLLNEMLVWGFTGQVISAILDV

SEQ ID NO: 1250687 - protein, 19 aa, Mycobacterium
AFLNVCRHRGAQLCTESEG

SEQ ID NO: 1250688 - protein, 18 aa, Mycobacterium
AFPTLAPDDLLAAAERLS

SEQ ID NO: 1250689 - protein, 18 aa, Mycobacterium
AFRGQCLVHRSQIMQLQG

SEQ ID NO: 1250690 - protein, 17 aa, Mycobacterium
AFSRPGVELTKRTLWSG

SEQ ID NO: 1250691 - protein, 24 aa, Mycobacterium
AFSSEVDGPVVLKTVRGGYDGRGV

SEQ ID NO: 1250692 - protein, 23 aa, Mycobacterium
AFSSWPSVCSTLRSEARKGRMLP

SEQ ID NO: 1250693 - protein, 17 aa, Mycobacterium
AFTSPALFDQRDDDGVV

SEQ ID NO: 1250694 - protein, 26 aa, Mycobacterium
AFVDSLRSQLGWRTLGVYAVNYPASG

SEQ ID NO: 1250695 - protein, 18 aa, Mycobacterium
AFVPFFPLGSAFTADNPI

SEQ ID NO: 1250696 - protein, 19 aa, Mycobacterium
AGAAIKTLWLPGPDPEPHY

SEQ ID NO: 1250697 - protein, 17 aa, Mycobacterium
AGALPQGWSPHWLRHTH

SEQ ID NO: 1250698 - protein, 25 aa, Mycobacterium
AGANWGAPFAEFPESGFDRVFDVNV

SEQ ID NO: 1250699 - protein, 31 aa, Mycobacterium
AGARLTGEVLRCPRCDAGFDVVHAGAGLGGL

SEQ ID NO: 1250700 - protein, 18 aa, Mycobacterium
AGASLAVLNHVPYPDTIT

SEQ ID NO: 1250701 - protein, 17 aa, Mycobacterium
AGAVCLYLEPIALYHTK

SEQ ID NO: 1250702 - protein, 18 aa, Mycobacterium
AGCAVLLKPSERTPLTAE

SEQ ID NO: 1250703 - protein, 23 aa, Mycobacterium
AGCHLDALMVRRALEALDPDPGT

SEQ ID NO: 1250704 - protein, 18 aa, Mycobacterium
AGDAFYWAAGHAPEAITD

SEQ ID NO: 1250705 - protein, 17 aa, Mycobacterium
AGDDRIAAFLADDDTVL

SEQ ID NO: 1250706 - protein, 20 aa, Mycobacterium
AGDESYVLLVRVGSARALED

SEQ ID NO: 1250707 - protein, 24 aa, Mycobacterium
AGDRARPEGVLDFEDIITAHDPIE

SEQ ID NO: 1250708 - protein, 19 aa, Mycobacterium
AGEADLILAKHRNGPTKTC

SEQ ID NO: 1250709 - protein, 17 aa, Mycobacterium
AGEVVRVAPRLVPHNPA

SEQ ID NO: 1250710 - protein, 18 aa, Mycobacterium
AGEWDLVVVAGLQEGLWP

SEQ ID NO: 1250711 - protein, 20 aa, Mycobacterium
AGFAARLAERTGRHRPDDGA

SEQ ID NO: 1250712 - protein, 18 aa, Mycobacterium
AGFPEEYRNRVFIADYSL

SEQ ID NO: 1250713 - protein, 22 aa, Mycobacterium
AGFRACKRCRPDASPGSPEWNV

SEQ ID NO: 1250714 - protein, 19 aa, Mycobacterium
AGGAAPWVIGEPQPAVVDL

SEQ ID NO: 1250715 - protein, 20 aa, Mycobacterium
AGGGRPVLAIARFAQFLAAA

SEQ ID NO: 1250716 - protein, 31 aa, Mycobacterium
AGGGWRMYTRSRYAPYVERLLLDGARSKLTR

SEQ ID NO: 1250717 - protein, 19 aa, Mycobacterium
AGGPRACIGQHFAMLEATL

SEQ ID NO: 1250718 - protein, 19 aa, Mycobacterium
AGGTPVRWEDETVRACFRC

SEQ ID NO: 1250719 - protein, 22 aa, Mycobacterium
AGGVISRADYVADFIEAMVAGP

SEQ ID NO: 1250720 - protein, 17 aa, Mycobacterium
AGIDCIEHGTGLTDDTI

SEQ ID NO: 1250721 - protein, 19 aa, Mycobacterium
AGLAEAMPVTGGQFRVESI

SEQ ID NO: 1250722 - protein, 19 aa, Mycobacterium
AGLDPAVMIDVFNAGSGAT

SEQ ID NO: 1250723 - protein, 17 aa, Mycobacterium
AGLIGAISLEVFGQHGA

SEQ ID NO: 1250724 - protein, 17 aa, Mycobacterium
AGLLAIKAFHDANGAPE

SEQ ID NO: 1250725 - protein, 17 aa, Mycobacterium
AGLLLELSGATIADVMT

SEQ ID NO: 1250726 - protein, 25 aa, Mycobacterium
AGLPGDLPGTIAAILERAPSCGELR

SEQ ID NO: 1250727 - protein, 22 aa, Mycobacterium
AGLRCPADLAVMGVDARPLGAV

SEQ ID NO: 1250728 - protein, 18 aa, Mycobacterium
AGLTRLKRRYVITPLSNG

SEQ ID NO: 1250729 - protein, 18 aa, Mycobacterium
AGMADAFLNGGQTLDITP

SEQ ID NO: 1250730 - protein, 19 aa, Mycobacterium
AGMAPWPGFVGRVRDAGVR

SEQ ID NO: 1250731 - protein, 17 aa, Mycobacterium
AGMIPDAVSIPVGQLPA

SEQ ID NO: 1250732 - protein, 21 aa, Mycobacterium
AGNQWKASPLQLALEMLAAHV

SEQ ID NO: 1250733 - protein, 23 aa, Mycobacterium
AGNRVEYGRALALLGATDVALID

SEQ ID NO: 1250734 - protein, 18 aa, Mycobacterium
AGPKARYITGTALPVDAG

SEQ ID NO: 1250735 - protein, 27 aa, Mycobacterium
AGPPEHLAWIGQWGIFDALRAGRDVVR

SEQ ID NO: 1250736 - protein, 18 aa, Mycobacterium
AGPRGELQGAWAAADQPR

SEQ ID NO: 1250737 - protein, 22 aa, Mycobacterium
AGPRRRAILGLKERGRTDLIAP

SEQ ID NO: 1250738 - protein, 19 aa, Mycobacterium
AGPRWRRRRVRIAEIPDTD

SEQ ID NO: 1250739 - protein, 23 aa, Mycobacterium
AGPSCTHILALLGAEVIHVESAR

SEQ ID NO: 1250740 - protein, 30 aa, Mycobacterium
AGPTCAANLKCLCRKHHLLKTFWTGEDGWR

SEQ ID NO: 1250741 - protein, 30 aa, Mycobacterium
AGPTCAANLKCLCRKHHLLKTFWTGENGWC

SEQ ID NO: 1250742 - protein, 30 aa, Mycobacterium
AGPTCAANLKCLCRKHHLLKTFWTGENGWR

SEQ ID NO: 1250743 - protein, 34 aa, Mycobacterium
AGQGCAAPTRMLLPRSRYDEGVALLKALYENMRA

SEQ ID NO: 1250744 - protein, 18 aa, Mycobacterium
AGQQCNRSLVQMATGAGK

SEQ ID NO: 1250745 - protein, 18 aa, Mycobacterium
AGQRWPRFVPAAREAGFA

SEQ ID NO: 1250746 - protein, 22 aa, Mycobacterium
AGQTARRLVMFDVDSTLVQGEV

SEQ ID NO: 1250747 - protein, 17 aa, Mycobacterium
AGRAVVLAPRLWVPDDF

SEQ ID NO: 1250748 - protein, 23 aa, Mycobacterium
AGRLRFACLPTPASLEDFDYDAA

SEQ ID NO: 1250749 - protein, 18 aa, Mycobacterium
AGRRGIVSVRELLPHVDG

SEQ ID NO: 1250750 - protein, 19 aa, Mycobacterium
AGSDRARQVISWNPSGTGT

SEQ ID NO: 1250751 - protein, 19 aa, Mycobacterium
AGSLIPLAAGASYPTTDQT

SEQ ID NO: 1250752 - protein, 25 aa, Mycobacterium
AGTEVGITFGGLLSPGGSIFNALDL

SEQ ID NO: 1250753 - protein, 21 aa, Mycobacterium
AGTGVRFTPTLAFVRDTVPDT

SEQ ID NO: 1250754 - protein, 18 aa, Mycobacterium
AGTKLVFYPFLPWPWPRV

SEQ ID NO: 1250755 - protein, 19 aa, Mycobacterium
AGTVAEWLGHVLNVITGRM

SEQ ID NO: 1250756 - protein, 21 aa, Mycobacterium
AGVDPHWEWNAGLLHLRGQME

SEQ ID NO: 1250757 - protein, 20 aa, Mycobacterium
AGVFVPRSVGVLSSDPLVDD

SEQ ID NO: 1250758 - protein, 26 aa, Mycobacterium
AGVLESWAGGWSFRHELLREVAAELA

SEQ ID NO: 1250759 - protein, 20 aa, Mycobacterium
AGVLSWGRLWEMSEDQWSAV

SEQ ID NO: 1250760 - protein, 24 aa, Mycobacterium
AGVPAPLRWGEYRPGRLADAQFGL

SEQ ID NO: 1250761 - protein, 30 aa, Mycobacterium
AGVPIGLVTDGRWWGIVWAEEGTATGSGIV

SEQ ID NO: 1250762 - protein, 17 aa, Mycobacterium
AGVRPAGVWAYEAHRVA

SEQ ID NO: 1250763 - protein, 23 aa, Mycobacterium
AGVRPRMCEAAGRVADGLAGHPL

SEQ ID NO: 1250764 - protein, 19 aa, Mycobacterium
AGVSRWVVDTGFKGDLITT

SEQ ID NO: 1250765 - protein, 19 aa, Mycobacterium
AGVTPAGLLHHFQSKEQLL

SEQ ID NO: 1250766 - protein, 24 aa, Mycobacterium
AGYEEALVRYGLQICAHWCRSGRA

SEQ ID NO: 1250767 - protein, 25 aa, Mycobacterium
AGYRGEIKVSLINLDPHAPIVIRRG

SEQ ID NO: 1250768 - protein, 19 aa, Mycobacterium
AHAEALDASADWVPQLWRD

SEQ ID NO: 1250769 - protein, 31 aa, Mycobacterium
AHGKTPAQVLLRWSIQLGNVVIARSANPDRI

SEQ ID NO: 1250770 - protein, 17 aa, Mycobacterium
AHGTDIITTRNIISNEN

SEQ ID NO: 1250771 - protein, 17 aa, Mycobacterium
AHHIAGLQVLVRSVVAG

SEQ ID NO: 1250772 - protein, 17 aa, Mycobacterium
AHHRLFSHVPWLSSQLL

SEQ ID NO: 1250773 - protein, 17 aa, Mycobacterium
AHLADLGVRPRDRVMVF

SEQ ID NO: 1250774 - protein, 18 aa, Mycobacterium
AHPVGFQWVVEAKARGTD

SEQ ID NO: 1250775 - protein, 22 aa, Mycobacterium
AHQECPDCHALTADLAAHKQWH

SEQ ID NO: 1250776 - protein, 28 aa, Mycobacterium
AHTDTRWFTCALSRLDVVRATAALPAEA

SEQ ID NO: 1250777 - protein, 31 aa, Mycobacterium
AHTEFPYVFCDATFCKVRIGAHVVSQALVVA

SEQ ID NO: 1250778 - protein, 28 aa, Mycobacterium
AHWARRTGDPLARRVAGETARFLIDDMG

SEQ ID NO: 1250779 - protein, 18 aa, Mycobacterium
AHYRCHTDHAWSHTVTIP

SEQ ID NO: 1250780 - protein, 21 aa, Mycobacterium
AIALRCQVRIDPLRRGYTDDE

SEQ ID NO: 1250781 - protein, 19 aa, Mycobacterium
AIARFRRRHLAALTPLFVQ

SEQ ID NO: 1250782 - protein, 19 aa, Mycobacterium
AICAGLAADGHRVAVLDVD

SEQ ID NO: 1250783 - protein, 21 aa, Mycobacterium
AICVPACPGAGKSRLVALLAG

SEQ ID NO: 1250784 - protein, 19 aa, Mycobacterium
AIDEAIVWPQQGRVLEVWA

SEQ ID NO: 1250785 - protein, 19 aa, Mycobacterium
AIDFAAAVAQQGSFLGYRV

SEQ ID NO: 1250786 - protein, 18 aa, Mycobacterium
AIEKIFKVKVDSVNTANR

SEQ ID NO: 1250787 - protein, 24 aa, Mycobacterium
AIEPGELVALLGPSGCGKTTTLRM

SEQ ID NO: 1250788 - protein, 24 aa, Mycobacterium
AIGECLSWADGWLPGDAAYRDLSA

SEQ ID NO: 1250789 - protein, 23 aa, Mycobacterium
AIGELALATGLRRQEFTHLLTYE

SEQ ID NO: 1250790 - protein, 17 aa, Mycobacterium
AIGRPRVPVEVNHEPFL

SEQ ID NO: 1250791 - protein, 19 aa, Mycobacterium
AIHGRVCYHPCETHCNRGQ

SEQ ID NO: 1250792 - protein, 22 aa, Mycobacterium
AIKALCPGARVYGVEPELAGDT

SEQ ID NO: 1250793 - protein, 23 aa, Mycobacterium
AILNEIREGVLLGHAQEQLNARA

SEQ ID NO: 1250794 - protein, 17 aa, Mycobacterium
AIMPMRTIGYLLGIPEE

SEQ ID NO: 1250795 - protein, 26 aa, Mycobacterium
AIPKLRQGSYFPDWLLERRKRAERAL

SEQ ID NO: 1250796 - protein, 18 aa, Mycobacterium
AIRLALAATGRRDVVAMC

SEQ ID NO: 1250797 - protein, 31 aa, Mycobacterium
AIRRLLDRISLGGAWDMVKGVFTGEADDILR

SEQ ID NO: 1250798 - protein, 34 aa, Mycobacterium
AITAHRALTVAEGWPSRLRPGALEGATVLVAGGA

SEQ ID NO: 1250799 - protein, 18 aa, Mycobacterium
AIVNVIGLPPTVTVFGTP

SEQ ID NO: 1250800 - protein, 18 aa, Mycobacterium
AIVTRLPSVFDFTPLTSS

SEQ ID NO: 1250801 - protein, 23 aa, Mycobacterium
AKAATICSLLPWPDDPAEQQELQ

SEQ ID NO: 1250802 - protein, 20 aa, Mycobacterium
AKAGDWRAVLDLLEGGGEGF

SEQ ID NO: 1250803 - protein, 24 aa, Mycobacterium
AKAVGNIEQVEWEKLAQIALAAAW

SEQ ID NO: 1250804 - protein, 18 aa, Mycobacterium
AKEAPGWTVTTGDVDGAH

SEQ ID NO: 1250805 - protein, 21 aa, Mycobacterium
AKELKRRGFRFVGPTTAYALM

SEQ ID NO: 1250806 - protein, 21 aa, Mycobacterium
AKGASRWGADMALHVSAGIGT

SEQ ID NO: 1250807 - protein, 17 aa, Mycobacterium
AKGVAFLGIDVRDNNRE

SEQ ID NO: 1250808 - protein, 17 aa, Mycobacterium
AKLPAGQIRPLLAELVV

SEQ ID NO: 1250809 - protein, 26 aa, Mycobacterium
AKLRLDELTRFFAWITDRGVTSLAAV

SEQ ID NO: 1250810 - protein, 20 aa, Mycobacterium
AKLTLTRTVEVAGTFTPVQA

SEQ ID NO: 1250811 - protein, 21 aa, Mycobacterium
AKNGPMWLLDAFRKRHAADVS

SEQ ID NO: 1250812 - protein, 25 aa, Mycobacterium
AKPTVVYCAGGYRSSVAASLLRAHG

SEQ ID NO: 1250813 - protein, 17 aa, Mycobacterium
AKPVLLQRAIGFIEENL

SEQ ID NO: 1250814 - protein, 19 aa, Mycobacterium
AKSRPSGNWFPFAASDAIR

SEQ ID NO: 1250815 - protein, 28 aa, Mycobacterium
AKTLGPRCAMTGELLAPLWEATAAAQAQ

SEQ ID NO: 1250816 - protein, 17 aa, Mycobacterium
AKVESYVALGISEGAQL

SEQ ID NO: 1250817 - protein, 20 aa, Mycobacterium
ALAAGRPGVWDPVDLLVLEE

SEQ ID NO: 1250818 - protein, 17 aa, Mycobacterium
ALACNRSAGVMGVTVSA

SEQ ID NO: 1250819 - protein, 21 aa, Mycobacterium
ALAEAALRWGPLSEARLARAI

SEQ ID NO: 1250820 - protein, 24 aa, Mycobacterium
ALAENRVDAVVGWHQAGGDLATAL

SEQ ID NO: 1250821 - protein, 22 aa, Mycobacterium
ALAEQCRRLDALGVDYEIVPGV

SEQ ID NO: 1250822 - protein, 22 aa, Mycobacterium
ALAERTAALGVRVLRYGSAGGR

SEQ ID NO: 1250823 - protein, 19 aa, Mycobacterium
ALAHAWRSSGGQVLGLAPT

SEQ ID NO: 1250824 - protein, 18 aa, Mycobacterium
ALAHRPGAVVSRTDLLGA

SEQ ID NO: 1250825 - protein, 18 aa, Mycobacterium
ALAKGTLVWHRDRLDEAQ

SEQ ID NO: 1250826 - protein, 23 aa, Mycobacterium
ALAKLCAEWPEARKELRDDLERW

SEQ ID NO: 1250827 - protein, 17 aa, Mycobacterium
ALAPLFGLEPDQLRVIA

SEQ ID NO: 1250828 - protein, 24 aa, Mycobacterium
ALASRYGCPALEATPVQTAPAAPP

SEQ ID NO: 1250829 - protein, 24 aa, Mycobacterium
ALDAELWSGAGWRVYGLGRGQLNV

SEQ ID NO: 1250830 - protein, 30 aa, Mycobacterium
ALDFMRSCSIKHGMASVIFSLEMSKSEIVM

SEQ ID NO: 1250831 - protein, 29 aa, Mycobacterium
ALDLGKRFRRVLGRTVPLATLLGGVTGAE

SEQ ID NO: 1250832 - protein, 17 aa, Mycobacterium
ALDVVKKRLEAVGLGEL

SEQ ID NO: 1250833 - protein, 24 aa, Mycobacterium
ALERAAALWPDRLAVTALPGGTNL

SEQ ID NO: 1250834 - protein, 18 aa, Mycobacterium
ALERAGVQHIVWSTLEDT

SEQ ID NO: 1250835 - protein, 26 aa, Mycobacterium
ALFAREKWTRILIPWRHESSHLHPHQ

SEQ ID NO: 1250836 - protein, 17 aa, Mycobacterium
ALFRWMKSPLMPITPQA

SEQ ID NO: 1250837 - protein, 21 aa, Mycobacterium
ALGGRRVGLALAPAGAGKTTA

SEQ ID NO: 1250838 - protein, 26 aa, Mycobacterium
ALGIRGCSVSMPFKQDVLDLVDEVEP

SEQ ID NO: 1250839 - protein, 17 aa, Mycobacterium
ALGLDPRETVVAFVGRI

SEQ ID NO: 1250840 - protein, 26 aa, Mycobacterium
ALGQMWAAGVDLDWSRLSKDKPGLIT

SEQ ID NO: 1250841 - protein, 22 aa, Mycobacterium
ALGRITCIAHHWSVADREVTDV

SEQ ID NO: 1250842 - protein, 17 aa, Mycobacterium
ALHMARRGVEVEIFTRA

SEQ ID NO: 1250843 - protein, 27 aa, Mycobacterium
ALHRVRFKVVPPFAGILDLTMGFAVAQ

SEQ ID NO: 1250844 - protein, 26 aa, Mycobacterium
ALIAHGVAVWDVLRECRRTGSLDSAV

SEQ ID NO: 1250845 - protein, 17 aa, Mycobacterium
ALKSARHATGRRKIVSI

SEQ ID NO: 1250846 - protein, 21 aa, Mycobacterium
ALLADHLDFLNGRDYRGKREL

SEQ ID NO: 1250847 - protein, 24 aa, Mycobacterium
ALLCRRSTFERVLHRIAALQDGIT

SEQ ID NO: 1250848 - protein, 18 aa, Mycobacterium
ALLDACFQAVGAHSALQA

SEQ ID NO: 1250849 - protein, 29 aa, Mycobacterium
ALLGADLFDRWKALGARFVAARPLTQLHW

SEQ ID NO: 1250850 - protein, 18 aa, Mycobacterium
ALLPAAKDHALFDEALGA

SEQ ID NO: 1250851 - protein, 18 aa, Mycobacterium
ALLPALAEYAEFIDGGDY

SEQ ID NO: 1250852 - protein, 21 aa, Mycobacterium
ALLPSLLRYQTPMWPERALTR

SEQ ID NO: 1250853 - protein, 24 aa, Mycobacterium
ALLRNLGTRIARWRRAAGADEGLI

SEQ ID NO: 1250854 - protein, 28 aa, Mycobacterium
ALMAVDDWPLLRWRMREYTHGRWGTHIV

SEQ ID NO: 1250855 - protein, 17 aa, Mycobacterium
ALMRPRSRGRLTLASAD

SEQ ID NO: 1250856 - protein, 23 aa, Mycobacterium
ALNDIRSGAALTTLAQELGGLSL

SEQ ID NO: 1250857 - protein, 28 aa, Mycobacterium
ALPELERPWLASRIELMETTDMAVVVSQ

SEQ ID NO: 1250858 - protein, 21 aa, Mycobacterium
ALRATDEFKAHVKIGLNNGLT

SEQ ID NO: 1250859 - protein, 25 aa, Mycobacterium
ALRDHPGEGLGFWTQFDTYIPAALA

SEQ ID NO: 1250860 - protein, 20 aa, Mycobacterium
ALRFYTDILGFTPKHDIPMG

SEQ ID NO: 1250861 - protein, 24 aa, Mycobacterium
ALRIRLGPVARVRYGLSEWAAAPR

SEQ ID NO: 1250862 - protein, 26 aa, Mycobacterium
ALRTRAIELLELVGLGHRIHHQPTKM

SEQ ID NO: 1250863 - protein, 29 aa, Mycobacterium
ALRYPASAGPRCRDIWLVTAGAERVRAGE

SEQ ID NO: 1250864 - protein, 21 aa, Mycobacterium
ALSGMGRLGIELDEHLNESPS

SEQ ID NO: 1250865 - protein, 32 aa, Mycobacterium
ALSPRMLRIAAEFADGVVLWMASASAIAGRIA

SEQ ID NO: 1250866 - protein, 35 aa, Mycobacterium
ALSWYLAMACFKLAVVIEGTWSRYLAGRATREAGE

SEQ ID NO: 1250867 - protein, 18 aa, Mycobacterium
ALTAAWWHGFSRFCPEIV

SEQ ID NO: 1250868 - protein, 23 aa, Mycobacterium
ALTEARIGVAPSIISLTLLPKMT

SEQ ID NO: 1250869 - protein, 33 aa, Mycobacterium
ALVCYSHGLASYLERICETWPRRQQPAYVGEFH

SEQ ID NO: 1250870 - protein, 24 aa, Mycobacterium
ALVEQCGRRSLLLPGDLAEAEQCR

SEQ ID NO: 1250871 - protein, 26 aa, Mycobacterium
ALVLHDLSWRLARFGPAQVGLEPLPA

SEQ ID NO: 1250872 - protein, 22 aa, Mycobacterium
ALVQRWIDAMPQYGPGHADLVA

SEQ ID NO: 1250873 - protein, 17 aa, Mycobacterium
ALYSPVLADPRRPANTA

SEQ ID NO: 1250874 - protein, 23 aa, Mycobacterium
ALYYRELCRPVHLTASPVGAPGV

SEQ ID NO: 1250875 - protein, 24 aa, Mycobacterium
AMAARGRGGLVIFGSGAGLAGGPN

SEQ ID NO: 1250876 - protein, 17 aa, Mycobacterium
AMAQGLDVVRIGLASTD

SEQ ID NO: 1250877 - protein, 24 aa, Mycobacterium
AMAQRPAVCRALIGELGRAARMPA

SEQ ID NO: 1250878 - protein, 22 aa, Mycobacterium
AMDRVNPVYIPRNHLVEEALTA

SEQ ID NO: 1250879 - protein, 18 aa, Mycobacterium
AMEKFDYTKGFKFSTYAT

SEQ ID NO: 1250880 - protein, 25 aa, Mycobacterium
AMIAEAGDALAVFGVNIPPTARMGS

SEQ ID NO: 1250881 - protein, 21 aa, Mycobacterium
AMIVIRLQTIVSREVAPVDSV

SEQ ID NO: 1250882 - protein, 17 aa, Mycobacterium
AMLQRLDGLDVERLTEI

SEQ ID NO: 1250883 - protein, 23 aa, Mycobacterium
AMQSAWWKMAIDTAGYGRAGAAR

SEQ ID NO: 1250884 - protein, 23 aa, Mycobacterium
AMRRGRVRPLGLDRYGVQLRVED

SEQ ID NO: 1250885 - protein, 24 aa, Mycobacterium
AMSGIARRLPGPRPEFVGNEDGRG

SEQ ID NO: 1250886 - protein, 25 aa, Mycobacterium
AMSPIRPNVIWAMDFQFDTTADGHT

SEQ ID NO: 1250887 - protein, 17 aa, Mycobacterium
AMTALRATWHGEASDAQ

SEQ ID NO: 1250888 - protein, 24 aa, Mycobacterium
AMVDQGKCLIRLVPTRWGPVATGG

SEQ ID NO: 1250889 - protein, 24 aa, Mycobacterium
ANAEAMIVGCEFDIETDVIVSWLP

SEQ ID NO: 1250890 - protein, 17 aa, Mycobacterium
ANAGITAPQAWNTITPA

SEQ ID NO: 1250891 - protein, 24 aa, Mycobacterium
ANAMGRPGLTLGLGPSHEPIVRDV

SEQ ID NO: 1250892 - protein, 23 aa, Mycobacterium
ANARARFPTLTYCESVQEACQNV

SEQ ID NO: 1250893 - protein, 36 aa, Mycobacterium
ANAYIEIHYAVSLIWERGGTVSAWLATSEGASYIPR

SEQ ID NO: 1250894 - protein, 29 aa, Mycobacterium
ANCEWYRCDTCRLLTAFSIRDVCPNSRCT

SEQ ID NO: 1250895 - protein, 18 aa, Mycobacterium
ANDLLAIGVLQALALIGD

SEQ ID NO: 1250896 - protein, 23 aa, Mycobacterium
ANELCPAMIWQLRNSAAGYRSPT

SEQ ID NO: 1250897 - protein, 25 aa, Mycobacterium
ANFAAGRLSYFLGVRGPAVVVDTAC

SEQ ID NO: 1250898 - protein, 24 aa, Mycobacterium
ANGEWLNERVVVFTEYVDTLEWIH

SEQ ID NO: 1250899 - protein, 17 aa, Mycobacterium
ANLQRVLVDLIELHLQG

SEQ ID NO: 1250900 - protein, 25 aa, Mycobacterium
ANLSRVYRRLGIRSRGELARVLNAE

SEQ ID NO: 1250901 - protein, 25 aa, Mycobacterium
ANPKNPRPVMLWGYQPLADNGQGRA

SEQ ID NO: 1250902 - protein, 20 aa, Mycobacterium
ANQQWGVWGAGAAMTPGNKN

SEQ ID NO: 1250903 - protein, 19 aa, Mycobacterium
ANQRCWMCEQRRTCTKQAH

SEQ ID NO: 1250904 - protein, 19 aa, Mycobacterium
ANRLFAGRTDLVLLHIDPA

SEQ ID NO: 1250905 - protein, 18 aa, Mycobacterium
APAEGAGPIPDLGQRQPA

SEQ ID NO: 1250906 - protein, 19 aa, Mycobacterium
APALDRMRFQEAMAALPQA

SEQ ID NO: 1250907 - protein, 27 aa, Mycobacterium
APATRPRIRLAYRLTPRRVTGATRADG

SEQ ID NO: 1250908 - protein, 17 aa, Mycobacterium
APAVCYLDEAIALESLR

SEQ ID NO: 1250909 - protein, 22 aa, Mycobacterium
APAYNSGGPWGYTPKGGTGVPT

SEQ ID NO: 1250910 - protein, 19 aa, Mycobacterium
APDHLPVVLEFAAVVAPEA

SEQ ID NO: 1250911 - protein, 21 aa, Mycobacterium
APDILLRAAAKLPDVRVLVAG

SEQ ID NO: 1250912 - protein, 19 aa, Mycobacterium
APDRNLALELVRVTEAGAM

SEQ ID NO: 1250913 - protein, 24 aa, Mycobacterium
APDSRPAALPFLSIKKITVHYRPR

SEQ ID NO: 1250914 - protein, 17 aa, Mycobacterium
APEAVAINSRQRASQTD

SEQ ID NO: 1250915 - protein, 17 aa, Mycobacterium
APEGGSCLVALRNDGGP

SEQ ID NO: 1250916 - protein, 21 aa, Mycobacterium
APEGLFGVVCDVTDNEAVDRA

SEQ ID NO: 1250917 - protein, 19 aa, Mycobacterium
APELSAWPRSPEWTGAGAV

SEQ ID NO: 1250918 - protein, 21 aa, Mycobacterium
APELVIPFLVPDGAHDYPDDT

SEQ ID NO: 1250919 - protein, 19 aa, Mycobacterium
APEPLPMPLQNILVSEAHQ

SEQ ID NO: 1250920 - protein, 18 aa, Mycobacterium
APEQHAAKGFRTCEHPET

SEQ ID NO: 1250921 - protein, 19 aa, Mycobacterium
APETLTWAQLARRTMSVAR

SEQ ID NO: 1250922 - protein, 17 aa, Mycobacterium
APGCGYSVDGTTCADSP

SEQ ID NO: 1250923 - protein, 22 aa, Mycobacterium
APGFPNLFFLYGPNTNPPGGSW

SEQ ID NO: 1250924 - protein, 19 aa, Mycobacterium
APGGVAYACSFRITEAVYF

SEQ ID NO: 1250925 - protein, 26 aa, Mycobacterium
APGLPDHGVVVLVDLGGSGSSISLAD

SEQ ID NO: 1250926 - protein, 17 aa, Mycobacterium
APGRPAAYASVGRAAAA

SEQ ID NO: 1250927 - protein, 17 aa, Mycobacterium
APGTVRATIGLQNCTAQ

SEQ ID NO: 1250928 - protein, 19 aa, Mycobacterium
APHGLTIGLVLAETLERER

SEQ ID NO: 1250929 - protein, 18 aa, Mycobacterium
APHRLEREFPELFERVAQ

SEQ ID NO: 1250930 - protein, 25 aa, Mycobacterium
APHRRLPITEFTHLLAGYERRREPL

SEQ ID NO: 1250931 - protein, 17 aa, Mycobacterium
APISREMILNFVAQHSL

SEQ ID NO: 1250932 - protein, 19 aa, Mycobacterium
APLPLQYADFGAWQTALLA

SEQ ID NO: 1250933 - protein, 19 aa, Mycobacterium
APLRIECIDISHVQGTDVV

SEQ ID NO: 1250934 - protein, 31 aa, Mycobacterium
APMPLQGIAYAFARRQLVSWMARRHGPVFRI

SEQ ID NO: 1250935 - protein, 21 aa, Mycobacterium
APMVRYPIPPMIHGATQSATW

SEQ ID NO: 1250936 - protein, 26 aa, Mycobacterium
APMYSAAEQSVWRRAFEAARPRAVWL

SEQ ID NO: 1250937 - protein, 19 aa, Mycobacterium
APNAWRLPFEREWREKTPE

SEQ ID NO: 1250938 - protein, 19 aa, Mycobacterium
APPAYAAVVERVRRAVALG

SEQ ID NO: 1250939 - protein, 25 aa, Mycobacterium
APPSITLPTVPGFPVQLPSELSMPR

SEQ ID NO: 1250940 - protein, 17 aa, Mycobacterium
APQALLLAVNPDTEPWS

SEQ ID NO: 1250941 - protein, 19 aa, Mycobacterium
APQLNDWGGGDFLSRWWAT

SEQ ID NO: 1250942 - protein, 24 aa, Mycobacterium
APRALFDMMRYRPAESAGDVAVPV

SEQ ID NO: 1250943 - protein, 23 aa, Mycobacterium
APRARTAMTAGVFGEAPDPSTDG

SEQ ID NO: 1250944 - protein, 20 aa, Mycobacterium
APRGGGPGPHYHRAMSEAFF

SEQ ID NO: 1250945 - protein, 17 aa, Mycobacterium
APRKWIFSPTRSRNSSA

SEQ ID NO: 1250946 - protein, 21 aa, Mycobacterium
APSELPSAVAQMRDIAAAHGV

SEQ ID NO: 1250947 - protein, 17 aa, Mycobacterium
APTKYPAGFFGVFTGSY

SEQ ID NO: 1250948 - protein, 17 aa, Mycobacterium
APTPAKLWILTRNAQPI

SEQ ID NO: 1250949 - protein, 22 aa, Mycobacterium
APVAATVCRKAFERGVLMETSG

SEQ ID NO: 1250950 - protein, 17 aa, Mycobacterium
APVELEFTETHRAITET

SEQ ID NO: 1250951 - protein, 19 aa, Mycobacterium
APVEPGYRILDGLRAAQQC

SEQ ID NO: 1250952 - protein, 20 aa, Mycobacterium
APVLHELRRPLAGVMSTLLT

SEQ ID NO: 1250953 - protein, 26 aa, Mycobacterium
APVPTGWKVPKAWLDSGVVKEAHSWD

SEQ ID NO: 1250954 - protein, 25 aa, Mycobacterium
APVPVEVEAALPLGSTDMGNVTQVV

SEQ ID NO: 1250955 - protein, 17 aa, Mycobacterium
APYLWSDLLARRNALSL

SEQ ID NO: 1250956 - protein, 17 aa, Mycobacterium
AQAALLRYQEAAQAQIQ

SEQ ID NO: 1250957 - protein, 24 aa, Mycobacterium
AQAARLGSGLGFPGTPYLHAYTRS

SEQ ID NO: 1250958 - protein, 24 aa, Mycobacterium
AQAFPHVYCELDFTNPLELAVATI

SEQ ID NO: 1250959 - protein, 26 aa, Mycobacterium
AQAQSGSIGLGFAIPVDQAKRIADEL

SEQ ID NO: 1250960 - protein, 18 aa, Mycobacterium
AQARAFLDNGDFDAALSA

SEQ ID NO: 1250961 - protein, 40 aa, Mycobacterium
AQARFPELSTWRCNLRELREWPPEIADLAQSARDAAATHT

SEQ ID NO: 1250962 - protein, 19 aa, Mycobacterium
AQARLMAHAAFGLLNSTPH

SEQ ID NO: 1250963 - protein, 21 aa, Mycobacterium
AQDYDRWLGVLTEDIHYYMPV

SEQ ID NO: 1250964 - protein, 17 aa, Mycobacterium
AQGRRVAAGVTDFLAGQ

SEQ ID NO: 1250965 - protein, 18 aa, Mycobacterium
AQIRWANPIGDRYMALLD

SEQ ID NO: 1250966 - protein, 24 aa, Mycobacterium
AQLRDLMDLHFFGPAALVRAALPI

SEQ ID NO: 1250967 - protein, 21 aa, Mycobacterium
AQLVPRTDTAAGILYTAAQRQ

SEQ ID NO: 1250968 - protein, 18 aa, Mycobacterium
AQMFPRPIGMVIGLEVSG

SEQ ID NO: 1250969 - protein, 26 aa, Mycobacterium
AQPFSGFRPGQYVSVGVTLPDGARQL

SEQ ID NO: 1250970 - protein, 17 aa, Mycobacterium
AQRAVVVGHDWGSPVVT

SEQ ID NO: 1250971 - protein, 17 aa, Mycobacterium
AQREVWTGTELRRLLSE

SEQ ID NO: 1250972 - protein, 24 aa, Mycobacterium
AQRGRLPGHPSYFLKPPTSLALSG

SEQ ID NO: 1250973 - protein, 20 aa, Mycobacterium
AQRLADLGARRLVLVSRSGI

SEQ ID NO: 1250974 - protein, 17 aa, Mycobacterium
AQRLALFAREKWTRILI

SEQ ID NO: 1250975 - protein, 17 aa, Mycobacterium
AQRPAVFIFNHRNQADP

SEQ ID NO: 1250976 - protein, 18 aa, Mycobacterium
AQRPAVFIFNHRNQADPL

SEQ ID NO: 1250977 - protein, 19 aa, Mycobacterium
AQRPELWNIYNGRHRKGEH

SEQ ID NO: 1250978 - protein, 25 aa, Mycobacterium
AQSAVKPWLVTVAKLLGRIAPGVPV

SEQ ID NO: 1250979 - protein, 25 aa, Mycobacterium
AQSYGRIRAGLIARGVPAEQIRFVH

SEQ ID NO: 1250980 - protein, 17 aa, Mycobacterium
AQVAAAWHTDALPDGPG

SEQ ID NO: 1250981 - protein, 22 aa, Mycobacterium
AQVELPSGVTLISDPETLVVNI

SEQ ID NO: 1250982 - protein, 21 aa, Mycobacterium
AQWSGRLAAYLARGRGNDDPD

SEQ ID NO: 1250983 - protein, 30 aa, Mycobacterium
ARAALIRTGYDWIRAWCEVFTETELLQGVT

SEQ ID NO: 1250984 - protein, 18 aa, Mycobacterium
ARAAQVFRLEEQPTVERE

SEQ ID NO: 1250985 - protein, 17 aa, Mycobacterium
ARAARPLFDQLRTQIID

SEQ ID NO: 1250986 - protein, 28 aa, Mycobacterium
ARAGKLGVPCRWPADAVTVCSFGDASVN

SEQ ID NO: 1250987 - protein, 17 aa, Mycobacterium
ARAHLRRKFLSAKVAVS

SEQ ID NO: 1250988 - protein, 17 aa, Mycobacterium
ARAPQALLLAVNPDTEP

SEQ ID NO: 1250989 - protein, 24 aa, Mycobacterium
ARARAQGLSNIWCRVMNGQDLDLA

SEQ ID NO: 1250990 - protein, 19 aa, Mycobacterium
ARCRALLLAARGDLTAAVR

SEQ ID NO: 1250991 - protein, 25 aa, Mycobacterium
ARDAGLRLTARMVFEQPTLQDLAAA

SEQ ID NO: 1250992 - protein, 30 aa, Mycobacterium
ARDRGCTRPGCTAPGYWCQAHHASADFVDG

SEQ ID NO: 1250993 - protein, 21 aa, Mycobacterium
ARDWSEQFVIGGRTTFVEEAA

SEQ ID NO: 1250994 - protein, 20 aa, Mycobacterium
ARERADYVGALWQANTGAPG

SEQ ID NO: 1250995 - protein, 17 aa, Mycobacterium
ARFALNALIAQDVPLNY

SEQ ID NO: 1250996 - protein, 31 aa, Mycobacterium
ARGAKGRAKVLARYAVWLGEHRAEIEDLLIK

SEQ ID NO: 1250997 - protein, 34 aa, Mycobacterium
ARGKKLTFELARFVKFMITEIFPGGRIPTTQMMV

SEQ ID NO: 1250998 - protein, 26 aa, Mycobacterium
ARHALARAAFQLGVLERALELTATYA

SEQ ID NO: 1250999 - protein, 19 aa, Mycobacterium
ARHARIYPLPSRSVGENGE

SEQ ID NO: 1251000 - protein, 18 aa, Mycobacterium
ARHPGVRGLRQLRETLAL

SEQ ID NO: 1251001 - protein, 22 aa, Mycobacterium
ARIFPKGLGMLLQRRDRTCRTP

SEQ ID NO: 1251002 - protein, 28 aa, Mycobacterium
ARIRSIGLRLGVPWYAYDTITFTGEVTA

SEQ ID NO: 1251003 - protein, 17 aa, Mycobacterium
ARKIRRATRGCTLDPKL

SEQ ID NO: 1251004 - protein, 31 aa, Mycobacterium
ARLDSEPGRPLWPMIILRTPKGWTGPREVDG

SEQ ID NO: 1251005 - protein, 19 aa, Mycobacterium
ARLLAARGRDHGVDVVDAP

SEQ ID NO: 1251006 - protein, 19 aa, Mycobacterium
ARLLAAVTLAAFPSASTVA

SEQ ID NO: 1251007 - protein, 20 aa, Mycobacterium
ARLMSLAAMMTIKPTLTIGS

SEQ ID NO: 1251008 - protein, 23 aa, Mycobacterium
ARLPCAYLNPGRYIAGRPLVKGM

SEQ ID NO: 1251009 - protein, 17 aa, Mycobacterium
ARLRDWLVTYLTTHVEC

SEQ ID NO: 1251010 - protein, 22 aa, Mycobacterium
ARLSALARNAADLGVVADTAHL

SEQ ID NO: 1251011 - protein, 21 aa, Mycobacterium
ARLYFATAVRLCRVRHVGMTM

SEQ ID NO: 1251012 - protein, 22 aa, Mycobacterium
ARNEGVLGWLHSVARSHVEVAL

SEQ ID NO: 1251013 - protein, 18 aa, Mycobacterium
ARNGFAPTADRREPIRWR

SEQ ID NO: 1251014 - protein, 20 aa, Mycobacterium
ARPDLDFHWVTVDFEPIIAL

SEQ ID NO: 1251015 - protein, 22 aa, Mycobacterium
ARPEGFKEWHHFVVHGPDQRLL

SEQ ID NO: 1251016 - protein, 18 aa, Mycobacterium
ARPPRWPAGDVRGDILAL

SEQ ID NO: 1251017 - protein, 23 aa, Mycobacterium
ARPSRFCPRMLHIAVSQPLVAAL

SEQ ID NO: 1251018 - protein, 23 aa, Mycobacterium
ARQGMLRLVDRYGADVVTTVMTT

SEQ ID NO: 1251019 - protein, 17 aa, Mycobacterium
ARQPYYRWRAHPVTDAE

SEQ ID NO: 1251020 - protein, 23 aa, Mycobacterium
ARQRPGLLVDWLAGNPADLDDDL

SEQ ID NO: 1251021 - protein, 18 aa, Mycobacterium
ARQSPGFLGYRDHHDSPP

SEQ ID NO: 1251022 - protein, 18 aa, Mycobacterium
ARQVISWNPSGTGTTNGR

SEQ ID NO: 1251023 - protein, 19 aa, Mycobacterium
ARRTPTFAGTIWLQQGSAP

SEQ ID NO: 1251024 - protein, 27 aa, Mycobacterium
ARSALAREFLPEFGLSTECGLGRHSTE

SEQ ID NO: 1251025 - protein, 18 aa, Mycobacterium
ARSGVNWQATEDFSETIG

SEQ ID NO: 1251026 - protein, 20 aa, Mycobacterium
ARSVEFSWRQSASAMREVFD

SEQ ID NO: 1251027 - protein, 26 aa, Mycobacterium
ARSWTTEIAPPWARPLIAANANPTLT

SEQ ID NO: 1251028 - protein, 17 aa, Mycobacterium
ARTAIGLVDPGAESPKE

SEQ ID NO: 1251029 - protein, 18 aa, Mycobacterium
ARTGEFRQRPLVLMRSID

SEQ ID NO: 1251030 - protein, 21 aa, Mycobacterium
ARTGTRVVIFAGRVGADASVL

SEQ ID NO: 1251031 - protein, 20 aa, Mycobacterium
ARTLFGFPVVQAVGSALPLA

SEQ ID NO: 1251032 - protein, 24 aa, Mycobacterium
ARTRFCVWSPPWLGWLSTGCESPL

SEQ ID NO: 1251033 - protein, 21 aa, Mycobacterium
ARTRRCVLFFDELDTIAKERS

SEQ ID NO: 1251034 - protein, 20 aa, Mycobacterium
ARTTFPVWQMNAIGDLTLHR

SEQ ID NO: 1251035 - protein, 17 aa, Mycobacterium
ARVAWTGAGVDLRTGTP

SEQ ID NO: 1251036 - protein, 18 aa, Mycobacterium
ARVDLPWQHVRARTAEKA

SEQ ID NO: 1251037 - protein, 19 aa, Mycobacterium
ARVFPHMRQIVVSHQRRGH

SEQ ID NO: 1251038 - protein, 22 aa, Mycobacterium
ARVGKSALYRRWPSKVEMTADL

SEQ ID NO: 1251039 - protein, 17 aa, Mycobacterium
ARVGNVLYRDFRPVAVL

SEQ ID NO: 1251040 - protein, 18 aa, Mycobacterium
ARVLGRMAATPSTHTLRV

SEQ ID NO: 1251041 - protein, 18 aa, Mycobacterium
ARVRIRLLRELAATGESL

SEQ ID NO: 1251042 - protein, 20 aa, Mycobacterium
ARVSVRAVVHRHYLEVLRPL

SEQ ID NO: 1251043 - protein, 18 aa, Mycobacterium
ARVTVRMLLTHTSGEEPD

SEQ ID NO: 1251044 - protein, 24 aa, Mycobacterium
ARYFLSTRLTHRMLVNNIRRTITE

SEQ ID NO: 1251045 - protein, 25 aa, Mycobacterium
ASAELGWERVIGALAERYHVLAPDM

SEQ ID NO: 1251046 - protein, 23 aa, Mycobacterium
ASAELLIMPSLYEGAGLPPLEAM

SEQ ID NO: 1251047 - protein, 23 aa, Mycobacterium
ASAEQPLGLGMLFYEDGNWNITT

SEQ ID NO: 1251048 - protein, 24 aa, Mycobacterium
ASALDRAALPYVVGTIAGDDTIMV

SEQ ID NO: 1251049 - protein, 18 aa, Mycobacterium
ASAMPVSRYRSFAEEVEP

SEQ ID NO: 1251050 - protein, 24 aa, Mycobacterium
ASAPTYRYEFGWRSTGVGGELGAA

SEQ ID NO: 1251051 - protein, 20 aa, Mycobacterium
ASARSVARWTSGQVVPQRLN

SEQ ID NO: 1251052 - protein, 22 aa, Mycobacterium
ASCAVPGVWPPVTIGPRRFMDG

SEQ ID NO: 1251053 - protein, 18 aa, Mycobacterium
ASCRRRRTVAVLGGGIAG

SEQ ID NO: 1251054 - protein, 18 aa, Mycobacterium
ASDLDAMVQIVDRDATIM

SEQ ID NO: 1251055 - protein, 17 aa, Mycobacterium
ASDLSLAVVRLARQLRF

SEQ ID NO: 1251056 - protein, 19 aa, Mycobacterium
ASEFYSRSGSISMAAMANS

SEQ ID NO: 1251057 - protein, 28 aa, Mycobacterium
ASEVWAEIWPDIGPRIESVLSTGRATWD

SEQ ID NO: 1251058 - protein, 24 aa, Mycobacterium
ASGMKVGIVASTWHSTICDALLDG

SEQ ID NO: 1251059 - protein, 22 aa, Mycobacterium
ASGPTPGFGMWVKIRAADGTVT

SEQ ID NO: 1251060 - protein, 25 aa, Mycobacterium
ASHRYREHFGFGFVMYVNGYCAQDV

SEQ ID NO: 1251061 - protein, 19 aa, Mycobacterium
ASKVARTTLYRHFQSSSHL

SEQ ID NO: 1251062 - protein, 19 aa, Mycobacterium
ASLAEAFASGPYFKVMLVN

SEQ ID NO: 1251063 - protein, 17 aa, Mycobacterium
ASLIGDFGAQVIKIEDP

SEQ ID NO: 1251064 - protein, 17 aa, Mycobacterium
ASMAATFAGDAAIAAGW

SEQ ID NO: 1251065 - protein, 17 aa, Mycobacterium
ASMRMLGGYFRFERENA

SEQ ID NO: 1251066 - protein, 19 aa, Mycobacterium
ASNRFGWTAYLGHPPDTSE

SEQ ID NO: 1251067 - protein, 32 aa, Mycobacterium
ASPADYIYAYGFRNPFRLTFTPDGKLLVADVG

SEQ ID NO: 1251068 - protein, 17 aa, Mycobacterium
ASPLQLALEMLAAHVQP

SEQ ID NO: 1251069 - protein, 20 aa, Mycobacterium
ASQLLPALCVALGEHSPTGA

SEQ ID NO: 1251070 - protein, 25 aa, Mycobacterium
ASQWKRYGHSNAYMRWVHRNDDVSK

SEQ ID NO: 1251071 - protein, 37 aa, Mycobacterium
ASRHWLFRHVPFYRAWFRFRLYWIYTERNYPALRVDP

SEQ ID NO: 1251072 - protein, 22 aa, Mycobacterium
ASRIESRYFVKLVTGQTAKNMI

SEQ ID NO: 1251073 - protein, 22 aa, Mycobacterium
ASSEPRPSGAGTRVLYVSPLKA

SEQ ID NO: 1251074 - protein, 27 aa, Mycobacterium
ASTDPVSWIGMPGDLPAEVLNRTLGYP

SEQ ID NO: 1251075 - protein, 18 aa, Mycobacterium
ASVDKFDSGSGWPSFTRP

SEQ ID NO: 1251076 - protein, 18 aa, Mycobacterium
ASVPGCIPFDRTTDPEPL

SEQ ID NO: 1251077 - protein, 25 aa, Mycobacterium
ASYMPRARRAVDEISVFARAAIDAA

SEQ ID NO: 1251078 - protein, 17 aa, Mycobacterium
ATAAECRKELKKVRDRI

SEQ ID NO: 1251079 - protein, 17 aa, Mycobacterium
ATAFPYGPYYGDRITRG

SEQ ID NO: 1251080 - protein, 17 aa, Mycobacterium
ATAHACLQHLSQFDTGG

SEQ ID NO: 1251081 - protein, 18 aa, Mycobacterium
ATALLYHACFAPRVAEVL

SEQ ID NO: 1251082 - protein, 28 aa, Mycobacterium
ATALTEIGRRGTISPALATVGLGLVPLL

SEQ ID NO: 1251083 - protein, 18 aa, Mycobacterium
ATDERFLALGGWKDKDEV

SEQ ID NO: 1251084 - protein, 24 aa, Mycobacterium
ATDFSRPLARVVLDNAPVVTLDVT

SEQ ID NO: 1251085 - protein, 19 aa, Mycobacterium
ATDLCEFMEFPSGILQVCG

SEQ ID NO: 1251086 - protein, 21 aa, Mycobacterium
ATDWCGRWIVAGPDVDAAALA

SEQ ID NO: 1251087 - protein, 23 aa, Mycobacterium
ATELSLATAEWVAFYNRQRPNGY

SEQ ID NO: 1251088 - protein, 20 aa, Mycobacterium
ATENYLRWVSDTDRTPPKPD

SEQ ID NO: 1251089 - protein, 19 aa, Mycobacterium
ATGAICRPGAGPMSLTGQP

SEQ ID NO: 1251090 - protein, 25 aa, Mycobacterium
ATGARSIPALVAWKLGLSSKNAKTI

SEQ ID NO: 1251091 - protein, 23 aa, Mycobacterium
ATGRRRIAFVSGPTELRQVRDRL

SEQ ID NO: 1251092 - protein, 17 aa, Mycobacterium
ATGVGKLAQAVWVYEHP

SEQ ID NO: 1251093 - protein, 21 aa, Mycobacterium
ATHRAKAGAAVARMQDRGETL

SEQ ID NO: 1251094 - protein, 23 aa, Mycobacterium
ATKCADIATVLRDTRAGQEQLIR

SEQ ID NO: 1251095 - protein, 17 aa, Mycobacterium
ATLAFPRYHRSVTADLA

SEQ ID NO: 1251096 - protein, 18 aa, Mycobacterium
ATLAGWLGPDRVIGASTI

SEQ ID NO: 1251097 - protein, 24 aa, Mycobacterium
ATLEEMRHASGLMSVLEDLSRGLE

SEQ ID NO: 1251098 - protein, 35 aa, Mycobacterium
ATLLIDRSASWMFDYYPLRVVRELPDGACEAAMTY

SEQ ID NO: 1251099 - protein, 25 aa, Mycobacterium
ATLSAWCKAAGVPIRHRKPASTSVA

SEQ ID NO: 1251100 - protein, 17 aa, Mycobacterium
ATLWELMDVQERTGIEL

SEQ ID NO: 1251101 - protein, 24 aa, Mycobacterium
ATPEWRLTGEQLLALRSGSTTLTQ

SEQ ID NO: 1251102 - protein, 25 aa, Mycobacterium
ATPLIVDFAHIWRDMPKVVFSRTLE

SEQ ID NO: 1251103 - protein, 18 aa, Mycobacterium
ATPLRDAWVPDADLRGVR

SEQ ID NO: 1251104 - protein, 22 aa, Mycobacterium
ATQWRNLGNGLSIFDDAVSPVR

SEQ ID NO: 1251105 - protein, 39 aa, Mycobacterium
ATRFPGGMYRNKCWLPYPGDDVLLCLGIHGQMIYVNRPA

SEQ ID NO: 1251106 - protein, 18 aa, Mycobacterium
ATRLCAQFIAGEEAVTQD

SEQ ID NO: 1251107 - protein, 27 aa, Mycobacterium
ATRTPRPPSGWLRMGGISSHNLRDLDV

SEQ ID NO: 1251108 - protein, 21 aa, Mycobacterium
ATSLHYGFRFKEALSAAYTAV

SEQ ID NO: 1251109 - protein, 23 aa, Mycobacterium
ATSLKRLLADRLRISDKTAGERL

SEQ ID NO: 1251110 - protein, 25 aa, Mycobacterium
ATSLQLTADMGRNFLTKLGILSPAT

SEQ ID NO: 1251111 - protein, 26 aa, Mycobacterium
ATTDWRRLTVTLAWLSPVNTATRRHR

SEQ ID NO: 1251112 - protein, 25 aa, Mycobacterium
ATTGRGLEQWYGWIEFLANPSKNPV

SEQ ID NO: 1251113 - protein, 18 aa, Mycobacterium
ATVARFVKGGARVVTSGR

SEQ ID NO: 1251114 - protein, 29 aa, Mycobacterium
ATVEPGARLNIPWNRDFNALVYVLSGRGA

SEQ ID NO: 1251115 - protein, 19 aa, Mycobacterium
ATVSFPYLDAALLVMGITP

SEQ ID NO: 1251116 - protein, 26 aa, Mycobacterium
ATVWHQACWKVAGAPMDYRGASAPAP

SEQ ID NO: 1251117 - protein, 25 aa, Mycobacterium
ATYDRLRETPLQWPVPPDDGTDRHP

SEQ ID NO: 1251118 - protein, 18 aa, Mycobacterium
AVAARRACEIVSAMLDRL

SEQ ID NO: 1251119 - protein, 25 aa, Mycobacterium
AVADIRLRWAESMADAAREIRSGRP

SEQ ID NO: 1251120 - protein, 17 aa, Mycobacterium
AVALRPVQTVAAPTEEL

SEQ ID NO: 1251121 - protein, 17 aa, Mycobacterium
AVDPVWIDGEFAPRLAG

SEQ ID NO: 1251122 - protein, 24 aa, Mycobacterium
AVEICPACHFILPDDWRNGHAVCI

SEQ ID NO: 1251123 - protein, 25 aa, Mycobacterium
AVEPRLWNMWTVLPILQDTTIVAAG

SEQ ID NO: 1251124 - protein, 25 aa, Mycobacterium
AVETARKGLWYDNARQDLWQIGMQA

SEQ ID NO: 1251125 - protein, 24 aa, Mycobacterium
AVGCAPGHPMLRVDRLYSDDADRP

SEQ ID NO: 1251126 - protein, 26 aa, Mycobacterium
AVGHAAIQLARWAGARVITTVSTSEK

SEQ ID NO: 1251127 - protein, 19 aa, Mycobacterium
AVGLADHRSEFGANLSGGQ

SEQ ID NO: 1251128 - protein, 17 aa, Mycobacterium
AVGLQWGLVSRRYGELT

SEQ ID NO: 1251129 - protein, 17 aa, Mycobacterium
AVGPSRHLVKFVACDGA

SEQ ID NO: 1251130 - protein, 18 aa, Mycobacterium
AVGSLVWGPLRGVLPGRP

SEQ ID NO: 1251131 - protein, 19 aa, Mycobacterium
AVGVVAGLARRQARLEAKA

SEQ ID NO: 1251132 - protein, 17 aa, Mycobacterium
AVHVALWQSGELVAGAV

SEQ ID NO: 1251133 - protein, 17 aa, Mycobacterium
AVIGDAYVDKALNEADD

SEQ ID NO: 1251134 - protein, 18 aa, Mycobacterium
AVIGWRFHHAVADLVVRL

SEQ ID NO: 1251135 - protein, 19 aa, Mycobacterium
AVIMWMGYDAPDGFTDPRI

SEQ ID NO: 1251136 - protein, 26 aa, Mycobacterium
AVIVCPANLASKWVDDFSRLLGGGLR

SEQ ID NO: 1251137 - protein, 19 aa, Mycobacterium
AVKHNGWGVPGLSWTPGED

SEQ ID NO: 1251138 - protein, 31 aa, Mycobacterium
AVLDIPGVVVGGVLNGFGFDGGLLTPESGTV

SEQ ID NO: 1251139 - protein, 31 aa, Mycobacterium
AVLGHARGAAPDRGWEIHRLPVDAGDEKGRT

SEQ ID NO: 1251140 - protein, 25 aa, Mycobacterium
AVLGVFCRRWGVPLIDGGTVRLPRL

SEQ ID NO: 1251141 - protein, 25 aa, Mycobacterium
AVLPPADRAEPAWRSRPRSPGERRM

SEQ ID NO: 1251142 - protein, 22 aa, Mycobacterium
AVLRRAIDLGIDHIDTAQIYGP

SEQ ID NO: 1251143 - protein, 25 aa, Mycobacterium
AVLRSRLDGLIAQWKRDHGDTDDTS

SEQ ID NO: 1251144 - protein, 21 aa, Mycobacterium
AVNDLRPGWVTALDLPLIAGA

SEQ ID NO: 1251145 - protein, 17 aa, Mycobacterium
AVPAEVLESLGAAVRLI

SEQ ID NO: 1251146 - protein, 23 aa, Mycobacterium
AVPPRRFGALIIDVAAREVHIDD

SEQ ID NO: 1251147 - protein, 18 aa, Mycobacterium
AVRPEVVVLLGATAAKAL

SEQ ID NO: 1251148 - protein, 19 aa, Mycobacterium
AVRPLSRVRIWDGSTPWLI

SEQ ID NO: 1251149 - protein, 21 aa, Mycobacterium
AVRRLLDKHLHGVGHALLASI

SEQ ID NO: 1251150 - protein, 18 aa, Mycobacterium
AVRSRRALDTTIVRPGRL

SEQ ID NO: 1251151 - protein, 24 aa, Mycobacterium
AVRYGGNPKRAFAVAERRTAHVRH

SEQ ID NO: 1251152 - protein, 18 aa, Mycobacterium
AVSWDELTDLLAAELRRV

SEQ ID NO: 1251153 - protein, 17 aa, Mycobacterium
AVTPEKQFTLFFDDVRV

SEQ ID NO: 1251154 - protein, 17 aa, Mycobacterium
AVTPTPRQSACPAPAFV

SEQ ID NO: 1251155 - protein, 24 aa, Mycobacterium
AVTRAKGAWLWSGRDAVAVGLSAS

SEQ ID NO: 1251156 - protein, 20 aa, Mycobacterium
AVTSLQDWVRPHLEELLGDE

SEQ ID NO: 1251157 - protein, 25 aa, Mycobacterium
AVVEVARSSFYAWLAAADGRAARRA

SEQ ID NO: 1251158 - protein, 24 aa, Mycobacterium
AVVLNELVLRAGIEPDVVDDVIWG

SEQ ID NO: 1251159 - protein, 17 aa, Mycobacterium
AVVRIGGAGHSAAIHSE

SEQ ID NO: 1251160 - protein, 22 aa, Mycobacterium
AVYTKGRLPLRVRELARVVIAN

SEQ ID NO: 1251161 - protein, 24 aa, Mycobacterium
AWAEREAPLGMARGEFNEFSNSLF

SEQ ID NO: 1251162 - protein, 26 aa, Mycobacterium
AWASADWRLRRGRIVLLDGDSPAGLR

SEQ ID NO: 1251163 - protein, 20 aa, Mycobacterium
AWDPEFSVRLAAAGFLGLTI

SEQ ID NO: 1251164 - protein, 17 aa, Mycobacterium
AWGLPTGATEEWAGGTA

SEQ ID NO: 1251165 - protein, 19 aa, Mycobacterium
AWLDSWRALGPDGAAMDRV

SEQ ID NO: 1251166 - protein, 19 aa, Mycobacterium
AWLEHNWKGLPKSTDPWVA

SEQ ID NO: 1251167 - protein, 18 aa, Mycobacterium
AWLTARHALARAAFQLGV

SEQ ID NO: 1251168 - protein, 20 aa, Mycobacterium
AWNPEFLREGFAVKDTLHPD

SEQ ID NO: 1251169 - protein, 21 aa, Mycobacterium
AWPRSPEWTGAGAVATPAAPT

SEQ ID NO: 1251170 - protein, 18 aa, Mycobacterium
AWPSAAGDYFTVRAGSLV

SEQ ID NO: 1251171 - protein, 20 aa, Mycobacterium
AWSGPRLEYNYRLEMKSGPT

SEQ ID NO: 1251172 - protein, 23 aa, Mycobacterium
AWVLCGAIAHNLLRAAGVLAGGA

SEQ ID NO: 1251173 - protein, 19 aa, Mycobacterium
AYAALLRRALRAGGITADN

SEQ ID NO: 1251174 - protein, 18 aa, Mycobacterium
AYAARAGITCAVLIPQGK

SEQ ID NO: 1251175 - protein, 22 aa, Mycobacterium
AYAEGLRALYLYTATFQDTAVA

SEQ ID NO: 1251176 - protein, 27 aa, Mycobacterium
AYAGHQFGGFAPRLGDGRALLLGELVD

SEQ ID NO: 1251177 - protein, 19 aa, Mycobacterium
AYAPYGIRVNALAPGPVDT

SEQ ID NO: 1251178 - protein, 20 aa, Mycobacterium
AYFTRIGYRGAGDPTLATLR

SEQ ID NO: 1251179 - protein, 18 aa, Mycobacterium
AYGSAGFAVLERTIVELR

SEQ ID NO: 1251180 - protein, 24 aa, Mycobacterium
AYLAGFAWGLGRGYTVLVEMDADG

SEQ ID NO: 1251181 - protein, 21 aa, Mycobacterium
AYLCGPAPFMAAVQAALAEAG

SEQ ID NO: 1251182 - protein, 18 aa, Mycobacterium
AYRTGDLSLMLRAMTERL

SEQ ID NO: 1251183 - protein, 25 aa, Mycobacterium
AYRTYGGLLARREFEPAGFSATGGL

SEQ ID NO: 1251184 - protein, 21 aa, Mycobacterium
AYTAGRLQVQFEVDAATLDDA

SEQ ID NO: 1251185 - protein, 26 aa, Mycobacterium
AYTNYRPVPLYGYRAKDVNGDYEKVV

SEQ ID NO: 1251186 - protein, 17 aa, Mycobacterium
AYVKLVIVPDGVDVSAL

SEQ ID NO: 1251187 - protein, 20 aa, Mycobacterium
AYVPGYRLKQEVQFTQLDDA

SEQ ID NO: 1251188 - protein, 25 aa, Mycobacterium
AYVPSRPQLEWQIRRRTMAISNVTV

SEQ ID NO: 1251189 - protein, 19 aa, Mycobacterium
AYYGLPMAKCRYEDLGDGA

SEQ ID NO: 1251190 - protein, 17 aa, Mycobacterium
CAAEHSLGQAIGGLSGA

SEQ ID NO: 1251191 - protein, 19 aa, Mycobacterium
CADPRPLGYDDSTTFCADL

SEQ ID NO: 1251192 - protein, 20 aa, Mycobacterium
CAETSVLLAMRPDLVHLDRM

SEQ ID NO: 1251193 - protein, 22 aa, Mycobacterium
CAFIEARPGLLHAYPDTDEAAG

SEQ ID NO: 1251194 - protein, 20 aa, Mycobacterium
CANAGIFPSGRLEELTPEDI

SEQ ID NO: 1251195 - protein, 20 aa, Mycobacterium
CASMPTPFVAVGESYWDFRQ

SEQ ID NO: 1251196 - protein, 17 aa, Mycobacterium
CAVRGPGCQDCVVSVLL

SEQ ID NO: 1251197 - protein, 18 aa, Mycobacterium
CDAFDKFPPFPFNVVFAM

SEQ ID NO: 1251198 - protein, 22 aa, Mycobacterium
CDKGNACLGCGHFATDTTHLDE

SEQ ID NO: 1251199 - protein, 33 aa, Mycobacterium
CDVAGRPGACWPLADIPLDWVLDGAVRAGVRLR

SEQ ID NO: 1251200 - protein, 18 aa, Mycobacterium
CEMENFLFEEAELLNDGR

SEQ ID NO: 1251201 - protein, 23 aa, Mycobacterium
CESVRCVDHNLLPGVEADMGPGD

SEQ ID NO: 1251202 - protein, 21 aa, Mycobacterium
CEWKGRAAYYDVVFGERVAPR

SEQ ID NO: 1251203 - protein, 21 aa, Mycobacterium
CGAEWPMSRLTLALSPATLPK

SEQ ID NO: 1251204 - protein, 26 aa, Mycobacterium
CGALSEWRATLIVRESACLSVEDRRM

SEQ ID NO: 1251205 - protein, 20 aa, Mycobacterium
CGDCGVKSNCLSVQPVDTEY

SEQ ID NO: 1251206 - protein, 18 aa, Mycobacterium
CGILVLKRLSDAVRDGDR

SEQ ID NO: 1251207 - protein, 21 aa, Mycobacterium
CGLAQLWPRLNEDLDARAAVI

SEQ ID NO: 1251208 - protein, 18 aa, Mycobacterium
CGPMGRMVFDQRLAAPVR

SEQ ID NO: 1251209 - protein, 24 aa, Mycobacterium
CGPRRMRGTAIGWAAARQSGVPAV

SEQ ID NO: 1251210 - protein, 20 aa, Mycobacterium
CGVETSCYGCLRSFRNARFH

SEQ ID NO: 1251211 - protein, 17 aa, Mycobacterium
CGVLAVKASWGRYETFR

SEQ ID NO: 1251212 - protein, 26 aa, Mycobacterium
CHHHRCFPVLAGGPGDRDLMLISPII

SEQ ID NO: 1251213 - protein, 18 aa, Mycobacterium
CLATATAVMQLYEQGKVQ

SEQ ID NO: 1251214 - protein, 20 aa, Mycobacterium
CLDGDCPSFVTVEVRPDAMR

SEQ ID NO: 1251215 - protein, 19 aa, Mycobacterium
CLGATFAMVEMRVVLREIL

SEQ ID NO: 1251216 - protein, 27 aa, Mycobacterium
CLTVAGSLRASRQWGLPHEVLDADEIR

SEQ ID NO: 1251217 - protein, 18 aa, Mycobacterium
CNCQPRIVVAENIQSTGY

SEQ ID NO: 1251218 - protein, 20 aa, Mycobacterium
CPAGLSVKWQNEMHDKFGLD

SEQ ID NO: 1251219 - protein, 20 aa, Mycobacterium
CPDATLGLLGRYGAAVGEAF

SEQ ID NO: 1251220 - protein, 25 aa, Mycobacterium
CQSGMCGTCETPVLSGVPEHRDDVL

SEQ ID NO: 1251221 - protein, 18 aa, Mycobacterium
CRAGQMLLVREHPRPTRI

SEQ ID NO: 1251222 - protein, 21 aa, Mycobacterium
CREGHCGACAVLKKSGEVEMA

SEQ ID NO: 1251223 - protein, 25 aa, Mycobacterium
CREGQCGSCAATLLRGRVDMPDTEI

SEQ ID NO: 1251224 - protein, 20 aa, Mycobacterium
CRGRHCLGRRRAGCSGRAGP

SEQ ID NO: 1251225 - protein, 17 aa, Mycobacterium
CRLPALSYRLLARLQAE

SEQ ID NO: 1251226 - protein, 19 aa, Mycobacterium
CRMGICQSCVVPLVDGHVR

SEQ ID NO: 1251227 - protein, 17 aa, Mycobacterium
CRPLPGLLEAHRDLQER

SEQ ID NO: 1251228 - protein, 29 aa, Mycobacterium
CRQCKSGRYNLCPEMKFYATPPIDGAFCR

SEQ ID NO: 1251229 - protein, 17 aa, Mycobacterium
CRSDLGGALVLSEFTGA

SEQ ID NO: 1251230 - protein, 22 aa, Mycobacterium
CSKEAKVIREMVARYLAGASIR

SEQ ID NO: 1251231 - protein, 25 aa, Mycobacterium
CSQGRVIPDLIEWWCDRDGVRPDKS

SEQ ID NO: 1251232 - protein, 17 aa, Mycobacterium
CTADPRKVRLALKSPPA

SEQ ID NO: 1251233 - protein, 26 aa, Mycobacterium
CTDTPWWAHDIWDLRADPRIPQRPHE

SEQ ID NO: 1251234 - protein, 17 aa, Mycobacterium
CTFRETARTLAGLADPR

SEQ ID NO: 1251235 - protein, 17 aa, Mycobacterium
CTHCNKCMATIYSHTHC

SEQ ID NO: 1251236 - protein, 18 aa, Mycobacterium
CTHDELYLAAESDLPTAL

SEQ ID NO: 1251237 - protein, 18 aa, Mycobacterium
CTTLRRLIVHRSVADDLV

SEQ ID NO: 1251238 - protein, 18 aa, Mycobacterium
CVCRGCYLLFTDTHAALR

SEQ ID NO: 1251239 - protein, 19 aa, Mycobacterium
CVDCGACEPVCPVEAIYYE

SEQ ID NO: 1251240 - protein, 21 aa, Mycobacterium
CVFFMRDVRSAQYFEQMKGRG

SEQ ID NO: 1251241 - protein, 22 aa, Mycobacterium
CVGRLRYLGLVLYDVDRVLEAA

SEQ ID NO: 1251242 - protein, 18 aa, Mycobacterium
CVRGVVQGVGFRPFVYTT

SEQ ID NO: 1251243 - protein, 20 aa, Mycobacterium
CWLRSRGHGVLAGFSASALH

SEQ ID NO: 1251244 - protein, 17 aa, Mycobacterium
CYEVEFSDGTVIVADAQ

SEQ ID NO: 1251245 - protein, 20 aa, Mycobacterium
CYGAVAAAVQLVWPDADGVL

SEQ ID NO: 1251246 - protein, 21 aa, Mycobacterium
CYGCLRSFRNARFHEQLSRGA

SEQ ID NO: 1251247 - protein, 18 aa, Mycobacterium
CYQGLRHRRGLPVRGQRT

SEQ ID NO: 1251248 - protein, 19 aa, Mycobacterium
DAAESCLRAKGIRATTVSE

SEQ ID NO: 1251249 - protein, 18 aa, Mycobacterium
DAAGRGHEALQLDVTDAA

SEQ ID NO: 1251250 - protein, 17 aa, Mycobacterium
DAAILRSRDRVVLVNGP

SEQ ID NO: 1251251 - protein, 25 aa, Mycobacterium
DAAKGLRYYLGVVLMATTGLRRGEV

SEQ ID NO: 1251252 - protein, 17 aa, Mycobacterium
DAAPGRRLFDAARTLVD

SEQ ID NO: 1251253 - protein, 21 aa, Mycobacterium
DAARELADWSADRGADYLDGG

SEQ ID NO: 1251254 - protein, 26 aa, Mycobacterium
DAARKAGKPEPEWGIKPFDFVLATSM

SEQ ID NO: 1251255 - protein, 20 aa, Mycobacterium
DAARPGAVFVGRNRNGSRSW

SEQ ID NO: 1251256 - protein, 24 aa, Mycobacterium
DADGSWYRAMLWDRHHQVPDHVPA

SEQ ID NO: 1251257 - protein, 24 aa, Mycobacterium
DADLRGVRALPVLILAGDVDAVVS

SEQ ID NO: 1251258 - protein, 29 aa, Mycobacterium
DADPFPEFKEGLGLMLELPAPTTLGSVEV

SEQ ID NO: 1251259 - protein, 23 aa, Mycobacterium
DADVVNYLRWFTFLEAGELAELE

SEQ ID NO: 1251260 - protein, 26 aa, Mycobacterium
DAEFPRLRVGLAVGQAVSRAGDWFGS

SEQ ID NO: 1251261 - protein, 18 aa, Mycobacterium
DAEHDRGLQFGFISDAAG

SEQ ID NO: 1251262 - protein, 23 aa, Mycobacterium
DAESWPHWATVITKVTWTSPEPR

SEQ ID NO: 1251263 - protein, 17 aa, Mycobacterium
DAFLAQRGIDLGGGRIT

SEQ ID NO: 1251264 - protein, 17 aa, Mycobacterium
DAGAIPPEARVHADSIA

SEQ ID NO: 1251265 - protein, 23 aa, Mycobacterium
DAGEICGLGHPIGVTATDDVDAL

SEQ ID NO: 1251266 - protein, 26 aa, Mycobacterium
DAGSLRPGDLAVWDGHVAMIVGDGVM

SEQ ID NO: 1251267 - protein, 21 aa, Mycobacterium
DAHAPIGLVVRNRLPHAAAIA

SEQ ID NO: 1251268 - protein, 20 aa, Mycobacterium
DAHARPGLLNVADVELPEDA

SEQ ID NO: 1251269 - protein, 21 aa, Mycobacterium
DAIGAMIGYFAELIERRRREP

SEQ ID NO: 1251270 - protein, 34 aa, Mycobacterium
DAKGHVAFGHGIHVCLGAPLARVELQSVISTLFS

SEQ ID NO: 1251271 - protein, 25 aa, Mycobacterium
DALGRRLPAPCLPGYDTLGTLRYLR

SEQ ID NO: 1251272 - protein, 23 aa, Mycobacterium
DALKSADVGAVFAELIRAGLQQL

SEQ ID NO: 1251273 - protein, 22 aa, Mycobacterium
DALLAPLTFISIFGYQAQLAMF

SEQ ID NO: 1251274 - protein, 27 aa, Mycobacterium
DALLEWLPPRGMRGEFERFDGRAGGSY

SEQ ID NO: 1251275 - protein, 21 aa, Mycobacterium
DALLRLRRARNWSFLSMPHYR

SEQ ID NO: 1251276 - protein, 23 aa, Mycobacterium
DALRRFGELKSDVTAAISNAHGI

SEQ ID NO: 1251277 - protein, 18 aa, Mycobacterium
DALVSAWHGQGGVAVPSA

SEQ ID NO: 1251278 - protein, 17 aa, Mycobacterium
DAMGLYFELIAQRRENP

SEQ ID NO: 1251279 - protein, 24 aa, Mycobacterium
DAMKVKLIVVRSWTTRAPAGDVTI

SEQ ID NO: 1251280 - protein, 23 aa, Mycobacterium
DAPKPDDSFIVFGYSQSAVIASL

SEQ ID NO: 1251281 - protein, 22 aa, Mycobacterium
DAPTPRPAAMSHRDRADVFAGI

SEQ ID NO: 1251282 - protein, 30 aa, Mycobacterium
DAQLDWPLTESLRYPAALVDDFDWARTLSG

SEQ ID NO: 1251283 - protein, 25 aa, Mycobacterium
DAQRLRAGNRVRYALVVSVETAEQT

SEQ ID NO: 1251284 - protein, 19 aa, Mycobacterium
DARAGLYQIVSREAAPEEW

SEQ ID NO: 1251285 - protein, 23 aa, Mycobacterium
DARHLAGIAHRFPTVTAACRQAG

SEQ ID NO: 1251286 - protein, 21 aa, Mycobacterium
DARPAGVGLTERFGRLLDEPL

SEQ ID NO: 1251287 - protein, 26 aa, Mycobacterium
DARTYRLPWPSGSVVYEIDQPEVIEF

SEQ ID NO: 1251288 - protein, 35 aa, Mycobacterium
DASLAHRCAVAMPWEWRQANAFSEQERLKVAARHM

SEQ ID NO: 1251289 - protein, 23 aa, Mycobacterium
DATAETFRDGWMHTGDLAREDED

SEQ ID NO: 1251290 - protein, 23 aa, Mycobacterium
DATEIDEILTLRVMTMTDEEKAQ

SEQ ID NO: 1251291 - protein, 25 aa, Mycobacterium
DATTKTRFVIVDAIGVTEHDFVEPP

SEQ ID NO: 1251292 - protein, 23 aa, Mycobacterium
DAVASRCFPSFAMRRGAGPIGAF

SEQ ID NO: 1251293 - protein, 26 aa, Mycobacterium
DAVLAWQAARCVARWDGAGKVDKGLR

SEQ ID NO: 1251294 - protein, 17 aa, Mycobacterium
DAVRWAVDEAVGRSVPL

SEQ ID NO: 1251295 - protein, 17 aa, Mycobacterium
DAYPRLWDKAGALLQSL

SEQ ID NO: 1251296 - protein, 22 aa, Mycobacterium
DCFDIAVDAARIALTYRTPVII

SEQ ID NO: 1251297 - protein, 21 aa, Mycobacterium
DCKARLAELHEAYRADYRAYY

SEQ ID NO: 1251298 - protein, 21 aa, Mycobacterium
DCPPGLLMSLGFAPQWVPGYL

SEQ ID NO: 1251299 - protein, 18 aa, Mycobacterium
DCTSTRKLRDWLVCRAID

SEQ ID NO: 1251300 - protein, 25 aa, Mycobacterium
DCVLRRDREGCWWHESLSGTTAPAW

SEQ ID NO: 1251301 - protein, 24 aa, Mycobacterium
DCYLKRPHLSVARHRLEENPWSFV

SEQ ID NO: 1251302 - protein, 18 aa, Mycobacterium
DDAHAWAAAVNDVRLALG

SEQ ID NO: 1251303 - protein, 27 aa, Mycobacterium
DDALLAVCELHIRLAASLVQVSTPVLD

SEQ ID NO: 1251304 - protein, 24 aa, Mycobacterium
DDAMQLCLVEMYLADERFTRHYDD

SEQ ID NO: 1251305 - protein, 17 aa, Mycobacterium
DDAVRWLAAQPRPPVAV

SEQ ID NO: 1251306 - protein, 19 aa, Mycobacterium
DDDSAWASADWRLRRGRIV

SEQ ID NO: 1251307 - protein, 19 aa, Mycobacterium
DDEPIRWSPSFEGELPPYW

SEQ ID NO: 1251308 - protein, 22 aa, Mycobacterium
DDGPVALALVKRGLPADTPLTT

SEQ ID NO: 1251309 - protein, 19 aa, Mycobacterium
DDGSWTWRYDSFRKGDGFE

SEQ ID NO: 1251310 - protein, 24 aa, Mycobacterium
DDHLRHCVRDAAATGGPAADAKLT

SEQ ID NO: 1251311 - protein, 28 aa, Mycobacterium
DDIDGALSWSADHRRSIVVFDTVPGGAG

SEQ ID NO: 1251312 - protein, 22 aa, Mycobacterium
DDIVLRRLRIAARVGRTPQRGP

SEQ ID NO: 1251313 - protein, 20 aa, Mycobacterium
DDKAAGRLVGQWVTAEGDAT

SEQ ID NO: 1251314 - protein, 19 aa, Mycobacterium
DDLHAIAILFSRTDEQYRA

SEQ ID NO: 1251315 - protein, 25 aa, Mycobacterium
DDLVEAIGVDAARYSLIRSSVDTPI

SEQ ID NO: 1251316 - protein, 18 aa, Mycobacterium
DDLWDFTEVVGLPVQMSR

SEQ ID NO: 1251317 - protein, 20 aa, Mycobacterium
DDNFVFPAGMLLVFEPVVWE

SEQ ID NO: 1251318 - protein, 24 aa, Mycobacterium
DDPDAGPVAGAWFTGRNVTPERVW

SEQ ID NO: 1251319 - protein, 27 aa, Mycobacterium
DDPEVRVPWNLPPKRRTREPESKSLLR

SEQ ID NO: 1251320 - protein, 17 aa, Mycobacterium
DDPPRWHVKVTPFRVVA

SEQ ID NO: 1251321 - protein, 25 aa, Mycobacterium
DDPVHPLEVGMEWVSAAPCAALRTV

SEQ ID NO: 1251322 - protein, 24 aa, Mycobacterium
DDQRAEGYAGWQKAVQRTLDWVDV

SEQ ID NO: 1251323 - protein, 20 aa, Mycobacterium
DDQRRCVLMLTDAGRDALAA

SEQ ID NO: 1251324 - protein, 20 aa, Mycobacterium
DDRAALLVRLLADRHGLTLS

SEQ ID NO: 1251325 - protein, 17 aa, Mycobacterium
DDRLWDILGAISADHRP

SEQ ID NO: 1251326 - protein, 18 aa, Mycobacterium
DDRPPCVGKRVTATGFCL

SEQ ID NO: 1251327 - protein, 24 aa, Mycobacterium
DDRWTSPHAGEWSTLDWNAQRLAV

SEQ ID NO: 1251328 - protein, 23 aa, Mycobacterium
DDSFRRWRVYAPGTWLQVESDQA

SEQ ID NO: 1251329 - protein, 18 aa, Mycobacterium
DDSLRLARREVLLDHSTL

SEQ ID NO: 1251330 - protein, 17 aa, Mycobacterium
DDTRLGDLLPPAPADTT

SEQ ID NO: 1251331 - protein, 19 aa, Mycobacterium
DDTVRRWLDDGSLAASADA

SEQ ID NO: 1251332 - protein, 18 aa, Mycobacterium
DDYLRFARMLLAGGEVDG

SEQ ID NO: 1251333 - protein, 18 aa, Mycobacterium
DEAIFCCAHCARKDTNAD

SEQ ID NO: 1251334 - protein, 17 aa, Mycobacterium
DEARNEGVLGWLHSVAR

SEQ ID NO: 1251335 - protein, 21 aa, Mycobacterium
DECPGAGMIAGIGRISGRECM

SEQ ID NO: 1251336 - protein, 17 aa, Mycobacterium
DEDLRWLDPNRTPKQIA

SEQ ID NO: 1251337 - protein, 17 aa, Mycobacterium
DEDRFAEQLAEQGSSRE

SEQ ID NO: 1251338 - protein, 20 aa, Mycobacterium
DEEIGAFLILLASAGNDTTK

SEQ ID NO: 1251339 - protein, 17 aa, Mycobacterium
DEELCGDVSRLAGWGNK

SEQ ID NO: 1251340 - protein, 24 aa, Mycobacterium
DEEVLGFCALLLVAGYETTTNLLG

SEQ ID NO: 1251341 - protein, 23 aa, Mycobacterium
DEFDLSNLFLLASTAALFSPALK

SEQ ID NO: 1251342 - protein, 21 aa, Mycobacterium
DEFPYDVWVHRGGSCRSGSKF

SEQ ID NO: 1251343 - protein, 22 aa, Mycobacterium
DEGGEPLPGFFVAMDPPDQTRL

SEQ ID NO: 1251344 - protein, 24 aa, Mycobacterium
DEHADALWRYALKLTGDAATAEDV

SEQ ID NO: 1251345 - protein, 23 aa, Mycobacterium
DEHRRAGLEWGTFAERSERLAET

SEQ ID NO: 1251346 - protein, 19 aa, Mycobacterium
DEIRDGAQIVDWIVGQPWS

SEQ ID NO: 1251347 - protein, 20 aa, Mycobacterium
DELDAVVFVNMWGDSDDTPM

SEQ ID NO: 1251348 - protein, 17 aa, Mycobacterium
DELERRGAKRALITLCI

SEQ ID NO: 1251349 - protein, 22 aa, Mycobacterium
DELMDVFAYPFATWRVYLHPTQ

SEQ ID NO: 1251350 - protein, 17 aa, Mycobacterium
DELTVTFVAGLKSPLPH

SEQ ID NO: 1251351 - protein, 29 aa, Mycobacterium
DELVGDGYLRFMRSFFESMFVPSSDPAIR

SEQ ID NO: 1251352 - protein, 33 aa, Mycobacterium
DENVALALQRTCGWSSLPLKGWLATAYQRYATL

SEQ ID NO: 1251353 - protein, 17 aa, Mycobacterium
DEPYRRALRVIHGRLTA

SEQ ID NO: 1251354 - protein, 18 aa, Mycobacterium
DERAELAPSAFVFMAEEA

SEQ ID NO: 1251355 - protein, 25 aa, Mycobacterium
DERNRPLLELSWDYVMDGDEPSGED

SEQ ID NO: 1251356 - protein, 19 aa, Mycobacterium
DETEWRTEYLYSRAATIYG

SEQ ID NO: 1251357 - protein, 21 aa, Mycobacterium
DEVDPALVVVFDLAGSVKDFR

SEQ ID NO: 1251358 - protein, 27 aa, Mycobacterium
DEVICAYGRIGSMFACDDFGYVPDIIT

SEQ ID NO: 1251359 - protein, 31 aa, Mycobacterium
DFGAVLGGGALPFGIFAGGLLTGPELINPAA

SEQ ID NO: 1251360 - protein, 18 aa, Mycobacterium
DFGDWAYERWPTISDGVL

SEQ ID NO: 1251361 - protein, 18 aa, Mycobacterium
DFIGSFLPMMIVMDPPRH

SEQ ID NO: 1251362 - protein, 25 aa, Mycobacterium
DFLEIAFAHVGLRWEDHVRFDERYL

SEQ ID NO: 1251363 - protein, 19 aa, Mycobacterium
DFRDAQRIPIGDAQLEENP

SEQ ID NO: 1251364 - protein, 21 aa, Mycobacterium
DFRPRKSFGQNFVHDANTVRR

SEQ ID NO: 1251365 - protein, 18 aa, Mycobacterium
DGAAMARRGCVYVSVNYR

SEQ ID NO: 1251366 - protein, 26 aa, Mycobacterium
DGARFDYRPGQFLTLRVPGEQGGAVA

SEQ ID NO: 1251367 - protein, 17 aa, Mycobacterium
DGARLFGEMVRHCADRI

SEQ ID NO: 1251368 - protein, 17 aa, Mycobacterium
DGARLMAERGRMFGSLP

SEQ ID NO: 1251369 - protein, 20 aa, Mycobacterium
DGDAIMVVLALAMRESGELA

SEQ ID NO: 1251370 - protein, 25 aa, Mycobacterium
DGEHVLPFISIRVWQPISENETEVL

SEQ ID NO: 1251371 - protein, 18 aa, Mycobacterium
DGESGEFVYACYLTSGYL

SEQ ID NO: 1251372 - protein, 21 aa, Mycobacterium
DGFAALWERRRMDLTVEAIVV

SEQ ID NO: 1251373 - protein, 29 aa, Mycobacterium
DGFQCGYCTPGQICSAVGMLDEVKSGAPS

SEQ ID NO: 1251374 - protein, 18 aa, Mycobacterium
DGFRGCLGVVGGFMQPQG

SEQ ID NO: 1251375 - protein, 22 aa, Mycobacterium
DGGDARVLLFYRAEDLGLARFF

SEQ ID NO: 1251376 - protein, 22 aa, Mycobacterium
DGGEFRAHLELASLAIALKRRV

SEQ ID NO: 1251377 - protein, 19 aa, Mycobacterium
DGGTFDWTNGRFPGFTTPD

SEQ ID NO: 1251378 - protein, 23 aa, Mycobacterium
DGHRALVAAGCCHFLGPSIVTVD

SEQ ID NO: 1251379 - protein, 19 aa, Mycobacterium
DGIEFAGDWDALGQRLSAS

SEQ ID NO: 1251380 - protein, 24 aa, Mycobacterium
DGIEPMCNVVVLGATNRPDLIDPA

SEQ ID NO: 1251381 - protein, 18 aa, Mycobacterium
DGKRASVWATLVKVDDSG

SEQ ID NO: 1251382 - protein, 20 aa, Mycobacterium
DGLELGQPVEVVFQQADDVW

SEQ ID NO: 1251383 - protein, 23 aa, Mycobacterium
DGLPRIALLDGLPFSNHAVLAGR

SEQ ID NO: 1251384 - protein, 20 aa, Mycobacterium
DGLQVPLPIASLLRDRFLTL

SEQ ID NO: 1251385 - protein, 18 aa, Mycobacterium
DGLRDCVSSALSVQNTVE

SEQ ID NO: 1251386 - protein, 31 aa, Mycobacterium
DGLSRFCEICVEAFAGFAIVKPQVAFFEAYG

SEQ ID NO: 1251387 - protein, 35 aa, Mycobacterium
DGMHEHRLAVLWPDVYPRLLRVMTADPIFQDRIVS

SEQ ID NO: 1251388 - protein, 18 aa, Mycobacterium
DGPCGSGTVFVFSGQGSQ

SEQ ID NO: 1251389 - protein, 27 aa, Mycobacterium
DGPFLSLPVVKEFWASGIDRLSDADDR

SEQ ID NO: 1251390 - protein, 24 aa, Mycobacterium
DGPLAGSHLLVWTTTPWTLPSNQA

SEQ ID NO: 1251391 - protein, 25 aa, Mycobacterium
DGPRAQGGLRYCINSAALRFIHLDD

SEQ ID NO: 1251392 - protein, 21 aa, Mycobacterium
DGPRGISAFVVEKDTPGVSFG

SEQ ID NO: 1251393 - protein, 21 aa, Mycobacterium
DGQAARRCAAQALPRRDRVVL

SEQ ID NO: 1251394 - protein, 18 aa, Mycobacterium
DGQDFVIDLTVWLDLAPA

SEQ ID NO: 1251395 - protein, 24 aa, Mycobacterium
DGQIGTACAVAFGSAFAATTRHAG

SEQ ID NO: 1251396 - protein, 38 aa, Mycobacterium
DGQLAARHRSMWASGDYPRLAAELVAPLGPVLVEAAGI

SEQ ID NO: 1251397 - protein, 18 aa, Mycobacterium
DGRGRRLIDSEWVQLNLA

SEQ ID NO: 1251398 - protein, 19 aa, Mycobacterium
DGRIPVLLSAHAGDLVAED

SEQ ID NO: 1251399 - protein, 20 aa, Mycobacterium
DGRVTLRATAMVDRLQVSIL

SEQ ID NO: 1251400 - protein, 17 aa, Mycobacterium
DGRWVVSIRCAQLAADR

SEQ ID NO: 1251401 - protein, 20 aa, Mycobacterium
DGSLRLPTEPGLTLLGDFRA

SEQ ID NO: 1251402 - protein, 18 aa, Mycobacterium
DGSPYEFHPCDIRDDDSV

SEQ ID NO: 1251403 - protein, 17 aa, Mycobacterium
DGSVLACVFNFSGSEHS

SEQ ID NO: 1251404 - protein, 21 aa, Mycobacterium
DGTAMDCFRALVAAQGGDTSR

SEQ ID NO: 1251405 - protein, 22 aa, Mycobacterium
DGTRLPADLVIIGLGVTPSVDW

SEQ ID NO: 1251406 - protein, 24 aa, Mycobacterium
DGVARYPARFQLVMAANPCPCAPA

SEQ ID NO: 1251407 - protein, 18 aa, Mycobacterium
DGVLQWRGTAGPGTTVDL

SEQ ID NO: 1251408 - protein, 19 aa, Mycobacterium
DGVRIAVSVYLPADTARQT

SEQ ID NO: 1251409 - protein, 25 aa, Mycobacterium
DGVTEVHVVLQFGSTVRDTAARIRD

SEQ ID NO: 1251410 - protein, 20 aa, Mycobacterium
DGWPAVLPLNAIRGAFHNGG

SEQ ID NO: 1251411 - protein, 28 aa, Mycobacterium
DGWWVHLRRCAACGHIGCCDDSLARHAS

SEQ ID NO: 1251412 - protein, 18 aa, Mycobacterium
DGYCNVVGRIKDMVIRGG

SEQ ID NO: 1251413 - protein, 24 aa, Mycobacterium
DGYPQRFGIPEGLYAEPVAVKQGW

SEQ ID NO: 1251414 - protein, 18 aa, Mycobacterium
DHDAPWGLFRADGDDAWV

SEQ ID NO: 1251415 - protein, 25 aa, Mycobacterium
DHDGCVIGGTAWDFANGNRIPRGCL

SEQ ID NO: 1251416 - protein, 20 aa, Mycobacterium
DHGKLCLKSRSGRDVTAEYP

SEQ ID NO: 1251417 - protein, 18 aa, Mycobacterium
DHINEAFAAADGKRDVRA

SEQ ID NO: 1251418 - protein, 21 aa, Mycobacterium
DHLSPRLNVRPSIAATQLGRK

SEQ ID NO: 1251419 - protein, 26 aa, Mycobacterium
DHSRRLWTVLIFMLWHAIFVEGSVTP

SEQ ID NO: 1251420 - protein, 27 aa, Mycobacterium
DHTIKATKLVAEWPIRDYIPDPDPIGT

SEQ ID NO: 1251421 - protein, 19 aa, Mycobacterium
DIAARVIPGSGLAVERVGS

SEQ ID NO: 1251422 - protein, 23 aa, Mycobacterium
DIDLYAPVARYWPEFGRAGKEDI

SEQ ID NO: 1251423 - protein, 25 aa, Mycobacterium
DIDYERWQPLHWVIEVPDVMERGGF

SEQ ID NO: 1251424 - protein, 25 aa, Mycobacterium
DIEDVCNRWAAGRFDTGVFKADGWR

SEQ ID NO: 1251425 - protein, 30 aa, Mycobacterium
DIFRQAKANLGWGYGVHVCLGMHLARLEMR

SEQ ID NO: 1251426 - protein, 18 aa, Mycobacterium
DIGPDLNLALAFATAFPY

SEQ ID NO: 1251427 - protein, 26 aa, Mycobacterium
DIISKGRVSYAFGIGHRAEEYRHFGV

SEQ ID NO: 1251428 - protein, 22 aa, Mycobacterium
DIKGLRLTLTQAAWRTSEGLPA

SEQ ID NO: 1251429 - protein, 18 aa, Mycobacterium
DIKRAWLRPLATTEHIWC

SEQ ID NO: 1251430 - protein, 17 aa, Mycobacterium
DILDARYASLFTPPYFP

SEQ ID NO: 1251431 - protein, 19 aa, Mycobacterium
DILITLGYDIDRPWHKLPK

SEQ ID NO: 1251432 - protein, 24 aa, Mycobacterium
DIPTRPGTRVRIGEVELEVVRILA

SEQ ID NO: 1251433 - protein, 17 aa, Mycobacterium
DIQTTLSTYGWVTEDAE

SEQ ID NO: 1251434 - protein, 20 aa, Mycobacterium
DIRDAMTIDLLLDGCDAVLH

SEQ ID NO: 1251435 - protein, 25 aa, Mycobacterium
DITARVCGICPVAYQVSACNAIEDA

SEQ ID NO: 1251436 - protein, 18 aa, Mycobacterium
DKAAELLVATSRKLDKAA

SEQ ID NO: 1251437 - protein, 20 aa, Mycobacterium
DKAFRALLTVSRRYDVKLRH

SEQ ID NO: 1251438 - protein, 26 aa, Mycobacterium
DKFFLPPRVVSLYGTRMWTEMTREQQ

SEQ ID NO: 1251439 - protein, 21 aa, Mycobacterium
DKGPGLWKVAVFLEVEGAAHY

SEQ ID NO: 1251440 - protein, 20 aa, Mycobacterium
DKLATWSMGILREGGRMLAL

SEQ ID NO: 1251441 - protein, 21 aa, Mycobacterium
DKLLRLRWPCPVPGARPLSEV

SEQ ID NO: 1251442 - protein, 22 aa, Mycobacterium
DKPLMRRKLAEMIVDVEAAQAL

SEQ ID NO: 1251443 - protein, 19 aa, Mycobacterium
DKPVIFAYHGYPWLIHRLA

SEQ ID NO: 1251444 - protein, 26 aa, Mycobacterium
DKSGRWIPRRDGLKESVWAVFPEEFQ

SEQ ID NO: 1251445 - protein, 21 aa, Mycobacterium
DKTLVVNFSGLRSYDPDDDDT

SEQ ID NO: 1251446 - protein, 23 aa, Mycobacterium
DLAALDAFAGYGLSDEPEPEPEP

SEQ ID NO: 1251447 - protein, 25 aa, Mycobacterium
DLAARVGAPLVLRGVGVRRVAGDRG

SEQ ID NO: 1251448 - protein, 18 aa, Mycobacterium
DLAARWLRAQGRGYYTIG

SEQ ID NO: 1251449 - protein, 24 aa, Mycobacterium
DLAGLRPRRFVVLPWLTPTLASHW

SEQ ID NO: 1251450 - protein, 18 aa, Mycobacterium
DLARAGRTVVVFEKRSTP

SEQ ID NO: 1251451 - protein, 24 aa, Mycobacterium
DLASRAAGAAVVWANDELFAEKEN

SEQ ID NO: 1251452 - protein, 25 aa, Mycobacterium
DLDAVCTELARTLRPGGRAAIGVGD

SEQ ID NO: 1251453 - protein, 26 aa, Mycobacterium
DLDEVGRLLLQRGIRSVPVVDDECRV

SEQ ID NO: 1251454 - protein, 17 aa, Mycobacterium
DLDRFARRFGVTVVDGF

SEQ ID NO: 1251455 - protein, 18 aa, Mycobacterium
DLDSAMAGFGIFPGPYPV

SEQ ID NO: 1251456 - protein, 21 aa, Mycobacterium
DLDSWRAAVRPNTKAFFGETI

SEQ ID NO: 1251457 - protein, 24 aa, Mycobacterium
DLEHWPAFVKSFLRLTTMIRKAAT

SEQ ID NO: 1251458 - protein, 19 aa, Mycobacterium
DLEVFICGGASVPPSLIRR

SEQ ID NO: 1251459 - protein, 25 aa, Mycobacterium
DLEVLWTRWADSRVEGLKREDVETF

SEQ ID NO: 1251460 - protein, 24 aa, Mycobacterium
DLFEVNEAFAPVVLAWAQDTGADL

SEQ ID NO: 1251461 - protein, 20 aa, Mycobacterium
DLFRSPAAAASFVVDPDGAL

SEQ ID NO: 1251462 - protein, 18 aa, Mycobacterium
DLGQEWDDNFVFPAGMLL

SEQ ID NO: 1251463 - protein, 23 aa, Mycobacterium
DLGRPTPCAGWDLGDLLVHMTVQ

SEQ ID NO: 1251464 - protein, 17 aa, Mycobacterium
DLGSAFGDWESIREKVH

SEQ ID NO: 1251465 - protein, 20 aa, Mycobacterium
DLGVAGFLGRLVKGRITDAN

SEQ ID NO: 1251466 - protein, 27 aa, Mycobacterium
DLGVQRLRLVAGWSLGGMQSLEFASRY

SEQ ID NO: 1251467 - protein, 25 aa, Mycobacterium
DLHAHPWFGCMVELADLPSLHNRRE

SEQ ID NO: 1251468 - protein, 24 aa, Mycobacterium
DLHTMLRLPTGIFYAQGVKANVLF

SEQ ID NO: 1251469 - protein, 24 aa, Mycobacterium
DLIDPALLRPGRLERLVFVEPPDA

SEQ ID NO: 1251470 - protein, 19 aa, Mycobacterium
DLITRRAADLVAFQSEKVA

SEQ ID NO: 1251471 - protein, 19 aa, Mycobacterium
DLKGLIKLGPEDAAEAFDL

SEQ ID NO: 1251472 - protein, 26 aa, Mycobacterium
DLKVKRRLAGMLARRGYSQSMALDVV

SEQ ID NO: 1251473 - protein, 18 aa, Mycobacterium
DLLAAFERDFFPIYPASA

SEQ ID NO: 1251474 - protein, 24 aa, Mycobacterium
DLLGEYRRTGVWRRIGLMDCGERW

SEQ ID NO: 1251475 - protein, 19 aa, Mycobacterium
DLLILRIAALFHENLLVLH

SEQ ID NO: 1251476 - protein, 21 aa, Mycobacterium
DLLLEQGWRPEDLALLTTGSR

SEQ ID NO: 1251477 - protein, 17 aa, Mycobacterium
DLLPAHPIAAARAGAAR

SEQ ID NO: 1251478 - protein, 18 aa, Mycobacterium
DLLQRVQRAMGLSREDDP

SEQ ID NO: 1251479 - protein, 17 aa, Mycobacterium
DLLRPGEDDLFWLGTEE

SEQ ID NO: 1251480 - protein, 23 aa, Mycobacterium
DLLRRKDVLNGRRGGAYRTGDLS

SEQ ID NO: 1251481 - protein, 24 aa, Mycobacterium
DLLRRVDPQLSMLFPVEDYPLIDG

SEQ ID NO: 1251482 - protein, 17 aa, Mycobacterium
DLLVPRAQVADWRDRLT

SEQ ID NO: 1251483 - protein, 20 aa, Mycobacterium
DLMAKRGLKEIGVLVEQSLI

SEQ ID NO: 1251484 - protein, 21 aa, Mycobacterium
DLPAEWEPLGAVAVGHPAEPQ

SEQ ID NO: 1251485 - protein, 23 aa, Mycobacterium
DLPANLQPGSTVAFDQFTLTRHN

SEQ ID NO: 1251486 - protein, 25 aa, Mycobacterium
DLPDHLRRSITWDRGSEMAGWQDIS

SEQ ID NO: 1251487 - protein, 23 aa, Mycobacterium
DLPDLEAVTAMYLTHREERLEQV

SEQ ID NO: 1251488 - protein, 18 aa, Mycobacterium
DLPSAWAASRVRRTIEAA

SEQ ID NO: 1251489 - protein, 29 aa, Mycobacterium
DLRDWRQWWTWSPGACWRHPLGPESSWHD

SEQ ID NO: 1251490 - protein, 20 aa, Mycobacterium
DLRHIRARMDALADERDEEL

SEQ ID NO: 1251491 - protein, 21 aa, Mycobacterium
DLRTPRGREIFLELVEQTDVI

SEQ ID NO: 1251492 - protein, 21 aa, Mycobacterium
DLRVIDNVRYFAALYGTGGQA

SEQ ID NO: 1251493 - protein, 18 aa, Mycobacterium
DLSDEFFRLFLDPTQTYS

SEQ ID NO: 1251494 - protein, 26 aa, Mycobacterium
DLSSIRRFWHVGAPCPPAVKEAWIGL

SEQ ID NO: 1251495 - protein, 24 aa, Mycobacterium
DLTDVDLSLMLKVTQLVTTGRTPA

SEQ ID NO: 1251496 - protein, 27 aa, Mycobacterium
DLTTCTAWPVLRRSLAMRALSGADPGR

SEQ ID NO: 1251497 - protein, 24 aa, Mycobacterium
DLVPGGPASLLWQLLRRGNDGMGR

SEQ ID NO: 1251498 - protein, 25 aa, Mycobacterium
DMGRARALAASWDRRLAGVIEVSDR

SEQ ID NO: 1251499 - protein, 27 aa, Mycobacterium
DMTRPRWSMDPLRIFPADIGVDKAVDL

SEQ ID NO: 1251500 - protein, 25 aa, Mycobacterium
DMTWLLSRWTCVFGTPACQGTVEGR

SEQ ID NO: 1251501 - protein, 24 aa, Mycobacterium
DMVSGDAWPGVSVVSVTWTRPPEW

SEQ ID NO: 1251502 - protein, 25 aa, Mycobacterium
DNAKAYIEVMSFDGLVNAATERNRA

SEQ ID NO: 1251503 - protein, 18 aa, Mycobacterium
DNANYLWIQQFYAALGPK

SEQ ID NO: 1251504 - protein, 23 aa, Mycobacterium
DNDRKPCGYGRMLRKEDPRFVRG

SEQ ID NO: 1251505 - protein, 22 aa, Mycobacterium
DNGIKIFGPGGHKLDDATEDRI

SEQ ID NO: 1251506 - protein, 18 aa, Mycobacterium
DNHLPAPLLLASAIAART

SEQ ID NO: 1251507 - protein, 36 aa, Mycobacterium
DNLRAGVYEAFCRRSEWLASGWTAHFAMQTGLVATP

SEQ ID NO: 1251508 - protein, 24 aa, Mycobacterium
DNQRTCFVTALGDRAFRVSAAVFV

SEQ ID NO: 1251509 - protein, 17 aa, Mycobacterium
DNVWSFLKTHGDPSWES

SEQ ID NO: 1251510 - protein, 24 aa, Mycobacterium
DPAGLDFGLKYGDQAQEFATALAD

SEQ ID NO: 1251511 - protein, 18 aa, Mycobacterium
DPAPELVRHAIARGAAVV

SEQ ID NO: 1251512 - protein, 24 aa, Mycobacterium
DPARPELGEARFIKNIEGLQNASI

SEQ ID NO: 1251513 - protein, 24 aa, Mycobacterium
DPARPSGGVANWVPEGVRVPGIGL

SEQ ID NO: 1251514 - protein, 23 aa, Mycobacterium
DPATAECWAEWFDQLAAAFDTLR

SEQ ID NO: 1251515 - protein, 17 aa, Mycobacterium
DPCFRWLAAGQVPHHRA

SEQ ID NO: 1251516 - protein, 22 aa, Mycobacterium
DPDDRLVLALGLRATESAQPLN

SEQ ID NO: 1251517 - protein, 20 aa, Mycobacterium
DPDRFAVIIGTGLGGGEKIV

SEQ ID NO: 1251518 - protein, 31 aa, Mycobacterium; identical to SEQ ID NO: 620746

SEQ ID NO: 1251519 - protein, 17 aa, Mycobacterium
DPDVPFPPAATGPRGRQ

SEQ ID NO: 1251520 - protein, 24 aa, Mycobacterium
DPERGRWSLPGGRLGHDEDLTTSV

SEQ ID NO: 1251521 - protein, 20 aa, Mycobacterium
DPFAEPGWFRTDDVGALDDG

SEQ ID NO: 1251522 - protein, 17 aa, Mycobacterium
DPFLDADLAEWRKIIDL

SEQ ID NO: 1251523 - protein, 25 aa, Mycobacterium
DPGEALFDFLRAIAVEWGAADRVLI

SEQ ID NO: 1251524 - protein, 27 aa, Mycobacterium
DPGPALVVRPFLKYQIITVAAPETAAG

SEQ ID NO: 1251525 - protein, 20 aa, Mycobacterium
DPLAPYGFSGWVGPEPHGAA

SEQ ID NO: 1251526 - protein, 19 aa, Mycobacterium
DPLLGYTDVDGVGFVVSEL

SEQ ID NO: 1251527 - protein, 22 aa, Mycobacterium
DPPEPFPSVSAYLGAGDIPPPP

SEQ ID NO: 1251528 - protein, 25 aa, Mycobacterium
DPQSPAGQAAIMAIIEKYQAKSGGT

SEQ ID NO: 1251529 - protein, 18 aa, Mycobacterium
DPRCRVRGVDALWVVDGS

SEQ ID NO: 1251530 - protein, 23 aa, Mycobacterium
DPREIANAVAFLASDLASYAVGA

SEQ ID NO: 1251531 - protein, 23 aa, Mycobacterium
DPRLRRLREDAVFEAVVGAIPQL

SEQ ID NO: 1251532 - protein, 22 aa, Mycobacterium
DPRRRAIVGMIFFDCLTQREVA

SEQ ID NO: 1251533 - protein, 18 aa, Mycobacterium
DPRSGRWQGLNKIECGLH

SEQ ID NO: 1251534 - protein, 18 aa, Mycobacterium
DPSRRLAAAANMFTDALA

SEQ ID NO: 1251535 - protein, 40 aa, Mycobacterium
DPYEISSADGWRANPEKVWAWYLWRHYMMDAVQPNNGHHA

SEQ ID NO: 1251536 - protein, 21 aa, Mycobacterium
DQIAALRWVRENIAAFGGDPD

SEQ ID NO: 1251537 - protein, 24 aa, Mycobacterium
DQLRGELLGAARAAALAAATNQVN

SEQ ID NO: 1251538 - protein, 18 aa, Mycobacterium
DQRRELVADPSLIPSAVE

SEQ ID NO: 1251539 - protein, 18 aa, Mycobacterium
DQSMPRWLADTVTRRLGV

SEQ ID NO: 1251540 - protein, 20 aa, Mycobacterium
DQTLKFIRPIVAGDTLHCDV

SEQ ID NO: 1251541 - protein, 21 aa, Mycobacterium
DQTRAAFEWAAVPDLCADMGA

SEQ ID NO: 1251542 - protein, 19 aa, Mycobacterium
DQVPDSFGLVRAHPNVVVL

SEQ ID NO: 1251543 - protein, 19 aa, Mycobacterium
DQWAMIMKLHHCIADGIAT

SEQ ID NO: 1251544 - protein, 25 aa, Mycobacterium
DRAGELGLVPLHWALASLLADIGSA

SEQ ID NO: 1251545 - protein, 19 aa, Mycobacterium
DRAQLAAGRAVRVAADAQD

SEQ ID NO: 1251546 - protein, 17 aa, Mycobacterium
DRDDWAVHVALWQSGEL

SEQ ID NO: 1251547 - protein, 27 aa, Mycobacterium
DRDGGRARCYGCGFQFAGTDDTAEDWQ

SEQ ID NO: 1251548 - protein, 23 aa, Mycobacterium
DREHRVAAVFLRELLAEDLQPVV

SEQ ID NO: 1251549 - protein, 18 aa, Mycobacterium
DREPVGGVHFAFVSNSSP

SEQ ID NO: 1251550 - protein, 24 aa, Mycobacterium
DRERPLWECWIVEGLPDDQWAMIM

SEQ ID NO: 1251551 - protein, 24 aa, Mycobacterium
DRHFRPEFFVAMRALCDEFDALLI

SEQ ID NO: 1251552 - protein, 18 aa, Mycobacterium
DRIEPVHAVTYFAPEARS

SEQ ID NO: 1251553 - protein, 20 aa, Mycobacterium
DRIQRCLDEGALAGDAVDIA

SEQ ID NO: 1251554 - protein, 19 aa, Mycobacterium
DRKRPARANLVFTDEDGET

SEQ ID NO: 1251555 - protein, 29 aa, Mycobacterium
DRLAKAWKRLETVTGMTAPQLNDWGGGDF

SEQ ID NO: 1251556 - protein, 18 aa, Mycobacterium
DRLKAEGYTAQMYSGRQS

SEQ ID NO: 1251557 - protein, 19 aa, Mycobacterium
DRLLVDLIHEAFRRMFERH

SEQ ID NO: 1251558 - protein, 24 aa, Mycobacterium
DRLRGELPAREEFREALSGRQRKI

SEQ ID NO: 1251559 - protein, 24 aa, Mycobacterium
DRLRLRPFLRACVLESVRLWPTTP

SEQ ID NO: 1251560 - protein, 22 aa, Mycobacterium
DRLRNWRFYDGFRVDATAPARH

SEQ ID NO: 1251561 - protein, 19 aa, Mycobacterium
DRLTARLAKIDAAVRELAA

SEQ ID NO: 1251562 - protein, 18 aa, Mycobacterium
DRLVDALAPFDVEIRGLA

SEQ ID NO: 1251563 - protein, 22 aa, Mycobacterium
DRMGALALHVAKIARRRHPQHV

SEQ ID NO: 1251564 - protein, 30 aa, Mycobacterium
DRPDPSPRIRLWWRPAEPMPDDPILNSCLL

SEQ ID NO: 1251565 - protein, 17 aa, Mycobacterium
DRPHARNAISLETMGQL

SEQ ID NO: 1251566 - protein, 18 aa, Mycobacterium
DRPIQWWRSDGWLCPYGP

SEQ ID NO: 1251567 - protein, 21 aa, Mycobacterium
DRPSYVYPMFEQAVRIAAGET

SEQ ID NO: 1251568 - protein, 20 aa, Mycobacterium
DRRFEVLRAIVADFVATKEP

SEQ ID NO: 1251569 - protein, 22 aa, Mycobacterium
DRRLDAFLLHHGHRWLHDDGSA

SEQ ID NO: 1251570 - protein, 18 aa, Mycobacterium
DRRLRVSVAGTVLVDTAD

SEQ ID NO: 1251571 - protein, 24 aa, Mycobacterium
DRRPLVWHDPRIESTKCSDTGPAF

SEQ ID NO: 1251572 - protein, 20 aa, Mycobacterium
DRRPPRAALVVVEDAAAADP

SEQ ID NO: 1251573 - protein, 18 aa, Mycobacterium
DRSGMAWCISNFGREEML

SEQ ID NO: 1251574 - protein, 24 aa, Mycobacterium
DRTLTRLAGVLGYADSSALNPAVP

SEQ ID NO: 1251575 - protein, 20 aa, Mycobacterium
DRVAGLLGLADREDAFAALG

SEQ ID NO: 1251576 - protein, 20 aa, Mycobacterium
DRVDPALSRLMAAWPDNPAL

SEQ ID NO: 1251577 - protein, 20 aa, Mycobacterium
DRVRAAAVRHGRTLRYGVRL

SEQ ID NO: 1251578 - protein, 25 aa, Mycobacterium
DRYRRTPEGWKICATGYDRTYDASM

SEQ ID NO: 1251579 - protein, 19 aa, Mycobacterium
DSAATRLADAGQRLQDGLS

SEQ ID NO: 1251580 - protein, 17 aa, Mycobacterium
DSAKLTLTRTVEVAGTF

SEQ ID NO: 1251581 - protein, 21 aa, Mycobacterium
DSALQAARWAGAVAAACGAPL

SEQ ID NO: 1251582 - protein, 22 aa, Mycobacterium
DSCRECDNCRAGIEQYCTGSGM

SEQ ID NO: 1251583 - protein, 18 aa, Mycobacterium
DSEGGFGITAHLIGYLPG

SEQ ID NO: 1251584 - protein, 27 aa, Mycobacterium
DSFDARTRFALWWVRLYGRGVQAKSEL

SEQ ID NO: 1251585 - protein, 17 aa, Mycobacterium
DSFRAAWAAGYRGLTAA

SEQ ID NO: 1251586 - protein, 22 aa, Mycobacterium
DSGRGVASFLVLRTRRDGSRNG

SEQ ID NO: 1251587 - protein, 24 aa, Mycobacterium
DSGSPAGWRGWRSAFIDLTEITAL

SEQ ID NO: 1251588 - protein, 18 aa, Mycobacterium
DSGTRLGPGGAFLQPALE

SEQ ID NO: 1251589 - protein, 20 aa, Mycobacterium
DSIFATRPLAEWAETFAAEP

SEQ ID NO: 1251590 - protein, 25 aa, Mycobacterium
DSLESRLAWEPTSLAAAVERTKALS

SEQ ID NO: 1251591 - protein, 17 aa, Mycobacterium
DSLTWKLFGDWRGLLQG

SEQ ID NO: 1251592 - protein, 23 aa, Mycobacterium
DSMELRLPSPVGADLTWRETHGE

SEQ ID NO: 1251593 - protein, 24 aa, Mycobacterium
DSNGRLAVCPFCGTAHDRHLQMRI

SEQ ID NO: 1251594 - protein, 17 aa, Mycobacterium
DSPEFQVRLLAKRPGPD

SEQ ID NO: 1251595 - protein, 20 aa, Mycobacterium
DSPLLLFAPHPSWIARQPRP

SEQ ID NO: 1251596 - protein, 24 aa, Mycobacterium
DSPLLPKIFKYVGKAHVWVYRRTG

SEQ ID NO: 1251597 - protein, 18 aa, Mycobacterium
DSPVAIHAVERFLGDLAT

SEQ ID NO: 1251598 - protein, 20 aa, Mycobacterium
DSRQAAAFAAPYLDRTYSRM

SEQ ID NO: 1251599 - protein, 23 aa, Mycobacterium
DSSNEARIPWEAVDPGNDPDPDR

SEQ ID NO: 1251600 - protein, 19 aa, Mycobacterium
DSTGKMWPLPYPQSTANTD

SEQ ID NO: 1251601 - protein, 24 aa, Mycobacterium
DSTHWWKHICTRTDVAIGELVDGF

SEQ ID NO: 1251602 - protein, 23 aa, Mycobacterium
DSTRAREKLGWVPTVHGQTLARL

SEQ ID NO: 1251603 - protein, 18 aa, Mycobacterium
DSTWPLSPETLAIYFNGV

SEQ ID NO: 1251604 - protein, 19 aa, Mycobacterium
DSVIPVWQARSFVEKLKAK

SEQ ID NO: 1251605 - protein, 19 aa, Mycobacterium
DSVLRRLKQYSGRLATEAV

SEQ ID NO: 1251606 - protein, 22 aa, Mycobacterium
DSWSDDNARAYLGMTAPGFPNL

SEQ ID NO: 1251607 - protein, 20 aa, Mycobacterium
DTAAVLAEWLGMPSDEIAHL

SEQ ID NO: 1251608 - protein, 23 aa, Mycobacterium
DTAGEWTIRFFMPSKWTMDTLPT

SEQ ID NO: 1251609 - protein, 31 aa, Mycobacterium
DTAPAEWLARGGVMLPIYQREAMWLSFDATE

SEQ ID NO: 1251610 - protein, 17 aa, Mycobacterium
DTCRELLDTYGDVIHLP

SEQ ID NO: 1251611 - protein, 24 aa, Mycobacterium
DTDVYWCTADIGWVTGHTYITYGP

SEQ ID NO: 1251612 - protein, 21 aa, Mycobacterium
DTFEVKWLCAVVEVARSSFYA

SEQ ID NO: 1251613 - protein, 24 aa, Mycobacterium
DTGGPFFIEFRTYRFRAHSMFDPE

SEQ ID NO: 1251614 - protein, 17 aa, Mycobacterium
DTGLHAWVVQRELADPV

SEQ ID NO: 1251615 - protein, 20 aa, Mycobacterium
DTGLLDRRAPDYAPVAVSDE

SEQ ID NO: 1251616 - protein, 17 aa, Mycobacterium
DTGQTYQAWQQQWNQAL

SEQ ID NO: 1251617 - protein, 25 aa, Mycobacterium
DTHLLRYPLPSAWGEDCDVALYLKD

SEQ ID NO: 1251618 - protein, 17 aa, Mycobacterium
DTLRWTVTTDAGTVLSA

SEQ ID NO: 1251619 - protein, 25 aa, Mycobacterium
DTLTALNGTIVWKGLADRDKVFDAG

SEQ ID NO: 1251620 - protein, 21 aa, Mycobacterium
DTLTMFGAIGFTWEHDLHLYW

SEQ ID NO: 1251621 - protein, 24 aa, Mycobacterium
DTLTVFHPQSFRAFASPLSSGVFV

SEQ ID NO: 1251622 - protein, 37 aa, Mycobacterium; identical to SEQ ID NO: 649186

SEQ ID NO: 1251623 - protein, 18 aa, Mycobacterium
DTMYGFLLTLRQKGPHGG

SEQ ID NO: 1251624 - protein, 25 aa, Mycobacterium
DTNTRFCAHWGLARGGRVAYVNGFT

SEQ ID NO: 1251625 - protein, 19 aa, Mycobacterium
DTPIPFGVWQRVSVAVRNR

SEQ ID NO: 1251626 - protein, 20 aa, Mycobacterium
DTPRPGPCAVGSVKSNIGHL

SEQ ID NO: 1251627 - protein, 21 aa, Mycobacterium
DTRTVLGFCLSVIHNGEVRGQ

SEQ ID NO: 1251628 - protein, 19 aa, Mycobacterium
DTSPEGYSWIDANDSTNNV

SEQ ID NO: 1251629 - protein, 24 aa, Mycobacterium
DTTPRVAQMFGVQAVPTVVALAGG

SEQ ID NO: 1251630 - protein, 18 aa, Mycobacterium
DTVILEWAVSGVVVKTGK

SEQ ID NO: 1251631 - protein, 24 aa, Mycobacterium
DTYRFYFCSTACLRQFADRVGDMS

SEQ ID NO: 1251632 - protein, 19 aa, Mycobacterium
DVAANWKLIVENFMECYHC

SEQ ID NO: 1251633 - protein, 17 aa, Mycobacterium
DVAGHLVELGFHADAAD

SEQ ID NO: 1251634 - protein, 19 aa, Mycobacterium
DVAIPRLRRVLVAPCTTTV

SEQ ID NO: 1251635 - protein, 19 aa, Mycobacterium
DVAKMIGAPIFHVNGDDPE

SEQ ID NO: 1251636 - protein, 37 aa, Mycobacterium
DVDAECPGATWAMATRRAAVFGCASGALRLTDGGATP

SEQ ID NO: 1251637 - protein, 27 aa, Mycobacterium
DVGAYNPCFPQYRFDNIGDETASGSVT

SEQ ID NO: 1251638 - protein, 24 aa, Mycobacterium
DVGSYRWSGPGGLRVNARAGVRAW

SEQ ID NO: 1251639 - protein, 29 aa, Mycobacterium
DVHLAIRPGQDWALLLAMVKVVLDEGLEH

SEQ ID NO: 1251640 - protein, 23 aa, Mycobacterium
DVIPAEWRCELVWHAEPPTTPAD

SEQ ID NO: 1251641 - protein, 21 aa, Mycobacterium
DVKPLECVFFMRDVRSAQYFE

SEQ ID NO: 1251642 - protein, 20 aa, Mycobacterium
DVKSGWKVAETFPAVPSSAD

SEQ ID NO: 1251643 - protein, 27 aa, Mycobacterium
DVLEVEEARALAALLTKHADKLESSDR

SEQ ID NO: 1251644 - protein, 28 aa, Mycobacterium
DVLGNLMKWPAVERVWLPEWLNHRDEVL

SEQ ID NO: 1251645 - protein, 19 aa, Mycobacterium
DVLKDGALGIHRLRRRSRQ

SEQ ID NO: 1251646 - protein, 19 aa, Mycobacterium
DVPDERRGAGFVSACALVD

SEQ ID NO: 1251647 - protein, 23 aa, Mycobacterium
DVPGIRADFPILQRVMRGGNQLA

SEQ ID NO: 1251648 - protein, 26 aa, Mycobacterium
DVPPPFGFKRSGQWLWWDNTTTEESI

SEQ ID NO: 1251649 - protein, 19 aa, Mycobacterium
DVRATVLAMNGMDALTRTG

SEQ ID NO: 1251650 - protein, 17 aa, Mycobacterium
DVRRVHRLLAYVPADVA

SEQ ID NO: 1251651 - protein, 21 aa, Mycobacterium
DVRTARIVTPRVMQVTLRGQL

SEQ ID NO: 1251652 - protein, 32 aa, Mycobacterium
DVTGTLMLPLGVRRLSAHASMRNAHYCYVTVT

SEQ ID NO: 1251653 - protein, 22 aa, Mycobacterium
DVTRRTGVEWVAAYGTTELPVI

SEQ ID NO: 1251654 - protein, 32 aa, Mycobacterium
DVWFPGKKGGPGWVEWGGCGMVNPNVLRACGI

SEQ ID NO: 1251655 - protein, 19 aa, Mycobacterium
DVYRRARVVAREDDPSGAV

SEQ ID NO: 1251656 - protein, 22 aa, Mycobacterium
DVYSRRVVGWSIADHLRTELVA

SEQ ID NO: 1251657 - protein, 20 aa, Mycobacterium
DVYYCVVDARGWLRDPAPLF

SEQ ID NO: 1251658 - protein, 19 aa, Mycobacterium
DWASEYIQVLQLLWDSWED

SEQ ID NO: 1251659 - protein, 18 aa, Mycobacterium
DWDRNYVHSLDWRWLTRP

SEQ ID NO: 1251660 - protein, 22 aa, Mycobacterium
DWHRWLWEAWTIDGLAGGRWAL

SEQ ID NO: 1251661 - protein, 24 aa, Mycobacterium
DWKTNWLGEREKPLTAADYSRTRM

SEQ ID NO: 1251662 - protein, 24 aa, Mycobacterium
DWNRAGSARAWWVLTAAGVADVRI

SEQ ID NO: 1251663 - protein, 22 aa, Mycobacterium
DWQPTACILCECNCGIVVEVEG

SEQ ID NO: 1251664 - protein, 20 aa, Mycobacterium
DWRIILHSPYGLRVHGPLAL

SEQ ID NO: 1251665 - protein, 21 aa, Mycobacterium
DWSELLKALAKEAGADAPVGD

SEQ ID NO: 1251666 - protein, 27 aa, Mycobacterium
DWTDKPRLLATFPFPHVLTMSVTLADR

SEQ ID NO: 1251667 - protein, 23 aa, Mycobacterium
DYLATRVSHQFNLRGPSVTVQTA

SEQ ID NO: 1251668 - protein, 18 aa, Mycobacterium
DYLEMVNPLWTTKELRGK

SEQ ID NO: 1251669 - protein, 19 aa, Mycobacterium
DYMKARAVTRLDQGMGGGK

SEQ ID NO: 1251670 - protein, 24 aa, Mycobacterium
DYPTWRAKVRKLPALDTAALRPAQ

SEQ ID NO: 1251671 - protein, 26 aa, Mycobacterium
DYSDASDLFYVWIKRALAGSWPEIGF

SEQ ID NO: 1251672 - protein, 25 aa, Mycobacterium
EAALALRAGALWVAANVDLTLPSER

SEQ ID NO: 1251673 - protein, 25 aa, Mycobacterium
EAALARAGLDLADIDLIELNEAFAA

SEQ ID NO: 1251674 - protein, 19 aa, Mycobacterium
EAALRPCDKPVPTAGLRRL

SEQ ID NO: 1251675 - protein, 24 aa, Mycobacterium
EAARKECYQALAVALAAGRPGVWD

SEQ ID NO: 1251676 - protein, 26 aa, Mycobacterium
EAARRGGEWLDWFAAERITAIGMGMI

SEQ ID NO: 1251677 - protein, 26 aa, Mycobacterium
EAAVDIWLRRIARRKVSPTVRNRLVR

SEQ ID NO: 1251678 - protein, 24 aa, Mycobacterium
EACECPGGCPSCVQSPKCGNGNDP

SEQ ID NO: 1251679 - protein, 27 aa, Mycobacterium
EADAAPTRFARGWHCLGLTRDFGDGKP

SEQ ID NO: 1251680 - protein, 21 aa, Mycobacterium
EADIFKIEFARMEALLHAVRL

SEQ ID NO: 1251681 - protein, 18 aa, Mycobacterium
EADLVLLAMGFVGPEKDG

SEQ ID NO: 1251682 - protein, 19 aa, Mycobacterium
EADPLRLLIYTSGSAGAPK

SEQ ID NO: 1251683 - protein, 21 aa, Mycobacterium
EAEAAEPLAEWEQELLAGATA

SEQ ID NO: 1251684 - protein, 20 aa, Mycobacterium
EAEGVLWSWTLDLVTGTVRE

SEQ ID NO: 1251685 - protein, 18 aa, Mycobacterium
EAELGWIATAFDPDVLTV

SEQ ID NO: 1251686 - protein, 18 aa, Mycobacterium
EAELPELLDRALPRTELV

SEQ ID NO: 1251687 - protein, 23 aa, Mycobacterium
EAEPGLRIAVPLPNADGAEVTTV

SEQ ID NO: 1251688 - protein, 20 aa, Mycobacterium
EAEVRYPARYALDARSVPSD

SEQ ID NO: 1251689 - protein, 17 aa, Mycobacterium
EAGAALLTLDAPTRGLL

SEQ ID NO: 1251690 - protein, 22 aa, Mycobacterium
EAGFAHLGGRPAPMAAAELQQH

SEQ ID NO: 1251691 - protein, 22 aa, Mycobacterium
EAGSKVKVTIMFRGREQSRPEL

SEQ ID NO: 1251692 - protein, 19 aa, Mycobacterium
EAGVPFGLKPEAIIPAYGM

SEQ ID NO: 1251693 - protein, 20 aa, Mycobacterium
EAGVQPWDAKGYKLPGGTPA

SEQ ID NO: 1251694 - protein, 20 aa, Mycobacterium
EAGVSRPTVYRRWPSKAHVV

SEQ ID NO: 1251695 - protein, 26 aa, Mycobacterium
EAHDPARCLYCRQPLGDDARALVSKY

SEQ ID NO: 1251696 - protein, 19 aa, Mycobacterium
EAIRAVNRPVLIIVDEVLD

SEQ ID NO: 1251697 - protein, 17 aa, Mycobacterium
EAIRLRVPVPSIAASLF

SEQ ID NO: 1251698 - protein, 20 aa, Mycobacterium
EAKLVFGGEALIVAGGADRT

SEQ ID NO: 1251699 - protein, 24 aa, Mycobacterium
EALARRIAPVPVRMADERLTTVSA

SEQ ID NO: 1251700 - protein, 23 aa, Mycobacterium
EALCAALPRSVHAEIGIADGSWV

SEQ ID NO: 1251701 - protein, 18 aa, Mycobacterium
EALGKLYVQRHFPPNAKA

SEQ ID NO: 1251702 - protein, 18 aa, Mycobacterium
EALIREGGGWGLDEVAEL

SEQ ID NO: 1251703 - protein, 18 aa, Mycobacterium
EALIRMDLAEMLRDEGYE

SEQ ID NO: 1251704 - protein, 18 aa, Mycobacterium
EALLLGSSYVIVWADRFG

SEQ ID NO: 1251705 - protein, 21 aa, Mycobacterium
EALPEAAWQRSVHAVLTADVV

SEQ ID NO: 1251706 - protein, 19 aa, Mycobacterium
EALPPETFDLVIVDEAHRS

SEQ ID NO: 1251707 - protein, 19 aa, Mycobacterium
EALRTFGKRLIDLTPAAVG

SEQ ID NO: 1251708 - protein, 25 aa, Mycobacterium
EALSARPGIVLSRRQLLEIVRDGPW

SEQ ID NO: 1251709 - protein, 25 aa, Mycobacterium
EAMDTIVGFAHRWSGSQSIGRTSTL

SEQ ID NO: 1251710 - protein, 36 aa, Mycobacterium
EAMGLLRGGDSWMFVGWCRLREGIRGFHLDRIRHLE

SEQ ID NO: 1251711 - protein, 21 aa, Mycobacterium
EANPRAAERAATFIFMASIVG

SEQ ID NO: 1251712 - protein, 21 aa, Mycobacterium
EAQRGKQDWALVDVTDIEAFL

SEQ ID NO: 1251713 - protein, 17 aa, Mycobacterium
EARAHWDVIAAKYAAPG

SEQ ID NO: 1251714 - protein, 17 aa, Mycobacterium
EARARKLIDAQLTQAGW

SEQ ID NO: 1251715 - protein, 19 aa, Mycobacterium
EAREALQTCYGKQESIAAI

SEQ ID NO: 1251716 - protein, 20 aa, Mycobacterium
EARPLPDPFIVAATQNPIEY

SEQ ID NO: 1251717 - protein, 21 aa, Mycobacterium
EASAKFSRKIVELNLLGALSV

SEQ ID NO: 1251718 - protein, 18 aa, Mycobacterium
EASAKINQLLDIAAANQN

SEQ ID NO: 1251719 - protein, 23 aa, Mycobacterium
EASGELKPGGTIVEPTSGNTGVG

SEQ ID NO: 1251720 - protein, 23 aa, Mycobacterium
EASGELKPGGTLVEPTSGNTGVG

SEQ ID NO: 1251721 - protein, 23 aa, Mycobacterium
EATAETFRDGWMHTGDLAREDED

SEQ ID NO: 1251722 - protein, 19 aa, Mycobacterium
EATIVRAGKRMIVTAVDVT

SEQ ID NO: 1251723 - protein, 25 aa, Mycobacterium
EATPPQMGAKSWKEVLAVRWRISTS

SEQ ID NO: 1251724 - protein, 23 aa, Mycobacterium
EATRVPFVIARTGANATAARTVT

SEQ ID NO: 1251725 - protein, 25 aa, Mycobacterium
EAVLARLDGIRGWQEDCYRDLHRHP

SEQ ID NO: 1251726 - protein, 17 aa, Mycobacterium
EAYPPRLAEDWDSVGLV

SEQ ID NO: 1251727 - protein, 20 aa, Mycobacterium
ECAHCGCRILGHGVETDEAI

SEQ ID NO: 1251728 - protein, 17 aa, Mycobacterium
ECARCLTQVTGEVEIEL

SEQ ID NO: 1251729 - protein, 19 aa, Mycobacterium
ECELCGAAGDFFLRGRTGG

SEQ ID NO: 1251730 - protein, 29 aa, Mycobacterium
ECGGCGRPSTWWCEPCAATLTVRADEPHL

SEQ ID NO: 1251731 - protein, 26 aa, Mycobacterium
EDAAMKLFWERGFDGVSISDVTAATG

SEQ ID NO: 1251732 - protein, 24 aa, Mycobacterium
EDAEVYLCGGNGFVQAVRAQLQER

SEQ ID NO: 1251733 - protein, 17 aa, Mycobacterium
EDAVLGVFCRRWGVPLI

SEQ ID NO: 1251734 - protein, 18 aa, Mycobacterium
EDEFGYRSIYVAYTAGDT

SEQ ID NO: 1251735 - protein, 23 aa, Mycobacterium
EDFRVAGQLLPRYPAKQVEGGLI

SEQ ID NO: 1251736 - protein, 23 aa, Mycobacterium
EDHPVDCTHCWELANPALDDFLH

SEQ ID NO: 1251737 - protein, 36 aa, Mycobacterium
EDLIAAGAYLWLRAWPVPGGDLWAVPTGWRVGDHAP

SEQ ID NO: 1251738 - protein, 17 aa, Mycobacterium
EDPGRGFLPTGGTVHAL

SEQ ID NO: 1251739 - protein, 25 aa, Mycobacterium
EDPLGFPYEFFYDVVHVERMAWRYD

SEQ ID NO: 1251740 - protein, 20 aa, Mycobacterium
EDPRLNVLLLEAGGGDRNLW

SEQ ID NO: 1251741 - protein, 18 aa, Mycobacterium
EDQSWRYKDLQYWTELAK

SEQ ID NO: 1251742 - protein, 24 aa, Mycobacterium
EDYLDGWPGTLIVVTHDRYFLERV

SEQ ID NO: 1251743 - protein, 17 aa, Mycobacterium
EDYPQFQRWSISLLSWI

SEQ ID NO: 1251744 - protein, 23 aa, Mycobacterium
EEAERRRAEGRSYTKNDYLQEDS

SEQ ID NO: 1251745 - protein, 23 aa, Mycobacterium
EEAIVLAGLARRSAAVPVAETDL

SEQ ID NO: 1251746 - protein, 20 aa, Mycobacterium
EEELKHFVKVMPRDFKRVLA

SEQ ID NO: 1251747 - protein, 32 aa, Mycobacterium
EEELRSALLAHARKRLGAAVAPKEIEFADALP

SEQ ID NO: 1251748 - protein, 20 aa, Mycobacterium
EEFLALKVEGVLDCAELLVV

SEQ ID NO: 1251749 - protein, 26 aa, Mycobacterium
EEFLHGAACHFCLFLSETSCERTNRF

SEQ ID NO: 1251750 - protein, 25 aa, Mycobacterium
EEGIKDLIGANGWENLKGAWTDMAK

SEQ ID NO: 1251751 - protein, 17 aa, Mycobacterium
EEGIKGAVEDVKGKAKE

SEQ ID NO: 1251752 - protein, 23 aa, Mycobacterium
EEIAQAVLFLASPRSSFVTGAVL

SEQ ID NO: 1251753 - protein, 21 aa, Mycobacterium
EESLPMFIVYRHEEIQQMLRD

SEQ ID NO: 1251754 - protein, 19 aa, Mycobacterium
EETARLLGIDPKRYAKFER

SEQ ID NO: 1251755 - protein, 19 aa, Mycobacterium
EEVELSGLLGRGGAAFPMA

SEQ ID NO: 1251756 - protein, 17 aa, Mycobacterium
EEVKSVPDLAVLLRMLP

SEQ ID NO: 1251757 - protein, 27 aa, Mycobacterium
EEVPRHMLETWAFRTFTVHPRENRFDA

SEQ ID NO: 1251758 - protein, 19 aa, Mycobacterium
EFARTALCLNEGSQYRYHA

SEQ ID NO: 1251759 - protein, 25 aa, Mycobacterium
EFDGRIITVPFSFKEIDSEGLISYV

SEQ ID NO: 1251760 - protein, 20 aa, Mycobacterium
EFLDELRAAGADVVPIRVYR

SEQ ID NO: 1251761 - protein, 19 aa, Mycobacterium
EFLEELAVFRDAVVQHAEL

SEQ ID NO: 1251762 - protein, 20 aa, Mycobacterium
EFLRRARRALPGDPDFGDPL

SEQ ID NO: 1251763 - protein, 17 aa, Mycobacterium
EFPESGFDRVFDVNVKG

SEQ ID NO: 1251764 - protein, 17 aa, Mycobacterium
EFRRELRACPADERGYL

SEQ ID NO: 1251765 - protein, 19 aa, Mycobacterium
EFRVLRDRLFETLAAVEPE

SEQ ID NO: 1251766 - protein, 19 aa, Mycobacterium
EFTCSIYADWPIDRRLDAF

SEQ ID NO: 1251767 - protein, 23 aa, Mycobacterium
EFVWDRRIERLLAFGRGQHFCLG

SEQ ID NO: 1251768 - protein, 19 aa, Mycobacterium
EFYGPRGAQHVRLALTATD

SEQ ID NO: 1251769 - protein, 23 aa, Mycobacterium
EGADLILVDICRSLPELEYPLAT

SEQ ID NO: 1251770 - protein, 20 aa, Mycobacterium
EGAPDDAMWVRTGDLGAFHD

SEQ ID NO: 1251771 - protein, 25 aa, Mycobacterium
EGASRPGHFAGVLTVVCKLLHIVRP

SEQ ID NO: 1251772 - protein, 19 aa, Mycobacterium
EGDATLSPSGRVVALNHAR

SEQ ID NO: 1251773 - protein, 19 aa, Mycobacterium
EGDFLFPAPAPRFSRTTTT

SEQ ID NO: 1251774 - protein, 19 aa, Mycobacterium
EGDGLAVNGSKTWISNARR

SEQ ID NO: 1251775 - protein, 24 aa, Mycobacterium
EGDLTELEMQWGRTIGQLPSPYTA

SEQ ID NO: 1251776 - protein, 21 aa, Mycobacterium
EGERLPLPSIVVVEIKRPMRK

SEQ ID NO: 1251777 - protein, 19 aa, Mycobacterium
EGFAEGWRTIARSLAGRPA

SEQ ID NO: 1251778 - protein, 20 aa, Mycobacterium
EGFLSTHLVGGVAPGTIVRL

SEQ ID NO: 1251779 - protein, 31 aa, Mycobacterium
EGFYWPREIDPGTWLSVRCPVEGSSRPIEEV

SEQ ID NO: 1251780 - protein, 18 aa, Mycobacterium
EGGLNVARAEWLRALAEL

SEQ ID NO: 1251781 - protein, 26 aa, Mycobacterium
EGGPDRWDFVAAYGRDGRVIAVLSTI

SEQ ID NO: 1251782 - protein, 21 aa, Mycobacterium
EGGSRFVSAPVFGRPEAAAAA

SEQ ID NO: 1251783 - protein, 17 aa, Mycobacterium
EGIGSCVDALNGLFAGV

SEQ ID NO: 1251784 - protein, 26 aa, Mycobacterium
EGKTRLARIGFDRVIGYLERPFEAML

SEQ ID NO: 1251785 - protein, 19 aa, Mycobacterium
EGLEILKTMMEGFPVGDPW

SEQ ID NO: 1251786 - protein, 32 aa, Mycobacterium
EGLGGFACSEFLPGGMIFHWLSPVDLTGQWPD

SEQ ID NO: 1251787 - protein, 19 aa, Mycobacterium
EGLGLMRVALRREPSVPLR

SEQ ID NO: 1251788 - protein, 22 aa, Mycobacterium
EGQPGPVSVLFLDLDRLKTVND

SEQ ID NO: 1251789 - protein, 18 aa, Mycobacterium
EGRIALEEILIRFPDWEV

SEQ ID NO: 1251790 - protein, 23 aa, Mycobacterium
EGRPAVDDFTRYVSACQVLGTCG

SEQ ID NO: 1251791 - protein, 21 aa, Mycobacterium
EGSPSRIAFVFPGQGTQWPSM

SEQ ID NO: 1251792 - protein, 17 aa, Mycobacterium
EGVEIAFTPTVGDMYPD

SEQ ID NO: 1251793 - protein, 17 aa, Mycobacterium
EGVFLQFDESVIGSWEQ

SEQ ID NO: 1251794 - protein, 18 aa, Mycobacterium
EGYACEWKGVLEDPDKLS

SEQ ID NO: 1251795 - protein, 24 aa, Mycobacterium
EGYKMSGNAPIYAILREARDRAKA

SEQ ID NO: 1251796 - protein, 17 aa, Mycobacterium
EGYTAQMYSGRQSKPDR

SEQ ID NO: 1251797 - protein, 23 aa, Mycobacterium
EHARSTAYHAVWALTNGSDDAAL

SEQ ID NO: 1251798 - protein, 29 aa, Mycobacterium
EHCNFSYKDMEAWGRKMFVTPGVVVDGKL

SEQ ID NO: 1251799 - protein, 26 aa, Mycobacterium
EHFPAGEMQLDFWSRFGSRAQQKNNT

SEQ ID NO: 1251800 - protein, 19 aa, Mycobacterium
EHGIAFVPFFPLGSAFTAD

SEQ ID NO: 1251801 - protein, 22 aa, Mycobacterium
EHLDPALLRSAGRAVPIAEVKI

SEQ ID NO: 1251802 - protein, 17 aa, Mycobacterium
EHLGHCVTQAVAEGGEQ

SEQ ID NO: 1251803 - protein, 23 aa, Mycobacterium
EHMGRAADMAISFDPNLYTVESV

SEQ ID NO: 1251804 - protein, 25 aa, Mycobacterium
EHTRFGTEVEALWWDDDRQEWQIHA

SEQ ID NO: 1251805 - protein, 20 aa, Mycobacterium
EHTRSLLLDAAEDVFAEKGF

SEQ ID NO: 1251806 - protein, 17 aa, Mycobacterium
EIADALIERCVSEFGRI

SEQ ID NO: 1251807 - protein, 23 aa, Mycobacterium
EIARRAGVGPGTIYRHFPTKEAL

SEQ ID NO: 1251808 - protein, 22 aa, Mycobacterium
EIATRTSAFLTHPAFTRYRTET

SEQ ID NO: 1251809 - protein, 30 aa, Mycobacterium
EIDRFNELVLRAGLSWQQVMVLRAYAKYLR

SEQ ID NO: 1251810 - protein, 31 aa, Mycobacterium
EIDSGAVLLPEFQRGYVWNRDQVRGLMRSLY

SEQ ID NO: 1251811 - protein, 22 aa, Mycobacterium
EIESYAPLMAYLVRSLQSGGDL

SEQ ID NO: 1251812 - protein, 21 aa, Mycobacterium
EIGAPSVTSWVRGVVGTLRRE

SEQ ID NO: 1251813 - protein, 34 aa, Mycobacterium
EIHRDWNARYTWPRFVCGLPREFFAAVRAEMSDR

SEQ ID NO: 1251814 - protein, 17 aa, Mycobacterium
EILEPFHGRVFDPACGS

SEQ ID NO: 1251815 - protein, 28 aa, Mycobacterium
EINAKPWWRDRIRAGLASYWVYQHMGNL

SEQ ID NO: 1251816 - protein, 18 aa, Mycobacterium
EINEAFASVVLSWAQVHG

SEQ ID NO: 1251817 - protein, 18 aa, Mycobacterium
EINRRFGTPIPPDTGEVD

SEQ ID NO: 1251818 - protein, 20 aa, Mycobacterium
EINRRPGPQTGQSGFDAFGI

SEQ ID NO: 1251819 - protein, 24 aa, Mycobacterium
EIPDRLEPEIALLIAGVSTDVVGA

SEQ ID NO: 1251820 - protein, 27 aa, Mycobacterium
EIRRRYPDWERWGLAPADMLMAAAGPA

SEQ ID NO: 1251821 - protein, 24 aa, Mycobacterium
EIRTRRLGVMGGTFDPIHHGHLVA

SEQ ID NO: 1251822 - protein, 19 aa, Mycobacterium
EISAATLLEDFGFTGDKLT

SEQ ID NO: 1251823 - protein, 23 aa, Mycobacterium
EISCGRAAVILDGERGALLFFAA

SEQ ID NO: 1251824 - protein, 18 aa, Mycobacterium
EKAQAAGHFDRRLGSIEI

SEQ ID NO: 1251825 - protein, 27 aa, Mycobacterium
EKDPRWTQGRLRWDHVVVLPNTELPAD

SEQ ID NO: 1251826 - protein, 19 aa, Mycobacterium
EKLNALSYELVEAFHTTLG

SEQ ID NO: 1251827 - protein, 19 aa, Mycobacterium
EKLQDVWGEALARGTAKRQ

SEQ ID NO: 1251828 - protein, 28 aa, Mycobacterium
EKLRKKRLMTLVHLWLVHRFKADAVYYV

SEQ ID NO: 1251829 - protein, 22 aa, Mycobacterium
EKWRVGDRVTTPFVCGCGRCQW

SEQ ID NO: 1251830 - protein, 20 aa, Mycobacterium
ELAARTPLGVALSGHDHAWS

SEQ ID NO: 1251831 - protein, 19 aa, Mycobacterium
ELADAWEPIFFYPEKLQDV

SEQ ID NO: 1251832 - protein, 22 aa, Mycobacterium
ELAEAIAAAAADAGRSYLRVPA

SEQ ID NO: 1251833 - protein, 21 aa, Mycobacterium
ELAVALGTILMRLDLRMSQRD

SEQ ID NO: 1251834 - protein, 21 aa, Mycobacterium
ELCRRFCRKLGITVASVDYRL

SEQ ID NO: 1251835 - protein, 20 aa, Mycobacterium
ELDAASGWTAQDWAQVGDEY

SEQ ID NO: 1251836 - protein, 26 aa, Mycobacterium
ELDGGKHSLRWPRQATLVDAMIAAGL

SEQ ID NO: 1251837 - protein, 17 aa, Mycobacterium
ELEASIMDRLWNRDPDA

SEQ ID NO: 1251838 - protein, 17 aa, Mycobacterium
ELFLHLRANAGVTETQR

SEQ ID NO: 1251839 - protein, 18 aa, Mycobacterium
ELFSRSSAVVRRYGGTVD

SEQ ID NO: 1251840 - protein, 24 aa, Mycobacterium
ELGCKEALFTLGDRPEARWDEARQ

SEQ ID NO: 1251841 - protein, 26 aa, Mycobacterium
ELGRPSRLKGAGFYSYVDGKRAGLWP

SEQ ID NO: 1251842 - protein, 52 aa, Mycobacterium
ELINPAAGPEFGFSLAGPIGALLLWRAGLADSIRTIFGFGRAAAESQVSDLP

SEQ ID NO: 1251843 - protein, 18 aa, Mycobacterium
ELIRRFDLDLDRPGKAYS

SEQ ID NO: 1251844 - protein, 19 aa, Mycobacterium
ELIYGPARSGPWKTVEDVE

SEQ ID NO: 1251845 - protein, 17 aa, Mycobacterium
ELKKNKSVRAWRLPMGF

SEQ ID NO: 1251846 - protein, 21 aa, Mycobacterium
ELKRRGGVRSAFFTPGEVDDL

SEQ ID NO: 1251847 - protein, 25 aa, Mycobacterium
ELLARRFEPVLFFHPDEVFFPSDAK

SEQ ID NO: 1251848 - protein, 19 aa, Mycobacterium
ELLPHAQGIVGILPPVVDE

SEQ ID NO: 1251849 - protein, 17 aa, Mycobacterium
ELLRGFLDWLFERYHQI

SEQ ID NO: 1251850 - protein, 18 aa, Mycobacterium
ELMTRAGVEILVAAGPEF

SEQ ID NO: 1251851 - protein, 20 aa, Mycobacterium
ELNAAVNPIQTWIEVFGQAA

SEQ ID NO: 1251852 - protein, 21 aa, Mycobacterium
ELPADFGLPDCPRWKVVDRTD

SEQ ID NO: 1251853 - protein, 21 aa, Mycobacterium
ELPHLRDVIVKALVSVEGDLQ

SEQ ID NO: 1251854 - protein, 23 aa, Mycobacterium
ELPVFPFKRQCPFAPADDYADGG

SEQ ID NO: 1251855 - protein, 29 aa, Mycobacterium
ELPVSSVLCTLELAGRLHLDLASLSLAAL

SEQ ID NO: 1251856 - protein, 20 aa, Mycobacterium
ELQALTFISGEQWLTHRGSV

SEQ ID NO: 1251857 - protein, 19 aa, Mycobacterium
ELRARAANLPVMLIGDGWN

SEQ ID NO: 1251858 - protein, 20 aa, Mycobacterium
ELRASAKAALERRCGITGLA

SEQ ID NO: 1251859 - protein, 20 aa, Mycobacterium
ELRIARGRRVVRVEYRSPRG

SEQ ID NO: 1251860 - protein, 27 aa, Mycobacterium
ELRPRKMREAAVLWERLTEAVGADARD

SEQ ID NO: 1251861 - protein, 17 aa, Mycobacterium
ELRTSWRNPPSTLHLAN

SEQ ID NO: 1251862 - protein, 27 aa, Mycobacterium
ELSGLAMAGAEFTVGVAPLAARADDSA

SEQ ID NO: 1251863 - protein, 24 aa, Mycobacterium
ELSRSVFSKGIFPAVDPLASSSTI

SEQ ID NO: 1251864 - protein, 20 aa, Mycobacterium
ELTGCFLPAMIAAKRGVVLN

SEQ ID NO: 1251865 - protein, 20 aa, Mycobacterium
ELTLPSGVRVRLFRPTGVPV

SEQ ID NO: 1251866 - protein, 26 aa, Mycobacterium
ELVDIPFKFHHPMWRENCEVDLEYHI

SEQ ID NO: 1251867 - protein, 21 aa, Mycobacterium
ELVSALPLFPYMDIHVTPLAR

SEQ ID NO: 1251868 - protein, 24 aa, Mycobacterium
ELYEIDYADGLRIARTLRTQVSPG

SEQ ID NO: 1251869 - protein, 19 aa, Mycobacterium
EMHRLAGAFGDVIAAEARE

SEQ ID NO: 1251870 - protein, 25 aa, Mycobacterium
EMMRSWWPAADRGFHAARVALRAAL

SEQ ID NO: 1251871 - protein, 20 aa, Mycobacterium
EMPKVLAAFDSNWGDARTNL

SEQ ID NO: 1251872 - protein, 20 aa, Mycobacterium
ENHPLLCLVDVGGVPTLLWK

SEQ ID NO: 1251873 - protein, 23 aa, Mycobacterium
ENITRLNVGIAMVTDRLPFSNPI

SEQ ID NO: 1251874 - protein, 24 aa, Mycobacterium
ENKYRLVFEKLRLQPGARLLDLGC

SEQ ID NO: 1251875 - protein, 18 aa, Mycobacterium
ENLREHRRGLLVDVVTDV

SEQ ID NO: 1251876 - protein, 23 aa, Mycobacterium
ENMRARMYAALGITEQGFSTDAC

SEQ ID NO: 1251877 - protein, 19 aa, Mycobacterium
ENQKRLGIVPSDTELSPMN

SEQ ID NO: 1251878 - protein, 18 aa, Mycobacterium
ENRARLTAEVVEAVADEI

SEQ ID NO: 1251879 - protein, 23 aa, Mycobacterium
ENRMISWPYPKLMNSNNMVDQGA

SEQ ID NO: 1251880 - protein, 24 aa, Mycobacterium
ENTRALDLLAKWGDVPTAPPVAPV

SEQ ID NO: 1251881 - protein, 25 aa, Mycobacterium
ENVPPRPEDLAGWAGDVFDHHQRFP

SEQ ID NO: 1251882 - protein, 19 aa, Mycobacterium
ENYQLQWERRSGFARLAIA

SEQ ID NO: 1251883 - protein, 19 aa, Mycobacterium
EPDGLFVKNLENVQGDERD

SEQ ID NO: 1251884 - protein, 19 aa, Mycobacterium
EPDPRYRGSLQDTRDTILT

SEQ ID NO: 1251885 - protein, 26 aa, Mycobacterium
EPDSMLHFFRRALRLRRDRCGVDGAT

SEQ ID NO: 1251886 - protein, 20 aa, Mycobacterium
EPEIPYYSATLYDPRDPAEF

SEQ ID NO: 1251887 - protein, 23 aa, Mycobacterium
EPESRARLIFNVPRPETLARYLR

SEQ ID NO: 1251888 - protein, 19 aa, Mycobacterium
EPHRVCRYLEDLAGDYHRF

SEQ ID NO: 1251889 - protein, 23 aa, Mycobacterium
EPHYRPSATLAAFVRARDLFCRF

SEQ ID NO: 1251890 - protein, 18 aa, Mycobacterium
EPIPEGYIALRCATFRGY

SEQ ID NO: 1251891 - protein, 18 aa, Mycobacterium
EPLASVLPGGRLYNSYRP

SEQ ID NO: 1251892 - protein, 23 aa, Mycobacterium
EPLLRKRHGAWIGWAGIPDSAED

SEQ ID NO: 1251893 - protein, 17 aa, Mycobacterium
EPPGCAPPRVGPGPEHA

SEQ ID NO: 1251894 - protein, 18 aa, Mycobacterium
EPPPRTGVHCAFTEAARR

SEQ ID NO: 1251895 - protein, 20 aa, Mycobacterium
EPRPSWGNPKYDPIWAAAAK

SEQ ID NO: 1251896 - protein, 24 aa, Mycobacterium
EPRYARAGAAFGFGPAGGGHGGGI

SEQ ID NO: 1251897 - protein, 18 aa, Mycobacterium
EPSLLAWLVRTLPAAISE

SEQ ID NO: 1251898 - protein, 23 aa, Mycobacterium
EPTAEWDAQAWRTRVRSSFDAGL

SEQ ID NO: 1251899 - protein, 20 aa, Mycobacterium
EPTFVPVLGRIAAGGPILAE

SEQ ID NO: 1251900 - protein, 17 aa, Mycobacterium
EPVAFLAQLGRDHRKYG

SEQ ID NO: 1251901 - protein, 25 aa, Mycobacterium
EQGDPRFSDVSSRVFGTPHDVDVGA

SEQ ID NO: 1251902 - protein, 20 aa, Mycobacterium
EQHHRPLVLVSAGIGITPMI

SEQ ID NO: 1251903 - protein, 21 aa, Mycobacterium
EQHPIPEWIVVGAGTGGTSAT

SEQ ID NO: 1251904 - protein, 17 aa, Mycobacterium
EQLAIDEAIVWPQQGRV

SEQ ID NO: 1251905 - protein, 18 aa, Mycobacterium
EQLEAMMAVLAGRDVVAV

SEQ ID NO: 1251906 - protein, 19 aa, Mycobacterium
EQLGWPRVRIHYTSGTRIP

SEQ ID NO: 1251907 - protein, 23 aa, Mycobacterium
EQLPGLVGGFGPEWVGVSVTMPG

SEQ ID NO: 1251908 - protein, 21 aa, Mycobacterium
EQMHACGVIDVATGRATKVAA

SEQ ID NO: 1251909 - protein, 17 aa, Mycobacterium
EQMKALFGLGLHPNADR

SEQ ID NO: 1251910 - protein, 17 aa, Mycobacterium
EQRVAAIIREMAPQIYL

SEQ ID NO: 1251911 - protein, 20 aa, Mycobacterium
EQYGFPHWTVYDEAHLLGPG

SEQ ID NO: 1251912 - protein, 25 aa, Mycobacterium
EQYTYWRIALPHAEAATFDAALRSH

SEQ ID NO: 1251913 - protein, 18 aa, Mycobacterium
EQYTYWRIALPHEEAATF

SEQ ID NO: 1251914 - protein, 18 aa, Mycobacterium
ERAGLRFDIPGFIVNDPA

SEQ ID NO: 1251915 - protein, 17 aa, Mycobacterium
ERASELTGAPVLPAITL

SEQ ID NO: 1251916 - protein, 23 aa, Mycobacterium
ERDGRVWLERGCRSHGLVRTLYD

SEQ ID NO: 1251917 - protein, 28 aa, Mycobacterium
ERETACAFYGRRLYELMSAYWPTADKTP

SEQ ID NO: 1251918 - protein, 17 aa, Mycobacterium
ERFDDFMMEQGLRPRSR

SEQ ID NO: 1251919 - protein, 23 aa, Mycobacterium
ERFFAEEVYREFGYAGPADVVEA

SEQ ID NO: 1251920 - protein, 17 aa, Mycobacterium
ERGRACGALRPGATIVE

SEQ ID NO: 1251921 - protein, 17 aa, Mycobacterium
ERGRVGGALVTEIYSVG

SEQ ID NO: 1251922 - protein, 20 aa, Mycobacterium
ERHPDVPLQLCTVAAADAAD

SEQ ID NO: 1251923 - protein, 23 aa, Mycobacterium
ERHPPFDALALWFDRVADYARVK

SEQ ID NO: 1251924 - protein, 36 aa, Mycobacterium
ERHTYELPLPPSLRARAEWHRFTITLAYMAPTVGQL

SEQ ID NO: 1251925 - protein, 25 aa, Mycobacterium
ERIALNAGFLWACSGYYNYDKGYSP

SEQ ID NO: 1251926 - protein, 17 aa, Mycobacterium
ERIVWRSKGDKGYVDGA

SEQ ID NO: 1251927 - protein, 20 aa, Mycobacterium
ERKTLRLVAQYGDACNLFGS

SEQ ID NO: 1251928 - protein, 21 aa, Mycobacterium
ERLGLDYVDLYLIHWPAGDHG

SEQ ID NO: 1251929 - protein, 18 aa, Mycobacterium
ERLLKALIPQIAVFGGAA

SEQ ID NO: 1251930 - protein, 24 aa, Mycobacterium
ERLRVTGFTGADVWDDWLRNDMDQ

SEQ ID NO: 1251931 - protein, 17 aa, Mycobacterium
ERLWPTLTAPLMTREQI

SEQ ID NO: 1251932 - protein, 17 aa, Mycobacterium
ERMFPSWVPLPVSELAV

SEQ ID NO: 1251933 - protein, 20 aa, Mycobacterium
ERMIRLPIGRLMPSKPAYGR

SEQ ID NO: 1251934 - protein, 23 aa, Mycobacterium
ERMPEVAEALVIGAEQPDGGYWM

SEQ ID NO: 1251935 - protein, 19 aa, Mycobacterium
ERMSPRAAARLMNILDGTS

SEQ ID NO: 1251936 - protein, 18 aa, Mycobacterium
ERNGFPAVVTEVGDFADI

SEQ ID NO: 1251937 - protein, 27 aa, Mycobacterium
ERNGRPRIAGVSSFGFAGTNAHVILEE

SEQ ID NO: 1251938 - protein, 34 aa, Mycobacterium
ERPETAVDEIVRWATPVHCFQRTALADVELGGVT

SEQ ID NO: 1251939 - protein, 17 aa, Mycobacterium
ERPEVMERLSAASHRYR

SEQ ID NO: 1251940 - protein, 19 aa, Mycobacterium
ERPPGRRPDAVFCANDLLA

SEQ ID NO: 1251941 - protein, 25 aa, Mycobacterium
ERQAWACGPEGMLNDAERVWGQAGI

SEQ ID NO: 1251942 - protein, 19 aa, Mycobacterium
ERRGAGFVSACALVDGTHE

SEQ ID NO: 1251943 - protein, 22 aa, Mycobacterium
ERSEHRLFLSATPHNGYTESFT

SEQ ID NO: 1251944 - protein, 30 aa, Mycobacterium
ERTQWRPAAEIVRMLLERIVGSLEAPAGEQ

SEQ ID NO: 1251945 - protein, 22 aa, Mycobacterium
ERTREIAPLNGFRDLDTARLLD

SEQ ID NO: 1251946 - protein, 21 aa, Mycobacterium
ERYLDMFTFFASSSLGMNHPA

SEQ ID NO: 1251947 - protein, 21 aa, Mycobacterium
ERYPRDVRWTGVLADELGADY

SEQ ID NO: 1251948 - protein, 23 aa, Mycobacterium
ESAIAFAGLRSVDWERAEPDADR

SEQ ID NO: 1251949 - protein, 17 aa, Mycobacterium
ESARGTLGPGVRALLLY

SEQ ID NO: 1251950 - protein, 18 aa, Mycobacterium
ESARHWRADTDDLPAPAA

SEQ ID NO: 1251951 - protein, 19 aa, Mycobacterium
ESARRLRSGPIRGYTSLPI

SEQ ID NO: 1251952 - protein, 23 aa, Mycobacterium
ESFEFWREFLASLRARGLSGVHL

SEQ ID NO: 1251953 - protein, 17 aa, Mycobacterium
ESGTDGWPPDGRAPQGC

SEQ ID NO: 1251954 - protein, 20 aa, Mycobacterium
ESIADWVKRQNLGSFTLGPL

SEQ ID NO: 1251955 - protein, 17 aa, Mycobacterium
ESIGVALLRRLTHREPA

SEQ ID NO: 1251956 - protein, 24 aa, Mycobacterium
ESLPGFGCVAAPIGAPGEAVAALS

SEQ ID NO: 1251957 - protein, 20 aa, Mycobacterium
ESLRPYLLSVGYRLTGSVAD

SEQ ID NO: 1251958 - protein, 26 aa, Mycobacterium
ESLRRSRLGVAVGQRSADKFVPEWIW

SEQ ID NO: 1251959 - protein, 24 aa, Mycobacterium
ESPRETWLRLLAIRNGFPPPTTQI

SEQ ID NO: 1251960 - protein, 25 aa, Mycobacterium
ESSEFTRRVGKAFRAHNIAAGLPGA

SEQ ID NO: 1251961 - protein, 24 aa, Mycobacterium
ESTACAMCADEFRDQARNLSVALE

SEQ ID NO: 1251962 - protein, 19 aa, Mycobacterium
ESTWHRWVAQYGGMKANEA

SEQ ID NO: 1251963 - protein, 19 aa, Mycobacterium
ESVGFLFNVTVEAAPAAPS

SEQ ID NO: 1251964 - protein, 24 aa, Mycobacterium
ESVPKPRVEQAFAVVDDADVLLVA

SEQ ID NO: 1251965 - protein, 18 aa, Mycobacterium
ESVSRSTTVISIVRQGNS

SEQ ID NO: 1251966 - protein, 30 aa, Mycobacterium
ETAKLCAQYLGPALRLLNFNNIPLPINAYL

SEQ ID NO: 1251967 - protein, 18 aa, Mycobacterium
ETAKPGVVDADWLRGLCL

SEQ ID NO: 1251968 - protein, 25 aa, Mycobacterium
ETATRGDGRIVFWFTPSTHSSHMQL

SEQ ID NO: 1251969 - protein, 18 aa, Mycobacterium
ETDPTYALHFVNAYEDGD

SEQ ID NO: 1251970 - protein, 32 aa, Mycobacterium
ETDPVLAEWFLRRFSLLDSLYMVPSPRLVGRT

SEQ ID NO: 1251971 - protein, 18 aa, Mycobacterium
ETHRARAVILAMGAAARH

SEQ ID NO: 1251972 - protein, 25 aa, Mycobacterium
ETIVLPGMVVPIELDDAARAAVEAA

SEQ ID NO: 1251973 - protein, 19 aa, Mycobacterium
ETLGRRLSKFWLTGPQAGT

SEQ ID NO: 1251974 - protein, 20 aa, Mycobacterium
ETLQLILGVWDLRADAYDAP

SEQ ID NO: 1251975 - protein, 19 aa, Mycobacterium
ETLTGFKWLSRADDDLPGK

SEQ ID NO: 1251976 - protein, 22 aa, Mycobacterium
ETPAKAIELWRCELDAMRDIGG

SEQ ID NO: 1251977 - protein, 19 aa, Mycobacterium
ETQKCFDEGVLKTSADANV

SEQ ID NO: 1251978 - protein, 31 aa, Mycobacterium
ETRLLGETELWQWAHRVVCEHPGPLEIDKTP

SEQ ID NO: 1251979 - protein, 19 aa, Mycobacterium
EVADWMLCHVKLEVHSQEI

SEQ ID NO: 1251980 - protein, 20 aa, Mycobacterium
EVALAAAIACLEQGLRVGCF

SEQ ID NO: 1251981 - protein, 24 aa, Mycobacterium
EVARRELAQQIAFYSSVKSYETVL

SEQ ID NO: 1251982 - protein, 18 aa, Mycobacterium
EVARRWGGALNILVNTVG

SEQ ID NO: 1251983 - protein, 23 aa, Mycobacterium
EVDRLRATVETFQRAEVERLAAL

SEQ ID NO: 1251984 - protein, 21 aa, Mycobacterium
EVFGASSLIVRCADFEEMTTV

SEQ ID NO: 1251985 - protein, 19 aa, Mycobacterium
EVFLRNQFYLRGNRAGAAH

SEQ ID NO: 1251986 - protein, 22 aa, Mycobacterium
EVGAIPEVWAAMARLHADGKAE

SEQ ID NO: 1251987 - protein, 18 aa, Mycobacterium
EVGPRHAAPEAPQTGPAP

SEQ ID NO: 1251988 - protein, 25 aa, Mycobacterium
EVGPSATWRTLKTGYQTSVEKNIAL

SEQ ID NO: 1251989 - protein, 20 aa, Mycobacterium
EVHAGLFGLLKHGSWSAWHQ

SEQ ID NO: 1251990 - protein, 17 aa, Mycobacterium
EVHPDFWHEDEFGYRSI

SEQ ID NO: 1251991 - protein, 26 aa, Mycobacterium
EVIVDALAALVFWRLIALGKPVSARH

SEQ ID NO: 1251992 - protein, 24 aa, Mycobacterium
EVKKWLAEVLPNFPAYSHLVGNFD

SEQ ID NO: 1251993 - protein, 22 aa, Mycobacterium
EVKPGSGVRGMIAKRGHIPVGY

SEQ ID NO: 1251994 - protein, 25 aa, Mycobacterium
EVLEHCIWYFLRPGGAPVVVVADDD

SEQ ID NO: 1251995 - protein, 28 aa, Mycobacterium
EVLELNLSSAWYLSRAAAKPMIAQGKGA

SEQ ID NO: 1251996 - protein, 25 aa, Mycobacterium
EVLRARNLLPVPWVDPVDVANAVVF

SEQ ID NO: 1251997 - protein, 18 aa, Mycobacterium
EVLRGGAVLAARVLGRMA

SEQ ID NO: 1251998 - protein, 24 aa, Mycobacterium
EVMALLERFGIPTAPHLVLGDGDD

SEQ ID NO: 1251999 - protein, 20 aa, Mycobacterium
EVPEGAIVVFSAHGVAPTVH

SEQ ID NO: 1252000 - protein, 25 aa, Mycobacterium
EVPICRTAEFLAWFLENVPIEPIWL

SEQ ID NO: 1252001 - protein, 25 aa, Mycobacterium
EVQIPKLRAGSFFPSLLERRRRIDK

SEQ ID NO: 1252002 - protein, 19 aa, Mycobacterium
EVQSTYPLSYGPQSDGSLS

SEQ ID NO: 1252003 - protein, 20 aa, Mycobacterium
EVRDHGWASVTEELEVGLNA

SEQ ID NO: 1252004 - protein, 23 aa, Mycobacterium
EVRVGRSRMIFWQGHGTGEGPGD

SEQ ID NO: 1252005 - protein, 22 aa, Mycobacterium
EVSGSLLRRKFGLATKAMEPLR

SEQ ID NO: 1252006 - protein, 17 aa, Mycobacterium
EVVGFHLNRGVLASASR

SEQ ID NO: 1252007 - protein, 25 aa, Mycobacterium
EVVGRLKPGIIMCREKGDATSANLF

SEQ ID NO: 1252008 - protein, 20 aa, Mycobacterium
EVVRILAPCRLLDDDIGAGA

SEQ ID NO: 1252009 - protein, 21 aa, Mycobacterium
EVVTCQPFAGSAPRFADPAAD

SEQ ID NO: 1252010 - protein, 19 aa, Mycobacterium
EVVVLLGATAAKALLGNDF

SEQ ID NO: 1252011 - protein, 21 aa, Mycobacterium
EVWGALTALVFDNRDSWRRAV

SEQ ID NO: 1252012 - protein, 26 aa, Mycobacterium
EVYARAVKDWVEFLAEHGVGLFDSRQ

SEQ ID NO: 1252013 - protein, 20 aa, Mycobacterium
EWDECLHKAASIVGPCSPVP

SEQ ID NO: 1252014 - protein, 18 aa, Mycobacterium
EWGICGVGVLPGDRKMAD

SEQ ID NO: 1252015 - protein, 24 aa, Mycobacterium
EWSPVCRACWWDDPDAGPVAGAWF

SEQ ID NO: 1252016 - protein, 19 aa, Mycobacterium
EWVPPDALLSFAEKLVEAK

SEQ ID NO: 1252017 - protein, 17 aa, Mycobacterium
EYCKQRHQFGTPIGSFQ

SEQ ID NO: 1252018 - protein, 21 aa, Mycobacterium
EYEALVGYSRAVRIGNQVLVA

SEQ ID NO: 1252019 - protein, 32 aa, Mycobacterium
EYLSGRWSQVYGFPVMPVDGILVGTAAMAALE

SEQ ID NO: 1252020 - protein, 36 aa, Mycobacterium
EYNALKAWLIGVGEDGEWPLFLDVWVEHAVEDVATS

SEQ ID NO: 1252021 - protein, 17 aa, Mycobacterium
EYRSCAKTQALVAEYGF

SEQ ID NO: 1252022 - protein, 20 aa, Mycobacterium
EYVPPTVLRTVFGWTSRRRA

SEQ ID NO: 1252023 - protein, 21 aa, Mycobacterium
EYYEKAGLWPYLEKLGFFLVG

SEQ ID NO: 1252024 - protein, 19 aa, Mycobacterium
FAAEIMPRVQVLSQRAEVA

SEQ ID NO: 1252025 - protein, 21 aa, Mycobacterium
FAASGYAGFRMDAVATRAGVG

SEQ ID NO: 1252026 - protein, 20 aa, Mycobacterium
FAASLIGDFGAQVIKIEDPG

SEQ ID NO: 1252027 - protein, 17 aa, Mycobacterium
FAASYAGTLARWSTSRH

SEQ ID NO: 1252028 - protein, 17 aa, Mycobacterium
FADAAARTSLRAVMADV

SEQ ID NO: 1252029 - protein, 21 aa, Mycobacterium
FADAVPLLTAIVEWGEGPRFS

SEQ ID NO: 1252030 - protein, 19 aa, Mycobacterium
FADHIFEIPATTTLYQPLL

SEQ ID NO: 1252031 - protein, 17 aa, Mycobacterium
FADPFAGSSSGGAPATT

SEQ ID NO: 1252032 - protein, 22 aa, Mycobacterium
FAELLRACGRIDGLERVRFTSP

SEQ ID NO: 1252033 - protein, 18 aa, Mycobacterium
FAEQVRAEAALQGYSDED

SEQ ID NO: 1252034 - protein, 25 aa, Mycobacterium
FAFAEAPVPFCWNEDNPAFSSMANA

SEQ ID NO: 1252035 - protein, 19 aa, Mycobacterium
FAGTLLRDHGLLLPIEPET

SEQ ID NO: 1252036 - protein, 19 aa, Mycobacterium
FAHAPHVRRTWGTTNGVEM

SEQ ID NO: 1252037 - protein, 19 aa, Mycobacterium
FAKAMVRRFDVDWTGLGFS

SEQ ID NO: 1252038 - protein, 17 aa, Mycobacterium
FALAGSYALWVFGGPEP

SEQ ID NO: 1252039 - protein, 23 aa, Mycobacterium
FALDPFQIRACEALESGHGVLVC

SEQ ID NO: 1252040 - protein, 26 aa, Mycobacterium
FALGHLRGAVNIGLEGRYAEFAGSVV

SEQ ID NO: 1252041 - protein, 19 aa, Mycobacterium
FALLTALGDPVLWSVPLHW

SEQ ID NO: 1252042 - protein, 17 aa, Mycobacterium
FAMLGPYSATKFAVRAL

SEQ ID NO: 1252043 - protein, 17 aa, Mycobacterium
FAPGCGLRGPTGPGTTP

SEQ ID NO: 1252044 - protein, 23 aa, Mycobacterium
FARELAAAKGLRDGRDYDDELVY

SEQ ID NO: 1252045 - protein, 22 aa, Mycobacterium
FARGKRLGRAPVIVDREVVRAI

SEQ ID NO: 1252046 - protein, 17 aa, Mycobacterium
FASNCDGEAFVVLAKPE

SEQ ID NO: 1252047 - protein, 17 aa, Mycobacterium
FATIPVVREDGWSDDGM

SEQ ID NO: 1252048 - protein, 19 aa, Mycobacterium
FATVCARDGVDAVAGLQAL

SEQ ID NO: 1252049 - protein, 19 aa, Mycobacterium
FAVPTIRGEIRRHFRDNTW

SEQ ID NO: 1252050 - protein, 17 aa, Mycobacterium
FAVSVLRLDGDNVGHEL

SEQ ID NO: 1252051 - protein, 18 aa, Mycobacterium
FAVTEGGRHSVTHYDTLE

SEQ ID NO: 1252052 - protein, 19 aa, Mycobacterium
FCGTVGPGFADGAVVGNIF

SEQ ID NO: 1252053 - protein, 31 aa, Mycobacterium
FCHNGCPLGNLIPEWNDLVFKDRWRDAIERL

SEQ ID NO: 1252054 - protein, 17 aa, Mycobacterium
FCIARDIVQDEGIETDV

SEQ ID NO: 1252055 - protein, 18 aa, Mycobacterium
FCTLTRSPGARAYYDQHR

SEQ ID NO: 1252056 - protein, 17 aa, Mycobacterium
FDAFGFDISVSRRAMAD

SEQ ID NO: 1252057 - protein, 27 aa, Mycobacterium
FDDMPAYRAALVAAWGRLRDEDCRRLD

SEQ ID NO: 1252058 - protein, 26 aa, Mycobacterium
FDDRVYKRGALTLHVLRTRIGDEKFF

SEQ ID NO: 1252059 - protein, 18 aa, Mycobacterium
FDEGVLKTSADANVGSIL

SEQ ID NO: 1252060 - protein, 25 aa, Mycobacterium
FDETRSIAGFFSFDPVRAEVSAALP

SEQ ID NO: 1252061 - protein, 19 aa, Mycobacterium
FDEVPVRTPGTLAFAPIVD

SEQ ID NO: 1252062 - protein, 22 aa, Mycobacterium
FDGDGMIHIVEFGGGKAAYRNR

SEQ ID NO: 1252063 - protein, 33 aa, Mycobacterium
FDGRIGTAVEEFVRWSTPVLQFARFATTDTEIN

SEQ ID NO: 1252064 - protein, 29 aa, Mycobacterium
FDILAALSSRPAVVFSRRQLLEAVWGDSW

SEQ ID NO: 1252065 - protein, 27 aa, Mycobacterium
FDKFPPFPFNVVFAMLRGQVSIKVLTE

SEQ ID NO: 1252066 - protein, 25 aa, Mycobacterium
FDLLPIPEFYGGTVYFDGADAPAVV

SEQ ID NO: 1252067 - protein, 22 aa, Mycobacterium
FDLPTAVKVVAQRARLMHASPS

SEQ ID NO: 1252068 - protein, 17 aa, Mycobacterium
FDLVDAYGADTVRFNIE

SEQ ID NO: 1252069 - protein, 19 aa, Mycobacterium
FDLVTCNPPYVPHAPEADR

SEQ ID NO: 1252070 - protein, 37 aa, Mycobacterium
FDRQLLLPGFVERVLEAWPRHDLGYAITDLIARGTAA

SEQ ID NO: 1252071 - protein, 25 aa, Mycobacterium
FDRVSDSFARYGVPTGDRIHLHKGL

SEQ ID NO: 1252072 - protein, 18 aa, Mycobacterium
FDSPRDALALALDLERTV

SEQ ID NO: 1252073 - protein, 25 aa, Mycobacterium
FDSRQRLKLALSRYAEHRATGPLPR

SEQ ID NO: 1252074 - protein, 18 aa, Mycobacterium
FDTRELAEELPLATFESE

SEQ ID NO: 1252075 - protein, 18 aa, Mycobacterium
FDVLMKPGPGFAMVARDN

SEQ ID NO: 1252076 - protein, 20 aa, Mycobacterium
FDVNVKGVFLLTRALVPLLE

SEQ ID NO: 1252077 - protein, 30 aa, Mycobacterium
FDVRPPRWLPPGRWWALIRVAAAGRLVYSP

SEQ ID NO: 1252078 - protein, 17 aa, Mycobacterium
FEATGARRTPPPRTPPL

SEQ ID NO: 1252079 - protein, 17 aa, Mycobacterium
FEEAFAALRSWDEQGLL

SEQ ID NO: 1252080 - protein, 35 aa, Mycobacterium
FEHLPQLLLTAMRWPRVGVMIARGDLAVEVGYERL

SEQ ID NO: 1252081 - protein, 23 aa, Mycobacterium
FEHTSAFLSWELVDSGGSRVMTV

SEQ ID NO: 1252082 - protein, 18 aa, Mycobacterium
FELDGADAAREFLADHGY

SEQ ID NO: 1252083 - protein, 26 aa, Mycobacterium
FERAWEQFIPFLAFPPELRRVIYTTN

SEQ ID NO: 1252084 - protein, 17 aa, Mycobacterium
FERISATAFDPNWLAGL

SEQ ID NO: 1252085 - protein, 22 aa, Mycobacterium
FERNRIKVIAPLGGQRELWAAM

SEQ ID NO: 1252086 - protein, 20 aa, Mycobacterium
FERRLAEHADELAAVIVEPV

SEQ ID NO: 1252087 - protein, 22 aa, Mycobacterium
FERRPRVGDHVSIVEEIASISE

SEQ ID NO: 1252088 - protein, 17 aa, Mycobacterium
FEVLRAIVADFVATKEP

SEQ ID NO: 1252089 - protein, 18 aa, Mycobacterium
FFGFPPQMARMMDPQHRL

SEQ ID NO: 1252090 - protein, 18 aa, Mycobacterium
FFGPAALVRAALPIMRAQ

SEQ ID NO: 1252091 - protein, 20 aa, Mycobacterium
FFKTCFDILPDDGRMTIQSS

SEQ ID NO: 1252092 - protein, 17 aa, Mycobacterium
FFLLGVPSDDAVRWLAA

SEQ ID NO: 1252093 - protein, 17 aa, Mycobacterium
FFLPKIASGDLHFSIGY

SEQ ID NO: 1252094 - protein, 22 aa, Mycobacterium
FGASNFPLAFSVAGGDTASALA

SEQ ID NO: 1252095 - protein, 20 aa, Mycobacterium
FGASSAFGGPCRTPVAERLA

SEQ ID NO: 1252096 - protein, 25 aa, Mycobacterium
FGCGDSRVAAEIIFDQGLGDMFVVR

SEQ ID NO: 1252097 - protein, 19 aa, Mycobacterium
FGDGDPWAAMRAAVHRLTP

SEQ ID NO: 1252098 - protein, 19 aa, Mycobacterium
FGDSLTWGWVPVEDGVPTE

SEQ ID NO: 1252099 - protein, 25 aa, Mycobacterium
FGDYFKKGAIEFAWTLLTNPVDQGG

SEQ ID NO: 1252100 - protein, 25 aa, Mycobacterium
FGEGPRWFEGLLWFSDMFGEAVHTV

SEQ ID NO: 1252101 - protein, 26 aa, Mycobacterium
FGELLGCAVPDGWPEFPESIEFTIGQ

SEQ ID NO: 1252102 - protein, 20 aa, Mycobacterium
FGEPDLLYSTFVHGVKRLPA

SEQ ID NO: 1252103 - protein, 17 aa, Mycobacterium
FGGLVRSLAGHLAVELD

SEQ ID NO: 1252104 - protein, 17 aa, Mycobacterium
FGGPPRKPTMLVTDVSM

SEQ ID NO: 1252105 - protein, 17 aa, Mycobacterium
FGGTAVFSGRQWVIDPI

SEQ ID NO: 1252106 - protein, 17 aa, Mycobacterium
FGIPGGAVLPVYDPLFD

SEQ ID NO: 1252107 - protein, 19 aa, Mycobacterium
FGLAPLRDVFELLREVRRW

SEQ ID NO: 1252108 - protein, 17 aa, Mycobacterium
FGLYIHVPFCATRCGYC

SEQ ID NO: 1252109 - protein, 17 aa, Mycobacterium
FGMDSWFPNLKIYNRNG

SEQ ID NO: 1252110 - protein, 19 aa, Mycobacterium
FGREWAIAALERGDRVAAT

SEQ ID NO: 1252111 - protein, 18 aa, Mycobacterium
FGSFHMVDGFLLNNQLTD

SEQ ID NO: 1252112 - protein, 30 aa, Mycobacterium
FGSGVSPGFAELLAIVAATACDRVDKITIA

SEQ ID NO: 1252113 - protein, 20 aa, Mycobacterium
FGTPIFKLGGAPVKVVSSVT

SEQ ID NO: 1252114 - protein, 17 aa, Mycobacterium
FGYRYLVEEARDAGEPM

SEQ ID NO: 1252115 - protein, 28 aa, Mycobacterium
FHAARVALRAALKVVRLLTTNDPGAREA

SEQ ID NO: 1252116 - protein, 18 aa, Mycobacterium
FHAAWCWEDTITQLRALG

SEQ ID NO: 1252117 - protein, 17 aa, Mycobacterium
FHGSPAALVELLEQMWW

SEQ ID NO: 1252118 - protein, 25 aa, Mycobacterium
FHLADGSGWLARNLVGGTHVILPSF

SEQ ID NO: 1252119 - protein, 32 aa, Mycobacterium
FHSRAEAAASLALRGGDPAGIGFYLDAGRIHI

SEQ ID NO: 1252120 - protein, 18 aa, Mycobacterium
FHTYRQVEGFSVSPAARV

SEQ ID NO: 1252121 - protein, 18 aa, Mycobacterium
FIAAGGFVGEFARQSPGF

SEQ ID NO: 1252122 - protein, 19 aa, Mycobacterium
FIDSSGLGALISGLKVARQ

SEQ ID NO: 1252123 - protein, 17 aa, Mycobacterium
FIRPIVAGDTLHCDVYI

SEQ ID NO: 1252124 - protein, 30 aa, Mycobacterium
FKDPVKGFFRALDFTLPWDVDAVQDAMPVE

SEQ ID NO: 1252125 - protein, 22 aa, Mycobacterium
FKGPEFDRRTVLDFEAIPITTG

SEQ ID NO: 1252126 - protein, 18 aa, Mycobacterium
FKKYRTALDYAQADRTEL

SEQ ID NO: 1252127 - protein, 20 aa, Mycobacterium
FKPLYGTSLVTGWASIHGFP

SEQ ID NO: 1252128 - protein, 19 aa, Mycobacterium
FKQKVIQQMITRRLQMGET

SEQ ID NO: 1252129 - protein, 24 aa, Mycobacterium
FKRKGHSARRWIAKNVRQQDMSLS

SEQ ID NO: 1252130 - protein, 20 aa, Mycobacterium
FLAAEARRAGAELPVSSVLC

SEQ ID NO: 1252131 - protein, 23 aa, Mycobacterium
FLAEARLAGITAPVIFDDPVSSL

SEQ ID NO: 1252132 - protein, 17 aa, Mycobacterium
FLAERAYDVHLLKLTNS

SEQ ID NO: 1252133 - protein, 17 aa, Mycobacterium
FLAPAAAIAAEITDAPT

SEQ ID NO: 1252134 - protein, 22 aa, Mycobacterium
FLARNRLYYTWFRADEAKGRQL

SEQ ID NO: 1252135 - protein, 21 aa, Mycobacterium
FLCGAVQAASRLNNEQSAKLC

SEQ ID NO: 1252136 - protein, 18 aa, Mycobacterium
FLCGSVIFVDGGTDAHFR

SEQ ID NO: 1252137 - protein, 23 aa, Mycobacterium
FLEGSWQYRRLFRRLPPEEPKHR

SEQ ID NO: 1252138 - protein, 18 aa, Mycobacterium
FLELAAALADHFPSTDDR

SEQ ID NO: 1252139 - protein, 18 aa, Mycobacterium
FLERLRVPTRVVMLANCG

SEQ ID NO: 1252140 - protein, 19 aa, Mycobacterium
FLESLTVRTNRTFQERYIA

SEQ ID NO: 1252141 - protein, 17 aa, Mycobacterium
FLFAVPWADGVAVPVNT

SEQ ID NO: 1252142 - protein, 17 aa, Mycobacterium
FLMDVPTILGGVVTGFG

SEQ ID NO: 1252143 - protein, 17 aa, Mycobacterium
FLNHKLSPARSFAGATL

SEQ ID NO: 1252144 - protein, 20 aa, Mycobacterium
FLPAGRAPRVGDVFRNPDLA

SEQ ID NO: 1252145 - protein, 18 aa, Mycobacterium
FLPMMPPAAVQFAGSAEI

SEQ ID NO: 1252146 - protein, 25 aa, Mycobacterium
FLRDRCAEAPFLPGASYHFVATSAA

SEQ ID NO: 1252147 - protein, 17 aa, Mycobacterium
FLRDRMQTLQDEFAKHG

SEQ ID NO: 1252148 - protein, 20 aa, Mycobacterium
FLRPVCYQNAPGVLLPAAVA

SEQ ID NO: 1252149 - protein, 17 aa, Mycobacterium
FLRSEFTCSIYADWPID

SEQ ID NO: 1252150 - protein, 18 aa, Mycobacterium
FLSGRPGRAAALRDFIAE

SEQ ID NO: 1252151 - protein, 18 aa, Mycobacterium
FLTRLAAAAPHIRGIGPS

SEQ ID NO: 1252152 - protein, 23 aa, Mycobacterium
FLVAAARFLAKRVTEAWTKEGML

SEQ ID NO: 1252153 - protein, 17 aa, Mycobacterium
FLYLDRLIGRHARAAKR

SEQ ID NO: 1252154 - protein, 25 aa, Mycobacterium
FMRKSEAPLPWAQMHRVAAPTLLTW

SEQ ID NO: 1252155 - protein, 18 aa, Mycobacterium
FMSGPAYARRLTAQALDA

SEQ ID NO: 1252156 - protein, 30 aa, Mycobacterium
FMTIAKLRAARLLWARVCEVVGAADAGAAT

SEQ ID NO: 1252157 - protein, 22 aa, Mycobacterium
FMWRLADRHIDEFIADGQCEFL

SEQ ID NO: 1252158 - protein, 25 aa, Mycobacterium
FNAFPASYWRRWSTLTSVVLQVELT

SEQ ID NO: 1252159 - protein, 20 aa, Mycobacterium
FNCRGIPGSQAWSYHAYGRA

SEQ ID NO: 1252160 - protein, 17 aa, Mycobacterium
FNEVFFDDVFVPDADVV

SEQ ID NO: 1252161 - protein, 20 aa, Mycobacterium
FPAGMLLVFEPVVWEDGTGG

SEQ ID NO: 1252162 - protein, 19 aa, Mycobacterium
FPEVLRLCMWAQLERPEAT

SEQ ID NO: 1252163 - protein, 26 aa, Mycobacterium
FPGACAGCGETPYLKLLSQLFGDRMM

SEQ ID NO: 1252164 - protein, 19 aa, Mycobacterium
FPGCDAPATRCDIDHTVPW

SEQ ID NO: 1252165 - protein, 25 aa, Mycobacterium
FPGLADGIALWPWQRDFVDRAVSTP

SEQ ID NO: 1252166 - protein, 22 aa, Mycobacterium
FPHGVPRLKVASVRNALTNLAL

SEQ ID NO: 1252167 - protein, 17 aa, Mycobacterium
FPNGMAITEDRATLIVA

SEQ ID NO: 1252168 - protein, 24 aa, Mycobacterium
FPNMSFSAGFPRTILVSHPISPTE

SEQ ID NO: 1252169 - protein, 32 aa, Mycobacterium
FPNYRRDALEQTPIRSIMAFQLFIADETIGAI

SEQ ID NO: 1252170 - protein, 24 aa, Mycobacterium
FPRCTQALREGRLSLDQVGAIAER

SEQ ID NO: 1252171 - protein, 24 aa, Mycobacterium
FPRCTRALREGRLSLDQVGAIAER

SEQ ID NO: 1252172 - protein, 17 aa, Mycobacterium
FPRRLPRSPIVVGASLS

SEQ ID NO: 1252173 - protein, 17 aa, Mycobacterium
FPTLPSWISLRLLENRT

SEQ ID NO: 1252174 - protein, 19 aa, Mycobacterium
FPTREALLAELYRDDVDAL

SEQ ID NO: 1252175 - protein, 18 aa, Mycobacterium
FPVIGHPGASLGAAVIAA

SEQ ID NO: 1252176 - protein, 32 aa, Mycobacterium
FQRAEVERLAALKLIDGRDVWAAGAKLADLLA

SEQ ID NO: 1252177 - protein, 18 aa, Mycobacterium
FQRDYFKSGDANCATAAN

SEQ ID NO: 1252178 - protein, 29 aa, Mycobacterium
FQVSCGHCAFCDRGRYAACEPRYARAGAA

SEQ ID NO: 1252179 - protein, 18 aa, Mycobacterium
FQWSEIRDGIYGQTLVTR

SEQ ID NO: 1252180 - protein, 17 aa, Mycobacterium
FRAAWAAGYRGLTAATD

SEQ ID NO: 1252181 - protein, 18 aa, Mycobacterium
FRDYFKAVYGPTIAAYRN

SEQ ID NO: 1252182 - protein, 18 aa, Mycobacterium
FREQRFVAADATRTPVEV

SEQ ID NO: 1252183 - protein, 19 aa, Mycobacterium
FRGITDWIIGGIRGGEYLR

SEQ ID NO: 1252184 - protein, 19 aa, Mycobacterium
FRKAFRAFIDHDAVPHVEA

SEQ ID NO: 1252185 - protein, 24 aa, Mycobacterium
FRLLQRLGADVAEYGFVETSAKQD

SEQ ID NO: 1252186 - protein, 18 aa, Mycobacterium
FRNLEKALAIYGAAKEGE

SEQ ID NO: 1252187 - protein, 18 aa, Mycobacterium
FRNVPGFLRLARAGIYTS

SEQ ID NO: 1252188 - protein, 17 aa, Mycobacterium
FRNWEDEPALPFDQTLL

SEQ ID NO: 1252189 - protein, 17 aa, Mycobacterium
FRPLYWWAQDLRAGGDV

SEQ ID NO: 1252190 - protein, 22 aa, Mycobacterium
FRQRYWARNHVGWRHMAATLPN

SEQ ID NO: 1252191 - protein, 26 aa, Mycobacterium
FRRFCLDSPRLAQVMFSRPFADFDPG

SEQ ID NO: 1252192 - protein, 27 aa, Mycobacterium
FRSSRWHDVRRVLAPLIQQVRHDPFLF

SEQ ID NO: 1252193 - protein, 18 aa, Mycobacterium
FRTLCRELEVARAGTVSG

SEQ ID NO: 1252194 - protein, 20 aa, Mycobacterium
FSAIADHRWRVVAKEQILAM

SEQ ID NO: 1252195 - protein, 17 aa, Mycobacterium
FSALIDHAVWFHRPADF

SEQ ID NO: 1252196 - protein, 17 aa, Mycobacterium
FSALLPAARAVRESVEW

SEQ ID NO: 1252197 - protein, 27 aa, Mycobacterium
FSEDIAGFGYADCAGHPTWFEPTEWLG

SEQ ID NO: 1252198 - protein, 26 aa, Mycobacterium
FSELPDFELIAGQVIANFEAAAAVLY

SEQ ID NO: 1252199 - protein, 25 aa, Mycobacterium
FSFDVRCTWLRNWVNGASGQRLGLA

SEQ ID NO: 1252200 - protein, 22 aa, Mycobacterium
FSGDWYVGLGVASATYPAMQMP

SEQ ID NO: 1252201 - protein, 27 aa, Mycobacterium
FSGHGFKIAPAVGRLVADIVVDGRSGD

SEQ ID NO: 1252202 - protein, 19 aa, Mycobacterium
FSGHVGDLITRRAADLVAF

SEQ ID NO: 1252203 - protein, 17 aa, Mycobacterium
FSKARTSGSIEAREMDE

SEQ ID NO: 1252204 - protein, 17 aa, Mycobacterium
FSNHAVLAGRLVIDDPD

SEQ ID NO: 1252205 - protein, 17 aa, Mycobacterium
FSPPKALDIGLVDQLVQ

SEQ ID NO: 1252206 - protein, 19 aa, Mycobacterium
FSQRGWHPVIGPFFNRGLM

SEQ ID NO: 1252207 - protein, 17 aa, Mycobacterium
FSRSGALPITKASDRLQ

SEQ ID NO: 1252208 - protein, 18 aa, Mycobacterium
FSSSRGCDLAMVRSEEGP

SEQ ID NO: 1252209 - protein, 17 aa, Mycobacterium
FSTKIAAVVGFPSGKHL

SEQ ID NO: 1252210 - protein, 27 aa, Mycobacterium
FSVEPGIYFPGQWGARIEDIVIVTEDG

SEQ ID NO: 1252211 - protein, 25 aa, Mycobacterium
FTAFPRAHWQKIWSNNPIVIWSPAV

SEQ ID NO: 1252212 - protein, 18 aa, Mycobacterium
FTDDRILPQLPRSAGPDG

SEQ ID NO: 1252213 - protein, 20 aa, Mycobacterium
FTDRGWRWGGDWRTPKDYQH

SEQ ID NO: 1252214 - protein, 26 aa, Mycobacterium
FTFRGCEGDSLLMLLDAKGIECSTGS

SEQ ID NO: 1252215 - protein, 24 aa, Mycobacterium
FTGKAGDITVFWRLAATSGGSVGS

SEQ ID NO: 1252216 - protein, 17 aa, Mycobacterium
FTHALARAVVARGATIG

SEQ ID NO: 1252217 - protein, 17 aa, Mycobacterium
FTLARGKLLSILQRNGA

SEQ ID NO: 1252218 - protein, 21 aa, Mycobacterium
FTPPPWWGALDGERPVVHVTQ

SEQ ID NO: 1252219 - protein, 17 aa, Mycobacterium
FTPPYFPGAAWAVPAPA

SEQ ID NO: 1252220 - protein, 17 aa, Mycobacterium
FTPTLAFVRDTVPDTAH

SEQ ID NO: 1252221 - protein, 17 aa, Mycobacterium
FTQVFATLFPGGEGRLL

SEQ ID NO: 1252222 - protein, 21 aa, Mycobacterium
FTRVVFNWIAKVTGVGGAETL

SEQ ID NO: 1252223 - protein, 17 aa, Mycobacterium
FTSDERGFWAKLEGFNP

SEQ ID NO: 1252224 - protein, 17 aa, Mycobacterium
FTSFFRALGLAARGDNE

SEQ ID NO: 1252225 - protein, 24 aa, Mycobacterium
FTSHPAGSVLVEFGETRVMCTASV

SEQ ID NO: 1252226 - protein, 20 aa, Mycobacterium
FTSLDPRAPFGGAKASGLGR

SEQ ID NO: 1252227 - protein, 25 aa, Mycobacterium
FTVRCARVGALPGLTATLARRPTPR

SEQ ID NO: 1252228 - protein, 25 aa, Mycobacterium
FVADVGAAFARLVADGATQIVIGHD

SEQ ID NO: 1252229 - protein, 25 aa, Mycobacterium
FVAGLKSPLPHPWRPADSSNEARIP

SEQ ID NO: 1252230 - protein, 18 aa, Mycobacterium
FVAPRFVEVGSYLGRSLC

SEQ ID NO: 1252231 - protein, 18 aa, Mycobacterium
FVATHLPMLAWMTEVVAK

SEQ ID NO: 1252232 - protein, 19 aa, Mycobacterium
FVCLLTCPEGIAAMQDAHP

SEQ ID NO: 1252233 - protein, 17 aa, Mycobacterium
FVDAFREGRIPGVTSTL

SEQ ID NO: 1252234 - protein, 23 aa, Mycobacterium
FVDRAVSTPAVFCAHEVGLGKTL

SEQ ID NO: 1252235 - protein, 17 aa, Mycobacterium
FVDVIGPYLKWGGDNSD

SEQ ID NO: 1252236 - protein, 30 aa, Mycobacterium
FVEFDHAMCFPKPAARVPIHIGGHSRAAAR

SEQ ID NO: 1252237 - protein, 19 aa, Mycobacterium
FVEVGSYLGRSLCSLAEVV

SEQ ID NO: 1252238 - protein, 17 aa, Mycobacterium
FVFGFGLDDRDMQRALD

SEQ ID NO: 1252239 - protein, 17 aa, Mycobacterium
FVFTSSYVTVGRRRGRR

SEQ ID NO: 1252240 - protein, 28 aa, Mycobacterium
FVIGPMVKLGWGRPVSFVTAEVALILSL

SEQ ID NO: 1252241 - protein, 18 aa, Mycobacterium
FVLPPPVLDKMRFIHHVI

SEQ ID NO: 1252242 - protein, 24 aa, Mycobacterium
FVLRELRAGLHFNALSLSGITPIE

SEQ ID NO: 1252243 - protein, 28 aa, Mycobacterium
FVNETNMRGRLALHHVRARVYGAEPVEP

SEQ ID NO: 1252244 - protein, 17 aa, Mycobacterium
FVVGLGGTLRANSSTER

SEQ ID NO: 1252245 - protein, 22 aa, Mycobacterium
FWARQIRATVRFADELSTVLAT

SEQ ID NO: 1252246 - protein, 28 aa, Mycobacterium
FWLSALWELPRAAAILMKLYRNATHGLG

SEQ ID NO: 1252247 - protein, 17 aa, Mycobacterium
FWSRFGSRAQQKNNTVV

SEQ ID NO: 1252248 - protein, 28 aa, Mycobacterium
FYAKHGFAVTGTKTFRLGAGVENDFVMV

SEQ ID NO: 1252249 - protein, 19 aa, Mycobacterium
FYDAFSPRFEEAIDYCDKF

SEQ ID NO: 1252250 - protein, 22 aa, Mycobacterium
FYESTGCFRDMISTHLCQVLGF

SEQ ID NO: 1252251 - protein, 23 aa, Mycobacterium
FYGDDMAAAWWVRDGAPAERPCL

SEQ ID NO: 1252252 - protein, 19 aa, Mycobacterium
FYICGPGPFMDTVEGALAT

SEQ ID NO: 1252253 - protein, 22 aa, Mycobacterium
FYRWPRDATFEGWRQRLPEGFT

SEQ ID NO: 1252254 - protein, 17 aa, Mycobacterium
GAAAVSRASYERLATGI

SEQ ID NO: 1252255 - protein, 31 aa, Mycobacterium
GAADGFMIFPPRVPYGIGAFVDLVVPELQRR

SEQ ID NO: 1252256 - protein, 20 aa, Mycobacterium
GAADYRRWPVTDAGDSIYWA

SEQ ID NO: 1252257 - protein, 18 aa, Mycobacterium
GAAHAVDLPFVFDRTDVD

SEQ ID NO: 1252258 - protein, 19 aa, Mycobacterium
GAAHLEAMVSYANHAQELA

SEQ ID NO: 1252259 - protein, 19 aa, Mycobacterium
GAAPATWMPSTRVTRDDWR

SEQ ID NO: 1252260 - protein, 23 aa, Mycobacterium
GAAPPAGGAPMAMMPPGGGMGGG

SEQ ID NO: 1252261 - protein, 21 aa, Mycobacterium
GACEPVCPVEAIYYEDDLPAD

SEQ ID NO: 1252262 - protein, 25 aa, Mycobacterium
GADGGRPAPRRGFAPGCGLRGPTGP

SEQ ID NO: 1252263 - protein, 34 aa, Mycobacterium
GADRPGSCQQVWCPVCALAALVQGEQHPLLNVVA

SEQ ID NO: 1252264 - protein, 20 aa, Mycobacterium
GADSIAFRLMYNTLRATYEP

SEQ ID NO: 1252265 - protein, 23 aa, Mycobacterium
GAEAMLPSPFCQELTALATDPGD

SEQ ID NO: 1252266 - protein, 21 aa, Mycobacterium
GAEPPARLLATARAAEVIECL

SEQ ID NO: 1252267 - protein, 27 aa, Mycobacterium
GAESPKETWLRLLIVRAGFPRPETQLP

SEQ ID NO: 1252268 - protein, 22 aa, Mycobacterium
GAETALRIGLVTEVVARERLWE

SEQ ID NO: 1252269 - protein, 23 aa, Mycobacterium
GAFRARVAPFNVNYRYVRDELRY

SEQ ID NO: 1252270 - protein, 21 aa, Mycobacterium
GAGATRPTWTPGGTASGSDAP

SEQ ID NO: 1252271 - protein, 17 aa, Mycobacterium
GAGDIPPPPGWNQPPGP

SEQ ID NO: 1252272 - protein, 25 aa, Mycobacterium
GAGGRYAGLVTLEMLIDTITRLRAE

SEQ ID NO: 1252273 - protein, 25 aa, Mycobacterium
GAGSLLMPPWRVIKFESDGVELEVA

SEQ ID NO: 1252274 - protein, 34 aa, Mycobacterium
GAGYGEEPGPLPWYKRPPVLFGAAAAAALAALSG

SEQ ID NO: 1252275 - protein, 19 aa, Mycobacterium
GAIGLEIAGYLAAHGAGNI

SEQ ID NO: 1252276 - protein, 17 aa, Mycobacterium
GAKRPIRRALISVYDKT

SEQ ID NO: 1252277 - protein, 18 aa, Mycobacterium
GAKVAVPAKDGWSPLSGV

SEQ ID NO: 1252278 - protein, 19 aa, Mycobacterium
GALAERYHVLAPDMLGFGR

SEQ ID NO: 1252279 - protein, 21 aa, Mycobacterium
GALAHRVGLRVAVAAQTREQA

SEQ ID NO: 1252280 - protein, 19 aa, Mycobacterium
GALELRWPSIDAAGQTVVY

SEQ ID NO: 1252281 - protein, 18 aa, Mycobacterium
GAMGYPVAVGVVAGLARR

SEQ ID NO: 1252282 - protein, 17 aa, Mycobacterium
GAMYRIVTLAVLRAGID

SEQ ID NO: 1252283 - protein, 19 aa, Mycobacterium
GANLGLWEPAFEQLSTQGA

SEQ ID NO: 1252284 - protein, 39 aa, Mycobacterium
GANNLYLAFGMLNWRFGDRELRSPLVLVPVRLSTANRGE

SEQ ID NO: 1252285 - protein, 20 aa, Mycobacterium
GAPLAPGEFILGYPDENGPV

SEQ ID NO: 1252286 - protein, 24 aa, Mycobacterium
GAPRSVVAANRWLRLLPASGAPSP

SEQ ID NO: 1252287 - protein, 27 aa, Mycobacterium
GAPVLAICAAIQVLGHWYETSSGERVD

SEQ ID NO: 1252288 - protein, 33 aa, Mycobacterium
GAQARYAAAPLRVHPDIHLFPAIPQQRSSTAET

SEQ ID NO: 1252289 - protein, 25 aa, Mycobacterium
GAQGGRPEALGGLGGARPGQLLPTV

SEQ ID NO: 1252290 - protein, 23 aa, Mycobacterium
GAQLRRRRLGYGRGARMKFEQDE

SEQ ID NO: 1252291 - protein, 28 aa, Mycobacterium
GAQRPIAVEAYGLFIFRDAIRALGGSTV

SEQ ID NO: 1252292 - protein, 19 aa, Mycobacterium
GARAKVALASRIYVEGRHD

SEQ ID NO: 1252293 - protein, 20 aa, Mycobacterium
GARLTVSIAAFGSTRSINAA

SEQ ID NO: 1252294 - protein, 20 aa, Mycobacterium
GARSEIALQTALRGTCDPAN

SEQ ID NO: 1252295 - protein, 20 aa, Mycobacterium
GASVQRARVDGRTVAQSIVD

SEQ ID NO: 1252296 - protein, 18 aa, Mycobacterium
GASWAQLAAQYIAGIAEL

SEQ ID NO: 1252297 - protein, 24 aa, Mycobacterium
GATELSLATAEWVAFYNRQRPNGY

SEQ ID NO: 1252298 - protein, 17 aa, Mycobacterium
GATLSLAELDSFIRNEI

SEQ ID NO: 1252299 - protein, 22 aa, Mycobacterium
GATPDQRWTGAASDAYATANER

SEQ ID NO: 1252300 - protein, 20 aa, Mycobacterium
GATPPGMTFVSWLPFYHDMG

SEQ ID NO: 1252301 - protein, 20 aa, Mycobacterium
GATSLKRLLADRLRISDKAA

SEQ ID NO: 1252302 - protein, 19 aa, Mycobacterium
GATVPLYYENRIPELQLTN

SEQ ID NO: 1252303 - protein, 24 aa, Mycobacterium
GAVESLAGLSARVLYVTNNASRSP

SEQ ID NO: 1252304 - protein, 18 aa, Mycobacterium
GAVPDYLKLLAAGINVVS

SEQ ID NO: 1252305 - protein, 18 aa, Mycobacterium
GAVSRLRGVAHLRGHETD

SEQ ID NO: 1252306 - protein, 18 aa, Mycobacterium
GAVTGAFSLVNFANPVHF

SEQ ID NO: 1252307 - protein, 18 aa, Mycobacterium
GAVTRYFAAYNLVCGPVV

SEQ ID NO: 1252308 - protein, 25 aa, Mycobacterium
GAVVDMTVQWAFDRHSFGRPLASYQ

SEQ ID NO: 1252309 - protein, 22 aa, Mycobacterium
GAYVPGMCDYVVMVRNRSKVFL

SEQ ID NO: 1252310 - protein, 23 aa, Mycobacterium
GCDHEIRPGTAHLVVWPADSGES

SEQ ID NO: 1252311 - protein, 23 aa, Mycobacterium
GCEGCSMMADHLGPLSHLHAKDT

SEQ ID NO: 1252312 - protein, 17 aa, Mycobacterium
GCGDVRLGEEFHHNGLS

SEQ ID NO: 1252313 - protein, 19 aa, Mycobacterium
GCGHAELSLALAADGYTVV

SEQ ID NO: 1252314 - protein, 23 aa, Mycobacterium
GCGKTRFVEAMAHQLGRDLITVA

SEQ ID NO: 1252315 - protein, 18 aa, Mycobacterium
GCGMVNPNVLRACGIDPD

SEQ ID NO: 1252316 - protein, 18 aa, Mycobacterium
GCRVQSLGVMRYLPVASA

SEQ ID NO: 1252317 - protein, 23 aa, Mycobacterium
GCSAIGGYVRYHAILGASEHCIA

SEQ ID NO: 1252318 - protein, 22 aa, Mycobacterium
GCTPVAAACRLVHDSGDVLDDA

SEQ ID NO: 1252319 - protein, 17 aa, Mycobacterium
GCVERARFGPEFRGAAR

SEQ ID NO: 1252320 - protein, 20 aa, Mycobacterium
GCVIECGLALGGSGIMLATE

SEQ ID NO: 1252321 - protein, 17 aa, Mycobacterium
GCVLIGSHVRNDDPLAA

SEQ ID NO: 1252322 - protein, 25 aa, Mycobacterium
GCVRVVPAWQIDRGFDAGAADLRRL

SEQ ID NO: 1252323 - protein, 20 aa, Mycobacterium
GDAFMSGLIDALWTHGLLGA

SEQ ID NO: 1252324 - protein, 19 aa, Mycobacterium
GDAGAFTGLHFNVETESFE

SEQ ID NO: 1252325 - protein, 22 aa, Mycobacterium
GDAHRGASLIVWAIAEGRSAAH

SEQ ID NO: 1252326 - protein, 19 aa, Mycobacterium
GDAYSRCDGHYDAYVERVQ

SEQ ID NO: 1252327 - protein, 18 aa, Mycobacterium
GDDARYWVEPGGVLVAGG

SEQ ID NO: 1252328 - protein, 21 aa, Mycobacterium
GDDEKTTWGDVFQRVRNGVAP

SEQ ID NO: 1252329 - protein, 18 aa, Mycobacterium
GDDVRWLADLTVRDGVDV

SEQ ID NO: 1252330 - protein, 17 aa, Mycobacterium
GDEAFPRAARKALQDSQ

SEQ ID NO: 1252331 - protein, 26 aa, Mycobacterium
GDEASRLFLTQMIEHHKGAITMAQQE

SEQ ID NO: 1252332 - protein, 22 aa, Mycobacterium
GDFDGVGLLLARGSFAGVAGAG

SEQ ID NO: 1252333 - protein, 21 aa, Mycobacterium
GDGALGFWKAMREVFPATREQ

SEQ ID NO: 1252334 - protein, 17 aa, Mycobacterium
GDGAYFIHYRWDSTDRD

SEQ ID NO: 1252335 - protein, 21 aa, Mycobacterium
GDGQRALVFRGLNLGDSTIKT

SEQ ID NO: 1252336 - protein, 19 aa, Mycobacterium
GDGRCKQVPYSKRAPRLAR

SEQ ID NO: 1252337 - protein, 24 aa, Mycobacterium
GDGTRLAEHWQLLPSGVAGFHERY

SEQ ID NO: 1252338 - protein, 20 aa, Mycobacterium
GDGVTRWKVGDEVVGMLPMA

SEQ ID NO: 1252339 - protein, 19 aa, Mycobacterium
GDHSITWPAATAVADVHGH

SEQ ID NO: 1252340 - protein, 19 aa, Mycobacterium
GDHSITWPAATAVADVHGY

SEQ ID NO: 1252341 - protein, 17 aa, Mycobacterium
GDIIPRLVSDGMAAVYD

SEQ ID NO: 1252342 - protein, 21 aa, Mycobacterium
GDIPPPPGWNQPPGPPGLYTP

SEQ ID NO: 1252343 - protein, 19 aa, Mycobacterium
GDITPYFSVGACVPIPIPF

SEQ ID NO: 1252344 - protein, 19 aa, Mycobacterium
GDKVSLWYGSANRDESKFL

SEQ ID NO: 1252345 - protein, 21 aa, Mycobacterium
GDLDFLRRPLLGFLSMAAGPT

SEQ ID NO: 1252346 - protein, 18 aa, Mycobacterium
GDLDRDLVLWAGGSGITP

SEQ ID NO: 1252347 - protein, 20 aa, Mycobacterium
GDLRSLFAFCNERTPGADLG

SEQ ID NO: 1252348 - protein, 22 aa, Mycobacterium
GDPARMFGRMLGIDGGVNPPFE

SEQ ID NO: 1252349 - protein, 20 aa, Mycobacterium
GDQTMFRKVFESVLAGHVKV

SEQ ID NO: 1252350 - protein, 24 aa, Mycobacterium
GDRHWPALCRSVGRHDWLTDDRFA

SEQ ID NO: 1252351 - protein, 24 aa, Mycobacterium
GDRLRLALDGELAAAVTGSTAPLA

SEQ ID NO: 1252352 - protein, 29 aa, Mycobacterium
GDRVMAALVLRPGAEFAVEKFQAFLAEQS

SEQ ID NO: 1252353 - protein, 22 aa, Mycobacterium
GDSARVLAAMWTQWMDAAATNA

SEQ ID NO: 1252354 - protein, 21 aa, Mycobacterium
GDSNVAFFREYRNVGLTPQDM

SEQ ID NO: 1252355 - protein, 23 aa, Mycobacterium
GDSRAVSLLARVILPRPGEPLDV

SEQ ID NO: 1252356 - protein, 17 aa, Mycobacterium
GDTALRFMGRTTTWGEL

SEQ ID NO: 1252357 - protein, 20 aa, Mycobacterium
GDTNTVLAFFVEQMSTEQSA

SEQ ID NO: 1252358 - protein, 25 aa, Mycobacterium
GDTPMILGALPFDLTAPTALFRPQR

SEQ ID NO: 1252359 - protein, 19 aa, Mycobacterium
GDTRWIHRAAHDLMGVNPG

SEQ ID NO: 1252360 - protein, 17 aa, Mycobacterium
GDVFPIHVECMDDAQRL

SEQ ID NO: 1252361 - protein, 19 aa, Mycobacterium
GDVGYPFSVQLPRQAQNYA

SEQ ID NO: 1252362 - protein, 17 aa, Mycobacterium
GDVTRTADDAGWDVVHV

SEQ ID NO: 1252363 - protein, 25 aa, Mycobacterium
GDVVDWSFHGGGGWGDPLDADPDEV

SEQ ID NO: 1252364 - protein, 19 aa, Mycobacterium
GDVVQECYTTLAGRSEEDG

SEQ ID NO: 1252365 - protein, 22 aa, Mycobacterium
GEAACGTCHVIVAPEWSDTVGL

SEQ ID NO: 1252366 - protein, 17 aa, Mycobacterium
GEAALSRRARAASRLSA

SEQ ID NO: 1252367 - protein, 25 aa, Mycobacterium
GEDPCPLLAACRLRKAMSDAKEAFY

SEQ ID NO: 1252368 - protein, 23 aa, Mycobacterium
GEEGRAWPSIARARDEGAAAVCA

SEQ ID NO: 1252369 - protein, 18 aa, Mycobacterium
GEEQPCIAGPRVGVSKAA

SEQ ID NO: 1252370 - protein, 26 aa, Mycobacterium
GEFAPRLAGTLSYFECTPWAEYDAGD

SEQ ID NO: 1252371 - protein, 24 aa, Mycobacterium
GEGALRLWDAVVAWTEFPHLYELQ

SEQ ID NO: 1252372 - protein, 22 aa, Mycobacterium
GEGHPALHVLLWQRALDPERGR

SEQ ID NO: 1252373 - protein, 25 aa, Mycobacterium
GEGKLYLCAIKDVFSNRIVGYSIDS

SEQ ID NO: 1252374 - protein, 20 aa, Mycobacterium
GEGLRRLGFESHVVTVDGHR

SEQ ID NO: 1252375 - protein, 20 aa, Mycobacterium
GEGQVAAAVRLLDEGATVPF

SEQ ID NO: 1252376 - protein, 17 aa, Mycobacterium
GEGRWAAHLPLTRQLQL

SEQ ID NO: 1252377 - protein, 18 aa, Mycobacterium
GEGVLRLVYSRGRESGGA

SEQ ID NO: 1252378 - protein, 24 aa, Mycobacterium
GEHHPHLLPLAGRVLEATDAETLS

SEQ ID NO: 1252379 - protein, 21 aa, Mycobacterium
GEIDLAAARDLPCHTGVRLLG

SEQ ID NO: 1252380 - protein, 19 aa, Mycobacterium
GEIISKIAVPAVRERLTDA

SEQ ID NO: 1252381 - protein, 17 aa, Mycobacterium
GEILRYINWVADKLDLR

SEQ ID NO: 1252382 - protein, 17 aa, Mycobacterium
GEIVQRLHVLAPGKRIL

SEQ ID NO: 1252383 - protein, 23 aa, Mycobacterium
GEKPRGAGLFVVAHSNGCELALR

SEQ ID NO: 1252384 - protein, 23 aa, Mycobacterium
GELGEPFTTAGLCLYRDGNDSVA

SEQ ID NO: 1252385 - protein, 21 aa, Mycobacterium
GELPPWLGDEAFHRSHRAALV

SEQ ID NO: 1252386 - protein, 19 aa, Mycobacterium
GEPGEFCTRGYSVMLGYWN

SEQ ID NO: 1252387 - protein, 18 aa, Mycobacterium
GEPIPGLFAAGRSTAGLA

SEQ ID NO: 1252388 - protein, 22 aa, Mycobacterium
GEPPPDIELIGMLNLLIGGGFD

SEQ ID NO: 1252389 - protein, 22 aa, Mycobacterium
GEPYVPFDAGADYQRFVDGKRR

SEQ ID NO: 1252390 - protein, 18 aa, Mycobacterium
GERFSLLPLSARTPAALV

SEQ ID NO: 1252391 - protein, 18 aa, Mycobacterium
GERGGLQRASDWLGDPVR

SEQ ID NO: 1252392 - protein, 24 aa, Mycobacterium
GERRIPIDEFYRLPVDEPHRDTVL

SEQ ID NO: 1252393 - protein, 29 aa, Mycobacterium
GERVVRALRHGTVWLNDFGYYTAAAEWGG

SEQ ID NO: 1252394 - protein, 31 aa, Mycobacterium
GESAAHPGLEAKLVRGIAWTEAVSGHATALA

SEQ ID NO: 1252395 - protein, 18 aa, Mycobacterium
GETLLRLLDNFVTAANEL

SEQ ID NO: 1252396 - protein, 18 aa, Mycobacterium
GETLVEIETLWTVGGEYP

SEQ ID NO: 1252397 - protein, 26 aa, Mycobacterium
GETPYDPRMMVAVLLYGYTVGVCSSR

SEQ ID NO: 1252398 - protein, 28 aa, Mycobacterium
GEVADGWSRLASALALTGVDVGQRVASP

SEQ ID NO: 1252399 - protein, 20 aa, Mycobacterium
GEVAKFWLSALWELPRAAAI

SEQ ID NO: 1252400 - protein, 19 aa, Mycobacterium
GEVSLPRLVQAVSAERGRP

SEQ ID NO: 1252401 - protein, 21 aa, Mycobacterium
GEVVEAPDGFMLVCSYNPAYR

SEQ ID NO: 1252402 - protein, 25 aa, Mycobacterium
GEVVVCGRLKDVIIMAGRNIYPTDI

SEQ ID NO: 1252403 - protein, 39 aa, Mycobacterium
GEWTEPTVLPAQWPVLLCNGAVGIAEGWATKVPAHNPRE

SEQ ID NO: 1252404 - protein, 25 aa, Mycobacterium
GFAGGRGHWALTRYDGVHHASRHPE

SEQ ID NO: 1252405 - protein, 19 aa, Mycobacterium
GFAGPRQRYTLAIMNSLNG

SEQ ID NO: 1252406 - protein, 18 aa, Mycobacterium
GFEGPRMLLGDLNMSPPT

SEQ ID NO: 1252407 - protein, 18 aa, Mycobacterium
GFGQLAAAGHEWIESLDV

SEQ ID NO: 1252408 - protein, 18 aa, Mycobacterium
GFHGIPFADTLGKTRETI

SEQ ID NO: 1252409 - protein, 23 aa, Mycobacterium
GFLARRTPTPSGRVAVISGGGSG

SEQ ID NO: 1252410 - protein, 21 aa, Mycobacterium
GFRGRWGQRVADDPVLRRCGP

SEQ ID NO: 1252411 - protein, 18 aa, Mycobacterium
GFSGAVLKLMRAGDYTFT

SEQ ID NO: 1252412 - protein, 26 aa, Mycobacterium
GFSGHGFKFVPVVGEILADLATTGAT

SEQ ID NO: 1252413 - protein, 19 aa, Mycobacterium
GFTSLGLTEEEAWALMNEL

SEQ ID NO: 1252414 - protein, 17 aa, Mycobacterium
GGAAIKPLWLPGPDPEP

SEQ ID NO: 1252415 - protein, 19 aa, Mycobacterium
GGAHYCLGANLARRELAEA

SEQ ID NO: 1252416 - protein, 19 aa, Mycobacterium
GGAKPHYGPIIMIGDPAAM

SEQ ID NO: 1252417 - protein, 18 aa, Mycobacterium
GGASWEFEDRKSLPLTVV

SEQ ID NO: 1252418 - protein, 20 aa, Mycobacterium
GGAVLAARVLGRMAATPSTH

SEQ ID NO: 1252419 - protein, 19 aa, Mycobacterium
GGELGRYSPYAVYLPGGDP

SEQ ID NO: 1252420 - protein, 24 aa, Mycobacterium
GGELTWPPGWSRWPSRRYGDTRLD

SEQ ID NO: 1252421 - protein, 20 aa, Mycobacterium
GGESTRPGATRVDPEVEAAR

SEQ ID NO: 1252422 - protein, 23 aa, Mycobacterium
GGEVGCRILVNGVVHDEQSATRQ

SEQ ID NO: 1252423 - protein, 26 aa, Mycobacterium
GGFDVSPRLAAAISDSRAELSGDTAA

SEQ ID NO: 1252424 - protein, 19 aa, Mycobacterium
GGGAPMMLPPGSMGPPAGA

SEQ ID NO: 1252425 - protein, 25 aa, Mycobacterium
GGGCLPKDIRAFIAMAGELGAGQAF

SEQ ID NO: 1252426 - protein, 23 aa, Mycobacterium
GGGDFLSRWWATRNARRLETPAT

SEQ ID NO: 1252427 - protein, 23 aa, Mycobacterium
GGGLPIGACLAVGPVGDLLTPGL

SEQ ID NO: 1252428 - protein, 17 aa, Mycobacterium
GGGMWFPCNPVAQRAGI

SEQ ID NO: 1252429 - protein, 25 aa, Mycobacterium
GGGRGIGVMIARGLLQAGASVYLSS

SEQ ID NO: 1252430 - protein, 19 aa, Mycobacterium
GGGSLIGIGGGNAAGGDGG

SEQ ID NO: 1252431 - protein, 23 aa, Mycobacterium
GGGTSRPAVMWIHSGGFVVGSPQ

SEQ ID NO: 1252432 - protein, 18 aa, Mycobacterium
GGIGWVPYFLERIDRTYK

SEQ ID NO: 1252433 - protein, 18 aa, Mycobacterium
GGIGYTWESGVHVYLKRA

SEQ ID NO: 1252434 - protein, 17 aa, Mycobacterium
GGIPAGFTGYGGIDVTP

SEQ ID NO: 1252435 - protein, 18 aa, Mycobacterium
GGITRLWRRTTGVPAPVI

SEQ ID NO: 1252436 - protein, 24 aa, Mycobacterium
GGKEIRIALPVTFDTLRGSGQSVH

SEQ ID NO: 1252437 - protein, 20 aa, Mycobacterium
GGLGGCPFAPGASGNIATED

SEQ ID NO: 1252438 - protein, 23 aa, Mycobacterium
GGLIEPHEGLTILFGENGTGKTG

SEQ ID NO: 1252439 - protein, 18 aa, Mycobacterium
GGMARALLDDGGFAVRAL

SEQ ID NO: 1252440 - protein, 28 aa, Mycobacterium
GGMGGTSLMDILGQLLGAGGSGMSGMNP

SEQ ID NO: 1252441 - protein, 21 aa, Mycobacterium
GGMGMMPMGARGAGGDTKASK

SEQ ID NO: 1252442 - protein, 20 aa, Mycobacterium
GGMWCPPSPIDKVLDRNGDE

SEQ ID NO: 1252443 - protein, 19 aa, Mycobacterium
GGNRARILAVSPLIREMMI

SEQ ID NO: 1252444 - protein, 17 aa, Mycobacterium
GGPARPRLMPLHLDGPA

SEQ ID NO: 1252445 - protein, 17 aa, Mycobacterium
GGPDYLLQVYKTYGPLH

SEQ ID NO: 1252446 - protein, 17 aa, Mycobacterium
GGPERRMLFLVSATDAY

SEQ ID NO: 1252447 - protein, 27 aa, Mycobacterium
GGPSPAPAVVYCHSGAFVLGNLDTDHR

SEQ ID NO: 1252448 - protein, 18 aa, Mycobacterium
GGPTPGPVTFDFGDQTQD

SEQ ID NO: 1252449 - protein, 19 aa, Mycobacterium
GGQPCGARIVVVTHRATDA

SEQ ID NO: 1252450 - protein, 22 aa, Mycobacterium
GGRAWLGIGAAWFEREHRGLGV

SEQ ID NO: 1252451 - protein, 26 aa, Mycobacterium
GGRDEVWRFTPLRRLRGLHDGSAVAS

SEQ ID NO: 1252452 - protein, 19 aa, Mycobacterium
GGSCQRTWEHAIPKTTRPT

SEQ ID NO: 1252453 - protein, 19 aa, Mycobacterium
GGSGARILTTLLYHMRDNN

SEQ ID NO: 1252454 - protein, 18 aa, Mycobacterium
GGSGMGFVVVSELCRVCM

SEQ ID NO: 1252455 - protein, 18 aa, Mycobacterium
GGSHPRFARNLGTGEPPI

SEQ ID NO: 1252456 - protein, 17 aa, Mycobacterium
GGSKPGLTAPAPLVHDL

SEQ ID NO: 1252457 - protein, 19 aa, Mycobacterium
GGSLKGFVVSGRWPDSTKE

SEQ ID NO: 1252458 - protein, 17 aa, Mycobacterium
GGSLPVPLIIGTNKHEA

SEQ ID NO: 1252459 - protein, 18 aa, Mycobacterium
GGSTARSGGGVWIPNNEI

SEQ ID NO: 1252460 - protein, 18 aa, Mycobacterium
GGSTARSGGGVWIPNNEV

SEQ ID NO: 1252461 - protein, 24 aa, Mycobacterium
GGTLPEVDGALFAAALRHAVDLVE

SEQ ID NO: 1252462 - protein, 22 aa, Mycobacterium
GGTRFRPHFFPFTEPSAEVDVW

SEQ ID NO: 1252463 - protein, 18 aa, Mycobacterium
GGTTGVFVDGERVESVGV

SEQ ID NO: 1252464 - protein, 18 aa, Mycobacterium
GGTVAGTAVNDWVDENGE

SEQ ID NO: 1252465 - protein, 17 aa, Mycobacterium
GGVAHKPWRARRAEEVL

SEQ ID NO: 1252466 - protein, 17 aa, Mycobacterium
GGVKVAFFRKGVECTPD

SEQ ID NO: 1252467 - protein, 27 aa, Mycobacterium
GGVPTLLWKLVEEIRPGDTVVLQRSQP

SEQ ID NO: 1252468 - protein, 19 aa, Mycobacterium
GGVSLRVPHHVGYFHEPGS

SEQ ID NO: 1252469 - protein, 22 aa, Mycobacterium
GGYRRCVGAAFATSELAVALGT

SEQ ID NO: 1252470 - protein, 17 aa, Mycobacterium
GHFSRAVITRWAELPLT

SEQ ID NO: 1252471 - protein, 22 aa, Mycobacterium
GHGEPEVWQRLLTAIRDAGLVL

SEQ ID NO: 1252472 - protein, 27 aa, Mycobacterium
GHGGLRTRRGEVINAFLERHRATTLDV

SEQ ID NO: 1252473 - protein, 22 aa, Mycobacterium
GHGKSTLALDFMRSCSIKHGMA

SEQ ID NO: 1252474 - protein, 17 aa, Mycobacterium
GHLAARGELSLFLGAGV

SEQ ID NO: 1252475 - protein, 17 aa, Mycobacterium
GHLESGAGITGFIKTVL

SEQ ID NO: 1252476 - protein, 23 aa, Mycobacterium
GHLTELELQWGRTIGQLPSPYTA

SEQ ID NO: 1252477 - protein, 18 aa, Mycobacterium
GHRIAYDVAANWKLIVEN

SEQ ID NO: 1252478 - protein, 24 aa, Mycobacterium
GHSQWYIDRFRAMARAGDDLVGEA

SEQ ID NO: 1252479 - protein, 24 aa, Mycobacterium
GHTATRLVLYNALADAERLERYGT

SEQ ID NO: 1252480 - protein, 26 aa, Mycobacterium
GHVLPVRCPHVPRNAQDLVWDRMVRI

SEQ ID NO: 1252481 - protein, 24 aa, Mycobacterium
GIASSTRYDWILADLAIMCAGGAT

SEQ ID NO: 1252482 - protein, 17 aa, Mycobacterium
GIDFARVGAVDFHTHVE

SEQ ID NO: 1252483 - protein, 21 aa, Mycobacterium
GIDLKASVFGPTTPELERTDL

SEQ ID NO: 1252484 - protein, 18 aa, Mycobacterium
GIDPDEYSGFAFGMGLER

SEQ ID NO: 1252485 - protein, 18 aa, Mycobacterium
GIEPRAGYEPAAAAGDEL

SEQ ID NO: 1252486 - protein, 26 aa, Mycobacterium
GIGFASARLLGQFGASVMVTGTTERA

SEQ ID NO: 1252487 - protein, 21 aa, Mycobacterium
GIGPWAKLLRFRDDLDRLLAE

SEQ ID NO: 1252488 - protein, 24 aa, Mycobacterium
GIGRATAVLFAREGARLVVTDIQS

SEQ ID NO: 1252489 - protein, 19 aa, Mycobacterium
GIGRGIAVELARQGADIAL

SEQ ID NO: 1252490 - protein, 34 aa, Mycobacterium
GIGVLYGRRELLAEMPPFLTGGSMIETVTMEGAT

SEQ ID NO: 1252491 - protein, 22 aa, Mycobacterium
GIHGQEVLTEWLGMADSEYEAL

SEQ ID NO: 1252492 - protein, 25 aa, Mycobacterium
GILGRHGRSSVLVIRNGQDGSAGSG

SEQ ID NO: 1252493 - protein, 18 aa, Mycobacterium
GIMPKLPMTFADWEAKAQ

SEQ ID NO: 1252494 - protein, 18 aa, Mycobacterium
GISAPRFLLEDCADDVAA

SEQ ID NO: 1252495 - protein, 35 aa, Mycobacterium; identical to SEQ ID NO: 667363

SEQ ID NO: 1252496 - protein, 17 aa, Mycobacterium
GKADLVKEFTFDYPSQI

SEQ ID NO: 1252497 - protein, 21 aa, Mycobacterium
GKAPLSRPVAVVLLGGLRELT

SEQ ID NO: 1252498 - protein, 17 aa, Mycobacterium
GKCPAVLGAPDADLLVL

SEQ ID NO: 1252499 - protein, 24 aa, Mycobacterium
GKGQWLAEQVMEWAGLDLLILRIA

SEQ ID NO: 1252500 - protein, 21 aa, Mycobacterium
GKGTALITMCAGGALSTGTII

SEQ ID NO: 1252501 - protein, 19 aa, Mycobacterium
GKLPATWRYTAEGLQRVRR

SEQ ID NO: 1252502 - protein, 19 aa, Mycobacterium
GKLPSEVFREHFLTCFIAD

SEQ ID NO: 1252503 - protein, 19 aa, Mycobacterium
GKRKRTRSGFGQRKSTKRA

SEQ ID NO: 1252504 - protein, 17 aa, Mycobacterium
GKRSIGLDMSVPEGREV

SEQ ID NO: 1252505 - protein, 26 aa, Mycobacterium
GKSHIIGLMAERWILAGYGVLVVDPE

SEQ ID NO: 1252506 - protein, 35 aa, Mycobacterium
GKSLSMLWFTQKVLRHVRGKWTFVMVTDRTELDTQ

SEQ ID NO: 1252507 - protein, 23 aa, Mycobacterium
GKTEAYLGLAAYTFAIRRLQGKI

SEQ ID NO: 1252508 - protein, 29 aa, Mycobacterium
GKTIIDINVRWKKGTTLEPDWQLDGDGWK

SEQ ID NO: 1252509 - protein, 34 aa, Mycobacterium
GKWYPGEPLPRWQIGLYWRADGAPLWTDASLLAD

SEQ ID NO: 1252510 - protein, 18 aa, Mycobacterium
GLAEGIERTVAWYRRNVG

SEQ ID NO: 1252511 - protein, 26 aa, Mycobacterium
GLALAEGFALAGARVVVASRKPDACE

SEQ ID NO: 1252512 - protein, 24 aa, Mycobacterium
GLASAWAAELCERYAPELNIVGAV

SEQ ID NO: 1252513 - protein, 33 aa, Mycobacterium
GLATELGLAFTPVFLSEEWRQVVLARRISTADA

SEQ ID NO: 1252514 - protein, 25 aa, Mycobacterium
GLCTAGLPADGEWPAMAPRIQALTV

SEQ ID NO: 1252515 - protein, 26 aa, Mycobacterium
GLDDDVRRALGFTFERFDGGGLPEGA

SEQ ID NO: 1252516 - protein, 20 aa, Mycobacterium
GLDLKWTHLGADNTSLFLKD

SEQ ID NO: 1252517 - protein, 23 aa, Mycobacterium
GLDLWLDEEALVFLDLNDRAAVA

SEQ ID NO: 1252518 - protein, 23 aa, Mycobacterium
GLDRDFVPGLARFIRQHSGGRWA

SEQ ID NO: 1252519 - protein, 23 aa, Mycobacterium
GLDREADDFFAFIADVSGANNGE

SEQ ID NO: 1252520 - protein, 26 aa, Mycobacterium
GLDSRAYRLPWPDGTVVYEIDQPAVI

SEQ ID NO: 1252521 - protein, 28 aa, Mycobacterium
GLDTRAFRLPWPDGMTVFEIDQPTVLRY

SEQ ID NO: 1252522 - protein, 24 aa, Mycobacterium
GLEGLRKIVRRLLDAGSVSGEFAD

SEQ ID NO: 1252523 - protein, 17 aa, Mycobacterium
GLELALWCDLRVVEEDA

SEQ ID NO: 1252524 - protein, 22 aa, Mycobacterium
GLERRVGELQAQVVVAAADLTK

SEQ ID NO: 1252525 - protein, 25 aa, Mycobacterium
GLGAPEFASRIGVGVDEFQSYIDGE

SEQ ID NO: 1252526 - protein, 17 aa, Mycobacterium
GLGGRKLGDEWSQGTFA

SEQ ID NO: 1252527 - protein, 21 aa, Mycobacterium
GLGHLGVQFARAMGFETVAIA

SEQ ID NO: 1252528 - protein, 23 aa, Mycobacterium
GLGPALRILRAVAHMTRRTVEGQ

SEQ ID NO: 1252529 - protein, 25 aa, Mycobacterium
GLGPTFPSYGWFRPLITIDHVLTRN

SEQ ID NO: 1252530 - protein, 24 aa, Mycobacterium
GLGRGDIDAGIALGGRYLLAAQRA

SEQ ID NO: 1252531 - protein, 19 aa, Mycobacterium
GLHFCLGSALARLEARVAF

SEQ ID NO: 1252532 - protein, 20 aa, Mycobacterium
GLHGGMFGEVGTYLPGRRIT

SEQ ID NO: 1252533 - protein, 18 aa, Mycobacterium
GLHPTNLGRLVLNEPAPL

SEQ ID NO: 1252534 - protein, 24 aa, Mycobacterium
GLIAPHYPAPWGLDATPLQQLIID

SEQ ID NO: 1252535 - protein, 18 aa, Mycobacterium
GLIGSRWLAHYTATTTFL

SEQ ID NO: 1252536 - protein, 18 aa, Mycobacterium
GLLLELVNNVARQVTPGA

SEQ ID NO: 1252537 - protein, 17 aa, Mycobacterium
GLPDDWYAEVVARLVPL

SEQ ID NO: 1252538 - protein, 17 aa, Mycobacterium
GLPDWSELLKALAKEAG

SEQ ID NO: 1252539 - protein, 24 aa, Mycobacterium
GLPTEAADLPWLLAGAKTLSYAVN

SEQ ID NO: 1252540 - protein, 18 aa, Mycobacterium
GLPYFPVTPLFPVAGPLG

SEQ ID NO: 1252541 - protein, 20 aa, Mycobacterium
GLRANELVKQFGAAVNGRGG

SEQ ID NO: 1252542 - protein, 22 aa, Mycobacterium
GLRHEHKLRRFGRATEVAGVAA

SEQ ID NO: 1252543 - protein, 24 aa, Mycobacterium
GLRYYRAAFFEVIPRVNAEVRSAL

SEQ ID NO: 1252544 - protein, 25 aa, Mycobacterium
GLSLDIAQAVALVWEATIDATGPDS

SEQ ID NO: 1252545 - protein, 19 aa, Mycobacterium
GLSVISWPERYGGRDATLL

SEQ ID NO: 1252546 - protein, 18 aa, Mycobacterium
GLVNVDWTSRFHCDERQV

SEQ ID NO: 1252547 - protein, 22 aa, Mycobacterium
GLWKALSARDWDAVKTHLSDDC

SEQ ID NO: 1252548 - protein, 28 aa, Mycobacterium
GMEYCPPELPGLEPLWGKSVFQCPFCHG

SEQ ID NO: 1252549 - protein, 17 aa, Mycobacterium
GMHALICSHGVLIAHAA

SEQ ID NO: 1252550 - protein, 24 aa, Mycobacterium
GMPAMRAVSCSIALTENFPHNGSL

SEQ ID NO: 1252551 - protein, 22 aa, Mycobacterium
GMRDLRRFMSGPAYARRLTAQA

SEQ ID NO: 1252552 - protein, 24 aa, Mycobacterium
GMRRRIDIAVSLVVPPQVLFLDEP

SEQ ID NO: 1252553 - protein, 23 aa, Mycobacterium
GMSCAHCVASITKAVQPLPGVAD

SEQ ID NO: 1252554 - protein, 22 aa, Mycobacterium
GMSLRSPARFLAPAERLVAEWK

SEQ ID NO: 1252555 - protein, 21 aa, Mycobacterium
GMTFVSWLPFYHDMGLIKGVC

SEQ ID NO: 1252556 - protein, 25 aa, Mycobacterium
GMVRTVRASTIWDDVRKCVGGYTCH

SEQ ID NO: 1252557 - protein, 18 aa, Mycobacterium
GNAMLAFAQAYRAAGTTP

SEQ ID NO: 1252558 - protein, 18 aa, Mycobacterium
GNGDLTFAVRPLGEVSNW

SEQ ID NO: 1252559 - protein, 25 aa, Mycobacterium
GNGGPTAWWHGRIVGGWGQDADGRV

SEQ ID NO: 1252560 - protein, 27 aa, Mycobacterium
GNGREWGQFAFDEFLEIKAALGYAPEA

SEQ ID NO: 1252561 - protein, 19 aa, Mycobacterium
GNGRGRLSDAGWDALDAAM

SEQ ID NO: 1252562 - protein, 19 aa, Mycobacterium
GNGRRLRVAGAGLLRAWRA

SEQ ID NO: 1252563 - protein, 26 aa, Mycobacterium
GNIAGCLVQSGIMRRNAKARLLRDNV

SEQ ID NO: 1252564 - protein, 27 aa, Mycobacterium
GNIAGCLVQSGIMRRNAKARLLRDNVV

SEQ ID NO: 1252565 - protein, 18 aa, Mycobacterium
GNPVDIYTFLPLARAAVQ

SEQ ID NO: 1252566 - protein, 19 aa, Mycobacterium
GNSVPRFHVAWGTGTGVVG

SEQ ID NO: 1252567 - protein, 19 aa, Mycobacterium
GNWDTAWDPTLPAIPSAFV

SEQ ID NO: 1252568 - protein, 18 aa, Mycobacterium
GNYLPKFGPYLSSGSNPW

SEQ ID NO: 1252569 - protein, 25 aa, Mycobacterium
GPAEALRALGIRVWSDVPVGASTSD

SEQ ID NO: 1252570 - protein, 21 aa, Mycobacterium
GPAECPGRNLALFTTSTLLAN

SEQ ID NO: 1252571 - protein, 24 aa, Mycobacterium
GPATRWSRRLGELTRTTARDVTVR

SEQ ID NO: 1252572 - protein, 26 aa, Mycobacterium
GPAVNLYERFLWRLFSKDYSLFERYQ

SEQ ID NO: 1252573 - protein, 18 aa, Mycobacterium
GPDAIALLTTDTIMYVSP

SEQ ID NO: 1252574 - protein, 26 aa, Mycobacterium
GPDEVLRLAPNVWPRNAVRGADGVVS

SEQ ID NO: 1252575 - protein, 20 aa, Mycobacterium
GPDHYRWTLHAGPVETTWES

SEQ ID NO: 1252576 - protein, 19 aa, Mycobacterium
GPDVGAVWHYGDPLGEQRA

SEQ ID NO: 1252577 - protein, 21 aa, Mycobacterium
GPEAGMALDVPWIPASGPALS

SEQ ID NO: 1252578 - protein, 18 aa, Mycobacterium
GPEGLGYAHLPSSGSTVT

SEQ ID NO: 1252579 - protein, 18 aa, Mycobacterium
GPELAARFEFPRLRFVAS

SEQ ID NO: 1252580 - protein, 26 aa, Mycobacterium
GPETPCAVVAFASWPEEIVLRGTLAD

SEQ ID NO: 1252581 - protein, 22 aa, Mycobacterium
GPFAGRLLGDMGAEVLKIEPPA

SEQ ID NO: 1252582 - protein, 17 aa, Mycobacterium
GPFGFGPVDRRRQARRE

SEQ ID NO: 1252583 - protein, 20 aa, Mycobacterium
GPGLTRVRRGKGFSYRDANG

SEQ ID NO: 1252584 - protein, 29 aa, Mycobacterium
GPGQEVRWVRRGGYVLSSFVAAALPADEI

SEQ ID NO: 1252585 - protein, 17 aa, Mycobacterium
GPGRLVADLVRRGVPAL

SEQ ID NO: 1252586 - protein, 31 aa, Mycobacterium
GPHPFPLMVRDFQRIIGLEARVQIQAQAGRL

SEQ ID NO: 1252587 - protein, 17 aa, Mycobacterium
GPKGGPGMREMLAITGA

SEQ ID NO: 1252588 - protein, 17 aa, Mycobacterium
GPLEASRPWATKDVVGA

SEQ ID NO: 1252589 - protein, 18 aa, Mycobacterium
GPLEASRPWATKDVVGAH

SEQ ID NO: 1252590 - protein, 32 aa, Mycobacterium
GPLPDEMPAAALWWRITETLAPTAAVPEPQES

SEQ ID NO: 1252591 - protein, 28 aa, Mycobacterium
GPLPRQARLADFRLPQRGICVVGQGLFD

SEQ ID NO: 1252592 - protein, 33 aa, Mycobacterium
GPLSAEGLIAWSRERMAGFKVPRYVEFLDELPL

SEQ ID NO: 1252593 - protein, 24 aa, Mycobacterium
GPPERYGPDLVRYRLASRVVKGQQ

SEQ ID NO: 1252594 - protein, 18 aa, Mycobacterium
GPPTAAVRRDRIDRLTAL

SEQ ID NO: 1252595 - protein, 17 aa, Mycobacterium
GPQRPALIFLNSPSNPT

SEQ ID NO: 1252596 - protein, 23 aa, Mycobacterium
GPRGCGKTSSARILARSLNCEQG

SEQ ID NO: 1252597 - protein, 28 aa, Mycobacterium
GPRGDAIKGCFDCRGVGHRFVKVSSVRT

SEQ ID NO: 1252598 - protein, 19 aa, Mycobacterium
GPRVKRTLTATGLRQLIAF

SEQ ID NO: 1252599 - protein, 19 aa, Mycobacterium
GPSSMWFDALGRRLPAPCL

SEQ ID NO: 1252600 - protein, 18 aa, Mycobacterium
GPVALARLIPAGVDVRGN

SEQ ID NO: 1252601 - protein, 17 aa, Mycobacterium
GPVLCILGYDDLDQAIE

SEQ ID NO: 1252602 - protein, 17 aa, Mycobacterium
GPYAVGITGEDAHLFTA

SEQ ID NO: 1252603 - protein, 20 aa, Mycobacterium
GQAYWSFGGLFLVDSPEQRR

SEQ ID NO: 1252604 - protein, 20 aa, Mycobacterium
GQGPAIRDAIIRLSQSVSAL

SEQ ID NO: 1252605 - protein, 23 aa, Mycobacterium
GQHFRVGPKRVWLVCDSTATVHG

SEQ ID NO: 1252606 - protein, 29 aa, Mycobacterium
GQLAGDKRFPFGIPKPDNANYLWIQQFYA

SEQ ID NO: 1252607 - protein, 18 aa, Mycobacterium
GQLCLPFYGALVTNCELD

SEQ ID NO: 1252608 - protein, 18 aa, Mycobacterium
GQLFRIAMYHDRLPDGHY

SEQ ID NO: 1252609 - protein, 21 aa, Mycobacterium
GQSYPFAPPVGLMFVLWDEEA

SEQ ID NO: 1252610 - protein, 22 aa, Mycobacterium
GQVCSAGTRLIVEESIADDFVA

SEQ ID NO: 1252611 - protein, 17 aa, Mycobacterium
GQVIANFEAAAAVLYEQ

SEQ ID NO: 1252612 - protein, 24 aa, Mycobacterium
GQYEPIAVVGMGCRLPGGVSDPDG

SEQ ID NO: 1252613 - protein, 23 aa, Mycobacterium
GRAPHGAALIEWLEEPGKEHRID

SEQ ID NO: 1252614 - protein, 17 aa, Mycobacterium
GRATSGVQGMRFNADDE

SEQ ID NO: 1252615 - protein, 34 aa, Mycobacterium
GRAVLPAVVCDRVMPGNCFAPFHFNDEHGEYLTV

SEQ ID NO: 1252616 - protein, 19 aa, Mycobacterium
GRAVVDWTFVEPKLLDLAT

SEQ ID NO: 1252617 - protein, 18 aa, Mycobacterium
GRAVVMLMLVRYVDGDLG

SEQ ID NO: 1252618 - protein, 25 aa, Mycobacterium
GRAWADWLPAVGRWTPASAQMPPPR

SEQ ID NO: 1252619 - protein, 18 aa, Mycobacterium
GRAWARFERGEVVFKAEV

SEQ ID NO: 1252620 - protein, 20 aa, Mycobacterium
GRDASVGWLVRRLEGDREVI

SEQ ID NO: 1252621 - protein, 22 aa, Mycobacterium
GRFAREITVGFPVHTSILEPLR

SEQ ID NO: 1252622 - protein, 26 aa, Mycobacterium
GRFDTGVFKADGWRFTTKVESQYLAQ

SEQ ID NO: 1252623 - protein, 18 aa, Mycobacterium
GRGAGVWTGIEGVAGVER

SEQ ID NO: 1252624 - protein, 20 aa, Mycobacterium
GRGDALRTAGAWLDTDEVDV

SEQ ID NO: 1252625 - protein, 28 aa, Mycobacterium
GRGDGFQLCQWCGWAKPAERGSRRRKHH

SEQ ID NO: 1252626 - protein, 22 aa, Mycobacterium
GRGEIPMSIELTGDPARVLSLV

SEQ ID NO: 1252627 - protein, 21 aa, Mycobacterium
GRGGMPVSALDGFYTTWDNAR

SEQ ID NO: 1252628 - protein, 32 aa, Mycobacterium
GRGIPRERLASVAEHYLHFGGVSPINGINRAL

SEQ ID NO: 1252629 - protein, 21 aa, Mycobacterium
GRGLPAGWAELHRHLDYWSRK

SEQ ID NO: 1252630 - protein, 40 aa, Mycobacterium
GRGRARVEYKLRDWLFARQRYWGEPFPIVYDSDGRPHPLP

SEQ ID NO: 1252631 - protein, 25 aa, Mycobacterium
GRGTMPAGLARWAAAQLAPAVVPWP

SEQ ID NO: 1252632 - protein, 24 aa, Mycobacterium
GRGTRLPVWLTQWGFERPPEDTVD

SEQ ID NO: 1252633 - protein, 20 aa, Mycobacterium
GRGYAHRVLIAIEGVDGAGK

SEQ ID NO: 1252634 - protein, 19 aa, Mycobacterium
GRHPAALSFGDTMAYAAAK

SEQ ID NO: 1252635 - protein, 19 aa, Mycobacterium
GRIALMSGQLGQLNGLPVS

SEQ ID NO: 1252636 - protein, 18 aa, Mycobacterium
GRIDGRYLDRGLLRTWSR

SEQ ID NO: 1252637 - protein, 25 aa, Mycobacterium
GRIGGKWRVGAGFRKPVPTMLLEHR

SEQ ID NO: 1252638 - protein, 28 aa, Mycobacterium
GRIKDMVIRGGENIYPREVEEFLHTHPD

SEQ ID NO: 1252639 - protein, 19 aa, Mycobacterium
GRITLLRKVFESLSNKTPV

SEQ ID NO: 1252640 - protein, 22 aa, Mycobacterium
GRLFDCVAALAGVRQTVAYEAQ

SEQ ID NO: 1252641 - protein, 20 aa, Mycobacterium
GRLGTCLDTTLTMAAVLEQA

SEQ ID NO: 1252642 - protein, 17 aa, Mycobacterium
GRLPEEYAIIGSGRHSP

SEQ ID NO: 1252643 - protein, 24 aa, Mycobacterium
GRLSELLRTPGFVLIRERGAAVVD

SEQ ID NO: 1252644 - protein, 25 aa, Mycobacterium
GRLSTRLIGQITWRTRLVQDPHLLA

SEQ ID NO: 1252645 - protein, 17 aa, Mycobacterium
GRLTGDIVRPVIWGPQK

SEQ ID NO: 1252646 - protein, 18 aa, Mycobacterium
GRLVSCPFVPGRIPDAAM

SEQ ID NO: 1252647 - protein, 17 aa, Mycobacterium
GRMLAARVLEIFPVTRT

SEQ ID NO: 1252648 - protein, 17 aa, Mycobacterium
GRNLALFTTSTLLANLL

SEQ ID NO: 1252649 - protein, 19 aa, Mycobacterium
GRPAGAMLLGAASTDDLVL

SEQ ID NO: 1252650 - protein, 22 aa, Mycobacterium
GRPEELLLFAVGREARVEFEGD

SEQ ID NO: 1252651 - protein, 19 aa, Mycobacterium
GRPFLAFVYGIAAHKIADA

SEQ ID NO: 1252652 - protein, 19 aa, Mycobacterium
GRPGGQVWTTALTVGDALT

SEQ ID NO: 1252653 - protein, 20 aa, Mycobacterium
GRPMCGVLSGAARFTERLTL

SEQ ID NO: 1252654 - protein, 18 aa, Mycobacterium
GRQILDFTDEVFGRPRGD

SEQ ID NO: 1252655 - protein, 22 aa, Mycobacterium
GRRQLPLLGRRAAEKLGLRVVL

SEQ ID NO: 1252656 - protein, 21 aa, Mycobacterium
GRRTYDIFAAYWPHQQGGEDG

SEQ ID NO: 1252657 - protein, 22 aa, Mycobacterium
GRSATNWASRVVFLNGHGGNTE

SEQ ID NO: 1252658 - protein, 20 aa, Mycobacterium
GRSATRWRSSSNGWARSSSH

SEQ ID NO: 1252659 - protein, 20 aa, Mycobacterium
GRSMLAHALHTVAKVAPQHL

SEQ ID NO: 1252660 - protein, 27 aa, Mycobacterium
GRSNNCLDCSLSALSSFRGDPTVSAPR

SEQ ID NO: 1252661 - protein, 19 aa, Mycobacterium
GRSRLEVIAPGAARQLASV

SEQ ID NO: 1252662 - protein, 25 aa, Mycobacterium
GRSYSPRFLFAWPNSKSAVMGPAQL

SEQ ID NO: 1252663 - protein, 17 aa, Mycobacterium
GRTGIGWVEWNRNIARS

SEQ ID NO: 1252664 - protein, 20 aa, Mycobacterium
GRTGLPWPDLNGTGAVSLLQ

SEQ ID NO: 1252665 - protein, 22 aa, Mycobacterium
GRTPAQVALAWTLNVAPNVLLI

SEQ ID NO: 1252666 - protein, 19 aa, Mycobacterium
GRTVDFKNTVLIFTSNLGT

SEQ ID NO: 1252667 - protein, 20 aa, Mycobacterium
GRTVDFKNTVLIFTSNLGTS

SEQ ID NO: 1252668 - protein, 25 aa, Mycobacterium
GRTVDWRFAATVGAKLVRPGPPATD

SEQ ID NO: 1252669 - protein, 20 aa, Mycobacterium
GRVGASLGLDSTVYEINVAI

SEQ ID NO: 1252670 - protein, 26 aa, Mycobacterium
GSAGAWRPVDGVAIANERYALSVDPA

SEQ ID NO: 1252671 - protein, 17 aa, Mycobacterium
GSAHGYRAMAAAVSAAS

SEQ ID NO: 1252672 - protein, 17 aa, Mycobacterium
GSALTLAQVCTRTGLAR

SEQ ID NO: 1252673 - protein, 17 aa, Mycobacterium
GSANVFARALGISPDPI

SEQ ID NO: 1252674 - protein, 19 aa, Mycobacterium
GSARYEFDIDWNLTGTPEA

SEQ ID NO: 1252675 - protein, 18 aa, Mycobacterium
GSAVFRMVSRRSDLTDVD

SEQ ID NO: 1252676 - protein, 19 aa, Mycobacterium
GSCVLRLDGYHPIELHAGD

SEQ ID NO: 1252677 - protein, 18 aa, Mycobacterium
GSDDFRFNAIIDEEIAKA

SEQ ID NO: 1252678 - protein, 19 aa, Mycobacterium
GSEFMEWRASMDLPAVADV

SEQ ID NO: 1252679 - protein, 18 aa, Mycobacterium
GSFYWHFDDMPAYRAALV

SEQ ID NO: 1252680 - protein, 19 aa, Mycobacterium
GSGDPYGRCCRPLHVGERH

SEQ ID NO: 1252681 - protein, 24 aa, Mycobacterium
GSGKSTFLRCINHLEAVNAGRLYI

SEQ ID NO: 1252682 - protein, 20 aa, Mycobacterium
GSGLELRAELLGKLTSLQVH

SEQ ID NO: 1252683 - protein, 18 aa, Mycobacterium
GSIGKWLKKLLSSARKSG

SEQ ID NO: 1252684 - protein, 17 aa, Mycobacterium
GSKERRITEKKRRGTIK

SEQ ID NO: 1252685 - protein, 17 aa, Mycobacterium
GSKWMFPLLDSMAEVWK

SEQ ID NO: 1252686 - protein, 17 aa, Mycobacterium
GSKWMFPLLDSMAEVYK

SEQ ID NO: 1252687 - protein, 24 aa, Mycobacterium
GSLDARLRELVIMRIGWITGSEYE

SEQ ID NO: 1252688 - protein, 17 aa, Mycobacterium
GSLVVGVCAEYDALPDI

SEQ ID NO: 1252689 - protein, 27 aa, Mycobacterium
GSMARRLRLNSRMGLLADDARVVDTLS

SEQ ID NO: 1252690 - protein, 22 aa, Mycobacterium
GSPRPTVGVEWEFALVDAHTRD

SEQ ID NO: 1252691 - protein, 20 aa, Mycobacterium
GSRAIERFLRPVCYQNAPGV

SEQ ID NO: 1252692 - protein, 23 aa, Mycobacterium
GSSCIYPKFAEQPIREESLLTGH

SEQ ID NO: 1252693 - protein, 29 aa, Mycobacterium
GSSTYWYARHLRLPPGVPAHHSGYLASMG

SEQ ID NO: 1252694 - protein, 26 aa, Mycobacterium
GSSYVIVWADRFGRPLVTVESAKQMA

SEQ ID NO: 1252695 - protein, 24 aa, Mycobacterium
GSVCAWTPEMVEQFGPAKRDSVGR

SEQ ID NO: 1252696 - protein, 20 aa, Mycobacterium
GSVPDIAGVAWRMTKDSGPW

SEQ ID NO: 1252697 - protein, 23 aa, Mycobacterium
GSVWMTGKCASWYLDAHGNNTTL

SEQ ID NO: 1252698 - protein, 18 aa, Mycobacterium
GSWKKVLTTSLRVSGAEA

SEQ ID NO: 1252699 - protein, 18 aa, Mycobacterium
GSYGRLIVTPDMEPPDAA

SEQ ID NO: 1252700 - protein, 24 aa, Mycobacterium
GTAMASLICHGDLNAPGASTQRRL

SEQ ID NO: 1252701 - protein, 21 aa, Mycobacterium
GTARFLALSVHEMVVDSTSRE

SEQ ID NO: 1252702 - protein, 24 aa, Mycobacterium
GTDRLAAVNLRLFARDGGDVPARI

SEQ ID NO: 1252703 - protein, 17 aa, Mycobacterium
GTDYVRNGYTFTIVDIA

SEQ ID NO: 1252704 - protein, 18 aa, Mycobacterium
GTELAALADRAGYVVGSD

SEQ ID NO: 1252705 - protein, 17 aa, Mycobacterium
GTGVKRLVVVKLDGGQV

SEQ ID NO: 1252706 - protein, 19 aa, Mycobacterium
GTHFKVPGIHLSEPSPQRT

SEQ ID NO: 1252707 - protein, 28 aa, Mycobacterium
GTKAVIICPIGFVADHIEVVWDLDSEVR

SEQ ID NO: 1252708 - protein, 18 aa, Mycobacterium
GTKDAWMTAWGPLVEAAT

SEQ ID NO: 1252709 - protein, 19 aa, Mycobacterium
GTLGPGVRALLLYPMNALA

SEQ ID NO: 1252710 - protein, 21 aa, Mycobacterium
GTLICPWHGLRLSGERREFGW

SEQ ID NO: 1252711 - protein, 22 aa, Mycobacterium
GTPNRLLLVLSDGFPYDDGYEG

SEQ ID NO: 1252712 - protein, 24 aa, Mycobacterium
GTPRAGPVRLRYPVYVDLLPPCND

SEQ ID NO: 1252713 - protein, 17 aa, Mycobacterium
GTPYLHAYTRSMTAWLC

SEQ ID NO: 1252714 - protein, 17 aa, Mycobacterium
GTQARVWVADGRATALR

SEQ ID NO: 1252715 - protein, 19 aa, Mycobacterium
GTQVRPAFEDPLSRLAAAA

SEQ ID NO: 1252716 - protein, 23 aa, Mycobacterium
GTQYRIIAPPGLEPSVSGYVNRA

SEQ ID NO: 1252717 - protein, 26 aa, Mycobacterium
GTRVTIEPNLACGHCTQCRAGRYNIC

SEQ ID NO: 1252718 - protein, 18 aa, Mycobacterium
GTVAAFLTLRQMIADALK

SEQ ID NO: 1252719 - protein, 18 aa, Mycobacterium
GTVLPPGTHVYLYRDLPV

SEQ ID NO: 1252720 - protein, 17 aa, Mycobacterium
GTVTYGPIWDWQRSHVF

SEQ ID NO: 1252721 - protein, 19 aa, Mycobacterium
GVAAGRRGPQALSLTLIDP

SEQ ID NO: 1252722 - protein, 17 aa, Mycobacterium
GVADLGVVVAVFKDTGS

SEQ ID NO: 1252723 - protein, 19 aa, Mycobacterium
GVANYCWFTDPSRALCLKL

SEQ ID NO: 1252724 - protein, 18 aa, Mycobacterium
GVARLRLVCREYGITDVS

SEQ ID NO: 1252725 - protein, 17 aa, Mycobacterium
GVDESWLGTRVTIEPNL

SEQ ID NO: 1252726 - protein, 18 aa, Mycobacterium
GVDHCFGPVMLHRVEATV

SEQ ID NO: 1252727 - protein, 18 aa, Mycobacterium
GVEKRWGATMVLTEPDAG

SEQ ID NO: 1252728 - protein, 18 aa, Mycobacterium
GVEPLAAAAARMITAATR

SEQ ID NO: 1252729 - protein, 24 aa, Mycobacterium
GVEPSEAIIQNWWRQGMMGGAKAH

SEQ ID NO: 1252730 - protein, 21 aa, Mycobacterium
GVGSKGWYVAPTVLAGVAPQA

SEQ ID NO: 1252731 - protein, 23 aa, Mycobacterium
GVHEAVGVIVGWVAETDARRRTA

SEQ ID NO: 1252732 - protein, 20 aa, Mycobacterium
GVIAACVWDGPTGALAPFWD

SEQ ID NO: 1252733 - protein, 23 aa, Mycobacterium
GVIGPRSRLHWSQATDWDAVCAH

SEQ ID NO: 1252734 - protein, 22 aa, Mycobacterium
GVIRALWPGVLVLNTGRETDTD

SEQ ID NO: 1252735 - protein, 22 aa, Mycobacterium
GVIYRSPLRHLALIGTEQGSDE

SEQ ID NO: 1252736 - protein, 24 aa, Mycobacterium
GVLGRPFYLMGFVDGWSPMDTHAR

SEQ ID NO: 1252737 - protein, 18 aa, Mycobacterium
GVPPGRLRMLRSFDPRSA

SEQ ID NO: 1252738 - protein, 24 aa, Mycobacterium
GVQAIAVCLLWSFREPSHEQRVAA

SEQ ID NO: 1252739 - protein, 24 aa, Mycobacterium
GVQRSWAQRIVCAPEFPPPDPRPV

SEQ ID NO: 1252740 - protein, 20 aa, Mycobacterium
GVRLGNHVRLSAPLDTVLTL

SEQ ID NO: 1252741 - protein, 20 aa, Mycobacterium
GVRMAITIMVLYNKNRRVPG

SEQ ID NO: 1252742 - protein, 26 aa, Mycobacterium
GVRPDAWGWLPLLTGVAVRDAVAEVS

SEQ ID NO: 1252743 - protein, 22 aa, Mycobacterium
GVRRSRRITALAGRYRDVDLGG

SEQ ID NO: 1252744 - protein, 24 aa, Mycobacterium
GVRTELRRATGLGFDISISDAKVS

SEQ ID NO: 1252745 - protein, 19 aa, Mycobacterium
GVRVKHCADGGVRITVGGR

SEQ ID NO: 1252746 - protein, 25 aa, Mycobacterium
GVRVNCIACGAIRTPGLEADAKRQG

SEQ ID NO: 1252747 - protein, 27 aa, Mycobacterium
GVSKALFYFYFPRKEDVLFEVGVMSTR

SEQ ID NO: 1252748 - protein, 18 aa, Mycobacterium
GVSRSKQRPDGMVDLSGH

SEQ ID NO: 1252749 - protein, 20 aa, Mycobacterium
GVTDIRQARHARIYPLPSRS

SEQ ID NO: 1252750 - protein, 19 aa, Mycobacterium
GVTMRRVELTPTFRTTLAL

SEQ ID NO: 1252751 - protein, 21 aa, Mycobacterium
GVYQCRACGAELFRSSEKFES

SEQ ID NO: 1252752 - protein, 21 aa, Mycobacterium
GVYRLKGTVAVRYRDRARRYV

SEQ ID NO: 1252753 - protein, 20 aa, Mycobacterium
GWAPRIRRFPARDDTDHLAL

SEQ ID NO: 1252754 - protein, 19 aa, Mycobacterium
GWFATLRRPNVELVAEGID

SEQ ID NO: 1252755 - protein, 20 aa, Mycobacterium
GWKRLCAKGSMTQDELLDAL

SEQ ID NO: 1252756 - protein, 19 aa, Mycobacterium
GWLADTGLHAWVVQRELAD

SEQ ID NO: 1252757 - protein, 24 aa, Mycobacterium
GWLTPEARAYWDVIAAKYAAPGTS

SEQ ID NO: 1252758 - protein, 25 aa, Mycobacterium
GWLYRHFPDKVSLLGAAIVRLNEAY

SEQ ID NO: 1252759 - protein, 21 aa, Mycobacterium
GWQRNRVLALALHLLDLGYFR

SEQ ID NO: 1252760 - protein, 25 aa, Mycobacterium
GWRPDPRTLTWWAVQSLTKTAIGCL

SEQ ID NO: 1252761 - protein, 18 aa, Mycobacterium
GWRYPDPLAPVAAAERAG

SEQ ID NO: 1252762 - protein, 17 aa, Mycobacterium
GYDAVYHFGRKVESAYE

SEQ ID NO: 1252763 - protein, 18 aa, Mycobacterium
GYGWIQPRLSPVARAALP

SEQ ID NO: 1252764 - protein, 20 aa, Mycobacterium
GYPSIGCAPCTAKPIEGADP

SEQ ID NO: 1252765 - protein, 28 aa, Mycobacterium
GYPTDWGIAAVRCFHGSPAALVELLEQM

SEQ ID NO: 1252766 - protein, 27 aa, Mycobacterium
GYRIDRIDYYAAWLQRFETALRALPER

SEQ ID NO: 1252767 - protein, 27 aa, Mycobacterium
GYRIQPRDCEFLGISPDQVEAWAEREA

SEQ ID NO: 1252768 - protein, 25 aa, Mycobacterium
GYSYYGEVLLDWVVERLANQKGSAG

SEQ ID NO: 1252769 - protein, 22 aa, Mycobacterium
HAALRAAVAAVREAQELQDAQL

SEQ ID NO: 1252770 - protein, 27 aa, Mycobacterium
HAARVTLGIALARLGMFAPAMSYLAEP

SEQ ID NO: 1252771 - protein, 17 aa, Mycobacterium
HAAYRRIQVRADDKAEA

SEQ ID NO: 1252772 - protein, 25 aa, Mycobacterium
HACTADEAFALLIERSQRENVKLRD

SEQ ID NO: 1252773 - protein, 29 aa, Mycobacterium
HAERYGLDMWLRVGATWLSAVDALAALAD

SEQ ID NO: 1252774 - protein, 19 aa, Mycobacterium
HAFEMPYGPSVPALYGLIA

SEQ ID NO: 1252775 - protein, 17 aa, Mycobacterium
HAGDSLTLQAEFTDYYA

SEQ ID NO: 1252776 - protein, 17 aa, Mycobacterium
HAGFPLVVKPISGAPGE

SEQ ID NO: 1252777 - protein, 22 aa, Mycobacterium
HAIAVGRPWWTRTLAAHDLADT

SEQ ID NO: 1252778 - protein, 25 aa, Mycobacterium
HALLPLLTARAGGLLVEITDGTTEY

SEQ ID NO: 1252779 - protein, 18 aa, Mycobacterium
HALRRACATHNYERGVDL

SEQ ID NO: 1252780 - protein, 18 aa, Mycobacterium
HAQVPRQWLSWHYRSQDE

SEQ ID NO: 1252781 - protein, 24 aa, Mycobacterium
HASSERYGLFVPRLYGDDFTPTEY

SEQ ID NO: 1252782 - protein, 18 aa, Mycobacterium
HAVGEYKVALTNRAQAEL

SEQ ID NO: 1252783 - protein, 18 aa, Mycobacterium
HAVRWAAGEAKLRGSRLT

SEQ ID NO: 1252784 - protein, 23 aa, Mycobacterium
HAYCLRLLTARARTRAELAGKLT

SEQ ID NO: 1252785 - protein, 37 aa, Mycobacterium
HCEPRWKMADSDGMWCFPDLSYGIGMVIRVVEGAPVP

SEQ ID NO: 1252786 - protein, 24 aa, Mycobacterium
HCLPPRDWTEPGFMGLGMIYTAMP

SEQ ID NO: 1252787 - protein, 19 aa, Mycobacterium
HCNKCMATIYSHTHCVVTG

SEQ ID NO: 1252788 - protein, 18 aa, Mycobacterium
HCSGRFRYQAGQFLTLRV

SEQ ID NO: 1252789 - protein, 21 aa, Mycobacterium
HCTRGLGIWEWASTTTGEPDV

SEQ ID NO: 1252790 - protein, 18 aa, Mycobacterium
HCVLDAAAVGGPAADNKL

SEQ ID NO: 1252791 - protein, 17 aa, Mycobacterium
HDASCYFDALPEETVAH

SEQ ID NO: 1252792 - protein, 23 aa, Mycobacterium
HDDALDLDELVAWMTDRHDGGTP

SEQ ID NO: 1252793 - protein, 22 aa, Mycobacterium
HDEFLATFVPLTFVGNHDVTRI

SEQ ID NO: 1252794 - protein, 21 aa, Mycobacterium
HDFLNTRCLTIAGGTEQILLT

SEQ ID NO: 1252795 - protein, 20 aa, Mycobacterium
HDGLDRFREAGVRKVWVYQA

SEQ ID NO: 1252796 - protein, 26 aa, Mycobacterium
HDGLRRFGDRWVRWGDTIADKIEAAL

SEQ ID NO: 1252797 - protein, 17 aa, Mycobacterium
HDHMLRPSYGLAEATVF

SEQ ID NO: 1252798 - protein, 18 aa, Mycobacterium
HDLHLYLRRATLYRSLYG

SEQ ID NO: 1252799 - protein, 23 aa, Mycobacterium
HDLPPRWDGLPVQWGDWSDTAAM

SEQ ID NO: 1252800 - protein, 17 aa, Mycobacterium
HDLPRGDLDRVTRQQAV

SEQ ID NO: 1252801 - protein, 22 aa, Mycobacterium
HDQARCVASLAALAALDTEVLL

SEQ ID NO: 1252802 - protein, 20 aa, Mycobacterium
HDTFLLALGQMWAAGVDLDW

SEQ ID NO: 1252803 - protein, 30 aa, Mycobacterium
HDVPTLLAEAVWRLGALGWACDLVAVVDVL

SEQ ID NO: 1252804 - protein, 17 aa, Mycobacterium
HELLGGRFVTAMTGSAP

SEQ ID NO: 1252805 - protein, 17 aa, Mycobacterium
HELYLTDVIAIFRQDGL

SEQ ID NO: 1252806 - protein, 23 aa, Mycobacterium
HETDRLAALSAEINGLGGQCEET

SEQ ID NO: 1252807 - protein, 17 aa, Mycobacterium
HEVMPRQPLGQSATLQT

SEQ ID NO: 1252808 - protein, 22 aa, Mycobacterium
HEYTRAKAIAALHELDQAGTAI

SEQ ID NO: 1252809 - protein, 18 aa, Mycobacterium
HFNEVFFDDVFVPDADVV

SEQ ID NO: 1252810 - protein, 17 aa, Mycobacterium
HFREQSFGRVVVATSTS

SEQ ID NO: 1252811 - protein, 23 aa, Mycobacterium
HFVGRGFSGKAMYVGLDKAAAVT

SEQ ID NO: 1252812 - protein, 18 aa, Mycobacterium
HGAEVVLCAAGRREAVAA

SEQ ID NO: 1252813 - protein, 18 aa, Mycobacterium
HGALFRFPTLKVGIVEAG

SEQ ID NO: 1252814 - protein, 24 aa, Mycobacterium
HGHVRLTYPPGWAVEPAELPFVLP

SEQ ID NO: 1252815 - protein, 28 aa, Mycobacterium
HGKTAAQALIRWHMQLGNIVIPKSVNPQ

SEQ ID NO: 1252816 - protein, 30 aa, Mycobacterium
HGPMGYPVAVGVVACLARRQGPLEAKADDF

SEQ ID NO: 1252817 - protein, 18 aa, Mycobacterium
HGPTIVLAHGFGCDQNLW

SEQ ID NO: 1252818 - protein, 23 aa, Mycobacterium
HGRVQGVGFRWWTRSRALELGLT

SEQ ID NO: 1252819 - protein, 25 aa, Mycobacterium
HGVEPNMRWRTFCAELLNIADKLNV

SEQ ID NO: 1252820 - protein, 18 aa, Mycobacterium
HGVTGRIFIAAGGFVGEF

SEQ ID NO: 1252821 - protein, 20 aa, Mycobacterium
HHGIGYGLLRFLYGPTARTL

SEQ ID NO: 1252822 - protein, 18 aa, Mycobacterium
HHLLRQGQLLAVRRDGKF

SEQ ID NO: 1252823 - protein, 24 aa, Mycobacterium
HIAARPAITLSWIRELPALGARAT

SEQ ID NO: 1252824 - protein, 18 aa, Mycobacterium
HICEVCGVEEILTPGDAF

SEQ ID NO: 1252825 - protein, 18 aa, Mycobacterium
HIEVKGVLDSAASNGIRM

SEQ ID NO: 1252826 - protein, 17 aa, Mycobacterium
HIGDYGIGFCLDTCHAW

SEQ ID NO: 1252827 - protein, 17 aa, Mycobacterium
HIRAFKRAAVVTDKEWI

SEQ ID NO: 1252828 - protein, 26 aa, Mycobacterium
HISQNWRLSGLAGEYITPVPAQQRLG

SEQ ID NO: 1252829 - protein, 26 aa, Mycobacterium
HIVIDGWSLPLFVGEMLTLYRAGGDP

SEQ ID NO: 1252830 - protein, 21 aa, Mycobacterium
HKAELLGFAVLAMYSNTPNFR

SEQ ID NO: 1252831 - protein, 31 aa, Mycobacterium
HKDARVSAGHRCPGWLTRSWTSSTPPGTPRP

SEQ ID NO: 1252832 - protein, 23 aa, Mycobacterium
HKRDRLGSALAELGFAVHDSAGT

SEQ ID NO: 1252833 - protein, 25 aa, Mycobacterium
HLDHPRLGWSHAPVGPVLAESLGLP

SEQ ID NO: 1252834 - protein, 20 aa, Mycobacterium
HLDMGWERLMIAVEYDGKQH

SEQ ID NO: 1252835 - protein, 25 aa, Mycobacterium
HLDYWSRKRYAASLMDPNLPPLNLN

SEQ ID NO: 1252836 - protein, 25 aa, Mycobacterium
HLEIAESTWHRWLAQYGGMKANDAK

SEQ ID NO: 1252837 - protein, 22 aa, Mycobacterium
HLGDSLVRCISMQPTDGLVRGV

SEQ ID NO: 1252838 - protein, 22 aa, Mycobacterium
HLKRAGIPFRVLERNDHVGGTW

SEQ ID NO: 1252839 - protein, 23 aa, Mycobacterium
HLMSWRPGLSYVELADQLTEYIV

SEQ ID NO: 1252840 - protein, 26 aa, Mycobacterium
HLRAVLRRFSPDWTHTDVTAALYRES

SEQ ID NO: 1252841 - protein, 25 aa, Mycobacterium
HLSTKRPRALVVVSHDRWFLDAVCT

SEQ ID NO: 1252842 - protein, 17 aa, Mycobacterium
HLTVYAFSTENWKRSTE

SEQ ID NO: 1252843 - protein, 21 aa, Mycobacterium
HLVTRADALRARMPSAESDNM

SEQ ID NO: 1252844 - protein, 34 aa, Mycobacterium; identical to SEQ ID NO: 675537

SEQ ID NO: 1252845 - protein, 25 aa, Mycobacterium
HMSILSLFYRWALEEGLAQTEPFTY

SEQ ID NO: 1252846 - protein, 22 aa, Mycobacterium
HMTGRSVSFPWGMETNQSTERA

SEQ ID NO: 1252847 - protein, 17 aa, Mycobacterium
HNCDFSALLPAARAVRE

SEQ ID NO: 1252848 - protein, 20 aa, Mycobacterium
HNRSWNCGVEGPTDDPQVNA

SEQ ID NO: 1252849 - protein, 17 aa, Mycobacterium
HPAKLALELARACTEAG

SEQ ID NO: 1252850 - protein, 22 aa, Mycobacterium
HPDLTALAPLLGTWSGKGSGEY

SEQ ID NO: 1252851 - protein, 25 aa, Mycobacterium
HPDRIRRLVTIGGIGTNVFSPGPSE

SEQ ID NO: 1252852 - protein, 18 aa, Mycobacterium
HPECAAVIAEVWTLLDGE

SEQ ID NO: 1252853 - protein, 21 aa, Mycobacterium
HPEDASLVWREFSAAGFEDHP

SEQ ID NO: 1252854 - protein, 21 aa, Mycobacterium
HPEPGAPLLGRFSFDVRCTWL

SEQ ID NO: 1252855 - protein, 25 aa, Mycobacterium
HPEPVDASALGWLVDGAHTLPAERG

SEQ ID NO: 1252856 - protein, 20 aa, Mycobacterium
HPGLLRFTTGFGQTTALMMS

SEQ ID NO: 1252857 - protein, 26 aa, Mycobacterium
HPLEGLDLLHGGAWKAELRALRSAVQ

SEQ ID NO: 1252858 - protein, 24 aa, Mycobacterium
HPLKRWPELGVPITMTDLRFMRFI

SEQ ID NO: 1252859 - protein, 24 aa, Mycobacterium
HPLRLAENGGFGFVGCYMNGTGFE

SEQ ID NO: 1252860 - protein, 20 aa, Mycobacterium
HPMAGYRSTESFALDAGRMC

SEQ ID NO: 1252861 - protein, 20 aa, Mycobacterium
HPPSCSRLTNPWRQEGVEVP

SEQ ID NO: 1252862 - protein, 17 aa, Mycobacterium
HPRACWGALRSTILGDA

SEQ ID NO: 1252863 - protein, 18 aa, Mycobacterium
HPRVRAGCEAMVAATPAE

SEQ ID NO: 1252864 - protein, 17 aa, Mycobacterium
HPSLPRGALLQVALGER

SEQ ID NO: 1252865 - protein, 17 aa, Mycobacterium
HPSRVAGVVGVDGPYPD

SEQ ID NO: 1252866 - protein, 26 aa, Mycobacterium
HPWEREWSYGWSMMRIGALLRRQSMA

SEQ ID NO: 1252867 - protein, 26 aa, Mycobacterium
HPYAHLRGFVLMPWLAAEPEATLTVA

SEQ ID NO: 1252868 - protein, 18 aa, Mycobacterium
HQAMEFLPWANRVQLGDP

SEQ ID NO: 1252869 - protein, 24 aa, Mycobacterium
HQLRLRGVDGLRVVDCSVMPTIVA

SEQ ID NO: 1252870 - protein, 18 aa, Mycobacterium
HQRPDQRRLLAGDPGLIA

SEQ ID NO: 1252871 - protein, 23 aa, Mycobacterium
HQVRGKLAVPFGVDETARERADY

SEQ ID NO: 1252872 - protein, 19 aa, Mycobacterium
HRATGPLPRRLAASTWGQH

SEQ ID NO: 1252873 - protein, 21 aa, Mycobacterium
HRDALTGLFTVWFSAHTADEV

SEQ ID NO: 1252874 - protein, 24 aa, Mycobacterium
HRDRTCVVPGCGATRGLHAHHIRH

SEQ ID NO: 1252875 - protein, 25 aa, Mycobacterium
HRFADKPTILFLGRHVGYPVALEGA

SEQ ID NO: 1252876 - protein, 21 aa, Mycobacterium
HRFYDSCRVLPQGDEAPGSLH

SEQ ID NO: 1252877 - protein, 26 aa, Mycobacterium
HRHLFTVLMDREWKHGVTAAVDVTLL

SEQ ID NO: 1252878 - protein, 17 aa, Mycobacterium
HRHRRPAVGGAQERLRL

SEQ ID NO: 1252879 - protein, 26 aa, Mycobacterium
HRHSRRRGCHHLRGGPQPPHRHRRPA

SEQ ID NO: 1252880 - protein, 25 aa, Mycobacterium
HRLAAEEWRSLRLAIKQQTVAANIA

SEQ ID NO: 1252881 - protein, 19 aa, Mycobacterium
HRPDSLGSVGFVHLSTPEQ

SEQ ID NO: 1252882 - protein, 18 aa, Mycobacterium
HRRALAKGTLVWHRDRLD

SEQ ID NO: 1252883 - protein, 19 aa, Mycobacterium
HRRGAAPGQELEYPEVVPH

SEQ ID NO: 1252884 - protein, 18 aa, Mycobacterium
HRRWPGLIEAYRDRLPVG

SEQ ID NO: 1252885 - protein, 22 aa, Mycobacterium
HSEAGLYLWATRGEPCRQTVDR

SEQ ID NO: 1252886 - protein, 22 aa, Mycobacterium
HSEAIARISWCVDQCAIGVITG

SEQ ID NO: 1252887 - protein, 17 aa, Mycobacterium
HSEIMGTINQQRTVLEG

SEQ ID NO: 1252888 - protein, 17 aa, Mycobacterium
HSGAFVLGNLDTDHRQC

SEQ ID NO: 1252889 - protein, 19 aa, Mycobacterium
HSSVSWVKYPFLESHPQYD

SEQ ID NO: 1252890 - protein, 24 aa, Mycobacterium
HSVGEVAATLWARRSHEPVRAAVI

SEQ ID NO: 1252891 - protein, 27 aa, Mycobacterium
HSWGVRDWWAMDWVWNALHLDDGTHLH

SEQ ID NO: 1252892 - protein, 20 aa, Mycobacterium
HTDHAWSHTVTIPVRVLAES

SEQ ID NO: 1252893 - protein, 23 aa, Mycobacterium
HTDLPRECLLIFGQEGPGITEDA

SEQ ID NO: 1252894 - protein, 26 aa, Mycobacterium
HTGRDLGALRARWAQLSASPLLENGI

SEQ ID NO: 1252895 - protein, 23 aa, Mycobacterium
HTHQRRCEFTVGRQQADGMSRVT

SEQ ID NO: 1252896 - protein, 19 aa, Mycobacterium
HTLDEAFALLTALGDPVLW

SEQ ID NO: 1252897 - protein, 24 aa, Mycobacterium
HTLSRASGVTVVLPDYRRAPENKF

SEQ ID NO: 1252898 - protein, 22 aa, Mycobacterium
HTPRGIWAPECAYAPGMEADYA

SEQ ID NO: 1252899 - protein, 25 aa, Mycobacterium
HVAAEGIEPFGFYYEKFALAAPAAA

SEQ ID NO: 1252900 - protein, 18 aa, Mycobacterium
HVAGPYTRRGTWLEQADT

SEQ ID NO: 1252901 - protein, 20 aa, Mycobacterium
HVAHPKLTMEASLEERRAAF

SEQ ID NO: 1252902 - protein, 17 aa, Mycobacterium
HVCSAFGVTLNDVVLAA

SEQ ID NO: 1252903 - protein, 18 aa, Mycobacterium
HVEPAYFLKPPSALTGHR

SEQ ID NO: 1252904 - protein, 25 aa, Mycobacterium
HVHPHRLRHSFAMRTLEYLVTGHYR

SEQ ID NO: 1252905 - protein, 19 aa, Mycobacterium
HVHPRLDVATGAWSTPWTW

SEQ ID NO: 1252906 - protein, 20 aa, Mycobacterium
HVLAAFGLVGVRPVPLGSSW

SEQ ID NO: 1252907 - protein, 18 aa, Mycobacterium
HVNGRWLADYEIPADRAA

SEQ ID NO: 1252908 - protein, 18 aa, Mycobacterium
HVNPDVPPPFGFKRSGQW

SEQ ID NO: 1252909 - protein, 25 aa, Mycobacterium
HVPADWLRMMLAFNRNQLQWFADPD

SEQ ID NO: 1252910 - protein, 24 aa, Mycobacterium
HVPPHVPVTLYWSATAYDRNTHGL

SEQ ID NO: 1252911 - protein, 32 aa, Mycobacterium
HVQFRLLPIGDPFRFLVNLAKSVPVGIDDGLQ

SEQ ID NO: 1252912 - protein, 28 aa, Mycobacterium
HVRIIQDFVRKLPAWVSWERRDHYERDL

SEQ ID NO: 1252913 - protein, 24 aa, Mycobacterium
HVRVIGQIPICWDPDREAAVARAH

SEQ ID NO: 1252914 - protein, 27 aa, Mycobacterium
HVTRLREDLCPDWPQPAQPGGSYRIEI

SEQ ID NO: 1252915 - protein, 23 aa, Mycobacterium
HVVEQEIRPLLAEYWFDDPQRVE

SEQ ID NO: 1252916 - protein, 23 aa, Mycobacterium
HVVPELPKTRSGKIMRRLLRDVA

SEQ ID NO: 1252917 - protein, 23 aa, Mycobacterium
HVVPVLTARGAYQSSYAPGTLRN

SEQ ID NO: 1252918 - protein, 17 aa, Mycobacterium
HWGFSRMPFGRDLAPSM

SEQ ID NO: 1252919 - protein, 25 aa, Mycobacterium
HYNGFFYKVMPPFCVGTSAQGVGDY

SEQ ID NO: 1252920 - protein, 25 aa, Mycobacterium
HYYEGRLASFPAPLRANAPSVSGHG

SEQ ID NO: 1252921 - protein, 17 aa, Mycobacterium
IAALFDDGTALSFVDQR

SEQ ID NO: 1252922 - protein, 18 aa, Mycobacterium
IAALRLRGVEHVVAADFS

SEQ ID NO: 1252923 - protein, 25 aa, Mycobacterium
IAARQRTGVGISRLISAGNEATIDM

SEQ ID NO: 1252924 - protein, 24 aa, Mycobacterium
IACRAALSYWRARRAIDAEAGQIA

SEQ ID NO: 1252925 - protein, 24 aa, Mycobacterium
IACTAEVLANIALREGADADIGLV

SEQ ID NO: 1252926 - protein, 20 aa, Mycobacterium
IADAPPILVLTGRPDDAWLA

SEQ ID NO: 1252927 - protein, 23 aa, Mycobacterium
IADPDAAVAVCGWRSDLDGAHVV

SEQ ID NO: 1252928 - protein, 19 aa, Mycobacterium
IADPSIVTWATARPDQVWA

SEQ ID NO: 1252929 - protein, 25 aa, Mycobacterium
IAELQRNRLSLALGGGSSQESAELA

SEQ ID NO: 1252930 - protein, 21 aa, Mycobacterium
IAELRGEEFIVHAGHGHSVMN

SEQ ID NO: 1252931 - protein, 24 aa, Mycobacterium
IAETLCGYGKFGLESTKQVLWANL

SEQ ID NO: 1252932 - protein, 19 aa, Mycobacterium
IAETMFRHDPSVMVYAPLR

SEQ ID NO: 1252933 - protein, 17 aa, Mycobacterium
IAGARPGDRIEHAAVVP

SEQ ID NO: 1252934 - protein, 18 aa, Mycobacterium
IAGLIGERGVTSAVGHHW

SEQ ID NO: 1252935 - protein, 22 aa, Mycobacterium
IAGPEHRVFFGGDTGYTASFSE

SEQ ID NO: 1252936 - protein, 23 aa, Mycobacterium
IAHAQRWRFDGITPIGPDVLLSL

SEQ ID NO: 1252937 - protein, 22 aa, Mycobacterium
IAHTLHALAWMIPGEVELFGLD

SEQ ID NO: 1252938 - protein, 19 aa, Mycobacterium
IAIEKIFKVKVDSVNTANR

SEQ ID NO: 1252939 - protein, 23 aa, Mycobacterium
IAILDRHARGFDPRDLSAVRAVA

SEQ ID NO: 1252940 - protein, 20 aa, Mycobacterium
IAKRGHIPVGYYKDEEKTRQ

SEQ ID NO: 1252941 - protein, 17 aa, Mycobacterium
IALAPDRVFPLPDAVSF

SEQ ID NO: 1252942 - protein, 24 aa, Mycobacterium
IALEHLLDFMPRYEVDFDGLERVH

SEQ ID NO: 1252943 - protein, 17 aa, Mycobacterium
IAMGMGILVTQVLTAAG

SEQ ID NO: 1252944 - protein, 17 aa, Mycobacterium
IARERGDRVIVVDVDTD

SEQ ID NO: 1252945 - protein, 19 aa, Mycobacterium
IARHAAGLVQVRYTEESHD

SEQ ID NO: 1252946 - protein, 22 aa, Mycobacterium
IARRIAEPYLRDGQIEEHLVYP

SEQ ID NO: 1252947 - protein, 17 aa, Mycobacterium
IASTNPWLSVTPVSEYS

SEQ ID NO: 1252948 - protein, 25 aa, Mycobacterium
IATDHLMRFPGRFADQLLAEHLQKV

SEQ ID NO: 1252949 - protein, 17 aa, Mycobacterium
IAVADGRVSGVALEDGT

SEQ ID NO: 1252950 - protein, 17 aa, Mycobacterium
IAVRRAGIALAREVERR

SEQ ID NO: 1252951 - protein, 18 aa, Mycobacterium
IAWQWIPFGPVLNARAEW

SEQ ID NO: 1252952 - protein, 21 aa, Mycobacterium
ICGAKVVRGTGYWANDVAAGR

SEQ ID NO: 1252953 - protein, 19 aa, Mycobacterium
ICSRRAPTIQWVRSEDTAK

SEQ ID NO: 1252954 - protein, 20 aa, Mycobacterium
IDAAGLRIVVMATPGHTADS

SEQ ID NO: 1252955 - protein, 27 aa, Mycobacterium
IDALAALLVARPAEFDVIVAENMFGDI

SEQ ID NO: 1252956 - protein, 18 aa, Mycobacterium
IDCCSRRVTGWAIADHMR

SEQ ID NO: 1252957 - protein, 18 aa, Mycobacterium
IDDARFAQRLADARIRTD

SEQ ID NO: 1252958 - protein, 30 aa, Mycobacterium
IDDVPRGISFLLNRNRLNVAISRAKYAAVI

SEQ ID NO: 1252959 - protein, 18 aa, Mycobacterium
IDFAKPVSKDELRRYQMQ

SEQ ID NO: 1252960 - protein, 17 aa, Mycobacterium
IDGATMYELMAAYEEWP

SEQ ID NO: 1252961 - protein, 18 aa, Mycobacterium
IDGGLRFAGDDGNEIIVT

SEQ ID NO: 1252962 - protein, 19 aa, Mycobacterium
IDGLAGWGLDVHTVAPEAD

SEQ ID NO: 1252963 - protein, 18 aa, Mycobacterium
IDGLPYTGSYTERAVVGV

SEQ ID NO: 1252964 - protein, 25 aa, Mycobacterium
IDGSRAALDAALWAVDAAVGRDTPL

SEQ ID NO: 1252965 - protein, 22 aa, Mycobacterium
IDHLKALGVNAIELMPVHHFAN

SEQ ID NO: 1252966 - protein, 17 aa, Mycobacterium
IDHQPLYPGATELSLAT

SEQ ID NO: 1252967 - protein, 20 aa, Mycobacterium
IDHTAPWPAGPTCAANLKCL

SEQ ID NO: 1252968 - protein, 21 aa, Mycobacterium
IDHTAPWPAGPTCAANLKCLC

SEQ ID NO: 1252969 - protein, 29 aa, Mycobacterium
IDHVFEFARTRRCVLFFDEFDTIAKERAD

SEQ ID NO: 1252970 - protein, 20 aa, Mycobacterium
IDHVIPWPYGPTHASNLNCK

SEQ ID NO: 1252971 - protein, 18 aa, Mycobacterium
IDLAACLVMAHSRATWRA

SEQ ID NO: 1252972 - protein, 35 aa, Mycobacterium
IDLGIPCRIFPQWLRCTGCGLLAPVSHNRFIYRNV

SEQ ID NO: 1252973 - protein, 17 aa, Mycobacterium
IDLTVWLDLAPAAASDD

SEQ ID NO: 1252974 - protein, 17 aa, Mycobacterium
IDMPNQFEAAERIAKRR

SEQ ID NO: 1252975 - protein, 18 aa, Mycobacterium
IDMQRDFLLPGGFGESLG

SEQ ID NO: 1252976 - protein, 23 aa, Mycobacterium
IDPELPDCWVVSAGETVIVTCGT

SEQ ID NO: 1252977 - protein, 19 aa, Mycobacterium
IDPGLRYVVPAGAVAQPVY

SEQ ID NO: 1252978 - protein, 18 aa, Mycobacterium
IDPGVSIDTITGVFLAAL

SEQ ID NO: 1252979 - protein, 24 aa, Mycobacterium
IDPHPELLTSWGLSVDADGLSRFC

SEQ ID NO: 1252980 - protein, 23 aa, Mycobacterium
IDPSARGIFYGRLSEMTDTDFRV

SEQ ID NO: 1252981 - protein, 17 aa, Mycobacterium
IDPTWLNGVTTVGVTSG

SEQ ID NO: 1252982 - protein, 21 aa, Mycobacterium
IDQVAAVGILQSWLDQRRAAL

SEQ ID NO: 1252983 - protein, 22 aa, Mycobacterium
IDRHPAGWCLSTSTGDLTARQV

SEQ ID NO: 1252984 - protein, 25 aa, Mycobacterium
IDRIRRAHLLLAMFNALQPGVFALS

SEQ ID NO: 1252985 - protein, 26 aa, Mycobacterium
IDRIRRAHLLLAMFNALQPGVFALSG

SEQ ID NO: 1252986 - protein, 18 aa, Mycobacterium
IDRIYLVLYGSAIATQFL

SEQ ID NO: 1252987 - protein, 19 aa, Mycobacterium
IDRRDWPLFRTVFTDDCTL

SEQ ID NO: 1252988 - protein, 20 aa, Mycobacterium
IDVLRRAYARAGDGGFTDDA

SEQ ID NO: 1252989 - protein, 20 aa, Mycobacterium
IDVSSAAFWAAEAGHRVAHT

SEQ ID NO: 1252990 - protein, 17 aa, Mycobacterium
IEAEVERLLFLGSSCIY

SEQ ID NO: 1252991 - protein, 18 aa, Mycobacterium
IEALNARADECWSQIQVL

SEQ ID NO: 1252992 - protein, 19 aa, Mycobacterium
IEDELRFKIGAQVMMLNND

SEQ ID NO: 1252993 - protein, 18 aa, Mycobacterium
IEEGVRWEPPLLTITRVA

SEQ ID NO: 1252994 - protein, 30 aa, Mycobacterium
IEGMMALTGYYAWHRICVDRKVLPGMQELV

SEQ ID NO: 1252995 - protein, 17 aa, Mycobacterium
IEHSVLYRRGVPPVVNE

SEQ ID NO: 1252996 - protein, 18 aa, Mycobacterium
IEHYAALIVAGFGLGDVI

SEQ ID NO: 1252997 - protein, 19 aa, Mycobacterium
IEINEAFSAVALASTKELG

SEQ ID NO: 1252998 - protein, 18 aa, Mycobacterium
IEKERCTGVYGVPTMFIA

SEQ ID NO: 1252999 - protein, 24 aa, Mycobacterium
IELTRDCQAFRGVLGTKVVVLKPA

SEQ ID NO: 1253000 - protein, 18 aa, Mycobacterium
IELWFRRDAARRAVAERS

SEQ ID NO: 1253001 - protein, 19 aa, Mycobacterium
IEPGRPCRLLGLHFDGEDG

SEQ ID NO: 1253002 - protein, 19 aa, Mycobacterium
IEQFGRHGFGVGVRTIAES

SEQ ID NO: 1253003 - protein, 17 aa, Mycobacterium
IEQMQGWLQEWGASSTP

SEQ ID NO: 1253004 - protein, 17 aa, Mycobacterium
IEREVHAGLFGLLKHGS

SEQ ID NO: 1253005 - protein, 32 aa, Mycobacterium
IERRAAEVVRTWLLDHERTWVAVDFTKTRPEA

SEQ ID NO: 1253006 - protein, 17 aa, Mycobacterium
IESDVTAGPTYRLFGIP

SEQ ID NO: 1253007 - protein, 18 aa, Mycobacterium
IESLGRMAPLRLSKAQWG

SEQ ID NO: 1253008 - protein, 24 aa, Mycobacterium
IETFPRPKVTASLERIGRALESER

SEQ ID NO: 1253009 - protein, 17 aa, Mycobacterium
IETPALTVLEGRAAGER

SEQ ID NO: 1253010 - protein, 19 aa, Mycobacterium
IFEEACRYIDGHSQPLPSL

SEQ ID NO: 1253011 - protein, 18 aa, Mycobacterium
IFFEGFRRLGRDLASTPV

SEQ ID NO: 1253012 - protein, 22 aa, Mycobacterium
IFPGMRLMESCVLNIKNKSHSV

SEQ ID NO: 1253013 - protein, 18 aa, Mycobacterium
IGAAESWQTLLAVESLPL

SEQ ID NO: 1253014 - protein, 23 aa, Mycobacterium
IGADDYWYLWRQMVSQPGVVDPA

SEQ ID NO: 1253015 - protein, 27 aa, Mycobacterium
IGDVGRPDLLASIGFTREELADKLYDS

SEQ ID NO: 1253016 - protein, 17 aa, Mycobacterium
IGEALRLWYELLTRSRL

SEQ ID NO: 1253017 - protein, 25 aa, Mycobacterium
IGENLRPDNLMNWARIAYNSAPGVA

SEQ ID NO: 1253018 - protein, 19 aa, Mycobacterium
IGGGLCLALAADIRVAASG

SEQ ID NO: 1253019 - protein, 25 aa, Mycobacterium
IGGRLVARVAGGWELTDLGREALAA

SEQ ID NO: 1253020 - protein, 17 aa, Mycobacterium
IGGSDLGPAMVYESLRH

SEQ ID NO: 1253021 - protein, 22 aa, Mycobacterium
IGGSWRRAGDGGTRQIINPADG

SEQ ID NO: 1253022 - protein, 22 aa, Mycobacterium
IGLAICERYLRDAPARIVLAAL

SEQ ID NO: 1253023 - protein, 27 aa, Mycobacterium
IGLEMIKAQGGIFGWVAGSAAVIPALN

SEQ ID NO: 1253024 - protein, 19 aa, Mycobacterium
IGLIFAAHSSVAWNSARRD

SEQ ID NO: 1253025 - protein, 18 aa, Mycobacterium
IGLRGWIAAADGWGVAAE

SEQ ID NO: 1253026 - protein, 27 aa, Mycobacterium
IGLVARRLDCQVGLLLTELSEEPGHHT

SEQ ID NO: 1253027 - protein, 17 aa, Mycobacterium
IGPVAAFLASRRNSYMT

SEQ ID NO: 1253028 - protein, 21 aa, Mycobacterium
IGVGALDDWDGAARFLTLGDA

SEQ ID NO: 1253029 - protein, 24 aa, Mycobacterium
IGYDARIGRRFLNAGIGFGGGCLP

SEQ ID NO: 1253030 - protein, 19 aa, Mycobacterium
IHADPAFAEHVARQLIDRP

SEQ ID NO: 1253031 - protein, 18 aa, Mycobacterium
IHEFGRCEPNSPAPNGGP

SEQ ID NO: 1253032 - protein, 20 aa, Mycobacterium
IHLNMPIAYPPAGGITDPTE

SEQ ID NO: 1253033 - protein, 19 aa, Mycobacterium
IHLRGHTPGSIALALHGPA

SEQ ID NO: 1253034 - protein, 31 aa, Mycobacterium
IHQARINVMPGFTGGGFYWHSDFETWHAEDG

SEQ ID NO: 1253035 - protein, 20 aa, Mycobacterium
IHSHCASAAMLAERIGLDDD

SEQ ID NO: 1253036 - protein, 18 aa, Mycobacterium
IIAEQAAQLYVFQRTPNY

SEQ ID NO: 1253037 - protein, 24 aa, Mycobacterium
IIATAWDCPFDGPTPPQRVLEIVD

SEQ ID NO: 1253038 - protein, 24 aa, Mycobacterium
IIQGGLKAVLAMQYECGFTNEPER

SEQ ID NO: 1253039 - protein, 18 aa, Mycobacterium
IIRSFEPGEDWFWNYETG

SEQ ID NO: 1253040 - protein, 21 aa, Mycobacterium
IITPGEALAGITPANITGSGP

SEQ ID NO: 1253041 - protein, 18 aa, Mycobacterium
IIVCPAGLSVKWQNEMHD

SEQ ID NO: 1253042 - protein, 21 aa, Mycobacterium
IKAGEGHAFISAGVETVSRFA

SEQ ID NO: 1253043 - protein, 30 aa, Mycobacterium
IKGCSIADVCAMQISDLAEWIRGLDEASVR

SEQ ID NO: 1253044 - protein, 21 aa, Mycobacterium
IKPFDFVLATSMLQVGVDVPR

SEQ ID NO: 1253045 - protein, 19 aa, Mycobacterium
IKVALDYEGAHHRGPDRFH

SEQ ID NO: 1253046 - protein, 17 aa, Mycobacterium
IKYRNLRLMTSAWSPKR

SEQ ID NO: 1253047 - protein, 19 aa, Mycobacterium
ILAEARLAIHTAVAEHGDR

SEQ ID NO: 1253048 - protein, 17 aa, Mycobacterium
ILDLGPGDILTRLTAPV

SEQ ID NO: 1253049 - protein, 22 aa, Mycobacterium
ILEGRRAVAFAVGDALEINVDC

SEQ ID NO: 1253050 - protein, 23 aa, Mycobacterium
ILERAPSCGELRLRVRDRGRLRY

SEQ ID NO: 1253051 - protein, 20 aa, Mycobacterium
ILHKERRGASTTVRSDSRFI

SEQ ID NO: 1253052 - protein, 17 aa, Mycobacterium
ILLLDGLPNYQRLFSLR

SEQ ID NO: 1253053 - protein, 19 aa, Mycobacterium
ILLTDIITAFGQRLAGQEV

SEQ ID NO: 1253054 - protein, 30 aa, Mycobacterium
ILQFAKFPLWKDLDESWKQLSRNALVSHLI

SEQ ID NO: 1253055 - protein, 18 aa, Mycobacterium
ILRVKAQPGVTWAAAAVE

SEQ ID NO: 1253056 - protein, 17 aa, Mycobacterium
ILTGMWATPVGETFDYS

SEQ ID NO: 1253057 - protein, 19 aa, Mycobacterium
IMRNGKLEKTFPVSLGKKG

SEQ ID NO: 1253058 - protein, 21 aa, Mycobacterium
INDRWQATMADYFDNRPDHAM

SEQ ID NO: 1253059 - protein, 23 aa, Mycobacterium
INPEAWRWYRNVFGDNNIPVVDT

SEQ ID NO: 1253060 - protein, 24 aa, Mycobacterium
INRRWPSKSELVFHAILGERPDLA

SEQ ID NO: 1253061 - protein, 23 aa, Mycobacterium
IPAACCGLVGLKPGRGLTPSGPA

SEQ ID NO: 1253062 - protein, 18 aa, Mycobacterium
IPADRLSRILPLVPGNPR

SEQ ID NO: 1253063 - protein, 17 aa, Mycobacterium
IPAGEIVVFVGPSGCGK

SEQ ID NO: 1253064 - protein, 23 aa, Mycobacterium
IPANLREAFELIVGGNPAEGIPA

SEQ ID NO: 1253065 - protein, 23 aa, Mycobacterium
IPDLPGSFYRPTLIADVGEQSEV

SEQ ID NO: 1253066 - protein, 28 aa, Mycobacterium
IPEASDWRMPYVLNPRGIQFTEPKWVTT

SEQ ID NO: 1253067 - protein, 25 aa, Mycobacterium
IPEGKLAATLERYNEHAARGEDPDF

SEQ ID NO: 1253068 - protein, 25 aa, Mycobacterium
IPEGLLNYLALLGWGIADDRDVFSL

SEQ ID NO: 1253069 - protein, 17 aa, Mycobacterium
IPFGFAKEEFQQYAADK

SEQ ID NO: 1253070 - protein, 19 aa, Mycobacterium
IPFGPVLNARAEWLEETGR

SEQ ID NO: 1253071 - protein, 20 aa, Mycobacterium
IPGDSDGSWDLILVDDEDRR

SEQ ID NO: 1253072 - protein, 20 aa, Mycobacterium
IPGGAVLPVYDPLFDSQKLR

SEQ ID NO: 1253073 - protein, 18 aa, Mycobacterium
IPGSQAWSYHAYGRAIDL

SEQ ID NO: 1253074 - protein, 17 aa, Mycobacterium
IPLAALHYFPVRPSTKS

SEQ ID NO: 1253075 - protein, 17 aa, Mycobacterium
IPLDAALLADGRPATAT

SEQ ID NO: 1253076 - protein, 18 aa, Mycobacterium
IPLGGGRVECRAVDSAAN

SEQ ID NO: 1253077 - protein, 21 aa, Mycobacterium
IPMQLAGMAMQIPQGIMQGVQ

SEQ ID NO: 1253078 - protein, 20 aa, Mycobacterium
IPPKAFPVVCEQLRRSGLAR

SEQ ID NO: 1253079 - protein, 25 aa, Mycobacterium
IPPTQDPPAFCYIVADLTDKMIERC

SEQ ID NO: 1253080 - protein, 22 aa, Mycobacterium
IPSPALYPGAPIPAPPNVLSNI

SEQ ID NO: 1253081 - protein, 24 aa, Mycobacterium
IPTGAPRFPGTRIAGPGPGRQQQR

SEQ ID NO: 1253082 - protein, 21 aa, Mycobacterium
IPVPHRFLPMMPPAAVQFAGS

SEQ ID NO: 1253083 - protein, 17 aa, Mycobacterium
IPYGATIEATAGDGSPV

SEQ ID NO: 1253084 - protein, 27 aa, Mycobacterium
IQDAGRWRVPLLLAIRPEVGVDDVRAV

SEQ ID NO: 1253085 - protein, 20 aa, Mycobacterium
IQDDYPDWFIGIRQNGVVIG

SEQ ID NO: 1253086 - protein, 24 aa, Mycobacterium
IQDFVKKLPAWVSWDRREDYERDL

SEQ ID NO: 1253087 - protein, 24 aa, Mycobacterium
IQEFVKKLPAWVSWERRDHYERDL

SEQ ID NO: 1253088 - protein, 17 aa, Mycobacterium
IQFELDAALSISGSSGV

SEQ ID NO: 1253089 - protein, 23 aa, Mycobacterium
IQIPRFCDHPLLDPVGACRQCLV

SEQ ID NO: 1253090 - protein, 22 aa, Mycobacterium
IQLHGGIAFTWEHDAHLYLRRA

SEQ ID NO: 1253091 - protein, 22 aa, Mycobacterium
IQNHLLQLLALTAMEEPVSFHP

SEQ ID NO: 1253092 - protein, 20 aa, Mycobacterium
IQSFDWRTLPLVRQQAPSVP

SEQ ID NO: 1253093 - protein, 20 aa, Mycobacterium
IQVCVRRHGRVVLNRAIGHG

SEQ ID NO: 1253094 - protein, 26 aa, Mycobacterium
IRAACRRWRVAEIIADPFRWTRTLQA

SEQ ID NO: 1253095 - protein, 21 aa, Mycobacterium
IRAAWPHFREQSFGRVVVATS

SEQ ID NO: 1253096 - protein, 28 aa, Mycobacterium
IRALLERDLPVYIISIGRTFRTDELDAT

SEQ ID NO: 1253097 - protein, 17 aa, Mycobacterium
IRANVRAGDVLDVTVPF

SEQ ID NO: 1253098 - protein, 19 aa, Mycobacterium
IRARFRGVDVYEMPPPGQG

SEQ ID NO: 1253099 - protein, 25 aa, Mycobacterium
IRAWGERQKRILAWLQVLDAGDDLD

SEQ ID NO: 1253100 - protein, 18 aa, Mycobacterium
IRCTWLETSHAFHSELLD

SEQ ID NO: 1253101 - protein, 19 aa, Mycobacterium
IRDAAYEAVMNWTAGTPIA

SEQ ID NO: 1253102 - protein, 19 aa, Mycobacterium
IREGGGWGLDEVAELGALS

SEQ ID NO: 1253103 - protein, 23 aa, Mycobacterium
IRELRFTADYHRLYDAISDALGV

SEQ ID NO: 1253104 - protein, 22 aa, Mycobacterium
IRGGYLSEVFPITFPHTPGIDV

SEQ ID NO: 1253105 - protein, 19 aa, Mycobacterium
IRGKMVISVRRRRPAVTSP

SEQ ID NO: 1253106 - protein, 17 aa, Mycobacterium
IRIAEVLLLAGQKLLDE

SEQ ID NO: 1253107 - protein, 25 aa, Mycobacterium
IRIGRRIMARLNWRKNGPGPTTPPH

SEQ ID NO: 1253108 - protein, 21 aa, Mycobacterium
IRKVSFKSLVPAWLVTDYSDV

SEQ ID NO: 1253109 - protein, 19 aa, Mycobacterium
IRLEPQWLTPTAYMMAKFG

SEQ ID NO: 1253110 - protein, 17 aa, Mycobacterium
IRLMAGHELVTEGFAPG

SEQ ID NO: 1253111 - protein, 28 aa, Mycobacterium
IRLRVPVPSIAASLFARFESRQEDSPTM

SEQ ID NO: 1253112 - protein, 26 aa, Mycobacterium
IRPLLLMLSHPFYWQHFGRLTDVVRT

SEQ ID NO: 1253113 - protein, 19 aa, Mycobacterium
IRQLITRLDNFVGVLDAQR

SEQ ID NO: 1253114 - protein, 19 aa, Mycobacterium
IRRAPIVDGIDEFDNDFFG

SEQ ID NO: 1253115 - protein, 21 aa, Mycobacterium
IRREGIRYATFVGAQLAQIDP

SEQ ID NO: 1253116 - protein, 30 aa, Mycobacterium
IRSPHAAAGLPRTLRTPITQGAKYFDVTGA

SEQ ID NO: 1253117 - protein, 18 aa, Mycobacterium
IRVRGLTYAYLKAAEPAV

SEQ ID NO: 1253118 - protein, 22 aa, Mycobacterium
IRVYRWRPAPRDGDFDQLVAGI

SEQ ID NO: 1253119 - protein, 23 aa, Mycobacterium
IRYIDRFLMFYIRTADRLQRTAP

SEQ ID NO: 1253120 - protein, 22 aa, Mycobacterium
IRYVDRFLMFYIRTADRLQRTA

SEQ ID NO: 1253121 - protein, 20 aa, Mycobacterium
ISALNRPVAAGGDTRNQNTV

SEQ ID NO: 1253122 - protein, 24 aa, Mycobacterium
ISAVLPTLAAPLMANVAALQAKEG

SEQ ID NO: 1253123 - protein, 17 aa, Mycobacterium
ISEAKWSLYPMGGSAVR

SEQ ID NO: 1253124 - protein, 25 aa, Mycobacterium
ISELPRAVDLFFRGITDWIIGGIRG

SEQ ID NO: 1253125 - protein, 19 aa, Mycobacterium
ISETTWRIPMAKRGRKKRD

SEQ ID NO: 1253126 - protein, 34 aa, Mycobacterium
ISFMTPAAFVRRPGRWIREMARKEGETGGVISVA

SEQ ID NO: 1253127 - protein, 39 aa, Mycobacterium
ISFSQRAQVALPWSMINAFCDLAQTYPWREARPGRYGSD

SEQ ID NO: 1253128 - protein, 26 aa, Mycobacterium
ISGEASRFGFVFTRRGVVPESASSWF

SEQ ID NO: 1253129 - protein, 26 aa, Mycobacterium
ISHEQRMRDAISWCEKAAESITTAKD

SEQ ID NO: 1253130 - protein, 19 aa, Mycobacterium
ISIFDSPCVSFHVDVDLEY

SEQ ID NO: 1253131 - protein, 24 aa, Mycobacterium
ISLERWDFRTGGGYRYVHSDENSS

SEQ ID NO: 1253132 - protein, 17 aa, Mycobacterium
ISLRRPSLDEVFLHLTT

SEQ ID NO: 1253133 - protein, 21 aa, Mycobacterium
ISPSGPRLAGSLGTSLLSLSM

SEQ ID NO: 1253134 - protein, 23 aa, Mycobacterium
ISQGRLEALLNFQTMVSDLTGLE

SEQ ID NO: 1253135 - protein, 24 aa, Mycobacterium
ISQGRLEALLNFQTMVSDLTGLEV

SEQ ID NO: 1253136 - protein, 20 aa, Mycobacterium
ISREMILNFVAQHSLKLPAS

SEQ ID NO: 1253137 - protein, 25 aa, Mycobacterium
ISRRLEMDDLMALRPAGLSSGQKQR

SEQ ID NO: 1253138 - protein, 24 aa, Mycobacterium
ISTPRWTELKSRVRDYLGTKIEFR

SEQ ID NO: 1253139 - protein, 24 aa, Mycobacterium
ISVEWIELAFFALLLRGCREAARG

SEQ ID NO: 1253140 - protein, 17 aa, Mycobacterium
ITALAGRYRDVDLGGLQ

SEQ ID NO: 1253141 - protein, 24 aa, Mycobacterium
ITDEIKSRILAMAAPDEHGNRPDV

SEQ ID NO: 1253142 - protein, 24 aa, Mycobacterium
ITDELPLLQARTVRVAGHLLEIRG

SEQ ID NO: 1253143 - protein, 22 aa, Mycobacterium
ITDLALSCAMWVGMGRVLRTLD

SEQ ID NO: 1253144 - protein, 17 aa, Mycobacterium
ITDRILLLDGLPNYQRL

SEQ ID NO: 1253145 - protein, 18 aa, Mycobacterium
ITGRIDLVHCNDSRDAAG

SEQ ID NO: 1253146 - protein, 18 aa, Mycobacterium
ITHDGFWRLFASEAGIEG

SEQ ID NO: 1253147 - protein, 26 aa, Mycobacterium
ITIDGRPTVNMAVGFLPPQDMIENAK

SEQ ID NO: 1253148 - protein, 18 aa, Mycobacterium
ITIEMAVAPIALALAAHP

SEQ ID NO: 1253149 - protein, 19 aa, Mycobacterium
ITLADAVAVVIARAEVVDR

SEQ ID NO: 1253150 - protein, 19 aa, Mycobacterium
ITMSLELGDRVGLVGHNGA

SEQ ID NO: 1253151 - protein, 26 aa, Mycobacterium
ITNCRPYLRREIDIVTPRLIIALGRD

SEQ ID NO: 1253152 - protein, 25 aa, Mycobacterium
ITNGRIPRLYGRQASEFVIRRAMSQ

SEQ ID NO: 1253153 - protein, 25 aa, Mycobacterium
ITPEQFFPAFGSMTFDDSVQEGRDN

SEQ ID NO: 1253154 - protein, 20 aa, Mycobacterium
ITTLPWPGSKWTASRDMPEP

SEQ ID NO: 1253155 - protein, 25 aa, Mycobacterium
ITTRGFRDAILMQRATGHWAGRELH

SEQ ID NO: 1253156 - protein, 23 aa, Mycobacterium
ITVLETRAALATTDMGTAREYGP

SEQ ID NO: 1253157 - protein, 19 aa, Mycobacterium
ITVPGLLTARVVPGTPAAQ

SEQ ID NO: 1253158 - protein, 17 aa, Mycobacterium
IVAGLPVAVHDDADEAR

SEQ ID NO: 1253159 - protein, 24 aa, Mycobacterium
IVAPEWSDTVGLCGANEEEMLAMN

SEQ ID NO: 1253160 - protein, 18 aa, Mycobacterium
IVDAMFLGILPFLLGEHA

SEQ ID NO: 1253161 - protein, 22 aa, Mycobacterium
IVEIPRPAGVVLALTPTTNPVS

SEQ ID NO: 1253162 - protein, 25 aa, Mycobacterium
IVGTLRPGRGRGASAPEVKAATSVP

SEQ ID NO: 1253163 - protein, 23 aa, Mycobacterium
IVISCPLLLTLPAVGTYPIEAVR

SEQ ID NO: 1253164 - protein, 21 aa, Mycobacterium
IVLAQGRFDPGQVMALVERER

SEQ ID NO: 1253165 - protein, 20 aa, Mycobacterium
IVPFNHPVLFAGSKIAAPLM

SEQ ID NO: 1253166 - protein, 24 aa, Mycobacterium
IVRRLHNAGAPLQCGALYDGINKS

SEQ ID NO: 1253167 - protein, 23 aa, Mycobacterium
IVRRLRDAEFRRIIGKTSVELDL

SEQ ID NO: 1253168 - protein, 19 aa, Mycobacterium
IVSRRYRHAVGEYKVALTN

SEQ ID NO: 1253169 - protein, 23 aa, Mycobacterium
IVSRVASLTGLPVRLGGDGLCMA

SEQ ID NO: 1253170 - protein, 17 aa, Mycobacterium
IVTPRVMQVTLRGQLPK

SEQ ID NO: 1253171 - protein, 17 aa, Mycobacterium
IVVLEYHPKGLFERTGN

SEQ ID NO: 1253172 - protein, 19 aa, Mycobacterium
IWAMPAVNLQLMYEAFAHS

SEQ ID NO: 1253173 - protein, 19 aa, Mycobacterium
IWEPGRILTTIGIRHPRSI

SEQ ID NO: 1253174 - protein, 20 aa, Mycobacterium
IWGFPKIMADFTVRETPRFD

SEQ ID NO: 1253175 - protein, 19 aa, Mycobacterium
IWLANLVAFISGRVSAADT

SEQ ID NO: 1253176 - protein, 18 aa, Mycobacterium
IWSPMLRRFPDLKFALSE

SEQ ID NO: 1253177 - protein, 22 aa, Mycobacterium
IYADMPLGPALAARGPEDIVKR

SEQ ID NO: 1253178 - protein, 21 aa, Mycobacterium
IYHALTWGPLVREIVSAATGR

SEQ ID NO: 1253179 - protein, 26 aa, Mycobacterium
IYNKHMIFPKPGVDLSDPASFASIGM

SEQ ID NO: 1253180 - protein, 19 aa, Mycobacterium
IYSFLRLLLPAGVETTYRS

SEQ ID NO: 1253181 - protein, 19 aa, Mycobacterium
KAADIGGVWRDNTYPGAAC

SEQ ID NO: 1253182 - protein, 25 aa, Mycobacterium
KAAEKLPMCRGRHPHLDAFYKCDQR

SEQ ID NO: 1253183 - protein, 28 aa, Mycobacterium
KAAEPAGWRLAAAATTWSEVAALMTAAQ

SEQ ID NO: 1253184 - protein, 18 aa, Mycobacterium
KAANLVKVSGNFLIASVI

SEQ ID NO: 1253185 - protein, 17 aa, Mycobacterium
KAAYCLAVCPAGEDVIE

SEQ ID NO: 1253186 - protein, 20 aa, Mycobacterium
KADGPDRVRISGVRGEPPPP

SEQ ID NO: 1253187 - protein, 22 aa, Mycobacterium
KAEAAAELAEFVGMADVKEQID

SEQ ID NO: 1253188 - protein, 24 aa, Mycobacterium
KAEHWSGFGDAEMVFAEPPKKTSP

SEQ ID NO: 1253189 - protein, 20 aa, Mycobacterium
KAGPVVSHLRFAAGKLDPAN

SEQ ID NO: 1253190 - protein, 23 aa, Mycobacterium
KAKKLRVRLPLPKLTVAVTDPAQ

SEQ ID NO: 1253191 - protein, 25 aa, Mycobacterium
KALGRIPVKGGARFVRHPRPVYEKD

SEQ ID NO: 1253192 - protein, 19 aa, Mycobacterium
KALLRRLVEAGTRVVQYGY

SEQ ID NO: 1253193 - protein, 25 aa, Mycobacterium
KALTRRGPHRVLRGDLGFAGLPGVV

SEQ ID NO: 1253194 - protein, 24 aa, Mycobacterium
KAPWRLKQNYLIDLRVIRNAKIDD

SEQ ID NO: 1253195 - protein, 19 aa, Mycobacterium
KARGFGEEVIRQFAQDIHI

SEQ ID NO: 1253196 - protein, 29 aa, Mycobacterium
KAVIVSEPFMPAAPLLSGLGMLVLTVAEL

SEQ ID NO: 1253197 - protein, 20 aa, Mycobacterium
KAVTETFAILANRGSGKSVT

SEQ ID NO: 1253198 - protein, 23 aa, Mycobacterium
KAYAAGLAAWWTVLEHTGTDWRE

SEQ ID NO: 1253199 - protein, 21 aa, Mycobacterium
KDDILAVLAYWARKDRDMVIT

SEQ ID NO: 1253200 - protein, 26 aa, Mycobacterium
KDELRRYQMQSGFVFQSHNLFPHKTV

SEQ ID NO: 1253201 - protein, 17 aa, Mycobacterium
KDGAPLTLVLGVAANDP

SEQ ID NO: 1253202 - protein, 18 aa, Mycobacterium
KDKASGDFVWDEEESEAL

SEQ ID NO: 1253203 - protein, 26 aa, Mycobacterium
KDLEELLAVVCGRGLELGDVAAEFHH

SEQ ID NO: 1253204 - protein, 17 aa, Mycobacterium
KDLGLALTLGEELDVDL

SEQ ID NO: 1253205 - protein, 30 aa, Mycobacterium
KDWGSGQPIVFSHGWPLSADDWDTQMLFFV

SEQ ID NO: 1253206 - protein, 24 aa, Mycobacterium
KECGPKSIKFVCLLTCPEGIAAMQ

SEQ ID NO: 1253207 - protein, 25 aa, Mycobacterium
KEGQRPPILDPFDPMTVWAYDECDL

SEQ ID NO: 1253208 - protein, 19 aa, Mycobacterium
KELRAVVAVDETDAVTAAA

SEQ ID NO: 1253209 - protein, 21 aa, Mycobacterium
KEQLTRLATALGPEAGVSDTS

SEQ ID NO: 1253210 - protein, 24 aa, Mycobacterium
KEVLRAPRSWCEPIYNITHWTTMP

SEQ ID NO: 1253211 - protein, 21 aa, Mycobacterium
KEVVDRTWAALKYVAGTTTAR

SEQ ID NO: 1253212 - protein, 20 aa, Mycobacterium
KEYNVRFTAVVPVPNDGKGA

SEQ ID NO: 1253213 - protein, 19 aa, Mycobacterium
KFVAGLPVYLVAKLLGERA

SEQ ID NO: 1253214 - protein, 26 aa, Mycobacterium
KGCTHPHCTVPFYWTEAHHTRDYAQG

SEQ ID NO: 1253215 - protein, 19 aa, Mycobacterium
KGDGPGVVLIPEMPGLHPH

SEQ ID NO: 1253216 - protein, 23 aa, Mycobacterium
KGEADLGLPHPVWQRLADTVDLI

SEQ ID NO: 1253217 - protein, 21 aa, Mycobacterium
KGKAKEGIGTVTGRDDMVREG

SEQ ID NO: 1253218 - protein, 17 aa, Mycobacterium
KGLRLARAQAAAVRAQG

SEQ ID NO: 1253219 - protein, 24 aa, Mycobacterium
KGMAFAVPLWFVVYDGCLHAATSA

SEQ ID NO: 1253220 - protein, 20 aa, Mycobacterium
KGPDAPTLCAGWKTRDLAAH

SEQ ID NO: 1253221 - protein, 22 aa, Mycobacterium
KGPQYAAMFGWPEPFADGADKK

SEQ ID NO: 1253222 - protein, 25 aa, Mycobacterium
KGQLTAPRASHDWAKGMRDQLLGRA

SEQ ID NO: 1253223 - protein, 19 aa, Mycobacterium
KGQQLGGVPDEWVVIEPAC

SEQ ID NO: 1253224 - protein, 24 aa, Mycobacterium
KGVLDRRSGTFIRFTRTAGGATAA

SEQ ID NO: 1253225 - protein, 17 aa, Mycobacterium
KHARRCVFWEVDPSTLG

SEQ ID NO: 1253226 - protein, 17 aa, Mycobacterium
KHGQRPPDEVVSFGEYE

SEQ ID NO: 1253227 - protein, 24 aa, Mycobacterium
KHLLRKGFEFKELEAAGLAREGKR

SEQ ID NO: 1253228 - protein, 23 aa, Mycobacterium
KHMRADVTVGAFLSGGIDSTAIA

SEQ ID NO: 1253229 - protein, 20 aa, Mycobacterium
KHNILYICDKLGALRRSDII

SEQ ID NO: 1253230 - protein, 37 aa, Mycobacterium
KHPSLQWIPDWMWRLNLKVLGPFAVWVTVGLYDPPVR

SEQ ID NO: 1253231 - protein, 22 aa, Mycobacterium
KHRRRARELTWHSTADLQRMLA

SEQ ID NO: 1253232 - protein, 17 aa, Mycobacterium
KIEPSLLAWLVRTLPAA

SEQ ID NO: 1253233 - protein, 21 aa, Mycobacterium
KISAGTRVHAHWVDEPVGAIT

SEQ ID NO: 1253234 - protein, 20 aa, Mycobacterium
KIVMEKLELVGLGGDETKFP

SEQ ID NO: 1253235 - protein, 24 aa, Mycobacterium
KKAFRAVALPARYMIACVNGHLDE

SEQ ID NO: 1253236 - protein, 19 aa, Mycobacterium
KKRLEAVGLGELSLDLHDK

SEQ ID NO: 1253237 - protein, 18 aa, Mycobacterium
KKVNAFIGFTRIDALDRI

SEQ ID NO: 1253238 - protein, 22 aa, Mycobacterium
KLARNHVFQLYAYVQSQHGSDE

SEQ ID NO: 1253239 - protein, 20 aa, Mycobacterium
KLDAAAVLHRLSLAHPVRQF

SEQ ID NO: 1253240 - protein, 23 aa, Mycobacterium
KLEELKALWFSEAAKYNGLPLGD

SEQ ID NO: 1253241 - protein, 24 aa, Mycobacterium
KLEQQAIFRKLWLHVGRVERLPKT

SEQ ID NO: 1253242 - protein, 18 aa, Mycobacterium
KLFGLSRERVRQIEREVM

SEQ ID NO: 1253243 - protein, 19 aa, Mycobacterium
KLFGLSRERVRQIEREVMA

SEQ ID NO: 1253244 - protein, 25 aa, Mycobacterium
KLFRRGQGKLGFEVKIHRIAAEGDA

SEQ ID NO: 1253245 - protein, 19 aa, Mycobacterium
KLGGAPVKVVSSVTLGDLD

SEQ ID NO: 1253246 - protein, 26 aa, Mycobacterium
KLIAAKRPRLIPIWDSFVEQATGLDT

SEQ ID NO: 1253247 - protein, 18 aa, Mycobacterium
KLKVGIVEAGSKWMFPLL

SEQ ID NO: 1253248 - protein, 17 aa, Mycobacterium
KLLEKAANLTIAEDEAA

SEQ ID NO: 1253249 - protein, 18 aa, Mycobacterium
KLLSQLFGDRMMIANATG

SEQ ID NO: 1253250 - protein, 21 aa, Mycobacterium
KLRGSRLTLVYAAPASLAAWS

SEQ ID NO: 1253251 - protein, 19 aa, Mycobacterium
KLSPARSFAGATLSLAEAK

SEQ ID NO: 1253252 - protein, 23 aa, Mycobacterium
KLVKRTLDGWLRELTATVSAAQA

SEQ ID NO: 1253253 - protein, 18 aa, Mycobacterium
KMAWLRAALTRSGVVTTT

SEQ ID NO: 1253254 - protein, 23 aa, Mycobacterium
KMHTDIAFGWTVERLARAAGVSR

SEQ ID NO: 1253255 - protein, 22 aa, Mycobacterium
KMLEASYRLHTIEATDLAVLDL

SEQ ID NO: 1253256 - protein, 18 aa, Mycobacterium
KMPKRRRTRAQNRARRIQ

SEQ ID NO: 1253257 - protein, 21 aa, Mycobacterium
KMSGNAPIYAILREARDRAKA

SEQ ID NO: 1253258 - protein, 17 aa, Mycobacterium
KNAKVLVIGAGGLGSPT

SEQ ID NO: 1253259 - protein, 17 aa, Mycobacterium
KNTPRALLMTATPHRGK

SEQ ID NO: 1253260 - protein, 18 aa, Mycobacterium
KPATAVAVTAHIAVDTAD

SEQ ID NO: 1253261 - protein, 24 aa, Mycobacterium
KPDERRLPVHPAHLTRIAPELRDR

SEQ ID NO: 1253262 - protein, 24 aa, Mycobacterium
KPENLQAIGAFKVRGAFNAIARLD

SEQ ID NO: 1253263 - protein, 23 aa, Mycobacterium
KPFKEALVADGIPFTSFAVDDVQ

SEQ ID NO: 1253264 - protein, 24 aa, Mycobacterium
KPGRPRTGLAALRMTTVDQLGRLV

SEQ ID NO: 1253265 - protein, 29 aa, Mycobacterium
KPGVLARVASLFSRRGFNIQSLAVGATEQ

SEQ ID NO: 1253266 - protein, 21 aa, Mycobacterium
KPHEGPCGSGTVFVFSGQGSQ

SEQ ID NO: 1253267 - protein, 25 aa, Mycobacterium
KPIYHRKWWDRYVEVNRRFAEATAR

SEQ ID NO: 1253268 - protein, 26 aa, Mycobacterium
KPPPSFADGFADGWFNTEEGIKDLIG

SEQ ID NO: 1253269 - protein, 23 aa, Mycobacterium
KPQRRIRLSGVMAAGGLSRDMYA

SEQ ID NO: 1253270 - protein, 21 aa, Mycobacterium
KPSARTSVPRLHWCAASRVVI

SEQ ID NO: 1253271 - protein, 27 aa, Mycobacterium
KPSGPRPRIALLDGLPMAGHIALSERL

SEQ ID NO: 1253272 - protein, 19 aa, Mycobacterium
KPSGRQLIALDGQRVTLGK

SEQ ID NO: 1253273 - protein, 20 aa, Mycobacterium
KQAHLPYLVYLRHPTTGGVF

SEQ ID NO: 1253274 - protein, 19 aa, Mycobacterium
KQDFGQWMFYGLGQALVGA

SEQ ID NO: 1253275 - protein, 19 aa, Mycobacterium
KQKRCRTAPGRLVEGQVVT

SEQ ID NO: 1253276 - protein, 17 aa, Mycobacterium
KQREILILRVVVGMSAE

SEQ ID NO: 1253277 - protein, 22 aa, Mycobacterium
KQVRRIQRQVAHEVVAEVDVRP

SEQ ID NO: 1253278 - protein, 19 aa, Mycobacterium
KRAARHIDAWLAGRSGERP

SEQ ID NO: 1253279 - protein, 27 aa, Mycobacterium
KRALDLFLKVSLLRRANPDRPHACLLT

SEQ ID NO: 1253280 - protein, 18 aa, Mycobacterium
KRDADGALRISVEDAAAL

SEQ ID NO: 1253281 - protein, 18 aa, Mycobacterium
KRFDTFAAATYVSGPSSS

SEQ ID NO: 1253282 - protein, 20 aa, Mycobacterium
KRHLESPIPGVYALDRELFL

SEQ ID NO: 1253283 - protein, 28 aa, Mycobacterium
KRLAADVAELVVSLGYRCRSTTKHVKGR

SEQ ID NO: 1253284 - protein, 17 aa, Mycobacterium
KRLAVWLVSDPSAVPGI

SEQ ID NO: 1253285 - protein, 19 aa, Mycobacterium
KRLGDALADGDRVLALVRG

SEQ ID NO: 1253286 - protein, 22 aa, Mycobacterium
KRLGHVAVMPLGVELRGAQASG

SEQ ID NO: 1253287 - protein, 25 aa, Mycobacterium
KRMPRIAGPCGVVIFGVTGDLSRKK

SEQ ID NO: 1253288 - protein, 19 aa, Mycobacterium
KRPLILLPAVDVVEGRAVR

SEQ ID NO: 1253289 - protein, 32 aa, Mycobacterium
KRPSRVVFVPAIPRLPSGKVLRRVLKEQHGCT

SEQ ID NO: 1253290 - protein, 21 aa, Mycobacterium
KRRHIDVCLGGPVEYQTVTTG

SEQ ID NO: 1253291 - protein, 20 aa, Mycobacterium
KRTLTATGLRQLIAFISRMT

SEQ ID NO: 1253292 - protein, 17 aa, Mycobacterium
KSASGSVRMGTLAQTLV

SEQ ID NO: 1253293 - protein, 35 aa, Mycobacterium
KSAYEYYTPFGWLRGFPFLAVQVVWAPGSEMSVAW

SEQ ID NO: 1253294 - protein, 19 aa, Mycobacterium
KSEAVQVYNILAGQSGARF

SEQ ID NO: 1253295 - protein, 20 aa, Mycobacterium
KSEIVMRLLSAEARIKLADM

SEQ ID NO: 1253296 - protein, 21 aa, Mycobacterium
KSGEAVVEMLRRGITARDILT

SEQ ID NO: 1253297 - protein, 32 aa, Mycobacterium
KSIPGMLMAAARLDLASVFLYNGSIMPGVAKL

SEQ ID NO: 1253298 - protein, 22 aa, Mycobacterium
KSIPLPVSYVLATLGSVKSRLR

SEQ ID NO: 1253299 - protein, 24 aa, Mycobacterium
KSMRIFKSEIKEMQSEGKSDNPPA

SEQ ID NO: 1253300 - protein, 25 aa, Mycobacterium
KSNWLRGELFAAPNVKVKVPYTNIP

SEQ ID NO: 1253301 - protein, 21 aa, Mycobacterium
KSSDRHVRRLAQLVTELEAVE

SEQ ID NO: 1253302 - protein, 25 aa, Mycobacterium
KSTLLLEVAHRWAVSGRRALYLTGE

SEQ ID NO: 1253303 - protein, 24 aa, Mycobacterium
KSTVWRAGIERARTRGFRVLAAHP

SEQ ID NO: 1253304 - protein, 20 aa, Mycobacterium
KSVLELMETVILLRMTGPRS

SEQ ID NO: 1253305 - protein, 19 aa, Mycobacterium
KTIAEWHDKCATKCADIAT

SEQ ID NO: 1253306 - protein, 17 aa, Mycobacterium
KTIDPYYGTSFYTIDFS

SEQ ID NO: 1253307 - protein, 17 aa, Mycobacterium
KTSGAKGLHVFVPVDDS

SEQ ID NO: 1253308 - protein, 20 aa, Mycobacterium
KTTWRELFEPAVQLADGGFD

SEQ ID NO: 1253309 - protein, 21 aa, Mycobacterium
KVAPALAAGCTMVMKPSEVTP

SEQ ID NO: 1253310 - protein, 17 aa, Mycobacterium
KVARFVFGLARRYGPRF

SEQ ID NO: 1253311 - protein, 23 aa, Mycobacterium
KVARVGIVLMRVFAGFSESAGGT

SEQ ID NO: 1253312 - protein, 19 aa, Mycobacterium
KVEGVLDCAELLVVALRDG

SEQ ID NO: 1253313 - protein, 34 aa, Mycobacterium
KVGSTYAPWDFFSDWKVIDAFGARSEIALQTALR

SEQ ID NO: 1253314 - protein, 22 aa, Mycobacterium
KVGVPYAGRAEYILVSTDNGVV

SEQ ID NO: 1253315 - protein, 18 aa, Mycobacterium
KVRSGWDDLVIAGGVESM

SEQ ID NO: 1253316 - protein, 25 aa, Mycobacterium
KVTDLRGRITAVLADGERMDAELAG

SEQ ID NO: 1253317 - protein, 19 aa, Mycobacterium
KWDGFRALVFRDGDDVVLM

SEQ ID NO: 1253318 - protein, 19 aa, Mycobacterium
KWLTDYAVAEAAGMAVTVD

SEQ ID NO: 1253319 - protein, 24 aa, Mycobacterium
KWQNEMHDKFGLDFRIVNSETMKE

SEQ ID NO: 1253320 - protein, 22 aa, Mycobacterium
KWRAQYPGLDWHVTADSEQAAG

SEQ ID NO: 1253321 - protein, 22 aa, Mycobacterium
KWVDDFSRLLGGGLRQITSATV

SEQ ID NO: 1253322 - protein, 25 aa, Mycobacterium
LAAAKGLPYVFAHHFSGQGTAEALA

SEQ ID NO: 1253323 - protein, 24 aa, Mycobacterium
LAAARPDLVSGLVLLDPAVGLDGE

SEQ ID NO: 1253324 - protein, 17 aa, Mycobacterium
LAADGAWVRYDGEGKPP

SEQ ID NO: 1253325 - protein, 19 aa, Mycobacterium
LAAEHGVKYVTLELGGKNP

SEQ ID NO: 1253326 - protein, 24 aa, Mycobacterium
LAAELRPWVPVVSLVKGLEQGTNM

SEQ ID NO: 1253327 - protein, 18 aa, Mycobacterium
LAAEPVYKPNLTLRGMGT

SEQ ID NO: 1253328 - protein, 22 aa, Mycobacterium
LAAERNRIGLLLVDDAQHLDPQ

SEQ ID NO: 1253329 - protein, 19 aa, Mycobacterium
LAAGAPKAFVNLAGRPMLE

SEQ ID NO: 1253330 - protein, 26 aa, Mycobacterium
LAAGEPRLAAAVPFYGPTPENPDFSG

SEQ ID NO: 1253331 - protein, 19 aa, Mycobacterium
LAAHRHGAQMADAWMIASG

SEQ ID NO: 1253332 - protein, 25 aa, Mycobacterium
LAALDVPVPFWFRAPGECPGAYAAE

SEQ ID NO: 1253333 - protein, 24 aa, Mycobacterium
LAALRGRLARMLVCDVDCARWLLD

SEQ ID NO: 1253334 - protein, 17 aa, Mycobacterium
LAAQGFHVVCVARREEP

SEQ ID NO: 1253335 - protein, 18 aa, Mycobacterium
LAARAEGLGMGWVSIFDP

SEQ ID NO: 1253336 - protein, 23 aa, Mycobacterium
LAASHLRHALAMEERLPQVGAAF

SEQ ID NO: 1253337 - protein, 19 aa, Mycobacterium
LAASSRRSAWWAGTATLGV

SEQ ID NO: 1253338 - protein, 17 aa, Mycobacterium
LAATKEFFALPLEEKMR

SEQ ID NO: 1253339 - protein, 19 aa, Mycobacterium
LAAWSLVHGFIMLWLNDLI

SEQ ID NO: 1253340 - protein, 24 aa, Mycobacterium
LADAIDRPVMWTIAALLGQHPIPV

SEQ ID NO: 1253341 - protein, 24 aa, Mycobacterium
LADAKTRLAPIFAPHDRETVVLAM

SEQ ID NO: 1253342 - protein, 19 aa, Mycobacterium
LADLNGYLGAPARRRDTGA

SEQ ID NO: 1253343 - protein, 17 aa, Mycobacterium
LADRPQERFGVSELARR

SEQ ID NO: 1253344 - protein, 22 aa, Mycobacterium
LAEAARLGFTTAVVPPGTTGVP

SEQ ID NO: 1253345 - protein, 18 aa, Mycobacterium
LAEASGLPQPVIAQLVPR

SEQ ID NO: 1253346 - protein, 31 aa, Mycobacterium
LAEGLPRLAGVPGWFACDVIQLVEAADHVIV

SEQ ID NO: 1253347 - protein, 17 aa, Mycobacterium
LAEGQRPTTVVFGCGDS

SEQ ID NO: 1253348 - protein, 20 aa, Mycobacterium
LAELHHQWHALGLTPLSILD

SEQ ID NO: 1253349 - protein, 19 aa, Mycobacterium
LAEPFGATTMGLIYVNPEG

SEQ ID NO: 1253350 - protein, 21 aa, Mycobacterium
LAEVVIHGWDVALATGQNYDC

SEQ ID NO: 1253351 - protein, 29 aa, Mycobacterium
LAGAWPSQSVMAWSGYSMQFKAAANSLFQ

SEQ ID NO: 1253352 - protein, 23 aa, Mycobacterium
LAGDTAEGLRCGHRVDWSIEDRN

SEQ ID NO: 1253353 - protein, 19 aa, Mycobacterium
LAGFDAWLDSWRALGPDGA

SEQ ID NO: 1253354 - protein, 18 aa, Mycobacterium
LAGGFCFGEGPRWFEGLL

SEQ ID NO: 1253355 - protein, 18 aa, Mycobacterium
LAGGRIALMSGQLGQLNG

SEQ ID NO: 1253356 - protein, 24 aa, Mycobacterium
LAGGRWALAVKMSPVLSGASAVRD

SEQ ID NO: 1253357 - protein, 26 aa, Mycobacterium
LAGHLRAGVIVRVWHGVYSLGPPDTA

SEQ ID NO: 1253358 - protein, 18 aa, Mycobacterium
LAGLSFPFLREKVHGRSN

SEQ ID NO: 1253359 - protein, 17 aa, Mycobacterium
LAGQGAVALLELDAPAA

SEQ ID NO: 1253360 - protein, 19 aa, Mycobacterium
LAGWGNKRVEAEAKTIAAR

SEQ ID NO: 1253361 - protein, 20 aa, Mycobacterium
LAHADAWGWTVVSMRNDWAT

SEQ ID NO: 1253362 - protein, 17 aa, Mycobacterium
LAHSLGLDDDRTWSDPA

SEQ ID NO: 1253363 - protein, 17 aa, Mycobacterium
LAKARDAFRATGIATVA

SEQ ID NO: 1253364 - protein, 23 aa, Mycobacterium
LAKDEWSKVTGFQRVRSTIRIFA

SEQ ID NO: 1253365 - protein, 18 aa, Mycobacterium
LAKLAVRLEMTAVYLRLV

SEQ ID NO: 1253366 - protein, 18 aa, Mycobacterium
LAKMPKRRRTRAADQAAR

SEQ ID NO: 1253367 - protein, 18 aa, Mycobacterium
LAKPLDRLAKAWKRLETV

SEQ ID NO: 1253368 - protein, 17 aa, Mycobacterium
LAKSASGSVRMGTLAQT

SEQ ID NO: 1253369 - protein, 17 aa, Mycobacterium
LALARFGGQPAVVLGQQ

SEQ ID NO: 1253370 - protein, 21 aa, Mycobacterium
LALGSEWLAVTGYRQADTNST

SEQ ID NO: 1253371 - protein, 25 aa, Mycobacterium
LALGYRIAPRPVLAMVSEQLMKARG

SEQ ID NO: 1253372 - protein, 20 aa, Mycobacterium
LALLSAMYVMFAGFFHGAAM

SEQ ID NO: 1253373 - protein, 26 aa, Mycobacterium
LALPGHAPSGLGFRPDGSLLITSVER

SEQ ID NO: 1253374 - protein, 24 aa, Mycobacterium
LALYRAVTAFGRVAAEELAPVDLS

SEQ ID NO: 1253375 - protein, 23 aa, Mycobacterium
LANRPALIVPLHLIEQATRQCYQ

SEQ ID NO: 1253376 - protein, 23 aa, Mycobacterium
LAPDVVDGLALFLPQATPAAKPG

SEQ ID NO: 1253377 - protein, 17 aa, Mycobacterium
LAPEGRLLVIGFAAGGG

SEQ ID NO: 1253378 - protein, 25 aa, Mycobacterium
LAPGRSAFFLGDSCGKGISAATVAS

SEQ ID NO: 1253379 - protein, 22 aa, Mycobacterium
LAPLLTRPAVIFGKSTVPAGTA

SEQ ID NO: 1253380 - protein, 18 aa, Mycobacterium
LAPLRAAARDGLAAYSTA

SEQ ID NO: 1253381 - protein, 19 aa, Mycobacterium
LAPPERSAMFLSELADLVL

SEQ ID NO: 1253382 - protein, 18 aa, Mycobacterium
LAPQPHPSKIVGVAVNNS

SEQ ID NO: 1253383 - protein, 25 aa, Mycobacterium
LAQNCDAYHDFLFAVPWADGVAVPV

SEQ ID NO: 1253384 - protein, 23 aa, Mycobacterium
LAQRLLDAYPRIDVLANNAGGMM

SEQ ID NO: 1253385 - protein, 22 aa, Mycobacterium
LARAELRVRYGLGERPVVVCLS

SEQ ID NO: 1253386 - protein, 18 aa, Mycobacterium
LARDAGLVIAERGGVLTD

SEQ ID NO: 1253387 - protein, 25 aa, Mycobacterium
LARDYPRLVAELGLDDTVLAELVGG

SEQ ID NO: 1253388 - protein, 22 aa, Mycobacterium
LAREIADVVGPLAQRIAADDRP

SEQ ID NO: 1253389 - protein, 18 aa, Mycobacterium
LASLAVRGTLVLFGGASG

SEQ ID NO: 1253390 - protein, 18 aa, Mycobacterium
LASLGIRKGEPFTPDEPT

SEQ ID NO: 1253391 - protein, 19 aa, Mycobacterium
LASTGPFREQRFVAADATR

SEQ ID NO: 1253392 - protein, 22 aa, Mycobacterium
LATQAACRVLRNGGTAADAMVT

SEQ ID NO: 1253393 - protein, 27 aa, Mycobacterium
LATQRTRLPLPWAQARLLSTIEDQGEA

SEQ ID NO: 1253394 - protein, 19 aa, Mycobacterium
LAVAEAFWPDGLQSGMGDP

SEQ ID NO: 1253395 - protein, 19 aa, Mycobacterium
LAVLPEVFDLVDAYGADTV

SEQ ID NO: 1253396 - protein, 18 aa, Mycobacterium
LAVLRAYNDWNIDEWCGT

SEQ ID NO: 1253397 - protein, 24 aa, Mycobacterium
LAVPLDDILGIPLTLQIPGQGPGA

SEQ ID NO: 1253398 - protein, 25 aa, Mycobacterium
LAYDLLEPWELLVLVDALPDRGAPG

SEQ ID NO: 1253399 - protein, 17 aa, Mycobacterium
LAYFLDKRQRGFDLCIY

SEQ ID NO: 1253400 - protein, 22 aa, Mycobacterium
LCEIRSAGAVFGLLDIDDEFFV

SEQ ID NO: 1253401 - protein, 18 aa, Mycobacterium
LCRHFAEQLIARGAKVYA

SEQ ID NO: 1253402 - protein, 17 aa, Mycobacterium
LCRVICRDGGITVLSPD

SEQ ID NO: 1253403 - protein, 19 aa, Mycobacterium
LCSAARCSPVNQVFLDSVG

SEQ ID NO: 1253404 - protein, 19 aa, Mycobacterium
LCTPLARRGAGHVGAGGDL

SEQ ID NO: 1253405 - protein, 31 aa, Mycobacterium
LDAFTRYLPKEFKRRGVQMLTEGKRTFAVMG

SEQ ID NO: 1253406 - protein, 26 aa, Mycobacterium
LDAHPVPGRWLPNGCMATSGSLIRWF

SEQ ID NO: 1253407 - protein, 33 aa, Mycobacterium; identical to SEQ ID NO: 687901

SEQ ID NO: 1253408 - protein, 18 aa, Mycobacterium
LDALGVRHALLVVTKADL

SEQ ID NO: 1253409 - protein, 19 aa, Mycobacterium
LDAPKRLGSFMDSRLWRML

SEQ ID NO: 1253410 - protein, 17 aa, Mycobacterium
LDAPVLVVVAPGLGTLN

SEQ ID NO: 1253411 - protein, 17 aa, Mycobacterium
LDAVCTRTWEVHGGAVD

SEQ ID NO: 1253412 - protein, 27 aa, Mycobacterium
LDDCLLKYSRLFAALTEWERSTDIAVL

SEQ ID NO: 1253413 - protein, 24 aa, Mycobacterium
LDDPSWRVRGGFEQLPTSVQDALR

SEQ ID NO: 1253414 - protein, 21 aa, Mycobacterium
LDEFGEAIAASAPLRRIGRDD

SEQ ID NO: 1253415 - protein, 17 aa, Mycobacterium
LDFDLLGRLPAPLTTTV

SEQ ID NO: 1253416 - protein, 17 aa, Mycobacterium
LDFLNGRDYRGKRELTP

SEQ ID NO: 1253417 - protein, 34 aa, Mycobacterium
LDFMRSCSIKHQLPSVIFSLEMSKSEIVMRLLSA

SEQ ID NO: 1253418 - protein, 22 aa, Mycobacterium
LDGDLRASARLVRRTLTDPRQG

SEQ ID NO: 1253419 - protein, 19 aa, Mycobacterium
LDGFCSASLMIDRTSGRAV

SEQ ID NO: 1253420 - protein, 26 aa, Mycobacterium
LDGLPNYQRLFSLRVGQTLREQFEAD

SEQ ID NO: 1253421 - protein, 17 aa, Mycobacterium
LDGPWASAVRSIAERAG

SEQ ID NO: 1253422 - protein, 27 aa, Mycobacterium
LDHNGVRRWLALDGQPLHRVIVAASEM

SEQ ID NO: 1253423 - protein, 17 aa, Mycobacterium
LDIAMGMGILVTQVLTA

SEQ ID NO: 1253424 - protein, 17 aa, Mycobacterium
LDINGRAAVVLPDNVLF

SEQ ID NO: 1253425 - protein, 17 aa, Mycobacterium
LDLCVERNIAFVPFFPL

SEQ ID NO: 1253426 - protein, 18 aa, Mycobacterium
LDLDMLIFAGGRERTRAE

SEQ ID NO: 1253427 - protein, 25 aa, Mycobacterium
LDLGCGWGGMVRYAARHGVKTVGVT

SEQ ID NO: 1253428 - protein, 18 aa, Mycobacterium
LDLGELSPALTVAADGAD

SEQ ID NO: 1253429 - protein, 22 aa, Mycobacterium
LDLPAGSILRQVDYFGLGTTVA

SEQ ID NO: 1253430 - protein, 26 aa, Mycobacterium
LDLQYRHRLEFAVGRTTSVNWDEPTD

SEQ ID NO: 1253431 - protein, 25 aa, Mycobacterium
LDLRHATSLRHCLDLLTQHARTHPD

SEQ ID NO: 1253432 - protein, 25 aa, Mycobacterium
LDLVGIPVDEHWRVMSDLATYADGT

SEQ ID NO: 1253433 - protein, 17 aa, Mycobacterium
LDLVGLSEFGGYLPRQL

SEQ ID NO: 1253434 - protein, 21 aa, Mycobacterium
LDMLNPLAWLRDKFGGADMTA

SEQ ID NO: 1253435 - protein, 27 aa, Mycobacterium
LDNAYLGHVIVLWSWALKQPNDGRPAS

SEQ ID NO: 1253436 - protein, 17 aa, Mycobacterium
LDNRVTLLDALREHLGV

SEQ ID NO: 1253437 - protein, 20 aa, Mycobacterium
LDPHAPIVIRRGDRIAQLLV

SEQ ID NO: 1253438 - protein, 17 aa, Mycobacterium
LDPLRPLTFISGPSATS

SEQ ID NO: 1253439 - protein, 20 aa, Mycobacterium
LDPSLPRYSASAAHLHERAG

SEQ ID NO: 1253440 - protein, 18 aa, Mycobacterium
LDQGRVGASLGLDSTVYE

SEQ ID NO: 1253441 - protein, 23 aa, Mycobacterium
LDRAAWRRFQVRLTLSAPSRAQA

SEQ ID NO: 1253442 - protein, 25 aa, Mycobacterium
LDRLFPRSIFYSLRLAEHNLDELLN

SEQ ID NO: 1253443 - protein, 27 aa, Mycobacterium
LDRNKERLRRILITEVGCPITVSGSQI

SEQ ID NO: 1253444 - protein, 18 aa, Mycobacterium
LDRPAGRGHMAFGRGAHF

SEQ ID NO: 1253445 - protein, 24 aa, Mycobacterium
LDRPFGIGLVHWVAEARPDLLERA

SEQ ID NO: 1253446 - protein, 21 aa, Mycobacterium
LDRSKPLWEMWVIEGVGETDP

SEQ ID NO: 1253447 - protein, 23 aa, Mycobacterium
LDSGRIPGLRGLGSGPGTRGVDG

SEQ ID NO: 1253448 - protein, 18 aa, Mycobacterium
LDTSKLVIFDGDSGENLT

SEQ ID NO: 1253449 - protein, 19 aa, Mycobacterium
LDTVIAYKLLFGIYSGIVP

SEQ ID NO: 1253450 - protein, 27 aa, Mycobacterium
LDVPILQGLCLTSSWSDWSSNDDGLSP

SEQ ID NO: 1253451 - protein, 17 aa, Mycobacterium
LDVPSIVVAHTIPKAPS

SEQ ID NO: 1253452 - protein, 17 aa, Mycobacterium
LDVRRRAVLELPDSNLK

SEQ ID NO: 1253453 - protein, 19 aa, Mycobacterium
LDVTVLFAYPRRLASGVQL

SEQ ID NO: 1253454 - protein, 20 aa, Mycobacterium
LDWNAQRLAVFDGDVDAIIR

SEQ ID NO: 1253455 - protein, 24 aa, Mycobacterium
LDYVKRVRAGGVLTATGRPIPPTQ

SEQ ID NO: 1253456 - protein, 25 aa, Mycobacterium
LEAAKSFLPETQWDVLVGLAAGFTP

SEQ ID NO: 1253457 - protein, 23 aa, Mycobacterium
LEAANLRGQWIYDEMLESVVGGP

SEQ ID NO: 1253458 - protein, 24 aa, Mycobacterium
LEACQAAGLDAEWVDGSHGAHVPF

SEQ ID NO: 1253459 - protein, 30 aa, Mycobacterium
LEAELPHGLPPVRLIAGAQLDGWQSYPDCV

SEQ ID NO: 1253460 - protein, 18 aa, Mycobacterium
LEAFLDRDVDALLATSRD

SEQ ID NO: 1253461 - protein, 22 aa, Mycobacterium
LEALHEAIRWRRTVHIDEIATL

SEQ ID NO: 1253462 - protein, 21 aa, Mycobacterium
LEAVVMDWVWYHQEPVTVRDV

SEQ ID NO: 1253463 - protein, 23 aa, Mycobacterium
LEAYCAIPSMGAVLHTLNIRLAP

SEQ ID NO: 1253464 - protein, 17 aa, Mycobacterium
LEECPACLRHYGVEERV

SEQ ID NO: 1253465 - protein, 23 aa, Mycobacterium
LEESFAAAVTRLILIGKAGLRLH

SEQ ID NO: 1253466 - protein, 28 aa, Mycobacterium
LEEVQRAGGVTLTLGFAVSRDLSSRRLV

SEQ ID NO: 1253467 - protein, 25 aa, Mycobacterium
LEGCWRLLESGGFLVAESDRVLGQV

SEQ ID NO: 1253468 - protein, 23 aa, Mycobacterium
LEGLQFPGSEFFTIADRVPGFDV

SEQ ID NO: 1253469 - protein, 27 aa, Mycobacterium
LEGPRFCGHPDLRYACIPSTSPVSRDF

SEQ ID NO: 1253470 - protein, 21 aa, Mycobacterium
LEGYTTLGFLSARTSRIDLGL

SEQ ID NO: 1253471 - protein, 24 aa, Mycobacterium
LEHGMPMCDVFWVMHVDESDLVAR

SEQ ID NO: 1253472 - protein, 18 aa, Mycobacterium
LEHRAAWVEAESDGTVTS

SEQ ID NO: 1253473 - protein, 17 aa, Mycobacterium
LEIALRLKALADPVRVK

SEQ ID NO: 1253474 - protein, 19 aa, Mycobacterium
LEIIARAPLAVTDGDSSAW

SEQ ID NO: 1253475 - protein, 25 aa, Mycobacterium
LEISSIPTVMAFRDGVLVYRQAGAL

SEQ ID NO: 1253476 - protein, 17 aa, Mycobacterium
LEKAADIGGVWRDNTYP

SEQ ID NO: 1253477 - protein, 23 aa, Mycobacterium
LEKERFMAALAMRMAEIRGTDAV

SEQ ID NO: 1253478 - protein, 17 aa, Mycobacterium
LELASLAIALKRRVLVL

SEQ ID NO: 1253479 - protein, 21 aa, Mycobacterium
LELHPLLNPAAYVWADVDPGF

SEQ ID NO: 1253480 - protein, 25 aa, Mycobacterium
LELRVLRLDTEYAWAEDPPSRIRHH

SEQ ID NO: 1253481 - protein, 25 aa, Mycobacterium
LEMATKFYTALGFTEVKRLTVPDQM

SEQ ID NO: 1253482 - protein, 17 aa, Mycobacterium
LEMRTAVNLLLDRLPNL

SEQ ID NO: 1253483 - protein, 23 aa, Mycobacterium
LENVPIEPIWLCPLRLRDESSWP

SEQ ID NO: 1253484 - protein, 23 aa, Mycobacterium
LEPYWEALRKVYAPFDVAASGPP

SEQ ID NO: 1253485 - protein, 23 aa, Mycobacterium
LEQEKLCLLVMIGVRSDGRKELV

SEQ ID NO: 1253486 - protein, 17 aa, Mycobacterium
LEQRGFESLWLGEHPQI

SEQ ID NO: 1253487 - protein, 28 aa, Mycobacterium
LEQVWRDNGRWSRFFMVPGGHIHRSTAC

SEQ ID NO: 1253488 - protein, 17 aa, Mycobacterium
LERAFRVFTERFGDFKP

SEQ ID NO: 1253489 - protein, 21 aa, Mycobacterium
LERALELTATYAREREQFERP

SEQ ID NO: 1253490 - protein, 20 aa, Mycobacterium
LEREFPELFERVAQLRARGL

SEQ ID NO: 1253491 - protein, 21 aa, Mycobacterium
LERLVGAQVAYLPNPRAEADE

SEQ ID NO: 1253492 - protein, 20 aa, Mycobacterium
LERQVCFALAVANRAVLGVY

SEQ ID NO: 1253493 - protein, 20 aa, Mycobacterium
LERRGAKRALITLCIGGGMG

SEQ ID NO: 1253494 - protein, 29 aa, Mycobacterium
LERWRKAGFRFSLDWLLRNATAVATGRAL

SEQ ID NO: 1253495 - protein, 17 aa, Mycobacterium
LESAEWELLTSALAPWT

SEQ ID NO: 1253496 - protein, 18 aa, Mycobacterium
LESGAGITGFIKTVLSVR

SEQ ID NO: 1253497 - protein, 18 aa, Mycobacterium
LESTMRFILSGKSAYVDG

SEQ ID NO: 1253498 - protein, 25 aa, Mycobacterium
LETGTWIRLHPRFDIDTMLHHVESD

SEQ ID NO: 1253499 - protein, 23 aa, Mycobacterium
LETVPICVGYTIDGKRTDEMPMT

SEQ ID NO: 1253500 - protein, 22 aa, Mycobacterium
LEVDRDCFARIAPGLPSNVIRI

SEQ ID NO: 1253501 - protein, 20 aa, Mycobacterium
LEVPEHLGGAGATFAETAVI

SEQ ID NO: 1253502 - protein, 19 aa, Mycobacterium
LEVPGLVYTATRKDAARYA

SEQ ID NO: 1253503 - protein, 20 aa, Mycobacterium
LEYLLLRPLDIDLFDGPHAG

SEQ ID NO: 1253504 - protein, 19 aa, Mycobacterium
LFAKHGVPMVAHDNDPLGE

SEQ ID NO: 1253505 - protein, 18 aa, Mycobacterium
LFDRALRRYLAGPSAYTA

SEQ ID NO: 1253506 - protein, 17 aa, Mycobacterium
LFEKAGRDLESQDYSEA

SEQ ID NO: 1253507 - protein, 24 aa, Mycobacterium
LFFPDGQCLFGPVLIDPPVGEGAL

SEQ ID NO: 1253508 - protein, 26 aa, Mycobacterium
LFGHSRRSYLWGMLHARRRRLEPDPE

SEQ ID NO: 1253509 - protein, 23 aa, Mycobacterium
LFPDVPDDLPYVWPASDRERRIP

SEQ ID NO: 1253510 - protein, 25 aa, Mycobacterium
LFQRWPTDWTDHWRALTMPAVAVRA

SEQ ID NO: 1253511 - protein, 18 aa, Mycobacterium
LFRFPKLKVGIVEAGSKW

SEQ ID NO: 1253512 - protein, 19 aa, Mycobacterium
LFSHVPWLSSQLLSAVEAF

SEQ ID NO: 1253513 - protein, 18 aa, Mycobacterium
LFTPGYPGFLRGLTPVGG

SEQ ID NO: 1253514 - protein, 21 aa, Mycobacterium
LFWVSAHPLRGFWGAGRITGE

SEQ ID NO: 1253515 - protein, 17 aa, Mycobacterium
LGAISADHRPAWTSTLV

SEQ ID NO: 1253516 - protein, 17 aa, Mycobacterium
LGALPPSLFLVGSGEVL

SEQ ID NO: 1253517 - protein, 19 aa, Mycobacterium
LGANLARLELRVLFEELLA

SEQ ID NO: 1253518 - protein, 19 aa, Mycobacterium
LGASGVWMGSAFLTSAEYD

SEQ ID NO: 1253519 - protein, 17 aa, Mycobacterium
LGCDATCEVWFERDGQL

SEQ ID NO: 1253520 - protein, 17 aa, Mycobacterium
LGCDATCEVWFERNGQP

SEQ ID NO: 1253521 - protein, 25 aa, Mycobacterium
LGDELPDLVAVLSRLIGPIRRVVYD

SEQ ID NO: 1253522 - protein, 25 aa, Mycobacterium
LGDGRARLVEACERGGATLFGSGVS

SEQ ID NO: 1253523 - protein, 26 aa, Mycobacterium
LGDPVLWSVPLHWAGVHAGILANSPE

SEQ ID NO: 1253524 - protein, 17 aa, Mycobacterium
LGDRAAELIDELNAELT

SEQ ID NO: 1253525 - protein, 25 aa, Mycobacterium
LGEAGFDWYEVSNWARSGGECRHNL

SEQ ID NO: 1253526 - protein, 22 aa, Mycobacterium
LGEGDFYSAVNLLVGAAIAPVA

SEQ ID NO: 1253527 - protein, 20 aa, Mycobacterium
LGGIAIKAALEKAGVAPSAV

SEQ ID NO: 1253528 - protein, 18 aa, Mycobacterium
LGGPDGFRGCLGVVGGFM

SEQ ID NO: 1253529 - protein, 19 aa, Mycobacterium
LGGQRELWAAMNPGGNNHR

SEQ ID NO: 1253530 - protein, 17 aa, Mycobacterium
LGGRSMLAHALHTVAKV

SEQ ID NO: 1253531 - protein, 19 aa, Mycobacterium
LGGRSRWLRRIADLTQQGV

SEQ ID NO: 1253532 - protein, 20 aa, Mycobacterium
LGGSGARILTTLLYHMRDNN

SEQ ID NO: 1253533 - protein, 21 aa, Mycobacterium
LGHLESGAGITGFIKTVLSLR

SEQ ID NO: 1253534 - protein, 21 aa, Mycobacterium
LGHLESGAGITGFIKTVLSVR

SEQ ID NO: 1253535 - protein, 26 aa, Mycobacterium
LGICNGFQVLCEAGLLPGALTRNIGL

SEQ ID NO: 1253536 - protein, 19 aa, Mycobacterium
LGIERAHLVGLSLGGMTAM

SEQ ID NO: 1253537 - protein, 19 aa, Mycobacterium
LGIEWPFDGELVLSDRDAA

SEQ ID NO: 1253538 - protein, 17 aa, Mycobacterium
LGILDIRPFARGHTLVI

SEQ ID NO: 1253539 - protein, 17 aa, Mycobacterium
LGKRAPMRRIVEARALS

SEQ ID NO: 1253540 - protein, 17 aa, Mycobacterium
LGKRFGPVLAVEGLDLS

SEQ ID NO: 1253541 - protein, 21 aa, Mycobacterium
LGLAGDLRRVTGMDRRLAEAA

SEQ ID NO: 1253542 - protein, 22 aa, Mycobacterium
LGLPTAPFWFAGSAEELGTVAQ

SEQ ID NO: 1253543 - protein, 21 aa, Mycobacterium
LGLRPRMAVGIHLRSGARRTP

SEQ ID NO: 1253544 - protein, 21 aa, Mycobacterium
LGMKPRTVIDLHNGGCAAFIL

SEQ ID NO: 1253545 - protein, 33 aa, Mycobacterium
LGMVRCVRAALPLLRSASWARIVNFSAQSTQRQ

SEQ ID NO: 1253546 - protein, 18 aa, Mycobacterium
LGNDTQYGLAAGVRTSDT

SEQ ID NO: 1253547 - protein, 31 aa, Mycobacterium
LGNMGAPMAKRLTGWPGGLIVFDVRPDAMAP

SEQ ID NO: 1253548 - protein, 17 aa, Mycobacterium
LGNTPLVGCPHLSPRWD

SEQ ID NO: 1253549 - protein, 17 aa, Mycobacterium
LGPMVMLGLGGVFVEVL

SEQ ID NO: 1253550 - protein, 19 aa, Mycobacterium
LGPQTCALVSAHFYPQMPF

SEQ ID NO: 1253551 - protein, 17 aa, Mycobacterium
LGPSDTCYLSMPLFHSN

SEQ ID NO: 1253552 - protein, 21 aa, Mycobacterium
LGPVGARFLAALAEAAAAEST

SEQ ID NO: 1253553 - protein, 25 aa, Mycobacterium
LGPVRLQFWVCGVFEVHAGRITLWR

SEQ ID NO: 1253554 - protein, 17 aa, Mycobacterium
LGRHFPFDPSQAEIPEP

SEQ ID NO: 1253555 - protein, 28 aa, Mycobacterium
LGRRLGRIRARVILMPAVTDTYFTVTEN

SEQ ID NO: 1253556 - protein, 30 aa, Mycobacterium
LGSPGGAVIIQFVVKTVVGMLDWGLDPQQA

SEQ ID NO: 1253557 - protein, 23 aa, Mycobacterium
LGSPWDGPTGRHAAEMLPTDDSG

SEQ ID NO: 1253558 - protein, 17 aa, Mycobacterium
LGVLGFRPVESLVTVTV

SEQ ID NO: 1253559 - protein, 31 aa, Mycobacterium
LGVVMARYILELEPFASLPVEQIAETIGPNL

SEQ ID NO: 1253560 - protein, 24 aa, Mycobacterium
LGYDSRIGRRFLNAGLGFGGGCLP

SEQ ID NO: 1253561 - protein, 25 aa, Mycobacterium
LGYRDPELLAGFWSLVEQLQISAMS

SEQ ID NO: 1253562 - protein, 21 aa, Mycobacterium
LHAGIPVHCLGDLLRVINDHI

SEQ ID NO: 1253563 - protein, 32 aa, Mycobacterium
LHISGRLAASIKEQVCRGTISFLSREARKPGS

SEQ ID NO: 1253564 - protein, 21 aa, Mycobacterium
LHKRWRGSRLRDPRQARFLTV

SEQ ID NO: 1253565 - protein, 25 aa, Mycobacterium
LHLEGPAPWKAWGTGEVVLPWPLPD

SEQ ID NO: 1253566 - protein, 25 aa, Mycobacterium
LHPLPPGLGRFPLRRVSDYPDTAPA

SEQ ID NO: 1253567 - protein, 24 aa, Mycobacterium
LHPYRVRHLLDRYGSLITEVLAFA

SEQ ID NO: 1253568 - protein, 25 aa, Mycobacterium
LHQRARAAVRIVRRVTGRRYTIAQF

SEQ ID NO: 1253569 - protein, 24 aa, Mycobacterium
LHRASGPMPKWYAPVGSLFDQFLG

SEQ ID NO: 1253570 - protein, 24 aa, Mycobacterium
LHRLQGLGRRTVLPGHGPDLPDLE

SEQ ID NO: 1253571 - protein, 23 aa, Mycobacterium
LHRLSRLGEWDAMGGLIDDEVLD

SEQ ID NO: 1253572 - protein, 18 aa, Mycobacterium
LHRLWPPVIDLVRHLVDD

SEQ ID NO: 1253573 - protein, 24 aa, Mycobacterium
LHSAFKLLNWQGGSGNVLVSEPYG

SEQ ID NO: 1253574 - protein, 28 aa, Mycobacterium
LHSAGYAVPHWPAEWGGGLSVAEQIVLY

SEQ ID NO: 1253575 - protein, 31 aa, Mycobacterium; identical to SEQ ID NO: 691391

SEQ ID NO: 1253576 - protein, 19 aa, Mycobacterium
LHTCNHAAMLALALRQRDR

SEQ ID NO: 1253577 - protein, 18 aa, Mycobacterium
LHTLPPKAQQAIREDLES

SEQ ID NO: 1253578 - protein, 20 aa, Mycobacterium
LHVDGAFGLWAAAAPRTRHL

SEQ ID NO: 1253579 - protein, 22 aa, Mycobacterium
LHWQPHLWRHLVERVPADPPHI

SEQ ID NO: 1253580 - protein, 17 aa, Mycobacterium
LHYAYNFLGETEQKMAS

SEQ ID NO: 1253581 - protein, 17 aa, Mycobacterium
LIADFYTRWFAADLSVR

SEQ ID NO: 1253582 - protein, 19 aa, Mycobacterium
LIAGTRCWTDREFLVHGDR

SEQ ID NO: 1253583 - protein, 30 aa, Mycobacterium
LIAQDVPLNYGRYSLDDSWYEYASVDPARP

SEQ ID NO: 1253584 - protein, 18 aa, Mycobacterium
LIARYKAPRTVDFVDSLP

SEQ ID NO: 1253585 - protein, 29 aa, Mycobacterium
LIASWLNYLPPRLVPPVFRHQARRRDSSM

SEQ ID NO: 1253586 - protein, 24 aa, Mycobacterium
LIDRGRLTVAVSRTYPLEEVVAAL

SEQ ID NO: 1253587 - protein, 32 aa, Mycobacterium
LIEEFRDVHLLHGFRGSEPWHLDQLADTLVGF

SEQ ID NO: 1253588 - protein, 25 aa, Mycobacterium
LIGGKCHQCGTYVFPPRANNCPNPA

SEQ ID NO: 1253589 - protein, 17 aa, Mycobacterium
LIGRDLLTQLGFRSGIH

SEQ ID NO: 1253590 - protein, 30 aa, Mycobacterium
LIGREVKKLPTLRGRTVITMFYENSTRTRV

SEQ ID NO: 1253591 - protein, 18 aa, Mycobacterium
LIGTAARWLYVDPNLAGA

SEQ ID NO: 1253592 - protein, 24 aa, Mycobacterium
LIHGAGGAVGWIAVQLAREAGARV

SEQ ID NO: 1253593 - protein, 27 aa, Mycobacterium
LILKPAPDTPWCAAAVGEIIAEHTDFP

SEQ ID NO: 1253594 - protein, 43 aa, Mycobacterium
LIQRFPNVLVLRTFSKAYGLAGLRIGYAIGSWGLTAELWAMQL

SEQ ID NO: 1253595 - protein, 17 aa, Mycobacterium
LIRRDLRGIPLVVPPGG

SEQ ID NO: 1253596 - protein, 23 aa, Mycobacterium
LISERPRLTAALDKLGKLGDTAT

SEQ ID NO: 1253597 - protein, 24 aa, Mycobacterium
LISERPRLTAALDKLGKLGDTATA

SEQ ID NO: 1253598 - protein, 23 aa, Mycobacterium
LISGGRLTVGIGVGGRHEDYEAV

SEQ ID NO: 1253599 - protein, 18 aa, Mycobacterium
LIVYWWPTPDKASVAGAI

SEQ ID NO: 1253600 - protein, 24 aa, Mycobacterium
LKAAAELFAANGFGSTRMEAIAQR

SEQ ID NO: 1253601 - protein, 17 aa, Mycobacterium
LKAMATVCEQCWPHIAA

SEQ ID NO: 1253602 - protein, 18 aa, Mycobacterium
LKDLPRLGISVLGESHDA

SEQ ID NO: 1253603 - protein, 21 aa, Mycobacterium
LKDRFRLRLIDFQILKQLQST

SEQ ID NO: 1253604 - protein, 18 aa, Mycobacterium
LKDVRLALEAGDGLQVPL

SEQ ID NO: 1253605 - protein, 20 aa, Mycobacterium
LKDVSGYVITLAQAENLPAH

SEQ ID NO: 1253606 - protein, 17 aa, Mycobacterium
LKGNLSGYWSRRIDDEH

SEQ ID NO: 1253607 - protein, 20 aa, Mycobacterium
LKIALSEGGTGWIPYFLERV

SEQ ID NO: 1253608 - protein, 27 aa, Mycobacterium
LKITGPTAPSWRKGRYHIAGRGPRDTY

SEQ ID NO: 1253609 - protein, 17 aa, Mycobacterium
LKLLGIADIIPLYASVD

SEQ ID NO: 1253610 - protein, 17 aa, Mycobacterium
LKMEGSWKVVPASRPSR

SEQ ID NO: 1253611 - protein, 21 aa, Mycobacterium
LKNRGAVFAFFREVKPKYVIL

SEQ ID NO: 1253612 - protein, 17 aa, Mycobacterium
LKNSYEWANDVKNGVQV

SEQ ID NO: 1253613 - protein, 17 aa, Mycobacterium
LKYGVKQVFSAAGASTR

SEQ ID NO: 1253614 - protein, 17 aa, Mycobacterium
LLAAEGFPVEPPRRRMR

SEQ ID NO: 1253615 - protein, 20 aa, Mycobacterium
LLAARLAVFRRWPSSSTAGR

SEQ ID NO: 1253616 - protein, 17 aa, Mycobacterium
LLAEAGYQMAPVGDGAP

SEQ ID NO: 1253617 - protein, 25 aa, Mycobacterium
LLAEFGIPITVERQVLYWLDPVGGT

SEQ ID NO: 1253618 - protein, 25 aa, Mycobacterium
LLAEPRGYCAGVDRAVETVERALEK

SEQ ID NO: 1253619 - protein, 19 aa, Mycobacterium
LLAFTAFPKQIWRQIWSNN

SEQ ID NO: 1253620 - protein, 18 aa, Mycobacterium
LLAKLGGITRLWRRTTGV

SEQ ID NO: 1253621 - protein, 19 aa, Mycobacterium
LLAPEFYKQPDVLFSDDMF

SEQ ID NO: 1253622 - protein, 24 aa, Mycobacterium
LLATARSWAWLSGRNYVTPDDVKA

SEQ ID NO: 1253623 - protein, 18 aa, Mycobacterium
LLCRDHLLGSLDDRSLRI

SEQ ID NO: 1253624 - protein, 18 aa, Mycobacterium
LLDCASLQALEKVGITEA

SEQ ID NO: 1253625 - protein, 20 aa, Mycobacterium
LLDKERPVQLIVAGKSHPAD

SEQ ID NO: 1253626 - protein, 18 aa, Mycobacterium
LLDKFSLARFPRIEEAST

SEQ ID NO: 1253627 - protein, 21 aa, Mycobacterium
LLDPARFPWLTATDQHGLRVQ

SEQ ID NO: 1253628 - protein, 18 aa, Mycobacterium
LLDPAVGLDGEWMREIAD

SEQ ID NO: 1253629 - protein, 19 aa, Mycobacterium
LLDRLGIERAHLVGLSLGG

SEQ ID NO: 1253630 - protein, 17 aa, Mycobacterium
LLDVCCEMAERIAAFSR

SEQ ID NO: 1253631 - protein, 20 aa, Mycobacterium
LLDVRWQLAQPDGRDDYAAG

SEQ ID NO: 1253632 - protein, 37 aa, Mycobacterium
LLDVSRIQWRFERLCKQIPLAAPWTAPAAHRLDDLSL

SEQ ID NO: 1253633 - protein, 20 aa, Mycobacterium
LLDWLAHTYNLLFVVSAGNH

SEQ ID NO: 1253634 - protein, 17 aa, Mycobacterium
LLEEGAYVVGLDLPEAD

SEQ ID NO: 1253635 - protein, 20 aa, Mycobacterium
LLERGRFDGLFIADVLGTYD

SEQ ID NO: 1253636 - protein, 27 aa, Mycobacterium
LLFALGDVFVGWLLLRSAHIALTALAE

SEQ ID NO: 1253637 - protein, 18 aa, Mycobacterium
LLGAGGSGMSGMNPLGQG

SEQ ID NO: 1253638 - protein, 20 aa, Mycobacterium
LLGDRSLQDHAWRIAAKLNW

SEQ ID NO: 1253639 - protein, 18 aa, Mycobacterium
LLGFGEGHTHGFLTSLAR

SEQ ID NO: 1253640 - protein, 22 aa, Mycobacterium
LLGGFRPLFRALDPEQVNTLSS

SEQ ID NO: 1253641 - protein, 21 aa, Mycobacterium
LLGKLTSLQVHHIFPKALLRK

SEQ ID NO: 1253642 - protein, 30 aa, Mycobacterium
LLGQSRPRTRWRWRAIVTDLAAPQRVDPRN

SEQ ID NO: 1253643 - protein, 17 aa, Mycobacterium
LLGRPTVLYPLGAFDPG

SEQ ID NO: 1253644 - protein, 31 aa, Mycobacterium
LLHPLSAPMTLRWLRDRFTDRPVYEHKTRTV

SEQ ID NO: 1253645 - protein, 18 aa, Mycobacterium
LLIPIRRAFRQYVNLRPI

SEQ ID NO: 1253646 - protein, 21 aa, Mycobacterium
LLKLLHPVMPFVTEVLWKTLT

SEQ ID NO: 1253647 - protein, 20 aa, Mycobacterium
LLKSCDVMPESLTARRNLSF

SEQ ID NO: 1253648 - protein, 17 aa, Mycobacterium
LLLAMSEEGYAQVSTKV

SEQ ID NO: 1253649 - protein, 23 aa, Mycobacterium
LLLHKGYEVHGLIRRASTFNTAR

SEQ ID NO: 1253650 - protein, 24 aa, Mycobacterium
LLLHYSIDWEASWVAEPRFRKTYW

SEQ ID NO: 1253651 - protein, 19 aa, Mycobacterium
LLLLARTGLELGVPDRVTR

SEQ ID NO: 1253652 - protein, 17 aa, Mycobacterium
LLLRDGRIIAQGEAADV

SEQ ID NO: 1253653 - protein, 17 aa, Mycobacterium
LLLWVPGWYLTYNYWPT

SEQ ID NO: 1253654 - protein, 18 aa, Mycobacterium
LLNEVARRIVAAGQGLAT

SEQ ID NO: 1253655 - protein, 17 aa, Mycobacterium
LLNVQSWLPTGAVPLDF

SEQ ID NO: 1253656 - protein, 21 aa, Mycobacterium
LLPGYRCITPTLPMGAHTVPM

SEQ ID NO: 1253657 - protein, 23 aa, Mycobacterium
LLPRPPRSATLPAVLGVAEESFT

SEQ ID NO: 1253658 - protein, 19 aa, Mycobacterium
LLREFELLEPLRARLAEGM

SEQ ID NO: 1253659 - protein, 20 aa, Mycobacterium
LLRGCREAARGLVPPGSVVT

SEQ ID NO: 1253660 - protein, 28 aa, Mycobacterium
LLSGALAFKLLYRCRALLQTGEVPTIRK

SEQ ID NO: 1253661 - protein, 37 aa, Mycobacterium
LLSNAMRPNGGILARGFEGMTIPLLGVTFYGPTPTDS

SEQ ID NO: 1253662 - protein, 23 aa, Mycobacterium
LLSQAFVEFTFPLAAQYFTINPL

SEQ ID NO: 1253663 - protein, 24 aa, Mycobacterium
LLSRREALRRLSLIGIGTAGATAL

SEQ ID NO: 1253664 - protein, 20 aa, Mycobacterium
LLSVGYRLTGSVADAEDAVQ

SEQ ID NO: 1253665 - protein, 23 aa, Mycobacterium
LLTEARRALREAIGIVEELRAEL

SEQ ID NO: 1253666 - protein, 19 aa, Mycobacterium
LLTQLGFRSGIHGLGDLLR

SEQ ID NO: 1253667 - protein, 17 aa, Mycobacterium
LLTRGILLGIKRRAESR

SEQ ID NO: 1253668 - protein, 26 aa, Mycobacterium
LLVAECLRAGTWEGLDAAELAAVLSA

SEQ ID NO: 1253669 - protein, 26 aa, Mycobacterium
LLVALDRFEALAGFRPVARTVDLMRA

SEQ ID NO: 1253670 - protein, 17 aa, Mycobacterium
LLVAVGPFASMALTVAE

SEQ ID NO: 1253671 - protein, 20 aa, Mycobacterium
LLVGISTRLLAGAREVLTDS

SEQ ID NO: 1253672 - protein, 22 aa, Mycobacterium
LLVNSRSGYKYGDVTALDHMAY

SEQ ID NO: 1253673 - protein, 24 aa, Mycobacterium
LLVRLLRYLPGGTLIDADHLGPAA

SEQ ID NO: 1253674 - protein, 18 aa, Mycobacterium
LLWIHGGPLASWNAWHWR

SEQ ID NO: 1253675 - protein, 18 aa, Mycobacterium
LLWSPRSDSSVALGQTLA

SEQ ID NO: 1253676 - protein, 18 aa, Mycobacterium
LLYVAAMFHDLGLTARYR

SEQ ID NO: 1253677 - protein, 17 aa, Mycobacterium
LMADFDGRIGTAVEEFV

SEQ ID NO: 1253678 - protein, 17 aa, Mycobacterium
LMAGHELVTEGFAPGQV

SEQ ID NO: 1253679 - protein, 23 aa, Mycobacterium
LMRHLHLPPVFNPLVGVLTQSPT

SEQ ID NO: 1253680 - protein, 19 aa, Mycobacterium
LMRKGETLLVFPGGGRDMV

SEQ ID NO: 1253681 - protein, 19 aa, Mycobacterium
LMRMRLTPAAFQRGASMAA

SEQ ID NO: 1253682 - protein, 21 aa, Mycobacterium
LMVPSAAMGRAIPVAFQGGGP

SEQ ID NO: 1253683 - protein, 24 aa, Mycobacterium
LNAEAVWWGKRVRAAHSRQLVADR

SEQ ID NO: 1253684 - protein, 26 aa, Mycobacterium
LNARRRWLMQHVRAGVVQTSDAAAGI

SEQ ID NO: 1253685 - protein, 24 aa, Mycobacterium
LNEAFASVVLKFQKDLGIPDEKLN

SEQ ID NO: 1253686 - protein, 18 aa, Mycobacterium
LNELTVFLQHNPWVSATD

SEQ ID NO: 1253687 - protein, 17 aa, Mycobacterium
LNGAAYLPACLASHLPL

SEQ ID NO: 1253688 - protein, 28 aa, Mycobacterium
LNHLMPVKLKWGISLGALIMHLRESKLI

SEQ ID NO: 1253689 - protein, 22 aa, Mycobacterium
LNLAAFQRIRFDGDTATATALV

SEQ ID NO: 1253690 - protein, 17 aa, Mycobacterium
LNNLPLNLTEGIEDRDT

SEQ ID NO: 1253691 - protein, 25 aa, Mycobacterium
LNQWWYWTPGASWRHPIGPGSSIVN

SEQ ID NO: 1253692 - protein, 17 aa, Mycobacterium
LNRALGVTSEVWNTFGR

SEQ ID NO: 1253693 - protein, 19 aa, Mycobacterium
LNSRLVRYFVKRYTLKRSA

SEQ ID NO: 1253694 - protein, 20 aa, Mycobacterium
LNTRPRPTLDLDTPAQRMAQ

SEQ ID NO: 1253695 - protein, 19 aa, Mycobacterium
LNTRVGSLVARVIESDVRK

SEQ ID NO: 1253696 - protein, 17 aa, Mycobacterium
LNTWGADISAGFYAAMD

SEQ ID NO: 1253697 - protein, 18 aa, Mycobacterium
LNVIARRAGVAKGSLFQY

SEQ ID NO: 1253698 - protein, 24 aa, Mycobacterium
LPAGSRLLLLWGAANRDPSHFDEP

SEQ ID NO: 1253699 - protein, 18 aa, Mycobacterium
LPAKRRYEVVNALDDERL

SEQ ID NO: 1253700 - protein, 18 aa, Mycobacterium
LPALIRRYDEAVASGAQS

SEQ ID NO: 1253701 - protein, 17 aa, Mycobacterium
LPAPAEGAGPIPDLGQR

SEQ ID NO: 1253702 - protein, 18 aa, Mycobacterium
LPAPRRGIYRALLDDGSI

SEQ ID NO: 1253703 - protein, 19 aa, Mycobacterium
LPAVNGGVMRLRDALEEAA

SEQ ID NO: 1253704 - protein, 20 aa, Mycobacterium
LPDCPRWKVVDRTDLPKLVD

SEQ ID NO: 1253705 - protein, 18 aa, Mycobacterium
LPDGGAWLYSETVRQIKA

SEQ ID NO: 1253706 - protein, 18 aa, Mycobacterium
LPDGVRMVSADESIPIDE

SEQ ID NO: 1253707 - protein, 17 aa, Mycobacterium
LPDLVAALRIRLGPVAR

SEQ ID NO: 1253708 - protein, 20 aa, Mycobacterium
LPDMFTRMMLSLVTTGIAPK

SEQ ID NO: 1253709 - protein, 22 aa, Mycobacterium
LPEAQLDRFLLKLTVPLPPRDQ

SEQ ID NO: 1253710 - protein, 17 aa, Mycobacterium
LPEDRVVVELSPYDLSR

SEQ ID NO: 1253711 - protein, 24 aa, Mycobacterium
LPEQPRLLIKWVEACYGATSVEML

SEQ ID NO: 1253712 - protein, 19 aa, Mycobacterium
LPEWLNHRDEVLARLRKSV

SEQ ID NO: 1253713 - protein, 18 aa, Mycobacterium
LPFIARAVIDALKQHPNV

SEQ ID NO: 1253714 - protein, 20 aa, Mycobacterium
LPGAVVSIGHGGRVVFQQAF

SEQ ID NO: 1253715 - protein, 25 aa, Mycobacterium
LPGGMFAGAALTWPSGNSGMMRLTA

SEQ ID NO: 1253716 - protein, 20 aa, Mycobacterium
LPGHGFYWFQLRAPDPEPEG

SEQ ID NO: 1253717 - protein, 25 aa, Mycobacterium
LPGHYDFLQRLFAGIKPRHRQQLLA

SEQ ID NO: 1253718 - protein, 26 aa, Mycobacterium
LPGKHAASAFALWFPVETDHARYGEM

SEQ ID NO: 1253719 - protein, 24 aa, Mycobacterium
LPGRNRYRMSMLVPDHLSTRSHGE

SEQ ID NO: 1253720 - protein, 24 aa, Mycobacterium
LPGTARIGAPEGWLGAASTALRAA

SEQ ID NO: 1253721 - protein, 17 aa, Mycobacterium
LPGTLSLTPALLAGIVE

SEQ ID NO: 1253722 - protein, 17 aa, Mycobacterium
LPHPAVRDMLAGKVADH

SEQ ID NO: 1253723 - protein, 25 aa, Mycobacterium
LPIASLLRDRFLTLLATGGGHLDWS

SEQ ID NO: 1253724 - protein, 17 aa, Mycobacterium
LPLAIPTYREALGRWLH

SEQ ID NO: 1253725 - protein, 19 aa, Mycobacterium
LPLGAGRLTREWLPDDPPG

SEQ ID NO: 1253726 - protein, 28 aa, Mycobacterium
LPLLRPGDEVYVCWSPDASLVLPAADIP

SEQ ID NO: 1253727 - protein, 20 aa, Mycobacterium
LPLMEARALLDLGDVAKATR

SEQ ID NO: 1253728 - protein, 33 aa, Mycobacterium
LPLPSLVICELLGIPYDRHDWFQEETVKFLRLD

SEQ ID NO: 1253729 - protein, 19 aa, Mycobacterium
LPLTDGIRFAMVAASIAVC

SEQ ID NO: 1253730 - protein, 23 aa, Mycobacterium
LPMPRGRGLLFEKLYPAFWEFKP

SEQ ID NO: 1253731 - protein, 20 aa, Mycobacterium
LPNAVSVRLTYWLVTRAETL

SEQ ID NO: 1253732 - protein, 17 aa, Mycobacterium
LPPGITLAAQGITSGPL

SEQ ID NO: 1253733 - protein, 27 aa, Mycobacterium
LPPLSSGLVGFFAYDMVRQLERLPSLA

SEQ ID NO: 1253734 - protein, 18 aa, Mycobacterium
LPRNAVRLLEQWLAHSAL

SEQ ID NO: 1253735 - protein, 22 aa, Mycobacterium
LPRPVRRSLRRASAPLPEGMRG

SEQ ID NO: 1253736 - protein, 24 aa, Mycobacterium
LPRTETFKVLKRHLSAEGTDCADP

SEQ ID NO: 1253737 - protein, 17 aa, Mycobacterium
LPSNRYAQIAVRVRAQC

SEQ ID NO: 1253738 - protein, 27 aa, Mycobacterium
LPSTGSFRGSGTWIPLLRSGPGGQAES

SEQ ID NO: 1253739 - protein, 17 aa, Mycobacterium
LPTEPGLTLLGDFRADP

SEQ ID NO: 1253740 - protein, 17 aa, Mycobacterium
LPVKAALAGGLAGAKEK

SEQ ID NO: 1253741 - protein, 26 aa, Mycobacterium
LPVMCDFWETVLFRAGLYRRNALHVH

SEQ ID NO: 1253742 - protein, 17 aa, Mycobacterium
LPVTLWFMDKAKAGTQR

SEQ ID NO: 1253743 - protein, 19 aa, Mycobacterium
LPWRYHPDGSVALASPPKE

SEQ ID NO: 1253744 - protein, 18 aa, Mycobacterium
LPYHRPPLSKGYLAGKNG

SEQ ID NO: 1253745 - protein, 27 aa, Mycobacterium
LQAAAQRLPFLPIRAGLGSDVRKFWGD

SEQ ID NO: 1253746 - protein, 18 aa, Mycobacterium
LQAPLITVLGCAFATSTE

SEQ ID NO: 1253747 - protein, 17 aa, Mycobacterium
LQAPRSLWRSAGIPTTA

SEQ ID NO: 1253748 - protein, 21 aa, Mycobacterium
LQELEKGAGVAVTGGGSLLPM

SEQ ID NO: 1253749 - protein, 28 aa, Mycobacterium
LQERARYRAHWLVARTAEHIGGWSSRPL

SEQ ID NO: 1253750 - protein, 21 aa, Mycobacterium
LQLALTKLWRSYGVTPDAVIG

SEQ ID NO: 1253751 - protein, 18 aa, Mycobacterium
LQLGPAVADRGRRRIRDR

SEQ ID NO: 1253752 - protein, 25 aa, Mycobacterium
LQLQRCPWCGTKIDPKRDLHVDRTA

SEQ ID NO: 1253753 - protein, 37 aa, Mycobacterium
LQMVKRLAWELLYATETCRSFALWAVGLMYSATGDRL

SEQ ID NO: 1253754 - protein, 20 aa, Mycobacterium
LQRASDWLGDPVRPVSPGLP

SEQ ID NO: 1253755 - protein, 17 aa, Mycobacterium
LQRGPEMLTFVLEHSPL

SEQ ID NO: 1253756 - protein, 17 aa, Mycobacterium
LQSAADYQQHWAAGNLA

SEQ ID NO: 1253757 - protein, 17 aa, Mycobacterium
LQSKYLFLGLKNQHRGQ

SEQ ID NO: 1253758 - protein, 17 aa, Mycobacterium
LQTALRGTCDPANLLDL

SEQ ID NO: 1253759 - protein, 20 aa, Mycobacterium
LQVHHIFPKALLRKHGLDRN

SEQ ID NO: 1253760 - protein, 17 aa, Mycobacterium
LQVSILDTGSWKTPRTE

SEQ ID NO: 1253761 - protein, 17 aa, Mycobacterium
LQYADFGAWQTALLADD

SEQ ID NO: 1253762 - protein, 24 aa, Mycobacterium
LRAADRRAMLCGNIGNPVLDVLGE

SEQ ID NO: 1253763 - protein, 20 aa, Mycobacterium
LRADLLRPWANWVTPEEERT

SEQ ID NO: 1253764 - protein, 18 aa, Mycobacterium
LRALAQAILNRVDPAIRF

SEQ ID NO: 1253765 - protein, 23 aa, Mycobacterium
LRARLDEMMLAPGLPDGTAVTEL

SEQ ID NO: 1253766 - protein, 18 aa, Mycobacterium
LRASAVRYAQADADAALR

SEQ ID NO: 1253767 - protein, 24 aa, Mycobacterium
LRAVGRGVLRPDLTVFDGDTAVGV

SEQ ID NO: 1253768 - protein, 19 aa, Mycobacterium
LRDARERYAPVPVVEVILP

SEQ ID NO: 1253769 - protein, 22 aa, Mycobacterium
LRDGLAHLGAWGILDRAVTLVP

SEQ ID NO: 1253770 - protein, 19 aa, Mycobacterium
LRDLMPALRQGGVAAVSEV

SEQ ID NO: 1253771 - protein, 22 aa, Mycobacterium
LREAGCATVAMVSRYPRSEAYA

SEQ ID NO: 1253772 - protein, 25 aa, Mycobacterium
LREAYRVSINRLEWMTPETREKALA

SEQ ID NO: 1253773 - protein, 20 aa, Mycobacterium
LREEELLVFLGVIANAGTET

SEQ ID NO: 1253774 - protein, 17 aa, Mycobacterium
LREHAQFAVLADGRPVG

SEQ ID NO: 1253775 - protein, 20 aa, Mycobacterium
LRELWRAHLRNKGRYGSPAA

SEQ ID NO: 1253776 - protein, 20 aa, Mycobacterium
LRERAGGGVVAFVATGFDVL

SEQ ID NO: 1253777 - protein, 17 aa, Mycobacterium
LRETLALVDGGAESPYE

SEQ ID NO: 1253778 - protein, 19 aa, Mycobacterium
LRGAAWVFTGEGGVDAQTL

SEQ ID NO: 1253779 - protein, 21 aa, Mycobacterium
LRGFLDWLFERYHQIVATEPN

SEQ ID NO: 1253780 - protein, 17 aa, Mycobacterium
LRGIPLVVPPGGLVVIE

SEQ ID NO: 1253781 - protein, 18 aa, Mycobacterium
LRGLDSLDLGARRLDAAP

SEQ ID NO: 1253782 - protein, 19 aa, Mycobacterium
LRGLDSLDLGARRLDAAPD

SEQ ID NO: 1253783 - protein, 18 aa, Mycobacterium
LRGPHVVVLPCDNMTPGA

SEQ ID NO: 1253784 - protein, 25 aa, Mycobacterium
LRGTCDPANLLDLFESFVAYMERPG

SEQ ID NO: 1253785 - protein, 19 aa, Mycobacterium
LRGTYAGLCHPAIIDHLKS

SEQ ID NO: 1253786 - protein, 17 aa, Mycobacterium
LRHCVLDAAAVGGPAAD

SEQ ID NO: 1253787 - protein, 28 aa, Mycobacterium
LRHRDGRWYWHWDPAFLTKPGDDPFVRA

SEQ ID NO: 1253788 - protein, 19 aa, Mycobacterium
LRIDYDEAQRWIVMHRGSL

SEQ ID NO: 1253789 - protein, 18 aa, Mycobacterium
LRIRRAVIGDAYVDKALN

SEQ ID NO: 1253790 - protein, 17 aa, Mycobacterium
LRLCPPAAGVGRMALRD

SEQ ID NO: 1253791 - protein, 17 aa, Mycobacterium
LRLKPSARTSVPRLHWC

SEQ ID NO: 1253792 - protein, 26 aa, Mycobacterium
LRLPVDGILFAVEWKQFCGTTRGAGD

SEQ ID NO: 1253793 - protein, 17 aa, Mycobacterium
LRLSFAEVVHRIRCAAG

SEQ ID NO: 1253794 - protein, 18 aa, Mycobacterium
LRNAYRCCRVLNAEHGRT

SEQ ID NO: 1253795 - protein, 23 aa, Mycobacterium
LRNHYIKTLGIWASRLEQHKEAA

SEQ ID NO: 1253796 - protein, 22 aa, Mycobacterium
LRPGEDDLFWLGTEEAMAQGRA

SEQ ID NO: 1253797 - protein, 20 aa, Mycobacterium
LRPLEAVLTLLTSAGFAGVD

SEQ ID NO: 1253798 - protein, 23 aa, Mycobacterium
LRQALDRYAGWKGIKQARTAIGL

SEQ ID NO: 1253799 - protein, 18 aa, Mycobacterium
LRQRCLTHELLIDPEAAD

SEQ ID NO: 1253800 - protein, 20 aa, Mycobacterium
LRRADEIGAVCAFIEARPGL

SEQ ID NO: 1253801 - protein, 17 aa, Mycobacterium
LRRAHLVDGVPWSEMAV

SEQ ID NO: 1253802 - protein, 25 aa, Mycobacterium
LRRFHRADFPGVWMLRGSDLSMDQL

SEQ ID NO: 1253803 - protein, 28 aa, Mycobacterium
LRRFPDLKFALSEGGIGWVPYFLERIDR

SEQ ID NO: 1253804 - protein, 17 aa, Mycobacterium
LRRGEVAGLLWSDVDLE

SEQ ID NO: 1253805 - protein, 17 aa, Mycobacterium
LRRLGLDDHLILEGISI

SEQ ID NO: 1253806 - protein, 19 aa, Mycobacterium
LRRQLAKALGQLRDDNVNP

SEQ ID NO: 1253807 - protein, 27 aa, Mycobacterium
LRRQLTPHFRPGCKRMLMTSDYYPALQ

SEQ ID NO: 1253808 - protein, 19 aa, Mycobacterium
LRRRFAFADLAPQFNSSWR

SEQ ID NO: 1253809 - protein, 18 aa, Mycobacterium
LRRVRLRSAGPLAAEVCA

SEQ ID NO: 1253810 - protein, 19 aa, Mycobacterium
LRSKHGVILTRACLSGYGR

SEQ ID NO: 1253811 - protein, 29 aa, Mycobacterium
LRSNAVELARAWKPATLRAVNKVTAGGLV

SEQ ID NO: 1253812 - protein, 18 aa, Mycobacterium
LRSTSGPVLNQGPHQVDV

SEQ ID NO: 1253813 - protein, 17 aa, Mycobacterium
LRTAGAWLDTDEVDVAL

SEQ ID NO: 1253814 - protein, 23 aa, Mycobacterium
LRTAIRLEPRPAPEPDKDADGEP

SEQ ID NO: 1253815 - protein, 22 aa, Mycobacterium
LRTAIRLEPRPAPEPEKDADGE

SEQ ID NO: 1253816 - protein, 18 aa, Mycobacterium
LRTATLRMLLAAIQTEEV

SEQ ID NO: 1253817 - protein, 20 aa, Mycobacterium
LRTEMGYPLHGHELSPEISP

SEQ ID NO: 1253818 - protein, 19 aa, Mycobacterium
LRTGQPLTALDLVEEAQAK

SEQ ID NO: 1253819 - protein, 26 aa, Mycobacterium
LRTREALKAMIPRAKGSIVNIGSYAC

SEQ ID NO: 1253820 - protein, 20 aa, Mycobacterium
LRTYPHPHFAFYQADIRRQV

SEQ ID NO: 1253821 - protein, 20 aa, Mycobacterium
LRVLHVPVVVIPRDQLTPED

SEQ ID NO: 1253822 - protein, 18 aa, Mycobacterium
LRYTQTVTLWHGVERVDC

SEQ ID NO: 1253823 - protein, 24 aa, Mycobacterium
LSAGPRLRTLITYDPDLSRAAADH

SEQ ID NO: 1253824 - protein, 33 aa, Mycobacterium
LSARPGLSYQLAEGIALLSKVDWRARGLADLGR

SEQ ID NO: 1253825 - protein, 20 aa, Mycobacterium
LSARTSRIDLGLLVTGVTYR

SEQ ID NO: 1253826 - protein, 23 aa, Mycobacterium
LSARWRPVLEPVLADIAAQEVVV

SEQ ID NO: 1253827 - protein, 20 aa, Mycobacterium
LSDLTFEIELGPFVDGDMVA

SEQ ID NO: 1253828 - protein, 19 aa, Mycobacterium
LSELRLGFEPAAAALAARR

SEQ ID NO: 1253829 - protein, 21 aa, Mycobacterium
LSELSVALGEVQRFVAGTRDL

SEQ ID NO: 1253830 - protein, 21 aa, Mycobacterium
LSEPFAASRPRPEYLAARDMR

SEQ ID NO: 1253831 - protein, 17 aa, Mycobacterium
LSEPGDGGVLVIDGDGS

SEQ ID NO: 1253832 - protein, 24 aa, Mycobacterium
LSERPREVVLFAQLYLKDIPFAWS

SEQ ID NO: 1253833 - protein, 29 aa, Mycobacterium
LSFAEVVHRIRCAAGAFADLGIGKGDRVA

SEQ ID NO: 1253834 - protein, 33 aa, Mycobacterium
LSGGRFTLAVGVGYLKREFAALGVDFDERADLF

SEQ ID NO: 1253835 - protein, 24 aa, Mycobacterium
LSGIGRWLHTLGFRGHITSKSRRY

SEQ ID NO: 1253836 - protein, 18 aa, Mycobacterium
LSGPRLAARLAASMQPFM

SEQ ID NO: 1253837 - protein, 20 aa, Mycobacterium
LSGPTAWLFGAEAHGLAPDV

SEQ ID NO: 1253838 - protein, 17 aa, Mycobacterium
LSGQTFVYKGMLTTPQL

SEQ ID NO: 1253839 - protein, 31 aa, Mycobacterium
LSGVGRGGPRPCVVMCPGFGGTQDTPALVAT

SEQ ID NO: 1253840 - protein, 18 aa, Mycobacterium
LSLLEGRLSIDLVTFDAA

SEQ ID NO: 1253841 - protein, 17 aa, Mycobacterium
LSLVRLAKCGPWHRGGW

SEQ ID NO: 1253842 - protein, 17 aa, Mycobacterium
LSMPVVAAVAVFTDVVS

SEQ ID NO: 1253843 - protein, 20 aa, Mycobacterium
LSPLRRGRGDPCFHLAADGT

SEQ ID NO: 1253844 - protein, 19 aa, Mycobacterium
LSQFAGGFGSDLASQTGTG

SEQ ID NO: 1253845 - protein, 17 aa, Mycobacterium
LSRASRRRAERWLADRH

SEQ ID NO: 1253846 - protein, 24 aa, Mycobacterium
LSRELALAFQRLGAFVVAVDRYAD

SEQ ID NO: 1253847 - protein, 24 aa, Mycobacterium
LSRGRVRLAVGTGWLAEEINACGA

SEQ ID NO: 1253848 - protein, 22 aa, Mycobacterium
LSRLGRGVDFLTHIADDARGRR

SEQ ID NO: 1253849 - protein, 19 aa, Mycobacterium
LSRSRWRRTLGANVAANIV

SEQ ID NO: 1253850 - protein, 17 aa, Mycobacterium
LSSEINLGVAQFTTEHA

SEQ ID NO: 1253851 - protein, 20 aa, Mycobacterium
LSSIGAHHVVVYKSIWEPGR

SEQ ID NO: 1253852 - protein, 17 aa, Mycobacterium
LSTERDILRSAAKYFAG

SEQ ID NO: 1253853 - protein, 17 aa, Mycobacterium
LSTLPWPKENIDKIVRG

SEQ ID NO: 1253854 - protein, 18 aa, Mycobacterium
LSVDRFVREDSPLPIDAA

SEQ ID NO: 1253855 - protein, 20 aa, Mycobacterium
LSVGYLRQGDDFAAGATVRE

SEQ ID NO: 1253856 - protein, 23 aa, Mycobacterium
LSVKRPNWIVAVERKGVWVETER

SEQ ID NO: 1253857 - protein, 19 aa, Mycobacterium
LSVRSSVMVFLVRHERHES

SEQ ID NO: 1253858 - protein, 18 aa, Mycobacterium
LSYFLDLRGPSITVDTAC

SEQ ID NO: 1253859 - protein, 21 aa, Mycobacterium
LSYPMAHCRIPVIDHITVENA

SEQ ID NO: 1253860 - protein, 24 aa, Mycobacterium
LTAAARADLVLAIYNPASKTRTWQ

SEQ ID NO: 1253861 - protein, 17 aa, Mycobacterium
LTAAGAVAVTAPRVNDK

SEQ ID NO: 1253862 - protein, 18 aa, Mycobacterium
LTAALAGARIVSRGPKAT

SEQ ID NO: 1253863 - protein, 17 aa, Mycobacterium
LTAALARWAEDVLADAM

SEQ ID NO: 1253864 - protein, 20 aa, Mycobacterium
LTAAQRGLVRFHHRHRVDGL

SEQ ID NO: 1253865 - protein, 19 aa, Mycobacterium
LTAELALALGSAAARRLST

SEQ ID NO: 1253866 - protein, 21 aa, Mycobacterium
LTAQLAERAWKHFQDIESRGG

SEQ ID NO: 1253867 - protein, 23 aa, Mycobacterium
LTCGRALRLLPLPVEVDLFDGKS

SEQ ID NO: 1253868 - protein, 30 aa, Mycobacterium
LTDGDGRGSGPLRWLPAIPTVLADNPHWGD

SEQ ID NO: 1253869 - protein, 18 aa, Mycobacterium
LTDLIRWGNLIRRDLRGI

SEQ ID NO: 1253870 - protein, 17 aa, Mycobacterium
LTDLLAAELRRVVDTHG

SEQ ID NO: 1253871 - protein, 42 aa, Mycobacterium
LTECPQCSGRLRKLFGKVGVVFKGSGFYRTDSRESTKTSTNG

SEQ ID NO: 1253872 - protein, 18 aa, Mycobacterium
LTEGKRTFAVMGGVVNHF

SEQ ID NO: 1253873 - protein, 17 aa, Mycobacterium
LTELAARCAATVTSGAD

SEQ ID NO: 1253874 - protein, 21 aa, Mycobacterium
LTEQLDILTGMWATPVGETFD

SEQ ID NO: 1253875 - protein, 23 aa, Mycobacterium
LTFDLTGPLARRLHVAVDGRAAR

SEQ ID NO: 1253876 - protein, 19 aa, Mycobacterium
LTFEVEFFARHGFAEIDGT

SEQ ID NO: 1253877 - protein, 17 aa, Mycobacterium
LTGFPEAIAATWSQAAV

SEQ ID NO: 1253878 - protein, 23 aa, Mycobacterium
LTGWSLGALIAMRVARDDGTRVR

SEQ ID NO: 1253879 - protein, 17 aa, Mycobacterium
LTLAKAPARAALRTPEG

SEQ ID NO: 1253880 - protein, 19 aa, Mycobacterium
LTLLRNVHRTAVAVFTDGG

SEQ ID NO: 1253881 - protein, 17 aa, Mycobacterium
LTLQIPGQGPGAIGSLI

SEQ ID NO: 1253882 - protein, 23 aa, Mycobacterium
LTMLRRRGWLHIRVISEDRPYDI

SEQ ID NO: 1253883 - protein, 22 aa, Mycobacterium
LTPEAWAVWEAIFAKYAAPGMC

SEQ ID NO: 1253884 - protein, 26 aa, Mycobacterium
LTPGSADCIIAFDLLVAADSKNLGYG

SEQ ID NO: 1253885 - protein, 17 aa, Mycobacterium
LTPQFPGLDTFAGDIYH

SEQ ID NO: 1253886 - protein, 18 aa, Mycobacterium
LTPTFRTTLALAVGQHAA

SEQ ID NO: 1253887 - protein, 21 aa, Mycobacterium
LTRILMSWRREVRRTEGTDQE

SEQ ID NO: 1253888 - protein, 19 aa, Mycobacterium
LTRMPGVRGLHHVMVEVQS

SEQ ID NO: 1253889 - protein, 18 aa, Mycobacterium
LTRPELLDLLAAAETLLA

SEQ ID NO: 1253890 - protein, 22 aa, Mycobacterium
LTRRSSGDYVLTGRKFYSTGAL

SEQ ID NO: 1253891 - protein, 17 aa, Mycobacterium
LTRSRLVSIHGKDRVRK

SEQ ID NO: 1253892 - protein, 17 aa, Mycobacterium
LTRTEFDILAALSSRPA

SEQ ID NO: 1253893 - protein, 19 aa, Mycobacterium
LTSPGVRIVRCEPGYATPI

SEQ ID NO: 1253894 - protein, 20 aa, Mycobacterium
LTSQMGRSFLQKIGLLPTPT

SEQ ID NO: 1253895 - protein, 19 aa, Mycobacterium
LTTDVAIPVARTEPALDLD

SEQ ID NO: 1253896 - protein, 21 aa, Mycobacterium
LTTSVAWRLRGQTSYCADGQV

SEQ ID NO: 1253897 - protein, 19 aa, Mycobacterium
LTVAWPGAHLGPMGLEGAV

SEQ ID NO: 1253898 - protein, 19 aa, Mycobacterium
LTVFEIDALIVHRSIGLDV

SEQ ID NO: 1253899 - protein, 32 aa, Mycobacterium
LTVKSPEFVALWADHRVKRCEADTYDLHHPLV

SEQ ID NO: 1253900 - protein, 23 aa, Mycobacterium
LTVMPGEFVCLMGPSGSGKSTLL

SEQ ID NO: 1253901 - protein, 20 aa, Mycobacterium
LTVRSNLLFFRSRGDSGRWE

SEQ ID NO: 1253902 - protein, 19 aa, Mycobacterium
LVAAWRGEPAEAMRQIDAA

SEQ ID NO: 1253903 - protein, 17 aa, Mycobacterium
LVADIWASSMLAVAQNR

SEQ ID NO: 1253904 - protein, 17 aa, Mycobacterium
LVAEALGGGTLRTAVTD

SEQ ID NO: 1253905 - protein, 23 aa, Mycobacterium
LVAGRPSDRWGQEVVAVVALAEG

SEQ ID NO: 1253906 - protein, 26 aa, Mycobacterium
LVDAADLPGGIAIRPTLKEAVAYLEG

SEQ ID NO: 1253907 - protein, 20 aa, Mycobacterium
LVDLDNWKLLKWLDPPAPFY

SEQ ID NO: 1253908 - protein, 17 aa, Mycobacterium
LVDTCLAAKAVGAEYVK

SEQ ID NO: 1253909 - protein, 17 aa, Mycobacterium
LVEAGTRVVQYGYAGAD

SEQ ID NO: 1253910 - protein, 20 aa, Mycobacterium
LVEFARRLASTGPFREQRFV

SEQ ID NO: 1253911 - protein, 25 aa, Mycobacterium
LVERSPLPFGRHRWVASTGPVDLDI

SEQ ID NO: 1253912 - protein, 18 aa, Mycobacterium
LVESSAPRAVKERMVFVL

SEQ ID NO: 1253913 - protein, 18 aa, Mycobacterium
LVGFISAFRCPRCERDRV

SEQ ID NO: 1253914 - protein, 21 aa, Mycobacterium
LVGVCTNTLCAIMGGDEILDA

SEQ ID NO: 1253915 - protein, 18 aa, Mycobacterium
LVHTVGFGWDPRRAWRLE

SEQ ID NO: 1253916 - protein, 31 aa, Mycobacterium
LVILLHGFASFWWSWRHQLRGLGGARVVAVD

SEQ ID NO: 1253917 - protein, 17 aa, Mycobacterium
LVKLTCRGRDFSTAVSR

SEQ ID NO: 1253918 - protein, 17 aa, Mycobacterium
LVKSGGFGTLLLLGHDW

SEQ ID NO: 1253919 - protein, 24 aa, Mycobacterium
LVLRSLGSAGLRFERQCQNALAVA

SEQ ID NO: 1253920 - protein, 17 aa, Mycobacterium
LVMGGSCQRTWEHAIPK

SEQ ID NO: 1253921 - protein, 21 aa, Mycobacterium
LVPDRLAARYLLAEATAEGGE

SEQ ID NO: 1253922 - protein, 17 aa, Mycobacterium
LVRECYGAVAAAVQLVW

SEQ ID NO: 1253923 - protein, 20 aa, Mycobacterium
LVRFKQGFTAWLRAYDQQSL

SEQ ID NO: 1253924 - protein, 17 aa, Mycobacterium
LVRGGRRTFGASFDRTR

SEQ ID NO: 1253925 - protein, 17 aa, Mycobacterium
LVRGLVTVIEFSRGTLG

SEQ ID NO: 1253926 - protein, 26 aa, Mycobacterium
LVRGRLVKRNAPAAAIAEGMAMVPED

SEQ ID NO: 1253927 - protein, 18 aa, Mycobacterium
LVRYWRLLKFKLTNPHVI

SEQ ID NO: 1253928 - protein, 20 aa, Mycobacterium
LVSAHFYPQMPFTSRRPDES

SEQ ID NO: 1253929 - protein, 17 aa, Mycobacterium
LVSDGMAAVYDFSNNEV

SEQ ID NO: 1253930 - protein, 33 aa, Mycobacterium
LVSPEYLRRELLDLSAWAWDEFLTANGDPALHT

SEQ ID NO: 1253931 - protein, 24 aa, Mycobacterium
LVSRARAVGALTVLDACQSVPHQP

SEQ ID NO: 1253932 - protein, 18 aa, Mycobacterium
LVTTNFFGVNTIPIGLNE

SEQ ID NO: 1253933 - protein, 24 aa, Mycobacterium
LVVQRLSLHGGLVLDFDDYNEIVI

SEQ ID NO: 1253934 - protein, 19 aa, Mycobacterium
LVVRNRLPHAAAIAGSLAG

SEQ ID NO: 1253935 - protein, 24 aa, Mycobacterium
LVVVKLDGGQVLKTFGAGASLYAV

SEQ ID NO: 1253936 - protein, 17 aa, Mycobacterium
LVYYYFPTMDDLYVEVL

SEQ ID NO: 1253937 - protein, 17 aa, Mycobacterium
LWEGVPALLDRLYYLDT

SEQ ID NO: 1253938 - protein, 18 aa, Mycobacterium
LWRSYGVTPDAVIGHSMG

SEQ ID NO: 1253939 - protein, 18 aa, Mycobacterium
LWTACTSLAGGTPVHYLC

SEQ ID NO: 1253940 - protein, 19 aa, Mycobacterium
LYDEIPFGFAKEEFQQYAA

SEQ ID NO: 1253941 - protein, 31 aa, Mycobacterium
LYDILKSGPLAGLRLGLMHGRLSGDEKDAVM

SEQ ID NO: 1253942 - protein, 22 aa, Mycobacterium
LYELIKRGELTQVHVGRRAFIT

SEQ ID NO: 1253943 - protein, 26 aa, Mycobacterium
LYIHVPFCATRCGYCDFNTYTPAEAG

SEQ ID NO: 1253944 - protein, 19 aa, Mycobacterium
LYLATVIDCCSRRVTGWAI

SEQ ID NO: 1253945 - protein, 19 aa, Mycobacterium
LYLIHWPVPEKNLFVDTFK

SEQ ID NO: 1253946 - protein, 19 aa, Mycobacterium
LYLRRARTGLQLFGGPRLH

SEQ ID NO: 1253947 - protein, 22 aa, Mycobacterium
LYVRPIMCPHELAAGSEEVLPN

SEQ ID NO: 1253948 - protein, 17 aa, Mycobacterium
LYWIGRYVERADDTARI

SEQ ID NO: 1253949 - protein, 17 aa, Mycobacterium
MADPRWLDPSVDPNDRA

SEQ ID NO: 1253950 - protein, 18 aa, Mycobacterium
MAEIRGTDAVVCGDWNIA

SEQ ID NO: 1253951 - protein, 20 aa, Mycobacterium
MAGIKHVLGIWVQQNEGAAF

SEQ ID NO: 1253952 - protein, 24 aa, Mycobacterium
MAGLYLREMQRLGLVKRAVIVCPA

SEQ ID NO: 1253953 - protein, 24 aa, Mycobacterium
MAGSVCPVEVMKRCINEMHMTEVA

SEQ ID NO: 1253954 - protein, 24 aa, Mycobacterium
MAKADASTAWAFMATSWSTAEVLG

SEQ ID NO: 1253955 - protein, 20 aa, Mycobacterium
MAKLPGFVDTATRERIEVDL

SEQ ID NO: 1253956 - protein, 28 aa, Mycobacterium
MAKRAGLPWDCVLSAELFRHYKPDPEAY

SEQ ID NO: 1253957 - protein, 20 aa, Mycobacterium
MALAHLWAAGLPWAGDLPPV

SEQ ID NO: 1253958 - protein, 33 aa, Mycobacterium
MAMGHVILSEFFVRQRVPFFVDYVRQYTDLPFL

SEQ ID NO: 1253959 - protein, 17 aa, Mycobacterium
MAMWPGAAVSGWYFSHP

SEQ ID NO: 1253960 - protein, 24 aa, Mycobacterium
MARAMEWPDLVPGSGAVAGGTRGE

SEQ ID NO: 1253961 - protein, 17 aa, Mycobacterium
MASASAIAGRIAPVLRE

SEQ ID NO: 1253962 - protein, 19 aa, Mycobacterium
MASNLPRLAVTSLTERLRV

SEQ ID NO: 1253963 - protein, 25 aa, Mycobacterium
MAVERSCALTAVALSGRRRSGAQLV

SEQ ID NO: 1253964 - protein, 26 aa, Mycobacterium
MCPICRKEQLTLVSWVFGDHLGPVSG

SEQ ID NO: 1253965 - protein, 17 aa, Mycobacterium
MDAWQCALEDVGPAGAD

SEQ ID NO: 1253966 - protein, 37 aa, Mycobacterium
MDGDPCQLCRWWWRQGRTWPKAHPFQRHKGCNCQPRI

SEQ ID NO: 1253967 - protein, 26 aa, Mycobacterium
MDPQHRLFLQTAWHAMEDAGCDPAGF

SEQ ID NO: 1253968 - protein, 25 aa, Mycobacterium
MDPQQRLALEVSWEALEHAGVPPRS

SEQ ID NO: 1253969 - protein, 19 aa, Mycobacterium
MECYHCSSIHPELVDVLPE

SEQ ID NO: 1253970 - protein, 19 aa, Mycobacterium
MEEALKAPAGERFRVLTRQ

SEQ ID NO: 1253971 - protein, 17 aa, Mycobacterium
MEHMGWRSPRQTRLEQA

SEQ ID NO: 1253972 - protein, 23 aa, Mycobacterium
MEIGEVDAAIDWAKRATDLDEGH

SEQ ID NO: 1253973 - protein, 20 aa, Mycobacterium
MENVREGLPLAYMMDDCRER

SEQ ID NO: 1253974 - protein, 18 aa, Mycobacterium
MERELPGSIVIAGAGAIG

SEQ ID NO: 1253975 - protein, 20 aa, Mycobacterium
MFDTVRFGLNLVVAGDDGEH

SEQ ID NO: 1253976 - protein, 17 aa, Mycobacterium
MFHLRFWESSHRGGRHV

SEQ ID NO: 1253977 - protein, 19 aa, Mycobacterium
MFPQRAFHALVELIEHAAE

SEQ ID NO: 1253978 - protein, 26 aa, Mycobacterium
MGALRRAGHVVAPFKVGPDFIDPGYH

SEQ ID NO: 1253979 - protein, 21 aa, Mycobacterium
MGAYLRYKGYVYAYGTGAGRG

SEQ ID NO: 1253980 - protein, 24 aa, Mycobacterium
MGEGRWKSSRSWPPPAEPRTYYLA

SEQ ID NO: 1253981 - protein, 17 aa, Mycobacterium
MGGAQSFFDQQTVVETW

SEQ ID NO: 1253982 - protein, 24 aa, Mycobacterium
MGGGKSHACIGAFHLAANPEALLG

SEQ ID NO: 1253983 - protein, 19 aa, Mycobacterium
MGHALLVPFARAAAWPDEL

SEQ ID NO: 1253984 - protein, 28 aa, Mycobacterium
MGILREGGRMLALKGARAEAEIEENRRV

SEQ ID NO: 1253985 - protein, 21 aa, Mycobacterium
MGRNGGGWAHYVGQEKCRPVT

SEQ ID NO: 1253986 - protein, 17 aa, Mycobacterium
MHARTSGLADYFALDEL

SEQ ID NO: 1253987 - protein, 19 aa, Mycobacterium
MHDVCRRHGALLIVDEAHG

SEQ ID NO: 1253988 - protein, 19 aa, Mycobacterium
MHLCGPDIIVWSGIELLCL

SEQ ID NO: 1253989 - protein, 25 aa, Mycobacterium
MHPAVCAAVSRLSYDGRLQSNDAVT

SEQ ID NO: 1253990 - protein, 17 aa, Mycobacterium
MIERQRGDLIFVGSDVA

SEQ ID NO: 1253991 - protein, 17 aa, Mycobacterium
MIGALRAIFATWSTGEP

SEQ ID NO: 1253992 - protein, 18 aa, Mycobacterium
MIGATGRVYLSGTEADIR

SEQ ID NO: 1253993 - protein, 19 aa, Mycobacterium
MKALFGLGLHPNADRISDH

SEQ ID NO: 1253994 - protein, 23 aa, Mycobacterium
MKGLEFRCMCVAGVTAKWVPALN

SEQ ID NO: 1253995 - protein, 18 aa, Mycobacterium
MKLARNMLTFTGFAAACE

SEQ ID NO: 1253996 - protein, 18 aa, Mycobacterium
MKRAWGPVRVAIAAEQAK

SEQ ID NO: 1253997 - protein, 23 aa, Mycobacterium
MKYAEPFAWVAERVRPHREKLVQ

SEQ ID NO: 1253998 - protein, 19 aa, Mycobacterium
MLDALWPFVEELERRVSDG

SEQ ID NO: 1253999 - protein, 25 aa, Mycobacterium
MLKAEANVALSRWGMLAPDGQCKTF

SEQ ID NO: 1254000 - protein, 18 aa, Mycobacterium
MLLEFGIVSRRYRHAVGE

SEQ ID NO: 1254001 - protein, 25 aa, Mycobacterium
MLLSEHIRLVAAFDHRHVFLDPDPD

SEQ ID NO: 1254002 - protein, 24 aa, Mycobacterium
MLNDPELQAAIGLFSTPEELQSQW

SEQ ID NO: 1254003 - protein, 31 aa, Mycobacterium
MLRERWSNQAAREWKELPARELADTTMTVLG

SEQ ID NO: 1254004 - protein, 26 aa, Mycobacterium
MLRMLRPDLTIGFFLHIPFPPVELFM

SEQ ID NO: 1254005 - protein, 27 aa, Mycobacterium
MLRMLRPDLTIGFFLHIPFPPVELFMQ

SEQ ID NO: 1254006 - protein, 20 aa, Mycobacterium
MLTELGVPPGRLRMLRSFDP

SEQ ID NO: 1254007 - protein, 22 aa, Mycobacterium
MLVVAAGIRPNVGLAQRAGLTV

SEQ ID NO: 1254008 - protein, 34 aa, Mycobacterium
MNAGGILGSMCFPSFPGFAGRLFATEDAEFSLAL

SEQ ID NO: 1254009 - protein, 20 aa, Mycobacterium
MNARQSLSFVTLARVIGDIG

SEQ ID NO: 1254010 - protein, 21 aa, Mycobacterium
MNEIRWDIRPSPHLGTVEIRV

SEQ ID NO: 1254011 - protein, 23 aa, Mycobacterium
MNLAVVLRTTWAVAKVLKDRGRA

SEQ ID NO: 1254012 - protein, 17 aa, Mycobacterium
MPADGPWTVTVPGATWG

SEQ ID NO: 1254013 - protein, 19 aa, Mycobacterium
MPAMLAAFHRAHPAVEITL

SEQ ID NO: 1254014 - protein, 20 aa, Mycobacterium
MPDIPGVDSFAGTTMHTARW

SEQ ID NO: 1254015 - protein, 22 aa, Mycobacterium
MPDRVLAAAVAFQAACEPRPYR

SEQ ID NO: 1254016 - protein, 18 aa, Mycobacterium
MPFFDTRDGPVVIEIPPA

SEQ ID NO: 1254017 - protein, 20 aa, Mycobacterium
MPHRGRLNVLANIVGKPYSQ

SEQ ID NO: 1254018 - protein, 18 aa, Mycobacterium
MPIVKDAPIRDWVKLAVT

SEQ ID NO: 1254019 - protein, 18 aa, Mycobacterium
MPLRRFVFTSSYVTVGRR

SEQ ID NO: 1254020 - protein, 19 aa, Mycobacterium
MPMNLPVVGGHEGAGVVAE

SEQ ID NO: 1254021 - protein, 18 aa, Mycobacterium
MPYVLKLADKGWRAACQA

SEQ ID NO: 1254022 - protein, 28 aa, Mycobacterium
MQKALKYEGVDVITIFKGLQLDIGAPPQ

SEQ ID NO: 1254023 - protein, 22 aa, Mycobacterium
MRARIGDAPVYVSVDIDVLDPA

SEQ ID NO: 1254024 - protein, 21 aa, Mycobacterium
MREVQPELNLLVSPTADNLAF

SEQ ID NO: 1254025 - protein, 19 aa, Mycobacterium
MRGPLLPPTVPGWRSRAER

SEQ ID NO: 1254026 - protein, 17 aa, Mycobacterium
MRLDLRMSQRDSAAPAP

SEQ ID NO: 1254027 - protein, 23 aa, Mycobacterium
MRLPAGRKHWYASVIRHTGCRSG

SEQ ID NO: 1254028 - protein, 23 aa, Mycobacterium
MRMPAYGGSLLDPARFPWLTATD

SEQ ID NO: 1254029 - protein, 17 aa, Mycobacterium
MRPRIGDIVVAARDSAA

SEQ ID NO: 1254030 - protein, 20 aa, Mycobacterium
MRQLRSWVRRGVDYARALPP

SEQ ID NO: 1254031 - protein, 17 aa, Mycobacterium
MRQWQFGEFRGEDAGTP

SEQ ID NO: 1254032 - protein, 21 aa, Mycobacterium
MRRLRAANLAGLTGRVLEIGA

SEQ ID NO: 1254033 - protein, 17 aa, Mycobacterium
MRRRLWAEFSGPAVELF

SEQ ID NO: 1254034 - protein, 17 aa, Mycobacterium
MRRVAPIWWNEQPIGAG

SEQ ID NO: 1254035 - protein, 30 aa, Mycobacterium
MRRVGPKGSGAFERISWDEALAEIKQRWTA

SEQ ID NO: 1254036 - protein, 17 aa, Mycobacterium
MRTAVNLLLDRLPNLRM

SEQ ID NO: 1254037 - protein, 18 aa, Mycobacterium
MRTLLSMQHRILGRTRRL

SEQ ID NO: 1254038 - protein, 23 aa, Mycobacterium
MRVVGRGGAVLGEVWGERPSAYL

SEQ ID NO: 1254039 - protein, 17 aa, Mycobacterium
MSDDDWTKMARRMGEIT

SEQ ID NO: 1254040 - protein, 20 aa, Mycobacterium
MSGALKHFFDTVYYPSLDHV

SEQ ID NO: 1254041 - protein, 17 aa, Mycobacterium
MSHLDAPTVIRVKRDGG

SEQ ID NO: 1254042 - protein, 18 aa, Mycobacterium
MSNFLRTAATAVRGEAPK

SEQ ID NO: 1254043 - protein, 21 aa, Mycobacterium
MSRVSGWLTPEARAHWDVIAA

SEQ ID NO: 1254044 - protein, 23 aa, Mycobacterium
MSTELMTRWSSRRTAIKARTAEL

SEQ ID NO: 1254045 - protein, 20 aa, Mycobacterium
MSVICPNTRLVLGGFSQGAM

SEQ ID NO: 1254046 - protein, 18 aa, Mycobacterium
MTERLGDVGYPFSVQLPR

SEQ ID NO: 1254047 - protein, 20 aa, Mycobacterium
MTRSLSLLSTLPWPKENIDK

SEQ ID NO: 1254048 - protein, 17 aa, Mycobacterium
MTSAALQVAERIAANTV

SEQ ID NO: 1254049 - protein, 21 aa, Mycobacterium
MTTTLAVEWAPKVRVNSVVVG

SEQ ID NO: 1254050 - protein, 18 aa, Mycobacterium
MTVSRGELLIGIDGRSEL

SEQ ID NO: 1254051 - protein, 17 aa, Mycobacterium
MTWRGGYHGDTFTPMSV

SEQ ID NO: 1254052 - protein, 27 aa, Mycobacterium
MVNSLGGRGVFAVELLVRGDEVYFSDV

SEQ ID NO: 1254053 - protein, 20 aa, Mycobacterium
MVRDRLEAIASEYEGVSARG

SEQ ID NO: 1254054 - protein, 17 aa, Mycobacterium
MVTRILALQAKPTPADA

SEQ ID NO: 1254055 - protein, 22 aa, Mycobacterium
MVVRLLAFGLRAHRLGDVDGEL

SEQ ID NO: 1254056 - protein, 22 aa, Mycobacterium
MVVRRTTPLTSFSALIDHAVWF

SEQ ID NO: 1254057 - protein, 19 aa, Mycobacterium
MWAASGVDYPTLLAAMVDT

SEQ ID NO: 1254058 - protein, 20 aa, Mycobacterium
MWFAIPGMYGGFHVTLRQGY

SEQ ID NO: 1254059 - protein, 19 aa, Mycobacterium
NAAALRPGDTLYRDVPVQY

SEQ ID NO: 1254060 - protein, 19 aa, Mycobacterium
NAAIAALVLPSSFRPIPDP

SEQ ID NO: 1254061 - protein, 21 aa, Mycobacterium
NAGARIGLLASDAVKSVDTAR

SEQ ID NO: 1254062 - protein, 18 aa, Mycobacterium
NAQDLVWDRMVRIVERAG

SEQ ID NO: 1254063 - protein, 20 aa, Mycobacterium
NARAVRWETLANLVPTDIAG

SEQ ID NO: 1254064 - protein, 19 aa, Mycobacterium
NARFPNSMVDRITPVTTPE

SEQ ID NO: 1254065 - protein, 25 aa, Mycobacterium
NARGGRLSRQSAWQVLQDAAERAGI

SEQ ID NO: 1254066 - protein, 22 aa, Mycobacterium
NARRLEVAFTRRDGVAEIAAVI

SEQ ID NO: 1254067 - protein, 24 aa, Mycobacterium
NAVESMDFGFFWATGVTKDGTILV

SEQ ID NO: 1254068 - protein, 20 aa, Mycobacterium
NAVGGGWFGYLSYPDPGADG

SEQ ID NO: 1254069 - protein, 19 aa, Mycobacterium
NAVRLLEQWLAHSALLRSH

SEQ ID NO: 1254070 - protein, 22 aa, Mycobacterium
NCDKGRWAFTYTDVGDRIATPL

SEQ ID NO: 1254071 - protein, 17 aa, Mycobacterium
NCWYPPRTLRAVVETLA

SEQ ID NO: 1254072 - protein, 25 aa, Mycobacterium
NDCTRVWRDGRVEQLGWPRVRIHYT

SEQ ID NO: 1254073 - protein, 17 aa, Mycobacterium
NDFLGWSDMVARQEDTR

SEQ ID NO: 1254074 - protein, 26 aa, Mycobacterium
NDIPYLCTLREGLLYALVPDRSGFEA

SEQ ID NO: 1254075 - protein, 20 aa, Mycobacterium
NDPRLGRILFVESATEPLLR

SEQ ID NO: 1254076 - protein, 26 aa, Mycobacterium
NDTQLRWRPIDFWPANTTVNIDASGT

SEQ ID NO: 1254077 - protein, 25 aa, Mycobacterium
NEALRRAGLDPADWDVTGITARTNS

SEQ ID NO: 1254078 - protein, 18 aa, Mycobacterium
NEFKDPSGKIVGFDVDLM

SEQ ID NO: 1254079 - protein, 24 aa, Mycobacterium
NEILEYHWGRHWVVWDAEDTFQQR

SEQ ID NO: 1254080 - protein, 21 aa, Mycobacterium
NEILRRAAAYLSQANLPGKGS

SEQ ID NO: 1254081 - protein, 17 aa, Mycobacterium
NEINAIANFCFLTQDAN

SEQ ID NO: 1254082 - protein, 27 aa, Mycobacterium
NEQSAKLCVQYLAPIIKNRQYNFPPIG

SEQ ID NO: 1254083 - protein, 31 aa, Mycobacterium
NERELRKLLADSMIRPHIGEVYALEDVTAAL

SEQ ID NO: 1254084 - protein, 19 aa, Mycobacterium
NEVGVLLARPRGPVDPTAS

SEQ ID NO: 1254085 - protein, 21 aa, Mycobacterium
NEVLRRAAAYLSQANLPGKGS

SEQ ID NO: 1254086 - protein, 25 aa, Mycobacterium
NFALPVPRPAGYVIVGDTASLPAIN

SEQ ID NO: 1254087 - protein, 20 aa, Mycobacterium
NFPGLSWPITLGHEIAGTVA

SEQ ID NO: 1254088 - protein, 19 aa, Mycobacterium
NFPYRYPWRDVERQLQRMA

SEQ ID NO: 1254089 - protein, 19 aa, Mycobacterium
NGAVLPILALYVVAAEEQG

SEQ ID NO: 1254090 - protein, 19 aa, Mycobacterium
NGAVLPILALYVVAAEEQR

SEQ ID NO: 1254091 - protein, 25 aa, Mycobacterium
NGAYWAAQACGRVMGPGSSIVNISS

SEQ ID NO: 1254092 - protein, 24 aa, Mycobacterium
NGCMATSGSLIRWFQTLIGGVDLL

SEQ ID NO: 1254093 - protein, 24 aa, Mycobacterium
NGELPAVRVGRSFRVHAKAVHDML

SEQ ID NO: 1254094 - protein, 18 aa, Mycobacterium
NGGTWRSALAVPVVVTQS

SEQ ID NO: 1254095 - protein, 26 aa, Mycobacterium
NGLFGGYREMVGWGRGRTPGALLDRN

SEQ ID NO: 1254096 - protein, 26 aa, Mycobacterium
NGQTLFEICARLTTKHGLGSSRQAIS

SEQ ID NO: 1254097 - protein, 30 aa, Mycobacterium
NGVAAALCFPSYPQFCGQYFARARDKDLVL

SEQ ID NO: 1254098 - protein, 19 aa, Mycobacterium
NGVPLRPTPLVAEVSALVD

SEQ ID NO: 1254099 - protein, 18 aa, Mycobacterium
NGYCGLPVQQSCPHANAC

SEQ ID NO: 1254100 - protein, 25 aa, Mycobacterium
NHARKVFRETVEWVLTERAVSRIGR

SEQ ID NO: 1254101 - protein, 22 aa, Mycobacterium
NHFHLRRVGGVWQIAARTTRLL

SEQ ID NO: 1254102 - protein, 21 aa, Mycobacterium
NHQCQLRFPGICTGHATEVDH

SEQ ID NO: 1254103 - protein, 24 aa, Mycobacterium
NIDEWKLKSSTAILDLKVADIAAG

SEQ ID NO: 1254104 - protein, 17 aa, Mycobacterium
NILCLDVARGIRRAHAH

SEQ ID NO: 1254105 - protein, 24 aa, Mycobacterium
NIQHADLLVVRRGEKVTVEVNVVV

SEQ ID NO: 1254106 - protein, 26 aa, Mycobacterium
NKRLYDALDQWAFCTLTRSPGARAYY

SEQ ID NO: 1254107 - protein, 19 aa, Mycobacterium
NLAPSMTIGTGFVGRSSIG

SEQ ID NO: 1254108 - protein, 20 aa, Mycobacterium
NLAPSMTIGTGFVGRSSIGE

SEQ ID NO: 1254109 - protein, 25 aa, Mycobacterium
NLARRELAEALTVLTRRLPAPRRVG

SEQ ID NO: 1254110 - protein, 22 aa, Mycobacterium
NLDELRMLVAGFLMAGTDTTRN

SEQ ID NO: 1254111 - protein, 19 aa, Mycobacterium
NLDEVRLITGIDVTDAASQ

SEQ ID NO: 1254112 - protein, 24 aa, Mycobacterium
NLDKLSLPFTERWSTQGRQKYFKD

SEQ ID NO: 1254113 - protein, 18 aa, Mycobacterium
NLLADKIFIPAPKIKSGS

SEQ ID NO: 1254114 - protein, 21 aa, Mycobacterium
NLLRVTLPWWPRGLRERDAML

SEQ ID NO: 1254115 - protein, 18 aa, Mycobacterium
NLLSRTALMQGFNALDQW

SEQ ID NO: 1254116 - protein, 21 aa, Mycobacterium
NLPKIKSVALPVAIETVNRIF

SEQ ID NO: 1254117 - protein, 19 aa, Mycobacterium
NLRVARALYDFITDEALAG

SEQ ID NO: 1254118 - protein, 26 aa, Mycobacterium
NLSEGWWPFLVGLSMGDAGGYKSEPM

SEQ ID NO: 1254119 - protein, 17 aa, Mycobacterium
NLSGTKPLHEWLEALRT

SEQ ID NO: 1254120 - protein, 17 aa, Mycobacterium
NLVNARYLRICVLTQYK

SEQ ID NO: 1254121 - protein, 19 aa, Mycobacterium
NLVRARSGVNWQATEDFSE

SEQ ID NO: 1254122 - protein, 27 aa, Mycobacterium
NMLAEPLLRRIDVLAAQGHPGAQQLAT

SEQ ID NO: 1254123 - protein, 17 aa, Mycobacterium
NNIQLHGGIAFTWEHDA

SEQ ID NO: 1254124 - protein, 32 aa, Mycobacterium
NPAILEAWTWPQHGRVLLGWYERFRDASGALD

SEQ ID NO: 1254125 - protein, 23 aa, Mycobacterium
NPDRFRFLATYIAGRSVDVTEAA

SEQ ID NO: 1254126 - protein, 20 aa, Mycobacterium
NPELKDILPRGYQKLERSTL
